United States Patent 8,461,315 (MICRORNAS AND USES THEREOF) - sequence listing, part 20

SEQ ID NO: 560514 - RNA, 64 nt, Homo Sapiens
ugaccagugguuucugcucgcagggagaaagucccgaggaaauggggcccagagcaaagggcau

SEQ ID NO: 560515 - RNA, 64 nt, Homo Sapiens
ggggugacucauuucccuugcaccagcugagguccgaggaaagcuuuggccagccacuaagucc

SEQ ID NO: 560516 - RNA, 64 nt, Homo Sapiens
uuagaaacaggcagaguugguuaaagugaggggccgaggaaaacugugcuuugugaacucugcu

SEQ ID NO: 560517 - RNA, 64 nt, Homo Sapiens
ccgagauagguacuguuaccauccucucugcagacgaggaaaccgaggaccaggagguucagua

SEQ ID NO: 560518 - RNA, 64 nt, Homo Sapiens
guacagggucugaguucugaagcauccgagcuggcgaggaaacagcugcggggucaggggcucc

SEQ ID NO: 560519 - RNA, 64 nt, Homo Sapiens
aagaccauggaagaaaagaaggaaugccaaagaucgaggaaaucuaccaagacuaguaggguag

SEQ ID NO: 560520 - RNA, 50 nt, Homo Sapiens
uggccgaaauguuauuuuaacgaggaaagaccacagcaagauucuuucau

SEQ ID NO: 560521 - RNA, 64 nt, Homo Sapiens
acauuugugucacuguacaguuuuguggacugagcgaggaaaaacaacaaauaauuuaaguugg

SEQ ID NO: 560522 - RNA, 64 nt, Homo Sapiens
auuuuaccaaagcaucaauaaauaaggcccagagcgaggaaaggggaccacugggugagagagg

SEQ ID NO: 560523 - RNA, 64 nt, Homo Sapiens
ucuuuuauuuguugacucuagcucccuucaaagucgaggaaagaucuuuacucacuuaaugagg

SEQ ID NO: 560524 - RNA, 64 nt, Homo Sapiens
agaucuccggauugucgggggacgcaggacucuucgaggaaaaccagccgaaugagaucaaaag

SEQ ID NO: 560525 - RNA, 64 nt, Homo Sapiens
uagucgauucucagauuaccaaggaugcaauccucgaggaaaaucuccggcggcccaggauucu

SEQ ID NO: 560526 - RNA, 64 nt, Homo Sapiens
ccauggcugcuuugugucacccccauaaaaaaggcgaggaaaacaggauugaaaggugcauuuu

SEQ ID NO: 560527 - RNA, 64 nt, Homo Sapiens
gaaagagucucagaguggaauguaucuggauacacgaggaaaaguaaaaucauccguaugucag

SEQ ID NO: 560528 - RNA, 64 nt, Homo Sapiens
agucugcccacauguaauuaccggcuaauucaagcgaggaaaaauguaagucauuuagaccaaa

SEQ ID NO: 560529 - RNA, 64 nt, Homo Sapiens
caggggaaguagagguggccgagguuggggcacacgaggaaaucguagucggggaagacucuac

SEQ ID NO: 560530 - RNA, 64 nt, Homo Sapiens
ccccuccucacucccuucccauaagcuauagacccgaggaaacucagagucggaacggagaaag

SEQ ID NO: 560531 - RNA, 64 nt, Homo Sapiens
cuggcgagcguggcccuguaggguucagcgugggcgaggaaagcagcugcugugcccaggacgu

SEQ ID NO: 560532 - RNA, 64 nt, Homo Sapiens
aaaagaaaagauacgugccugcgagacuccgucucgaggaaaaaacuccagccugggcaacaca

SEQ ID NO: 560533 - RNA, 64 nt, Homo Sapiens
uuggcccuucucaaacagaucgcagccugagcuccgaggaaaaacugaguauaugaguagugcc

SEQ ID NO: 560534 - RNA, 64 nt, Homo Sapiens
agggccugcuggcugagauaaaccucgaagcgcccgaggaaacgcugagcgucccaggcauaga

SEQ ID NO: 560535 - RNA, 64 nt, Homo Sapiens
auuccugagacauggaguaaguacucucgggacucgaggaaauuggugaugaaacugagguuca

SEQ ID NO: 560536 - RNA, 64 nt, Homo Sapiens
cuuacaguuugaauuaugacaguuugguauggugcgaggaaaaugaauaaaaaagcuuucuaug

SEQ ID NO: 560537 - RNA, 64 nt, Homo Sapiens
guccuugccuccuggaagaacugauaagaauaaacgaggaaaaguaccuugaauagaaguuuuc

SEQ ID NO: 560538 - RNA, 64 nt, Homo Sapiens
agccagagaauagaucaguauuucacugauaccacgaggaaaagaacaaacaaaacuuaaaagu

SEQ ID NO: 560539 - RNA, 64 nt, Homo Sapiens
aaucgaucuacacacauccacgcacaugcgaccccgaggaaacgaaacccacucuagaaaacgc

SEQ ID NO: 560540 - RNA, 59 nt, Homo Sapiens
agaaaauguuuaccucaugauaucccagccgaggaaaaagauccacuggaaacuaggcc

SEQ ID NO: 560541 - RNA, 59 nt, Homo Sapiens
agaccucuuucguuccuucuugcaccaggcgaggaaacgcacaggaaacuucgcaguga

SEQ ID NO: 560542 - RNA, 64 nt, Homo Sapiens
agguggcuagugguaucagugcaaaugcauacaacgaggaaaggcucauugcuuugcuuauuua

SEQ ID NO: 560543 - RNA, 64 nt, Homo Sapiens
ggaggccauuuuucagucaaagugucucaggcagcgaggaaauuacuuuguggaggaggcacca

SEQ ID NO: 560544 - RNA, 64 nt, Homo Sapiens
gggacccucaauuaugcagauuccauuuuagagacgaggaaacucacaaccuuaugagguagaa

SEQ ID NO: 560545 - RNA, 61 nt, Homo Sapiens
gagacaaccuuucugucuucugucccuggugcgaggaaacauucaccaggucaccaaguaa

SEQ ID NO: 560546 - RNA, 64 nt, Homo Sapiens
ccuuugcaggugaggggacacccauaugagaugacgaggaaaccccacacaggugccaggagug

SEQ ID NO: 560547 - RNA, 64 nt, Homo Sapiens
caccagaccacagaggauggagccugggaagcagcgaggaaaucacagcccccucgccccugcc

SEQ ID NO: 560548 - RNA, 64 nt, Homo Sapiens
agagaaacucuuugggcuguuugcaagaaaaaagcgaggaaauccaccugggccaucuugguuu

SEQ ID NO: 560549 - RNA, 64 nt, Homo Sapiens
uuguuucauuuacuccaaaggauccugaagccugcgaggaaaggaucuugaaaauauuugugca

SEQ ID NO: 560550 - RNA, 58 nt, Homo Sapiens
cugguggcggcggcguguaacaccuucccgaggaaacuccgcugccgacccugccuga

SEQ ID NO: 560551 - RNA, 64 nt, Homo Sapiens
aaaugccuuuguccuuuguauaaucagcaggcuccgaggaaaaaguuucuucuuuugugggcau

SEQ ID NO: 560552 - RNA, 64 nt, Homo Sapiens
gauccuucauguuucaauaggguucccagagcuccgaggaaacuucucuccuuugggacccccg

SEQ ID NO: 560553 - RNA, 64 nt, Homo Sapiens
cacuccuacacgcuaucccugccagcuguggcuccgaggaaaaucauccacaccagcuccccau

SEQ ID NO: 560554 - RNA, 64 nt, Homo Sapiens
acuaagaaaaaaagcacaaaguucucagagcucucgaggaaagugguuguccccguaccaccau

SEQ ID NO: 560555 - RNA, 64 nt, Homo Sapiens
cuucuucgacucagauucagaaaugaucuaaacacgaggaaacauuauucauuggaaaagugca

SEQ ID NO: 560556 - RNA, 64 nt, Homo Sapiens
ucugagaaacuucacucuuuucacuuaugcaucacgaggaaauaacuaaaauacauaccaagag

SEQ ID NO: 560557 - RNA, 64 nt, Homo Sapiens
agagggacucuggcgucccgcaggaagagagcaacgaggaaagggcccggagaguaguccgcgc

SEQ ID NO: 560558 - RNA, 64 nt, Homo Sapiens
cagagguuuauuuuaucugccucaugaauacacacgaggaaaagaaaaaccaauaagcugguga

SEQ ID NO: 560559 - RNA, 64 nt, Homo Sapiens
acucugcuuuguccgacauuugcaaagagguacacgaggaaauggaauugguauuucauuuuaa

SEQ ID NO: 560560 - RNA, 64 nt, Homo Sapiens
gagaaccuguucagauacaggccaguuucuucuucgaggaaagccaagcuccucaaacaggguu

SEQ ID NO: 560561 - RNA, 64 nt, Homo Sapiens
ucggcucgguacucaacacaacccaaguuucauccgaggaaauguccccgcaguggaugcagcu

SEQ ID NO: 560562 - RNA, 64 nt, Homo Sapiens
ucuuuagagcacagggacagaaauaaugugaaugcgaggaaaugggcaauuuuuguauccaagg

SEQ ID NO: 560563 - RNA, 64 nt, Homo Sapiens
cagcagcaaggcgcccaugccacacaccgucucucgaggaaacgcgguucagcgauucuuugac

SEQ ID NO: 560564 - RNA, 64 nt, Homo Sapiens
ucagauuucauuuucuacccguaacacacuggaccgaggaaaagggcugguccaugucuauaga

SEQ ID NO: 560565 - RNA, 64 nt, Homo Sapiens
cuguuaaaaaacaugcauuagaaucucuagaacacgaggaaaaacagggucuuguacauauguu

SEQ ID NO: 560566 - RNA, 64 nt, Homo Sapiens
ucuccuaagagccuucaugcacaccccugaaccacgaggaaacaguacagucgcuagucaagug

SEQ ID NO: 560567 - RNA, 64 nt, Homo Sapiens
cgggcucugagccacgcccucaggauacgcccgagcggaagaagcaccggacaaggguuccucc

SEQ ID NO: 560568 - RNA, 64 nt, Homo Sapiens
gcaagucagaguggcuggcaagccauacacugaggcggaagaucuuaauuacccagguguagga

SEQ ID NO: 560569 - RNA, 64 nt, Homo Sapiens; identical to SEQ ID NO: 95053

SEQ ID NO: 560570 - RNA, 64 nt, Homo Sapiens; identical to SEQ ID NO: 95054

SEQ ID NO: 560571 - RNA, 64 nt, Homo Sapiens; identical to SEQ ID NO: 95055

SEQ ID NO: 560572 - RNA, 64 nt, Homo Sapiens; identical to SEQ ID NO: 95056

SEQ ID NO: 560573 - RNA, 64 nt, Homo Sapiens; identical to SEQ ID NO: 95057

SEQ ID NO: 560574 - RNA, 64 nt, Homo Sapiens; identical to SEQ ID NO: 95058

SEQ ID NO: 560575 - RNA, 64 nt, Homo Sapiens; identical to SEQ ID NO: 95059

SEQ ID NO: 560576 - RNA, 64 nt, Homo Sapiens; identical to SEQ ID NO: 95060

SEQ ID NO: 560577 - RNA, 64 nt, Homo Sapiens; identical to SEQ ID NO: 95061

SEQ ID NO: 560578 - RNA, 64 nt, Homo Sapiens; identical to SEQ ID NO: 95062

SEQ ID NO: 560579 - RNA, 64 nt, Homo Sapiens; identical to SEQ ID NO: 95063

SEQ ID NO: 560580 - RNA, 64 nt, Homo Sapiens; identical to SEQ ID NO: 95064

SEQ ID NO: 560581 - RNA, 64 nt, Homo Sapiens; identical to SEQ ID NO: 95065

SEQ ID NO: 560582 - RNA, 64 nt, Homo Sapiens; identical to SEQ ID NO: 95066

SEQ ID NO: 560583 - RNA, 64 nt, Homo Sapiens; identical to SEQ ID NO: 95067

SEQ ID NO: 560584 - RNA, 64 nt, Homo Sapiens; identical to SEQ ID NO: 95068

SEQ ID NO: 560585 - RNA, 64 nt, Homo Sapiens; identical to SEQ ID NO: 95069

SEQ ID NO: 560586 - RNA, 64 nt, Homo Sapiens; identical to SEQ ID NO: 95070

SEQ ID NO: 560587 - RNA, 64 nt, Homo Sapiens; identical to SEQ ID NO: 95071

SEQ ID NO: 560588 - RNA, 64 nt, Homo Sapiens; identical to SEQ ID NO: 95072

SEQ ID NO: 560589 - RNA, 64 nt, Homo Sapiens; identical to SEQ ID NO: 95073

SEQ ID NO: 560590 - RNA, 64 nt, Homo Sapiens; identical to SEQ ID NO: 95074

SEQ ID NO: 560591 - RNA, 64 nt, Homo Sapiens; identical to SEQ ID NO: 95075

SEQ ID NO: 560592 - RNA, 64 nt, Homo Sapiens; identical to SEQ ID NO: 95076

SEQ ID NO: 560593 - RNA, 64 nt, Homo Sapiens; identical to SEQ ID NO: 95077

SEQ ID NO: 560594 - RNA, 64 nt, Homo Sapiens; identical to SEQ ID NO: 95078

SEQ ID NO: 560595 - RNA, 64 nt, Homo Sapiens; identical to SEQ ID NO: 95079

SEQ ID NO: 560596 - RNA, 64 nt, Homo Sapiens; identical to SEQ ID NO: 173420

SEQ ID NO: 560597 - RNA, 64 nt, Homo Sapiens; identical to SEQ ID NO: 173421

SEQ ID NO: 560598 - RNA, 64 nt, Homo Sapiens; identical to SEQ ID NO: 173422

SEQ ID NO: 560599 - RNA, 64 nt, Homo Sapiens; identical to SEQ ID NO: 173423

SEQ ID NO: 560600 - RNA, 64 nt, Homo Sapiens; identical to SEQ ID NO: 173424

SEQ ID NO: 560601 - RNA, 64 nt, Homo Sapiens; identical to SEQ ID NO: 173425

SEQ ID NO: 560602 - RNA, 64 nt, Homo Sapiens; identical to SEQ ID NO: 173426

SEQ ID NO: 560603 - RNA, 64 nt, Homo Sapiens; identical to SEQ ID NO: 173427

SEQ ID NO: 560604 - RNA, 64 nt, Homo Sapiens; identical to SEQ ID NO: 173428

SEQ ID NO: 560605 - RNA, 64 nt, Homo Sapiens; identical to SEQ ID NO: 173429

SEQ ID NO: 560606 - RNA, 64 nt, Homo Sapiens; identical to SEQ ID NO: 121134

SEQ ID NO: 560607 - RNA, 64 nt, Homo Sapiens; identical to SEQ ID NO: 121135

SEQ ID NO: 560608 - RNA, 64 nt, Homo Sapiens; identical to SEQ ID NO: 121136

SEQ ID NO: 560609 - RNA, 64 nt, Homo Sapiens; identical to SEQ ID NO: 121137

SEQ ID NO: 560610 - RNA, 64 nt, Homo Sapiens; identical to SEQ ID NO: 121138

SEQ ID NO: 560611 - RNA, 64 nt, Homo Sapiens; identical to SEQ ID NO: 121139

SEQ ID NO: 560612 - RNA, 64 nt, Homo Sapiens; identical to SEQ ID NO: 121140

SEQ ID NO: 560613 - RNA, 64 nt, Homo Sapiens; identical to SEQ ID NO: 121141

SEQ ID NO: 560614 - RNA, 64 nt, Homo Sapiens; identical to SEQ ID NO: 121142

SEQ ID NO: 560615 - RNA, 64 nt, Homo Sapiens; identical to SEQ ID NO: 121143

SEQ ID NO: 560616 - RNA, 64 nt, Homo Sapiens; identical to SEQ ID NO: 121144

SEQ ID NO: 560617 - RNA, 64 nt, Homo Sapiens; identical to SEQ ID NO: 121145

SEQ ID NO: 560618 - RNA, 64 nt, Homo Sapiens; identical to SEQ ID NO: 121146

SEQ ID NO: 560619 - RNA, 64 nt, Homo Sapiens; identical to SEQ ID NO: 121147

SEQ ID NO: 560620 - RNA, 64 nt, Homo Sapiens; identical to SEQ ID NO: 221675

SEQ ID NO: 560621 - RNA, 64 nt, Homo Sapiens; identical to SEQ ID NO: 221676

SEQ ID NO: 560622 - RNA, 64 nt, Homo Sapiens; identical to SEQ ID NO: 221677

SEQ ID NO: 560623 - RNA, 64 nt, Homo Sapiens; identical to SEQ ID NO: 221678

SEQ ID NO: 560624 - RNA, 64 nt, Homo Sapiens; identical to SEQ ID NO: 221679

SEQ ID NO: 560625 - RNA, 64 nt, Homo Sapiens; identical to SEQ ID NO: 221680

SEQ ID NO: 560626 - RNA, 64 nt, Homo Sapiens; identical to SEQ ID NO: 221681

SEQ ID NO: 560627 - RNA, 64 nt, Homo Sapiens; identical to SEQ ID NO: 221682

SEQ ID NO: 560628 - RNA, 64 nt, Homo Sapiens; identical to SEQ ID NO: 221683

SEQ ID NO: 560629 - RNA, 64 nt, Homo Sapiens; identical to SEQ ID NO: 221684

SEQ ID NO: 560630 - RNA, 64 nt, Homo Sapiens; identical to SEQ ID NO: 221685

SEQ ID NO: 560631 - RNA, 64 nt, Homo Sapiens; identical to SEQ ID NO: 221686

SEQ ID NO: 560632 - RNA, 64 nt, Homo Sapiens; identical to SEQ ID NO: 221687

SEQ ID NO: 560633 - RNA, 64 nt, Homo Sapiens; identical to SEQ ID NO: 221688

SEQ ID NO: 560634 - RNA, 64 nt, Homo Sapiens; identical to SEQ ID NO: 221689

SEQ ID NO: 560635 - RNA, 64 nt, Homo Sapiens; identical to SEQ ID NO: 221690

SEQ ID NO: 560636 - RNA, 64 nt, Homo Sapiens; identical to SEQ ID NO: 221691

SEQ ID NO: 560637 - RNA, 64 nt, Homo Sapiens; identical to SEQ ID NO: 221692

SEQ ID NO: 560638 - RNA, 64 nt, Homo Sapiens; identical to SEQ ID NO: 221693

SEQ ID NO: 560639 - RNA, 64 nt, Homo Sapiens; identical to SEQ ID NO: 221694

SEQ ID NO: 560640 - RNA, 64 nt, Homo Sapiens; identical to SEQ ID NO: 221695

SEQ ID NO: 560641 - RNA, 64 nt, Homo Sapiens; identical to SEQ ID NO: 221696

SEQ ID NO: 560642 - RNA, 64 nt, Homo Sapiens; identical to SEQ ID NO: 221697

SEQ ID NO: 560643 - RNA, 64 nt, Homo Sapiens; identical to SEQ ID NO: 221698

SEQ ID NO: 560644 - RNA, 64 nt, Homo Sapiens; identical to SEQ ID NO: 221699

SEQ ID NO: 560645 - RNA, 64 nt, Homo Sapiens; identical to SEQ ID NO: 221700

SEQ ID NO: 560646 - RNA, 64 nt, Homo Sapiens; identical to SEQ ID NO: 221701

SEQ ID NO: 560647 - RNA, 64 nt, Homo Sapiens; identical to SEQ ID NO: 221702

SEQ ID NO: 560648 - RNA, 64 nt, Homo Sapiens
guuuccguggguucugucauaggugcaguaaguacccgacuaaaacauaugacaauaagccacg

SEQ ID NO: 560649 - RNA, 64 nt, Homo Sapiens
uggcauuacaggcgugcagcuccugccucaaccucccgacuagccuccugggcucaagcgaucc

SEQ ID NO: 560650 - RNA, 64 nt, Homo Sapiens
uggaaggcuggccaggcaccagaaacagcuccuccccgacuagggcccccuggcggccaggaag

SEQ ID NO: 560651 - RNA, 64 nt, Homo Sapiens
ugagguuggagagaaagaacagaccagcgcccuucccgacuacauccgaaacuucacacagggu

SEQ ID NO: 560652 - RNA, 64 nt, Homo Sapiens
uauuuuuuaagaugaaucagaauguuccucccuccccgacuaccuucucugacugucuuccagu

SEQ ID NO: 560653 - RNA, 55 nt, Homo Sapiens
caagugcagacaagucaugagagaccccgacuacuccucagccacaucgcaccaa

SEQ ID NO: 560654 - RNA, 64 nt, Homo Sapiens
gaucacucuguucauaagaaucauugacauguuacccgacuaaggagaggcacagagugcacug

SEQ ID NO: 560655 - RNA, 64 nt, Homo Sapiens
guugcugguagagccugggcugucugagaccuaucccgacuaucuguuauccauccugaguuug

SEQ ID NO: 560656 - RNA, 64 nt, Homo Sapiens
uuuuucuauuugaacuucaguucuguccuugaaucccgacuagauauuucuugcccucuggucu

SEQ ID NO: 560657 - RNA, 64 nt, Homo Sapiens
uuugcccuaacuccuucaucagggggucccgagccccgacuagcacucaucucccuuccuucuc

SEQ ID NO: 560658 - RNA, 64 nt, Homo Sapiens
uuuuguauuuugaguagagaugugcgccaccaugcccgacuaauugaguagcugggacuacagg

SEQ ID NO: 560659 - RNA, 64 nt, Homo Sapiens
aaguagcuaggacugcaggcaccaugucacuaugcccgacuaauuuuuaauuuuuaauuuuuug

SEQ ID NO: 560660 - RNA, 64 nt, Homo Sapiens
uuaucaaacuugggcaauucuguuuguguaacuccccgacuaguggaugggagagucccauugc

SEQ ID NO: 560661 - RNA, 64 nt, Homo Sapiens
agcucuguuaguuccagccuccaaagcaaaagcucccgacuacucucacuuaucucaguggacu

SEQ ID NO: 560662 - RNA, 64 nt, Homo Sapiens
aagcccccacuacuaaauggccucucuccacuaccccgacuaucccugcacauaaacuccguuu

SEQ ID NO: 560663 - RNA, 64 nt, Homo Sapiens
caaguagcugggauuacaggugcacagcaccucccccgacuaauuuuuauauuuuuaguagaga

SEQ ID NO: 560664 - RNA, 64 nt, Homo Sapiens
aagggacggccucuccccucaaaaccuggcagagcccgacuagaccaugauuuuaaaaauuaaa

SEQ ID NO: 560665 - RNA, 64 nt, Homo Sapiens
uugccuccuuggauuuccuccacccucacggccacccgacuacucagccuuaccugugacacug

SEQ ID NO: 560666 - RNA, 64 nt, Homo Sapiens
cacccacuguccgccucugcccgcagagcccacgcccgacuagcaggcaugccgcgguagguaa

SEQ ID NO: 560667 - RNA, 64 nt, Homo Sapiens
ugaguagcugagauuauaagcacgcaccaucauacccgacuaauuuuuguauuuauaguagaaa

SEQ ID NO: 560668 - RNA, 64 nt, Homo Sapiens
gcagggcagggcuggguggggcaagaucccccagcccgacuagacccaccucaccugaaggggg

SEQ ID NO: 560669 - RNA, 64 nt, Homo Sapiens
ugaguagcuggaauuacaggcaggugccaccaugcccgacuaauuuuuuuuuauuuuuaguaga

SEQ ID NO: 560670 - RNA, 64 nt, Homo Sapiens; identical to SEQ ID NO: 309743

SEQ ID NO: 560671 - RNA, 64 nt, Homo Sapiens; identical to SEQ ID NO: 309744

SEQ ID NO: 560672 - RNA, 64 nt, Homo Sapiens; identical to SEQ ID NO: 309745

SEQ ID NO: 560673 - RNA, 64 nt, Homo Sapiens; identical to SEQ ID NO: 309746

SEQ ID NO: 560674 - RNA, 64 nt, Homo Sapiens; identical to SEQ ID NO: 309747

SEQ ID NO: 560675 - RNA, 64 nt, Homo Sapiens; identical to SEQ ID NO: 309748

SEQ ID NO: 560676 - RNA, 64 nt, Homo Sapiens; identical to SEQ ID NO: 309749

SEQ ID NO: 560677 - RNA, 56 nt, Homo Sapiens; identical to SEQ ID NO: 83586

SEQ ID NO: 560678 - RNA, 64 nt, Homo Sapiens; identical to SEQ ID NO: 309751

SEQ ID NO: 560679 - RNA, 64 nt, Homo Sapiens; identical to SEQ ID NO: 309752

SEQ ID NO: 560680 - RNA, 64 nt, Homo Sapiens; identical to SEQ ID NO: 309753

SEQ ID NO: 560681 - RNA, 64 nt, Homo Sapiens; identical to SEQ ID NO: 309754

SEQ ID NO: 560682 - RNA, 64 nt, Homo Sapiens; identical to SEQ ID NO: 309755

SEQ ID NO: 560683 - RNA, 64 nt, Homo Sapiens; identical to SEQ ID NO: 309756

SEQ ID NO: 560684 - RNA, 64 nt, Homo Sapiens; identical to SEQ ID NO: 309757

SEQ ID NO: 560685 - RNA, 64 nt, Homo Sapiens; identical to SEQ ID NO: 309758

SEQ ID NO: 560686 - RNA, 64 nt, Homo Sapiens; identical to SEQ ID NO: 309759

SEQ ID NO: 560687 - RNA, 64 nt, Homo Sapiens; identical to SEQ ID NO: 309760

SEQ ID NO: 560688 - RNA, 64 nt, Homo Sapiens; identical to SEQ ID NO: 309761

SEQ ID NO: 560689 - RNA, 64 nt, Homo Sapiens; identical to SEQ ID NO: 309762

SEQ ID NO: 560690 - RNA, 64 nt, Homo Sapiens; identical to SEQ ID NO: 309763

SEQ ID NO: 560691 - RNA, 64 nt, Homo Sapiens; identical to SEQ ID NO: 309764

SEQ ID NO: 560692 - RNA, 64 nt, Homo Sapiens; identical to SEQ ID NO: 309765

SEQ ID NO: 560693 - RNA, 64 nt, Homo Sapiens; identical to SEQ ID NO: 309766

SEQ ID NO: 560694 - RNA, 64 nt, Homo Sapiens; identical to SEQ ID NO: 309767

SEQ ID NO: 560695 - RNA, 64 nt, Homo Sapiens; identical to SEQ ID NO: 309768

SEQ ID NO: 560696 - RNA, 64 nt, Homo Sapiens; identical to SEQ ID NO: 309769

SEQ ID NO: 560697 - RNA, 64 nt, Homo Sapiens; identical to SEQ ID NO: 309770

SEQ ID NO: 560698 - RNA, 64 nt, Homo Sapiens; identical to SEQ ID NO: 309771

SEQ ID NO: 560699 - RNA, 64 nt, Homo Sapiens; identical to SEQ ID NO: 309772

SEQ ID NO: 560700 - RNA, 64 nt, Homo Sapiens; identical to SEQ ID NO: 309773

SEQ ID NO: 560701 - RNA, 64 nt, Homo Sapiens; identical to SEQ ID NO: 309774

SEQ ID NO: 560702 - RNA, 64 nt, Homo Sapiens; identical to SEQ ID NO: 309775

SEQ ID NO: 560703 - RNA, 64 nt, Homo Sapiens; identical to SEQ ID NO: 560648

SEQ ID NO: 560704 - RNA, 64 nt, Homo Sapiens; identical to SEQ ID NO: 560649

SEQ ID NO: 560705 - RNA, 64 nt, Homo Sapiens; identical to SEQ ID NO: 560650

SEQ ID NO: 560706 - RNA, 64 nt, Homo Sapiens; identical to SEQ ID NO: 560651

SEQ ID NO: 560707 - RNA, 64 nt, Homo Sapiens; identical to SEQ ID NO: 560652

SEQ ID NO: 560708 - RNA, 55 nt, Homo Sapiens; identical to SEQ ID NO: 560653

SEQ ID NO: 560709 - RNA, 64 nt, Homo Sapiens; identical to SEQ ID NO: 560654

SEQ ID NO: 560710 - RNA, 64 nt, Homo Sapiens; identical to SEQ ID NO: 560655

SEQ ID NO: 560711 - RNA, 64 nt, Homo Sapiens; identical to SEQ ID NO: 560656

SEQ ID NO: 560712 - RNA, 64 nt, Homo Sapiens; identical to SEQ ID NO: 560657

SEQ ID NO: 560713 - RNA, 64 nt, Homo Sapiens; identical to SEQ ID NO: 560658

SEQ ID NO: 560714 - RNA, 64 nt, Homo Sapiens; identical to SEQ ID NO: 560659

SEQ ID NO: 560715 - RNA, 64 nt, Homo Sapiens; identical to SEQ ID NO: 560660

SEQ ID NO: 560716 - RNA, 64 nt, Homo Sapiens; identical to SEQ ID NO: 560661

SEQ ID NO: 560717 - RNA, 64 nt, Homo Sapiens; identical to SEQ ID NO: 560662

SEQ ID NO: 560718 - RNA, 64 nt, Homo Sapiens; identical to SEQ ID NO: 560663

SEQ ID NO: 560719 - RNA, 64 nt, Homo Sapiens; identical to SEQ ID NO: 560664

SEQ ID NO: 560720 - RNA, 64 nt, Homo Sapiens; identical to SEQ ID NO: 560665

SEQ ID NO: 560721 - RNA, 64 nt, Homo Sapiens; identical to SEQ ID NO: 560666

SEQ ID NO: 560722 - RNA, 64 nt, Homo Sapiens; identical to SEQ ID NO: 560667

SEQ ID NO: 560723 - RNA, 64 nt, Homo Sapiens; identical to SEQ ID NO: 560668

SEQ ID NO: 560724 - RNA, 64 nt, Homo Sapiens; identical to SEQ ID NO: 560669

SEQ ID NO: 560725 - RNA, 64 nt, Homo Sapiens; identical to SEQ ID NO: 309743

SEQ ID NO: 560726 - RNA, 64 nt, Homo Sapiens; identical to SEQ ID NO: 309744

SEQ ID NO: 560727 - RNA, 64 nt, Homo Sapiens; identical to SEQ ID NO: 309745

SEQ ID NO: 560728 - RNA, 64 nt, Homo Sapiens; identical to SEQ ID NO: 309746

SEQ ID NO: 560729 - RNA, 64 nt, Homo Sapiens; identical to SEQ ID NO: 309747

SEQ ID NO: 560730 - RNA, 64 nt, Homo Sapiens; identical to SEQ ID NO: 309748

SEQ ID NO: 560731 - RNA, 64 nt, Homo Sapiens; identical to SEQ ID NO: 309749

SEQ ID NO: 560732 - RNA, 56 nt, Homo Sapiens; identical to SEQ ID NO: 83586

SEQ ID NO: 560733 - RNA, 64 nt, Homo Sapiens; identical to SEQ ID NO: 309751

SEQ ID NO: 560734 - RNA, 64 nt, Homo Sapiens; identical to SEQ ID NO: 309752

SEQ ID NO: 560735 - RNA, 64 nt, Homo Sapiens; identical to SEQ ID NO: 309753

SEQ ID NO: 560736 - RNA, 64 nt, Homo Sapiens; identical to SEQ ID NO: 309754

SEQ ID NO: 560737 - RNA, 64 nt, Homo Sapiens; identical to SEQ ID NO: 309755

SEQ ID NO: 560738 - RNA, 64 nt, Homo Sapiens; identical to SEQ ID NO: 309756

SEQ ID NO: 560739 - RNA, 64 nt, Homo Sapiens; identical to SEQ ID NO: 309757

SEQ ID NO: 560740 - RNA, 64 nt, Homo Sapiens; identical to SEQ ID NO: 309758

SEQ ID NO: 560741 - RNA, 64 nt, Homo Sapiens; identical to SEQ ID NO: 309759

SEQ ID NO: 560742 - RNA, 64 nt, Homo Sapiens; identical to SEQ ID NO: 309760

SEQ ID NO: 560743 - RNA, 64 nt, Homo Sapiens; identical to SEQ ID NO: 309761

SEQ ID NO: 560744 - RNA, 64 nt, Homo Sapiens; identical to SEQ ID NO: 309762

SEQ ID NO: 560745 - RNA, 64 nt, Homo Sapiens; identical to SEQ ID NO: 309763

SEQ ID NO: 560746 - RNA, 64 nt, Homo Sapiens; identical to SEQ ID NO: 309764

SEQ ID NO: 560747 - RNA, 64 nt, Homo Sapiens; identical to SEQ ID NO: 309765

SEQ ID NO: 560748 - RNA, 64 nt, Homo Sapiens; identical to SEQ ID NO: 309766

SEQ ID NO: 560749 - RNA, 64 nt, Homo Sapiens; identical to SEQ ID NO: 309767

SEQ ID NO: 560750 - RNA, 64 nt, Homo Sapiens; identical to SEQ ID NO: 309768

SEQ ID NO: 560751 - RNA, 64 nt, Homo Sapiens; identical to SEQ ID NO: 309769

SEQ ID NO: 560752 - RNA, 64 nt, Homo Sapiens; identical to SEQ ID NO: 309770

SEQ ID NO: 560753 - RNA, 64 nt, Homo Sapiens; identical to SEQ ID NO: 309771

SEQ ID NO: 560754 - RNA, 64 nt, Homo Sapiens; identical to SEQ ID NO: 309772

SEQ ID NO: 560755 - RNA, 64 nt, Homo Sapiens; identical to SEQ ID NO: 309773

SEQ ID NO: 560756 - RNA, 64 nt, Homo Sapiens; identical to SEQ ID NO: 309774

SEQ ID NO: 560757 - RNA, 64 nt, Homo Sapiens; identical to SEQ ID NO: 309775

SEQ ID NO: 560758 - RNA, 64 nt, Homo Sapiens; identical to SEQ ID NO: 560648

SEQ ID NO: 560759 - RNA, 64 nt, Homo Sapiens; identical to SEQ ID NO: 560649

SEQ ID NO: 560760 - RNA, 64 nt, Homo Sapiens; identical to SEQ ID NO: 560650

SEQ ID NO: 560761 - RNA, 64 nt, Homo Sapiens; identical to SEQ ID NO: 560651

SEQ ID NO: 560762 - RNA, 64 nt, Homo Sapiens; identical to SEQ ID NO: 560652

SEQ ID NO: 560763 - RNA, 55 nt, Homo Sapiens; identical to SEQ ID NO: 560653

SEQ ID NO: 560764 - RNA, 64 nt, Homo Sapiens; identical to SEQ ID NO: 560654

SEQ ID NO: 560765 - RNA, 64 nt, Homo Sapiens; identical to SEQ ID NO: 560655

SEQ ID NO: 560766 - RNA, 64 nt, Homo Sapiens; identical to SEQ ID NO: 560656

SEQ ID NO: 560767 - RNA, 64 nt, Homo Sapiens; identical to SEQ ID NO: 560657

SEQ ID NO: 560768 - RNA, 64 nt, Homo Sapiens; identical to SEQ ID NO: 560658

SEQ ID NO: 560769 - RNA, 64 nt, Homo Sapiens; identical to SEQ ID NO: 560659

SEQ ID NO: 560770 - RNA, 64 nt, Homo Sapiens; identical to SEQ ID NO: 560660

SEQ ID NO: 560771 - RNA, 64 nt, Homo Sapiens; identical to SEQ ID NO: 560661

SEQ ID NO: 560772 - RNA, 64 nt, Homo Sapiens; identical to SEQ ID NO: 560662

SEQ ID NO: 560773 - RNA, 64 nt, Homo Sapiens; identical to SEQ ID NO: 560663

SEQ ID NO: 560774 - RNA, 64 nt, Homo Sapiens; identical to SEQ ID NO: 560664

SEQ ID NO: 560775 - RNA, 64 nt, Homo Sapiens; identical to SEQ ID NO: 560665

SEQ ID NO: 560776 - RNA, 64 nt, Homo Sapiens; identical to SEQ ID NO: 560666

SEQ ID NO: 560777 - RNA, 64 nt, Homo Sapiens; identical to SEQ ID NO: 560667

SEQ ID NO: 560778 - RNA, 64 nt, Homo Sapiens; identical to SEQ ID NO: 560668

SEQ ID NO: 560779 - RNA, 64 nt, Homo Sapiens; identical to SEQ ID NO: 560669

SEQ ID NO: 560780 - RNA, 64 nt, Homo Sapiens; identical to SEQ ID NO: 309743

SEQ ID NO: 560781 - RNA, 64 nt, Homo Sapiens; identical to SEQ ID NO: 309744

SEQ ID NO: 560782 - RNA, 64 nt, Homo Sapiens; identical to SEQ ID NO: 309745

SEQ ID NO: 560783 - RNA, 64 nt, Homo Sapiens; identical to SEQ ID NO: 309746

SEQ ID NO: 560784 - RNA, 64 nt, Homo Sapiens; identical to SEQ ID NO: 309747

SEQ ID NO: 560785 - RNA, 64 nt, Homo Sapiens; identical to SEQ ID NO: 309748

SEQ ID NO: 560786 - RNA, 64 nt, Homo Sapiens; identical to SEQ ID NO: 309749

SEQ ID NO: 560787 - RNA, 56 nt, Homo Sapiens; identical to SEQ ID NO: 83586

SEQ ID NO: 560788 - RNA, 64 nt, Homo Sapiens; identical to SEQ ID NO: 309751

SEQ ID NO: 560789 - RNA, 64 nt, Homo Sapiens; identical to SEQ ID NO: 309752

SEQ ID NO: 560790 - RNA, 64 nt, Homo Sapiens; identical to SEQ ID NO: 309753

SEQ ID NO: 560791 - RNA, 64 nt, Homo Sapiens; identical to SEQ ID NO: 309754

SEQ ID NO: 560792 - RNA, 64 nt, Homo Sapiens; identical to SEQ ID NO: 309755

SEQ ID NO: 560793 - RNA, 64 nt, Homo Sapiens; identical to SEQ ID NO: 309756

SEQ ID NO: 560794 - RNA, 64 nt, Homo Sapiens; identical to SEQ ID NO: 309757

SEQ ID NO: 560795 - RNA, 64 nt, Homo Sapiens; identical to SEQ ID NO: 309758

SEQ ID NO: 560796 - RNA, 64 nt, Homo Sapiens; identical to SEQ ID NO: 309759

SEQ ID NO: 560797 - RNA, 64 nt, Homo Sapiens; identical to SEQ ID NO: 309760

SEQ ID NO: 560798 - RNA, 64 nt, Homo Sapiens; identical to SEQ ID NO: 309761

SEQ ID NO: 560799 - RNA, 64 nt, Homo Sapiens; identical to SEQ ID NO: 309762

SEQ ID NO: 560800 - RNA, 64 nt, Homo Sapiens; identical to SEQ ID NO: 309763

SEQ ID NO: 560801 - RNA, 64 nt, Homo Sapiens; identical to SEQ ID NO: 309764

SEQ ID NO: 560802 - RNA, 64 nt, Homo Sapiens; identical to SEQ ID NO: 309765

SEQ ID NO: 560803 - RNA, 64 nt, Homo Sapiens; identical to SEQ ID NO: 309766

SEQ ID NO: 560804 - RNA, 64 nt, Homo Sapiens; identical to SEQ ID NO: 309767

SEQ ID NO: 560805 - RNA, 64 nt, Homo Sapiens; identical to SEQ ID NO: 309768

SEQ ID NO: 560806 - RNA, 64 nt, Homo Sapiens; identical to SEQ ID NO: 309769

SEQ ID NO: 560807 - RNA, 64 nt, Homo Sapiens; identical to SEQ ID NO: 309770

SEQ ID NO: 560808 - RNA, 64 nt, Homo Sapiens; identical to SEQ ID NO: 309771

SEQ ID NO: 560809 - RNA, 64 nt, Homo Sapiens; identical to SEQ ID NO: 309772

SEQ ID NO: 560810 - RNA, 64 nt, Homo Sapiens; identical to SEQ ID NO: 309773

SEQ ID NO: 560811 - RNA, 64 nt, Homo Sapiens; identical to SEQ ID NO: 309774

SEQ ID NO: 560812 - RNA, 64 nt, Homo Sapiens; identical to SEQ ID NO: 309775

SEQ ID NO: 560813 - RNA, 64 nt, Homo Sapiens; identical to SEQ ID NO: 238083

SEQ ID NO: 560814 - RNA, 64 nt, Homo Sapiens; identical to SEQ ID NO: 238084

SEQ ID NO: 560815 - RNA, 64 nt, Homo Sapiens; identical to SEQ ID NO: 238085

SEQ ID NO: 560816 - RNA, 64 nt, Homo Sapiens; identical to SEQ ID NO: 238086

SEQ ID NO: 560817 - RNA, 64 nt, Homo Sapiens; identical to SEQ ID NO: 238087

SEQ ID NO: 560818 - RNA, 64 nt, Homo Sapiens; identical to SEQ ID NO: 238088

SEQ ID NO: 560819 - RNA, 64 nt, Homo Sapiens; identical to SEQ ID NO: 238089

SEQ ID NO: 560820 - RNA, 64 nt, Homo Sapiens; identical to SEQ ID NO: 238090

SEQ ID NO: 560821 - RNA, 64 nt, Homo Sapiens
auauucaacuuucauggacugccccuggcaagguccucgauaaaggaagagguaaguuugacau

SEQ ID NO: 560822 - RNA, 64 nt, Homo Sapiens
cuagagcccacccccuccuccuaguugacucagcccucgauaguuguacagguuggcccuucac

SEQ ID NO: 560823 - RNA, 64 nt, Homo Sapiens
agucagcuagacacacucagugcuuuuacgugucccucgauaacgcaguccaguuuugugaugc

SEQ ID NO: 560824 - RNA, 64 nt, Homo Sapiens
gauuuagauuaucaaaugugucagugauugaugaccucgauauguguaacagucucccuuaugg

SEQ ID NO: 560825 - RNA, 64 nt, Homo Sapiens
aaaaucauccuugacaugaaugaaaagugaguaaccucgauauuguuugugcaagugaaaaugu

SEQ ID NO: 560826 - RNA, 50 nt, Homo Sapiens
aaaaauucaaaucacaguagccucgauagaagcuauuuuugaugaauuuc

SEQ ID NO: 560827 - RNA, 64 nt, Homo Sapiens
uuuggaaggauuccuuuuucuguagaauacuuugccucgauauauaagcauacagaugcacuuu

SEQ ID NO: 560828 - RNA, 64 nt, Homo Sapiens
uagucagguugauuggacuuacgacccaaaugaaccucgauacugcauuuguaaucagguaaaa

SEQ ID NO: 560829 - RNA, 64 nt, Homo Sapiens
ccacuggcccugcacccuuuuaucucuuccugcuccucgauaggggcuguaucauagcgauauu

SEQ ID NO: 560830 - RNA, 64 nt, Homo Sapiens
ugcuuauauuaacaagaagacucacgcaauaacuccucgauaacucucagugaugguaucuguu

SEQ ID NO: 560831 - RNA, 64 nt, Homo Sapiens
cuuauuuuauuccacaacucuucuagcauaccaaccucgauacuauuaaggagaauagccuccu

SEQ ID NO: 560832 - RNA, 64 nt, Homo Sapiens
ggcuguguaaacacagucaaaauaauucuaaaucccucgauauuuuuaaagaucuguaaguaac

SEQ ID NO: 560833 - RNA, 64 nt, Homo Sapiens
gaaacagaaaacgugucucagauggcuggcuuuaccucgauagcauaagagagaccuaagacau

SEQ ID NO: 560834 - RNA, 64 nt, Homo Sapiens
ccucccucugcuugcccagguacuccuuccgccgccucgauacacgggacguugagcacaacgu

SEQ ID NO: 560835 - RNA, 64 nt, Homo Sapiens
ucuguuaauauaaauagagaacauauuuaucauuccucgauaguuaauuauagacuuugguacc

SEQ ID NO: 560836 - RNA, 64 nt, Homo Sapiens
cuuggaggccaaaccuuaaauccagagauagcagccucgauagggaccuuaaaaggauucacaa

SEQ ID NO: 560837 - RNA, 64 nt, Homo Sapiens
ccauggaaugcucgcacguuucuucuuugggaccccucgauaucauguggggaucgagcagccu

SEQ ID NO: 560838 - RNA, 64 nt, Homo Sapiens
ccaugcaagggcuuccugagagugacugagcuguccucgauagggguauggaauuuuucccuuc

SEQ ID NO: 560839 - RNA, 64 nt, Homo Sapiens
ggucaccagauuguuuuguaaugcccgccccuugccucgauauugccaguuucuugugcaauaa

SEQ ID NO: 560840 - RNA, 64 nt, Homo Sapiens
cugacauuuggaaaaacacaccaacuccugggaaccucgauauuuggccacuugagaaguuuug

SEQ ID NO: 560841 - RNA, 64 nt, Homo Sapiens
acucaccaccauuccuuggccagccuuuugccucccucgauacucaacaaagagaagcaaagcc

SEQ ID NO: 560842 - RNA, 64 nt, Homo Sapiens
ccggaaugggguuuucccacguguggccugcuguccucgauagacaguggggaccugagaaugc

SEQ ID NO: 560843 - RNA, 64 nt, Homo Sapiens
ugcgaauacaucugcuuuccggggucggaggagcccucgauacccuggagagcagaggcuauuu

SEQ ID NO: 560844 - RNA, 64 nt, Homo Sapiens
uucaauguaccuuccuucaccucgucguauauauccucgauaaguauuaaaacaguauuugagu

SEQ ID NO: 560845 - RNA, 64 nt, Homo Sapiens
aguuuccccuccuaauacauauggcuguuuuccaccucgauaauauaacacgaguuugggcccg

SEQ ID NO: 560846 - RNA, 64 nt, Homo Sapiens
aauccucuaaaucaguuuauggagaauuacccacccucgauaucugaucccauuccucaucucc

SEQ ID NO: 560847 - RNA, 64 nt, Homo Sapiens
gggaaccacuuucuuauuuucacccuguggucuuccucgauaaagcacaugugcugcccuacag

SEQ ID NO: 560848 - RNA, 64 nt, Homo Sapiens
uaauuguauagauuuuaaaaaauauauacagaaaccucgauauaguauguguacacacauguau

SEQ ID NO: 560849 - RNA, 64 nt, Homo Sapiens; identical to SEQ ID NO: 84343

SEQ ID NO: 560850 - RNA, 64 nt, Homo Sapiens; identical to SEQ ID NO: 84344

SEQ ID NO: 560851 - RNA, 64 nt, Homo Sapiens; identical to SEQ ID NO: 84345

SEQ ID NO: 560852 - RNA, 64 nt, Homo Sapiens; identical to SEQ ID NO: 84346

SEQ ID NO: 560853 - RNA, 64 nt, Homo Sapiens; identical to SEQ ID NO: 84347

SEQ ID NO: 560854 - RNA, 64 nt, Homo Sapiens; identical to SEQ ID NO: 84348

SEQ ID NO: 560855 - RNA, 64 nt, Homo Sapiens; identical to SEQ ID NO: 84349

SEQ ID NO: 560856 - RNA, 64 nt, Homo Sapiens; identical to SEQ ID NO: 84350

SEQ ID NO: 560857 - RNA, 64 nt, Homo Sapiens; identical to SEQ ID NO: 84351

SEQ ID NO: 560858 - RNA, 64 nt, Homo Sapiens; identical to SEQ ID NO: 84352

SEQ ID NO: 560859 - RNA, 64 nt, Homo Sapiens; identical to SEQ ID NO: 84353

SEQ ID NO: 560860 - RNA, 64 nt, Homo Sapiens; identical to SEQ ID NO: 84354

SEQ ID NO: 560861 - RNA, 64 nt, Homo Sapiens; identical to SEQ ID NO: 84355

SEQ ID NO: 560862 - RNA, 64 nt, Homo Sapiens; identical to SEQ ID NO: 84356

SEQ ID NO: 560863 - RNA, 64 nt, Homo Sapiens; identical to SEQ ID NO: 84357

SEQ ID NO: 560864 - RNA, 64 nt, Homo Sapiens; identical to SEQ ID NO: 84358

SEQ ID NO: 560865 - RNA, 64 nt, Homo Sapiens; identical to SEQ ID NO: 84359

SEQ ID NO: 560866 - RNA, 64 nt, Homo Sapiens; identical to SEQ ID NO: 84360

SEQ ID NO: 560867 - RNA, 64 nt, Homo Sapiens; identical to SEQ ID NO: 84361

SEQ ID NO: 560868 - RNA, 64 nt, Homo Sapiens; identical to SEQ ID NO: 84362

SEQ ID NO: 560869 - RNA, 64 nt, Homo Sapiens; identical to SEQ ID NO: 84363

SEQ ID NO: 560870 - RNA, 64 nt, Homo Sapiens; identical to SEQ ID NO: 84364

SEQ ID NO: 560871 - RNA, 64 nt, Homo Sapiens; identical to SEQ ID NO: 84365

SEQ ID NO: 560872 - RNA, 64 nt, Homo Sapiens; identical to SEQ ID NO: 84366

SEQ ID NO: 560873 - RNA, 64 nt, Homo Sapiens; identical to SEQ ID NO: 84367

SEQ ID NO: 560874 - RNA, 64 nt, Homo Sapiens; identical to SEQ ID NO: 84368

SEQ ID NO: 560875 - RNA, 64 nt, Homo Sapiens; identical to SEQ ID NO: 84369

SEQ ID NO: 560876 - RNA, 64 nt, Homo Sapiens; identical to SEQ ID NO: 84370

SEQ ID NO: 560877 - RNA, 64 nt, Homo Sapiens; identical to SEQ ID NO: 84371

SEQ ID NO: 560878 - RNA, 64 nt, Homo Sapiens; identical to SEQ ID NO: 84372

SEQ ID NO: 560879 - RNA, 64 nt, Homo Sapiens; identical to SEQ ID NO: 84373

SEQ ID NO: 560880 - RNA, 64 nt, Homo Sapiens; identical to SEQ ID NO: 84374

SEQ ID NO: 560881 - RNA, 64 nt, Homo Sapiens; identical to SEQ ID NO: 84375

SEQ ID NO: 560882 - RNA, 64 nt, Homo Sapiens; identical to SEQ ID NO: 84376

SEQ ID NO: 560883 - RNA, 64 nt, Homo Sapiens; identical to SEQ ID NO: 437676

SEQ ID NO: 560884 - RNA, 64 nt, Homo Sapiens; identical to SEQ ID NO: 437677

SEQ ID NO: 560885 - RNA, 64 nt, Homo Sapiens; identical to SEQ ID NO: 437678

SEQ ID NO: 560886 - RNA, 64 nt, Homo Sapiens; identical to SEQ ID NO: 437679

SEQ ID NO: 560887 - RNA, 64 nt, Homo Sapiens; identical to SEQ ID NO: 437680

SEQ ID NO: 560888 - RNA, 64 nt, Homo Sapiens; identical to SEQ ID NO: 437681

SEQ ID NO: 560889 - RNA, 64 nt, Homo Sapiens; identical to SEQ ID NO: 437682

SEQ ID NO: 560890 - RNA, 64 nt, Homo Sapiens; identical to SEQ ID NO: 437683

SEQ ID NO: 560891 - RNA, 64 nt, Homo Sapiens; identical to SEQ ID NO: 437684

SEQ ID NO: 560892 - RNA, 64 nt, Homo Sapiens; identical to SEQ ID NO: 437685

SEQ ID NO: 560893 - RNA, 64 nt, Homo Sapiens; identical to SEQ ID NO: 437686

SEQ ID NO: 560894 - RNA, 64 nt, Homo Sapiens; identical to SEQ ID NO: 437687

SEQ ID NO: 560895 - RNA, 64 nt, Homo Sapiens; identical to SEQ ID NO: 437688

SEQ ID NO: 560896 - RNA, 64 nt, Homo Sapiens; identical to SEQ ID NO: 437689

SEQ ID NO: 560897 - RNA, 64 nt, Homo Sapiens; identical to SEQ ID NO: 437690

SEQ ID NO: 560898 - RNA, 64 nt, Homo Sapiens; identical to SEQ ID NO: 437691

SEQ ID NO: 560899 - RNA, 64 nt, Homo Sapiens; identical to SEQ ID NO: 437692

SEQ ID NO: 560900 - RNA, 64 nt, Homo Sapiens; identical to SEQ ID NO: 437693

SEQ ID NO: 560901 - RNA, 64 nt, Homo Sapiens; identical to SEQ ID NO: 437694

SEQ ID NO: 560902 - RNA, 64 nt, Homo Sapiens; identical to SEQ ID NO: 437695

SEQ ID NO: 560903 - RNA, 64 nt, Homo Sapiens; identical to SEQ ID NO: 437696

SEQ ID NO: 560904 - RNA, 64 nt, Homo Sapiens; identical to SEQ ID NO: 437697

SEQ ID NO: 560905 - RNA, 64 nt, Homo Sapiens; identical to SEQ ID NO: 437698

SEQ ID NO: 560906 - RNA, 64 nt, Homo Sapiens; identical to SEQ ID NO: 437699

SEQ ID NO: 560907 - RNA, 64 nt, Homo Sapiens; identical to SEQ ID NO: 437700

SEQ ID NO: 560908 - RNA, 64 nt, Homo Sapiens; identical to SEQ ID NO: 437701

SEQ ID NO: 560909 - RNA, 64 nt, Homo Sapiens; identical to SEQ ID NO: 437702

SEQ ID NO: 560910 - RNA, 64 nt, Homo Sapiens; identical to SEQ ID NO: 437703

SEQ ID NO: 560911 - RNA, 64 nt, Homo Sapiens; identical to SEQ ID NO: 437704

SEQ ID NO: 560912 - RNA, 64 nt, Homo Sapiens; identical to SEQ ID NO: 437705

SEQ ID NO: 560913 - RNA, 64 nt, Homo Sapiens; identical to SEQ ID NO: 437706

SEQ ID NO: 560914 - RNA, 64 nt, Homo Sapiens; identical to SEQ ID NO: 437707

SEQ ID NO: 560915 - RNA, 64 nt, Homo Sapiens; identical to SEQ ID NO: 437708

SEQ ID NO: 560916 - RNA, 64 nt, Homo Sapiens; identical to SEQ ID NO: 437709

SEQ ID NO: 560917 - RNA, 64 nt, Homo Sapiens; identical to SEQ ID NO: 437710

SEQ ID NO: 560918 - RNA, 64 nt, Homo Sapiens; identical to SEQ ID NO: 437711

SEQ ID NO: 560919 - RNA, 64 nt, Homo Sapiens; identical to SEQ ID NO: 437712

SEQ ID NO: 560920 - RNA, 64 nt, Homo Sapiens; identical to SEQ ID NO: 437713

SEQ ID NO: 560921 - RNA, 64 nt, Homo Sapiens; identical to SEQ ID NO: 437714

SEQ ID NO: 560922 - RNA, 64 nt, Homo Sapiens; identical to SEQ ID NO: 437715

SEQ ID NO: 560923 - RNA, 64 nt, Homo Sapiens; identical to SEQ ID NO: 437716

SEQ ID NO: 560924 - RNA, 64 nt, Homo Sapiens; identical to SEQ ID NO: 437717

SEQ ID NO: 560925 - RNA, 64 nt, Homo Sapiens; identical to SEQ ID NO: 437718

SEQ ID NO: 560926 - RNA, 64 nt, Homo Sapiens; identical to SEQ ID NO: 209724

SEQ ID NO: 560927 - RNA, 64 nt, Homo Sapiens; identical to SEQ ID NO: 209725

SEQ ID NO: 560928 - RNA, 64 nt, Homo Sapiens; identical to SEQ ID NO: 209726

SEQ ID NO: 560929 - RNA, 64 nt, Homo Sapiens; identical to SEQ ID NO: 209727

SEQ ID NO: 560930 - RNA, 64 nt, Homo Sapiens; identical to SEQ ID NO: 209728

SEQ ID NO: 560931 - RNA, 64 nt, Homo Sapiens; identical to SEQ ID NO: 209729

SEQ ID NO: 560932 - RNA, 64 nt, Homo Sapiens; identical to SEQ ID NO: 209730

SEQ ID NO: 560933 - RNA, 64 nt, Homo Sapiens; identical to SEQ ID NO: 209731

SEQ ID NO: 560934 - RNA, 64 nt, Homo Sapiens; identical to SEQ ID NO: 209732

SEQ ID NO: 560935 - RNA, 64 nt, Homo Sapiens; identical to SEQ ID NO: 209733

SEQ ID NO: 560936 - RNA, 63 nt, Homo Sapiens; identical to SEQ ID NO: 209734

SEQ ID NO: 560937 - RNA, 64 nt, Homo Sapiens; identical to SEQ ID NO: 209735

SEQ ID NO: 560938 - RNA, 64 nt, Homo Sapiens; identical to SEQ ID NO: 209736

SEQ ID NO: 560939 - RNA, 64 nt, Homo Sapiens; identical to SEQ ID NO: 209737

SEQ ID NO: 560940 - RNA, 64 nt, Homo Sapiens; identical to SEQ ID NO: 209738

SEQ ID NO: 560941 - RNA, 64 nt, Homo Sapiens; identical to SEQ ID NO: 209739

SEQ ID NO: 560942 - RNA, 64 nt, Homo Sapiens; identical to SEQ ID NO: 209740

SEQ ID NO: 560943 - RNA, 64 nt, Homo Sapiens; identical to SEQ ID NO: 209741

SEQ ID NO: 560944 - RNA, 64 nt, Homo Sapiens; identical to SEQ ID NO: 209742

SEQ ID NO: 560945 - RNA, 64 nt, Homo Sapiens; identical to SEQ ID NO: 209743

SEQ ID NO: 560946 - RNA, 64 nt, Homo Sapiens; identical to SEQ ID NO: 209744

SEQ ID NO: 560947 - RNA, 64 nt, Homo Sapiens; identical to SEQ ID NO: 209745

SEQ ID NO: 560948 - RNA, 64 nt, Homo Sapiens; identical to SEQ ID NO: 209746

SEQ ID NO: 560949 - RNA, 64 nt, Homo Sapiens; identical to SEQ ID NO: 209747

SEQ ID NO: 560950 - RNA, 64 nt, Homo Sapiens; identical to SEQ ID NO: 209748

SEQ ID NO: 560951 - RNA, 64 nt, Homo Sapiens; identical to SEQ ID NO: 209749

SEQ ID NO: 560952 - RNA, 64 nt, Homo Sapiens; identical to SEQ ID NO: 209750

SEQ ID NO: 560953 - RNA, 64 nt, Homo Sapiens; identical to SEQ ID NO: 209751

SEQ ID NO: 560954 - RNA, 64 nt, Homo Sapiens; identical to SEQ ID NO: 209752

SEQ ID NO: 560955 - RNA, 64 nt, Homo Sapiens; identical to SEQ ID NO: 209753

SEQ ID NO: 560956 - RNA, 64 nt, Homo Sapiens; identical to SEQ ID NO: 209754

SEQ ID NO: 560957 - RNA, 64 nt, Homo Sapiens; identical to SEQ ID NO: 209755

SEQ ID NO: 560958 - RNA, 64 nt, Homo Sapiens; identical to SEQ ID NO: 209756

SEQ ID NO: 560959 - RNA, 64 nt, Homo Sapiens; identical to SEQ ID NO: 209757

SEQ ID NO: 560960 - RNA, 64 nt, Homo Sapiens; identical to SEQ ID NO: 209758

SEQ ID NO: 560961 - RNA, 64 nt, Homo Sapiens; identical to SEQ ID NO: 209759

SEQ ID NO: 560962 - RNA, 64 nt, Homo Sapiens; identical to SEQ ID NO: 209760

SEQ ID NO: 560963 - RNA, 64 nt, Homo Sapiens; identical to SEQ ID NO: 209761

SEQ ID NO: 560964 - RNA, 64 nt, Homo Sapiens; identical to SEQ ID NO: 209762

SEQ ID NO: 560965 - RNA, 64 nt, Homo Sapiens; identical to SEQ ID NO: 209763

SEQ ID NO: 560966 - RNA, 64 nt, Homo Sapiens; identical to SEQ ID NO: 209764

SEQ ID NO: 560967 - RNA, 64 nt, Homo Sapiens; identical to SEQ ID NO: 209765

SEQ ID NO: 560968 - RNA, 64 nt, Homo Sapiens; identical to SEQ ID NO: 209766

SEQ ID NO: 560969 - RNA, 64 nt, Homo Sapiens; identical to SEQ ID NO: 209767

SEQ ID NO: 560970 - RNA, 64 nt, Homo Sapiens; identical to SEQ ID NO: 209768

SEQ ID NO: 560971 - RNA, 64 nt, Homo Sapiens; identical to SEQ ID NO: 209769

SEQ ID NO: 560972 - RNA, 64 nt, Homo Sapiens; identical to SEQ ID NO: 209770

SEQ ID NO: 560973 - RNA, 64 nt, Homo Sapiens; identical to SEQ ID NO: 209771

SEQ ID NO: 560974 - RNA, 64 nt, Homo Sapiens; identical to SEQ ID NO: 209772

SEQ ID NO: 560975 - RNA, 64 nt, Homo Sapiens; identical to SEQ ID NO: 209773

SEQ ID NO: 560976 - RNA, 64 nt, Homo Sapiens; identical to SEQ ID NO: 209774

SEQ ID NO: 560977 - RNA, 64 nt, Homo Sapiens; identical to SEQ ID NO: 209775

SEQ ID NO: 560978 - RNA, 64 nt, Homo Sapiens; identical to SEQ ID NO: 209776

SEQ ID NO: 560979 - RNA, 64 nt, Homo Sapiens; identical to SEQ ID NO: 209777

SEQ ID NO: 560980 - RNA, 64 nt, Homo Sapiens; identical to SEQ ID NO: 209778

SEQ ID NO: 560981 - RNA, 64 nt, Homo Sapiens; identical to SEQ ID NO: 209779

SEQ ID NO: 560982 - RNA, 64 nt, Homo Sapiens; identical to SEQ ID NO: 209780

SEQ ID NO: 560983 - RNA, 64 nt, Homo Sapiens; identical to SEQ ID NO: 209781

SEQ ID NO: 560984 - RNA, 64 nt, Homo Sapiens; identical to SEQ ID NO: 209782

SEQ ID NO: 560985 - RNA, 64 nt, Homo Sapiens; identical to SEQ ID NO: 209783

SEQ ID NO: 560986 - RNA, 64 nt, Homo Sapiens; identical to SEQ ID NO: 209784

SEQ ID NO: 560987 - RNA, 64 nt, Homo Sapiens; identical to SEQ ID NO: 209785

SEQ ID NO: 560988 - RNA, 64 nt, Homo Sapiens; identical to SEQ ID NO: 209786

SEQ ID NO: 560989 - RNA, 64 nt, Homo Sapiens; identical to SEQ ID NO: 209787

SEQ ID NO: 560990 - RNA, 64 nt, Homo Sapiens; identical to SEQ ID NO: 209788

SEQ ID NO: 560991 - RNA, 64 nt, Homo Sapiens; identical to SEQ ID NO: 209789

SEQ ID NO: 560992 - RNA, 64 nt, Homo Sapiens; identical to SEQ ID NO: 209790

SEQ ID NO: 560993 - RNA, 64 nt, Homo Sapiens; identical to SEQ ID NO: 209791

SEQ ID NO: 560994 - RNA, 64 nt, Homo Sapiens; identical to SEQ ID NO: 209792

SEQ ID NO: 560995 - RNA, 64 nt, Homo Sapiens; identical to SEQ ID NO: 209793

SEQ ID NO: 560996 - RNA, 64 nt, Homo Sapiens; identical to SEQ ID NO: 209794

SEQ ID NO: 560997 - RNA, 64 nt, Homo Sapiens; identical to SEQ ID NO: 209795

SEQ ID NO: 560998 - RNA, 64 nt, Homo Sapiens; identical to SEQ ID NO: 209796

SEQ ID NO: 560999 - RNA, 64 nt, Homo Sapiens; identical to SEQ ID NO: 209797

SEQ ID NO: 561000 - RNA, 64 nt, Homo Sapiens; identical to SEQ ID NO: 209798

SEQ ID NO: 561001 - RNA, 64 nt, Homo Sapiens; identical to SEQ ID NO: 209799

SEQ ID NO: 561002 - RNA, 64 nt, Homo Sapiens; identical to SEQ ID NO: 209800

SEQ ID NO: 561003 - RNA, 64 nt, Homo Sapiens; identical to SEQ ID NO: 209801

SEQ ID NO: 561004 - RNA, 64 nt, Homo Sapiens; identical to SEQ ID NO: 209802

SEQ ID NO: 561005 - RNA, 64 nt, Homo Sapiens; identical to SEQ ID NO: 209803

SEQ ID NO: 561006 - RNA, 64 nt, Homo Sapiens; identical to SEQ ID NO: 209804

SEQ ID NO: 561007 - RNA, 64 nt, Homo Sapiens; identical to SEQ ID NO: 209805

SEQ ID NO: 561008 - RNA, 64 nt, Homo Sapiens; identical to SEQ ID NO: 209806

SEQ ID NO: 561009 - RNA, 64 nt, Homo Sapiens; identical to SEQ ID NO: 209807

SEQ ID NO: 561010 - RNA, 64 nt, Homo Sapiens; identical to SEQ ID NO: 209808

SEQ ID NO: 561011 - RNA, 64 nt, Homo Sapiens; identical to SEQ ID NO: 209809

SEQ ID NO: 561012 - RNA, 64 nt, Homo Sapiens; identical to SEQ ID NO: 209810

SEQ ID NO: 561013 - RNA, 64 nt, Homo Sapiens; identical to SEQ ID NO: 209811

SEQ ID NO: 561014 - RNA, 64 nt, Homo Sapiens; identical to SEQ ID NO: 209812

SEQ ID NO: 561015 - RNA, 64 nt, Homo Sapiens; identical to SEQ ID NO: 209813

SEQ ID NO: 561016 - RNA, 64 nt, Homo Sapiens; identical to SEQ ID NO: 209814

SEQ ID NO: 561017 - RNA, 59 nt, Homo Sapiens
ugguaggggguuugaagaauccccuguccaccucccaaauccaggcccggcccccucug

SEQ ID NO: 561018 - RNA, 59 nt, Homo Sapiens
ucuccugaccucgugauccacccaccucgaccucccaaagugcugagauuacaggcgug

SEQ ID NO: 561019 - RNA, 59 nt, Homo Sapiens
uuuccaaaagauauuuugguaagacaacaaccucccagugauaugccaccuuucaauuu

SEQ ID NO: 561020 - RNA, 59 nt, Homo Sapiens
ccccgcaaucucggcucacugcaaccucuaccucccagguucaagcuauucuacugccu

SEQ ID NO: 561021 - RNA, 59 nt, Homo Sapiens
uggccagaaccaauguccauucuagccccaccucccacugguccuccaguacccugucu

SEQ ID NO: 561022 - RNA, 59 nt, Homo Sapiens
cugaugaccucucuggcuggggcauggccaccucccaaccagggucccuggccagaagg

SEQ ID NO: 561023 - RNA, 59 nt, Homo Sapiens
gcccuucugaaaagugccagcucaguuacaccucccaguuguggcuggcagccacuauu

SEQ ID NO: 561024 - RNA, 59 nt, Homo Sapiens
accaccaugaaguuuggugacugcccccuaccucccacccaugugguuggaaggauaga

SEQ ID NO: 561025 - RNA, 59 nt, Homo Sapiens
gugcugggauuacaggcuugcccaccuugaccucccaaaucuugagcucaagcagucua

SEQ ID NO: 561026 - RNA, 59 nt, Homo Sapiens
uagcugggacuauaggcaugcccacuucaaccucccaaguucugggcucaagcaauccu

SEQ ID NO: 561027 - RNA, 59 nt, Homo Sapiens
cuccuggccuaggugauccacccgccucgaccucccaaagugcugggauuacaggcaug

SEQ ID NO: 561028 - RNA, 59 nt, Homo Sapiens
cauggaugagaguccugggugugaggaacaccucccaccaggcuagaggcaacugccca

SEQ ID NO: 561029 - RNA, 59 nt, Homo Sapiens
ucucccuggcagcagaugagaugggaagaaccucccacagacccccucaucucagagua

SEQ ID NO: 561030 - RNA, 59 nt, Homo Sapiens
ccuucaauguggggacgagaugaugcccaaccucccaccgaaggccuaugaaaaggucc

SEQ ID NO: 561031 - RNA, 59 nt, Homo Sapiens
uggugugaucucagcucacugcaaccuccaccucccagguucaagcaauucuucugccu

SEQ ID NO: 561032 - RNA, 59 nt, Homo Sapiens
uggugacaucucggcucacugcaaccuccaccucccagguucaagugauucuccugccu

SEQ ID NO: 561033 - RNA, 59 nt, Homo Sapiens
ucuaggggauauuugugcaaauuauaauaaccucccaguuuucucaaauguacacuugu

SEQ ID NO: 561034 - RNA, 59 nt, Homo Sapiens
guacugggauuacaggcgugccugccucgaccucccaaauccugaacucaagugaucca

SEQ ID NO: 561035 - RNA, 59 nt, Homo Sapiens
uagugcaaucucagcucacugcaaccuccaccucccagacucaagccauccucccaccu

SEQ ID NO: 561036 - RNA, 59 nt, Homo Sapiens
ucccagacucaagccauccucccaccucaaccucccaaguagcugggacuacaggcaua

SEQ ID NO: 561037 - RNA, 59 nt, Homo Sapiens
caccccaaacaaauggaagauuaaaacucaccucccaauuagagagcugagacccuuau

SEQ ID NO: 561038 - RNA, 59 nt, Homo Sapiens
agggcuccucacuaucuaggcucugugccaccucccaagcuggaaucccacaacaucag

SEQ ID NO: 561039 - RNA, 59 nt, Homo Sapiens
gugcugugauuacaggugugcccgccucgaccucccaaaucucuugaccucaugaucca

SEQ ID NO: 561040 - RNA, 59 nt, Homo Sapiens
uucaagcaauucuccugccugcaaccuccaccucccagguggugcaaucucggcucacu

SEQ ID NO: 561041 - RNA, 59 nt, Homo Sapiens
guccccaaguaugaggugaacggggugaaaccucccauuggccaaaggacacggcucag

SEQ ID NO: 561042 - RNA, 59 nt, Homo Sapiens
ucugugguucugagaagcccgaggucaucaccucccaguacaacaacaugcgcguggag

SEQ ID NO: 561043 - RNA, 59 nt, Homo Sapiens
cuccgccccauacccgucacuacagccucaccucccaccccugucacuacggccucacc

SEQ ID NO: 561044 - RNA, 59 nt, Homo Sapiens
ucaccucccaccccugucacuacggccucaccucccaccccugucacuacagccucacc

SEQ ID NO: 561045 - RNA, 59 nt, Homo Sapiens
caugagaggucugcucucaugaccuaaucaccucccaaaggccccaccucccaauacca

SEQ ID NO: 561046 - RNA, 59 nt, Homo Sapiens
ucaugaccuaaucaccucccaaaggccccaccucccaauaccaucacauuagggguuag

SEQ ID NO: 561047 - RNA, 59 nt, Homo Sapiens
aaccaaccacacccggugggggaaccagcaccucccaccagccgaugccccccgguaug

SEQ ID NO: 561048 - RNA, 59 nt, Homo Sapiens
aaccagccacacccggugggggaaccagcaccucccaccagccgaugccccccaguaug

SEQ ID NO: 561049 - RNA, 59 nt, Homo Sapiens
aaccagccacacccagugggggaaccagcaccucccaccagccgaugccccccggugug

SEQ ID NO: 561050 - RNA, 59 nt, Homo Sapiens
aaccagccacucccgguggggaaaacagcaccucccaccccggggggcccccgggugca

SEQ ID NO: 561051 - RNA, 59 nt, Homo Sapiens
ugauaugcagugcuuuugacuacccucccaccucccaccuugucccagguuggaguccc

SEQ ID NO: 561052 - RNA, 59 nt, Homo Sapiens
ggcucgcucccccccccccacacccuccaaccucccauucccuccuaccugagaggcug

SEQ ID NO: 561053 - RNA, 59 nt, Homo Sapiens
ugugcccuugcucucuaacuucugagcccaccucccaggguaggcaccugggggcaugc

SEQ ID NO: 561054 - RNA, 59 nt, Homo Sapiens
gguaggcaccugggggcaugcaggugcccaccucccaggguaggcaccugggggcaugc

SEQ ID NO: 561055 - RNA, 59 nt, Homo Sapiens
cauacuugacuguccccaaauggcuguccaccucccagcucuccugagcuuaguguccg

SEQ ID NO: 561056 - RNA, 59 nt, Homo Sapiens
cuccacuucccaguuugcaacuuccccucaccucccacucucuucauucauugcuagug

SEQ ID NO: 561057 - RNA, 59 nt, Homo Sapiens
ugugaacauuuguaaccacugcuucagucaccucccaccucuugccaccugcugcugcu

SEQ ID NO: 561058 - RNA, 59 nt, Homo Sapiens
ccaugaacucuucacuccuuggggaagccaccucccaucacaccccugagcagaguuag

SEQ ID NO: 561059 - RNA, 59 nt, Homo Sapiens
uuaagcuuugcaggacagggcaaaucucuaccucccaugaagaagaagaagaagagaca

SEQ ID NO: 561060 - RNA, 59 nt, Homo Sapiens
cucaagugauccucccacccguaaccuccaccucccaggucacuugaucuuggcucacu

SEQ ID NO: 561061 - RNA, 59 nt, Homo Sapiens
ggaccggggccagccuaggggggccugugaccucccauggagcccagccccgcccucca

SEQ ID NO: 561062 - RNA, 59 nt, Homo Sapiens
gcccuccacaccuccggcgcuccgcacccaccucccacggccccgccccugcccccgcu

SEQ ID NO: 561063 - RNA, 59 nt, Homo Sapiens
gcugggccuggauggcugccucaccucucaccucccaacgucccuagcccuuacguccu

SEQ ID NO: 561064 - RNA, 59 nt, Homo Sapiens
caucuuucaagggaccucuccaugaucccaccucccauucacagauaccucucuuguag

SEQ ID NO: 561065 - RNA, 59 nt, Homo Sapiens
cagggcucuguguuuugucuggccggagaaccucccaggccugguguggggucugagac

SEQ ID NO: 561066 - RNA, 59 nt, Homo Sapiens
ugccccucgagcaaaaaccucugacgcccaccucccaggguucccgccgcaguggggcc

SEQ ID NO: 561067 - RNA, 59 nt, Homo Sapiens
cuccuccucuucuccuucaacggcaacccaccucccaccagucuucaaccagauauccu

SEQ ID NO: 561068 - RNA, 59 nt, Homo Sapiens
ccagaccauccaggccugguacugcacagaccucccacuccaccccccaaacguccugg

SEQ ID NO: 561069 - RNA, 59 nt, Homo Sapiens
ggugcagcugcccaaagucuccgaugugcaccucccagaggugccugaaauggccgugc

SEQ ID NO: 561070 - RNA, 59 nt, Homo Sapiens
agugcagcuuccaaaaguccccgaugugcaccucccagaggugcccgagauggccgugc

SEQ ID NO: 561071 - RNA, 59 nt, Homo Sapiens
cuguauguacuuccaguaucaggccaaagaccucccaagggcuuggccaaaacaggcuc

SEQ ID NO: 561072 - RNA, 59 nt, Homo Sapiens
uucaagcgacucuccugccugcaaccuccaccucccagguggagugaucucagcucacu

SEQ ID NO: 561073 - RNA, 59 nt, Homo Sapiens
gugggaccccaagugaagacacauccgacaccucccagccccugacuaacagccucagc

SEQ ID NO: 561074 - RNA, 59 nt, Homo Sapiens
agggugaagaguccaagaagggccguaguaccucccagcagccccggcccccugugcag

SEQ ID NO: 561075 - RNA, 64 nt, Homo Sapiens
guuccuguggugugcaaagcauuaugauaggcaccguggggaaacuggaaaugaauuugacaug

SEQ ID NO: 561076 - RNA, 64 nt, Homo Sapiens
uuuuacuuacuuuuauagcauuacugugccuagucguggggaaagagauggggcuguauagauu

SEQ ID NO: 561077 - RNA, 64 nt, Homo Sapiens
ccauuggcauuugggaaccaccccacauccagggcguggggagaaaggggacucuggauagggu

SEQ ID NO: 561078 - RNA, 64 nt, Homo Sapiens
gaggccuggaaaugcggaggccauugugugugugcguggggacaccuuuguacucguguugugu

SEQ ID NO: 561079 - RNA, 64 nt, Homo Sapiens
ucccccauagguggcugagcaucggaguggaguucguggggaacugcguggugcucuuugcugc

SEQ ID NO: 561080 - RNA, 64 nt, Homo Sapiens
ggaaggcagccgcccucccgaagguuggcccccacguggggagguggaguuccggaauuauucu

SEQ ID NO: 561081 - RNA, 64 nt, Homo Sapiens
ccgggaggaaggcgcccggcugcgucugcagaggcggggagaggaggcggcgagggucccgggg

SEQ ID NO: 561082 - RNA, 64 nt, Homo Sapiens
cagcucgcaggccccgggcccggccgcgccuccgcggggagagcaccccggcuucccgcgcgcc

SEQ ID NO: 561083 - RNA, 64 nt, Homo Sapiens
gcuguucccucuccugcccggacuguggccucgccggggagagcgggcgggggagcucgcgccg

SEQ ID NO: 561084 - RNA, 64 nt, Homo Sapiens
ggaagggggcggggcuucccucccgggccgcaugcggggagaggcugcucccuccccuuuuucc

SEQ ID NO: 561085 - RNA, 64 nt, Homo Sapiens
uaagccagugccagcauccagcaugagcagaugucggggagacugggaagucuccagcguuacu

SEQ ID NO: 561086 - RNA, 64 nt, Homo Sapiens
uaagccagugccagcauccagcgugagcagacgucggggagacugggaagucuccgauguuacu

SEQ ID NO: 561087 - RNA, 64 nt, Homo Sapiens
uuugcauugcuggcccagcgccuggccuggggggcggggagaggcagcagaaggggcugggcag

SEQ ID NO: 561088 - RNA, 64 nt, Homo Sapiens
cugggcaggggcgguggaggacucaggaacugcccggggagaguggguauggcggcugagccag

SEQ ID NO: 561089 - RNA, 64 nt, Homo Sapiens
uucuuuuugaaaagacaagccuugggaaucaaagaaaauggaacgaagauucaggaaaaaugca

SEQ ID NO: 561090 - RNA, 64 nt, Homo Sapiens
auggcugcugacuucugacuggcgguccauguugaaaauggagguccaagucuggcugugucca

SEQ ID NO: 561091 - RNA, 64 nt, Homo Sapiens
uaauuuuaaaaucaggaaagacuugguuuuucucaaaauggaaaaaaagguuguuuuaauaucu

SEQ ID NO: 561092 - RNA, 64 nt, Homo Sapiens
uaguuuuagauuugugguaaaaagguguuuguuuaaaauggauaaguuuuauaaccagucuauu

SEQ ID NO: 561093 - RNA, 64 nt, Homo Sapiens
gcuauuacaauuugauaguuauguucagcuuuugaaaauggacguuuccgauuuacaaauguaa

SEQ ID NO: 561094 - RNA, 64 nt, Homo Sapiens
agguguacuuguguuuauguacuccugacguauuaaaauggaauaauacuaaucuuguuaaaag

SEQ ID NO: 561095 - RNA, 64 nt, Homo Sapiens
aauuuuuguaaugacaugacauuacaagaguauaaaaauggacauuaaaucauggccuugcauu

SEQ ID NO: 561096 - RNA, 64 nt, Homo Sapiens
uauaauguauucagacuuugauuacuacuuauuuaaaauggaauguuuuaugguugugcauaug

SEQ ID NO: 561097 - RNA, 64 nt, Homo Sapiens
aauggucauuuuuaaaaaauaauuuccuagaaagaaaauggaaagauaagaauuaaaaggguuu

SEQ ID NO: 561098 - RNA, 64 nt, Homo Sapiens
cacaaggucaguugacacuaaagagacuguauuaaaaauggauaauauuugcccaugcuacagg

SEQ ID NO: 561099 - RNA, 64 nt, Homo Sapiens
aaagguauuucacuggagaaacaagaugcagaacaaaauggauaucccugaauucaggacuucc

SEQ ID NO: 561100 - RNA, 64 nt, Homo Sapiens
aggucaauaaagauauauuuaacugcuuuguaagaaaauggaaaaaggguaagaaugaguuuuu

SEQ ID NO: 561101 - RNA, 64 nt, Homo Sapiens
cuacaaguagggaauguuuucugaagcagaaguuaaaauggacagcauuucuagaauuaacauu

SEQ ID NO: 561102 - RNA, 64 nt, Homo Sapiens
uuaaauuauauagcugggauauuuugccacuguuaaaauggauucagaagagguccuagaaaag

SEQ ID NO: 561103 - RNA, 64 nt, Homo Sapiens
augaaggaaucagauucccuauguaaagcaguuuaaaauggaauucaauguucagugcucaggu

SEQ ID NO: 561104 - RNA, 64 nt, Homo Sapiens
caauaagacacucaaauaugaguacaaaugccuuaaaauggaauugaaaaacucuuuauuuucc

SEQ ID NO: 561105 - RNA, 64 nt, Homo Sapiens
cugacuaucauaaaaucaaaacaagugaaauaacaaaauggacaugguggcuuuguuuagguag

SEQ ID NO: 561106 - RNA, 64 nt, Homo Sapiens
auaaaauaaugcugcaaacuuaauguucuuaugcaaaauggaacgcuaaugaaacacagcuuac

SEQ ID NO: 561107 - RNA, 64 nt, Homo Sapiens
aaagaaagagcagcugccacaauacucauugauuaaaauggaauuagaaaggaaaacuugaauc

SEQ ID NO: 561108 - RNA, 64 nt, Homo Sapiens
uacaaaaacuugcagcaguauuguauguacagagaaaauggacuucccuucaguagugagcagu

SEQ ID NO: 561109 - RNA, 64 nt, Homo Sapiens
cuccuguuugcaggcccagaggagccaagucauuaaaauggaaguggauucuggauggccgggc

SEQ ID NO: 561110 - RNA, 64 nt, Homo Sapiens
ugcugcaaacauuguacauccaaauuaaaggaaaaaaauggaaaccaucaguuguugcugugug

SEQ ID NO: 561111 - RNA, 64 nt, Homo Sapiens
uucuuuuagcaauucaguuuuauaaaacuaguuaaaaauggaauuucucuuccuuuacuuagcc

SEQ ID NO: 561112 - RNA, 64 nt, Homo Sapiens
gggaugaaaauaaugggaguuaccucuuccaugaaaaauggaaaauguaauucaggcuuguguc

SEQ ID NO: 561113 - RNA, 64 nt, Homo Sapiens
auuucaaucaaacauuuccuagcuuggugaaaugaaaauggaacuguauaaacagguugcuaua

SEQ ID NO: 561114 - RNA, 64 nt, Homo Sapiens
ccugaaguagacagaguaguucaggagguuucacaaaauggacuauccucaaauaaucucaauu

SEQ ID NO: 561115 - RNA, 64 nt, Homo Sapiens
ucuuauuauagaauaaccugggauaacgugcauuaaaauggaguauaucucacacauuuguaau

SEQ ID NO: 561116 - RNA, 64 nt, Homo Sapiens
auuaaaaacucaaauugugguccaaggauauaaaaaaauggaaguccggggaucaucacaucag

SEQ ID NO: 561117 - RNA, 64 nt, Homo Sapiens
uuggggaaaacauuuuuuaucauuuucuauuaagaaaauggaaaacuuaaauaugguguuaaaa

SEQ ID NO: 561118 - RNA, 64 nt, Homo Sapiens
uauuaagaaaauggaaaacuuaaauaugguguuaaaaauggaaauauaugugauauuugcauua

SEQ ID NO: 561119 - RNA, 64 nt, Homo Sapiens
uuuaaugaacuauaccuguuaaguuccaaaggucaaaauggaggcauuugcugucuaauauuca

SEQ ID NO: 561120 - RNA, 64 nt, Homo Sapiens
ucuuucuacuaauguaaauuugagauuauuuuuaaaaauggaauaaaagagguuuuggucauuu

SEQ ID NO: 561121 - RNA, 64 nt, Homo Sapiens
augaccccucucuccccaguauuaucuuacuugcaaaauggagaccaaauucuauccugugagg

SEQ ID NO: 561122 - RNA, 64 nt, Homo Sapiens
cuuugaaguaaaaccuuuuuucuugcuacugaaaaaaauggaguuguuuugggugguaaagugu

SEQ ID NO: 561123 - RNA, 64 nt, Homo Sapiens
cagcaugacugguucugggagaaggugagagacaaaaauggaaagauccuggccugugguagug

SEQ ID NO: 561124 - RNA, 64 nt, Homo Sapiens
ugaaaugaaagcuacaaauacaugugagaagaaaaaaauggauuuuuuuagcaaauaauuaacu

SEQ ID NO: 561125 - RNA, 64 nt, Homo Sapiens
gauggcagugguuugaaaaacuaaaacagaaaaaaaaauggaagccaacacaucacucauuuua

SEQ ID NO: 561126 - RNA, 64 nt, Homo Sapiens
uucccuuugauacagucaacaagccugacccuguaaaauggagguggaaagacaagcucaagug

SEQ ID NO: 561127 - RNA, 64 nt, Homo Sapiens
ugugcucugagugccuagcggaguuccagcaaacaaaauggacucaagagagauuugauuaaug

SEQ ID NO: 561128 - RNA, 64 nt, Homo Sapiens
guuaacugaauggaauuaaauuuuuuaaacuaacaaaauggaauucuauuaauaauucccccaa

SEQ ID NO: 561129 - RNA, 64 nt, Homo Sapiens
auguuuucucucaaauuuccauaaucuauuaaaaaaaauggagaauugaaaaauuaauauuucu

SEQ ID NO: 561130 - RNA, 64 nt, Homo Sapiens
uuuuucuuucuuuacugcaugcauagcacuuaauaaaauggauuuuuaaaaaauccacuaguaa

SEQ ID NO: 561131 - RNA, 64 nt, Homo Sapiens
aaauacucuucagauccuauguagucagugaaacaaaauggagagcguauucugauagaaggac

SEQ ID NO: 561132 - RNA, 64 nt, Homo Sapiens
uauagaugcuauuguucugauggcccggcugaauaaaauggaaauucuaguuuguuagaauuau

SEQ ID NO: 561133 - RNA, 64 nt, Homo Sapiens
aaagguuuuaaucauucuucuauaaaauacauuuaaaauggaaaaauacuuaauaucacuaaau

SEQ ID NO: 561134 - RNA, 64 nt, Homo Sapiens
gcugcuuuugacaauaaugcaaaagagccuaugaaaaauggacacuacgaucuugcaguuaucc

SEQ ID NO: 561135 - RNA, 64 nt, Homo Sapiens
gauggagagaucaaacgacugagaaaugcaauccaaaauggaaauagucuuccccagcuaaaaa

SEQ ID NO: 561136 - RNA, 64 nt, Homo Sapiens
uggggauggggaaacaugcaguagaacucaucuaaaaauggauuacaaucuugaacauuuuaca

SEQ ID NO: 561137 - RNA, 64 nt, Homo Sapiens
uuuuuccaguuaaaauauugugacaaaccagagaaaaauggaccaauaaaggaaccuuuuauac

SEQ ID NO: 561138 - RNA, 64 nt, Homo Sapiens
accucuugacuagguuaucaccaugcaauggaaaaaaauggacauucuggggaaagaauaguaa

SEQ ID NO: 561139 - RNA, 64 nt, Homo Sapiens
auuccaaagcaagggcaaggcaaggcuacuuggaaaaauggaugaguuugccacuaaaaggaac

SEQ ID NO: 561140 - RNA, 64 nt, Homo Sapiens
auuuauagacagauaauuuauagacaguuaaguaaaaauggauauuuauagacaguuaaauuua

SEQ ID NO: 561141 - RNA, 64 nt, Homo Sapiens
caucuucuauguagcugugauaucucaucuuucuaaaauggaacuuguuaaaaaguguucaaac

SEQ ID NO: 561142 - RNA, 64 nt, Homo Sapiens
uucccagaucucaguaaacagccacucagccuugaaaauggaguguuguuguuucuaaacauau

SEQ ID NO: 561143 - RNA, 64 nt, Homo Sapiens
cagcuagaaggauugcaagguagauuuuuguuuuaaaauggagagaaguggacagauaaggcca

SEQ ID NO: 561144 - RNA, 64 nt, Homo Sapiens
uuagaacacacacgacuuuuuauuccuccauugcaaaauggaaucaagauacuacacaagaccu

SEQ ID NO: 561145 - RNA, 64 nt, Homo Sapiens
uucucaucugccggcauuauacuuuggcgcuguuaaaauggaaugagcagaaccaagagaggaa

SEQ ID NO: 561146 - RNA, 64 nt, Homo Sapiens
uuguagguggaguuccugaccaaggauuccucccaaaauggagucuaggucaaauugggugucu

SEQ ID NO: 561147 - RNA, 64 nt, Homo Sapiens
aucagugguuccaagauuucaaaguggugaaaugaaaauggagcagcuaguauguuuuauuauu

SEQ ID NO: 561148 - RNA, 64 nt, Homo Sapiens
cgccauguuccuuccacuaaaguagaggguucuuaaaauggaaaaaccugugggcucuucauau

SEQ ID NO: 561149 - RNA, 64 nt, Homo Sapiens
gugaauuuuuaaaauauaugcacuuuaaaauaguaaaauggaaaauggaaaagaauuuuacaug

SEQ ID NO: 561150 - RNA, 64 nt, Homo Sapiens
agaauuuuacaugcacuuuauaauuaccuaccaaaaaauggaaauguauuucccuucuucaaau

SEQ ID NO: 561151 - RNA, 64 nt, Homo Sapiens
cggggggccacauagaagccugccaaacucuaauaaaauggaguaaccaaaauggagucacuua

SEQ ID NO: 561152 - RNA, 64 nt, Homo Sapiens
cacuuaugccaaacucuaauaaguugcuggaaccaaaauggagugccucaguuuccuuauguga

SEQ ID NO: 561153 - RNA, 64 nt, Homo Sapiens
gagccaucccuucccuguccccccacuuuccuacaaaauggaggugaagaaucaagagggcagc

SEQ ID NO: 561154 - RNA, 64 nt, Homo Sapiens
guuggagacguguauccccgagauccauuuggacaaaauggaagaagagaaaauaaaccaagau

SEQ ID NO: 561155 - RNA, 64 nt, Homo Sapiens
gauuaguauggccuauuuuugauaagaacuuuugaaaauggaagggcaguuuuuggaauuacuu

SEQ ID NO: 561156 - RNA, 64 nt, Homo Sapiens
ccuuguucuugcacaacuguguuauuugguuaugaaaauggaaucacauaaaauguuuuauuuu

SEQ ID NO: 561157 - RNA, 64 nt, Homo Sapiens
ccuugcaacuuccuucuccacuaacccaggacuaaaaauggacaggcugaccucaguguuuaca

SEQ ID NO: 561158 - RNA, 64 nt, Homo Sapiens
gagaugauaauauauuauguauuugaauuccugaaaaauggaaaauguuuaagauauauguaua

SEQ ID NO: 561159 - RNA, 64 nt, Homo Sapiens
uuaugugguaauaucagugauauuucgaacugugaaaauggacuuaauaauuagaccauuucua

SEQ ID NO: 561160 - RNA, 64 nt, Homo Sapiens
cugagaaagcuuaagaccugcuucaaaagccugaaaaauggaaaaauaaaauuguuuucagaua

SEQ ID NO: 561161 - RNA, 64 nt, Homo Sapiens
ggcagaugcuagaaucccccuacuucucucaacaaaaauggaaggcauuugagagaucagcuaa

SEQ ID NO: 561162 - RNA, 64 nt, Homo Sapiens
uaugguguaaaagcaacaggauauauauuuuuggaaaauggagcaaauauauauauguacauac

SEQ ID NO: 561163 - RNA, 64 nt, Homo Sapiens
uuucccaccauucacugacugccuuagucuauagaaaauggacucuuugcagaaaaagugugcu

SEQ ID NO: 561164 - RNA, 64 nt, Homo Sapiens
uaaaagugaagugguaaauaauguacuaguuguuaaaauggaaauuuuccuaaggccaaggaua

SEQ ID NO: 561165 - RNA, 64 nt, Homo Sapiens
acuuuuguaacuuaccuguugacugaugaaaaguaaaauggacuacuuguucaaaacagggaaa

SEQ ID NO: 561166 - RNA, 64 nt, Homo Sapiens
cccuuaaaggugcuuugauaaauacuacuuucucaaaauggaagcuaaaagagaaggaagagaa

SEQ ID NO: 561167 - RNA, 64 nt, Homo Sapiens
caugguuaaaggauagaaggccccaucaaaaaaaaaaauggauagggaguguguaccccuuacu

SEQ ID NO: 561168 - RNA, 64 nt, Homo Sapiens
uccagguagauguaauucacggauuuaaaagacaaaaauggaggacuuggcacagcgaaaaaau

SEQ ID NO: 561169 - RNA, 64 nt, Homo Sapiens
uaaaagacaaaaauggaggucuuggcacagcgaaaaaauggauuagaaucagauguguaauaua

SEQ ID NO: 561170 - RNA, 64 nt, Homo Sapiens
ucuuucuccuguuuguuugcuuguuaguuuguuuaaaauggaaaaagggguucucuguguucug

SEQ ID NO: 561171 - RNA, 64 nt, Homo Sapiens
cuucaagggugauaggaaccauuauguugagcccaaaauggaaguaauaauaaaugccuccugg

SEQ ID NO: 561172 - RNA, 64 nt, Homo Sapiens
uaugagggggaaaaaucacuaacaugaaaggcaaaaaauggacuaugauuccuguggggaaaca

SEQ ID NO: 561173 - RNA, 64 nt, Homo Sapiens
auuuuucaggccagacauagcuuccuaaugaaagaaaauggaaauguaauucgacgacuccuca

SEQ ID NO: 561174 - RNA, 64 nt, Homo Sapiens
acaaaaaucugaaagaaacgcaaaugcaauuuuuaaaauggaaacacaaaccuccaaguagcuc

SEQ ID NO: 561175 - RNA, 64 nt, Homo Sapiens
caccucaccuccgcagcacccuuccucaguuuccaaaauggaaccccaggucuuccaagcucug

SEQ ID NO: 561176 - RNA, 64 nt, Homo Sapiens
gcuggcuagaaauuggucuguagaaaugaccuugaaaauggaguucuggccaggugcgguggcu

SEQ ID NO: 561177 - RNA, 64 nt, Homo Sapiens
ucuuaaaaaaaaaaaaaaaaaaaagaaagaaaagaaaauggaguucugagagcuaggaaacugg

SEQ ID NO: 561178 - RNA, 64 nt, Homo Sapiens
aaucagcaggacaugggcggaaucagcgcucuguaaaauggaccagcacucuguaagauggacc

SEQ ID NO: 561179 - RNA, 64 nt, Homo Sapiens
aaucagcacucuguaagauguacaagaggauuguaaaauggaccccuggagaacuuuucugucu

SEQ ID NO: 561180 - RNA, 64 nt, Homo Sapiens
aggagguacuaagugcaaugucuuagcauucugcaaaauggagaucuguuguccagcggcuuau

SEQ ID NO: 561181 - RNA, 64 nt, Homo Sapiens
cuuuccaagcagucucuggugcuuuucuucucucaaaauggauccgauaaauauuugaauagag

SEQ ID NO: 561182 - RNA, 64 nt, Homo Sapiens
acuucuuugcaugcguuuaagucaguuuauacacaaaauggauuuuauuuuuuaguuuaacugu

SEQ ID NO: 561183 - RNA, 64 nt, Homo Sapiens
ucggagccauucauucggagaaaacguuuugaucaaaauggagacuuuuguagucguuucaaaa

SEQ ID NO: 561184 - RNA, 64 nt, Homo Sapiens
cguacaaagccuauccguguucuuccacugacccaaaauggaacgucauuuguguugugaaaau

SEQ ID NO: 561185 - RNA, 64 nt, Homo Sapiens
uuauggagcuucaagaaucgcugcucauaauaggaaaauggaugcaucugcauguuuauuuccu

SEQ ID NO: 561186 - RNA, 64 nt, Homo Sapiens
aaugcuaauugauaauauaaauacccccugcuuaaaaauggacaaaaagaaacuauaauguaau

SEQ ID NO: 561187 - RNA, 64 nt, Homo Sapiens
acacccaccccuuauuuuccguaaauacacacacaaaauggaucgcaucugugugacuaauggu

SEQ ID NO: 561188 - RNA, 64 nt, Homo Sapiens
uuggacaacuacuguaaucauuuuuuuuuuaggaaaaauggaaggugccggggguaaucauggc

SEQ ID NO: 561189 - RNA, 64 nt, Homo Sapiens
ggguaguaauuacauugugguauuaauauuuagaaaaauggaccucagcaguguauuuacugua

SEQ ID NO: 561190 - RNA, 64 nt, Homo Sapiens
gccaccacuuagguuccaugauugaggaacauggaaaauggaggaggauagguucuuuggguaa

SEQ ID NO: 561191 - RNA, 64 nt, Homo Sapiens
aggauagguucuuuggguaaguuguguccuuuaaaaaauggaggggaaucauuuuuggugaacu

SEQ ID NO: 561192 - RNA, 64 nt, Homo Sapiens
uacucauauacaggguggaauaaauggauggauaaaaauggaauaaagugagaaguaauuauug

SEQ ID NO: 561193 - RNA, 64 nt, Homo Sapiens
cuuuuugacgaucacuuauauguagaaaucauugaaaauggaucggagaauacauauaauaugg

SEQ ID NO: 561194 - RNA, 64 nt, Homo Sapiens
gcuuucuaccuaaauuuauuaguuauauguucacaaaauggaagaauuuuauuggagaaaagca

SEQ ID NO: 561195 - RNA, 64 nt, Homo Sapiens
caugaugaagauauagucaccuucggaagaaaugaaaauggaaacaaguuagauuuuccuggag

SEQ ID NO: 561196 - RNA, 64 nt, Homo Sapiens
gcucugaauaggcacucucugaugugauuacuuaaaaauggaauuggguagugugaccuguuug

SEQ ID NO: 561197 - RNA, 64 nt, Homo Sapiens
aauugggugagccuuggagacugaggauuuugacaaaauggauuuccucuaccucauacuuccu

SEQ ID NO: 561198 - RNA, 64 nt, Homo Sapiens
ccaaucugagaaaaggcaaaccuaauaugaaagaaaaauggaucgcaaauggaaaacaggagau

SEQ ID NO: 561199 - RNA, 64 nt, Homo Sapiens
gaauacaauaacuacuacaguuuggacaaucugcaaaauggagauggagucaaaaggcaaauca

SEQ ID NO: 561200 - RNA, 64 nt, Homo Sapiens; identical to SEQ ID NO: 158079

SEQ ID NO: 561201 - RNA, 64 nt, Homo Sapiens; identical to SEQ ID NO: 158080

SEQ ID NO: 561202 - RNA, 64 nt, Homo Sapiens; identical to SEQ ID NO: 158081

SEQ ID NO: 561203 - RNA, 64 nt, Homo Sapiens; identical to SEQ ID NO: 158082

SEQ ID NO: 561204 - RNA, 64 nt, Homo Sapiens; identical to SEQ ID NO: 158083

SEQ ID NO: 561205 - RNA, 64 nt, Homo Sapiens; identical to SEQ ID NO: 158084

SEQ ID NO: 561206 - RNA, 64 nt, Homo Sapiens; identical to SEQ ID NO: 158085

SEQ ID NO: 561207 - RNA, 64 nt, Homo Sapiens; identical to SEQ ID NO: 158086

SEQ ID NO: 561208 - RNA, 64 nt, Homo Sapiens; identical to SEQ ID NO: 158087

SEQ ID NO: 561209 - RNA, 64 nt, Homo Sapiens; identical to SEQ ID NO: 298090

SEQ ID NO: 561210 - RNA, 64 nt, Homo Sapiens; identical to SEQ ID NO: 298091

SEQ ID NO: 561211 - RNA, 64 nt, Homo Sapiens; identical to SEQ ID NO: 298092

SEQ ID NO: 561212 - RNA, 64 nt, Homo Sapiens; identical to SEQ ID NO: 298093

SEQ ID NO: 561213 - RNA, 64 nt, Homo Sapiens; identical to SEQ ID NO: 298094

SEQ ID NO: 561214 - RNA, 64 nt, Homo Sapiens; identical to SEQ ID NO: 298095

SEQ ID NO: 561215 - RNA, 64 nt, Homo Sapiens; identical to SEQ ID NO: 298096

SEQ ID NO: 561216 - RNA, 64 nt, Homo Sapiens; identical to SEQ ID NO: 298097

SEQ ID NO: 561217 - RNA, 64 nt, Homo Sapiens; identical to SEQ ID NO: 298098

SEQ ID NO: 561218 - RNA, 64 nt, Homo Sapiens; identical to SEQ ID NO: 298099

SEQ ID NO: 561219 - RNA, 64 nt, Homo Sapiens; identical to SEQ ID NO: 298100

SEQ ID NO: 561220 - RNA, 64 nt, Homo Sapiens; identical to SEQ ID NO: 298101

SEQ ID NO: 561221 - RNA, 64 nt, Homo Sapiens; identical to SEQ ID NO: 298102

SEQ ID NO: 561222 - RNA, 64 nt, Homo Sapiens; identical to SEQ ID NO: 298103

SEQ ID NO: 561223 - RNA, 64 nt, Homo Sapiens; identical to SEQ ID NO: 298104

SEQ ID NO: 561224 - RNA, 64 nt, Homo Sapiens; identical to SEQ ID NO: 298105

SEQ ID NO: 561225 - RNA, 64 nt, Homo Sapiens; identical to SEQ ID NO: 298106

SEQ ID NO: 561226 - RNA, 64 nt, Homo Sapiens; identical to SEQ ID NO: 298107

SEQ ID NO: 561227 - RNA, 64 nt, Homo Sapiens; identical to SEQ ID NO: 298108

SEQ ID NO: 561228 - RNA, 64 nt, Homo Sapiens; identical to SEQ ID NO: 298109

SEQ ID NO: 561229 - RNA, 64 nt, Homo Sapiens; identical to SEQ ID NO: 298110

SEQ ID NO: 561230 - RNA, 64 nt, Homo Sapiens; identical to SEQ ID NO: 298111

SEQ ID NO: 561231 - RNA, 63 nt, Homo Sapiens
cccagcugccccagcacgcgggacccauagcacaccccuuagcgcuugccuagguugcugaaa

SEQ ID NO: 561232 - RNA, 63 nt, Homo Sapiens
aucugcuuauucuucagcuucaccucugcacuaaccccuuacccuuaugguacgucaggauuu

SEQ ID NO: 561233 - RNA, 63 nt, Homo Sapiens
ccauauaaacuauuuucacagaucucaacuaaaaccccuuacuucacaaaugauuguguugug

SEQ ID NO: 561234 - RNA, 63 nt, Homo Sapiens
ugccugugcuugaagguugcuguagagcaucugaccccuuauuaccaccuuaagcaauguaua

SEQ ID NO: 561235 - RNA, 63 nt, Homo Sapiens
uuccucuaguacuaccaguauucauaaauguauaccccuuacuguaauuuguuccucuuagaa

SEQ ID NO: 561236 - RNA, 63 nt, Homo Sapiens
aauguaagucuagcuaccuauccaauacuaaauaccccuuaaaguauuaaaugcacuaucugc

SEQ ID NO: 561237 - RNA, 63 nt, Homo Sapiens
ucugaaacaagggucacacuacucagagggauaaccccuuacaguggucugaggaguaacuau

SEQ ID NO: 561238 - RNA, 63 nt, Homo Sapiens
aauuguucccaaaugaaaacuuguuuuaaguccaccccuuaguuuccuuauuuuacaaggucu

SEQ ID NO: 561239 - RNA, 63 nt, Homo Sapiens
ccaucggccaugugggaggugaacauggccacuaccccuuaucuuugagaucgugcuggggag

SEQ ID NO: 561240 - RNA, 63 nt, Homo Sapiens
gaauucaacucaagguuugacaaaagccaaauaaccccuuauggugcuuuucuuuacaggauu

SEQ ID NO: 561241 - RNA, 63 nt, Homo Sapiens
cuuaagaauagugcuuguuugaguaaaacccuuaccccuuauucauaagagaagcaaaucuga

SEQ ID NO: 561242 - RNA, 63 nt, Homo Sapiens
ucugucugagaauuaugguuggcaugggcuccaaccccuuagcaacagcagggugacuuuaga

SEQ ID NO: 561243 - RNA, 63 nt, Homo Sapiens
gcaguugguagaaggaaugggcugccucuccccaccccuuaaaaacuccuuguucuccccucu

SEQ ID NO: 561244 - RNA, 63 nt, Homo Sapiens
ugagggagucagcacaguccaagcgguaguaccaccccuuagucgucagcugcugagaggagc

SEQ ID NO: 561245 - RNA, 63 nt, Homo Sapiens
aauaagcacuccuugcagaggaaauaauuaccaaccccuuagcauuuccuacgucuguucacu

SEQ ID NO: 561246 - RNA, 63 nt, Homo Sapiens
cugggaacccaccgcaggugcgcucuccgcuccaccccuuagccgcgcugcuacagagcuuca

SEQ ID NO: 561247 - RNA, 63 nt, Homo Sapiens
gcugugguuuacaacuuuucuggugcccuguuaaccccuuaaaccaagcuaggaacaucagcc

SEQ ID NO: 561248 - RNA, 63 nt, Homo Sapiens
agaugugguuucaaaguaaaggccuccucccccaccccuuaggccccguggugacauuuccca

SEQ ID NO: 561249 - RNA, 63 nt, Homo Sapiens
aggcugacuuguugacugaagccuuuuucccagaccccuuauuucgaauccccaagcuucagu

SEQ ID NO: 561250 - RNA, 63 nt, Homo Sapiens
agacccccgccagacagacucccaaccagacugaccccuuacuauucacacagccugccgagu

SEQ ID NO: 561251 - RNA, 63 nt, Homo Sapiens
agugagaaaucuuuacaguugacaggaaccuggaccccuuaccccaacuuuaugaguaaugcu

SEQ ID NO: 561252 - RNA, 63 nt, Homo Sapiens
uagauugagcuuagauugccucucuagacaacuaccccuuaguuauaauucuguguccccucu

SEQ ID NO: 561253 - RNA, 63 nt, Homo Sapiens
cagcugcuuugcacaaagguccuucuuguccacaccccuuauccccaggcuggugccccggga

SEQ ID NO: 561254 - RNA, 63 nt, Homo Sapiens
ggagauggagaccauccuggcuaacacggugaaaccccuuaucuaugcgccuguagucccagc

SEQ ID NO: 561255 - RNA, 63 nt, Homo Sapiens
uccaccuuagugccagggcccucucccugcccuaccccuuaacagaccuguugcugcauagaa

SEQ ID NO: 561256 - RNA, 63 nt, Homo Sapiens
acucucccuacuagcuggaacauugcuuuauaaaccccuuagagagagccuucagccaaaccu

SEQ ID NO: 561257 - RNA, 63 nt, Homo Sapiens
cuacacugaacacuaaagaagaagauuaacccaaccccuuacaccagucacauccauuuugug

SEQ ID NO: 561258 - RNA, 63 nt, Homo Sapiens
auacuguuauauccucaacuuggauuuaugguaaccccuuauaguucauggagaccaaaauuu

SEQ ID NO: 561259 - RNA, 63 nt, Homo Sapiens
ucuacucggucauucuccccauuuccauccauuaccccuuagccauugagacuaaaggaaaua

SEQ ID NO: 561260 - RNA, 63 nt, Homo Sapiens
cuacaacauaaauaauuugaguuuaggugauccaccccuuaauuguacccccgaugguauauu

SEQ ID NO: 561261 - RNA, 63 nt, Homo Sapiens
caaacuacuuacuugcucuaaacaguuacuuguaccccuuaaccugucuucaaaaguugcaua

SEQ ID NO: 561262 - RNA, 63 nt, Homo Sapiens
aaaaucgucucucccucccuuugaaaugaauauaccccuuaguguuuggguauauucauuuca

SEQ ID NO: 561263 - RNA, 63 nt, Homo Sapiens
ccuuuugucucugggaccagacuuguuggugcuaccccuuacuccccucugcaacccccauuu

SEQ ID NO: 561264 - RNA, 63 nt, Homo Sapiens
cagcuccucugguggaaucccuaucaagcuccaaccccuuauacagaaaaaccagcuuaucau

SEQ ID NO: 561265 - RNA, 63 nt, Homo Sapiens
gagaagcauauauggccacaccagcccuuugaaaccccuuagaggcaugcauuuugcauuggu

SEQ ID NO: 561266 - RNA, 63 nt, Homo Sapiens
uaucaugccuuuguucucuuucuccaaccaaggaccccuuauuaaaauguucuggaugcauca

SEQ ID NO: 561267 - RNA, 63 nt, Homo Sapiens
cugcagcagcucacaggcugcccaucuucaaugaccccuuaaugguuuucccuuggccacuag

SEQ ID NO: 561268 - RNA, 63 nt, Homo Sapiens
ggugcuuaauucuguugaaaggagcauuuuuacaccccuuaaguuuacacuguugggaguaaa

SEQ ID NO: 561269 - RNA, 63 nt, Homo Sapiens
gauguauuucauggcacugcaaucacuuaagaaaccccuuauuggaaaagcugacacccagac

SEQ ID NO: 561270 - RNA, 63 nt, Homo Sapiens
aagucuucugcaaacccauucaauaaaacaaauaccccuuagauuaccacauaaucuuuuaaa

SEQ ID NO: 561271 - RNA, 63 nt, Homo Sapiens
agaaggaugcccagacaucagccuccuucuuucaccccuuaccccaaagagaaagaguuugaa

SEQ ID NO: 561272 - RNA, 63 nt, Homo Sapiens
guuuucccucaugcgauuaccugugccuuugagaccccuuaagugcccacuguuucuuccuuu

SEQ ID NO: 561273 - RNA, 63 nt, Homo Sapiens
cagcugugagguggcuucagcggaagucugcugaccccuuauauuccccgagaguauaaagag

SEQ ID NO: 561274 - RNA, 63 nt, Homo Sapiens
gccuugaaaaucacaucaaguaguuaauuaucuaccccuuaccuguguuuauaacuuccaggu

SEQ ID NO: 561275 - RNA, 50 nt, Homo Sapiens; identical to SEQ ID NO: 165317

SEQ ID NO: 561276 - RNA, 63 nt, Homo Sapiens
cacuuaucucaucacagagcccccucuugguucaccccuuacucaggcacuccaagugaacca

SEQ ID NO: 561277 - RNA, 63 nt, Homo Sapiens
gugcaaccacugaggcaaagucaucuacccucuaccccuuacuuucucaggguguucuugucc

SEQ ID NO: 561278 - RNA, 63 nt, Homo Sapiens
agugcaagcuuauuuaucucaacuuaacaugccaccccuuagcacagugcauuuucaauaucu

SEQ ID NO: 561279 - RNA, 63 nt, Homo Sapiens
guuccuggggcaggcggaaaaaaacguuuucaaaccccuuacaccucccuucccgaccccaac

SEQ ID NO: 561280 - RNA, 63 nt, Homo Sapiens
uuaugucaccucagcccucaucucaaugcccaaaccccuuacacacaccuucaguuagcuuca

SEQ ID NO: 561281 - RNA, 63 nt, Homo Sapiens
agcccagauguucaguucucuuggccccucucuaccccuuacugggauccgguuuucauuuuc

SEQ ID NO: 561282 - RNA, 63 nt, Homo Sapiens
auauuugggauaucuauugaagaaaaaaagaaaaccccuuaaagauaauguacaugcuucaug

SEQ ID NO: 561283 - RNA, 63 nt, Homo Sapiens
uagccugguuuuaugugacacugauacacacacaccccuuauaugggacuaauuuuacacuuu

SEQ ID NO: 561284 - RNA, 63 nt, Homo Sapiens
auucccucuacuguguggaacagccagaucaccaccccuuacacauuccaccacagugccccu

SEQ ID NO: 561285 - RNA, 63 nt, Homo Sapiens
ugucuucauaauaguccuauggguaguccagacaccccuuagauagagaccuguugguugcua

SEQ ID NO: 561286 - RNA, 63 nt, Homo Sapiens
ggcaugucaacuccuguacuguuuacuguuuacaccccuuauugcagcgugaguagcucuuuu

SEQ ID NO: 561287 - RNA, 63 nt, Homo Sapiens
gcauuuuucucaaugcagaaauacauuucucucaccccuuaauauauaaaugcauuauuacac

SEQ ID NO: 561288 - RNA, 63 nt, Homo Sapiens
uaaaaaauguggcaacacuuuuaauaaaugcucaccccuuauugcacaggaaagcauuuauac

SEQ ID NO: 561289 - RNA, 63 nt, Homo Sapiens
gguaucuccaggauugaagagcauugcauggacaccccuuauccaggacucugucaauuuccc

SEQ ID NO: 561290 - RNA, 63 nt, Homo Sapiens
uuucuaaguacccauuucuuuccuauuuaaagaaccccuuagguuuuauauauuuuuucugac

SEQ ID NO: 561291 - RNA, 63 nt, Homo Sapiens
cuagguaaauugacagaaauguccagagccaggaccccuuaauucccagccccuucucccagg

SEQ ID NO: 561292 - RNA, 63 nt, Homo Sapiens
auuaccauguuuuuuuuuuuaacuuauucacagaccccuuauagugaaagcagcuuuuaguuu

SEQ ID NO: 561293 - RNA, 63 nt, Homo Sapiens
uuuaaaauacuuugcgccuucuuggccucccaaaccccuuauuuucuacagaauaggucagau

SEQ ID NO: 561294 - RNA, 63 nt, Homo Sapiens
uggcagcccuucccuagcacacugguggaagagaccccuuaagaaccugaccccagugaauga

SEQ ID NO: 561295 - RNA, 63 nt, Homo Sapiens
gccccuuccccagaccccucuccagucuccugcaccccuuagcccucccugcuuugccuggcc

SEQ ID NO: 561296 - RNA, 63 nt, Homo Sapiens
uagcaugcacaaaguguauuggagagagccuauaccccuuacuugaaacauagagggagagag

SEQ ID NO: 561297 - RNA, 63 nt, Homo Sapiens
cguuuaaaauaaaauaugcaaccaguuuguccuaccccuuaagauguauccagauuuaaaccu

SEQ ID NO: 561298 - RNA, 63 nt, Homo Sapiens
uuuuggauugucggauuuccucccucacaugauaccccuuaucuuuuauaaugucuuaugccu

SEQ ID NO: 561299 - RNA, 63 nt, Homo Sapiens
acuuggaaggggccuggucugucaacuaguccaaccccuuaaaauucauagaggagcaaacug

SEQ ID NO: 561300 - RNA, 63 nt, Homo Sapiens
uacuaaaaauacaaaaauuaccaacauggcaaaaccccuuauuggaguucgagagcagccugg

SEQ ID NO: 561301 - RNA, 63 nt, Homo Sapiens
gacucugcggcccuccaggacggacaccgggugaccccuuagggcacccaggcaagaucccua

SEQ ID NO: 561302 - RNA, 63 nt, Homo Sapiens
uuuguugcacugaaauggaauucccaugccccuaccccuuaccccaguuuuuugaacauggaa

SEQ ID NO: 561303 - RNA, 63 nt, Homo Sapiens
aaauacuaagugguuuucuugcucccacucccuaccccuuaguuaaauaggguuuauuuucca

SEQ ID NO: 561304 - RNA, 63 nt, Homo Sapiens
uauugaauacuuacauucucuaauaagaaaaccaccccuuagauugaaguaaacugcaguccu

SEQ ID NO: 561305 - RNA, 63 nt, Homo Sapiens
uaaggaguguaguuauaauagaaaugcuaauuuaccccuuaccgucuggugucuucagcuccu

SEQ ID NO: 561306 - RNA, 63 nt, Homo Sapiens
agagccaugacagccuacagaggcccauccuauaccccuuauuagcaaggaucuggccuggag

SEQ ID NO: 561307 - RNA, 63 nt, Homo Sapiens
acaccugcucgucccauuuacagccaugcggccaccccuuagccaaccccauugucagcaccc

SEQ ID NO: 561308 - RNA, 63 nt, Homo Sapiens
auuucucacuuacaauuucuugaauuuuuucucaccccuuauuaguaucaauauuucugucau

SEQ ID NO: 561309 - RNA, 63 nt, Homo Sapiens
cucuuuggucuuacacauccaugacaucuuuaaaccccuuacaucccucuacgucucucuaga

SEQ ID NO: 561310 - RNA, 63 nt, Homo Sapiens
ucuugaacagguauuacaaaggaagaaaacuucaccccuuauccuuaacauauauaguauauu

SEQ ID NO: 561311 - RNA, 63 nt, Homo Sapiens
aaacagacacaucaacgcaccccacucacagacaccccuuaccccacccccacuguacagaga

SEQ ID NO: 561312 - RNA, 63 nt, Homo Sapiens
ugucaacaggaguuaacugaaacuuuuuauuguaccccuuaaucacagugaagcaaaggacac

SEQ ID NO: 561313 - RNA, 63 nt, Homo Sapiens
ccggacaggaugaauggaucauacacugggaccaccccuuaccccccuuuuuaugccccaccg

SEQ ID NO: 561314 - RNA, 63 nt, Homo Sapiens
cuggugaucaggaaagcccgcagcggcugggucaccccuuacgagcccccuucccuggcucug

SEQ ID NO: 561315 - RNA, 63 nt, Homo Sapiens
cuccaaggccugaugugagccuucuguucagacaccccuuaugaggauuccgccgcuggaagc

SEQ ID NO: 561316 - RNA, 63 nt, Homo Sapiens
ggaaacacgagaucaguaguagaugccaagggcaccccuuaaucugguuacggcccaggggga

SEQ ID NO: 561317 - RNA, 63 nt, Homo Sapiens
gaauuuguuuugugauuaguucgccccuuccccaccccuuaccagauguuaagcagcuaugaa

SEQ ID NO: 561318 - RNA, 61 nt, Homo Sapiens; identical to SEQ ID NO: 165360

SEQ ID NO: 561319 - RNA, 63 nt, Homo Sapiens
acaaagcgaauaggcaguuagcacagcacagcuaccccuuaccaagcagucuauggaaacaac

SEQ ID NO: 561320 - RNA, 63 nt, Homo Sapiens
ucaggcacccggggccagagacauaugggccauaccccuuaaccccgggaugcaagguagcau

SEQ ID NO: 561321 - RNA, 63 nt, Homo Sapiens
ugaacuagugccuuuggguacuuuuucagccacaccccuuauguacacaauggcuuuguuuug

SEQ ID NO: 561322 - RNA, 63 nt, Homo Sapiens
acucccccgauuauucugcccugccaggaagccaccccuuagcacggucuccagcuccccuuu

SEQ ID NO: 561323 - RNA, 63 nt, Homo Sapiens
caccaugaccccaucagguuccuccacugccccaccccuuagaccuugacugcagagcagguu

SEQ ID NO: 561324 - RNA, 63 nt, Homo Sapiens
ucuugauuucccuuaaacgauggauuuggaucgaccccuuacaucccucccucacuuucacug

SEQ ID NO: 561325 - RNA, 56 nt, Homo Sapiens; identical to SEQ ID NO: 165367

SEQ ID NO: 561326 - RNA, 63 nt, Homo Sapiens
cuacuggccuugucaacauacagacuucaaaauaccccuuaugagaauccaaagaaugaugug

SEQ ID NO: 561327 - RNA, 63 nt, Homo Sapiens
uacacuguaugaucaacauaacugacuuguucaaccccuuaguauacagcaacaaucauugcu

SEQ ID NO: 561328 - RNA, 63 nt, Homo Sapiens
uagcucccuccuugaaacaaccgaaagggccugaccccuuacuauaacugugagcucgcacaa

SEQ ID NO: 561329 - RNA, 63 nt, Homo Sapiens
ccccaucaaaaaaaaaaaugguagggaguguguaccccuuacuaaaaaguuugugacauugua

SEQ ID NO: 561330 - RNA, 63 nt, Homo Sapiens
gccagcagcuuccuccuucagccaccuggccauaccccuuaaauaagccccucaccuugcugc

SEQ ID NO: 561331 - RNA, 63 nt, Homo Sapiens
guggucaaguaccuaagguagaaaugccacaaaaccccuuaaaauaaagagauuuugauuuuu

SEQ ID NO: 561332 - RNA, 63 nt, Homo Sapiens
cuugcuuucuuuagaauuuuguuuucuuugaggaccccuuaauccucuccauuuuagcccagu

SEQ ID NO: 561333 - RNA, 63 nt, Homo Sapiens
caaaaagguguguuuucuuucucuaacuuccucaccccuuaaccucccuguuucucaugcuuu

SEQ ID NO: 561334 - RNA, 63 nt, Homo Sapiens
uccaagaggggcccagcauuguauuucccugugaccccuuacucuccuggccagaacuugagc

SEQ ID NO: 561335 - RNA, 63 nt, Homo Sapiens
cgggcccagcucaagcccccuuccuugcucuggaccccuuagguauacccuggaagagcuggg

SEQ ID NO: 561336 - RNA, 63 nt, Homo Sapiens
ccccuguuuucagggaccucugccuucucccacaccccuuacacuagugaggacuccuucggc

SEQ ID NO: 561337 - RNA, 63 nt, Homo Sapiens
ugugcugcuugcacaacugagcugcugguguguaccccuuagcagggugucuggggacuuacg

SEQ ID NO: 561338 - RNA, 63 nt, Homo Sapiens
ccguccauccauccauccacucuuccacccucuaccccuuaccuuauucuaaaaagaacuuag

SEQ ID NO: 561339 - RNA, 63 nt, Homo Sapiens
agcgccuggaagcagaaccaauucucuuuccugaccccuuaggggcaacauccaugccuucuc

SEQ ID NO: 561340 - RNA, 63 nt, Homo Sapiens
ccaacucagcuccucuuugcugcccuucccgggaccccuuauuaggcagcugugccccuggcc

SEQ ID NO: 561341 - RNA, 63 nt, Homo Sapiens
cuuuugguggagaggcccggccucucacaaaagaccccuuaccacugcucugaugaagaggag

SEQ ID NO: 561342 - RNA, 63 nt, Homo Sapiens
uuaccaguaaauuauguuucuguauguaaaauaaccccuuauuagagagacaguguuauaugu

SEQ ID NO: 561343 - RNA, 63 nt, Homo Sapiens
gacucugccccucagcagggcuuacuaagcacuaccccuuaacagggaugacuccgcacugcc

SEQ ID NO: 561344 - RNA, 63 nt, Homo Sapiens
ccagagaaccagccuaggaacacucgggaugacaccccuuaucacaccaaggacagcaaguuu

SEQ ID NO: 561345 - RNA, 63 nt, Homo Sapiens
uuccccgagaguguaaagagcgaaagucugcuaaccccuuacacagcucugagguggcuucag

SEQ ID NO: 561346 - RNA, 63 nt, Homo Sapiens
ucuccauuugagaggagagugcuuggggcuugaaccccuuaccccacugcugcugacugggca

SEQ ID NO: 561347 - RNA, 63 nt, Homo Sapiens
uggggacaagccccucuuggucucagccacagcaccccuuauuccagcugcccugcccaaccu

SEQ ID NO: 561348 - RNA, 63 nt, Homo Sapiens
ccuucuuucuaaacucaacccauuucccucccuaccccuuaucuucaggacucuucagagcua

SEQ ID NO: 561349 - RNA, 63 nt, Homo Sapiens
gguccuugccucucguguacccccucaaggcugaccccuuagauggcccaggaauggcaggug

SEQ ID NO: 561350 - RNA, 63 nt, Homo Sapiens
gcugccaaaaccacaugggcgccauuaccccauaccccuuauucaaaccauuuuauuuuuugg

SEQ ID NO: 561351 - RNA, 63 nt, Homo Sapiens
uugccaaagacuugaggacccuuggcugagccuaccccuuacucuugggccuuuucucucaac

SEQ ID NO: 561352 - RNA, 63 nt, Homo Sapiens
uuuaacuuugugguaacugauuucuucuuccccaccccuuaauaagucuguuuuuuuuuuuuc

SEQ ID NO: 561353 - RNA, 63 nt, Homo Sapiens
augaugacaucccacacacuuccacuugugguaaccccuuacguggaaguuaagagaguggca

SEQ ID NO: 561354 - RNA, 63 nt, Homo Sapiens
uuccucauacagacuggcacucugcaggcccucaccccuuaacaacgaugggugcuguggucc

SEQ ID NO: 561355 - RNA, 63 nt, Homo Sapiens
caucucucuacugcuggacugugggccgaucuaaccccuuaccccuuagggacagguggaggu

SEQ ID NO: 561356 - RNA, 63 nt, Homo Sapiens
cuaaucauaugugcucagacacagcucaagcacaccccuuaguuaagaaagaaccuccauaua

SEQ ID NO: 561357 - RNA, 63 nt, Homo Sapiens
cccugcauuccagaugggggccuccuggcccggaccccuuacacuccagugccgaccgcugag

SEQ ID NO: 561358 - RNA, 63 nt, Homo Sapiens
uauuauuuuuucuucaauauaacacuggaggaaaccccuuaugaggaugccaucugccuaaau

SEQ ID NO: 561359 - RNA, 63 nt, Homo Sapiens
aggugugaccucaggugugugaguaucccucauaccccuuaucaucacugccuauucgcucuu

SEQ ID NO: 561360 - RNA, 63 nt, Homo Sapiens
cccuggcccccugaguuuccucgcaucuucccaaccccuuaagaggaaccaaauuuaagacuc

SEQ ID NO: 561361 - RNA, 63 nt, Homo Sapiens
uaauuccuuaacaucucuauaauaauuucagaaaccccuuaaacuacauuaacauggaugcag

SEQ ID NO: 561362 - RNA, 63 nt, Homo Sapiens
uuggguaccccucuggcccucaccuccacccccaccccuuaacaacaacugaccuguuuccuc

SEQ ID NO: 561363 - RNA, 63 nt, Homo Sapiens
ccggcauuguauuccaaagaggcaggagcacagaccccuuaaaucaagaccggaggcacagag

SEQ ID NO: 561364 - RNA, 63 nt, Homo Sapiens
cauaaguuuucaggaaauaacagcaggcugggcaccccuuagccuagcacugagucaagcaau

SEQ ID NO: 561365 - RNA, 63 nt, Homo Sapiens
auguguuugcagaccggcugggauagccuccccaccccuuaucagagccaagacaccugcugc

SEQ ID NO: 561366 - RNA, 63 nt, Homo Sapiens
ucuuggauugugaugcuauugguacuugagaauaccccuuaucugaguauaaagaauccuuga

SEQ ID NO: 561367 - RNA, 63 nt, Homo Sapiens
cucccugaaaauguuuuucuuggugcaacccuuaccccuuagcgcaggagggcccuaccugau

SEQ ID NO: 561368 - RNA, 63 nt, Homo Sapiens
aaugaaaaauuccacucaaaagagaaggaacauaccccuuacaguuugaggaaagcaagaauc

SEQ ID NO: 561369 - RNA, 63 nt, Homo Sapiens
aaggccccagaugaucccagaaggggcucuugaaccccuuauugcccuucagucugcuccacc

SEQ ID NO: 561370 - RNA, 63 nt, Homo Sapiens
gcucgcccaccggccugugaguguguuucacucaccccuuaccgggcccugcaaagcacccaa

SEQ ID NO: 561371 - RNA, 63 nt, Homo Sapiens
aucugauauggucauuuguuuuaaauaacacccaccccuuauuuuccguaaauacacacacaa

SEQ ID NO: 561372 - RNA, 63 nt, Homo Sapiens
ggccggucuaaagugagcucuaugggcagaucuaccccuuacuuauuauuccagaucugcagu

SEQ ID NO: 561373 - RNA, 63 nt, Homo Sapiens
ccucauuuccuucuuuuauuccuccccaccccaaccccuuaaaaaaaaggucagaaggacaaa

SEQ ID NO: 561374 - RNA, 63 nt, Homo Sapiens
ucagggguaagggaaggaagccagccuuucagcaccccuuacccuccacaguucugugauuuc

SEQ ID NO: 561375 - RNA, 63 nt, Homo Sapiens
uuuuaugccuguuaagcuuugcaguuggguuuuaccccuuaguuuuuucacucuuaugucaga

SEQ ID NO: 561376 - RNA, 63 nt, Homo Sapiens
aaagugauggccccacagaacaccuucuagaugaccccuuaauccgcgguuugucagggggcc

SEQ ID NO: 561377 - RNA, 64 nt, Homo Sapiens
gaagaugcuuucagugaugcucucuauacucauaaauaagcaaauguggcaggcuuugcuuucu

SEQ ID NO: 561378 - RNA, 64 nt, Homo Sapiens
ccaccuuuauguauuuucuuaaagcacgccuuuaaauaagcaaaaacuuuaaaaggcaggaaag

SEQ ID NO: 561379 - RNA, 64 nt, Homo Sapiens
uccugcggaacuugauuaacgcaguauccagaacaauaagcaggcaaccgcaauccggagcgcg

SEQ ID NO: 561380 - RNA, 64 nt, Homo Sapiens
caccggagacuugguacccaauugaugcauuuuuaauaagcaauuaauuuugaaugcccucacu

SEQ ID NO: 561381 - RNA, 64 nt, Homo Sapiens
ccaaguuauaugacuaauauuuagcacuauuuaaaauaagcacaguugucuucacuuaauccau

SEQ ID NO: 561382 - RNA, 64 nt, Homo Sapiens
guuuugguauaagguacauaaaaaaauauuuuggaauaagcauuaggaaagaacuacuagcuac

SEQ ID NO: 561383 - RNA, 64 nt, Homo Sapiens
auaagggaaguuuauuuucugcgguuuuugcaagaauaagcaaagcccauggaauuuaauuuuu

SEQ ID NO: 561384 - RNA, 64 nt, Homo Sapiens
auucagguaaauuuucuuuuccaagaagcuuuugaauaagcauauuuccuccaaaggucucucu

SEQ ID NO: 561385 - RNA, 64 nt, Homo Sapiens
cguauaauaaagucucugaaaaggccuuauucagaauaagcaagaaagguucugugauucacuu

SEQ ID NO: 561386 - RNA, 64 nt, Homo Sapiens
gcacauccaucuccaucagagcugauagccuguuaauaagcacuggucuaacacagccaacccu

SEQ ID NO: 561387 - RNA, 64 nt, Homo Sapiens; identical to SEQ ID NO: 452644

SEQ ID NO: 561388 - RNA, 64 nt, Homo Sapiens; identical to SEQ ID NO: 452645

SEQ ID NO: 561389 - RNA, 64 nt, Homo Sapiens; identical to SEQ ID NO: 452646

SEQ ID NO: 561390 - RNA, 64 nt, Homo Sapiens; identical to SEQ ID NO: 452647

SEQ ID NO: 561391 - RNA, 64 nt, Homo Sapiens; identical to SEQ ID NO: 452648

SEQ ID NO: 561392 - RNA, 64 nt, Homo Sapiens; identical to SEQ ID NO: 452649

SEQ ID NO: 561393 - RNA, 64 nt, Homo Sapiens; identical to SEQ ID NO: 452650

SEQ ID NO: 561394 - RNA, 64 nt, Homo Sapiens; identical to SEQ ID NO: 452651

SEQ ID NO: 561395 - RNA, 64 nt, Homo Sapiens; identical to SEQ ID NO: 452652

SEQ ID NO: 561396 - RNA, 64 nt, Homo Sapiens; identical to SEQ ID NO: 452653

SEQ ID NO: 561397 - RNA, 64 nt, Homo Sapiens; identical to SEQ ID NO: 452654

SEQ ID NO: 561398 - RNA, 62 nt, Homo Sapiens; identical to SEQ ID NO: 452655

SEQ ID NO: 561399 - RNA, 64 nt, Homo Sapiens; identical to SEQ ID NO: 452656

SEQ ID NO: 561400 - RNA, 64 nt, Homo Sapiens; identical to SEQ ID NO: 452657

SEQ ID NO: 561401 - RNA, 64 nt, Homo Sapiens; identical to SEQ ID NO: 452658

SEQ ID NO: 561402 - RNA, 64 nt, Homo Sapiens; identical to SEQ ID NO: 452659

SEQ ID NO: 561403 - RNA, 64 nt, Homo Sapiens; identical to SEQ ID NO: 452660

SEQ ID NO: 561404 - RNA, 64 nt, Homo Sapiens; identical to SEQ ID NO: 452661

SEQ ID NO: 561405 - RNA, 64 nt, Homo Sapiens; identical to SEQ ID NO: 452662

SEQ ID NO: 561406 - RNA, 64 nt, Homo Sapiens; identical to SEQ ID NO: 452663

SEQ ID NO: 561407 - RNA, 64 nt, Homo Sapiens; identical to SEQ ID NO: 452663

SEQ ID NO: 561408 - RNA, 64 nt, Homo Sapiens; identical to SEQ ID NO: 452665

SEQ ID NO: 561409 - RNA, 64 nt, Homo Sapiens; identical to SEQ ID NO: 452666

SEQ ID NO: 561410 - RNA, 64 nt, Homo Sapiens; identical to SEQ ID NO: 430373

SEQ ID NO: 561411 - RNA, 64 nt, Homo Sapiens; identical to SEQ ID NO: 430374

SEQ ID NO: 561412 - RNA, 64 nt, Homo Sapiens; identical to SEQ ID NO: 430375

SEQ ID NO: 561413 - RNA, 64 nt, Homo Sapiens; identical to SEQ ID NO: 430376

SEQ ID NO: 561414 - RNA, 64 nt, Homo Sapiens; identical to SEQ ID NO: 430377

SEQ ID NO: 561415 - RNA, 64 nt, Homo Sapiens; identical to SEQ ID NO: 430378

SEQ ID NO: 561416 - RNA, 64 nt, Homo Sapiens; identical to SEQ ID NO: 430379

SEQ ID NO: 561417 - RNA, 64 nt, Homo Sapiens; identical to SEQ ID NO: 430380

SEQ ID NO: 561418 - RNA, 64 nt, Homo Sapiens; identical to SEQ ID NO: 430381

SEQ ID NO: 561419 - RNA, 64 nt, Homo Sapiens; identical to SEQ ID NO: 430382

SEQ ID NO: 561420 - RNA, 64 nt, Homo Sapiens; identical to SEQ ID NO: 430383

SEQ ID NO: 561421 - RNA, 64 nt, Homo Sapiens; identical to SEQ ID NO: 430384

SEQ ID NO: 561422 - RNA, 64 nt, Homo Sapiens; identical to SEQ ID NO: 430385

SEQ ID NO: 561423 - RNA, 64 nt, Homo Sapiens; identical to SEQ ID NO: 430386

SEQ ID NO: 561424 - RNA, 64 nt, Homo Sapiens; identical to SEQ ID NO: 430387

SEQ ID NO: 561425 - RNA, 64 nt, Homo Sapiens; identical to SEQ ID NO: 430388

SEQ ID NO: 561426 - RNA, 64 nt, Homo Sapiens; identical to SEQ ID NO: 430389

SEQ ID NO: 561427 - RNA, 64 nt, Homo Sapiens; identical to SEQ ID NO: 430390

SEQ ID NO: 561428 - RNA, 64 nt, Homo Sapiens; identical to SEQ ID NO: 430391

SEQ ID NO: 561429 - RNA, 64 nt, Homo Sapiens; identical to SEQ ID NO: 430392

SEQ ID NO: 561430 - RNA, 64 nt, Homo Sapiens; identical to SEQ ID NO: 430393

SEQ ID NO: 561431 - RNA, 64 nt, Homo Sapiens; identical to SEQ ID NO: 430394

SEQ ID NO: 561432 - RNA, 64 nt, Homo Sapiens; identical to SEQ ID NO: 430395

SEQ ID NO: 561433 - RNA, 64 nt, Homo Sapiens; identical to SEQ ID NO: 430396

SEQ ID NO: 561434 - RNA, 64 nt, Homo Sapiens; identical to SEQ ID NO: 430397

SEQ ID NO: 561435 - RNA, 64 nt, Homo Sapiens; identical to SEQ ID NO: 430398

SEQ ID NO: 561436 - RNA, 64 nt, Homo Sapiens; identical to SEQ ID NO: 430399

SEQ ID NO: 561437 - RNA, 64 nt, Homo Sapiens; identical to SEQ ID NO: 430400

SEQ ID NO: 561438 - RNA, 64 nt, Homo Sapiens; identical to SEQ ID NO: 430401

SEQ ID NO: 561439 - RNA, 64 nt, Homo Sapiens; identical to SEQ ID NO: 430402

SEQ ID NO: 561440 - RNA, 64 nt, Homo Sapiens; identical to SEQ ID NO: 430403

SEQ ID NO: 561441 - RNA, 64 nt, Homo Sapiens; identical to SEQ ID NO: 430404

SEQ ID NO: 561442 - RNA, 62 nt, Homo Sapiens; identical to SEQ ID NO: 296757

SEQ ID NO: 561443 - RNA, 64 nt, Homo Sapiens; identical to SEQ ID NO: 430406

SEQ ID NO: 561444 - RNA, 64 nt, Homo Sapiens; identical to SEQ ID NO: 430407

SEQ ID NO: 561445 - RNA, 64 nt, Homo Sapiens; identical to SEQ ID NO: 430408

SEQ ID NO: 561446 - RNA, 64 nt, Homo Sapiens; identical to SEQ ID NO: 430409

SEQ ID NO: 561447 - RNA, 64 nt, Homo Sapiens; identical to SEQ ID NO: 430410

SEQ ID NO: 561448 - RNA, 64 nt, Homo Sapiens; identical to SEQ ID NO: 430411

SEQ ID NO: 561449 - RNA, 64 nt, Homo Sapiens; identical to SEQ ID NO: 430412

SEQ ID NO: 561450 - RNA, 64 nt, Homo Sapiens; identical to SEQ ID NO: 430413

SEQ ID NO: 561451 - RNA, 64 nt, Homo Sapiens; identical to SEQ ID NO: 430414

SEQ ID NO: 561452 - RNA, 64 nt, Homo Sapiens; identical to SEQ ID NO: 430415

SEQ ID NO: 561453 - RNA, 64 nt, Homo Sapiens; identical to SEQ ID NO: 430416

SEQ ID NO: 561454 - RNA, 64 nt, Homo Sapiens; identical to SEQ ID NO: 430417

SEQ ID NO: 561455 - RNA, 64 nt, Homo Sapiens; identical to SEQ ID NO: 430418

SEQ ID NO: 561456 - RNA, 64 nt, Homo Sapiens; identical to SEQ ID NO: 430419

SEQ ID NO: 561457 - RNA, 64 nt, Homo Sapiens; identical to SEQ ID NO: 430420

SEQ ID NO: 561458 - RNA, 64 nt, Homo Sapiens; identical to SEQ ID NO: 430421

SEQ ID NO: 561459 - RNA, 64 nt, Homo Sapiens; identical to SEQ ID NO: 430422

SEQ ID NO: 561460 - RNA, 64 nt, Homo Sapiens; identical to SEQ ID NO: 430423

SEQ ID NO: 561461 - RNA, 64 nt, Homo Sapiens; identical to SEQ ID NO: 430424

SEQ ID NO: 561462 - RNA, 64 nt, Homo Sapiens; identical to SEQ ID NO: 430425

SEQ ID NO: 561463 - RNA, 64 nt, Homo Sapiens; identical to SEQ ID NO: 430426

SEQ ID NO: 561464 - RNA, 64 nt, Homo Sapiens; identical to SEQ ID NO: 430427

SEQ ID NO: 561465 - RNA, 64 nt, Homo Sapiens; identical to SEQ ID NO: 430428

SEQ ID NO: 561466 - RNA, 64 nt, Homo Sapiens; identical to SEQ ID NO: 430429

SEQ ID NO: 561467 - RNA, 64 nt, Homo Sapiens; identical to SEQ ID NO: 430430

SEQ ID NO: 561468 - RNA, 64 nt, Homo Sapiens; identical to SEQ ID NO: 430431

SEQ ID NO: 561469 - RNA, 64 nt, Homo Sapiens; identical to SEQ ID NO: 430432

SEQ ID NO: 561470 - RNA, 64 nt, Homo Sapiens; identical to SEQ ID NO: 430433

SEQ ID NO: 561471 - RNA, 64 nt, Homo Sapiens; identical to SEQ ID NO: 430434

SEQ ID NO: 561472 - RNA, 64 nt, Homo Sapiens; identical to SEQ ID NO: 430435

SEQ ID NO: 561473 - RNA, 64 nt, Homo Sapiens; identical to SEQ ID NO: 430436

SEQ ID NO: 561474 - RNA, 64 nt, Homo Sapiens; identical to SEQ ID NO: 430437

SEQ ID NO: 561475 - RNA, 64 nt, Homo Sapiens; identical to SEQ ID NO: 430438

SEQ ID NO: 561476 - RNA, 64 nt, Homo Sapiens; identical to SEQ ID NO: 430439

SEQ ID NO: 561477 - RNA, 64 nt, Homo Sapiens; identical to SEQ ID NO: 430440

SEQ ID NO: 561478 - RNA, 64 nt, Homo Sapiens; identical to SEQ ID NO: 430441

SEQ ID NO: 561479 - RNA, 64 nt, Homo Sapiens; identical to SEQ ID NO: 430442

SEQ ID NO: 561480 - RNA, 64 nt, Homo Sapiens; identical to SEQ ID NO: 430443

SEQ ID NO: 561481 - RNA, 64 nt, Homo Sapiens; identical to SEQ ID NO: 430444

SEQ ID NO: 561482 - RNA, 64 nt, Homo Sapiens; identical to SEQ ID NO: 430445

SEQ ID NO: 561483 - RNA, 64 nt, Homo Sapiens; identical to SEQ ID NO: 430446

SEQ ID NO: 561484 - RNA, 64 nt, Homo Sapiens; identical to SEQ ID NO: 430447

SEQ ID NO: 561485 - RNA, 64 nt, Homo Sapiens; identical to SEQ ID NO: 430448

SEQ ID NO: 561486 - RNA, 64 nt, Homo Sapiens; identical to SEQ ID NO: 430449

SEQ ID NO: 561487 - RNA, 64 nt, Homo Sapiens; identical to SEQ ID NO: 361390

SEQ ID NO: 561488 - RNA, 64 nt, Homo Sapiens; identical to SEQ ID NO: 361391

SEQ ID NO: 561489 - RNA, 64 nt, Homo Sapiens; identical to SEQ ID NO: 361392

SEQ ID NO: 561490 - RNA, 64 nt, Homo Sapiens; identical to SEQ ID NO: 361393

SEQ ID NO: 561491 - RNA, 64 nt, Homo Sapiens; identical to SEQ ID NO: 361394

SEQ ID NO: 561492 - RNA, 64 nt, Homo Sapiens; identical to SEQ ID NO: 361395

SEQ ID NO: 561493 - RNA, 64 nt, Homo Sapiens; identical to SEQ ID NO: 361396

SEQ ID NO: 561494 - RNA, 64 nt, Homo Sapiens; identical to SEQ ID NO: 361397

SEQ ID NO: 561495 - RNA, 64 nt, Homo Sapiens; identical to SEQ ID NO: 361398

SEQ ID NO: 561496 - RNA, 64 nt, Homo Sapiens; identical to SEQ ID NO: 361399

SEQ ID NO: 561497 - RNA, 64 nt, Homo Sapiens; identical to SEQ ID NO: 385550

SEQ ID NO: 561498 - RNA, 64 nt, Homo Sapiens; identical to SEQ ID NO: 385551

SEQ ID NO: 561499 - RNA, 64 nt, Homo Sapiens; identical to SEQ ID NO: 385552

SEQ ID NO: 561500 - RNA, 64 nt, Homo Sapiens; identical to SEQ ID NO: 385553

SEQ ID NO: 561501 - RNA, 64 nt, Homo Sapiens; identical to SEQ ID NO: 385554

SEQ ID NO: 561502 - RNA, 64 nt, Homo Sapiens; identical to SEQ ID NO: 385555

SEQ ID NO: 561503 - RNA, 64 nt, Homo Sapiens; identical to SEQ ID NO: 385556

SEQ ID NO: 561504 - RNA, 64 nt, Homo Sapiens; identical to SEQ ID NO: 385557

SEQ ID NO: 561505 - RNA, 64 nt, Homo Sapiens; identical to SEQ ID NO: 385558

SEQ ID NO: 561506 - RNA, 64 nt, Homo Sapiens; identical to SEQ ID NO: 385559

SEQ ID NO: 561507 - RNA, 64 nt, Homo Sapiens; identical to SEQ ID NO: 385560

SEQ ID NO: 561508 - RNA, 64 nt, Homo Sapiens; identical to SEQ ID NO: 385561

SEQ ID NO: 561509 - RNA, 64 nt, Homo Sapiens; identical to SEQ ID NO: 385562

SEQ ID NO: 561510 - RNA, 64 nt, Homo Sapiens; identical to SEQ ID NO: 385563

SEQ ID NO: 561511 - RNA, 64 nt, Homo Sapiens; identical to SEQ ID NO: 385564

SEQ ID NO: 561512 - RNA, 64 nt, Homo Sapiens; identical to SEQ ID NO: 385565

SEQ ID NO: 561513 - RNA, 64 nt, Homo Sapiens; identical to SEQ ID NO: 385566

SEQ ID NO: 561514 - RNA, 64 nt, Homo Sapiens; identical to SEQ ID NO: 385567

SEQ ID NO: 561515 - RNA, 64 nt, Homo Sapiens; identical to SEQ ID NO: 385568

SEQ ID NO: 561516 - RNA, 64 nt, Homo Sapiens; identical to SEQ ID NO: 385569

SEQ ID NO: 561517 - RNA, 64 nt, Homo Sapiens; identical to SEQ ID NO: 385570

SEQ ID NO: 561518 - RNA, 64 nt, Homo Sapiens; identical to SEQ ID NO: 385571

SEQ ID NO: 561519 - RNA, 64 nt, Homo Sapiens; identical to SEQ ID NO: 385572

SEQ ID NO: 561520 - RNA, 64 nt, Homo Sapiens; identical to SEQ ID NO: 385573

SEQ ID NO: 561521 - RNA, 64 nt, Homo Sapiens; identical to SEQ ID NO: 385574

SEQ ID NO: 561522 - RNA, 64 nt, Homo Sapiens; identical to SEQ ID NO: 385575

SEQ ID NO: 561523 - RNA, 64 nt, Homo Sapiens; identical to SEQ ID NO: 385576

SEQ ID NO: 561524 - RNA, 64 nt, Homo Sapiens; identical to SEQ ID NO: 385577

SEQ ID NO: 561525 - RNA, 64 nt, Homo Sapiens; identical to SEQ ID NO: 385578

SEQ ID NO: 561526 - RNA, 64 nt, Homo Sapiens; identical to SEQ ID NO: 385579

SEQ ID NO: 561527 - RNA, 64 nt, Homo Sapiens; identical to SEQ ID NO: 385580

SEQ ID NO: 561528 - RNA, 64 nt, Homo Sapiens; identical to SEQ ID NO: 385581

SEQ ID NO: 561529 - RNA, 64 nt, Homo Sapiens; identical to SEQ ID NO: 385582

SEQ ID NO: 561530 - RNA, 64 nt, Homo Sapiens; identical to SEQ ID NO: 385583

SEQ ID NO: 561531 - RNA, 64 nt, Homo Sapiens; identical to SEQ ID NO: 385584

SEQ ID NO: 561532 - RNA, 64 nt, Homo Sapiens; identical to SEQ ID NO: 385585

SEQ ID NO: 561533 - RNA, 64 nt, Homo Sapiens; identical to SEQ ID NO: 385586

SEQ ID NO: 561534 - RNA, 64 nt, Homo Sapiens; identical to SEQ ID NO: 385587

SEQ ID NO: 561535 - RNA, 64 nt, Homo Sapiens; identical to SEQ ID NO: 385588

SEQ ID NO: 561536 - RNA, 64 nt, Homo Sapiens; identical to SEQ ID NO: 114926

SEQ ID NO: 561537 - RNA, 64 nt, Homo Sapiens; identical to SEQ ID NO: 114927

SEQ ID NO: 561538 - RNA, 64 nt, Homo Sapiens; identical to SEQ ID NO: 536729

SEQ ID NO: 561539 - RNA, 64 nt, Homo Sapiens; identical to SEQ ID NO: 536730

SEQ ID NO: 561540 - RNA, 64 nt, Homo Sapiens; identical to SEQ ID NO: 536731

SEQ ID NO: 561541 - RNA, 64 nt, Homo Sapiens; identical to SEQ ID NO: 536732

SEQ ID NO: 561542 - RNA, 64 nt, Homo Sapiens; identical to SEQ ID NO: 536733

SEQ ID NO: 561543 - RNA, 64 nt, Homo Sapiens; identical to SEQ ID NO: 536734

SEQ ID NO: 561544 - RNA, 64 nt, Homo Sapiens; identical to SEQ ID NO: 536735

SEQ ID NO: 561545 - RNA, 64 nt, Homo Sapiens; identical to SEQ ID NO: 536736

SEQ ID NO: 561546 - RNA, 64 nt, Homo Sapiens; identical to SEQ ID NO: 536737

SEQ ID NO: 561547 - RNA, 64 nt, Homo Sapiens; identical to SEQ ID NO: 536738

SEQ ID NO: 561548 - RNA, 64 nt, Homo Sapiens; identical to SEQ ID NO: 536739

SEQ ID NO: 561549 - RNA, 64 nt, Homo Sapiens; identical to SEQ ID NO: 536740

SEQ ID NO: 561550 - RNA, 64 nt, Homo Sapiens; identical to SEQ ID NO: 536741

SEQ ID NO: 561551 - RNA, 64 nt, Homo Sapiens; identical to SEQ ID NO: 536742

SEQ ID NO: 561552 - RNA, 64 nt, Homo Sapiens; identical to SEQ ID NO: 536743

SEQ ID NO: 561553 - RNA, 64 nt, Homo Sapiens; identical to SEQ ID NO: 536744

SEQ ID NO: 561554 - RNA, 64 nt, Homo Sapiens; identical to SEQ ID NO: 536745

SEQ ID NO: 561555 - RNA, 64 nt, Homo Sapiens; identical to SEQ ID NO: 536746

SEQ ID NO: 561556 - RNA, 64 nt, Homo Sapiens; identical to SEQ ID NO: 536747

SEQ ID NO: 561557 - RNA, 64 nt, Homo Sapiens; identical to SEQ ID NO: 536748

SEQ ID NO: 561558 - RNA, 64 nt, Homo Sapiens; identical to SEQ ID NO: 536749

SEQ ID NO: 561559 - RNA, 64 nt, Homo Sapiens; identical to SEQ ID NO: 536750

SEQ ID NO: 561560 - RNA, 64 nt, Homo Sapiens; identical to SEQ ID NO: 536751

SEQ ID NO: 561561 - RNA, 64 nt, Homo Sapiens; identical to SEQ ID NO: 536752

SEQ ID NO: 561562 - RNA, 64 nt, Homo Sapiens; identical to SEQ ID NO: 536753

SEQ ID NO: 561563 - RNA, 64 nt, Homo Sapiens; identical to SEQ ID NO: 536754

SEQ ID NO: 561564 - RNA, 64 nt, Homo Sapiens; identical to SEQ ID NO: 536755

SEQ ID NO: 561565 - RNA, 64 nt, Homo Sapiens; identical to SEQ ID NO: 536756

SEQ ID NO: 561566 - RNA, 64 nt, Homo Sapiens; identical to SEQ ID NO: 536757

SEQ ID NO: 561567 - RNA, 57 nt, Homo Sapiens; identical to SEQ ID NO: 536758

SEQ ID NO: 561568 - RNA, 64 nt, Homo Sapiens; identical to SEQ ID NO: 536759

SEQ ID NO: 561569 - RNA, 64 nt, Homo Sapiens; identical to SEQ ID NO: 536760

SEQ ID NO: 561570 - RNA, 64 nt, Homo Sapiens; identical to SEQ ID NO: 536761

SEQ ID NO: 561571 - RNA, 64 nt, Homo Sapiens; identical to SEQ ID NO: 536762

SEQ ID NO: 561572 - RNA, 64 nt, Homo Sapiens
cugacuaauggugucacugcuggcaauggugauaauggauuaauuccucaaaggaagagcagaa

SEQ ID NO: 561573 - RNA, 64 nt, Homo Sapiens
cugacuaauggugccacugcuggcaauggugaugauggauuaauuccuccaaggaagagcagaa

SEQ ID NO: 561574 - RNA, 64 nt, Homo Sapiens
gugagucaucagaguuuauuugcugaccuuucauauggauuauuaaaagugucacauauuagaa

SEQ ID NO: 561575 - RNA, 64 nt, Homo Sapiens
gaggagcccucacggcugaugacacugaaccuggauggauuauaccucgugucaguagccuugu

SEQ ID NO: 561576 - RNA, 64 nt, Homo Sapiens
uguaagaaaugaaauaaguacaaggaaauggcauauggauuaacaaaugagguuuuuugcauuc

SEQ ID NO: 561577 - RNA, 64 nt, Homo Sapiens
caucagcugccucucgaauggaagaacagugguaauggauuaacauccuauuuuguuguacuaa

SEQ ID NO: 561578 - RNA, 64 nt, Homo Sapiens
uguuuguugucuuauuugugguggcacucguuuaauggauuaacugagguugcucaauguucag

SEQ ID NO: 561579 - RNA, 64 nt, Homo Sapiens
gacuuaaaaauagucauuuucuuuauaaagacaaauggauuauauuuacuuagaugccagucua

SEQ ID NO: 561580 - RNA, 64 nt, Homo Sapiens
auaaaauacuuaaauuugugcucacaauuaugagauggauuauaagccuuugucagaaaguauu

SEQ ID NO: 561581 - RNA, 64 nt, Homo Sapiens
cugaaacauaugaaauugcuaucaguacaaccccauggauuaggagccgagaauggucagaaag

SEQ ID NO: 561582 - RNA, 64 nt, Homo Sapiens
uuuuggguuuaacugaauauaauaguacaacuuaauggauuagcaauuacauuuaucugaagaa

SEQ ID NO: 561583 - RNA, 64 nt, Homo Sapiens
uuaaaaauaagauauuugggguauauucaagugcauggauuaguuuuccugacaaagcauguuu

SEQ ID NO: 561584 - RNA, 64 nt, Homo Sapiens
caugguaucugcugcaaacaugaguagauccaugauggauuaauaaagcuugcugaaaaaaaaa

SEQ ID NO: 561585 - RNA, 64 nt, Homo Sapiens
aggugauugggccaugaggucugugcccuccugaauggauuaauccauucauggauuaauggau

SEQ ID NO: 561586 - RNA, 64 nt, Homo Sapiens
aggucugugcccuccugaauggauuaauccauucauggauuaauggauuauuaugaguggggga

SEQ ID NO: 561587 - RNA, 64 nt, Homo Sapiens
gcccuccugaauggauuaauccauucauggauuaauggauuauuaugagugggggacuggugac

SEQ ID NO: 561588 - RNA, 64 nt, Homo Sapiens
uuggggguagauuagaaaacccuuacacuuuggcuaugaacaaauaauaaaaauuauucuuuaa

SEQ ID NO: 561589 - RNA, 64 nt, Homo Sapiens
aaaagauguuauucugaguuuguuuuaauacauauaugaacauauaguuuuauucaauuaaacc

SEQ ID NO: 561590 - RNA, 64 nt, Homo Sapiens
acaguauaccaguaacagcacuuuaucucauuuauaugaacaccuuugaggugcuacuuaaguc

SEQ ID NO: 561591 - RNA, 64 nt, Homo Sapiens
caacguuuguuccuguguguacaauuguacuuuguaugaacagcuuuaucauuuuuauaggcuu

SEQ ID NO: 561592 - RNA, 64 nt, Homo Sapiens
uaaaaagaaaaaauccagaacauaagaacuauauuaugaacacaugauuugaaccuguuguggu

SEQ ID NO: 561593 - RNA, 64 nt, Homo Sapiens
ucccugccaucaaauuuauuagaagagaccuauauaugaacaacuuaaaggcacugauuucuau

SEQ ID NO: 561594 - RNA, 64 nt, Homo Sapiens
uuuuaaaaauguguccauuguugcauuuuauauauaugaacaaacaaaaaaugcacaguucaua

SEQ ID NO: 561595 - RNA, 64 nt, Homo Sapiens
guugagacaaucaccacaguuauuacccaaauacuaugaacauauuuuuguaaaccagucauuc

SEQ ID NO: 561596 - RNA, 64 nt, Homo Sapiens
ucacagcugcuuugggcaguagcugaagccgaaguaugaacaguccauuuuguuucuuaaaauu

SEQ ID NO: 561597 - RNA, 64 nt, Homo Sapiens
auggcauuaaaacauuuuugaggcaguugucuaauaugaacaauaaucuaaacaauauauuccu

SEQ ID NO: 561598 - RNA, 64 nt, Homo Sapiens
uuggagauaggagaugaaaaaaagauauaucuccuaugaacagaacccuuauaauaaaagauca

SEQ ID NO: 561599 - RNA, 64 nt, Homo Sapiens
uauggaggccagagcucauuauacuucauaaaauuaugaacagaaacuaaugaaugacauuuag

SEQ ID NO: 561600 - RNA, 64 nt, Homo Sapiens
uagcaacuguuugauuucuuucuggauacagcuguaugaacacuuuucuauuuuauacugaaau

SEQ ID NO: 561601 - RNA, 64 nt, Homo Sapiens
gccuuaucuguagggaccuaaauuuuuuaagugcuaugaacacugaucaaguaguuguggagag

SEQ ID NO: 561602 - RNA, 64 nt, Homo Sapiens
guacuguugcuuuaauaugaucacacuuauauuuuaugaacauuuguaagaaaauguuacggca

SEQ ID NO: 561603 - RNA, 64 nt, Homo Sapiens
caagucuuucuucuuuuuuaaauuguuuauguguuaugaacauccugaacugacaaugaaggga

SEQ ID NO: 561604 - RNA, 64 nt, Homo Sapiens
agacuagaaaaguuuuccugcauuuauuaauugguaugaacaugcuauaauguuccccagaaac

SEQ ID NO: 561605 - RNA, 64 nt, Homo Sapiens
uuaaugaagacuuuauuuucaaaaauugauaccuuaugaacacagaaauauacaucuuguguau

SEQ ID NO: 561606 - RNA, 64 nt, Homo Sapiens; identical to SEQ ID NO: 486887

SEQ ID NO: 561607 - RNA, 64 nt, Homo Sapiens; identical to SEQ ID NO: 486888

SEQ ID NO: 561608 - RNA, 64 nt, Homo Sapiens; identical to SEQ ID NO: 486889

SEQ ID NO: 561609 - RNA, 64 nt, Homo Sapiens; identical to SEQ ID NO: 486890

SEQ ID NO: 561610 - RNA, 64 nt, Homo Sapiens; identical to SEQ ID NO: 486891

SEQ ID NO: 561611 - RNA, 64 nt, Homo Sapiens; identical to SEQ ID NO: 486892

SEQ ID NO: 561612 - RNA, 64 nt, Homo Sapiens; identical to SEQ ID NO: 486893

SEQ ID NO: 561613 - RNA, 64 nt, Homo Sapiens; identical to SEQ ID NO: 486894

SEQ ID NO: 561614 - RNA, 64 nt, Homo Sapiens; identical to SEQ ID NO: 486895

SEQ ID NO: 561615 - RNA, 64 nt, Homo Sapiens; identical to SEQ ID NO: 486896

SEQ ID NO: 561616 - RNA, 64 nt, Homo Sapiens; identical to SEQ ID NO: 486897

SEQ ID NO: 561617 - RNA, 64 nt, Homo Sapiens; identical to SEQ ID NO: 486898

SEQ ID NO: 561618 - RNA, 64 nt, Homo Sapiens; identical to SEQ ID NO: 486899

SEQ ID NO: 561619 - RNA, 64 nt, Homo Sapiens; identical to SEQ ID NO: 486900

SEQ ID NO: 561620 - RNA, 64 nt, Homo Sapiens; identical to SEQ ID NO: 486901

SEQ ID NO: 561621 - RNA, 64 nt, Homo Sapiens; identical to SEQ ID NO: 486902

SEQ ID NO: 561622 - RNA, 64 nt, Homo Sapiens; identical to SEQ ID NO: 486903

SEQ ID NO: 561623 - RNA, 64 nt, Homo Sapiens; identical to SEQ ID NO: 74808

SEQ ID NO: 561624 - RNA, 64 nt, Homo Sapiens; identical to SEQ ID NO: 74809

SEQ ID NO: 561625 - RNA, 64 nt, Homo Sapiens; identical to SEQ ID NO: 74810

SEQ ID NO: 561626 - RNA, 64 nt, Homo Sapiens; identical to SEQ ID NO: 74811

SEQ ID NO: 561627 - RNA, 64 nt, Homo Sapiens; identical to SEQ ID NO: 74812

SEQ ID NO: 561628 - RNA, 64 nt, Homo Sapiens; identical to SEQ ID NO: 74813

SEQ ID NO: 561629 - RNA, 64 nt, Homo Sapiens; identical to SEQ ID NO: 74814

SEQ ID NO: 561630 - RNA, 64 nt, Homo Sapiens; identical to SEQ ID NO: 74815

SEQ ID NO: 561631 - RNA, 64 nt, Homo Sapiens; identical to SEQ ID NO: 74816

SEQ ID NO: 561632 - RNA, 64 nt, Homo Sapiens; identical to SEQ ID NO: 74817

SEQ ID NO: 561633 - RNA, 64 nt, Homo Sapiens; identical to SEQ ID NO: 74818

SEQ ID NO: 561634 - RNA, 64 nt, Homo Sapiens; identical to SEQ ID NO: 74819

SEQ ID NO: 561635 - RNA, 64 nt, Homo Sapiens; identical to SEQ ID NO: 74820

SEQ ID NO: 561636 - RNA, 64 nt, Homo Sapiens; identical to SEQ ID NO: 74821

SEQ ID NO: 561637 - RNA, 64 nt, Homo Sapiens; identical to SEQ ID NO: 74822

SEQ ID NO: 561638 - RNA, 64 nt, Homo Sapiens; identical to SEQ ID NO: 74823

SEQ ID NO: 561639 - RNA, 64 nt, Homo Sapiens; identical to SEQ ID NO: 74824

SEQ ID NO: 561640 - RNA, 64 nt, Homo Sapiens; identical to SEQ ID NO: 74825

SEQ ID NO: 561641 - RNA, 64 nt, Homo Sapiens; identical to SEQ ID NO: 74826

SEQ ID NO: 561642 - RNA, 64 nt, Homo Sapiens; identical to SEQ ID NO: 74827

SEQ ID NO: 561643 - RNA, 64 nt, Homo Sapiens; identical to SEQ ID NO: 74828

SEQ ID NO: 561644 - RNA, 64 nt, Homo Sapiens; identical to SEQ ID NO: 74829

SEQ ID NO: 561645 - RNA, 64 nt, Homo Sapiens; identical to SEQ ID NO: 74830

SEQ ID NO: 561646 - RNA, 64 nt, Homo Sapiens; identical to SEQ ID NO: 74831

SEQ ID NO: 561647 - RNA, 64 nt, Homo Sapiens; identical to SEQ ID NO: 74832

SEQ ID NO: 561648 - RNA, 64 nt, Homo Sapiens; identical to SEQ ID NO: 74833

SEQ ID NO: 561649 - RNA, 64 nt, Homo Sapiens; identical to SEQ ID NO: 74834

SEQ ID NO: 561650 - RNA, 64 nt, Homo Sapiens; identical to SEQ ID NO: 74835

SEQ ID NO: 561651 - RNA, 64 nt, Homo Sapiens; identical to SEQ ID NO: 74836

SEQ ID NO: 561652 - RNA, 64 nt, Homo Sapiens
caacgucagccagaacaucgcggccgagacccgggcugaggacccgccgugguuugaaggugcg

SEQ ID NO: 561653 - RNA, 64 nt, Homo Sapiens
cauacgggucaguagggauaagaauugucucugggcugaggaauucuucuguucucugguuuca

SEQ ID NO: 561654 - RNA, 64 nt, Homo Sapiens
cuucacugucccuauuccuagaccuggggcuugagcugaggaugggacgaugugcccagggagg

SEQ ID NO: 561655 - RNA, 64 nt, Homo Sapiens
caggguccccucagucaaggcagugggaugggcggcugaggaacggggcaggcaaggucacugc

SEQ ID NO: 561656 - RNA, 64 nt, Homo Sapiens
gcgucugcagggugacgccugagacagcaccacugcugaggagucugaggacuguccucccaca

SEQ ID NO: 561657 - RNA, 64 nt, Homo Sapiens
ugcugggguccagggcuguuggaggaccccgagggcugaggagcagccaggacccgccugcucc

SEQ ID NO: 561658 - RNA, 64 nt, Homo Sapiens
ugggcgugaguggacgugucgacccagaggggacgcugaggaagaggugccgacacugagcugu

SEQ ID NO: 561659 - RNA, 64 nt, Homo Sapiens
caaccagaucaggagagcaacccacggaaggcgggcugaggagaccacagggcuguuuugccuc

SEQ ID NO: 561660 - RNA, 64 nt, Homo Sapiens
gaggaucucuugugccuaggcagcuacuagggaggcugaggaggguggcacacacuuguagccc

SEQ ID NO: 561661 - RNA, 61 nt, Homo Sapiens
gacgcacugucacaccucugcgcagugaagggcugaggaugggaucuucaaggggagauga

SEQ ID NO: 561662 - RNA, 64 nt, Homo Sapiens
gagaccgcggcaucaaccagccggacccaucuacgcugaggacgaucuccccucguccugcguc

SEQ ID NO: 561663 - RNA, 64 nt, Homo Sapiens
gcgacaaggacgacauucugagacgcaacugcaggcugaggaccgaacuccaccgucauccccg

SEQ ID NO: 561664 - RNA, 64 nt, Homo Sapiens
cggccaaacaaguguuaaagugaaucagcuacaugcugaggaaauuaacuauugugauugcugc

SEQ ID NO: 561665 - RNA, 64 nt, Homo Sapiens
ggggguacugugcccaccacgccuguccccagaggcugaggagagcugccccugccuaccuccu

SEQ ID NO: 561666 - RNA, 64 nt, Homo Sapiens
gaaacucagaucagccacccaggaggaagagcgggcugaggaaacccagagggaccaagcgcug

SEQ ID NO: 561667 - RNA, 64 nt, Homo Sapiens
gccaggaaaagccaugaguugcaaccaaaacgcggcugaggauggaacucagaaugaaacugca

SEQ ID NO: 561668 - RNA, 64 nt, Homo Sapiens
cccaucuguugacaaugucuuguggagcauuuuugcugaggaaaaggucacuuguaaacagagg

SEQ ID NO: 561669 - RNA, 64 nt, Homo Sapiens
ucuuuguuucuuuuuaauuaaaauacaagaagcagcugaggaaagggagacaagguauuuuauu

SEQ ID NO: 561670 - RNA, 64 nt, Homo Sapiens
auuggggaacgcuucagcccguauuuaguacugugcugaggagcagcuggcugcgcuucuccgg

SEQ ID NO: 561671 - RNA, 64 nt, Homo Sapiens
ucagccauguggccucugggacauggaagcauaugcugaggaccucuuggucaguuucuagaag

SEQ ID NO: 561672 - RNA, 64 nt, Homo Sapiens
agcccccaggggccgagcguuggggggcgagggugcugaggagcacugggggccagagcuaggg

SEQ ID NO: 561673 - RNA, 64 nt, Homo Sapiens
ccuccgcugggcaucucccuggccaugacgcggggcugaggaugccgggcagguggucacugag

SEQ ID NO: 561674 - RNA, 64 nt, Homo Sapiens
aaggaauucugcagcuugcauagcagaaacuauagcugaggacuugucccagcuuuaagauauc

SEQ ID NO: 561675 - RNA, 63 nt, Homo Sapiens
agucacaguggaacuguccccacccaccccauagcugaggagguuccagacuuugaugacuag

SEQ ID NO: 561676 - RNA, 64 nt, Homo Sapiens
cgcugcugggagacagcgcaugcugucccugcuggcugaggagcucacugcgucaaagggcugg

SEQ ID NO: 561677 - RNA, 64 nt, Homo Sapiens
gcacucacagcaccccuuuccaaccuguguccuggcugaggaaugaguucgaggugcaguuugg

SEQ ID NO: 561678 - RNA, 64 nt, Homo Sapiens
aggugucucugagaauccaauuccauggugcccagcugaggaccaaggccggguaaugagccau

SEQ ID NO: 561679 - RNA, 64 nt, Homo Sapiens
auguaugucaccucaggaccuccuaauccugucagcugaggaggugccugucuuuacuuuaauc

SEQ ID NO: 561680 - RNA, 64 nt, Homo Sapiens; identical to SEQ ID NO: 546336

SEQ ID NO: 561681 - RNA, 64 nt, Homo Sapiens; identical to SEQ ID NO: 546337

SEQ ID NO: 561682 - RNA, 64 nt, Homo Sapiens; identical to SEQ ID NO: 546338

SEQ ID NO: 561683 - RNA, 64 nt, Homo Sapiens; identical to SEQ ID NO: 546339

SEQ ID NO: 561684 - RNA, 64 nt, Homo Sapiens; identical to SEQ ID NO: 325145

SEQ ID NO: 561685 - RNA, 64 nt, Homo Sapiens; identical to SEQ ID NO: 325146

SEQ ID NO: 561686 - RNA, 64 nt, Homo Sapiens; identical to SEQ ID NO: 325147

SEQ ID NO: 561687 - RNA, 64 nt, Homo Sapiens; identical to SEQ ID NO: 325148

SEQ ID NO: 561688 - RNA, 64 nt, Homo Sapiens; identical to SEQ ID NO: 325149

SEQ ID NO: 561689 - RNA, 64 nt, Homo Sapiens; identical to SEQ ID NO: 325150

SEQ ID NO: 561690 - RNA, 64 nt, Homo Sapiens; identical to SEQ ID NO: 325151

SEQ ID NO: 561691 - RNA, 64 nt, Homo Sapiens; identical to SEQ ID NO: 325152

SEQ ID NO: 561692 - RNA, 64 nt, Homo Sapiens; identical to SEQ ID NO: 325153

SEQ ID NO: 561693 - RNA, 64 nt, Homo Sapiens; identical to SEQ ID NO: 325154

SEQ ID NO: 561694 - RNA, 64 nt, Homo Sapiens; identical to SEQ ID NO: 325155

SEQ ID NO: 561695 - RNA, 64 nt, Homo Sapiens; identical to SEQ ID NO: 325156

SEQ ID NO: 561696 - RNA, 64 nt, Homo Sapiens; identical to SEQ ID NO: 325157

SEQ ID NO: 561697 - RNA, 64 nt, Homo Sapiens; identical to SEQ ID NO: 325158

SEQ ID NO: 561698 - RNA, 64 nt, Homo Sapiens; identical to SEQ ID NO: 325159

SEQ ID NO: 561699 - RNA, 64 nt, Homo Sapiens; identical to SEQ ID NO: 325160

SEQ ID NO: 561700 - RNA, 64 nt, Homo Sapiens; identical to SEQ ID NO: 325161

SEQ ID NO: 561701 - RNA, 64 nt, Homo Sapiens; identical to SEQ ID NO: 325162

SEQ ID NO: 561702 - RNA, 64 nt, Homo Sapiens; identical to SEQ ID NO: 52979

SEQ ID NO: 561703 - RNA, 64 nt, Homo Sapiens; identical to SEQ ID NO: 52980

SEQ ID NO: 561704 - RNA, 64 nt, Homo Sapiens; identical to SEQ ID NO: 52981

SEQ ID NO: 561705 - RNA, 64 nt, Homo Sapiens; identical to SEQ ID NO: 52982

SEQ ID NO: 561706 - RNA, 64 nt, Homo Sapiens; identical to SEQ ID NO: 52983

SEQ ID NO: 561707 - RNA, 64 nt, Homo Sapiens; identical to SEQ ID NO: 52984

SEQ ID NO: 561708 - RNA, 64 nt, Homo Sapiens; identical to SEQ ID NO: 52985

SEQ ID NO: 561709 - RNA, 64 nt, Homo Sapiens; identical to SEQ ID NO: 52986

SEQ ID NO: 561710 - RNA, 64 nt, Homo Sapiens; identical to SEQ ID NO: 52987

SEQ ID NO: 561711 - RNA, 64 nt, Homo Sapiens; identical to SEQ ID NO: 52988

SEQ ID NO: 561712 - RNA, 64 nt, Homo Sapiens; identical to SEQ ID NO: 52989

SEQ ID NO: 561713 - RNA, 64 nt, Homo Sapiens; identical to SEQ ID NO: 52990

SEQ ID NO: 561714 - RNA, 64 nt, Homo Sapiens; identical to SEQ ID NO: 52991

SEQ ID NO: 561715 - RNA, 64 nt, Homo Sapiens; identical to SEQ ID NO: 52992

SEQ ID NO: 561716 - RNA, 64 nt, Homo Sapiens; identical to SEQ ID NO: 52993

SEQ ID NO: 561717 - RNA, 64 nt, Homo Sapiens; identical to SEQ ID NO: 52994

SEQ ID NO: 561718 - RNA, 64 nt, Homo Sapiens; identical to SEQ ID NO: 52995

SEQ ID NO: 561719 - RNA, 64 nt, Homo Sapiens; identical to SEQ ID NO: 52996

SEQ ID NO: 561720 - RNA, 64 nt, Homo Sapiens; identical to SEQ ID NO: 52997

SEQ ID NO: 561721 - RNA, 64 nt, Homo Sapiens; identical to SEQ ID NO: 52998

SEQ ID NO: 561722 - RNA, 64 nt, Homo Sapiens; identical to SEQ ID NO: 52999

SEQ ID NO: 561723 - RNA, 64 nt, Homo Sapiens; identical to SEQ ID NO: 53000

SEQ ID NO: 561724 - RNA, 64 nt, Homo Sapiens; identical to SEQ ID NO: 53001

SEQ ID NO: 561725 - RNA, 64 nt, Homo Sapiens; identical to SEQ ID NO: 53002

SEQ ID NO: 561726 - RNA, 64 nt, Homo Sapiens; identical to SEQ ID NO: 53003

SEQ ID NO: 561727 - RNA, 64 nt, Homo Sapiens; identical to SEQ ID NO: 53004

SEQ ID NO: 561728 - RNA, 59 nt, Homo Sapiens; identical to SEQ ID NO: 53005

SEQ ID NO: 561729 - RNA, 64 nt, Homo Sapiens; identical to SEQ ID NO: 53006

SEQ ID NO: 561730 - RNA, 64 nt, Homo Sapiens; identical to SEQ ID NO: 53007

SEQ ID NO: 561731 - RNA, 64 nt, Homo Sapiens; identical to SEQ ID NO: 53008

SEQ ID NO: 561732 - RNA, 64 nt, Homo Sapiens; identical to SEQ ID NO: 53009

SEQ ID NO: 561733 - RNA, 64 nt, Homo Sapiens; identical to SEQ ID NO: 53010

SEQ ID NO: 561734 - RNA, 64 nt, Homo Sapiens; identical to SEQ ID NO: 53011

SEQ ID NO: 561735 - RNA, 64 nt, Homo Sapiens; identical to SEQ ID NO: 53012

SEQ ID NO: 561736 - RNA, 64 nt, Homo Sapiens; identical to SEQ ID NO: 53013

SEQ ID NO: 561737 - RNA, 64 nt, Homo Sapiens; identical to SEQ ID NO: 53014

SEQ ID NO: 561738 - RNA, 64 nt, Homo Sapiens; identical to SEQ ID NO: 53015

SEQ ID NO: 561739 - RNA, 64 nt, Homo Sapiens; identical to SEQ ID NO: 53016

SEQ ID NO: 561740 - RNA, 64 nt, Homo Sapiens; identical to SEQ ID NO: 53017

SEQ ID NO: 561741 - RNA, 64 nt, Homo Sapiens
gugagccaccacgcccagccucccaaagugcugagauuacaagugugauccacuugccucggcc

SEQ ID NO: 561742 - RNA, 64 nt, Homo Sapiens
gccugccacuaugccuggcuucccaaguagcuaggauuacaagugcgauucuucugccucagcc

SEQ ID NO: 561743 - RNA, 64 nt, Homo Sapiens
uuuugcucuucuugucuuuguauguucaccaggagauuacaauuuaauuggcuccaauucauaa

SEQ ID NO: 561744 - RNA, 64 nt, Homo Sapiens
gccaaggguaauagaaaugcguuuauagcuuccagauuacaaaggcugaauugaacauuuugaa

SEQ ID NO: 561745 - RNA, 64 nt, Homo Sapiens; identical to SEQ ID NO: 294359

SEQ ID NO: 561746 - RNA, 64 nt, Homo Sapiens; identical to SEQ ID NO: 294360

SEQ ID NO: 561747 - RNA, 64 nt, Homo Sapiens; identical to SEQ ID NO: 294361

SEQ ID NO: 561748 - RNA, 64 nt, Homo Sapiens; identical to SEQ ID NO: 294362

SEQ ID NO: 561749 - RNA, 64 nt, Homo Sapiens; identical to SEQ ID NO: 294363

SEQ ID NO: 561750 - RNA, 64 nt, Homo Sapiens; identical to SEQ ID NO: 294364

SEQ ID NO: 561751 - RNA, 64 nt, Homo Sapiens; identical to SEQ ID NO: 294365

SEQ ID NO: 561752 - RNA, 64 nt, Homo Sapiens; identical to SEQ ID NO: 294366

SEQ ID NO: 561753 - RNA, 64 nt, Homo Sapiens; identical to SEQ ID NO: 294367

SEQ ID NO: 561754 - RNA, 64 nt, Homo Sapiens; identical to SEQ ID NO: 294368

SEQ ID NO: 561755 - RNA, 64 nt, Homo Sapiens; identical to SEQ ID NO: 294369

SEQ ID NO: 561756 - RNA, 64 nt, Homo Sapiens; identical to SEQ ID NO: 294370

SEQ ID NO: 561757 - RNA, 64 nt, Homo Sapiens; identical to SEQ ID NO: 294371

SEQ ID NO: 561758 - RNA, 64 nt, Homo Sapiens; identical to SEQ ID NO: 294372

SEQ ID NO: 561759 - RNA, 64 nt, Homo Sapiens; identical to SEQ ID NO: 294373

SEQ ID NO: 561760 - RNA, 64 nt, Homo Sapiens; identical to SEQ ID NO: 294374

SEQ ID NO: 561761 - RNA, 64 nt, Homo Sapiens; identical to SEQ ID NO: 294375

SEQ ID NO: 561762 - RNA, 64 nt, Homo Sapiens; identical to SEQ ID NO: 294376

SEQ ID NO: 561763 - RNA, 64 nt, Homo Sapiens; identical to SEQ ID NO: 294377

SEQ ID NO: 561764 - RNA, 64 nt, Homo Sapiens; identical to SEQ ID NO: 294378

SEQ ID NO: 561765 - RNA, 64 nt, Homo Sapiens; identical to SEQ ID NO: 294379

SEQ ID NO: 561766 - RNA, 64 nt, Homo Sapiens; identical to SEQ ID NO: 294380

SEQ ID NO: 561767 - RNA, 64 nt, Homo Sapiens; identical to SEQ ID NO: 294381

SEQ ID NO: 561768 - RNA, 64 nt, Homo Sapiens; identical to SEQ ID NO: 294382

SEQ ID NO: 561769 - RNA, 64 nt, Homo Sapiens; identical to SEQ ID NO: 294383

SEQ ID NO: 561770 - RNA, 64 nt, Homo Sapiens; identical to SEQ ID NO: 294384

SEQ ID NO: 561771 - RNA, 64 nt, Homo Sapiens; identical to SEQ ID NO: 294385

SEQ ID NO: 561772 - RNA, 64 nt, Homo Sapiens; identical to SEQ ID NO: 294386

SEQ ID NO: 561773 - RNA, 64 nt, Homo Sapiens; identical to SEQ ID NO: 294387

SEQ ID NO: 561774 - RNA, 64 nt, Homo Sapiens; identical to SEQ ID NO: 294388

SEQ ID NO: 561775 - RNA, 64 nt, Homo Sapiens; identical to SEQ ID NO: 294389

SEQ ID NO: 561776 - RNA, 64 nt, Homo Sapiens; identical to SEQ ID NO: 294390

SEQ ID NO: 561777 - RNA, 64 nt, Homo Sapiens; identical to SEQ ID NO: 294391

SEQ ID NO: 561778 - RNA, 64 nt, Homo Sapiens; identical to SEQ ID NO: 294392

SEQ ID NO: 561779 - RNA, 64 nt, Homo Sapiens; identical to SEQ ID NO: 284290

SEQ ID NO: 561780 - RNA, 64 nt, Homo Sapiens; identical to SEQ ID NO: 284291

SEQ ID NO: 561781 - RNA, 64 nt, Homo Sapiens; identical to SEQ ID NO: 284292

SEQ ID NO: 561782 - RNA, 64 nt, Homo Sapiens; identical to SEQ ID NO: 284293

SEQ ID NO: 561783 - RNA, 64 nt, Homo Sapiens; identical to SEQ ID NO: 284294

SEQ ID NO: 561784 - RNA, 64 nt, Homo Sapiens; identical to SEQ ID NO: 284295

SEQ ID NO: 561785 - RNA, 64 nt, Homo Sapiens; identical to SEQ ID NO: 284296

SEQ ID NO: 561786 - RNA, 64 nt, Homo Sapiens; identical to SEQ ID NO: 284297

SEQ ID NO: 561787 - RNA, 64 nt, Homo Sapiens; identical to SEQ ID NO: 284298

SEQ ID NO: 561788 - RNA, 64 nt, Homo Sapiens; identical to SEQ ID NO: 284299

SEQ ID NO: 561789 - RNA, 64 nt, Homo Sapiens; identical to SEQ ID NO: 284300

SEQ ID NO: 561790 - RNA, 64 nt, Homo Sapiens; identical to SEQ ID NO: 284301

SEQ ID NO: 561791 - RNA, 64 nt, Homo Sapiens; identical to SEQ ID NO: 284302

SEQ ID NO: 561792 - RNA, 64 nt, Homo Sapiens; identical to SEQ ID NO: 284303

SEQ ID NO: 561793 - RNA, 64 nt, Homo Sapiens; identical to SEQ ID NO: 284304

SEQ ID NO: 561794 - RNA, 64 nt, Homo Sapiens; identical to SEQ ID NO: 284305

SEQ ID NO: 561795 - RNA, 64 nt, Homo Sapiens; identical to SEQ ID NO: 284306

SEQ ID NO: 561796 - RNA, 64 nt, Homo Sapiens; identical to SEQ ID NO: 284307

SEQ ID NO: 561797 - RNA, 64 nt, Homo Sapiens; identical to SEQ ID NO: 284308

SEQ ID NO: 561798 - RNA, 64 nt, Homo Sapiens; identical to SEQ ID NO: 284309

SEQ ID NO: 561799 - RNA, 64 nt, Homo Sapiens; identical to SEQ ID NO: 284310

SEQ ID NO: 561800 - RNA, 64 nt, Homo Sapiens; identical to SEQ ID NO: 284311

SEQ ID NO: 561801 - RNA, 64 nt, Homo Sapiens; identical to SEQ ID NO: 284312

SEQ ID NO: 561802 - RNA, 64 nt, Homo Sapiens; identical to SEQ ID NO: 284313

SEQ ID NO: 561803 - RNA, 64 nt, Homo Sapiens; identical to SEQ ID NO: 284314

SEQ ID NO: 561804 - RNA, 64 nt, Homo Sapiens; identical to SEQ ID NO: 284315

SEQ ID NO: 561805 - RNA, 64 nt, Homo Sapiens; identical to SEQ ID NO: 284316

SEQ ID NO: 561806 - RNA, 64 nt, Homo Sapiens; identical to SEQ ID NO: 284317

SEQ ID NO: 561807 - RNA, 64 nt, Homo Sapiens; identical to SEQ ID NO: 284318

SEQ ID NO: 561808 - RNA, 64 nt, Homo Sapiens; identical to SEQ ID NO: 284319

SEQ ID NO: 561809 - RNA, 64 nt, Homo Sapiens; identical to SEQ ID NO: 284320

SEQ ID NO: 561810 - RNA, 64 nt, Homo Sapiens; identical to SEQ ID NO: 284321

SEQ ID NO: 561811 - RNA, 64 nt, Homo Sapiens; identical to SEQ ID NO: 284322

SEQ ID NO: 561812 - RNA, 64 nt, Homo Sapiens; identical to SEQ ID NO: 284323

SEQ ID NO: 561813 - RNA, 64 nt, Homo Sapiens; identical to SEQ ID NO: 284324

SEQ ID NO: 561814 - RNA, 64 nt, Homo Sapiens; identical to SEQ ID NO: 284325

SEQ ID NO: 561815 - RNA, 64 nt, Homo Sapiens; identical to SEQ ID NO: 284326

SEQ ID NO: 561816 - RNA, 64 nt, Homo Sapiens; identical to SEQ ID NO: 284327

SEQ ID NO: 561817 - RNA, 64 nt, Homo Sapiens; identical to SEQ ID NO: 284328

SEQ ID NO: 561818 - RNA, 64 nt, Homo Sapiens; identical to SEQ ID NO: 284329

SEQ ID NO: 561819 - RNA, 64 nt, Homo Sapiens; identical to SEQ ID NO: 284330

SEQ ID NO: 561820 - RNA, 64 nt, Homo Sapiens; identical to SEQ ID NO: 284331

SEQ ID NO: 561821 - RNA, 64 nt, Homo Sapiens; identical to SEQ ID NO: 284332

SEQ ID NO: 561822 - RNA, 64 nt, Homo Sapiens; identical to SEQ ID NO: 284333

SEQ ID NO: 561823 - RNA, 50 nt, Homo Sapiens; identical to SEQ ID NO: 284334

SEQ ID NO: 561824 - RNA, 64 nt, Homo Sapiens; identical to SEQ ID NO: 284335

SEQ ID NO: 561825 - RNA, 64 nt, Homo Sapiens; identical to SEQ ID NO: 284336

SEQ ID NO: 561826 - RNA, 64 nt, Homo Sapiens; identical to SEQ ID NO: 284337

SEQ ID NO: 561827 - RNA, 64 nt, Homo Sapiens; identical to SEQ ID NO: 284338

SEQ ID NO: 561828 - RNA, 64 nt, Homo Sapiens; identical to SEQ ID NO: 284339

SEQ ID NO: 561829 - RNA, 64 nt, Homo Sapiens; identical to SEQ ID NO: 284340

SEQ ID NO: 561830 - RNA, 64 nt, Homo Sapiens; identical to SEQ ID NO: 284341

SEQ ID NO: 561831 - RNA, 64 nt, Homo Sapiens; identical to SEQ ID NO: 284342

SEQ ID NO: 561832 - RNA, 64 nt, Homo Sapiens; identical to SEQ ID NO: 284343

SEQ ID NO: 561833 - RNA, 64 nt, Homo Sapiens; identical to SEQ ID NO: 284344

SEQ ID NO: 561834 - RNA, 64 nt, Homo Sapiens; identical to SEQ ID NO: 284345

SEQ ID NO: 561835 - RNA, 64 nt, Homo Sapiens; identical to SEQ ID NO: 284346

SEQ ID NO: 561836 - RNA, 64 nt, Homo Sapiens; identical to SEQ ID NO: 284347

SEQ ID NO: 561837 - RNA, 64 nt, Homo Sapiens; identical to SEQ ID NO: 284348

SEQ ID NO: 561838 - RNA, 64 nt, Homo Sapiens; identical to SEQ ID NO: 284349

SEQ ID NO: 561839 - RNA, 64 nt, Homo Sapiens; identical to SEQ ID NO: 284350

SEQ ID NO: 561840 - RNA, 64 nt, Homo Sapiens; identical to SEQ ID NO: 284351

SEQ ID NO: 561841 - RNA, 64 nt, Homo Sapiens; identical to SEQ ID NO: 284352

SEQ ID NO: 561842 - RNA, 64 nt, Homo Sapiens; identical to SEQ ID NO: 284353

SEQ ID NO: 561843 - RNA, 64 nt, Homo Sapiens
gucaguauuuuuguaagguuaaaacuguauaaaaacauuaaauuugaaauaacugcaacuagag

SEQ ID NO: 561844 - RNA, 64 nt, Homo Sapiens
uuaacuauguaagauauuauaaauaauguauaaaacauuaaaaguuuauauauaaauauuauau

SEQ ID NO: 561845 - RNA, 64 nt, Homo Sapiens
uaagauuuguuuucaagugguugaaacuaaauugacauuaaaaucuaggcagcuggaaaaguau

SEQ ID NO: 561846 - RNA, 64 nt, Homo Sapiens
caaauuuuaauguuggccucgauauauuaauaagacauuaaaguagucggaacaauugccuguu

SEQ ID NO: 561847 - RNA, 64 nt, Homo Sapiens
uacuuugcaggaaauccuugcugcugauuuaaacacauuaaaggauagcauguccuaaugcuug

SEQ ID NO: 561848 - RNA, 64 nt, Homo Sapiens
acucuucccucaaauguguauuuugccaauuugcacauuaaauguccccucuccuccacauuug

SEQ ID NO: 561849 - RNA, 64 nt, Homo Sapiens
uuauuuugagaguuucuucuucauaaaucuacagacauuaaacaauuguuguguucuuuuuacc

SEQ ID NO: 561850 - RNA, 64 nt, Homo Sapiens
cauuuaggaaagauuucuuagguuuugaaagaauacauuaaaauaaaaaacuugccccuacuag

SEQ ID NO: 561851 - RNA, 64 nt, Homo Sapiens
auuucugaauugcaguugaauuaugcuucuaaauacauuaaaacuuggagcacagguuugauau

SEQ ID NO: 561852 - RNA, 64 nt, Homo Sapiens
uuuuagugcuaguuuaagccaucuccuaagugagacauuaaacaauguaaaaacuuuauuugaa

SEQ ID NO: 561853 - RNA, 64 nt, Homo Sapiens
uuaacagucuaucaaucaauaaauguuauuccaaacauuaaauuaugcaaagucuacuacuucc

SEQ ID NO: 561854 - RNA, 64 nt, Homo Sapiens
gagcagauuuggaucuuuuauguuggagauuaucacauuaaauucuacgauguguuucauuaac

SEQ ID NO: 561855 - RNA, 64 nt, Homo Sapiens
uaaauguuuaaccaaagaaacuuuuaucagggacacauuaaauacugucccaaacaguauaugc

SEQ ID NO: 561856 - RNA, 64 nt, Homo Sapiens
uaguggcaaaacuuaauuugauuugccuaaugauacauuaaaguucuuuggcucagagaggaua

SEQ ID NO: 561857 - RNA, 64 nt, Homo Sapiens
caauacauacugcuccuuuguaaaacauuauaaaacauuaaauuuugcaguucugaguuucaga

SEQ ID NO: 561858 - RNA, 64 nt, Homo Sapiens
ucugcuucuuaaagucagcauauuuuugaauugaacauuaaaaucaggcagguguguaauaaau

SEQ ID NO: 561859 - RNA, 64 nt, Homo Sapiens
gcccuagcaguaucuaauuaguuaauuuuuuugcacauuaaaauuuucuuuugaaaagaacuau

SEQ ID NO: 561860 - RNA, 64 nt, Homo Sapiens
caaacugauuaggauuugauggacucaaucaaaaacauuaaacgcuaucuacagugugauguau

SEQ ID NO: 561861 - RNA, 64 nt, Homo Sapiens
acugccuaugggcugugauguauauagaaguuguacauuaaacauacccucauuuuuuucuuuu

SEQ ID NO: 561862 - RNA, 64 nt, Homo Sapiens
aucuuuauauguuccacauguuaagaauaaauguacauuaaaucuuguuaagcacugugauggg

SEQ ID NO: 561863 - RNA, 64 nt, Homo Sapiens
cacugugaaggcagcauacuaugaaaaucuuaucacauuaaauuauagaaauaaugucauuuga

SEQ ID NO: 561864 - RNA, 64 nt, Homo Sapiens
gaaauaaugucauuugaaugauaacuguauuaaaacauuaaauaguuggaauuugauuucaugc

SEQ ID NO: 561865 - RNA, 64 nt, Homo Sapiens
caacagaaaaaaaagcuaagaaaacugagaacuaacauuaaaaaaauuaaauuuagaauaagaa

SEQ ID NO: 561866 - RNA, 64 nt, Homo Sapiens
auacuuaguauguaaaugucacgagaucauuuuuacauuaaacgugaaaaaaaaucaacuuugc

SEQ ID NO: 561867 - RNA, 64 nt, Homo Sapiens
gcaaagugcagcagaguauuuauuuugaagagaaacauuaaaaguacaaagagguuuguaguac

SEQ ID NO: 561868 - RNA, 64 nt, Homo Sapiens
cauuauuuaugaccuuuucuguggaagaguaagaacauuaaaaugaaagaugcaugaugaaaau

SEQ ID NO: 561869 - RNA, 64 nt, Homo Sapiens
ugauaucugugucuguauugacuugucuuguguuacauuaaacaguaggcagaacugaggucuc

SEQ ID NO: 561870 - RNA, 64 nt, Homo Sapiens
cuguccaugucuaauaaguaaaaacugauagaauacauuaaaaagucacugguuuaucauagaa

SEQ ID NO: 561871 - RNA, 64 nt, Homo Sapiens
ugugugguaaacauucauauggccauuaauuuuaacauuaaaucguagguagggcaauguagua

SEQ ID NO: 561872 - RNA, 64 nt, Homo Sapiens
uuucuaauuuauuagagauuauggaucaguucugacauuaaaaucauaguuaauugauggaugg

SEQ ID NO: 561873 - RNA, 64 nt, Homo Sapiens
gaaaagaugcuugaugcccagccccguuuuaaggacauuaaaagcuaucaggccaagaccccag

SEQ ID NO: 561874 - RNA, 64 nt, Homo Sapiens
ucaaccugcucacuguucuaucuccaaaugagacacauuaaaggguagccuacaaauguuuuca

SEQ ID NO: 561875 - RNA, 64 nt, Homo Sapiens
agacuuuuaauaaaaagaaauuguagaaauaaacacauuaaaauuugcccagcugucgucuaag

SEQ ID NO: 561876 - RNA, 64 nt, Homo Sapiens
uaauagcaauguauguguuauaauacaacuuaguacauuaaagcuacgaaaacucauccuggcu

SEQ ID NO: 561877 - RNA, 64 nt, Homo Sapiens
aacugauucaugaagacguuauugaaacuucuguacauuaaaagaagcgagcccaagucaugua

SEQ ID NO: 561878 - RNA, 64 nt, Homo Sapiens
ucuaaaggauauuauuguuucauuucaauaaaugacauuaaaaauaaguuucuguuaugauugc

SEQ ID NO: 561879 - RNA, 64 nt, Homo Sapiens
guaaaauguauaagucaucucacuuuuugucaagacauuaaaccaucuuagaucggagugugaa

SEQ ID NO: 561880 - RNA, 64 nt, Homo Sapiens
uaauagcaagaaaauugauguauauuuuaaugauacauuaaaauucccuuuuaaucauaauagu

SEQ ID NO: 561881 - RNA, 64 nt, Homo Sapiens
cucuugagaacuauaaaguggugaaaaggauaaaacauuaaaaauuaaacaauuuuuuucuaac

SEQ ID NO: 561882 - RNA, 64 nt, Homo Sapiens
cuguaaaugaaagccaccuugacaguccccacacacauuaaauuacuugaguccauauggguug

SEQ ID NO: 561883 - RNA, 64 nt, Homo Sapiens
aaauggacauuccagaauauaauuccacuacacuacauuaaagucuaugugcaauuauacucua

SEQ ID NO: 561884 - RNA, 57 nt, Homo Sapiens
uuguaauacuaguuuuuuaaagucaucacauuaaacacugaagcuacuacugauuaa

SEQ ID NO: 561885 - RNA, 64 nt, Homo Sapiens
aagguuuaaaaaucuauuuuaaagagaaaauuucacauuaaagggauagaauucauaacacauu

SEQ ID NO: 561886 - RNA, 64 nt, Homo Sapiens
gaaaauuucacauuaaaggaauagaauucauaacacauuaaagaauccuaaaugguuauauuug

SEQ ID NO: 561887 - RNA, 64 nt, Homo Sapiens
auguuucuuagaaacuuuaaaccuuuaacuucaaacauuaaaauacaagucuuuuaaguacaug

SEQ ID NO: 561888 - RNA, 64 nt, Homo Sapiens
aaauguacauaauguuuauauacacuuaugccuuacauuaaaguccaauaugagaaauacaugu

SEQ ID NO: 561889 - RNA, 64 nt, Homo Sapiens
caaaguguucauacuaaaauauauuuuugcagauacauuaaauaugaaagauauucaauccaaa

SEQ ID NO: 561890 - RNA, 64 nt, Homo Sapiens
cauuauuuaugaccuuuucuaugaaaagauaaggacauuaaaauguaagaugcgugaggaaaau

SEQ ID NO: 561891 - RNA, 64 nt, Homo Sapiens
auagagaaacuugaguaauuuuuacauuucuaagacauuaaaucccauuuaaauucugugugaa

SEQ ID NO: 561892 - RNA, 64 nt, Homo Sapiens
cuaagacauuaaaucccauuuaaauucugugugaacauuaaagacagcacacuugcaaaaguau

SEQ ID NO: 561893 - RNA, 64 nt, Homo Sapiens
auacucgaggcauaaauguauuauauucccaacaacauuaaaaauuuauuuuuauuuuuugugg

SEQ ID NO: 561894 - RNA, 64 nt, Homo Sapiens
ucacuugguaguuagccacauuauuuuauuagaaacauuaaagaaauguuuuguauuucuugac

SEQ ID NO: 561895 - RNA, 64 nt, Homo Sapiens
uacacacacacacacacgaacccucacucucacacuugcacacagaugcuugcacacaugcacc

SEQ ID NO: 561896 - RNA, 64 nt, Homo Sapiens
ugcacccccucacucucacaaggaaugaaggaugcuugcacacaagcguuggucuucucuuguc

SEQ ID NO: 561897 - RNA, 64 nt, Homo Sapiens
auggucucaguuguauagaugaguuuuugaaaugcuugcacagcuauccaauccacuggucugu

SEQ ID NO: 561898 - RNA, 64 nt, Homo Sapiens
gcagaggcuccgggcucacuugcuugcacaccgccuugcacauagagcaaaaagcugcagccgg

SEQ ID NO: 561899 - RNA, 64 nt, Homo Sapiens
gccuugcacauagcagaggcagcugcagccggugcuugcacaccagagaaagaagagagcaaaa

SEQ ID NO: 561900 - RNA, 64 nt, Homo Sapiens
gcagaggcuccgggcugacuugcuugcacaccgccuugcacauacagcaaagagccgcagccgg

SEQ ID NO: 561901 - RNA, 64 nt, Homo Sapiens
gccuugcacauagcagaggcagccgcagccggugcuugcacaccagaaagaagagacagcaaag

SEQ ID NO: 561902 - RNA, 64 nt, Homo Sapiens
cuucaauagauuuauucuuauucaguaaaguguucuugcacaucucagaacuauuuuugugguu

SEQ ID NO: 561903 - RNA, 64 nt, Homo Sapiens
uucaaaguaguccgcaaagcccacgcccggcccacuugcacauugggauuacaggcgugagcca

SEQ ID NO: 561904 - RNA, 64 nt, Homo Sapiens
uuuuguuuguuuguuuguuuugucacuuauuucacuugcacauuaauaucuuguguuugcuuuu

SEQ ID NO: 561905 - RNA, 64 nt, Homo Sapiens
caagacaggacccugggaccacagagggcaggaacuugcacaaaaucacacagccaagccaguc

SEQ ID NO: 561906 - RNA, 64 nt, Homo Sapiens
cuaugugggugggaccacagacucacauccugaccuugcacaaacagccccucuggacacagcc

SEQ ID NO: 561907 - RNA, 64 nt, Homo Sapiens
cgcugccuugcgggaggggggacgaugcuacuuucuugcacacgucgaaggacuugcacagaca

SEQ ID NO: 561908 - RNA, 64 nt, Homo Sapiens
cagacgaugcuacuuucuugccuaacucgaaggacuugcacagaacacuugcccguauuacuua

SEQ ID NO: 561909 - RNA, 64 nt, Homo Sapiens
caaccuaccuucuuuccagagcuuccagaugauccuugcacagacugagaguuccagauuccca

SEQ ID NO: 561910 - RNA, 64 nt, Homo Sapiens
auccucagaaccauucacugcucacccugcauagcuugcacaacagaguccugguuuccucagc

SEQ ID NO: 561911 - RNA, 64 nt, Homo Sapiens
ugcuuuacagacuuccaagaaaaugccgaagcagcuugcacaguuggaacacuuuaacagaagg

SEQ ID NO: 561912 - RNA, 64 nt, Homo Sapiens
ucaauaauuccuuucccgagaauuucuuugaauacuugcacauugcuaaauggagaaauguuuc

SEQ ID NO: 561913 - RNA, 64 nt, Homo Sapiens; identical to SEQ ID NO: 561843

SEQ ID NO: 561914 - RNA, 64 nt, Homo Sapiens; identical to SEQ ID NO: 561844

SEQ ID NO: 561915 - RNA, 64 nt, Homo Sapiens; identical to SEQ ID NO: 561845

SEQ ID NO: 561916 - RNA, 64 nt, Homo Sapiens; identical to SEQ ID NO: 561846

SEQ ID NO: 561917 - RNA, 64 nt, Homo Sapiens; identical to SEQ ID NO: 561847

SEQ ID NO: 561918 - RNA, 64 nt, Homo Sapiens; identical to SEQ ID NO: 561848

SEQ ID NO: 561919 - RNA, 64 nt, Homo Sapiens; identical to SEQ ID NO: 561849

SEQ ID NO: 561920 - RNA, 64 nt, Homo Sapiens; identical to SEQ ID NO: 561850

SEQ ID NO: 561921 - RNA, 64 nt, Homo Sapiens; identical to SEQ ID NO: 561851

SEQ ID NO: 561922 - RNA, 64 nt, Homo Sapiens; identical to SEQ ID NO: 561852

SEQ ID NO: 561923 - RNA, 64 nt, Homo Sapiens; identical to SEQ ID NO: 561853

SEQ ID NO: 561924 - RNA, 64 nt, Homo Sapiens; identical to SEQ ID NO: 561854

SEQ ID NO: 561925 - RNA, 64 nt, Homo Sapiens; identical to SEQ ID NO: 561855

SEQ ID NO: 561926 - RNA, 64 nt, Homo Sapiens; identical to SEQ ID NO: 561856

SEQ ID NO: 561927 - RNA, 64 nt, Homo Sapiens; identical to SEQ ID NO: 561857

SEQ ID NO: 561928 - RNA, 64 nt, Homo Sapiens; identical to SEQ ID NO: 561858

SEQ ID NO: 561929 - RNA, 64 nt, Homo Sapiens; identical to SEQ ID NO: 561859

SEQ ID NO: 561930 - RNA, 64 nt, Homo Sapiens; identical to SEQ ID NO: 561860

SEQ ID NO: 561931 - RNA, 64 nt, Homo Sapiens; identical to SEQ ID NO: 561861

SEQ ID NO: 561932 - RNA, 64 nt, Homo Sapiens; identical to SEQ ID NO: 561862

SEQ ID NO: 561933 - RNA, 64 nt, Homo Sapiens; identical to SEQ ID NO: 561863

SEQ ID NO: 561934 - RNA, 64 nt, Homo Sapiens; identical to SEQ ID NO: 561864

SEQ ID NO: 561935 - RNA, 64 nt, Homo Sapiens; identical to SEQ ID NO: 561865

SEQ ID NO: 561936 - RNA, 64 nt, Homo Sapiens; identical to SEQ ID NO: 561866

SEQ ID NO: 561937 - RNA, 64 nt, Homo Sapiens; identical to SEQ ID NO: 561867

SEQ ID NO: 561938 - RNA, 64 nt, Homo Sapiens; identical to SEQ ID NO: 561868

SEQ ID NO: 561939 - RNA, 64 nt, Homo Sapiens; identical to SEQ ID NO: 561869

SEQ ID NO: 561940 - RNA, 64 nt, Homo Sapiens; identical to SEQ ID NO: 561870

SEQ ID NO: 561941 - RNA, 64 nt, Homo Sapiens; identical to SEQ ID NO: 561871

SEQ ID NO: 561942 - RNA, 64 nt, Homo Sapiens; identical to SEQ ID NO: 561872

SEQ ID NO: 561943 - RNA, 64 nt, Homo Sapiens; identical to SEQ ID NO: 561873

SEQ ID NO: 561944 - RNA, 64 nt, Homo Sapiens; identical to SEQ ID NO: 561874

SEQ ID NO: 561945 - RNA, 64 nt, Homo Sapiens; identical to SEQ ID NO: 561875

SEQ ID NO: 561946 - RNA, 64 nt, Homo Sapiens; identical to SEQ ID NO: 561876

SEQ ID NO: 561947 - RNA, 64 nt, Homo Sapiens; identical to SEQ ID NO: 561877

SEQ ID NO: 561948 - RNA, 64 nt, Homo Sapiens; identical to SEQ ID NO: 561878

SEQ ID NO: 561949 - RNA, 64 nt, Homo Sapiens; identical to SEQ ID NO: 561879

SEQ ID NO: 561950 - RNA, 64 nt, Homo Sapiens; identical to SEQ ID NO: 561880

SEQ ID NO: 561951 - RNA, 64 nt, Homo Sapiens; identical to SEQ ID NO: 561881

SEQ ID NO: 561952 - RNA, 64 nt, Homo Sapiens; identical to SEQ ID NO: 561882

SEQ ID NO: 561953 - RNA, 64 nt, Homo Sapiens; identical to SEQ ID NO: 561883

SEQ ID NO: 561954 - RNA, 57 nt, Homo Sapiens; identical to SEQ ID NO: 561884

SEQ ID NO: 561955 - RNA, 64 nt, Homo Sapiens; identical to SEQ ID NO: 561885

SEQ ID NO: 561956 - RNA, 64 nt, Homo Sapiens; identical to SEQ ID NO: 561886

SEQ ID NO: 561957 - RNA, 64 nt, Homo Sapiens; identical to SEQ ID NO: 561887

SEQ ID NO: 561958 - RNA, 64 nt, Homo Sapiens; identical to SEQ ID NO: 561888

SEQ ID NO: 561959 - RNA, 64 nt, Homo Sapiens; identical to SEQ ID NO: 561889

SEQ ID NO: 561960 - RNA, 64 nt, Homo Sapiens; identical to SEQ ID NO: 561890

SEQ ID NO: 561961 - RNA, 64 nt, Homo Sapiens; identical to SEQ ID NO: 561891

SEQ ID NO: 561962 - RNA, 64 nt, Homo Sapiens; identical to SEQ ID NO: 561892

SEQ ID NO: 561963 - RNA, 64 nt, Homo Sapiens; identical to SEQ ID NO: 561893

SEQ ID NO: 561964 - RNA, 64 nt, Homo Sapiens; identical to SEQ ID NO: 561894

SEQ ID NO: 561965 - RNA, 64 nt, Homo Sapiens; identical to SEQ ID NO: 561895

SEQ ID NO: 561966 - RNA, 64 nt, Homo Sapiens; identical to SEQ ID NO: 561896

SEQ ID NO: 561967 - RNA, 64 nt, Homo Sapiens; identical to SEQ ID NO: 561897

SEQ ID NO: 561968 - RNA, 64 nt, Homo Sapiens; identical to SEQ ID NO: 561898

SEQ ID NO: 561969 - RNA, 64 nt, Homo Sapiens; identical to SEQ ID NO: 561899

SEQ ID NO: 561970 - RNA, 64 nt, Homo Sapiens; identical to SEQ ID NO: 561900

SEQ ID NO: 561971 - RNA, 64 nt, Homo Sapiens; identical to SEQ ID NO: 561901

SEQ ID NO: 561972 - RNA, 64 nt, Homo Sapiens; identical to SEQ ID NO: 561902

SEQ ID NO: 561973 - RNA, 64 nt, Homo Sapiens; identical to SEQ ID NO: 561903

SEQ ID NO: 561974 - RNA, 64 nt, Homo Sapiens; identical to SEQ ID NO: 561904

SEQ ID NO: 561975 - RNA, 64 nt, Homo Sapiens; identical to SEQ ID NO: 561905

SEQ ID NO: 561976 - RNA, 64 nt, Homo Sapiens; identical to SEQ ID NO: 561906

SEQ ID NO: 561977 - RNA, 64 nt, Homo Sapiens; identical to SEQ ID NO: 561907

SEQ ID NO: 561978 - RNA, 64 nt, Homo Sapiens; identical to SEQ ID NO: 561908

SEQ ID NO: 561979 - RNA, 64 nt, Homo Sapiens; identical to SEQ ID NO: 561909

SEQ ID NO: 561980 - RNA, 64 nt, Homo Sapiens; identical to SEQ ID NO: 561910

SEQ ID NO: 561981 - RNA, 64 nt, Homo Sapiens; identical to SEQ ID NO: 561911

SEQ ID NO: 561982 - RNA, 64 nt, Homo Sapiens; identical to SEQ ID NO: 561912

SEQ ID NO: 561983 - RNA, 64 nt, Homo Sapiens; identical to SEQ ID NO: 389582

SEQ ID NO: 561984 - RNA, 64 nt, Homo Sapiens; identical to SEQ ID NO: 389583

SEQ ID NO: 561985 - RNA, 64 nt, Homo Sapiens; identical to SEQ ID NO: 389584

SEQ ID NO: 561986 - RNA, 64 nt, Homo Sapiens; identical to SEQ ID NO: 389585

SEQ ID NO: 561987 - RNA, 64 nt, Homo Sapiens; identical to SEQ ID NO: 389586

SEQ ID NO: 561988 - RNA, 64 nt, Homo Sapiens; identical to SEQ ID NO: 389587

SEQ ID NO: 561989 - RNA, 64 nt, Homo Sapiens
aggaaaagcaaaggcuuuucuuuucaguuuguguuauuuggaagacagaaaaacaucuugucua

SEQ ID NO: 561990 - RNA, 64 nt, Homo Sapiens
aaugggacuguagguuguuuuucuacaucuucauuauuuggaccuaaaaccaguuuuuaauaag

SEQ ID NO: 561991 - RNA, 64 nt, Homo Sapiens
aguuauugucugugccaugaaacaauacgucauauauuuggaaccccagccuagaaagcacagg

SEQ ID NO: 561992 - RNA, 64 nt, Homo Sapiens
uggauguuuuugaauuauuugugugcucagggacuauuuggaacacuucuugcuggaaugaaca

SEQ ID NO: 561993 - RNA, 64 nt, Homo Sapiens
auguuguagcuugggugaauuacacuuccuaguuuauuuggauuuaaguugacaaauaaaaauu

SEQ ID NO: 561994 - RNA, 64 nt, Homo Sapiens
cguugguauaacauugcuucuugaaaaaugaaaguauuuggacauacagacagaagcaauauua

SEQ ID NO: 561995 - RNA, 64 nt, Homo Sapiens
guuacaugguagaacugcccaugccacaaauauuuauuuggaaaaguagucauuaaaugaaccc

SEQ ID NO: 561996 - RNA, 64 nt, Homo Sapiens
caaccaugcccccuucguuggcaucacagggccuuauuuggaagagcgggcaaagaggauggaa

SEQ ID NO: 561997 - RNA, 64 nt, Homo Sapiens
accaguggaaugucagauaauuuucaccaguuuuuauuuggagccguuuuauuguguagaccau

SEQ ID NO: 561998 - RNA, 64 nt, Homo Sapiens
uuggagccguuuuauuguguagaccauauuuacauauuuggauaaguacacaaagcgucaaugc

SEQ ID NO: 561999 - RNA, 64 nt, Homo Sapiens
gcauaugcuuuuugcuaaauauguauguacagaguauuuggaaguuaagaauugauuagacuag

SEQ ID NO: 562000 - RNA, 64 nt, Homo Sapiens
ugaauuuuuugccaaacuuaguaacucuguuaaauauuuggaggauuuaaagaacaucccaguu

SEQ ID NO: 562001 - RNA, 64 nt, Homo Sapiens
uaaguguuuugcuuuugucuuuucagcauugugcuauuuggaaaguuuuaggauugcuaucaau

SEQ ID NO: 562002 - RNA, 64 nt, Homo Sapiens
uuuaaaggaguaaagacuguugauuauguuggaauauuuggaauuaaaaugguuuuuacuccug

SEQ ID NO: 562003 - RNA, 64 nt, Homo Sapiens
uuuggcaaccucuguauuuggguuacagucaaccuauuuggauacuuggcaaaagauucuugcu

SEQ ID NO: 562004 - RNA, 64 nt, Homo Sapiens
auauuuuauaugccuuuugagcuguguaacuuaauauuuggauacuugacaauuuguuuuauua

SEQ ID NO: 562005 - RNA, 64 nt, Homo Sapiens
gacgucuguguuuuugaaggguuguguggcgagcuauuuggaaaugaggacagaugaugcagcu

SEQ ID NO: 562006 - RNA, 64 nt, Homo Sapiens
auuuguguauuguacgauguuugaaauuguaguguauuuggauucuuagcuguuaucccuacuc

SEQ ID NO: 562007 - RNA, 64 nt, Homo Sapiens
uaacucccuuaguaauugcuacaguauuaggguuuauuuggaguacaauaaaguuuacuaaaaa

SEQ ID NO: 562008 - RNA, 64 nt, Homo Sapiens
gaauggaagaauauggguuauccacuggagauaguauuuggaaucaggaagugggaaaacucua

SEQ ID NO: 562009 - RNA, 64 nt, Homo Sapiens
guaaugagcugagaaaagacagagcauaucuguguauuuggaaaaauaauuguaacguaauugc

SEQ ID NO: 562010 - RNA, 64 nt, Homo Sapiens
uguaacguaauugcagugcauuuagacaggcaucuauuuggaccuguuucuaucucuaaaugaa

SEQ ID NO: 562011 - RNA, 64 nt, Homo Sapiens
uuuaucuauauugaaaaucauuuacauuggccuauauuuggaagagagauagucuuuuguuuuu

SEQ ID NO: 562012 - RNA, 64 nt, Homo Sapiens
uuucuuacuauaaauuuuaaacaaauugguuaguuauuuggauauuuuauuaaacuaguaacac

SEQ ID NO: 562013 - RNA, 64 nt, Homo Sapiens
ccaaagggcccccuaacccucuuguggcuccaguuauuuggaaacuaugaucugcauccuuagg

SEQ ID NO: 562014 - RNA, 64 nt, Homo Sapiens
uaagcgccagugguaguugggaggaauaaaccauuauuuggaugcaggugguuuuugauugcaa

SEQ ID NO: 562015 - RNA, 64 nt, Homo Sapiens
cagaaaguuguaaaguuugugcuggagaaagguuuauuuggacuuugauuacauaaauauuaaa

SEQ ID NO: 562016 - RNA, 64 nt, Homo Sapiens
uuuucucuaauuaggugacuguucauaauggguauauuuggaauuuagaagaaauaauuuugua

SEQ ID NO: 562017 - RNA, 64 nt, Homo Sapiens
agcugccuggagagaagaacaagugugaaauuuguauuuggaaaaagaaaagcccuuauuugga

SEQ ID NO: 562018 - RNA, 64 nt, Homo Sapiens
gugugaaauuuguauuuggaucaagaaaagcccuuauuuggaaauacccauaaucaguaaccua

SEQ ID NO: 562019 - RNA, 64 nt, Homo Sapiens
aaggcguaagauaaggauggaaggcuguccaaguuauuuggaaggccucggcagcuugggauua

SEQ ID NO: 562020 - RNA, 64 nt, Homo Sapiens
auugacucuuccaauauaggucucagaaauccaauauuuggaguacaauuucuuuuaauccaga

SEQ ID NO: 562021 - RNA, 64 nt, Homo Sapiens
ucauguugcuuuagguuuaauaaauagccuuaacuauuuggaggggaaaaaaugggucaacuuu

SEQ ID NO: 562022 - RNA, 64 nt, Homo Sapiens
gcguuugcauguacaacuuucuauuuuuagccuauauuuggaaagaaagcacuuaacauuuuag

SEQ ID NO: 562023 - RNA, 64 nt, Homo Sapiens
uucucauuuuuaguucugauuguuacuauagaacuauuuggauugaaacuuguucauaauuuau

SEQ ID NO: 562024 - RNA, 64 nt, Homo Sapiens
aagauacagcaacaaucauuuuaaaaaacauaucuauuuggaauaguuaguuuuauaaugauuu

SEQ ID NO: 562025 - RNA, 64 nt, Homo Sapiens
uaauuucagcuuaauugaccuuauuagaacucaguauuuggaaaugcaguuuucuuuccaguac

SEQ ID NO: 562026 - RNA, 64 nt, Homo Sapiens
uaaaauaagaguaucauccauuuacuauuuguuuuauuuggaguuguuuucuucccucaaauau

SEQ ID NO: 562027 - RNA, 64 nt, Homo Sapiens
aaguuugugcccuguguuuuucaacuauuuucuauauuuggagauaaaaaugaauugaaccauu

SEQ ID NO: 562028 - RNA, 64 nt, Homo Sapiens
uaaauggaaauuaauuuauuguagacuacaucucuauuuggaaugaugagguaaauguauaccu

SEQ ID NO: 562029 - RNA, 64 nt, Homo Sapiens
caccuuuaauguuuuauugauuucacuggcacuguauuuggaccuguccuuguauauguagaga

SEQ ID NO: 562030 - RNA, 64 nt, Homo Sapiens
guauucauggaucgaagcaaccauggaucaaaaguauuuggagcauccauggauugcagugauc

SEQ ID NO: 562031 - RNA, 64 nt, Homo Sapiens
gcauccauggauugcagugaucauuaaucaaaaauauuuggaaaacaaaaaggguaguugcauc

SEQ ID NO: 562032 - RNA, 64 nt, Homo Sapiens
uauuucauuacuaacaaucuucuaccaucacuaauauuuggaagaaagagcccuacacuagauu

SEQ ID NO: 562033 - RNA, 64 nt, Homo Sapiens
gggauuucagcaacuaaacacaugagaaauaugauauuuggauaauugcauauugucagagcag

SEQ ID NO: 562034 - RNA, 64 nt, Homo Sapiens
gaagauaaaaguacauaaugaaaauccauggccuuauuuggaauauauaucacuuuccaaauuu

SEQ ID NO: 562035 - RNA, 64 nt, Homo Sapiens
uuuagguuccuuaauuuggcuguugguaccuguguauuuggaauauuuuaggggauucgaauuu

SEQ ID NO: 562036 - RNA, 64 nt, Homo Sapiens; identical to SEQ ID NO: 95478

SEQ ID NO: 562037 - RNA, 64 nt, Homo Sapiens; identical to SEQ ID NO: 95479

SEQ ID NO: 562038 - RNA, 64 nt, Homo Sapiens; identical to SEQ ID NO: 95480

SEQ ID NO: 562039 - RNA, 64 nt, Homo Sapiens; identical to SEQ ID NO: 95481

SEQ ID NO: 562040 - RNA, 64 nt, Homo Sapiens; identical to SEQ ID NO: 95482

SEQ ID NO: 562041 - RNA, 64 nt, Homo Sapiens; identical to SEQ ID NO: 95483

SEQ ID NO: 562042 - RNA, 64 nt, Homo Sapiens; identical to SEQ ID NO: 95484

SEQ ID NO: 562043 - RNA, 64 nt, Homo Sapiens; identical to SEQ ID NO: 95485

SEQ ID NO: 562044 - RNA, 64 nt, Homo Sapiens; identical to SEQ ID NO: 95486

SEQ ID NO: 562045 - RNA, 64 nt, Homo Sapiens; identical to SEQ ID NO: 95487

SEQ ID NO: 562046 - RNA, 64 nt, Homo Sapiens; identical to SEQ ID NO: 95488

SEQ ID NO: 562047 - RNA, 64 nt, Homo Sapiens; identical to SEQ ID NO: 95489

SEQ ID NO: 562048 - RNA, 64 nt, Homo Sapiens; identical to SEQ ID NO: 95490

SEQ ID NO: 562049 - RNA, 64 nt, Homo Sapiens; identical to SEQ ID NO: 95491

SEQ ID NO: 562050 - RNA, 64 nt, Homo Sapiens; identical to SEQ ID NO: 95492

SEQ ID NO: 562051 - RNA, 64 nt, Homo Sapiens; identical to SEQ ID NO: 95493

SEQ ID NO: 562052 - RNA, 64 nt, Homo Sapiens; identical to SEQ ID NO: 95494

SEQ ID NO: 562053 - RNA, 64 nt, Homo Sapiens; identical to SEQ ID NO: 95495

SEQ ID NO: 562054 - RNA, 64 nt, Homo Sapiens; identical to SEQ ID NO: 95496

SEQ ID NO: 562055 - RNA, 64 nt, Homo Sapiens; identical to SEQ ID NO: 95497

SEQ ID NO: 562056 - RNA, 64 nt, Homo Sapiens; identical to SEQ ID NO: 95498

SEQ ID NO: 562057 - RNA, 64 nt, Homo Sapiens; identical to SEQ ID NO: 95499

SEQ ID NO: 562058 - RNA, 64 nt, Homo Sapiens; identical to SEQ ID NO: 95500

SEQ ID NO: 562059 - RNA, 64 nt, Homo Sapiens; identical to SEQ ID NO: 95501

SEQ ID NO: 562060 - RNA, 64 nt, Homo Sapiens; identical to SEQ ID NO: 95502

SEQ ID NO: 562061 - RNA, 64 nt, Homo Sapiens; identical to SEQ ID NO: 95503

SEQ ID NO: 562062 - RNA, 64 nt, Homo Sapiens; identical to SEQ ID NO: 95504

SEQ ID NO: 562063 - RNA, 64 nt, Homo Sapiens; identical to SEQ ID NO: 95505

SEQ ID NO: 562064 - RNA, 64 nt, Homo Sapiens; identical to SEQ ID NO: 95506

SEQ ID NO: 562065 - RNA, 64 nt, Homo Sapiens; identical to SEQ ID NO: 95507

SEQ ID NO: 562066 - RNA, 64 nt, Homo Sapiens; identical to SEQ ID NO: 95508

SEQ ID NO: 562067 - RNA, 64 nt, Homo Sapiens; identical to SEQ ID NO: 95509

SEQ ID NO: 562068 - RNA, 64 nt, Homo Sapiens; identical to SEQ ID NO: 95510

SEQ ID NO: 562069 - RNA, 64 nt, Homo Sapiens; identical to SEQ ID NO: 95511

SEQ ID NO: 562070 - RNA, 64 nt, Homo Sapiens; identical to SEQ ID NO: 95512

SEQ ID NO: 562071 - RNA, 64 nt, Homo Sapiens; identical to SEQ ID NO: 95513

SEQ ID NO: 562072 - RNA, 64 nt, Homo Sapiens; identical to SEQ ID NO: 95514

SEQ ID NO: 562073 - RNA, 64 nt, Homo Sapiens; identical to SEQ ID NO: 95515

SEQ ID NO: 562074 - RNA, 64 nt, Homo Sapiens; identical to SEQ ID NO: 95516

SEQ ID NO: 562075 - RNA, 64 nt, Homo Sapiens; identical to SEQ ID NO: 95517

SEQ ID NO: 562076 - RNA, 64 nt, Homo Sapiens; identical to SEQ ID NO: 95518

SEQ ID NO: 562077 - RNA, 64 nt, Homo Sapiens; identical to SEQ ID NO: 95519

SEQ ID NO: 562078 - RNA, 64 nt, Homo Sapiens; identical to SEQ ID NO: 95520

SEQ ID NO: 562079 - RNA, 64 nt, Homo Sapiens; identical to SEQ ID NO: 95521

SEQ ID NO: 562080 - RNA, 64 nt, Homo Sapiens; identical to SEQ ID NO: 95522

SEQ ID NO: 562081 - RNA, 64 nt, Homo Sapiens; identical to SEQ ID NO: 95523

SEQ ID NO: 562082 - RNA, 64 nt, Homo Sapiens; identical to SEQ ID NO: 95524

SEQ ID NO: 562083 - RNA, 64 nt, Homo Sapiens; identical to SEQ ID NO: 95525

SEQ ID NO: 562084 - RNA, 64 nt, Homo Sapiens; identical to SEQ ID NO: 150365

SEQ ID NO: 562085 - RNA, 64 nt, Homo Sapiens; identical to SEQ ID NO: 150366

SEQ ID NO: 562086 - RNA, 64 nt, Homo Sapiens; identical to SEQ ID NO: 150367

SEQ ID NO: 562087 - RNA, 64 nt, Homo Sapiens; identical to SEQ ID NO: 150368

SEQ ID NO: 562088 - RNA, 64 nt, Homo Sapiens; identical to SEQ ID NO: 150369

SEQ ID NO: 562089 - RNA, 64 nt, Homo Sapiens; identical to SEQ ID NO: 150370

SEQ ID NO: 562090 - RNA, 64 nt, Homo Sapiens; identical to SEQ ID NO: 150371

SEQ ID NO: 562091 - RNA, 64 nt, Homo Sapiens; identical to SEQ ID NO: 150372

SEQ ID NO: 562092 - RNA, 64 nt, Homo Sapiens; identical to SEQ ID NO: 150373

SEQ ID NO: 562093 - RNA, 64 nt, Homo Sapiens; identical to SEQ ID NO: 150374

SEQ ID NO: 562094 - RNA, 64 nt, Homo Sapiens; identical to SEQ ID NO: 150375

SEQ ID NO: 562095 - RNA, 64 nt, Homo Sapiens; identical to SEQ ID NO: 150376

SEQ ID NO: 562096 - RNA, 64 nt, Homo Sapiens; identical to SEQ ID NO: 150377

SEQ ID NO: 562097 - RNA, 64 nt, Homo Sapiens; identical to SEQ ID NO: 150378

SEQ ID NO: 562098 - RNA, 64 nt, Homo Sapiens; identical to SEQ ID NO: 80175

SEQ ID NO: 562099 - RNA, 64 nt, Homo Sapiens; identical to SEQ ID NO: 80176

SEQ ID NO: 562100 - RNA, 64 nt, Homo Sapiens; identical to SEQ ID NO: 80177

SEQ ID NO: 562101 - RNA, 64 nt, Homo Sapiens; identical to SEQ ID NO: 80178

SEQ ID NO: 562102 - RNA, 64 nt, Homo Sapiens; identical to SEQ ID NO: 80179

SEQ ID NO: 562103 - RNA, 64 nt, Homo Sapiens; identical to SEQ ID NO: 80180

SEQ ID NO: 562104 - RNA, 64 nt, Homo Sapiens; identical to SEQ ID NO: 80181

SEQ ID NO: 562105 - RNA, 50 nt, Homo Sapiens; identical to SEQ ID NO: 80182

SEQ ID NO: 562106 - RNA, 64 nt, Homo Sapiens; identical to SEQ ID NO: 188510

SEQ ID NO: 562107 - RNA, 64 nt, Homo Sapiens; identical to SEQ ID NO: 188511

SEQ ID NO: 562108 - RNA, 64 nt, Homo Sapiens; identical to SEQ ID NO: 188512

SEQ ID NO: 562109 - RNA, 64 nt, Homo Sapiens; identical to SEQ ID NO: 188513

SEQ ID NO: 562110 - RNA, 64 nt, Homo Sapiens; identical to SEQ ID NO: 188514

SEQ ID NO: 562111 - RNA, 64 nt, Homo Sapiens; identical to SEQ ID NO: 188515

SEQ ID NO: 562112 - RNA, 64 nt, Homo Sapiens; identical to SEQ ID NO: 188516

SEQ ID NO: 562113 - RNA, 64 nt, Homo Sapiens; identical to SEQ ID NO: 188517

SEQ ID NO: 562114 - RNA, 64 nt, Homo Sapiens; identical to SEQ ID NO: 188518

SEQ ID NO: 562115 - RNA, 64 nt, Homo Sapiens; identical to SEQ ID NO: 188519

SEQ ID NO: 562116 - RNA, 64 nt, Homo Sapiens; identical to SEQ ID NO: 188520

SEQ ID NO: 562117 - RNA, 64 nt, Homo Sapiens; identical to SEQ ID NO: 188521

SEQ ID NO: 562118 - RNA, 64 nt, Homo Sapiens; identical to SEQ ID NO: 188522

SEQ ID NO: 562119 - RNA, 64 nt, Homo Sapiens; identical to SEQ ID NO: 188523

SEQ ID NO: 562120 - RNA, 64 nt, Homo Sapiens; identical to SEQ ID NO: 188524

SEQ ID NO: 562121 - RNA, 64 nt, Homo Sapiens; identical to SEQ ID NO: 188525

SEQ ID NO: 562122 - RNA, 64 nt, Homo Sapiens; identical to SEQ ID NO: 188526

SEQ ID NO: 562123 - RNA, 64 nt, Homo Sapiens; identical to SEQ ID NO: 188527

SEQ ID NO: 562124 - RNA, 64 nt, Homo Sapiens; identical to SEQ ID NO: 188528

SEQ ID NO: 562125 - RNA, 64 nt, Homo Sapiens; identical to SEQ ID NO: 188529

SEQ ID NO: 562126 - RNA, 64 nt, Homo Sapiens; identical to SEQ ID NO: 188530

SEQ ID NO: 562127 - RNA, 64 nt, Homo Sapiens; identical to SEQ ID NO: 188531

SEQ ID NO: 562128 - RNA, 64 nt, Homo Sapiens; identical to SEQ ID NO: 188532

SEQ ID NO: 562129 - RNA, 64 nt, Homo Sapiens; identical to SEQ ID NO: 188533

SEQ ID NO: 562130 - RNA, 64 nt, Homo Sapiens; identical to SEQ ID NO: 188534

SEQ ID NO: 562131 - RNA, 64 nt, Homo Sapiens
caaguaaaaauucucaucuggucuccccugcuguuaguaacagucaccaaaauguucuaagcaa

SEQ ID NO: 562132 - RNA, 64 nt, Homo Sapiens
uaguaaaauaaguaaauuucuuuuggaauauuuuuaguaacaaauagccacuauaauucuguag

SEQ ID NO: 562133 - RNA, 64 nt, Homo Sapiens
aaggcauagcuaaaggcuaaacauauggcuuuaguaguaacaaaaggguucauagaaacuucau

SEQ ID NO: 562134 - RNA, 64 nt, Homo Sapiens
ucuauagagauaaauagaaauuuucaauaagauguaguaacacugugauuuaucuuucaagagu

SEQ ID NO: 562135 - RNA, 64 nt, Homo Sapiens
guauuuauuaaacuacagcauuguacaauuagcuuaguaacacuauggaauaagcuaaaacaua

SEQ ID NO: 562136 - RNA, 64 nt, Homo Sapiens
gaaaugaaaaucugccguggaauuaacuaauaaguaguaacaauaaacuucauauuuagaaugc

SEQ ID NO: 562137 - RNA, 64 nt, Homo Sapiens; identical to SEQ ID NO: 111876

SEQ ID NO: 562138 - RNA, 64 nt, Homo Sapiens; identical to SEQ ID NO: 111877

SEQ ID NO: 562139 - RNA, 64 nt, Homo Sapiens; identical to SEQ ID NO: 111878

SEQ ID NO: 562140 - RNA, 64 nt, Homo Sapiens; identical to SEQ ID NO: 111879

SEQ ID NO: 562141 - RNA, 64 nt, Homo Sapiens; identical to SEQ ID NO: 111880

SEQ ID NO: 562142 - RNA, 64 nt, Homo Sapiens; identical to SEQ ID NO: 111881

SEQ ID NO: 562143 - RNA, 64 nt, Homo Sapiens
agguugcuuucuuaguuucagcaaugggcuggcuugucuagacaugguuuuaagaauagcugac

SEQ ID NO: 562144 - RNA, 64 nt, Homo Sapiens
guucguccucccccacucccuccuaucguugguuugucuagaacacucagcugcuucuuugguc

SEQ ID NO: 562145 - RNA, 64 nt, Homo Sapiens
uccugccacuuccaauucuugccauugcucacucugucuagacuucguaauuuauuucccccca

SEQ ID NO: 562146 - RNA, 64 nt, Homo Sapiens
uggggguggcuggguuuaucuuggcuggagcaugugucuagaggaaucugcaacacuccugcug

SEQ ID NO: 562147 - RNA, 62 nt, Homo Sapiens
gcuaagucaggaacaucggaugccagggagggaggagaaagccgaagcgaaaggggucaggg

SEQ ID NO: 562148 - RNA, 62 nt, Homo Sapiens
ggaauuuuagugacaccuuaugccauuucaagaggagaaaugcaggcuggcagagcaauuuc

SEQ ID NO: 562149 - RNA, 62 nt, Homo Sapiens
auauuuaacuaaguaaaaguacauuaaaagacaggagaaauucuaacggaaacugcuuuuug

SEQ ID NO: 562150 - RNA, 62 nt, Homo Sapiens
ucugagaaaaugaaaacaucguagcagauggaaggagaaaccucauucauuucauuuccccc

SEQ ID NO: 562151 - RNA, 62 nt, Homo Sapiens
ggaaaagcagaaaggaaaaaaugaggagaaaaaggagaaaagauagguagaugguaaagaga

SEQ ID NO: 562152 - RNA, 62 nt, Homo Sapiens
ggagaaaagggaaaagcagaguaaagagaaugaggagaaaaagagggucacauagguagaug

SEQ ID NO: 562153 - RNA, 62 nt, Homo Sapiens
aggaaacgggcuuucucugaggcaaaguggugaggagaaaaccaggguuggugugaugccaa

SEQ ID NO: 562154 - RNA, 62 nt, Homo Sapiens
augcuuaggaaguuuucaggcucagcugugcaaggagaaagccgcucccaccauugccccuc

SEQ ID NO: 562155 - RNA, 62 nt, Homo Sapiens
ggucuaguuucugccucugauggugcaguggaaggagaaauauaucaaucucgguuuuuuug

SEQ ID NO: 562156 - RNA, 62 nt, Homo Sapiens
gaagaauguacacuuuuuuaaaaaaaaaguauaggagaaacuguuuugaaagauaggcaaaa

SEQ ID NO: 562157 - RNA, 62 nt, Homo Sapiens
gaaagugcccacgaaaauuauguaggcgcugcaggagaaagauaacauucacuguuagagag

SEQ ID NO: 562158 - RNA, 62 nt, Homo Sapiens
gagugaggccuuuuuaaccuuaggaauuccuaaggagaaacaaauuccuaaggaggaauucu

SEQ ID NO: 562159 - RNA, 52 nt, Homo Sapiens; identical to SEQ ID NO: 21695

SEQ ID NO: 562160 - RNA, 62 nt, Homo Sapiens
gugcccugcuggauaucugggucuggaacaggaggagaaagggugucugcugccuggugagg

SEQ ID NO: 562161 - RNA, 62 nt, Homo Sapiens
gcuggguuuugggucuaauugucaucuaagagaggagaaauaaugcuguuuuuauugggcau

SEQ ID NO: 562162 - RNA, 62 nt, Homo Sapiens
aauuguuuuuaaaucacacauuuggugggaggaggagaaaacaacuuaucucaaauggagau

SEQ ID NO: 562163 - RNA, 62 nt, Homo Sapiens
uguugaucgguagggcagccauauguguaggaaggagaaaacagaauuugguggauaccuag

SEQ ID NO: 562164 - RNA, 62 nt, Homo Sapiens
uuuuauaauccuuaaugugaggcuaagguauaaggagaaaggagauugguaaggaaguguga

SEQ ID NO: 562165 - RNA, 62 nt, Homo Sapiens
uaacuagaaaaccaaugaaauaaauauuuaagaggagaaaagauaaacauaauucaaauauu

SEQ ID NO: 562166 - RNA, 62 nt, Homo Sapiens
uguuuuuggagagcugugaaagcuauaaauauaggagaaaaaacaguauuucuauuuaaggc

SEQ ID NO: 562167 - RNA, 62 nt, Homo Sapiens
ccuuuggagaaacuggaccccaaguuggaccaaggagaaagcggcuccucugugacaaaaca

SEQ ID NO: 562168 - RNA, 62 nt, Homo Sapiens
aaugcuucugcaagauuuucuuaguuauucuaaggagaaaaaauugguauuuauuuuaaaua

SEQ ID NO: 562169 - RNA, 62 nt, Homo Sapiens
cucucagaaaagagaaaaaagaaugucaguuuaggagaaaagcuuccuuuuuacuugugugg

SEQ ID NO: 562170 - RNA, 62 nt, Homo Sapiens
gacaguaauuccagcucggucccuccaggcaaaggagaaacgggacuuacuucacaggacag

SEQ ID NO: 562171 - RNA, 62 nt, Homo Sapiens
aaaacagaaaccugguuauauauugaaaagacaggagaaaagguuucuggacguuugugcag

SEQ ID NO: 562172 - RNA, 62 nt, Homo Sapiens
uuuuuuggcuuuagauuuaauaauuuuuuuaaaggagaaaaaguucauaaggaggugagaag

SEQ ID NO: 562173 - RNA, 62 nt, Homo Sapiens
uggcuguccuuccauuuucaagcagagagcaaaggagaaaucccuagacuucagagagaaug

SEQ ID NO: 562174 - RNA, 62 nt, Homo Sapiens
acaaccaggaugaggaugucagcaaaccuaacaggagaaaggcugaauaucaacucugaaag

SEQ ID NO: 562175 - RNA, 62 nt, Homo Sapiens
aaacucaagucucaccauucaggagaagagugaggagaaagggcacagcagcucccucaagg

SEQ ID NO: 562176 - RNA, 62 nt, Homo Sapiens
gggcacaggagucggaaggaggguuccaauaaaggagaaacaugcuauguuuacucguucuu

SEQ ID NO: 562177 - RNA, 62 nt, Homo Sapiens
aguucugauaaaccucuuagacuauaaacuauaggagaaagauuauggacugggcaaagccc

SEQ ID NO: 562178 - RNA, 62 nt, Homo Sapiens
gguuaauggacuuuguguuuauuuuaacuggaaggagaaacaauguuugugaaauaaaacug

SEQ ID NO: 562179 - RNA, 62 nt, Homo Sapiens
aaaguauaagccuaacuuugucgcuaguccuaaggagaaaccuuuaaccacaaaguuuuuau

SEQ ID NO: 562180 - RNA, 62 nt, Homo Sapiens
cuugagacuuuccuuugugugguaggacuuggaggagaaauccccuggacuuucacuaaccc

SEQ ID NO: 562181 - RNA, 62 nt, Homo Sapiens
cccuuugcuguagcuacacuucagauuaaaguaggagaaagaaugugcugaguguuuuccuc

SEQ ID NO: 562182 - RNA, 62 nt, Homo Sapiens
ggggcaucuuuguguaaaagaugcauggagucaggagaaaaccaccuucauaaacugcucug

SEQ ID NO: 562183 - RNA, 62 nt, Homo Sapiens
guuauuuauuaccguucccuaccagaggugggaggagaaaaaagguuugaacagugggagau

SEQ ID NO: 562184 - RNA, 62 nt, Homo Sapiens
gaagaggcaugaagaaguauucccagaaggagaggagaaaauuaauauauguuuaacuggag

SEQ ID NO: 562185 - RNA, 62 nt, Homo Sapiens
ucaguagaaacccagaaaagugacuuauaaccaggagaaaaaugcaaagaagcaauaaaaua

SEQ ID NO: 562186 - RNA, 62 nt, Homo Sapiens
gguuugggacagaaagaaauuuccccauggaaaggagaaaguggugaguuuucuaaaaguau

SEQ ID NO: 562187 - RNA, 62 nt, Homo Sapiens
caauaaugaauaaaaggacuaugcgccucuugaggagaaaagacaaagcagagauggaaaua

SEQ ID NO: 562188 - RNA, 62 nt, Homo Sapiens
gcaaaaauaaaauaauuauauuauauuccaguaggagaaaaauggucucugcccuucggagc

SEQ ID NO: 562189 - RNA, 62 nt, Homo Sapiens
ucuccugcuaacuuuuuuucacuggcaccgccaggagaaaaugguuauuggugacuuacugg

SEQ ID NO: 562190 - RNA, 62 nt, Homo Sapiens
uuccuaguauuuaacagaacccaagugaacagaggagaaaugagauugccagaaagugauua

SEQ ID NO: 562191 - RNA, 62 nt, Homo Sapiens
augaugacuaguucacacauaaaguccuuuuaaggagaaaaucuaaaaugaaaaguggauaa

SEQ ID NO: 562192 - RNA, 62 nt, Homo Sapiens
cagagaaagaugaagaggagaauuacucauagaggagaaaacaagcuggacuguggguucca

SEQ ID NO: 562193 - RNA, 62 nt, Homo Sapiens
uugguguaaucugcuuuccucuuggacuagagaggagaaagaucaggguaggugggcacagg

SEQ ID NO: 562194 - RNA, 62 nt, Homo Sapiens
gaugauuuuacauuuucuaguaggagggcuauaggagaaacuaaccauaggaaagugacaug

SEQ ID NO: 562195 - RNA, 62 nt, Homo Sapiens
ccauaggaaagugacauguagagagccaacacaggagaaaaaucagagcuuucuauccaucu

SEQ ID NO: 562196 - RNA, 62 nt, Homo Sapiens
uuaguuuuccugaaaucaccaggucaggcacaaggagaaaagguuccuggauacugacuaac

SEQ ID NO: 562197 - RNA, 62 nt, Homo Sapiens
auacugacuaacuuggguggguggaucuagccaggagaaagacaguaacauguguucuguac

SEQ ID NO: 562198 - RNA, 62 nt, Homo Sapiens
augaguuacaaugucagguguuuagauucuggaggagaaaaagggagaagacaaaauuggug

SEQ ID NO: 562199 - RNA, 62 nt, Homo Sapiens
ccucacugcaguuucaacaucagauagagcagaggagaaacaucuaaauuaccauuuacuuc

SEQ ID NO: 562200 - RNA, 62 nt, Homo Sapiens
auguaagaaggcagggcaggggggcuuuuuacaggagaaaaaaaaaugacuuauaagagaaa

SEQ ID NO: 562201 - RNA, 62 nt, Homo Sapiens
aucuuuauaauuucuuugucucacagaagacuaggagaaagaucuuuuuuaaauaaucuuuu

SEQ ID NO: 562202 - RNA, 62 nt, Homo Sapiens
uuagaacucuucaacuucgguaaugaggaagaaggagaaagagcugggggaagggcagaaga

SEQ ID NO: 562203 - RNA, 62 nt, Homo Sapiens
gcagaagacugguuuaggaggaaaaggaaauaaggagaaaagagaaugggagagugagagaa

SEQ ID NO: 562204 - RNA, 62 nt, Homo Sapiens
cagagggccucagggagcugcaaaacucauccaggagaaaaaggcaggagcagcaagugacc

SEQ ID NO: 562205 - RNA, 62 nt, Homo Sapiens
aagagaguggagauacggaagggggagaggagaggagaaauguggacagagggcuugaagac

SEQ ID NO: 562206 - RNA, 62 nt, Homo Sapiens
aauuaugcuagagcaauuagacacccauggcgaggagaaaaaagaaccucuacuuaaaccuc

SEQ ID NO: 562207 - RNA, 62 nt, Homo Sapiens
acauaaaacuagauaacuuugaaaaaagccacaggagaaaaaucuucaggaucuugggcuag

SEQ ID NO: 562208 - RNA, 62 nt, Homo Sapiens
ugcaucauaacuuuacagaagagaggagaggaaggagaaaacaagcugugcucagaggaggu

SEQ ID NO: 562209 - RNA, 62 nt, Homo Sapiens
cuuucugucuuauuaaaauugaugagacuagaaggagaaauauuuuuccuuucaaaucagac

SEQ ID NO: 562210 - RNA, 62 nt, Homo Sapiens
ugguaaguacauaauugugauuguauauaaaaaggagaaaaauugaggacagugacugccau

SEQ ID NO: 562211 - RNA, 62 nt, Homo Sapiens
ggcuggggccucgagaaggaauuuggggucugaggagaaacagguaggauguuuccuagacc

SEQ ID NO: 562212 - RNA, 64 nt, Homo Sapiens; identical to SEQ ID NO: 94103

SEQ ID NO: 562213 - RNA, 64 nt, Homo Sapiens; identical to SEQ ID NO: 94104

SEQ ID NO: 562214 - RNA, 64 nt, Homo Sapiens
auuauauauacuuaauaaaaacuuuguaaauauuacccuguaauuuuauuuaaaaaaaaacaua

SEQ ID NO: 562215 - RNA, 64 nt, Homo Sapiens
aauacguaauucuuccuguugacugcucaccaauacccuguaaagguaauuugccacgcuuuuu

SEQ ID NO: 562216 - RNA, 64 nt, Homo Sapiens
acagacuggcaacaagaagauuaucagauaaagcacccuguaucauauacuugaguggugugug

SEQ ID NO: 562217 - RNA, 64 nt, Homo Sapiens
ggaucuuaaagcauuccccacuuucaagcuacucacccuguaauuuaacuaucccugccuguga

SEQ ID NO: 562218 - RNA, 64 nt, Homo Sapiens
ugccuguaacucuaagcaguaucaugguccccagacccuguacccauucaaagcuaccagaagc

SEQ ID NO: 562219 - RNA, 64 nt, Homo Sapiens
agacucuggagcccauggugugcguugcugguucacccuguaucuucuggcauauuuuagggga

SEQ ID NO: 562220 - RNA, 64 nt, Homo Sapiens
uuuauaguucuuaaucuaaacaccuuuuauaggcacccuguaguaauaacaauaaggaguaagc

SEQ ID NO: 562221 - RNA, 64 nt, Homo Sapiens
aauaguaccaaagcauuaccuuaggauaggcaagacccuguaugcuuggggaaauggcaagucu

SEQ ID NO: 562222 - RNA, 64 nt, Homo Sapiens; identical to SEQ ID NO: 77046

SEQ ID NO: 562223 - RNA, 64 nt, Homo Sapiens; identical to SEQ ID NO: 77047

SEQ ID NO: 562224 - RNA, 64 nt, Homo Sapiens; identical to SEQ ID NO: 77048

SEQ ID NO: 562225 - RNA, 64 nt, Homo Sapiens; identical to SEQ ID NO: 77049

SEQ ID NO: 562226 - RNA, 64 nt, Homo Sapiens; identical to SEQ ID NO: 161764

SEQ ID NO: 562227 - RNA, 64 nt, Homo Sapiens; identical to SEQ ID NO: 161765

SEQ ID NO: 562228 - RNA, 64 nt, Homo Sapiens
auagaccuggggcugcaguuggggacuucaugucagugcaaaugccauuaguuccauuuguacc

SEQ ID NO: 562229 - RNA, 64 nt, Homo Sapiens
aauuuaaggaacaaguaacuaaaaauguuaagccagugcaaaauaaucugcuuaccuacucaca

SEQ ID NO: 562230 - RNA, 64 nt, Homo Sapiens
auugaacacuuuaacgaagucuauauaacuucugagugcaaaucuacacuugguugccucuugg

SEQ ID NO: 562231 - RNA, 64 nt, Homo Sapiens
cuucagaccaauucuuuguaacuauauggccuucagugcaaagauuacuucccugaagcaagag

SEQ ID NO: 562232 - RNA, 64 nt, Homo Sapiens
gucagaagacaauggcgcugcauguuuuucuuugagugcaaauguacauugcuaagauuuuuuu

SEQ ID NO: 562233 - RNA, 64 nt, Homo Sapiens
aucgauaaucauugcauagugacugaaaagccuaagugcaaaaaaaaaaaaaaaagauguucuu

SEQ ID NO: 562234 - RNA, 64 nt, Homo Sapiens
ugaguugggauuuuugcacucagugaaaagcugaagugcaaaagagcuaucaaagacaagagga

SEQ ID NO: 562235 - RNA, 64 nt, Homo Sapiens
uggcucuccagauuuacuuuuggggccuguucuaagugcaaacccagcaaguuucacuuguccu

SEQ ID NO: 562236 - RNA, 64 nt, Homo Sapiens
uaaucggcuguaugguagauaguugccauuaagcagugcaaaauuaaaaacaaucccaugcuag

SEQ ID NO: 562237 - RNA, 64 nt, Homo Sapiens
uguagaguaaaaauguccauguccuguguuucuuagugcaaauccuaaugugugugaugauagu

SEQ ID NO: 562238 - RNA, 64 nt, Homo Sapiens
gcuuaccagcuccuaccaguccagugugcuuauaagugcaaaagaaaguaaaggcaaccccaga

SEQ ID NO: 562239 - RNA, 64 nt, Homo Sapiens
uugucuuuccugcccccuaucuguuugcugugauagugcaaagaagcacaggaaaauguuuaau

SEQ ID NO: 562240 - RNA, 64 nt, Homo Sapiens
agacagaguugccucagguucccaggggcccgggaguccaaauacuggaauggaggguuggagg

SEQ ID NO: 562241 - RNA, 64 nt, Homo Sapiens
agucacaggccagagcugccuugguauguuguuaaguccaaaacuucuucucugggcuaccuau

SEQ ID NO: 562242 - RNA, 64 nt, Homo Sapiens
uuuuauucucaacagguguaugggcuuacucauaaguccaaacaaucccaauauuuugucuugg

SEQ ID NO: 562243 - RNA, 64 nt, Homo Sapiens
auuuaugaggggagcuuacaauggcagggugaucaguccaaagcucuaaaggaagaagcacuaa

SEQ ID NO: 562244 - RNA, 64 nt, Homo Sapiens
uaucuguuggaggauucucuauggugcaagguccaguccaaaggcuggaaacccaggaaagcug

SEQ ID NO: 562245 - RNA, 64 nt, Homo Sapiens
cuggagugugaggcaggagguauuaagucuaacaaguccaaaagggauuggcuuguguuguuau

SEQ ID NO: 562246 - RNA, 64 nt, Homo Sapiens
cuuaacucauuucagcauuaacccaaaaguccgcaguccaaaguuucaucugagacaaggcaag

SEQ ID NO: 562247 - RNA, 64 nt, Homo Sapiens
uuggccaacacaaaaggguaacagggcccaugcaaguccaaaauucagcagggcagucaaauuu

SEQ ID NO: 562248 - RNA, 64 nt, Homo Sapiens
gaaauauuaguguuacggaagugccuaauaucccaguccaaauuuuuuuuuuuuuuuuuuuuuu

SEQ ID NO: 562249 - RNA, 64 nt, Homo Sapiens
gggauuacaggugugagccaccacgccuggccccaguccaaaauauuuaaagauuguuuccuua

SEQ ID NO: 562250 - RNA, 64 nt, Homo Sapiens
aguuagacccuugcauacagccauuuuuucuuucaguccaaaauauugacuggccauccaauua

SEQ ID NO: 562251 - RNA, 64 nt, Homo Sapiens
uaagaaacugucauguuuuguauuagugacuucuaguccaaauaggggcaacuaaauguaucuu

SEQ ID NO: 562252 - RNA, 64 nt, Homo Sapiens
auguuuguaacuuaugaacacacgugaaguguugaguccaaaagacaaaggggcaucggcaugu

SEQ ID NO: 562253 - RNA, 64 nt, Homo Sapiens
aagcgugcuuucauuuucaaguagcauaugcaagaguccaaacaggcuacccaauguuacuacu

SEQ ID NO: 562254 - RNA, 64 nt, Homo Sapiens; identical to SEQ ID NO: 481345

SEQ ID NO: 562255 - RNA, 64 nt, Homo Sapiens; identical to SEQ ID NO: 481346

SEQ ID NO: 562256 - RNA, 64 nt, Homo Sapiens; identical to SEQ ID NO: 481347

SEQ ID NO: 562257 - RNA, 64 nt, Homo Sapiens; identical to SEQ ID NO: 481348

SEQ ID NO: 562258 - RNA, 64 nt, Homo Sapiens; identical to SEQ ID NO: 481349

SEQ ID NO: 562259 - RNA, 64 nt, Homo Sapiens; identical to SEQ ID NO: 481350

SEQ ID NO: 562260 - RNA, 64 nt, Homo Sapiens; identical to SEQ ID NO: 481351

SEQ ID NO: 562261 - RNA, 63 nt, Homo Sapiens; identical to SEQ ID NO: 481352

SEQ ID NO: 562262 - RNA, 64 nt, Homo Sapiens; identical to SEQ ID NO: 481353

SEQ ID NO: 562263 - RNA, 64 nt, Homo Sapiens; identical to SEQ ID NO: 481354

SEQ ID NO: 562264 - RNA, 64 nt, Homo Sapiens; identical to SEQ ID NO: 481355

SEQ ID NO: 562265 - RNA, 64 nt, Homo Sapiens; identical to SEQ ID NO: 481356

SEQ ID NO: 562266 - RNA, 64 nt, Homo Sapiens; identical to SEQ ID NO: 481357

SEQ ID NO: 562267 - RNA, 64 nt, Homo Sapiens; identical to SEQ ID NO: 481358

SEQ ID NO: 562268 - RNA, 64 nt, Homo Sapiens; identical to SEQ ID NO: 481359

SEQ ID NO: 562269 - RNA, 64 nt, Homo Sapiens; identical to SEQ ID NO: 481360

SEQ ID NO: 562270 - RNA, 64 nt, Homo Sapiens; identical to SEQ ID NO: 481361

SEQ ID NO: 562271 - RNA, 64 nt, Homo Sapiens; identical to SEQ ID NO: 481362

SEQ ID NO: 562272 - RNA, 64 nt, Homo Sapiens; identical to SEQ ID NO: 481363

SEQ ID NO: 562273 - RNA, 64 nt, Homo Sapiens; identical to SEQ ID NO: 481364

SEQ ID NO: 562274 - RNA, 64 nt, Homo Sapiens; identical to SEQ ID NO: 481365

SEQ ID NO: 562275 - RNA, 64 nt, Homo Sapiens; identical to SEQ ID NO: 481366

SEQ ID NO: 562276 - RNA, 64 nt, Homo Sapiens; identical to SEQ ID NO: 481367

SEQ ID NO: 562277 - RNA, 64 nt, Homo Sapiens; identical to SEQ ID NO: 481368

SEQ ID NO: 562278 - RNA, 64 nt, Homo Sapiens; identical to SEQ ID NO: 481369

SEQ ID NO: 562279 - RNA, 64 nt, Homo Sapiens; identical to SEQ ID NO: 481370

SEQ ID NO: 562280 - RNA, 64 nt, Homo Sapiens; identical to SEQ ID NO: 481371

SEQ ID NO: 562281 - RNA, 64 nt, Homo Sapiens; identical to SEQ ID NO: 481372

SEQ ID NO: 562282 - RNA, 64 nt, Homo Sapiens; identical to SEQ ID NO: 481373

SEQ ID NO: 562283 - RNA, 64 nt, Homo Sapiens; identical to SEQ ID NO: 481374

SEQ ID NO: 562284 - RNA, 64 nt, Homo Sapiens; identical to SEQ ID NO: 481375

SEQ ID NO: 562285 - RNA, 64 nt, Homo Sapiens; identical to SEQ ID NO: 481376

SEQ ID NO: 562286 - RNA, 64 nt, Homo Sapiens; identical to SEQ ID NO: 481377

SEQ ID NO: 562287 - RNA, 64 nt, Homo Sapiens; identical to SEQ ID NO: 481378

SEQ ID NO: 562288 - RNA, 64 nt, Homo Sapiens; identical to SEQ ID NO: 481379

SEQ ID NO: 562289 - RNA, 64 nt, Homo Sapiens; identical to SEQ ID NO: 481380

SEQ ID NO: 562290 - RNA, 64 nt, Homo Sapiens; identical to SEQ ID NO: 481381

SEQ ID NO: 562291 - RNA, 64 nt, Homo Sapiens; identical to SEQ ID NO: 481382

SEQ ID NO: 562292 - RNA, 64 nt, Homo Sapiens; identical to SEQ ID NO: 481383

SEQ ID NO: 562293 - RNA, 64 nt, Homo Sapiens; identical to SEQ ID NO: 481384

SEQ ID NO: 562294 - RNA, 64 nt, Homo Sapiens; identical to SEQ ID NO: 481385

SEQ ID NO: 562295 - RNA, 64 nt, Homo Sapiens; identical to SEQ ID NO: 481386

SEQ ID NO: 562296 - RNA, 64 nt, Homo Sapiens; identical to SEQ ID NO: 481387

SEQ ID NO: 562297 - RNA, 64 nt, Homo Sapiens; identical to SEQ ID NO: 481388

SEQ ID NO: 562298 - RNA, 64 nt, Homo Sapiens; identical to SEQ ID NO: 481389

SEQ ID NO: 562299 - RNA, 64 nt, Homo Sapiens; identical to SEQ ID NO: 481390

SEQ ID NO: 562300 - RNA, 64 nt, Homo Sapiens; identical to SEQ ID NO: 481391

SEQ ID NO: 562301 - RNA, 64 nt, Homo Sapiens; identical to SEQ ID NO: 481392

SEQ ID NO: 562302 - RNA, 64 nt, Homo Sapiens; identical to SEQ ID NO: 481393

SEQ ID NO: 562303 - RNA, 64 nt, Homo Sapiens; identical to SEQ ID NO: 481394

SEQ ID NO: 562304 - RNA, 64 nt, Homo Sapiens; identical to SEQ ID NO: 481395

SEQ ID NO: 562305 - RNA, 64 nt, Homo Sapiens
uccauucuaguugucuugaauaagguaucuccaagcaacacaucucagcuccccuuuaaaaauc

SEQ ID NO: 562306 - RNA, 64 nt, Homo Sapiens
aaucagauggcaccagggacgucuucacaaauucgcaacacaacagggcuuuggccaagcccuu

SEQ ID NO: 562307 - RNA, 64 nt, Homo Sapiens
cuuuccccuucacucucccuucccugcacccagugcaacacaccguggcugcuuuuggcuggau

SEQ ID NO: 562308 - RNA, 64 nt, Homo Sapiens
auuauaaggaaucagaaaucucucccuuacagaggcaacacagacuucucuggcucacccaagc

SEQ ID NO: 562309 - RNA, 64 nt, Homo Sapiens
aacggaagucuuaaaaacuuugaauguaaaaguugcaacacacaaaauguaagagaucugguuu

SEQ ID NO: 562310 - RNA, 64 nt, Homo Sapiens
gacagguuuaagucagucaaggauggugaauguugcaacacaauucauuuuuccccccaccuua

SEQ ID NO: 562311 - RNA, 64 nt, Homo Sapiens
uacccaaaagagaaaaaaaauuaagacaagccuggcaacacaccuggugaagaguaguuuacua

SEQ ID NO: 562312 - RNA, 64 nt, Homo Sapiens
agagcuuagccuggagcaccuuuccuucaagccagcaacacagagcacuagguucaauucccug

SEQ ID NO: 562313 - RNA, 64 nt, Homo Sapiens; identical to SEQ ID NO: 312115

SEQ ID NO: 562314 - RNA, 64 nt, Homo Sapiens; identical to SEQ ID NO: 312116

SEQ ID NO: 562315 - RNA, 64 nt, Homo Sapiens; identical to SEQ ID NO: 312117

SEQ ID NO: 562316 - RNA, 64 nt, Homo Sapiens; identical to SEQ ID NO: 312118

SEQ ID NO: 562317 - RNA, 64 nt, Homo Sapiens
gacacagugcguggagacggccauguggcacccagggacugaagcuucccacugugguaacccc

SEQ ID NO: 562318 - RNA, 64 nt, Homo Sapiens
ugcugcagcugaggcugguccuccuccaugagaggggacugaaaggaugauucuucaaagcccc

SEQ ID NO: 562319 - RNA, 64 nt, Homo Sapiens
agucaagagcaacggccacguggguuaagaguuggggacugaggcauagacaagaaaacagaua

SEQ ID NO: 562320 - RNA, 64 nt, Homo Sapiens
cacugcccuaaguuucuuuauuuguaauuaagaagggacugaaccugcugacugccagcaaagg

SEQ ID NO: 562321 - RNA, 64 nt, Homo Sapiens
gaaugaagaauuauuuccucauuuggaaguaggagggacugaagaaauucuccccaggcacugu

SEQ ID NO: 562322 - RNA, 64 nt, Homo Sapiens
aggagggacugaagaaauucuccccaggcacugugggacugagaguccuauuccccuaguaaua

SEQ ID NO: 562323 - RNA, 64 nt, Homo Sapiens
auggacccugcugaaagcagccccagguacgauagggacugaaugguauuugcuuuguaacucc

SEQ ID NO: 562324 - RNA, 64 nt, Homo Sapiens
uuucucaauggaagugaaauaccgagcccagugugggacugacaccugcgauguuuacguccac

SEQ ID NO: 562325 - RNA, 64 nt, Homo Sapiens
uggacccuguaaagggucagggugaaucagaugggggacugagcaaguagcuaugacugcagau

SEQ ID NO: 562326 - RNA, 64 nt, Homo Sapiens
agcaaguagcuaugacugcagaucauguaaggaagggacugacaagaagcucccagaugcuggg

SEQ ID NO: 562327 - RNA, 64 nt, Homo Sapiens; identical to SEQ ID NO: 235033

SEQ ID NO: 562328 - RNA, 64 nt, Homo Sapiens; identical to SEQ ID NO: 235034

SEQ ID NO: 562329 - RNA, 64 nt, Homo Sapiens; identical to SEQ ID NO: 235035

SEQ ID NO: 562330 - RNA, 64 nt, Homo Sapiens; identical to SEQ ID NO: 235036

SEQ ID NO: 562331 - RNA, 64 nt, Homo Sapiens; identical to SEQ ID NO: 235037

SEQ ID NO: 562332 - RNA, 64 nt, Homo Sapiens; identical to SEQ ID NO: 235038

SEQ ID NO: 562333 - RNA, 64 nt, Homo Sapiens; identical to SEQ ID NO: 235039

SEQ ID NO: 562334 - RNA, 64 nt, Homo Sapiens; identical to SEQ ID NO: 235040

SEQ ID NO: 562335 - RNA, 64 nt, Homo Sapiens; identical to SEQ ID NO: 235041

SEQ ID NO: 562336 - RNA, 64 nt, Homo Sapiens; identical to SEQ ID NO: 235042

SEQ ID NO: 562337 - RNA, 62 nt, Homo Sapiens
cucagaaguaugcgauguaauuaaagaaauuauuggauaaccucuacaaauaaagauagggg

SEQ ID NO: 562338 - RNA, 64 nt, Homo Sapiens
ugugagacuaaaagcuuuucuuauugacuuaaauuuggauaacagcaaggugugaggggggugg

SEQ ID NO: 562339 - RNA, 64 nt, Homo Sapiens
acuucguucgcagagcuuuucagauuguggaauguuggauaaggaauuauagaccucuaguagc

SEQ ID NO: 562340 - RNA, 64 nt, Homo Sapiens
uguaacuuauauuaauaguaauuuguaaaguugguuggauaagcuauccguguugcagguucau

SEQ ID NO: 562341 - RNA, 64 nt, Homo Sapiens
ugacuggcucccucaguccuauucuguagccuuuuuggauaaaauuggguuuuaacauaccucg

SEQ ID NO: 562342 - RNA, 64 nt, Homo Sapiens
agcacuugaaaacaugacaagggcccguaguuguuuggauaagagaacuccagcauagagccuu

SEQ ID NO: 562343 - RNA, 64 nt, Homo Sapiens
aaaaaaaaaaaaaaaaguaaaacagagcgagacuccgucucaaacacugcacuccagccugggc

SEQ ID NO: 562344 - RNA, 64 nt, Homo Sapiens
aaacaaaaagcccguggcaagacagagcgagacuccgucucaaacacugcacuccagccugggu

SEQ ID NO: 562345 - RNA, 64 nt, Homo Sapiens
ggccugcguggccuccugagcagcagcugaccgcccgucucaugcuggacgggaccccugggcg

SEQ ID NO: 562346 - RNA, 64 nt, Homo Sapiens
ggccuacguggcugccugagcagcagcugaccgcccgucucacuguuggccagggcuuuguggc

SEQ ID NO: 562347 - RNA, 64 nt, Homo Sapiens
cggucacugauucacacccagucccugccacagaccgucucagacacgcacagugggccugcug

SEQ ID NO: 562348 - RNA, 64 nt, Homo Sapiens
ugcugcaugauucacacccagucccugccacagaccgucucagacacgcacagugggccugcug

SEQ ID NO: 562349 - RNA, 64 nt, Homo Sapiens; identical to SEQ ID NO: 562348

SEQ ID NO: 562350 - RNA, 64 nt, Homo Sapiens
cccucacaggagcuuacuggcucuuaagcuuccgccgucucaacaggaggggaggaacacugca

SEQ ID NO: 562351 - RNA, 64 nt, Homo Sapiens
aaaaaaaaaaaaaaaaaaaagacagagcgagacuccgucucaaacacugcacuccagccugggc

SEQ ID NO: 562352 - RNA, 64 nt, Homo Sapiens; identical to SEQ ID NO: 264286

SEQ ID NO: 562353 - RNA, 64 nt, Homo Sapiens; identical to SEQ ID NO: 264287

SEQ ID NO: 562354 - RNA, 64 nt, Homo Sapiens; identical to SEQ ID NO: 264288

SEQ ID NO: 562355 - RNA, 64 nt, Homo Sapiens; identical to SEQ ID NO: 264289

SEQ ID NO: 562356 - RNA, 64 nt, Homo Sapiens; identical to SEQ ID NO: 264290

SEQ ID NO: 562357 - RNA, 64 nt, Homo Sapiens; identical to SEQ ID NO: 264291

SEQ ID NO: 562358 - RNA, 64 nt, Homo Sapiens; identical to SEQ ID NO: 264292

SEQ ID NO: 562359 - RNA, 64 nt, Homo Sapiens; identical to SEQ ID NO: 264293

SEQ ID NO: 562360 - RNA, 64 nt, Homo Sapiens; identical to SEQ ID NO: 264294

SEQ ID NO: 562361 - RNA, 64 nt, Homo Sapiens; identical to SEQ ID NO: 264295

SEQ ID NO: 562362 - RNA, 64 nt, Homo Sapiens; identical to SEQ ID NO: 264296

SEQ ID NO: 562363 - RNA, 64 nt, Homo Sapiens; identical to SEQ ID NO: 264297

SEQ ID NO: 562364 - RNA, 64 nt, Homo Sapiens; identical to SEQ ID NO: 264298

SEQ ID NO: 562365 - RNA, 64 nt, Homo Sapiens; identical to SEQ ID NO: 264299

SEQ ID NO: 562366 - RNA, 64 nt, Homo Sapiens; identical to SEQ ID NO: 264300

SEQ ID NO: 562367 - RNA, 64 nt, Homo Sapiens; identical to SEQ ID NO: 264301

SEQ ID NO: 562368 - RNA, 64 nt, Homo Sapiens; identical to SEQ ID NO: 249371

SEQ ID NO: 562369 - RNA, 64 nt, Homo Sapiens; identical to SEQ ID NO: 249372

SEQ ID NO: 562370 - RNA, 64 nt, Homo Sapiens; identical to SEQ ID NO: 249373

SEQ ID NO: 562371 - RNA, 64 nt, Homo Sapiens; identical to SEQ ID NO: 249374

SEQ ID NO: 562372 - RNA, 64 nt, Homo Sapiens; identical to SEQ ID NO: 249375

SEQ ID NO: 562373 - RNA, 64 nt, Homo Sapiens; identical to SEQ ID NO: 249376

SEQ ID NO: 562374 - RNA, 64 nt, Homo Sapiens; identical to SEQ ID NO: 249377

SEQ ID NO: 562375 - RNA, 64 nt, Homo Sapiens; identical to SEQ ID NO: 249378

SEQ ID NO: 562376 - RNA, 64 nt, Homo Sapiens; identical to SEQ ID NO: 249379

SEQ ID NO: 562377 - RNA, 64 nt, Homo Sapiens; identical to SEQ ID NO: 249380

SEQ ID NO: 562378 - RNA, 64 nt, Homo Sapiens; identical to SEQ ID NO: 249381

SEQ ID NO: 562379 - RNA, 64 nt, Homo Sapiens; identical to SEQ ID NO: 249382

SEQ ID NO: 562380 - RNA, 64 nt, Homo Sapiens; identical to SEQ ID NO: 249383

SEQ ID NO: 562381 - RNA, 64 nt, Homo Sapiens; identical to SEQ ID NO: 249384

SEQ ID NO: 562382 - RNA, 64 nt, Homo Sapiens; identical to SEQ ID NO: 249385

SEQ ID NO: 562383 - RNA, 64 nt, Homo Sapiens; identical to SEQ ID NO: 249386

SEQ ID NO: 562384 - RNA, 64 nt, Homo Sapiens; identical to SEQ ID NO: 249387

SEQ ID NO: 562385 - RNA, 64 nt, Homo Sapiens; identical to SEQ ID NO: 249388

SEQ ID NO: 562386 - RNA, 64 nt, Homo Sapiens; identical to SEQ ID NO: 249389

SEQ ID NO: 562387 - RNA, 64 nt, Homo Sapiens; identical to SEQ ID NO: 249390

SEQ ID NO: 562388 - RNA, 63 nt, Homo Sapiens; identical to SEQ ID NO: 249391

SEQ ID NO: 562389 - RNA, 64 nt, Homo Sapiens; identical to SEQ ID NO: 249392

SEQ ID NO: 562390 - RNA, 64 nt, Homo Sapiens; identical to SEQ ID NO: 249393

SEQ ID NO: 562391 - RNA, 64 nt, Homo Sapiens; identical to SEQ ID NO: 249394

SEQ ID NO: 562392 - RNA, 64 nt, Homo Sapiens; identical to SEQ ID NO: 249395

SEQ ID NO: 562393 - RNA, 64 nt, Homo Sapiens; identical to SEQ ID NO: 249396

SEQ ID NO: 562394 - RNA, 64 nt, Homo Sapiens; identical to SEQ ID NO: 249397

SEQ ID NO: 562395 - RNA, 64 nt, Homo Sapiens; identical to SEQ ID NO: 249398

SEQ ID NO: 562396 - RNA, 64 nt, Homo Sapiens; identical to SEQ ID NO: 249399

SEQ ID NO: 562397 - RNA, 64 nt, Homo Sapiens; identical to SEQ ID NO: 249400

SEQ ID NO: 562398 - RNA, 64 nt, Homo Sapiens; identical to SEQ ID NO: 249401

SEQ ID NO: 562399 - RNA, 64 nt, Homo Sapiens; identical to SEQ ID NO: 249402

SEQ ID NO: 562400 - RNA, 64 nt, Homo Sapiens; identical to SEQ ID NO: 249403

SEQ ID NO: 562401 - RNA, 64 nt, Homo Sapiens; identical to SEQ ID NO: 249404

SEQ ID NO: 562402 - RNA, 64 nt, Homo Sapiens; identical to SEQ ID NO: 249405

SEQ ID NO: 562403 - RNA, 64 nt, Homo Sapiens; identical to SEQ ID NO: 249406

SEQ ID NO: 562404 - RNA, 64 nt, Homo Sapiens; identical to SEQ ID NO: 249407

SEQ ID NO: 562405 - RNA, 64 nt, Homo Sapiens; identical to SEQ ID NO: 249408

SEQ ID NO: 562406 - RNA, 64 nt, Homo Sapiens; identical to SEQ ID NO: 249409

SEQ ID NO: 562407 - RNA, 64 nt, Homo Sapiens; identical to SEQ ID NO: 249410

SEQ ID NO: 562408 - RNA, 64 nt, Homo Sapiens; identical to SEQ ID NO: 249411

SEQ ID NO: 562409 - RNA, 64 nt, Homo Sapiens; identical to SEQ ID NO: 249412

SEQ ID NO: 562410 - RNA, 64 nt, Homo Sapiens; identical to SEQ ID NO: 249413

SEQ ID NO: 562411 - RNA, 64 nt, Homo Sapiens; identical to SEQ ID NO: 249414

SEQ ID NO: 562412 - RNA, 64 nt, Homo Sapiens; identical to SEQ ID NO: 249415

SEQ ID NO: 562413 - RNA, 64 nt, Homo Sapiens; identical to SEQ ID NO: 249416

SEQ ID NO: 562414 - RNA, 64 nt, Homo Sapiens; identical to SEQ ID NO: 249417

SEQ ID NO: 562415 - RNA, 64 nt, Homo Sapiens; identical to SEQ ID NO: 249418

SEQ ID NO: 562416 - RNA, 64 nt, Homo Sapiens; identical to SEQ ID NO: 249419

SEQ ID NO: 562417 - RNA, 64 nt, Homo Sapiens; identical to SEQ ID NO: 249420

SEQ ID NO: 562418 - RNA, 64 nt, Homo Sapiens; identical to SEQ ID NO: 249421

SEQ ID NO: 562419 - RNA, 64 nt, Homo Sapiens; identical to SEQ ID NO: 249422

SEQ ID NO: 562420 - RNA, 64 nt, Homo Sapiens; identical to SEQ ID NO: 249423

SEQ ID NO: 562421 - RNA, 59 nt, Homo Sapiens; identical to SEQ ID NO: 249424

SEQ ID NO: 562422 - RNA, 64 nt, Homo Sapiens
gaaugaaguaguuuguuucauagcuugucucauugaauaguauuauugaagauacuaaaugaug

SEQ ID NO: 562423 - RNA, 64 nt, Homo Sapiens
acaaugucuugauaauucuaccuuuuuagagcaagaauaguaucugcuaauguaagggacaucu

SEQ ID NO: 562424 - RNA, 64 nt, Homo Sapiens
augcuuccaggaacuacaaggggaauauuuuacagaauaguaaaaaugaugucgucucugaagu

SEQ ID NO: 562425 - RNA, 64 nt, Homo Sapiens
ugucucuaaacaggcagcauuacuugagaaaaaugaauaguaaagaguucaaagucuuccauuu

SEQ ID NO: 562426 - RNA, 64 nt, Homo Sapiens
ucaggaguucaaagucuuccauauauaauuuccagaauaguaacauugacaaagaaauuguuac

SEQ ID NO: 562427 - RNA, 64 nt, Homo Sapiens
auguuuguucuuuuuucagcaaaauacuucaaaugaauaguauuaacuuacaaaaagucacaaa

SEQ ID NO: 562428 - RNA, 64 nt, Homo Sapiens
uguauguauugauuucuaggaacccccaaaaggagaauaguaaaaaaagaucauacuuaaaauu

SEQ ID NO: 562429 - RNA, 64 nt, Homo Sapiens
gauugaaaaguaaaguaugucuagcucaaacugugaauaguaagagauuagcaaauguuaauuc

SEQ ID NO: 562430 - RNA, 64 nt, Homo Sapiens
uugauauauuuauuuaucaguccauucuuuucaugaauaguaaguuaaagcugaaauaaccagc

SEQ ID NO: 562431 - RNA, 64 nt, Homo Sapiens; identical to SEQ ID NO: 60102

SEQ ID NO: 562432 - RNA, 64 nt, Homo Sapiens; identical to SEQ ID NO: 60103

SEQ ID NO: 562433 - RNA, 64 nt, Homo Sapiens; identical to SEQ ID NO: 60104

SEQ ID NO: 562434 - RNA, 64 nt, Homo Sapiens; identical to SEQ ID NO: 60105

SEQ ID NO: 562435 - RNA, 64 nt, Homo Sapiens; identical to SEQ ID NO: 60106

SEQ ID NO: 562436 - RNA, 64 nt, Homo Sapiens; identical to SEQ ID NO: 60107

SEQ ID NO: 562437 - RNA, 64 nt, Homo Sapiens; identical to SEQ ID NO: 60108

SEQ ID NO: 562438 - RNA, 64 nt, Homo Sapiens; identical to SEQ ID NO: 60109

SEQ ID NO: 562439 - RNA, 64 nt, Homo Sapiens; identical to SEQ ID NO: 60110

SEQ ID NO: 562440 - RNA, 64 nt, Homo Sapiens; identical to SEQ ID NO: 60111

SEQ ID NO: 562441 - RNA, 64 nt, Homo Sapiens; identical to SEQ ID NO: 60112

SEQ ID NO: 562442 - RNA, 64 nt, Homo Sapiens; identical to SEQ ID NO: 60113

SEQ ID NO: 562443 - RNA, 64 nt, Homo Sapiens; identical to SEQ ID NO: 60114

SEQ ID NO: 562444 - RNA, 64 nt, Homo Sapiens; identical to SEQ ID NO: 60115

SEQ ID NO: 562445 - RNA, 64 nt, Homo Sapiens; identical to SEQ ID NO: 60116

SEQ ID NO: 562446 - RNA, 64 nt, Homo Sapiens; identical to SEQ ID NO: 60117

SEQ ID NO: 562447 - RNA, 64 nt, Homo Sapiens; identical to SEQ ID NO: 60118

SEQ ID NO: 562448 - RNA, 64 nt, Homo Sapiens; identical to SEQ ID NO: 60119

SEQ ID NO: 562449 - RNA, 64 nt, Homo Sapiens; identical to SEQ ID NO: 60120

SEQ ID NO: 562450 - RNA, 64 nt, Homo Sapiens; identical to SEQ ID NO: 60121

SEQ ID NO: 562451 - RNA, 64 nt, Homo Sapiens; identical to SEQ ID NO: 60122

SEQ ID NO: 562452 - RNA, 64 nt, Homo Sapiens; identical to SEQ ID NO: 60123

SEQ ID NO: 562453 - RNA, 64 nt, Homo Sapiens; identical to SEQ ID NO: 60124

SEQ ID NO: 562454 - RNA, 64 nt, Homo Sapiens; identical to SEQ ID NO: 60125

SEQ ID NO: 562455 - RNA, 64 nt, Homo Sapiens; identical to SEQ ID NO: 60126

SEQ ID NO: 562456 - RNA, 64 nt, Homo Sapiens; identical to SEQ ID NO: 60127

SEQ ID NO: 562457 - RNA, 64 nt, Homo Sapiens; identical to SEQ ID NO: 60128

SEQ ID NO: 562458 - RNA, 64 nt, Homo Sapiens; identical to SEQ ID NO: 60129

SEQ ID NO: 562459 - RNA, 64 nt, Homo Sapiens; identical to SEQ ID NO: 60130

SEQ ID NO: 562460 - RNA, 64 nt, Homo Sapiens; identical to SEQ ID NO: 60131

SEQ ID NO: 562461 - RNA, 64 nt, Homo Sapiens; identical to SEQ ID NO: 60132

SEQ ID NO: 562462 - RNA, 64 nt, Homo Sapiens; identical to SEQ ID NO: 60133

SEQ ID NO: 562463 - RNA, 64 nt, Homo Sapiens; identical to SEQ ID NO: 60134

SEQ ID NO: 562464 - RNA, 64 nt, Homo Sapiens; identical to SEQ ID NO: 60135

SEQ ID NO: 562465 - RNA, 64 nt, Homo Sapiens; identical to SEQ ID NO: 60136

SEQ ID NO: 562466 - RNA, 64 nt, Homo Sapiens; identical to SEQ ID NO: 60137

SEQ ID NO: 562467 - RNA, 64 nt, Homo Sapiens; identical to SEQ ID NO: 60138

SEQ ID NO: 562468 - RNA, 64 nt, Homo Sapiens; identical to SEQ ID NO: 60139

SEQ ID NO: 562469 - RNA, 64 nt, Homo Sapiens; identical to SEQ ID NO: 60140

SEQ ID NO: 562470 - RNA, 64 nt, Homo Sapiens; identical to SEQ ID NO: 60141

SEQ ID NO: 562471 - RNA, 64 nt, Homo Sapiens; identical to SEQ ID NO: 60142

SEQ ID NO: 562472 - RNA, 64 nt, Homo Sapiens; identical to SEQ ID NO: 60143

SEQ ID NO: 562473 - RNA, 64 nt, Homo Sapiens; identical to SEQ ID NO: 60144

SEQ ID NO: 562474 - RNA, 64 nt, Homo Sapiens; identical to SEQ ID NO: 60145

SEQ ID NO: 562475 - RNA, 64 nt, Homo Sapiens; identical to SEQ ID NO: 60146

SEQ ID NO: 562476 - RNA, 64 nt, Homo Sapiens; identical to SEQ ID NO: 60147

SEQ ID NO: 562477 - RNA, 64 nt, Homo Sapiens; identical to SEQ ID NO: 60148

SEQ ID NO: 562478 - RNA, 64 nt, Homo Sapiens; identical to SEQ ID NO: 60149

SEQ ID NO: 562479 - RNA, 64 nt, Homo Sapiens; identical to SEQ ID NO: 60150

SEQ ID NO: 562480 - RNA, 64 nt, Homo Sapiens; identical to SEQ ID NO: 60151

SEQ ID NO: 562481 - RNA, 64 nt, Homo Sapiens; identical to SEQ ID NO: 60152

SEQ ID NO: 562482 - RNA, 64 nt, Homo Sapiens; identical to SEQ ID NO: 60153

SEQ ID NO: 562483 - RNA, 64 nt, Homo Sapiens; identical to SEQ ID NO: 60154

SEQ ID NO: 562484 - RNA, 64 nt, Homo Sapiens; identical to SEQ ID NO: 60155

SEQ ID NO: 562485 - RNA, 64 nt, Homo Sapiens; identical to SEQ ID NO: 60156

SEQ ID NO: 562486 - RNA, 64 nt, Homo Sapiens; identical to SEQ ID NO: 60157

SEQ ID NO: 562487 - RNA, 64 nt, Homo Sapiens; identical to SEQ ID NO: 60158

SEQ ID NO: 562488 - RNA, 64 nt, Homo Sapiens; identical to SEQ ID NO: 60159

SEQ ID NO: 562489 - RNA, 64 nt, Homo Sapiens; identical to SEQ ID NO: 60160

SEQ ID NO: 562490 - RNA, 64 nt, Homo Sapiens; identical to SEQ ID NO: 60161

SEQ ID NO: 562491 - RNA, 64 nt, Homo Sapiens; identical to SEQ ID NO: 60162

SEQ ID NO: 562492 - RNA, 64 nt, Homo Sapiens; identical to SEQ ID NO: 60163

SEQ ID NO: 562493 - RNA, 64 nt, Homo Sapiens; identical to SEQ ID NO: 60164

SEQ ID NO: 562494 - RNA, 64 nt, Homo Sapiens; identical to SEQ ID NO: 60165

SEQ ID NO: 562495 - RNA, 64 nt, Homo Sapiens; identical to SEQ ID NO: 60166

SEQ ID NO: 562496 - RNA, 64 nt, Homo Sapiens; identical to SEQ ID NO: 60167

SEQ ID NO: 562497 - RNA, 64 nt, Homo Sapiens; identical to SEQ ID NO: 60168

SEQ ID NO: 562498 - RNA, 64 nt, Homo Sapiens; identical to SEQ ID NO: 60169

SEQ ID NO: 562499 - RNA, 64 nt, Homo Sapiens; identical to SEQ ID NO: 60170

SEQ ID NO: 562500 - RNA, 64 nt, Homo Sapiens; identical to SEQ ID NO: 60171

SEQ ID NO: 562501 - RNA, 64 nt, Homo Sapiens; identical to SEQ ID NO: 383060

SEQ ID NO: 562502 - RNA, 64 nt, Homo Sapiens; identical to SEQ ID NO: 383061

SEQ ID NO: 562503 - RNA, 64 nt, Homo Sapiens; identical to SEQ ID NO: 383062

SEQ ID NO: 562504 - RNA, 64 nt, Homo Sapiens; identical to SEQ ID NO: 383063

SEQ ID NO: 562505 - RNA, 64 nt, Homo Sapiens; identical to SEQ ID NO: 383064

SEQ ID NO: 562506 - RNA, 64 nt, Homo Sapiens; identical to SEQ ID NO: 383065

SEQ ID NO: 562507 - RNA, 64 nt, Homo Sapiens; identical to SEQ ID NO: 383066

SEQ ID NO: 562508 - RNA, 64 nt, Homo Sapiens; identical to SEQ ID NO: 383067

SEQ ID NO: 562509 - RNA, 64 nt, Homo Sapiens; identical to SEQ ID NO: 383068

SEQ ID NO: 562510 - RNA, 64 nt, Homo Sapiens; identical to SEQ ID NO: 383069

SEQ ID NO: 562511 - RNA, 64 nt, Homo Sapiens; identical to SEQ ID NO: 383070

SEQ ID NO: 562512 - RNA, 64 nt, Homo Sapiens; identical to SEQ ID NO: 383071

SEQ ID NO: 562513 - RNA, 64 nt, Homo Sapiens; identical to SEQ ID NO: 383072

SEQ ID NO: 562514 - RNA, 64 nt, Homo Sapiens; identical to SEQ ID NO: 383073

SEQ ID NO: 562515 - RNA, 64 nt, Homo Sapiens; identical to SEQ ID NO: 383074

SEQ ID NO: 562516 - RNA, 64 nt, Homo Sapiens; identical to SEQ ID NO: 383075

SEQ ID NO: 562517 - RNA, 64 nt, Homo Sapiens; identical to SEQ ID NO: 383076

SEQ ID NO: 562518 - RNA, 64 nt, Homo Sapiens; identical to SEQ ID NO: 383077

SEQ ID NO: 562519 - RNA, 64 nt, Homo Sapiens; identical to SEQ ID NO: 383078

SEQ ID NO: 562520 - RNA, 51 nt, Homo Sapiens; identical to SEQ ID NO: 111105

SEQ ID NO: 562521 - RNA, 64 nt, Homo Sapiens; identical to SEQ ID NO: 383080

SEQ ID NO: 562522 - RNA, 64 nt, Homo Sapiens; identical to SEQ ID NO: 383081

SEQ ID NO: 562523 - RNA, 64 nt, Homo Sapiens; identical to SEQ ID NO: 383082

SEQ ID NO: 562524 - RNA, 64 nt, Homo Sapiens; identical to SEQ ID NO: 383083

SEQ ID NO: 562525 - RNA, 64 nt, Homo Sapiens; identical to SEQ ID NO: 383084

SEQ ID NO: 562526 - RNA, 64 nt, Homo Sapiens; identical to SEQ ID NO: 383085

SEQ ID NO: 562527 - RNA, 64 nt, Homo Sapiens; identical to SEQ ID NO: 383086

SEQ ID NO: 562528 - RNA, 64 nt, Homo Sapiens; identical to SEQ ID NO: 383087

SEQ ID NO: 562529 - RNA, 64 nt, Homo Sapiens; identical to SEQ ID NO: 383088

SEQ ID NO: 562530 - RNA, 64 nt, Homo Sapiens; identical to SEQ ID NO: 383089

SEQ ID NO: 562531 - RNA, 64 nt, Homo Sapiens; identical to SEQ ID NO: 383090

SEQ ID NO: 562532 - RNA, 64 nt, Homo Sapiens; identical to SEQ ID NO: 383091

SEQ ID NO: 562533 - RNA, 64 nt, Homo Sapiens; identical to SEQ ID NO: 383092

SEQ ID NO: 562534 - RNA, 64 nt, Homo Sapiens; identical to SEQ ID NO: 383093

SEQ ID NO: 562535 - RNA, 64 nt, Homo Sapiens; identical to SEQ ID NO: 383094

SEQ ID NO: 562536 - RNA, 64 nt, Homo Sapiens; identical to SEQ ID NO: 383095

SEQ ID NO: 562537 - RNA, 64 nt, Homo Sapiens; identical to SEQ ID NO: 247680

SEQ ID NO: 562538 - RNA, 64 nt, Homo Sapiens; identical to SEQ ID NO: 247681

SEQ ID NO: 562539 - RNA, 64 nt, Homo Sapiens; identical to SEQ ID NO: 247682

SEQ ID NO: 562540 - RNA, 64 nt, Homo Sapiens; identical to SEQ ID NO: 247683

SEQ ID NO: 562541 - RNA, 64 nt, Homo Sapiens; identical to SEQ ID NO: 247684

SEQ ID NO: 562542 - RNA, 64 nt, Homo Sapiens; identical to SEQ ID NO: 247685

SEQ ID NO: 562543 - RNA, 64 nt, Homo Sapiens; identical to SEQ ID NO: 247686

SEQ ID NO: 562544 - RNA, 64 nt, Homo Sapiens; identical to SEQ ID NO: 247687

SEQ ID NO: 562545 - RNA, 64 nt, Homo Sapiens; identical to SEQ ID NO: 247688

SEQ ID NO: 562546 - RNA, 64 nt, Homo Sapiens; identical to SEQ ID NO: 247689

SEQ ID NO: 562547 - RNA, 64 nt, Homo Sapiens; identical to SEQ ID NO: 247690

SEQ ID NO: 562548 - RNA, 64 nt, Homo Sapiens; identical to SEQ ID NO: 247691

SEQ ID NO: 562549 - RNA, 64 nt, Homo Sapiens; identical to SEQ ID NO: 247692

SEQ ID NO: 562550 - RNA, 64 nt, Homo Sapiens; identical to SEQ ID NO: 247693

SEQ ID NO: 562551 - RNA, 64 nt, Homo Sapiens; identical to SEQ ID NO: 247694

SEQ ID NO: 562552 - RNA, 64 nt, Homo Sapiens; identical to SEQ ID NO: 247695

SEQ ID NO: 562553 - RNA, 64 nt, Homo Sapiens; identical to SEQ ID NO: 247696

SEQ ID NO: 562554 - RNA, 64 nt, Homo Sapiens; identical to SEQ ID NO: 247697

SEQ ID NO: 562555 - RNA, 62 nt, Homo Sapiens
cauucuuaucugccaaagaauggugggucugggaccccaauuauucauguggccuuacggga

SEQ ID NO: 562556 - RNA, 62 nt, Homo Sapiens
ccaccacacaccagcagccaaaguccaacagagaccccaaacugggucagggacuccaggcc

SEQ ID NO: 562557 - RNA, 62 nt, Homo Sapiens
agguccugcugcaaacccccgcuggcagaucugaccccaagggucugaaaggccaacccgag

SEQ ID NO: 562558 - RNA, 62 nt, Homo Sapiens
cuaagcccuaaaucugcugaccagcugccagagaccccaacauaagugggccuuuaaaaacc

SEQ ID NO: 562559 - RNA, 62 nt, Homo Sapiens
ccgcggaggcaccgaugcccagccccacgcacgaccccaagcccaacugggcgcccgucccc

SEQ ID NO: 562560 - RNA, 62 nt, Homo Sapiens
ccaggaaccucucagccgauggacacagcacagaccccaaagcaaccagccacucccggugg

SEQ ID NO: 562561 - RNA, 62 nt, Homo Sapiens
ccguaacuccuaggaccccccagccccuagaagaccccaaugcccugugcccucaaguccua

SEQ ID NO: 562562 - RNA, 62 nt, Homo Sapiens
uuuggaggccccauucuaggcccccuuugggggaccccaaaauauuuuuuaaguaacgacuu

SEQ ID NO: 562563 - RNA, 62 nt, Homo Sapiens
ccccagggcugaggaccccugacagcauagcugaccccaaucacaguaugugagugucugga

SEQ ID NO: 562564 - RNA, 62 nt, Homo Sapiens
cuugacuccagcugcgcccaagcauaccccaagaccccaagcagcaccugcuggcugcugga

SEQ ID NO: 562565 - RNA, 64 nt, Homo Sapiens
gugaacccaggauaugaauuuuugcaucuucccauugucgaauuagucuccagccucuaaauaa

SEQ ID NO: 562566 - RNA, 64 nt, Homo Sapiens
aagccucggguucuuucaagcuacauguacuaaauugucgaaggucucccaggagcucuguacu

SEQ ID NO: 562567 - RNA, 64 nt, Homo Sapiens
cugucaacguaacgauuucaugaacguuauuauauugucgaauuccuacugacaacauuauaac

SEQ ID NO: 562568 - RNA, 64 nt, Homo Sapiens
ccagacauggacccuaaaucaacagacaauggcauugucgaagagcaaccuguuaaugaaucau

SEQ ID NO: 562569 - RNA, 64 nt, Homo Sapiens
ugugucuguuugauguggugugauugugcuggccuugucgaaaaagaugugaugcuucucagaa

SEQ ID NO: 562570 - RNA, 64 nt, Homo Sapiens
ugaccaaaugccgccaaccccgagggccaguuucuugucgaauugguacgggcucucuggggcu

SEQ ID NO: 562571 - RNA, 64 nt, Homo Sapiens
augaccaaguacauaauggauuuaguaauaaauauugucgaauugcuaaaaagucuucaaucau

SEQ ID NO: 562572 - RNA, 64 nt, Homo Sapiens
aacaggagagccgccuacccgacgcgacguccauuugucgaaagacuuuaauuuucagcucgaa

SEQ ID NO: 562573 - RNA, 64 nt, Homo Sapiens
aaagagcaaaaccguuuuaaguuugaaaggauauuugucgaaaaugucucuuuggguucuuucu

SEQ ID NO: 562574 - RNA, 64 nt, Homo Sapiens
cuccucugaauggcuuuguggggucgcuuugcguuugucgaagcgaugugacccuccaggguuu

SEQ ID NO: 562575 - RNA, 64 nt, Homo Sapiens
guggauuuucuccuucagcaauaaggguugcggguugucgaaggggaaaaagugaggguugggg

SEQ ID NO: 562576 - RNA, 64 nt, Homo Sapiens
aaauuaucuuguaaguagcuugucaucaauccccuugucgaaaacuagaaaaaaaggaguugac

SEQ ID NO: 562577 - RNA, 64 nt, Homo Sapiens
uuacgucagaugccucuaaggaaaauacacuagguugucgaaauaauaauuccacagccucuuc

SEQ ID NO: 562578 - RNA, 64 nt, Homo Sapiens
gcugcagcagcuuucuuucaagcaaagggcagucuugucgaaucguggaaccgaugcaaguuuc

SEQ ID NO: 562579 - RNA, 64 nt, Homo Sapiens
ggagaaaaugaggauauauuaagaaaauguacaguugucgaaguuugaaauaaagauacuaugc

SEQ ID NO: 562580 - RNA, 64 nt, Homo Sapiens
guagaaucuccuuucugcgucgucauauuugaacuugucgaaccagaucuucucauguacuagg

SEQ ID NO: 562581 - RNA, 64 nt, Homo Sapiens
cggaccaaacagugcucaugcuucaggaccuuguuugucgaagauguugguuucccuuucucug

SEQ ID NO: 562582 - RNA, 64 nt, Homo Sapiens
auaccagauuauuaaaugugggguaguuuauaccuugucgaaucauauugaaugcaggaggcgg

SEQ ID NO: 562583 - RNA, 64 nt, Homo Sapiens
uuuugguucaagaaagaauguucaugugcaucuuuugucgaaugcaaagguaucugaauaauuu

SEQ ID NO: 562584 - RNA, 64 nt, Homo Sapiens
uucuccccugggccgccggguaaaaacuguccuguugucgaagcaaacggucaggccacgugac

SEQ ID NO: 562585 - RNA, 64 nt, Homo Sapiens
ccuguggugagauuguuuugauggcucguguucuuugucgaaggaugccuggcagcuagagcaa

SEQ ID NO: 562586 - RNA, 64 nt, Homo Sapiens
cgcccacccgccuuuuauaaaccucuaauuuauuuugucgaauuuuuauuauuuguuuucccgc

SEQ ID NO: 562587 - RNA, 64 nt, Homo Sapiens
ugcuuauaacuggagaucuuuuggcuuuucuauguugucgaauguaaugucugagacuagcuaa

SEQ ID NO: 562588 - RNA, 64 nt, Homo Sapiens
gguaauaugaaagauuuuaaaaaauuucaacugauugucgaaaguuuuaaauguucuuaguuuu

SEQ ID NO: 562589 - RNA, 64 nt, Homo Sapiens
aaaguucuuauaagcuguuucuuaaacaaugacauugucgaaagaaaaguaauuuaguuacauu

SEQ ID NO: 562590 - RNA, 64 nt, Homo Sapiens
aauuccggacaagacuacccgcaguacauguuacuugucgaaaaaaaagaagaaaagcaaucuc

SEQ ID NO: 562591 - RNA, 64 nt, Homo Sapiens
ugauccguuagugauguucugaggaaucuaccaguugucgaagagacaaguagauucuucgacu

SEQ ID NO: 562592 - RNA, 64 nt, Homo Sapiens
cucacaggacacagccauccagcggcaucuuuccuugucgaaugauacuguaaugaccuuccaa

SEQ ID NO: 562593 - RNA, 64 nt, Homo Sapiens
acaguaauauuuguauuuggccgaggugcucuguuugucgaaacaggcggcgcccacccgcugc

SEQ ID NO: 562594 - RNA, 64 nt, Homo Sapiens
ggggggcgugguucucgucgagcaggaaucagucuugucgaacagagggcccuuaaaggaaggc

SEQ ID NO: 562595 - RNA, 64 nt, Homo Sapiens
acgugcagcagaugcaaaggguucuagcugcaguuugucgaauugagguuuuagguaaagcaua

SEQ ID NO: 562596 - RNA, 64 nt, Homo Sapiens
caucuucugguuuaaacuuguuugcugugaacaauugucgaaaagagucuuccaauuaaugcuu

SEQ ID NO: 562597 - RNA, 64 nt, Homo Sapiens
gcaguuuugugccuuuauguauuugccuuguucuuugucgaaugugugaaauuccguacugugg

SEQ ID NO: 562598 - RNA, 64 nt, Homo Sapiens
guagacauuacuuguuuuauuguugauacuuaaguugucgaacaccaguuugauuuauuuuaau

SEQ ID NO: 562599 - RNA, 64 nt, Homo Sapiens; identical to SEQ ID NO: 494526

SEQ ID NO: 562600 - RNA, 64 nt, Homo Sapiens; identical to SEQ ID NO: 494527

SEQ ID NO: 562601 - RNA, 64 nt, Homo Sapiens; identical to SEQ ID NO: 494528

SEQ ID NO: 562602 - RNA, 64 nt, Homo Sapiens; identical to SEQ ID NO: 494529

SEQ ID NO: 562603 - RNA, 64 nt, Homo Sapiens; identical to SEQ ID NO: 494530

SEQ ID NO: 562604 - RNA, 64 nt, Homo Sapiens; identical to SEQ ID NO: 494531

SEQ ID NO: 562605 - RNA, 64 nt, Homo Sapiens; identical to SEQ ID NO: 494532

SEQ ID NO: 562606 - RNA, 64 nt, Homo Sapiens; identical to SEQ ID NO: 494533

SEQ ID NO: 562607 - RNA, 64 nt, Homo Sapiens; identical to SEQ ID NO: 494534

SEQ ID NO: 562608 - RNA, 64 nt, Homo Sapiens; identical to SEQ ID NO: 494535

SEQ ID NO: 562609 - RNA, 64 nt, Homo Sapiens; identical to SEQ ID NO: 494536

SEQ ID NO: 562610 - RNA, 64 nt, Homo Sapiens; identical to SEQ ID NO: 494537

SEQ ID NO: 562611 - RNA, 64 nt, Homo Sapiens; identical to SEQ ID NO: 494538

SEQ ID NO: 562612 - RNA, 64 nt, Homo Sapiens; identical to SEQ ID NO: 494539

SEQ ID NO: 562613 - RNA, 64 nt, Homo Sapiens; identical to SEQ ID NO: 494540

SEQ ID NO: 562614 - RNA, 64 nt, Homo Sapiens; identical to SEQ ID NO: 494541

SEQ ID NO: 562615 - RNA, 64 nt, Homo Sapiens; identical to SEQ ID NO: 209092

SEQ ID NO: 562616 - RNA, 64 nt, Homo Sapiens; identical to SEQ ID NO: 209093

SEQ ID NO: 562617 - RNA, 64 nt, Homo Sapiens; identical to SEQ ID NO: 209094

SEQ ID NO: 562618 - RNA, 64 nt, Homo Sapiens; identical to SEQ ID NO: 209095

SEQ ID NO: 562619 - RNA, 64 nt, Homo Sapiens; identical to SEQ ID NO: 209096

SEQ ID NO: 562620 - RNA, 64 nt, Homo Sapiens; identical to SEQ ID NO: 209097

SEQ ID NO: 562621 - RNA, 64 nt, Homo Sapiens; identical to SEQ ID NO: 209098

SEQ ID NO: 562622 - RNA, 64 nt, Homo Sapiens; identical to SEQ ID NO: 209099

SEQ ID NO: 562623 - RNA, 64 nt, Homo Sapiens; identical to SEQ ID NO: 209100

SEQ ID NO: 562624 - RNA, 64 nt, Homo Sapiens; identical to SEQ ID NO: 209101

SEQ ID NO: 562625 - RNA, 64 nt, Homo Sapiens; identical to SEQ ID NO: 209102

SEQ ID NO: 562626 - RNA, 64 nt, Homo Sapiens; identical to SEQ ID NO: 209103

SEQ ID NO: 562627 - RNA, 64 nt, Homo Sapiens; identical to SEQ ID NO: 209104

SEQ ID NO: 562628 - RNA, 64 nt, Homo Sapiens; identical to SEQ ID NO: 209105

SEQ ID NO: 562629 - RNA, 64 nt, Homo Sapiens; identical to SEQ ID NO: 209106

SEQ ID NO: 562630 - RNA, 64 nt, Homo Sapiens; identical to SEQ ID NO: 209107

SEQ ID NO: 562631 - RNA, 64 nt, Homo Sapiens; identical to SEQ ID NO: 209108

SEQ ID NO: 562632 - RNA, 64 nt, Homo Sapiens; identical to SEQ ID NO: 209109

SEQ ID NO: 562633 - RNA, 64 nt, Homo Sapiens; identical to SEQ ID NO: 209110

SEQ ID NO: 562634 - RNA, 64 nt, Homo Sapiens; identical to SEQ ID NO: 209111

SEQ ID NO: 562635 - RNA, 64 nt, Homo Sapiens; identical to SEQ ID NO: 209112

SEQ ID NO: 562636 - RNA, 64 nt, Homo Sapiens; identical to SEQ ID NO: 209113

SEQ ID NO: 562637 - RNA, 59 nt, Homo Sapiens; identical to SEQ ID NO: 209114

SEQ ID NO: 562638 - RNA, 64 nt, Homo Sapiens; identical to SEQ ID NO: 209115

SEQ ID NO: 562639 - RNA, 64 nt, Homo Sapiens; identical to SEQ ID NO: 209116

SEQ ID NO: 562640 - RNA, 64 nt, Homo Sapiens; identical to SEQ ID NO: 209117

SEQ ID NO: 562641 - RNA, 64 nt, Homo Sapiens; identical to SEQ ID NO: 209118

SEQ ID NO: 562642 - RNA, 64 nt, Homo Sapiens; identical to SEQ ID NO: 209119

SEQ ID NO: 562643 - RNA, 64 nt, Homo Sapiens; identical to SEQ ID NO: 209120

SEQ ID NO: 562644 - RNA, 64 nt, Homo Sapiens; identical to SEQ ID NO: 209121

SEQ ID NO: 562645 - RNA, 64 nt, Homo Sapiens; identical to SEQ ID NO: 209122

SEQ ID NO: 562646 - RNA, 64 nt, Homo Sapiens; identical to SEQ ID NO: 209123

SEQ ID NO: 562647 - RNA, 64 nt, Homo Sapiens; identical to SEQ ID NO: 209124

SEQ ID NO: 562648 - RNA, 64 nt, Homo Sapiens; identical to SEQ ID NO: 209125

SEQ ID NO: 562649 - RNA, 64 nt, Homo Sapiens; identical to SEQ ID NO: 209126

SEQ ID NO: 562650 - RNA, 64 nt, Homo Sapiens; identical to SEQ ID NO: 209127

SEQ ID NO: 562651 - RNA, 64 nt, Homo Sapiens; identical to SEQ ID NO: 209128

SEQ ID NO: 562652 - RNA, 64 nt, Homo Sapiens; identical to SEQ ID NO: 209129

SEQ ID NO: 562653 - RNA, 64 nt, Homo Sapiens; identical to SEQ ID NO: 209130

SEQ ID NO: 562654 - RNA, 64 nt, Homo Sapiens; identical to SEQ ID NO: 209131

SEQ ID NO: 562655 - RNA, 64 nt, Homo Sapiens; identical to SEQ ID NO: 209132

SEQ ID NO: 562656 - RNA, 64 nt, Homo Sapiens; identical to SEQ ID NO: 209133

SEQ ID NO: 562657 - RNA, 64 nt, Homo Sapiens; identical to SEQ ID NO: 209134

SEQ ID NO: 562658 - RNA, 64 nt, Homo Sapiens; identical to SEQ ID NO: 209135

SEQ ID NO: 562659 - RNA, 64 nt, Homo Sapiens; identical to SEQ ID NO: 209136

SEQ ID NO: 562660 - RNA, 64 nt, Homo Sapiens; identical to SEQ ID NO: 209137

SEQ ID NO: 562661 - RNA, 64 nt, Homo Sapiens; identical to SEQ ID NO: 209138

SEQ ID NO: 562662 - RNA, 64 nt, Homo Sapiens; identical to SEQ ID NO: 209139

SEQ ID NO: 562663 - RNA, 64 nt, Homo Sapiens; identical to SEQ ID NO: 209140

SEQ ID NO: 562664 - RNA, 64 nt, Homo Sapiens; identical to SEQ ID NO: 209141

SEQ ID NO: 562665 - RNA, 64 nt, Homo Sapiens; identical to SEQ ID NO: 209142

SEQ ID NO: 562666 - RNA, 64 nt, Homo Sapiens; identical to SEQ ID NO: 209143

SEQ ID NO: 562667 - RNA, 64 nt, Homo Sapiens; identical to SEQ ID NO: 209144

SEQ ID NO: 562668 - RNA, 64 nt, Homo Sapiens; identical to SEQ ID NO: 209145

SEQ ID NO: 562669 - RNA, 64 nt, Homo Sapiens
acacuaaaccuaggucuggucaccaauaggguuuggagagcaaagggccacaacucaucagcug

SEQ ID NO: 562670 - RNA, 64 nt, Homo Sapiens
acuccccucuaccaaucccuggcacaggguuccuggagagcaggugcuguacauuuuacagcuu

SEQ ID NO: 562671 - RNA, 64 nt, Homo Sapiens
ccaggaggacaugggccuggcgggguugucugcaggagagcaaggaggcuguggcggacacucu

SEQ ID NO: 562672 - RNA, 64 nt, Homo Sapiens
gcagaacagcccagaaaaggagugguggcagccaggagagcagccagguggcaacaaugccccg

SEQ ID NO: 562673 - RNA, 64 nt, Homo Sapiens
guguguuggucuauaugacagggaggagaguaaaggagagcaggagcaauuggcugccugcaaa

SEQ ID NO: 562674 - RNA, 64 nt, Homo Sapiens
ggaucuuggucuguuuuucuugugggagccuaguggagagcagacguggcuuuuuaugugucuu

SEQ ID NO: 562675 - RNA, 64 nt, Homo Sapiens
ccuagagcagacccuuuagaaaucagcccaagggggagagcaagagaaaacacucuagggagua

SEQ ID NO: 562676 - RNA, 64 nt, Homo Sapiens
aagggcccaucgauucccuacuaaugagaggcagggagagcaugggcaauggagacccaccaau

SEQ ID NO: 562677 - RNA, 64 nt, Homo Sapiens
cuucuccacucagcuccaaaacaugcgggagccaggagagcaccggcccucaggcuuuucucag

SEQ ID NO: 562678 - RNA, 64 nt, Homo Sapiens
acacuagggaggacccccagcaaucccccccgccggagagcaggucagccuaaccucuccuggc

SEQ ID NO: 562679 - RNA, 64 nt, Homo Sapiens
uuuguacuuucucugugggugccaguuaaauauuggagagcaaggaauguggacuuguauggcu

SEQ ID NO: 562680 - RNA, 64 nt, Homo Sapiens
aauuaauguugacuguuuuagauuguaagcuccuggagagcaguauugcuguaguaggaauguu

SEQ ID NO: 562681 - RNA, 64 nt, Homo Sapiens
gagacucacgucccccagggcaagugcuuguggaggagagcaagucucaagagcgcaguauuug

SEQ ID NO: 562682 - RNA, 64 nt, Homo Sapiens
cagugccgggcugggcucugcggugcgguccacgggagagcaggccuccagcuggaaaggccag

SEQ ID NO: 562683 - RNA, 64 nt, Homo Sapiens
gcagugugaguagaaggaagucaacaauauguggggagagcacucgguugucuuuacuuuuaaa

SEQ ID NO: 562684 - RNA, 64 nt, Homo Sapiens
uguaauauuuuggacugcuguuuuccauuaaugaggagagcaacaggccccugauuauacaguu

SEQ ID NO: 562685 - RNA, 64 nt, Homo Sapiens
aauccuacccccucuucaaagcagagugggacuuggagagcaaaggcccaugcccccuucgcuc

SEQ ID NO: 562686 - RNA, 64 nt, Homo Sapiens
cccaucagcucccaacgagccuccucaggggguaggagagcacugccucuaugcccugcagagc

SEQ ID NO: 562687 - RNA, 64 nt, Homo Sapiens
cugcacccuccagcaacaacguacuguauguaugggagagcagacagccugauguguuuacaug

SEQ ID NO: 562688 - RNA, 64 nt, Homo Sapiens
aggucccgaguccccuccuauuuuuucugggaaaggagagcaagcacugacucuuccacccuuu

SEQ ID NO: 562689 - RNA, 64 nt, Homo Sapiens
gcaguuagaguucagaggccccuuuuuugaaacaggagagcaaauuucuuuuuuuucuuucguu

SEQ ID NO: 562690 - RNA, 64 nt, Homo Sapiens
aggaagauagccuggagaagcugcagaggcccagggagagcagccucaggcuaugccauggcag

SEQ ID NO: 562691 - RNA, 64 nt, Homo Sapiens
gcccucagcaucaacgaggagauggggaugaggaggagagcacagugaggggccccgccagccc

SEQ ID NO: 562692 - RNA, 64 nt, Homo Sapiens
ugcauugggaggagaaggcagggugagggaucugggagagcaggacguugagauauccugaccc

SEQ ID NO: 562693 - RNA, 64 nt, Homo Sapiens
gagaggagugaccgggacuggagccagggucuggggagagcaacagcaccaggcuuuuccuggu

SEQ ID NO: 562694 - RNA, 64 nt, Homo Sapiens
gcccaugcgagagcugccugauggccucuugucaggagagcaguggcacgggggcgugaggaag

SEQ ID NO: 562695 - RNA, 64 nt, Homo Sapiens
cuuugaccagcaaccaaguaaaaucaguaauugaggagagcagggcacaaaggggcugcaguuu

SEQ ID NO: 562696 - RNA, 64 nt, Homo Sapiens
uucccccauccaagcauccuucgauuagggaaguggagagcacaucccuguaaggcccauaaga

SEQ ID NO: 562697 - RNA, 64 nt, Homo Sapiens
ggaagggggaaacugaccaagaaagaaauucuaaggagagcaugagagaaggcuggcauuggca

SEQ ID NO: 562698 - RNA, 64 nt, Homo Sapiens
aggagagcaugagagaaggcuggcauuggcaggaggagagcaccaggacgaggaugggaagcga

SEQ ID NO: 562699 - RNA, 64 nt, Homo Sapiens
gcuaccagggagcugcagcgcgagucccccagggggagagcaugcaagguggguggcucuggca

SEQ ID NO: 562700 - RNA, 64 nt, Homo Sapiens
guccuaaguccccagcagguggguuugagugaagggagagcacgguugggggagggcacagggu

SEQ ID NO: 562701 - RNA, 64 nt, Homo Sapiens; identical to SEQ ID NO: 110917

SEQ ID NO: 562702 - RNA, 64 nt, Homo Sapiens; identical to SEQ ID NO: 110918

SEQ ID NO: 562703 - RNA, 64 nt, Homo Sapiens; identical to SEQ ID NO: 110919

SEQ ID NO: 562704 - RNA, 64 nt, Homo Sapiens; identical to SEQ ID NO: 110920

SEQ ID NO: 562705 - RNA, 64 nt, Homo Sapiens; identical to SEQ ID NO: 110921

SEQ ID NO: 562706 - RNA, 64 nt, Homo Sapiens; identical to SEQ ID NO: 110922

SEQ ID NO: 562707 - RNA, 64 nt, Homo Sapiens; identical to SEQ ID NO: 110923

SEQ ID NO: 562708 - RNA, 64 nt, Homo Sapiens; identical to SEQ ID NO: 110924

SEQ ID NO: 562709 - RNA, 64 nt, Homo Sapiens; identical to SEQ ID NO: 110925

SEQ ID NO: 562710 - RNA, 64 nt, Homo Sapiens; identical to SEQ ID NO: 110926

SEQ ID NO: 562711 - RNA, 64 nt, Homo Sapiens; identical to SEQ ID NO: 110927

SEQ ID NO: 562712 - RNA, 64 nt, Homo Sapiens; identical to SEQ ID NO: 110928

SEQ ID NO: 562713 - RNA, 61 nt, Homo Sapiens; identical to SEQ ID NO: 110929

SEQ ID NO: 562714 - RNA, 64 nt, Homo Sapiens; identical to SEQ ID NO: 110930

SEQ ID NO: 562715 - RNA, 64 nt, Homo Sapiens; identical to SEQ ID NO: 110931

SEQ ID NO: 562716 - RNA, 64 nt, Homo Sapiens; identical to SEQ ID NO: 110932

SEQ ID NO: 562717 - RNA, 64 nt, Homo Sapiens; identical to SEQ ID NO: 110933

SEQ ID NO: 562718 - RNA, 64 nt, Homo Sapiens; identical to SEQ ID NO: 110934

SEQ ID NO: 562719 - RNA, 64 nt, Homo Sapiens; identical to SEQ ID NO: 110935

SEQ ID NO: 562720 - RNA, 64 nt, Homo Sapiens; identical to SEQ ID NO: 110936

SEQ ID NO: 562721 - RNA, 64 nt, Homo Sapiens; identical to SEQ ID NO: 110937

SEQ ID NO: 562722 - RNA, 64 nt, Homo Sapiens; identical to SEQ ID NO: 110938

SEQ ID NO: 562723 - RNA, 64 nt, Homo Sapiens; identical to SEQ ID NO: 110939

SEQ ID NO: 562724 - RNA, 64 nt, Homo Sapiens; identical to SEQ ID NO: 110940

SEQ ID NO: 562725 - RNA, 64 nt, Homo Sapiens; identical to SEQ ID NO: 110941

SEQ ID NO: 562726 - RNA, 64 nt, Homo Sapiens; identical to SEQ ID NO: 110942

SEQ ID NO: 562727 - RNA, 64 nt, Homo Sapiens; identical to SEQ ID NO: 110943

SEQ ID NO: 562728 - RNA, 64 nt, Homo Sapiens; identical to SEQ ID NO: 110944

SEQ ID NO: 562729 - RNA, 64 nt, Homo Sapiens; identical to SEQ ID NO: 110945

SEQ ID NO: 562730 - RNA, 64 nt, Homo Sapiens; identical to SEQ ID NO: 110946

SEQ ID NO: 562731 - RNA, 64 nt, Homo Sapiens; identical to SEQ ID NO: 110947

SEQ ID NO: 562732 - RNA, 64 nt, Homo Sapiens; identical to SEQ ID NO: 110948

SEQ ID NO: 562733 - RNA, 64 nt, Homo Sapiens; identical to SEQ ID NO: 110949

SEQ ID NO: 562734 - RNA, 64 nt, Homo Sapiens; identical to SEQ ID NO: 110950

SEQ ID NO: 562735 - RNA, 64 nt, Homo Sapiens; identical to SEQ ID NO: 110951

SEQ ID NO: 562736 - RNA, 64 nt, Homo Sapiens; identical to SEQ ID NO: 110952

SEQ ID NO: 562737 - RNA, 64 nt, Homo Sapiens; identical to SEQ ID NO: 110953

SEQ ID NO: 562738 - RNA, 64 nt, Homo Sapiens; identical to SEQ ID NO: 110954

SEQ ID NO: 562739 - RNA, 64 nt, Homo Sapiens; identical to SEQ ID NO: 110955

SEQ ID NO: 562740 - RNA, 64 nt, Homo Sapiens; identical to SEQ ID NO: 110956

SEQ ID NO: 562741 - RNA, 64 nt, Homo Sapiens; identical to SEQ ID NO: 110957

SEQ ID NO: 562742 - RNA, 64 nt, Homo Sapiens; identical to SEQ ID NO: 110958

SEQ ID NO: 562743 - RNA, 64 nt, Homo Sapiens; identical to SEQ ID NO: 110959

SEQ ID NO: 562744 - RNA, 64 nt, Homo Sapiens; identical to SEQ ID NO: 110960

SEQ ID NO: 562745 - RNA, 64 nt, Homo Sapiens; identical to SEQ ID NO: 110961

SEQ ID NO: 562746 - RNA, 64 nt, Homo Sapiens; identical to SEQ ID NO: 110962

SEQ ID NO: 562747 - RNA, 64 nt, Homo Sapiens; identical to SEQ ID NO: 110963

SEQ ID NO: 562748 - RNA, 64 nt, Homo Sapiens; identical to SEQ ID NO: 110964

SEQ ID NO: 562749 - RNA, 64 nt, Homo Sapiens; identical to SEQ ID NO: 110965

SEQ ID NO: 562750 - RNA, 64 nt, Homo Sapiens; identical to SEQ ID NO: 110966

SEQ ID NO: 562751 - RNA, 64 nt, Homo Sapiens; identical to SEQ ID NO: 110967

SEQ ID NO: 562752 - RNA, 64 nt, Homo Sapiens; identical to SEQ ID NO: 110968

SEQ ID NO: 562753 - RNA, 64 nt, Homo Sapiens; identical to SEQ ID NO: 110969

SEQ ID NO: 562754 - RNA, 64 nt, Homo Sapiens; identical to SEQ ID NO: 110970

SEQ ID NO: 562755 - RNA, 64 nt, Homo Sapiens; identical to SEQ ID NO: 110971

SEQ ID NO: 562756 - RNA, 64 nt, Homo Sapiens; identical to SEQ ID NO: 110972

SEQ ID NO: 562757 - RNA, 64 nt, Homo Sapiens; identical to SEQ ID NO: 110973

SEQ ID NO: 562758 - RNA, 64 nt, Homo Sapiens; identical to SEQ ID NO: 110974

SEQ ID NO: 562759 - RNA, 64 nt, Homo Sapiens; identical to SEQ ID NO: 110975

SEQ ID NO: 562760 - RNA, 64 nt, Homo Sapiens; identical to SEQ ID NO: 110976

SEQ ID NO: 562761 - RNA, 64 nt, Homo Sapiens; identical to SEQ ID NO: 110977

SEQ ID NO: 562762 - RNA, 64 nt, Homo Sapiens; identical to SEQ ID NO: 110978

SEQ ID NO: 562763 - RNA, 64 nt, Homo Sapiens; identical to SEQ ID NO: 110979

SEQ ID NO: 562764 - RNA, 64 nt, Homo Sapiens; identical to SEQ ID NO: 110980

SEQ ID NO: 562765 - RNA, 64 nt, Homo Sapiens
guuugguaaacaaacucaaaauggauucuuaggagcauuuuaguguuuauuaaauaacugacca

SEQ ID NO: 562766 - RNA, 64 nt, Homo Sapiens
guggcuagauuuaugcuaaaaugauucucaguuagcauuuuaguaacacuucaaagguuuuuuu

SEQ ID NO: 562767 - RNA, 64 nt, Homo Sapiens
aaauauuucugaauaaggcuucaccauacuguaagcauuuuagguagauugccuuaaagguuau

SEQ ID NO: 562768 - RNA, 64 nt, Homo Sapiens
uuuaacuaaaagcugguucccaaaugcauagcuggcauuuuaauuuaaauucaaaucuacauag

SEQ ID NO: 562769 - RNA, 64 nt, Homo Sapiens
uaauuguagauaaagaauaguuuuaagggcagaagcauuuuaguuggcaauuucuuugacuuuc

SEQ ID NO: 562770 - RNA, 64 nt, Homo Sapiens
cccugcaggcuucugccauauugcagcuuggacugcauuuuaaguuauugaagcccagacauuc

SEQ ID NO: 562771 - RNA, 64 nt, Homo Sapiens
uaguucuaaaaucagcaaaaaaaucuccagaaaugcauuuuaugauaugauaugcugaacacca

SEQ ID NO: 562772 - RNA, 64 nt, Homo Sapiens
uauaaaaauacagacagaaauucagccaaauaaugcauuuuauugaaaaaaauauuuuuaaaau

SEQ ID NO: 562773 - RNA, 64 nt, Homo Sapiens
guuccauugucuuggugguguuuaggggggaacugcauuuuagguuaaaaaacacuucauuaug

SEQ ID NO: 562774 - RNA, 64 nt, Homo Sapiens
caaacuuugagccuuucucuggggcaauacuauugcauuuuacguuugaaugcaugaucuguau

SEQ ID NO: 562775 - RNA, 64 nt, Homo Sapiens
uaacuggaacauuuagaaagaaggaaaugaaugugcauuuuauuaauuccuuaggggcacaagg

SEQ ID NO: 562776 - RNA, 64 nt, Homo Sapiens
aagaagcaaugaugugcugcuucugauuuuucuugcauuuuaaauucucagccaaccuacagcc

SEQ ID NO: 562777 - RNA, 64 nt, Homo Sapiens
accuuuggauauguuuguaaaacucuucucaguagcauuuuaugagaaaaugcauuuuaaacac

SEQ ID NO: 562778 - RNA, 64 nt, Homo Sapiens
cacaacucuucucaguagcauguaagaagaaaaugcauuuuaaauguauauauuacagcuuauc

SEQ ID NO: 562779 - RNA, 64 nt, Homo Sapiens
ucaagaugcuuuguuucuuucauaugaaaaaaaugcauuuuauaaauucagaaagucauagauu

SEQ ID NO: 562780 - RNA, 64 nt, Homo Sapiens
ucagaaagucauagauuucugaaggcgucaacgugcauuuuauuuauggacugguaaguaacug

SEQ ID NO: 562781 - RNA, 64 nt, Homo Sapiens
uacuaauuguauuuaaaauuucuacuucccuuaggcauuuuauaaaaauuuaaaaauuauuuuu

SEQ ID NO: 562782 - RNA, 64 nt, Homo Sapiens
uaucauuacacagcuaagauuuuuauuuaacuuagcauuuuagcaaguuuucuuaugaaaauac

SEQ ID NO: 562783 - RNA, 64 nt, Homo Sapiens
cagagcuuauauucuaguggaggaaguuagacaagcauuuuaaguaauaaauguauagagagug

SEQ ID NO: 562784 - RNA, 64 nt, Homo Sapiens
uaugaccaaccagauuaaacucuacccacauccugcauuuuaaggucuaaguuuaacuggucaa

SEQ ID NO: 562785 - RNA, 64 nt, Homo Sapiens
ucucccacuucugaaauguucauuuauacugguugcauuuuaagaucaugaaacaauuccaguu

SEQ ID NO: 562786 - RNA, 64 nt, Homo Sapiens
gaaugcaaaauaaaacuugcagugaaugaauuuagcauuuuaugagagugcuguuggaaagacu

SEQ ID NO: 562787 - RNA, 64 nt, Homo Sapiens
uacuguguauggggagguuguaguauuuauuauagcauuuuaaauaaggguaauucauuuuuua

SEQ ID NO: 562788 - RNA, 64 nt, Homo Sapiens
caguaguccaaauuaaagaaaaaaugauuauucugcauuuuauucuuuccauaucuguaacaug

SEQ ID NO: 562789 - RNA, 64 nt, Homo Sapiens
gguuaaaacauuuugaaaaagagaaaaauuaauggcauuuuaaaugcaaacauauaucuacaga

SEQ ID NO: 562790 - RNA, 64 nt, Homo Sapiens
uguaguuugaauauuuuccauccauuuuacagaagcauuuuaaacuuguggagcaauagaguuc

SEQ ID NO: 562791 - RNA, 64 nt, Homo Sapiens
ugucaguuacaauaugagaaagauguuuuaagaagcauuuuaaauguauuuuucguauucugga

SEQ ID NO: 562792 - RNA, 64 nt, Homo Sapiens
ugcaugaaauguaauugauuagcauuuuagauuugcauuuuaaaaaugaaaagccuuucucugg

SEQ ID NO: 562793 - RNA, 64 nt, Homo Sapiens
uuugcauuuuaaaugcaugaagccuuucucuggagcauuuuagauauuucacauugaaaugaaa

SEQ ID NO: 562794 - RNA, 64 nt, Homo Sapiens
acaacucauuaaauauuggaucugcacgugacuggcauuuuaaaggauguguagccuucuggaa

SEQ ID NO: 562795 - RNA, 64 nt, Homo Sapiens
gguuagggagaggauauaaggaauauuuucauuugcauuuuaguugcuggugcuggagucugaa

SEQ ID NO: 562796 - RNA, 64 nt, Homo Sapiens
guacaaauauccuggugcgaaugacucaugcaaagcauuuuacccagaagugcguaccagaagu

SEQ ID NO: 562797 - RNA, 64 nt, Homo Sapiens
uuuaguguaucaugcgaguuuguauaauuucauagcauuuuaaacaauuauuuuuagagaguaa

SEQ ID NO: 562798 - RNA, 64 nt, Homo Sapiens
agcuuuuuuuuuugcuauugaacauggccaaaaugcauuuuaugaccuguuaaguauucucuga

SEQ ID NO: 562799 - RNA, 64 nt, Homo Sapiens
gacauuucuucccaaguacguuauacauuagucagcauuuuaaagugucuuuaaauauauuagg

SEQ ID NO: 562800 - RNA, 64 nt, Homo Sapiens
gcugucuugcuauacugaaugaagucaguucagggcauuuuagguacuggaguuuuaguuagcg

SEQ ID NO: 562801 - RNA, 64 nt, Homo Sapiens
caaaaugaaguauauccauugcaaaggcucuugggcauuuuaaaacaauacuuucaguuauguu

SEQ ID NO: 562802 - RNA, 64 nt, Homo Sapiens
cacuuuuccaaagugauucugggcuuaggaacgugcauuuuaaaaugaaucagaaacuagguug

SEQ ID NO: 562803 - RNA, 64 nt, Homo Sapiens
uacaccauucuacuauuccuauaguuuacaaauagcauuuuacaguagcauuuggcaacccuuu

SEQ ID NO: 562804 - RNA, 64 nt, Homo Sapiens
cuguaaauaguuguuuuaauuuagcugaauguuagcauuuuagucuuuggcauuuuagcguuug

SEQ ID NO: 562805 - RNA, 64 nt, Homo Sapiens
uuaauuuagcugaauguuagcauuuuagucuuuggcauuuuagcguuugggagguagauuaaua

SEQ ID NO: 562806 - RNA, 64 nt, Homo Sapiens
caguacuuuauauaguauagcuuugggccauguagcauuuuaagacucaauuuuaaaaaauuau

SEQ ID NO: 562807 - RNA, 64 nt, Homo Sapiens
cauuuuugcuuuuaaccaauuaaagaagccaauggcauuuuaguuuuauauuguguuuuccacu

SEQ ID NO: 562808 - RNA, 64 nt, Homo Sapiens
cuugaauuuacucagucuuauaaauuaaaaaugugcauuuuauauaaagaugcauuuuauauaa

SEQ ID NO: 562809 - RNA, 64 nt, Homo Sapiens
uuauaaauuaaaaaugugcauuuuauauaaagaugcauuuuauauaaaaaugcacaccuuuaau

SEQ ID NO: 562810 - RNA, 64 nt, Homo Sapiens
auauuuuuuuuuaaucuagggacuaggguccaaagcauuuuauauuaucauuccagcuauguug

SEQ ID NO: 562811 - RNA, 64 nt, Homo Sapiens
cugugaauuuauuguuaggcaugucaacuauucugcauuuuacuacaacauaaaccuugguuau

SEQ ID NO: 562812 - RNA, 64 nt, Homo Sapiens
ucacaagaggagugugagggcaaaugucaucgcugcauuuuauuaggaaagaacaucagcugac

SEQ ID NO: 562813 - RNA, 64 nt, Homo Sapiens
caguacucugggugcaauaaucuucacagaaagugcauuuuaacucauacguuauugcauuuga

SEQ ID NO: 562814 - RNA, 64 nt, Homo Sapiens
auauuauguguguacuucaccuuccaauuaaauggcauuuuauacuugcaaugauagaaaacuc

SEQ ID NO: 562815 - RNA, 64 nt, Homo Sapiens
agcugaauugagaucaggguuucuuuuccagggugcauuuuaauauacguaugaaaugaaauau

SEQ ID NO: 562816 - RNA, 64 nt, Homo Sapiens
uguuguuguuauagccaugcauugaccauuaaaugcauuuuaauaucucggcaaaaugagauuu

SEQ ID NO: 562817 - RNA, 64 nt, Homo Sapiens
acauguguauaauaagaugggugccuacugugaugcauuuuaccaggcauuuuaccuucauuau

SEQ ID NO: 562818 - RNA, 64 nt, Homo Sapiens
uaagaugggugccuacugugaugcauuuuaccaggcauuuuaccuucauuauuacucaucucua

SEQ ID NO: 562819 - RNA, 64 nt, Homo Sapiens
ugguauaggaauuuaaugagggccaugggaacuggcauuuuacuuauauauaaaauaaaauuua

SEQ ID NO: 562820 - RNA, 64 nt, Homo Sapiens
uuucaucuaccaauccauguuuucauacuuuuuugcauuuuaccccacauuuaaaggacuguau

SEQ ID NO: 562821 - RNA, 64 nt, Homo Sapiens
uaagcagagaccaucugugaccauagccuagcuagcauuuuaaaaggggaaauuuuguucucua

SEQ ID NO: 562822 - RNA, 64 nt, Homo Sapiens
auaaccuguucauuaauaucagaaauuuacaauagcauuuuaagaccauaguaggauucuagca

SEQ ID NO: 562823 - RNA, 64 nt, Homo Sapiens
gauuaggacaguggucacuuaguacauuuucccugcauuuuagaauaaaaaaaaaaauuguuug

SEQ ID NO: 562824 - RNA, 64 nt, Homo Sapiens
acauguacaugaaacagugaguuuaauuuacuuggcauuuuaggcacuuaguaaauuaaaaguu

SEQ ID NO: 562825 - RNA, 64 nt, Homo Sapiens
uuauggugcuuuugguggaaauuuuuauuauuuagcauuuuaggagaccgcugucaacugguuu

SEQ ID NO: 562826 - RNA, 64 nt, Homo Sapiens
ugguguugaaaaauaacuguuacuucuuaaagcagcauuuuaucuucuauuuugaagacuauuu

SEQ ID NO: 562827 - RNA, 64 nt, Homo Sapiens
auuuggagagauacucaaaagagcuaaaacugcagcauuuuaccuuuaaaugcagugccuagag

SEQ ID NO: 562828 - RNA, 64 nt, Homo Sapiens
aauaaaaagagcagggcacugcuggugggaagaggcauuuuaccuuccagugcaaauccugcuc

SEQ ID NO: 562829 - RNA, 64 nt, Homo Sapiens
guacagauugcugcuucugcuuuuuuccaugacugcauuuuacuucagaugcuuuagagagauu

SEQ ID NO: 562830 - RNA, 64 nt, Homo Sapiens
guuaaacauuuuuaaguauuuuccugaucacuaugcauuuuaaaucucuugccuaaguauuccu

SEQ ID NO: 562831 - RNA, 64 nt, Homo Sapiens
aacccauaagccuacaauaguggccucccuuaaggcauuuuacaucucuucuuugaguuguuua

SEQ ID NO: 562832 - RNA, 64 nt, Homo Sapiens
guguaaguuauaguaccuguaacaaucaaacaaagcauuuuaagccaagaauuuugcugaauga

SEQ ID NO: 562833 - RNA, 64 nt, Homo Sapiens
gauagcuguucguguuagcguuagcugaauaaaggcauuuuacuaaaacuccgcuucuauagaa

SEQ ID NO: 562834 - RNA, 64 nt, Homo Sapiens
cagaagucauaaguuuuugcauauagaagacauggcauuuuacuaagacugugcagcucacgga

SEQ ID NO: 562835 - RNA, 64 nt, Homo Sapiens
aguaauauuugaagauuuguguaacaaauauugugcauuuuaacacucaaaguaagcaauggag

SEQ ID NO: 562836 - RNA, 64 nt, Homo Sapiens
gauaaaacuaaagcauaugguuaaagaaaucuaugcauuuuaaguucuugccaucuuuguuuuc

SEQ ID NO: 562837 - RNA, 64 nt, Homo Sapiens
cacauuggaggagucguaugaaucuaccuagcaugcauuuuacaguuccucucguuuuuccuuc

SEQ ID NO: 562838 - RNA, 64 nt, Homo Sapiens
guuuuggggaagaaaauaucaaaucaucucacaugcauuuuauauauguugcaugcauuaaaaa

SEQ ID NO: 562839 - RNA, 64 nt, Homo Sapiens; identical to SEQ ID NO: 130982

SEQ ID NO: 562840 - RNA, 64 nt, Homo Sapiens; identical to SEQ ID NO: 130983

SEQ ID NO: 562841 - RNA, 64 nt, Homo Sapiens; identical to SEQ ID NO: 130984

SEQ ID NO: 562842 - RNA, 64 nt, Homo Sapiens; identical to SEQ ID NO: 130985

SEQ ID NO: 562843 - RNA, 64 nt, Homo Sapiens; identical to SEQ ID NO: 130986

SEQ ID NO: 562844 - RNA, 64 nt, Homo Sapiens; identical to SEQ ID NO: 130987

SEQ ID NO: 562845 - RNA, 64 nt, Homo Sapiens; identical to SEQ ID NO: 130988

SEQ ID NO: 562846 - RNA, 64 nt, Homo Sapiens; identical to SEQ ID NO: 130989

SEQ ID NO: 562847 - RNA, 64 nt, Homo Sapiens; identical to SEQ ID NO: 130990

SEQ ID NO: 562848 - RNA, 64 nt, Homo Sapiens; identical to SEQ ID NO: 130991

SEQ ID NO: 562849 - RNA, 64 nt, Homo Sapiens; identical to SEQ ID NO: 130992

SEQ ID NO: 562850 - RNA, 64 nt, Homo Sapiens; identical to SEQ ID NO: 130993

SEQ ID NO: 562851 - RNA, 64 nt, Homo Sapiens; identical to SEQ ID NO: 130994

SEQ ID NO: 562852 - RNA, 64 nt, Homo Sapiens; identical to SEQ ID NO: 130995

SEQ ID NO: 562853 - RNA, 64 nt, Homo Sapiens; identical to SEQ ID NO: 130996

SEQ ID NO: 562854 - RNA, 64 nt, Homo Sapiens; identical to SEQ ID NO: 130997

SEQ ID NO: 562855 - RNA, 64 nt, Homo Sapiens; identical to SEQ ID NO: 130998

SEQ ID NO: 562856 - RNA, 64 nt, Homo Sapiens; identical to SEQ ID NO: 130999

SEQ ID NO: 562857 - RNA, 64 nt, Homo Sapiens; identical to SEQ ID NO: 131000

SEQ ID NO: 562858 - RNA, 64 nt, Homo Sapiens; identical to SEQ ID NO: 131001

SEQ ID NO: 562859 - RNA, 64 nt, Homo Sapiens; identical to SEQ ID NO: 131002

SEQ ID NO: 562860 - RNA, 64 nt, Homo Sapiens; identical to SEQ ID NO: 131003

SEQ ID NO: 562861 - RNA, 64 nt, Homo Sapiens; identical to SEQ ID NO: 131004

SEQ ID NO: 562862 - RNA, 64 nt, Homo Sapiens; identical to SEQ ID NO: 131005

SEQ ID NO: 562863 - RNA, 64 nt, Homo Sapiens; identical to SEQ ID NO: 131006

SEQ ID NO: 562864 - RNA, 64 nt, Homo Sapiens; identical to SEQ ID NO: 131007

SEQ ID NO: 562865 - RNA, 64 nt, Homo Sapiens; identical to SEQ ID NO: 131008

SEQ ID NO: 562866 - RNA, 64 nt, Homo Sapiens; identical to SEQ ID NO: 131009

SEQ ID NO: 562867 - RNA, 64 nt, Homo Sapiens; identical to SEQ ID NO: 162075

SEQ ID NO: 562868 - RNA, 64 nt, Homo Sapiens; identical to SEQ ID NO: 162076

SEQ ID NO: 562869 - RNA, 64 nt, Homo Sapiens; identical to SEQ ID NO: 162077

SEQ ID NO: 562870 - RNA, 64 nt, Homo Sapiens; identical to SEQ ID NO: 162078

SEQ ID NO: 562871 - RNA, 64 nt, Homo Sapiens; identical to SEQ ID NO: 162079

SEQ ID NO: 562872 - RNA, 64 nt, Homo Sapiens; identical to SEQ ID NO: 162080

SEQ ID NO: 562873 - RNA, 64 nt, Homo Sapiens; identical to SEQ ID NO: 162081

SEQ ID NO: 562874 - RNA, 64 nt, Homo Sapiens; identical to SEQ ID NO: 162082

SEQ ID NO: 562875 - RNA, 64 nt, Homo Sapiens; identical to SEQ ID NO: 162083

SEQ ID NO: 562876 - RNA, 64 nt, Homo Sapiens; identical to SEQ ID NO: 162084

SEQ ID NO: 562877 - RNA, 64 nt, Homo Sapiens; identical to SEQ ID NO: 162085

SEQ ID NO: 562878 - RNA, 64 nt, Homo Sapiens; identical to SEQ ID NO: 162086

SEQ ID NO: 562879 - RNA, 64 nt, Homo Sapiens; identical to SEQ ID NO: 162087

SEQ ID NO: 562880 - RNA, 64 nt, Homo Sapiens; identical to SEQ ID NO: 162088

SEQ ID NO: 562881 - RNA, 64 nt, Homo Sapiens; identical to SEQ ID NO: 162089

SEQ ID NO: 562882 - RNA, 64 nt, Homo Sapiens; identical to SEQ ID NO: 162090

SEQ ID NO: 562883 - RNA, 64 nt, Homo Sapiens; identical to SEQ ID NO: 162091

SEQ ID NO: 562884 - RNA, 64 nt, Homo Sapiens; identical to SEQ ID NO: 162092

SEQ ID NO: 562885 - RNA, 64 nt, Homo Sapiens; identical to SEQ ID NO: 162093

SEQ ID NO: 562886 - RNA, 64 nt, Homo Sapiens; identical to SEQ ID NO: 162092

SEQ ID NO: 562887 - RNA, 64 nt, Homo Sapiens
auuuaaagaaugguuccugaaaugaagucaguagaaauggcaugggauaagagcagagcucaca

SEQ ID NO: 562888 - RNA, 64 nt, Homo Sapiens
auccacuuuuucagguaaacauuuuucauuuggcaaauggcauaauuauuugaaagugacagga

SEQ ID NO: 562889 - RNA, 64 nt, Homo Sapiens
aauacuagaaacacaaggaaaugcaaguuacgcuaaauggcaguaauacuacccaacugccuuu

SEQ ID NO: 562890 - RNA, 64 nt, Homo Sapiens
aaucagcauacacauuuuugacuguacacacuauaaauggcaucaaauuuggauauuuuucuua

SEQ ID NO: 562891 - RNA, 64 nt, Homo Sapiens
guccuauuucauuagugaagacauaguucaccuaaaauggcauccugcucugaaucuagacuuu

SEQ ID NO: 562892 - RNA, 64 nt, Homo Sapiens
aaauggcauccugcucugaaucuagacuuuuuagaaauggcauauguuuuugaugauaugucaa

SEQ ID NO: 562893 - RNA, 64 nt, Homo Sapiens
uuaagcaagccauaguuaguaagacaacuuuauaaaauggcacugucuuucuggcuaauuaaaa

SEQ ID NO: 562894 - RNA, 64 nt, Homo Sapiens
uucgugaucaccacagugaguugcuaagagcugaaaauggcaucucccuagagcuuucccugug

SEQ ID NO: 562895 - RNA, 64 nt, Homo Sapiens
ggaugugcuucauccucuaauggcacaguauuugaaauggcaaaagccuuccuaguccuccacc

SEQ ID NO: 562896 - RNA, 64 nt, Homo Sapiens
gugguccgagguagcugcucaaagaaucugguuuaaauggcauuagauugagaauuuuauuuga

SEQ ID NO: 562897 - RNA, 64 nt, Homo Sapiens
uaaauuacuugaucuuuuuguauuuuguuuaugaaaauggcaagagaugagagaggggacuaau

SEQ ID NO: 562898 - RNA, 64 nt, Homo Sapiens
gugaggcucugggguuagauauucaaacuguaugaaauggcaaacucuaagguucuuuuuuuuu

SEQ ID NO: 562899 - RNA, 64 nt, Homo Sapiens
uuuguaagcgugucauuuaagcauuuaauuuuagaaauggcaaauaggaugucuugaaacccgu

SEQ ID NO: 562900 - RNA, 64 nt, Homo Sapiens
gccaggaguuggaccuagguagguugcuagcaggaaauggcagacauuauaccaguguugucca

SEQ ID NO: 562901 - RNA, 64 nt, Homo Sapiens
agaaaugcagauuucccaguaaguuggguaacaaaaauggcaaauagcacuuugcgcauugugu

SEQ ID NO: 562902 - RNA, 64 nt, Homo Sapiens
uauucccccuuggaauuugacaguuucuauggugaaauggcagaagguaacaacuauguugaaa

SEQ ID NO: 562903 - RNA, 64 nt, Homo Sapiens
gauauacaguuuuuucuucuuaguucugcauuagaaauggcaucuguuuuaggucucaaaauau

SEQ ID NO: 562904 - RNA, 64 nt, Homo Sapiens
accacuaccaaccauucauuuuuccucuuugacuaaauggcauuauccugcuccuccucucaug

SEQ ID NO: 562905 - RNA, 64 nt, Homo Sapiens
agagcuuaaaaaccaaaguuugggcaauuaaaauaaauggcauaauuuagguggaauugauguc

SEQ ID NO: 562906 - RNA, 64 nt, Homo Sapiens
augggacugaaacaugagaauuuuuuuucaucucaaauggcagcuuaaaauucugacaguugcc

SEQ ID NO: 562907 - RNA, 64 nt, Homo Sapiens
uagagguaacuuaauuugggaauuuguuguguugaaauggcauuuaauuucaaccuaaauacug

SEQ ID NO: 562908 - RNA, 64 nt, Homo Sapiens
caaugaaauuuuuuaguauguucaacucucauccaaauggcauaugacccuguuuacacagccu

SEQ ID NO: 562909 - RNA, 64 nt, Homo Sapiens
uguauaccaauuuguagaaaaauuugaauggauuaaauggcaccccuugaagauguagcuucca

SEQ ID NO: 562910 - RNA, 64 nt, Homo Sapiens
acaaggugugcaguggccccguaacugcccuuuuaaauggcaugggcugcaaaaccggcaaccu

SEQ ID NO: 562911 - RNA, 64 nt, Homo Sapiens
aacaccuuaagcaauauauuaauugguaacuaagaaauggcacagcugugaaugcagaauguaa

SEQ ID NO: 562912 - RNA, 64 nt, Homo Sapiens
guuuuuaugacuuuuauacucauuuuacuacaguaaauggcaguaacucaaauaaaaugcccca

SEQ ID NO: 562913 - RNA, 64 nt, Homo Sapiens
gaagcuggucuuuaaugagugggaaaugguuucuaaauggcaucaauguuucacuggaauugau

SEQ ID NO: 562914 - RNA, 64 nt, Homo Sapiens
ugggcucuguaaguuauuuuaugacacaguauugaaauggcaggauauacccagauuuacagag

SEQ ID NO: 562915 - RNA, 64 nt, Homo Sapiens
augccaauaugagauauuucuaggcacuacaaugaaauggcaggcaguaucaauggaaaaauga

SEQ ID NO: 562916 - RNA, 64 nt, Homo Sapiens
caaagaugaucauuuuuaugauucaaaauuacugaaauggcaaucagaaaauaacauacccugu

SEQ ID NO: 562917 - RNA, 64 nt, Homo Sapiens
gacguuaaaaaaaguuuuucguaacaugacacuaaaauggcagaacuggggaagggaaguuuca

SEQ ID NO: 562918 - RNA, 64 nt, Homo Sapiens
ugcucuuguuuuacccauguuuugccucucuugaaaauggcagggguauccugggugaagccug

SEQ ID NO: 562919 - RNA, 64 nt, Homo Sapiens
agaaaaguuauuuuucaaaggucuugcaguuaauaaauggcagagugagcauucaaguccaggu

SEQ ID NO: 562920 - RNA, 64 nt, Homo Sapiens
ugugaaaauguauaaaagaugcaucuguuguuucaaauggcacuaucuucuuuucaguacuaca

SEQ ID NO: 562921 - RNA, 64 nt, Homo Sapiens
cuuuuaaacacucugaccauagaaauguuuuucaaaauggcaacaauggauaaaccaaggauuu

SEQ ID NO: 562922 - RNA, 64 nt, Homo Sapiens
agcaaaaucuauggccacacugagaagccuuugaaaauggcaaauacuuuucaucaccaauugc

SEQ ID NO: 562923 - RNA, 64 nt, Homo Sapiens
auccguguacgaaucgaauacaaaauuugggggaaaauggcacuggcaauaaucaacugaauug

SEQ ID NO: 562924 - RNA, 64 nt, Homo Sapiens
acauauguagaugugcugcagcaaugugccuucuaaauggcauguuguccauuuacagcccuca

SEQ ID NO: 562925 - RNA, 64 nt, Homo Sapiens
ucguaucucuaauuuauggucuauauaccaauuuaaauggcauguaaaccugccuguuucuucu

SEQ ID NO: 562926 - RNA, 64 nt, Homo Sapiens
ggagacauuuaagauugucagcaaacuugucccaaaauggcacaucaucauaauccauuuucuc

SEQ ID NO: 562927 - RNA, 64 nt, Homo Sapiens
cauuguuuuuauucuuacacgacuacaguacuucaaauggcacauagauaggcaggauauuaca

SEQ ID NO: 562928 - RNA, 64 nt, Homo Sapiens
uguuucagugucacagagacauucuuugauaaggaaauggcacaaacauaaagggaaaggcugc

SEQ ID NO: 562929 - RNA, 64 nt, Homo Sapiens
ugucaauauuaaagauagcugagaagcaccuuucaaauggcacagucccucuucaagaugucua

SEQ ID NO: 562930 - RNA, 64 nt, Homo Sapiens
agcauuucccuaucuugcaguucuguuaacaugaaaauggcauuuuuccauaauagcuuuaaaa

SEQ ID NO: 562931 - RNA, 64 nt, Homo Sapiens
agauugucuuagucucaaugagauguagcuacaaaaauggcaccucuuagcagugaugaggcuc

SEQ ID NO: 562932 - RNA, 64 nt, Homo Sapiens
ucuugaaauagaauuggggccacuaauggaagacaaauggcaaaaaauggcauaaauauggucg

SEQ ID NO: 562933 - RNA, 64 nt, Homo Sapiens
aauauggucgcacuaauggaauaaaagggaagguaaauggcauagcaccuucagccacagccuu

SEQ ID NO: 562934 - RNA, 64 nt, Homo Sapiens
ucuccuaauuaauuuuccacaaacagcauucuagaaauggcauuucaaaugaagagaaaaagaa

SEQ ID NO: 562935 - RNA, 64 nt, Homo Sapiens
aagacgucaggccacccucauuaaugcuuuaaaaaaauggcaaaacuggauaaccuaauuuuuu

SEQ ID NO: 562936 - RNA, 64 nt, Homo Sapiens
cuagacauggauaggagugcguuuuaggcacagcaaauggcacauacaagggccagggagcaag

SEQ ID NO: 562937 - RNA, 64 nt, Homo Sapiens
ggccagggagcaagagagaggacagguccucaacaaauggcaugugacuuuguaaguguagaau

SEQ ID NO: 562938 - RNA, 64 nt, Homo Sapiens
ccugcggaucgagagaggggguagagucuucuucaaauggcaguuuuacuucaaauggcagauu

SEQ ID NO: 562939 - RNA, 64 nt, Homo Sapiens
ggguagagucuucuucaaauggcaguuuuacuucaaauggcagauuucacaagaguugguuauu

SEQ ID NO: 562940 - RNA, 64 nt, Homo Sapiens
agauggcucuauauuuuuuaaguugaaugagguaaaauggcauuacacauuucuuacaaaaaag

SEQ ID NO: 562941 - RNA, 64 nt, Homo Sapiens
ucauauacauguaaaaucagaugugcacauaugaaaauggcacacaguuucucuuaaucugauu

SEQ ID NO: 562942 - RNA, 64 nt, Homo Sapiens
uuuagguauagauaaccuaauaacugcuuuauaaaaauggcaacaagagcaucuucauuuuaau

SEQ ID NO: 562943 - RNA, 64 nt, Homo Sapiens
uugcugaagugucaaaauauuauuuuuaucagaaaaauggcauaauaaaagccugaauuugaaa

SEQ ID NO: 562944 - RNA, 64 nt, Homo Sapiens
accacgucuaaagcaguuucuuuacucuugugccaaauggcaacguccacaucauggcaguuca

SEQ ID NO: 562945 - RNA, 64 nt, Homo Sapiens
uaaauaccuuaguuaaugacguaauauauguaagaaauggcaaaucucccuagugaaaacuugg

SEQ ID NO: 562946 - RNA, 64 nt, Homo Sapiens
ccacuuuuuauaugguuguuuaguuucaagcaauaugauguacauuacuuuugagaaacaguau

SEQ ID NO: 562947 - RNA, 64 nt, Homo Sapiens
gucuuuaacagcauaauuuauauugcuuuuucaaaugauguagcugcauuaauuguguucauca

SEQ ID NO: 562948 - RNA, 64 nt, Homo Sapiens
gcugauaauauuuaauaaucuggaggagagaauaaugauguaccaauaaguggagauuccuccu

SEQ ID NO: 562949 - RNA, 64 nt, Homo Sapiens
auaaugauguaccaauaaguggagauuccuccuuaugauguaugcuagguuauggaagauguaa

SEQ ID NO: 562950 - RNA, 64 nt, Homo Sapiens
cucuauuuuguaaauauaagaugaguauuauuuaaugauguauuugcauaaguaaugcaaauug

SEQ ID NO: 562951 - RNA, 64 nt, Homo Sapiens
uaauauauuuaaauggggaauuucaucuaaaacaaugauguaguauuuuuaauauucugauugg

SEQ ID NO: 562952 - RNA, 64 nt, Homo Sapiens
cuuccuguacauaaauucaagaaaggagaugaguaugauguaugugccauuuguuuggaugagu

SEQ ID NO: 562953 - RNA, 64 nt, Homo Sapiens
uuugaaaguaagugacuuauguuuaacagaacuaaugauguauugaaacacuguauuaugaaaa

SEQ ID NO: 562954 - RNA, 64 nt, Homo Sapiens
ucaguucuauaaaugugcucguuuaaaggauuauaugauguacaguauaacaccagagcuugcu

SEQ ID NO: 562955 - RNA, 64 nt, Homo Sapiens
uuccuuaugauaaaaggaugcuuuugagaaaacaaugauguaaaguuucaaucuaaaauagcag

SEQ ID NO: 562956 - RNA, 64 nt, Homo Sapiens
acauuaaguagaaugugcauguuguaguccuaugaugauguaaacuugguacuacauaaugacu

SEQ ID NO: 562957 - RNA, 64 nt, Homo Sapiens
aaugacuugcuccacacaugcaguaaacuacauaaugauguacugguaaacuagaaacaaagaa

SEQ ID NO: 562958 - RNA, 64 nt, Homo Sapiens
cauuuuuaaaugugaagcuuuuguacaagcacauaugauguagauugugguugauacucaagcc

SEQ ID NO: 562959 - RNA, 64 nt, Homo Sapiens
cuaaacuaagcaaauaaugcaugaauagcacuuuaugauguaggaggcuguuaauuucccaucu

SEQ ID NO: 562960 - RNA, 64 nt, Homo Sapiens
auuugguuacuuggguuuggauacccuuagugggaugauguaaauagaggcuagcuaccuaggc

SEQ ID NO: 562961 - RNA, 64 nt, Homo Sapiens
auuuaaucacaucccccuucuagagugcuucaaaaugauguagucccucaacuuggcuaaagaa

SEQ ID NO: 562962 - RNA, 64 nt, Homo Sapiens
uuuuuuuuuuugagauggaguaugauguacuuuuaugauguacuauugcuuuugcauguucaca

SEQ ID NO: 562963 - RNA, 64 nt, Homo Sapiens
uuuaugauguacuuuuuuuuuugcauguucacauaugauguacuucuuuccggcugcauugcuu

SEQ ID NO: 562964 - RNA, 64 nt, Homo Sapiens
uuguaaaaaaauugauugaagguucuggcaccuuaugauguacuuuccaaucuuuccucccaag

SEQ ID NO: 562965 - RNA, 64 nt, Homo Sapiens
cauguauuuuaguaaauccauuuuaaaauggccaaugauguauagaaaugaauuauuaaaacaa

SEQ ID NO: 562966 - RNA, 64 nt, Homo Sapiens
aagccuguaucucugugaugaagugacuaguccuaugauguacaggcaguauccaugaaagcac

SEQ ID NO: 562967 - RNA, 64 nt, Homo Sapiens
caccacuggagcuucacuguucugauuuuacaucaugauguaauugcucaccaucagaucaacc

SEQ ID NO: 562968 - RNA, 64 nt, Homo Sapiens
uuucauaaccuggagaucagacuguugcuuucgcaugauguauguagugucucaugacuggagu

SEQ ID NO: 562969 - RNA, 64 nt, Homo Sapiens
uccuuguauuuuucaagagcuauuuuguaaacagaugauguauuucuccauugaaaacacaaua

SEQ ID NO: 562970 - RNA, 64 nt, Homo Sapiens
gaaacugaacagugaaguggcaaguauucauuucaugauguaaagaaauuugggagguuaauac

SEQ ID NO: 562971 - RNA, 64 nt, Homo Sapiens; identical to SEQ ID NO: 562970

SEQ ID NO: 562972 - RNA, 64 nt, Homo Sapiens
uuugucuccccucuccaaagauaaauauuuauauaugauguaugggauuuggaaccuuauugug

SEQ ID NO: 562973 - RNA, 64 nt, Homo Sapiens
ugaaauauaaaauaggauuuguuuaaauauuaccaugauguaguauauugucuggaaagggaug

SEQ ID NO: 562974 - RNA, 64 nt, Homo Sapiens
aucugaggggacccuguuaggagagcauagcaucaugauguauuagcuguucaucugcuacugg

SEQ ID NO: 562975 - RNA, 64 nt, Homo Sapiens
gccauaucuauaccauauuuuauucgagucacugaugauguaaugauauauuuuuucauuauua

SEQ ID NO: 562976 - RNA, 64 nt, Homo Sapiens
auuaaaauaaugccaaacaccaaauaugaauuuuaugauguacacuuugugcuuggcauuaaaa

SEQ ID NO: 562977 - RNA, 64 nt, Homo Sapiens
aaauguaaacagaucgcacagaguaaagaagaugaugauguaauagugaauaaaccucauguuu

SEQ ID NO: 562978 - RNA, 64 nt, Homo Sapiens
uguuaaauaacgcuuuuauacuguauuuuguacuaugauguaacuccccuuccuuauggcuagg

SEQ ID NO: 562979 - RNA, 64 nt, Homo Sapiens
uaugcccuuauaucccaaaaaagaacuuuagaugaugauguauugcacuuuuauugagaaugag

SEQ ID NO: 562980 - RNA, 64 nt, Homo Sapiens
uguugcccuacuaccuaccaagagcaagaaaaagaugauguagauuuuaugguugugaagaacg

SEQ ID NO: 562981 - RNA, 64 nt, Homo Sapiens; identical to SEQ ID NO: 180837

SEQ ID NO: 562982 - RNA, 64 nt, Homo Sapiens; identical to SEQ ID NO: 180838

SEQ ID NO: 562983 - RNA, 64 nt, Homo Sapiens; identical to SEQ ID NO: 180839

SEQ ID NO: 562984 - RNA, 64 nt, Homo Sapiens; identical to SEQ ID NO: 180840

SEQ ID NO: 562985 - RNA, 64 nt, Homo Sapiens; identical to SEQ ID NO: 180841

SEQ ID NO: 562986 - RNA, 64 nt, Homo Sapiens; identical to SEQ ID NO: 180842

SEQ ID NO: 562987 - RNA, 64 nt, Homo Sapiens; identical to SEQ ID NO: 180843

SEQ ID NO: 562988 - RNA, 64 nt, Homo Sapiens; identical to SEQ ID NO: 180844

SEQ ID NO: 562989 - RNA, 64 nt, Homo Sapiens; identical to SEQ ID NO: 180845

SEQ ID NO: 562990 - RNA, 64 nt, Homo Sapiens; identical to SEQ ID NO: 180846

SEQ ID NO: 562991 - RNA, 64 nt, Homo Sapiens; identical to SEQ ID NO: 180847

SEQ ID NO: 562992 - RNA, 64 nt, Homo Sapiens; identical to SEQ ID NO: 180848

SEQ ID NO: 562993 - RNA, 64 nt, Homo Sapiens; identical to SEQ ID NO: 180849

SEQ ID NO: 562994 - RNA, 64 nt, Homo Sapiens; identical to SEQ ID NO: 180850

SEQ ID NO: 562995 - RNA, 64 nt, Homo Sapiens; identical to SEQ ID NO: 180851

SEQ ID NO: 562996 - RNA, 64 nt, Homo Sapiens; identical to SEQ ID NO: 180852

SEQ ID NO: 562997 - RNA, 64 nt, Homo Sapiens; identical to SEQ ID NO: 562946

SEQ ID NO: 562998 - RNA, 64 nt, Homo Sapiens; identical to SEQ ID NO: 562947

SEQ ID NO: 562999 - RNA, 64 nt, Homo Sapiens; identical to SEQ ID NO: 562948

SEQ ID NO: 563000 - RNA, 64 nt, Homo Sapiens; identical to SEQ ID NO: 562949

SEQ ID NO: 563001 - RNA, 64 nt, Homo Sapiens; identical to SEQ ID NO: 562950

SEQ ID NO: 563002 - RNA, 64 nt, Homo Sapiens; identical to SEQ ID NO: 562951

SEQ ID NO: 563003 - RNA, 64 nt, Homo Sapiens; identical to SEQ ID NO: 562952

SEQ ID NO: 563004 - RNA, 64 nt, Homo Sapiens; identical to SEQ ID NO: 562953

SEQ ID NO: 563005 - RNA, 64 nt, Homo Sapiens; identical to SEQ ID NO: 562954

SEQ ID NO: 563006 - RNA, 64 nt, Homo Sapiens; identical to SEQ ID NO: 562955

SEQ ID NO: 563007 - RNA, 64 nt, Homo Sapiens; identical to SEQ ID NO: 562956

SEQ ID NO: 563008 - RNA, 64 nt, Homo Sapiens; identical to SEQ ID NO: 562957

SEQ ID NO: 563009 - RNA, 64 nt, Homo Sapiens; identical to SEQ ID NO: 562958

SEQ ID NO: 563010 - RNA, 64 nt, Homo Sapiens; identical to SEQ ID NO: 562959

SEQ ID NO: 563011 - RNA, 64 nt, Homo Sapiens; identical to SEQ ID NO: 562960

SEQ ID NO: 563012 - RNA, 64 nt, Homo Sapiens; identical to SEQ ID NO: 562961

SEQ ID NO: 563013 - RNA, 64 nt, Homo Sapiens; identical to SEQ ID NO: 562962

SEQ ID NO: 563014 - RNA, 64 nt, Homo Sapiens; identical to SEQ ID NO: 562963

SEQ ID NO: 563015 - RNA, 64 nt, Homo Sapiens; identical to SEQ ID NO: 562964

SEQ ID NO: 563016 - RNA, 64 nt, Homo Sapiens; identical to SEQ ID NO: 562965

SEQ ID NO: 563017 - RNA, 64 nt, Homo Sapiens; identical to SEQ ID NO: 562966

SEQ ID NO: 563018 - RNA, 64 nt, Homo Sapiens; identical to SEQ ID NO: 562967

SEQ ID NO: 563019 - RNA, 64 nt, Homo Sapiens; identical to SEQ ID NO: 562968

SEQ ID NO: 563020 - RNA, 64 nt, Homo Sapiens; identical to SEQ ID NO: 562969

SEQ ID NO: 563021 - RNA, 64 nt, Homo Sapiens; identical to SEQ ID NO: 562970

SEQ ID NO: 563022 - RNA, 64 nt, Homo Sapiens; identical to SEQ ID NO: 562970

SEQ ID NO: 563023 - RNA, 64 nt, Homo Sapiens; identical to SEQ ID NO: 562972

SEQ ID NO: 563024 - RNA, 64 nt, Homo Sapiens; identical to SEQ ID NO: 562973

SEQ ID NO: 563025 - RNA, 64 nt, Homo Sapiens; identical to SEQ ID NO: 562974

SEQ ID NO: 563026 - RNA, 64 nt, Homo Sapiens; identical to SEQ ID NO: 562975

SEQ ID NO: 563027 - RNA, 64 nt, Homo Sapiens; identical to SEQ ID NO: 562976

SEQ ID NO: 563028 - RNA, 64 nt, Homo Sapiens; identical to SEQ ID NO: 562977

SEQ ID NO: 563029 - RNA, 64 nt, Homo Sapiens; identical to SEQ ID NO: 562978

SEQ ID NO: 563030 - RNA, 64 nt, Homo Sapiens; identical to SEQ ID NO: 562979

SEQ ID NO: 563031 - RNA, 64 nt, Homo Sapiens; identical to SEQ ID NO: 562980

SEQ ID NO: 563032 - RNA, 64 nt, Homo Sapiens; identical to SEQ ID NO: 180837

SEQ ID NO: 563033 - RNA, 64 nt, Homo Sapiens; identical to SEQ ID NO: 180838

SEQ ID NO: 563034 - RNA, 64 nt, Homo Sapiens; identical to SEQ ID NO: 180839

SEQ ID NO: 563035 - RNA, 64 nt, Homo Sapiens; identical to SEQ ID NO: 180840

SEQ ID NO: 563036 - RNA, 64 nt, Homo Sapiens; identical to SEQ ID NO: 180841

SEQ ID NO: 563037 - RNA, 64 nt, Homo Sapiens; identical to SEQ ID NO: 180842

SEQ ID NO: 563038 - RNA, 64 nt, Homo Sapiens; identical to SEQ ID NO: 180843

SEQ ID NO: 563039 - RNA, 64 nt, Homo Sapiens; identical to SEQ ID NO: 180844

SEQ ID NO: 563040 - RNA, 64 nt, Homo Sapiens; identical to SEQ ID NO: 180845

SEQ ID NO: 563041 - RNA, 64 nt, Homo Sapiens; identical to SEQ ID NO: 180846

SEQ ID NO: 563042 - RNA, 64 nt, Homo Sapiens; identical to SEQ ID NO: 180847

SEQ ID NO: 563043 - RNA, 64 nt, Homo Sapiens; identical to SEQ ID NO: 180848

SEQ ID NO: 563044 - RNA, 64 nt, Homo Sapiens; identical to SEQ ID NO: 180849

SEQ ID NO: 563045 - RNA, 64 nt, Homo Sapiens; identical to SEQ ID NO: 180850

SEQ ID NO: 563046 - RNA, 64 nt, Homo Sapiens; identical to SEQ ID NO: 180851

SEQ ID NO: 563047 - RNA, 64 nt, Homo Sapiens; identical to SEQ ID NO: 180852

SEQ ID NO: 563048 - RNA, 64 nt, Homo Sapiens; identical to SEQ ID NO: 210217

SEQ ID NO: 563049 - RNA, 64 nt, Homo Sapiens; identical to SEQ ID NO: 210218

SEQ ID NO: 563050 - RNA, 64 nt, Homo Sapiens; identical to SEQ ID NO: 210219

SEQ ID NO: 563051 - RNA, 64 nt, Homo Sapiens; identical to SEQ ID NO: 210220

SEQ ID NO: 563052 - RNA, 64 nt, Homo Sapiens; identical to SEQ ID NO: 210221

SEQ ID NO: 563053 - RNA, 64 nt, Homo Sapiens; identical to SEQ ID NO: 210222

SEQ ID NO: 563054 - RNA, 64 nt, Homo Sapiens; identical to SEQ ID NO: 210223

SEQ ID NO: 563055 - RNA, 64 nt, Homo Sapiens; identical to SEQ ID NO: 210224

SEQ ID NO: 563056 - RNA, 64 nt, Homo Sapiens; identical to SEQ ID NO: 210225

SEQ ID NO: 563057 - RNA, 64 nt, Homo Sapiens; identical to SEQ ID NO: 210226

SEQ ID NO: 563058 - RNA, 64 nt, Homo Sapiens; identical to SEQ ID NO: 210227

SEQ ID NO: 563059 - RNA, 64 nt, Homo Sapiens; identical to SEQ ID NO: 210228

SEQ ID NO: 563060 - RNA, 64 nt, Homo Sapiens; identical to SEQ ID NO: 210229

SEQ ID NO: 563061 - RNA, 64 nt, Homo Sapiens; identical to SEQ ID NO: 210230

SEQ ID NO: 563062 - RNA, 64 nt, Homo Sapiens; identical to SEQ ID NO: 210231

SEQ ID NO: 563063 - RNA, 64 nt, Homo Sapiens; identical to SEQ ID NO: 210232

SEQ ID NO: 563064 - RNA, 64 nt, Homo Sapiens; identical to SEQ ID NO: 535894

SEQ ID NO: 563065 - RNA, 64 nt, Homo Sapiens; identical to SEQ ID NO: 535895

SEQ ID NO: 563066 - RNA, 64 nt, Homo Sapiens; identical to SEQ ID NO: 535896

SEQ ID NO: 563067 - RNA, 64 nt, Homo Sapiens; identical to SEQ ID NO: 535897

SEQ ID NO: 563068 - RNA, 64 nt, Homo Sapiens; identical to SEQ ID NO: 535898

SEQ ID NO: 563069 - RNA, 64 nt, Homo Sapiens; identical to SEQ ID NO: 535899

SEQ ID NO: 563070 - RNA, 64 nt, Homo Sapiens; identical to SEQ ID NO: 535900

SEQ ID NO: 563071 - RNA, 64 nt, Homo Sapiens; identical to SEQ ID NO: 535901

SEQ ID NO: 563072 - RNA, 64 nt, Homo Sapiens; identical to SEQ ID NO: 535902

SEQ ID NO: 563073 - RNA, 64 nt, Homo Sapiens; identical to SEQ ID NO: 535903

SEQ ID NO: 563074 - RNA, 64 nt, Homo Sapiens; identical to SEQ ID NO: 535904

SEQ ID NO: 563075 - RNA, 64 nt, Homo Sapiens; identical to SEQ ID NO: 535905

SEQ ID NO: 563076 - RNA, 64 nt, Homo Sapiens; identical to SEQ ID NO: 494417

SEQ ID NO: 563077 - RNA, 64 nt, Homo Sapiens; identical to SEQ ID NO: 494418

SEQ ID NO: 563078 - RNA, 64 nt, Homo Sapiens; identical to SEQ ID NO: 494419

SEQ ID NO: 563079 - RNA, 64 nt, Homo Sapiens; identical to SEQ ID NO: 494420

SEQ ID NO: 563080 - RNA, 64 nt, Homo Sapiens; identical to SEQ ID NO: 494421

SEQ ID NO: 563081 - RNA, 64 nt, Homo Sapiens; identical to SEQ ID NO: 494422

SEQ ID NO: 563082 - RNA, 64 nt, Homo Sapiens; identical to SEQ ID NO: 494423

SEQ ID NO: 563083 - RNA, 64 nt, Homo Sapiens; identical to SEQ ID NO: 494424

SEQ ID NO: 563084 - RNA, 64 nt, Homo Sapiens
uuuauuuuaccauccucccaugguuccuuuugccccuugguaaggucggcacucaguaaauguu

SEQ ID NO: 563085 - RNA, 64 nt, Homo Sapiens
ugguggcaucuguugaacugaacugaguaaggauccuugguacucuccguagucacaguuucag

SEQ ID NO: 563086 - RNA, 64 nt, Homo Sapiens
gaggccaacccaucucaccugacacugaauacugccuugguagaaagugaggaccuguaaucca

SEQ ID NO: 563087 - RNA, 64 nt, Homo Sapiens
auuuuuuuucuuuauguguaguguuuucaugcuaccuugguaggaaacuuauuuacaaaccaua

SEQ ID NO: 563088 - RNA, 64 nt, Homo Sapiens
gaucauuucucccuauucaaaugagaauauuuucccuugguagaauccauauacaauauggauu

SEQ ID NO: 563089 - RNA, 64 nt, Homo Sapiens
caguaugugacccaaagaaagaguugucucaacuccuugguacaggguucauucaaacccccaa

SEQ ID NO: 563090 - RNA, 64 nt, Homo Sapiens
ggccaggucaggcaggccagucgucuacacacccccuugguacccauucccauuucacaaacuc

SEQ ID NO: 563091 - RNA, 64 nt, Homo Sapiens
agccaggggcccacacaccuggugccaggguccaccuugguauaccagcucggcagaacaguuc

SEQ ID NO: 563092 - RNA, 64 nt, Homo Sapiens
aggaaugggauauggagccacauccacuuccaccccuugguaucuggacccacguguucuuccu

SEQ ID NO: 563093 - RNA, 64 nt, Homo Sapiens
guaggacauuuagagguggcagugucuggaucuaccuugguaggagggagucaguacuguugga

SEQ ID NO: 563094 - RNA, 64 nt, Homo Sapiens
uuuaauuacuuuccccuuuugcuugauucuucuuccuugguaucauauucaaaggaggaaagaa

SEQ ID NO: 563095 - RNA, 64 nt, Homo Sapiens
uuguaacuauuaaccuuucuaaaaguuuucaucgccuugguaaagcuccagaaauggacaaugc

SEQ ID NO: 563096 - RNA, 64 nt, Homo Sapiens
cugaaugucugugaauuucagaggucucugcuagccuugguaucauuuucuagcaauaacugag

SEQ ID NO: 563097 - RNA, 64 nt, Homo Sapiens
cuccucacaccccagcaccccccauuuuuucaaaccuugguaucuguugggugaacaguauaau

SEQ ID NO: 563098 - RNA, 64 nt, Homo Sapiens
gcccaucggcaaaucgcaauaauugccagagacaccuugguaguucagcuccaccuggagugcg

SEQ ID NO: 563099 - RNA, 64 nt, Homo Sapiens
uuuuuaaacacuguuaacugacuacuguuguagaccuugguauuggaguguuuucagugucugu

SEQ ID NO: 563100 - RNA, 64 nt, Homo Sapiens
aaugcuuauugcugcaugaucaauuuucuucugaauaacaaaugaacuauaaacacacugcaua

SEQ ID NO: 563101 - RNA, 64 nt, Homo Sapiens
acuuugcuuccuaauuuaaaaaaccauuucagcuauaacaaaguacaaccauuugcuucauuua

SEQ ID NO: 563102 - RNA, 64 nt, Homo Sapiens
cacauacaugauaccauccaaauucuugcuuuuaauaacaaagguacaauauuuuguuuuagua

SEQ ID NO: 563103 - RNA, 64 nt, Homo Sapiens
aaguguugccugccaccaaucaguaaguuagucuauaacaaauuuuacccuaacaguuuuacca

SEQ ID NO: 563104 - RNA, 64 nt, Homo Sapiens
caacaaauguaaauauguuuaccuuaaaggcucaauaacaaauagucuguucauucugggccua

SEQ ID NO: 563105 - RNA, 64 nt, Homo Sapiens
ugcauaauuuauuuaucuacccaaaaacuaacaaauaacaaaggugugauuggcuuagguaauc

SEQ ID NO: 563106 - RNA, 64 nt, Homo Sapiens
agaggaucuugaagcgaucaagaauccagauucuauaacaaaucaaauugcacuuuuggaagcc

SEQ ID NO: 563107 - RNA, 64 nt, Homo Sapiens
aaggcuuaaugaauuuauggcagguuuuuauauaauaacaaauaaauuaaaggaaaauuaccaa

SEQ ID NO: 563108 - RNA, 64 nt, Homo Sapiens
ggauagacuuauuggaauuuacaagacauacaacauaacaaaaaguguugcuguaaauccaaaa

SEQ ID NO: 563109 - RNA, 64 nt, Homo Sapiens
uuaaugaaagcaaaacauuacuuacauuuuugcaauaacaaacaaagacaaaauuguaggaaau

SEQ ID NO: 563110 - RNA, 64 nt, Homo Sapiens
cuccaaauauucuggagaacuuccuugugcuuugauaacaaagaucugauaaugaaugccagcu

SEQ ID NO: 563111 - RNA, 64 nt, Homo Sapiens
uuuaauuugaugggaaaauaguacacacauauauauaacaaauaauauauuaaaaaacccaucc

SEQ ID NO: 563112 - RNA, 64 nt, Homo Sapiens
gggagggaauaaaucaugacuuaucccauuuucaauaacaaaacgaaacuauggcacuaaccaa

SEQ ID NO: 563113 - RNA, 64 nt, Homo Sapiens
acgucuaauacuaugacuguuaaaaugucagacuauaacaaauaucuaucuuuuauuuuucauu

SEQ ID NO: 563114 - RNA, 64 nt, Homo Sapiens
ucaacuagagauuauaaagucucuaaagaaggcaauaacaaaauuuaucaagauauaguacuuu

SEQ ID NO: 563115 - RNA, 64 nt, Homo Sapiens
gaaacaagaauuagaaugacuugagaacgggcaaauaacaaagcaaaccaauauaauuauaugg

SEQ ID NO: 563116 - RNA, 64 nt, Homo Sapiens
ccauagaaacuauuaaaguaacuagaacugucaaauaacaaaacggcucauguuuuuaaaauau

SEQ ID NO: 563117 - RNA, 64 nt, Homo Sapiens
auguucagcuuuccauuugguacauuguauuaagauaacaaaacauauaacaaauguuugccuu

SEQ ID NO: 563118 - RNA, 64 nt, Homo Sapiens
uuugccuuuacauuguauuaauuuauauucuuauauaacaaaugcauuuuaucauauuuauacu

SEQ ID NO: 563119 - RNA, 64 nt, Homo Sapiens
ccugcugacauuaauaagcaguagaaaauucuaaauaacaaaaacaaauaacaugauugucuuu

SEQ ID NO: 563120 - RNA, 64 nt, Homo Sapiens
gguacuuuuacauuugaguagugugugugugguuauaacaaacucuguguguguacguguaugu

SEQ ID NO: 563121 - RNA, 64 nt, Homo Sapiens
caaaguucuuugugcuuuucaugcaguagaaauuauaacaaauauuucuaucuguaucuggaca

SEQ ID NO: 563122 - RNA, 64 nt, Homo Sapiens
ggaagauuucaagaaaggacuucuauuguuuuuuauaacaaaguauaccuaaacaggaagaaaa

SEQ ID NO: 563123 - RNA, 64 nt, Homo Sapiens
agaauuucuucacaaaaugaaauuuaaaauggaaauaacaaagcaacuguuagaaaaauuagaa

SEQ ID NO: 563124 - RNA, 64 nt, Homo Sapiens
auaucuaauuuuuauuggaucauacaauuauuuuauaacaaaaucccuguuaucuaaauuauaa

SEQ ID NO: 563125 - RNA, 64 nt, Homo Sapiens
guagccaucuccuuguuccaguguuauuguagcaauaacaaaaaguguguuugcacacacgcgu

SEQ ID NO: 563126 - RNA, 64 nt, Homo Sapiens
ggccaaacucgcaggacauuggaauggaaguuuaauaacaaaugugucucaggugucagucuua

SEQ ID NO: 563127 - RNA, 64 nt, Homo Sapiens; identical to SEQ ID NO: 130466

SEQ ID NO: 563128 - RNA, 64 nt, Homo Sapiens; identical to SEQ ID NO: 130467

SEQ ID NO: 563129 - RNA, 64 nt, Homo Sapiens; identical to SEQ ID NO: 130468

SEQ ID NO: 563130 - RNA, 64 nt, Homo Sapiens; identical to SEQ ID NO: 130469

SEQ ID NO: 563131 - RNA, 64 nt, Homo Sapiens; identical to SEQ ID NO: 130470

SEQ ID NO: 563132 - RNA, 64 nt, Homo Sapiens; identical to SEQ ID NO: 130471

SEQ ID NO: 563133 - RNA, 64 nt, Homo Sapiens; identical to SEQ ID NO: 130472

SEQ ID NO: 563134 - RNA, 64 nt, Homo Sapiens; identical to SEQ ID NO: 130473

SEQ ID NO: 563135 - RNA, 64 nt, Homo Sapiens; identical to SEQ ID NO: 130474

SEQ ID NO: 563136 - RNA, 64 nt, Homo Sapiens; identical to SEQ ID NO: 130475

SEQ ID NO: 563137 - RNA, 64 nt, Homo Sapiens; identical to SEQ ID NO: 130476

SEQ ID NO: 563138 - RNA, 64 nt, Homo Sapiens; identical to SEQ ID NO: 130477

SEQ ID NO: 563139 - RNA, 64 nt, Homo Sapiens; identical to SEQ ID NO: 130478

SEQ ID NO: 563140 - RNA, 64 nt, Homo Sapiens; identical to SEQ ID NO: 130479

SEQ ID NO: 563141 - RNA, 64 nt, Homo Sapiens; identical to SEQ ID NO: 130480

SEQ ID NO: 563142 - RNA, 64 nt, Homo Sapiens; identical to SEQ ID NO: 130481

SEQ ID NO: 563143 - RNA, 64 nt, Homo Sapiens; identical to SEQ ID NO: 130482

SEQ ID NO: 563144 - RNA, 64 nt, Homo Sapiens; identical to SEQ ID NO: 130483

SEQ ID NO: 563145 - RNA, 64 nt, Homo Sapiens; identical to SEQ ID NO: 130484

SEQ ID NO: 563146 - RNA, 64 nt, Homo Sapiens; identical to SEQ ID NO: 130485

SEQ ID NO: 563147 - RNA, 64 nt, Homo Sapiens; identical to SEQ ID NO: 130486

SEQ ID NO: 563148 - RNA, 64 nt, Homo Sapiens; identical to SEQ ID NO: 130487

SEQ ID NO: 563149 - RNA, 64 nt, Homo Sapiens; identical to SEQ ID NO: 130488

SEQ ID NO: 563150 - RNA, 64 nt, Homo Sapiens; identical to SEQ ID NO: 130489

SEQ ID NO: 563151 - RNA, 64 nt, Homo Sapiens; identical to SEQ ID NO: 130490

SEQ ID NO: 563152 - RNA, 64 nt, Homo Sapiens; identical to SEQ ID NO: 130491

SEQ ID NO: 563153 - RNA, 64 nt, Homo Sapiens; identical to SEQ ID NO: 173467

SEQ ID NO: 563154 - RNA, 64 nt, Homo Sapiens; identical to SEQ ID NO: 173468

SEQ ID NO: 563155 - RNA, 64 nt, Homo Sapiens; identical to SEQ ID NO: 173469

SEQ ID NO: 563156 - RNA, 64 nt, Homo Sapiens; identical to SEQ ID NO: 173470

SEQ ID NO: 563157 - RNA, 64 nt, Homo Sapiens; identical to SEQ ID NO: 173471

SEQ ID NO: 563158 - RNA, 64 nt, Homo Sapiens; identical to SEQ ID NO: 173472

SEQ ID NO: 563159 - RNA, 64 nt, Homo Sapiens; identical to SEQ ID NO: 173473

SEQ ID NO: 563160 - RNA, 64 nt, Homo Sapiens; identical to SEQ ID NO: 173474

SEQ ID NO: 563161 - RNA, 64 nt, Homo Sapiens; identical to SEQ ID NO: 173475

SEQ ID NO: 563162 - RNA, 64 nt, Homo Sapiens; identical to SEQ ID NO: 173476

SEQ ID NO: 563163 - RNA, 64 nt, Homo Sapiens; identical to SEQ ID NO: 173477

SEQ ID NO: 563164 - RNA, 64 nt, Homo Sapiens; identical to SEQ ID NO: 173478

SEQ ID NO: 563165 - RNA, 64 nt, Homo Sapiens; identical to SEQ ID NO: 173479

SEQ ID NO: 563166 - RNA, 64 nt, Homo Sapiens; identical to SEQ ID NO: 173480

SEQ ID NO: 563167 - RNA, 64 nt, Homo Sapiens; identical to SEQ ID NO: 173481

SEQ ID NO: 563168 - RNA, 64 nt, Homo Sapiens; identical to SEQ ID NO: 173482

SEQ ID NO: 563169 - RNA, 64 nt, Homo Sapiens; identical to SEQ ID NO: 173483

SEQ ID NO: 563170 - RNA, 64 nt, Homo Sapiens; identical to SEQ ID NO: 173484

SEQ ID NO: 563171 - RNA, 64 nt, Homo Sapiens; identical to SEQ ID NO: 173485

SEQ ID NO: 563172 - RNA, 64 nt, Homo Sapiens; identical to SEQ ID NO: 173486

SEQ ID NO: 563173 - RNA, 64 nt, Homo Sapiens; identical to SEQ ID NO: 173487

SEQ ID NO: 563174 - RNA, 64 nt, Homo Sapiens; identical to SEQ ID NO: 173488

SEQ ID NO: 563175 - RNA, 64 nt, Homo Sapiens; identical to SEQ ID NO: 455593

SEQ ID NO: 563176 - RNA, 64 nt, Homo Sapiens; identical to SEQ ID NO: 455594

SEQ ID NO: 563177 - RNA, 64 nt, Homo Sapiens; identical to SEQ ID NO: 455595

SEQ ID NO: 563178 - RNA, 64 nt, Homo Sapiens; identical to SEQ ID NO: 455596

SEQ ID NO: 563179 - RNA, 65 nt, Homo Sapiens; identical to SEQ ID NO: 44973

SEQ ID NO: 563180 - RNA, 65 nt, Homo Sapiens; identical to SEQ ID NO: 44974

SEQ ID NO: 563181 - RNA, 65 nt, Homo Sapiens; identical to SEQ ID NO: 44975

SEQ ID NO: 563182 - RNA, 65 nt, Homo Sapiens; identical to SEQ ID NO: 44976

SEQ ID NO: 563183 - RNA, 65 nt, Homo Sapiens; identical to SEQ ID NO: 44977

SEQ ID NO: 563184 - RNA, 65 nt, Homo Sapiens; identical to SEQ ID NO: 44978

SEQ ID NO: 563185 - RNA, 65 nt, Homo Sapiens; identical to SEQ ID NO: 44979

SEQ ID NO: 563186 - RNA, 65 nt, Homo Sapiens; identical to SEQ ID NO: 44980

SEQ ID NO: 563187 - RNA, 65 nt, Homo Sapiens; identical to SEQ ID NO: 44981

SEQ ID NO: 563188 - RNA, 65 nt, Homo Sapiens; identical to SEQ ID NO: 44982

SEQ ID NO: 563189 - RNA, 65 nt, Homo Sapiens; identical to SEQ ID NO: 44983

SEQ ID NO: 563190 - RNA, 65 nt, Homo Sapiens; identical to SEQ ID NO: 44984

SEQ ID NO: 563191 - RNA, 65 nt, Homo Sapiens; identical to SEQ ID NO: 44985

SEQ ID NO: 563192 - RNA, 65 nt, Homo Sapiens; identical to SEQ ID NO: 44986

SEQ ID NO: 563193 - RNA, 65 nt, Homo Sapiens; identical to SEQ ID NO: 44987

SEQ ID NO: 563194 - RNA, 65 nt, Homo Sapiens; identical to SEQ ID NO: 44988

SEQ ID NO: 563195 - RNA, 65 nt, Homo Sapiens; identical to SEQ ID NO: 44989

SEQ ID NO: 563196 - RNA, 65 nt, Homo Sapiens; identical to SEQ ID NO: 44990

SEQ ID NO: 563197 - RNA, 65 nt, Homo Sapiens; identical to SEQ ID NO: 44991

SEQ ID NO: 563198 - RNA, 65 nt, Homo Sapiens; identical to SEQ ID NO: 44992

SEQ ID NO: 563199 - RNA, 65 nt, Homo Sapiens; identical to SEQ ID NO: 44993

SEQ ID NO: 563200 - RNA, 65 nt, Homo Sapiens; identical to SEQ ID NO: 44994

SEQ ID NO: 563201 - RNA, 65 nt, Homo Sapiens; identical to SEQ ID NO: 44995

SEQ ID NO: 563202 - RNA, 65 nt, Homo Sapiens; identical to SEQ ID NO: 44996

SEQ ID NO: 563203 - RNA, 65 nt, Homo Sapiens; identical to SEQ ID NO: 44997

SEQ ID NO: 563204 - RNA, 65 nt, Homo Sapiens; identical to SEQ ID NO: 44998

SEQ ID NO: 563205 - RNA, 65 nt, Homo Sapiens; identical to SEQ ID NO: 44999

SEQ ID NO: 563206 - RNA, 65 nt, Homo Sapiens; identical to SEQ ID NO: 45000

SEQ ID NO: 563207 - RNA, 65 nt, Homo Sapiens; identical to SEQ ID NO: 45001

SEQ ID NO: 563208 - RNA, 65 nt, Homo Sapiens; identical to SEQ ID NO: 45002

SEQ ID NO: 563209 - RNA, 65 nt, Homo Sapiens; identical to SEQ ID NO: 45003

SEQ ID NO: 563210 - RNA, 65 nt, Homo Sapiens; identical to SEQ ID NO: 45004

SEQ ID NO: 563211 - RNA, 65 nt, Homo Sapiens; identical to SEQ ID NO: 45005

SEQ ID NO: 563212 - RNA, 65 nt, Homo Sapiens; identical to SEQ ID NO: 45006

SEQ ID NO: 563213 - RNA, 65 nt, Homo Sapiens; identical to SEQ ID NO: 45007

SEQ ID NO: 563214 - RNA, 65 nt, Homo Sapiens; identical to SEQ ID NO: 45008

SEQ ID NO: 563215 - RNA, 65 nt, Homo Sapiens; identical to SEQ ID NO: 45009

SEQ ID NO: 563216 - RNA, 65 nt, Homo Sapiens; identical to SEQ ID NO: 45010

SEQ ID NO: 563217 - RNA, 65 nt, Homo Sapiens; identical to SEQ ID NO: 45011

SEQ ID NO: 563218 - RNA, 65 nt, Homo Sapiens; identical to SEQ ID NO: 45012

SEQ ID NO: 563219 - RNA, 65 nt, Homo Sapiens; identical to SEQ ID NO: 45013

SEQ ID NO: 563220 - RNA, 65 nt, Homo Sapiens; identical to SEQ ID NO: 45014

SEQ ID NO: 563221 - RNA, 65 nt, Homo Sapiens; identical to SEQ ID NO: 45015

SEQ ID NO: 563222 - RNA, 65 nt, Homo Sapiens; identical to SEQ ID NO: 45016

SEQ ID NO: 563223 - RNA, 65 nt, Homo Sapiens; identical to SEQ ID NO: 45017

SEQ ID NO: 563224 - RNA, 65 nt, Homo Sapiens; identical to SEQ ID NO: 45018

SEQ ID NO: 563225 - RNA, 65 nt, Homo Sapiens; identical to SEQ ID NO: 45019

SEQ ID NO: 563226 - RNA, 65 nt, Homo Sapiens; identical to SEQ ID NO: 45020

SEQ ID NO: 563227 - RNA, 65 nt, Homo Sapiens; identical to SEQ ID NO: 45021

SEQ ID NO: 563228 - RNA, 65 nt, Homo Sapiens; identical to SEQ ID NO: 45022

SEQ ID NO: 563229 - RNA, 65 nt, Homo Sapiens; identical to SEQ ID NO: 45023

SEQ ID NO: 563230 - RNA, 65 nt, Homo Sapiens; identical to SEQ ID NO: 45024

SEQ ID NO: 563231 - RNA, 64 nt, Homo Sapiens; identical to SEQ ID NO: 51839

SEQ ID NO: 563232 - RNA, 64 nt, Homo Sapiens; identical to SEQ ID NO: 51840

SEQ ID NO: 563233 - RNA, 64 nt, Homo Sapiens; identical to SEQ ID NO: 51841

SEQ ID NO: 563234 - RNA, 64 nt, Homo Sapiens; identical to SEQ ID NO: 51842

SEQ ID NO: 563235 - RNA, 64 nt, Homo Sapiens; identical to SEQ ID NO: 51843

SEQ ID NO: 563236 - RNA, 64 nt, Homo Sapiens; identical to SEQ ID NO: 51844

SEQ ID NO: 563237 - RNA, 64 nt, Homo Sapiens; identical to SEQ ID NO: 51845

SEQ ID NO: 563238 - RNA, 64 nt, Homo Sapiens; identical to SEQ ID NO: 51846

SEQ ID NO: 563239 - RNA, 64 nt, Homo Sapiens; identical to SEQ ID NO: 51847

SEQ ID NO: 563240 - RNA, 64 nt, Homo Sapiens; identical to SEQ ID NO: 51848

SEQ ID NO: 563241 - RNA, 64 nt, Homo Sapiens; identical to SEQ ID NO: 51849

SEQ ID NO: 563242 - RNA, 64 nt, Homo Sapiens; identical to SEQ ID NO: 51850

SEQ ID NO: 563243 - RNA, 64 nt, Homo Sapiens; identical to SEQ ID NO: 51851

SEQ ID NO: 563244 - RNA, 64 nt, Homo Sapiens; identical to SEQ ID NO: 51852

SEQ ID NO: 563245 - RNA, 64 nt, Homo Sapiens; identical to SEQ ID NO: 51853

SEQ ID NO: 563246 - RNA, 64 nt, Homo Sapiens; identical to SEQ ID NO: 51854

SEQ ID NO: 563247 - RNA, 64 nt, Homo Sapiens; identical to SEQ ID NO: 51855

SEQ ID NO: 563248 - RNA, 64 nt, Homo Sapiens; identical to SEQ ID NO: 51856

SEQ ID NO: 563249 - RNA, 64 nt, Homo Sapiens; identical to SEQ ID NO: 51857

SEQ ID NO: 563250 - RNA, 64 nt, Homo Sapiens; identical to SEQ ID NO: 51858

SEQ ID NO: 563251 - RNA, 64 nt, Homo Sapiens; identical to SEQ ID NO: 51859

SEQ ID NO: 563252 - RNA, 64 nt, Homo Sapiens; identical to SEQ ID NO: 51860

SEQ ID NO: 563253 - RNA, 64 nt, Homo Sapiens; identical to SEQ ID NO: 51861

SEQ ID NO: 563254 - RNA, 64 nt, Homo Sapiens; identical to SEQ ID NO: 51862

SEQ ID NO: 563255 - RNA, 64 nt, Homo Sapiens; identical to SEQ ID NO: 51863

SEQ ID NO: 563256 - RNA, 64 nt, Homo Sapiens; identical to SEQ ID NO: 51864

SEQ ID NO: 563257 - RNA, 64 nt, Homo Sapiens; identical to SEQ ID NO: 51865

SEQ ID NO: 563258 - RNA, 64 nt, Homo Sapiens; identical to SEQ ID NO: 51866

SEQ ID NO: 563259 - RNA, 64 nt, Homo Sapiens; identical to SEQ ID NO: 51867

SEQ ID NO: 563260 - RNA, 64 nt, Homo Sapiens; identical to SEQ ID NO: 51868

SEQ ID NO: 563261 - RNA, 64 nt, Homo Sapiens; identical to SEQ ID NO: 51869

SEQ ID NO: 563262 - RNA, 64 nt, Homo Sapiens; identical to SEQ ID NO: 51870

SEQ ID NO: 563263 - RNA, 64 nt, Homo Sapiens; identical to SEQ ID NO: 51871

SEQ ID NO: 563264 - RNA, 64 nt, Homo Sapiens; identical to SEQ ID NO: 51872

SEQ ID NO: 563265 - RNA, 64 nt, Homo Sapiens; identical to SEQ ID NO: 51873

SEQ ID NO: 563266 - RNA, 64 nt, Homo Sapiens; identical to SEQ ID NO: 51874

SEQ ID NO: 563267 - RNA, 64 nt, Homo Sapiens; identical to SEQ ID NO: 51875

SEQ ID NO: 563268 - RNA, 64 nt, Homo Sapiens; identical to SEQ ID NO: 51876

SEQ ID NO: 563269 - RNA, 64 nt, Homo Sapiens; identical to SEQ ID NO: 51877

SEQ ID NO: 563270 - RNA, 64 nt, Homo Sapiens; identical to SEQ ID NO: 51878

SEQ ID NO: 563271 - RNA, 64 nt, Homo Sapiens; identical to SEQ ID NO: 51879

SEQ ID NO: 563272 - RNA, 64 nt, Homo Sapiens; identical to SEQ ID NO: 51880

SEQ ID NO: 563273 - RNA, 64 nt, Homo Sapiens; identical to SEQ ID NO: 51881

SEQ ID NO: 563274 - RNA, 64 nt, Homo Sapiens; identical to SEQ ID NO: 51882

SEQ ID NO: 563275 - RNA, 64 nt, Homo Sapiens; identical to SEQ ID NO: 51883

SEQ ID NO: 563276 - RNA, 64 nt, Homo Sapiens; identical to SEQ ID NO: 51884

SEQ ID NO: 563277 - RNA, 64 nt, Homo Sapiens; identical to SEQ ID NO: 51885

SEQ ID NO: 563278 - RNA, 64 nt, Homo Sapiens; identical to SEQ ID NO: 51886

SEQ ID NO: 563279 - RNA, 64 nt, Homo Sapiens; identical to SEQ ID NO: 51887

SEQ ID NO: 563280 - RNA, 64 nt, Homo Sapiens; identical to SEQ ID NO: 51888

SEQ ID NO: 563281 - RNA, 64 nt, Homo Sapiens; identical to SEQ ID NO: 51889

SEQ ID NO: 563282 - RNA, 64 nt, Homo Sapiens; identical to SEQ ID NO: 51890

SEQ ID NO: 563283 - RNA, 63 nt, Homo Sapiens; identical to SEQ ID NO: 51891

SEQ ID NO: 563284 - RNA, 64 nt, Homo Sapiens; identical to SEQ ID NO: 51892

SEQ ID NO: 563285 - RNA, 64 nt, Homo Sapiens; identical to SEQ ID NO: 51893

SEQ ID NO: 563286 - RNA, 64 nt, Homo Sapiens; identical to SEQ ID NO: 51894

SEQ ID NO: 563287 - RNA, 64 nt, Homo Sapiens; identical to SEQ ID NO: 51895

SEQ ID NO: 563288 - RNA, 64 nt, Homo Sapiens; identical to SEQ ID NO: 51896

SEQ ID NO: 563289 - RNA, 64 nt, Homo Sapiens; identical to SEQ ID NO: 51897

SEQ ID NO: 563290 - RNA, 64 nt, Homo Sapiens; identical to SEQ ID NO: 51898

SEQ ID NO: 563291 - RNA, 64 nt, Homo Sapiens; identical to SEQ ID NO: 51899

SEQ ID NO: 563292 - RNA, 64 nt, Homo Sapiens; identical to SEQ ID NO: 51900

SEQ ID NO: 563293 - RNA, 64 nt, Homo Sapiens; identical to SEQ ID NO: 51901

SEQ ID NO: 563294 - RNA, 64 nt, Homo Sapiens; identical to SEQ ID NO: 51902

SEQ ID NO: 563295 - RNA, 64 nt, Homo Sapiens; identical to SEQ ID NO: 51903

SEQ ID NO: 563296 - RNA, 64 nt, Homo Sapiens; identical to SEQ ID NO: 51904

SEQ ID NO: 563297 - RNA, 64 nt, Homo Sapiens; identical to SEQ ID NO: 51905

SEQ ID NO: 563298 - RNA, 64 nt, Homo Sapiens; identical to SEQ ID NO: 51906

SEQ ID NO: 563299 - RNA, 64 nt, Homo Sapiens; identical to SEQ ID NO: 51907

SEQ ID NO: 563300 - RNA, 64 nt, Homo Sapiens; identical to SEQ ID NO: 51908

SEQ ID NO: 563301 - RNA, 64 nt, Homo Sapiens; identical to SEQ ID NO: 51909

SEQ ID NO: 563302 - RNA, 64 nt, Homo Sapiens; identical to SEQ ID NO: 51910

SEQ ID NO: 563303 - RNA, 64 nt, Homo Sapiens; identical to SEQ ID NO: 51911

SEQ ID NO: 563304 - RNA, 64 nt, Homo Sapiens; identical to SEQ ID NO: 51912

SEQ ID NO: 563305 - RNA, 64 nt, Homo Sapiens; identical to SEQ ID NO: 51913

SEQ ID NO: 563306 - RNA, 64 nt, Homo Sapiens; identical to SEQ ID NO: 51914

SEQ ID NO: 563307 - RNA, 64 nt, Homo Sapiens; identical to SEQ ID NO: 51915

SEQ ID NO: 563308 - RNA, 64 nt, Homo Sapiens; identical to SEQ ID NO: 51916

SEQ ID NO: 563309 - RNA, 64 nt, Homo Sapiens; identical to SEQ ID NO: 51917

SEQ ID NO: 563310 - RNA, 64 nt, Homo Sapiens
uucccacugaagauaccccaaaggaugcaagugccuacaguauuaucaggaggagaacaugaaa

SEQ ID NO: 563311 - RNA, 64 nt, Homo Sapiens
uuuugagaaugccaaaaaucagguuucagaaaagcuacaguaugaaaucugaaaagcaacagaa

SEQ ID NO: 563312 - RNA, 65 nt, Homo Sapiens; identical to SEQ ID NO: 192258

SEQ ID NO: 563313 - RNA, 65 nt, Homo Sapiens; identical to SEQ ID NO: 192259

SEQ ID NO: 563314 - RNA, 65 nt, Homo Sapiens; identical to SEQ ID NO: 192260

SEQ ID NO: 563315 - RNA, 65 nt, Homo Sapiens; identical to SEQ ID NO: 192261

SEQ ID NO: 563316 - RNA, 65 nt, Homo Sapiens; identical to SEQ ID NO: 192262

SEQ ID NO: 563317 - RNA, 65 nt, Homo Sapiens; identical to SEQ ID NO: 192263

SEQ ID NO: 563318 - RNA, 65 nt, Homo Sapiens; identical to SEQ ID NO: 192264

SEQ ID NO: 563319 - RNA, 65 nt, Homo Sapiens; identical to SEQ ID NO: 192265

SEQ ID NO: 563320 - RNA, 65 nt, Homo Sapiens; identical to SEQ ID NO: 192266

SEQ ID NO: 563321 - RNA, 65 nt, Homo Sapiens; identical to SEQ ID NO: 192267

SEQ ID NO: 563322 - RNA, 65 nt, Homo Sapiens; identical to SEQ ID NO: 192268

SEQ ID NO: 563323 - RNA, 65 nt, Homo Sapiens; identical to SEQ ID NO: 192269

SEQ ID NO: 563324 - RNA, 65 nt, Homo Sapiens; identical to SEQ ID NO: 192270

SEQ ID NO: 563325 - RNA, 65 nt, Homo Sapiens; identical to SEQ ID NO: 192271

SEQ ID NO: 563326 - RNA, 65 nt, Homo Sapiens; identical to SEQ ID NO: 192272

SEQ ID NO: 563327 - RNA, 65 nt, Homo Sapiens; identical to SEQ ID NO: 192273

SEQ ID NO: 563328 - RNA, 65 nt, Homo Sapiens; identical to SEQ ID NO: 192274

SEQ ID NO: 563329 - RNA, 65 nt, Homo Sapiens; identical to SEQ ID NO: 192275

SEQ ID NO: 563330 - RNA, 65 nt, Homo Sapiens; identical to SEQ ID NO: 192276

SEQ ID NO: 563331 - RNA, 65 nt, Homo Sapiens; identical to SEQ ID NO: 192277

SEQ ID NO: 563332 - RNA, 65 nt, Homo Sapiens; identical to SEQ ID NO: 192278

SEQ ID NO: 563333 - RNA, 65 nt, Homo Sapiens; identical to SEQ ID NO: 192279

SEQ ID NO: 563334 - RNA, 65 nt, Homo Sapiens; identical to SEQ ID NO: 192280

SEQ ID NO: 563335 - RNA, 65 nt, Homo Sapiens; identical to SEQ ID NO: 192281

SEQ ID NO: 563336 - RNA, 65 nt, Homo Sapiens; identical to SEQ ID NO: 192282

SEQ ID NO: 563337 - RNA, 65 nt, Homo Sapiens; identical to SEQ ID NO: 192283

SEQ ID NO: 563338 - RNA, 65 nt, Homo Sapiens; identical to SEQ ID NO: 192284

SEQ ID NO: 563339 - RNA, 65 nt, Homo Sapiens; identical to SEQ ID NO: 192285

SEQ ID NO: 563340 - RNA, 65 nt, Homo Sapiens; identical to SEQ ID NO: 192286

SEQ ID NO: 563341 - RNA, 65 nt, Homo Sapiens; identical to SEQ ID NO: 192287

SEQ ID NO: 563342 - RNA, 65 nt, Homo Sapiens; identical to SEQ ID NO: 192288

SEQ ID NO: 563343 - RNA, 65 nt, Homo Sapiens; identical to SEQ ID NO: 192289

SEQ ID NO: 563344 - RNA, 65 nt, Homo Sapiens; identical to SEQ ID NO: 192290

SEQ ID NO: 563345 - RNA, 65 nt, Homo Sapiens; identical to SEQ ID NO: 192291

SEQ ID NO: 563346 - RNA, 65 nt, Homo Sapiens; identical to SEQ ID NO: 192292

SEQ ID NO: 563347 - RNA, 65 nt, Homo Sapiens; identical to SEQ ID NO: 192293

SEQ ID NO: 563348 - RNA, 65 nt, Homo Sapiens; identical to SEQ ID NO: 192294

SEQ ID NO: 563349 - RNA, 65 nt, Homo Sapiens; identical to SEQ ID NO: 192295

SEQ ID NO: 563350 - RNA, 65 nt, Homo Sapiens; identical to SEQ ID NO: 192296

SEQ ID NO: 563351 - RNA, 65 nt, Homo Sapiens; identical to SEQ ID NO: 192297

SEQ ID NO: 563352 - RNA, 65 nt, Homo Sapiens; identical to SEQ ID NO: 192298

SEQ ID NO: 563353 - RNA, 65 nt, Homo Sapiens; identical to SEQ ID NO: 192299

SEQ ID NO: 563354 - RNA, 65 nt, Homo Sapiens; identical to SEQ ID NO: 192300

SEQ ID NO: 563355 - RNA, 65 nt, Homo Sapiens; identical to SEQ ID NO: 192301

SEQ ID NO: 563356 - RNA, 65 nt, Homo Sapiens; identical to SEQ ID NO: 192302

SEQ ID NO: 563357 - RNA, 65 nt, Homo Sapiens; identical to SEQ ID NO: 192303

SEQ ID NO: 563358 - RNA, 65 nt, Homo Sapiens; identical to SEQ ID NO: 192304

SEQ ID NO: 563359 - RNA, 65 nt, Homo Sapiens; identical to SEQ ID NO: 192305

SEQ ID NO: 563360 - RNA, 65 nt, Homo Sapiens; identical to SEQ ID NO: 192306

SEQ ID NO: 563361 - RNA, 65 nt, Homo Sapiens; identical to SEQ ID NO: 192307

SEQ ID NO: 563362 - RNA, 65 nt, Homo Sapiens; identical to SEQ ID NO: 192308

SEQ ID NO: 563363 - RNA, 65 nt, Homo Sapiens; identical to SEQ ID NO: 192309

SEQ ID NO: 563364 - RNA, 65 nt, Homo Sapiens; identical to SEQ ID NO: 192310

SEQ ID NO: 563365 - RNA, 65 nt, Homo Sapiens; identical to SEQ ID NO: 192311

SEQ ID NO: 563366 - RNA, 65 nt, Homo Sapiens; identical to SEQ ID NO: 192312

SEQ ID NO: 563367 - RNA, 65 nt, Homo Sapiens; identical to SEQ ID NO: 192313

SEQ ID NO: 563368 - RNA, 65 nt, Homo Sapiens; identical to SEQ ID NO: 192314

SEQ ID NO: 563369 - RNA, 65 nt, Homo Sapiens; identical to SEQ ID NO: 192315

SEQ ID NO: 563370 - RNA, 65 nt, Homo Sapiens; identical to SEQ ID NO: 192316

SEQ ID NO: 563371 - RNA, 65 nt, Homo Sapiens; identical to SEQ ID NO: 192317

SEQ ID NO: 563372 - RNA, 65 nt, Homo Sapiens; identical to SEQ ID NO: 192318

SEQ ID NO: 563373 - RNA, 65 nt, Homo Sapiens; identical to SEQ ID NO: 192319

SEQ ID NO: 563374 - RNA, 65 nt, Homo Sapiens; identical to SEQ ID NO: 192320

SEQ ID NO: 563375 - RNA, 65 nt, Homo Sapiens; identical to SEQ ID NO: 192321

SEQ ID NO: 563376 - RNA, 65 nt, Homo Sapiens; identical to SEQ ID NO: 192322

SEQ ID NO: 563377 - RNA, 65 nt, Homo Sapiens; identical to SEQ ID NO: 192323

SEQ ID NO: 563378 - RNA, 65 nt, Homo Sapiens; identical to SEQ ID NO: 192324

SEQ ID NO: 563379 - RNA, 65 nt, Homo Sapiens; identical to SEQ ID NO: 192325

SEQ ID NO: 563380 - RNA, 65 nt, Homo Sapiens; identical to SEQ ID NO: 192326

SEQ ID NO: 563381 - RNA, 65 nt, Homo Sapiens; identical to SEQ ID NO: 192327

SEQ ID NO: 563382 - RNA, 65 nt, Homo Sapiens; identical to SEQ ID NO: 192328

SEQ ID NO: 563383 - RNA, 65 nt, Homo Sapiens; identical to SEQ ID NO: 192329

SEQ ID NO: 563384 - RNA, 65 nt, Homo Sapiens; identical to SEQ ID NO: 192330

SEQ ID NO: 563385 - RNA, 65 nt, Homo Sapiens; identical to SEQ ID NO: 192331

SEQ ID NO: 563386 - RNA, 65 nt, Homo Sapiens; identical to SEQ ID NO: 192332

SEQ ID NO: 563387 - RNA, 65 nt, Homo Sapiens; identical to SEQ ID NO: 192333

SEQ ID NO: 563388 - RNA, 65 nt, Homo Sapiens; identical to SEQ ID NO: 192334

SEQ ID NO: 563389 - RNA, 65 nt, Homo Sapiens; identical to SEQ ID NO: 192335

SEQ ID NO: 563390 - RNA, 65 nt, Homo Sapiens; identical to SEQ ID NO: 192336

SEQ ID NO: 563391 - RNA, 65 nt, Homo Sapiens; identical to SEQ ID NO: 192337

SEQ ID NO: 563392 - RNA, 65 nt, Homo Sapiens; identical to SEQ ID NO: 192338

SEQ ID NO: 563393 - RNA, 65 nt, Homo Sapiens; identical to SEQ ID NO: 192339

SEQ ID NO: 563394 - RNA, 65 nt, Homo Sapiens; identical to SEQ ID NO: 192340

SEQ ID NO: 563395 - RNA, 65 nt, Homo Sapiens; identical to SEQ ID NO: 192341

SEQ ID NO: 563396 - RNA, 65 nt, Homo Sapiens; identical to SEQ ID NO: 192342

SEQ ID NO: 563397 - RNA, 65 nt, Homo Sapiens; identical to SEQ ID NO: 192343

SEQ ID NO: 563398 - RNA, 65 nt, Homo Sapiens; identical to SEQ ID NO: 192344

SEQ ID NO: 563399 - RNA, 65 nt, Homo Sapiens; identical to SEQ ID NO: 192345

SEQ ID NO: 563400 - RNA, 65 nt, Homo Sapiens; identical to SEQ ID NO: 192346

SEQ ID NO: 563401 - RNA, 65 nt, Homo Sapiens; identical to SEQ ID NO: 192347

SEQ ID NO: 563402 - RNA, 65 nt, Homo Sapiens; identical to SEQ ID NO: 192348

SEQ ID NO: 563403 - RNA, 65 nt, Homo Sapiens; identical to SEQ ID NO: 192349

SEQ ID NO: 563404 - RNA, 65 nt, Homo Sapiens; identical to SEQ ID NO: 192350

SEQ ID NO: 563405 - RNA, 65 nt, Homo Sapiens; identical to SEQ ID NO: 192351

SEQ ID NO: 563406 - RNA, 65 nt, Homo Sapiens; identical to SEQ ID NO: 192352

SEQ ID NO: 563407 - RNA, 65 nt, Homo Sapiens; identical to SEQ ID NO: 192353

SEQ ID NO: 563408 - RNA, 65 nt, Homo Sapiens; identical to SEQ ID NO: 192354

SEQ ID NO: 563409 - RNA, 65 nt, Homo Sapiens; identical to SEQ ID NO: 192355

SEQ ID NO: 563410 - RNA, 65 nt, Homo Sapiens; identical to SEQ ID NO: 192356

SEQ ID NO: 563411 - RNA, 65 nt, Homo Sapiens; identical to SEQ ID NO: 192357

SEQ ID NO: 563412 - RNA, 65 nt, Homo Sapiens; identical to SEQ ID NO: 192358

SEQ ID NO: 563413 - RNA, 65 nt, Homo Sapiens; identical to SEQ ID NO: 192359

SEQ ID NO: 563414 - RNA, 65 nt, Homo Sapiens; identical to SEQ ID NO: 192360

SEQ ID NO: 563415 - RNA, 65 nt, Homo Sapiens; identical to SEQ ID NO: 192361

SEQ ID NO: 563416 - RNA, 65 nt, Homo Sapiens; identical to SEQ ID NO: 192362

SEQ ID NO: 563417 - RNA, 65 nt, Homo Sapiens; identical to SEQ ID NO: 192363

SEQ ID NO: 563418 - RNA, 65 nt, Homo Sapiens; identical to SEQ ID NO: 192364

SEQ ID NO: 563419 - RNA, 65 nt, Homo Sapiens; identical to SEQ ID NO: 192365

SEQ ID NO: 563420 - RNA, 65 nt, Homo Sapiens; identical to SEQ ID NO: 192366

SEQ ID NO: 563421 - RNA, 65 nt, Homo Sapiens; identical to SEQ ID NO: 192367

SEQ ID NO: 563422 - RNA, 65 nt, Homo Sapiens; identical to SEQ ID NO: 192368

SEQ ID NO: 563423 - RNA, 65 nt, Homo Sapiens; identical to SEQ ID NO: 192369

SEQ ID NO: 563424 - RNA, 65 nt, Homo Sapiens; identical to SEQ ID NO: 192370

SEQ ID NO: 563425 - RNA, 65 nt, Homo Sapiens; identical to SEQ ID NO: 192371

SEQ ID NO: 563426 - RNA, 65 nt, Homo Sapiens; identical to SEQ ID NO: 192372

SEQ ID NO: 563427 - RNA, 65 nt, Homo Sapiens; identical to SEQ ID NO: 192373

SEQ ID NO: 563428 - RNA, 65 nt, Homo Sapiens; identical to SEQ ID NO: 192374

SEQ ID NO: 563429 - RNA, 65 nt, Homo Sapiens; identical to SEQ ID NO: 192375

SEQ ID NO: 563430 - RNA, 65 nt, Homo Sapiens; identical to SEQ ID NO: 192376

SEQ ID NO: 563431 - RNA, 65 nt, Homo Sapiens; identical to SEQ ID NO: 192377

SEQ ID NO: 563432 - RNA, 65 nt, Homo Sapiens; identical to SEQ ID NO: 192378

SEQ ID NO: 563433 - RNA, 65 nt, Homo Sapiens; identical to SEQ ID NO: 192379

SEQ ID NO: 563434 - RNA, 65 nt, Homo Sapiens; identical to SEQ ID NO: 192380

SEQ ID NO: 563435 - RNA, 65 nt, Homo Sapiens; identical to SEQ ID NO: 192381

SEQ ID NO: 563436 - RNA, 65 nt, Homo Sapiens; identical to SEQ ID NO: 192382

SEQ ID NO: 563437 - RNA, 65 nt, Homo Sapiens; identical to SEQ ID NO: 192383

SEQ ID NO: 563438 - RNA, 65 nt, Homo Sapiens; identical to SEQ ID NO: 192384

SEQ ID NO: 563439 - RNA, 65 nt, Homo Sapiens; identical to SEQ ID NO: 192385

SEQ ID NO: 563440 - RNA, 65 nt, Homo Sapiens; identical to SEQ ID NO: 192386

SEQ ID NO: 563441 - RNA, 65 nt, Homo Sapiens; identical to SEQ ID NO: 192387

SEQ ID NO: 563442 - RNA, 65 nt, Homo Sapiens; identical to SEQ ID NO: 192388

SEQ ID NO: 563443 - RNA, 65 nt, Homo Sapiens; identical to SEQ ID NO: 192389

SEQ ID NO: 563444 - RNA, 65 nt, Homo Sapiens; identical to SEQ ID NO: 192390

SEQ ID NO: 563445 - RNA, 65 nt, Homo Sapiens; identical to SEQ ID NO: 192391

SEQ ID NO: 563446 - RNA, 65 nt, Homo Sapiens; identical to SEQ ID NO: 192392

SEQ ID NO: 563447 - RNA, 65 nt, Homo Sapiens; identical to SEQ ID NO: 192393

SEQ ID NO: 563448 - RNA, 65 nt, Homo Sapiens; identical to SEQ ID NO: 192394

SEQ ID NO: 563449 - RNA, 65 nt, Homo Sapiens; identical to SEQ ID NO: 192395

SEQ ID NO: 563450 - RNA, 65 nt, Homo Sapiens; identical to SEQ ID NO: 192396

SEQ ID NO: 563451 - RNA, 65 nt, Homo Sapiens; identical to SEQ ID NO: 192397

SEQ ID NO: 563452 - RNA, 65 nt, Homo Sapiens; identical to SEQ ID NO: 192398

SEQ ID NO: 563453 - RNA, 65 nt, Homo Sapiens; identical to SEQ ID NO: 192399

SEQ ID NO: 563454 - RNA, 65 nt, Homo Sapiens; identical to SEQ ID NO: 192400

SEQ ID NO: 563455 - RNA, 65 nt, Homo Sapiens; identical to SEQ ID NO: 192401

SEQ ID NO: 563456 - RNA, 65 nt, Homo Sapiens; identical to SEQ ID NO: 192402

SEQ ID NO: 563457 - RNA, 65 nt, Homo Sapiens; identical to SEQ ID NO: 192403

SEQ ID NO: 563458 - RNA, 65 nt, Homo Sapiens; identical to SEQ ID NO: 192404

SEQ ID NO: 563459 - RNA, 65 nt, Homo Sapiens; identical to SEQ ID NO: 192405

SEQ ID NO: 563460 - RNA, 65 nt, Homo Sapiens; identical to SEQ ID NO: 192406

SEQ ID NO: 563461 - RNA, 65 nt, Homo Sapiens; identical to SEQ ID NO: 192407

SEQ ID NO: 563462 - RNA, 65 nt, Homo Sapiens; identical to SEQ ID NO: 192408

SEQ ID NO: 563463 - RNA, 65 nt, Homo Sapiens; identical to SEQ ID NO: 192409

SEQ ID NO: 563464 - RNA, 65 nt, Homo Sapiens; identical to SEQ ID NO: 192410

SEQ ID NO: 563465 - RNA, 65 nt, Homo Sapiens; identical to SEQ ID NO: 192411

SEQ ID NO: 563466 - RNA, 65 nt, Homo Sapiens; identical to SEQ ID NO: 192412

SEQ ID NO: 563467 - RNA, 65 nt, Homo Sapiens; identical to SEQ ID NO: 192413

SEQ ID NO: 563468 - RNA, 65 nt, Homo Sapiens; identical to SEQ ID NO: 192414

SEQ ID NO: 563469 - RNA, 65 nt, Homo Sapiens; identical to SEQ ID NO: 192415

SEQ ID NO: 563470 - RNA, 65 nt, Homo Sapiens; identical to SEQ ID NO: 192416

SEQ ID NO: 563471 - RNA, 65 nt, Homo Sapiens; identical to SEQ ID NO: 192417

SEQ ID NO: 563472 - RNA, 65 nt, Homo Sapiens; identical to SEQ ID NO: 192418

SEQ ID NO: 563473 - RNA, 65 nt, Homo Sapiens; identical to SEQ ID NO: 192419

SEQ ID NO: 563474 - RNA, 65 nt, Homo Sapiens; identical to SEQ ID NO: 192420

SEQ ID NO: 563475 - RNA, 65 nt, Homo Sapiens; identical to SEQ ID NO: 192421

SEQ ID NO: 563476 - RNA, 65 nt, Homo Sapiens; identical to SEQ ID NO: 192422

SEQ ID NO: 563477 - RNA, 65 nt, Homo Sapiens; identical to SEQ ID NO: 192423

SEQ ID NO: 563478 - RNA, 65 nt, Homo Sapiens; identical to SEQ ID NO: 192424

SEQ ID NO: 563479 - RNA, 65 nt, Homo Sapiens; identical to SEQ ID NO: 192425

SEQ ID NO: 563480 - RNA, 65 nt, Homo Sapiens; identical to SEQ ID NO: 192426

SEQ ID NO: 563481 - RNA, 65 nt, Homo Sapiens; identical to SEQ ID NO: 192427

SEQ ID NO: 563482 - RNA, 65 nt, Homo Sapiens; identical to SEQ ID NO: 192428

SEQ ID NO: 563483 - RNA, 65 nt, Homo Sapiens; identical to SEQ ID NO: 192429

SEQ ID NO: 563484 - RNA, 65 nt, Homo Sapiens; identical to SEQ ID NO: 192430

SEQ ID NO: 563485 - RNA, 65 nt, Homo Sapiens; identical to SEQ ID NO: 192431

SEQ ID NO: 563486 - RNA, 65 nt, Homo Sapiens; identical to SEQ ID NO: 192432

SEQ ID NO: 563487 - RNA, 65 nt, Homo Sapiens; identical to SEQ ID NO: 192433

SEQ ID NO: 563488 - RNA, 65 nt, Homo Sapiens; identical to SEQ ID NO: 192434

SEQ ID NO: 563489 - RNA, 65 nt, Homo Sapiens; identical to SEQ ID NO: 192435

SEQ ID NO: 563490 - RNA, 65 nt, Homo Sapiens; identical to SEQ ID NO: 192436

SEQ ID NO: 563491 - RNA, 65 nt, Homo Sapiens; identical to SEQ ID NO: 192437

SEQ ID NO: 563492 - RNA, 65 nt, Homo Sapiens; identical to SEQ ID NO: 192438

SEQ ID NO: 563493 - RNA, 65 nt, Homo Sapiens; identical to SEQ ID NO: 192439

SEQ ID NO: 563494 - RNA, 65 nt, Homo Sapiens; identical to SEQ ID NO: 192440

SEQ ID NO: 563495 - RNA, 65 nt, Homo Sapiens; identical to SEQ ID NO: 192441

SEQ ID NO: 563496 - RNA, 65 nt, Homo Sapiens; identical to SEQ ID NO: 192442

SEQ ID NO: 563497 - RNA, 65 nt, Homo Sapiens; identical to SEQ ID NO: 192443

SEQ ID NO: 563498 - RNA, 65 nt, Homo Sapiens; identical to SEQ ID NO: 192444

SEQ ID NO: 563499 - RNA, 65 nt, Homo Sapiens; identical to SEQ ID NO: 192445

SEQ ID NO: 563500 - RNA, 65 nt, Homo Sapiens; identical to SEQ ID NO: 192446

SEQ ID NO: 563501 - RNA, 65 nt, Homo Sapiens; identical to SEQ ID NO: 192447

SEQ ID NO: 563502 - RNA, 65 nt, Homo Sapiens; identical to SEQ ID NO: 192448

SEQ ID NO: 563503 - RNA, 65 nt, Homo Sapiens; identical to SEQ ID NO: 192449

SEQ ID NO: 563504 - RNA, 65 nt, Homo Sapiens; identical to SEQ ID NO: 192450

SEQ ID NO: 563505 - RNA, 65 nt, Homo Sapiens; identical to SEQ ID NO: 192451

SEQ ID NO: 563506 - RNA, 65 nt, Homo Sapiens; identical to SEQ ID NO: 192452

SEQ ID NO: 563507 - RNA, 65 nt, Homo Sapiens; identical to SEQ ID NO: 192453

SEQ ID NO: 563508 - RNA, 65 nt, Homo Sapiens; identical to SEQ ID NO: 192454

SEQ ID NO: 563509 - RNA, 65 nt, Homo Sapiens; identical to SEQ ID NO: 192455

SEQ ID NO: 563510 - RNA, 65 nt, Homo Sapiens; identical to SEQ ID NO: 192456

SEQ ID NO: 563511 - RNA, 65 nt, Homo Sapiens; identical to SEQ ID NO: 192457

SEQ ID NO: 563512 - RNA, 65 nt, Homo Sapiens; identical to SEQ ID NO: 192458

SEQ ID NO: 563513 - RNA, 65 nt, Homo Sapiens; identical to SEQ ID NO: 192459

SEQ ID NO: 563514 - RNA, 65 nt, Homo Sapiens; identical to SEQ ID NO: 192460

SEQ ID NO: 563515 - RNA, 65 nt, Homo Sapiens; identical to SEQ ID NO: 192461

SEQ ID NO: 563516 - RNA, 65 nt, Homo Sapiens; identical to SEQ ID NO: 192462

SEQ ID NO: 563517 - RNA, 65 nt, Homo Sapiens; identical to SEQ ID NO: 192463

SEQ ID NO: 563518 - RNA, 51 nt, Homo Sapiens; identical to SEQ ID NO: 192464

SEQ ID NO: 563519 - RNA, 65 nt, Homo Sapiens; identical to SEQ ID NO: 192465

SEQ ID NO: 563520 - RNA, 65 nt, Homo Sapiens; identical to SEQ ID NO: 192466

SEQ ID NO: 563521 - RNA, 65 nt, Homo Sapiens; identical to SEQ ID NO: 192467

SEQ ID NO: 563522 - RNA, 65 nt, Homo Sapiens; identical to SEQ ID NO: 192468

SEQ ID NO: 563523 - RNA, 65 nt, Homo Sapiens; identical to SEQ ID NO: 192469

SEQ ID NO: 563524 - RNA, 65 nt, Homo Sapiens; identical to SEQ ID NO: 192470

SEQ ID NO: 563525 - RNA, 65 nt, Homo Sapiens; identical to SEQ ID NO: 192471

SEQ ID NO: 563526 - RNA, 65 nt, Homo Sapiens; identical to SEQ ID NO: 192472

SEQ ID NO: 563527 - RNA, 65 nt, Homo Sapiens; identical to SEQ ID NO: 192473

SEQ ID NO: 563528 - RNA, 65 nt, Homo Sapiens; identical to SEQ ID NO: 192474

SEQ ID NO: 563529 - RNA, 65 nt, Homo Sapiens; identical to SEQ ID NO: 192475

SEQ ID NO: 563530 - RNA, 65 nt, Homo Sapiens; identical to SEQ ID NO: 192476

SEQ ID NO: 563531 - RNA, 65 nt, Homo Sapiens; identical to SEQ ID NO: 192477

SEQ ID NO: 563532 - RNA, 65 nt, Homo Sapiens; identical to SEQ ID NO: 192478

SEQ ID NO: 563533 - RNA, 65 nt, Homo Sapiens; identical to SEQ ID NO: 192479

SEQ ID NO: 563534 - RNA, 65 nt, Homo Sapiens; identical to SEQ ID NO: 192480

SEQ ID NO: 563535 - RNA, 65 nt, Homo Sapiens; identical to SEQ ID NO: 192481

SEQ ID NO: 563536 - RNA, 65 nt, Homo Sapiens; identical to SEQ ID NO: 192482

SEQ ID NO: 563537 - RNA, 65 nt, Homo Sapiens; identical to SEQ ID NO: 192483

SEQ ID NO: 563538 - RNA, 65 nt, Homo Sapiens; identical to SEQ ID NO: 192484

SEQ ID NO: 563539 - RNA, 65 nt, Homo Sapiens; identical to SEQ ID NO: 192485

SEQ ID NO: 563540 - RNA, 65 nt, Homo Sapiens; identical to SEQ ID NO: 192486

SEQ ID NO: 563541 - RNA, 65 nt, Homo Sapiens; identical to SEQ ID NO: 192487

SEQ ID NO: 563542 - RNA, 65 nt, Homo Sapiens; identical to SEQ ID NO: 192488

SEQ ID NO: 563543 - RNA, 65 nt, Homo Sapiens; identical to SEQ ID NO: 192489

SEQ ID NO: 563544 - RNA, 65 nt, Homo Sapiens; identical to SEQ ID NO: 192490

SEQ ID NO: 563545 - RNA, 65 nt, Homo Sapiens; identical to SEQ ID NO: 192491

SEQ ID NO: 563546 - RNA, 65 nt, Homo Sapiens; identical to SEQ ID NO: 192492

SEQ ID NO: 563547 - RNA, 65 nt, Homo Sapiens; identical to SEQ ID NO: 192493

SEQ ID NO: 563548 - RNA, 65 nt, Homo Sapiens; identical to SEQ ID NO: 192494

SEQ ID NO: 563549 - RNA, 65 nt, Homo Sapiens; identical to SEQ ID NO: 192495

SEQ ID NO: 563550 - RNA, 65 nt, Homo Sapiens; identical to SEQ ID NO: 192496

SEQ ID NO: 563551 - RNA, 65 nt, Homo Sapiens; identical to SEQ ID NO: 192497

SEQ ID NO: 563552 - RNA, 65 nt, Homo Sapiens; identical to SEQ ID NO: 192498

SEQ ID NO: 563553 - RNA, 65 nt, Homo Sapiens; identical to SEQ ID NO: 192499

SEQ ID NO: 563554 - RNA, 65 nt, Homo Sapiens; identical to SEQ ID NO: 192500

SEQ ID NO: 563555 - RNA, 65 nt, Homo Sapiens; identical to SEQ ID NO: 192501

SEQ ID NO: 563556 - RNA, 65 nt, Homo Sapiens; identical to SEQ ID NO: 192502

SEQ ID NO: 563557 - RNA, 65 nt, Homo Sapiens; identical to SEQ ID NO: 192503

SEQ ID NO: 563558 - RNA, 65 nt, Homo Sapiens; identical to SEQ ID NO: 192504

SEQ ID NO: 563559 - RNA, 65 nt, Homo Sapiens; identical to SEQ ID NO: 192505

SEQ ID NO: 563560 - RNA, 65 nt, Homo Sapiens; identical to SEQ ID NO: 192506

SEQ ID NO: 563561 - RNA, 65 nt, Homo Sapiens; identical to SEQ ID NO: 192507

SEQ ID NO: 563562 - RNA, 65 nt, Homo Sapiens; identical to SEQ ID NO: 192508

SEQ ID NO: 563563 - RNA, 65 nt, Homo Sapiens; identical to SEQ ID NO: 192509

SEQ ID NO: 563564 - RNA, 65 nt, Homo Sapiens; identical to SEQ ID NO: 192510

SEQ ID NO: 563565 - RNA, 65 nt, Homo Sapiens; identical to SEQ ID NO: 192511

SEQ ID NO: 563566 - RNA, 65 nt, Homo Sapiens; identical to SEQ ID NO: 192512

SEQ ID NO: 563567 - RNA, 65 nt, Homo Sapiens; identical to SEQ ID NO: 192513

SEQ ID NO: 563568 - RNA, 65 nt, Homo Sapiens; identical to SEQ ID NO: 192514

SEQ ID NO: 563569 - RNA, 65 nt, Homo Sapiens; identical to SEQ ID NO: 192515

SEQ ID NO: 563570 - RNA, 65 nt, Homo Sapiens; identical to SEQ ID NO: 192516

SEQ ID NO: 563571 - RNA, 65 nt, Homo Sapiens; identical to SEQ ID NO: 192517

SEQ ID NO: 563572 - RNA, 65 nt, Homo Sapiens; identical to SEQ ID NO: 192518

SEQ ID NO: 563573 - RNA, 65 nt, Homo Sapiens; identical to SEQ ID NO: 192519

SEQ ID NO: 563574 - RNA, 65 nt, Homo Sapiens; identical to SEQ ID NO: 192520

SEQ ID NO: 563575 - RNA, 65 nt, Homo Sapiens; identical to SEQ ID NO: 192521

SEQ ID NO: 563576 - RNA, 65 nt, Homo Sapiens; identical to SEQ ID NO: 192522

SEQ ID NO: 563577 - RNA, 65 nt, Homo Sapiens; identical to SEQ ID NO: 192523

SEQ ID NO: 563578 - RNA, 65 nt, Homo Sapiens; identical to SEQ ID NO: 192524

SEQ ID NO: 563579 - RNA, 65 nt, Homo Sapiens; identical to SEQ ID NO: 192525

SEQ ID NO: 563580 - RNA, 65 nt, Homo Sapiens; identical to SEQ ID NO: 192526

SEQ ID NO: 563581 - RNA, 65 nt, Homo Sapiens; identical to SEQ ID NO: 192527

SEQ ID NO: 563582 - RNA, 65 nt, Homo Sapiens; identical to SEQ ID NO: 192528

SEQ ID NO: 563583 - RNA, 65 nt, Homo Sapiens; identical to SEQ ID NO: 192529

SEQ ID NO: 563584 - RNA, 65 nt, Homo Sapiens; identical to SEQ ID NO: 192530

SEQ ID NO: 563585 - RNA, 65 nt, Homo Sapiens; identical to SEQ ID NO: 192531

SEQ ID NO: 563586 - RNA, 53 nt, Homo Sapiens; identical to SEQ ID NO: 192532

SEQ ID NO: 563587 - RNA, 65 nt, Homo Sapiens; identical to SEQ ID NO: 192533

SEQ ID NO: 563588 - RNA, 65 nt, Homo Sapiens; identical to SEQ ID NO: 192534

SEQ ID NO: 563589 - RNA, 65 nt, Homo Sapiens; identical to SEQ ID NO: 192535

SEQ ID NO: 563590 - RNA, 65 nt, Homo Sapiens; identical to SEQ ID NO: 192536

SEQ ID NO: 563591 - RNA, 65 nt, Homo Sapiens; identical to SEQ ID NO: 192537

SEQ ID NO: 563592 - RNA, 65 nt, Homo Sapiens; identical to SEQ ID NO: 192538

SEQ ID NO: 563593 - RNA, 65 nt, Homo Sapiens; identical to SEQ ID NO: 192539

SEQ ID NO: 563594 - RNA, 65 nt, Homo Sapiens; identical to SEQ ID NO: 192540

SEQ ID NO: 563595 - RNA, 65 nt, Homo Sapiens; identical to SEQ ID NO: 192541

SEQ ID NO: 563596 - RNA, 65 nt, Homo Sapiens; identical to SEQ ID NO: 192542

SEQ ID NO: 563597 - RNA, 65 nt, Homo Sapiens; identical to SEQ ID NO: 192543

SEQ ID NO: 563598 - RNA, 65 nt, Homo Sapiens; identical to SEQ ID NO: 192544

SEQ ID NO: 563599 - RNA, 65 nt, Homo Sapiens; identical to SEQ ID NO: 192545

SEQ ID NO: 563600 - RNA, 65 nt, Homo Sapiens; identical to SEQ ID NO: 192546

SEQ ID NO: 563601 - RNA, 65 nt, Homo Sapiens; identical to SEQ ID NO: 192547

SEQ ID NO: 563602 - RNA, 65 nt, Homo Sapiens; identical to SEQ ID NO: 192548

SEQ ID NO: 563603 - RNA, 65 nt, Homo Sapiens; identical to SEQ ID NO: 192549

SEQ ID NO: 563604 - RNA, 65 nt, Homo Sapiens; identical to SEQ ID NO: 192550

SEQ ID NO: 563605 - RNA, 65 nt, Homo Sapiens; identical to SEQ ID NO: 192551

SEQ ID NO: 563606 - RNA, 65 nt, Homo Sapiens; identical to SEQ ID NO: 192552

SEQ ID NO: 563607 - RNA, 65 nt, Homo Sapiens; identical to SEQ ID NO: 192553

SEQ ID NO: 563608 - RNA, 65 nt, Homo Sapiens; identical to SEQ ID NO: 192554

SEQ ID NO: 563609 - RNA, 65 nt, Homo Sapiens; identical to SEQ ID NO: 192555

SEQ ID NO: 563610 - RNA, 65 nt, Homo Sapiens; identical to SEQ ID NO: 192556

SEQ ID NO: 563611 - RNA, 65 nt, Homo Sapiens; identical to SEQ ID NO: 192557

SEQ ID NO: 563612 - RNA, 65 nt, Homo Sapiens; identical to SEQ ID NO: 192558

SEQ ID NO: 563613 - RNA, 65 nt, Homo Sapiens; identical to SEQ ID NO: 192559

SEQ ID NO: 563614 - RNA, 65 nt, Homo Sapiens; identical to SEQ ID NO: 192560

SEQ ID NO: 563615 - RNA, 65 nt, Homo Sapiens; identical to SEQ ID NO: 192561

SEQ ID NO: 563616 - RNA, 65 nt, Homo Sapiens; identical to SEQ ID NO: 192562

SEQ ID NO: 563617 - RNA, 65 nt, Homo Sapiens; identical to SEQ ID NO: 192563

SEQ ID NO: 563618 - RNA, 65 nt, Homo Sapiens; identical to SEQ ID NO: 192564

SEQ ID NO: 563619 - RNA, 65 nt, Homo Sapiens; identical to SEQ ID NO: 192565

SEQ ID NO: 563620 - RNA, 65 nt, Homo Sapiens; identical to SEQ ID NO: 192566

SEQ ID NO: 563621 - RNA, 65 nt, Homo Sapiens; identical to SEQ ID NO: 192567

SEQ ID NO: 563622 - RNA, 65 nt, Homo Sapiens; identical to SEQ ID NO: 192568

SEQ ID NO: 563623 - RNA, 65 nt, Homo Sapiens; identical to SEQ ID NO: 192569

SEQ ID NO: 563624 - RNA, 65 nt, Homo Sapiens; identical to SEQ ID NO: 192570

SEQ ID NO: 563625 - RNA, 65 nt, Homo Sapiens; identical to SEQ ID NO: 192571

SEQ ID NO: 563626 - RNA, 65 nt, Homo Sapiens; identical to SEQ ID NO: 192572

SEQ ID NO: 563627 - RNA, 65 nt, Homo Sapiens; identical to SEQ ID NO: 192573

SEQ ID NO: 563628 - RNA, 65 nt, Homo Sapiens; identical to SEQ ID NO: 192574

SEQ ID NO: 563629 - RNA, 65 nt, Homo Sapiens; identical to SEQ ID NO: 192575

SEQ ID NO: 563630 - RNA, 65 nt, Homo Sapiens; identical to SEQ ID NO: 192576

SEQ ID NO: 563631 - RNA, 65 nt, Homo Sapiens; identical to SEQ ID NO: 192577

SEQ ID NO: 563632 - RNA, 65 nt, Homo Sapiens; identical to SEQ ID NO: 192578

SEQ ID NO: 563633 - RNA, 65 nt, Homo Sapiens; identical to SEQ ID NO: 192579

SEQ ID NO: 563634 - RNA, 65 nt, Homo Sapiens; identical to SEQ ID NO: 192580

SEQ ID NO: 563635 - RNA, 65 nt, Homo Sapiens; identical to SEQ ID NO: 192581

SEQ ID NO: 563636 - RNA, 65 nt, Homo Sapiens; identical to SEQ ID NO: 192582

SEQ ID NO: 563637 - RNA, 65 nt, Homo Sapiens; identical to SEQ ID NO: 192583

SEQ ID NO: 563638 - RNA, 65 nt, Homo Sapiens; identical to SEQ ID NO: 192584

SEQ ID NO: 563639 - RNA, 65 nt, Homo Sapiens; identical to SEQ ID NO: 192585

SEQ ID NO: 563640 - RNA, 65 nt, Homo Sapiens; identical to SEQ ID NO: 192586

SEQ ID NO: 563641 - RNA, 65 nt, Homo Sapiens; identical to SEQ ID NO: 192587

SEQ ID NO: 563642 - RNA, 65 nt, Homo Sapiens; identical to SEQ ID NO: 192588

SEQ ID NO: 563643 - RNA, 65 nt, Homo Sapiens; identical to SEQ ID NO: 192589

SEQ ID NO: 563644 - RNA, 65 nt, Homo Sapiens; identical to SEQ ID NO: 192590

SEQ ID NO: 563645 - RNA, 65 nt, Homo Sapiens; identical to SEQ ID NO: 192591

SEQ ID NO: 563646 - RNA, 65 nt, Homo Sapiens; identical to SEQ ID NO: 192592

SEQ ID NO: 563647 - RNA, 65 nt, Homo Sapiens; identical to SEQ ID NO: 192593

SEQ ID NO: 563648 - RNA, 65 nt, Homo Sapiens; identical to SEQ ID NO: 192594

SEQ ID NO: 563649 - RNA, 65 nt, Homo Sapiens; identical to SEQ ID NO: 192595

SEQ ID NO: 563650 - RNA, 65 nt, Homo Sapiens; identical to SEQ ID NO: 192596

SEQ ID NO: 563651 - RNA, 65 nt, Homo Sapiens; identical to SEQ ID NO: 192597

SEQ ID NO: 563652 - RNA, 65 nt, Homo Sapiens; identical to SEQ ID NO: 192598

SEQ ID NO: 563653 - RNA, 65 nt, Homo Sapiens; identical to SEQ ID NO: 192599

SEQ ID NO: 563654 - RNA, 65 nt, Homo Sapiens; identical to SEQ ID NO: 192600

SEQ ID NO: 563655 - RNA, 65 nt, Homo Sapiens; identical to SEQ ID NO: 192601

SEQ ID NO: 563656 - RNA, 65 nt, Homo Sapiens; identical to SEQ ID NO: 192602

SEQ ID NO: 563657 - RNA, 65 nt, Homo Sapiens; identical to SEQ ID NO: 192603

SEQ ID NO: 563658 - RNA, 65 nt, Homo Sapiens; identical to SEQ ID NO: 192604

SEQ ID NO: 563659 - RNA, 65 nt, Homo Sapiens; identical to SEQ ID NO: 192605

SEQ ID NO: 563660 - RNA, 65 nt, Homo Sapiens; identical to SEQ ID NO: 192606

SEQ ID NO: 563661 - RNA, 65 nt, Homo Sapiens; identical to SEQ ID NO: 192607

SEQ ID NO: 563662 - RNA, 65 nt, Homo Sapiens; identical to SEQ ID NO: 192608

SEQ ID NO: 563663 - RNA, 65 nt, Homo Sapiens; identical to SEQ ID NO: 192609

SEQ ID NO: 563664 - RNA, 65 nt, Homo Sapiens; identical to SEQ ID NO: 192610

SEQ ID NO: 563665 - RNA, 65 nt, Homo Sapiens; identical to SEQ ID NO: 192611

SEQ ID NO: 563666 - RNA, 65 nt, Homo Sapiens; identical to SEQ ID NO: 192612

SEQ ID NO: 563667 - RNA, 65 nt, Homo Sapiens; identical to SEQ ID NO: 192613

SEQ ID NO: 563668 - RNA, 65 nt, Homo Sapiens; identical to SEQ ID NO: 192614

SEQ ID NO: 563669 - RNA, 65 nt, Homo Sapiens; identical to SEQ ID NO: 192615

SEQ ID NO: 563670 - RNA, 65 nt, Homo Sapiens; identical to SEQ ID NO: 192616

SEQ ID NO: 563671 - RNA, 65 nt, Homo Sapiens; identical to SEQ ID NO: 192617

SEQ ID NO: 563672 - RNA, 65 nt, Homo Sapiens; identical to SEQ ID NO: 192618

SEQ ID NO: 563673 - RNA, 65 nt, Homo Sapiens; identical to SEQ ID NO: 192619

SEQ ID NO: 563674 - RNA, 65 nt, Homo Sapiens; identical to SEQ ID NO: 192620

SEQ ID NO: 563675 - RNA, 65 nt, Homo Sapiens; identical to SEQ ID NO: 192621

SEQ ID NO: 563676 - RNA, 65 nt, Homo Sapiens; identical to SEQ ID NO: 192622

SEQ ID NO: 563677 - RNA, 65 nt, Homo Sapiens; identical to SEQ ID NO: 192623

SEQ ID NO: 563678 - RNA, 65 nt, Homo Sapiens; identical to SEQ ID NO: 192624

SEQ ID NO: 563679 - RNA, 65 nt, Homo Sapiens; identical to SEQ ID NO: 192625

SEQ ID NO: 563680 - RNA, 65 nt, Homo Sapiens; identical to SEQ ID NO: 192626

SEQ ID NO: 563681 - RNA, 65 nt, Homo Sapiens; identical to SEQ ID NO: 192627

SEQ ID NO: 563682 - RNA, 65 nt, Homo Sapiens; identical to SEQ ID NO: 192628

SEQ ID NO: 563683 - RNA, 65 nt, Homo Sapiens; identical to SEQ ID NO: 192629

SEQ ID NO: 563684 - RNA, 65 nt, Homo Sapiens; identical to SEQ ID NO: 192630

SEQ ID NO: 563685 - RNA, 65 nt, Homo Sapiens; identical to SEQ ID NO: 192631

SEQ ID NO: 563686 - RNA, 65 nt, Homo Sapiens; identical to SEQ ID NO: 192632

SEQ ID NO: 563687 - RNA, 65 nt, Homo Sapiens; identical to SEQ ID NO: 192633

SEQ ID NO: 563688 - RNA, 65 nt, Homo Sapiens; identical to SEQ ID NO: 192634

SEQ ID NO: 563689 - RNA, 65 nt, Homo Sapiens; identical to SEQ ID NO: 192635

SEQ ID NO: 563690 - RNA, 65 nt, Homo Sapiens; identical to SEQ ID NO: 192636

SEQ ID NO: 563691 - RNA, 65 nt, Homo Sapiens; identical to SEQ ID NO: 192637

SEQ ID NO: 563692 - RNA, 65 nt, Homo Sapiens; identical to SEQ ID NO: 192638

SEQ ID NO: 563693 - RNA, 65 nt, Homo Sapiens; identical to SEQ ID NO: 192639

SEQ ID NO: 563694 - RNA, 65 nt, Homo Sapiens; identical to SEQ ID NO: 192640

SEQ ID NO: 563695 - RNA, 65 nt, Homo Sapiens; identical to SEQ ID NO: 192641

SEQ ID NO: 563696 - RNA, 65 nt, Homo Sapiens; identical to SEQ ID NO: 192642

SEQ ID NO: 563697 - RNA, 65 nt, Homo Sapiens; identical to SEQ ID NO: 192643

SEQ ID NO: 563698 - RNA, 65 nt, Homo Sapiens; identical to SEQ ID NO: 192644

SEQ ID NO: 563699 - RNA, 65 nt, Homo Sapiens; identical to SEQ ID NO: 192645

SEQ ID NO: 563700 - RNA, 65 nt, Homo Sapiens; identical to SEQ ID NO: 192646

SEQ ID NO: 563701 - RNA, 65 nt, Homo Sapiens; identical to SEQ ID NO: 192647

SEQ ID NO: 563702 - RNA, 65 nt, Homo Sapiens; identical to SEQ ID NO: 192648

SEQ ID NO: 563703 - RNA, 65 nt, Homo Sapiens; identical to SEQ ID NO: 192649

SEQ ID NO: 563704 - RNA, 51 nt, Homo Sapiens; identical to SEQ ID NO: 192650

SEQ ID NO: 563705 - RNA, 65 nt, Homo Sapiens; identical to SEQ ID NO: 192651

SEQ ID NO: 563706 - RNA, 65 nt, Homo Sapiens; identical to SEQ ID NO: 192652

SEQ ID NO: 563707 - RNA, 65 nt, Homo Sapiens; identical to SEQ ID NO: 192653

SEQ ID NO: 563708 - RNA, 65 nt, Homo Sapiens; identical to SEQ ID NO: 192654

SEQ ID NO: 563709 - RNA, 65 nt, Homo Sapiens; identical to SEQ ID NO: 192655

SEQ ID NO: 563710 - RNA, 65 nt, Homo Sapiens; identical to SEQ ID NO: 192656

SEQ ID NO: 563711 - RNA, 65 nt, Homo Sapiens; identical to SEQ ID NO: 192657

SEQ ID NO: 563712 - RNA, 65 nt, Homo Sapiens; identical to SEQ ID NO: 192658

SEQ ID NO: 563713 - RNA, 65 nt, Homo Sapiens; identical to SEQ ID NO: 192659

SEQ ID NO: 563714 - RNA, 65 nt, Homo Sapiens; identical to SEQ ID NO: 192660

SEQ ID NO: 563715 - RNA, 65 nt, Homo Sapiens; identical to SEQ ID NO: 192661

SEQ ID NO: 563716 - RNA, 65 nt, Homo Sapiens; identical to SEQ ID NO: 192662

SEQ ID NO: 563717 - RNA, 65 nt, Homo Sapiens; identical to SEQ ID NO: 192663

SEQ ID NO: 563718 - RNA, 65 nt, Homo Sapiens; identical to SEQ ID NO: 192664

SEQ ID NO: 563719 - RNA, 65 nt, Homo Sapiens; identical to SEQ ID NO: 192665

SEQ ID NO: 563720 - RNA, 65 nt, Homo Sapiens; identical to SEQ ID NO: 192666

SEQ ID NO: 563721 - RNA, 65 nt, Homo Sapiens; identical to SEQ ID NO: 192667

SEQ ID NO: 563722 - RNA, 65 nt, Homo Sapiens; identical to SEQ ID NO: 192668

SEQ ID NO: 563723 - RNA, 65 nt, Homo Sapiens; identical to SEQ ID NO: 192669

SEQ ID NO: 563724 - RNA, 65 nt, Homo Sapiens; identical to SEQ ID NO: 192670

SEQ ID NO: 563725 - RNA, 65 nt, Homo Sapiens; identical to SEQ ID NO: 192671

SEQ ID NO: 563726 - RNA, 65 nt, Homo Sapiens; identical to SEQ ID NO: 192672

SEQ ID NO: 563727 - RNA, 65 nt, Homo Sapiens; identical to SEQ ID NO: 192673

SEQ ID NO: 563728 - RNA, 65 nt, Homo Sapiens; identical to SEQ ID NO: 192674

SEQ ID NO: 563729 - RNA, 65 nt, Homo Sapiens; identical to SEQ ID NO: 192675

SEQ ID NO: 563730 - RNA, 65 nt, Homo Sapiens; identical to SEQ ID NO: 192676

SEQ ID NO: 563731 - RNA, 65 nt, Homo Sapiens; identical to SEQ ID NO: 192677

SEQ ID NO: 563732 - RNA, 65 nt, Homo Sapiens; identical to SEQ ID NO: 192678

SEQ ID NO: 563733 - RNA, 65 nt, Homo Sapiens; identical to SEQ ID NO: 192679

SEQ ID NO: 563734 - RNA, 65 nt, Homo Sapiens; identical to SEQ ID NO: 192680

SEQ ID NO: 563735 - RNA, 64 nt, Homo Sapiens; identical to SEQ ID NO: 138762

SEQ ID NO: 563736 - RNA, 64 nt, Homo Sapiens; identical to SEQ ID NO: 138763

SEQ ID NO: 563737 - RNA, 64 nt, Homo Sapiens; identical to SEQ ID NO: 138764

SEQ ID NO: 563738 - RNA, 64 nt, Homo Sapiens; identical to SEQ ID NO: 138765

SEQ ID NO: 563739 - RNA, 64 nt, Homo Sapiens
uaucuuggguacuugagcagacgguauauuccagaggugggaggugggaggggaagggagaaau

SEQ ID NO: 563740 - RNA, 64 nt, Homo Sapiens
gguacuugagcagacgguauauuccagaggugggaggugggaggggaagggagaaauccaaaac

SEQ ID NO: 563741 - RNA, 64 nt, Homo Sapiens
ccucaacaccucugcacaagcugcacccucaggcaggugggauggauuuccagccaaagccucc

SEQ ID NO: 563742 - RNA, 64 nt, Homo Sapiens
agugugccugaagucccagauacuuggggggcugaggugggaggaucucuugagccugggaggu

SEQ ID NO: 563743 - RNA, 64 nt, Homo Sapiens
cucacgccuguaauccuagcacuuugggaggccaaggugggaggauugcuugagcucaggaguu

SEQ ID NO: 563744 - RNA, 64 nt, Homo Sapiens
cggguggguggucuuuuggagaaguuucccugaaaggugggaggcccugugugcuagugucugg

SEQ ID NO: 563745 - RNA, 64 nt, Homo Sapiens
ugauuggaggccauggccuagggugagaacugagaggugggagacaacccaaugcgaaguauuu

SEQ ID NO: 563746 - RNA, 64 nt, Homo Sapiens
ugugcaucuauagucccugcuauuugagaggcugaggugggaggaucauuugagugcaggaguu

SEQ ID NO: 563747 - RNA, 64 nt, Homo Sapiens
cacaccccuguagucccagcuacuugggaggcugaggugggaggauugcuugaacccaagaggu

SEQ ID NO: 563748 - RNA, 64 nt, Homo Sapiens
cacaugccuguaguuccagcuacucaggaggcugaggugggagaaucuccugagccuggaaggu

SEQ ID NO: 563749 - RNA, 64 nt, Homo Sapiens
acgagcauacuuguaccuuugucucugggcaaacaggugggacuguuagugacccauuugggaa

SEQ ID NO: 563750 - RNA, 64 nt, Homo Sapiens
cccugcagggcagggaccccuugggaaaucgaggaggugggacgggcugggcccugugucccag

SEQ ID NO: 563751 - RNA, 64 nt, Homo Sapiens
aucacuugagcccaggagguuacucaggaggcugaggugggaaacaugugccuguggucccagc

SEQ ID NO: 563752 - RNA, 64 nt, Homo Sapiens
cauuacaagacuuugggcucuuugaauuugggagaggugggauucagagggagcccaugggcug

SEQ ID NO: 563753 - RNA, 64 nt, Homo Sapiens
gggcaggacuuucccuuccaugaggcaaggugggaggugggaugggguauguugagaaacaucc

SEQ ID NO: 563754 - RNA, 64 nt, Homo Sapiens
ugggauggggcaggacuuucaacauccugaggcaaggugggaggcaugaagggguauguugaga

SEQ ID NO: 563755 - RNA, 64 nt, Homo Sapiens
cucacaccuguaauccaagcacuuugggaggccaaggugggagcaucacuugauccugggaguu

SEQ ID NO: 563756 - RNA, 64 nt, Homo Sapiens
uguguuccuguagucccagcuccccaggaggcugaggugggagguuggcuuuaacccaggaggc

SEQ ID NO: 563757 - RNA, 64 nt, Homo Sapiens
gaguucaggagaggguucuggaccacagauguugaggugggagucauuagugaauagaugaugu

SEQ ID NO: 563758 - RNA, 64 nt, Homo Sapiens
ccuaugcuuguagucacagcuacucgggaggccgaggugggagggucuucugagcccagggagg

SEQ ID NO: 563759 - RNA, 64 nt, Homo Sapiens
cucacagcuauaaucucagcacuuugggaggcugaggugggagaauugccugagcccaggaguu

SEQ ID NO: 563760 - RNA, 64 nt, Homo Sapiens
cacacaucuguggucccaggugcucaggaagcugaggugggaggaucacuugagcccaauucaa

SEQ ID NO: 563761 - RNA, 64 nt, Homo Sapiens
agggaaguuuuuucauuuugggaauuuaguccccaggugggacaguguuauggcaguggaggug

SEQ ID NO: 563762 - RNA, 64 nt, Homo Sapiens
uuaguccccaggugggacaauguuauggcaguggaggugggaauuuuuuauuuuguuucucuag

SEQ ID NO: 563763 - RNA, 64 nt, Homo Sapiens
guuucaaauuucccugauccgguaccagguggccaggugggacugacuuagaacggggggaggg

SEQ ID NO: 563764 - RNA, 64 nt, Homo Sapiens
acugcaaccugacgcgaugccagaccccagcgucaggugggaguaggcccuugguguuuuacca

SEQ ID NO: 563765 - RNA, 64 nt, Homo Sapiens
acugcaaccugacacaaugccugauccgugugugaggugggaguacaacccugguguuacacaa

SEQ ID NO: 563766 - RNA, 64 nt, Homo Sapiens
acugcaaccugacaggaugccggaucccaaagucaggugggaguaggcccuugguguuauacaa

SEQ ID NO: 563767 - RNA, 64 nt, Homo Sapiens
auugcuugggcccaggaauuuacucaggaggcugaggugggagaugcacacuuguagucccagc

SEQ ID NO: 563768 - RNA, 64 nt, Homo Sapiens
aucgcuugaggccaggaguuacuuugggaggucgaggugggaggcucacaccuguaaucccagc

SEQ ID NO: 563769 - RNA, 64 nt, Homo Sapiens
cccaccuagugccccagacugagcucuccaggccaggugggaacggcugauguggacugucuuu

SEQ ID NO: 563770 - RNA, 64 nt, Homo Sapiens
ggugcuaaagccaaccagccuuuggguccugggcaggugggagcugaaaaggaucgaggcaugg

SEQ ID NO: 563771 - RNA, 64 nt, Homo Sapiens
gagagaauagagcugccacugggcaccugcgcacaggugggaggaaagggccuggccaguccug

SEQ ID NO: 563772 - RNA, 64 nt, Homo Sapiens
auugccugagcucaggaguuacuuugggaggccaaggugggaagcucaugccuguaauccuaac

SEQ ID NO: 563773 - RNA, 64 nt, Homo Sapiens
uuguuauaaggucuuuaaacuagauucuuuugcuaggugggagaaugcuucccaccuuaccuuu

SEQ ID NO: 563774 - RNA, 64 nt, Homo Sapiens
uuuggauuugaauguggacugugaagaauuuugcaggugggagaaauuaagggacuggagagag

SEQ ID NO: 563775 - RNA, 64 nt, Homo Sapiens
ugugaacuccaauuaagggaucgguggcuggugaaggugggagaugccccuuuuucccaccgau

SEQ ID NO: 563776 - RNA, 64 nt, Homo Sapiens
cccagcagacgagacagcaaagaccaaggccuggaggugggagcgucugccccagugaggaggc

SEQ ID NO: 563777 - RNA, 64 nt, Homo Sapiens
ugucuccacccccuuccauguguugaauaauaaaaggugggaaagugcugucacgaggagcucc

SEQ ID NO: 563778 - RNA, 64 nt, Homo Sapiens
uuugcugagcaaggagaaccugagugugagguugaggugggacagggaaccuguauaaggguau

SEQ ID NO: 563779 - RNA, 64 nt, Homo Sapiens
agguaaagcaacucagcugcacugcguaagagccaggugggauauaacuucucacuuggaacag

SEQ ID NO: 563780 - RNA, 64 nt, Homo Sapiens
guucaagugauucuccugccucagccucccaaguaggugggauuacaggcgcccgccaccacgc

SEQ ID NO: 563781 - RNA, 64 nt, Homo Sapiens
aagcugcuuugaugcauggcuauaaucccagccgaggugggaggaucacuugaguccagguuca

SEQ ID NO: 563782 - RNA, 64 nt, Homo Sapiens
ucuugcucuccuggucacugaguguuuugaagggaggugggagcuuagugcccgggaugggcac

SEQ ID NO: 563783 - RNA, 64 nt, Homo Sapiens
aggaguacacggugcggaucaucugugcgacugaaggugggaagggcaggaggcgggagcccgg

SEQ ID NO: 563784 - RNA, 64 nt, Homo Sapiens
ccgugggcuuugguuuuauaguagaggagucaggaggugggaggucccuuuccucacccaguug

SEQ ID NO: 563785 - RNA, 64 nt, Homo Sapiens
gccuguccacacccuggauccucugcuucuugccaggugggaggcucagccuuggguggcuugu

SEQ ID NO: 563786 - RNA, 64 nt, Homo Sapiens
gugguuggagauagaaaggcuuauuuuaauauggaggugggagugggagagauaauagguguga

SEQ ID NO: 563787 - RNA, 64 nt, Homo Sapiens
cccagauuuccucccuuugcuugcucagccuuucaggugggaaacugaagggccuugggguagu

SEQ ID NO: 563788 - RNA, 64 nt, Homo Sapiens
ggauggggcucuucugucugcuggaaagguauggaggugggagagguggcagaggugggaugag

SEQ ID NO: 563789 - RNA, 64 nt, Homo Sapiens
agcuggaaagguauggagguuguuuugguggcagaggugggaugcccucugaccccgcgaugag

SEQ ID NO: 563790 - RNA, 64 nt, Homo Sapiens
aucgcuugagcccaugaggcuacuauggagguugaggugggaggugugugccuguagucccagc

SEQ ID NO: 563791 - RNA, 64 nt, Homo Sapiens
aucgcuugagcccaggaguuacuuuaggaggccaaggugggaggcucacucuuguaaucccaaa

SEQ ID NO: 563792 - RNA, 64 nt, Homo Sapiens
caccccggugagggggugugccccccgucacuccaggugggagcccagugcuccuugucaagcu

SEQ ID NO: 563793 - RNA, 64 nt, Homo Sapiens
agccccacagcccccuccucggacagaaggcggcaggugggacgggaagugucaugcaagugcu

SEQ ID NO: 563794 - RNA, 64 nt, Homo Sapiens
cugacuaucaccccuaaucucugacagauagaggaggugggaccccuagaucaccacuggauug

SEQ ID NO: 563795 - RNA, 64 nt, Homo Sapiens
gccacggcaggcagcgagcagcgggcuccuaaugaggugggaaagcaucuccccaccgagagaa

SEQ ID NO: 563796 - RNA, 64 nt, Homo Sapiens
cuccauggccucagaggaaguagcucugauuuugaggugggagacgcuuccucaagaagaggau

SEQ ID NO: 563797 - RNA, 64 nt, Homo Sapiens
uugauucucagcacuuggggggcacgcugugggcaggugggagcauccagggaugccaucugug

SEQ ID NO: 563798 - RNA, 64 nt, Homo Sapiens
ucccuaugcugccuaggcuguuuugguuuuuaugaggugggauaggccagaggcuuguuuuguc

SEQ ID NO: 563799 - RNA, 64 nt, Homo Sapiens
auugagcaccuacuauaugcagaaggggaggccgaggugggaggaucauuggaucucaggaguu

SEQ ID NO: 563800 - RNA, 64 nt, Homo Sapiens
ugggugcuuguaguuccagcuacucaggaggcugaggugggaggaugacuugaacgcaggaggc

SEQ ID NO: 563801 - RNA, 64 nt, Homo Sapiens
ggcuagaccaggucccugccgguccaccaggcggaggugggacaaagguccuaacaggagucac

SEQ ID NO: 563802 - RNA, 64 nt, Homo Sapiens
cccuugcgggucccccaggaagccaggugaccccaggugggaggcuguguguggaggccauccu

SEQ ID NO: 563803 - RNA, 64 nt, Homo Sapiens
caacacccuucugauggaagacccuucugauggaaggugggagcgauggaaggugggagccaac

SEQ ID NO: 563804 - RNA, 64 nt, Homo Sapiens; identical to SEQ ID NO: 563803

SEQ ID NO: 563805 - RNA, 64 nt, Homo Sapiens; identical to SEQ ID NO: 563803

SEQ ID NO: 563806 - RNA, 64 nt, Homo Sapiens; identical to SEQ ID NO: 563803

SEQ ID NO: 563807 - RNA, 64 nt, Homo Sapiens
caacacccuucugauggaagcaucuucugauggaaggugggagcuucagguuucccugggccag

SEQ ID NO: 563808 - RNA, 64 nt, Homo Sapiens
aucacuugagccuaugagguugugguuccagcugaggugggaggauuagccggguuccaucacc

SEQ ID NO: 563809 - RNA, 64 nt, Homo Sapiens
cguucccgcugcucacugcgacaucccugaacccaggugggaccccuggcuguagagaagggcu

SEQ ID NO: 563810 - RNA, 64 nt, Homo Sapiens
gcuccccuguaagcugggugagcuacugaagccaaggugggaggcagcugacaacaccacccac

SEQ ID NO: 563811 - RNA, 64 nt, Homo Sapiens
cauggaaugaaacaggggagugagggacacaaggaggugggaagugggagggucccagccccac

SEQ ID NO: 563812 - RNA, 64 nt, Homo Sapiens
cucacacauggaaucccagcacuuugggaggccgaggugggaggaucacuugagcccaggaguu

SEQ ID NO: 563813 - RNA, 64 nt, Homo Sapiens
cacacaucaguagucccagcuacucugcaggcugaggugggaggauugcuugaacccaggaggu

SEQ ID NO: 563814 - RNA, 64 nt, Homo Sapiens
cuucaacuaaagaauaugaaggguagacuccaggaggugggauuuucccaaugucaaguuauua

SEQ ID NO: 563815 - RNA, 64 nt, Homo Sapiens
auggugcucuuuaagcgugaagccaaggcuguucaggugggaccuuuagguuccccuggacucc

SEQ ID NO: 563816 - RNA, 64 nt, Homo Sapiens
ugcuuucauguccuguuucacaauuuuugaauuuaggugggauugguuucacugacguuuuccu

SEQ ID NO: 563817 - RNA, 64 nt, Homo Sapiens
ccgucuucugggggcgggggcccaggaagguucuaggugggaccugggguggggcuggcauccu

SEQ ID NO: 563818 - RNA, 64 nt, Homo Sapiens
auaacauuacuuggaggguucauaacauuaauaccuaaguaaaccugauacauaccuaaguaaa

SEQ ID NO: 563819 - RNA, 64 nt, Homo Sapiens
auaacauuaauaccuaaguaccucugauacauaccuaaguaaacaucugcuuuggaaauuauug

SEQ ID NO: 563820 - RNA, 64 nt, Homo Sapiens
augaauccugauuucuagugaccuuacauuuuuucuaaguaacaauucugauuaagcuuacuuu

SEQ ID NO: 563821 - RNA, 64 nt, Homo Sapiens
gggaaauaauucuguauuucucuacuaccaacaacuaaguaauucauuuuuucagauucuuauu

SEQ ID NO: 563822 - RNA, 64 nt, Homo Sapiens
cucucaguuucuugguaucuaguggaagguuucacuaaguaaaaauauuugacuuuucauaagu

SEQ ID NO: 563823 - RNA, 64 nt, Homo Sapiens
aucugaguuucuugguaucuaguggaagguuucacuaaguaaagguauuugacuuuucauaagu

SEQ ID NO: 563824 - RNA, 64 nt, Homo Sapiens
aaauuccuauugaucaaaacagaauuuacuugugcuaaguaauauuucugauccuggccccuaa

SEQ ID NO: 563825 - RNA, 64 nt, Homo Sapiens
uuucuucugcugaaguuuuagguuggccuaaggacuaaguaauucaugacacugcaguuaaauu

SEQ ID NO: 563826 - RNA, 64 nt, Homo Sapiens; identical to SEQ ID NO: 361526

SEQ ID NO: 563827 - RNA, 64 nt, Homo Sapiens; identical to SEQ ID NO: 361527

SEQ ID NO: 563828 - RNA, 64 nt, Homo Sapiens; identical to SEQ ID NO: 361528

SEQ ID NO: 563829 - RNA, 64 nt, Homo Sapiens; identical to SEQ ID NO: 361529

SEQ ID NO: 563830 - RNA, 64 nt, Homo Sapiens; identical to SEQ ID NO: 361530

SEQ ID NO: 563831 - RNA, 64 nt, Homo Sapiens; identical to SEQ ID NO: 361531

SEQ ID NO: 563832 - RNA, 64 nt, Homo Sapiens; identical to SEQ ID NO: 361532

SEQ ID NO: 563833 - RNA, 64 nt, Homo Sapiens; identical to SEQ ID NO: 361533

SEQ ID NO: 563834 - RNA, 64 nt, Homo Sapiens; identical to SEQ ID NO: 361534

SEQ ID NO: 563835 - RNA, 64 nt, Homo Sapiens; identical to SEQ ID NO: 361535

SEQ ID NO: 563836 - RNA, 64 nt, Homo Sapiens; identical to SEQ ID NO: 326578

SEQ ID NO: 563837 - RNA, 64 nt, Homo Sapiens; identical to SEQ ID NO: 326579

SEQ ID NO: 563838 - RNA, 64 nt, Homo Sapiens; identical to SEQ ID NO: 326580

SEQ ID NO: 563839 - RNA, 64 nt, Homo Sapiens; identical to SEQ ID NO: 326581

SEQ ID NO: 563840 - RNA, 64 nt, Homo Sapiens; identical to SEQ ID NO: 326582

SEQ ID NO: 563841 - RNA, 64 nt, Homo Sapiens; identical to SEQ ID NO: 326583

SEQ ID NO: 563842 - RNA, 64 nt, Homo Sapiens; identical to SEQ ID NO: 326584

SEQ ID NO: 563843 - RNA, 64 nt, Homo Sapiens; identical to SEQ ID NO: 326585

SEQ ID NO: 563844 - RNA, 64 nt, Homo Sapiens; identical to SEQ ID NO: 326586

SEQ ID NO: 563845 - RNA, 64 nt, Homo Sapiens; identical to SEQ ID NO: 326587

SEQ ID NO: 563846 - RNA, 64 nt, Homo Sapiens; identical to SEQ ID NO: 326588

SEQ ID NO: 563847 - RNA, 64 nt, Homo Sapiens; identical to SEQ ID NO: 326589

SEQ ID NO: 563848 - RNA, 64 nt, Homo Sapiens; identical to SEQ ID NO: 326590

SEQ ID NO: 563849 - RNA, 64 nt, Homo Sapiens; identical to SEQ ID NO: 326591

SEQ ID NO: 563850 - RNA, 64 nt, Homo Sapiens
ggagcugaaccagggagcuagcaaaaguaaagcagacuuauaaaauuauagcuaugugcagcug

SEQ ID NO: 563851 - RNA, 64 nt, Homo Sapiens
aauaauucaccuauauguguuugagguugugacagacuuauaaaaucuuuuuaaaaaauaaagc

SEQ ID NO: 563852 - RNA, 64 nt, Homo Sapiens; identical to SEQ ID NO: 291360

SEQ ID NO: 563853 - RNA, 64 nt, Homo Sapiens; identical to SEQ ID NO: 291361

SEQ ID NO: 563854 - RNA, 64 nt, Homo Sapiens; identical to SEQ ID NO: 291362

SEQ ID NO: 563855 - RNA, 64 nt, Homo Sapiens; identical to SEQ ID NO: 291363

SEQ ID NO: 563856 - RNA, 64 nt, Homo Sapiens; identical to SEQ ID NO: 291364

SEQ ID NO: 563857 - RNA, 64 nt, Homo Sapiens; identical to SEQ ID NO: 291365

SEQ ID NO: 563858 - RNA, 64 nt, Homo Sapiens; identical to SEQ ID NO: 291366

SEQ ID NO: 563859 - RNA, 64 nt, Homo Sapiens; identical to SEQ ID NO: 291367

SEQ ID NO: 563860 - RNA, 64 nt, Homo Sapiens; identical to SEQ ID NO: 291368

SEQ ID NO: 563861 - RNA, 64 nt, Homo Sapiens; identical to SEQ ID NO: 291369

SEQ ID NO: 563862 - RNA, 64 nt, Homo Sapiens; identical to SEQ ID NO: 291370

SEQ ID NO: 563863 - RNA, 64 nt, Homo Sapiens; identical to SEQ ID NO: 291371

SEQ ID NO: 563864 - RNA, 64 nt, Homo Sapiens; identical to SEQ ID NO: 291372

SEQ ID NO: 563865 - RNA, 64 nt, Homo Sapiens; identical to SEQ ID NO: 291373

SEQ ID NO: 563866 - RNA, 64 nt, Homo Sapiens; identical to SEQ ID NO: 291374

SEQ ID NO: 563867 - RNA, 64 nt, Homo Sapiens; identical to SEQ ID NO: 291375

SEQ ID NO: 563868 - RNA, 64 nt, Homo Sapiens; identical to SEQ ID NO: 291376

SEQ ID NO: 563869 - RNA, 64 nt, Homo Sapiens; identical to SEQ ID NO: 291377

SEQ ID NO: 563870 - RNA, 64 nt, Homo Sapiens; identical to SEQ ID NO: 291378

SEQ ID NO: 563871 - RNA, 64 nt, Homo Sapiens; identical to SEQ ID NO: 59936

SEQ ID NO: 563872 - RNA, 64 nt, Homo Sapiens; identical to SEQ ID NO: 59937

SEQ ID NO: 563873 - RNA, 64 nt, Homo Sapiens; identical to SEQ ID NO: 59938

SEQ ID NO: 563874 - RNA, 64 nt, Homo Sapiens; identical to SEQ ID NO: 59939

SEQ ID NO: 563875 - RNA, 64 nt, Homo Sapiens; identical to SEQ ID NO: 59940

SEQ ID NO: 563876 - RNA, 64 nt, Homo Sapiens; identical to SEQ ID NO: 59941

SEQ ID NO: 563877 - RNA, 64 nt, Homo Sapiens; identical to SEQ ID NO: 59942

SEQ ID NO: 563878 - RNA, 64 nt, Homo Sapiens; identical to SEQ ID NO: 59943

SEQ ID NO: 563879 - RNA, 64 nt, Homo Sapiens; identical to SEQ ID NO: 59944

SEQ ID NO: 563880 - RNA, 64 nt, Homo Sapiens; identical to SEQ ID NO: 59945

SEQ ID NO: 563881 - RNA, 64 nt, Homo Sapiens; identical to SEQ ID NO: 59946

SEQ ID NO: 563882 - RNA, 64 nt, Homo Sapiens; identical to SEQ ID NO: 59947

SEQ ID NO: 563883 - RNA, 64 nt, Homo Sapiens; identical to SEQ ID NO: 59948

SEQ ID NO: 563884 - RNA, 64 nt, Homo Sapiens; identical to SEQ ID NO: 59949

SEQ ID NO: 563885 - RNA, 64 nt, Homo Sapiens; identical to SEQ ID NO: 59950

SEQ ID NO: 563886 - RNA, 64 nt, Homo Sapiens; identical to SEQ ID NO: 59951

SEQ ID NO: 563887 - RNA, 64 nt, Homo Sapiens; identical to SEQ ID NO: 59952

SEQ ID NO: 563888 - RNA, 64 nt, Homo Sapiens; identical to SEQ ID NO: 59953

SEQ ID NO: 563889 - RNA, 64 nt, Homo Sapiens; identical to SEQ ID NO: 59954

SEQ ID NO: 563890 - RNA, 64 nt, Homo Sapiens; identical to SEQ ID NO: 59955

SEQ ID NO: 563891 - RNA, 64 nt, Homo Sapiens
gacgagggacagggguuucacuccguuuugcaaaguggaggaggggcuuccaagagaaaggagg

SEQ ID NO: 563892 - RNA, 64 nt, Homo Sapiens
gaaggaaagcugggacaagcgcauccucccugggguggaggaugcuccauucuggccagucccu

SEQ ID NO: 563893 - RNA, 64 nt, Homo Sapiens
ccaaauauuuuagguguaauucauauguauuugaguggaggauuuuuuuucucauuuuucuagu

SEQ ID NO: 563894 - RNA, 64 nt, Homo Sapiens
aguguuaaauuuuaaccagcauuaacaugguagaguggaggagugaguguguucaaagaucaac

SEQ ID NO: 563895 - RNA, 64 nt, Homo Sapiens
cuccugggacaggucucuuuagcugaccggcucgguggaggacaguaacaggaaaaccacccac

SEQ ID NO: 563896 - RNA, 64 nt, Homo Sapiens
gaaaagcccuucuccuugcccaggccuuugaaaaguggaggaaauuguagucacagaguggcug

SEQ ID NO: 563897 - RNA, 64 nt, Homo Sapiens
aauagaauggugguuaucaagggcugguggggcaguggaggauugaggagauauuggucaaaau

SEQ ID NO: 563898 - RNA, 64 nt, Homo Sapiens
aggcugaggcaggagaauugcuugaacgcgggagguggaggauacaaugaacccgaggucgcgc

SEQ ID NO: 563899 - RNA, 64 nt, Homo Sapiens
uuccucugguuaauucucaucuguuauaguugcuguggaggaaggaggacuggaugaggauguc

SEQ ID NO: 563900 - RNA, 64 nt, Homo Sapiens
aggccauucuggaugccauggcgaguucuugagaguggaggagcgcaggaguuugauaagcuuc

SEQ ID NO: 563901 - RNA, 64 nt, Homo Sapiens
gcagaggagaacaacuaguuccaaaacagugaacguggaggaugaagaugcugcguggaggaac

SEQ ID NO: 563902 - RNA, 64 nt, Homo Sapiens
ccaaaacagugaacguggaggaugaagaugcugcguggaggaacaugcaauuuuauucaauaua

SEQ ID NO: 563903 - RNA, 64 nt, Homo Sapiens
accuacaauucaguuaggcuagagacagaugcugguggaggaagggcugggccaccagggauca

SEQ ID NO: 563904 - RNA, 64 nt, Homo Sapiens
gugaggacucuuuccgacugcccagaaaguggggguggaggaccgaggcuacagcuccacacgc

SEQ ID NO: 563905 - RNA, 64 nt, Homo Sapiens
gagcuucucggagcccccucgcugggagagggcuguggaggaaguguggaggacagcaguggcu

SEQ ID NO: 563906 - RNA, 64 nt, Homo Sapiens
gcaguggcugcugggagaggccagaggugccuuuguggaggacagaucacaggaaguggaggag

SEQ ID NO: 563907 - RNA, 64 nt, Homo Sapiens
cagaggugccuuuguggagguuggaucacaggaaguggaggagcugcugcucuucccccaccau

SEQ ID NO: 563908 - RNA, 64 nt, Homo Sapiens
uuugcaaguaggcuuugaggggugaaggagauugguggaggagaguaaauaaucuagaggcaag

SEQ ID NO: 563909 - RNA, 64 nt, Homo Sapiens
agcucacugccuauaagaggaaauaagagagaaaguggaggagagggacaaaaggaguaauuau

SEQ ID NO: 563910 - RNA, 64 nt, Homo Sapiens
gacaaggucccuacucuuguggaguuuacuucugguggaggagacagaugauaaguaaacaaau

SEQ ID NO: 563911 - RNA, 64 nt, Homo Sapiens
uuuaauuuuugcuagauugauauuaaaaacucauguggaggaacucaaggaauguuuagaagac

SEQ ID NO: 563912 - RNA, 64 nt, Homo Sapiens
ggggguacagacuuccuucuaauuuuaagagauaguggaggagaaaauacaaaauggacuaaau

SEQ ID NO: 563913 - RNA, 64 nt, Homo Sapiens
uaauucaaugggagauaguaacaccaagacucuaguggaggaauagacagaaguauugagagaa

SEQ ID NO: 563914 - RNA, 64 nt, Homo Sapiens
uggugcugccuuggagggcugggggaaggaguguguggaggagggaggagggugaagacugagg

SEQ ID NO: 563915 - RNA, 64 nt, Homo Sapiens
uggcugggaacauugcaucccaaagagcuucucaguggaggaggcuggggaaggcaugaggggg

SEQ ID NO: 563916 - RNA, 64 nt, Homo Sapiens
aagauguucgucagccaauucccacaaacugcugguggaggaaguuggcagaaacgugaugugu

SEQ ID NO: 563917 - RNA, 64 nt, Homo Sapiens
gcgcgccgccccgagcuggacaaaugaauccagcguggaggaaggcugcccucccucccacaaa

SEQ ID NO: 563918 - RNA, 64 nt, Homo Sapiens
uuggaaugaaauuccuccuuccccccaucucugaguggaggaagcccaccaaucugcccuuugc

SEQ ID NO: 563919 - RNA, 64 nt, Homo Sapiens
ugccauagggucugcagccugcuggggcuaagcgguggaggaaggcucugucacuccaggcaua

SEQ ID NO: 563920 - RNA, 64 nt, Homo Sapiens
agaccagugguccuuccucucccaauguggccauguggaggacaggaugucuuccuggggguug

SEQ ID NO: 563921 - RNA, 64 nt, Homo Sapiens
ccugacucuguguuguaauuucaggggagcaucaguggaggaggcagugggggcagcagcagcc

SEQ ID NO: 563922 - RNA, 64 nt, Homo Sapiens
aauugaaaaccaggaccauaagaccagugccaguguggaggauuugugucaauucaguuuccuu

SEQ ID NO: 563923 - RNA, 64 nt, Homo Sapiens
ugaaguacugugaauuuuuaccaaguacuuuuaaguggaggaaaauuaaaugaguaaaggaagc

SEQ ID NO: 563924 - RNA, 64 nt, Homo Sapiens
gucuacucugucucugcugcuagagaagccaccuguggaggacugggcugugguugggccugag

SEQ ID NO: 563925 - RNA, 64 nt, Homo Sapiens
guggaggacugggcugugguugggccugaggccuguggaggaggugaguguagccagcagcggc

SEQ ID NO: 563926 - RNA, 64 nt, Homo Sapiens
cuuccacagggauuuucaggaaaggcagaagcucguggaggaugggcaucugagguggcccugc

SEQ ID NO: 563927 - RNA, 64 nt, Homo Sapiens
uucucccccaucuucuuaagaagcaggggggcagguggaggagagugaggggagagcugcccgg

SEQ ID NO: 563928 - RNA, 64 nt, Homo Sapiens
ugaggccaucggcugucucugcauuucauuggcuguggaggagagacuccuaggauggcugcug

SEQ ID NO: 563929 - RNA, 64 nt, Homo Sapiens
gagagggagaguuuucaagguuuauggcaacuuuguggaggaccuggguaacucuuacccuugg

SEQ ID NO: 563930 - RNA, 64 nt, Homo Sapiens; identical to SEQ ID NO: 517844

SEQ ID NO: 563931 - RNA, 64 nt, Homo Sapiens; identical to SEQ ID NO: 517845

SEQ ID NO: 563932 - RNA, 64 nt, Homo Sapiens; identical to SEQ ID NO: 517846

SEQ ID NO: 563933 - RNA, 64 nt, Homo Sapiens; identical to SEQ ID NO: 517847

SEQ ID NO: 563934 - RNA, 64 nt, Homo Sapiens; identical to SEQ ID NO: 517848

SEQ ID NO: 563935 - RNA, 64 nt, Homo Sapiens; identical to SEQ ID NO: 517849

SEQ ID NO: 563936 - RNA, 64 nt, Homo Sapiens; identical to SEQ ID NO: 517850

SEQ ID NO: 563937 - RNA, 64 nt, Homo Sapiens; identical to SEQ ID NO: 517851

SEQ ID NO: 563938 - RNA, 64 nt, Homo Sapiens
cagccaguuuguuaugucuuaauauguuaggauuuauccucagucuuacguuaauguaauuauu

SEQ ID NO: 563939 - RNA, 64 nt, Homo Sapiens
cauuuuccucaagaaugucuguaccuauugacuguauccucaugacagacuuguaaccuggcau

SEQ ID NO: 563940 - RNA, 64 nt, Homo Sapiens
acacccacccacccccaagugcaugucuccaucacuuaaaaaguaaguuccauuugaaaauauc

SEQ ID NO: 563941 - RNA, 64 nt, Homo Sapiens
auuuuuaauuaagaaaggguaguuugguagucuacuuaaaaauguuucugggaaauucacuaga

SEQ ID NO: 563942 - RNA, 64 nt, Homo Sapiens
aaccacgaguaagauauuauuuaaauguugaaaucuuaaaaaccugccuccaagauuucagaag

SEQ ID NO: 563943 - RNA, 64 nt, Homo Sapiens
ggucauguaacagguaaccacaauuuucagguuucuuaaaaacagcuguaacuaacucaggauu

SEQ ID NO: 563944 - RNA, 64 nt, Homo Sapiens
uauacuucauuuuacaauacauauucccuuuuaacuuaaaaaaauuguaaaugugggagaaaaa

SEQ ID NO: 563945 - RNA, 64 nt, Homo Sapiens
auuaauuuacaaugucccugauauugagcuaacucuuaaaaaaaccaaacaaaacucguaucug

SEQ ID NO: 563946 - RNA, 64 nt, Homo Sapiens
ccugugauguaacuguaagccuucucgacuuagacuuaaaaaguggucacauagauuaauuuug

SEQ ID NO: 563947 - RNA, 64 nt, Homo Sapiens
aauuauaaauuauuuuuggauugcugagcugaaucuuaaaaagccaaguugauauacauaguca

SEQ ID NO: 563948 - RNA, 64 nt, Homo Sapiens
uaaagucaguaugaacuauaauaaauaucuguagcuuaaaaaguagguucacauguacagguaa

SEQ ID NO: 563949 - RNA, 64 nt, Homo Sapiens
ucuguucauagaguuguauaauaaaacaugauugcuuaaaaacuuguauaguugucuagauuuc

SEQ ID NO: 563950 - RNA, 64 nt, Homo Sapiens
gaggauucaacacauauuuugagcaagacccugucuuaaaaaaagcacuccagccugggugaca

SEQ ID NO: 563951 - RNA, 64 nt, Homo Sapiens
cuuaauaaaucugccauuucuuguaacuugauggcuuaaaaauauuaagaccccuaauagccuu

SEQ ID NO: 563952 - RNA, 64 nt, Homo Sapiens
uuguaaaugcugucaacuauaagugugguagggacuuaaaaaaccauacuucuucauucaauac

SEQ ID NO: 563953 - RNA, 64 nt, Homo Sapiens
ugacagauguugaaugcccauaaaaauauuauaacuuaaaaaaaguuuagaggaaaaaaaugac

SEQ ID NO: 563954 - RNA, 64 nt, Homo Sapiens
gguugagcaccagaaucucauuuauaaauguuggcuuaaaaagauuuuucuauuuggaaaagac

SEQ ID NO: 563955 - RNA, 64 nt, Homo Sapiens
ucauuguucuacaaguaaauguuuggaguauuuucuuaaaaaauuaggauugcuaaaauagaaa

SEQ ID NO: 563956 - RNA, 64 nt, Homo Sapiens
uuuuuguuguuaugcauugacucauuuccaugugcuuaaaaaugccaaaaaucagguuaguagg

SEQ ID NO: 563957 - RNA, 64 nt, Homo Sapiens
guuuccucaaugacuuagauggaaucuaaaccagcuuaaaaacagacuucauuuguauacauuu

SEQ ID NO: 563958 - RNA, 64 nt, Homo Sapiens
gucuuacacuggauaaaaguucauaaaaauaaagcuuaaaaauuaugagggaaucugaaauguu

SEQ ID NO: 563959 - RNA, 64 nt, Homo Sapiens
caaaaaucaaaaagaggaaaauuaaaagugcccucuuaaaaauaguuucaaacacaacuugaaa

SEQ ID NO: 563960 - RNA, 64 nt, Homo Sapiens
agccauauuaaaauuuugaaaauauaguuaucuucuuaaaaaccauuauaacaauucagagaga

SEQ ID NO: 563961 - RNA, 64 nt, Homo Sapiens
caaaaguaaacuuauuuuauuauacagauuauuucuuaaaaacucuauuuauaccuuaacauga

SEQ ID NO: 563962 - RNA, 64 nt, Homo Sapiens
agaauaaaaauaugccuuuagucauuugguuuuucuuaaaaaguugagauucuuaaucugacuu

SEQ ID NO: 563963 - RNA, 64 nt, Homo Sapiens
uuccaaacuuucagcagugauauuauuuccauaacuuaaaaagugaguuugaaaaagaaaaucu

SEQ ID NO: 563964 - RNA, 64 nt, Homo Sapiens
gaagcuauuauuaacuacugcaagcuaagccgagcuuaaaaaugccuuuuguuuuaaaugggcu

SEQ ID NO: 563965 - RNA, 64 nt, Homo Sapiens
acacuuggaugucucgcuucacaauaaaacacagcuuaaaaauaaaauaacugaaagaaauaga

SEQ ID NO: 563966 - RNA, 64 nt, Homo Sapiens
aaaaagaauaaaagauuuucuauaagcaauugcccuuaaaaauuaaauuccuaaaaggaaacug

SEQ ID NO: 563967 - RNA, 64 nt, Homo Sapiens
cacauacaaacaaaacucuuauacagggguuggacuuaaaaacaucugcuuuuuaacaauuugu

SEQ ID NO: 563968 - RNA, 64 nt, Homo Sapiens
aagaugguuuaaucacuaccuuccuauaaaauuccuuaaaaauauaaugauggugcuaaaauuc

SEQ ID NO: 563969 - RNA, 64 nt, Homo Sapiens
aaaaaacguuucucacugucucuuuaaggagaaucuuaaaaaaauguguaacuauaauagagac

SEQ ID NO: 563970 - RNA, 64 nt, Homo Sapiens
auugagaagaaaaacucaauuuuguuuccgugcacuuaaaaauacgugacacucauuuuagugc

SEQ ID NO: 563971 - RNA, 64 nt, Homo Sapiens
ugcuaauucucagaaaggcaaagaacuggcuuuacuuaaaaauauauuuuacugaggaugaucg

SEQ ID NO: 563972 - RNA, 64 nt, Homo Sapiens
aaaaaacuguuuuugcauaggguaguacuaagaucuuaaaaagugguaacugucuugaagaaaa

SEQ ID NO: 563973 - RNA, 64 nt, Homo Sapiens
ucaguucuuaucugaauuccaaaauaaaccugugcuuaaaaaagaaauaauugaccaaguaagu

SEQ ID NO: 563974 - RNA, 64 nt, Homo Sapiens
aaaguaugcagguagcaaagauguaauaaauuugcuuaaaaaaagaaauuaaaguuuuauuuag

SEQ ID NO: 563975 - RNA, 64 nt, Homo Sapiens
cuagaggauagagcugcaucacuuaaauucaugacuuaaaaaauaauacaguuuauauacaacu

SEQ ID NO: 563976 - RNA, 64 nt, Homo Sapiens
uuacgccacccaauguauagccaaauuguacgugcuuaaaaaacagugccgagaguauguucag

SEQ ID NO: 563977 - RNA, 64 nt, Homo Sapiens
cggccaucacaaccacucacugagaguugcccuucuuaaaaauguauuuuauuuuagccagugg

SEQ ID NO: 563978 - RNA, 64 nt, Homo Sapiens
agaccagccugggcaacacagcgagaccccaucucuuaaaaaauaacagacuugaggaaccccu

SEQ ID NO: 563979 - RNA, 64 nt, Homo Sapiens
aacccagaucagaagaucugugcggacucuaacacuuaaaaaaacagggauguuuuguuuagcu

SEQ ID NO: 563980 - RNA, 64 nt, Homo Sapiens
acacauuagcuuauaguccucuauuacuugguagcuuaaaaacauuuucuguugccacugcaac

SEQ ID NO: 563981 - RNA, 64 nt, Homo Sapiens
uacuuaaauggcuaaguuuauuuggagggaauaacuuaaaaaaaaagaaaagcucccucaguuu

SEQ ID NO: 563982 - RNA, 64 nt, Homo Sapiens
gaguugauguccuuauagguaacaauagucuaaccuuaaaaauuccuuuuucuucaguaaaccc

SEQ ID NO: 563983 - RNA, 64 nt, Homo Sapiens
gauccuaugagagaagagaguauggugcuggguccuuaaaaaaaaaaaugauacuugguccuua

SEQ ID NO: 563984 - RNA, 64 nt, Homo Sapiens
gcuggguccuuaaaaaaaaaaaugauacuugguccuuaaaaaauaugcucuccccucccuuuuu

SEQ ID NO: 563985 - RNA, 64 nt, Homo Sapiens
aaaguuguaucuugacacaggaaaugggaaaaaacuuaaaaauuaauaugguguauuuuuccaa

SEQ ID NO: 563986 - RNA, 64 nt, Homo Sapiens
gucauuuggugcucugcuaaccauuuauauaaaacuuaaaaacaagagaaaagaaaaaucaauu

SEQ ID NO: 563987 - RNA, 64 nt, Homo Sapiens
aucuguggauucaaccaaccaaggacggaaaaugcuuaaaaaauaauacaacaacaacaaaaaa

SEQ ID NO: 563988 - RNA, 64 nt, Homo Sapiens
caagucauuuuuguauuuuucaucuuuaagaaugcuuaaaaaagcuaaucccuaaaauaguuag

SEQ ID NO: 563989 - RNA, 64 nt, Homo Sapiens
acuuuccaagguuauuucugaauguaacaauuuccuuaaaaaugacuuauccaauuucuguauu

SEQ ID NO: 563990 - RNA, 64 nt, Homo Sapiens
uguagcuaaacuaauuuugcaaaucaaacagacacuuaaaaaacuagcauauguaaagguauuc

SEQ ID NO: 563991 - RNA, 64 nt, Homo Sapiens
uguuuucaaugacaguaagcuacaaaucaugaugcuuaaaaacuuucuaaagaugaauugugug

SEQ ID NO: 563992 - RNA, 64 nt, Homo Sapiens
uguaucauauuuaucacaugaccacuuuugauuccuuaaaaagacauuacaggcuuaaauucca

SEQ ID NO: 563993 - RNA, 64 nt, Homo Sapiens
uauuaacuggcacauauguacuaaaaaccccucacuuaaaaauggcagucucaauccuacuguc

SEQ ID NO: 563994 - RNA, 64 nt, Homo Sapiens
gaaacguuguuacugaugaguaccacagacucaucuuaaaaaaaacucucauuauggugaucau

SEQ ID NO: 563995 - RNA, 64 nt, Homo Sapiens
aaauugaaagcuugcuguacaaaggcaacagcaacuuaaaaaagaaaaucuggacaauagaugu

SEQ ID NO: 563996 - RNA, 64 nt, Homo Sapiens
auugaagauucaucccauacuucuauauaccaugcuuaaaaaucacgucauucuuuaaacaaaa

SEQ ID NO: 563997 - RNA, 64 nt, Homo Sapiens
auacugucugugaaauaauguaagaagcuuuucacuuaaaaaaaaugcauuacuuucacuuaac

SEQ ID NO: 563998 - RNA, 64 nt, Homo Sapiens
uguucuuuuauuuuuaauuauuauuuccccgucccuuaaaaagacaaaaaaaauaaggcaaaag

SEQ ID NO: 563999 - RNA, 64 nt, Homo Sapiens
aaucuauaugggauguaauuuuuuuguucagucucuuaaaaaauacuuuguuuugguacauuug

SEQ ID NO: 564000 - RNA, 64 nt, Homo Sapiens
uaaaaagcuaaagcugccaaauuucuguugaacucuuaaaaacagcucauguuuguuuguccuc

SEQ ID NO: 564001 - RNA, 64 nt, Homo Sapiens
auauuuaaauaacuuauuuuucuccauugcuguucuuaaaaacauuguaaguagcuguaauaua

SEQ ID NO: 564002 - RNA, 64 nt, Homo Sapiens
uucauuuaaauaaaauuuuaacauggcucaauaacuuaaaaacgaaaauuaauguuuucccuua

SEQ ID NO: 564003 - RNA, 64 nt, Homo Sapiens
gaauauaucaguauuuagaaccugauguggucugcuuaaaaaauuugauuuauaccauuauuaa

SEQ ID NO: 564004 - RNA, 64 nt, Homo Sapiens
uuucuuuuucuuaauggaagaagauauuuaauaucuuaaaaauauuccaaguuaggaagaacac

SEQ ID NO: 564005 - RNA, 64 nt, Homo Sapiens
uuaucagccugggcaacacagugagacuccaucucuuaaaaaaaaaauuagcuggguauagugg

SEQ ID NO: 564006 - RNA, 64 nt, Homo Sapiens
cuuccuaaguauaaaugguugucuguuuuuguaacuuaaaaaaaaaaaaaaaaguuuggccggg

SEQ ID NO: 564007 - RNA, 64 nt, Homo Sapiens
ugcacuccggccugaugacagagcgagauuccgucuuaaaaaaaaaaaaaaaaaaguuuguuuu

SEQ ID NO: 564008 - RNA, 64 nt, Homo Sapiens
gcagugagcuaugauugcaccacuguacuccugccuuaaaaaaaaaaaaaaaaucccaauaguc

SEQ ID NO: 564009 - RNA, 64 nt, Homo Sapiens
aauaccccccaacuuuuuuagagacagccugucucuuaaaaaaaaaauuaauuugguagugaga

SEQ ID NO: 564010 - RNA, 64 nt, Homo Sapiens
ggaauaauugccccuuugcagagaaaaaaaaaaacuuaaaaaaagcacaugccuacugcugccu

SEQ ID NO: 564011 - RNA, 64 nt, Homo Sapiens
aaugaauugugccuaguggagaaccucuauagaucuuaaaaaaugaauuauucuuuagcagugu

SEQ ID NO: 564012 - RNA, 64 nt, Homo Sapiens
acuaaaaagaaaaaaagaaguuuuaagacucugucuuaaaaaaaaaaaagagccugggcaauuu

SEQ ID NO: 564013 - RNA, 64 nt, Homo Sapiens
gagccugggcaauuuuuuuaguuuuuuuaagacucuuaaaaaaagcacuccagccugggcaaga

SEQ ID NO: 564014 - RNA, 64 nt, Homo Sapiens
uguucacauuacaugaaaguuuucaguagaagaacuuaaaaauugacaucugaacauauucagu

SEQ ID NO: 564015 - RNA, 64 nt, Homo Sapiens
ugugcaaucaccccugccuuuauguauaggagcucuuaaaaaacggaaaauaguccccaucuaa

SEQ ID NO: 564016 - RNA, 64 nt, Homo Sapiens
acauaauucucauucacgcaaauauaaguaucuccuuaaaaagauuuuuaaugcuuaggggaag

SEQ ID NO: 564017 - RNA, 64 nt, Homo Sapiens
auuuuaaguauauccuuuaaucuauuuuccucugcuuaaaaaaauugucauugguaaauaguag

SEQ ID NO: 564018 - RNA, 64 nt, Homo Sapiens
ccugcccaaaaugugaagcuuuaaaaaauuuauacuuaaaaaauuuuuaaaauaaaauaaguuc

SEQ ID NO: 564019 - RNA, 64 nt, Homo Sapiens
uuauacuuaaaaaauccugcaaauaaaauaaguucuuaaaaaauaaccuguucuuccuuuuuua

SEQ ID NO: 564020 - RNA, 64 nt, Homo Sapiens
aauaaaaugcuuuuucuacuauuugucuugauuacuuaaaaaaauaaaaauauaaguaaggauc

SEQ ID NO: 564021 - RNA, 64 nt, Homo Sapiens
ugaauugugaaauggauguuuaagaaaauauaggcuuaaaaaguaaaucuauaaaaugaugucu

SEQ ID NO: 564022 - RNA, 64 nt, Homo Sapiens
gugcaauccaugauuuauacucagaaucgacauucuuaaaaaguuauuucaagggauggcauaa

SEQ ID NO: 564023 - RNA, 64 nt, Homo Sapiens
gcaguuuggggguaaagcauuuuggaggaauaaccuuaaaaaguuaaaaagucauuguaauaac

SEQ ID NO: 564024 - RNA, 64 nt, Homo Sapiens
cugucaguaucaaugcuuagagaaauauccuuuccuuaaaaagaaaauaacuuuuauauuuaga

SEQ ID NO: 564025 - RNA, 64 nt, Homo Sapiens
aaucacaucauauauaugugguguuguacccauucuuaaaaauaauauugugcuuuauguggua

SEQ ID NO: 564026 - RNA, 64 nt, Homo Sapiens
cacuaggucaauguuuuucaauggcugaucaaaacuuaaaaacaaguuuaaguggcuugauuaa

SEQ ID NO: 564027 - RNA, 64 nt, Homo Sapiens
auuauuuauaaauugaauuauggucuuacacauccuuaaaaauguuuaaaccccuuacacucuu

SEQ ID NO: 564028 - RNA, 64 nt, Homo Sapiens
acucauggugaggcuuaacaaaaucauggcuaagcuuaaaaaaaugaggagugaacauuugggu

SEQ ID NO: 564029 - RNA, 64 nt, Homo Sapiens
cugcauuacauuccuugauaucauuugcgcacaacuuaaaaagucaugaccagaagggaaacag

SEQ ID NO: 564030 - RNA, 64 nt, Homo Sapiens
aaaaaauugcucuuggcuguauaaaguuuuuuuccuuaaaaaaaaaguuccuaggaaaaaagga

SEQ ID NO: 564031 - RNA, 64 nt, Homo Sapiens
uuuuuucuguaccuaacuugauucuauugacuuucuuaaaaauagucaaaacuugcaauauaac

SEQ ID NO: 564032 - RNA, 64 nt, Homo Sapiens
uguugcugacaaacuuaucccaaaacuuuaguggcuuaaaaaaaccugcccccaacuguuaguc

SEQ ID NO: 564033 - RNA, 64 nt, Homo Sapiens
cccacguauauuauguagucuauuugcaacuguucuuaaaaaaaugacauuaaaagaauaguuu

SEQ ID NO: 564034 - RNA, 64 nt, Homo Sapiens
guuuuaggaaaauauuugguaguuaauguauaugcuuaaaaacaaauuaagaguugaccuuuua

SEQ ID NO: 564035 - RNA, 64 nt, Homo Sapiens
caaggaaaaaagacugccuuauuuaagaauuuaucuuaaaaaugcgaguucugcugaucaggaa

SEQ ID NO: 564036 - RNA, 64 nt, Homo Sapiens
ccccguuuacauguaggcagcuugcuuugaaaaacuuaaaaagcauagcuucccuuccggaaag

SEQ ID NO: 564037 - RNA, 64 nt, Homo Sapiens
caaacacaaaaagaugagucguuuugucucaaaacuuaaaaaaauuuaaaaaugugacuuucuu

SEQ ID NO: 564038 - RNA, 64 nt, Homo Sapiens
accaagguccucagacugcuuuuagcaucugcaacuuaaaaaaaugggaguuagaaaaagaaca

SEQ ID NO: 564039 - RNA, 64 nt, Homo Sapiens
guuauuuagugacaaacguggcuuucaaacuaugcuuaaaaaguuccggcuggacacgguggcu

SEQ ID NO: 564040 - RNA, 64 nt, Homo Sapiens
uuuuuaauuaaauaguuaaaauaauguagugcaacuuaaaaauaucuauggcuuuguuuuuguu

SEQ ID NO: 564041 - RNA, 64 nt, Homo Sapiens
ccagagcuuuauuaagaagcauuucuuuucuucccuuaaaaaauagaugcuuauuuuuauugac

SEQ ID NO: 564042 - RNA, 64 nt, Homo Sapiens
caucacaccuaaagacaugggaugaauaacaacacuuaaaaacuauauauuacuuguaagguau

SEQ ID NO: 564043 - RNA, 64 nt, Homo Sapiens
ggcauuuaguaaccuuaauuaaacuauauauuugcuuaaaaauuucuuucagaaggcaaauagg

SEQ ID NO: 564044 - RNA, 64 nt, Homo Sapiens
acaaacuagaauuugccuguaauguuguagaauacuuaaaaaaaaagauuuaccuuuuuaaaua

SEQ ID NO: 564045 - RNA, 64 nt, Homo Sapiens
acaugucauugaagucauaagacuuccgcugcugcuuaaaaauaaagcauguaaagguguuuaa

SEQ ID NO: 564046 - RNA, 64 nt, Homo Sapiens
uaaaauauuuuuuuccuaugaaacugaauuuguucuuaaaaaaaucacauuccacaucuguuuc

SEQ ID NO: 564047 - RNA, 64 nt, Homo Sapiens
caaauuggacagcuacuucucccaaugcucagcgcuuaaaaaaaauuuguggcaauuaaguggu

SEQ ID NO: 564048 - RNA, 64 nt, Homo Sapiens
guuaggcuugaauucauuuauaugucuuuugauucuuaaaaaaacaaaaaacauuccauuagaa

SEQ ID NO: 564049 - RNA, 64 nt, Homo Sapiens
augaauggcagguguucauuauaaucuguauugacuuaaaaaguuucuuccucaugaugcuaau

SEQ ID NO: 564050 - RNA, 64 nt, Homo Sapiens
uacaaacaguuuuguaacucuuugcuuuuuaaaucuuaaaaaaaaaaaaguugcugaaguacug

SEQ ID NO: 564051 - RNA, 64 nt, Homo Sapiens
ccgaaaaugcagggguuggcuuucugacugggaacuuaaaaaucacucuucaugcuucccuggu

SEQ ID NO: 564052 - RNA, 64 nt, Homo Sapiens
aaaaaaucauaugaucauuucucuuuuuaguucucuuaaaaaaaucacaaauucauuugucagc

SEQ ID NO: 564053 - RNA, 64 nt, Homo Sapiens
aaagucuaugaagagucuguuuaggaauugauggcuuaaaaaaaauauucuacaguggauagaa

SEQ ID NO: 564054 - RNA, 64 nt, Homo Sapiens
ccacagacacaguuaaagcaaguuaaauacagcacuuaaaaauauuugacuguaauaguauagu

SEQ ID NO: 564055 - RNA, 64 nt, Homo Sapiens
ggaucagcaugaguauagaccuugaucguuuguccuuaaaaaggguuuuccauauaccuuaggu

SEQ ID NO: 564056 - RNA, 64 nt, Homo Sapiens
uggcuaaaguaaaagggaaaaguagauccgauaacuuaaaaacguagcucaucccuuaccaucc

SEQ ID NO: 564057 - RNA, 64 nt, Homo Sapiens
aacacaguagcaccuaaaucuguuuucaauugggcuuaaaaauugacaugcaaucucuuaaguu

SEQ ID NO: 564058 - RNA, 64 nt, Homo Sapiens
caccuaguagggcaugugcauuuaaaaacuuguccuuaaaaauagaagacagaaguauuaaaau

SEQ ID NO: 564059 - RNA, 64 nt, Homo Sapiens
cuuauucucuuaacaaauuuuaaaagguagugaucuuaaaaaaaaaucacuggauaacuaggaa

SEQ ID NO: 564060 - RNA, 64 nt, Homo Sapiens
aaucauacucaaucuaggacauguuccuuuacuccuuaaaaaagaaaggaaagaucucuaaauu

SEQ ID NO: 564061 - RNA, 64 nt, Homo Sapiens
cagagcucauaguauuuguuuucugcuccgaacacuuaaaaaauacuaagacgugauagugaaa

SEQ ID NO: 564062 - RNA, 64 nt, Homo Sapiens
agaccagccugggaaacauagcaagaccccaucucuuaaaaaaaaagaaauauauagacauaua

SEQ ID NO: 564063 - RNA, 64 nt, Homo Sapiens
aaggagacuuuagcuuugcuuguaguuuuuauaccuuaaaaagacugguagcauauaaaauaaa

SEQ ID NO: 564064 - RNA, 64 nt, Homo Sapiens
gaacucagaauacagacaaguagaaagauucucgcuuaaaaaaaauguauuuauuuuauggcaa

SEQ ID NO: 564065 - RNA, 64 nt, Homo Sapiens
caauggaaucauauaguauguaaccuguuuugagcuuaaaaaaaaaguauacaugacuuuaaug

SEQ ID NO: 564066 - RNA, 64 nt, Homo Sapiens
uauggaaugauauuucauugcacuuuuaauuuaacuuaaaaaugccuucccuugacuguugaua

SEQ ID NO: 564067 - RNA, 64 nt, Homo Sapiens
aguccagccagguugacagaaugagacccugucucuuaaaaaaaaaaaaaaaaauccuggugau

SEQ ID NO: 564068 - RNA, 64 nt, Homo Sapiens
uuuacauagaucaguuguauaaaagaaaccauuucuuaaaaaauucuuaaaaaaggcucaaccc

SEQ ID NO: 564069 - RNA, 64 nt, Homo Sapiens
gcucaacccaaaagaaaccagggagaucccuuuucuuaaaaaagaucaaggccuguuugcaaag

SEQ ID NO: 564070 - RNA, 64 nt, Homo Sapiens
auuuggggggaaagaauagauauggggaaauaaacuuaaaaaaaaaucaggaauuuaaaaaaac

SEQ ID NO: 564071 - RNA, 64 nt, Homo Sapiens
ugaauucaguuucaaucaaguuuacauuauguugcuuaaaaaaauagaaauuauucuuuaucuu

SEQ ID NO: 564072 - RNA, 64 nt, Homo Sapiens
guguuuacagaugguuuauucaauacuuauaagacuuaaaaauuaaaaugcacagaaaugcaug

SEQ ID NO: 564073 - RNA, 64 nt, Homo Sapiens
uucagugugacuuuaauauuaaguuuagucacagcuuaaaaacauggugcagggcaauguuuca

SEQ ID NO: 564074 - RNA, 64 nt, Homo Sapiens
acacggcuuuuuacuuauuuguacuuucuuuaaucuuaaaaaguuuaaaaaauugacauccuuu

SEQ ID NO: 564075 - RNA, 64 nt, Homo Sapiens
ugacauccuuuguacuuucuucuuaacaugauaacuuaaaaaaugcucugauuccaucauguuu

SEQ ID NO: 564076 - RNA, 64 nt, Homo Sapiens
cccuauuucaaaaaaauaaaaauuggaagaagagcuuaaaaaagauaagauuuuaaagaguccc

SEQ ID NO: 564077 - RNA, 64 nt, Homo Sapiens
aucaagguuagcaaacuuuauacguagccuaacacuuaaaaaaugcacucauuaucuuaaaccu

SEQ ID NO: 564078 - RNA, 64 nt, Homo Sapiens
uguguaugcaucaacacaguauauguaaaacugucuuaaaaauccauuaacuucuaccuaaauc

SEQ ID NO: 564079 - RNA, 64 nt, Homo Sapiens
cuggcuuuuguuaacuugauaauucuucaucuaccuuaaaaagaaaaaaauuacacauagucau

SEQ ID NO: 564080 - RNA, 64 nt, Homo Sapiens
caggauugauguaagcacugagugcauauuuuaucuuaaaaacuauauugugguaauuguaagu

SEQ ID NO: 564081 - RNA, 64 nt, Homo Sapiens
aaauugccauguuccaaaaugugaagagagucaacuuaaaaaauuaaugaaagcccucuuuuug

SEQ ID NO: 564082 - RNA, 64 nt, Homo Sapiens
gggaauaagcuuuuugguuuaugaaauauuuuuacuuaaaaauugugagccaccacgcccggcc

SEQ ID NO: 564083 - RNA, 64 nt, Homo Sapiens
gggaauaagcucgcuuuuuuaugaaauauuuuuacuuaaaaauugugagccaccgugcccaacc

SEQ ID NO: 564084 - RNA, 64 nt, Homo Sapiens
agcaugcugcuuuuuguacugagcuuucuuugcacuuaaaaauuuuaaaagucuauuuuauuau

SEQ ID NO: 564085 - RNA, 64 nt, Homo Sapiens
uccuugauguacagauuuuagcacacgggaaagccuuaaaaauacauugucuacauagugacau

SEQ ID NO: 564086 - RNA, 64 nt, Homo Sapiens
auagugucaaaaauucagggaguuuuccaaaauacuuaaaaauauaaaaaugagaacaggugug

SEQ ID NO: 564087 - RNA, 64 nt, Homo Sapiens
auauaacacaaugugguagugagccuaccuacuucuuaaaaaacaaagcauaccuuccccaaau

SEQ ID NO: 564088 - RNA, 64 nt, Homo Sapiens
aagugacauacaauuggaaaucucuggagugagaucuauguacaaauuuucaccagucuaugua

SEQ ID NO: 564089 - RNA, 64 nt, Homo Sapiens
ucuggagugagaucuauguaagaauuuucaccagucuauguaucucuuuauguauagcucugau

SEQ ID NO: 564090 - RNA, 64 nt, Homo Sapiens
ccagcuauugguguaccuauaauuuaagaaauagucuauguaaagucacaaauuaaugaaaaaa

SEQ ID NO: 564091 - RNA, 64 nt, Homo Sapiens
uuugcaauguaaaauaaaguguuucugauuauuuucuauguaaaggaacccucuccuuuccccu

SEQ ID NO: 564092 - RNA, 64 nt, Homo Sapiens
caucuauauguguauuauguaucaauuuaccuacucuauguaugaacaauguauuugucaaugc

SEQ ID NO: 564093 - RNA, 64 nt, Homo Sapiens
uaccaucuaaucuaugcaugaucauuuauuuacaucuauguaucaauuauagacaauuugcccu

SEQ ID NO: 564094 - RNA, 64 nt, Homo Sapiens
aaauucuguacaacuuucugcagauguaaaguuuucuauguaaauggacaaaauguauauggua

SEQ ID NO: 564095 - RNA, 64 nt, Homo Sapiens
gaauuuaacguugaauauaugauguagauuuuacucuauguacaucuuuugggugguggggcuu

SEQ ID NO: 564096 - RNA, 64 nt, Homo Sapiens
guggugguuauuagggcuuuuucugaaauguguaucuauguaacaucacuuaagugugcuuaau

SEQ ID NO: 564097 - RNA, 64 nt, Homo Sapiens
augauaaggcuacaauucagaaucuucugaaccaucuauguaaugaauggggauuauacauugg

SEQ ID NO: 564098 - RNA, 64 nt, Homo Sapiens
guuguuugccuucuuauuguuggauuuugagaguucuauguacaaguccuuugucagucgugug

SEQ ID NO: 564099 - RNA, 64 nt, Homo Sapiens
caauaauuuuuggcuauucugcuuccuuuguguuucuauguaaauuuuaucaucagugugucua

SEQ ID NO: 564100 - RNA, 64 nt, Homo Sapiens
aacugagcaguuucuguguauauauagaagguagaaaugaaaagugagaaaauauuugaaaggg

SEQ ID NO: 564101 - RNA, 64 nt, Homo Sapiens
aacaaaagcaaagcauuaguggcuauggucuguaaaaugaaacaaaaaaacuuuauuucacuau

SEQ ID NO: 564102 - RNA, 64 nt, Homo Sapiens
aaucagaaaauauaauaaaauugcacaaaaaaaaaaaugaaaaagaugcagacuggucuuuuag

SEQ ID NO: 564103 - RNA, 64 nt, Homo Sapiens
aaacacagauaccacuuuaucagggaaguuagucaaaugaaauggaaauugguaaauggacaaa

SEQ ID NO: 564104 - RNA, 64 nt, Homo Sapiens
uuggaguauuuucuuuauaauuucuugaacaggcaaaugaaagcuuauuauagaaugcauguau

SEQ ID NO: 564105 - RNA, 64 nt, Homo Sapiens
ucauuuucgagggucuaaaauuaucugguaaaacaaaugaaauuaagugauccaaagcugcuga

SEQ ID NO: 564106 - RNA, 64 nt, Homo Sapiens
ggacuaaaagguuuuauugaaauaaagccucuuaaaaugaaaaaucauauacuuuuaacaucac

SEQ ID NO: 564107 - RNA, 64 nt, Homo Sapiens
auauuuggaaauaccuggauauuugcuagaggaaaaaugaaagcaaaacuucguacacagugcc

SEQ ID NO: 564108 - RNA, 64 nt, Homo Sapiens
aaaauggucaaaaaauaagucaucagcacuuaagaaaugaaagcaacuuuugaaauuuucuguu

SEQ ID NO: 564109 - RNA, 64 nt, Homo Sapiens
cagaugacuugugaaccccacaguguggaugugcaaaugaaaauugaaggaaagaauaugaacu

SEQ ID NO: 564110 - RNA, 64 nt, Homo Sapiens
uuuuuaacaaauaaaaggcauuuaaguaaaacuaaaaugaaaaaaguaggccuucugacauugu

SEQ ID NO: 564111 - RNA, 64 nt, Homo Sapiens
ugaugauaaaauuuguaucucauuaauuuuaucaaaaugaaacuaaaaguacauauguauuaua

SEQ ID NO: 564112 - RNA, 64 nt, Homo Sapiens
guaauagagaaaagauuugucaguguguuuuuuuaaaugaaauaacuagucugugcuacuuuau

SEQ ID NO: 564113 - RNA, 64 nt, Homo Sapiens
guuauaaucucuuuaggagagaagauuaucaaacaaaugaaacaaguaaaggaagaaagaaggu

SEQ ID NO: 564114 - RNA, 64 nt, Homo Sapiens
auugaccagcuuaagagaaaacuagauacugacaaaaugaaacucauaguagaaguuaagguaa

SEQ ID NO: 564115 - RNA, 64 nt, Homo Sapiens
aaaagaaaaaucaugucaucuucuauuuguacagaaaugaaaauaaaauaugaaaauaaugaaa

SEQ ID NO: 564116 - RNA, 64 nt, Homo Sapiens
cagaaaugaaaauaaaauaugaaaauaaugaaagaaaugaaaagauagcuuuuaauugugguau

SEQ ID NO: 564117 - RNA, 64 nt, Homo Sapiens
uaaauucagcuuugcuaauccagaaauuguucccaaaugaaaacuuguuuuaaguccaccccuu

SEQ ID NO: 564118 - RNA, 64 nt, Homo Sapiens
ggcuuucauacccaaggaucuguuuccuugcugaaaaugaaacccuaucuuucacuuuacauuc

SEQ ID NO: 564119 - RNA, 64 nt, Homo Sapiens
uaugucauacuuauuuuuuugaaaguuuuaagaaaaaugaaauuaguuuaggagccacgugagu

SEQ ID NO: 564120 - RNA, 64 nt, Homo Sapiens
cauuuggaaguuuaggagccgcugcagaaggacgaaaugaaaagccagcucagcuccacacaaa

SEQ ID NO: 564121 - RNA, 64 nt, Homo Sapiens
uaaaagcaaauguaaaagugacuuucaagccaacaaaugaaauuacaguuuucuuucuccaaga

SEQ ID NO: 564122 - RNA, 64 nt, Homo Sapiens
aaagaacaguuagaguaacuuacauccugggaggaaaugaaacucccuauuuaaaaaagagcag

SEQ ID NO: 564123 - RNA, 64 nt, Homo Sapiens
caggcaaccagccuagaagaauuuugagucacagaaaugaaaccgaaaaggaggagcaaaggag

SEQ ID NO: 564124 - RNA, 64 nt, Homo Sapiens
gaggagcaaaggagauuuugacuagugaccaguaaaaugaaaagggaggcugcuuccccaugac

SEQ ID NO: 564125 - RNA, 64 nt, Homo Sapiens
ugucuaaaugcuuuugucuauccauguuguagacaaaugaaauucuacuucuuaacuuguuuuu

SEQ ID NO: 564126 - RNA, 64 nt, Homo Sapiens
uauguguauauaacuuucaauugcugcauaauuuaaaugaaaccucugggacaguaauaaaaga

SEQ ID NO: 564127 - RNA, 64 nt, Homo Sapiens
ugaaaucaccaaauguaaacaagccuuuuuaugaaaaugaaaucgcaguauuggcauuguucuc

SEQ ID NO: 564128 - RNA, 64 nt, Homo Sapiens
guucacuugagggauuagucuaaauuacuggaugaaaugaaauuugaggcccagcaagcaccac

SEQ ID NO: 564129 - RNA, 64 nt, Homo Sapiens
aaucucaauuuagagguaugcagugucggugaauaaaugaaaccgcauuucauuauguguucua

SEQ ID NO: 564130 - RNA, 64 nt, Homo Sapiens
uggccaaggaaacuguccauuucucucagaaagcaaaugaaaugcuacagcuauacccagaccu

SEQ ID NO: 564131 - RNA, 64 nt, Homo Sapiens
uuuuuuuuuaauucccacuuuggcuguguacaucaaaugaaaugagaaguguguaugcugacca

SEQ ID NO: 564132 - RNA, 64 nt, Homo Sapiens
uguauuaugagaaucuuauaaucggaauggagugaaaugaaacauuuugaguacugauggcaug

SEQ ID NO: 564133 - RNA, 64 nt, Homo Sapiens
aauugccaauugauuguaacuauuauuuauuuuuaaaugaaaguguaagaaugcuuucugauuc

SEQ ID NO: 564134 - RNA, 64 nt, Homo Sapiens
aggcuuaggacucugugccaaaaaucucuauuuuaaaugaaaauauuuauauaaaaauacauuu

SEQ ID NO: 564135 - RNA, 64 nt, Homo Sapiens
uugguuguaacaaaauuugauuugaacuaccuauaaaugaaaagucgggguuuauuacuuuaua

SEQ ID NO: 564136 - RNA, 64 nt, Homo Sapiens
uuuagaauccuuugaaucuaaguauuuguuuccuaaaugaaacauuuguacaacauuugauguu

SEQ ID NO: 564137 - RNA, 64 nt, Homo Sapiens
cucuauuuaaaagcuaagaaauguuuuaaaggaaaaaugaaauuaucuuccuuuagcuuauuuu

SEQ ID NO: 564138 - RNA, 64 nt, Homo Sapiens
ugugugaauaacauuguaugauguauaaauuagaaaaugaaaaaacuucacuucuuuguauauu

SEQ ID NO: 564139 - RNA, 64 nt, Homo Sapiens
uuaagucacuuauuaacuuucaauuaagugcacuaaaugaaaagcaaaaucauggugacacuuc

SEQ ID NO: 564140 - RNA, 64 nt, Homo Sapiens
uucccaguauuauaaauuguuuugggaaacacugaaaugaaaucacccuuuccaggaauaaugu

SEQ ID NO: 564141 - RNA, 64 nt, Homo Sapiens
uaagaauugaauuggaaagagcacaccauuuuguaaaugaaacuugaggucaguguuuguuuuu

SEQ ID NO: 564142 - RNA, 64 nt, Homo Sapiens
uuguuuaaacauuaaaauuagaauuuuugaaaugaaaugaaaccucuuuaugcuaauagauuug

SEQ ID NO: 564143 - RNA, 64 nt, Homo Sapiens
aaaccuuguuuaaacauuaaauuuggaauuuuugaaaugaaauguuacaucuuuaugcuaauag

SEQ ID NO: 564144 - RNA, 64 nt, Homo Sapiens
ugaaaagguuggguaagaauauccaaauuacaggaaaugaaaccaugaauguuaucagcuauuu

SEQ ID NO: 564145 - RNA, 64 nt, Homo Sapiens
cuuuucagugaugcagccagugguguuugcacuuaaaugaaaacuggagugagaagaaaguccu

SEQ ID NO: 564146 - RNA, 64 nt, Homo Sapiens
auuucuuacaucuaauuuguauuguacuaugacuaaaugaaauuggauuuuguuaaucaaauuu

SEQ ID NO: 564147 - RNA, 64 nt, Homo Sapiens
gauucuccuugaguucugaucaacaucggcgaggaaaugaaagcauuuauguuccuauauauua

SEQ ID NO: 564148 - RNA, 64 nt, Homo Sapiens
guucuggagaucaguugugcguuucaguuuugcaaaaugaaaaaaguucuuuaaugggugaaga

SEQ ID NO: 564149 - RNA, 64 nt, Homo Sapiens
aauuuuaaaaauguaaaaccgugcaaauaagcaaaaaugaaaaccaugauagaaaauuuggaaa

SEQ ID NO: 564150 - RNA, 64 nt, Homo Sapiens
ggcgcuggcuuuccacagugguuccuugccugaaaaaugaaagaguccaccuuucuaggccuug

SEQ ID NO: 564151 - RNA, 64 nt, Homo Sapiens
uuaaaacagaaccuuuaagagcaaccauggcacaaaaugaaaauguaguaguacaaccaguugu

SEQ ID NO: 564152 - RNA, 64 nt, Homo Sapiens
aaaccuuggaagcccucuuaugagcgaauucaggaaaugaaagcuaaaacaacccauuugcuac

SEQ ID NO: 564153 - RNA, 64 nt, Homo Sapiens
gcuguggaaguuaagguguugaccacugugccugaaaugaaaccacaaggcuugagaauagaaa

SEQ ID NO: 564154 - RNA, 64 nt, Homo Sapiens
gagcuaguauguuguaaaaccugccaccugaauaaaaugaaaaaaaaaguguuuuuuugagaca

SEQ ID NO: 564155 - RNA, 64 nt, Homo Sapiens
ggauuacaggcgugagccaccgugcccggcccuaaaaugaaauuauuaauguugguucugaaac

SEQ ID NO: 564156 - RNA, 64 nt, Homo Sapiens
gaaagcagaaagaaggaaagccuagaacagaaauaaaugaaauagagaauagaaaagcaauaca

SEQ ID NO: 564157 - RNA, 64 nt, Homo Sapiens
auacuaugaacaauugaaugccaacaaauuagauaaaugaaauggacaaauuccuaggaagaca

SEQ ID NO: 564158 - RNA, 64 nt, Homo Sapiens
uguuucuguuggaaacacugaagcagggacucuaaaaugaaagcaucucacauugguuuucuuu

SEQ ID NO: 564159 - RNA, 64 nt, Homo Sapiens
cgaaauugccugugugcacauauuuuuagaugaaaaaugaaacuaccuuacaauauuauuuuuu

SEQ ID NO: 564160 - RNA, 64 nt, Homo Sapiens
auuuaaggguuaugcugcacguaacuuuaaaaauaaaugaaauuuguuaauuucucuguagguu

SEQ ID NO: 564161 - RNA, 64 nt, Homo Sapiens
gaaagaaaacccacacacaaaucccacgauaucuaaaugaaaaaggagauguccucuccacuuu

SEQ ID NO: 564162 - RNA, 64 nt, Homo Sapiens
aaaucgccaguuggggaugaacuauuucaggcccaaaugaaagguuaucaucgaagguggugaa

SEQ ID NO: 564163 - RNA, 64 nt, Homo Sapiens
ccacgucauauaacucaagagguuuggagaauagaaaugaaaagggaacugaaaaacuccacag

SEQ ID NO: 564164 - RNA, 64 nt, Homo Sapiens
uuaggagcucugcuuggaaagguuguaggacaggaaaugaaacaagcuccacuggguccccuuu

SEQ ID NO: 564165 - RNA, 64 nt, Homo Sapiens
auccuguuauuuucuuagggguuggcuugaacauaaaugaaaauagauuuuuuuguuuggggag

SEQ ID NO: 564166 - RNA, 64 nt, Homo Sapiens
auguggcauguucaucguauacgcacacguacuuaaaugaaagcagauuccugguucggguguu

SEQ ID NO: 564167 - RNA, 64 nt, Homo Sapiens
acuacaaaauuugaaauuuaauucaaccacuguaaaaugaaauuauuaagcauuggguggguaa

SEQ ID NO: 564168 - RNA, 64 nt, Homo Sapiens
cuuuccacugaaugcauaauguuuaaauagcauaaaaugaaaugcuacaaaaauugaacuaauu

SEQ ID NO: 564169 - RNA, 64 nt, Homo Sapiens
ugaacuaauuuauacuuuaaaguauuucuggguuaaaugaaacaaugaaauuuuuuaguauguu

SEQ ID NO: 564170 - RNA, 64 nt, Homo Sapiens
uugcacaucugcucuguuuugguuuuucuacaggaaaugaaaaucaacuuguuuuuuuaauaug

SEQ ID NO: 564171 - RNA, 64 nt, Homo Sapiens
uucuagauucacaaauuuaaauaaauuacucaaaaaaugaaaauugauuuuguaaacuuuuauu

SEQ ID NO: 564172 - RNA, 52 nt, Homo Sapiens
agagucagaaagcuaaauaaaaaaaugaaacuuuuuugaguaauaaaaauga

SEQ ID NO: 564173 - RNA, 64 nt, Homo Sapiens
cuaaauaaaaaaaugaaacuuuuuugaguaauaaaaaugaaaagacgcuguauguaugacuuuu

SEQ ID NO: 564174 - RNA, 64 nt, Homo Sapiens
agugcugcugauaugauacaaguagacaaaauuuaaaugaaauuuugucacauucuauggaaaa

SEQ ID NO: 564175 - RNA, 64 nt, Homo Sapiens
auaauuuaaaaacaagacaucuccagguaggaaaaaaugaaagcuauuucaugcaaacauuauc

SEQ ID NO: 564176 - RNA, 64 nt, Homo Sapiens
ugugaaaauauaugauuuuuaugucaaucaagacaaaugaaauauauauguauguguauauaua

SEQ ID NO: 564177 - RNA, 64 nt, Homo Sapiens
cuuauuguaccaaaucuuugagauauuuguacauaaaugaaauauguacuuucaugcuaaaauu

SEQ ID NO: 564178 - RNA, 64 nt, Homo Sapiens
aacauuuuacuucugcgcuuucaagaauacagaaaaaugaaaauaugaauucuagaaacuaaaa

SEQ ID NO: 564179 - RNA, 64 nt, Homo Sapiens
ugaaaaaucuauaguagcagagaggaaaugcauaaaaugaaagaaacaggaaauuacaugguug

SEQ ID NO: 564180 - RNA, 64 nt, Homo Sapiens
aaccuccucaguuguugcaaaccacagcugauguaaaugaaaaguucuuauuuuuagaaaaaua

SEQ ID NO: 564181 - RNA, 64 nt, Homo Sapiens
aacucuuuaggugaacuuugcacauaggaagagcaaaugaaauagaagauuuuuguagguguac

SEQ ID NO: 564182 - RNA, 64 nt, Homo Sapiens
aaugcaagauuucuuaauaaaugacaaggggggcaaaugaaaucuauucuagagacggguugca

SEQ ID NO: 564183 - RNA, 64 nt, Homo Sapiens
cugacuucgccucuuccugcuaguauuuuucuguaaaugaaaugaacucauugucuccaccaga

SEQ ID NO: 564184 - RNA, 64 nt, Homo Sapiens
aaugagauuuauaaccacuuugagcgcuguuuuuaaaugaaaagauugacuuacuaccuaacac

SEQ ID NO: 564185 - RNA, 64 nt, Homo Sapiens
ggaacauuucaaucaaacaucuauaagcuuggugaaaugaaaauaaguuuguauaaacagguug

SEQ ID NO: 564186 - RNA, 64 nt, Homo Sapiens
auggagcauuguuaauuuacaauugcuaaacaagaaaugaaaacacaauagguucuaaaaauaa

SEQ ID NO: 564187 - RNA, 64 nt, Homo Sapiens
ccacaguauagcgcauauuuacucauaacuuuccaaaugaaacccccuguuugacuucacacac

SEQ ID NO: 564188 - RNA, 64 nt, Homo Sapiens
gacacaggguguauaucuagaauagaaaagacaaaaaugaaagaauggacacuaaacuggagcc

SEQ ID NO: 564189 - RNA, 64 nt, Homo Sapiens
uagcgcaccugcacuuugaacugaauggauguggaaaugaaagcagaauaguaugcucuauuuc

SEQ ID NO: 564190 - RNA, 64 nt, Homo Sapiens
ccacaaaugcaagacuguucuagagcuguaaggaaaaugaaaagucaggcuuuuuaaauaaaau

SEQ ID NO: 564191 - RNA, 64 nt, Homo Sapiens
aagcuucaaagcugcuuuauucaauaaaaaaaagaaaugaaaaagauauaugaauaugacaaag

SEQ ID NO: 564192 - RNA, 64 nt, Homo Sapiens
agcaaccauaauauggucacuacccuaauagacuaaaugaaaucuugcaauuucaaauuacucu

SEQ ID NO: 564193 - RNA, 64 nt, Homo Sapiens
gucauuuuggguugccgugcucccaaaacauuuuaaaugaaaguauuggcauucaaaaagacag

SEQ ID NO: 564194 - RNA, 64 nt, Homo Sapiens
augaaaguauuggcauucaaaaagacagcagacaaaaugaaagaaaaugagagcagaaaguaag

SEQ ID NO: 564195 - RNA, 64 nt, Homo Sapiens
guuaauuacaacugcuauauagacauuuuguuucaaaugaaacuuuaaaagacugaaaaauuuu

SEQ ID NO: 564196 - RNA, 64 nt, Homo Sapiens
ugacugaugauacaugcauacauauuuguugaauaaaugaaaauuuauuuuuagugauaagauu

SEQ ID NO: 564197 - RNA, 64 nt, Homo Sapiens
agacuuuuugaagggaaaauagagcaacagggaaaaaugaaagaaaugucuugguuacugagcu

SEQ ID NO: 564198 - RNA, 64 nt, Homo Sapiens
uuuuggaagcgauaaacuuuaaauauacuuauuaaaaugaaauucuauuaaguuuuucagaucu

SEQ ID NO: 564199 - RNA, 64 nt, Homo Sapiens
guauaggcuacuauuuagggcaaaaggaaucuugaaaugaaagaaacagaacuaaaaggcuaac

SEQ ID NO: 564200 - RNA, 64 nt, Homo Sapiens
uuugccuauuucuuguauaaguuaaggcagccauaaaugaaaauacaaaacaaacguuugcuuu

SEQ ID NO: 564201 - RNA, 64 nt, Homo Sapiens
ccuaaaaguugucaacuccccacccuuggacuuuaaaugaaaauuuuauucaguccagcuauuc

SEQ ID NO: 564202 - RNA, 64 nt, Homo Sapiens
guaguauuuuguuggaagagaauguuuauacaaaaaaugaaauucuuccaacagcagagaaacu

SEQ ID NO: 564203 - RNA, 64 nt, Homo Sapiens
uuuucuuagaggagagagagaaauauuaaaagagaaaugaaacaauagaguauuuuggguuuuu

SEQ ID NO: 564204 - RNA, 64 nt, Homo Sapiens
cuuuggguauccuguaauuuaguuguaacauagaaaaugaaaaaacaguuaaaaaaagugaagu

SEQ ID NO: 564205 - RNA, 64 nt, Homo Sapiens
guuucaggaaguuucugcagcuguggaucugggcaaaugaaaauucagaucauauuucacaauc

SEQ ID NO: 564206 - RNA, 64 nt, Homo Sapiens
gguaauaaaacuguaucaguagaaccaucauuggaaaugaaacugaaauuauacuauauuuuau

SEQ ID NO: 564207 - RNA, 64 nt, Homo Sapiens
uguagguaaccuauuuauaugggacaaaauuauaaaaugaaaugugaaacagaucuauaguuuu

SEQ ID NO: 564208 - RNA, 64 nt, Homo Sapiens
gaucuauaguuuugggacaauugauaugucaugaaaaugaaacauuauuaauguugggcaaaaa

SEQ ID NO: 564209 - RNA, 64 nt, Homo Sapiens
aaugacauugaaacauuuguaauaacaaguugucaaaugaaaagcuuauaugacaaaugaaaag

SEQ ID NO: 564210 - RNA, 64 nt, Homo Sapiens
aauaacaaguugucaaaugauuugcuuauaugacaaaugaaaagauuuuuaguuaugagaaauc

SEQ ID NO: 564211 - RNA, 64 nt, Homo Sapiens
cugccuuggcuagaguuugauugcaugauuucccaaaugaaauauuaagaauugagcaguucug

SEQ ID NO: 564212 - RNA, 64 nt, Homo Sapiens
gaauggagauuggccugguugugaacaaagugagaaaugaaaucaauacgugauuaauaugcaa

SEQ ID NO: 564213 - RNA, 64 nt, Homo Sapiens
uaggauuaaaaauugcaccacacuaauuuaacauaaaugaaaauaauauuaauauuuacauauu

SEQ ID NO: 564214 - RNA, 64 nt, Homo Sapiens
aaagcaacaauaauuuugaaguagauuuuuaaacaaaugaaauugacuggacuuuuggguggug

SEQ ID NO: 564215 - RNA, 64 nt, Homo Sapiens
uagacaaaauauucagagccauuuuuuuuaagggaaaugaaaaagauacucuggguuuuuuaua

SEQ ID NO: 564216 - RNA, 64 nt, Homo Sapiens
cuaacaaaaauaaguacucaggacuuuuuuuucaaaaugaaauauuuauguacuguuuuauggu

SEQ ID NO: 564217 - RNA, 64 nt, Homo Sapiens
ccuuccccaacccuccauaaaaaaacaaaaauggaaaugaaaaaugaaacaaaaaaggacaaaa

SEQ ID NO: 564218 - RNA, 64 nt, Homo Sapiens
caacccuccauaaaaaaacaaaaauggaaaugaaaaaugaaacaaaaaaggacaaaaccaaaaa

SEQ ID NO: 564219 - RNA, 64 nt, Homo Sapiens
gaaaccaauuuuuauccaccaucuaguccuuauuaaaugaaaccucacggauccuuuguuccgc

SEQ ID NO: 564220 - RNA, 64 nt, Homo Sapiens
caagaugcacaucgcuauuaacagccagagucauaaaugaaaugaaauugaagaauucauucaa

SEQ ID NO: 564221 - RNA, 64 nt, Homo Sapiens
ugcacaucgcuauuaacagccagagucauaaaugaaaugaaauugaagaauucauucaaaugcu

SEQ ID NO: 564222 - RNA, 64 nt, Homo Sapiens
guuuaauaagagcaaauauaggggaaaaucuuugaaaugaaagcuacaaauacaugugagaaga

SEQ ID NO: 564223 - RNA, 64 nt, Homo Sapiens
uggggcuggcuaggccuccacuuguccaucugugaaaugaaaggaucagccuggacagcccucu

SEQ ID NO: 564224 - RNA, 64 nt, Homo Sapiens
uuuuccuggaacaaugcuaaauaugcucccuauaaaaugaaauguauuuucuaauguuucuggg

SEQ ID NO: 564225 - RNA, 64 nt, Homo Sapiens
acauaguucgugcucagaaaaagugauacgauugaaaugaaaucaaauuauuucaaucagauga

SEQ ID NO: 564226 - RNA, 64 nt, Homo Sapiens
augugccugauuuaauguuuuuaauaaucacagcaaaugaaaggugguuuaguuauaagugaag

SEQ ID NO: 564227 - RNA, 64 nt, Homo Sapiens
uuagguguguucauucacgguauggaaauacaguaaaugaaagauuccaacuaguugucagugc

SEQ ID NO: 564228 - RNA, 64 nt, Homo Sapiens
ugugaacauguagauguuuuguguguauuuuuuuaaaugaaaacucaaaauaagacaaguaauu

SEQ ID NO: 564229 - RNA, 64 nt, Homo Sapiens
guguuuuauguuaagcaaaacauacuuuagaaacaaaugaaaaaggcaauugaaaaucccagcu

SEQ ID NO: 564230 - RNA, 64 nt, Homo Sapiens
ccaaaaagcaaaccaaaagaccccaugucuacaaaaaugaaaaacugggcaacauagcaacacc

SEQ ID NO: 564231 - RNA, 64 nt, Homo Sapiens
guccgcuauauugugauuugucaggggccauggaaaaugaaaaaaagagaugacaaaacuaagu

SEQ ID NO: 564232 - RNA, 64 nt, Homo Sapiens
ucaacuuuaagguauguuuugcuguaacccuuuaaaaugaaaugagcucagucccuaugaggua

SEQ ID NO: 564233 - RNA, 64 nt, Homo Sapiens
accuuucagcuauguuuguagacuacugcccuuaaaaugaaaaauuacauuaacuauuucaaag

SEQ ID NO: 564234 - RNA, 64 nt, Homo Sapiens
uugaauguucauguguggguaaacuauuuaauaaaaaugaaagaugacauuucuuuuuauauau

SEQ ID NO: 564235 - RNA, 64 nt, Homo Sapiens
gauccaucaucaaagucuuuuuugcgcuggaauuaaaugaaaugaauacuauagcuucacacag

SEQ ID NO: 564236 - RNA, 64 nt, Homo Sapiens
ucucuccauuaccuucugcuuucacuaaauaagcaaaugaaaaccgagugauuuuccucuguuu

SEQ ID NO: 564237 - RNA, 64 nt, Homo Sapiens
gaauaagucacauugguuccauuuuuagggaaaaaaaugaaaaaacaguccuuuauccaccugg

SEQ ID NO: 564238 - RNA, 64 nt, Homo Sapiens
uuuaacauuaaaucguagguagggcaauguaguaaaaugaaagagaauuaagaaagguuuugaa

SEQ ID NO: 564239 - RNA, 64 nt, Homo Sapiens
cacugguagguaagcaugaguuaaggaaagucaaaaaugaaaauauauuuugcuguguauaaau

SEQ ID NO: 564240 - RNA, 64 nt, Homo Sapiens
uuauauucagucccuucuaauacuguaucaauguaaaugaaauaaauauauucaaauuggcuuu

SEQ ID NO: 564241 - RNA, 64 nt, Homo Sapiens
uggucugcagucuggaagcuugucugcucuauagaaaugaaaaugcagcaugaaguugacauug

SEQ ID NO: 564242 - RNA, 64 nt, Homo Sapiens
gaaaugaaaaugcagcaugaaguugacauuguggaaaugaaaguaauuggguauuagaaaucug

SEQ ID NO: 564243 - RNA, 64 nt, Homo Sapiens
caauacucaacaguaauuccacuguuaccugcacaaaugaaaaaugauguauuccacuguuauu

SEQ ID NO: 564244 - RNA, 64 nt, Homo Sapiens
uuuuguagauaccauaucccauacaaacacauccaaaugaaaaauguagauuuguacuuagcaa

SEQ ID NO: 564245 - RNA, 64 nt, Homo Sapiens
uuguuuccaauuauuuauaaugucuggguuugagaaaugaaauacaugauauuuacuguuuugu

SEQ ID NO: 564246 - RNA, 64 nt, Homo Sapiens
uccauuuuuguaagccauaagcuuacccaucuucaaaugaaaauauacuuacuaguugauuucu

SEQ ID NO: 564247 - RNA, 64 nt, Homo Sapiens
auuuuuaugccuacuuaggaggaaaacaagaaggaaaugaaaauaguucuugcuauaaugguau

SEQ ID NO: 564248 - RNA, 64 nt, Homo Sapiens
ucuugcuauaaugguauggacgguaacaugaaacaaaugaaagugugugcauuaaaguuguaaa

SEQ ID NO: 564249 - RNA, 64 nt, Homo Sapiens
ugagucaucuaauuagauguuacuuuuaguuuuaaaaugaaaucuuaggugccuuagggguuuu

SEQ ID NO: 564250 - RNA, 64 nt, Homo Sapiens
uggaguacuuuguuauauaacagaagccauccugaaaugaaacuagucuaaaaaaauucauugu

SEQ ID NO: 564251 - RNA, 64 nt, Homo Sapiens
cuucucuucuuacaguaguucaaauacaaaacugaaaugaaaucccauuggauuguacuucucu

SEQ ID NO: 564252 - RNA, 64 nt, Homo Sapiens
cuuagccagcaaaacaaaacaaaacaaaacaaacaaaugaaaaacguuuaaaaagaagaagaag

SEQ ID NO: 564253 - RNA, 64 nt, Homo Sapiens
aagaguaaacuuuuccuaaaacacuuuauauuauaaaugaaaauaaauugcuaguuuauauuuu

SEQ ID NO: 564254 - RNA, 64 nt, Homo Sapiens
uuucaucuacauguaauguguuauuaauuuuauuaaaugaaaacuaaucaccuucauguggaaa

SEQ ID NO: 564255 - RNA, 64 nt, Homo Sapiens
uggggugggaggggagaaagggaaccuuuucuuaaaaugaaaauaauuacugcuauuuuaaaau

SEQ ID NO: 564256 - RNA, 64 nt, Homo Sapiens
uuuacaucacguacucauaaccuauuaugaaaauaaaugaaacuggcuggguaugguggcucau

SEQ ID NO: 564257 - RNA, 64 nt, Homo Sapiens
ucauaacuguggcuauuacuucuuuaucagaauaaaaugaaauugguuaucaagcauauauuag

SEQ ID NO: 564258 - RNA, 64 nt, Homo Sapiens
agccgucuuacaagucguuacuucgugccaaaucaaaugaaacagcauauuuacucuuacuuua

SEQ ID NO: 564259 - RNA, 64 nt, Homo Sapiens
uauuauuaagcuucuguguuaaacaagaaaaagaaaaugaaaaguggcaggaauuguccuuaug

SEQ ID NO: 564260 - RNA, 64 nt, Homo Sapiens
ugacauugccagaaacuuacaaguuuuauaaaucaaaugaaaggacuuuaaaucuguccuguaa

SEQ ID NO: 564261 - RNA, 64 nt, Homo Sapiens
uuuugagaccucuuaagaaaaaauaaaaaguaaaaaaugaaaggaaucuuuuuuagaaauagag

SEQ ID NO: 564262 - RNA, 64 nt, Homo Sapiens
ugcuguauuaaugacaauuauucaugaaaauaaaaaaugaaauauuuuguauacuacuaccuuc

SEQ ID NO: 564263 - RNA, 64 nt, Homo Sapiens
gguuaguuaaaugauaaacaugaaagcucuguccaaaugaaaaagguauuucuaacaacaacca

SEQ ID NO: 564264 - RNA, 64 nt, Homo Sapiens
ggcuuuaaaauaaaucccuuguaaguuguccugcaaaugaaauuacugucuggaaaacugcaau

SEQ ID NO: 564265 - RNA, 64 nt, Homo Sapiens
guacagcauuuucaacauauuggcaacauauuuuaaaugaaaacacuaaaacaauucuuaguau

SEQ ID NO: 564266 - RNA, 64 nt, Homo Sapiens
cauuaacauaaaauaucaaacacacaaagucauaaaaugaaaauuuacaguuuuaccuguucau

SEQ ID NO: 564267 - RNA, 64 nt, Homo Sapiens
cguguuucugcuagaauuaaaaaguuaaauuuaaaaaugaaaaugaaagacagcuucccaggag

SEQ ID NO: 564268 - RNA, 64 nt, Homo Sapiens
ucugcuagaauuaaaaaguuaaauuuaaaaaugaaaaugaaagacagcuucccaggaguuuugu

SEQ ID NO: 564269 - RNA, 64 nt, Homo Sapiens
ugcauauucuggaucauagaugcuauuaauaguuaaaugaaaucuuugugugcaacugcuucau

SEQ ID NO: 564270 - RNA, 64 nt, Homo Sapiens
auagggcaguuuggugcaauauuaauucaguccaaaaugaaauuagcccccuacugagaaguua

SEQ ID NO: 564271 - RNA, 64 nt, Homo Sapiens
aagugucccauuuuuaauaaauacaagauaccaaaaaugaaaaagaagaggauggaaaaacuga

SEQ ID NO: 564272 - RNA, 64 nt, Homo Sapiens
auaguuuaaaacaaguagcuaauuuggucaccaaaaaugaaauacuuuaauuauggucaaauau

SEQ ID NO: 564273 - RNA, 64 nt, Homo Sapiens
acuaguucagugaucagcauuugucaggauaaucaaaugaaaaucaugggcucaauuauuaugu

SEQ ID NO: 564274 - RNA, 64 nt, Homo Sapiens
ccuuacaccagauaucaguuuuuucuuauuaagaaaaugaaaucuauuaaauauuugacuuuuu

SEQ ID NO: 564275 - RNA, 64 nt, Homo Sapiens
ugacucugggggagcagagccugcaccauugcugaaaugaaagauuucuaaacuguugaauaug

SEQ ID NO: 564276 - RNA, 64 nt, Homo Sapiens
augucuuacugaaacauuuugccagacuuucuccaaaugaaaccugaaucaauuuuucuaaauc

SEQ ID NO: 564277 - RNA, 64 nt, Homo Sapiens
ggaccuguguuuccaugucaaauguuuucaaauaaaaugaaauaugaguuucaauacuuuuuau

SEQ ID NO: 564278 - RNA, 64 nt, Homo Sapiens
uagguuauagauaaacaauuagguauaauagcaaaaaugaaaauuggaagaaugcaaaauggau

SEQ ID NO: 564279 - RNA, 64 nt, Homo Sapiens
auuuuuugcaaaguuagacaauggcacaaagucaaaaugaaaucaauguuuaguucacaaguag

SEQ ID NO: 564280 - RNA, 64 nt, Homo Sapiens
gaggggguucuuccucaccuuguaaccagugcagaaaugaaauagcuuagcggcaagaagccgu

SEQ ID NO: 564281 - RNA, 64 nt, Homo Sapiens
aucuaggugcuucaauucacuuucuugagaggacaaaugaaaagcuguggagaaaauguccuca

SEQ ID NO: 564282 - RNA, 64 nt, Homo Sapiens
ucuguugucucuucauauucuucuuccuuuuccuaaaugaaauuauauuauuucaacuacuaaa

SEQ ID NO: 564283 - RNA, 64 nt, Homo Sapiens
uauaaaauagguguugccuauugcugugcuuauaaaaugaaaaaggaaauugaggacacuuuug

SEQ ID NO: 564284 - RNA, 64 nt, Homo Sapiens
uaacugcucaacaggaaaugaaccuagaaacagaaaaugaaaagguugauugaaauaaaacuug

SEQ ID NO: 564285 - RNA, 64 nt, Homo Sapiens
uggaaguuuugucuugggcaguaugggcugggccaaaugaaaugauuuuuauaauucuaaacag

SEQ ID NO: 564286 - RNA, 64 nt, Homo Sapiens
augaaaugauuuuuauaauucuaaacagguuaccaaaugaaaugucauggcuuuacuuugguca

SEQ ID NO: 564287 - RNA, 64 nt, Homo Sapiens
agcauuagagcuuuauauacuguaguguuugaauaaaugaaaccuccagcauaugguagauacu

SEQ ID NO: 564288 - RNA, 64 nt, Homo Sapiens
uacaauguucucaccaaauaauauauaguuuacaaaaugaaaauuguuauuacuugaauauaga

SEQ ID NO: 564289 - RNA, 64 nt, Homo Sapiens
agggagcaggggaguuaggaucucaguugguuccaaaugaaaccaagagggauucaugugucug

SEQ ID NO: 564290 - RNA, 64 nt, Homo Sapiens
uaacaagugggugaauguggugaugcuuuucugaaaaugaaauagacaaaccgagugcaaugaa

SEQ ID NO: 564291 - RNA, 64 nt, Homo Sapiens
uuuauacucuauguuucuguaugagggcacagugaaaugaaaauuuauauucuuauaauuuuaa

SEQ ID NO: 564292 - RNA, 64 nt, Homo Sapiens
uauuuuuuuaaaugaauugacguaauuauuauuuaaaugaaagcuauacagagauaaagcuaaa

SEQ ID NO: 564293 - RNA, 64 nt, Homo Sapiens
uuuacccaugaccaacaguagggauguaaaaaugaaaugaaacccaggcacuuucaagaacuuu

SEQ ID NO: 564294 - RNA, 64 nt, Homo Sapiens
aaaccuuuacccaugaccaaacuuugggauguaaaaaugaaaugguccacaggcacuuucaaga

SEQ ID NO: 564295 - RNA, 64 nt, Homo Sapiens
ggaucugguucaacauagcacaaacccuuaggaaaaaugaaauuaacaucacugauguguaauc

SEQ ID NO: 564296 - RNA, 64 nt, Homo Sapiens
cuugcuguauucucaguuucuaauaaaaagaaccaaaugaaauaugaccugucguguguuuuuu

SEQ ID NO: 564297 - RNA, 64 nt, Homo Sapiens
cauaaaacacaggaaaggggaauucugugauggcaaaugaaaaaaauguuaacauuugguagac

SEQ ID NO: 564298 - RNA, 64 nt, Homo Sapiens
cguauuauuuuuuucuuaacagaaauauuuuuaaaaaugaaaaaguacucaaaagugagaagag

SEQ ID NO: 564299 - RNA, 64 nt, Homo Sapiens
guaucuucagaacuuaacauguuuuuauucagcaaaaugaaaacaccagaacaugggucauagg

SEQ ID NO: 564300 - RNA, 64 nt, Homo Sapiens
aaaacaaucauuggacggaacuacuguaaguaugaaaugaaagagaaauauauauuuuaaacag

SEQ ID NO: 564301 - RNA, 64 nt, Homo Sapiens
uccuaucaauuuuauuuugugaagacuaaguaagaaaugaaauguauuuuuauaaccccauuga

SEQ ID NO: 564302 - RNA, 64 nt, Homo Sapiens
aagccagguauucuaaaagaugugauuuaaaacaaaaugaaaaucaucuuccuauuuaaugaau

SEQ ID NO: 564303 - RNA, 64 nt, Homo Sapiens
caccuaucuuucuaucacagggccaaccugaaggaaaugaaacugcguacuuuguuuauccauu

SEQ ID NO: 564304 - RNA, 64 nt, Homo Sapiens
gcauucacaguuucuguaaaucuuuugccucguaaaaugaaaauaugcaaucuugaauauuuuc

SEQ ID NO: 564305 - RNA, 64 nt, Homo Sapiens
gggagauauuuacauuccguacauacccauauuuaaaugaaauggaggccuuuuuaacaugcag

SEQ ID NO: 564306 - RNA, 64 nt, Homo Sapiens
gucgccaaacuuggguauucauggaauuucuaguaaaugaaauaccuauacuuugauacugaag

SEQ ID NO: 564307 - RNA, 64 nt, Homo Sapiens
ggcuggagauuuuuuccaauauuguuuucuuugaaaaugaaaggggaucaucuauuuuaguuuu

SEQ ID NO: 564308 - RNA, 64 nt, Homo Sapiens
uuucuuuuccagggugcauuuuaauauacguaugaaaugaaauauuugguuaggauuuuuaaau

SEQ ID NO: 564309 - RNA, 64 nt, Homo Sapiens
uucaagggagcauuauagggcagaaaacaaauuaaaaugaaauguuguuguuauagccaugcau

SEQ ID NO: 564310 - RNA, 64 nt, Homo Sapiens
uaguucuguaacugcauuuuucaccuuaaaaguuaaaugaaaugcaugaugguauuuuauuccu

SEQ ID NO: 564311 - RNA, 64 nt, Homo Sapiens
cacagacauuuauuuuuuaaauugauaggguagaaaaugaaauguacuucuguuuauucuuaau

SEQ ID NO: 564312 - RNA, 64 nt, Homo Sapiens
uaauuuauacacagcaggcaagcuuacaauguggaaaugaaagccuccccuaauucagugugcc

SEQ ID NO: 564313 - RNA, 64 nt, Homo Sapiens
cuuguuuccgucuagucuaauagguuuaucagugaaaugaaaggcuuucgaucguguauuuaug

SEQ ID NO: 564314 - RNA, 64 nt, Homo Sapiens
ccauauaugugcaaacagauauuuaaaauuuucaaaaugaaauucuuuuagauucugaauggug

SEQ ID NO: 564315 - RNA, 64 nt, Homo Sapiens
uaaaauauuucaguuuucugaacaagcaauaauaaaaugaaacuaagaauuacuuuaaucaacu

SEQ ID NO: 564316 - RNA, 53 nt, Homo Sapiens
gaauuuuaaacuuuuugcaugucaaaugaaacuuccauuacagucaaggcuaa

SEQ ID NO: 564317 - RNA, 64 nt, Homo Sapiens
cgugaagucacauuccacaucaguuagccccagaaaaugaaaucucugcuuuaguuucacauug

SEQ ID NO: 564318 - RNA, 64 nt, Homo Sapiens
uuuuuacuaauauauauuuuacacaagggauauaaaaugaaagaauuuauaauagguauauaga

SEQ ID NO: 564319 - RNA, 64 nt, Homo Sapiens
ucaaauugaaucuuuuacuuaccucuugcaaaaaaaaugaaaaaugaaaaaacaaauucaaaac

SEQ ID NO: 564320 - RNA, 64 nt, Homo Sapiens
gaaucuuuuacuuaccucuugcaaaaaaaaugaaaaaugaaaaaacaaauucaaaaccuauuca

SEQ ID NO: 564321 - RNA, 64 nt, Homo Sapiens
uagauuaguuuaaaugugaacauuaauguaaucaaaaugaaauaguuucauuccuucagagcuc

SEQ ID NO: 564322 - RNA, 64 nt, Homo Sapiens
cggauuucaaauaaccagacaccaaaacuauucaaaaugaaaacucugccaugacauacacuua

SEQ ID NO: 564323 - RNA, 64 nt, Homo Sapiens
ggcccuagcuuuagagggaacuaaccuccauuugaaaugaaauuacaaaagugauuuuuuuacu

SEQ ID NO: 564324 - RNA, 64 nt, Homo Sapiens
aagaaaaaaaaaagagcuauggaaaaaaaaaaaaaaaugaaaaagcgucaucugguugaacucu

SEQ ID NO: 564325 - RNA, 64 nt, Homo Sapiens
guaaagaaaauaccaguguuaugugcucuuuguaaaaugaaauuauucauaaaauuuuaguuua

SEQ ID NO: 564326 - RNA, 64 nt, Homo Sapiens
uacuugacaagauuaaaaguuuuugaaguagaagaaaugaaaauggcaaacaaccuggucaacc

SEQ ID NO: 564327 - RNA, 64 nt, Homo Sapiens
gaggcugcaacaacaguaagagaauuucuucacaaaaugaaaauuaaaauggaaauaacaaagc

SEQ ID NO: 564328 - RNA, 64 nt, Homo Sapiens
auuuagaacggggcaggcaaauaaaaguaauaaaaaaugaaauuacugccaauuaacuaucacc

SEQ ID NO: 564329 - RNA, 64 nt, Homo Sapiens
auuuauaauaggacucgacuaaagugaaauacaaaaaugaaaauaucuugguaaauugagacuc

SEQ ID NO: 564330 - RNA, 64 nt, Homo Sapiens
auaggcaucuauguaaaguguuaaccuuuuuuacaaaugaaaugauuuuaaugaguaaauagaa

SEQ ID NO: 564331 - RNA, 64 nt, Homo Sapiens
aaaucccuuuccccuuagcccccuaccuuaacccaaaugaaaguuuccaggggccuuuggucug

SEQ ID NO: 564332 - RNA, 64 nt, Homo Sapiens
aaugacucuuggagucaagagugagaucuguaagaaaugaaagacuaaagagaaaucuggaagu

SEQ ID NO: 564333 - RNA, 64 nt, Homo Sapiens
aggauaauuuccacuguguggaaugugaauaguuaaaugaaaaguuaugguuauuuaauguaau

SEQ ID NO: 564334 - RNA, 64 nt, Homo Sapiens
uucacacauaaaguccuuuuaaggagaaaaucuaaaaugaaaaguggauaaacagaacauuuau

SEQ ID NO: 564335 - RNA, 64 nt, Homo Sapiens
gguacaaaaucuugcauaagcugaacuaaaauaaaaaugaaaaggagagauuaaagguauuccu

SEQ ID NO: 564336 - RNA, 64 nt, Homo Sapiens
aaucaagaaaauaugccauuuauagagauaagauaaaugaaauaauacuucagccaccagguuu

SEQ ID NO: 564337 - RNA, 64 nt, Homo Sapiens
auauaguagaacauacuuuuuuuuucuuuaagccaaaugaaaagagguaacuuugcuuuuuucc

SEQ ID NO: 564338 - RNA, 64 nt, Homo Sapiens
uuuucuaugcauaguuaugcauuuauauucucaaaaaugaaaucauaauguacauugcuuugua

SEQ ID NO: 564339 - RNA, 64 nt, Homo Sapiens
gaaaaugacuuauuuccagaagauaccgcucuaaaaaugaaauuguuaggugaaaguguuuuug

SEQ ID NO: 564340 - RNA, 64 nt, Homo Sapiens
auauguguaaaagagucaaauccuaaaugggaucaaaugaaauauucaagucugggauaaucuu

SEQ ID NO: 564341 - RNA, 64 nt, Homo Sapiens
gccagaaagauauaaaacugggaaggcuuugauaaaaugaaauuggaaucuaaauagucaguga

SEQ ID NO: 564342 - RNA, 64 nt, Homo Sapiens
aacucccaagcccuaaagaggauaaguccaaaugaaaugaaauccacagauaaacugaggcuca

SEQ ID NO: 564343 - RNA, 64 nt, Homo Sapiens
aaaucaacucccaagcccuagcucagauaaguccaaaugaaaugaugaacacagauaaacugag

SEQ ID NO: 564344 - RNA, 64 nt, Homo Sapiens
agggacagacauguucaucagguacuucaagaagaaaugaaagauugucaaagagagaaggucg

SEQ ID NO: 564345 - RNA, 64 nt, Homo Sapiens
caagagcuacaagauggcugaccuguucugguggaaaugaaaacagggacaggaggaaaaugaa

SEQ ID NO: 564346 - RNA, 64 nt, Homo Sapiens
uguucugguggaaaugaaaagagggacaggaggaaaaugaaaccgagcaagugaucuggcaaaa

SEQ ID NO: 564347 - RNA, 64 nt, Homo Sapiens
acacacacccacccacacacacacacacagaagaaaaugaaagcugacacaccucgaagccuuc

SEQ ID NO: 564348 - RNA, 64 nt, Homo Sapiens
guucagcuguuauuaaacugucauuucucccgcuaaaugaaaaccguguuguuauaaagcuuaa

SEQ ID NO: 564349 - RNA, 64 nt, Homo Sapiens
guuggguguugauaggaaucaacacagacaccagaaaugaaagugaguagaguugcaacuggaa

SEQ ID NO: 564350 - RNA, 64 nt, Homo Sapiens
caaguggucuucuguagagguaaaacaggaccccaaaugaaaucaagaaaauuauuuuugaaau

SEQ ID NO: 564351 - RNA, 64 nt, Homo Sapiens
aucuguguaagugaagggacaacuagcacuggaaaaaugaaaucagaagcaucacuucuuggau

SEQ ID NO: 564352 - RNA, 64 nt, Homo Sapiens
aaaaaauaaaauauuuguuucucuaaagguuauaaaaugaaaacgcccuaguugaauuaagaaa

SEQ ID NO: 564353 - RNA, 64 nt, Homo Sapiens
ccuguugcugcgucacugugggggagggaaaaugaaaugaaaacaaauaacuugggggaaacgg

SEQ ID NO: 564354 - RNA, 64 nt, Homo Sapiens
aaaacccuguugcugcgucaaacggggggagggaaaaugaaauggcacuaaauaacuuggggga

SEQ ID NO: 564355 - RNA, 64 nt, Homo Sapiens
ucuaaauguuguauuuuaucaaauuuguauuuuuaaaugaaaauaaauucuuaauauuuucaua

SEQ ID NO: 564356 - RNA, 64 nt, Homo Sapiens
acccuguguuuuaaaauauauucaccaaaagauuaaaugaaaccauguaggacuuaugauccaa

SEQ ID NO: 564357 - RNA, 64 nt, Homo Sapiens
uaguuuaagaccaaacauuuccucugcuugcuggaaaugaaauauucccguuaacaaauuacgg

SEQ ID NO: 564358 - RNA, 64 nt, Homo Sapiens
ggccagucaaaaaaaaaaagaacccaggucauugaaaugaaauuuccugaauaaaacaacaucc

SEQ ID NO: 564359 - RNA, 64 nt, Homo Sapiens
aaauacauauaugcagugcuuguuguccaaauagaaaugaaaauaaguggaagagagaggaaga

SEQ ID NO: 564360 - RNA, 64 nt, Homo Sapiens
gcaaccuuuuuuccuugaauuaacagcaauaaaaaaaugaaaaacagcuuaagaauugugccuc

SEQ ID NO: 564361 - RNA, 64 nt, Homo Sapiens
guuaauuuuaccuuguuugaauagcaauaacugaaaaugaaaguagugguaauccucuucuaaa

SEQ ID NO: 564362 - RNA, 64 nt, Homo Sapiens
gguaauccucuucuaaaauaaaacaguuucaucuaaaugaaagugaucugaggaggcuuuggua

SEQ ID NO: 564363 - RNA, 64 nt, Homo Sapiens
uuaauuuuagggauucauuuaauucuuuucucucaaaugaaaaugcauguaugcccgaauuugu

SEQ ID NO: 564364 - RNA, 64 nt, Homo Sapiens
agaacaaagaggaaaauggucaaugcaauauuuaaaaugaaaugguguguauauuauuauuaau

SEQ ID NO: 564365 - RNA, 64 nt, Homo Sapiens
ccuuaauaggaaaaaaagagugaucauuaccuguaaaugaaagauuuacauauuuuugucuugu

SEQ ID NO: 564366 - RNA, 64 nt, Homo Sapiens
aauaugcaguccaaaauucauuucuuuuuuuuggaaaugaaacauuaguguuugacacuccaua

SEQ ID NO: 564367 - RNA, 64 nt, Homo Sapiens
agaggucauacaggugagagacaccaaguauauuaaaugaaagaaggccucuuaaauucaaccc

SEQ ID NO: 564368 - RNA, 64 nt, Homo Sapiens
uuaaaacaauguugaaugaaaaaaaucaaaauacaaaugaaacauuguguaauaauauuuaugu

SEQ ID NO: 564369 - RNA, 64 nt, Homo Sapiens
aauacuuguuguaaaaaugacaaauaugugagcaaaaugaaacaaugaaaaccuaggaaaguag

SEQ ID NO: 564370 - RNA, 64 nt, Homo Sapiens
cuaggaaaguagcaaauauguugagauccaaaaaaaaugaaaacagugaucccagauuagauuu

SEQ ID NO: 564371 - RNA, 64 nt, Homo Sapiens
ucguccacaggggaucugucaguuuggguccuccaaaugaaaaaugucaagacagaauuggaca

SEQ ID NO: 564372 - RNA, 64 nt, Homo Sapiens
gguuuuccauauaauauuauuuaaaaugcugagaaaaugaaaaaaucuaaauggugaaauauau

SEQ ID NO: 564373 - RNA, 64 nt, Homo Sapiens
uaaaaauaaauaaaacagcagcagcaaacaaauaaaaugaaauaaaagaaacaaaugaaauaaa

SEQ ID NO: 564374 - RNA, 64 nt, Homo Sapiens
cagcagcaaacaaauaaaaugaaauaaaagaaacaaaugaaauaaauauuguguugugcagcau

SEQ ID NO: 564375 - RNA, 64 nt, Homo Sapiens
ucugcuuaacuccaauuucugggucaugaucaaaaaaugaaaagucaaauauauuucucuuuca

SEQ ID NO: 564376 - RNA, 64 nt, Homo Sapiens
gaauacagcauggaaaauauaccagcauuuuaaaaaaugaaauaaaccaguuuaaugggauaca

SEQ ID NO: 564377 - RNA, 64 nt, Homo Sapiens
acuuaaaauugcuauauuuguacauaauucaauaaaaugaaaugacuguuauuuaaagauguuu

SEQ ID NO: 564378 - RNA, 64 nt, Homo Sapiens
cuagauuagacuagaaaauagaaaacugaguaggaaaugaaauauguuuuacucuuauaaaaag

SEQ ID NO: 564379 - RNA, 64 nt, Homo Sapiens
uuucuucucuaaaacauuaguuuaauuuucuucaaaaugaaaauacugcuuuguaauuacaaaa

SEQ ID NO: 564380 - RNA, 64 nt, Homo Sapiens
uuaaaaugauugacauaaacucuuugugccuugaaaaugaaacaaauuauaaaaauguuuaaau

SEQ ID NO: 564381 - RNA, 64 nt, Homo Sapiens
aaauuuaaaauguuuacggcgcuuaauugccuggaaaugaaaugaaaucaaauuuaucaguuuu

SEQ ID NO: 564382 - RNA, 64 nt, Homo Sapiens
uaaaauguuuacggcgcuuaauugccuggaaaugaaaugaaaucaaauuuaucaguuuuuuucc

SEQ ID NO: 564383 - RNA, 64 nt, Homo Sapiens
ucaaauuuucuuuagugcuuaaaauuaaguuuuaaaaugaaaucagacacugcagguuuguaua

SEQ ID NO: 564384 - RNA, 64 nt, Homo Sapiens
uaaaaugaaaucagacacugcagguuuguauauaaaaugaaaagcuauacuacuuuuuacaaaa

SEQ ID NO: 564385 - RNA, 64 nt, Homo Sapiens
ugauaauauaaucucuauuuuuuuaggaaaacaaaaaugaaaaacuacuccauuugaggauugu

SEQ ID NO: 564386 - RNA, 64 nt, Homo Sapiens
aggcuguaauauguguacauuguguuuaagagaaaaaugaaacccacaugccgccauuuuccug

SEQ ID NO: 564387 - RNA, 64 nt, Homo Sapiens
uguucacccaaaugauucuccuauuuauuuugugaaaugaaaaugugucuuuuuuggauaugag

SEQ ID NO: 564388 - RNA, 64 nt, Homo Sapiens
uugugaguguuuauugguuuugcugaaaaccuaaaaaugaaagugacuaaugugaaaaaaacau

SEQ ID NO: 564389 - RNA, 64 nt, Homo Sapiens
uuuuuuuuuuaagggagcucaaggucacaagaagaaaugaaaggaacaaucagcagcccuguuc

SEQ ID NO: 564390 - RNA, 64 nt, Homo Sapiens
auucaucuacuuagacuuuuuaaaugccugccauaaaugaaauugaaaugguagaauggcugac

SEQ ID NO: 564391 - RNA, 64 nt, Homo Sapiens
caaauaauauucaugaagaguuguuuauaaugucaaaugaaaccuacaggaaucucugauuaca

SEQ ID NO: 564392 - RNA, 64 nt, Homo Sapiens
aaagaccauuuaaucuugaaggaacacaaagaucaaaugaaaaguaaaacacucuaaauaaauu

SEQ ID NO: 564393 - RNA, 64 nt, Homo Sapiens
aaauguaguuaguuugauacuccuuagaauaaaaaaaugaaacaguaacaacuuuuauguaaaa

SEQ ID NO: 564394 - RNA, 64 nt, Homo Sapiens
accaaauuuaaaaaaugauggauuaugcucugugaaaugaaaaguucaaucauugccuaaaaaa

SEQ ID NO: 564395 - RNA, 64 nt, Homo Sapiens
aucuuguuucaaaauaaguauuucugauuuuguaaaaugaaauauaaaauaugucucagaucuu

SEQ ID NO: 564396 - RNA, 64 nt, Homo Sapiens
acuaugggauguauauauaucauugcuguuagagaaaugaaauaaaauggggcugggcucagug

SEQ ID NO: 564397 - RNA, 64 nt, Homo Sapiens
cucagcaacaacacuuaugcauccaaacacucacaaaugaaaccugaaagaaucuuuucugagc

SEQ ID NO: 564398 - RNA, 64 nt, Homo Sapiens
cuuaaggucgggaugccuuuuuuuccauguaaggaaaugaaaagaccaaaaucuucaggcaaaa

SEQ ID NO: 564399 - RNA, 64 nt, Homo Sapiens
ugcaagcacauuggugaccuacugauaugcaggaaaaugaaauacugaaaugccuuaauuguga

SEQ ID NO: 564400 - RNA, 64 nt, Homo Sapiens
cuugagcacacuuuaaaaagauuaauaaaaccauaaaugaaacaaacauucuacuuuaaaaauu

SEQ ID NO: 564401 - RNA, 64 nt, Homo Sapiens
aucccaacuauugagcauguaaacuucuugcuucaaaugaaaaaucaccaucugaaaauucaca

SEQ ID NO: 564402 - RNA, 64 nt, Homo Sapiens
uauuucuuggggaugccuuuauuuuaccuuggagaaaugaaaauugaaauaagcugcuaaucag

SEQ ID NO: 564403 - RNA, 64 nt, Homo Sapiens
guguaaucuaaaauauaccaccuaggugauuuuuaaaugaaaauuuuccuaagaucauuuuuau

SEQ ID NO: 564404 - RNA, 64 nt, Homo Sapiens
aagggagggaaaguuguauuuaaaaguaaaaugcaaaugaaaacauuauuaaagcaaaaauaaa

SEQ ID NO: 564405 - RNA, 64 nt, Homo Sapiens
ucaggcaguuuaguccauaggagaucucaaugcgaaaugaaaacgcuaaaggcuuuucuacucu

SEQ ID NO: 564406 - RNA, 64 nt, Homo Sapiens
auauauaggagggauaucaguaaguuuagcuucuaaaugaaauauacugcauagaaaucaaaug

SEQ ID NO: 564407 - RNA, 64 nt, Homo Sapiens
ggaaacaugaugaagauauauggagcuucggaagaaaugaaaauguuagcaaguuagauuuucc

SEQ ID NO: 564408 - RNA, 64 nt, Homo Sapiens
gaucagaagcuggaugagagauuuuaaucaucuuaaaugaaacaagcgaauuggggaggggagu

SEQ ID NO: 564409 - RNA, 64 nt, Homo Sapiens
uuuaaucuuugaaaauuauuaaacacacacacacaaaugaaauuuuuaaaguucuuauuuaaaa

SEQ ID NO: 564410 - RNA, 64 nt, Homo Sapiens
ccaauguaaagaucuaauuuacaccuuuuuuucaaaaugaaauauguaucucacauuaaacaaa

SEQ ID NO: 564411 - RNA, 64 nt, Homo Sapiens
uaaaaccuuuuauuuucuucacauaaagcaacuaaaaugaaacaaggggugagaauaaguauaa

SEQ ID NO: 564412 - RNA, 64 nt, Homo Sapiens
aacauucuacuuuaaaaauuauuaauaaaaccauaaaugaaacacuugagcacacuuuaaaaag

SEQ ID NO: 564413 - RNA, 64 nt, Homo Sapiens
cugaaaugccuuaauugugaacugauacgcaggaaaaugaaauauguaagcacauuggugaccu

SEQ ID NO: 564414 - RNA, 64 nt, Homo Sapiens; identical to SEQ ID NO: 415214

SEQ ID NO: 564415 - RNA, 64 nt, Homo Sapiens; identical to SEQ ID NO: 415215

SEQ ID NO: 564416 - RNA, 64 nt, Homo Sapiens; identical to SEQ ID NO: 415216

SEQ ID NO: 564417 - RNA, 64 nt, Homo Sapiens; identical to SEQ ID NO: 415217

SEQ ID NO: 564418 - RNA, 64 nt, Homo Sapiens; identical to SEQ ID NO: 415218

SEQ ID NO: 564419 - RNA, 64 nt, Homo Sapiens; identical to SEQ ID NO: 415219

SEQ ID NO: 564420 - RNA, 64 nt, Homo Sapiens; identical to SEQ ID NO: 415220

SEQ ID NO: 564421 - RNA, 64 nt, Homo Sapiens; identical to SEQ ID NO: 415221

SEQ ID NO: 564422 - RNA, 55 nt, Homo Sapiens; identical to SEQ ID NO: 415222

SEQ ID NO: 564423 - RNA, 64 nt, Homo Sapiens; identical to SEQ ID NO: 415223

SEQ ID NO: 564424 - RNA, 64 nt, Homo Sapiens; identical to SEQ ID NO: 415224

SEQ ID NO: 564425 - RNA, 64 nt, Homo Sapiens; identical to SEQ ID NO: 415225

SEQ ID NO: 564426 - RNA, 64 nt, Homo Sapiens; identical to SEQ ID NO: 415226

SEQ ID NO: 564427 - RNA, 64 nt, Homo Sapiens; identical to SEQ ID NO: 415227

SEQ ID NO: 564428 - RNA, 64 nt, Homo Sapiens; identical to SEQ ID NO: 415228

SEQ ID NO: 564429 - RNA, 50 nt, Homo Sapiens; identical to SEQ ID NO: 415229

SEQ ID NO: 564430 - RNA, 64 nt, Homo Sapiens; identical to SEQ ID NO: 415230

SEQ ID NO: 564431 - RNA, 64 nt, Homo Sapiens; identical to SEQ ID NO: 415231

SEQ ID NO: 564432 - RNA, 64 nt, Homo Sapiens; identical to SEQ ID NO: 415232

SEQ ID NO: 564433 - RNA, 64 nt, Homo Sapiens; identical to SEQ ID NO: 415233

SEQ ID NO: 564434 - RNA, 64 nt, Homo Sapiens; identical to SEQ ID NO: 415234

SEQ ID NO: 564435 - RNA, 64 nt, Homo Sapiens; identical to SEQ ID NO: 415235

SEQ ID NO: 564436 - RNA, 64 nt, Homo Sapiens; identical to SEQ ID NO: 415236

SEQ ID NO: 564437 - RNA, 64 nt, Homo Sapiens; identical to SEQ ID NO: 415237

SEQ ID NO: 564438 - RNA, 64 nt, Homo Sapiens; identical to SEQ ID NO: 415238

SEQ ID NO: 564439 - RNA, 64 nt, Homo Sapiens; identical to SEQ ID NO: 415239

SEQ ID NO: 564440 - RNA, 64 nt, Homo Sapiens; identical to SEQ ID NO: 415240

SEQ ID NO: 564441 - RNA, 64 nt, Homo Sapiens; identical to SEQ ID NO: 415241

SEQ ID NO: 564442 - RNA, 64 nt, Homo Sapiens; identical to SEQ ID NO: 415242

SEQ ID NO: 564443 - RNA, 64 nt, Homo Sapiens; identical to SEQ ID NO: 415243

SEQ ID NO: 564444 - RNA, 64 nt, Homo Sapiens; identical to SEQ ID NO: 415244

SEQ ID NO: 564445 - RNA, 64 nt, Homo Sapiens; identical to SEQ ID NO: 415245

SEQ ID NO: 564446 - RNA, 64 nt, Homo Sapiens; identical to SEQ ID NO: 415246

SEQ ID NO: 564447 - RNA, 64 nt, Homo Sapiens; identical to SEQ ID NO: 415247

SEQ ID NO: 564448 - RNA, 64 nt, Homo Sapiens; identical to SEQ ID NO: 415248

SEQ ID NO: 564449 - RNA, 64 nt, Homo Sapiens; identical to SEQ ID NO: 415249

SEQ ID NO: 564450 - RNA, 64 nt, Homo Sapiens; identical to SEQ ID NO: 415250

SEQ ID NO: 564451 - RNA, 64 nt, Homo Sapiens; identical to SEQ ID NO: 415251

SEQ ID NO: 564452 - RNA, 64 nt, Homo Sapiens; identical to SEQ ID NO: 415252

SEQ ID NO: 564453 - RNA, 64 nt, Homo Sapiens; identical to SEQ ID NO: 415253

SEQ ID NO: 564454 - RNA, 64 nt, Homo Sapiens; identical to SEQ ID NO: 415254

SEQ ID NO: 564455 - RNA, 64 nt, Homo Sapiens; identical to SEQ ID NO: 415255

SEQ ID NO: 564456 - RNA, 64 nt, Homo Sapiens; identical to SEQ ID NO: 415256

SEQ ID NO: 564457 - RNA, 64 nt, Homo Sapiens; identical to SEQ ID NO: 293538

SEQ ID NO: 564458 - RNA, 64 nt, Homo Sapiens; identical to SEQ ID NO: 293539

SEQ ID NO: 564459 - RNA, 64 nt, Homo Sapiens; identical to SEQ ID NO: 293540

SEQ ID NO: 564460 - RNA, 64 nt, Homo Sapiens; identical to SEQ ID NO: 293541

SEQ ID NO: 564461 - RNA, 64 nt, Homo Sapiens; identical to SEQ ID NO: 293542

SEQ ID NO: 564462 - RNA, 64 nt, Homo Sapiens; identical to SEQ ID NO: 293543

SEQ ID NO: 564463 - RNA, 64 nt, Homo Sapiens; identical to SEQ ID NO: 293544

SEQ ID NO: 564464 - RNA, 64 nt, Homo Sapiens; identical to SEQ ID NO: 293545

SEQ ID NO: 564465 - RNA, 64 nt, Homo Sapiens; identical to SEQ ID NO: 293546

SEQ ID NO: 564466 - RNA, 64 nt, Homo Sapiens; identical to SEQ ID NO: 293547

SEQ ID NO: 564467 - RNA, 64 nt, Homo Sapiens; identical to SEQ ID NO: 293548

SEQ ID NO: 564468 - RNA, 64 nt, Homo Sapiens; identical to SEQ ID NO: 293549

SEQ ID NO: 564469 - RNA, 64 nt, Homo Sapiens; identical to SEQ ID NO: 293550

SEQ ID NO: 564470 - RNA, 64 nt, Homo Sapiens; identical to SEQ ID NO: 293551

SEQ ID NO: 564471 - RNA, 64 nt, Homo Sapiens; identical to SEQ ID NO: 293552

SEQ ID NO: 564472 - RNA, 64 nt, Homo Sapiens; identical to SEQ ID NO: 293553

SEQ ID NO: 564473 - RNA, 64 nt, Homo Sapiens; identical to SEQ ID NO: 293554

SEQ ID NO: 564474 - RNA, 64 nt, Homo Sapiens; identical to SEQ ID NO: 293555

SEQ ID NO: 564475 - RNA, 64 nt, Homo Sapiens; identical to SEQ ID NO: 293556

SEQ ID NO: 564476 - RNA, 64 nt, Homo Sapiens; identical to SEQ ID NO: 293557

SEQ ID NO: 564477 - RNA, 64 nt, Homo Sapiens; identical to SEQ ID NO: 293558

SEQ ID NO: 564478 - RNA, 64 nt, Homo Sapiens; identical to SEQ ID NO: 293559

SEQ ID NO: 564479 - RNA, 64 nt, Homo Sapiens; identical to SEQ ID NO: 293560

SEQ ID NO: 564480 - RNA, 64 nt, Homo Sapiens; identical to SEQ ID NO: 293561

SEQ ID NO: 564481 - RNA, 64 nt, Homo Sapiens; identical to SEQ ID NO: 293562

SEQ ID NO: 564482 - RNA, 64 nt, Homo Sapiens; identical to SEQ ID NO: 293563

SEQ ID NO: 564483 - RNA, 64 nt, Homo Sapiens; identical to SEQ ID NO: 293564

SEQ ID NO: 564484 - RNA, 64 nt, Homo Sapiens; identical to SEQ ID NO: 293565

SEQ ID NO: 564485 - RNA, 64 nt, Homo Sapiens; identical to SEQ ID NO: 293566

SEQ ID NO: 564486 - RNA, 64 nt, Homo Sapiens; identical to SEQ ID NO: 293567

SEQ ID NO: 564487 - RNA, 64 nt, Homo Sapiens; identical to SEQ ID NO: 293568

SEQ ID NO: 564488 - RNA, 64 nt, Homo Sapiens; identical to SEQ ID NO: 293569

SEQ ID NO: 564489 - RNA, 64 nt, Homo Sapiens; identical to SEQ ID NO: 293570

SEQ ID NO: 564490 - RNA, 64 nt, Homo Sapiens; identical to SEQ ID NO: 293571

SEQ ID NO: 564491 - RNA, 64 nt, Homo Sapiens; identical to SEQ ID NO: 103727

SEQ ID NO: 564492 - RNA, 64 nt, Homo Sapiens; identical to SEQ ID NO: 103728

SEQ ID NO: 564493 - RNA, 64 nt, Homo Sapiens; identical to SEQ ID NO: 103729

SEQ ID NO: 564494 - RNA, 64 nt, Homo Sapiens; identical to SEQ ID NO: 103730

SEQ ID NO: 564495 - RNA, 64 nt, Homo Sapiens; identical to SEQ ID NO: 24953

SEQ ID NO: 564496 - RNA, 64 nt, Homo Sapiens; identical to SEQ ID NO: 24954

SEQ ID NO: 564497 - RNA, 64 nt, Homo Sapiens; identical to SEQ ID NO: 24955

SEQ ID NO: 564498 - RNA, 64 nt, Homo Sapiens; identical to SEQ ID NO: 24956

SEQ ID NO: 564499 - RNA, 64 nt, Homo Sapiens; identical to SEQ ID NO: 24957

SEQ ID NO: 564500 - RNA, 64 nt, Homo Sapiens; identical to SEQ ID NO: 24958

SEQ ID NO: 564501 - RNA, 64 nt, Homo Sapiens; identical to SEQ ID NO: 24959

SEQ ID NO: 564502 - RNA, 64 nt, Homo Sapiens; identical to SEQ ID NO: 24960

SEQ ID NO: 564503 - RNA, 64 nt, Homo Sapiens; identical to SEQ ID NO: 24961

SEQ ID NO: 564504 - RNA, 64 nt, Homo Sapiens; identical to SEQ ID NO: 24962

SEQ ID NO: 564505 - RNA, 64 nt, Homo Sapiens; identical to SEQ ID NO: 24963

SEQ ID NO: 564506 - RNA, 64 nt, Homo Sapiens; identical to SEQ ID NO: 24964

SEQ ID NO: 564507 - RNA, 64 nt, Homo Sapiens
ggagaucacccauuuacuguagguaguauucucuuccuacuauauuucauaucuaccuacuaca

SEQ ID NO: 564508 - RNA, 64 nt, Homo Sapiens
auauuucauaucuaccuacuacauuucauaucauuccuacuacauuucauaucuaccuacauuu

SEQ ID NO: 564509 - RNA, 64 nt, Homo Sapiens; identical to SEQ ID NO: 299681

SEQ ID NO: 564510 - RNA, 64 nt, Homo Sapiens; identical to SEQ ID NO: 299682

SEQ ID NO: 564511 - RNA, 64 nt, Homo Sapiens; identical to SEQ ID NO: 299683

SEQ ID NO: 564512 - RNA, 64 nt, Homo Sapiens; identical to SEQ ID NO: 299684

SEQ ID NO: 564513 - RNA, 64 nt, Homo Sapiens; identical to SEQ ID NO: 299685

SEQ ID NO: 564514 - RNA, 64 nt, Homo Sapiens; identical to SEQ ID NO: 299686

SEQ ID NO: 564515 - RNA, 64 nt, Homo Sapiens; identical to SEQ ID NO: 299687

SEQ ID NO: 564516 - RNA, 64 nt, Homo Sapiens; identical to SEQ ID NO: 299688

SEQ ID NO: 564517 - RNA, 64 nt, Homo Sapiens; identical to SEQ ID NO: 299689

SEQ ID NO: 564518 - RNA, 64 nt, Homo Sapiens; identical to SEQ ID NO: 299690

SEQ ID NO: 564519 - RNA, 64 nt, Homo Sapiens; identical to SEQ ID NO: 299691

SEQ ID NO: 564520 - RNA, 64 nt, Homo Sapiens; identical to SEQ ID NO: 299692

SEQ ID NO: 564521 - RNA, 53 nt, Homo Sapiens; identical to SEQ ID NO: 299693

SEQ ID NO: 564522 - RNA, 64 nt, Homo Sapiens; identical to SEQ ID NO: 299694

SEQ ID NO: 564523 - RNA, 64 nt, Homo Sapiens; identical to SEQ ID NO: 299695

SEQ ID NO: 564524 - RNA, 64 nt, Homo Sapiens; identical to SEQ ID NO: 299696

SEQ ID NO: 564525 - RNA, 64 nt, Homo Sapiens; identical to SEQ ID NO: 299697

SEQ ID NO: 564526 - RNA, 64 nt, Homo Sapiens; identical to SEQ ID NO: 299698

SEQ ID NO: 564527 - RNA, 64 nt, Homo Sapiens; identical to SEQ ID NO: 299699

SEQ ID NO: 564528 - RNA, 64 nt, Homo Sapiens; identical to SEQ ID NO: 299700

SEQ ID NO: 564529 - RNA, 64 nt, Homo Sapiens; identical to SEQ ID NO: 299701

SEQ ID NO: 564530 - RNA, 64 nt, Homo Sapiens; identical to SEQ ID NO: 299702

SEQ ID NO: 564531 - RNA, 64 nt, Homo Sapiens; identical to SEQ ID NO: 299703

SEQ ID NO: 564532 - RNA, 64 nt, Homo Sapiens; identical to SEQ ID NO: 299704

SEQ ID NO: 564533 - RNA, 64 nt, Homo Sapiens; identical to SEQ ID NO: 299705

SEQ ID NO: 564534 - RNA, 64 nt, Homo Sapiens; identical to SEQ ID NO: 299706

SEQ ID NO: 564535 - RNA, 64 nt, Homo Sapiens; identical to SEQ ID NO: 299707

SEQ ID NO: 564536 - RNA, 64 nt, Homo Sapiens; identical to SEQ ID NO: 299708

SEQ ID NO: 564537 - RNA, 64 nt, Homo Sapiens; identical to SEQ ID NO: 299709

SEQ ID NO: 564538 - RNA, 64 nt, Homo Sapiens; identical to SEQ ID NO: 299710

SEQ ID NO: 564539 - RNA, 64 nt, Homo Sapiens; identical to SEQ ID NO: 299711

SEQ ID NO: 564540 - RNA, 64 nt, Homo Sapiens
gcaagaccaaaaugacaaugaugaugauaaugaugaugacgacgacaacgaugaugcuuguaac

SEQ ID NO: 564541 - RNA, 64 nt, Homo Sapiens
accagggguccaaguccccauggagagcugcagugaugacgacaagagaagccaaacaaagacu

SEQ ID NO: 564542 - RNA, 64 nt, Homo Sapiens
gcauggcggcggggugcaggggaaaguuaaaggugaugacgaucaucacaccugugucguuacc

SEQ ID NO: 564543 - RNA, 64 nt, Homo Sapiens
ccaaguacaccugcaaggcugugauguuugcggggaugacgauggaacugcucuuuaauuauua

SEQ ID NO: 564544 - RNA, 64 nt, Homo Sapiens
ucagaggucgcacacagugacucuccucucucaggaugacgaggaccugugccuucaacaagca

SEQ ID NO: 564545 - RNA, 64 nt, Homo Sapiens
auuaugaaaugugccuuuucucugucugggcugugaugacgaauuaaaaaaggucuccugcaga

SEQ ID NO: 564546 - RNA, 64 nt, Homo Sapiens
acaaccacaaaaaaaauugaaaaaaaaaaaacaagaugacgacguaaaaaaaaacaaaaaaaaa

SEQ ID NO: 564547 - RNA, 64 nt, Homo Sapiens
aaugugaaggguuaauguagaugccauaucuguagaugacgaugauaucuggcagaauguguga

SEQ ID NO: 564548 - RNA, 64 nt, Homo Sapiens
acgugcaacagcagaaagauaacgacgcugagaggaugacgacacaacaaagguccaguuagga

SEQ ID NO: 564549 - RNA, 64 nt, Homo Sapiens
acuuucccagugaugagaagcaggacuguagggugaugacgauccucugcacagcuccaaccaa

SEQ ID NO: 564550 - RNA, 64 nt, Homo Sapiens
uuucaucuguuuuguuccuugagucagugcuguugaugacgaguugucuugaauaaaucaugug

SEQ ID NO: 564551 - RNA, 64 nt, Homo Sapiens
augccguuggggcggaggcugccauguugucuuugaugacgaugccagaaucacgcccuccugg

SEQ ID NO: 564552 - RNA, 64 nt, Homo Sapiens
auugagaugucacuuuacaugggaguuauccauugaugacgaugaaaugccugauuuagaaaac

SEQ ID NO: 564553 - RNA, 64 nt, Homo Sapiens
aauaagaaguccacacaagcaagccaaauuuuuagaugacgaaguccauaaauaacuagagaau

SEQ ID NO: 564554 - RNA, 64 nt, Homo Sapiens
ucuggcguccacaccccagguguugcugacacuggaugacgaccuggauacugugcagcgggac

SEQ ID NO: 564555 - RNA, 64 nt, Homo Sapiens
ugaugaugaugaugaugaagaugaugaugaugaugaugacgaggaagcugaagaaaaagcgcca

SEQ ID NO: 564556 - RNA, 64 nt, Homo Sapiens
ugaggucagaggucaggagcagggcuggggucaggaugacgaggccugggguccugguguuggg

SEQ ID NO: 564557 - RNA, 64 nt, Homo Sapiens
augaccagucguacuaucuuaaaaaagagaagaagaugacgaugauccaggcuucugccaaaaa

SEQ ID NO: 564558 - RNA, 64 nt, Homo Sapiens
acacuuaagugugaauuuuuuagaaguaaagugugaugacgauauaacguauuuggaguuuauu

SEQ ID NO: 564559 - RNA, 64 nt, Homo Sapiens
ccgcuuguuuugggugcacaggagccccacugcugaugacgaacuaucucuaacuggucuugac

SEQ ID NO: 564560 - RNA, 64 nt, Homo Sapiens
guaguugucuguugaugauggugaugaugaugaugaugacgauagugaugccacacauucucuc

SEQ ID NO: 564561 - RNA, 64 nt, Homo Sapiens
gggugaacagccaucacuucgagaugaugacggugaugacgacuugcugaugauucccaagauu

SEQ ID NO: 564562 - RNA, 64 nt, Homo Sapiens
ggaggagcggugagaacauggaaccggacuccaagaugacgaucuaaagacccgggagcgagaa

SEQ ID NO: 564563 - RNA, 64 nt, Homo Sapiens
augcacucgguaaguuuucucgagugacaccacugaugacgauggcccacgcuguuccgguugg

SEQ ID NO: 564564 - RNA, 64 nt, Homo Sapiens
cuuaacaauaacgauacaaaccaaagacacuuuugaugacgauuacuagcagauuuguaugguu

SEQ ID NO: 564565 - RNA, 64 nt, Homo Sapiens
aaaccccuuugcaggugagggagugcccauaugagaugacgagggugguccacacaggugccag

SEQ ID NO: 564566 - RNA, 64 nt, Homo Sapiens
agaugcuuaugaugaccuggaccaagaagacccagaugacgaccuggauauuugacuggccaga

SEQ ID NO: 564567 - RNA, 64 nt, Homo Sapiens
aacugccuucguuugguccagggccaucgugggugaugacgauugcucucuugcacucaaggac

SEQ ID NO: 564568 - RNA, 64 nt, Homo Sapiens
uaaauuaaaauuuuaugacaguaucgaggcuugugaugacgaauccugcucuaaaauacacaag

SEQ ID NO: 564569 - RNA, 64 nt, Homo Sapiens
gccgggcacagcguggcuacagagggucucccucgaugacgacgacgacgacgccaccacccca

SEQ ID NO: 564570 - RNA, 64 nt, Homo Sapiens
uaucugaugagaacucacacuagcuuguuuacaagaugacgacaguccaagggcagccuugggc

SEQ ID NO: 564571 - RNA, 64 nt, Homo Sapiens
uggcugauuggcccugggccgccacccucgcugugaugacgagccuccuuccgggacaagccug

SEQ ID NO: 564572 - RNA, 64 nt, Homo Sapiens
uggguggaaaccuacccuguuccuggugccagaugaugacgaccccgggcacccccccccaggc

SEQ ID NO: 564573 - RNA, 64 nt, Homo Sapiens
acaucagagguuagacuuacaggcuguagaaggggaugacgagguuccccuucagggccacaac

SEQ ID NO: 564574 - RNA, 64 nt, Homo Sapiens
auugggggugggggagauggcuuccccacuaugggaugacgaggcgagagggaagcccuugcug

SEQ ID NO: 564575 - RNA, 64 nt, Homo Sapiens
ggugauuuaugaagagaucagcgacccugaggaagaugacgaguaacuccguaagagaaccuuc

SEQ ID NO: 564576 - RNA, 64 nt, Homo Sapiens
aagaguccaggucacugugcgaucaggauguuaggaugacgagcuguucauguuuuguccagcg

SEQ ID NO: 564577 - RNA, 64 nt, Homo Sapiens; identical to SEQ ID NO: 430373

SEQ ID NO: 564578 - RNA, 64 nt, Homo Sapiens; identical to SEQ ID NO: 430374

SEQ ID NO: 564579 - RNA, 64 nt, Homo Sapiens; identical to SEQ ID NO: 430375

SEQ ID NO: 564580 - RNA, 64 nt, Homo Sapiens; identical to SEQ ID NO: 430376

SEQ ID NO: 564581 - RNA, 64 nt, Homo Sapiens; identical to SEQ ID NO: 430377

SEQ ID NO: 564582 - RNA, 64 nt, Homo Sapiens; identical to SEQ ID NO: 430378

SEQ ID NO: 564583 - RNA, 64 nt, Homo Sapiens; identical to SEQ ID NO: 430379

SEQ ID NO: 564584 - RNA, 64 nt, Homo Sapiens; identical to SEQ ID NO: 430380

SEQ ID NO: 564585 - RNA, 64 nt, Homo Sapiens; identical to SEQ ID NO: 430381

SEQ ID NO: 564586 - RNA, 64 nt, Homo Sapiens; identical to SEQ ID NO: 430382

SEQ ID NO: 564587 - RNA, 64 nt, Homo Sapiens; identical to SEQ ID NO: 430383

SEQ ID NO: 564588 - RNA, 64 nt, Homo Sapiens; identical to SEQ ID NO: 430384

SEQ ID NO: 564589 - RNA, 64 nt, Homo Sapiens; identical to SEQ ID NO: 430385

SEQ ID NO: 564590 - RNA, 64 nt, Homo Sapiens; identical to SEQ ID NO: 430386

SEQ ID NO: 564591 - RNA, 64 nt, Homo Sapiens; identical to SEQ ID NO: 430387

SEQ ID NO: 564592 - RNA, 64 nt, Homo Sapiens; identical to SEQ ID NO: 430388

SEQ ID NO: 564593 - RNA, 64 nt, Homo Sapiens; identical to SEQ ID NO: 430389

SEQ ID NO: 564594 - RNA, 64 nt, Homo Sapiens; identical to SEQ ID NO: 430390

SEQ ID NO: 564595 - RNA, 64 nt, Homo Sapiens; identical to SEQ ID NO: 430391

SEQ ID NO: 564596 - RNA, 64 nt, Homo Sapiens; identical to SEQ ID NO: 430392

SEQ ID NO: 564597 - RNA, 64 nt, Homo Sapiens; identical to SEQ ID NO: 430393

SEQ ID NO: 564598 - RNA, 64 nt, Homo Sapiens; identical to SEQ ID NO: 430394

SEQ ID NO: 564599 - RNA, 64 nt, Homo Sapiens; identical to SEQ ID NO: 430395

SEQ ID NO: 564600 - RNA, 64 nt, Homo Sapiens; identical to SEQ ID NO: 430396

SEQ ID NO: 564601 - RNA, 64 nt, Homo Sapiens; identical to SEQ ID NO: 430397

SEQ ID NO: 564602 - RNA, 64 nt, Homo Sapiens; identical to SEQ ID NO: 430398

SEQ ID NO: 564603 - RNA, 64 nt, Homo Sapiens; identical to SEQ ID NO: 430399

SEQ ID NO: 564604 - RNA, 64 nt, Homo Sapiens; identical to SEQ ID NO: 430400

SEQ ID NO: 564605 - RNA, 64 nt, Homo Sapiens; identical to SEQ ID NO: 430401

SEQ ID NO: 564606 - RNA, 64 nt, Homo Sapiens; identical to SEQ ID NO: 430402

SEQ ID NO: 564607 - RNA, 64 nt, Homo Sapiens; identical to SEQ ID NO: 430403

SEQ ID NO: 564608 - RNA, 64 nt, Homo Sapiens; identical to SEQ ID NO: 430404

SEQ ID NO: 564609 - RNA, 62 nt, Homo Sapiens; identical to SEQ ID NO: 296757

SEQ ID NO: 564610 - RNA, 64 nt, Homo Sapiens; identical to SEQ ID NO: 430406

SEQ ID NO: 564611 - RNA, 64 nt, Homo Sapiens; identical to SEQ ID NO: 430407

SEQ ID NO: 564612 - RNA, 64 nt, Homo Sapiens; identical to SEQ ID NO: 430408

SEQ ID NO: 564613 - RNA, 64 nt, Homo Sapiens; identical to SEQ ID NO: 430409

SEQ ID NO: 564614 - RNA, 64 nt, Homo Sapiens; identical to SEQ ID NO: 430410

SEQ ID NO: 564615 - RNA, 64 nt, Homo Sapiens; identical to SEQ ID NO: 430411

SEQ ID NO: 564616 - RNA, 64 nt, Homo Sapiens; identical to SEQ ID NO: 430412

SEQ ID NO: 564617 - RNA, 64 nt, Homo Sapiens; identical to SEQ ID NO: 430413

SEQ ID NO: 564618 - RNA, 64 nt, Homo Sapiens; identical to SEQ ID NO: 430414

SEQ ID NO: 564619 - RNA, 64 nt, Homo Sapiens; identical to SEQ ID NO: 430415

SEQ ID NO: 564620 - RNA, 64 nt, Homo Sapiens; identical to SEQ ID NO: 430416

SEQ ID NO: 564621 - RNA, 64 nt, Homo Sapiens; identical to SEQ ID NO: 430417

SEQ ID NO: 564622 - RNA, 64 nt, Homo Sapiens; identical to SEQ ID NO: 430418

SEQ ID NO: 564623 - RNA, 64 nt, Homo Sapiens; identical to SEQ ID NO: 430419

SEQ ID NO: 564624 - RNA, 64 nt, Homo Sapiens; identical to SEQ ID NO: 430420

SEQ ID NO: 564625 - RNA, 64 nt, Homo Sapiens; identical to SEQ ID NO: 430421

SEQ ID NO: 564626 - RNA, 64 nt, Homo Sapiens; identical to SEQ ID NO: 430422

SEQ ID NO: 564627 - RNA, 64 nt, Homo Sapiens; identical to SEQ ID NO: 430423

SEQ ID NO: 564628 - RNA, 64 nt, Homo Sapiens; identical to SEQ ID NO: 430424

SEQ ID NO: 564629 - RNA, 64 nt, Homo Sapiens; identical to SEQ ID NO: 430425

SEQ ID NO: 564630 - RNA, 64 nt, Homo Sapiens; identical to SEQ ID NO: 430426

SEQ ID NO: 564631 - RNA, 64 nt, Homo Sapiens; identical to SEQ ID NO: 430427

SEQ ID NO: 564632 - RNA, 64 nt, Homo Sapiens; identical to SEQ ID NO: 430428

SEQ ID NO: 564633 - RNA, 64 nt, Homo Sapiens; identical to SEQ ID NO: 430429

SEQ ID NO: 564634 - RNA, 64 nt, Homo Sapiens; identical to SEQ ID NO: 430430

SEQ ID NO: 564635 - RNA, 64 nt, Homo Sapiens; identical to SEQ ID NO: 430431

SEQ ID NO: 564636 - RNA, 64 nt, Homo Sapiens; identical to SEQ ID NO: 430432

SEQ ID NO: 564637 - RNA, 64 nt, Homo Sapiens; identical to SEQ ID NO: 430433

SEQ ID NO: 564638 - RNA, 64 nt, Homo Sapiens; identical to SEQ ID NO: 430434

SEQ ID NO: 564639 - RNA, 64 nt, Homo Sapiens; identical to SEQ ID NO: 430435

SEQ ID NO: 564640 - RNA, 64 nt, Homo Sapiens; identical to SEQ ID NO: 430436

SEQ ID NO: 564641 - RNA, 64 nt, Homo Sapiens; identical to SEQ ID NO: 430437

SEQ ID NO: 564642 - RNA, 64 nt, Homo Sapiens; identical to SEQ ID NO: 430438

SEQ ID NO: 564643 - RNA, 64 nt, Homo Sapiens; identical to SEQ ID NO: 430439

SEQ ID NO: 564644 - RNA, 64 nt, Homo Sapiens; identical to SEQ ID NO: 430440

SEQ ID NO: 564645 - RNA, 64 nt, Homo Sapiens; identical to SEQ ID NO: 430441

SEQ ID NO: 564646 - RNA, 64 nt, Homo Sapiens; identical to SEQ ID NO: 430442

SEQ ID NO: 564647 - RNA, 64 nt, Homo Sapiens; identical to SEQ ID NO: 430443

SEQ ID NO: 564648 - RNA, 64 nt, Homo Sapiens; identical to SEQ ID NO: 430444

SEQ ID NO: 564649 - RNA, 64 nt, Homo Sapiens; identical to SEQ ID NO: 430445

SEQ ID NO: 564650 - RNA, 64 nt, Homo Sapiens; identical to SEQ ID NO: 430446

SEQ ID NO: 564651 - RNA, 64 nt, Homo Sapiens; identical to SEQ ID NO: 430447

SEQ ID NO: 564652 - RNA, 64 nt, Homo Sapiens; identical to SEQ ID NO: 430448

SEQ ID NO: 564653 - RNA, 64 nt, Homo Sapiens; identical to SEQ ID NO: 430449

SEQ ID NO: 564654 - RNA, 64 nt, Homo Sapiens; identical to SEQ ID NO: 165419

SEQ ID NO: 564655 - RNA, 64 nt, Homo Sapiens; identical to SEQ ID NO: 165420

SEQ ID NO: 564656 - RNA, 64 nt, Homo Sapiens; identical to SEQ ID NO: 165421

SEQ ID NO: 564657 - RNA, 64 nt, Homo Sapiens; identical to SEQ ID NO: 165422

SEQ ID NO: 564658 - RNA, 64 nt, Homo Sapiens; identical to SEQ ID NO: 165423

SEQ ID NO: 564659 - RNA, 64 nt, Homo Sapiens; identical to SEQ ID NO: 165424

SEQ ID NO: 564660 - RNA, 64 nt, Homo Sapiens; identical to SEQ ID NO: 165425

SEQ ID NO: 564661 - RNA, 64 nt, Homo Sapiens; identical to SEQ ID NO: 165426

SEQ ID NO: 564662 - RNA, 64 nt, Homo Sapiens; identical to SEQ ID NO: 165427

SEQ ID NO: 564663 - RNA, 64 nt, Homo Sapiens; identical to SEQ ID NO: 165428

SEQ ID NO: 564664 - RNA, 64 nt, Homo Sapiens; identical to SEQ ID NO: 165429

SEQ ID NO: 564665 - RNA, 64 nt, Homo Sapiens; identical to SEQ ID NO: 165430

SEQ ID NO: 564666 - RNA, 64 nt, Homo Sapiens; identical to SEQ ID NO: 165431

SEQ ID NO: 564667 - RNA, 64 nt, Homo Sapiens; identical to SEQ ID NO: 165432

SEQ ID NO: 564668 - RNA, 64 nt, Homo Sapiens; identical to SEQ ID NO: 165433

SEQ ID NO: 564669 - RNA, 64 nt, Homo Sapiens; identical to SEQ ID NO: 165434

SEQ ID NO: 564670 - RNA, 64 nt, Homo Sapiens; identical to SEQ ID NO: 165435

SEQ ID NO: 564671 - RNA, 64 nt, Homo Sapiens; identical to SEQ ID NO: 165436

SEQ ID NO: 564672 - RNA, 64 nt, Homo Sapiens; identical to SEQ ID NO: 165437

SEQ ID NO: 564673 - RNA, 64 nt, Homo Sapiens; identical to SEQ ID NO: 165438

SEQ ID NO: 564674 - RNA, 64 nt, Homo Sapiens; identical to SEQ ID NO: 165439

SEQ ID NO: 564675 - RNA, 64 nt, Homo Sapiens; identical to SEQ ID NO: 165440

SEQ ID NO: 564676 - RNA, 64 nt, Homo Sapiens; identical to SEQ ID NO: 165441

SEQ ID NO: 564677 - RNA, 64 nt, Homo Sapiens; identical to SEQ ID NO: 165442

SEQ ID NO: 564678 - RNA, 64 nt, Homo Sapiens; identical to SEQ ID NO: 165443

SEQ ID NO: 564679 - RNA, 64 nt, Homo Sapiens; identical to SEQ ID NO: 165444

SEQ ID NO: 564680 - RNA, 64 nt, Homo Sapiens; identical to SEQ ID NO: 165445

SEQ ID NO: 564681 - RNA, 64 nt, Homo Sapiens; identical to SEQ ID NO: 165446

SEQ ID NO: 564682 - RNA, 64 nt, Homo Sapiens; identical to SEQ ID NO: 165447

SEQ ID NO: 564683 - RNA, 64 nt, Homo Sapiens; identical to SEQ ID NO: 165448

SEQ ID NO: 564684 - RNA, 64 nt, Homo Sapiens; identical to SEQ ID NO: 165449

SEQ ID NO: 564685 - RNA, 64 nt, Homo Sapiens; identical to SEQ ID NO: 165450

SEQ ID NO: 564686 - RNA, 64 nt, Homo Sapiens; identical to SEQ ID NO: 165451

SEQ ID NO: 564687 - RNA, 64 nt, Homo Sapiens; identical to SEQ ID NO: 165452

SEQ ID NO: 564688 - RNA, 64 nt, Homo Sapiens; identical to SEQ ID NO: 165453

SEQ ID NO: 564689 - RNA, 64 nt, Homo Sapiens; identical to SEQ ID NO: 165454

SEQ ID NO: 564690 - RNA, 64 nt, Homo Sapiens; identical to SEQ ID NO: 165455

SEQ ID NO: 564691 - RNA, 64 nt, Homo Sapiens; identical to SEQ ID NO: 165456

SEQ ID NO: 564692 - RNA, 64 nt, Homo Sapiens; identical to SEQ ID NO: 165457

SEQ ID NO: 564693 - RNA, 64 nt, Homo Sapiens; identical to SEQ ID NO: 165458

SEQ ID NO: 564694 - RNA, 64 nt, Homo Sapiens; identical to SEQ ID NO: 165459

SEQ ID NO: 564695 - RNA, 64 nt, Homo Sapiens; identical to SEQ ID NO: 165460

SEQ ID NO: 564696 - RNA, 64 nt, Homo Sapiens; identical to SEQ ID NO: 165461

SEQ ID NO: 564697 - RNA, 64 nt, Homo Sapiens; identical to SEQ ID NO: 165462

SEQ ID NO: 564698 - RNA, 64 nt, Homo Sapiens; identical to SEQ ID NO: 165463

SEQ ID NO: 564699 - RNA, 64 nt, Homo Sapiens; identical to SEQ ID NO: 165464

SEQ ID NO: 564700 - RNA, 63 nt, Homo Sapiens; identical to SEQ ID NO: 165465

SEQ ID NO: 564701 - RNA, 64 nt, Homo Sapiens; identical to SEQ ID NO: 165466

SEQ ID NO: 564702 - RNA, 64 nt, Homo Sapiens; identical to SEQ ID NO: 165467

SEQ ID NO: 564703 - RNA, 64 nt, Homo Sapiens; identical to SEQ ID NO: 165468

SEQ ID NO: 564704 - RNA, 64 nt, Homo Sapiens; identical to SEQ ID NO: 165469

SEQ ID NO: 564705 - RNA, 64 nt, Homo Sapiens; identical to SEQ ID NO: 165470

SEQ ID NO: 564706 - RNA, 64 nt, Homo Sapiens; identical to SEQ ID NO: 165471

SEQ ID NO: 564707 - RNA, 64 nt, Homo Sapiens; identical to SEQ ID NO: 165472

SEQ ID NO: 564708 - RNA, 64 nt, Homo Sapiens; identical to SEQ ID NO: 165473

SEQ ID NO: 564709 - RNA, 64 nt, Homo Sapiens; identical to SEQ ID NO: 165474

SEQ ID NO: 564710 - RNA, 64 nt, Homo Sapiens; identical to SEQ ID NO: 165475

SEQ ID NO: 564711 - RNA, 64 nt, Homo Sapiens; identical to SEQ ID NO: 165476

SEQ ID NO: 564712 - RNA, 64 nt, Homo Sapiens; identical to SEQ ID NO: 165477

SEQ ID NO: 564713 - RNA, 64 nt, Homo Sapiens; identical to SEQ ID NO: 165478

SEQ ID NO: 564714 - RNA, 64 nt, Homo Sapiens; identical to SEQ ID NO: 165479

SEQ ID NO: 564715 - RNA, 64 nt, Homo Sapiens; identical to SEQ ID NO: 165480

SEQ ID NO: 564716 - RNA, 64 nt, Homo Sapiens; identical to SEQ ID NO: 165481

SEQ ID NO: 564717 - RNA, 64 nt, Homo Sapiens; identical to SEQ ID NO: 165482

SEQ ID NO: 564718 - RNA, 64 nt, Homo Sapiens; identical to SEQ ID NO: 165483

SEQ ID NO: 564719 - RNA, 64 nt, Homo Sapiens; identical to SEQ ID NO: 165484

SEQ ID NO: 564720 - RNA, 64 nt, Homo Sapiens; identical to SEQ ID NO: 165485

SEQ ID NO: 564721 - RNA, 64 nt, Homo Sapiens
gucuucaugagucuccugggcccaaagccaucuucugauggaaggaagagaguagggccaguga

SEQ ID NO: 564722 - RNA, 64 nt, Homo Sapiens
gcugagcggcagaaacuugucucauaaauuggcacugauggagcaucagcuguggcccacagag

SEQ ID NO: 564723 - RNA, 64 nt, Homo Sapiens
acuggauuuucagaccugcugaggaccguaaggccugauggaacacagaacugaacugagguuc

SEQ ID NO: 564724 - RNA, 64 nt, Homo Sapiens
acaugcccauuacuaacggcaaaagggggauucccugauggaaccauaauacccuuggaaauac

SEQ ID NO: 564725 - RNA, 64 nt, Homo Sapiens
gcaugggccaugugagaagaucgccaggaucuuccugauggaagcugacuugggcguggaaguc

SEQ ID NO: 564726 - RNA, 64 nt, Homo Sapiens
aauuccccagauacugaacaauuuguguuugugacugauggagaauuucaggaaugaaugagaa

SEQ ID NO: 564727 - RNA, 64 nt, Homo Sapiens
ggcaaugaaaagcguggauucuccuuaacaucaucugauggaauaggugacuggaucuguguuc

SEQ ID NO: 564728 - RNA, 64 nt, Homo Sapiens
gcuucuccaugcuggagaagugguucugucccagcugauggaugccccagcgcgccccuggccc

SEQ ID NO: 564729 - RNA, 64 nt, Homo Sapiens
auacuucuugguggacuccaugcugaaaagaucccugauggacauuccccagcaguuuagugcc

SEQ ID NO: 564730 - RNA, 64 nt, Homo Sapiens
gagccagguggaaugccauaucugcuaguagagacugauggagacugggucauuugggaguggc

SEQ ID NO: 564731 - RNA, 64 nt, Homo Sapiens
caucaccaugaugugguagcuugugacuuuucuccugauggagcauuacuggcuacugcaucuu

SEQ ID NO: 564732 - RNA, 64 nt, Homo Sapiens
aguauauaucugggauccacauaauggagacauucugauggaauuuggguggguacagcaugaa

SEQ ID NO: 564733 - RNA, 64 nt, Homo Sapiens
gcgggauucccgcuucugaagagccaacacccuucugauggaagacccuucugauggaaggugg

SEQ ID NO: 564734 - RNA, 64 nt, Homo Sapiens
gugggagccaacacccuucugagccaacacccuucugauggaagacccuucugauggaaggugg

SEQ ID NO: 564735 - RNA, 64 nt, Homo Sapiens; identical to SEQ ID NO: 564734

SEQ ID NO: 564736 - RNA, 64 nt, Homo Sapiens; identical to SEQ ID NO: 564734

SEQ ID NO: 564737 - RNA, 64 nt, Homo Sapiens
gugggagccaacacccuucugagccaacacccuucugauggaagcaucuucugauggaaggugg

SEQ ID NO: 564738 - RNA, 64 nt, Homo Sapiens
gugggagccaacacccuucuugggccagcaucuucugauggaagagaagccuuucagguuuccc

SEQ ID NO: 564739 - RNA, 64 nt, Homo Sapiens
ggaaacgugugugucaguuggaccaugugggacccugauggaccugaaagaccaggaucggucc

SEQ ID NO: 564740 - RNA, 64 nt, Homo Sapiens
gcugucggcugaugaggaggcggccgccccagugcugauggagaugccacuuucgugugacugc

SEQ ID NO: 564741 - RNA, 64 nt, Homo Sapiens
cccccucauuagcagggcuuaucugggggagcugcugauggaguccucgcugcucaugcccaca

SEQ ID NO: 564742 - RNA, 64 nt, Homo Sapiens
gguguuuagacacagauaggaguccaggguaugacugauggaggccccggcccacgugaccagc

SEQ ID NO: 564743 - RNA, 64 nt, Homo Sapiens; identical to SEQ ID NO: 98311

SEQ ID NO: 564744 - RNA, 64 nt, Homo Sapiens; identical to SEQ ID NO: 98312

SEQ ID NO: 564745 - RNA, 64 nt, Homo Sapiens; identical to SEQ ID NO: 98313

SEQ ID NO: 564746 - RNA, 64 nt, Homo Sapiens; identical to SEQ ID NO: 98314

SEQ ID NO: 564747 - RNA, 64 nt, Homo Sapiens; identical to SEQ ID NO: 98315

SEQ ID NO: 564748 - RNA, 64 nt, Homo Sapiens; identical to SEQ ID NO: 98316

SEQ ID NO: 564749 - RNA, 64 nt, Homo Sapiens; identical to SEQ ID NO: 98317

SEQ ID NO: 564750 - RNA, 64 nt, Homo Sapiens; identical to SEQ ID NO: 98318

SEQ ID NO: 564751 - RNA, 64 nt, Homo Sapiens; identical to SEQ ID NO: 98319

SEQ ID NO: 564752 - RNA, 64 nt, Homo Sapiens; identical to SEQ ID NO: 98320

SEQ ID NO: 564753 - RNA, 64 nt, Homo Sapiens; identical to SEQ ID NO: 98321

SEQ ID NO: 564754 - RNA, 64 nt, Homo Sapiens; identical to SEQ ID NO: 98322

SEQ ID NO: 564755 - RNA, 64 nt, Homo Sapiens; identical to SEQ ID NO: 98323

SEQ ID NO: 564756 - RNA, 64 nt, Homo Sapiens; identical to SEQ ID NO: 98324

SEQ ID NO: 564757 - RNA, 64 nt, Homo Sapiens; identical to SEQ ID NO: 98325

SEQ ID NO: 564758 - RNA, 64 nt, Homo Sapiens; identical to SEQ ID NO: 98326

SEQ ID NO: 564759 - RNA, 64 nt, Homo Sapiens; identical to SEQ ID NO: 98327

SEQ ID NO: 564760 - RNA, 64 nt, Homo Sapiens; identical to SEQ ID NO: 98328

SEQ ID NO: 564761 - RNA, 64 nt, Homo Sapiens; identical to SEQ ID NO: 98329

SEQ ID NO: 564762 - RNA, 64 nt, Homo Sapiens; identical to SEQ ID NO: 98330

SEQ ID NO: 564763 - RNA, 64 nt, Homo Sapiens; identical to SEQ ID NO: 98331

SEQ ID NO: 564764 - RNA, 64 nt, Homo Sapiens; identical to SEQ ID NO: 98332

SEQ ID NO: 564765 - RNA, 64 nt, Homo Sapiens; identical to SEQ ID NO: 98333

SEQ ID NO: 564766 - RNA, 64 nt, Homo Sapiens; identical to SEQ ID NO: 98334

SEQ ID NO: 564767 - RNA, 64 nt, Homo Sapiens; identical to SEQ ID NO: 98335

SEQ ID NO: 564768 - RNA, 64 nt, Homo Sapiens; identical to SEQ ID NO: 98336

SEQ ID NO: 564769 - RNA, 64 nt, Homo Sapiens; identical to SEQ ID NO: 98337

SEQ ID NO: 564770 - RNA, 64 nt, Homo Sapiens; identical to SEQ ID NO: 98338

SEQ ID NO: 564771 - RNA, 64 nt, Homo Sapiens; identical to SEQ ID NO: 98339

SEQ ID NO: 564772 - RNA, 64 nt, Homo Sapiens; identical to SEQ ID NO: 98340

SEQ ID NO: 564773 - RNA, 64 nt, Homo Sapiens; identical to SEQ ID NO: 98341

SEQ ID NO: 564774 - RNA, 64 nt, Homo Sapiens; identical to SEQ ID NO: 98342

SEQ ID NO: 564775 - RNA, 64 nt, Homo Sapiens; identical to SEQ ID NO: 98343

SEQ ID NO: 564776 - RNA, 64 nt, Homo Sapiens; identical to SEQ ID NO: 98344

SEQ ID NO: 564777 - RNA, 64 nt, Homo Sapiens; identical to SEQ ID NO: 98345

SEQ ID NO: 564778 - RNA, 64 nt, Homo Sapiens; identical to SEQ ID NO: 98346

SEQ ID NO: 564779 - RNA, 64 nt, Homo Sapiens; identical to SEQ ID NO: 98347

SEQ ID NO: 564780 - RNA, 64 nt, Homo Sapiens; identical to SEQ ID NO: 98348

SEQ ID NO: 564781 - RNA, 64 nt, Homo Sapiens; identical to SEQ ID NO: 98349

SEQ ID NO: 564782 - RNA, 64 nt, Homo Sapiens; identical to SEQ ID NO: 98350

SEQ ID NO: 564783 - RNA, 64 nt, Homo Sapiens; identical to SEQ ID NO: 98351

SEQ ID NO: 564784 - RNA, 64 nt, Homo Sapiens; identical to SEQ ID NO: 98352

SEQ ID NO: 564785 - RNA, 64 nt, Homo Sapiens; identical to SEQ ID NO: 98353

SEQ ID NO: 564786 - RNA, 64 nt, Homo Sapiens; identical to SEQ ID NO: 98354

SEQ ID NO: 564787 - RNA, 64 nt, Homo Sapiens; identical to SEQ ID NO: 98355

SEQ ID NO: 564788 - RNA, 64 nt, Homo Sapiens; identical to SEQ ID NO: 98356

SEQ ID NO: 564789 - RNA, 64 nt, Homo Sapiens; identical to SEQ ID NO: 98357

SEQ ID NO: 564790 - RNA, 64 nt, Homo Sapiens; identical to SEQ ID NO: 98358

SEQ ID NO: 564791 - RNA, 64 nt, Homo Sapiens; identical to SEQ ID NO: 98359

SEQ ID NO: 564792 - RNA, 64 nt, Homo Sapiens; identical to SEQ ID NO: 98360

SEQ ID NO: 564793 - RNA, 64 nt, Homo Sapiens; identical to SEQ ID NO: 98361

SEQ ID NO: 564794 - RNA, 64 nt, Homo Sapiens; identical to SEQ ID NO: 98362

SEQ ID NO: 564795 - RNA, 64 nt, Homo Sapiens; identical to SEQ ID NO: 98363

SEQ ID NO: 564796 - RNA, 64 nt, Homo Sapiens; identical to SEQ ID NO: 98364

SEQ ID NO: 564797 - RNA, 64 nt, Homo Sapiens; identical to SEQ ID NO: 98365

SEQ ID NO: 564798 - RNA, 64 nt, Homo Sapiens; identical to SEQ ID NO: 98366

SEQ ID NO: 564799 - RNA, 64 nt, Homo Sapiens; identical to SEQ ID NO: 98367

SEQ ID NO: 564800 - RNA, 64 nt, Homo Sapiens; identical to SEQ ID NO: 98368

SEQ ID NO: 564801 - RNA, 64 nt, Homo Sapiens; identical to SEQ ID NO: 98369

SEQ ID NO: 564802 - RNA, 64 nt, Homo Sapiens; identical to SEQ ID NO: 98370

SEQ ID NO: 564803 - RNA, 64 nt, Homo Sapiens; identical to SEQ ID NO: 98371

SEQ ID NO: 564804 - RNA, 64 nt, Homo Sapiens; identical to SEQ ID NO: 98372

SEQ ID NO: 564805 - RNA, 64 nt, Homo Sapiens; identical to SEQ ID NO: 98373

SEQ ID NO: 564806 - RNA, 64 nt, Homo Sapiens; identical to SEQ ID NO: 98374

SEQ ID NO: 564807 - RNA, 64 nt, Homo Sapiens; identical to SEQ ID NO: 98375

SEQ ID NO: 564808 - RNA, 64 nt, Homo Sapiens; identical to SEQ ID NO: 98376

SEQ ID NO: 564809 - RNA, 64 nt, Homo Sapiens; identical to SEQ ID NO: 98377

SEQ ID NO: 564810 - RNA, 64 nt, Homo Sapiens; identical to SEQ ID NO: 98378

SEQ ID NO: 564811 - RNA, 64 nt, Homo Sapiens; identical to SEQ ID NO: 98379

SEQ ID NO: 564812 - RNA, 64 nt, Homo Sapiens; identical to SEQ ID NO: 98380

SEQ ID NO: 564813 - RNA, 64 nt, Homo Sapiens; identical to SEQ ID NO: 98381

SEQ ID NO: 564814 - RNA, 64 nt, Homo Sapiens; identical to SEQ ID NO: 98382

SEQ ID NO: 564815 - RNA, 64 nt, Homo Sapiens; identical to SEQ ID NO: 98383

SEQ ID NO: 564816 - RNA, 64 nt, Homo Sapiens; identical to SEQ ID NO: 98384

SEQ ID NO: 564817 - RNA, 64 nt, Homo Sapiens; identical to SEQ ID NO: 98385

SEQ ID NO: 564818 - RNA, 64 nt, Homo Sapiens; identical to SEQ ID NO: 98386

SEQ ID NO: 564819 - RNA, 64 nt, Homo Sapiens; identical to SEQ ID NO: 98387

SEQ ID NO: 564820 - RNA, 64 nt, Homo Sapiens; identical to SEQ ID NO: 98388

SEQ ID NO: 564821 - RNA, 64 nt, Homo Sapiens; identical to SEQ ID NO: 98389

SEQ ID NO: 564822 - RNA, 64 nt, Homo Sapiens; identical to SEQ ID NO: 98390

SEQ ID NO: 564823 - RNA, 64 nt, Homo Sapiens; identical to SEQ ID NO: 98391

SEQ ID NO: 564824 - RNA, 64 nt, Homo Sapiens; identical to SEQ ID NO: 98392

SEQ ID NO: 564825 - RNA, 64 nt, Homo Sapiens; identical to SEQ ID NO: 98393

SEQ ID NO: 564826 - RNA, 64 nt, Homo Sapiens; identical to SEQ ID NO: 98394

SEQ ID NO: 564827 - RNA, 64 nt, Homo Sapiens; identical to SEQ ID NO: 98395

SEQ ID NO: 564828 - RNA, 64 nt, Homo Sapiens; identical to SEQ ID NO: 98396

SEQ ID NO: 564829 - RNA, 64 nt, Homo Sapiens; identical to SEQ ID NO: 98397

SEQ ID NO: 564830 - RNA, 64 nt, Homo Sapiens; identical to SEQ ID NO: 98398

SEQ ID NO: 564831 - RNA, 64 nt, Homo Sapiens; identical to SEQ ID NO: 98399

SEQ ID NO: 564832 - RNA, 64 nt, Homo Sapiens; identical to SEQ ID NO: 98400

SEQ ID NO: 564833 - RNA, 64 nt, Homo Sapiens; identical to SEQ ID NO: 98401

SEQ ID NO: 564834 - RNA, 64 nt, Homo Sapiens; identical to SEQ ID NO: 98402

SEQ ID NO: 564835 - RNA, 64 nt, Homo Sapiens; identical to SEQ ID NO: 98403

SEQ ID NO: 564836 - RNA, 64 nt, Homo Sapiens; identical to SEQ ID NO: 98404

SEQ ID NO: 564837 - RNA, 64 nt, Homo Sapiens; identical to SEQ ID NO: 98405

SEQ ID NO: 564838 - RNA, 64 nt, Homo Sapiens; identical to SEQ ID NO: 98406

SEQ ID NO: 564839 - RNA, 64 nt, Homo Sapiens; identical to SEQ ID NO: 98407

SEQ ID NO: 564840 - RNA, 64 nt, Homo Sapiens; identical to SEQ ID NO: 98408

SEQ ID NO: 564841 - RNA, 64 nt, Homo Sapiens; identical to SEQ ID NO: 98409

SEQ ID NO: 564842 - RNA, 64 nt, Homo Sapiens; identical to SEQ ID NO: 98410

SEQ ID NO: 564843 - RNA, 64 nt, Homo Sapiens; identical to SEQ ID NO: 98411

SEQ ID NO: 564844 - RNA, 64 nt, Homo Sapiens; identical to SEQ ID NO: 98412

SEQ ID NO: 564845 - RNA, 64 nt, Homo Sapiens; identical to SEQ ID NO: 98413

SEQ ID NO: 564846 - RNA, 64 nt, Homo Sapiens; identical to SEQ ID NO: 98414

SEQ ID NO: 564847 - RNA, 64 nt, Homo Sapiens; identical to SEQ ID NO: 98415

SEQ ID NO: 564848 - RNA, 64 nt, Homo Sapiens; identical to SEQ ID NO: 98416

SEQ ID NO: 564849 - RNA, 64 nt, Homo Sapiens; identical to SEQ ID NO: 98417

SEQ ID NO: 564850 - RNA, 64 nt, Homo Sapiens; identical to SEQ ID NO: 98418

SEQ ID NO: 564851 - RNA, 64 nt, Homo Sapiens; identical to SEQ ID NO: 98419

SEQ ID NO: 564852 - RNA, 64 nt, Homo Sapiens; identical to SEQ ID NO: 98420

SEQ ID NO: 564853 - RNA, 64 nt, Homo Sapiens; identical to SEQ ID NO: 98421

SEQ ID NO: 564854 - RNA, 64 nt, Homo Sapiens; identical to SEQ ID NO: 98422

SEQ ID NO: 564855 - RNA, 64 nt, Homo Sapiens; identical to SEQ ID NO: 98423

SEQ ID NO: 564856 - RNA, 64 nt, Homo Sapiens; identical to SEQ ID NO: 98424

SEQ ID NO: 564857 - RNA, 64 nt, Homo Sapiens; identical to SEQ ID NO: 98425

SEQ ID NO: 564858 - RNA, 64 nt, Homo Sapiens; identical to SEQ ID NO: 98426

SEQ ID NO: 564859 - RNA, 64 nt, Homo Sapiens; identical to SEQ ID NO: 98427

SEQ ID NO: 564860 - RNA, 64 nt, Homo Sapiens; identical to SEQ ID NO: 98428

SEQ ID NO: 564861 - RNA, 64 nt, Homo Sapiens; identical to SEQ ID NO: 98429

SEQ ID NO: 564862 - RNA, 64 nt, Homo Sapiens; identical to SEQ ID NO: 98430

SEQ ID NO: 564863 - RNA, 64 nt, Homo Sapiens; identical to SEQ ID NO: 98431

SEQ ID NO: 564864 - RNA, 64 nt, Homo Sapiens; identical to SEQ ID NO: 98432

SEQ ID NO: 564865 - RNA, 64 nt, Homo Sapiens; identical to SEQ ID NO: 98433

SEQ ID NO: 564866 - RNA, 64 nt, Homo Sapiens; identical to SEQ ID NO: 98434

SEQ ID NO: 564867 - RNA, 64 nt, Homo Sapiens; identical to SEQ ID NO: 98435

SEQ ID NO: 564868 - RNA, 64 nt, Homo Sapiens; identical to SEQ ID NO: 98436

SEQ ID NO: 564869 - RNA, 64 nt, Homo Sapiens; identical to SEQ ID NO: 98437

SEQ ID NO: 564870 - RNA, 64 nt, Homo Sapiens; identical to SEQ ID NO: 98438

SEQ ID NO: 564871 - RNA, 64 nt, Homo Sapiens; identical to SEQ ID NO: 98439

SEQ ID NO: 564872 - RNA, 64 nt, Homo Sapiens; identical to SEQ ID NO: 98440

SEQ ID NO: 564873 - RNA, 64 nt, Homo Sapiens; identical to SEQ ID NO: 98441

SEQ ID NO: 564874 - RNA, 64 nt, Homo Sapiens; identical to SEQ ID NO: 98442

SEQ ID NO: 564875 - RNA, 64 nt, Homo Sapiens; identical to SEQ ID NO: 98443

SEQ ID NO: 564876 - RNA, 64 nt, Homo Sapiens; identical to SEQ ID NO: 98444

SEQ ID NO: 564877 - RNA, 64 nt, Homo Sapiens; identical to SEQ ID NO: 98445

SEQ ID NO: 564878 - RNA, 64 nt, Homo Sapiens; identical to SEQ ID NO: 98446

SEQ ID NO: 564879 - RNA, 64 nt, Homo Sapiens; identical to SEQ ID NO: 98447

SEQ ID NO: 564880 - RNA, 64 nt, Homo Sapiens; identical to SEQ ID NO: 98448

SEQ ID NO: 564881 - RNA, 64 nt, Homo Sapiens; identical to SEQ ID NO: 98449

SEQ ID NO: 564882 - RNA, 64 nt, Homo Sapiens; identical to SEQ ID NO: 98450

SEQ ID NO: 564883 - RNA, 64 nt, Homo Sapiens; identical to SEQ ID NO: 98451

SEQ ID NO: 564884 - RNA, 64 nt, Homo Sapiens; identical to SEQ ID NO: 98452

SEQ ID NO: 564885 - RNA, 64 nt, Homo Sapiens; identical to SEQ ID NO: 98453

SEQ ID NO: 564886 - RNA, 64 nt, Homo Sapiens; identical to SEQ ID NO: 98454

SEQ ID NO: 564887 - RNA, 64 nt, Homo Sapiens; identical to SEQ ID NO: 98455

SEQ ID NO: 564888 - RNA, 64 nt, Homo Sapiens; identical to SEQ ID NO: 98456

SEQ ID NO: 564889 - RNA, 64 nt, Homo Sapiens; identical to SEQ ID NO: 98457

SEQ ID NO: 564890 - RNA, 64 nt, Homo Sapiens; identical to SEQ ID NO: 98458

SEQ ID NO: 564891 - RNA, 64 nt, Homo Sapiens; identical to SEQ ID NO: 98459

SEQ ID NO: 564892 - RNA, 64 nt, Homo Sapiens; identical to SEQ ID NO: 98460

SEQ ID NO: 564893 - RNA, 64 nt, Homo Sapiens; identical to SEQ ID NO: 98461

SEQ ID NO: 564894 - RNA, 64 nt, Homo Sapiens; identical to SEQ ID NO: 98462

SEQ ID NO: 564895 - RNA, 64 nt, Homo Sapiens; identical to SEQ ID NO: 98463

SEQ ID NO: 564896 - RNA, 64 nt, Homo Sapiens; identical to SEQ ID NO: 98464

SEQ ID NO: 564897 - RNA, 64 nt, Homo Sapiens; identical to SEQ ID NO: 98465

SEQ ID NO: 564898 - RNA, 64 nt, Homo Sapiens; identical to SEQ ID NO: 98466

SEQ ID NO: 564899 - RNA, 64 nt, Homo Sapiens; identical to SEQ ID NO: 98467

SEQ ID NO: 564900 - RNA, 64 nt, Homo Sapiens; identical to SEQ ID NO: 98468

SEQ ID NO: 564901 - RNA, 64 nt, Homo Sapiens; identical to SEQ ID NO: 98469

SEQ ID NO: 564902 - RNA, 64 nt, Homo Sapiens; identical to SEQ ID NO: 98470

SEQ ID NO: 564903 - RNA, 64 nt, Homo Sapiens; identical to SEQ ID NO: 98471

SEQ ID NO: 564904 - RNA, 64 nt, Homo Sapiens; identical to SEQ ID NO: 98472

SEQ ID NO: 564905 - RNA, 64 nt, Homo Sapiens; identical to SEQ ID NO: 98473

SEQ ID NO: 564906 - RNA, 64 nt, Homo Sapiens; identical to SEQ ID NO: 98474

SEQ ID NO: 564907 - RNA, 64 nt, Homo Sapiens; identical to SEQ ID NO: 98475

SEQ ID NO: 564908 - RNA, 64 nt, Homo Sapiens; identical to SEQ ID NO: 98476

SEQ ID NO: 564909 - RNA, 64 nt, Homo Sapiens; identical to SEQ ID NO: 98477

SEQ ID NO: 564910 - RNA, 64 nt, Homo Sapiens; identical to SEQ ID NO: 98478

SEQ ID NO: 564911 - RNA, 64 nt, Homo Sapiens; identical to SEQ ID NO: 98479

SEQ ID NO: 564912 - RNA, 64 nt, Homo Sapiens; identical to SEQ ID NO: 98480

SEQ ID NO: 564913 - RNA, 64 nt, Homo Sapiens; identical to SEQ ID NO: 98481

SEQ ID NO: 564914 - RNA, 64 nt, Homo Sapiens; identical to SEQ ID NO: 98482

SEQ ID NO: 564915 - RNA, 64 nt, Homo Sapiens; identical to SEQ ID NO: 98483

SEQ ID NO: 564916 - RNA, 64 nt, Homo Sapiens; identical to SEQ ID NO: 98484

SEQ ID NO: 564917 - RNA, 64 nt, Homo Sapiens; identical to SEQ ID NO: 98485

SEQ ID NO: 564918 - RNA, 64 nt, Homo Sapiens; identical to SEQ ID NO: 98486

SEQ ID NO: 564919 - RNA, 64 nt, Homo Sapiens; identical to SEQ ID NO: 98487

SEQ ID NO: 564920 - RNA, 64 nt, Homo Sapiens; identical to SEQ ID NO: 98488

SEQ ID NO: 564921 - RNA, 64 nt, Homo Sapiens; identical to SEQ ID NO: 98489

SEQ ID NO: 564922 - RNA, 64 nt, Homo Sapiens; identical to SEQ ID NO: 98490

SEQ ID NO: 564923 - RNA, 64 nt, Homo Sapiens; identical to SEQ ID NO: 98491

SEQ ID NO: 564924 - RNA, 64 nt, Homo Sapiens; identical to SEQ ID NO: 98492

SEQ ID NO: 564925 - RNA, 64 nt, Homo Sapiens; identical to SEQ ID NO: 98493

SEQ ID NO: 564926 - RNA, 64 nt, Homo Sapiens; identical to SEQ ID NO: 98494

SEQ ID NO: 564927 - RNA, 64 nt, Homo Sapiens; identical to SEQ ID NO: 98495

SEQ ID NO: 564928 - RNA, 64 nt, Homo Sapiens; identical to SEQ ID NO: 98496

SEQ ID NO: 564929 - RNA, 64 nt, Homo Sapiens; identical to SEQ ID NO: 98497

SEQ ID NO: 564930 - RNA, 64 nt, Homo Sapiens; identical to SEQ ID NO: 98498

SEQ ID NO: 564931 - RNA, 64 nt, Homo Sapiens; identical to SEQ ID NO: 98499

SEQ ID NO: 564932 - RNA, 64 nt, Homo Sapiens; identical to SEQ ID NO: 98500

SEQ ID NO: 564933 - RNA, 64 nt, Homo Sapiens; identical to SEQ ID NO: 98501

SEQ ID NO: 564934 - RNA, 64 nt, Homo Sapiens; identical to SEQ ID NO: 98502

SEQ ID NO: 564935 - RNA, 64 nt, Homo Sapiens; identical to SEQ ID NO: 98503

SEQ ID NO: 564936 - RNA, 64 nt, Homo Sapiens; identical to SEQ ID NO: 98504

SEQ ID NO: 564937 - RNA, 64 nt, Homo Sapiens
aaaucuucagcccgguaugaaaacuuaaagguauauauucaauuuuuuaccauuuuauggaaaa

SEQ ID NO: 564938 - RNA, 64 nt, Homo Sapiens
uuugaaaaccaccaaaaaucaagggaacuuuuauauauucaauuccuuuucugguguaauguua

SEQ ID NO: 564939 - RNA, 64 nt, Homo Sapiens
uuccaucuaugaaaauuucaaugaaauggacagaauauucaauuagugguaagauaauuguaaa

SEQ ID NO: 564940 - RNA, 64 nt, Homo Sapiens
cagccauuugugugugcacauagagccuugcauuauauucaacauucuuaugguuaaagggaaa

SEQ ID NO: 564941 - RNA, 64 nt, Homo Sapiens
ugugaaacuaaaacuuuauguuacugcuuuguugauauucaaaguguuuucaugauuuuaggaa

SEQ ID NO: 564942 - RNA, 64 nt, Homo Sapiens
aguacaucuuccccccccccguuuugauguacacauauucaaaaaaguaaaaguuaacuuuuug

SEQ ID NO: 564943 - RNA, 64 nt, Homo Sapiens
ugcauauuaucuuuaaaaagauuauguucaaauaauauucaauacaaagauaauuuucuuuacu

SEQ ID NO: 564944 - RNA, 64 nt, Homo Sapiens
aagcucaaagauaauuuucuuuugcaaaugccauauauucaaaaugcauaagagcuaauguuau

SEQ ID NO: 564945 - RNA, 64 nt, Homo Sapiens
guuguaccuuaacauugguggaagacuacgcugcauauucaagauguuauucagaauaaagaga

SEQ ID NO: 564946 - RNA, 64 nt, Homo Sapiens
uaugguuuguaacugcuuuuuucauauuuuauucauauucaauucuuuaaaauuugugcucuuu

SEQ ID NO: 564947 - RNA, 64 nt, Homo Sapiens
aagaugauaaucuuaccuugcaguuauugacuuuauauucaauuauuuacaucaaauaaugaaa

SEQ ID NO: 564948 - RNA, 64 nt, Homo Sapiens
uaacugaaauguacaaaugucaaauuuuggaaguauauucaauaccaaugcuguaugagugggc

SEQ ID NO: 564949 - RNA, 64 nt, Homo Sapiens
ccuuuugaauguugaagauaggaaagaaagccauauauucaaauauguaauuuuccucauuuag

SEQ ID NO: 564950 - RNA, 64 nt, Homo Sapiens
uguuucuuucuuaauaguauccuaguuccagcauauauucaacaugaauuuuaucauucuccuc

SEQ ID NO: 564951 - RNA, 64 nt, Homo Sapiens
acagaagcucuggcaggaguugaagauagcccucauauucaagguagaugggauuuacuauagg

SEQ ID NO: 564952 - RNA, 64 nt, Homo Sapiens
ugaaauacaaaaauuauguuuauagggaacaugaauauucaagagauugcuuuucugaaggcag

SEQ ID NO: 564953 - RNA, 64 nt, Homo Sapiens
aaucuuguacauaacuauuuuugccuagaagucaauauucaauacaaguugggaguggagauca

SEQ ID NO: 564954 - RNA, 64 nt, Homo Sapiens
ugggaguggagaucauugccgcauuauuucaaacauauucaaguuuguauccauagaauaggca

SEQ ID NO: 564955 - RNA, 64 nt, Homo Sapiens
cuuuuauuuuuucucccgucuagccagaggugaaauauucaacggaggauuuguaugcucccug

SEQ ID NO: 564956 - RNA, 64 nt, Homo Sapiens
uucuccaguuguccccaaaacuaauauaugauccauauucaaaaaacacugauacugcauaaau

SEQ ID NO: 564957 - RNA, 64 nt, Homo Sapiens
uauauugugaagugugaaaagcugguagggagcgauauucaagagcagcugaggauacaaaugu

SEQ ID NO: 564958 - RNA, 64 nt, Homo Sapiens
caauggagaaacaaguuauaugugaauuauuugaauauucaaagaaauugaaagcuuuaaaaau

SEQ ID NO: 564959 - RNA, 64 nt, Homo Sapiens
uaagguuuaaguaauuugguuuaauaaucagaaaauauucaauacaguguuggauauucuguca

SEQ ID NO: 564960 - RNA, 64 nt, Homo Sapiens
agggagagaagggggcuguagaguuugaaaaagcauauucaauauuaaaauaguuuuauauuug

SEQ ID NO: 564961 - RNA, 64 nt, Homo Sapiens
acuguaagcccccuuuuggauagggcugggaaaaauauucaauaaacuugaauuugauuuaaaa

SEQ ID NO: 564962 - RNA, 64 nt, Homo Sapiens
uguguuuguuucccaugggauacuucuuuaaaaaauauucaaaaaguaaaauuagaaucagaaa

SEQ ID NO: 564963 - RNA, 64 nt, Homo Sapiens
aaucaaaacauacaauggcaaguaguaugcaugcauauucaagagacucuuccauuuuugcaag

SEQ ID NO: 564964 - RNA, 64 nt, Homo Sapiens
gaguauuuuauuaacaccugauuuguauuccauuauauucaaaaugcaucuuugguauugugcc

SEQ ID NO: 564965 - RNA, 64 nt, Homo Sapiens
agcuuaaauaaguugcuuugauuguuuauguguuauauucaauuaagcagaaacuuaagaaaaa

SEQ ID NO: 564966 - RNA, 64 nt, Homo Sapiens
uucauuuuuuccuuuuuccaaagaagaugaaauaauauucaaauuaauaauguuaaagacacuu

SEQ ID NO: 564967 - RNA, 64 nt, Homo Sapiens
aauacauguggcuaacaaguguaaggggugugagauauucaaaggcauaaaaauaguuuccuag

SEQ ID NO: 564968 - RNA, 64 nt, Homo Sapiens
uacaaauguauaaggcaguugcuuuaauauuucaauauucaaguaauaaugcaacuucgaguau

SEQ ID NO: 564969 - RNA, 64 nt, Homo Sapiens
uuuuuauaaaugaauuuuucauagaauuuacaguauauucaaaggaagaaagauaaaauuauug

SEQ ID NO: 564970 - RNA, 64 nt, Homo Sapiens
auuguuuaguuguuuucuccccugauuaauggugauauucaaguaugauacaaaaagaauugua

SEQ ID NO: 564971 - RNA, 64 nt, Homo Sapiens
guagcuucauccaauauaucgaguucgggacccaggguaaaaugugcaaaacagaaguaaauaa

SEQ ID NO: 564972 - RNA, 64 nt, Homo Sapiens
ucucugcaucacuuguuaaugugaccacuauuguggguaaaauggcugguagcuccagaauuuu

SEQ ID NO: 564973 - RNA, 64 nt, Homo Sapiens
agacuugguaauacagagauggacaaucguacugggguaaaaaaacccugcugaagagaggaca

SEQ ID NO: 564974 - RNA, 64 nt, Homo Sapiens
gugcuuugcaucuccaggcaguucucucacauuuggguaaaauguuuagcaggcuguaaacuua

SEQ ID NO: 564975 - RNA, 64 nt, Homo Sapiens
guaaaauguuuagcaggcuguaaacuuaagaaaaggguaaaauaaaauuuucuggagaggaacu

SEQ ID NO: 564976 - RNA, 64 nt, Homo Sapiens
ugguuguacaacuuuagcaucggggcugcuggaaggguaaaagcuaaauggaguuucuccugcu

SEQ ID NO: 564977 - RNA, 64 nt, Homo Sapiens
uguauuuaggaagugucaggauguucaaaggaaaggguaaaaaguguucauggggaaaaagcuc

SEQ ID NO: 564978 - RNA, 64 nt, Homo Sapiens
acucaggauauaguuggccuaauaaucggggcauggguaaaacuuaugaaaauuuccucaugcu

SEQ ID NO: 564979 - RNA, 64 nt, Homo Sapiens
uggcuguaaccuaaaccaacuguaaaggaguccuggguaaaaugcaggguccauuucucuugga

SEQ ID NO: 564980 - RNA, 64 nt, Homo Sapiens
aaacaaaacauuuccuauaaucuuugguugguguggguaaaagauucaccauacugguuucuuc

SEQ ID NO: 564981 - RNA, 64 nt, Homo Sapiens
uggguuuagggcuagcccugccuccaucucccuuggguaaaaugaagggugugggguaaaagau

SEQ ID NO: 564982 - RNA, 64 nt, Homo Sapiens
gccuccaucucccuuggguaaaaugaagggugugggguaaaagaugcauaaggccuuuucuagc

SEQ ID NO: 564983 - RNA, 64 nt, Homo Sapiens
gugaaggaaauuugagucuguauugcugcuacaaggguaaaaccaggaccaauggguaaaagua

SEQ ID NO: 564984 - RNA, 64 nt, Homo Sapiens
guauugcugcuacaaggguaaaaccaggaccaauggguaaaaguaacaggcgggcagauuuugg

SEQ ID NO: 564985 - RNA, 64 nt, Homo Sapiens
gagacguccccgugagcccgccccuucugcauauggguaaaacuucaggcaagcaaaagauugu

SEQ ID NO: 564986 - RNA, 64 nt, Homo Sapiens
ucucaggcaagcaaaagauucuuguaaaaggccaggguaaaauggucaaaagauaaauuggggc

SEQ ID NO: 564987 - RNA, 64 nt, Homo Sapiens
cucuauacuggaguucccuucuuccucuugcuguaggcucaaucccauaccgacaucuacaacu

SEQ ID NO: 564988 - RNA, 64 nt, Homo Sapiens
ccucaaagcccaaagccaagggaaggauaaaucaaggcucaaggcuuccccagcaaagauuagg

SEQ ID NO: 564989 - RNA, 64 nt, Homo Sapiens
aucuaccugccucagccuccggucuuaaacuucuaggcucaagccucacuauguuuccucaucu

SEQ ID NO: 564990 - RNA, 64 nt, Homo Sapiens
uauccuccaaccucagccugagccuugaccuccuaggcucaagcgcacaaucacagcucacugc

SEQ ID NO: 564991 - RNA, 64 nt, Homo Sapiens; identical to SEQ ID NO: 274983

SEQ ID NO: 564992 - RNA, 64 nt, Homo Sapiens; identical to SEQ ID NO: 274984

SEQ ID NO: 564993 - RNA, 64 nt, Homo Sapiens; identical to SEQ ID NO: 274985

SEQ ID NO: 564994 - RNA, 64 nt, Homo Sapiens; identical to SEQ ID NO: 274986

SEQ ID NO: 564995 - RNA, 64 nt, Homo Sapiens; identical to SEQ ID NO: 274987

SEQ ID NO: 564996 - RNA, 64 nt, Homo Sapiens; identical to SEQ ID NO: 274988

SEQ ID NO: 564997 - RNA, 64 nt, Homo Sapiens; identical to SEQ ID NO: 274989

SEQ ID NO: 564998 - RNA, 64 nt, Homo Sapiens; identical to SEQ ID NO: 274990

SEQ ID NO: 564999 - RNA, 64 nt, Homo Sapiens; identical to SEQ ID NO: 274991

SEQ ID NO: 565000 - RNA, 64 nt, Homo Sapiens; identical to SEQ ID NO: 274992

SEQ ID NO: 565001 - RNA, 64 nt, Homo Sapiens; identical to SEQ ID NO: 274993

SEQ ID NO: 565002 - RNA, 64 nt, Homo Sapiens; identical to SEQ ID NO: 274994

SEQ ID NO: 565003 - RNA, 64 nt, Homo Sapiens; identical to SEQ ID NO: 274995

SEQ ID NO: 565004 - RNA, 64 nt, Homo Sapiens; identical to SEQ ID NO: 274996

SEQ ID NO: 565005 - RNA, 64 nt, Homo Sapiens
cugcuccaaggcggagggugggagcaggugugccagggcucagggcucagacuugggagggccu

SEQ ID NO: 565006 - RNA, 64 nt, Homo Sapiens
aaggcggagggugggagcaggugugccagggcucagggcucagacuugggagggccuaggcaga

SEQ ID NO: 565007 - RNA, 64 nt, Homo Sapiens
cgugcuggugcacucugcuaguuguuaucucuguagggcucaggaagcuggaaggaggaaggga

SEQ ID NO: 565008 - RNA, 64 nt, Homo Sapiens
uccucacuguaaugugaggaagcaccucugugucagggcucaccugggcauccaaagcggccac

SEQ ID NO: 565009 - RNA, 64 nt, Homo Sapiens
ugggcucugccaaugugggcugccccucgcacacagggcucacagggcaggccuugcugggguc

SEQ ID NO: 565010 - RNA, 64 nt, Homo Sapiens
aaccagggccucccuguucacggugacacaggucagggcucagagugacccucagcugucaccu

SEQ ID NO: 565011 - RNA, 64 nt, Homo Sapiens
cugccggagcuccaaccaaaggcucacaggagacagggcucaggcucgacccagggacaugcag

SEQ ID NO: 565012 - RNA, 64 nt, Homo Sapiens
ggagacagggcucaggcugcacccagggacaugcagggcucacaccccugcauccccagccucg

SEQ ID NO: 565013 - RNA, 64 nt, Homo Sapiens
caggugucccauaucugguuauguuaaccuagaaagggcucacucuaccucuaggcauguuuca

SEQ ID NO: 565014 - RNA, 64 nt, Homo Sapiens
ucuuccauugagaaaagcauaugaauccuaggaaagggcucagccugugauaggcauucaauaa

SEQ ID NO: 565015 - RNA, 64 nt, Homo Sapiens
gccugacucugagggguuccaucaagugaggaagagggcucagagcacccccacuuucaacuga

SEQ ID NO: 565016 - RNA, 64 nt, Homo Sapiens
agagggcuguguugcucucuccuggaauuggccaagggcucaggcuacaaguccaaccagugga

SEQ ID NO: 565017 - RNA, 64 nt, Homo Sapiens
aaucucaggaccccgcccagggagcugccagcccagggcucagcuucccaugggccccccgccc

SEQ ID NO: 565018 - RNA, 64 nt, Homo Sapiens
cagagagggaccccagcacaucgugggcacgggcagggcucagccgcucccaccuccccacaga

SEQ ID NO: 565019 - RNA, 64 nt, Homo Sapiens
gggucuguuguuugaccguccugagaccgagggaagggcucagcugaaggaccccgucugcagg

SEQ ID NO: 565020 - RNA, 64 nt, Homo Sapiens
cacagcccgugugacugcuagagggcaggggugcagggcucagggggcccgggcugguccuuug

SEQ ID NO: 565021 - RNA, 64 nt, Homo Sapiens
gcuggauaauuucccuaggcgaagcaucugggccagggcucaugcaguucccuccaggcuucua

SEQ ID NO: 565022 - RNA, 64 nt, Homo Sapiens
cgacccucauggggaaggucacccagcguccuggagggcucagggagcuucaagaccuugucug

SEQ ID NO: 565023 - RNA, 64 nt, Homo Sapiens
uaagcauuugucucuccuuagggucuuucaaaacucuuuggaucccugggagggguagccauua

SEQ ID NO: 565024 - RNA, 64 nt, Homo Sapiens
uguagaccucuuggauuccaugauaacacaguugucuuuggacucugucuuucccaugcaaagc

SEQ ID NO: 565025 - RNA, 64 nt, Homo Sapiens
acauguugauguuauaagcacaauagauggggcaucuuuggauugauguucacagcuuuauacu

SEQ ID NO: 565026 - RNA, 64 nt, Homo Sapiens
uucaguuuacugaaugauuaccaccuguaauuccucuuuggauuguguagacucaacaugagac

SEQ ID NO: 565027 - RNA, 64 nt, Homo Sapiens
uuuugagaaugccaaaccacauuuuuaucacacuucuuuggaaaucaaugccuuugcauagaaa

SEQ ID NO: 565028 - RNA, 64 nt, Homo Sapiens
gguacagaauuuugaguaauggugaaaauuguugucuuuggaaagcacaaaagaaaccuggaaa

SEQ ID NO: 565029 - RNA, 64 nt, Homo Sapiens
aaaucccccccacuccaaagguggacucauccauucuuuggaacccucuaccccacauuggcca

SEQ ID NO: 565030 - RNA, 64 nt, Homo Sapiens
cuucaacuucugaagugaaucccacuuauucuccucuuuggaauucuuccuugucuccccucuc

SEQ ID NO: 565031 - RNA, 64 nt, Homo Sapiens
uuguuaggggaaggcuaugugggggcuguggacgucuuuggaaugauuggaccucauuacauaa

SEQ ID NO: 565032 - RNA, 64 nt, Homo Sapiens
gauuauggagauaaucuccugccauaauuugccaucuuuggagaugcaaaaccaaaaauaaaua

SEQ ID NO: 565033 - RNA, 64 nt, Homo Sapiens
cugcauguugccugccacuuacucaccacuggggucuuuggaagauaaucuuccucuuuggaaa

SEQ ID NO: 565034 - RNA, 64 nt, Homo Sapiens
acucaccacuggggucuuuggaagauaaucuuccucuuuggaaaugaauggaaaagcaaaaggc

SEQ ID NO: 565035 - RNA, 64 nt, Homo Sapiens
ccuccuuggaucaguuuucuuuccagucuaaucaucuuuggaacuaaaacuuguucuaacucgu

SEQ ID NO: 565036 - RNA, 64 nt, Homo Sapiens
uuuaucugcagauauugccuguagucuaaagaucucuuuggaagacaaagcauuggcuauauau

SEQ ID NO: 565037 - RNA, 64 nt, Homo Sapiens
ucucguagagaugguuuguuuguguacaagauacucuuuggaucguuagguaaaaugccugcuu

SEQ ID NO: 565038 - RNA, 64 nt, Homo Sapiens
gaagggcauagucuuugagcuguuggggugggggucuuuggagaauacucugguggccuggucc

SEQ ID NO: 565039 - RNA, 64 nt, Homo Sapiens
cuguguaauggaauguauuuuuaucagcauuguuucuuuggaguaucauagaggaccacggcgc

SEQ ID NO: 565040 - RNA, 64 nt, Homo Sapiens
aucauugccuguacuauuccugccuuaaagacuuucuuuggaagaaauucccagaaguuacaga

SEQ ID NO: 565041 - RNA, 64 nt, Homo Sapiens
accaaccuaaaaaauuacagagaagagaaaauuaucuuuggauugugcugcccuauauaaaggu

SEQ ID NO: 565042 - RNA, 64 nt, Homo Sapiens
aaaaagaaauacaaaguuguaaaaguaauggauuucuuuggaugcugaaugcagugauguuauc

SEQ ID NO: 565043 - RNA, 64 nt, Homo Sapiens
ucggguucagaacacuuuuuauauuaccguuaugucuuuggaaauuugcaauauuguaguucau

SEQ ID NO: 565044 - RNA, 64 nt, Homo Sapiens
guuuucaccaucucuuguaaagcaaaauggcuuuucuuuggacaaagaaauuguuuuuaacaga

SEQ ID NO: 565045 - RNA, 64 nt, Homo Sapiens
gugugccggacucuggggcuccgagaaaccugguucuuuggacugcaguacacaaucaaggaca

SEQ ID NO: 565046 - RNA, 64 nt, Homo Sapiens
ccaugaucuauuuaugaggagaaggaaagccgauucuuuggaaguucagcagaugaaagcccag

SEQ ID NO: 565047 - RNA, 64 nt, Homo Sapiens
caagaaaggagagucuugcagugauuaaggucucucuuuggacucuccccucuuauguaccucu

SEQ ID NO: 565048 - RNA, 64 nt, Homo Sapiens
gagauggcccucugguagacacaggauagauaacucuuuggauagcaugucuuuuuuucuguua

SEQ ID NO: 565049 - RNA, 64 nt, Homo Sapiens; identical to SEQ ID NO: 198474

SEQ ID NO: 565050 - RNA, 64 nt, Homo Sapiens; identical to SEQ ID NO: 198475

SEQ ID NO: 565051 - RNA, 64 nt, Homo Sapiens; identical to SEQ ID NO: 198476

SEQ ID NO: 565052 - RNA, 64 nt, Homo Sapiens; identical to SEQ ID NO: 198477

SEQ ID NO: 565053 - RNA, 64 nt, Homo Sapiens; identical to SEQ ID NO: 198478

SEQ ID NO: 565054 - RNA, 64 nt, Homo Sapiens; identical to SEQ ID NO: 198479

SEQ ID NO: 565055 - RNA, 64 nt, Homo Sapiens; identical to SEQ ID NO: 198480

SEQ ID NO: 565056 - RNA, 64 nt, Homo Sapiens; identical to SEQ ID NO: 198481

SEQ ID NO: 565057 - RNA, 64 nt, Homo Sapiens; identical to SEQ ID NO: 198482

SEQ ID NO: 565058 - RNA, 64 nt, Homo Sapiens; identical to SEQ ID NO: 198483

SEQ ID NO: 565059 - RNA, 64 nt, Homo Sapiens; identical to SEQ ID NO: 198484

SEQ ID NO: 565060 - RNA, 64 nt, Homo Sapiens; identical to SEQ ID NO: 198485

SEQ ID NO: 565061 - RNA, 64 nt, Homo Sapiens; identical to SEQ ID NO: 198486

SEQ ID NO: 565062 - RNA, 64 nt, Homo Sapiens; identical to SEQ ID NO: 198487

SEQ ID NO: 565063 - RNA, 64 nt, Homo Sapiens; identical to SEQ ID NO: 198488

SEQ ID NO: 565064 - RNA, 64 nt, Homo Sapiens; identical to SEQ ID NO: 198489

SEQ ID NO: 565065 - RNA, 64 nt, Homo Sapiens; identical to SEQ ID NO: 198490

SEQ ID NO: 565066 - RNA, 64 nt, Homo Sapiens; identical to SEQ ID NO: 198491

SEQ ID NO: 565067 - RNA, 64 nt, Homo Sapiens; identical to SEQ ID NO: 198492

SEQ ID NO: 565068 - RNA, 64 nt, Homo Sapiens; identical to SEQ ID NO: 483170

SEQ ID NO: 565069 - RNA, 64 nt, Homo Sapiens; identical to SEQ ID NO: 483171

SEQ ID NO: 565070 - RNA, 64 nt, Homo Sapiens; identical to SEQ ID NO: 483172

SEQ ID NO: 565071 - RNA, 64 nt, Homo Sapiens; identical to SEQ ID NO: 483173

SEQ ID NO: 565072 - RNA, 64 nt, Homo Sapiens; identical to SEQ ID NO: 483174

SEQ ID NO: 565073 - RNA, 64 nt, Homo Sapiens; identical to SEQ ID NO: 483175

SEQ ID NO: 565074 - RNA, 64 nt, Homo Sapiens; identical to SEQ ID NO: 483176

SEQ ID NO: 565075 - RNA, 64 nt, Homo Sapiens; identical to SEQ ID NO: 483177

SEQ ID NO: 565076 - RNA, 64 nt, Homo Sapiens; identical to SEQ ID NO: 483178

SEQ ID NO: 565077 - RNA, 64 nt, Homo Sapiens; identical to SEQ ID NO: 483179

SEQ ID NO: 565078 - RNA, 64 nt, Homo Sapiens; identical to SEQ ID NO: 483180

SEQ ID NO: 565079 - RNA, 64 nt, Homo Sapiens; identical to SEQ ID NO: 483181

SEQ ID NO: 565080 - RNA, 64 nt, Homo Sapiens; identical to SEQ ID NO: 483182

SEQ ID NO: 565081 - RNA, 64 nt, Homo Sapiens; identical to SEQ ID NO: 483183

SEQ ID NO: 565082 - RNA, 64 nt, Homo Sapiens; identical to SEQ ID NO: 483184

SEQ ID NO: 565083 - RNA, 64 nt, Homo Sapiens; identical to SEQ ID NO: 483185

SEQ ID NO: 565084 - RNA, 64 nt, Homo Sapiens; identical to SEQ ID NO: 483186

SEQ ID NO: 565085 - RNA, 64 nt, Homo Sapiens; identical to SEQ ID NO: 483187

SEQ ID NO: 565086 - RNA, 64 nt, Homo Sapiens; identical to SEQ ID NO: 483188

SEQ ID NO: 565087 - RNA, 64 nt, Homo Sapiens; identical to SEQ ID NO: 483189

SEQ ID NO: 565088 - RNA, 64 nt, Homo Sapiens; identical to SEQ ID NO: 483190

SEQ ID NO: 565089 - RNA, 64 nt, Homo Sapiens; identical to SEQ ID NO: 483191

SEQ ID NO: 565090 - RNA, 64 nt, Homo Sapiens; identical to SEQ ID NO: 483192

SEQ ID NO: 565091 - RNA, 64 nt, Homo Sapiens; identical to SEQ ID NO: 483193

SEQ ID NO: 565092 - RNA, 64 nt, Homo Sapiens; identical to SEQ ID NO: 483194

SEQ ID NO: 565093 - RNA, 64 nt, Homo Sapiens; identical to SEQ ID NO: 483195

SEQ ID NO: 565094 - RNA, 64 nt, Homo Sapiens; identical to SEQ ID NO: 483196

SEQ ID NO: 565095 - RNA, 64 nt, Homo Sapiens; identical to SEQ ID NO: 483197

SEQ ID NO: 565096 - RNA, 64 nt, Homo Sapiens; identical to SEQ ID NO: 483198

SEQ ID NO: 565097 - RNA, 64 nt, Homo Sapiens; identical to SEQ ID NO: 483199

SEQ ID NO: 565098 - RNA, 64 nt, Homo Sapiens; identical to SEQ ID NO: 483200

SEQ ID NO: 565099 - RNA, 64 nt, Homo Sapiens; identical to SEQ ID NO: 483201

SEQ ID NO: 565100 - RNA, 64 nt, Homo Sapiens; identical to SEQ ID NO: 483202

SEQ ID NO: 565101 - RNA, 64 nt, Homo Sapiens; identical to SEQ ID NO: 123011

SEQ ID NO: 565102 - RNA, 64 nt, Homo Sapiens; identical to SEQ ID NO: 123012

SEQ ID NO: 565103 - RNA, 64 nt, Homo Sapiens; identical to SEQ ID NO: 123013

SEQ ID NO: 565104 - RNA, 64 nt, Homo Sapiens; identical to SEQ ID NO: 123014

SEQ ID NO: 565105 - RNA, 64 nt, Homo Sapiens; identical to SEQ ID NO: 123015

SEQ ID NO: 565106 - RNA, 64 nt, Homo Sapiens; identical to SEQ ID NO: 123016

SEQ ID NO: 565107 - RNA, 64 nt, Homo Sapiens; identical to SEQ ID NO: 123017

SEQ ID NO: 565108 - RNA, 64 nt, Homo Sapiens; identical to SEQ ID NO: 123018

SEQ ID NO: 565109 - RNA, 64 nt, Homo Sapiens; identical to SEQ ID NO: 123019

SEQ ID NO: 565110 - RNA, 64 nt, Homo Sapiens; identical to SEQ ID NO: 123020

SEQ ID NO: 565111 - RNA, 64 nt, Homo Sapiens; identical to SEQ ID NO: 123021

SEQ ID NO: 565112 - RNA, 64 nt, Homo Sapiens; identical to SEQ ID NO: 123022

SEQ ID NO: 565113 - RNA, 64 nt, Homo Sapiens; identical to SEQ ID NO: 123023

SEQ ID NO: 565114 - RNA, 64 nt, Homo Sapiens; identical to SEQ ID NO: 123024

SEQ ID NO: 565115 - RNA, 64 nt, Homo Sapiens; identical to SEQ ID NO: 123025

SEQ ID NO: 565116 - RNA, 64 nt, Homo Sapiens; identical to SEQ ID NO: 123026

SEQ ID NO: 565117 - RNA, 64 nt, Homo Sapiens; identical to SEQ ID NO: 123027

SEQ ID NO: 565118 - RNA, 64 nt, Homo Sapiens; identical to SEQ ID NO: 123028

SEQ ID NO: 565119 - RNA, 64 nt, Homo Sapiens; identical to SEQ ID NO: 123029

SEQ ID NO: 565120 - RNA, 64 nt, Homo Sapiens; identical to SEQ ID NO: 123030

SEQ ID NO: 565121 - RNA, 64 nt, Homo Sapiens; identical to SEQ ID NO: 123031

SEQ ID NO: 565122 - RNA, 64 nt, Homo Sapiens; identical to SEQ ID NO: 123032

SEQ ID NO: 565123 - RNA, 64 nt, Homo Sapiens; identical to SEQ ID NO: 123033

SEQ ID NO: 565124 - RNA, 64 nt, Homo Sapiens; identical to SEQ ID NO: 123034

SEQ ID NO: 565125 - RNA, 64 nt, Homo Sapiens; identical to SEQ ID NO: 123035

SEQ ID NO: 565126 - RNA, 64 nt, Homo Sapiens; identical to SEQ ID NO: 123036

SEQ ID NO: 565127 - RNA, 64 nt, Homo Sapiens; identical to SEQ ID NO: 123037

SEQ ID NO: 565128 - RNA, 64 nt, Homo Sapiens; identical to SEQ ID NO: 123038

SEQ ID NO: 565129 - RNA, 64 nt, Homo Sapiens; identical to SEQ ID NO: 123039

SEQ ID NO: 565130 - RNA, 64 nt, Homo Sapiens; identical to SEQ ID NO: 123040

SEQ ID NO: 565131 - RNA, 64 nt, Homo Sapiens; identical to SEQ ID NO: 123041

SEQ ID NO: 565132 - RNA, 64 nt, Homo Sapiens; identical to SEQ ID NO: 123042

SEQ ID NO: 565133 - RNA, 64 nt, Homo Sapiens; identical to SEQ ID NO: 123043

SEQ ID NO: 565134 - RNA, 64 nt, Homo Sapiens; identical to SEQ ID NO: 123044

SEQ ID NO: 565135 - RNA, 64 nt, Homo Sapiens; identical to SEQ ID NO: 123045

SEQ ID NO: 565136 - RNA, 64 nt, Homo Sapiens; identical to SEQ ID NO: 123046

SEQ ID NO: 565137 - RNA, 64 nt, Homo Sapiens; identical to SEQ ID NO: 123047

SEQ ID NO: 565138 - RNA, 64 nt, Homo Sapiens; identical to SEQ ID NO: 123048

SEQ ID NO: 565139 - RNA, 64 nt, Homo Sapiens; identical to SEQ ID NO: 123049

SEQ ID NO: 565140 - RNA, 64 nt, Homo Sapiens; identical to SEQ ID NO: 123050

SEQ ID NO: 565141 - RNA, 64 nt, Homo Sapiens; identical to SEQ ID NO: 123051

SEQ ID NO: 565142 - RNA, 64 nt, Homo Sapiens; identical to SEQ ID NO: 123052

SEQ ID NO: 565143 - RNA, 64 nt, Homo Sapiens; identical to SEQ ID NO: 123053

SEQ ID NO: 565144 - RNA, 64 nt, Homo Sapiens; identical to SEQ ID NO: 123054

SEQ ID NO: 565145 - RNA, 64 nt, Homo Sapiens; identical to SEQ ID NO: 123055

SEQ ID NO: 565146 - RNA, 64 nt, Homo Sapiens; identical to SEQ ID NO: 123056

SEQ ID NO: 565147 - RNA, 64 nt, Homo Sapiens; identical to SEQ ID NO: 123057

SEQ ID NO: 565148 - RNA, 64 nt, Homo Sapiens; identical to SEQ ID NO: 123058

SEQ ID NO: 565149 - RNA, 64 nt, Homo Sapiens; identical to SEQ ID NO: 123059

SEQ ID NO: 565150 - RNA, 64 nt, Homo Sapiens; identical to SEQ ID NO: 123060

SEQ ID NO: 565151 - RNA, 64 nt, Homo Sapiens; identical to SEQ ID NO: 123061

SEQ ID NO: 565152 - RNA, 64 nt, Homo Sapiens; identical to SEQ ID NO: 123062

SEQ ID NO: 565153 - RNA, 64 nt, Homo Sapiens; identical to SEQ ID NO: 123063

SEQ ID NO: 565154 - RNA, 64 nt, Homo Sapiens; identical to SEQ ID NO: 123064

SEQ ID NO: 565155 - RNA, 64 nt, Homo Sapiens; identical to SEQ ID NO: 123065

SEQ ID NO: 565156 - RNA, 64 nt, Homo Sapiens; identical to SEQ ID NO: 123066

SEQ ID NO: 565157 - RNA, 64 nt, Homo Sapiens; identical to SEQ ID NO: 123067

SEQ ID NO: 565158 - RNA, 64 nt, Homo Sapiens; identical to SEQ ID NO: 123068

SEQ ID NO: 565159 - RNA, 64 nt, Homo Sapiens; identical to SEQ ID NO: 123069

SEQ ID NO: 565160 - RNA, 64 nt, Homo Sapiens; identical to SEQ ID NO: 123070

SEQ ID NO: 565161 - RNA, 64 nt, Homo Sapiens; identical to SEQ ID NO: 123071

SEQ ID NO: 565162 - RNA, 64 nt, Homo Sapiens; identical to SEQ ID NO: 123072

SEQ ID NO: 565163 - RNA, 64 nt, Homo Sapiens; identical to SEQ ID NO: 123073

SEQ ID NO: 565164 - RNA, 64 nt, Homo Sapiens; identical to SEQ ID NO: 123074

SEQ ID NO: 565165 - RNA, 64 nt, Homo Sapiens
agucagagcugugagcggggggcgccguccaggccgagcgcagacuguuuaggacucagcagac

SEQ ID NO: 565166 - RNA, 64 nt, Homo Sapiens
cacaugcacaagugcgaaggugugugugcgucugcgagcgcacaagagagagaauaugugugug

SEQ ID NO: 565167 - RNA, 64 nt, Homo Sapiens
gcguuaaguagagaagucuuaguugcuaagugcccgagcgcagccccacagcccguguucccga

SEQ ID NO: 565168 - RNA, 64 nt, Homo Sapiens
gugaugcucgggucugccccuugucgccgagccccgagcgcacgacagcuuucuugcgucucau

SEQ ID NO: 565169 - RNA, 64 nt, Homo Sapiens
gccacaggcgccaagagcaacacaccaagccacccgagcgcaguccgagcugcuggcccagggc

SEQ ID NO: 565170 - RNA, 64 nt, Homo Sapiens
augaguguuccagagggagaagcaucgcugaccccgagcgcagguuuugcuagcagauugcccu

SEQ ID NO: 565171 - RNA, 64 nt, Homo Sapiens
cuggaguccccaugggggcgguagcugaaguuggcgagcgcagcgguggaugcagagcuggcug

SEQ ID NO: 565172 - RNA, 64 nt, Homo Sapiens
cuggcaagcaucaacaggagucuucuucccaacacgagcgcauccauguccugagaaaaagucu

SEQ ID NO: 565173 - RNA, 64 nt, Homo Sapiens
cguagccaccaaccgcuaaaaugcacgccaucaucgagcgcacggccagcuucgugugcaggca

SEQ ID NO: 565174 - RNA, 64 nt, Homo Sapiens
ucaugcacaaggccccguugacuggaauccagaucgagcgcaguggugggcacugcagaggauc

SEQ ID NO: 565175 - RNA, 64 nt, Homo Sapiens
cuacuuagcaguguuggucucuggggcuggaagccgagcgcaugcugggagcgguacugucaga

SEQ ID NO: 565176 - RNA, 64 nt, Homo Sapiens
gucuuccccacuggcaguggcagcagccccaccccgagcgcacacugugauggaggagacugag

SEQ ID NO: 565177 - RNA, 64 nt, Homo Sapiens
ugccacacgcccgcggugaucccagccagggccccgagcgcagaggcggagcugugcucagcac

SEQ ID NO: 565178 - RNA, 64 nt, Homo Sapiens
uguagauaagcaugagaguguggagcagagucggcgagcgcaagccgagcccaucaaccuggac

SEQ ID NO: 565179 - RNA, 64 nt, Homo Sapiens
cuguaguccugguagcuguugugcuuggaaauaacgagcgcauccuugccucagcuaccugcuc

SEQ ID NO: 565180 - RNA, 64 nt, Homo Sapiens
acccccccgcccucgcgcugugcucccgggggggcgagcgcaugacucgacaagcuggaccccc

SEQ ID NO: 565181 - RNA, 64 nt, Homo Sapiens
gugaagcgugcucauuucaugcuggguaugacgccgagcgcacaccacuggcgugagacagcgc

SEQ ID NO: 565182 - RNA, 64 nt, Homo Sapiens; identical to SEQ ID NO: 165937

SEQ ID NO: 565183 - RNA, 64 nt, Homo Sapiens; identical to SEQ ID NO: 165938

SEQ ID NO: 565184 - RNA, 64 nt, Homo Sapiens; identical to SEQ ID NO: 165939

SEQ ID NO: 565185 - RNA, 64 nt, Homo Sapiens; identical to SEQ ID NO: 165940

SEQ ID NO: 565186 - RNA, 64 nt, Homo Sapiens; identical to SEQ ID NO: 165941

SEQ ID NO: 565187 - RNA, 64 nt, Homo Sapiens; identical to SEQ ID NO: 165942

SEQ ID NO: 565188 - RNA, 64 nt, Homo Sapiens; identical to SEQ ID NO: 165943

SEQ ID NO: 565189 - RNA, 64 nt, Homo Sapiens; identical to SEQ ID NO: 165944

SEQ ID NO: 565190 - RNA, 64 nt, Homo Sapiens; identical to SEQ ID NO: 165945

SEQ ID NO: 565191 - RNA, 64 nt, Homo Sapiens; identical to SEQ ID NO: 165946

SEQ ID NO: 565192 - RNA, 64 nt, Homo Sapiens; identical to SEQ ID NO: 165947

SEQ ID NO: 565193 - RNA, 64 nt, Homo Sapiens; identical to SEQ ID NO: 165948

SEQ ID NO: 565194 - RNA, 64 nt, Homo Sapiens; identical to SEQ ID NO: 165949

SEQ ID NO: 565195 - RNA, 64 nt, Homo Sapiens; identical to SEQ ID NO: 165950

SEQ ID NO: 565196 - RNA, 64 nt, Homo Sapiens; identical to SEQ ID NO: 165951

SEQ ID NO: 565197 - RNA, 64 nt, Homo Sapiens; identical to SEQ ID NO: 165952

SEQ ID NO: 565198 - RNA, 64 nt, Homo Sapiens; identical to SEQ ID NO: 165953

SEQ ID NO: 565199 - RNA, 64 nt, Homo Sapiens; identical to SEQ ID NO: 165954

SEQ ID NO: 565200 - RNA, 64 nt, Homo Sapiens; identical to SEQ ID NO: 165955

SEQ ID NO: 565201 - RNA, 64 nt, Homo Sapiens; identical to SEQ ID NO: 165956

SEQ ID NO: 565202 - RNA, 64 nt, Homo Sapiens; identical to SEQ ID NO: 165957

SEQ ID NO: 565203 - RNA, 64 nt, Homo Sapiens; identical to SEQ ID NO: 165958

SEQ ID NO: 565204 - RNA, 64 nt, Homo Sapiens; identical to SEQ ID NO: 165959

SEQ ID NO: 565205 - RNA, 64 nt, Homo Sapiens; identical to SEQ ID NO: 165960

SEQ ID NO: 565206 - RNA, 64 nt, Homo Sapiens; identical to SEQ ID NO: 165961

SEQ ID NO: 565207 - RNA, 64 nt, Homo Sapiens; identical to SEQ ID NO: 165962

SEQ ID NO: 565208 - RNA, 64 nt, Homo Sapiens; identical to SEQ ID NO: 165963

SEQ ID NO: 565209 - RNA, 64 nt, Homo Sapiens; identical to SEQ ID NO: 165964

SEQ ID NO: 565210 - RNA, 64 nt, Homo Sapiens
caccucagaguucgccuuuucauuucaagcauaaggcaauaaauaccugcagcaacgugggaga

SEQ ID NO: 565211 - RNA, 64 nt, Homo Sapiens
cuuuuugucuguuaguuauuucuccaggggaaaaggcaauaauuuucuaagacccgugugaaug

SEQ ID NO: 565212 - RNA, 64 nt, Homo Sapiens
guuugucaacauauucucuuuaauccuuaauauaggcaauaaaugagaauccugcaaugggcaa

SEQ ID NO: 565213 - RNA, 64 nt, Homo Sapiens
cuuaauauaggcaauaaaugagaauccugcaaugggcaauaauccugcggccacugcaugugag

SEQ ID NO: 565214 - RNA, 64 nt, Homo Sapiens
cguacuauaguauucuuaauacagugcucacugcauuuaauaaauauuuaauaaaugaugaaug

SEQ ID NO: 565215 - RNA, 64 nt, Homo Sapiens
auucuuaauacagugcucacugcauuuaauaaauauuuaauaaaugaugaaugauagaaguuuc

SEQ ID NO: 565216 - RNA, 64 nt, Homo Sapiens
agcugaucacaagcacaaaucuuucccacuagccauuuaauaaguuaaaaaaagauacaaaaac

SEQ ID NO: 565217 - RNA, 64 nt, Homo Sapiens
cacuuaaucuauaugcuuuacacuagcuuucugcauuuaauagguuagaauguaaauuaaagug

SEQ ID NO: 565218 - RNA, 64 nt, Homo Sapiens
uucuaaaaggccuuuuuguuuauaauguuuguucauuuaauagcagauauaaaauugguuuauc

SEQ ID NO: 565219 - RNA, 64 nt, Homo Sapiens
gaauaacaaucuuauuuuccaauacccuuuacugauuuaauacacaaguuguccuuucucuuaa

SEQ ID NO: 565220 - RNA, 64 nt, Homo Sapiens
ccccguaaaugucuucagugguauuuaagauaccauuuaauaugcauuaugagguauacaacua

SEQ ID NO: 565221 - RNA, 64 nt, Homo Sapiens
caaaauauguuuuuggaauaaccauauuucccuuauuuaauaaguauuaacauugcaaaacugg

SEQ ID NO: 565222 - RNA, 64 nt, Homo Sapiens
gaaaccuguaaauuacuguuaugcaaagauccuaauuuaauaaaucagugaugaguugggcuua

SEQ ID NO: 565223 - RNA, 64 nt, Homo Sapiens
uauuauugaauaucagucucacucagauuaucugauuuaauacaaggaggcaaacuauuuuagc

SEQ ID NO: 565224 - RNA, 64 nt, Homo Sapiens
aagcuuuaaaaagaaaccuggaaagauauuuaauauuuaauacuuaauguaaaauuuaaauggg

SEQ ID NO: 565225 - RNA, 64 nt, Homo Sapiens
uaauacuaagcuuuaaaaagaaauggggaaagauauuuaauauuggcagaguaauguaaaauuu

SEQ ID NO: 565226 - RNA, 64 nt, Homo Sapiens
cuucucggagucuguuaaguuuucucuggcaaugauuuaauagaauucacccuugauuuaauua

SEQ ID NO: 565227 - RNA, 64 nt, Homo Sapiens
ucagaaaauuucugcagagcuaagauuuauucuuauuuaauacuugcaaaggaaauuugaaaga

SEQ ID NO: 565228 - RNA, 64 nt, Homo Sapiens
acuuagcuuaugaguagcuuauacaauuaugaagauuuaauauuacagauaaaauguaaacugu

SEQ ID NO: 565229 - RNA, 64 nt, Homo Sapiens
auguaucaaauguaacuuacugcgacuaaacuuaauuuaauauuuacucuauaaccaaaugaaa

SEQ ID NO: 565230 - RNA, 64 nt, Homo Sapiens
cauguauguaucuaaacaccaaaaaacuggugauauuuaauaugaaaagacuugcagcuaaucu

SEQ ID NO: 565231 - RNA, 64 nt, Homo Sapiens
cuugauucagaaacaaaacaguagguuggcuuuaauuuaauauauguagcuuucuauauaugua

SEQ ID NO: 565232 - RNA, 64 nt, Homo Sapiens
gguguacaguaauagaggcuuauuuaaugagauuauuuaauaagauguguauauuugguguucc

SEQ ID NO: 565233 - RNA, 64 nt, Homo Sapiens
uguaaauguguauauuuggugaguccuauggcuuauuuaauaacuguggcuguagauagaagaa

SEQ ID NO: 565234 - RNA, 64 nt, Homo Sapiens
cauugaagucuaugaauucuuuacuccauguuuuauuuaauauccauuacuucuagccuuucaa

SEQ ID NO: 565235 - RNA, 64 nt, Homo Sapiens
agggguuaagguucaugagagcgggaaguauaagauuuaauaggacaucuauagugacaauaaa

SEQ ID NO: 565236 - RNA, 64 nt, Homo Sapiens
ucauaugugacaguuuuuuuaaucuauuuuuaugauuuaauaucaaacauuuuuaucauuuaaa

SEQ ID NO: 565237 - RNA, 64 nt, Homo Sapiens
uguauuaaggauuaacuggaugguaguuaauuggauuuaauauugagaauagguaguggguugc

SEQ ID NO: 565238 - RNA, 64 nt, Homo Sapiens
cuuuugucuaauuuuuaauuuuugcuguuuugucauuuaauaugaaugacaauucuauuuuugc

SEQ ID NO: 565239 - RNA, 64 nt, Homo Sapiens
aaugacaauucuauuuuugcuacaacaguauacuauuuaauauuuuuaauacuuucauauauuu

SEQ ID NO: 565240 - RNA, 64 nt, Homo Sapiens
ugcucacugauuguuaacugagcauuauuuuaucauuuaauauguguuaugaauguuuaccauc

SEQ ID NO: 565241 - RNA, 64 nt, Homo Sapiens
ggucccugguggaaauucaaagaugguucagaaaauuuaauauuuguugcauuguauauuccaa

SEQ ID NO: 565242 - RNA, 64 nt, Homo Sapiens
ugggaacauaugccaauuauggaauaggcuauguauuuaauauuaaucucugccauuaggauau

SEQ ID NO: 565243 - RNA, 64 nt, Homo Sapiens
gcaaaaauagcuuuuuacuucaucaguugcuaagauuuaauacuuuggauucaucaaaguguga

SEQ ID NO: 565244 - RNA, 64 nt, Homo Sapiens
ggagggagguggagggaggaaggugggaauuauuauuuaauacaucauuaaugcuuauuaaucu

SEQ ID NO: 565245 - RNA, 64 nt, Homo Sapiens
gcaaccuuauucaauagguuuucccauauuucagauuuaauaacugaaggccagagagauuaau

SEQ ID NO: 565246 - RNA, 64 nt, Homo Sapiens
aguuuaaauuucaaauguuuuaaaauuuguaggcauuuaauaaauuaucuuuuuuuggaggggu

SEQ ID NO: 565247 - RNA, 64 nt, Homo Sapiens
ucaaaggaaaauguuuauauacauccacauguuuauuuaauauguuucucuuaacaccugaaac

SEQ ID NO: 565248 - RNA, 64 nt, Homo Sapiens
augcaaugguuaugcuuucacaccaucucuguucauuuaauacuaauaauguaaauaaagaacu

SEQ ID NO: 565249 - RNA, 64 nt, Homo Sapiens
aaguuugcuuugagacuuuuaaaagaacuuuuguauuuaauacaugggucucagcguuuuucau

SEQ ID NO: 565250 - RNA, 64 nt, Homo Sapiens
uuuuugaaauugcagagcuuaguuguauagauuaauuuaauaacugcuugcacagcauggucuc

SEQ ID NO: 565251 - RNA, 64 nt, Homo Sapiens
ggaauaucugcauuaauauaguauuccaaaauauauuuaauaauuauguuugaaaaauccguga

SEQ ID NO: 565252 - RNA, 64 nt, Homo Sapiens
uuaauuacuaaaaaggcauaucagacaagauuauauuuaauauaaaaacagaccauuuaaaaac

SEQ ID NO: 565253 - RNA, 64 nt, Homo Sapiens
uuucaggcaaucucaacuuacuucuuuaaucaacauuuaauaucaauggaucugugauuaaaug

SEQ ID NO: 565254 - RNA, 64 nt, Homo Sapiens
auuaaaugucugaauauguaaugccucgugaaguauuuaauaauggccuuuauuuguauuugga

SEQ ID NO: 565255 - RNA, 64 nt, Homo Sapiens
cagacuauuugcuaauguauaaugugcagaaaauauuuaauaucaaaagaaaauugauauuuuu

SEQ ID NO: 565256 - RNA, 64 nt, Homo Sapiens
aucaauuagaucuaaacaguuauuucuguuuccuauuuaauacagcugaagucaaaauauguaa

SEQ ID NO: 565257 - RNA, 64 nt, Homo Sapiens
uauuuuaguauguauuucaccagauuuggugaauauuuaauauaguuuucauguagcagcaaug

SEQ ID NO: 565258 - RNA, 64 nt, Homo Sapiens
uaaaaacaucuccaaaaagguuguuaauaaaggcauuuaauagaauagaaaauggaagauggug

SEQ ID NO: 565259 - RNA, 64 nt, Homo Sapiens
gaaaauuaauaaugguacuuaugauuaaaaacgcauuuaauacuaacugcaguaguucuuucaa

SEQ ID NO: 565260 - RNA, 64 nt, Homo Sapiens
uguguggauggggaaaauguuuuaaaauccaguuauuuaauaugaguuugagagagaaaauugu

SEQ ID NO: 565261 - RNA, 64 nt, Homo Sapiens
uauuauaguuuaugaauauccuauuuugaaauugauuuaauagcgaaagucacauuuugaaagg

SEQ ID NO: 565262 - RNA, 64 nt, Homo Sapiens
gaucucaauaccacacccucuuucuaauuuaauaauuuaauaguauuugaccaguguuaagaau

SEQ ID NO: 565263 - RNA, 64 nt, Homo Sapiens
uuaauagugaucucaauaccuuaagaauuuucuaauuuaauaaucucgucuaauuugaccagug

SEQ ID NO: 565264 - RNA, 64 nt, Homo Sapiens
uucuaauaacacucauuccuaagcuuugaguauuauuuaauaauaaucucuaaaucuaagaacu

SEQ ID NO: 565265 - RNA, 64 nt, Homo Sapiens
gaaccaauuacacucuugagccacagaugaguaaauuuaauaauaauuuguguuauuuuuugaa

SEQ ID NO: 565266 - RNA, 64 nt, Homo Sapiens
ucaaaauugucccugauuuuugaaaaaccaguuaauuuaauagccaaaugccauugggagguuu

SEQ ID NO: 565267 - RNA, 64 nt, Homo Sapiens
aauauaccauauaauauauuauugguuucccaauauuuaauauaauaagcaucaaauuuacaac

SEQ ID NO: 565268 - RNA, 64 nt, Homo Sapiens
auuucuauuacuaaaguucauaucacaaaaugauauuuaauaauaaccuugggguaaaucauga

SEQ ID NO: 565269 - RNA, 64 nt, Homo Sapiens
cuguagcaauaaaaugaccaagugcaaugacuugauuuaauaaaaucauauuuuaaaaguugcu

SEQ ID NO: 565270 - RNA, 64 nt, Homo Sapiens
acauauucacuugaauauauagauauuaguaugcauuuaauaaauguacucacauacuauagaa

SEQ ID NO: 565271 - RNA, 64 nt, Homo Sapiens
uauauacauuuuaauuuauuuuauaucuaucuauauuuaauaaagaaauaaucauguucuggua

SEQ ID NO: 565272 - RNA, 64 nt, Homo Sapiens
uaaagugccuauaaaggaaauggcuccacuguaaauuuaauagaggagauuuugcuaauacauu

SEQ ID NO: 565273 - RNA, 64 nt, Homo Sapiens
cugccuuuuaccuucaguaagagagaguucucacauuuaauaucaggcagaaucaguagcugga

SEQ ID NO: 565274 - RNA, 64 nt, Homo Sapiens
acacuaauuuauauaggagugaaguuuuauaaauauuuaauauuuauuuuggauucaaauugua

SEQ ID NO: 565275 - RNA, 64 nt, Homo Sapiens
guauuaagacaggacauauuguuggugagauaauauuuaauagguauaaaaugguaaaauaccu

SEQ ID NO: 565276 - RNA, 64 nt, Homo Sapiens
ugaugaaaacauaaugccuuaguaaaauagcucuauuuaauaaagaagauugaguacucugaca

SEQ ID NO: 565277 - RNA, 64 nt, Homo Sapiens
caguuugaucucucuaaaauuguaguuugguuugauuuaauauaauucuuaguagaaauuuuga

SEQ ID NO: 565278 - RNA, 64 nt, Homo Sapiens
auaauucuaaaggaaauuguguuguacauuuaugauuuaauaaaguguguagaguuaagaagcu

SEQ ID NO: 565279 - RNA, 64 nt, Homo Sapiens
auuaccuuacuguggaggaagaauggauuggauuauuuaauaacgaugcagagagccauuuugu

SEQ ID NO: 565280 - RNA, 64 nt, Homo Sapiens
uuucaacuauagguaauaacucuuagagaaauuaauuuaauauuagaauuucuauuaugaauca

SEQ ID NO: 565281 - RNA, 64 nt, Homo Sapiens
uuuuaaauaaauuauaagcuuuaagguacgaaguauuuaauagaucuaaucaaauauguugauu

SEQ ID NO: 565282 - RNA, 64 nt, Homo Sapiens
aaaguaaaauugaacuuauuaaaagcuaucuaugauuuaauagauuuaauaaaauuccuucacg

SEQ ID NO: 565283 - RNA, 64 nt, Homo Sapiens
uugaacuuauuaaaagcuaucuaugauuuaauagauuuaauaaaauuccuucacgaccugguac

SEQ ID NO: 565284 - RNA, 64 nt, Homo Sapiens
accaguuaucuguuaaucaaaauugcauuuuacaauuuaauaaugugauauuuccuaugucuac

SEQ ID NO: 565285 - RNA, 64 nt, Homo Sapiens
ucacaguuucagcacucaaccucaucauacgcugauuuaauauuguuuuacauuaaaauagucc

SEQ ID NO: 565286 - RNA, 64 nt, Homo Sapiens
uuauuuuuucacuacaacagccaguauuauguucauuuaauaaauuuuauaaugcauuuuacuc

SEQ ID NO: 565287 - RNA, 64 nt, Homo Sapiens
cuaaaaaaaaucuuguuggauuuuauccaauuacauuuaauacacacugcugcuuuuaauugua

SEQ ID NO: 565288 - RNA, 64 nt, Homo Sapiens
uuuuguuucuccuuaggaaugaaaaaauaaacauauuuaauaauuggcuacauuugacacuuua

SEQ ID NO: 565289 - RNA, 64 nt, Homo Sapiens
cucacagcuuuguguuuauuaaucuaguguccauauuuaauacuaauuucuuguuggaaaugua

SEQ ID NO: 565290 - RNA, 64 nt, Homo Sapiens
cauccuuugagcuaaacuaaauuaaaauuacaguauuuaauaauucuuugggcauuuuuaagag

SEQ ID NO: 565291 - RNA, 64 nt, Homo Sapiens
auuugaauuuaaaaauauugagcucuugauuacaauuuaauacauuguaaaaaguauuaaaucc

SEQ ID NO: 565292 - RNA, 64 nt, Homo Sapiens
auucauuuggcuucauuuuuaaauaaauuuauaaauuuaauaacccaagaagaucuggaaaguu

SEQ ID NO: 565293 - RNA, 64 nt, Homo Sapiens
uaaaccugagagauagguauaaauauauuuguuaauuuaauauuucuguaccagguaugcauua

SEQ ID NO: 565294 - RNA, 64 nt, Homo Sapiens
uuuguggccaguaaaauuauuuuaauacaaucggauuuaauaaugcccgaguuucuugauuuua

SEQ ID NO: 565295 - RNA, 64 nt, Homo Sapiens
aucggauuuaauaauuuuguaguuucuugauuuuauuuaauacagaaaugguucauugggcccg

SEQ ID NO: 565296 - RNA, 64 nt, Homo Sapiens
ccccuuaccccaguuuuuugaacauggaaagaaaauuuaauaacuuuuuaaagugacauaauuu

SEQ ID NO: 565297 - RNA, 64 nt, Homo Sapiens
auaauuuacaugcaauauguuuaucaacucaagaauuuaauauaguugguacacaacuaguuuu

SEQ ID NO: 565298 - RNA, 64 nt, Homo Sapiens
uguauuaaaauguacaaaauguuuuguuaauaaaauuuaauaauguuuauaacuccgugccauu

SEQ ID NO: 565299 - RNA, 64 nt, Homo Sapiens
guuuuuuuacauuucugcuuugaaugcagaugcaauuuaauauaauagauuuuuuaaugaauua

SEQ ID NO: 565300 - RNA, 64 nt, Homo Sapiens
ccuguguacagcaaacugaggaagaaagaucauuauuuaauacugggcccugaaaugacaccca

SEQ ID NO: 565301 - RNA, 64 nt, Homo Sapiens
agguauagaagcucuucaaggcauuuucugauauauuuaauaagcuaauuaaucugcauaugaa

SEQ ID NO: 565302 - RNA, 64 nt, Homo Sapiens
caauugguagcaccuuagcucaaucauuggaaguauuuaauauggaacuuuaauaauccagaug

SEQ ID NO: 565303 - RNA, 64 nt, Homo Sapiens
uauaguaguuaauaucuaaguaaaauaugaugaaauuuaauagagaauucacuccucccaaaag

SEQ ID NO: 565304 - RNA, 64 nt, Homo Sapiens
caucucaaaagaugccaacguugucuuugauaauauuuaauauauuuuuuaaaaaacaauucuu

SEQ ID NO: 565305 - RNA, 64 nt, Homo Sapiens
gauagugcugaaagaauuccccaguggaaggagaauuuaauaaaaugaauagacagaacccuau

SEQ ID NO: 565306 - RNA, 64 nt, Homo Sapiens
gcuuuaaaauaaaaauaaaacaagucugauccauauuuaauaauaacauugcauaaacacuuuu

SEQ ID NO: 565307 - RNA, 64 nt, Homo Sapiens
caugcuuuugugccuuuaagaaaauacaacucucauuuaauauucauugaaaaguuggccuugu

SEQ ID NO: 565308 - RNA, 64 nt, Homo Sapiens
uguagaugcagguaaauauauuuuaaccccuagaauuuaauauuuaaaaguuuacauaaguuuu

SEQ ID NO: 565309 - RNA, 64 nt, Homo Sapiens
ucuuauuuuguuuuuguuguaauguuugaauacuauuuaauauccgguuuuaauauugcuggau

SEQ ID NO: 565310 - RNA, 64 nt, Homo Sapiens
cuguguaacaguaacucuuuuuugcuuuucaguaauuuaauauguucacuuaacaaaauacgaa

SEQ ID NO: 565311 - RNA, 64 nt, Homo Sapiens
guugaugaauauagcugcuguacuguauauuaauauuuaauagaucaacaaauggucauugaaa

SEQ ID NO: 565312 - RNA, 64 nt, Homo Sapiens
ugacuggagaccccagugugggggaggucuuaccauuuaauauagaaaugauaucaauaacuaa

SEQ ID NO: 565313 - RNA, 64 nt, Homo Sapiens
cagggcuuggggacccaaugcaaagaugaugacuauuuaauaaaauggaaaauuuaauaaaucc

SEQ ID NO: 565314 - RNA, 64 nt, Homo Sapiens
augcaaagaugaugacuauuuaauaaaauggaaaauuuaauaaauccucauuuuauuaacuaag

SEQ ID NO: 565315 - RNA, 64 nt, Homo Sapiens
ggucaaaauuuucuguguuuuuauagaagaguuuauuuaauauauuuaggguuaaaaaccugac

SEQ ID NO: 565316 - RNA, 64 nt, Homo Sapiens
cugggggaaaaaaggccuuguacguuuuuaguaaauuuaauauucauacuagaauuuuuauuuc

SEQ ID NO: 565317 - RNA, 64 nt, Homo Sapiens
cugagagucucuuguuugucugugacuaugcuugauuuaauaagggcuuggggcaagugaaguu

SEQ ID NO: 565318 - RNA, 64 nt, Homo Sapiens
caauuucuuccauaauagauaacuuugauggcacauuuaauaccucuuuuagaauugaggcccc

SEQ ID NO: 565319 - RNA, 64 nt, Homo Sapiens
aucaagaguguauuguuuacuguuuuacaguauuauuuaauauccaacuggucuccaaucucca

SEQ ID NO: 565320 - RNA, 64 nt, Homo Sapiens
uuugagcuuguaagaugagaacugcuuuuuacacauuuaauaaaaaaaggucucugaauuaucu

SEQ ID NO: 565321 - RNA, 64 nt, Homo Sapiens
uaaaaacccaaauuaucaaacccugauauuuaauauuuaauauuuucaucauuccuuccgaaac

SEQ ID NO: 565322 - RNA, 64 nt, Homo Sapiens
uaauauuuaaaaacccaaauccgaaaccccugauauuuaauauugacggaauucaucauuccuu

SEQ ID NO: 565323 - RNA, 64 nt, Homo Sapiens
gucaauuggaauuuuuagagcaugccugcauuccauuuaauagagugucgcucagguggccacu

SEQ ID NO: 565324 - RNA, 64 nt, Homo Sapiens
uccaaagauauuuucaggauucaugggccuauauauuuaauaccuaaguuacucagcucuaucc

SEQ ID NO: 565325 - RNA, 64 nt, Homo Sapiens
auugucuuaaaauacgugauuaucuaaaagcauaauuuaauagcauaaugucuucuauauguag

SEQ ID NO: 565326 - RNA, 64 nt, Homo Sapiens
auuaucuuaaaauacaugauuuucuaaaaguauaauuuaauagauguuaauuacuaaaauuuuc

SEQ ID NO: 565327 - RNA, 64 nt, Homo Sapiens
aaagaaaguaucauguaaacgauugucagguuauauuuaauaagaaauauuuucauuuaauaaa

SEQ ID NO: 565328 - RNA, 64 nt, Homo Sapiens
gauugucagguuauauuuaaacaaaaauauuuucauuuaauaaacuuuuguuguuguugaugau

SEQ ID NO: 565329 - RNA, 64 nt, Homo Sapiens
aucuugcaaagaacaguacuauaacauuuguauaauuuaauaagaaugcacaaaggaacacagu

SEQ ID NO: 565330 - RNA, 64 nt, Homo Sapiens
uggaagguucauaggagaaaggaaugaauggcuuauuuaauaaaagugcuauugaaaucacugg

SEQ ID NO: 565331 - RNA, 64 nt, Homo Sapiens
aaaaaccaauuguguccugaaaauuguuucaagaauuuaauauuuuuaugaaaauuauuuuauu

SEQ ID NO: 565332 - RNA, 64 nt, Homo Sapiens
cuugcaucauugaaacuacuacaaugauacuaucauuuaauaauauuaauauuacuugaaauag

SEQ ID NO: 565333 - RNA, 64 nt, Homo Sapiens
gccaaucuuucuagaugucucugaagguaagaucauuuaauaucuuugauaugcuuacgaguaa

SEQ ID NO: 565334 - RNA, 64 nt, Homo Sapiens
uaaauaucaauaacagugcuacuuaguuaucaguauuuaauaucugaggugaguuggggguauc

SEQ ID NO: 565335 - RNA, 64 nt, Homo Sapiens
aagugaaccucccgugccuuagugaauguuauauauuuaauauuaaaaagguuuugguuaugaa

SEQ ID NO: 565336 - RNA, 64 nt, Homo Sapiens
cuaaaaaaaaaaaguucugucaggaauauucucgauuuaauaaggcccauagcggaugccuccu

SEQ ID NO: 565337 - RNA, 64 nt, Homo Sapiens
acuaggucaaaaacaaaacacccaaggaagcaauauuuaauaaagggaguuguuauaaacacac

SEQ ID NO: 565338 - RNA, 64 nt, Homo Sapiens
cuguuuuauacuauaaaguuuuugccaguaauaaauuuaauauuaggaaauaaaucaguguccg

SEQ ID NO: 565339 - RNA, 64 nt, Homo Sapiens
uaucuauuucuguuacauuuauuaggcccccaaaauuuaauagaugaauaaucaaaaauauuuu

SEQ ID NO: 565340 - RNA, 64 nt, Homo Sapiens
cuucuaauucuaguuuauacucuauauuugaguuauuuaauacauuuuagcaauuuagagcaau

SEQ ID NO: 565341 - RNA, 64 nt, Homo Sapiens
cacauuagguuuaauuuuuuaaaauguaguuucaauuuaauaauagcagacugauacuaaauuu

SEQ ID NO: 565342 - RNA, 64 nt, Homo Sapiens
cuuuuguugaaaccacagcuagcacaacauuaugauuuaauaugaaauggcuaaggucaaguaa

SEQ ID NO: 565343 - RNA, 64 nt, Homo Sapiens
gcuuuuaauuaugguacgcuacuucuuuucuuucauuuaauaaagcaaagaaaccacagcacau

SEQ ID NO: 565344 - RNA, 64 nt, Homo Sapiens
gaaugauauaacuccugugcaaugaaggugauaacaguaaaagaaggcaggggaaacuuacguu

SEQ ID NO: 565345 - RNA, 64 nt, Homo Sapiens
uauuacaagucuugacccaucccugucguaacuccaguaaaaguuacuguuacuagaaaauuuu

SEQ ID NO: 565346 - RNA, 64 nt, Homo Sapiens
cuguaguaauugaccuaaaaacuuauguuagcuucaguaaaaguacuuuuauuguaaauaaaca

SEQ ID NO: 565347 - RNA, 64 nt, Homo Sapiens
agugcccuugagaagggauuuuuuuuuaaauauacaguaaaauauuucgugggaaccuaacacu

SEQ ID NO: 565348 - RNA, 64 nt, Homo Sapiens
aauauggcguauuaugugaaaagaacuacaggcacaguaaaaaaccaaauuguaccacuccuug

SEQ ID NO: 565349 - RNA, 64 nt, Homo Sapiens
auggucuacuaaggaaacacauauagaaaagguacaguaaaaaucacaauauuuguguaucuaa

SEQ ID NO: 565350 - RNA, 64 nt, Homo Sapiens
ugcuuccuaacucuguuuuugaaagaaauucucccaguaaaaguucuguggccccaaauccagu

SEQ ID NO: 565351 - RNA, 64 nt, Homo Sapiens
cugugagaaaugccaucccuaaaccaaccggugucaguaaaauuguaauuuuugccaauuagag

SEQ ID NO: 565352 - RNA, 64 nt, Homo Sapiens
uuguguuucuuuuccagugucucaguuaauacaucaguaaaauguuggaaagucacuaaugugc

SEQ ID NO: 565353 - RNA, 64 nt, Homo Sapiens
acugaauaucagaaaaaaugguguauuuucagaacaguaaaauuaugagcuguuuuaaauacug

SEQ ID NO: 565354 - RNA, 64 nt, Homo Sapiens
agauaacuuagaacucagucuagcauuuuugcaccaguaaaaauaaaguaaggauuucuuuaaa

SEQ ID NO: 565355 - RNA, 64 nt, Homo Sapiens
cuuguaaugaggaguaguaaucaucaucuuuagucaguaaaaacaaacagucacauuagguaug

SEQ ID NO: 565356 - RNA, 64 nt, Homo Sapiens
aagaaucuuuuuaaagugaccuuaauauaucaugcaguaaaagguugaaauuuaggucugucau

SEQ ID NO: 565357 - RNA, 64 nt, Homo Sapiens
uuaauuuaggcgucuagaaaaucucaguucccaccaguaaaauuauccugaguagcuaaugcac

SEQ ID NO: 565358 - RNA, 64 nt, Homo Sapiens
aaauuacaaaaugaguguuuuuagauucaagugacaguaaaaggauuuguucccuucagugacu

SEQ ID NO: 565359 - RNA, 64 nt, Homo Sapiens
ccaguuuacugcuuagaaauagcaagaggcacugcaguaaaacuuguuucucauuguaaagcuu

SEQ ID NO: 565360 - RNA, 64 nt, Homo Sapiens
augguuaauuucauuucuugcuuugccaccuaagcaguaaaacaugauauugaccacuuggaga

SEQ ID NO: 565361 - RNA, 64 nt, Homo Sapiens
ccuggaagacaacccaggcauguaaaacccaaaacaguaaaaauaagauggauuaaagacuuaa

SEQ ID NO: 565362 - RNA, 64 nt, Homo Sapiens
aaagacuauucuguuucuaguuguuaaacuagcacaguaaaaguuauuucuuuacagaauggau

SEQ ID NO: 565363 - RNA, 64 nt, Homo Sapiens
auacuuuucuauuaaagaucuguacauauuuuuacaguaaaaugcuuuauggaacuaguuuuag

SEQ ID NO: 565364 - RNA, 64 nt, Homo Sapiens
uuuuuuaaaaaugaaaaaguuuauaauuuacauucaguaaaaucacccuuuuuagugucuaguc

SEQ ID NO: 565365 - RNA, 64 nt, Homo Sapiens
agcauuuaacuugcuaaauauugcuuucuaucaucaguaaaaacgauuuugaggaguaucuuau

SEQ ID NO: 565366 - RNA, 64 nt, Homo Sapiens
aauguguauucaacaaaagauuuaucuggacugccaguaaaacacuauuuccuuuauauacuug

SEQ ID NO: 565367 - RNA, 64 nt, Homo Sapiens
auauacacauauguauacauauauauauauucuacaguaaaacuguagacuguccucguccuug

SEQ ID NO: 565368 - RNA, 64 nt, Homo Sapiens
cugagaucacgacacugcacuccagccugggcaacaguaaaaccuggucuccaaaaaaaaaaaa

SEQ ID NO: 565369 - RNA, 64 nt, Homo Sapiens
auuuucgagugacuuuccuuuuugcauuuuuuggcaguaaaagccaaacguuguauuuguucuu

SEQ ID NO: 565370 - RNA, 64 nt, Homo Sapiens
cuugcuuugcuuuccucucuaugaugugauaauacaguaaaagcuuucuuacccagcauagugg

SEQ ID NO: 565371 - RNA, 64 nt, Homo Sapiens
aaaaauguuucuguuuugaaacuugaucuacaaucaguaaaaguuugauaaucaguauaucccu

SEQ ID NO: 565372 - RNA, 64 nt, Homo Sapiens
auugaugugaccacacucuucuuaauuuuguucacaguaaaaacacuuuuuugaguuauuaggc

SEQ ID NO: 565373 - RNA, 64 nt, Homo Sapiens
cauuucaaucuuacaaagcauaucgaacaguuaucaguaaaagaugacaauagcugccuucccc

SEQ ID NO: 565374 - RNA, 64 nt, Homo Sapiens
cacuuccaaaaagauacacaugguacaguccagccaguaaaaaauccuguaccacucuauucac

SEQ ID NO: 565375 - RNA, 64 nt, Homo Sapiens
gaugucagaaauugacauacaaacagaaauuacccaguaaaaaggcgauauaugaacggcauaa

SEQ ID NO: 565376 - RNA, 64 nt, Homo Sapiens
cuuuuaccacagggaaauacgcauuaauuguuuccaguaaaacuuauuuuugucuauuuggauc

SEQ ID NO: 565377 - RNA, 64 nt, Homo Sapiens
gaaaagagaacauaagcaaaucgcauuauauacccaguaaaaaauccgacuaauacucuuuuug

SEQ ID NO: 565378 - RNA, 64 nt, Homo Sapiens
uauaaaaugggggauaauuaauacaugcgugucucaguaaaaaugaucauuuuucuguucauau

SEQ ID NO: 565379 - RNA, 64 nt, Homo Sapiens
gggggugagaauaaugagauaauaacuauucucacaguaaaagaggccacggggugccuggacu

SEQ ID NO: 565380 - RNA, 64 nt, Homo Sapiens
uuugugugaaggauuggaaauuuaugugagccuucaguaaaauccuuccagaaaaccuuauuau

SEQ ID NO: 565381 - RNA, 64 nt, Homo Sapiens
aaggacuugccaugguucacuagcccccucuuaucaguaaaacaauuugagucuuuuucuuacc

SEQ ID NO: 565382 - RNA, 64 nt, Homo Sapiens
uccauuucucccuguuauuuaaaagcccaaaaagcaguaaaauucauguuaucuuauuaaaaga

SEQ ID NO: 565383 - RNA, 62 nt, Homo Sapiens
uugauauaauguguuaugcuuuaguugaaauguccccuuaacggaauaguauccccuuaugu

SEQ ID NO: 565384 - RNA, 62 nt, Homo Sapiens
uuuaguugaaauguccccuuaauggaauaguauccccuuaugucagccuaugccagggcuuc

SEQ ID NO: 565385 - RNA, 62 nt, Homo Sapiens
ugucuuugaacuuucucuuuauuauuuaacacuccccuuaacaucauuuccccccagucagc

SEQ ID NO: 565386 - RNA, 62 nt, Homo Sapiens
aaacuugaagugauaugcagguguuuuuuuuuuccccuuaaauuugaugcauuuauuuuuag

SEQ ID NO: 565387 - RNA, 62 nt, Homo Sapiens
ucuagaacugcuccuuggugggcucucaaguguccccuuagagagauuggauuugaccccuu

SEQ ID NO: 565388 - RNA, 62 nt, Homo Sapiens
gacaaaaugaagacuaucauuguuguuguuguuccccuuacaaucugaagacuggguuuuuu

SEQ ID NO: 565389 - RNA, 62 nt, Homo Sapiens
aagucuuucguagacaccccagagcacacacauccccuuaguccaccgguuagaugucucuc

SEQ ID NO: 565390 - RNA, 62 nt, Homo Sapiens
gaacacguccuaggcaggucugacgugaaaccuccccuuacccugaaccgugugacucugca

SEQ ID NO: 565391 - RNA, 62 nt, Homo Sapiens
cugccaccagcaaggauaaagaaauauuuguauccccuuacauauugacaaaaugguuuccg

SEQ ID NO: 565392 - RNA, 62 nt, Homo Sapiens
auuacuaaauauuuuauuuuaucgugggcaucuccccuuaugcagcuguuuucacuuagcau

SEQ ID NO: 565393 - RNA, 64 nt, Homo Sapiens
aucaucuggcuuuauaguggaaugccagcuacugccaccuaaaacuugaagccaagaacucuuc

SEQ ID NO: 565394 - RNA, 64 nt, Homo Sapiens
acauucagggaagaguaaugagagaucugcugauccaccuaagcuucuauggaaccacauuuua

SEQ ID NO: 565395 - RNA, 64 nt, Homo Sapiens; identical to SEQ ID NO: 138957

SEQ ID NO: 565396 - RNA, 64 nt, Homo Sapiens; identical to SEQ ID NO: 138958

SEQ ID NO: 565397 - RNA, 64 nt, Homo Sapiens; identical to SEQ ID NO: 138959

SEQ ID NO: 565398 - RNA, 64 nt, Homo Sapiens; identical to SEQ ID NO: 138960

SEQ ID NO: 565399 - RNA, 64 nt, Homo Sapiens; identical to SEQ ID NO: 138961

SEQ ID NO: 565400 - RNA, 64 nt, Homo Sapiens; identical to SEQ ID NO: 138962

SEQ ID NO: 565401 - RNA, 64 nt, Homo Sapiens; identical to SEQ ID NO: 138963

SEQ ID NO: 565402 - RNA, 64 nt, Homo Sapiens; identical to SEQ ID NO: 138964

SEQ ID NO: 565403 - RNA, 64 nt, Homo Sapiens; identical to SEQ ID NO: 138965

SEQ ID NO: 565404 - RNA, 64 nt, Homo Sapiens; identical to SEQ ID NO: 138966

SEQ ID NO: 565405 - RNA, 64 nt, Homo Sapiens; identical to SEQ ID NO: 138967

SEQ ID NO: 565406 - RNA, 64 nt, Homo Sapiens; identical to SEQ ID NO: 138968

SEQ ID NO: 565407 - RNA, 64 nt, Homo Sapiens; identical to SEQ ID NO: 138969

SEQ ID NO: 565408 - RNA, 64 nt, Homo Sapiens; identical to SEQ ID NO: 138970

SEQ ID NO: 565409 - RNA, 64 nt, Homo Sapiens; identical to SEQ ID NO: 138971

SEQ ID NO: 565410 - RNA, 64 nt, Homo Sapiens; identical to SEQ ID NO: 138972

SEQ ID NO: 565411 - RNA, 64 nt, Homo Sapiens; identical to SEQ ID NO: 138973

SEQ ID NO: 565412 - RNA, 64 nt, Homo Sapiens; identical to SEQ ID NO: 138974

SEQ ID NO: 565413 - RNA, 64 nt, Homo Sapiens; identical to SEQ ID NO: 138975

SEQ ID NO: 565414 - RNA, 64 nt, Homo Sapiens; identical to SEQ ID NO: 138976

SEQ ID NO: 565415 - RNA, 64 nt, Homo Sapiens; identical to SEQ ID NO: 138977

SEQ ID NO: 565416 - RNA, 64 nt, Homo Sapiens; identical to SEQ ID NO: 138978

SEQ ID NO: 565417 - RNA, 64 nt, Homo Sapiens; identical to SEQ ID NO: 138979

SEQ ID NO: 565418 - RNA, 64 nt, Homo Sapiens; identical to SEQ ID NO: 138980

SEQ ID NO: 565419 - RNA, 64 nt, Homo Sapiens; identical to SEQ ID NO: 138981

SEQ ID NO: 565420 - RNA, 64 nt, Homo Sapiens; identical to SEQ ID NO: 138982

SEQ ID NO: 565421 - RNA, 64 nt, Homo Sapiens; identical to SEQ ID NO: 138983

SEQ ID NO: 565422 - RNA, 64 nt, Homo Sapiens; identical to SEQ ID NO: 138984

SEQ ID NO: 565423 - RNA, 64 nt, Homo Sapiens; identical to SEQ ID NO: 138985

SEQ ID NO: 565424 - RNA, 64 nt, Homo Sapiens; identical to SEQ ID NO: 138986

SEQ ID NO: 565425 - RNA, 64 nt, Homo Sapiens; identical to SEQ ID NO: 138987

SEQ ID NO: 565426 - RNA, 64 nt, Homo Sapiens; identical to SEQ ID NO: 138988

SEQ ID NO: 565427 - RNA, 64 nt, Homo Sapiens; identical to SEQ ID NO: 138989

SEQ ID NO: 565428 - RNA, 64 nt, Homo Sapiens; identical to SEQ ID NO: 138990

SEQ ID NO: 565429 - RNA, 64 nt, Homo Sapiens; identical to SEQ ID NO: 138991

SEQ ID NO: 565430 - RNA, 64 nt, Homo Sapiens; identical to SEQ ID NO: 276116

SEQ ID NO: 565431 - RNA, 64 nt, Homo Sapiens; identical to SEQ ID NO: 276117

SEQ ID NO: 565432 - RNA, 64 nt, Homo Sapiens; identical to SEQ ID NO: 276118

SEQ ID NO: 565433 - RNA, 64 nt, Homo Sapiens; identical to SEQ ID NO: 276119

SEQ ID NO: 565434 - RNA, 64 nt, Homo Sapiens; identical to SEQ ID NO: 276120

SEQ ID NO: 565435 - RNA, 64 nt, Homo Sapiens; identical to SEQ ID NO: 276121

SEQ ID NO: 565436 - RNA, 64 nt, Homo Sapiens; identical to SEQ ID NO: 276122

SEQ ID NO: 565437 - RNA, 64 nt, Homo Sapiens; identical to SEQ ID NO: 276123

SEQ ID NO: 565438 - RNA, 64 nt, Homo Sapiens; identical to SEQ ID NO: 276124

SEQ ID NO: 565439 - RNA, 64 nt, Homo Sapiens; identical to SEQ ID NO: 276125

SEQ ID NO: 565440 - RNA, 64 nt, Homo Sapiens; identical to SEQ ID NO: 276126

SEQ ID NO: 565441 - RNA, 64 nt, Homo Sapiens; identical to SEQ ID NO: 276127

SEQ ID NO: 565442 - RNA, 64 nt, Homo Sapiens; identical to SEQ ID NO: 276128

SEQ ID NO: 565443 - RNA, 64 nt, Homo Sapiens; identical to SEQ ID NO: 276129

SEQ ID NO: 565444 - RNA, 64 nt, Homo Sapiens; identical to SEQ ID NO: 276130

SEQ ID NO: 565445 - RNA, 64 nt, Homo Sapiens; identical to SEQ ID NO: 276131

SEQ ID NO: 565446 - RNA, 64 nt, Homo Sapiens; identical to SEQ ID NO: 276132

SEQ ID NO: 565447 - RNA, 64 nt, Homo Sapiens; identical to SEQ ID NO: 276133

SEQ ID NO: 565448 - RNA, 64 nt, Homo Sapiens; identical to SEQ ID NO: 276134

SEQ ID NO: 565449 - RNA, 64 nt, Homo Sapiens; identical to SEQ ID NO: 276135

SEQ ID NO: 565450 - RNA, 64 nt, Homo Sapiens; identical to SEQ ID NO: 276136

SEQ ID NO: 565451 - RNA, 64 nt, Homo Sapiens; identical to SEQ ID NO: 276137

SEQ ID NO: 565452 - RNA, 64 nt, Homo Sapiens; identical to SEQ ID NO: 276138

SEQ ID NO: 565453 - RNA, 64 nt, Homo Sapiens; identical to SEQ ID NO: 276139

SEQ ID NO: 565454 - RNA, 64 nt, Homo Sapiens; identical to SEQ ID NO: 276140

SEQ ID NO: 565455 - RNA, 64 nt, Homo Sapiens; identical to SEQ ID NO: 276141

SEQ ID NO: 565456 - RNA, 64 nt, Homo Sapiens; identical to SEQ ID NO: 276142

SEQ ID NO: 565457 - RNA, 64 nt, Homo Sapiens; identical to SEQ ID NO: 276143

SEQ ID NO: 565458 - RNA, 64 nt, Homo Sapiens; identical to SEQ ID NO: 276144

SEQ ID NO: 565459 - RNA, 64 nt, Homo Sapiens; identical to SEQ ID NO: 276145

SEQ ID NO: 565460 - RNA, 64 nt, Homo Sapiens; identical to SEQ ID NO: 276146

SEQ ID NO: 565461 - RNA, 64 nt, Homo Sapiens; identical to SEQ ID NO: 276147

SEQ ID NO: 565462 - RNA, 64 nt, Homo Sapiens; identical to SEQ ID NO: 276148

SEQ ID NO: 565463 - RNA, 64 nt, Homo Sapiens
gaucauguauuuauaaauauuagaagaucuguauuguguagaauaauauccuuuagaaaugcuc

SEQ ID NO: 565464 - RNA, 64 nt, Homo Sapiens
guguauugcuuccucagauuaacuaguuugcuuguguguagagaaccgcuaacuugacuggaug

SEQ ID NO: 565465 - RNA, 64 nt, Homo Sapiens
ccuucaaacacaaagauugcugugaaaacgaaaauguguagacgcacucucaaaaacugcacgg

SEQ ID NO: 565466 - RNA, 64 nt, Homo Sapiens
gccacaucagcaccauccgagagcuuauuaguaauguguagauucucaugucccagccagacuu

SEQ ID NO: 565467 - RNA, 64 nt, Homo Sapiens; identical to SEQ ID NO: 129356

SEQ ID NO: 565468 - RNA, 64 nt, Homo Sapiens; identical to SEQ ID NO: 129357

SEQ ID NO: 565469 - RNA, 64 nt, Homo Sapiens; identical to SEQ ID NO: 129358

SEQ ID NO: 565470 - RNA, 64 nt, Homo Sapiens; identical to SEQ ID NO: 129359

SEQ ID NO: 565471 - RNA, 64 nt, Homo Sapiens; identical to SEQ ID NO: 129360

SEQ ID NO: 565472 - RNA, 64 nt, Homo Sapiens; identical to SEQ ID NO: 129361

SEQ ID NO: 565473 - RNA, 64 nt, Homo Sapiens; identical to SEQ ID NO: 129362

SEQ ID NO: 565474 - RNA, 64 nt, Homo Sapiens; identical to SEQ ID NO: 129363

SEQ ID NO: 565475 - RNA, 64 nt, Homo Sapiens; identical to SEQ ID NO: 129364

SEQ ID NO: 565476 - RNA, 64 nt, Homo Sapiens; identical to SEQ ID NO: 129365

SEQ ID NO: 565477 - RNA, 64 nt, Homo Sapiens; identical to SEQ ID NO: 129366

SEQ ID NO: 565478 - RNA, 64 nt, Homo Sapiens; identical to SEQ ID NO: 129367

SEQ ID NO: 565479 - RNA, 64 nt, Homo Sapiens; identical to SEQ ID NO: 129368

SEQ ID NO: 565480 - RNA, 64 nt, Homo Sapiens; identical to SEQ ID NO: 129369

SEQ ID NO: 565481 - RNA, 64 nt, Homo Sapiens; identical to SEQ ID NO: 129370

SEQ ID NO: 565482 - RNA, 64 nt, Homo Sapiens; identical to SEQ ID NO: 129371

SEQ ID NO: 565483 - RNA, 64 nt, Homo Sapiens; identical to SEQ ID NO: 129372

SEQ ID NO: 565484 - RNA, 55 nt, Homo Sapiens; identical to SEQ ID NO: 129373

SEQ ID NO: 565485 - RNA, 64 nt, Homo Sapiens; identical to SEQ ID NO: 129374

SEQ ID NO: 565486 - RNA, 64 nt, Homo Sapiens; identical to SEQ ID NO: 129375

SEQ ID NO: 565487 - RNA, 64 nt, Homo Sapiens; identical to SEQ ID NO: 129376

SEQ ID NO: 565488 - RNA, 64 nt, Homo Sapiens; identical to SEQ ID NO: 129377

SEQ ID NO: 565489 - RNA, 64 nt, Homo Sapiens; identical to SEQ ID NO: 129378

SEQ ID NO: 565490 - RNA, 64 nt, Homo Sapiens; identical to SEQ ID NO: 129379

SEQ ID NO: 565491 - RNA, 64 nt, Homo Sapiens; identical to SEQ ID NO: 53018

SEQ ID NO: 565492 - RNA, 64 nt, Homo Sapiens; identical to SEQ ID NO: 53019

SEQ ID NO: 565493 - RNA, 64 nt, Homo Sapiens; identical to SEQ ID NO: 53020

SEQ ID NO: 565494 - RNA, 64 nt, Homo Sapiens; identical to SEQ ID NO: 53021

SEQ ID NO: 565495 - RNA, 64 nt, Homo Sapiens; identical to SEQ ID NO: 53022

SEQ ID NO: 565496 - RNA, 64 nt, Homo Sapiens; identical to SEQ ID NO: 53023

SEQ ID NO: 565497 - RNA, 64 nt, Homo Sapiens; identical to SEQ ID NO: 53024

SEQ ID NO: 565498 - RNA, 64 nt, Homo Sapiens; identical to SEQ ID NO: 53025

SEQ ID NO: 565499 - RNA, 64 nt, Homo Sapiens; identical to SEQ ID NO: 53026

SEQ ID NO: 565500 - RNA, 64 nt, Homo Sapiens; identical to SEQ ID NO: 53027

SEQ ID NO: 565501 - RNA, 64 nt, Homo Sapiens; identical to SEQ ID NO: 53028

SEQ ID NO: 565502 - RNA, 64 nt, Homo Sapiens; identical to SEQ ID NO: 53029

SEQ ID NO: 565503 - RNA, 64 nt, Homo Sapiens; identical to SEQ ID NO: 53030

SEQ ID NO: 565504 - RNA, 64 nt, Homo Sapiens; identical to SEQ ID NO: 53031

SEQ ID NO: 565505 - RNA, 64 nt, Homo Sapiens; identical to SEQ ID NO: 53032

SEQ ID NO: 565506 - RNA, 64 nt, Homo Sapiens; identical to SEQ ID NO: 53033

SEQ ID NO: 565507 - RNA, 64 nt, Homo Sapiens; identical to SEQ ID NO: 53034

SEQ ID NO: 565508 - RNA, 64 nt, Homo Sapiens; identical to SEQ ID NO: 53035

SEQ ID NO: 565509 - RNA, 64 nt, Homo Sapiens; identical to SEQ ID NO: 53036

SEQ ID NO: 565510 - RNA, 64 nt, Homo Sapiens; identical to SEQ ID NO: 53037

SEQ ID NO: 565511 - RNA, 64 nt, Homo Sapiens; identical to SEQ ID NO: 53038

SEQ ID NO: 565512 - RNA, 64 nt, Homo Sapiens; identical to SEQ ID NO: 53039

SEQ ID NO: 565513 - RNA, 64 nt, Homo Sapiens; identical to SEQ ID NO: 53040

SEQ ID NO: 565514 - RNA, 64 nt, Homo Sapiens; identical to SEQ ID NO: 53041

SEQ ID NO: 565515 - RNA, 64 nt, Homo Sapiens; identical to SEQ ID NO: 53042

SEQ ID NO: 565516 - RNA, 64 nt, Homo Sapiens; identical to SEQ ID NO: 53043

SEQ ID NO: 565517 - RNA, 64 nt, Homo Sapiens; identical to SEQ ID NO: 53044

SEQ ID NO: 565518 - RNA, 64 nt, Homo Sapiens; identical to SEQ ID NO: 53045

SEQ ID NO: 565519 - RNA, 64 nt, Homo Sapiens; identical to SEQ ID NO: 53046

SEQ ID NO: 565520 - RNA, 64 nt, Homo Sapiens; identical to SEQ ID NO: 53047

SEQ ID NO: 565521 - RNA, 64 nt, Homo Sapiens; identical to SEQ ID NO: 53048

SEQ ID NO: 565522 - RNA, 64 nt, Homo Sapiens; identical to SEQ ID NO: 53049

SEQ ID NO: 565523 - RNA, 64 nt, Homo Sapiens; identical to SEQ ID NO: 53050

SEQ ID NO: 565524 - RNA, 64 nt, Homo Sapiens; identical to SEQ ID NO: 53051

SEQ ID NO: 565525 - RNA, 64 nt, Homo Sapiens; identical to SEQ ID NO: 53052

SEQ ID NO: 565526 - RNA, 64 nt, Homo Sapiens; identical to SEQ ID NO: 53053

SEQ ID NO: 565527 - RNA, 64 nt, Homo Sapiens; identical to SEQ ID NO: 53054

SEQ ID NO: 565528 - RNA, 64 nt, Homo Sapiens; identical to SEQ ID NO: 53055

SEQ ID NO: 565529 - RNA, 64 nt, Homo Sapiens; identical to SEQ ID NO: 53056

SEQ ID NO: 565530 - RNA, 64 nt, Homo Sapiens; identical to SEQ ID NO: 53057

SEQ ID NO: 565531 - RNA, 64 nt, Homo Sapiens; identical to SEQ ID NO: 53058

SEQ ID NO: 565532 - RNA, 64 nt, Homo Sapiens; identical to SEQ ID NO: 53059

SEQ ID NO: 565533 - RNA, 64 nt, Homo Sapiens
uuuauauucaccuuuugaugauuuggggaauauauauugacauacaaggaagauaaucuguuuc

SEQ ID NO: 565534 - RNA, 64 nt, Homo Sapiens
aguacuuaaguuauaugauuuauauuaaaacauuuauugacaaagccuaagagcuaaggcagua

SEQ ID NO: 565535 - RNA, 64 nt, Homo Sapiens
aguuuauauauuugucaaaagacaagaguuuauauauugacaaggguggaauacucuauauauu

SEQ ID NO: 565536 - RNA, 64 nt, Homo Sapiens
aguuuauauauugacaagaguggaauacucuauauauugacaaguaggaaauguuuuggggugg

SEQ ID NO: 565537 - RNA, 64 nt, Homo Sapiens
auuagauaauauuaagaaacuugggagaauggaauauugacaaugaagagauacuuaacaauaa

SEQ ID NO: 565538 - RNA, 64 nt, Homo Sapiens
cuugagacaucagucaaaugguggaacuccuagguauugacagaauggcauuuuaagaaauaag

SEQ ID NO: 565539 - RNA, 64 nt, Homo Sapiens
aauggaccuaaauggacuauaguauauuggauguuaaauccauauaugauguauauuuuguaaa

SEQ ID NO: 565540 - RNA, 64 nt, Homo Sapiens
uuuugccauguuuacauuuuguaucuuguaaaaauaaauccaacuuugugucuaaaaaguuaaa

SEQ ID NO: 565541 - RNA, 64 nt, Homo Sapiens
gugagauguauguuuggcucugcuuuuaacuuuauaaauccagugaccucucucucugggacuu

SEQ ID NO: 565542 - RNA, 64 nt, Homo Sapiens
aaugcaagauuucagaaaaugaaaaaucuguugauaaauccaucacuauaauaaaaccgaaggu

SEQ ID NO: 565543 - RNA, 64 nt, Homo Sapiens
auuuucaaauaacaugucaugugauauuuucuauuaaauccaguucaauggauuuguuuacaau

SEQ ID NO: 565544 - RNA, 64 nt, Homo Sapiens
gccucaaggggcccagccacgaggcuucuauugauaaauccagaggguggguggggccaaagag

SEQ ID NO: 565545 - RNA, 64 nt, Homo Sapiens
ucguucggauggugggaggcugccuaggaggcaguaaauccagucacagugccugggaggggcc

SEQ ID NO: 565546 - RNA, 64 nt, Homo Sapiens
acagugccugggaggggcccauccuuccaaaauguaaauccagucgcggugugaccgagcuggc

SEQ ID NO: 565547 - RNA, 64 nt, Homo Sapiens
uccaguuacuguggugaaaaagaagaaaugaacuuaaauccacucccuuucuagggaaaggagg

SEQ ID NO: 565548 - RNA, 64 nt, Homo Sapiens
aaaaggacucuauucacuaaguagccuguguuuuuaaauccagggcugcaggcagcaacgcaag

SEQ ID NO: 565549 - RNA, 64 nt, Homo Sapiens
uuuccuucucuugaguuccugaacaggugcucaauaaauccaagguaugcgacaugcccugccu

SEQ ID NO: 565550 - RNA, 64 nt, Homo Sapiens
agacgcugccggucggucaggaccucaaaauuauuaaauccaacuuuguuuuauuuucuugaga

SEQ ID NO: 565551 - RNA, 64 nt, Homo Sapiens
auuguaccgacaucacguagacaaaaacuccagauaaauccauugauuggguauuuucauuauu

SEQ ID NO: 565552 - RNA, 64 nt, Homo Sapiens
aaauaaggccauaaaggaggggcuuucaaauuccuaaauccacauauagggcugaguuccuagu

SEQ ID NO: 565553 - RNA, 64 nt, Homo Sapiens
aaagaagacuaaggggacaguacauguauuuuaguaaauccagauuaaaauggccaaugaugua

SEQ ID NO: 565554 - RNA, 64 nt, Homo Sapiens
agcagcuugauuccaccaaucagaucaaccaauauaaauccacaugaguacccacauggcuaac

SEQ ID NO: 565555 - RNA, 64 nt, Homo Sapiens
uccaaaauaaaaucucugcccuaaauuuuacuaauaaauccauuuuucuagugauacacaaauu

SEQ ID NO: 565556 - RNA, 64 nt, Homo Sapiens
aucauuuauucaugagccaaagccauuaagaagauaaauccaguuaucagcuuccugucucuga

SEQ ID NO: 565557 - RNA, 64 nt, Homo Sapiens
ucuuuuuccuaauuaauguagcuuucggaugacauaaauccaguaucucugcuuaugacauaaa

SEQ ID NO: 565558 - RNA, 64 nt, Homo Sapiens
ggaugacauaaauccaguaucucugcuuaugacauaaauccaguaccucugcuuuucuuuugcu

SEQ ID NO: 565559 - RNA, 64 nt, Homo Sapiens
uaaaugaguauucaguuuuauuuuuaguaaagauuaaauccaaaacuuuacuuuuaauguagca

SEQ ID NO: 565560 - RNA, 64 nt, Homo Sapiens
ggcucauagguaaugaauauuucugacuuagauguaaauccaucuggaaucuuuacauccuuug

SEQ ID NO: 565561 - RNA, 64 nt, Homo Sapiens; identical to SEQ ID NO: 189841

SEQ ID NO: 565562 - RNA, 64 nt, Homo Sapiens; identical to SEQ ID NO: 189842

SEQ ID NO: 565563 - RNA, 64 nt, Homo Sapiens; identical to SEQ ID NO: 196221

SEQ ID NO: 565564 - RNA, 64 nt, Homo Sapiens; identical to SEQ ID NO: 196222

SEQ ID NO: 565565 - RNA, 64 nt, Homo Sapiens; identical to SEQ ID NO: 196223

SEQ ID NO: 565566 - RNA, 64 nt, Homo Sapiens; identical to SEQ ID NO: 196224

SEQ ID NO: 565567 - RNA, 64 nt, Homo Sapiens; identical to SEQ ID NO: 196225

SEQ ID NO: 565568 - RNA, 64 nt, Homo Sapiens; identical to SEQ ID NO: 196226

SEQ ID NO: 565569 - RNA, 64 nt, Homo Sapiens; identical to SEQ ID NO: 196227

SEQ ID NO: 565570 - RNA, 64 nt, Homo Sapiens; identical to SEQ ID NO: 196228

SEQ ID NO: 565571 - RNA, 64 nt, Homo Sapiens; identical to SEQ ID NO: 196229

SEQ ID NO: 565572 - RNA, 64 nt, Homo Sapiens; identical to SEQ ID NO: 196230

SEQ ID NO: 565573 - RNA, 64 nt, Homo Sapiens; identical to SEQ ID NO: 196231

SEQ ID NO: 565574 - RNA, 64 nt, Homo Sapiens; identical to SEQ ID NO: 196232

SEQ ID NO: 565575 - RNA, 64 nt, Homo Sapiens; identical to SEQ ID NO: 196233

SEQ ID NO: 565576 - RNA, 64 nt, Homo Sapiens; identical to SEQ ID NO: 196234

SEQ ID NO: 565577 - RNA, 64 nt, Homo Sapiens; identical to SEQ ID NO: 196235

SEQ ID NO: 565578 - RNA, 64 nt, Homo Sapiens; identical to SEQ ID NO: 196236

SEQ ID NO: 565579 - RNA, 64 nt, Homo Sapiens; identical to SEQ ID NO: 196237

SEQ ID NO: 565580 - RNA, 64 nt, Homo Sapiens; identical to SEQ ID NO: 196238

SEQ ID NO: 565581 - RNA, 64 nt, Homo Sapiens; identical to SEQ ID NO: 196239

SEQ ID NO: 565582 - RNA, 64 nt, Homo Sapiens; identical to SEQ ID NO: 196240

SEQ ID NO: 565583 - RNA, 64 nt, Homo Sapiens; identical to SEQ ID NO: 196241

SEQ ID NO: 565584 - RNA, 64 nt, Homo Sapiens; identical to SEQ ID NO: 196242

SEQ ID NO: 565585 - RNA, 64 nt, Homo Sapiens; identical to SEQ ID NO: 196243

SEQ ID NO: 565586 - RNA, 64 nt, Homo Sapiens; identical to SEQ ID NO: 196244

SEQ ID NO: 565587 - RNA, 64 nt, Homo Sapiens; identical to SEQ ID NO: 196245

SEQ ID NO: 565588 - RNA, 64 nt, Homo Sapiens; identical to SEQ ID NO: 196246

SEQ ID NO: 565589 - RNA, 64 nt, Homo Sapiens; identical to SEQ ID NO: 196247

SEQ ID NO: 565590 - RNA, 64 nt, Homo Sapiens; identical to SEQ ID NO: 196248

SEQ ID NO: 565591 - RNA, 64 nt, Homo Sapiens; identical to SEQ ID NO: 196249

SEQ ID NO: 565592 - RNA, 64 nt, Homo Sapiens; identical to SEQ ID NO: 196250

SEQ ID NO: 565593 - RNA, 64 nt, Homo Sapiens; identical to SEQ ID NO: 196251

SEQ ID NO: 565594 - RNA, 64 nt, Homo Sapiens; identical to SEQ ID NO: 196252

SEQ ID NO: 565595 - RNA, 64 nt, Homo Sapiens; identical to SEQ ID NO: 196253

SEQ ID NO: 565596 - RNA, 64 nt, Homo Sapiens; identical to SEQ ID NO: 196254

SEQ ID NO: 565597 - RNA, 64 nt, Homo Sapiens; identical to SEQ ID NO: 196255

SEQ ID NO: 565598 - RNA, 64 nt, Homo Sapiens; identical to SEQ ID NO: 196256

SEQ ID NO: 565599 - RNA, 64 nt, Homo Sapiens; identical to SEQ ID NO: 196257

SEQ ID NO: 565600 - RNA, 64 nt, Homo Sapiens; identical to SEQ ID NO: 196258

SEQ ID NO: 565601 - RNA, 64 nt, Homo Sapiens; identical to SEQ ID NO: 196259

SEQ ID NO: 565602 - RNA, 64 nt, Homo Sapiens; identical to SEQ ID NO: 196260

SEQ ID NO: 565603 - RNA, 64 nt, Homo Sapiens; identical to SEQ ID NO: 196261

SEQ ID NO: 565604 - RNA, 64 nt, Homo Sapiens; identical to SEQ ID NO: 196262

SEQ ID NO: 565605 - RNA, 64 nt, Homo Sapiens; identical to SEQ ID NO: 196263

SEQ ID NO: 565606 - RNA, 64 nt, Homo Sapiens; identical to SEQ ID NO: 196264

SEQ ID NO: 565607 - RNA, 64 nt, Homo Sapiens; identical to SEQ ID NO: 196265

SEQ ID NO: 565608 - RNA, 64 nt, Homo Sapiens; identical to SEQ ID NO: 196266

SEQ ID NO: 565609 - RNA, 64 nt, Homo Sapiens; identical to SEQ ID NO: 196267

SEQ ID NO: 565610 - RNA, 64 nt, Homo Sapiens; identical to SEQ ID NO: 196268

SEQ ID NO: 565611 - RNA, 64 nt, Homo Sapiens; identical to SEQ ID NO: 196269

SEQ ID NO: 565612 - RNA, 64 nt, Homo Sapiens; identical to SEQ ID NO: 196270

SEQ ID NO: 565613 - RNA, 64 nt, Homo Sapiens; identical to SEQ ID NO: 196271

SEQ ID NO: 565614 - RNA, 64 nt, Homo Sapiens; identical to SEQ ID NO: 196272

SEQ ID NO: 565615 - RNA, 64 nt, Homo Sapiens; identical to SEQ ID NO: 196273

SEQ ID NO: 565616 - RNA, 64 nt, Homo Sapiens; identical to SEQ ID NO: 196274

SEQ ID NO: 565617 - RNA, 64 nt, Homo Sapiens; identical to SEQ ID NO: 196275

SEQ ID NO: 565618 - RNA, 64 nt, Homo Sapiens; identical to SEQ ID NO: 196276

SEQ ID NO: 565619 - RNA, 64 nt, Homo Sapiens; identical to SEQ ID NO: 196277

SEQ ID NO: 565620 - RNA, 64 nt, Homo Sapiens; identical to SEQ ID NO: 196278

SEQ ID NO: 565621 - RNA, 64 nt, Homo Sapiens; identical to SEQ ID NO: 196279

SEQ ID NO: 565622 - RNA, 64 nt, Homo Sapiens; identical to SEQ ID NO: 196280

SEQ ID NO: 565623 - RNA, 64 nt, Homo Sapiens; identical to SEQ ID NO: 196281

SEQ ID NO: 565624 - RNA, 64 nt, Homo Sapiens; identical to SEQ ID NO: 196282

SEQ ID NO: 565625 - RNA, 64 nt, Homo Sapiens; identical to SEQ ID NO: 196283

SEQ ID NO: 565626 - RNA, 64 nt, Homo Sapiens; identical to SEQ ID NO: 196284

SEQ ID NO: 565627 - RNA, 64 nt, Homo Sapiens; identical to SEQ ID NO: 196285

SEQ ID NO: 565628 - RNA, 64 nt, Homo Sapiens; identical to SEQ ID NO: 196286

SEQ ID NO: 565629 - RNA, 64 nt, Homo Sapiens; identical to SEQ ID NO: 196287

SEQ ID NO: 565630 - RNA, 64 nt, Homo Sapiens; identical to SEQ ID NO: 196288

SEQ ID NO: 565631 - RNA, 64 nt, Homo Sapiens; identical to SEQ ID NO: 196289

SEQ ID NO: 565632 - RNA, 64 nt, Homo Sapiens; identical to SEQ ID NO: 196290

SEQ ID NO: 565633 - RNA, 64 nt, Homo Sapiens; identical to SEQ ID NO: 196291

SEQ ID NO: 565634 - RNA, 64 nt, Homo Sapiens; identical to SEQ ID NO: 196292

SEQ ID NO: 565635 - RNA, 64 nt, Homo Sapiens; identical to SEQ ID NO: 196293

SEQ ID NO: 565636 - RNA, 64 nt, Homo Sapiens; identical to SEQ ID NO: 196294

SEQ ID NO: 565637 - RNA, 64 nt, Homo Sapiens; identical to SEQ ID NO: 196295

SEQ ID NO: 565638 - RNA, 64 nt, Homo Sapiens; identical to SEQ ID NO: 196296

SEQ ID NO: 565639 - RNA, 64 nt, Homo Sapiens; identical to SEQ ID NO: 196297

SEQ ID NO: 565640 - RNA, 64 nt, Homo Sapiens; identical to SEQ ID NO: 196298

SEQ ID NO: 565641 - RNA, 64 nt, Homo Sapiens; identical to SEQ ID NO: 196299

SEQ ID NO: 565642 - RNA, 64 nt, Homo Sapiens; identical to SEQ ID NO: 196300

SEQ ID NO: 565643 - RNA, 64 nt, Homo Sapiens; identical to SEQ ID NO: 196301

SEQ ID NO: 565644 - RNA, 64 nt, Homo Sapiens; identical to SEQ ID NO: 196302

SEQ ID NO: 565645 - RNA, 64 nt, Homo Sapiens; identical to SEQ ID NO: 196303

SEQ ID NO: 565646 - RNA, 64 nt, Homo Sapiens; identical to SEQ ID NO: 196304

SEQ ID NO: 565647 - RNA, 64 nt, Homo Sapiens; identical to SEQ ID NO: 196305

SEQ ID NO: 565648 - RNA, 64 nt, Homo Sapiens; identical to SEQ ID NO: 196306

SEQ ID NO: 565649 - RNA, 64 nt, Homo Sapiens; identical to SEQ ID NO: 196307

SEQ ID NO: 565650 - RNA, 64 nt, Homo Sapiens; identical to SEQ ID NO: 196308

SEQ ID NO: 565651 - RNA, 64 nt, Homo Sapiens; identical to SEQ ID NO: 196309

SEQ ID NO: 565652 - RNA, 64 nt, Homo Sapiens; identical to SEQ ID NO: 196310

SEQ ID NO: 565653 - RNA, 64 nt, Homo Sapiens; identical to SEQ ID NO: 196311

SEQ ID NO: 565654 - RNA, 64 nt, Homo Sapiens; identical to SEQ ID NO: 196312

SEQ ID NO: 565655 - RNA, 64 nt, Homo Sapiens; identical to SEQ ID NO: 196313

SEQ ID NO: 565656 - RNA, 64 nt, Homo Sapiens; identical to SEQ ID NO: 196314

SEQ ID NO: 565657 - RNA, 64 nt, Homo Sapiens; identical to SEQ ID NO: 196315

SEQ ID NO: 565658 - RNA, 64 nt, Homo Sapiens; identical to SEQ ID NO: 196316

SEQ ID NO: 565659 - RNA, 64 nt, Homo Sapiens; identical to SEQ ID NO: 196317

SEQ ID NO: 565660 - RNA, 64 nt, Homo Sapiens; identical to SEQ ID NO: 196318

SEQ ID NO: 565661 - RNA, 64 nt, Homo Sapiens; identical to SEQ ID NO: 196319

SEQ ID NO: 565662 - RNA, 64 nt, Homo Sapiens; identical to SEQ ID NO: 196320

SEQ ID NO: 565663 - RNA, 64 nt, Homo Sapiens; identical to SEQ ID NO: 196321

SEQ ID NO: 565664 - RNA, 64 nt, Homo Sapiens; identical to SEQ ID NO: 196322

SEQ ID NO: 565665 - RNA, 64 nt, Homo Sapiens
guccuccaaagagucaucguaugauucuuggauauuuagcuauuagcaauauuucucaaaccug

SEQ ID NO: 565666 - RNA, 64 nt, Homo Sapiens
cuuauuuaauuuuaaagguuucugaagacauuucuuuagcuaguagauuucccaguuaucuugc

SEQ ID NO: 565667 - RNA, 64 nt, Homo Sapiens
aggcauuuuaaaagcugaagaaaagugacauuauuuuagcuagugguuuuuaauuuauuuuuug

SEQ ID NO: 565668 - RNA, 64 nt, Homo Sapiens
auuuaugauaucaacuuggguccaagaugauaguuuuagcuagcuuaugaacauuggguucaca

SEQ ID NO: 565669 - RNA, 64 nt, Homo Sapiens
aguuuagucuacguguauaaggcucccaguaggauuuagcuaggcuacuagaaguuagacugcu

SEQ ID NO: 565670 - RNA, 64 nt, Homo Sapiens
uaggccaaaagggcuagccagguggcaagaucaauuuagcuacuuuguauuuucagagucaaau

SEQ ID NO: 565671 - RNA, 64 nt, Homo Sapiens
uaauaaaguuugauauaggccuuacucuuugcccuuuagcuaacguauuaccuuuaacuugccu

SEQ ID NO: 565672 - RNA, 64 nt, Homo Sapiens
gccuguacuuuuugcuggcagucuauucauguucuuuagcuagacaggcauuuuuaagacagau

SEQ ID NO: 565673 - RNA, 64 nt, Homo Sapiens
auuuuuaauaucguaacugauuucuugaugcuaguuuagcuauauuaggaaacugcuucuaccu

SEQ ID NO: 565674 - RNA, 64 nt, Homo Sapiens
acgcuuacuuuucauuaaaauauuucuugucgcuuuuagcuauugucagaauccaauaaacagc

SEQ ID NO: 565675 - RNA, 64 nt, Homo Sapiens
cacugaaaggcaaauuuaguucaggagguuaguuuuuagcuagcuuuggaaguaagccuuuauu

SEQ ID NO: 565676 - RNA, 64 nt, Homo Sapiens
ugcagacuaaaagguugaaggcccgaaacuaacuuuuagcuaacaauaagggcugugccccaau

SEQ ID NO: 565677 - RNA, 64 nt, Homo Sapiens
gcccaccaaaccaaaacaaaaacacuucgagcuauuuagcuaaacuuaggacaauuaccacuga

SEQ ID NO: 565678 - RNA, 64 nt, Homo Sapiens
accuugcagcgggaaccuuauuccuggcagagcauuuagcuaacuaauuugguuguucuaaaua

SEQ ID NO: 565679 - RNA, 61 nt, Homo Sapiens
uuaccuuacauagcacuugauacguguuaaaugaacauaugaauguaauuuauauauuccu

SEQ ID NO: 565680 - RNA, 61 nt, Homo Sapiens
uaccacucugaagucugcugacugugucucuugaacauacuuaggauauucugcacauuau

SEQ ID NO: 565681 - RNA, 61 nt, Homo Sapiens
ugaaacuugaacaaauagauggucacauugcugaacauaauucuaaaauaaaauauuggca

SEQ ID NO: 565682 - RNA, 61 nt, Homo Sapiens
gacaaucaccacaguuauuacccaaauacuaugaacauauuuuuguaaaccagucauucug

SEQ ID NO: 565683 - RNA, 61 nt, Homo Sapiens
uaagacacaagguacugucucugggucuguaugaacauaagucuuuucauucacgugcuuu

SEQ ID NO: 565684 - RNA, 61 nt, Homo Sapiens
uugggccauuggugcaugcauuuugcaagacugaacauaguacuguuucugaacugucuuc

SEQ ID NO: 565685 - RNA, 61 nt, Homo Sapiens
uuuaaaaacacuaugguagauaacagcccauugaacauacuuuuuaaagugaaauauuugu

SEQ ID NO: 565686 - RNA, 61 nt, Homo Sapiens
uuugccaggaagaugaaaauauggguauuuuugaacauauucaucaucaaaauuagcuaac

SEQ ID NO: 565687 - RNA, 58 nt, Homo Sapiens; identical to SEQ ID NO: 79438

SEQ ID NO: 565688 - RNA, 61 nt, Homo Sapiens
gcagagcuuuuaaccaguccgcaaagcucacugaacauaaguuaauucauacuggagaaaa

SEQ ID NO: 565689 - RNA, 61 nt, Homo Sapiens
caucaucccucaaagugucaaauuaagagagugaacauaucguggagaacaugcauacuac

SEQ ID NO: 565690 - RNA, 61 nt, Homo Sapiens
uaaaguguacuauuugauaaauaaaauaaacugaacauauuuuuauugagauauaauuaac

SEQ ID NO: 565691 - RNA, 61 nt, Homo Sapiens
gguguuagauguuagcacaucuucaaguuguugaacauaaaaauaauuucuucagagauaa

SEQ ID NO: 565692 - RNA, 61 nt, Homo Sapiens
cguuuccaacaaaguuuuacugaacaggaagugaacauaguuuuaauuuauuuuuauuguu

SEQ ID NO: 565693 - RNA, 61 nt, Homo Sapiens
caaagacgauuuuuucaggcugugauuauggugaacauaacaaaacccaguagucaccaag

SEQ ID NO: 565694 - RNA, 61 nt, Homo Sapiens
uaaacagaaguuguugcuuaugaugugugagugaacauaugccacugccuggccuuuuuuu

SEQ ID NO: 565695 - RNA, 61 nt, Homo Sapiens
gucagagagaccucauccugcucuuuugugaugaacauauucaugaaauguggaagucagu

SEQ ID NO: 565696 - RNA, 61 nt, Homo Sapiens
uggaaggacacagugaugaauguacuaugucugaacauagaaacucgggcuugagugagaa

SEQ ID NO: 565697 - RNA, 61 nt, Homo Sapiens
gaugaaauacgaaaaauuacaguuuacuuaaugaacauaaggauaaauagaaaaacugaau

SEQ ID NO: 565698 - RNA, 61 nt, Homo Sapiens
acauuuuaacaauguuaauucuugcagaccaugaacauaagcuaccuucccauuuauaugc

SEQ ID NO: 565699 - RNA, 64 nt, Homo Sapiens
auaagagcagagcucacacuuuuacaguugcaguauuucaaagucccuauccaggucacuccag

SEQ ID NO: 565700 - RNA, 64 nt, Homo Sapiens
gcuuugugcuaaaugugguuuuguguuuugcuguauuucaaaauuuuccuucuguuaaaggaaa

SEQ ID NO: 565701 - RNA, 64 nt, Homo Sapiens
gagauggggacagacugaagacagaggucguuugauuucaaagcaagucaaccugcuuuuuucu

SEQ ID NO: 565702 - RNA, 64 nt, Homo Sapiens
aaccaugucaucuuuuucuuggaugauugcaguuauuucaaaaauuugcaugcaaaauauacac

SEQ ID NO: 565703 - RNA, 64 nt, Homo Sapiens
uugcauuacuaacagccauuuaucuaaugagguuauuucaaagugaagccuacgugcucacagu

SEQ ID NO: 565704 - RNA, 64 nt, Homo Sapiens
cauuaaaaccagguauggaaauuggcuugucugcauuucaaaauacacccuuugcccaagugcc

SEQ ID NO: 565705 - RNA, 64 nt, Homo Sapiens
gcuaucuccaucugggcugaaagggaucgaagacauuucaaauuagacauuucgucauuuaagu

SEQ ID NO: 565706 - RNA, 64 nt, Homo Sapiens
gcucuaucugggcugauagaaagggaucgaaaacauuucaaauuauacauuucaucauuuaagu

SEQ ID NO: 565707 - RNA, 64 nt, Homo Sapiens
gaucuugaaaguaauauauuacaguacaagugcgauuucaaaaagccuuuggcuguugauuagu

SEQ ID NO: 565708 - RNA, 64 nt, Homo Sapiens
cuaaaucacuucuuguaggacuuagauuuuuaaaauuucaaaucuguauguuguuacugaagua

SEQ ID NO: 565709 - RNA, 64 nt, Homo Sapiens
ugauugaggaaacaaguucugaaauaauagcacaauuucaaagaagagacucuuugcaaaguug

SEQ ID NO: 565710 - RNA, 64 nt, Homo Sapiens
uuucaaagaagagacucuuugcaaaguugauaacauuucaaacccugaaggacagugacuuauu

SEQ ID NO: 565711 - RNA, 64 nt, Homo Sapiens
ucaauuugauuguccugaccuacuguauaaguaaauuucaaaugucauuacuuucucuuuguua

SEQ ID NO: 565712 - RNA, 64 nt, Homo Sapiens
ugaaagaaaaacuugaaaugcuacuuaacuuacuauuucaaagggaaguauauuucuuuuuaaa

SEQ ID NO: 565713 - RNA, 64 nt, Homo Sapiens
cucuagacaaaaccuucuauuuuagcuuuagugaauuucaaaaguaaugggucuuggaguauag

SEQ ID NO: 565714 - RNA, 64 nt, Homo Sapiens
aagugcaauauaacaauguaaccaaaucuagauaauuucaaaguugucauuaauuuaguaagcc

SEQ ID NO: 565715 - RNA, 64 nt, Homo Sapiens
caucuucuaaccuaccuaagaaaucccuggaggcauuucaaauuacacuuuuuaaacuuguuag

SEQ ID NO: 565716 - RNA, 64 nt, Homo Sapiens
acauuagugagaguaacagcuucagccaguuaggauuucaaaauuucaaccuuauuaaaaauuc

SEQ ID NO: 565717 - RNA, 64 nt, Homo Sapiens
ugucaauaaguaaugcuggaacaaauagucacaaauuucaaacuaggaucauguuagugagcag

SEQ ID NO: 565718 - RNA, 64 nt, Homo Sapiens
uuuuuaugcacuggcuauuugggauauagauccgauuucaaagguuguuuguuuuuuaauuacu

SEQ ID NO: 565719 - RNA, 64 nt, Homo Sapiens
cagaauacuugacucauuuaguuugugauauuaaauuucaaaugaaaauucacuaaucuugaau

SEQ ID NO: 565720 - RNA, 64 nt, Homo Sapiens
guccagauguaggggaagaguaauaccaaagacuauuucaaaauuuucaaagcacaauaacuag

SEQ ID NO: 565721 - RNA, 64 nt, Homo Sapiens
aaguaaacauggcguuuuaucuuuucaucagaaaauuucaaacagaauguuaaguuacaaaaga

SEQ ID NO: 565722 - RNA, 64 nt, Homo Sapiens
agaaucacucuaugcuuagauucuacuauggauaauuucaaaguuaauuagugacacuccuaau

SEQ ID NO: 565723 - RNA, 64 nt, Homo Sapiens
aguuuugcuaugggcugcccuauaugcagaacacauuucaaaugcuugauuuguaaugagcucu

SEQ ID NO: 565724 - RNA, 64 nt, Homo Sapiens
gauuuccucuguaaucuauucagagauuuucaacauuucaaaaucaaugaaugaaacuagaaag

SEQ ID NO: 565725 - RNA, 64 nt, Homo Sapiens
ggcucaggaucugaccgcagucccgggaguaagcauuucaaagggggaaggcaguguggucccu

SEQ ID NO: 565726 - RNA, 64 nt, Homo Sapiens
uacauaaacauuaggcagguugcuuaaccuuuuuauuucaaacucucucaacucuaaagugcua

SEQ ID NO: 565727 - RNA, 64 nt, Homo Sapiens
ugugugaaauaguuuuuauugaaagucaagugacauuucaaaagaaguucuauaacaauuaugu

SEQ ID NO: 565728 - RNA, 64 nt, Homo Sapiens
uaguuuuugccacaucugcaaugauuauuguuuaauuucaaaagaauccucaggcucuacaauc

SEQ ID NO: 565729 - RNA, 64 nt, Homo Sapiens
uaugcaugccaaauguaaggccaugaaaaucaguauuucaaauaacuuaaaaaaugcuuuacua

SEQ ID NO: 565730 - RNA, 64 nt, Homo Sapiens
cuuacaaaguauuuuucccaaagauagcuuuacuauuucaaaaauugucaaauuaaugcaugcu

SEQ ID NO: 565731 - RNA, 64 nt, Homo Sapiens
uuaauaucacuuaucuacuucauugccuaaguucauuucaaagaauuuguauuuagaaaagguu

SEQ ID NO: 565732 - RNA, 64 nt, Homo Sapiens
aauaacugucagaggugaucuuuauuuucuaaauauuucaaacuugaaaacagaguaaaaaagu

SEQ ID NO: 565733 - RNA, 64 nt, Homo Sapiens
acaaaaagaagcagcagcagacaaaacauuguauauuucaaaagcacauugaagggcagagccu

SEQ ID NO: 565734 - RNA, 64 nt, Homo Sapiens
uaauguccugcuuucacauuuuaauugucaaauaauuucaaauuaguuagaugguccuaaacau

SEQ ID NO: 565735 - RNA, 64 nt, Homo Sapiens
uuuauuaccuuccucggugcaaaaaucaauaaaaauuucaaauguaaaacuggauuuuaaauuu

SEQ ID NO: 565736 - RNA, 64 nt, Homo Sapiens
gaaacuuuaauccaaagaaaagguaggugguuuuauuucaaaggagaaauuuagcagucagauu

SEQ ID NO: 565737 - RNA, 64 nt, Homo Sapiens
aggucagaccuuuuauacuucucagcuuuuucguauuucaaauauuucacguaucuuccaagua

SEQ ID NO: 565738 - RNA, 64 nt, Homo Sapiens
cacuaacugaauucuccaaauacucacacgugaaauuucaaaaaagaagccacaaauauguagu

SEQ ID NO: 565739 - RNA, 64 nt, Homo Sapiens
uagccuggcagaacagauuacuuaaagcuauuucauuucaaagcagacugaaugugacuucauc

SEQ ID NO: 565740 - RNA, 64 nt, Homo Sapiens
aacacgugcaccccaucaucuuuugggagagaauauuucaaaugucucauuuuuauuuuuauuu

SEQ ID NO: 565741 - RNA, 64 nt, Homo Sapiens
ccuugucaauggucaagcguaucuuccacugcaaauuucaaaaguguaaauguccaaaauguug

SEQ ID NO: 565742 - RNA, 64 nt, Homo Sapiens
gcagcaguuccaugaagacacgcaagggcaaaccauuucaaauggggggcaccugaccagaaug

SEQ ID NO: 565743 - RNA, 64 nt, Homo Sapiens
gauuguaugcacuugcaaagacaaauauaugcauauuucaaaugacacauauauauacacauac

SEQ ID NO: 565744 - RNA, 64 nt, Homo Sapiens
auguguguacguguguauauaucuucugaaauauauuucaaaauuauguaaauuauauuuauac

SEQ ID NO: 565745 - RNA, 64 nt, Homo Sapiens
acgggaguauucuguugguuugcucuuaauggaaauuucaaaggugguauaauuacccccauug

SEQ ID NO: 565746 - RNA, 64 nt, Homo Sapiens
uuaauuaauauaauuaaaagcucuuugcauuaaaauuucaaaguagcgucacaagccagcaacu

SEQ ID NO: 565747 - RNA, 64 nt, Homo Sapiens
gauuaauauguuucugcuguaaaggauuucuaaaauuucaaacuaauacucuuuuucaagugcu

SEQ ID NO: 565748 - RNA, 64 nt, Homo Sapiens
ccaauugcuuuaccugaacauaucuaucggaaggauuucaaacaagcagcccucugagauggcg

SEQ ID NO: 565749 - RNA, 64 nt, Homo Sapiens
aggaagcucaggacuuuuuucuuuaaagcuagucauuucaaaagcauauuguauuuuuuugaau

SEQ ID NO: 565750 - RNA, 64 nt, Homo Sapiens
uauuguauuuuuuugaaugacuacaguauggacaauuucaaaaaccaaaacccacuuuggauug

SEQ ID NO: 565751 - RNA, 64 nt, Homo Sapiens
ugucaaaaaaugagcaacagaggagucacucuggauuucaaaaaaauuuauuauccauaauuau

SEQ ID NO: 565752 - RNA, 64 nt, Homo Sapiens
gcugcugauguaguucccgguugaacugagagcaauuucaaaagaauuugaguaacaaacagcu

SEQ ID NO: 565753 - RNA, 64 nt, Homo Sapiens
cucccuuuugacaaaaaaacugaauauuugcuucauuucaaauauaauuucuguuuaaaaauau

SEQ ID NO: 565754 - RNA, 64 nt, Homo Sapiens
uaaucucugccaucucgcuaaguuucauuuaaucauuucaaaguuacaauguuuucacauauau

SEQ ID NO: 565755 - RNA, 64 nt, Homo Sapiens
gcuguucgugacauucuuuaugugcaaauuugugauuucaaaaauguccugccaguuuaagggu

SEQ ID NO: 565756 - RNA, 64 nt, Homo Sapiens
auaaccuuccucuuagaaaauggcagguguuguaauuucaaauuuuugugcaauuagauuaaau

SEQ ID NO: 565757 - RNA, 64 nt, Homo Sapiens
aacacuagaccuuaugugguuuauuccuucaaucauuucaaacauugaaaguagggccuacaug

SEQ ID NO: 565758 - RNA, 64 nt, Homo Sapiens
ugauauuuuucuuuuacauguaaacaaugaaguuauuucaaaguuaaguuuuaaacaaaauaca

SEQ ID NO: 565759 - RNA, 64 nt, Homo Sapiens
ugagaaagaaguauauauggauaaauauuuauagauuucaaaauuugucaaauaaagaacaucu

SEQ ID NO: 565760 - RNA, 64 nt, Homo Sapiens
aucgaguuguacaugauaaacacaauguauacauauuucaaacuuuaguucaacugauccauuc

SEQ ID NO: 565761 - RNA, 64 nt, Homo Sapiens
ucaaacggcaacauuccucagaaaccaaagcuuuauuucaaaucucuuccuucccuggcugguu

SEQ ID NO: 565762 - RNA, 64 nt, Homo Sapiens
uacucucaaccaccuaggcaaugaagaauauaccauuucaaauauuuacaguacuugucuucac

SEQ ID NO: 565763 - RNA, 64 nt, Homo Sapiens
aaaaaagaaaaaaagaaaaaagaaaaaucucauuauuucaaaaugauagacauauaccaaaaac

SEQ ID NO: 565764 - RNA, 64 nt, Homo Sapiens
gcucauauccuuuugaagguaguugcaaagagacauuucaaaacugcccuaggccauugcagca

SEQ ID NO: 565765 - RNA, 64 nt, Homo Sapiens
uauuaguuuuaucuuuaacauggcucucauuuaaauuucaaaaugugcaaaaagaagcaugugg

SEQ ID NO: 565766 - RNA, 64 nt, Homo Sapiens
aaucagcauucuccagcaaucguugguuucuuccauuucaaacucccaucucaagcaagaaugg

SEQ ID NO: 565767 - RNA, 64 nt, Homo Sapiens
uuauuuuuuuauuuauucauuagaaauuuuccucauuucaaaauaauuuaugacucauggaaug

SEQ ID NO: 565768 - RNA, 64 nt, Homo Sapiens
acagccaguaauaauaauuuaaauauaauuuauuauuucaaaagaauaugucuuaaaagggaaa

SEQ ID NO: 565769 - RNA, 64 nt, Homo Sapiens
ugcaugucaggauugcacaguauguuacaauacaauuucaaagagaacccacauuugugagauu

SEQ ID NO: 565770 - RNA, 64 nt, Homo Sapiens
ucuacugccaaacuucuggcaaauuuaccugugaauuucaaaauguuauaaaaucucuugauau

SEQ ID NO: 565771 - RNA, 64 nt, Homo Sapiens
auguauuuucuucuaugugcaagaaaaauagggcauuucaaagagcuguuuugauuaaaauuua

SEQ ID NO: 565772 - RNA, 64 nt, Homo Sapiens
uucugaaucuuuguauuugcuuuugcaaauagguauuucaaagcucuuuuccuaacugguuaag

SEQ ID NO: 565773 - RNA, 64 nt, Homo Sapiens
auacccucaauuucuggccuuuggcuauuuuagcauuucaaagugacuucuaugaagcuuuuuu

SEQ ID NO: 565774 - RNA, 64 nt, Homo Sapiens
ugauuauuauaaaaauaaugaauucucacuguaaauuucaaaaaaaaauuacaaaaguauguga

SEQ ID NO: 565775 - RNA, 64 nt, Homo Sapiens
uuccuuuucuaaccuauuaaaauaccucacuaucauuucaaaagguuaaaugaguugaucacua

SEQ ID NO: 565776 - RNA, 64 nt, Homo Sapiens
aucacuaucucugcucugugcuccucaaaauauaauuucaaauggauccgaucuaaaucuauac

SEQ ID NO: 565777 - RNA, 64 nt, Homo Sapiens
cagauucacugagcauaaaaaauuucauccaccgauuucaaaacaugcuuguaaucaggaaagu

SEQ ID NO: 565778 - RNA, 64 nt, Homo Sapiens
gaagaaaauguaacagaagcuaaugccaccauugauuucaaaguuugaacagcuuugauuaacu

SEQ ID NO: 565779 - RNA, 64 nt, Homo Sapiens
cguuuugcuuuugagucauguaaugcagccaauaauuucaaaccagccaauucucuuaacucug

SEQ ID NO: 565780 - RNA, 64 nt, Homo Sapiens
uaugaagaauuacagaauuaaagaaaaccucuaaauuucaaaauuuacaccccagagauuuaag

SEQ ID NO: 565781 - RNA, 64 nt, Homo Sapiens
caauccuaagagcuaaugugguuuuucaaucaugauuucaaaugcuucaguagaauuagauuuu

SEQ ID NO: 565782 - RNA, 64 nt, Homo Sapiens
auaaggaaggcugguuauggauauucauaagguuauuucaaaguuaauaaagacaaaguggcaa

SEQ ID NO: 565783 - RNA, 64 nt, Homo Sapiens
acuuuaagggauccuuuagaaacauuuuuacuuaauuucaaaugagugggcugagcauguagac

SEQ ID NO: 565784 - RNA, 64 nt, Homo Sapiens
acuucaaagauaguuauugaccuuauaaauaaauauuucaaaauuuugauucggaagacuaagu

SEQ ID NO: 565785 - RNA, 64 nt, Homo Sapiens
agcacucuaaaauuuagaguauaaauugucuuauauuucaaauuagaaaaguucaaaugaaguu

SEQ ID NO: 565786 - RNA, 64 nt, Homo Sapiens
uuaguaaauuugguguaauacguggggcuuccauauuucaaaguggaagcuuucuucucugaag

SEQ ID NO: 565787 - RNA, 64 nt, Homo Sapiens
cuguuuucuggggucugggaaaauagaaaauaagauuucaaauauuaaauaagcuuaaaggaac

SEQ ID NO: 565788 - RNA, 64 nt, Homo Sapiens
gauuguauuucucugcuuucauuucaauuucauuauuucaaauugcuugucaaaauggcccaaa

SEQ ID NO: 565789 - RNA, 64 nt, Homo Sapiens
ccguaaccuaggcacucugcaaguccaguguuuaauuucaaagcagugaugaauugcucuuuug

SEQ ID NO: 565790 - RNA, 64 nt, Homo Sapiens
uaaaauuguccacacacuagaaaaauaaaucagaauuucaaauuauaaaaauacuuuguagauu

SEQ ID NO: 565791 - RNA, 64 nt, Homo Sapiens
uguguauauaugauuucuauaauacuaaacuaauauuucaaaaauuugaaauguuaauauguua

SEQ ID NO: 565792 - RNA, 64 nt, Homo Sapiens
uugaaauguuugauauggcaagauagguaugguaauuucaaagugaauugggaauuccucuggc

SEQ ID NO: 565793 - RNA, 64 nt, Homo Sapiens
uauucuugagauacaaaaaaaaaaaguaaauacaauuucaaaaaaaaaguuccggaucuguuuu

SEQ ID NO: 565794 - RNA, 64 nt, Homo Sapiens
ggugcugaacuuucucucauaggacgucgcuuggauuucaaauccacggucaccugcugcccuu

SEQ ID NO: 565795 - RNA, 64 nt, Homo Sapiens
uccugcacuucgagaagaaucaaaauguuccugaauuucaaauaccucaugcaaaaugucuccu

SEQ ID NO: 565796 - RNA, 64 nt, Homo Sapiens
acaauguacaauuguuucauuucagaaaauaaaaauuucaaaucaugaauaccuugugguuuug

SEQ ID NO: 565797 - RNA, 64 nt, Homo Sapiens
ugcauuuaaaaucauacauggguucuacucuaagauuucaaaagacaaguauuacuagaguggu

SEQ ID NO: 565798 - RNA, 64 nt, Homo Sapiens
aggauaaauccucugugguauuaugggaugaaauauuucaaaaggaaggcagagcuucuauucu

SEQ ID NO: 565799 - RNA, 64 nt, Homo Sapiens
guaauuucaguuuggagcuugcagccaaguuuucauuucaaaaugauuuuaaaaauauuuuacu

SEQ ID NO: 565800 - RNA, 64 nt, Homo Sapiens
uccaagaauuucuaguauaucuagcuuuccuuucauuucaaaagagggcaugaaaaacuaacug

SEQ ID NO: 565801 - RNA, 64 nt, Homo Sapiens
aacaaauguauacgguuuuaaauaacuacauuuuauuucaaacuucaguuggugaguuuugaag

SEQ ID NO: 565802 - RNA, 64 nt, Homo Sapiens
auuaaauuucuacugcuacuauguuucugguuucauuucaaauaaacuagguuaguugcgaggg

SEQ ID NO: 565803 - RNA, 64 nt, Homo Sapiens
cugaaaucucauaaaaaguuuguaagaguuguguauuucaaaaauguaaauacuguguuugugc

SEQ ID NO: 565804 - RNA, 64 nt, Homo Sapiens
gcuagaguuaguacuacuuacacgugcaggucuaauuucaaaggcccuaagaaugcuaugauuu

SEQ ID NO: 565805 - RNA, 64 nt, Homo Sapiens
aaguccagccaguuuacucauuucgauucagaauauuucaaauuuagcaauaaacaauuagcau

SEQ ID NO: 565806 - RNA, 64 nt, Homo Sapiens
guuucacuuuuuaaaaaauccauuacuguuuugcauuucaaaaguuggauuaaaggguuguaac

SEQ ID NO: 565807 - RNA, 64 nt, Homo Sapiens
uguggaauuuaguuauuauguguauuuauguaguauuucaaacauuucaaaaugcuuucaucua

SEQ ID NO: 565808 - RNA, 64 nt, Homo Sapiens
uaguuauuauguguauuuauguaguauuucaaacauuucaaaaugcuuucaucuauguuuauca

SEQ ID NO: 565809 - RNA, 64 nt, Homo Sapiens
uaucacauccucuugaaaaugaauugucuacaaaauuucaaaugcaaaguauuacagccaaaua

SEQ ID NO: 565810 - RNA, 64 nt, Homo Sapiens
acuaugagucucuaaaucucucuguaagaaaaaaauuucaaaguaaagauuuuacucuugcaau

SEQ ID NO: 565811 - RNA, 64 nt, Homo Sapiens
gagacauaaugacagcugauguuaaacuuuucauauuucaaauuagauucccuaggagguauaa

SEQ ID NO: 565812 - RNA, 64 nt, Homo Sapiens
agauauaccgugugaagcuauugucagcuucucuauuucaaaaugcaaucagcauauaacuaua

SEQ ID NO: 565813 - RNA, 64 nt, Homo Sapiens
gugggggaagaaagaaacuguucauuuagcccagauuucaaauauucaucaauuacauuacaca

SEQ ID NO: 565814 - RNA, 64 nt, Homo Sapiens
gaagauaaauaauaucccaauuucauuaauuuugauuucaaaugauccaugcauucugauagca

SEQ ID NO: 565815 - RNA, 64 nt, Homo Sapiens
uacagucucagaaaugguuaguccauuucuuacaauuucaaaguuuugacuagugagcuuaauu

SEQ ID NO: 565816 - RNA, 64 nt, Homo Sapiens
caacuagauggggcucugaaaagaaaggucacauauuucaaacaaguuuaagaccacaaguuag

SEQ ID NO: 565817 - RNA, 64 nt, Homo Sapiens
auguuaugugcaaugaacacgccugugaaaauacauuucaaaaauuugcaaaugacuaccuaua

SEQ ID NO: 565818 - RNA, 64 nt, Homo Sapiens
uuugcacaauauaccacuuaugguuugcaccgucauuucaaaugggguacaaaucucccaaaga

SEQ ID NO: 565819 - RNA, 64 nt, Homo Sapiens
uauuuccaaucacaaggaaaaaucaguuuacuucauuucaaaacaagcagcugugacaaccucc

SEQ ID NO: 565820 - RNA, 64 nt, Homo Sapiens
aaugggucccaaagccuaacuguauacgucuaagauuucaaaacugugugagccuaugaaaaag

SEQ ID NO: 565821 - RNA, 64 nt, Homo Sapiens
agacaugugggaaaggcuuuuauucucccacgucauuucaaagacaugaaaaaacucacacugc

SEQ ID NO: 565822 - RNA, 64 nt, Homo Sapiens
agauaugugggaaaggcuuuuauucugccaagucauuucaaauaccugaaaaaucuuacacugg

SEQ ID NO: 565823 - RNA, 64 nt, Homo Sapiens
ggcgcgagccaccgcgcccggccccuaaguuaauauuucaaacaaucgaagguaaaacaacaua

SEQ ID NO: 565824 - RNA, 64 nt, Homo Sapiens
ccuuaauggguuguauagaacacugaagcaucugauuucaaacucuuagcucuuuuccucuauu

SEQ ID NO: 565825 - RNA, 64 nt, Homo Sapiens
caguuuuccccugacauaugagugauuucaguuuauuucaaauaaaccauguggugaaggcuua

SEQ ID NO: 565826 - RNA, 64 nt, Homo Sapiens
caugaaaggacucacacuagguuuauuucauuggauuucaaagaagauaugugggaaagccuuu

SEQ ID NO: 565827 - RNA, 64 nt, Homo Sapiens
ggguccauuagggcuucguucuguccagcuucuaauuucaaaacgaagagaccaaagccuguaa

SEQ ID NO: 565828 - RNA, 64 nt, Homo Sapiens
ccugagugagucugacugaaucucgugaugauucauuucaaaauauucaacuuuaaaacaaauu

SEQ ID NO: 565829 - RNA, 64 nt, Homo Sapiens
uuuacaagauuuaauaggaaaugaaacagcuugaauuucaaacuaaauuguauuuucagagcua

SEQ ID NO: 565830 - RNA, 64 nt, Homo Sapiens
ucuuuauaauaauuucuuauggagaagaggcuauauuucaaaggaauugagacauacucccauc

SEQ ID NO: 565831 - RNA, 64 nt, Homo Sapiens
agucuagaccagcuagugcuagugauuuuuggauauuucaaaauguggcccacaaugagugagu

SEQ ID NO: 565832 - RNA, 64 nt, Homo Sapiens
aacauugcagguauuuuauaguuuguagcuggauauuucaaagagugucuagaauuguucuccu

SEQ ID NO: 565833 - RNA, 64 nt, Homo Sapiens
gaucuuugaaaccucagauuaaugaaaugaagauauuucaaacaccugccccaaauuucaaauu

SEQ ID NO: 565834 - RNA, 64 nt, Homo Sapiens
aaugaaaugaagauauuucaauauccugccccaaauuucaaauuauguuuagacucuuaagauc

SEQ ID NO: 565835 - RNA, 64 nt, Homo Sapiens
aaauuuugaaccaaaaacaugcaaggaauauaagauuucaaauagucuucacauuuuugucuaa

SEQ ID NO: 565836 - RNA, 64 nt, Homo Sapiens
uagguauuagagcacuaucacaucauugcuuaauauuucaaaaaaugggcaaggccauucucua

SEQ ID NO: 565837 - RNA, 64 nt, Homo Sapiens
aaaaaccaauacaacaaaacgaguggcacgauuuauuucaaacuaggccagcugggauuccagc

SEQ ID NO: 565838 - RNA, 64 nt, Homo Sapiens
aucucgugguguuucgcagaaaaaaauccagaaaauuucaaaugcaguugaguauucuuuuuua

SEQ ID NO: 565839 - RNA, 64 nt, Homo Sapiens
acagcauuuccccaguugcccuuuaaguucuucuauuucaaacguuaauuuugcuucucuuucu

SEQ ID NO: 565840 - RNA, 64 nt, Homo Sapiens
ucaggucgauuugugguaacuguagucaucuuaaauuucaaaccauuuaccaucugaaaguuuu

SEQ ID NO: 565841 - RNA, 64 nt, Homo Sapiens
guauauauaaaagguaaaaaauguuggccuggguauuucaaaggauggaugcaacuuauuaaaa

SEQ ID NO: 565842 - RNA, 64 nt, Homo Sapiens
caugaauaagaauauuccguaagugauuucaaauauuucaaauuuguauaguuucauuuauuug

SEQ ID NO: 565843 - RNA, 64 nt, Homo Sapiens
uuucaaauucaugaauaagaauuuauuugaagugauuucaaauaaauucuaaguguauaguuuc

SEQ ID NO: 565844 - RNA, 64 nt, Homo Sapiens
aacuucauccauuugcacuguucagacauauauauguauguauguaaaaauuauauauacacaa

SEQ ID NO: 565845 - RNA, 64 nt, Homo Sapiens
ucauccauuugcacuguucagacauauauauguauguauguaaaaauuauauauacacaaauua

SEQ ID NO: 565846 - RNA, 64 nt, Homo Sapiens
uauagaugucuguguauacauauguaugugugaguguauguauacacacacacacacacacaca

SEQ ID NO: 565847 - RNA, 64 nt, Homo Sapiens
gggaaagacccuaggugcucauaacuagaguauguguauguacuuacauggguguuuugaucuc

SEQ ID NO: 565848 - RNA, 64 nt, Homo Sapiens
uauguaaauuguguguuaaaacauauaguguguauguauguauauagcaaaguauuugcugcuu

SEQ ID NO: 565849 - RNA, 64 nt, Homo Sapiens
uauauauguaaauugugugugcuuacauauaguguguauguauguaaguagcaaaguauuugcu

SEQ ID NO: 565850 - RNA, 64 nt, Homo Sapiens
cacacacacacgugugcacaacugaauguguguauguauguacauuucucguugaguucucccc

SEQ ID NO: 565851 - RNA, 64 nt, Homo Sapiens
uacacacacacacacgugugccccacugaauguguguauguaugccuguuucucguugaguucu

SEQ ID NO: 565852 - RNA, 64 nt, Homo Sapiens
aggcuucgaagcacaagccaaauaugucaauauuuguauguaagaaacuaauuauguaauaggu

SEQ ID NO: 565853 - RNA, 64 nt, Homo Sapiens
uccuggacuaugugguuuuaugacuaaagucacauguauguauuaaacauugaggcucuguaga

SEQ ID NO: 565854 - RNA, 64 nt, Homo Sapiens
cugcgcgcuauccccucacauucucuauguacuauguauguauguauuauuauuauugcugcca

SEQ ID NO: 565855 - RNA, 64 nt, Homo Sapiens
gcgcuauccccucacauucucuauguacuauguauguauguauuauuauuauugcugccaagag

SEQ ID NO: 565856 - RNA, 64 nt, Homo Sapiens
uuucacaauuagacuacauuuaauguguaggaauuguauguauguauaucuucuguaaauaaca

SEQ ID NO: 565857 - RNA, 64 nt, Homo Sapiens
acaauuagacuacauuuaauguguaggaauuguauguauguauaucuucuguaaauaacaucua

SEQ ID NO: 565858 - RNA, 64 nt, Homo Sapiens
uaaacacccacauauauuugauauuuaauaugcauguauguaucgcuaaucuaaaaaacuggug

SEQ ID NO: 565859 - RNA, 64 nt, Homo Sapiens
acuuacugaagaauaccugacaaucaugauugauuguauguaucaggccagaagcugucugagg

SEQ ID NO: 565860 - RNA, 64 nt, Homo Sapiens
uaaauacauagauuaaggaauuuucuauauuguauguauguauaccaauguuuuuugcaucaac

SEQ ID NO: 565861 - RNA, 64 nt, Homo Sapiens
uauauaaauacauagauuaacaacuuuucuauauuguauguaugcaagccaauguuuuuugcau

SEQ ID NO: 565862 - RNA, 64 nt, Homo Sapiens
acccguaaauauccauuuuggccuucuuguuuucuguauguauaaaaaguaagcaaacaugauu

SEQ ID NO: 565863 - RNA, 64 nt, Homo Sapiens
uaaaugaucauccgacucagcuuggugcuaauauuguauguauucugggaaaaaaauaugcugc

SEQ ID NO: 565864 - RNA, 64 nt, Homo Sapiens
uauguagacuauccuaaugauacacauauauguguguauguagacauaucuacacauacauaua

SEQ ID NO: 565865 - RNA, 64 nt, Homo Sapiens
auggcuguacagguagaccaaguacuuuaauguauguauguauauaggugacagguuauugucc

SEQ ID NO: 565866 - RNA, 64 nt, Homo Sapiens
uauaauggcuguacagguagguccaguacuuuaauguauguauguucuuaggugacagguuauu

SEQ ID NO: 565867 - RNA, 64 nt, Homo Sapiens
aaaugaaauauauauguauguguauauauauacauguauguaugaaauauauauaugugcgugu

SEQ ID NO: 565868 - RNA, 64 nt, Homo Sapiens
gcuauaauuuggcaugucauuaucuagauuuauauguauguacguauuucagguccuugaaauu

SEQ ID NO: 565869 - RNA, 64 nt, Homo Sapiens
agguuuucaguaguuuacccuccggaacccaaguuguauguauguauacgugugugugugugug

SEQ ID NO: 565870 - RNA, 64 nt, Homo Sapiens
uuucaguaguuuacccuccggaacccaaguuguauguauguauacgugugugugugugugugug

SEQ ID NO: 565871 - RNA, 64 nt, Homo Sapiens
uucucauuuuuaucccauugagacuauuuauuuauguauguauguauuuauuuauuuauugccu

SEQ ID NO: 565872 - RNA, 64 nt, Homo Sapiens
cauuuuuaucccauugagacuauuuauuuauguauguauguauuuauuuauuuauugccuggag

SEQ ID NO: 565873 - RNA, 64 nt, Homo Sapiens
aaaaagacauaaaaccuuagcaacugccauuuacuguauguagauagaaaaugagcauuuuuua

SEQ ID NO: 565874 - RNA, 64 nt, Homo Sapiens
uauauacaaucguguguaaauucaaaauaagaaauguauguaauggaaagucuaaaaugcuuac

SEQ ID NO: 565875 - RNA, 64 nt, Homo Sapiens
gagucagaaguagcuucugugugaaacuuauauuuguauguagcuuucuaggaaaauuuuacag

SEQ ID NO: 565876 - RNA, 64 nt, Homo Sapiens
uaugaugggugcauugucagagggaaaauauauguguauguacacauguguauguacacacaca

SEQ ID NO: 565877 - RNA, 64 nt, Homo Sapiens
ugucagagggaaaauauauguguauguacacauguguauguacacacacacacacaccugccau

SEQ ID NO: 565878 - RNA, 64 nt, Homo Sapiens
uaacugaauuuguucaguguaagcagcuacuguauguauguagcguuuuaaugggguugaaaac

SEQ ID NO: 565879 - RNA, 64 nt, Homo Sapiens
uagcuaacugaauuuguucaaaacaagcagcuacuguauguaugugcuguuuuaaugggguuga

SEQ ID NO: 565880 - RNA, 64 nt, Homo Sapiens
agccaucauaauguugguguuuguuucccuccaauguauguauguuuaguuuuuauccaaccug

SEQ ID NO: 565881 - RNA, 64 nt, Homo Sapiens
gaaagcaaguucaaaagaacucugguaauuuuccuguauguacaauuuaaagagugaauaagau

SEQ ID NO: 565882 - RNA, 64 nt, Homo Sapiens
aucagugaugaauagcccccaaacagugggaguguguauguauguguguauguauguaucuaug

SEQ ID NO: 565883 - RNA, 64 nt, Homo Sapiens
uagcccccaaacagugggaguguguauguauguguguauguauguaucuauguauaugcuuggg

SEQ ID NO: 565884 - RNA, 64 nt, Homo Sapiens
ccccaaacagugggaguguguauguauguguguauguauguaucuauguauaugcuugggaaca

SEQ ID NO: 565885 - RNA, 64 nt, Homo Sapiens
auguaaaaauagcauucuacuugaucuuacaguauguauguauguauguauggagacauaugug

SEQ ID NO: 565886 - RNA, 64 nt, Homo Sapiens
aaaaauagcauucuacuugaucuuacaguauguauguauguauguauggagacauaugugugcg

SEQ ID NO: 565887 - RNA, 64 nt, Homo Sapiens
auagcauucuacuugaucuuacaguauguauguauguauguauggagacauaugugugcgugug

SEQ ID NO: 565888 - RNA, 64 nt, Homo Sapiens
uaccuuuuaacagacuguuuuuaaaaauuaaaaauguauguauagguuuugaaauuuuuuuaaa

SEQ ID NO: 565889 - RNA, 64 nt, Homo Sapiens
auuugcaaacacauuguucuauauguaaggguacuguauguaaaacucuguauuaaaacuauuc

SEQ ID NO: 565890 - RNA, 64 nt, Homo Sapiens
ugcaugcauguguauaaagacguguguauguauguguauguauaaaauauaaguauauggugug

SEQ ID NO: 565891 - RNA, 64 nt, Homo Sapiens
uguauguauaugcaugcaugauauggugugcguguguauguauggauagaauuuaaauauaagu

SEQ ID NO: 565892 - RNA, 64 nt, Homo Sapiens
aguuaggucaccaaacacggguuucacuuccacauguauguacaaagauauugaaccucauuca

SEQ ID NO: 565893 - RNA, 64 nt, Homo Sapiens
uguaugugugugugugugugaauagcgccauauauguauguaugaaagcauuuuggaaaugggg

SEQ ID NO: 565894 - RNA, 64 nt, Homo Sapiens
uguaaaugugauagaagucuauguaauguauuuauguauguauuccucccagacuggcuacugu

SEQ ID NO: 565895 - RNA, 64 nt, Homo Sapiens
guauuuauguauguauuugucccagacuggcuacuguauguaauccucuguggggagucugccu

SEQ ID NO: 565896 - RNA, 64 nt, Homo Sapiens
gauugaguugucaauuaaaacgugcaacacuguauguauguagauuguugauccacuuauaauu

SEQ ID NO: 565897 - RNA, 64 nt, Homo Sapiens
uagagauugaguugucaauuaauucgugcaacacuguauguaugauaauuguugauccacuuau

SEQ ID NO: 565898 - RNA, 64 nt, Homo Sapiens
ggucggggagaggauagugguguguguguguguauguauguauaaaugugugugugugugugug

SEQ ID NO: 565899 - RNA, 64 nt, Homo Sapiens
uauaggucggggagaggauauguguguguguguguguauguaugcuagaaugugugugugugug

SEQ ID NO: 565900 - RNA, 64 nt, Homo Sapiens
auggaaccuaaggaugugauuuguuuucauuguuuguauguacuacuuuuauggcagucauaug

SEQ ID NO: 565901 - RNA, 64 nt, Homo Sapiens
uaaauuaaauuaguuauaaauaaauaaccaaaaauguauguaaacauucaaaugauuaucugaa

SEQ ID NO: 565902 - RNA, 64 nt, Homo Sapiens
ccuggguucaaaucauaguucagcuuucaauaacuguauguaugauuuuggcuaaaggauuuga

SEQ ID NO: 565903 - RNA, 64 nt, Homo Sapiens
agaucagcugucaaagccuuucuguauauauguauguauguaaaaguauuauuaauaauauaug

SEQ ID NO: 565904 - RNA, 64 nt, Homo Sapiens
uaaaagaucagcugucaaaguaugucuguauauauguauguauguuaaaguauuauuaauaaua

SEQ ID NO: 565905 - RNA, 64 nt, Homo Sapiens
ccuucagcuaaaaacuuaauguucuuuauaccuuuguauguaugaccuacuuuuguaacagacc

SEQ ID NO: 565906 - RNA, 64 nt, Homo Sapiens
uugaauauggaaucuuacuauuugaauagaaauguguauguauaauauacauacauacauaagc

SEQ ID NO: 565907 - RNA, 64 nt, Homo Sapiens
uaguauaauuuguuacuuucuaugucuuuuucucuguauguaaguggguuugaaguaguuuagu

SEQ ID NO: 565908 - RNA, 64 nt, Homo Sapiens
acauacauggaguauggagguggauaugauuggauguauguaacgaaaaaaaugauccaaaaua

SEQ ID NO: 565909 - RNA, 64 nt, Homo Sapiens
uauauacacauauauauguauauauacacauauauguauguauacacauauacacauguauaua

SEQ ID NO: 565910 - RNA, 64 nt, Homo Sapiens
uguauacacauauacacauguauauauacauguguguauguauacauguauauauauauacaua

SEQ ID NO: 565911 - RNA, 64 nt, Homo Sapiens
agauuuauccaucgagacuaucugguaugcguuauguauguagucuguugcugcugaaagaugu

SEQ ID NO: 565912 - RNA, 64 nt, Homo Sapiens
auguuucuguuccaguuguaaucuucaggucuuuuguauguaaacauuaugcaaguacgcuauc

SEQ ID NO: 565913 - RNA, 64 nt, Homo Sapiens
aauguacauaaauauuuuuauagacaaacauauauguauguauguuuauaaauuguuaaacauu

SEQ ID NO: 565914 - RNA, 64 nt, Homo Sapiens
cugaaaauaagaaaauacauaaacaaaaaaaauuuguauguaaagguuuuuaugaaugugaagc

SEQ ID NO: 565915 - RNA, 64 nt, Homo Sapiens
ugauuaugguacuaauaauagauuuuuguguguauguauguaugaaaaauauuuucugaucuug

SEQ ID NO: 565916 - RNA, 64 nt, Homo Sapiens
uaugugauuaugguacuaaucuuggauuuuuguguguauguaugagagaaaaauauuuucugau

SEQ ID NO: 565917 - RNA, 64 nt, Homo Sapiens
caugcacuuuguauuaauauccuguaggauguacuguauguaguuccccuuccaccucucuuug

SEQ ID NO: 565918 - RNA, 64 nt, Homo Sapiens
uuuuagucuuucuguuuugaguuguaugauaaacuguauguaguaggggacagagaugggauuu

SEQ ID NO: 565919 - RNA, 64 nt, Homo Sapiens
caacaacuugaaagguggcauucuugguauuuacuguauguaagacuccuggaauauugucugg

SEQ ID NO: 565920 - RNA, 64 nt, Homo Sapiens
aaauuucacagggauaugcuuauauauauauauauguauguauauauauauauacacauacaua

SEQ ID NO: 565921 - RNA, 64 nt, Homo Sapiens
auucaguaauaaaugucaucccacacagaauguauguauguaaugucuguacugacucuaucug

SEQ ID NO: 565922 - RNA, 64 nt, Homo Sapiens
uaauauucaguaauaaauguucugccacacagaauguauguauguuuugucuguacugacucua

SEQ ID NO: 565923 - RNA, 64 nt, Homo Sapiens
aaacuaacuuuuuuguuuuuaauccaggccaacauguauguaaauuaaauuuuuagauaauuga

SEQ ID NO: 565924 - RNA, 64 nt, Homo Sapiens
ugugauuuuucacugacaguaaugacaaauuuaauguauguaauugucuaugcauuuuaaguua

SEQ ID NO: 565925 - RNA, 64 nt, Homo Sapiens
agcauuaugcaaggggaaaaaagcacuaugucuguguauguauguauauaguguaauacguaua

SEQ ID NO: 565926 - RNA, 64 nt, Homo Sapiens
uuaugcaaggggaaaaaagcacuaugucuguguauguauguauauaguguaauacguauauuuu

SEQ ID NO: 565927 - RNA, 64 nt, Homo Sapiens
gguuagauugauuuuaauguauauauuagacauuuguauguaugcucugacauugugauuugua

SEQ ID NO: 565928 - RNA, 64 nt, Homo Sapiens
ucaaaacacaguaguaccagccuuaccuuucugcuguauguagauagucagaucauccuacugg

SEQ ID NO: 565929 - RNA, 64 nt, Homo Sapiens
caggcacccagcuuugucuguggguuaguauugguguauguaugaguaucuguauguauauaua

SEQ ID NO: 565930 - RNA, 64 nt, Homo Sapiens
ucuguggguuaguauugguguauguaugaguaucuguauguauauauacacgguauuuauagag

SEQ ID NO: 565931 - RNA, 64 nt, Homo Sapiens
gggaaauaauuuucucaacacaaaucuguauuuuuguauguagauugaucuuuuucauaguguu

SEQ ID NO: 565932 - RNA, 64 nt, Homo Sapiens
gaguggguuggggccccaaauuuggguucaagucuguauguaugguccccuggcuggccuggcu

SEQ ID NO: 565933 - RNA, 63 nt, Homo Sapiens
uauauuuacuccccugccacuaaauauaaauguauguauguauauuucuuccugagauuucua

SEQ ID NO: 565934 - RNA, 64 nt, Homo Sapiens
uauuauauuuacuccccugcucuauaaauauaaauguauguaugugcaauuucuuccugagauu

SEQ ID NO: 565935 - RNA, 64 nt, Homo Sapiens
ucuacauaaugcaaauuguguauuuuuaugucuuuguauguaguugguugguguauguauguuu

SEQ ID NO: 565936 - RNA, 64 nt, Homo Sapiens
uuuuauuuuuaugucuuugugguguggugguugguguauguauguugauugguugagauuaacu

SEQ ID NO: 565937 - RNA, 64 nt, Homo Sapiens
auuuaagguuggaaaaaaaauaauuuuugguguauguauguaauuugagcacauugcagcuaug

SEQ ID NO: 565938 - RNA, 64 nt, Homo Sapiens
uaauauuuaagguuggaaaauauguaauuuuugguguauguauggcuguugagcacauugcagc

SEQ ID NO: 565939 - RNA, 64 nt, Homo Sapiens
cucaacaagaaaaaaaaaaaagaauauauauauauguauguauguauguauguaaacacacaca

SEQ ID NO: 565940 - RNA, 64 nt, Homo Sapiens
acaagaaaaaaaaaaaagaauauauauauauguauguauguauguauguaaacacacacacuaa

SEQ ID NO: 565941 - RNA, 64 nt, Homo Sapiens
gaaaaaaaaaaaagaauauauauauauguauguauguauguauguaaacacacacacuaauuug

SEQ ID NO: 565942 - RNA, 64 nt, Homo Sapiens
aaaaaaaaagaauauauauauauguauguauguauguauguaaacacacacacuaauuugagag

SEQ ID NO: 565943 - RNA, 64 nt, Homo Sapiens
acaaauaaugcauaagaaauauauauauaauauauguauguauguauagccagaugcaguggca

SEQ ID NO: 565944 - RNA, 64 nt, Homo Sapiens
auaaugcauaagaaauauauauauaauauauguauguauguauagccagaugcaguggcacaug

SEQ ID NO: 565945 - RNA, 64 nt, Homo Sapiens
uuuauaaagaacaacuguuucuauuauugaaaauuguauguaaaacuauuuaaaauagaauaga

SEQ ID NO: 565946 - RNA, 64 nt, Homo Sapiens
agauuuuggguuuucagauuaggaauacccaaccuguauguacguauauuucuguaucuaugua

SEQ ID NO: 565947 - RNA, 64 nt, Homo Sapiens
acccaaccuguauguacguauauuucuguaucuauguauguauauauaugcauaugcagacaua

SEQ ID NO: 565948 - RNA, 64 nt, Homo Sapiens
ugcagacauauguauauggucuggucagcauauguguauguaugcguauguauguauguaugua

SEQ ID NO: 565949 - RNA, 64 nt, Homo Sapiens
uauggucuggucagcauauguguauguaugcguauguauguauguauguaugcccucagugcag

SEQ ID NO: 565950 - RNA, 64 nt, Homo Sapiens
gucuggucagcauauguguauguaugcguauguauguauguauguaugcccucagugcaguggg

SEQ ID NO: 565951 - RNA, 64 nt, Homo Sapiens
ggucagcauauguguauguaugcguauguauguauguauguaugcccucagugcagugggguuu

SEQ ID NO: 565952 - RNA, 64 nt, Homo Sapiens
ccuaacuccuaaaguggaacuauauauacacauauguauguauauauguguauauauauauaca

SEQ ID NO: 565953 - RNA, 64 nt, Homo Sapiens
gaauuugggaaagcauuugcagagagaaaccuuuuguauguaaacccaccugugaacuccuacc

SEQ ID NO: 565954 - RNA, 64 nt, Homo Sapiens
cauauauguauuccauauauauguauacauuccauguauguaugcguguguauauauuccacau

SEQ ID NO: 565955 - RNA, 64 nt, Homo Sapiens
ccacauguauauauuccacaguauauauuccacguguauguauuguggaauauauuccacaugu

SEQ ID NO: 565956 - RNA, 64 nt, Homo Sapiens
aguucuaaaauuuccauuuuuaaauuuuggucacuguauguaucugagugcauucaccaccuuu

SEQ ID NO: 565957 - RNA, 64 nt, Homo Sapiens
gugucauuuuucugucagauaauuguuguuucccuguauguagugagaaaucugcagucauuca

SEQ ID NO: 565958 - RNA, 64 nt, Homo Sapiens
aaaauaagcuuggccuagcacuuagaaugcagaauguauguaauacaauaugaaguuauuaguu

SEQ ID NO: 565959 - RNA, 64 nt, Homo Sapiens
agcaugaagucuuaaggacacuuguaaaagacaguguauguagacauaucaucuguggacugac

SEQ ID NO: 565960 - RNA, 64 nt, Homo Sapiens
uauaccuauggaaaacuaguauucucucacucuguguauguauaagauauauauaccuauugaa

SEQ ID NO: 565961 - RNA, 64 nt, Homo Sapiens
uucagggauauguauauguaugauaacuauacauuguauguaaaucuuaaaagucccugauuua

SEQ ID NO: 565962 - RNA, 64 nt, Homo Sapiens
ucuaagggcuuuacaaggaucaaauaagaugguguguauguaagaaauuuguaaaaugugaaga

SEQ ID NO: 565963 - RNA, 64 nt, Homo Sapiens
agcuaaagguagaaguguuugauccagugaacuguguauguaugugugggguuuuuuucuuuau

SEQ ID NO: 565964 - RNA, 64 nt, Homo Sapiens
uccauuauuacuugggucuuuacuucugggaauuuguauguaacagccuagaaaauuaaaagga

SEQ ID NO: 565965 - RNA, 64 nt, Homo Sapiens
gacacagcacacaaguggcuauugugauguaugauguauguaguccuacaacugcaaaacgucu

SEQ ID NO: 565966 - RNA, 64 nt, Homo Sapiens
uauguuuauaucuaucgucuuuuauguaugcauauguauguagaguaugcauauaaguauaugc

SEQ ID NO: 565967 - RNA, 64 nt, Homo Sapiens
cauaugcaugcauguauauggcauuacaugcauauguauguagaguuugguaauaugcagguag

SEQ ID NO: 565968 - RNA, 64 nt, Homo Sapiens
cgcaugugugcaugugaguauauguauguguguauguauguaucuugcccacuguguguguggg

SEQ ID NO: 565969 - RNA, 64 nt, Homo Sapiens
uauccgcaugugugcauguguggguauguauguguguauguaugccucuugcccacugugugug

SEQ ID NO: 565970 - RNA, 64 nt, Homo Sapiens; identical to SEQ ID NO: 565964

SEQ ID NO: 565971 - RNA, 64 nt, Homo Sapiens
gacacagcacacaaguggcuauugugauguaugauguauguagucccacaacugcaaaacgucu

SEQ ID NO: 565972 - RNA, 64 nt, Homo Sapiens; identical to SEQ ID NO: 44500

SEQ ID NO: 565973 - RNA, 64 nt, Homo Sapiens; identical to SEQ ID NO: 44501

SEQ ID NO: 565974 - RNA, 64 nt, Homo Sapiens; identical to SEQ ID NO: 44502

SEQ ID NO: 565975 - RNA, 64 nt, Homo Sapiens; identical to SEQ ID NO: 44503

SEQ ID NO: 565976 - RNA, 64 nt, Homo Sapiens; identical to SEQ ID NO: 44504

SEQ ID NO: 565977 - RNA, 64 nt, Homo Sapiens; identical to SEQ ID NO: 44505

SEQ ID NO: 565978 - RNA, 64 nt, Homo Sapiens; identical to SEQ ID NO: 44506

SEQ ID NO: 565979 - RNA, 64 nt, Homo Sapiens; identical to SEQ ID NO: 44507

SEQ ID NO: 565980 - RNA, 64 nt, Homo Sapiens; identical to SEQ ID NO: 44508

SEQ ID NO: 565981 - RNA, 64 nt, Homo Sapiens; identical to SEQ ID NO: 44509

SEQ ID NO: 565982 - RNA, 64 nt, Homo Sapiens; identical to SEQ ID NO: 44510

SEQ ID NO: 565983 - RNA, 64 nt, Homo Sapiens; identical to SEQ ID NO: 44511

SEQ ID NO: 565984 - RNA, 64 nt, Homo Sapiens; identical to SEQ ID NO: 44512

SEQ ID NO: 565985 - RNA, 64 nt, Homo Sapiens; identical to SEQ ID NO: 44513

SEQ ID NO: 565986 - RNA, 64 nt, Homo Sapiens; identical to SEQ ID NO: 44514

SEQ ID NO: 565987 - RNA, 64 nt, Homo Sapiens; identical to SEQ ID NO: 44515

SEQ ID NO: 565988 - RNA, 64 nt, Homo Sapiens; identical to SEQ ID NO: 44516

SEQ ID NO: 565989 - RNA, 64 nt, Homo Sapiens; identical to SEQ ID NO: 44517

SEQ ID NO: 565990 - RNA, 64 nt, Homo Sapiens; identical to SEQ ID NO: 44518

SEQ ID NO: 565991 - RNA, 64 nt, Homo Sapiens; identical to SEQ ID NO: 44519

SEQ ID NO: 565992 - RNA, 64 nt, Homo Sapiens; identical to SEQ ID NO: 44520

SEQ ID NO: 565993 - RNA, 64 nt, Homo Sapiens; identical to SEQ ID NO: 44521

SEQ ID NO: 565994 - RNA, 64 nt, Homo Sapiens; identical to SEQ ID NO: 44522

SEQ ID NO: 565995 - RNA, 64 nt, Homo Sapiens; identical to SEQ ID NO: 44523

SEQ ID NO: 565996 - RNA, 64 nt, Homo Sapiens; identical to SEQ ID NO: 44524

SEQ ID NO: 565997 - RNA, 64 nt, Homo Sapiens; identical to SEQ ID NO: 44525

SEQ ID NO: 565998 - RNA, 64 nt, Homo Sapiens; identical to SEQ ID NO: 44526

SEQ ID NO: 565999 - RNA, 64 nt, Homo Sapiens; identical to SEQ ID NO: 44527

SEQ ID NO: 566000 - RNA, 64 nt, Homo Sapiens; identical to SEQ ID NO: 44528

SEQ ID NO: 566001 - RNA, 64 nt, Homo Sapiens; identical to SEQ ID NO: 44529

SEQ ID NO: 566002 - RNA, 64 nt, Homo Sapiens; identical to SEQ ID NO: 44530

SEQ ID NO: 566003 - RNA, 64 nt, Homo Sapiens; identical to SEQ ID NO: 44531

SEQ ID NO: 566004 - RNA, 64 nt, Homo Sapiens; identical to SEQ ID NO: 44532

SEQ ID NO: 566005 - RNA, 64 nt, Homo Sapiens; identical to SEQ ID NO: 44533

SEQ ID NO: 566006 - RNA, 64 nt, Homo Sapiens; identical to SEQ ID NO: 44534

SEQ ID NO: 566007 - RNA, 64 nt, Homo Sapiens; identical to SEQ ID NO: 44535

SEQ ID NO: 566008 - RNA, 64 nt, Homo Sapiens; identical to SEQ ID NO: 44536

SEQ ID NO: 566009 - RNA, 64 nt, Homo Sapiens; identical to SEQ ID NO: 44537

SEQ ID NO: 566010 - RNA, 64 nt, Homo Sapiens; identical to SEQ ID NO: 44538

SEQ ID NO: 566011 - RNA, 64 nt, Homo Sapiens; identical to SEQ ID NO: 44539

SEQ ID NO: 566012 - RNA, 64 nt, Homo Sapiens; identical to SEQ ID NO: 44540

SEQ ID NO: 566013 - RNA, 64 nt, Homo Sapiens; identical to SEQ ID NO: 44541

SEQ ID NO: 566014 - RNA, 64 nt, Homo Sapiens; identical to SEQ ID NO: 44542

SEQ ID NO: 566015 - RNA, 64 nt, Homo Sapiens; identical to SEQ ID NO: 44543

SEQ ID NO: 566016 - RNA, 64 nt, Homo Sapiens; identical to SEQ ID NO: 44544

SEQ ID NO: 566017 - RNA, 64 nt, Homo Sapiens; identical to SEQ ID NO: 44545

SEQ ID NO: 566018 - RNA, 64 nt, Homo Sapiens; identical to SEQ ID NO: 44546

SEQ ID NO: 566019 - RNA, 64 nt, Homo Sapiens; identical to SEQ ID NO: 44547

SEQ ID NO: 566020 - RNA, 64 nt, Homo Sapiens; identical to SEQ ID NO: 44548

SEQ ID NO: 566021 - RNA, 64 nt, Homo Sapiens; identical to SEQ ID NO: 44549

SEQ ID NO: 566022 - RNA, 64 nt, Homo Sapiens; identical to SEQ ID NO: 44550

SEQ ID NO: 566023 - RNA, 64 nt, Homo Sapiens; identical to SEQ ID NO: 44551

SEQ ID NO: 566024 - RNA, 64 nt, Homo Sapiens; identical to SEQ ID NO: 44552

SEQ ID NO: 566025 - RNA, 64 nt, Homo Sapiens; identical to SEQ ID NO: 44553

SEQ ID NO: 566026 - RNA, 64 nt, Homo Sapiens; identical to SEQ ID NO: 44554

SEQ ID NO: 566027 - RNA, 64 nt, Homo Sapiens; identical to SEQ ID NO: 44555

SEQ ID NO: 566028 - RNA, 64 nt, Homo Sapiens; identical to SEQ ID NO: 44556

SEQ ID NO: 566029 - RNA, 64 nt, Homo Sapiens; identical to SEQ ID NO: 44557

SEQ ID NO: 566030 - RNA, 64 nt, Homo Sapiens; identical to SEQ ID NO: 44558

SEQ ID NO: 566031 - RNA, 64 nt, Homo Sapiens; identical to SEQ ID NO: 44559

SEQ ID NO: 566032 - RNA, 64 nt, Homo Sapiens; identical to SEQ ID NO: 44560

SEQ ID NO: 566033 - RNA, 64 nt, Homo Sapiens; identical to SEQ ID NO: 44561

SEQ ID NO: 566034 - RNA, 64 nt, Homo Sapiens; identical to SEQ ID NO: 44562

SEQ ID NO: 566035 - RNA, 64 nt, Homo Sapiens; identical to SEQ ID NO: 44563

SEQ ID NO: 566036 - RNA, 64 nt, Homo Sapiens; identical to SEQ ID NO: 44564

SEQ ID NO: 566037 - RNA, 64 nt, Homo Sapiens; identical to SEQ ID NO: 44565

SEQ ID NO: 566038 - RNA, 64 nt, Homo Sapiens; identical to SEQ ID NO: 44566

SEQ ID NO: 566039 - RNA, 64 nt, Homo Sapiens; identical to SEQ ID NO: 44567

SEQ ID NO: 566040 - RNA, 64 nt, Homo Sapiens; identical to SEQ ID NO: 44568

SEQ ID NO: 566041 - RNA, 64 nt, Homo Sapiens; identical to SEQ ID NO: 44569

SEQ ID NO: 566042 - RNA, 64 nt, Homo Sapiens; identical to SEQ ID NO: 44570

SEQ ID NO: 566043 - RNA, 64 nt, Homo Sapiens; identical to SEQ ID NO: 44571

SEQ ID NO: 566044 - RNA, 64 nt, Homo Sapiens; identical to SEQ ID NO: 44572

SEQ ID NO: 566045 - RNA, 64 nt, Homo Sapiens; identical to SEQ ID NO: 44573

SEQ ID NO: 566046 - RNA, 64 nt, Homo Sapiens; identical to SEQ ID NO: 44574

SEQ ID NO: 566047 - RNA, 64 nt, Homo Sapiens; identical to SEQ ID NO: 44575

SEQ ID NO: 566048 - RNA, 64 nt, Homo Sapiens; identical to SEQ ID NO: 44576

SEQ ID NO: 566049 - RNA, 64 nt, Homo Sapiens; identical to SEQ ID NO: 44577

SEQ ID NO: 566050 - RNA, 64 nt, Homo Sapiens; identical to SEQ ID NO: 44578

SEQ ID NO: 566051 - RNA, 64 nt, Homo Sapiens; identical to SEQ ID NO: 44579

SEQ ID NO: 566052 - RNA, 64 nt, Homo Sapiens; identical to SEQ ID NO: 44580

SEQ ID NO: 566053 - RNA, 64 nt, Homo Sapiens; identical to SEQ ID NO: 44581

SEQ ID NO: 566054 - RNA, 64 nt, Homo Sapiens; identical to SEQ ID NO: 44582

SEQ ID NO: 566055 - RNA, 64 nt, Homo Sapiens; identical to SEQ ID NO: 44583

SEQ ID NO: 566056 - RNA, 64 nt, Homo Sapiens; identical to SEQ ID NO: 44584

SEQ ID NO: 566057 - RNA, 64 nt, Homo Sapiens; identical to SEQ ID NO: 44585

SEQ ID NO: 566058 - RNA, 64 nt, Homo Sapiens; identical to SEQ ID NO: 44586

SEQ ID NO: 566059 - RNA, 64 nt, Homo Sapiens; identical to SEQ ID NO: 44587

SEQ ID NO: 566060 - RNA, 64 nt, Homo Sapiens; identical to SEQ ID NO: 44588

SEQ ID NO: 566061 - RNA, 64 nt, Homo Sapiens; identical to SEQ ID NO: 44589

SEQ ID NO: 566062 - RNA, 64 nt, Homo Sapiens; identical to SEQ ID NO: 44590

SEQ ID NO: 566063 - RNA, 64 nt, Homo Sapiens; identical to SEQ ID NO: 44591

SEQ ID NO: 566064 - RNA, 64 nt, Homo Sapiens; identical to SEQ ID NO: 44592

SEQ ID NO: 566065 - RNA, 64 nt, Homo Sapiens; identical to SEQ ID NO: 44593

SEQ ID NO: 566066 - RNA, 64 nt, Homo Sapiens; identical to SEQ ID NO: 44594

SEQ ID NO: 566067 - RNA, 64 nt, Homo Sapiens; identical to SEQ ID NO: 44595

SEQ ID NO: 566068 - RNA, 64 nt, Homo Sapiens; identical to SEQ ID NO: 44596

SEQ ID NO: 566069 - RNA, 64 nt, Homo Sapiens; identical to SEQ ID NO: 44597

SEQ ID NO: 566070 - RNA, 64 nt, Homo Sapiens; identical to SEQ ID NO: 44598

SEQ ID NO: 566071 - RNA, 64 nt, Homo Sapiens; identical to SEQ ID NO: 44599

SEQ ID NO: 566072 - RNA, 64 nt, Homo Sapiens; identical to SEQ ID NO: 44600

SEQ ID NO: 566073 - RNA, 64 nt, Homo Sapiens; identical to SEQ ID NO: 44601

SEQ ID NO: 566074 - RNA, 64 nt, Homo Sapiens; identical to SEQ ID NO: 44602

SEQ ID NO: 566075 - RNA, 64 nt, Homo Sapiens; identical to SEQ ID NO: 44603

SEQ ID NO: 566076 - RNA, 64 nt, Homo Sapiens; identical to SEQ ID NO: 44604

SEQ ID NO: 566077 - RNA, 64 nt, Homo Sapiens; identical to SEQ ID NO: 44605

SEQ ID NO: 566078 - RNA, 64 nt, Homo Sapiens; identical to SEQ ID NO: 44606

SEQ ID NO: 566079 - RNA, 64 nt, Homo Sapiens; identical to SEQ ID NO: 44607

SEQ ID NO: 566080 - RNA, 64 nt, Homo Sapiens; identical to SEQ ID NO: 44608

SEQ ID NO: 566081 - RNA, 64 nt, Homo Sapiens; identical to SEQ ID NO: 44609

SEQ ID NO: 566082 - RNA, 64 nt, Homo Sapiens; identical to SEQ ID NO: 44610

SEQ ID NO: 566083 - RNA, 56 nt, Homo Sapiens; identical to SEQ ID NO: 44611

SEQ ID NO: 566084 - RNA, 64 nt, Homo Sapiens; identical to SEQ ID NO: 44612

SEQ ID NO: 566085 - RNA, 64 nt, Homo Sapiens; identical to SEQ ID NO: 44613

SEQ ID NO: 566086 - RNA, 64 nt, Homo Sapiens; identical to SEQ ID NO: 44614

SEQ ID NO: 566087 - RNA, 64 nt, Homo Sapiens; identical to SEQ ID NO: 44615

SEQ ID NO: 566088 - RNA, 64 nt, Homo Sapiens; identical to SEQ ID NO: 44616

SEQ ID NO: 566089 - RNA, 64 nt, Homo Sapiens; identical to SEQ ID NO: 44617

SEQ ID NO: 566090 - RNA, 64 nt, Homo Sapiens; identical to SEQ ID NO: 44618

SEQ ID NO: 566091 - RNA, 64 nt, Homo Sapiens; identical to SEQ ID NO: 44619

SEQ ID NO: 566092 - RNA, 64 nt, Homo Sapiens; identical to SEQ ID NO: 44620

SEQ ID NO: 566093 - RNA, 64 nt, Homo Sapiens; identical to SEQ ID NO: 44621

SEQ ID NO: 566094 - RNA, 64 nt, Homo Sapiens; identical to SEQ ID NO: 44622

SEQ ID NO: 566095 - RNA, 64 nt, Homo Sapiens; identical to SEQ ID NO: 44623

SEQ ID NO: 566096 - RNA, 64 nt, Homo Sapiens; identical to SEQ ID NO: 44624

SEQ ID NO: 566097 - RNA, 64 nt, Homo Sapiens; identical to SEQ ID NO: 44625

SEQ ID NO: 566098 - RNA, 64 nt, Homo Sapiens; identical to SEQ ID NO: 44626

SEQ ID NO: 566099 - RNA, 64 nt, Homo Sapiens; identical to SEQ ID NO: 44627

SEQ ID NO: 566100 - RNA, 64 nt, Homo Sapiens; identical to SEQ ID NO: 44628

SEQ ID NO: 566101 - RNA, 64 nt, Homo Sapiens; identical to SEQ ID NO: 44629

SEQ ID NO: 566102 - RNA, 64 nt, Homo Sapiens; identical to SEQ ID NO: 44630

SEQ ID NO: 566103 - RNA, 64 nt, Homo Sapiens; identical to SEQ ID NO: 44631

SEQ ID NO: 566104 - RNA, 64 nt, Homo Sapiens; identical to SEQ ID NO: 44632

SEQ ID NO: 566105 - RNA, 64 nt, Homo Sapiens; identical to SEQ ID NO: 44633

SEQ ID NO: 566106 - RNA, 64 nt, Homo Sapiens; identical to SEQ ID NO: 44634

SEQ ID NO: 566107 - RNA, 64 nt, Homo Sapiens; identical to SEQ ID NO: 44635

SEQ ID NO: 566108 - RNA, 64 nt, Homo Sapiens; identical to SEQ ID NO: 44636

SEQ ID NO: 566109 - RNA, 64 nt, Homo Sapiens; identical to SEQ ID NO: 44637

SEQ ID NO: 566110 - RNA, 64 nt, Homo Sapiens; identical to SEQ ID NO: 44638

SEQ ID NO: 566111 - RNA, 64 nt, Homo Sapiens; identical to SEQ ID NO: 44639

SEQ ID NO: 566112 - RNA, 64 nt, Homo Sapiens; identical to SEQ ID NO: 44640

SEQ ID NO: 566113 - RNA, 64 nt, Homo Sapiens; identical to SEQ ID NO: 44641

SEQ ID NO: 566114 - RNA, 64 nt, Homo Sapiens; identical to SEQ ID NO: 44642

SEQ ID NO: 566115 - RNA, 64 nt, Homo Sapiens; identical to SEQ ID NO: 44643

SEQ ID NO: 566116 - RNA, 64 nt, Homo Sapiens; identical to SEQ ID NO: 44644

SEQ ID NO: 566117 - RNA, 64 nt, Homo Sapiens; identical to SEQ ID NO: 44645

SEQ ID NO: 566118 - RNA, 64 nt, Homo Sapiens; identical to SEQ ID NO: 44646

SEQ ID NO: 566119 - RNA, 64 nt, Homo Sapiens; identical to SEQ ID NO: 44647

SEQ ID NO: 566120 - RNA, 64 nt, Homo Sapiens; identical to SEQ ID NO: 44648

SEQ ID NO: 566121 - RNA, 64 nt, Homo Sapiens; identical to SEQ ID NO: 44649

SEQ ID NO: 566122 - RNA, 64 nt, Homo Sapiens; identical to SEQ ID NO: 44650

SEQ ID NO: 566123 - RNA, 64 nt, Homo Sapiens; identical to SEQ ID NO: 44651

SEQ ID NO: 566124 - RNA, 64 nt, Homo Sapiens; identical to SEQ ID NO: 44652

SEQ ID NO: 566125 - RNA, 64 nt, Homo Sapiens; identical to SEQ ID NO: 44653

SEQ ID NO: 566126 - RNA, 64 nt, Homo Sapiens; identical to SEQ ID NO: 44654

SEQ ID NO: 566127 - RNA, 64 nt, Homo Sapiens; identical to SEQ ID NO: 44655

SEQ ID NO: 566128 - RNA, 64 nt, Homo Sapiens; identical to SEQ ID NO: 44656

SEQ ID NO: 566129 - RNA, 64 nt, Homo Sapiens; identical to SEQ ID NO: 44657

SEQ ID NO: 566130 - RNA, 64 nt, Homo Sapiens; identical to SEQ ID NO: 44658

SEQ ID NO: 566131 - RNA, 64 nt, Homo Sapiens; identical to SEQ ID NO: 44659

SEQ ID NO: 566132 - RNA, 64 nt, Homo Sapiens; identical to SEQ ID NO: 44660

SEQ ID NO: 566133 - RNA, 64 nt, Homo Sapiens; identical to SEQ ID NO: 44661

SEQ ID NO: 566134 - RNA, 64 nt, Homo Sapiens; identical to SEQ ID NO: 44662

SEQ ID NO: 566135 - RNA, 64 nt, Homo Sapiens; identical to SEQ ID NO: 44663

SEQ ID NO: 566136 - RNA, 64 nt, Homo Sapiens; identical to SEQ ID NO: 44664

SEQ ID NO: 566137 - RNA, 64 nt, Homo Sapiens; identical to SEQ ID NO: 44665

SEQ ID NO: 566138 - RNA, 64 nt, Homo Sapiens; identical to SEQ ID NO: 44666

SEQ ID NO: 566139 - RNA, 64 nt, Homo Sapiens; identical to SEQ ID NO: 44667

SEQ ID NO: 566140 - RNA, 64 nt, Homo Sapiens; identical to SEQ ID NO: 44668

SEQ ID NO: 566141 - RNA, 64 nt, Homo Sapiens; identical to SEQ ID NO: 44669

SEQ ID NO: 566142 - RNA, 64 nt, Homo Sapiens; identical to SEQ ID NO: 44670

SEQ ID NO: 566143 - RNA, 64 nt, Homo Sapiens; identical to SEQ ID NO: 44671

SEQ ID NO: 566144 - RNA, 64 nt, Homo Sapiens; identical to SEQ ID NO: 44672

SEQ ID NO: 566145 - RNA, 64 nt, Homo Sapiens; identical to SEQ ID NO: 44673

SEQ ID NO: 566146 - RNA, 64 nt, Homo Sapiens; identical to SEQ ID NO: 44674

SEQ ID NO: 566147 - RNA, 64 nt, Homo Sapiens; identical to SEQ ID NO: 44675

SEQ ID NO: 566148 - RNA, 64 nt, Homo Sapiens; identical to SEQ ID NO: 44676

SEQ ID NO: 566149 - RNA, 64 nt, Homo Sapiens; identical to SEQ ID NO: 44677

SEQ ID NO: 566150 - RNA, 64 nt, Homo Sapiens; identical to SEQ ID NO: 44678

SEQ ID NO: 566151 - RNA, 64 nt, Homo Sapiens; identical to SEQ ID NO: 44679

SEQ ID NO: 566152 - RNA, 64 nt, Homo Sapiens; identical to SEQ ID NO: 44680

SEQ ID NO: 566153 - RNA, 64 nt, Homo Sapiens; identical to SEQ ID NO: 44681

SEQ ID NO: 566154 - RNA, 64 nt, Homo Sapiens; identical to SEQ ID NO: 44682

SEQ ID NO: 566155 - RNA, 64 nt, Homo Sapiens; identical to SEQ ID NO: 44683

SEQ ID NO: 566156 - RNA, 64 nt, Homo Sapiens; identical to SEQ ID NO: 44684

SEQ ID NO: 566157 - RNA, 64 nt, Homo Sapiens; identical to SEQ ID NO: 44685

SEQ ID NO: 566158 - RNA, 64 nt, Homo Sapiens; identical to SEQ ID NO: 44686

SEQ ID NO: 566159 - RNA, 64 nt, Homo Sapiens; identical to SEQ ID NO: 44687

SEQ ID NO: 566160 - RNA, 64 nt, Homo Sapiens; identical to SEQ ID NO: 44688

SEQ ID NO: 566161 - RNA, 64 nt, Homo Sapiens; identical to SEQ ID NO: 44689

SEQ ID NO: 566162 - RNA, 64 nt, Homo Sapiens; identical to SEQ ID NO: 44690

SEQ ID NO: 566163 - RNA, 64 nt, Homo Sapiens; identical to SEQ ID NO: 44691

SEQ ID NO: 566164 - RNA, 64 nt, Homo Sapiens; identical to SEQ ID NO: 44692

SEQ ID NO: 566165 - RNA, 64 nt, Homo Sapiens; identical to SEQ ID NO: 44693

SEQ ID NO: 566166 - RNA, 64 nt, Homo Sapiens; identical to SEQ ID NO: 44694

SEQ ID NO: 566167 - RNA, 64 nt, Homo Sapiens; identical to SEQ ID NO: 44695

SEQ ID NO: 566168 - RNA, 64 nt, Homo Sapiens; identical to SEQ ID NO: 44696

SEQ ID NO: 566169 - RNA, 64 nt, Homo Sapiens; identical to SEQ ID NO: 44697

SEQ ID NO: 566170 - RNA, 64 nt, Homo Sapiens; identical to SEQ ID NO: 44698

SEQ ID NO: 566171 - RNA, 64 nt, Homo Sapiens; identical to SEQ ID NO: 44699

SEQ ID NO: 566172 - RNA, 64 nt, Homo Sapiens; identical to SEQ ID NO: 44700

SEQ ID NO: 566173 - RNA, 64 nt, Homo Sapiens; identical to SEQ ID NO: 44701

SEQ ID NO: 566174 - RNA, 64 nt, Homo Sapiens; identical to SEQ ID NO: 44702

SEQ ID NO: 566175 - RNA, 64 nt, Homo Sapiens; identical to SEQ ID NO: 44703

SEQ ID NO: 566176 - RNA, 64 nt, Homo Sapiens; identical to SEQ ID NO: 44704

SEQ ID NO: 566177 - RNA, 64 nt, Homo Sapiens; identical to SEQ ID NO: 44705

SEQ ID NO: 566178 - RNA, 64 nt, Homo Sapiens; identical to SEQ ID NO: 44706

SEQ ID NO: 566179 - RNA, 64 nt, Homo Sapiens; identical to SEQ ID NO: 44707

SEQ ID NO: 566180 - RNA, 64 nt, Homo Sapiens; identical to SEQ ID NO: 44708

SEQ ID NO: 566181 - RNA, 64 nt, Homo Sapiens; identical to SEQ ID NO: 44709

SEQ ID NO: 566182 - RNA, 64 nt, Homo Sapiens; identical to SEQ ID NO: 44710

SEQ ID NO: 566183 - RNA, 64 nt, Homo Sapiens; identical to SEQ ID NO: 44711

SEQ ID NO: 566184 - RNA, 64 nt, Homo Sapiens; identical to SEQ ID NO: 44712

SEQ ID NO: 566185 - RNA, 64 nt, Homo Sapiens; identical to SEQ ID NO: 44713

SEQ ID NO: 566186 - RNA, 64 nt, Homo Sapiens; identical to SEQ ID NO: 44714

SEQ ID NO: 566187 - RNA, 64 nt, Homo Sapiens; identical to SEQ ID NO: 44715

SEQ ID NO: 566188 - RNA, 64 nt, Homo Sapiens; identical to SEQ ID NO: 44716

SEQ ID NO: 566189 - RNA, 64 nt, Homo Sapiens; identical to SEQ ID NO: 44717

SEQ ID NO: 566190 - RNA, 64 nt, Homo Sapiens; identical to SEQ ID NO: 44718

SEQ ID NO: 566191 - RNA, 64 nt, Homo Sapiens; identical to SEQ ID NO: 44719

SEQ ID NO: 566192 - RNA, 64 nt, Homo Sapiens; identical to SEQ ID NO: 44720

SEQ ID NO: 566193 - RNA, 64 nt, Homo Sapiens; identical to SEQ ID NO: 44721

SEQ ID NO: 566194 - RNA, 64 nt, Homo Sapiens; identical to SEQ ID NO: 44722

SEQ ID NO: 566195 - RNA, 64 nt, Homo Sapiens; identical to SEQ ID NO: 44723

SEQ ID NO: 566196 - RNA, 64 nt, Homo Sapiens; identical to SEQ ID NO: 44724

SEQ ID NO: 566197 - RNA, 64 nt, Homo Sapiens; identical to SEQ ID NO: 44725

SEQ ID NO: 566198 - RNA, 64 nt, Homo Sapiens; identical to SEQ ID NO: 44726

SEQ ID NO: 566199 - RNA, 64 nt, Homo Sapiens; identical to SEQ ID NO: 44727

SEQ ID NO: 566200 - RNA, 64 nt, Homo Sapiens; identical to SEQ ID NO: 44728

SEQ ID NO: 566201 - RNA, 64 nt, Homo Sapiens; identical to SEQ ID NO: 44729

SEQ ID NO: 566202 - RNA, 64 nt, Homo Sapiens; identical to SEQ ID NO: 44730

SEQ ID NO: 566203 - RNA, 64 nt, Homo Sapiens; identical to SEQ ID NO: 44731

SEQ ID NO: 566204 - RNA, 64 nt, Homo Sapiens; identical to SEQ ID NO: 44732

SEQ ID NO: 566205 - RNA, 64 nt, Homo Sapiens; identical to SEQ ID NO: 44733

SEQ ID NO: 566206 - RNA, 64 nt, Homo Sapiens; identical to SEQ ID NO: 44734

SEQ ID NO: 566207 - RNA, 64 nt, Homo Sapiens; identical to SEQ ID NO: 44735

SEQ ID NO: 566208 - RNA, 64 nt, Homo Sapiens; identical to SEQ ID NO: 44736

SEQ ID NO: 566209 - RNA, 64 nt, Homo Sapiens; identical to SEQ ID NO: 44737

SEQ ID NO: 566210 - RNA, 64 nt, Homo Sapiens; identical to SEQ ID NO: 44738

SEQ ID NO: 566211 - RNA, 64 nt, Homo Sapiens; identical to SEQ ID NO: 44739

SEQ ID NO: 566212 - RNA, 64 nt, Homo Sapiens; identical to SEQ ID NO: 44740

SEQ ID NO: 566213 - RNA, 64 nt, Homo Sapiens; identical to SEQ ID NO: 44741

SEQ ID NO: 566214 - RNA, 64 nt, Homo Sapiens; identical to SEQ ID NO: 44742

SEQ ID NO: 566215 - RNA, 64 nt, Homo Sapiens; identical to SEQ ID NO: 44743

SEQ ID NO: 566216 - RNA, 64 nt, Homo Sapiens; identical to SEQ ID NO: 44744

SEQ ID NO: 566217 - RNA, 64 nt, Homo Sapiens; identical to SEQ ID NO: 44745

SEQ ID NO: 566218 - RNA, 64 nt, Homo Sapiens; identical to SEQ ID NO: 44746

SEQ ID NO: 566219 - RNA, 64 nt, Homo Sapiens; identical to SEQ ID NO: 44747

SEQ ID NO: 566220 - RNA, 64 nt, Homo Sapiens; identical to SEQ ID NO: 44748

SEQ ID NO: 566221 - RNA, 64 nt, Homo Sapiens; identical to SEQ ID NO: 44749

SEQ ID NO: 566222 - RNA, 64 nt, Homo Sapiens; identical to SEQ ID NO: 44750

SEQ ID NO: 566223 - RNA, 64 nt, Homo Sapiens; identical to SEQ ID NO: 44751

SEQ ID NO: 566224 - RNA, 64 nt, Homo Sapiens; identical to SEQ ID NO: 44752

SEQ ID NO: 566225 - RNA, 64 nt, Homo Sapiens; identical to SEQ ID NO: 44753

SEQ ID NO: 566226 - RNA, 64 nt, Homo Sapiens; identical to SEQ ID NO: 44754

SEQ ID NO: 566227 - RNA, 64 nt, Homo Sapiens; identical to SEQ ID NO: 44755

SEQ ID NO: 566228 - RNA, 64 nt, Homo Sapiens; identical to SEQ ID NO: 44756

SEQ ID NO: 566229 - RNA, 64 nt, Homo Sapiens; identical to SEQ ID NO: 44757

SEQ ID NO: 566230 - RNA, 64 nt, Homo Sapiens; identical to SEQ ID NO: 44758

SEQ ID NO: 566231 - RNA, 64 nt, Homo Sapiens; identical to SEQ ID NO: 44759

SEQ ID NO: 566232 - RNA, 64 nt, Homo Sapiens; identical to SEQ ID NO: 44760

SEQ ID NO: 566233 - RNA, 64 nt, Homo Sapiens; identical to SEQ ID NO: 44761

SEQ ID NO: 566234 - RNA, 64 nt, Homo Sapiens; identical to SEQ ID NO: 44762

SEQ ID NO: 566235 - RNA, 64 nt, Homo Sapiens; identical to SEQ ID NO: 44763

SEQ ID NO: 566236 - RNA, 64 nt, Homo Sapiens; identical to SEQ ID NO: 44764

SEQ ID NO: 566237 - RNA, 64 nt, Homo Sapiens; identical to SEQ ID NO: 44765

SEQ ID NO: 566238 - RNA, 64 nt, Homo Sapiens; identical to SEQ ID NO: 44766

SEQ ID NO: 566239 - RNA, 64 nt, Homo Sapiens; identical to SEQ ID NO: 44767

SEQ ID NO: 566240 - RNA, 64 nt, Homo Sapiens; identical to SEQ ID NO: 44768

SEQ ID NO: 566241 - RNA, 64 nt, Homo Sapiens; identical to SEQ ID NO: 44769

SEQ ID NO: 566242 - RNA, 64 nt, Homo Sapiens; identical to SEQ ID NO: 44770

SEQ ID NO: 566243 - RNA, 64 nt, Homo Sapiens; identical to SEQ ID NO: 44771

SEQ ID NO: 566244 - RNA, 64 nt, Homo Sapiens; identical to SEQ ID NO: 44772

SEQ ID NO: 566245 - RNA, 64 nt, Homo Sapiens; identical to SEQ ID NO: 44773

SEQ ID NO: 566246 - RNA, 64 nt, Homo Sapiens; identical to SEQ ID NO: 44774

SEQ ID NO: 566247 - RNA, 64 nt, Homo Sapiens; identical to SEQ ID NO: 44775

SEQ ID NO: 566248 - RNA, 64 nt, Homo Sapiens; identical to SEQ ID NO: 44776

SEQ ID NO: 566249 - RNA, 57 nt, Homo Sapiens; identical to SEQ ID NO: 44777

SEQ ID NO: 566250 - RNA, 64 nt, Homo Sapiens; identical to SEQ ID NO: 44778

SEQ ID NO: 566251 - RNA, 64 nt, Homo Sapiens; identical to SEQ ID NO: 44779

SEQ ID NO: 566252 - RNA, 64 nt, Homo Sapiens; identical to SEQ ID NO: 44780

SEQ ID NO: 566253 - RNA, 64 nt, Homo Sapiens; identical to SEQ ID NO: 44781

SEQ ID NO: 566254 - RNA, 64 nt, Homo Sapiens; identical to SEQ ID NO: 44782

SEQ ID NO: 566255 - RNA, 64 nt, Homo Sapiens; identical to SEQ ID NO: 44783

SEQ ID NO: 566256 - RNA, 64 nt, Homo Sapiens; identical to SEQ ID NO: 44784

SEQ ID NO: 566257 - RNA, 64 nt, Homo Sapiens; identical to SEQ ID NO: 44785

SEQ ID NO: 566258 - RNA, 64 nt, Homo Sapiens; identical to SEQ ID NO: 44786

SEQ ID NO: 566259 - RNA, 64 nt, Homo Sapiens; identical to SEQ ID NO: 44773

SEQ ID NO: 566260 - RNA, 64 nt, Homo Sapiens; identical to SEQ ID NO: 44788

SEQ ID NO: 566261 - RNA, 64 nt, Homo Sapiens
cuagauauuaaugucaaucauuuaagauuaaugggcaugcaauuaagucuccauuuaagauuaa

SEQ ID NO: 566262 - RNA, 64 nt, Homo Sapiens
ggcaugcaauuaagucuccauuuaagauuaaugggcaugcaaugaagucuccagcagacaauca

SEQ ID NO: 566263 - RNA, 64 nt, Homo Sapiens
cuuauaagacuuaaaaauugaaaugcacagaaaugcaugcaauaaauaugauuucauaaaugua

SEQ ID NO: 566264 - RNA, 64 nt, Homo Sapiens
guuagagaucuguuauauaagggacaaguguaaagcaugcaaaaaauuuuucugucuauuaaau

SEQ ID NO: 566265 - RNA, 64 nt, Homo Sapiens; identical to SEQ ID NO: 45110

SEQ ID NO: 566266 - RNA, 64 nt, Homo Sapiens; identical to SEQ ID NO: 45111

SEQ ID NO: 566267 - RNA, 64 nt, Homo Sapiens; identical to SEQ ID NO: 45112

SEQ ID NO: 566268 - RNA, 64 nt, Homo Sapiens; identical to SEQ ID NO: 45113

SEQ ID NO: 566269 - RNA, 59 nt, Homo Sapiens; identical to SEQ ID NO: 45114

SEQ ID NO: 566270 - RNA, 64 nt, Homo Sapiens; identical to SEQ ID NO: 45115

SEQ ID NO: 566271 - RNA, 64 nt, Homo Sapiens; identical to SEQ ID NO: 45116

SEQ ID NO: 566272 - RNA, 64 nt, Homo Sapiens; identical to SEQ ID NO: 45117

SEQ ID NO: 566273 - RNA, 64 nt, Homo Sapiens; identical to SEQ ID NO: 45118

SEQ ID NO: 566274 - RNA, 64 nt, Homo Sapiens; identical to SEQ ID NO: 45119

SEQ ID NO: 566275 - RNA, 64 nt, Homo Sapiens; identical to SEQ ID NO: 45120

SEQ ID NO: 566276 - RNA, 64 nt, Homo Sapiens; identical to SEQ ID NO: 45121

SEQ ID NO: 566277 - RNA, 64 nt, Homo Sapiens; identical to SEQ ID NO: 45122

SEQ ID NO: 566278 - RNA, 64 nt, Homo Sapiens; identical to SEQ ID NO: 45123

SEQ ID NO: 566279 - RNA, 64 nt, Homo Sapiens; identical to SEQ ID NO: 45124

SEQ ID NO: 566280 - RNA, 64 nt, Homo Sapiens; identical to SEQ ID NO: 45125

SEQ ID NO: 566281 - RNA, 64 nt, Homo Sapiens; identical to SEQ ID NO: 45126

SEQ ID NO: 566282 - RNA, 64 nt, Homo Sapiens; identical to SEQ ID NO: 45127

SEQ ID NO: 566283 - RNA, 64 nt, Homo Sapiens; identical to SEQ ID NO: 45128

SEQ ID NO: 566284 - RNA, 64 nt, Homo Sapiens; identical to SEQ ID NO: 45129

SEQ ID NO: 566285 - RNA, 64 nt, Homo Sapiens; identical to SEQ ID NO: 45130

SEQ ID NO: 566286 - RNA, 64 nt, Homo Sapiens; identical to SEQ ID NO: 45131

SEQ ID NO: 566287 - RNA, 64 nt, Homo Sapiens; identical to SEQ ID NO: 45132

SEQ ID NO: 566288 - RNA, 64 nt, Homo Sapiens; identical to SEQ ID NO: 45133

SEQ ID NO: 566289 - RNA, 64 nt, Homo Sapiens; identical to SEQ ID NO: 45134

SEQ ID NO: 566290 - RNA, 64 nt, Homo Sapiens; identical to SEQ ID NO: 45135

SEQ ID NO: 566291 - RNA, 64 nt, Homo Sapiens; identical to SEQ ID NO: 45136

SEQ ID NO: 566292 - RNA, 64 nt, Homo Sapiens; identical to SEQ ID NO: 45137

SEQ ID NO: 566293 - RNA, 64 nt, Homo Sapiens; identical to SEQ ID NO: 45138

SEQ ID NO: 566294 - RNA, 64 nt, Homo Sapiens; identical to SEQ ID NO: 45139

SEQ ID NO: 566295 - RNA, 64 nt, Homo Sapiens; identical to SEQ ID NO: 45140

SEQ ID NO: 566296 - RNA, 64 nt, Homo Sapiens; identical to SEQ ID NO: 45141

SEQ ID NO: 566297 - RNA, 64 nt, Homo Sapiens; identical to SEQ ID NO: 45142

SEQ ID NO: 566298 - RNA, 64 nt, Homo Sapiens; identical to SEQ ID NO: 45143

SEQ ID NO: 566299 - RNA, 64 nt, Homo Sapiens; identical to SEQ ID NO: 45144

SEQ ID NO: 566300 - RNA, 64 nt, Homo Sapiens; identical to SEQ ID NO: 45145

SEQ ID NO: 566301 - RNA, 64 nt, Homo Sapiens; identical to SEQ ID NO: 45146

SEQ ID NO: 566302 - RNA, 64 nt, Homo Sapiens; identical to SEQ ID NO: 45147

SEQ ID NO: 566303 - RNA, 64 nt, Homo Sapiens; identical to SEQ ID NO: 45148

SEQ ID NO: 566304 - RNA, 64 nt, Homo Sapiens; identical to SEQ ID NO: 45149

SEQ ID NO: 566305 - RNA, 64 nt, Homo Sapiens; identical to SEQ ID NO: 45150

SEQ ID NO: 566306 - RNA, 64 nt, Homo Sapiens; identical to SEQ ID NO: 45151

SEQ ID NO: 566307 - RNA, 64 nt, Homo Sapiens; identical to SEQ ID NO: 45152

SEQ ID NO: 566308 - RNA, 64 nt, Homo Sapiens; identical to SEQ ID NO: 45153

SEQ ID NO: 566309 - RNA, 64 nt, Homo Sapiens; identical to SEQ ID NO: 45154

SEQ ID NO: 566310 - RNA, 64 nt, Homo Sapiens; identical to SEQ ID NO: 45155

SEQ ID NO: 566311 - RNA, 64 nt, Homo Sapiens; identical to SEQ ID NO: 45156

SEQ ID NO: 566312 - RNA, 64 nt, Homo Sapiens; identical to SEQ ID NO: 45157

SEQ ID NO: 566313 - RNA, 64 nt, Homo Sapiens; identical to SEQ ID NO: 45158

SEQ ID NO: 566314 - RNA, 64 nt, Homo Sapiens; identical to SEQ ID NO: 45159

SEQ ID NO: 566315 - RNA, 64 nt, Homo Sapiens; identical to SEQ ID NO: 45160

SEQ ID NO: 566316 - RNA, 64 nt, Homo Sapiens; identical to SEQ ID NO: 45161

SEQ ID NO: 566317 - RNA, 64 nt, Homo Sapiens; identical to SEQ ID NO: 45162

SEQ ID NO: 566318 - RNA, 64 nt, Homo Sapiens; identical to SEQ ID NO: 45163

SEQ ID NO: 566319 - RNA, 64 nt, Homo Sapiens; identical to SEQ ID NO: 45164

SEQ ID NO: 566320 - RNA, 64 nt, Homo Sapiens; identical to SEQ ID NO: 45165

SEQ ID NO: 566321 - RNA, 64 nt, Homo Sapiens; identical to SEQ ID NO: 45166

SEQ ID NO: 566322 - RNA, 64 nt, Homo Sapiens; identical to SEQ ID NO: 45167

SEQ ID NO: 566323 - RNA, 64 nt, Homo Sapiens; identical to SEQ ID NO: 45168

SEQ ID NO: 566324 - RNA, 64 nt, Homo Sapiens; identical to SEQ ID NO: 45169

SEQ ID NO: 566325 - RNA, 64 nt, Homo Sapiens; identical to SEQ ID NO: 45170

SEQ ID NO: 566326 - RNA, 64 nt, Homo Sapiens; identical to SEQ ID NO: 45171

SEQ ID NO: 566327 - RNA, 64 nt, Homo Sapiens; identical to SEQ ID NO: 45172

SEQ ID NO: 566328 - RNA, 64 nt, Homo Sapiens; identical to SEQ ID NO: 45173

SEQ ID NO: 566329 - RNA, 64 nt, Homo Sapiens; identical to SEQ ID NO: 45174

SEQ ID NO: 566330 - RNA, 64 nt, Homo Sapiens; identical to SEQ ID NO: 45175

SEQ ID NO: 566331 - RNA, 64 nt, Homo Sapiens; identical to SEQ ID NO: 45176

SEQ ID NO: 566332 - RNA, 64 nt, Homo Sapiens; identical to SEQ ID NO: 45177

SEQ ID NO: 566333 - RNA, 64 nt, Homo Sapiens; identical to SEQ ID NO: 45178

SEQ ID NO: 566334 - RNA, 64 nt, Homo Sapiens; identical to SEQ ID NO: 45179

SEQ ID NO: 566335 - RNA, 64 nt, Homo Sapiens; identical to SEQ ID NO: 45180

SEQ ID NO: 566336 - RNA, 64 nt, Homo Sapiens; identical to SEQ ID NO: 45181

SEQ ID NO: 566337 - RNA, 64 nt, Homo Sapiens; identical to SEQ ID NO: 45182

SEQ ID NO: 566338 - RNA, 64 nt, Homo Sapiens; identical to SEQ ID NO: 45183

SEQ ID NO: 566339 - RNA, 64 nt, Homo Sapiens; identical to SEQ ID NO: 45184

SEQ ID NO: 566340 - RNA, 64 nt, Homo Sapiens; identical to SEQ ID NO: 45185

SEQ ID NO: 566341 - RNA, 64 nt, Homo Sapiens; identical to SEQ ID NO: 45186

SEQ ID NO: 566342 - RNA, 64 nt, Homo Sapiens; identical to SEQ ID NO: 45187

SEQ ID NO: 566343 - RNA, 64 nt, Homo Sapiens; identical to SEQ ID NO: 45188

SEQ ID NO: 566344 - RNA, 64 nt, Homo Sapiens; identical to SEQ ID NO: 45189

SEQ ID NO: 566345 - RNA, 64 nt, Homo Sapiens; identical to SEQ ID NO: 45190

SEQ ID NO: 566346 - RNA, 64 nt, Homo Sapiens; identical to SEQ ID NO: 45191

SEQ ID NO: 566347 - RNA, 64 nt, Homo Sapiens; identical to SEQ ID NO: 45192

SEQ ID NO: 566348 - RNA, 64 nt, Homo Sapiens; identical to SEQ ID NO: 45193

SEQ ID NO: 566349 - RNA, 64 nt, Homo Sapiens; identical to SEQ ID NO: 45194

SEQ ID NO: 566350 - RNA, 64 nt, Homo Sapiens; identical to SEQ ID NO: 45195

SEQ ID NO: 566351 - RNA, 64 nt, Homo Sapiens; identical to SEQ ID NO: 45196

SEQ ID NO: 566352 - RNA, 64 nt, Homo Sapiens
acaugccauuaauaaaacccaagaucuuuuaaaucaaaaccauucagcaaaugcuguaagaccu

SEQ ID NO: 566353 - RNA, 64 nt, Homo Sapiens
ugauguaaaucuucauagugucagacauacugaccaaaaccacaaucuagacuacaaaguauau

SEQ ID NO: 566354 - RNA, 64 nt, Homo Sapiens
uuccuuggaaccacauuauuguuauuuaccuuaucaaaaccacgaaugggaaacagaagccuaa

SEQ ID NO: 566355 - RNA, 64 nt, Homo Sapiens
uacuuaaucuuuuacaucauugguaaauauguuacaaaaccaagaaauauuuugugacuuuaau

SEQ ID NO: 566356 - RNA, 64 nt, Homo Sapiens
cucuuauucucaguggaaaagauuuaugugaggucaaaaccaaauuuuuuuucaagaacccuug

SEQ ID NO: 566357 - RNA, 64 nt, Homo Sapiens
aaaagaauuguaauggcuacauaaaauuuuugcucaaaaccagaaaagguguuuugccagagag

SEQ ID NO: 566358 - RNA, 64 nt, Homo Sapiens
guguuacaguacacuuguagccaaaacuggaagacaaaaccaauauauaauuuggcugcugauu

SEQ ID NO: 566359 - RNA, 64 nt, Homo Sapiens
guugcgcuaccuaacaguaccaucuuggauccuucaaaaccaaagacuugccccagcacugcug

SEQ ID NO: 566360 - RNA, 64 nt, Homo Sapiens
uguccccuuuugagcugccacauuaucccaggggcaaaaccaccccaguaaggcccagugaucc

SEQ ID NO: 566361 - RNA, 64 nt, Homo Sapiens
cuacauguuuuggacuaaaaaagaaaacacucaacaaaaccaauuguugaaaacaaacaaaaag

SEQ ID NO: 566362 - RNA, 64 nt, Homo Sapiens
gagacauccagacuuguauauuucaguggaaauacaaaaccacuucagagaccaggguaucucc

SEQ ID NO: 566363 - RNA, 64 nt, Homo Sapiens
agaagcaaccuggagaacagcuaucaaucauauucaaaaccaguacaagaacugcugccuggua

SEQ ID NO: 566364 - RNA, 64 nt, Homo Sapiens
uccugaccucaggugauccaccgccuaggccucccaaaaccauuagggcucagaggaagguauc

SEQ ID NO: 566365 - RNA, 63 nt, Homo Sapiens
cugauagucuagcagguaauuaaacuuauauguccaaaaccauauucuucccugucucuucaa

SEQ ID NO: 566366 - RNA, 64 nt, Homo Sapiens
gcaaauuggagcauuucucaucgagccugccauucaaaaccaaauccguucugggcggugguuc

SEQ ID NO: 566367 - RNA, 64 nt, Homo Sapiens
uucugcauuuaaccaguccugaaugcguuuaaaacaaaaccacuuuauguuuaacauagaaaau

SEQ ID NO: 566368 - RNA, 64 nt, Homo Sapiens
aaaccaacaacaaaaaaaguggagacaguuuuaacaaaaccaauaauguuucagugaaaacuuu

SEQ ID NO: 566369 - RNA, 64 nt, Homo Sapiens
uuccccauuuuaacgggcguaaauucagacccugcaaaaccacaaaaaaaaagaaaacagaaaa

SEQ ID NO: 566370 - RNA, 64 nt, Homo Sapiens
aaaaauuuaaguuuuuuuaauuuuauuauguaagcaaaaccaauaguggcuauaguuacugauu

SEQ ID NO: 566371 - RNA, 64 nt, Homo Sapiens
auagaaaaaggugcuaucguuuucuuuacauacucaaaaccaaguaaguaagaaacaauuauaa

SEQ ID NO: 566372 - RNA, 64 nt, Homo Sapiens
gggggauacaaccguuuugcuccauacuaaaugacaaaaccauaaaaaccuuccaaugugggga

SEQ ID NO: 566373 - RNA, 64 nt, Homo Sapiens
ccugccaauccgcuguaacaacucugcuuuaaaacaaaaccaaacaaaacuuuaaaaaaaaaug

SEQ ID NO: 566374 - RNA, 64 nt, Homo Sapiens
gucuccugcagugccauucugccuucucaaugagcaaaaccauuuucuaaguaugaggauauua

SEQ ID NO: 566375 - RNA, 64 nt, Homo Sapiens
agucauguaauucaaucauguuuaauaugucagucaaaaccaaauucagaauuguuuuguguac

SEQ ID NO: 566376 - RNA, 64 nt, Homo Sapiens
uuaaguuuuaaguauauuaacauuuucauuuguccaaaaccaccccacugaggaaggaaauguu

SEQ ID NO: 566377 - RNA, 64 nt, Homo Sapiens
acauccucuucuuucugccaagcuucucuucuaucaaaaccaacuuugaaaauaaucuauuugu

SEQ ID NO: 566378 - RNA, 64 nt, Homo Sapiens
ccucacuucacagggucuguaaaaagguuaaucacaaaaccaaccauuuuaaaaagaaaaacag

SEQ ID NO: 566379 - RNA, 64 nt, Homo Sapiens
uccucucucugacgggguggcauuuggccuugaacaaaaccaaguccacuggggacagaggcag

SEQ ID NO: 566380 - RNA, 64 nt, Homo Sapiens
acacagguggagcugacccucgucuuuguggcagcaaaaccaggaugccuggagcuguggccug

SEQ ID NO: 566381 - RNA, 64 nt, Homo Sapiens
ccugaucccuuaugaccaacuucaagucugaguucaaaaccagcgcacuuuauuuucgucaagu

SEQ ID NO: 566382 - RNA, 64 nt, Homo Sapiens
auuauaggauuuuuuucuuuguaaaaaccgguaucaaaaccaaaauaggauuuuuucuuuuuua

SEQ ID NO: 566383 - RNA, 64 nt, Homo Sapiens
uuuuuucaacaucuaaaauuuuuguuuuagccuucaaaaccaacuuaccaaccucaguccagcu

SEQ ID NO: 566384 - RNA, 64 nt, Homo Sapiens
gaaggaaaucaggcauuccuauuucuuuaaauaacaaaaccacuaauugccacucaaugcugga

SEQ ID NO: 566385 - RNA, 64 nt, Homo Sapiens; identical to SEQ ID NO: 522646

SEQ ID NO: 566386 - RNA, 64 nt, Homo Sapiens; identical to SEQ ID NO: 522647

SEQ ID NO: 566387 - RNA, 64 nt, Homo Sapiens; identical to SEQ ID NO: 522648

SEQ ID NO: 566388 - RNA, 64 nt, Homo Sapiens; identical to SEQ ID NO: 522649

SEQ ID NO: 566389 - RNA, 64 nt, Homo Sapiens; identical to SEQ ID NO: 522650

SEQ ID NO: 566390 - RNA, 64 nt, Homo Sapiens; identical to SEQ ID NO: 522651

SEQ ID NO: 566391 - RNA, 64 nt, Homo Sapiens; identical to SEQ ID NO: 522652

SEQ ID NO: 566392 - RNA, 64 nt, Homo Sapiens; identical to SEQ ID NO: 522653

SEQ ID NO: 566393 - RNA, 64 nt, Homo Sapiens; identical to SEQ ID NO: 522654

SEQ ID NO: 566394 - RNA, 64 nt, Homo Sapiens; identical to SEQ ID NO: 522655

SEQ ID NO: 566395 - RNA, 64 nt, Homo Sapiens; identical to SEQ ID NO: 522656

SEQ ID NO: 566396 - RNA, 64 nt, Homo Sapiens; identical to SEQ ID NO: 522657

SEQ ID NO: 566397 - RNA, 64 nt, Homo Sapiens; identical to SEQ ID NO: 522658

SEQ ID NO: 566398 - RNA, 64 nt, Homo Sapiens; identical to SEQ ID NO: 522659

SEQ ID NO: 566399 - RNA, 64 nt, Homo Sapiens; identical to SEQ ID NO: 522660

SEQ ID NO: 566400 - RNA, 64 nt, Homo Sapiens; identical to SEQ ID NO: 522661

SEQ ID NO: 566401 - RNA, 64 nt, Homo Sapiens; identical to SEQ ID NO: 169676

SEQ ID NO: 566402 - RNA, 64 nt, Homo Sapiens; identical to SEQ ID NO: 169677

SEQ ID NO: 566403 - RNA, 64 nt, Homo Sapiens; identical to SEQ ID NO: 169678

SEQ ID NO: 566404 - RNA, 64 nt, Homo Sapiens; identical to SEQ ID NO: 169679

SEQ ID NO: 566405 - RNA, 64 nt, Homo Sapiens; identical to SEQ ID NO: 169680

SEQ ID NO: 566406 - RNA, 64 nt, Homo Sapiens; identical to SEQ ID NO: 169681

SEQ ID NO: 566407 - RNA, 64 nt, Homo Sapiens; identical to SEQ ID NO: 169682

SEQ ID NO: 566408 - RNA, 64 nt, Homo Sapiens; identical to SEQ ID NO: 169683

SEQ ID NO: 566409 - RNA, 64 nt, Homo Sapiens; identical to SEQ ID NO: 169684

SEQ ID NO: 566410 - RNA, 64 nt, Homo Sapiens; identical to SEQ ID NO: 169685

SEQ ID NO: 566411 - RNA, 64 nt, Homo Sapiens; identical to SEQ ID NO: 169686

SEQ ID NO: 566412 - RNA, 64 nt, Homo Sapiens; identical to SEQ ID NO: 169687

SEQ ID NO: 566413 - RNA, 64 nt, Homo Sapiens; identical to SEQ ID NO: 169688

SEQ ID NO: 566414 - RNA, 64 nt, Homo Sapiens; identical to SEQ ID NO: 169689

SEQ ID NO: 566415 - RNA, 64 nt, Homo Sapiens; identical to SEQ ID NO: 169690

SEQ ID NO: 566416 - RNA, 64 nt, Homo Sapiens; identical to SEQ ID NO: 169691

SEQ ID NO: 566417 - RNA, 64 nt, Homo Sapiens; identical to SEQ ID NO: 169692

SEQ ID NO: 566418 - RNA, 64 nt, Homo Sapiens; identical to SEQ ID NO: 169693

SEQ ID NO: 566419 - RNA, 64 nt, Homo Sapiens; identical to SEQ ID NO: 169694

SEQ ID NO: 566420 - RNA, 64 nt, Homo Sapiens; identical to SEQ ID NO: 169695

SEQ ID NO: 566421 - RNA, 64 nt, Homo Sapiens; identical to SEQ ID NO: 169696

SEQ ID NO: 566422 - RNA, 64 nt, Homo Sapiens; identical to SEQ ID NO: 169697

SEQ ID NO: 566423 - RNA, 64 nt, Homo Sapiens; identical to SEQ ID NO: 169698

SEQ ID NO: 566424 - RNA, 64 nt, Homo Sapiens; identical to SEQ ID NO: 169699

SEQ ID NO: 566425 - RNA, 64 nt, Homo Sapiens; identical to SEQ ID NO: 169700

SEQ ID NO: 566426 - RNA, 64 nt, Homo Sapiens; identical to SEQ ID NO: 169701

SEQ ID NO: 566427 - RNA, 64 nt, Homo Sapiens; identical to SEQ ID NO: 169702

SEQ ID NO: 566428 - RNA, 64 nt, Homo Sapiens; identical to SEQ ID NO: 169703

SEQ ID NO: 566429 - RNA, 64 nt, Homo Sapiens; identical to SEQ ID NO: 169704

SEQ ID NO: 566430 - RNA, 64 nt, Homo Sapiens; identical to SEQ ID NO: 169705

SEQ ID NO: 566431 - RNA, 64 nt, Homo Sapiens; identical to SEQ ID NO: 169706

SEQ ID NO: 566432 - RNA, 64 nt, Homo Sapiens; identical to SEQ ID NO: 169707

SEQ ID NO: 566433 - RNA, 64 nt, Homo Sapiens; identical to SEQ ID NO: 169708

SEQ ID NO: 566434 - RNA, 64 nt, Homo Sapiens; identical to SEQ ID NO: 169709

SEQ ID NO: 566435 - RNA, 64 nt, Homo Sapiens; identical to SEQ ID NO: 169710

SEQ ID NO: 566436 - RNA, 64 nt, Homo Sapiens; identical to SEQ ID NO: 169711

SEQ ID NO: 566437 - RNA, 64 nt, Homo Sapiens; identical to SEQ ID NO: 169712

SEQ ID NO: 566438 - RNA, 64 nt, Homo Sapiens; identical to SEQ ID NO: 169713

SEQ ID NO: 566439 - RNA, 64 nt, Homo Sapiens; identical to SEQ ID NO: 169714

SEQ ID NO: 566440 - RNA, 64 nt, Homo Sapiens; identical to SEQ ID NO: 169715

SEQ ID NO: 566441 - RNA, 64 nt, Homo Sapiens; identical to SEQ ID NO: 169716

SEQ ID NO: 566442 - RNA, 64 nt, Homo Sapiens; identical to SEQ ID NO: 169717

SEQ ID NO: 566443 - RNA, 64 nt, Homo Sapiens; identical to SEQ ID NO: 169718

SEQ ID NO: 566444 - RNA, 64 nt, Homo Sapiens; identical to SEQ ID NO: 169719

SEQ ID NO: 566445 - RNA, 64 nt, Homo Sapiens; identical to SEQ ID NO: 169720

SEQ ID NO: 566446 - RNA, 62 nt, Homo Sapiens; identical to SEQ ID NO: 169721

SEQ ID NO: 566447 - RNA, 64 nt, Homo Sapiens; identical to SEQ ID NO: 169722

SEQ ID NO: 566448 - RNA, 64 nt, Homo Sapiens; identical to SEQ ID NO: 169723

SEQ ID NO: 566449 - RNA, 64 nt, Homo Sapiens; identical to SEQ ID NO: 169724

SEQ ID NO: 566450 - RNA, 64 nt, Homo Sapiens; identical to SEQ ID NO: 169725

SEQ ID NO: 566451 - RNA, 64 nt, Homo Sapiens; identical to SEQ ID NO: 169726

SEQ ID NO: 566452 - RNA, 64 nt, Homo Sapiens; identical to SEQ ID NO: 169727

SEQ ID NO: 566453 - RNA, 64 nt, Homo Sapiens; identical to SEQ ID NO: 169728

SEQ ID NO: 566454 - RNA, 64 nt, Homo Sapiens; identical to SEQ ID NO: 169729

SEQ ID NO: 566455 - RNA, 64 nt, Homo Sapiens; identical to SEQ ID NO: 169730

SEQ ID NO: 566456 - RNA, 64 nt, Homo Sapiens; identical to SEQ ID NO: 169731

SEQ ID NO: 566457 - RNA, 64 nt, Homo Sapiens; identical to SEQ ID NO: 169732

SEQ ID NO: 566458 - RNA, 64 nt, Homo Sapiens; identical to SEQ ID NO: 169733

SEQ ID NO: 566459 - RNA, 64 nt, Homo Sapiens; identical to SEQ ID NO: 169734

SEQ ID NO: 566460 - RNA, 64 nt, Homo Sapiens; identical to SEQ ID NO: 369644

SEQ ID NO: 566461 - RNA, 64 nt, Homo Sapiens; identical to SEQ ID NO: 369645

SEQ ID NO: 566462 - RNA, 64 nt, Homo Sapiens; identical to SEQ ID NO: 369646

SEQ ID NO: 566463 - RNA, 64 nt, Homo Sapiens; identical to SEQ ID NO: 369647

SEQ ID NO: 566464 - RNA, 64 nt, Homo Sapiens; identical to SEQ ID NO: 369648

SEQ ID NO: 566465 - RNA, 64 nt, Homo Sapiens; identical to SEQ ID NO: 369649

SEQ ID NO: 566466 - RNA, 64 nt, Homo Sapiens; identical to SEQ ID NO: 369650

SEQ ID NO: 566467 - RNA, 64 nt, Homo Sapiens; identical to SEQ ID NO: 369651

SEQ ID NO: 566468 - RNA, 64 nt, Homo Sapiens; identical to SEQ ID NO: 390131

SEQ ID NO: 566469 - RNA, 64 nt, Homo Sapiens; identical to SEQ ID NO: 390132

SEQ ID NO: 566470 - RNA, 64 nt, Homo Sapiens; identical to SEQ ID NO: 390133

SEQ ID NO: 566471 - RNA, 64 nt, Homo Sapiens; identical to SEQ ID NO: 390134

SEQ ID NO: 566472 - RNA, 64 nt, Homo Sapiens; identical to SEQ ID NO: 390135

SEQ ID NO: 566473 - RNA, 64 nt, Homo Sapiens; identical to SEQ ID NO: 390136

SEQ ID NO: 566474 - RNA, 64 nt, Homo Sapiens; identical to SEQ ID NO: 390137

SEQ ID NO: 566475 - RNA, 64 nt, Homo Sapiens; identical to SEQ ID NO: 390138

SEQ ID NO: 566476 - RNA, 64 nt, Homo Sapiens; identical to SEQ ID NO: 390139

SEQ ID NO: 566477 - RNA, 64 nt, Homo Sapiens; identical to SEQ ID NO: 390140

SEQ ID NO: 566478 - RNA, 64 nt, Homo Sapiens; identical to SEQ ID NO: 390141

SEQ ID NO: 566479 - RNA, 64 nt, Homo Sapiens; identical to SEQ ID NO: 390142

SEQ ID NO: 566480 - RNA, 64 nt, Homo Sapiens; identical to SEQ ID NO: 390143

SEQ ID NO: 566481 - RNA, 57 nt, Homo Sapiens; identical to SEQ ID NO: 390144

SEQ ID NO: 566482 - RNA, 64 nt, Homo Sapiens; identical to SEQ ID NO: 390145

SEQ ID NO: 566483 - RNA, 64 nt, Homo Sapiens; identical to SEQ ID NO: 390146

SEQ ID NO: 566484 - RNA, 64 nt, Homo Sapiens; identical to SEQ ID NO: 390147

SEQ ID NO: 566485 - RNA, 64 nt, Homo Sapiens; identical to SEQ ID NO: 390148

SEQ ID NO: 566486 - RNA, 64 nt, Homo Sapiens; identical to SEQ ID NO: 390149

SEQ ID NO: 566487 - RNA, 64 nt, Homo Sapiens; identical to SEQ ID NO: 390150

SEQ ID NO: 566488 - RNA, 64 nt, Homo Sapiens; identical to SEQ ID NO: 390151

SEQ ID NO: 566489 - RNA, 64 nt, Homo Sapiens; identical to SEQ ID NO: 390152

SEQ ID NO: 566490 - RNA, 64 nt, Homo Sapiens; identical to SEQ ID NO: 390153

SEQ ID NO: 566491 - RNA, 64 nt, Homo Sapiens; identical to SEQ ID NO: 390154

SEQ ID NO: 566492 - RNA, 64 nt, Homo Sapiens; identical to SEQ ID NO: 390155

SEQ ID NO: 566493 - RNA, 64 nt, Homo Sapiens; identical to SEQ ID NO: 390156

SEQ ID NO: 566494 - RNA, 64 nt, Homo Sapiens; identical to SEQ ID NO: 390157

SEQ ID NO: 566495 - RNA, 64 nt, Homo Sapiens; identical to SEQ ID NO: 390158

SEQ ID NO: 566496 - RNA, 64 nt, Homo Sapiens; identical to SEQ ID NO: 390159

SEQ ID NO: 566497 - RNA, 64 nt, Homo Sapiens; identical to SEQ ID NO: 390160

SEQ ID NO: 566498 - RNA, 64 nt, Homo Sapiens; identical to SEQ ID NO: 390161

SEQ ID NO: 566499 - RNA, 64 nt, Homo Sapiens; identical to SEQ ID NO: 390162

SEQ ID NO: 566500 - RNA, 64 nt, Homo Sapiens; identical to SEQ ID NO: 390163

SEQ ID NO: 566501 - RNA, 64 nt, Homo Sapiens; identical to SEQ ID NO: 390164

SEQ ID NO: 566502 - RNA, 64 nt, Homo Sapiens; identical to SEQ ID NO: 390165

SEQ ID NO: 566503 - RNA, 64 nt, Homo Sapiens; identical to SEQ ID NO: 390166

SEQ ID NO: 566504 - RNA, 64 nt, Homo Sapiens; identical to SEQ ID NO: 390167

SEQ ID NO: 566505 - RNA, 64 nt, Homo Sapiens; identical to SEQ ID NO: 390168

SEQ ID NO: 566506 - RNA, 64 nt, Homo Sapiens; identical to SEQ ID NO: 390169

SEQ ID NO: 566507 - RNA, 64 nt, Homo Sapiens; identical to SEQ ID NO: 390170

SEQ ID NO: 566508 - RNA, 64 nt, Homo Sapiens; identical to SEQ ID NO: 390171

SEQ ID NO: 566509 - RNA, 64 nt, Homo Sapiens; identical to SEQ ID NO: 390172

SEQ ID NO: 566510 - RNA, 64 nt, Homo Sapiens; identical to SEQ ID NO: 390173

SEQ ID NO: 566511 - RNA, 64 nt, Homo Sapiens; identical to SEQ ID NO: 390174

SEQ ID NO: 566512 - RNA, 64 nt, Homo Sapiens; identical to SEQ ID NO: 390175

SEQ ID NO: 566513 - RNA, 64 nt, Homo Sapiens; identical to SEQ ID NO: 390176

SEQ ID NO: 566514 - RNA, 64 nt, Homo Sapiens; identical to SEQ ID NO: 390177

SEQ ID NO: 566515 - RNA, 64 nt, Homo Sapiens; identical to SEQ ID NO: 390178

SEQ ID NO: 566516 - RNA, 64 nt, Homo Sapiens; identical to SEQ ID NO: 390179

SEQ ID NO: 566517 - RNA, 64 nt, Homo Sapiens; identical to SEQ ID NO: 390180

SEQ ID NO: 566518 - RNA, 64 nt, Homo Sapiens; identical to SEQ ID NO: 390181

SEQ ID NO: 566519 - RNA, 64 nt, Homo Sapiens; identical to SEQ ID NO: 390182

SEQ ID NO: 566520 - RNA, 64 nt, Homo Sapiens; identical to SEQ ID NO: 390183

SEQ ID NO: 566521 - RNA, 64 nt, Homo Sapiens; identical to SEQ ID NO: 390184

SEQ ID NO: 566522 - RNA, 64 nt, Homo Sapiens; identical to SEQ ID NO: 390185

SEQ ID NO: 566523 - RNA, 64 nt, Homo Sapiens; identical to SEQ ID NO: 390186

SEQ ID NO: 566524 - RNA, 64 nt, Homo Sapiens; identical to SEQ ID NO: 390187

SEQ ID NO: 566525 - RNA, 64 nt, Homo Sapiens; identical to SEQ ID NO: 390188

SEQ ID NO: 566526 - RNA, 64 nt, Homo Sapiens; identical to SEQ ID NO: 390189

SEQ ID NO: 566527 - RNA, 64 nt, Homo Sapiens; identical to SEQ ID NO: 390190

SEQ ID NO: 566528 - RNA, 64 nt, Homo Sapiens; identical to SEQ ID NO: 390191

SEQ ID NO: 566529 - RNA, 64 nt, Homo Sapiens; identical to SEQ ID NO: 390192

SEQ ID NO: 566530 - RNA, 64 nt, Homo Sapiens; identical to SEQ ID NO: 390193

SEQ ID NO: 566531 - RNA, 64 nt, Homo Sapiens; identical to SEQ ID NO: 390194

SEQ ID NO: 566532 - RNA, 64 nt, Homo Sapiens; identical to SEQ ID NO: 390195

SEQ ID NO: 566533 - RNA, 64 nt, Homo Sapiens; identical to SEQ ID NO: 390196

SEQ ID NO: 566534 - RNA, 64 nt, Homo Sapiens; identical to SEQ ID NO: 390197

SEQ ID NO: 566535 - RNA, 64 nt, Homo Sapiens; identical to SEQ ID NO: 390198

SEQ ID NO: 566536 - RNA, 64 nt, Homo Sapiens; identical to SEQ ID NO: 390199

SEQ ID NO: 566537 - RNA, 64 nt, Homo Sapiens; identical to SEQ ID NO: 390200

SEQ ID NO: 566538 - RNA, 64 nt, Homo Sapiens; identical to SEQ ID NO: 390201

SEQ ID NO: 566539 - RNA, 64 nt, Homo Sapiens; identical to SEQ ID NO: 390202

SEQ ID NO: 566540 - RNA, 64 nt, Homo Sapiens; identical to SEQ ID NO: 390203

SEQ ID NO: 566541 - RNA, 64 nt, Homo Sapiens; identical to SEQ ID NO: 390204

SEQ ID NO: 566542 - RNA, 60 nt, Homo Sapiens; identical to SEQ ID NO: 390205

SEQ ID NO: 566543 - RNA, 64 nt, Homo Sapiens; identical to SEQ ID NO: 390206

SEQ ID NO: 566544 - RNA, 64 nt, Homo Sapiens; identical to SEQ ID NO: 390207

SEQ ID NO: 566545 - RNA, 64 nt, Homo Sapiens; identical to SEQ ID NO: 390208

SEQ ID NO: 566546 - RNA, 64 nt, Homo Sapiens; identical to SEQ ID NO: 390209

SEQ ID NO: 566547 - RNA, 64 nt, Homo Sapiens; identical to SEQ ID NO: 390210

SEQ ID NO: 566548 - RNA, 64 nt, Homo Sapiens; identical to SEQ ID NO: 390211

SEQ ID NO: 566549 - RNA, 64 nt, Homo Sapiens; identical to SEQ ID NO: 390212

SEQ ID NO: 566550 - RNA, 64 nt, Homo Sapiens; identical to SEQ ID NO: 390213

SEQ ID NO: 566551 - RNA, 64 nt, Homo Sapiens; identical to SEQ ID NO: 390214

SEQ ID NO: 566552 - RNA, 64 nt, Homo Sapiens; identical to SEQ ID NO: 390215

SEQ ID NO: 566553 - RNA, 64 nt, Homo Sapiens; identical to SEQ ID NO: 390216

SEQ ID NO: 566554 - RNA, 64 nt, Homo Sapiens; identical to SEQ ID NO: 390217

SEQ ID NO: 566555 - RNA, 64 nt, Homo Sapiens; identical to SEQ ID NO: 390218

SEQ ID NO: 566556 - RNA, 64 nt, Homo Sapiens; identical to SEQ ID NO: 390219

SEQ ID NO: 566557 - RNA, 64 nt, Homo Sapiens; identical to SEQ ID NO: 390220

SEQ ID NO: 566558 - RNA, 64 nt, Homo Sapiens; identical to SEQ ID NO: 390221

SEQ ID NO: 566559 - RNA, 64 nt, Homo Sapiens; identical to SEQ ID NO: 390222

SEQ ID NO: 566560 - RNA, 64 nt, Homo Sapiens; identical to SEQ ID NO: 390223

SEQ ID NO: 566561 - RNA, 64 nt, Homo Sapiens; identical to SEQ ID NO: 390224

SEQ ID NO: 566562 - RNA, 64 nt, Homo Sapiens; identical to SEQ ID NO: 390225

SEQ ID NO: 566563 - RNA, 64 nt, Homo Sapiens; identical to SEQ ID NO: 390226

SEQ ID NO: 566564 - RNA, 64 nt, Homo Sapiens; identical to SEQ ID NO: 390227

SEQ ID NO: 566565 - RNA, 64 nt, Homo Sapiens; identical to SEQ ID NO: 390228

SEQ ID NO: 566566 - RNA, 64 nt, Homo Sapiens; identical to SEQ ID NO: 390229

SEQ ID NO: 566567 - RNA, 64 nt, Homo Sapiens; identical to SEQ ID NO: 390230

SEQ ID NO: 566568 - RNA, 64 nt, Homo Sapiens; identical to SEQ ID NO: 390231

SEQ ID NO: 566569 - RNA, 64 nt, Homo Sapiens; identical to SEQ ID NO: 390232

SEQ ID NO: 566570 - RNA, 64 nt, Homo Sapiens; identical to SEQ ID NO: 390233

SEQ ID NO: 566571 - RNA, 64 nt, Homo Sapiens; identical to SEQ ID NO: 390234

SEQ ID NO: 566572 - RNA, 64 nt, Homo Sapiens; identical to SEQ ID NO: 390235

SEQ ID NO: 566573 - RNA, 64 nt, Homo Sapiens; identical to SEQ ID NO: 390236

SEQ ID NO: 566574 - RNA, 64 nt, Homo Sapiens; identical to SEQ ID NO: 390237

SEQ ID NO: 566575 - RNA, 64 nt, Homo Sapiens; identical to SEQ ID NO: 390238

SEQ ID NO: 566576 - RNA, 64 nt, Homo Sapiens; identical to SEQ ID NO: 390239

SEQ ID NO: 566577 - RNA, 64 nt, Homo Sapiens; identical to SEQ ID NO: 390240

SEQ ID NO: 566578 - RNA, 64 nt, Homo Sapiens; identical to SEQ ID NO: 390241

SEQ ID NO: 566579 - RNA, 64 nt, Homo Sapiens; identical to SEQ ID NO: 390242

SEQ ID NO: 566580 - RNA, 64 nt, Homo Sapiens; identical to SEQ ID NO: 390243

SEQ ID NO: 566581 - RNA, 64 nt, Homo Sapiens; identical to SEQ ID NO: 390244

SEQ ID NO: 566582 - RNA, 64 nt, Homo Sapiens; identical to SEQ ID NO: 390245

SEQ ID NO: 566583 - RNA, 64 nt, Homo Sapiens; identical to SEQ ID NO: 390246

SEQ ID NO: 566584 - RNA, 64 nt, Homo Sapiens; identical to SEQ ID NO: 390247

SEQ ID NO: 566585 - RNA, 64 nt, Homo Sapiens; identical to SEQ ID NO: 390248

SEQ ID NO: 566586 - RNA, 64 nt, Homo Sapiens; identical to SEQ ID NO: 390249

SEQ ID NO: 566587 - RNA, 64 nt, Homo Sapiens; identical to SEQ ID NO: 390250

SEQ ID NO: 566588 - RNA, 64 nt, Homo Sapiens; identical to SEQ ID NO: 390251

SEQ ID NO: 566589 - RNA, 64 nt, Homo Sapiens; identical to SEQ ID NO: 390252

SEQ ID NO: 566590 - RNA, 64 nt, Homo Sapiens; identical to SEQ ID NO: 390253

SEQ ID NO: 566591 - RNA, 64 nt, Homo Sapiens; identical to SEQ ID NO: 390254

SEQ ID NO: 566592 - RNA, 64 nt, Homo Sapiens; identical to SEQ ID NO: 390255

SEQ ID NO: 566593 - RNA, 64 nt, Homo Sapiens; identical to SEQ ID NO: 390256

SEQ ID NO: 566594 - RNA, 64 nt, Homo Sapiens; identical to SEQ ID NO: 390257

SEQ ID NO: 566595 - RNA, 64 nt, Homo Sapiens; identical to SEQ ID NO: 390258

SEQ ID NO: 566596 - RNA, 64 nt, Homo Sapiens; identical to SEQ ID NO: 390259

SEQ ID NO: 566597 - RNA, 64 nt, Homo Sapiens
cuauccacaauuuaaauaaacucucucucccccuaccuaccaaaggcacagaauuugcuaccau

SEQ ID NO: 566598 - RNA, 64 nt, Homo Sapiens
aagagccuguauuuugaguuggaccauguuuuuaaccuaccaucguguuaucuaucacauaaca

SEQ ID NO: 566599 - RNA, 64 nt, Homo Sapiens
uagauuuaggagcagaaaugcaaggggcugcaugaccuaccaggacagaacuuuccccaauuac

SEQ ID NO: 566600 - RNA, 64 nt, Homo Sapiens
ucggauucaacuaccuuagauaauauuucugaaaaccuaccagccagaggguagggcacaaaga

SEQ ID NO: 566601 - RNA, 64 nt, Homo Sapiens
ggggugugguugugcccugaauguaauauggaaaaccuaccaguugauugcaaugugagaccga

SEQ ID NO: 566602 - RNA, 64 nt, Homo Sapiens
gcugugcuguuaaugccgugugcaugcauauuucaccuaccaaauacuauacuuuucauaaugu

SEQ ID NO: 566603 - RNA, 64 nt, Homo Sapiens
uccugcaccccuuugaucggucuguucaacuuccaccuaccaccuuauacaugcaaaccuacca

SEQ ID NO: 566604 - RNA, 64 nt, Homo Sapiens
uguucaacuuccaccuaccaucuuauacaugcaaaccuaccauccuauguccccuggggcguua

SEQ ID NO: 566605 - RNA, 64 nt, Homo Sapiens
auggaaugaacuaaaauaaacaagaacaaaagaauaguauaauuauaucaguaacaagaagacu

SEQ ID NO: 566606 - RNA, 64 nt, Homo Sapiens
cauugacauuaauaaaacuuagaaacaguauaauuaguauaacauuuacucugaauuugaagau

SEQ ID NO: 566607 - RNA, 64 nt, Homo Sapiens
auguguguguguguucuguguuuaacaaaaccaauaguauaaaacuuaauccagauagccugga

SEQ ID NO: 566608 - RNA, 64 nt, Homo Sapiens
gaaauuauuagaagaauucaacuuuggaaguuuauaguauaauuuaggaaucagcgauacaacc

SEQ ID NO: 566609 - RNA, 64 nt, Homo Sapiens
cugcaagaauaaaaguaacuaaauguugacuuccuaguauaaaaauuguggaugauggcuuauu

SEQ ID NO: 566610 - RNA, 64 nt, Homo Sapiens
uuucuuaauuuggauaauaauaauagcuuuugauuaguauaauaauacauagacauuucaaaau

SEQ ID NO: 566611 - RNA, 64 nt, Homo Sapiens
uguuacuuucaaauacccguucucuguauguaaguaguauaauuguaguuuaguuaugucuuuu

SEQ ID NO: 566612 - RNA, 64 nt, Homo Sapiens
aggccaugcauauaauguacucucuuuuugaaaauaguauaaacuuaauaguuuaaaacaauau

SEQ ID NO: 566613 - RNA, 64 nt, Homo Sapiens
gaaauuuuuguagaugaaaauucugcaaauuuucuaguauaacaugucacaagaaaaaaauguc

SEQ ID NO: 566614 - RNA, 64 nt, Homo Sapiens
gcaucagccuaagaauggcauuucagaagcaggauaguauaaaauggugguauggcugacccug

SEQ ID NO: 566615 - RNA, 64 nt, Homo Sapiens
agaaucaaguccgagagugaugugcaggaguaaguaguauaagacuuaacuagagucaauuaga

SEQ ID NO: 566616 - RNA, 64 nt, Homo Sapiens
uacauagaaaacacaaguaaaauucaaugggagauaguauaaaaaagacucuaguggaggaauu

SEQ ID NO: 566617 - RNA, 64 nt, Homo Sapiens
uagucuuccuucaaugcguguauguaaucuuuguuaguauaaaagauauuaaauauaggugcca

SEQ ID NO: 566618 - RNA, 64 nt, Homo Sapiens
uugaguuauuuugucuuuuagaauacacaaaauauaguauaaagacauuucacaauuuccaaac

SEQ ID NO: 566619 - RNA, 64 nt, Homo Sapiens
auaggaacuaaguuaaacuuaguuauaacuacuguaguauaaaucucuggaaaaagacuccgag

SEQ ID NO: 566620 - RNA, 64 nt, Homo Sapiens
gaacucaagggaaaaggaaaacauucaugcccaauaguauaagguguuggcggacagguuaugg

SEQ ID NO: 566621 - RNA, 64 nt, Homo Sapiens; identical to SEQ ID NO: 166381

SEQ ID NO: 566622 - RNA, 64 nt, Homo Sapiens; identical to SEQ ID NO: 166382

SEQ ID NO: 566623 - RNA, 64 nt, Homo Sapiens; identical to SEQ ID NO: 166383

SEQ ID NO: 566624 - RNA, 64 nt, Homo Sapiens; identical to SEQ ID NO: 166384

SEQ ID NO: 566625 - RNA, 64 nt, Homo Sapiens; identical to SEQ ID NO: 166385

SEQ ID NO: 566626 - RNA, 64 nt, Homo Sapiens; identical to SEQ ID NO: 166386

SEQ ID NO: 566627 - RNA, 64 nt, Homo Sapiens; identical to SEQ ID NO: 166387

SEQ ID NO: 566628 - RNA, 64 nt, Homo Sapiens; identical to SEQ ID NO: 166388

SEQ ID NO: 566629 - RNA, 64 nt, Homo Sapiens; identical to SEQ ID NO: 166389

SEQ ID NO: 566630 - RNA, 64 nt, Homo Sapiens; identical to SEQ ID NO: 166390

SEQ ID NO: 566631 - RNA, 64 nt, Homo Sapiens; identical to SEQ ID NO: 166391

SEQ ID NO: 566632 - RNA, 64 nt, Homo Sapiens; identical to SEQ ID NO: 166392

SEQ ID NO: 566633 - RNA, 64 nt, Homo Sapiens; identical to SEQ ID NO: 166393

SEQ ID NO: 566634 - RNA, 64 nt, Homo Sapiens; identical to SEQ ID NO: 166394

SEQ ID NO: 566635 - RNA, 64 nt, Homo Sapiens; identical to SEQ ID NO: 166395

SEQ ID NO: 566636 - RNA, 64 nt, Homo Sapiens; identical to SEQ ID NO: 166396

SEQ ID NO: 566637 - RNA, 64 nt, Homo Sapiens; identical to SEQ ID NO: 166397

SEQ ID NO: 566638 - RNA, 64 nt, Homo Sapiens; identical to SEQ ID NO: 110173

SEQ ID NO: 566639 - RNA, 64 nt, Homo Sapiens; identical to SEQ ID NO: 110174

SEQ ID NO: 566640 - RNA, 64 nt, Homo Sapiens; identical to SEQ ID NO: 110175

SEQ ID NO: 566641 - RNA, 64 nt, Homo Sapiens; identical to SEQ ID NO: 110176

SEQ ID NO: 566642 - RNA, 64 nt, Homo Sapiens; identical to SEQ ID NO: 110177

SEQ ID NO: 566643 - RNA, 64 nt, Homo Sapiens; identical to SEQ ID NO: 110178

SEQ ID NO: 566644 - RNA, 64 nt, Homo Sapiens; identical to SEQ ID NO: 110179

SEQ ID NO: 566645 - RNA, 64 nt, Homo Sapiens; identical to SEQ ID NO: 110180

SEQ ID NO: 566646 - RNA, 64 nt, Homo Sapiens; identical to SEQ ID NO: 110181

SEQ ID NO: 566647 - RNA, 64 nt, Homo Sapiens; identical to SEQ ID NO: 110182

SEQ ID NO: 566648 - RNA, 64 nt, Homo Sapiens; identical to SEQ ID NO: 110183

SEQ ID NO: 566649 - RNA, 64 nt, Homo Sapiens; identical to SEQ ID NO: 110184

SEQ ID NO: 566650 - RNA, 64 nt, Homo Sapiens; identical to SEQ ID NO: 110185

SEQ ID NO: 566651 - RNA, 64 nt, Homo Sapiens; identical to SEQ ID NO: 110186

SEQ ID NO: 566652 - RNA, 64 nt, Homo Sapiens; identical to SEQ ID NO: 110187

SEQ ID NO: 566653 - RNA, 64 nt, Homo Sapiens; identical to SEQ ID NO: 110188

SEQ ID NO: 566654 - RNA, 64 nt, Homo Sapiens; identical to SEQ ID NO: 110189

SEQ ID NO: 566655 - RNA, 64 nt, Homo Sapiens; identical to SEQ ID NO: 110190

SEQ ID NO: 566656 - RNA, 64 nt, Homo Sapiens; identical to SEQ ID NO: 110191

SEQ ID NO: 566657 - RNA, 64 nt, Homo Sapiens; identical to SEQ ID NO: 110192

SEQ ID NO: 566658 - RNA, 64 nt, Homo Sapiens; identical to SEQ ID NO: 110193

SEQ ID NO: 566659 - RNA, 64 nt, Homo Sapiens; identical to SEQ ID NO: 110194

SEQ ID NO: 566660 - RNA, 64 nt, Homo Sapiens; identical to SEQ ID NO: 110195

SEQ ID NO: 566661 - RNA, 59 nt, Homo Sapiens; identical to SEQ ID NO: 110196

SEQ ID NO: 566662 - RNA, 64 nt, Homo Sapiens; identical to SEQ ID NO: 110197

SEQ ID NO: 566663 - RNA, 64 nt, Homo Sapiens; identical to SEQ ID NO: 110198

SEQ ID NO: 566664 - RNA, 64 nt, Homo Sapiens; identical to SEQ ID NO: 110199

SEQ ID NO: 566665 - RNA, 64 nt, Homo Sapiens; identical to SEQ ID NO: 110200

SEQ ID NO: 566666 - RNA, 62 nt, Homo Sapiens; identical to SEQ ID NO: 110201

SEQ ID NO: 566667 - RNA, 64 nt, Homo Sapiens; identical to SEQ ID NO: 110202

SEQ ID NO: 566668 - RNA, 64 nt, Homo Sapiens; identical to SEQ ID NO: 110203

SEQ ID NO: 566669 - RNA, 64 nt, Homo Sapiens; identical to SEQ ID NO: 110204

SEQ ID NO: 566670 - RNA, 64 nt, Homo Sapiens; identical to SEQ ID NO: 110205

SEQ ID NO: 566671 - RNA, 64 nt, Homo Sapiens; identical to SEQ ID NO: 110206

SEQ ID NO: 566672 - RNA, 64 nt, Homo Sapiens; identical to SEQ ID NO: 110207

SEQ ID NO: 566673 - RNA, 64 nt, Homo Sapiens; identical to SEQ ID NO: 110208

SEQ ID NO: 566674 - RNA, 64 nt, Homo Sapiens; identical to SEQ ID NO: 110209

SEQ ID NO: 566675 - RNA, 64 nt, Homo Sapiens; identical to SEQ ID NO: 110210

SEQ ID NO: 566676 - RNA, 64 nt, Homo Sapiens; identical to SEQ ID NO: 110211

SEQ ID NO: 566677 - RNA, 64 nt, Homo Sapiens; identical to SEQ ID NO: 110212

SEQ ID NO: 566678 - RNA, 64 nt, Homo Sapiens; identical to SEQ ID NO: 110213

SEQ ID NO: 566679 - RNA, 64 nt, Homo Sapiens; identical to SEQ ID NO: 110214

SEQ ID NO: 566680 - RNA, 64 nt, Homo Sapiens; identical to SEQ ID NO: 110215

SEQ ID NO: 566681 - RNA, 64 nt, Homo Sapiens; identical to SEQ ID NO: 110216

SEQ ID NO: 566682 - RNA, 64 nt, Homo Sapiens; identical to SEQ ID NO: 110217

SEQ ID NO: 566683 - RNA, 64 nt, Homo Sapiens; identical to SEQ ID NO: 110218

SEQ ID NO: 566684 - RNA, 64 nt, Homo Sapiens; identical to SEQ ID NO: 110219

SEQ ID NO: 566685 - RNA, 64 nt, Homo Sapiens; identical to SEQ ID NO: 110220

SEQ ID NO: 566686 - RNA, 64 nt, Homo Sapiens; identical to SEQ ID NO: 110221

SEQ ID NO: 566687 - RNA, 62 nt, Homo Sapiens; identical to SEQ ID NO: 110222

SEQ ID NO: 566688 - RNA, 64 nt, Homo Sapiens; identical to SEQ ID NO: 110223

SEQ ID NO: 566689 - RNA, 64 nt, Homo Sapiens; identical to SEQ ID NO: 110224

SEQ ID NO: 566690 - RNA, 64 nt, Homo Sapiens; identical to SEQ ID NO: 110225

SEQ ID NO: 566691 - RNA, 64 nt, Homo Sapiens; identical to SEQ ID NO: 110226

SEQ ID NO: 566692 - RNA, 64 nt, Homo Sapiens; identical to SEQ ID NO: 110227

SEQ ID NO: 566693 - RNA, 64 nt, Homo Sapiens; identical to SEQ ID NO: 110228

SEQ ID NO: 566694 - RNA, 64 nt, Homo Sapiens; identical to SEQ ID NO: 110229

SEQ ID NO: 566695 - RNA, 64 nt, Homo Sapiens; identical to SEQ ID NO: 110230

SEQ ID NO: 566696 - RNA, 64 nt, Homo Sapiens; identical to SEQ ID NO: 110231

SEQ ID NO: 566697 - RNA, 64 nt, Homo Sapiens; identical to SEQ ID NO: 110232

SEQ ID NO: 566698 - RNA, 64 nt, Homo Sapiens; identical to SEQ ID NO: 110233

SEQ ID NO: 566699 - RNA, 64 nt, Homo Sapiens; identical to SEQ ID NO: 110234

SEQ ID NO: 566700 - RNA, 64 nt, Homo Sapiens; identical to SEQ ID NO: 110235

SEQ ID NO: 566701 - RNA, 64 nt, Homo Sapiens; identical to SEQ ID NO: 110236

SEQ ID NO: 566702 - RNA, 64 nt, Homo Sapiens; identical to SEQ ID NO: 110237

SEQ ID NO: 566703 - RNA, 64 nt, Homo Sapiens; identical to SEQ ID NO: 110238

SEQ ID NO: 566704 - RNA, 64 nt, Homo Sapiens; identical to SEQ ID NO: 110239

SEQ ID NO: 566705 - RNA, 64 nt, Homo Sapiens; identical to SEQ ID NO: 110240

SEQ ID NO: 566706 - RNA, 64 nt, Homo Sapiens; identical to SEQ ID NO: 110241

SEQ ID NO: 566707 - RNA, 64 nt, Homo Sapiens; identical to SEQ ID NO: 110242

SEQ ID NO: 566708 - RNA, 64 nt, Homo Sapiens; identical to SEQ ID NO: 110243

SEQ ID NO: 566709 - RNA, 64 nt, Homo Sapiens; identical to SEQ ID NO: 110244

SEQ ID NO: 566710 - RNA, 64 nt, Homo Sapiens; identical to SEQ ID NO: 110245

SEQ ID NO: 566711 - RNA, 64 nt, Homo Sapiens; identical to SEQ ID NO: 110246

SEQ ID NO: 566712 - RNA, 64 nt, Homo Sapiens; identical to SEQ ID NO: 110247

SEQ ID NO: 566713 - RNA, 64 nt, Homo Sapiens; identical to SEQ ID NO: 110248

SEQ ID NO: 566714 - RNA, 64 nt, Homo Sapiens; identical to SEQ ID NO: 286103

SEQ ID NO: 566715 - RNA, 64 nt, Homo Sapiens; identical to SEQ ID NO: 286104

SEQ ID NO: 566716 - RNA, 64 nt, Homo Sapiens; identical to SEQ ID NO: 286105

SEQ ID NO: 566717 - RNA, 64 nt, Homo Sapiens; identical to SEQ ID NO: 286106

SEQ ID NO: 566718 - RNA, 64 nt, Homo Sapiens; identical to SEQ ID NO: 286107

SEQ ID NO: 566719 - RNA, 64 nt, Homo Sapiens; identical to SEQ ID NO: 286108

SEQ ID NO: 566720 - RNA, 64 nt, Homo Sapiens; identical to SEQ ID NO: 286109

SEQ ID NO: 566721 - RNA, 64 nt, Homo Sapiens; identical to SEQ ID NO: 286110

SEQ ID NO: 566722 - RNA, 64 nt, Homo Sapiens; identical to SEQ ID NO: 286111

SEQ ID NO: 566723 - RNA, 64 nt, Homo Sapiens; identical to SEQ ID NO: 286112

SEQ ID NO: 566724 - RNA, 64 nt, Homo Sapiens; identical to SEQ ID NO: 286113

SEQ ID NO: 566725 - RNA, 64 nt, Homo Sapiens; identical to SEQ ID NO: 286114

SEQ ID NO: 566726 - RNA, 64 nt, Homo Sapiens; identical to SEQ ID NO: 286115

SEQ ID NO: 566727 - RNA, 64 nt, Homo Sapiens; identical to SEQ ID NO: 286116

SEQ ID NO: 566728 - RNA, 64 nt, Homo Sapiens; identical to SEQ ID NO: 286117

SEQ ID NO: 566729 - RNA, 64 nt, Homo Sapiens; identical to SEQ ID NO: 286118

SEQ ID NO: 566730 - RNA, 64 nt, Homo Sapiens; identical to SEQ ID NO: 286119

SEQ ID NO: 566731 - RNA, 64 nt, Homo Sapiens; identical to SEQ ID NO: 286120

SEQ ID NO: 566732 - RNA, 64 nt, Homo Sapiens; identical to SEQ ID NO: 286121

SEQ ID NO: 566733 - RNA, 64 nt, Homo Sapiens; identical to SEQ ID NO: 286122

SEQ ID NO: 566734 - RNA, 64 nt, Homo Sapiens; identical to SEQ ID NO: 286123

SEQ ID NO: 566735 - RNA, 64 nt, Homo Sapiens; identical to SEQ ID NO: 286124

SEQ ID NO: 566736 - RNA, 65 nt, Homo Sapiens; identical to SEQ ID NO: 420659

SEQ ID NO: 566737 - RNA, 65 nt, Homo Sapiens; identical to SEQ ID NO: 420660

SEQ ID NO: 566738 - RNA, 65 nt, Homo Sapiens; identical to SEQ ID NO: 420661

SEQ ID NO: 566739 - RNA, 65 nt, Homo Sapiens; identical to SEQ ID NO: 420662

SEQ ID NO: 566740 - RNA, 65 nt, Homo Sapiens; identical to SEQ ID NO: 420663

SEQ ID NO: 566741 - RNA, 65 nt, Homo Sapiens; identical to SEQ ID NO: 420664

SEQ ID NO: 566742 - RNA, 65 nt, Homo Sapiens; identical to SEQ ID NO: 420665

SEQ ID NO: 566743 - RNA, 65 nt, Homo Sapiens; identical to SEQ ID NO: 420666

SEQ ID NO: 566744 - RNA, 65 nt, Homo Sapiens; identical to SEQ ID NO: 420667

SEQ ID NO: 566745 - RNA, 65 nt, Homo Sapiens; identical to SEQ ID NO: 420668

SEQ ID NO: 566746 - RNA, 65 nt, Homo Sapiens; identical to SEQ ID NO: 420669

SEQ ID NO: 566747 - RNA, 65 nt, Homo Sapiens; identical to SEQ ID NO: 420670

SEQ ID NO: 566748 - RNA, 65 nt, Homo Sapiens; identical to SEQ ID NO: 420671

SEQ ID NO: 566749 - RNA, 65 nt, Homo Sapiens; identical to SEQ ID NO: 420672

SEQ ID NO: 566750 - RNA, 65 nt, Homo Sapiens; identical to SEQ ID NO: 420673

SEQ ID NO: 566751 - RNA, 65 nt, Homo Sapiens; identical to SEQ ID NO: 420674

SEQ ID NO: 566752 - RNA, 65 nt, Homo Sapiens; identical to SEQ ID NO: 420675

SEQ ID NO: 566753 - RNA, 65 nt, Homo Sapiens; identical to SEQ ID NO: 420676

SEQ ID NO: 566754 - RNA, 65 nt, Homo Sapiens; identical to SEQ ID NO: 420677

SEQ ID NO: 566755 - RNA, 65 nt, Homo Sapiens; identical to SEQ ID NO: 420678

SEQ ID NO: 566756 - RNA, 65 nt, Homo Sapiens; identical to SEQ ID NO: 420679

SEQ ID NO: 566757 - RNA, 65 nt, Homo Sapiens; identical to SEQ ID NO: 420680

SEQ ID NO: 566758 - RNA, 65 nt, Homo Sapiens; identical to SEQ ID NO: 420681

SEQ ID NO: 566759 - RNA, 65 nt, Homo Sapiens; identical to SEQ ID NO: 420682

SEQ ID NO: 566760 - RNA, 65 nt, Homo Sapiens; identical to SEQ ID NO: 420683

SEQ ID NO: 566761 - RNA, 65 nt, Homo Sapiens; identical to SEQ ID NO: 420684

SEQ ID NO: 566762 - RNA, 65 nt, Homo Sapiens; identical to SEQ ID NO: 420685

SEQ ID NO: 566763 - RNA, 65 nt, Homo Sapiens; identical to SEQ ID NO: 420686

SEQ ID NO: 566764 - RNA, 65 nt, Homo Sapiens; identical to SEQ ID NO: 420687

SEQ ID NO: 566765 - RNA, 65 nt, Homo Sapiens; identical to SEQ ID NO: 420688

SEQ ID NO: 566766 - RNA, 65 nt, Homo Sapiens; identical to SEQ ID NO: 420689

SEQ ID NO: 566767 - RNA, 65 nt, Homo Sapiens; identical to SEQ ID NO: 420690

SEQ ID NO: 566768 - RNA, 65 nt, Homo Sapiens; identical to SEQ ID NO: 420691

SEQ ID NO: 566769 - RNA, 65 nt, Homo Sapiens; identical to SEQ ID NO: 420692

SEQ ID NO: 566770 - RNA, 65 nt, Homo Sapiens; identical to SEQ ID NO: 420693

SEQ ID NO: 566771 - RNA, 65 nt, Homo Sapiens; identical to SEQ ID NO: 420694

SEQ ID NO: 566772 - RNA, 65 nt, Homo Sapiens; identical to SEQ ID NO: 420695

SEQ ID NO: 566773 - RNA, 65 nt, Homo Sapiens; identical to SEQ ID NO: 420696

SEQ ID NO: 566774 - RNA, 65 nt, Homo Sapiens; identical to SEQ ID NO: 420697

SEQ ID NO: 566775 - RNA, 65 nt, Homo Sapiens; identical to SEQ ID NO: 420698

SEQ ID NO: 566776 - RNA, 65 nt, Homo Sapiens; identical to SEQ ID NO: 420699

SEQ ID NO: 566777 - RNA, 65 nt, Homo Sapiens; identical to SEQ ID NO: 420700

SEQ ID NO: 566778 - RNA, 65 nt, Homo Sapiens; identical to SEQ ID NO: 420701

SEQ ID NO: 566779 - RNA, 65 nt, Homo Sapiens; identical to SEQ ID NO: 420702

SEQ ID NO: 566780 - RNA, 65 nt, Homo Sapiens; identical to SEQ ID NO: 420703

SEQ ID NO: 566781 - RNA, 65 nt, Homo Sapiens; identical to SEQ ID NO: 420704

SEQ ID NO: 566782 - RNA, 65 nt, Homo Sapiens; identical to SEQ ID NO: 420705

SEQ ID NO: 566783 - RNA, 65 nt, Homo Sapiens; identical to SEQ ID NO: 420706

SEQ ID NO: 566784 - RNA, 65 nt, Homo Sapiens; identical to SEQ ID NO: 420707

SEQ ID NO: 566785 - RNA, 65 nt, Homo Sapiens; identical to SEQ ID NO: 420708

SEQ ID NO: 566786 - RNA, 65 nt, Homo Sapiens; identical to SEQ ID NO: 420709

SEQ ID NO: 566787 - RNA, 65 nt, Homo Sapiens; identical to SEQ ID NO: 420710

SEQ ID NO: 566788 - RNA, 65 nt, Homo Sapiens; identical to SEQ ID NO: 420711

SEQ ID NO: 566789 - RNA, 65 nt, Homo Sapiens; identical to SEQ ID NO: 420712

SEQ ID NO: 566790 - RNA, 65 nt, Homo Sapiens; identical to SEQ ID NO: 420713

SEQ ID NO: 566791 - RNA, 65 nt, Homo Sapiens; identical to SEQ ID NO: 420714

SEQ ID NO: 566792 - RNA, 65 nt, Homo Sapiens; identical to SEQ ID NO: 420715

SEQ ID NO: 566793 - RNA, 65 nt, Homo Sapiens; identical to SEQ ID NO: 420716

SEQ ID NO: 566794 - RNA, 65 nt, Homo Sapiens; identical to SEQ ID NO: 420717

SEQ ID NO: 566795 - RNA, 65 nt, Homo Sapiens; identical to SEQ ID NO: 420718

SEQ ID NO: 566796 - RNA, 65 nt, Homo Sapiens; identical to SEQ ID NO: 420719

SEQ ID NO: 566797 - RNA, 65 nt, Homo Sapiens; identical to SEQ ID NO: 420720

SEQ ID NO: 566798 - RNA, 65 nt, Homo Sapiens; identical to SEQ ID NO: 420721

SEQ ID NO: 566799 - RNA, 65 nt, Homo Sapiens; identical to SEQ ID NO: 420722

SEQ ID NO: 566800 - RNA, 65 nt, Homo Sapiens; identical to SEQ ID NO: 420723

SEQ ID NO: 566801 - RNA, 65 nt, Homo Sapiens; identical to SEQ ID NO: 420724

SEQ ID NO: 566802 - RNA, 65 nt, Homo Sapiens; identical to SEQ ID NO: 420725

SEQ ID NO: 566803 - RNA, 65 nt, Homo Sapiens; identical to SEQ ID NO: 420726

SEQ ID NO: 566804 - RNA, 65 nt, Homo Sapiens; identical to SEQ ID NO: 420727

SEQ ID NO: 566805 - RNA, 65 nt, Homo Sapiens; identical to SEQ ID NO: 420728

SEQ ID NO: 566806 - RNA, 65 nt, Homo Sapiens; identical to SEQ ID NO: 420729

SEQ ID NO: 566807 - RNA, 65 nt, Homo Sapiens; identical to SEQ ID NO: 420730

SEQ ID NO: 566808 - RNA, 65 nt, Homo Sapiens; identical to SEQ ID NO: 420731

SEQ ID NO: 566809 - RNA, 65 nt, Homo Sapiens; identical to SEQ ID NO: 420732

SEQ ID NO: 566810 - RNA, 65 nt, Homo Sapiens; identical to SEQ ID NO: 420733

SEQ ID NO: 566811 - RNA, 65 nt, Homo Sapiens; identical to SEQ ID NO: 420734

SEQ ID NO: 566812 - RNA, 65 nt, Homo Sapiens; identical to SEQ ID NO: 420735

SEQ ID NO: 566813 - RNA, 65 nt, Homo Sapiens; identical to SEQ ID NO: 420736

SEQ ID NO: 566814 - RNA, 65 nt, Homo Sapiens; identical to SEQ ID NO: 420737

SEQ ID NO: 566815 - RNA, 65 nt, Homo Sapiens; identical to SEQ ID NO: 420738

SEQ ID NO: 566816 - RNA, 65 nt, Homo Sapiens; identical to SEQ ID NO: 420739

SEQ ID NO: 566817 - RNA, 65 nt, Homo Sapiens; identical to SEQ ID NO: 420740

SEQ ID NO: 566818 - RNA, 65 nt, Homo Sapiens; identical to SEQ ID NO: 420741

SEQ ID NO: 566819 - RNA, 65 nt, Homo Sapiens; identical to SEQ ID NO: 420742

SEQ ID NO: 566820 - RNA, 65 nt, Homo Sapiens; identical to SEQ ID NO: 420743

SEQ ID NO: 566821 - RNA, 65 nt, Homo Sapiens; identical to SEQ ID NO: 420744

SEQ ID NO: 566822 - RNA, 65 nt, Homo Sapiens; identical to SEQ ID NO: 420745

SEQ ID NO: 566823 - RNA, 65 nt, Homo Sapiens; identical to SEQ ID NO: 420746

SEQ ID NO: 566824 - RNA, 65 nt, Homo Sapiens; identical to SEQ ID NO: 420747

SEQ ID NO: 566825 - RNA, 65 nt, Homo Sapiens; identical to SEQ ID NO: 420748

SEQ ID NO: 566826 - RNA, 65 nt, Homo Sapiens; identical to SEQ ID NO: 420749

SEQ ID NO: 566827 - RNA, 65 nt, Homo Sapiens; identical to SEQ ID NO: 420750

SEQ ID NO: 566828 - RNA, 65 nt, Homo Sapiens; identical to SEQ ID NO: 420751

SEQ ID NO: 566829 - RNA, 65 nt, Homo Sapiens; identical to SEQ ID NO: 420752

SEQ ID NO: 566830 - RNA, 65 nt, Homo Sapiens; identical to SEQ ID NO: 420753

SEQ ID NO: 566831 - RNA, 65 nt, Homo Sapiens; identical to SEQ ID NO: 420754

SEQ ID NO: 566832 - RNA, 65 nt, Homo Sapiens; identical to SEQ ID NO: 420755

SEQ ID NO: 566833 - RNA, 65 nt, Homo Sapiens; identical to SEQ ID NO: 420756

SEQ ID NO: 566834 - RNA, 65 nt, Homo Sapiens; identical to SEQ ID NO: 420757

SEQ ID NO: 566835 - RNA, 65 nt, Homo Sapiens; identical to SEQ ID NO: 420758

SEQ ID NO: 566836 - RNA, 65 nt, Homo Sapiens; identical to SEQ ID NO: 420759

SEQ ID NO: 566837 - RNA, 65 nt, Homo Sapiens; identical to SEQ ID NO: 420760

SEQ ID NO: 566838 - RNA, 64 nt, Homo Sapiens; identical to SEQ ID NO: 61733

SEQ ID NO: 566839 - RNA, 64 nt, Homo Sapiens; identical to SEQ ID NO: 61734

SEQ ID NO: 566840 - RNA, 64 nt, Homo Sapiens; identical to SEQ ID NO: 61735

SEQ ID NO: 566841 - RNA, 64 nt, Homo Sapiens; identical to SEQ ID NO: 61736

SEQ ID NO: 566842 - RNA, 64 nt, Homo Sapiens; identical to SEQ ID NO: 61737

SEQ ID NO: 566843 - RNA, 64 nt, Homo Sapiens; identical to SEQ ID NO: 61738

SEQ ID NO: 566844 - RNA, 64 nt, Homo Sapiens; identical to SEQ ID NO: 61739

SEQ ID NO: 566845 - RNA, 64 nt, Homo Sapiens; identical to SEQ ID NO: 61740

SEQ ID NO: 566846 - RNA, 64 nt, Homo Sapiens; identical to SEQ ID NO: 61741

SEQ ID NO: 566847 - RNA, 64 nt, Homo Sapiens; identical to SEQ ID NO: 61742

SEQ ID NO: 566848 - RNA, 64 nt, Homo Sapiens; identical to SEQ ID NO: 61743

SEQ ID NO: 566849 - RNA, 64 nt, Homo Sapiens; identical to SEQ ID NO: 61744

SEQ ID NO: 566850 - RNA, 64 nt, Homo Sapiens; identical to SEQ ID NO: 61745

SEQ ID NO: 566851 - RNA, 64 nt, Homo Sapiens; identical to SEQ ID NO: 61746

SEQ ID NO: 566852 - RNA, 64 nt, Homo Sapiens; identical to SEQ ID NO: 61747

SEQ ID NO: 566853 - RNA, 64 nt, Homo Sapiens; identical to SEQ ID NO: 61748

SEQ ID NO: 566854 - RNA, 64 nt, Homo Sapiens; identical to SEQ ID NO: 61749

SEQ ID NO: 566855 - RNA, 64 nt, Homo Sapiens; identical to SEQ ID NO: 61750

SEQ ID NO: 566856 - RNA, 64 nt, Homo Sapiens; identical to SEQ ID NO: 61751

SEQ ID NO: 566857 - RNA, 64 nt, Homo Sapiens; identical to SEQ ID NO: 61752

SEQ ID NO: 566858 - RNA, 64 nt, Homo Sapiens; identical to SEQ ID NO: 61753

SEQ ID NO: 566859 - RNA, 64 nt, Homo Sapiens; identical to SEQ ID NO: 61754

SEQ ID NO: 566860 - RNA, 64 nt, Homo Sapiens; identical to SEQ ID NO: 61755

SEQ ID NO: 566861 - RNA, 64 nt, Homo Sapiens; identical to SEQ ID NO: 61756

SEQ ID NO: 566862 - RNA, 64 nt, Homo Sapiens; identical to SEQ ID NO: 61757

SEQ ID NO: 566863 - RNA, 64 nt, Homo Sapiens; identical to SEQ ID NO: 61758

SEQ ID NO: 566864 - RNA, 64 nt, Homo Sapiens; identical to SEQ ID NO: 61759

SEQ ID NO: 566865 - RNA, 64 nt, Homo Sapiens; identical to SEQ ID NO: 61760

SEQ ID NO: 566866 - RNA, 64 nt, Homo Sapiens; identical to SEQ ID NO: 61761

SEQ ID NO: 566867 - RNA, 64 nt, Homo Sapiens; identical to SEQ ID NO: 61762

SEQ ID NO: 566868 - RNA, 64 nt, Homo Sapiens; identical to SEQ ID NO: 61763

SEQ ID NO: 566869 - RNA, 64 nt, Homo Sapiens; identical to SEQ ID NO: 61764

SEQ ID NO: 566870 - RNA, 64 nt, Homo Sapiens; identical to SEQ ID NO: 61765

SEQ ID NO: 566871 - RNA, 64 nt, Homo Sapiens; identical to SEQ ID NO: 61766

SEQ ID NO: 566872 - RNA, 64 nt, Homo Sapiens; identical to SEQ ID NO: 61767

SEQ ID NO: 566873 - RNA, 64 nt, Homo Sapiens; identical to SEQ ID NO: 61768

SEQ ID NO: 566874 - RNA, 64 nt, Homo Sapiens; identical to SEQ ID NO: 61769

SEQ ID NO: 566875 - RNA, 64 nt, Homo Sapiens; identical to SEQ ID NO: 61770

SEQ ID NO: 566876 - RNA, 64 nt, Homo Sapiens; identical to SEQ ID NO: 61771

SEQ ID NO: 566877 - RNA, 64 nt, Homo Sapiens; identical to SEQ ID NO: 61772

SEQ ID NO: 566878 - RNA, 64 nt, Homo Sapiens; identical to SEQ ID NO: 61773

SEQ ID NO: 566879 - RNA, 64 nt, Homo Sapiens; identical to SEQ ID NO: 61774

SEQ ID NO: 566880 - RNA, 64 nt, Homo Sapiens; identical to SEQ ID NO: 61775

SEQ ID NO: 566881 - RNA, 64 nt, Homo Sapiens; identical to SEQ ID NO: 61776

SEQ ID NO: 566882 - RNA, 64 nt, Homo Sapiens; identical to SEQ ID NO: 61777

SEQ ID NO: 566883 - RNA, 64 nt, Homo Sapiens; identical to SEQ ID NO: 61778

SEQ ID NO: 566884 - RNA, 64 nt, Homo Sapiens; identical to SEQ ID NO: 61779

SEQ ID NO: 566885 - RNA, 64 nt, Homo Sapiens; identical to SEQ ID NO: 61780

SEQ ID NO: 566886 - RNA, 64 nt, Homo Sapiens; identical to SEQ ID NO: 61781

SEQ ID NO: 566887 - RNA, 64 nt, Homo Sapiens; identical to SEQ ID NO: 61782

SEQ ID NO: 566888 - RNA, 64 nt, Homo Sapiens; identical to SEQ ID NO: 61783

SEQ ID NO: 566889 - RNA, 64 nt, Homo Sapiens; identical to SEQ ID NO: 61784

SEQ ID NO: 566890 - RNA, 64 nt, Homo Sapiens; identical to SEQ ID NO: 61785

SEQ ID NO: 566891 - RNA, 64 nt, Homo Sapiens; identical to SEQ ID NO: 61786

SEQ ID NO: 566892 - RNA, 64 nt, Homo Sapiens; identical to SEQ ID NO: 61787

SEQ ID NO: 566893 - RNA, 64 nt, Homo Sapiens; identical to SEQ ID NO: 61788

SEQ ID NO: 566894 - RNA, 64 nt, Homo Sapiens; identical to SEQ ID NO: 61789

SEQ ID NO: 566895 - RNA, 64 nt, Homo Sapiens; identical to SEQ ID NO: 61790

SEQ ID NO: 566896 - RNA, 64 nt, Homo Sapiens; identical to SEQ ID NO: 61791

SEQ ID NO: 566897 - RNA, 64 nt, Homo Sapiens; identical to SEQ ID NO: 61792

SEQ ID NO: 566898 - RNA, 64 nt, Homo Sapiens; identical to SEQ ID NO: 61793

SEQ ID NO: 566899 - RNA, 64 nt, Homo Sapiens; identical to SEQ ID NO: 61794

SEQ ID NO: 566900 - RNA, 64 nt, Homo Sapiens; identical to SEQ ID NO: 61795

SEQ ID NO: 566901 - RNA, 64 nt, Homo Sapiens; identical to SEQ ID NO: 61796

SEQ ID NO: 566902 - RNA, 64 nt, Homo Sapiens; identical to SEQ ID NO: 61797

SEQ ID NO: 566903 - RNA, 64 nt, Homo Sapiens; identical to SEQ ID NO: 61798

SEQ ID NO: 566904 - RNA, 64 nt, Homo Sapiens; identical to SEQ ID NO: 61799

SEQ ID NO: 566905 - RNA, 64 nt, Homo Sapiens; identical to SEQ ID NO: 61800

SEQ ID NO: 566906 - RNA, 64 nt, Homo Sapiens; identical to SEQ ID NO: 61801

SEQ ID NO: 566907 - RNA, 64 nt, Homo Sapiens; identical to SEQ ID NO: 61802

SEQ ID NO: 566908 - RNA, 64 nt, Homo Sapiens; identical to SEQ ID NO: 61803

SEQ ID NO: 566909 - RNA, 64 nt, Homo Sapiens; identical to SEQ ID NO: 61804

SEQ ID NO: 566910 - RNA, 64 nt, Homo Sapiens; identical to SEQ ID NO: 61805

SEQ ID NO: 566911 - RNA, 64 nt, Homo Sapiens; identical to SEQ ID NO: 61806

SEQ ID NO: 566912 - RNA, 64 nt, Homo Sapiens; identical to SEQ ID NO: 61807

SEQ ID NO: 566913 - RNA, 64 nt, Homo Sapiens; identical to SEQ ID NO: 61808

SEQ ID NO: 566914 - RNA, 64 nt, Homo Sapiens; identical to SEQ ID NO: 61809

SEQ ID NO: 566915 - RNA, 64 nt, Homo Sapiens; identical to SEQ ID NO: 61810

SEQ ID NO: 566916 - RNA, 64 nt, Homo Sapiens; identical to SEQ ID NO: 61811

SEQ ID NO: 566917 - RNA, 64 nt, Homo Sapiens; identical to SEQ ID NO: 61812

SEQ ID NO: 566918 - RNA, 52 nt, Homo Sapiens; identical to SEQ ID NO: 61813

SEQ ID NO: 566919 - RNA, 64 nt, Homo Sapiens; identical to SEQ ID NO: 61814

SEQ ID NO: 566920 - RNA, 64 nt, Homo Sapiens; identical to SEQ ID NO: 61815

SEQ ID NO: 566921 - RNA, 64 nt, Homo Sapiens; identical to SEQ ID NO: 61816

SEQ ID NO: 566922 - RNA, 64 nt, Homo Sapiens; identical to SEQ ID NO: 61817

SEQ ID NO: 566923 - RNA, 64 nt, Homo Sapiens; identical to SEQ ID NO: 61818

SEQ ID NO: 566924 - RNA, 64 nt, Homo Sapiens; identical to SEQ ID NO: 61819

SEQ ID NO: 566925 - RNA, 64 nt, Homo Sapiens; identical to SEQ ID NO: 61820

SEQ ID NO: 566926 - RNA, 64 nt, Homo Sapiens; identical to SEQ ID NO: 61821

SEQ ID NO: 566927 - RNA, 64 nt, Homo Sapiens; identical to SEQ ID NO: 61822

SEQ ID NO: 566928 - RNA, 64 nt, Homo Sapiens; identical to SEQ ID NO: 61823

SEQ ID NO: 566929 - RNA, 64 nt, Homo Sapiens; identical to SEQ ID NO: 61824

SEQ ID NO: 566930 - RNA, 64 nt, Homo Sapiens; identical to SEQ ID NO: 61825

SEQ ID NO: 566931 - RNA, 64 nt, Homo Sapiens; identical to SEQ ID NO: 61826

SEQ ID NO: 566932 - RNA, 64 nt, Homo Sapiens; identical to SEQ ID NO: 61827

SEQ ID NO: 566933 - RNA, 64 nt, Homo Sapiens; identical to SEQ ID NO: 61828

SEQ ID NO: 566934 - RNA, 64 nt, Homo Sapiens; identical to SEQ ID NO: 61829

SEQ ID NO: 566935 - RNA, 64 nt, Homo Sapiens; identical to SEQ ID NO: 61830

SEQ ID NO: 566936 - RNA, 64 nt, Homo Sapiens; identical to SEQ ID NO: 61831

SEQ ID NO: 566937 - RNA, 64 nt, Homo Sapiens; identical to SEQ ID NO: 61832

SEQ ID NO: 566938 - RNA, 64 nt, Homo Sapiens; identical to SEQ ID NO: 61833

SEQ ID NO: 566939 - RNA, 64 nt, Homo Sapiens; identical to SEQ ID NO: 61834

SEQ ID NO: 566940 - RNA, 64 nt, Homo Sapiens; identical to SEQ ID NO: 61835

SEQ ID NO: 566941 - RNA, 64 nt, Homo Sapiens; identical to SEQ ID NO: 61836

SEQ ID NO: 566942 - RNA, 64 nt, Homo Sapiens; identical to SEQ ID NO: 61837

SEQ ID NO: 566943 - RNA, 64 nt, Homo Sapiens; identical to SEQ ID NO: 61838

SEQ ID NO: 566944 - RNA, 64 nt, Homo Sapiens; identical to SEQ ID NO: 61839

SEQ ID NO: 566945 - RNA, 64 nt, Homo Sapiens; identical to SEQ ID NO: 61840

SEQ ID NO: 566946 - RNA, 64 nt, Homo Sapiens; identical to SEQ ID NO: 61841

SEQ ID NO: 566947 - RNA, 64 nt, Homo Sapiens; identical to SEQ ID NO: 61842

SEQ ID NO: 566948 - RNA, 64 nt, Homo Sapiens; identical to SEQ ID NO: 61843

SEQ ID NO: 566949 - RNA, 64 nt, Homo Sapiens; identical to SEQ ID NO: 61844

SEQ ID NO: 566950 - RNA, 64 nt, Homo Sapiens; identical to SEQ ID NO: 61845

SEQ ID NO: 566951 - RNA, 64 nt, Homo Sapiens; identical to SEQ ID NO: 61846

SEQ ID NO: 566952 - RNA, 64 nt, Homo Sapiens; identical to SEQ ID NO: 61847

SEQ ID NO: 566953 - RNA, 64 nt, Homo Sapiens; identical to SEQ ID NO: 61848

SEQ ID NO: 566954 - RNA, 64 nt, Homo Sapiens; identical to SEQ ID NO: 61849

SEQ ID NO: 566955 - RNA, 64 nt, Homo Sapiens; identical to SEQ ID NO: 61850

SEQ ID NO: 566956 - RNA, 64 nt, Homo Sapiens; identical to SEQ ID NO: 61851

SEQ ID NO: 566957 - RNA, 64 nt, Homo Sapiens; identical to SEQ ID NO: 61852

SEQ ID NO: 566958 - RNA, 64 nt, Homo Sapiens; identical to SEQ ID NO: 61853

SEQ ID NO: 566959 - RNA, 64 nt, Homo Sapiens; identical to SEQ ID NO: 61854

SEQ ID NO: 566960 - RNA, 64 nt, Homo Sapiens; identical to SEQ ID NO: 61855

SEQ ID NO: 566961 - RNA, 64 nt, Homo Sapiens; identical to SEQ ID NO: 61856

SEQ ID NO: 566962 - RNA, 64 nt, Homo Sapiens; identical to SEQ ID NO: 61857

SEQ ID NO: 566963 - RNA, 64 nt, Homo Sapiens; identical to SEQ ID NO: 61858

SEQ ID NO: 566964 - RNA, 64 nt, Homo Sapiens; identical to SEQ ID NO: 61859

SEQ ID NO: 566965 - RNA, 64 nt, Homo Sapiens; identical to SEQ ID NO: 61860

SEQ ID NO: 566966 - RNA, 64 nt, Homo Sapiens; identical to SEQ ID NO: 61861

SEQ ID NO: 566967 - RNA, 64 nt, Homo Sapiens; identical to SEQ ID NO: 61862

SEQ ID NO: 566968 - RNA, 64 nt, Homo Sapiens; identical to SEQ ID NO: 61863

SEQ ID NO: 566969 - RNA, 64 nt, Homo Sapiens; identical to SEQ ID NO: 61864

SEQ ID NO: 566970 - RNA, 64 nt, Homo Sapiens; identical to SEQ ID NO: 61865

SEQ ID NO: 566971 - RNA, 64 nt, Homo Sapiens; identical to SEQ ID NO: 61866

SEQ ID NO: 566972 - RNA, 64 nt, Homo Sapiens; identical to SEQ ID NO: 61867

SEQ ID NO: 566973 - RNA, 64 nt, Homo Sapiens; identical to SEQ ID NO: 61868

SEQ ID NO: 566974 - RNA, 64 nt, Homo Sapiens; identical to SEQ ID NO: 61869

SEQ ID NO: 566975 - RNA, 64 nt, Homo Sapiens; identical to SEQ ID NO: 61870

SEQ ID NO: 566976 - RNA, 64 nt, Homo Sapiens; identical to SEQ ID NO: 61871

SEQ ID NO: 566977 - RNA, 64 nt, Homo Sapiens; identical to SEQ ID NO: 61872

SEQ ID NO: 566978 - RNA, 64 nt, Homo Sapiens; identical to SEQ ID NO: 61873

SEQ ID NO: 566979 - RNA, 64 nt, Homo Sapiens; identical to SEQ ID NO: 61874

SEQ ID NO: 566980 - RNA, 64 nt, Homo Sapiens; identical to SEQ ID NO: 61875

SEQ ID NO: 566981 - RNA, 64 nt, Homo Sapiens; identical to SEQ ID NO: 61876

SEQ ID NO: 566982 - RNA, 64 nt, Homo Sapiens; identical to SEQ ID NO: 61877

SEQ ID NO: 566983 - RNA, 64 nt, Homo Sapiens; identical to SEQ ID NO: 61878

SEQ ID NO: 566984 - RNA, 64 nt, Homo Sapiens; identical to SEQ ID NO: 61879

SEQ ID NO: 566985 - RNA, 64 nt, Homo Sapiens; identical to SEQ ID NO: 61880

SEQ ID NO: 566986 - RNA, 64 nt, Homo Sapiens; identical to SEQ ID NO: 61881

SEQ ID NO: 566987 - RNA, 64 nt, Homo Sapiens; identical to SEQ ID NO: 61882

SEQ ID NO: 566988 - RNA, 64 nt, Homo Sapiens; identical to SEQ ID NO: 61883

SEQ ID NO: 566989 - RNA, 64 nt, Homo Sapiens; identical to SEQ ID NO: 61884

SEQ ID NO: 566990 - RNA, 64 nt, Homo Sapiens; identical to SEQ ID NO: 61885

SEQ ID NO: 566991 - RNA, 64 nt, Homo Sapiens; identical to SEQ ID NO: 61886

SEQ ID NO: 566992 - RNA, 64 nt, Homo Sapiens; identical to SEQ ID NO: 61887

SEQ ID NO: 566993 - RNA, 64 nt, Homo Sapiens; identical to SEQ ID NO: 61888

SEQ ID NO: 566994 - RNA, 64 nt, Homo Sapiens; identical to SEQ ID NO: 61889

SEQ ID NO: 566995 - RNA, 64 nt, Homo Sapiens; identical to SEQ ID NO: 61890

SEQ ID NO: 566996 - RNA, 64 nt, Homo Sapiens; identical to SEQ ID NO: 61891

SEQ ID NO: 566997 - RNA, 64 nt, Homo Sapiens; identical to SEQ ID NO: 61892

SEQ ID NO: 566998 - RNA, 64 nt, Homo Sapiens; identical to SEQ ID NO: 61893

SEQ ID NO: 566999 - RNA, 64 nt, Homo Sapiens; identical to SEQ ID NO: 61894

SEQ ID NO: 567000 - RNA, 64 nt, Homo Sapiens; identical to SEQ ID NO: 61895

SEQ ID NO: 567001 - RNA, 64 nt, Homo Sapiens; identical to SEQ ID NO: 61896

SEQ ID NO: 567002 - RNA, 64 nt, Homo Sapiens; identical to SEQ ID NO: 61897

SEQ ID NO: 567003 - RNA, 64 nt, Homo Sapiens; identical to SEQ ID NO: 61898

SEQ ID NO: 567004 - RNA, 64 nt, Homo Sapiens; identical to SEQ ID NO: 61899

SEQ ID NO: 567005 - RNA, 64 nt, Homo Sapiens; identical to SEQ ID NO: 61900

SEQ ID NO: 567006 - RNA, 64 nt, Homo Sapiens; identical to SEQ ID NO: 61901

SEQ ID NO: 567007 - RNA, 64 nt, Homo Sapiens; identical to SEQ ID NO: 61902

SEQ ID NO: 567008 - RNA, 64 nt, Homo Sapiens; identical to SEQ ID NO: 61903

SEQ ID NO: 567009 - RNA, 64 nt, Homo Sapiens; identical to SEQ ID NO: 61904

SEQ ID NO: 567010 - RNA, 64 nt, Homo Sapiens; identical to SEQ ID NO: 61905

SEQ ID NO: 567011 - RNA, 64 nt, Homo Sapiens; identical to SEQ ID NO: 61906

SEQ ID NO: 567012 - RNA, 64 nt, Homo Sapiens; identical to SEQ ID NO: 61907

SEQ ID NO: 567013 - RNA, 64 nt, Homo Sapiens; identical to SEQ ID NO: 61908

SEQ ID NO: 567014 - RNA, 64 nt, Homo Sapiens; identical to SEQ ID NO: 61909

SEQ ID NO: 567015 - RNA, 64 nt, Homo Sapiens; identical to SEQ ID NO: 61910

SEQ ID NO: 567016 - RNA, 64 nt, Homo Sapiens; identical to SEQ ID NO: 61911

SEQ ID NO: 567017 - RNA, 64 nt, Homo Sapiens; identical to SEQ ID NO: 61912

SEQ ID NO: 567018 - RNA, 64 nt, Homo Sapiens; identical to SEQ ID NO: 61913

SEQ ID NO: 567019 - RNA, 64 nt, Homo Sapiens; identical to SEQ ID NO: 61914

SEQ ID NO: 567020 - RNA, 64 nt, Homo Sapiens; identical to SEQ ID NO: 61915

SEQ ID NO: 567021 - RNA, 64 nt, Homo Sapiens; identical to SEQ ID NO: 61916

SEQ ID NO: 567022 - RNA, 64 nt, Homo Sapiens; identical to SEQ ID NO: 61917

SEQ ID NO: 567023 - RNA, 64 nt, Homo Sapiens; identical to SEQ ID NO: 61918

SEQ ID NO: 567024 - RNA, 64 nt, Homo Sapiens; identical to SEQ ID NO: 61919

SEQ ID NO: 567025 - RNA, 64 nt, Homo Sapiens; identical to SEQ ID NO: 61920

SEQ ID NO: 567026 - RNA, 64 nt, Homo Sapiens; identical to SEQ ID NO: 61921

SEQ ID NO: 567027 - RNA, 64 nt, Homo Sapiens; identical to SEQ ID NO: 61922

SEQ ID NO: 567028 - RNA, 64 nt, Homo Sapiens; identical to SEQ ID NO: 61923

SEQ ID NO: 567029 - RNA, 64 nt, Homo Sapiens; identical to SEQ ID NO: 61924

SEQ ID NO: 567030 - RNA, 64 nt, Homo Sapiens; identical to SEQ ID NO: 61925

SEQ ID NO: 567031 - RNA, 64 nt, Homo Sapiens; identical to SEQ ID NO: 61926

SEQ ID NO: 567032 - RNA, 64 nt, Homo Sapiens; identical to SEQ ID NO: 61927

SEQ ID NO: 567033 - RNA, 64 nt, Homo Sapiens; identical to SEQ ID NO: 61928

SEQ ID NO: 567034 - RNA, 64 nt, Homo Sapiens; identical to SEQ ID NO: 61929

SEQ ID NO: 567035 - RNA, 64 nt, Homo Sapiens; identical to SEQ ID NO: 61930

SEQ ID NO: 567036 - RNA, 64 nt, Homo Sapiens; identical to SEQ ID NO: 61931

SEQ ID NO: 567037 - RNA, 64 nt, Homo Sapiens; identical to SEQ ID NO: 61932

SEQ ID NO: 567038 - RNA, 64 nt, Homo Sapiens; identical to SEQ ID NO: 61933

SEQ ID NO: 567039 - RNA, 64 nt, Homo Sapiens; identical to SEQ ID NO: 61934

SEQ ID NO: 567040 - RNA, 64 nt, Homo Sapiens; identical to SEQ ID NO: 61935

SEQ ID NO: 567041 - RNA, 64 nt, Homo Sapiens; identical to SEQ ID NO: 61936

SEQ ID NO: 567042 - RNA, 64 nt, Homo Sapiens; identical to SEQ ID NO: 61937

SEQ ID NO: 567043 - RNA, 64 nt, Homo Sapiens; identical to SEQ ID NO: 61938

SEQ ID NO: 567044 - RNA, 64 nt, Homo Sapiens; identical to SEQ ID NO: 61939

SEQ ID NO: 567045 - RNA, 64 nt, Homo Sapiens; identical to SEQ ID NO: 61940

SEQ ID NO: 567046 - RNA, 64 nt, Homo Sapiens; identical to SEQ ID NO: 61941

SEQ ID NO: 567047 - RNA, 64 nt, Homo Sapiens; identical to SEQ ID NO: 61942

SEQ ID NO: 567048 - RNA, 64 nt, Homo Sapiens; identical to SEQ ID NO: 61943

SEQ ID NO: 567049 - RNA, 64 nt, Homo Sapiens; identical to SEQ ID NO: 61944

SEQ ID NO: 567050 - RNA, 64 nt, Homo Sapiens; identical to SEQ ID NO: 61945

SEQ ID NO: 567051 - RNA, 64 nt, Homo Sapiens; identical to SEQ ID NO: 61946

SEQ ID NO: 567052 - RNA, 64 nt, Homo Sapiens; identical to SEQ ID NO: 61947

SEQ ID NO: 567053 - RNA, 64 nt, Homo Sapiens; identical to SEQ ID NO: 61948

SEQ ID NO: 567054 - RNA, 64 nt, Homo Sapiens; identical to SEQ ID NO: 61949

SEQ ID NO: 567055 - RNA, 64 nt, Homo Sapiens; identical to SEQ ID NO: 61950

SEQ ID NO: 567056 - RNA, 64 nt, Homo Sapiens; identical to SEQ ID NO: 61951

SEQ ID NO: 567057 - RNA, 64 nt, Homo Sapiens; identical to SEQ ID NO: 61952

SEQ ID NO: 567058 - RNA, 64 nt, Homo Sapiens; identical to SEQ ID NO: 61953

SEQ ID NO: 567059 - RNA, 64 nt, Homo Sapiens; identical to SEQ ID NO: 61954

SEQ ID NO: 567060 - RNA, 64 nt, Homo Sapiens; identical to SEQ ID NO: 61955

SEQ ID NO: 567061 - RNA, 64 nt, Homo Sapiens; identical to SEQ ID NO: 61956

SEQ ID NO: 567062 - RNA, 64 nt, Homo Sapiens; identical to SEQ ID NO: 61957

SEQ ID NO: 567063 - RNA, 64 nt, Homo Sapiens; identical to SEQ ID NO: 61958

SEQ ID NO: 567064 - RNA, 64 nt, Homo Sapiens; identical to SEQ ID NO: 61959

SEQ ID NO: 567065 - RNA, 64 nt, Homo Sapiens; identical to SEQ ID NO: 61960

SEQ ID NO: 567066 - RNA, 64 nt, Homo Sapiens; identical to SEQ ID NO: 61961

SEQ ID NO: 567067 - RNA, 64 nt, Homo Sapiens; identical to SEQ ID NO: 61962

SEQ ID NO: 567068 - RNA, 64 nt, Homo Sapiens; identical to SEQ ID NO: 61963

SEQ ID NO: 567069 - RNA, 64 nt, Homo Sapiens; identical to SEQ ID NO: 61964

SEQ ID NO: 567070 - RNA, 64 nt, Homo Sapiens; identical to SEQ ID NO: 61965

SEQ ID NO: 567071 - RNA, 64 nt, Homo Sapiens; identical to SEQ ID NO: 61966

SEQ ID NO: 567072 - RNA, 64 nt, Homo Sapiens; identical to SEQ ID NO: 61967

SEQ ID NO: 567073 - RNA, 64 nt, Homo Sapiens; identical to SEQ ID NO: 61968

SEQ ID NO: 567074 - RNA, 64 nt, Homo Sapiens; identical to SEQ ID NO: 61969

SEQ ID NO: 567075 - RNA, 64 nt, Homo Sapiens; identical to SEQ ID NO: 61970

SEQ ID NO: 567076 - RNA, 64 nt, Homo Sapiens; identical to SEQ ID NO: 61971

SEQ ID NO: 567077 - RNA, 64 nt, Homo Sapiens; identical to SEQ ID NO: 61972

SEQ ID NO: 567078 - RNA, 64 nt, Homo Sapiens; identical to SEQ ID NO: 61973

SEQ ID NO: 567079 - RNA, 64 nt, Homo Sapiens; identical to SEQ ID NO: 61974

SEQ ID NO: 567080 - RNA, 64 nt, Homo Sapiens; identical to SEQ ID NO: 61975

SEQ ID NO: 567081 - RNA, 64 nt, Homo Sapiens; identical to SEQ ID NO: 61976

SEQ ID NO: 567082 - RNA, 64 nt, Homo Sapiens; identical to SEQ ID NO: 61977

SEQ ID NO: 567083 - RNA, 64 nt, Homo Sapiens; identical to SEQ ID NO: 61978

SEQ ID NO: 567084 - RNA, 64 nt, Homo Sapiens; identical to SEQ ID NO: 61979

SEQ ID NO: 567085 - RNA, 64 nt, Homo Sapiens; identical to SEQ ID NO: 61980

SEQ ID NO: 567086 - RNA, 64 nt, Homo Sapiens; identical to SEQ ID NO: 61981

SEQ ID NO: 567087 - RNA, 64 nt, Homo Sapiens; identical to SEQ ID NO: 61982

SEQ ID NO: 567088 - RNA, 64 nt, Homo Sapiens; identical to SEQ ID NO: 61983

SEQ ID NO: 567089 - RNA, 64 nt, Homo Sapiens; identical to SEQ ID NO: 61984

SEQ ID NO: 567090 - RNA, 64 nt, Homo Sapiens; identical to SEQ ID NO: 61985

SEQ ID NO: 567091 - RNA, 64 nt, Homo Sapiens; identical to SEQ ID NO: 61986

SEQ ID NO: 567092 - RNA, 64 nt, Homo Sapiens; identical to SEQ ID NO: 61987

SEQ ID NO: 567093 - RNA, 64 nt, Homo Sapiens; identical to SEQ ID NO: 61988

SEQ ID NO: 567094 - RNA, 64 nt, Homo Sapiens; identical to SEQ ID NO: 61989

SEQ ID NO: 567095 - RNA, 64 nt, Homo Sapiens; identical to SEQ ID NO: 61990

SEQ ID NO: 567096 - RNA, 64 nt, Homo Sapiens; identical to SEQ ID NO: 61991

SEQ ID NO: 567097 - RNA, 64 nt, Homo Sapiens; identical to SEQ ID NO: 61992

SEQ ID NO: 567098 - RNA, 64 nt, Homo Sapiens; identical to SEQ ID NO: 61993

SEQ ID NO: 567099 - RNA, 64 nt, Homo Sapiens; identical to SEQ ID NO: 61994

SEQ ID NO: 567100 - RNA, 64 nt, Homo Sapiens; identical to SEQ ID NO: 61995

SEQ ID NO: 567101 - RNA, 64 nt, Homo Sapiens; identical to SEQ ID NO: 61996

SEQ ID NO: 567102 - RNA, 64 nt, Homo Sapiens; identical to SEQ ID NO: 61997

SEQ ID NO: 567103 - RNA, 64 nt, Homo Sapiens; identical to SEQ ID NO: 61998

SEQ ID NO: 567104 - RNA, 64 nt, Homo Sapiens; identical to SEQ ID NO: 61999

SEQ ID NO: 567105 - RNA, 64 nt, Homo Sapiens; identical to SEQ ID NO: 62000

SEQ ID NO: 567106 - RNA, 64 nt, Homo Sapiens; identical to SEQ ID NO: 62001

SEQ ID NO: 567107 - RNA, 64 nt, Homo Sapiens; identical to SEQ ID NO: 62002

SEQ ID NO: 567108 - RNA, 64 nt, Homo Sapiens; identical to SEQ ID NO: 62003

SEQ ID NO: 567109 - RNA, 64 nt, Homo Sapiens; identical to SEQ ID NO: 62004

SEQ ID NO: 567110 - RNA, 64 nt, Homo Sapiens; identical to SEQ ID NO: 62005

SEQ ID NO: 567111 - RNA, 64 nt, Homo Sapiens; identical to SEQ ID NO: 62006

SEQ ID NO: 567112 - RNA, 64 nt, Homo Sapiens; identical to SEQ ID NO: 62007

SEQ ID NO: 567113 - RNA, 64 nt, Homo Sapiens; identical to SEQ ID NO: 62008

SEQ ID NO: 567114 - RNA, 64 nt, Homo Sapiens; identical to SEQ ID NO: 62009

SEQ ID NO: 567115 - RNA, 64 nt, Homo Sapiens; identical to SEQ ID NO: 62010

SEQ ID NO: 567116 - RNA, 64 nt, Homo Sapiens; identical to SEQ ID NO: 62011

SEQ ID NO: 567117 - RNA, 64 nt, Homo Sapiens; identical to SEQ ID NO: 62012

SEQ ID NO: 567118 - RNA, 64 nt, Homo Sapiens; identical to SEQ ID NO: 62013

SEQ ID NO: 567119 - RNA, 64 nt, Homo Sapiens; identical to SEQ ID NO: 62014

SEQ ID NO: 567120 - RNA, 64 nt, Homo Sapiens; identical to SEQ ID NO: 62015

SEQ ID NO: 567121 - RNA, 64 nt, Homo Sapiens; identical to SEQ ID NO: 62016

SEQ ID NO: 567122 - RNA, 64 nt, Homo Sapiens; identical to SEQ ID NO: 62017

SEQ ID NO: 567123 - RNA, 64 nt, Homo Sapiens; identical to SEQ ID NO: 62018

SEQ ID NO: 567124 - RNA, 64 nt, Homo Sapiens; identical to SEQ ID NO: 62019

SEQ ID NO: 567125 - RNA, 64 nt, Homo Sapiens; identical to SEQ ID NO: 62020

SEQ ID NO: 567126 - RNA, 64 nt, Homo Sapiens; identical to SEQ ID NO: 62021

SEQ ID NO: 567127 - RNA, 64 nt, Homo Sapiens; identical to SEQ ID NO: 62022

SEQ ID NO: 567128 - RNA, 64 nt, Homo Sapiens; identical to SEQ ID NO: 62023

SEQ ID NO: 567129 - RNA, 64 nt, Homo Sapiens; identical to SEQ ID NO: 62024

SEQ ID NO: 567130 - RNA, 64 nt, Homo Sapiens; identical to SEQ ID NO: 62025

SEQ ID NO: 567131 - RNA, 64 nt, Homo Sapiens; identical to SEQ ID NO: 62026

SEQ ID NO: 567132 - RNA, 64 nt, Homo Sapiens; identical to SEQ ID NO: 62027

SEQ ID NO: 567133 - RNA, 64 nt, Homo Sapiens; identical to SEQ ID NO: 62028

SEQ ID NO: 567134 - RNA, 64 nt, Homo Sapiens; identical to SEQ ID NO: 62029

SEQ ID NO: 567135 - RNA, 64 nt, Homo Sapiens; identical to SEQ ID NO: 62030

SEQ ID NO: 567136 - RNA, 64 nt, Homo Sapiens; identical to SEQ ID NO: 62031

SEQ ID NO: 567137 - RNA, 64 nt, Homo Sapiens; identical to SEQ ID NO: 62032

SEQ ID NO: 567138 - RNA, 64 nt, Homo Sapiens; identical to SEQ ID NO: 62033

SEQ ID NO: 567139 - RNA, 64 nt, Homo Sapiens; identical to SEQ ID NO: 62034

SEQ ID NO: 567140 - RNA, 64 nt, Homo Sapiens; identical to SEQ ID NO: 62035

SEQ ID NO: 567141 - RNA, 64 nt, Homo Sapiens; identical to SEQ ID NO: 62036

SEQ ID NO: 567142 - RNA, 64 nt, Homo Sapiens; identical to SEQ ID NO: 62037

SEQ ID NO: 567143 - RNA, 64 nt, Homo Sapiens; identical to SEQ ID NO: 62038

SEQ ID NO: 567144 - RNA, 64 nt, Homo Sapiens; identical to SEQ ID NO: 62039

SEQ ID NO: 567145 - RNA, 64 nt, Homo Sapiens; identical to SEQ ID NO: 62040

SEQ ID NO: 567146 - RNA, 64 nt, Homo Sapiens; identical to SEQ ID NO: 62041

SEQ ID NO: 567147 - RNA, 64 nt, Homo Sapiens; identical to SEQ ID NO: 62042

SEQ ID NO: 567148 - RNA, 64 nt, Homo Sapiens; identical to SEQ ID NO: 62043

SEQ ID NO: 567149 - RNA, 64 nt, Homo Sapiens; identical to SEQ ID NO: 62044

SEQ ID NO: 567150 - RNA, 64 nt, Homo Sapiens; identical to SEQ ID NO: 62045

SEQ ID NO: 567151 - RNA, 64 nt, Homo Sapiens; identical to SEQ ID NO: 62046

SEQ ID NO: 567152 - RNA, 64 nt, Homo Sapiens; identical to SEQ ID NO: 62047

SEQ ID NO: 567153 - RNA, 64 nt, Homo Sapiens; identical to SEQ ID NO: 62048

SEQ ID NO: 567154 - RNA, 64 nt, Homo Sapiens; identical to SEQ ID NO: 62049

SEQ ID NO: 567155 - RNA, 64 nt, Homo Sapiens; identical to SEQ ID NO: 62050

SEQ ID NO: 567156 - RNA, 64 nt, Homo Sapiens; identical to SEQ ID NO: 62051

SEQ ID NO: 567157 - RNA, 64 nt, Homo Sapiens; identical to SEQ ID NO: 62052

SEQ ID NO: 567158 - RNA, 57 nt, Homo Sapiens; identical to SEQ ID NO: 62053

SEQ ID NO: 567159 - RNA, 64 nt, Homo Sapiens; identical to SEQ ID NO: 62054

SEQ ID NO: 567160 - RNA, 64 nt, Homo Sapiens; identical to SEQ ID NO: 62055

SEQ ID NO: 567161 - RNA, 64 nt, Homo Sapiens; identical to SEQ ID NO: 62056

SEQ ID NO: 567162 - RNA, 64 nt, Homo Sapiens; identical to SEQ ID NO: 62057

SEQ ID NO: 567163 - RNA, 64 nt, Homo Sapiens; identical to SEQ ID NO: 62058

SEQ ID NO: 567164 - RNA, 64 nt, Homo Sapiens; identical to SEQ ID NO: 62059

SEQ ID NO: 567165 - RNA, 64 nt, Homo Sapiens; identical to SEQ ID NO: 62060

SEQ ID NO: 567166 - RNA, 64 nt, Homo Sapiens; identical to SEQ ID NO: 62061

SEQ ID NO: 567167 - RNA, 64 nt, Homo Sapiens; identical to SEQ ID NO: 62062

SEQ ID NO: 567168 - RNA, 64 nt, Homo Sapiens; identical to SEQ ID NO: 62063

SEQ ID NO: 567169 - RNA, 64 nt, Homo Sapiens; identical to SEQ ID NO: 62064

SEQ ID NO: 567170 - RNA, 64 nt, Homo Sapiens; identical to SEQ ID NO: 62065

SEQ ID NO: 567171 - RNA, 64 nt, Homo Sapiens; identical to SEQ ID NO: 62066

SEQ ID NO: 567172 - RNA, 64 nt, Homo Sapiens; identical to SEQ ID NO: 62067

SEQ ID NO: 567173 - RNA, 64 nt, Homo Sapiens; identical to SEQ ID NO: 62068

SEQ ID NO: 567174 - RNA, 64 nt, Homo Sapiens; identical to SEQ ID NO: 62069

SEQ ID NO: 567175 - RNA, 64 nt, Homo Sapiens; identical to SEQ ID NO: 62070

SEQ ID NO: 567176 - RNA, 64 nt, Homo Sapiens; identical to SEQ ID NO: 62071

SEQ ID NO: 567177 - RNA, 64 nt, Homo Sapiens; identical to SEQ ID NO: 62072

SEQ ID NO: 567178 - RNA, 64 nt, Homo Sapiens; identical to SEQ ID NO: 62073

SEQ ID NO: 567179 - RNA, 64 nt, Homo Sapiens; identical to SEQ ID NO: 62074

SEQ ID NO: 567180 - RNA, 64 nt, Homo Sapiens; identical to SEQ ID NO: 62075

SEQ ID NO: 567181 - RNA, 64 nt, Homo Sapiens; identical to SEQ ID NO: 62076

SEQ ID NO: 567182 - RNA, 64 nt, Homo Sapiens; identical to SEQ ID NO: 62077

SEQ ID NO: 567183 - RNA, 64 nt, Homo Sapiens; identical to SEQ ID NO: 62078

SEQ ID NO: 567184 - RNA, 64 nt, Homo Sapiens; identical to SEQ ID NO: 62079

SEQ ID NO: 567185 - RNA, 64 nt, Homo Sapiens; identical to SEQ ID NO: 62080

SEQ ID NO: 567186 - RNA, 64 nt, Homo Sapiens; identical to SEQ ID NO: 62081

SEQ ID NO: 567187 - RNA, 64 nt, Homo Sapiens; identical to SEQ ID NO: 62082

SEQ ID NO: 567188 - RNA, 64 nt, Homo Sapiens; identical to SEQ ID NO: 62083

SEQ ID NO: 567189 - RNA, 64 nt, Homo Sapiens; identical to SEQ ID NO: 62084

SEQ ID NO: 567190 - RNA, 64 nt, Homo Sapiens; identical to SEQ ID NO: 62085

SEQ ID NO: 567191 - RNA, 64 nt, Homo Sapiens; identical to SEQ ID NO: 62086

SEQ ID NO: 567192 - RNA, 64 nt, Homo Sapiens; identical to SEQ ID NO: 62087

SEQ ID NO: 567193 - RNA, 64 nt, Homo Sapiens; identical to SEQ ID NO: 62088

SEQ ID NO: 567194 - RNA, 64 nt, Homo Sapiens; identical to SEQ ID NO: 62089

SEQ ID NO: 567195 - RNA, 64 nt, Homo Sapiens; identical to SEQ ID NO: 62090

SEQ ID NO: 567196 - RNA, 64 nt, Homo Sapiens; identical to SEQ ID NO: 62091

SEQ ID NO: 567197 - RNA, 64 nt, Homo Sapiens; identical to SEQ ID NO: 62092

SEQ ID NO: 567198 - RNA, 64 nt, Homo Sapiens; identical to SEQ ID NO: 62093

SEQ ID NO: 567199 - RNA, 64 nt, Homo Sapiens; identical to SEQ ID NO: 62094

SEQ ID NO: 567200 - RNA, 64 nt, Homo Sapiens; identical to SEQ ID NO: 62095

SEQ ID NO: 567201 - RNA, 64 nt, Homo Sapiens; identical to SEQ ID NO: 62096

SEQ ID NO: 567202 - RNA, 64 nt, Homo Sapiens; identical to SEQ ID NO: 62097

SEQ ID NO: 567203 - RNA, 64 nt, Homo Sapiens; identical to SEQ ID NO: 62098

SEQ ID NO: 567204 - RNA, 64 nt, Homo Sapiens; identical to SEQ ID NO: 62099

SEQ ID NO: 567205 - RNA, 64 nt, Homo Sapiens; identical to SEQ ID NO: 62100

SEQ ID NO: 567206 - RNA, 64 nt, Homo Sapiens; identical to SEQ ID NO: 62101

SEQ ID NO: 567207 - RNA, 64 nt, Homo Sapiens; identical to SEQ ID NO: 62102

SEQ ID NO: 567208 - RNA, 64 nt, Homo Sapiens; identical to SEQ ID NO: 62103

SEQ ID NO: 567209 - RNA, 64 nt, Homo Sapiens; identical to SEQ ID NO: 62104

SEQ ID NO: 567210 - RNA, 64 nt, Homo Sapiens; identical to SEQ ID NO: 62105

SEQ ID NO: 567211 - RNA, 64 nt, Homo Sapiens; identical to SEQ ID NO: 62106

SEQ ID NO: 567212 - RNA, 64 nt, Homo Sapiens; identical to SEQ ID NO: 62107

SEQ ID NO: 567213 - RNA, 64 nt, Homo Sapiens; identical to SEQ ID NO: 62108

SEQ ID NO: 567214 - RNA, 64 nt, Homo Sapiens; identical to SEQ ID NO: 62109

SEQ ID NO: 567215 - RNA, 64 nt, Homo Sapiens; identical to SEQ ID NO: 62110

SEQ ID NO: 567216 - RNA, 64 nt, Homo Sapiens; identical to SEQ ID NO: 62111

SEQ ID NO: 567217 - RNA, 64 nt, Homo Sapiens; identical to SEQ ID NO: 62112

SEQ ID NO: 567218 - RNA, 64 nt, Homo Sapiens; identical to SEQ ID NO: 62113

SEQ ID NO: 567219 - RNA, 64 nt, Homo Sapiens; identical to SEQ ID NO: 62114

SEQ ID NO: 567220 - RNA, 64 nt, Homo Sapiens; identical to SEQ ID NO: 62115

SEQ ID NO: 567221 - RNA, 64 nt, Homo Sapiens; identical to SEQ ID NO: 62116

SEQ ID NO: 567222 - RNA, 64 nt, Homo Sapiens; identical to SEQ ID NO: 62117

SEQ ID NO: 567223 - RNA, 64 nt, Homo Sapiens; identical to SEQ ID NO: 62118

SEQ ID NO: 567224 - RNA, 64 nt, Homo Sapiens; identical to SEQ ID NO: 62119

SEQ ID NO: 567225 - RNA, 64 nt, Homo Sapiens; identical to SEQ ID NO: 62120

SEQ ID NO: 567226 - RNA, 64 nt, Homo Sapiens; identical to SEQ ID NO: 62121

SEQ ID NO: 567227 - RNA, 64 nt, Homo Sapiens; identical to SEQ ID NO: 62122

SEQ ID NO: 567228 - RNA, 64 nt, Homo Sapiens; identical to SEQ ID NO: 62123

SEQ ID NO: 567229 - RNA, 64 nt, Homo Sapiens; identical to SEQ ID NO: 62124

SEQ ID NO: 567230 - RNA, 64 nt, Homo Sapiens; identical to SEQ ID NO: 62125

SEQ ID NO: 567231 - RNA, 64 nt, Homo Sapiens; identical to SEQ ID NO: 62126

SEQ ID NO: 567232 - RNA, 64 nt, Homo Sapiens; identical to SEQ ID NO: 62127

SEQ ID NO: 567233 - RNA, 64 nt, Homo Sapiens; identical to SEQ ID NO: 62128

SEQ ID NO: 567234 - RNA, 64 nt, Homo Sapiens; identical to SEQ ID NO: 62129

SEQ ID NO: 567235 - RNA, 64 nt, Homo Sapiens; identical to SEQ ID NO: 62130

SEQ ID NO: 567236 - RNA, 64 nt, Homo Sapiens; identical to SEQ ID NO: 62131

SEQ ID NO: 567237 - RNA, 64 nt, Homo Sapiens; identical to SEQ ID NO: 62132

SEQ ID NO: 567238 - RNA, 64 nt, Homo Sapiens; identical to SEQ ID NO: 62133

SEQ ID NO: 567239 - RNA, 64 nt, Homo Sapiens; identical to SEQ ID NO: 62134

SEQ ID NO: 567240 - RNA, 64 nt, Homo Sapiens; identical to SEQ ID NO: 62135

SEQ ID NO: 567241 - RNA, 64 nt, Homo Sapiens; identical to SEQ ID NO: 62136

SEQ ID NO: 567242 - RNA, 64 nt, Homo Sapiens; identical to SEQ ID NO: 62137

SEQ ID NO: 567243 - RNA, 64 nt, Homo Sapiens; identical to SEQ ID NO: 62138

SEQ ID NO: 567244 - RNA, 64 nt, Homo Sapiens; identical to SEQ ID NO: 62139

SEQ ID NO: 567245 - RNA, 64 nt, Homo Sapiens; identical to SEQ ID NO: 62140

SEQ ID NO: 567246 - RNA, 64 nt, Homo Sapiens; identical to SEQ ID NO: 62141

SEQ ID NO: 567247 - RNA, 64 nt, Homo Sapiens; identical to SEQ ID NO: 62142

SEQ ID NO: 567248 - RNA, 64 nt, Homo Sapiens; identical to SEQ ID NO: 62143

SEQ ID NO: 567249 - RNA, 64 nt, Homo Sapiens; identical to SEQ ID NO: 62144

SEQ ID NO: 567250 - RNA, 64 nt, Homo Sapiens; identical to SEQ ID NO: 62145

SEQ ID NO: 567251 - RNA, 64 nt, Homo Sapiens; identical to SEQ ID NO: 62146

SEQ ID NO: 567252 - RNA, 64 nt, Homo Sapiens; identical to SEQ ID NO: 62147

SEQ ID NO: 567253 - RNA, 64 nt, Homo Sapiens; identical to SEQ ID NO: 62148

SEQ ID NO: 567254 - RNA, 64 nt, Homo Sapiens; identical to SEQ ID NO: 62149

SEQ ID NO: 567255 - RNA, 64 nt, Homo Sapiens; identical to SEQ ID NO: 62150

SEQ ID NO: 567256 - RNA, 64 nt, Homo Sapiens; identical to SEQ ID NO: 62151

SEQ ID NO: 567257 - RNA, 64 nt, Homo Sapiens; identical to SEQ ID NO: 62152

SEQ ID NO: 567258 - RNA, 64 nt, Homo Sapiens; identical to SEQ ID NO: 62153

SEQ ID NO: 567259 - RNA, 64 nt, Homo Sapiens; identical to SEQ ID NO: 62154

SEQ ID NO: 567260 - RNA, 64 nt, Homo Sapiens; identical to SEQ ID NO: 62155

SEQ ID NO: 567261 - RNA, 64 nt, Homo Sapiens; identical to SEQ ID NO: 62156

SEQ ID NO: 567262 - RNA, 64 nt, Homo Sapiens; identical to SEQ ID NO: 62157

SEQ ID NO: 567263 - RNA, 64 nt, Homo Sapiens; identical to SEQ ID NO: 62158

SEQ ID NO: 567264 - RNA, 64 nt, Homo Sapiens; identical to SEQ ID NO: 62159

SEQ ID NO: 567265 - RNA, 64 nt, Homo Sapiens; identical to SEQ ID NO: 62160

SEQ ID NO: 567266 - RNA, 64 nt, Homo Sapiens; identical to SEQ ID NO: 62161

SEQ ID NO: 567267 - RNA, 64 nt, Homo Sapiens; identical to SEQ ID NO: 62162

SEQ ID NO: 567268 - RNA, 64 nt, Homo Sapiens; identical to SEQ ID NO: 62163

SEQ ID NO: 567269 - RNA, 64 nt, Homo Sapiens; identical to SEQ ID NO: 62164

SEQ ID NO: 567270 - RNA, 64 nt, Homo Sapiens; identical to SEQ ID NO: 62165

SEQ ID NO: 567271 - RNA, 64 nt, Homo Sapiens; identical to SEQ ID NO: 62166

SEQ ID NO: 567272 - RNA, 64 nt, Homo Sapiens; identical to SEQ ID NO: 62167

SEQ ID NO: 567273 - RNA, 64 nt, Homo Sapiens; identical to SEQ ID NO: 62168

SEQ ID NO: 567274 - RNA, 64 nt, Homo Sapiens; identical to SEQ ID NO: 62169

SEQ ID NO: 567275 - RNA, 64 nt, Homo Sapiens; identical to SEQ ID NO: 62170

SEQ ID NO: 567276 - RNA, 64 nt, Homo Sapiens; identical to SEQ ID NO: 62171

SEQ ID NO: 567277 - RNA, 64 nt, Homo Sapiens; identical to SEQ ID NO: 62172

SEQ ID NO: 567278 - RNA, 64 nt, Homo Sapiens; identical to SEQ ID NO: 62173

SEQ ID NO: 567279 - RNA, 64 nt, Homo Sapiens; identical to SEQ ID NO: 62174

SEQ ID NO: 567280 - RNA, 64 nt, Homo Sapiens; identical to SEQ ID NO: 62175

SEQ ID NO: 567281 - RNA, 64 nt, Homo Sapiens; identical to SEQ ID NO: 62176

SEQ ID NO: 567282 - RNA, 64 nt, Homo Sapiens; identical to SEQ ID NO: 62177

SEQ ID NO: 567283 - RNA, 64 nt, Homo Sapiens; identical to SEQ ID NO: 62178

SEQ ID NO: 567284 - RNA, 64 nt, Homo Sapiens; identical to SEQ ID NO: 62179

SEQ ID NO: 567285 - RNA, 64 nt, Homo Sapiens; identical to SEQ ID NO: 62180

SEQ ID NO: 567286 - RNA, 64 nt, Homo Sapiens; identical to SEQ ID NO: 62181

SEQ ID NO: 567287 - RNA, 64 nt, Homo Sapiens; identical to SEQ ID NO: 62182

SEQ ID NO: 567288 - RNA, 64 nt, Homo Sapiens; identical to SEQ ID NO: 62183

SEQ ID NO: 567289 - RNA, 64 nt, Homo Sapiens; identical to SEQ ID NO: 62184

SEQ ID NO: 567290 - RNA, 64 nt, Homo Sapiens; identical to SEQ ID NO: 62185

SEQ ID NO: 567291 - RNA, 64 nt, Homo Sapiens; identical to SEQ ID NO: 62186

SEQ ID NO: 567292 - RNA, 64 nt, Homo Sapiens; identical to SEQ ID NO: 62187

SEQ ID NO: 567293 - RNA, 64 nt, Homo Sapiens; identical to SEQ ID NO: 62188

SEQ ID NO: 567294 - RNA, 64 nt, Homo Sapiens; identical to SEQ ID NO: 62189

SEQ ID NO: 567295 - RNA, 64 nt, Homo Sapiens; identical to SEQ ID NO: 62190

SEQ ID NO: 567296 - RNA, 64 nt, Homo Sapiens; identical to SEQ ID NO: 62191

SEQ ID NO: 567297 - RNA, 64 nt, Homo Sapiens; identical to SEQ ID NO: 62192

SEQ ID NO: 567298 - RNA, 64 nt, Homo Sapiens; identical to SEQ ID NO: 62193

SEQ ID NO: 567299 - RNA, 64 nt, Homo Sapiens; identical to SEQ ID NO: 62194

SEQ ID NO: 567300 - RNA, 64 nt, Homo Sapiens; identical to SEQ ID NO: 62195

SEQ ID NO: 567301 - RNA, 64 nt, Homo Sapiens; identical to SEQ ID NO: 62196

SEQ ID NO: 567302 - RNA, 64 nt, Homo Sapiens; identical to SEQ ID NO: 62197

SEQ ID NO: 567303 - RNA, 64 nt, Homo Sapiens; identical to SEQ ID NO: 62198

SEQ ID NO: 567304 - RNA, 64 nt, Homo Sapiens; identical to SEQ ID NO: 62199

SEQ ID NO: 567305 - RNA, 64 nt, Homo Sapiens; identical to SEQ ID NO: 62200

SEQ ID NO: 567306 - RNA, 64 nt, Homo Sapiens; identical to SEQ ID NO: 62201

SEQ ID NO: 567307 - RNA, 64 nt, Homo Sapiens; identical to SEQ ID NO: 62202

SEQ ID NO: 567308 - RNA, 62 nt, Homo Sapiens; identical to SEQ ID NO: 62203

SEQ ID NO: 567309 - RNA, 64 nt, Homo Sapiens; identical to SEQ ID NO: 62204

SEQ ID NO: 567310 - RNA, 64 nt, Homo Sapiens; identical to SEQ ID NO: 62205

SEQ ID NO: 567311 - RNA, 64 nt, Homo Sapiens; identical to SEQ ID NO: 62206

SEQ ID NO: 567312 - RNA, 64 nt, Homo Sapiens; identical to SEQ ID NO: 62207

SEQ ID NO: 567313 - RNA, 64 nt, Homo Sapiens; identical to SEQ ID NO: 62208

SEQ ID NO: 567314 - RNA, 64 nt, Homo Sapiens; identical to SEQ ID NO: 62209

SEQ ID NO: 567315 - RNA, 64 nt, Homo Sapiens; identical to SEQ ID NO: 62210

SEQ ID NO: 567316 - RNA, 64 nt, Homo Sapiens; identical to SEQ ID NO: 62211

SEQ ID NO: 567317 - RNA, 64 nt, Homo Sapiens; identical to SEQ ID NO: 62212

SEQ ID NO: 567318 - RNA, 64 nt, Homo Sapiens; identical to SEQ ID NO: 62213

SEQ ID NO: 567319 - RNA, 64 nt, Homo Sapiens; identical to SEQ ID NO: 62214

SEQ ID NO: 567320 - RNA, 64 nt, Homo Sapiens; identical to SEQ ID NO: 62215

SEQ ID NO: 567321 - RNA, 64 nt, Homo Sapiens; identical to SEQ ID NO: 62216

SEQ ID NO: 567322 - RNA, 64 nt, Homo Sapiens; identical to SEQ ID NO: 62217

SEQ ID NO: 567323 - RNA, 64 nt, Homo Sapiens; identical to SEQ ID NO: 62218

SEQ ID NO: 567324 - RNA, 64 nt, Homo Sapiens; identical to SEQ ID NO: 62219

SEQ ID NO: 567325 - RNA, 64 nt, Homo Sapiens; identical to SEQ ID NO: 62220

SEQ ID NO: 567326 - RNA, 64 nt, Homo Sapiens; identical to SEQ ID NO: 62221

SEQ ID NO: 567327 - RNA, 64 nt, Homo Sapiens; identical to SEQ ID NO: 62222

SEQ ID NO: 567328 - RNA, 64 nt, Homo Sapiens; identical to SEQ ID NO: 62223

SEQ ID NO: 567329 - RNA, 64 nt, Homo Sapiens; identical to SEQ ID NO: 62224

SEQ ID NO: 567330 - RNA, 64 nt, Homo Sapiens; identical to SEQ ID NO: 62225

SEQ ID NO: 567331 - RNA, 64 nt, Homo Sapiens; identical to SEQ ID NO: 62226

SEQ ID NO: 567332 - RNA, 64 nt, Homo Sapiens; identical to SEQ ID NO: 62227

SEQ ID NO: 567333 - RNA, 64 nt, Homo Sapiens; identical to SEQ ID NO: 62228

SEQ ID NO: 567334 - RNA, 64 nt, Homo Sapiens; identical to SEQ ID NO: 62229

SEQ ID NO: 567335 - RNA, 64 nt, Homo Sapiens; identical to SEQ ID NO: 62230

SEQ ID NO: 567336 - RNA, 60 nt, Homo Sapiens; identical to SEQ ID NO: 62231

SEQ ID NO: 567337 - RNA, 64 nt, Homo Sapiens; identical to SEQ ID NO: 62232

SEQ ID NO: 567338 - RNA, 64 nt, Homo Sapiens; identical to SEQ ID NO: 62233

SEQ ID NO: 567339 - RNA, 64 nt, Homo Sapiens; identical to SEQ ID NO: 62234

SEQ ID NO: 567340 - RNA, 64 nt, Homo Sapiens; identical to SEQ ID NO: 62235

SEQ ID NO: 567341 - RNA, 64 nt, Homo Sapiens; identical to SEQ ID NO: 62236

SEQ ID NO: 567342 - RNA, 64 nt, Homo Sapiens; identical to SEQ ID NO: 62237

SEQ ID NO: 567343 - RNA, 64 nt, Homo Sapiens; identical to SEQ ID NO: 62238

SEQ ID NO: 567344 - RNA, 64 nt, Homo Sapiens; identical to SEQ ID NO: 62239

SEQ ID NO: 567345 - RNA, 64 nt, Homo Sapiens; identical to SEQ ID NO: 62240

SEQ ID NO: 567346 - RNA, 64 nt, Homo Sapiens; identical to SEQ ID NO: 62241

SEQ ID NO: 567347 - RNA, 64 nt, Homo Sapiens; identical to SEQ ID NO: 62242

SEQ ID NO: 567348 - RNA, 64 nt, Homo Sapiens; identical to SEQ ID NO: 62243

SEQ ID NO: 567349 - RNA, 64 nt, Homo Sapiens; identical to SEQ ID NO: 62244

SEQ ID NO: 567350 - RNA, 64 nt, Homo Sapiens; identical to SEQ ID NO: 62245

SEQ ID NO: 567351 - RNA, 64 nt, Homo Sapiens; identical to SEQ ID NO: 62246

SEQ ID NO: 567352 - RNA, 64 nt, Homo Sapiens; identical to SEQ ID NO: 62247

SEQ ID NO: 567353 - RNA, 64 nt, Homo Sapiens; identical to SEQ ID NO: 62248

SEQ ID NO: 567354 - RNA, 64 nt, Homo Sapiens; identical to SEQ ID NO: 62249

SEQ ID NO: 567355 - RNA, 64 nt, Homo Sapiens; identical to SEQ ID NO: 62250

SEQ ID NO: 567356 - RNA, 64 nt, Homo Sapiens; identical to SEQ ID NO: 62251

SEQ ID NO: 567357 - RNA, 64 nt, Homo Sapiens; identical to SEQ ID NO: 62252

SEQ ID NO: 567358 - RNA, 64 nt, Homo Sapiens; identical to SEQ ID NO: 62253

SEQ ID NO: 567359 - RNA, 64 nt, Homo Sapiens; identical to SEQ ID NO: 62254

SEQ ID NO: 567360 - RNA, 64 nt, Homo Sapiens; identical to SEQ ID NO: 62255

SEQ ID NO: 567361 - RNA, 64 nt, Homo Sapiens; identical to SEQ ID NO: 62256

SEQ ID NO: 567362 - RNA, 64 nt, Homo Sapiens; identical to SEQ ID NO: 62257

SEQ ID NO: 567363 - RNA, 64 nt, Homo Sapiens; identical to SEQ ID NO: 62258

SEQ ID NO: 567364 - RNA, 64 nt, Homo Sapiens; identical to SEQ ID NO: 62259

SEQ ID NO: 567365 - RNA, 64 nt, Homo Sapiens; identical to SEQ ID NO: 62260

SEQ ID NO: 567366 - RNA, 64 nt, Homo Sapiens; identical to SEQ ID NO: 62261

SEQ ID NO: 567367 - RNA, 64 nt, Homo Sapiens; identical to SEQ ID NO: 62262

SEQ ID NO: 567368 - RNA, 64 nt, Homo Sapiens; identical to SEQ ID NO: 62263

SEQ ID NO: 567369 - RNA, 64 nt, Homo Sapiens; identical to SEQ ID NO: 62264

SEQ ID NO: 567370 - RNA, 64 nt, Homo Sapiens; identical to SEQ ID NO: 62265

SEQ ID NO: 567371 - RNA, 64 nt, Homo Sapiens; identical to SEQ ID NO: 62266

SEQ ID NO: 567372 - RNA, 64 nt, Homo Sapiens; identical to SEQ ID NO: 62267

SEQ ID NO: 567373 - RNA, 64 nt, Homo Sapiens; identical to SEQ ID NO: 62268

SEQ ID NO: 567374 - RNA, 64 nt, Homo Sapiens; identical to SEQ ID NO: 62269

SEQ ID NO: 567375 - RNA, 64 nt, Homo Sapiens; identical to SEQ ID NO: 62270

SEQ ID NO: 567376 - RNA, 64 nt, Homo Sapiens; identical to SEQ ID NO: 62271

SEQ ID NO: 567377 - RNA, 64 nt, Homo Sapiens; identical to SEQ ID NO: 62272

SEQ ID NO: 567378 - RNA, 64 nt, Homo Sapiens; identical to SEQ ID NO: 62273

SEQ ID NO: 567379 - RNA, 64 nt, Homo Sapiens; identical to SEQ ID NO: 62274

SEQ ID NO: 567380 - RNA, 64 nt, Homo Sapiens; identical to SEQ ID NO: 62275

SEQ ID NO: 567381 - RNA, 64 nt, Homo Sapiens; identical to SEQ ID NO: 62276

SEQ ID NO: 567382 - RNA, 64 nt, Homo Sapiens; identical to SEQ ID NO: 62277

SEQ ID NO: 567383 - RNA, 64 nt, Homo Sapiens; identical to SEQ ID NO: 62278

SEQ ID NO: 567384 - RNA, 64 nt, Homo Sapiens; identical to SEQ ID NO: 62279

SEQ ID NO: 567385 - RNA, 64 nt, Homo Sapiens; identical to SEQ ID NO: 62280

SEQ ID NO: 567386 - RNA, 64 nt, Homo Sapiens; identical to SEQ ID NO: 62281

SEQ ID NO: 567387 - RNA, 64 nt, Homo Sapiens; identical to SEQ ID NO: 62282

SEQ ID NO: 567388 - RNA, 64 nt, Homo Sapiens; identical to SEQ ID NO: 62283

SEQ ID NO: 567389 - RNA, 64 nt, Homo Sapiens; identical to SEQ ID NO: 62284

SEQ ID NO: 567390 - RNA, 64 nt, Homo Sapiens; identical to SEQ ID NO: 62285

SEQ ID NO: 567391 - RNA, 64 nt, Homo Sapiens; identical to SEQ ID NO: 62286

SEQ ID NO: 567392 - RNA, 64 nt, Homo Sapiens; identical to SEQ ID NO: 62287

SEQ ID NO: 567393 - RNA, 64 nt, Homo Sapiens; identical to SEQ ID NO: 62288

SEQ ID NO: 567394 - RNA, 64 nt, Homo Sapiens; identical to SEQ ID NO: 62289

SEQ ID NO: 567395 - RNA, 64 nt, Homo Sapiens; identical to SEQ ID NO: 62290

SEQ ID NO: 567396 - RNA, 64 nt, Homo Sapiens; identical to SEQ ID NO: 62291

SEQ ID NO: 567397 - RNA, 64 nt, Homo Sapiens; identical to SEQ ID NO: 62292

SEQ ID NO: 567398 - RNA, 64 nt, Homo Sapiens; identical to SEQ ID NO: 62293

SEQ ID NO: 567399 - RNA, 64 nt, Homo Sapiens; identical to SEQ ID NO: 62294

SEQ ID NO: 567400 - RNA, 64 nt, Homo Sapiens; identical to SEQ ID NO: 62295

SEQ ID NO: 567401 - RNA, 64 nt, Homo Sapiens; identical to SEQ ID NO: 62296

SEQ ID NO: 567402 - RNA, 64 nt, Homo Sapiens; identical to SEQ ID NO: 62297

SEQ ID NO: 567403 - RNA, 64 nt, Homo Sapiens; identical to SEQ ID NO: 62298

SEQ ID NO: 567404 - RNA, 64 nt, Homo Sapiens; identical to SEQ ID NO: 62299

SEQ ID NO: 567405 - RNA, 64 nt, Homo Sapiens; identical to SEQ ID NO: 62300

SEQ ID NO: 567406 - RNA, 64 nt, Homo Sapiens; identical to SEQ ID NO: 62301

SEQ ID NO: 567407 - RNA, 64 nt, Homo Sapiens; identical to SEQ ID NO: 62302

SEQ ID NO: 567408 - RNA, 64 nt, Homo Sapiens; identical to SEQ ID NO: 62303

SEQ ID NO: 567409 - RNA, 64 nt, Homo Sapiens; identical to SEQ ID NO: 62304

SEQ ID NO: 567410 - RNA, 64 nt, Homo Sapiens; identical to SEQ ID NO: 62305

SEQ ID NO: 567411 - RNA, 64 nt, Homo Sapiens; identical to SEQ ID NO: 62306

SEQ ID NO: 567412 - RNA, 64 nt, Homo Sapiens; identical to SEQ ID NO: 62307

SEQ ID NO: 567413 - RNA, 64 nt, Homo Sapiens; identical to SEQ ID NO: 62308

SEQ ID NO: 567414 - RNA, 64 nt, Homo Sapiens; identical to SEQ ID NO: 62309

SEQ ID NO: 567415 - RNA, 64 nt, Homo Sapiens; identical to SEQ ID NO: 62310

SEQ ID NO: 567416 - RNA, 64 nt, Homo Sapiens; identical to SEQ ID NO: 62311

SEQ ID NO: 567417 - RNA, 64 nt, Homo Sapiens; identical to SEQ ID NO: 62312

SEQ ID NO: 567418 - RNA, 64 nt, Homo Sapiens; identical to SEQ ID NO: 62313

SEQ ID NO: 567419 - RNA, 64 nt, Homo Sapiens; identical to SEQ ID NO: 62314

SEQ ID NO: 567420 - RNA, 64 nt, Homo Sapiens; identical to SEQ ID NO: 62315

SEQ ID NO: 567421 - RNA, 64 nt, Homo Sapiens; identical to SEQ ID NO: 62316

SEQ ID NO: 567422 - RNA, 64 nt, Homo Sapiens; identical to SEQ ID NO: 62317

SEQ ID NO: 567423 - RNA, 64 nt, Homo Sapiens; identical to SEQ ID NO: 62318

SEQ ID NO: 567424 - RNA, 64 nt, Homo Sapiens; identical to SEQ ID NO: 62319

SEQ ID NO: 567425 - RNA, 64 nt, Homo Sapiens; identical to SEQ ID NO: 62320

SEQ ID NO: 567426 - RNA, 64 nt, Homo Sapiens; identical to SEQ ID NO: 62321

SEQ ID NO: 567427 - RNA, 64 nt, Homo Sapiens; identical to SEQ ID NO: 62322

SEQ ID NO: 567428 - RNA, 64 nt, Homo Sapiens; identical to SEQ ID NO: 62323

SEQ ID NO: 567429 - RNA, 64 nt, Homo Sapiens; identical to SEQ ID NO: 62324

SEQ ID NO: 567430 - RNA, 64 nt, Homo Sapiens; identical to SEQ ID NO: 62325

SEQ ID NO: 567431 - RNA, 64 nt, Homo Sapiens; identical to SEQ ID NO: 62326

SEQ ID NO: 567432 - RNA, 64 nt, Homo Sapiens; identical to SEQ ID NO: 62327

SEQ ID NO: 567433 - RNA, 64 nt, Homo Sapiens; identical to SEQ ID NO: 62328

SEQ ID NO: 567434 - RNA, 64 nt, Homo Sapiens; identical to SEQ ID NO: 62329

SEQ ID NO: 567435 - RNA, 64 nt, Homo Sapiens; identical to SEQ ID NO: 62330

SEQ ID NO: 567436 - RNA, 64 nt, Homo Sapiens; identical to SEQ ID NO: 62331

SEQ ID NO: 567437 - RNA, 64 nt, Homo Sapiens; identical to SEQ ID NO: 62332

SEQ ID NO: 567438 - RNA, 64 nt, Homo Sapiens; identical to SEQ ID NO: 62333

SEQ ID NO: 567439 - RNA, 64 nt, Homo Sapiens; identical to SEQ ID NO: 62334

SEQ ID NO: 567440 - RNA, 64 nt, Homo Sapiens; identical to SEQ ID NO: 62335

SEQ ID NO: 567441 - RNA, 64 nt, Homo Sapiens; identical to SEQ ID NO: 62336

SEQ ID NO: 567442 - RNA, 64 nt, Homo Sapiens; identical to SEQ ID NO: 62337

SEQ ID NO: 567443 - RNA, 64 nt, Homo Sapiens; identical to SEQ ID NO: 62338

SEQ ID NO: 567444 - RNA, 64 nt, Homo Sapiens; identical to SEQ ID NO: 62339

SEQ ID NO: 567445 - RNA, 64 nt, Homo Sapiens; identical to SEQ ID NO: 62340

SEQ ID NO: 567446 - RNA, 64 nt, Homo Sapiens; identical to SEQ ID NO: 62341

SEQ ID NO: 567447 - RNA, 64 nt, Homo Sapiens; identical to SEQ ID NO: 62342

SEQ ID NO: 567448 - RNA, 64 nt, Homo Sapiens; identical to SEQ ID NO: 62343

SEQ ID NO: 567449 - RNA, 64 nt, Homo Sapiens; identical to SEQ ID NO: 62344

SEQ ID NO: 567450 - RNA, 64 nt, Homo Sapiens; identical to SEQ ID NO: 62345

SEQ ID NO: 567451 - RNA, 64 nt, Homo Sapiens; identical to SEQ ID NO: 62346

SEQ ID NO: 567452 - RNA, 64 nt, Homo Sapiens; identical to SEQ ID NO: 62347

SEQ ID NO: 567453 - RNA, 64 nt, Homo Sapiens; identical to SEQ ID NO: 62348

SEQ ID NO: 567454 - RNA, 64 nt, Homo Sapiens; identical to SEQ ID NO: 62349

SEQ ID NO: 567455 - RNA, 64 nt, Homo Sapiens; identical to SEQ ID NO: 62350

SEQ ID NO: 567456 - RNA, 64 nt, Homo Sapiens; identical to SEQ ID NO: 62351

SEQ ID NO: 567457 - RNA, 64 nt, Homo Sapiens; identical to SEQ ID NO: 62352

SEQ ID NO: 567458 - RNA, 64 nt, Homo Sapiens; identical to SEQ ID NO: 62353

SEQ ID NO: 567459 - RNA, 64 nt, Homo Sapiens; identical to SEQ ID NO: 62354

SEQ ID NO: 567460 - RNA, 64 nt, Homo Sapiens; identical to SEQ ID NO: 62355

SEQ ID NO: 567461 - RNA, 64 nt, Homo Sapiens; identical to SEQ ID NO: 62356

SEQ ID NO: 567462 - RNA, 64 nt, Homo Sapiens; identical to SEQ ID NO: 62357

SEQ ID NO: 567463 - RNA, 64 nt, Homo Sapiens; identical to SEQ ID NO: 62358

SEQ ID NO: 567464 - RNA, 64 nt, Homo Sapiens; identical to SEQ ID NO: 62359

SEQ ID NO: 567465 - RNA, 64 nt, Homo Sapiens; identical to SEQ ID NO: 62360

SEQ ID NO: 567466 - RNA, 64 nt, Homo Sapiens; identical to SEQ ID NO: 62361

SEQ ID NO: 567467 - RNA, 64 nt, Homo Sapiens; identical to SEQ ID NO: 62362

SEQ ID NO: 567468 - RNA, 64 nt, Homo Sapiens; identical to SEQ ID NO: 62363

SEQ ID NO: 567469 - RNA, 64 nt, Homo Sapiens; identical to SEQ ID NO: 62364

SEQ ID NO: 567470 - RNA, 64 nt, Homo Sapiens; identical to SEQ ID NO: 62365

SEQ ID NO: 567471 - RNA, 64 nt, Homo Sapiens; identical to SEQ ID NO: 62366

SEQ ID NO: 567472 - RNA, 64 nt, Homo Sapiens; identical to SEQ ID NO: 62367

SEQ ID NO: 567473 - RNA, 64 nt, Homo Sapiens; identical to SEQ ID NO: 62368

SEQ ID NO: 567474 - RNA, 64 nt, Homo Sapiens; identical to SEQ ID NO: 62369

SEQ ID NO: 567475 - RNA, 64 nt, Homo Sapiens; identical to SEQ ID NO: 62370

SEQ ID NO: 567476 - RNA, 64 nt, Homo Sapiens; identical to SEQ ID NO: 62371

SEQ ID NO: 567477 - RNA, 64 nt, Homo Sapiens; identical to SEQ ID NO: 62372

SEQ ID NO: 567478 - RNA, 64 nt, Homo Sapiens; identical to SEQ ID NO: 62373

SEQ ID NO: 567479 - RNA, 64 nt, Homo Sapiens; identical to SEQ ID NO: 62374

SEQ ID NO: 567480 - RNA, 64 nt, Homo Sapiens; identical to SEQ ID NO: 62375

SEQ ID NO: 567481 - RNA, 64 nt, Homo Sapiens; identical to SEQ ID NO: 62376

SEQ ID NO: 567482 - RNA, 64 nt, Homo Sapiens; identical to SEQ ID NO: 62377

SEQ ID NO: 567483 - RNA, 64 nt, Homo Sapiens; identical to SEQ ID NO: 62378

SEQ ID NO: 567484 - RNA, 64 nt, Homo Sapiens; identical to SEQ ID NO: 62379

SEQ ID NO: 567485 - RNA, 64 nt, Homo Sapiens; identical to SEQ ID NO: 62380

SEQ ID NO: 567486 - RNA, 64 nt, Homo Sapiens; identical to SEQ ID NO: 62381

SEQ ID NO: 567487 - RNA, 64 nt, Homo Sapiens; identical to SEQ ID NO: 62382

SEQ ID NO: 567488 - RNA, 64 nt, Homo Sapiens; identical to SEQ ID NO: 62383

SEQ ID NO: 567489 - RNA, 64 nt, Homo Sapiens; identical to SEQ ID NO: 62384

SEQ ID NO: 567490 - RNA, 64 nt, Homo Sapiens; identical to SEQ ID NO: 62385

SEQ ID NO: 567491 - RNA, 64 nt, Homo Sapiens; identical to SEQ ID NO: 62386

SEQ ID NO: 567492 - RNA, 64 nt, Homo Sapiens; identical to SEQ ID NO: 62387

SEQ ID NO: 567493 - RNA, 64 nt, Homo Sapiens; identical to SEQ ID NO: 62388

SEQ ID NO: 567494 - RNA, 64 nt, Homo Sapiens; identical to SEQ ID NO: 62389

SEQ ID NO: 567495 - RNA, 64 nt, Homo Sapiens; identical to SEQ ID NO: 62390

SEQ ID NO: 567496 - RNA, 64 nt, Homo Sapiens; identical to SEQ ID NO: 62391

SEQ ID NO: 567497 - RNA, 64 nt, Homo Sapiens; identical to SEQ ID NO: 62392

SEQ ID NO: 567498 - RNA, 64 nt, Homo Sapiens; identical to SEQ ID NO: 62393

SEQ ID NO: 567499 - RNA, 64 nt, Homo Sapiens; identical to SEQ ID NO: 62394

SEQ ID NO: 567500 - RNA, 64 nt, Homo Sapiens; identical to SEQ ID NO: 62395

SEQ ID NO: 567501 - RNA, 64 nt, Homo Sapiens; identical to SEQ ID NO: 62396

SEQ ID NO: 567502 - RNA, 64 nt, Homo Sapiens; identical to SEQ ID NO: 62397

SEQ ID NO: 567503 - RNA, 64 nt, Homo Sapiens; identical to SEQ ID NO: 62398

SEQ ID NO: 567504 - RNA, 64 nt, Homo Sapiens; identical to SEQ ID NO: 62399

SEQ ID NO: 567505 - RNA, 64 nt, Homo Sapiens; identical to SEQ ID NO: 62400

SEQ ID NO: 567506 - RNA, 64 nt, Homo Sapiens; identical to SEQ ID NO: 62401

SEQ ID NO: 567507 - RNA, 64 nt, Homo Sapiens; identical to SEQ ID NO: 62402

SEQ ID NO: 567508 - RNA, 64 nt, Homo Sapiens; identical to SEQ ID NO: 62403

SEQ ID NO: 567509 - RNA, 64 nt, Homo Sapiens; identical to SEQ ID NO: 62404

SEQ ID NO: 567510 - RNA, 64 nt, Homo Sapiens; identical to SEQ ID NO: 62405

SEQ ID NO: 567511 - RNA, 64 nt, Homo Sapiens; identical to SEQ ID NO: 62406

SEQ ID NO: 567512 - RNA, 64 nt, Homo Sapiens; identical to SEQ ID NO: 62407

SEQ ID NO: 567513 - RNA, 64 nt, Homo Sapiens; identical to SEQ ID NO: 62408

SEQ ID NO: 567514 - RNA, 64 nt, Homo Sapiens; identical to SEQ ID NO: 62409

SEQ ID NO: 567515 - RNA, 64 nt, Homo Sapiens; identical to SEQ ID NO: 62410

SEQ ID NO: 567516 - RNA, 64 nt, Homo Sapiens; identical to SEQ ID NO: 62411

SEQ ID NO: 567517 - RNA, 64 nt, Homo Sapiens; identical to SEQ ID NO: 62412

SEQ ID NO: 567518 - RNA, 64 nt, Homo Sapiens; identical to SEQ ID NO: 62413

SEQ ID NO: 567519 - RNA, 64 nt, Homo Sapiens; identical to SEQ ID NO: 62414

SEQ ID NO: 567520 - RNA, 64 nt, Homo Sapiens; identical to SEQ ID NO: 62415

SEQ ID NO: 567521 - RNA, 64 nt, Homo Sapiens; identical to SEQ ID NO: 62416

SEQ ID NO: 567522 - RNA, 64 nt, Homo Sapiens; identical to SEQ ID NO: 62417

SEQ ID NO: 567523 - RNA, 64 nt, Homo Sapiens; identical to SEQ ID NO: 62418

SEQ ID NO: 567524 - RNA, 64 nt, Homo Sapiens; identical to SEQ ID NO: 62419

SEQ ID NO: 567525 - RNA, 64 nt, Homo Sapiens; identical to SEQ ID NO: 62420

SEQ ID NO: 567526 - RNA, 64 nt, Homo Sapiens; identical to SEQ ID NO: 62421

SEQ ID NO: 567527 - RNA, 64 nt, Homo Sapiens; identical to SEQ ID NO: 62422

SEQ ID NO: 567528 - RNA, 64 nt, Homo Sapiens; identical to SEQ ID NO: 62423

SEQ ID NO: 567529 - RNA, 64 nt, Homo Sapiens; identical to SEQ ID NO: 62424

SEQ ID NO: 567530 - RNA, 64 nt, Homo Sapiens; identical to SEQ ID NO: 62425

SEQ ID NO: 567531 - RNA, 64 nt, Homo Sapiens; identical to SEQ ID NO: 62426

SEQ ID NO: 567532 - RNA, 64 nt, Homo Sapiens; identical to SEQ ID NO: 62427

SEQ ID NO: 567533 - RNA, 64 nt, Homo Sapiens; identical to SEQ ID NO: 62428

SEQ ID NO: 567534 - RNA, 64 nt, Homo Sapiens; identical to SEQ ID NO: 62429

SEQ ID NO: 567535 - RNA, 64 nt, Homo Sapiens; identical to SEQ ID NO: 62430

SEQ ID NO: 567536 - RNA, 64 nt, Homo Sapiens; identical to SEQ ID NO: 62431

SEQ ID NO: 567537 - RNA, 64 nt, Homo Sapiens; identical to SEQ ID NO: 62432

SEQ ID NO: 567538 - RNA, 64 nt, Homo Sapiens; identical to SEQ ID NO: 62433

SEQ ID NO: 567539 - RNA, 64 nt, Homo Sapiens; identical to SEQ ID NO: 62434

SEQ ID NO: 567540 - RNA, 64 nt, Homo Sapiens; identical to SEQ ID NO: 62435

SEQ ID NO: 567541 - RNA, 64 nt, Homo Sapiens; identical to SEQ ID NO: 62436

SEQ ID NO: 567542 - RNA, 64 nt, Homo Sapiens; identical to SEQ ID NO: 62437

SEQ ID NO: 567543 - RNA, 64 nt, Homo Sapiens; identical to SEQ ID NO: 62438

SEQ ID NO: 567544 - RNA, 64 nt, Homo Sapiens; identical to SEQ ID NO: 62439

SEQ ID NO: 567545 - RNA, 64 nt, Homo Sapiens; identical to SEQ ID NO: 62440

SEQ ID NO: 567546 - RNA, 64 nt, Homo Sapiens; identical to SEQ ID NO: 62441

SEQ ID NO: 567547 - RNA, 64 nt, Homo Sapiens; identical to SEQ ID NO: 62442

SEQ ID NO: 567548 - RNA, 64 nt, Homo Sapiens; identical to SEQ ID NO: 62443

SEQ ID NO: 567549 - RNA, 64 nt, Homo Sapiens; identical to SEQ ID NO: 62444

SEQ ID NO: 567550 - RNA, 64 nt, Homo Sapiens; identical to SEQ ID NO: 62445

SEQ ID NO: 567551 - RNA, 64 nt, Homo Sapiens; identical to SEQ ID NO: 62446

SEQ ID NO: 567552 - RNA, 64 nt, Homo Sapiens; identical to SEQ ID NO: 62447

SEQ ID NO: 567553 - RNA, 64 nt, Homo Sapiens; identical to SEQ ID NO: 62448

SEQ ID NO: 567554 - RNA, 64 nt, Homo Sapiens; identical to SEQ ID NO: 62449

SEQ ID NO: 567555 - RNA, 64 nt, Homo Sapiens; identical to SEQ ID NO: 62450

SEQ ID NO: 567556 - RNA, 64 nt, Homo Sapiens; identical to SEQ ID NO: 62451

SEQ ID NO: 567557 - RNA, 64 nt, Homo Sapiens; identical to SEQ ID NO: 62452

SEQ ID NO: 567558 - RNA, 64 nt, Homo Sapiens; identical to SEQ ID NO: 62453

SEQ ID NO: 567559 - RNA, 64 nt, Homo Sapiens; identical to SEQ ID NO: 62454

SEQ ID NO: 567560 - RNA, 64 nt, Homo Sapiens; identical to SEQ ID NO: 62455

SEQ ID NO: 567561 - RNA, 64 nt, Homo Sapiens; identical to SEQ ID NO: 62456

SEQ ID NO: 567562 - RNA, 64 nt, Homo Sapiens; identical to SEQ ID NO: 62457

SEQ ID NO: 567563 - RNA, 64 nt, Homo Sapiens; identical to SEQ ID NO: 62458

SEQ ID NO: 567564 - RNA, 64 nt, Homo Sapiens; identical to SEQ ID NO: 62459

SEQ ID NO: 567565 - RNA, 50 nt, Homo Sapiens; identical to SEQ ID NO: 62460

SEQ ID NO: 567566 - RNA, 64 nt, Homo Sapiens; identical to SEQ ID NO: 62461

SEQ ID NO: 567567 - RNA, 64 nt, Homo Sapiens; identical to SEQ ID NO: 62462

SEQ ID NO: 567568 - RNA, 64 nt, Homo Sapiens; identical to SEQ ID NO: 62463

SEQ ID NO: 567569 - RNA, 64 nt, Homo Sapiens; identical to SEQ ID NO: 62464

SEQ ID NO: 567570 - RNA, 64 nt, Homo Sapiens; identical to SEQ ID NO: 62465

SEQ ID NO: 567571 - RNA, 64 nt, Homo Sapiens; identical to SEQ ID NO: 62466

SEQ ID NO: 567572 - RNA, 64 nt, Homo Sapiens; identical to SEQ ID NO: 62467

SEQ ID NO: 567573 - RNA, 64 nt, Homo Sapiens; identical to SEQ ID NO: 62468

SEQ ID NO: 567574 - RNA, 64 nt, Homo Sapiens; identical to SEQ ID NO: 62469

SEQ ID NO: 567575 - RNA, 64 nt, Homo Sapiens; identical to SEQ ID NO: 62470

SEQ ID NO: 567576 - RNA, 64 nt, Homo Sapiens; identical to SEQ ID NO: 62471

SEQ ID NO: 567577 - RNA, 64 nt, Homo Sapiens; identical to SEQ ID NO: 62472

SEQ ID NO: 567578 - RNA, 64 nt, Homo Sapiens; identical to SEQ ID NO: 62473

SEQ ID NO: 567579 - RNA, 64 nt, Homo Sapiens; identical to SEQ ID NO: 62474

SEQ ID NO: 567580 - RNA, 64 nt, Homo Sapiens; identical to SEQ ID NO: 62475

SEQ ID NO: 567581 - RNA, 64 nt, Homo Sapiens; identical to SEQ ID NO: 62476

SEQ ID NO: 567582 - RNA, 64 nt, Homo Sapiens; identical to SEQ ID NO: 62477

SEQ ID NO: 567583 - RNA, 64 nt, Homo Sapiens; identical to SEQ ID NO: 62478

SEQ ID NO: 567584 - RNA, 64 nt, Homo Sapiens; identical to SEQ ID NO: 62479

SEQ ID NO: 567585 - RNA, 64 nt, Homo Sapiens; identical to SEQ ID NO: 62480

SEQ ID NO: 567586 - RNA, 64 nt, Homo Sapiens; identical to SEQ ID NO: 62481

SEQ ID NO: 567587 - RNA, 64 nt, Homo Sapiens; identical to SEQ ID NO: 62482

SEQ ID NO: 567588 - RNA, 64 nt, Homo Sapiens; identical to SEQ ID NO: 62483

SEQ ID NO: 567589 - RNA, 64 nt, Homo Sapiens; identical to SEQ ID NO: 62484

SEQ ID NO: 567590 - RNA, 64 nt, Homo Sapiens; identical to SEQ ID NO: 62485

SEQ ID NO: 567591 - RNA, 64 nt, Homo Sapiens; identical to SEQ ID NO: 62486

SEQ ID NO: 567592 - RNA, 64 nt, Homo Sapiens; identical to SEQ ID NO: 62487

SEQ ID NO: 567593 - RNA, 64 nt, Homo Sapiens; identical to SEQ ID NO: 62488

SEQ ID NO: 567594 - RNA, 64 nt, Homo Sapiens; identical to SEQ ID NO: 62489

SEQ ID NO: 567595 - RNA, 64 nt, Homo Sapiens; identical to SEQ ID NO: 62490

SEQ ID NO: 567596 - RNA, 64 nt, Homo Sapiens; identical to SEQ ID NO: 62491

SEQ ID NO: 567597 - RNA, 64 nt, Homo Sapiens; identical to SEQ ID NO: 62492

SEQ ID NO: 567598 - RNA, 64 nt, Homo Sapiens; identical to SEQ ID NO: 62493

SEQ ID NO: 567599 - RNA, 64 nt, Homo Sapiens; identical to SEQ ID NO: 62494

SEQ ID NO: 567600 - RNA, 64 nt, Homo Sapiens; identical to SEQ ID NO: 62495

SEQ ID NO: 567601 - RNA, 64 nt, Homo Sapiens; identical to SEQ ID NO: 62496

SEQ ID NO: 567602 - RNA, 63 nt, Homo Sapiens; identical to SEQ ID NO: 62497

SEQ ID NO: 567603 - RNA, 64 nt, Homo Sapiens; identical to SEQ ID NO: 62498

SEQ ID NO: 567604 - RNA, 64 nt, Homo Sapiens; identical to SEQ ID NO: 62499

SEQ ID NO: 567605 - RNA, 64 nt, Homo Sapiens; identical to SEQ ID NO: 62500

SEQ ID NO: 567606 - RNA, 64 nt, Homo Sapiens; identical to SEQ ID NO: 62501

SEQ ID NO: 567607 - RNA, 64 nt, Homo Sapiens; identical to SEQ ID NO: 62502

SEQ ID NO: 567608 - RNA, 64 nt, Homo Sapiens; identical to SEQ ID NO: 62503

SEQ ID NO: 567609 - RNA, 64 nt, Homo Sapiens; identical to SEQ ID NO: 62504

SEQ ID NO: 567610 - RNA, 64 nt, Homo Sapiens; identical to SEQ ID NO: 62505

SEQ ID NO: 567611 - RNA, 64 nt, Homo Sapiens; identical to SEQ ID NO: 62506

SEQ ID NO: 567612 - RNA, 64 nt, Homo Sapiens; identical to SEQ ID NO: 62507

SEQ ID NO: 567613 - RNA, 64 nt, Homo Sapiens; identical to SEQ ID NO: 62508

SEQ ID NO: 567614 - RNA, 64 nt, Homo Sapiens; identical to SEQ ID NO: 62509

SEQ ID NO: 567615 - RNA, 64 nt, Homo Sapiens; identical to SEQ ID NO: 62510

SEQ ID NO: 567616 - RNA, 64 nt, Homo Sapiens; identical to SEQ ID NO: 62511

SEQ ID NO: 567617 - RNA, 64 nt, Homo Sapiens; identical to SEQ ID NO: 62512

SEQ ID NO: 567618 - RNA, 64 nt, Homo Sapiens; identical to SEQ ID NO: 62513

SEQ ID NO: 567619 - RNA, 64 nt, Homo Sapiens; identical to SEQ ID NO: 62514

SEQ ID NO: 567620 - RNA, 64 nt, Homo Sapiens; identical to SEQ ID NO: 62515

SEQ ID NO: 567621 - RNA, 64 nt, Homo Sapiens; identical to SEQ ID NO: 62516

SEQ ID NO: 567622 - RNA, 64 nt, Homo Sapiens; identical to SEQ ID NO: 62517

SEQ ID NO: 567623 - RNA, 64 nt, Homo Sapiens; identical to SEQ ID NO: 62518

SEQ ID NO: 567624 - RNA, 64 nt, Homo Sapiens; identical to SEQ ID NO: 62519

SEQ ID NO: 567625 - RNA, 64 nt, Homo Sapiens; identical to SEQ ID NO: 62520

SEQ ID NO: 567626 - RNA, 64 nt, Homo Sapiens; identical to SEQ ID NO: 62521

SEQ ID NO: 567627 - RNA, 64 nt, Homo Sapiens; identical to SEQ ID NO: 62522

SEQ ID NO: 567628 - RNA, 64 nt, Homo Sapiens; identical to SEQ ID NO: 62523

SEQ ID NO: 567629 - RNA, 64 nt, Homo Sapiens; identical to SEQ ID NO: 62524

SEQ ID NO: 567630 - RNA, 64 nt, Homo Sapiens; identical to SEQ ID NO: 62525

SEQ ID NO: 567631 - RNA, 64 nt, Homo Sapiens; identical to SEQ ID NO: 62526

SEQ ID NO: 567632 - RNA, 64 nt, Homo Sapiens; identical to SEQ ID NO: 62527

SEQ ID NO: 567633 - RNA, 64 nt, Homo Sapiens; identical to SEQ ID NO: 62528

SEQ ID NO: 567634 - RNA, 64 nt, Homo Sapiens; identical to SEQ ID NO: 62529

SEQ ID NO: 567635 - RNA, 64 nt, Homo Sapiens; identical to SEQ ID NO: 62530

SEQ ID NO: 567636 - RNA, 64 nt, Homo Sapiens; identical to SEQ ID NO: 62531

SEQ ID NO: 567637 - RNA, 64 nt, Homo Sapiens; identical to SEQ ID NO: 62532

SEQ ID NO: 567638 - RNA, 64 nt, Homo Sapiens; identical to SEQ ID NO: 62533

SEQ ID NO: 567639 - RNA, 64 nt, Homo Sapiens; identical to SEQ ID NO: 62534

SEQ ID NO: 567640 - RNA, 64 nt, Homo Sapiens; identical to SEQ ID NO: 62535

SEQ ID NO: 567641 - RNA, 64 nt, Homo Sapiens; identical to SEQ ID NO: 62536

SEQ ID NO: 567642 - RNA, 64 nt, Homo Sapiens; identical to SEQ ID NO: 62537

SEQ ID NO: 567643 - RNA, 64 nt, Homo Sapiens; identical to SEQ ID NO: 62538

SEQ ID NO: 567644 - RNA, 64 nt, Homo Sapiens; identical to SEQ ID NO: 62539

SEQ ID NO: 567645 - RNA, 64 nt, Homo Sapiens; identical to SEQ ID NO: 62540

SEQ ID NO: 567646 - RNA, 64 nt, Homo Sapiens; identical to SEQ ID NO: 62541

SEQ ID NO: 567647 - RNA, 64 nt, Homo Sapiens; identical to SEQ ID NO: 62542

SEQ ID NO: 567648 - RNA, 64 nt, Homo Sapiens; identical to SEQ ID NO: 62543

SEQ ID NO: 567649 - RNA, 64 nt, Homo Sapiens; identical to SEQ ID NO: 62544

SEQ ID NO: 567650 - RNA, 64 nt, Homo Sapiens; identical to SEQ ID NO: 62545

SEQ ID NO: 567651 - RNA, 64 nt, Homo Sapiens; identical to SEQ ID NO: 62546

SEQ ID NO: 567652 - RNA, 64 nt, Homo Sapiens; identical to SEQ ID NO: 62547

SEQ ID NO: 567653 - RNA, 64 nt, Homo Sapiens; identical to SEQ ID NO: 62548

SEQ ID NO: 567654 - RNA, 64 nt, Homo Sapiens; identical to SEQ ID NO: 62549

SEQ ID NO: 567655 - RNA, 64 nt, Homo Sapiens; identical to SEQ ID NO: 62550

SEQ ID NO: 567656 - RNA, 64 nt, Homo Sapiens; identical to SEQ ID NO: 62551

SEQ ID NO: 567657 - RNA, 64 nt, Homo Sapiens; identical to SEQ ID NO: 62552

SEQ ID NO: 567658 - RNA, 64 nt, Homo Sapiens; identical to SEQ ID NO: 62553

SEQ ID NO: 567659 - RNA, 64 nt, Homo Sapiens; identical to SEQ ID NO: 62554

SEQ ID NO: 567660 - RNA, 64 nt, Homo Sapiens; identical to SEQ ID NO: 62555

SEQ ID NO: 567661 - RNA, 64 nt, Homo Sapiens; identical to SEQ ID NO: 62556

SEQ ID NO: 567662 - RNA, 64 nt, Homo Sapiens; identical to SEQ ID NO: 62557

SEQ ID NO: 567663 - RNA, 64 nt, Homo Sapiens; identical to SEQ ID NO: 62558

SEQ ID NO: 567664 - RNA, 64 nt, Homo Sapiens; identical to SEQ ID NO: 62559

SEQ ID NO: 567665 - RNA, 64 nt, Homo Sapiens; identical to SEQ ID NO: 62560

SEQ ID NO: 567666 - RNA, 64 nt, Homo Sapiens; identical to SEQ ID NO: 62561

SEQ ID NO: 567667 - RNA, 64 nt, Homo Sapiens; identical to SEQ ID NO: 62562

SEQ ID NO: 567668 - RNA, 64 nt, Homo Sapiens; identical to SEQ ID NO: 62563

SEQ ID NO: 567669 - RNA, 64 nt, Homo Sapiens; identical to SEQ ID NO: 62564

SEQ ID NO: 567670 - RNA, 64 nt, Homo Sapiens; identical to SEQ ID NO: 62565

SEQ ID NO: 567671 - RNA, 64 nt, Homo Sapiens; identical to SEQ ID NO: 62566

SEQ ID NO: 567672 - RNA, 64 nt, Homo Sapiens; identical to SEQ ID NO: 62567

SEQ ID NO: 567673 - RNA, 64 nt, Homo Sapiens; identical to SEQ ID NO: 62568

SEQ ID NO: 567674 - RNA, 64 nt, Homo Sapiens; identical to SEQ ID NO: 62569

SEQ ID NO: 567675 - RNA, 64 nt, Homo Sapiens; identical to SEQ ID NO: 62570

SEQ ID NO: 567676 - RNA, 64 nt, Homo Sapiens; identical to SEQ ID NO: 62571

SEQ ID NO: 567677 - RNA, 64 nt, Homo Sapiens; identical to SEQ ID NO: 62572

SEQ ID NO: 567678 - RNA, 64 nt, Homo Sapiens; identical to SEQ ID NO: 62573

SEQ ID NO: 567679 - RNA, 64 nt, Homo Sapiens; identical to SEQ ID NO: 62574

SEQ ID NO: 567680 - RNA, 64 nt, Homo Sapiens; identical to SEQ ID NO: 62575

SEQ ID NO: 567681 - RNA, 64 nt, Homo Sapiens; identical to SEQ ID NO: 62576

SEQ ID NO: 567682 - RNA, 64 nt, Homo Sapiens; identical to SEQ ID NO: 62577

SEQ ID NO: 567683 - RNA, 64 nt, Homo Sapiens; identical to SEQ ID NO: 62578

SEQ ID NO: 567684 - RNA, 64 nt, Homo Sapiens; identical to SEQ ID NO: 62579

SEQ ID NO: 567685 - RNA, 64 nt, Homo Sapiens; identical to SEQ ID NO: 62580

SEQ ID NO: 567686 - RNA, 64 nt, Homo Sapiens; identical to SEQ ID NO: 62581

SEQ ID NO: 567687 - RNA, 64 nt, Homo Sapiens; identical to SEQ ID NO: 62582

SEQ ID NO: 567688 - RNA, 64 nt, Homo Sapiens; identical to SEQ ID NO: 62583

SEQ ID NO: 567689 - RNA, 64 nt, Homo Sapiens; identical to SEQ ID NO: 62584

SEQ ID NO: 567690 - RNA, 64 nt, Homo Sapiens; identical to SEQ ID NO: 62585

SEQ ID NO: 567691 - RNA, 64 nt, Homo Sapiens; identical to SEQ ID NO: 62586

SEQ ID NO: 567692 - RNA, 64 nt, Homo Sapiens; identical to SEQ ID NO: 62587

SEQ ID NO: 567693 - RNA, 64 nt, Homo Sapiens; identical to SEQ ID NO: 62588

SEQ ID NO: 567694 - RNA, 64 nt, Homo Sapiens; identical to SEQ ID NO: 62589

SEQ ID NO: 567695 - RNA, 64 nt, Homo Sapiens; identical to SEQ ID NO: 62590

SEQ ID NO: 567696 - RNA, 64 nt, Homo Sapiens; identical to SEQ ID NO: 62591

SEQ ID NO: 567697 - RNA, 64 nt, Homo Sapiens; identical to SEQ ID NO: 62592

SEQ ID NO: 567698 - RNA, 64 nt, Homo Sapiens; identical to SEQ ID NO: 62593

SEQ ID NO: 567699 - RNA, 64 nt, Homo Sapiens; identical to SEQ ID NO: 62594

SEQ ID NO: 567700 - RNA, 64 nt, Homo Sapiens; identical to SEQ ID NO: 62595

SEQ ID NO: 567701 - RNA, 64 nt, Homo Sapiens; identical to SEQ ID NO: 62596

SEQ ID NO: 567702 - RNA, 64 nt, Homo Sapiens; identical to SEQ ID NO: 62597

SEQ ID NO: 567703 - RNA, 64 nt, Homo Sapiens; identical to SEQ ID NO: 62598

SEQ ID NO: 567704 - RNA, 64 nt, Homo Sapiens; identical to SEQ ID NO: 62599

SEQ ID NO: 567705 - RNA, 64 nt, Homo Sapiens; identical to SEQ ID NO: 62600

SEQ ID NO: 567706 - RNA, 64 nt, Homo Sapiens; identical to SEQ ID NO: 62601

SEQ ID NO: 567707 - RNA, 64 nt, Homo Sapiens; identical to SEQ ID NO: 62602

SEQ ID NO: 567708 - RNA, 64 nt, Homo Sapiens; identical to SEQ ID NO: 62603

SEQ ID NO: 567709 - RNA, 64 nt, Homo Sapiens; identical to SEQ ID NO: 62604

SEQ ID NO: 567710 - RNA, 64 nt, Homo Sapiens; identical to SEQ ID NO: 62605

SEQ ID NO: 567711 - RNA, 64 nt, Homo Sapiens; identical to SEQ ID NO: 62606

SEQ ID NO: 567712 - RNA, 64 nt, Homo Sapiens; identical to SEQ ID NO: 62607

SEQ ID NO: 567713 - RNA, 64 nt, Homo Sapiens; identical to SEQ ID NO: 62608

SEQ ID NO: 567714 - RNA, 64 nt, Homo Sapiens; identical to SEQ ID NO: 62609

SEQ ID NO: 567715 - RNA, 64 nt, Homo Sapiens; identical to SEQ ID NO: 62610

SEQ ID NO: 567716 - RNA, 64 nt, Homo Sapiens; identical to SEQ ID NO: 62611

SEQ ID NO: 567717 - RNA, 64 nt, Homo Sapiens; identical to SEQ ID NO: 62612

SEQ ID NO: 567718 - RNA, 64 nt, Homo Sapiens; identical to SEQ ID NO: 62613

SEQ ID NO: 567719 - RNA, 64 nt, Homo Sapiens; identical to SEQ ID NO: 62614

SEQ ID NO: 567720 - RNA, 64 nt, Homo Sapiens; identical to SEQ ID NO: 62615

SEQ ID NO: 567721 - RNA, 64 nt, Homo Sapiens; identical to SEQ ID NO: 62616

SEQ ID NO: 567722 - RNA, 64 nt, Homo Sapiens; identical to SEQ ID NO: 62617

SEQ ID NO: 567723 - RNA, 64 nt, Homo Sapiens; identical to SEQ ID NO: 62618

SEQ ID NO: 567724 - RNA, 64 nt, Homo Sapiens; identical to SEQ ID NO: 62619

SEQ ID NO: 567725 - RNA, 64 nt, Homo Sapiens; identical to SEQ ID NO: 62620

SEQ ID NO: 567726 - RNA, 64 nt, Homo Sapiens; identical to SEQ ID NO: 62621

SEQ ID NO: 567727 - RNA, 64 nt, Homo Sapiens; identical to SEQ ID NO: 62622

SEQ ID NO: 567728 - RNA, 64 nt, Homo Sapiens; identical to SEQ ID NO: 62623

SEQ ID NO: 567729 - RNA, 64 nt, Homo Sapiens; identical to SEQ ID NO: 62624

SEQ ID NO: 567730 - RNA, 64 nt, Homo Sapiens; identical to SEQ ID NO: 62625

SEQ ID NO: 567731 - RNA, 64 nt, Homo Sapiens; identical to SEQ ID NO: 62626

SEQ ID NO: 567732 - RNA, 64 nt, Homo Sapiens; identical to SEQ ID NO: 62627

SEQ ID NO: 567733 - RNA, 64 nt, Homo Sapiens; identical to SEQ ID NO: 62628

SEQ ID NO: 567734 - RNA, 64 nt, Homo Sapiens; identical to SEQ ID NO: 62629

SEQ ID NO: 567735 - RNA, 63 nt, Homo Sapiens; identical to SEQ ID NO: 62630

SEQ ID NO: 567736 - RNA, 64 nt, Homo Sapiens; identical to SEQ ID NO: 62631

SEQ ID NO: 567737 - RNA, 64 nt, Homo Sapiens; identical to SEQ ID NO: 62632

SEQ ID NO: 567738 - RNA, 64 nt, Homo Sapiens; identical to SEQ ID NO: 62633

SEQ ID NO: 567739 - RNA, 64 nt, Homo Sapiens; identical to SEQ ID NO: 62634

SEQ ID NO: 567740 - RNA, 64 nt, Homo Sapiens; identical to SEQ ID NO: 62635

SEQ ID NO: 567741 - RNA, 64 nt, Homo Sapiens; identical to SEQ ID NO: 62636

SEQ ID NO: 567742 - RNA, 64 nt, Homo Sapiens; identical to SEQ ID NO: 62637

SEQ ID NO: 567743 - RNA, 64 nt, Homo Sapiens; identical to SEQ ID NO: 62638

SEQ ID NO: 567744 - RNA, 64 nt, Homo Sapiens; identical to SEQ ID NO: 62639

SEQ ID NO: 567745 - RNA, 64 nt, Homo Sapiens; identical to SEQ ID NO: 62640

SEQ ID NO: 567746 - RNA, 64 nt, Homo Sapiens; identical to SEQ ID NO: 62641

SEQ ID NO: 567747 - RNA, 64 nt, Homo Sapiens; identical to SEQ ID NO: 62642

SEQ ID NO: 567748 - RNA, 64 nt, Homo Sapiens; identical to SEQ ID NO: 62643

SEQ ID NO: 567749 - RNA, 64 nt, Homo Sapiens; identical to SEQ ID NO: 62644

SEQ ID NO: 567750 - RNA, 64 nt, Homo Sapiens; identical to SEQ ID NO: 62645

SEQ ID NO: 567751 - RNA, 64 nt, Homo Sapiens; identical to SEQ ID NO: 62646

SEQ ID NO: 567752 - RNA, 64 nt, Homo Sapiens; identical to SEQ ID NO: 62647

SEQ ID NO: 567753 - RNA, 64 nt, Homo Sapiens; identical to SEQ ID NO: 62648

SEQ ID NO: 567754 - RNA, 64 nt, Homo Sapiens; identical to SEQ ID NO: 62649

SEQ ID NO: 567755 - RNA, 64 nt, Homo Sapiens; identical to SEQ ID NO: 62650

SEQ ID NO: 567756 - RNA, 64 nt, Homo Sapiens; identical to SEQ ID NO: 62651

SEQ ID NO: 567757 - RNA, 64 nt, Homo Sapiens; identical to SEQ ID NO: 62652

SEQ ID NO: 567758 - RNA, 64 nt, Homo Sapiens; identical to SEQ ID NO: 62653

SEQ ID NO: 567759 - RNA, 64 nt, Homo Sapiens; identical to SEQ ID NO: 62654

SEQ ID NO: 567760 - RNA, 64 nt, Homo Sapiens; identical to SEQ ID NO: 62655

SEQ ID NO: 567761 - RNA, 64 nt, Homo Sapiens; identical to SEQ ID NO: 62656

SEQ ID NO: 567762 - RNA, 64 nt, Homo Sapiens; identical to SEQ ID NO: 62657

SEQ ID NO: 567763 - RNA, 64 nt, Homo Sapiens; identical to SEQ ID NO: 62658

SEQ ID NO: 567764 - RNA, 64 nt, Homo Sapiens; identical to SEQ ID NO: 62659

SEQ ID NO: 567765 - RNA, 64 nt, Homo Sapiens; identical to SEQ ID NO: 62660

SEQ ID NO: 567766 - RNA, 64 nt, Homo Sapiens; identical to SEQ ID NO: 62661

SEQ ID NO: 567767 - RNA, 64 nt, Homo Sapiens; identical to SEQ ID NO: 62662

SEQ ID NO: 567768 - RNA, 64 nt, Homo Sapiens; identical to SEQ ID NO: 62663

SEQ ID NO: 567769 - RNA, 64 nt, Homo Sapiens; identical to SEQ ID NO: 62664

SEQ ID NO: 567770 - RNA, 64 nt, Homo Sapiens; identical to SEQ ID NO: 62665

SEQ ID NO: 567771 - RNA, 64 nt, Homo Sapiens; identical to SEQ ID NO: 62666

SEQ ID NO: 567772 - RNA, 64 nt, Homo Sapiens; identical to SEQ ID NO: 62667

SEQ ID NO: 567773 - RNA, 64 nt, Homo Sapiens; identical to SEQ ID NO: 62668

SEQ ID NO: 567774 - RNA, 64 nt, Homo Sapiens; identical to SEQ ID NO: 62669

SEQ ID NO: 567775 - RNA, 64 nt, Homo Sapiens; identical to SEQ ID NO: 62670

SEQ ID NO: 567776 - RNA, 64 nt, Homo Sapiens; identical to SEQ ID NO: 62671

SEQ ID NO: 567777 - RNA, 64 nt, Homo Sapiens; identical to SEQ ID NO: 62672

SEQ ID NO: 567778 - RNA, 64 nt, Homo Sapiens; identical to SEQ ID NO: 62673

SEQ ID NO: 567779 - RNA, 64 nt, Homo Sapiens; identical to SEQ ID NO: 62674

SEQ ID NO: 567780 - RNA, 64 nt, Homo Sapiens; identical to SEQ ID NO: 62675

SEQ ID NO: 567781 - RNA, 64 nt, Homo Sapiens; identical to SEQ ID NO: 62676

SEQ ID NO: 567782 - RNA, 64 nt, Homo Sapiens; identical to SEQ ID NO: 62677

SEQ ID NO: 567783 - RNA, 64 nt, Homo Sapiens; identical to SEQ ID NO: 62678

SEQ ID NO: 567784 - RNA, 64 nt, Homo Sapiens; identical to SEQ ID NO: 62679

SEQ ID NO: 567785 - RNA, 64 nt, Homo Sapiens; identical to SEQ ID NO: 62680

SEQ ID NO: 567786 - RNA, 64 nt, Homo Sapiens; identical to SEQ ID NO: 62681

SEQ ID NO: 567787 - RNA, 64 nt, Homo Sapiens; identical to SEQ ID NO: 62682

SEQ ID NO: 567788 - RNA, 64 nt, Homo Sapiens; identical to SEQ ID NO: 62683

SEQ ID NO: 567789 - RNA, 64 nt, Homo Sapiens; identical to SEQ ID NO: 62684

SEQ ID NO: 567790 - RNA, 64 nt, Homo Sapiens; identical to SEQ ID NO: 62685

SEQ ID NO: 567791 - RNA, 64 nt, Homo Sapiens; identical to SEQ ID NO: 62686

SEQ ID NO: 567792 - RNA, 64 nt, Homo Sapiens; identical to SEQ ID NO: 62687

SEQ ID NO: 567793 - RNA, 64 nt, Homo Sapiens; identical to SEQ ID NO: 62688

SEQ ID NO: 567794 - RNA, 64 nt, Homo Sapiens; identical to SEQ ID NO: 62689

SEQ ID NO: 567795 - RNA, 64 nt, Homo Sapiens; identical to SEQ ID NO: 62690

SEQ ID NO: 567796 - RNA, 64 nt, Homo Sapiens; identical to SEQ ID NO: 62691

SEQ ID NO: 567797 - RNA, 64 nt, Homo Sapiens; identical to SEQ ID NO: 62692

SEQ ID NO: 567798 - RNA, 64 nt, Homo Sapiens; identical to SEQ ID NO: 62693

SEQ ID NO: 567799 - RNA, 64 nt, Homo Sapiens; identical to SEQ ID NO: 62694

SEQ ID NO: 567800 - RNA, 64 nt, Homo Sapiens; identical to SEQ ID NO: 62695

SEQ ID NO: 567801 - RNA, 64 nt, Homo Sapiens; identical to SEQ ID NO: 62696

SEQ ID NO: 567802 - RNA, 64 nt, Homo Sapiens; identical to SEQ ID NO: 62697

SEQ ID NO: 567803 - RNA, 64 nt, Homo Sapiens; identical to SEQ ID NO: 62698

SEQ ID NO: 567804 - RNA, 64 nt, Homo Sapiens; identical to SEQ ID NO: 62699

SEQ ID NO: 567805 - RNA, 64 nt, Homo Sapiens; identical to SEQ ID NO: 62700

SEQ ID NO: 567806 - RNA, 64 nt, Homo Sapiens; identical to SEQ ID NO: 62701

SEQ ID NO: 567807 - RNA, 64 nt, Homo Sapiens; identical to SEQ ID NO: 62702

SEQ ID NO: 567808 - RNA, 64 nt, Homo Sapiens; identical to SEQ ID NO: 62703

SEQ ID NO: 567809 - RNA, 64 nt, Homo Sapiens; identical to SEQ ID NO: 62704

SEQ ID NO: 567810 - RNA, 64 nt, Homo Sapiens; identical to SEQ ID NO: 62705

SEQ ID NO: 567811 - RNA, 64 nt, Homo Sapiens; identical to SEQ ID NO: 62706

SEQ ID NO: 567812 - RNA, 64 nt, Homo Sapiens; identical to SEQ ID NO: 62707

SEQ ID NO: 567813 - RNA, 64 nt, Homo Sapiens; identical to SEQ ID NO: 62708

SEQ ID NO: 567814 - RNA, 64 nt, Homo Sapiens; identical to SEQ ID NO: 62709

SEQ ID NO: 567815 - RNA, 64 nt, Homo Sapiens; identical to SEQ ID NO: 62710

SEQ ID NO: 567816 - RNA, 64 nt, Homo Sapiens; identical to SEQ ID NO: 62711

SEQ ID NO: 567817 - RNA, 64 nt, Homo Sapiens; identical to SEQ ID NO: 62712

SEQ ID NO: 567818 - RNA, 64 nt, Homo Sapiens; identical to SEQ ID NO: 62713

SEQ ID NO: 567819 - RNA, 64 nt, Homo Sapiens; identical to SEQ ID NO: 62714

SEQ ID NO: 567820 - RNA, 64 nt, Homo Sapiens; identical to SEQ ID NO: 62715

SEQ ID NO: 567821 - RNA, 64 nt, Homo Sapiens; identical to SEQ ID NO: 62716

SEQ ID NO: 567822 - RNA, 64 nt, Homo Sapiens; identical to SEQ ID NO: 62717

SEQ ID NO: 567823 - RNA, 64 nt, Homo Sapiens; identical to SEQ ID NO: 62718

SEQ ID NO: 567824 - RNA, 64 nt, Homo Sapiens; identical to SEQ ID NO: 62719

SEQ ID NO: 567825 - RNA, 64 nt, Homo Sapiens; identical to SEQ ID NO: 62720

SEQ ID NO: 567826 - RNA, 64 nt, Homo Sapiens; identical to SEQ ID NO: 62721

SEQ ID NO: 567827 - RNA, 64 nt, Homo Sapiens; identical to SEQ ID NO: 62722

SEQ ID NO: 567828 - RNA, 64 nt, Homo Sapiens; identical to SEQ ID NO: 62723

SEQ ID NO: 567829 - RNA, 64 nt, Homo Sapiens; identical to SEQ ID NO: 62724

SEQ ID NO: 567830 - RNA, 64 nt, Homo Sapiens; identical to SEQ ID NO: 62725

SEQ ID NO: 567831 - RNA, 64 nt, Homo Sapiens; identical to SEQ ID NO: 62726

SEQ ID NO: 567832 - RNA, 62 nt, Homo Sapiens; identical to SEQ ID NO: 62727

SEQ ID NO: 567833 - RNA, 64 nt, Homo Sapiens; identical to SEQ ID NO: 62728

SEQ ID NO: 567834 - RNA, 64 nt, Homo Sapiens; identical to SEQ ID NO: 62729

SEQ ID NO: 567835 - RNA, 64 nt, Homo Sapiens; identical to SEQ ID NO: 62730

SEQ ID NO: 567836 - RNA, 64 nt, Homo Sapiens; identical to SEQ ID NO: 62731

SEQ ID NO: 567837 - RNA, 64 nt, Homo Sapiens; identical to SEQ ID NO: 62732

SEQ ID NO: 567838 - RNA, 64 nt, Homo Sapiens; identical to SEQ ID NO: 62733

SEQ ID NO: 567839 - RNA, 64 nt, Homo Sapiens; identical to SEQ ID NO: 62734

SEQ ID NO: 567840 - RNA, 64 nt, Homo Sapiens; identical to SEQ ID NO: 62735

SEQ ID NO: 567841 - RNA, 64 nt, Homo Sapiens; identical to SEQ ID NO: 62736

SEQ ID NO: 567842 - RNA, 64 nt, Homo Sapiens; identical to SEQ ID NO: 62737

SEQ ID NO: 567843 - RNA, 64 nt, Homo Sapiens; identical to SEQ ID NO: 62738

SEQ ID NO: 567844 - RNA, 64 nt, Homo Sapiens; identical to SEQ ID NO: 62739

SEQ ID NO: 567845 - RNA, 64 nt, Homo Sapiens; identical to SEQ ID NO: 62740

SEQ ID NO: 567846 - RNA, 64 nt, Homo Sapiens; identical to SEQ ID NO: 62741

SEQ ID NO: 567847 - RNA, 64 nt, Homo Sapiens; identical to SEQ ID NO: 62742

SEQ ID NO: 567848 - RNA, 64 nt, Homo Sapiens; identical to SEQ ID NO: 62743

SEQ ID NO: 567849 - RNA, 64 nt, Homo Sapiens; identical to SEQ ID NO: 62744

SEQ ID NO: 567850 - RNA, 64 nt, Homo Sapiens; identical to SEQ ID NO: 62745

SEQ ID NO: 567851 - RNA, 64 nt, Homo Sapiens; identical to SEQ ID NO: 62746

SEQ ID NO: 567852 - RNA, 64 nt, Homo Sapiens; identical to SEQ ID NO: 62747

SEQ ID NO: 567853 - RNA, 64 nt, Homo Sapiens; identical to SEQ ID NO: 62748

SEQ ID NO: 567854 - RNA, 64 nt, Homo Sapiens; identical to SEQ ID NO: 62749

SEQ ID NO: 567855 - RNA, 64 nt, Homo Sapiens; identical to SEQ ID NO: 62750

SEQ ID NO: 567856 - RNA, 64 nt, Homo Sapiens; identical to SEQ ID NO: 62751

SEQ ID NO: 567857 - RNA, 64 nt, Homo Sapiens; identical to SEQ ID NO: 62752

SEQ ID NO: 567858 - RNA, 64 nt, Homo Sapiens; identical to SEQ ID NO: 62753

SEQ ID NO: 567859 - RNA, 64 nt, Homo Sapiens; identical to SEQ ID NO: 62754

SEQ ID NO: 567860 - RNA, 64 nt, Homo Sapiens; identical to SEQ ID NO: 62755

SEQ ID NO: 567861 - RNA, 64 nt, Homo Sapiens; identical to SEQ ID NO: 62756

SEQ ID NO: 567862 - RNA, 64 nt, Homo Sapiens; identical to SEQ ID NO: 62757

SEQ ID NO: 567863 - RNA, 64 nt, Homo Sapiens; identical to SEQ ID NO: 62758

SEQ ID NO: 567864 - RNA, 64 nt, Homo Sapiens; identical to SEQ ID NO: 62759

SEQ ID NO: 567865 - RNA, 64 nt, Homo Sapiens; identical to SEQ ID NO: 62760

SEQ ID NO: 567866 - RNA, 64 nt, Homo Sapiens; identical to SEQ ID NO: 62761

SEQ ID NO: 567867 - RNA, 64 nt, Homo Sapiens; identical to SEQ ID NO: 62762

SEQ ID NO: 567868 - RNA, 64 nt, Homo Sapiens; identical to SEQ ID NO: 62763

SEQ ID NO: 567869 - RNA, 64 nt, Homo Sapiens; identical to SEQ ID NO: 62764

SEQ ID NO: 567870 - RNA, 64 nt, Homo Sapiens; identical to SEQ ID NO: 62765

SEQ ID NO: 567871 - RNA, 64 nt, Homo Sapiens; identical to SEQ ID NO: 62766

SEQ ID NO: 567872 - RNA, 64 nt, Homo Sapiens; identical to SEQ ID NO: 62767

SEQ ID NO: 567873 - RNA, 64 nt, Homo Sapiens; identical to SEQ ID NO: 62768

SEQ ID NO: 567874 - RNA, 64 nt, Homo Sapiens; identical to SEQ ID NO: 62769

SEQ ID NO: 567875 - RNA, 64 nt, Homo Sapiens; identical to SEQ ID NO: 62770

SEQ ID NO: 567876 - RNA, 64 nt, Homo Sapiens; identical to SEQ ID NO: 62771

SEQ ID NO: 567877 - RNA, 64 nt, Homo Sapiens; identical to SEQ ID NO: 62772

SEQ ID NO: 567878 - RNA, 64 nt, Homo Sapiens; identical to SEQ ID NO: 62773

SEQ ID NO: 567879 - RNA, 64 nt, Homo Sapiens; identical to SEQ ID NO: 62774

SEQ ID NO: 567880 - RNA, 64 nt, Homo Sapiens; identical to SEQ ID NO: 62775

SEQ ID NO: 567881 - RNA, 64 nt, Homo Sapiens; identical to SEQ ID NO: 62776

SEQ ID NO: 567882 - RNA, 64 nt, Homo Sapiens; identical to SEQ ID NO: 62777

SEQ ID NO: 567883 - RNA, 64 nt, Homo Sapiens; identical to SEQ ID NO: 62778

SEQ ID NO: 567884 - RNA, 64 nt, Homo Sapiens; identical to SEQ ID NO: 62779

SEQ ID NO: 567885 - RNA, 64 nt, Homo Sapiens; identical to SEQ ID NO: 62780

SEQ ID NO: 567886 - RNA, 64 nt, Homo Sapiens; identical to SEQ ID NO: 62781

SEQ ID NO: 567887 - RNA, 64 nt, Homo Sapiens; identical to SEQ ID NO: 62782

SEQ ID NO: 567888 - RNA, 64 nt, Homo Sapiens; identical to SEQ ID NO: 62783

SEQ ID NO: 567889 - RNA, 64 nt, Homo Sapiens; identical to SEQ ID NO: 62784

SEQ ID NO: 567890 - RNA, 64 nt, Homo Sapiens; identical to SEQ ID NO: 62785

SEQ ID NO: 567891 - RNA, 64 nt, Homo Sapiens; identical to SEQ ID NO: 62786

SEQ ID NO: 567892 - RNA, 64 nt, Homo Sapiens; identical to SEQ ID NO: 62787

SEQ ID NO: 567893 - RNA, 64 nt, Homo Sapiens; identical to SEQ ID NO: 62788

SEQ ID NO: 567894 - RNA, 64 nt, Homo Sapiens; identical to SEQ ID NO: 62789

SEQ ID NO: 567895 - RNA, 64 nt, Homo Sapiens; identical to SEQ ID NO: 62790

SEQ ID NO: 567896 - RNA, 64 nt, Homo Sapiens; identical to SEQ ID NO: 62791

SEQ ID NO: 567897 - RNA, 64 nt, Homo Sapiens; identical to SEQ ID NO: 62792

SEQ ID NO: 567898 - RNA, 64 nt, Homo Sapiens; identical to SEQ ID NO: 62793

SEQ ID NO: 567899 - RNA, 64 nt, Homo Sapiens; identical to SEQ ID NO: 62794

SEQ ID NO: 567900 - RNA, 64 nt, Homo Sapiens; identical to SEQ ID NO: 62795

SEQ ID NO: 567901 - RNA, 64 nt, Homo Sapiens; identical to SEQ ID NO: 62796

SEQ ID NO: 567902 - RNA, 64 nt, Homo Sapiens; identical to SEQ ID NO: 62797

SEQ ID NO: 567903 - RNA, 64 nt, Homo Sapiens; identical to SEQ ID NO: 62798

SEQ ID NO: 567904 - RNA, 64 nt, Homo Sapiens; identical to SEQ ID NO: 62799

SEQ ID NO: 567905 - RNA, 64 nt, Homo Sapiens; identical to SEQ ID NO: 62800

SEQ ID NO: 567906 - RNA, 64 nt, Homo Sapiens; identical to SEQ ID NO: 62801

SEQ ID NO: 567907 - RNA, 64 nt, Homo Sapiens; identical to SEQ ID NO: 62802

SEQ ID NO: 567908 - RNA, 64 nt, Homo Sapiens; identical to SEQ ID NO: 62803

SEQ ID NO: 567909 - RNA, 64 nt, Homo Sapiens; identical to SEQ ID NO: 62804

SEQ ID NO: 567910 - RNA, 64 nt, Homo Sapiens; identical to SEQ ID NO: 62805

SEQ ID NO: 567911 - RNA, 64 nt, Homo Sapiens; identical to SEQ ID NO: 62806

SEQ ID NO: 567912 - RNA, 64 nt, Homo Sapiens; identical to SEQ ID NO: 62807

SEQ ID NO: 567913 - RNA, 64 nt, Homo Sapiens; identical to SEQ ID NO: 62808

SEQ ID NO: 567914 - RNA, 64 nt, Homo Sapiens; identical to SEQ ID NO: 62809

SEQ ID NO: 567915 - RNA, 64 nt, Homo Sapiens; identical to SEQ ID NO: 62810

SEQ ID NO: 567916 - RNA, 64 nt, Homo Sapiens; identical to SEQ ID NO: 62811

SEQ ID NO: 567917 - RNA, 64 nt, Homo Sapiens; identical to SEQ ID NO: 62812

SEQ ID NO: 567918 - RNA, 64 nt, Homo Sapiens; identical to SEQ ID NO: 62813

SEQ ID NO: 567919 - RNA, 64 nt, Homo Sapiens; identical to SEQ ID NO: 62814

SEQ ID NO: 567920 - RNA, 64 nt, Homo Sapiens; identical to SEQ ID NO: 62815

SEQ ID NO: 567921 - RNA, 64 nt, Homo Sapiens; identical to SEQ ID NO: 62816

SEQ ID NO: 567922 - RNA, 64 nt, Homo Sapiens; identical to SEQ ID NO: 62817

SEQ ID NO: 567923 - RNA, 64 nt, Homo Sapiens; identical to SEQ ID NO: 62818

SEQ ID NO: 567924 - RNA, 64 nt, Homo Sapiens; identical to SEQ ID NO: 62819

SEQ ID NO: 567925 - RNA, 64 nt, Homo Sapiens; identical to SEQ ID NO: 62820

SEQ ID NO: 567926 - RNA, 64 nt, Homo Sapiens; identical to SEQ ID NO: 62821

SEQ ID NO: 567927 - RNA, 64 nt, Homo Sapiens; identical to SEQ ID NO: 62822

SEQ ID NO: 567928 - RNA, 64 nt, Homo Sapiens; identical to SEQ ID NO: 62823

SEQ ID NO: 567929 - RNA, 64 nt, Homo Sapiens; identical to SEQ ID NO: 62824

SEQ ID NO: 567930 - RNA, 64 nt, Homo Sapiens; identical to SEQ ID NO: 62825

SEQ ID NO: 567931 - RNA, 64 nt, Homo Sapiens; identical to SEQ ID NO: 62826

SEQ ID NO: 567932 - RNA, 64 nt, Homo Sapiens; identical to SEQ ID NO: 62827

SEQ ID NO: 567933 - RNA, 64 nt, Homo Sapiens; identical to SEQ ID NO: 62828

SEQ ID NO: 567934 - RNA, 64 nt, Homo Sapiens; identical to SEQ ID NO: 62829

SEQ ID NO: 567935 - RNA, 64 nt, Homo Sapiens; identical to SEQ ID NO: 62830

SEQ ID NO: 567936 - RNA, 64 nt, Homo Sapiens; identical to SEQ ID NO: 62831

SEQ ID NO: 567937 - RNA, 64 nt, Homo Sapiens; identical to SEQ ID NO: 62832

SEQ ID NO: 567938 - RNA, 64 nt, Homo Sapiens; identical to SEQ ID NO: 62833

SEQ ID NO: 567939 - RNA, 64 nt, Homo Sapiens; identical to SEQ ID NO: 62834

SEQ ID NO: 567940 - RNA, 64 nt, Homo Sapiens; identical to SEQ ID NO: 62835

SEQ ID NO: 567941 - RNA, 64 nt, Homo Sapiens; identical to SEQ ID NO: 62836

SEQ ID NO: 567942 - RNA, 64 nt, Homo Sapiens; identical to SEQ ID NO: 62837

SEQ ID NO: 567943 - RNA, 64 nt, Homo Sapiens; identical to SEQ ID NO: 62838

SEQ ID NO: 567944 - RNA, 64 nt, Homo Sapiens; identical to SEQ ID NO: 62839

SEQ ID NO: 567945 - RNA, 64 nt, Homo Sapiens; identical to SEQ ID NO: 62840

SEQ ID NO: 567946 - RNA, 64 nt, Homo Sapiens; identical to SEQ ID NO: 62841

SEQ ID NO: 567947 - RNA, 64 nt, Homo Sapiens; identical to SEQ ID NO: 62842

SEQ ID NO: 567948 - RNA, 64 nt, Homo Sapiens; identical to SEQ ID NO: 62843

SEQ ID NO: 567949 - RNA, 64 nt, Homo Sapiens; identical to SEQ ID NO: 62844

SEQ ID NO: 567950 - RNA, 64 nt, Homo Sapiens; identical to SEQ ID NO: 62845

SEQ ID NO: 567951 - RNA, 64 nt, Homo Sapiens; identical to SEQ ID NO: 62846

SEQ ID NO: 567952 - RNA, 64 nt, Homo Sapiens; identical to SEQ ID NO: 62847

SEQ ID NO: 567953 - RNA, 64 nt, Homo Sapiens; identical to SEQ ID NO: 62848

SEQ ID NO: 567954 - RNA, 64 nt, Homo Sapiens; identical to SEQ ID NO: 62849

SEQ ID NO: 567955 - RNA, 64 nt, Homo Sapiens; identical to SEQ ID NO: 62850

SEQ ID NO: 567956 - RNA, 64 nt, Homo Sapiens; identical to SEQ ID NO: 62851

SEQ ID NO: 567957 - RNA, 64 nt, Homo Sapiens; identical to SEQ ID NO: 62852

SEQ ID NO: 567958 - RNA, 64 nt, Homo Sapiens; identical to SEQ ID NO: 62853

SEQ ID NO: 567959 - RNA, 64 nt, Homo Sapiens; identical to SEQ ID NO: 62854

SEQ ID NO: 567960 - RNA, 64 nt, Homo Sapiens; identical to SEQ ID NO: 62855

SEQ ID NO: 567961 - RNA, 64 nt, Homo Sapiens; identical to SEQ ID NO: 62856

SEQ ID NO: 567962 - RNA, 64 nt, Homo Sapiens; identical to SEQ ID NO: 62857

SEQ ID NO: 567963 - RNA, 64 nt, Homo Sapiens; identical to SEQ ID NO: 62858

SEQ ID NO: 567964 - RNA, 64 nt, Homo Sapiens; identical to SEQ ID NO: 62859

SEQ ID NO: 567965 - RNA, 64 nt, Homo Sapiens; identical to SEQ ID NO: 62860

SEQ ID NO: 567966 - RNA, 64 nt, Homo Sapiens; identical to SEQ ID NO: 62861

SEQ ID NO: 567967 - RNA, 64 nt, Homo Sapiens; identical to SEQ ID NO: 62862

SEQ ID NO: 567968 - RNA, 64 nt, Homo Sapiens; identical to SEQ ID NO: 62863

SEQ ID NO: 567969 - RNA, 64 nt, Homo Sapiens; identical to SEQ ID NO: 62864

SEQ ID NO: 567970 - RNA, 64 nt, Homo Sapiens; identical to SEQ ID NO: 62865

SEQ ID NO: 567971 - RNA, 64 nt, Homo Sapiens; identical to SEQ ID NO: 62866

SEQ ID NO: 567972 - RNA, 64 nt, Homo Sapiens; identical to SEQ ID NO: 62867

SEQ ID NO: 567973 - RNA, 64 nt, Homo Sapiens; identical to SEQ ID NO: 62868

SEQ ID NO: 567974 - RNA, 64 nt, Homo Sapiens; identical to SEQ ID NO: 62869

SEQ ID NO: 567975 - RNA, 64 nt, Homo Sapiens; identical to SEQ ID NO: 62870

SEQ ID NO: 567976 - RNA, 64 nt, Homo Sapiens; identical to SEQ ID NO: 62871

SEQ ID NO: 567977 - RNA, 64 nt, Homo Sapiens; identical to SEQ ID NO: 62872

SEQ ID NO: 567978 - RNA, 64 nt, Homo Sapiens; identical to SEQ ID NO: 62873

SEQ ID NO: 567979 - RNA, 64 nt, Homo Sapiens; identical to SEQ ID NO: 62874

SEQ ID NO: 567980 - RNA, 64 nt, Homo Sapiens; identical to SEQ ID NO: 62875

SEQ ID NO: 567981 - RNA, 64 nt, Homo Sapiens; identical to SEQ ID NO: 62876

SEQ ID NO: 567982 - RNA, 64 nt, Homo Sapiens; identical to SEQ ID NO: 62877

SEQ ID NO: 567983 - RNA, 64 nt, Homo Sapiens; identical to SEQ ID NO: 62878

SEQ ID NO: 567984 - RNA, 64 nt, Homo Sapiens; identical to SEQ ID NO: 62879

SEQ ID NO: 567985 - RNA, 64 nt, Homo Sapiens; identical to SEQ ID NO: 62880

SEQ ID NO: 567986 - RNA, 64 nt, Homo Sapiens; identical to SEQ ID NO: 62881

SEQ ID NO: 567987 - RNA, 64 nt, Homo Sapiens; identical to SEQ ID NO: 62882

SEQ ID NO: 567988 - RNA, 64 nt, Homo Sapiens; identical to SEQ ID NO: 62883

SEQ ID NO: 567989 - RNA, 64 nt, Homo Sapiens; identical to SEQ ID NO: 62884

SEQ ID NO: 567990 - RNA, 64 nt, Homo Sapiens; identical to SEQ ID NO: 62885

SEQ ID NO: 567991 - RNA, 64 nt, Homo Sapiens; identical to SEQ ID NO: 62886

SEQ ID NO: 567992 - RNA, 64 nt, Homo Sapiens; identical to SEQ ID NO: 62887

SEQ ID NO: 567993 - RNA, 64 nt, Homo Sapiens; identical to SEQ ID NO: 62888

SEQ ID NO: 567994 - RNA, 64 nt, Homo Sapiens; identical to SEQ ID NO: 62889

SEQ ID NO: 567995 - RNA, 64 nt, Homo Sapiens; identical to SEQ ID NO: 62890

SEQ ID NO: 567996 - RNA, 64 nt, Homo Sapiens; identical to SEQ ID NO: 62891

SEQ ID NO: 567997 - RNA, 64 nt, Homo Sapiens; identical to SEQ ID NO: 62892

SEQ ID NO: 567998 - RNA, 64 nt, Homo Sapiens; identical to SEQ ID NO: 62893

SEQ ID NO: 567999 - RNA, 64 nt, Homo Sapiens; identical to SEQ ID NO: 62894

SEQ ID NO: 568000 - RNA, 64 nt, Homo Sapiens; identical to SEQ ID NO: 62895

SEQ ID NO: 568001 - RNA, 64 nt, Homo Sapiens; identical to SEQ ID NO: 62896

SEQ ID NO: 568002 - RNA, 64 nt, Homo Sapiens; identical to SEQ ID NO: 62897

SEQ ID NO: 568003 - RNA, 64 nt, Homo Sapiens; identical to SEQ ID NO: 62898

SEQ ID NO: 568004 - RNA, 64 nt, Homo Sapiens; identical to SEQ ID NO: 62899

SEQ ID NO: 568005 - RNA, 64 nt, Homo Sapiens; identical to SEQ ID NO: 62900

SEQ ID NO: 568006 - RNA, 64 nt, Homo Sapiens; identical to SEQ ID NO: 62901

SEQ ID NO: 568007 - RNA, 64 nt, Homo Sapiens; identical to SEQ ID NO: 62902

SEQ ID NO: 568008 - RNA, 64 nt, Homo Sapiens; identical to SEQ ID NO: 62903

SEQ ID NO: 568009 - RNA, 64 nt, Homo Sapiens; identical to SEQ ID NO: 62904

SEQ ID NO: 568010 - RNA, 64 nt, Homo Sapiens; identical to SEQ ID NO: 62905

SEQ ID NO: 568011 - RNA, 64 nt, Homo Sapiens; identical to SEQ ID NO: 62906

SEQ ID NO: 568012 - RNA, 64 nt, Homo Sapiens; identical to SEQ ID NO: 62907

SEQ ID NO: 568013 - RNA, 64 nt, Homo Sapiens; identical to SEQ ID NO: 62908

SEQ ID NO: 568014 - RNA, 64 nt, Homo Sapiens; identical to SEQ ID NO: 62909

SEQ ID NO: 568015 - RNA, 64 nt, Homo Sapiens; identical to SEQ ID NO: 62910

SEQ ID NO: 568016 - RNA, 64 nt, Homo Sapiens; identical to SEQ ID NO: 62911

SEQ ID NO: 568017 - RNA, 64 nt, Homo Sapiens; identical to SEQ ID NO: 62912

SEQ ID NO: 568018 - RNA, 64 nt, Homo Sapiens; identical to SEQ ID NO: 62913

SEQ ID NO: 568019 - RNA, 64 nt, Homo Sapiens; identical to SEQ ID NO: 62914

SEQ ID NO: 568020 - RNA, 64 nt, Homo Sapiens; identical to SEQ ID NO: 62915

SEQ ID NO: 568021 - RNA, 64 nt, Homo Sapiens; identical to SEQ ID NO: 62916

SEQ ID NO: 568022 - RNA, 64 nt, Homo Sapiens; identical to SEQ ID NO: 62917

SEQ ID NO: 568023 - RNA, 64 nt, Homo Sapiens; identical to SEQ ID NO: 62918

SEQ ID NO: 568024 - RNA, 64 nt, Homo Sapiens; identical to SEQ ID NO: 62919

SEQ ID NO: 568025 - RNA, 64 nt, Homo Sapiens; identical to SEQ ID NO: 62920

SEQ ID NO: 568026 - RNA, 64 nt, Homo Sapiens; identical to SEQ ID NO: 62921

SEQ ID NO: 568027 - RNA, 64 nt, Homo Sapiens; identical to SEQ ID NO: 62922

SEQ ID NO: 568028 - RNA, 64 nt, Homo Sapiens; identical to SEQ ID NO: 62923

SEQ ID NO: 568029 - RNA, 64 nt, Homo Sapiens; identical to SEQ ID NO: 62924

SEQ ID NO: 568030 - RNA, 64 nt, Homo Sapiens; identical to SEQ ID NO: 62925

SEQ ID NO: 568031 - RNA, 64 nt, Homo Sapiens; identical to SEQ ID NO: 62926

SEQ ID NO: 568032 - RNA, 64 nt, Homo Sapiens; identical to SEQ ID NO: 62927

SEQ ID NO: 568033 - RNA, 64 nt, Homo Sapiens; identical to SEQ ID NO: 62928

SEQ ID NO: 568034 - RNA, 64 nt, Homo Sapiens; identical to SEQ ID NO: 62929

SEQ ID NO: 568035 - RNA, 64 nt, Homo Sapiens; identical to SEQ ID NO: 62930

SEQ ID NO: 568036 - RNA, 64 nt, Homo Sapiens; identical to SEQ ID NO: 62931

SEQ ID NO: 568037 - RNA, 64 nt, Homo Sapiens; identical to SEQ ID NO: 62930

SEQ ID NO: 568038 - RNA, 64 nt, Homo Sapiens; identical to SEQ ID NO: 62931

SEQ ID NO: 568039 - RNA, 64 nt, Homo Sapiens; identical to SEQ ID NO: 62934

SEQ ID NO: 568040 - RNA, 64 nt, Homo Sapiens; identical to SEQ ID NO: 62935

SEQ ID NO: 568041 - RNA, 64 nt, Homo Sapiens
gaaacuaauauaccucaguauuccaucauggucugaaagucaaacuucggcaaggcacggacga

SEQ ID NO: 568042 - RNA, 64 nt, Homo Sapiens
ugggguccuguuaaaccacagacaguuaugaacugaaagucauaacggggagaggugccuggcu

SEQ ID NO: 568043 - RNA, 64 nt, Homo Sapiens
auucggagcuagaggacauggaaaauaaagccaggaaagucaaaaaaacgaaagagaaggagaa

SEQ ID NO: 568044 - RNA, 64 nt, Homo Sapiens
aagagaaggagaagaaaaaggaaaagggcaaauugaaagucaaggagaaaaagcgcaaagagga

SEQ ID NO: 568045 - RNA, 64 nt, Homo Sapiens
uaagugugaguaaaguuaguaucucaggauaugagaaagucaaugaaauaguuuucuuagauua

SEQ ID NO: 568046 - RNA, 64 nt, Homo Sapiens
gcaaaauuaugaauaggauauuuaauuuuauauugaaagucaguuuauuuuguguaagcagaga

SEQ ID NO: 568047 - RNA, 64 nt, Homo Sapiens
gaauuaaguucuaguucugauuuuuaaaaaaugugaaagucaaauuaugaucccagcaauacac

SEQ ID NO: 568048 - RNA, 64 nt, Homo Sapiens
ugauucuacaauuggacauuguagccaugacauggaaagucaacaaauuaccuacuaaacagug

SEQ ID NO: 568049 - RNA, 64 nt, Homo Sapiens
aagcaaaaugccuugaguguuguuuggccuuucagaaagucaacacacucuccuaauaagcaga

SEQ ID NO: 568050 - RNA, 64 nt, Homo Sapiens
caaaaccgcucaacugcauggaccucaggauugagaaagucacuaccacauugcaaucacacua

SEQ ID NO: 568051 - RNA, 64 nt, Homo Sapiens
gauuaugccggcgguuagaagucggugcacagcugaaagucagcugggcugagcuggggaacau

SEQ ID NO: 568052 - RNA, 64 nt, Homo Sapiens
aacaaagccagccgugaaaaaagcgaucugacaugaaagucauuugaggcauagccagcuucaa

SEQ ID NO: 568053 - RNA, 64 nt, Homo Sapiens
aacccaguaaccauaagaaauuaugaguuguggguuucaucacucauauuccauaguguguggu

SEQ ID NO: 568054 - RNA, 64 nt, Homo Sapiens
uguuuuaugaauuuauccaugaacaaucugcuuuuuucaucauuuguuuaaagaaguacuccaa

SEQ ID NO: 568055 - RNA, 64 nt, Homo Sapiens
gccuccaaccuaauuugaguuucauuuguauuuuuuucaucaccuuacauguguuaacagcugu

SEQ ID NO: 568056 - RNA, 64 nt, Homo Sapiens
aggaugcacuauauucauggguaggaaagauuaguuucaucaagauuucaauuuuuaucaauuc

SEQ ID NO: 568057 - RNA, 64 nt, Homo Sapiens
guucugaguugucagaucucuugaagacaauauuuuucaucacuuauuguuuacuaaagcuaca

SEQ ID NO: 568058 - RNA, 64 nt, Homo Sapiens
guaaagaagaggggaaacccagccagcuacuuuuuuucaucacuuuuuauucauaacuucagau

SEQ ID NO: 568059 - RNA, 64 nt, Homo Sapiens
gauuaaaaaaagaaaaccacuauuuucaucauaauuucaucauuugguuucugcuuucauugac

SEQ ID NO: 568060 - RNA, 64 nt, Homo Sapiens
auuucaucauugauuaaaaacuuucauugacuauuuucaucauaaguaguaaaguugguuucug

SEQ ID NO: 568061 - RNA, 64 nt, Homo Sapiens
gaaccuuuucaaacuuuucugaaaugcaaggugcuuucaucaaucaaaauauugaaguucaucu

SEQ ID NO: 568062 - RNA, 64 nt, Homo Sapiens
aucuauucaaauauacaggugccuguauggccccuuucaucaauugauggugcacuacucugag

SEQ ID NO: 568063 - RNA, 64 nt, Homo Sapiens
acuuguuuucccagcaucauugacucagcacuguuuucaucacaguuaauaaucuauauuuauu

SEQ ID NO: 568064 - RNA, 64 nt, Homo Sapiens
aguaugugugcgugagcugguggaguuauguggauuucaucacugccauguagaggaaaagaua

SEQ ID NO: 568065 - RNA, 64 nt, Homo Sapiens
aguaucuguuacacauuagaaguaguugucacuauuucaucaucuugguuuuucauuuguuuua

SEQ ID NO: 568066 - RNA, 64 nt, Homo Sapiens
guauuuuugaauuauuuauauaaaauaucuaucuuuucaucaugucuauaguuccugagauuuu

SEQ ID NO: 568067 - RNA, 64 nt, Homo Sapiens
aacaaaagugccucaucauaauuuguucuuuugguuucaucacucuggcaucagugugcagcaa

SEQ ID NO: 568068 - RNA, 64 nt, Homo Sapiens
uugcacugugaaauagcuuuuucauuugggcugguuucaucauuagaauuguuauuaugcagcc

SEQ ID NO: 568069 - RNA, 64 nt, Homo Sapiens
cuaggaucaugaagugcuauugcccuggucuugcuuucaucacuacaggugacugugaaacaga

SEQ ID NO: 568070 - RNA, 64 nt, Homo Sapiens
gcuggcugauuucuccauagggcaggacucauuuuuucaucaugcaugaagcuggcagauaguc

SEQ ID NO: 568071 - RNA, 64 nt, Homo Sapiens
ggccuguagguagcaaaugcaggauuuuguuuacuuucaucaugucaugugguggucagacugc

SEQ ID NO: 568072 - RNA, 64 nt, Homo Sapiens
cagacugcucgcugguggccucgcuuuagaagguuuucaucaagccccgcccuuucucucucau

SEQ ID NO: 568073 - RNA, 64 nt, Homo Sapiens
auuaauuaaaauuugggaccaguaaucugucgcauuucaucaagacucucaauugaguuaaauc

SEQ ID NO: 568074 - RNA, 64 nt, Homo Sapiens
aaaaguccgaaaagcaaaccgauccaacuauuucuuucaucagagcugugaaucuguugaugga

SEQ ID NO: 568075 - RNA, 64 nt, Homo Sapiens
caaaagugaguguuucuauuugagaaggacacuuuuucaucaucuaaacugauucgcauaggug

SEQ ID NO: 568076 - RNA, 64 nt, Homo Sapiens
aucauugcuuuauaguagcuuauaucaauuuagauuucaucauuacuauuuugcauacuggaau

SEQ ID NO: 568077 - RNA, 64 nt, Homo Sapiens
ugggaucagcuauauggcaauguuuuagaaugguuuucaucaguuuaagugaauuaauuauuga

SEQ ID NO: 568078 - RNA, 64 nt, Homo Sapiens
uuagccaggauggucuugauuuaguagagacggguuucaucaugccggcuacuuuuuuauauuu

SEQ ID NO: 568079 - RNA, 64 nt, Homo Sapiens
agccuuggaaugggcauaaguuguauguccuacauuucaucauugucccgggccugcauugcac

SEQ ID NO: 568080 - RNA, 64 nt, Homo Sapiens
cagguaaguguauaaaagagauuaagugcuuuuuuuucaucacuugauuauuuucuuuaaaauc

SEQ ID NO: 568081 - RNA, 64 nt, Homo Sapiens
guugccuaugcccagggaauagguaaguugcuauuuucaucacaucugaaaacaucuagcccaa

SEQ ID NO: 568082 - RNA, 64 nt, Homo Sapiens
aagcagccuuugugguuuaguggauaaguggcuguuucaucaguuaguuuuuggaaaaaccuug

SEQ ID NO: 568083 - RNA, 64 nt, Homo Sapiens
gcuucauacgacauggaguuaaaaaguaacauauuuucaucauuccuuuuuauuuugguguugc

SEQ ID NO: 568084 - RNA, 64 nt, Homo Sapiens
cauuguagguugggaaggguaauacuaacagguauuucaucagugguuucagcccauuccuugg

SEQ ID NO: 568085 - RNA, 64 nt, Homo Sapiens
ucaugaauaugauaaaaauauccuaucaguauaauuucaucauuaacucugccaaccacuuuuc

SEQ ID NO: 568086 - RNA, 64 nt, Homo Sapiens
gauuucaacguaagugagcuacuuuauuaucagguuucaucauaagucuucuguggaaagauag

SEQ ID NO: 568087 - RNA, 64 nt, Homo Sapiens
ccacagccuggucaggagggaaggaccucacuuguuucaucaaauggagugguuuaaaacugau

SEQ ID NO: 568088 - RNA, 64 nt, Homo Sapiens
uaaaaaaacaaaaagacauauucagguacugauuuuucaucaagagauugacauaccaaugauc

SEQ ID NO: 568089 - RNA, 64 nt, Homo Sapiens
aaucaugucuuuugccucuuauuugaauaguaaguuucaucacaaaagcuugaaaacauuuagc

SEQ ID NO: 568090 - RNA, 64 nt, Homo Sapiens
augaucauccaucuuuuguaucagggugcacuucuuucaucaaauucuaaacuggcaaaaauuu

SEQ ID NO: 568091 - RNA, 64 nt, Homo Sapiens
acacuguggguuuauauugauguguaacaaguugauuuggaacacuggacucucauucuguuau

SEQ ID NO: 568092 - RNA, 64 nt, Homo Sapiens
ccaauugguauauacaacuuucagagccucuuguauuuggaaggcuggaagggcccagacuuug

SEQ ID NO: 568093 - RNA, 64 nt, Homo Sapiens
uagaaaagguccuaguuagguuccuauauaaagcauuuggaagaugaccuuguugcccuugaaa

SEQ ID NO: 568094 - RNA, 64 nt, Homo Sapiens
cccucaucuccauucucaguuucuuccccacaaaauuuggaaucaaagcuuuuaugacguuugc

SEQ ID NO: 568095 - RNA, 64 nt, Homo Sapiens
aaugcuaccuugcuguacauacuuauaaccuuguauuuggaaaugagaaauagguuuauauuuu

SEQ ID NO: 568096 - RNA, 64 nt, Homo Sapiens
uuaucaaauuuuuaaaauacaaguuugguaugugauuuggaaaagaugccuucuggaucuuaag

SEQ ID NO: 568097 - RNA, 64 nt, Homo Sapiens
ugauaacacucagaaaaccacaguguguuuucauauuuggaacuuuguaauagcgggaguagca

SEQ ID NO: 568098 - RNA, 64 nt, Homo Sapiens
aagaacugguuuauuuuauagucagucaaaaugcauuuggaauguaccuugcuuccauaacaga

SEQ ID NO: 568099 - RNA, 64 nt, Homo Sapiens
uucucguauuuaauaugggugaacaccaacuuuuauuuggaauaauaauuuuccuccuaaacaa

SEQ ID NO: 568100 - RNA, 64 nt, Homo Sapiens
gugucagcaugcauagugcuaagaaagcaagccaauuuggaaacuuagguuagugacaaaauug

SEQ ID NO: 568101 - RNA, 64 nt, Homo Sapiens
ggagaaggucccaggugaauuggcucucauggaaauuuggaauuacaaaauaaacguccugggg

SEQ ID NO: 568102 - RNA, 64 nt, Homo Sapiens
gugcuacccguugcugggggaggagucaugguuuauuuggaaaugucaguugcaaucaugguuc

SEQ ID NO: 568103 - RNA, 64 nt, Homo Sapiens
cuaagcaguuucucuguuugcuugucauagcagcauuuggaaacucaaacaugcuuucauuuac

SEQ ID NO: 568104 - RNA, 64 nt, Homo Sapiens
aaugugugaaccuuaagaaauccccauuuguggaauuuggaaacguguguugacuccugguggu

SEQ ID NO: 568105 - RNA, 64 nt, Homo Sapiens
ggaaccuauauuugugcuugaagguguuuuugauauuuggaaacaguauaagccauuuggaguc

SEQ ID NO: 568106 - RNA, 64 nt, Homo Sapiens
ugagaaguucuuugcagauuuggggcgaggggugauuuggaaaagaagaccuggguggaaagcg

SEQ ID NO: 568107 - RNA, 64 nt, Homo Sapiens
cucccguacugcuuucaggucuuguaaaauaagcauuuggaagucuugggaggccugccugcua

SEQ ID NO: 568108 - RNA, 64 nt, Homo Sapiens
augaaggaaugaaucuuuuuuuguacuguaccuuauuuggaagguaaugugcauuguuauugag

SEQ ID NO: 568109 - RNA, 64 nt, Homo Sapiens
agaguaaugaagaaauaauagaauuuucauuaaaauuuggaaacaguggauagcucaucccuag

SEQ ID NO: 568110 - RNA, 64 nt, Homo Sapiens
guuauugucugugccaugacacaauacgucauauauuuggaacaccagccuagaaagcacagga

SEQ ID NO: 568111 - RNA, 64 nt, Homo Sapiens
ggauguuuuugaauuauuuuugugcucagggacuauuuggaacucuucuugcuggaaugaacag

SEQ ID NO: 568112 - RNA, 64 nt, Homo Sapiens
uuacaugguagaacugcccaugccacaaauauuuauuuggaaaaguagucauuaaaugaaccca

SEQ ID NO: 568113 - RNA, 64 nt, Homo Sapiens
aaccaugcccccuucguuggcaucacagggccuuauuuggaagagcgggcaaagaggauggaaa

SEQ ID NO: 568114 - RNA, 64 nt, Homo Sapiens
gcacuuuaauugauuaauccuuggaaggcucaacauuuggaauugagcaauacccaagccucau

SEQ ID NO: 568115 - RNA, 64 nt, Homo Sapiens
cucaacauuuggaauugcacaauacccaagccucauuuggaagggccucugguggcugcagagc

SEQ ID NO: 568116 - RNA, 64 nt, Homo Sapiens
aaguguuuugcuuuugucuguucagcauugugcuauuuggaaauuuuuaggauugcuaucaauu

SEQ ID NO: 568117 - RNA, 64 nt, Homo Sapiens
uuaaaggaguaaagacugucgauuauguuggaauauuuggaauuaaaaugguuuuuacuccugu

SEQ ID NO: 568118 - RNA, 64 nt, Homo Sapiens
acccaugaagguaacuaacgaaaaaaaaacaauaauuuggaaaaaugcauucacuugaaaaacu

SEQ ID NO: 568119 - RNA, 64 nt, Homo Sapiens
aaguucauugaagauaaagcgccagauuuggggcauuuggaaagcuuaaaaauaauaacuuauu

SEQ ID NO: 568120 - RNA, 64 nt, Homo Sapiens
uuugccaucaaaauucuuuggacaauugcaucagauuuggaaguuuguuuaaaaacuugcuuaa

SEQ ID NO: 568121 - RNA, 64 nt, Homo Sapiens
auauguacaaaaaucauuuuaucccaugccugaaauuuggaagcuuucuaugaaaucuacuugg

SEQ ID NO: 568122 - RNA, 64 nt, Homo Sapiens
caauaaaaaaugugaacaauaaugauuuugcuacauuuggaauuucccuuuuauaauuuguuuu

SEQ ID NO: 568123 - RNA, 64 nt, Homo Sapiens
aacauuggugauuauacagaauaauuucacggacauuuggaaaugcaaggagauaggauuauag

SEQ ID NO: 568124 - RNA, 64 nt, Homo Sapiens
gucuguucuucuuuucuucuuucauuucaguggcauuuggaagcaaagagugcuaggcaccugc

SEQ ID NO: 568125 - RNA, 64 nt, Homo Sapiens
uaucugcuggcguuggguuccaaauuugcauuuuauuuggaaacagacaaguagaagaugcuac

SEQ ID NO: 568126 - RNA, 64 nt, Homo Sapiens
caccaacacuuacccagaauaugccucauugguaauuuggaagacaaguuauuaaggagaaggc

SEQ ID NO: 568127 - RNA, 64 nt, Homo Sapiens
ggaaggcaucuccaugccagaguuaaauuuccacauuuggaauguggaucuuguuugauucugu

SEQ ID NO: 568128 - RNA, 64 nt, Homo Sapiens
aaaacugcugugguugcugcuacaggaggcagccauuuggaagggacuuugugaccaaauaguc

SEQ ID NO: 568129 - RNA, 64 nt, Homo Sapiens
caucucuauuuuuuucuuacguguccuaccuccuauuuggaaacauugcucgaugccacucaug

SEQ ID NO: 568130 - RNA, 64 nt, Homo Sapiens
cacagguuguuuuuuguuugugaaaagauaagggauuuggaagccagaaaucuuuaugaauaaa

SEQ ID NO: 568131 - RNA, 64 nt, Homo Sapiens
uacagaaaauauagggaagaagugacuucagaaaauuuggaaaacauuguuaaaaugcaaucau

SEQ ID NO: 568132 - RNA, 64 nt, Homo Sapiens
aguggaagcuguuccuuugacuugugaaaguuuaauuuggaauuucccuccccaaacaaguaaa

SEQ ID NO: 568133 - RNA, 64 nt, Homo Sapiens
ucuuuaauuauccuaauguucacugucauguggcauuuggaaaacacagccugaauggacguag

SEQ ID NO: 568134 - RNA, 64 nt, Homo Sapiens
uagaaaagaucuugguuuuugagcaacggcaccuauuuggaacuuccgacgaugacucuugggu

SEQ ID NO: 568135 - RNA, 64 nt, Homo Sapiens
gauuuacuggaauuacaaaauuuuuccuuguagcauuuggaaauguccagugagcaguguugcg

SEQ ID NO: 568136 - RNA, 64 nt, Homo Sapiens
gacggaaacaacguugcuaucgcagccagugcacauuuggaauuuuggagauuggcuugucuca

SEQ ID NO: 568137 - RNA, 64 nt, Homo Sapiens
uucugagagauguguaguuauguugggagcagggauuuggaaauuaauagguguacuaaaauug

SEQ ID NO: 568138 - RNA, 64 nt, Homo Sapiens
uacacuacuguaaguuuguagaagaaaaaccuuuauuuggaauaauauugucauaccauaguag

SEQ ID NO: 568139 - RNA, 64 nt, Homo Sapiens
cuaaugguuaagacaccaguaacaaaaacacaugauuuggaaauacuuuggcuuuuucauauac

SEQ ID NO: 568140 - RNA, 64 nt, Homo Sapiens
cuguguuagagcacagauuuaccuaggcuugaagauuuggaagaaauaauauguaagaauggcc

SEQ ID NO: 568141 - RNA, 64 nt, Homo Sapiens
acuuguccaggcacucaagucgcaucagcuauaaauuuggaaguauucuguccacuccucaccu

SEQ ID NO: 568142 - RNA, 64 nt, Homo Sapiens
auucaugucuguaacuaaccaccugugagauuauauuuggaaaagugcagagggauuaaauuag

SEQ ID NO: 568143 - RNA, 64 nt, Homo Sapiens
cagguacauuaagcuuuaguuagucauacaguucauuuggaauuuguaugguuuuuccccagau

SEQ ID NO: 568144 - RNA, 64 nt, Homo Sapiens
aggcccucucagggaggagacauccaagcaaaucauuuggaaaaguuaggaaaccuuuaggauu

SEQ ID NO: 568145 - RNA, 64 nt, Homo Sapiens
gacugguguguacugaauaggaaagggaaguuuuauuuggaaccuucuaagaggaaaucaacca

SEQ ID NO: 568146 - RNA, 64 nt, Homo Sapiens
gcugccuggagagaagaacuagugugaaauuuguauuuggaaaaagaaaagcccuuauuuggaa

SEQ ID NO: 568147 - RNA, 64 nt, Homo Sapiens
ugugaaauuuguauuuggaacaagaaaagcccuuauuuggaaagacccauaaucaguaaccuau

SEQ ID NO: 568148 - RNA, 64 nt, Homo Sapiens
augagccugggacuccaugucacguuuccuucugauuuggaaucucuccaucuguaauuccuca

SEQ ID NO: 568149 - RNA, 64 nt, Homo Sapiens
aggcguaagauaaggauggaaggcuguccaaguuauuuggaaggccucggcagcuugggauuag

SEQ ID NO: 568150 - RNA, 64 nt, Homo Sapiens
uuagucaccucugagccaccggaaggcggacaagauuuggaaguaaaugucacauuuguaaagg

SEQ ID NO: 568151 - RNA, 64 nt, Homo Sapiens
ggaccagaggcccuugaaaacagguuguucacagauuuggaauggagcccucccacugccagcu

SEQ ID NO: 568152 - RNA, 64 nt, Homo Sapiens
agucaaccaaagauggcaugacuuaccugcgcagauuuggaagcauugaacuuagagugcuggc

SEQ ID NO: 568153 - RNA, 64 nt, Homo Sapiens
gcuuacauugauuuuguagacacauuaagucaagauuuggaauuuaagucacuggcagguaucu

SEQ ID NO: 568154 - RNA, 64 nt, Homo Sapiens
cuucuuggaucuguggguuuauuguuuccauaaaauuuggaaauuuuuacaaucuucuucaaau

SEQ ID NO: 568155 - RNA, 64 nt, Homo Sapiens
aaguauucuggagcuuuguuaugaguugcagguuauuuggaagcaguuuccuuuuucaggucuu

SEQ ID NO: 568156 - RNA, 64 nt, Homo Sapiens
uuauuuucgcaaaaaaccuauguuuucuucauucauuuggaaccgaaccuagcgcaucaaauuu

SEQ ID NO: 568157 - RNA, 64 nt, Homo Sapiens
ccauuccaccugacccugugcggagcacagagugauuuggaacuggaaagaaaucgggaugccg

SEQ ID NO: 568158 - RNA, 64 nt, Homo Sapiens
ugaucaaccacuguuccuucgaagugaccaucacauuuggaaaggaagaggcccucugggugau

SEQ ID NO: 568159 - RNA, 64 nt, Homo Sapiens
ccuagccaaggggauuucgucucacagccaggaaauuuggaaaucaguugccgaaccaggccgc

SEQ ID NO: 568160 - RNA, 64 nt, Homo Sapiens
agcaaguuugaccuugguucuguugcugaagcaaauuuggaacuuuucugucucagugugaucc

SEQ ID NO: 568161 - RNA, 64 nt, Homo Sapiens
ucugucucagugugauccacuaacccacaggaucauuuggaaccuugaauagcucugcuuggac

SEQ ID NO: 568162 - RNA, 64 nt, Homo Sapiens
gaagaaacaauacaugcuugcuauuaauauuucaauuuggaauguucugaauugaccaaauuua

SEQ ID NO: 568163 - RNA, 64 nt, Homo Sapiens
uuucagagcccuccugcucacuugaccacgugagauuuggaauaacuguaggacuucuguuucc

SEQ ID NO: 568164 - RNA, 64 nt, Homo Sapiens
cauagcuugaaggcagugaguaggguacagccagauuuggaaacuauaaagguuaccacaugac

SEQ ID NO: 568165 - RNA, 64 nt, Homo Sapiens
uugaaugcuuauaaagguuaagucuggggugaagauuuggaaucggccccuaaaacauucauua

SEQ ID NO: 568166 - RNA, 64 nt, Homo Sapiens
guauuggaguuaaucuguauuauauuguaccuugauuuggaaaaccuguacuauuauuaauguu

SEQ ID NO: 568167 - RNA, 64 nt, Homo Sapiens
ggggaaggagccaccccaaacuuaaacuuggccaauuuggaaaggcauauaugcagugcuuuuu

SEQ ID NO: 568168 - RNA, 64 nt, Homo Sapiens
aagauaaaaguacauaaugaaaauccauggccuuauuuggaauauauaucacuuuccaaauuuu

SEQ ID NO: 568169 - RNA, 64 nt, Homo Sapiens
uuagguuccuuaauuuggcuguugguaccuguguauuuggaauauuuuaggggauucgaauuuu

SEQ ID NO: 568170 - RNA, 64 nt, Homo Sapiens; identical to SEQ ID NO: 265126

SEQ ID NO: 568171 - RNA, 64 nt, Homo Sapiens; identical to SEQ ID NO: 265127

SEQ ID NO: 568172 - RNA, 64 nt, Homo Sapiens; identical to SEQ ID NO: 265128

SEQ ID NO: 568173 - RNA, 64 nt, Homo Sapiens; identical to SEQ ID NO: 265129

SEQ ID NO: 568174 - RNA, 64 nt, Homo Sapiens; identical to SEQ ID NO: 265130

SEQ ID NO: 568175 - RNA, 64 nt, Homo Sapiens; identical to SEQ ID NO: 265131

SEQ ID NO: 568176 - RNA, 64 nt, Homo Sapiens; identical to SEQ ID NO: 265132

SEQ ID NO: 568177 - RNA, 64 nt, Homo Sapiens; identical to SEQ ID NO: 265133

SEQ ID NO: 568178 - RNA, 64 nt, Homo Sapiens; identical to SEQ ID NO: 265134

SEQ ID NO: 568179 - RNA, 64 nt, Homo Sapiens; identical to SEQ ID NO: 265135

SEQ ID NO: 568180 - RNA, 64 nt, Homo Sapiens; identical to SEQ ID NO: 265136

SEQ ID NO: 568181 - RNA, 64 nt, Homo Sapiens; identical to SEQ ID NO: 265137

SEQ ID NO: 568182 - RNA, 64 nt, Homo Sapiens; identical to SEQ ID NO: 265138

SEQ ID NO: 568183 - RNA, 64 nt, Homo Sapiens; identical to SEQ ID NO: 265139

SEQ ID NO: 568184 - RNA, 64 nt, Homo Sapiens; identical to SEQ ID NO: 265140

SEQ ID NO: 568185 - RNA, 64 nt, Homo Sapiens; identical to SEQ ID NO: 265141

SEQ ID NO: 568186 - RNA, 64 nt, Homo Sapiens; identical to SEQ ID NO: 265142

SEQ ID NO: 568187 - RNA, 64 nt, Homo Sapiens; identical to SEQ ID NO: 265143

SEQ ID NO: 568188 - RNA, 64 nt, Homo Sapiens; identical to SEQ ID NO: 265144

SEQ ID NO: 568189 - RNA, 64 nt, Homo Sapiens; identical to SEQ ID NO: 265145

SEQ ID NO: 568190 - RNA, 64 nt, Homo Sapiens; identical to SEQ ID NO: 265146

SEQ ID NO: 568191 - RNA, 64 nt, Homo Sapiens; identical to SEQ ID NO: 265147

SEQ ID NO: 568192 - RNA, 64 nt, Homo Sapiens; identical to SEQ ID NO: 265148

SEQ ID NO: 568193 - RNA, 64 nt, Homo Sapiens; identical to SEQ ID NO: 265149

SEQ ID NO: 568194 - RNA, 63 nt, Homo Sapiens; identical to SEQ ID NO: 265150

SEQ ID NO: 568195 - RNA, 64 nt, Homo Sapiens; identical to SEQ ID NO: 265151

SEQ ID NO: 568196 - RNA, 64 nt, Homo Sapiens; identical to SEQ ID NO: 265152

SEQ ID NO: 568197 - RNA, 64 nt, Homo Sapiens; identical to SEQ ID NO: 265153

SEQ ID NO: 568198 - RNA, 64 nt, Homo Sapiens; identical to SEQ ID NO: 265154

SEQ ID NO: 568199 - RNA, 64 nt, Homo Sapiens; identical to SEQ ID NO: 265155

SEQ ID NO: 568200 - RNA, 64 nt, Homo Sapiens; identical to SEQ ID NO: 265156

SEQ ID NO: 568201 - RNA, 64 nt, Homo Sapiens; identical to SEQ ID NO: 265157

SEQ ID NO: 568202 - RNA, 64 nt, Homo Sapiens; identical to SEQ ID NO: 265158

SEQ ID NO: 568203 - RNA, 64 nt, Homo Sapiens; identical to SEQ ID NO: 265159

SEQ ID NO: 568204 - RNA, 64 nt, Homo Sapiens; identical to SEQ ID NO: 265160

SEQ ID NO: 568205 - RNA, 64 nt, Homo Sapiens; identical to SEQ ID NO: 265161

SEQ ID NO: 568206 - RNA, 64 nt, Homo Sapiens; identical to SEQ ID NO: 265162

SEQ ID NO: 568207 - RNA, 64 nt, Homo Sapiens; identical to SEQ ID NO: 265163

SEQ ID NO: 568208 - RNA, 64 nt, Homo Sapiens; identical to SEQ ID NO: 265164

SEQ ID NO: 568209 - RNA, 64 nt, Homo Sapiens; identical to SEQ ID NO: 265165

SEQ ID NO: 568210 - RNA, 64 nt, Homo Sapiens; identical to SEQ ID NO: 265166

SEQ ID NO: 568211 - RNA, 64 nt, Homo Sapiens; identical to SEQ ID NO: 265167

SEQ ID NO: 568212 - RNA, 64 nt, Homo Sapiens; identical to SEQ ID NO: 265168

SEQ ID NO: 568213 - RNA, 64 nt, Homo Sapiens; identical to SEQ ID NO: 265169

SEQ ID NO: 568214 - RNA, 64 nt, Homo Sapiens; identical to SEQ ID NO: 265170

SEQ ID NO: 568215 - RNA, 64 nt, Homo Sapiens; identical to SEQ ID NO: 265171

SEQ ID NO: 568216 - RNA, 64 nt, Homo Sapiens; identical to SEQ ID NO: 265172

SEQ ID NO: 568217 - RNA, 64 nt, Homo Sapiens; identical to SEQ ID NO: 265173

SEQ ID NO: 568218 - RNA, 64 nt, Homo Sapiens; identical to SEQ ID NO: 265174

SEQ ID NO: 568219 - RNA, 64 nt, Homo Sapiens; identical to SEQ ID NO: 265175

SEQ ID NO: 568220 - RNA, 64 nt, Homo Sapiens; identical to SEQ ID NO: 265176

SEQ ID NO: 568221 - RNA, 64 nt, Homo Sapiens; identical to SEQ ID NO: 265177

SEQ ID NO: 568222 - RNA, 64 nt, Homo Sapiens; identical to SEQ ID NO: 265178

SEQ ID NO: 568223 - RNA, 64 nt, Homo Sapiens; identical to SEQ ID NO: 265179

SEQ ID NO: 568224 - RNA, 64 nt, Homo Sapiens; identical to SEQ ID NO: 533739

SEQ ID NO: 568225 - RNA, 64 nt, Homo Sapiens; identical to SEQ ID NO: 533740

SEQ ID NO: 568226 - RNA, 64 nt, Homo Sapiens; identical to SEQ ID NO: 533741

SEQ ID NO: 568227 - RNA, 64 nt, Homo Sapiens; identical to SEQ ID NO: 533742

SEQ ID NO: 568228 - RNA, 64 nt, Homo Sapiens; identical to SEQ ID NO: 533743

SEQ ID NO: 568229 - RNA, 64 nt, Homo Sapiens; identical to SEQ ID NO: 533744

SEQ ID NO: 568230 - RNA, 64 nt, Homo Sapiens; identical to SEQ ID NO: 533745

SEQ ID NO: 568231 - RNA, 64 nt, Homo Sapiens; identical to SEQ ID NO: 533746

SEQ ID NO: 568232 - RNA, 64 nt, Homo Sapiens; identical to SEQ ID NO: 533747

SEQ ID NO: 568233 - RNA, 64 nt, Homo Sapiens; identical to SEQ ID NO: 533748

SEQ ID NO: 568234 - RNA, 64 nt, Homo Sapiens; identical to SEQ ID NO: 533749

SEQ ID NO: 568235 - RNA, 64 nt, Homo Sapiens; identical to SEQ ID NO: 533750

SEQ ID NO: 568236 - RNA, 64 nt, Homo Sapiens; identical to SEQ ID NO: 533751

SEQ ID NO: 568237 - RNA, 64 nt, Homo Sapiens; identical to SEQ ID NO: 533752

SEQ ID NO: 568238 - RNA, 64 nt, Homo Sapiens; identical to SEQ ID NO: 533753

SEQ ID NO: 568239 - RNA, 64 nt, Homo Sapiens; identical to SEQ ID NO: 533754

SEQ ID NO: 568240 - RNA, 64 nt, Homo Sapiens
aagggaggagacaucuggccuuuuuagaaccugagaggaaaaaaagagucuuuuuuuccccucu

SEQ ID NO: 568241 - RNA, 64 nt, Homo Sapiens
ccagcuucgcuccuuaucacugcauugugaagaggaggaaaagugaaucacggagagagaaagg

SEQ ID NO: 568242 - RNA, 64 nt, Homo Sapiens
gagggcaguuaaacagugacauguugagcaccuggaggaaaaaaaaggugcaguuuuuaauaag

SEQ ID NO: 568243 - RNA, 64 nt, Homo Sapiens
cuuaggcagcauugauuuaggucacuuucccagugaggaaaauuucuguguuuucagaauuucc

SEQ ID NO: 568244 - RNA, 64 nt, Homo Sapiens
uuaggucaugaacauggucagaaccuuuggacaagaggaaaaauacuaagagauuugcuuuuuc

SEQ ID NO: 568245 - RNA, 64 nt, Homo Sapiens
accuagauaggucaugcaagugagaaagacaucugaggaaaauggaagaccuaaggcagacagg

SEQ ID NO: 568246 - RNA, 64 nt, Homo Sapiens
agcuauuuauauauauuauuuuuuuuuaagaaaggaggaaaagaaaccaaaaguuuuuuuuaag

SEQ ID NO: 568247 - RNA, 64 nt, Homo Sapiens
gugcaauaugcccccugggucccaggagggucuggaggaaaacuggcuaucagaaccuccugau

SEQ ID NO: 568248 - RNA, 64 nt, Homo Sapiens
uguagcuaaauguugauuuaugcuggacccaagagaggaaaaguaugaauaucaaaucuuuuga

SEQ ID NO: 568249 - RNA, 64 nt, Homo Sapiens
aaaauuaaaaaaaaaaugcaauguggaauacggugaggaaaaaauaccuuccccagccacaggu

SEQ ID NO: 568250 - RNA, 64 nt, Homo Sapiens
aaagaugggguaagaaaacucugcguuaauuauugaggaaaaaacuuuucaaacaaugguuucu

SEQ ID NO: 568251 - RNA, 64 nt, Homo Sapiens
gcugaauacucuggauucauagucuucugagacggaggaaaacugcauugucuacuggagcuuu

SEQ ID NO: 568252 - RNA, 64 nt, Homo Sapiens
cuccaccuggggcagcagcaggaggccuggggaggaggaaaaucaggcagucggccuggagucu

SEQ ID NO: 568253 - RNA, 64 nt, Homo Sapiens
ugggcugaaggacugucuucacgaagucaguccugaggaaaaauauuggggacuccaaaugucc

SEQ ID NO: 568254 - RNA, 64 nt, Homo Sapiens
aaaaauucuauuggacaauggcaauaucaacaaugaggaaaauuacugaagaauaaguuuccau

SEQ ID NO: 568255 - RNA, 64 nt, Homo Sapiens
caaagauuuuaucucuucuucuaacuuuuaguaagaggaaaaagggauuauaaaacccuucaua

SEQ ID NO: 568256 - RNA, 64 nt, Homo Sapiens
aaaugauuccucuucccaugaccuaaaacacugugaggaaaaaucauucaaguggcaugccaag

SEQ ID NO: 568257 - RNA, 64 nt, Homo Sapiens
aguucuaagauaguuccagggauuaaaagguuaagaggaaaacacaaaucaccaaauuucugau

SEQ ID NO: 568258 - RNA, 64 nt, Homo Sapiens
guuacauuuuuaauaugcaaccacuucuucaccugaggaaaacuagaaugaaaugcagucuaaa

SEQ ID NO: 568259 - RNA, 64 nt, Homo Sapiens
ucuguuuuaauguguuuuuuaaaugcuguauguagaggaaaaucugcagaccacuggaauacau

SEQ ID NO: 568260 - RNA, 64 nt, Homo Sapiens
aggggaccccacacacauguacagagacaaaaaugaggaaaacuccauguguuacuuggucagg

SEQ ID NO: 568261 - RNA, 64 nt, Homo Sapiens
ucagcuggcugggucaaggcgguucagaccugcagaggaaaacaauguucaaggcccaggcugg

SEQ ID NO: 568262 - RNA, 64 nt, Homo Sapiens
accaccuuucuucaauuuacguuaugauucaguagaggaaaaaguugaggggcacucuaccuug

SEQ ID NO: 568263 - RNA, 64 nt, Homo Sapiens
caacaacagcaacaacacgauugaauguguagaagaggaaaaagguuuguacaagaaaguuugu

SEQ ID NO: 568264 - RNA, 64 nt, Homo Sapiens
ucaaucuucaguuuuggccuaccuaucuuuauuagaggaaaaucuuauauugaagauucugaaa

SEQ ID NO: 568265 - RNA, 64 nt, Homo Sapiens
ucuagugggauuagcaaggugcuaggauucuaccgaggaaaacaaugcacauggaaacccauga

SEQ ID NO: 568266 - RNA, 64 nt, Homo Sapiens
aauuacagucaaaauauuugaguggggaggaagggaggaaaaauaucugcagcaugcuauagaa

SEQ ID NO: 568267 - RNA, 64 nt, Homo Sapiens
aagacuaaagccugcauacuagggaaugucacaggaggaaaagguauaauauuuugugccuuga

SEQ ID NO: 568268 - RNA, 64 nt, Homo Sapiens
uuauaggaauuugcuuccuaagucuacuuuugaagaggaaaacaggaacguaccauauauuuug

SEQ ID NO: 568269 - RNA, 64 nt, Homo Sapiens
cuuuauacuaaaaauauaggcucuugggauuggagaggaaaaauuagaggugauuuucagauuu

SEQ ID NO: 568270 - RNA, 64 nt, Homo Sapiens
aauucucggcuguaguugcauaagcauugcucaagaggaaaauccaaaagugcagcaggagaac

SEQ ID NO: 568271 - RNA, 64 nt, Homo Sapiens
aggguauagcugaauaggcaguuucuuuuguccugaggaaaaucaggacaugccugcuuucuaa

SEQ ID NO: 568272 - RNA, 64 nt, Homo Sapiens
acagaagacauugcuaaaagugacuaaguuaugugaggaaaaaauauaauauauaauaaugaaa

SEQ ID NO: 568273 - RNA, 64 nt, Homo Sapiens
gaagauugugaugguguaagcugggacaauaugggaggaaaagucccuaaauaugguaacuacu

SEQ ID NO: 568274 - RNA, 57 nt, Homo Sapiens
uggauggauuucaacuuuaacuuacuggaggaaaaaaaauuuauggcuaaaaagggu

SEQ ID NO: 568275 - RNA, 64 nt, Homo Sapiens
gaaugaugaggacacagcagccauauuaugccaagaggaaaaauaucaugaucauauugaaaga

SEQ ID NO: 568276 - RNA, 64 nt, Homo Sapiens
aaagaaaugguugcugaacccaaaacauguuuaggaggaaaaccagaagaacagagcaguggca

SEQ ID NO: 568277 - RNA, 64 nt, Homo Sapiens
acugcuuaauuggcaugagguuuccuuuugagaugaggaaaauguucugaaaauauggugaugg

SEQ ID NO: 568278 - RNA, 64 nt, Homo Sapiens
uuaugauagaucuuauuguacacauuuuguaccagaggaaaacccuaaagcauuaguugcucaa

SEQ ID NO: 568279 - RNA, 64 nt, Homo Sapiens
uggaagaguaagaaaauuaaaauacaagaugcaugaggaaaauguagagaugcucuuugugauu

SEQ ID NO: 568280 - RNA, 64 nt, Homo Sapiens
guccuugaagcagcuauuugaagauguguuuucugaggaaaacaggcuacaacuguuuauuaaa

SEQ ID NO: 568281 - RNA, 64 nt, Homo Sapiens
uauacuguaaauaaacuugaugaauauuauaugugaggaaaacuuucauguauagcacucauug

SEQ ID NO: 568282 - RNA, 64 nt, Homo Sapiens
uagaaacaggcagaguuggauaaagugaggggccgaggaaaacugugcuuugugaacucugcuu

SEQ ID NO: 568283 - RNA, 64 nt, Homo Sapiens
agaagaaaccccgguacugagcagaagggaggaugaggaaaaagugugguuguggcauguguga

SEQ ID NO: 568284 - RNA, 64 nt, Homo Sapiens
uccuuagccuucagugccauggaacuaaucaagggaggaaaaggucaccagggagaacuggaca

SEQ ID NO: 568285 - RNA, 64 nt, Homo Sapiens
ccacuuaaggaucugcucuaugaaggagaagaaagaggaaaaagaaguaaaggaguuaggagga

SEQ ID NO: 568286 - RNA, 64 nt, Homo Sapiens
gugcuuuuggccaugucucacuucugcaucaagugaggaaaaaucaagcaggagauaacauuuu

SEQ ID NO: 568287 - RNA, 64 nt, Homo Sapiens
uacacauaauacaaacauacagagagggagagaggaggaaaaaaaucucucucuagagcgagca

SEQ ID NO: 568288 - RNA, 64 nt, Homo Sapiens
cagucaaaugaccuuuuuacuggguggcaguugugaggaaaagcuuuccugcuuuuguacugca

SEQ ID NO: 568289 - RNA, 64 nt, Homo Sapiens
uucguagucuuuguaaaauauuaccaguauaucagaggaaaauuaauacccaaguacauucuaa

SEQ ID NO: 568290 - RNA, 64 nt, Homo Sapiens
auuuucuaaaaacacacacagaaaucgcuugagugaggaaaaguccacauggcagagacaggua

SEQ ID NO: 568291 - RNA, 64 nt, Homo Sapiens
cuccaacaguucugaagccaacccacaaaucuuugaggaaaaggggucacuuuguuuacuauuc

SEQ ID NO: 568292 - RNA, 64 nt, Homo Sapiens
aaagagucucagaguggaacguaucuggauacacgaggaaaaggaaaaucauccguaugucagu

SEQ ID NO: 568293 - RNA, 51 nt, Homo Sapiens
aaaaccccaagcacccauuaggaggaaaaccaggaggaggaggaagaauaa

SEQ ID NO: 568294 - RNA, 64 nt, Homo Sapiens
ugccucuggucaaguagaucaaaauaggcuuagagaggaaaagcucaaauccacugacagauau

SEQ ID NO: 568295 - RNA, 64 nt, Homo Sapiens
cagagccuccacuuaguuuugaaccucaaacuaggaggaaaagauuuuagacacugggagaaga

SEQ ID NO: 568296 - RNA, 64 nt, Homo Sapiens
gccuaauacaauuagaaucuaacaucuaacuagugaggaaaaguggaguuuuagaggaaaaguc

SEQ ID NO: 568297 - RNA, 64 nt, Homo Sapiens
caacaucuaacuagugaggaaaaauggaguuuuagaggaaaaguugguugugagggggaaucug

SEQ ID NO: 568298 - RNA, 64 nt, Homo Sapiens
agguuguccaugagauuugagaaggagguucagugaggaaaauaugaaggcaaaggaaacuaag

SEQ ID NO: 568299 - RNA, 64 nt, Homo Sapiens
aaagaggggaaaaugaguuuagucuaggagcugggaggaaaagauaggccacuccuccaaagga

SEQ ID NO: 568300 - RNA, 64 nt, Homo Sapiens
agacaaaaacagccucacagcugagagacccaaggaggaaaaacaccaggcacgaacccaccug

SEQ ID NO: 568301 - RNA, 64 nt, Homo Sapiens
caaaaacagcugauuuguuuugccuuaauuuuaagaggaaaauaaggaacuguagccauuucau

SEQ ID NO: 568302 - RNA, 64 nt, Homo Sapiens
cauguauauuuuuguuccguugccugaacuugaggaggaaaauaagucacuaaucauacucuga

SEQ ID NO: 568303 - RNA, 64 nt, Homo Sapiens
gucaauaaggucaagggaaaaacgagggcugauggaggaaaaagaggaguuuucuccauaucaa

SEQ ID NO: 568304 - RNA, 64 nt, Homo Sapiens
aaaaaaagcaaaaagcaaggcuaagacaugugaggaggaaaaggucgggaguccucuagcaggc

SEQ ID NO: 568305 - RNA, 64 nt, Homo Sapiens
uccuugccuccuggaagaacugauaagaauaaacgaggaaaaggaccuugaauagaaguuuucc

SEQ ID NO: 568306 - RNA, 64 nt, Homo Sapiens
cagccucccugagccugcauuacugcccaaauaggaggaaaacaguguggcuuggaggaaaugg

SEQ ID NO: 568307 - RNA, 64 nt, Homo Sapiens
gacuugaguagucuuuggucacuugugucaguuggaggaaaauacuccauacacugaggcagaa

SEQ ID NO: 568308 - RNA, 64 nt, Homo Sapiens
uccauacacugaggcagaaaaguuuccuauuacugaggaaaaccaaauguugacuaauuuuucc

SEQ ID NO: 568309 - RNA, 64 nt, Homo Sapiens
gaacaauuuuagaagcaagguucauuuuccuacagaggaaaauaaauauuuguaagaaaaaacu

SEQ ID NO: 568310 - RNA, 64 nt, Homo Sapiens
gugauucucccagcccuugcaguccgcuaggugagaggaaaagcucuuuacuuccgccccuggc

SEQ ID NO: 568311 - RNA, 64 nt, Homo Sapiens
cuucuggguuaugggagaaaccagagaugggaaugaggaaaauaugaacuacagcagaagcccc

SEQ ID NO: 568312 - RNA, 64 nt, Homo Sapiens
aaaccaaccaaccccuaaaaaaauuaaggggagagaggaaaacauccaacgacuguaggaggaa

SEQ ID NO: 568313 - RNA, 64 nt, Homo Sapiens
uaaggggagagaggaaaacauccaacgacuguaggaggaaaaaugcaacugaagcugugauauu

SEQ ID NO: 568314 - RNA, 64 nt, Homo Sapiens
uguccggguccuuuaucauccuauucauccuggagaggaaaagugucgggcaaagggggaucug

SEQ ID NO: 568315 - RNA, 64 nt, Homo Sapiens
aaggagccagugcugagaugcugcuguguugguugaggaaaaccucgggccugagggccaggcc

SEQ ID NO: 568316 - RNA, 64 nt, Homo Sapiens
ucacccacccucagcuucccuuuuccuaaauuaagaggaaaaguggucaaagaaaaacucuuca

SEQ ID NO: 568317 - RNA, 64 nt, Homo Sapiens
gcgucaacggccacuguguguggcugcucugagugaggaaaaaauuaaaaagaaaaacugguuc

SEQ ID NO: 568318 - RNA, 64 nt, Homo Sapiens
acaaaggcucagcuggggaugguguuugacuucggaggaaaaaaguugcuauugcccguuaaag

SEQ ID NO: 568319 - RNA, 64 nt, Homo Sapiens
aaagacaaaugcugcgcccuugccuuuagucgcugaggaaaaauaaucuucagggcacugcugc

SEQ ID NO: 568320 - RNA, 64 nt, Homo Sapiens
gagacucagacaggaaaggguccucaggcugcuggaggaaaacugggaacugugccuuugaguu

SEQ ID NO: 568321 - RNA, 64 nt, Homo Sapiens
guaggaauuuauuuuuucuuaggcagucccccuagaggaaaaaugcuuggcugccugucuuucu

SEQ ID NO: 568322 - RNA, 64 nt, Homo Sapiens
ggugcagggacagggagaugauuuauucagggaggaggaaaaguaggaagaggggaaggugcgu

SEQ ID NO: 568323 - RNA, 64 nt, Homo Sapiens
uauucugaauauuaacggugaugguugauuuggggaggaaaacuucccuuuuagaauacauuaa

SEQ ID NO: 568324 - RNA, 64 nt, Homo Sapiens
uauuuaaaagaaauacgagauauagaugaacagagaggaaaauggcacuuuugcucauggugaa

SEQ ID NO: 568325 - RNA, 64 nt, Homo Sapiens
auucuguguuugguaaccccuauaaacuggggcagaggaaaagaaugaugguucaaggccauac

SEQ ID NO: 568326 - RNA, 64 nt, Homo Sapiens
cagggaagguagauaacuuuuaggaccuugaugugaggaaaagauaaaauuuaaacaauaaauu

SEQ ID NO: 568327 - RNA, 64 nt, Homo Sapiens
aucuccccugcaaagcccggccuuuccuccagaggaggaaaauuucccugccugucaaucacca

SEQ ID NO: 568328 - RNA, 64 nt, Homo Sapiens
auggcaauuuuugagugccauuucugaacuagaagaggaaaaaacuauuaaaaaaaaaaguugu

SEQ ID NO: 568329 - RNA, 64 nt, Homo Sapiens
aggggaaguuggggauaggcgacaaauguucagugaggaaaaaacagugaggaaaaaacauuca

SEQ ID NO: 568330 - RNA, 64 nt, Homo Sapiens
cauucagacaaauguucaguaaaacauguucagugaggaaaaaaaauguucagugugagugagg

SEQ ID NO: 568331 - RNA, 64 nt, Homo Sapiens
uguucagugaggaaaaaacauguucagugugagugaggaaaacacagccacaguuucagacaaa

SEQ ID NO: 568332 - RNA, 64 nt, Homo Sapiens
cugcagaaggaacugguuugccaagacacucccagaggaaaacaugacaccgcuguggcuuagc

SEQ ID NO: 568333 - RNA, 64 nt, Homo Sapiens
aaaauguacaaaaagauuuuaaggccaaaaaaaagaggaaaagaaccacagaaaagagaaagga

SEQ ID NO: 568334 - RNA, 64 nt, Homo Sapiens
augcucucugcucacugguuuucaauaccaccaagaggaaaauauugacaaguuuaaaggcugu

SEQ ID NO: 568335 - RNA, 64 nt, Homo Sapiens
ugcugugacuuaugugcagcuuuccaguugagcagaggaaaauaguggcaggacugucccccag

SEQ ID NO: 568336 - RNA, 62 nt, Homo Sapiens
cuuuccugucuguauuugaugcaggauuaaacacuucccagagaggauucuagucugguaaa

SEQ ID NO: 568337 - RNA, 62 nt, Homo Sapiens
uugagcccagcaccuaaaaguacaggaauuucacuucccaccaggacuugagcacauaacuc

SEQ ID NO: 568338 - RNA, 62 nt, Homo Sapiens
cucugaggcugcagggcuggaaguccuugcccacuucccacucuccugccccaaucuaucua

SEQ ID NO: 568339 - RNA, 62 nt, Homo Sapiens
acuucccacucuccugccccaaucuaucuaguacuucccaggcaaauaggccccuuugaggc

SEQ ID NO: 568340 - RNA, 62 nt, Homo Sapiens
aucccuuguaucuccuuucuuguuuacuucccacuucccagaauuuaaagagaucuguguac

SEQ ID NO: 568341 - RNA, 62 nt, Homo Sapiens
ucccagaaucccuuguaucuuguguacuguuuacuucccacugcuccugauuuaaagagauc

SEQ ID NO: 568342 - RNA, 62 nt, Homo Sapiens
cauuccacuagacugcccccugccacccuggcacuucccagggccuggcaguauggucugau

SEQ ID NO: 568343 - RNA, 62 nt, Homo Sapiens
augguacaugcauuuucuagaauagagcugggacuucccauguggcccacaucugaccuggc

SEQ ID NO: 568344 - RNA, 62 nt, Homo Sapiens
acucagcuguuccagccggugccaaccugugaacuucccaccauaucccagaaucugcuauu

SEQ ID NO: 568345 - RNA, 62 nt, Homo Sapiens
accauaucccagaaucugcuauuccccaaaccacuucccaguuuccuuucaguaaucuuucu

SEQ ID NO: 568346 - RNA, 62 nt, Homo Sapiens
uauuacgccucauacugaauauguucaguggaacuucccaucgccuaauaaauaugacaugg

SEQ ID NO: 568347 - RNA, 62 nt, Homo Sapiens
ucugacgaaaggucuccaugacacacauugcaacuucccacuuagggaccuugauuuugggg

SEQ ID NO: 568348 - RNA, 62 nt, Homo Sapiens
gguugcauggcggcugggcaaaggugcuccccacuucccagauggugcggcggcuggccaga

SEQ ID NO: 568349 - RNA, 62 nt, Homo Sapiens
gauggugcggcggcuggccagaggcacucuucacuucccagacagaggggcggccgggcaga

SEQ ID NO: 568350 - RNA, 62 nt, Homo Sapiens
gacagaggggcggccgggcagaggugcuccucacuucccagagggugcaggagccagcucug

SEQ ID NO: 568351 - RNA, 62 nt, Homo Sapiens
auugcaggcagcugggcccacauugcaggcagacuucccacccuccaguggucacuucccac

SEQ ID NO: 568352 - RNA, 62 nt, Homo Sapiens
auugcaggcagacuucccacccuccaguggucacuucccaccauugccauagaggagcccuc

SEQ ID NO: 568353 - RNA, 62 nt, Homo Sapiens
uagccuuucucaguguccguggcauuuuugugacuucccagcacuagaauaaguuuuccugc

SEQ ID NO: 568354 - RNA, 62 nt, Homo Sapiens
agugaggcgcuuggugcccucuggacuuucccacuucccaacaugggagaauugugaacuuu

SEQ ID NO: 568355 - RNA, 62 nt, Homo Sapiens
acccacagaccuucccuuuagcuguugacacaacuucccagcucugcaagugugcccccugg

SEQ ID NO: 568356 - RNA, 62 nt, Homo Sapiens
cugcccugcccugccuagccucugcuacucccacuucccaacuccagggaaugcauuacuuu

SEQ ID NO: 568357 - RNA, 62 nt, Homo Sapiens
auccacaaagcuucgccuuuucaccacggccuacuucccaaucaucccugugugcugcagca

SEQ ID NO: 568358 - RNA, 62 nt, Homo Sapiens
gccuggagagaaauaaaccucaccgauguagcacuucccacuagcaaauggaggaaauuaag

SEQ ID NO: 568359 - RNA, 62 nt, Homo Sapiens
gugccuauugauacuuggggaaaucccccagcacuucccacauuuuuucucugcauuuaaaa

SEQ ID NO: 568360 - RNA, 62 nt, Homo Sapiens
ccacaaaugggacacaugguaugguugaugauacuucccacacuuguugcuguacaaaagca

SEQ ID NO: 568361 - RNA, 62 nt, Homo Sapiens
uaacuccugggcucagugauccucccguuucgacuucccaaagugcugggauuacaggugug

SEQ ID NO: 568362 - RNA, 62 nt, Homo Sapiens
acaagcaaaaucagccagcacuuugaucacggacuucccagccucuaggacugugagcaaua

SEQ ID NO: 568363 - RNA, 62 nt, Homo Sapiens
uaucuucucccccacgguauccuaaacuuuagacuucccacuguucugaaaggagacauugc

SEQ ID NO: 568364 - RNA, 62 nt, Homo Sapiens
ggacucaagaggaaucuguuucucugcugucaacuucccaucuggcucagcauagggucacu

SEQ ID NO: 568365 - RNA, 64 nt, Homo Sapiens; identical to SEQ ID NO: 334708

SEQ ID NO: 568366 - RNA, 64 nt, Homo Sapiens; identical to SEQ ID NO: 334709

SEQ ID NO: 568367 - RNA, 64 nt, Homo Sapiens; identical to SEQ ID NO: 334710

SEQ ID NO: 568368 - RNA, 64 nt, Homo Sapiens; identical to SEQ ID NO: 334711

SEQ ID NO: 568369 - RNA, 64 nt, Homo Sapiens; identical to SEQ ID NO: 334712

SEQ ID NO: 568370 - RNA, 64 nt, Homo Sapiens; identical to SEQ ID NO: 334713

SEQ ID NO: 568371 - RNA, 64 nt, Homo Sapiens; identical to SEQ ID NO: 334714

SEQ ID NO: 568372 - RNA, 64 nt, Homo Sapiens; identical to SEQ ID NO: 334715

SEQ ID NO: 568373 - RNA, 64 nt, Homo Sapiens; identical to SEQ ID NO: 334716

SEQ ID NO: 568374 - RNA, 64 nt, Homo Sapiens; identical to SEQ ID NO: 334717

SEQ ID NO: 568375 - RNA, 64 nt, Homo Sapiens; identical to SEQ ID NO: 334718

SEQ ID NO: 568376 - RNA, 64 nt, Homo Sapiens; identical to SEQ ID NO: 334719

SEQ ID NO: 568377 - RNA, 64 nt, Homo Sapiens; identical to SEQ ID NO: 334720

SEQ ID NO: 568378 - RNA, 64 nt, Homo Sapiens; identical to SEQ ID NO: 334721

SEQ ID NO: 568379 - RNA, 64 nt, Homo Sapiens; identical to SEQ ID NO: 334722

SEQ ID NO: 568380 - RNA, 64 nt, Homo Sapiens; identical to SEQ ID NO: 334723

SEQ ID NO: 568381 - RNA, 64 nt, Homo Sapiens; identical to SEQ ID NO: 334724

SEQ ID NO: 568382 - RNA, 64 nt, Homo Sapiens; identical to SEQ ID NO: 334725

SEQ ID NO: 568383 - RNA, 64 nt, Homo Sapiens; identical to SEQ ID NO: 334726

SEQ ID NO: 568384 - RNA, 64 nt, Homo Sapiens; identical to SEQ ID NO: 334727

SEQ ID NO: 568385 - RNA, 64 nt, Homo Sapiens; identical to SEQ ID NO: 334728

SEQ ID NO: 568386 - RNA, 64 nt, Homo Sapiens; identical to SEQ ID NO: 334729

SEQ ID NO: 568387 - RNA, 64 nt, Homo Sapiens; identical to SEQ ID NO: 334730

SEQ ID NO: 568388 - RNA, 64 nt, Homo Sapiens; identical to SEQ ID NO: 334731

SEQ ID NO: 568389 - RNA, 64 nt, Homo Sapiens; identical to SEQ ID NO: 334732

SEQ ID NO: 568390 - RNA, 64 nt, Homo Sapiens; identical to SEQ ID NO: 334733

SEQ ID NO: 568391 - RNA, 64 nt, Homo Sapiens; identical to SEQ ID NO: 334734

SEQ ID NO: 568392 - RNA, 64 nt, Homo Sapiens; identical to SEQ ID NO: 334735

SEQ ID NO: 568393 - RNA, 64 nt, Homo Sapiens; identical to SEQ ID NO: 334736

SEQ ID NO: 568394 - RNA, 64 nt, Homo Sapiens; identical to SEQ ID NO: 334737

SEQ ID NO: 568395 - RNA, 64 nt, Homo Sapiens; identical to SEQ ID NO: 334738

SEQ ID NO: 568396 - RNA, 64 nt, Homo Sapiens; identical to SEQ ID NO: 334739

SEQ ID NO: 568397 - RNA, 64 nt, Homo Sapiens; identical to SEQ ID NO: 334740

SEQ ID NO: 568398 - RNA, 64 nt, Homo Sapiens; identical to SEQ ID NO: 334741

SEQ ID NO: 568399 - RNA, 64 nt, Homo Sapiens; identical to SEQ ID NO: 334742

SEQ ID NO: 568400 - RNA, 64 nt, Homo Sapiens; identical to SEQ ID NO: 334743

SEQ ID NO: 568401 - RNA, 64 nt, Homo Sapiens; identical to SEQ ID NO: 334744

SEQ ID NO: 568402 - RNA, 64 nt, Homo Sapiens; identical to SEQ ID NO: 334745

SEQ ID NO: 568403 - RNA, 64 nt, Homo Sapiens; identical to SEQ ID NO: 334746

SEQ ID NO: 568404 - RNA, 64 nt, Homo Sapiens; identical to SEQ ID NO: 334747

SEQ ID NO: 568405 - RNA, 64 nt, Homo Sapiens; identical to SEQ ID NO: 334748

SEQ ID NO: 568406 - RNA, 64 nt, Homo Sapiens; identical to SEQ ID NO: 334749

SEQ ID NO: 568407 - RNA, 64 nt, Homo Sapiens; identical to SEQ ID NO: 334750

SEQ ID NO: 568408 - RNA, 64 nt, Homo Sapiens; identical to SEQ ID NO: 334751

SEQ ID NO: 568409 - RNA, 64 nt, Homo Sapiens; identical to SEQ ID NO: 334752

SEQ ID NO: 568410 - RNA, 64 nt, Homo Sapiens; identical to SEQ ID NO: 334753

SEQ ID NO: 568411 - RNA, 64 nt, Homo Sapiens; identical to SEQ ID NO: 334754

SEQ ID NO: 568412 - RNA, 64 nt, Homo Sapiens; identical to SEQ ID NO: 334755

SEQ ID NO: 568413 - RNA, 64 nt, Homo Sapiens; identical to SEQ ID NO: 334756

SEQ ID NO: 568414 - RNA, 64 nt, Homo Sapiens; identical to SEQ ID NO: 334757

SEQ ID NO: 568415 - RNA, 64 nt, Homo Sapiens; identical to SEQ ID NO: 334758

SEQ ID NO: 568416 - RNA, 64 nt, Homo Sapiens; identical to SEQ ID NO: 334759

SEQ ID NO: 568417 - RNA, 64 nt, Homo Sapiens; identical to SEQ ID NO: 334760

SEQ ID NO: 568418 - RNA, 64 nt, Homo Sapiens; identical to SEQ ID NO: 334761

SEQ ID NO: 568419 - RNA, 64 nt, Homo Sapiens; identical to SEQ ID NO: 334762

SEQ ID NO: 568420 - RNA, 64 nt, Homo Sapiens; identical to SEQ ID NO: 334763

SEQ ID NO: 568421 - RNA, 64 nt, Homo Sapiens; identical to SEQ ID NO: 334764

SEQ ID NO: 568422 - RNA, 64 nt, Homo Sapiens; identical to SEQ ID NO: 334765

SEQ ID NO: 568423 - RNA, 64 nt, Homo Sapiens; identical to SEQ ID NO: 334766

SEQ ID NO: 568424 - RNA, 64 nt, Homo Sapiens; identical to SEQ ID NO: 334767

SEQ ID NO: 568425 - RNA, 64 nt, Homo Sapiens; identical to SEQ ID NO: 334768

SEQ ID NO: 568426 - RNA, 64 nt, Homo Sapiens; identical to SEQ ID NO: 334769

SEQ ID NO: 568427 - RNA, 64 nt, Homo Sapiens; identical to SEQ ID NO: 334770

SEQ ID NO: 568428 - RNA, 64 nt, Homo Sapiens; identical to SEQ ID NO: 334771

SEQ ID NO: 568429 - RNA, 64 nt, Homo Sapiens; identical to SEQ ID NO: 334772

SEQ ID NO: 568430 - RNA, 64 nt, Homo Sapiens; identical to SEQ ID NO: 348598

SEQ ID NO: 568431 - RNA, 64 nt, Homo Sapiens; identical to SEQ ID NO: 348599

SEQ ID NO: 568432 - RNA, 64 nt, Homo Sapiens; identical to SEQ ID NO: 348600

SEQ ID NO: 568433 - RNA, 64 nt, Homo Sapiens; identical to SEQ ID NO: 348601

SEQ ID NO: 568434 - RNA, 64 nt, Homo Sapiens; identical to SEQ ID NO: 348602

SEQ ID NO: 568435 - RNA, 64 nt, Homo Sapiens; identical to SEQ ID NO: 348603

SEQ ID NO: 568436 - RNA, 64 nt, Homo Sapiens; identical to SEQ ID NO: 348604

SEQ ID NO: 568437 - RNA, 64 nt, Homo Sapiens; identical to SEQ ID NO: 348605

SEQ ID NO: 568438 - RNA, 64 nt, Homo Sapiens; identical to SEQ ID NO: 348606

SEQ ID NO: 568439 - RNA, 64 nt, Homo Sapiens; identical to SEQ ID NO: 348607

SEQ ID NO: 568440 - RNA, 64 nt, Homo Sapiens; identical to SEQ ID NO: 348608

SEQ ID NO: 568441 - RNA, 64 nt, Homo Sapiens; identical to SEQ ID NO: 348609

SEQ ID NO: 568442 - RNA, 64 nt, Homo Sapiens; identical to SEQ ID NO: 348610

SEQ ID NO: 568443 - RNA, 64 nt, Homo Sapiens; identical to SEQ ID NO: 348611

SEQ ID NO: 568444 - RNA, 64 nt, Homo Sapiens; identical to SEQ ID NO: 348612

SEQ ID NO: 568445 - RNA, 64 nt, Homo Sapiens; identical to SEQ ID NO: 348613

SEQ ID NO: 568446 - RNA, 64 nt, Homo Sapiens; identical to SEQ ID NO: 348614

SEQ ID NO: 568447 - RNA, 64 nt, Homo Sapiens; identical to SEQ ID NO: 348615

SEQ ID NO: 568448 - RNA, 64 nt, Homo Sapiens; identical to SEQ ID NO: 348616

SEQ ID NO: 568449 - RNA, 64 nt, Homo Sapiens; identical to SEQ ID NO: 348617

SEQ ID NO: 568450 - RNA, 64 nt, Homo Sapiens; identical to SEQ ID NO: 334277

SEQ ID NO: 568451 - RNA, 64 nt, Homo Sapiens; identical to SEQ ID NO: 334278

SEQ ID NO: 568452 - RNA, 64 nt, Homo Sapiens; identical to SEQ ID NO: 334279

SEQ ID NO: 568453 - RNA, 64 nt, Homo Sapiens; identical to SEQ ID NO: 334280

SEQ ID NO: 568454 - RNA, 64 nt, Homo Sapiens; identical to SEQ ID NO: 334281

SEQ ID NO: 568455 - RNA, 64 nt, Homo Sapiens; identical to SEQ ID NO: 334282

SEQ ID NO: 568456 - RNA, 64 nt, Homo Sapiens; identical to SEQ ID NO: 334283

SEQ ID NO: 568457 - RNA, 64 nt, Homo Sapiens; identical to SEQ ID NO: 334284

SEQ ID NO: 568458 - RNA, 64 nt, Homo Sapiens; identical to SEQ ID NO: 334285

SEQ ID NO: 568459 - RNA, 64 nt, Homo Sapiens; identical to SEQ ID NO: 334286

SEQ ID NO: 568460 - RNA, 64 nt, Homo Sapiens; identical to SEQ ID NO: 334287

SEQ ID NO: 568461 - RNA, 64 nt, Homo Sapiens; identical to SEQ ID NO: 334288

SEQ ID NO: 568462 - RNA, 62 nt, Homo Sapiens
ggaaguucuuucuacuuccagcuucuugcuugggcagguagaaguccaguuuuccuucucca

SEQ ID NO: 568463 - RNA, 62 nt, Homo Sapiens
acagaacucacaaaauagcagauagccugggaggcagguagaccaccuccucaguuccugug

SEQ ID NO: 568464 - RNA, 62 nt, Homo Sapiens
agucccuggccucucccccuugccgccuucugggcagguagcuuaucugcucuuccccuccc

SEQ ID NO: 568465 - RNA, 62 nt, Homo Sapiens
gcacccugggagcccggcauccugggcuggcuggcagguaugcacccagcccaucaccacuc

SEQ ID NO: 568466 - RNA, 62 nt, Homo Sapiens
gugcauccgugaauagcccacccugugacaauggcagguagugcugagggacacgagggcaa

SEQ ID NO: 568467 - RNA, 64 nt, Homo Sapiens; identical to SEQ ID NO: 238461

SEQ ID NO: 568468 - RNA, 64 nt, Homo Sapiens; identical to SEQ ID NO: 238462

SEQ ID NO: 568469 - RNA, 64 nt, Homo Sapiens; identical to SEQ ID NO: 238463

SEQ ID NO: 568470 - RNA, 64 nt, Homo Sapiens; identical to SEQ ID NO: 238464

SEQ ID NO: 568471 - RNA, 64 nt, Homo Sapiens; identical to SEQ ID NO: 238465

SEQ ID NO: 568472 - RNA, 64 nt, Homo Sapiens; identical to SEQ ID NO: 238466

SEQ ID NO: 568473 - RNA, 64 nt, Homo Sapiens; identical to SEQ ID NO: 238467

SEQ ID NO: 568474 - RNA, 64 nt, Homo Sapiens; identical to SEQ ID NO: 238468

SEQ ID NO: 568475 - RNA, 64 nt, Homo Sapiens
gccuucauggccaucuagccccaguucagggcagcauccauagcccacaagccagcgugggugg

SEQ ID NO: 568476 - RNA, 64 nt, Homo Sapiens
gggagggacccauguccauggcuucguugagggccauccauaugccagcugggggccagcccac

SEQ ID NO: 568477 - RNA, 64 nt, Homo Sapiens
aggugacaaguucuuggacuuugccccgaaagcacauccauaaaagacaaaaucugauauauug

SEQ ID NO: 568478 - RNA, 64 nt, Homo Sapiens
agauguccuacaacagguacaugguuaaacaaaccauccauaacuuggaauacugcucuggaau

SEQ ID NO: 568479 - RNA, 64 nt, Homo Sapiens; identical to SEQ ID NO: 277422

SEQ ID NO: 568480 - RNA, 64 nt, Homo Sapiens; identical to SEQ ID NO: 277423

SEQ ID NO: 568481 - RNA, 64 nt, Homo Sapiens; identical to SEQ ID NO: 277424

SEQ ID NO: 568482 - RNA, 64 nt, Homo Sapiens; identical to SEQ ID NO: 277425

SEQ ID NO: 568483 - RNA, 64 nt, Homo Sapiens; identical to SEQ ID NO: 277426

SEQ ID NO: 568484 - RNA, 64 nt, Homo Sapiens; identical to SEQ ID NO: 277427

SEQ ID NO: 568485 - RNA, 64 nt, Homo Sapiens; identical to SEQ ID NO: 277428

SEQ ID NO: 568486 - RNA, 64 nt, Homo Sapiens; identical to SEQ ID NO: 277429

SEQ ID NO: 568487 - RNA, 64 nt, Homo Sapiens; identical to SEQ ID NO: 277430

SEQ ID NO: 568488 - RNA, 64 nt, Homo Sapiens; identical to SEQ ID NO: 277431

SEQ ID NO: 568489 - RNA, 64 nt, Homo Sapiens; identical to SEQ ID NO: 277432

SEQ ID NO: 568490 - RNA, 64 nt, Homo Sapiens; identical to SEQ ID NO: 277433

SEQ ID NO: 568491 - RNA, 64 nt, Homo Sapiens; identical to SEQ ID NO: 277434

SEQ ID NO: 568492 - RNA, 64 nt, Homo Sapiens; identical to SEQ ID NO: 277435

SEQ ID NO: 568493 - RNA, 64 nt, Homo Sapiens; identical to SEQ ID NO: 277436

SEQ ID NO: 568494 - RNA, 64 nt, Homo Sapiens; identical to SEQ ID NO: 277437

SEQ ID NO: 568495 - RNA, 64 nt, Homo Sapiens; identical to SEQ ID NO: 277438

SEQ ID NO: 568496 - RNA, 64 nt, Homo Sapiens; identical to SEQ ID NO: 277439

SEQ ID NO: 568497 - RNA, 64 nt, Homo Sapiens; identical to SEQ ID NO: 277440

SEQ ID NO: 568498 - RNA, 64 nt, Homo Sapiens; identical to SEQ ID NO: 277441

SEQ ID NO: 568499 - RNA, 64 nt, Homo Sapiens; identical to SEQ ID NO: 277442

SEQ ID NO: 568500 - RNA, 64 nt, Homo Sapiens; identical to SEQ ID NO: 277443

SEQ ID NO: 568501 - RNA, 64 nt, Homo Sapiens; identical to SEQ ID NO: 277444

SEQ ID NO: 568502 - RNA, 64 nt, Homo Sapiens; identical to SEQ ID NO: 277445

SEQ ID NO: 568503 - RNA, 64 nt, Homo Sapiens; identical to SEQ ID NO: 277446

SEQ ID NO: 568504 - RNA, 64 nt, Homo Sapiens; identical to SEQ ID NO: 277447

SEQ ID NO: 568505 - RNA, 64 nt, Homo Sapiens; identical to SEQ ID NO: 277448

SEQ ID NO: 568506 - RNA, 62 nt, Homo Sapiens
ccgaguuccuuaaaucucagcugggauccuggaccugggaggccccugugagggccagcucu

SEQ ID NO: 568507 - RNA, 62 nt, Homo Sapiens
gggaggccccugugagggccagcucuggaaaaaccugggaguugaugccggaggcuguggaa

SEQ ID NO: 568508 - RNA, 62 nt, Homo Sapiens
uagagguugcagugagcugaagaaucgcuugaaccugggaguacuugggagacugaggcagg

SEQ ID NO: 568509 - RNA, 62 nt, Homo Sapiens
uuuguuaaaauuuuuuaaaacuggucgggaauaccugggaagucagugguucccaaaucugg

SEQ ID NO: 568510 - RNA, 62 nt, Homo Sapiens
ucaagcaauucugcugcaucagccucccgaguaccugggauuacaggcaugugccaccacgc

SEQ ID NO: 568511 - RNA, 62 nt, Homo Sapiens
uuuauugaguaccuacugugugcuaggcauugaccugggaacuagagauacuucacagaaua

SEQ ID NO: 568512 - RNA, 62 nt, Homo Sapiens
auuuaaaacuccagaugccccgcauuccaaccaccugggagcucaguguccccaccuugcag

SEQ ID NO: 568513 - RNA, 62 nt, Homo Sapiens
agucaucagucagggugcgucaacucagggccaccugggauccacucacagucaccgucuua

SEQ ID NO: 568514 - RNA, 62 nt, Homo Sapiens
uuggccggagaugucuuuuuacacaaacacucaccugggacguugcacagauaucuuugaag

SEQ ID NO: 568515 - RNA, 62 nt, Homo Sapiens
uccaacauaugaugaaaaccaagcugagauggaccugggaacugaugccagccuugagcaug

SEQ ID NO: 568516 - RNA, 62 nt, Homo Sapiens
gacaucaccacugcccuaugaacagaugcagaaccugggaauggaggcucagaaacaacagc

SEQ ID NO: 568517 - RNA, 62 nt, Homo Sapiens
ugccccccaugagccaggacgaagauggacuuaccugggacccagaggagaugggggcuucu

SEQ ID NO: 568518 - RNA, 62 nt, Homo Sapiens
uucaucuuucugccuccaccugggacuggaggaccugggaauggagcagggcuggggaauga

SEQ ID NO: 568519 - RNA, 62 nt, Homo Sapiens
cggagguugcggugagcugcagaauugcuugaaccugggagaacuagggaggcugaggcagg

SEQ ID NO: 568520 - RNA, 62 nt, Homo Sapiens
cagagguugcagugagcugaagaaucgcuugaaccugggaggacuugagaggcugaggcagg

SEQ ID NO: 568521 - RNA, 62 nt, Homo Sapiens
gguggcuaagucccaccauaacagcuaaggggaccugggagaugauggcucauuuccaccca

SEQ ID NO: 568522 - RNA, 62 nt, Homo Sapiens
aggauuuccagagcgcacauccacaggccuggaccugggaugaagaugaaugaagaacaugg

SEQ ID NO: 568523 - RNA, 62 nt, Homo Sapiens
gggcaugguggcaugcaccuguagucccagcuaccugggaggcugaggcaggagaauugcuu

SEQ ID NO: 568524 - RNA, 62 nt, Homo Sapiens
accugggaggcugaggcaggagaauugcuugaaccugggaggcagagguugcagugagccaa

SEQ ID NO: 568525 - RNA, 62 nt, Homo Sapiens
uguucuuccugccuuucugcguuguuguuuuaaccugggaaguuguuguuguugucauuguu

SEQ ID NO: 568526 - RNA, 62 nt, Homo Sapiens
acaggcacgcaccaccaugcagccucccaaguaccugggacuucaggugauccucacaccuu

SEQ ID NO: 568527 - RNA, 62 nt, Homo Sapiens
agaugacacaaggcacuccuagcuauugagccaccugggaugacaaacccaccucuguuggg

SEQ ID NO: 568528 - RNA, 62 nt, Homo Sapiens
cagaagccucugcaccuacucucggggaggauaccugggagaucagcauuauccugccagac

SEQ ID NO: 568529 - RNA, 62 nt, Homo Sapiens
aaaaccuccacgugacuguuuggugcaucuugaccugggaagacgccucaugggaacgaacu

SEQ ID NO: 568530 - RNA, 62 nt, Homo Sapiens
cucuguguucuguguauuugucugaauuaaugaccugggauauaaagcuaugcuagcuuuca

SEQ ID NO: 568531 - RNA, 62 nt, Homo Sapiens
gggccuaggcugauagucagagccuguggcacaccugggaugggccagggcccugggugggg

SEQ ID NO: 568532 - RNA, 62 nt, Homo Sapiens
gccccuagaaaugcugccuuugugugugggguaccugggaaaggguguggcugaggcaguca

SEQ ID NO: 568533 - RNA, 62 nt, Homo Sapiens
aaugaaaaaaaaaaauaaaggcugccucauugaccugggaaaucucacuuuuuguuaauguu

SEQ ID NO: 568534 - RNA, 62 nt, Homo Sapiens
cagagagagaaggagaaggacucagcaagccaaccugggaauagcugaugggagugagagaa

SEQ ID NO: 568535 - RNA, 62 nt, Homo Sapiens
cucggguccucuugagcaguggagcaagggagaccugggagcgugggagccaggaucagcgc

SEQ ID NO: 568536 - RNA, 62 nt, Homo Sapiens
auuugggaggcugaggcaggagaaucacuugaaccugggaggcggagguugcagugagccga

SEQ ID NO: 568537 - RNA, 62 nt, Homo Sapiens
gcagguuggccccugaacuggagcauccuggcaccugggagcgagcacagugaagacccuga

SEQ ID NO: 568538 - RNA, 62 nt, Homo Sapiens
acagugaagacccugagagcgagcacccuggcaccugggagcgagcacagugaagaccaugg

SEQ ID NO: 568539 - RNA, 62 nt, Homo Sapiens
cagagguugcagugagccggagaaucgcuugaaccugggaggacuggggaggcugaggcagg

SEQ ID NO: 568540 - RNA, 62 nt, Homo Sapiens
cauccuugauacuuucucuuaccaagcuaggaaccugggagucucucucaauuacugggacc

SEQ ID NO: 568541 - RNA, 62 nt, Homo Sapiens
cagagguugcagugagccaaagaaucgcuugaaccugggaggccucaggaggcugaggcagg

SEQ ID NO: 568542 - RNA, 62 nt, Homo Sapiens
cggaaguugcagugagccgaagaaucgcuugaaccugggaggacuugggaggcugaggcagg

SEQ ID NO: 568543 - RNA, 62 nt, Homo Sapiens
gcuucuuccagguaugggcagauacgaagcaaaccugggauuuugaugucucuagaccugca

SEQ ID NO: 568544 - RNA, 62 nt, Homo Sapiens
ccaagagccaguggcugagccuugagggaugaaccugggagcagcccucagguccccagcuc

SEQ ID NO: 568545 - RNA, 62 nt, Homo Sapiens
gccccccuacagucacugccacacugguggggaccugggacccagacccggaaccagcccag

SEQ ID NO: 568546 - RNA, 62 nt, Homo Sapiens
ugaggacagaaggcaggagacuuuggucaguuaccugggaauucugggcugccaggaaacga

SEQ ID NO: 568547 - RNA, 62 nt, Homo Sapiens
guggccaggccgugcccuugccuuccccgaugaccugggauguaccugggagcacacuuuuc

SEQ ID NO: 568548 - RNA, 62 nt, Homo Sapiens
acacuuuucccuuccccgauuugacccugcuuaccugggagcgugaggcucuuggggguggu

SEQ ID NO: 568549 - RNA, 62 nt, Homo Sapiens
cagaggcugcagugagccaaagaauugcuugaaccugggaggacucaggauccugaggcaug

SEQ ID NO: 568550 - RNA, 62 nt, Homo Sapiens
ucaggcacgcgccacuacacagccuugugaauaccugggacuuuaagcgauccuccucccuc

SEQ ID NO: 568551 - RNA, 62 nt, Homo Sapiens
acucaggagacugaggcagaaggaucgcuugaaccugggaggcagagguugcagugagccga

SEQ ID NO: 568552 - RNA, 62 nt, Homo Sapiens
acuggggaggcugagucaggagaaucgcuugaaccugggaggcggagguugcggucagcuga

SEQ ID NO: 568553 - RNA, 62 nt, Homo Sapiens
gggugagcugaagcaggguggggcguaaccucaccugggaagugcaaggagucggggaucuc

SEQ ID NO: 568554 - RNA, 62 nt, Homo Sapiens
auucucccugccagcacagcagucugaagucaaccugggaugaucaagcuugguggggggag

SEQ ID NO: 568555 - RNA, 62 nt, Homo Sapiens
cgguugcagugagccaagauagaauggcuugaaccugggaagacucgggaggcagaggcagg

SEQ ID NO: 568556 - RNA, 62 nt, Homo Sapiens
accagcugcggcgcauggagagcgagcugggcaccugggagcacagugaugaggagguggac

SEQ ID NO: 568557 - RNA, 62 nt, Homo Sapiens
gcagccucccagaagcucucuucugcuucaaaaccugggaucucuggcauuacccuauuggg

SEQ ID NO: 568558 - RNA, 62 nt, Homo Sapiens
guggguaaguccugccauucaagacuggagacaccugggaaauaaaaagagcagggcacugc

SEQ ID NO: 568559 - RNA, 62 nt, Homo Sapiens
uuucaccaguuugacucaccugcucagaguuuaccugggagaagucaucuucucuuuuuucu

SEQ ID NO: 568560 - RNA, 62 nt, Homo Sapiens
gcuuccagaauccucgcagacggcugcugggcaccugggagaccacaugccguucccaugcc

SEQ ID NO: 568561 - RNA, 62 nt, Homo Sapiens
cacacagcugcucagcaccacuuucauucuggaccugggaccuuaggagccgggugacagca

SEQ ID NO: 568562 - RNA, 62 nt, Homo Sapiens
auaaacacgacauauuuaaagaagguucuuucaccugggagcaaaugaacaauagcuaagug

SEQ ID NO: 568563 - RNA, 62 nt, Homo Sapiens
ggcccuccugccacuucagcacaccuugccccaccugggaccaucacacgugaagcaccagg

SEQ ID NO: 568564 - RNA, 62 nt, Homo Sapiens
cgaauggacaggaaagggagccagagcuguauaccugggacaggccagggagccuuuagugc

SEQ ID NO: 568565 - RNA, 62 nt, Homo Sapiens
uggagccuaccucugucugagacaggugccuaaccugggaccuguggucaugugagucuggg

SEQ ID NO: 568566 - RNA, 62 nt, Homo Sapiens
agccugguuucugggugcuagauccagcccaaaccugggaaggccagccuuguacagucugc

SEQ ID NO: 568567 - RNA, 62 nt, Homo Sapiens
auauaucccugauaaauauuucuuuaauuaaaaccugggauugagugugguuucuuuuugaa

SEQ ID NO: 568568 - RNA, 62 nt, Homo Sapiens
gagauuuaaacucugaauuugcacagcacugaaccugggaaauauuuggaauuagaacccuu

SEQ ID NO: 568569 - RNA, 64 nt, Homo Sapiens; identical to SEQ ID NO: 75114

SEQ ID NO: 568570 - RNA, 64 nt, Homo Sapiens; identical to SEQ ID NO: 75115

SEQ ID NO: 568571 - RNA, 64 nt, Homo Sapiens; identical to SEQ ID NO: 75116

SEQ ID NO: 568572 - RNA, 64 nt, Homo Sapiens; identical to SEQ ID NO: 75117

SEQ ID NO: 568573 - RNA, 64 nt, Homo Sapiens; identical to SEQ ID NO: 75118

SEQ ID NO: 568574 - RNA, 64 nt, Homo Sapiens; identical to SEQ ID NO: 75119

SEQ ID NO: 568575 - RNA, 64 nt, Homo Sapiens; identical to SEQ ID NO: 75120

SEQ ID NO: 568576 - RNA, 64 nt, Homo Sapiens; identical to SEQ ID NO: 75121

SEQ ID NO: 568577 - RNA, 64 nt, Homo Sapiens; identical to SEQ ID NO: 75122

SEQ ID NO: 568578 - RNA, 64 nt, Homo Sapiens; identical to SEQ ID NO: 75123

SEQ ID NO: 568579 - RNA, 64 nt, Homo Sapiens; identical to SEQ ID NO: 75124

SEQ ID NO: 568580 - RNA, 64 nt, Homo Sapiens; identical to SEQ ID NO: 75125

SEQ ID NO: 568581 - RNA, 64 nt, Homo Sapiens; identical to SEQ ID NO: 75126

SEQ ID NO: 568582 - RNA, 64 nt, Homo Sapiens; identical to SEQ ID NO: 75127

SEQ ID NO: 568583 - RNA, 64 nt, Homo Sapiens; identical to SEQ ID NO: 75128

SEQ ID NO: 568584 - RNA, 64 nt, Homo Sapiens; identical to SEQ ID NO: 75129

SEQ ID NO: 568585 - RNA, 64 nt, Homo Sapiens; identical to SEQ ID NO: 75130

SEQ ID NO: 568586 - RNA, 64 nt, Homo Sapiens; identical to SEQ ID NO: 75131

SEQ ID NO: 568587 - RNA, 64 nt, Homo Sapiens; identical to SEQ ID NO: 75132

SEQ ID NO: 568588 - RNA, 64 nt, Homo Sapiens; identical to SEQ ID NO: 75133

SEQ ID NO: 568589 - RNA, 64 nt, Homo Sapiens; identical to SEQ ID NO: 75134

SEQ ID NO: 568590 - RNA, 64 nt, Homo Sapiens
uguuuaaccaaagcuuugaaaugugaugaagccaccaacauaagcacuugccuaacagaaauca

SEQ ID NO: 568591 - RNA, 64 nt, Homo Sapiens
ugcagaggagcucaaugucgcgggacuagcuacaccaacauaugcacuuuuuacauuuagaaac

SEQ ID NO: 568592 - RNA, 64 nt, Homo Sapiens
uccaucuuuccauccauuaccuccauccauccuuccaacauauauuuauugaguaccuacugug

SEQ ID NO: 568593 - RNA, 64 nt, Homo Sapiens
uaaacauugaacucaguucuucaagguuucaucaccaacauaaggaaugaaguuggaaccacag

SEQ ID NO: 568594 - RNA, 64 nt, Homo Sapiens
aucaccugaggucaggaguucaagaccagccuggccaacauagugaaaccccuuguuuacucaa

SEQ ID NO: 568595 - RNA, 64 nt, Homo Sapiens
ugcaauguuauuuacuguuguaauuacuguaauaccaacauaugggccccaucugcacacuccu

SEQ ID NO: 568596 - RNA, 64 nt, Homo Sapiens
guuuucacaguuccucuuuggccacugugccuggccaacauaauugcugggauuacaggcauga

SEQ ID NO: 568597 - RNA, 64 nt, Homo Sapiens
guaguauuugcuuuuuaguccucccacuuccaccccaacauagauucgaaggacucauucuuuc

SEQ ID NO: 568598 - RNA, 64 nt, Homo Sapiens
uuaggcuucagcaucucaccuauuuuguuucuuaccaacauaauaaaaaaccuucaacugaagg

SEQ ID NO: 568599 - RNA, 64 nt, Homo Sapiens
auuaaaguauguauauauuaguauaccccguggaccaacauaauuuuaucuuuuguuaaaaugu

SEQ ID NO: 568600 - RNA, 64 nt, Homo Sapiens
ggcggugcaugccgcggugaccgcgcuggcguguccaacauagugucaccuaugacccggcugg

SEQ ID NO: 568601 - RNA, 64 nt, Homo Sapiens
cacuagaguggcuccugugacagccucucuucccccaacauacugguggaaggggggucugggg

SEQ ID NO: 568602 - RNA, 64 nt, Homo Sapiens
gaaaccccgucucuacuaaacaagaucaaccuggccaacauacuaucgccugaggucaggaguu

SEQ ID NO: 568603 - RNA, 64 nt, Homo Sapiens
ugugauuuauauaacuuuguuguccuaaaauuuuccaacauagacuuucacaacagucacucug

SEQ ID NO: 568604 - RNA, 64 nt, Homo Sapiens
ucaacuuagaaacuccaaggagguuacauguuuuccaacauauccuaaaaacugugauauaagc

SEQ ID NO: 568605 - RNA, 64 nt, Homo Sapiens
ccuguucuuugguagacugggaauguagagcuagccaacauaucacauucugaaugaauaaaua

SEQ ID NO: 568606 - RNA, 64 nt, Homo Sapiens
auuacuugaggccaggagauugagaccaguguggccaacauagcaaaaacccgucucgacgaaa

SEQ ID NO: 568607 - RNA, 64 nt, Homo Sapiens
ugcaugcuugggggugccaagggauucgagaccuccaacauacuugucugaagguggugauucu

SEQ ID NO: 568608 - RNA, 64 nt, Homo Sapiens
gaaacuccgucucuaccaaucaagaccagccugcccaacauaguaucaccugaggugaggaguu

SEQ ID NO: 568609 - RNA, 64 nt, Homo Sapiens
ucaugcccuucagcuuugaccauuaauaaccucaccaacauagccuugggcuccuuuucaagga

SEQ ID NO: 568610 - RNA, 64 nt, Homo Sapiens
aauuauaauaggaauaauuuaaacaagaauacuuccaacauaaaguccuaauauuuagaugucc

SEQ ID NO: 568611 - RNA, 64 nt, Homo Sapiens
auauauaugcugucuuaaaaggccuuaaaaacuaccaacauauaaucacugauaaaugcucccu

SEQ ID NO: 568612 - RNA, 64 nt, Homo Sapiens
cauaagugagugccaaugaaaccaauuuaauguaccaacauaagauuauccuucagaaaucugu

SEQ ID NO: 568613 - RNA, 64 nt, Homo Sapiens
augcuuugauugaugcagcaauacagacauuuuaccaacauaauuuccagucauuucccauaaa

SEQ ID NO: 568614 - RNA, 64 nt, Homo Sapiens
cuucuuuaaaucaaaagcugauuauaaauaaaugccaacauaccgcacaagcuuguauauacau

SEQ ID NO: 568615 - RNA, 64 nt, Homo Sapiens
ucuuuaauuuuaauacaaaaauuauaaugauuauccaacauauuauucuuagagcauauucuuu

SEQ ID NO: 568616 - RNA, 64 nt, Homo Sapiens
agaucacaaggucaggaguucaagaccagccuggccaacauagugaaaccccaucucuacugaa

SEQ ID NO: 568617 - RNA, 64 nt, Homo Sapiens
aaguguuguaucaaagugugauauacaaaguguaccaacauaaguguugguagcacuuaagacu

SEQ ID NO: 568618 - RNA, 64 nt, Homo Sapiens
ccaagcccucucgacugccccuauccccuggaccccaacauaccuacaaugcuggggaggcccu

SEQ ID NO: 568619 - RNA, 64 nt, Homo Sapiens
uuugaucugggcucugagcacaagucaggaaacaccaacauauucacacucucccaguagguuc

SEQ ID NO: 568620 - RNA, 64 nt, Homo Sapiens
ccagugcccucaggcguccaucugaugcaugggaccaacauaaggcaggcagggauacaaggca

SEQ ID NO: 568621 - RNA, 64 nt, Homo Sapiens
cucagccaucggucuagcauaucagucacugggcccaacauauccauuuuuaaacccuuucccc

SEQ ID NO: 568622 - RNA, 64 nt, Homo Sapiens
agcuuguuucagaaauucucacuuuuguugacugccaacauacaaaguaagggaaacucaagau

SEQ ID NO: 568623 - RNA, 64 nt, Homo Sapiens
aucacuugaggucgggaguucgagaccagccuggccaacauagcaaaacccugucucuacuaaa

SEQ ID NO: 568624 - RNA, 64 nt, Homo Sapiens
ugguuuucuaguaugaaagacaauaguacaaaaaccaacauagucuauauuugaacacacugua

SEQ ID NO: 568625 - RNA, 64 nt, Homo Sapiens
uucugcucugucuuacugacuuggucaguauggcccaacauagcgcuaaugugguucucagaaa

SEQ ID NO: 568626 - RNA, 64 nt, Homo Sapiens
uaugaagcaagcuacaugaguagaacagugucauccaacauaaaauccuauggaauucagguuc

SEQ ID NO: 568627 - RNA, 64 nt, Homo Sapiens
augaaaaccccaugaagguguggaccugggaacuccaacauaugccuugagcaugaagcugaga

SEQ ID NO: 568628 - RNA, 64 nt, Homo Sapiens
gaguguuuaaaauagcauuuaaaaaaacagcagaccaacauauaccaagaaugcauuauuccac

SEQ ID NO: 568629 - RNA, 64 nt, Homo Sapiens
guacuagcaguguuucccguagagaggucuaacaccaacauaagcuauauucucaguguagggc

SEQ ID NO: 568630 - RNA, 64 nt, Homo Sapiens
cgcuuuugugccaaacccauaaaacaagcccuucccaacauaagguaucuuauugcuaacccuc

SEQ ID NO: 568631 - RNA, 64 nt, Homo Sapiens
caucuggaguguguccaguuggacauuagguaucccaacauaacuuguaaaaggcugccauuau

SEQ ID NO: 568632 - RNA, 64 nt, Homo Sapiens
gaaaccccaucucuacugaacaagaccauagugaccaacauaguagaucacgagaucaagagau

SEQ ID NO: 568633 - RNA, 64 nt, Homo Sapiens
gauauauucaguauuguagauacuacacuaauuuccaacauaagaggcaggaagaguuuugauu

SEQ ID NO: 568634 - RNA, 64 nt, Homo Sapiens
aaaccugacuucuaaguguggguuuuucuucucuccaacauaauuauguuaauaugguccucau

SEQ ID NO: 568635 - RNA, 64 nt, Homo Sapiens
uaaagcugaaacacugaaacagccauugccuugaccaacauauuccuuugucacauuauguaaa

SEQ ID NO: 568636 - RNA, 64 nt, Homo Sapiens
uagcuagaccuuugcuuccuucuugccagcucucccaacauacccaauccuggugaucagggaa

SEQ ID NO: 568637 - RNA, 64 nt, Homo Sapiens
cuguucauccuaucccuuccaagguugguccaugccaacauaaccucugggcaucagacaucag

SEQ ID NO: 568638 - RNA, 64 nt, Homo Sapiens
uaucagcucauguucuuauuagaucugauuuucuccaacauaaauaggcauagguuugcaaucc

SEQ ID NO: 568639 - RNA, 64 nt, Homo Sapiens
ucagacauagcccagguagcuuuacaucagggauccaacauaaccacaacauacacugucaaac

SEQ ID NO: 568640 - RNA, 64 nt, Homo Sapiens
aacuuucccaugcagcuucugaaccacacuuuauccaacauacacuggagcuaguuuugagggu

SEQ ID NO: 568641 - RNA, 64 nt, Homo Sapiens
ugauaaggugguucuuucauaacucuaaugccauccaacauagcccugggagaggcauguuagg

SEQ ID NO: 568642 - RNA, 64 nt, Homo Sapiens
aucagggccuacaguaacaugccaaaaguugcuuccaacauauuucucugcuuuggauggggca

SEQ ID NO: 568643 - RNA, 64 nt, Homo Sapiens
uauaaaggagauggcuuauucaaccauagccccuccaacauaucuacuggaaauucugcugguu

SEQ ID NO: 568644 - RNA, 64 nt, Homo Sapiens
aucaccugaggucaggaguucaagaccagccuggccaacauagugaaaccccgucucuacuaaa

SEQ ID NO: 568645 - RNA, 64 nt, Homo Sapiens
aaauguuuuacacgaauguaagagcauguagaagccaacauauaaauaaauuguuuaaaaaaac

SEQ ID NO: 568646 - RNA, 64 nt, Homo Sapiens
uuacaauaaaagcaacuuuugaacauuuuucucuccaacauauuggaaaguuaaccauuuaaaa

SEQ ID NO: 568647 - RNA, 64 nt, Homo Sapiens
uccugcauuacaugaauggaguacuuaaccuucuccaacauacauuccccucauucauguggcu

SEQ ID NO: 568648 - RNA, 64 nt, Homo Sapiens
acaugaugagauaucaaggugacauuuuauuugaccaacauagccucagaucuagauaacucau

SEQ ID NO: 568649 - RNA, 64 nt, Homo Sapiens
gaaaccccaucucuacuaaacgagggcagccugaccaacauaguggaucacgaggucaggaguu

SEQ ID NO: 568650 - RNA, 64 nt, Homo Sapiens
ugacaaauagcuauaauaggaacacucccuaucaccaacauauuuugguuaguauauuccuuca

SEQ ID NO: 568651 - RNA, 64 nt, Homo Sapiens
uuuuguuuuuuaauuuggggucucuuuguuuuccccaacauaauguucauaauguuucugcauu

SEQ ID NO: 568652 - RNA, 64 nt, Homo Sapiens
aucaccugagggcaggagucugagaccagccuggccaacauagcaaaaccccaucucuauuaaa

SEQ ID NO: 568653 - RNA, 64 nt, Homo Sapiens
uauuauuccaguuagccuuggauuauuucaguggccaacauaugcagacauuuguacuccucaa

SEQ ID NO: 568654 - RNA, 64 nt, Homo Sapiens
cccauuucucauuuuacauuuuaaagucguuccuccaacauaguguguauuggucugaaggggg

SEQ ID NO: 568655 - RNA, 64 nt, Homo Sapiens
uagaaccacuauuacgugaaaaggcuugaaacaaccaacauauacaaauaaaacccugccuugu

SEQ ID NO: 568656 - RNA, 64 nt, Homo Sapiens
caagagugaaacucucaaaagcagaaacaaaaacccaacauauaugggcuguuagauaguaauu

SEQ ID NO: 568657 - RNA, 64 nt, Homo Sapiens
ccgugaccuacguaggaaaaccaaauuauaaaagccaacauauggucaucaauuaggagaaauc

SEQ ID NO: 568658 - RNA, 64 nt, Homo Sapiens
ggaaaaagaaagccuaugggaaauggcugugcucccaacauagcuuugcagaugauguggguuu

SEQ ID NO: 568659 - RNA, 64 nt, Homo Sapiens
uuuuuguuucuaagcaauauauacauaaaaucaaccaacauaucugaaaaggaucaugaaaccu

SEQ ID NO: 568660 - RNA, 64 nt, Homo Sapiens
aagucagaagaagacagcaaaaaaagcaacuuuuccaacauacaauuuacuuuuaauaaaguau

SEQ ID NO: 568661 - RNA, 64 nt, Homo Sapiens
cacaagcaaguuaucugucugccucucacugaauccaacauaucguaucagauugauuuuugua

SEQ ID NO: 568662 - RNA, 64 nt, Homo Sapiens
uuaauagaaaguuggccaauugguggcaaaauugccaacauaaguagaagggccagcuuacugu

SEQ ID NO: 568663 - RNA, 64 nt, Homo Sapiens
cuucuuaaaggucuaauuaacucacauuagacaaccaacauaauugaauaauuauaggcuuuuc

SEQ ID NO: 568664 - RNA, 64 nt, Homo Sapiens
cauacuuaaguaauauacauauuaugucugcaccccaacauaggauccuaucauuuaaaaagaa

SEQ ID NO: 568665 - RNA, 64 nt, Homo Sapiens
uaacacagauguuuuuuacccgcccugcauauucccaacauacuagugguacauaaauuuaucu

SEQ ID NO: 568666 - RNA, 64 nt, Homo Sapiens
uuuuuuacugucaguugcgggugaauugcaaaacccaacauauuauccccccuuuuuaaguagu

SEQ ID NO: 568667 - RNA, 64 nt, Homo Sapiens
aucaccugaggucaggaguuugugaccagccuggccaacauagugaaauccuguuucuacuaaa

SEQ ID NO: 568668 - RNA, 64 nt, Homo Sapiens
auucugcaggaaaccccagcagugugaacgcaucccaacauagguuaagagcaaguugaaaaca

SEQ ID NO: 568669 - RNA, 64 nt, Homo Sapiens
ccuaagaucuucaccucucugccucccuacugccccaacauagccuugaggaggcuucucagcc

SEQ ID NO: 568670 - RNA, 64 nt, Homo Sapiens
uuaaaaguccuuacaucccagauauuugaguuuaccaacauacuaugggugauggaacuuggaa

SEQ ID NO: 568671 - RNA, 64 nt, Homo Sapiens
agaauauauuaguuuucaagggagugggaggcuuccaacauaguauugaaucucaggaaaaacu

SEQ ID NO: 568672 - RNA, 64 nt, Homo Sapiens
aagggcccgugcgcuccaacccugcaucgaacugccaacauaguacaccuuuuagaaaaagauu

SEQ ID NO: 568673 - RNA, 61 nt, Homo Sapiens
gauggcgugggauguacugaaagcaaaaacaccaacauacaagucuugacaacagcaucug

SEQ ID NO: 568674 - RNA, 64 nt, Homo Sapiens
uggguacauuuuaucauuuauuagcgcugaagagccaacauauuuguagauuuuuaauaucuca

SEQ ID NO: 568675 - RNA, 64 nt, Homo Sapiens
gaaugagaauggauucuguacaauacacuagaaaccaacauaauguauuucuuuaaaaccugug

SEQ ID NO: 568676 - RNA, 64 nt, Homo Sapiens
aaaaaauggcagugaugaauuuuaaggguuucccccaacauauaaaauaaugcaaagaaucccu

SEQ ID NO: 568677 - RNA, 64 nt, Homo Sapiens
gaaaccccaucucuacuaaacgagaccauucuggccaacauaguagaucaugaggucaggagau

SEQ ID NO: 568678 - RNA, 64 nt, Homo Sapiens
ugaggacauagcaucugcccuggaaaucguuauuccaacauaauauuauuuucuagaaugcccu

SEQ ID NO: 568679 - RNA, 64 nt, Homo Sapiens
agccuuuauacaaauguauuuaguucucuuuuuuccaacauaaaauucuuguuuuaagauacaa

SEQ ID NO: 568680 - RNA, 64 nt, Homo Sapiens
agaucacgaagucaguaguuugagaccagccuggccaacauagugaaaccccgucucuacuaaa

SEQ ID NO: 568681 - RNA, 64 nt, Homo Sapiens
uauaccaagaaguccaaacccagcacgcaacagcccaacauaaccuagaaugucaagacacuca

SEQ ID NO: 568682 - RNA, 64 nt, Homo Sapiens
auggauaccgacuguuuuuauguuggaauuuguuccaacauaauuagaaucuguuuggugaguu

SEQ ID NO: 568683 - RNA, 64 nt, Homo Sapiens
aucacuugaggucaggaguuggagaccagccuggccaacauagugaaaccccgucucuacuaaa

SEQ ID NO: 568684 - RNA, 64 nt, Homo Sapiens
cuccagguucacuuuggauaugaucuuucuuuucccaacauaugcccucagaaaagugacagug

SEQ ID NO: 568685 - RNA, 64 nt, Homo Sapiens
auuauagucucuucuuucugugcugaaagauuacccaacauaccgagaaaaagggaucuaggaa

SEQ ID NO: 568686 - RNA, 64 nt, Homo Sapiens
uaaauaugcaguuuaugugucaucaauguacaugccaacauaaauauggcgauuguauagcugu

SEQ ID NO: 568687 - RNA, 64 nt, Homo Sapiens
ugcuucugagaaagcauuugccuuucuuccucucccaacauaacaaucgugguaacagaaugcg

SEQ ID NO: 568688 - RNA, 64 nt, Homo Sapiens
auuaccugaggcaaggaguuugagaccagcuuagccaacauaguaagacccccaucucuuuaaa

SEQ ID NO: 568689 - RNA, 64 nt, Homo Sapiens
ccaucauuucuagcuaaaacuccauuuggugaaaccaacauauccauuucuuuuccuaguuacg

SEQ ID NO: 568690 - RNA, 64 nt, Homo Sapiens
aaaacaggcuagcaauugcaaagucaggcuuugaccaacauauuucuuugcacugaggccuugc

SEQ ID NO: 568691 - RNA, 64 nt, Homo Sapiens
ucucuuccuugugccucuccagaaggggucucucccaacauauuuccccuucaugaagguagag

SEQ ID NO: 568692 - RNA, 64 nt, Homo Sapiens
aauacauaaaguggcaugguguuaucauuccuccccaacauaauugcuucucuucuuguucccu

SEQ ID NO: 568693 - RNA, 64 nt, Homo Sapiens
aacagacagauuuaugucuuuguaaaagucauaaccaacauaugucguuuaaaugauauuuuaa

SEQ ID NO: 568694 - RNA, 64 nt, Homo Sapiens
uuuauauguucuuugcuuccuacuucccugucuuccaacauacuguucacuuacucuggcaguc

SEQ ID NO: 568695 - RNA, 64 nt, Homo Sapiens
agaagcaaauucaccagaagggaaacaucucaggccaacauaggcaaaugaaaagggcuauuaa

SEQ ID NO: 568696 - RNA, 64 nt, Homo Sapiens
aucauuugagcccaggaauuggaaagcagccuggccaacauagugggacccugucucuacaaaa

SEQ ID NO: 568697 - RNA, 64 nt, Homo Sapiens
agccaucacaaauagccacauucugcucuacucuccaacauaccagauucuacacuguuguuau

SEQ ID NO: 568698 - RNA, 64 nt, Homo Sapiens
gaaaccccgucucuauuaaaugagaccagccuggccaacauaguaucacucaaggucaggcauu

SEQ ID NO: 568699 - RNA, 64 nt, Homo Sapiens
uuuuaaauguuuugcuauuguaggacuuccuuuaccaacauacuuuaacaacaggaaacacuug

SEQ ID NO: 568700 - RNA, 64 nt, Homo Sapiens
caccauaauuuuuuuauuuuucaaaucuuaccugccaacauauuuuaucuucucugaaagaacu

SEQ ID NO: 568701 - RNA, 64 nt, Homo Sapiens
auuuuucauuauuugggggacucuguaucagcccccaacauauugaaaaaucuaauucaauaaa

SEQ ID NO: 568702 - RNA, 64 nt, Homo Sapiens
ggggaaguggggcuugaagaagcagccuaaugaaccaacauaccguuuugugugugguuuuuuu

SEQ ID NO: 568703 - RNA, 64 nt, Homo Sapiens
gcuggguucugauccuaguuccaccaucaagccaccaacauacucccaucugugaaaggaaaga

SEQ ID NO: 568704 - RNA, 64 nt, Homo Sapiens
uuccccacccaggcacccccccccacaccagaccccaacauagcaguugaggcccgggcagggc

SEQ ID NO: 568705 - RNA, 64 nt, Homo Sapiens
gaaacccccucucuacuaaacgaaaccagccuggccaacauaguaucaccugaggucaggaguu

SEQ ID NO: 568706 - RNA, 64 nt, Homo Sapiens
ucuuuuauuaaccagucauuacacugcggaacagccaacauagaguacuugcucucguccugug

SEQ ID NO: 568707 - RNA, 64 nt, Homo Sapiens
uucaucuaaggucuggaguucgagaccagccuggccaacauagcgagagcagcuccgguggcgg

SEQ ID NO: 568708 - RNA, 64 nt, Homo Sapiens
gaaaccccaucucugcuaaacgagaccagccuggccaacauaguggaucaugaggucaggaguu

SEQ ID NO: 568709 - RNA, 64 nt, Homo Sapiens
uaaaaugucucuacuaaaaaugagaccagccuggccaacauaauaucaccugaagucagaaguu

SEQ ID NO: 568710 - RNA, 64 nt, Homo Sapiens
agaugggcuggaaguaaggaggcuuagcaaggagccaacauaacguaauaaaagcaaacagccu

SEQ ID NO: 568711 - RNA, 64 nt, Homo Sapiens
cauuuuguugcaggaaaugucuccccaccucccaccaacauauaagcuaucuuagguggagcua

SEQ ID NO: 568712 - RNA, 64 nt, Homo Sapiens
auggaagcacggggcuagaguuuccacauaggccccaacauaaaggccuucccucgcuguugag

SEQ ID NO: 568713 - RNA, 64 nt, Homo Sapiens
ccaucugcaguuaugugcugaggugauaauucauccaacauauuuguuagcauaaauauuaugc

SEQ ID NO: 568714 - RNA, 64 nt, Homo Sapiens
uuguuuuccaguggguccagagucuucucuauacccaacauauguuuacuuuaugaacuuaaau

SEQ ID NO: 568715 - RNA, 64 nt, Homo Sapiens
cuuuacccuucuccccaaacagggacuaaauguuccaacauaauaguuaggacuugauuguaga

SEQ ID NO: 568716 - RNA, 64 nt, Homo Sapiens
gagaguaauacacuauugaaaaccaagcuugccaccaacauauuacaaguuuuugucuggagcc

SEQ ID NO: 568717 - RNA, 64 nt, Homo Sapiens
ccuucccauaucucucaugaacugcccccccuccccaacauauuccauuauagugugaguggag

SEQ ID NO: 568718 - RNA, 64 nt, Homo Sapiens
gaaggggacccuccgcucuguagugcuacaggguccaacauagagccggguguccccaacagcg

SEQ ID NO: 568719 - RNA, 64 nt, Homo Sapiens
aaccauuggcaucaucguuucuuuugaauuaaaaccaacauaucagcaauagucugcucucccc

SEQ ID NO: 568720 - RNA, 64 nt, Homo Sapiens
aucaccugaggccaggaguucgagaccagccuggccaacauagcgaaacccgaucucuacuaaa

SEQ ID NO: 568721 - RNA, 64 nt, Homo Sapiens
cucccuguccccaugucccgggcuccacugggcaccaacauaaccuuguucucuguccuuucuc

SEQ ID NO: 568722 - RNA, 64 nt, Homo Sapiens
augggaguucugaagcagaaaccaugggcuaaaaccaacauacaucuuaauaccagauacccua

SEQ ID NO: 568723 - RNA, 64 nt, Homo Sapiens
augaaugcaguggauaugggaaagccuucagucaccaacauauuguggcuggacagcaggcagu

SEQ ID NO: 568724 - RNA, 64 nt, Homo Sapiens
cggaaguggcuauggaauggccacaggguuguguccaacauacagacaccacacucgugugacc

SEQ ID NO: 568725 - RNA, 64 nt, Homo Sapiens
ccuguccagcccagugccugcagaaacacuuggcccaacauagccauccaccgcugcugagucu

SEQ ID NO: 568726 - RNA, 64 nt, Homo Sapiens
uugccauagauagaagguauauagguggaauaauccaacauaaagaaaacuugaugugauugcc

SEQ ID NO: 568727 - RNA, 64 nt, Homo Sapiens
gaaaccccaucucuacuaaacgagaccagccuggccaacauaguggaucacgaggucaggaguu

SEQ ID NO: 568728 - RNA, 64 nt, Homo Sapiens
aauuuuagaagggaacaauugagauuuaggacuuccaacauaugcaguaaccuucugagauauu

SEQ ID NO: 568729 - RNA, 64 nt, Homo Sapiens
uuuauccugucucaguaggaucacauucuuucugccaacauagugguuuuucucuaugaaugaa

SEQ ID NO: 568730 - RNA, 64 nt, Homo Sapiens
caaaagcacuuuuccaucuuguacacgagauacaccaacauagcuacaaucaaacaggccuggg

SEQ ID NO: 568731 - RNA, 64 nt, Homo Sapiens
cugcuagaaucuggccccuggccaucuuaaagugccaacauaugccugcaggguuuauaaaaaa

SEQ ID NO: 568732 - RNA, 64 nt, Homo Sapiens
uuucaagacuucugaugggucaaggaaaaagaugccaacauacccguauuuaccaaguacuaug

SEQ ID NO: 568733 - RNA, 64 nt, Homo Sapiens
cugaggagugugaacuguuggggucaguuaagacccaacauaacucuaucagaagaaaacuguu

SEQ ID NO: 568734 - RNA, 64 nt, Homo Sapiens
cacugggcauuggguaagggccaagccaucuggcccaacauacgcugaauuggcugccaagagu

SEQ ID NO: 568735 - RNA, 64 nt, Homo Sapiens
uacugaaaauacugaaacugaccauuauaaaaucccaacauauaugaaccuuuucuggccauga

SEQ ID NO: 568736 - RNA, 64 nt, Homo Sapiens
agcuaccagucuaauguguaaugguaguguagggccaacauacagaaguguuaaacuaauucac

SEQ ID NO: 568737 - RNA, 64 nt, Homo Sapiens
caauccccgccaagagacuggcauagcuggacauccaacauaccaauuuucugcuaauacaggu

SEQ ID NO: 568738 - RNA, 64 nt, Homo Sapiens
gggguucguuaugccaaagugucuacaugugccaccaacauaaaacaaaaccaagccuuggcuc

SEQ ID NO: 568739 - RNA, 64 nt, Homo Sapiens
ugaguggugaauuagcaacaguaacacugauuauccaacauauauuuuggaauaucuacuaugu

SEQ ID NO: 568740 - RNA, 64 nt, Homo Sapiens
ggcagcggaaggggcugacugggucugguccuuaccaacauagacggugcaaacacucuuaaca

SEQ ID NO: 568741 - RNA, 64 nt, Homo Sapiens
ggaugacaaggucaggaguucaagaccagcuuggccaacauagugaaaccccgucucugcugaa

SEQ ID NO: 568742 - RNA, 64 nt, Homo Sapiens
aucaccugaggucaggaguucaagaccagucuggccaacauagcaaaacccugucucuacuaaa

SEQ ID NO: 568743 - RNA, 64 nt, Homo Sapiens
uagccuuuuauuauuuuucuugucaagcuguggaccaacauauauagcugguauguuucauaaa

SEQ ID NO: 568744 - RNA, 64 nt, Homo Sapiens
acauuggggauugaaaaucauauugguauuugcaccaacauagucauaaaauaguauguuaaua

SEQ ID NO: 568745 - RNA, 64 nt, Homo Sapiens
aucaccggaggucaggaguucgagaccagccuugccaacauagugaaacccugucucuacuaaa

SEQ ID NO: 568746 - RNA, 64 nt, Homo Sapiens
guucacauugaugauucccaagucaauaagcuugccaacauaauggacuugaacaaagauggaa

SEQ ID NO: 568747 - RNA, 64 nt, Homo Sapiens
cuuggagcagagagaacaggcuguaaauggguugccaacauaagcuggcugagaaauaaaagaa

SEQ ID NO: 568748 - RNA, 64 nt, Homo Sapiens
acaggaaagugucaauaaaaaaacuugagcaacaccaacauauuuuuucuuaaaaugucacguu

SEQ ID NO: 568749 - RNA, 64 nt, Homo Sapiens
acuucuaaaaagacaagaaacauggccuaaauaaccaacauagauuuacauaguaaguuucaca

SEQ ID NO: 568750 - RNA, 64 nt, Homo Sapiens
agucauuuguaaccuugcuuaaguauuucuuaguccaacauagauauuuucuuucuccugacca

SEQ ID NO: 568751 - RNA, 64 nt, Homo Sapiens
ucuaaccucagauaagugcagugucuuugcaaugccaacauaagggagaucuuggccaacguga

SEQ ID NO: 568752 - RNA, 64 nt, Homo Sapiens
aaaaccucaucucuacuaaagagaacuggccuggccaacauagcucacuugagguuaggaguuu

SEQ ID NO: 568753 - RNA, 64 nt, Homo Sapiens
aacaaacacaccaaacaaagcugcuuuuugugagccaacauagucaugcuuagaacugagaaaa

SEQ ID NO: 568754 - RNA, 64 nt, Homo Sapiens
auuuuugcagccuaagaguuuuaauauucacuagccaacauaguccccauuuaucuuuugucua

SEQ ID NO: 568755 - RNA, 64 nt, Homo Sapiens
ccagcucugggaccaaaagcgcugggggcuggggccaacauaccaggccuuuugggagccacag

SEQ ID NO: 568756 - RNA, 64 nt, Homo Sapiens
ccucagcuuaccucugcagggacuucuggcggguccaacauagcagggaaagcagcugucaccu

SEQ ID NO: 568757 - RNA, 64 nt, Homo Sapiens
cuuugugccucgguuauuaaggaaaaaaaaauguccaacauacaguuuuuaaaguguggcaguu

SEQ ID NO: 568758 - RNA, 64 nt, Homo Sapiens; identical to SEQ ID NO: 165047

SEQ ID NO: 568759 - RNA, 64 nt, Homo Sapiens; identical to SEQ ID NO: 165048

SEQ ID NO: 568760 - RNA, 64 nt, Homo Sapiens; identical to SEQ ID NO: 165049

SEQ ID NO: 568761 - RNA, 64 nt, Homo Sapiens; identical to SEQ ID NO: 165050

SEQ ID NO: 568762 - RNA, 64 nt, Homo Sapiens; identical to SEQ ID NO: 165051

SEQ ID NO: 568763 - RNA, 64 nt, Homo Sapiens; identical to SEQ ID NO: 165052

SEQ ID NO: 568764 - RNA, 64 nt, Homo Sapiens; identical to SEQ ID NO: 165053

SEQ ID NO: 568765 - RNA, 64 nt, Homo Sapiens; identical to SEQ ID NO: 165054

SEQ ID NO: 568766 - RNA, 64 nt, Homo Sapiens; identical to SEQ ID NO: 165055

SEQ ID NO: 568767 - RNA, 64 nt, Homo Sapiens; identical to SEQ ID NO: 165056

SEQ ID NO: 568768 - RNA, 64 nt, Homo Sapiens; identical to SEQ ID NO: 165057

SEQ ID NO: 568769 - RNA, 64 nt, Homo Sapiens; identical to SEQ ID NO: 165058

SEQ ID NO: 568770 - RNA, 64 nt, Homo Sapiens; identical to SEQ ID NO: 165059

SEQ ID NO: 568771 - RNA, 64 nt, Homo Sapiens; identical to SEQ ID NO: 165060

SEQ ID NO: 568772 - RNA, 64 nt, Homo Sapiens; identical to SEQ ID NO: 165061

SEQ ID NO: 568773 - RNA, 64 nt, Homo Sapiens; identical to SEQ ID NO: 165062

SEQ ID NO: 568774 - RNA, 64 nt, Homo Sapiens; identical to SEQ ID NO: 236262

SEQ ID NO: 568775 - RNA, 64 nt, Homo Sapiens; identical to SEQ ID NO: 236263

SEQ ID NO: 568776 - RNA, 64 nt, Homo Sapiens; identical to SEQ ID NO: 236264

SEQ ID NO: 568777 - RNA, 64 nt, Homo Sapiens; identical to SEQ ID NO: 236265

SEQ ID NO: 568778 - RNA, 64 nt, Homo Sapiens; identical to SEQ ID NO: 236266

SEQ ID NO: 568779 - RNA, 64 nt, Homo Sapiens; identical to SEQ ID NO: 236267

SEQ ID NO: 568780 - RNA, 64 nt, Homo Sapiens; identical to SEQ ID NO: 236268

SEQ ID NO: 568781 - RNA, 64 nt, Homo Sapiens; identical to SEQ ID NO: 236269

SEQ ID NO: 568782 - RNA, 64 nt, Homo Sapiens; identical to SEQ ID NO: 167990

SEQ ID NO: 568783 - RNA, 64 nt, Homo Sapiens; identical to SEQ ID NO: 167991

SEQ ID NO: 568784 - RNA, 64 nt, Homo Sapiens; identical to SEQ ID NO: 167992

SEQ ID NO: 568785 - RNA, 64 nt, Homo Sapiens; identical to SEQ ID NO: 167993

SEQ ID NO: 568786 - RNA, 64 nt, Homo Sapiens; identical to SEQ ID NO: 167994

SEQ ID NO: 568787 - RNA, 64 nt, Homo Sapiens; identical to SEQ ID NO: 167995

SEQ ID NO: 568788 - RNA, 64 nt, Homo Sapiens; identical to SEQ ID NO: 167996

SEQ ID NO: 568789 - RNA, 64 nt, Homo Sapiens; identical to SEQ ID NO: 167997

SEQ ID NO: 568790 - RNA, 64 nt, Homo Sapiens; identical to SEQ ID NO: 167998

SEQ ID NO: 568791 - RNA, 64 nt, Homo Sapiens; identical to SEQ ID NO: 167999

SEQ ID NO: 568792 - RNA, 64 nt, Homo Sapiens; identical to SEQ ID NO: 168000

SEQ ID NO: 568793 - RNA, 64 nt, Homo Sapiens; identical to SEQ ID NO: 168001

SEQ ID NO: 568794 - RNA, 64 nt, Homo Sapiens; identical to SEQ ID NO: 168002

SEQ ID NO: 568795 - RNA, 64 nt, Homo Sapiens; identical to SEQ ID NO: 168003

SEQ ID NO: 568796 - RNA, 64 nt, Homo Sapiens; identical to SEQ ID NO: 168004

SEQ ID NO: 568797 - RNA, 64 nt, Homo Sapiens; identical to SEQ ID NO: 168005

SEQ ID NO: 568798 - RNA, 64 nt, Homo Sapiens; identical to SEQ ID NO: 168006

SEQ ID NO: 568799 - RNA, 64 nt, Homo Sapiens; identical to SEQ ID NO: 168007

SEQ ID NO: 568800 - RNA, 64 nt, Homo Sapiens; identical to SEQ ID NO: 168008

SEQ ID NO: 568801 - RNA, 64 nt, Homo Sapiens; identical to SEQ ID NO: 168009

SEQ ID NO: 568802 - RNA, 64 nt, Homo Sapiens; identical to SEQ ID NO: 168010

SEQ ID NO: 568803 - RNA, 64 nt, Homo Sapiens; identical to SEQ ID NO: 168011

SEQ ID NO: 568804 - RNA, 64 nt, Homo Sapiens; identical to SEQ ID NO: 168012

SEQ ID NO: 568805 - RNA, 64 nt, Homo Sapiens; identical to SEQ ID NO: 168013

SEQ ID NO: 568806 - RNA, 64 nt, Homo Sapiens; identical to SEQ ID NO: 168014

SEQ ID NO: 568807 - RNA, 64 nt, Homo Sapiens; identical to SEQ ID NO: 168015

SEQ ID NO: 568808 - RNA, 64 nt, Homo Sapiens; identical to SEQ ID NO: 168016

SEQ ID NO: 568809 - RNA, 64 nt, Homo Sapiens; identical to SEQ ID NO: 168017

SEQ ID NO: 568810 - RNA, 64 nt, Homo Sapiens; identical to SEQ ID NO: 168018

SEQ ID NO: 568811 - RNA, 64 nt, Homo Sapiens; identical to SEQ ID NO: 168018

SEQ ID NO: 568812 - RNA, 64 nt, Homo Sapiens; identical to SEQ ID NO: 168020

SEQ ID NO: 568813 - RNA, 64 nt, Homo Sapiens; identical to SEQ ID NO: 168021

SEQ ID NO: 568814 - RNA, 64 nt, Homo Sapiens; identical to SEQ ID NO: 168022

SEQ ID NO: 568815 - RNA, 64 nt, Homo Sapiens; identical to SEQ ID NO: 168023

SEQ ID NO: 568816 - RNA, 64 nt, Homo Sapiens; identical to SEQ ID NO: 168024

SEQ ID NO: 568817 - RNA, 64 nt, Homo Sapiens; identical to SEQ ID NO: 168025

SEQ ID NO: 568818 - RNA, 64 nt, Homo Sapiens; identical to SEQ ID NO: 168026

SEQ ID NO: 568819 - RNA, 64 nt, Homo Sapiens; identical to SEQ ID NO: 176114

SEQ ID NO: 568820 - RNA, 64 nt, Homo Sapiens; identical to SEQ ID NO: 176115

SEQ ID NO: 568821 - RNA, 64 nt, Homo Sapiens; identical to SEQ ID NO: 176116

SEQ ID NO: 568822 - RNA, 64 nt, Homo Sapiens; identical to SEQ ID NO: 176117

SEQ ID NO: 568823 - RNA, 64 nt, Homo Sapiens; identical to SEQ ID NO: 176118

SEQ ID NO: 568824 - RNA, 64 nt, Homo Sapiens; identical to SEQ ID NO: 176119

SEQ ID NO: 568825 - RNA, 64 nt, Homo Sapiens; identical to SEQ ID NO: 176120

SEQ ID NO: 568826 - RNA, 64 nt, Homo Sapiens; identical to SEQ ID NO: 176121

SEQ ID NO: 568827 - RNA, 64 nt, Homo Sapiens; identical to SEQ ID NO: 176122

SEQ ID NO: 568828 - RNA, 64 nt, Homo Sapiens; identical to SEQ ID NO: 176123

SEQ ID NO: 568829 - RNA, 64 nt, Homo Sapiens; identical to SEQ ID NO: 176124

SEQ ID NO: 568830 - RNA, 64 nt, Homo Sapiens; identical to SEQ ID NO: 176125

SEQ ID NO: 568831 - RNA, 64 nt, Homo Sapiens; identical to SEQ ID NO: 176126

SEQ ID NO: 568832 - RNA, 64 nt, Homo Sapiens; identical to SEQ ID NO: 176127

SEQ ID NO: 568833 - RNA, 64 nt, Homo Sapiens; identical to SEQ ID NO: 176128

SEQ ID NO: 568834 - RNA, 64 nt, Homo Sapiens; identical to SEQ ID NO: 176129

SEQ ID NO: 568835 - RNA, 64 nt, Homo Sapiens; identical to SEQ ID NO: 176130

SEQ ID NO: 568836 - RNA, 64 nt, Homo Sapiens; identical to SEQ ID NO: 176131

SEQ ID NO: 568837 - RNA, 64 nt, Homo Sapiens; identical to SEQ ID NO: 176132

SEQ ID NO: 568838 - RNA, 64 nt, Homo Sapiens; identical to SEQ ID NO: 176133

SEQ ID NO: 568839 - RNA, 64 nt, Homo Sapiens; identical to SEQ ID NO: 176134

SEQ ID NO: 568840 - RNA, 64 nt, Homo Sapiens; identical to SEQ ID NO: 176135

SEQ ID NO: 568841 - RNA, 64 nt, Homo Sapiens; identical to SEQ ID NO: 176136

SEQ ID NO: 568842 - RNA, 64 nt, Homo Sapiens; identical to SEQ ID NO: 176137

SEQ ID NO: 568843 - RNA, 64 nt, Homo Sapiens; identical to SEQ ID NO: 176138

SEQ ID NO: 568844 - RNA, 64 nt, Homo Sapiens; identical to SEQ ID NO: 176139

SEQ ID NO: 568845 - RNA, 64 nt, Homo Sapiens; identical to SEQ ID NO: 176140

SEQ ID NO: 568846 - RNA, 64 nt, Homo Sapiens; identical to SEQ ID NO: 176141

SEQ ID NO: 568847 - RNA, 64 nt, Homo Sapiens; identical to SEQ ID NO: 176142

SEQ ID NO: 568848 - RNA, 64 nt, Homo Sapiens; identical to SEQ ID NO: 176143

SEQ ID NO: 568849 - RNA, 64 nt, Homo Sapiens; identical to SEQ ID NO: 176144

SEQ ID NO: 568850 - RNA, 64 nt, Homo Sapiens; identical to SEQ ID NO: 176145

SEQ ID NO: 568851 - RNA, 64 nt, Homo Sapiens; identical to SEQ ID NO: 176146

SEQ ID NO: 568852 - RNA, 64 nt, Homo Sapiens; identical to SEQ ID NO: 176147

SEQ ID NO: 568853 - RNA, 64 nt, Homo Sapiens; identical to SEQ ID NO: 176148

SEQ ID NO: 568854 - RNA, 64 nt, Homo Sapiens; identical to SEQ ID NO: 176149

SEQ ID NO: 568855 - RNA, 64 nt, Homo Sapiens; identical to SEQ ID NO: 176150

SEQ ID NO: 568856 - RNA, 64 nt, Homo Sapiens; identical to SEQ ID NO: 176151

SEQ ID NO: 568857 - RNA, 64 nt, Homo Sapiens; identical to SEQ ID NO: 176152

SEQ ID NO: 568858 - RNA, 64 nt, Homo Sapiens; identical to SEQ ID NO: 176153

SEQ ID NO: 568859 - RNA, 64 nt, Homo Sapiens; identical to SEQ ID NO: 176154

SEQ ID NO: 568860 - RNA, 64 nt, Homo Sapiens; identical to SEQ ID NO: 176155

SEQ ID NO: 568861 - RNA, 64 nt, Homo Sapiens; identical to SEQ ID NO: 176156

SEQ ID NO: 568862 - RNA, 57 nt, Homo Sapiens; identical to SEQ ID NO: 176157

SEQ ID NO: 568863 - RNA, 64 nt, Homo Sapiens; identical to SEQ ID NO: 176158

SEQ ID NO: 568864 - RNA, 64 nt, Homo Sapiens; identical to SEQ ID NO: 176159

SEQ ID NO: 568865 - RNA, 64 nt, Homo Sapiens; identical to SEQ ID NO: 176160

SEQ ID NO: 568866 - RNA, 64 nt, Homo Sapiens; identical to SEQ ID NO: 176161

SEQ ID NO: 568867 - RNA, 64 nt, Homo Sapiens; identical to SEQ ID NO: 176162

SEQ ID NO: 568868 - RNA, 64 nt, Homo Sapiens; identical to SEQ ID NO: 176163

SEQ ID NO: 568869 - RNA, 64 nt, Homo Sapiens; identical to SEQ ID NO: 176164

SEQ ID NO: 568870 - RNA, 64 nt, Homo Sapiens; identical to SEQ ID NO: 176165

SEQ ID NO: 568871 - RNA, 64 nt, Homo Sapiens; identical to SEQ ID NO: 176166

SEQ ID NO: 568872 - RNA, 64 nt, Homo Sapiens; identical to SEQ ID NO: 176167

SEQ ID NO: 568873 - RNA, 64 nt, Homo Sapiens; identical to SEQ ID NO: 176168

SEQ ID NO: 568874 - RNA, 64 nt, Homo Sapiens; identical to SEQ ID NO: 176169

SEQ ID NO: 568875 - RNA, 64 nt, Homo Sapiens; identical to SEQ ID NO: 176170

SEQ ID NO: 568876 - RNA, 64 nt, Homo Sapiens; identical to SEQ ID NO: 176171

SEQ ID NO: 568877 - RNA, 64 nt, Homo Sapiens; identical to SEQ ID NO: 176172

SEQ ID NO: 568878 - RNA, 64 nt, Homo Sapiens; identical to SEQ ID NO: 176173

SEQ ID NO: 568879 - RNA, 64 nt, Homo Sapiens; identical to SEQ ID NO: 176174

SEQ ID NO: 568880 - RNA, 64 nt, Homo Sapiens; identical to SEQ ID NO: 176175

SEQ ID NO: 568881 - RNA, 64 nt, Homo Sapiens; identical to SEQ ID NO: 176176

SEQ ID NO: 568882 - RNA, 64 nt, Homo Sapiens; identical to SEQ ID NO: 176177

SEQ ID NO: 568883 - RNA, 64 nt, Homo Sapiens; identical to SEQ ID NO: 176178

SEQ ID NO: 568884 - RNA, 64 nt, Homo Sapiens; identical to SEQ ID NO: 176179

SEQ ID NO: 568885 - RNA, 64 nt, Homo Sapiens; identical to SEQ ID NO: 176180

SEQ ID NO: 568886 - RNA, 64 nt, Homo Sapiens; identical to SEQ ID NO: 176181

SEQ ID NO: 568887 - RNA, 64 nt, Homo Sapiens; identical to SEQ ID NO: 176182

SEQ ID NO: 568888 - RNA, 64 nt, Homo Sapiens; identical to SEQ ID NO: 176183

SEQ ID NO: 568889 - RNA, 64 nt, Homo Sapiens; identical to SEQ ID NO: 176184

SEQ ID NO: 568890 - RNA, 64 nt, Homo Sapiens; identical to SEQ ID NO: 176185

SEQ ID NO: 568891 - RNA, 64 nt, Homo Sapiens; identical to SEQ ID NO: 176186

SEQ ID NO: 568892 - RNA, 64 nt, Homo Sapiens; identical to SEQ ID NO: 176187

SEQ ID NO: 568893 - RNA, 64 nt, Homo Sapiens; identical to SEQ ID NO: 176188

SEQ ID NO: 568894 - RNA, 64 nt, Homo Sapiens; identical to SEQ ID NO: 176189

SEQ ID NO: 568895 - RNA, 64 nt, Homo Sapiens; identical to SEQ ID NO: 176190

SEQ ID NO: 568896 - RNA, 64 nt, Homo Sapiens; identical to SEQ ID NO: 176191

SEQ ID NO: 568897 - RNA, 64 nt, Homo Sapiens; identical to SEQ ID NO: 176192

SEQ ID NO: 568898 - RNA, 64 nt, Homo Sapiens; identical to SEQ ID NO: 176193

SEQ ID NO: 568899 - RNA, 53 nt, Homo Sapiens; identical to SEQ ID NO: 176194

SEQ ID NO: 568900 - RNA, 64 nt, Homo Sapiens; identical to SEQ ID NO: 176195

SEQ ID NO: 568901 - RNA, 64 nt, Homo Sapiens; identical to SEQ ID NO: 176196

SEQ ID NO: 568902 - RNA, 64 nt, Homo Sapiens; identical to SEQ ID NO: 176197

SEQ ID NO: 568903 - RNA, 64 nt, Homo Sapiens; identical to SEQ ID NO: 176198

SEQ ID NO: 568904 - RNA, 64 nt, Homo Sapiens; identical to SEQ ID NO: 176199

SEQ ID NO: 568905 - RNA, 64 nt, Homo Sapiens; identical to SEQ ID NO: 176200

SEQ ID NO: 568906 - RNA, 64 nt, Homo Sapiens; identical to SEQ ID NO: 176201

SEQ ID NO: 568907 - RNA, 64 nt, Homo Sapiens; identical to SEQ ID NO: 176202

SEQ ID NO: 568908 - RNA, 64 nt, Homo Sapiens; identical to SEQ ID NO: 176203

SEQ ID NO: 568909 - RNA, 64 nt, Homo Sapiens; identical to SEQ ID NO: 176204

SEQ ID NO: 568910 - RNA, 64 nt, Homo Sapiens; identical to SEQ ID NO: 176205

SEQ ID NO: 568911 - RNA, 64 nt, Homo Sapiens; identical to SEQ ID NO: 176206

SEQ ID NO: 568912 - RNA, 64 nt, Homo Sapiens; identical to SEQ ID NO: 176207

SEQ ID NO: 568913 - RNA, 64 nt, Homo Sapiens; identical to SEQ ID NO: 176208

SEQ ID NO: 568914 - RNA, 64 nt, Homo Sapiens; identical to SEQ ID NO: 176209

SEQ ID NO: 568915 - RNA, 64 nt, Homo Sapiens; identical to SEQ ID NO: 176210

SEQ ID NO: 568916 - RNA, 64 nt, Homo Sapiens; identical to SEQ ID NO: 176211

SEQ ID NO: 568917 - RNA, 64 nt, Homo Sapiens; identical to SEQ ID NO: 176212

SEQ ID NO: 568918 - RNA, 64 nt, Homo Sapiens; identical to SEQ ID NO: 176213

SEQ ID NO: 568919 - RNA, 64 nt, Homo Sapiens; identical to SEQ ID NO: 176214

SEQ ID NO: 568920 - RNA, 64 nt, Homo Sapiens; identical to SEQ ID NO: 176215

SEQ ID NO: 568921 - RNA, 64 nt, Homo Sapiens; identical to SEQ ID NO: 176216

SEQ ID NO: 568922 - RNA, 64 nt, Homo Sapiens; identical to SEQ ID NO: 176217

SEQ ID NO: 568923 - RNA, 64 nt, Homo Sapiens; identical to SEQ ID NO: 176218

SEQ ID NO: 568924 - RNA, 64 nt, Homo Sapiens; identical to SEQ ID NO: 176219

SEQ ID NO: 568925 - RNA, 64 nt, Homo Sapiens; identical to SEQ ID NO: 176220

SEQ ID NO: 568926 - RNA, 64 nt, Homo Sapiens; identical to SEQ ID NO: 176221

SEQ ID NO: 568927 - RNA, 64 nt, Homo Sapiens; identical to SEQ ID NO: 176222

SEQ ID NO: 568928 - RNA, 64 nt, Homo Sapiens; identical to SEQ ID NO: 176223

SEQ ID NO: 568929 - RNA, 64 nt, Homo Sapiens; identical to SEQ ID NO: 176224

SEQ ID NO: 568930 - RNA, 64 nt, Homo Sapiens; identical to SEQ ID NO: 176225

SEQ ID NO: 568931 - RNA, 64 nt, Homo Sapiens; identical to SEQ ID NO: 176226

SEQ ID NO: 568932 - RNA, 64 nt, Homo Sapiens; identical to SEQ ID NO: 176227

SEQ ID NO: 568933 - RNA, 64 nt, Homo Sapiens; identical to SEQ ID NO: 176228

SEQ ID NO: 568934 - RNA, 64 nt, Homo Sapiens; identical to SEQ ID NO: 176229

SEQ ID NO: 568935 - RNA, 64 nt, Homo Sapiens; identical to SEQ ID NO: 176230

SEQ ID NO: 568936 - RNA, 64 nt, Homo Sapiens; identical to SEQ ID NO: 176231

SEQ ID NO: 568937 - RNA, 64 nt, Homo Sapiens; identical to SEQ ID NO: 176232

SEQ ID NO: 568938 - RNA, 64 nt, Homo Sapiens; identical to SEQ ID NO: 176233

SEQ ID NO: 568939 - RNA, 64 nt, Homo Sapiens; identical to SEQ ID NO: 176234

SEQ ID NO: 568940 - RNA, 64 nt, Homo Sapiens; identical to SEQ ID NO: 176235

SEQ ID NO: 568941 - RNA, 64 nt, Homo Sapiens; identical to SEQ ID NO: 176236

SEQ ID NO: 568942 - RNA, 64 nt, Homo Sapiens; identical to SEQ ID NO: 176237

SEQ ID NO: 568943 - RNA, 64 nt, Homo Sapiens; identical to SEQ ID NO: 176238

SEQ ID NO: 568944 - RNA, 51 nt, Homo Sapiens; identical to SEQ ID NO: 176239

SEQ ID NO: 568945 - RNA, 64 nt, Homo Sapiens; identical to SEQ ID NO: 176240

SEQ ID NO: 568946 - RNA, 64 nt, Homo Sapiens; identical to SEQ ID NO: 176241

SEQ ID NO: 568947 - RNA, 64 nt, Homo Sapiens; identical to SEQ ID NO: 176242

SEQ ID NO: 568948 - RNA, 64 nt, Homo Sapiens; identical to SEQ ID NO: 176243

SEQ ID NO: 568949 - RNA, 64 nt, Homo Sapiens; identical to SEQ ID NO: 176244

SEQ ID NO: 568950 - RNA, 64 nt, Homo Sapiens; identical to SEQ ID NO: 176245

SEQ ID NO: 568951 - RNA, 64 nt, Homo Sapiens; identical to SEQ ID NO: 176246

SEQ ID NO: 568952 - RNA, 64 nt, Homo Sapiens; identical to SEQ ID NO: 176247

SEQ ID NO: 568953 - RNA, 64 nt, Homo Sapiens; identical to SEQ ID NO: 176248

SEQ ID NO: 568954 - RNA, 64 nt, Homo Sapiens; identical to SEQ ID NO: 176249

SEQ ID NO: 568955 - RNA, 64 nt, Homo Sapiens; identical to SEQ ID NO: 176250

SEQ ID NO: 568956 - RNA, 64 nt, Homo Sapiens; identical to SEQ ID NO: 176251

SEQ ID NO: 568957 - RNA, 64 nt, Homo Sapiens; identical to SEQ ID NO: 176252

SEQ ID NO: 568958 - RNA, 64 nt, Homo Sapiens; identical to SEQ ID NO: 176253

SEQ ID NO: 568959 - RNA, 64 nt, Homo Sapiens; identical to SEQ ID NO: 176254

SEQ ID NO: 568960 - RNA, 64 nt, Homo Sapiens; identical to SEQ ID NO: 176255

SEQ ID NO: 568961 - RNA, 64 nt, Homo Sapiens; identical to SEQ ID NO: 176256

SEQ ID NO: 568962 - RNA, 64 nt, Homo Sapiens; identical to SEQ ID NO: 176257

SEQ ID NO: 568963 - RNA, 64 nt, Homo Sapiens; identical to SEQ ID NO: 176258

SEQ ID NO: 568964 - RNA, 64 nt, Homo Sapiens; identical to SEQ ID NO: 176259

SEQ ID NO: 568965 - RNA, 64 nt, Homo Sapiens; identical to SEQ ID NO: 176260

SEQ ID NO: 568966 - RNA, 64 nt, Homo Sapiens; identical to SEQ ID NO: 176261

SEQ ID NO: 568967 - RNA, 64 nt, Homo Sapiens; identical to SEQ ID NO: 176262

SEQ ID NO: 568968 - RNA, 64 nt, Homo Sapiens; identical to SEQ ID NO: 176263

SEQ ID NO: 568969 - RNA, 64 nt, Homo Sapiens; identical to SEQ ID NO: 176264

SEQ ID NO: 568970 - RNA, 64 nt, Homo Sapiens; identical to SEQ ID NO: 176265

SEQ ID NO: 568971 - RNA, 64 nt, Homo Sapiens; identical to SEQ ID NO: 176266

SEQ ID NO: 568972 - RNA, 64 nt, Homo Sapiens; identical to SEQ ID NO: 176267

SEQ ID NO: 568973 - RNA, 64 nt, Homo Sapiens; identical to SEQ ID NO: 176268

SEQ ID NO: 568974 - RNA, 64 nt, Homo Sapiens; identical to SEQ ID NO: 176269

SEQ ID NO: 568975 - RNA, 53 nt, Homo Sapiens; identical to SEQ ID NO: 176270

SEQ ID NO: 568976 - RNA, 64 nt, Homo Sapiens; identical to SEQ ID NO: 176271

SEQ ID NO: 568977 - RNA, 64 nt, Homo Sapiens; identical to SEQ ID NO: 176272

SEQ ID NO: 568978 - RNA, 64 nt, Homo Sapiens
caugucccaggcacuguacuaaccuacagagaugcuaagagaaaaaaaagacuuguuucugauc

SEQ ID NO: 568979 - RNA, 64 nt, Homo Sapiens
ggaaacucagggcuucuaguuucucuuagaaaagcuaagagaagauaaggucugaauaauagca

SEQ ID NO: 568980 - RNA, 64 nt, Homo Sapiens
gcuuuuuuuuuuuuuuugguuaaguuuguuuuuucuaagagauuugcaaugcaaggucuccuug

SEQ ID NO: 568981 - RNA, 64 nt, Homo Sapiens
guuuugcuucaagaugucagaaagucaaguucagcuaagagacacccagguccccagcuugccc

SEQ ID NO: 568982 - RNA, 64 nt, Homo Sapiens
acuguugguggaaucuuuuacauaacugaugccuguucaaaaacgcauucaauacuagcagauu

SEQ ID NO: 568983 - RNA, 64 nt, Homo Sapiens
auggaaaauugaauuuucuuggaaccauucugaaguucaaaacuugcaacuauaucuauaugug

SEQ ID NO: 568984 - RNA, 64 nt, Homo Sapiens
uugcaagaaagucagaccuguuucuuguaacuggguucaaaaagaaaaaaauaauaaaaauaaa

SEQ ID NO: 568985 - RNA, 64 nt, Homo Sapiens
auucucacucugcuuugcaucccccaaacuucuuguucaaaacggggggaguuuaggagacuuu

SEQ ID NO: 568986 - RNA, 64 nt, Homo Sapiens
uuuucacagcaucagcagucaucucacuaguuauguucaaaaaaguaagugaaauuuuaugucu

SEQ ID NO: 568987 - RNA, 64 nt, Homo Sapiens
uucuccaguuacuguauucuacaaauauuuuuauguucaaaacacacaguacagacagcaugga

SEQ ID NO: 568988 - RNA, 64 nt, Homo Sapiens
uucauuaggcaaacuuugguuuaaguaaacauauguucaaaaucagauuaacagauacagguuu

SEQ ID NO: 568989 - RNA, 64 nt, Homo Sapiens
ugaagggcaugcuguaauuucacacaauuuuccaguucaaaaauggagaauacuucgccuaaaa

SEQ ID NO: 568990 - RNA, 64 nt, Homo Sapiens
auauucauguaccugugaucauuuucaagucuguguucaaaaauucaaacuuuauugacaagug

SEQ ID NO: 568991 - RNA, 64 nt, Homo Sapiens
cuaaauguacguaagguaaauuaauauagucacaguucaaaauuguguuuuguuuauuaaauag

SEQ ID NO: 568992 - RNA, 64 nt, Homo Sapiens
aggaaucaaguccacucuucugccugcaacauuuguucaaaaacuaaccaagguaaaauauuua

SEQ ID NO: 568993 - RNA, 64 nt, Homo Sapiens
aaaaagauacaaaguucauaauaucaaaauauguguucaaaauugguauuuuaauuuuaauauu

SEQ ID NO: 568994 - RNA, 64 nt, Homo Sapiens
auccagugaagcauaaauuagaauuuaauuugauguucaaaaacaguuccauuuuuaaggguua

SEQ ID NO: 568995 - RNA, 64 nt, Homo Sapiens
agaaaagggagauaacuaaugagcuucuagugauguucaaaauugcuguuaauaggcauuauac

SEQ ID NO: 568996 - RNA, 64 nt, Homo Sapiens
uugagcuaucugaaaacuguuauuccuaaguaauguucaaaaaugauaaguaaucuggauaccu

SEQ ID NO: 568997 - RNA, 64 nt, Homo Sapiens
auuucuuaauguguguguuuuuacuugcauaucuguucaaaacacuuuuaacaaaauuaauuca

SEQ ID NO: 568998 - RNA, 64 nt, Homo Sapiens
guuuuuccccccuccuucugcuguguaucaugguguucaaaacagaaauguuuuuuggcauucc

SEQ ID NO: 568999 - RNA, 64 nt, Homo Sapiens
gacaauuaugaguuugcccucuuuccccuaccaaguucaaaauauaucuaagaaagauuguaaa

SEQ ID NO: 569000 - RNA, 64 nt, Homo Sapiens; identical to SEQ ID NO: 378451

SEQ ID NO: 569001 - RNA, 64 nt, Homo Sapiens; identical to SEQ ID NO: 378452

SEQ ID NO: 569002 - RNA, 64 nt, Homo Sapiens; identical to SEQ ID NO: 378453

SEQ ID NO: 569003 - RNA, 64 nt, Homo Sapiens; identical to SEQ ID NO: 378454

SEQ ID NO: 569004 - RNA, 64 nt, Homo Sapiens; identical to SEQ ID NO: 378455

SEQ ID NO: 569005 - RNA, 64 nt, Homo Sapiens; identical to SEQ ID NO: 378456

SEQ ID NO: 569006 - RNA, 64 nt, Homo Sapiens; identical to SEQ ID NO: 378457

SEQ ID NO: 569007 - RNA, 64 nt, Homo Sapiens; identical to SEQ ID NO: 378458

SEQ ID NO: 569008 - RNA, 61 nt, Homo Sapiens; identical to SEQ ID NO: 378459

SEQ ID NO: 569009 - RNA, 64 nt, Homo Sapiens; identical to SEQ ID NO: 378460

SEQ ID NO: 569010 - RNA, 64 nt, Homo Sapiens; identical to SEQ ID NO: 378461

SEQ ID NO: 569011 - RNA, 64 nt, Homo Sapiens; identical to SEQ ID NO: 378462

SEQ ID NO: 569012 - RNA, 64 nt, Homo Sapiens; identical to SEQ ID NO: 378463

SEQ ID NO: 569013 - RNA, 64 nt, Homo Sapiens; identical to SEQ ID NO: 378464

SEQ ID NO: 569014 - RNA, 64 nt, Homo Sapiens; identical to SEQ ID NO: 378465

SEQ ID NO: 569015 - RNA, 64 nt, Homo Sapiens; identical to SEQ ID NO: 378466

SEQ ID NO: 569016 - RNA, 64 nt, Homo Sapiens; identical to SEQ ID NO: 378467

SEQ ID NO: 569017 - RNA, 64 nt, Homo Sapiens; identical to SEQ ID NO: 378468

SEQ ID NO: 569018 - RNA, 64 nt, Homo Sapiens; identical to SEQ ID NO: 378469

SEQ ID NO: 569019 - RNA, 64 nt, Homo Sapiens; identical to SEQ ID NO: 378470

SEQ ID NO: 569020 - RNA, 64 nt, Homo Sapiens; identical to SEQ ID NO: 378471

SEQ ID NO: 569021 - RNA, 64 nt, Homo Sapiens; identical to SEQ ID NO: 378472

SEQ ID NO: 569022 - RNA, 64 nt, Homo Sapiens; identical to SEQ ID NO: 378473

SEQ ID NO: 569023 - RNA, 64 nt, Homo Sapiens; identical to SEQ ID NO: 378474

SEQ ID NO: 569024 - RNA, 64 nt, Homo Sapiens; identical to SEQ ID NO: 378475

SEQ ID NO: 569025 - RNA, 64 nt, Homo Sapiens; identical to SEQ ID NO: 378476

SEQ ID NO: 569026 - RNA, 64 nt, Homo Sapiens; identical to SEQ ID NO: 378477

SEQ ID NO: 569027 - RNA, 64 nt, Homo Sapiens; identical to SEQ ID NO: 378478

SEQ ID NO: 569028 - RNA, 64 nt, Homo Sapiens; identical to SEQ ID NO: 378479

SEQ ID NO: 569029 - RNA, 64 nt, Homo Sapiens; identical to SEQ ID NO: 378480

SEQ ID NO: 569030 - RNA, 64 nt, Homo Sapiens; identical to SEQ ID NO: 378481

SEQ ID NO: 569031 - RNA, 64 nt, Homo Sapiens; identical to SEQ ID NO: 378482

SEQ ID NO: 569032 - RNA, 64 nt, Homo Sapiens; identical to SEQ ID NO: 378483

SEQ ID NO: 569033 - RNA, 64 nt, Homo Sapiens; identical to SEQ ID NO: 378484

SEQ ID NO: 569034 - RNA, 64 nt, Homo Sapiens; identical to SEQ ID NO: 378485

SEQ ID NO: 569035 - RNA, 64 nt, Homo Sapiens; identical to SEQ ID NO: 378486

SEQ ID NO: 569036 - RNA, 64 nt, Homo Sapiens; identical to SEQ ID NO: 378487

SEQ ID NO: 569037 - RNA, 64 nt, Homo Sapiens; identical to SEQ ID NO: 378488

SEQ ID NO: 569038 - RNA, 64 nt, Homo Sapiens; identical to SEQ ID NO: 378489

SEQ ID NO: 569039 - RNA, 64 nt, Homo Sapiens; identical to SEQ ID NO: 378490

SEQ ID NO: 569040 - RNA, 64 nt, Homo Sapiens; identical to SEQ ID NO: 378491

SEQ ID NO: 569041 - RNA, 64 nt, Homo Sapiens; identical to SEQ ID NO: 378492

SEQ ID NO: 569042 - RNA, 64 nt, Homo Sapiens; identical to SEQ ID NO: 378493

SEQ ID NO: 569043 - RNA, 64 nt, Homo Sapiens; identical to SEQ ID NO: 378494

SEQ ID NO: 569044 - RNA, 64 nt, Homo Sapiens; identical to SEQ ID NO: 378495

SEQ ID NO: 569045 - RNA, 64 nt, Homo Sapiens; identical to SEQ ID NO: 378496

SEQ ID NO: 569046 - RNA, 64 nt, Homo Sapiens; identical to SEQ ID NO: 378497

SEQ ID NO: 569047 - RNA, 64 nt, Homo Sapiens; identical to SEQ ID NO: 378498

SEQ ID NO: 569048 - RNA, 64 nt, Homo Sapiens; identical to SEQ ID NO: 378499

SEQ ID NO: 569049 - RNA, 64 nt, Homo Sapiens; identical to SEQ ID NO: 378500

SEQ ID NO: 569050 - RNA, 64 nt, Homo Sapiens; identical to SEQ ID NO: 378501

SEQ ID NO: 569051 - RNA, 64 nt, Homo Sapiens; identical to SEQ ID NO: 378502

SEQ ID NO: 569052 - RNA, 64 nt, Homo Sapiens; identical to SEQ ID NO: 378503

SEQ ID NO: 569053 - RNA, 64 nt, Homo Sapiens; identical to SEQ ID NO: 378504

SEQ ID NO: 569054 - RNA, 64 nt, Homo Sapiens; identical to SEQ ID NO: 378505

SEQ ID NO: 569055 - RNA, 64 nt, Homo Sapiens; identical to SEQ ID NO: 378506

SEQ ID NO: 569056 - RNA, 64 nt, Homo Sapiens; identical to SEQ ID NO: 378507

SEQ ID NO: 569057 - RNA, 64 nt, Homo Sapiens; identical to SEQ ID NO: 386331

SEQ ID NO: 569058 - RNA, 64 nt, Homo Sapiens; identical to SEQ ID NO: 386332

SEQ ID NO: 569059 - RNA, 64 nt, Homo Sapiens; identical to SEQ ID NO: 386353

SEQ ID NO: 569060 - RNA, 64 nt, Homo Sapiens; identical to SEQ ID NO: 386354

SEQ ID NO: 569061 - RNA, 64 nt, Homo Sapiens; identical to SEQ ID NO: 386357

SEQ ID NO: 569062 - RNA, 64 nt, Homo Sapiens; identical to SEQ ID NO: 386358

SEQ ID NO: 569063 - RNA, 64 nt, Homo Sapiens; identical to SEQ ID NO: 386377

SEQ ID NO: 569064 - RNA, 64 nt, Homo Sapiens; identical to SEQ ID NO: 386378

SEQ ID NO: 569065 - RNA, 64 nt, Homo Sapiens; identical to SEQ ID NO: 386418

SEQ ID NO: 569066 - RNA, 64 nt, Homo Sapiens; identical to SEQ ID NO: 386419

SEQ ID NO: 569067 - RNA, 64 nt, Homo Sapiens; identical to SEQ ID NO: 386420

SEQ ID NO: 569068 - RNA, 64 nt, Homo Sapiens; identical to SEQ ID NO: 386421

SEQ ID NO: 569069 - RNA, 64 nt, Homo Sapiens; identical to SEQ ID NO: 294262

SEQ ID NO: 569070 - RNA, 64 nt, Homo Sapiens; identical to SEQ ID NO: 294263

SEQ ID NO: 569071 - RNA, 64 nt, Homo Sapiens; identical to SEQ ID NO: 294264

SEQ ID NO: 569072 - RNA, 64 nt, Homo Sapiens; identical to SEQ ID NO: 294265

SEQ ID NO: 569073 - RNA, 64 nt, Homo Sapiens; identical to SEQ ID NO: 294266

SEQ ID NO: 569074 - RNA, 64 nt, Homo Sapiens; identical to SEQ ID NO: 294267

SEQ ID NO: 569075 - RNA, 64 nt, Homo Sapiens; identical to SEQ ID NO: 294268

SEQ ID NO: 569076 - RNA, 64 nt, Homo Sapiens; identical to SEQ ID NO: 294269

SEQ ID NO: 569077 - RNA, 64 nt, Homo Sapiens; identical to SEQ ID NO: 294270

SEQ ID NO: 569078 - RNA, 64 nt, Homo Sapiens; identical to SEQ ID NO: 294271

SEQ ID NO: 569079 - RNA, 64 nt, Homo Sapiens; identical to SEQ ID NO: 294272

SEQ ID NO: 569080 - RNA, 64 nt, Homo Sapiens; identical to SEQ ID NO: 294273

SEQ ID NO: 569081 - RNA, 64 nt, Homo Sapiens; identical to SEQ ID NO: 294274

SEQ ID NO: 569082 - RNA, 64 nt, Homo Sapiens; identical to SEQ ID NO: 294275

SEQ ID NO: 569083 - RNA, 64 nt, Homo Sapiens; identical to SEQ ID NO: 294276

SEQ ID NO: 569084 - RNA, 64 nt, Homo Sapiens; identical to SEQ ID NO: 294277

SEQ ID NO: 569085 - RNA, 64 nt, Homo Sapiens; identical to SEQ ID NO: 294278

SEQ ID NO: 569086 - RNA, 64 nt, Homo Sapiens; identical to SEQ ID NO: 294279

SEQ ID NO: 569087 - RNA, 64 nt, Homo Sapiens; identical to SEQ ID NO: 294280

SEQ ID NO: 569088 - RNA, 64 nt, Homo Sapiens; identical to SEQ ID NO: 294281

SEQ ID NO: 569089 - RNA, 64 nt, Homo Sapiens; identical to SEQ ID NO: 294282

SEQ ID NO: 569090 - RNA, 64 nt, Homo Sapiens; identical to SEQ ID NO: 294283

SEQ ID NO: 569091 - RNA, 64 nt, Homo Sapiens; identical to SEQ ID NO: 294284

SEQ ID NO: 569092 - RNA, 64 nt, Homo Sapiens; identical to SEQ ID NO: 294285

SEQ ID NO: 569093 - RNA, 64 nt, Homo Sapiens; identical to SEQ ID NO: 294286

SEQ ID NO: 569094 - RNA, 64 nt, Homo Sapiens; identical to SEQ ID NO: 294287

SEQ ID NO: 569095 - RNA, 64 nt, Homo Sapiens; identical to SEQ ID NO: 294288

SEQ ID NO: 569096 - RNA, 64 nt, Homo Sapiens; identical to SEQ ID NO: 294289

SEQ ID NO: 569097 - RNA, 64 nt, Homo Sapiens; identical to SEQ ID NO: 294290

SEQ ID NO: 569098 - RNA, 64 nt, Homo Sapiens; identical to SEQ ID NO: 294291

SEQ ID NO: 569099 - RNA, 64 nt, Homo Sapiens; identical to SEQ ID NO: 294292

SEQ ID NO: 569100 - RNA, 64 nt, Homo Sapiens; identical to SEQ ID NO: 294293

SEQ ID NO: 569101 - RNA, 64 nt, Homo Sapiens; identical to SEQ ID NO: 294294

SEQ ID NO: 569102 - RNA, 64 nt, Homo Sapiens; identical to SEQ ID NO: 294295

SEQ ID NO: 569103 - RNA, 64 nt, Homo Sapiens; identical to SEQ ID NO: 294296

SEQ ID NO: 569104 - RNA, 64 nt, Homo Sapiens; identical to SEQ ID NO: 294297

SEQ ID NO: 569105 - RNA, 64 nt, Homo Sapiens; identical to SEQ ID NO: 294298

SEQ ID NO: 569106 - RNA, 64 nt, Homo Sapiens; identical to SEQ ID NO: 294299

SEQ ID NO: 569107 - RNA, 64 nt, Homo Sapiens; identical to SEQ ID NO: 142269

SEQ ID NO: 569108 - RNA, 64 nt, Homo Sapiens; identical to SEQ ID NO: 142270

SEQ ID NO: 569109 - RNA, 64 nt, Homo Sapiens; identical to SEQ ID NO: 142271

SEQ ID NO: 569110 - RNA, 64 nt, Homo Sapiens; identical to SEQ ID NO: 142272

SEQ ID NO: 569111 - RNA, 64 nt, Homo Sapiens; identical to SEQ ID NO: 142273

SEQ ID NO: 569112 - RNA, 64 nt, Homo Sapiens; identical to SEQ ID NO: 142274

SEQ ID NO: 569113 - RNA, 64 nt, Homo Sapiens; identical to SEQ ID NO: 142275

SEQ ID NO: 569114 - RNA, 64 nt, Homo Sapiens; identical to SEQ ID NO: 142276

SEQ ID NO: 569115 - RNA, 64 nt, Homo Sapiens; identical to SEQ ID NO: 142277

SEQ ID NO: 569116 - RNA, 64 nt, Homo Sapiens; identical to SEQ ID NO: 142278

SEQ ID NO: 569117 - RNA, 64 nt, Homo Sapiens; identical to SEQ ID NO: 142279

SEQ ID NO: 569118 - RNA, 64 nt, Homo Sapiens; identical to SEQ ID NO: 142280

SEQ ID NO: 569119 - RNA, 64 nt, Homo Sapiens; identical to SEQ ID NO: 142281

SEQ ID NO: 569120 - RNA, 64 nt, Homo Sapiens; identical to SEQ ID NO: 142282

SEQ ID NO: 569121 - RNA, 64 nt, Homo Sapiens; identical to SEQ ID NO: 142283

SEQ ID NO: 569122 - RNA, 64 nt, Homo Sapiens; identical to SEQ ID NO: 142284

SEQ ID NO: 569123 - RNA, 64 nt, Homo Sapiens; identical to SEQ ID NO: 142285

SEQ ID NO: 569124 - RNA, 64 nt, Homo Sapiens; identical to SEQ ID NO: 142286

SEQ ID NO: 569125 - RNA, 64 nt, Homo Sapiens; identical to SEQ ID NO: 142287

SEQ ID NO: 569126 - RNA, 64 nt, Homo Sapiens; identical to SEQ ID NO: 142288

SEQ ID NO: 569127 - RNA, 64 nt, Homo Sapiens; identical to SEQ ID NO: 142289

SEQ ID NO: 569128 - RNA, 64 nt, Homo Sapiens; identical to SEQ ID NO: 142290

SEQ ID NO: 569129 - RNA, 64 nt, Homo Sapiens; identical to SEQ ID NO: 142291

SEQ ID NO: 569130 - RNA, 64 nt, Homo Sapiens; identical to SEQ ID NO: 142292

SEQ ID NO: 569131 - RNA, 64 nt, Homo Sapiens; identical to SEQ ID NO: 142293

SEQ ID NO: 569132 - RNA, 64 nt, Homo Sapiens; identical to SEQ ID NO: 142294

SEQ ID NO: 569133 - RNA, 64 nt, Homo Sapiens; identical to SEQ ID NO: 142295

SEQ ID NO: 569134 - RNA, 64 nt, Homo Sapiens; identical to SEQ ID NO: 142296

SEQ ID NO: 569135 - RNA, 64 nt, Homo Sapiens; identical to SEQ ID NO: 142297

SEQ ID NO: 569136 - RNA, 64 nt, Homo Sapiens; identical to SEQ ID NO: 142298

SEQ ID NO: 569137 - RNA, 64 nt, Homo Sapiens; identical to SEQ ID NO: 142299

SEQ ID NO: 569138 - RNA, 64 nt, Homo Sapiens; identical to SEQ ID NO: 142300

SEQ ID NO: 569139 - RNA, 64 nt, Homo Sapiens; identical to SEQ ID NO: 142301

SEQ ID NO: 569140 - RNA, 64 nt, Homo Sapiens; identical to SEQ ID NO: 142302

SEQ ID NO: 569141 - RNA, 64 nt, Homo Sapiens; identical to SEQ ID NO: 142303

SEQ ID NO: 569142 - RNA, 64 nt, Homo Sapiens; identical to SEQ ID NO: 142304

SEQ ID NO: 569143 - RNA, 64 nt, Homo Sapiens; identical to SEQ ID NO: 142305

SEQ ID NO: 569144 - RNA, 64 nt, Homo Sapiens; identical to SEQ ID NO: 142306

SEQ ID NO: 569145 - RNA, 64 nt, Homo Sapiens; identical to SEQ ID NO: 142307

SEQ ID NO: 569146 - RNA, 64 nt, Homo Sapiens; identical to SEQ ID NO: 142308

SEQ ID NO: 569147 - RNA, 64 nt, Homo Sapiens; identical to SEQ ID NO: 142309

SEQ ID NO: 569148 - RNA, 64 nt, Homo Sapiens; identical to SEQ ID NO: 142310

SEQ ID NO: 569149 - RNA, 64 nt, Homo Sapiens; identical to SEQ ID NO: 142311

SEQ ID NO: 569150 - RNA, 64 nt, Homo Sapiens; identical to SEQ ID NO: 142312

SEQ ID NO: 569151 - RNA, 64 nt, Homo Sapiens; identical to SEQ ID NO: 142313

SEQ ID NO: 569152 - RNA, 64 nt, Homo Sapiens; identical to SEQ ID NO: 142314

SEQ ID NO: 569153 - RNA, 64 nt, Homo Sapiens; identical to SEQ ID NO: 142315

SEQ ID NO: 569154 - RNA, 64 nt, Homo Sapiens; identical to SEQ ID NO: 142316

SEQ ID NO: 569155 - RNA, 64 nt, Homo Sapiens; identical to SEQ ID NO: 142317

SEQ ID NO: 569156 - RNA, 64 nt, Homo Sapiens; identical to SEQ ID NO: 142318

SEQ ID NO: 569157 - RNA, 64 nt, Homo Sapiens; identical to SEQ ID NO: 142319

SEQ ID NO: 569158 - RNA, 64 nt, Homo Sapiens; identical to SEQ ID NO: 142320

SEQ ID NO: 569159 - RNA, 64 nt, Homo Sapiens; identical to SEQ ID NO: 142321

SEQ ID NO: 569160 - RNA, 64 nt, Homo Sapiens; identical to SEQ ID NO: 142322

SEQ ID NO: 569161 - RNA, 64 nt, Homo Sapiens; identical to SEQ ID NO: 142323

SEQ ID NO: 569162 - RNA, 64 nt, Homo Sapiens; identical to SEQ ID NO: 142324

SEQ ID NO: 569163 - RNA, 64 nt, Homo Sapiens; identical to SEQ ID NO: 142325

SEQ ID NO: 569164 - RNA, 64 nt, Homo Sapiens; identical to SEQ ID NO: 142326

SEQ ID NO: 569165 - RNA, 64 nt, Homo Sapiens; identical to SEQ ID NO: 142327

SEQ ID NO: 569166 - RNA, 64 nt, Homo Sapiens; identical to SEQ ID NO: 142328

SEQ ID NO: 569167 - RNA, 64 nt, Homo Sapiens; identical to SEQ ID NO: 142329

SEQ ID NO: 569168 - RNA, 64 nt, Homo Sapiens; identical to SEQ ID NO: 142330

SEQ ID NO: 569169 - RNA, 64 nt, Homo Sapiens; identical to SEQ ID NO: 142331

SEQ ID NO: 569170 - RNA, 64 nt, Homo Sapiens; identical to SEQ ID NO: 142332

SEQ ID NO: 569171 - RNA, 64 nt, Homo Sapiens; identical to SEQ ID NO: 142333

SEQ ID NO: 569172 - RNA, 64 nt, Homo Sapiens; identical to SEQ ID NO: 142334

SEQ ID NO: 569173 - RNA, 64 nt, Homo Sapiens; identical to SEQ ID NO: 142335

SEQ ID NO: 569174 - RNA, 64 nt, Homo Sapiens; identical to SEQ ID NO: 142336

SEQ ID NO: 569175 - RNA, 64 nt, Homo Sapiens; identical to SEQ ID NO: 142337

SEQ ID NO: 569176 - RNA, 64 nt, Homo Sapiens; identical to SEQ ID NO: 142338

SEQ ID NO: 569177 - RNA, 64 nt, Homo Sapiens; identical to SEQ ID NO: 142339

SEQ ID NO: 569178 - RNA, 64 nt, Homo Sapiens; identical to SEQ ID NO: 142340

SEQ ID NO: 569179 - RNA, 64 nt, Homo Sapiens; identical to SEQ ID NO: 142341

SEQ ID NO: 569180 - RNA, 64 nt, Homo Sapiens; identical to SEQ ID NO: 142342

SEQ ID NO: 569181 - RNA, 64 nt, Homo Sapiens; identical to SEQ ID NO: 142343

SEQ ID NO: 569182 - RNA, 64 nt, Homo Sapiens; identical to SEQ ID NO: 142344

SEQ ID NO: 569183 - RNA, 64 nt, Homo Sapiens; identical to SEQ ID NO: 142345

SEQ ID NO: 569184 - RNA, 64 nt, Homo Sapiens; identical to SEQ ID NO: 142346

SEQ ID NO: 569185 - RNA, 64 nt, Homo Sapiens; identical to SEQ ID NO: 142347

SEQ ID NO: 569186 - RNA, 64 nt, Homo Sapiens; identical to SEQ ID NO: 142348

SEQ ID NO: 569187 - RNA, 64 nt, Homo Sapiens; identical to SEQ ID NO: 142349

SEQ ID NO: 569188 - RNA, 64 nt, Homo Sapiens; identical to SEQ ID NO: 142350

SEQ ID NO: 569189 - RNA, 64 nt, Homo Sapiens; identical to SEQ ID NO: 142351

SEQ ID NO: 569190 - RNA, 64 nt, Homo Sapiens; identical to SEQ ID NO: 142352

SEQ ID NO: 569191 - RNA, 64 nt, Homo Sapiens; identical to SEQ ID NO: 142353

SEQ ID NO: 569192 - RNA, 64 nt, Homo Sapiens; identical to SEQ ID NO: 142354

SEQ ID NO: 569193 - RNA, 64 nt, Homo Sapiens; identical to SEQ ID NO: 142355

SEQ ID NO: 569194 - RNA, 64 nt, Homo Sapiens; identical to SEQ ID NO: 142356

SEQ ID NO: 569195 - RNA, 64 nt, Homo Sapiens; identical to SEQ ID NO: 142357

SEQ ID NO: 569196 - RNA, 64 nt, Homo Sapiens; identical to SEQ ID NO: 142358

SEQ ID NO: 569197 - RNA, 64 nt, Homo Sapiens; identical to SEQ ID NO: 142359

SEQ ID NO: 569198 - RNA, 64 nt, Homo Sapiens; identical to SEQ ID NO: 142360

SEQ ID NO: 569199 - RNA, 64 nt, Homo Sapiens; identical to SEQ ID NO: 142361

SEQ ID NO: 569200 - RNA, 64 nt, Homo Sapiens; identical to SEQ ID NO: 142362

SEQ ID NO: 569201 - RNA, 64 nt, Homo Sapiens; identical to SEQ ID NO: 142363

SEQ ID NO: 569202 - RNA, 64 nt, Homo Sapiens; identical to SEQ ID NO: 142364

SEQ ID NO: 569203 - RNA, 64 nt, Homo Sapiens; identical to SEQ ID NO: 142365

SEQ ID NO: 569204 - RNA, 64 nt, Homo Sapiens; identical to SEQ ID NO: 142366

SEQ ID NO: 569205 - RNA, 64 nt, Homo Sapiens; identical to SEQ ID NO: 142367

SEQ ID NO: 569206 - RNA, 64 nt, Homo Sapiens; identical to SEQ ID NO: 142368

SEQ ID NO: 569207 - RNA, 64 nt, Homo Sapiens; identical to SEQ ID NO: 142369

SEQ ID NO: 569208 - RNA, 64 nt, Homo Sapiens; identical to SEQ ID NO: 142370

SEQ ID NO: 569209 - RNA, 64 nt, Homo Sapiens; identical to SEQ ID NO: 142371

SEQ ID NO: 569210 - RNA, 64 nt, Homo Sapiens; identical to SEQ ID NO: 142372

SEQ ID NO: 569211 - RNA, 64 nt, Homo Sapiens; identical to SEQ ID NO: 142373

SEQ ID NO: 569212 - RNA, 64 nt, Homo Sapiens; identical to SEQ ID NO: 142374

SEQ ID NO: 569213 - RNA, 64 nt, Homo Sapiens; identical to SEQ ID NO: 142375

SEQ ID NO: 569214 - RNA, 64 nt, Homo Sapiens; identical to SEQ ID NO: 142376

SEQ ID NO: 569215 - RNA, 64 nt, Homo Sapiens; identical to SEQ ID NO: 142377

SEQ ID NO: 569216 - RNA, 64 nt, Homo Sapiens; identical to SEQ ID NO: 142378

SEQ ID NO: 569217 - RNA, 64 nt, Homo Sapiens; identical to SEQ ID NO: 142379

SEQ ID NO: 569218 - RNA, 64 nt, Homo Sapiens; identical to SEQ ID NO: 142380

SEQ ID NO: 569219 - RNA, 64 nt, Homo Sapiens; identical to SEQ ID NO: 142381

SEQ ID NO: 569220 - RNA, 64 nt, Homo Sapiens; identical to SEQ ID NO: 142382

SEQ ID NO: 569221 - RNA, 64 nt, Homo Sapiens; identical to SEQ ID NO: 142383

SEQ ID NO: 569222 - RNA, 64 nt, Homo Sapiens; identical to SEQ ID NO: 142384

SEQ ID NO: 569223 - RNA, 64 nt, Homo Sapiens; identical to SEQ ID NO: 142385

SEQ ID NO: 569224 - RNA, 64 nt, Homo Sapiens; identical to SEQ ID NO: 142386

SEQ ID NO: 569225 - RNA, 64 nt, Homo Sapiens; identical to SEQ ID NO: 142387

SEQ ID NO: 569226 - RNA, 64 nt, Homo Sapiens; identical to SEQ ID NO: 142388

SEQ ID NO: 569227 - RNA, 64 nt, Homo Sapiens; identical to SEQ ID NO: 142389

SEQ ID NO: 569228 - RNA, 64 nt, Homo Sapiens; identical to SEQ ID NO: 142390

SEQ ID NO: 569229 - RNA, 64 nt, Homo Sapiens; identical to SEQ ID NO: 142391

SEQ ID NO: 569230 - RNA, 64 nt, Homo Sapiens; identical to SEQ ID NO: 142392

SEQ ID NO: 569231 - RNA, 64 nt, Homo Sapiens; identical to SEQ ID NO: 142393

SEQ ID NO: 569232 - RNA, 64 nt, Homo Sapiens; identical to SEQ ID NO: 142394

SEQ ID NO: 569233 - RNA, 61 nt, Homo Sapiens; identical to SEQ ID NO: 142395

SEQ ID NO: 569234 - RNA, 64 nt, Homo Sapiens; identical to SEQ ID NO: 142396

SEQ ID NO: 569235 - RNA, 64 nt, Homo Sapiens; identical to SEQ ID NO: 142397

SEQ ID NO: 569236 - RNA, 64 nt, Homo Sapiens; identical to SEQ ID NO: 142398

SEQ ID NO: 569237 - RNA, 64 nt, Homo Sapiens; identical to SEQ ID NO: 142399

SEQ ID NO: 569238 - RNA, 64 nt, Homo Sapiens; identical to SEQ ID NO: 142400

SEQ ID NO: 569239 - RNA, 64 nt, Homo Sapiens; identical to SEQ ID NO: 142401

SEQ ID NO: 569240 - RNA, 64 nt, Homo Sapiens; identical to SEQ ID NO: 142402

SEQ ID NO: 569241 - RNA, 64 nt, Homo Sapiens; identical to SEQ ID NO: 142403

SEQ ID NO: 569242 - RNA, 64 nt, Homo Sapiens; identical to SEQ ID NO: 142404

SEQ ID NO: 569243 - RNA, 64 nt, Homo Sapiens; identical to SEQ ID NO: 142405

SEQ ID NO: 569244 - RNA, 64 nt, Homo Sapiens; identical to SEQ ID NO: 142406

SEQ ID NO: 569245 - RNA, 64 nt, Homo Sapiens; identical to SEQ ID NO: 142407

SEQ ID NO: 569246 - RNA, 64 nt, Homo Sapiens; identical to SEQ ID NO: 142408

SEQ ID NO: 569247 - RNA, 64 nt, Homo Sapiens; identical to SEQ ID NO: 142409

SEQ ID NO: 569248 - RNA, 64 nt, Homo Sapiens; identical to SEQ ID NO: 142410

SEQ ID NO: 569249 - RNA, 64 nt, Homo Sapiens; identical to SEQ ID NO: 142411

SEQ ID NO: 569250 - RNA, 64 nt, Homo Sapiens; identical to SEQ ID NO: 142412

SEQ ID NO: 569251 - RNA, 64 nt, Homo Sapiens; identical to SEQ ID NO: 142413

SEQ ID NO: 569252 - RNA, 64 nt, Homo Sapiens; identical to SEQ ID NO: 142414

SEQ ID NO: 569253 - RNA, 64 nt, Homo Sapiens; identical to SEQ ID NO: 142415

SEQ ID NO: 569254 - RNA, 64 nt, Homo Sapiens; identical to SEQ ID NO: 142416

SEQ ID NO: 569255 - RNA, 64 nt, Homo Sapiens; identical to SEQ ID NO: 142417

SEQ ID NO: 569256 - RNA, 64 nt, Homo Sapiens; identical to SEQ ID NO: 142418

SEQ ID NO: 569257 - RNA, 64 nt, Homo Sapiens; identical to SEQ ID NO: 142419

SEQ ID NO: 569258 - RNA, 64 nt, Homo Sapiens; identical to SEQ ID NO: 142420

SEQ ID NO: 569259 - RNA, 64 nt, Homo Sapiens; identical to SEQ ID NO: 142421

SEQ ID NO: 569260 - RNA, 64 nt, Homo Sapiens; identical to SEQ ID NO: 142422

SEQ ID NO: 569261 - RNA, 64 nt, Homo Sapiens; identical to SEQ ID NO: 142423

SEQ ID NO: 569262 - RNA, 64 nt, Homo Sapiens; identical to SEQ ID NO: 142424

SEQ ID NO: 569263 - RNA, 64 nt, Homo Sapiens; identical to SEQ ID NO: 142425

SEQ ID NO: 569264 - RNA, 64 nt, Homo Sapiens; identical to SEQ ID NO: 142426

SEQ ID NO: 569265 - RNA, 64 nt, Homo Sapiens; identical to SEQ ID NO: 142427

SEQ ID NO: 569266 - RNA, 64 nt, Homo Sapiens; identical to SEQ ID NO: 142428

SEQ ID NO: 569267 - RNA, 64 nt, Homo Sapiens; identical to SEQ ID NO: 142429

SEQ ID NO: 569268 - RNA, 64 nt, Homo Sapiens; identical to SEQ ID NO: 142430

SEQ ID NO: 569269 - RNA, 64 nt, Homo Sapiens; identical to SEQ ID NO: 142431

SEQ ID NO: 569270 - RNA, 64 nt, Homo Sapiens; identical to SEQ ID NO: 142432

SEQ ID NO: 569271 - RNA, 64 nt, Homo Sapiens; identical to SEQ ID NO: 142433

SEQ ID NO: 569272 - RNA, 64 nt, Homo Sapiens; identical to SEQ ID NO: 142434

SEQ ID NO: 569273 - RNA, 64 nt, Homo Sapiens; identical to SEQ ID NO: 142435

SEQ ID NO: 569274 - RNA, 64 nt, Homo Sapiens; identical to SEQ ID NO: 142436

SEQ ID NO: 569275 - RNA, 64 nt, Homo Sapiens; identical to SEQ ID NO: 142437

SEQ ID NO: 569276 - RNA, 64 nt, Homo Sapiens; identical to SEQ ID NO: 142438

SEQ ID NO: 569277 - RNA, 64 nt, Homo Sapiens; identical to SEQ ID NO: 142439

SEQ ID NO: 569278 - RNA, 64 nt, Homo Sapiens; identical to SEQ ID NO: 142440

SEQ ID NO: 569279 - RNA, 64 nt, Homo Sapiens; identical to SEQ ID NO: 142441

SEQ ID NO: 569280 - RNA, 64 nt, Homo Sapiens; identical to SEQ ID NO: 142442

SEQ ID NO: 569281 - RNA, 64 nt, Homo Sapiens; identical to SEQ ID NO: 142443

SEQ ID NO: 569282 - RNA, 64 nt, Homo Sapiens; identical to SEQ ID NO: 142444

SEQ ID NO: 569283 - RNA, 64 nt, Homo Sapiens; identical to SEQ ID NO: 142445

SEQ ID NO: 569284 - RNA, 64 nt, Homo Sapiens; identical to SEQ ID NO: 142446

SEQ ID NO: 569285 - RNA, 56 nt, Homo Sapiens; identical to SEQ ID NO: 142447

SEQ ID NO: 569286 - RNA, 64 nt, Homo Sapiens; identical to SEQ ID NO: 142448

SEQ ID NO: 569287 - RNA, 64 nt, Homo Sapiens; identical to SEQ ID NO: 142449

SEQ ID NO: 569288 - RNA, 64 nt, Homo Sapiens; identical to SEQ ID NO: 142450

SEQ ID NO: 569289 - RNA, 64 nt, Homo Sapiens; identical to SEQ ID NO: 142451

SEQ ID NO: 569290 - RNA, 64 nt, Homo Sapiens; identical to SEQ ID NO: 142452

SEQ ID NO: 569291 - RNA, 64 nt, Homo Sapiens; identical to SEQ ID NO: 142453

SEQ ID NO: 569292 - RNA, 64 nt, Homo Sapiens; identical to SEQ ID NO: 142454

SEQ ID NO: 569293 - RNA, 64 nt, Homo Sapiens; identical to SEQ ID NO: 142455

SEQ ID NO: 569294 - RNA, 64 nt, Homo Sapiens; identical to SEQ ID NO: 142456

SEQ ID NO: 569295 - RNA, 64 nt, Homo Sapiens; identical to SEQ ID NO: 142457

SEQ ID NO: 569296 - RNA, 64 nt, Homo Sapiens; identical to SEQ ID NO: 142458

SEQ ID NO: 569297 - RNA, 64 nt, Homo Sapiens; identical to SEQ ID NO: 142459

SEQ ID NO: 569298 - RNA, 64 nt, Homo Sapiens; identical to SEQ ID NO: 142460

SEQ ID NO: 569299 - RNA, 64 nt, Homo Sapiens; identical to SEQ ID NO: 142461

SEQ ID NO: 569300 - RNA, 64 nt, Homo Sapiens; identical to SEQ ID NO: 142462

SEQ ID NO: 569301 - RNA, 64 nt, Homo Sapiens; identical to SEQ ID NO: 142463

SEQ ID NO: 569302 - RNA, 64 nt, Homo Sapiens; identical to SEQ ID NO: 142464

SEQ ID NO: 569303 - RNA, 64 nt, Homo Sapiens; identical to SEQ ID NO: 142465

SEQ ID NO: 569304 - RNA, 64 nt, Homo Sapiens; identical to SEQ ID NO: 142466

SEQ ID NO: 569305 - RNA, 64 nt, Homo Sapiens; identical to SEQ ID NO: 142467

SEQ ID NO: 569306 - RNA, 64 nt, Homo Sapiens; identical to SEQ ID NO: 142468

SEQ ID NO: 569307 - RNA, 64 nt, Homo Sapiens; identical to SEQ ID NO: 142469

SEQ ID NO: 569308 - RNA, 64 nt, Homo Sapiens; identical to SEQ ID NO: 142470

SEQ ID NO: 569309 - RNA, 64 nt, Homo Sapiens; identical to SEQ ID NO: 142471

SEQ ID NO: 569310 - RNA, 64 nt, Homo Sapiens; identical to SEQ ID NO: 142472

SEQ ID NO: 569311 - RNA, 64 nt, Homo Sapiens; identical to SEQ ID NO: 142473

SEQ ID NO: 569312 - RNA, 64 nt, Homo Sapiens; identical to SEQ ID NO: 142474

SEQ ID NO: 569313 - RNA, 64 nt, Homo Sapiens; identical to SEQ ID NO: 142475

SEQ ID NO: 569314 - RNA, 64 nt, Homo Sapiens; identical to SEQ ID NO: 142476

SEQ ID NO: 569315 - RNA, 64 nt, Homo Sapiens; identical to SEQ ID NO: 142477

SEQ ID NO: 569316 - RNA, 64 nt, Homo Sapiens; identical to SEQ ID NO: 142478

SEQ ID NO: 569317 - RNA, 64 nt, Homo Sapiens; identical to SEQ ID NO: 142479

SEQ ID NO: 569318 - RNA, 64 nt, Homo Sapiens; identical to SEQ ID NO: 142480

SEQ ID NO: 569319 - RNA, 64 nt, Homo Sapiens; identical to SEQ ID NO: 142481

SEQ ID NO: 569320 - RNA, 64 nt, Homo Sapiens; identical to SEQ ID NO: 142482

SEQ ID NO: 569321 - RNA, 64 nt, Homo Sapiens; identical to SEQ ID NO: 142483

SEQ ID NO: 569322 - RNA, 64 nt, Homo Sapiens; identical to SEQ ID NO: 142484

SEQ ID NO: 569323 - RNA, 64 nt, Homo Sapiens; identical to SEQ ID NO: 142485

SEQ ID NO: 569324 - RNA, 64 nt, Homo Sapiens; identical to SEQ ID NO: 142486

SEQ ID NO: 569325 - RNA, 64 nt, Homo Sapiens; identical to SEQ ID NO: 142487

SEQ ID NO: 569326 - RNA, 64 nt, Homo Sapiens; identical to SEQ ID NO: 142488

SEQ ID NO: 569327 - RNA, 64 nt, Homo Sapiens; identical to SEQ ID NO: 142489

SEQ ID NO: 569328 - RNA, 64 nt, Homo Sapiens; identical to SEQ ID NO: 142490

SEQ ID NO: 569329 - RNA, 64 nt, Homo Sapiens; identical to SEQ ID NO: 142491

SEQ ID NO: 569330 - RNA, 64 nt, Homo Sapiens; identical to SEQ ID NO: 142492

SEQ ID NO: 569331 - RNA, 64 nt, Homo Sapiens; identical to SEQ ID NO: 142493

SEQ ID NO: 569332 - RNA, 64 nt, Homo Sapiens; identical to SEQ ID NO: 142494

SEQ ID NO: 569333 - RNA, 64 nt, Homo Sapiens; identical to SEQ ID NO: 142495

SEQ ID NO: 569334 - RNA, 64 nt, Homo Sapiens; identical to SEQ ID NO: 142496

SEQ ID NO: 569335 - RNA, 64 nt, Homo Sapiens; identical to SEQ ID NO: 142497

SEQ ID NO: 569336 - RNA, 64 nt, Homo Sapiens; identical to SEQ ID NO: 142498

SEQ ID NO: 569337 - RNA, 64 nt, Homo Sapiens; identical to SEQ ID NO: 142499

SEQ ID NO: 569338 - RNA, 64 nt, Homo Sapiens; identical to SEQ ID NO: 142500

SEQ ID NO: 569339 - RNA, 64 nt, Homo Sapiens; identical to SEQ ID NO: 142501

SEQ ID NO: 569340 - RNA, 64 nt, Homo Sapiens; identical to SEQ ID NO: 142502

SEQ ID NO: 569341 - RNA, 64 nt, Homo Sapiens; identical to SEQ ID NO: 142503

SEQ ID NO: 569342 - RNA, 64 nt, Homo Sapiens; identical to SEQ ID NO: 142504

SEQ ID NO: 569343 - RNA, 64 nt, Homo Sapiens; identical to SEQ ID NO: 142505

SEQ ID NO: 569344 - RNA, 64 nt, Homo Sapiens; identical to SEQ ID NO: 142506

SEQ ID NO: 569345 - RNA, 64 nt, Homo Sapiens; identical to SEQ ID NO: 142507

SEQ ID NO: 569346 - RNA, 64 nt, Homo Sapiens; identical to SEQ ID NO: 142508

SEQ ID NO: 569347 - RNA, 64 nt, Homo Sapiens; identical to SEQ ID NO: 142509

SEQ ID NO: 569348 - RNA, 64 nt, Homo Sapiens; identical to SEQ ID NO: 142510

SEQ ID NO: 569349 - RNA, 64 nt, Homo Sapiens; identical to SEQ ID NO: 142511

SEQ ID NO: 569350 - RNA, 64 nt, Homo Sapiens; identical to SEQ ID NO: 142512

SEQ ID NO: 569351 - RNA, 64 nt, Homo Sapiens; identical to SEQ ID NO: 142513

SEQ ID NO: 569352 - RNA, 64 nt, Homo Sapiens; identical to SEQ ID NO: 142514

SEQ ID NO: 569353 - RNA, 64 nt, Homo Sapiens; identical to SEQ ID NO: 142515

SEQ ID NO: 569354 - RNA, 64 nt, Homo Sapiens; identical to SEQ ID NO: 142516

SEQ ID NO: 569355 - RNA, 64 nt, Homo Sapiens; identical to SEQ ID NO: 142517

SEQ ID NO: 569356 - RNA, 64 nt, Homo Sapiens; identical to SEQ ID NO: 142518

SEQ ID NO: 569357 - RNA, 64 nt, Homo Sapiens; identical to SEQ ID NO: 142519

SEQ ID NO: 569358 - RNA, 64 nt, Homo Sapiens; identical to SEQ ID NO: 142520

SEQ ID NO: 569359 - RNA, 64 nt, Homo Sapiens; identical to SEQ ID NO: 142521

SEQ ID NO: 569360 - RNA, 64 nt, Homo Sapiens; identical to SEQ ID NO: 142522

SEQ ID NO: 569361 - RNA, 64 nt, Homo Sapiens; identical to SEQ ID NO: 142523

SEQ ID NO: 569362 - RNA, 64 nt, Homo Sapiens; identical to SEQ ID NO: 142524

SEQ ID NO: 569363 - RNA, 64 nt, Homo Sapiens; identical to SEQ ID NO: 142525

SEQ ID NO: 569364 - RNA, 64 nt, Homo Sapiens; identical to SEQ ID NO: 142526

SEQ ID NO: 569365 - RNA, 64 nt, Homo Sapiens; identical to SEQ ID NO: 142527

SEQ ID NO: 569366 - RNA, 64 nt, Homo Sapiens; identical to SEQ ID NO: 142528

SEQ ID NO: 569367 - RNA, 64 nt, Homo Sapiens; identical to SEQ ID NO: 142529

SEQ ID NO: 569368 - RNA, 64 nt, Homo Sapiens; identical to SEQ ID NO: 142530

SEQ ID NO: 569369 - RNA, 64 nt, Homo Sapiens; identical to SEQ ID NO: 142531

SEQ ID NO: 569370 - RNA, 64 nt, Homo Sapiens; identical to SEQ ID NO: 142532

SEQ ID NO: 569371 - RNA, 64 nt, Homo Sapiens; identical to SEQ ID NO: 142533

SEQ ID NO: 569372 - RNA, 64 nt, Homo Sapiens; identical to SEQ ID NO: 142534

SEQ ID NO: 569373 - RNA, 64 nt, Homo Sapiens; identical to SEQ ID NO: 142535

SEQ ID NO: 569374 - RNA, 64 nt, Homo Sapiens; identical to SEQ ID NO: 142536

SEQ ID NO: 569375 - RNA, 64 nt, Homo Sapiens; identical to SEQ ID NO: 142537

SEQ ID NO: 569376 - RNA, 64 nt, Homo Sapiens; identical to SEQ ID NO: 142538

SEQ ID NO: 569377 - RNA, 64 nt, Homo Sapiens; identical to SEQ ID NO: 142539

SEQ ID NO: 569378 - RNA, 64 nt, Homo Sapiens; identical to SEQ ID NO: 142540

SEQ ID NO: 569379 - RNA, 64 nt, Homo Sapiens; identical to SEQ ID NO: 142541

SEQ ID NO: 569380 - RNA, 59 nt, Homo Sapiens; identical to SEQ ID NO: 142542

SEQ ID NO: 569381 - RNA, 64 nt, Homo Sapiens; identical to SEQ ID NO: 142543

SEQ ID NO: 569382 - RNA, 64 nt, Homo Sapiens; identical to SEQ ID NO: 142544

SEQ ID NO: 569383 - RNA, 64 nt, Homo Sapiens; identical to SEQ ID NO: 142545

SEQ ID NO: 569384 - RNA, 64 nt, Homo Sapiens; identical to SEQ ID NO: 142546

SEQ ID NO: 569385 - RNA, 64 nt, Homo Sapiens; identical to SEQ ID NO: 142547

SEQ ID NO: 569386 - RNA, 64 nt, Homo Sapiens; identical to SEQ ID NO: 142548

SEQ ID NO: 569387 - RNA, 64 nt, Homo Sapiens; identical to SEQ ID NO: 142549

SEQ ID NO: 569388 - RNA, 64 nt, Homo Sapiens; identical to SEQ ID NO: 142550

SEQ ID NO: 569389 - RNA, 64 nt, Homo Sapiens; identical to SEQ ID NO: 142551

SEQ ID NO: 569390 - RNA, 64 nt, Homo Sapiens; identical to SEQ ID NO: 142552

SEQ ID NO: 569391 - RNA, 64 nt, Homo Sapiens; identical to SEQ ID NO: 142553

SEQ ID NO: 569392 - RNA, 64 nt, Homo Sapiens; identical to SEQ ID NO: 142554

SEQ ID NO: 569393 - RNA, 64 nt, Homo Sapiens; identical to SEQ ID NO: 142555

SEQ ID NO: 569394 - RNA, 64 nt, Homo Sapiens; identical to SEQ ID NO: 142556

SEQ ID NO: 569395 - RNA, 64 nt, Homo Sapiens; identical to SEQ ID NO: 142557

SEQ ID NO: 569396 - RNA, 64 nt, Homo Sapiens; identical to SEQ ID NO: 142558

SEQ ID NO: 569397 - RNA, 64 nt, Homo Sapiens; identical to SEQ ID NO: 142559

SEQ ID NO: 569398 - RNA, 64 nt, Homo Sapiens; identical to SEQ ID NO: 142560

SEQ ID NO: 569399 - RNA, 64 nt, Homo Sapiens; identical to SEQ ID NO: 142561

SEQ ID NO: 569400 - RNA, 64 nt, Homo Sapiens; identical to SEQ ID NO: 142562

SEQ ID NO: 569401 - RNA, 64 nt, Homo Sapiens; identical to SEQ ID NO: 142563

SEQ ID NO: 569402 - RNA, 64 nt, Homo Sapiens; identical to SEQ ID NO: 142564

SEQ ID NO: 569403 - RNA, 64 nt, Homo Sapiens; identical to SEQ ID NO: 142565

SEQ ID NO: 569404 - RNA, 64 nt, Homo Sapiens; identical to SEQ ID NO: 142566

SEQ ID NO: 569405 - RNA, 64 nt, Homo Sapiens; identical to SEQ ID NO: 142567

SEQ ID NO: 569406 - RNA, 64 nt, Homo Sapiens; identical to SEQ ID NO: 142568

SEQ ID NO: 569407 - RNA, 64 nt, Homo Sapiens; identical to SEQ ID NO: 142569

SEQ ID NO: 569408 - RNA, 64 nt, Homo Sapiens; identical to SEQ ID NO: 142570

SEQ ID NO: 569409 - RNA, 64 nt, Homo Sapiens; identical to SEQ ID NO: 142571

SEQ ID NO: 569410 - RNA, 64 nt, Homo Sapiens; identical to SEQ ID NO: 142572

SEQ ID NO: 569411 - RNA, 64 nt, Homo Sapiens; identical to SEQ ID NO: 142573

SEQ ID NO: 569412 - RNA, 64 nt, Homo Sapiens; identical to SEQ ID NO: 142574

SEQ ID NO: 569413 - RNA, 64 nt, Homo Sapiens; identical to SEQ ID NO: 142575

SEQ ID NO: 569414 - RNA, 64 nt, Homo Sapiens; identical to SEQ ID NO: 142576

SEQ ID NO: 569415 - RNA, 64 nt, Homo Sapiens; identical to SEQ ID NO: 142577

SEQ ID NO: 569416 - RNA, 64 nt, Homo Sapiens; identical to SEQ ID NO: 142578

SEQ ID NO: 569417 - RNA, 64 nt, Homo Sapiens; identical to SEQ ID NO: 142579

SEQ ID NO: 569418 - RNA, 64 nt, Homo Sapiens; identical to SEQ ID NO: 142580

SEQ ID NO: 569419 - RNA, 64 nt, Homo Sapiens; identical to SEQ ID NO: 142581

SEQ ID NO: 569420 - RNA, 64 nt, Homo Sapiens; identical to SEQ ID NO: 142582

SEQ ID NO: 569421 - RNA, 64 nt, Homo Sapiens; identical to SEQ ID NO: 142583

SEQ ID NO: 569422 - RNA, 55 nt, Homo Sapiens; identical to SEQ ID NO: 142584

SEQ ID NO: 569423 - RNA, 64 nt, Homo Sapiens; identical to SEQ ID NO: 142585

SEQ ID NO: 569424 - RNA, 64 nt, Homo Sapiens; identical to SEQ ID NO: 142586

SEQ ID NO: 569425 - RNA, 64 nt, Homo Sapiens; identical to SEQ ID NO: 142587

SEQ ID NO: 569426 - RNA, 64 nt, Homo Sapiens; identical to SEQ ID NO: 142588

SEQ ID NO: 569427 - RNA, 64 nt, Homo Sapiens; identical to SEQ ID NO: 142589

SEQ ID NO: 569428 - RNA, 64 nt, Homo Sapiens; identical to SEQ ID NO: 142590

SEQ ID NO: 569429 - RNA, 64 nt, Homo Sapiens; identical to SEQ ID NO: 142591

SEQ ID NO: 569430 - RNA, 64 nt, Homo Sapiens; identical to SEQ ID NO: 142592

SEQ ID NO: 569431 - RNA, 64 nt, Homo Sapiens; identical to SEQ ID NO: 142593

SEQ ID NO: 569432 - RNA, 64 nt, Homo Sapiens; identical to SEQ ID NO: 142594

SEQ ID NO: 569433 - RNA, 64 nt, Homo Sapiens; identical to SEQ ID NO: 142595

SEQ ID NO: 569434 - RNA, 64 nt, Homo Sapiens; identical to SEQ ID NO: 142596

SEQ ID NO: 569435 - RNA, 64 nt, Homo Sapiens; identical to SEQ ID NO: 142597

SEQ ID NO: 569436 - RNA, 64 nt, Homo Sapiens; identical to SEQ ID NO: 142598

SEQ ID NO: 569437 - RNA, 64 nt, Homo Sapiens; identical to SEQ ID NO: 142599

SEQ ID NO: 569438 - RNA, 64 nt, Homo Sapiens; identical to SEQ ID NO: 142600

SEQ ID NO: 569439 - RNA, 64 nt, Homo Sapiens; identical to SEQ ID NO: 142601

SEQ ID NO: 569440 - RNA, 64 nt, Homo Sapiens; identical to SEQ ID NO: 142602

SEQ ID NO: 569441 - RNA, 64 nt, Homo Sapiens; identical to SEQ ID NO: 142603

SEQ ID NO: 569442 - RNA, 64 nt, Homo Sapiens; identical to SEQ ID NO: 142604

SEQ ID NO: 569443 - RNA, 64 nt, Homo Sapiens; identical to SEQ ID NO: 142605

SEQ ID NO: 569444 - RNA, 64 nt, Homo Sapiens; identical to SEQ ID NO: 142606

SEQ ID NO: 569445 - RNA, 64 nt, Homo Sapiens; identical to SEQ ID NO: 142607

SEQ ID NO: 569446 - RNA, 64 nt, Homo Sapiens; identical to SEQ ID NO: 142608

SEQ ID NO: 569447 - RNA, 64 nt, Homo Sapiens; identical to SEQ ID NO: 142609

SEQ ID NO: 569448 - RNA, 64 nt, Homo Sapiens; identical to SEQ ID NO: 142610

SEQ ID NO: 569449 - RNA, 64 nt, Homo Sapiens; identical to SEQ ID NO: 142611

SEQ ID NO: 569450 - RNA, 64 nt, Homo Sapiens; identical to SEQ ID NO: 142612

SEQ ID NO: 569451 - RNA, 64 nt, Homo Sapiens; identical to SEQ ID NO: 142613

SEQ ID NO: 569452 - RNA, 64 nt, Homo Sapiens; identical to SEQ ID NO: 142614

SEQ ID NO: 569453 - RNA, 64 nt, Homo Sapiens; identical to SEQ ID NO: 142615

SEQ ID NO: 569454 - RNA, 64 nt, Homo Sapiens; identical to SEQ ID NO: 142616

SEQ ID NO: 569455 - RNA, 64 nt, Homo Sapiens; identical to SEQ ID NO: 142617

SEQ ID NO: 569456 - RNA, 64 nt, Homo Sapiens; identical to SEQ ID NO: 142618

SEQ ID NO: 569457 - RNA, 64 nt, Homo Sapiens; identical to SEQ ID NO: 142619

SEQ ID NO: 569458 - RNA, 64 nt, Homo Sapiens; identical to SEQ ID NO: 142620

SEQ ID NO: 569459 - RNA, 64 nt, Homo Sapiens; identical to SEQ ID NO: 142621

SEQ ID NO: 569460 - RNA, 64 nt, Homo Sapiens; identical to SEQ ID NO: 142622

SEQ ID NO: 569461 - RNA, 64 nt, Homo Sapiens; identical to SEQ ID NO: 142623

SEQ ID NO: 569462 - RNA, 64 nt, Homo Sapiens; identical to SEQ ID NO: 142624

SEQ ID NO: 569463 - RNA, 64 nt, Homo Sapiens; identical to SEQ ID NO: 142625

SEQ ID NO: 569464 - RNA, 64 nt, Homo Sapiens; identical to SEQ ID NO: 142626

SEQ ID NO: 569465 - RNA, 64 nt, Homo Sapiens; identical to SEQ ID NO: 142627

SEQ ID NO: 569466 - RNA, 64 nt, Homo Sapiens; identical to SEQ ID NO: 142628

SEQ ID NO: 569467 - RNA, 64 nt, Homo Sapiens; identical to SEQ ID NO: 142629

SEQ ID NO: 569468 - RNA, 64 nt, Homo Sapiens; identical to SEQ ID NO: 142630

SEQ ID NO: 569469 - RNA, 64 nt, Homo Sapiens; identical to SEQ ID NO: 142631

SEQ ID NO: 569470 - RNA, 64 nt, Homo Sapiens; identical to SEQ ID NO: 142632

SEQ ID NO: 569471 - RNA, 64 nt, Homo Sapiens; identical to SEQ ID NO: 142633

SEQ ID NO: 569472 - RNA, 64 nt, Homo Sapiens; identical to SEQ ID NO: 142634

SEQ ID NO: 569473 - RNA, 64 nt, Homo Sapiens; identical to SEQ ID NO: 142635

SEQ ID NO: 569474 - RNA, 64 nt, Homo Sapiens; identical to SEQ ID NO: 142636

SEQ ID NO: 569475 - RNA, 64 nt, Homo Sapiens; identical to SEQ ID NO: 142637

SEQ ID NO: 569476 - RNA, 64 nt, Homo Sapiens; identical to SEQ ID NO: 142638

SEQ ID NO: 569477 - RNA, 64 nt, Homo Sapiens; identical to SEQ ID NO: 142639

SEQ ID NO: 569478 - RNA, 64 nt, Homo Sapiens; identical to SEQ ID NO: 142640

SEQ ID NO: 569479 - RNA, 64 nt, Homo Sapiens; identical to SEQ ID NO: 142641

SEQ ID NO: 569480 - RNA, 64 nt, Homo Sapiens; identical to SEQ ID NO: 142642

SEQ ID NO: 569481 - RNA, 64 nt, Homo Sapiens; identical to SEQ ID NO: 142643

SEQ ID NO: 569482 - RNA, 64 nt, Homo Sapiens; identical to SEQ ID NO: 142644

SEQ ID NO: 569483 - RNA, 64 nt, Homo Sapiens; identical to SEQ ID NO: 142645

SEQ ID NO: 569484 - RNA, 64 nt, Homo Sapiens; identical to SEQ ID NO: 142646

SEQ ID NO: 569485 - RNA, 64 nt, Homo Sapiens; identical to SEQ ID NO: 142647

SEQ ID NO: 569486 - RNA, 64 nt, Homo Sapiens; identical to SEQ ID NO: 142648

SEQ ID NO: 569487 - RNA, 64 nt, Homo Sapiens; identical to SEQ ID NO: 142649

SEQ ID NO: 569488 - RNA, 64 nt, Homo Sapiens; identical to SEQ ID NO: 142650

SEQ ID NO: 569489 - RNA, 64 nt, Homo Sapiens; identical to SEQ ID NO: 142651

SEQ ID NO: 569490 - RNA, 64 nt, Homo Sapiens; identical to SEQ ID NO: 142652

SEQ ID NO: 569491 - RNA, 64 nt, Homo Sapiens; identical to SEQ ID NO: 142653

SEQ ID NO: 569492 - RNA, 64 nt, Homo Sapiens; identical to SEQ ID NO: 142654

SEQ ID NO: 569493 - RNA, 64 nt, Homo Sapiens; identical to SEQ ID NO: 142655

SEQ ID NO: 569494 - RNA, 64 nt, Homo Sapiens; identical to SEQ ID NO: 142656

SEQ ID NO: 569495 - RNA, 64 nt, Homo Sapiens; identical to SEQ ID NO: 142657

SEQ ID NO: 569496 - RNA, 64 nt, Homo Sapiens; identical to SEQ ID NO: 142658

SEQ ID NO: 569497 - RNA, 64 nt, Homo Sapiens; identical to SEQ ID NO: 142659

SEQ ID NO: 569498 - RNA, 64 nt, Homo Sapiens; identical to SEQ ID NO: 142660

SEQ ID NO: 569499 - RNA, 64 nt, Homo Sapiens; identical to SEQ ID NO: 142661

SEQ ID NO: 569500 - RNA, 64 nt, Homo Sapiens; identical to SEQ ID NO: 142662

SEQ ID NO: 569501 - RNA, 64 nt, Homo Sapiens; identical to SEQ ID NO: 142663

SEQ ID NO: 569502 - RNA, 64 nt, Homo Sapiens; identical to SEQ ID NO: 142664

SEQ ID NO: 569503 - RNA, 64 nt, Homo Sapiens; identical to SEQ ID NO: 142665

SEQ ID NO: 569504 - RNA, 64 nt, Homo Sapiens; identical to SEQ ID NO: 142666

SEQ ID NO: 569505 - RNA, 64 nt, Homo Sapiens; identical to SEQ ID NO: 142667

SEQ ID NO: 569506 - RNA, 64 nt, Homo Sapiens; identical to SEQ ID NO: 142668

SEQ ID NO: 569507 - RNA, 64 nt, Homo Sapiens; identical to SEQ ID NO: 142669

SEQ ID NO: 569508 - RNA, 64 nt, Homo Sapiens; identical to SEQ ID NO: 142670

SEQ ID NO: 569509 - RNA, 64 nt, Homo Sapiens; identical to SEQ ID NO: 142671

SEQ ID NO: 569510 - RNA, 64 nt, Homo Sapiens; identical to SEQ ID NO: 142672

SEQ ID NO: 569511 - RNA, 64 nt, Homo Sapiens; identical to SEQ ID NO: 142673

SEQ ID NO: 569512 - RNA, 64 nt, Homo Sapiens; identical to SEQ ID NO: 142674

SEQ ID NO: 569513 - RNA, 64 nt, Homo Sapiens; identical to SEQ ID NO: 142675

SEQ ID NO: 569514 - RNA, 64 nt, Homo Sapiens; identical to SEQ ID NO: 142676

SEQ ID NO: 569515 - RNA, 64 nt, Homo Sapiens; identical to SEQ ID NO: 142677

SEQ ID NO: 569516 - RNA, 64 nt, Homo Sapiens; identical to SEQ ID NO: 142678

SEQ ID NO: 569517 - RNA, 64 nt, Homo Sapiens; identical to SEQ ID NO: 142679

SEQ ID NO: 569518 - RNA, 64 nt, Homo Sapiens; identical to SEQ ID NO: 142680

SEQ ID NO: 569519 - RNA, 64 nt, Homo Sapiens; identical to SEQ ID NO: 142681

SEQ ID NO: 569520 - RNA, 64 nt, Homo Sapiens; identical to SEQ ID NO: 142682

SEQ ID NO: 569521 - RNA, 64 nt, Homo Sapiens; identical to SEQ ID NO: 142683

SEQ ID NO: 569522 - RNA, 64 nt, Homo Sapiens; identical to SEQ ID NO: 142684

SEQ ID NO: 569523 - RNA, 64 nt, Homo Sapiens; identical to SEQ ID NO: 142685

SEQ ID NO: 569524 - RNA, 64 nt, Homo Sapiens; identical to SEQ ID NO: 142686

SEQ ID NO: 569525 - RNA, 64 nt, Homo Sapiens; identical to SEQ ID NO: 142687

SEQ ID NO: 569526 - RNA, 64 nt, Homo Sapiens; identical to SEQ ID NO: 142688

SEQ ID NO: 569527 - RNA, 64 nt, Homo Sapiens; identical to SEQ ID NO: 142689

SEQ ID NO: 569528 - RNA, 64 nt, Homo Sapiens; identical to SEQ ID NO: 142690

SEQ ID NO: 569529 - RNA, 64 nt, Homo Sapiens; identical to SEQ ID NO: 142691

SEQ ID NO: 569530 - RNA, 64 nt, Homo Sapiens; identical to SEQ ID NO: 142692

SEQ ID NO: 569531 - RNA, 64 nt, Homo Sapiens; identical to SEQ ID NO: 142693

SEQ ID NO: 569532 - RNA, 64 nt, Homo Sapiens; identical to SEQ ID NO: 142694

SEQ ID NO: 569533 - RNA, 64 nt, Homo Sapiens; identical to SEQ ID NO: 142695

SEQ ID NO: 569534 - RNA, 64 nt, Homo Sapiens; identical to SEQ ID NO: 142696

SEQ ID NO: 569535 - RNA, 64 nt, Homo Sapiens; identical to SEQ ID NO: 142697

SEQ ID NO: 569536 - RNA, 64 nt, Homo Sapiens; identical to SEQ ID NO: 142698

SEQ ID NO: 569537 - RNA, 64 nt, Homo Sapiens; identical to SEQ ID NO: 142699

SEQ ID NO: 569538 - RNA, 64 nt, Homo Sapiens; identical to SEQ ID NO: 142700

SEQ ID NO: 569539 - RNA, 64 nt, Homo Sapiens; identical to SEQ ID NO: 142701

SEQ ID NO: 569540 - RNA, 64 nt, Homo Sapiens; identical to SEQ ID NO: 142702

SEQ ID NO: 569541 - RNA, 64 nt, Homo Sapiens; identical to SEQ ID NO: 142703

SEQ ID NO: 569542 - RNA, 64 nt, Homo Sapiens; identical to SEQ ID NO: 142704

SEQ ID NO: 569543 - RNA, 64 nt, Homo Sapiens; identical to SEQ ID NO: 142705

SEQ ID NO: 569544 - RNA, 64 nt, Homo Sapiens; identical to SEQ ID NO: 142706

SEQ ID NO: 569545 - RNA, 64 nt, Homo Sapiens; identical to SEQ ID NO: 142707

SEQ ID NO: 569546 - RNA, 64 nt, Homo Sapiens; identical to SEQ ID NO: 142708

SEQ ID NO: 569547 - RNA, 64 nt, Homo Sapiens; identical to SEQ ID NO: 142709

SEQ ID NO: 569548 - RNA, 64 nt, Homo Sapiens; identical to SEQ ID NO: 142710

SEQ ID NO: 569549 - RNA, 64 nt, Homo Sapiens; identical to SEQ ID NO: 142711

SEQ ID NO: 569550 - RNA, 64 nt, Homo Sapiens; identical to SEQ ID NO: 142712

SEQ ID NO: 569551 - RNA, 64 nt, Homo Sapiens; identical to SEQ ID NO: 142713

SEQ ID NO: 569552 - RNA, 64 nt, Homo Sapiens; identical to SEQ ID NO: 142714

SEQ ID NO: 569553 - RNA, 64 nt, Homo Sapiens; identical to SEQ ID NO: 142715

SEQ ID NO: 569554 - RNA, 64 nt, Homo Sapiens; identical to SEQ ID NO: 142716

SEQ ID NO: 569555 - RNA, 64 nt, Homo Sapiens; identical to SEQ ID NO: 142717

SEQ ID NO: 569556 - RNA, 64 nt, Homo Sapiens; identical to SEQ ID NO: 142718

SEQ ID NO: 569557 - RNA, 64 nt, Homo Sapiens; identical to SEQ ID NO: 142719

SEQ ID NO: 569558 - RNA, 64 nt, Homo Sapiens; identical to SEQ ID NO: 142720

SEQ ID NO: 569559 - RNA, 64 nt, Homo Sapiens; identical to SEQ ID NO: 142721

SEQ ID NO: 569560 - RNA, 64 nt, Homo Sapiens; identical to SEQ ID NO: 142722

SEQ ID NO: 569561 - RNA, 64 nt, Homo Sapiens; identical to SEQ ID NO: 142723

SEQ ID NO: 569562 - RNA, 64 nt, Homo Sapiens; identical to SEQ ID NO: 142724

SEQ ID NO: 569563 - RNA, 64 nt, Homo Sapiens; identical to SEQ ID NO: 142725

SEQ ID NO: 569564 - RNA, 64 nt, Homo Sapiens; identical to SEQ ID NO: 142726

SEQ ID NO: 569565 - RNA, 64 nt, Homo Sapiens; identical to SEQ ID NO: 142727

SEQ ID NO: 569566 - RNA, 64 nt, Homo Sapiens; identical to SEQ ID NO: 142728

SEQ ID NO: 569567 - RNA, 64 nt, Homo Sapiens; identical to SEQ ID NO: 142729

SEQ ID NO: 569568 - RNA, 64 nt, Homo Sapiens; identical to SEQ ID NO: 142730

SEQ ID NO: 569569 - RNA, 64 nt, Homo Sapiens; identical to SEQ ID NO: 142731

SEQ ID NO: 569570 - RNA, 64 nt, Homo Sapiens; identical to SEQ ID NO: 142732

SEQ ID NO: 569571 - RNA, 64 nt, Homo Sapiens; identical to SEQ ID NO: 142733

SEQ ID NO: 569572 - RNA, 64 nt, Homo Sapiens; identical to SEQ ID NO: 142734

SEQ ID NO: 569573 - RNA, 64 nt, Homo Sapiens; identical to SEQ ID NO: 142735

SEQ ID NO: 569574 - RNA, 64 nt, Homo Sapiens; identical to SEQ ID NO: 142736

SEQ ID NO: 569575 - RNA, 64 nt, Homo Sapiens; identical to SEQ ID NO: 142737

SEQ ID NO: 569576 - RNA, 64 nt, Homo Sapiens; identical to SEQ ID NO: 142738

SEQ ID NO: 569577 - RNA, 64 nt, Homo Sapiens; identical to SEQ ID NO: 142739

SEQ ID NO: 569578 - RNA, 64 nt, Homo Sapiens; identical to SEQ ID NO: 142740

SEQ ID NO: 569579 - RNA, 64 nt, Homo Sapiens; identical to SEQ ID NO: 142741

SEQ ID NO: 569580 - RNA, 64 nt, Homo Sapiens; identical to SEQ ID NO: 142742

SEQ ID NO: 569581 - RNA, 64 nt, Homo Sapiens; identical to SEQ ID NO: 142743

SEQ ID NO: 569582 - RNA, 64 nt, Homo Sapiens; identical to SEQ ID NO: 142744

SEQ ID NO: 569583 - RNA, 64 nt, Homo Sapiens; identical to SEQ ID NO: 142745

SEQ ID NO: 569584 - RNA, 64 nt, Homo Sapiens; identical to SEQ ID NO: 142746

SEQ ID NO: 569585 - RNA, 64 nt, Homo Sapiens; identical to SEQ ID NO: 142747

SEQ ID NO: 569586 - RNA, 64 nt, Homo Sapiens; identical to SEQ ID NO: 142748

SEQ ID NO: 569587 - RNA, 64 nt, Homo Sapiens; identical to SEQ ID NO: 142749

SEQ ID NO: 569588 - RNA, 64 nt, Homo Sapiens; identical to SEQ ID NO: 142750

SEQ ID NO: 569589 - RNA, 64 nt, Homo Sapiens; identical to SEQ ID NO: 142751

SEQ ID NO: 569590 - RNA, 64 nt, Homo Sapiens; identical to SEQ ID NO: 142752

SEQ ID NO: 569591 - RNA, 64 nt, Homo Sapiens; identical to SEQ ID NO: 142753

SEQ ID NO: 569592 - RNA, 64 nt, Homo Sapiens; identical to SEQ ID NO: 142754

SEQ ID NO: 569593 - RNA, 64 nt, Homo Sapiens; identical to SEQ ID NO: 142755

SEQ ID NO: 569594 - RNA, 64 nt, Homo Sapiens; identical to SEQ ID NO: 142756

SEQ ID NO: 569595 - RNA, 64 nt, Homo Sapiens; identical to SEQ ID NO: 142757

SEQ ID NO: 569596 - RNA, 64 nt, Homo Sapiens; identical to SEQ ID NO: 142758

SEQ ID NO: 569597 - RNA, 64 nt, Homo Sapiens; identical to SEQ ID NO: 142759

SEQ ID NO: 569598 - RNA, 64 nt, Homo Sapiens; identical to SEQ ID NO: 142760

SEQ ID NO: 569599 - RNA, 64 nt, Homo Sapiens; identical to SEQ ID NO: 142761

SEQ ID NO: 569600 - RNA, 64 nt, Homo Sapiens; identical to SEQ ID NO: 142762

SEQ ID NO: 569601 - RNA, 64 nt, Homo Sapiens; identical to SEQ ID NO: 142763

SEQ ID NO: 569602 - RNA, 64 nt, Homo Sapiens; identical to SEQ ID NO: 142764

SEQ ID NO: 569603 - RNA, 64 nt, Homo Sapiens; identical to SEQ ID NO: 142765

SEQ ID NO: 569604 - RNA, 64 nt, Homo Sapiens; identical to SEQ ID NO: 142766

SEQ ID NO: 569605 - RNA, 64 nt, Homo Sapiens; identical to SEQ ID NO: 142767

SEQ ID NO: 569606 - RNA, 64 nt, Homo Sapiens; identical to SEQ ID NO: 142768

SEQ ID NO: 569607 - RNA, 64 nt, Homo Sapiens; identical to SEQ ID NO: 142769

SEQ ID NO: 569608 - RNA, 64 nt, Homo Sapiens; identical to SEQ ID NO: 142770

SEQ ID NO: 569609 - RNA, 64 nt, Homo Sapiens; identical to SEQ ID NO: 142771

SEQ ID NO: 569610 - RNA, 64 nt, Homo Sapiens; identical to SEQ ID NO: 142772

SEQ ID NO: 569611 - RNA, 64 nt, Homo Sapiens; identical to SEQ ID NO: 142773

SEQ ID NO: 569612 - RNA, 64 nt, Homo Sapiens; identical to SEQ ID NO: 142774

SEQ ID NO: 569613 - RNA, 64 nt, Homo Sapiens; identical to SEQ ID NO: 142775

SEQ ID NO: 569614 - RNA, 64 nt, Homo Sapiens; identical to SEQ ID NO: 142776

SEQ ID NO: 569615 - RNA, 64 nt, Homo Sapiens; identical to SEQ ID NO: 142777

SEQ ID NO: 569616 - RNA, 64 nt, Homo Sapiens; identical to SEQ ID NO: 142778

SEQ ID NO: 569617 - RNA, 64 nt, Homo Sapiens; identical to SEQ ID NO: 142779

SEQ ID NO: 569618 - RNA, 64 nt, Homo Sapiens; identical to SEQ ID NO: 142780

SEQ ID NO: 569619 - RNA, 64 nt, Homo Sapiens; identical to SEQ ID NO: 142781

SEQ ID NO: 569620 - RNA, 64 nt, Homo Sapiens; identical to SEQ ID NO: 142782

SEQ ID NO: 569621 - RNA, 64 nt, Homo Sapiens; identical to SEQ ID NO: 142783

SEQ ID NO: 569622 - RNA, 64 nt, Homo Sapiens; identical to SEQ ID NO: 142784

SEQ ID NO: 569623 - RNA, 64 nt, Homo Sapiens; identical to SEQ ID NO: 142785

SEQ ID NO: 569624 - RNA, 64 nt, Homo Sapiens; identical to SEQ ID NO: 142786

SEQ ID NO: 569625 - RNA, 64 nt, Homo Sapiens; identical to SEQ ID NO: 142787

SEQ ID NO: 569626 - RNA, 64 nt, Homo Sapiens; identical to SEQ ID NO: 142788

SEQ ID NO: 569627 - RNA, 64 nt, Homo Sapiens; identical to SEQ ID NO: 142789

SEQ ID NO: 569628 - RNA, 64 nt, Homo Sapiens; identical to SEQ ID NO: 142790

SEQ ID NO: 569629 - RNA, 64 nt, Homo Sapiens; identical to SEQ ID NO: 142791

SEQ ID NO: 569630 - RNA, 64 nt, Homo Sapiens; identical to SEQ ID NO: 142792

SEQ ID NO: 569631 - RNA, 64 nt, Homo Sapiens; identical to SEQ ID NO: 142793

SEQ ID NO: 569632 - RNA, 64 nt, Homo Sapiens; identical to SEQ ID NO: 142794

SEQ ID NO: 569633 - RNA, 64 nt, Homo Sapiens; identical to SEQ ID NO: 142795

SEQ ID NO: 569634 - RNA, 64 nt, Homo Sapiens; identical to SEQ ID NO: 142796

SEQ ID NO: 569635 - RNA, 64 nt, Homo Sapiens; identical to SEQ ID NO: 142797

SEQ ID NO: 569636 - RNA, 64 nt, Homo Sapiens; identical to SEQ ID NO: 142798

SEQ ID NO: 569637 - RNA, 64 nt, Homo Sapiens; identical to SEQ ID NO: 142799

SEQ ID NO: 569638 - RNA, 64 nt, Homo Sapiens; identical to SEQ ID NO: 142800

SEQ ID NO: 569639 - RNA, 64 nt, Homo Sapiens; identical to SEQ ID NO: 142801

SEQ ID NO: 569640 - RNA, 64 nt, Homo Sapiens; identical to SEQ ID NO: 142802

SEQ ID NO: 569641 - RNA, 64 nt, Homo Sapiens; identical to SEQ ID NO: 142803

SEQ ID NO: 569642 - RNA, 64 nt, Homo Sapiens; identical to SEQ ID NO: 142804

SEQ ID NO: 569643 - RNA, 64 nt, Homo Sapiens; identical to SEQ ID NO: 142805

SEQ ID NO: 569644 - RNA, 64 nt, Homo Sapiens; identical to SEQ ID NO: 142806

SEQ ID NO: 569645 - RNA, 64 nt, Homo Sapiens; identical to SEQ ID NO: 142807

SEQ ID NO: 569646 - RNA, 64 nt, Homo Sapiens; identical to SEQ ID NO: 142808

SEQ ID NO: 569647 - RNA, 64 nt, Homo Sapiens; identical to SEQ ID NO: 142809

SEQ ID NO: 569648 - RNA, 64 nt, Homo Sapiens; identical to SEQ ID NO: 142810

SEQ ID NO: 569649 - RNA, 64 nt, Homo Sapiens; identical to SEQ ID NO: 142811

SEQ ID NO: 569650 - RNA, 64 nt, Homo Sapiens; identical to SEQ ID NO: 142812

SEQ ID NO: 569651 - RNA, 64 nt, Homo Sapiens; identical to SEQ ID NO: 142813

SEQ ID NO: 569652 - RNA, 64 nt, Homo Sapiens; identical to SEQ ID NO: 142814

SEQ ID NO: 569653 - RNA, 64 nt, Homo Sapiens; identical to SEQ ID NO: 142815

SEQ ID NO: 569654 - RNA, 64 nt, Homo Sapiens; identical to SEQ ID NO: 142816

SEQ ID NO: 569655 - RNA, 64 nt, Homo Sapiens; identical to SEQ ID NO: 142817

SEQ ID NO: 569656 - RNA, 64 nt, Homo Sapiens; identical to SEQ ID NO: 142818

SEQ ID NO: 569657 - RNA, 64 nt, Homo Sapiens; identical to SEQ ID NO: 142819

SEQ ID NO: 569658 - RNA, 64 nt, Homo Sapiens; identical to SEQ ID NO: 142820

SEQ ID NO: 569659 - RNA, 64 nt, Homo Sapiens; identical to SEQ ID NO: 142821

SEQ ID NO: 569660 - RNA, 64 nt, Homo Sapiens; identical to SEQ ID NO: 142822

SEQ ID NO: 569661 - RNA, 64 nt, Homo Sapiens; identical to SEQ ID NO: 142823

SEQ ID NO: 569662 - RNA, 64 nt, Homo Sapiens; identical to SEQ ID NO: 142824

SEQ ID NO: 569663 - RNA, 64 nt, Homo Sapiens; identical to SEQ ID NO: 142825

SEQ ID NO: 569664 - RNA, 64 nt, Homo Sapiens; identical to SEQ ID NO: 142826

SEQ ID NO: 569665 - RNA, 64 nt, Homo Sapiens; identical to SEQ ID NO: 142827

SEQ ID NO: 569666 - RNA, 64 nt, Homo Sapiens; identical to SEQ ID NO: 142828

SEQ ID NO: 569667 - RNA, 64 nt, Homo Sapiens; identical to SEQ ID NO: 142829

SEQ ID NO: 569668 - RNA, 64 nt, Homo Sapiens; identical to SEQ ID NO: 142830

SEQ ID NO: 569669 - RNA, 64 nt, Homo Sapiens; identical to SEQ ID NO: 142831

SEQ ID NO: 569670 - RNA, 64 nt, Homo Sapiens; identical to SEQ ID NO: 142832

SEQ ID NO: 569671 - RNA, 64 nt, Homo Sapiens; identical to SEQ ID NO: 142833

SEQ ID NO: 569672 - RNA, 64 nt, Homo Sapiens; identical to SEQ ID NO: 142834

SEQ ID NO: 569673 - RNA, 64 nt, Homo Sapiens; identical to SEQ ID NO: 142835

SEQ ID NO: 569674 - RNA, 64 nt, Homo Sapiens; identical to SEQ ID NO: 142836

SEQ ID NO: 569675 - RNA, 64 nt, Homo Sapiens; identical to SEQ ID NO: 142837

SEQ ID NO: 569676 - RNA, 64 nt, Homo Sapiens; identical to SEQ ID NO: 142838

SEQ ID NO: 569677 - RNA, 64 nt, Homo Sapiens; identical to SEQ ID NO: 142839

SEQ ID NO: 569678 - RNA, 64 nt, Homo Sapiens; identical to SEQ ID NO: 142840

SEQ ID NO: 569679 - RNA, 64 nt, Homo Sapiens; identical to SEQ ID NO: 142841

SEQ ID NO: 569680 - RNA, 64 nt, Homo Sapiens; identical to SEQ ID NO: 142842

SEQ ID NO: 569681 - RNA, 64 nt, Homo Sapiens; identical to SEQ ID NO: 142843

SEQ ID NO: 569682 - RNA, 64 nt, Homo Sapiens; identical to SEQ ID NO: 142844

SEQ ID NO: 569683 - RNA, 64 nt, Homo Sapiens; identical to SEQ ID NO: 142845

SEQ ID NO: 569684 - RNA, 64 nt, Homo Sapiens; identical to SEQ ID NO: 142846

SEQ ID NO: 569685 - RNA, 64 nt, Homo Sapiens; identical to SEQ ID NO: 142847

SEQ ID NO: 569686 - RNA, 64 nt, Homo Sapiens; identical to SEQ ID NO: 142848

SEQ ID NO: 569687 - RNA, 64 nt, Homo Sapiens; identical to SEQ ID NO: 142849

SEQ ID NO: 569688 - RNA, 64 nt, Homo Sapiens; identical to SEQ ID NO: 142850

SEQ ID NO: 569689 - RNA, 64 nt, Homo Sapiens; identical to SEQ ID NO: 142851

SEQ ID NO: 569690 - RNA, 64 nt, Homo Sapiens; identical to SEQ ID NO: 142852

SEQ ID NO: 569691 - RNA, 64 nt, Homo Sapiens; identical to SEQ ID NO: 142853

SEQ ID NO: 569692 - RNA, 64 nt, Homo Sapiens; identical to SEQ ID NO: 142854

SEQ ID NO: 569693 - RNA, 64 nt, Homo Sapiens; identical to SEQ ID NO: 142855

SEQ ID NO: 569694 - RNA, 64 nt, Homo Sapiens; identical to SEQ ID NO: 142856

SEQ ID NO: 569695 - RNA, 64 nt, Homo Sapiens; identical to SEQ ID NO: 142857

SEQ ID NO: 569696 - RNA, 64 nt, Homo Sapiens; identical to SEQ ID NO: 142858

SEQ ID NO: 569697 - RNA, 64 nt, Homo Sapiens; identical to SEQ ID NO: 142859

SEQ ID NO: 569698 - RNA, 64 nt, Homo Sapiens; identical to SEQ ID NO: 142860

SEQ ID NO: 569699 - RNA, 64 nt, Homo Sapiens; identical to SEQ ID NO: 142861

SEQ ID NO: 569700 - RNA, 64 nt, Homo Sapiens; identical to SEQ ID NO: 142862

SEQ ID NO: 569701 - RNA, 64 nt, Homo Sapiens; identical to SEQ ID NO: 142863

SEQ ID NO: 569702 - RNA, 64 nt, Homo Sapiens; identical to SEQ ID NO: 142864

SEQ ID NO: 569703 - RNA, 64 nt, Homo Sapiens; identical to SEQ ID NO: 142865

SEQ ID NO: 569704 - RNA, 64 nt, Homo Sapiens; identical to SEQ ID NO: 142866

SEQ ID NO: 569705 - RNA, 64 nt, Homo Sapiens; identical to SEQ ID NO: 142867

SEQ ID NO: 569706 - RNA, 64 nt, Homo Sapiens; identical to SEQ ID NO: 142868

SEQ ID NO: 569707 - RNA, 64 nt, Homo Sapiens; identical to SEQ ID NO: 142869

SEQ ID NO: 569708 - RNA, 64 nt, Homo Sapiens; identical to SEQ ID NO: 142870

SEQ ID NO: 569709 - RNA, 64 nt, Homo Sapiens; identical to SEQ ID NO: 142871

SEQ ID NO: 569710 - RNA, 64 nt, Homo Sapiens; identical to SEQ ID NO: 142872

SEQ ID NO: 569711 - RNA, 64 nt, Homo Sapiens; identical to SEQ ID NO: 142873

SEQ ID NO: 569712 - RNA, 64 nt, Homo Sapiens; identical to SEQ ID NO: 142874

SEQ ID NO: 569713 - RNA, 64 nt, Homo Sapiens; identical to SEQ ID NO: 142875

SEQ ID NO: 569714 - RNA, 64 nt, Homo Sapiens; identical to SEQ ID NO: 142876

SEQ ID NO: 569715 - RNA, 64 nt, Homo Sapiens; identical to SEQ ID NO: 142877

SEQ ID NO: 569716 - RNA, 64 nt, Homo Sapiens; identical to SEQ ID NO: 142878

SEQ ID NO: 569717 - RNA, 64 nt, Homo Sapiens; identical to SEQ ID NO: 142879

SEQ ID NO: 569718 - RNA, 64 nt, Homo Sapiens; identical to SEQ ID NO: 142880

SEQ ID NO: 569719 - RNA, 64 nt, Homo Sapiens; identical to SEQ ID NO: 142881

SEQ ID NO: 569720 - RNA, 64 nt, Homo Sapiens; identical to SEQ ID NO: 142882

SEQ ID NO: 569721 - RNA, 64 nt, Homo Sapiens; identical to SEQ ID NO: 142883

SEQ ID NO: 569722 - RNA, 64 nt, Homo Sapiens; identical to SEQ ID NO: 142884

SEQ ID NO: 569723 - RNA, 64 nt, Homo Sapiens; identical to SEQ ID NO: 142885

SEQ ID NO: 569724 - RNA, 64 nt, Homo Sapiens; identical to SEQ ID NO: 142886

SEQ ID NO: 569725 - RNA, 64 nt, Homo Sapiens; identical to SEQ ID NO: 142887

SEQ ID NO: 569726 - RNA, 64 nt, Homo Sapiens; identical to SEQ ID NO: 142888

SEQ ID NO: 569727 - RNA, 64 nt, Homo Sapiens; identical to SEQ ID NO: 142889

SEQ ID NO: 569728 - RNA, 64 nt, Homo Sapiens; identical to SEQ ID NO: 142890

SEQ ID NO: 569729 - RNA, 64 nt, Homo Sapiens; identical to SEQ ID NO: 142891

SEQ ID NO: 569730 - RNA, 64 nt, Homo Sapiens; identical to SEQ ID NO: 142892

SEQ ID NO: 569731 - RNA, 64 nt, Homo Sapiens; identical to SEQ ID NO: 142893

SEQ ID NO: 569732 - RNA, 64 nt, Homo Sapiens; identical to SEQ ID NO: 142894

SEQ ID NO: 569733 - RNA, 64 nt, Homo Sapiens; identical to SEQ ID NO: 142895

SEQ ID NO: 569734 - RNA, 64 nt, Homo Sapiens; identical to SEQ ID NO: 142896

SEQ ID NO: 569735 - RNA, 64 nt, Homo Sapiens; identical to SEQ ID NO: 142897

SEQ ID NO: 569736 - RNA, 64 nt, Homo Sapiens; identical to SEQ ID NO: 142898

SEQ ID NO: 569737 - RNA, 64 nt, Homo Sapiens; identical to SEQ ID NO: 142899

SEQ ID NO: 569738 - RNA, 64 nt, Homo Sapiens; identical to SEQ ID NO: 142900

SEQ ID NO: 569739 - RNA, 64 nt, Homo Sapiens; identical to SEQ ID NO: 142901

SEQ ID NO: 569740 - RNA, 64 nt, Homo Sapiens; identical to SEQ ID NO: 142902

SEQ ID NO: 569741 - RNA, 64 nt, Homo Sapiens; identical to SEQ ID NO: 142903

SEQ ID NO: 569742 - RNA, 64 nt, Homo Sapiens; identical to SEQ ID NO: 142904

SEQ ID NO: 569743 - RNA, 64 nt, Homo Sapiens; identical to SEQ ID NO: 142905

SEQ ID NO: 569744 - RNA, 64 nt, Homo Sapiens; identical to SEQ ID NO: 142906

SEQ ID NO: 569745 - RNA, 64 nt, Homo Sapiens; identical to SEQ ID NO: 142907

SEQ ID NO: 569746 - RNA, 64 nt, Homo Sapiens; identical to SEQ ID NO: 142908

SEQ ID NO: 569747 - RNA, 64 nt, Homo Sapiens; identical to SEQ ID NO: 142909

SEQ ID NO: 569748 - RNA, 64 nt, Homo Sapiens; identical to SEQ ID NO: 142910

SEQ ID NO: 569749 - RNA, 64 nt, Homo Sapiens; identical to SEQ ID NO: 142911

SEQ ID NO: 569750 - RNA, 64 nt, Homo Sapiens; identical to SEQ ID NO: 142912

SEQ ID NO: 569751 - RNA, 64 nt, Homo Sapiens; identical to SEQ ID NO: 142913

SEQ ID NO: 569752 - RNA, 64 nt, Homo Sapiens; identical to SEQ ID NO: 142914

SEQ ID NO: 569753 - RNA, 64 nt, Homo Sapiens; identical to SEQ ID NO: 142915

SEQ ID NO: 569754 - RNA, 64 nt, Homo Sapiens; identical to SEQ ID NO: 142916

SEQ ID NO: 569755 - RNA, 64 nt, Homo Sapiens; identical to SEQ ID NO: 142917

SEQ ID NO: 569756 - RNA, 64 nt, Homo Sapiens; identical to SEQ ID NO: 142918

SEQ ID NO: 569757 - RNA, 64 nt, Homo Sapiens; identical to SEQ ID NO: 142919

SEQ ID NO: 569758 - RNA, 64 nt, Homo Sapiens; identical to SEQ ID NO: 142920

SEQ ID NO: 569759 - RNA, 64 nt, Homo Sapiens; identical to SEQ ID NO: 142921

SEQ ID NO: 569760 - RNA, 64 nt, Homo Sapiens; identical to SEQ ID NO: 142922

SEQ ID NO: 569761 - RNA, 64 nt, Homo Sapiens; identical to SEQ ID NO: 142923

SEQ ID NO: 569762 - RNA, 64 nt, Homo Sapiens; identical to SEQ ID NO: 142924

SEQ ID NO: 569763 - RNA, 64 nt, Homo Sapiens; identical to SEQ ID NO: 142925

SEQ ID NO: 569764 - RNA, 64 nt, Homo Sapiens; identical to SEQ ID NO: 142926

SEQ ID NO: 569765 - RNA, 64 nt, Homo Sapiens; identical to SEQ ID NO: 142927

SEQ ID NO: 569766 - RNA, 64 nt, Homo Sapiens; identical to SEQ ID NO: 142928

SEQ ID NO: 569767 - RNA, 64 nt, Homo Sapiens; identical to SEQ ID NO: 142929

SEQ ID NO: 569768 - RNA, 64 nt, Homo Sapiens; identical to SEQ ID NO: 142930

SEQ ID NO: 569769 - RNA, 64 nt, Homo Sapiens; identical to SEQ ID NO: 142931

SEQ ID NO: 569770 - RNA, 64 nt, Homo Sapiens; identical to SEQ ID NO: 142932

SEQ ID NO: 569771 - RNA, 64 nt, Homo Sapiens; identical to SEQ ID NO: 142933

SEQ ID NO: 569772 - RNA, 64 nt, Homo Sapiens; identical to SEQ ID NO: 142934

SEQ ID NO: 569773 - RNA, 64 nt, Homo Sapiens; identical to SEQ ID NO: 142935

SEQ ID NO: 569774 - RNA, 64 nt, Homo Sapiens; identical to SEQ ID NO: 142936

SEQ ID NO: 569775 - RNA, 64 nt, Homo Sapiens; identical to SEQ ID NO: 142937

SEQ ID NO: 569776 - RNA, 64 nt, Homo Sapiens; identical to SEQ ID NO: 142938

SEQ ID NO: 569777 - RNA, 64 nt, Homo Sapiens; identical to SEQ ID NO: 142939

SEQ ID NO: 569778 - RNA, 64 nt, Homo Sapiens; identical to SEQ ID NO: 142940

SEQ ID NO: 569779 - RNA, 64 nt, Homo Sapiens; identical to SEQ ID NO: 142941

SEQ ID NO: 569780 - RNA, 64 nt, Homo Sapiens; identical to SEQ ID NO: 142942

SEQ ID NO: 569781 - RNA, 64 nt, Homo Sapiens; identical to SEQ ID NO: 142943

SEQ ID NO: 569782 - RNA, 64 nt, Homo Sapiens; identical to SEQ ID NO: 142944

SEQ ID NO: 569783 - RNA, 64 nt, Homo Sapiens; identical to SEQ ID NO: 142945

SEQ ID NO: 569784 - RNA, 64 nt, Homo Sapiens; identical to SEQ ID NO: 142946

SEQ ID NO: 569785 - RNA, 64 nt, Homo Sapiens; identical to SEQ ID NO: 142947

SEQ ID NO: 569786 - RNA, 64 nt, Homo Sapiens; identical to SEQ ID NO: 142948

SEQ ID NO: 569787 - RNA, 64 nt, Homo Sapiens; identical to SEQ ID NO: 142949

SEQ ID NO: 569788 - RNA, 64 nt, Homo Sapiens; identical to SEQ ID NO: 142950

SEQ ID NO: 569789 - RNA, 64 nt, Homo Sapiens; identical to SEQ ID NO: 142951

SEQ ID NO: 569790 - RNA, 64 nt, Homo Sapiens; identical to SEQ ID NO: 142952

SEQ ID NO: 569791 - RNA, 64 nt, Homo Sapiens; identical to SEQ ID NO: 142953

SEQ ID NO: 569792 - RNA, 64 nt, Homo Sapiens; identical to SEQ ID NO: 142954

SEQ ID NO: 569793 - RNA, 64 nt, Homo Sapiens; identical to SEQ ID NO: 142955

SEQ ID NO: 569794 - RNA, 64 nt, Homo Sapiens; identical to SEQ ID NO: 142956

SEQ ID NO: 569795 - RNA, 64 nt, Homo Sapiens; identical to SEQ ID NO: 142957

SEQ ID NO: 569796 - RNA, 64 nt, Homo Sapiens; identical to SEQ ID NO: 142958

SEQ ID NO: 569797 - RNA, 64 nt, Homo Sapiens; identical to SEQ ID NO: 142959

SEQ ID NO: 569798 - RNA, 64 nt, Homo Sapiens; identical to SEQ ID NO: 142960

SEQ ID NO: 569799 - RNA, 64 nt, Homo Sapiens; identical to SEQ ID NO: 142961

SEQ ID NO: 569800 - RNA, 64 nt, Homo Sapiens; identical to SEQ ID NO: 142962

SEQ ID NO: 569801 - RNA, 64 nt, Homo Sapiens; identical to SEQ ID NO: 142963

SEQ ID NO: 569802 - RNA, 64 nt, Homo Sapiens; identical to SEQ ID NO: 142964

SEQ ID NO: 569803 - RNA, 64 nt, Homo Sapiens; identical to SEQ ID NO: 142965

SEQ ID NO: 569804 - RNA, 64 nt, Homo Sapiens; identical to SEQ ID NO: 142966

SEQ ID NO: 569805 - RNA, 64 nt, Homo Sapiens; identical to SEQ ID NO: 142967

SEQ ID NO: 569806 - RNA, 64 nt, Homo Sapiens; identical to SEQ ID NO: 142968

SEQ ID NO: 569807 - RNA, 64 nt, Homo Sapiens; identical to SEQ ID NO: 142969

SEQ ID NO: 569808 - RNA, 64 nt, Homo Sapiens; identical to SEQ ID NO: 142970

SEQ ID NO: 569809 - RNA, 64 nt, Homo Sapiens; identical to SEQ ID NO: 142971

SEQ ID NO: 569810 - RNA, 64 nt, Homo Sapiens; identical to SEQ ID NO: 142972

SEQ ID NO: 569811 - RNA, 64 nt, Homo Sapiens; identical to SEQ ID NO: 142973

SEQ ID NO: 569812 - RNA, 64 nt, Homo Sapiens; identical to SEQ ID NO: 142974

SEQ ID NO: 569813 - RNA, 64 nt, Homo Sapiens; identical to SEQ ID NO: 142975

SEQ ID NO: 569814 - RNA, 64 nt, Homo Sapiens; identical to SEQ ID NO: 142976

SEQ ID NO: 569815 - RNA, 64 nt, Homo Sapiens; identical to SEQ ID NO: 142977

SEQ ID NO: 569816 - RNA, 64 nt, Homo Sapiens; identical to SEQ ID NO: 142978

SEQ ID NO: 569817 - RNA, 64 nt, Homo Sapiens; identical to SEQ ID NO: 142979

SEQ ID NO: 569818 - RNA, 64 nt, Homo Sapiens; identical to SEQ ID NO: 142980

SEQ ID NO: 569819 - RNA, 64 nt, Homo Sapiens; identical to SEQ ID NO: 142981

SEQ ID NO: 569820 - RNA, 64 nt, Homo Sapiens; identical to SEQ ID NO: 142982

SEQ ID NO: 569821 - RNA, 64 nt, Homo Sapiens; identical to SEQ ID NO: 142983

SEQ ID NO: 569822 - RNA, 64 nt, Homo Sapiens; identical to SEQ ID NO: 142984

SEQ ID NO: 569823 - RNA, 64 nt, Homo Sapiens; identical to SEQ ID NO: 142985

SEQ ID NO: 569824 - RNA, 64 nt, Homo Sapiens; identical to SEQ ID NO: 142986

SEQ ID NO: 569825 - RNA, 64 nt, Homo Sapiens; identical to SEQ ID NO: 142987

SEQ ID NO: 569826 - RNA, 64 nt, Homo Sapiens; identical to SEQ ID NO: 142988

SEQ ID NO: 569827 - RNA, 64 nt, Homo Sapiens; identical to SEQ ID NO: 142989

SEQ ID NO: 569828 - RNA, 64 nt, Homo Sapiens; identical to SEQ ID NO: 142990

SEQ ID NO: 569829 - RNA, 64 nt, Homo Sapiens; identical to SEQ ID NO: 142991

SEQ ID NO: 569830 - RNA, 64 nt, Homo Sapiens; identical to SEQ ID NO: 142992

SEQ ID NO: 569831 - RNA, 64 nt, Homo Sapiens; identical to SEQ ID NO: 142993

SEQ ID NO: 569832 - RNA, 64 nt, Homo Sapiens; identical to SEQ ID NO: 142994

SEQ ID NO: 569833 - RNA, 64 nt, Homo Sapiens; identical to SEQ ID NO: 142995

SEQ ID NO: 569834 - RNA, 64 nt, Homo Sapiens; identical to SEQ ID NO: 142996

SEQ ID NO: 569835 - RNA, 64 nt, Homo Sapiens; identical to SEQ ID NO: 142997

SEQ ID NO: 569836 - RNA, 64 nt, Homo Sapiens; identical to SEQ ID NO: 142998

SEQ ID NO: 569837 - RNA, 64 nt, Homo Sapiens; identical to SEQ ID NO: 142999

SEQ ID NO: 569838 - RNA, 64 nt, Homo Sapiens; identical to SEQ ID NO: 143000

SEQ ID NO: 569839 - RNA, 64 nt, Homo Sapiens; identical to SEQ ID NO: 143001

SEQ ID NO: 569840 - RNA, 64 nt, Homo Sapiens; identical to SEQ ID NO: 143002

SEQ ID NO: 569841 - RNA, 64 nt, Homo Sapiens; identical to SEQ ID NO: 143003

SEQ ID NO: 569842 - RNA, 64 nt, Homo Sapiens; identical to SEQ ID NO: 143004

SEQ ID NO: 569843 - RNA, 64 nt, Homo Sapiens; identical to SEQ ID NO: 143005

SEQ ID NO: 569844 - RNA, 64 nt, Homo Sapiens; identical to SEQ ID NO: 143006

SEQ ID NO: 569845 - RNA, 64 nt, Homo Sapiens; identical to SEQ ID NO: 143007

SEQ ID NO: 569846 - RNA, 64 nt, Homo Sapiens; identical to SEQ ID NO: 143008

SEQ ID NO: 569847 - RNA, 64 nt, Homo Sapiens; identical to SEQ ID NO: 143009

SEQ ID NO: 569848 - RNA, 64 nt, Homo Sapiens; identical to SEQ ID NO: 143010

SEQ ID NO: 569849 - RNA, 64 nt, Homo Sapiens; identical to SEQ ID NO: 143011

SEQ ID NO: 569850 - RNA, 64 nt, Homo Sapiens; identical to SEQ ID NO: 143012

SEQ ID NO: 569851 - RNA, 64 nt, Homo Sapiens; identical to SEQ ID NO: 143013

SEQ ID NO: 569852 - RNA, 64 nt, Homo Sapiens; identical to SEQ ID NO: 143014

SEQ ID NO: 569853 - RNA, 64 nt, Homo Sapiens; identical to SEQ ID NO: 143015

SEQ ID NO: 569854 - RNA, 64 nt, Homo Sapiens; identical to SEQ ID NO: 143016

SEQ ID NO: 569855 - RNA, 64 nt, Homo Sapiens; identical to SEQ ID NO: 143017

SEQ ID NO: 569856 - RNA, 64 nt, Homo Sapiens; identical to SEQ ID NO: 143018

SEQ ID NO: 569857 - RNA, 64 nt, Homo Sapiens; identical to SEQ ID NO: 143019

SEQ ID NO: 569858 - RNA, 64 nt, Homo Sapiens; identical to SEQ ID NO: 143020

SEQ ID NO: 569859 - RNA, 64 nt, Homo Sapiens; identical to SEQ ID NO: 143021

SEQ ID NO: 569860 - RNA, 64 nt, Homo Sapiens; identical to SEQ ID NO: 143022

SEQ ID NO: 569861 - RNA, 64 nt, Homo Sapiens; identical to SEQ ID NO: 143023

SEQ ID NO: 569862 - RNA, 64 nt, Homo Sapiens; identical to SEQ ID NO: 143024

SEQ ID NO: 569863 - RNA, 64 nt, Homo Sapiens; identical to SEQ ID NO: 143025

SEQ ID NO: 569864 - RNA, 64 nt, Homo Sapiens; identical to SEQ ID NO: 143026

SEQ ID NO: 569865 - RNA, 64 nt, Homo Sapiens; identical to SEQ ID NO: 143027

SEQ ID NO: 569866 - RNA, 64 nt, Homo Sapiens; identical to SEQ ID NO: 143028

SEQ ID NO: 569867 - RNA, 64 nt, Homo Sapiens; identical to SEQ ID NO: 143029

SEQ ID NO: 569868 - RNA, 64 nt, Homo Sapiens; identical to SEQ ID NO: 143030

SEQ ID NO: 569869 - RNA, 64 nt, Homo Sapiens; identical to SEQ ID NO: 143031

SEQ ID NO: 569870 - RNA, 64 nt, Homo Sapiens; identical to SEQ ID NO: 143032

SEQ ID NO: 569871 - RNA, 64 nt, Homo Sapiens; identical to SEQ ID NO: 143033

SEQ ID NO: 569872 - RNA, 64 nt, Homo Sapiens; identical to SEQ ID NO: 143034

SEQ ID NO: 569873 - RNA, 64 nt, Homo Sapiens; identical to SEQ ID NO: 143035

SEQ ID NO: 569874 - RNA, 64 nt, Homo Sapiens; identical to SEQ ID NO: 143036

SEQ ID NO: 569875 - RNA, 64 nt, Homo Sapiens; identical to SEQ ID NO: 143037

SEQ ID NO: 569876 - RNA, 64 nt, Homo Sapiens; identical to SEQ ID NO: 143038

SEQ ID NO: 569877 - RNA, 64 nt, Homo Sapiens; identical to SEQ ID NO: 143039

SEQ ID NO: 569878 - RNA, 64 nt, Homo Sapiens; identical to SEQ ID NO: 143040

SEQ ID NO: 569879 - RNA, 64 nt, Homo Sapiens; identical to SEQ ID NO: 143041

SEQ ID NO: 569880 - RNA, 64 nt, Homo Sapiens; identical to SEQ ID NO: 143042

SEQ ID NO: 569881 - RNA, 64 nt, Homo Sapiens; identical to SEQ ID NO: 143043

SEQ ID NO: 569882 - RNA, 64 nt, Homo Sapiens; identical to SEQ ID NO: 143044

SEQ ID NO: 569883 - RNA, 64 nt, Homo Sapiens; identical to SEQ ID NO: 143045

SEQ ID NO: 569884 - RNA, 64 nt, Homo Sapiens; identical to SEQ ID NO: 143046

SEQ ID NO: 569885 - RNA, 64 nt, Homo Sapiens; identical to SEQ ID NO: 143047

SEQ ID NO: 569886 - RNA, 64 nt, Homo Sapiens; identical to SEQ ID NO: 143048

SEQ ID NO: 569887 - RNA, 64 nt, Homo Sapiens; identical to SEQ ID NO: 143049

SEQ ID NO: 569888 - RNA, 64 nt, Homo Sapiens; identical to SEQ ID NO: 143050

SEQ ID NO: 569889 - RNA, 64 nt, Homo Sapiens; identical to SEQ ID NO: 143051

SEQ ID NO: 569890 - RNA, 64 nt, Homo Sapiens; identical to SEQ ID NO: 143052

SEQ ID NO: 569891 - RNA, 64 nt, Homo Sapiens; identical to SEQ ID NO: 143053

SEQ ID NO: 569892 - RNA, 64 nt, Homo Sapiens; identical to SEQ ID NO: 143054

SEQ ID NO: 569893 - RNA, 64 nt, Homo Sapiens; identical to SEQ ID NO: 143055

SEQ ID NO: 569894 - RNA, 64 nt, Homo Sapiens; identical to SEQ ID NO: 143056

SEQ ID NO: 569895 - RNA, 64 nt, Homo Sapiens; identical to SEQ ID NO: 143057

SEQ ID NO: 569896 - RNA, 64 nt, Homo Sapiens; identical to SEQ ID NO: 143058

SEQ ID NO: 569897 - RNA, 64 nt, Homo Sapiens; identical to SEQ ID NO: 143059

SEQ ID NO: 569898 - RNA, 64 nt, Homo Sapiens; identical to SEQ ID NO: 143060

SEQ ID NO: 569899 - RNA, 64 nt, Homo Sapiens; identical to SEQ ID NO: 143061

SEQ ID NO: 569900 - RNA, 64 nt, Homo Sapiens; identical to SEQ ID NO: 143062

SEQ ID NO: 569901 - RNA, 64 nt, Homo Sapiens; identical to SEQ ID NO: 143063

SEQ ID NO: 569902 - RNA, 64 nt, Homo Sapiens; identical to SEQ ID NO: 143064

SEQ ID NO: 569903 - RNA, 64 nt, Homo Sapiens; identical to SEQ ID NO: 143065

SEQ ID NO: 569904 - RNA, 64 nt, Homo Sapiens; identical to SEQ ID NO: 143066

SEQ ID NO: 569905 - RNA, 64 nt, Homo Sapiens; identical to SEQ ID NO: 143067

SEQ ID NO: 569906 - RNA, 64 nt, Homo Sapiens; identical to SEQ ID NO: 143068

SEQ ID NO: 569907 - RNA, 64 nt, Homo Sapiens; identical to SEQ ID NO: 143069

SEQ ID NO: 569908 - RNA, 64 nt, Homo Sapiens; identical to SEQ ID NO: 143070

SEQ ID NO: 569909 - RNA, 64 nt, Homo Sapiens; identical to SEQ ID NO: 143071

SEQ ID NO: 569910 - RNA, 64 nt, Homo Sapiens; identical to SEQ ID NO: 143072

SEQ ID NO: 569911 - RNA, 64 nt, Homo Sapiens; identical to SEQ ID NO: 143073

SEQ ID NO: 569912 - RNA, 64 nt, Homo Sapiens; identical to SEQ ID NO: 143074

SEQ ID NO: 569913 - RNA, 64 nt, Homo Sapiens; identical to SEQ ID NO: 143075

SEQ ID NO: 569914 - RNA, 64 nt, Homo Sapiens; identical to SEQ ID NO: 143076

SEQ ID NO: 569915 - RNA, 64 nt, Homo Sapiens; identical to SEQ ID NO: 143077

SEQ ID NO: 569916 - RNA, 64 nt, Homo Sapiens; identical to SEQ ID NO: 143078

SEQ ID NO: 569917 - RNA, 64 nt, Homo Sapiens; identical to SEQ ID NO: 143079

SEQ ID NO: 569918 - RNA, 64 nt, Homo Sapiens; identical to SEQ ID NO: 143080

SEQ ID NO: 569919 - RNA, 64 nt, Homo Sapiens; identical to SEQ ID NO: 143081

SEQ ID NO: 569920 - RNA, 64 nt, Homo Sapiens; identical to SEQ ID NO: 143082

SEQ ID NO: 569921 - RNA, 64 nt, Homo Sapiens; identical to SEQ ID NO: 143083

SEQ ID NO: 569922 - RNA, 64 nt, Homo Sapiens; identical to SEQ ID NO: 143084

SEQ ID NO: 569923 - RNA, 64 nt, Homo Sapiens; identical to SEQ ID NO: 143085

SEQ ID NO: 569924 - RNA, 64 nt, Homo Sapiens; identical to SEQ ID NO: 143086

SEQ ID NO: 569925 - RNA, 64 nt, Homo Sapiens; identical to SEQ ID NO: 143087

SEQ ID NO: 569926 - RNA, 64 nt, Homo Sapiens; identical to SEQ ID NO: 143088

SEQ ID NO: 569927 - RNA, 64 nt, Homo Sapiens; identical to SEQ ID NO: 143089

SEQ ID NO: 569928 - RNA, 64 nt, Homo Sapiens; identical to SEQ ID NO: 143090

SEQ ID NO: 569929 - RNA, 64 nt, Homo Sapiens; identical to SEQ ID NO: 143091

SEQ ID NO: 569930 - RNA, 64 nt, Homo Sapiens; identical to SEQ ID NO: 143092

SEQ ID NO: 569931 - RNA, 64 nt, Homo Sapiens; identical to SEQ ID NO: 143093

SEQ ID NO: 569932 - RNA, 64 nt, Homo Sapiens; identical to SEQ ID NO: 143094

SEQ ID NO: 569933 - RNA, 64 nt, Homo Sapiens; identical to SEQ ID NO: 143095

SEQ ID NO: 569934 - RNA, 64 nt, Homo Sapiens; identical to SEQ ID NO: 143096

SEQ ID NO: 569935 - RNA, 64 nt, Homo Sapiens; identical to SEQ ID NO: 143097

SEQ ID NO: 569936 - RNA, 64 nt, Homo Sapiens; identical to SEQ ID NO: 143098

SEQ ID NO: 569937 - RNA, 64 nt, Homo Sapiens; identical to SEQ ID NO: 143099

SEQ ID NO: 569938 - RNA, 64 nt, Homo Sapiens; identical to SEQ ID NO: 143100

SEQ ID NO: 569939 - RNA, 64 nt, Homo Sapiens; identical to SEQ ID NO: 143101

SEQ ID NO: 569940 - RNA, 64 nt, Homo Sapiens; identical to SEQ ID NO: 143102

SEQ ID NO: 569941 - RNA, 64 nt, Homo Sapiens; identical to SEQ ID NO: 143103

SEQ ID NO: 569942 - RNA, 64 nt, Homo Sapiens; identical to SEQ ID NO: 143104

SEQ ID NO: 569943 - RNA, 64 nt, Homo Sapiens; identical to SEQ ID NO: 143105

SEQ ID NO: 569944 - RNA, 64 nt, Homo Sapiens; identical to SEQ ID NO: 143106

SEQ ID NO: 569945 - RNA, 64 nt, Homo Sapiens; identical to SEQ ID NO: 143107

SEQ ID NO: 569946 - RNA, 64 nt, Homo Sapiens; identical to SEQ ID NO: 143108

SEQ ID NO: 569947 - RNA, 64 nt, Homo Sapiens; identical to SEQ ID NO: 143109

SEQ ID NO: 569948 - RNA, 64 nt, Homo Sapiens; identical to SEQ ID NO: 143110

SEQ ID NO: 569949 - RNA, 64 nt, Homo Sapiens; identical to SEQ ID NO: 143111

SEQ ID NO: 569950 - RNA, 64 nt, Homo Sapiens; identical to SEQ ID NO: 143112

SEQ ID NO: 569951 - RNA, 64 nt, Homo Sapiens; identical to SEQ ID NO: 143113

SEQ ID NO: 569952 - RNA, 64 nt, Homo Sapiens; identical to SEQ ID NO: 143114

SEQ ID NO: 569953 - RNA, 64 nt, Homo Sapiens; identical to SEQ ID NO: 143115

SEQ ID NO: 569954 - RNA, 64 nt, Homo Sapiens; identical to SEQ ID NO: 143116

SEQ ID NO: 569955 - RNA, 64 nt, Homo Sapiens; identical to SEQ ID NO: 143117

SEQ ID NO: 569956 - RNA, 64 nt, Homo Sapiens; identical to SEQ ID NO: 143118

SEQ ID NO: 569957 - RNA, 64 nt, Homo Sapiens; identical to SEQ ID NO: 143119

SEQ ID NO: 569958 - RNA, 64 nt, Homo Sapiens; identical to SEQ ID NO: 143120

SEQ ID NO: 569959 - RNA, 64 nt, Homo Sapiens; identical to SEQ ID NO: 143121

SEQ ID NO: 569960 - RNA, 64 nt, Homo Sapiens; identical to SEQ ID NO: 143122

SEQ ID NO: 569961 - RNA, 64 nt, Homo Sapiens; identical to SEQ ID NO: 143123

SEQ ID NO: 569962 - RNA, 64 nt, Homo Sapiens; identical to SEQ ID NO: 143124

SEQ ID NO: 569963 - RNA, 64 nt, Homo Sapiens; identical to SEQ ID NO: 143125

SEQ ID NO: 569964 - RNA, 64 nt, Homo Sapiens; identical to SEQ ID NO: 143126

SEQ ID NO: 569965 - RNA, 64 nt, Homo Sapiens; identical to SEQ ID NO: 143127

SEQ ID NO: 569966 - RNA, 64 nt, Homo Sapiens; identical to SEQ ID NO: 143128

SEQ ID NO: 569967 - RNA, 64 nt, Homo Sapiens; identical to SEQ ID NO: 143129

SEQ ID NO: 569968 - RNA, 64 nt, Homo Sapiens; identical to SEQ ID NO: 143130

SEQ ID NO: 569969 - RNA, 64 nt, Homo Sapiens; identical to SEQ ID NO: 143131

SEQ ID NO: 569970 - RNA, 64 nt, Homo Sapiens; identical to SEQ ID NO: 143132

SEQ ID NO: 569971 - RNA, 64 nt, Homo Sapiens; identical to SEQ ID NO: 143133

SEQ ID NO: 569972 - RNA, 64 nt, Homo Sapiens; identical to SEQ ID NO: 143134

SEQ ID NO: 569973 - RNA, 64 nt, Homo Sapiens; identical to SEQ ID NO: 143135

SEQ ID NO: 569974 - RNA, 64 nt, Homo Sapiens; identical to SEQ ID NO: 143136

SEQ ID NO: 569975 - RNA, 64 nt, Homo Sapiens; identical to SEQ ID NO: 143137

SEQ ID NO: 569976 - RNA, 64 nt, Homo Sapiens; identical to SEQ ID NO: 143138

SEQ ID NO: 569977 - RNA, 64 nt, Homo Sapiens; identical to SEQ ID NO: 143139

SEQ ID NO: 569978 - RNA, 64 nt, Homo Sapiens; identical to SEQ ID NO: 143140

SEQ ID NO: 569979 - RNA, 64 nt, Homo Sapiens; identical to SEQ ID NO: 143141

SEQ ID NO: 569980 - RNA, 64 nt, Homo Sapiens; identical to SEQ ID NO: 143142

SEQ ID NO: 569981 - RNA, 64 nt, Homo Sapiens; identical to SEQ ID NO: 143143

SEQ ID NO: 569982 - RNA, 64 nt, Homo Sapiens; identical to SEQ ID NO: 143144

SEQ ID NO: 569983 - RNA, 64 nt, Homo Sapiens; identical to SEQ ID NO: 143145

SEQ ID NO: 569984 - RNA, 64 nt, Homo Sapiens; identical to SEQ ID NO: 143146

SEQ ID NO: 569985 - RNA, 64 nt, Homo Sapiens; identical to SEQ ID NO: 143147

SEQ ID NO: 569986 - RNA, 64 nt, Homo Sapiens; identical to SEQ ID NO: 143148

SEQ ID NO: 569987 - RNA, 64 nt, Homo Sapiens; identical to SEQ ID NO: 143149

SEQ ID NO: 569988 - RNA, 64 nt, Homo Sapiens; identical to SEQ ID NO: 143150

SEQ ID NO: 569989 - RNA, 64 nt, Homo Sapiens; identical to SEQ ID NO: 143151

SEQ ID NO: 569990 - RNA, 64 nt, Homo Sapiens; identical to SEQ ID NO: 143152

SEQ ID NO: 569991 - RNA, 64 nt, Homo Sapiens; identical to SEQ ID NO: 143153

SEQ ID NO: 569992 - RNA, 64 nt, Homo Sapiens; identical to SEQ ID NO: 143154

SEQ ID NO: 569993 - RNA, 64 nt, Homo Sapiens; identical to SEQ ID NO: 143155

SEQ ID NO: 569994 - RNA, 64 nt, Homo Sapiens; identical to SEQ ID NO: 143156

SEQ ID NO: 569995 - RNA, 64 nt, Homo Sapiens; identical to SEQ ID NO: 143157

SEQ ID NO: 569996 - RNA, 64 nt, Homo Sapiens; identical to SEQ ID NO: 143158

SEQ ID NO: 569997 - RNA, 64 nt, Homo Sapiens; identical to SEQ ID NO: 143159

SEQ ID NO: 569998 - RNA, 64 nt, Homo Sapiens; identical to SEQ ID NO: 143160

SEQ ID NO: 569999 - RNA, 64 nt, Homo Sapiens; identical to SEQ ID NO: 143161

SEQ ID NO: 570000 - RNA, 64 nt, Homo Sapiens; identical to SEQ ID NO: 143162

SEQ ID NO: 570001 - RNA, 64 nt, Homo Sapiens; identical to SEQ ID NO: 143163

SEQ ID NO: 570002 - RNA, 64 nt, Homo Sapiens; identical to SEQ ID NO: 143164

SEQ ID NO: 570003 - RNA, 64 nt, Homo Sapiens; identical to SEQ ID NO: 143165

SEQ ID NO: 570004 - RNA, 64 nt, Homo Sapiens; identical to SEQ ID NO: 143166

SEQ ID NO: 570005 - RNA, 64 nt, Homo Sapiens; identical to SEQ ID NO: 143167

SEQ ID NO: 570006 - RNA, 64 nt, Homo Sapiens; identical to SEQ ID NO: 143168

SEQ ID NO: 570007 - RNA, 64 nt, Homo Sapiens; identical to SEQ ID NO: 143169

SEQ ID NO: 570008 - RNA, 64 nt, Homo Sapiens; identical to SEQ ID NO: 143170

SEQ ID NO: 570009 - RNA, 64 nt, Homo Sapiens; identical to SEQ ID NO: 143171

SEQ ID NO: 570010 - RNA, 64 nt, Homo Sapiens; identical to SEQ ID NO: 143172

SEQ ID NO: 570011 - RNA, 64 nt, Homo Sapiens; identical to SEQ ID NO: 143173

SEQ ID NO: 570012 - RNA, 64 nt, Homo Sapiens; identical to SEQ ID NO: 143174

SEQ ID NO: 570013 - RNA, 64 nt, Homo Sapiens; identical to SEQ ID NO: 143175

SEQ ID NO: 570014 - RNA, 64 nt, Homo Sapiens; identical to SEQ ID NO: 143176

SEQ ID NO: 570015 - RNA, 64 nt, Homo Sapiens; identical to SEQ ID NO: 143177

SEQ ID NO: 570016 - RNA, 64 nt, Homo Sapiens; identical to SEQ ID NO: 143178

SEQ ID NO: 570017 - RNA, 64 nt, Homo Sapiens; identical to SEQ ID NO: 143179

SEQ ID NO: 570018 - RNA, 64 nt, Homo Sapiens; identical to SEQ ID NO: 143180

SEQ ID NO: 570019 - RNA, 64 nt, Homo Sapiens; identical to SEQ ID NO: 143181

SEQ ID NO: 570020 - RNA, 64 nt, Homo Sapiens; identical to SEQ ID NO: 143182

SEQ ID NO: 570021 - RNA, 64 nt, Homo Sapiens; identical to SEQ ID NO: 143183

SEQ ID NO: 570022 - RNA, 64 nt, Homo Sapiens; identical to SEQ ID NO: 143184

SEQ ID NO: 570023 - RNA, 64 nt, Homo Sapiens; identical to SEQ ID NO: 143185

SEQ ID NO: 570024 - RNA, 64 nt, Homo Sapiens; identical to SEQ ID NO: 143186

SEQ ID NO: 570025 - RNA, 64 nt, Homo Sapiens; identical to SEQ ID NO: 143187

SEQ ID NO: 570026 - RNA, 64 nt, Homo Sapiens; identical to SEQ ID NO: 143188

SEQ ID NO: 570027 - RNA, 64 nt, Homo Sapiens; identical to SEQ ID NO: 143189

SEQ ID NO: 570028 - RNA, 64 nt, Homo Sapiens; identical to SEQ ID NO: 143190

SEQ ID NO: 570029 - RNA, 64 nt, Homo Sapiens; identical to SEQ ID NO: 143191

SEQ ID NO: 570030 - RNA, 64 nt, Homo Sapiens; identical to SEQ ID NO: 143192

SEQ ID NO: 570031 - RNA, 64 nt, Homo Sapiens; identical to SEQ ID NO: 143193

SEQ ID NO: 570032 - RNA, 64 nt, Homo Sapiens; identical to SEQ ID NO: 143194

SEQ ID NO: 570033 - RNA, 64 nt, Homo Sapiens; identical to SEQ ID NO: 143195

SEQ ID NO: 570034 - RNA, 64 nt, Homo Sapiens; identical to SEQ ID NO: 143196

SEQ ID NO: 570035 - RNA, 64 nt, Homo Sapiens; identical to SEQ ID NO: 143197

SEQ ID NO: 570036 - RNA, 64 nt, Homo Sapiens; identical to SEQ ID NO: 143198

SEQ ID NO: 570037 - RNA, 64 nt, Homo Sapiens; identical to SEQ ID NO: 143199

SEQ ID NO: 570038 - RNA, 64 nt, Homo Sapiens; identical to SEQ ID NO: 143200

SEQ ID NO: 570039 - RNA, 64 nt, Homo Sapiens; identical to SEQ ID NO: 143201

SEQ ID NO: 570040 - RNA, 64 nt, Homo Sapiens; identical to SEQ ID NO: 143202

SEQ ID NO: 570041 - RNA, 64 nt, Homo Sapiens; identical to SEQ ID NO: 143203

SEQ ID NO: 570042 - RNA, 64 nt, Homo Sapiens; identical to SEQ ID NO: 143204

SEQ ID NO: 570043 - RNA, 64 nt, Homo Sapiens; identical to SEQ ID NO: 143205

SEQ ID NO: 570044 - RNA, 64 nt, Homo Sapiens; identical to SEQ ID NO: 143206

SEQ ID NO: 570045 - RNA, 64 nt, Homo Sapiens; identical to SEQ ID NO: 143207

SEQ ID NO: 570046 - RNA, 64 nt, Homo Sapiens; identical to SEQ ID NO: 143208

SEQ ID NO: 570047 - RNA, 64 nt, Homo Sapiens; identical to SEQ ID NO: 23360

SEQ ID NO: 570048 - RNA, 64 nt, Homo Sapiens; identical to SEQ ID NO: 23361

SEQ ID NO: 570049 - RNA, 64 nt, Homo Sapiens; identical to SEQ ID NO: 23362

SEQ ID NO: 570050 - RNA, 64 nt, Homo Sapiens; identical to SEQ ID NO: 23363

SEQ ID NO: 570051 - RNA, 64 nt, Homo Sapiens; identical to SEQ ID NO: 23364

SEQ ID NO: 570052 - RNA, 64 nt, Homo Sapiens; identical to SEQ ID NO: 23365

SEQ ID NO: 570053 - RNA, 64 nt, Homo Sapiens; identical to SEQ ID NO: 23366

SEQ ID NO: 570054 - RNA, 64 nt, Homo Sapiens; identical to SEQ ID NO: 23367

SEQ ID NO: 570055 - RNA, 64 nt, Homo Sapiens; identical to SEQ ID NO: 23368

SEQ ID NO: 570056 - RNA, 64 nt, Homo Sapiens; identical to SEQ ID NO: 23369

SEQ ID NO: 570057 - RNA, 64 nt, Homo Sapiens; identical to SEQ ID NO: 23370

SEQ ID NO: 570058 - RNA, 64 nt, Homo Sapiens; identical to SEQ ID NO: 23371

SEQ ID NO: 570059 - RNA, 64 nt, Homo Sapiens; identical to SEQ ID NO: 23372

SEQ ID NO: 570060 - RNA, 64 nt, Homo Sapiens; identical to SEQ ID NO: 23373

SEQ ID NO: 570061 - RNA, 64 nt, Homo Sapiens; identical to SEQ ID NO: 23374

SEQ ID NO: 570062 - RNA, 64 nt, Homo Sapiens; identical to SEQ ID NO: 23375

SEQ ID NO: 570063 - RNA, 64 nt, Homo Sapiens; identical to SEQ ID NO: 23376

SEQ ID NO: 570064 - RNA, 64 nt, Homo Sapiens; identical to SEQ ID NO: 23377

SEQ ID NO: 570065 - RNA, 64 nt, Homo Sapiens; identical to SEQ ID NO: 23378

SEQ ID NO: 570066 - RNA, 64 nt, Homo Sapiens; identical to SEQ ID NO: 23379

SEQ ID NO: 570067 - RNA, 64 nt, Homo Sapiens; identical to SEQ ID NO: 23380

SEQ ID NO: 570068 - RNA, 64 nt, Homo Sapiens; identical to SEQ ID NO: 23381

SEQ ID NO: 570069 - RNA, 64 nt, Homo Sapiens; identical to SEQ ID NO: 23382

SEQ ID NO: 570070 - RNA, 64 nt, Homo Sapiens; identical to SEQ ID NO: 23383

SEQ ID NO: 570071 - RNA, 64 nt, Homo Sapiens; identical to SEQ ID NO: 23384

SEQ ID NO: 570072 - RNA, 64 nt, Homo Sapiens; identical to SEQ ID NO: 23385

SEQ ID NO: 570073 - RNA, 64 nt, Homo Sapiens; identical to SEQ ID NO: 23386

SEQ ID NO: 570074 - RNA, 64 nt, Homo Sapiens; identical to SEQ ID NO: 23387

SEQ ID NO: 570075 - RNA, 64 nt, Homo Sapiens; identical to SEQ ID NO: 23388

SEQ ID NO: 570076 - RNA, 64 nt, Homo Sapiens; identical to SEQ ID NO: 23389

SEQ ID NO: 570077 - RNA, 64 nt, Homo Sapiens; identical to SEQ ID NO: 23390

SEQ ID NO: 570078 - RNA, 64 nt, Homo Sapiens; identical to SEQ ID NO: 23391

SEQ ID NO: 570079 - RNA, 64 nt, Homo Sapiens; identical to SEQ ID NO: 23392

SEQ ID NO: 570080 - RNA, 64 nt, Homo Sapiens; identical to SEQ ID NO: 23393

SEQ ID NO: 570081 - RNA, 64 nt, Homo Sapiens; identical to SEQ ID NO: 23394

SEQ ID NO: 570082 - RNA, 64 nt, Homo Sapiens; identical to SEQ ID NO: 23395

SEQ ID NO: 570083 - RNA, 64 nt, Homo Sapiens; identical to SEQ ID NO: 23396

SEQ ID NO: 570084 - RNA, 64 nt, Homo Sapiens; identical to SEQ ID NO: 23397

SEQ ID NO: 570085 - RNA, 64 nt, Homo Sapiens; identical to SEQ ID NO: 23398

SEQ ID NO: 570086 - RNA, 64 nt, Homo Sapiens; identical to SEQ ID NO: 23399

SEQ ID NO: 570087 - RNA, 64 nt, Homo Sapiens; identical to SEQ ID NO: 23400

SEQ ID NO: 570088 - RNA, 64 nt, Homo Sapiens; identical to SEQ ID NO: 23401

SEQ ID NO: 570089 - RNA, 64 nt, Homo Sapiens; identical to SEQ ID NO: 23402

SEQ ID NO: 570090 - RNA, 64 nt, Homo Sapiens; identical to SEQ ID NO: 23403

SEQ ID NO: 570091 - RNA, 64 nt, Homo Sapiens; identical to SEQ ID NO: 23404

SEQ ID NO: 570092 - RNA, 64 nt, Homo Sapiens; identical to SEQ ID NO: 23405

SEQ ID NO: 570093 - RNA, 64 nt, Homo Sapiens; identical to SEQ ID NO: 23406

SEQ ID NO: 570094 - RNA, 64 nt, Homo Sapiens; identical to SEQ ID NO: 23407

SEQ ID NO: 570095 - RNA, 64 nt, Homo Sapiens; identical to SEQ ID NO: 23408

SEQ ID NO: 570096 - RNA, 64 nt, Homo Sapiens; identical to SEQ ID NO: 23409

SEQ ID NO: 570097 - RNA, 64 nt, Homo Sapiens; identical to SEQ ID NO: 23410

SEQ ID NO: 570098 - RNA, 64 nt, Homo Sapiens; identical to SEQ ID NO: 23411

SEQ ID NO: 570099 - RNA, 64 nt, Homo Sapiens; identical to SEQ ID NO: 23412

SEQ ID NO: 570100 - RNA, 64 nt, Homo Sapiens; identical to SEQ ID NO: 23413

SEQ ID NO: 570101 - RNA, 64 nt, Homo Sapiens; identical to SEQ ID NO: 23414

SEQ ID NO: 570102 - RNA, 64 nt, Homo Sapiens; identical to SEQ ID NO: 23415

SEQ ID NO: 570103 - RNA, 64 nt, Homo Sapiens; identical to SEQ ID NO: 23416

SEQ ID NO: 570104 - RNA, 64 nt, Homo Sapiens; identical to SEQ ID NO: 23417

SEQ ID NO: 570105 - RNA, 64 nt, Homo Sapiens; identical to SEQ ID NO: 23418

SEQ ID NO: 570106 - RNA, 64 nt, Homo Sapiens; identical to SEQ ID NO: 23419

SEQ ID NO: 570107 - RNA, 64 nt, Homo Sapiens; identical to SEQ ID NO: 23420

SEQ ID NO: 570108 - RNA, 64 nt, Homo Sapiens; identical to SEQ ID NO: 23421

SEQ ID NO: 570109 - RNA, 64 nt, Homo Sapiens; identical to SEQ ID NO: 23422

SEQ ID NO: 570110 - RNA, 64 nt, Homo Sapiens; identical to SEQ ID NO: 23423

SEQ ID NO: 570111 - RNA, 64 nt, Homo Sapiens; identical to SEQ ID NO: 23424

SEQ ID NO: 570112 - RNA, 64 nt, Homo Sapiens; identical to SEQ ID NO: 23425

SEQ ID NO: 570113 - RNA, 64 nt, Homo Sapiens; identical to SEQ ID NO: 23426

SEQ ID NO: 570114 - RNA, 64 nt, Homo Sapiens; identical to SEQ ID NO: 23427

SEQ ID NO: 570115 - RNA, 64 nt, Homo Sapiens; identical to SEQ ID NO: 23428

SEQ ID NO: 570116 - RNA, 64 nt, Homo Sapiens; identical to SEQ ID NO: 23429

SEQ ID NO: 570117 - RNA, 64 nt, Homo Sapiens; identical to SEQ ID NO: 23430

SEQ ID NO: 570118 - RNA, 64 nt, Homo Sapiens; identical to SEQ ID NO: 23431

SEQ ID NO: 570119 - RNA, 64 nt, Homo Sapiens; identical to SEQ ID NO: 23432

SEQ ID NO: 570120 - RNA, 64 nt, Homo Sapiens; identical to SEQ ID NO: 23433

SEQ ID NO: 570121 - RNA, 64 nt, Homo Sapiens; identical to SEQ ID NO: 23434

SEQ ID NO: 570122 - RNA, 64 nt, Homo Sapiens; identical to SEQ ID NO: 23435

SEQ ID NO: 570123 - RNA, 64 nt, Homo Sapiens; identical to SEQ ID NO: 23436

SEQ ID NO: 570124 - RNA, 64 nt, Homo Sapiens; identical to SEQ ID NO: 23437

SEQ ID NO: 570125 - RNA, 64 nt, Homo Sapiens; identical to SEQ ID NO: 23438

SEQ ID NO: 570126 - RNA, 64 nt, Homo Sapiens; identical to SEQ ID NO: 23439

SEQ ID NO: 570127 - RNA, 64 nt, Homo Sapiens; identical to SEQ ID NO: 23440

SEQ ID NO: 570128 - RNA, 64 nt, Homo Sapiens; identical to SEQ ID NO: 23441

SEQ ID NO: 570129 - RNA, 64 nt, Homo Sapiens; identical to SEQ ID NO: 23442

SEQ ID NO: 570130 - RNA, 64 nt, Homo Sapiens; identical to SEQ ID NO: 23443

SEQ ID NO: 570131 - RNA, 64 nt, Homo Sapiens; identical to SEQ ID NO: 23444

SEQ ID NO: 570132 - RNA, 64 nt, Homo Sapiens; identical to SEQ ID NO: 23445

SEQ ID NO: 570133 - RNA, 64 nt, Homo Sapiens; identical to SEQ ID NO: 23446

SEQ ID NO: 570134 - RNA, 64 nt, Homo Sapiens; identical to SEQ ID NO: 23447

SEQ ID NO: 570135 - RNA, 64 nt, Homo Sapiens; identical to SEQ ID NO: 23448

SEQ ID NO: 570136 - RNA, 64 nt, Homo Sapiens; identical to SEQ ID NO: 23449

SEQ ID NO: 570137 - RNA, 64 nt, Homo Sapiens; identical to SEQ ID NO: 23450

SEQ ID NO: 570138 - RNA, 64 nt, Homo Sapiens; identical to SEQ ID NO: 23451

SEQ ID NO: 570139 - RNA, 64 nt, Homo Sapiens; identical to SEQ ID NO: 23452

SEQ ID NO: 570140 - RNA, 64 nt, Homo Sapiens
cugugaauguuccaacaccugccuccacuucuccccucaagaaauuuucaacgccaggaaucau

SEQ ID NO: 570141 - RNA, 64 nt, Homo Sapiens
caugaagagacuucugcuuuucaacccccacccuccucaagaaguaauaauuuguuuacuugua

SEQ ID NO: 570142 - RNA, 64 nt, Homo Sapiens
guccuuggcuuaaagcuguaccucauucuaaguuccucaagagacuucucuuuuguuagggagg

SEQ ID NO: 570143 - RNA, 64 nt, Homo Sapiens
ugccuguggaccgaggcccccuggucaacaaggaccucaagaacugucagccccaguuggcuuc

SEQ ID NO: 570144 - RNA, 64 nt, Homo Sapiens
aauuugggugagcugcaccugauuaguugaaaggccucaagaacaaacacugcaguuuccugga

SEQ ID NO: 570145 - RNA, 64 nt, Homo Sapiens
aacacugcaguuuccuggaaaagaagaaacuuugccucaagacuauagccaucgacuccugccu

SEQ ID NO: 570146 - RNA, 64 nt, Homo Sapiens
gaugcuuuuugggaaacguucucaccuucuuucuccucaagaaacagguugaguccagaugcuu

SEQ ID NO: 570147 - RNA, 64 nt, Homo Sapiens
agcccacgcccuugucagcugggcacaucacccaccucaagacaaggacugcuggcuguaacca

SEQ ID NO: 570148 - RNA, 64 nt, Homo Sapiens
uccacuaagaaggccugucuacacugcaggggaaccucaagaacuuuucauugcacuucuaaaa

SEQ ID NO: 570149 - RNA, 64 nt, Homo Sapiens
ucaaaaggaagagccuuuuaaaaacauuugccaaccucaagaauaaauacugaaagucuugaaa

SEQ ID NO: 570150 - RNA, 64 nt, Homo Sapiens
cccccagugccuuguaugaaccuacccucugcacccucaagaaauacaggaccccccaagucuu

SEQ ID NO: 570151 - RNA, 64 nt, Homo Sapiens
aaacccaccauaaccagccccccuuguucuuaucccucaagaagacuuccuucauuaacaaaga

SEQ ID NO: 570152 - RNA, 64 nt, Homo Sapiens
caaaacacuugccugaauacauaucacguauuuuagacucgaagccucaaagcacuggauugug

SEQ ID NO: 570153 - RNA, 64 nt, Homo Sapiens
aauaggcauagcuacguggcacuauauucuggccagacucgauguguacucuaacuuaagaaau

SEQ ID NO: 570154 - RNA, 64 nt, Homo Sapiens
gagggugccacagggaaagcuguagaaggcaagaagacucgagaaucccccagaguuauuuuuc

SEQ ID NO: 570155 - RNA, 64 nt, Homo Sapiens
cugagcguggaucugaacacucgguuggaacaugagacucgaggacagucacugagccagacgg

SEQ ID NO: 570156 - RNA, 64 nt, Homo Sapiens
guuuugguuuccaccuauuuaaagucagauuuauagacucgaggagacagaaacugaaucccac

SEQ ID NO: 570157 - RNA, 64 nt, Homo Sapiens
ugucucagaugaggagggagagaaggaggccgccagacucgagaggugggaggaacuccuugca

SEQ ID NO: 570158 - RNA, 64 nt, Homo Sapiens
accaaccagggaagcuguccugccuucugcugaaagacucgagaacaacccuucucuguugguc

SEQ ID NO: 570159 - RNA, 64 nt, Homo Sapiens
ccagcccccaggaagccugcaucugaggcagagaagacucgaguucaaagucagggcccacccc

SEQ ID NO: 570160 - RNA, 64 nt, Homo Sapiens
caaguguuucuguucugggauaguucuuaggaacagacucgaugcaucgcuucuuuuucaaaac

SEQ ID NO: 570161 - RNA, 64 nt, Homo Sapiens
cuauccccucccuugcuccugaggccaaagccagagacucgaacagccuccccaccaccaccag

SEQ ID NO: 570162 - RNA, 64 nt, Homo Sapiens
cauauugccacugugcuaucugaugcauauuuuaagacucgauuggggcaaguguuuucugaaa

SEQ ID NO: 570163 - RNA, 64 nt, Homo Sapiens
aaauaggcuccaggccuaggcagauguucauauuagacucgaaagccuagcaccucuugaaauc

SEQ ID NO: 570164 - RNA, 64 nt, Homo Sapiens
auuucuaaagaauauuugcuucccuuagaacuacagacucgaaaucuuuaaagauggugccuaa

SEQ ID NO: 570165 - RNA, 64 nt, Homo Sapiens
ucugucaggccuucaggguucagcaguacagccgagacucgacucugugccucccuccccagug

SEQ ID NO: 570166 - RNA, 64 nt, Homo Sapiens
gcaagacuuagaaugaaaaauccuggucaucaaaagacucgacaccccaucuucaaguuucaca

SEQ ID NO: 570167 - RNA, 64 nt, Homo Sapiens
aaaaucugcugcaccuuguagaaaagaaguugcaagacucgaauucuaaugaagagaaaaaaag

SEQ ID NO: 570168 - RNA, 64 nt, Homo Sapiens
uuugauaaaaguaccuuuucauuuguauguucuuagacucgaagguagacaugauaaaagaaac

SEQ ID NO: 570169 - RNA, 64 nt, Homo Sapiens
acagcacccagacuucaugcaucaaaauauucagagacucgagcgaauuuucuugucgcuuccu

SEQ ID NO: 570170 - RNA, 64 nt, Homo Sapiens
gggggaggggguaaggagcgcuauacccccucgaagacucgagauguuucccccacgucucccu

SEQ ID NO: 570171 - RNA, 64 nt, Homo Sapiens
aaacaucacauacauucuuggaucaauacucugcagacucgaaagcauggugcuuuucugagca

SEQ ID NO: 570172 - RNA, 50 nt, Homo Sapiens
gauccugugcuuuacucugaagacucgagagaaguuugcugaggaaugcc

SEQ ID NO: 570173 - RNA, 64 nt, Homo Sapiens
cugugaugugugguccccauauguggcucagcaaagacucgagagaucaucccuuugucugcau

SEQ ID NO: 570174 - RNA, 64 nt, Homo Sapiens
gcagcgccucccgccgccucgggccgccuccuccagacucgagagggcugagccccuccucucc

SEQ ID NO: 570175 - RNA, 64 nt, Homo Sapiens
auacugcaugugacuuuccuaagcggcagcugaaagacucgagcccgugcugucuccuuugguu

SEQ ID NO: 570176 - RNA, 64 nt, Homo Sapiens
auacucguguauuuuaagauaugaaugugacucaagacucgaggccgauacgaggcugugauuc

SEQ ID NO: 570177 - RNA, 64 nt, Homo Sapiens
ggaucaccugcagauuuaaagccuacucugccacagacucgaguaagaaaauguucucuugaug

SEQ ID NO: 570178 - RNA, 64 nt, Homo Sapiens
uuuccuaacaguuauuuccccggguccagcuuaaagacucgauggaaggagguagaaccucugc

SEQ ID NO: 570179 - RNA, 64 nt, Homo Sapiens
cgccugugcagcccucccagguggaguacacggcagacucgaccguggcagccauguauuacag

SEQ ID NO: 570180 - RNA, 64 nt, Homo Sapiens
gugguggugaacagaacaaagcuucaaccccaugagacucgauaauauaagccaaaaaaugcuu

SEQ ID NO: 570181 - RNA, 64 nt, Homo Sapiens
uguuagggcugaggaaccaauucaaaaacaagacagacucgaguuucaaaucuagaagaugcag

SEQ ID NO: 570182 - RNA, 64 nt, Homo Sapiens
gccuggaaacgagagucuuaauugaggagaugggagacucgaacucuagcccuggaucugccuu

SEQ ID NO: 570183 - RNA, 64 nt, Homo Sapiens
uauuuaacuauguguggaacaacccaguaauaucagacucgaauuacuauuucauucuauuuca

SEQ ID NO: 570184 - RNA, 64 nt, Homo Sapiens
cuuugggaaacucauuauauucaucuuugaauauagacucgaguaguaauggauuuuuuuuuac

SEQ ID NO: 570185 - RNA, 64 nt, Homo Sapiens
ucugcuuuguuugcauacuggucuucagauuaugagacucgaugauaacaguaugguacugcuu

SEQ ID NO: 570186 - RNA, 64 nt, Homo Sapiens
ucucacugcaccagugucuucccgggguuuuugcagacucgaaguggcccugccuccuguccuc

SEQ ID NO: 570187 - RNA, 64 nt, Homo Sapiens
ucauuuucucagucauuuccagguuguauuucaaagacucgaauaagacagugauuuuugugua

SEQ ID NO: 570188 - RNA, 64 nt, Homo Sapiens
augaacucuuugaugaggauuuguaaacgaaaacagacucgaacuauuguguaccaccacauag

SEQ ID NO: 570189 - RNA, 64 nt, Homo Sapiens
uuaguaaauccuuaaaggcuguccccuugcacuuagacucgaagucugacaggcuuaagcuuuc

SEQ ID NO: 570190 - RNA, 64 nt, Homo Sapiens
cagggccugggccagccuuacaggucaguagacuagacucgacuacuuggggucagugauucuu

SEQ ID NO: 570191 - RNA, 64 nt, Homo Sapiens
gaagccagcuuccaagaacuaaacccagcacuccagacucgagggacugcaauagaaaacuccc

SEQ ID NO: 570192 - RNA, 64 nt, Homo Sapiens
uuccagacagggacccaggguucccaguuaccaaagacucgaacuugcuuuucuccuccucccc

SEQ ID NO: 570193 - RNA, 64 nt, Homo Sapiens
uuccaucauagcguagguguggagucgggagucgagacucgagaaagugugcauagaucugaga

SEQ ID NO: 570194 - RNA, 64 nt, Homo Sapiens
uucucucucuuagcuccacgucagcacugagaccagacucgagcaccccuguccuguaagcgag

SEQ ID NO: 570195 - RNA, 64 nt, Homo Sapiens
agagccgccccguguccccccaggugcuggaggcagacucgagggccgaauuguuucuaguuag

SEQ ID NO: 570196 - RNA, 64 nt, Homo Sapiens
acuuuuuuuuguauguuuuuuuucugcuggaaacagacucgauucauauugaauauaauauauu

SEQ ID NO: 570197 - RNA, 64 nt, Homo Sapiens
cgcagagcuggccgcgccaaauaaugucucugugagacucgagaacuuucauuuuuuuccaggc

SEQ ID NO: 570198 - RNA, 64 nt, Homo Sapiens
gugcuggcauuucucacccuacaccuuuuccacgagacucgagucauuuauaacggaaucaggc

SEQ ID NO: 570199 - RNA, 64 nt, Homo Sapiens
agagccggagagagagacgacagcgccgccuccuagacucgagcaaggcgagaguagcgcacgc

SEQ ID NO: 570200 - RNA, 64 nt, Homo Sapiens
cuggucacugcaggucccagugcuuugagccuccagacucgaggagccccuaguccccucugug

SEQ ID NO: 570201 - RNA, 64 nt, Homo Sapiens
guucaugcagucaguguuauacaaugaguuauggagacucgaggaggacauuuggggacugugu

SEQ ID NO: 570202 - RNA, 64 nt, Homo Sapiens
auuuuuaucacucuaaucaguaaggcuacuaucuagacucgaaugcuuucauacaagugauuuu

SEQ ID NO: 570203 - RNA, 64 nt, Homo Sapiens
cagugguaacacugcacaguccugugcccuguccagacucgaggaauaagacuugucucgguca

SEQ ID NO: 570204 - RNA, 64 nt, Homo Sapiens
acagccccuggcacugcagguggccucccuccagagacucgaguccccaugauucccuccucgu

SEQ ID NO: 570205 - RNA, 64 nt, Homo Sapiens
guaaaggcaaggaggggggcuuuuagguuaaguaagacucgagaccaaguugacccaguuuguc

SEQ ID NO: 570206 - RNA, 64 nt, Homo Sapiens
cacaucguguuucuuccagaaauucagacgcaacagagguuaggccaguuugguggguuccagu

SEQ ID NO: 570207 - RNA, 64 nt, Homo Sapiens
guugaggcuucacgcucagggaaacuucugggucagagguuaauaaccacgcuccuuggagcaa

SEQ ID NO: 570208 - RNA, 64 nt, Homo Sapiens
guggguccaggaaggcagcuggaguugagucacaagagguuaaguucccugcacccuggaaagg

SEQ ID NO: 570209 - RNA, 64 nt, Homo Sapiens
ugccuggccuggcuccccacccucguccugucccagagguuaucgccagcugccuuccucaucc

SEQ ID NO: 570210 - RNA, 64 nt, Homo Sapiens
uacaauuuaaauugggcuaauuaaaaauaaaaccagagguuauaauuuaaauuuaugccacaau

SEQ ID NO: 570211 - RNA, 64 nt, Homo Sapiens
uacaacuacaaggaaaaaaaugauaaauggaaccagagguuauacuuucuagcccauccaaauu

SEQ ID NO: 570212 - RNA, 64 nt, Homo Sapiens
uucaauaugaucacuuuuuccuucuuugccugggagagguuaagaggagguuucgaagguauag

SEQ ID NO: 570213 - RNA, 64 nt, Homo Sapiens
uuuuuuaaauuuuuucagugagcguggugacugcagagguuagugcugugaaaagcugggcuaa

SEQ ID NO: 570214 - RNA, 64 nt, Homo Sapiens
cuagacugggccugcucauuaguugguuaaauaaagagguuagugucuggaaccaagacuauuc

SEQ ID NO: 570215 - RNA, 64 nt, Homo Sapiens
gugugagacuuguaguauucgccugauuucuagaagagguuauauuuauguauuugcuaguuca

SEQ ID NO: 570216 - RNA, 64 nt, Homo Sapiens
gugcaauaagaauuuagggaagauuugaugcuggagagguuaagaagagagguuauagaguaga

SEQ ID NO: 570217 - RNA, 64 nt, Homo Sapiens
gaguagaagauuugaugcugggagguguuuaaagagagguuauagaaggaaauugagauuagag

SEQ ID NO: 570218 - RNA, 64 nt, Homo Sapiens; identical to SEQ ID NO: 71859

SEQ ID NO: 570219 - RNA, 64 nt, Homo Sapiens; identical to SEQ ID NO: 71860

SEQ ID NO: 570220 - RNA, 64 nt, Homo Sapiens; identical to SEQ ID NO: 71861

SEQ ID NO: 570221 - RNA, 64 nt, Homo Sapiens; identical to SEQ ID NO: 71862

SEQ ID NO: 570222 - RNA, 64 nt, Homo Sapiens; identical to SEQ ID NO: 71863

SEQ ID NO: 570223 - RNA, 64 nt, Homo Sapiens; identical to SEQ ID NO: 71864

SEQ ID NO: 570224 - RNA, 64 nt, Homo Sapiens; identical to SEQ ID NO: 71865

SEQ ID NO: 570225 - RNA, 64 nt, Homo Sapiens; identical to SEQ ID NO: 71866

SEQ ID NO: 570226 - RNA, 64 nt, Homo Sapiens; identical to SEQ ID NO: 71867

SEQ ID NO: 570227 - RNA, 64 nt, Homo Sapiens; identical to SEQ ID NO: 71868

SEQ ID NO: 570228 - RNA, 64 nt, Homo Sapiens; identical to SEQ ID NO: 71869

SEQ ID NO: 570229 - RNA, 64 nt, Homo Sapiens; identical to SEQ ID NO: 71870

SEQ ID NO: 570230 - RNA, 64 nt, Homo Sapiens; identical to SEQ ID NO: 71871

SEQ ID NO: 570231 - RNA, 64 nt, Homo Sapiens; identical to SEQ ID NO: 71872

SEQ ID NO: 570232 - RNA, 64 nt, Homo Sapiens; identical to SEQ ID NO: 71873

SEQ ID NO: 570233 - RNA, 64 nt, Homo Sapiens; identical to SEQ ID NO: 71874

SEQ ID NO: 570234 - RNA, 64 nt, Homo Sapiens; identical to SEQ ID NO: 71875

SEQ ID NO: 570235 - RNA, 64 nt, Homo Sapiens; identical to SEQ ID NO: 71876

SEQ ID NO: 570236 - RNA, 64 nt, Homo Sapiens; identical to SEQ ID NO: 71877

SEQ ID NO: 570237 - RNA, 64 nt, Homo Sapiens; identical to SEQ ID NO: 71878

SEQ ID NO: 570238 - RNA, 64 nt, Homo Sapiens; identical to SEQ ID NO: 71879

SEQ ID NO: 570239 - RNA, 64 nt, Homo Sapiens
gcucagauugucgaguuaguuuuaacaccugggaaaacaggacacauuucccaguuaaaugaua

SEQ ID NO: 570240 - RNA, 64 nt, Homo Sapiens
auaaaagagaaauuuagaaaucuuuacuguaugaaaacaggaaagaaugugcugcguuuuguuu

SEQ ID NO: 570241 - RNA, 64 nt, Homo Sapiens
ugcauguuugaucuguugucucaaaccaaacaggaaacaggaaaucaccugagaggcagacaga

SEQ ID NO: 570242 - RNA, 64 nt, Homo Sapiens
caggaaaugcauguuugaucagacagaucaaaccaaacaggaaauuauaagucaccugagaggc

SEQ ID NO: 570243 - RNA, 64 nt, Homo Sapiens
uauggcaacggaacauccucaagcagagguaguaaaacaggaaagcagcauguccgaaaguaaa

SEQ ID NO: 570244 - RNA, 64 nt, Homo Sapiens
cauguccgaaaguaaaguguugggugaaguggggaaacaggacagcagcucugcuagcuuggcu

SEQ ID NO: 570245 - RNA, 64 nt, Homo Sapiens
gacugaauuaauaauucucuuguuucuuccaaggaaacaggagaaaguucuucucauuucauua

SEQ ID NO: 570246 - RNA, 64 nt, Homo Sapiens
guugagcacuuccagucaguggacucagaccuuuaaacaggagauaagaggucauuucuggaau

SEQ ID NO: 570247 - RNA, 64 nt, Homo Sapiens
uagguguuugggguacacugcaaaaggaaaaagaaaacaggaccaacagagcaagauccugucu

SEQ ID NO: 570248 - RNA, 64 nt, Homo Sapiens
caggcugggcacagcagcucagcucucucuuugaaaacaggaccacaggaaagauuuguaagug

SEQ ID NO: 570249 - RNA, 64 nt, Homo Sapiens
caucuguuuuuugucccucaccaggacggcccugaaacaggacacugcgcagggccagccgcua

SEQ ID NO: 570250 - RNA, 64 nt, Homo Sapiens
ggaaaagcuaccaguuuuuuacuguuuuauagcaaaacaggaaaauuaaccguucuagaaagcc

SEQ ID NO: 570251 - RNA, 64 nt, Homo Sapiens
uauuuauauacccuggggacagaaagucagguugaaacaggaaaaccaccagacucuaaucuca

SEQ ID NO: 570252 - RNA, 64 nt, Homo Sapiens
aaguucaacccgugugugaaagcaaaacaauggaaaacaggauuggcuucuucaaaggcuccuc

SEQ ID NO: 570253 - RNA, 64 nt, Homo Sapiens
cucuucuguucugcaaguuucuggugggaacacgaaacaggagugaacacgaauuuccauuuac

SEQ ID NO: 570254 - RNA, 64 nt, Homo Sapiens
guccuggcacuacccagauuucauucuggucaccaaacaggaggucaggggguagcugauccug

SEQ ID NO: 570255 - RNA, 64 nt, Homo Sapiens
gaagcccuuuuuaccuagaaagaguagaacuuugaaacaggacuuaccuagcaguugugcccuc

SEQ ID NO: 570256 - RNA, 64 nt, Homo Sapiens
auaaagucaagugaggaauaaaucauagugacccaaacaggauuagguaauuuccauagcaacu

SEQ ID NO: 570257 - RNA, 64 nt, Homo Sapiens
gcaaagcaguuagaguucagucguuccuuuuuugaaacaggagacuuccuuucuuuuuuuucuu

SEQ ID NO: 570258 - RNA, 64 nt, Homo Sapiens
gaaauccauguucuccaucugucaccaaggaaauaaacaggaagauguuugcuuguaugaccaa

SEQ ID NO: 570259 - RNA, 64 nt, Homo Sapiens
uggacauucuaagggaggaguugccauggucaccaaacaggaaggcacugccauugucuuuugg

SEQ ID NO: 570260 - RNA, 64 nt, Homo Sapiens
agagcagccuggggccaagcaacucuggccacccaaacaggacaauggggaucuucagggaagg

SEQ ID NO: 570261 - RNA, 64 nt, Homo Sapiens
cugagguaagagaauaacuggcuaagaagaacauaaacaggaugggaaaaagcccgagucugau

SEQ ID NO: 570262 - RNA, 64 nt, Homo Sapiens
aagcccgagucugaugcuaaacgaaguagguaauaaacaggaaacacauggaucuuucaggaaa

SEQ ID NO: 570263 - RNA, 64 nt, Homo Sapiens
cagcaucgcuuucaauaggccaggacacuuuugaaaacaggacucuucaccaagaaaacccaaa

SEQ ID NO: 570264 - RNA, 64 nt, Homo Sapiens
cuuuugaaaacaggacucagcaccaagaaaacccaaacaggacaucacuugaaauucugcucuu

SEQ ID NO: 570265 - RNA, 64 nt, Homo Sapiens
uccaaggccacuacauugaguugucuuuauuaacaaacaggauacauggugggagcugguugaa

SEQ ID NO: 570266 - RNA, 64 nt, Homo Sapiens
ccccuuugcaggacuugcacuucauuucauagccaaacaggagauugugagcuaucuaucuaua

SEQ ID NO: 570267 - RNA, 64 nt, Homo Sapiens
gagacuucauuguaugacuuauucauuguauaauaaacaggaguuagaaguaauuguuuuauca

SEQ ID NO: 570268 - RNA, 64 nt, Homo Sapiens
guaguuggcaagaugaaaugugacaacauugcuuaaacaggauaaaucagaaauuccuuuuagc

SEQ ID NO: 570269 - RNA, 64 nt, Homo Sapiens
ucugugaccgcccuacccccccccugcccaaacaaaacaggacauuaaaacaggagccuagagc

SEQ ID NO: 570270 - RNA, 64 nt, Homo Sapiens
cuagagcccccugcccaaacuuucccagcacuuaaaacaggagcauaauugggacccagagccc

SEQ ID NO: 570271 - RNA, 64 nt, Homo Sapiens
ucagcacugucuccaugcagcaguugcugggucccauguccagcugccucuuuggcuucauggg

SEQ ID NO: 570272 - RNA, 64 nt, Homo Sapiens
aauuguuuucagggccuuguccagcugagagcuucauguccaccagauucugagaggugucagc

SEQ ID NO: 570273 - RNA, 64 nt, Homo Sapiens
auccugcuuaagguuuuaggauucuguaggcuuccauguccagaugacauauuuauuuuugucu

SEQ ID NO: 570274 - RNA, 64 nt, Homo Sapiens
gguguggggagccugccuccggggucccaaauuccauguccagaccaggcagacgggcugaagu

SEQ ID NO: 570275 - RNA, 64 nt, Homo Sapiens
guuauggcaugugcagaaaaccgacaaacggucacauguccaucauugagagaacuguguuuuu

SEQ ID NO: 570276 - RNA, 64 nt, Homo Sapiens
ugaacaugcagaggguuaauauacugaguaccagcauguccauuucuugucugugcuaauauaa

SEQ ID NO: 570277 - RNA, 64 nt, Homo Sapiens
uauuggcaaguaugcagagccgugaacgucauggcauguccaaggaauuaaaugggaguucauu

SEQ ID NO: 570278 - RNA, 64 nt, Homo Sapiens
aaugaauauauugccuguuuugugaauacugacacauguccauaccuaaaacacuccugaguca

SEQ ID NO: 570279 - RNA, 64 nt, Homo Sapiens
ucuaagugcaaccgccuagacuuucuuucagauacauguccacauguccauuuuucagguucuc

SEQ ID NO: 570280 - RNA, 64 nt, Homo Sapiens
caaccgccuagacuuucuuucagauacauguccacauguccauuuuucagguucucuaaguugg

SEQ ID NO: 570281 - RNA, 64 nt, Homo Sapiens; identical to SEQ ID NO: 193284

SEQ ID NO: 570282 - RNA, 64 nt, Homo Sapiens; identical to SEQ ID NO: 193285

SEQ ID NO: 570283 - RNA, 64 nt, Homo Sapiens; identical to SEQ ID NO: 193286

SEQ ID NO: 570284 - RNA, 64 nt, Homo Sapiens; identical to SEQ ID NO: 193287

SEQ ID NO: 570285 - RNA, 64 nt, Homo Sapiens; identical to SEQ ID NO: 193288

SEQ ID NO: 570286 - RNA, 64 nt, Homo Sapiens; identical to SEQ ID NO: 193289

SEQ ID NO: 570287 - RNA, 64 nt, Homo Sapiens; identical to SEQ ID NO: 193290

SEQ ID NO: 570288 - RNA, 64 nt, Homo Sapiens; identical to SEQ ID NO: 193291

SEQ ID NO: 570289 - RNA, 64 nt, Homo Sapiens; identical to SEQ ID NO: 193292

SEQ ID NO: 570290 - RNA, 64 nt, Homo Sapiens; identical to SEQ ID NO: 193293

SEQ ID NO: 570291 - RNA, 64 nt, Homo Sapiens; identical to SEQ ID NO: 193294

SEQ ID NO: 570292 - RNA, 64 nt, Homo Sapiens; identical to SEQ ID NO: 193295

SEQ ID NO: 570293 - RNA, 64 nt, Homo Sapiens; identical to SEQ ID NO: 193296

SEQ ID NO: 570294 - RNA, 64 nt, Homo Sapiens; identical to SEQ ID NO: 193297

SEQ ID NO: 570295 - RNA, 64 nt, Homo Sapiens; identical to SEQ ID NO: 193298

SEQ ID NO: 570296 - RNA, 64 nt, Homo Sapiens; identical to SEQ ID NO: 193299

SEQ ID NO: 570297 - RNA, 64 nt, Homo Sapiens; identical to SEQ ID NO: 193300

SEQ ID NO: 570298 - RNA, 64 nt, Homo Sapiens; identical to SEQ ID NO: 193301

SEQ ID NO: 570299 - RNA, 64 nt, Homo Sapiens; identical to SEQ ID NO: 193302

SEQ ID NO: 570300 - RNA, 64 nt, Homo Sapiens; identical to SEQ ID NO: 193303

SEQ ID NO: 570301 - RNA, 64 nt, Homo Sapiens; identical to SEQ ID NO: 193304

SEQ ID NO: 570302 - RNA, 64 nt, Homo Sapiens; identical to SEQ ID NO: 193305

SEQ ID NO: 570303 - RNA, 64 nt, Homo Sapiens; identical to SEQ ID NO: 193306

SEQ ID NO: 570304 - RNA, 64 nt, Homo Sapiens; identical to SEQ ID NO: 193307

SEQ ID NO: 570305 - RNA, 64 nt, Homo Sapiens; identical to SEQ ID NO: 193308

SEQ ID NO: 570306 - RNA, 64 nt, Homo Sapiens; identical to SEQ ID NO: 193309

SEQ ID NO: 570307 - RNA, 64 nt, Homo Sapiens; identical to SEQ ID NO: 193310

SEQ ID NO: 570308 - RNA, 64 nt, Homo Sapiens; identical to SEQ ID NO: 193311

SEQ ID NO: 570309 - RNA, 64 nt, Homo Sapiens; identical to SEQ ID NO: 193312

SEQ ID NO: 570310 - RNA, 64 nt, Homo Sapiens; identical to SEQ ID NO: 193313

SEQ ID NO: 570311 - RNA, 64 nt, Homo Sapiens
cugaaagggcucuaaagaaggaacuaccaaaaccugacuugaaaugccauuucuuuuaaccuuc

SEQ ID NO: 570312 - RNA, 64 nt, Homo Sapiens
uauuuacauuagaguauaccuuuuaguaauaaaaugacuugaaaucauauuauuuuuaaaagcc

SEQ ID NO: 570313 - RNA, 64 nt, Homo Sapiens
auggaagccauugucuaaucaacucuaucauuagugacuugaugucucauaccuuaauuuugua

SEQ ID NO: 570314 - RNA, 64 nt, Homo Sapiens
uuaauguuuugcuuugcauuuuagguucagauuaugacuugauugaaauaaaugugccuauaca

SEQ ID NO: 570315 - RNA, 56 nt, Homo Sapiens
uuaagaagaaaucuaagugaacuggcugacuugauggaaucauguucaaguggcau

SEQ ID NO: 570316 - RNA, 64 nt, Homo Sapiens
aauggguuuuuaaguagaaccuaggguuucuaauugacuugauuucuggaaaugaaaacccgcg

SEQ ID NO: 570317 - RNA, 64 nt, Homo Sapiens
ugagacaugguuauagauaagacaauuguagcauugacuugaaguuccuuuucaaaauaaaagu

SEQ ID NO: 570318 - RNA, 64 nt, Homo Sapiens
gagggauaagugugauuuaggaugauccagucacugacuugauuaagcaggugaaaccuuagga

SEQ ID NO: 570319 - RNA, 64 nt, Homo Sapiens
ucgacucauucuccauuuugcuuugguuuugucuugacuugacuugacuuuggggguaaagucu

SEQ ID NO: 570320 - RNA, 64 nt, Homo Sapiens
ucauucuccauuuugcuuugguuuugucuugacuugacuugacuuuggggguaaagucuuucac

SEQ ID NO: 570321 - RNA, 64 nt, Homo Sapiens
uaauuuauugaauuuuacuguuacacauaguuuuugacuugaauuaaaauacuagacaaagcag

SEQ ID NO: 570322 - RNA, 64 nt, Homo Sapiens
gaaauucauagagaagagaauagaguggaugaugugacuugaaguuuuugcagcuuauuuuuuc

SEQ ID NO: 570323 - RNA, 64 nt, Homo Sapiens
agagaauuguaacauagcaugacaaauuuuguguugacuugaaaggaaucacaccauuauuccu

SEQ ID NO: 570324 - RNA, 64 nt, Homo Sapiens
ucuugugugcuagauuaaaagugagacagagacuugacuugauccucugagcucaagcuauuga

SEQ ID NO: 570325 - RNA, 64 nt, Homo Sapiens; identical to SEQ ID NO: 311803

SEQ ID NO: 570326 - RNA, 64 nt, Homo Sapiens; identical to SEQ ID NO: 311804

SEQ ID NO: 570327 - RNA, 64 nt, Homo Sapiens; identical to SEQ ID NO: 311805

SEQ ID NO: 570328 - RNA, 64 nt, Homo Sapiens; identical to SEQ ID NO: 311806

SEQ ID NO: 570329 - RNA, 64 nt, Homo Sapiens; identical to SEQ ID NO: 311807

SEQ ID NO: 570330 - RNA, 64 nt, Homo Sapiens; identical to SEQ ID NO: 311808

SEQ ID NO: 570331 - RNA, 64 nt, Homo Sapiens; identical to SEQ ID NO: 311809

SEQ ID NO: 570332 - RNA, 64 nt, Homo Sapiens; identical to SEQ ID NO: 311810

SEQ ID NO: 570333 - RNA, 64 nt, Homo Sapiens; identical to SEQ ID NO: 311811

SEQ ID NO: 570334 - RNA, 64 nt, Homo Sapiens; identical to SEQ ID NO: 311812

SEQ ID NO: 570335 - RNA, 64 nt, Homo Sapiens; identical to SEQ ID NO: 311813

SEQ ID NO: 570336 - RNA, 64 nt, Homo Sapiens; identical to SEQ ID NO: 311814

SEQ ID NO: 570337 - RNA, 64 nt, Homo Sapiens; identical to SEQ ID NO: 311815

SEQ ID NO: 570338 - RNA, 64 nt, Homo Sapiens; identical to SEQ ID NO: 311816

SEQ ID NO: 570339 - RNA, 64 nt, Homo Sapiens; identical to SEQ ID NO: 311817

SEQ ID NO: 570340 - RNA, 64 nt, Homo Sapiens; identical to SEQ ID NO: 311818

SEQ ID NO: 570341 - RNA, 64 nt, Homo Sapiens; identical to SEQ ID NO: 311819

SEQ ID NO: 570342 - RNA, 64 nt, Homo Sapiens; identical to SEQ ID NO: 311820

SEQ ID NO: 570343 - RNA, 64 nt, Homo Sapiens; identical to SEQ ID NO: 311821

SEQ ID NO: 570344 - RNA, 64 nt, Homo Sapiens; identical to SEQ ID NO: 311822

SEQ ID NO: 570345 - RNA, 64 nt, Homo Sapiens; identical to SEQ ID NO: 311823

SEQ ID NO: 570346 - RNA, 64 nt, Homo Sapiens; identical to SEQ ID NO: 311824

SEQ ID NO: 570347 - RNA, 64 nt, Homo Sapiens; identical to SEQ ID NO: 311825

SEQ ID NO: 570348 - RNA, 64 nt, Homo Sapiens; identical to SEQ ID NO: 311824

SEQ ID NO: 570349 - RNA, 64 nt, Homo Sapiens; identical to SEQ ID NO: 311824

SEQ ID NO: 570350 - RNA, 64 nt, Homo Sapiens; identical to SEQ ID NO: 311828

SEQ ID NO: 570351 - RNA, 64 nt, Homo Sapiens; identical to SEQ ID NO: 311829

SEQ ID NO: 570352 - RNA, 64 nt, Homo Sapiens; identical to SEQ ID NO: 311830

SEQ ID NO: 570353 - RNA, 64 nt, Homo Sapiens; identical to SEQ ID NO: 311831

SEQ ID NO: 570354 - RNA, 64 nt, Homo Sapiens; identical to SEQ ID NO: 311832

SEQ ID NO: 570355 - RNA, 64 nt, Homo Sapiens; identical to SEQ ID NO: 311833

SEQ ID NO: 570356 - RNA, 64 nt, Homo Sapiens; identical to SEQ ID NO: 311834

SEQ ID NO: 570357 - RNA, 64 nt, Homo Sapiens; identical to SEQ ID NO: 311835

SEQ ID NO: 570358 - RNA, 64 nt, Homo Sapiens; identical to SEQ ID NO: 311836

SEQ ID NO: 570359 - RNA, 64 nt, Homo Sapiens; identical to SEQ ID NO: 311837

SEQ ID NO: 570360 - RNA, 64 nt, Homo Sapiens; identical to SEQ ID NO: 311838

SEQ ID NO: 570361 - RNA, 64 nt, Homo Sapiens; identical to SEQ ID NO: 311839

SEQ ID NO: 570362 - RNA, 64 nt, Homo Sapiens; identical to SEQ ID NO: 311840

SEQ ID NO: 570363 - RNA, 64 nt, Homo Sapiens; identical to SEQ ID NO: 311841

SEQ ID NO: 570364 - RNA, 64 nt, Homo Sapiens; identical to SEQ ID NO: 311842

SEQ ID NO: 570365 - RNA, 64 nt, Homo Sapiens; identical to SEQ ID NO: 311843

SEQ ID NO: 570366 - RNA, 64 nt, Homo Sapiens; identical to SEQ ID NO: 311844

SEQ ID NO: 570367 - RNA, 64 nt, Homo Sapiens; identical to SEQ ID NO: 311845

SEQ ID NO: 570368 - RNA, 64 nt, Homo Sapiens; identical to SEQ ID NO: 311846

SEQ ID NO: 570369 - RNA, 64 nt, Homo Sapiens; identical to SEQ ID NO: 58312

SEQ ID NO: 570370 - RNA, 64 nt, Homo Sapiens; identical to SEQ ID NO: 58313

SEQ ID NO: 570371 - RNA, 64 nt, Homo Sapiens; identical to SEQ ID NO: 58314

SEQ ID NO: 570372 - RNA, 64 nt, Homo Sapiens; identical to SEQ ID NO: 58315

SEQ ID NO: 570373 - RNA, 64 nt, Homo Sapiens; identical to SEQ ID NO: 58316

SEQ ID NO: 570374 - RNA, 64 nt, Homo Sapiens; identical to SEQ ID NO: 58317

SEQ ID NO: 570375 - RNA, 64 nt, Homo Sapiens; identical to SEQ ID NO: 58318

SEQ ID NO: 570376 - RNA, 64 nt, Homo Sapiens; identical to SEQ ID NO: 58319

SEQ ID NO: 570377 - RNA, 64 nt, Homo Sapiens; identical to SEQ ID NO: 58320

SEQ ID NO: 570378 - RNA, 64 nt, Homo Sapiens; identical to SEQ ID NO: 58321

SEQ ID NO: 570379 - RNA, 64 nt, Homo Sapiens; identical to SEQ ID NO: 58322

SEQ ID NO: 570380 - RNA, 64 nt, Homo Sapiens; identical to SEQ ID NO: 58323

SEQ ID NO: 570381 - RNA, 64 nt, Homo Sapiens; identical to SEQ ID NO: 58324

SEQ ID NO: 570382 - RNA, 64 nt, Homo Sapiens; identical to SEQ ID NO: 58325

SEQ ID NO: 570383 - RNA, 64 nt, Homo Sapiens; identical to SEQ ID NO: 58326

SEQ ID NO: 570384 - RNA, 64 nt, Homo Sapiens; identical to SEQ ID NO: 58327

SEQ ID NO: 570385 - RNA, 64 nt, Homo Sapiens; identical to SEQ ID NO: 58328

SEQ ID NO: 570386 - RNA, 64 nt, Homo Sapiens; identical to SEQ ID NO: 58329

SEQ ID NO: 570387 - RNA, 64 nt, Homo Sapiens; identical to SEQ ID NO: 58330

SEQ ID NO: 570388 - RNA, 64 nt, Homo Sapiens; identical to SEQ ID NO: 58331

SEQ ID NO: 570389 - RNA, 64 nt, Homo Sapiens; identical to SEQ ID NO: 58332

SEQ ID NO: 570390 - RNA, 64 nt, Homo Sapiens; identical to SEQ ID NO: 58333

SEQ ID NO: 570391 - RNA, 64 nt, Homo Sapiens; identical to SEQ ID NO: 58334

SEQ ID NO: 570392 - RNA, 64 nt, Homo Sapiens; identical to SEQ ID NO: 58335

SEQ ID NO: 570393 - RNA, 64 nt, Homo Sapiens; identical to SEQ ID NO: 58336

SEQ ID NO: 570394 - RNA, 64 nt, Homo Sapiens; identical to SEQ ID NO: 58337

SEQ ID NO: 570395 - RNA, 64 nt, Homo Sapiens; identical to SEQ ID NO: 58338

SEQ ID NO: 570396 - RNA, 64 nt, Homo Sapiens; identical to SEQ ID NO: 58339

SEQ ID NO: 570397 - RNA, 64 nt, Homo Sapiens; identical to SEQ ID NO: 58340

SEQ ID NO: 570398 - RNA, 64 nt, Homo Sapiens; identical to SEQ ID NO: 58341

SEQ ID NO: 570399 - RNA, 64 nt, Homo Sapiens; identical to SEQ ID NO: 58342

SEQ ID NO: 570400 - RNA, 64 nt, Homo Sapiens; identical to SEQ ID NO: 58343

SEQ ID NO: 570401 - RNA, 64 nt, Homo Sapiens; identical to SEQ ID NO: 58344

SEQ ID NO: 570402 - RNA, 64 nt, Homo Sapiens; identical to SEQ ID NO: 58345

SEQ ID NO: 570403 - RNA, 64 nt, Homo Sapiens; identical to SEQ ID NO: 58346

SEQ ID NO: 570404 - RNA, 64 nt, Homo Sapiens; identical to SEQ ID NO: 58347

SEQ ID NO: 570405 - RNA, 64 nt, Homo Sapiens; identical to SEQ ID NO: 58348

SEQ ID NO: 570406 - RNA, 64 nt, Homo Sapiens; identical to SEQ ID NO: 58349

SEQ ID NO: 570407 - RNA, 64 nt, Homo Sapiens; identical to SEQ ID NO: 58350

SEQ ID NO: 570408 - RNA, 64 nt, Homo Sapiens; identical to SEQ ID NO: 58351

SEQ ID NO: 570409 - RNA, 64 nt, Homo Sapiens; identical to SEQ ID NO: 58352

SEQ ID NO: 570410 - RNA, 64 nt, Homo Sapiens; identical to SEQ ID NO: 58353

SEQ ID NO: 570411 - RNA, 64 nt, Homo Sapiens; identical to SEQ ID NO: 58354

SEQ ID NO: 570412 - RNA, 64 nt, Homo Sapiens; identical to SEQ ID NO: 58355

SEQ ID NO: 570413 - RNA, 64 nt, Homo Sapiens; identical to SEQ ID NO: 58356

SEQ ID NO: 570414 - RNA, 64 nt, Homo Sapiens; identical to SEQ ID NO: 58357

SEQ ID NO: 570415 - RNA, 64 nt, Homo Sapiens; identical to SEQ ID NO: 58358

SEQ ID NO: 570416 - RNA, 64 nt, Homo Sapiens; identical to SEQ ID NO: 58359

SEQ ID NO: 570417 - RNA, 64 nt, Homo Sapiens; identical to SEQ ID NO: 58360

SEQ ID NO: 570418 - RNA, 64 nt, Homo Sapiens; identical to SEQ ID NO: 58361

SEQ ID NO: 570419 - RNA, 64 nt, Homo Sapiens; identical to SEQ ID NO: 58362

SEQ ID NO: 570420 - RNA, 64 nt, Homo Sapiens; identical to SEQ ID NO: 58363

SEQ ID NO: 570421 - RNA, 64 nt, Homo Sapiens; identical to SEQ ID NO: 58364

SEQ ID NO: 570422 - RNA, 64 nt, Homo Sapiens; identical to SEQ ID NO: 58365

SEQ ID NO: 570423 - RNA, 64 nt, Homo Sapiens; identical to SEQ ID NO: 58366

SEQ ID NO: 570424 - RNA, 64 nt, Homo Sapiens; identical to SEQ ID NO: 58367

SEQ ID NO: 570425 - RNA, 64 nt, Homo Sapiens; identical to SEQ ID NO: 58368

SEQ ID NO: 570426 - RNA, 64 nt, Homo Sapiens; identical to SEQ ID NO: 58369

SEQ ID NO: 570427 - RNA, 64 nt, Homo Sapiens; identical to SEQ ID NO: 58370

SEQ ID NO: 570428 - RNA, 64 nt, Homo Sapiens; identical to SEQ ID NO: 58371

SEQ ID NO: 570429 - RNA, 64 nt, Homo Sapiens; identical to SEQ ID NO: 58372

SEQ ID NO: 570430 - RNA, 64 nt, Homo Sapiens; identical to SEQ ID NO: 58373

SEQ ID NO: 570431 - RNA, 64 nt, Homo Sapiens; identical to SEQ ID NO: 58374

SEQ ID NO: 570432 - RNA, 64 nt, Homo Sapiens; identical to SEQ ID NO: 58375

SEQ ID NO: 570433 - RNA, 64 nt, Homo Sapiens; identical to SEQ ID NO: 58376

SEQ ID NO: 570434 - RNA, 64 nt, Homo Sapiens; identical to SEQ ID NO: 58377

SEQ ID NO: 570435 - RNA, 64 nt, Homo Sapiens; identical to SEQ ID NO: 58378

SEQ ID NO: 570436 - RNA, 64 nt, Homo Sapiens; identical to SEQ ID NO: 58379

SEQ ID NO: 570437 - RNA, 64 nt, Homo Sapiens; identical to SEQ ID NO: 58380

SEQ ID NO: 570438 - RNA, 64 nt, Homo Sapiens; identical to SEQ ID NO: 58381

SEQ ID NO: 570439 - RNA, 64 nt, Homo Sapiens; identical to SEQ ID NO: 58382

SEQ ID NO: 570440 - RNA, 64 nt, Homo Sapiens; identical to SEQ ID NO: 58383

SEQ ID NO: 570441 - RNA, 64 nt, Homo Sapiens; identical to SEQ ID NO: 58384

SEQ ID NO: 570442 - RNA, 64 nt, Homo Sapiens; identical to SEQ ID NO: 58385

SEQ ID NO: 570443 - RNA, 64 nt, Homo Sapiens; identical to SEQ ID NO: 58386

SEQ ID NO: 570444 - RNA, 64 nt, Homo Sapiens; identical to SEQ ID NO: 58387

SEQ ID NO: 570445 - RNA, 64 nt, Homo Sapiens; identical to SEQ ID NO: 58388

SEQ ID NO: 570446 - RNA, 64 nt, Homo Sapiens; identical to SEQ ID NO: 58389

SEQ ID NO: 570447 - RNA, 64 nt, Homo Sapiens; identical to SEQ ID NO: 58390

SEQ ID NO: 570448 - RNA, 64 nt, Homo Sapiens; identical to SEQ ID NO: 58391

SEQ ID NO: 570449 - RNA, 64 nt, Homo Sapiens; identical to SEQ ID NO: 58392

SEQ ID NO: 570450 - RNA, 64 nt, Homo Sapiens; identical to SEQ ID NO: 58393

SEQ ID NO: 570451 - RNA, 64 nt, Homo Sapiens; identical to SEQ ID NO: 58394

SEQ ID NO: 570452 - RNA, 64 nt, Homo Sapiens; identical to SEQ ID NO: 58395

SEQ ID NO: 570453 - RNA, 64 nt, Homo Sapiens; identical to SEQ ID NO: 58396

SEQ ID NO: 570454 - RNA, 64 nt, Homo Sapiens; identical to SEQ ID NO: 58397

SEQ ID NO: 570455 - RNA, 64 nt, Homo Sapiens; identical to SEQ ID NO: 58398

SEQ ID NO: 570456 - RNA, 64 nt, Homo Sapiens; identical to SEQ ID NO: 58399

SEQ ID NO: 570457 - RNA, 64 nt, Homo Sapiens; identical to SEQ ID NO: 58400

SEQ ID NO: 570458 - RNA, 64 nt, Homo Sapiens; identical to SEQ ID NO: 58401

SEQ ID NO: 570459 - RNA, 64 nt, Homo Sapiens; identical to SEQ ID NO: 58402

SEQ ID NO: 570460 - RNA, 64 nt, Homo Sapiens; identical to SEQ ID NO: 58403

SEQ ID NO: 570461 - RNA, 64 nt, Homo Sapiens; identical to SEQ ID NO: 58404

SEQ ID NO: 570462 - RNA, 64 nt, Homo Sapiens; identical to SEQ ID NO: 58405

SEQ ID NO: 570463 - RNA, 64 nt, Homo Sapiens; identical to SEQ ID NO: 58406

SEQ ID NO: 570464 - RNA, 64 nt, Homo Sapiens; identical to SEQ ID NO: 58407

SEQ ID NO: 570465 - RNA, 64 nt, Homo Sapiens; identical to SEQ ID NO: 58408

SEQ ID NO: 570466 - RNA, 64 nt, Homo Sapiens; identical to SEQ ID NO: 58409

SEQ ID NO: 570467 - RNA, 64 nt, Homo Sapiens; identical to SEQ ID NO: 58410

SEQ ID NO: 570468 - RNA, 64 nt, Homo Sapiens; identical to SEQ ID NO: 58411

SEQ ID NO: 570469 - RNA, 64 nt, Homo Sapiens; identical to SEQ ID NO: 58412

SEQ ID NO: 570470 - RNA, 64 nt, Homo Sapiens; identical to SEQ ID NO: 58413

SEQ ID NO: 570471 - RNA, 64 nt, Homo Sapiens; identical to SEQ ID NO: 58414

SEQ ID NO: 570472 - RNA, 64 nt, Homo Sapiens; identical to SEQ ID NO: 58415

SEQ ID NO: 570473 - RNA, 64 nt, Homo Sapiens; identical to SEQ ID NO: 58416

SEQ ID NO: 570474 - RNA, 64 nt, Homo Sapiens; identical to SEQ ID NO: 58417

SEQ ID NO: 570475 - RNA, 64 nt, Homo Sapiens; identical to SEQ ID NO: 58418

SEQ ID NO: 570476 - RNA, 64 nt, Homo Sapiens; identical to SEQ ID NO: 58419

SEQ ID NO: 570477 - RNA, 64 nt, Homo Sapiens; identical to SEQ ID NO: 58420

SEQ ID NO: 570478 - RNA, 64 nt, Homo Sapiens; identical to SEQ ID NO: 58421

SEQ ID NO: 570479 - RNA, 64 nt, Homo Sapiens; identical to SEQ ID NO: 58422

SEQ ID NO: 570480 - RNA, 64 nt, Homo Sapiens; identical to SEQ ID NO: 58423

SEQ ID NO: 570481 - RNA, 64 nt, Homo Sapiens; identical to SEQ ID NO: 58424

SEQ ID NO: 570482 - RNA, 64 nt, Homo Sapiens; identical to SEQ ID NO: 58425

SEQ ID NO: 570483 - RNA, 64 nt, Homo Sapiens; identical to SEQ ID NO: 58426

SEQ ID NO: 570484 - RNA, 64 nt, Homo Sapiens; identical to SEQ ID NO: 58427

SEQ ID NO: 570485 - RNA, 64 nt, Homo Sapiens; identical to SEQ ID NO: 58428

SEQ ID NO: 570486 - RNA, 64 nt, Homo Sapiens; identical to SEQ ID NO: 58429

SEQ ID NO: 570487 - RNA, 64 nt, Homo Sapiens; identical to SEQ ID NO: 58430

SEQ ID NO: 570488 - RNA, 64 nt, Homo Sapiens; identical to SEQ ID NO: 58431

SEQ ID NO: 570489 - RNA, 64 nt, Homo Sapiens; identical to SEQ ID NO: 58432

SEQ ID NO: 570490 - RNA, 64 nt, Homo Sapiens; identical to SEQ ID NO: 58433

SEQ ID NO: 570491 - RNA, 64 nt, Homo Sapiens; identical to SEQ ID NO: 58434

SEQ ID NO: 570492 - RNA, 64 nt, Homo Sapiens; identical to SEQ ID NO: 58435

SEQ ID NO: 570493 - RNA, 50 nt, Homo Sapiens; identical to SEQ ID NO: 58436

SEQ ID NO: 570494 - RNA, 64 nt, Homo Sapiens; identical to SEQ ID NO: 58437

SEQ ID NO: 570495 - RNA, 64 nt, Homo Sapiens; identical to SEQ ID NO: 58438

SEQ ID NO: 570496 - RNA, 64 nt, Homo Sapiens; identical to SEQ ID NO: 58439

SEQ ID NO: 570497 - RNA, 64 nt, Homo Sapiens; identical to SEQ ID NO: 58440

SEQ ID NO: 570498 - RNA, 64 nt, Homo Sapiens; identical to SEQ ID NO: 58441

SEQ ID NO: 570499 - RNA, 64 nt, Homo Sapiens; identical to SEQ ID NO: 58442

SEQ ID NO: 570500 - RNA, 64 nt, Homo Sapiens; identical to SEQ ID NO: 58443

SEQ ID NO: 570501 - RNA, 64 nt, Homo Sapiens; identical to SEQ ID NO: 58444

SEQ ID NO: 570502 - RNA, 64 nt, Homo Sapiens; identical to SEQ ID NO: 58445

SEQ ID NO: 570503 - RNA, 64 nt, Homo Sapiens; identical to SEQ ID NO: 58446

SEQ ID NO: 570504 - RNA, 64 nt, Homo Sapiens; identical to SEQ ID NO: 58447

SEQ ID NO: 570505 - RNA, 64 nt, Homo Sapiens; identical to SEQ ID NO: 58448

SEQ ID NO: 570506 - RNA, 64 nt, Homo Sapiens; identical to SEQ ID NO: 58449

SEQ ID NO: 570507 - RNA, 64 nt, Homo Sapiens; identical to SEQ ID NO: 58450

SEQ ID NO: 570508 - RNA, 64 nt, Homo Sapiens; identical to SEQ ID NO: 58451

SEQ ID NO: 570509 - RNA, 64 nt, Homo Sapiens; identical to SEQ ID NO: 58452

SEQ ID NO: 570510 - RNA, 64 nt, Homo Sapiens; identical to SEQ ID NO: 58453

SEQ ID NO: 570511 - RNA, 64 nt, Homo Sapiens; identical to SEQ ID NO: 58454

SEQ ID NO: 570512 - RNA, 64 nt, Homo Sapiens; identical to SEQ ID NO: 58455

SEQ ID NO: 570513 - RNA, 64 nt, Homo Sapiens; identical to SEQ ID NO: 58456

SEQ ID NO: 570514 - RNA, 64 nt, Homo Sapiens; identical to SEQ ID NO: 58457

SEQ ID NO: 570515 - RNA, 64 nt, Homo Sapiens; identical to SEQ ID NO: 58458

SEQ ID NO: 570516 - RNA, 64 nt, Homo Sapiens; identical to SEQ ID NO: 58459

SEQ ID NO: 570517 - RNA, 64 nt, Homo Sapiens; identical to SEQ ID NO: 58460

SEQ ID NO: 570518 - RNA, 64 nt, Homo Sapiens; identical to SEQ ID NO: 58461

SEQ ID NO: 570519 - RNA, 64 nt, Homo Sapiens; identical to SEQ ID NO: 58462

SEQ ID NO: 570520 - RNA, 64 nt, Homo Sapiens; identical to SEQ ID NO: 58463

SEQ ID NO: 570521 - RNA, 64 nt, Homo Sapiens; identical to SEQ ID NO: 58464

SEQ ID NO: 570522 - RNA, 64 nt, Homo Sapiens; identical to SEQ ID NO: 58465

SEQ ID NO: 570523 - RNA, 64 nt, Homo Sapiens; identical to SEQ ID NO: 58466

SEQ ID NO: 570524 - RNA, 64 nt, Homo Sapiens; identical to SEQ ID NO: 58467

SEQ ID NO: 570525 - RNA, 64 nt, Homo Sapiens
ggagagagaaggacagugcacggagagguuuccagagcacaaauuguugguuccuagcacaaau

SEQ ID NO: 570526 - RNA, 64 nt, Homo Sapiens
aauuguugguuccuagcacaaauuagaugguuuggagcacaauggugaagcacacuccccuccc

SEQ ID NO: 570527 - RNA, 64 nt, Homo Sapiens
ggaugggacgaugugcccagggagggacccaccagagcacaagagaagguggcuaccugggggu

SEQ ID NO: 570528 - RNA, 64 nt, Homo Sapiens
gcaaggagcuaggacccccaguccugccccccaggagcacaagcaggguccccucagucaaggc

SEQ ID NO: 570529 - RNA, 64 nt, Homo Sapiens
cauauuagguaaaauauuggucaaaguugcgaaagagcacaaacagauuugagcauuugaagau

SEQ ID NO: 570530 - RNA, 64 nt, Homo Sapiens
aucuuuuagauuugagcauuagcgcauaauaacagagcacaagcaacaauguuuucuuucuggu

SEQ ID NO: 570531 - RNA, 64 nt, Homo Sapiens; identical to SEQ ID NO: 21124

SEQ ID NO: 570532 - RNA, 64 nt, Homo Sapiens; identical to SEQ ID NO: 21125

SEQ ID NO: 570533 - RNA, 64 nt, Homo Sapiens; identical to SEQ ID NO: 21126

SEQ ID NO: 570534 - RNA, 64 nt, Homo Sapiens; identical to SEQ ID NO: 21127

SEQ ID NO: 570535 - RNA, 64 nt, Homo Sapiens; identical to SEQ ID NO: 21128

SEQ ID NO: 570536 - RNA, 64 nt, Homo Sapiens; identical to SEQ ID NO: 21129

SEQ ID NO: 570537 - RNA, 64 nt, Homo Sapiens; identical to SEQ ID NO: 21130

SEQ ID NO: 570538 - RNA, 64 nt, Homo Sapiens; identical to SEQ ID NO: 21131

SEQ ID NO: 570539 - RNA, 64 nt, Homo Sapiens; identical to SEQ ID NO: 21132

SEQ ID NO: 570540 - RNA, 64 nt, Homo Sapiens; identical to SEQ ID NO: 21133

SEQ ID NO: 570541 - RNA, 64 nt, Homo Sapiens; identical to SEQ ID NO: 21134

SEQ ID NO: 570542 - RNA, 64 nt, Homo Sapiens; identical to SEQ ID NO: 21135

SEQ ID NO: 570543 - RNA, 64 nt, Homo Sapiens; identical to SEQ ID NO: 21136

SEQ ID NO: 570544 - RNA, 64 nt, Homo Sapiens; identical to SEQ ID NO: 21137

SEQ ID NO: 570545 - RNA, 64 nt, Homo Sapiens; identical to SEQ ID NO: 21138

SEQ ID NO: 570546 - RNA, 64 nt, Homo Sapiens; identical to SEQ ID NO: 21139

SEQ ID NO: 570547 - RNA, 64 nt, Homo Sapiens; identical to SEQ ID NO: 21140

SEQ ID NO: 570548 - RNA, 64 nt, Homo Sapiens; identical to SEQ ID NO: 21141

SEQ ID NO: 570549 - RNA, 64 nt, Homo Sapiens
gucugucauggggaaacuauauuuuugagcacauggaacaaauuauacuuccucauucauauua

SEQ ID NO: 570550 - RNA, 64 nt, Homo Sapiens
uaguccuauaauuuucagcuuaauuauaaacaaaggaacaaauaaguggaagggcagcuauuac

SEQ ID NO: 570551 - RNA, 64 nt, Homo Sapiens
uugauucgaaggaugaagacgaagaagcaagggaggaacaaaugaagaaccaucuuuguucaug

SEQ ID NO: 570552 - RNA, 64 nt, Homo Sapiens
gugucauggugcagagguaggcauucugagcaggggaacaaaauaagggccuagaaacucaccc

SEQ ID NO: 570553 - RNA, 64 nt, Homo Sapiens
cugagccaccccacccggccuauuuucuuaaaggggaacaaaugaucuugacaacauauuauuc

SEQ ID NO: 570554 - RNA, 64 nt, Homo Sapiens
gggauuaugacagguauuaccaaaaacaccaaaaggaacaaaggggccugcguuaaaaccuaau

SEQ ID NO: 570555 - RNA, 64 nt, Homo Sapiens
uuuacuguuagacuaaucaaaaauaacuuuaaaaggaacaaagaaacuccaacauuucacauua

SEQ ID NO: 570556 - RNA, 64 nt, Homo Sapiens
ggaaucaagaccaauaccaaggagaaauuccuagggaacaaaaauuccaaugaggaauugaccu

SEQ ID NO: 570557 - RNA, 64 nt, Homo Sapiens
ggaucaauuugugaguuuuucuuuucuuccccauggaacaaaugaguuauuuccuuuuauaaua

SEQ ID NO: 570558 - RNA, 64 nt, Homo Sapiens
gaaaugacugugguguggagggaccacuccagguggaacaaacaguucacugagggguggcacg

SEQ ID NO: 570559 - RNA, 64 nt, Homo Sapiens
ucuagugauuaguaugccaacuuuuccaaggaagggaacaaaaggggauguaauccuuacauug

SEQ ID NO: 570560 - RNA, 64 nt, Homo Sapiens
aguuagaaaaacuuuaaaaauacauacugauucuggaacaaaacugauuaaaaucgaacuuuau

SEQ ID NO: 570561 - RNA, 64 nt, Homo Sapiens
cuuuuuaacacacguaagggaccgcacccaguugggaacaaagcugggauuauaggugugagcc

SEQ ID NO: 570562 - RNA, 64 nt, Homo Sapiens
cuuuuuuuuuuuugagacggcuuuccuuuaaaggggaacaaagcuaauaauuuuggaucauuuu

SEQ ID NO: 570563 - RNA, 64 nt, Homo Sapiens
cauauugacgguucucucagcagaucccucagcaggaacaaagguauuuguaccuccagaaugg

SEQ ID NO: 570564 - RNA, 64 nt, Homo Sapiens
gacaagcagaacagguguggaauacaggcuuuagggaacaaaggauagauccccuuaaagaaaa

SEQ ID NO: 570565 - RNA, 64 nt, Homo Sapiens
gugggaagaggugaucuguaaagagucucagaguggaacaaagauggauacacgaggaaaagga

SEQ ID NO: 570566 - RNA, 64 nt, Homo Sapiens
aggucccuguuaggguucuauggcaggacucacaggaacaaacgagcacccauuaaacaagucc

SEQ ID NO: 570567 - RNA, 64 nt, Homo Sapiens
acuuuauuuuuauugguuccugaagacgggacaaggaacaaauacauacguuaauaugagagau

SEQ ID NO: 570568 - RNA, 64 nt, Homo Sapiens
gaacuacuacucacaguuaccacuuggggucaguggaacaaaaugcauauaugguuuugacauu

SEQ ID NO: 570569 - RNA, 64 nt, Homo Sapiens
uguugggacccagagcaauguaagauguagacuuggaacaaagcccaauccuuccacauacugu

SEQ ID NO: 570570 - RNA, 64 nt, Homo Sapiens
acugccuccagagucuuuaagccucucccccacaggaacaaaacauacucugcaaguugaccug

SEQ ID NO: 570571 - RNA, 64 nt, Homo Sapiens
ucugugcaaacuggaggacuccuuccaacuuccuggaacaaagcgacaucgccagcagcaggcu

SEQ ID NO: 570572 - RNA, 64 nt, Homo Sapiens
acagugugcucacucucagagccauggauuaccuggaacaaagugcagauuagugcccacgguc

SEQ ID NO: 570573 - RNA, 64 nt, Homo Sapiens
aguuggaaguaaagcacuccucagcaaauguaaaggaacaaaaauuauaacaaacugucucuca

SEQ ID NO: 570574 - RNA, 64 nt, Homo Sapiens
uccagaaucuacaaugaacucaaacaaauuuacaggaacaaacaaccccaucaaaaagucggca

SEQ ID NO: 570575 - RNA, 64 nt, Homo Sapiens; identical to SEQ ID NO: 336334

SEQ ID NO: 570576 - RNA, 64 nt, Homo Sapiens; identical to SEQ ID NO: 336335

SEQ ID NO: 570577 - RNA, 64 nt, Homo Sapiens; identical to SEQ ID NO: 336336

SEQ ID NO: 570578 - RNA, 64 nt, Homo Sapiens; identical to SEQ ID NO: 336337

SEQ ID NO: 570579 - RNA, 64 nt, Homo Sapiens; identical to SEQ ID NO: 336338

SEQ ID NO: 570580 - RNA, 64 nt, Homo Sapiens; identical to SEQ ID NO: 336339

SEQ ID NO: 570581 - RNA, 64 nt, Homo Sapiens; identical to SEQ ID NO: 336340

SEQ ID NO: 570582 - RNA, 64 nt, Homo Sapiens; identical to SEQ ID NO: 336341

SEQ ID NO: 570583 - RNA, 64 nt, Homo Sapiens; identical to SEQ ID NO: 336342

SEQ ID NO: 570584 - RNA, 64 nt, Homo Sapiens; identical to SEQ ID NO: 336343

SEQ ID NO: 570585 - RNA, 64 nt, Homo Sapiens
gguacauuuuauagguaucacaucauuuuuaauuucaagauauuucugagaacacagaauaauc

SEQ ID NO: 570586 - RNA, 64 nt, Homo Sapiens
auguaacuuggaaagcgaggcguuuuaaaucugcucaagauaaaaguccuauuacagcuaaucu

SEQ ID NO: 570587 - RNA, 64 nt, Homo Sapiens
gaaaaauaguuuuugaaaacaucagauuauaaaaucaagauaguccggacgcgguggcacaugc

SEQ ID NO: 570588 - RNA, 64 nt, Homo Sapiens
gcgacagagcgagacuccaccucaaaaaauaaaaucaagauaaccucuugaauguaauagcuca

SEQ ID NO: 570589 - RNA, 64 nt, Homo Sapiens
uccagcuucuuggcucagccauuuggagagccguucaagauacuagaguauggauaaucuuugg

SEQ ID NO: 570590 - RNA, 64 nt, Homo Sapiens
cuagaaauaaaaaccagauguguaaugagauguaucaagauaucuucccaugcagauugugaaa

SEQ ID NO: 570591 - RNA, 64 nt, Homo Sapiens
uuuucacuguaggcuauuacaggauacuucaggaucaagauacagaaccuuuuauuuaaagagu

SEQ ID NO: 570592 - RNA, 64 nt, Homo Sapiens
gucaauguguuuguuugugucucugagauugacuucaagauaauaagcugcuaauuguaaacaa

SEQ ID NO: 570593 - RNA, 64 nt, Homo Sapiens
aaccuguguucuccucauaauaguauagaauaauucaagauaggcaagaaggacagcaguaaau

SEQ ID NO: 570594 - RNA, 64 nt, Homo Sapiens; identical to SEQ ID NO: 48032

SEQ ID NO: 570595 - RNA, 64 nt, Homo Sapiens; identical to SEQ ID NO: 48033

SEQ ID NO: 570596 - RNA, 64 nt, Homo Sapiens; identical to SEQ ID NO: 48034

SEQ ID NO: 570597 - RNA, 64 nt, Homo Sapiens; identical to SEQ ID NO: 48035

SEQ ID NO: 570598 - RNA, 64 nt, Homo Sapiens; identical to SEQ ID NO: 48036

SEQ ID NO: 570599 - RNA, 64 nt, Homo Sapiens; identical to SEQ ID NO: 48037

SEQ ID NO: 570600 - RNA, 64 nt, Homo Sapiens; identical to SEQ ID NO: 48038

SEQ ID NO: 570601 - RNA, 64 nt, Homo Sapiens; identical to SEQ ID NO: 48039

SEQ ID NO: 570602 - RNA, 64 nt, Homo Sapiens; identical to SEQ ID NO: 48040

SEQ ID NO: 570603 - RNA, 64 nt, Homo Sapiens; identical to SEQ ID NO: 48041

SEQ ID NO: 570604 - RNA, 64 nt, Homo Sapiens; identical to SEQ ID NO: 48042

SEQ ID NO: 570605 - RNA, 64 nt, Homo Sapiens; identical to SEQ ID NO: 48043

SEQ ID NO: 570606 - RNA, 64 nt, Homo Sapiens; identical to SEQ ID NO: 48044

SEQ ID NO: 570607 - RNA, 64 nt, Homo Sapiens; identical to SEQ ID NO: 48045

SEQ ID NO: 570608 - RNA, 64 nt, Homo Sapiens; identical to SEQ ID NO: 48046

SEQ ID NO: 570609 - RNA, 64 nt, Homo Sapiens; identical to SEQ ID NO: 48047

SEQ ID NO: 570610 - RNA, 64 nt, Homo Sapiens; identical to SEQ ID NO: 21683

SEQ ID NO: 570611 - RNA, 64 nt, Homo Sapiens; identical to SEQ ID NO: 21684

SEQ ID NO: 570612 - RNA, 64 nt, Homo Sapiens; identical to SEQ ID NO: 21685

SEQ ID NO: 570613 - RNA, 64 nt, Homo Sapiens; identical to SEQ ID NO: 21686

SEQ ID NO: 570614 - RNA, 64 nt, Homo Sapiens; identical to SEQ ID NO: 21687

SEQ ID NO: 570615 - RNA, 64 nt, Homo Sapiens; identical to SEQ ID NO: 21688

SEQ ID NO: 570616 - RNA, 64 nt, Homo Sapiens; identical to SEQ ID NO: 21689

SEQ ID NO: 570617 - RNA, 64 nt, Homo Sapiens; identical to SEQ ID NO: 21690

SEQ ID NO: 570618 - RNA, 64 nt, Homo Sapiens; identical to SEQ ID NO: 21691

SEQ ID NO: 570619 - RNA, 64 nt, Homo Sapiens; identical to SEQ ID NO: 21692

SEQ ID NO: 570620 - RNA, 64 nt, Homo Sapiens; identical to SEQ ID NO: 21693

SEQ ID NO: 570621 - RNA, 64 nt, Homo Sapiens; identical to SEQ ID NO: 21694

SEQ ID NO: 570622 - RNA, 52 nt, Homo Sapiens; identical to SEQ ID NO: 21695

SEQ ID NO: 570623 - RNA, 64 nt, Homo Sapiens; identical to SEQ ID NO: 21696

SEQ ID NO: 570624 - RNA, 64 nt, Homo Sapiens; identical to SEQ ID NO: 21697

SEQ ID NO: 570625 - RNA, 64 nt, Homo Sapiens; identical to SEQ ID NO: 21698

SEQ ID NO: 570626 - RNA, 64 nt, Homo Sapiens; identical to SEQ ID NO: 21699

SEQ ID NO: 570627 - RNA, 64 nt, Homo Sapiens; identical to SEQ ID NO: 21700

SEQ ID NO: 570628 - RNA, 64 nt, Homo Sapiens; identical to SEQ ID NO: 21701

SEQ ID NO: 570629 - RNA, 64 nt, Homo Sapiens; identical to SEQ ID NO: 21702

SEQ ID NO: 570630 - RNA, 64 nt, Homo Sapiens; identical to SEQ ID NO: 21703

SEQ ID NO: 570631 - RNA, 64 nt, Homo Sapiens; identical to SEQ ID NO: 21704

SEQ ID NO: 570632 - RNA, 64 nt, Homo Sapiens; identical to SEQ ID NO: 21705

SEQ ID NO: 570633 - RNA, 64 nt, Homo Sapiens; identical to SEQ ID NO: 21706

SEQ ID NO: 570634 - RNA, 64 nt, Homo Sapiens; identical to SEQ ID NO: 21707

SEQ ID NO: 570635 - RNA, 64 nt, Homo Sapiens; identical to SEQ ID NO: 21708

SEQ ID NO: 570636 - RNA, 64 nt, Homo Sapiens; identical to SEQ ID NO: 21709

SEQ ID NO: 570637 - RNA, 64 nt, Homo Sapiens; identical to SEQ ID NO: 21710

SEQ ID NO: 570638 - RNA, 64 nt, Homo Sapiens; identical to SEQ ID NO: 21711

SEQ ID NO: 570639 - RNA, 64 nt, Homo Sapiens; identical to SEQ ID NO: 21712

SEQ ID NO: 570640 - RNA, 64 nt, Homo Sapiens; identical to SEQ ID NO: 21713

SEQ ID NO: 570641 - RNA, 64 nt, Homo Sapiens; identical to SEQ ID NO: 21714

SEQ ID NO: 570642 - RNA, 64 nt, Homo Sapiens; identical to SEQ ID NO: 21715

SEQ ID NO: 570643 - RNA, 64 nt, Homo Sapiens; identical to SEQ ID NO: 21716

SEQ ID NO: 570644 - RNA, 64 nt, Homo Sapiens; identical to SEQ ID NO: 21717

SEQ ID NO: 570645 - RNA, 64 nt, Homo Sapiens; identical to SEQ ID NO: 21718

SEQ ID NO: 570646 - RNA, 64 nt, Homo Sapiens; identical to SEQ ID NO: 21719

SEQ ID NO: 570647 - RNA, 64 nt, Homo Sapiens; identical to SEQ ID NO: 21720

SEQ ID NO: 570648 - RNA, 64 nt, Homo Sapiens; identical to SEQ ID NO: 21721

SEQ ID NO: 570649 - RNA, 64 nt, Homo Sapiens; identical to SEQ ID NO: 21722

SEQ ID NO: 570650 - RNA, 64 nt, Homo Sapiens; identical to SEQ ID NO: 21723

SEQ ID NO: 570651 - RNA, 64 nt, Homo Sapiens; identical to SEQ ID NO: 21724

SEQ ID NO: 570652 - RNA, 64 nt, Homo Sapiens; identical to SEQ ID NO: 21725

SEQ ID NO: 570653 - RNA, 64 nt, Homo Sapiens; identical to SEQ ID NO: 21726

SEQ ID NO: 570654 - RNA, 64 nt, Homo Sapiens; identical to SEQ ID NO: 21727

SEQ ID NO: 570655 - RNA, 64 nt, Homo Sapiens; identical to SEQ ID NO: 21728

SEQ ID NO: 570656 - RNA, 64 nt, Homo Sapiens; identical to SEQ ID NO: 21729

SEQ ID NO: 570657 - RNA, 64 nt, Homo Sapiens; identical to SEQ ID NO: 21730

SEQ ID NO: 570658 - RNA, 64 nt, Homo Sapiens; identical to SEQ ID NO: 21731

SEQ ID NO: 570659 - RNA, 64 nt, Homo Sapiens; identical to SEQ ID NO: 21732

SEQ ID NO: 570660 - RNA, 64 nt, Homo Sapiens; identical to SEQ ID NO: 21733

SEQ ID NO: 570661 - RNA, 64 nt, Homo Sapiens; identical to SEQ ID NO: 21734

SEQ ID NO: 570662 - RNA, 64 nt, Homo Sapiens; identical to SEQ ID NO: 21735

SEQ ID NO: 570663 - RNA, 64 nt, Homo Sapiens; identical to SEQ ID NO: 21736

SEQ ID NO: 570664 - RNA, 64 nt, Homo Sapiens; identical to SEQ ID NO: 21737

SEQ ID NO: 570665 - RNA, 64 nt, Homo Sapiens; identical to SEQ ID NO: 21738

SEQ ID NO: 570666 - RNA, 64 nt, Homo Sapiens; identical to SEQ ID NO: 21739

SEQ ID NO: 570667 - RNA, 64 nt, Homo Sapiens; identical to SEQ ID NO: 21740

SEQ ID NO: 570668 - RNA, 64 nt, Homo Sapiens; identical to SEQ ID NO: 21741

SEQ ID NO: 570669 - RNA, 64 nt, Homo Sapiens; identical to SEQ ID NO: 21742

SEQ ID NO: 570670 - RNA, 64 nt, Homo Sapiens; identical to SEQ ID NO: 21743

SEQ ID NO: 570671 - RNA, 64 nt, Homo Sapiens; identical to SEQ ID NO: 21744

SEQ ID NO: 570672 - RNA, 64 nt, Homo Sapiens; identical to SEQ ID NO: 21745

SEQ ID NO: 570673 - RNA, 64 nt, Homo Sapiens; identical to SEQ ID NO: 21746

SEQ ID NO: 570674 - RNA, 64 nt, Homo Sapiens; identical to SEQ ID NO: 21747

SEQ ID NO: 570675 - RNA, 64 nt, Homo Sapiens; identical to SEQ ID NO: 293071

SEQ ID NO: 570676 - RNA, 64 nt, Homo Sapiens; identical to SEQ ID NO: 293072

SEQ ID NO: 570677 - RNA, 64 nt, Homo Sapiens; identical to SEQ ID NO: 293073

SEQ ID NO: 570678 - RNA, 64 nt, Homo Sapiens; identical to SEQ ID NO: 293074

SEQ ID NO: 570679 - RNA, 64 nt, Homo Sapiens; identical to SEQ ID NO: 293075

SEQ ID NO: 570680 - RNA, 64 nt, Homo Sapiens; identical to SEQ ID NO: 293076

SEQ ID NO: 570681 - RNA, 64 nt, Homo Sapiens; identical to SEQ ID NO: 293077

SEQ ID NO: 570682 - RNA, 64 nt, Homo Sapiens; identical to SEQ ID NO: 293078

SEQ ID NO: 570683 - RNA, 64 nt, Homo Sapiens; identical to SEQ ID NO: 293079

SEQ ID NO: 570684 - RNA, 64 nt, Homo Sapiens; identical to SEQ ID NO: 293080

SEQ ID NO: 570685 - RNA, 64 nt, Homo Sapiens; identical to SEQ ID NO: 293081

SEQ ID NO: 570686 - RNA, 64 nt, Homo Sapiens; identical to SEQ ID NO: 293082

SEQ ID NO: 570687 - RNA, 64 nt, Homo Sapiens; identical to SEQ ID NO: 293083

SEQ ID NO: 570688 - RNA, 64 nt, Homo Sapiens; identical to SEQ ID NO: 293084

SEQ ID NO: 570689 - RNA, 64 nt, Homo Sapiens; identical to SEQ ID NO: 293085

SEQ ID NO: 570690 - RNA, 64 nt, Homo Sapiens; identical to SEQ ID NO: 293086

SEQ ID NO: 570691 - RNA, 64 nt, Homo Sapiens; identical to SEQ ID NO: 293087

SEQ ID NO: 570692 - RNA, 64 nt, Homo Sapiens; identical to SEQ ID NO: 293088

SEQ ID NO: 570693 - RNA, 64 nt, Homo Sapiens; identical to SEQ ID NO: 293089

SEQ ID NO: 570694 - RNA, 64 nt, Homo Sapiens; identical to SEQ ID NO: 293090

SEQ ID NO: 570695 - RNA, 64 nt, Homo Sapiens; identical to SEQ ID NO: 293091

SEQ ID NO: 570696 - RNA, 64 nt, Homo Sapiens; identical to SEQ ID NO: 293092

SEQ ID NO: 570697 - RNA, 64 nt, Homo Sapiens; identical to SEQ ID NO: 293093

SEQ ID NO: 570698 - RNA, 64 nt, Homo Sapiens; identical to SEQ ID NO: 293094

SEQ ID NO: 570699 - RNA, 64 nt, Homo Sapiens; identical to SEQ ID NO: 293095

SEQ ID NO: 570700 - RNA, 64 nt, Homo Sapiens; identical to SEQ ID NO: 293096

SEQ ID NO: 570701 - RNA, 64 nt, Homo Sapiens; identical to SEQ ID NO: 293097

SEQ ID NO: 570702 - RNA, 64 nt, Homo Sapiens; identical to SEQ ID NO: 293098

SEQ ID NO: 570703 - RNA, 64 nt, Homo Sapiens; identical to SEQ ID NO: 293099

SEQ ID NO: 570704 - RNA, 64 nt, Homo Sapiens; identical to SEQ ID NO: 293100

SEQ ID NO: 570705 - RNA, 64 nt, Homo Sapiens; identical to SEQ ID NO: 293101

SEQ ID NO: 570706 - RNA, 64 nt, Homo Sapiens; identical to SEQ ID NO: 293102

SEQ ID NO: 570707 - RNA, 57 nt, Homo Sapiens
ugacauuaguaugaaauuuaaaagaaaugccaauauguaaaauauaaagcuacaucc

SEQ ID NO: 570708 - RNA, 57 nt, Homo Sapiens
auaauaaaauacauuugucuauacaaaugccaauaugggugguaggaauagcaacua

SEQ ID NO: 570709 - RNA, 57 nt, Homo Sapiens
uugggagaacaauaaaacuauuaaauuugccaauauucacaaagauuaaaaguuacu

SEQ ID NO: 570710 - RNA, 57 nt, Homo Sapiens
uugguuucucauaacuugcauuucauuugccaauaaaaugguugaaggaaugcucag

SEQ ID NO: 570711 - RNA, 57 nt, Homo Sapiens
ccauuucucuagaauguuuaagcucuuugccaauauuauuccuuuguuuaauuuuua

SEQ ID NO: 570712 - RNA, 64 nt, Homo Sapiens; identical to SEQ ID NO: 47689

SEQ ID NO: 570713 - RNA, 64 nt, Homo Sapiens; identical to SEQ ID NO: 47690

SEQ ID NO: 570714 - RNA, 64 nt, Homo Sapiens; identical to SEQ ID NO: 47691

SEQ ID NO: 570715 - RNA, 64 nt, Homo Sapiens; identical to SEQ ID NO: 47692

SEQ ID NO: 570716 - RNA, 64 nt, Homo Sapiens; identical to SEQ ID NO: 47693

SEQ ID NO: 570717 - RNA, 64 nt, Homo Sapiens; identical to SEQ ID NO: 47694

SEQ ID NO: 570718 - RNA, 64 nt, Homo Sapiens; identical to SEQ ID NO: 47695

SEQ ID NO: 570719 - RNA, 64 nt, Homo Sapiens; identical to SEQ ID NO: 47696

SEQ ID NO: 570720 - RNA, 64 nt, Homo Sapiens; identical to SEQ ID NO: 47697

SEQ ID NO: 570721 - RNA, 64 nt, Homo Sapiens; identical to SEQ ID NO: 47698

SEQ ID NO: 570722 - RNA, 64 nt, Homo Sapiens; identical to SEQ ID NO: 47699

SEQ ID NO: 570723 - RNA, 64 nt, Homo Sapiens; identical to SEQ ID NO: 47700

SEQ ID NO: 570724 - RNA, 64 nt, Homo Sapiens; identical to SEQ ID NO: 47701

SEQ ID NO: 570725 - RNA, 64 nt, Homo Sapiens; identical to SEQ ID NO: 47702

SEQ ID NO: 570726 - RNA, 64 nt, Homo Sapiens; identical to SEQ ID NO: 47703

SEQ ID NO: 570727 - RNA, 64 nt, Homo Sapiens; identical to SEQ ID NO: 47704

SEQ ID NO: 570728 - RNA, 64 nt, Homo Sapiens; identical to SEQ ID NO: 255688

SEQ ID NO: 570729 - RNA, 64 nt, Homo Sapiens; identical to SEQ ID NO: 255689

SEQ ID NO: 570730 - RNA, 64 nt, Homo Sapiens; identical to SEQ ID NO: 255690

SEQ ID NO: 570731 - RNA, 64 nt, Homo Sapiens; identical to SEQ ID NO: 255691

SEQ ID NO: 570732 - RNA, 64 nt, Homo Sapiens; identical to SEQ ID NO: 255692

SEQ ID NO: 570733 - RNA, 64 nt, Homo Sapiens; identical to SEQ ID NO: 255693

SEQ ID NO: 570734 - RNA, 64 nt, Homo Sapiens; identical to SEQ ID NO: 255694

SEQ ID NO: 570735 - RNA, 64 nt, Homo Sapiens; identical to SEQ ID NO: 255695

SEQ ID NO: 570736 - RNA, 64 nt, Homo Sapiens; identical to SEQ ID NO: 511695

SEQ ID NO: 570737 - RNA, 64 nt, Homo Sapiens; identical to SEQ ID NO: 511696

SEQ ID NO: 570738 - RNA, 64 nt, Homo Sapiens; identical to SEQ ID NO: 511697

SEQ ID NO: 570739 - RNA, 64 nt, Homo Sapiens; identical to SEQ ID NO: 511698

SEQ ID NO: 570740 - RNA, 64 nt, Homo Sapiens; identical to SEQ ID NO: 511699

SEQ ID NO: 570741 - RNA, 64 nt, Homo Sapiens; identical to SEQ ID NO: 511700

SEQ ID NO: 570742 - RNA, 64 nt, Homo Sapiens; identical to SEQ ID NO: 511701

SEQ ID NO: 570743 - RNA, 64 nt, Homo Sapiens; identical to SEQ ID NO: 511702

SEQ ID NO: 570744 - RNA, 64 nt, Homo Sapiens; identical to SEQ ID NO: 511703

SEQ ID NO: 570745 - RNA, 64 nt, Homo Sapiens; identical to SEQ ID NO: 511704

SEQ ID NO: 570746 - RNA, 64 nt, Homo Sapiens; identical to SEQ ID NO: 511705

SEQ ID NO: 570747 - RNA, 64 nt, Homo Sapiens; identical to SEQ ID NO: 511706

SEQ ID NO: 570748 - RNA, 64 nt, Homo Sapiens; identical to SEQ ID NO: 511707

SEQ ID NO: 570749 - RNA, 64 nt, Homo Sapiens; identical to SEQ ID NO: 511708

SEQ ID NO: 570750 - RNA, 64 nt, Homo Sapiens; identical to SEQ ID NO: 511709

SEQ ID NO: 570751 - RNA, 64 nt, Homo Sapiens; identical to SEQ ID NO: 511710

SEQ ID NO: 570752 - RNA, 64 nt, Homo Sapiens; identical to SEQ ID NO: 511711

SEQ ID NO: 570753 - RNA, 64 nt, Homo Sapiens; identical to SEQ ID NO: 511712

SEQ ID NO: 570754 - RNA, 64 nt, Homo Sapiens; identical to SEQ ID NO: 511713

SEQ ID NO: 570755 - RNA, 64 nt, Homo Sapiens; identical to SEQ ID NO: 511714

SEQ ID NO: 570756 - RNA, 64 nt, Homo Sapiens; identical to SEQ ID NO: 511715

SEQ ID NO: 570757 - RNA, 64 nt, Homo Sapiens; identical to SEQ ID NO: 511716

SEQ ID NO: 570758 - RNA, 64 nt, Homo Sapiens
gggccaacugggaugaggugagaugaagcacacaggaaccuaauagguuuuuuuuucucacaga

SEQ ID NO: 570759 - RNA, 64 nt, Homo Sapiens
agauggacaggcugaggugucaagcugcuugaugggaaccuacuuuguacuacucagcugauca

SEQ ID NO: 570760 - RNA, 64 nt, Homo Sapiens
ggagggagagugaggagggaguguuauuuccuugggaaccuagggaggagagguuccuuuguug

SEQ ID NO: 570761 - RNA, 64 nt, Homo Sapiens
gaacugcucuuggacuuguuuuccuguuguuuguggaaccuacgcguuugaauggcuugaacgu

SEQ ID NO: 570762 - RNA, 64 nt, Homo Sapiens; identical to SEQ ID NO: 44795

SEQ ID NO: 570763 - RNA, 64 nt, Homo Sapiens; identical to SEQ ID NO: 44796

SEQ ID NO: 570764 - RNA, 64 nt, Homo Sapiens; identical to SEQ ID NO: 44797

SEQ ID NO: 570765 - RNA, 64 nt, Homo Sapiens; identical to SEQ ID NO: 44798

SEQ ID NO: 570766 - RNA, 64 nt, Homo Sapiens; identical to SEQ ID NO: 44799

SEQ ID NO: 570767 - RNA, 64 nt, Homo Sapiens; identical to SEQ ID NO: 44800

SEQ ID NO: 570768 - RNA, 64 nt, Homo Sapiens; identical to SEQ ID NO: 44801

SEQ ID NO: 570769 - RNA, 64 nt, Homo Sapiens; identical to SEQ ID NO: 44802

SEQ ID NO: 570770 - RNA, 64 nt, Homo Sapiens; identical to SEQ ID NO: 44803

SEQ ID NO: 570771 - RNA, 64 nt, Homo Sapiens; identical to SEQ ID NO: 44804

SEQ ID NO: 570772 - RNA, 64 nt, Homo Sapiens; identical to SEQ ID NO: 44805

SEQ ID NO: 570773 - RNA, 64 nt, Homo Sapiens; identical to SEQ ID NO: 44806

SEQ ID NO: 570774 - RNA, 64 nt, Homo Sapiens; identical to SEQ ID NO: 44807

SEQ ID NO: 570775 - RNA, 64 nt, Homo Sapiens; identical to SEQ ID NO: 44808

SEQ ID NO: 570776 - RNA, 64 nt, Homo Sapiens; identical to SEQ ID NO: 44809

SEQ ID NO: 570777 - RNA, 64 nt, Homo Sapiens; identical to SEQ ID NO: 44810

SEQ ID NO: 570778 - RNA, 64 nt, Homo Sapiens; identical to SEQ ID NO: 44811

SEQ ID NO: 570779 - RNA, 64 nt, Homo Sapiens; identical to SEQ ID NO: 44812

SEQ ID NO: 570780 - RNA, 64 nt, Homo Sapiens; identical to SEQ ID NO: 44813

SEQ ID NO: 570781 - RNA, 64 nt, Homo Sapiens; identical to SEQ ID NO: 44814

SEQ ID NO: 570782 - RNA, 64 nt, Homo Sapiens; identical to SEQ ID NO: 44815

SEQ ID NO: 570783 - RNA, 64 nt, Homo Sapiens; identical to SEQ ID NO: 44816

SEQ ID NO: 570784 - RNA, 64 nt, Homo Sapiens; identical to SEQ ID NO: 44817

SEQ ID NO: 570785 - RNA, 64 nt, Homo Sapiens; identical to SEQ ID NO: 44818

SEQ ID NO: 570786 - RNA, 64 nt, Homo Sapiens; identical to SEQ ID NO: 44819

SEQ ID NO: 570787 - RNA, 64 nt, Homo Sapiens; identical to SEQ ID NO: 44820

SEQ ID NO: 570788 - RNA, 64 nt, Homo Sapiens; identical to SEQ ID NO: 44821

SEQ ID NO: 570789 - RNA, 64 nt, Homo Sapiens; identical to SEQ ID NO: 44822

SEQ ID NO: 570790 - RNA, 64 nt, Homo Sapiens; identical to SEQ ID NO: 44823

SEQ ID NO: 570791 - RNA, 64 nt, Homo Sapiens; identical to SEQ ID NO: 44824

SEQ ID NO: 570792 - RNA, 64 nt, Homo Sapiens; identical to SEQ ID NO: 44825

SEQ ID NO: 570793 - RNA, 64 nt, Homo Sapiens; identical to SEQ ID NO: 44826

SEQ ID NO: 570794 - RNA, 64 nt, Homo Sapiens; identical to SEQ ID NO: 44827

SEQ ID NO: 570795 - RNA, 64 nt, Homo Sapiens; identical to SEQ ID NO: 44828

SEQ ID NO: 570796 - RNA, 64 nt, Homo Sapiens; identical to SEQ ID NO: 44829

SEQ ID NO: 570797 - RNA, 64 nt, Homo Sapiens; identical to SEQ ID NO: 44830

SEQ ID NO: 570798 - RNA, 64 nt, Homo Sapiens; identical to SEQ ID NO: 44831

SEQ ID NO: 570799 - RNA, 64 nt, Homo Sapiens; identical to SEQ ID NO: 44832

SEQ ID NO: 570800 - RNA, 64 nt, Homo Sapiens; identical to SEQ ID NO: 44833

SEQ ID NO: 570801 - RNA, 64 nt, Homo Sapiens; identical to SEQ ID NO: 44834

SEQ ID NO: 570802 - RNA, 64 nt, Homo Sapiens; identical to SEQ ID NO: 44835

SEQ ID NO: 570803 - RNA, 64 nt, Homo Sapiens; identical to SEQ ID NO: 44836

SEQ ID NO: 570804 - RNA, 64 nt, Homo Sapiens; identical to SEQ ID NO: 44837

SEQ ID NO: 570805 - RNA, 64 nt, Homo Sapiens; identical to SEQ ID NO: 44838

SEQ ID NO: 570806 - RNA, 64 nt, Homo Sapiens; identical to SEQ ID NO: 44839

SEQ ID NO: 570807 - RNA, 64 nt, Homo Sapiens; identical to SEQ ID NO: 44840

SEQ ID NO: 570808 - RNA, 59 nt, Homo Sapiens; identical to SEQ ID NO: 44841

SEQ ID NO: 570809 - RNA, 64 nt, Homo Sapiens; identical to SEQ ID NO: 44842

SEQ ID NO: 570810 - RNA, 64 nt, Homo Sapiens; identical to SEQ ID NO: 44843

SEQ ID NO: 570811 - RNA, 64 nt, Homo Sapiens; identical to SEQ ID NO: 44844

SEQ ID NO: 570812 - RNA, 64 nt, Homo Sapiens; identical to SEQ ID NO: 44845

SEQ ID NO: 570813 - RNA, 64 nt, Homo Sapiens; identical to SEQ ID NO: 44846

SEQ ID NO: 570814 - RNA, 64 nt, Homo Sapiens; identical to SEQ ID NO: 44847

SEQ ID NO: 570815 - RNA, 64 nt, Homo Sapiens; identical to SEQ ID NO: 44848

SEQ ID NO: 570816 - RNA, 64 nt, Homo Sapiens; identical to SEQ ID NO: 44849

SEQ ID NO: 570817 - RNA, 64 nt, Homo Sapiens; identical to SEQ ID NO: 44850

SEQ ID NO: 570818 - RNA, 64 nt, Homo Sapiens; identical to SEQ ID NO: 44851

SEQ ID NO: 570819 - RNA, 64 nt, Homo Sapiens; identical to SEQ ID NO: 44852

SEQ ID NO: 570820 - RNA, 64 nt, Homo Sapiens; identical to SEQ ID NO: 44853

SEQ ID NO: 570821 - RNA, 64 nt, Homo Sapiens; identical to SEQ ID NO: 44854

SEQ ID NO: 570822 - RNA, 64 nt, Homo Sapiens; identical to SEQ ID NO: 44855

SEQ ID NO: 570823 - RNA, 64 nt, Homo Sapiens; identical to SEQ ID NO: 44856

SEQ ID NO: 570824 - RNA, 64 nt, Homo Sapiens; identical to SEQ ID NO: 44857

SEQ ID NO: 570825 - RNA, 64 nt, Homo Sapiens; identical to SEQ ID NO: 44858

SEQ ID NO: 570826 - RNA, 64 nt, Homo Sapiens; identical to SEQ ID NO: 44859

SEQ ID NO: 570827 - RNA, 64 nt, Homo Sapiens; identical to SEQ ID NO: 44860

SEQ ID NO: 570828 - RNA, 64 nt, Homo Sapiens; identical to SEQ ID NO: 44861

SEQ ID NO: 570829 - RNA, 64 nt, Homo Sapiens; identical to SEQ ID NO: 44862

SEQ ID NO: 570830 - RNA, 64 nt, Homo Sapiens; identical to SEQ ID NO: 44863

SEQ ID NO: 570831 - RNA, 64 nt, Homo Sapiens; identical to SEQ ID NO: 44864

SEQ ID NO: 570832 - RNA, 64 nt, Homo Sapiens; identical to SEQ ID NO: 130466

SEQ ID NO: 570833 - RNA, 64 nt, Homo Sapiens; identical to SEQ ID NO: 130467

SEQ ID NO: 570834 - RNA, 64 nt, Homo Sapiens; identical to SEQ ID NO: 130468

SEQ ID NO: 570835 - RNA, 64 nt, Homo Sapiens; identical to SEQ ID NO: 130469

SEQ ID NO: 570836 - RNA, 64 nt, Homo Sapiens; identical to SEQ ID NO: 130470

SEQ ID NO: 570837 - RNA, 64 nt, Homo Sapiens; identical to SEQ ID NO: 130471

SEQ ID NO: 570838 - RNA, 64 nt, Homo Sapiens; identical to SEQ ID NO: 130472

SEQ ID NO: 570839 - RNA, 64 nt, Homo Sapiens; identical to SEQ ID NO: 130473

SEQ ID NO: 570840 - RNA, 64 nt, Homo Sapiens; identical to SEQ ID NO: 130474

SEQ ID NO: 570841 - RNA, 64 nt, Homo Sapiens; identical to SEQ ID NO: 130475

SEQ ID NO: 570842 - RNA, 64 nt, Homo Sapiens; identical to SEQ ID NO: 130476

SEQ ID NO: 570843 - RNA, 64 nt, Homo Sapiens; identical to SEQ ID NO: 130477

SEQ ID NO: 570844 - RNA, 64 nt, Homo Sapiens; identical to SEQ ID NO: 130478

SEQ ID NO: 570845 - RNA, 64 nt, Homo Sapiens; identical to SEQ ID NO: 130479

SEQ ID NO: 570846 - RNA, 64 nt, Homo Sapiens; identical to SEQ ID NO: 130480

SEQ ID NO: 570847 - RNA, 64 nt, Homo Sapiens; identical to SEQ ID NO: 130481

SEQ ID NO: 570848 - RNA, 64 nt, Homo Sapiens; identical to SEQ ID NO: 130482

SEQ ID NO: 570849 - RNA, 64 nt, Homo Sapiens; identical to SEQ ID NO: 130483

SEQ ID NO: 570850 - RNA, 64 nt, Homo Sapiens; identical to SEQ ID NO: 130484

SEQ ID NO: 570851 - RNA, 64 nt, Homo Sapiens; identical to SEQ ID NO: 130485

SEQ ID NO: 570852 - RNA, 64 nt, Homo Sapiens; identical to SEQ ID NO: 130486

SEQ ID NO: 570853 - RNA, 64 nt, Homo Sapiens; identical to SEQ ID NO: 130487

SEQ ID NO: 570854 - RNA, 64 nt, Homo Sapiens; identical to SEQ ID NO: 130488

SEQ ID NO: 570855 - RNA, 64 nt, Homo Sapiens; identical to SEQ ID NO: 130489

SEQ ID NO: 570856 - RNA, 64 nt, Homo Sapiens; identical to SEQ ID NO: 130490

SEQ ID NO: 570857 - RNA, 64 nt, Homo Sapiens; identical to SEQ ID NO: 130491

SEQ ID NO: 570858 - RNA, 64 nt, Homo Sapiens; identical to SEQ ID NO: 91216

SEQ ID NO: 570859 - RNA, 64 nt, Homo Sapiens; identical to SEQ ID NO: 91217

SEQ ID NO: 570860 - RNA, 64 nt, Homo Sapiens; identical to SEQ ID NO: 91218

SEQ ID NO: 570861 - RNA, 64 nt, Homo Sapiens; identical to SEQ ID NO: 91219

SEQ ID NO: 570862 - RNA, 64 nt, Homo Sapiens; identical to SEQ ID NO: 91220

SEQ ID NO: 570863 - RNA, 64 nt, Homo Sapiens; identical to SEQ ID NO: 91221

SEQ ID NO: 570864 - RNA, 64 nt, Homo Sapiens; identical to SEQ ID NO: 91222

SEQ ID NO: 570865 - RNA, 64 nt, Homo Sapiens; identical to SEQ ID NO: 91223

SEQ ID NO: 570866 - RNA, 64 nt, Homo Sapiens; identical to SEQ ID NO: 91224

SEQ ID NO: 570867 - RNA, 55 nt, Homo Sapiens; identical to SEQ ID NO: 91225

SEQ ID NO: 570868 - RNA, 64 nt, Homo Sapiens; identical to SEQ ID NO: 91226

SEQ ID NO: 570869 - RNA, 64 nt, Homo Sapiens; identical to SEQ ID NO: 91227

SEQ ID NO: 570870 - RNA, 64 nt, Homo Sapiens; identical to SEQ ID NO: 91228

SEQ ID NO: 570871 - RNA, 64 nt, Homo Sapiens; identical to SEQ ID NO: 91229

SEQ ID NO: 570872 - RNA, 64 nt, Homo Sapiens; identical to SEQ ID NO: 91230

SEQ ID NO: 570873 - RNA, 64 nt, Homo Sapiens; identical to SEQ ID NO: 91231

SEQ ID NO: 570874 - RNA, 64 nt, Homo Sapiens; identical to SEQ ID NO: 91232

SEQ ID NO: 570875 - RNA, 64 nt, Homo Sapiens; identical to SEQ ID NO: 91233

SEQ ID NO: 570876 - RNA, 64 nt, Homo Sapiens; identical to SEQ ID NO: 91234

SEQ ID NO: 570877 - RNA, 64 nt, Homo Sapiens; identical to SEQ ID NO: 91235

SEQ ID NO: 570878 - RNA, 64 nt, Homo Sapiens; identical to SEQ ID NO: 91236

SEQ ID NO: 570879 - RNA, 64 nt, Homo Sapiens; identical to SEQ ID NO: 91237

SEQ ID NO: 570880 - RNA, 64 nt, Homo Sapiens; identical to SEQ ID NO: 91238

SEQ ID NO: 570881 - RNA, 55 nt, Homo Sapiens; identical to SEQ ID NO: 91239

SEQ ID NO: 570882 - RNA, 64 nt, Homo Sapiens; identical to SEQ ID NO: 91240

SEQ ID NO: 570883 - RNA, 64 nt, Homo Sapiens; identical to SEQ ID NO: 91241

SEQ ID NO: 570884 - RNA, 64 nt, Homo Sapiens; identical to SEQ ID NO: 91242

SEQ ID NO: 570885 - RNA, 64 nt, Homo Sapiens; identical to SEQ ID NO: 91243

SEQ ID NO: 570886 - RNA, 64 nt, Homo Sapiens; identical to SEQ ID NO: 91244

SEQ ID NO: 570887 - RNA, 64 nt, Homo Sapiens; identical to SEQ ID NO: 91245

SEQ ID NO: 570888 - RNA, 64 nt, Homo Sapiens; identical to SEQ ID NO: 91246

SEQ ID NO: 570889 - RNA, 64 nt, Homo Sapiens; identical to SEQ ID NO: 91247

SEQ ID NO: 570890 - RNA, 64 nt, Homo Sapiens; identical to SEQ ID NO: 91248

SEQ ID NO: 570891 - RNA, 64 nt, Homo Sapiens; identical to SEQ ID NO: 91249

SEQ ID NO: 570892 - RNA, 64 nt, Homo Sapiens; identical to SEQ ID NO: 91250

SEQ ID NO: 570893 - RNA, 64 nt, Homo Sapiens; identical to SEQ ID NO: 91251

SEQ ID NO: 570894 - RNA, 64 nt, Homo Sapiens; identical to SEQ ID NO: 91252

SEQ ID NO: 570895 - RNA, 64 nt, Homo Sapiens; identical to SEQ ID NO: 91253

SEQ ID NO: 570896 - RNA, 64 nt, Homo Sapiens; identical to SEQ ID NO: 91254

SEQ ID NO: 570897 - RNA, 64 nt, Homo Sapiens; identical to SEQ ID NO: 91255

SEQ ID NO: 570898 - RNA, 64 nt, Homo Sapiens; identical to SEQ ID NO: 91256

SEQ ID NO: 570899 - RNA, 64 nt, Homo Sapiens; identical to SEQ ID NO: 91257

SEQ ID NO: 570900 - RNA, 64 nt, Homo Sapiens; identical to SEQ ID NO: 91258

SEQ ID NO: 570901 - RNA, 64 nt, Homo Sapiens; identical to SEQ ID NO: 91259

SEQ ID NO: 570902 - RNA, 64 nt, Homo Sapiens; identical to SEQ ID NO: 91260

SEQ ID NO: 570903 - RNA, 64 nt, Homo Sapiens; identical to SEQ ID NO: 91261

SEQ ID NO: 570904 - RNA, 60 nt, Homo Sapiens
ccuuuuuggguaacacaguuaauuuaccaacugauacagauaauagaauauauucauaau

SEQ ID NO: 570905 - RNA, 60 nt, Homo Sapiens
cauguguaacacuuuucagucuguggauaucugauacauuaagauuucuuuuuauaagua

SEQ ID NO: 570906 - RNA, 60 nt, Homo Sapiens
accuucccuagagggaauacagucccagggcugauacagauguuuacugaggcacuggcg

SEQ ID NO: 570907 - RNA, 60 nt, Homo Sapiens
gacagaagaauuggguagauugccucucuucugauacaagcuacccauuuucagcuucuc

SEQ ID NO: 570908 - RNA, 60 nt, Homo Sapiens
cggguuguacagaaacugguauuuuuggugcugauacaagagaaauguauuuuuaaauau

SEQ ID NO: 570909 - RNA, 60 nt, Homo Sapiens
ucagaacuuaauuuaaaagucuuaaauauucugauacaauucagcugucuucucuaccuu

SEQ ID NO: 570910 - RNA, 64 nt, Homo Sapiens; identical to SEQ ID NO: 334526

SEQ ID NO: 570911 - RNA, 64 nt, Homo Sapiens; identical to SEQ ID NO: 334527

SEQ ID NO: 570912 - RNA, 64 nt, Homo Sapiens; identical to SEQ ID NO: 334528

SEQ ID NO: 570913 - RNA, 64 nt, Homo Sapiens; identical to SEQ ID NO: 334529

SEQ ID NO: 570914 - RNA, 64 nt, Homo Sapiens; identical to SEQ ID NO: 334530

SEQ ID NO: 570915 - RNA, 64 nt, Homo Sapiens; identical to SEQ ID NO: 334531

SEQ ID NO: 570916 - RNA, 64 nt, Homo Sapiens; identical to SEQ ID NO: 334532

SEQ ID NO: 570917 - RNA, 64 nt, Homo Sapiens; identical to SEQ ID NO: 334533

SEQ ID NO: 570918 - RNA, 64 nt, Homo Sapiens; identical to SEQ ID NO: 334534

SEQ ID NO: 570919 - RNA, 64 nt, Homo Sapiens; identical to SEQ ID NO: 334535

SEQ ID NO: 570920 - RNA, 64 nt, Homo Sapiens; identical to SEQ ID NO: 334536

SEQ ID NO: 570921 - RNA, 64 nt, Homo Sapiens; identical to SEQ ID NO: 334537

SEQ ID NO: 570922 - RNA, 64 nt, Homo Sapiens; identical to SEQ ID NO: 334538

SEQ ID NO: 570923 - RNA, 64 nt, Homo Sapiens; identical to SEQ ID NO: 334539

SEQ ID NO: 570924 - RNA, 64 nt, Homo Sapiens; identical to SEQ ID NO: 334540

SEQ ID NO: 570925 - RNA, 64 nt, Homo Sapiens; identical to SEQ ID NO: 334541

SEQ ID NO: 570926 - RNA, 64 nt, Homo Sapiens; identical to SEQ ID NO: 334542

SEQ ID NO: 570927 - RNA, 64 nt, Homo Sapiens; identical to SEQ ID NO: 334543

SEQ ID NO: 570928 - RNA, 64 nt, Homo Sapiens; identical to SEQ ID NO: 334544

SEQ ID NO: 570929 - RNA, 64 nt, Homo Sapiens; identical to SEQ ID NO: 334545

SEQ ID NO: 570930 - RNA, 64 nt, Homo Sapiens; identical to SEQ ID NO: 334546

SEQ ID NO: 570931 - RNA, 64 nt, Homo Sapiens; identical to SEQ ID NO: 334547

SEQ ID NO: 570932 - RNA, 64 nt, Homo Sapiens; identical to SEQ ID NO: 334548

SEQ ID NO: 570933 - RNA, 64 nt, Homo Sapiens; identical to SEQ ID NO: 334549

SEQ ID NO: 570934 - RNA, 64 nt, Homo Sapiens; identical to SEQ ID NO: 334550

SEQ ID NO: 570935 - RNA, 64 nt, Homo Sapiens; identical to SEQ ID NO: 334550

SEQ ID NO: 570936 - RNA, 64 nt, Homo Sapiens; identical to SEQ ID NO: 334550

SEQ ID NO: 570937 - RNA, 64 nt, Homo Sapiens; identical to SEQ ID NO: 334553

SEQ ID NO: 570938 - RNA, 64 nt, Homo Sapiens; identical to SEQ ID NO: 334554

SEQ ID NO: 570939 - RNA, 64 nt, Homo Sapiens; identical to SEQ ID NO: 334555

SEQ ID NO: 570940 - RNA, 64 nt, Homo Sapiens; identical to SEQ ID NO: 64824

SEQ ID NO: 570941 - RNA, 64 nt, Homo Sapiens; identical to SEQ ID NO: 64825

SEQ ID NO: 570942 - RNA, 64 nt, Homo Sapiens; identical to SEQ ID NO: 64826

SEQ ID NO: 570943 - RNA, 64 nt, Homo Sapiens; identical to SEQ ID NO: 64827

SEQ ID NO: 570944 - RNA, 64 nt, Homo Sapiens; identical to SEQ ID NO: 64828

SEQ ID NO: 570945 - RNA, 64 nt, Homo Sapiens; identical to SEQ ID NO: 64829

SEQ ID NO: 570946 - RNA, 64 nt, Homo Sapiens; identical to SEQ ID NO: 64830

SEQ ID NO: 570947 - RNA, 64 nt, Homo Sapiens; identical to SEQ ID NO: 64831

SEQ ID NO: 570948 - RNA, 64 nt, Homo Sapiens; identical to SEQ ID NO: 64832

SEQ ID NO: 570949 - RNA, 64 nt, Homo Sapiens; identical to SEQ ID NO: 64833

SEQ ID NO: 570950 - RNA, 64 nt, Homo Sapiens; identical to SEQ ID NO: 64834

SEQ ID NO: 570951 - RNA, 64 nt, Homo Sapiens; identical to SEQ ID NO: 64835

SEQ ID NO: 570952 - RNA, 64 nt, Homo Sapiens; identical to SEQ ID NO: 64836

SEQ ID NO: 570953 - RNA, 64 nt, Homo Sapiens; identical to SEQ ID NO: 64837

SEQ ID NO: 570954 - RNA, 64 nt, Homo Sapiens; identical to SEQ ID NO: 64838

SEQ ID NO: 570955 - RNA, 64 nt, Homo Sapiens; identical to SEQ ID NO: 64839

SEQ ID NO: 570956 - RNA, 64 nt, Homo Sapiens; identical to SEQ ID NO: 64840

SEQ ID NO: 570957 - RNA, 64 nt, Homo Sapiens; identical to SEQ ID NO: 64841

SEQ ID NO: 570958 - RNA, 64 nt, Homo Sapiens; identical to SEQ ID NO: 64842

SEQ ID NO: 570959 - RNA, 64 nt, Homo Sapiens; identical to SEQ ID NO: 64843

SEQ ID NO: 570960 - RNA, 64 nt, Homo Sapiens; identical to SEQ ID NO: 64844

SEQ ID NO: 570961 - RNA, 64 nt, Homo Sapiens; identical to SEQ ID NO: 64845

SEQ ID NO: 570962 - RNA, 64 nt, Homo Sapiens; identical to SEQ ID NO: 64846

SEQ ID NO: 570963 - RNA, 64 nt, Homo Sapiens; identical to SEQ ID NO: 64847

SEQ ID NO: 570964 - RNA, 64 nt, Homo Sapiens; identical to SEQ ID NO: 64848

SEQ ID NO: 570965 - RNA, 64 nt, Homo Sapiens; identical to SEQ ID NO: 64849

SEQ ID NO: 570966 - RNA, 64 nt, Homo Sapiens; identical to SEQ ID NO: 64850

SEQ ID NO: 570967 - RNA, 64 nt, Homo Sapiens; identical to SEQ ID NO: 64851

SEQ ID NO: 570968 - RNA, 64 nt, Homo Sapiens; identical to SEQ ID NO: 64852

SEQ ID NO: 570969 - RNA, 64 nt, Homo Sapiens; identical to SEQ ID NO: 64853

SEQ ID NO: 570970 - RNA, 64 nt, Homo Sapiens; identical to SEQ ID NO: 64854

SEQ ID NO: 570971 - RNA, 64 nt, Homo Sapiens; identical to SEQ ID NO: 64855

SEQ ID NO: 570972 - RNA, 64 nt, Homo Sapiens; identical to SEQ ID NO: 64856

SEQ ID NO: 570973 - RNA, 64 nt, Homo Sapiens; identical to SEQ ID NO: 531886

SEQ ID NO: 570974 - RNA, 64 nt, Homo Sapiens; identical to SEQ ID NO: 531887

SEQ ID NO: 570975 - RNA, 64 nt, Homo Sapiens; identical to SEQ ID NO: 531888

SEQ ID NO: 570976 - RNA, 64 nt, Homo Sapiens; identical to SEQ ID NO: 531889

SEQ ID NO: 570977 - RNA, 64 nt, Homo Sapiens; identical to SEQ ID NO: 531890

SEQ ID NO: 570978 - RNA, 64 nt, Homo Sapiens; identical to SEQ ID NO: 531891

SEQ ID NO: 570979 - RNA, 64 nt, Homo Sapiens; identical to SEQ ID NO: 531892

SEQ ID NO: 570980 - RNA, 64 nt, Homo Sapiens; identical to SEQ ID NO: 531893

SEQ ID NO: 570981 - RNA, 64 nt, Homo Sapiens; identical to SEQ ID NO: 531894

SEQ ID NO: 570982 - RNA, 64 nt, Homo Sapiens; identical to SEQ ID NO: 531895

SEQ ID NO: 570983 - RNA, 64 nt, Homo Sapiens; identical to SEQ ID NO: 531896

SEQ ID NO: 570984 - RNA, 64 nt, Homo Sapiens; identical to SEQ ID NO: 531897

SEQ ID NO: 570985 - RNA, 64 nt, Homo Sapiens; identical to SEQ ID NO: 531898

SEQ ID NO: 570986 - RNA, 64 nt, Homo Sapiens; identical to SEQ ID NO: 531899

SEQ ID NO: 570987 - RNA, 64 nt, Homo Sapiens; identical to SEQ ID NO: 531900

SEQ ID NO: 570988 - RNA, 64 nt, Homo Sapiens; identical to SEQ ID NO: 531901

SEQ ID NO: 570989 - RNA, 64 nt, Homo Sapiens; identical to SEQ ID NO: 531902

SEQ ID NO: 570990 - RNA, 64 nt, Homo Sapiens; identical to SEQ ID NO: 531903

SEQ ID NO: 570991 - RNA, 64 nt, Homo Sapiens; identical to SEQ ID NO: 531904

SEQ ID NO: 570992 - RNA, 64 nt, Homo Sapiens; identical to SEQ ID NO: 531905

SEQ ID NO: 570993 - RNA, 64 nt, Homo Sapiens; identical to SEQ ID NO: 531906

SEQ ID NO: 570994 - RNA, 64 nt, Homo Sapiens; identical to SEQ ID NO: 531907

SEQ ID NO: 570995 - RNA, 64 nt, Homo Sapiens; identical to SEQ ID NO: 531908

SEQ ID NO: 570996 - RNA, 64 nt, Homo Sapiens; identical to SEQ ID NO: 531909

SEQ ID NO: 570997 - RNA, 64 nt, Homo Sapiens; identical to SEQ ID NO: 531910

SEQ ID NO: 570998 - RNA, 64 nt, Homo Sapiens; identical to SEQ ID NO: 531911

SEQ ID NO: 570999 - RNA, 64 nt, Homo Sapiens; identical to SEQ ID NO: 531912

SEQ ID NO: 571000 - RNA, 64 nt, Homo Sapiens; identical to SEQ ID NO: 531913

SEQ ID NO: 571001 - RNA, 64 nt, Homo Sapiens; identical to SEQ ID NO: 531914

SEQ ID NO: 571002 - RNA, 64 nt, Homo Sapiens; identical to SEQ ID NO: 531915

SEQ ID NO: 571003 - RNA, 64 nt, Homo Sapiens; identical to SEQ ID NO: 531916

SEQ ID NO: 571004 - RNA, 64 nt, Homo Sapiens; identical to SEQ ID NO: 531917

SEQ ID NO: 571005 - RNA, 64 nt, Homo Sapiens; identical to SEQ ID NO: 531918

SEQ ID NO: 571006 - RNA, 64 nt, Homo Sapiens; identical to SEQ ID NO: 531919

SEQ ID NO: 571007 - RNA, 64 nt, Homo Sapiens; identical to SEQ ID NO: 531920

SEQ ID NO: 571008 - RNA, 64 nt, Homo Sapiens; identical to SEQ ID NO: 531921

SEQ ID NO: 571009 - RNA, 64 nt, Homo Sapiens; identical to SEQ ID NO: 531922

SEQ ID NO: 571010 - RNA, 64 nt, Homo Sapiens; identical to SEQ ID NO: 211201

SEQ ID NO: 571011 - RNA, 64 nt, Homo Sapiens; identical to SEQ ID NO: 211202

SEQ ID NO: 571012 - RNA, 64 nt, Homo Sapiens; identical to SEQ ID NO: 211203

SEQ ID NO: 571013 - RNA, 64 nt, Homo Sapiens; identical to SEQ ID NO: 211204

SEQ ID NO: 571014 - RNA, 64 nt, Homo Sapiens; identical to SEQ ID NO: 211205

SEQ ID NO: 571015 - RNA, 64 nt, Homo Sapiens; identical to SEQ ID NO: 211206

SEQ ID NO: 571016 - RNA, 64 nt, Homo Sapiens; identical to SEQ ID NO: 61390

SEQ ID NO: 571017 - RNA, 64 nt, Homo Sapiens; identical to SEQ ID NO: 61391

SEQ ID NO: 571018 - RNA, 64 nt, Homo Sapiens; identical to SEQ ID NO: 61392

SEQ ID NO: 571019 - RNA, 64 nt, Homo Sapiens; identical to SEQ ID NO: 61393

SEQ ID NO: 571020 - RNA, 64 nt, Homo Sapiens; identical to SEQ ID NO: 61394

SEQ ID NO: 571021 - RNA, 64 nt, Homo Sapiens; identical to SEQ ID NO: 61395

SEQ ID NO: 571022 - RNA, 64 nt, Homo Sapiens; identical to SEQ ID NO: 61396

SEQ ID NO: 571023 - RNA, 64 nt, Homo Sapiens; identical to SEQ ID NO: 61397

SEQ ID NO: 571024 - RNA, 64 nt, Homo Sapiens; identical to SEQ ID NO: 61398

SEQ ID NO: 571025 - RNA, 64 nt, Homo Sapiens; identical to SEQ ID NO: 61399

SEQ ID NO: 571026 - RNA, 64 nt, Homo Sapiens; identical to SEQ ID NO: 61400

SEQ ID NO: 571027 - RNA, 64 nt, Homo Sapiens; identical to SEQ ID NO: 61401

SEQ ID NO: 571028 - RNA, 64 nt, Homo Sapiens; identical to SEQ ID NO: 61402

SEQ ID NO: 571029 - RNA, 64 nt, Homo Sapiens; identical to SEQ ID NO: 61403

SEQ ID NO: 571030 - RNA, 64 nt, Homo Sapiens; identical to SEQ ID NO: 61404

SEQ ID NO: 571031 - RNA, 64 nt, Homo Sapiens; identical to SEQ ID NO: 61405

SEQ ID NO: 571032 - RNA, 64 nt, Homo Sapiens; identical to SEQ ID NO: 61406

SEQ ID NO: 571033 - RNA, 64 nt, Homo Sapiens; identical to SEQ ID NO: 61407

SEQ ID NO: 571034 - RNA, 64 nt, Homo Sapiens; identical to SEQ ID NO: 61406

SEQ ID NO: 571035 - RNA, 64 nt, Homo Sapiens; identical to SEQ ID NO: 61409

SEQ ID NO: 571036 - RNA, 64 nt, Homo Sapiens; identical to SEQ ID NO: 61410

SEQ ID NO: 571037 - RNA, 64 nt, Homo Sapiens; identical to SEQ ID NO: 61411

SEQ ID NO: 571038 - RNA, 64 nt, Homo Sapiens; identical to SEQ ID NO: 61412

SEQ ID NO: 571039 - RNA, 64 nt, Homo Sapiens; identical to SEQ ID NO: 61413

SEQ ID NO: 571040 - RNA, 64 nt, Homo Sapiens; identical to SEQ ID NO: 61414

SEQ ID NO: 571041 - RNA, 64 nt, Homo Sapiens; identical to SEQ ID NO: 61415

SEQ ID NO: 571042 - RNA, 64 nt, Homo Sapiens; identical to SEQ ID NO: 61416

SEQ ID NO: 571043 - RNA, 64 nt, Homo Sapiens; identical to SEQ ID NO: 189185

SEQ ID NO: 571044 - RNA, 64 nt, Homo Sapiens; identical to SEQ ID NO: 189186

SEQ ID NO: 571045 - RNA, 64 nt, Homo Sapiens; identical to SEQ ID NO: 189187

SEQ ID NO: 571046 - RNA, 64 nt, Homo Sapiens; identical to SEQ ID NO: 189188

SEQ ID NO: 571047 - RNA, 64 nt, Homo Sapiens; identical to SEQ ID NO: 189189

SEQ ID NO: 571048 - RNA, 64 nt, Homo Sapiens; identical to SEQ ID NO: 189190

SEQ ID NO: 571049 - RNA, 64 nt, Homo Sapiens; identical to SEQ ID NO: 189191

SEQ ID NO: 571050 - RNA, 64 nt, Homo Sapiens; identical to SEQ ID NO: 189192

SEQ ID NO: 571051 - RNA, 64 nt, Homo Sapiens; identical to SEQ ID NO: 189193

SEQ ID NO: 571052 - RNA, 64 nt, Homo Sapiens; identical to SEQ ID NO: 189194

SEQ ID NO: 571053 - RNA, 64 nt, Homo Sapiens; identical to SEQ ID NO: 189195

SEQ ID NO: 571054 - RNA, 64 nt, Homo Sapiens; identical to SEQ ID NO: 189196

SEQ ID NO: 571055 - RNA, 64 nt, Homo Sapiens; identical to SEQ ID NO: 189197

SEQ ID NO: 571056 - RNA, 64 nt, Homo Sapiens; identical to SEQ ID NO: 189198

SEQ ID NO: 571057 - RNA, 64 nt, Homo Sapiens; identical to SEQ ID NO: 189199

SEQ ID NO: 571058 - RNA, 64 nt, Homo Sapiens; identical to SEQ ID NO: 189200

SEQ ID NO: 571059 - RNA, 64 nt, Homo Sapiens; identical to SEQ ID NO: 189201

SEQ ID NO: 571060 - RNA, 64 nt, Homo Sapiens; identical to SEQ ID NO: 189202

SEQ ID NO: 571061 - RNA, 64 nt, Homo Sapiens; identical to SEQ ID NO: 189203

SEQ ID NO: 571062 - RNA, 64 nt, Homo Sapiens; identical to SEQ ID NO: 189204

SEQ ID NO: 571063 - RNA, 64 nt, Homo Sapiens; identical to SEQ ID NO: 189205

SEQ ID NO: 571064 - RNA, 64 nt, Homo Sapiens; identical to SEQ ID NO: 189206

SEQ ID NO: 571065 - RNA, 64 nt, Homo Sapiens; identical to SEQ ID NO: 189207

SEQ ID NO: 571066 - RNA, 64 nt, Homo Sapiens; identical to SEQ ID NO: 189208

SEQ ID NO: 571067 - RNA, 64 nt, Homo Sapiens; identical to SEQ ID NO: 189209

SEQ ID NO: 571068 - RNA, 64 nt, Homo Sapiens; identical to SEQ ID NO: 189210

SEQ ID NO: 571069 - RNA, 64 nt, Homo Sapiens; identical to SEQ ID NO: 189211

SEQ ID NO: 571070 - RNA, 64 nt, Homo Sapiens; identical to SEQ ID NO: 189212

SEQ ID NO: 571071 - RNA, 64 nt, Homo Sapiens; identical to SEQ ID NO: 189213

SEQ ID NO: 571072 - RNA, 50 nt, Homo Sapiens; identical to SEQ ID NO: 189214

SEQ ID NO: 571073 - RNA, 64 nt, Homo Sapiens; identical to SEQ ID NO: 189215

SEQ ID NO: 571074 - RNA, 64 nt, Homo Sapiens; identical to SEQ ID NO: 189216

SEQ ID NO: 571075 - RNA, 64 nt, Homo Sapiens; identical to SEQ ID NO: 189217

SEQ ID NO: 571076 - RNA, 64 nt, Homo Sapiens; identical to SEQ ID NO: 189218

SEQ ID NO: 571077 - RNA, 64 nt, Homo Sapiens; identical to SEQ ID NO: 189219

SEQ ID NO: 571078 - RNA, 64 nt, Homo Sapiens; identical to SEQ ID NO: 189220

SEQ ID NO: 571079 - RNA, 64 nt, Homo Sapiens; identical to SEQ ID NO: 189221

SEQ ID NO: 571080 - RNA, 64 nt, Homo Sapiens; identical to SEQ ID NO: 189222

SEQ ID NO: 571081 - RNA, 64 nt, Homo Sapiens; identical to SEQ ID NO: 189223

SEQ ID NO: 571082 - RNA, 64 nt, Homo Sapiens; identical to SEQ ID NO: 189224

SEQ ID NO: 571083 - RNA, 64 nt, Homo Sapiens; identical to SEQ ID NO: 189225

SEQ ID NO: 571084 - RNA, 64 nt, Homo Sapiens; identical to SEQ ID NO: 189226

SEQ ID NO: 571085 - RNA, 64 nt, Homo Sapiens; identical to SEQ ID NO: 189227

SEQ ID NO: 571086 - RNA, 64 nt, Homo Sapiens; identical to SEQ ID NO: 189228

SEQ ID NO: 571087 - RNA, 64 nt, Homo Sapiens; identical to SEQ ID NO: 189229

SEQ ID NO: 571088 - RNA, 64 nt, Homo Sapiens; identical to SEQ ID NO: 189230

SEQ ID NO: 571089 - RNA, 64 nt, Homo Sapiens; identical to SEQ ID NO: 189231

SEQ ID NO: 571090 - RNA, 64 nt, Homo Sapiens; identical to SEQ ID NO: 189232

SEQ ID NO: 571091 - RNA, 64 nt, Homo Sapiens; identical to SEQ ID NO: 189233

SEQ ID NO: 571092 - RNA, 64 nt, Homo Sapiens; identical to SEQ ID NO: 189234

SEQ ID NO: 571093 - RNA, 64 nt, Homo Sapiens; identical to SEQ ID NO: 189235

SEQ ID NO: 571094 - RNA, 64 nt, Homo Sapiens; identical to SEQ ID NO: 189236

SEQ ID NO: 571095 - RNA, 64 nt, Homo Sapiens; identical to SEQ ID NO: 189237

SEQ ID NO: 571096 - RNA, 64 nt, Homo Sapiens; identical to SEQ ID NO: 189238

SEQ ID NO: 571097 - RNA, 64 nt, Homo Sapiens; identical to SEQ ID NO: 189239

SEQ ID NO: 571098 - RNA, 64 nt, Homo Sapiens; identical to SEQ ID NO: 189240

SEQ ID NO: 571099 - RNA, 64 nt, Homo Sapiens; identical to SEQ ID NO: 189241

SEQ ID NO: 571100 - RNA, 64 nt, Homo Sapiens; identical to SEQ ID NO: 189242

SEQ ID NO: 571101 - RNA, 64 nt, Homo Sapiens; identical to SEQ ID NO: 189243

SEQ ID NO: 571102 - RNA, 64 nt, Homo Sapiens; identical to SEQ ID NO: 189244

SEQ ID NO: 571103 - RNA, 64 nt, Homo Sapiens; identical to SEQ ID NO: 189245

SEQ ID NO: 571104 - RNA, 64 nt, Homo Sapiens; identical to SEQ ID NO: 189246

SEQ ID NO: 571105 - RNA, 64 nt, Homo Sapiens; identical to SEQ ID NO: 189247

SEQ ID NO: 571106 - RNA, 64 nt, Homo Sapiens; identical to SEQ ID NO: 189248

SEQ ID NO: 571107 - RNA, 64 nt, Homo Sapiens; identical to SEQ ID NO: 189249

SEQ ID NO: 571108 - RNA, 64 nt, Homo Sapiens; identical to SEQ ID NO: 189250

SEQ ID NO: 571109 - RNA, 64 nt, Homo Sapiens; identical to SEQ ID NO: 189251

SEQ ID NO: 571110 - RNA, 64 nt, Homo Sapiens; identical to SEQ ID NO: 189252

SEQ ID NO: 571111 - RNA, 64 nt, Homo Sapiens; identical to SEQ ID NO: 189253

SEQ ID NO: 571112 - RNA, 64 nt, Homo Sapiens; identical to SEQ ID NO: 189254

SEQ ID NO: 571113 - RNA, 64 nt, Homo Sapiens; identical to SEQ ID NO: 189255

SEQ ID NO: 571114 - RNA, 64 nt, Homo Sapiens; identical to SEQ ID NO: 189256

SEQ ID NO: 571115 - RNA, 64 nt, Homo Sapiens; identical to SEQ ID NO: 189257

SEQ ID NO: 571116 - RNA, 64 nt, Homo Sapiens; identical to SEQ ID NO: 189258

SEQ ID NO: 571117 - RNA, 64 nt, Homo Sapiens; identical to SEQ ID NO: 83829

SEQ ID NO: 571118 - RNA, 64 nt, Homo Sapiens; identical to SEQ ID NO: 83830

SEQ ID NO: 571119 - RNA, 64 nt, Homo Sapiens; identical to SEQ ID NO: 83831

SEQ ID NO: 571120 - RNA, 64 nt, Homo Sapiens; identical to SEQ ID NO: 83832

SEQ ID NO: 571121 - RNA, 64 nt, Homo Sapiens; identical to SEQ ID NO: 83833

SEQ ID NO: 571122 - RNA, 64 nt, Homo Sapiens; identical to SEQ ID NO: 83834

SEQ ID NO: 571123 - RNA, 64 nt, Homo Sapiens; identical to SEQ ID NO: 83835

SEQ ID NO: 571124 - RNA, 64 nt, Homo Sapiens; identical to SEQ ID NO: 83836

SEQ ID NO: 571125 - RNA, 64 nt, Homo Sapiens; identical to SEQ ID NO: 83837

SEQ ID NO: 571126 - RNA, 64 nt, Homo Sapiens; identical to SEQ ID NO: 83838

SEQ ID NO: 571127 - RNA, 64 nt, Homo Sapiens; identical to SEQ ID NO: 83839

SEQ ID NO: 571128 - RNA, 64 nt, Homo Sapiens; identical to SEQ ID NO: 83840

SEQ ID NO: 571129 - RNA, 64 nt, Homo Sapiens; identical to SEQ ID NO: 83841

SEQ ID NO: 571130 - RNA, 64 nt, Homo Sapiens; identical to SEQ ID NO: 83842

SEQ ID NO: 571131 - RNA, 64 nt, Homo Sapiens; identical to SEQ ID NO: 83843

SEQ ID NO: 571132 - RNA, 64 nt, Homo Sapiens; identical to SEQ ID NO: 83844

SEQ ID NO: 571133 - RNA, 64 nt, Homo Sapiens; identical to SEQ ID NO: 83845

SEQ ID NO: 571134 - RNA, 64 nt, Homo Sapiens; identical to SEQ ID NO: 83846

SEQ ID NO: 571135 - RNA, 64 nt, Homo Sapiens; identical to SEQ ID NO: 83847

SEQ ID NO: 571136 - RNA, 64 nt, Homo Sapiens; identical to SEQ ID NO: 83848

SEQ ID NO: 571137 - RNA, 64 nt, Homo Sapiens; identical to SEQ ID NO: 83849

SEQ ID NO: 571138 - RNA, 64 nt, Homo Sapiens; identical to SEQ ID NO: 83850

SEQ ID NO: 571139 - RNA, 64 nt, Homo Sapiens; identical to SEQ ID NO: 83851

SEQ ID NO: 571140 - RNA, 64 nt, Homo Sapiens; identical to SEQ ID NO: 83852

SEQ ID NO: 571141 - RNA, 64 nt, Homo Sapiens; identical to SEQ ID NO: 83853

SEQ ID NO: 571142 - RNA, 64 nt, Homo Sapiens; identical to SEQ ID NO: 83854

SEQ ID NO: 571143 - RNA, 64 nt, Homo Sapiens; identical to SEQ ID NO: 83855

SEQ ID NO: 571144 - RNA, 64 nt, Homo Sapiens; identical to SEQ ID NO: 83856

SEQ ID NO: 571145 - RNA, 64 nt, Homo Sapiens; identical to SEQ ID NO: 83857

SEQ ID NO: 571146 - RNA, 64 nt, Homo Sapiens; identical to SEQ ID NO: 83858

SEQ ID NO: 571147 - RNA, 64 nt, Homo Sapiens; identical to SEQ ID NO: 83859

SEQ ID NO: 571148 - RNA, 64 nt, Homo Sapiens; identical to SEQ ID NO: 83860

SEQ ID NO: 571149 - RNA, 64 nt, Homo Sapiens; identical to SEQ ID NO: 83861

SEQ ID NO: 571150 - RNA, 64 nt, Homo Sapiens; identical to SEQ ID NO: 83862

SEQ ID NO: 571151 - RNA, 64 nt, Homo Sapiens; identical to SEQ ID NO: 83863

SEQ ID NO: 571152 - RNA, 64 nt, Homo Sapiens; identical to SEQ ID NO: 83864

SEQ ID NO: 571153 - RNA, 64 nt, Homo Sapiens; identical to SEQ ID NO: 83865

SEQ ID NO: 571154 - RNA, 64 nt, Homo Sapiens; identical to SEQ ID NO: 83866

SEQ ID NO: 571155 - RNA, 64 nt, Homo Sapiens; identical to SEQ ID NO: 83867

SEQ ID NO: 571156 - RNA, 64 nt, Homo Sapiens; identical to SEQ ID NO: 83868

SEQ ID NO: 571157 - RNA, 64 nt, Homo Sapiens; identical to SEQ ID NO: 83869

SEQ ID NO: 571158 - RNA, 64 nt, Homo Sapiens; identical to SEQ ID NO: 83870

SEQ ID NO: 571159 - RNA, 64 nt, Homo Sapiens; identical to SEQ ID NO: 83871

SEQ ID NO: 571160 - RNA, 64 nt, Homo Sapiens; identical to SEQ ID NO: 83872

SEQ ID NO: 571161 - RNA, 64 nt, Homo Sapiens; identical to SEQ ID NO: 83873

SEQ ID NO: 571162 - RNA, 64 nt, Homo Sapiens; identical to SEQ ID NO: 83874

SEQ ID NO: 571163 - RNA, 64 nt, Homo Sapiens; identical to SEQ ID NO: 83875

SEQ ID NO: 571164 - RNA, 64 nt, Homo Sapiens; identical to SEQ ID NO: 83876

SEQ ID NO: 571165 - RNA, 64 nt, Homo Sapiens; identical to SEQ ID NO: 83877

SEQ ID NO: 571166 - RNA, 64 nt, Homo Sapiens; identical to SEQ ID NO: 83878

SEQ ID NO: 571167 - RNA, 64 nt, Homo Sapiens; identical to SEQ ID NO: 83879

SEQ ID NO: 571168 - RNA, 64 nt, Homo Sapiens; identical to SEQ ID NO: 83880

SEQ ID NO: 571169 - RNA, 64 nt, Homo Sapiens; identical to SEQ ID NO: 83881

SEQ ID NO: 571170 - RNA, 64 nt, Homo Sapiens; identical to SEQ ID NO: 284290

SEQ ID NO: 571171 - RNA, 64 nt, Homo Sapiens; identical to SEQ ID NO: 284291

SEQ ID NO: 571172 - RNA, 64 nt, Homo Sapiens; identical to SEQ ID NO: 284292

SEQ ID NO: 571173 - RNA, 64 nt, Homo Sapiens; identical to SEQ ID NO: 284293

SEQ ID NO: 571174 - RNA, 64 nt, Homo Sapiens; identical to SEQ ID NO: 284294

SEQ ID NO: 571175 - RNA, 64 nt, Homo Sapiens; identical to SEQ ID NO: 284295

SEQ ID NO: 571176 - RNA, 64 nt, Homo Sapiens; identical to SEQ ID NO: 284296

SEQ ID NO: 571177 - RNA, 64 nt, Homo Sapiens; identical to SEQ ID NO: 284297

SEQ ID NO: 571178 - RNA, 64 nt, Homo Sapiens; identical to SEQ ID NO: 284298

SEQ ID NO: 571179 - RNA, 64 nt, Homo Sapiens; identical to SEQ ID NO: 284299

SEQ ID NO: 571180 - RNA, 64 nt, Homo Sapiens; identical to SEQ ID NO: 284300

SEQ ID NO: 571181 - RNA, 64 nt, Homo Sapiens; identical to SEQ ID NO: 284301

SEQ ID NO: 571182 - RNA, 64 nt, Homo Sapiens; identical to SEQ ID NO: 284302

SEQ ID NO: 571183 - RNA, 64 nt, Homo Sapiens; identical to SEQ ID NO: 284303

SEQ ID NO: 571184 - RNA, 64 nt, Homo Sapiens; identical to SEQ ID NO: 284304

SEQ ID NO: 571185 - RNA, 64 nt, Homo Sapiens; identical to SEQ ID NO: 284305

SEQ ID NO: 571186 - RNA, 64 nt, Homo Sapiens; identical to SEQ ID NO: 284306

SEQ ID NO: 571187 - RNA, 64 nt, Homo Sapiens; identical to SEQ ID NO: 284307

SEQ ID NO: 571188 - RNA, 64 nt, Homo Sapiens; identical to SEQ ID NO: 284308

SEQ ID NO: 571189 - RNA, 64 nt, Homo Sapiens; identical to SEQ ID NO: 284309

SEQ ID NO: 571190 - RNA, 64 nt, Homo Sapiens; identical to SEQ ID NO: 284310

SEQ ID NO: 571191 - RNA, 64 nt, Homo Sapiens; identical to SEQ ID NO: 284311

SEQ ID NO: 571192 - RNA, 64 nt, Homo Sapiens; identical to SEQ ID NO: 284312

SEQ ID NO: 571193 - RNA, 64 nt, Homo Sapiens; identical to SEQ ID NO: 284313

SEQ ID NO: 571194 - RNA, 64 nt, Homo Sapiens; identical to SEQ ID NO: 284314

SEQ ID NO: 571195 - RNA, 64 nt, Homo Sapiens; identical to SEQ ID NO: 284315

SEQ ID NO: 571196 - RNA, 64 nt, Homo Sapiens; identical to SEQ ID NO: 284316

SEQ ID NO: 571197 - RNA, 64 nt, Homo Sapiens; identical to SEQ ID NO: 284317

SEQ ID NO: 571198 - RNA, 64 nt, Homo Sapiens; identical to SEQ ID NO: 284318

SEQ ID NO: 571199 - RNA, 64 nt, Homo Sapiens; identical to SEQ ID NO: 284319

SEQ ID NO: 571200 - RNA, 64 nt, Homo Sapiens; identical to SEQ ID NO: 284320

SEQ ID NO: 571201 - RNA, 64 nt, Homo Sapiens; identical to SEQ ID NO: 284321

SEQ ID NO: 571202 - RNA, 64 nt, Homo Sapiens; identical to SEQ ID NO: 284322

SEQ ID NO: 571203 - RNA, 64 nt, Homo Sapiens; identical to SEQ ID NO: 284323

SEQ ID NO: 571204 - RNA, 64 nt, Homo Sapiens; identical to SEQ ID NO: 284324

SEQ ID NO: 571205 - RNA, 64 nt, Homo Sapiens; identical to SEQ ID NO: 284325

SEQ ID NO: 571206 - RNA, 64 nt, Homo Sapiens; identical to SEQ ID NO: 284326

SEQ ID NO: 571207 - RNA, 64 nt, Homo Sapiens; identical to SEQ ID NO: 284327

SEQ ID NO: 571208 - RNA, 64 nt, Homo Sapiens; identical to SEQ ID NO: 284328

SEQ ID NO: 571209 - RNA, 64 nt, Homo Sapiens; identical to SEQ ID NO: 284329

SEQ ID NO: 571210 - RNA, 64 nt, Homo Sapiens; identical to SEQ ID NO: 284330

SEQ ID NO: 571211 - RNA, 64 nt, Homo Sapiens; identical to SEQ ID NO: 284331

SEQ ID NO: 571212 - RNA, 64 nt, Homo Sapiens; identical to SEQ ID NO: 284332

SEQ ID NO: 571213 - RNA, 64 nt, Homo Sapiens; identical to SEQ ID NO: 284333

SEQ ID NO: 571214 - RNA, 50 nt, Homo Sapiens; identical to SEQ ID NO: 284334

SEQ ID NO: 571215 - RNA, 64 nt, Homo Sapiens; identical to SEQ ID NO: 284335

SEQ ID NO: 571216 - RNA, 64 nt, Homo Sapiens; identical to SEQ ID NO: 284336

SEQ ID NO: 571217 - RNA, 64 nt, Homo Sapiens; identical to SEQ ID NO: 284337

SEQ ID NO: 571218 - RNA, 64 nt, Homo Sapiens; identical to SEQ ID NO: 284338

SEQ ID NO: 571219 - RNA, 64 nt, Homo Sapiens; identical to SEQ ID NO: 284339

SEQ ID NO: 571220 - RNA, 64 nt, Homo Sapiens; identical to SEQ ID NO: 284340

SEQ ID NO: 571221 - RNA, 64 nt, Homo Sapiens; identical to SEQ ID NO: 284341

SEQ ID NO: 571222 - RNA, 64 nt, Homo Sapiens; identical to SEQ ID NO: 284342

SEQ ID NO: 571223 - RNA, 64 nt, Homo Sapiens; identical to SEQ ID NO: 284343

SEQ ID NO: 571224 - RNA, 64 nt, Homo Sapiens; identical to SEQ ID NO: 284344

SEQ ID NO: 571225 - RNA, 64 nt, Homo Sapiens; identical to SEQ ID NO: 284345

SEQ ID NO: 571226 - RNA, 64 nt, Homo Sapiens; identical to SEQ ID NO: 284346

SEQ ID NO: 571227 - RNA, 64 nt, Homo Sapiens; identical to SEQ ID NO: 284347

SEQ ID NO: 571228 - RNA, 64 nt, Homo Sapiens; identical to SEQ ID NO: 284348

SEQ ID NO: 571229 - RNA, 64 nt, Homo Sapiens; identical to SEQ ID NO: 284349

SEQ ID NO: 571230 - RNA, 64 nt, Homo Sapiens; identical to SEQ ID NO: 284350

SEQ ID NO: 571231 - RNA, 64 nt, Homo Sapiens; identical to SEQ ID NO: 284351

SEQ ID NO: 571232 - RNA, 64 nt, Homo Sapiens; identical to SEQ ID NO: 284352

SEQ ID NO: 571233 - RNA, 64 nt, Homo Sapiens; identical to SEQ ID NO: 284353

SEQ ID NO: 571234 - RNA, 65 nt, Homo Sapiens
uguucuuaaugcagccacuauaacuugauaagucauugcacuauuuaaaaaguuuuaguaauauc

SEQ ID NO: 571235 - RNA, 65 nt, Homo Sapiens
auauacacagucuguuucuucuauuccuagacauauugcacuacuuuuucagugguucuuggucc

SEQ ID NO: 571236 - RNA, 65 nt, Homo Sapiens
gaguaggaagaguuaauuguaagaaaauguuuuauuugcacuacuggauuauuuuuauauuugaa

SEQ ID NO: 571237 - RNA, 65 nt, Homo Sapiens
gaagguaaagagagaaucagcuggaguucuccugcuugcacuagaagugcuuuccuuaucaguaa

SEQ ID NO: 571238 - RNA, 65 nt, Homo Sapiens
ccuggacuauauaacuuaaaagaaguaaaacguaauugcacuacuguuuuccagacuggaaaaaa

SEQ ID NO: 571239 - RNA, 65 nt, Homo Sapiens
uaagggcaaaaacggauugaaaugaacauagcguuuugcacuaaugauaagauaaccugagaggu

SEQ ID NO: 571240 - RNA, 65 nt, Homo Sapiens
gggguaugauguuugggucaagcagagagggaacuuugcacuauugggcugucaacauucaaagc

SEQ ID NO: 571241 - RNA, 65 nt, Homo Sapiens
auggccucugacgugaccauaagcaguguuucuacuugcacuagcgggaaauucagcuuuugcag

SEQ ID NO: 571242 - RNA, 65 nt, Homo Sapiens
uguuaucaguagugccuuuaaaauaucugagcucuuugcacuaccuauuuuauucuuauucaaag

SEQ ID NO: 571243 - RNA, 65 nt, Homo Sapiens
auauuuccaggcugcauuugcguuacuuuucauauuugcacuaaguaaguaacuuuaaauuaugc

SEQ ID NO: 571244 - RNA, 64 nt, Homo Sapiens; identical to SEQ ID NO: 217362

SEQ ID NO: 571245 - RNA, 64 nt, Homo Sapiens; identical to SEQ ID NO: 217363

SEQ ID NO: 571246 - RNA, 64 nt, Homo Sapiens; identical to SEQ ID NO: 217364

SEQ ID NO: 571247 - RNA, 64 nt, Homo Sapiens; identical to SEQ ID NO: 217365

SEQ ID NO: 571248 - RNA, 64 nt, Homo Sapiens; identical to SEQ ID NO: 217366

SEQ ID NO: 571249 - RNA, 64 nt, Homo Sapiens; identical to SEQ ID NO: 217367

SEQ ID NO: 571250 - RNA, 64 nt, Homo Sapiens; identical to SEQ ID NO: 217368

SEQ ID NO: 571251 - RNA, 64 nt, Homo Sapiens; identical to SEQ ID NO: 217369

SEQ ID NO: 571252 - RNA, 64 nt, Homo Sapiens; identical to SEQ ID NO: 217370

SEQ ID NO: 571253 - RNA, 64 nt, Homo Sapiens; identical to SEQ ID NO: 217371

SEQ ID NO: 571254 - RNA, 64 nt, Homo Sapiens; identical to SEQ ID NO: 217372

SEQ ID NO: 571255 - RNA, 64 nt, Homo Sapiens; identical to SEQ ID NO: 217373

SEQ ID NO: 571256 - RNA, 64 nt, Homo Sapiens; identical to SEQ ID NO: 217374

SEQ ID NO: 571257 - RNA, 64 nt, Homo Sapiens; identical to SEQ ID NO: 217375

SEQ ID NO: 571258 - RNA, 64 nt, Homo Sapiens; identical to SEQ ID NO: 217376

SEQ ID NO: 571259 - RNA, 64 nt, Homo Sapiens; identical to SEQ ID NO: 217377

SEQ ID NO: 571260 - RNA, 64 nt, Homo Sapiens; identical to SEQ ID NO: 217378

SEQ ID NO: 571261 - RNA, 64 nt, Homo Sapiens; identical to SEQ ID NO: 217379

SEQ ID NO: 571262 - RNA, 64 nt, Homo Sapiens; identical to SEQ ID NO: 217380

SEQ ID NO: 571263 - RNA, 64 nt, Homo Sapiens; identical to SEQ ID NO: 217381

SEQ ID NO: 571264 - RNA, 64 nt, Homo Sapiens; identical to SEQ ID NO: 217382

SEQ ID NO: 571265 - RNA, 64 nt, Homo Sapiens; identical to SEQ ID NO: 217383

SEQ ID NO: 571266 - RNA, 64 nt, Homo Sapiens; identical to SEQ ID NO: 217384

SEQ ID NO: 571267 - RNA, 64 nt, Homo Sapiens; identical to SEQ ID NO: 217385

SEQ ID NO: 571268 - RNA, 55 nt, Homo Sapiens; identical to SEQ ID NO: 217386

SEQ ID NO: 571269 - RNA, 64 nt, Homo Sapiens; identical to SEQ ID NO: 217387

SEQ ID NO: 571270 - RNA, 64 nt, Homo Sapiens; identical to SEQ ID NO: 217388

SEQ ID NO: 571271 - RNA, 64 nt, Homo Sapiens; identical to SEQ ID NO: 217389

SEQ ID NO: 571272 - RNA, 64 nt, Homo Sapiens; identical to SEQ ID NO: 217390

SEQ ID NO: 571273 - RNA, 64 nt, Homo Sapiens; identical to SEQ ID NO: 217391

SEQ ID NO: 571274 - RNA, 64 nt, Homo Sapiens; identical to SEQ ID NO: 217392

SEQ ID NO: 571275 - RNA, 64 nt, Homo Sapiens; identical to SEQ ID NO: 217393

SEQ ID NO: 571276 - RNA, 64 nt, Homo Sapiens; identical to SEQ ID NO: 217394

SEQ ID NO: 571277 - RNA, 64 nt, Homo Sapiens; identical to SEQ ID NO: 496535

SEQ ID NO: 571278 - RNA, 64 nt, Homo Sapiens; identical to SEQ ID NO: 496536

SEQ ID NO: 571279 - RNA, 64 nt, Homo Sapiens; identical to SEQ ID NO: 496537

SEQ ID NO: 571280 - RNA, 64 nt, Homo Sapiens; identical to SEQ ID NO: 496538

SEQ ID NO: 571281 - RNA, 64 nt, Homo Sapiens; identical to SEQ ID NO: 496539

SEQ ID NO: 571282 - RNA, 64 nt, Homo Sapiens; identical to SEQ ID NO: 130383

SEQ ID NO: 571283 - RNA, 64 nt, Homo Sapiens; identical to SEQ ID NO: 130384

SEQ ID NO: 571284 - RNA, 64 nt, Homo Sapiens; identical to SEQ ID NO: 130385

SEQ ID NO: 571285 - RNA, 64 nt, Homo Sapiens; identical to SEQ ID NO: 130386

SEQ ID NO: 571286 - RNA, 64 nt, Homo Sapiens; identical to SEQ ID NO: 130387

SEQ ID NO: 571287 - RNA, 64 nt, Homo Sapiens; identical to SEQ ID NO: 130388

SEQ ID NO: 571288 - RNA, 64 nt, Homo Sapiens; identical to SEQ ID NO: 130389

SEQ ID NO: 571289 - RNA, 64 nt, Homo Sapiens; identical to SEQ ID NO: 130390

SEQ ID NO: 571290 - RNA, 64 nt, Homo Sapiens; identical to SEQ ID NO: 130391

SEQ ID NO: 571291 - RNA, 64 nt, Homo Sapiens; identical to SEQ ID NO: 130392

SEQ ID NO: 571292 - RNA, 64 nt, Homo Sapiens; identical to SEQ ID NO: 130393

SEQ ID NO: 571293 - RNA, 64 nt, Homo Sapiens; identical to SEQ ID NO: 130394

SEQ ID NO: 571294 - RNA, 64 nt, Homo Sapiens; identical to SEQ ID NO: 130395

SEQ ID NO: 571295 - RNA, 64 nt, Homo Sapiens; identical to SEQ ID NO: 130396

SEQ ID NO: 571296 - RNA, 64 nt, Homo Sapiens; identical to SEQ ID NO: 156143

SEQ ID NO: 571297 - RNA, 64 nt, Homo Sapiens; identical to SEQ ID NO: 156144

SEQ ID NO: 571298 - RNA, 64 nt, Homo Sapiens; identical to SEQ ID NO: 156145

SEQ ID NO: 571299 - RNA, 64 nt, Homo Sapiens; identical to SEQ ID NO: 156146

SEQ ID NO: 571300 - RNA, 64 nt, Homo Sapiens; identical to SEQ ID NO: 156147

SEQ ID NO: 571301 - RNA, 64 nt, Homo Sapiens; identical to SEQ ID NO: 156148

SEQ ID NO: 571302 - RNA, 64 nt, Homo Sapiens; identical to SEQ ID NO: 156149

SEQ ID NO: 571303 - RNA, 64 nt, Homo Sapiens; identical to SEQ ID NO: 156150

SEQ ID NO: 571304 - RNA, 64 nt, Homo Sapiens; identical to SEQ ID NO: 156151

SEQ ID NO: 571305 - RNA, 64 nt, Homo Sapiens; identical to SEQ ID NO: 156152

SEQ ID NO: 571306 - RNA, 64 nt, Homo Sapiens; identical to SEQ ID NO: 156153

SEQ ID NO: 571307 - RNA, 64 nt, Homo Sapiens; identical to SEQ ID NO: 156154

SEQ ID NO: 571308 - RNA, 64 nt, Homo Sapiens; identical to SEQ ID NO: 156155

SEQ ID NO: 571309 - RNA, 64 nt, Homo Sapiens; identical to SEQ ID NO: 156156

SEQ ID NO: 571310 - RNA, 64 nt, Homo Sapiens; identical to SEQ ID NO: 156157

SEQ ID NO: 571311 - RNA, 64 nt, Homo Sapiens; identical to SEQ ID NO: 156158

SEQ ID NO: 571312 - RNA, 64 nt, Homo Sapiens; identical to SEQ ID NO: 156159

SEQ ID NO: 571313 - RNA, 64 nt, Homo Sapiens; identical to SEQ ID NO: 156160

SEQ ID NO: 571314 - RNA, 64 nt, Homo Sapiens; identical to SEQ ID NO: 156161

SEQ ID NO: 571315 - RNA, 64 nt, Homo Sapiens; identical to SEQ ID NO: 156162

SEQ ID NO: 571316 - RNA, 64 nt, Homo Sapiens; identical to SEQ ID NO: 156163

SEQ ID NO: 571317 - RNA, 64 nt, Homo Sapiens; identical to SEQ ID NO: 156164

SEQ ID NO: 571318 - RNA, 64 nt, Homo Sapiens; identical to SEQ ID NO: 156165

SEQ ID NO: 571319 - RNA, 64 nt, Homo Sapiens; identical to SEQ ID NO: 156166

SEQ ID NO: 571320 - RNA, 64 nt, Homo Sapiens; identical to SEQ ID NO: 156167

SEQ ID NO: 571321 - RNA, 64 nt, Homo Sapiens; identical to SEQ ID NO: 156168

SEQ ID NO: 571322 - RNA, 64 nt, Homo Sapiens; identical to SEQ ID NO: 156169

SEQ ID NO: 571323 - RNA, 64 nt, Homo Sapiens; identical to SEQ ID NO: 156170

SEQ ID NO: 571324 - RNA, 64 nt, Homo Sapiens; identical to SEQ ID NO: 156171

SEQ ID NO: 571325 - RNA, 64 nt, Homo Sapiens; identical to SEQ ID NO: 156172

SEQ ID NO: 571326 - RNA, 64 nt, Homo Sapiens; identical to SEQ ID NO: 156173

SEQ ID NO: 571327 - RNA, 64 nt, Homo Sapiens; identical to SEQ ID NO: 156174

SEQ ID NO: 571328 - RNA, 64 nt, Homo Sapiens; identical to SEQ ID NO: 156175

SEQ ID NO: 571329 - RNA, 64 nt, Homo Sapiens; identical to SEQ ID NO: 156176

SEQ ID NO: 571330 - RNA, 64 nt, Homo Sapiens; identical to SEQ ID NO: 156177

SEQ ID NO: 571331 - RNA, 64 nt, Homo Sapiens; identical to SEQ ID NO: 156178

SEQ ID NO: 571332 - RNA, 64 nt, Homo Sapiens; identical to SEQ ID NO: 156179

SEQ ID NO: 571333 - RNA, 64 nt, Homo Sapiens; identical to SEQ ID NO: 156180

SEQ ID NO: 571334 - RNA, 64 nt, Homo Sapiens; identical to SEQ ID NO: 156181

SEQ ID NO: 571335 - RNA, 64 nt, Homo Sapiens; identical to SEQ ID NO: 156182

SEQ ID NO: 571336 - RNA, 64 nt, Homo Sapiens; identical to SEQ ID NO: 156183

SEQ ID NO: 571337 - RNA, 64 nt, Homo Sapiens; identical to SEQ ID NO: 156184

SEQ ID NO: 571338 - RNA, 64 nt, Homo Sapiens; identical to SEQ ID NO: 156185

SEQ ID NO: 571339 - RNA, 64 nt, Homo Sapiens; identical to SEQ ID NO: 156186

SEQ ID NO: 571340 - RNA, 64 nt, Homo Sapiens; identical to SEQ ID NO: 156187

SEQ ID NO: 571341 - RNA, 64 nt, Homo Sapiens; identical to SEQ ID NO: 156188

SEQ ID NO: 571342 - RNA, 64 nt, Homo Sapiens; identical to SEQ ID NO: 156189

SEQ ID NO: 571343 - RNA, 64 nt, Homo Sapiens; identical to SEQ ID NO: 156190

SEQ ID NO: 571344 - RNA, 64 nt, Homo Sapiens; identical to SEQ ID NO: 156191

SEQ ID NO: 571345 - RNA, 64 nt, Homo Sapiens; identical to SEQ ID NO: 156192

SEQ ID NO: 571346 - RNA, 64 nt, Homo Sapiens; identical to SEQ ID NO: 156193

SEQ ID NO: 571347 - RNA, 64 nt, Homo Sapiens; identical to SEQ ID NO: 156194

SEQ ID NO: 571348 - RNA, 64 nt, Homo Sapiens; identical to SEQ ID NO: 156195

SEQ ID NO: 571349 - RNA, 64 nt, Homo Sapiens; identical to SEQ ID NO: 156196

SEQ ID NO: 571350 - RNA, 64 nt, Homo Sapiens; identical to SEQ ID NO: 156197

SEQ ID NO: 571351 - RNA, 64 nt, Homo Sapiens; identical to SEQ ID NO: 156198

SEQ ID NO: 571352 - RNA, 64 nt, Homo Sapiens; identical to SEQ ID NO: 156199

SEQ ID NO: 571353 - RNA, 64 nt, Homo Sapiens; identical to SEQ ID NO: 156200

SEQ ID NO: 571354 - RNA, 64 nt, Homo Sapiens; identical to SEQ ID NO: 156201

SEQ ID NO: 571355 - RNA, 64 nt, Homo Sapiens; identical to SEQ ID NO: 156202

SEQ ID NO: 571356 - RNA, 64 nt, Homo Sapiens; identical to SEQ ID NO: 156203

SEQ ID NO: 571357 - RNA, 64 nt, Homo Sapiens; identical to SEQ ID NO: 156204

SEQ ID NO: 571358 - RNA, 64 nt, Homo Sapiens; identical to SEQ ID NO: 156205

SEQ ID NO: 571359 - RNA, 64 nt, Homo Sapiens; identical to SEQ ID NO: 156206

SEQ ID NO: 571360 - RNA, 64 nt, Homo Sapiens; identical to SEQ ID NO: 156207

SEQ ID NO: 571361 - RNA, 64 nt, Homo Sapiens; identical to SEQ ID NO: 156208

SEQ ID NO: 571362 - RNA, 64 nt, Homo Sapiens; identical to SEQ ID NO: 156209

SEQ ID NO: 571363 - RNA, 53 nt, Homo Sapiens; identical to SEQ ID NO: 156210

SEQ ID NO: 571364 - RNA, 64 nt, Homo Sapiens; identical to SEQ ID NO: 156211

SEQ ID NO: 571365 - RNA, 64 nt, Homo Sapiens; identical to SEQ ID NO: 156212

SEQ ID NO: 571366 - RNA, 64 nt, Homo Sapiens; identical to SEQ ID NO: 156213

SEQ ID NO: 571367 - RNA, 64 nt, Homo Sapiens; identical to SEQ ID NO: 156214

SEQ ID NO: 571368 - RNA, 64 nt, Homo Sapiens; identical to SEQ ID NO: 156215

SEQ ID NO: 571369 - RNA, 64 nt, Homo Sapiens; identical to SEQ ID NO: 156216

SEQ ID NO: 571370 - RNA, 64 nt, Homo Sapiens; identical to SEQ ID NO: 156217

SEQ ID NO: 571371 - RNA, 64 nt, Homo Sapiens; identical to SEQ ID NO: 156218

SEQ ID NO: 571372 - RNA, 64 nt, Homo Sapiens; identical to SEQ ID NO: 156219

SEQ ID NO: 571373 - RNA, 64 nt, Homo Sapiens; identical to SEQ ID NO: 156220

SEQ ID NO: 571374 - RNA, 64 nt, Homo Sapiens; identical to SEQ ID NO: 156221

SEQ ID NO: 571375 - RNA, 64 nt, Homo Sapiens; identical to SEQ ID NO: 156222

SEQ ID NO: 571376 - RNA, 64 nt, Homo Sapiens; identical to SEQ ID NO: 156223

SEQ ID NO: 571377 - RNA, 64 nt, Homo Sapiens; identical to SEQ ID NO: 156224

SEQ ID NO: 571378 - RNA, 64 nt, Homo Sapiens; identical to SEQ ID NO: 156225

SEQ ID NO: 571379 - RNA, 64 nt, Homo Sapiens; identical to SEQ ID NO: 156226

SEQ ID NO: 571380 - RNA, 64 nt, Homo Sapiens; identical to SEQ ID NO: 156227

SEQ ID NO: 571381 - RNA, 64 nt, Homo Sapiens; identical to SEQ ID NO: 156228

SEQ ID NO: 571382 - RNA, 64 nt, Homo Sapiens; identical to SEQ ID NO: 156229

SEQ ID NO: 571383 - RNA, 64 nt, Homo Sapiens; identical to SEQ ID NO: 156230

SEQ ID NO: 571384 - RNA, 64 nt, Homo Sapiens; identical to SEQ ID NO: 156231

SEQ ID NO: 571385 - RNA, 64 nt, Homo Sapiens; identical to SEQ ID NO: 156232

SEQ ID NO: 571386 - RNA, 64 nt, Homo Sapiens; identical to SEQ ID NO: 156233

SEQ ID NO: 571387 - RNA, 64 nt, Homo Sapiens; identical to SEQ ID NO: 156234

SEQ ID NO: 571388 - RNA, 64 nt, Homo Sapiens; identical to SEQ ID NO: 156235

SEQ ID NO: 571389 - RNA, 64 nt, Homo Sapiens; identical to SEQ ID NO: 156236

SEQ ID NO: 571390 - RNA, 64 nt, Homo Sapiens; identical to SEQ ID NO: 156237

SEQ ID NO: 571391 - RNA, 64 nt, Homo Sapiens; identical to SEQ ID NO: 156238

SEQ ID NO: 571392 - RNA, 64 nt, Homo Sapiens; identical to SEQ ID NO: 156239

SEQ ID NO: 571393 - RNA, 64 nt, Homo Sapiens; identical to SEQ ID NO: 156240

SEQ ID NO: 571394 - RNA, 64 nt, Homo Sapiens; identical to SEQ ID NO: 156241

SEQ ID NO: 571395 - RNA, 64 nt, Homo Sapiens; identical to SEQ ID NO: 156242

SEQ ID NO: 571396 - RNA, 64 nt, Homo Sapiens; identical to SEQ ID NO: 156243

SEQ ID NO: 571397 - RNA, 64 nt, Homo Sapiens; identical to SEQ ID NO: 156244

SEQ ID NO: 571398 - RNA, 64 nt, Homo Sapiens; identical to SEQ ID NO: 156245

SEQ ID NO: 571399 - RNA, 64 nt, Homo Sapiens; identical to SEQ ID NO: 156246

SEQ ID NO: 571400 - RNA, 64 nt, Homo Sapiens; identical to SEQ ID NO: 156247

SEQ ID NO: 571401 - RNA, 64 nt, Homo Sapiens; identical to SEQ ID NO: 156248

SEQ ID NO: 571402 - RNA, 64 nt, Homo Sapiens; identical to SEQ ID NO: 156249

SEQ ID NO: 571403 - RNA, 64 nt, Homo Sapiens; identical to SEQ ID NO: 156250

SEQ ID NO: 571404 - RNA, 64 nt, Homo Sapiens; identical to SEQ ID NO: 156251

SEQ ID NO: 571405 - RNA, 64 nt, Homo Sapiens; identical to SEQ ID NO: 156252

SEQ ID NO: 571406 - RNA, 64 nt, Homo Sapiens; identical to SEQ ID NO: 156253

SEQ ID NO: 571407 - RNA, 64 nt, Homo Sapiens; identical to SEQ ID NO: 156254

SEQ ID NO: 571408 - RNA, 64 nt, Homo Sapiens; identical to SEQ ID NO: 156255

SEQ ID NO: 571409 - RNA, 64 nt, Homo Sapiens; identical to SEQ ID NO: 156256

SEQ ID NO: 571410 - RNA, 64 nt, Homo Sapiens; identical to SEQ ID NO: 156257

SEQ ID NO: 571411 - RNA, 64 nt, Homo Sapiens; identical to SEQ ID NO: 156258

SEQ ID NO: 571412 - RNA, 64 nt, Homo Sapiens; identical to SEQ ID NO: 156259

SEQ ID NO: 571413 - RNA, 64 nt, Homo Sapiens; identical to SEQ ID NO: 156260

SEQ ID NO: 571414 - RNA, 64 nt, Homo Sapiens; identical to SEQ ID NO: 156261

SEQ ID NO: 571415 - RNA, 64 nt, Homo Sapiens; identical to SEQ ID NO: 156262

SEQ ID NO: 571416 - RNA, 64 nt, Homo Sapiens; identical to SEQ ID NO: 156263

SEQ ID NO: 571417 - RNA, 64 nt, Homo Sapiens; identical to SEQ ID NO: 156264

SEQ ID NO: 571418 - RNA, 64 nt, Homo Sapiens; identical to SEQ ID NO: 156265

SEQ ID NO: 571419 - RNA, 64 nt, Homo Sapiens; identical to SEQ ID NO: 156266

SEQ ID NO: 571420 - RNA, 64 nt, Homo Sapiens; identical to SEQ ID NO: 156267

SEQ ID NO: 571421 - RNA, 64 nt, Homo Sapiens; identical to SEQ ID NO: 156268

SEQ ID NO: 571422 - RNA, 64 nt, Homo Sapiens; identical to SEQ ID NO: 156269

SEQ ID NO: 571423 - RNA, 64 nt, Homo Sapiens; identical to SEQ ID NO: 156270

SEQ ID NO: 571424 - RNA, 64 nt, Homo Sapiens; identical to SEQ ID NO: 156271

SEQ ID NO: 571425 - RNA, 64 nt, Homo Sapiens; identical to SEQ ID NO: 156272

SEQ ID NO: 571426 - RNA, 64 nt, Homo Sapiens; identical to SEQ ID NO: 156273

SEQ ID NO: 571427 - RNA, 64 nt, Homo Sapiens; identical to SEQ ID NO: 156274

SEQ ID NO: 571428 - RNA, 64 nt, Homo Sapiens; identical to SEQ ID NO: 156275

SEQ ID NO: 571429 - RNA, 64 nt, Homo Sapiens; identical to SEQ ID NO: 156276

SEQ ID NO: 571430 - RNA, 64 nt, Homo Sapiens; identical to SEQ ID NO: 156277

SEQ ID NO: 571431 - RNA, 64 nt, Homo Sapiens; identical to SEQ ID NO: 156278

SEQ ID NO: 571432 - RNA, 64 nt, Homo Sapiens; identical to SEQ ID NO: 156279

SEQ ID NO: 571433 - RNA, 64 nt, Homo Sapiens; identical to SEQ ID NO: 156280

SEQ ID NO: 571434 - RNA, 64 nt, Homo Sapiens; identical to SEQ ID NO: 156281

SEQ ID NO: 571435 - RNA, 64 nt, Homo Sapiens; identical to SEQ ID NO: 156282

SEQ ID NO: 571436 - RNA, 64 nt, Homo Sapiens; identical to SEQ ID NO: 156283

SEQ ID NO: 571437 - RNA, 64 nt, Homo Sapiens; identical to SEQ ID NO: 156284

SEQ ID NO: 571438 - RNA, 64 nt, Homo Sapiens; identical to SEQ ID NO: 156285

SEQ ID NO: 571439 - RNA, 64 nt, Homo Sapiens; identical to SEQ ID NO: 156286

SEQ ID NO: 571440 - RNA, 64 nt, Homo Sapiens; identical to SEQ ID NO: 156287

SEQ ID NO: 571441 - RNA, 64 nt, Homo Sapiens; identical to SEQ ID NO: 120128

SEQ ID NO: 571442 - RNA, 64 nt, Homo Sapiens; identical to SEQ ID NO: 120129

SEQ ID NO: 571443 - RNA, 64 nt, Homo Sapiens; identical to SEQ ID NO: 120130

SEQ ID NO: 571444 - RNA, 64 nt, Homo Sapiens; identical to SEQ ID NO: 120131

SEQ ID NO: 571445 - RNA, 64 nt, Homo Sapiens; identical to SEQ ID NO: 120132

SEQ ID NO: 571446 - RNA, 64 nt, Homo Sapiens; identical to SEQ ID NO: 120133

SEQ ID NO: 571447 - RNA, 64 nt, Homo Sapiens; identical to SEQ ID NO: 120134

SEQ ID NO: 571448 - RNA, 64 nt, Homo Sapiens; identical to SEQ ID NO: 120135

SEQ ID NO: 571449 - RNA, 64 nt, Homo Sapiens; identical to SEQ ID NO: 120136

SEQ ID NO: 571450 - RNA, 64 nt, Homo Sapiens; identical to SEQ ID NO: 120137

SEQ ID NO: 571451 - RNA, 64 nt, Homo Sapiens; identical to SEQ ID NO: 120138

SEQ ID NO: 571452 - RNA, 64 nt, Homo Sapiens; identical to SEQ ID NO: 120139

SEQ ID NO: 571453 - RNA, 64 nt, Homo Sapiens; identical to SEQ ID NO: 120140

SEQ ID NO: 571454 - RNA, 64 nt, Homo Sapiens; identical to SEQ ID NO: 120141

SEQ ID NO: 571455 - RNA, 64 nt, Homo Sapiens; identical to SEQ ID NO: 120142

SEQ ID NO: 571456 - RNA, 64 nt, Homo Sapiens; identical to SEQ ID NO: 120143

SEQ ID NO: 571457 - RNA, 64 nt, Homo Sapiens; identical to SEQ ID NO: 120144

SEQ ID NO: 571458 - RNA, 64 nt, Homo Sapiens; identical to SEQ ID NO: 120145

SEQ ID NO: 571459 - RNA, 64 nt, Homo Sapiens; identical to SEQ ID NO: 120146

SEQ ID NO: 571460 - RNA, 64 nt, Homo Sapiens; identical to SEQ ID NO: 120147

SEQ ID NO: 571461 - RNA, 64 nt, Homo Sapiens; identical to SEQ ID NO: 120148

SEQ ID NO: 571462 - RNA, 64 nt, Homo Sapiens; identical to SEQ ID NO: 120149

SEQ ID NO: 571463 - RNA, 64 nt, Homo Sapiens; identical to SEQ ID NO: 120150

SEQ ID NO: 571464 - RNA, 64 nt, Homo Sapiens; identical to SEQ ID NO: 120151

SEQ ID NO: 571465 - RNA, 64 nt, Homo Sapiens; identical to SEQ ID NO: 120152

SEQ ID NO: 571466 - RNA, 64 nt, Homo Sapiens; identical to SEQ ID NO: 120153

SEQ ID NO: 571467 - RNA, 64 nt, Homo Sapiens; identical to SEQ ID NO: 120154

SEQ ID NO: 571468 - RNA, 64 nt, Homo Sapiens; identical to SEQ ID NO: 120155

SEQ ID NO: 571469 - RNA, 64 nt, Homo Sapiens; identical to SEQ ID NO: 120156

SEQ ID NO: 571470 - RNA, 64 nt, Homo Sapiens; identical to SEQ ID NO: 120157

SEQ ID NO: 571471 - RNA, 64 nt, Homo Sapiens; identical to SEQ ID NO: 120158

SEQ ID NO: 571472 - RNA, 64 nt, Homo Sapiens
aauaaacuauucaucauauaauaguaagcugcaucuaaauuaaaucuuggacauaauuaauauu

SEQ ID NO: 571473 - RNA, 64 nt, Homo Sapiens
cuuuuucagaaauaucgaagcacuccccaaauuucuaaauuaauuugaaaguuuaaguuuuaga

SEQ ID NO: 571474 - RNA, 64 nt, Homo Sapiens
gaguaacugaaccaaaggaaaaagaagcucuuugcuaaauuaaggucuuuuauaaauuuaguaa

SEQ ID NO: 571475 - RNA, 64 nt, Homo Sapiens
augauguugagauuauuauauacuguauuuucuucuaaauuaacccuaauguuuaaaaacucac

SEQ ID NO: 571476 - RNA, 64 nt, Homo Sapiens
augaaauauauaugaugaaaagaauugagaaguucuaaauuaagacauuucaguuaagcucaua

SEQ ID NO: 571477 - RNA, 64 nt, Homo Sapiens
ugcucuucauguuaauauggcagaguuuuguaaacuaaauuaaaacuuacugauauauuggacu

SEQ ID NO: 571478 - RNA, 64 nt, Homo Sapiens
ucaguuugguaguucauuauuuuagaacaaauuucuaaauuaauuuauucccauaaccuacaau

SEQ ID NO: 571479 - RNA, 64 nt, Homo Sapiens
uauagauaaaaaccuucuucuguauuccucaccucuaaauuauauguuauuugcuauuugaaaa

SEQ ID NO: 571480 - RNA, 64 nt, Homo Sapiens
guggucauuuacugcugcucuuuuacaguuagcucuaaauuacuuguuugaacuauuuauuucu

SEQ ID NO: 571481 - RNA, 64 nt, Homo Sapiens
uuuccucagaguuuuuguuuucuauauauuaagucuaaauuaaguuuucuacucauuaagacua

SEQ ID NO: 571482 - RNA, 64 nt, Homo Sapiens
uugaaaaguugaaauuuaugagcuuugaagauugcuaaauuaaauaauuuauagcuccaaaaac

SEQ ID NO: 571483 - RNA, 64 nt, Homo Sapiens
uaauuuuaaguauaauguuuugccuuugguacaacuaaauuaaaacucuugguggucacauauu

SEQ ID NO: 571484 - RNA, 64 nt, Homo Sapiens
gcaggggacuuuggcacccauugaauugugccuacuaaauuauauuugaauaugcagacaaccu

SEQ ID NO: 571485 - RNA, 64 nt, Homo Sapiens
uuauguuuuugagagguugauccuucccauguuacuaaauuaauucuuuuaaaaauaaaauccu

SEQ ID NO: 571486 - RNA, 64 nt, Homo Sapiens
gaggcuacaucacccaaaguagauguuagaaaaccuaaauuaaugaaccauauuuuuaaaaucc

SEQ ID NO: 571487 - RNA, 64 nt, Homo Sapiens
ccaaccucuuugggagaaguaugaaugcgugugucuaaauuaaaagaaaaaaauauuuaaacgu

SEQ ID NO: 571488 - RNA, 64 nt, Homo Sapiens
gccugaccucaaccccgcucuccucauccuauuccuaaauuaggcuaauaaagugaaauuggua

SEQ ID NO: 571489 - RNA, 64 nt, Homo Sapiens
aaagcaauuaggaguauguuccugauuuuauucucuaaauuauacucaauuucaugguaauuac

SEQ ID NO: 571490 - RNA, 64 nt, Homo Sapiens
uuuaaaucauuucacucuguuaaucaauaugugccuaaauuauaugagagauaaucuauuuuca

SEQ ID NO: 571491 - RNA, 64 nt, Homo Sapiens
guaauauccaguucuuacugggacagaacaguagcuaaauuaaauuuauaauguuuacuuuuua

SEQ ID NO: 571492 - RNA, 64 nt, Homo Sapiens
aaauguuuagugaaacauuugugaaaaaagaagacuaaauuaagaccugagcugaaauaaagug

SEQ ID NO: 571493 - RNA, 64 nt, Homo Sapiens
aaaucugaaaaguggaggaagaguacaaauagaccuaaauuaagcucauuuuuaggcuuugauu

SEQ ID NO: 571494 - RNA, 64 nt, Homo Sapiens
augguuaaaacaggaguuguguucucugucgcugcuaaauuauucuucacuugagugaagcaaa

SEQ ID NO: 571495 - RNA, 64 nt, Homo Sapiens
uugugcuugaaguauuucuucucugguuguaauucuaaauuacagagucauuugagcuuucucc

SEQ ID NO: 571496 - RNA, 64 nt, Homo Sapiens
guuuucuauuuuaucuaaaaucuuuccauuauaucuaaauuagaaugaucauccugcgcaaauu

SEQ ID NO: 571497 - RNA, 64 nt, Homo Sapiens
uagacuuaggcauuaacauguuuuuuaaaaaaagcuaaauuacaacaaaaauccuuguugaagu

SEQ ID NO: 571498 - RNA, 64 nt, Homo Sapiens
agcauuuguuuuagcauuacuuuuguacauuacacuaaauuauuauacuaguacaagugguaau

SEQ ID NO: 571499 - RNA, 64 nt, Homo Sapiens
aagguuugaagaauuuuuuuuuacaagacuaguucuaaauuaacagcuuauaaaaaauuugucu

SEQ ID NO: 571500 - RNA, 64 nt, Homo Sapiens
aauuucuaguaaaucuauaaaaauggguaagucccuaaauuacaaaugagaaaauugaagcaca

SEQ ID NO: 571501 - RNA, 64 nt, Homo Sapiens
acccuuggcagggcaucgaccaggcuguuacuggcuaaauuaaaugccaugaaucauugcaggg

SEQ ID NO: 571502 - RNA, 60 nt, Homo Sapiens
uacuagaaaaaaaaaaaggauugaagaagccuaaauuaggugcacauuuucaacauguag

SEQ ID NO: 571503 - RNA, 64 nt, Homo Sapiens
uccaugccccuaggauuuugcuuccuccccggugcuaaauuagcaagcuccuagagaagccaug

SEQ ID NO: 571504 - RNA, 64 nt, Homo Sapiens
guucucaaggaggaaaauuggucuaggaagccuucuaaauuaaacucugggaaauauaguaaug

SEQ ID NO: 571505 - RNA, 64 nt, Homo Sapiens
ucugugaauugcagguauuguaaaaacaaaaaugcuaaauuauaguuuugccuaaauuaguaua

SEQ ID NO: 571506 - RNA, 64 nt, Homo Sapiens
auauaaaaacaaaaaugcuacggggggguuuugccuaaauuaguuuuguuggacgauucagugg

SEQ ID NO: 571507 - RNA, 64 nt, Homo Sapiens
acuuguaauuagagauugacuucagaaacuuuuucuaaauuauaaagacggaaugaccagaaaa

SEQ ID NO: 571508 - RNA, 64 nt, Homo Sapiens
uuuauagaguucauagaaauacaucaauaagcuccuaaauuauagagccucaauuuugguuuuu

SEQ ID NO: 571509 - RNA, 64 nt, Homo Sapiens; identical to SEQ ID NO: 169421

SEQ ID NO: 571510 - RNA, 64 nt, Homo Sapiens; identical to SEQ ID NO: 169422

SEQ ID NO: 571511 - RNA, 64 nt, Homo Sapiens; identical to SEQ ID NO: 169423

SEQ ID NO: 571512 - RNA, 64 nt, Homo Sapiens; identical to SEQ ID NO: 169424

SEQ ID NO: 571513 - RNA, 64 nt, Homo Sapiens; identical to SEQ ID NO: 169425

SEQ ID NO: 571514 - RNA, 64 nt, Homo Sapiens; identical to SEQ ID NO: 169426

SEQ ID NO: 571515 - RNA, 64 nt, Homo Sapiens; identical to SEQ ID NO: 169427

SEQ ID NO: 571516 - RNA, 64 nt, Homo Sapiens; identical to SEQ ID NO: 169428

SEQ ID NO: 571517 - RNA, 64 nt, Homo Sapiens; identical to SEQ ID NO: 169429

SEQ ID NO: 571518 - RNA, 64 nt, Homo Sapiens; identical to SEQ ID NO: 169430

SEQ ID NO: 571519 - RNA, 64 nt, Homo Sapiens; identical to SEQ ID NO: 169431

SEQ ID NO: 571520 - RNA, 64 nt, Homo Sapiens; identical to SEQ ID NO: 169432

SEQ ID NO: 571521 - RNA, 64 nt, Homo Sapiens; identical to SEQ ID NO: 169433

SEQ ID NO: 571522 - RNA, 64 nt, Homo Sapiens; identical to SEQ ID NO: 169434

SEQ ID NO: 571523 - RNA, 64 nt, Homo Sapiens; identical to SEQ ID NO: 169435

SEQ ID NO: 571524 - RNA, 64 nt, Homo Sapiens; identical to SEQ ID NO: 169436

SEQ ID NO: 571525 - RNA, 64 nt, Homo Sapiens; identical to SEQ ID NO: 169437

SEQ ID NO: 571526 - RNA, 64 nt, Homo Sapiens; identical to SEQ ID NO: 169438

SEQ ID NO: 571527 - RNA, 64 nt, Homo Sapiens; identical to SEQ ID NO: 169439

SEQ ID NO: 571528 - RNA, 64 nt, Homo Sapiens; identical to SEQ ID NO: 169440

SEQ ID NO: 571529 - RNA, 64 nt, Homo Sapiens; identical to SEQ ID NO: 169441

SEQ ID NO: 571530 - RNA, 64 nt, Homo Sapiens; identical to SEQ ID NO: 169442

SEQ ID NO: 571531 - RNA, 64 nt, Homo Sapiens; identical to SEQ ID NO: 169443

SEQ ID NO: 571532 - RNA, 64 nt, Homo Sapiens; identical to SEQ ID NO: 169442

SEQ ID NO: 571533 - RNA, 64 nt, Homo Sapiens; identical to SEQ ID NO: 169443

SEQ ID NO: 571534 - RNA, 64 nt, Homo Sapiens; identical to SEQ ID NO: 289444

SEQ ID NO: 571535 - RNA, 64 nt, Homo Sapiens; identical to SEQ ID NO: 289445

SEQ ID NO: 571536 - RNA, 64 nt, Homo Sapiens; identical to SEQ ID NO: 289446

SEQ ID NO: 571537 - RNA, 64 nt, Homo Sapiens; identical to SEQ ID NO: 289447

SEQ ID NO: 571538 - RNA, 64 nt, Homo Sapiens; identical to SEQ ID NO: 289448

SEQ ID NO: 571539 - RNA, 64 nt, Homo Sapiens; identical to SEQ ID NO: 289449

SEQ ID NO: 571540 - RNA, 64 nt, Homo Sapiens; identical to SEQ ID NO: 289450

SEQ ID NO: 571541 - RNA, 64 nt, Homo Sapiens; identical to SEQ ID NO: 289451

SEQ ID NO: 571542 - RNA, 64 nt, Homo Sapiens; identical to SEQ ID NO: 289452

SEQ ID NO: 571543 - RNA, 64 nt, Homo Sapiens; identical to SEQ ID NO: 289453

SEQ ID NO: 571544 - RNA, 64 nt, Homo Sapiens; identical to SEQ ID NO: 289454

SEQ ID NO: 571545 - RNA, 64 nt, Homo Sapiens; identical to SEQ ID NO: 289455

SEQ ID NO: 571546 - RNA, 64 nt, Homo Sapiens; identical to SEQ ID NO: 289456

SEQ ID NO: 571547 - RNA, 64 nt, Homo Sapiens; identical to SEQ ID NO: 289457

SEQ ID NO: 571548 - RNA, 64 nt, Homo Sapiens; identical to SEQ ID NO: 289458

SEQ ID NO: 571549 - RNA, 64 nt, Homo Sapiens; identical to SEQ ID NO: 289459

SEQ ID NO: 571550 - RNA, 64 nt, Homo Sapiens; identical to SEQ ID NO: 289460

SEQ ID NO: 571551 - RNA, 64 nt, Homo Sapiens; identical to SEQ ID NO: 289461

SEQ ID NO: 571552 - RNA, 64 nt, Homo Sapiens; identical to SEQ ID NO: 289462

SEQ ID NO: 571553 - RNA, 64 nt, Homo Sapiens; identical to SEQ ID NO: 289463

SEQ ID NO: 571554 - RNA, 64 nt, Homo Sapiens; identical to SEQ ID NO: 289464

SEQ ID NO: 571555 - RNA, 64 nt, Homo Sapiens; identical to SEQ ID NO: 289465

SEQ ID NO: 571556 - RNA, 64 nt, Homo Sapiens; identical to SEQ ID NO: 289466

SEQ ID NO: 571557 - RNA, 64 nt, Homo Sapiens; identical to SEQ ID NO: 289467

SEQ ID NO: 571558 - RNA, 64 nt, Homo Sapiens; identical to SEQ ID NO: 84166

SEQ ID NO: 571559 - RNA, 64 nt, Homo Sapiens; identical to SEQ ID NO: 84167

SEQ ID NO: 571560 - RNA, 64 nt, Homo Sapiens; identical to SEQ ID NO: 84168

SEQ ID NO: 571561 - RNA, 64 nt, Homo Sapiens; identical to SEQ ID NO: 84169

SEQ ID NO: 571562 - RNA, 64 nt, Homo Sapiens; identical to SEQ ID NO: 84170

SEQ ID NO: 571563 - RNA, 64 nt, Homo Sapiens; identical to SEQ ID NO: 84171

SEQ ID NO: 571564 - RNA, 64 nt, Homo Sapiens; identical to SEQ ID NO: 84172

SEQ ID NO: 571565 - RNA, 64 nt, Homo Sapiens; identical to SEQ ID NO: 84173

SEQ ID NO: 571566 - RNA, 64 nt, Homo Sapiens; identical to SEQ ID NO: 84174

SEQ ID NO: 571567 - RNA, 64 nt, Homo Sapiens; identical to SEQ ID NO: 84175

SEQ ID NO: 571568 - RNA, 64 nt, Homo Sapiens; identical to SEQ ID NO: 84176

SEQ ID NO: 571569 - RNA, 64 nt, Homo Sapiens; identical to SEQ ID NO: 84177

SEQ ID NO: 571570 - RNA, 64 nt, Homo Sapiens; identical to SEQ ID NO: 84178

SEQ ID NO: 571571 - RNA, 64 nt, Homo Sapiens; identical to SEQ ID NO: 84179

SEQ ID NO: 571572 - RNA, 64 nt, Homo Sapiens; identical to SEQ ID NO: 84180

SEQ ID NO: 571573 - RNA, 64 nt, Homo Sapiens; identical to SEQ ID NO: 84181

SEQ ID NO: 571574 - RNA, 64 nt, Homo Sapiens; identical to SEQ ID NO: 84182

SEQ ID NO: 571575 - RNA, 64 nt, Homo Sapiens; identical to SEQ ID NO: 84183

SEQ ID NO: 571576 - RNA, 64 nt, Homo Sapiens; identical to SEQ ID NO: 84184

SEQ ID NO: 571577 - RNA, 64 nt, Homo Sapiens; identical to SEQ ID NO: 84185

SEQ ID NO: 571578 - RNA, 64 nt, Homo Sapiens; identical to SEQ ID NO: 84186

SEQ ID NO: 571579 - RNA, 64 nt, Homo Sapiens; identical to SEQ ID NO: 84187

SEQ ID NO: 571580 - RNA, 64 nt, Homo Sapiens; identical to SEQ ID NO: 84188

SEQ ID NO: 571581 - RNA, 64 nt, Homo Sapiens; identical to SEQ ID NO: 84189

SEQ ID NO: 571582 - RNA, 64 nt, Homo Sapiens; identical to SEQ ID NO: 84190

SEQ ID NO: 571583 - RNA, 64 nt, Homo Sapiens; identical to SEQ ID NO: 84191

SEQ ID NO: 571584 - RNA, 64 nt, Homo Sapiens; identical to SEQ ID NO: 84192

SEQ ID NO: 571585 - RNA, 64 nt, Homo Sapiens; identical to SEQ ID NO: 84193

SEQ ID NO: 571586 - RNA, 64 nt, Homo Sapiens; identical to SEQ ID NO: 84194

SEQ ID NO: 571587 - RNA, 64 nt, Homo Sapiens; identical to SEQ ID NO: 84195

SEQ ID NO: 571588 - RNA, 64 nt, Homo Sapiens; identical to SEQ ID NO: 84196

SEQ ID NO: 571589 - RNA, 64 nt, Homo Sapiens; identical to SEQ ID NO: 84197

SEQ ID NO: 571590 - RNA, 64 nt, Homo Sapiens; identical to SEQ ID NO: 84198

SEQ ID NO: 571591 - RNA, 64 nt, Homo Sapiens; identical to SEQ ID NO: 84199

SEQ ID NO: 571592 - RNA, 64 nt, Homo Sapiens; identical to SEQ ID NO: 84200

SEQ ID NO: 571593 - RNA, 64 nt, Homo Sapiens; identical to SEQ ID NO: 84201

SEQ ID NO: 571594 - RNA, 64 nt, Homo Sapiens; identical to SEQ ID NO: 84202

SEQ ID NO: 571595 - RNA, 64 nt, Homo Sapiens; identical to SEQ ID NO: 84203

SEQ ID NO: 571596 - RNA, 64 nt, Homo Sapiens; identical to SEQ ID NO: 84204

SEQ ID NO: 571597 - RNA, 64 nt, Homo Sapiens; identical to SEQ ID NO: 84205

SEQ ID NO: 571598 - RNA, 64 nt, Homo Sapiens; identical to SEQ ID NO: 84206

SEQ ID NO: 571599 - RNA, 64 nt, Homo Sapiens; identical to SEQ ID NO: 84207

SEQ ID NO: 571600 - RNA, 64 nt, Homo Sapiens; identical to SEQ ID NO: 84208

SEQ ID NO: 571601 - RNA, 64 nt, Homo Sapiens; identical to SEQ ID NO: 84209

SEQ ID NO: 571602 - RNA, 64 nt, Homo Sapiens; identical to SEQ ID NO: 84210

SEQ ID NO: 571603 - RNA, 64 nt, Homo Sapiens; identical to SEQ ID NO: 84211

SEQ ID NO: 571604 - RNA, 64 nt, Homo Sapiens; identical to SEQ ID NO: 84212

SEQ ID NO: 571605 - RNA, 64 nt, Homo Sapiens; identical to SEQ ID NO: 84213

SEQ ID NO: 571606 - RNA, 64 nt, Homo Sapiens; identical to SEQ ID NO: 84214

SEQ ID NO: 571607 - RNA, 64 nt, Homo Sapiens; identical to SEQ ID NO: 84215

SEQ ID NO: 571608 - RNA, 64 nt, Homo Sapiens; identical to SEQ ID NO: 84216

SEQ ID NO: 571609 - RNA, 64 nt, Homo Sapiens; identical to SEQ ID NO: 84217

SEQ ID NO: 571610 - RNA, 64 nt, Homo Sapiens; identical to SEQ ID NO: 84218

SEQ ID NO: 571611 - RNA, 64 nt, Homo Sapiens; identical to SEQ ID NO: 84219

SEQ ID NO: 571612 - RNA, 64 nt, Homo Sapiens; identical to SEQ ID NO: 84220

SEQ ID NO: 571613 - RNA, 64 nt, Homo Sapiens; identical to SEQ ID NO: 84221

SEQ ID NO: 571614 - RNA, 64 nt, Homo Sapiens; identical to SEQ ID NO: 84222

SEQ ID NO: 571615 - RNA, 64 nt, Homo Sapiens; identical to SEQ ID NO: 84223

SEQ ID NO: 571616 - RNA, 64 nt, Homo Sapiens; identical to SEQ ID NO: 84224

SEQ ID NO: 571617 - RNA, 64 nt, Homo Sapiens; identical to SEQ ID NO: 84225

SEQ ID NO: 571618 - RNA, 64 nt, Homo Sapiens; identical to SEQ ID NO: 84226

SEQ ID NO: 571619 - RNA, 64 nt, Homo Sapiens; identical to SEQ ID NO: 84227

SEQ ID NO: 571620 - RNA, 64 nt, Homo Sapiens; identical to SEQ ID NO: 84228

SEQ ID NO: 571621 - RNA, 64 nt, Homo Sapiens; identical to SEQ ID NO: 84229

SEQ ID NO: 571622 - RNA, 64 nt, Homo Sapiens; identical to SEQ ID NO: 84230

SEQ ID NO: 571623 - RNA, 64 nt, Homo Sapiens; identical to SEQ ID NO: 84231

SEQ ID NO: 571624 - RNA, 64 nt, Homo Sapiens; identical to SEQ ID NO: 84232

SEQ ID NO: 571625 - RNA, 64 nt, Homo Sapiens; identical to SEQ ID NO: 84233

SEQ ID NO: 571626 - RNA, 64 nt, Homo Sapiens
uacuuuguuuuugugagucaugucucaugaaauuuauuggaauguuuaaucauauuugcuaaga

SEQ ID NO: 571627 - RNA, 64 nt, Homo Sapiens
ccuauaaucuguugcuuuuucucaauauguguccuauuggaaauuccucaaaucguuggugcca

SEQ ID NO: 571628 - RNA, 64 nt, Homo Sapiens
accugcuguuacuuauucagauaaacauggugccuauuggaacaauagcggauagagcuacagg

SEQ ID NO: 571629 - RNA, 64 nt, Homo Sapiens
aaaccucuugagaaaaagaaaaguucauacugauuauuggaaaaggacuauauaugugagcaag

SEQ ID NO: 571630 - RNA, 64 nt, Homo Sapiens
cuaagcuugugggagucauugccuaguguuccauuauuggaaugauucuuguuaacccauuuau

SEQ ID NO: 571631 - RNA, 64 nt, Homo Sapiens
ugaccuuuuaaaggccacugaaaagagcuaauauuauuggaaacauuaucuccuguuuagcacc

SEQ ID NO: 571632 - RNA, 64 nt, Homo Sapiens
ucaaaccaaauccccacugaaaacaugcuauuuuuauuggaacucacagcucucuuggucacaa

SEQ ID NO: 571633 - RNA, 64 nt, Homo Sapiens
uucuaauuuguuaggccuugaaauauauauuuuuuauuggaaaaugucuuauuaacaucugaaa

SEQ ID NO: 571634 - RNA, 64 nt, Homo Sapiens
uauaaguuaucucacugcucuguugaaaauagguuauuggaauauucaugucuugggcaggagu

SEQ ID NO: 571635 - RNA, 64 nt, Homo Sapiens
ugauauuuuccugguacucguacugauaagggauuauuggaagucagucacagaauuuggaaau

SEQ ID NO: 571636 - RNA, 64 nt, Homo Sapiens
aaaacaauaugcuuuguugaaggaaaauuuucuuuauuggaaugugguuguaauccuuguucag

SEQ ID NO: 571637 - RNA, 64 nt, Homo Sapiens
uaauuagcccacaaagguggaugagauucuccucuauuggaagccacuuuauagcuauggaaac

SEQ ID NO: 571638 - RNA, 64 nt, Homo Sapiens
guuuuaaacaaccaagcuaaucauugcuguauuauauuggaaaauuuuuaaaaagaaauuauuc

SEQ ID NO: 571639 - RNA, 64 nt, Homo Sapiens
cucauagaaucccagucaccuuuauauaucauauuauuggaagagauucaucuucauaaucucc

SEQ ID NO: 571640 - RNA, 64 nt, Homo Sapiens
cauagaaucacaauuaccuuuauauaucauauguuauuggaagagauuccucaguaaucuccaa

SEQ ID NO: 571641 - RNA, 64 nt, Homo Sapiens
ugauuuuccuggaugcuuucuaauuuauugaauuuauuggaacuuucucuggggaguuauauaa

SEQ ID NO: 571642 - RNA, 64 nt, Homo Sapiens
aucuaguuuuuuaaauuuuuugauuauacacguguauuggaaauugguuagugaaugucuggca

SEQ ID NO: 571643 - RNA, 64 nt, Homo Sapiens
uccacuuaaauggcuauacauuggaaaaaucaguuauuggaauuauguagcagcuucauugcua

SEQ ID NO: 571644 - RNA, 64 nt, Homo Sapiens
aucaguuauuggaauuuccaagcagcuucauugcuauuggaaaauacagaacaaaauaauaugu

SEQ ID NO: 571645 - RNA, 64 nt, Homo Sapiens
uguggacaaaaaaagcggggaagacagcaagauuuauuggaagauacuuacaggggaaauuaau

SEQ ID NO: 571646 - RNA, 64 nt, Homo Sapiens
aagaggaguauuauagccaaguuuucuuugaaaguauuggaaaacuaaaauuaaaugacaagga

SEQ ID NO: 571647 - RNA, 64 nt, Homo Sapiens
cucucccugccuacuuccuagccuuuccaaucuuuauuggaagucuccccaccuccugcaauac

SEQ ID NO: 571648 - RNA, 64 nt, Homo Sapiens
aguaaacauggcuagaaagaaaggacuuuucuuuuauuggaagagucucaaagcccaggcagaa

SEQ ID NO: 571649 - RNA, 64 nt, Homo Sapiens
guaugaaugauguuuuagaaugauucccucuugcuauuggaaugugguccagacgucaaccagg

SEQ ID NO: 571650 - RNA, 64 nt, Homo Sapiens
uaauucggaagggaaaacagucgaucaagggauguauuggaacaugucggaguagaaauuguuc

SEQ ID NO: 571651 - RNA, 64 nt, Homo Sapiens
auacauguguggauguguaaauggagcuuguacauauuggaaaggucauuguggcuaucugcau

SEQ ID NO: 571652 - RNA, 64 nt, Homo Sapiens
auaaugcuuauguaucugaagaaaaggucagaucuauuggaaaugacagcccgauacuugagcc

SEQ ID NO: 571653 - RNA, 64 nt, Homo Sapiens
uuucugcugaucaaagaugaucaagcuuucuguguauuggaacagaaaguaacaaagaggaaug

SEQ ID NO: 571654 - RNA, 64 nt, Homo Sapiens
gggcaauuggaacaaagugaaggacauagagguauauuggaagaggcagagccugaggugguag

SEQ ID NO: 571655 - RNA, 64 nt, Homo Sapiens
uccagucccaaugguccugacuuugggcgcuggguauuggaaauggaugcaaaguacaaugugu

SEQ ID NO: 571656 - RNA, 64 nt, Homo Sapiens
gauuuacuguaucuugugauugugauuuccagacuauuggaaguuuuauuuauaacuucuacca

SEQ ID NO: 571657 - RNA, 64 nt, Homo Sapiens
uaaagaauucuguccacuugagugguuuauuagauauuggaaccucaccuuguucauuucacau

SEQ ID NO: 571658 - RNA, 64 nt, Homo Sapiens
cagcugcugagaaagaugggaucaaagaagauaauauuggaaauaggaggcuuacaaacagcaa

SEQ ID NO: 571659 - RNA, 64 nt, Homo Sapiens; identical to SEQ ID NO: 145890

SEQ ID NO: 571660 - RNA, 64 nt, Homo Sapiens; identical to SEQ ID NO: 145891

SEQ ID NO: 571661 - RNA, 64 nt, Homo Sapiens; identical to SEQ ID NO: 145892

SEQ ID NO: 571662 - RNA, 64 nt, Homo Sapiens; identical to SEQ ID NO: 145893

SEQ ID NO: 571663 - RNA, 64 nt, Homo Sapiens; identical to SEQ ID NO: 145894

SEQ ID NO: 571664 - RNA, 64 nt, Homo Sapiens; identical to SEQ ID NO: 145895

SEQ ID NO: 571665 - RNA, 64 nt, Homo Sapiens; identical to SEQ ID NO: 145896

SEQ ID NO: 571666 - RNA, 64 nt, Homo Sapiens; identical to SEQ ID NO: 145897

SEQ ID NO: 571667 - RNA, 64 nt, Homo Sapiens; identical to SEQ ID NO: 145898

SEQ ID NO: 571668 - RNA, 64 nt, Homo Sapiens; identical to SEQ ID NO: 145899

SEQ ID NO: 571669 - RNA, 64 nt, Homo Sapiens; identical to SEQ ID NO: 145900

SEQ ID NO: 571670 - RNA, 64 nt, Homo Sapiens; identical to SEQ ID NO: 145901

SEQ ID NO: 571671 - RNA, 64 nt, Homo Sapiens; identical to SEQ ID NO: 145902

SEQ ID NO: 571672 - RNA, 64 nt, Homo Sapiens; identical to SEQ ID NO: 145903

SEQ ID NO: 571673 - RNA, 64 nt, Homo Sapiens; identical to SEQ ID NO: 145904

SEQ ID NO: 571674 - RNA, 64 nt, Homo Sapiens; identical to SEQ ID NO: 145905

SEQ ID NO: 571675 - RNA, 64 nt, Homo Sapiens; identical to SEQ ID NO: 145906

SEQ ID NO: 571676 - RNA, 64 nt, Homo Sapiens; identical to SEQ ID NO: 145907

SEQ ID NO: 571677 - RNA, 62 nt, Homo Sapiens; identical to SEQ ID NO: 145908

SEQ ID NO: 571678 - RNA, 64 nt, Homo Sapiens; identical to SEQ ID NO: 145909

SEQ ID NO: 571679 - RNA, 64 nt, Homo Sapiens; identical to SEQ ID NO: 145910

SEQ ID NO: 571680 - RNA, 64 nt, Homo Sapiens; identical to SEQ ID NO: 145911

SEQ ID NO: 571681 - RNA, 64 nt, Homo Sapiens; identical to SEQ ID NO: 145912

SEQ ID NO: 571682 - RNA, 64 nt, Homo Sapiens; identical to SEQ ID NO: 145913

SEQ ID NO: 571683 - RNA, 64 nt, Homo Sapiens; identical to SEQ ID NO: 145914

SEQ ID NO: 571684 - RNA, 64 nt, Homo Sapiens; identical to SEQ ID NO: 145915

SEQ ID NO: 571685 - RNA, 64 nt, Homo Sapiens; identical to SEQ ID NO: 145916

SEQ ID NO: 571686 - RNA, 64 nt, Homo Sapiens; identical to SEQ ID NO: 145917

SEQ ID NO: 571687 - RNA, 64 nt, Homo Sapiens; identical to SEQ ID NO: 145918

SEQ ID NO: 571688 - RNA, 64 nt, Homo Sapiens; identical to SEQ ID NO: 145919

SEQ ID NO: 571689 - RNA, 64 nt, Homo Sapiens; identical to SEQ ID NO: 145920

SEQ ID NO: 571690 - RNA, 64 nt, Homo Sapiens; identical to SEQ ID NO: 145921

SEQ ID NO: 571691 - RNA, 64 nt, Homo Sapiens; identical to SEQ ID NO: 145922

SEQ ID NO: 571692 - RNA, 64 nt, Homo Sapiens; identical to SEQ ID NO: 145923

SEQ ID NO: 571693 - RNA, 64 nt, Homo Sapiens; identical to SEQ ID NO: 145924

SEQ ID NO: 571694 - RNA, 64 nt, Homo Sapiens; identical to SEQ ID NO: 145925

SEQ ID NO: 571695 - RNA, 64 nt, Homo Sapiens; identical to SEQ ID NO: 145926

SEQ ID NO: 571696 - RNA, 64 nt, Homo Sapiens; identical to SEQ ID NO: 145927

SEQ ID NO: 571697 - RNA, 64 nt, Homo Sapiens; identical to SEQ ID NO: 145928

SEQ ID NO: 571698 - RNA, 64 nt, Homo Sapiens; identical to SEQ ID NO: 145929

SEQ ID NO: 571699 - RNA, 64 nt, Homo Sapiens; identical to SEQ ID NO: 145930

SEQ ID NO: 571700 - RNA, 64 nt, Homo Sapiens; identical to SEQ ID NO: 145931

SEQ ID NO: 571701 - RNA, 64 nt, Homo Sapiens; identical to SEQ ID NO: 145932

SEQ ID NO: 571702 - RNA, 64 nt, Homo Sapiens; identical to SEQ ID NO: 145933

SEQ ID NO: 571703 - RNA, 64 nt, Homo Sapiens; identical to SEQ ID NO: 145934

SEQ ID NO: 571704 - RNA, 64 nt, Homo Sapiens; identical to SEQ ID NO: 145935

SEQ ID NO: 571705 - RNA, 64 nt, Homo Sapiens; identical to SEQ ID NO: 145936

SEQ ID NO: 571706 - RNA, 64 nt, Homo Sapiens; identical to SEQ ID NO: 145937

SEQ ID NO: 571707 - RNA, 64 nt, Homo Sapiens; identical to SEQ ID NO: 145938

SEQ ID NO: 571708 - RNA, 64 nt, Homo Sapiens; identical to SEQ ID NO: 145939

SEQ ID NO: 571709 - RNA, 64 nt, Homo Sapiens; identical to SEQ ID NO: 145940

SEQ ID NO: 571710 - RNA, 64 nt, Homo Sapiens; identical to SEQ ID NO: 145941

SEQ ID NO: 571711 - RNA, 64 nt, Homo Sapiens; identical to SEQ ID NO: 145942

SEQ ID NO: 571712 - RNA, 64 nt, Homo Sapiens; identical to SEQ ID NO: 145943

SEQ ID NO: 571713 - RNA, 64 nt, Homo Sapiens; identical to SEQ ID NO: 145944

SEQ ID NO: 571714 - RNA, 64 nt, Homo Sapiens; identical to SEQ ID NO: 145945

SEQ ID NO: 571715 - RNA, 64 nt, Homo Sapiens; identical to SEQ ID NO: 145946

SEQ ID NO: 571716 - RNA, 64 nt, Homo Sapiens; identical to SEQ ID NO: 145947

SEQ ID NO: 571717 - RNA, 64 nt, Homo Sapiens; identical to SEQ ID NO: 145948

SEQ ID NO: 571718 - RNA, 64 nt, Homo Sapiens; identical to SEQ ID NO: 145949

SEQ ID NO: 571719 - RNA, 64 nt, Homo Sapiens; identical to SEQ ID NO: 145950

SEQ ID NO: 571720 - RNA, 64 nt, Homo Sapiens; identical to SEQ ID NO: 145951

SEQ ID NO: 571721 - RNA, 64 nt, Homo Sapiens; identical to SEQ ID NO: 145952

SEQ ID NO: 571722 - RNA, 64 nt, Homo Sapiens; identical to SEQ ID NO: 145953

SEQ ID NO: 571723 - RNA, 64 nt, Homo Sapiens; identical to SEQ ID NO: 145954

SEQ ID NO: 571724 - RNA, 64 nt, Homo Sapiens; identical to SEQ ID NO: 145955

SEQ ID NO: 571725 - RNA, 64 nt, Homo Sapiens; identical to SEQ ID NO: 145956

SEQ ID NO: 571726 - RNA, 64 nt, Homo Sapiens; identical to SEQ ID NO: 145957

SEQ ID NO: 571727 - RNA, 64 nt, Homo Sapiens; identical to SEQ ID NO: 145958

SEQ ID NO: 571728 - RNA, 64 nt, Homo Sapiens; identical to SEQ ID NO: 145959

SEQ ID NO: 571729 - RNA, 64 nt, Homo Sapiens; identical to SEQ ID NO: 145960

SEQ ID NO: 571730 - RNA, 64 nt, Homo Sapiens; identical to SEQ ID NO: 145961

SEQ ID NO: 571731 - RNA, 64 nt, Homo Sapiens; identical to SEQ ID NO: 145962

SEQ ID NO: 571732 - RNA, 64 nt, Homo Sapiens; identical to SEQ ID NO: 145963

SEQ ID NO: 571733 - RNA, 64 nt, Homo Sapiens; identical to SEQ ID NO: 145964

SEQ ID NO: 571734 - RNA, 64 nt, Homo Sapiens; identical to SEQ ID NO: 145965

SEQ ID NO: 571735 - RNA, 64 nt, Homo Sapiens; identical to SEQ ID NO: 145966

SEQ ID NO: 571736 - RNA, 64 nt, Homo Sapiens; identical to SEQ ID NO: 145967

SEQ ID NO: 571737 - RNA, 64 nt, Homo Sapiens; identical to SEQ ID NO: 145968

SEQ ID NO: 571738 - RNA, 64 nt, Homo Sapiens; identical to SEQ ID NO: 145969

SEQ ID NO: 571739 - RNA, 64 nt, Homo Sapiens; identical to SEQ ID NO: 145970

SEQ ID NO: 571740 - RNA, 64 nt, Homo Sapiens; identical to SEQ ID NO: 145971

SEQ ID NO: 571741 - RNA, 64 nt, Homo Sapiens; identical to SEQ ID NO: 145972

SEQ ID NO: 571742 - RNA, 64 nt, Homo Sapiens; identical to SEQ ID NO: 145973

SEQ ID NO: 571743 - RNA, 64 nt, Homo Sapiens; identical to SEQ ID NO: 145974

SEQ ID NO: 571744 - RNA, 64 nt, Homo Sapiens; identical to SEQ ID NO: 145975

SEQ ID NO: 571745 - RNA, 64 nt, Homo Sapiens; identical to SEQ ID NO: 145976

SEQ ID NO: 571746 - RNA, 64 nt, Homo Sapiens; identical to SEQ ID NO: 145977

SEQ ID NO: 571747 - RNA, 64 nt, Homo Sapiens; identical to SEQ ID NO: 145978

SEQ ID NO: 571748 - RNA, 64 nt, Homo Sapiens; identical to SEQ ID NO: 145979

SEQ ID NO: 571749 - RNA, 64 nt, Homo Sapiens; identical to SEQ ID NO: 145980

SEQ ID NO: 571750 - RNA, 64 nt, Homo Sapiens; identical to SEQ ID NO: 145981

SEQ ID NO: 571751 - RNA, 64 nt, Homo Sapiens; identical to SEQ ID NO: 145982

SEQ ID NO: 571752 - RNA, 64 nt, Homo Sapiens; identical to SEQ ID NO: 145983

SEQ ID NO: 571753 - RNA, 64 nt, Homo Sapiens; identical to SEQ ID NO: 145984

SEQ ID NO: 571754 - RNA, 64 nt, Homo Sapiens; identical to SEQ ID NO: 145985

SEQ ID NO: 571755 - RNA, 64 nt, Homo Sapiens; identical to SEQ ID NO: 145986

SEQ ID NO: 571756 - RNA, 64 nt, Homo Sapiens; identical to SEQ ID NO: 145987

SEQ ID NO: 571757 - RNA, 64 nt, Homo Sapiens; identical to SEQ ID NO: 145988

SEQ ID NO: 571758 - RNA, 64 nt, Homo Sapiens; identical to SEQ ID NO: 145989

SEQ ID NO: 571759 - RNA, 64 nt, Homo Sapiens; identical to SEQ ID NO: 145990

SEQ ID NO: 571760 - RNA, 64 nt, Homo Sapiens; identical to SEQ ID NO: 145991

SEQ ID NO: 571761 - RNA, 64 nt, Homo Sapiens; identical to SEQ ID NO: 145992

SEQ ID NO: 571762 - RNA, 64 nt, Homo Sapiens; identical to SEQ ID NO: 145993

SEQ ID NO: 571763 - RNA, 64 nt, Homo Sapiens; identical to SEQ ID NO: 145994

SEQ ID NO: 571764 - RNA, 64 nt, Homo Sapiens; identical to SEQ ID NO: 145995

SEQ ID NO: 571765 - RNA, 64 nt, Homo Sapiens; identical to SEQ ID NO: 145996

SEQ ID NO: 571766 - RNA, 64 nt, Homo Sapiens; identical to SEQ ID NO: 145997

SEQ ID NO: 571767 - RNA, 64 nt, Homo Sapiens; identical to SEQ ID NO: 145998

SEQ ID NO: 571768 - RNA, 64 nt, Homo Sapiens
cuuagguuagugcccagugccagauugguuucccccgguggagcgggagauggaaaggggauau

SEQ ID NO: 571769 - RNA, 64 nt, Homo Sapiens
cugaccacccugcuugagccgugcucgcugggguccgguggagaacccagugcuuugcuuaugg

SEQ ID NO: 571770 - RNA, 64 nt, Homo Sapiens
aggcuuucuccaggaggauuaccugaucucauguuaggccuaaggguuuuauucuauauugcuu

SEQ ID NO: 571771 - RNA, 64 nt, Homo Sapiens
cucuuuuaacagccucugaaggaggauuauaacuuaggccuagcgggaaauggggcugugagga

SEQ ID NO: 571772 - RNA, 64 nt, Homo Sapiens
uccuacccaauugucaugauuguccuuaguacccuaggccuagauucugagaucuucccauucu

SEQ ID NO: 571773 - RNA, 64 nt, Homo Sapiens
uacccuaggccuagauucugagaucuucccauucuaggccuacaagcacuacuugcuguagcug

SEQ ID NO: 571774 - RNA, 64 nt, Homo Sapiens; identical to SEQ ID NO: 571768

SEQ ID NO: 571775 - RNA, 64 nt, Homo Sapiens; identical to SEQ ID NO: 571769

SEQ ID NO: 571776 - RNA, 64 nt, Homo Sapiens; identical to SEQ ID NO: 571770

SEQ ID NO: 571777 - RNA, 64 nt, Homo Sapiens; identical to SEQ ID NO: 571771

SEQ ID NO: 571778 - RNA, 64 nt, Homo Sapiens; identical to SEQ ID NO: 571772

SEQ ID NO: 571779 - RNA, 64 nt, Homo Sapiens; identical to SEQ ID NO: 571773

SEQ ID NO: 571780 - RNA, 64 nt, Homo Sapiens; identical to SEQ ID NO: 161149

SEQ ID NO: 571781 - RNA, 64 nt, Homo Sapiens; identical to SEQ ID NO: 161150

SEQ ID NO: 571782 - RNA, 64 nt, Homo Sapiens; identical to SEQ ID NO: 161151

SEQ ID NO: 571783 - RNA, 64 nt, Homo Sapiens; identical to SEQ ID NO: 161152

SEQ ID NO: 571784 - RNA, 64 nt, Homo Sapiens; identical to SEQ ID NO: 161153

SEQ ID NO: 571785 - RNA, 64 nt, Homo Sapiens; identical to SEQ ID NO: 161154

SEQ ID NO: 571786 - RNA, 64 nt, Homo Sapiens; identical to SEQ ID NO: 161155

SEQ ID NO: 571787 - RNA, 64 nt, Homo Sapiens; identical to SEQ ID NO: 161156

SEQ ID NO: 571788 - RNA, 64 nt, Homo Sapiens; identical to SEQ ID NO: 161157

SEQ ID NO: 571789 - RNA, 64 nt, Homo Sapiens; identical to SEQ ID NO: 161158

SEQ ID NO: 571790 - RNA, 64 nt, Homo Sapiens; identical to SEQ ID NO: 161159

SEQ ID NO: 571791 - RNA, 64 nt, Homo Sapiens; identical to SEQ ID NO: 161160

SEQ ID NO: 571792 - RNA, 64 nt, Homo Sapiens; identical to SEQ ID NO: 161161

SEQ ID NO: 571793 - RNA, 64 nt, Homo Sapiens; identical to SEQ ID NO: 161162

SEQ ID NO: 571794 - RNA, 64 nt, Homo Sapiens; identical to SEQ ID NO: 161163

SEQ ID NO: 571795 - RNA, 64 nt, Homo Sapiens; identical to SEQ ID NO: 161164

SEQ ID NO: 571796 - RNA, 64 nt, Homo Sapiens; identical to SEQ ID NO: 161165

SEQ ID NO: 571797 - RNA, 64 nt, Homo Sapiens; identical to SEQ ID NO: 161166

SEQ ID NO: 571798 - RNA, 64 nt, Homo Sapiens; identical to SEQ ID NO: 161167

SEQ ID NO: 571799 - RNA, 64 nt, Homo Sapiens; identical to SEQ ID NO: 161168

SEQ ID NO: 571800 - RNA, 64 nt, Homo Sapiens; identical to SEQ ID NO: 161169

SEQ ID NO: 571801 - RNA, 64 nt, Homo Sapiens; identical to SEQ ID NO: 161170

SEQ ID NO: 571802 - RNA, 64 nt, Homo Sapiens; identical to SEQ ID NO: 161171

SEQ ID NO: 571803 - RNA, 64 nt, Homo Sapiens; identical to SEQ ID NO: 161172

SEQ ID NO: 571804 - RNA, 64 nt, Homo Sapiens; identical to SEQ ID NO: 161173

SEQ ID NO: 571805 - RNA, 64 nt, Homo Sapiens; identical to SEQ ID NO: 161174

SEQ ID NO: 571806 - RNA, 64 nt, Homo Sapiens; identical to SEQ ID NO: 161175

SEQ ID NO: 571807 - RNA, 64 nt, Homo Sapiens; identical to SEQ ID NO: 161176

SEQ ID NO: 571808 - RNA, 64 nt, Homo Sapiens; identical to SEQ ID NO: 161177

SEQ ID NO: 571809 - RNA, 64 nt, Homo Sapiens; identical to SEQ ID NO: 161178

SEQ ID NO: 571810 - RNA, 64 nt, Homo Sapiens; identical to SEQ ID NO: 161179

SEQ ID NO: 571811 - RNA, 64 nt, Homo Sapiens; identical to SEQ ID NO: 161180

SEQ ID NO: 571812 - RNA, 64 nt, Homo Sapiens; identical to SEQ ID NO: 161181

SEQ ID NO: 571813 - RNA, 64 nt, Homo Sapiens; identical to SEQ ID NO: 161182

SEQ ID NO: 571814 - RNA, 64 nt, Homo Sapiens; identical to SEQ ID NO: 161183

SEQ ID NO: 571815 - RNA, 63 nt, Homo Sapiens
gaaucacuugaccccaggugguggagguugcagugagccaagauugcaccauugcacuccagc

SEQ ID NO: 571816 - RNA, 63 nt, Homo Sapiens
gaaucgcuugaacccgggaggcacagguuccagugagccaagguugugccacugcacuccagc

SEQ ID NO: 571817 - RNA, 63 nt, Homo Sapiens
aaaaauuagcagaauugguggaugagccaagauugagccaaaaaccugggaggcggagguugu

SEQ ID NO: 571818 - RNA, 63 nt, Homo Sapiens
uugagccaaaaaaaaauuaggcggagguugugaugagccaagagaauccguugaaccugggag

SEQ ID NO: 571819 - RNA, 63 nt, Homo Sapiens
aggcaaacugcacaagcuuguguuccccuccugugagccaagguauccugaggcuuuccacaa

SEQ ID NO: 571820 - RNA, 63 nt, Homo Sapiens
agcuggcccauuggucauucuaguaaucacgucugagccaaggggauuaauuaggaaaaccaa

SEQ ID NO: 571821 - RNA, 63 nt, Homo Sapiens
ucaugccaauguauuccaguguggagguuccagugagccaaaagaaucgcuugaacccaggag

SEQ ID NO: 571822 - RNA, 63 nt, Homo Sapiens
aucuaagucaucccugacuccagcuccauuguuugagccaagaggaagaggaugguauuacau

SEQ ID NO: 571823 - RNA, 63 nt, Homo Sapiens
gaaucaccuggaguuaggagguggugguugcagugagccaaucucaccauugcacuucagccu

SEQ ID NO: 571824 - RNA, 63 nt, Homo Sapiens
agaauugccucaaccgggaggcggagguugcagugagccaagaucgcaccacugcacuccagc

SEQ ID NO: 571825 - RNA, 63 nt, Homo Sapiens
ggauugcuugaacccaagaggucgaggcugcagugagccaagauugugccacugcacuccagc

SEQ ID NO: 571826 - RNA, 63 nt, Homo Sapiens
ggagaaucuccugagccuggaagguccaggcagugagccaagauugugccaccacacuccagc

SEQ ID NO: 571827 - RNA, 63 nt, Homo Sapiens
uaacauacccuaguugccguuuuuuaauugccaugagccaaauacuucuugguauacaauuga

SEQ ID NO: 571828 - RNA, 63 nt, Homo Sapiens
uggaaaucgccccuuuugaaggugccauucuuaugagccaaaaguuugucauuuaaaaguuca

SEQ ID NO: 571829 - RNA, 63 nt, Homo Sapiens
ggucugcuccuguggcggugaugcagcuucaggugagccaagggauuuccgucaugcucccaa

SEQ ID NO: 571830 - RNA, 63 nt, Homo Sapiens
ccaccauaaugugaauaugcgggcaggccuuuuugagccaaucggggugccaugguguuggag

SEQ ID NO: 571831 - RNA, 63 nt, Homo Sapiens
ggaucacuugagccccggaggucgaggcuacagugagccaagagugcacuacuguacuccagc

SEQ ID NO: 571832 - RNA, 63 nt, Homo Sapiens
ccauuuucuaugcuuguaacugucuucuagcagugagccaaauguaaaauagugaauaaaguc

SEQ ID NO: 571833 - RNA, 63 nt, Homo Sapiens
uauuagcuacaaaacuggauaaacuucagaauaugagccaaugaguaggaaggaacuugaaga

SEQ ID NO: 571834 - RNA, 63 nt, Homo Sapiens
gaauggcaugaacccaggaggcagagauugcagugagccaagaucacgccccugcacuccagc

SEQ ID NO: 571835 - RNA, 63 nt, Homo Sapiens
uaaauaaagcaauauacugguuagauaggauauugagccaauuugaaaaccacuggucuagcu

SEQ ID NO: 571836 - RNA, 63 nt, Homo Sapiens
uaaguaaagcaauguuauuguuagauagguuguugagccaauuuuacaagaauaaagauuucu

SEQ ID NO: 571837 - RNA, 63 nt, Homo Sapiens
ucgcaccacugcacuccagcgcggagguugcagugagccaagagaauugcuugaacccaggag

SEQ ID NO: 571838 - RNA, 63 nt, Homo Sapiens
caaugaagggaaaauuaauuaacuuuucuaccuugagccaagcaucuaagaaaagggaauuuu

SEQ ID NO: 571839 - RNA, 63 nt, Homo Sapiens
gaaucacuugaaccuaggaggcggagguugcagugagccaagauggcgccauugcacuccagc

SEQ ID NO: 571840 - RNA, 63 nt, Homo Sapiens
gaaucgcuugaacccaggaggcggagguugcagugagccaagauggcgccauugcacuccagc

SEQ ID NO: 571841 - RNA, 63 nt, Homo Sapiens
caaugccacuacacuccagcgcagaggcugcagugagccaagagaauugcuugaaccugggag

SEQ ID NO: 571842 - RNA, 63 nt, Homo Sapiens
ucacagcacugcacugcugcgcggagguugcagugagccaagagaauuguuugaaccuggaag

SEQ ID NO: 571843 - RNA, 63 nt, Homo Sapiens
ucgcgccacugcacuccagcgcggagguugcggugagccaagauaaucacuugaauccgggag

SEQ ID NO: 571844 - RNA, 63 nt, Homo Sapiens
ugcacugcaccccagccuggguggggguugcagugagccaagaagaucucuugagcccaaggg

SEQ ID NO: 571845 - RNA, 63 nt, Homo Sapiens
cuggaagcauucccaugugggugucugaguccaugagccaagccugaggggacagugagucuc

SEQ ID NO: 571846 - RNA, 63 nt, Homo Sapiens
gucaccagaaagcugcuguuuuggguucugcauugagccaaauauguagaggaccuaccaagc

SEQ ID NO: 571847 - RNA, 63 nt, Homo Sapiens
ucuaucuuccacuguggcccugcagagauccccugagccaagccgaggcaguuuccacauaag

SEQ ID NO: 571848 - RNA, 63 nt, Homo Sapiens
caggguccacuagaaauuggcuguaauacucauugagccaaguugucauaucaaauucaaccc

SEQ ID NO: 571849 - RNA, 64 nt, Homo Sapiens; identical to SEQ ID NO: 179815

SEQ ID NO: 571850 - RNA, 64 nt, Homo Sapiens; identical to SEQ ID NO: 179816

SEQ ID NO: 571851 - RNA, 64 nt, Homo Sapiens; identical to SEQ ID NO: 179817

SEQ ID NO: 571852 - RNA, 64 nt, Homo Sapiens; identical to SEQ ID NO: 179818

SEQ ID NO: 571853 - RNA, 64 nt, Homo Sapiens; identical to SEQ ID NO: 179819

SEQ ID NO: 571854 - RNA, 64 nt, Homo Sapiens; identical to SEQ ID NO: 179820

SEQ ID NO: 571855 - RNA, 64 nt, Homo Sapiens; identical to SEQ ID NO: 179821

SEQ ID NO: 571856 - RNA, 64 nt, Homo Sapiens; identical to SEQ ID NO: 179822

SEQ ID NO: 571857 - RNA, 64 nt, Homo Sapiens; identical to SEQ ID NO: 179823

SEQ ID NO: 571858 - RNA, 64 nt, Homo Sapiens; identical to SEQ ID NO: 179824

SEQ ID NO: 571859 - RNA, 64 nt, Homo Sapiens; identical to SEQ ID NO: 179825

SEQ ID NO: 571860 - RNA, 64 nt, Homo Sapiens; identical to SEQ ID NO: 179826

SEQ ID NO: 571861 - RNA, 64 nt, Homo Sapiens; identical to SEQ ID NO: 179827

SEQ ID NO: 571862 - RNA, 64 nt, Homo Sapiens; identical to SEQ ID NO: 179828

SEQ ID NO: 571863 - RNA, 64 nt, Homo Sapiens; identical to SEQ ID NO: 179829

SEQ ID NO: 571864 - RNA, 64 nt, Homo Sapiens; identical to SEQ ID NO: 179830

SEQ ID NO: 571865 - RNA, 64 nt, Homo Sapiens; identical to SEQ ID NO: 179831

SEQ ID NO: 571866 - RNA, 64 nt, Homo Sapiens; identical to SEQ ID NO: 179832

SEQ ID NO: 571867 - RNA, 64 nt, Homo Sapiens; identical to SEQ ID NO: 179833

SEQ ID NO: 571868 - RNA, 64 nt, Homo Sapiens; identical to SEQ ID NO: 179834

SEQ ID NO: 571869 - RNA, 64 nt, Homo Sapiens; identical to SEQ ID NO: 179835

SEQ ID NO: 571870 - RNA, 64 nt, Homo Sapiens; identical to SEQ ID NO: 179836

SEQ ID NO: 571871 - RNA, 64 nt, Homo Sapiens; identical to SEQ ID NO: 179837

SEQ ID NO: 571872 - RNA, 53 nt, Homo Sapiens; identical to SEQ ID NO: 86549

SEQ ID NO: 571873 - RNA, 64 nt, Homo Sapiens; identical to SEQ ID NO: 179839

SEQ ID NO: 571874 - RNA, 64 nt, Homo Sapiens; identical to SEQ ID NO: 179840

SEQ ID NO: 571875 - RNA, 64 nt, Homo Sapiens; identical to SEQ ID NO: 179841

SEQ ID NO: 571876 - RNA, 64 nt, Homo Sapiens; identical to SEQ ID NO: 179842

SEQ ID NO: 571877 - RNA, 64 nt, Homo Sapiens; identical to SEQ ID NO: 179843

SEQ ID NO: 571878 - RNA, 64 nt, Homo Sapiens; identical to SEQ ID NO: 179844

SEQ ID NO: 571879 - RNA, 64 nt, Homo Sapiens; identical to SEQ ID NO: 179845

SEQ ID NO: 571880 - RNA, 64 nt, Homo Sapiens; identical to SEQ ID NO: 179846

SEQ ID NO: 571881 - RNA, 64 nt, Homo Sapiens; identical to SEQ ID NO: 179847

SEQ ID NO: 571882 - RNA, 64 nt, Homo Sapiens; identical to SEQ ID NO: 179848

SEQ ID NO: 571883 - RNA, 64 nt, Homo Sapiens; identical to SEQ ID NO: 179849

SEQ ID NO: 571884 - RNA, 64 nt, Homo Sapiens; identical to SEQ ID NO: 179850

SEQ ID NO: 571885 - RNA, 64 nt, Homo Sapiens; identical to SEQ ID NO: 179851

SEQ ID NO: 571886 - RNA, 64 nt, Homo Sapiens; identical to SEQ ID NO: 179852

SEQ ID NO: 571887 - RNA, 64 nt, Homo Sapiens; identical to SEQ ID NO: 179853

SEQ ID NO: 571888 - RNA, 64 nt, Homo Sapiens; identical to SEQ ID NO: 179854

SEQ ID NO: 571889 - RNA, 64 nt, Homo Sapiens; identical to SEQ ID NO: 179855

SEQ ID NO: 571890 - RNA, 64 nt, Homo Sapiens; identical to SEQ ID NO: 179856

SEQ ID NO: 571891 - RNA, 64 nt, Homo Sapiens; identical to SEQ ID NO: 179857

SEQ ID NO: 571892 - RNA, 64 nt, Homo Sapiens; identical to SEQ ID NO: 179858

SEQ ID NO: 571893 - RNA, 64 nt, Homo Sapiens; identical to SEQ ID NO: 179859

SEQ ID NO: 571894 - RNA, 64 nt, Homo Sapiens; identical to SEQ ID NO: 179860

SEQ ID NO: 571895 - RNA, 64 nt, Homo Sapiens; identical to SEQ ID NO: 179861

SEQ ID NO: 571896 - RNA, 64 nt, Homo Sapiens; identical to SEQ ID NO: 179862

SEQ ID NO: 571897 - RNA, 64 nt, Homo Sapiens; identical to SEQ ID NO: 179863

SEQ ID NO: 571898 - RNA, 64 nt, Homo Sapiens; identical to SEQ ID NO: 179864

SEQ ID NO: 571899 - RNA, 64 nt, Homo Sapiens; identical to SEQ ID NO: 179865

SEQ ID NO: 571900 - RNA, 64 nt, Homo Sapiens; identical to SEQ ID NO: 179866

SEQ ID NO: 571901 - RNA, 64 nt, Homo Sapiens; identical to SEQ ID NO: 179867

SEQ ID NO: 571902 - RNA, 64 nt, Homo Sapiens; identical to SEQ ID NO: 179868

SEQ ID NO: 571903 - RNA, 64 nt, Homo Sapiens; identical to SEQ ID NO: 179869

SEQ ID NO: 571904 - RNA, 64 nt, Homo Sapiens; identical to SEQ ID NO: 485635

SEQ ID NO: 571905 - RNA, 64 nt, Homo Sapiens; identical to SEQ ID NO: 485636

SEQ ID NO: 571906 - RNA, 64 nt, Homo Sapiens; identical to SEQ ID NO: 485637

SEQ ID NO: 571907 - RNA, 64 nt, Homo Sapiens; identical to SEQ ID NO: 485638

SEQ ID NO: 571908 - RNA, 64 nt, Homo Sapiens; identical to SEQ ID NO: 485639

SEQ ID NO: 571909 - RNA, 64 nt, Homo Sapiens; identical to SEQ ID NO: 485640

SEQ ID NO: 571910 - RNA, 64 nt, Homo Sapiens; identical to SEQ ID NO: 485641

SEQ ID NO: 571911 - RNA, 64 nt, Homo Sapiens; identical to SEQ ID NO: 485642

SEQ ID NO: 571912 - RNA, 64 nt, Homo Sapiens; identical to SEQ ID NO: 485643

SEQ ID NO: 571913 - RNA, 64 nt, Homo Sapiens; identical to SEQ ID NO: 485644

SEQ ID NO: 571914 - RNA, 64 nt, Homo Sapiens; identical to SEQ ID NO: 485645

SEQ ID NO: 571915 - RNA, 64 nt, Homo Sapiens; identical to SEQ ID NO: 485646

SEQ ID NO: 571916 - RNA, 64 nt, Homo Sapiens; identical to SEQ ID NO: 485647

SEQ ID NO: 571917 - RNA, 64 nt, Homo Sapiens; identical to SEQ ID NO: 485648

SEQ ID NO: 571918 - RNA, 64 nt, Homo Sapiens; identical to SEQ ID NO: 485649

SEQ ID NO: 571919 - RNA, 64 nt, Homo Sapiens; identical to SEQ ID NO: 485650

SEQ ID NO: 571920 - RNA, 64 nt, Homo Sapiens; identical to SEQ ID NO: 485651

SEQ ID NO: 571921 - RNA, 64 nt, Homo Sapiens; identical to SEQ ID NO: 485652

SEQ ID NO: 571922 - RNA, 64 nt, Homo Sapiens; identical to SEQ ID NO: 485653

SEQ ID NO: 571923 - RNA, 64 nt, Homo Sapiens; identical to SEQ ID NO: 485654

SEQ ID NO: 571924 - RNA, 64 nt, Homo Sapiens; identical to SEQ ID NO: 485655

SEQ ID NO: 571925 - RNA, 64 nt, Homo Sapiens; identical to SEQ ID NO: 485656

SEQ ID NO: 571926 - RNA, 64 nt, Homo Sapiens; identical to SEQ ID NO: 485657

SEQ ID NO: 571927 - RNA, 64 nt, Homo Sapiens; identical to SEQ ID NO: 485658

SEQ ID NO: 571928 - RNA, 64 nt, Homo Sapiens; identical to SEQ ID NO: 485659

SEQ ID NO: 571929 - RNA, 64 nt, Homo Sapiens; identical to SEQ ID NO: 485660

SEQ ID NO: 571930 - RNA, 64 nt, Homo Sapiens; identical to SEQ ID NO: 485661

SEQ ID NO: 571931 - RNA, 64 nt, Homo Sapiens; identical to SEQ ID NO: 485662

SEQ ID NO: 571932 - RNA, 64 nt, Homo Sapiens; identical to SEQ ID NO: 485663

SEQ ID NO: 571933 - RNA, 64 nt, Homo Sapiens; identical to SEQ ID NO: 485664

SEQ ID NO: 571934 - RNA, 64 nt, Homo Sapiens; identical to SEQ ID NO: 485665

SEQ ID NO: 571935 - RNA, 64 nt, Homo Sapiens; identical to SEQ ID NO: 485666

SEQ ID NO: 571936 - RNA, 64 nt, Homo Sapiens; identical to SEQ ID NO: 485667

SEQ ID NO: 571937 - RNA, 64 nt, Homo Sapiens
accaucuuccuguccugccugacaguucgcucauuccaacuaaucaucaucuucaaguuuucca

SEQ ID NO: 571938 - RNA, 64 nt, Homo Sapiens
ccggauuguguuaguaguagccaucaggagggucuccaacuaaaacacuuguuccugcuugcuc

SEQ ID NO: 571939 - RNA, 64 nt, Homo Sapiens
ugacagcaacgauuccaaccacggcaagcuggcuuccaacuauaacauuuuacucucaaagguc

SEQ ID NO: 571940 - RNA, 64 nt, Homo Sapiens
uuuaaacacagagaccugccaagacgcccucucguccaacuaugcccaggcugaaguccucacc

SEQ ID NO: 571941 - RNA, 64 nt, Homo Sapiens
uguaagaaaccccuguccccagucagagauaacauccaacuaacuccagaagcggaagaggaua

SEQ ID NO: 571942 - RNA, 64 nt, Homo Sapiens
auuauaaucaaaaucaaugcacauaguccagugguccaacuauaauuauaguuuaaauucaauu

SEQ ID NO: 571943 - RNA, 64 nt, Homo Sapiens
acuguaaugauaaucuuucuuguuuguuacuuuuuccaacuaccaaugauagacaaauacccag

SEQ ID NO: 571944 - RNA, 64 nt, Homo Sapiens
auaaaauguuuugcuaaaucuuuuucucuuugucuccaacuaauugugccuucauacaauaaua

SEQ ID NO: 571945 - RNA, 64 nt, Homo Sapiens
caaauaaaguagagcuuaugcagaagaaaugaaauccaacuagaccaauaaacaauaaauuuuc

SEQ ID NO: 571946 - RNA, 64 nt, Homo Sapiens
ugacauguagcucauguauguaucuuauacauaauccaacuaauagcauuauuucauaaaaugc

SEQ ID NO: 571947 - RNA, 64 nt, Homo Sapiens
aaugaauggaagaugaugggguggaaauguaugauccaacuagaguucucaugccaucaguugu

SEQ ID NO: 571948 - RNA, 64 nt, Homo Sapiens
uuacugaacugauuuagcagggaauggaauccauuccaacuauugcacguggauuucccagcug

SEQ ID NO: 571949 - RNA, 64 nt, Homo Sapiens
ccuccuggguucaagggauucuccugccucagccuccaacuagcugggauuacaggcacaagcc

SEQ ID NO: 571950 - RNA, 64 nt, Homo Sapiens
gaggucuuaaaguccagggaaaaaaagucuggguuccaacuagaauucuagaaauauuucuaga

SEQ ID NO: 571951 - RNA, 64 nt, Homo Sapiens
guuugaaauggcaauuaucaguguuggauuuaguuccaacuacuugauuuacaaaaauguacau

SEQ ID NO: 571952 - RNA, 64 nt, Homo Sapiens
gcugcagcauuuugguaaaacaaaauaacucauuuccaacuacugauugaacacuuuaguaaug

SEQ ID NO: 571953 - RNA, 64 nt, Homo Sapiens
gugccuugcaagugcucaacuguugaccuugcacuccaacuauacuugggcacagaccugcauu

SEQ ID NO: 571954 - RNA, 64 nt, Homo Sapiens
caggaggcugaggcaugagagugggugccuguaauccaacuaccaaaauuagccagacguggug

SEQ ID NO: 571955 - RNA, 64 nt, Homo Sapiens
aucugccaaguggauacuggaucuugagcaguuauccaacuagguccacccauucucccuuugc

SEQ ID NO: 571956 - RNA, 64 nt, Homo Sapiens
ugaccuacacggacuuuuauaagucuucuuuccuuccaacuaaaguaucuaaugucucccuaau

SEQ ID NO: 571957 - RNA, 64 nt, Homo Sapiens
uaaauauucuaugguacauucucagaaauuggcuuccaacuaaaauacguuugacccauuuuga

SEQ ID NO: 571958 - RNA, 64 nt, Homo Sapiens
uaauuuuaguacuugaauaaguaugcagcagaacuccaacuaucuuuuuuccuguuuuuuuuaa

SEQ ID NO: 571959 - RNA, 64 nt, Homo Sapiens
cucauaauccaguuuaauccuuuuauuugcuuccuccaacuauuuaaagugguccaaaaacacu

SEQ ID NO: 571960 - RNA, 64 nt, Homo Sapiens
aauagaauaaaggcaguuuuuaccaguuaauuuuuccaacuacucugacuaaacuuuuuuucug

SEQ ID NO: 571961 - RNA, 64 nt, Homo Sapiens
uauuuuuuucuaaauaaauagguuucuucuguuuuccaacuaaacaugaaguguguuuuucuuu

SEQ ID NO: 571962 - RNA, 64 nt, Homo Sapiens
uauguguguccuguaacacaaaaguuuaacaccuuccaacuacuucugauuuugcuuugcuguc

SEQ ID NO: 571963 - RNA, 64 nt, Homo Sapiens
ggaagagaaacuuguggaaagauuucucuaauuuuccaacuagauaacacaaaauuaaaaacau

SEQ ID NO: 571964 - RNA, 64 nt, Homo Sapiens
uugaauaaauaguaauauuuugcaaugcuuguuuuccaacuaugaucugcuuuacaugauacua

SEQ ID NO: 571965 - RNA, 64 nt, Homo Sapiens
cgcccuagagaaaaagauucugaaggaacucacuuccaacuauaucccuucuuaccugaacaac

SEQ ID NO: 571966 - RNA, 64 nt, Homo Sapiens
aauagaauggaauuaaaacuguucagaaugauuuuccaacuagcaaauauaaguaugccugguu

SEQ ID NO: 571967 - RNA, 64 nt, Homo Sapiens
guccauaccuacuucuaggauugcaaaggagucuuccaacuagagaaaaauuguccacugacau

SEQ ID NO: 571968 - RNA, 64 nt, Homo Sapiens
augaaguuggcagcaacagacaaucuuuucugccuccaacuacuuguuuugauguagguauuaa

SEQ ID NO: 571969 - RNA, 64 nt, Homo Sapiens
uagaucauuaucucuuuccuauuuuuugucuuauuccaacuaaguagggaauaauaaaggccug

SEQ ID NO: 571970 - RNA, 64 nt, Homo Sapiens
aaacauuuuccuauuaaaauuauuuccaaaacguuccaacuaaauagaagacauugcguuaucu

SEQ ID NO: 571971 - RNA, 64 nt, Homo Sapiens
gaaaauaauguuggacaaguuuaauucagccuuauccaacuaggcuuccuuuaacgaagugccu

SEQ ID NO: 571972 - RNA, 64 nt, Homo Sapiens
guauauuuuuuguuuauuaagaugagaguuuaauuccaacuagaaugggucuaacuacauugau

SEQ ID NO: 571973 - RNA, 64 nt, Homo Sapiens
gauagcuuauuuugaaaaagaacucuuuggugacuccaacuaugaaaaccagaaaaaaguccag

SEQ ID NO: 571974 - RNA, 64 nt, Homo Sapiens
uaauuuguagcucaucauuucauuuuuuucuuccuccaacuacacagacauaaaugcuaaguaa

SEQ ID NO: 571975 - RNA, 64 nt, Homo Sapiens
caaagaaaaaauuguuguuuguauucaagagacuuccaacuagacauuuugccuugcuguguau

SEQ ID NO: 571976 - RNA, 64 nt, Homo Sapiens
guauauuuagguaacuagaacgauuagcuauuuauccaacuacuguuuagauguauguguaaau

SEQ ID NO: 571977 - RNA, 64 nt, Homo Sapiens
uccuucccugccuuaggccggaugcucuccgagguccaacuauacaaaugcuaguaagcagaaa

SEQ ID NO: 571978 - RNA, 64 nt, Homo Sapiens
auauaauacauuucgaucuugaaaaaaaacacuuuccaacuauuuuguauuacaaaggaaccau

SEQ ID NO: 571979 - RNA, 64 nt, Homo Sapiens
aucccacuuccugcccccagaaagggccuuuauuuccaacuaggaggauaaugccuaguccagg

SEQ ID NO: 571980 - RNA, 64 nt, Homo Sapiens
cauauuuaugaagcaagaauagguacagucauuuuccaacuaacaucuagugagacugggauuc

SEQ ID NO: 571981 - RNA, 64 nt, Homo Sapiens
ucuccagcaauaggaugauuuacuauaaauuucauccaacuacuugugaucucucucaccuaca

SEQ ID NO: 571982 - RNA, 64 nt, Homo Sapiens
auagggaacacguagauuugacccugguucugcauccaacuagcuguuucuugaaagagccugg

SEQ ID NO: 571983 - RNA, 64 nt, Homo Sapiens
uuuuugauagaauuaaauuuauuuaaauuuauccuccaacuaaauaaauuuuugauagaauuaa

SEQ ID NO: 571984 - RNA, 58 nt, Homo Sapiens
aguuuggcccggccacuggcgucucgucuccaacuagauuguaccagcggaaagcuga

SEQ ID NO: 571985 - RNA, 64 nt, Homo Sapiens
aauaaacaacuacuguugauugugcccuggaauuuccaacuaguuacaauuggacauucauuug

SEQ ID NO: 571986 - RNA, 52 nt, Homo Sapiens
gcaggaauccggauuguucgucuccaacuacuugugauuuucaguggcuuga

SEQ ID NO: 571987 - RNA, 64 nt, Homo Sapiens
gccaaauugcagaagaaacuaguuuuuuucaaaguccaacuacagcgcgcacacacacucuuca

SEQ ID NO: 571988 - RNA, 64 nt, Homo Sapiens
cauucacgguauggaaauacaguaaaugaaagauuccaacuaguugucagugcuucuugaaauu

SEQ ID NO: 571989 - RNA, 64 nt, Homo Sapiens
augguuuaauuuuauguggacguauguuaaauuauccaacuacccuauuguuaagcauuugguu

SEQ ID NO: 571990 - RNA, 64 nt, Homo Sapiens
aaguuagaaaacauaaucuucugccuucucaugauccaacuaaugccuuacucuucuugaaauu

SEQ ID NO: 571991 - RNA, 64 nt, Homo Sapiens
guuuagaaacacaacuauauuguuugcuaagcauuccaacuaucucauuuccaagcaaguauua

SEQ ID NO: 571992 - RNA, 64 nt, Homo Sapiens
uucuuccuggggccaguuuugcuccuucugccauuccaacuaguaacacagcucuuagcuggga

SEQ ID NO: 571993 - RNA, 64 nt, Homo Sapiens
aauuacgcuaucuagaauugcuauagucacaauauccaacuaaaguuccaaauguauuucauua

SEQ ID NO: 571994 - RNA, 64 nt, Homo Sapiens
acaacuguaauguacuugauuguuuucuuuuucguccaacuaaaguaauuuauuuuugauucuu

SEQ ID NO: 571995 - RNA, 64 nt, Homo Sapiens
uuucuaagacauauuuaauguagguuacauacacuccaacuauuacuuugcuuuugcauaugaa

SEQ ID NO: 571996 - RNA, 64 nt, Homo Sapiens
aagauaucucaaugugcaauaaauaagaauguuauccaacuauuaauccacacauauuguuuua

SEQ ID NO: 571997 - RNA, 64 nt, Homo Sapiens
ugggacuacaggugcgcgccuccugccucagccuuccaacuagccuccugggcucaagcaaucc

SEQ ID NO: 571998 - RNA, 64 nt, Homo Sapiens
cacaaaccuugaacauuuuaaggugguguugguauccaacuauacgaacuucgaccuacugaaa

SEQ ID NO: 571999 - RNA, 64 nt, Homo Sapiens
agacagauauuuacauuuaaaaaacaugaaggacuccaacuagauuuucucugaguuggaaaca

SEQ ID NO: 572000 - RNA, 64 nt, Homo Sapiens
gccugggaucuugcgaaaagaaaggaacagaaguuccaacuauugacacaaugguucaugccca

SEQ ID NO: 572001 - RNA, 64 nt, Homo Sapiens
acaacauguuuuagagcauccaaguaccauauaauccaacuaucaugguaaggccagaaaucuu

SEQ ID NO: 572002 - RNA, 64 nt, Homo Sapiens
auggaguccauuggcgaacccuauugcaauuugguccaacuauaucuucuggugaaggaaauua

SEQ ID NO: 572003 - RNA, 64 nt, Homo Sapiens
uuggaggcuuuggaagggcacugggaccugucuuuccaacuaaaucacuaucagagccacaaau

SEQ ID NO: 572004 - RNA, 64 nt, Homo Sapiens
aaaaaacccuacagcuaacauuauccuugauguuuccaacuagacacuuuccuacuaagaucag

SEQ ID NO: 572005 - RNA, 64 nt, Homo Sapiens
gccagggccugccggcgcggggaggaaagcaaaauccaacuaaugguauauauuguaggguaca

SEQ ID NO: 572006 - RNA, 64 nt, Homo Sapiens
ugcaaugaaucuagaugcaauuaauuuuauuccuuccaacuaaaauuacaauauuuuuagguua

SEQ ID NO: 572007 - RNA, 64 nt, Homo Sapiens
uuugucuccuccuuuaacugagucaucaucuuaguccaacuaaugcagucgauacaaugcguag

SEQ ID NO: 572008 - RNA, 64 nt, Homo Sapiens
aauauuuuaauggcagacugggaaaacagaauucuccaacuaaacagccaugguucuuucuggu

SEQ ID NO: 572009 - RNA, 64 nt, Homo Sapiens
ugcuuuccuacuaagaucagucauccuugauguuuccaacuaaaaaaaaacccuacaucuagca

SEQ ID NO: 572010 - RNA, 64 nt, Homo Sapiens
gcuguggugggcagagccccaaaacaagcagccuuccaacuagagacucgggggugucugaagg

SEQ ID NO: 572011 - RNA, 64 nt, Homo Sapiens
uaccuaccguagcuuuuuaccguucacuuccccuuccaacuauguccagaugugcaggcuccuc

SEQ ID NO: 572012 - RNA, 64 nt, Homo Sapiens
aaacugggggauauuaugaacuuuguucccuaaguccaacuacuccaauuucuauuaaagguuc

SEQ ID NO: 572013 - RNA, 64 nt, Homo Sapiens
guauugccacuauuguuaauuccaaaccuaauuguccaacuauuauuugguugagcucauauaa

SEQ ID NO: 572014 - RNA, 64 nt, Homo Sapiens
uggugcguaauuguuuccuacugaggacagcuaauccaacuacuuuucaguuuuauaaagggaa

SEQ ID NO: 572015 - RNA, 64 nt, Homo Sapiens
cgaauuucugugcccuccugacccauugcuguuguccaacuauuuauugacucuggguccuucc

SEQ ID NO: 572016 - RNA, 64 nt, Homo Sapiens
uuggucacaacuauucaugcuuccugugauuucauccaacuacuuaccuugccuacgauauccc

SEQ ID NO: 572017 - RNA, 64 nt, Homo Sapiens
auugcuuaagauacgcagccauuccauauucaucuccaacuacacaggggaacggagcagauag

SEQ ID NO: 572018 - RNA, 64 nt, Homo Sapiens
aaacauuucauuaugaggucagacuaggauaauguccaacuaaaaacaaacccuuuucauccug

SEQ ID NO: 572019 - RNA, 64 nt, Homo Sapiens
gacaucuuaaacccuacaaacuuggaaaaauuuauccaacuauauuuuugucacauaucuuuuu

SEQ ID NO: 572020 - RNA, 64 nt, Homo Sapiens
uccuuaugauguuuuuaacauuauaacugccaucuccaacuacaacuaagcauuguaaauuuau

SEQ ID NO: 572021 - RNA, 64 nt, Homo Sapiens
ucuuucaucagaaaaaguccucuguugauggagauccaacuauuuguggucugucagcugugaa

SEQ ID NO: 572022 - RNA, 64 nt, Homo Sapiens
gccacuccccgcuuacauuuaugugucaguguuuuccaacuacuuagaguuuauguaccucgug

SEQ ID NO: 572023 - RNA, 64 nt, Homo Sapiens
ugcuugcauuggugaauauacauauuuuaaaaauuccaacuaucauuuguaauaaaaucaacuu

SEQ ID NO: 572024 - RNA, 64 nt, Homo Sapiens
uagugguagaacuaggauuuauugugaacugcuauccaacuauucuuaaaccacauaaccaagc

SEQ ID NO: 572025 - RNA, 64 nt, Homo Sapiens
uuauuuggcuauaaaaagucagcauaaaauaugauccaacuaaaagggauuaauuuuuggcauu

SEQ ID NO: 572026 - RNA, 64 nt, Homo Sapiens
gcucgagggaggggagugcuuucugccccaugccuccaacuacuguaugcaggccuggcucucu

SEQ ID NO: 572027 - RNA, 64 nt, Homo Sapiens
acugauacuaauuauauaaugagaaaaaaauguauccaacuaggacacauaucuuuugaguuau

SEQ ID NO: 572028 - RNA, 64 nt, Homo Sapiens
ccuagacugacuaggauucuauuucauaagcacauccaacuacuuuuauuucuguaucugacau

SEQ ID NO: 572029 - RNA, 64 nt, Homo Sapiens
gagugucacugcuuucuagggugcucugcuuuuuuccaacuacgcacaccagguacuuaaagau

SEQ ID NO: 572030 - RNA, 64 nt, Homo Sapiens
uagccaugugacguccugguugcugccagggacuuccaacuagaaaaauugaaauuguuuccca

SEQ ID NO: 572031 - RNA, 64 nt, Homo Sapiens
aacccucucuggccccaugucauugugaguggcuuccaacuagcuaccgagauuugggcaauag

SEQ ID NO: 572032 - RNA, 64 nt, Homo Sapiens
uagaacaugagcguggacuuggcugccacaagaauccaacuacauuguggccacgcccccaccc

SEQ ID NO: 572033 - RNA, 64 nt, Homo Sapiens
guuggaccacguggcaucagaggucccauccagauccaacuauagguccaagaguccacguaag

SEQ ID NO: 572034 - RNA, 64 nt, Homo Sapiens
uuaagacuuggauucucuucugcccuuguuaaucuccaacuaauuacuacagauugacacguuu

SEQ ID NO: 572035 - RNA, 64 nt, Homo Sapiens
acccaagacacaguacccagucaugguuuccccauccaacuauuaguuucauacuuugaaaacu

SEQ ID NO: 572036 - RNA, 64 nt, Homo Sapiens
gcaguucagggcugauccaauaagguaaacccauuccaacuacaguuaugugcaaugaccuauu

SEQ ID NO: 572037 - RNA, 64 nt, Homo Sapiens
aagaaacucacccccaagggcagcacccagcaacuccaacuaacccugccagacggcacccacc

SEQ ID NO: 572038 - RNA, 64 nt, Homo Sapiens
uguccaaaaccuaaauugaaaauaaacuuguuuauccaacuaagguauguugacuaaauuuaca

SEQ ID NO: 572039 - RNA, 64 nt, Homo Sapiens
accugcuugaauguaaauaucuaaacuauaagcuuccaacuauuacugcugcuacuagaaaugu

SEQ ID NO: 572040 - RNA, 64 nt, Homo Sapiens
cgcaggacaccaggucccuuaaguucucacccuguccaacuauuaacuuucuuccuuggaggcc

SEQ ID NO: 572041 - RNA, 64 nt, Homo Sapiens
ugagggcagcaggaugguggccuggguggggucguccaacuagguuugcuaaccugagggguca

SEQ ID NO: 572042 - RNA, 64 nt, Homo Sapiens
ggccucaaacgauccuccugugcccacacugcucuccaacuacugagauggggucuugcuacgu

SEQ ID NO: 572043 - RNA, 64 nt, Homo Sapiens
gaccagaauauaaaaagcaaauacaaaaauaaaauccaacuaaaagcuuucuacuuuauaucau

SEQ ID NO: 572044 - RNA, 64 nt, Homo Sapiens
cucuugagagcaagugagauuguuagaauuaaguuccaacuauacaguuuucuaacauagcuau

SEQ ID NO: 572045 - RNA, 64 nt, Homo Sapiens
aaacggauggccucuacgcuguuccaucacagucuccaacuaaggcuuaugguauuucauuaaa

SEQ ID NO: 572046 - RNA, 64 nt, Homo Sapiens
gguggugcuucccuacccccuagaaaugcugccuuccaacuaccacucucccagaugugacccu

SEQ ID NO: 572047 - RNA, 64 nt, Homo Sapiens
ucuuguaucugguucuacucccaggaugaaauuauccaacuacauauauauuuagaggaagaaa

SEQ ID NO: 572048 - RNA, 64 nt, Homo Sapiens
uuagcaaauguuaauuccuaugggaaaaacugaguccaacuagaggugagaaaauagagcauug

SEQ ID NO: 572049 - RNA, 64 nt, Homo Sapiens
ccuagccuauacccucugcuaccuuucccccuuauccaacuagcccaccccaauaucaucaggc

SEQ ID NO: 572050 - RNA, 64 nt, Homo Sapiens
aaucauaguuauuuuuaacucccugucugauaguuccaacuacuaggucaacugagucuagguc

SEQ ID NO: 572051 - RNA, 64 nt, Homo Sapiens
guguuacauuucauguaauuuagccaacucccauuccaacuaggcuuuggcuaaaucugacaau

SEQ ID NO: 572052 - RNA, 64 nt, Homo Sapiens
uuuuggauaaaauuggguuuuaacauaccucgaguccaacuaaucucauuaaacaaauauucuc

SEQ ID NO: 572053 - RNA, 64 nt, Homo Sapiens
auguguauauauuucuaucucuugcuacaauaauuccaacuaagugaacuucucaauuaucauc

SEQ ID NO: 572054 - RNA, 64 nt, Homo Sapiens
uagucuuguuggagaagcccagagagaaugggacuccaacuaagggaaccugaaaucaacucaa

SEQ ID NO: 572055 - RNA, 64 nt, Homo Sapiens
aaguguuuaagaaucuacacacuacaaacuggaauccaacuauaauuuuuauguauuuuucaaa

SEQ ID NO: 572056 - RNA, 64 nt, Homo Sapiens
uuugugucagcuuccagcucacaaacagggcugcuccaacuaguuccacccgccuugcuuuaag

SEQ ID NO: 572057 - RNA, 59 nt, Homo Sapiens
accaaaauuucaaaccuaggacacuggaaugacugcagggaucagugguucucccauau

SEQ ID NO: 572058 - RNA, 59 nt, Homo Sapiens
gguuuuuuaaauuuuuucagugagcguggugacugcagagguuagugcugugaaaagcu

SEQ ID NO: 572059 - RNA, 59 nt, Homo Sapiens
gcuaacauuauuuguguauuaaauguauuugacugcaggaauuugugcguauccguuuu

SEQ ID NO: 572060 - RNA, 59 nt, Homo Sapiens
guuugcccguaucaucaugauugguacccugacugcacuacagugguuuaucuaugacu

SEQ ID NO: 572061 - RNA, 59 nt, Homo Sapiens
aaugccuuuggcuggucgccagcugugcaugacugcaguuccuagacucuaacuuaacc

SEQ ID NO: 572062 - RNA, 59 nt, Homo Sapiens
gagcauaggcgggaaaucugaguagagucugacugcaguuuuugcuuaugauuuguaaa

SEQ ID NO: 572063 - RNA, 59 nt, Homo Sapiens
aagugggaguguuucuguuguaauugcugugacugcaggggaguguuuuuauuguuagc

SEQ ID NO: 572064 - RNA, 59 nt, Homo Sapiens
aagugggaguguuuuuauuguuucagcugugacugcaggguagucugccuugaaaaguc

SEQ ID NO: 572065 - RNA, 59 nt, Homo Sapiens
uacaaacacccaggauccuuuggaagacuugacugcaaauucuucacagugcagugaau

SEQ ID NO: 572066 - RNA, 59 nt, Homo Sapiens
aaccagguaauauuggcaaauagcuuaaaugacugcaguaauuuauuaucauugaagaa

SEQ ID NO: 572067 - RNA, 64 nt, Homo Sapiens
guaaaccccaccauuaccuuaagacccuucgguguccaucuacacuaacuauaucuugaaaaca

SEQ ID NO: 572068 - RNA, 64 nt, Homo Sapiens
aaguucccaaaggcaagacucccucuguuaccuuuccaucuagcggugacuugaggcuggagcu

SEQ ID NO: 572069 - RNA, 64 nt, Homo Sapiens
auuuaucccgaucuccuggaaggcuguugugauuuccaucuaagaaaugagggucuugagaauc

SEQ ID NO: 572070 - RNA, 64 nt, Homo Sapiens
gaucccuuccccugcuuugacccccagacuuugcuccaucuauuauugcuucuccauccuggau

SEQ ID NO: 572071 - RNA, 64 nt, Homo Sapiens
ccccacaugccagaaaagugaaguccuagguguuuccaucuauguuucaaucuguccaucuacc

SEQ ID NO: 572072 - RNA, 64 nt, Homo Sapiens
aaguccuagguguuuccaucuauguuucaaucuguccaucuaccaggccucgcgauaaaaacaa

SEQ ID NO: 572073 - RNA, 64 nt, Homo Sapiens
uucuuagcugcugaaaucagugcucuuucacuucuucagagaagcagggaugguaccuacccgg

SEQ ID NO: 572074 - RNA, 64 nt, Homo Sapiens
agcccuguuuccugcguaaaggugguauguccaguucagagauguguauaaugagcauggcuug

SEQ ID NO: 572075 - RNA, 64 nt, Homo Sapiens
uguaguaaauuauguugaaacauuuuauauacacuucagagaccuguaagauguugcacuaaaa

SEQ ID NO: 572076 - RNA, 64 nt, Homo Sapiens
ugggcuuucagugggaauuuccccauuucuuuauuucagagaugugaaaaaagaaggucuuuug

SEQ ID NO: 572077 - RNA, 64 nt, Homo Sapiens
aaugguucaaaugucuuacagaacuaagaucuuuuucagagaaauugcucacaaaaguuaguga

SEQ ID NO: 572078 - RNA, 64 nt, Homo Sapiens
gcacuuaaacuugugauaaggaagaugaagggucuucagagaagaaccucuuaaaaggcccacg

SEQ ID NO: 572079 - RNA, 64 nt, Homo Sapiens
uccuauuagaaugguagcuuugaaguguuuuuacuucagagauccugcauagcauuuauugggg

SEQ ID NO: 572080 - RNA, 64 nt, Homo Sapiens
auuacuaaaucaguuauuauuuuacuuuuccaaauucagagaaagaaaacagauuaccugaauu

SEQ ID NO: 572081 - RNA, 64 nt, Homo Sapiens
ggugcagcgccagacauuuucaggcgggacuuucuucagagaguuucuggaggaaugcauguca

SEQ ID NO: 572082 - RNA, 64 nt, Homo Sapiens
cugcugcuaaggaccuucuagcagaacacauguuuucagagaagucugcucccuuucuccagag

SEQ ID NO: 572083 - RNA, 64 nt, Homo Sapiens
ugaucacugagacagccacuugguuuuuggcucuuucagagaggucucagguucuuuccaugca

SEQ ID NO: 572084 - RNA, 64 nt, Homo Sapiens
acaaaucacuguauuuaucuccgcaggcuauuuguucagagaggccuuuuguuuaaauauaaau

SEQ ID NO: 572085 - RNA, 64 nt, Homo Sapiens
aaugcguggcagagacugcaacagggauuguguguucagagaucauaugcauauguguagggcu

SEQ ID NO: 572086 - RNA, 64 nt, Homo Sapiens
ugugauggguuguagaagcguguguuugagagaauucagagacauuugaaggcugcugugugca

SEQ ID NO: 572087 - RNA, 64 nt, Homo Sapiens
gcagguuuuccauuuuaguggguucugcuuuuauuucagagacagacaugugucuucucugucc

SEQ ID NO: 572088 - RNA, 64 nt, Homo Sapiens
gucccagugugcgagccccacuuggacacaaguguucagagaggucccccucugccacuugaca

SEQ ID NO: 572089 - RNA, 64 nt, Homo Sapiens
agacuuguauauuucaguggaaauacaaaaccacuucagagaccaggguaucuccucuggaagg

SEQ ID NO: 572090 - RNA, 64 nt, Homo Sapiens
aauguucuuagaggaggaaauauccuuuguccuguucagagagaccagggcccuaccauuaggc

SEQ ID NO: 572091 - RNA, 64 nt, Homo Sapiens
uagucauauuuaaaguugucgaauucuaaauaaguucagagauauuccaaacuaauaaacugau

SEQ ID NO: 572092 - RNA, 64 nt, Homo Sapiens
cauucuaaacaagggcauucuuaaaaaugaagauuucagagacccauaauuaccuagaugccuc

SEQ ID NO: 572093 - RNA, 64 nt, Homo Sapiens
auugggucugggaagagguaaugcucucugauaauucagagagcccaccuuuacuggguucuaa

SEQ ID NO: 572094 - RNA, 64 nt, Homo Sapiens
auccauuaaagcagccaggaaucagcgaugugucuucagagacaaggccuucccggggcccccc

SEQ ID NO: 572095 - RNA, 64 nt, Homo Sapiens
gcacguuugaauacauucuccaguagacagggacuucagagauuauccaugcuuuacaccugga

SEQ ID NO: 572096 - RNA, 64 nt, Homo Sapiens
agaggaggaagauggugacacugggaauacaggguucagagaggaucucggcugaauucaggac

SEQ ID NO: 572097 - RNA, 64 nt, Homo Sapiens
accccacggggcuguuugucauugaccuacaugguucagagaacucccagugagagagcugucc

SEQ ID NO: 572098 - RNA, 64 nt, Homo Sapiens
uguuccaugcucucuagcacaaagaagaguugacuucagagaugauucaacucgugauacacca

SEQ ID NO: 572099 - RNA, 64 nt, Homo Sapiens
gaaaauaaaaaggauucuaauauuuuauucucuuuucagagaagaacuuccuucuugcugaaca

SEQ ID NO: 572100 - RNA, 64 nt, Homo Sapiens
uuauguuuucauccauuaaauauucagagaaaacuucagagaaagagcucaucaucagucuuaa

SEQ ID NO: 572101 - RNA, 64 nt, Homo Sapiens
acuucagagaaauuauguuucaucagucuuaauauucagagaaaucugaacaaagagagcucau

SEQ ID NO: 572102 - RNA, 64 nt, Homo Sapiens
acauucaacucaggaagcauuugacucguuguacuucagagaccauaaaugacaagguuuugac

SEQ ID NO: 572103 - RNA, 64 nt, Homo Sapiens
cauguguaaaauuauacuuucaguaauuggagaauucagagauugcauuucuagcagagaauuc

SEQ ID NO: 572104 - RNA, 64 nt, Homo Sapiens
guauuacuuuuccuacaacagaaccuggugaaacuucagagagcugucuagaacucgagaauca

SEQ ID NO: 572105 - RNA, 64 nt, Homo Sapiens
uuauauuucacuagaacuguguacuugauugauuuucagagaaauaucacaaauuagaaauauu

SEQ ID NO: 572106 - RNA, 64 nt, Homo Sapiens
auuuuuguuuuuguuggauagcuuuuaauuacauuucagagagguguaauuuuggguagaugcu

SEQ ID NO: 572107 - RNA, 64 nt, Homo Sapiens
uuuauaugacuggugauacuggcuuuacagaaauuucagagaacuaauuuuuaaaaucuuuagc

SEQ ID NO: 572108 - RNA, 64 nt, Homo Sapiens
uuuuuuuuccuaugugcaacuaugaauuguacguuucagagaaacuguccucauuggucguccc

SEQ ID NO: 572109 - RNA, 64 nt, Homo Sapiens
gccgagcguggcuuucucuaccguuccauccugguucagagaagagcuucguuucaggggucug

SEQ ID NO: 572110 - RNA, 55 nt, Homo Sapiens
gucuuccaaugccaaucugaggaccuucagagacagucuacgccuuaacaagcac

SEQ ID NO: 572111 - RNA, 64 nt, Homo Sapiens
acaaaaacuguuuuaagacgucuacguugaauuauucagagaauuaagcaauaaaagcucacac

SEQ ID NO: 572112 - RNA, 64 nt, Homo Sapiens
gguguuggcucuagacuggucagcccuucuggguuucagagaccgggaggugcuguuaguuggg

SEQ ID NO: 572113 - RNA, 64 nt, Homo Sapiens
gggacuuggccagugguuuaagcucaaguucuuuuucagagaaaucugcacagggcaguuagcc

SEQ ID NO: 572114 - RNA, 64 nt, Homo Sapiens
cccagucacccacucacucagaaagccgggagucaucggacaccuugcuggucagagguccugg

SEQ ID NO: 572115 - RNA, 64 nt, Homo Sapiens
aaguuggugcugcuaagaccgagaaauuuaaagaaucggacagauggacgcagagaaccagagg

SEQ ID NO: 572116 - RNA, 64 nt, Homo Sapiens
ccagggccugagcagcuggaucugguacaaagcaaucggacauagaguuggagggggaggcccc

SEQ ID NO: 572117 - RNA, 64 nt, Homo Sapiens
gccccgcuuuggagaggcugagggccacugcgggaucggacaaagggagcagggaaccugagac

SEQ ID NO: 572118 - RNA, 64 nt, Homo Sapiens
gaaagaaagcaaacaagaagacuccggcucugcuaucggacacagauccugaucccucuugcuu

SEQ ID NO: 572119 - RNA, 64 nt, Homo Sapiens
aagcuaggugcucugucaccaccuguuauaaguuaucggacagaaaguggguaagaaaaugcaa

SEQ ID NO: 572120 - RNA, 64 nt, Homo Sapiens
aacaggaaacaaagauaaugacucaguucagaggaucggacaaaugugucuaguccggguggac

SEQ ID NO: 572121 - RNA, 55 nt, Homo Sapiens
acccccagcacuuggggguugcagcaucggacaagucacagacaacagcuacuaa

SEQ ID NO: 572122 - RNA, 64 nt, Homo Sapiens
agaggugggggcaacucugcgugaagaaaucucaaucggacaccucucaugggacucaauggug

SEQ ID NO: 572123 - RNA, 64 nt, Homo Sapiens
uaauauguaaauaaaugacuucuacacauuauauaucggacauauucacugcaguauacauuua

SEQ ID NO: 572124 - RNA, 64 nt, Homo Sapiens
gccuuacgugcccgagggcgaauuguaauguugaaucggacagaugccuuccaaaucaugccau

SEQ ID NO: 572125 - RNA, 64 nt, Homo Sapiens
gucucugugugguucauaggcucacaggccugcaaucggacacuacagaaagaauauaagcaau

SEQ ID NO: 572126 - RNA, 64 nt, Homo Sapiens
accaucuuuaugaccugcuuaaaagauuuccuuuaucggacagguuagcuuuugaaaguguuuu

SEQ ID NO: 572127 - RNA, 64 nt, Homo Sapiens
aagaagcaaagccuucagcaagaucauacgacucaucggacacuaauuuauauaggagugaagu

SEQ ID NO: 572128 - RNA, 64 nt, Homo Sapiens
uguggagcgcaggggccuggcugcauugcuucucaucggacacuugcuccuccaucgauggaca

SEQ ID NO: 572129 - RNA, 64 nt, Homo Sapiens
ugaugccagcaguuccugcuaacacauggagggaaucggacagguaguucauuuccaaucccag

SEQ ID NO: 572130 - RNA, 64 nt, Homo Sapiens
cacucaaaagcaaagcauucucuucccagugccuaucggacagugcggcggucgaggugggugu

SEQ ID NO: 572131 - RNA, 64 nt, Homo Sapiens
uucuuacucaaagauaacacacguugugauucauaucggacaguggaaaauacuacauucaccc

SEQ ID NO: 572132 - RNA, 64 nt, Homo Sapiens
ggcagguuagugacaguuauucauagaagguggaaucggacagaacugcuccucuguguguacu

SEQ ID NO: 572133 - RNA, 64 nt, Homo Sapiens
cauccuuucucacacuucccccccccgucaccgaaucggacacugcuccccugcgaccgcccug

SEQ ID NO: 572134 - RNA, 64 nt, Homo Sapiens
augauccucuuaaagaauaaaagcacauccguggaucggacauggcugcaugugccugcuuaac

SEQ ID NO: 572135 - RNA, 64 nt, Homo Sapiens
cuaaugcauauuuauaagagccuuggcuuguguuaucggacauuuuuaaccuuaauuuuacagc

SEQ ID NO: 572136 - RNA, 64 nt, Homo Sapiens
gacuggagcccaggugacagguccuguugaggccaucggacagaacugguagcuaugcuuugau

SEQ ID NO: 572137 - RNA, 64 nt, Homo Sapiens
cucauccagacccccugcccuguggcuggcaggcaucggacagcuucccuccaugcaccaucac

SEQ ID NO: 572138 - RNA, 64 nt, Homo Sapiens
ucuggggaaaggaagguggcgaacaagcucagcaaucggacaucgaagcuugcggagcccaggu

SEQ ID NO: 572139 - RNA, 64 nt, Homo Sapiens
ccgucugacccucugcggccacugcgccacugccaucggacaggaggauuccuuguguuuuguc

SEQ ID NO: 572140 - RNA, 64 nt, Homo Sapiens
accccgucuaacacugcaucccccuaaggaauccaucggacaagcagccucccaagcauauaac

SEQ ID NO: 572141 - RNA, 64 nt, Homo Sapiens
gccauccaugggccccaccuccucaugugacccgaucggacagucugcaucccgcgcgcugcag

SEQ ID NO: 572142 - RNA, 64 nt, Homo Sapiens
gaccgcuucuucauguagauauuagcaaauugucaucggacaauuaucugcugucguacagcac

SEQ ID NO: 572143 - RNA, 64 nt, Homo Sapiens; identical to SEQ ID NO: 121134

SEQ ID NO: 572144 - RNA, 64 nt, Homo Sapiens; identical to SEQ ID NO: 121135

SEQ ID NO: 572145 - RNA, 64 nt, Homo Sapiens; identical to SEQ ID NO: 121136

SEQ ID NO: 572146 - RNA, 64 nt, Homo Sapiens; identical to SEQ ID NO: 121137

SEQ ID NO: 572147 - RNA, 64 nt, Homo Sapiens; identical to SEQ ID NO: 121138

SEQ ID NO: 572148 - RNA, 64 nt, Homo Sapiens; identical to SEQ ID NO: 121139

SEQ ID NO: 572149 - RNA, 64 nt, Homo Sapiens; identical to SEQ ID NO: 121140

SEQ ID NO: 572150 - RNA, 64 nt, Homo Sapiens; identical to SEQ ID NO: 121141

SEQ ID NO: 572151 - RNA, 64 nt, Homo Sapiens; identical to SEQ ID NO: 121142

SEQ ID NO: 572152 - RNA, 64 nt, Homo Sapiens; identical to SEQ ID NO: 121143

SEQ ID NO: 572153 - RNA, 64 nt, Homo Sapiens; identical to SEQ ID NO: 121144

SEQ ID NO: 572154 - RNA, 64 nt, Homo Sapiens; identical to SEQ ID NO: 121145

SEQ ID NO: 572155 - RNA, 64 nt, Homo Sapiens; identical to SEQ ID NO: 121146

SEQ ID NO: 572156 - RNA, 64 nt, Homo Sapiens; identical to SEQ ID NO: 121147

SEQ ID NO: 572157 - RNA, 64 nt, Homo Sapiens; identical to SEQ ID NO: 526825

SEQ ID NO: 572158 - RNA, 64 nt, Homo Sapiens; identical to SEQ ID NO: 526826

SEQ ID NO: 572159 - RNA, 64 nt, Homo Sapiens; identical to SEQ ID NO: 526891

SEQ ID NO: 572160 - RNA, 64 nt, Homo Sapiens; identical to SEQ ID NO: 526892

SEQ ID NO: 572161 - RNA, 64 nt, Homo Sapiens; identical to SEQ ID NO: 526922

SEQ ID NO: 572162 - RNA, 64 nt, Homo Sapiens; identical to SEQ ID NO: 526923

SEQ ID NO: 572163 - RNA, 64 nt, Homo Sapiens; identical to SEQ ID NO: 526945

SEQ ID NO: 572164 - RNA, 64 nt, Homo Sapiens; identical to SEQ ID NO: 526946

SEQ ID NO: 572165 - RNA, 64 nt, Homo Sapiens; identical to SEQ ID NO: 526947

SEQ ID NO: 572166 - RNA, 64 nt, Homo Sapiens; identical to SEQ ID NO: 526953

SEQ ID NO: 572167 - RNA, 64 nt, Homo Sapiens; identical to SEQ ID NO: 526954

SEQ ID NO: 572168 - RNA, 64 nt, Homo Sapiens; identical to SEQ ID NO: 526955

SEQ ID NO: 572169 - RNA, 64 nt, Homo Sapiens; identical to SEQ ID NO: 526986

SEQ ID NO: 572170 - RNA, 64 nt, Homo Sapiens; identical to SEQ ID NO: 526987

SEQ ID NO: 572171 - RNA, 64 nt, Homo Sapiens; identical to SEQ ID NO: 526988

SEQ ID NO: 572172 - RNA, 64 nt, Homo Sapiens; identical to SEQ ID NO: 48305

SEQ ID NO: 572173 - RNA, 64 nt, Homo Sapiens; identical to SEQ ID NO: 48306

SEQ ID NO: 572174 - RNA, 64 nt, Homo Sapiens; identical to SEQ ID NO: 48307

SEQ ID NO: 572175 - RNA, 64 nt, Homo Sapiens; identical to SEQ ID NO: 48308

SEQ ID NO: 572176 - RNA, 64 nt, Homo Sapiens; identical to SEQ ID NO: 48309

SEQ ID NO: 572177 - RNA, 64 nt, Homo Sapiens; identical to SEQ ID NO: 48310

SEQ ID NO: 572178 - RNA, 64 nt, Homo Sapiens; identical to SEQ ID NO: 48311

SEQ ID NO: 572179 - RNA, 64 nt, Homo Sapiens; identical to SEQ ID NO: 48312

SEQ ID NO: 572180 - RNA, 64 nt, Homo Sapiens; identical to SEQ ID NO: 48313

SEQ ID NO: 572181 - RNA, 64 nt, Homo Sapiens; identical to SEQ ID NO: 48314

SEQ ID NO: 572182 - RNA, 64 nt, Homo Sapiens; identical to SEQ ID NO: 48315

SEQ ID NO: 572183 - RNA, 64 nt, Homo Sapiens; identical to SEQ ID NO: 48316

SEQ ID NO: 572184 - RNA, 64 nt, Homo Sapiens; identical to SEQ ID NO: 48317

SEQ ID NO: 572185 - RNA, 64 nt, Homo Sapiens; identical to SEQ ID NO: 48318

SEQ ID NO: 572186 - RNA, 64 nt, Homo Sapiens; identical to SEQ ID NO: 48319

SEQ ID NO: 572187 - RNA, 64 nt, Homo Sapiens; identical to SEQ ID NO: 48320

SEQ ID NO: 572188 - RNA, 64 nt, Homo Sapiens; identical to SEQ ID NO: 48321

SEQ ID NO: 572189 - RNA, 64 nt, Homo Sapiens; identical to SEQ ID NO: 48322

SEQ ID NO: 572190 - RNA, 64 nt, Homo Sapiens; identical to SEQ ID NO: 48323

SEQ ID NO: 572191 - RNA, 64 nt, Homo Sapiens; identical to SEQ ID NO: 48324

SEQ ID NO: 572192 - RNA, 64 nt, Homo Sapiens; identical to SEQ ID NO: 48325

SEQ ID NO: 572193 - RNA, 64 nt, Homo Sapiens; identical to SEQ ID NO: 48326

SEQ ID NO: 572194 - RNA, 64 nt, Homo Sapiens; identical to SEQ ID NO: 48327

SEQ ID NO: 572195 - RNA, 64 nt, Homo Sapiens; identical to SEQ ID NO: 48328

SEQ ID NO: 572196 - RNA, 64 nt, Homo Sapiens; identical to SEQ ID NO: 48329

SEQ ID NO: 572197 - RNA, 51 nt, Homo Sapiens; identical to SEQ ID NO: 48330

SEQ ID NO: 572198 - RNA, 64 nt, Homo Sapiens; identical to SEQ ID NO: 48331

SEQ ID NO: 572199 - RNA, 64 nt, Homo Sapiens; identical to SEQ ID NO: 48332

SEQ ID NO: 572200 - RNA, 64 nt, Homo Sapiens; identical to SEQ ID NO: 48333

SEQ ID NO: 572201 - RNA, 64 nt, Homo Sapiens; identical to SEQ ID NO: 48334

SEQ ID NO: 572202 - RNA, 64 nt, Homo Sapiens; identical to SEQ ID NO: 48335

SEQ ID NO: 572203 - RNA, 64 nt, Homo Sapiens; identical to SEQ ID NO: 48336

SEQ ID NO: 572204 - RNA, 64 nt, Homo Sapiens; identical to SEQ ID NO: 48337

SEQ ID NO: 572205 - RNA, 64 nt, Homo Sapiens; identical to SEQ ID NO: 48338

SEQ ID NO: 572206 - RNA, 64 nt, Homo Sapiens; identical to SEQ ID NO: 48339

SEQ ID NO: 572207 - RNA, 64 nt, Homo Sapiens; identical to SEQ ID NO: 48340

SEQ ID NO: 572208 - RNA, 64 nt, Homo Sapiens; identical to SEQ ID NO: 48341

SEQ ID NO: 572209 - RNA, 64 nt, Homo Sapiens; identical to SEQ ID NO: 48342

SEQ ID NO: 572210 - RNA, 64 nt, Homo Sapiens; identical to SEQ ID NO: 48343

SEQ ID NO: 572211 - RNA, 64 nt, Homo Sapiens; identical to SEQ ID NO: 48344

SEQ ID NO: 572212 - RNA, 64 nt, Homo Sapiens; identical to SEQ ID NO: 48345

SEQ ID NO: 572213 - RNA, 64 nt, Homo Sapiens; identical to SEQ ID NO: 48346

SEQ ID NO: 572214 - RNA, 64 nt, Homo Sapiens; identical to SEQ ID NO: 48347

SEQ ID NO: 572215 - RNA, 64 nt, Homo Sapiens; identical to SEQ ID NO: 48348

SEQ ID NO: 572216 - RNA, 64 nt, Homo Sapiens; identical to SEQ ID NO: 48349

SEQ ID NO: 572217 - RNA, 64 nt, Homo Sapiens; identical to SEQ ID NO: 211563

SEQ ID NO: 572218 - RNA, 64 nt, Homo Sapiens; identical to SEQ ID NO: 211564

SEQ ID NO: 572219 - RNA, 64 nt, Homo Sapiens; identical to SEQ ID NO: 211565

SEQ ID NO: 572220 - RNA, 64 nt, Homo Sapiens; identical to SEQ ID NO: 211566

SEQ ID NO: 572221 - RNA, 64 nt, Homo Sapiens; identical to SEQ ID NO: 211567

SEQ ID NO: 572222 - RNA, 64 nt, Homo Sapiens; identical to SEQ ID NO: 211568

SEQ ID NO: 572223 - RNA, 64 nt, Homo Sapiens; identical to SEQ ID NO: 211569

SEQ ID NO: 572224 - RNA, 64 nt, Homo Sapiens; identical to SEQ ID NO: 211570

SEQ ID NO: 572225 - RNA, 64 nt, Homo Sapiens; identical to SEQ ID NO: 211571

SEQ ID NO: 572226 - RNA, 64 nt, Homo Sapiens; identical to SEQ ID NO: 211572

SEQ ID NO: 572227 - RNA, 64 nt, Homo Sapiens; identical to SEQ ID NO: 211573

SEQ ID NO: 572228 - RNA, 64 nt, Homo Sapiens; identical to SEQ ID NO: 211574

SEQ ID NO: 572229 - RNA, 64 nt, Homo Sapiens; identical to SEQ ID NO: 211575

SEQ ID NO: 572230 - RNA, 64 nt, Homo Sapiens; identical to SEQ ID NO: 211576

SEQ ID NO: 572231 - RNA, 64 nt, Homo Sapiens; identical to SEQ ID NO: 211577

SEQ ID NO: 572232 - RNA, 64 nt, Homo Sapiens; identical to SEQ ID NO: 211578

SEQ ID NO: 572233 - RNA, 64 nt, Homo Sapiens; identical to SEQ ID NO: 211579

SEQ ID NO: 572234 - RNA, 64 nt, Homo Sapiens; identical to SEQ ID NO: 211580

SEQ ID NO: 572235 - RNA, 64 nt, Homo Sapiens; identical to SEQ ID NO: 211581

SEQ ID NO: 572236 - RNA, 64 nt, Homo Sapiens; identical to SEQ ID NO: 211582

SEQ ID NO: 572237 - RNA, 64 nt, Homo Sapiens; identical to SEQ ID NO: 211583

SEQ ID NO: 572238 - RNA, 64 nt, Homo Sapiens; identical to SEQ ID NO: 211584

SEQ ID NO: 572239 - RNA, 64 nt, Homo Sapiens; identical to SEQ ID NO: 211585

SEQ ID NO: 572240 - RNA, 64 nt, Homo Sapiens; identical to SEQ ID NO: 211586

SEQ ID NO: 572241 - RNA, 64 nt, Homo Sapiens; identical to SEQ ID NO: 211587

SEQ ID NO: 572242 - RNA, 64 nt, Homo Sapiens; identical to SEQ ID NO: 211588

SEQ ID NO: 572243 - RNA, 64 nt, Homo Sapiens; identical to SEQ ID NO: 211589

SEQ ID NO: 572244 - RNA, 64 nt, Homo Sapiens; identical to SEQ ID NO: 211590

SEQ ID NO: 572245 - RNA, 64 nt, Homo Sapiens; identical to SEQ ID NO: 211591

SEQ ID NO: 572246 - RNA, 64 nt, Homo Sapiens; identical to SEQ ID NO: 211592

SEQ ID NO: 572247 - RNA, 64 nt, Homo Sapiens; identical to SEQ ID NO: 211593

SEQ ID NO: 572248 - RNA, 64 nt, Homo Sapiens; identical to SEQ ID NO: 211594

SEQ ID NO: 572249 - RNA, 64 nt, Homo Sapiens; identical to SEQ ID NO: 211595

SEQ ID NO: 572250 - RNA, 64 nt, Homo Sapiens; identical to SEQ ID NO: 211596

SEQ ID NO: 572251 - RNA, 64 nt, Homo Sapiens; identical to SEQ ID NO: 211597

SEQ ID NO: 572252 - RNA, 64 nt, Homo Sapiens; identical to SEQ ID NO: 211598

SEQ ID NO: 572253 - RNA, 64 nt, Homo Sapiens; identical to SEQ ID NO: 211599

SEQ ID NO: 572254 - RNA, 64 nt, Homo Sapiens; identical to SEQ ID NO: 211600

SEQ ID NO: 572255 - RNA, 64 nt, Homo Sapiens; identical to SEQ ID NO: 211601

SEQ ID NO: 572256 - RNA, 64 nt, Homo Sapiens; identical to SEQ ID NO: 211602

SEQ ID NO: 572257 - RNA, 64 nt, Homo Sapiens; identical to SEQ ID NO: 211603

SEQ ID NO: 572258 - RNA, 64 nt, Homo Sapiens; identical to SEQ ID NO: 211604

SEQ ID NO: 572259 - RNA, 64 nt, Homo Sapiens; identical to SEQ ID NO: 211605

SEQ ID NO: 572260 - RNA, 64 nt, Homo Sapiens; identical to SEQ ID NO: 211606

SEQ ID NO: 572261 - RNA, 64 nt, Homo Sapiens; identical to SEQ ID NO: 211607

SEQ ID NO: 572262 - RNA, 64 nt, Homo Sapiens; identical to SEQ ID NO: 211608

SEQ ID NO: 572263 - RNA, 64 nt, Homo Sapiens; identical to SEQ ID NO: 211609

SEQ ID NO: 572264 - RNA, 64 nt, Homo Sapiens; identical to SEQ ID NO: 211610

SEQ ID NO: 572265 - RNA, 64 nt, Homo Sapiens; identical to SEQ ID NO: 211611

SEQ ID NO: 572266 - RNA, 64 nt, Homo Sapiens; identical to SEQ ID NO: 211612

SEQ ID NO: 572267 - RNA, 64 nt, Homo Sapiens; identical to SEQ ID NO: 211613

SEQ ID NO: 572268 - RNA, 64 nt, Homo Sapiens; identical to SEQ ID NO: 211614

SEQ ID NO: 572269 - RNA, 64 nt, Homo Sapiens; identical to SEQ ID NO: 211615

SEQ ID NO: 572270 - RNA, 64 nt, Homo Sapiens; identical to SEQ ID NO: 211616

SEQ ID NO: 572271 - RNA, 64 nt, Homo Sapiens; identical to SEQ ID NO: 211617

SEQ ID NO: 572272 - RNA, 64 nt, Homo Sapiens; identical to SEQ ID NO: 211618

SEQ ID NO: 572273 - RNA, 64 nt, Homo Sapiens; identical to SEQ ID NO: 211619

SEQ ID NO: 572274 - RNA, 64 nt, Homo Sapiens
cagugauaaagcuggguuaccgauugucuguuaucgaacacauuuagaaagucggcuguugaua

SEQ ID NO: 572275 - RNA, 64 nt, Homo Sapiens
uuuguuugaaaggcuugucagcaucagugaaguccgaacacaucaacccaaaagaccuaccauc

SEQ ID NO: 572276 - RNA, 64 nt, Homo Sapiens
ucaucuagagguaaucuggcagucuugugaaaaccgaacacaacucagaaacuuggaaucguuu

SEQ ID NO: 572277 - RNA, 64 nt, Homo Sapiens
ugcccuguuccccguccugagccgccacuuccagcgaacacacacagguguccugccguuggac

SEQ ID NO: 572278 - RNA, 64 nt, Homo Sapiens
cccucugggcccaacgcaggaggcccucagcacccgaacacaucuuccuccuccccacccgagc

SEQ ID NO: 572279 - RNA, 64 nt, Homo Sapiens
ccagguguuucugucucuuuccuguuucugagugcgaacacaaaauucuugucuuaugucuuga

SEQ ID NO: 572280 - RNA, 64 nt, Homo Sapiens
cauauauguucacuuauuuguugaacaugacacccgaacacauaauacauaaaccuaaaagcau

SEQ ID NO: 572281 - RNA, 64 nt, Homo Sapiens
auucagucaccuguucagccggcacugagaagaacgaacacaagaaaaagauaagaaauacuag

SEQ ID NO: 572282 - RNA, 64 nt, Homo Sapiens
aagccugugaccauggcagccaggcacaaaggcccgaacacaggggggcugugaggggugucuc

SEQ ID NO: 572283 - RNA, 64 nt, Homo Sapiens
ugcaggaagguaacuguuauucaagaaauaaagacgaacacauuucuaaaaucuaaaauccauu

SEQ ID NO: 572284 - RNA, 64 nt, Homo Sapiens
acauuguuuggacggcagcccugugugccgccuccgaacacagauguggaauccguaauugcau

SEQ ID NO: 572285 - RNA, 64 nt, Homo Sapiens
cacacacacacacacgcacacacacacacacacacgaacacacacacacacacacgagcacaca

SEQ ID NO: 572286 - RNA, 64 nt, Homo Sapiens
acgcuaauugauaaccgagucauuuacauguuuucgaacacagaauagcucuuuucucagcauc

SEQ ID NO: 572287 - RNA, 64 nt, Homo Sapiens
ccugcauucaggaugugaggaauguuuauuuaaacgaacacauuagaauucaacauuaaagauu

SEQ ID NO: 572288 - RNA, 64 nt, Homo Sapiens
uucugaugauuucccaaaauaaucucuuacucaacgaacacaucucaaaaagcuuauuucuuuu

SEQ ID NO: 572289 - RNA, 64 nt, Homo Sapiens
cacagcugugaacugcaugaaauguauugugaaacgaacacaagauuaagcuuugucagguuaa

SEQ ID NO: 572290 - RNA, 64 nt, Homo Sapiens
ucccaggagucugggaaggaacuccccucccugccgaacacacauuaaagcauccuccuccugg

SEQ ID NO: 572291 - RNA, 59 nt, Homo Sapiens
aucuuuacagauucauuuaagccaucagacgaacacaagagaggcucaaacaagaaauu

SEQ ID NO: 572292 - RNA, 64 nt, Homo Sapiens
guucagaggaagcacauaauguccagaucuauggcgaacacagguguuggaagccaggacugug

SEQ ID NO: 572293 - RNA, 64 nt, Homo Sapiens
ccaaauuuuaggcaaauuauuauuucucaauaugcgaacacaguauuuagaacacaauauuaga

SEQ ID NO: 572294 - RNA, 64 nt, Homo Sapiens
uuucaagguuguuugugcaugcuuguaagauaugcgaacacacgguggcauuggaaaaauaccu

SEQ ID NO: 572295 - RNA, 64 nt, Homo Sapiens
acaaaauggcuaaauaguuuaaaauagguuaauucgaacacaggaaaggaucuauuuguuguuu

SEQ ID NO: 572296 - RNA, 64 nt, Homo Sapiens
aacccagcccacaugacuagguccccuccccuuacgaacacagauggucauuuucuggagaggg

SEQ ID NO: 572297 - RNA, 64 nt, Homo Sapiens
cagguaguucugggggcgauacugccgaaaggcccgaacacauguauuuuggcugcaauugagg

SEQ ID NO: 572298 - RNA, 64 nt, Homo Sapiens
gacacguuuggccagugacauucacugucaugugcgaacacaguucacuuggaguggauccagc

SEQ ID NO: 572299 - RNA, 64 nt, Homo Sapiens
uuugcugcccagccauaacccacucagugacagacgaacacagcuaaggccucgcugccagccu

SEQ ID NO: 572300 - RNA, 64 nt, Homo Sapiens
ccucuacuguaaacuuucugguccgagaacgagccgaacacagcgcgacgcagggacuaggacg

SEQ ID NO: 572301 - RNA, 64 nt, Homo Sapiens
ggagaccuggacacaacagacacacaucacaaggcgaacacaaauggacacacauaccuggcca

SEQ ID NO: 572302 - RNA, 64 nt, Homo Sapiens
uugaaagacaggacauggagagcugcuggguuggcgaacacauccaugugccgggaggauggug

SEQ ID NO: 572303 - RNA, 64 nt, Homo Sapiens
agguugguguggcuggcuaacacagcuacuuacgcgaacacagcuggucaccccaugggacagg

SEQ ID NO: 572304 - RNA, 64 nt, Homo Sapiens
cgugcacacgcagcgcacaucuccuuggcgcccacgaacacaggucuccuggacccccagcggu

SEQ ID NO: 572305 - RNA, 64 nt, Homo Sapiens
agacggagauugcagugagcgcaggggaauggcucgaacacaggcagcuacucuggaggcugag

SEQ ID NO: 572306 - RNA, 64 nt, Homo Sapiens
guggaucuuuggggaauggcuucaaaauaagucacgaacacaaauucuuuguaaauuauguaaa

SEQ ID NO: 572307 - RNA, 64 nt, Homo Sapiens
gcacugagagcuggagaguuggugauaagcgagacgaacacauuuccugcccucauacacacau

SEQ ID NO: 572308 - RNA, 60 nt, Homo Sapiens
gggacggaauccacccacaaacggcccucucgaacacaauuggaaaccccugccccauaa

SEQ ID NO: 572309 - RNA, 64 nt, Homo Sapiens
gugacuuuagcagaagaugcgggaccaaggacccaucaaugaugaaaaaugagacacagguuug

SEQ ID NO: 572310 - RNA, 64 nt, Homo Sapiens
gcccucaagacugagcugcucaauuuuauuugauaucaaugaacaaaugauucauuugaagaua

SEQ ID NO: 572311 - RNA, 64 nt, Homo Sapiens
uaagaucaacaaugaaguauaaauucuguuuuaaaucaaugaccuccaccugcccauagucacc

SEQ ID NO: 572312 - RNA, 64 nt, Homo Sapiens
guggguuaaguaauagauuugacaagacuaugauaucaaugaauccuaaggcaaagaaauauaa

SEQ ID NO: 572313 - RNA, 52 nt, Homo Sapiens
gcguagacuacauuuugugaggaucaaugaagacuaaauauaaaaaacauuu

SEQ ID NO: 572314 - RNA, 64 nt, Homo Sapiens
guaggcuggaagaaguggauauugaaguuuugacaucaaugaugaggcuccaguugucuauuca

SEQ ID NO: 572315 - RNA, 64 nt, Homo Sapiens
aguaaguguaagaaaaugauugcuuaucaguaguaucaaugauuuacucaauaucugaaucacc

SEQ ID NO: 572316 - RNA, 64 nt, Homo Sapiens
uugaaacauuugccuuuaggcuguucuuugagguaucaaugaagugauugaauuucaauaccuu

SEQ ID NO: 572317 - RNA, 64 nt, Homo Sapiens
aaaccauaaucaucucuuggaagaaaaugcugagaucaaugaauuauucugugugccuauauug

SEQ ID NO: 572318 - RNA, 64 nt, Homo Sapiens
ucauuaauuuuuaauugaaacuaguuauuuuauaaucaaugaauuuguucuuucugauuuuaag

SEQ ID NO: 572319 - RNA, 64 nt, Homo Sapiens
uagcuuaaguaguuucuccaaguacuuuugugcuaucaaugaguucuucucaaaaaauaauuag

SEQ ID NO: 572320 - RNA, 64 nt, Homo Sapiens
uaucaaccagacugaccacaagaacugucaucucaucaaugaaggaguaacugaucaaugaagc

SEQ ID NO: 572321 - RNA, 64 nt, Homo Sapiens
aagaacugucaucucaucaaugaaggaguaacugaucaaugaagccagcaaugcuuuuuucuug

SEQ ID NO: 572322 - RNA, 64 nt, Homo Sapiens
ugggucaguccagcccccuccacaucacugagccaucaaugagcugagagaucaaugacuuuuu

SEQ ID NO: 572323 - RNA, 64 nt, Homo Sapiens
ccuccacaucacugagccaucaaugagcugagagaucaaugacuuuuuaggcagcuguguuuuu

SEQ ID NO: 572324 - RNA, 64 nt, Homo Sapiens
cccuuaagccaaucauguaaaggaaaguuaagguaucaaugagaucuuuuuauucauugcccuc

SEQ ID NO: 572325 - RNA, 64 nt, Homo Sapiens
uuagggguuacgauuauagcuacauaggaaccaaaucaaugaaucuguguaggggagccacauu

SEQ ID NO: 572326 - RNA, 64 nt, Homo Sapiens
gacauuugacuuuuauuuuuagucccgcaaaccggggacggaaggggaauuccaccugagaaca

SEQ ID NO: 572327 - RNA, 64 nt, Homo Sapiens
uugcaguuacaccacgauuccaggcuucacuguagggacggacacucacguucacaccuggugg

SEQ ID NO: 572328 - RNA, 64 nt, Homo Sapiens
aauggacgguuuaggugaaaauaaucaacugcauaguucccaugcacgcugggcaaugagaauc

SEQ ID NO: 572329 - RNA, 64 nt, Homo Sapiens
uauagcuuuauuucuuaaggggguagggaaaauuaguucccauucuuucaacccccuuaacugu

SEQ ID NO: 572330 - RNA, 64 nt, Homo Sapiens
caaggagaaggaugccagccacccauccucccccaguucccagccuuuccccuguuggucacag

SEQ ID NO: 572331 - RNA, 64 nt, Homo Sapiens
ugcccugcaugauucuguguugccgcugcugcauaguucccagccccauccuguccugcucacu

SEQ ID NO: 572332 - RNA, 64 nt, Homo Sapiens
cccaauuaauaaucagcaagaauuugaucguuccaguucccacuuggaggccuuucaucccucg

SEQ ID NO: 572333 - RNA, 64 nt, Homo Sapiens
gagacucuucuaagucuucaucucagagacccugaguucccacucagacccacucagccaaauc

SEQ ID NO: 572334 - RNA, 64 nt, Homo Sapiens
gucaguuauucauguuuucaauuucuacaauuacaguucccaaacuuguuuuuggaaaaacaaa

SEQ ID NO: 572335 - RNA, 64 nt, Homo Sapiens
gacacaguuguucauguuauauuucuacaauuacaguucccaaacuuguucuuggauaaagaaa

SEQ ID NO: 572336 - RNA, 64 nt, Homo Sapiens
uaccgaagccuacugugguagggucccucaccuggcuagggagacgggcagggagaaugccugg

SEQ ID NO: 572337 - RNA, 64 nt, Homo Sapiens
aacuguugcucuuggugggcguggggacggaggagcuagggacuuauggauguguggguacuug

SEQ ID NO: 572338 - RNA, 64 nt, Homo Sapiens; identical to SEQ ID NO: 128175

SEQ ID NO: 572339 - RNA, 64 nt, Homo Sapiens; identical to SEQ ID NO: 128176

SEQ ID NO: 572340 - RNA, 64 nt, Homo Sapiens; identical to SEQ ID NO: 128177

SEQ ID NO: 572341 - RNA, 64 nt, Homo Sapiens; identical to SEQ ID NO: 128178

SEQ ID NO: 572342 - RNA, 64 nt, Homo Sapiens; identical to SEQ ID NO: 128179

SEQ ID NO: 572343 - RNA, 64 nt, Homo Sapiens; identical to SEQ ID NO: 128180

SEQ ID NO: 572344 - RNA, 64 nt, Homo Sapiens; identical to SEQ ID NO: 128181

SEQ ID NO: 572345 - RNA, 64 nt, Homo Sapiens; identical to SEQ ID NO: 128182

SEQ ID NO: 572346 - RNA, 64 nt, Homo Sapiens; identical to SEQ ID NO: 128183

SEQ ID NO: 572347 - RNA, 64 nt, Homo Sapiens; identical to SEQ ID NO: 128184

SEQ ID NO: 572348 - RNA, 64 nt, Homo Sapiens; identical to SEQ ID NO: 128185

SEQ ID NO: 572349 - RNA, 64 nt, Homo Sapiens; identical to SEQ ID NO: 128186

SEQ ID NO: 572350 - RNA, 64 nt, Homo Sapiens; identical to SEQ ID NO: 128187

SEQ ID NO: 572351 - RNA, 64 nt, Homo Sapiens; identical to SEQ ID NO: 128188

SEQ ID NO: 572352 - RNA, 64 nt, Homo Sapiens; identical to SEQ ID NO: 128189

SEQ ID NO: 572353 - RNA, 64 nt, Homo Sapiens; identical to SEQ ID NO: 128190

SEQ ID NO: 572354 - RNA, 64 nt, Homo Sapiens; identical to SEQ ID NO: 128191

SEQ ID NO: 572355 - RNA, 64 nt, Homo Sapiens; identical to SEQ ID NO: 128192

SEQ ID NO: 572356 - RNA, 64 nt, Homo Sapiens; identical to SEQ ID NO: 128193

SEQ ID NO: 572357 - RNA, 64 nt, Homo Sapiens; identical to SEQ ID NO: 128194

SEQ ID NO: 572358 - RNA, 64 nt, Homo Sapiens; identical to SEQ ID NO: 128195

SEQ ID NO: 572359 - RNA, 64 nt, Homo Sapiens; identical to SEQ ID NO: 128196

SEQ ID NO: 572360 - RNA, 64 nt, Homo Sapiens; identical to SEQ ID NO: 128197

SEQ ID NO: 572361 - RNA, 64 nt, Homo Sapiens; identical to SEQ ID NO: 128198

SEQ ID NO: 572362 - RNA, 64 nt, Homo Sapiens; identical to SEQ ID NO: 128199

SEQ ID NO: 572363 - RNA, 64 nt, Homo Sapiens; identical to SEQ ID NO: 128200

SEQ ID NO: 572364 - RNA, 64 nt, Homo Sapiens; identical to SEQ ID NO: 128201

SEQ ID NO: 572365 - RNA, 64 nt, Homo Sapiens; identical to SEQ ID NO: 128202

SEQ ID NO: 572366 - RNA, 64 nt, Homo Sapiens; identical to SEQ ID NO: 128203

SEQ ID NO: 572367 - RNA, 64 nt, Homo Sapiens; identical to SEQ ID NO: 128204

SEQ ID NO: 572368 - RNA, 64 nt, Homo Sapiens; identical to SEQ ID NO: 128205

SEQ ID NO: 572369 - RNA, 64 nt, Homo Sapiens; identical to SEQ ID NO: 128206

SEQ ID NO: 572370 - RNA, 64 nt, Homo Sapiens; identical to SEQ ID NO: 23238

SEQ ID NO: 572371 - RNA, 64 nt, Homo Sapiens; identical to SEQ ID NO: 23239

SEQ ID NO: 572372 - RNA, 64 nt, Homo Sapiens; identical to SEQ ID NO: 23240

SEQ ID NO: 572373 - RNA, 64 nt, Homo Sapiens; identical to SEQ ID NO: 23241

SEQ ID NO: 572374 - RNA, 64 nt, Homo Sapiens; identical to SEQ ID NO: 111122

SEQ ID NO: 572375 - RNA, 64 nt, Homo Sapiens; identical to SEQ ID NO: 111123

SEQ ID NO: 572376 - RNA, 64 nt, Homo Sapiens; identical to SEQ ID NO: 111124

SEQ ID NO: 572377 - RNA, 64 nt, Homo Sapiens; identical to SEQ ID NO: 111125

SEQ ID NO: 572378 - RNA, 64 nt, Homo Sapiens; identical to SEQ ID NO: 111126

SEQ ID NO: 572379 - RNA, 64 nt, Homo Sapiens; identical to SEQ ID NO: 111127

SEQ ID NO: 572380 - RNA, 64 nt, Homo Sapiens; identical to SEQ ID NO: 111128

SEQ ID NO: 572381 - RNA, 64 nt, Homo Sapiens; identical to SEQ ID NO: 111129

SEQ ID NO: 572382 - RNA, 64 nt, Homo Sapiens; identical to SEQ ID NO: 111130

SEQ ID NO: 572383 - RNA, 64 nt, Homo Sapiens; identical to SEQ ID NO: 111131

SEQ ID NO: 572384 - RNA, 64 nt, Homo Sapiens; identical to SEQ ID NO: 111132

SEQ ID NO: 572385 - RNA, 64 nt, Homo Sapiens; identical to SEQ ID NO: 111133

SEQ ID NO: 572386 - RNA, 64 nt, Homo Sapiens; identical to SEQ ID NO: 111134

SEQ ID NO: 572387 - RNA, 64 nt, Homo Sapiens; identical to SEQ ID NO: 111135

SEQ ID NO: 572388 - RNA, 64 nt, Homo Sapiens; identical to SEQ ID NO: 111136

SEQ ID NO: 572389 - RNA, 64 nt, Homo Sapiens; identical to SEQ ID NO: 111137

SEQ ID NO: 572390 - RNA, 64 nt, Homo Sapiens; identical to SEQ ID NO: 111138

SEQ ID NO: 572391 - RNA, 64 nt, Homo Sapiens; identical to SEQ ID NO: 111139

SEQ ID NO: 572392 - RNA, 64 nt, Homo Sapiens; identical to SEQ ID NO: 111140

SEQ ID NO: 572393 - RNA, 64 nt, Homo Sapiens; identical to SEQ ID NO: 111141

SEQ ID NO: 572394 - RNA, 64 nt, Homo Sapiens; identical to SEQ ID NO: 111142

SEQ ID NO: 572395 - RNA, 64 nt, Homo Sapiens; identical to SEQ ID NO: 111143

SEQ ID NO: 572396 - RNA, 64 nt, Homo Sapiens; identical to SEQ ID NO: 111144

SEQ ID NO: 572397 - RNA, 64 nt, Homo Sapiens; identical to SEQ ID NO: 111145

SEQ ID NO: 572398 - RNA, 64 nt, Homo Sapiens; identical to SEQ ID NO: 111146

SEQ ID NO: 572399 - RNA, 64 nt, Homo Sapiens; identical to SEQ ID NO: 111147

SEQ ID NO: 572400 - RNA, 64 nt, Homo Sapiens; identical to SEQ ID NO: 111148

SEQ ID NO: 572401 - RNA, 64 nt, Homo Sapiens; identical to SEQ ID NO: 111149

SEQ ID NO: 572402 - RNA, 64 nt, Homo Sapiens; identical to SEQ ID NO: 111150

SEQ ID NO: 572403 - RNA, 64 nt, Homo Sapiens; identical to SEQ ID NO: 111151

SEQ ID NO: 572404 - RNA, 64 nt, Homo Sapiens; identical to SEQ ID NO: 111152

SEQ ID NO: 572405 - RNA, 64 nt, Homo Sapiens; identical to SEQ ID NO: 111153

SEQ ID NO: 572406 - RNA, 64 nt, Homo Sapiens; identical to SEQ ID NO: 111154

SEQ ID NO: 572407 - RNA, 64 nt, Homo Sapiens; identical to SEQ ID NO: 111155

SEQ ID NO: 572408 - RNA, 64 nt, Homo Sapiens; identical to SEQ ID NO: 111156

SEQ ID NO: 572409 - RNA, 64 nt, Homo Sapiens; identical to SEQ ID NO: 111157

SEQ ID NO: 572410 - RNA, 64 nt, Homo Sapiens; identical to SEQ ID NO: 111158

SEQ ID NO: 572411 - RNA, 64 nt, Homo Sapiens; identical to SEQ ID NO: 111159

SEQ ID NO: 572412 - RNA, 64 nt, Homo Sapiens; identical to SEQ ID NO: 111160

SEQ ID NO: 572413 - RNA, 64 nt, Homo Sapiens; identical to SEQ ID NO: 111161

SEQ ID NO: 572414 - RNA, 64 nt, Homo Sapiens; identical to SEQ ID NO: 111162

SEQ ID NO: 572415 - RNA, 64 nt, Homo Sapiens; identical to SEQ ID NO: 111163

SEQ ID NO: 572416 - RNA, 64 nt, Homo Sapiens; identical to SEQ ID NO: 111164

SEQ ID NO: 572417 - RNA, 64 nt, Homo Sapiens; identical to SEQ ID NO: 111165

SEQ ID NO: 572418 - RNA, 64 nt, Homo Sapiens; identical to SEQ ID NO: 111166

SEQ ID NO: 572419 - RNA, 64 nt, Homo Sapiens; identical to SEQ ID NO: 111167

SEQ ID NO: 572420 - RNA, 64 nt, Homo Sapiens; identical to SEQ ID NO: 111168

SEQ ID NO: 572421 - RNA, 64 nt, Homo Sapiens; identical to SEQ ID NO: 111169

SEQ ID NO: 572422 - RNA, 64 nt, Homo Sapiens; identical to SEQ ID NO: 111170

SEQ ID NO: 572423 - RNA, 64 nt, Homo Sapiens; identical to SEQ ID NO: 111171

SEQ ID NO: 572424 - RNA, 64 nt, Homo Sapiens; identical to SEQ ID NO: 111172

SEQ ID NO: 572425 - RNA, 64 nt, Homo Sapiens; identical to SEQ ID NO: 111173

SEQ ID NO: 572426 - RNA, 64 nt, Homo Sapiens; identical to SEQ ID NO: 111174

SEQ ID NO: 572427 - RNA, 64 nt, Homo Sapiens; identical to SEQ ID NO: 111175

SEQ ID NO: 572428 - RNA, 64 nt, Homo Sapiens; identical to SEQ ID NO: 111176

SEQ ID NO: 572429 - RNA, 64 nt, Homo Sapiens; identical to SEQ ID NO: 111177

SEQ ID NO: 572430 - RNA, 64 nt, Homo Sapiens; identical to SEQ ID NO: 111178

SEQ ID NO: 572431 - RNA, 64 nt, Homo Sapiens; identical to SEQ ID NO: 111179

SEQ ID NO: 572432 - RNA, 64 nt, Homo Sapiens; identical to SEQ ID NO: 111180

SEQ ID NO: 572433 - RNA, 64 nt, Homo Sapiens; identical to SEQ ID NO: 111181

SEQ ID NO: 572434 - RNA, 64 nt, Homo Sapiens; identical to SEQ ID NO: 111182

SEQ ID NO: 572435 - RNA, 64 nt, Homo Sapiens; identical to SEQ ID NO: 111183

SEQ ID NO: 572436 - RNA, 64 nt, Homo Sapiens; identical to SEQ ID NO: 111184

SEQ ID NO: 572437 - RNA, 64 nt, Homo Sapiens; identical to SEQ ID NO: 111185

SEQ ID NO: 572438 - RNA, 64 nt, Homo Sapiens; identical to SEQ ID NO: 111186

SEQ ID NO: 572439 - RNA, 64 nt, Homo Sapiens; identical to SEQ ID NO: 111187

SEQ ID NO: 572440 - RNA, 64 nt, Homo Sapiens; identical to SEQ ID NO: 111188

SEQ ID NO: 572441 - RNA, 64 nt, Homo Sapiens; identical to SEQ ID NO: 111189

SEQ ID NO: 572442 - RNA, 64 nt, Homo Sapiens; identical to SEQ ID NO: 111190

SEQ ID NO: 572443 - RNA, 64 nt, Homo Sapiens; identical to SEQ ID NO: 111191

SEQ ID NO: 572444 - RNA, 64 nt, Homo Sapiens; identical to SEQ ID NO: 111192

SEQ ID NO: 572445 - RNA, 64 nt, Homo Sapiens; identical to SEQ ID NO: 111193

SEQ ID NO: 572446 - RNA, 64 nt, Homo Sapiens; identical to SEQ ID NO: 111194

SEQ ID NO: 572447 - RNA, 64 nt, Homo Sapiens; identical to SEQ ID NO: 111195

SEQ ID NO: 572448 - RNA, 64 nt, Homo Sapiens; identical to SEQ ID NO: 111196

SEQ ID NO: 572449 - RNA, 64 nt, Homo Sapiens; identical to SEQ ID NO: 111197

SEQ ID NO: 572450 - RNA, 64 nt, Homo Sapiens; identical to SEQ ID NO: 111198

SEQ ID NO: 572451 - RNA, 64 nt, Homo Sapiens; identical to SEQ ID NO: 111199

SEQ ID NO: 572452 - RNA, 64 nt, Homo Sapiens; identical to SEQ ID NO: 111200

SEQ ID NO: 572453 - RNA, 64 nt, Homo Sapiens; identical to SEQ ID NO: 111201

SEQ ID NO: 572454 - RNA, 64 nt, Homo Sapiens; identical to SEQ ID NO: 111202

SEQ ID NO: 572455 - RNA, 64 nt, Homo Sapiens; identical to SEQ ID NO: 111203

SEQ ID NO: 572456 - RNA, 64 nt, Homo Sapiens; identical to SEQ ID NO: 111204

SEQ ID NO: 572457 - RNA, 64 nt, Homo Sapiens; identical to SEQ ID NO: 111205

SEQ ID NO: 572458 - RNA, 64 nt, Homo Sapiens; identical to SEQ ID NO: 111206

SEQ ID NO: 572459 - RNA, 64 nt, Homo Sapiens; identical to SEQ ID NO: 111207

SEQ ID NO: 572460 - RNA, 64 nt, Homo Sapiens; identical to SEQ ID NO: 111208

SEQ ID NO: 572461 - RNA, 64 nt, Homo Sapiens; identical to SEQ ID NO: 111209

SEQ ID NO: 572462 - RNA, 64 nt, Homo Sapiens; identical to SEQ ID NO: 111210

SEQ ID NO: 572463 - RNA, 64 nt, Homo Sapiens; identical to SEQ ID NO: 111211

SEQ ID NO: 572464 - RNA, 64 nt, Homo Sapiens; identical to SEQ ID NO: 111212

SEQ ID NO: 572465 - RNA, 64 nt, Homo Sapiens; identical to SEQ ID NO: 111213

SEQ ID NO: 572466 - RNA, 64 nt, Homo Sapiens; identical to SEQ ID NO: 111214

SEQ ID NO: 572467 - RNA, 64 nt, Homo Sapiens; identical to SEQ ID NO: 111215

SEQ ID NO: 572468 - RNA, 64 nt, Homo Sapiens; identical to SEQ ID NO: 111216

SEQ ID NO: 572469 - RNA, 64 nt, Homo Sapiens; identical to SEQ ID NO: 111217

SEQ ID NO: 572470 - RNA, 64 nt, Homo Sapiens; identical to SEQ ID NO: 111218

SEQ ID NO: 572471 - RNA, 64 nt, Homo Sapiens; identical to SEQ ID NO: 111219

SEQ ID NO: 572472 - RNA, 64 nt, Homo Sapiens; identical to SEQ ID NO: 111220

SEQ ID NO: 572473 - RNA, 64 nt, Homo Sapiens; identical to SEQ ID NO: 111221

SEQ ID NO: 572474 - RNA, 64 nt, Homo Sapiens; identical to SEQ ID NO: 111222

SEQ ID NO: 572475 - RNA, 64 nt, Homo Sapiens; identical to SEQ ID NO: 111223

SEQ ID NO: 572476 - RNA, 64 nt, Homo Sapiens; identical to SEQ ID NO: 111224

SEQ ID NO: 572477 - RNA, 64 nt, Homo Sapiens; identical to SEQ ID NO: 111225

SEQ ID NO: 572478 - RNA, 64 nt, Homo Sapiens; identical to SEQ ID NO: 111226

SEQ ID NO: 572479 - RNA, 64 nt, Homo Sapiens; identical to SEQ ID NO: 111227

SEQ ID NO: 572480 - RNA, 64 nt, Homo Sapiens; identical to SEQ ID NO: 111228

SEQ ID NO: 572481 - RNA, 64 nt, Homo Sapiens; identical to SEQ ID NO: 111229

SEQ ID NO: 572482 - RNA, 64 nt, Homo Sapiens; identical to SEQ ID NO: 111230

SEQ ID NO: 572483 - RNA, 64 nt, Homo Sapiens; identical to SEQ ID NO: 111231

SEQ ID NO: 572484 - RNA, 64 nt, Homo Sapiens; identical to SEQ ID NO: 111232

SEQ ID NO: 572485 - RNA, 64 nt, Homo Sapiens; identical to SEQ ID NO: 111233

SEQ ID NO: 572486 - RNA, 64 nt, Homo Sapiens; identical to SEQ ID NO: 111234

SEQ ID NO: 572487 - RNA, 64 nt, Homo Sapiens; identical to SEQ ID NO: 111235

SEQ ID NO: 572488 - RNA, 64 nt, Homo Sapiens; identical to SEQ ID NO: 111236

SEQ ID NO: 572489 - RNA, 64 nt, Homo Sapiens; identical to SEQ ID NO: 111237

SEQ ID NO: 572490 - RNA, 64 nt, Homo Sapiens; identical to SEQ ID NO: 111238

SEQ ID NO: 572491 - RNA, 64 nt, Homo Sapiens; identical to SEQ ID NO: 111239

SEQ ID NO: 572492 - RNA, 64 nt, Homo Sapiens; identical to SEQ ID NO: 111240

SEQ ID NO: 572493 - RNA, 64 nt, Homo Sapiens; identical to SEQ ID NO: 111241

SEQ ID NO: 572494 - RNA, 64 nt, Homo Sapiens; identical to SEQ ID NO: 111242

SEQ ID NO: 572495 - RNA, 64 nt, Homo Sapiens; identical to SEQ ID NO: 111243

SEQ ID NO: 572496 - RNA, 64 nt, Homo Sapiens; identical to SEQ ID NO: 111244

SEQ ID NO: 572497 - RNA, 64 nt, Homo Sapiens; identical to SEQ ID NO: 111245

SEQ ID NO: 572498 - RNA, 64 nt, Homo Sapiens; identical to SEQ ID NO: 111246

SEQ ID NO: 572499 - RNA, 64 nt, Homo Sapiens; identical to SEQ ID NO: 111247

SEQ ID NO: 572500 - RNA, 64 nt, Homo Sapiens; identical to SEQ ID NO: 111248

SEQ ID NO: 572501 - RNA, 64 nt, Homo Sapiens; identical to SEQ ID NO: 111249

SEQ ID NO: 572502 - RNA, 64 nt, Homo Sapiens; identical to SEQ ID NO: 111250

SEQ ID NO: 572503 - RNA, 64 nt, Homo Sapiens; identical to SEQ ID NO: 111251

SEQ ID NO: 572504 - RNA, 64 nt, Homo Sapiens; identical to SEQ ID NO: 111252

SEQ ID NO: 572505 - RNA, 64 nt, Homo Sapiens; identical to SEQ ID NO: 111253

SEQ ID NO: 572506 - RNA, 64 nt, Homo Sapiens; identical to SEQ ID NO: 111254

SEQ ID NO: 572507 - RNA, 64 nt, Homo Sapiens; identical to SEQ ID NO: 111255

SEQ ID NO: 572508 - RNA, 64 nt, Homo Sapiens; identical to SEQ ID NO: 111256

SEQ ID NO: 572509 - RNA, 64 nt, Homo Sapiens; identical to SEQ ID NO: 111257

SEQ ID NO: 572510 - RNA, 64 nt, Homo Sapiens; identical to SEQ ID NO: 111258

SEQ ID NO: 572511 - RNA, 64 nt, Homo Sapiens; identical to SEQ ID NO: 111259

SEQ ID NO: 572512 - RNA, 64 nt, Homo Sapiens; identical to SEQ ID NO: 111260

SEQ ID NO: 572513 - RNA, 64 nt, Homo Sapiens; identical to SEQ ID NO: 111261

SEQ ID NO: 572514 - RNA, 64 nt, Homo Sapiens; identical to SEQ ID NO: 111262

SEQ ID NO: 572515 - RNA, 64 nt, Homo Sapiens; identical to SEQ ID NO: 111263

SEQ ID NO: 572516 - RNA, 64 nt, Homo Sapiens; identical to SEQ ID NO: 111264

SEQ ID NO: 572517 - RNA, 64 nt, Homo Sapiens; identical to SEQ ID NO: 111265

SEQ ID NO: 572518 - RNA, 64 nt, Homo Sapiens; identical to SEQ ID NO: 111266

SEQ ID NO: 572519 - RNA, 64 nt, Homo Sapiens; identical to SEQ ID NO: 111267

SEQ ID NO: 572520 - RNA, 64 nt, Homo Sapiens; identical to SEQ ID NO: 111268

SEQ ID NO: 572521 - RNA, 64 nt, Homo Sapiens; identical to SEQ ID NO: 111269

SEQ ID NO: 572522 - RNA, 64 nt, Homo Sapiens; identical to SEQ ID NO: 111270

SEQ ID NO: 572523 - RNA, 64 nt, Homo Sapiens; identical to SEQ ID NO: 111271

SEQ ID NO: 572524 - RNA, 64 nt, Homo Sapiens; identical to SEQ ID NO: 111272

SEQ ID NO: 572525 - RNA, 64 nt, Homo Sapiens; identical to SEQ ID NO: 111273

SEQ ID NO: 572526 - RNA, 64 nt, Homo Sapiens; identical to SEQ ID NO: 111274

SEQ ID NO: 572527 - RNA, 64 nt, Homo Sapiens; identical to SEQ ID NO: 111275

SEQ ID NO: 572528 - RNA, 64 nt, Homo Sapiens; identical to SEQ ID NO: 111276

SEQ ID NO: 572529 - RNA, 64 nt, Homo Sapiens; identical to SEQ ID NO: 111277

SEQ ID NO: 572530 - RNA, 64 nt, Homo Sapiens; identical to SEQ ID NO: 111278

SEQ ID NO: 572531 - RNA, 64 nt, Homo Sapiens; identical to SEQ ID NO: 111279

SEQ ID NO: 572532 - RNA, 64 nt, Homo Sapiens; identical to SEQ ID NO: 111280

SEQ ID NO: 572533 - RNA, 64 nt, Homo Sapiens; identical to SEQ ID NO: 111281

SEQ ID NO: 572534 - RNA, 64 nt, Homo Sapiens; identical to SEQ ID NO: 111282

SEQ ID NO: 572535 - RNA, 64 nt, Homo Sapiens; identical to SEQ ID NO: 111283

SEQ ID NO: 572536 - RNA, 64 nt, Homo Sapiens; identical to SEQ ID NO: 111284

SEQ ID NO: 572537 - RNA, 64 nt, Homo Sapiens; identical to SEQ ID NO: 111285

SEQ ID NO: 572538 - RNA, 64 nt, Homo Sapiens; identical to SEQ ID NO: 111286

SEQ ID NO: 572539 - RNA, 64 nt, Homo Sapiens; identical to SEQ ID NO: 111287

SEQ ID NO: 572540 - RNA, 64 nt, Homo Sapiens; identical to SEQ ID NO: 111288

SEQ ID NO: 572541 - RNA, 64 nt, Homo Sapiens; identical to SEQ ID NO: 111289

SEQ ID NO: 572542 - RNA, 64 nt, Homo Sapiens; identical to SEQ ID NO: 111290

SEQ ID NO: 572543 - RNA, 64 nt, Homo Sapiens; identical to SEQ ID NO: 111291

SEQ ID NO: 572544 - RNA, 64 nt, Homo Sapiens; identical to SEQ ID NO: 111292

SEQ ID NO: 572545 - RNA, 64 nt, Homo Sapiens; identical to SEQ ID NO: 111293

SEQ ID NO: 572546 - RNA, 64 nt, Homo Sapiens; identical to SEQ ID NO: 111294

SEQ ID NO: 572547 - RNA, 64 nt, Homo Sapiens; identical to SEQ ID NO: 111295

SEQ ID NO: 572548 - RNA, 64 nt, Homo Sapiens; identical to SEQ ID NO: 111296

SEQ ID NO: 572549 - RNA, 64 nt, Homo Sapiens; identical to SEQ ID NO: 111297

SEQ ID NO: 572550 - RNA, 64 nt, Homo Sapiens; identical to SEQ ID NO: 111298

SEQ ID NO: 572551 - RNA, 64 nt, Homo Sapiens; identical to SEQ ID NO: 111299

SEQ ID NO: 572552 - RNA, 64 nt, Homo Sapiens; identical to SEQ ID NO: 111300

SEQ ID NO: 572553 - RNA, 64 nt, Homo Sapiens; identical to SEQ ID NO: 111301

SEQ ID NO: 572554 - RNA, 64 nt, Homo Sapiens; identical to SEQ ID NO: 111302

SEQ ID NO: 572555 - RNA, 64 nt, Homo Sapiens; identical to SEQ ID NO: 111303

SEQ ID NO: 572556 - RNA, 64 nt, Homo Sapiens; identical to SEQ ID NO: 111304

SEQ ID NO: 572557 - RNA, 58 nt, Homo Sapiens
guagaaaaaugucacguuuccauaucuccugcuggaaaucagaaaauauaauaaaauu

SEQ ID NO: 572558 - RNA, 58 nt, Homo Sapiens
gaaucaauggaucuguugaagaacucagcugcuggaaaccaugcaaaauguuuugaau

SEQ ID NO: 572559 - RNA, 58 nt, Homo Sapiens
aaacugcagcagccacgcacacagaagccugcuggaagacaggucucucuccguccac

SEQ ID NO: 572560 - RNA, 58 nt, Homo Sapiens
uuacauaagaucugccuuccacacuucccugcuggaaggcauucucagagcuuuaugu

SEQ ID NO: 572561 - RNA, 58 nt, Homo Sapiens
uuuccugcccucuguggucaucugccaccugcuggaucaagugcuuucucuuuuacac

SEQ ID NO: 572562 - RNA, 58 nt, Homo Sapiens
uuccugguugucuguugaaucuuucuggcugcuggaauuggagauaggauguuuugcu

SEQ ID NO: 572563 - RNA, 58 nt, Homo Sapiens
ucaggagcagcaaugggucucaccauagcugcuggaaucacaccugagaacugagaua

SEQ ID NO: 572564 - RNA, 58 nt, Homo Sapiens
gcuguccucgugcgauugcccucuccugcugcuggacuucugccuuuguuggccugau

SEQ ID NO: 572565 - RNA, 58 nt, Homo Sapiens
ccgcccucuggaccuguguagggccucacugcuggagcggggaaaccgcagcucagcc

SEQ ID NO: 572566 - RNA, 58 nt, Homo Sapiens
gccucccagccccucaagacaccgcuggcugcuggacacccucuucacuugugugugu

SEQ ID NO: 572567 - RNA, 58 nt, Homo Sapiens
ugggaguggcauguaugacgugacuggccugcuggauguggagggggcgcgugcaggc

SEQ ID NO: 572568 - RNA, 58 nt, Homo Sapiens
uugccaugcuggccaggcuggucucgaacugcuggauucaagugauccgcccaucucc

SEQ ID NO: 572569 - RNA, 58 nt, Homo Sapiens
ccaggccuacccuacugcccgcugcguccugcuggaggugcaagugccugcugcccuu

SEQ ID NO: 572570 - RNA, 58 nt, Homo Sapiens
acugcaacugcugacccugcagagcuggcugcuggacgcaccgugcucgcugcccgca

SEQ ID NO: 572571 - RNA, 58 nt, Homo Sapiens
cugagaguucaagaccagcccaggaaggcugcuggaaacucacuuugggaggcugagg

SEQ ID NO: 572572 - RNA, 58 nt, Homo Sapiens
cucaggcuaacauccuggaguccuucugcugcuggauugaagccuuagaugcuauagu

SEQ ID NO: 572573 - RNA, 58 nt, Homo Sapiens
gcgcccauuuagaggauguggcuguaaccugcuggaugggacuccauagcuccuuccc

SEQ ID NO: 572574 - RNA, 58 nt, Homo Sapiens
uuggcugggccucugguucugacacuuucugcuggaagcugucaggcugggacaggcu

SEQ ID NO: 572575 - RNA, 58 nt, Homo Sapiens
cucacagacugaccauuccaucccacagcugcuggacauagagugauuugcagccccu

SEQ ID NO: 572576 - RNA, 58 nt, Homo Sapiens
ugagugaccauccaggcagucaccauaacugcuggagugucugggauugguagcucuc

SEQ ID NO: 572577 - RNA, 58 nt, Homo Sapiens
uugggucccucggucucccucauugucccugcuggagagcgcucuacggaggcuucuc

SEQ ID NO: 572578 - RNA, 58 nt, Homo Sapiens
ggccuuaggggugaaggugguccacgcccugcuggaccccccuacaucgcugcugucg

SEQ ID NO: 572579 - RNA, 58 nt, Homo Sapiens
gggacaaacaacucaagugucuuaacagcugcuggagugggauccuuguuaucucuua

SEQ ID NO: 572580 - RNA, 58 nt, Homo Sapiens
uguuuuaguaaucauucuauaaaugauacugcuggauugauugccguggguugauagc

SEQ ID NO: 572581 - RNA, 58 nt, Homo Sapiens
guguuggcaacacagcgugugcauggggcugcuggaggagagcauuccagagcaguac

SEQ ID NO: 572582 - RNA, 58 nt, Homo Sapiens
ggguccgaugugccaagugaucaugauucugcuggaaagaggauuuuaaauauugugg

SEQ ID NO: 572583 - RNA, 58 nt, Homo Sapiens
cgagggccuggccucgcuguugguggcccugcuggagaagaccacgugggucgaccgu

SEQ ID NO: 572584 - RNA, 58 nt, Homo Sapiens
ggaggagaccgacuggucgcacucgcagcugcuggacuugggccccaucgacgcgcuc

SEQ ID NO: 572585 - RNA, 58 nt, Homo Sapiens
uguaaauaauuuaaaauccuagaugaaccugcuggauuggaagccaagccauuauggc

SEQ ID NO: 572586 - RNA, 58 nt, Homo Sapiens
aggugaaagucgcuuugggaaaaaauugcugcuggagacccaaaaggacagagaacua

SEQ ID NO: 572587 - RNA, 58 nt, Homo Sapiens
cucagucugcuugaauggugaugagauucugcuggaucucagcacgcugcaggugucu

SEQ ID NO: 572588 - RNA, 58 nt, Homo Sapiens
auucaguuagcaaaccuugaugaagcaccugcuggacacugagggacccaaagcucaa

SEQ ID NO: 572589 - RNA, 58 nt, Homo Sapiens
caccauaucagccugcgggacauggagucugcuggaggcccugcacccuccgggaagc

SEQ ID NO: 572590 - RNA, 58 nt, Homo Sapiens
gugaacuggggacccugcacugccacuccugcuggagggcuagggguaccccagcugc

SEQ ID NO: 572591 - RNA, 58 nt, Homo Sapiens
ggcauugcucggguaccacuugcuggagcugcuggaggcccugggguugguagggcag

SEQ ID NO: 572592 - RNA, 58 nt, Homo Sapiens
ccagcuggugugccaauuccccaggccccugcuggauuggcaggcccuguccgaggag

SEQ ID NO: 572593 - RNA, 58 nt, Homo Sapiens
ugguguugcagcuugugggcaggugaagcugcuggagcucaggacaaggaggagauga

SEQ ID NO: 572594 - RNA, 58 nt, Homo Sapiens
uugaguggaaagccgagccuaggagaggcugcuggagcggagaggaugcuggagcaag

SEQ ID NO: 572595 - RNA, 58 nt, Homo Sapiens
ucugcccagaccacacguagcccccaggcugcuggacacgucggacagcgaaguaucc

SEQ ID NO: 572596 - RNA, 58 nt, Homo Sapiens
gacuucccgucgccugcgagccugcggccugcuggagccugcgcagcuuggauggaga

SEQ ID NO: 572597 - RNA, 58 nt, Homo Sapiens
uacaaaaccucaugccuacugucugccacugcuggagaaggaaucaugguuucuagaa

SEQ ID NO: 572598 - RNA, 58 nt, Homo Sapiens
gauccauguauguguccagcacagcggccugcuggacucugagaacugggaaagauca

SEQ ID NO: 572599 - RNA, 58 nt, Homo Sapiens
gcgagugggaaucagagccuaccucccacugcuggaguggaaugccuggucuugagca

SEQ ID NO: 572600 - RNA, 58 nt, Homo Sapiens
caucuuucccaagccuugccucagugggcugcuggaccucagaaaugaagggaacccc

SEQ ID NO: 572601 - RNA, 58 nt, Homo Sapiens
cugcaccuacugaggaugucgaccuuggcugcuggagguggggaccucaccugcuggg

SEQ ID NO: 572602 - RNA, 58 nt, Homo Sapiens
ccuuuguggccaacccucucggccucaccugcuggagucgggaaccucaucugccugg

SEQ ID NO: 572603 - RNA, 58 nt, Homo Sapiens
ccagauucuggguccccaauaacugcagcugcuggauucacagcaaguggauccuggc

SEQ ID NO: 572604 - RNA, 58 nt, Homo Sapiens
cuggaugucaacaaaccucaaagcucagcugcuggauugccucgagcccuggaucucc

SEQ ID NO: 572605 - RNA, 58 nt, Homo Sapiens
cugauguggaaggcuucccuccuggguucugcuggaaguuuuggccagaagggcccag

SEQ ID NO: 572606 - RNA, 58 nt, Homo Sapiens
ccuuugccagaguuaaaucaguucuaaacugcuggagguugcaggagcuccuuugcau

SEQ ID NO: 572607 - RNA, 58 nt, Homo Sapiens
ugcccuaugggccugccgggcugagggccugcuggaggccucaggugcuguccauggg

SEQ ID NO: 572608 - RNA, 58 nt, Homo Sapiens
ggcaaggguuaaggccugaaucaugagccugcuggaagcccagccccuacugcuguga

SEQ ID NO: 572609 - RNA, 58 nt, Homo Sapiens
gauucaaaacuuauuagaacaguagcuucugcuggaauuugcaaucacugaagucaua

SEQ ID NO: 572610 - RNA, 58 nt, Homo Sapiens
uuguuugcugucugucuccccugccccacugcuggaacagaggcuccaagaaaacagg

SEQ ID NO: 572611 - RNA, 58 nt, Homo Sapiens
uuucacuuguguuuugucuuaaacccuacugcuggaaacaauuuuauguaauaagcaa

SEQ ID NO: 572612 - RNA, 58 nt, Homo Sapiens
ugccuaguugccugcaaagccucauguccugcuggaaggguaguggccaucuuacauu

SEQ ID NO: 572613 - RNA, 58 nt, Homo Sapiens
gcucagagcaagcugggcucggccagcacugcuggauguuggccaagcucggaggcuu

SEQ ID NO: 572614 - RNA, 58 nt, Homo Sapiens
uugcugaucuuuuccaaguugcaaagcccugcuggacagcgcuuuggaaaccacaucc

SEQ ID NO: 572615 - RNA, 58 nt, Homo Sapiens
uguacagccugaaggaugagagaugaaccugcuggagagcccccaacuggccucccug

SEQ ID NO: 572616 - RNA, 58 nt, Homo Sapiens
ugaccucuucuucuguuaccgcuggcugcugcuggaacucaagcgugaguucgccuuc

SEQ ID NO: 572617 - RNA, 58 nt, Homo Sapiens
auucaugcuguuccucugccuggccauccugcuggagcaccgcgaccacaucaugcgc

SEQ ID NO: 572618 - RNA, 64 nt, Homo Sapiens; identical to SEQ ID NO: 299632

SEQ ID NO: 572619 - RNA, 64 nt, Homo Sapiens; identical to SEQ ID NO: 299633

SEQ ID NO: 572620 - RNA, 51 nt, Homo Sapiens; identical to SEQ ID NO: 299634

SEQ ID NO: 572621 - RNA, 64 nt, Homo Sapiens; identical to SEQ ID NO: 299635

SEQ ID NO: 572622 - RNA, 64 nt, Homo Sapiens; identical to SEQ ID NO: 299636

SEQ ID NO: 572623 - RNA, 64 nt, Homo Sapiens; identical to SEQ ID NO: 299637

SEQ ID NO: 572624 - RNA, 64 nt, Homo Sapiens; identical to SEQ ID NO: 299638

SEQ ID NO: 572625 - RNA, 64 nt, Homo Sapiens; identical to SEQ ID NO: 299639

SEQ ID NO: 572626 - RNA, 64 nt, Homo Sapiens; identical to SEQ ID NO: 299640

SEQ ID NO: 572627 - RNA, 64 nt, Homo Sapiens; identical to SEQ ID NO: 299641

SEQ ID NO: 572628 - RNA, 64 nt, Homo Sapiens; identical to SEQ ID NO: 299642

SEQ ID NO: 572629 - RNA, 64 nt, Homo Sapiens; identical to SEQ ID NO: 299643

SEQ ID NO: 572630 - RNA, 64 nt, Homo Sapiens; identical to SEQ ID NO: 299644

SEQ ID NO: 572631 - RNA, 64 nt, Homo Sapiens; identical to SEQ ID NO: 299645

SEQ ID NO: 572632 - RNA, 64 nt, Homo Sapiens; identical to SEQ ID NO: 299646

SEQ ID NO: 572633 - RNA, 64 nt, Homo Sapiens; identical to SEQ ID NO: 299647

SEQ ID NO: 572634 - RNA, 64 nt, Homo Sapiens; identical to SEQ ID NO: 299648

SEQ ID NO: 572635 - RNA, 64 nt, Homo Sapiens
agauacuauugucagauucagguuuugaaauuugucaaauaaacaggauaacuguacauuuuuc

SEQ ID NO: 572636 - RNA, 64 nt, Homo Sapiens
ggaaguguuuuuucaugucauagauuagcaauuuucaaauaauuauuuuuucucugaaaauuuu

SEQ ID NO: 572637 - RNA, 64 nt, Homo Sapiens
ggggguuagucucuuuuauuugauucuuaaauauucaaauaaauauuaacaguaaaacauaaac

SEQ ID NO: 572638 - RNA, 64 nt, Homo Sapiens
uccuuagaagggacagaacuaagaaauacauugcucaaauaauauuuuacuuuauugauaauga

SEQ ID NO: 572639 - RNA, 64 nt, Homo Sapiens
acaaaguggcaagucugcccugaaccuguaagcaucaaauaagcaugagagagaaaaaaacaug

SEQ ID NO: 572640 - RNA, 64 nt, Homo Sapiens
uauuuuuuaaauuuuuaaaauuugauuuuaaauuucaaauaaauuuaaauaaauuuuaaauaaa

SEQ ID NO: 572641 - RNA, 64 nt, Homo Sapiens
aaguaaccaugucuuugucuuacuuuuuuuuucuucaaauaaaaccgcaguauuuauuaaaaca

SEQ ID NO: 572642 - RNA, 64 nt, Homo Sapiens
ggugucuugguuugaugucaauaaaaaugcaaagucaaauaaaagugauuuuuugccaucguug

SEQ ID NO: 572643 - RNA, 64 nt, Homo Sapiens
auguuuaaaaauuaucuugauuuccuguacuuuuucaaauaauguggaguuuuuaaagggacau

SEQ ID NO: 572644 - RNA, 64 nt, Homo Sapiens
cuccauccuucccucucccaaaaggggcucccucucaaauaaauaaagaaguugcugcccaguu

SEQ ID NO: 572645 - RNA, 64 nt, Homo Sapiens
cuuaaagacacaaugcacacuaaaaugauacaagucaaauaaauugaaaacaaucagggcacau

SEQ ID NO: 572646 - RNA, 64 nt, Homo Sapiens
uucuuguuaacccauuuauggggagaagaacauuucaaauaagacccaggaagauuucaaggca

SEQ ID NO: 572647 - RNA, 64 nt, Homo Sapiens
ucaggaagccaauuuucuauguguuuuucaguauucaaauaagaaacucuuuauuuaaauaugu

SEQ ID NO: 572648 - RNA, 64 nt, Homo Sapiens
uaugauucauauauuuuaugaaucagaauaaccuucaaauaaaauaaaucuaagucgguuaaaa

SEQ ID NO: 572649 - RNA, 64 nt, Homo Sapiens
aaauguagagcacaauggaauuaugcuggaagucucaaauaauauuuuuuuccuauuuuauacu

SEQ ID NO: 572650 - RNA, 64 nt, Homo Sapiens
uuaaggaaauucauuucuuaaaaauauaguguccucaaauaauuaauuuuuuugcaaacuuuag

SEQ ID NO: 572651 - RNA, 64 nt, Homo Sapiens
gcuaagcuaauuuuauauuugguauacaugcaugucaaauaaaguuaauuuuacauacuauucu

SEQ ID NO: 572652 - RNA, 64 nt, Homo Sapiens
uggguccuugaggccugccaguguguaaagguguucaaauaaagggcuguuucuacagguaaca

SEQ ID NO: 572653 - RNA, 64 nt, Homo Sapiens
gaccauuaauuuuauuuguuuuuguucuauguaaucaaauaaaauuugaguaacauguaauggu

SEQ ID NO: 572654 - RNA, 64 nt, Homo Sapiens
ccuaggaauguauuuugcuucaggauuuuuaaauucaaauaaggauggcagugcccauuuuaag

SEQ ID NO: 572655 - RNA, 64 nt, Homo Sapiens
uccuuauuaaggcuuuaguaauuuguauguaaugucaaauaaaaggaauucaaaucugaguaaa

SEQ ID NO: 572656 - RNA, 64 nt, Homo Sapiens
uuuuuaaaaaauuuuugaauucccauccuaauuuucaaauaaguuucaaggagacuaucaggau

SEQ ID NO: 572657 - RNA, 64 nt, Homo Sapiens
cuaucaggauuauuauuuuaaagauuagauuuagucaaauaagucuuagcaggcaauaaaguuu

SEQ ID NO: 572658 - RNA, 64 nt, Homo Sapiens
cauuccaaaauacaauguuaguagcaaaacaaauucaaauaaucgaagaauaucaaauaauaaa

SEQ ID NO: 572659 - RNA, 64 nt, Homo Sapiens
aaguagcaaaacaaauucaaacuggagaagaauaucaaauaauaaauaacuucauaagaugaac

SEQ ID NO: 572660 - RNA, 64 nt, Homo Sapiens
uauucacuuuucauguggcaacaggcccaucauaucaaauaacuagagacucacucaggaagug

SEQ ID NO: 572661 - RNA, 64 nt, Homo Sapiens
aagucaagcagaggacuuccucaagaagguaacaucaaauaaauuaacuggggugcaaaccucu

SEQ ID NO: 572662 - RNA, 64 nt, Homo Sapiens
gcuaauuucuuugaaaauggggggaaaaguagucucaaauaaaaaauucuuaaaagauacaugu

SEQ ID NO: 572663 - RNA, 64 nt, Homo Sapiens
aaagaaacugucuuuuuaaaaaacuucuagcuaaucaaauaagguuuuuugcuuuuaccuagau

SEQ ID NO: 572664 - RNA, 64 nt, Homo Sapiens
aucagucucacuguuggcugucauugugacaaagucaaauaaacccccaaggacgacacacagu

SEQ ID NO: 572665 - RNA, 64 nt, Homo Sapiens
ucuggcuucaggaaagucuagaagcaauauuucuucaaauaaaagguguuuaaacuuuuuucug

SEQ ID NO: 572666 - RNA, 64 nt, Homo Sapiens
aaugcuggaauacucaagaaguauuuuacucugaucaaauaaauaguuuguagugaugggaagu

SEQ ID NO: 572667 - RNA, 64 nt, Homo Sapiens
aucaaucaaucagcauauacuggauauguacuaaucaaauaauaugucaaaaucugaauauauc

SEQ ID NO: 572668 - RNA, 64 nt, Homo Sapiens
cagaaugaacuuugguaaccagaaauguaaaauuucaaauaacggauaaaauaauguguuauuu

SEQ ID NO: 572669 - RNA, 64 nt, Homo Sapiens
aaauguuuuaucacucaaaaauccauuagaaguuucaaauaaauugcuuucuugcuagcuguau

SEQ ID NO: 572670 - RNA, 64 nt, Homo Sapiens
cuacaaauaguuuuuguagcaaaugaaaauuucuucaaauaagccuuuuguuucaaauaaaacu

SEQ ID NO: 572671 - RNA, 64 nt, Homo Sapiens
gcaaaugaaaauuucuucaaauaagccuuuuguuucaaauaaaacuugucucaaaacaugcuuc

SEQ ID NO: 572672 - RNA, 64 nt, Homo Sapiens
cuguacaaggcugcuuguuuuuuuauugccaaagucaaauaaacgggagacugucaugcucaug

SEQ ID NO: 572673 - RNA, 64 nt, Homo Sapiens
gagacugucaugcucaugcaugaauagaauuuagucaaauaaaaaauuuuggucauuugguacu

SEQ ID NO: 572674 - RNA, 64 nt, Homo Sapiens
uucaggauguauuuuaaaugauuacaucuuaugaucaaauaacuaaaaacuaugcuuuaaagga

SEQ ID NO: 572675 - RNA, 64 nt, Homo Sapiens
auaagcauuuggcaaaaacauaaaacauuaaaauucaaauaauucugguauuuucuguaucaua

SEQ ID NO: 572676 - RNA, 64 nt, Homo Sapiens
cauauuugccaaaauuuuuguaaacccugucuugucaaauaaguguauaauauuguauuauuaa

SEQ ID NO: 572677 - RNA, 64 nt, Homo Sapiens
ugguugccuagauucucucuggaaacugacuuugucaaauaaauagcagauuguagugucuggu

SEQ ID NO: 572678 - RNA, 64 nt, Homo Sapiens
ugguuuguuagacauucauaugaaaaagcuggguucaaauaaguaggugugagaauugugugug

SEQ ID NO: 572679 - RNA, 64 nt, Homo Sapiens
agacaccaagaugcagggccaugaaaaccggauuucaaauaacccuuaaccaaaacuauucaaa

SEQ ID NO: 572680 - RNA, 64 nt, Homo Sapiens
cccaggaauucaagguugguucaacaucuaaaaaucaaauaagcuaauauacagucaguucuca

SEQ ID NO: 572681 - RNA, 64 nt, Homo Sapiens
guuaggaauucaagguuuguucaacaucuaaaaaucaaauaagcuaauaaagaaaagagguuua

SEQ ID NO: 572682 - RNA, 64 nt, Homo Sapiens
cuuuaucucaguaggaaauuaaauaauucaaacaucaaauaacuucaauuuaaggcuauggacu

SEQ ID NO: 572683 - RNA, 64 nt, Homo Sapiens
gauguuuccacguggcuauuuccaagcuuugccuucaaauaaauucuguacuuaaucauauauu

SEQ ID NO: 572684 - RNA, 64 nt, Homo Sapiens
uugcugacaugguuuuauuagauacuguagugauucaaauaaguuuucuauuugaaaaaaaaaa

SEQ ID NO: 572685 - RNA, 64 nt, Homo Sapiens
gucuggguauucauugguuauuggccugaaaugaucaaauaacuacaaaugaucuguugaauaa

SEQ ID NO: 572686 - RNA, 64 nt, Homo Sapiens
aaucauuaaggaacccauuacugccauuuggaauucaaauaaccuaaccaaccuccaccuccuc

SEQ ID NO: 572687 - RNA, 64 nt, Homo Sapiens
aacaaacaaaaaacaaaaaauccccacaacuuugucaaauaauguacaggcaaacacuuucaaa

SEQ ID NO: 572688 - RNA, 64 nt, Homo Sapiens
uccuuccgucuuuucucccauuuuacaguauuacucaaauaagggcacacagugaucauauuag

SEQ ID NO: 572689 - RNA, 64 nt, Homo Sapiens
agaacucugcccuuccuucuguucuuuugugcuuucaaauaacuaacacgaacuuccagaaaau

SEQ ID NO: 572690 - RNA, 64 nt, Homo Sapiens
aguacaaacauugaacaauuugaaagguaaaaucucaaauaacaauguacuguaacuuuaucag

SEQ ID NO: 572691 - RNA, 64 nt, Homo Sapiens
caucaugauuuaaauuuucuaaauucuaaaggaaucaaauaauuauuagcuuuguggcuuugug

SEQ ID NO: 572692 - RNA, 64 nt, Homo Sapiens
ugguaucuacauucaugugaauugugugugauguucaaauaaaguguggcaauuuuaaauuuau

SEQ ID NO: 572693 - RNA, 64 nt, Homo Sapiens
ucauacacacuuucuaguucauguaaaauugaauucaaauaaaacaucuaguagacuucugcac

SEQ ID NO: 572694 - RNA, 64 nt, Homo Sapiens
ccucuauccuuuuuuccuuuccugaucaaggugcucuucucauuuuuuccugagaaccuuagcc

SEQ ID NO: 572695 - RNA, 64 nt, Homo Sapiens
ccugaauuauuaaugaaugcccaggaaguaauuuucuucucauucuucuaaaacuacugccuuu

SEQ ID NO: 572696 - RNA, 64 nt, Homo Sapiens
uucuguacuuuuuuucuuuuuucuucaucuccgaucuucucaaauauauauaauuuuguacguu

SEQ ID NO: 572697 - RNA, 64 nt, Homo Sapiens
uugcuagccagaaaugacugggcaccuagucagaucuucucagcuuauaggcagggaugaaaug

SEQ ID NO: 572698 - RNA, 64 nt, Homo Sapiens
gagaaggaaggauucaccaccuccaggaaaagugucuucucagaaacaaccagcugagaaggua

SEQ ID NO: 572699 - RNA, 64 nt, Homo Sapiens
agaaauaaaggagggaccaauaucugggacagugucuucucagaaacaaccagcugagaaggua

SEQ ID NO: 572700 - RNA, 64 nt, Homo Sapiens
aagaauaauggguggugggaaaucuggaacagugucuucucagaaacaaccagccucaaaggua

SEQ ID NO: 572701 - RNA, 64 nt, Homo Sapiens
agaaauaaaggauggacuacagugugggacagugucuucucagaaacaaccagccuugaaggua

SEQ ID NO: 572702 - RNA, 64 nt, Homo Sapiens
agaaauaaaggauggagaaaaaucugggacagugucuucucagaaacaaccagccuugaaggua

SEQ ID NO: 572703 - RNA, 64 nt, Homo Sapiens
agaaauaaaggauggagaaaaaucugggacagugucuucucagaaaccaccagccuugacggua

SEQ ID NO: 572704 - RNA, 64 nt, Homo Sapiens
aggaaaaaaggauggagaaauaucuaggaaagugucuucucagaaaccaccaaccuugaaggua

SEQ ID NO: 572705 - RNA, 64 nt, Homo Sapiens
agaaaaaaaggauggagaaauaucuaggaaagugucuucucagaaaccaccagccuugaaggua

SEQ ID NO: 572706 - RNA, 64 nt, Homo Sapiens
aggcauuuuggucaggucauuuguaggcaguuucucuucucacaaaagauguacuuaagcaggc

SEQ ID NO: 572707 - RNA, 64 nt, Homo Sapiens
ccucgguucuuugucauucagauugcauuugaccucuucucaucuauuuauuucuuuauacauc

SEQ ID NO: 572708 - RNA, 64 nt, Homo Sapiens
ccaccuuuguuacguugaaaucccucauuuauuuucuucucaaaaugcccauuauccaaaugca

SEQ ID NO: 572709 - RNA, 64 nt, Homo Sapiens
gccguuggccugucaucagugagauacaauccagucuucucaugcacgggaacacacacacccu

SEQ ID NO: 572710 - RNA, 64 nt, Homo Sapiens
aauaaguggggucaggcauucgaguuuuugucuuucuucucagguguauuucuugguaccccca

SEQ ID NO: 572711 - RNA, 64 nt, Homo Sapiens
cuaccucucucgccuuuguucuuguugaagggucucuucucagcuaauuaacucugaaucaugg

SEQ ID NO: 572712 - RNA, 64 nt, Homo Sapiens
uguaucaguauaaucuacgauucuguuagaaguaucuucucagcccugcuacugucugcugcuc

SEQ ID NO: 572713 - RNA, 64 nt, Homo Sapiens
ucuucuugaaacaagcuauaauucaucuuccacaucuucucaccguuuucacagccacugcagg

SEQ ID NO: 572714 - RNA, 64 nt, Homo Sapiens
ccucguccguuugcuguucuacccagacggccacucuucucaccaaggcagcacuaugcugcaa

SEQ ID NO: 572715 - RNA, 64 nt, Homo Sapiens
accacaucacacuuauuuccaacagaauauacauucuucucagcagaacgcuccaccccaaauc

SEQ ID NO: 572716 - RNA, 64 nt, Homo Sapiens
uucaucccugccuucccuuuuguuucuaggguuuucuucucaguguuggucaaauuuugcugcc

SEQ ID NO: 572717 - RNA, 64 nt, Homo Sapiens
gaguuuuuguuuaaaaaccagagagggcagucauucuucucacuuuuacuuuaccauaggaugu

SEQ ID NO: 572718 - RNA, 64 nt, Homo Sapiens
acucugccugaaaccuuuccuggucacaggauucucuucucagagggcauguuucucaauggag

SEQ ID NO: 572719 - RNA, 64 nt, Homo Sapiens
agaaaggaacagaaaacaaagucuuccuccucagucuucucagucacaguuggaagcagagcca

SEQ ID NO: 572720 - RNA, 64 nt, Homo Sapiens
uuucuccaccuuucaguuucgggacuuugggauuucuucucagcucauucccaguagcuguccu

SEQ ID NO: 572721 - RNA, 64 nt, Homo Sapiens
aucccaggcuggaaauuaccgcagagcugucaacucuucucaaacccaaguuuuucagaaacca

SEQ ID NO: 572722 - RNA, 64 nt, Homo Sapiens
cacuucuuaccccagccuacccuuccugcauuucucuucucagcucuuccaugauggauucccc

SEQ ID NO: 572723 - RNA, 64 nt, Homo Sapiens
aaaccaacauccagaucuauagcagaguccuuauucuucucauaaaucuuuuuacuuuggcuac

SEQ ID NO: 572724 - RNA, 64 nt, Homo Sapiens
gacaggcugguccaguggcuagccccucugugucucuucucagguuucuucuucucauugcuga

SEQ ID NO: 572725 - RNA, 64 nt, Homo Sapiens
gcugaagccccucugugucugaaauugguuuucuucuucucauuucucugcuaagaagccaaaa

SEQ ID NO: 572726 - RNA, 64 nt, Homo Sapiens
cccaauuuucauuugaguuuauguguggaguuacucuucucaugcacuguuugacaagucuuuc

SEQ ID NO: 572727 - RNA, 64 nt, Homo Sapiens
uggacuccuuccagaaagguaaggucugaaauuaucuucucaauggaaaaggagacuggaauga

SEQ ID NO: 572728 - RNA, 64 nt, Homo Sapiens
agcugaagaaugucccuaccugaauuuucauucaucuucucagcgguuggcaagaaaacauacu

SEQ ID NO: 572729 - RNA, 64 nt, Homo Sapiens
agagcacugggacauuaaacaccuggcuagaguuucuucucaucgccaucccgauccuugcucu

SEQ ID NO: 572730 - RNA, 64 nt, Homo Sapiens
cagaguucugccaggaggguggcuuuugcuguccucuucucacgucaaaucauggugagggcug

SEQ ID NO: 572731 - RNA, 64 nt, Homo Sapiens
uuaucaaaguaagaauacucagauuuccauaagcucuucucaccuccucuuagcccaacucaaa

SEQ ID NO: 572732 - RNA, 64 nt, Homo Sapiens
caccuccucuuagcccaacucaaacuccaucagaucuucucaccuugauuuugagcuggaaugu

SEQ ID NO: 572733 - RNA, 64 nt, Homo Sapiens
uuuucaagcaucuccugaggaucagaaaguaauuucuucucaaaggguacuuccacugauggaa

SEQ ID NO: 572734 - RNA, 64 nt, Homo Sapiens
cucguuagggaagagaaacaggguguugucagcaucuucucacucccuucuccuugauaacagc

SEQ ID NO: 572735 - RNA, 64 nt, Homo Sapiens
ucuuuuuauuuuacagauauuugugucgucacugucuucucaaaucauguguaagaguuuggag

SEQ ID NO: 572736 - RNA, 64 nt, Homo Sapiens
caaggggaacugaagaguggagcucaguuuccucucuucucacccuccaccuguuccucauuug

SEQ ID NO: 572737 - RNA, 64 nt, Homo Sapiens
auauuuuacuuaagaguauaaaacuaugcuaaauaaauuguauuguauauggaauaugcuugcc

SEQ ID NO: 572738 - RNA, 64 nt, Homo Sapiens
uuucaaguaauaaaucugaauucuauuaguuuaaaaauuguaaaauucaaguuaaaugacgugu

SEQ ID NO: 572739 - RNA, 64 nt, Homo Sapiens
uaagguaagaggaaucaaguaugcuaaauagaagaaauuguaggaugaaggaagguaaauaaaa

SEQ ID NO: 572740 - RNA, 64 nt, Homo Sapiens
acauguuucccugacauuuuagauauguauuuuaaaauuguagcuuuauaaacauaaauuuuug

SEQ ID NO: 572741 - RNA, 64 nt, Homo Sapiens
agguauuuacacauacaacuauuacugagagugcaaauuguacauuauaauauaaaucaaucuu

SEQ ID NO: 572742 - RNA, 64 nt, Homo Sapiens
aagaucuucugcagaaucaggaauauuacuggauaaauuguaugcauuaucuguauuaaugcuu

SEQ ID NO: 572743 - RNA, 64 nt, Homo Sapiens
ucauuacuuauacugggacaaccaaauuaaaaaaaaauuguaucuagccuuuacuguuugauau

SEQ ID NO: 572744 - RNA, 64 nt, Homo Sapiens
acuccaaggugauguuguacaaguaugcauuauuaaauuguaaaaugaguuaucaugaauuuua

SEQ ID NO: 572745 - RNA, 64 nt, Homo Sapiens
aacugacccauugaugucugccuuugaaauuauuaaauuguaaagagguucacuuuuaaucuuu

SEQ ID NO: 572746 - RNA, 64 nt, Homo Sapiens
agcuuuucaggaaccauauuuaagacccuacuccaaauuguagaagcuuugcuuuucacgugau

SEQ ID NO: 572747 - RNA, 64 nt, Homo Sapiens
uuuaaaauaacagggucuaagauuuugcaaaaaaaaauuguagcuguuuugucucuuugcaacu

SEQ ID NO: 572748 - RNA, 64 nt, Homo Sapiens
guauucuacuucuguuuaaauuggucuuuucacuaaauuguacaccuaucaauuuaucugaacu

SEQ ID NO: 572749 - RNA, 64 nt, Homo Sapiens
aacuggcaugguucguauuuuaaaaaucuugcacaaauuguaaugugauacugugaaacaaauu

SEQ ID NO: 572750 - RNA, 64 nt, Homo Sapiens
cuggacuggguauaacuauguuauaggaaaguagaaauuguauucuuuauuuuccaucuuuguu

SEQ ID NO: 572751 - RNA, 64 nt, Homo Sapiens
uuuauaagucuuugauucacuguugugaaaaccaaaauuguaauucauuuuuguauuuuuucua

SEQ ID NO: 572752 - RNA, 64 nt, Homo Sapiens
accguauauauagucauuuugaaauuuggguaaaaaauuguacaucaauacauacugcuccuuu

SEQ ID NO: 572753 - RNA, 64 nt, Homo Sapiens
cauaaaaaugguuaaaauggauguuaaugccacuaaauuguaccaugguugcucaacauuuuga

SEQ ID NO: 572754 - RNA, 64 nt, Homo Sapiens
augccuccaaaaguuuauuuucuauuugaccucuaaauuguaaaaauguauguuaccauuaauu

SEQ ID NO: 572755 - RNA, 64 nt, Homo Sapiens
gacuauuuaacuugaggguaauaaacuuagaauaaaauuguaaaauuguauagagauaugcaga

SEQ ID NO: 572756 - RNA, 64 nt, Homo Sapiens
aacuugaggguaauaaacuuagaauaaaauuguaaaauuguauagagauaugcagaaggaaggg

SEQ ID NO: 572757 - RNA, 64 nt, Homo Sapiens
uacagcugauggacucaauuuugagccaaauauaaaauuguauuacuugauauucaacagccac

SEQ ID NO: 572758 - RNA, 64 nt, Homo Sapiens
augauacagaaacacuccuuuuaugggagcuucaaaauuguaucagaaacaagcuacucugaca

SEQ ID NO: 572759 - RNA, 64 nt, Homo Sapiens
aauuguacaaaggucaagcccucuaaaagacacuaaauuguacuuuaaaagacacuaaauugua

SEQ ID NO: 572760 - RNA, 64 nt, Homo Sapiens
cuaaaagacacuaaauuguauuuuaaaagacacuaaauuguacuguuuuaaauauuuaggaagc

SEQ ID NO: 572761 - RNA, 64 nt, Homo Sapiens
caaucaagacaacacaagaaucuggaguuaucaaaaauuguauaaaaguaacacugugucaucu

SEQ ID NO: 572762 - RNA, 64 nt, Homo Sapiens
uauuccuuagaggagcaaauggaaagcagguuuuaaauuguaaagaaaccuggcccagcuugcu

SEQ ID NO: 572763 - RNA, 64 nt, Homo Sapiens
uuuuuucuuaauguuguggauuacuuuguuucauaaauuguacaucuguaauacuaauauuuau

SEQ ID NO: 572764 - RNA, 64 nt, Homo Sapiens
gauguuugugccuuuucuuugucugguacuuuuaaaauuguacaauuugaaauuaaccuauugg

SEQ ID NO: 572765 - RNA, 64 nt, Homo Sapiens
cuuaauguauaccuuuuauaaauuuugcucaauaaaauuguaaguguauguacauauaaaaaua

SEQ ID NO: 572766 - RNA, 64 nt, Homo Sapiens
gugauuuucaauuuuauguuuuuuaacuuaaaaaaaauuguauuguuaguuagaaaauguuagg

SEQ ID NO: 572767 - RNA, 64 nt, Homo Sapiens
aucacaauuuaguggagaguauuuauuugagccuaaauuguagguagcccuuacuacacucaac

SEQ ID NO: 572768 - RNA, 64 nt, Homo Sapiens
aaagauagaaauuauauugauaaguaaauauguaaaauuguaaauauguaaaaaaaagaauggu

SEQ ID NO: 572769 - RNA, 64 nt, Homo Sapiens
aacauguaauaauuuuuaacauuaaugauuccauaaauuguauuauugggauuagaaugugcuu

SEQ ID NO: 572770 - RNA, 64 nt, Homo Sapiens
uucaaccagagacacaacuuucuggcagacagacaaauuguacaacaccaacaauauccuggac

SEQ ID NO: 572771 - RNA, 64 nt, Homo Sapiens
aauguaaaugggggcuucaauuguggagaaauguaaauuguaauauauuugggaguaguauaau

SEQ ID NO: 572772 - RNA, 64 nt, Homo Sapiens
aaaaguuugugaauaacucauagcaauagaauguaaauuguauaaucuggcucauuaaaaaauu

SEQ ID NO: 572773 - RNA, 64 nt, Homo Sapiens
aauuaugaauuauuggagaauuccaaaauagcagaaauuguaaacgugggaauuuuaauguuug

SEQ ID NO: 572774 - RNA, 64 nt, Homo Sapiens
accuuaaggcucuucacagucauauaauuuaacaaaauuguacaauccuaccauucaagguuau

SEQ ID NO: 572775 - RNA, 64 nt, Homo Sapiens
uuaaaauucauacaauuauuauuuuaucugaacuaaauuguaucaaagguuuauguaaacuuga

SEQ ID NO: 572776 - RNA, 64 nt, Homo Sapiens
uuucuuuuucuuuuaauaaagccugcaaguuacuaaauuguaguuucauaaauucuguaguaaa

SEQ ID NO: 572777 - RNA, 64 nt, Homo Sapiens
aacuguacugccaauagaauucuggaauugugagaaauuguaucauugaaguucaguaggaugu

SEQ ID NO: 572778 - RNA, 64 nt, Homo Sapiens
ccucaaugcgauucugagauauuugaauuucauaaaauuguaacugaaauuuaaaauuuuuagu

SEQ ID NO: 572779 - RNA, 64 nt, Homo Sapiens
uauuuuaaggagcucccaaaauguguuaccuauuaaauuguaacucagcaaguagaagaccauu

SEQ ID NO: 572780 - RNA, 64 nt, Homo Sapiens
cuuuugugauuuugccaaaguguaugugguuauaaaauuguagaccuucuucccuaauguguuu

SEQ ID NO: 572781 - RNA, 64 nt, Homo Sapiens
uuugauauugaauucucuugcuuauuguaguuagaaauuguaaccaugaaaugaaacuuuguaa

SEQ ID NO: 572782 - RNA, 64 nt, Homo Sapiens
auccuuaacauauauaguauauuuaaaaaauauaaaauuguauuguacuaaugugaugauggau

SEQ ID NO: 572783 - RNA, 64 nt, Homo Sapiens
aggcucaucaguuuuagcaucucugcuccccagaaaauuguaagcauccucaccagccugugga

SEQ ID NO: 572784 - RNA, 64 nt, Homo Sapiens
uuaagauuuugggguauuauuugugacucuccugaaauuguaaacuugugcuucuguguccagu

SEQ ID NO: 572785 - RNA, 64 nt, Homo Sapiens
uccuguuaucuccuuguuugaauuucaggucauuaaauuguauaaccaucauuugaauuguagu

SEQ ID NO: 572786 - RNA, 64 nt, Homo Sapiens
cugcugcuauaacuuccaguuuuacaucuuuguaaaauuguaucucaaaggcagaaaaggccau

SEQ ID NO: 572787 - RNA, 64 nt, Homo Sapiens
uucauuguuucuguuacuaacauuaaaagugugcaaauuguauaaaauuagguacuucgauuag

SEQ ID NO: 572788 - RNA, 64 nt, Homo Sapiens
aaccaaauguauagagcuuuggguguaggauaugaaauuguacuuagauuuaagaaaaagagaa

SEQ ID NO: 572789 - RNA, 64 nt, Homo Sapiens
uggacugcuugaauuacauuggcuuuuagaaccgaaauuguaacuauguauuguauuucauggg

SEQ ID NO: 572790 - RNA, 64 nt, Homo Sapiens
gauugacaauagacuuaagauaugauuuacaauaaaauuguaaauuugcagcuguaucucacac

SEQ ID NO: 572791 - RNA, 64 nt, Homo Sapiens
guucagaaaguuuguuucuccuuaguaugcauuaaaauuguauuauucuaaccaguuaaccagc

SEQ ID NO: 572792 - RNA, 64 nt, Homo Sapiens
uugguuuuugaguuguuuuuucuuaauguaagaaaaauuguauuuuuuuuacaaguaucuucaa

SEQ ID NO: 572793 - RNA, 64 nt, Homo Sapiens
uucuaauaaaacaaagcaaaucacauuuagcuucaaauuguaacaauucaauugaauuuuaaaa

SEQ ID NO: 572794 - RNA, 64 nt, Homo Sapiens
aucaguuauggcacaauaaagauuuucuguuuuuaaauuguauuucaucugcuuccuccccauu

SEQ ID NO: 572795 - RNA, 64 nt, Homo Sapiens
cuguuguguuuuaagauagaaaggaacaagacuaaaauuguaaauacuuuguaaacaucagcau

SEQ ID NO: 572796 - RNA, 64 nt, Homo Sapiens
ugcaauaaacaacaucaaauaaaaaaacuuguuuaaauuguauucaaauuguguacaaacacua

SEQ ID NO: 572797 - RNA, 64 nt, Homo Sapiens
augaauuaggagcauaguuuaaugauguaaugaaaaauuguaccccaaaauaauuuuuagagaa

SEQ ID NO: 572798 - RNA, 64 nt, Homo Sapiens
guaaaugaaagcuauugagauugaagcuuuuuaaaaauuguaaagauaaaauugaaguacuuaa

SEQ ID NO: 572799 - RNA, 64 nt, Homo Sapiens
ccucguaggauguauguugguuggauuuguaauuaaauuguaagaacccuuuuuuccgucaaaa

SEQ ID NO: 572800 - RNA, 64 nt, Homo Sapiens
auuacccucuagcucuaacacugaaaauaauaauaaauuguagaucucugcaacuaaguuuaaa

SEQ ID NO: 572801 - RNA, 64 nt, Homo Sapiens
ugugauuugagacauauacauauguuuguauuauaaauuguaagcaaucaguuugagauacuag

SEQ ID NO: 572802 - RNA, 64 nt, Homo Sapiens
gcaugugacucuuuuggcuucauuuuauuaaucaaaauuguauauauguuaauuuaccaccaua

SEQ ID NO: 572803 - RNA, 64 nt, Homo Sapiens
cguuucagugccuuucuuguugaaaagacuuuuuaaauuguacacucauguauauuuauaguaa

SEQ ID NO: 572804 - RNA, 64 nt, Homo Sapiens
uuuuuagaauguuuuuaugauuguuaaaaaggacaaauuguacauuuuuauguuuuauuauacu

SEQ ID NO: 572805 - RNA, 64 nt, Homo Sapiens
cacuacaaaaugucaaaauauacguugaucucuuaaauuguaaaacagcuauuuaggggaaugu

SEQ ID NO: 572806 - RNA, 64 nt, Homo Sapiens
acuuuuguauauauaaaagcuacuuuaggacauuaaauuguacaauuuuauaaaugaucuuuug

SEQ ID NO: 572807 - RNA, 64 nt, Homo Sapiens
caguuuuuauucuaaccacuuuaugucuuauauuaaauuguauauguuaguugcucacuagagu

SEQ ID NO: 572808 - RNA, 64 nt, Homo Sapiens
acuuggcacaaaauuucuucaguuuauuaucuguaaauuguacaguuuucuuuuugaaaguuuu

SEQ ID NO: 572809 - RNA, 64 nt, Homo Sapiens
ggaaaaaaauaaaugccuuugaaugaaaauucugaaauuguaaaugucuauuuuaauauucacc

SEQ ID NO: 572810 - RNA, 64 nt, Homo Sapiens
uuuuaaacucuucaaauaucaugaacaagauacuaaauuguaccuaaggauuuguauuucuuua

SEQ ID NO: 572811 - RNA, 64 nt, Homo Sapiens
augcagguucuagcugaaaaauucaacuauaagaaaauuguauuuauauaacauuuacuauuuu

SEQ ID NO: 572812 - RNA, 64 nt, Homo Sapiens
aaccauucugggauuugggaacuucuuuaaaggaaaauuguaguagaggucaucuugauggaau

SEQ ID NO: 572813 - RNA, 64 nt, Homo Sapiens
cucugucggcuucugcagaaaaaccaaagcccucaaauuguagugugccucuuuguuuuucccc

SEQ ID NO: 572814 - RNA, 64 nt, Homo Sapiens
ugaauuugugccucuuuguuugaagucauguucuaaauuguauuugagccauugcgcccagccu

SEQ ID NO: 572815 - RNA, 64 nt, Homo Sapiens
uugaacauuggaaauagaugucauguauuuauaaaaauuguauaauauuuuuauaugaauuguu

SEQ ID NO: 572816 - RNA, 64 nt, Homo Sapiens
aaguuccacagguagcagacuggggagaaaaaaaaaauuguaucaauaaagguuauucuaacug

SEQ ID NO: 572817 - RNA, 64 nt, Homo Sapiens
aacauguuuaucguauuugaugcuacaggauuugaaauuguauuacaaauccaaugaaaugagu

SEQ ID NO: 572818 - RNA, 64 nt, Homo Sapiens
gguuuaauaauuuuuaauuauauggcuugaguuuaaauuguaauaggcguaacuaauuuuaacu

SEQ ID NO: 572819 - RNA, 64 nt, Homo Sapiens
gucacaugcugaguaaaagugccuuacaauguaaaaauuguacaguacuuauguucccaaguag

SEQ ID NO: 572820 - RNA, 64 nt, Homo Sapiens
auauuuuguuccuguuauauuggcuuuauuuucaaaauuguaguuuguaguauuaguuuccuuu

SEQ ID NO: 572821 - RNA, 64 nt, Homo Sapiens
auuuaacuuggauuuaggcauugaagaccaguggaaauuguauacagugcagaauuaaaccgug

SEQ ID NO: 572822 - RNA, 64 nt, Homo Sapiens
guaccaugcuuagaacugaguaugaaugcauuaaaaauuguaaaacuuuuccaaugcacuguug

SEQ ID NO: 572823 - RNA, 64 nt, Homo Sapiens
aaguucuauuaaaacuuguaucuauaucgcuaguaaauuguaaugggaggaaaguauuaaaaaa

SEQ ID NO: 572824 - RNA, 64 nt, Homo Sapiens
uuauaacaguagaaaacauaaaauaauugcuggaaaauuguauuucaccauagugauagcccau

SEQ ID NO: 572825 - RNA, 64 nt, Homo Sapiens; identical to SEQ ID NO: 206029

SEQ ID NO: 572826 - RNA, 64 nt, Homo Sapiens; identical to SEQ ID NO: 206030

SEQ ID NO: 572827 - RNA, 64 nt, Homo Sapiens; identical to SEQ ID NO: 206031

SEQ ID NO: 572828 - RNA, 64 nt, Homo Sapiens; identical to SEQ ID NO: 206032

SEQ ID NO: 572829 - RNA, 64 nt, Homo Sapiens; identical to SEQ ID NO: 206033

SEQ ID NO: 572830 - RNA, 64 nt, Homo Sapiens; identical to SEQ ID NO: 206034

SEQ ID NO: 572831 - RNA, 64 nt, Homo Sapiens; identical to SEQ ID NO: 206035

SEQ ID NO: 572832 - RNA, 64 nt, Homo Sapiens; identical to SEQ ID NO: 206036

SEQ ID NO: 572833 - RNA, 64 nt, Homo Sapiens; identical to SEQ ID NO: 206037

SEQ ID NO: 572834 - RNA, 64 nt, Homo Sapiens; identical to SEQ ID NO: 206038

SEQ ID NO: 572835 - RNA, 64 nt, Homo Sapiens; identical to SEQ ID NO: 206039

SEQ ID NO: 572836 - RNA, 64 nt, Homo Sapiens; identical to SEQ ID NO: 206040

SEQ ID NO: 572837 - RNA, 64 nt, Homo Sapiens; identical to SEQ ID NO: 206041

SEQ ID NO: 572838 - RNA, 64 nt, Homo Sapiens; identical to SEQ ID NO: 206042

SEQ ID NO: 572839 - RNA, 64 nt, Homo Sapiens; identical to SEQ ID NO: 206043

SEQ ID NO: 572840 - RNA, 64 nt, Homo Sapiens; identical to SEQ ID NO: 206044

SEQ ID NO: 572841 - RNA, 64 nt, Homo Sapiens; identical to SEQ ID NO: 206045

SEQ ID NO: 572842 - RNA, 64 nt, Homo Sapiens; identical to SEQ ID NO: 206046

SEQ ID NO: 572843 - RNA, 64 nt, Homo Sapiens; identical to SEQ ID NO: 206047

SEQ ID NO: 572844 - RNA, 64 nt, Homo Sapiens; identical to SEQ ID NO: 206048

SEQ ID NO: 572845 - RNA, 64 nt, Homo Sapiens; identical to SEQ ID NO: 206049

SEQ ID NO: 572846 - RNA, 64 nt, Homo Sapiens; identical to SEQ ID NO: 206050

SEQ ID NO: 572847 - RNA, 64 nt, Homo Sapiens; identical to SEQ ID NO: 206051

SEQ ID NO: 572848 - RNA, 64 nt, Homo Sapiens; identical to SEQ ID NO: 206052

SEQ ID NO: 572849 - RNA, 64 nt, Homo Sapiens; identical to SEQ ID NO: 206053

SEQ ID NO: 572850 - RNA, 64 nt, Homo Sapiens; identical to SEQ ID NO: 206054

SEQ ID NO: 572851 - RNA, 64 nt, Homo Sapiens; identical to SEQ ID NO: 206055

SEQ ID NO: 572852 - RNA, 64 nt, Homo Sapiens; identical to SEQ ID NO: 206056

SEQ ID NO: 572853 - RNA, 64 nt, Homo Sapiens; identical to SEQ ID NO: 206057

SEQ ID NO: 572854 - RNA, 64 nt, Homo Sapiens; identical to SEQ ID NO: 206058

SEQ ID NO: 572855 - RNA, 64 nt, Homo Sapiens; identical to SEQ ID NO: 206059

SEQ ID NO: 572856 - RNA, 64 nt, Homo Sapiens; identical to SEQ ID NO: 206060

SEQ ID NO: 572857 - RNA, 64 nt, Homo Sapiens; identical to SEQ ID NO: 206061

SEQ ID NO: 572858 - RNA, 64 nt, Homo Sapiens; identical to SEQ ID NO: 206062

SEQ ID NO: 572859 - RNA, 64 nt, Homo Sapiens; identical to SEQ ID NO: 206063

SEQ ID NO: 572860 - RNA, 64 nt, Homo Sapiens; identical to SEQ ID NO: 206064

SEQ ID NO: 572861 - RNA, 64 nt, Homo Sapiens; identical to SEQ ID NO: 206065

SEQ ID NO: 572862 - RNA, 64 nt, Homo Sapiens; identical to SEQ ID NO: 206066

SEQ ID NO: 572863 - RNA, 64 nt, Homo Sapiens; identical to SEQ ID NO: 206067

SEQ ID NO: 572864 - RNA, 64 nt, Homo Sapiens; identical to SEQ ID NO: 206068

SEQ ID NO: 572865 - RNA, 64 nt, Homo Sapiens; identical to SEQ ID NO: 206069

SEQ ID NO: 572866 - RNA, 64 nt, Homo Sapiens; identical to SEQ ID NO: 206070

SEQ ID NO: 572867 - RNA, 64 nt, Homo Sapiens; identical to SEQ ID NO: 206071

SEQ ID NO: 572868 - RNA, 64 nt, Homo Sapiens; identical to SEQ ID NO: 206072

SEQ ID NO: 572869 - RNA, 64 nt, Homo Sapiens; identical to SEQ ID NO: 206073

SEQ ID NO: 572870 - RNA, 64 nt, Homo Sapiens; identical to SEQ ID NO: 206074

SEQ ID NO: 572871 - RNA, 64 nt, Homo Sapiens; identical to SEQ ID NO: 206075

SEQ ID NO: 572872 - RNA, 64 nt, Homo Sapiens; identical to SEQ ID NO: 206076

SEQ ID NO: 572873 - RNA, 64 nt, Homo Sapiens; identical to SEQ ID NO: 206077

SEQ ID NO: 572874 - RNA, 64 nt, Homo Sapiens; identical to SEQ ID NO: 206078

SEQ ID NO: 572875 - RNA, 64 nt, Homo Sapiens
ucguaucugaguguaacuuugccaauauuuuaaaagccaaaauauucucuggacaacaaauuug

SEQ ID NO: 572876 - RNA, 64 nt, Homo Sapiens
auuugcucaaagucacagagaaaauuaguggcaaagccaaaaagauucagaucuucugacucga

SEQ ID NO: 572877 - RNA, 64 nt, Homo Sapiens
cuuuuaugcugaugaugguauuuggagaugugaaagccaaaagccccuggcagugguggggaau

SEQ ID NO: 572878 - RNA, 64 nt, Homo Sapiens
ggagcagcuguggcuguuacauaaauagagaugcagccaaaauuuuaggccuuuuauccugcuu

SEQ ID NO: 572879 - RNA, 64 nt, Homo Sapiens
gaauagguuuuuuuaauuuuuuaagcuaaacacaagccaaaaauccuuaauuuaaugauaaaau

SEQ ID NO: 572880 - RNA, 64 nt, Homo Sapiens
uucuucacgcaggggcuugguagguugaaauagcagccaaaacagaggucaaacguuguuuccu

SEQ ID NO: 572881 - RNA, 64 nt, Homo Sapiens
uggaccaggaugaagagggaucaaagagauaauuagccaaaaacccaguagccuagaagauaca

SEQ ID NO: 572882 - RNA, 64 nt, Homo Sapiens
uguugagaaugaguaccacucucaccauugguauagccaaaaaagcuuggaagugaccaaggcu

SEQ ID NO: 572883 - RNA, 64 nt, Homo Sapiens
aauauacuuuggcacuuuuucauaggcccuaaagagccaaaauaugaguaauugugacauggac

SEQ ID NO: 572884 - RNA, 64 nt, Homo Sapiens
uaaagaucaaccauuuauccucuuagcacgcaaaagccaaaaucgguuuguauaccacaagccc

SEQ ID NO: 572885 - RNA, 64 nt, Homo Sapiens
aauagcaaagaauugacuggggcaauaacguuuaagccaaaacaauguuuaaaccuuuuuuggg

SEQ ID NO: 572886 - RNA, 64 nt, Homo Sapiens
uuacuauuucacaacagccugacaacauuucuauagccaaaaauagcuaaauaccucaaucagu

SEQ ID NO: 572887 - RNA, 64 nt, Homo Sapiens
gaauaccugucugccauguauuucaaucuuagugagccaaaauuguuuguuuguuacuacagaa

SEQ ID NO: 572888 - RNA, 64 nt, Homo Sapiens
ccggaaguaaaucuauaucuguuagaaauaauguagccaaaagaauguaaauuugaggauuuuu

SEQ ID NO: 572889 - RNA, 64 nt, Homo Sapiens
cuacauucuuacugguuuacauuaaaauccuuuaagccaaaaggaagcuugcucuauggauuua

SEQ ID NO: 572890 - RNA, 64 nt, Homo Sapiens
uugccauagugcuguauuugaaaaucgaugcuuuagccaaaagcugaaugaccaccguuuccgu

SEQ ID NO: 572891 - RNA, 64 nt, Homo Sapiens
cugaucagaauucacuuuuuucgccaaauagcugagccaaaaggagagguuuuuuaaaagacug

SEQ ID NO: 572892 - RNA, 64 nt, Homo Sapiens
gaccaaggcuauucagcagucuaaaauaggagagagccaaaacuaaacaaaaauauuuuucccc

SEQ ID NO: 572893 - RNA, 64 nt, Homo Sapiens
cucuuuucagacacagcgguuuuuguuuccaagaagccaaaauuguuuagaauuugcuucccau

SEQ ID NO: 572894 - RNA, 64 nt, Homo Sapiens
ugagugcuuguaacaaaauaaacaacaaaaacaaagccaaaaacuaccuuuauccauaugugaa

SEQ ID NO: 572895 - RNA, 64 nt, Homo Sapiens
agagauaaaauuaauaauagaucuuugugcguagagccaaaaaauaaguucaucuuugaaauac

SEQ ID NO: 572896 - RNA, 64 nt, Homo Sapiens
acugguuauaugccucccuuuccugucauauuuuagccaaaacaauagaacccaaggaaugccu

SEQ ID NO: 572897 - RNA, 64 nt, Homo Sapiens
ugagugguugaauaugauuacuaugacuuaacauagccaaaaugcaguaagggaacaaguugag

SEQ ID NO: 572898 - RNA, 64 nt, Homo Sapiens
aagguguuugaaaauaguuuacuuguugccuauaagccaaaauuuuuuuugaacucuucucauu

SEQ ID NO: 572899 - RNA, 64 nt, Homo Sapiens
uuuagaaacacucagucucucagcaccucaguccagccaaaauggccuucauggagggugguaa

SEQ ID NO: 572900 - RNA, 64 nt, Homo Sapiens
cugacagcagggucugcccuggccuccugacaccagccaaaaucagggaucccugcacccagga

SEQ ID NO: 572901 - RNA, 64 nt, Homo Sapiens; identical to SEQ ID NO: 171556

SEQ ID NO: 572902 - RNA, 64 nt, Homo Sapiens; identical to SEQ ID NO: 171557

SEQ ID NO: 572903 - RNA, 64 nt, Homo Sapiens; identical to SEQ ID NO: 171558

SEQ ID NO: 572904 - RNA, 64 nt, Homo Sapiens; identical to SEQ ID NO: 171559

SEQ ID NO: 572905 - RNA, 64 nt, Homo Sapiens; identical to SEQ ID NO: 171560

SEQ ID NO: 572906 - RNA, 64 nt, Homo Sapiens; identical to SEQ ID NO: 171561

SEQ ID NO: 572907 - RNA, 64 nt, Homo Sapiens; identical to SEQ ID NO: 171562

SEQ ID NO: 572908 - RNA, 64 nt, Homo Sapiens; identical to SEQ ID NO: 171563

SEQ ID NO: 572909 - RNA, 64 nt, Homo Sapiens; identical to SEQ ID NO: 171564

SEQ ID NO: 572910 - RNA, 64 nt, Homo Sapiens; identical to SEQ ID NO: 171565

SEQ ID NO: 572911 - RNA, 64 nt, Homo Sapiens; identical to SEQ ID NO: 171566

SEQ ID NO: 572912 - RNA, 64 nt, Homo Sapiens; identical to SEQ ID NO: 171567

SEQ ID NO: 572913 - RNA, 64 nt, Homo Sapiens; identical to SEQ ID NO: 171568

SEQ ID NO: 572914 - RNA, 64 nt, Homo Sapiens; identical to SEQ ID NO: 171569

SEQ ID NO: 572915 - RNA, 64 nt, Homo Sapiens; identical to SEQ ID NO: 171570

SEQ ID NO: 572916 - RNA, 64 nt, Homo Sapiens; identical to SEQ ID NO: 171571

SEQ ID NO: 572917 - RNA, 64 nt, Homo Sapiens; identical to SEQ ID NO: 171572

SEQ ID NO: 572918 - RNA, 64 nt, Homo Sapiens; identical to SEQ ID NO: 171573

SEQ ID NO: 572919 - RNA, 64 nt, Homo Sapiens; identical to SEQ ID NO: 171574

SEQ ID NO: 572920 - RNA, 64 nt, Homo Sapiens; identical to SEQ ID NO: 171575

SEQ ID NO: 572921 - RNA, 64 nt, Homo Sapiens; identical to SEQ ID NO: 171576

SEQ ID NO: 572922 - RNA, 64 nt, Homo Sapiens; identical to SEQ ID NO: 171577

SEQ ID NO: 572923 - RNA, 64 nt, Homo Sapiens; identical to SEQ ID NO: 171578

SEQ ID NO: 572924 - RNA, 64 nt, Homo Sapiens; identical to SEQ ID NO: 171579

SEQ ID NO: 572925 - RNA, 64 nt, Homo Sapiens; identical to SEQ ID NO: 171580

SEQ ID NO: 572926 - RNA, 64 nt, Homo Sapiens; identical to SEQ ID NO: 171581

SEQ ID NO: 572927 - RNA, 64 nt, Homo Sapiens; identical to SEQ ID NO: 171582

SEQ ID NO: 572928 - RNA, 64 nt, Homo Sapiens; identical to SEQ ID NO: 171583

SEQ ID NO: 572929 - RNA, 64 nt, Homo Sapiens; identical to SEQ ID NO: 171584

SEQ ID NO: 572930 - RNA, 64 nt, Homo Sapiens; identical to SEQ ID NO: 171585

SEQ ID NO: 572931 - RNA, 64 nt, Homo Sapiens; identical to SEQ ID NO: 171586

SEQ ID NO: 572932 - RNA, 64 nt, Homo Sapiens; identical to SEQ ID NO: 171587

SEQ ID NO: 572933 - RNA, 64 nt, Homo Sapiens; identical to SEQ ID NO: 171588

SEQ ID NO: 572934 - RNA, 64 nt, Homo Sapiens; identical to SEQ ID NO: 171589

SEQ ID NO: 572935 - RNA, 64 nt, Homo Sapiens; identical to SEQ ID NO: 171590

SEQ ID NO: 572936 - RNA, 64 nt, Homo Sapiens; identical to SEQ ID NO: 171591

SEQ ID NO: 572937 - RNA, 64 nt, Homo Sapiens; identical to SEQ ID NO: 171592

SEQ ID NO: 572938 - RNA, 64 nt, Homo Sapiens; identical to SEQ ID NO: 171593

SEQ ID NO: 572939 - RNA, 64 nt, Homo Sapiens; identical to SEQ ID NO: 171594

SEQ ID NO: 572940 - RNA, 64 nt, Homo Sapiens; identical to SEQ ID NO: 171595

SEQ ID NO: 572941 - RNA, 64 nt, Homo Sapiens; identical to SEQ ID NO: 171596

SEQ ID NO: 572942 - RNA, 64 nt, Homo Sapiens; identical to SEQ ID NO: 171597

SEQ ID NO: 572943 - RNA, 64 nt, Homo Sapiens; identical to SEQ ID NO: 171598

SEQ ID NO: 572944 - RNA, 64 nt, Homo Sapiens; identical to SEQ ID NO: 171599

SEQ ID NO: 572945 - RNA, 64 nt, Homo Sapiens; identical to SEQ ID NO: 171600

SEQ ID NO: 572946 - RNA, 64 nt, Homo Sapiens; identical to SEQ ID NO: 171601

SEQ ID NO: 572947 - RNA, 64 nt, Homo Sapiens; identical to SEQ ID NO: 171602

SEQ ID NO: 572948 - RNA, 64 nt, Homo Sapiens; identical to SEQ ID NO: 171603

SEQ ID NO: 572949 - RNA, 64 nt, Homo Sapiens; identical to SEQ ID NO: 171604

SEQ ID NO: 572950 - RNA, 64 nt, Homo Sapiens; identical to SEQ ID NO: 171605

SEQ ID NO: 572951 - RNA, 64 nt, Homo Sapiens; identical to SEQ ID NO: 171606

SEQ ID NO: 572952 - RNA, 64 nt, Homo Sapiens; identical to SEQ ID NO: 171607

SEQ ID NO: 572953 - RNA, 64 nt, Homo Sapiens; identical to SEQ ID NO: 171608

SEQ ID NO: 572954 - RNA, 64 nt, Homo Sapiens; identical to SEQ ID NO: 171609

SEQ ID NO: 572955 - RNA, 64 nt, Homo Sapiens; identical to SEQ ID NO: 171610

SEQ ID NO: 572956 - RNA, 64 nt, Homo Sapiens; identical to SEQ ID NO: 171611

SEQ ID NO: 572957 - RNA, 64 nt, Homo Sapiens; identical to SEQ ID NO: 171612

SEQ ID NO: 572958 - RNA, 64 nt, Homo Sapiens; identical to SEQ ID NO: 171613

SEQ ID NO: 572959 - RNA, 64 nt, Homo Sapiens; identical to SEQ ID NO: 171614

SEQ ID NO: 572960 - RNA, 64 nt, Homo Sapiens; identical to SEQ ID NO: 171615

SEQ ID NO: 572961 - RNA, 64 nt, Homo Sapiens; identical to SEQ ID NO: 171616

SEQ ID NO: 572962 - RNA, 64 nt, Homo Sapiens; identical to SEQ ID NO: 171617

SEQ ID NO: 572963 - RNA, 64 nt, Homo Sapiens; identical to SEQ ID NO: 171618

SEQ ID NO: 572964 - RNA, 64 nt, Homo Sapiens; identical to SEQ ID NO: 171619

SEQ ID NO: 572965 - RNA, 64 nt, Homo Sapiens; identical to SEQ ID NO: 171620

SEQ ID NO: 572966 - RNA, 64 nt, Homo Sapiens; identical to SEQ ID NO: 171621

SEQ ID NO: 572967 - RNA, 64 nt, Homo Sapiens; identical to SEQ ID NO: 171622

SEQ ID NO: 572968 - RNA, 64 nt, Homo Sapiens; identical to SEQ ID NO: 171623

SEQ ID NO: 572969 - RNA, 64 nt, Homo Sapiens; identical to SEQ ID NO: 171624

SEQ ID NO: 572970 - RNA, 64 nt, Homo Sapiens; identical to SEQ ID NO: 171625

SEQ ID NO: 572971 - RNA, 64 nt, Homo Sapiens; identical to SEQ ID NO: 171626

SEQ ID NO: 572972 - RNA, 64 nt, Homo Sapiens; identical to SEQ ID NO: 171627

SEQ ID NO: 572973 - RNA, 64 nt, Homo Sapiens; identical to SEQ ID NO: 171628

SEQ ID NO: 572974 - RNA, 64 nt, Homo Sapiens; identical to SEQ ID NO: 235822

SEQ ID NO: 572975 - RNA, 64 nt, Homo Sapiens; identical to SEQ ID NO: 235823

SEQ ID NO: 572976 - RNA, 64 nt, Homo Sapiens; identical to SEQ ID NO: 235824

SEQ ID NO: 572977 - RNA, 64 nt, Homo Sapiens; identical to SEQ ID NO: 235825

SEQ ID NO: 572978 - RNA, 64 nt, Homo Sapiens; identical to SEQ ID NO: 235826

SEQ ID NO: 572979 - RNA, 64 nt, Homo Sapiens; identical to SEQ ID NO: 235827

SEQ ID NO: 572980 - RNA, 64 nt, Homo Sapiens; identical to SEQ ID NO: 235828

SEQ ID NO: 572981 - RNA, 64 nt, Homo Sapiens; identical to SEQ ID NO: 235829

SEQ ID NO: 572982 - RNA, 64 nt, Homo Sapiens; identical to SEQ ID NO: 235830

SEQ ID NO: 572983 - RNA, 64 nt, Homo Sapiens; identical to SEQ ID NO: 235831

SEQ ID NO: 572984 - RNA, 64 nt, Homo Sapiens; identical to SEQ ID NO: 235832

SEQ ID NO: 572985 - RNA, 64 nt, Homo Sapiens; identical to SEQ ID NO: 235833

SEQ ID NO: 572986 - RNA, 64 nt, Homo Sapiens; identical to SEQ ID NO: 235834

SEQ ID NO: 572987 - RNA, 64 nt, Homo Sapiens; identical to SEQ ID NO: 235835

SEQ ID NO: 572988 - RNA, 64 nt, Homo Sapiens; identical to SEQ ID NO: 235836

SEQ ID NO: 572989 - RNA, 64 nt, Homo Sapiens; identical to SEQ ID NO: 235837

SEQ ID NO: 572990 - RNA, 64 nt, Homo Sapiens; identical to SEQ ID NO: 235838

SEQ ID NO: 572991 - RNA, 64 nt, Homo Sapiens; identical to SEQ ID NO: 235839

SEQ ID NO: 572992 - RNA, 64 nt, Homo Sapiens; identical to SEQ ID NO: 235840

SEQ ID NO: 572993 - RNA, 64 nt, Homo Sapiens; identical to SEQ ID NO: 235841

SEQ ID NO: 572994 - RNA, 64 nt, Homo Sapiens; identical to SEQ ID NO: 235842

SEQ ID NO: 572995 - RNA, 64 nt, Homo Sapiens; identical to SEQ ID NO: 235843

SEQ ID NO: 572996 - RNA, 64 nt, Homo Sapiens; identical to SEQ ID NO: 235844

SEQ ID NO: 572997 - RNA, 64 nt, Homo Sapiens; identical to SEQ ID NO: 235845

SEQ ID NO: 572998 - RNA, 55 nt, Homo Sapiens; identical to SEQ ID NO: 235846

SEQ ID NO: 572999 - RNA, 64 nt, Homo Sapiens; identical to SEQ ID NO: 235847

SEQ ID NO: 573000 - RNA, 64 nt, Homo Sapiens; identical to SEQ ID NO: 235848

SEQ ID NO: 573001 - RNA, 64 nt, Homo Sapiens; identical to SEQ ID NO: 235849

SEQ ID NO: 573002 - RNA, 64 nt, Homo Sapiens; identical to SEQ ID NO: 235850

SEQ ID NO: 573003 - RNA, 64 nt, Homo Sapiens; identical to SEQ ID NO: 235851

SEQ ID NO: 573004 - RNA, 64 nt, Homo Sapiens; identical to SEQ ID NO: 235852

SEQ ID NO: 573005 - RNA, 64 nt, Homo Sapiens; identical to SEQ ID NO: 235853

SEQ ID NO: 573006 - RNA, 64 nt, Homo Sapiens; identical to SEQ ID NO: 235854

SEQ ID NO: 573007 - RNA, 64 nt, Homo Sapiens; identical to SEQ ID NO: 235855

SEQ ID NO: 573008 - RNA, 64 nt, Homo Sapiens; identical to SEQ ID NO: 235856

SEQ ID NO: 573009 - RNA, 64 nt, Homo Sapiens; identical to SEQ ID NO: 235857

SEQ ID NO: 573010 - RNA, 64 nt, Homo Sapiens; identical to SEQ ID NO: 235858

SEQ ID NO: 573011 - RNA, 64 nt, Homo Sapiens; identical to SEQ ID NO: 235859

SEQ ID NO: 573012 - RNA, 64 nt, Homo Sapiens; identical to SEQ ID NO: 235860

SEQ ID NO: 573013 - RNA, 64 nt, Homo Sapiens; identical to SEQ ID NO: 235861

SEQ ID NO: 573014 - RNA, 64 nt, Homo Sapiens; identical to SEQ ID NO: 235862

SEQ ID NO: 573015 - RNA, 64 nt, Homo Sapiens; identical to SEQ ID NO: 235863

SEQ ID NO: 573016 - RNA, 64 nt, Homo Sapiens; identical to SEQ ID NO: 235864

SEQ ID NO: 573017 - RNA, 64 nt, Homo Sapiens; identical to SEQ ID NO: 235865

SEQ ID NO: 573018 - RNA, 64 nt, Homo Sapiens; identical to SEQ ID NO: 235866

SEQ ID NO: 573019 - RNA, 64 nt, Homo Sapiens; identical to SEQ ID NO: 235867

SEQ ID NO: 573020 - RNA, 64 nt, Homo Sapiens; identical to SEQ ID NO: 235868

SEQ ID NO: 573021 - RNA, 64 nt, Homo Sapiens; identical to SEQ ID NO: 235869

SEQ ID NO: 573022 - RNA, 64 nt, Homo Sapiens; identical to SEQ ID NO: 235870

SEQ ID NO: 573023 - RNA, 64 nt, Homo Sapiens; identical to SEQ ID NO: 235871

SEQ ID NO: 573024 - RNA, 64 nt, Homo Sapiens; identical to SEQ ID NO: 235872

SEQ ID NO: 573025 - RNA, 64 nt, Homo Sapiens; identical to SEQ ID NO: 235873

SEQ ID NO: 573026 - RNA, 64 nt, Homo Sapiens; identical to SEQ ID NO: 235874

SEQ ID NO: 573027 - RNA, 64 nt, Homo Sapiens; identical to SEQ ID NO: 235875

SEQ ID NO: 573028 - RNA, 64 nt, Homo Sapiens; identical to SEQ ID NO: 235876

SEQ ID NO: 573029 - RNA, 64 nt, Homo Sapiens; identical to SEQ ID NO: 235877

SEQ ID NO: 573030 - RNA, 64 nt, Homo Sapiens; identical to SEQ ID NO: 235878

SEQ ID NO: 573031 - RNA, 64 nt, Homo Sapiens; identical to SEQ ID NO: 235879

SEQ ID NO: 573032 - RNA, 64 nt, Homo Sapiens; identical to SEQ ID NO: 235880

SEQ ID NO: 573033 - RNA, 64 nt, Homo Sapiens; identical to SEQ ID NO: 235881

SEQ ID NO: 573034 - RNA, 64 nt, Homo Sapiens; identical to SEQ ID NO: 235882

SEQ ID NO: 573035 - RNA, 64 nt, Homo Sapiens; identical to SEQ ID NO: 235883

SEQ ID NO: 573036 - RNA, 64 nt, Homo Sapiens; identical to SEQ ID NO: 235884

SEQ ID NO: 573037 - RNA, 64 nt, Homo Sapiens; identical to SEQ ID NO: 235885

SEQ ID NO: 573038 - RNA, 64 nt, Homo Sapiens; identical to SEQ ID NO: 235886

SEQ ID NO: 573039 - RNA, 64 nt, Homo Sapiens; identical to SEQ ID NO: 310683

SEQ ID NO: 573040 - RNA, 64 nt, Homo Sapiens; identical to SEQ ID NO: 310684

SEQ ID NO: 573041 - RNA, 64 nt, Homo Sapiens; identical to SEQ ID NO: 246269

SEQ ID NO: 573042 - RNA, 64 nt, Homo Sapiens; identical to SEQ ID NO: 246270

SEQ ID NO: 573043 - RNA, 64 nt, Homo Sapiens; identical to SEQ ID NO: 246271

SEQ ID NO: 573044 - RNA, 64 nt, Homo Sapiens; identical to SEQ ID NO: 246272

SEQ ID NO: 573045 - RNA, 64 nt, Homo Sapiens; identical to SEQ ID NO: 246273

SEQ ID NO: 573046 - RNA, 64 nt, Homo Sapiens; identical to SEQ ID NO: 246274

SEQ ID NO: 573047 - RNA, 64 nt, Homo Sapiens; identical to SEQ ID NO: 246275

SEQ ID NO: 573048 - RNA, 64 nt, Homo Sapiens; identical to SEQ ID NO: 246276

SEQ ID NO: 573049 - RNA, 51 nt, Homo Sapiens; identical to SEQ ID NO: 246277

SEQ ID NO: 573050 - RNA, 64 nt, Homo Sapiens; identical to SEQ ID NO: 246278

SEQ ID NO: 573051 - RNA, 64 nt, Homo Sapiens; identical to SEQ ID NO: 246279

SEQ ID NO: 573052 - RNA, 56 nt, Homo Sapiens; identical to SEQ ID NO: 246280

SEQ ID NO: 573053 - RNA, 64 nt, Homo Sapiens; identical to SEQ ID NO: 246281

SEQ ID NO: 573054 - RNA, 64 nt, Homo Sapiens; identical to SEQ ID NO: 246282

SEQ ID NO: 573055 - RNA, 64 nt, Homo Sapiens; identical to SEQ ID NO: 246283

SEQ ID NO: 573056 - RNA, 64 nt, Homo Sapiens; identical to SEQ ID NO: 246284

SEQ ID NO: 573057 - RNA, 64 nt, Homo Sapiens; identical to SEQ ID NO: 246285

SEQ ID NO: 573058 - RNA, 64 nt, Homo Sapiens; identical to SEQ ID NO: 246286

SEQ ID NO: 573059 - RNA, 64 nt, Homo Sapiens; identical to SEQ ID NO: 246287

SEQ ID NO: 573060 - RNA, 64 nt, Homo Sapiens; identical to SEQ ID NO: 246288

SEQ ID NO: 573061 - RNA, 64 nt, Homo Sapiens; identical to SEQ ID NO: 246289

SEQ ID NO: 573062 - RNA, 64 nt, Homo Sapiens; identical to SEQ ID NO: 246290

SEQ ID NO: 573063 - RNA, 64 nt, Homo Sapiens; identical to SEQ ID NO: 246291

SEQ ID NO: 573064 - RNA, 64 nt, Homo Sapiens; identical to SEQ ID NO: 246292

SEQ ID NO: 573065 - RNA, 64 nt, Homo Sapiens; identical to SEQ ID NO: 246293

SEQ ID NO: 573066 - RNA, 64 nt, Homo Sapiens; identical to SEQ ID NO: 246294

SEQ ID NO: 573067 - RNA, 64 nt, Homo Sapiens; identical to SEQ ID NO: 246295

SEQ ID NO: 573068 - RNA, 64 nt, Homo Sapiens; identical to SEQ ID NO: 246296

SEQ ID NO: 573069 - RNA, 64 nt, Homo Sapiens; identical to SEQ ID NO: 246297

SEQ ID NO: 573070 - RNA, 64 nt, Homo Sapiens; identical to SEQ ID NO: 246298

SEQ ID NO: 573071 - RNA, 64 nt, Homo Sapiens; identical to SEQ ID NO: 246299

SEQ ID NO: 573072 - RNA, 64 nt, Homo Sapiens; identical to SEQ ID NO: 246300

SEQ ID NO: 573073 - RNA, 64 nt, Homo Sapiens; identical to SEQ ID NO: 246301

SEQ ID NO: 573074 - RNA, 64 nt, Homo Sapiens
cggacgggccugugccguggggaagcagacacaacccaaacauuugcuacuaacauaggaaaca

SEQ ID NO: 573075 - RNA, 64 nt, Homo Sapiens
agcauauuguggauuggaaaggcugcgacagccccccaaacaggaaagacaaaaaacaaacaaa

SEQ ID NO: 573076 - RNA, 64 nt, Homo Sapiens
acaccaagcagaauucugcauggugacagucucccccaaacauggccugcugggcccaagugag

SEQ ID NO: 573077 - RNA, 64 nt, Homo Sapiens
agccagccaaggccgcuguggccuucagggucuccccaaacagugggcugcuagaagcacgauc

SEQ ID NO: 573078 - RNA, 64 nt, Homo Sapiens
gugguagagaagaugaggguuaacuuuagccuuucccaaacacuggcaacaaccacuuccucaa

SEQ ID NO: 573079 - RNA, 64 nt, Homo Sapiens
ccaguuuccaacacacucaagagagagccccaaccccaaacacagaguuucauggaaaccccac

SEQ ID NO: 573080 - RNA, 64 nt, Homo Sapiens
uuccugaaaauaacauucccuuaauuauuuuaaucccaaacaucugugaauuuccaguuuuuuu

SEQ ID NO: 573081 - RNA, 64 nt, Homo Sapiens
ccacaggucccaugcccacuccuagcauaaauuucccaaacagugcagccuccucgugauccuc

SEQ ID NO: 573082 - RNA, 64 nt, Homo Sapiens
auguggucuacaucucagccuuccugaccucugccccaaacacacgcugcaauuuugucuccuc

SEQ ID NO: 573083 - RNA, 64 nt, Homo Sapiens
augaaaagauaggacggaugugauaugaaaaaaacccaaacauuuuggcauugaaugauggcua

SEQ ID NO: 573084 - RNA, 64 nt, Homo Sapiens
aaucugaaaggccgggauaaaccuaaucacuguucccaaacauugacaaauccuaacccaacca

SEQ ID NO: 573085 - RNA, 64 nt, Homo Sapiens
ggaacacaugagguuagggacccuuguucagcaccccaaacagccugccuguuuaaagcaggca

SEQ ID NO: 573086 - RNA, 64 nt, Homo Sapiens
agagaauaaagccuugauacacuuaacaauggaacccaaacagagcugcugucuauuucugugc

SEQ ID NO: 573087 - RNA, 64 nt, Homo Sapiens
aauagaaaggcauauguauacuggugcaaagugccccaaacagcgaugauugcguagauguugc

SEQ ID NO: 573088 - RNA, 61 nt, Homo Sapiens
cgagugauaauacaguuuuacugcaaaagaagcacuucaaaccuauuauguccuuagaacu

SEQ ID NO: 573089 - RNA, 61 nt, Homo Sapiens
cgaaugucaaaaacaaaugcgacaaacaauggcacuucaucauuuaaaguaauguugccaa

SEQ ID NO: 573090 - RNA, 61 nt, Homo Sapiens
cucguggccuagcacugguguugagcaaugugcacuucacuggagagaaagaacuggaauu

SEQ ID NO: 573091 - RNA, 61 nt, Homo Sapiens
cuuacuauucccacuuucauucaaucaaccugcacuucauaucuagauuucuagaaaagcu

SEQ ID NO: 573092 - RNA, 61 nt, Homo Sapiens
ccugggaaccuggucugauuccuuccaacgugcacuucagcuggagaaagaaaccaagaag

SEQ ID NO: 573093 - RNA, 61 nt, Homo Sapiens
gcucuucuuuuuaggaaggcucuggugcagagcacuucaaauauguccucaggccagauac

SEQ ID NO: 573094 - RNA, 64 nt, Homo Sapiens
cccagggcgggagcccauacccgguccugcccgagcucaacaauccuaggggcggaaagaagac

SEQ ID NO: 573095 - RNA, 64 nt, Homo Sapiens
cccccucuccauuguuuccagcauggagaccccagcucaacacgaccucccucuccccaacgag

SEQ ID NO: 573096 - RNA, 64 nt, Homo Sapiens
cacugccccucagcaaggaugacucagcacugccgcucaacagacaugacucagggauggcuua

SEQ ID NO: 573097 - RNA, 64 nt, Homo Sapiens
cacugccccucagcaaggaugacucagcacugccgcucaacagggaugacucagggauggcuua

SEQ ID NO: 573098 - RNA, 64 nt, Homo Sapiens; identical to SEQ ID NO: 573096

SEQ ID NO: 573099 - RNA, 64 nt, Homo Sapiens
cacugccccucaccaaggaugacucagcacugccgcucaacagacaugacucagggauggcuua

SEQ ID NO: 573100 - RNA, 64 nt, Homo Sapiens; identical to SEQ ID NO: 83678

SEQ ID NO: 573101 - RNA, 64 nt, Homo Sapiens; identical to SEQ ID NO: 83679

SEQ ID NO: 573102 - RNA, 64 nt, Homo Sapiens; identical to SEQ ID NO: 83680

SEQ ID NO: 573103 - RNA, 64 nt, Homo Sapiens; identical to SEQ ID NO: 83681

SEQ ID NO: 573104 - RNA, 64 nt, Homo Sapiens; identical to SEQ ID NO: 83682

SEQ ID NO: 573105 - RNA, 64 nt, Homo Sapiens; identical to SEQ ID NO: 83683

SEQ ID NO: 573106 - RNA, 64 nt, Homo Sapiens; identical to SEQ ID NO: 83684

SEQ ID NO: 573107 - RNA, 64 nt, Homo Sapiens; identical to SEQ ID NO: 83685

SEQ ID NO: 573108 - RNA, 64 nt, Homo Sapiens; identical to SEQ ID NO: 83686

SEQ ID NO: 573109 - RNA, 64 nt, Homo Sapiens; identical to SEQ ID NO: 83687

SEQ ID NO: 573110 - RNA, 64 nt, Homo Sapiens; identical to SEQ ID NO: 83688

SEQ ID NO: 573111 - RNA, 64 nt, Homo Sapiens; identical to SEQ ID NO: 83689

SEQ ID NO: 573112 - RNA, 64 nt, Homo Sapiens; identical to SEQ ID NO: 83690

SEQ ID NO: 573113 - RNA, 64 nt, Homo Sapiens; identical to SEQ ID NO: 83691

SEQ ID NO: 573114 - RNA, 64 nt, Homo Sapiens; identical to SEQ ID NO: 83692

SEQ ID NO: 573115 - RNA, 64 nt, Homo Sapiens; identical to SEQ ID NO: 83693

SEQ ID NO: 573116 - RNA, 64 nt, Homo Sapiens; identical to SEQ ID NO: 83694

SEQ ID NO: 573117 - RNA, 64 nt, Homo Sapiens; identical to SEQ ID NO: 83695

SEQ ID NO: 573118 - RNA, 64 nt, Homo Sapiens; identical to SEQ ID NO: 83696

SEQ ID NO: 573119 - RNA, 64 nt, Homo Sapiens; identical to SEQ ID NO: 83697

SEQ ID NO: 573120 - RNA, 64 nt, Homo Sapiens; identical to SEQ ID NO: 83698

SEQ ID NO: 573121 - RNA, 64 nt, Homo Sapiens; identical to SEQ ID NO: 83699

SEQ ID NO: 573122 - RNA, 64 nt, Homo Sapiens; identical to SEQ ID NO: 83700

SEQ ID NO: 573123 - RNA, 64 nt, Homo Sapiens; identical to SEQ ID NO: 83701

SEQ ID NO: 573124 - RNA, 64 nt, Homo Sapiens; identical to SEQ ID NO: 83702

SEQ ID NO: 573125 - RNA, 64 nt, Homo Sapiens; identical to SEQ ID NO: 83703

SEQ ID NO: 573126 - RNA, 64 nt, Homo Sapiens; identical to SEQ ID NO: 83704

SEQ ID NO: 573127 - RNA, 64 nt, Homo Sapiens; identical to SEQ ID NO: 83705

SEQ ID NO: 573128 - RNA, 64 nt, Homo Sapiens; identical to SEQ ID NO: 83706

SEQ ID NO: 573129 - RNA, 64 nt, Homo Sapiens; identical to SEQ ID NO: 83707

SEQ ID NO: 573130 - RNA, 64 nt, Homo Sapiens; identical to SEQ ID NO: 83708

SEQ ID NO: 573131 - RNA, 64 nt, Homo Sapiens; identical to SEQ ID NO: 83709

SEQ ID NO: 573132 - RNA, 64 nt, Homo Sapiens; identical to SEQ ID NO: 83710

SEQ ID NO: 573133 - RNA, 64 nt, Homo Sapiens; identical to SEQ ID NO: 83711

SEQ ID NO: 573134 - RNA, 64 nt, Homo Sapiens; identical to SEQ ID NO: 83712

SEQ ID NO: 573135 - RNA, 64 nt, Homo Sapiens; identical to SEQ ID NO: 83713

SEQ ID NO: 573136 - RNA, 64 nt, Homo Sapiens; identical to SEQ ID NO: 83714

SEQ ID NO: 573137 - RNA, 64 nt, Homo Sapiens; identical to SEQ ID NO: 83715

SEQ ID NO: 573138 - RNA, 64 nt, Homo Sapiens; identical to SEQ ID NO: 83716

SEQ ID NO: 573139 - RNA, 64 nt, Homo Sapiens; identical to SEQ ID NO: 83717

SEQ ID NO: 573140 - RNA, 64 nt, Homo Sapiens; identical to SEQ ID NO: 83718

SEQ ID NO: 573141 - RNA, 64 nt, Homo Sapiens; identical to SEQ ID NO: 83719

SEQ ID NO: 573142 - RNA, 64 nt, Homo Sapiens; identical to SEQ ID NO: 83720

SEQ ID NO: 573143 - RNA, 64 nt, Homo Sapiens; identical to SEQ ID NO: 83721

SEQ ID NO: 573144 - RNA, 64 nt, Homo Sapiens; identical to SEQ ID NO: 83722

SEQ ID NO: 573145 - RNA, 64 nt, Homo Sapiens; identical to SEQ ID NO: 83723

SEQ ID NO: 573146 - RNA, 64 nt, Homo Sapiens; identical to SEQ ID NO: 83724

SEQ ID NO: 573147 - RNA, 64 nt, Homo Sapiens; identical to SEQ ID NO: 83725

SEQ ID NO: 573148 - RNA, 64 nt, Homo Sapiens; identical to SEQ ID NO: 83726

SEQ ID NO: 573149 - RNA, 64 nt, Homo Sapiens; identical to SEQ ID NO: 83727

SEQ ID NO: 573150 - RNA, 64 nt, Homo Sapiens; identical to SEQ ID NO: 83728

SEQ ID NO: 573151 - RNA, 64 nt, Homo Sapiens; identical to SEQ ID NO: 83729

SEQ ID NO: 573152 - RNA, 64 nt, Homo Sapiens; identical to SEQ ID NO: 83730

SEQ ID NO: 573153 - RNA, 64 nt, Homo Sapiens; identical to SEQ ID NO: 83731

SEQ ID NO: 573154 - RNA, 64 nt, Homo Sapiens; identical to SEQ ID NO: 234346

SEQ ID NO: 573155 - RNA, 64 nt, Homo Sapiens; identical to SEQ ID NO: 234347

SEQ ID NO: 573156 - RNA, 64 nt, Homo Sapiens; identical to SEQ ID NO: 234348

SEQ ID NO: 573157 - RNA, 64 nt, Homo Sapiens; identical to SEQ ID NO: 234349

SEQ ID NO: 573158 - RNA, 64 nt, Homo Sapiens; identical to SEQ ID NO: 234350

SEQ ID NO: 573159 - RNA, 64 nt, Homo Sapiens; identical to SEQ ID NO: 234351

SEQ ID NO: 573160 - RNA, 64 nt, Homo Sapiens; identical to SEQ ID NO: 234352

SEQ ID NO: 573161 - RNA, 64 nt, Homo Sapiens; identical to SEQ ID NO: 234353

SEQ ID NO: 573162 - RNA, 64 nt, Homo Sapiens; identical to SEQ ID NO: 234354

SEQ ID NO: 573163 - RNA, 64 nt, Homo Sapiens; identical to SEQ ID NO: 234355

SEQ ID NO: 573164 - RNA, 64 nt, Homo Sapiens; identical to SEQ ID NO: 234356

SEQ ID NO: 573165 - RNA, 64 nt, Homo Sapiens; identical to SEQ ID NO: 234357

SEQ ID NO: 573166 - RNA, 64 nt, Homo Sapiens; identical to SEQ ID NO: 150696

SEQ ID NO: 573167 - RNA, 64 nt, Homo Sapiens; identical to SEQ ID NO: 150697

SEQ ID NO: 573168 - RNA, 64 nt, Homo Sapiens; identical to SEQ ID NO: 150698

SEQ ID NO: 573169 - RNA, 64 nt, Homo Sapiens; identical to SEQ ID NO: 150699

SEQ ID NO: 573170 - RNA, 64 nt, Homo Sapiens
gcaggcaggacuccuugugcucccagcagcucagacagggaaaggauaguccccacucacggug

SEQ ID NO: 573171 - RNA, 64 nt, Homo Sapiens
gaaucucaucaaccagggaagaggaacugagaucacagggaaggagauuggaggugauaccagc

SEQ ID NO: 573172 - RNA, 64 nt, Homo Sapiens
auucuucagcgugucugguaccuuggauguucaaacagggaacacugucagggcugaggagaac

SEQ ID NO: 573173 - RNA, 64 nt, Homo Sapiens
uggauccagaacaugacaacagagagcugcguccacagggaacaaagcccugaccucucucucc

SEQ ID NO: 573174 - RNA, 64 nt, Homo Sapiens
caaguucaugguacauacgcaaggagacucuaagacagggaaagaccuguuauguugcuuuugg

SEQ ID NO: 573175 - RNA, 64 nt, Homo Sapiens
gggagaagaaagacccccauggcagcggggauagacagggaauggaggccugcccagacuagga

SEQ ID NO: 573176 - RNA, 64 nt, Homo Sapiens
gugcccagaauuuaccaucaucucugaaggaguuacagggaaguggucuccccaauucuccccu

SEQ ID NO: 573177 - RNA, 64 nt, Homo Sapiens
ccuuuugcucucugugacccuaagagcacacugcacagggaaaauugccccauccagaccuggc

SEQ ID NO: 573178 - RNA, 64 nt, Homo Sapiens
gaaacuugggucuugcugcccauccuuccucagcacagggaacccggaagcccguugcacugac

SEQ ID NO: 573179 - RNA, 64 nt, Homo Sapiens
ucgugcauacaugcggggaccccagacugucagcacagggaagauggaucccauccuaauuuuu

SEQ ID NO: 573180 - RNA, 64 nt, Homo Sapiens
ucuccccagcucugcccucuggguccacaugaggacagggaagcucgggaaggggaagggagac

SEQ ID NO: 573181 - RNA, 64 nt, Homo Sapiens
ccccgcugggcacucucugucccaucccucuaggacagggaagcuggccugguccagggcacug

SEQ ID NO: 573182 - RNA, 64 nt, Homo Sapiens
gccuucucuguggcuacaagggacccacagaauuacagggaaguuacagggaagcagguuucau

SEQ ID NO: 573183 - RNA, 64 nt, Homo Sapiens
ggcuacaagggacccacagaauuacagggaaguuacagggaagcagguuucaucucaauauugg

SEQ ID NO: 573184 - RNA, 64 nt, Homo Sapiens
auacaaacacuacagacaauaaauauuaggagacacagggaaguggggagagguggggaguaau

SEQ ID NO: 573185 - RNA, 64 nt, Homo Sapiens
gggaaguggggagagguggggaguaauaguaaacacagggaagagcuccccuacggaccaggua

SEQ ID NO: 573186 - RNA, 64 nt, Homo Sapiens
guguguguggcagcaggcagcggggaggggaggaacagggaagggggagcuggggagcuuggcu

SEQ ID NO: 573187 - RNA, 64 nt, Homo Sapiens
acuuacaauuauuccuugauggcuaggacagggaacagggaagcgaguacaggcuuggagaaau

SEQ ID NO: 573188 - RNA, 64 nt, Homo Sapiens
gggaagcacuuacaauuauugagaaauggcuaggacagggaacaggagccugaguacaggcuug

SEQ ID NO: 573189 - RNA, 64 nt, Homo Sapiens
agcuucguuguucucauagaaccaacagcaucugagcccucaacaccaacagcaccauccucug

SEQ ID NO: 573190 - RNA, 64 nt, Homo Sapiens
cgcccagcacccuauugauggcuauaggacagguagcccucauuuccaugccugauaaccccuu

SEQ ID NO: 573191 - RNA, 64 nt, Homo Sapiens
ccugucaucccaggacacuuccggugacaccugcagcccucacuggagcugaccaagccuuggc

SEQ ID NO: 573192 - RNA, 64 nt, Homo Sapiens
guccccuaccugaccugucucccggugcccuaggagcccucagucagcuggggaggacauggcg

SEQ ID NO: 573193 - RNA, 64 nt, Homo Sapiens
gucagucccacugcacccccgagcuuccacugucagcccucacugcuggagcuaaggccagcua

SEQ ID NO: 573194 - RNA, 64 nt, Homo Sapiens
ucccaggguacacucuucucaguccuggggguaaagcccucagaccaaaaccagagggcagucu

SEQ ID NO: 573195 - RNA, 64 nt, Homo Sapiens
ccagcacagccagcaaggacucccuccagcacacagcccucaccaccgugccccaugcaggggc

SEQ ID NO: 573196 - RNA, 64 nt, Homo Sapiens
ugcaguggcccuacccagccugagaccucagcucagcccucagggcccagggugcugugaccga

SEQ ID NO: 573197 - RNA, 64 nt, Homo Sapiens
ucuuucccuggucuuuuagucuaguccuuuggcaagcccucaaccucagauuaauccuauuuau

SEQ ID NO: 573198 - RNA, 64 nt, Homo Sapiens
aaucacuacaagugucucacuucagccuuagaaaagcccucaauguaaaccuuauguuuguuac

SEQ ID NO: 573199 - RNA, 64 nt, Homo Sapiens
guccagaccucggcugccacgccccaggaccugcagcccucaugggggcuggggauccccauca

SEQ ID NO: 573200 - RNA, 64 nt, Homo Sapiens
ucauccuggccugcccucuagacuccaguccccaagcccucagccuagugggugucauggaugg

SEQ ID NO: 573201 - RNA, 64 nt, Homo Sapiens
agccaucaaggcuguggggaggaaccauaaacccagcccucacagcucccagcacagggccucc

SEQ ID NO: 573202 - RNA, 64 nt, Homo Sapiens
gagcucaaaccucuagucugggaugagcucacagagcccucaugaguuaagauccauccauauc

SEQ ID NO: 573203 - RNA, 64 nt, Homo Sapiens
uuguguaacuaauuugugguaaaguaguugauucagcccucagaagaaaacuuuuguuuagagc

SEQ ID NO: 573204 - RNA, 64 nt, Homo Sapiens
aaagaaaucuccuaacaaaagaacuaagaggcccagcccucagaaacccuucagugcuacauuu

SEQ ID NO: 573205 - RNA, 64 nt, Homo Sapiens
ccacuuccuuuccuacugucugcggacccuucccagcccucaucguacuaaacccgcaccccag

SEQ ID NO: 573206 - RNA, 64 nt, Homo Sapiens
accauuuaagagacucuuuacaguucguugguagagcccucagaccaucgucucauccuccuuu

SEQ ID NO: 573207 - RNA, 54 nt, Homo Sapiens
cuuuagauagugcugacugauucuagcccucagggaugaggaugaaaagcugga

SEQ ID NO: 573208 - RNA, 64 nt, Homo Sapiens
gccacagacaaaccacccccacuccuacccagccagcccucaaaacacaaaggaacaaagacag

SEQ ID NO: 573209 - RNA, 64 nt, Homo Sapiens
ccacagcccucccagguaccaccuccccugccugagcccucacuuccucucugagcagccuccu

SEQ ID NO: 573210 - RNA, 64 nt, Homo Sapiens
ucuuauaauacccugaucccggggguuccccaucagcccucauuacucuuuggggccccuuucu

SEQ ID NO: 573211 - RNA, 64 nt, Homo Sapiens
uaugcucucggucuuuccuggaggcugccaacccagcccucauccucccuugcucacaaaguua

SEQ ID NO: 573212 - RNA, 64 nt, Homo Sapiens
ugugcucguccagcucaccaccacagccccucucagcccucaguaggugggaggggccagcugc

SEQ ID NO: 573213 - RNA, 64 nt, Homo Sapiens
gcaggaggaagguauuggccgaggagaagcuggcagcccucacuccuccccaccucagccuggg

SEQ ID NO: 573214 - RNA, 64 nt, Homo Sapiens
ugugucccugugccacuuuggugggaggaaggcgagcccucauggaucagaagucgcagcucug

SEQ ID NO: 573215 - RNA, 64 nt, Homo Sapiens; identical to SEQ ID NO: 325163

SEQ ID NO: 573216 - RNA, 64 nt, Homo Sapiens; identical to SEQ ID NO: 325164

SEQ ID NO: 573217 - RNA, 64 nt, Homo Sapiens; identical to SEQ ID NO: 325165

SEQ ID NO: 573218 - RNA, 64 nt, Homo Sapiens; identical to SEQ ID NO: 325166

SEQ ID NO: 573219 - RNA, 64 nt, Homo Sapiens; identical to SEQ ID NO: 325167

SEQ ID NO: 573220 - RNA, 64 nt, Homo Sapiens; identical to SEQ ID NO: 325168

SEQ ID NO: 573221 - RNA, 64 nt, Homo Sapiens; identical to SEQ ID NO: 325169

SEQ ID NO: 573222 - RNA, 64 nt, Homo Sapiens; identical to SEQ ID NO: 325170

SEQ ID NO: 573223 - RNA, 64 nt, Homo Sapiens; identical to SEQ ID NO: 325171

SEQ ID NO: 573224 - RNA, 64 nt, Homo Sapiens; identical to SEQ ID NO: 325172

SEQ ID NO: 573225 - RNA, 64 nt, Homo Sapiens; identical to SEQ ID NO: 325173

SEQ ID NO: 573226 - RNA, 64 nt, Homo Sapiens; identical to SEQ ID NO: 325174

SEQ ID NO: 573227 - RNA, 64 nt, Homo Sapiens; identical to SEQ ID NO: 325175

SEQ ID NO: 573228 - RNA, 64 nt, Homo Sapiens; identical to SEQ ID NO: 325176

SEQ ID NO: 573229 - RNA, 64 nt, Homo Sapiens; identical to SEQ ID NO: 325177

SEQ ID NO: 573230 - RNA, 64 nt, Homo Sapiens; identical to SEQ ID NO: 325178

SEQ ID NO: 573231 - RNA, 64 nt, Homo Sapiens; identical to SEQ ID NO: 325179

SEQ ID NO: 573232 - RNA, 64 nt, Homo Sapiens; identical to SEQ ID NO: 325180

SEQ ID NO: 573233 - RNA, 64 nt, Homo Sapiens; identical to SEQ ID NO: 325181

SEQ ID NO: 573234 - RNA, 64 nt, Homo Sapiens; identical to SEQ ID NO: 325182

SEQ ID NO: 573235 - RNA, 64 nt, Homo Sapiens; identical to SEQ ID NO: 325183

SEQ ID NO: 573236 - RNA, 64 nt, Homo Sapiens; identical to SEQ ID NO: 325184

SEQ ID NO: 573237 - RNA, 64 nt, Homo Sapiens; identical to SEQ ID NO: 325185

SEQ ID NO: 573238 - RNA, 64 nt, Homo Sapiens; identical to SEQ ID NO: 325186

SEQ ID NO: 573239 - RNA, 64 nt, Homo Sapiens; identical to SEQ ID NO: 325187

SEQ ID NO: 573240 - RNA, 64 nt, Homo Sapiens; identical to SEQ ID NO: 325188

SEQ ID NO: 573241 - RNA, 64 nt, Homo Sapiens; identical to SEQ ID NO: 325189

SEQ ID NO: 573242 - RNA, 64 nt, Homo Sapiens; identical to SEQ ID NO: 325190

SEQ ID NO: 573243 - RNA, 64 nt, Homo Sapiens; identical to SEQ ID NO: 325191

SEQ ID NO: 573244 - RNA, 64 nt, Homo Sapiens; identical to SEQ ID NO: 325192

SEQ ID NO: 573245 - RNA, 64 nt, Homo Sapiens; identical to SEQ ID NO: 325193

SEQ ID NO: 573246 - RNA, 64 nt, Homo Sapiens; identical to SEQ ID NO: 325194

SEQ ID NO: 573247 - RNA, 64 nt, Homo Sapiens; identical to SEQ ID NO: 325195

SEQ ID NO: 573248 - RNA, 64 nt, Homo Sapiens; identical to SEQ ID NO: 325196

SEQ ID NO: 573249 - RNA, 64 nt, Homo Sapiens; identical to SEQ ID NO: 325197

SEQ ID NO: 573250 - RNA, 64 nt, Homo Sapiens; identical to SEQ ID NO: 325198

SEQ ID NO: 573251 - RNA, 64 nt, Homo Sapiens; identical to SEQ ID NO: 325199

SEQ ID NO: 573252 - RNA, 64 nt, Homo Sapiens; identical to SEQ ID NO: 325200

SEQ ID NO: 573253 - RNA, 64 nt, Homo Sapiens; identical to SEQ ID NO: 325201

SEQ ID NO: 573254 - RNA, 64 nt, Homo Sapiens; identical to SEQ ID NO: 325202

SEQ ID NO: 573255 - RNA, 64 nt, Homo Sapiens; identical to SEQ ID NO: 325203

SEQ ID NO: 573256 - RNA, 64 nt, Homo Sapiens; identical to SEQ ID NO: 325204

SEQ ID NO: 573257 - RNA, 64 nt, Homo Sapiens; identical to SEQ ID NO: 325205

SEQ ID NO: 573258 - RNA, 64 nt, Homo Sapiens; identical to SEQ ID NO: 325206

SEQ ID NO: 573259 - RNA, 64 nt, Homo Sapiens; identical to SEQ ID NO: 325207

SEQ ID NO: 573260 - RNA, 64 nt, Homo Sapiens; identical to SEQ ID NO: 325208

SEQ ID NO: 573261 - RNA, 64 nt, Homo Sapiens; identical to SEQ ID NO: 325209

SEQ ID NO: 573262 - RNA, 64 nt, Homo Sapiens; identical to SEQ ID NO: 325210

SEQ ID NO: 573263 - RNA, 64 nt, Homo Sapiens; identical to SEQ ID NO: 93499

SEQ ID NO: 573264 - RNA, 64 nt, Homo Sapiens; identical to SEQ ID NO: 93500

SEQ ID NO: 573265 - RNA, 64 nt, Homo Sapiens; identical to SEQ ID NO: 93501

SEQ ID NO: 573266 - RNA, 64 nt, Homo Sapiens; identical to SEQ ID NO: 93502

SEQ ID NO: 573267 - RNA, 64 nt, Homo Sapiens; identical to SEQ ID NO: 93503

SEQ ID NO: 573268 - RNA, 64 nt, Homo Sapiens; identical to SEQ ID NO: 93504

SEQ ID NO: 573269 - RNA, 64 nt, Homo Sapiens; identical to SEQ ID NO: 93505

SEQ ID NO: 573270 - RNA, 64 nt, Homo Sapiens; identical to SEQ ID NO: 93506

SEQ ID NO: 573271 - RNA, 64 nt, Homo Sapiens; identical to SEQ ID NO: 93507

SEQ ID NO: 573272 - RNA, 64 nt, Homo Sapiens; identical to SEQ ID NO: 93508

SEQ ID NO: 573273 - RNA, 64 nt, Homo Sapiens; identical to SEQ ID NO: 93509

SEQ ID NO: 573274 - RNA, 64 nt, Homo Sapiens; identical to SEQ ID NO: 93510

SEQ ID NO: 573275 - RNA, 64 nt, Homo Sapiens; identical to SEQ ID NO: 93511

SEQ ID NO: 573276 - RNA, 64 nt, Homo Sapiens; identical to SEQ ID NO: 93512

SEQ ID NO: 573277 - RNA, 64 nt, Homo Sapiens; identical to SEQ ID NO: 93513

SEQ ID NO: 573278 - RNA, 64 nt, Homo Sapiens; identical to SEQ ID NO: 93514

SEQ ID NO: 573279 - RNA, 64 nt, Homo Sapiens; identical to SEQ ID NO: 93515

SEQ ID NO: 573280 - RNA, 64 nt, Homo Sapiens; identical to SEQ ID NO: 93516

SEQ ID NO: 573281 - RNA, 64 nt, Homo Sapiens; identical to SEQ ID NO: 93517

SEQ ID NO: 573282 - RNA, 64 nt, Homo Sapiens; identical to SEQ ID NO: 93518

SEQ ID NO: 573283 - RNA, 64 nt, Homo Sapiens; identical to SEQ ID NO: 93519

SEQ ID NO: 573284 - RNA, 64 nt, Homo Sapiens; identical to SEQ ID NO: 93520

SEQ ID NO: 573285 - RNA, 64 nt, Homo Sapiens; identical to SEQ ID NO: 93521

SEQ ID NO: 573286 - RNA, 64 nt, Homo Sapiens; identical to SEQ ID NO: 93522

SEQ ID NO: 573287 - RNA, 64 nt, Homo Sapiens; identical to SEQ ID NO: 93523

SEQ ID NO: 573288 - RNA, 64 nt, Homo Sapiens; identical to SEQ ID NO: 93524

SEQ ID NO: 573289 - RNA, 64 nt, Homo Sapiens; identical to SEQ ID NO: 93525

SEQ ID NO: 573290 - RNA, 64 nt, Homo Sapiens; identical to SEQ ID NO: 93526

SEQ ID NO: 573291 - RNA, 64 nt, Homo Sapiens; identical to SEQ ID NO: 93527

SEQ ID NO: 573292 - RNA, 64 nt, Homo Sapiens; identical to SEQ ID NO: 93528

SEQ ID NO: 573293 - RNA, 64 nt, Homo Sapiens; identical to SEQ ID NO: 93529

SEQ ID NO: 573294 - RNA, 64 nt, Homo Sapiens; identical to SEQ ID NO: 93530

SEQ ID NO: 573295 - RNA, 64 nt, Homo Sapiens; identical to SEQ ID NO: 93531

SEQ ID NO: 573296 - RNA, 64 nt, Homo Sapiens; identical to SEQ ID NO: 93532

SEQ ID NO: 573297 - RNA, 64 nt, Homo Sapiens; identical to SEQ ID NO: 93533

SEQ ID NO: 573298 - RNA, 64 nt, Homo Sapiens; identical to SEQ ID NO: 93534

SEQ ID NO: 573299 - RNA, 64 nt, Homo Sapiens; identical to SEQ ID NO: 93535

SEQ ID NO: 573300 - RNA, 64 nt, Homo Sapiens; identical to SEQ ID NO: 93536

SEQ ID NO: 573301 - RNA, 64 nt, Homo Sapiens; identical to SEQ ID NO: 93537

SEQ ID NO: 573302 - RNA, 64 nt, Homo Sapiens; identical to SEQ ID NO: 93538

SEQ ID NO: 573303 - RNA, 64 nt, Homo Sapiens; identical to SEQ ID NO: 93539

SEQ ID NO: 573304 - RNA, 64 nt, Homo Sapiens; identical to SEQ ID NO: 93540

SEQ ID NO: 573305 - RNA, 64 nt, Homo Sapiens; identical to SEQ ID NO: 93541

SEQ ID NO: 573306 - RNA, 64 nt, Homo Sapiens; identical to SEQ ID NO: 93542

SEQ ID NO: 573307 - RNA, 64 nt, Homo Sapiens; identical to SEQ ID NO: 93543

SEQ ID NO: 573308 - RNA, 64 nt, Homo Sapiens; identical to SEQ ID NO: 93544

SEQ ID NO: 573309 - RNA, 64 nt, Homo Sapiens; identical to SEQ ID NO: 93545

SEQ ID NO: 573310 - RNA, 64 nt, Homo Sapiens; identical to SEQ ID NO: 93546

SEQ ID NO: 573311 - RNA, 64 nt, Homo Sapiens; identical to SEQ ID NO: 93547

SEQ ID NO: 573312 - RNA, 64 nt, Homo Sapiens; identical to SEQ ID NO: 93548

SEQ ID NO: 573313 - RNA, 64 nt, Homo Sapiens; identical to SEQ ID NO: 93549

SEQ ID NO: 573314 - RNA, 64 nt, Homo Sapiens; identical to SEQ ID NO: 93550

SEQ ID NO: 573315 - RNA, 64 nt, Homo Sapiens; identical to SEQ ID NO: 93551

SEQ ID NO: 573316 - RNA, 64 nt, Homo Sapiens; identical to SEQ ID NO: 93552

SEQ ID NO: 573317 - RNA, 64 nt, Homo Sapiens; identical to SEQ ID NO: 93553

SEQ ID NO: 573318 - RNA, 64 nt, Homo Sapiens; identical to SEQ ID NO: 93554

SEQ ID NO: 573319 - RNA, 64 nt, Homo Sapiens; identical to SEQ ID NO: 93555

SEQ ID NO: 573320 - RNA, 64 nt, Homo Sapiens; identical to SEQ ID NO: 93556

SEQ ID NO: 573321 - RNA, 64 nt, Homo Sapiens; identical to SEQ ID NO: 93557

SEQ ID NO: 573322 - RNA, 64 nt, Homo Sapiens; identical to SEQ ID NO: 93558

SEQ ID NO: 573323 - RNA, 64 nt, Homo Sapiens; identical to SEQ ID NO: 93559

SEQ ID NO: 573324 - RNA, 64 nt, Homo Sapiens; identical to SEQ ID NO: 93560

SEQ ID NO: 573325 - RNA, 64 nt, Homo Sapiens; identical to SEQ ID NO: 93561

SEQ ID NO: 573326 - RNA, 64 nt, Homo Sapiens; identical to SEQ ID NO: 93562

SEQ ID NO: 573327 - RNA, 64 nt, Homo Sapiens; identical to SEQ ID NO: 93563

SEQ ID NO: 573328 - RNA, 64 nt, Homo Sapiens; identical to SEQ ID NO: 93564

SEQ ID NO: 573329 - RNA, 64 nt, Homo Sapiens; identical to SEQ ID NO: 93565

SEQ ID NO: 573330 - RNA, 64 nt, Homo Sapiens; identical to SEQ ID NO: 93566

SEQ ID NO: 573331 - RNA, 64 nt, Homo Sapiens; identical to SEQ ID NO: 93567

SEQ ID NO: 573332 - RNA, 64 nt, Homo Sapiens; identical to SEQ ID NO: 93568

SEQ ID NO: 573333 - RNA, 64 nt, Homo Sapiens; identical to SEQ ID NO: 93569

SEQ ID NO: 573334 - RNA, 64 nt, Homo Sapiens; identical to SEQ ID NO: 93570

SEQ ID NO: 573335 - RNA, 64 nt, Homo Sapiens; identical to SEQ ID NO: 93571

SEQ ID NO: 573336 - RNA, 64 nt, Homo Sapiens; identical to SEQ ID NO: 93572

SEQ ID NO: 573337 - RNA, 64 nt, Homo Sapiens; identical to SEQ ID NO: 93573

SEQ ID NO: 573338 - RNA, 64 nt, Homo Sapiens; identical to SEQ ID NO: 93574

SEQ ID NO: 573339 - RNA, 64 nt, Homo Sapiens; identical to SEQ ID NO: 93575

SEQ ID NO: 573340 - RNA, 64 nt, Homo Sapiens; identical to SEQ ID NO: 93576

SEQ ID NO: 573341 - RNA, 64 nt, Homo Sapiens; identical to SEQ ID NO: 93577

SEQ ID NO: 573342 - RNA, 64 nt, Homo Sapiens; identical to SEQ ID NO: 93578

SEQ ID NO: 573343 - RNA, 64 nt, Homo Sapiens; identical to SEQ ID NO: 93579

SEQ ID NO: 573344 - RNA, 64 nt, Homo Sapiens; identical to SEQ ID NO: 93580

SEQ ID NO: 573345 - RNA, 64 nt, Homo Sapiens; identical to SEQ ID NO: 93581

SEQ ID NO: 573346 - RNA, 64 nt, Homo Sapiens; identical to SEQ ID NO: 93582

SEQ ID NO: 573347 - RNA, 64 nt, Homo Sapiens; identical to SEQ ID NO: 23612

SEQ ID NO: 573348 - RNA, 64 nt, Homo Sapiens; identical to SEQ ID NO: 23613

SEQ ID NO: 573349 - RNA, 64 nt, Homo Sapiens; identical to SEQ ID NO: 23614

SEQ ID NO: 573350 - RNA, 64 nt, Homo Sapiens; identical to SEQ ID NO: 23615

SEQ ID NO: 573351 - RNA, 64 nt, Homo Sapiens; identical to SEQ ID NO: 23616

SEQ ID NO: 573352 - RNA, 64 nt, Homo Sapiens; identical to SEQ ID NO: 23617

SEQ ID NO: 573353 - RNA, 64 nt, Homo Sapiens; identical to SEQ ID NO: 23618

SEQ ID NO: 573354 - RNA, 64 nt, Homo Sapiens; identical to SEQ ID NO: 23619

SEQ ID NO: 573355 - RNA, 64 nt, Homo Sapiens; identical to SEQ ID NO: 23620

SEQ ID NO: 573356 - RNA, 64 nt, Homo Sapiens; identical to SEQ ID NO: 23621

SEQ ID NO: 573357 - RNA, 64 nt, Homo Sapiens; identical to SEQ ID NO: 23622

SEQ ID NO: 573358 - RNA, 64 nt, Homo Sapiens; identical to SEQ ID NO: 23623

SEQ ID NO: 573359 - RNA, 64 nt, Homo Sapiens; identical to SEQ ID NO: 23624

SEQ ID NO: 573360 - RNA, 64 nt, Homo Sapiens; identical to SEQ ID NO: 23625

SEQ ID NO: 573361 - RNA, 64 nt, Homo Sapiens; identical to SEQ ID NO: 23626

SEQ ID NO: 573362 - RNA, 64 nt, Homo Sapiens; identical to SEQ ID NO: 23627

SEQ ID NO: 573363 - RNA, 64 nt, Homo Sapiens; identical to SEQ ID NO: 363943

SEQ ID NO: 573364 - RNA, 64 nt, Homo Sapiens; identical to SEQ ID NO: 363944

SEQ ID NO: 573365 - RNA, 64 nt, Homo Sapiens; identical to SEQ ID NO: 363945

SEQ ID NO: 573366 - RNA, 64 nt, Homo Sapiens; identical to SEQ ID NO: 363946

SEQ ID NO: 573367 - RNA, 64 nt, Homo Sapiens; identical to SEQ ID NO: 363947

SEQ ID NO: 573368 - RNA, 64 nt, Homo Sapiens; identical to SEQ ID NO: 363948

SEQ ID NO: 573369 - RNA, 64 nt, Homo Sapiens; identical to SEQ ID NO: 363949

SEQ ID NO: 573370 - RNA, 64 nt, Homo Sapiens; identical to SEQ ID NO: 363950

SEQ ID NO: 573371 - RNA, 64 nt, Homo Sapiens; identical to SEQ ID NO: 363951

SEQ ID NO: 573372 - RNA, 64 nt, Homo Sapiens; identical to SEQ ID NO: 363952

SEQ ID NO: 573373 - RNA, 64 nt, Homo Sapiens; identical to SEQ ID NO: 363953

SEQ ID NO: 573374 - RNA, 64 nt, Homo Sapiens; identical to SEQ ID NO: 363954

SEQ ID NO: 573375 - RNA, 64 nt, Homo Sapiens; identical to SEQ ID NO: 363955

SEQ ID NO: 573376 - RNA, 64 nt, Homo Sapiens; identical to SEQ ID NO: 363956

SEQ ID NO: 573377 - RNA, 64 nt, Homo Sapiens; identical to SEQ ID NO: 363957

SEQ ID NO: 573378 - RNA, 64 nt, Homo Sapiens; identical to SEQ ID NO: 363958

SEQ ID NO: 573379 - RNA, 64 nt, Homo Sapiens; identical to SEQ ID NO: 363959

SEQ ID NO: 573380 - RNA, 64 nt, Homo Sapiens; identical to SEQ ID NO: 363960

SEQ ID NO: 573381 - RNA, 64 nt, Homo Sapiens; identical to SEQ ID NO: 363961

SEQ ID NO: 573382 - RNA, 64 nt, Homo Sapiens; identical to SEQ ID NO: 363962

SEQ ID NO: 573383 - RNA, 64 nt, Homo Sapiens; identical to SEQ ID NO: 363963

SEQ ID NO: 573384 - RNA, 64 nt, Homo Sapiens; identical to SEQ ID NO: 363964

SEQ ID NO: 573385 - RNA, 64 nt, Homo Sapiens; identical to SEQ ID NO: 363965

SEQ ID NO: 573386 - RNA, 64 nt, Homo Sapiens; identical to SEQ ID NO: 363966

SEQ ID NO: 573387 - RNA, 64 nt, Homo Sapiens; identical to SEQ ID NO: 363967

SEQ ID NO: 573388 - RNA, 64 nt, Homo Sapiens; identical to SEQ ID NO: 363968

SEQ ID NO: 573389 - RNA, 64 nt, Homo Sapiens; identical to SEQ ID NO: 363969

SEQ ID NO: 573390 - RNA, 64 nt, Homo Sapiens; identical to SEQ ID NO: 363970

SEQ ID NO: 573391 - RNA, 64 nt, Homo Sapiens; identical to SEQ ID NO: 363971

SEQ ID NO: 573392 - RNA, 64 nt, Homo Sapiens; identical to SEQ ID NO: 363972

SEQ ID NO: 573393 - RNA, 64 nt, Homo Sapiens; identical to SEQ ID NO: 363973

SEQ ID NO: 573394 - RNA, 64 nt, Homo Sapiens; identical to SEQ ID NO: 363974

SEQ ID NO: 573395 - RNA, 64 nt, Homo Sapiens; identical to SEQ ID NO: 363975

SEQ ID NO: 573396 - RNA, 64 nt, Homo Sapiens; identical to SEQ ID NO: 363976

SEQ ID NO: 573397 - RNA, 64 nt, Homo Sapiens; identical to SEQ ID NO: 363977

SEQ ID NO: 573398 - RNA, 64 nt, Homo Sapiens; identical to SEQ ID NO: 363978

SEQ ID NO: 573399 - RNA, 63 nt, Homo Sapiens; identical to SEQ ID NO: 363979

SEQ ID NO: 573400 - RNA, 64 nt, Homo Sapiens; identical to SEQ ID NO: 363980

SEQ ID NO: 573401 - RNA, 64 nt, Homo Sapiens; identical to SEQ ID NO: 363981

SEQ ID NO: 573402 - RNA, 64 nt, Homo Sapiens; identical to SEQ ID NO: 363982

SEQ ID NO: 573403 - RNA, 64 nt, Homo Sapiens; identical to SEQ ID NO: 363983

SEQ ID NO: 573404 - RNA, 64 nt, Homo Sapiens; identical to SEQ ID NO: 363984

SEQ ID NO: 573405 - RNA, 64 nt, Homo Sapiens; identical to SEQ ID NO: 363985

SEQ ID NO: 573406 - RNA, 64 nt, Homo Sapiens; identical to SEQ ID NO: 363986

SEQ ID NO: 573407 - RNA, 64 nt, Homo Sapiens; identical to SEQ ID NO: 363987

SEQ ID NO: 573408 - RNA, 64 nt, Homo Sapiens; identical to SEQ ID NO: 363988

SEQ ID NO: 573409 - RNA, 64 nt, Homo Sapiens; identical to SEQ ID NO: 363989

SEQ ID NO: 573410 - RNA, 64 nt, Homo Sapiens; identical to SEQ ID NO: 363990

SEQ ID NO: 573411 - RNA, 64 nt, Homo Sapiens; identical to SEQ ID NO: 363991

SEQ ID NO: 573412 - RNA, 64 nt, Homo Sapiens; identical to SEQ ID NO: 363992

SEQ ID NO: 573413 - RNA, 64 nt, Homo Sapiens; identical to SEQ ID NO: 363993

SEQ ID NO: 573414 - RNA, 64 nt, Homo Sapiens; identical to SEQ ID NO: 363994

SEQ ID NO: 573415 - RNA, 64 nt, Homo Sapiens; identical to SEQ ID NO: 116925

SEQ ID NO: 573416 - RNA, 64 nt, Homo Sapiens; identical to SEQ ID NO: 116926

SEQ ID NO: 573417 - RNA, 64 nt, Homo Sapiens; identical to SEQ ID NO: 116927

SEQ ID NO: 573418 - RNA, 64 nt, Homo Sapiens; identical to SEQ ID NO: 116928

SEQ ID NO: 573419 - RNA, 64 nt, Homo Sapiens; identical to SEQ ID NO: 116929

SEQ ID NO: 573420 - RNA, 64 nt, Homo Sapiens; identical to SEQ ID NO: 116930

SEQ ID NO: 573421 - RNA, 64 nt, Homo Sapiens; identical to SEQ ID NO: 116931

SEQ ID NO: 573422 - RNA, 64 nt, Homo Sapiens; identical to SEQ ID NO: 116932

SEQ ID NO: 573423 - RNA, 64 nt, Homo Sapiens; identical to SEQ ID NO: 116933

SEQ ID NO: 573424 - RNA, 63 nt, Homo Sapiens; identical to SEQ ID NO: 116934

SEQ ID NO: 573425 - RNA, 64 nt, Homo Sapiens; identical to SEQ ID NO: 116935

SEQ ID NO: 573426 - RNA, 64 nt, Homo Sapiens; identical to SEQ ID NO: 116936

SEQ ID NO: 573427 - RNA, 64 nt, Homo Sapiens; identical to SEQ ID NO: 116937

SEQ ID NO: 573428 - RNA, 64 nt, Homo Sapiens; identical to SEQ ID NO: 116938

SEQ ID NO: 573429 - RNA, 64 nt, Homo Sapiens; identical to SEQ ID NO: 116939

SEQ ID NO: 573430 - RNA, 64 nt, Homo Sapiens; identical to SEQ ID NO: 116940

SEQ ID NO: 573431 - RNA, 64 nt, Homo Sapiens; identical to SEQ ID NO: 116941

SEQ ID NO: 573432 - RNA, 64 nt, Homo Sapiens; identical to SEQ ID NO: 116942

SEQ ID NO: 573433 - RNA, 64 nt, Homo Sapiens; identical to SEQ ID NO: 116943

SEQ ID NO: 573434 - RNA, 64 nt, Homo Sapiens; identical to SEQ ID NO: 116944

SEQ ID NO: 573435 - RNA, 64 nt, Homo Sapiens; identical to SEQ ID NO: 116945

SEQ ID NO: 573436 - RNA, 64 nt, Homo Sapiens; identical to SEQ ID NO: 116946

SEQ ID NO: 573437 - RNA, 64 nt, Homo Sapiens; identical to SEQ ID NO: 116947

SEQ ID NO: 573438 - RNA, 64 nt, Homo Sapiens; identical to SEQ ID NO: 116948

SEQ ID NO: 573439 - RNA, 64 nt, Homo Sapiens; identical to SEQ ID NO: 116949

SEQ ID NO: 573440 - RNA, 64 nt, Homo Sapiens; identical to SEQ ID NO: 116950

SEQ ID NO: 573441 - RNA, 64 nt, Homo Sapiens; identical to SEQ ID NO: 116951

SEQ ID NO: 573442 - RNA, 64 nt, Homo Sapiens; identical to SEQ ID NO: 116952

SEQ ID NO: 573443 - RNA, 64 nt, Homo Sapiens; identical to SEQ ID NO: 116953

SEQ ID NO: 573444 - RNA, 64 nt, Homo Sapiens; identical to SEQ ID NO: 116954

SEQ ID NO: 573445 - RNA, 64 nt, Homo Sapiens; identical to SEQ ID NO: 116955

SEQ ID NO: 573446 - RNA, 64 nt, Homo Sapiens; identical to SEQ ID NO: 116956

SEQ ID NO: 573447 - RNA, 64 nt, Homo Sapiens; identical to SEQ ID NO: 116957

SEQ ID NO: 573448 - RNA, 64 nt, Homo Sapiens; identical to SEQ ID NO: 116958

SEQ ID NO: 573449 - RNA, 64 nt, Homo Sapiens; identical to SEQ ID NO: 116959

SEQ ID NO: 573450 - RNA, 64 nt, Homo Sapiens; identical to SEQ ID NO: 116960

SEQ ID NO: 573451 - RNA, 64 nt, Homo Sapiens; identical to SEQ ID NO: 116961

SEQ ID NO: 573452 - RNA, 64 nt, Homo Sapiens; identical to SEQ ID NO: 116962

SEQ ID NO: 573453 - RNA, 64 nt, Homo Sapiens; identical to SEQ ID NO: 116963

SEQ ID NO: 573454 - RNA, 64 nt, Homo Sapiens; identical to SEQ ID NO: 116964

SEQ ID NO: 573455 - RNA, 64 nt, Homo Sapiens; identical to SEQ ID NO: 116965

SEQ ID NO: 573456 - RNA, 64 nt, Homo Sapiens; identical to SEQ ID NO: 116966

SEQ ID NO: 573457 - RNA, 64 nt, Homo Sapiens; identical to SEQ ID NO: 116967

SEQ ID NO: 573458 - RNA, 64 nt, Homo Sapiens; identical to SEQ ID NO: 116968

SEQ ID NO: 573459 - RNA, 64 nt, Homo Sapiens; identical to SEQ ID NO: 116969

SEQ ID NO: 573460 - RNA, 57 nt, Homo Sapiens; identical to SEQ ID NO: 116970

SEQ ID NO: 573461 - RNA, 64 nt, Homo Sapiens; identical to SEQ ID NO: 116971

SEQ ID NO: 573462 - RNA, 64 nt, Homo Sapiens; identical to SEQ ID NO: 116972

SEQ ID NO: 573463 - RNA, 64 nt, Homo Sapiens; identical to SEQ ID NO: 116973

SEQ ID NO: 573464 - RNA, 64 nt, Homo Sapiens; identical to SEQ ID NO: 116971

SEQ ID NO: 573465 - RNA, 64 nt, Homo Sapiens; identical to SEQ ID NO: 116975

SEQ ID NO: 573466 - RNA, 64 nt, Homo Sapiens; identical to SEQ ID NO: 116976

SEQ ID NO: 573467 - RNA, 64 nt, Homo Sapiens; identical to SEQ ID NO: 116977

SEQ ID NO: 573468 - RNA, 64 nt, Homo Sapiens; identical to SEQ ID NO: 116978

SEQ ID NO: 573469 - RNA, 64 nt, Homo Sapiens; identical to SEQ ID NO: 116979

SEQ ID NO: 573470 - RNA, 64 nt, Homo Sapiens; identical to SEQ ID NO: 116980

SEQ ID NO: 573471 - RNA, 64 nt, Homo Sapiens; identical to SEQ ID NO: 116981

SEQ ID NO: 573472 - RNA, 64 nt, Homo Sapiens; identical to SEQ ID NO: 116982

SEQ ID NO: 573473 - RNA, 64 nt, Homo Sapiens; identical to SEQ ID NO: 116983

SEQ ID NO: 573474 - RNA, 64 nt, Homo Sapiens; identical to SEQ ID NO: 116984

SEQ ID NO: 573475 - RNA, 64 nt, Homo Sapiens; identical to SEQ ID NO: 116985

SEQ ID NO: 573476 - RNA, 64 nt, Homo Sapiens; identical to SEQ ID NO: 116986

SEQ ID NO: 573477 - RNA, 64 nt, Homo Sapiens; identical to SEQ ID NO: 116987

SEQ ID NO: 573478 - RNA, 64 nt, Homo Sapiens; identical to SEQ ID NO: 116988

SEQ ID NO: 573479 - RNA, 64 nt, Homo Sapiens; identical to SEQ ID NO: 116989

SEQ ID NO: 573480 - RNA, 64 nt, Homo Sapiens; identical to SEQ ID NO: 116990

SEQ ID NO: 573481 - RNA, 64 nt, Homo Sapiens; identical to SEQ ID NO: 116991

SEQ ID NO: 573482 - RNA, 64 nt, Homo Sapiens; identical to SEQ ID NO: 116992

SEQ ID NO: 573483 - RNA, 64 nt, Homo Sapiens; identical to SEQ ID NO: 116993

SEQ ID NO: 573484 - RNA, 64 nt, Homo Sapiens; identical to SEQ ID NO: 116994

SEQ ID NO: 573485 - RNA, 64 nt, Homo Sapiens; identical to SEQ ID NO: 116995

SEQ ID NO: 573486 - RNA, 64 nt, Homo Sapiens; identical to SEQ ID NO: 116996

SEQ ID NO: 573487 - RNA, 64 nt, Homo Sapiens; identical to SEQ ID NO: 116997

SEQ ID NO: 573488 - RNA, 64 nt, Homo Sapiens; identical to SEQ ID NO: 116998

SEQ ID NO: 573489 - RNA, 64 nt, Homo Sapiens; identical to SEQ ID NO: 116999

SEQ ID NO: 573490 - RNA, 64 nt, Homo Sapiens; identical to SEQ ID NO: 117000

SEQ ID NO: 573491 - RNA, 64 nt, Homo Sapiens; identical to SEQ ID NO: 117001

SEQ ID NO: 573492 - RNA, 64 nt, Homo Sapiens; identical to SEQ ID NO: 117002

SEQ ID NO: 573493 - RNA, 64 nt, Homo Sapiens; identical to SEQ ID NO: 117003

SEQ ID NO: 573494 - RNA, 64 nt, Homo Sapiens; identical to SEQ ID NO: 117004

SEQ ID NO: 573495 - RNA, 64 nt, Homo Sapiens; identical to SEQ ID NO: 117005

SEQ ID NO: 573496 - RNA, 64 nt, Homo Sapiens; identical to SEQ ID NO: 117006

SEQ ID NO: 573497 - RNA, 64 nt, Homo Sapiens; identical to SEQ ID NO: 117007

SEQ ID NO: 573498 - RNA, 64 nt, Homo Sapiens; identical to SEQ ID NO: 117008

SEQ ID NO: 573499 - RNA, 64 nt, Homo Sapiens; identical to SEQ ID NO: 117009

SEQ ID NO: 573500 - RNA, 64 nt, Homo Sapiens; identical to SEQ ID NO: 117010

SEQ ID NO: 573501 - RNA, 64 nt, Homo Sapiens; identical to SEQ ID NO: 117011

SEQ ID NO: 573502 - RNA, 64 nt, Homo Sapiens; identical to SEQ ID NO: 117012

SEQ ID NO: 573503 - RNA, 64 nt, Homo Sapiens; identical to SEQ ID NO: 117013

SEQ ID NO: 573504 - RNA, 64 nt, Homo Sapiens; identical to SEQ ID NO: 117014

SEQ ID NO: 573505 - RNA, 64 nt, Homo Sapiens; identical to SEQ ID NO: 117015

SEQ ID NO: 573506 - RNA, 64 nt, Homo Sapiens; identical to SEQ ID NO: 117016

SEQ ID NO: 573507 - RNA, 64 nt, Homo Sapiens; identical to SEQ ID NO: 117017

SEQ ID NO: 573508 - RNA, 64 nt, Homo Sapiens; identical to SEQ ID NO: 117018

SEQ ID NO: 573509 - RNA, 64 nt, Homo Sapiens; identical to SEQ ID NO: 117019

SEQ ID NO: 573510 - RNA, 64 nt, Homo Sapiens; identical to SEQ ID NO: 117020

SEQ ID NO: 573511 - RNA, 64 nt, Homo Sapiens; identical to SEQ ID NO: 117021

SEQ ID NO: 573512 - RNA, 64 nt, Homo Sapiens; identical to SEQ ID NO: 117022

SEQ ID NO: 573513 - RNA, 64 nt, Homo Sapiens; identical to SEQ ID NO: 117023

SEQ ID NO: 573514 - RNA, 64 nt, Homo Sapiens; identical to SEQ ID NO: 117024

SEQ ID NO: 573515 - RNA, 64 nt, Homo Sapiens; identical to SEQ ID NO: 117025

SEQ ID NO: 573516 - RNA, 64 nt, Homo Sapiens; identical to SEQ ID NO: 117026

SEQ ID NO: 573517 - RNA, 64 nt, Homo Sapiens; identical to SEQ ID NO: 117027

SEQ ID NO: 573518 - RNA, 64 nt, Homo Sapiens; identical to SEQ ID NO: 117028

SEQ ID NO: 573519 - RNA, 64 nt, Homo Sapiens; identical to SEQ ID NO: 117029

SEQ ID NO: 573520 - RNA, 64 nt, Homo Sapiens; identical to SEQ ID NO: 117030

SEQ ID NO: 573521 - RNA, 64 nt, Homo Sapiens; identical to SEQ ID NO: 117031

SEQ ID NO: 573522 - RNA, 64 nt, Homo Sapiens; identical to SEQ ID NO: 117032

SEQ ID NO: 573523 - RNA, 64 nt, Homo Sapiens; identical to SEQ ID NO: 117033

SEQ ID NO: 573524 - RNA, 64 nt, Homo Sapiens; identical to SEQ ID NO: 117034

SEQ ID NO: 573525 - RNA, 64 nt, Homo Sapiens; identical to SEQ ID NO: 117035

SEQ ID NO: 573526 - RNA, 64 nt, Homo Sapiens; identical to SEQ ID NO: 117036

SEQ ID NO: 573527 - RNA, 64 nt, Homo Sapiens; identical to SEQ ID NO: 117037

SEQ ID NO: 573528 - RNA, 64 nt, Homo Sapiens; identical to SEQ ID NO: 117038

SEQ ID NO: 573529 - RNA, 64 nt, Homo Sapiens; identical to SEQ ID NO: 117039

SEQ ID NO: 573530 - RNA, 64 nt, Homo Sapiens; identical to SEQ ID NO: 117040

SEQ ID NO: 573531 - RNA, 64 nt, Homo Sapiens; identical to SEQ ID NO: 117041

SEQ ID NO: 573532 - RNA, 64 nt, Homo Sapiens; identical to SEQ ID NO: 117042

SEQ ID NO: 573533 - RNA, 64 nt, Homo Sapiens; identical to SEQ ID NO: 117043

SEQ ID NO: 573534 - RNA, 64 nt, Homo Sapiens; identical to SEQ ID NO: 117044

SEQ ID NO: 573535 - RNA, 64 nt, Homo Sapiens; identical to SEQ ID NO: 117045

SEQ ID NO: 573536 - RNA, 64 nt, Homo Sapiens; identical to SEQ ID NO: 117046

SEQ ID NO: 573537 - RNA, 64 nt, Homo Sapiens; identical to SEQ ID NO: 117047

SEQ ID NO: 573538 - RNA, 64 nt, Homo Sapiens; identical to SEQ ID NO: 117048

SEQ ID NO: 573539 - RNA, 64 nt, Homo Sapiens; identical to SEQ ID NO: 117049

SEQ ID NO: 573540 - RNA, 64 nt, Homo Sapiens
ugauuguaugaaguuuuaaaaaaaacuacagcagccaaagaaacuauauauauauauauauaua

SEQ ID NO: 573541 - RNA, 64 nt, Homo Sapiens
uauuuucagaucucucaaaaaucacaucauuugaccaaagaauaauuuaagacacauagaacag

SEQ ID NO: 573542 - RNA, 64 nt, Homo Sapiens
cugggaauaucauagaguaacaagugcuggucagccaaagaaacauucacugcuggugaaccaa

SEQ ID NO: 573543 - RNA, 64 nt, Homo Sapiens
agaaaggacagaauuaaccaaauacaucauguggccaaagaauguuuacauaugaagguuuaaa

SEQ ID NO: 573544 - RNA, 64 nt, Homo Sapiens
auaaacuagcagaggacauuacagucaaugcaugccaaagaaccaauauuacuuaaaaaguaga

SEQ ID NO: 573545 - RNA, 64 nt, Homo Sapiens
uaauguaaauuaaauccacuacaugccucccccaccaaagaauaucucucuccccuucucauac

SEQ ID NO: 573546 - RNA, 64 nt, Homo Sapiens
auagauauuuuucaugaugauccucaacugagacccaaagaauucaaaagcuaaaauaguucac

SEQ ID NO: 573547 - RNA, 64 nt, Homo Sapiens
uuuauuuuuccucauuucucaugggcaacagaggccaaagaaacgaagcaagacaaacagcaaa

SEQ ID NO: 573548 - RNA, 64 nt, Homo Sapiens
uguaccuccuccaugucugucugcguguuuuccaccaaagaaugcaaagcagacuuccaggugu

SEQ ID NO: 573549 - RNA, 64 nt, Homo Sapiens
cuuuucagcuuauuaaguagcucuuugguaaacaccaaagaaguuucugauagugucugcacaa

SEQ ID NO: 573550 - RNA, 64 nt, Homo Sapiens
aaccaacauuuggugaggaauuagcaauuucuugccaaagaaaauugauucugcccaauuauuu

SEQ ID NO: 573551 - RNA, 64 nt, Homo Sapiens
gaagggcacauuuaucuaggggcauuucagguuuccaaagaaaggaauguaugccugggaaaga

SEQ ID NO: 573552 - RNA, 64 nt, Homo Sapiens
aaagccuuuauugacuaauugauuuaaccucaguccaaagaacagucucuauacuugcccucau

SEQ ID NO: 573553 - RNA, 64 nt, Homo Sapiens
aaggguggaggguaaucucuacuuuccuauacugccaaagaaugugaggaagaaaugggacucu

SEQ ID NO: 573554 - RNA, 64 nt, Homo Sapiens
uguugccagcuaugccuuugagaaccucgggaucccaaagaaugaggggaauuucuucagaaag

SEQ ID NO: 573555 - RNA, 64 nt, Homo Sapiens
aguugaauuaaacauuuucaaugacuacuacauuccaaagaaacuguaacuuaaauuccaaacu

SEQ ID NO: 573556 - RNA, 64 nt, Homo Sapiens
uuugguugguuuugguggaugccuaugaauuaacccaaagaagcagcaaauaucuuaccaggca

SEQ ID NO: 573557 - RNA, 64 nt, Homo Sapiens
augaagcuugugaguagagcaaacaaacguuuuuccaaagaauucacagugcuccuuugcaauu

SEQ ID NO: 573558 - RNA, 64 nt, Homo Sapiens
guuaguaaucccucacuuuaauaccucuuaggaaccaaagaaugccucuacaagcaaaaagaua

SEQ ID NO: 573559 - RNA, 64 nt, Homo Sapiens
aaguccacccuugguuccuaaaagggccaaagaaccaaagaagaugccccagcuggggaaauca

SEQ ID NO: 573560 - RNA, 64 nt, Homo Sapiens
aaagaagaaaguccacccuuggaaaucaaaagggccaaagaaccccuuacccugccccagcugg

SEQ ID NO: 573561 - RNA, 64 nt, Homo Sapiens
cacugcauguaaaagauguaaacgauuaagucuaccaaagaacacaaauucuguaauuucacuc

SEQ ID NO: 573562 - RNA, 64 nt, Homo Sapiens
uuaaaauacuucaauccuggaaucuuuuaaguauccaaagaauaaauuacaugauuaugauacu

SEQ ID NO: 573563 - RNA, 64 nt, Homo Sapiens
cugaaauauauaguaaaugcggggagaaccccaaccaaagaaauaagaaauauuaauaccacau

SEQ ID NO: 573564 - RNA, 64 nt, Homo Sapiens
auccaagcaauaaaguggaaaaccuuaaccaacaccaaagaaacuaaagcaaaaagcaggccac

SEQ ID NO: 573565 - RNA, 64 nt, Homo Sapiens
auuuuguaaugugguuuaacauccuuguuguuugccaaagaaauuucauuuggcugugaauauu

SEQ ID NO: 573566 - RNA, 64 nt, Homo Sapiens
cucuguuucugcaggggaugauauuggugaguugccaaagaagcaauacagcauaucugcuuuu

SEQ ID NO: 573567 - RNA, 64 nt, Homo Sapiens
agaauuucugaugauuuggguucuuuuccauaguccaaagaaacagaucagcucuucagguauc

SEQ ID NO: 573568 - RNA, 64 nt, Homo Sapiens
ggucccagaacaaggaagucacuuuucaguggauccaaagaaucuacuccuuaaaccuggagaa

SEQ ID NO: 573569 - RNA, 64 nt, Homo Sapiens
uuccucuaaagaugucuuuauguuuccuucauucccaaagaauauuuuuguggaauauaagauu

SEQ ID NO: 573570 - RNA, 64 nt, Homo Sapiens
guacaccuucuguuucuuugcuuauuuuuuaacgccaaagaaagacucucagagaauagacaac

SEQ ID NO: 573571 - RNA, 64 nt, Homo Sapiens
uaccugcacucaaaccaggaugaggugcccucccccaaagaaugaggguauaaaugcauguucc

SEQ ID NO: 573572 - RNA, 64 nt, Homo Sapiens
ccgccaacacgcacaccuccccuuuugcuuccagccaaagaacaccccgaucccgccagaacgg

SEQ ID NO: 573573 - RNA, 64 nt, Homo Sapiens
aaauggagaguagugagcaaaacaucagauuucaccaaagaaccaaagugacuccacaauuggg

SEQ ID NO: 573574 - RNA, 64 nt, Homo Sapiens
ggggaaacugcacuuagacugacagaauugaacaccaaagaauuugcuggcuuccaaauugggc

SEQ ID NO: 573575 - RNA, 64 nt, Homo Sapiens
uagaggggguggggagguaaauuccucugacuugccaaagaaaaagaagggaaccacaguggau

SEQ ID NO: 573576 - RNA, 64 nt, Homo Sapiens
uggcauuccugaauaauuuccaaauguuuuuaauccaaagaaaaagguuuaaagcuuauuuccc

SEQ ID NO: 573577 - RNA, 64 nt, Homo Sapiens; identical to SEQ ID NO: 208972

SEQ ID NO: 573578 - RNA, 64 nt, Homo Sapiens; identical to SEQ ID NO: 208973

SEQ ID NO: 573579 - RNA, 64 nt, Homo Sapiens; identical to SEQ ID NO: 208974

SEQ ID NO: 573580 - RNA, 64 nt, Homo Sapiens; identical to SEQ ID NO: 208975

SEQ ID NO: 573581 - RNA, 64 nt, Homo Sapiens; identical to SEQ ID NO: 208976

SEQ ID NO: 573582 - RNA, 64 nt, Homo Sapiens; identical to SEQ ID NO: 208977

SEQ ID NO: 573583 - RNA, 64 nt, Homo Sapiens; identical to SEQ ID NO: 208978

SEQ ID NO: 573584 - RNA, 64 nt, Homo Sapiens; identical to SEQ ID NO: 208979

SEQ ID NO: 573585 - RNA, 64 nt, Homo Sapiens; identical to SEQ ID NO: 208980

SEQ ID NO: 573586 - RNA, 64 nt, Homo Sapiens; identical to SEQ ID NO: 208981

SEQ ID NO: 573587 - RNA, 64 nt, Homo Sapiens; identical to SEQ ID NO: 208982

SEQ ID NO: 573588 - RNA, 64 nt, Homo Sapiens; identical to SEQ ID NO: 208983

SEQ ID NO: 573589 - RNA, 64 nt, Homo Sapiens; identical to SEQ ID NO: 208984

SEQ ID NO: 573590 - RNA, 64 nt, Homo Sapiens; identical to SEQ ID NO: 208985

SEQ ID NO: 573591 - RNA, 64 nt, Homo Sapiens; identical to SEQ ID NO: 208986

SEQ ID NO: 573592 - RNA, 64 nt, Homo Sapiens; identical to SEQ ID NO: 208987

SEQ ID NO: 573593 - RNA, 64 nt, Homo Sapiens; identical to SEQ ID NO: 208988

SEQ ID NO: 573594 - RNA, 64 nt, Homo Sapiens; identical to SEQ ID NO: 208989

SEQ ID NO: 573595 - RNA, 64 nt, Homo Sapiens; identical to SEQ ID NO: 208990

SEQ ID NO: 573596 - RNA, 64 nt, Homo Sapiens; identical to SEQ ID NO: 208991

SEQ ID NO: 573597 - RNA, 64 nt, Homo Sapiens; identical to SEQ ID NO: 208992

SEQ ID NO: 573598 - RNA, 64 nt, Homo Sapiens; identical to SEQ ID NO: 208993

SEQ ID NO: 573599 - RNA, 64 nt, Homo Sapiens; identical to SEQ ID NO: 208994

SEQ ID NO: 573600 - RNA, 64 nt, Homo Sapiens; identical to SEQ ID NO: 208995

SEQ ID NO: 573601 - RNA, 64 nt, Homo Sapiens; identical to SEQ ID NO: 208996

SEQ ID NO: 573602 - RNA, 64 nt, Homo Sapiens; identical to SEQ ID NO: 208997

SEQ ID NO: 573603 - RNA, 64 nt, Homo Sapiens; identical to SEQ ID NO: 208998

SEQ ID NO: 573604 - RNA, 64 nt, Homo Sapiens; identical to SEQ ID NO: 208999

SEQ ID NO: 573605 - RNA, 64 nt, Homo Sapiens; identical to SEQ ID NO: 209000

SEQ ID NO: 573606 - RNA, 64 nt, Homo Sapiens; identical to SEQ ID NO: 209001

SEQ ID NO: 573607 - RNA, 64 nt, Homo Sapiens; identical to SEQ ID NO: 209002

SEQ ID NO: 573608 - RNA, 64 nt, Homo Sapiens; identical to SEQ ID NO: 209003

SEQ ID NO: 573609 - RNA, 64 nt, Homo Sapiens; identical to SEQ ID NO: 209004

SEQ ID NO: 573610 - RNA, 64 nt, Homo Sapiens; identical to SEQ ID NO: 209005

SEQ ID NO: 573611 - RNA, 64 nt, Homo Sapiens; identical to SEQ ID NO: 209006

SEQ ID NO: 573612 - RNA, 64 nt, Homo Sapiens; identical to SEQ ID NO: 209007

SEQ ID NO: 573613 - RNA, 64 nt, Homo Sapiens; identical to SEQ ID NO: 209008

SEQ ID NO: 573614 - RNA, 64 nt, Homo Sapiens; identical to SEQ ID NO: 209009

SEQ ID NO: 573615 - RNA, 64 nt, Homo Sapiens; identical to SEQ ID NO: 209010

SEQ ID NO: 573616 - RNA, 64 nt, Homo Sapiens; identical to SEQ ID NO: 209011

SEQ ID NO: 573617 - RNA, 64 nt, Homo Sapiens; identical to SEQ ID NO: 209012

SEQ ID NO: 573618 - RNA, 64 nt, Homo Sapiens; identical to SEQ ID NO: 209013

SEQ ID NO: 573619 - RNA, 64 nt, Homo Sapiens; identical to SEQ ID NO: 209014

SEQ ID NO: 573620 - RNA, 64 nt, Homo Sapiens; identical to SEQ ID NO: 209015

SEQ ID NO: 573621 - RNA, 64 nt, Homo Sapiens; identical to SEQ ID NO: 209016

SEQ ID NO: 573622 - RNA, 64 nt, Homo Sapiens; identical to SEQ ID NO: 209017

SEQ ID NO: 573623 - RNA, 64 nt, Homo Sapiens; identical to SEQ ID NO: 209018

SEQ ID NO: 573624 - RNA, 64 nt, Homo Sapiens; identical to SEQ ID NO: 209019

SEQ ID NO: 573625 - RNA, 64 nt, Homo Sapiens; identical to SEQ ID NO: 209020

SEQ ID NO: 573626 - RNA, 64 nt, Homo Sapiens; identical to SEQ ID NO: 209021

SEQ ID NO: 573627 - RNA, 61 nt, Homo Sapiens
cauugguggcagaugugagcgacaucaggcgcuuccucagugcauuucacgagccacaggu

SEQ ID NO: 573628 - RNA, 61 nt, Homo Sapiens
aaccuccgccucucagguucaagugguucuccuuccucagccucccaaguagcugggauua

SEQ ID NO: 573629 - RNA, 61 nt, Homo Sapiens
uuaguuuuuaaaauauuccguggucaaaauucuuccucacuauaauugguauuuacuuuua

SEQ ID NO: 573630 - RNA, 61 nt, Homo Sapiens
aggagggaacagaccauggaaauuuaaacgacuuccucacggucacagaacuaguuuuuua

SEQ ID NO: 573631 - RNA, 61 nt, Homo Sapiens
caggcaacgagugggccacaucucacuucugcuuccucaucucagcccacucugaaaaugu

SEQ ID NO: 573632 - RNA, 61 nt, Homo Sapiens
uccucccccagcuccagggcuccuggauguccuuccucaacucccuccaccccuagacaau

SEQ ID NO: 573633 - RNA, 61 nt, Homo Sapiens
ucuccgucucuuuuuuuucacauccuucugucuuccucaauucccuucccuccuccuuccu

SEQ ID NO: 573634 - RNA, 61 nt, Homo Sapiens
cuucugucuuccucaauucucuucccuccuccuuccucaucguuaaccuuccaccuccucc

SEQ ID NO: 573635 - RNA, 61 nt, Homo Sapiens
gaagaagugccucgggguugcacaaaguguucuuccucauguugagcugccaaagaagggu

SEQ ID NO: 573636 - RNA, 61 nt, Homo Sapiens
caaacugguccauuagauucugacuucaagccuuccucaacuggugcaucucagaugcacu

SEQ ID NO: 573637 - RNA, 61 nt, Homo Sapiens
ucuggaauuuggccaggcaggucacucgccccuuccucauccuccagccaccccuacccca

SEQ ID NO: 573638 - RNA, 61 nt, Homo Sapiens
uucccuucccuccaccucucccuaaacgacccuuccucacagcucaaccaguauuuauuuc

SEQ ID NO: 573639 - RNA, 61 nt, Homo Sapiens
uauuuccguguucuuaccuagccuccccccacuuccucaaaacaaacaagagauggcaaag

SEQ ID NO: 573640 - RNA, 61 nt, Homo Sapiens
aagaugaaaagacaacaaaaguaucuucauacuuccucauccccucauugcaacaaaaccu

SEQ ID NO: 573641 - RNA, 61 nt, Homo Sapiens
uagacuugaaaugucuccacauuuuggaggacuuccucagcccuuuucauugagggaaaau

SEQ ID NO: 573642 - RNA, 61 nt, Homo Sapiens
uuugugaaaauagaguuuugguaaucacuuucuuccucaaaauaaguccuucuguuaauuu

SEQ ID NO: 573643 - RNA, 61 nt, Homo Sapiens
gguuuguguugcuaagcaaauuauuuuguagcuuccucacuguuugcuauuuuuguuuaac

SEQ ID NO: 573644 - RNA, 61 nt, Homo Sapiens
ugucuguaaauaacucugguaaaacuaggaucuuccucagaauauuuuccugacagacuug

SEQ ID NO: 573645 - RNA, 61 nt, Homo Sapiens
caauggguggccuugugacuuucuccaaugacuuccucaacgccagauuccgaaacuccca

SEQ ID NO: 573646 - RNA, 61 nt, Homo Sapiens
cugggaaaacugagaaaaccgcauugaggagcuuccucauuucaaaguaguuccuauaggg

SEQ ID NO: 573647 - RNA, 61 nt, Homo Sapiens
ucccaccucaccugagagccauugaauuugccuuccucaugaauuaaaaccucccccaagc

SEQ ID NO: 573648 - RNA, 61 nt, Homo Sapiens
ccucaugaauuaaaaccucccccaagcagagcuuccucagagaaagugguucuaugaugac

SEQ ID NO: 573649 - RNA, 61 nt, Homo Sapiens
gggcaccugaaagaaauuagcaugaugcagucuuccucaugccccaagugaguggaaguga

SEQ ID NO: 573650 - RNA, 56 nt, Homo Sapiens; identical to SEQ ID NO: 217988

SEQ ID NO: 573651 - RNA, 61 nt, Homo Sapiens
cccuacagauuugcaggcugggaaggcuagacuuccucagcccgagggcugcccuuccaaa

SEQ ID NO: 573652 - RNA, 61 nt, Homo Sapiens
gaggucugagcagggccuggccuuuccuccucuuccucacccucauccuuugggaggcuga

SEQ ID NO: 573653 - RNA, 61 nt, Homo Sapiens
aaagagaggaaccaauaccuucaaggcucuucuuccucaccgagcaugcuucccuaggauc

SEQ ID NO: 573654 - RNA, 61 nt, Homo Sapiens
agugacaaagccucugaaagaugcaucaucucuuccucacacccauuuagugggggauggg

SEQ ID NO: 573655 - RNA, 61 nt, Homo Sapiens
acugacuauuuuaucaaauucacacuauauacuuccucaccgaauauauuaaauccacaaa

SEQ ID NO: 573656 - RNA, 61 nt, Homo Sapiens
uggaaggcagcuuuucagaaaaaauuagucacuuccucacacccuuuauagugugaaauga

SEQ ID NO: 573657 - RNA, 61 nt, Homo Sapiens
aucacaugguucaggacagaagaugaagugacuuccucaaaagauaaucugaagcucacaa

SEQ ID NO: 573658 - RNA, 61 nt, Homo Sapiens
gucuguagccaucugauauccugccuaauuccuuccucacagaagaucuguccugcaccau

SEQ ID NO: 573659 - RNA, 61 nt, Homo Sapiens
agaacagucucguagcugcaguucagcugugcuuccucagccuacuaucauaggcuuccuc

SEQ ID NO: 573660 - RNA, 61 nt, Homo Sapiens
cagcugugcuuccucagccuacuaucauaggcuuccucagcccucugucauauggcuguuu

SEQ ID NO: 573661 - RNA, 61 nt, Homo Sapiens
aaggguagcaaaggccaaugucuucuagcugcuuccucaaccccuguccccuggagaccag

SEQ ID NO: 573662 - RNA, 61 nt, Homo Sapiens
cuuuaauggguauaauuuccuggcugccucccuuccucagcccauuagguuaaacaccaaa

SEQ ID NO: 573663 - RNA, 61 nt, Homo Sapiens
cccucauuggaacaaaaccuauaucuucauacuuccucaucaagaugaaaagacaacaaaa

SEQ ID NO: 573664 - RNA, 61 nt, Homo Sapiens
acaaacaagagauggcaaaggccucccccgacuuccucaaauauuacccuauucuuaccua

SEQ ID NO: 573665 - RNA, 61 nt, Homo Sapiens
caccgccacugggccugucauuuuguauucucuuccucaucgagauuuuaaagacguuccc

SEQ ID NO: 573666 - RNA, 61 nt, Homo Sapiens
uuucagcagugcagccgggguggagccaucucuuccucauagccuggccagcaccccacac

SEQ ID NO: 573667 - RNA, 61 nt, Homo Sapiens
cgacgacugcaaaguguaugcacaccgcaugcuuccucauccacauagugccagcagcagu

SEQ ID NO: 573668 - RNA, 61 nt, Homo Sapiens
guuucuuagcuuggggagaugauggacuuagcuuccucaagauaaauuucuaguuuauuaa

SEQ ID NO: 573669 - RNA, 61 nt, Homo Sapiens
ucauuauaaucuguauugacuuaaaaaguuucuuccucaugaugcuaauaguuuuuuguau

SEQ ID NO: 573670 - RNA, 61 nt, Homo Sapiens
aaggucagugaagucuaucaaucauucuccccuuccucaucagcaaugguagauagaaaug

SEQ ID NO: 573671 - RNA, 61 nt, Homo Sapiens
gggucuguccccgucauuucccgugaacauccuuccucaucagugggaagugugaagguga

SEQ ID NO: 573672 - RNA, 61 nt, Homo Sapiens
gggaccccuucaucuguugggcccuccccugcuuccucagcccaccguuguguccgagccc

SEQ ID NO: 573673 - RNA, 61 nt, Homo Sapiens
ccuccucugacccacccaugggcccgcucaccuuccucacccuccaccccugcagccuccu

SEQ ID NO: 573674 - RNA, 61 nt, Homo Sapiens
gcccgucggguuguggcaucagauaaucgugcuuccucagcuucaacaguggcuuuuucuu

SEQ ID NO: 573675 - RNA, 61 nt, Homo Sapiens
cacuguguuuccucugcacuguucccuuccacuuccucauccucuuugugacauggaaguu

SEQ ID NO: 573676 - RNA, 61 nt, Homo Sapiens
uagauauaaaaaugauugugcccuaaccaaacuuccucagauugugcacuguuuguuuaaa

SEQ ID NO: 573677 - RNA, 61 nt, Homo Sapiens
gcacucugcuucuuccguuccagcccucucucuuccucaaucaggggugagccaccgcacc

SEQ ID NO: 573678 - RNA, 61 nt, Homo Sapiens
cucgagccucagucucccguacggcagaugccuuccucagucucaggagcuccaaccccgg

SEQ ID NO: 573679 - RNA, 61 nt, Homo Sapiens
acugaccaucucucacuguccuccccaccuucuuccucacucacacauuuuuuguacaucu

SEQ ID NO: 573680 - RNA, 61 nt, Homo Sapiens
uagccggggcagacacccagcuggcuggguccuuccucagccuugccuccuccugucccca

SEQ ID NO: 573681 - RNA, 61 nt, Homo Sapiens
uaaaauucuuauuuaaccuuccucccuucaucuuccucacccuuuuuacaguggaagaaag

SEQ ID NO: 573682 - RNA, 61 nt, Homo Sapiens
cuuuuccaauccuaguugucuaccuucuuuucuuccucauuuccuucuuuuauuccucccc

SEQ ID NO: 573683 - RNA, 64 nt, Homo Sapiens
aaccuucauaaagcaggucagcguggccugauugucccaggaccugaagggagcaaggauggcc

SEQ ID NO: 573684 - RNA, 64 nt, Homo Sapiens
ucagcuugggaaugauggcugccaacucccaaucucccaggaaggcagggggcagaaucuuuuu

SEQ ID NO: 573685 - RNA, 64 nt, Homo Sapiens
gacuccccuuucccuucccaaagaggauaggaccucccaggaugcuucccagccucuccucagu

SEQ ID NO: 573686 - RNA, 64 nt, Homo Sapiens
caaagggugugccucguccugcccgcacugccucucccaggaacuggaaaagcccuguccggug

SEQ ID NO: 573687 - RNA, 64 nt, Homo Sapiens
acaguguuucaagagacccuaaaaaaccugccugucccaggacccuaugguaaugaacaccaaa

SEQ ID NO: 573688 - RNA, 64 nt, Homo Sapiens
cuccugcuucccuuaccagucgugcaccgcugacucccaggaagucuuuccugaagucugacca

SEQ ID NO: 573689 - RNA, 64 nt, Homo Sapiens
uggcuauuagguaugucuugggauguugcauugcucccaggaacuuuauccagcaaugccucaa

SEQ ID NO: 573690 - RNA, 64 nt, Homo Sapiens
agggacacuccagccccccucucucuggcuggccucccaggaggccaccucccaaccugaugac

SEQ ID NO: 573691 - RNA, 64 nt, Homo Sapiens
cuuugauuuuuaccguuucuaggcuacaauuuucucccaggaagggggaaagaugagcuuuucu

SEQ ID NO: 573692 - RNA, 64 nt, Homo Sapiens
aaucgauggccuugcagcacaggucuggagaagcucccaggaaccgugugacgggggaaagcca

SEQ ID NO: 573693 - RNA, 64 nt, Homo Sapiens
uguccaggccaggcacaguggcucacaccuguaaucccaggacuucgggaggcugaggcuggag

SEQ ID NO: 573694 - RNA, 64 nt, Homo Sapiens
guccaagaggaguaaaggucaugacagaauuuacucccaggacaaucuaaguucugccacaagu

SEQ ID NO: 573695 - RNA, 64 nt, Homo Sapiens
ggaccugccccugaccaaugauacccacaccuccucccaggaagacugcccaggccuuuguuag

SEQ ID NO: 573696 - RNA, 64 nt, Homo Sapiens
cccccugccugauccccugcuggcugggggcagcucccaggauauccugccuuccaacuguuuc

SEQ ID NO: 573697 - RNA, 64 nt, Homo Sapiens
ggccagcccaguccauggccccuccuucccccuuucccaggaaaccugcuaggccccaguucuu

SEQ ID NO: 573698 - RNA, 64 nt, Homo Sapiens
ggaauacugagugggagaucggucugggugggucucccaggagauggcugccaggggccugcag

SEQ ID NO: 573699 - RNA, 64 nt, Homo Sapiens
uugcccugcuaggaauuagaagacagacaccaugucccaggacaguguuacuucuucugcauga

SEQ ID NO: 573700 - RNA, 64 nt, Homo Sapiens
gaaugcugauucagagugcaccucuuugacuaggucccaggauccccuugucccuggaguaggg

SEQ ID NO: 573701 - RNA, 64 nt, Homo Sapiens
ugugauagagcaggccacaccagaucuguaauucucccaggagcgcccagagaugcccugggcu

SEQ ID NO: 573702 - RNA, 64 nt, Homo Sapiens
ccagacugcaauaacuggagggaauuccugguguucccaggacacagcucccacaaggguucca

SEQ ID NO: 573703 - RNA, 64 nt, Homo Sapiens
ucggcugccuuuuccucuauuaaagcugcucgauucccaggaucaguuccuggcccguggaugu

SEQ ID NO: 573704 - RNA, 64 nt, Homo Sapiens
ucaggaggaggaccccagggcauugaccaucuggucccaggagccccagccagacacucauucc

SEQ ID NO: 573705 - RNA, 64 nt, Homo Sapiens
uagcgucucugcacgugaccucugacaaagcccaucccaggagacggggugaagcuauucccca

SEQ ID NO: 573706 - RNA, 64 nt, Homo Sapiens
agucuugcaagacccagggagaacccacugcuuuucccaggaggcuccaggauuaggaaaugug

SEQ ID NO: 573707 - RNA, 64 nt, Homo Sapiens
auggggaccaggaaggcugucuccuccaaggaagucccaggaggucccaccugccugggcgaau

SEQ ID NO: 573708 - RNA, 64 nt, Homo Sapiens
aacauuccagccccacccuccuaggggacccucaucccaggaacugagggcugagucugguucc

SEQ ID NO: 573709 - RNA, 64 nt, Homo Sapiens
cacuuugggaagccaaggugggcugaucacuugaucccaggaguuugagaccagccugggcacc

SEQ ID NO: 573710 - RNA, 64 nt, Homo Sapiens
caacuauuggggaggcuaagguaggaucacuugaucccaggaggcggagguugcagugaguugc

SEQ ID NO: 573711 - RNA, 64 nt, Homo Sapiens
ccacaacaaaauucuuaucuaagagugcaucuccucccaggauugcuaauaagagguuggguga

SEQ ID NO: 573712 - RNA, 64 nt, Homo Sapiens
cuugcgugccagagacgccauuuccauugcucugucccaggacacucauucucaugccuguagg

SEQ ID NO: 573713 - RNA, 64 nt, Homo Sapiens
ugccuucauucaggcggguaucacaccucacaugucccaggagccuggaucuuccccccacucc

SEQ ID NO: 573714 - RNA, 64 nt, Homo Sapiens
cagcucuccccacacagcagucacugcauggaugucccaggaggcaugcugguggccuucugaa

SEQ ID NO: 573715 - RNA, 64 nt, Homo Sapiens
ucggaugaccauacucagacuucaaaaaacucucucccaggaccugcauuuucuaagugggaca

SEQ ID NO: 573716 - RNA, 64 nt, Homo Sapiens
ugcuccaacagaauauugcuagccaucaagcacuucccaggaucuauagcaacucauugguggu

SEQ ID NO: 573717 - RNA, 64 nt, Homo Sapiens
gcagagguggcagugagcugggagaaucgcuugaucccaggaagcuacuugggaggcugaggca

SEQ ID NO: 573718 - RNA, 64 nt, Homo Sapiens
cagcugcugacagguuugcuuaagggggugguugucccaggaggucugguagauagauagcaug

SEQ ID NO: 573719 - RNA, 64 nt, Homo Sapiens
cguccagcccggggcagucugacugucggugcccucccaggaacggggaaggccuccgucugug

SEQ ID NO: 573720 - RNA, 64 nt, Homo Sapiens
agaaaccuacaaaaugucaaaccagcuucccgacucccaggagcucaagccaagcccagaggca

SEQ ID NO: 573721 - RNA, 64 nt, Homo Sapiens
uuuugcagcaguguaauaaagucaauuaaaaacuucccaggauuucuuuggacccaggaaacag

SEQ ID NO: 573722 - RNA, 64 nt, Homo Sapiens
uguggguccuuucugugcacuaugaacgcuucuuucccaggacagaaaauguguagucuaccuu

SEQ ID NO: 573723 - RNA, 63 nt, Homo Sapiens
ucugggaaggagggacuguucugccgaacacacaucccaggagcuccuccuggacuccccucc

SEQ ID NO: 573724 - RNA, 64 nt, Homo Sapiens
ugcagacuucuuaaaaggagggagaauccucccuucccaggagggugggcugucacugcuugag

SEQ ID NO: 573725 - RNA, 64 nt, Homo Sapiens
agcagccacaagggcagggcugagacccgcaggcucccaggaccugugugcacacaugcagagg

SEQ ID NO: 573726 - RNA, 64 nt, Homo Sapiens
gccuugggggugaugaccccaggguccugaggccucccaggaggaccaauuucccagggacucc

SEQ ID NO: 573727 - RNA, 64 nt, Homo Sapiens
uugggcaagucacccgcacugagccuugccaccaucccaggacuaggguggggggagggcaccg

SEQ ID NO: 573728 - RNA, 64 nt, Homo Sapiens
caacugggccccguuucuagcagccagggaggggucccaggacuaggggaggacccugagggcu

SEQ ID NO: 573729 - RNA, 64 nt, Homo Sapiens
ggaaauaugucccccccuaauuggucuccauuuuucccaggacaacuacuuucuuaauaucacu

SEQ ID NO: 573730 - RNA, 64 nt, Homo Sapiens
uccagcuccuuaaacugacgagaugccaaggaggucccaggaaggccacuccaaucacccuaca

SEQ ID NO: 573731 - RNA, 64 nt, Homo Sapiens
agugaggagcugugcugauguaaguguccuucucucccaggaugucauuuuuuuggucacccuu

SEQ ID NO: 573732 - RNA, 64 nt, Homo Sapiens
ccagccccucuggccaggaccuagcccugcccccucccaggagcaguuggaggggugggcuucu

SEQ ID NO: 573733 - RNA, 64 nt, Homo Sapiens
ccuuagccgucugagugagcuguguaugaacaagucccaggaguuccaagagucuagagugguu

SEQ ID NO: 573734 - RNA, 64 nt, Homo Sapiens
ucugggcgguggcuucacuccugagucugcaaaaucccaggaaacuugggucuugcugcccauc

SEQ ID NO: 573735 - RNA, 64 nt, Homo Sapiens
cgccgcucccucaugcugccgggcuggaggcaggucccaggacgugaccacggccccaagccca

SEQ ID NO: 573736 - RNA, 64 nt, Homo Sapiens
ugcugcucccuugugugagugggcuggacgcaggucccaggacgugaccgcggccccgagccug

SEQ ID NO: 573737 - RNA, 64 nt, Homo Sapiens
ugcugcucccuugugugagugggcuggacgcaggucccaggacaugaccgcggccccgagccug

SEQ ID NO: 573738 - RNA, 64 nt, Homo Sapiens
uggccugggccuccucacaacauggugucuggauucccaggaugagcaucccaggaucgcaaga

SEQ ID NO: 573739 - RNA, 64 nt, Homo Sapiens
ucacaacauggugucuggauucccaggaugagcaucccaggaucgcaagagccauguagaagcu

SEQ ID NO: 573740 - RNA, 64 nt, Homo Sapiens
cagcuuuagcuuucuccaccagauaaccagcuaaucccaggaauuugcugccccccaccagugg

SEQ ID NO: 573741 - RNA, 64 nt, Homo Sapiens
agcauuuuuccccucugugcuggauacagacuucucccaggauccucucuuugggagcgaagcc

SEQ ID NO: 573742 - RNA, 64 nt, Homo Sapiens
ugucagcuucggaagcaucucucgaggacucuggucccaggaugucucccaggacaagccaguc

SEQ ID NO: 573743 - RNA, 64 nt, Homo Sapiens
aagcaucucucgaggacucuggucccaggaugucucccaggacaagccagucugccucuuccuc

SEQ ID NO: 573744 - RNA, 64 nt, Homo Sapiens
ggcuuggaagggacuucucccgcaccccacucugucccaggacauagggcagggggccucacug

SEQ ID NO: 573745 - RNA, 64 nt, Homo Sapiens
gcaggacccuuggcaggcaagccccucccuucacucccaggaccuaccuucugcuaguaaagga

SEQ ID NO: 573746 - RNA, 64 nt, Homo Sapiens
accaggcgcccagcccugcggaggaggccggggcucccaggaagcggacgcccgguccccacac

SEQ ID NO: 573747 - RNA, 64 nt, Homo Sapiens
guagugacauuggugagacaacagcccuaacacuucccaggaacugaagugccucaugugauug

SEQ ID NO: 573748 - RNA, 64 nt, Homo Sapiens
cugugaauggcuguucuccccucacugcugagucucccaggacccccuuuggagaugcccaugg

SEQ ID NO: 573749 - RNA, 64 nt, Homo Sapiens
gggagcuggacuucagggagccugagugaugcuuucccaggagcagggcagcuggcuggaccag

SEQ ID NO: 573750 - RNA, 64 nt, Homo Sapiens
gaggacaccgggaggcuguuagggggucacugaaucccaggagccaaccucccccuuugcaggg

SEQ ID NO: 573751 - RNA, 64 nt, Homo Sapiens
ggaaagcuuugagaguuuauguuuacucuuugagucccaggagaagccuggcacccucuuugca

SEQ ID NO: 573752 - RNA, 64 nt, Homo Sapiens
gcgauggugccuggucucugaguaagaugccaggucccaggaacucaggcuucaggugagaagg

SEQ ID NO: 573753 - RNA, 64 nt, Homo Sapiens
cuuaagaaggucgccuaagccuaagagaagacagucccaggagaagcuggccgggaccagccag

SEQ ID NO: 573754 - RNA, 64 nt, Homo Sapiens
caguucaagaaagcuucaaaaagagacaaacaccucccaggagaagguugcucuagauugagag

SEQ ID NO: 573755 - RNA, 64 nt, Homo Sapiens
ugggccaacucaccugagucuccuaguuuucuccucccaggaacccccacuuauuccccauucu

SEQ ID NO: 573756 - RNA, 64 nt, Homo Sapiens
ccagcaggugccucgauucccugcccuugugaccucccaggaaacagaacugaucugggacacu

SEQ ID NO: 573757 - RNA, 64 nt, Homo Sapiens
gauucucuaaggagcacgaaagggggaaugccccucccaggaguuuaugggagaagggacuggg

SEQ ID NO: 573758 - RNA, 64 nt, Homo Sapiens
ugacgaggcaggggcuccaggaccuugagacgcaucccaggagguccuccacuacaaccuccau

SEQ ID NO: 573759 - RNA, 64 nt, Homo Sapiens
ugagaagggccugcucacccggaaugacccucuaucccaggaccaggggcugcaccuuccccca

SEQ ID NO: 573760 - RNA, 64 nt, Homo Sapiens
auuugagggguuccggugauuuuuuguuugaaguucccaggaauggucucuuuguugcuauguu

SEQ ID NO: 573761 - RNA, 64 nt, Homo Sapiens
guucuaggugggaccccgucuggggcuggcauccucccaggaagaaagggugucugaugugggg

SEQ ID NO: 573762 - RNA, 64 nt, Homo Sapiens
cagaaugcuuuuaaauuuuccagggccuuucuccucccaggaucugggaaagcuugggaaccac

SEQ ID NO: 573763 - RNA, 64 nt, Homo Sapiens
aacaggagaaucugggcccuaggagcccuguaacucccaggagagaccacugaaaauacuggag

SEQ ID NO: 573764 - RNA, 64 nt, Homo Sapiens
uuuggggcaagugaguuaggccaacauccucucaucccaggacaacucaaagaaggccguguuu

SEQ ID NO: 573765 - RNA, 64 nt, Homo Sapiens
gggauuuaccugcccccuagguugagauucugccucccaggagagaucugaacuggaagcagag

SEQ ID NO: 573766 - RNA, 64 nt, Homo Sapiens
gagaaagagaagacaagagcugcuugagcaggguucccaggagggagggggcuuucuccccuuu

SEQ ID NO: 573767 - RNA, 64 nt, Homo Sapiens
aaaagccaagcaagagguugauggcuauauacccucccaggagugggagggugcugggccugac

SEQ ID NO: 573768 - RNA, 64 nt, Homo Sapiens; identical to SEQ ID NO: 260343

SEQ ID NO: 573769 - RNA, 64 nt, Homo Sapiens; identical to SEQ ID NO: 260344

SEQ ID NO: 573770 - RNA, 64 nt, Homo Sapiens; identical to SEQ ID NO: 260345

SEQ ID NO: 573771 - RNA, 64 nt, Homo Sapiens; identical to SEQ ID NO: 260346

SEQ ID NO: 573772 - RNA, 64 nt, Homo Sapiens; identical to SEQ ID NO: 260347

SEQ ID NO: 573773 - RNA, 64 nt, Homo Sapiens; identical to SEQ ID NO: 260348

SEQ ID NO: 573774 - RNA, 64 nt, Homo Sapiens; identical to SEQ ID NO: 260349

SEQ ID NO: 573775 - RNA, 64 nt, Homo Sapiens; identical to SEQ ID NO: 260350

SEQ ID NO: 573776 - RNA, 57 nt, Homo Sapiens; identical to SEQ ID NO: 260351

SEQ ID NO: 573777 - RNA, 64 nt, Homo Sapiens; identical to SEQ ID NO: 260352

SEQ ID NO: 573778 - RNA, 64 nt, Homo Sapiens; identical to SEQ ID NO: 260353

SEQ ID NO: 573779 - RNA, 64 nt, Homo Sapiens; identical to SEQ ID NO: 260354

SEQ ID NO: 573780 - RNA, 64 nt, Homo Sapiens; identical to SEQ ID NO: 260355

SEQ ID NO: 573781 - RNA, 64 nt, Homo Sapiens; identical to SEQ ID NO: 260356

SEQ ID NO: 573782 - RNA, 64 nt, Homo Sapiens; identical to SEQ ID NO: 260357

SEQ ID NO: 573783 - RNA, 64 nt, Homo Sapiens; identical to SEQ ID NO: 260358

SEQ ID NO: 573784 - RNA, 64 nt, Homo Sapiens; identical to SEQ ID NO: 260359

SEQ ID NO: 573785 - RNA, 64 nt, Homo Sapiens; identical to SEQ ID NO: 260360

SEQ ID NO: 573786 - RNA, 64 nt, Homo Sapiens; identical to SEQ ID NO: 260361

SEQ ID NO: 573787 - RNA, 64 nt, Homo Sapiens; identical to SEQ ID NO: 260362

SEQ ID NO: 573788 - RNA, 64 nt, Homo Sapiens; identical to SEQ ID NO: 260363

SEQ ID NO: 573789 - RNA, 64 nt, Homo Sapiens; identical to SEQ ID NO: 260364

SEQ ID NO: 573790 - RNA, 64 nt, Homo Sapiens; identical to SEQ ID NO: 260365

SEQ ID NO: 573791 - RNA, 64 nt, Homo Sapiens; identical to SEQ ID NO: 260366

SEQ ID NO: 573792 - RNA, 64 nt, Homo Sapiens; identical to SEQ ID NO: 260367

SEQ ID NO: 573793 - RNA, 64 nt, Homo Sapiens; identical to SEQ ID NO: 260368

SEQ ID NO: 573794 - RNA, 64 nt, Homo Sapiens; identical to SEQ ID NO: 260369

SEQ ID NO: 573795 - RNA, 64 nt, Homo Sapiens; identical to SEQ ID NO: 260370

SEQ ID NO: 573796 - RNA, 64 nt, Homo Sapiens; identical to SEQ ID NO: 260371

SEQ ID NO: 573797 - RNA, 64 nt, Homo Sapiens; identical to SEQ ID NO: 260372

SEQ ID NO: 573798 - RNA, 64 nt, Homo Sapiens; identical to SEQ ID NO: 260373

SEQ ID NO: 573799 - RNA, 64 nt, Homo Sapiens; identical to SEQ ID NO: 260374

SEQ ID NO: 573800 - RNA, 64 nt, Homo Sapiens; identical to SEQ ID NO: 260375

SEQ ID NO: 573801 - RNA, 64 nt, Homo Sapiens; identical to SEQ ID NO: 260376

SEQ ID NO: 573802 - RNA, 64 nt, Homo Sapiens; identical to SEQ ID NO: 260377

SEQ ID NO: 573803 - RNA, 64 nt, Homo Sapiens; identical to SEQ ID NO: 260378

SEQ ID NO: 573804 - RNA, 64 nt, Homo Sapiens; identical to SEQ ID NO: 260379

SEQ ID NO: 573805 - RNA, 64 nt, Homo Sapiens; identical to SEQ ID NO: 260380

SEQ ID NO: 573806 - RNA, 64 nt, Homo Sapiens; identical to SEQ ID NO: 260381

SEQ ID NO: 573807 - RNA, 64 nt, Homo Sapiens; identical to SEQ ID NO: 260382

SEQ ID NO: 573808 - RNA, 64 nt, Homo Sapiens; identical to SEQ ID NO: 260383

SEQ ID NO: 573809 - RNA, 64 nt, Homo Sapiens; identical to SEQ ID NO: 260384

SEQ ID NO: 573810 - RNA, 64 nt, Homo Sapiens; identical to SEQ ID NO: 260385

SEQ ID NO: 573811 - RNA, 64 nt, Homo Sapiens; identical to SEQ ID NO: 260386

SEQ ID NO: 573812 - RNA, 64 nt, Homo Sapiens; identical to SEQ ID NO: 260387

SEQ ID NO: 573813 - RNA, 64 nt, Homo Sapiens; identical to SEQ ID NO: 260388

SEQ ID NO: 573814 - RNA, 64 nt, Homo Sapiens; identical to SEQ ID NO: 260389

SEQ ID NO: 573815 - RNA, 64 nt, Homo Sapiens; identical to SEQ ID NO: 260390

SEQ ID NO: 573816 - RNA, 64 nt, Homo Sapiens; identical to SEQ ID NO: 260391

SEQ ID NO: 573817 - RNA, 64 nt, Homo Sapiens; identical to SEQ ID NO: 260392

SEQ ID NO: 573818 - RNA, 64 nt, Homo Sapiens; identical to SEQ ID NO: 260393

SEQ ID NO: 573819 - RNA, 64 nt, Homo Sapiens; identical to SEQ ID NO: 260394

SEQ ID NO: 573820 - RNA, 64 nt, Homo Sapiens; identical to SEQ ID NO: 260395

SEQ ID NO: 573821 - RNA, 64 nt, Homo Sapiens; identical to SEQ ID NO: 260396

SEQ ID NO: 573822 - RNA, 64 nt, Homo Sapiens; identical to SEQ ID NO: 260397

SEQ ID NO: 573823 - RNA, 64 nt, Homo Sapiens; identical to SEQ ID NO: 260398

SEQ ID NO: 573824 - RNA, 64 nt, Homo Sapiens; identical to SEQ ID NO: 260399

SEQ ID NO: 573825 - RNA, 64 nt, Homo Sapiens; identical to SEQ ID NO: 260400

SEQ ID NO: 573826 - RNA, 64 nt, Homo Sapiens; identical to SEQ ID NO: 260401

SEQ ID NO: 573827 - RNA, 64 nt, Homo Sapiens; identical to SEQ ID NO: 260402

SEQ ID NO: 573828 - RNA, 64 nt, Homo Sapiens; identical to SEQ ID NO: 260403

SEQ ID NO: 573829 - RNA, 64 nt, Homo Sapiens; identical to SEQ ID NO: 260404

SEQ ID NO: 573830 - RNA, 64 nt, Homo Sapiens; identical to SEQ ID NO: 260405

SEQ ID NO: 573831 - RNA, 64 nt, Homo Sapiens; identical to SEQ ID NO: 260406

SEQ ID NO: 573832 - RNA, 64 nt, Homo Sapiens; identical to SEQ ID NO: 260407

SEQ ID NO: 573833 - RNA, 64 nt, Homo Sapiens; identical to SEQ ID NO: 260408

SEQ ID NO: 573834 - RNA, 64 nt, Homo Sapiens; identical to SEQ ID NO: 260409

SEQ ID NO: 573835 - RNA, 64 nt, Homo Sapiens; identical to SEQ ID NO: 260410

SEQ ID NO: 573836 - RNA, 64 nt, Homo Sapiens; identical to SEQ ID NO: 260411

SEQ ID NO: 573837 - RNA, 64 nt, Homo Sapiens; identical to SEQ ID NO: 260412

SEQ ID NO: 573838 - RNA, 64 nt, Homo Sapiens; identical to SEQ ID NO: 260413

SEQ ID NO: 573839 - RNA, 64 nt, Homo Sapiens; identical to SEQ ID NO: 260414

SEQ ID NO: 573840 - RNA, 64 nt, Homo Sapiens; identical to SEQ ID NO: 260415

SEQ ID NO: 573841 - RNA, 64 nt, Homo Sapiens; identical to SEQ ID NO: 260416

SEQ ID NO: 573842 - RNA, 64 nt, Homo Sapiens; identical to SEQ ID NO: 260417

SEQ ID NO: 573843 - RNA, 64 nt, Homo Sapiens; identical to SEQ ID NO: 260418

SEQ ID NO: 573844 - RNA, 64 nt, Homo Sapiens; identical to SEQ ID NO: 260419

SEQ ID NO: 573845 - RNA, 64 nt, Homo Sapiens; identical to SEQ ID NO: 260420

SEQ ID NO: 573846 - RNA, 64 nt, Homo Sapiens; identical to SEQ ID NO: 260421

SEQ ID NO: 573847 - RNA, 64 nt, Homo Sapiens; identical to SEQ ID NO: 260422

SEQ ID NO: 573848 - RNA, 64 nt, Homo Sapiens; identical to SEQ ID NO: 260423

SEQ ID NO: 573849 - RNA, 64 nt, Homo Sapiens; identical to SEQ ID NO: 260424

SEQ ID NO: 573850 - RNA, 64 nt, Homo Sapiens; identical to SEQ ID NO: 260425

SEQ ID NO: 573851 - RNA, 64 nt, Homo Sapiens; identical to SEQ ID NO: 260426

SEQ ID NO: 573852 - RNA, 64 nt, Homo Sapiens; identical to SEQ ID NO: 260427

SEQ ID NO: 573853 - RNA, 64 nt, Homo Sapiens; identical to SEQ ID NO: 260428

SEQ ID NO: 573854 - RNA, 64 nt, Homo Sapiens; identical to SEQ ID NO: 260429

SEQ ID NO: 573855 - RNA, 64 nt, Homo Sapiens; identical to SEQ ID NO: 260430

SEQ ID NO: 573856 - RNA, 64 nt, Homo Sapiens; identical to SEQ ID NO: 260431

SEQ ID NO: 573857 - RNA, 64 nt, Homo Sapiens; identical to SEQ ID NO: 260432

SEQ ID NO: 573858 - RNA, 64 nt, Homo Sapiens; identical to SEQ ID NO: 260433

SEQ ID NO: 573859 - RNA, 64 nt, Homo Sapiens; identical to SEQ ID NO: 260434

SEQ ID NO: 573860 - RNA, 64 nt, Homo Sapiens; identical to SEQ ID NO: 260435

SEQ ID NO: 573861 - RNA, 64 nt, Homo Sapiens; identical to SEQ ID NO: 260436

SEQ ID NO: 573862 - RNA, 64 nt, Homo Sapiens; identical to SEQ ID NO: 260437

SEQ ID NO: 573863 - RNA, 64 nt, Homo Sapiens; identical to SEQ ID NO: 260438

SEQ ID NO: 573864 - RNA, 64 nt, Homo Sapiens; identical to SEQ ID NO: 260439

SEQ ID NO: 573865 - RNA, 64 nt, Homo Sapiens; identical to SEQ ID NO: 260440

SEQ ID NO: 573866 - RNA, 64 nt, Homo Sapiens; identical to SEQ ID NO: 260441

SEQ ID NO: 573867 - RNA, 64 nt, Homo Sapiens; identical to SEQ ID NO: 260442

SEQ ID NO: 573868 - RNA, 64 nt, Homo Sapiens; identical to SEQ ID NO: 260443

SEQ ID NO: 573869 - RNA, 64 nt, Homo Sapiens; identical to SEQ ID NO: 260444

SEQ ID NO: 573870 - RNA, 64 nt, Homo Sapiens; identical to SEQ ID NO: 260445

SEQ ID NO: 573871 - RNA, 64 nt, Homo Sapiens; identical to SEQ ID NO: 260446

SEQ ID NO: 573872 - RNA, 64 nt, Homo Sapiens; identical to SEQ ID NO: 260447

SEQ ID NO: 573873 - RNA, 64 nt, Homo Sapiens; identical to SEQ ID NO: 260448

SEQ ID NO: 573874 - RNA, 64 nt, Homo Sapiens; identical to SEQ ID NO: 260449

SEQ ID NO: 573875 - RNA, 64 nt, Homo Sapiens; identical to SEQ ID NO: 260450

SEQ ID NO: 573876 - RNA, 64 nt, Homo Sapiens; identical to SEQ ID NO: 260451

SEQ ID NO: 573877 - RNA, 64 nt, Homo Sapiens; identical to SEQ ID NO: 260452

SEQ ID NO: 573878 - RNA, 64 nt, Homo Sapiens; identical to SEQ ID NO: 260453

SEQ ID NO: 573879 - RNA, 64 nt, Homo Sapiens; identical to SEQ ID NO: 260454

SEQ ID NO: 573880 - RNA, 64 nt, Homo Sapiens; identical to SEQ ID NO: 260455

SEQ ID NO: 573881 - RNA, 64 nt, Homo Sapiens; identical to SEQ ID NO: 260456

SEQ ID NO: 573882 - RNA, 64 nt, Homo Sapiens; identical to SEQ ID NO: 260457

SEQ ID NO: 573883 - RNA, 64 nt, Homo Sapiens; identical to SEQ ID NO: 260458

SEQ ID NO: 573884 - RNA, 64 nt, Homo Sapiens; identical to SEQ ID NO: 260459

SEQ ID NO: 573885 - RNA, 64 nt, Homo Sapiens; identical to SEQ ID NO: 260460

SEQ ID NO: 573886 - RNA, 64 nt, Homo Sapiens; identical to SEQ ID NO: 260461

SEQ ID NO: 573887 - RNA, 64 nt, Homo Sapiens; identical to SEQ ID NO: 260462

SEQ ID NO: 573888 - RNA, 64 nt, Homo Sapiens; identical to SEQ ID NO: 260463

SEQ ID NO: 573889 - RNA, 64 nt, Homo Sapiens; identical to SEQ ID NO: 260464

SEQ ID NO: 573890 - RNA, 64 nt, Homo Sapiens; identical to SEQ ID NO: 260465

SEQ ID NO: 573891 - RNA, 64 nt, Homo Sapiens; identical to SEQ ID NO: 260466

SEQ ID NO: 573892 - RNA, 64 nt, Homo Sapiens; identical to SEQ ID NO: 260467

SEQ ID NO: 573893 - RNA, 64 nt, Homo Sapiens; identical to SEQ ID NO: 260468

SEQ ID NO: 573894 - RNA, 64 nt, Homo Sapiens; identical to SEQ ID NO: 260469

SEQ ID NO: 573895 - RNA, 56 nt, Homo Sapiens; identical to SEQ ID NO: 260470

SEQ ID NO: 573896 - RNA, 64 nt, Homo Sapiens; identical to SEQ ID NO: 260471

SEQ ID NO: 573897 - RNA, 64 nt, Homo Sapiens; identical to SEQ ID NO: 260472

SEQ ID NO: 573898 - RNA, 64 nt, Homo Sapiens; identical to SEQ ID NO: 260473

SEQ ID NO: 573899 - RNA, 64 nt, Homo Sapiens; identical to SEQ ID NO: 260474

SEQ ID NO: 573900 - RNA, 64 nt, Homo Sapiens; identical to SEQ ID NO: 260475

SEQ ID NO: 573901 - RNA, 64 nt, Homo Sapiens; identical to SEQ ID NO: 260476

SEQ ID NO: 573902 - RNA, 64 nt, Homo Sapiens; identical to SEQ ID NO: 260477

SEQ ID NO: 573903 - RNA, 64 nt, Homo Sapiens; identical to SEQ ID NO: 260478

SEQ ID NO: 573904 - RNA, 64 nt, Homo Sapiens; identical to SEQ ID NO: 260479

SEQ ID NO: 573905 - RNA, 64 nt, Homo Sapiens; identical to SEQ ID NO: 260480

SEQ ID NO: 573906 - RNA, 64 nt, Homo Sapiens; identical to SEQ ID NO: 260481

SEQ ID NO: 573907 - RNA, 64 nt, Homo Sapiens; identical to SEQ ID NO: 260482

SEQ ID NO: 573908 - RNA, 64 nt, Homo Sapiens; identical to SEQ ID NO: 260483

SEQ ID NO: 573909 - RNA, 64 nt, Homo Sapiens; identical to SEQ ID NO: 260484

SEQ ID NO: 573910 - RNA, 64 nt, Homo Sapiens; identical to SEQ ID NO: 260485

SEQ ID NO: 573911 - RNA, 64 nt, Homo Sapiens; identical to SEQ ID NO: 260486

SEQ ID NO: 573912 - RNA, 64 nt, Homo Sapiens; identical to SEQ ID NO: 260487

SEQ ID NO: 573913 - RNA, 64 nt, Homo Sapiens; identical to SEQ ID NO: 260488

SEQ ID NO: 573914 - RNA, 64 nt, Homo Sapiens; identical to SEQ ID NO: 260489

SEQ ID NO: 573915 - RNA, 64 nt, Homo Sapiens; identical to SEQ ID NO: 260490

SEQ ID NO: 573916 - RNA, 64 nt, Homo Sapiens; identical to SEQ ID NO: 260491

SEQ ID NO: 573917 - RNA, 64 nt, Homo Sapiens; identical to SEQ ID NO: 260492

SEQ ID NO: 573918 - RNA, 64 nt, Homo Sapiens; identical to SEQ ID NO: 260493

SEQ ID NO: 573919 - RNA, 64 nt, Homo Sapiens; identical to SEQ ID NO: 260494

SEQ ID NO: 573920 - RNA, 64 nt, Homo Sapiens; identical to SEQ ID NO: 260495

SEQ ID NO: 573921 - RNA, 64 nt, Homo Sapiens; identical to SEQ ID NO: 260496

SEQ ID NO: 573922 - RNA, 64 nt, Homo Sapiens; identical to SEQ ID NO: 260497

SEQ ID NO: 573923 - RNA, 64 nt, Homo Sapiens; identical to SEQ ID NO: 260498

SEQ ID NO: 573924 - RNA, 64 nt, Homo Sapiens; identical to SEQ ID NO: 260499

SEQ ID NO: 573925 - RNA, 64 nt, Homo Sapiens; identical to SEQ ID NO: 260500

SEQ ID NO: 573926 - RNA, 64 nt, Homo Sapiens; identical to SEQ ID NO: 260501

SEQ ID NO: 573927 - RNA, 64 nt, Homo Sapiens; identical to SEQ ID NO: 260502

SEQ ID NO: 573928 - RNA, 64 nt, Homo Sapiens; identical to SEQ ID NO: 260503

SEQ ID NO: 573929 - RNA, 64 nt, Homo Sapiens; identical to SEQ ID NO: 260504

SEQ ID NO: 573930 - RNA, 64 nt, Homo Sapiens; identical to SEQ ID NO: 260505

SEQ ID NO: 573931 - RNA, 64 nt, Homo Sapiens; identical to SEQ ID NO: 260506

SEQ ID NO: 573932 - RNA, 64 nt, Homo Sapiens; identical to SEQ ID NO: 260507

SEQ ID NO: 573933 - RNA, 64 nt, Homo Sapiens; identical to SEQ ID NO: 260508

SEQ ID NO: 573934 - RNA, 64 nt, Homo Sapiens; identical to SEQ ID NO: 260509

SEQ ID NO: 573935 - RNA, 64 nt, Homo Sapiens; identical to SEQ ID NO: 260510

SEQ ID NO: 573936 - RNA, 64 nt, Homo Sapiens; identical to SEQ ID NO: 260511

SEQ ID NO: 573937 - RNA, 64 nt, Homo Sapiens; identical to SEQ ID NO: 260512

SEQ ID NO: 573938 - RNA, 64 nt, Homo Sapiens; identical to SEQ ID NO: 260513

SEQ ID NO: 573939 - RNA, 64 nt, Homo Sapiens; identical to SEQ ID NO: 260514

SEQ ID NO: 573940 - RNA, 64 nt, Homo Sapiens; identical to SEQ ID NO: 260515

SEQ ID NO: 573941 - RNA, 64 nt, Homo Sapiens; identical to SEQ ID NO: 260516

SEQ ID NO: 573942 - RNA, 64 nt, Homo Sapiens; identical to SEQ ID NO: 260517

SEQ ID NO: 573943 - RNA, 64 nt, Homo Sapiens; identical to SEQ ID NO: 260518

SEQ ID NO: 573944 - RNA, 64 nt, Homo Sapiens; identical to SEQ ID NO: 260519

SEQ ID NO: 573945 - RNA, 64 nt, Homo Sapiens; identical to SEQ ID NO: 260520

SEQ ID NO: 573946 - RNA, 64 nt, Homo Sapiens; identical to SEQ ID NO: 260521

SEQ ID NO: 573947 - RNA, 64 nt, Homo Sapiens; identical to SEQ ID NO: 260522

SEQ ID NO: 573948 - RNA, 64 nt, Homo Sapiens; identical to SEQ ID NO: 260523

SEQ ID NO: 573949 - RNA, 64 nt, Homo Sapiens; identical to SEQ ID NO: 260524

SEQ ID NO: 573950 - RNA, 64 nt, Homo Sapiens; identical to SEQ ID NO: 260525

SEQ ID NO: 573951 - RNA, 64 nt, Homo Sapiens; identical to SEQ ID NO: 260526

SEQ ID NO: 573952 - RNA, 64 nt, Homo Sapiens; identical to SEQ ID NO: 260527

SEQ ID NO: 573953 - RNA, 64 nt, Homo Sapiens; identical to SEQ ID NO: 260528

SEQ ID NO: 573954 - RNA, 64 nt, Homo Sapiens; identical to SEQ ID NO: 260529

SEQ ID NO: 573955 - RNA, 64 nt, Homo Sapiens; identical to SEQ ID NO: 260530

SEQ ID NO: 573956 - RNA, 64 nt, Homo Sapiens; identical to SEQ ID NO: 260531

SEQ ID NO: 573957 - RNA, 64 nt, Homo Sapiens; identical to SEQ ID NO: 260532

SEQ ID NO: 573958 - RNA, 64 nt, Homo Sapiens; identical to SEQ ID NO: 260533

SEQ ID NO: 573959 - RNA, 64 nt, Homo Sapiens; identical to SEQ ID NO: 260534

SEQ ID NO: 573960 - RNA, 64 nt, Homo Sapiens; identical to SEQ ID NO: 260535

SEQ ID NO: 573961 - RNA, 64 nt, Homo Sapiens; identical to SEQ ID NO: 260536

SEQ ID NO: 573962 - RNA, 64 nt, Homo Sapiens; identical to SEQ ID NO: 260537

SEQ ID NO: 573963 - RNA, 64 nt, Homo Sapiens; identical to SEQ ID NO: 260538

SEQ ID NO: 573964 - RNA, 64 nt, Homo Sapiens; identical to SEQ ID NO: 260539

SEQ ID NO: 573965 - RNA, 64 nt, Homo Sapiens; identical to SEQ ID NO: 260540

SEQ ID NO: 573966 - RNA, 64 nt, Homo Sapiens; identical to SEQ ID NO: 260541

SEQ ID NO: 573967 - RNA, 64 nt, Homo Sapiens; identical to SEQ ID NO: 260542

SEQ ID NO: 573968 - RNA, 64 nt, Homo Sapiens
auuuuaagcaucaaaugcaaucaucuaaaauauaaaggucaaucauuuauaauagaaacaccuu

SEQ ID NO: 573969 - RNA, 64 nt, Homo Sapiens
cauaguaaaguuugcuuucauaacugcagcaaaaaaggucaacuugccaagucacugcugccau

SEQ ID NO: 573970 - RNA, 64 nt, Homo Sapiens
aaugaaugauaaauuaagagaaaaaaauaucaggaaggucaauauaugccuaacauuucuaaac

SEQ ID NO: 573971 - RNA, 64 nt, Homo Sapiens
uccacagguuguaagcuaggucuagcugacugcaaaggucaaguucucuuuacuccgucaccau

SEQ ID NO: 573972 - RNA, 64 nt, Homo Sapiens
gaaaaccccgucucuauaccggaaaaaggucaauaaggucaaggucaaaacgagggcugaugga

SEQ ID NO: 573973 - RNA, 64 nt, Homo Sapiens
aggucaagggaaaaccccgugcugauggaggaaaaaggucaauauucuccauaucaaaacgagg

SEQ ID NO: 573974 - RNA, 64 nt, Homo Sapiens
uuaauaacacugaaacaggaaccaggaaucuauuaaggucaauauuuuaaaaauaaugauuuuu

SEQ ID NO: 573975 - RNA, 64 nt, Homo Sapiens
uggaacuugauaguuuuuuagacucuauaauucuaaggucaaaaucaaagugaaucauuuaguu

SEQ ID NO: 573976 - RNA, 64 nt, Homo Sapiens
aaaguacuagucuaguaaaauuuauucuuguuagaaggucaacaaaauaucuguuuagcuuuua

SEQ ID NO: 573977 - RNA, 64 nt, Homo Sapiens
gcguuuuguuggcugggcuucuggaggcacuggcaaggucaaacugcauuucuuuaagaacagu

SEQ ID NO: 573978 - RNA, 64 nt, Homo Sapiens
gagcagguuuccacugugggcgguuggcacucugccaucugaguccucugccuaaagcauuccu

SEQ ID NO: 573979 - RNA, 64 nt, Homo Sapiens
ggcaagcaaaccugggguauuuauccacugacuuccaucugacacugguugaggaccacugcca

SEQ ID NO: 573980 - RNA, 64 nt, Homo Sapiens
cacgcaggaaauugugagcaauuuaagaaaacaaccaucugagaaguuaaaguauggcccgacc

SEQ ID NO: 573981 - RNA, 64 nt, Homo Sapiens
auuuugggaggagcccccaggaaaauggaaacccccaucugagugcaacuuugauuuauagaag

SEQ ID NO: 573982 - RNA, 64 nt, Homo Sapiens
guggugacuggggcccauguuuguuucaaauaagccaucugauucaaggguuuuuuuuguuugu

SEQ ID NO: 573983 - RNA, 64 nt, Homo Sapiens
cugugacaggcauagcucauccacuccaggaaggccaucugaccuucuccugauugacccgacu

SEQ ID NO: 573984 - RNA, 64 nt, Homo Sapiens
cuuaaagauccauucugaauguuucaauuugagcccaucugagcuccauuuuauaaaacacaag

SEQ ID NO: 573985 - RNA, 64 nt, Homo Sapiens
cucugaguaaagaucccaauggagaaucaaggguccaucugagcccuucaauguaugacuccug

SEQ ID NO: 573986 - RNA, 64 nt, Homo Sapiens
ccagcgcuaauucaggcuccuaauaaaccaggguccaucugaccuccacaugcuuuucuuuuuc

SEQ ID NO: 573987 - RNA, 64 nt, Homo Sapiens
aagaggcaucuucgagcccacugaaucccuagacccaucugaugguucagcagugacguagcau

SEQ ID NO: 573988 - RNA, 64 nt, Homo Sapiens
cucccaaauugcuccccacccuaagaccaagucuccaucugagaaagguggggauuucugaguu

SEQ ID NO: 573989 - RNA, 64 nt, Homo Sapiens
aauggguacaggaaaggauuuggccucaguuuccccaucugaagagggcguccuaacgccucca

SEQ ID NO: 573990 - RNA, 64 nt, Homo Sapiens
ccugagccagcuuuauauuucaaccauggcuggcccaucugagagcaucuccccacucucgcca

SEQ ID NO: 573991 - RNA, 64 nt, Homo Sapiens
cauuuucucuuauuuuguuuucucuggaucuuuuccaucugaggguacaggaaguaccaggacc

SEQ ID NO: 573992 - RNA, 64 nt, Homo Sapiens
guuacaggcacuaaaguuaguaaagaaaaguuuaccaucugaaaaagcuggauuuucuuuaaga

SEQ ID NO: 573993 - RNA, 64 nt, Homo Sapiens
aacuuacuugcauaccaaguugauacuugaauaaccaucugaaagugguacuugaucauuuuua

SEQ ID NO: 573994 - RNA, 64 nt, Homo Sapiens
guaacuguagucaucuuaaauuucaaaccauuuaccaucugaaaguuuugauuugaauguaaaa

SEQ ID NO: 573995 - RNA, 64 nt, Homo Sapiens
aaucauagcugucugaccucuacggaccucacauccaucugaggcuucauggacaaagauucuc

SEQ ID NO: 573996 - RNA, 64 nt, Homo Sapiens
gagguuagaauagagggcagaguaaaaggaagcuccaucugagcaaguacaccaaaugaucuca

SEQ ID NO: 573997 - RNA, 62 nt, Homo Sapiens
uaaucagauaggccggucucagacauuaauccuaccaucugauauuuuuggugaaggaaaaa

SEQ ID NO: 573998 - RNA, 64 nt, Homo Sapiens; identical to SEQ ID NO: 532503

SEQ ID NO: 573999 - RNA, 64 nt, Homo Sapiens; identical to SEQ ID NO: 532504

SEQ ID NO: 574000 - RNA, 64 nt, Homo Sapiens; identical to SEQ ID NO: 532505

SEQ ID NO: 574001 - RNA, 64 nt, Homo Sapiens; identical to SEQ ID NO: 532506

SEQ ID NO: 574002 - RNA, 64 nt, Homo Sapiens; identical to SEQ ID NO: 532507

SEQ ID NO: 574003 - RNA, 64 nt, Homo Sapiens; identical to SEQ ID NO: 532508

SEQ ID NO: 574004 - RNA, 64 nt, Homo Sapiens; identical to SEQ ID NO: 532509

SEQ ID NO: 574005 - RNA, 64 nt, Homo Sapiens; identical to SEQ ID NO: 532510

SEQ ID NO: 574006 - RNA, 64 nt, Homo Sapiens; identical to SEQ ID NO: 532511

SEQ ID NO: 574007 - RNA, 54 nt, Homo Sapiens; identical to SEQ ID NO: 532512

SEQ ID NO: 574008 - RNA, 61 nt, Homo Sapiens; identical to SEQ ID NO: 532513

SEQ ID NO: 574009 - RNA, 64 nt, Homo Sapiens; identical to SEQ ID NO: 532514

SEQ ID NO: 574010 - RNA, 64 nt, Homo Sapiens; identical to SEQ ID NO: 532515

SEQ ID NO: 574011 - RNA, 64 nt, Homo Sapiens; identical to SEQ ID NO: 532516

SEQ ID NO: 574012 - RNA, 64 nt, Homo Sapiens
gcuacaagugacgaggaagguucuguuuugaguauagccagagaaaacaaggauggagaaaaau

SEQ ID NO: 574013 - RNA, 64 nt, Homo Sapiens
gguacaagugacgaggaagauucuguuuuggguauagccagagaaaacaaggauggagaaaaau

SEQ ID NO: 574014 - RNA, 64 nt, Homo Sapiens
gcuacaagugaugagaaagauucuguuuugaauauagccagaggaaaaaaggauggagaaaaaa

SEQ ID NO: 574015 - RNA, 64 nt, Homo Sapiens
cccugcuccuggccaccuuuuggagauagccagauagccagaugagccuccccgacccacuacc

SEQ ID NO: 574016 - RNA, 64 nt, Homo Sapiens
gccagaugcccugcuccuggccacuaccuggagauagccagauaagucucagagccuccccgac

SEQ ID NO: 574017 - RNA, 64 nt, Homo Sapiens; identical to SEQ ID NO: 243769

SEQ ID NO: 574018 - RNA, 64 nt, Homo Sapiens; identical to SEQ ID NO: 243770

SEQ ID NO: 574019 - RNA, 64 nt, Homo Sapiens; identical to SEQ ID NO: 243771

SEQ ID NO: 574020 - RNA, 64 nt, Homo Sapiens; identical to SEQ ID NO: 243772

SEQ ID NO: 574021 - RNA, 64 nt, Homo Sapiens; identical to SEQ ID NO: 243773

SEQ ID NO: 574022 - RNA, 64 nt, Homo Sapiens; identical to SEQ ID NO: 243774

SEQ ID NO: 574023 - RNA, 64 nt, Homo Sapiens; identical to SEQ ID NO: 243775

SEQ ID NO: 574024 - RNA, 64 nt, Homo Sapiens; identical to SEQ ID NO: 243776

SEQ ID NO: 574025 - RNA, 64 nt, Homo Sapiens; identical to SEQ ID NO: 243777

SEQ ID NO: 574026 - RNA, 64 nt, Homo Sapiens; identical to SEQ ID NO: 243778

SEQ ID NO: 574027 - RNA, 64 nt, Homo Sapiens; identical to SEQ ID NO: 243779

SEQ ID NO: 574028 - RNA, 64 nt, Homo Sapiens; identical to SEQ ID NO: 243780

SEQ ID NO: 574029 - RNA, 64 nt, Homo Sapiens; identical to SEQ ID NO: 243781

SEQ ID NO: 574030 - RNA, 64 nt, Homo Sapiens; identical to SEQ ID NO: 243782

SEQ ID NO: 574031 - RNA, 64 nt, Homo Sapiens; identical to SEQ ID NO: 243783

SEQ ID NO: 574032 - RNA, 64 nt, Homo Sapiens; identical to SEQ ID NO: 243784

SEQ ID NO: 574033 - RNA, 64 nt, Homo Sapiens; identical to SEQ ID NO: 243785

SEQ ID NO: 574034 - RNA, 64 nt, Homo Sapiens; identical to SEQ ID NO: 243786

SEQ ID NO: 574035 - RNA, 64 nt, Homo Sapiens; identical to SEQ ID NO: 243787

SEQ ID NO: 574036 - RNA, 64 nt, Homo Sapiens; identical to SEQ ID NO: 243788

SEQ ID NO: 574037 - RNA, 64 nt, Homo Sapiens; identical to SEQ ID NO: 243789

SEQ ID NO: 574038 - RNA, 64 nt, Homo Sapiens; identical to SEQ ID NO: 243790

SEQ ID NO: 574039 - RNA, 64 nt, Homo Sapiens; identical to SEQ ID NO: 243791

SEQ ID NO: 574040 - RNA, 64 nt, Homo Sapiens; identical to SEQ ID NO: 243792

SEQ ID NO: 574041 - RNA, 64 nt, Homo Sapiens; identical to SEQ ID NO: 243793

SEQ ID NO: 574042 - RNA, 64 nt, Homo Sapiens; identical to SEQ ID NO: 243794

SEQ ID NO: 574043 - RNA, 64 nt, Homo Sapiens; identical to SEQ ID NO: 243795

SEQ ID NO: 574044 - RNA, 64 nt, Homo Sapiens; identical to SEQ ID NO: 243796

SEQ ID NO: 574045 - RNA, 64 nt, Homo Sapiens; identical to SEQ ID NO: 243797

SEQ ID NO: 574046 - RNA, 64 nt, Homo Sapiens; identical to SEQ ID NO: 243798

SEQ ID NO: 574047 - RNA, 64 nt, Homo Sapiens; identical to SEQ ID NO: 243799

SEQ ID NO: 574048 - RNA, 64 nt, Homo Sapiens; identical to SEQ ID NO: 243800

SEQ ID NO: 574049 - RNA, 64 nt, Homo Sapiens; identical to SEQ ID NO: 243801

SEQ ID NO: 574050 - RNA, 64 nt, Homo Sapiens; identical to SEQ ID NO: 243802

SEQ ID NO: 574051 - RNA, 64 nt, Homo Sapiens; identical to SEQ ID NO: 243803

SEQ ID NO: 574052 - RNA, 64 nt, Homo Sapiens; identical to SEQ ID NO: 243804

SEQ ID NO: 574053 - RNA, 64 nt, Homo Sapiens; identical to SEQ ID NO: 243805

SEQ ID NO: 574054 - RNA, 64 nt, Homo Sapiens; identical to SEQ ID NO: 243806

SEQ ID NO: 574055 - RNA, 64 nt, Homo Sapiens; identical to SEQ ID NO: 243807

SEQ ID NO: 574056 - RNA, 64 nt, Homo Sapiens; identical to SEQ ID NO: 243808

SEQ ID NO: 574057 - RNA, 64 nt, Homo Sapiens; identical to SEQ ID NO: 243809

SEQ ID NO: 574058 - RNA, 64 nt, Homo Sapiens; identical to SEQ ID NO: 243810

SEQ ID NO: 574059 - RNA, 64 nt, Homo Sapiens; identical to SEQ ID NO: 243811

SEQ ID NO: 574060 - RNA, 64 nt, Homo Sapiens; identical to SEQ ID NO: 243812

SEQ ID NO: 574061 - RNA, 64 nt, Homo Sapiens; identical to SEQ ID NO: 243813

SEQ ID NO: 574062 - RNA, 64 nt, Homo Sapiens; identical to SEQ ID NO: 243814

SEQ ID NO: 574063 - RNA, 64 nt, Homo Sapiens; identical to SEQ ID NO: 243815

SEQ ID NO: 574064 - RNA, 64 nt, Homo Sapiens; identical to SEQ ID NO: 243816

SEQ ID NO: 574065 - RNA, 64 nt, Homo Sapiens; identical to SEQ ID NO: 243817

SEQ ID NO: 574066 - RNA, 64 nt, Homo Sapiens; identical to SEQ ID NO: 243818

SEQ ID NO: 574067 - RNA, 64 nt, Homo Sapiens; identical to SEQ ID NO: 243819

SEQ ID NO: 574068 - RNA, 64 nt, Homo Sapiens; identical to SEQ ID NO: 243820

SEQ ID NO: 574069 - RNA, 64 nt, Homo Sapiens; identical to SEQ ID NO: 243821

SEQ ID NO: 574070 - RNA, 64 nt, Homo Sapiens; identical to SEQ ID NO: 243822

SEQ ID NO: 574071 - RNA, 64 nt, Homo Sapiens; identical to SEQ ID NO: 243823

SEQ ID NO: 574072 - RNA, 64 nt, Homo Sapiens; identical to SEQ ID NO: 243824

SEQ ID NO: 574073 - RNA, 64 nt, Homo Sapiens; identical to SEQ ID NO: 243825

SEQ ID NO: 574074 - RNA, 64 nt, Homo Sapiens; identical to SEQ ID NO: 131680

SEQ ID NO: 574075 - RNA, 64 nt, Homo Sapiens; identical to SEQ ID NO: 131681

SEQ ID NO: 574076 - RNA, 64 nt, Homo Sapiens; identical to SEQ ID NO: 131682

SEQ ID NO: 574077 - RNA, 64 nt, Homo Sapiens; identical to SEQ ID NO: 131683

SEQ ID NO: 574078 - RNA, 64 nt, Homo Sapiens; identical to SEQ ID NO: 131684

SEQ ID NO: 574079 - RNA, 64 nt, Homo Sapiens; identical to SEQ ID NO: 131685

SEQ ID NO: 574080 - RNA, 64 nt, Homo Sapiens; identical to SEQ ID NO: 131686

SEQ ID NO: 574081 - RNA, 64 nt, Homo Sapiens; identical to SEQ ID NO: 131687

SEQ ID NO: 574082 - RNA, 64 nt, Homo Sapiens; identical to SEQ ID NO: 61201

SEQ ID NO: 574083 - RNA, 64 nt, Homo Sapiens; identical to SEQ ID NO: 61202

SEQ ID NO: 574084 - RNA, 64 nt, Homo Sapiens; identical to SEQ ID NO: 61203

SEQ ID NO: 574085 - RNA, 64 nt, Homo Sapiens; identical to SEQ ID NO: 61204

SEQ ID NO: 574086 - RNA, 64 nt, Homo Sapiens; identical to SEQ ID NO: 61205

SEQ ID NO: 574087 - RNA, 64 nt, Homo Sapiens; identical to SEQ ID NO: 61206

SEQ ID NO: 574088 - RNA, 64 nt, Homo Sapiens; identical to SEQ ID NO: 61207

SEQ ID NO: 574089 - RNA, 64 nt, Homo Sapiens; identical to SEQ ID NO: 61208

SEQ ID NO: 574090 - RNA, 64 nt, Homo Sapiens; identical to SEQ ID NO: 61209

SEQ ID NO: 574091 - RNA, 64 nt, Homo Sapiens; identical to SEQ ID NO: 61210

SEQ ID NO: 574092 - RNA, 64 nt, Homo Sapiens; identical to SEQ ID NO: 61211

SEQ ID NO: 574093 - RNA, 64 nt, Homo Sapiens; identical to SEQ ID NO: 61212

SEQ ID NO: 574094 - RNA, 64 nt, Homo Sapiens; identical to SEQ ID NO: 61213

SEQ ID NO: 574095 - RNA, 64 nt, Homo Sapiens; identical to SEQ ID NO: 61214

SEQ ID NO: 574096 - RNA, 64 nt, Homo Sapiens; identical to SEQ ID NO: 61215

SEQ ID NO: 574097 - RNA, 64 nt, Homo Sapiens; identical to SEQ ID NO: 61216

SEQ ID NO: 574098 - RNA, 64 nt, Homo Sapiens; identical to SEQ ID NO: 61217

SEQ ID NO: 574099 - RNA, 64 nt, Homo Sapiens; identical to SEQ ID NO: 61218

SEQ ID NO: 574100 - RNA, 64 nt, Homo Sapiens; identical to SEQ ID NO: 61219

SEQ ID NO: 574101 - RNA, 64 nt, Homo Sapiens; identical to SEQ ID NO: 61220

SEQ ID NO: 574102 - RNA, 64 nt, Homo Sapiens; identical to SEQ ID NO: 61221

SEQ ID NO: 574103 - RNA, 64 nt, Homo Sapiens; identical to SEQ ID NO: 61222

SEQ ID NO: 574104 - RNA, 64 nt, Homo Sapiens; identical to SEQ ID NO: 61223

SEQ ID NO: 574105 - RNA, 64 nt, Homo Sapiens; identical to SEQ ID NO: 61224

SEQ ID NO: 574106 - RNA, 64 nt, Homo Sapiens; identical to SEQ ID NO: 61225

SEQ ID NO: 574107 - RNA, 64 nt, Homo Sapiens; identical to SEQ ID NO: 61226

SEQ ID NO: 574108 - RNA, 64 nt, Homo Sapiens; identical to SEQ ID NO: 61227

SEQ ID NO: 574109 - RNA, 64 nt, Homo Sapiens; identical to SEQ ID NO: 61228

SEQ ID NO: 574110 - RNA, 64 nt, Homo Sapiens; identical to SEQ ID NO: 61229

SEQ ID NO: 574111 - RNA, 64 nt, Homo Sapiens; identical to SEQ ID NO: 61230

SEQ ID NO: 574112 - RNA, 64 nt, Homo Sapiens; identical to SEQ ID NO: 61231

SEQ ID NO: 574113 - RNA, 64 nt, Homo Sapiens; identical to SEQ ID NO: 61232

SEQ ID NO: 574114 - RNA, 64 nt, Homo Sapiens; identical to SEQ ID NO: 61233

SEQ ID NO: 574115 - RNA, 64 nt, Homo Sapiens; identical to SEQ ID NO: 61234

SEQ ID NO: 574116 - RNA, 64 nt, Homo Sapiens; identical to SEQ ID NO: 61235

SEQ ID NO: 574117 - RNA, 64 nt, Homo Sapiens; identical to SEQ ID NO: 61236

SEQ ID NO: 574118 - RNA, 64 nt, Homo Sapiens; identical to SEQ ID NO: 61237

SEQ ID NO: 574119 - RNA, 64 nt, Homo Sapiens; identical to SEQ ID NO: 61238

SEQ ID NO: 574120 - RNA, 59 nt, Homo Sapiens; identical to SEQ ID NO: 61239

SEQ ID NO: 574121 - RNA, 64 nt, Homo Sapiens; identical to SEQ ID NO: 61240

SEQ ID NO: 574122 - RNA, 64 nt, Homo Sapiens; identical to SEQ ID NO: 61241

SEQ ID NO: 574123 - RNA, 64 nt, Homo Sapiens; identical to SEQ ID NO: 61242

SEQ ID NO: 574124 - RNA, 64 nt, Homo Sapiens; identical to SEQ ID NO: 61243

SEQ ID NO: 574125 - RNA, 64 nt, Homo Sapiens; identical to SEQ ID NO: 61244

SEQ ID NO: 574126 - RNA, 64 nt, Homo Sapiens; identical to SEQ ID NO: 61245

SEQ ID NO: 574127 - RNA, 64 nt, Homo Sapiens; identical to SEQ ID NO: 61246

SEQ ID NO: 574128 - RNA, 64 nt, Homo Sapiens; identical to SEQ ID NO: 61247

SEQ ID NO: 574129 - RNA, 64 nt, Homo Sapiens; identical to SEQ ID NO: 61248

SEQ ID NO: 574130 - RNA, 64 nt, Homo Sapiens; identical to SEQ ID NO: 61249

SEQ ID NO: 574131 - RNA, 64 nt, Homo Sapiens; identical to SEQ ID NO: 38988

SEQ ID NO: 574132 - RNA, 64 nt, Homo Sapiens; identical to SEQ ID NO: 38989

SEQ ID NO: 574133 - RNA, 64 nt, Homo Sapiens; identical to SEQ ID NO: 38990

SEQ ID NO: 574134 - RNA, 64 nt, Homo Sapiens; identical to SEQ ID NO: 38991

SEQ ID NO: 574135 - RNA, 64 nt, Homo Sapiens; identical to SEQ ID NO: 38992

SEQ ID NO: 574136 - RNA, 64 nt, Homo Sapiens; identical to SEQ ID NO: 38993

SEQ ID NO: 574137 - RNA, 64 nt, Homo Sapiens; identical to SEQ ID NO: 38994

SEQ ID NO: 574138 - RNA, 64 nt, Homo Sapiens; identical to SEQ ID NO: 38995

SEQ ID NO: 574139 - RNA, 64 nt, Homo Sapiens; identical to SEQ ID NO: 38996

SEQ ID NO: 574140 - RNA, 64 nt, Homo Sapiens; identical to SEQ ID NO: 38997

SEQ ID NO: 574141 - RNA, 64 nt, Homo Sapiens; identical to SEQ ID NO: 38998

SEQ ID NO: 574142 - RNA, 64 nt, Homo Sapiens; identical to SEQ ID NO: 38999

SEQ ID NO: 574143 - RNA, 64 nt, Homo Sapiens; identical to SEQ ID NO: 39000

SEQ ID NO: 574144 - RNA, 64 nt, Homo Sapiens; identical to SEQ ID NO: 39001

SEQ ID NO: 574145 - RNA, 64 nt, Homo Sapiens; identical to SEQ ID NO: 39002

SEQ ID NO: 574146 - RNA, 64 nt, Homo Sapiens; identical to SEQ ID NO: 39003

SEQ ID NO: 574147 - RNA, 64 nt, Homo Sapiens; identical to SEQ ID NO: 39004

SEQ ID NO: 574148 - RNA, 64 nt, Homo Sapiens; identical to SEQ ID NO: 39005

SEQ ID NO: 574149 - RNA, 64 nt, Homo Sapiens; identical to SEQ ID NO: 39006

SEQ ID NO: 574150 - RNA, 64 nt, Homo Sapiens; identical to SEQ ID NO: 39007

SEQ ID NO: 574151 - RNA, 64 nt, Homo Sapiens; identical to SEQ ID NO: 39008

SEQ ID NO: 574152 - RNA, 64 nt, Homo Sapiens; identical to SEQ ID NO: 39009

SEQ ID NO: 574153 - RNA, 64 nt, Homo Sapiens; identical to SEQ ID NO: 39010

SEQ ID NO: 574154 - RNA, 64 nt, Homo Sapiens; identical to SEQ ID NO: 39011

SEQ ID NO: 574155 - RNA, 64 nt, Homo Sapiens; identical to SEQ ID NO: 39012

SEQ ID NO: 574156 - RNA, 64 nt, Homo Sapiens; identical to SEQ ID NO: 39013

SEQ ID NO: 574157 - RNA, 64 nt, Homo Sapiens; identical to SEQ ID NO: 39014

SEQ ID NO: 574158 - RNA, 64 nt, Homo Sapiens; identical to SEQ ID NO: 39015

SEQ ID NO: 574159 - RNA, 64 nt, Homo Sapiens; identical to SEQ ID NO: 39016

SEQ ID NO: 574160 - RNA, 64 nt, Homo Sapiens; identical to SEQ ID NO: 39017

SEQ ID NO: 574161 - RNA, 64 nt, Homo Sapiens; identical to SEQ ID NO: 39018

SEQ ID NO: 574162 - RNA, 64 nt, Homo Sapiens; identical to SEQ ID NO: 39019

SEQ ID NO: 574163 - RNA, 64 nt, Homo Sapiens; identical to SEQ ID NO: 39020

SEQ ID NO: 574164 - RNA, 64 nt, Homo Sapiens; identical to SEQ ID NO: 39021

SEQ ID NO: 574165 - RNA, 64 nt, Homo Sapiens; identical to SEQ ID NO: 39022

SEQ ID NO: 574166 - RNA, 64 nt, Homo Sapiens; identical to SEQ ID NO: 39023

SEQ ID NO: 574167 - RNA, 64 nt, Homo Sapiens; identical to SEQ ID NO: 39024

SEQ ID NO: 574168 - RNA, 64 nt, Homo Sapiens; identical to SEQ ID NO: 39025

SEQ ID NO: 574169 - RNA, 64 nt, Homo Sapiens; identical to SEQ ID NO: 39026

SEQ ID NO: 574170 - RNA, 64 nt, Homo Sapiens; identical to SEQ ID NO: 39027

SEQ ID NO: 574171 - RNA, 64 nt, Homo Sapiens; identical to SEQ ID NO: 39028

SEQ ID NO: 574172 - RNA, 64 nt, Homo Sapiens; identical to SEQ ID NO: 39029

SEQ ID NO: 574173 - RNA, 64 nt, Homo Sapiens; identical to SEQ ID NO: 39030

SEQ ID NO: 574174 - RNA, 64 nt, Homo Sapiens; identical to SEQ ID NO: 39031

SEQ ID NO: 574175 - RNA, 64 nt, Homo Sapiens; identical to SEQ ID NO: 39032

SEQ ID NO: 574176 - RNA, 64 nt, Homo Sapiens; identical to SEQ ID NO: 39033

SEQ ID NO: 574177 - RNA, 64 nt, Homo Sapiens; identical to SEQ ID NO: 39034

SEQ ID NO: 574178 - RNA, 64 nt, Homo Sapiens; identical to SEQ ID NO: 39035

SEQ ID NO: 574179 - RNA, 64 nt, Homo Sapiens; identical to SEQ ID NO: 39036

SEQ ID NO: 574180 - RNA, 64 nt, Homo Sapiens; identical to SEQ ID NO: 39037

SEQ ID NO: 574181 - RNA, 64 nt, Homo Sapiens; identical to SEQ ID NO: 39038

SEQ ID NO: 574182 - RNA, 64 nt, Homo Sapiens; identical to SEQ ID NO: 39039

SEQ ID NO: 574183 - RNA, 64 nt, Homo Sapiens; identical to SEQ ID NO: 39040

SEQ ID NO: 574184 - RNA, 64 nt, Homo Sapiens; identical to SEQ ID NO: 39041

SEQ ID NO: 574185 - RNA, 64 nt, Homo Sapiens; identical to SEQ ID NO: 39042

SEQ ID NO: 574186 - RNA, 64 nt, Homo Sapiens; identical to SEQ ID NO: 39043

SEQ ID NO: 574187 - RNA, 64 nt, Homo Sapiens; identical to SEQ ID NO: 39044

SEQ ID NO: 574188 - RNA, 64 nt, Homo Sapiens; identical to SEQ ID NO: 39045

SEQ ID NO: 574189 - RNA, 64 nt, Homo Sapiens; identical to SEQ ID NO: 279869

SEQ ID NO: 574190 - RNA, 64 nt, Homo Sapiens; identical to SEQ ID NO: 279870

SEQ ID NO: 574191 - RNA, 64 nt, Homo Sapiens; identical to SEQ ID NO: 279871

SEQ ID NO: 574192 - RNA, 64 nt, Homo Sapiens; identical to SEQ ID NO: 279871

SEQ ID NO: 574193 - RNA, 64 nt, Homo Sapiens; identical to SEQ ID NO: 279873

SEQ ID NO: 574194 - RNA, 64 nt, Homo Sapiens; identical to SEQ ID NO: 279874

SEQ ID NO: 574195 - RNA, 64 nt, Homo Sapiens; identical to SEQ ID NO: 279875

SEQ ID NO: 574196 - RNA, 64 nt, Homo Sapiens; identical to SEQ ID NO: 279876

SEQ ID NO: 574197 - RNA, 64 nt, Homo Sapiens; identical to SEQ ID NO: 279877

SEQ ID NO: 574198 - RNA, 64 nt, Homo Sapiens; identical to SEQ ID NO: 279878

SEQ ID NO: 574199 - RNA, 64 nt, Homo Sapiens; identical to SEQ ID NO: 279879

SEQ ID NO: 574200 - RNA, 64 nt, Homo Sapiens; identical to SEQ ID NO: 279880

SEQ ID NO: 574201 - RNA, 64 nt, Homo Sapiens; identical to SEQ ID NO: 279881

SEQ ID NO: 574202 - RNA, 64 nt, Homo Sapiens; identical to SEQ ID NO: 279882

SEQ ID NO: 574203 - RNA, 64 nt, Homo Sapiens; identical to SEQ ID NO: 279883

SEQ ID NO: 574204 - RNA, 64 nt, Homo Sapiens; identical to SEQ ID NO: 279884

SEQ ID NO: 574205 - RNA, 64 nt, Homo Sapiens; identical to SEQ ID NO: 279885

SEQ ID NO: 574206 - RNA, 64 nt, Homo Sapiens; identical to SEQ ID NO: 279886

SEQ ID NO: 574207 - RNA, 64 nt, Homo Sapiens; identical to SEQ ID NO: 279887

SEQ ID NO: 574208 - RNA, 64 nt, Homo Sapiens; identical to SEQ ID NO: 279888

SEQ ID NO: 574209 - RNA, 64 nt, Homo Sapiens; identical to SEQ ID NO: 279889

SEQ ID NO: 574210 - RNA, 64 nt, Homo Sapiens; identical to SEQ ID NO: 279890

SEQ ID NO: 574211 - RNA, 64 nt, Homo Sapiens; identical to SEQ ID NO: 279891

SEQ ID NO: 574212 - RNA, 64 nt, Homo Sapiens; identical to SEQ ID NO: 279892

SEQ ID NO: 574213 - RNA, 64 nt, Homo Sapiens; identical to SEQ ID NO: 279893

SEQ ID NO: 574214 - RNA, 64 nt, Homo Sapiens; identical to SEQ ID NO: 279894

SEQ ID NO: 574215 - RNA, 64 nt, Homo Sapiens; identical to SEQ ID NO: 279895

SEQ ID NO: 574216 - RNA, 64 nt, Homo Sapiens; identical to SEQ ID NO: 279896

SEQ ID NO: 574217 - RNA, 64 nt, Homo Sapiens; identical to SEQ ID NO: 279897

SEQ ID NO: 574218 - RNA, 64 nt, Homo Sapiens; identical to SEQ ID NO: 279898

SEQ ID NO: 574219 - RNA, 64 nt, Homo Sapiens; identical to SEQ ID NO: 279898

SEQ ID NO: 574220 - RNA, 64 nt, Homo Sapiens; identical to SEQ ID NO: 83612

SEQ ID NO: 574221 - RNA, 64 nt, Homo Sapiens; identical to SEQ ID NO: 83613

SEQ ID NO: 574222 - RNA, 64 nt, Homo Sapiens; identical to SEQ ID NO: 83614

SEQ ID NO: 574223 - RNA, 64 nt, Homo Sapiens; identical to SEQ ID NO: 83615

SEQ ID NO: 574224 - RNA, 64 nt, Homo Sapiens; identical to SEQ ID NO: 83616

SEQ ID NO: 574225 - RNA, 64 nt, Homo Sapiens; identical to SEQ ID NO: 83617

SEQ ID NO: 574226 - RNA, 64 nt, Homo Sapiens; identical to SEQ ID NO: 83618

SEQ ID NO: 574227 - RNA, 64 nt, Homo Sapiens; identical to SEQ ID NO: 83619

SEQ ID NO: 574228 - RNA, 64 nt, Homo Sapiens; identical to SEQ ID NO: 83620

SEQ ID NO: 574229 - RNA, 64 nt, Homo Sapiens; identical to SEQ ID NO: 83621

SEQ ID NO: 574230 - RNA, 64 nt, Homo Sapiens; identical to SEQ ID NO: 83622

SEQ ID NO: 574231 - RNA, 64 nt, Homo Sapiens; identical to SEQ ID NO: 83623

SEQ ID NO: 574232 - RNA, 64 nt, Homo Sapiens; identical to SEQ ID NO: 83624

SEQ ID NO: 574233 - RNA, 64 nt, Homo Sapiens; identical to SEQ ID NO: 83625

SEQ ID NO: 574234 - RNA, 64 nt, Homo Sapiens; identical to SEQ ID NO: 83626

SEQ ID NO: 574235 - RNA, 64 nt, Homo Sapiens; identical to SEQ ID NO: 83627

SEQ ID NO: 574236 - RNA, 64 nt, Homo Sapiens; identical to SEQ ID NO: 83628

SEQ ID NO: 574237 - RNA, 64 nt, Homo Sapiens; identical to SEQ ID NO: 83629

SEQ ID NO: 574238 - RNA, 64 nt, Homo Sapiens; identical to SEQ ID NO: 83630

SEQ ID NO: 574239 - RNA, 64 nt, Homo Sapiens; identical to SEQ ID NO: 83631

SEQ ID NO: 574240 - RNA, 64 nt, Homo Sapiens; identical to SEQ ID NO: 83632

SEQ ID NO: 574241 - RNA, 60 nt, Homo Sapiens; identical to SEQ ID NO: 83633

SEQ ID NO: 574242 - RNA, 64 nt, Homo Sapiens; identical to SEQ ID NO: 83634

SEQ ID NO: 574243 - RNA, 64 nt, Homo Sapiens; identical to SEQ ID NO: 83635

SEQ ID NO: 574244 - RNA, 64 nt, Homo Sapiens; identical to SEQ ID NO: 83636

SEQ ID NO: 574245 - RNA, 64 nt, Homo Sapiens; identical to SEQ ID NO: 83637

SEQ ID NO: 574246 - RNA, 64 nt, Homo Sapiens; identical to SEQ ID NO: 83638

SEQ ID NO: 574247 - RNA, 64 nt, Homo Sapiens; identical to SEQ ID NO: 83639

SEQ ID NO: 574248 - RNA, 64 nt, Homo Sapiens; identical to SEQ ID NO: 83640

SEQ ID NO: 574249 - RNA, 64 nt, Homo Sapiens; identical to SEQ ID NO: 83641

SEQ ID NO: 574250 - RNA, 64 nt, Homo Sapiens; identical to SEQ ID NO: 83642

SEQ ID NO: 574251 - RNA, 64 nt, Homo Sapiens; identical to SEQ ID NO: 83643

SEQ ID NO: 574252 - RNA, 64 nt, Homo Sapiens; identical to SEQ ID NO: 83644

SEQ ID NO: 574253 - RNA, 64 nt, Homo Sapiens; identical to SEQ ID NO: 83645

SEQ ID NO: 574254 - RNA, 64 nt, Homo Sapiens; identical to SEQ ID NO: 83646

SEQ ID NO: 574255 - RNA, 64 nt, Homo Sapiens; identical to SEQ ID NO: 83647

SEQ ID NO: 574256 - RNA, 64 nt, Homo Sapiens; identical to SEQ ID NO: 83648

SEQ ID NO: 574257 - RNA, 64 nt, Homo Sapiens; identical to SEQ ID NO: 83649

SEQ ID NO: 574258 - RNA, 64 nt, Homo Sapiens; identical to SEQ ID NO: 83650

SEQ ID NO: 574259 - RNA, 54 nt, Homo Sapiens; identical to SEQ ID NO: 83651

SEQ ID NO: 574260 - RNA, 64 nt, Homo Sapiens; identical to SEQ ID NO: 83652

SEQ ID NO: 574261 - RNA, 64 nt, Homo Sapiens; identical to SEQ ID NO: 83653

SEQ ID NO: 574262 - RNA, 64 nt, Homo Sapiens; identical to SEQ ID NO: 83654

SEQ ID NO: 574263 - RNA, 64 nt, Homo Sapiens; identical to SEQ ID NO: 83655

SEQ ID NO: 574264 - RNA, 64 nt, Homo Sapiens; identical to SEQ ID NO: 83656

SEQ ID NO: 574265 - RNA, 64 nt, Homo Sapiens; identical to SEQ ID NO: 83657

SEQ ID NO: 574266 - RNA, 59 nt, Homo Sapiens; identical to SEQ ID NO: 83658

SEQ ID NO: 574267 - RNA, 64 nt, Homo Sapiens; identical to SEQ ID NO: 83659

SEQ ID NO: 574268 - RNA, 64 nt, Homo Sapiens; identical to SEQ ID NO: 83660

SEQ ID NO: 574269 - RNA, 64 nt, Homo Sapiens; identical to SEQ ID NO: 83661

SEQ ID NO: 574270 - RNA, 64 nt, Homo Sapiens; identical to SEQ ID NO: 83662

SEQ ID NO: 574271 - RNA, 64 nt, Homo Sapiens; identical to SEQ ID NO: 83663

SEQ ID NO: 574272 - RNA, 64 nt, Homo Sapiens; identical to SEQ ID NO: 83664

SEQ ID NO: 574273 - RNA, 64 nt, Homo Sapiens; identical to SEQ ID NO: 83665

SEQ ID NO: 574274 - RNA, 64 nt, Homo Sapiens; identical to SEQ ID NO: 83666

SEQ ID NO: 574275 - RNA, 64 nt, Homo Sapiens; identical to SEQ ID NO: 83667

SEQ ID NO: 574276 - RNA, 64 nt, Homo Sapiens; identical to SEQ ID NO: 83668

SEQ ID NO: 574277 - RNA, 66 nt, Homo Sapiens
aacauuuauuugaguggaguuuuuuuuccuucaagaaugcaguacuaguucuugccuuggcugcag

SEQ ID NO: 574278 - RNA, 66 nt, Homo Sapiens
cacgaucuggucugggaacaaaagcccaugucuccuaugcaguacgcaacaagaugagcuaaucga

SEQ ID NO: 574279 - RNA, 66 nt, Homo Sapiens
agaaagaaagaaaaaaaaagagcaucuuaccuucauaugcaguaaacuucuaucacccuacauucc

SEQ ID NO: 574280 - RNA, 66 nt, Homo Sapiens
gcaagcuaauaacguugguuccugcugccauacuguaugcaguacuauccuuuuuuguuccuuuuu

SEQ ID NO: 574281 - RNA, 66 nt, Homo Sapiens
aaaguuugggggugcaauauaagaaguuuauauaauaugcaguacauuauccaaaagagaagguag

SEQ ID NO: 574282 - RNA, 66 nt, Homo Sapiens
aauaugcaguacauuauccaaaagagaagguaguuaaugcaguagaaaguagugguaauaauuccu

SEQ ID NO: 574283 - RNA, 66 nt, Homo Sapiens
gcaacaggggugcaauuuaaaaauguaauaauauuaaugcaguauuuauuuucuacagauuuugaa

SEQ ID NO: 574284 - RNA, 66 nt, Homo Sapiens
cuuuuuuguauaaaauuauuuaaaauauugauuugaaugcaguaggucuuuuuuaaaguuuuuuuu

SEQ ID NO: 574285 - RNA, 66 nt, Homo Sapiens
acaucagagaguucauacuaaaauauauuuuugcagaugcaguaaauaugaaaaauauuuaauccc

SEQ ID NO: 574286 - RNA, 66 nt, Homo Sapiens
auuaucauuuuguugauugugcuuuuauguaauaaaaugcaguacuuuaaaacauuuagauugugu

SEQ ID NO: 574287 - RNA, 66 nt, Homo Sapiens
caaaaugugaucuaguguaaggaauacauuuucaaaaugcaguaaucuuauuuaaaauuuaaauaa

SEQ ID NO: 574288 - RNA, 66 nt, Homo Sapiens
cuuuauaaaaacucauuugcggccacuggguuucucaugcaguaagauauaaguucucuuugcgua

SEQ ID NO: 574289 - RNA, 66 nt, Homo Sapiens
uuuuuaaauuuucagaugauacuuuuauguaauaaaaugcaguacauacguuauuuuacuauuugu

SEQ ID NO: 574290 - RNA, 66 nt, Homo Sapiens
uauuuaaaacauuuaauccaagauauauuuuugcagaugcaguauaacaccagaggguucauacug

SEQ ID NO: 574291 - RNA, 66 nt, Homo Sapiens
uaaaugugcagauuuuaugcggaauuuuuuaauaacaugcaguauaauucguaauaauuuagugau

SEQ ID NO: 574292 - RNA, 66 nt, Homo Sapiens
ccuagcacucaauguaaucauaacuugaaauagaccaugcaguauuugugggguuagcagaucgaa

SEQ ID NO: 574293 - RNA, 66 nt, Homo Sapiens
auuggagaguuaacagaauauagagaggcuuguuuaaugcaguaccuacagacaagagagccacag

SEQ ID NO: 574294 - RNA, 64 nt, Homo Sapiens; identical to SEQ ID NO: 163552

SEQ ID NO: 574295 - RNA, 64 nt, Homo Sapiens; identical to SEQ ID NO: 163553

SEQ ID NO: 574296 - RNA, 64 nt, Homo Sapiens; identical to SEQ ID NO: 163554

SEQ ID NO: 574297 - RNA, 64 nt, Homo Sapiens; identical to SEQ ID NO: 163555

SEQ ID NO: 574298 - RNA, 64 nt, Homo Sapiens; identical to SEQ ID NO: 163556

SEQ ID NO: 574299 - RNA, 64 nt, Homo Sapiens; identical to SEQ ID NO: 163557

SEQ ID NO: 574300 - RNA, 64 nt, Homo Sapiens; identical to SEQ ID NO: 163558

SEQ ID NO: 574301 - RNA, 64 nt, Homo Sapiens; identical to SEQ ID NO: 163559

SEQ ID NO: 574302 - RNA, 64 nt, Homo Sapiens; identical to SEQ ID NO: 163560

SEQ ID NO: 574303 - RNA, 64 nt, Homo Sapiens; identical to SEQ ID NO: 163561

SEQ ID NO: 574304 - RNA, 64 nt, Homo Sapiens; identical to SEQ ID NO: 163562

SEQ ID NO: 574305 - RNA, 64 nt, Homo Sapiens; identical to SEQ ID NO: 163563

SEQ ID NO: 574306 - RNA, 64 nt, Homo Sapiens; identical to SEQ ID NO: 163564

SEQ ID NO: 574307 - RNA, 64 nt, Homo Sapiens; identical to SEQ ID NO: 163565

SEQ ID NO: 574308 - RNA, 64 nt, Homo Sapiens; identical to SEQ ID NO: 163566

SEQ ID NO: 574309 - RNA, 64 nt, Homo Sapiens; identical to SEQ ID NO: 163567

SEQ ID NO: 574310 - RNA, 64 nt, Homo Sapiens; identical to SEQ ID NO: 163568

SEQ ID NO: 574311 - RNA, 64 nt, Homo Sapiens; identical to SEQ ID NO: 163569

SEQ ID NO: 574312 - RNA, 64 nt, Homo Sapiens; identical to SEQ ID NO: 163570

SEQ ID NO: 574313 - RNA, 64 nt, Homo Sapiens; identical to SEQ ID NO: 163571

SEQ ID NO: 574314 - RNA, 64 nt, Homo Sapiens; identical to SEQ ID NO: 163572

SEQ ID NO: 574315 - RNA, 64 nt, Homo Sapiens; identical to SEQ ID NO: 163573

SEQ ID NO: 574316 - RNA, 64 nt, Homo Sapiens; identical to SEQ ID NO: 163574

SEQ ID NO: 574317 - RNA, 64 nt, Homo Sapiens; identical to SEQ ID NO: 163575

SEQ ID NO: 574318 - RNA, 64 nt, Homo Sapiens; identical to SEQ ID NO: 163576

SEQ ID NO: 574319 - RNA, 64 nt, Homo Sapiens; identical to SEQ ID NO: 163577

SEQ ID NO: 574320 - RNA, 64 nt, Homo Sapiens
uuuugaguuuguuuuagcuaaaaagaaggaauacacacaggaauaaugaccccaaaaaugcuua

SEQ ID NO: 574321 - RNA, 64 nt, Homo Sapiens
aaugaccccaaaaaugcuuagauaaggccccuauacacaggaccugacauuuagcucaaugaug

SEQ ID NO: 574322 - RNA, 64 nt, Homo Sapiens
aacccaauacauauuguacugagugugugugucuacacaggauacucuguuggggagagaggaa

SEQ ID NO: 574323 - RNA, 64 nt, Homo Sapiens
uuucuauaguuauuguuuuccagaauucugcccaacacaggagaaaugggccaccuccccacaa

SEQ ID NO: 574324 - RNA, 64 nt, Homo Sapiens
caguccucucugggccgcagcggacccagcuggaacacaggaaguuggagcaguaggugcuccu

SEQ ID NO: 574325 - RNA, 64 nt, Homo Sapiens
uaugucucuuucaacucuaguuuuugagguggggacacaggagguccagugggacacagccacu

SEQ ID NO: 574326 - RNA, 64 nt, Homo Sapiens
auauuugcuacacaguacccagagcagccuaucuacacaggacauuaauaaugguguacuuuaa

SEQ ID NO: 574327 - RNA, 64 nt, Homo Sapiens
cugcaaguggaggaacgagagcuggggagcccauacacaggaccugaagcccuaaagaaaggcc

SEQ ID NO: 574328 - RNA, 64 nt, Homo Sapiens
ucuuccuaagaggcagcauggugugguagaaagaacacaggacaagggagagagagccaaacag

SEQ ID NO: 574329 - RNA, 64 nt, Homo Sapiens
uauuuuguaucuacuuaaguuugucacugugacaacacaggaaaaguugguuuucaggugagau

SEQ ID NO: 574330 - RNA, 64 nt, Homo Sapiens
uugggggaaaauagguaaacauagcuucuagcuaacacaggagaccuauucuuagccuuuacua

SEQ ID NO: 574331 - RNA, 64 nt, Homo Sapiens
gaggccaggggcuaggaguuuggcaagccccaccacacaggaguucuguucccugcucccucgc

SEQ ID NO: 574332 - RNA, 64 nt, Homo Sapiens
cccagccagggaauucugaaggcucagcacgaccacacaggacaucccuggcucccugucccug

SEQ ID NO: 574333 - RNA, 64 nt, Homo Sapiens
uucaucucauccugugggauucugcaaucauaaaacacaggaaaggggaauucugugauggcaa

SEQ ID NO: 574334 - RNA, 64 nt, Homo Sapiens
aggauggauagaaaaaaagcacuuacauuggggcacacaggaaaucccagugucuagcaauggu

SEQ ID NO: 574335 - RNA, 64 nt, Homo Sapiens
gcaccagaaccugucucgggcugacggggguggcacacaggacacggguggaucccaacaggca

SEQ ID NO: 574336 - RNA, 64 nt, Homo Sapiens
gcucacucauagccauguccacaugggggcuugcacacaggaucacucacauauguacauguac

SEQ ID NO: 574337 - RNA, 64 nt, Homo Sapiens
accuuuacuuuacagcuucccuuuauaauuuguuacacaggaauaguuaaaugcauuuguuugu

SEQ ID NO: 574338 - RNA, 64 nt, Homo Sapiens
cagaggacugccuaguagcaaagguuauuccuggacacaggaaagacgggcauuacagggacca

SEQ ID NO: 574339 - RNA, 64 nt, Homo Sapiens
acugauugggaggugcguguucagcagaaccugcacacaggacagcgggaaaaaucgaugagcg

SEQ ID NO: 574340 - RNA, 64 nt, Homo Sapiens
cagguaggacagcugcuccccaagccuccugaggacacaggaagagacggaaggagcaccuuga

SEQ ID NO: 574341 - RNA, 64 nt, Homo Sapiens
ugccuggugugaaaugaucuauggccuguuucuuacacaggaagcccccugaaccuccuguaca

SEQ ID NO: 574342 - RNA, 64 nt, Homo Sapiens
guccccgacugugccacgugguaggacacauaggacacaggaauuccuggguccuugcccauga

SEQ ID NO: 574343 - RNA, 64 nt, Homo Sapiens
uggguccuugcccaugacugugccaugugguaggacacaggacacaggaauuccuggaaagugg

SEQ ID NO: 574344 - RNA, 64 nt, Homo Sapiens
uugcccaugacugugccaugugguaggacacaggacacaggaauuccuggaaagugguggcuuc

SEQ ID NO: 574345 - RNA, 64 nt, Homo Sapiens
ggaaaaggcuccagugagcgcgccugcuuuagagacacaggaugauucagaccggaaacagacc

SEQ ID NO: 574346 - RNA, 64 nt, Homo Sapiens
gagaagccuucaggguacauucagcucuuaacaaacacaggaggacuuaauggcagcuuggcau

SEQ ID NO: 574347 - RNA, 64 nt, Homo Sapiens
aagacaucagagaugcugcuaagucggcuccagcacacaggagccccccacaacgaagaguuag

SEQ ID NO: 574348 - RNA, 64 nt, Homo Sapiens
cggagauugcagugagcugaggggaauggcucgaacacaggagacuacucuggaggcugaggca

SEQ ID NO: 574349 - RNA, 64 nt, Homo Sapiens
caaaccauaugauuguaaggccacaaaauuucucacacaggacauauugccacucguuucaaac

SEQ ID NO: 574350 - RNA, 64 nt, Homo Sapiens
cuggcccccacccaccuuccuugcgaccaccaacacacaggaacucugugugagagagagggcg

SEQ ID NO: 574351 - RNA, 64 nt, Homo Sapiens
aggccugguggagggggaggggagaagccaagggacacaggagaccacccccgagcuugccuca

SEQ ID NO: 574352 - RNA, 64 nt, Homo Sapiens
uucucaguguccuaacagcccugcuugggccauaacacaggagaccugcucccuaucugcgcac

SEQ ID NO: 574353 - RNA, 64 nt, Homo Sapiens
cugagucuuagcaauggacaauuccaauaccuccacacaggacacuagaguaagaaaccuucac

SEQ ID NO: 574354 - RNA, 64 nt, Homo Sapiens
cgagagagugcaguucaggguuaaggcacaucaaacacaggaguaaauggcaguauccuaagag

SEQ ID NO: 574355 - RNA, 64 nt, Homo Sapiens
aaucuauuuuggauagaaauucccuggccuuaggacacaggacagggggggguggggggacuua

SEQ ID NO: 574356 - RNA, 64 nt, Homo Sapiens
acaugugcuacaaaggagcugcuaaggcccuggcacacaggaacgauuacaugagaugccuuag

SEQ ID NO: 574357 - RNA, 64 nt, Homo Sapiens
aucacuaugccugugugaaauauuacaaaauacuacacaggagcagacuguuuuuagguuuugc

SEQ ID NO: 574358 - RNA, 64 nt, Homo Sapiens
gacugcugaaggaaccccauggaugaggugcaggcuacuucacucuuuuuuuuucuuuuuugag

SEQ ID NO: 574359 - RNA, 64 nt, Homo Sapiens
guugggauuauaggugugagccacugcacccagccuacuucacucuucugaauuauucugauuu

SEQ ID NO: 574360 - RNA, 64 nt, Homo Sapiens
guucauucaauuccagaaaaacucauggaugagacuacuucagaaucagguacugaugaagagc

SEQ ID NO: 574361 - RNA, 64 nt, Homo Sapiens
acaaagguggcagcaguugaaggaagagauugagcuacuucaggacuuaaaacaaaccuugugc

SEQ ID NO: 574362 - RNA, 64 nt, Homo Sapiens; identical to SEQ ID NO: 154522

SEQ ID NO: 574363 - RNA, 64 nt, Homo Sapiens; identical to SEQ ID NO: 154523

SEQ ID NO: 574364 - RNA, 64 nt, Homo Sapiens; identical to SEQ ID NO: 154524

SEQ ID NO: 574365 - RNA, 64 nt, Homo Sapiens; identical to SEQ ID NO: 154525

SEQ ID NO: 574366 - RNA, 64 nt, Homo Sapiens; identical to SEQ ID NO: 154526

SEQ ID NO: 574367 - RNA, 64 nt, Homo Sapiens; identical to SEQ ID NO: 154527

SEQ ID NO: 574368 - RNA, 64 nt, Homo Sapiens; identical to SEQ ID NO: 154528

SEQ ID NO: 574369 - RNA, 64 nt, Homo Sapiens; identical to SEQ ID NO: 154529

SEQ ID NO: 574370 - RNA, 64 nt, Homo Sapiens; identical to SEQ ID NO: 154530

SEQ ID NO: 574371 - RNA, 64 nt, Homo Sapiens; identical to SEQ ID NO: 154531

SEQ ID NO: 574372 - RNA, 64 nt, Homo Sapiens; identical to SEQ ID NO: 154532

SEQ ID NO: 574373 - RNA, 64 nt, Homo Sapiens; identical to SEQ ID NO: 154533

SEQ ID NO: 574374 - RNA, 64 nt, Homo Sapiens; identical to SEQ ID NO: 154534

SEQ ID NO: 574375 - RNA, 64 nt, Homo Sapiens; identical to SEQ ID NO: 154535

SEQ ID NO: 574376 - RNA, 64 nt, Homo Sapiens; identical to SEQ ID NO: 154536

SEQ ID NO: 574377 - RNA, 64 nt, Homo Sapiens; identical to SEQ ID NO: 154537

SEQ ID NO: 574378 - RNA, 64 nt, Homo Sapiens; identical to SEQ ID NO: 154538

SEQ ID NO: 574379 - RNA, 64 nt, Homo Sapiens; identical to SEQ ID NO: 154539

SEQ ID NO: 574380 - RNA, 64 nt, Homo Sapiens; identical to SEQ ID NO: 154540

SEQ ID NO: 574381 - RNA, 64 nt, Homo Sapiens; identical to SEQ ID NO: 154541

SEQ ID NO: 574382 - RNA, 64 nt, Homo Sapiens; identical to SEQ ID NO: 154542

SEQ ID NO: 574383 - RNA, 64 nt, Homo Sapiens; identical to SEQ ID NO: 154543

SEQ ID NO: 574384 - RNA, 64 nt, Homo Sapiens; identical to SEQ ID NO: 154544

SEQ ID NO: 574385 - RNA, 64 nt, Homo Sapiens; identical to SEQ ID NO: 154545

SEQ ID NO: 574386 - RNA, 64 nt, Homo Sapiens; identical to SEQ ID NO: 154546

SEQ ID NO: 574387 - RNA, 64 nt, Homo Sapiens; identical to SEQ ID NO: 154547

SEQ ID NO: 574388 - RNA, 64 nt, Homo Sapiens; identical to SEQ ID NO: 154548

SEQ ID NO: 574389 - RNA, 64 nt, Homo Sapiens; identical to SEQ ID NO: 154549

SEQ ID NO: 574390 - RNA, 64 nt, Homo Sapiens; identical to SEQ ID NO: 154550

SEQ ID NO: 574391 - RNA, 64 nt, Homo Sapiens; identical to SEQ ID NO: 154551

SEQ ID NO: 574392 - RNA, 64 nt, Homo Sapiens
caacacuugcauuguagagaaaggcuucuuauauccuuuucaauagacugcccuggcucuuucc

SEQ ID NO: 574393 - RNA, 64 nt, Homo Sapiens
cuuuguacagagauuuguacauuuguguaauaggccuuuucaugcuuuauguguagcuuuuuac

SEQ ID NO: 574394 - RNA, 64 nt, Homo Sapiens
aaaauaacuuagacucuaguaaauucccuuuucaccuuuucaggagggaaaagauaaagaccag

SEQ ID NO: 574395 - RNA, 64 nt, Homo Sapiens
uuuucaggaaaauaacuuagaagaccagaaauucccuuuucaccaggugauaagggaaaagaua

SEQ ID NO: 574396 - RNA, 64 nt, Homo Sapiens
aagggucucaaccccaguguacagcacacagcucccuuuucaaaugaacuuuggcaaugagaac

SEQ ID NO: 574397 - RNA, 64 nt, Homo Sapiens
gcaccauucucagaacaccucaaaagugacaaguccuuuucacaaaagggggagcucaauagcu

SEQ ID NO: 574398 - RNA, 64 nt, Homo Sapiens
ggaaaacauuaaaaucccuuauuuuuuuaguuuuccuuuucaaaggagggacuuguuuacggga

SEQ ID NO: 574399 - RNA, 64 nt, Homo Sapiens
ugaccacaaguccucugaugagagacuauuacuuccuuuucacacucucugccuugaaaacuaa

SEQ ID NO: 574400 - RNA, 64 nt, Homo Sapiens
auauuugaacaaauauaguuuuuguauucuuauaccuuuucaaucuagccacuguuaauaucua

SEQ ID NO: 574401 - RNA, 64 nt, Homo Sapiens
auaaaagugacaauuguagcuuccuucugagcuuccuuuucaaaagaucucucuaagaguuuuu

SEQ ID NO: 574402 - RNA, 64 nt, Homo Sapiens
uucaucaucgcuguaacuaguaaguucaucuaguccuuuucaaauagaaaaacaacaaaaccca

SEQ ID NO: 574403 - RNA, 64 nt, Homo Sapiens
uucagugauucuguuuucauaggcuuuuuaaagcccuuuucagucaaauuagaugcuccuuugu

SEQ ID NO: 574404 - RNA, 64 nt, Homo Sapiens
uguaaaugcaguuauaaccuuuuauacagauuuaccuuuucaguguucaguacaaguuuaaguu

SEQ ID NO: 574405 - RNA, 64 nt, Homo Sapiens
aguuaccagaaguauggccucuaaugguguugagccuuuucaagaaccaacaaauuaucuuugu

SEQ ID NO: 574406 - RNA, 64 nt, Homo Sapiens
accuccauauuuucaggauuuuugaagcuguugaccuuuucauguugauuauuuuaaauugugu

SEQ ID NO: 574407 - RNA, 64 nt, Homo Sapiens
aacguguauuuuuuuaauauaaauauauaacuguccuuuucaucccauguugccgcuaagugau

SEQ ID NO: 574408 - RNA, 64 nt, Homo Sapiens
uuuaaggcaaaaguacuugagccuauguauuuuaccuuuucauaauuuucccugcccucagguu

SEQ ID NO: 574409 - RNA, 64 nt, Homo Sapiens
auuuuuuagcuuuuaugcuuauagguuuugcaagccuuuucauuaaucauguuuucuugcugug

SEQ ID NO: 574410 - RNA, 64 nt, Homo Sapiens
aauuuugcuaaacuuuguaaggugaacuugcuucccuuuucacuaagaaaaaguguaacacuaa

SEQ ID NO: 574411 - RNA, 64 nt, Homo Sapiens
gaauguuggcagcauuuagucuucuuuuaaccugccuuuucacuaagcaagugaaguauagcug

SEQ ID NO: 574412 - RNA, 64 nt, Homo Sapiens
uccuuuugaugcacugaccaggaauugugauaauccuuuucauuuuuauggcuuuuuacaguuu

SEQ ID NO: 574413 - RNA, 64 nt, Homo Sapiens
aacuaugcagccaugaaacacaagaaaaucauguccuuuucagcaacauggaugcaacuagagg

SEQ ID NO: 574414 - RNA, 64 nt, Homo Sapiens
acaugauaguuuccauaacauaaccuuuucauaaccuuuucauauucauaacaugauaguuucc

SEQ ID NO: 574415 - RNA, 64 nt, Homo Sapiens
accuuuucauaacaugauagugauaguuuccuaaccuuuucauaaauauuagcuuuucauaaca

SEQ ID NO: 574416 - RNA, 63 nt, Homo Sapiens
aggacauccuggaggugugaacuucuucucugaccuuuucaauaauauuuuaaauacaguuuu

SEQ ID NO: 574417 - RNA, 64 nt, Homo Sapiens
cuuccucaggaaaucugaaauacaauugcuguugccuuuucagagaaacuuuugguuuucuuua

SEQ ID NO: 574418 - RNA, 64 nt, Homo Sapiens
cuguggagcggugcagaugugaaagugagaaagcccuuuucacaguagcccccagggaucaugu

SEQ ID NO: 574419 - RNA, 64 nt, Homo Sapiens
aauguagaccuccaugaacugcaccggggggucaccuuuucacauugaacaaugauacacagcu

SEQ ID NO: 574420 - RNA, 64 nt, Homo Sapiens
agaaaugugcugcauugccgaguucuuauuuucaccuuuucauaaucccaacuacaauaacaag

SEQ ID NO: 574421 - RNA, 64 nt, Homo Sapiens
ggguggcucccuugcuccaggaacugaacgaggcccuuuucauaccuuaaauauauucugcaca

SEQ ID NO: 574422 - RNA, 64 nt, Homo Sapiens
guaguauuauauauaaaauauaguuccccgucccccuuuucauugaguuugauauucuucagua

SEQ ID NO: 574423 - RNA, 64 nt, Homo Sapiens
aauuaguauuuauaugaaagucaagaucuaaguaccuuuucauauaauucaaacugauugcuug

SEQ ID NO: 574424 - RNA, 64 nt, Homo Sapiens
acuggucuaaaaacuauuguuaucuuuuuuuuuuccuuuucacuguuauggccuuuucacauuu

SEQ ID NO: 574425 - RNA, 64 nt, Homo Sapiens
uguuaucuuuuuuuuuuccuuuucacuguuauggccuuuucacauuucuaaaucccaucuugau

SEQ ID NO: 574426 - RNA, 64 nt, Homo Sapiens
uagaagaaugaaguacucugaaguauuuugguugccuuuucauuucaacuguguuuugaauuug

SEQ ID NO: 574427 - RNA, 64 nt, Homo Sapiens
augaauaaacuuuaaaaaugugaaguguccuuuuccuuuucacaauacaaaaaaaauuucaaca

SEQ ID NO: 574428 - RNA, 64 nt, Homo Sapiens
cccacuugcccuuucucuuuagucuuugucccuuccuuuucacuaagugccccucauccuuuuc

SEQ ID NO: 574429 - RNA, 64 nt, Homo Sapiens
cuuugucccuuccuuuucacuaagugccccucauccuuuucaaucucauugucacuggauagug

SEQ ID NO: 574430 - RNA, 64 nt, Homo Sapiens
gguaaccauguuguguucuucuaggcauuacuggccuuuucacugacaaguuaccccugaaauc

SEQ ID NO: 574431 - RNA, 64 nt, Homo Sapiens
ucugcaguggcaaaugguaggggcaauagcgcucccuuuucaccugaaaugccuucagcucagg

SEQ ID NO: 574432 - RNA, 64 nt, Homo Sapiens
guuguguggauauaacauuuaucucaauuagccaccuuuucacaaauucaaguuuaugggagaa

SEQ ID NO: 574433 - RNA, 64 nt, Homo Sapiens
agaucuccacuaguuuuugugaagauagauacagccuuuucagaguaugucaguauauuaugca

SEQ ID NO: 574434 - RNA, 64 nt, Homo Sapiens
ugaccagggccuuuauuuggauuuuuacguagucaucaacaauuuuaauguauuaguccaaauu

SEQ ID NO: 574435 - RNA, 64 nt, Homo Sapiens
uaauguauuaguccaaauuagaauuauuuuaaugaucaacaauuaaaagacaagcacuuuggaa

SEQ ID NO: 574436 - RNA, 64 nt, Homo Sapiens
ccuacugacugcacaucuuaucaacaaguccucaaucaacaaguucuuuucaccccaccuucaa

SEQ ID NO: 574437 - RNA, 64 nt, Homo Sapiens
ccucaaucaacaaguccuacucaccccaccuucaaucaacaagucagaaaccugugucaucuuu

SEQ ID NO: 574438 - RNA, 64 nt, Homo Sapiens
uuuagcauucuaaauuuaaaugcuuaaaacgucaaucaacaaaacuuuguuuuaaauauuguaa

SEQ ID NO: 574439 - RNA, 64 nt, Homo Sapiens
acaaaugaauccagacuugucuaacagauuuuccaucaacaaauauuguuaugugcaaaaguau

SEQ ID NO: 574440 - RNA, 64 nt, Homo Sapiens; identical to SEQ ID NO: 172974

SEQ ID NO: 574441 - RNA, 64 nt, Homo Sapiens; identical to SEQ ID NO: 172975

SEQ ID NO: 574442 - RNA, 64 nt, Homo Sapiens; identical to SEQ ID NO: 172976

SEQ ID NO: 574443 - RNA, 64 nt, Homo Sapiens; identical to SEQ ID NO: 172977

SEQ ID NO: 574444 - RNA, 64 nt, Homo Sapiens; identical to SEQ ID NO: 172978

SEQ ID NO: 574445 - RNA, 64 nt, Homo Sapiens; identical to SEQ ID NO: 172979

SEQ ID NO: 574446 - RNA, 64 nt, Homo Sapiens; identical to SEQ ID NO: 172980

SEQ ID NO: 574447 - RNA, 64 nt, Homo Sapiens; identical to SEQ ID NO: 172981

SEQ ID NO: 574448 - RNA, 64 nt, Homo Sapiens; identical to SEQ ID NO: 172982

SEQ ID NO: 574449 - RNA, 64 nt, Homo Sapiens; identical to SEQ ID NO: 172983

SEQ ID NO: 574450 - RNA, 64 nt, Homo Sapiens; identical to SEQ ID NO: 172984

SEQ ID NO: 574451 - RNA, 64 nt, Homo Sapiens; identical to SEQ ID NO: 172985

SEQ ID NO: 574452 - RNA, 64 nt, Homo Sapiens; identical to SEQ ID NO: 172986

SEQ ID NO: 574453 - RNA, 64 nt, Homo Sapiens; identical to SEQ ID NO: 172987

SEQ ID NO: 574454 - RNA, 64 nt, Homo Sapiens; identical to SEQ ID NO: 172988

SEQ ID NO: 574455 - RNA, 54 nt, Homo Sapiens; identical to SEQ ID NO: 172989

SEQ ID NO: 574456 - RNA, 64 nt, Homo Sapiens; identical to SEQ ID NO: 172990

SEQ ID NO: 574457 - RNA, 64 nt, Homo Sapiens; identical to SEQ ID NO: 172991

SEQ ID NO: 574458 - RNA, 64 nt, Homo Sapiens; identical to SEQ ID NO: 172992

SEQ ID NO: 574459 - RNA, 64 nt, Homo Sapiens; identical to SEQ ID NO: 172993

SEQ ID NO: 574460 - RNA, 64 nt, Homo Sapiens; identical to SEQ ID NO: 172994

SEQ ID NO: 574461 - RNA, 64 nt, Homo Sapiens; identical to SEQ ID NO: 172995

SEQ ID NO: 574462 - RNA, 64 nt, Homo Sapiens; identical to SEQ ID NO: 172996

SEQ ID NO: 574463 - RNA, 64 nt, Homo Sapiens; identical to SEQ ID NO: 172997

SEQ ID NO: 574464 - RNA, 64 nt, Homo Sapiens; identical to SEQ ID NO: 172998

SEQ ID NO: 574465 - RNA, 64 nt, Homo Sapiens; identical to SEQ ID NO: 172999

SEQ ID NO: 574466 - RNA, 64 nt, Homo Sapiens; identical to SEQ ID NO: 173000

SEQ ID NO: 574467 - RNA, 64 nt, Homo Sapiens; identical to SEQ ID NO: 173001

SEQ ID NO: 574468 - RNA, 64 nt, Homo Sapiens; identical to SEQ ID NO: 173002

SEQ ID NO: 574469 - RNA, 64 nt, Homo Sapiens; identical to SEQ ID NO: 173003

SEQ ID NO: 574470 - RNA, 64 nt, Homo Sapiens; identical to SEQ ID NO: 173004

SEQ ID NO: 574471 - RNA, 61 nt, Homo Sapiens; identical to SEQ ID NO: 173005

SEQ ID NO: 574472 - RNA, 64 nt, Homo Sapiens; identical to SEQ ID NO: 173006

SEQ ID NO: 574473 - RNA, 64 nt, Homo Sapiens; identical to SEQ ID NO: 173007

SEQ ID NO: 574474 - RNA, 64 nt, Homo Sapiens; identical to SEQ ID NO: 173008

SEQ ID NO: 574475 - RNA, 64 nt, Homo Sapiens; identical to SEQ ID NO: 173009

SEQ ID NO: 574476 - RNA, 64 nt, Homo Sapiens
gagcuugucagcaagaggaggacagaauucucccagcguuaacacaaaauccaugggcaguaug

SEQ ID NO: 574477 - RNA, 64 nt, Homo Sapiens
auaaaaaauguuuagauacauaaauaugguggucagcguuaauaaaguggagaaauauuggaga

SEQ ID NO: 574478 - RNA, 64 nt, Homo Sapiens
aaaccucucauaaucccacugcauagaaauaacaagcguuaacauuuucauauuuuuuucuuuc

SEQ ID NO: 574479 - RNA, 64 nt, Homo Sapiens
uccacuaagaaaugccaagauucuuaaauuugccagcguuaaaguagaaaauaacauuucagaa

SEQ ID NO: 574480 - RNA, 64 nt, Homo Sapiens
guuccuuucaaaggagaaugaaauucacacugccagcguuaacauuuuuaaagaagaaaaaaaa

SEQ ID NO: 574481 - RNA, 64 nt, Homo Sapiens
ccauaaaacuuagcuaaguuuuguuuuguuuuucagcguuaauguaaaggggcagcagugccaa

SEQ ID NO: 574482 - RNA, 64 nt, Homo Sapiens
ugcugcaugucaucuggcguuguuccgaccuggaagcguuaaacucucgcaauuuugaggaggc

SEQ ID NO: 574483 - RNA, 64 nt, Homo Sapiens
accuuuaucuucaugaauaauagaagaaaaguuuagcguuaagcaaacaauccaaaucuaagcu

SEQ ID NO: 574484 - RNA, 64 nt, Homo Sapiens
gguauuauguuaaaugucuguuuuaaaagaaaguagcguuaagauagaucaguaaccaaaauca

SEQ ID NO: 574485 - RNA, 64 nt, Homo Sapiens
gguauuauguuaacugucuguuuuaaaagaaaguagcguuaagauagaucaguaaccaaaauca

SEQ ID NO: 574486 - RNA, 64 nt, Homo Sapiens
caacuaugaagaucugcagcguguuauguuuuacagcguuaaaauaaauagcgacuucaguauu

SEQ ID NO: 574487 - RNA, 64 nt, Homo Sapiens
uucguaacuaauuacauauccaaagcaaugccuuagcguuaacccucaggauaaaaacuguaaa

SEQ ID NO: 574488 - RNA, 64 nt, Homo Sapiens
aaaguuuuaaauaaauggcuauuauuuuucuucaagcguuaauaccuguacauugucacauugc

SEQ ID NO: 574489 - RNA, 64 nt, Homo Sapiens
augaacuuuggucccaaauauccaucuuuucaguagcguuaauuaugcucuguuuccaacugca

SEQ ID NO: 574490 - RNA, 64 nt, Homo Sapiens
aaaaagcaaugaauauguaagaaucaucagcuguagcguuaacacuaaauacaccaaggacaaa

SEQ ID NO: 574491 - RNA, 64 nt, Homo Sapiens
gccacugaaacuggguauauuuaugauuucuuucagcguuaaaaagaaacauaguguugcccuu

SEQ ID NO: 574492 - RNA, 64 nt, Homo Sapiens
uuuguuuguauuaagcacuuuaagaauaauuagcagcguuaaauaacuaauguuuuauggcacu

SEQ ID NO: 574493 - RNA, 64 nt, Homo Sapiens
gcagagucuaccuugaaaccguauuaguacaauaagcguuaaggcaauucaguccugggcaaag

SEQ ID NO: 574494 - RNA, 64 nt, Homo Sapiens
ugugaacagagaaaugccucccguaguguuugaaagcguuaagcugauaauguaauuaacaacu

SEQ ID NO: 574495 - RNA, 64 nt, Homo Sapiens
agaauguguauaggaggguuuggcugaguccuucagcguuaaguggaggaaagcuuggggaagc

SEQ ID NO: 574496 - RNA, 64 nt, Homo Sapiens
uguuagauguccucagaagucaguugcaaauuuuagcguuaaagucaggauuuauuguucauac

SEQ ID NO: 574497 - RNA, 64 nt, Homo Sapiens
caguaaaauauucaauaagacuguauaaauaaugagcguuaacaauauucuguaaaccuaaugu

SEQ ID NO: 574498 - RNA, 64 nt, Homo Sapiens
uuucuacacaauauaaauauccaguauaaaggaaagcguuaagucgguaagcuagaggauugua

SEQ ID NO: 574499 - RNA, 64 nt, Homo Sapiens
gguagaaaaaaaacaagaaaaaaauuuuaaaaauagcguuaaaaugcauuuuaggcuccuaaug

SEQ ID NO: 574500 - RNA, 64 nt, Homo Sapiens
auuguguuuuucagaaucuuuggcggacuacauaagcguuaaaaucaguacauugauguuuuga

SEQ ID NO: 574501 - RNA, 64 nt, Homo Sapiens
gcuccaggauccagcucucuaaggcccugggagcagcguuaaggaaacggcucuuuuauuuaug

SEQ ID NO: 574502 - RNA, 64 nt, Homo Sapiens
augaaacugggccaaggggaaaauucaguaaguuagcguuaaauggaaguaaauauauguauac

SEQ ID NO: 574503 - RNA, 64 nt, Homo Sapiens
gaauucuugcuuuuagacaagacuuuucuuacccagcguuaauuggacaacucauuaguguuuu

SEQ ID NO: 574504 - RNA, 64 nt, Homo Sapiens
uuggucuucuguauuuuggagcaaacagaaugcaagcguuaacuuagcgauauaaccuugcuuu

SEQ ID NO: 574505 - RNA, 64 nt, Homo Sapiens
gcucauaauuuuaaucagcucaaaaccauccuaaagcguuaacuacaguguaaguuuccauuaa

SEQ ID NO: 574506 - RNA, 64 nt, Homo Sapiens
gcaguugugugucuguggcacugugucacuuuuuagcguuaaugucucaagcaugguuccaacu

SEQ ID NO: 574507 - RNA, 64 nt, Homo Sapiens
uaauuuuggcaaauuguuaagacacugugaagucagcguuaaccaugugcauacaacuuaagga

SEQ ID NO: 574508 - RNA, 64 nt, Homo Sapiens
agagaggggaauggccaaaaucacaaagcaaguuagcguuaagagcugagacuagaauucaggg

SEQ ID NO: 574509 - RNA, 64 nt, Homo Sapiens
ucgucacuugaaaacgagaagaccaaaccgucccagcguuaaugucuuugccucuccccggggg

SEQ ID NO: 574510 - RNA, 64 nt, Homo Sapiens
uuagaaagaaaaaugaggcaaugauuuuauuaacagcguuaaguuuuaauuuacaacuuuuaaa

SEQ ID NO: 574511 - RNA, 64 nt, Homo Sapiens
gcgcugugacccugcaguagcgcaaaggcugcgcagcguuaaugcgcauugcgugcgaaugaac

SEQ ID NO: 574512 - RNA, 64 nt, Homo Sapiens
uugacaauauuaaggcaauaagaggaauaagcuuagcguuaauacauaacucauugaauuuugg

SEQ ID NO: 574513 - RNA, 64 nt, Homo Sapiens; identical to SEQ ID NO: 129470

SEQ ID NO: 574514 - RNA, 64 nt, Homo Sapiens; identical to SEQ ID NO: 129471

SEQ ID NO: 574515 - RNA, 64 nt, Homo Sapiens; identical to SEQ ID NO: 129472

SEQ ID NO: 574516 - RNA, 64 nt, Homo Sapiens; identical to SEQ ID NO: 129473

SEQ ID NO: 574517 - RNA, 64 nt, Homo Sapiens; identical to SEQ ID NO: 129474

SEQ ID NO: 574518 - RNA, 64 nt, Homo Sapiens; identical to SEQ ID NO: 129475

SEQ ID NO: 574519 - RNA, 64 nt, Homo Sapiens; identical to SEQ ID NO: 129476

SEQ ID NO: 574520 - RNA, 64 nt, Homo Sapiens; identical to SEQ ID NO: 129477

SEQ ID NO: 574521 - RNA, 64 nt, Homo Sapiens; identical to SEQ ID NO: 129478

SEQ ID NO: 574522 - RNA, 64 nt, Homo Sapiens; identical to SEQ ID NO: 129479

SEQ ID NO: 574523 - RNA, 64 nt, Homo Sapiens
caggccaggaaggaggggaaugggacagucagauucuucuaaaucaaccaagaauucuguaucc

SEQ ID NO: 574524 - RNA, 64 nt, Homo Sapiens
agaggcuggccugucuuuaaguuccaaggauggcucuucuaacccuccuuaagucuuguagggg

SEQ ID NO: 574525 - RNA, 64 nt, Homo Sapiens
uaccuaagcacuuuaaaauagcauuucaaauucaucuucuaacccuuguuagaaaucccuggag

SEQ ID NO: 574526 - RNA, 64 nt, Homo Sapiens
cuuggccugaaucugguugacacugccuccucccucuucuaagcuagagucccuggcuucuggc

SEQ ID NO: 574527 - RNA, 64 nt, Homo Sapiens
uccaaaagaagauguaauaaggaggcuaauauugucuucuaaguuuuuaauucucaaaagugua

SEQ ID NO: 574528 - RNA, 64 nt, Homo Sapiens
acuauacuuuuaguucucacuaaugccuguguuuucuucuaagauaauccaaggucaagaagau

SEQ ID NO: 574529 - RNA, 64 nt, Homo Sapiens
caguaagaauuagguggaaucaaacgugcuuuauucuucuaacguacgauaauguguacuauga

SEQ ID NO: 574530 - RNA, 64 nt, Homo Sapiens
cgugaagaaaauaguuugagcaaugccuaugaauucuucuaauagaaauucuuauuuugaccau

SEQ ID NO: 574531 - RNA, 64 nt, Homo Sapiens
ucuucuaugguaguaccuacagaucugcccuucuucuucuaaaggguaagucauaaucugugua

SEQ ID NO: 574532 - RNA, 64 nt, Homo Sapiens
uacaauuuaugggaugcucacuaugcccuguuucucuucuaaacaauuuacauguaaugucuca

SEQ ID NO: 574533 - RNA, 64 nt, Homo Sapiens
aacuuaaaagacaccaaucuacuucaauauuuucucuucuaaccacccuuuacuaaagaaauaa

SEQ ID NO: 574534 - RNA, 64 nt, Homo Sapiens
guauguaguaaguuuccuuuaugcaauugcuauaucuucuaauuucuccguuuucauuaacuuu

SEQ ID NO: 574535 - RNA, 64 nt, Homo Sapiens
aacuaccuauccuuacauuucaccuacuaaugucucuucuaacaucuuagagguccauggagaa

SEQ ID NO: 574536 - RNA, 64 nt, Homo Sapiens
aucugguucuauaugaaugcuauuuuuucccuucucuucuaacaugaaauauauuuucucuuuu

SEQ ID NO: 574537 - RNA, 64 nt, Homo Sapiens
cccugaaauccugaguuuaaagaaaucauauaucucuucuaaccaagauuucuugaaggauuuu

SEQ ID NO: 574538 - RNA, 64 nt, Homo Sapiens
cgugugcagcacggggcgaaacuuccggacacgcucuucuaaagcgaggagggccggggaggac

SEQ ID NO: 574539 - RNA, 64 nt, Homo Sapiens
aaguauggaauaucucauguuaacacaaagccuaucuucuaauguacagcugggaaaaaucauu

SEQ ID NO: 574540 - RNA, 64 nt, Homo Sapiens
ccacagggauccccagaugguugggcagacagagucuucuaagcgggcaaaaccaugacuuuca

SEQ ID NO: 574541 - RNA, 64 nt, Homo Sapiens
ccaauccaaauggcgucuggucuaaacuuccccaucuucuaaacacucaggccaagaaacgucu

SEQ ID NO: 574542 - RNA, 64 nt, Homo Sapiens
uuccccaucuucuaaacccacaggccaagaaacgucuucuaaacaucucuacucuuaagagacu

SEQ ID NO: 574543 - RNA, 51 nt, Homo Sapiens; identical to SEQ ID NO: 516816

SEQ ID NO: 574544 - RNA, 64 nt, Homo Sapiens; identical to SEQ ID NO: 516817

SEQ ID NO: 574545 - RNA, 64 nt, Homo Sapiens; identical to SEQ ID NO: 516818

SEQ ID NO: 574546 - RNA, 64 nt, Homo Sapiens; identical to SEQ ID NO: 516819

SEQ ID NO: 574547 - RNA, 64 nt, Homo Sapiens; identical to SEQ ID NO: 516820

SEQ ID NO: 574548 - RNA, 64 nt, Homo Sapiens; identical to SEQ ID NO: 516821

SEQ ID NO: 574549 - RNA, 64 nt, Homo Sapiens; identical to SEQ ID NO: 516822

SEQ ID NO: 574550 - RNA, 64 nt, Homo Sapiens; identical to SEQ ID NO: 516823

SEQ ID NO: 574551 - RNA, 64 nt, Homo Sapiens; identical to SEQ ID NO: 516824

SEQ ID NO: 574552 - RNA, 64 nt, Homo Sapiens; identical to SEQ ID NO: 516825

SEQ ID NO: 574553 - RNA, 64 nt, Homo Sapiens; identical to SEQ ID NO: 516826

SEQ ID NO: 574554 - RNA, 64 nt, Homo Sapiens; identical to SEQ ID NO: 516827

SEQ ID NO: 574555 - RNA, 64 nt, Homo Sapiens; identical to SEQ ID NO: 516828

SEQ ID NO: 574556 - RNA, 64 nt, Homo Sapiens; identical to SEQ ID NO: 516829

SEQ ID NO: 574557 - RNA, 64 nt, Homo Sapiens; identical to SEQ ID NO: 516830

SEQ ID NO: 574558 - RNA, 64 nt, Homo Sapiens; identical to SEQ ID NO: 516831

SEQ ID NO: 574559 - RNA, 64 nt, Homo Sapiens; identical to SEQ ID NO: 516832

SEQ ID NO: 574560 - RNA, 64 nt, Homo Sapiens; identical to SEQ ID NO: 516833

SEQ ID NO: 574561 - RNA, 64 nt, Homo Sapiens; identical to SEQ ID NO: 516834

SEQ ID NO: 574562 - RNA, 64 nt, Homo Sapiens; identical to SEQ ID NO: 516835

SEQ ID NO: 574563 - RNA, 64 nt, Homo Sapiens; identical to SEQ ID NO: 516836

SEQ ID NO: 574564 - RNA, 64 nt, Homo Sapiens; identical to SEQ ID NO: 516837

SEQ ID NO: 574565 - RNA, 64 nt, Homo Sapiens; identical to SEQ ID NO: 516838

SEQ ID NO: 574566 - RNA, 64 nt, Homo Sapiens; identical to SEQ ID NO: 516839

SEQ ID NO: 574567 - RNA, 64 nt, Homo Sapiens; identical to SEQ ID NO: 516840

SEQ ID NO: 574568 - RNA, 64 nt, Homo Sapiens; identical to SEQ ID NO: 516841

SEQ ID NO: 574569 - RNA, 64 nt, Homo Sapiens; identical to SEQ ID NO: 516842

SEQ ID NO: 574570 - RNA, 64 nt, Homo Sapiens; identical to SEQ ID NO: 516843

SEQ ID NO: 574571 - RNA, 64 nt, Homo Sapiens; identical to SEQ ID NO: 516844

SEQ ID NO: 574572 - RNA, 64 nt, Homo Sapiens; identical to SEQ ID NO: 516845

SEQ ID NO: 574573 - RNA, 64 nt, Homo Sapiens; identical to SEQ ID NO: 516846

SEQ ID NO: 574574 - RNA, 64 nt, Homo Sapiens; identical to SEQ ID NO: 516847

SEQ ID NO: 574575 - RNA, 64 nt, Homo Sapiens; identical to SEQ ID NO: 516848

SEQ ID NO: 574576 - RNA, 64 nt, Homo Sapiens; identical to SEQ ID NO: 516849

SEQ ID NO: 574577 - RNA, 64 nt, Homo Sapiens; identical to SEQ ID NO: 516850

SEQ ID NO: 574578 - RNA, 64 nt, Homo Sapiens; identical to SEQ ID NO: 516851

SEQ ID NO: 574579 - RNA, 64 nt, Homo Sapiens; identical to SEQ ID NO: 516852

SEQ ID NO: 574580 - RNA, 64 nt, Homo Sapiens; identical to SEQ ID NO: 516853

SEQ ID NO: 574581 - RNA, 64 nt, Homo Sapiens; identical to SEQ ID NO: 516854

SEQ ID NO: 574582 - RNA, 64 nt, Homo Sapiens; identical to SEQ ID NO: 516855

SEQ ID NO: 574583 - RNA, 64 nt, Homo Sapiens; identical to SEQ ID NO: 516856

SEQ ID NO: 574584 - RNA, 64 nt, Homo Sapiens; identical to SEQ ID NO: 516857

SEQ ID NO: 574585 - RNA, 64 nt, Homo Sapiens; identical to SEQ ID NO: 516858

SEQ ID NO: 574586 - RNA, 64 nt, Homo Sapiens; identical to SEQ ID NO: 516859

SEQ ID NO: 574587 - RNA, 64 nt, Homo Sapiens; identical to SEQ ID NO: 516860

SEQ ID NO: 574588 - RNA, 64 nt, Homo Sapiens; identical to SEQ ID NO: 516861

SEQ ID NO: 574589 - RNA, 64 nt, Homo Sapiens; identical to SEQ ID NO: 516862

SEQ ID NO: 574590 - RNA, 64 nt, Homo Sapiens; identical to SEQ ID NO: 516863

SEQ ID NO: 574591 - RNA, 64 nt, Homo Sapiens; identical to SEQ ID NO: 516864

SEQ ID NO: 574592 - RNA, 64 nt, Homo Sapiens; identical to SEQ ID NO: 516865

SEQ ID NO: 574593 - RNA, 64 nt, Homo Sapiens; identical to SEQ ID NO: 516866

SEQ ID NO: 574594 - RNA, 64 nt, Homo Sapiens; identical to SEQ ID NO: 235822

SEQ ID NO: 574595 - RNA, 64 nt, Homo Sapiens; identical to SEQ ID NO: 235823

SEQ ID NO: 574596 - RNA, 64 nt, Homo Sapiens; identical to SEQ ID NO: 235824

SEQ ID NO: 574597 - RNA, 64 nt, Homo Sapiens; identical to SEQ ID NO: 235825

SEQ ID NO: 574598 - RNA, 64 nt, Homo Sapiens; identical to SEQ ID NO: 235826

SEQ ID NO: 574599 - RNA, 64 nt, Homo Sapiens; identical to SEQ ID NO: 235827

SEQ ID NO: 574600 - RNA, 64 nt, Homo Sapiens; identical to SEQ ID NO: 235828

SEQ ID NO: 574601 - RNA, 64 nt, Homo Sapiens; identical to SEQ ID NO: 235829

SEQ ID NO: 574602 - RNA, 64 nt, Homo Sapiens; identical to SEQ ID NO: 235830

SEQ ID NO: 574603 - RNA, 64 nt, Homo Sapiens; identical to SEQ ID NO: 235831

SEQ ID NO: 574604 - RNA, 64 nt, Homo Sapiens; identical to SEQ ID NO: 235832

SEQ ID NO: 574605 - RNA, 64 nt, Homo Sapiens; identical to SEQ ID NO: 235833

SEQ ID NO: 574606 - RNA, 64 nt, Homo Sapiens; identical to SEQ ID NO: 235834

SEQ ID NO: 574607 - RNA, 64 nt, Homo Sapiens; identical to SEQ ID NO: 235835

SEQ ID NO: 574608 - RNA, 64 nt, Homo Sapiens; identical to SEQ ID NO: 235836

SEQ ID NO: 574609 - RNA, 64 nt, Homo Sapiens; identical to SEQ ID NO: 235837

SEQ ID NO: 574610 - RNA, 64 nt, Homo Sapiens; identical to SEQ ID NO: 235838

SEQ ID NO: 574611 - RNA, 64 nt, Homo Sapiens; identical to SEQ ID NO: 235839

SEQ ID NO: 574612 - RNA, 64 nt, Homo Sapiens; identical to SEQ ID NO: 235840

SEQ ID NO: 574613 - RNA, 64 nt, Homo Sapiens; identical to SEQ ID NO: 235841

SEQ ID NO: 574614 - RNA, 64 nt, Homo Sapiens; identical to SEQ ID NO: 235842

SEQ ID NO: 574615 - RNA, 64 nt, Homo Sapiens; identical to SEQ ID NO: 235843

SEQ ID NO: 574616 - RNA, 64 nt, Homo Sapiens; identical to SEQ ID NO: 235844

SEQ ID NO: 574617 - RNA, 64 nt, Homo Sapiens; identical to SEQ ID NO: 235845

SEQ ID NO: 574618 - RNA, 55 nt, Homo Sapiens; identical to SEQ ID NO: 235846

SEQ ID NO: 574619 - RNA, 64 nt, Homo Sapiens; identical to SEQ ID NO: 235847

SEQ ID NO: 574620 - RNA, 64 nt, Homo Sapiens; identical to SEQ ID NO: 235848

SEQ ID NO: 574621 - RNA, 64 nt, Homo Sapiens; identical to SEQ ID NO: 235849

SEQ ID NO: 574622 - RNA, 64 nt, Homo Sapiens; identical to SEQ ID NO: 235850

SEQ ID NO: 574623 - RNA, 64 nt, Homo Sapiens; identical to SEQ ID NO: 235851

SEQ ID NO: 574624 - RNA, 64 nt, Homo Sapiens; identical to SEQ ID NO: 235852

SEQ ID NO: 574625 - RNA, 64 nt, Homo Sapiens; identical to SEQ ID NO: 235853

SEQ ID NO: 574626 - RNA, 64 nt, Homo Sapiens; identical to SEQ ID NO: 235854

SEQ ID NO: 574627 - RNA, 64 nt, Homo Sapiens; identical to SEQ ID NO: 235855

SEQ ID NO: 574628 - RNA, 64 nt, Homo Sapiens; identical to SEQ ID NO: 235856

SEQ ID NO: 574629 - RNA, 64 nt, Homo Sapiens; identical to SEQ ID NO: 235857

SEQ ID NO: 574630 - RNA, 64 nt, Homo Sapiens; identical to SEQ ID NO: 235858

SEQ ID NO: 574631 - RNA, 64 nt, Homo Sapiens; identical to SEQ ID NO: 235859

SEQ ID NO: 574632 - RNA, 64 nt, Homo Sapiens; identical to SEQ ID NO: 235860

SEQ ID NO: 574633 - RNA, 64 nt, Homo Sapiens; identical to SEQ ID NO: 235861

SEQ ID NO: 574634 - RNA, 64 nt, Homo Sapiens; identical to SEQ ID NO: 235862

SEQ ID NO: 574635 - RNA, 64 nt, Homo Sapiens; identical to SEQ ID NO: 235863

SEQ ID NO: 574636 - RNA, 64 nt, Homo Sapiens; identical to SEQ ID NO: 235864

SEQ ID NO: 574637 - RNA, 64 nt, Homo Sapiens; identical to SEQ ID NO: 235865

SEQ ID NO: 574638 - RNA, 64 nt, Homo Sapiens; identical to SEQ ID NO: 235866

SEQ ID NO: 574639 - RNA, 64 nt, Homo Sapiens; identical to SEQ ID NO: 235867

SEQ ID NO: 574640 - RNA, 64 nt, Homo Sapiens; identical to SEQ ID NO: 235868

SEQ ID NO: 574641 - RNA, 64 nt, Homo Sapiens; identical to SEQ ID NO: 235869

SEQ ID NO: 574642 - RNA, 64 nt, Homo Sapiens; identical to SEQ ID NO: 235870

SEQ ID NO: 574643 - RNA, 64 nt, Homo Sapiens; identical to SEQ ID NO: 235871

SEQ ID NO: 574644 - RNA, 64 nt, Homo Sapiens; identical to SEQ ID NO: 235872

SEQ ID NO: 574645 - RNA, 64 nt, Homo Sapiens; identical to SEQ ID NO: 235873

SEQ ID NO: 574646 - RNA, 64 nt, Homo Sapiens; identical to SEQ ID NO: 235874

SEQ ID NO: 574647 - RNA, 64 nt, Homo Sapiens; identical to SEQ ID NO: 235875

SEQ ID NO: 574648 - RNA, 64 nt, Homo Sapiens; identical to SEQ ID NO: 235876

SEQ ID NO: 574649 - RNA, 64 nt, Homo Sapiens; identical to SEQ ID NO: 235877

SEQ ID NO: 574650 - RNA, 64 nt, Homo Sapiens; identical to SEQ ID NO: 235878

SEQ ID NO: 574651 - RNA, 64 nt, Homo Sapiens; identical to SEQ ID NO: 235879

SEQ ID NO: 574652 - RNA, 64 nt, Homo Sapiens; identical to SEQ ID NO: 235880

SEQ ID NO: 574653 - RNA, 64 nt, Homo Sapiens; identical to SEQ ID NO: 235881

SEQ ID NO: 574654 - RNA, 64 nt, Homo Sapiens; identical to SEQ ID NO: 235882

SEQ ID NO: 574655 - RNA, 64 nt, Homo Sapiens; identical to SEQ ID NO: 235883

SEQ ID NO: 574656 - RNA, 64 nt, Homo Sapiens; identical to SEQ ID NO: 235884

SEQ ID NO: 574657 - RNA, 64 nt, Homo Sapiens; identical to SEQ ID NO: 235885

SEQ ID NO: 574658 - RNA, 64 nt, Homo Sapiens; identical to SEQ ID NO: 235886

SEQ ID NO: 574659 - RNA, 64 nt, Homo Sapiens; identical to SEQ ID NO: 111411

SEQ ID NO: 574660 - RNA, 64 nt, Homo Sapiens; identical to SEQ ID NO: 111412

SEQ ID NO: 574661 - RNA, 64 nt, Homo Sapiens; identical to SEQ ID NO: 111413

SEQ ID NO: 574662 - RNA, 64 nt, Homo Sapiens; identical to SEQ ID NO: 111414

SEQ ID NO: 574663 - RNA, 64 nt, Homo Sapiens; identical to SEQ ID NO: 111415

SEQ ID NO: 574664 - RNA, 64 nt, Homo Sapiens; identical to SEQ ID NO: 111416

SEQ ID NO: 574665 - RNA, 64 nt, Homo Sapiens; identical to SEQ ID NO: 111417

SEQ ID NO: 574666 - RNA, 64 nt, Homo Sapiens; identical to SEQ ID NO: 111418

SEQ ID NO: 574667 - RNA, 64 nt, Homo Sapiens; identical to SEQ ID NO: 111419

SEQ ID NO: 574668 - RNA, 64 nt, Homo Sapiens; identical to SEQ ID NO: 111420

SEQ ID NO: 574669 - RNA, 64 nt, Homo Sapiens; identical to SEQ ID NO: 111421

SEQ ID NO: 574670 - RNA, 64 nt, Homo Sapiens; identical to SEQ ID NO: 111422

SEQ ID NO: 574671 - RNA, 64 nt, Homo Sapiens; identical to SEQ ID NO: 111423

SEQ ID NO: 574672 - RNA, 64 nt, Homo Sapiens; identical to SEQ ID NO: 111424

SEQ ID NO: 574673 - RNA, 64 nt, Homo Sapiens; identical to SEQ ID NO: 111425

SEQ ID NO: 574674 - RNA, 64 nt, Homo Sapiens; identical to SEQ ID NO: 111426

SEQ ID NO: 574675 - RNA, 64 nt, Homo Sapiens; identical to SEQ ID NO: 111427

SEQ ID NO: 574676 - RNA, 64 nt, Homo Sapiens; identical to SEQ ID NO: 111428

SEQ ID NO: 574677 - RNA, 64 nt, Homo Sapiens; identical to SEQ ID NO: 111429

SEQ ID NO: 574678 - RNA, 64 nt, Homo Sapiens; identical to SEQ ID NO: 111430

SEQ ID NO: 574679 - RNA, 64 nt, Homo Sapiens; identical to SEQ ID NO: 111431

SEQ ID NO: 574680 - RNA, 64 nt, Homo Sapiens; identical to SEQ ID NO: 111432

SEQ ID NO: 574681 - RNA, 64 nt, Homo Sapiens; identical to SEQ ID NO: 111433

SEQ ID NO: 574682 - RNA, 64 nt, Homo Sapiens; identical to SEQ ID NO: 111434

SEQ ID NO: 574683 - RNA, 58 nt, Homo Sapiens; identical to SEQ ID NO: 111435

SEQ ID NO: 574684 - RNA, 64 nt, Homo Sapiens; identical to SEQ ID NO: 111436

SEQ ID NO: 574685 - RNA, 64 nt, Homo Sapiens; identical to SEQ ID NO: 111437

SEQ ID NO: 574686 - RNA, 64 nt, Homo Sapiens; identical to SEQ ID NO: 111438

SEQ ID NO: 574687 - RNA, 64 nt, Homo Sapiens; identical to SEQ ID NO: 111439

SEQ ID NO: 574688 - RNA, 64 nt, Homo Sapiens; identical to SEQ ID NO: 111440

SEQ ID NO: 574689 - RNA, 64 nt, Homo Sapiens; identical to SEQ ID NO: 111441

SEQ ID NO: 574690 - RNA, 64 nt, Homo Sapiens; identical to SEQ ID NO: 111442

SEQ ID NO: 574691 - RNA, 64 nt, Homo Sapiens; identical to SEQ ID NO: 111443

SEQ ID NO: 574692 - RNA, 64 nt, Homo Sapiens; identical to SEQ ID NO: 111444

SEQ ID NO: 574693 - RNA, 64 nt, Homo Sapiens; identical to SEQ ID NO: 111445

SEQ ID NO: 574694 - RNA, 64 nt, Homo Sapiens; identical to SEQ ID NO: 111446

SEQ ID NO: 574695 - RNA, 64 nt, Homo Sapiens; identical to SEQ ID NO: 111447

SEQ ID NO: 574696 - RNA, 64 nt, Homo Sapiens; identical to SEQ ID NO: 111448

SEQ ID NO: 574697 - RNA, 64 nt, Homo Sapiens; identical to SEQ ID NO: 111449

SEQ ID NO: 574698 - RNA, 64 nt, Homo Sapiens; identical to SEQ ID NO: 111450

SEQ ID NO: 574699 - RNA, 64 nt, Homo Sapiens; identical to SEQ ID NO: 111451

SEQ ID NO: 574700 - RNA, 64 nt, Homo Sapiens; identical to SEQ ID NO: 111452

SEQ ID NO: 574701 - RNA, 64 nt, Homo Sapiens; identical to SEQ ID NO: 111453

SEQ ID NO: 574702 - RNA, 64 nt, Homo Sapiens; identical to SEQ ID NO: 111454

SEQ ID NO: 574703 - RNA, 64 nt, Homo Sapiens; identical to SEQ ID NO: 111455

SEQ ID NO: 574704 - RNA, 64 nt, Homo Sapiens; identical to SEQ ID NO: 111456

SEQ ID NO: 574705 - RNA, 64 nt, Homo Sapiens; identical to SEQ ID NO: 111457

SEQ ID NO: 574706 - RNA, 64 nt, Homo Sapiens; identical to SEQ ID NO: 111458

SEQ ID NO: 574707 - RNA, 64 nt, Homo Sapiens; identical to SEQ ID NO: 111459

SEQ ID NO: 574708 - RNA, 52 nt, Homo Sapiens; identical to SEQ ID NO: 111460

SEQ ID NO: 574709 - RNA, 64 nt, Homo Sapiens; identical to SEQ ID NO: 111461

SEQ ID NO: 574710 - RNA, 64 nt, Homo Sapiens; identical to SEQ ID NO: 111462

SEQ ID NO: 574711 - RNA, 64 nt, Homo Sapiens; identical to SEQ ID NO: 111463

SEQ ID NO: 574712 - RNA, 64 nt, Homo Sapiens; identical to SEQ ID NO: 111464

SEQ ID NO: 574713 - RNA, 64 nt, Homo Sapiens; identical to SEQ ID NO: 111465

SEQ ID NO: 574714 - RNA, 64 nt, Homo Sapiens; identical to SEQ ID NO: 111466

SEQ ID NO: 574715 - RNA, 64 nt, Homo Sapiens; identical to SEQ ID NO: 111467

SEQ ID NO: 574716 - RNA, 64 nt, Homo Sapiens
agagacaucaagaauggauuccacuaaugagaagaccacuaaagcaacccauuugaagagaaga

SEQ ID NO: 574717 - RNA, 64 nt, Homo Sapiens
agaagaccacuaaagagagacauuugaagagaagaccacuaauguuccuagugagaaaacaacc

SEQ ID NO: 574718 - RNA, 64 nt, Homo Sapiens; identical to SEQ ID NO: 296599

SEQ ID NO: 574719 - RNA, 64 nt, Homo Sapiens; identical to SEQ ID NO: 296600

SEQ ID NO: 574720 - RNA, 64 nt, Homo Sapiens; identical to SEQ ID NO: 296601

SEQ ID NO: 574721 - RNA, 64 nt, Homo Sapiens; identical to SEQ ID NO: 296602

SEQ ID NO: 574722 - RNA, 64 nt, Homo Sapiens
agguagucaaggcagccucacaccaagcugucucaucaccaaaucagagucuagagaaagugau

SEQ ID NO: 574723 - RNA, 64 nt, Homo Sapiens
ugucucaucaccaaauaggugucuagagaaagugaucaccaagcguugaacagcauggcucaga

SEQ ID NO: 574724 - RNA, 64 nt, Homo Sapiens
ucccauccauuuuuuuuuaaccuuuuucucucucaucaccaaaguccuaacugcagacuuuugc

SEQ ID NO: 574725 - RNA, 64 nt, Homo Sapiens
ccauggcuuuuucucaaagcuuaccaguuauccaaucaccaaaucaacuaaacuuuucuaaagg

SEQ ID NO: 574726 - RNA, 64 nt, Homo Sapiens
agagucugggggaagggucguggguggggaauuuaucaccaacauccauuguagggggaaucua

SEQ ID NO: 574727 - RNA, 64 nt, Homo Sapiens
agcggaugaaggauggcagcaucucacaugccccaucaccaacucugaggcaccuggggugggg

SEQ ID NO: 574728 - RNA, 64 nt, Homo Sapiens
uaagaauguagugcauguggccaagccuuuaguuaucaccaauccccuacuguuaaucagagau

SEQ ID NO: 574729 - RNA, 64 nt, Homo Sapiens
cauuucaggcagccagcucuuccucacccacuacaucaccaaguccuguggauauaucugcuaa

SEQ ID NO: 574730 - RNA, 64 nt, Homo Sapiens; identical to SEQ ID NO: 107009

SEQ ID NO: 574731 - RNA, 64 nt, Homo Sapiens; identical to SEQ ID NO: 107010

SEQ ID NO: 574732 - RNA, 64 nt, Homo Sapiens
cagaacuccugaauucugaagauugcccuccucccauuaauaggauuguauggauguaagaugg

SEQ ID NO: 574733 - RNA, 64 nt, Homo Sapiens
uaccuucaccugggaaacugaucacuucacaugccauuaauaaaacccaagaucuuuuaaauca

SEQ ID NO: 574734 - RNA, 64 nt, Homo Sapiens
aaauauuacauauauauaagacaaaagguuuucccauuaauaugcauuuaaugcauaaaucaac

SEQ ID NO: 574735 - RNA, 64 nt, Homo Sapiens
ucaagauaaagaacaaauguaaaaaaucucugcucauuaauauucagugacucaaugaugggga

SEQ ID NO: 574736 - RNA, 64 nt, Homo Sapiens
cuauauuucuucuuacacauaaaaagcuguuuaacauuaauaaaggaauaaaauuuguguaaga

SEQ ID NO: 574737 - RNA, 64 nt, Homo Sapiens
agauucaugagugagauauacgagaggguagucacauuaauagauaaagucuauuucugagaua

SEQ ID NO: 574738 - RNA, 64 nt, Homo Sapiens
aggacuuugaucuuuuaagguuuuuuuuccccagcauuaauauugauuuauaaagauuugaaaa

SEQ ID NO: 574739 - RNA, 64 nt, Homo Sapiens
agcuauuaaauuuugauguugccucaguuauuuucauuaauaacuuuugcuaaaauuuaccuuu

SEQ ID NO: 574740 - RNA, 64 nt, Homo Sapiens
ugauauaaaguguuuguugaucuaauguauacugcauuaauaaauagaaacugcagauuuuaga

SEQ ID NO: 574741 - RNA, 64 nt, Homo Sapiens
cauuuaauucaaauaccaaaaaaccaaggugcaucauuaauauuaagauacuucaaaaccaaaa

SEQ ID NO: 574742 - RNA, 64 nt, Homo Sapiens
aaaauacuuuaauaagugucuuuaaaagcugauucauuaauaucagugauaagauagccuugau

SEQ ID NO: 574743 - RNA, 64 nt, Homo Sapiens
uuaaaucagugaccaucauaacaugacauauuuucauuaauaguuauucuucuuuauaucucug

SEQ ID NO: 574744 - RNA, 64 nt, Homo Sapiens
aguccaaaaaaugucauaaauuucugagguacagcauuaauacucaguugguugauuggauuuu

SEQ ID NO: 574745 - RNA, 64 nt, Homo Sapiens
aggugaaauacaggaaaacugccauucuguuuuccauuaauaauauauuccauuuagaaauuuu

SEQ ID NO: 574746 - RNA, 64 nt, Homo Sapiens
uaaaauguuuacauugagcagaaaauuaauaaaucauuaauagucacuccuaaguaccuuuaag

SEQ ID NO: 574747 - RNA, 64 nt, Homo Sapiens
acuauucugauuauuuggacgacaguuuaggcuucauuaauagauugguauaaaacaauauuuu

SEQ ID NO: 574748 - RNA, 64 nt, Homo Sapiens
cccauuuuacuaagccccuagacccauucaaaaccauuaauaagcccccucuccuuuuuuugua

SEQ ID NO: 574749 - RNA, 64 nt, Homo Sapiens
uucaauguggaccagacauuaacaguuaugcuugcauuaauaaucaguuuuuugauagcuuuuu

SEQ ID NO: 574750 - RNA, 64 nt, Homo Sapiens
aauuuuuaaagguauugguuaaauaacguuuaaaaacauguacugagaugaaucuaauuuuuag

SEQ ID NO: 574751 - RNA, 64 nt, Homo Sapiens
ugaaucuaauuuuuagauugcccuguauuuuguuaacauguauauauguacaacaguguguuug

SEQ ID NO: 574752 - RNA, 64 nt, Homo Sapiens
caauugaauccaaauuucaacgacaaaaaaaaaaaacauguauuuuagaguucaucuuuggcaa

SEQ ID NO: 574753 - RNA, 64 nt, Homo Sapiens
ucuuaauuuuugccuuuugcauaagccucuuuauaacauguaucuuuaaaacaauuaagucuuu

SEQ ID NO: 574754 - RNA, 64 nt, Homo Sapiens
ucgccagauagggaccggugaacaccugauuccaaacauguaggaugggggucuuguccucuuu

SEQ ID NO: 574755 - RNA, 64 nt, Homo Sapiens
cuuuuugauuaagagcacaaacuuuuuuuuguaaaacauguaaaaaaaaaaacugggauuaauu

SEQ ID NO: 574756 - RNA, 64 nt, Homo Sapiens
uuaaguggugcuuugugguaucugaacaauucauaacauguaaauaaugugggaaaauaguauu

SEQ ID NO: 574757 - RNA, 64 nt, Homo Sapiens
uggcaugcagugaugaugugcucuuacacuuguuaacauguauuaaguguuauuugcaaaaggu

SEQ ID NO: 574758 - RNA, 64 nt, Homo Sapiens
agaaguggccaccuccgaaaaauuccccuucuagaacauguagacacuugagaaauguuucugu

SEQ ID NO: 574759 - RNA, 64 nt, Homo Sapiens
gaaugaaaaccuagagauuuuaaaucaugaauugaacauguaaaauuccaguaaaauguaaaaa

SEQ ID NO: 574760 - RNA, 64 nt, Homo Sapiens
cuuacuuaggaaguccagcaaaaagaaaugaugcaacauguaggcuaaaaaaaacaccaacaac

SEQ ID NO: 574761 - RNA, 64 nt, Homo Sapiens
cugagcacgguggcaugccuauuagaagugguguaacauguaaggacauuucuuuguuuucaac

SEQ ID NO: 574762 - RNA, 64 nt, Homo Sapiens
gcugcuauuuuacuauuuggaauuucuuuucaucaacauguagaaacaaauaggaagaaauuga

SEQ ID NO: 574763 - RNA, 64 nt, Homo Sapiens
uuagugaaguguuuuuggagucagucaagaaggaaacauguauauugauaaaauuaacacaaaa

SEQ ID NO: 574764 - RNA, 64 nt, Homo Sapiens
uuguuucuauuacuuaaauguuaccugguagaaaaacauguagagguaacccucucagguauau

SEQ ID NO: 574765 - RNA, 64 nt, Homo Sapiens
gucugcuucccucauuauugucuucacuguagucaacauguagaauaauuauaauuuuaacaua

SEQ ID NO: 574766 - RNA, 64 nt, Homo Sapiens
ugccacacuuugcaccuuaauuuguagugucacaaacauguauacaaccagaagcacauccauu

SEQ ID NO: 574767 - RNA, 64 nt, Homo Sapiens
gagaggacuaaaugucaucugguacccacaaagcaacauguacccgaaggugggagggaggacu

SEQ ID NO: 574768 - RNA, 64 nt, Homo Sapiens
auauuaugaccacacacaucucugcuggaaagucaacauguaguaagcaagauuuaacuguuug

SEQ ID NO: 574769 - RNA, 64 nt, Homo Sapiens
agugaguggaaauggaaauaaugguuauaucuaaaacauguagaaaaagaguaacugguagauu

SEQ ID NO: 574770 - RNA, 64 nt, Homo Sapiens
aaacauauguagguaagguuauguuuauaauucaaacauguagugcuuuugauacucagcuguc

SEQ ID NO: 574771 - RNA, 64 nt, Homo Sapiens
uguaagaucagccuuucccaccuauugacagauaaacauguaucuauccaagcugaaaagcaug

SEQ ID NO: 574772 - RNA, 64 nt, Homo Sapiens
cugugcauuuuaugggugacucauggucagccuaaacauguauauaacaccaucacaaauaggu

SEQ ID NO: 574773 - RNA, 64 nt, Homo Sapiens
uuuaacaaaccuuccuaggacgugauauuuuaaaaacauguaggauauauauauuuaucugaaa

SEQ ID NO: 574774 - RNA, 64 nt, Homo Sapiens; identical to SEQ ID NO: 110317

SEQ ID NO: 574775 - RNA, 64 nt, Homo Sapiens; identical to SEQ ID NO: 110318

SEQ ID NO: 574776 - RNA, 64 nt, Homo Sapiens; identical to SEQ ID NO: 110319

SEQ ID NO: 574777 - RNA, 64 nt, Homo Sapiens; identical to SEQ ID NO: 110320

SEQ ID NO: 574778 - RNA, 64 nt, Homo Sapiens; identical to SEQ ID NO: 110321

SEQ ID NO: 574779 - RNA, 64 nt, Homo Sapiens; identical to SEQ ID NO: 110322

SEQ ID NO: 574780 - RNA, 51 nt, Homo Sapiens; identical to SEQ ID NO: 110323

SEQ ID NO: 574781 - RNA, 64 nt, Homo Sapiens; identical to SEQ ID NO: 110324

SEQ ID NO: 574782 - RNA, 64 nt, Homo Sapiens; identical to SEQ ID NO: 110325

SEQ ID NO: 574783 - RNA, 64 nt, Homo Sapiens; identical to SEQ ID NO: 110326

SEQ ID NO: 574784 - RNA, 64 nt, Homo Sapiens; identical to SEQ ID NO: 110327

SEQ ID NO: 574785 - RNA, 64 nt, Homo Sapiens; identical to SEQ ID NO: 110328

SEQ ID NO: 574786 - RNA, 64 nt, Homo Sapiens; identical to SEQ ID NO: 110329

SEQ ID NO: 574787 - RNA, 64 nt, Homo Sapiens; identical to SEQ ID NO: 110330

SEQ ID NO: 574788 - RNA, 64 nt, Homo Sapiens; identical to SEQ ID NO: 110331

SEQ ID NO: 574789 - RNA, 64 nt, Homo Sapiens; identical to SEQ ID NO: 110332

SEQ ID NO: 574790 - RNA, 64 nt, Homo Sapiens; identical to SEQ ID NO: 110333

SEQ ID NO: 574791 - RNA, 64 nt, Homo Sapiens; identical to SEQ ID NO: 110334

SEQ ID NO: 574792 - RNA, 64 nt, Homo Sapiens; identical to SEQ ID NO: 110335

SEQ ID NO: 574793 - RNA, 64 nt, Homo Sapiens; identical to SEQ ID NO: 110336

SEQ ID NO: 574794 - RNA, 64 nt, Homo Sapiens; identical to SEQ ID NO: 110337

SEQ ID NO: 574795 - RNA, 64 nt, Homo Sapiens; identical to SEQ ID NO: 110338

SEQ ID NO: 574796 - RNA, 64 nt, Homo Sapiens; identical to SEQ ID NO: 110339

SEQ ID NO: 574797 - RNA, 64 nt, Homo Sapiens; identical to SEQ ID NO: 110340

SEQ ID NO: 574798 - RNA, 64 nt, Homo Sapiens; identical to SEQ ID NO: 110341

SEQ ID NO: 574799 - RNA, 64 nt, Homo Sapiens; identical to SEQ ID NO: 110342

SEQ ID NO: 574800 - RNA, 64 nt, Homo Sapiens; identical to SEQ ID NO: 110343

SEQ ID NO: 574801 - RNA, 64 nt, Homo Sapiens; identical to SEQ ID NO: 110344

SEQ ID NO: 574802 - RNA, 64 nt, Homo Sapiens; identical to SEQ ID NO: 110345

SEQ ID NO: 574803 - RNA, 64 nt, Homo Sapiens; identical to SEQ ID NO: 110346

SEQ ID NO: 574804 - RNA, 64 nt, Homo Sapiens; identical to SEQ ID NO: 110347

SEQ ID NO: 574805 - RNA, 64 nt, Homo Sapiens; identical to SEQ ID NO: 110348

SEQ ID NO: 574806 - RNA, 64 nt, Homo Sapiens; identical to SEQ ID NO: 110349

SEQ ID NO: 574807 - RNA, 64 nt, Homo Sapiens; identical to SEQ ID NO: 110350

SEQ ID NO: 574808 - RNA, 64 nt, Homo Sapiens; identical to SEQ ID NO: 110351

SEQ ID NO: 574809 - RNA, 64 nt, Homo Sapiens; identical to SEQ ID NO: 110352

SEQ ID NO: 574810 - RNA, 64 nt, Homo Sapiens; identical to SEQ ID NO: 110353

SEQ ID NO: 574811 - RNA, 64 nt, Homo Sapiens; identical to SEQ ID NO: 110354

SEQ ID NO: 574812 - RNA, 64 nt, Homo Sapiens; identical to SEQ ID NO: 110355

SEQ ID NO: 574813 - RNA, 64 nt, Homo Sapiens; identical to SEQ ID NO: 110356

SEQ ID NO: 574814 - RNA, 64 nt, Homo Sapiens; identical to SEQ ID NO: 110357

SEQ ID NO: 574815 - RNA, 64 nt, Homo Sapiens; identical to SEQ ID NO: 110358

SEQ ID NO: 574816 - RNA, 64 nt, Homo Sapiens; identical to SEQ ID NO: 110359

SEQ ID NO: 574817 - RNA, 64 nt, Homo Sapiens
aacccggcuguugccuuaaaugugugagagggacuuggccaaggcaaaagcuggggagaugcca

SEQ ID NO: 574818 - RNA, 64 nt, Homo Sapiens
gcacagcucucaggcccagcccugggcgaccuccuuggccaagucugccuuucacccuggggug

SEQ ID NO: 574819 - RNA, 64 nt, Homo Sapiens
auucacauauuagcaacaaaaucccguaauucuuuuggccaacagcagcuauuuuggggagcag

SEQ ID NO: 574820 - RNA, 64 nt, Homo Sapiens
cuaggguuucagguugccuccccucauaugguuuuuggccaagugacuaaaacaguuuuccaca

SEQ ID NO: 574821 - RNA, 64 nt, Homo Sapiens
cagaacuuggcaucugaaccaccucugacucagcuuggccaaugccacaugggagucucccagc

SEQ ID NO: 574822 - RNA, 52 nt, Homo Sapiens
cagcugcaaaccuggccagagcuuggccaagcgccugcauccuacagaguga

SEQ ID NO: 574823 - RNA, 64 nt, Homo Sapiens
gggcugcgugaaguccagugacccugaggggauuuuggccaaaggaaacagccagggcugggcu

SEQ ID NO: 574824 - RNA, 64 nt, Homo Sapiens
cagucuucaauguccacuaauucacucuaagcauuuggccaaaaaaaggagagagaaauaacug

SEQ ID NO: 574825 - RNA, 64 nt, Homo Sapiens
aaagcagcaacacugauacuugugugcaccugauuuggccaauaggaucaacagugaaaagaca

SEQ ID NO: 574826 - RNA, 64 nt, Homo Sapiens
gaaaucagaucccagggugagaguaacaggccauuuggccaagaaagaaaccuguuuguuuuuc

SEQ ID NO: 574827 - RNA, 64 nt, Homo Sapiens
uugcuguuuauagagugaacuauaauaauaugcuuuggccaaauaugacaguaucugcagauac

SEQ ID NO: 574828 - RNA, 64 nt, Homo Sapiens
ucguauuuguaaacuaaaacgaaucagagaauacuuggccaagcuuugcuuauuuuaguauuuu

SEQ ID NO: 574829 - RNA, 64 nt, Homo Sapiens
uuagggcuuugguuuucauuccuuuuuguuuggcuuggccaaaccagaauucagcuuaucugaa

SEQ ID NO: 574830 - RNA, 64 nt, Homo Sapiens
auugagguaacaagauaaagacaaauccacuucuuuggccaaauucaggcuuuggcuuuaugac

SEQ ID NO: 574831 - RNA, 64 nt, Homo Sapiens
uuuuuucuuuuuuuccccuccaaacuccuuuuccuuggccaagccuucaugcuucccccuuucc

SEQ ID NO: 574832 - RNA, 64 nt, Homo Sapiens
uccaccacggcuucccucuuggcucauuccaagcuuggccaaauuggggaagugggauggaggu

SEQ ID NO: 574833 - RNA, 64 nt, Homo Sapiens
cgcccauccacaucuggaaaucuggaguggccacuuggccaaaguguugucccugcugccuccc

SEQ ID NO: 574834 - RNA, 64 nt, Homo Sapiens
ccaggucucucaaacuugucgcgaaucgagggcuuuggccaaggaccucaguuuuucugacaca

SEQ ID NO: 574835 - RNA, 64 nt, Homo Sapiens
uguuucaaaggaagaaccagucaccuuucacuucuuggccaaauuuuauccugagaaugcugaa

SEQ ID NO: 574836 - RNA, 64 nt, Homo Sapiens
aaguagcugggacuacaggcaugcaccaccacacuuggccaauguucuguauuuuuaauaggga

SEQ ID NO: 574837 - RNA, 64 nt, Homo Sapiens
cuuucuuaauaaaaugccuucucccggcgggggcuuggccaaagcggugccccaggaugggcuc

SEQ ID NO: 574838 - RNA, 64 nt, Homo Sapiens
augggaggguuccgcuuaaacagacagcgucucauuggccaaaggaguuauggagcgcuccgac

SEQ ID NO: 574839 - RNA, 64 nt, Homo Sapiens
uccuuuaaagacauacgaaagugguuuuaaguuguuggccaaaacuggaccauguccuaauaug

SEQ ID NO: 574840 - RNA, 64 nt, Homo Sapiens
ucggaggcuuggccagcacuucuggggccagcauuuggccaagcggcgggagaagguugucucc

SEQ ID NO: 574841 - RNA, 64 nt, Homo Sapiens; identical to SEQ ID NO: 38255

SEQ ID NO: 574842 - RNA, 64 nt, Homo Sapiens; identical to SEQ ID NO: 38256

SEQ ID NO: 574843 - RNA, 64 nt, Homo Sapiens; identical to SEQ ID NO: 38257

SEQ ID NO: 574844 - RNA, 64 nt, Homo Sapiens; identical to SEQ ID NO: 38258

SEQ ID NO: 574845 - RNA, 64 nt, Homo Sapiens; identical to SEQ ID NO: 38259

SEQ ID NO: 574846 - RNA, 64 nt, Homo Sapiens; identical to SEQ ID NO: 38260

SEQ ID NO: 574847 - RNA, 64 nt, Homo Sapiens; identical to SEQ ID NO: 38261

SEQ ID NO: 574848 - RNA, 64 nt, Homo Sapiens; identical to SEQ ID NO: 38262

SEQ ID NO: 574849 - RNA, 64 nt, Homo Sapiens; identical to SEQ ID NO: 38263

SEQ ID NO: 574850 - RNA, 64 nt, Homo Sapiens; identical to SEQ ID NO: 38264

SEQ ID NO: 574851 - RNA, 64 nt, Homo Sapiens; identical to SEQ ID NO: 38265

SEQ ID NO: 574852 - RNA, 64 nt, Homo Sapiens; identical to SEQ ID NO: 38266

SEQ ID NO: 574853 - RNA, 64 nt, Homo Sapiens; identical to SEQ ID NO: 38267

SEQ ID NO: 574854 - RNA, 64 nt, Homo Sapiens; identical to SEQ ID NO: 38268

SEQ ID NO: 574855 - RNA, 64 nt, Homo Sapiens; identical to SEQ ID NO: 38269

SEQ ID NO: 574856 - RNA, 64 nt, Homo Sapiens; identical to SEQ ID NO: 38270

SEQ ID NO: 574857 - RNA, 64 nt, Homo Sapiens; identical to SEQ ID NO: 38271

SEQ ID NO: 574858 - RNA, 64 nt, Homo Sapiens; identical to SEQ ID NO: 38272

SEQ ID NO: 574859 - RNA, 64 nt, Homo Sapiens; identical to SEQ ID NO: 38273

SEQ ID NO: 574860 - RNA, 64 nt, Homo Sapiens; identical to SEQ ID NO: 38274

SEQ ID NO: 574861 - RNA, 64 nt, Homo Sapiens; identical to SEQ ID NO: 38275

SEQ ID NO: 574862 - RNA, 64 nt, Homo Sapiens; identical to SEQ ID NO: 38276

SEQ ID NO: 574863 - RNA, 64 nt, Homo Sapiens; identical to SEQ ID NO: 38277

SEQ ID NO: 574864 - RNA, 64 nt, Homo Sapiens; identical to SEQ ID NO: 38278

SEQ ID NO: 574865 - RNA, 64 nt, Homo Sapiens; identical to SEQ ID NO: 38279

SEQ ID NO: 574866 - RNA, 64 nt, Homo Sapiens; identical to SEQ ID NO: 38280

SEQ ID NO: 574867 - RNA, 64 nt, Homo Sapiens; identical to SEQ ID NO: 38281

SEQ ID NO: 574868 - RNA, 64 nt, Homo Sapiens; identical to SEQ ID NO: 38282

SEQ ID NO: 574869 - RNA, 64 nt, Homo Sapiens; identical to SEQ ID NO: 38283

SEQ ID NO: 574870 - RNA, 64 nt, Homo Sapiens; identical to SEQ ID NO: 38284

SEQ ID NO: 574871 - RNA, 62 nt, Homo Sapiens; identical to SEQ ID NO: 38285

SEQ ID NO: 574872 - RNA, 64 nt, Homo Sapiens; identical to SEQ ID NO: 38286

SEQ ID NO: 574873 - RNA, 64 nt, Homo Sapiens; identical to SEQ ID NO: 38287

SEQ ID NO: 574874 - RNA, 64 nt, Homo Sapiens; identical to SEQ ID NO: 38288

SEQ ID NO: 574875 - RNA, 64 nt, Homo Sapiens; identical to SEQ ID NO: 38289

SEQ ID NO: 574876 - RNA, 64 nt, Homo Sapiens; identical to SEQ ID NO: 38290

SEQ ID NO: 574877 - RNA, 64 nt, Homo Sapiens; identical to SEQ ID NO: 38291

SEQ ID NO: 574878 - RNA, 64 nt, Homo Sapiens; identical to SEQ ID NO: 38292

SEQ ID NO: 574879 - RNA, 64 nt, Homo Sapiens; identical to SEQ ID NO: 38293

SEQ ID NO: 574880 - RNA, 64 nt, Homo Sapiens; identical to SEQ ID NO: 38294

SEQ ID NO: 574881 - RNA, 64 nt, Homo Sapiens; identical to SEQ ID NO: 38295

SEQ ID NO: 574882 - RNA, 64 nt, Homo Sapiens; identical to SEQ ID NO: 38296

SEQ ID NO: 574883 - RNA, 64 nt, Homo Sapiens; identical to SEQ ID NO: 38297

SEQ ID NO: 574884 - RNA, 64 nt, Homo Sapiens; identical to SEQ ID NO: 38298

SEQ ID NO: 574885 - RNA, 64 nt, Homo Sapiens; identical to SEQ ID NO: 38299

SEQ ID NO: 574886 - RNA, 64 nt, Homo Sapiens; identical to SEQ ID NO: 38300

SEQ ID NO: 574887 - RNA, 64 nt, Homo Sapiens; identical to SEQ ID NO: 38301

SEQ ID NO: 574888 - RNA, 64 nt, Homo Sapiens; identical to SEQ ID NO: 38302

SEQ ID NO: 574889 - RNA, 64 nt, Homo Sapiens; identical to SEQ ID NO: 38303

SEQ ID NO: 574890 - RNA, 64 nt, Homo Sapiens; identical to SEQ ID NO: 38304

SEQ ID NO: 574891 - RNA, 64 nt, Homo Sapiens; identical to SEQ ID NO: 38305

SEQ ID NO: 574892 - RNA, 64 nt, Homo Sapiens; identical to SEQ ID NO: 38306

SEQ ID NO: 574893 - RNA, 64 nt, Homo Sapiens; identical to SEQ ID NO: 38307

SEQ ID NO: 574894 - RNA, 64 nt, Homo Sapiens; identical to SEQ ID NO: 38308

SEQ ID NO: 574895 - RNA, 64 nt, Homo Sapiens; identical to SEQ ID NO: 38309

SEQ ID NO: 574896 - RNA, 64 nt, Homo Sapiens; identical to SEQ ID NO: 38310

SEQ ID NO: 574897 - RNA, 64 nt, Homo Sapiens; identical to SEQ ID NO: 38311

SEQ ID NO: 574898 - RNA, 64 nt, Homo Sapiens; identical to SEQ ID NO: 38312

SEQ ID NO: 574899 - RNA, 64 nt, Homo Sapiens; identical to SEQ ID NO: 38313

SEQ ID NO: 574900 - RNA, 64 nt, Homo Sapiens; identical to SEQ ID NO: 38314

SEQ ID NO: 574901 - RNA, 64 nt, Homo Sapiens; identical to SEQ ID NO: 38315

SEQ ID NO: 574902 - RNA, 64 nt, Homo Sapiens; identical to SEQ ID NO: 38316

SEQ ID NO: 574903 - RNA, 64 nt, Homo Sapiens; identical to SEQ ID NO: 38317

SEQ ID NO: 574904 - RNA, 64 nt, Homo Sapiens; identical to SEQ ID NO: 38318

SEQ ID NO: 574905 - RNA, 64 nt, Homo Sapiens; identical to SEQ ID NO: 459316

SEQ ID NO: 574906 - RNA, 64 nt, Homo Sapiens; identical to SEQ ID NO: 459317

SEQ ID NO: 574907 - RNA, 64 nt, Homo Sapiens; identical to SEQ ID NO: 459318

SEQ ID NO: 574908 - RNA, 64 nt, Homo Sapiens; identical to SEQ ID NO: 459319

SEQ ID NO: 574909 - RNA, 64 nt, Homo Sapiens; identical to SEQ ID NO: 459320

SEQ ID NO: 574910 - RNA, 64 nt, Homo Sapiens; identical to SEQ ID NO: 459321

SEQ ID NO: 574911 - RNA, 64 nt, Homo Sapiens; identical to SEQ ID NO: 459322

SEQ ID NO: 574912 - RNA, 64 nt, Homo Sapiens; identical to SEQ ID NO: 459323

SEQ ID NO: 574913 - RNA, 64 nt, Homo Sapiens; identical to SEQ ID NO: 459324

SEQ ID NO: 574914 - RNA, 64 nt, Homo Sapiens; identical to SEQ ID NO: 459325

SEQ ID NO: 574915 - RNA, 64 nt, Homo Sapiens; identical to SEQ ID NO: 459326

SEQ ID NO: 574916 - RNA, 64 nt, Homo Sapiens; identical to SEQ ID NO: 459327

SEQ ID NO: 574917 - RNA, 64 nt, Homo Sapiens; identical to SEQ ID NO: 459328

SEQ ID NO: 574918 - RNA, 64 nt, Homo Sapiens; identical to SEQ ID NO: 459329

SEQ ID NO: 574919 - RNA, 64 nt, Homo Sapiens; identical to SEQ ID NO: 459330

SEQ ID NO: 574920 - RNA, 64 nt, Homo Sapiens; identical to SEQ ID NO: 459331

SEQ ID NO: 574921 - RNA, 64 nt, Homo Sapiens; identical to SEQ ID NO: 459332

SEQ ID NO: 574922 - RNA, 64 nt, Homo Sapiens; identical to SEQ ID NO: 459333

SEQ ID NO: 574923 - RNA, 64 nt, Homo Sapiens; identical to SEQ ID NO: 459334

SEQ ID NO: 574924 - RNA, 64 nt, Homo Sapiens; identical to SEQ ID NO: 459335

SEQ ID NO: 574925 - RNA, 64 nt, Homo Sapiens; identical to SEQ ID NO: 459336

SEQ ID NO: 574926 - RNA, 64 nt, Homo Sapiens; identical to SEQ ID NO: 459337

SEQ ID NO: 574927 - RNA, 64 nt, Homo Sapiens; identical to SEQ ID NO: 459338

SEQ ID NO: 574928 - RNA, 64 nt, Homo Sapiens; identical to SEQ ID NO: 459339

SEQ ID NO: 574929 - RNA, 64 nt, Homo Sapiens; identical to SEQ ID NO: 459340

SEQ ID NO: 574930 - RNA, 64 nt, Homo Sapiens; identical to SEQ ID NO: 459341

SEQ ID NO: 574931 - RNA, 64 nt, Homo Sapiens; identical to SEQ ID NO: 459342

SEQ ID NO: 574932 - RNA, 64 nt, Homo Sapiens; identical to SEQ ID NO: 459343

SEQ ID NO: 574933 - RNA, 64 nt, Homo Sapiens; identical to SEQ ID NO: 459344

SEQ ID NO: 574934 - RNA, 64 nt, Homo Sapiens; identical to SEQ ID NO: 459345

SEQ ID NO: 574935 - RNA, 64 nt, Homo Sapiens; identical to SEQ ID NO: 459346

SEQ ID NO: 574936 - RNA, 64 nt, Homo Sapiens; identical to SEQ ID NO: 459347

SEQ ID NO: 574937 - RNA, 64 nt, Homo Sapiens; identical to SEQ ID NO: 459348

SEQ ID NO: 574938 - RNA, 64 nt, Homo Sapiens; identical to SEQ ID NO: 459349

SEQ ID NO: 574939 - RNA, 64 nt, Homo Sapiens; identical to SEQ ID NO: 459350

SEQ ID NO: 574940 - RNA, 64 nt, Homo Sapiens; identical to SEQ ID NO: 459351

SEQ ID NO: 574941 - RNA, 64 nt, Homo Sapiens; identical to SEQ ID NO: 459352

SEQ ID NO: 574942 - RNA, 64 nt, Homo Sapiens; identical to SEQ ID NO: 459353

SEQ ID NO: 574943 - RNA, 64 nt, Homo Sapiens; identical to SEQ ID NO: 38255

SEQ ID NO: 574944 - RNA, 64 nt, Homo Sapiens; identical to SEQ ID NO: 38256

SEQ ID NO: 574945 - RNA, 64 nt, Homo Sapiens; identical to SEQ ID NO: 38257

SEQ ID NO: 574946 - RNA, 64 nt, Homo Sapiens; identical to SEQ ID NO: 38258

SEQ ID NO: 574947 - RNA, 64 nt, Homo Sapiens; identical to SEQ ID NO: 38259

SEQ ID NO: 574948 - RNA, 64 nt, Homo Sapiens; identical to SEQ ID NO: 38260

SEQ ID NO: 574949 - RNA, 64 nt, Homo Sapiens; identical to SEQ ID NO: 38261

SEQ ID NO: 574950 - RNA, 64 nt, Homo Sapiens; identical to SEQ ID NO: 38262

SEQ ID NO: 574951 - RNA, 64 nt, Homo Sapiens; identical to SEQ ID NO: 38263

SEQ ID NO: 574952 - RNA, 64 nt, Homo Sapiens; identical to SEQ ID NO: 38264

SEQ ID NO: 574953 - RNA, 64 nt, Homo Sapiens; identical to SEQ ID NO: 38265

SEQ ID NO: 574954 - RNA, 64 nt, Homo Sapiens; identical to SEQ ID NO: 38266

SEQ ID NO: 574955 - RNA, 64 nt, Homo Sapiens; identical to SEQ ID NO: 38267

SEQ ID NO: 574956 - RNA, 64 nt, Homo Sapiens; identical to SEQ ID NO: 38268

SEQ ID NO: 574957 - RNA, 64 nt, Homo Sapiens; identical to SEQ ID NO: 38269

SEQ ID NO: 574958 - RNA, 64 nt, Homo Sapiens; identical to SEQ ID NO: 38270

SEQ ID NO: 574959 - RNA, 64 nt, Homo Sapiens; identical to SEQ ID NO: 38271

SEQ ID NO: 574960 - RNA, 64 nt, Homo Sapiens; identical to SEQ ID NO: 38272

SEQ ID NO: 574961 - RNA, 64 nt, Homo Sapiens; identical to SEQ ID NO: 38273

SEQ ID NO: 574962 - RNA, 64 nt, Homo Sapiens; identical to SEQ ID NO: 38274

SEQ ID NO: 574963 - RNA, 64 nt, Homo Sapiens; identical to SEQ ID NO: 38275

SEQ ID NO: 574964 - RNA, 64 nt, Homo Sapiens; identical to SEQ ID NO: 38276

SEQ ID NO: 574965 - RNA, 64 nt, Homo Sapiens; identical to SEQ ID NO: 38277

SEQ ID NO: 574966 - RNA, 64 nt, Homo Sapiens; identical to SEQ ID NO: 38278

SEQ ID NO: 574967 - RNA, 64 nt, Homo Sapiens; identical to SEQ ID NO: 38279

SEQ ID NO: 574968 - RNA, 64 nt, Homo Sapiens; identical to SEQ ID NO: 38280

SEQ ID NO: 574969 - RNA, 64 nt, Homo Sapiens; identical to SEQ ID NO: 38281

SEQ ID NO: 574970 - RNA, 64 nt, Homo Sapiens; identical to SEQ ID NO: 38282

SEQ ID NO: 574971 - RNA, 64 nt, Homo Sapiens; identical to SEQ ID NO: 38283

SEQ ID NO: 574972 - RNA, 64 nt, Homo Sapiens; identical to SEQ ID NO: 38284

SEQ ID NO: 574973 - RNA, 62 nt, Homo Sapiens; identical to SEQ ID NO: 38285

SEQ ID NO: 574974 - RNA, 64 nt, Homo Sapiens; identical to SEQ ID NO: 38286

SEQ ID NO: 574975 - RNA, 64 nt, Homo Sapiens; identical to SEQ ID NO: 38287

SEQ ID NO: 574976 - RNA, 64 nt, Homo Sapiens; identical to SEQ ID NO: 38288

SEQ ID NO: 574977 - RNA, 64 nt, Homo Sapiens; identical to SEQ ID NO: 38289

SEQ ID NO: 574978 - RNA, 64 nt, Homo Sapiens; identical to SEQ ID NO: 38290

SEQ ID NO: 574979 - RNA, 64 nt, Homo Sapiens; identical to SEQ ID NO: 38291

SEQ ID NO: 574980 - RNA, 64 nt, Homo Sapiens; identical to SEQ ID NO: 38292

SEQ ID NO: 574981 - RNA, 64 nt, Homo Sapiens; identical to SEQ ID NO: 38293

SEQ ID NO: 574982 - RNA, 64 nt, Homo Sapiens; identical to SEQ ID NO: 38294

SEQ ID NO: 574983 - RNA, 64 nt, Homo Sapiens; identical to SEQ ID NO: 38295

SEQ ID NO: 574984 - RNA, 64 nt, Homo Sapiens; identical to SEQ ID NO: 38296

SEQ ID NO: 574985 - RNA, 64 nt, Homo Sapiens; identical to SEQ ID NO: 38297

SEQ ID NO: 574986 - RNA, 64 nt, Homo Sapiens; identical to SEQ ID NO: 38298

SEQ ID NO: 574987 - RNA, 64 nt, Homo Sapiens; identical to SEQ ID NO: 38299

SEQ ID NO: 574988 - RNA, 64 nt, Homo Sapiens; identical to SEQ ID NO: 38300

SEQ ID NO: 574989 - RNA, 64 nt, Homo Sapiens; identical to SEQ ID NO: 38301

SEQ ID NO: 574990 - RNA, 64 nt, Homo Sapiens; identical to SEQ ID NO: 38302

SEQ ID NO: 574991 - RNA, 64 nt, Homo Sapiens; identical to SEQ ID NO: 38303

SEQ ID NO: 574992 - RNA, 64 nt, Homo Sapiens; identical to SEQ ID NO: 38304

SEQ ID NO: 574993 - RNA, 64 nt, Homo Sapiens; identical to SEQ ID NO: 38305

SEQ ID NO: 574994 - RNA, 64 nt, Homo Sapiens; identical to SEQ ID NO: 38306

SEQ ID NO: 574995 - RNA, 64 nt, Homo Sapiens; identical to SEQ ID NO: 38307

SEQ ID NO: 574996 - RNA, 64 nt, Homo Sapiens; identical to SEQ ID NO: 38308

SEQ ID NO: 574997 - RNA, 64 nt, Homo Sapiens; identical to SEQ ID NO: 38309

SEQ ID NO: 574998 - RNA, 64 nt, Homo Sapiens; identical to SEQ ID NO: 38310

SEQ ID NO: 574999 - RNA, 64 nt, Homo Sapiens; identical to SEQ ID NO: 38311

SEQ ID NO: 575000 - RNA, 64 nt, Homo Sapiens; identical to SEQ ID NO: 38312

SEQ ID NO: 575001 - RNA, 64 nt, Homo Sapiens; identical to SEQ ID NO: 38313

SEQ ID NO: 575002 - RNA, 64 nt, Homo Sapiens; identical to SEQ ID NO: 38314

SEQ ID NO: 575003 - RNA, 64 nt, Homo Sapiens; identical to SEQ ID NO: 38315

SEQ ID NO: 575004 - RNA, 64 nt, Homo Sapiens; identical to SEQ ID NO: 38316

SEQ ID NO: 575005 - RNA, 64 nt, Homo Sapiens; identical to SEQ ID NO: 38317

SEQ ID NO: 575006 - RNA, 64 nt, Homo Sapiens; identical to SEQ ID NO: 38318

SEQ ID NO: 575007 - RNA, 64 nt, Homo Sapiens; identical to SEQ ID NO: 459316

SEQ ID NO: 575008 - RNA, 64 nt, Homo Sapiens; identical to SEQ ID NO: 459317

SEQ ID NO: 575009 - RNA, 64 nt, Homo Sapiens; identical to SEQ ID NO: 459318

SEQ ID NO: 575010 - RNA, 64 nt, Homo Sapiens; identical to SEQ ID NO: 459319

SEQ ID NO: 575011 - RNA, 64 nt, Homo Sapiens; identical to SEQ ID NO: 459320

SEQ ID NO: 575012 - RNA, 64 nt, Homo Sapiens; identical to SEQ ID NO: 459321

SEQ ID NO: 575013 - RNA, 64 nt, Homo Sapiens; identical to SEQ ID NO: 459322

SEQ ID NO: 575014 - RNA, 64 nt, Homo Sapiens; identical to SEQ ID NO: 459323

SEQ ID NO: 575015 - RNA, 64 nt, Homo Sapiens; identical to SEQ ID NO: 459324

SEQ ID NO: 575016 - RNA, 64 nt, Homo Sapiens; identical to SEQ ID NO: 459325

SEQ ID NO: 575017 - RNA, 64 nt, Homo Sapiens; identical to SEQ ID NO: 459326

SEQ ID NO: 575018 - RNA, 64 nt, Homo Sapiens; identical to SEQ ID NO: 459327

SEQ ID NO: 575019 - RNA, 64 nt, Homo Sapiens; identical to SEQ ID NO: 459328

SEQ ID NO: 575020 - RNA, 64 nt, Homo Sapiens; identical to SEQ ID NO: 459329

SEQ ID NO: 575021 - RNA, 64 nt, Homo Sapiens; identical to SEQ ID NO: 459330

SEQ ID NO: 575022 - RNA, 64 nt, Homo Sapiens; identical to SEQ ID NO: 459331

SEQ ID NO: 575023 - RNA, 64 nt, Homo Sapiens; identical to SEQ ID NO: 459332

SEQ ID NO: 575024 - RNA, 64 nt, Homo Sapiens; identical to SEQ ID NO: 459333

SEQ ID NO: 575025 - RNA, 64 nt, Homo Sapiens; identical to SEQ ID NO: 459334

SEQ ID NO: 575026 - RNA, 64 nt, Homo Sapiens; identical to SEQ ID NO: 459335

SEQ ID NO: 575027 - RNA, 64 nt, Homo Sapiens; identical to SEQ ID NO: 459336

SEQ ID NO: 575028 - RNA, 64 nt, Homo Sapiens; identical to SEQ ID NO: 459337

SEQ ID NO: 575029 - RNA, 64 nt, Homo Sapiens; identical to SEQ ID NO: 459338

SEQ ID NO: 575030 - RNA, 64 nt, Homo Sapiens; identical to SEQ ID NO: 459339

SEQ ID NO: 575031 - RNA, 64 nt, Homo Sapiens; identical to SEQ ID NO: 459340

SEQ ID NO: 575032 - RNA, 64 nt, Homo Sapiens; identical to SEQ ID NO: 459341

SEQ ID NO: 575033 - RNA, 64 nt, Homo Sapiens; identical to SEQ ID NO: 459342

SEQ ID NO: 575034 - RNA, 64 nt, Homo Sapiens; identical to SEQ ID NO: 459343

SEQ ID NO: 575035 - RNA, 64 nt, Homo Sapiens; identical to SEQ ID NO: 459344

SEQ ID NO: 575036 - RNA, 64 nt, Homo Sapiens; identical to SEQ ID NO: 459345

SEQ ID NO: 575037 - RNA, 64 nt, Homo Sapiens; identical to SEQ ID NO: 459346

SEQ ID NO: 575038 - RNA, 64 nt, Homo Sapiens; identical to SEQ ID NO: 459347

SEQ ID NO: 575039 - RNA, 64 nt, Homo Sapiens; identical to SEQ ID NO: 459348

SEQ ID NO: 575040 - RNA, 64 nt, Homo Sapiens; identical to SEQ ID NO: 459349

SEQ ID NO: 575041 - RNA, 64 nt, Homo Sapiens; identical to SEQ ID NO: 459350

SEQ ID NO: 575042 - RNA, 64 nt, Homo Sapiens; identical to SEQ ID NO: 459351

SEQ ID NO: 575043 - RNA, 64 nt, Homo Sapiens; identical to SEQ ID NO: 459352

SEQ ID NO: 575044 - RNA, 64 nt, Homo Sapiens; identical to SEQ ID NO: 459353

SEQ ID NO: 575045 - RNA, 64 nt, Homo Sapiens; identical to SEQ ID NO: 120916

SEQ ID NO: 575046 - RNA, 64 nt, Homo Sapiens; identical to SEQ ID NO: 120917

SEQ ID NO: 575047 - RNA, 64 nt, Homo Sapiens; identical to SEQ ID NO: 120918

SEQ ID NO: 575048 - RNA, 64 nt, Homo Sapiens; identical to SEQ ID NO: 120919

SEQ ID NO: 575049 - RNA, 64 nt, Homo Sapiens; identical to SEQ ID NO: 120920

SEQ ID NO: 575050 - RNA, 64 nt, Homo Sapiens; identical to SEQ ID NO: 120921

SEQ ID NO: 575051 - RNA, 64 nt, Homo Sapiens; identical to SEQ ID NO: 120922

SEQ ID NO: 575052 - RNA, 64 nt, Homo Sapiens; identical to SEQ ID NO: 120923

SEQ ID NO: 575053 - RNA, 64 nt, Homo Sapiens; identical to SEQ ID NO: 120924

SEQ ID NO: 575054 - RNA, 64 nt, Homo Sapiens; identical to SEQ ID NO: 120925

SEQ ID NO: 575055 - RNA, 64 nt, Homo Sapiens
auuuccuuuauagcuaaaagcgcucucugccaagcccaccaaguguuccuguaauuuugugaca

SEQ ID NO: 575056 - RNA, 64 nt, Homo Sapiens
ugucauaguaaagucuccugagaaguugauggaacccaccaauaacacucuugaagagcuucca

SEQ ID NO: 575057 - RNA, 64 nt, Homo Sapiens
gucaaugucaagagaggaaguaugagcgucacugcccaccaaagccuugaacccaacagucccu

SEQ ID NO: 575058 - RNA, 64 nt, Homo Sapiens
aaauccaugugaccauucuggcaauggcagcauucccaccaacaaaucaauaucccaacauucu

SEQ ID NO: 575059 - RNA, 64 nt, Homo Sapiens
aaccacacccggugggggcagggaaccagcaccucccaccaacccagccgaugccccccgguau

SEQ ID NO: 575060 - RNA, 64 nt, Homo Sapiens
agccacacccggugggggcagggaaccagcaccucccaccaacccagccgaugccccccaguau

SEQ ID NO: 575061 - RNA, 64 nt, Homo Sapiens
agccacacccagugggggcagggaaccagcaccucccaccaacccagccgaugccccccggugu

SEQ ID NO: 575062 - RNA, 64 nt, Homo Sapiens
agccacucccgguggggacaagaaaacagcaccucccaccaacccccggggggcccccgggugc

SEQ ID NO: 575063 - RNA, 64 nt, Homo Sapiens
agucccuccaacagcaauauuuuauaauauuuaacccaccaaaaauugaccagaaaacaaugau

SEQ ID NO: 575064 - RNA, 64 nt, Homo Sapiens
ugcuccuauccaacaauuauaagucugugcaaaacccaccaaaacacauucugacacaagaugc

SEQ ID NO: 575065 - RNA, 64 nt, Homo Sapiens
uucaggaagccugugaaaaacgugauuccugggccccaccaagacccaccaaaaccaucucugg

SEQ ID NO: 575066 - RNA, 64 nt, Homo Sapiens
cugugaaaaacgugauuccugggccccaccaagacccaccaaaaccaucucuggggcuuggugc

SEQ ID NO: 575067 - RNA, 64 nt, Homo Sapiens; identical to SEQ ID NO: 218191

SEQ ID NO: 575068 - RNA, 64 nt, Homo Sapiens; identical to SEQ ID NO: 218192

SEQ ID NO: 575069 - RNA, 64 nt, Homo Sapiens; identical to SEQ ID NO: 218193

SEQ ID NO: 575070 - RNA, 64 nt, Homo Sapiens; identical to SEQ ID NO: 218194

SEQ ID NO: 575071 - RNA, 64 nt, Homo Sapiens; identical to SEQ ID NO: 218195

SEQ ID NO: 575072 - RNA, 64 nt, Homo Sapiens; identical to SEQ ID NO: 218196

SEQ ID NO: 575073 - RNA, 64 nt, Homo Sapiens; identical to SEQ ID NO: 218197

SEQ ID NO: 575074 - RNA, 64 nt, Homo Sapiens; identical to SEQ ID NO: 218198

SEQ ID NO: 575075 - RNA, 64 nt, Homo Sapiens; identical to SEQ ID NO: 218199

SEQ ID NO: 575076 - RNA, 64 nt, Homo Sapiens; identical to SEQ ID NO: 218200

SEQ ID NO: 575077 - RNA, 64 nt, Homo Sapiens; identical to SEQ ID NO: 218201

SEQ ID NO: 575078 - RNA, 64 nt, Homo Sapiens; identical to SEQ ID NO: 218202

SEQ ID NO: 575079 - RNA, 64 nt, Homo Sapiens; identical to SEQ ID NO: 218203

SEQ ID NO: 575080 - RNA, 64 nt, Homo Sapiens; identical to SEQ ID NO: 218204

SEQ ID NO: 575081 - RNA, 64 nt, Homo Sapiens; identical to SEQ ID NO: 218205

SEQ ID NO: 575082 - RNA, 64 nt, Homo Sapiens; identical to SEQ ID NO: 218206

SEQ ID NO: 575083 - RNA, 64 nt, Homo Sapiens; identical to SEQ ID NO: 218207

SEQ ID NO: 575084 - RNA, 64 nt, Homo Sapiens; identical to SEQ ID NO: 218208

SEQ ID NO: 575085 - RNA, 64 nt, Homo Sapiens; identical to SEQ ID NO: 218209

SEQ ID NO: 575086 - RNA, 64 nt, Homo Sapiens; identical to SEQ ID NO: 218210

SEQ ID NO: 575087 - RNA, 64 nt, Homo Sapiens; identical to SEQ ID NO: 218211

SEQ ID NO: 575088 - RNA, 64 nt, Homo Sapiens; identical to SEQ ID NO: 218212

SEQ ID NO: 575089 - RNA, 64 nt, Homo Sapiens; identical to SEQ ID NO: 218213

SEQ ID NO: 575090 - RNA, 64 nt, Homo Sapiens; identical to SEQ ID NO: 218214

SEQ ID NO: 575091 - RNA, 64 nt, Homo Sapiens; identical to SEQ ID NO: 218215

SEQ ID NO: 575092 - RNA, 64 nt, Homo Sapiens; identical to SEQ ID NO: 218216

SEQ ID NO: 575093 - RNA, 64 nt, Homo Sapiens; identical to SEQ ID NO: 218217

SEQ ID NO: 575094 - RNA, 64 nt, Homo Sapiens; identical to SEQ ID NO: 218218

SEQ ID NO: 575095 - RNA, 64 nt, Homo Sapiens; identical to SEQ ID NO: 218219

SEQ ID NO: 575096 - RNA, 64 nt, Homo Sapiens; identical to SEQ ID NO: 218220

SEQ ID NO: 575097 - RNA, 64 nt, Homo Sapiens; identical to SEQ ID NO: 218221

SEQ ID NO: 575098 - RNA, 64 nt, Homo Sapiens; identical to SEQ ID NO: 218222

SEQ ID NO: 575099 - RNA, 64 nt, Homo Sapiens; identical to SEQ ID NO: 218223

SEQ ID NO: 575100 - RNA, 64 nt, Homo Sapiens; identical to SEQ ID NO: 218224

SEQ ID NO: 575101 - RNA, 64 nt, Homo Sapiens; identical to SEQ ID NO: 218225

SEQ ID NO: 575102 - RNA, 64 nt, Homo Sapiens; identical to SEQ ID NO: 218226

SEQ ID NO: 575103 - RNA, 64 nt, Homo Sapiens; identical to SEQ ID NO: 218227

SEQ ID NO: 575104 - RNA, 64 nt, Homo Sapiens; identical to SEQ ID NO: 218228

SEQ ID NO: 575105 - RNA, 64 nt, Homo Sapiens; identical to SEQ ID NO: 218229

SEQ ID NO: 575106 - RNA, 64 nt, Homo Sapiens; identical to SEQ ID NO: 218230

SEQ ID NO: 575107 - RNA, 64 nt, Homo Sapiens; identical to SEQ ID NO: 218231

SEQ ID NO: 575108 - RNA, 64 nt, Homo Sapiens; identical to SEQ ID NO: 218232

SEQ ID NO: 575109 - RNA, 64 nt, Homo Sapiens; identical to SEQ ID NO: 218233

SEQ ID NO: 575110 - RNA, 64 nt, Homo Sapiens; identical to SEQ ID NO: 218234

SEQ ID NO: 575111 - RNA, 64 nt, Homo Sapiens; identical to SEQ ID NO: 218235

SEQ ID NO: 575112 - RNA, 64 nt, Homo Sapiens; identical to SEQ ID NO: 218236

SEQ ID NO: 575113 - RNA, 64 nt, Homo Sapiens; identical to SEQ ID NO: 218237

SEQ ID NO: 575114 - RNA, 64 nt, Homo Sapiens; identical to SEQ ID NO: 218238

SEQ ID NO: 575115 - RNA, 64 nt, Homo Sapiens; identical to SEQ ID NO: 218239

SEQ ID NO: 575116 - RNA, 64 nt, Homo Sapiens; identical to SEQ ID NO: 218240

SEQ ID NO: 575117 - RNA, 64 nt, Homo Sapiens; identical to SEQ ID NO: 218241

SEQ ID NO: 575118 - RNA, 64 nt, Homo Sapiens; identical to SEQ ID NO: 218242

SEQ ID NO: 575119 - RNA, 64 nt, Homo Sapiens; identical to SEQ ID NO: 218243

SEQ ID NO: 575120 - RNA, 64 nt, Homo Sapiens; identical to SEQ ID NO: 218244

SEQ ID NO: 575121 - RNA, 64 nt, Homo Sapiens; identical to SEQ ID NO: 218245

SEQ ID NO: 575122 - RNA, 64 nt, Homo Sapiens; identical to SEQ ID NO: 218246

SEQ ID NO: 575123 - RNA, 64 nt, Homo Sapiens; identical to SEQ ID NO: 218247

SEQ ID NO: 575124 - RNA, 64 nt, Homo Sapiens; identical to SEQ ID NO: 218248

SEQ ID NO: 575125 - RNA, 64 nt, Homo Sapiens; identical to SEQ ID NO: 218249

SEQ ID NO: 575126 - RNA, 64 nt, Homo Sapiens; identical to SEQ ID NO: 218250

SEQ ID NO: 575127 - RNA, 64 nt, Homo Sapiens; identical to SEQ ID NO: 218251

SEQ ID NO: 575128 - RNA, 64 nt, Homo Sapiens; identical to SEQ ID NO: 218252

SEQ ID NO: 575129 - RNA, 64 nt, Homo Sapiens; identical to SEQ ID NO: 218253

SEQ ID NO: 575130 - RNA, 64 nt, Homo Sapiens; identical to SEQ ID NO: 218254

SEQ ID NO: 575131 - RNA, 64 nt, Homo Sapiens; identical to SEQ ID NO: 218255

SEQ ID NO: 575132 - RNA, 64 nt, Homo Sapiens; identical to SEQ ID NO: 218256

SEQ ID NO: 575133 - RNA, 64 nt, Homo Sapiens; identical to SEQ ID NO: 218257

SEQ ID NO: 575134 - RNA, 64 nt, Homo Sapiens; identical to SEQ ID NO: 218258

SEQ ID NO: 575135 - RNA, 64 nt, Homo Sapiens; identical to SEQ ID NO: 218259

SEQ ID NO: 575136 - RNA, 64 nt, Homo Sapiens; identical to SEQ ID NO: 218260

SEQ ID NO: 575137 - RNA, 64 nt, Homo Sapiens; identical to SEQ ID NO: 218261

SEQ ID NO: 575138 - RNA, 64 nt, Homo Sapiens; identical to SEQ ID NO: 218262

SEQ ID NO: 575139 - RNA, 64 nt, Homo Sapiens; identical to SEQ ID NO: 218263

SEQ ID NO: 575140 - RNA, 64 nt, Homo Sapiens; identical to SEQ ID NO: 218264

SEQ ID NO: 575141 - RNA, 64 nt, Homo Sapiens; identical to SEQ ID NO: 218265

SEQ ID NO: 575142 - RNA, 64 nt, Homo Sapiens; identical to SEQ ID NO: 218266

SEQ ID NO: 575143 - RNA, 64 nt, Homo Sapiens; identical to SEQ ID NO: 218267

SEQ ID NO: 575144 - RNA, 64 nt, Homo Sapiens; identical to SEQ ID NO: 218268

SEQ ID NO: 575145 - RNA, 64 nt, Homo Sapiens; identical to SEQ ID NO: 218269

SEQ ID NO: 575146 - RNA, 64 nt, Homo Sapiens; identical to SEQ ID NO: 218270

SEQ ID NO: 575147 - RNA, 64 nt, Homo Sapiens; identical to SEQ ID NO: 218271

SEQ ID NO: 575148 - RNA, 64 nt, Homo Sapiens; identical to SEQ ID NO: 218272

SEQ ID NO: 575149 - RNA, 64 nt, Homo Sapiens; identical to SEQ ID NO: 218273

SEQ ID NO: 575150 - RNA, 64 nt, Homo Sapiens; identical to SEQ ID NO: 218274

SEQ ID NO: 575151 - RNA, 64 nt, Homo Sapiens; identical to SEQ ID NO: 218275

SEQ ID NO: 575152 - RNA, 64 nt, Homo Sapiens; identical to SEQ ID NO: 218276

SEQ ID NO: 575153 - RNA, 64 nt, Homo Sapiens; identical to SEQ ID NO: 218277

SEQ ID NO: 575154 - RNA, 64 nt, Homo Sapiens; identical to SEQ ID NO: 218278

SEQ ID NO: 575155 - RNA, 64 nt, Homo Sapiens; identical to SEQ ID NO: 218279

SEQ ID NO: 575156 - RNA, 64 nt, Homo Sapiens; identical to SEQ ID NO: 218280

SEQ ID NO: 575157 - RNA, 64 nt, Homo Sapiens; identical to SEQ ID NO: 218281

SEQ ID NO: 575158 - RNA, 64 nt, Homo Sapiens; identical to SEQ ID NO: 218282

SEQ ID NO: 575159 - RNA, 64 nt, Homo Sapiens; identical to SEQ ID NO: 218283

SEQ ID NO: 575160 - RNA, 64 nt, Homo Sapiens; identical to SEQ ID NO: 218284

SEQ ID NO: 575161 - RNA, 64 nt, Homo Sapiens; identical to SEQ ID NO: 218285

SEQ ID NO: 575162 - RNA, 64 nt, Homo Sapiens; identical to SEQ ID NO: 218286

SEQ ID NO: 575163 - RNA, 64 nt, Homo Sapiens; identical to SEQ ID NO: 218287

SEQ ID NO: 575164 - RNA, 64 nt, Homo Sapiens; identical to SEQ ID NO: 218288

SEQ ID NO: 575165 - RNA, 64 nt, Homo Sapiens; identical to SEQ ID NO: 218289

SEQ ID NO: 575166 - RNA, 64 nt, Homo Sapiens; identical to SEQ ID NO: 218290

SEQ ID NO: 575167 - RNA, 64 nt, Homo Sapiens; identical to SEQ ID NO: 218291

SEQ ID NO: 575168 - RNA, 64 nt, Homo Sapiens; identical to SEQ ID NO: 218292

SEQ ID NO: 575169 - RNA, 64 nt, Homo Sapiens; identical to SEQ ID NO: 218293

SEQ ID NO: 575170 - RNA, 64 nt, Homo Sapiens; identical to SEQ ID NO: 218294

SEQ ID NO: 575171 - RNA, 64 nt, Homo Sapiens; identical to SEQ ID NO: 218295

SEQ ID NO: 575172 - RNA, 64 nt, Homo Sapiens; identical to SEQ ID NO: 218296

SEQ ID NO: 575173 - RNA, 64 nt, Homo Sapiens; identical to SEQ ID NO: 218297

SEQ ID NO: 575174 - RNA, 64 nt, Homo Sapiens; identical to SEQ ID NO: 218298

SEQ ID NO: 575175 - RNA, 64 nt, Homo Sapiens; identical to SEQ ID NO: 218299

SEQ ID NO: 575176 - RNA, 64 nt, Homo Sapiens; identical to SEQ ID NO: 218300

SEQ ID NO: 575177 - RNA, 64 nt, Homo Sapiens; identical to SEQ ID NO: 218301

SEQ ID NO: 575178 - RNA, 64 nt, Homo Sapiens; identical to SEQ ID NO: 218302

SEQ ID NO: 575179 - RNA, 64 nt, Homo Sapiens; identical to SEQ ID NO: 218303

SEQ ID NO: 575180 - RNA, 64 nt, Homo Sapiens; identical to SEQ ID NO: 218304

SEQ ID NO: 575181 - RNA, 64 nt, Homo Sapiens; identical to SEQ ID NO: 218305

SEQ ID NO: 575182 - RNA, 64 nt, Homo Sapiens; identical to SEQ ID NO: 218306

SEQ ID NO: 575183 - RNA, 64 nt, Homo Sapiens; identical to SEQ ID NO: 218307

SEQ ID NO: 575184 - RNA, 64 nt, Homo Sapiens; identical to SEQ ID NO: 218308

SEQ ID NO: 575185 - RNA, 64 nt, Homo Sapiens; identical to SEQ ID NO: 218309

SEQ ID NO: 575186 - RNA, 64 nt, Homo Sapiens; identical to SEQ ID NO: 218310

SEQ ID NO: 575187 - RNA, 64 nt, Homo Sapiens; identical to SEQ ID NO: 218311

SEQ ID NO: 575188 - RNA, 64 nt, Homo Sapiens; identical to SEQ ID NO: 218312

SEQ ID NO: 575189 - RNA, 64 nt, Homo Sapiens; identical to SEQ ID NO: 218313

SEQ ID NO: 575190 - RNA, 64 nt, Homo Sapiens; identical to SEQ ID NO: 218314

SEQ ID NO: 575191 - RNA, 64 nt, Homo Sapiens; identical to SEQ ID NO: 218315

SEQ ID NO: 575192 - RNA, 64 nt, Homo Sapiens; identical to SEQ ID NO: 218316

SEQ ID NO: 575193 - RNA, 64 nt, Homo Sapiens; identical to SEQ ID NO: 218317

SEQ ID NO: 575194 - RNA, 64 nt, Homo Sapiens; identical to SEQ ID NO: 218318

SEQ ID NO: 575195 - RNA, 64 nt, Homo Sapiens; identical to SEQ ID NO: 218319

SEQ ID NO: 575196 - RNA, 64 nt, Homo Sapiens; identical to SEQ ID NO: 218320

SEQ ID NO: 575197 - RNA, 64 nt, Homo Sapiens; identical to SEQ ID NO: 218321

SEQ ID NO: 575198 - RNA, 64 nt, Homo Sapiens; identical to SEQ ID NO: 218322

SEQ ID NO: 575199 - RNA, 64 nt, Homo Sapiens; identical to SEQ ID NO: 218323

SEQ ID NO: 575200 - RNA, 64 nt, Homo Sapiens; identical to SEQ ID NO: 218324

SEQ ID NO: 575201 - RNA, 64 nt, Homo Sapiens; identical to SEQ ID NO: 218325

SEQ ID NO: 575202 - RNA, 64 nt, Homo Sapiens; identical to SEQ ID NO: 218326

SEQ ID NO: 575203 - RNA, 64 nt, Homo Sapiens; identical to SEQ ID NO: 218327

SEQ ID NO: 575204 - RNA, 64 nt, Homo Sapiens; identical to SEQ ID NO: 218328

SEQ ID NO: 575205 - RNA, 64 nt, Homo Sapiens; identical to SEQ ID NO: 218329

SEQ ID NO: 575206 - RNA, 64 nt, Homo Sapiens; identical to SEQ ID NO: 218330

SEQ ID NO: 575207 - RNA, 64 nt, Homo Sapiens; identical to SEQ ID NO: 218331

SEQ ID NO: 575208 - RNA, 64 nt, Homo Sapiens; identical to SEQ ID NO: 218332

SEQ ID NO: 575209 - RNA, 64 nt, Homo Sapiens; identical to SEQ ID NO: 218333

SEQ ID NO: 575210 - RNA, 64 nt, Homo Sapiens; identical to SEQ ID NO: 218334

SEQ ID NO: 575211 - RNA, 64 nt, Homo Sapiens; identical to SEQ ID NO: 218335

SEQ ID NO: 575212 - RNA, 64 nt, Homo Sapiens; identical to SEQ ID NO: 218336

SEQ ID NO: 575213 - RNA, 64 nt, Homo Sapiens; identical to SEQ ID NO: 218337

SEQ ID NO: 575214 - RNA, 64 nt, Homo Sapiens; identical to SEQ ID NO: 218338

SEQ ID NO: 575215 - RNA, 64 nt, Homo Sapiens; identical to SEQ ID NO: 218339

SEQ ID NO: 575216 - RNA, 64 nt, Homo Sapiens; identical to SEQ ID NO: 218340

SEQ ID NO: 575217 - RNA, 64 nt, Homo Sapiens; identical to SEQ ID NO: 218341

SEQ ID NO: 575218 - RNA, 64 nt, Homo Sapiens; identical to SEQ ID NO: 218342

SEQ ID NO: 575219 - RNA, 64 nt, Homo Sapiens; identical to SEQ ID NO: 218343

SEQ ID NO: 575220 - RNA, 64 nt, Homo Sapiens; identical to SEQ ID NO: 218344

SEQ ID NO: 575221 - RNA, 64 nt, Homo Sapiens
caucuguccuacacuugagauaugaaucugagagaugcuguagaaugaaauauaugugaaagga

SEQ ID NO: 575222 - RNA, 64 nt, Homo Sapiens
ugugcuuugcccacaugcccauugacgucuagcuaugcuguaucgaagaaccgauacacuuggc

SEQ ID NO: 575223 - RNA, 64 nt, Homo Sapiens
uuaaauuuguguaaauacuucugcaaagguacugaugcuguaaagucaaaacaguuuuguggaa

SEQ ID NO: 575224 - RNA, 64 nt, Homo Sapiens
ucauauucaccauucuuccaccucauugaauugcaugcuguaguucuagcuuuucugcuauaau

SEQ ID NO: 575225 - RNA, 64 nt, Homo Sapiens
cccauaucaaaagacacagggcucccuucuguugaugcuguauucacagccaggcgcuagcaca

SEQ ID NO: 575226 - RNA, 64 nt, Homo Sapiens
agcaaguccugcaaccaaacguguccauuuccuuaugcuguaaauuggacuuucuagcauauau

SEQ ID NO: 575227 - RNA, 64 nt, Homo Sapiens
gccgucuggccucuggccucagucuucagauagacaguaagaagaaagcagccucauugauccg

SEQ ID NO: 575228 - RNA, 64 nt, Homo Sapiens
aaaagcucuccuuguaauugcaaguuuaguaacucaguaagaacaugccugcgacucccuuucu

SEQ ID NO: 575229 - RNA, 64 nt, Homo Sapiens
aaaauaaguuuuaucuuaaaaucauauuugaagacaguaagacaguaaacuauuuuaggaaguc

SEQ ID NO: 575230 - RNA, 64 nt, Homo Sapiens
gucaguagaagugagauaagauccucagaggaaacaguaagaagggauaaucauuaagauagua

SEQ ID NO: 575231 - RNA, 63 nt, Homo Sapiens
gaagcgcaaauuuucuugaacuguaucaugucuccccaucauuuucccaggacauuuuuuuuu

SEQ ID NO: 575232 - RNA, 63 nt, Homo Sapiens
aauaacuuuuuaucuugcucugugaccuaccuaccccaucagaguguugagccgcucauagca

SEQ ID NO: 575233 - RNA, 63 nt, Homo Sapiens
gcgagcucuguccuuacauggaccgacgagacuccccaucacaaacucuaagaaugccaaagg

SEQ ID NO: 575234 - RNA, 63 nt, Homo Sapiens
ugcccggacccuuuggccugcaggcaacgauucccccaucagccaccuuuucugcuugcuaca

SEQ ID NO: 575235 - RNA, 63 nt, Homo Sapiens
ccugcacccaccccagccagcuuuccugccccuccccaucauagggaugcuucccucugcccu

SEQ ID NO: 575236 - RNA, 63 nt, Homo Sapiens
gggucagcuggagagacccacaagcaauucuguccccaucaaggcauuguggggggacaggcu

SEQ ID NO: 575237 - RNA, 63 nt, Homo Sapiens
cccauuuccuuccccaaccagcacacacuucuuccccaucaagcaugcuccgcaaaguucucc

SEQ ID NO: 575238 - RNA, 63 nt, Homo Sapiens
acuacuccuccccagagacaacaccgcaucaguccccaucaucaaucucacugucucguuuuc

SEQ ID NO: 575239 - RNA, 63 nt, Homo Sapiens
acugcccaagguaauuuauagauucaaugccauccccaucaagcuaccaaugacuuucuucac

SEQ ID NO: 575240 - RNA, 63 nt, Homo Sapiens
aaugaacucaaacaaauuuacaggaacaaacaaccccaucaaaaagucggcaaaggacaugaa

SEQ ID NO: 575241 - RNA, 63 nt, Homo Sapiens
guucagcccagaagcccuuccaggcaugaucuuccccaucaggcugggcucuggcagggaccu

SEQ ID NO: 575242 - RNA, 63 nt, Homo Sapiens
cugcagcuggacccugcaggguggcucccuccuccccaucaagcacaagagagggcccaggaa

SEQ ID NO: 575243 - RNA, 63 nt, Homo Sapiens
ugcuucauacauacuugaccucucuuuucuauuccccaucacuuuugugcugaagcuaaucau

SEQ ID NO: 575244 - RNA, 63 nt, Homo Sapiens
gcuaauggaaaauacccaagggagggcaaagccccccaucagaugcaugaauguuugcgaaug

SEQ ID NO: 575245 - RNA, 63 nt, Homo Sapiens
ugagcuguuuucuguuggccuugcugcuccuccccccaucaccgucucgguugucguuuuuuc

SEQ ID NO: 575246 - RNA, 63 nt, Homo Sapiens
ccccucaaccuaucccguucagguggcgagagcccccaucaugguuccagaggugcagacaag

SEQ ID NO: 575247 - RNA, 63 nt, Homo Sapiens
ugggaaagcccaggccgcagugggugucccccaccccaucagcgggggcugggacuaaagaaa

SEQ ID NO: 575248 - RNA, 63 nt, Homo Sapiens
ucaaacauuaaggguacccgggacaacugacucccccaucagcccccuuucccugacugucaa

SEQ ID NO: 575249 - RNA, 63 nt, Homo Sapiens
cccccaccucgggucccugaccccagcucgaugccccaucaccgccucucccuggcucccaag

SEQ ID NO: 575250 - RNA, 63 nt, Homo Sapiens
cucccaagggugcaggugggcgcaaggcccggcccccaucacauguucccuuggccucagagc

SEQ ID NO: 575251 - RNA, 64 nt, Homo Sapiens; identical to SEQ ID NO: 441022

SEQ ID NO: 575252 - RNA, 64 nt, Homo Sapiens; identical to SEQ ID NO: 441023

SEQ ID NO: 575253 - RNA, 64 nt, Homo Sapiens; identical to SEQ ID NO: 441024

SEQ ID NO: 575254 - RNA, 64 nt, Homo Sapiens; identical to SEQ ID NO: 441025

SEQ ID NO: 575255 - RNA, 64 nt, Homo Sapiens; identical to SEQ ID NO: 441026

SEQ ID NO: 575256 - RNA, 64 nt, Homo Sapiens; identical to SEQ ID NO: 441027

SEQ ID NO: 575257 - RNA, 64 nt, Homo Sapiens; identical to SEQ ID NO: 441028

SEQ ID NO: 575258 - RNA, 64 nt, Homo Sapiens; identical to SEQ ID NO: 441029

SEQ ID NO: 575259 - RNA, 64 nt, Homo Sapiens; identical to SEQ ID NO: 441030

SEQ ID NO: 575260 - RNA, 64 nt, Homo Sapiens; identical to SEQ ID NO: 441031

SEQ ID NO: 575261 - RNA, 64 nt, Homo Sapiens; identical to SEQ ID NO: 441032

SEQ ID NO: 575262 - RNA, 64 nt, Homo Sapiens; identical to SEQ ID NO: 441033

SEQ ID NO: 575263 - RNA, 64 nt, Homo Sapiens; identical to SEQ ID NO: 441034

SEQ ID NO: 575264 - RNA, 64 nt, Homo Sapiens; identical to SEQ ID NO: 441035

SEQ ID NO: 575265 - RNA, 64 nt, Homo Sapiens; identical to SEQ ID NO: 441036

SEQ ID NO: 575266 - RNA, 64 nt, Homo Sapiens; identical to SEQ ID NO: 441037

SEQ ID NO: 575267 - RNA, 64 nt, Homo Sapiens; identical to SEQ ID NO: 441038

SEQ ID NO: 575268 - RNA, 64 nt, Homo Sapiens; identical to SEQ ID NO: 441039

SEQ ID NO: 575269 - RNA, 64 nt, Homo Sapiens; identical to SEQ ID NO: 441040

SEQ ID NO: 575270 - RNA, 64 nt, Homo Sapiens; identical to SEQ ID NO: 441041

SEQ ID NO: 575271 - RNA, 64 nt, Homo Sapiens; identical to SEQ ID NO: 441042

SEQ ID NO: 575272 - RNA, 64 nt, Homo Sapiens
ccuucauaccccuccucaacguucuuuuacuuuauacuuuaacuaccugagaguuaucagagcu

SEQ ID NO: 575273 - RNA, 64 nt, Homo Sapiens
agaaaauaccacccucuugugcccuuaaaagcauuacuuuaacugguagggaacgccagaaacu

SEQ ID NO: 575274 - RNA, 64 nt, Homo Sapiens
agaaauagcaacgagaugaauuuuguuaaaggucuacuuuaaucugaagguuucauaaugauca

SEQ ID NO: 575275 - RNA, 64 nt, Homo Sapiens
guagcagccacugacauuucucauguaaggaagguacuuuaaauuucaccuuugcaaacuuccc

SEQ ID NO: 575276 - RNA, 64 nt, Homo Sapiens
ggauagugcuucuugaccauuucagcauuuauuauacuuuaaugugcacugagcugugcugaug

SEQ ID NO: 575277 - RNA, 64 nt, Homo Sapiens
gucucugcucugacugaauuccaccccuccagacuacuuuaaauacuggcuugagccacugcac

SEQ ID NO: 575278 - RNA, 64 nt, Homo Sapiens
ucucauucauaauuucgcaauuuugauuugguuuuacuuuaauuaucucuaaaauguauaaaua

SEQ ID NO: 575279 - RNA, 64 nt, Homo Sapiens
uugaauaaaaaucuucauugcuaaaauuacuuuuuacuuuaagcugguacuucauuuuucuuaa

SEQ ID NO: 575280 - RNA, 64 nt, Homo Sapiens
aauguguuuguauacacaugucauuuauuauuauuacuuuaagauagguauuauucauguguca

SEQ ID NO: 575281 - RNA, 64 nt, Homo Sapiens
caaaguuuauuuugugaugcccucuugguuuugauacuuuaaaaucuguggcacccguucuaca

SEQ ID NO: 575282 - RNA, 64 nt, Homo Sapiens
cuuuuuuuaacagauagaauuuguauuuuuauuguacuuuaaaaagauuuauguaauagguaua

SEQ ID NO: 575283 - RNA, 64 nt, Homo Sapiens
uuaacuguguuuagcucauuuaaaucaaaauguguacuuuaaucuaaaauguuuuaauaaucug

SEQ ID NO: 575284 - RNA, 64 nt, Homo Sapiens
uuuuugguuuauuuauacuauauucugcauacaguacuuuaaaugccaauuacagugcaaucuu

SEQ ID NO: 575285 - RNA, 64 nt, Homo Sapiens
cagaguaccagguuuuauuuuucaccuuauucucuacuuuaaacaaaucauaacuuucucuuua

SEQ ID NO: 575286 - RNA, 64 nt, Homo Sapiens
ucugucuugaauuuggcccucccucuccccucucuacuuuaauucauuggagcaugggauuugg

SEQ ID NO: 575287 - RNA, 64 nt, Homo Sapiens
uuucucaauuagaauauuucacaacuuguuuuuguacuuuaagguuuuaaauuuacaacuuucc

SEQ ID NO: 575288 - RNA, 64 nt, Homo Sapiens
gaaauacaaaggaaauuucugggaagaagcaagauacuuuaagaagccucggcaaaccaauuug

SEQ ID NO: 575289 - RNA, 64 nt, Homo Sapiens
auugucauuaugugaaaccaauauuggcaaauaguacuuuaaugaugaaguaaaugaccagaaa

SEQ ID NO: 575290 - RNA, 64 nt, Homo Sapiens
ucauuauuuuuuuccuuuuaugugccacuguggcuacuuuaaaucacucugagagguaaaugga

SEQ ID NO: 575291 - RNA, 64 nt, Homo Sapiens
cuuaccuucuauagguagcuauaaguuaaaaacuuacuuuaaauaauugaaaaaugugaguuac

SEQ ID NO: 575292 - RNA, 64 nt, Homo Sapiens
gaggaaagcuacuuaacaaucacauacaaguucauacuuuaaaacaaaccagauguaaaacacu

SEQ ID NO: 575293 - RNA, 64 nt, Homo Sapiens
uuuucagcagaaauuaugcuauagauacccauuauacuuuaaaugccuuaaguuauaguuaugu

SEQ ID NO: 575294 - RNA, 64 nt, Homo Sapiens
auguaugguuagaguccaaugaaaugugagacuauacuuuaaagucucucuugggcuuccuccc

SEQ ID NO: 575295 - RNA, 64 nt, Homo Sapiens
ccuuaauuccagcauacagcuaucuuuaaagcccuacuuuaacuaggccucuucagaaaacuau

SEQ ID NO: 575296 - RNA, 64 nt, Homo Sapiens
caauccugcugcauucacugaugggguguaccuauacuuuaagcugaucuuauugcauguuucc

SEQ ID NO: 575297 - RNA, 64 nt, Homo Sapiens
guaacaucaacucaguuguaaaccccaaaucuacuacuuuaaaugcaaaaguuacuccauauac

SEQ ID NO: 575298 - RNA, 64 nt, Homo Sapiens
ucauuuauacaaaugaauaagaucuccuauggaguacuuuaaaugaaaaguguuuuaaguguaa

SEQ ID NO: 575299 - RNA, 64 nt, Homo Sapiens
ucuauaguuuucuccuuuagauaauaagcaugcauacuuuaacuccuucuugguuucccauagu

SEQ ID NO: 575300 - RNA, 64 nt, Homo Sapiens
aaaaguaugcuagcacuauuuacacuuuccuuuguacuuuaaaauagagcuaaauugauuuaau

SEQ ID NO: 575301 - RNA, 64 nt, Homo Sapiens
aagcauugccauugaaggcuuaauugacugaaauuacuuuaacauuuuggaaauuguuguauau

SEQ ID NO: 575302 - RNA, 64 nt, Homo Sapiens
aagcaugaauuggaacugcaaugaaagucaaauuuacuuuaaaaagaaauuaauauggcuucac

SEQ ID NO: 575303 - RNA, 64 nt, Homo Sapiens
uauuaaauauauuuauuuauuuaaauguuauuauuacuuuaaauauuauuuuaaauauuuugga

SEQ ID NO: 575304 - RNA, 64 nt, Homo Sapiens
uaauuuuuuaccuugauuuggcauguuuguauguuacuuuaaagaggauguguguucuaaagga

SEQ ID NO: 575305 - RNA, 64 nt, Homo Sapiens
acucauuauuguaaguaaucucugaaagccuuuuuacuuuaaccaaaucuacaugguuuaauau

SEQ ID NO: 575306 - RNA, 64 nt, Homo Sapiens
caaaucuacaugguuuaauaugugaaauuuuaacuacuuuaacuaguuuuauaaauuucuuaau

SEQ ID NO: 575307 - RNA, 64 nt, Homo Sapiens
auaauaaaauuuaucuaauuuuaaauaaaaugauuacuuuaaaaguuuaucaguuuucaauaga

SEQ ID NO: 575308 - RNA, 64 nt, Homo Sapiens
uaauguuauauuuaugcuaaaauaacccuagauauacuuuaaaauaaaaguauaaaacauuaaa

SEQ ID NO: 575309 - RNA, 64 nt, Homo Sapiens
cuuaaaauuauacauaaaaucaucccuaucuacuuacuuuaaugugcugauauauuagaaaugg

SEQ ID NO: 575310 - RNA, 64 nt, Homo Sapiens
uuaucuuuuuauuuuauaaguauguuuguaauguuacuuuaaaaacugggagacacuaguagua

SEQ ID NO: 575311 - RNA, 64 nt, Homo Sapiens
caugaaaauaucucccuuuggagcugcucagacuuacuuuaagcucaaacagaagggaaugcua

SEQ ID NO: 575312 - RNA, 64 nt, Homo Sapiens
guaacuccauggcauaaauaguuguauuuuuguguacuuuaaaaucaacuuauaacugugagau

SEQ ID NO: 575313 - RNA, 64 nt, Homo Sapiens
ucucccauuugguuuauaaaaagaagucaguugauacuuuaaaauuagaaaacauucuauauaa

SEQ ID NO: 575314 - RNA, 64 nt, Homo Sapiens
aagaauuaacagagauugaaaacugauacuucacuacuuuaauagaucauuauaucauuggaac

SEQ ID NO: 575315 - RNA, 64 nt, Homo Sapiens
aacuggaaauggaaaaaaaaagcaaaucugugucuacuuuaaaauuaaaaucagcuuuauucua

SEQ ID NO: 575316 - RNA, 64 nt, Homo Sapiens
gguuuguccaaaauaaauaugauaauaaaaucgcuacuuuaaggucaaaagaaugaauaacauu

SEQ ID NO: 575317 - RNA, 64 nt, Homo Sapiens
auggaagucugugcaugaggcuucuccaucucucuacuuuaaaguucucuuuacuucucuccac

SEQ ID NO: 575318 - RNA, 64 nt, Homo Sapiens
guuagucuuaaauaguugggcauacacugacuguuacuuuaacugccaagcacauuaacuuucu

SEQ ID NO: 575319 - RNA, 64 nt, Homo Sapiens
uggauggguuaauuuauauaaagcauagcaaaucuacuuuaaacuauucuuccuuaaguaagug

SEQ ID NO: 575320 - RNA, 64 nt, Homo Sapiens
uuuuaagugugggggguuugaaauuaagauuuaauacuuuaaugcacauauauauaugacuuga

SEQ ID NO: 575321 - RNA, 64 nt, Homo Sapiens
uguguguguguguguguguguguguguaagggaguacuuuaaccuugccaguuuguucccucuu

SEQ ID NO: 575322 - RNA, 64 nt, Homo Sapiens
ucagauauuuguuguaaguuaauucaauucuuaauacuuuaauuuugcuccaacaagggcuuua

SEQ ID NO: 575323 - RNA, 64 nt, Homo Sapiens
auacuugaaauuuauuuguaugauauaaaguuauuacuuuaaacaaaaugcaaguaugggggga

SEQ ID NO: 575324 - RNA, 64 nt, Homo Sapiens
uaaucuuuaaaucaugauccuaauuagcuguccuuacuuuaacuugaucuaauuauugcuuccu

SEQ ID NO: 575325 - RNA, 64 nt, Homo Sapiens
ugcaaagucuuccgggccuagguauuauaggcaguacuuuaaauuucgguccuuuuuaaucugg

SEQ ID NO: 575326 - RNA, 64 nt, Homo Sapiens
aguauuguaggcacgguggacagugcuuuuuugguacuuuaacagaaagaauguguuucaguau

SEQ ID NO: 575327 - RNA, 64 nt, Homo Sapiens
gaucacuucucuuuucaguuggagaauaaacucauacuuuaaaaguggguauuuaagaaaaccu

SEQ ID NO: 575328 - RNA, 64 nt, Homo Sapiens
aaauucaaaugaagagaaaagaaagugugaggucuacuuuaaaauaaaaugauacuuaaauaaa

SEQ ID NO: 575329 - RNA, 64 nt, Homo Sapiens
uuuauuauaaaauauaaacaauaucuguugcauguacuuuaaagaggcagaacacaauggcuaa

SEQ ID NO: 575330 - RNA, 64 nt, Homo Sapiens
accuugugcugcucuuuaugucuaaaaaugcuccuacuuuaaguaauauaccagcgaauuuaaa

SEQ ID NO: 575331 - RNA, 64 nt, Homo Sapiens
auuuacuacaauauguacauaucaacuaaaguuguacuuuaaaauuauuacauacacaucagcc

SEQ ID NO: 575332 - RNA, 64 nt, Homo Sapiens
uaguuuugcauaguucuaguauuguuguccgguuuacuuuaacucaaaaccaaaaguuauuaaa

SEQ ID NO: 575333 - RNA, 64 nt, Homo Sapiens; identical to SEQ ID NO: 114130

SEQ ID NO: 575334 - RNA, 64 nt, Homo Sapiens; identical to SEQ ID NO: 114131

SEQ ID NO: 575335 - RNA, 64 nt, Homo Sapiens; identical to SEQ ID NO: 114132

SEQ ID NO: 575336 - RNA, 64 nt, Homo Sapiens; identical to SEQ ID NO: 114133

SEQ ID NO: 575337 - RNA, 64 nt, Homo Sapiens; identical to SEQ ID NO: 114134

SEQ ID NO: 575338 - RNA, 64 nt, Homo Sapiens; identical to SEQ ID NO: 114135

SEQ ID NO: 575339 - RNA, 64 nt, Homo Sapiens; identical to SEQ ID NO: 114136

SEQ ID NO: 575340 - RNA, 64 nt, Homo Sapiens; identical to SEQ ID NO: 114137

SEQ ID NO: 575341 - RNA, 64 nt, Homo Sapiens; identical to SEQ ID NO: 114138

SEQ ID NO: 575342 - RNA, 64 nt, Homo Sapiens; identical to SEQ ID NO: 114139

SEQ ID NO: 575343 - RNA, 64 nt, Homo Sapiens; identical to SEQ ID NO: 114140

SEQ ID NO: 575344 - RNA, 64 nt, Homo Sapiens; identical to SEQ ID NO: 114141

SEQ ID NO: 575345 - RNA, 64 nt, Homo Sapiens; identical to SEQ ID NO: 114142

SEQ ID NO: 575346 - RNA, 64 nt, Homo Sapiens; identical to SEQ ID NO: 114143

SEQ ID NO: 575347 - RNA, 64 nt, Homo Sapiens; identical to SEQ ID NO: 114144

SEQ ID NO: 575348 - RNA, 64 nt, Homo Sapiens; identical to SEQ ID NO: 114145

SEQ ID NO: 575349 - RNA, 64 nt, Homo Sapiens; identical to SEQ ID NO: 114146

SEQ ID NO: 575350 - RNA, 64 nt, Homo Sapiens; identical to SEQ ID NO: 114147

SEQ ID NO: 575351 - RNA, 64 nt, Homo Sapiens; identical to SEQ ID NO: 133830

SEQ ID NO: 575352 - RNA, 64 nt, Homo Sapiens; identical to SEQ ID NO: 133831

SEQ ID NO: 575353 - RNA, 64 nt, Homo Sapiens; identical to SEQ ID NO: 133832

SEQ ID NO: 575354 - RNA, 64 nt, Homo Sapiens; identical to SEQ ID NO: 133833

SEQ ID NO: 575355 - RNA, 64 nt, Homo Sapiens; identical to SEQ ID NO: 133834

SEQ ID NO: 575356 - RNA, 64 nt, Homo Sapiens; identical to SEQ ID NO: 133835

SEQ ID NO: 575357 - RNA, 64 nt, Homo Sapiens; identical to SEQ ID NO: 133836

SEQ ID NO: 575358 - RNA, 64 nt, Homo Sapiens; identical to SEQ ID NO: 133837

SEQ ID NO: 575359 - RNA, 64 nt, Homo Sapiens; identical to SEQ ID NO: 133838

SEQ ID NO: 575360 - RNA, 64 nt, Homo Sapiens; identical to SEQ ID NO: 133839

SEQ ID NO: 575361 - RNA, 64 nt, Homo Sapiens; identical to SEQ ID NO: 133840

SEQ ID NO: 575362 - RNA, 64 nt, Homo Sapiens; identical to SEQ ID NO: 133841

SEQ ID NO: 575363 - RNA, 64 nt, Homo Sapiens; identical to SEQ ID NO: 133842

SEQ ID NO: 575364 - RNA, 64 nt, Homo Sapiens; identical to SEQ ID NO: 133843

SEQ ID NO: 575365 - RNA, 64 nt, Homo Sapiens; identical to SEQ ID NO: 133844

SEQ ID NO: 575366 - RNA, 64 nt, Homo Sapiens; identical to SEQ ID NO: 133845

SEQ ID NO: 575367 - RNA, 64 nt, Homo Sapiens; identical to SEQ ID NO: 133846

SEQ ID NO: 575368 - RNA, 64 nt, Homo Sapiens; identical to SEQ ID NO: 133847

SEQ ID NO: 575369 - RNA, 64 nt, Homo Sapiens; identical to SEQ ID NO: 133848

SEQ ID NO: 575370 - RNA, 64 nt, Homo Sapiens; identical to SEQ ID NO: 133849

SEQ ID NO: 575371 - RNA, 64 nt, Homo Sapiens; identical to SEQ ID NO: 133850

SEQ ID NO: 575372 - RNA, 64 nt, Homo Sapiens; identical to SEQ ID NO: 133851

SEQ ID NO: 575373 - RNA, 64 nt, Homo Sapiens; identical to SEQ ID NO: 133852

SEQ ID NO: 575374 - RNA, 64 nt, Homo Sapiens; identical to SEQ ID NO: 133853

SEQ ID NO: 575375 - RNA, 64 nt, Homo Sapiens; identical to SEQ ID NO: 133854

SEQ ID NO: 575376 - RNA, 64 nt, Homo Sapiens; identical to SEQ ID NO: 133855

SEQ ID NO: 575377 - RNA, 64 nt, Homo Sapiens; identical to SEQ ID NO: 133856

SEQ ID NO: 575378 - RNA, 64 nt, Homo Sapiens; identical to SEQ ID NO: 133857

SEQ ID NO: 575379 - RNA, 64 nt, Homo Sapiens; identical to SEQ ID NO: 133858

SEQ ID NO: 575380 - RNA, 64 nt, Homo Sapiens; identical to SEQ ID NO: 133859

SEQ ID NO: 575381 - RNA, 64 nt, Homo Sapiens; identical to SEQ ID NO: 133860

SEQ ID NO: 575382 - RNA, 64 nt, Homo Sapiens; identical to SEQ ID NO: 133861

SEQ ID NO: 575383 - RNA, 64 nt, Homo Sapiens; identical to SEQ ID NO: 133862

SEQ ID NO: 575384 - RNA, 64 nt, Homo Sapiens; identical to SEQ ID NO: 133863

SEQ ID NO: 575385 - RNA, 64 nt, Homo Sapiens; identical to SEQ ID NO: 133864

SEQ ID NO: 575386 - RNA, 64 nt, Homo Sapiens; identical to SEQ ID NO: 133865

SEQ ID NO: 575387 - RNA, 64 nt, Homo Sapiens; identical to SEQ ID NO: 133866

SEQ ID NO: 575388 - RNA, 64 nt, Homo Sapiens; identical to SEQ ID NO: 133867

SEQ ID NO: 575389 - RNA, 64 nt, Homo Sapiens; identical to SEQ ID NO: 133868

SEQ ID NO: 575390 - RNA, 64 nt, Homo Sapiens; identical to SEQ ID NO: 133869

SEQ ID NO: 575391 - RNA, 64 nt, Homo Sapiens; identical to SEQ ID NO: 133870

SEQ ID NO: 575392 - RNA, 64 nt, Homo Sapiens; identical to SEQ ID NO: 133871

SEQ ID NO: 575393 - RNA, 64 nt, Homo Sapiens; identical to SEQ ID NO: 133872

SEQ ID NO: 575394 - RNA, 64 nt, Homo Sapiens; identical to SEQ ID NO: 133873

SEQ ID NO: 575395 - RNA, 64 nt, Homo Sapiens; identical to SEQ ID NO: 133874

SEQ ID NO: 575396 - RNA, 64 nt, Homo Sapiens; identical to SEQ ID NO: 133875

SEQ ID NO: 575397 - RNA, 64 nt, Homo Sapiens; identical to SEQ ID NO: 133876

SEQ ID NO: 575398 - RNA, 64 nt, Homo Sapiens; identical to SEQ ID NO: 133877

SEQ ID NO: 575399 - RNA, 64 nt, Homo Sapiens; identical to SEQ ID NO: 133878

SEQ ID NO: 575400 - RNA, 64 nt, Homo Sapiens; identical to SEQ ID NO: 133879

SEQ ID NO: 575401 - RNA, 64 nt, Homo Sapiens; identical to SEQ ID NO: 133880

SEQ ID NO: 575402 - RNA, 64 nt, Homo Sapiens; identical to SEQ ID NO: 133881

SEQ ID NO: 575403 - RNA, 64 nt, Homo Sapiens; identical to SEQ ID NO: 133882

SEQ ID NO: 575404 - RNA, 64 nt, Homo Sapiens; identical to SEQ ID NO: 133883

SEQ ID NO: 575405 - RNA, 64 nt, Homo Sapiens; identical to SEQ ID NO: 133884

SEQ ID NO: 575406 - RNA, 64 nt, Homo Sapiens; identical to SEQ ID NO: 133885

SEQ ID NO: 575407 - RNA, 64 nt, Homo Sapiens; identical to SEQ ID NO: 133886

SEQ ID NO: 575408 - RNA, 64 nt, Homo Sapiens; identical to SEQ ID NO: 133887

SEQ ID NO: 575409 - RNA, 64 nt, Homo Sapiens; identical to SEQ ID NO: 133888

SEQ ID NO: 575410 - RNA, 64 nt, Homo Sapiens; identical to SEQ ID NO: 133889

SEQ ID NO: 575411 - RNA, 64 nt, Homo Sapiens; identical to SEQ ID NO: 133890

SEQ ID NO: 575412 - RNA, 64 nt, Homo Sapiens; identical to SEQ ID NO: 133891

SEQ ID NO: 575413 - RNA, 64 nt, Homo Sapiens; identical to SEQ ID NO: 133892

SEQ ID NO: 575414 - RNA, 64 nt, Homo Sapiens; identical to SEQ ID NO: 133893

SEQ ID NO: 575415 - RNA, 64 nt, Homo Sapiens
augccgcuggacucucugaccuuggagaguguaaacaucauauaugauucuguguuccugagau

SEQ ID NO: 575416 - RNA, 64 nt, Homo Sapiens
uuuuucagauuuuuuauaugcuucuuuacuacuuacaucauaaugcacaauuuuauauacugau

SEQ ID NO: 575417 - RNA, 64 nt, Homo Sapiens
acagaacaagacuccaucucaaaaaaaaaaaaguacaucauaaaaguacaucauaugugaacau

SEQ ID NO: 575418 - RNA, 64 nt, Homo Sapiens
ccaucucaaaaaaaaaaaaguacaucauaaaaguacaucauaugugaacaugcaaaagcaaugc

SEQ ID NO: 575419 - RNA, 64 nt, Homo Sapiens; identical to SEQ ID NO: 245916

SEQ ID NO: 575420 - RNA, 64 nt, Homo Sapiens; identical to SEQ ID NO: 245917

SEQ ID NO: 575421 - RNA, 64 nt, Homo Sapiens; identical to SEQ ID NO: 245918

SEQ ID NO: 575422 - RNA, 64 nt, Homo Sapiens; identical to SEQ ID NO: 245919

SEQ ID NO: 575423 - RNA, 64 nt, Homo Sapiens; identical to SEQ ID NO: 245920

SEQ ID NO: 575424 - RNA, 64 nt, Homo Sapiens; identical to SEQ ID NO: 245921

SEQ ID NO: 575425 - RNA, 64 nt, Homo Sapiens; identical to SEQ ID NO: 245922

SEQ ID NO: 575426 - RNA, 64 nt, Homo Sapiens; identical to SEQ ID NO: 245923

SEQ ID NO: 575427 - RNA, 64 nt, Homo Sapiens; identical to SEQ ID NO: 245924

SEQ ID NO: 575428 - RNA, 64 nt, Homo Sapiens; identical to SEQ ID NO: 245925

SEQ ID NO: 575429 - RNA, 64 nt, Homo Sapiens; identical to SEQ ID NO: 245926

SEQ ID NO: 575430 - RNA, 64 nt, Homo Sapiens; identical to SEQ ID NO: 245927

SEQ ID NO: 575431 - RNA, 64 nt, Homo Sapiens; identical to SEQ ID NO: 245928

SEQ ID NO: 575432 - RNA, 64 nt, Homo Sapiens; identical to SEQ ID NO: 245929

SEQ ID NO: 575433 - RNA, 64 nt, Homo Sapiens; identical to SEQ ID NO: 245930

SEQ ID NO: 575434 - RNA, 64 nt, Homo Sapiens; identical to SEQ ID NO: 245931

SEQ ID NO: 575435 - RNA, 64 nt, Homo Sapiens; identical to SEQ ID NO: 245932

SEQ ID NO: 575436 - RNA, 64 nt, Homo Sapiens; identical to SEQ ID NO: 245933

SEQ ID NO: 575437 - RNA, 64 nt, Homo Sapiens; identical to SEQ ID NO: 245934

SEQ ID NO: 575438 - RNA, 64 nt, Homo Sapiens; identical to SEQ ID NO: 245935

SEQ ID NO: 575439 - RNA, 64 nt, Homo Sapiens; identical to SEQ ID NO: 245936

SEQ ID NO: 575440 - RNA, 64 nt, Homo Sapiens
cacuuuauuccaaaguacacauucauuucugaaagcaguugagcuuucucccaguacuccagca

SEQ ID NO: 575441 - RNA, 64 nt, Homo Sapiens
ccuagcagcguuauugauggauucuucagaaacagcaguugauaguuaggucauuuguggguug

SEQ ID NO: 575442 - RNA, 64 nt, Homo Sapiens
gacaacagaagcuucagaagacagcccucccccagcaguugaauauagcggguuacuuucacau

SEQ ID NO: 575443 - RNA, 64 nt, Homo Sapiens
cgucaucacuuuucagugauacuuggcaacagaagcaguugagugugguuuauagagggccaag

SEQ ID NO: 575444 - RNA, 64 nt, Homo Sapiens
agacacauccucagugaaucaggucaagcaggaagcaguugacacugacuaacuuggcauuugc

SEQ ID NO: 575445 - RNA, 64 nt, Homo Sapiens
uauguuuauauuuuaagucaguucuaagaagcaggcaguugaugugugcuacccuuucuaaacu

SEQ ID NO: 575446 - RNA, 64 nt, Homo Sapiens
augguguuaaugauauuagagaugaaaaacguuagcaguugauuuuuguccaaaagcaagucau

SEQ ID NO: 575447 - RNA, 64 nt, Homo Sapiens
aaaugggaaaagggaaaaggagagagcaauugaggcaguugaccauauucaguuuuauuuauuu

SEQ ID NO: 575448 - RNA, 64 nt, Homo Sapiens
aacagcaacauaaaccacauauuuguuuucaaaagcaguugaguucuauaaaacacuauaggac

SEQ ID NO: 575449 - RNA, 64 nt, Homo Sapiens
ucucguccuggucucugcccguucgagcagaggggcaguugaagcgauucuguuuuguucaucu

SEQ ID NO: 575450 - RNA, 64 nt, Homo Sapiens
cagagacacuuugccacaguucuuugaaauagcagcaguugaaaaucagaaauuuuggaagggu

SEQ ID NO: 575451 - RNA, 64 nt, Homo Sapiens
aaaggacagccccugguuggguuugcagagcugggcaguugaggccaccuucucuccacagaau

SEQ ID NO: 575452 - RNA, 64 nt, Homo Sapiens
uauuuauaaccuguuauaagugcuauauucuguuugcaguuaggaaaugcagaauucaaaguga

SEQ ID NO: 575453 - RNA, 64 nt, Homo Sapiens
aucucaaaaaagaaggaauuucuccuuuguuucuugcaguuaauguaagaauacuuuaaaucuc

SEQ ID NO: 575454 - RNA, 64 nt, Homo Sapiens
gcaaaugaacuuuuuuaaaaaucaucuuccauguugcaguuagucuuucuuuucauuacaaguc

SEQ ID NO: 575455 - RNA, 64 nt, Homo Sapiens
guuguacauugcauagaugucacugguucauguuugcaguuacuucacaaaagaaauugccuua

SEQ ID NO: 575456 - RNA, 64 nt, Homo Sapiens
gcuccagcagaaaccagauugaacagaucgucauugcaguuaaaauagcauucaggccuuccau

SEQ ID NO: 575457 - RNA, 64 nt, Homo Sapiens
uucuaacagagaaguccaaaaaaagggcugguaaugcaguuacauuugauagauagaugccuuu

SEQ ID NO: 575458 - RNA, 64 nt, Homo Sapiens
gccuguguggccagcuucaccagcaguccuguggugcaguuacugaaaggacguguggagacag

SEQ ID NO: 575459 - RNA, 64 nt, Homo Sapiens
accuccuguaacuaaagcauuuuggcuguuauuuugcaguuaauuggacgugcccaggaaugcu

SEQ ID NO: 575460 - RNA, 64 nt, Homo Sapiens
ggcuucuguuacauggagcuuuugguugcugagaugcaguuaaugacuacaagaugaaagacaa

SEQ ID NO: 575461 - RNA, 64 nt, Homo Sapiens
ucacccucagcuggcggaaccuggcugcgaacugugcaguuacguugcauccacaggauuccag

SEQ ID NO: 575462 - RNA, 64 nt, Homo Sapiens
cuuguaaaccuggaggguugauauauucuuuccaugcaguuauuagaacuuaguuuuguuccaa

SEQ ID NO: 575463 - RNA, 64 nt, Homo Sapiens
ggccccggggcauggcugcugacgugggcauggguggauuuagccaaggaccuggcaacccagg

SEQ ID NO: 575464 - RNA, 64 nt, Homo Sapiens
gcugcuuugggggaggggggaacucgagaauguauggauuuaccugaaaacaaauuauucauuu

SEQ ID NO: 575465 - RNA, 64 nt, Homo Sapiens
gcugcccucuguuuuuuuuauccacucguaaaucuggauuuauuucuucuguuuuauacaagcu

SEQ ID NO: 575466 - RNA, 64 nt, Homo Sapiens
agucagguucuucucuacaguucaaaauugagaauggauuuaauuaacuagcauuuagccagcu

SEQ ID NO: 575467 - RNA, 64 nt, Homo Sapiens
uccacauauguaccccuucuccuuuuuuuaaagauggauuuaaaccaagaugccuccaggaaag

SEQ ID NO: 575468 - RNA, 64 nt, Homo Sapiens
uauuucauuauuuuaauaacugugaugucauguauggauuuacuuugggguucaaaucaaaaug

SEQ ID NO: 575469 - RNA, 64 nt, Homo Sapiens
aaagcuauaccaaaagggccauguuucaagaaaauggauuuaaacauauuucccuguggaggua

SEQ ID NO: 575470 - RNA, 64 nt, Homo Sapiens
gagacugauucagaggagcaacccuauuuagaaauggauuuaucaucaccucaaacgagauaua

SEQ ID NO: 575471 - RNA, 64 nt, Homo Sapiens
acuuugguugauuuuuaagugggcuuccauuccauggauuuaaucagucccaagaagaucaaac

SEQ ID NO: 575472 - RNA, 64 nt, Homo Sapiens
caaacucagcaguacuugggugcugaagaacuguuggauuuacccuggcacgugugccacuugc

SEQ ID NO: 575473 - RNA, 64 nt, Homo Sapiens
uuuucuuaacuauuuggauuugaaauaaauggcauggauuuauuuuauuguauucuaauauaau

SEQ ID NO: 575474 - RNA, 64 nt, Homo Sapiens
ucuuuacuguaaugacucaaucccuuuuccauuuuggauuuaucauggaagcuugaguauguuc

SEQ ID NO: 575475 - RNA, 64 nt, Homo Sapiens
cuuaucuaccccguggauuccagcauguaccccauggauuuaauugacuuucaaauguaugaac

SEQ ID NO: 575476 - RNA, 64 nt, Homo Sapiens
gcugugcaggaugugccuuggaaucaaaguuuaauggauuuaggacagaaacaugcgcuguaau

SEQ ID NO: 575477 - RNA, 64 nt, Homo Sapiens
ugagugcuuuaaacaaauagcuuuuugggugaaauggauuuaugcuagaagcacuuuauguuuc

SEQ ID NO: 575478 - RNA, 64 nt, Homo Sapiens
agggcaucaaucagcucaacucauggauuauuaauggauuuaagcuaggcaugugaaaucacuu

SEQ ID NO: 575479 - RNA, 64 nt, Homo Sapiens
uaaaauccuuuaagccaaaaggaagcuugcucuauggauuuaaaugcaaacuucauuuaccagu

SEQ ID NO: 575480 - RNA, 64 nt, Homo Sapiens
cacuaaaacaggguucucuuuggauuaaaaguucuggauuuauugcaacuauuuuccuugagaa

SEQ ID NO: 575481 - RNA, 64 nt, Homo Sapiens
gucagaauucuaaacuaaagacauguuuggaguguggauuuaucuucaguuuuucuuuggacaa

SEQ ID NO: 575482 - RNA, 64 nt, Homo Sapiens
gaauauggcacauuggaaccauuuuauucaccaguggauuuacccuuagaguauuuuuagaucu

SEQ ID NO: 575483 - RNA, 64 nt, Homo Sapiens
aauuuuaaacaaucauuuaccauauguuuaugucuggauuuaaacaggauguuaauaaugaagc

SEQ ID NO: 575484 - RNA, 64 nt, Homo Sapiens
ccaaaauugcuuagucaccaugugacuuagucuauggauuuauuuauaaacaauuuaugcaugc

SEQ ID NO: 575485 - RNA, 64 nt, Homo Sapiens
auucuugaccugguguucuucaucauucuugcuauggauuuaucaauuuuguuccucuuuucca

SEQ ID NO: 575486 - RNA, 64 nt, Homo Sapiens
ucauaaugcaucuucuucccuccuucuacuguacuggauuuaaagcgcaccuuauagagacauc

SEQ ID NO: 575487 - RNA, 64 nt, Homo Sapiens
agguuguuaaggcuguaagagaagaugcuaguuauggauuuacaguaaagggucugccagauag

SEQ ID NO: 575488 - RNA, 64 nt, Homo Sapiens
ggaacugucauaguguucaggcccuccacucaucuggauuuacacucgagagccaauacccugu

SEQ ID NO: 575489 - RNA, 64 nt, Homo Sapiens
auuucuuaggcauuuucucucuuauaaaguuuccuggauuuauaaauuuucauugauuuuacua

SEQ ID NO: 575490 - RNA, 64 nt, Homo Sapiens
ugaguguaaguuuacuauauauaaagcuaagauguggauuuacaggaagaacccugguuugaau

SEQ ID NO: 575491 - RNA, 64 nt, Homo Sapiens
aguuguggucugacacacacugcugugguuccccuggauuuagugaaaugccguaugcagguuu

SEQ ID NO: 575492 - RNA, 64 nt, Homo Sapiens
aagguagcagugcuucucugguccucaagagacuuggauuuaaagguaggaugauguuuuuuuc

SEQ ID NO: 575493 - RNA, 64 nt, Homo Sapiens
acauuacaauccugcauuguauauaaauaauuuauggauuuaugcaggcuacaaucuucauuua

SEQ ID NO: 575494 - RNA, 64 nt, Homo Sapiens
uaaagcgaagagacaagaucguugccucuugaaguggauuuaaccuaaauaagcuuccacgcca

SEQ ID NO: 575495 - RNA, 64 nt, Homo Sapiens
ccauuucugauacgugguuuuuaaaaauaugaaauggauuuauauauacuauauuccucaaauc

SEQ ID NO: 575496 - RNA, 64 nt, Homo Sapiens
auugauuguuacuuaaauuuuccaccuggaaucauggauuuaaaauuuccccaccucaugggga

SEQ ID NO: 575497 - RNA, 64 nt, Homo Sapiens
uauuuauuuugagauagagccccagccugguuauuggauuuauuuacaggcaugagccaccgca

SEQ ID NO: 575498 - RNA, 64 nt, Homo Sapiens
agguaaucaaggcaauucaggaaaauacuguggauggauuuaauuuuauuucugauuuucacag

SEQ ID NO: 575499 - RNA, 64 nt, Homo Sapiens
uuggcaaauuuaggagcuuguucccauugccaaauggauuuagaaauucccuugugagugccug

SEQ ID NO: 575500 - RNA, 64 nt, Homo Sapiens
acacauacauacauauuaccauacugaagggaaauggauuuauauuugaauuugauauuugaau

SEQ ID NO: 575501 - RNA, 64 nt, Homo Sapiens
gguaaauauguuacaaaaccgagaaauauuuugugacuuuaauuuaccugcaugaauaaauaau

SEQ ID NO: 575502 - RNA, 64 nt, Homo Sapiens
uggaggaaaaauauccuacacuaaggagagauaggacuuuaaucauacugcauagaggaacaga

SEQ ID NO: 575503 - RNA, 64 nt, Homo Sapiens
aaauuuuuuucaugauggaaagaaucagacagaugacuuuaaagaaagaaugugaaauuuuuac

SEQ ID NO: 575504 - RNA, 64 nt, Homo Sapiens
ccuuuauauuuuuaaagauaaucuuuuucuuauggacuuuaagauaauuauuucugaaauaucc

SEQ ID NO: 575505 - RNA, 64 nt, Homo Sapiens
ggaaguuucauucauauuuagcuuucugucauuugacuuuaaaaaaauaaugcacagggcuuga

SEQ ID NO: 575506 - RNA, 64 nt, Homo Sapiens
uaaugcacagggcuugagcuuagaaauguucucagacuuuaaaaguagucccaucuccacuauu

SEQ ID NO: 575507 - RNA, 64 nt, Homo Sapiens
aaauaaucauguuugaauuguuaauacuuucaaggacuuuaaaauuuccuuuucucugagaguu

SEQ ID NO: 575508 - RNA, 64 nt, Homo Sapiens
aucuuguguaucaaaccuauagaauauguaaaaugacuuuaaggcuuuugaacaacuugguuuc

SEQ ID NO: 575509 - RNA, 64 nt, Homo Sapiens
uaugaaaccuaauccuacccaugaaauuucugcugacuuuaauacuggcaacaaauugugaaac

SEQ ID NO: 575510 - RNA, 64 nt, Homo Sapiens
ugucaccaauugaaaaucuuauuaguuaauaaaugacuuuaaauuauuguagauuuauuuuuau

SEQ ID NO: 575511 - RNA, 64 nt, Homo Sapiens
uuguccaguucuggucuuuucagccauucuuccugacuuuaauagugugacuuuucaaguguaa

SEQ ID NO: 575512 - RNA, 64 nt, Homo Sapiens
gcuuuagggaauuuuaaguugcaugcauuucagagacuuuaagucaguugguuuuuauuagcug

SEQ ID NO: 575513 - RNA, 64 nt, Homo Sapiens
ugccaggagccauaggaauaucuguauguuggaugacuuuaaugcuacauuuuaaaaaaagaaa

SEQ ID NO: 575514 - RNA, 64 nt, Homo Sapiens
ugugcucuuaccagugguuaauaauuugaaguuugacuuuaauuguaaaagccguuaauguaga

SEQ ID NO: 575515 - RNA, 64 nt, Homo Sapiens
uaucacacaaaguuccuguauuucuagggaagcagacuuuaaauuucuaaaaacuugauuuaau

SEQ ID NO: 575516 - RNA, 64 nt, Homo Sapiens
uuuaaagagcucauuugcaacuaaaggggaaauggacuuuaaauaaauguagacauaugcuugg

SEQ ID NO: 575517 - RNA, 64 nt, Homo Sapiens
uaagagaaagaaaucauaaaacuaaaccagaagagacuuuaaaaaugaugaaacuuuuuaaaaa

SEQ ID NO: 575518 - RNA, 64 nt, Homo Sapiens
uuauaaaaugauuucccaugaaaacauucagugugacuuuaauacaaaguuuagucacagcuua

SEQ ID NO: 575519 - RNA, 64 nt, Homo Sapiens
aagucaaacaacuuauaagaucuauuuuuaaaaggacuuuaacguugggaaacuagagaacacc

SEQ ID NO: 575520 - RNA, 64 nt, Homo Sapiens
ucuuauuacccugauugaaugugugaugugaacugacuuuaaguaaucaggauugaauuccauu

SEQ ID NO: 575521 - RNA, 64 nt, Homo Sapiens
uagucauuaacuugaauuuggucuguauagucuagacuuuaaauuuaaaguuuucuacaagggg

SEQ ID NO: 575522 - RNA, 64 nt, Homo Sapiens
gaguuuguuggugaaguuugggggcgggguguugggaguagagacaggguaaggggacgugaga

SEQ ID NO: 575523 - RNA, 64 nt, Homo Sapiens
gugccacccuaggucauaugaccuuggccaccuuggaguagacccagaccccucgggacccggg

SEQ ID NO: 575524 - RNA, 64 nt, Homo Sapiens; identical to SEQ ID NO: 89905

SEQ ID NO: 575525 - RNA, 64 nt, Homo Sapiens; identical to SEQ ID NO: 89906

SEQ ID NO: 575526 - RNA, 64 nt, Homo Sapiens; identical to SEQ ID NO: 89907

SEQ ID NO: 575527 - RNA, 64 nt, Homo Sapiens; identical to SEQ ID NO: 89908

SEQ ID NO: 575528 - RNA, 64 nt, Homo Sapiens; identical to SEQ ID NO: 89909

SEQ ID NO: 575529 - RNA, 64 nt, Homo Sapiens; identical to SEQ ID NO: 89910

SEQ ID NO: 575530 - RNA, 64 nt, Homo Sapiens; identical to SEQ ID NO: 89911

SEQ ID NO: 575531 - RNA, 64 nt, Homo Sapiens; identical to SEQ ID NO: 89912

SEQ ID NO: 575532 - RNA, 64 nt, Homo Sapiens; identical to SEQ ID NO: 89913

SEQ ID NO: 575533 - RNA, 64 nt, Homo Sapiens; identical to SEQ ID NO: 89914

SEQ ID NO: 575534 - RNA, 64 nt, Homo Sapiens; identical to SEQ ID NO: 89915

SEQ ID NO: 575535 - RNA, 64 nt, Homo Sapiens; identical to SEQ ID NO: 89916

SEQ ID NO: 575536 - RNA, 64 nt, Homo Sapiens; identical to SEQ ID NO: 89917

SEQ ID NO: 575537 - RNA, 64 nt, Homo Sapiens; identical to SEQ ID NO: 89918

SEQ ID NO: 575538 - RNA, 64 nt, Homo Sapiens; identical to SEQ ID NO: 89919

SEQ ID NO: 575539 - RNA, 64 nt, Homo Sapiens; identical to SEQ ID NO: 89920

SEQ ID NO: 575540 - RNA, 64 nt, Homo Sapiens; identical to SEQ ID NO: 89921

SEQ ID NO: 575541 - RNA, 64 nt, Homo Sapiens; identical to SEQ ID NO: 89922

SEQ ID NO: 575542 - RNA, 64 nt, Homo Sapiens; identical to SEQ ID NO: 89923

SEQ ID NO: 575543 - RNA, 64 nt, Homo Sapiens; identical to SEQ ID NO: 89924

SEQ ID NO: 575544 - RNA, 64 nt, Homo Sapiens; identical to SEQ ID NO: 89925

SEQ ID NO: 575545 - RNA, 64 nt, Homo Sapiens; identical to SEQ ID NO: 89926

SEQ ID NO: 575546 - RNA, 64 nt, Homo Sapiens; identical to SEQ ID NO: 89927

SEQ ID NO: 575547 - RNA, 64 nt, Homo Sapiens; identical to SEQ ID NO: 89928

SEQ ID NO: 575548 - RNA, 50 nt, Homo Sapiens; identical to SEQ ID NO: 89929

SEQ ID NO: 575549 - RNA, 64 nt, Homo Sapiens; identical to SEQ ID NO: 89930

SEQ ID NO: 575550 - RNA, 64 nt, Homo Sapiens; identical to SEQ ID NO: 89931

SEQ ID NO: 575551 - RNA, 64 nt, Homo Sapiens; identical to SEQ ID NO: 89932

SEQ ID NO: 575552 - RNA, 64 nt, Homo Sapiens; identical to SEQ ID NO: 89933

SEQ ID NO: 575553 - RNA, 64 nt, Homo Sapiens; identical to SEQ ID NO: 89934

SEQ ID NO: 575554 - RNA, 64 nt, Homo Sapiens; identical to SEQ ID NO: 89935

SEQ ID NO: 575555 - RNA, 64 nt, Homo Sapiens; identical to SEQ ID NO: 89936

SEQ ID NO: 575556 - RNA, 64 nt, Homo Sapiens; identical to SEQ ID NO: 89937

SEQ ID NO: 575557 - RNA, 64 nt, Homo Sapiens; identical to SEQ ID NO: 89938

SEQ ID NO: 575558 - RNA, 64 nt, Homo Sapiens; identical to SEQ ID NO: 89939

SEQ ID NO: 575559 - RNA, 64 nt, Homo Sapiens; identical to SEQ ID NO: 89940

SEQ ID NO: 575560 - RNA, 64 nt, Homo Sapiens; identical to SEQ ID NO: 89941

SEQ ID NO: 575561 - RNA, 55 nt, Homo Sapiens; identical to SEQ ID NO: 89942

SEQ ID NO: 575562 - RNA, 64 nt, Homo Sapiens; identical to SEQ ID NO: 89943

SEQ ID NO: 575563 - RNA, 64 nt, Homo Sapiens; identical to SEQ ID NO: 89944

SEQ ID NO: 575564 - RNA, 64 nt, Homo Sapiens; identical to SEQ ID NO: 89945

SEQ ID NO: 575565 - RNA, 64 nt, Homo Sapiens; identical to SEQ ID NO: 89946

SEQ ID NO: 575566 - RNA, 64 nt, Homo Sapiens; identical to SEQ ID NO: 89947

SEQ ID NO: 575567 - RNA, 64 nt, Homo Sapiens; identical to SEQ ID NO: 89948

SEQ ID NO: 575568 - RNA, 64 nt, Homo Sapiens; identical to SEQ ID NO: 89949

SEQ ID NO: 575569 - RNA, 64 nt, Homo Sapiens; identical to SEQ ID NO: 89950

SEQ ID NO: 575570 - RNA, 64 nt, Homo Sapiens; identical to SEQ ID NO: 89951

SEQ ID NO: 575571 - RNA, 64 nt, Homo Sapiens; identical to SEQ ID NO: 89952

SEQ ID NO: 575572 - RNA, 64 nt, Homo Sapiens; identical to SEQ ID NO: 89953

SEQ ID NO: 575573 - RNA, 64 nt, Homo Sapiens; identical to SEQ ID NO: 89954

SEQ ID NO: 575574 - RNA, 64 nt, Homo Sapiens; identical to SEQ ID NO: 89955

SEQ ID NO: 575575 - RNA, 64 nt, Homo Sapiens; identical to SEQ ID NO: 89956

SEQ ID NO: 575576 - RNA, 64 nt, Homo Sapiens; identical to SEQ ID NO: 89957

SEQ ID NO: 575577 - RNA, 64 nt, Homo Sapiens; identical to SEQ ID NO: 89958

SEQ ID NO: 575578 - RNA, 64 nt, Homo Sapiens; identical to SEQ ID NO: 89959

SEQ ID NO: 575579 - RNA, 64 nt, Homo Sapiens; identical to SEQ ID NO: 89960

SEQ ID NO: 575580 - RNA, 64 nt, Homo Sapiens; identical to SEQ ID NO: 89961

SEQ ID NO: 575581 - RNA, 64 nt, Homo Sapiens; identical to SEQ ID NO: 89962

SEQ ID NO: 575582 - RNA, 64 nt, Homo Sapiens; identical to SEQ ID NO: 89963

SEQ ID NO: 575583 - RNA, 64 nt, Homo Sapiens; identical to SEQ ID NO: 89964

SEQ ID NO: 575584 - RNA, 64 nt, Homo Sapiens; identical to SEQ ID NO: 89965

SEQ ID NO: 575585 - RNA, 64 nt, Homo Sapiens; identical to SEQ ID NO: 89966

SEQ ID NO: 575586 - RNA, 64 nt, Homo Sapiens; identical to SEQ ID NO: 89967

SEQ ID NO: 575587 - RNA, 64 nt, Homo Sapiens; identical to SEQ ID NO: 89968

SEQ ID NO: 575588 - RNA, 64 nt, Homo Sapiens; identical to SEQ ID NO: 89969

SEQ ID NO: 575589 - RNA, 64 nt, Homo Sapiens; identical to SEQ ID NO: 89970

SEQ ID NO: 575590 - RNA, 64 nt, Homo Sapiens; identical to SEQ ID NO: 89971

SEQ ID NO: 575591 - RNA, 64 nt, Homo Sapiens; identical to SEQ ID NO: 89972

SEQ ID NO: 575592 - RNA, 64 nt, Homo Sapiens; identical to SEQ ID NO: 89973

SEQ ID NO: 575593 - RNA, 64 nt, Homo Sapiens; identical to SEQ ID NO: 89974

SEQ ID NO: 575594 - RNA, 64 nt, Homo Sapiens; identical to SEQ ID NO: 89975

SEQ ID NO: 575595 - RNA, 64 nt, Homo Sapiens; identical to SEQ ID NO: 89976

SEQ ID NO: 575596 - RNA, 64 nt, Homo Sapiens; identical to SEQ ID NO: 89977

SEQ ID NO: 575597 - RNA, 64 nt, Homo Sapiens; identical to SEQ ID NO: 89978

SEQ ID NO: 575598 - RNA, 64 nt, Homo Sapiens; identical to SEQ ID NO: 89979

SEQ ID NO: 575599 - RNA, 64 nt, Homo Sapiens; identical to SEQ ID NO: 89980

SEQ ID NO: 575600 - RNA, 64 nt, Homo Sapiens; identical to SEQ ID NO: 89981

SEQ ID NO: 575601 - RNA, 64 nt, Homo Sapiens; identical to SEQ ID NO: 89982

SEQ ID NO: 575602 - RNA, 64 nt, Homo Sapiens; identical to SEQ ID NO: 89983

SEQ ID NO: 575603 - RNA, 64 nt, Homo Sapiens; identical to SEQ ID NO: 89984

SEQ ID NO: 575604 - RNA, 64 nt, Homo Sapiens; identical to SEQ ID NO: 89985

SEQ ID NO: 575605 - RNA, 64 nt, Homo Sapiens; identical to SEQ ID NO: 89986

SEQ ID NO: 575606 - RNA, 64 nt, Homo Sapiens; identical to SEQ ID NO: 89987

SEQ ID NO: 575607 - RNA, 64 nt, Homo Sapiens; identical to SEQ ID NO: 89988

SEQ ID NO: 575608 - RNA, 59 nt, Homo Sapiens; identical to SEQ ID NO: 89989

SEQ ID NO: 575609 - RNA, 64 nt, Homo Sapiens; identical to SEQ ID NO: 89990

SEQ ID NO: 575610 - RNA, 64 nt, Homo Sapiens; identical to SEQ ID NO: 89991

SEQ ID NO: 575611 - RNA, 64 nt, Homo Sapiens; identical to SEQ ID NO: 89992

SEQ ID NO: 575612 - RNA, 64 nt, Homo Sapiens; identical to SEQ ID NO: 89993

SEQ ID NO: 575613 - RNA, 64 nt, Homo Sapiens; identical to SEQ ID NO: 89994

SEQ ID NO: 575614 - RNA, 64 nt, Homo Sapiens; identical to SEQ ID NO: 89995

SEQ ID NO: 575615 - RNA, 64 nt, Homo Sapiens; identical to SEQ ID NO: 89996

SEQ ID NO: 575616 - RNA, 64 nt, Homo Sapiens; identical to SEQ ID NO: 89997

SEQ ID NO: 575617 - RNA, 64 nt, Homo Sapiens; identical to SEQ ID NO: 89998

SEQ ID NO: 575618 - RNA, 64 nt, Homo Sapiens; identical to SEQ ID NO: 89999

SEQ ID NO: 575619 - RNA, 64 nt, Homo Sapiens; identical to SEQ ID NO: 90000

SEQ ID NO: 575620 - RNA, 64 nt, Homo Sapiens; identical to SEQ ID NO: 90001

SEQ ID NO: 575621 - RNA, 64 nt, Homo Sapiens; identical to SEQ ID NO: 90002

SEQ ID NO: 575622 - RNA, 64 nt, Homo Sapiens; identical to SEQ ID NO: 90003

SEQ ID NO: 575623 - RNA, 64 nt, Homo Sapiens; identical to SEQ ID NO: 90004

SEQ ID NO: 575624 - RNA, 64 nt, Homo Sapiens; identical to SEQ ID NO: 90005

SEQ ID NO: 575625 - RNA, 64 nt, Homo Sapiens; identical to SEQ ID NO: 90006

SEQ ID NO: 575626 - RNA, 64 nt, Homo Sapiens; identical to SEQ ID NO: 90007

SEQ ID NO: 575627 - RNA, 64 nt, Homo Sapiens; identical to SEQ ID NO: 90008

SEQ ID NO: 575628 - RNA, 64 nt, Homo Sapiens; identical to SEQ ID NO: 90009

SEQ ID NO: 575629 - RNA, 64 nt, Homo Sapiens; identical to SEQ ID NO: 90010

SEQ ID NO: 575630 - RNA, 64 nt, Homo Sapiens; identical to SEQ ID NO: 90011

SEQ ID NO: 575631 - RNA, 64 nt, Homo Sapiens; identical to SEQ ID NO: 90012

SEQ ID NO: 575632 - RNA, 64 nt, Homo Sapiens; identical to SEQ ID NO: 90013

SEQ ID NO: 575633 - RNA, 64 nt, Homo Sapiens; identical to SEQ ID NO: 90014

SEQ ID NO: 575634 - RNA, 64 nt, Homo Sapiens; identical to SEQ ID NO: 90015

SEQ ID NO: 575635 - RNA, 64 nt, Homo Sapiens; identical to SEQ ID NO: 90016

SEQ ID NO: 575636 - RNA, 64 nt, Homo Sapiens; identical to SEQ ID NO: 90017

SEQ ID NO: 575637 - RNA, 64 nt, Homo Sapiens; identical to SEQ ID NO: 90018

SEQ ID NO: 575638 - RNA, 64 nt, Homo Sapiens; identical to SEQ ID NO: 90019

SEQ ID NO: 575639 - RNA, 64 nt, Homo Sapiens; identical to SEQ ID NO: 90020

SEQ ID NO: 575640 - RNA, 64 nt, Homo Sapiens; identical to SEQ ID NO: 90021

SEQ ID NO: 575641 - RNA, 64 nt, Homo Sapiens; identical to SEQ ID NO: 90022

SEQ ID NO: 575642 - RNA, 64 nt, Homo Sapiens; identical to SEQ ID NO: 90023

SEQ ID NO: 575643 - RNA, 64 nt, Homo Sapiens; identical to SEQ ID NO: 90024

SEQ ID NO: 575644 - RNA, 64 nt, Homo Sapiens; identical to SEQ ID NO: 90025

SEQ ID NO: 575645 - RNA, 64 nt, Homo Sapiens; identical to SEQ ID NO: 90026

SEQ ID NO: 575646 - RNA, 64 nt, Homo Sapiens; identical to SEQ ID NO: 90027

SEQ ID NO: 575647 - RNA, 64 nt, Homo Sapiens; identical to SEQ ID NO: 90028

SEQ ID NO: 575648 - RNA, 64 nt, Homo Sapiens; identical to SEQ ID NO: 90029

SEQ ID NO: 575649 - RNA, 64 nt, Homo Sapiens; identical to SEQ ID NO: 90030

SEQ ID NO: 575650 - RNA, 64 nt, Homo Sapiens; identical to SEQ ID NO: 90031

SEQ ID NO: 575651 - RNA, 64 nt, Homo Sapiens; identical to SEQ ID NO: 90032

SEQ ID NO: 575652 - RNA, 64 nt, Homo Sapiens; identical to SEQ ID NO: 90033

SEQ ID NO: 575653 - RNA, 64 nt, Homo Sapiens; identical to SEQ ID NO: 90034

SEQ ID NO: 575654 - RNA, 64 nt, Homo Sapiens; identical to SEQ ID NO: 90035

SEQ ID NO: 575655 - RNA, 64 nt, Homo Sapiens; identical to SEQ ID NO: 90036

SEQ ID NO: 575656 - RNA, 64 nt, Homo Sapiens; identical to SEQ ID NO: 90037

SEQ ID NO: 575657 - RNA, 64 nt, Homo Sapiens; identical to SEQ ID NO: 90038

SEQ ID NO: 575658 - RNA, 64 nt, Homo Sapiens; identical to SEQ ID NO: 90039

SEQ ID NO: 575659 - RNA, 64 nt, Homo Sapiens; identical to SEQ ID NO: 90040

SEQ ID NO: 575660 - RNA, 64 nt, Homo Sapiens; identical to SEQ ID NO: 90041

SEQ ID NO: 575661 - RNA, 64 nt, Homo Sapiens; identical to SEQ ID NO: 90042

SEQ ID NO: 575662 - RNA, 64 nt, Homo Sapiens; identical to SEQ ID NO: 90043

SEQ ID NO: 575663 - RNA, 64 nt, Homo Sapiens; identical to SEQ ID NO: 90044

SEQ ID NO: 575664 - RNA, 64 nt, Homo Sapiens; identical to SEQ ID NO: 90045

SEQ ID NO: 575665 - RNA, 64 nt, Homo Sapiens; identical to SEQ ID NO: 90046

SEQ ID NO: 575666 - RNA, 64 nt, Homo Sapiens; identical to SEQ ID NO: 90047

SEQ ID NO: 575667 - RNA, 64 nt, Homo Sapiens; identical to SEQ ID NO: 90048

SEQ ID NO: 575668 - RNA, 64 nt, Homo Sapiens; identical to SEQ ID NO: 90049

SEQ ID NO: 575669 - RNA, 64 nt, Homo Sapiens; identical to SEQ ID NO: 90050

SEQ ID NO: 575670 - RNA, 64 nt, Homo Sapiens; identical to SEQ ID NO: 90051

SEQ ID NO: 575671 - RNA, 64 nt, Homo Sapiens; identical to SEQ ID NO: 90052

SEQ ID NO: 575672 - RNA, 64 nt, Homo Sapiens; identical to SEQ ID NO: 90053

SEQ ID NO: 575673 - RNA, 64 nt, Homo Sapiens; identical to SEQ ID NO: 90054

SEQ ID NO: 575674 - RNA, 64 nt, Homo Sapiens; identical to SEQ ID NO: 90055

SEQ ID NO: 575675 - RNA, 64 nt, Homo Sapiens; identical to SEQ ID NO: 90056

SEQ ID NO: 575676 - RNA, 64 nt, Homo Sapiens; identical to SEQ ID NO: 90057

SEQ ID NO: 575677 - RNA, 64 nt, Homo Sapiens; identical to SEQ ID NO: 90058

SEQ ID NO: 575678 - RNA, 64 nt, Homo Sapiens; identical to SEQ ID NO: 90059

SEQ ID NO: 575679 - RNA, 64 nt, Homo Sapiens; identical to SEQ ID NO: 90060

SEQ ID NO: 575680 - RNA, 64 nt, Homo Sapiens; identical to SEQ ID NO: 90061

SEQ ID NO: 575681 - RNA, 64 nt, Homo Sapiens; identical to SEQ ID NO: 90062

SEQ ID NO: 575682 - RNA, 64 nt, Homo Sapiens; identical to SEQ ID NO: 90063

SEQ ID NO: 575683 - RNA, 64 nt, Homo Sapiens; identical to SEQ ID NO: 90064

SEQ ID NO: 575684 - RNA, 64 nt, Homo Sapiens; identical to SEQ ID NO: 90065

SEQ ID NO: 575685 - RNA, 64 nt, Homo Sapiens; identical to SEQ ID NO: 90066

SEQ ID NO: 575686 - RNA, 64 nt, Homo Sapiens; identical to SEQ ID NO: 90067

SEQ ID NO: 575687 - RNA, 64 nt, Homo Sapiens; identical to SEQ ID NO: 90068

SEQ ID NO: 575688 - RNA, 64 nt, Homo Sapiens; identical to SEQ ID NO: 90069

SEQ ID NO: 575689 - RNA, 64 nt, Homo Sapiens; identical to SEQ ID NO: 90070

SEQ ID NO: 575690 - RNA, 64 nt, Homo Sapiens; identical to SEQ ID NO: 90071

SEQ ID NO: 575691 - RNA, 64 nt, Homo Sapiens; identical to SEQ ID NO: 90072

SEQ ID NO: 575692 - RNA, 64 nt, Homo Sapiens; identical to SEQ ID NO: 90073

SEQ ID NO: 575693 - RNA, 64 nt, Homo Sapiens; identical to SEQ ID NO: 90074

SEQ ID NO: 575694 - RNA, 64 nt, Homo Sapiens; identical to SEQ ID NO: 90075

SEQ ID NO: 575695 - RNA, 64 nt, Homo Sapiens; identical to SEQ ID NO: 90076

SEQ ID NO: 575696 - RNA, 64 nt, Homo Sapiens; identical to SEQ ID NO: 90077

SEQ ID NO: 575697 - RNA, 64 nt, Homo Sapiens; identical to SEQ ID NO: 90078

SEQ ID NO: 575698 - RNA, 64 nt, Homo Sapiens; identical to SEQ ID NO: 90079

SEQ ID NO: 575699 - RNA, 64 nt, Homo Sapiens; identical to SEQ ID NO: 90080

SEQ ID NO: 575700 - RNA, 64 nt, Homo Sapiens; identical to SEQ ID NO: 90081

SEQ ID NO: 575701 - RNA, 64 nt, Homo Sapiens; identical to SEQ ID NO: 90082

SEQ ID NO: 575702 - RNA, 64 nt, Homo Sapiens; identical to SEQ ID NO: 90083

SEQ ID NO: 575703 - RNA, 64 nt, Homo Sapiens; identical to SEQ ID NO: 90084

SEQ ID NO: 575704 - RNA, 64 nt, Homo Sapiens; identical to SEQ ID NO: 125569

SEQ ID NO: 575705 - RNA, 64 nt, Homo Sapiens; identical to SEQ ID NO: 125570

SEQ ID NO: 575706 - RNA, 64 nt, Homo Sapiens; identical to SEQ ID NO: 125571

SEQ ID NO: 575707 - RNA, 64 nt, Homo Sapiens; identical to SEQ ID NO: 125572

SEQ ID NO: 575708 - RNA, 64 nt, Homo Sapiens; identical to SEQ ID NO: 125573

SEQ ID NO: 575709 - RNA, 64 nt, Homo Sapiens; identical to SEQ ID NO: 125574

SEQ ID NO: 575710 - RNA, 64 nt, Homo Sapiens; identical to SEQ ID NO: 125575

SEQ ID NO: 575711 - RNA, 64 nt, Homo Sapiens; identical to SEQ ID NO: 125576

SEQ ID NO: 575712 - RNA, 64 nt, Homo Sapiens; identical to SEQ ID NO: 125577

SEQ ID NO: 575713 - RNA, 64 nt, Homo Sapiens; identical to SEQ ID NO: 125578

SEQ ID NO: 575714 - RNA, 64 nt, Homo Sapiens; identical to SEQ ID NO: 125579

SEQ ID NO: 575715 - RNA, 64 nt, Homo Sapiens; identical to SEQ ID NO: 125580

SEQ ID NO: 575716 - RNA, 64 nt, Homo Sapiens; identical to SEQ ID NO: 125581

SEQ ID NO: 575717 - RNA, 64 nt, Homo Sapiens; identical to SEQ ID NO: 125582

SEQ ID NO: 575718 - RNA, 64 nt, Homo Sapiens; identical to SEQ ID NO: 125583

SEQ ID NO: 575719 - RNA, 64 nt, Homo Sapiens; identical to SEQ ID NO: 125584

SEQ ID NO: 575720 - RNA, 64 nt, Homo Sapiens; identical to SEQ ID NO: 125585

SEQ ID NO: 575721 - RNA, 64 nt, Homo Sapiens; identical to SEQ ID NO: 125586

SEQ ID NO: 575722 - RNA, 64 nt, Homo Sapiens; identical to SEQ ID NO: 125587

SEQ ID NO: 575723 - RNA, 64 nt, Homo Sapiens; identical to SEQ ID NO: 125588

SEQ ID NO: 575724 - RNA, 64 nt, Homo Sapiens; identical to SEQ ID NO: 125589

SEQ ID NO: 575725 - RNA, 64 nt, Homo Sapiens; identical to SEQ ID NO: 125590

SEQ ID NO: 575726 - RNA, 64 nt, Homo Sapiens; identical to SEQ ID NO: 125591

SEQ ID NO: 575727 - RNA, 64 nt, Homo Sapiens; identical to SEQ ID NO: 125592

SEQ ID NO: 575728 - RNA, 64 nt, Homo Sapiens; identical to SEQ ID NO: 125593

SEQ ID NO: 575729 - RNA, 64 nt, Homo Sapiens; identical to SEQ ID NO: 125594

SEQ ID NO: 575730 - RNA, 64 nt, Homo Sapiens; identical to SEQ ID NO: 125595

SEQ ID NO: 575731 - RNA, 64 nt, Homo Sapiens; identical to SEQ ID NO: 125596

SEQ ID NO: 575732 - RNA, 64 nt, Homo Sapiens; identical to SEQ ID NO: 125597

SEQ ID NO: 575733 - RNA, 64 nt, Homo Sapiens; identical to SEQ ID NO: 125598

SEQ ID NO: 575734 - RNA, 64 nt, Homo Sapiens; identical to SEQ ID NO: 125599

SEQ ID NO: 575735 - RNA, 64 nt, Homo Sapiens; identical to SEQ ID NO: 125600

SEQ ID NO: 575736 - RNA, 64 nt, Homo Sapiens; identical to SEQ ID NO: 125601

SEQ ID NO: 575737 - RNA, 64 nt, Homo Sapiens; identical to SEQ ID NO: 125602

SEQ ID NO: 575738 - RNA, 64 nt, Homo Sapiens; identical to SEQ ID NO: 125603

SEQ ID NO: 575739 - RNA, 64 nt, Homo Sapiens; identical to SEQ ID NO: 125604

SEQ ID NO: 575740 - RNA, 64 nt, Homo Sapiens; identical to SEQ ID NO: 125605

SEQ ID NO: 575741 - RNA, 64 nt, Homo Sapiens; identical to SEQ ID NO: 125606

SEQ ID NO: 575742 - RNA, 64 nt, Homo Sapiens; identical to SEQ ID NO: 125607

SEQ ID NO: 575743 - RNA, 64 nt, Homo Sapiens; identical to SEQ ID NO: 125608

SEQ ID NO: 575744 - RNA, 64 nt, Homo Sapiens; identical to SEQ ID NO: 125609

SEQ ID NO: 575745 - RNA, 64 nt, Homo Sapiens; identical to SEQ ID NO: 125610

SEQ ID NO: 575746 - RNA, 64 nt, Homo Sapiens; identical to SEQ ID NO: 125611

SEQ ID NO: 575747 - RNA, 64 nt, Homo Sapiens; identical to SEQ ID NO: 125612

SEQ ID NO: 575748 - RNA, 64 nt, Homo Sapiens; identical to SEQ ID NO: 125613

SEQ ID NO: 575749 - RNA, 64 nt, Homo Sapiens; identical to SEQ ID NO: 125614

SEQ ID NO: 575750 - RNA, 64 nt, Homo Sapiens; identical to SEQ ID NO: 125615

SEQ ID NO: 575751 - RNA, 64 nt, Homo Sapiens; identical to SEQ ID NO: 125616

SEQ ID NO: 575752 - RNA, 64 nt, Homo Sapiens; identical to SEQ ID NO: 125617

SEQ ID NO: 575753 - RNA, 64 nt, Homo Sapiens; identical to SEQ ID NO: 125618

SEQ ID NO: 575754 - RNA, 64 nt, Homo Sapiens; identical to SEQ ID NO: 125619

SEQ ID NO: 575755 - RNA, 64 nt, Homo Sapiens; identical to SEQ ID NO: 125620

SEQ ID NO: 575756 - RNA, 64 nt, Homo Sapiens; identical to SEQ ID NO: 125621

SEQ ID NO: 575757 - RNA, 64 nt, Homo Sapiens; identical to SEQ ID NO: 125622

SEQ ID NO: 575758 - RNA, 64 nt, Homo Sapiens; identical to SEQ ID NO: 125623

SEQ ID NO: 575759 - RNA, 64 nt, Homo Sapiens; identical to SEQ ID NO: 125624

SEQ ID NO: 575760 - RNA, 64 nt, Homo Sapiens; identical to SEQ ID NO: 125625

SEQ ID NO: 575761 - RNA, 64 nt, Homo Sapiens; identical to SEQ ID NO: 125626

SEQ ID NO: 575762 - RNA, 64 nt, Homo Sapiens; identical to SEQ ID NO: 125627

SEQ ID NO: 575763 - RNA, 64 nt, Homo Sapiens; identical to SEQ ID NO: 125628

SEQ ID NO: 575764 - RNA, 64 nt, Homo Sapiens; identical to SEQ ID NO: 125629

SEQ ID NO: 575765 - RNA, 64 nt, Homo Sapiens; identical to SEQ ID NO: 125630

SEQ ID NO: 575766 - RNA, 64 nt, Homo Sapiens; identical to SEQ ID NO: 125631

SEQ ID NO: 575767 - RNA, 64 nt, Homo Sapiens; identical to SEQ ID NO: 125632

SEQ ID NO: 575768 - RNA, 64 nt, Homo Sapiens; identical to SEQ ID NO: 125633

SEQ ID NO: 575769 - RNA, 64 nt, Homo Sapiens; identical to SEQ ID NO: 125634

SEQ ID NO: 575770 - RNA, 64 nt, Homo Sapiens; identical to SEQ ID NO: 125635

SEQ ID NO: 575771 - RNA, 64 nt, Homo Sapiens; identical to SEQ ID NO: 125636

SEQ ID NO: 575772 - RNA, 64 nt, Homo Sapiens; identical to SEQ ID NO: 125637

SEQ ID NO: 575773 - RNA, 64 nt, Homo Sapiens; identical to SEQ ID NO: 125638

SEQ ID NO: 575774 - RNA, 64 nt, Homo Sapiens; identical to SEQ ID NO: 125639

SEQ ID NO: 575775 - RNA, 64 nt, Homo Sapiens; identical to SEQ ID NO: 125640

SEQ ID NO: 575776 - RNA, 64 nt, Homo Sapiens; identical to SEQ ID NO: 125641

SEQ ID NO: 575777 - RNA, 64 nt, Homo Sapiens; identical to SEQ ID NO: 125642

SEQ ID NO: 575778 - RNA, 64 nt, Homo Sapiens; identical to SEQ ID NO: 462554

SEQ ID NO: 575779 - RNA, 64 nt, Homo Sapiens; identical to SEQ ID NO: 462555

SEQ ID NO: 575780 - RNA, 64 nt, Homo Sapiens; identical to SEQ ID NO: 462556

SEQ ID NO: 575781 - RNA, 64 nt, Homo Sapiens; identical to SEQ ID NO: 462557

SEQ ID NO: 575782 - RNA, 55 nt, Homo Sapiens; identical to SEQ ID NO: 462558

SEQ ID NO: 575783 - RNA, 64 nt, Homo Sapiens; identical to SEQ ID NO: 462559

SEQ ID NO: 575784 - RNA, 64 nt, Homo Sapiens; identical to SEQ ID NO: 462560

SEQ ID NO: 575785 - RNA, 64 nt, Homo Sapiens; identical to SEQ ID NO: 462561

SEQ ID NO: 575786 - RNA, 64 nt, Homo Sapiens; identical to SEQ ID NO: 462562

SEQ ID NO: 575787 - RNA, 64 nt, Homo Sapiens; identical to SEQ ID NO: 462563

SEQ ID NO: 575788 - RNA, 64 nt, Homo Sapiens; identical to SEQ ID NO: 462564

SEQ ID NO: 575789 - RNA, 64 nt, Homo Sapiens; identical to SEQ ID NO: 462565

SEQ ID NO: 575790 - RNA, 64 nt, Homo Sapiens; identical to SEQ ID NO: 462566

SEQ ID NO: 575791 - RNA, 64 nt, Homo Sapiens; identical to SEQ ID NO: 462567

SEQ ID NO: 575792 - RNA, 64 nt, Homo Sapiens; identical to SEQ ID NO: 462568

SEQ ID NO: 575793 - RNA, 64 nt, Homo Sapiens; identical to SEQ ID NO: 462569

SEQ ID NO: 575794 - RNA, 64 nt, Homo Sapiens; identical to SEQ ID NO: 462570

SEQ ID NO: 575795 - RNA, 64 nt, Homo Sapiens; identical to SEQ ID NO: 462571

SEQ ID NO: 575796 - RNA, 64 nt, Homo Sapiens; identical to SEQ ID NO: 462572

SEQ ID NO: 575797 - RNA, 64 nt, Homo Sapiens; identical to SEQ ID NO: 462573

SEQ ID NO: 575798 - RNA, 64 nt, Homo Sapiens; identical to SEQ ID NO: 462574

SEQ ID NO: 575799 - RNA, 64 nt, Homo Sapiens; identical to SEQ ID NO: 462575

SEQ ID NO: 575800 - RNA, 64 nt, Homo Sapiens; identical to SEQ ID NO: 462576

SEQ ID NO: 575801 - RNA, 64 nt, Homo Sapiens; identical to SEQ ID NO: 462577

SEQ ID NO: 575802 - RNA, 64 nt, Homo Sapiens; identical to SEQ ID NO: 462578

SEQ ID NO: 575803 - RNA, 64 nt, Homo Sapiens; identical to SEQ ID NO: 462579

SEQ ID NO: 575804 - RNA, 64 nt, Homo Sapiens; identical to SEQ ID NO: 462580

SEQ ID NO: 575805 - RNA, 64 nt, Homo Sapiens; identical to SEQ ID NO: 462581

SEQ ID NO: 575806 - RNA, 64 nt, Homo Sapiens; identical to SEQ ID NO: 462582

SEQ ID NO: 575807 - RNA, 64 nt, Homo Sapiens; identical to SEQ ID NO: 462583

SEQ ID NO: 575808 - RNA, 64 nt, Homo Sapiens; identical to SEQ ID NO: 462584

SEQ ID NO: 575809 - RNA, 64 nt, Homo Sapiens; identical to SEQ ID NO: 462585

SEQ ID NO: 575810 - RNA, 64 nt, Homo Sapiens; identical to SEQ ID NO: 462586

SEQ ID NO: 575811 - RNA, 64 nt, Homo Sapiens; identical to SEQ ID NO: 462587

SEQ ID NO: 575812 - RNA, 64 nt, Homo Sapiens; identical to SEQ ID NO: 462588

SEQ ID NO: 575813 - RNA, 64 nt, Homo Sapiens; identical to SEQ ID NO: 462589

SEQ ID NO: 575814 - RNA, 64 nt, Homo Sapiens; identical to SEQ ID NO: 462590

SEQ ID NO: 575815 - RNA, 64 nt, Homo Sapiens; identical to SEQ ID NO: 462591

SEQ ID NO: 575816 - RNA, 64 nt, Homo Sapiens; identical to SEQ ID NO: 462592

SEQ ID NO: 575817 - RNA, 64 nt, Homo Sapiens; identical to SEQ ID NO: 462593

SEQ ID NO: 575818 - RNA, 64 nt, Homo Sapiens; identical to SEQ ID NO: 462594

SEQ ID NO: 575819 - RNA, 64 nt, Homo Sapiens; identical to SEQ ID NO: 462595

SEQ ID NO: 575820 - RNA, 64 nt, Homo Sapiens; identical to SEQ ID NO: 462596

SEQ ID NO: 575821 - RNA, 64 nt, Homo Sapiens; identical to SEQ ID NO: 462597

SEQ ID NO: 575822 - RNA, 64 nt, Homo Sapiens; identical to SEQ ID NO: 462598

SEQ ID NO: 575823 - RNA, 64 nt, Homo Sapiens; identical to SEQ ID NO: 462599

SEQ ID NO: 575824 - RNA, 64 nt, Homo Sapiens; identical to SEQ ID NO: 462600

SEQ ID NO: 575825 - RNA, 64 nt, Homo Sapiens; identical to SEQ ID NO: 462601

SEQ ID NO: 575826 - RNA, 64 nt, Homo Sapiens; identical to SEQ ID NO: 462602

SEQ ID NO: 575827 - RNA, 64 nt, Homo Sapiens; identical to SEQ ID NO: 462603

SEQ ID NO: 575828 - RNA, 64 nt, Homo Sapiens; identical to SEQ ID NO: 462604

SEQ ID NO: 575829 - RNA, 51 nt, Homo Sapiens; identical to SEQ ID NO: 462605

SEQ ID NO: 575830 - RNA, 64 nt, Homo Sapiens; identical to SEQ ID NO: 462606

SEQ ID NO: 575831 - RNA, 64 nt, Homo Sapiens; identical to SEQ ID NO: 462607

SEQ ID NO: 575832 - RNA, 64 nt, Homo Sapiens; identical to SEQ ID NO: 462608

SEQ ID NO: 575833 - RNA, 64 nt, Homo Sapiens; identical to SEQ ID NO: 462609

SEQ ID NO: 575834 - RNA, 64 nt, Homo Sapiens
cuucuaccccuauguccaaauuuucagccaccacagaccucagcuguguauccuaucuguucua

SEQ ID NO: 575835 - RNA, 64 nt, Homo Sapiens
ucuguccaucuuguuccuguggcuuagcacauacagaccucagaucuuacuugguagugagugc

SEQ ID NO: 575836 - RNA, 64 nt, Homo Sapiens
ugaggacuuaaugucuucuugucccugggaacccagaccucagacugggcggccagaugaaugg

SEQ ID NO: 575837 - RNA, 64 nt, Homo Sapiens
caggauuggagaucaaaccaagcacgggguccugagaccucaggaggggcccaggggcagccga

SEQ ID NO: 575838 - RNA, 64 nt, Homo Sapiens
aucuucccuuuaacccaagauucccuuugcccugagaccucagacagucuucauccaaacaccu

SEQ ID NO: 575839 - RNA, 64 nt, Homo Sapiens
guuuugggucuaggugagagccaucaccaguaggagaccucagucccaggccugggaucugaca

SEQ ID NO: 575840 - RNA, 64 nt, Homo Sapiens
ccuuauaccuccuugauugaauaccagacagccuagaccucaguacaaaagguauugaaacauu

SEQ ID NO: 575841 - RNA, 64 nt, Homo Sapiens
uacaaaagguauugaaacauuuuugauacauaacagaccucagucuuuuuuaaaaauuaauaua

SEQ ID NO: 575842 - RNA, 64 nt, Homo Sapiens
uuuguagguaaagauuuauugaaaauggugauauagaccucagagcuguuaucuuaguuuaaag

SEQ ID NO: 575843 - RNA, 64 nt, Homo Sapiens
caauaucacuuugaaaguuacaaaaccuugucaaagaccucauguuuuuugaguugugcuuuca

SEQ ID NO: 575844 - RNA, 64 nt, Homo Sapiens
uucaggacuggccuagugaaguaauugcaagaggagaccucacaacuuuccacuucuacuuaca

SEQ ID NO: 575845 - RNA, 64 nt, Homo Sapiens
auggaaaaccugggggauggucagagcccagucgagaccucacacacggcugucccucauggag

SEQ ID NO: 575846 - RNA, 64 nt, Homo Sapiens
cagucgagaccucacacacggcugucccucauggagaccucaugccauggucuuugcuaggccu

SEQ ID NO: 575847 - RNA, 64 nt, Homo Sapiens
gcuacccaaggaaauaggagucccuggacaaagaagaccucaggggcccaaaggaaagacggcu

SEQ ID NO: 575848 - RNA, 64 nt, Homo Sapiens
gaggguugaguuucucuaagcugccaccuccagcagaccucaggcaaggauuccuggccagcuc

SEQ ID NO: 575849 - RNA, 64 nt, Homo Sapiens
gcaggggcaaguggcucuccccauuaccuucucaagaccucagugggagcaccagccaauggua

SEQ ID NO: 575850 - RNA, 64 nt, Homo Sapiens
auuaaaaaggaagaaaccacagaaagaaaacuacagaccucaagauuccacucugugcccgccu

SEQ ID NO: 575851 - RNA, 64 nt, Homo Sapiens
auguuugaguuauuuugucucauaagcaaguaucagaccucagacaguuguggaugucagugug

SEQ ID NO: 575852 - RNA, 64 nt, Homo Sapiens
gaacacacuggaauggcugaagaucuggguuucuagaccucacuccaccacagcgucagggugg

SEQ ID NO: 575853 - RNA, 64 nt, Homo Sapiens
cggaugaacauauuccaguauuuucuucuuucucagaccucaguagcaaguuguucaauuuuaa

SEQ ID NO: 575854 - RNA, 64 nt, Homo Sapiens
uggaugaacccauuccacugcaacugguguuuucagaccucaguggaugugauggagaaguuau

SEQ ID NO: 575855 - RNA, 64 nt, Homo Sapiens
cuuacaaaaaauaauaauggugggaaacauagcaagaucucaucccaggaguucuagacaagcc

SEQ ID NO: 575856 - RNA, 64 nt, Homo Sapiens
auauuuguugagaacuuguucaaauuuuaacaucagaucucaacugagcuaccuggccccuccc

SEQ ID NO: 575857 - RNA, 54 nt, Homo Sapiens
uugauguggaaaaucucugaagucagaucucaauuuuuagaaaacucucugaau

SEQ ID NO: 575858 - RNA, 64 nt, Homo Sapiens
auauuucuaauggaaaaucagguguuuacaggaaagaucucagaggcuaugagcucugaauaaa

SEQ ID NO: 575859 - RNA, 64 nt, Homo Sapiens
ggggaauaaguucauccucacagaucagaaucagagaucucagacaggucaacaccagagaucu

SEQ ID NO: 575860 - RNA, 64 nt, Homo Sapiens
ucagaaucagagaucucagacaggucaacaccagagaucucagaccauccugucuggaauacac

SEQ ID NO: 575861 - RNA, 64 nt, Homo Sapiens
acuguacuccagccugggcgguugcagugagccgagaucucacccuugaaccggggaggcagag

SEQ ID NO: 575862 - RNA, 64 nt, Homo Sapiens
agucucugccuucagggucacuagauuguggcccagaucucaggggcacuguggguggcucacc

SEQ ID NO: 575863 - RNA, 64 nt, Homo Sapiens
uaggugcacaauaaaucuaguaauagccccacacagaucucaucauuguugcuacuuccuuuug

SEQ ID NO: 575864 - RNA, 64 nt, Homo Sapiens
cauucuacuucacaguaauagcucuaucagccacagaucucaugguggcuguugcaugauaaug

SEQ ID NO: 575865 - RNA, 64 nt, Homo Sapiens; identical to SEQ ID NO: 313152

SEQ ID NO: 575866 - RNA, 64 nt, Homo Sapiens; identical to SEQ ID NO: 313153

SEQ ID NO: 575867 - RNA, 64 nt, Homo Sapiens; identical to SEQ ID NO: 313154

SEQ ID NO: 575868 - RNA, 64 nt, Homo Sapiens; identical to SEQ ID NO: 313155

SEQ ID NO: 575869 - RNA, 64 nt, Homo Sapiens
acucguaucugaguguaacuuugccaauauuuuaaaagccaaaauauucucuggacaacaaauu

SEQ ID NO: 575870 - RNA, 64 nt, Homo Sapiens
ucauuugcucaaagucacagagaaaauuaguggcaaagccaaaaagauucagaucuucugacuc

SEQ ID NO: 575871 - RNA, 64 nt, Homo Sapiens
acuugcauucacaacuuuaaaaaaguuguauuacaaagccaaacugguuaucuucuggauacua

SEQ ID NO: 575872 - RNA, 64 nt, Homo Sapiens
aguuggucuuauccaguuagucacauuacuuuugaaagccaagagugcuucuaggauauaaaau

SEQ ID NO: 575873 - RNA, 64 nt, Homo Sapiens
uguaugcucucaaguuccaaaaugaauaaagacaaaagccaaggaaugaaugaauaaauaaaua

SEQ ID NO: 575874 - RNA, 64 nt, Homo Sapiens
gguuauagggguacacuuaggucuuucucugaaaaaagccaaagaaagggacaauuuggcugaa

SEQ ID NO: 575875 - RNA, 64 nt, Homo Sapiens
gauggcgcugggagaagauguucagaauaucucaaaagccaaguccagaagguaaacuccaggg

SEQ ID NO: 575876 - RNA, 64 nt, Homo Sapiens
accagggugacugcaccucgaauaaaggccagauaaagccaaacuugcuggguuacauuccuug

SEQ ID NO: 575877 - RNA, 64 nt, Homo Sapiens
ggaaacgaaucggagccauuugccaaacaauaauaaagccaacucuucuccccuaaacaacuuc

SEQ ID NO: 575878 - RNA, 64 nt, Homo Sapiens
auuuugaugcaaaagaaauuacuuuuuuuuucuuaaagccaauuagcagacugcauguguugau

SEQ ID NO: 575879 - RNA, 64 nt, Homo Sapiens
ugaaaaaaaguuagauugugcauuuauaaaagaaaaagccaaagugacuuuuaccacaaaucuu

SEQ ID NO: 575880 - RNA, 64 nt, Homo Sapiens
ggaauuuugcagugacaggacaacgucaaugccaaaagccaaggaccaaaagacuaaaaucuuu

SEQ ID NO: 575881 - RNA, 64 nt, Homo Sapiens
gcgggagugguauguggcccugaauaaaagaggaaaagccaaacgagggugcagcccccggguu

SEQ ID NO: 575882 - RNA, 64 nt, Homo Sapiens
auuauauguauacaucaguauaguguuuuauuauaaagccaauuaucugauuaagcauucuuuc

SEQ ID NO: 575883 - RNA, 64 nt, Homo Sapiens
uuuuuuuuaaggcugagauuucuaaaauauaaguaaagccaaccgauuuuucuguuucacacac

SEQ ID NO: 575884 - RNA, 64 nt, Homo Sapiens
uguacgguagaaauuucuacuugaagcauuugaaaaagccaaagaaauuaaagcaacaauaauu

SEQ ID NO: 575885 - RNA, 64 nt, Homo Sapiens
ggcugcagccaggccacugggugggagauguggaaaagccaagaagaguggacuguucccugag

SEQ ID NO: 575886 - RNA, 64 nt, Homo Sapiens
ugaacagcggcuggacuuggugaggcugcuuuccaaagccaaugggauuacuaggugcccagaa

SEQ ID NO: 575887 - RNA, 64 nt, Homo Sapiens
agggaggcacucaagaugaaaacuacuucaacuaaaagccaaccacuugaacaaggugagugaa

SEQ ID NO: 575888 - RNA, 64 nt, Homo Sapiens
cacuauucucauugccaacguuaaaccuuauuuaaaagccaaacgugcccugagcccucuccuc

SEQ ID NO: 575889 - RNA, 64 nt, Homo Sapiens
ccaucugccaggacgagguagacugcugugggccaaagccaagcaccuuaacuuuuaaaaaagg

SEQ ID NO: 575890 - RNA, 64 nt, Homo Sapiens
uuaccauugcuuccuccagcaagacaaaaccgaaaaagccaaaacaaaagcuuuucauuaucug

SEQ ID NO: 575891 - RNA, 64 nt, Homo Sapiens
augaugauuccaugacucccaccuaugcagccuuaaagccaaauccgcguguguguguuugugu

SEQ ID NO: 575892 - RNA, 64 nt, Homo Sapiens
cuucgaggcuggggcucuguaaugaauuaguuuaaaagccaaggucauaacaugaauugauggu

SEQ ID NO: 575893 - RNA, 64 nt, Homo Sapiens
auugacccaguuacuugaggggcggguauuuuuaaaagccaaagaggcauugagaaaggggaaa

SEQ ID NO: 575894 - RNA, 64 nt, Homo Sapiens
acuuucuagaagcgaaauaaagacaucuggccucaaagccaagaaauaacuucagaggagguga

SEQ ID NO: 575895 - RNA, 64 nt, Homo Sapiens
aaggauaaaauaagcauuaguguagacaauuacaaaagccaaaacuuuuucauguugacagauu

SEQ ID NO: 575896 - RNA, 64 nt, Homo Sapiens
cagacucaccagaaauugcuaaauaugaaauccgaaagccaaacugucuuuuugggguuggacu

SEQ ID NO: 575897 - RNA, 64 nt, Homo Sapiens; identical to SEQ ID NO: 561089

SEQ ID NO: 575898 - RNA, 64 nt, Homo Sapiens; identical to SEQ ID NO: 561090

SEQ ID NO: 575899 - RNA, 64 nt, Homo Sapiens; identical to SEQ ID NO: 561091

SEQ ID NO: 575900 - RNA, 64 nt, Homo Sapiens; identical to SEQ ID NO: 561092

SEQ ID NO: 575901 - RNA, 64 nt, Homo Sapiens; identical to SEQ ID NO: 561093

SEQ ID NO: 575902 - RNA, 64 nt, Homo Sapiens; identical to SEQ ID NO: 561094

SEQ ID NO: 575903 - RNA, 64 nt, Homo Sapiens; identical to SEQ ID NO: 561095

SEQ ID NO: 575904 - RNA, 64 nt, Homo Sapiens; identical to SEQ ID NO: 561096

SEQ ID NO: 575905 - RNA, 64 nt, Homo Sapiens; identical to SEQ ID NO: 561097

SEQ ID NO: 575906 - RNA, 64 nt, Homo Sapiens; identical to SEQ ID NO: 561098

SEQ ID NO: 575907 - RNA, 64 nt, Homo Sapiens; identical to SEQ ID NO: 561099

SEQ ID NO: 575908 - RNA, 64 nt, Homo Sapiens; identical to SEQ ID NO: 561100

SEQ ID NO: 575909 - RNA, 64 nt, Homo Sapiens; identical to SEQ ID NO: 561101

SEQ ID NO: 575910 - RNA, 64 nt, Homo Sapiens; identical to SEQ ID NO: 561102

SEQ ID NO: 575911 - RNA, 64 nt, Homo Sapiens; identical to SEQ ID NO: 561103

SEQ ID NO: 575912 - RNA, 64 nt, Homo Sapiens; identical to SEQ ID NO: 561104

SEQ ID NO: 575913 - RNA, 64 nt, Homo Sapiens; identical to SEQ ID NO: 561105

SEQ ID NO: 575914 - RNA, 64 nt, Homo Sapiens; identical to SEQ ID NO: 561106

SEQ ID NO: 575915 - RNA, 64 nt, Homo Sapiens; identical to SEQ ID NO: 561107

SEQ ID NO: 575916 - RNA, 64 nt, Homo Sapiens; identical to SEQ ID NO: 561108

SEQ ID NO: 575917 - RNA, 64 nt, Homo Sapiens; identical to SEQ ID NO: 561109

SEQ ID NO: 575918 - RNA, 64 nt, Homo Sapiens; identical to SEQ ID NO: 561110

SEQ ID NO: 575919 - RNA, 64 nt, Homo Sapiens; identical to SEQ ID NO: 561111

SEQ ID NO: 575920 - RNA, 64 nt, Homo Sapiens; identical to SEQ ID NO: 561112

SEQ ID NO: 575921 - RNA, 64 nt, Homo Sapiens; identical to SEQ ID NO: 561113

SEQ ID NO: 575922 - RNA, 64 nt, Homo Sapiens; identical to SEQ ID NO: 561114

SEQ ID NO: 575923 - RNA, 64 nt, Homo Sapiens; identical to SEQ ID NO: 561115

SEQ ID NO: 575924 - RNA, 64 nt, Homo Sapiens; identical to SEQ ID NO: 561116

SEQ ID NO: 575925 - RNA, 64 nt, Homo Sapiens; identical to SEQ ID NO: 561117

SEQ ID NO: 575926 - RNA, 64 nt, Homo Sapiens; identical to SEQ ID NO: 561118

SEQ ID NO: 575927 - RNA, 64 nt, Homo Sapiens; identical to SEQ ID NO: 561119

SEQ ID NO: 575928 - RNA, 64 nt, Homo Sapiens; identical to SEQ ID NO: 561120

SEQ ID NO: 575929 - RNA, 64 nt, Homo Sapiens; identical to SEQ ID NO: 561121

SEQ ID NO: 575930 - RNA, 64 nt, Homo Sapiens; identical to SEQ ID NO: 561122

SEQ ID NO: 575931 - RNA, 64 nt, Homo Sapiens; identical to SEQ ID NO: 561123

SEQ ID NO: 575932 - RNA, 64 nt, Homo Sapiens; identical to SEQ ID NO: 561124

SEQ ID NO: 575933 - RNA, 64 nt, Homo Sapiens; identical to SEQ ID NO: 561125

SEQ ID NO: 575934 - RNA, 64 nt, Homo Sapiens; identical to SEQ ID NO: 561126

SEQ ID NO: 575935 - RNA, 64 nt, Homo Sapiens; identical to SEQ ID NO: 561127

SEQ ID NO: 575936 - RNA, 64 nt, Homo Sapiens; identical to SEQ ID NO: 561128

SEQ ID NO: 575937 - RNA, 64 nt, Homo Sapiens; identical to SEQ ID NO: 561129

SEQ ID NO: 575938 - RNA, 64 nt, Homo Sapiens; identical to SEQ ID NO: 561130

SEQ ID NO: 575939 - RNA, 64 nt, Homo Sapiens; identical to SEQ ID NO: 561131

SEQ ID NO: 575940 - RNA, 64 nt, Homo Sapiens; identical to SEQ ID NO: 561132

SEQ ID NO: 575941 - RNA, 64 nt, Homo Sapiens; identical to SEQ ID NO: 561133

SEQ ID NO: 575942 - RNA, 64 nt, Homo Sapiens; identical to SEQ ID NO: 561134

SEQ ID NO: 575943 - RNA, 64 nt, Homo Sapiens; identical to SEQ ID NO: 561135

SEQ ID NO: 575944 - RNA, 64 nt, Homo Sapiens; identical to SEQ ID NO: 561136

SEQ ID NO: 575945 - RNA, 64 nt, Homo Sapiens; identical to SEQ ID NO: 561137

SEQ ID NO: 575946 - RNA, 64 nt, Homo Sapiens; identical to SEQ ID NO: 561138

SEQ ID NO: 575947 - RNA, 64 nt, Homo Sapiens; identical to SEQ ID NO: 561139

SEQ ID NO: 575948 - RNA, 64 nt, Homo Sapiens; identical to SEQ ID NO: 561140

SEQ ID NO: 575949 - RNA, 64 nt, Homo Sapiens; identical to SEQ ID NO: 561141

SEQ ID NO: 575950 - RNA, 64 nt, Homo Sapiens; identical to SEQ ID NO: 561142

SEQ ID NO: 575951 - RNA, 64 nt, Homo Sapiens; identical to SEQ ID NO: 561143

SEQ ID NO: 575952 - RNA, 64 nt, Homo Sapiens; identical to SEQ ID NO: 561144

SEQ ID NO: 575953 - RNA, 64 nt, Homo Sapiens; identical to SEQ ID NO: 561145

SEQ ID NO: 575954 - RNA, 64 nt, Homo Sapiens; identical to SEQ ID NO: 561146

SEQ ID NO: 575955 - RNA, 64 nt, Homo Sapiens; identical to SEQ ID NO: 561147

SEQ ID NO: 575956 - RNA, 64 nt, Homo Sapiens; identical to SEQ ID NO: 561148

SEQ ID NO: 575957 - RNA, 64 nt, Homo Sapiens; identical to SEQ ID NO: 561149

SEQ ID NO: 575958 - RNA, 64 nt, Homo Sapiens; identical to SEQ ID NO: 561150

SEQ ID NO: 575959 - RNA, 64 nt, Homo Sapiens; identical to SEQ ID NO: 561151

SEQ ID NO: 575960 - RNA, 64 nt, Homo Sapiens; identical to SEQ ID NO: 561152

SEQ ID NO: 575961 - RNA, 64 nt, Homo Sapiens; identical to SEQ ID NO: 561153

SEQ ID NO: 575962 - RNA, 64 nt, Homo Sapiens; identical to SEQ ID NO: 561154

SEQ ID NO: 575963 - RNA, 64 nt, Homo Sapiens; identical to SEQ ID NO: 561155

SEQ ID NO: 575964 - RNA, 64 nt, Homo Sapiens; identical to SEQ ID NO: 561156

SEQ ID NO: 575965 - RNA, 64 nt, Homo Sapiens; identical to SEQ ID NO: 561157

SEQ ID NO: 575966 - RNA, 64 nt, Homo Sapiens; identical to SEQ ID NO: 561158

SEQ ID NO: 575967 - RNA, 64 nt, Homo Sapiens; identical to SEQ ID NO: 561159

SEQ ID NO: 575968 - RNA, 64 nt, Homo Sapiens; identical to SEQ ID NO: 561160

SEQ ID NO: 575969 - RNA, 64 nt, Homo Sapiens; identical to SEQ ID NO: 561161

SEQ ID NO: 575970 - RNA, 64 nt, Homo Sapiens; identical to SEQ ID NO: 561162

SEQ ID NO: 575971 - RNA, 64 nt, Homo Sapiens; identical to SEQ ID NO: 561163

SEQ ID NO: 575972 - RNA, 64 nt, Homo Sapiens; identical to SEQ ID NO: 561164

SEQ ID NO: 575973 - RNA, 64 nt, Homo Sapiens; identical to SEQ ID NO: 561165

SEQ ID NO: 575974 - RNA, 64 nt, Homo Sapiens; identical to SEQ ID NO: 561166

SEQ ID NO: 575975 - RNA, 64 nt, Homo Sapiens; identical to SEQ ID NO: 561167

SEQ ID NO: 575976 - RNA, 64 nt, Homo Sapiens; identical to SEQ ID NO: 561168

SEQ ID NO: 575977 - RNA, 64 nt, Homo Sapiens; identical to SEQ ID NO: 561169

SEQ ID NO: 575978 - RNA, 64 nt, Homo Sapiens; identical to SEQ ID NO: 561170

SEQ ID NO: 575979 - RNA, 64 nt, Homo Sapiens; identical to SEQ ID NO: 561171

SEQ ID NO: 575980 - RNA, 64 nt, Homo Sapiens; identical to SEQ ID NO: 561172

SEQ ID NO: 575981 - RNA, 64 nt, Homo Sapiens; identical to SEQ ID NO: 561173

SEQ ID NO: 575982 - RNA, 64 nt, Homo Sapiens; identical to SEQ ID NO: 561174

SEQ ID NO: 575983 - RNA, 64 nt, Homo Sapiens; identical to SEQ ID NO: 561175

SEQ ID NO: 575984 - RNA, 64 nt, Homo Sapiens; identical to SEQ ID NO: 561176

SEQ ID NO: 575985 - RNA, 64 nt, Homo Sapiens; identical to SEQ ID NO: 561177

SEQ ID NO: 575986 - RNA, 64 nt, Homo Sapiens; identical to SEQ ID NO: 561178

SEQ ID NO: 575987 - RNA, 64 nt, Homo Sapiens; identical to SEQ ID NO: 561179

SEQ ID NO: 575988 - RNA, 64 nt, Homo Sapiens; identical to SEQ ID NO: 561180

SEQ ID NO: 575989 - RNA, 64 nt, Homo Sapiens; identical to SEQ ID NO: 561181

SEQ ID NO: 575990 - RNA, 64 nt, Homo Sapiens; identical to SEQ ID NO: 561182

SEQ ID NO: 575991 - RNA, 64 nt, Homo Sapiens; identical to SEQ ID NO: 561183

SEQ ID NO: 575992 - RNA, 64 nt, Homo Sapiens; identical to SEQ ID NO: 561184

SEQ ID NO: 575993 - RNA, 64 nt, Homo Sapiens; identical to SEQ ID NO: 561185

SEQ ID NO: 575994 - RNA, 64 nt, Homo Sapiens; identical to SEQ ID NO: 561186

SEQ ID NO: 575995 - RNA, 64 nt, Homo Sapiens; identical to SEQ ID NO: 561187

SEQ ID NO: 575996 - RNA, 64 nt, Homo Sapiens; identical to SEQ ID NO: 561188

SEQ ID NO: 575997 - RNA, 64 nt, Homo Sapiens; identical to SEQ ID NO: 561189

SEQ ID NO: 575998 - RNA, 64 nt, Homo Sapiens; identical to SEQ ID NO: 561190

SEQ ID NO: 575999 - RNA, 64 nt, Homo Sapiens; identical to SEQ ID NO: 561191

SEQ ID NO: 576000 - RNA, 64 nt, Homo Sapiens; identical to SEQ ID NO: 561192

SEQ ID NO: 576001 - RNA, 64 nt, Homo Sapiens; identical to SEQ ID NO: 561193

SEQ ID NO: 576002 - RNA, 64 nt, Homo Sapiens; identical to SEQ ID NO: 561194

SEQ ID NO: 576003 - RNA, 64 nt, Homo Sapiens; identical to SEQ ID NO: 561195

SEQ ID NO: 576004 - RNA, 64 nt, Homo Sapiens; identical to SEQ ID NO: 561196

SEQ ID NO: 576005 - RNA, 64 nt, Homo Sapiens; identical to SEQ ID NO: 561197

SEQ ID NO: 576006 - RNA, 64 nt, Homo Sapiens; identical to SEQ ID NO: 561198

SEQ ID NO: 576007 - RNA, 64 nt, Homo Sapiens; identical to SEQ ID NO: 561199

SEQ ID NO: 576008 - RNA, 64 nt, Homo Sapiens
aaauagaguuacucucuaagaccguuuauguuucucaucuaauccaaaccuucagaacauucaa

SEQ ID NO: 576009 - RNA, 64 nt, Homo Sapiens
ucuucuauguccugagcaugaauuguucagugggucaucuaaauaucuuagcuuccuugcuuac

SEQ ID NO: 576010 - RNA, 64 nt, Homo Sapiens
cucuagauuuugaaaccaaaaaacugaacugaaaucaucuaaagaguuaaaauuucagugaucu

SEQ ID NO: 576011 - RNA, 64 nt, Homo Sapiens
agucuugcgucucauccuuuaugauguugagaaaucaucuaauuucucagaacuuuuucuuauc

SEQ ID NO: 576012 - RNA, 64 nt, Homo Sapiens
cucaucuguuuaauggugauagaauguguccuccucaucuaauggggaaaucaugcaacuacuc

SEQ ID NO: 576013 - RNA, 56 nt, Homo Sapiens
aacacggucucaaccuggccccugaaucaucuaaaacaugcuuugcccuggaguaa

SEQ ID NO: 576014 - RNA, 64 nt, Homo Sapiens
gcaggccaccaaauuuaaaaggugaagaucacugucaucuaaaaagggagacaggugcagauga

SEQ ID NO: 576015 - RNA, 64 nt, Homo Sapiens
gccagccacugucagcaaaggaugaagguaacaaucaucuaaaauacugagcucaggagagcaa

SEQ ID NO: 576016 - RNA, 64 nt, Homo Sapiens
gguuaguggcuuuugcuuggguuguguggacuucucaucuaaaaccaauccucccuaacaauuc

SEQ ID NO: 576017 - RNA, 64 nt, Homo Sapiens
gaguaagguauuaggcccuuauuugagcuauuuuucaucuaaaaacuucuugcauguugaagau

SEQ ID NO: 576018 - RNA, 64 nt, Homo Sapiens; identical to SEQ ID NO: 56858

SEQ ID NO: 576019 - RNA, 64 nt, Homo Sapiens; identical to SEQ ID NO: 56859

SEQ ID NO: 576020 - RNA, 64 nt, Homo Sapiens; identical to SEQ ID NO: 56860

SEQ ID NO: 576021 - RNA, 64 nt, Homo Sapiens; identical to SEQ ID NO: 56861

SEQ ID NO: 576022 - RNA, 64 nt, Homo Sapiens; identical to SEQ ID NO: 56862

SEQ ID NO: 576023 - RNA, 64 nt, Homo Sapiens; identical to SEQ ID NO: 56863

SEQ ID NO: 576024 - RNA, 64 nt, Homo Sapiens; identical to SEQ ID NO: 56864

SEQ ID NO: 576025 - RNA, 64 nt, Homo Sapiens; identical to SEQ ID NO: 56865

SEQ ID NO: 576026 - RNA, 64 nt, Homo Sapiens; identical to SEQ ID NO: 56866

SEQ ID NO: 576027 - RNA, 64 nt, Homo Sapiens; identical to SEQ ID NO: 56867

SEQ ID NO: 576028 - RNA, 64 nt, Homo Sapiens; identical to SEQ ID NO: 56868

SEQ ID NO: 576029 - RNA, 64 nt, Homo Sapiens; identical to SEQ ID NO: 56869

SEQ ID NO: 576030 - RNA, 64 nt, Homo Sapiens; identical to SEQ ID NO: 56870

SEQ ID NO: 576031 - RNA, 64 nt, Homo Sapiens; identical to SEQ ID NO: 56871

SEQ ID NO: 576032 - RNA, 64 nt, Homo Sapiens; identical to SEQ ID NO: 56872

SEQ ID NO: 576033 - RNA, 64 nt, Homo Sapiens; identical to SEQ ID NO: 56873

SEQ ID NO: 576034 - RNA, 64 nt, Homo Sapiens; identical to SEQ ID NO: 56874

SEQ ID NO: 576035 - RNA, 64 nt, Homo Sapiens; identical to SEQ ID NO: 56875

SEQ ID NO: 576036 - RNA, 64 nt, Homo Sapiens; identical to SEQ ID NO: 56876

SEQ ID NO: 576037 - RNA, 64 nt, Homo Sapiens; identical to SEQ ID NO: 56877

SEQ ID NO: 576038 - RNA, 64 nt, Homo Sapiens; identical to SEQ ID NO: 56878

SEQ ID NO: 576039 - RNA, 64 nt, Homo Sapiens; identical to SEQ ID NO: 56879

SEQ ID NO: 576040 - RNA, 64 nt, Homo Sapiens; identical to SEQ ID NO: 56880

SEQ ID NO: 576041 - RNA, 64 nt, Homo Sapiens; identical to SEQ ID NO: 56881

SEQ ID NO: 576042 - RNA, 64 nt, Homo Sapiens; identical to SEQ ID NO: 242974

SEQ ID NO: 576043 - RNA, 64 nt, Homo Sapiens; identical to SEQ ID NO: 242975

SEQ ID NO: 576044 - RNA, 64 nt, Homo Sapiens; identical to SEQ ID NO: 242976

SEQ ID NO: 576045 - RNA, 64 nt, Homo Sapiens; identical to SEQ ID NO: 242977

SEQ ID NO: 576046 - RNA, 64 nt, Homo Sapiens; identical to SEQ ID NO: 242978

SEQ ID NO: 576047 - RNA, 64 nt, Homo Sapiens; identical to SEQ ID NO: 242979

SEQ ID NO: 576048 - RNA, 64 nt, Homo Sapiens; identical to SEQ ID NO: 242980

SEQ ID NO: 576049 - RNA, 64 nt, Homo Sapiens; identical to SEQ ID NO: 242981

SEQ ID NO: 576050 - RNA, 64 nt, Homo Sapiens; identical to SEQ ID NO: 242982

SEQ ID NO: 576051 - RNA, 64 nt, Homo Sapiens; identical to SEQ ID NO: 242983

SEQ ID NO: 576052 - RNA, 64 nt, Homo Sapiens; identical to SEQ ID NO: 242984

SEQ ID NO: 576053 - RNA, 64 nt, Homo Sapiens; identical to SEQ ID NO: 242985

SEQ ID NO: 576054 - RNA, 64 nt, Homo Sapiens; identical to SEQ ID NO: 53697

SEQ ID NO: 576055 - RNA, 64 nt, Homo Sapiens; identical to SEQ ID NO: 53698

SEQ ID NO: 576056 - RNA, 64 nt, Homo Sapiens; identical to SEQ ID NO: 53699

SEQ ID NO: 576057 - RNA, 64 nt, Homo Sapiens; identical to SEQ ID NO: 53700

SEQ ID NO: 576058 - RNA, 64 nt, Homo Sapiens; identical to SEQ ID NO: 53701

SEQ ID NO: 576059 - RNA, 64 nt, Homo Sapiens; identical to SEQ ID NO: 53702

SEQ ID NO: 576060 - RNA, 64 nt, Homo Sapiens
cuugguuucacacucagcuacaugugaccuccagcuuggugagguugccugaagauuagggaaa

SEQ ID NO: 576061 - RNA, 64 nt, Homo Sapiens
aucugcuuacccacuucauuauuugacagcuuuccuuggugacccaaaccuuguagccuaagcc

SEQ ID NO: 576062 - RNA, 64 nt, Homo Sapiens
gcuuugcuaauucacagguauuuuaaaaagggagcuuggugagacuuccuaagaugugcuugca

SEQ ID NO: 576063 - RNA, 64 nt, Homo Sapiens
ggauucaacuugcuugggagcugaacagcaggaccuuggugacuagcaggugcugccugugacu

SEQ ID NO: 576064 - RNA, 64 nt, Homo Sapiens
ucagaaaacacuuauuuuguuucuuaaguuaugacuuggugagucagggugccuguaggaagug

SEQ ID NO: 576065 - RNA, 64 nt, Homo Sapiens
aaaagaacacuccuuucugagacuuugcuuaauacuuggugaccucacaaucacgucgguauga

SEQ ID NO: 576066 - RNA, 64 nt, Homo Sapiens
uagaccguuugcuucuuuaaaaccgucucauggucuuggugacggugacguagaccauuuuuga

SEQ ID NO: 576067 - RNA, 64 nt, Homo Sapiens
uagaccauuuuugaaaccguaaccaucucauggucuuggugacgaggccaagccuauuguguga

SEQ ID NO: 576068 - RNA, 64 nt, Homo Sapiens
ugcuacuguuuuccaagugaaugggucucaaagacuuggugaccccagccucaucuucuaggcc

SEQ ID NO: 576069 - RNA, 64 nt, Homo Sapiens
ggacccuguccagcacagcuucuggcacaggaugcuuggugaauguacccuuucuuucccuccc

SEQ ID NO: 576070 - RNA, 64 nt, Homo Sapiens
acucaccauuucuauuaauuucuguugguaagaacuuggugagaaugccccguggaagauacac

SEQ ID NO: 576071 - RNA, 64 nt, Homo Sapiens
uaaaagcauauuuuggguacauuuguuucaaaaccuuggugaugcauuacaacuuguuuucuua

SEQ ID NO: 576072 - RNA, 64 nt, Homo Sapiens
acauauauauauauauuuuucaggaaccauaguucuuggugacuaucuggcuauuaguauuuua

SEQ ID NO: 576073 - RNA, 64 nt, Homo Sapiens
cuggccauagcuaaguuaaccaaguauggcuuuacuuggugacauauccagucgucaucucauu

SEQ ID NO: 576074 - RNA, 64 nt, Homo Sapiens
ucuccuguugacccugguuuagagccguuaaccacuuggugaguuauguggguguuguugcccu

SEQ ID NO: 576075 - RNA, 64 nt, Homo Sapiens
cuugaggccaggaguucaagaccacccugaccaacuuggugaaaucccaucucuacuaaaaaua

SEQ ID NO: 576076 - RNA, 64 nt, Homo Sapiens
uuaacucuucaauauaagcuaugaaguaauaguugguugugaauuaaaguggcaccagcuagca

SEQ ID NO: 576077 - RNA, 64 nt, Homo Sapiens
agcuuagggggagggugggaaaguuugggggggggguugugaagauuuagggggaccuugauag

SEQ ID NO: 576078 - RNA, 64 nt, Homo Sapiens
acuguuucaaaugauuggauccuaggauacugaugguugugaaggacuagcagccaaauaacug

SEQ ID NO: 576079 - RNA, 64 nt, Homo Sapiens
gcuggcaagucccccccaacaacucugggaaggagguugugauuuuaucccacucaaucaaagg

SEQ ID NO: 576080 - RNA, 64 nt, Homo Sapiens; identical to SEQ ID NO: 480710

SEQ ID NO: 576081 - RNA, 64 nt, Homo Sapiens; identical to SEQ ID NO: 480711

SEQ ID NO: 576082 - RNA, 64 nt, Homo Sapiens; identical to SEQ ID NO: 480712

SEQ ID NO: 576083 - RNA, 64 nt, Homo Sapiens; identical to SEQ ID NO: 480713

SEQ ID NO: 576084 - RNA, 64 nt, Homo Sapiens; identical to SEQ ID NO: 480714

SEQ ID NO: 576085 - RNA, 64 nt, Homo Sapiens; identical to SEQ ID NO: 480715

SEQ ID NO: 576086 - RNA, 64 nt, Homo Sapiens; identical to SEQ ID NO: 480716

SEQ ID NO: 576087 - RNA, 64 nt, Homo Sapiens; identical to SEQ ID NO: 480717

SEQ ID NO: 576088 - RNA, 64 nt, Homo Sapiens; identical to SEQ ID NO: 480718

SEQ ID NO: 576089 - RNA, 64 nt, Homo Sapiens; identical to SEQ ID NO: 480719

SEQ ID NO: 576090 - RNA, 64 nt, Homo Sapiens; identical to SEQ ID NO: 480720

SEQ ID NO: 576091 - RNA, 64 nt, Homo Sapiens; identical to SEQ ID NO: 480721

SEQ ID NO: 576092 - RNA, 64 nt, Homo Sapiens; identical to SEQ ID NO: 480722

SEQ ID NO: 576093 - RNA, 64 nt, Homo Sapiens; identical to SEQ ID NO: 480723

SEQ ID NO: 576094 - RNA, 64 nt, Homo Sapiens; identical to SEQ ID NO: 84166

SEQ ID NO: 576095 - RNA, 64 nt, Homo Sapiens; identical to SEQ ID NO: 84167

SEQ ID NO: 576096 - RNA, 64 nt, Homo Sapiens; identical to SEQ ID NO: 84168

SEQ ID NO: 576097 - RNA, 64 nt, Homo Sapiens; identical to SEQ ID NO: 84169

SEQ ID NO: 576098 - RNA, 64 nt, Homo Sapiens; identical to SEQ ID NO: 84170

SEQ ID NO: 576099 - RNA, 64 nt, Homo Sapiens; identical to SEQ ID NO: 84171

SEQ ID NO: 576100 - RNA, 64 nt, Homo Sapiens; identical to SEQ ID NO: 84172

SEQ ID NO: 576101 - RNA, 64 nt, Homo Sapiens; identical to SEQ ID NO: 84173

SEQ ID NO: 576102 - RNA, 64 nt, Homo Sapiens; identical to SEQ ID NO: 84174

SEQ ID NO: 576103 - RNA, 64 nt, Homo Sapiens; identical to SEQ ID NO: 84175

SEQ ID NO: 576104 - RNA, 64 nt, Homo Sapiens; identical to SEQ ID NO: 84176

SEQ ID NO: 576105 - RNA, 64 nt, Homo Sapiens; identical to SEQ ID NO: 84177

SEQ ID NO: 576106 - RNA, 64 nt, Homo Sapiens; identical to SEQ ID NO: 84178

SEQ ID NO: 576107 - RNA, 64 nt, Homo Sapiens; identical to SEQ ID NO: 84179

SEQ ID NO: 576108 - RNA, 64 nt, Homo Sapiens; identical to SEQ ID NO: 84180

SEQ ID NO: 576109 - RNA, 64 nt, Homo Sapiens; identical to SEQ ID NO: 84181

SEQ ID NO: 576110 - RNA, 64 nt, Homo Sapiens; identical to SEQ ID NO: 84182

SEQ ID NO: 576111 - RNA, 64 nt, Homo Sapiens; identical to SEQ ID NO: 84183

SEQ ID NO: 576112 - RNA, 64 nt, Homo Sapiens; identical to SEQ ID NO: 84184

SEQ ID NO: 576113 - RNA, 64 nt, Homo Sapiens; identical to SEQ ID NO: 84185

SEQ ID NO: 576114 - RNA, 64 nt, Homo Sapiens; identical to SEQ ID NO: 84186

SEQ ID NO: 576115 - RNA, 64 nt, Homo Sapiens; identical to SEQ ID NO: 84187

SEQ ID NO: 576116 - RNA, 64 nt, Homo Sapiens; identical to SEQ ID NO: 84188

SEQ ID NO: 576117 - RNA, 64 nt, Homo Sapiens; identical to SEQ ID NO: 84189

SEQ ID NO: 576118 - RNA, 64 nt, Homo Sapiens; identical to SEQ ID NO: 84190

SEQ ID NO: 576119 - RNA, 64 nt, Homo Sapiens; identical to SEQ ID NO: 84191

SEQ ID NO: 576120 - RNA, 64 nt, Homo Sapiens; identical to SEQ ID NO: 84192

SEQ ID NO: 576121 - RNA, 64 nt, Homo Sapiens; identical to SEQ ID NO: 84193

SEQ ID NO: 576122 - RNA, 64 nt, Homo Sapiens; identical to SEQ ID NO: 84194

SEQ ID NO: 576123 - RNA, 64 nt, Homo Sapiens; identical to SEQ ID NO: 84195

SEQ ID NO: 576124 - RNA, 64 nt, Homo Sapiens; identical to SEQ ID NO: 84196

SEQ ID NO: 576125 - RNA, 64 nt, Homo Sapiens; identical to SEQ ID NO: 84197

SEQ ID NO: 576126 - RNA, 64 nt, Homo Sapiens; identical to SEQ ID NO: 84198

SEQ ID NO: 576127 - RNA, 64 nt, Homo Sapiens; identical to SEQ ID NO: 84199

SEQ ID NO: 576128 - RNA, 64 nt, Homo Sapiens; identical to SEQ ID NO: 84200

SEQ ID NO: 576129 - RNA, 64 nt, Homo Sapiens; identical to SEQ ID NO: 84201

SEQ ID NO: 576130 - RNA, 64 nt, Homo Sapiens; identical to SEQ ID NO: 84202

SEQ ID NO: 576131 - RNA, 64 nt, Homo Sapiens; identical to SEQ ID NO: 84203

SEQ ID NO: 576132 - RNA, 64 nt, Homo Sapiens; identical to SEQ ID NO: 84204

SEQ ID NO: 576133 - RNA, 64 nt, Homo Sapiens; identical to SEQ ID NO: 84205

SEQ ID NO: 576134 - RNA, 64 nt, Homo Sapiens; identical to SEQ ID NO: 84206

SEQ ID NO: 576135 - RNA, 64 nt, Homo Sapiens; identical to SEQ ID NO: 84207

SEQ ID NO: 576136 - RNA, 64 nt, Homo Sapiens; identical to SEQ ID NO: 84208

SEQ ID NO: 576137 - RNA, 64 nt, Homo Sapiens; identical to SEQ ID NO: 84209

SEQ ID NO: 576138 - RNA, 64 nt, Homo Sapiens; identical to SEQ ID NO: 84210

SEQ ID NO: 576139 - RNA, 64 nt, Homo Sapiens; identical to SEQ ID NO: 84211

SEQ ID NO: 576140 - RNA, 64 nt, Homo Sapiens; identical to SEQ ID NO: 84212

SEQ ID NO: 576141 - RNA, 64 nt, Homo Sapiens; identical to SEQ ID NO: 84213

SEQ ID NO: 576142 - RNA, 64 nt, Homo Sapiens; identical to SEQ ID NO: 84214

SEQ ID NO: 576143 - RNA, 64 nt, Homo Sapiens; identical to SEQ ID NO: 84215

SEQ ID NO: 576144 - RNA, 64 nt, Homo Sapiens; identical to SEQ ID NO: 84216

SEQ ID NO: 576145 - RNA, 64 nt, Homo Sapiens; identical to SEQ ID NO: 84217

SEQ ID NO: 576146 - RNA, 64 nt, Homo Sapiens; identical to SEQ ID NO: 84218

SEQ ID NO: 576147 - RNA, 64 nt, Homo Sapiens; identical to SEQ ID NO: 84219

SEQ ID NO: 576148 - RNA, 64 nt, Homo Sapiens; identical to SEQ ID NO: 84220

SEQ ID NO: 576149 - RNA, 64 nt, Homo Sapiens; identical to SEQ ID NO: 84221

SEQ ID NO: 576150 - RNA, 64 nt, Homo Sapiens; identical to SEQ ID NO: 84222

SEQ ID NO: 576151 - RNA, 64 nt, Homo Sapiens; identical to SEQ ID NO: 84223

SEQ ID NO: 576152 - RNA, 64 nt, Homo Sapiens; identical to SEQ ID NO: 84224

SEQ ID NO: 576153 - RNA, 64 nt, Homo Sapiens; identical to SEQ ID NO: 84225

SEQ ID NO: 576154 - RNA, 64 nt, Homo Sapiens; identical to SEQ ID NO: 84226

SEQ ID NO: 576155 - RNA, 64 nt, Homo Sapiens; identical to SEQ ID NO: 84227

SEQ ID NO: 576156 - RNA, 64 nt, Homo Sapiens; identical to SEQ ID NO: 84228

SEQ ID NO: 576157 - RNA, 64 nt, Homo Sapiens; identical to SEQ ID NO: 84229

SEQ ID NO: 576158 - RNA, 64 nt, Homo Sapiens; identical to SEQ ID NO: 84230

SEQ ID NO: 576159 - RNA, 64 nt, Homo Sapiens; identical to SEQ ID NO: 84231

SEQ ID NO: 576160 - RNA, 64 nt, Homo Sapiens; identical to SEQ ID NO: 84232

SEQ ID NO: 576161 - RNA, 64 nt, Homo Sapiens; identical to SEQ ID NO: 84233

SEQ ID NO: 576162 - RNA, 64 nt, Homo Sapiens
aaaugcugggacuuuucaugaacuuugucuuaaguguugacaugaaucauucuaaaaggcuaaa

SEQ ID NO: 576163 - RNA, 64 nt, Homo Sapiens
aaaaaaacaaaaaaaaagcaauagauagagaaauuguugacaauuucuguagucuuuccuaguu

SEQ ID NO: 576164 - RNA, 64 nt, Homo Sapiens
aaucaacuggcuuuuuuuaaaaaagguagcauuuuguugacaguuauuuuguaaacauaagcaa

SEQ ID NO: 576165 - RNA, 64 nt, Homo Sapiens
uauguguguuaaauauauugaguuuggauuaaaauguugacaugauuucacauuugaaaauaaa

SEQ ID NO: 576166 - RNA, 64 nt, Homo Sapiens
ccuuuuagaaguugugaaauaugaucguuguaauuguugacauugauuaucgaccaugguaugc

SEQ ID NO: 576167 - RNA, 64 nt, Homo Sapiens
guagcucauacuggaaaaguaugccucccuuuuguguugacacuauuucauaaauuaaacauuu

SEQ ID NO: 576168 - RNA, 64 nt, Homo Sapiens
cugcuaggugaugguuuaugucagcagaugcaccuguugacagcugccauuaucccagacagca

SEQ ID NO: 576169 - RNA, 64 nt, Homo Sapiens
uuaaucggucccagguaugagaguaauuuuaaaauguugacaccucuuuucugguuaauaucuu

SEQ ID NO: 576170 - RNA, 64 nt, Homo Sapiens
ugaggauggguaugcaaggaggcuggaaacuguguguugacauucauuuguuccuuguaagaau

SEQ ID NO: 576171 - RNA, 64 nt, Homo Sapiens
uauuacuuuaauuuugcauuuaauacagcucuucuguugacaguucaagguugauacguagcuu

SEQ ID NO: 576172 - RNA, 64 nt, Homo Sapiens
gaaaacaugaauucugugauggaugacaacagguuguugacauuggccaacggggaacgcaucc

SEQ ID NO: 576173 - RNA, 64 nt, Homo Sapiens
acgaauauaucaaacgccuugcuucuuugucuacuguugacacagaaggaguuugggccaaccc

SEQ ID NO: 576174 - RNA, 64 nt, Homo Sapiens
aguuguggacaaaaagccaacagugcaagcucuguguugacaaguguaggcaggacugugauaa

SEQ ID NO: 576175 - RNA, 64 nt, Homo Sapiens
guuauauaauaaaugauaauugucuugguguuaauguugacauugcguaguuggagucuguccc

SEQ ID NO: 576176 - RNA, 64 nt, Homo Sapiens
agucucagugaagacuaugacauauuaaauuuuuuguugacauuagcuuaaaauacaagacugc

SEQ ID NO: 576177 - RNA, 64 nt, Homo Sapiens
cugaaugcuucuaaguaaauaguugcagcuguuuuguugacauuaauugcaaaaaaaaaaaaaa

SEQ ID NO: 576178 - RNA, 64 nt, Homo Sapiens
ucccugaggguuuacugugaagugcugaggacaguguugacaacuaacucguuuuccuagaugg

SEQ ID NO: 576179 - RNA, 64 nt, Homo Sapiens
aaauuaaguuaccacagacucuguaguguguaaauguugacaaggaauuggaucacaaucaugu

SEQ ID NO: 576180 - RNA, 64 nt, Homo Sapiens
gcacugacuuuagaaagauggacuguauaaaacuuguugacaauaccacauucaccuuguaaau

SEQ ID NO: 576181 - RNA, 64 nt, Homo Sapiens
auggagaaagcaagaucaugguuuuauuccauucuguugacaaggcuaccuccuuuuuccugaa

SEQ ID NO: 576182 - RNA, 64 nt, Homo Sapiens
agcucuccgggcccucagggcggggugggagagcuguugacagaccgacagcucccuggguguc

SEQ ID NO: 576183 - RNA, 64 nt, Homo Sapiens
uggcacuuugcuggccccgacgacucccucacuguguugacacuagggucugagccaagccccu

SEQ ID NO: 576184 - RNA, 64 nt, Homo Sapiens
uccucggcuccaugugccagaggcuccgguccaugcaguacaauggcagcuacuucgacagagg

SEQ ID NO: 576185 - RNA, 64 nt, Homo Sapiens
acuacauaacugauuuuuaguugacuuagcuauagcaguacaaugauuaguaauguaaaaauua

SEQ ID NO: 576186 - RNA, 64 nt, Homo Sapiens
aggaaauagaauguaaaacaucacaaaaaaaauugcaguacauaaaauuucuggacuauguuag

SEQ ID NO: 576187 - RNA, 64 nt, Homo Sapiens
uuccugggaaucaagguaacucacacgacuacuugcaguacaaauuuuuugcuucucuuucgac

SEQ ID NO: 576188 - RNA, 64 nt, Homo Sapiens
caauucagcuugaaaaauaaucucacuacauguagcaguacauuauauguacauuauauguaau

SEQ ID NO: 576189 - RNA, 64 nt, Homo Sapiens
cuuuaugcuggacccaguaagaugaggaagucgggcaguacacaggaagaggagccaggcccuu

SEQ ID NO: 576190 - RNA, 64 nt, Homo Sapiens
uaaucagaaaaaaaacuuauuucuuaaucaaaaggcaguacaaaaaaaguaauaauguuuuaua

SEQ ID NO: 576191 - RNA, 64 nt, Homo Sapiens
aauaaucccaaagacacugacaacucaaggaacagcaguacaguacuauuagaaguuaaguaug

SEQ ID NO: 576192 - RNA, 64 nt, Homo Sapiens
gcgcggcucuacacgcuuggggcacauaucggaagcaguacagcacuucucguugcugcucugu

SEQ ID NO: 576193 - RNA, 64 nt, Homo Sapiens
uucaaagggguauuccuagcauuuuuuauaaguagcaguacacauuaaucauagcuacauaccu

SEQ ID NO: 576194 - RNA, 64 nt, Homo Sapiens
caaaacacgcaagggcaucacacuuggagcccgugcaguacaggugggacucccagugaacuua

SEQ ID NO: 576195 - RNA, 64 nt, Homo Sapiens
auguaaccaauaaagcucccucucuguuggcucugcaguacaauguauccucuggcgcgaaugc

SEQ ID NO: 576196 - RNA, 64 nt, Homo Sapiens
cuugguuuccagagcucccaaucccucgggcccagcaguacacaggccaccagaagacacuucc

SEQ ID NO: 576197 - RNA, 64 nt, Homo Sapiens
uuguccuuuuuuuaagacgucauuaccuugugaagcaguacacauacucuuuuuugauuagcua

SEQ ID NO: 576198 - RNA, 64 nt, Homo Sapiens
uaagcagccauuaauaaacucacucaguaaaagagcaguacauguuuuguugguuaacuguguu

SEQ ID NO: 576199 - RNA, 64 nt, Homo Sapiens
uguuuugcccagccaucacuggaagaugggucuugcaguacauuugggaguguauuaacuggag

SEQ ID NO: 576200 - RNA, 64 nt, Homo Sapiens
cugggaggaaaugaaacuaacuauuuaaaaaagagcaguacauccuucauuucuaguacacgcc

SEQ ID NO: 576201 - RNA, 64 nt, Homo Sapiens
ugaauguuauuuuacauccacccuguuuacagaggcaguacaacuguggaaugaugugaauugg

SEQ ID NO: 576202 - RNA, 64 nt, Homo Sapiens
uagguuuuugagacaaucacauggccugagauaagcaguacaagcaagaauuugggaaacacag

SEQ ID NO: 576203 - RNA, 64 nt, Homo Sapiens
ugauccuuuaauauuauccaugcuuuuauaaagugcaguacacauuuugacauugccacaguuu

SEQ ID NO: 576204 - RNA, 64 nt, Homo Sapiens
agaguggugcgaggaguacauuuucagagcaggugcaguacaucuuccggcucuaugaaucauu

SEQ ID NO: 576205 - RNA, 64 nt, Homo Sapiens
agcuccuaaagugaccuuccgggugggaagggcagcaguacacaugaccccauccuuuucuuug

SEQ ID NO: 576206 - RNA, 64 nt, Homo Sapiens
gaugguaaauacugucccacucagcucugcuggcgcaguacagcagcagcagccccagcacagc

SEQ ID NO: 576207 - RNA, 64 nt, Homo Sapiens
aaucauggccuugcauuaaaauauggaaagcagagcaguacauauucaaauguauucagaaagu

SEQ ID NO: 576208 - RNA, 64 nt, Homo Sapiens
uggaagccaaaacaagguggcugacacuggucuugcaguacaacugauuaaucagccuaugugc

SEQ ID NO: 576209 - RNA, 64 nt, Homo Sapiens
accucuaugcacuucuuucuuagacuggaucuuugcaguacaacagcuguaguauggagauuaa

SEQ ID NO: 576210 - RNA, 60 nt, Homo Sapiens
aguuuuagauacucauuaguuuaaaaaccugcaguacaaccacagcccucaggaaguuga

SEQ ID NO: 576211 - RNA, 64 nt, Homo Sapiens
cugccugacgccagcccugccuccacguauuuaugcaguacagucugcugauucgggcuguggc

SEQ ID NO: 576212 - RNA, 64 nt, Homo Sapiens
cgcugcggugucaccucuguuccauuggggacgggcaguacaaggcgugcuagaggugucacgc

SEQ ID NO: 576213 - RNA, 57 nt, Homo Sapiens
gucacagggaaggauucuaaaagguaugcaguacagcaguauagaauccaugccaau

SEQ ID NO: 576214 - RNA, 64 nt, Homo Sapiens
uucaauucugaaguuauaccuagugauguuuuuugcaguacauuugaauggauuguagacacug

SEQ ID NO: 576215 - RNA, 64 nt, Homo Sapiens
ggagaggcuggaaaacauaugccaagcugaugaggcaguacaggagacucacugaggaauacaa

SEQ ID NO: 576216 - RNA, 64 nt, Homo Sapiens
aguugccauaauaguauaaaaaauagacuguguugcaguacacaaaaaucauaaauuucccuca

SEQ ID NO: 576217 - RNA, 64 nt, Homo Sapiens
uuaugcaaauauggaaauuaauguacuuagaauagcaguacauuggguugauauuaacaaagga

SEQ ID NO: 576218 - RNA, 64 nt, Homo Sapiens
uggccucuaguuuauauaauuauuuaccucuuuggcaguacagauaacaaaauacacuuuacug

SEQ ID NO: 576219 - RNA, 64 nt, Homo Sapiens
uuugaauugguuucuacacauuuccaguaguauggcaguacagugcucuguucauugcaagcug

SEQ ID NO: 576220 - RNA, 64 nt, Homo Sapiens
caggguauguccuaacauggaguuaacuggaauagcaguacacuagcaaguaucugugaauccu

SEQ ID NO: 576221 - RNA, 64 nt, Homo Sapiens
aacuuguaaacuucaucuauuucaaauauuuuaugcaguacauuauauuauucuguacaaaggc

SEQ ID NO: 576222 - RNA, 64 nt, Homo Sapiens
ucagccucacugagcuaauauuuuuuuuaaaugugcaguacacauuguaugaaaauuccuguga

SEQ ID NO: 576223 - RNA, 64 nt, Homo Sapiens
cuauuguucaucauauuugauccuuguccucacagcaguacauugugaacaauaaagauaaaag

SEQ ID NO: 576224 - RNA, 64 nt, Homo Sapiens
cauagcaagccuuguccugaacaguguaugucaugcaguacagauauauugguggcaucaguca

SEQ ID NO: 576225 - RNA, 64 nt, Homo Sapiens
uuucugaaagcuacccauaauuugucacuucagugcaguacauugagaacaggcaagacagaac

SEQ ID NO: 576226 - RNA, 64 nt, Homo Sapiens
uguuccugccccaagccgucaaucagauuguggagcaguacacagucagaugaaaauacuguaa

SEQ ID NO: 576227 - RNA, 64 nt, Homo Sapiens
aaguccuggauuuccaagauccgcgucugaaagugcaguacaucguuuguaccugaaacugccg

SEQ ID NO: 576228 - RNA, 64 nt, Homo Sapiens
uggaacuagucuuccuuccuuauuccucgaacaugcaguacauaaaaaggggaaaaggagaaaa

SEQ ID NO: 576229 - RNA, 64 nt, Homo Sapiens
cuauuucuugugguuauaacuuaaugaaaacaaugcaguacaggacauauauuuuuuaaaauaa

SEQ ID NO: 576230 - RNA, 64 nt, Homo Sapiens
uuugggggugcaauauaagaaguuuauauaauaugcaguacauuauccaaaagagaagguaguu

SEQ ID NO: 576231 - RNA, 64 nt, Homo Sapiens
agaacauuuuccagaaguucuucuguuguagaaagcaguacaguaucuuaagugucaaccaguu

SEQ ID NO: 576232 - RNA, 64 nt, Homo Sapiens
uuccaggcagccucugucaggccuucaggguucagcaguacagccgagacucgacucugugccu

SEQ ID NO: 576233 - RNA, 64 nt, Homo Sapiens
acgugguggguuguggggaugcaguuuggcaucugcaguacaccaagcacaugauucaugucug

SEQ ID NO: 576234 - RNA, 64 nt, Homo Sapiens
acuauggaauagauuauuaaucauguggcagggagcaguacacauauucccccaaacuuuuugu

SEQ ID NO: 576235 - RNA, 64 nt, Homo Sapiens
auuggauacaguacggauuuuauuaagcaagaaugcaguacagaaccuccuuuaugguuaauac

SEQ ID NO: 576236 - RNA, 52 nt, Homo Sapiens
cuaaagagagugagcaugagaugcaguacauuggaaacaucugccuucuuaa

SEQ ID NO: 576237 - RNA, 64 nt, Homo Sapiens
ugaagcacuuuuuaacaacaagagcaacuuuccagcaguacauucaccccagcgccauuuguaa

SEQ ID NO: 576238 - RNA, 64 nt, Homo Sapiens
cuggcuuuuuaucuucuuagcucaucuuaaauaagcaguacacuuggaugcagugcgucugaag

SEQ ID NO: 576239 - RNA, 64 nt, Homo Sapiens
uauucugacugacaucaauuugucuaaucuuguagcaguacaguacaguccugauuauugcaac

SEQ ID NO: 576240 - RNA, 64 nt, Homo Sapiens
ugcagaucacuguuggccucaucuuccucugccugcaguacagacugagagguacagggcagag

SEQ ID NO: 576241 - RNA, 64 nt, Homo Sapiens
auucggaugaugcaaggagacacaugccaccccagcaguacacaaagcacuuaccuugacuggu

SEQ ID NO: 576242 - RNA, 64 nt, Homo Sapiens
cccucucuuuuuccucuguagagaaaugugaggggcaguacauuuacugugcuuuucacaccau

SEQ ID NO: 576243 - RNA, 64 nt, Homo Sapiens
gggcuuauuguguuaacacucguuuuaucuuuaugcaguacaguuaagacaaaguaacccucaa

SEQ ID NO: 576244 - RNA, 64 nt, Homo Sapiens
uauuaauugaccacuuccuucacuuaaggcauuugcaguacaaauauaccuuuuaauagguauc

SEQ ID NO: 576245 - RNA, 64 nt, Homo Sapiens
ugauuuuaugcccuuaaaguuuucuacuuucaaagcaguacaugcugacucaauacaucuggga

SEQ ID NO: 576246 - RNA, 64 nt, Homo Sapiens
auuauaucauuuuaugaauugugcuuuucauaaugcaguacauuucaaaauuuuuagauuaugu

SEQ ID NO: 576247 - RNA, 64 nt, Homo Sapiens
cuaguacaucuuuuaaaaaguuacuaauuuuccagcaguacaaauauuaacaauuauauuaaca

SEQ ID NO: 576248 - RNA, 64 nt, Homo Sapiens
uaauuaaaauauauaagcuuuauuuauuucaugagcaguacagcuauuuacacauauuuccaaa

SEQ ID NO: 576249 - RNA, 64 nt, Homo Sapiens
ugugcauggggcugcuggaggagagcauuccagagcaguacaucugcuauaucugccgggaccc

SEQ ID NO: 576250 - RNA, 64 nt, Homo Sapiens
ugcacaaagcagaaucucagaaugccaugcgcuggcaguacaugucuugcuuuaugggcucaag

SEQ ID NO: 576251 - RNA, 64 nt, Homo Sapiens
agucuacacaaagacuucaaaaacugcuuagauugcaguacauguauaagaggugggaauccca

SEQ ID NO: 576252 - RNA, 64 nt, Homo Sapiens
cuuaucaacugguuguauaucuuucugagcaucugcaguacagucauaugagagcgagauuuaa

SEQ ID NO: 576253 - RNA, 64 nt, Homo Sapiens
gugaaggccugcgcacugaacuguaaggcagugggcaguacaggguaacuggaggcggggccag

SEQ ID NO: 576254 - RNA, 64 nt, Homo Sapiens
gaguggccuugaggacgaaccccgcagggagcaagcaguacaguggcauucccagggggaccag

SEQ ID NO: 576255 - RNA, 64 nt, Homo Sapiens
aggucugccaggcugucccgugcccugcucgguggcaguacaagcuggcggccugcagcgugag

SEQ ID NO: 576256 - RNA, 64 nt, Homo Sapiens
agaaacuauaucaaacacuagaccaaaaguauuugcaguacaaauuuguucuacggggaggaaa

SEQ ID NO: 576257 - RNA, 64 nt, Homo Sapiens
acuccacauauacaacuuccuaucaaugaccagugcaguacagaugagccuuugaauacaucuu

SEQ ID NO: 576258 - RNA, 64 nt, Homo Sapiens
cccuguccccuccccaacccccccgcccagucccgcaguacaucugccaaaccccagggccugg

SEQ ID NO: 576259 - RNA, 64 nt, Homo Sapiens
uuggaaagaaugugaaauccgugccagacaccgggcaguacacuugucauauuguaacaugcgu

SEQ ID NO: 576260 - RNA, 64 nt, Homo Sapiens
uuuuaggaaaggaugaucaaaaauaaugcauccagcaguacaauaaaaguaaaccacaaaaaaa

SEQ ID NO: 576261 - RNA, 64 nt, Homo Sapiens
uaauaaguaggauuuuuguuuuguuuugcauuuugcaguacaaaggagaaaugauuagaacuua

SEQ ID NO: 576262 - RNA, 64 nt, Homo Sapiens
uaagcugaguccauauacuugucuaacuaagaaagcaguacagaggaaaacaggaaccugauuu

SEQ ID NO: 576263 - RNA, 64 nt, Homo Sapiens
ccaaacauucagaugaacugagcgucuuacacacgcaguacagaggagcacacauuaggauaga

SEQ ID NO: 576264 - RNA, 52 nt, Homo Sapiens
uuauuauguaauuaggacaccagcaguacaugacaucuauggggaagacuaa

SEQ ID NO: 576265 - RNA, 64 nt, Homo Sapiens
cagacccaagaccuagguggcagccggcccugcagcaguacagcgcauucccaucacggugcuc

SEQ ID NO: 576266 - RNA, 64 nt, Homo Sapiens
gcgcgcguguguguguguguguguauauuuauuugcaguacagugagagaucacuucagugugu

SEQ ID NO: 576267 - RNA, 64 nt, Homo Sapiens
guagcuuaccugacacaagaggaauaagaauggagcaguacaugggaaaggaggcaugccucug

SEQ ID NO: 576268 - RNA, 61 nt, Homo Sapiens
aaaaacuuguaaaccugugaauggaccccaagcaguacacuugcuggucuagguauuaacc

SEQ ID NO: 576269 - RNA, 64 nt, Homo Sapiens
uuuuccauccgcuaaguuuagauggaguccaaacgcaguacagcagaagaguuaacauuuacac

SEQ ID NO: 576270 - RNA, 64 nt, Homo Sapiens
ugaaaaucucccuguaauccucuuccuccauuaugcaguacacggacaccuggcuacagaccag

SEQ ID NO: 576271 - RNA, 64 nt, Homo Sapiens
ccuggccucagagccauuuauauucccagaguaggcaguacaggaucucguguugauuugcugu

SEQ ID NO: 576272 - RNA, 64 nt, Homo Sapiens
aaaggaauggaugguggaccgaauauuccuacuugcaguacauccuucagaauccuauggaaga

SEQ ID NO: 576273 - RNA, 64 nt, Homo Sapiens
ucgucaccuaggaauagauuacuuaaagguugcagcaguacaucuuucuuucucugcuuucuug

SEQ ID NO: 576274 - RNA, 64 nt, Homo Sapiens
uacuaagaguucucuuacugucagaaucucucuugcaguacagcucaaaauaguggaugcauuu

SEQ ID NO: 576275 - RNA, 64 nt, Homo Sapiens
ggaggauccggaaagaguuuccgaagagugaagggcaguacaguggcuucaagaguccuuacug

SEQ ID NO: 576276 - RNA, 64 nt, Homo Sapiens
uauccagagagacugggcuucucagaggacaccugcaguacagcgacagaguacagagaagggc

SEQ ID NO: 576277 - RNA, 64 nt, Homo Sapiens
gcucgguucucccaaacacauaauuucuguuucagcaguacaaaggcauguuuuaaaaucuaua

SEQ ID NO: 576278 - RNA, 64 nt, Homo Sapiens
guuuucuagaaacuucuuuaaagugccacauuuggcaguacaaaugagucugaguguaauagcc

SEQ ID NO: 576279 - RNA, 64 nt, Homo Sapiens
aaaaggauuauugugaggauuuucugcaaugauugcaguacaaguuguuagacucauagaguuu

SEQ ID NO: 576280 - RNA, 64 nt, Homo Sapiens
uuacuugucgaaaaaauuccagaaaagcaaucucgcaguacauguugauggaaaaagaaaaaga

SEQ ID NO: 576281 - RNA, 64 nt, Homo Sapiens
acuucaagguugcagugaaugaugcucacuuguugcaguacaaucaucggguuaaaaaacucaa

SEQ ID NO: 576282 - RNA, 64 nt, Homo Sapiens
acaguacuuccaaauuuuaagguauggaaugaaugcaguacaucuggaauuguagucgaugaau

SEQ ID NO: 576283 - RNA, 64 nt, Homo Sapiens
uaugggcugugauuccccuuguaguacagaaggugcaguacauccagcuucagguucugcuccu

SEQ ID NO: 576284 - RNA, 64 nt, Homo Sapiens
uuguggagccuuuuaacugugaggguugauuaaggcaguacaaagcgaaguccuauggaaaccc

SEQ ID NO: 576285 - RNA, 64 nt, Homo Sapiens
uucuguuucauuaugcucgaagguucaaacacaagcaguacauguuuuugguuaaauaagagua

SEQ ID NO: 576286 - RNA, 64 nt, Homo Sapiens
auguggaacaccuaucagggagcagaaaaggggugcaguacacuaagugaacccagauucugga

SEQ ID NO: 576287 - RNA, 64 nt, Homo Sapiens
gaugaacacacguuucaagacccaauugcccugagcaguacaauaaugccuuuuauuuauuuuu

SEQ ID NO: 576288 - RNA, 64 nt, Homo Sapiens
uggauaaucaguauuugacuuguaaauggugucagcaguacacaauacaaauagaugcaaugac

SEQ ID NO: 576289 - RNA, 64 nt, Homo Sapiens
cuucaucuuuugaaagguaguuccugagaguucagcaguacaguucaccgagagaggggcaggu

SEQ ID NO: 576290 - RNA, 64 nt, Homo Sapiens
gggcccuaggcugcuuccgguagucccuguuuuugcaguacaugggugacuaucuccccuguug

SEQ ID NO: 576291 - RNA, 64 nt, Homo Sapiens
ucacucccagaagagaccagcugggaccuucuuugcaguacaauuugaaauuccugauguauuu

SEQ ID NO: 576292 - RNA, 64 nt, Homo Sapiens
auccacauucagauaaccauggguugcuucugcugcaguacagagcaaauagaguuccggagcu

SEQ ID NO: 576293 - RNA, 64 nt, Homo Sapiens
guugaagagacuuuauucucugcuggggcaagaugcaguacaaaagaaucuaauaacauuaaaa

SEQ ID NO: 576294 - RNA, 64 nt, Homo Sapiens
caagcugcuaggaacuuacgguuuuauuaggagagcaguacaaggguaucuaucccaguaccaa

SEQ ID NO: 576295 - RNA, 64 nt, Homo Sapiens
cucugcugccucuguggaagagauuccuauuacugcaguacauacgucugccagggguaaccug

SEQ ID NO: 576296 - RNA, 64 nt, Homo Sapiens
cucucugcauuuuuuccccaguggaacagacucugcaguacauuaaucagguugagaauugaaa

SEQ ID NO: 576297 - RNA, 64 nt, Homo Sapiens
aucuuccacgaaaugggccauuccaguacuuccugcaguacaagaaccucuccaucaucuuccg

SEQ ID NO: 576298 - RNA, 64 nt, Homo Sapiens
gacgcccagcuccugucauccuuccuuagguccugcaguacagucuuccccugaaugccaccgg

SEQ ID NO: 576299 - RNA, 64 nt, Homo Sapiens
aucugacucuggcucaggcucgauucgaguggcugcaguacaggggcaggcgcaaaugauuugg

SEQ ID NO: 576300 - RNA, 64 nt, Homo Sapiens
uuagcagacacugcgcguggagaagggcuuaucugcaguacacucugccauguggagggugggc

SEQ ID NO: 576301 - RNA, 64 nt, Homo Sapiens
gggucauuacccucugccuccuggaagaccaauugcaguacaaauugaaaugggucggcucuag

SEQ ID NO: 576302 - RNA, 64 nt, Homo Sapiens
aauauucauguucauggaacuuugaaaguauaaugcaguacauuguuagaccacagaaguggaa

SEQ ID NO: 576303 - RNA, 64 nt, Homo Sapiens
uuuuaauguagugaacacaggugggacguuucaagcaguacauguuggaaaagaccacucucuu

SEQ ID NO: 576304 - RNA, 64 nt, Homo Sapiens
gggcggagcugggguuuggugcaguuuccagggugcaguacagcagggccugaauacuggcccu

SEQ ID NO: 576305 - RNA, 64 nt, Homo Sapiens
gugggggguuucuuuuuaugucugggucauucaggcaguacaucugaauuaagcugaauguaga

SEQ ID NO: 576306 - RNA, 64 nt, Homo Sapiens
gggagcuggacagauuauagugguugaagucugugcaguacagaagggcggagcuuauucacac

SEQ ID NO: 576307 - RNA, 64 nt, Homo Sapiens
cuucagucaccaacauauuguggcuggacagcaggcaguacacacuggagaaagacugaaugcc

SEQ ID NO: 576308 - RNA, 64 nt, Homo Sapiens
aaccaggggagaaaucucaguggaacauugaagagcaguacaaacaggaacaaaacaaaaagaa

SEQ ID NO: 576309 - RNA, 64 nt, Homo Sapiens
ggcgugugcucccagaauaucccuugguuuguaagcaguacaagauggaugcguuggucuuucu

SEQ ID NO: 576310 - RNA, 64 nt, Homo Sapiens
uuuaaauuuucagaugauguuuauguaauaaaaugcaguacauuuuauuuuacuauuuguacuu

SEQ ID NO: 576311 - RNA, 64 nt, Homo Sapiens
acuaggcucuuaaacgaucauccauaacacaauagcaguacaccauccugucucaguaggauac

SEQ ID NO: 576312 - RNA, 64 nt, Homo Sapiens
uccgagagggugggaacagcagcauccccuaauugcaguacacgguuccuuuuccgcccgccac

SEQ ID NO: 576313 - RNA, 64 nt, Homo Sapiens
uggcucacggugaaauaagcuugccaggaggcuggcaguacagagugcagcagcgagcaaaucc

SEQ ID NO: 576314 - RNA, 64 nt, Homo Sapiens
ucguuccuguugggcugaacccuaaggugagugugcaguacagugugugugggugaaauggaga

SEQ ID NO: 576315 - RNA, 64 nt, Homo Sapiens
cucuggggcuccgagaaaccugguucuuuggacugcaguacacaaucaaggacacaguggccug

SEQ ID NO: 576316 - RNA, 64 nt, Homo Sapiens
auccauuuaaaacaagcugauaguguuucguuaagcaguacaucuugugcaugcaaaaaugaau

SEQ ID NO: 576317 - RNA, 64 nt, Homo Sapiens
uaacaaagaaguugugaguaucuuagaguagaaggcaguacagaaauuaagagcuuagcauccc

SEQ ID NO: 576318 - RNA, 64 nt, Homo Sapiens
agccagacuauaccuuguguagcuucaagaacucgcaguacauuaccagcugugauucuccacu

SEQ ID NO: 576319 - RNA, 64 nt, Homo Sapiens
uaccugggcacaaacagaauuuuccauuuauuaagcaguacaaauguuuuucauccauuccuaa

SEQ ID NO: 576320 - RNA, 64 nt, Homo Sapiens
uacauguuugguaccaagaaaggaaccugucagggcaguacaaugugacuuugaaaauauauac

SEQ ID NO: 576321 - RNA, 64 nt, Homo Sapiens
gauggguccccaaaguggaggccuucaugaaauugcaguacagacuuuugacuuguacguguua

SEQ ID NO: 576322 - RNA, 64 nt, Homo Sapiens
uguguaucccaccaaacuaacagacagcugcucugcaguacagauuacagcucugacaaaucau

SEQ ID NO: 576323 - RNA, 64 nt, Homo Sapiens
guguaggcaagagaaagaauuauguucauauuaagcaguacagauuuacugauuaagugaccaa

SEQ ID NO: 576324 - RNA, 64 nt, Homo Sapiens
cuggccaacuguuaccaguuagaaauauuugaaggcaguacacuugaaaaagacaagauuuaug

SEQ ID NO: 576325 - RNA, 64 nt, Homo Sapiens
guguauauuuuggaaaagacuagggauagaguaagcaguacaaaguaucuuaggcuuauauacg

SEQ ID NO: 576326 - RNA, 64 nt, Homo Sapiens
guauucuguuugggggaauuccugaauuggcuaugcaguacauuguuagcagaccuaaagcaag

SEQ ID NO: 576327 - RNA, 64 nt, Homo Sapiens
cgacuucagcagcuuccugcugcuagucgaugcagcaguacaaacggcugccgagcuggagcua

SEQ ID NO: 576328 - RNA, 64 nt, Homo Sapiens
uuagccagacuauauuguguagcuucaagaacuugcaguacauuaccagcugugauucuccuga

SEQ ID NO: 576329 - RNA, 64 nt, Homo Sapiens; identical to SEQ ID NO: 140312

SEQ ID NO: 576330 - RNA, 64 nt, Homo Sapiens; identical to SEQ ID NO: 140313

SEQ ID NO: 576331 - RNA, 64 nt, Homo Sapiens; identical to SEQ ID NO: 140314

SEQ ID NO: 576332 - RNA, 64 nt, Homo Sapiens; identical to SEQ ID NO: 140315

SEQ ID NO: 576333 - RNA, 64 nt, Homo Sapiens; identical to SEQ ID NO: 140316

SEQ ID NO: 576334 - RNA, 64 nt, Homo Sapiens; identical to SEQ ID NO: 140317

SEQ ID NO: 576335 - RNA, 64 nt, Homo Sapiens; identical to SEQ ID NO: 140318

SEQ ID NO: 576336 - RNA, 64 nt, Homo Sapiens; identical to SEQ ID NO: 140319

SEQ ID NO: 576337 - RNA, 64 nt, Homo Sapiens; identical to SEQ ID NO: 140320

SEQ ID NO: 576338 - RNA, 64 nt, Homo Sapiens; identical to SEQ ID NO: 140321

SEQ ID NO: 576339 - RNA, 64 nt, Homo Sapiens; identical to SEQ ID NO: 140322

SEQ ID NO: 576340 - RNA, 64 nt, Homo Sapiens; identical to SEQ ID NO: 140323

SEQ ID NO: 576341 - RNA, 64 nt, Homo Sapiens; identical to SEQ ID NO: 140324

SEQ ID NO: 576342 - RNA, 64 nt, Homo Sapiens; identical to SEQ ID NO: 140325

SEQ ID NO: 576343 - RNA, 64 nt, Homo Sapiens; identical to SEQ ID NO: 140326

SEQ ID NO: 576344 - RNA, 64 nt, Homo Sapiens; identical to SEQ ID NO: 140327

SEQ ID NO: 576345 - RNA, 64 nt, Homo Sapiens; identical to SEQ ID NO: 140328

SEQ ID NO: 576346 - RNA, 64 nt, Homo Sapiens; identical to SEQ ID NO: 140329

SEQ ID NO: 576347 - RNA, 64 nt, Homo Sapiens; identical to SEQ ID NO: 140330

SEQ ID NO: 576348 - RNA, 64 nt, Homo Sapiens; identical to SEQ ID NO: 140331

SEQ ID NO: 576349 - RNA, 64 nt, Homo Sapiens; identical to SEQ ID NO: 140332

SEQ ID NO: 576350 - RNA, 64 nt, Homo Sapiens; identical to SEQ ID NO: 140333

SEQ ID NO: 576351 - RNA, 64 nt, Homo Sapiens; identical to SEQ ID NO: 140334

SEQ ID NO: 576352 - RNA, 64 nt, Homo Sapiens; identical to SEQ ID NO: 140335

SEQ ID NO: 576353 - RNA, 64 nt, Homo Sapiens; identical to SEQ ID NO: 140336

SEQ ID NO: 576354 - RNA, 64 nt, Homo Sapiens; identical to SEQ ID NO: 140337

SEQ ID NO: 576355 - RNA, 64 nt, Homo Sapiens; identical to SEQ ID NO: 140338

SEQ ID NO: 576356 - RNA, 64 nt, Homo Sapiens; identical to SEQ ID NO: 140339

SEQ ID NO: 576357 - RNA, 64 nt, Homo Sapiens; identical to SEQ ID NO: 201717

SEQ ID NO: 576358 - RNA, 64 nt, Homo Sapiens; identical to SEQ ID NO: 201718

SEQ ID NO: 576359 - RNA, 64 nt, Homo Sapiens; identical to SEQ ID NO: 201719

SEQ ID NO: 576360 - RNA, 64 nt, Homo Sapiens; identical to SEQ ID NO: 201720

SEQ ID NO: 576361 - RNA, 64 nt, Homo Sapiens; identical to SEQ ID NO: 201721

SEQ ID NO: 576362 - RNA, 64 nt, Homo Sapiens; identical to SEQ ID NO: 201722

SEQ ID NO: 576363 - RNA, 64 nt, Homo Sapiens; identical to SEQ ID NO: 201723

SEQ ID NO: 576364 - RNA, 64 nt, Homo Sapiens; identical to SEQ ID NO: 201724

SEQ ID NO: 576365 - RNA, 64 nt, Homo Sapiens; identical to SEQ ID NO: 201725

SEQ ID NO: 576366 - RNA, 64 nt, Homo Sapiens; identical to SEQ ID NO: 201726

SEQ ID NO: 576367 - RNA, 64 nt, Homo Sapiens; identical to SEQ ID NO: 201727

SEQ ID NO: 576368 - RNA, 64 nt, Homo Sapiens; identical to SEQ ID NO: 201728

SEQ ID NO: 576369 - RNA, 64 nt, Homo Sapiens; identical to SEQ ID NO: 201729

SEQ ID NO: 576370 - RNA, 64 nt, Homo Sapiens; identical to SEQ ID NO: 201730

SEQ ID NO: 576371 - RNA, 64 nt, Homo Sapiens; identical to SEQ ID NO: 201731

SEQ ID NO: 576372 - RNA, 64 nt, Homo Sapiens; identical to SEQ ID NO: 201732

SEQ ID NO: 576373 - RNA, 64 nt, Homo Sapiens; identical to SEQ ID NO: 201733

SEQ ID NO: 576374 - RNA, 64 nt, Homo Sapiens; identical to SEQ ID NO: 201734

SEQ ID NO: 576375 - RNA, 64 nt, Homo Sapiens; identical to SEQ ID NO: 201735

SEQ ID NO: 576376 - RNA, 64 nt, Homo Sapiens; identical to SEQ ID NO: 201736

SEQ ID NO: 576377 - RNA, 64 nt, Homo Sapiens; identical to SEQ ID NO: 201737

SEQ ID NO: 576378 - RNA, 64 nt, Homo Sapiens; identical to SEQ ID NO: 201738

SEQ ID NO: 576379 - RNA, 64 nt, Homo Sapiens; identical to SEQ ID NO: 201739

SEQ ID NO: 576380 - RNA, 64 nt, Homo Sapiens; identical to SEQ ID NO: 201740

SEQ ID NO: 576381 - RNA, 64 nt, Homo Sapiens; identical to SEQ ID NO: 201741

SEQ ID NO: 576382 - RNA, 64 nt, Homo Sapiens; identical to SEQ ID NO: 201742

SEQ ID NO: 576383 - RNA, 64 nt, Homo Sapiens; identical to SEQ ID NO: 201743

SEQ ID NO: 576384 - RNA, 64 nt, Homo Sapiens; identical to SEQ ID NO: 201744

SEQ ID NO: 576385 - RNA, 64 nt, Homo Sapiens; identical to SEQ ID NO: 201745

SEQ ID NO: 576386 - RNA, 64 nt, Homo Sapiens; identical to SEQ ID NO: 201746

SEQ ID NO: 576387 - RNA, 64 nt, Homo Sapiens; identical to SEQ ID NO: 201747

SEQ ID NO: 576388 - RNA, 64 nt, Homo Sapiens; identical to SEQ ID NO: 201748

SEQ ID NO: 576389 - RNA, 64 nt, Homo Sapiens; identical to SEQ ID NO: 201749

SEQ ID NO: 576390 - RNA, 64 nt, Homo Sapiens; identical to SEQ ID NO: 201750

SEQ ID NO: 576391 - RNA, 64 nt, Homo Sapiens; identical to SEQ ID NO: 201751

SEQ ID NO: 576392 - RNA, 64 nt, Homo Sapiens; identical to SEQ ID NO: 201752

SEQ ID NO: 576393 - RNA, 64 nt, Homo Sapiens; identical to SEQ ID NO: 201753

SEQ ID NO: 576394 - RNA, 64 nt, Homo Sapiens; identical to SEQ ID NO: 201754

SEQ ID NO: 576395 - RNA, 64 nt, Homo Sapiens; identical to SEQ ID NO: 201755

SEQ ID NO: 576396 - RNA, 64 nt, Homo Sapiens; identical to SEQ ID NO: 201756

SEQ ID NO: 576397 - RNA, 64 nt, Homo Sapiens; identical to SEQ ID NO: 201757

SEQ ID NO: 576398 - RNA, 64 nt, Homo Sapiens; identical to SEQ ID NO: 201758

SEQ ID NO: 576399 - RNA, 64 nt, Homo Sapiens; identical to SEQ ID NO: 201759

SEQ ID NO: 576400 - RNA, 64 nt, Homo Sapiens; identical to SEQ ID NO: 201760

SEQ ID NO: 576401 - RNA, 64 nt, Homo Sapiens; identical to SEQ ID NO: 201761

SEQ ID NO: 576402 - RNA, 64 nt, Homo Sapiens; identical to SEQ ID NO: 201762

SEQ ID NO: 576403 - RNA, 64 nt, Homo Sapiens; identical to SEQ ID NO: 201763

SEQ ID NO: 576404 - RNA, 64 nt, Homo Sapiens; identical to SEQ ID NO: 201764

SEQ ID NO: 576405 - RNA, 64 nt, Homo Sapiens; identical to SEQ ID NO: 201765

SEQ ID NO: 576406 - RNA, 64 nt, Homo Sapiens; identical to SEQ ID NO: 201766

SEQ ID NO: 576407 - RNA, 64 nt, Homo Sapiens; identical to SEQ ID NO: 201767

SEQ ID NO: 576408 - RNA, 64 nt, Homo Sapiens; identical to SEQ ID NO: 201768

SEQ ID NO: 576409 - RNA, 64 nt, Homo Sapiens; identical to SEQ ID NO: 201769

SEQ ID NO: 576410 - RNA, 64 nt, Homo Sapiens; identical to SEQ ID NO: 201770

SEQ ID NO: 576411 - RNA, 64 nt, Homo Sapiens; identical to SEQ ID NO: 201771

SEQ ID NO: 576412 - RNA, 64 nt, Homo Sapiens; identical to SEQ ID NO: 201772

SEQ ID NO: 576413 - RNA, 64 nt, Homo Sapiens; identical to SEQ ID NO: 201773

SEQ ID NO: 576414 - RNA, 64 nt, Homo Sapiens; identical to SEQ ID NO: 201774

SEQ ID NO: 576415 - RNA, 64 nt, Homo Sapiens; identical to SEQ ID NO: 201775

SEQ ID NO: 576416 - RNA, 64 nt, Homo Sapiens; identical to SEQ ID NO: 201776

SEQ ID NO: 576417 - RNA, 64 nt, Homo Sapiens; identical to SEQ ID NO: 201777

SEQ ID NO: 576418 - RNA, 64 nt, Homo Sapiens; identical to SEQ ID NO: 201778

SEQ ID NO: 576419 - RNA, 64 nt, Homo Sapiens; identical to SEQ ID NO: 201779

SEQ ID NO: 576420 - RNA, 64 nt, Homo Sapiens; identical to SEQ ID NO: 201780

SEQ ID NO: 576421 - RNA, 64 nt, Homo Sapiens; identical to SEQ ID NO: 201781

SEQ ID NO: 576422 - RNA, 64 nt, Homo Sapiens; identical to SEQ ID NO: 201782

SEQ ID NO: 576423 - RNA, 64 nt, Homo Sapiens; identical to SEQ ID NO: 201783

SEQ ID NO: 576424 - RNA, 64 nt, Homo Sapiens; identical to SEQ ID NO: 201784

SEQ ID NO: 576425 - RNA, 64 nt, Homo Sapiens; identical to SEQ ID NO: 201785

SEQ ID NO: 576426 - RNA, 64 nt, Homo Sapiens; identical to SEQ ID NO: 201786

SEQ ID NO: 576427 - RNA, 64 nt, Homo Sapiens; identical to SEQ ID NO: 201787

SEQ ID NO: 576428 - RNA, 64 nt, Homo Sapiens; identical to SEQ ID NO: 201788

SEQ ID NO: 576429 - RNA, 64 nt, Homo Sapiens; identical to SEQ ID NO: 201789

SEQ ID NO: 576430 - RNA, 64 nt, Homo Sapiens; identical to SEQ ID NO: 201790

SEQ ID NO: 576431 - RNA, 64 nt, Homo Sapiens; identical to SEQ ID NO: 201791

SEQ ID NO: 576432 - RNA, 64 nt, Homo Sapiens; identical to SEQ ID NO: 201792

SEQ ID NO: 576433 - RNA, 64 nt, Homo Sapiens; identical to SEQ ID NO: 201793

SEQ ID NO: 576434 - RNA, 64 nt, Homo Sapiens; identical to SEQ ID NO: 201794

SEQ ID NO: 576435 - RNA, 64 nt, Homo Sapiens; identical to SEQ ID NO: 189516

SEQ ID NO: 576436 - RNA, 64 nt, Homo Sapiens; identical to SEQ ID NO: 189517

SEQ ID NO: 576437 - RNA, 64 nt, Homo Sapiens; identical to SEQ ID NO: 284063

SEQ ID NO: 576438 - RNA, 64 nt, Homo Sapiens; identical to SEQ ID NO: 284064

SEQ ID NO: 576439 - RNA, 64 nt, Homo Sapiens; identical to SEQ ID NO: 284065

SEQ ID NO: 576440 - RNA, 64 nt, Homo Sapiens; identical to SEQ ID NO: 284066

SEQ ID NO: 576441 - RNA, 64 nt, Homo Sapiens; identical to SEQ ID NO: 284067

SEQ ID NO: 576442 - RNA, 64 nt, Homo Sapiens; identical to SEQ ID NO: 284068

SEQ ID NO: 576443 - RNA, 64 nt, Homo Sapiens; identical to SEQ ID NO: 284069

SEQ ID NO: 576444 - RNA, 64 nt, Homo Sapiens; identical to SEQ ID NO: 284070

SEQ ID NO: 576445 - RNA, 64 nt, Homo Sapiens; identical to SEQ ID NO: 284071

SEQ ID NO: 576446 - RNA, 64 nt, Homo Sapiens; identical to SEQ ID NO: 284072

SEQ ID NO: 576447 - RNA, 57 nt, Homo Sapiens; identical to SEQ ID NO: 284073

SEQ ID NO: 576448 - RNA, 64 nt, Homo Sapiens; identical to SEQ ID NO: 284074

SEQ ID NO: 576449 - RNA, 64 nt, Homo Sapiens; identical to SEQ ID NO: 284075

SEQ ID NO: 576450 - RNA, 64 nt, Homo Sapiens; identical to SEQ ID NO: 284076

SEQ ID NO: 576451 - RNA, 64 nt, Homo Sapiens; identical to SEQ ID NO: 284077

SEQ ID NO: 576452 - RNA, 64 nt, Homo Sapiens; identical to SEQ ID NO: 284078

SEQ ID NO: 576453 - RNA, 64 nt, Homo Sapiens; identical to SEQ ID NO: 284079

SEQ ID NO: 576454 - RNA, 64 nt, Homo Sapiens; identical to SEQ ID NO: 284080

SEQ ID NO: 576455 - RNA, 64 nt, Homo Sapiens; identical to SEQ ID NO: 284081

SEQ ID NO: 576456 - RNA, 64 nt, Homo Sapiens; identical to SEQ ID NO: 284082

SEQ ID NO: 576457 - RNA, 64 nt, Homo Sapiens; identical to SEQ ID NO: 284083

SEQ ID NO: 576458 - RNA, 64 nt, Homo Sapiens; identical to SEQ ID NO: 284084

SEQ ID NO: 576459 - RNA, 64 nt, Homo Sapiens; identical to SEQ ID NO: 284085

SEQ ID NO: 576460 - RNA, 64 nt, Homo Sapiens; identical to SEQ ID NO: 284086

SEQ ID NO: 576461 - RNA, 64 nt, Homo Sapiens; identical to SEQ ID NO: 284087

SEQ ID NO: 576462 - RNA, 64 nt, Homo Sapiens; identical to SEQ ID NO: 284088

SEQ ID NO: 576463 - RNA, 64 nt, Homo Sapiens; identical to SEQ ID NO: 284089

SEQ ID NO: 576464 - RNA, 64 nt, Homo Sapiens; identical to SEQ ID NO: 284090

SEQ ID NO: 576465 - RNA, 55 nt, Homo Sapiens; identical to SEQ ID NO: 284091

SEQ ID NO: 576466 - RNA, 64 nt, Homo Sapiens; identical to SEQ ID NO: 284092

SEQ ID NO: 576467 - RNA, 64 nt, Homo Sapiens; identical to SEQ ID NO: 284093

SEQ ID NO: 576468 - RNA, 64 nt, Homo Sapiens; identical to SEQ ID NO: 284094

SEQ ID NO: 576469 - RNA, 64 nt, Homo Sapiens; identical to SEQ ID NO: 284095

SEQ ID NO: 576470 - RNA, 64 nt, Homo Sapiens; identical to SEQ ID NO: 284096

SEQ ID NO: 576471 - RNA, 64 nt, Homo Sapiens; identical to SEQ ID NO: 284097

SEQ ID NO: 576472 - RNA, 64 nt, Homo Sapiens; identical to SEQ ID NO: 284098

SEQ ID NO: 576473 - RNA, 64 nt, Homo Sapiens; identical to SEQ ID NO: 284099

SEQ ID NO: 576474 - RNA, 64 nt, Homo Sapiens; identical to SEQ ID NO: 284100

SEQ ID NO: 576475 - RNA, 64 nt, Homo Sapiens; identical to SEQ ID NO: 284101

SEQ ID NO: 576476 - RNA, 64 nt, Homo Sapiens; identical to SEQ ID NO: 284102

SEQ ID NO: 576477 - RNA, 64 nt, Homo Sapiens; identical to SEQ ID NO: 284103

SEQ ID NO: 576478 - RNA, 64 nt, Homo Sapiens; identical to SEQ ID NO: 284104

SEQ ID NO: 576479 - RNA, 64 nt, Homo Sapiens; identical to SEQ ID NO: 284105

SEQ ID NO: 576480 - RNA, 64 nt, Homo Sapiens; identical to SEQ ID NO: 284106

SEQ ID NO: 576481 - RNA, 64 nt, Homo Sapiens; identical to SEQ ID NO: 284107

SEQ ID NO: 576482 - RNA, 64 nt, Homo Sapiens; identical to SEQ ID NO: 284108

SEQ ID NO: 576483 - RNA, 64 nt, Homo Sapiens; identical to SEQ ID NO: 284109

SEQ ID NO: 576484 - RNA, 64 nt, Homo Sapiens; identical to SEQ ID NO: 284110

SEQ ID NO: 576485 - RNA, 64 nt, Homo Sapiens; identical to SEQ ID NO: 284111

SEQ ID NO: 576486 - RNA, 64 nt, Homo Sapiens; identical to SEQ ID NO: 284112

SEQ ID NO: 576487 - RNA, 64 nt, Homo Sapiens; identical to SEQ ID NO: 284113

SEQ ID NO: 576488 - RNA, 64 nt, Homo Sapiens; identical to SEQ ID NO: 284114

SEQ ID NO: 576489 - RNA, 64 nt, Homo Sapiens; identical to SEQ ID NO: 284115

SEQ ID NO: 576490 - RNA, 64 nt, Homo Sapiens; identical to SEQ ID NO: 284116

SEQ ID NO: 576491 - RNA, 64 nt, Homo Sapiens; identical to SEQ ID NO: 284117

SEQ ID NO: 576492 - RNA, 64 nt, Homo Sapiens; identical to SEQ ID NO: 284118

SEQ ID NO: 576493 - RNA, 64 nt, Homo Sapiens; identical to SEQ ID NO: 284119

SEQ ID NO: 576494 - RNA, 64 nt, Homo Sapiens; identical to SEQ ID NO: 284120

SEQ ID NO: 576495 - RNA, 64 nt, Homo Sapiens; identical to SEQ ID NO: 284121

SEQ ID NO: 576496 - RNA, 64 nt, Homo Sapiens; identical to SEQ ID NO: 284122

SEQ ID NO: 576497 - RNA, 64 nt, Homo Sapiens; identical to SEQ ID NO: 284123

SEQ ID NO: 576498 - RNA, 64 nt, Homo Sapiens; identical to SEQ ID NO: 284124

SEQ ID NO: 576499 - RNA, 64 nt, Homo Sapiens; identical to SEQ ID NO: 284125

SEQ ID NO: 576500 - RNA, 64 nt, Homo Sapiens; identical to SEQ ID NO: 284126

SEQ ID NO: 576501 - RNA, 64 nt, Homo Sapiens; identical to SEQ ID NO: 284127

SEQ ID NO: 576502 - RNA, 64 nt, Homo Sapiens; identical to SEQ ID NO: 284128

SEQ ID NO: 576503 - RNA, 64 nt, Homo Sapiens; identical to SEQ ID NO: 284129

SEQ ID NO: 576504 - RNA, 64 nt, Homo Sapiens; identical to SEQ ID NO: 284130

SEQ ID NO: 576505 - RNA, 64 nt, Homo Sapiens; identical to SEQ ID NO: 21560

SEQ ID NO: 576506 - RNA, 64 nt, Homo Sapiens; identical to SEQ ID NO: 21561

SEQ ID NO: 576507 - RNA, 64 nt, Homo Sapiens; identical to SEQ ID NO: 21562

SEQ ID NO: 576508 - RNA, 64 nt, Homo Sapiens; identical to SEQ ID NO: 21563

SEQ ID NO: 576509 - RNA, 64 nt, Homo Sapiens; identical to SEQ ID NO: 21564

SEQ ID NO: 576510 - RNA, 64 nt, Homo Sapiens; identical to SEQ ID NO: 21565

SEQ ID NO: 576511 - RNA, 64 nt, Homo Sapiens; identical to SEQ ID NO: 21566

SEQ ID NO: 576512 - RNA, 64 nt, Homo Sapiens; identical to SEQ ID NO: 21567

SEQ ID NO: 576513 - RNA, 64 nt, Homo Sapiens; identical to SEQ ID NO: 21568

SEQ ID NO: 576514 - RNA, 64 nt, Homo Sapiens; identical to SEQ ID NO: 21569

SEQ ID NO: 576515 - RNA, 64 nt, Homo Sapiens; identical to SEQ ID NO: 21570

SEQ ID NO: 576516 - RNA, 64 nt, Homo Sapiens; identical to SEQ ID NO: 21571

SEQ ID NO: 576517 - RNA, 64 nt, Homo Sapiens; identical to SEQ ID NO: 21572

SEQ ID NO: 576518 - RNA, 64 nt, Homo Sapiens; identical to SEQ ID NO: 21573

SEQ ID NO: 576519 - RNA, 65 nt, Homo Sapiens
caugagcucccuggaguccgacgcggguuuucucucugggggaccugggugguccccgcuguggu

SEQ ID NO: 576520 - RNA, 65 nt, Homo Sapiens
ccucccccuccccagaaggccaagggaugugggggcugggggacugggaggccuggcagucuuca

SEQ ID NO: 576521 - RNA, 65 nt, Homo Sapiens
uggaaggaaacacgcggaucugaacagcaguaauccugggggauacggggguugggcuagauuac

SEQ ID NO: 576522 - RNA, 65 nt, Homo Sapiens
uugcccucugccugccucagcugcugccugaccggcugggggaggcacuggcgggaggccucggg

SEQ ID NO: 576523 - RNA, 65 nt, Homo Sapiens
gacguggugggcugagguuaaucagggaagguuuccugggggaggugauccuugaacuggcuccc

SEQ ID NO: 576524 - RNA, 60 nt, Homo Sapiens
ucccacggcagaagcccugaggacugacuccugggggagaacagcauucccgccgccucc

SEQ ID NO: 576525 - RNA, 65 nt, Homo Sapiens
uucccugcugacccugccccacuuccagggaaaagcugggggagguuggaccccucucacugacu

SEQ ID NO: 576526 - RNA, 65 nt, Homo Sapiens
ggauaaugacuuugcaucugcaccuggaacggggccugggggaccuggggucuggugugccaggc

SEQ ID NO: 576527 - RNA, 65 nt, Homo Sapiens
agaauccuccuggaauuucuuggagacgaaaguaucugggggauuguuggguacuagggagacug

SEQ ID NO: 576528 - RNA, 65 nt, Homo Sapiens
ugggagggggaggaaguuggcugagccauugagugcugggggaggccauccaagauggcaugaau

SEQ ID NO: 576529 - RNA, 65 nt, Homo Sapiens
acuugagcacauaacucuaugucugaucuaggaggcugggggaagagccucccauaaaaucacac

SEQ ID NO: 576530 - RNA, 65 nt, Homo Sapiens
ccuggcagagugacaaaggcucaggacggcuggcucugggggacucaggccaagccccuuggcac

SEQ ID NO: 576531 - RNA, 65 nt, Homo Sapiens
cagggacagccaggcaccugcuccucuugcccuuccugggggaagggagcugccuucugucccug

SEQ ID NO: 576532 - RNA, 65 nt, Homo Sapiens
ggucucaaaaaacaaauguguggcuaaggaguuaccugggggaaguagaaugagaggucuguugg

SEQ ID NO: 576533 - RNA, 65 nt, Homo Sapiens
uccaaagcuuuagcagcuuaauuaaaucuguuggacugggggaggagagagcuguucucuagugg

SEQ ID NO: 576534 - RNA, 65 nt, Homo Sapiens
ugcccccuaggccuaguggugaucccagugcucuacugggggaugagagaaaggcauuuuauagc

SEQ ID NO: 576535 - RNA, 65 nt, Homo Sapiens
ggucuggcugcagcuagaggacaggcaagccagcucugggggagucuuaggaacugggaguuggu

SEQ ID NO: 576536 - RNA, 65 nt, Homo Sapiens
gguuuaacugagguuuaugaauauucaaaccuuugcugggggaaagaaaugaaaguuaaugagca

SEQ ID NO: 576537 - RNA, 65 nt, Homo Sapiens
gaaguguccucuccacguaacucauuaugccccuccugggggagauugcaucuccaggacaagca

SEQ ID NO: 576538 - RNA, 65 nt, Homo Sapiens
aggucugcugcuucacuggggcccgaugacuuuggcugggggagggggccuagggccucuucuca

SEQ ID NO: 576539 - RNA, 65 nt, Homo Sapiens
acccagcugaacugccccuccaagggacaggaaggcugggggagggaguuuacaacccaagccau

SEQ ID NO: 576540 - RNA, 65 nt, Homo Sapiens
uucugcaggggcccacugaagcagaagguuuuucucugggggaaccugucucaguguugacugca

SEQ ID NO: 576541 - RNA, 65 nt, Homo Sapiens
guuccugauggggaugccugugggauggcccacaccugggggaccuggcagauggggugaguugg

SEQ ID NO: 576542 - RNA, 65 nt, Homo Sapiens
ggagacacagauguccagagugauuggagaauguccugggggaaugaaguuccuuccacaaacac

SEQ ID NO: 576543 - RNA, 65 nt, Homo Sapiens
aggccuggggacggcuuuuacuuaaaccgccaaggcugggggaagaagcucucuccucccuuucu

SEQ ID NO: 576544 - RNA, 65 nt, Homo Sapiens
aguaggguuuagccgggccccauggucacagaccccugggggaggcuuccagcucagucccacag

SEQ ID NO: 576545 - RNA, 65 nt, Homo Sapiens
cagaccccuuccccaccaggcuaggccccccacaccugggggacccccuggccccucuuuugucu

SEQ ID NO: 576546 - RNA, 65 nt, Homo Sapiens
ccuaaauccucucguaucucaccccaaaccccaaacugggggaaaaaaaguuaacucuuugugaa

SEQ ID NO: 576547 - RNA, 65 nt, Homo Sapiens
cucuuucauauucuuuuaauacaucuugaucacagcugggggaaaaaaagcuuuuuaauucuaua

SEQ ID NO: 576548 - RNA, 65 nt, Homo Sapiens
ucuugauucugcauuugaggaaggucagggugccgcugggggagcagggagcggggagggaggaa

SEQ ID NO: 576549 - RNA, 65 nt, Homo Sapiens
agcaacccugagagagacagucuugugagggagaucugggggaggcaggaagcuccucagauuuu

SEQ ID NO: 576550 - RNA, 65 nt, Homo Sapiens
uuguggaggcacccagguuguccaugcuugggauucugggggaaggagagaagggcagcucaggg

SEQ ID NO: 576551 - RNA, 65 nt, Homo Sapiens
guuagcaacugugaacagagaggucgggauuugcccugggggaggaagagaggccaaguucagag

SEQ ID NO: 576552 - RNA, 65 nt, Homo Sapiens
gguucucugauuuucguguucucugcccagaugggcugggggaguugagagugugcuuauuuuca

SEQ ID NO: 576553 - RNA, 65 nt, Homo Sapiens
augggugguggucagggccugggggcuuggccaugcugggggaauggggcucuggguuccugccu

SEQ ID NO: 576554 - RNA, 65 nt, Homo Sapiens
auggugcauucuguaaccauggagucuucuguuuccugggggaaaggggcauucaugaccugaac

SEQ ID NO: 576555 - RNA, 65 nt, Homo Sapiens
ccacuccggacacuguguuugccguaugcauguugcugggggaagcugcugugcacgacguggau

SEQ ID NO: 576556 - RNA, 65 nt, Homo Sapiens
gauacgaccggggaaaauguuguucauuuaccaaccugggggauuuaggcuuuauucaucccuuc

SEQ ID NO: 576557 - RNA, 65 nt, Homo Sapiens
cagggucaggcccccuccucgccuguggacaccagcugggggaucugcagcaaugggucccucua

SEQ ID NO: 576558 - RNA, 65 nt, Homo Sapiens
ggggggagucauaggaaaagccccacgucuuccagcugggggaugcucuaaggcuaugcaacccu

SEQ ID NO: 576559 - RNA, 65 nt, Homo Sapiens
cccaguuucucuucagacacagccgaaucuggucccugggggacccuggggcaccuuaccaccgg

SEQ ID NO: 576560 - RNA, 65 nt, Homo Sapiens
cccaggccccgggcugagcaagcaguagagugggacugggggagaccuugauggaguggggaaca

SEQ ID NO: 576561 - RNA, 65 nt, Homo Sapiens
gacugcugacccaccaagguguaccaggcacauggcugggggagguaucaggggacaaaccaggg

SEQ ID NO: 576562 - RNA, 65 nt, Homo Sapiens
agaaguagugagagaaggaauugggaccagccucucugggggacccaccagccaaccacauagcc

SEQ ID NO: 576563 - RNA, 65 nt, Homo Sapiens
aagggauaucuacuguggucacaucauggacugagcugggggaagugaagucuucuccuccauga

SEQ ID NO: 576564 - RNA, 65 nt, Homo Sapiens
cggacauggcuuggccugggguggacucagccaggcugggggagcgggcugggcagggaggcgcc

SEQ ID NO: 576565 - RNA, 65 nt, Homo Sapiens
aagacggcucccacuuccuucaaggugcacgcgagcugggggaugcucucguuuggcccucugaa

SEQ ID NO: 576566 - RNA, 65 nt, Homo Sapiens
cccucuuuucuauauuuauuucuugugcuguggggcugggggauguccagcgcugagggccaggg

SEQ ID NO: 576567 - RNA, 65 nt, Homo Sapiens
uccuucauguugaggguuuucaaucacugugcucccugggggagaacaucccacucucugaacua

SEQ ID NO: 576568 - RNA, 65 nt, Homo Sapiens
cugaucaauagagcuugguccugcaggugaaaacucugggggaugugcccaccuguccugcuucu

SEQ ID NO: 576569 - RNA, 65 nt, Homo Sapiens
gaccccucggcgccuggccuaauggcagggagcugcugggggacugggaggggaggaaugacaca

SEQ ID NO: 576570 - RNA, 65 nt, Homo Sapiens
uuugccuuguuuguaauguuaagggucagugugugcugggggacucugguaaccuuacucaaaag

SEQ ID NO: 576571 - RNA, 65 nt, Homo Sapiens
guaggaagaggagccuugccaugaguccuggagagcugggggaacggcuacacucuuccaucagc

SEQ ID NO: 576572 - RNA, 65 nt, Homo Sapiens
gcaucaaagguugaacuuuuguauuuuguauugggcugggggauauuaauaauugcuuuuucugu

SEQ ID NO: 576573 - RNA, 65 nt, Homo Sapiens
agcaauaaaccucagcccucaucuccuguuggaugcugggggagaggccucgggugcccucucac

SEQ ID NO: 576574 - RNA, 65 nt, Homo Sapiens
gcagggggagaugggugaugucauuuccagguuuucugggggaguuccuuaguuagccacuugug

SEQ ID NO: 576575 - RNA, 65 nt, Homo Sapiens
aagacauccucaagaaaacagggauuuaaggacuucugggggacccuggaaggcaugggguggcu

SEQ ID NO: 576576 - RNA, 65 nt, Homo Sapiens
cgucaugacugccaaucucaugugugcaaugauggcugggggaaugauugaugcuacuguuggua

SEQ ID NO: 576577 - RNA, 65 nt, Homo Sapiens
ucaagggagggccuaaagcagcgcaagggaugggccugggggaacccagguggccccugaauucu

SEQ ID NO: 576578 - RNA, 65 nt, Homo Sapiens
guuuuugcuggaucugcuccuuuguaaaauggccccugggggaguugucuuccccugcuccgcau

SEQ ID NO: 576579 - RNA, 65 nt, Homo Sapiens
caacacugggauggucuguguugcacgcacacuaccugggggagugugaggggacguccuugguc

SEQ ID NO: 576580 - RNA, 65 nt, Homo Sapiens
gguggggggaacaacuggcucccuuguuucuugggcugggggagggguuucuuuuucuuuaaucu

SEQ ID NO: 576581 - RNA, 65 nt, Homo Sapiens
ucuuaauuagauaaaaguuccucagauuuuauaaacugggggauuaaaguucacuggaaauugcc

SEQ ID NO: 576582 - RNA, 65 nt, Homo Sapiens
gucaccgccuuugcugccuccugggcccacagagccugggggaguacugugcuucagggguaggg

SEQ ID NO: 576583 - RNA, 65 nt, Homo Sapiens
ggacucuccccugugagacuggcugguggcaggagcugggggagaagccaccacccagcauccca

SEQ ID NO: 576584 - RNA, 65 nt, Homo Sapiens
guuucacuguuacaucaccaacauaucccugguuucugggggaggguguuuacauuuauaggacc

SEQ ID NO: 576585 - RNA, 65 nt, Homo Sapiens
aaaguagauagacagaaaauugugcagguccuagccugggggagguagucauaggaaacauauua

SEQ ID NO: 576586 - RNA, 65 nt, Homo Sapiens
aguugcucacugucaaauacggauuagucaaccaucugggggagaaaugaaauuguucacuugag

SEQ ID NO: 576587 - RNA, 65 nt, Homo Sapiens
cagcugggaugggagccagcccaccucugaagaugcugggggaggcccugaaagucuuguguacc

SEQ ID NO: 576588 - RNA, 65 nt, Homo Sapiens
aagggcaaauaugcuuguuagguaguugagcagcucugggggaauaaaauauuuuaaaaauucuu

SEQ ID NO: 576589 - RNA, 65 nt, Homo Sapiens
uguguuccccacagggagaggcucuggggggauggcugggggaugcagagccucagagcaaauaa

SEQ ID NO: 576590 - RNA, 65 nt, Homo Sapiens
aagagggggaccugccaccagggagcuuccuggcucugggggacccaggugggacuuagcaguga

SEQ ID NO: 576591 - RNA, 65 nt, Homo Sapiens
uuuuuuuuuugcuuguuacucaucuguugaccuaccugggggaaguagcacccuugcauuucaaa

SEQ ID NO: 576592 - RNA, 65 nt, Homo Sapiens
ucugugaggggagagguuuuacaagccagacaggccugggggacugcaguccccaaggagacccu

SEQ ID NO: 576593 - RNA, 65 nt, Homo Sapiens
uucauacuuuugguccauguaagugcuacccguugcugggggaggagucaugguuuauuuggaaa

SEQ ID NO: 576594 - RNA, 65 nt, Homo Sapiens
acccaccgcccccaaucuaucuuggcucacucgcucugggggaagcuagcugccaugcuaugagc

SEQ ID NO: 576595 - RNA, 65 nt, Homo Sapiens
ugagaaccagugcuuauguggugugcccuuggcuucugggggagagcuuggggcagcagaggccc

SEQ ID NO: 576596 - RNA, 65 nt, Homo Sapiens
uacuaguuacaaaucacaguauaagauuuaagugccugggggaaggauacaauuuuuagaaauua

SEQ ID NO: 576597 - RNA, 65 nt, Homo Sapiens
gcccggaguccucccuaggagaggggcucgaugggcugggggaaggagccugaagguugccccug

SEQ ID NO: 576598 - RNA, 65 nt, Homo Sapiens
ucaguaggggcccccuccccuuggugugccuaugccugggggaggaucugccugucuaugugcug

SEQ ID NO: 576599 - RNA, 65 nt, Homo Sapiens
gcccagccucccaccuguuucuguggacaaaccggcugggggacuaccuccacugcccccagggg

SEQ ID NO: 576600 - RNA, 65 nt, Homo Sapiens
gggauggggguauguguggacauguugaagaaaaucugggggauuucuuccaagaacagaagcgg

SEQ ID NO: 576601 - RNA, 65 nt, Homo Sapiens
gaggcuggcccucauucgggccuggugcucuucugcugggggacucggcaugcuggucuuuccga

SEQ ID NO: 576602 - RNA, 65 nt, Homo Sapiens
aagcaucugcuccaaggaggucucccggccccucgcugggggagaucccggcaccgccgccgucg

SEQ ID NO: 576603 - RNA, 65 nt, Homo Sapiens
cuggcauaauucggcuauaauaagcagucaguccccugggggaauuagcauugugugauaagcac

SEQ ID NO: 576604 - RNA, 65 nt, Homo Sapiens
ucugacuugaggcccaucucuugucuuaaguugcacugggggauuggaaggugacuucucucugu

SEQ ID NO: 576605 - RNA, 65 nt, Homo Sapiens
ugcccccagagccacccacuggcucuggacaagcacugggggacgucuggcucugugggucccug

SEQ ID NO: 576606 - RNA, 65 nt, Homo Sapiens
gaagacuuguucucucuuucuugucagagcaggagcugggggagguuccaggguucuuguggcug

SEQ ID NO: 576607 - RNA, 65 nt, Homo Sapiens
gcaccugugaauuaccugaggcugccccgccuccacugggggauccugcagggccagaaguucag

SEQ ID NO: 576608 - RNA, 65 nt, Homo Sapiens
uggcuugaguuucucaaaagaaacaggaaugugagcugggggagcaagaaaacaaaacuggacag

SEQ ID NO: 576609 - RNA, 65 nt, Homo Sapiens
gacagcggcucaggagugggaccccaaucccaugccugggggagaugcugacaugagccucagag

SEQ ID NO: 576610 - RNA, 65 nt, Homo Sapiens
ugccccuuguugguacauuccagaggcgcaggggccugggggauaugaagcuagggaagccccug

SEQ ID NO: 576611 - RNA, 65 nt, Homo Sapiens
ugcagugagccaugaguaugccacugcacuccagccugggggacagagcaagacccugccucaaa

SEQ ID NO: 576612 - RNA, 65 nt, Homo Sapiens
cccucaggcagcaugcuuagggacaacucuguggccugggggacaucugugucacaguauaggau

SEQ ID NO: 576613 - RNA, 65 nt, Homo Sapiens
cacaccaagaacagcuuuugagucuguauccuccacugggggaagugcucccaguucagaacaag

SEQ ID NO: 576614 - RNA, 65 nt, Homo Sapiens
ucccagcgaugcgucagaucuuacguggcuuccugcugggggagauggccuucacccacgggaug

SEQ ID NO: 576615 - RNA, 65 nt, Homo Sapiens
ucgacauugagccuucgaguggccagcuucacucucugggggagugcaggguggacaucaccuug

SEQ ID NO: 576616 - RNA, 65 nt, Homo Sapiens
ccuguaggaaauggugaagcauagcucugggucuccugggggagaccaggcuuggcugcgggaga

SEQ ID NO: 576617 - RNA, 65 nt, Homo Sapiens
gcagugaacccccucagaucaguagaauauaguaucugggggagaagacuuacuuccuucagggc

SEQ ID NO: 576618 - RNA, 65 nt, Homo Sapiens
gagcuguagacguacgcucaggcgcuccugcuguccugggggagagaagguucgccccuccccga

SEQ ID NO: 576619 - RNA, 65 nt, Homo Sapiens
ugaggcgacuagggcaccauacucacuuuccagggcugggggaagggggacgcaggaucaucccc

SEQ ID NO: 576620 - RNA, 65 nt, Homo Sapiens
cacccagaguagccaugaggaggcagagagggucacugggggacacuguggcagcaggagggacu

SEQ ID NO: 576621 - RNA, 65 nt, Homo Sapiens
cuccagcagacucuccagcccucuuccuccuuccucugggggaggagggguuccugagggaccug

SEQ ID NO: 576622 - RNA, 65 nt, Homo Sapiens
cugguguucccaugcacagggccauucaggaagggcugggggaguguguguggcaauaaagcuug

SEQ ID NO: 576623 - RNA, 65 nt, Homo Sapiens
ugcagaaugcagucaucagaccugaaaaaacaacacugggggagggggacggugaaggccaaguu

SEQ ID NO: 576624 - RNA, 65 nt, Homo Sapiens
aucuauuuuguuuaccuacuguaucaaaggggagucugggggagaaugguaguauuuuuuuuuuu

SEQ ID NO: 576625 - RNA, 65 nt, Homo Sapiens
auccugcugccaaggguggacacggcugcagacuucugggggaauugucgccuccugcucuuuug

SEQ ID NO: 576626 - RNA, 65 nt, Homo Sapiens
ccaaccugacaguccaggagauggacuggcuggugcugggggagcugcagauggcccuggagugg

SEQ ID NO: 576627 - RNA, 65 nt, Homo Sapiens
cccucucaacaguggggucgggggcccacccccagcugggggaccccaugcaggcugaugggccc

SEQ ID NO: 576628 - RNA, 65 nt, Homo Sapiens
agacccuuggaaaaguccucgggacuccccagggccugggggaggcagggccugcccauccagaa

SEQ ID NO: 576629 - RNA, 65 nt, Homo Sapiens
aaaaaaaagaaaaaaccucauaguggauuccagggcugggggaaagcaauagaaugaaccagaac

SEQ ID NO: 576630 - RNA, 65 nt, Homo Sapiens
gagcccagagaacagcgaagggaggcccuccugugcugggggaauccuguggaaugagugugcau

SEQ ID NO: 576631 - RNA, 65 nt, Homo Sapiens
ggggggccauuuccuuuucugccccucaccuugggcugggggacuauuacccacccgaccuggcu

SEQ ID NO: 576632 - RNA, 65 nt, Homo Sapiens
ggcauggggcaggggcccagggcacugccagguagcugggggaguagggggcaccccaaagaggg

SEQ ID NO: 576633 - RNA, 65 nt, Homo Sapiens
caaauaaagccugcucuccccuccccagaucuguccugggggaugaccccaaaucccccgacucc

SEQ ID NO: 576634 - RNA, 65 nt, Homo Sapiens
agccaagcccucaccccacaagaucacucugugcccugggggaggggaacgggucacccugcuga

SEQ ID NO: 576635 - RNA, 65 nt, Homo Sapiens
caggcaggggaagggcagagugcccggcucauggucugggggaugacccugaaugcauuggccgg

SEQ ID NO: 576636 - RNA, 65 nt, Homo Sapiens
ggaggccgccagcccggagggcggccaagcacaaacugggggagacaagagccccgugcauccag

SEQ ID NO: 576637 - RNA, 65 nt, Homo Sapiens
cugaggaguucagacugugcgggaagggagccacccugggggaguaaauuuaauggcgacuuggg

SEQ ID NO: 576638 - RNA, 65 nt, Homo Sapiens
aagagaaaagaaaugguuuuuugccuugcaugaugcugggggaaaauuguauuugugguguugcc

SEQ ID NO: 576639 - RNA, 65 nt, Homo Sapiens
uuaacucuugaccuguaugcagaaauugaucuucccugggggacuguuccugucuucuguuuuau

SEQ ID NO: 576640 - RNA, 65 nt, Homo Sapiens
gggagccgcagcagcuccccggugggggucggggccugggggacucauagcuggggguugggggu

SEQ ID NO: 576641 - RNA, 65 nt, Homo Sapiens
gggugcuccuuaaauauauaaguaaucauacucaacugggggaaguguauuacugcuucccauug

SEQ ID NO: 576642 - RNA, 65 nt, Homo Sapiens
uccugcuggucggggcccaauacaccuucaaugggcugggggacuccaccuuggauggugucagu

SEQ ID NO: 576643 - RNA, 65 nt, Homo Sapiens
ccaaacagccuguccugcaaaaagaagaccuaggacugggggaaccaaaggaaagacaacugggg

SEQ ID NO: 576644 - RNA, 65 nt, Homo Sapiens
ugaggucagcacuugggcccacugacagugacugacugggggagaagguccugcagcccccuucc

SEQ ID NO: 576645 - RNA, 65 nt, Homo Sapiens
ccacccugccccuuguccucucagagccucagcuucugggggagacaugcucuccccacaggggg

SEQ ID NO: 576646 - RNA, 65 nt, Homo Sapiens
ggucacugcuacaccuuagcagcucuuccccuuuccugggggaugugcacggcagcuugagccug

SEQ ID NO: 576647 - RNA, 65 nt, Homo Sapiens
ccugucacguggucaaggcccggccccaucagaggcugggggaggcggcacauuggcaguguguc

SEQ ID NO: 576648 - RNA, 65 nt, Homo Sapiens
agaaauaaacauaagacguauguaaacaaaaacaacugggggaaucaaaucaaacaguuggauuc

SEQ ID NO: 576649 - RNA, 65 nt, Homo Sapiens
ugcuuugucagagauggguguggauuuagguuauacugggggagaacuuuucucagcacagauuc

SEQ ID NO: 576650 - RNA, 65 nt, Homo Sapiens
ugcguguuguauucagcacuaaaaaauggugggagcugggggagaaugaagacuguuaaaugaaa

SEQ ID NO: 576651 - RNA, 65 nt, Homo Sapiens
aacauguggauaggcuauagcuguucagaggucuccugggggagcuuaaaacgggggaaacacug

SEQ ID NO: 576652 - RNA, 65 nt, Homo Sapiens
cuuccuaguaauuuugacuuggauuauuuucuagccugggggaugggguucauauguguuguugu

SEQ ID NO: 576653 - RNA, 65 nt, Homo Sapiens
gcaaagaguuaauauauagaaggguaccuugaacacugggggaggggacauugaacaaguuguuu

SEQ ID NO: 576654 - RNA, 65 nt, Homo Sapiens
ggauaaagaccuuccagcuccuguguucuagaccucugggggauaagggaguccaggguggauga

SEQ ID NO: 576655 - RNA, 65 nt, Homo Sapiens
acuuaugagcaauacucuguggaggucugguggggcugggggagcacccaggcggaucugcaagc

SEQ ID NO: 576656 - RNA, 65 nt, Homo Sapiens
ccgggagggcagagccagaagaaggcucauuagaccugggggacccaaagggucuggccucuuug

SEQ ID NO: 576657 - RNA, 65 nt, Homo Sapiens
auucacuguguuauuugguuuaaaucaaagugauucugggggaagcuaugcucuuucaguggaua

SEQ ID NO: 576658 - RNA, 65 nt, Homo Sapiens
ccuuuuagaggucuuacugcaauaagaaguaaugccugggggacgguaauccuaauaggacgucc

SEQ ID NO: 576659 - RNA, 65 nt, Homo Sapiens
gggggccgcuggaggaagggcagccgacccggccgcugggggaagugccaggggcccggggcacc

SEQ ID NO: 576660 - RNA, 65 nt, Homo Sapiens
uagcugucccaggcgucacaacccauccucccaggcugggggagaaaggaccuccuggaacugac

SEQ ID NO: 576661 - RNA, 65 nt, Homo Sapiens
ugcuuccuggaguggauguggcccagagaaggaggcugggggaucaccagccccaaggucccgaa

SEQ ID NO: 576662 - RNA, 65 nt, Homo Sapiens
cuuaacagagcguggaagggcugccuuucccccuucugggggagaaacugugcuacugaagggaa

SEQ ID NO: 576663 - RNA, 65 nt, Homo Sapiens
gagcgagacuccaucucaaaccacugcacuccagccugggggacaugcagugagccgagauggcg

SEQ ID NO: 576664 - RNA, 65 nt, Homo Sapiens
uuugugucucaguccuagaaccauuagcagaaacucugggggaaccaaaccaccuguuuccccuu

SEQ ID NO: 576665 - RNA, 65 nt, Homo Sapiens
agccuggguuggguuuagaaauacgggauguaccccugggggaaagguuuggaaauaaguggaaa

SEQ ID NO: 576666 - RNA, 65 nt, Homo Sapiens
uaaaggaauuccccguaaggcagcacucaccuggccugggggaauagcuguugucaucacugagu

SEQ ID NO: 576667 - RNA, 65 nt, Homo Sapiens
cagaugaauguauuuauuugggagaccgggguauccugggggacccaauguaggagcugccuugg

SEQ ID NO: 576668 - RNA, 65 nt, Homo Sapiens
cccuucuccccugugccguaguuugucuccugggacugggggaggaguccgaggugggguugguu

SEQ ID NO: 576669 - RNA, 65 nt, Homo Sapiens
uauccccauccucugccucaucguuccccugagcacugggggacagacccucacccccacccugg

SEQ ID NO: 576670 - RNA, 65 nt, Homo Sapiens
ggguguuggggggcccccuuccaugacucuguccccugggggagguaggacagggcugggcuucc

SEQ ID NO: 576671 - RNA, 65 nt, Homo Sapiens
aacuccaagcacuacauuuuggcggcugccggccucugggggagguggcaguuaugcuguuacua

SEQ ID NO: 576672 - RNA, 65 nt, Homo Sapiens
ggcccagccaccuccucagccccaugugaugcucccugggggagcccuacuccccuugcuacaug

SEQ ID NO: 576673 - RNA, 65 nt, Homo Sapiens
gaggcagccaugggaaggagcccaggggagcuggccugggggagcgaagcccauguucgcuuccu

SEQ ID NO: 576674 - RNA, 65 nt, Homo Sapiens
gggcccugccccccucccuuccgcuccugcccagccugggggaaggagaaaggaggggagaaagc

SEQ ID NO: 576675 - RNA, 65 nt, Homo Sapiens
caaucccagugcugcaaucacacauccauucugcccugggggacccuggagccuacuugugcgcu

SEQ ID NO: 576676 - RNA, 57 nt, Homo Sapiens; identical to SEQ ID NO: 284073

SEQ ID NO: 576677 - RNA, 65 nt, Homo Sapiens
agccacaaaguaaacuucauuuucaggcaguguuucugggggagguuauggagggaagaaaaaag

SEQ ID NO: 576678 - RNA, 65 nt, Homo Sapiens
ucuucuuugugaaccugugaguacuccacaguuuacugggggaaaaggcuucaguaaagcagagg

SEQ ID NO: 576679 - RNA, 65 nt, Homo Sapiens
cgcacagcagugaucaagugucaucccuuacgugacugggggaugucuguccuaaaagcugacug

SEQ ID NO: 576680 - RNA, 65 nt, Homo Sapiens
cugaccguaaguaaaaacacacagaauuguguugacugggggaggugaaucacaaaaaaguuacg

SEQ ID NO: 576681 - RNA, 65 nt, Homo Sapiens
ccagcugagucugaauucugcauccugggguugcccugggggauagggacagaccagcccuuccc

SEQ ID NO: 576682 - RNA, 65 nt, Homo Sapiens
aauucugucauuccuaaaacacacacagccugucccugggggaguugugagaguggcuuucuacc

SEQ ID NO: 576683 - RNA, 65 nt, Homo Sapiens
cuccuccccacccuaaaggguuugcagaugccuuccugggggauaucaugauuacaauuuuuucc

SEQ ID NO: 576684 - RNA, 65 nt, Homo Sapiens
gguggccagcccauuuucugugggucucagaggagcugggggagcuccuagccucagcccccagc

SEQ ID NO: 576685 - RNA, 65 nt, Homo Sapiens
auagcuccccaagagcuggcgagaacuuaacccaccugggggaaacauccuguuguauacuagga

SEQ ID NO: 576686 - RNA, 65 nt, Homo Sapiens
gcagggaggaggcacuucuuaggcagggaguaauccugggggacaggauguggggagaguggaag

SEQ ID NO: 576687 - RNA, 65 nt, Homo Sapiens
agauucccacccaauucaaaaaucuguuuuucuaacugggggaaaucaguagcacaaguuauuua

SEQ ID NO: 576688 - RNA, 65 nt, Homo Sapiens
cagugagaccuugucuuuaaccacugcauuucagccugggggauaugcagugagccaugaucauu

SEQ ID NO: 576689 - RNA, 65 nt, Homo Sapiens
gagcaagacucuaucuccaaccauugcacuccagccugggggacaugcagugagccaagaucacg

SEQ ID NO: 576690 - RNA, 65 nt, Homo Sapiens
auacccagugucuaccuucaccccaucgccacauccugggggagcguagccagggcggccgggcg

SEQ ID NO: 576691 - RNA, 65 nt, Homo Sapiens
agcagggcugagggggugcagcuugcugguguucacugggggagggccugugggcacacauggca

SEQ ID NO: 576692 - RNA, 65 nt, Homo Sapiens
auguuuaggacuucaagaucacacuugugggcaaucugggggagccacaacuuuucaugaagugc

SEQ ID NO: 576693 - RNA, 65 nt, Homo Sapiens
ccuugucccagauacucuaaaugugaauguaugagcugggggagucaacccagcccaccaugccu

SEQ ID NO: 576694 - RNA, 65 nt, Homo Sapiens
gggccuucccagccagccagcaggagaggcaagaacugggggaacacaggaaccuaggggaggag

SEQ ID NO: 576695 - RNA, 65 nt, Homo Sapiens
uggccaugugggggcagcaggggccugggccauagcugggggaggccagacccugagggcuuugc

SEQ ID NO: 576696 - RNA, 65 nt, Homo Sapiens
caucaccaacuguccccugcgaggagaaaucacuccugggggagaaccacugacccaaaugaauu

SEQ ID NO: 576697 - RNA, 65 nt, Homo Sapiens
aagaagaggcucaaaugcuguccccggcagcuuuccugggggacuagagcuccuucuggccaugu

SEQ ID NO: 576698 - RNA, 65 nt, Homo Sapiens
aagccagccuuggcccugcagccuccaccucgccgcugggggaccaacagguugcuuacagcuuu

SEQ ID NO: 576699 - RNA, 65 nt, Homo Sapiens
aauagaaccaaaaacgccagucaugggaggcagagcugggggagcgaggcugacaaugacuccug

SEQ ID NO: 576700 - RNA, 65 nt, Homo Sapiens
agccucagccccuagccuggccucuuugcauggggcugggggagauggggcgcugggagugagug

SEQ ID NO: 576701 - RNA, 65 nt, Homo Sapiens
uuuauguacaaacauguuguuuguuuuauuuggggcugggggagguauaugaugagcagacuucu

SEQ ID NO: 576702 - RNA, 57 nt, Homo Sapiens
cgccuccugagcgagacuagggcugggcugggggagggcagggccggacggagugga

SEQ ID NO: 576703 - RNA, 65 nt, Homo Sapiens
aauggccugcuuuaagggugcagccccucgcccgucugggggauggagggggguggcauugguuc

SEQ ID NO: 576704 - RNA, 65 nt, Homo Sapiens
gcugccaagcaucaguguuagggcuggggcucagccugggggagccuacuggggacugagccccc

SEQ ID NO: 576705 - RNA, 65 nt, Homo Sapiens
gcuugaagucaggaguucaauuuagaaggcugaggcugggggauucaugccuguaaacccagggc

SEQ ID NO: 576706 - RNA, 65 nt, Homo Sapiens
ccgcgggagccugugaauguucggaugccgcuguccugggggagcuugcagaagaguaaacacuc

SEQ ID NO: 576707 - RNA, 65 nt, Homo Sapiens
agugggccuccuuagggagauuccccccuggcuuucugggggaggcccugggugaugagcagcuu

SEQ ID NO: 576708 - RNA, 65 nt, Homo Sapiens
cguuucugccacccugggugugggcagcccaacugcugggggagacagaggccugguggcccugc

SEQ ID NO: 576709 - RNA, 65 nt, Homo Sapiens
gacggccauggcacuuggggugggcucgggacgggcugggggaggaagccccggggggcagcagg

SEQ ID NO: 576710 - RNA, 65 nt, Homo Sapiens
uauacaaacuaauauauuuuuuccugugagacuuccugggggaaagccgcacagguguccugugc

SEQ ID NO: 576711 - RNA, 65 nt, Homo Sapiens
aagccauaucaugcuaaaauuuuauuuguuguuuucugggggaaauuguguuugcuuggugcugg

SEQ ID NO: 576712 - RNA, 65 nt, Homo Sapiens
uuccccugagcaaaacaaacugaggucuuagaacucugggggauaugaaucuuuggggguugguu

SEQ ID NO: 576713 - RNA, 65 nt, Homo Sapiens
acaggucccucugcaaaacuuaagcucccaagagccugggggaucuauggaggagggagcagaug

SEQ ID NO: 576714 - RNA, 65 nt, Homo Sapiens
agggcagacggccccugccucagaccaggagauagcugggggacaggagagacccucccacccag

SEQ ID NO: 576715 - RNA, 65 nt, Homo Sapiens
ggccaaagcagggacaguggggcuggacaaggggacugggggagggacuaacucagauggugcuc

SEQ ID NO: 576716 - RNA, 65 nt, Homo Sapiens
gguagcugcuaucuuugagaggauggggggggggacugggggagguggcacagaaauuguuuggg

SEQ ID NO: 576717 - RNA, 65 nt, Homo Sapiens
agccaggcccugaggaacagggugucaccuccugccugggggaagagccccaggacaagugagcu

SEQ ID NO: 576718 - RNA, 65 nt, Homo Sapiens
ggguuuuucuuuuuauuuuugaggcacuuuacagacugggggaggcaccuuaacucacccaccac

SEQ ID NO: 576719 - RNA, 65 nt, Homo Sapiens
gugauggggcgggggucccccauucuggccgguaacugggggaaggccaccgcaggggcccucca

SEQ ID NO: 576720 - RNA, 65 nt, Homo Sapiens
auauaugucuuaguggacagcaguuugcccaggaacugggggaucugucugcagugaauguucaa

SEQ ID NO: 576721 - RNA, 65 nt, Homo Sapiens
gacuguugugggaacgucccugcaugaagggcagccugggggacaaaagcgcagugcaugcuggg

SEQ ID NO: 576722 - RNA, 65 nt, Homo Sapiens
ggaugcuagccaucuccaggcuucuuucuucugcacugggggacuugcccauuugggaaacugag

SEQ ID NO: 576723 - RNA, 65 nt, Homo Sapiens
agacugugaagcaggaagacuuuccagcugcuuuccugggggauccuuccuucacaugcucuugu

SEQ ID NO: 576724 - RNA, 65 nt, Homo Sapiens
ugaaaacucuaaaaagccauugaugagauguauagcugggggacaaaacauaaagccaucaagca

SEQ ID NO: 576725 - RNA, 65 nt, Homo Sapiens
aguacacucacuagggggcagggcgcugcugguuccugggggacugggugggaagggugguggga

SEQ ID NO: 576726 - RNA, 65 nt, Homo Sapiens
cccugacaucccuuuccacugugugugugaccaugcugggggagggggacucugcuuggaauuaa

SEQ ID NO: 576727 - RNA, 65 nt, Homo Sapiens
acuuccugaagauggagccucaggagguggagucccugggggagaccuaugacuucgacagcauc

SEQ ID NO: 576728 - RNA, 65 nt, Homo Sapiens
gugguacugccacucugcagguggagcgggugacucugggggaccauuaagaccuccagaccggg

SEQ ID NO: 576729 - RNA, 65 nt, Homo Sapiens
cucuucugaaauaaugcauccaaaggguugauauucugggggaggucacugcagaaggauggaac

SEQ ID NO: 576730 - RNA, 65 nt, Homo Sapiens
uggcacaggcucugcuagguuccggacacaggcuucugggggaagggucucccuuggccaucacg

SEQ ID NO: 576731 - RNA, 65 nt, Homo Sapiens
agaaagcuuuuugacugugaaggcagaggucagcacugggggaaacuugcugguggucucuccca

SEQ ID NO: 576732 - RNA, 65 nt, Homo Sapiens
uacaugcacacacuugcauacauauauauuuuuggcugggggagugugaguuuugccuuucuaag

SEQ ID NO: 576733 - RNA, 65 nt, Homo Sapiens
gccacgugaaaggcagcucuagacaucaaccaguccugggggaggggagugggaaccgggcacaa

SEQ ID NO: 576734 - RNA, 65 nt, Homo Sapiens
uuaacagccuuuagaagccgcugcugaaauugauacugggggaaggguuccccuuccuucuagag

SEQ ID NO: 576735 - RNA, 65 nt, Homo Sapiens
gccgcaccugcagcuccagggaguuaacucuucuucugggggacugagaacuguagaaagccaca

SEQ ID NO: 576736 - RNA, 65 nt, Homo Sapiens
gagaugcuuccgaccuuucaggugacgcaggaacacugggggagucugaaugauuggggugaaga

SEQ ID NO: 576737 - RNA, 65 nt, Homo Sapiens
gagggaggcugucgucgcccccaggaaagacgggccugggggaggcgggacagugggagaggcgc

SEQ ID NO: 576738 - RNA, 65 nt, Homo Sapiens
cggccugggucuugcuggacgaguguggccuagagcugggggaggacacuccccacgugugcugg

SEQ ID NO: 576739 - RNA, 65 nt, Homo Sapiens
cuccaggcccagcggaugcuggcacccaagcgcagcugggggaccccucagcuccgucucagagu

SEQ ID NO: 576740 - RNA, 65 nt, Homo Sapiens
ugugugucgugcuuuuuacccaucuugggaaaguccugggggacggcagcggccuccuguagcac

SEQ ID NO: 576741 - RNA, 65 nt, Homo Sapiens
ccccagccucccacccugguucccgcaaagugccucugggggacccucccacccuggucccaguu

SEQ ID NO: 576742 - RNA, 65 nt, Homo Sapiens
cuaggacugagacccugggugggugcccgcaggggcugggggaugucagguggauggaagguucu

SEQ ID NO: 576743 - RNA, 65 nt, Homo Sapiens
guguccaccccgaucaagaaugccuugucccuguucugggggaagcugguacuggacuaucuacc

SEQ ID NO: 576744 - RNA, 65 nt, Homo Sapiens
gaaaagaauuuuuuaaaaaaagauuaagauuuuaucugggggaaaggcuaacagucuagugcaaa

SEQ ID NO: 576745 - RNA, 65 nt, Homo Sapiens
uucagcgaagagcugugcucuugaugcagggaacccugggggacuuucaauaacccuguaguggc

SEQ ID NO: 576746 - RNA, 65 nt, Homo Sapiens
cugagggugagggaacagccaggaggaagcuggcgcugggggagggccuggcugcagagaggcgg

SEQ ID NO: 576747 - RNA, 65 nt, Homo Sapiens
gggauugggaugggcagaaucaucucaagcuucuccugggggaugcuuuagucuccaauauggag

SEQ ID NO: 576748 - RNA, 65 nt, Homo Sapiens
agcccugcagaccacucugaguucugccuuguccacugggggaccgugcuggcucaggguucauc

SEQ ID NO: 576749 - RNA, 65 nt, Homo Sapiens
gaguuuguacauuuuccauuucggggccagagcugcugggggaccgggcccgggacuguccguuc

SEQ ID NO: 576750 - RNA, 65 nt, Homo Sapiens
cugcaaccucaaaggagcaagccuugaaacaguugcugggggaaguggccagaguagagaugcug

SEQ ID NO: 576751 - RNA, 65 nt, Homo Sapiens
acccccauaguuguauaaaggucauagugaagaagcugggggaagacugcuucagccagauccug

SEQ ID NO: 576752 - RNA, 65 nt, Homo Sapiens
ccacagcaagauucuuucauucgucuccuccuagccugggggaccaggcucgaacugacccugga

SEQ ID NO: 576753 - RNA, 65 nt, Homo Sapiens
auuuuuaaaaguuaaggggcaagcagcauugcauucugggggaacgauccuggccacagccgcca

SEQ ID NO: 576754 - RNA, 65 nt, Homo Sapiens
gagcucccgccuugcgggcagugcuaaagguggagcugggggauuuuccugggaaugauuugagg

SEQ ID NO: 576755 - RNA, 65 nt, Homo Sapiens
uggcggcugguguuggucagaugcaccugugugcacugggggagggaugguuugggcaggugcag

SEQ ID NO: 576756 - RNA, 65 nt, Homo Sapiens
cucaccggaggcccggugaccacggaacucaccgucugggggaggaggagagaaggaaggggugg

SEQ ID NO: 576757 - RNA, 65 nt, Homo Sapiens
cccagccagcucugccucucucagggccuggaguccugggggagcucagccagcucugccuuucu

SEQ ID NO: 576758 - RNA, 65 nt, Homo Sapiens
acugggccacguacaagcagggcuucggcagucggcugggggaguucuggcuggggaaugacaac

SEQ ID NO: 576759 - RNA, 65 nt, Homo Sapiens
cucacccagcacccugcccccguuuguucaguuaccugggggaacagcugaggaggggugggggc

SEQ ID NO: 576760 - RNA, 65 nt, Homo Sapiens
gaggaaggccuccugagggagccagcagggaagaucugggggacaggcuaggguggucagaggaa

SEQ ID NO: 576761 - RNA, 65 nt, Homo Sapiens
aaaaaugugaacuaacuuauacuguaacuuaagugcugggggaaacaaaagcacauuagagacua

SEQ ID NO: 576762 - RNA, 65 nt, Homo Sapiens
gcaacagagaaagaggaaaguuuauuuagugcaaucugggggaugguaggagauguuuaggucuc

SEQ ID NO: 576763 - RNA, 65 nt, Homo Sapiens
caccccucggccauucccuccucaaagguggggagcugggggagccuuucccagccugagagaug

SEQ ID NO: 576764 - RNA, 65 nt, Homo Sapiens
aggugggaagggccaccagguagcccuucuccacucugggggaggcuggcugugaccccucaggc

SEQ ID NO: 576765 - RNA, 65 nt, Homo Sapiens
gcugaggaugggccuagcaguggggccugggugggcugggggacaagcaguauucuccuggaucc

SEQ ID NO: 576766 - RNA, 65 nt, Homo Sapiens
gggguggggggugguaguggggcauccuuccaaaccugggggacgccuggccuugcuggaaugga

SEQ ID NO: 576767 - RNA, 65 nt, Homo Sapiens
gguguuuugugaaagugaugacuuugagauuuuugcugggggagguuguaaaauuuuuugugagc

SEQ ID NO: 576768 - RNA, 65 nt, Homo Sapiens
cgugucacuccugggccaugaaugggcucuggcugcugggggagccgugaccugucuggcucagg

SEQ ID NO: 576769 - RNA, 65 nt, Homo Sapiens
agggggucucuggagaugucucuacccaggggugucugggggacauugugaagggucagacacag

SEQ ID NO: 576770 - RNA, 65 nt, Homo Sapiens
cugggagugagugagugagagaggggacccccauccugggggauggggaaguguccugagugaag

SEQ ID NO: 576771 - RNA, 65 nt, Homo Sapiens
ugcuggcggccucuuccuggucccuuccuuguguccugggggaccacugcuuagugcuucagcug

SEQ ID NO: 576772 - RNA, 65 nt, Homo Sapiens
uaauucagaggggagaggccgccagagcugagcuccugggggagucugaaccucaccaaacugag

SEQ ID NO: 576773 - RNA, 65 nt, Homo Sapiens
ugaagaaaucuugaguuaagugaguucugaggcugcugggggaaccagaucaauucaaagcuaaa

SEQ ID NO: 576774 - RNA, 65 nt, Homo Sapiens
ggagaauauucagcauaaugcuggcucuuguuucacugggggaaacaaguuauucucaaauauuu

SEQ ID NO: 576775 - RNA, 65 nt, Homo Sapiens
gacacagcuacacgcccauuaaagcacagcacguccugggggaggggggcauuuuuuauguuaca

SEQ ID NO: 576776 - RNA, 65 nt, Homo Sapiens
ugaagguagacaccagccagcaugguggcccuguucugggggagcaggguaaggcaggaggaagu

SEQ ID NO: 576777 - RNA, 65 nt, Homo Sapiens
ugcagugagcugugaucgugccacugaccuccagccugggggacagagcaagaccgugucucaaa

SEQ ID NO: 576778 - RNA, 65 nt, Homo Sapiens
agcugcuuugagcuccuggacucaccugaggcucccugggggaugacacucaguucugucacugu

SEQ ID NO: 576779 - RNA, 65 nt, Homo Sapiens
aucacaggaucuccugggccuuggagcaccucacgcugggggaaucaaucccugagggacucaga

SEQ ID NO: 576780 - RNA, 65 nt, Homo Sapiens
agcccuugggugcggggucucugugcacuugagagcugggggacccacccaccgucucccacucc

SEQ ID NO: 576781 - RNA, 65 nt, Homo Sapiens
aucugggcucgucucucucugggaacaaguuagcgcugggggacucugucggacgcagcggcuuc

SEQ ID NO: 576782 - RNA, 65 nt, Homo Sapiens
uuuuuguugcuuuuacuuucgauucuagggauucacugggggauauaccgguuacauuauuaaau

SEQ ID NO: 576783 - RNA, 65 nt, Homo Sapiens
ugggguauaauauuuaacgaaccagccuaaauauucugggggaaguacacauuuuuaacuuuaug

SEQ ID NO: 576784 - RNA, 65 nt, Homo Sapiens
cauuuugcaccaugaguuuguuauaauagaggaagcugggggacccaacaagcaauuaagagcag

SEQ ID NO: 576785 - RNA, 65 nt, Homo Sapiens
ccguggcgaugggcgcuggggcaggcuggcccugccugggggaguccacuggugacugcuggugg

SEQ ID NO: 576786 - RNA, 55 nt, Homo Sapiens; identical to SEQ ID NO: 284091

SEQ ID NO: 576787 - RNA, 65 nt, Homo Sapiens
gaacgcacagaucuguuugauuucuacuugugugucugggggaaugaaaccacagcauugguuuu

SEQ ID NO: 576788 - RNA, 65 nt, Homo Sapiens
uggaugucagaucugguaggcuuggcccaugggugcugggggaggccuuggcugccccaggccuc

SEQ ID NO: 576789 - RNA, 65 nt, Homo Sapiens
uuuuagguguugagauggggcuguggcugcagagccugggggagcgucggcucagcaggaggagg

SEQ ID NO: 576790 - RNA, 65 nt, Homo Sapiens
gggcacccagcugccuuuccuaucagugggaagggcugggggaggaauguaaaacucgcagcaga

SEQ ID NO: 576791 - RNA, 65 nt, Homo Sapiens
cugaguugugucacuucaguccauuaggaguggaacugggggaaucuacagaaucagggaaagaa

SEQ ID NO: 576792 - RNA, 65 nt, Homo Sapiens
agggaagacgaggaaccccaaggagccccucucugcugggggagagcaggaggggcgaccagaua

SEQ ID NO: 576793 - RNA, 65 nt, Homo Sapiens
cuggaaccaaucccccaugguuguggauuuugauacugggggaucuauauaugggacuugagcau

SEQ ID NO: 576794 - RNA, 65 nt, Homo Sapiens
agagcuuggccuugugcccaaaaugaaagaugacucugggggagcaauaugcugcaccauugcug

SEQ ID NO: 576795 - RNA, 65 nt, Homo Sapiens
uagaacccacauguuggucuggaacagcuuuggggcugggggaacgacugaucucuuccuugcag

SEQ ID NO: 576796 - RNA, 65 nt, Homo Sapiens
ccuggguuccgguuguugaucaggcuggggaggugcugggggagcaugagcugugcgcugcucug

SEQ ID NO: 576797 - RNA, 65 nt, Homo Sapiens
gccuggccuggccgcgucaugagcccaccugcugccugggggagaggugucgggucccagagagg

SEQ ID NO: 576798 - RNA, 65 nt, Homo Sapiens
gagagaucugacaaauacugcaacccuccuugguacugggggaggagaugaacaccacuucuaca

SEQ ID NO: 576799 - RNA, 63 nt, Homo Sapiens
gccccgaugagggguccugaggaggggauggggcugggggaugggccugagugagaggggagg

SEQ ID NO: 576800 - RNA, 65 nt, Homo Sapiens
gacucaagacugacucugauaguguagcauuuucccugggggaguuuugguuuuaauuagauggu

SEQ ID NO: 576801 - RNA, 65 nt, Homo Sapiens
ucuaggauuccugccacuuuggucccuggccucuccugggggaggcugcuguucuuaggugcucu

SEQ ID NO: 576802 - RNA, 65 nt, Homo Sapiens
cuagugccucugaggcagaaccaaaggagccugcacugggggaaaucccuuuuccugccugccug

SEQ ID NO: 576803 - RNA, 65 nt, Homo Sapiens
ugcagugagcugagaucgugcuacugcacuccagccugggggacagaaagagacuccgucucaaa

SEQ ID NO: 576804 - RNA, 65 nt, Homo Sapiens
ucuguugacacucaugauucugaauguugccugggcugggggaguaccuguagcacgccagugcu

SEQ ID NO: 576805 - RNA, 65 nt, Homo Sapiens
ccacccuuggaccugacucagcuaacaaucuagcccugggggaaugugaucuaccugaugcgacc

SEQ ID NO: 576806 - RNA, 65 nt, Homo Sapiens
uggaguugcaccgcggcagcuccauggaaaucaaucugggggagaaggacacugcaucccagauc

SEQ ID NO: 576807 - RNA, 65 nt, Homo Sapiens
guucuuccagguggcucccgcugaggcagcggucucugggggaucccccagcugaaggaggcugg

SEQ ID NO: 576808 - RNA, 65 nt, Homo Sapiens
ccugcccuguccaggugggaagcugagucccagugcugggggacuguggccugggcugaucuuga

SEQ ID NO: 576809 - RNA, 65 nt, Homo Sapiens
caaagacccguguuggggguacugaaggagaggcccugggggacccucugaagcauuucugccuc

SEQ ID NO: 576810 - RNA, 65 nt, Homo Sapiens
gcuugcauaaaggagaaaacaacucuauguacaugcugggggagagugccuaaugugggagacca

SEQ ID NO: 576811 - RNA, 65 nt, Homo Sapiens
uggccugaacucugugauagagugugacugagcugcugggggacaugugagccucaaauccauag

SEQ ID NO: 576812 - RNA, 65 nt, Homo Sapiens
cucacagucaccgcaggugcaggcaggaagcagcccugggggacuggacgcugcuauugauucau

SEQ ID NO: 576813 - RNA, 65 nt, Homo Sapiens
aagcuuuuccgaugucacaauguggaggaaagcaccugggggacaacagugcucgugcagguggg

SEQ ID NO: 576814 - RNA, 65 nt, Homo Sapiens
gauauucagauggagcacugucacuuagacauucucugggggauuuucugcuugucuuucuugag

SEQ ID NO: 576815 - RNA, 65 nt, Homo Sapiens
ggccacacuguccuguuggcaucacagccccaaggcugggggaacuucaugcugggacaagcagc

SEQ ID NO: 576816 - RNA, 65 nt, Homo Sapiens
gcccuagcauaggaaaagcuuccuugaugugagcucugggggagugugaaggaugcaucucuagc

SEQ ID NO: 576817 - RNA, 65 nt, Homo Sapiens
ucuuuugcuauuaaaacuacuguucauuuugggggcugggggaagugagccuguuuggaugaugg

SEQ ID NO: 576818 - RNA, 65 nt, Homo Sapiens
aaggggugcaagaggaaggagugugcccagaccagcugggggagcauugaaaggacagcuugggg

SEQ ID NO: 576819 - RNA, 65 nt, Homo Sapiens
ucaggguugccgcagugucaccucaguggaccagccugggggaaggagcuuaauugcugagacau

SEQ ID NO: 576820 - RNA, 65 nt, Homo Sapiens
cacaggcccucauccacccuccuccacgaccagcucugggggaggcccugagcccucccagggac

SEQ ID NO: 576821 - RNA, 65 nt, Homo Sapiens
uuaugaagggccuugagcauaguccaacuacuaaacugggggauaaaagguuccuuuguucccua

SEQ ID NO: 576822 - RNA, 65 nt, Homo Sapiens
ccuuccuugaacccuaauaauggucucucccagcucugggggacuuuccucuggcccagugaauu

SEQ ID NO: 576823 - RNA, 65 nt, Homo Sapiens
cuuaaaggggcugggguagaggcuccuuccuccagcugggggacuucagugccucaggaucuuau

SEQ ID NO: 576824 - RNA, 65 nt, Homo Sapiens
aagugugucaacuauuucuuuccaggggagaugaccugggggaggagccuuggcagacccuugac

SEQ ID NO: 576825 - RNA, 65 nt, Homo Sapiens
gggaugguugugggucuuuccagggagagacagaacugggggaaagcucaggagugggcagcagu

SEQ ID NO: 576826 - RNA, 65 nt, Homo Sapiens
ccuggcuccaaccaaccccuaguacugccccaccccugggggaaaaagcagucuauaccagcaug

SEQ ID NO: 576827 - RNA, 65 nt, Homo Sapiens
uaccauuccaaaggaagccacagccagcguggguccugggggaaaguuccuuaacugcugagccu

SEQ ID NO: 576828 - RNA, 65 nt, Homo Sapiens
ugccacaucugaggaacugguuguuuccagggaagcugggggaacccaccaccuuugucugauac

SEQ ID NO: 576829 - RNA, 65 nt, Homo Sapiens
gggagaucuaagaugucccauagggguccuaucuccugggggaagccuaggacccaggggagguu

SEQ ID NO: 576830 - RNA, 65 nt, Homo Sapiens
cugcucgagagaggccaagaaggucuugcuucuaucugggggacgccugccagggcugcaaagca

SEQ ID NO: 576831 - RNA, 65 nt, Homo Sapiens
caggggccccaggaagaagcuggugggauugggaccugggggauagaggaccacuacuauacuga

SEQ ID NO: 576832 - RNA, 65 nt, Homo Sapiens
aaagagcccuuauuuguggggcuuauacagagccucugggggaaagagaaugaaacuuguggaga

SEQ ID NO: 576833 - RNA, 65 nt, Homo Sapiens
ggggugggcaguaccuaucccucuguaacuucuuucugggggauucuugaaggggagacucccuc

SEQ ID NO: 576834 - RNA, 65 nt, Homo Sapiens
gggauuagcuagacuaggagaacugccuuaaccuucugggggaggaaacaacuugguugugaacc

SEQ ID NO: 576835 - RNA, 65 nt, Homo Sapiens
gaugguggcuuuaggggaagggggaaagguguaggcugggggauugagguggggaaucauuuuag

SEQ ID NO: 576836 - RNA, 65 nt, Homo Sapiens
gaagccugcguugguccagagcggaggcugugugccugggggaguuuuccucuauacaucucucc

SEQ ID NO: 576837 - RNA, 65 nt, Homo Sapiens
uaaaccaagaaggagaccuuuucacaauggaaaaccugggggauggucagagcccagucgagacc

SEQ ID NO: 576838 - RNA, 65 nt, Homo Sapiens
aguucaguaaacagacuguagagugucugacuauacugggggaagaggagccaaugacaggguag

SEQ ID NO: 576839 - RNA, 65 nt, Homo Sapiens
acgcauuacuagaaucauuucauuauuucugcuuccugggggaaggaugcagaaggagucugaug

SEQ ID NO: 576840 - RNA, 65 nt, Homo Sapiens
uguauucacccaggcuuccuucucaguagcucuagcugggggaggugucagcugggccccuccug

SEQ ID NO: 576841 - RNA, 52 nt, Homo Sapiens
ccacugggaguagcggcuaaagcugggggauagaggggcugcagggccacug

SEQ ID NO: 576842 - RNA, 65 nt, Homo Sapiens
cugcucucccaucaagcuucagaugccauguuguacugggggaauguagcccuugugcuccccac

SEQ ID NO: 576843 - RNA, 65 nt, Homo Sapiens
ggaaggagguuuccaguucauuuacauuaagggcccugggggagaauaaagcucagagcaggagg

SEQ ID NO: 576844 - RNA, 65 nt, Homo Sapiens
ucuacguuccugcccuuuacuauugcugauggagccugggggaaccaucacuuuuuuugugugcu

SEQ ID NO: 576845 - RNA, 65 nt, Homo Sapiens
cacagcaacccagagauggccaaaagcauucaagccugggggaagauguuugacuauugcugcuc

SEQ ID NO: 576846 - RNA, 65 nt, Homo Sapiens
ccagcuggaggccaggcccaggugcgugccuuguccugggggauugaccaucaugucuucccugc

SEQ ID NO: 576847 - RNA, 61 nt, Homo Sapiens
auccuccaaaagacagaugaugcggagguuccugggggaaucaaagagaaaugugccucau

SEQ ID NO: 576848 - RNA, 65 nt, Homo Sapiens
aaggucugcuugcaaaguuggcccuuggcuggcaucugggggaacuugguucuuggauggauucc

SEQ ID NO: 576849 - RNA, 65 nt, Homo Sapiens
gaaguagcagucgcuggcagagcacacaggcugcucugggggaugagcuggugcguuuaaggaac

SEQ ID NO: 576850 - RNA, 65 nt, Homo Sapiens
ccuggccacagagggcaaggacugugccggagucccugggggaggugcuggcgcgggaugaggac

SEQ ID NO: 576851 - RNA, 65 nt, Homo Sapiens
ggagggagugaggggcagugaacagccccagugcacugggggaggcaucuuccauguuguaaagg

SEQ ID NO: 576852 - RNA, 65 nt, Homo Sapiens
ggugcuguuuuaauuucuaacccagaguggaugggcugggggagggcugccucucccaccacaag

SEQ ID NO: 576853 - RNA, 65 nt, Homo Sapiens
aaaaagccaacaguaagcccagauuuuaagaagaucugggggaauucuaagucauguauaggcua

SEQ ID NO: 576854 - RNA, 65 nt, Homo Sapiens
acuuagguuaaugugcuaggacaggucuaggcaaccugggggauguucauaaggccaugcuccug

SEQ ID NO: 576855 - RNA, 65 nt, Homo Sapiens
cccuggauuucagaaagagcuggcugacccagucccugggggaagccccacucucauuccccagg

SEQ ID NO: 576856 - RNA, 65 nt, Homo Sapiens
cagaacaagauuguucucuguucuuucacuauugucugggggacuaucaaaagaccuuuuucagg

SEQ ID NO: 576857 - RNA, 51 nt, Homo Sapiens
gggucaugcagcaccagggggcugggggaagguggagagaagaagcccuga

SEQ ID NO: 576858 - RNA, 65 nt, Homo Sapiens
gugcagccagcaugugcaguaaccaggaggccacacugggggagcaggggcgccuguggggaggg

SEQ ID NO: 576859 - RNA, 65 nt, Homo Sapiens
aggcaaucgcuguagcugcccuccggcuggauguucugggggagggagugaggugugauugggcc

SEQ ID NO: 576860 - RNA, 65 nt, Homo Sapiens
ggacaacauccugaaauaaaccagacagcaaggcccugggggaaaggagcaaauuaaacaauaaa

SEQ ID NO: 576861 - RNA, 65 nt, Homo Sapiens
guucagggcagcaaugcugaaaguagggaaggcagcugggggaggucuagaaauagaggcuccca

SEQ ID NO: 576862 - RNA, 65 nt, Homo Sapiens
accugcucugcccucuccccccagaccgccagugacugggggaggggcagcagacugaccaucuc

SEQ ID NO: 576863 - RNA, 65 nt, Homo Sapiens
ggaauaguauccuccagguuccucagccuccucaucugggggagugugauguaggggucuggucu

SEQ ID NO: 576864 - RNA, 65 nt, Homo Sapiens
acgggcaacagcagucaggaggggcucucuggggucugggggaauuggacugcagaacaaaccgu

SEQ ID NO: 576865 - RNA, 65 nt, Homo Sapiens
aggacgugggcccagccacaggucuccccucaggccugggggauaguugguuaucaucagaaggu

SEQ ID NO: 576866 - RNA, 65 nt, Homo Sapiens
cagaaaagaggugcggcaggguuacccagaugguucugggggagagagggaacauuuccuuagau

SEQ ID NO: 576867 - RNA, 65 nt, Homo Sapiens
ggugucauccaccucgcuuuacgaggaacacagcucugggggaauuugguuuuguuuuguugcca

SEQ ID NO: 576868 - RNA, 65 nt, Homo Sapiens
ggaacaggaugcccagcccagcagcugggagugggcugggggagguccucccacuggacaugguu

SEQ ID NO: 576869 - RNA, 65 nt, Homo Sapiens
uggagauuugacuguuuaaaccagacuguuaccuucugggggagacacguuuuuauggaucugca

SEQ ID NO: 576870 - RNA, 65 nt, Homo Sapiens
ccucggaaucuauuuaauaaaguugucaaugcucccugggggagcuugauauuuauuguacuaag

SEQ ID NO: 576871 - RNA, 65 nt, Homo Sapiens
gaggggcuggccaggucuggcacacgaaaccucaacugggggaguaagccagucucacugugaac

SEQ ID NO: 576872 - RNA, 65 nt, Homo Sapiens
uccagagacuaggccucucccccuuccuuaguagccugggggaugucugagccaggagugaaugg

SEQ ID NO: 576873 - RNA, 65 nt, Homo Sapiens
acuuagaaauugagcucuuacucucuucuguaauacugggggaccuacagcugccguggggcuga

SEQ ID NO: 576874 - RNA, 65 nt, Homo Sapiens
aguaacuuaguaaaauugaccuucgcaaaaccucacugggggagugccuuguagagcugugggug

SEQ ID NO: 576875 - RNA, 65 nt, Homo Sapiens
uacuacccuugguaugcaugggguugcauguggcccugggggaguuaguugugccucagacuugg

SEQ ID NO: 576876 - RNA, 65 nt, Homo Sapiens
uuuugccucgaggcugagcucacugacauugaugccugggggacccuacauggcagggagggcug

SEQ ID NO: 576877 - RNA, 65 nt, Homo Sapiens
aguuuaggggcacaggagauguagucguuccagggcugggggaggugggagggaucacgccuaua

SEQ ID NO: 576878 - RNA, 53 nt, Homo Sapiens
ccauucugucccugguguagagccugggggacccaucuuccaccucaccucuu

SEQ ID NO: 576879 - RNA, 65 nt, Homo Sapiens
gguguggcccucaggccuggugcugccuuggagggcugggggaaggaguguguggaggagggagg

SEQ ID NO: 576880 - RNA, 65 nt, Homo Sapiens
gagaagagauugguuaguauggccugaacugguggcugggggaacugugucuggucaaguuaugg

SEQ ID NO: 576881 - RNA, 65 nt, Homo Sapiens
uacuagggaggcugaggugggaggaucacuugagccugggggacugaggcugcagugagccauga

SEQ ID NO: 576882 - RNA, 65 nt, Homo Sapiens
uuaauucucauuaauacucuuuauuuauccuauuucugggggaggauguacguggccauguauga

SEQ ID NO: 576883 - RNA, 65 nt, Homo Sapiens
uaauucccagauugugccuuauaaccugccuuugccugggggaguggugccucgcaugcugauaa

SEQ ID NO: 576884 - RNA, 59 nt, Homo Sapiens
ccuugaacucugucgguugaugcugacuccugggggagggaggagucauguuggagguu

SEQ ID NO: 576885 - RNA, 65 nt, Homo Sapiens
agcuggggagguggauuuagcagaaggcaacuccucugggggauuugaaccggucugucuucacu

SEQ ID NO: 576886 - RNA, 65 nt, Homo Sapiens
gaggacuaggagcccagccuugcgccgcauucgcacugggggacaugggaggggucuagcuggcc

SEQ ID NO: 576887 - RNA, 65 nt, Homo Sapiens
augguaugagagucggaccuggacagggccagcugcugggggagcggcacuggggacuggaggcu

SEQ ID NO: 576888 - RNA, 65 nt, Homo Sapiens
ccucaccugcagagaaacgcgcuccuuggcggacacugggggaggagaggaagaagcgcggcuaa

SEQ ID NO: 576889 - RNA, 65 nt, Homo Sapiens
uaaugagcagaucucuguggugcucuucuccuuggcugggggagggguaggugauuguacguggu

SEQ ID NO: 576890 - RNA, 58 nt, Homo Sapiens
ggaggucuguuacugaaagaguggggagcugggggaggaugugaucauacaagacuga

SEQ ID NO: 576891 - RNA, 65 nt, Homo Sapiens
ggaccagacaagauaacaggugggaggaggcacuucugggggauacccaacucugggaguugugg

SEQ ID NO: 576892 - RNA, 65 nt, Homo Sapiens
agaugcuaauaaacuguuuucagucuucacuugcacugggggaacagggcucccggagagggagu

SEQ ID NO: 576893 - RNA, 65 nt, Homo Sapiens
gagggguggugaugucaggggcuuuaggaagauaccugggggaugcggguugcagucccgacacg

SEQ ID NO: 576894 - RNA, 65 nt, Homo Sapiens
ggguagugcuggggagagauuuuaggauggugauacugggggaccauagaggaaguggaagugcc

SEQ ID NO: 576895 - RNA, 65 nt, Homo Sapiens
aaaggccuugauuuuaggguaguaaauuuaauauucugggggaaaauuuuuauuucuacguuuuu

SEQ ID NO: 576896 - RNA, 65 nt, Homo Sapiens
guuguggauuucauaaagccuaaugauggaagauucugggggagaaaauuuccacucgcauuauu

SEQ ID NO: 576897 - RNA, 65 nt, Homo Sapiens
gggaaagugauucuguaaccacaccuggacuuuuacugggggaguauggggguguguacaacuua

SEQ ID NO: 576898 - RNA, 65 nt, Homo Sapiens
caccccacagacucagcgccccuugagugguggugcugggggagguucauauuacauaagggaaa

SEQ ID NO: 576899 - RNA, 65 nt, Homo Sapiens
uuuggauaaggcaaauucaacuuucagucucuuuucugggggaaaaaaauaauaaaccuagccua

SEQ ID NO: 576900 - RNA, 65 nt, Homo Sapiens
gcugagaucacacuacuguacuacuguacuccagccugggggaaagagugaaacuccaucucaaa

SEQ ID NO: 576901 - RNA, 65 nt, Homo Sapiens
cagugugagaaggaagacagagaaguucuugaaagcugggggaugugugggcaagagguggauug

SEQ ID NO: 576902 - RNA, 65 nt, Homo Sapiens
cuucuugauuucacuucugauggaugcauggggcucugggggaaugcugggaaaaugggcaagca

SEQ ID NO: 576903 - RNA, 65 nt, Homo Sapiens
cugucuggccagggagauccaugugcucaauguugcugggggaccuacaaaagucaaacauugcu

SEQ ID NO: 576904 - RNA, 65 nt, Homo Sapiens
aaugcgucuuuaaaaauagucucuguggcaggucacugggggacaauguacagcauucuggccau

SEQ ID NO: 576905 - RNA, 65 nt, Homo Sapiens
gugaagugaagacaaugacucaaggagauuuacaacugggggagggauuuaacagaaauguacag

SEQ ID NO: 576906 - RNA, 65 nt, Homo Sapiens
ugggccucaggccugcuccaagaacggggugggaacugggggaccccgacugaggggugggcugc

SEQ ID NO: 576907 - RNA, 65 nt, Homo Sapiens
ggucugaccccaccuagagcugggguuuuggggggcugggggaugcagcaauagcaauccagaau

SEQ ID NO: 576908 - RNA, 65 nt, Homo Sapiens
ucuguucuuugguauggaauuaggacggagguucccugggggaaggugauggcccugaagggcug

SEQ ID NO: 576909 - RNA, 65 nt, Homo Sapiens
uacugcuguugcuggcaggucuguaccagcacagccugggggagcgggagcaggaugcccuggac

SEQ ID NO: 576910 - RNA, 65 nt, Homo Sapiens
gcacagucaguggagagagcgaggcugggguccuccugggggacauguggcugagacucuggaca

SEQ ID NO: 576911 - RNA, 65 nt, Homo Sapiens
ggggaaccccuccccacccucuagugcgcaccgugcugggggaagcuuaaaggcagcgggcgcug

SEQ ID NO: 576912 - RNA, 65 nt, Homo Sapiens
gcuggucacuguuucucacaauagcaaauuugugucugggggacuuccuggcagcuuuuaacauu

SEQ ID NO: 576913 - RNA, 65 nt, Homo Sapiens
aagagggccucgggggccucucccugccccucagccugggggaaggggcauggugggcacaguuc

SEQ ID NO: 576914 - RNA, 65 nt, Homo Sapiens
cccucuagcucccucagccgaacagcacccugcaucugggggauugaagcagucgcugacccccg

SEQ ID NO: 576915 - RNA, 65 nt, Homo Sapiens
aucucgaagugacuccgggcugagcaguggggcggcugggggaggggugacgauucuccucaggc

SEQ ID NO: 576916 - RNA, 65 nt, Homo Sapiens
cucauuccugccuccuuccugagccaguucagggccugggggagagccagcuugggguaggaagu

SEQ ID NO: 576917 - RNA, 65 nt, Homo Sapiens
uuccuuauccagacaguggggaaggcaugacacaccugggggaaauuggcgaugucacccgugua

SEQ ID NO: 576918 - RNA, 65 nt, Homo Sapiens
agggagaugugcgugucaaauauucaucuaguccccugggggaggggaagggugggucuagacau

SEQ ID NO: 576919 - RNA, 65 nt, Homo Sapiens
ucaccuaccacccaaguccucaugcccuccgagggcugggggaggaggggcucaaggaagggggg

SEQ ID NO: 576920 - RNA, 65 nt, Homo Sapiens
guccugccccugcuaccugcuucauuguccauccccugggggagugggucagagguacuggaggg

SEQ ID NO: 576921 - RNA, 65 nt, Homo Sapiens
gggaaaggacacacacaggauaugggagccaggggcugggggagguggaaggggcggggggcggg

SEQ ID NO: 576922 - RNA, 65 nt, Homo Sapiens
acugaaguguuacuugaaccgggggaaucucggaccugggggagccggggugugaggggacugga

SEQ ID NO: 576923 - RNA, 65 nt, Homo Sapiens
cauucaugauggccuccuccuucaggccucaaugccugggggaggccugcacuguccugauuggc

SEQ ID NO: 576924 - RNA, 65 nt, Homo Sapiens
cucccucugaacuucaagucuccaaagaucagaaucugggggagggagcgcgugcagggaggggc

SEQ ID NO: 576925 - RNA, 65 nt, Homo Sapiens
uccacucuauucccacccuugagggagcccccuuacugggggaggguccuugcaauuccagcgaa

SEQ ID NO: 576926 - RNA, 65 nt, Homo Sapiens
cuccaugaggacaugggaagguaggaguugccgcccugggggagggucccgggcugcucaccucu

SEQ ID NO: 576927 - RNA, 65 nt, Homo Sapiens
gacaaaaccaugcagcucagaggucccugugggggcugggggagcugcccugcaggucuuggcac

SEQ ID NO: 576928 - RNA, 65 nt, Homo Sapiens
ggccagcaaggcaguccccccacgcccgagaaagccugggggacccagacaccuguccccacagu

SEQ ID NO: 576929 - RNA, 65 nt, Homo Sapiens
gcucauuuggguucaggcgcacuucaaaacccucccugggggaggcuguuucuucucaggauucc

SEQ ID NO: 576930 - RNA, 65 nt, Homo Sapiens
guccuggccuccaggugugcagcaggggcugugugcugggggagguuccaguuaggcgaugggau

SEQ ID NO: 576931 - RNA, 65 nt, Homo Sapiens
cuggcaaaucucagcuguugagacauuuggaaguccugggggauggaccgugcucugucggcccg

SEQ ID NO: 576932 - RNA, 65 nt, Homo Sapiens
cuggugccagccuugaaaguuucugcuucucuuggcugggggacucccugcccuuugguucauuu

SEQ ID NO: 576933 - RNA, 65 nt, Homo Sapiens
cccucugugaaugggucucuccccggccucccacccugggggagggagggguuguggggccugaa

SEQ ID NO: 576934 - RNA, 65 nt, Homo Sapiens
cccgugcauguuuacgccuugccccugccacccuccugggggacaggccgggguuugaaggcagg

SEQ ID NO: 576935 - RNA, 65 nt, Homo Sapiens
ucagccagcuccggggcucuagagugggaagcuuccugggggacccauggccuuccugccacugc

SEQ ID NO: 576936 - RNA, 65 nt, Homo Sapiens
ccuggugaagggcuggaccugagugggaaaggcaccugggggagcagccugcuuccaggagccua

SEQ ID NO: 576937 - RNA, 65 nt, Homo Sapiens
ggccgggccuggcaccaaucccgccaaucacgagacugggggaccccaggggcgucugcugugcc

SEQ ID NO: 576938 - RNA, 65 nt, Homo Sapiens
cagcucucucugugggcuuccccgggcuugggagccugggggaugacuuagagaaaggucacugg

SEQ ID NO: 576939 - RNA, 65 nt, Homo Sapiens
ugagcgcucaggacgugaugggugcaggcggcuugcugggggaugggacuucuagagaaaggccu

SEQ ID NO: 576940 - RNA, 65 nt, Homo Sapiens
gcaggagccuuccuuucuccugauuuuuuaaggagcugggggaagucaacuugacaccacuaaga

SEQ ID NO: 576941 - RNA, 65 nt, Homo Sapiens
cgaccaauuagucacugcugugcgccccgccugaccugggggagcaugccuggccugccagacac

SEQ ID NO: 576942 - RNA, 65 nt, Homo Sapiens
ucaggugccacccaacgcugacaggucuaugugugcugggggaugacauagcccaaggaggcacc

SEQ ID NO: 576943 - RNA, 65 nt, Homo Sapiens
gaggcagauaagaaggugcgccacagaccucacaccugggggacacccgcugccugcacuggaac

SEQ ID NO: 576944 - RNA, 65 nt, Homo Sapiens
gggaucuuugagaccaaaacagaugcuccuguuugcugggggagggugugagcacggaguauuuc

SEQ ID NO: 576945 - RNA, 65 nt, Homo Sapiens
gaaaagaaucccugcagccugguagaauugggaagcugggggaaggguggucugagcacccccuc

SEQ ID NO: 576946 - RNA, 65 nt, Homo Sapiens
cucaccuuccagagaggacagacacagauuuccugcugggggagggaggaguccacgcauccuga

SEQ ID NO: 576947 - RNA, 65 nt, Homo Sapiens
acagaugcccucagaauuggggcaugggaggggggcugggggaccccaugauucagccacggacu

SEQ ID NO: 576948 - RNA, 65 nt, Homo Sapiens
cagaauauccuucaaguuccacuucccagggagcucugggggaggggcggccauucuggcuccgu

SEQ ID NO: 576949 - RNA, 65 nt, Homo Sapiens
ggaaguggucuggcuggaacuccaaguggcuuagucugggggaucaggaggugggagguggaugg

SEQ ID NO: 576950 - RNA, 65 nt, Homo Sapiens
cacucacuaggugacagcggccaccaggcucugugcugggggacgauacuggcccuggccucgac

SEQ ID NO: 576951 - RNA, 65 nt, Homo Sapiens
gccaggugaguguuuucuucaggcagcugaggguccugggggagcugaggcucugugcugcaccc

SEQ ID NO: 576952 - RNA, 65 nt, Homo Sapiens
gcccccugggaacugggggugcgggaguucucccucugggggacagaaaaucugacuacuaggaa

SEQ ID NO: 576953 - RNA, 65 nt, Homo Sapiens
cccugugcagaaggcuacugccccuuaggccucagcugggggaaaggcaguucuggugcuguaga

SEQ ID NO: 576954 - RNA, 65 nt, Homo Sapiens
agagguucaggcaguuccugucaucucugaaaagacugggggauaugaaaucuucccccuacccc

SEQ ID NO: 576955 - RNA, 65 nt, Homo Sapiens
aaaucagguagcccagacuggugauggagcagagucugggggaagggucguggguggggaauuua

SEQ ID NO: 576956 - RNA, 65 nt, Homo Sapiens
gguuuucucucuggauggaacgggcaugggccucucugggggaggcagggcuggaaugggagacc

SEQ ID NO: 576957 - RNA, 65 nt, Homo Sapiens
ccucucccaggcugucccccuccucccagggccuccugggggaccuuuguauuaagccaauuaaa

SEQ ID NO: 576958 - RNA, 65 nt, Homo Sapiens
aacugaacuugcuauggaaaggacagugugggaggcugggggagcuguguccugcaguucccagg

SEQ ID NO: 576959 - RNA, 65 nt, Homo Sapiens
agccaccuugaccguaggggaaggaggaaugugggcugggggaagaugcccucaacucacccccu

SEQ ID NO: 576960 - RNA, 65 nt, Homo Sapiens
ccaccugcccucccgggcaguacuggggaccuucccugggggacggggagggaggaggcagcgac

SEQ ID NO: 576961 - RNA, 65 nt, Homo Sapiens
uacaggggggucuccccucaccccugcacccccagcugggggagcuggcucugccccgaccuccu

SEQ ID NO: 576962 - RNA, 65 nt, Homo Sapiens
agaagagggagaaggagaggcucugaaagcugcuucugggggauuucaagggacugggggugcca

SEQ ID NO: 576963 - RNA, 65 nt, Homo Sapiens
aagucccgggucugucucucucacucucgcucucacugggggagggaaagaauggcuuugguggc

SEQ ID NO: 576964 - RNA, 65 nt, Homo Sapiens
gaggaugucugggccacucaggggucauucauggccugggggauguaccagcaucucccaguuca

SEQ ID NO: 576965 - RNA, 65 nt, Homo Sapiens
uguggccagccuagggcucauggcaugggcccccacugggggagggaggcaucuuguuucuugug

SEQ ID NO: 576966 - RNA, 65 nt, Homo Sapiens
guuuuugauggaauugauuuucccugaguggagugcugggggaaggaggagguccaggccgguag

SEQ ID NO: 576967 - RNA, 65 nt, Homo Sapiens
agcuggcugagauuggggcagcggcucagcagucccugggggaagccauugacguguaccaggcg

SEQ ID NO: 576968 - RNA, 65 nt, Homo Sapiens
cagccccagcuucgcacaggcuccuggagggcugccugggggaggcagacaugggagugccaagg

SEQ ID NO: 576969 - RNA, 65 nt, Homo Sapiens
ggagcuaagggcgaggcccuucccuucagaggcuccugggggauuagggugugguguuugccaag

SEQ ID NO: 576970 - RNA, 65 nt, Homo Sapiens
uggguccccccaccguggugccccucaccauccuccugggggagcaggggguggguucucccuga

SEQ ID NO: 576971 - RNA, 65 nt, Homo Sapiens
ugaggaaauggaugauuucucuuuuccauaugucacugggggaaaggcugccuguaccucucaag

SEQ ID NO: 576972 - RNA, 65 nt, Homo Sapiens
gugacaucuacaacuccaagauugccgggaagcuccugggggaugcucuaaagcugggcucaagc

SEQ ID NO: 576973 - RNA, 65 nt, Homo Sapiens
gcgcuguggaacugccgcagccacgcaggaggucccugggggaugcuuugggaaguccuugcccc

SEQ ID NO: 576974 - RNA, 65 nt, Homo Sapiens
gaaagcucugcaguggggggcugguggcuccggggcugggggaucacaggcuggugaaccccggu

SEQ ID NO: 576975 - RNA, 65 nt, Homo Sapiens
uugguuccaggcuccuguucucuggacuucagauccugggggagccccuccccccccugaauccc

SEQ ID NO: 576976 - RNA, 65 nt, Homo Sapiens
uaggcagcucccugcccuccgugugugucuguuaucugggggagaggaguguggaaggguugggg

SEQ ID NO: 576977 - RNA, 65 nt, Homo Sapiens
cugggcuggguucccagucggagccuuucggggaucugggggaugagggcggaaggccuagcucc

SEQ ID NO: 576978 - RNA, 65 nt, Homo Sapiens
gucagugcacgcaagcagggacauuuccuagccagcugggggacacuggaaauucgggaaaccaa

SEQ ID NO: 576979 - RNA, 65 nt, Homo Sapiens
ggcugcucugggcagggugugcgggccgggcccggcugggggagggcagcucugggcacgccgca

SEQ ID NO: 576980 - RNA, 65 nt, Homo Sapiens
ggcagcucugggcacgccgcacccacgccccccaccugggggaaacaggcgguuccugcccgguu

SEQ ID NO: 576981 - RNA, 65 nt, Homo Sapiens
gucccucgggcaccugggcccccccgcuuggcucccugggggaauggcccaggcgggccgcgguu

SEQ ID NO: 576982 - RNA, 65 nt, Homo Sapiens
cugaccagcuugggcuccacgaugaagcugcaggucugggggacagauggagcuaccguguccag

SEQ ID NO: 576983 - RNA, 65 nt, Homo Sapiens
gcaguggguucugggggggccccuccuguugaagacugggggagaucaugcggccccaggggccu

SEQ ID NO: 576984 - RNA, 65 nt, Homo Sapiens
aggggaaugcgcucuggaaagguaagcuggauauccugggggaggcagagugugcgggggacgga

SEQ ID NO: 576985 - RNA, 65 nt, Homo Sapiens
aacccggaucccgcugcaucgagaagggaggcuggcugggggagaguuggaggagggcuuguuug

SEQ ID NO: 576986 - RNA, 65 nt, Homo Sapiens
cgacggguggaguacaauaagucugaacagaaggucugggggaagcccaaggccugccuggcucu

SEQ ID NO: 576987 - RNA, 65 nt, Homo Sapiens
agaaggggccaucugggcccgggacugggucagcccugggggaucucucucuucgugccuggucu

SEQ ID NO: 576988 - RNA, 65 nt, Homo Sapiens
caguuuuaacaucagugcacgacagcacuacaagucugggggagcaaggaaugcagcccccugaa

SEQ ID NO: 576989 - RNA, 65 nt, Homo Sapiens
ucagagcagagugccacauugguagacauugggaccugggggaccccaacagguuuccaggagau

SEQ ID NO: 576990 - RNA, 65 nt, Homo Sapiens
gaagcgugccuccccaccccgagccagcagcugcgcugggggaggggaguguuccggcaaagaca

SEQ ID NO: 576991 - RNA, 65 nt, Homo Sapiens
gaagauuauuuuagcuauuuguuucuuaggagugacugggggagguuaaguaauguuuggugucu

SEQ ID NO: 576992 - RNA, 65 nt, Homo Sapiens
uccaagcagaguguuuuauuacaugguguggggggcugggggaggcagacccccccauuucccgc

SEQ ID NO: 576993 - RNA, 65 nt, Homo Sapiens
caaagccaaaacugcccaaauucucacccugaucccugggggacugcucacugagcucuucuuca

SEQ ID NO: 576994 - RNA, 65 nt, Homo Sapiens
gaaagcuacgccauccuuccuacaggcauucaaggcugggggaaggaaagaguguggguucuaag

SEQ ID NO: 576995 - RNA, 65 nt, Homo Sapiens
gagaaggcgcuucccaacuuagaguuuguucuguucugggggacauuccccaaccacagagaaca

SEQ ID NO: 576996 - RNA, 65 nt, Homo Sapiens
ugaggguagaggcaggggaacauuuccuaccuucucugggggauugaggcuauagggucacuugc

SEQ ID NO: 576997 - RNA, 65 nt, Homo Sapiens
gggauggggccaggcucaguuuguuuuagauccuccugggggauguucauagugugcuugugugu

SEQ ID NO: 576998 - RNA, 65 nt, Homo Sapiens
ugggguucucagacugccaacagcacccccaggcccugggggaccucagcccgcuccugcccgcc

SEQ ID NO: 576999 - RNA, 54 nt, Homo Sapiens
gaaacacugcugcccucuuuagggcugggggagacuggaaccccacuggcuuag

SEQ ID NO: 577000 - RNA, 65 nt, Homo Sapiens
ucagaacauucgaaucucuggccccuccuuuuggccugggggagggaccuccucugggcccuguc

SEQ ID NO: 577001 - RNA, 65 nt, Homo Sapiens
ggaaugaccuccugaccacuugcaacagagccccucugggggacuuguccaucaaggcccugugc

SEQ ID NO: 577002 - RNA, 65 nt, Homo Sapiens
cgguaaugguggcugugcaugguuuugaggggugucugggggaagcugccuugcgugcuuuucug

SEQ ID NO: 577003 - RNA, 65 nt, Homo Sapiens
uuauuuauaagggcucuagauaaugcaaacacuaacugggggauucauguuaacccucuagcuga

SEQ ID NO: 577004 - RNA, 65 nt, Homo Sapiens
gaaacuuauuggaaaacuugauugaagaaaagggacugggggaaggggccuggcuuaaaagcagg

SEQ ID NO: 577005 - RNA, 65 nt, Homo Sapiens
cagggcacagggagaugcucuggugaaguaguaaacugggggagggaagagcagcagcagcagga

SEQ ID NO: 577006 - RNA, 65 nt, Homo Sapiens
caggcucacuggccauuuucgaguccccuagguggcugggggaggcugggaccuuucccucccag

SEQ ID NO: 577007 - RNA, 65 nt, Homo Sapiens
gggcagagagaggagaccaaagggcagaagauggacugggggaggggcuguggauggggcggagc

SEQ ID NO: 577008 - RNA, 65 nt, Homo Sapiens
ggccucaguccagaaaccucggugggaugaccgcacugggggaggaggggcagagcgaaguucug

SEQ ID NO: 577009 - RNA, 65 nt, Homo Sapiens
ccuuuucuuugaggacguacugugugcgugcguggcugggggaggucuacaugugugugucuacg

SEQ ID NO: 577010 - RNA, 65 nt, Homo Sapiens
guauguguauaugcauggggaaaggcaccuggggccugggggaggcuauaggauauaagcauuag

SEQ ID NO: 577011 - RNA, 65 nt, Homo Sapiens
gaaggaagggucuauaugaguuaaaugccaaguaucugggggauuaucugauuuagaaauaacau

SEQ ID NO: 577012 - RNA, 65 nt, Homo Sapiens
agcagggcacuguguccggcggagccaaguccacucugggggagcucuggcggggaccacgggcc

SEQ ID NO: 577013 - RNA, 65 nt, Homo Sapiens
ugcccugugugggcccaaccaguggacaauggagucugggggagggggaaccccggggacaugcc

SEQ ID NO: 577014 - RNA, 65 nt, Homo Sapiens
gggaggugacggcgcccgccgcagguggggcgaggcugggggagggcggcgccgcggcgggccug

SEQ ID NO: 577015 - RNA, 65 nt, Homo Sapiens
cuagacggggaggggccaggacccacccacugcuccugggggaugagguccugguuuuaaagccc

SEQ ID NO: 577016 - RNA, 65 nt, Homo Sapiens
aagggcaaccguugcuguucacacgcucagccugucugggggagcgggccucuagcuucagccag

SEQ ID NO: 577017 - RNA, 65 nt, Homo Sapiens
ccacccccacccccuucaguguuaaguggggagcccugggggagucucuccugccucccagccuc

SEQ ID NO: 577018 - RNA, 65 nt, Homo Sapiens
ugcagugagccuugaucgugccacugcacuccagccugggggacagagcacgacccugucuccaa

SEQ ID NO: 577019 - RNA, 65 nt, Homo Sapiens
auacuccuggcgauacugacuagaaagucagggagcugggggagcuguucacuuuaggauacggg

SEQ ID NO: 577020 - RNA, 65 nt, Homo Sapiens
aaaaacgcaaaccaaagcaggcaggcagacagcugcugggggaaauccugggguccuugagacag

SEQ ID NO: 577021 - RNA, 65 nt, Homo Sapiens
ggcgcagaccugaggcgaggccaccccccuccauccugggggaagcgcccgcgaaaaccguggag

SEQ ID NO: 577022 - RNA, 65 nt, Homo Sapiens
ccugcugaggcucagccccucaacccgguggcauucugggggaggaguggggcccacagcucucc

SEQ ID NO: 577023 - RNA, 65 nt, Homo Sapiens
caugccucuaaucccagcacuuugggaggcugaggcugggggaucaccugaggucaggaguucga

SEQ ID NO: 577024 - RNA, 65 nt, Homo Sapiens
ugcagugagcugagguggugccacuacgcuccagccugggggagggggacauagcgagacucggu

SEQ ID NO: 577025 - RNA, 65 nt, Homo Sapiens
gcuggugccgccucauaggcagacgaggaucaucgcugggggaccuuucccgugggcuuucuucc

SEQ ID NO: 577026 - RNA, 65 nt, Homo Sapiens
gccccuuaguccccaagccccucccccuaaggcagcugggggagaggugaccuaguacuggaaaa

SEQ ID NO: 577027 - RNA, 65 nt, Homo Sapiens
ucccucccuggugcucauuggaaucugaguagagucugggggaggguccccaccuuccuguaccu

SEQ ID NO: 577028 - RNA, 65 nt, Homo Sapiens
cccagaggcuuuggaguucaaucuugaaggggugucugggggaacuuuacuguugcaaguuguaa

SEQ ID NO: 577029 - RNA, 65 nt, Homo Sapiens
ccggccugacgcuguggccccgggacccagcagagcugggggagggaucagcccccaaagaaaug

SEQ ID NO: 577030 - RNA, 65 nt, Homo Sapiens
acgcagcugccaugaugccuugggaugcccugguccugggggacucaggugccucccugauuccu

SEQ ID NO: 577031 - RNA, 65 nt, Homo Sapiens
gcagggagagcugcugagccuaaagacuggagaaucugggggacugggagugggggucagagagg

SEQ ID NO: 577032 - RNA, 65 nt, Homo Sapiens
uuauggacaggggccugggcuuucuuccaagggcacugggggagccauggcaagguuguagguag

SEQ ID NO: 577033 - RNA, 65 nt, Homo Sapiens
uaaacagaggaagacaacauaugucacuggggaggcugggggagcuagacaaaauucacacggga

SEQ ID NO: 577034 - RNA, 65 nt, Homo Sapiens
caccuccccaccucccucccccgucagugggaugacugggggaggguugcugcagggaagaggag

SEQ ID NO: 577035 - RNA, 65 nt, Homo Sapiens
ccugagcacacccgaggcucccaccugcggagccgcugggggaccucacgucccagccaggaucc

SEQ ID NO: 577036 - RNA, 65 nt, Homo Sapiens
uagcacgguuuggggacuugggguguucccaagaccugggggacgacagacaucacgggaggaag

SEQ ID NO: 577037 - RNA, 56 nt, Homo Sapiens
accgccgggacuucugguagaggcggcugggggagggugggggcagggcuggcugg

SEQ ID NO: 577038 - RNA, 65 nt, Homo Sapiens
gugaacggccauguguuaauggccagcucccaucgcugggggacgcuggaggacccugggcccca

SEQ ID NO: 577039 - RNA, 65 nt, Homo Sapiens
ggggaguugaaaaugcacaugaucacugugaccuucugggggagggcguccugucccucacauuu

SEQ ID NO: 577040 - RNA, 65 nt, Homo Sapiens
agagugagacuuagucucaaccauugcacuccagccugggggacaugcagugagccaagaucgcg

SEQ ID NO: 577041 - RNA, 65 nt, Homo Sapiens
cucgguuugaccgccagcggguggugugcacauggcugggggacauaugugugugaccaucagca

SEQ ID NO: 577042 - RNA, 65 nt, Homo Sapiens
cccgacggccacaggacuccucucccucugcuucccugggggagccggcucaaaggcaagcgagc

SEQ ID NO: 577043 - RNA, 65 nt, Homo Sapiens
cucuuacggaaaauccgacagacccauagacagcccugggggagcccacccaaauaucaaacacg

SEQ ID NO: 577044 - RNA, 65 nt, Homo Sapiens
gggaggggcaaaggugagaggaacggcaaggcggucugggggaugauggcugaggagggugcugg

SEQ ID NO: 577045 - RNA, 65 nt, Homo Sapiens
cagauggggugcaggaaucugucaucucccacugccugggggaguccagggaaugggggcuuugg

SEQ ID NO: 577046 - RNA, 65 nt, Homo Sapiens
aaugaggugagggggguucuggauuacuuuugauccugggggaccucccuuuccuuuugguuuug

SEQ ID NO: 577047 - RNA, 65 nt, Homo Sapiens
ggucugagacucccuuuccuacucuccgucggcagcugggggaagcggauacuugccaaaaugag

SEQ ID NO: 577048 - RNA, 65 nt, Homo Sapiens
ggaauccugauuuuuuuuuucuggauucagagagucugggggacagaugugugacuucuuaucac

SEQ ID NO: 577049 - RNA, 65 nt, Homo Sapiens
gccagggccccuaggcuacaguugggggaagauaacugggggaaggugagggcaguagggauugg

SEQ ID NO: 577050 - RNA, 65 nt, Homo Sapiens
gggcggggcuugaccugcgggacagggacucggggcugggggacgucgagggggaaagggggugg

SEQ ID NO: 577051 - RNA, 51 nt, Homo Sapiens
acccauacugaggaguugaaucugggggacccagaauccagaaagguuuga

SEQ ID NO: 577052 - RNA, 65 nt, Homo Sapiens
cucgaaggaggcugucagagcagaacccacccucccugggggacccaccccaugucccagagccu

SEQ ID NO: 577053 - RNA, 65 nt, Homo Sapiens
ccugccccccaaaacccucuaggggccaugcaugucugggggaccuggggcucccccucgaggcg

SEQ ID NO: 577054 - RNA, 65 nt, Homo Sapiens
ccuggucugugggggcauccccugugagggugacucugggggaccggagggcagaggcgcagaau

SEQ ID NO: 577055 - RNA, 65 nt, Homo Sapiens
ggacaagucagggaccacuuggagccacagccugucugggggaaaagaguucaguccuggcugga

SEQ ID NO: 577056 - RNA, 58 nt, Homo Sapiens
cuuucgagcucccagcuccaggagggagcugggggacauggaguuacaggcaaaguga

SEQ ID NO: 577057 - RNA, 65 nt, Homo Sapiens
acaaacaaacaggguccuuaacaaaggccccggagcugggggaccgugggggccaccaaaaaccc

SEQ ID NO: 577058 - RNA, 65 nt, Homo Sapiens
ccucugcccagagaacucacaacccccucucugaccugggggacaaugcaaacaggucacagugc

SEQ ID NO: 577059 - RNA, 65 nt, Homo Sapiens
gugaaacugcaggagcucagcauagacccagcucucugggggauggucaccuggugauuucaaug

SEQ ID NO: 577060 - RNA, 65 nt, Homo Sapiens
ccugaaacgcuccuuugugugugugucagcugaggcugggggagagccguggucccugaggaugg

SEQ ID NO: 577061 - RNA, 65 nt, Homo Sapiens
gcaggaauagcaaagagugcaaacuugggguaugacugggggagaguggaacaugccuuuuccgc

SEQ ID NO: 577062 - RNA, 65 nt, Homo Sapiens
gagugcgcccugcacuccccgaacccgaguccgcgcugggggagccucgcccccgcccccaccgg

SEQ ID NO: 577063 - RNA, 65 nt, Homo Sapiens
ugcccugauggccugagcaucccccagauccaagccugggggaucccgggaaagcgauggacaga

SEQ ID NO: 577064 - RNA, 65 nt, Homo Sapiens
cuccaguaaauaccuggaagagggaaccugaaucccugggggagacagaaggggcaggggccacc

SEQ ID NO: 577065 - RNA, 65 nt, Homo Sapiens
ucaauucuuucauucccugaccagugagaggguuccugggggaaguauggugaauaaacugacau

SEQ ID NO: 577066 - RNA, 65 nt, Homo Sapiens
aguguuuuguagauuucagaugacuaugcagaggccugggggaccccuggcucugggccgggccu

SEQ ID NO: 577067 - RNA, 65 nt, Homo Sapiens
aagauggauaaacugagccucacuugcccucgugccugggggagagaggcagcaagucuuaacaa

SEQ ID NO: 577068 - RNA, 65 nt, Homo Sapiens
uaccaguggaagagacaucccuugacuuuuguggccugggggagggguagugcuccacagcuuuu

SEQ ID NO: 577069 - RNA, 65 nt, Homo Sapiens
cauuucuguggagggagggcagcuggcccccagcccugggggauuccugagcuggccugucugcg

SEQ ID NO: 577070 - RNA, 65 nt, Homo Sapiens
cuucuccaccgcacagacugggaaccccuccuggccugggggaagaguuuguuaccuaccuuacu

SEQ ID NO: 577071 - RNA, 65 nt, Homo Sapiens
gccgugcaugggguguacacagaagcagcagcauccugggggauguccagaacccaucuggccag

SEQ ID NO: 577072 - RNA, 65 nt, Homo Sapiens
ucuccucaugcgccugcacccugguggcccccacccugggggaggguagugcucccaccccugga

SEQ ID NO: 577073 - RNA, 65 nt, Homo Sapiens
augcauguugcagaagccggagauggaggugggggcugggggaauugaauggucugcccugggca

SEQ ID NO: 577074 - RNA, 65 nt, Homo Sapiens
gggcccacccuuaaaggcgggccuuaguccuugggcugggggagggccugcugcagccaccuggu

SEQ ID NO: 577075 - RNA, 65 nt, Homo Sapiens
cccgcggcggccugaacccuggacgggcccagaggcugggggagcugcgccuuccacgcccccca

SEQ ID NO: 577076 - RNA, 65 nt, Homo Sapiens
gggagucagagcccuggcuggagguagagaggggacugggggacuaaagacucagccaagacaag

SEQ ID NO: 577077 - RNA, 65 nt, Homo Sapiens
ccagcccagugcgggcacagauugggagaagcagucugggggagggcaaagaaaugugaaaaggc

SEQ ID NO: 577078 - RNA, 65 nt, Homo Sapiens
aagaaaccauaauuacuugauauuuagaaauguuccugggggauggaucaaagaaaaaucccccu

SEQ ID NO: 577079 - RNA, 65 nt, Homo Sapiens
ggguugccagggagacucagucucugggccugggucugggggagaaccucuauaaaccagugacu

SEQ ID NO: 577080 - RNA, 65 nt, Homo Sapiens
augcuggagggagcacgccgucacucaauccuggccugggggagacagagucgggaaggggcggg

SEQ ID NO: 577081 - RNA, 65 nt, Homo Sapiens
gccggguucauucccuguccuagcaaaaaucagggcugggggagaaugaaaagggaccccauaug

SEQ ID NO: 577082 - RNA, 65 nt, Homo Sapiens
gcuccucccaugccuccugccacggcugggacacgcugggggagggugagucuuccagcugccac

SEQ ID NO: 577083 - RNA, 65 nt, Homo Sapiens
cacaguaaacaucucugccuuugccuguguguguucugggggaggggggacauggaaaaauauug

SEQ ID NO: 577084 - RNA, 65 nt, Homo Sapiens
ucuugccuuguccccaacguuccacaacagucccgcugggggauugaagcgguuucacuccgcaa

SEQ ID NO: 577085 - RNA, 65 nt, Homo Sapiens
gaucauaaccccuucugugccuugggaugccggagcugggggaccuggaggcccaucagccggag

SEQ ID NO: 577086 - RNA, 65 nt, Homo Sapiens
gcauccauguguguccguggguaccguaagggcuacugggggaagaaccuguaagcaggguguga

SEQ ID NO: 577087 - RNA, 65 nt, Homo Sapiens
uuuuguuuuuuucuguuuucucugagggugggauucugggggaauaccaaagaggaguaaccauc

SEQ ID NO: 577088 - RNA, 65 nt, Homo Sapiens
gaguggcucacgggcagagaaggguagcccuggggcugggggagggauuggaagccucccuggag

SEQ ID NO: 577089 - RNA, 65 nt, Homo Sapiens
gggacaagauacucaccaggaccaggaaggggacucugggggacuggcuuccccugugagcagca

SEQ ID NO: 577090 - RNA, 65 nt, Homo Sapiens
ccaucccugucccucaggguagcaccauggcaggacugggggaacuggaguguccuugcuguauc

SEQ ID NO: 577091 - RNA, 65 nt, Homo Sapiens
gcugcuucgcaagcccccucauuagcagggcuuaucugggggagcugcugauggaguccucgcug

SEQ ID NO: 577092 - RNA, 65 nt, Homo Sapiens
ucauuugaaguuugcuuuggcuaaauuuugacacccugggggauguccugggagaaugccaguac

SEQ ID NO: 577093 - RNA, 65 nt, Homo Sapiens
gggacaagauacucaccaggaccaggaaggggacucugggggaccggcuuccccugugagcagca

SEQ ID NO: 577094 - RNA, 65 nt, Homo Sapiens
ucacugcugauuuucuaugucuuugcuccauacugcugggggaugggagagccacaguguguuuc

SEQ ID NO: 577095 - RNA, 65 nt, Homo Sapiens
uuccugugcgucugugucuuugugccuguaucucgcugggggacuucacaggaagcaggauuugg

SEQ ID NO: 577096 - RNA, 65 nt, Homo Sapiens
ggcacagggcacaggcagggacagaaagccuucuccugggggagggugggaagccaggguguccu

SEQ ID NO: 577097 - RNA, 65 nt, Homo Sapiens
acugucuuggccauggggaagcacuauggccucagcugggggaaagacccuggccuaggggucuu

SEQ ID NO: 577098 - RNA, 53 nt, Homo Sapiens
agcccagcaagggucuuugagaccugggggaucucaggagccaccugggaugg

SEQ ID NO: 577099 - RNA, 65 nt, Homo Sapiens
ugucugaaacaaacagucacaagcaaaggaagaggcugggggacuagaaagaggcccugcccucu

SEQ ID NO: 577100 - RNA, 65 nt, Homo Sapiens
agcuguggcuggggguguggaggcagugggaugaacugggggacaggucugcgcugcagugggau

SEQ ID NO: 577101 - RNA, 65 nt, Homo Sapiens
cggcugaggguagcaagcagggguugugagucaggcugggggacuuguuugaaagaaagaggagu

SEQ ID NO: 577102 - RNA, 65 nt, Homo Sapiens
cugugugaggugugggaggugggaagggugagggucugggggaaugcggagaaaagggaggcuug

SEQ ID NO: 577103 - RNA, 65 nt, Homo Sapiens
gauuuuaugcuggaaauaugacccugugcagacugcugggggaggcaggaggaugccugccugga

SEQ ID NO: 577104 - RNA, 65 nt, Homo Sapiens
uccuuuuugcuuccucaguuuuuaucaggcuuucucugggggacagcagucucugagcaccaggg

SEQ ID NO: 577105 - RNA, 65 nt, Homo Sapiens
ucccaaaacaaagcuguuugccucacucaggagaucugggggagguuucauuuaaaagugcuggg

SEQ ID NO: 577106 - RNA, 65 nt, Homo Sapiens
ugaguggccaagaugaugccaggcugcccuauacacugggggauucugcccuggcccaugcacac

SEQ ID NO: 577107 - RNA, 65 nt, Homo Sapiens
gucaaggagccuaaacacccugaaauugugacccccugggggacagcugccagacacagcuggcg

SEQ ID NO: 577108 - RNA, 65 nt, Homo Sapiens
acaucugcccauccucccagcuccugugucagagccugggggacgagucacccagcucaccccca

SEQ ID NO: 577109 - RNA, 65 nt, Homo Sapiens
gcuuucagugccugcuguucgaccuucggcaguggcugggggacuugggcagcaccuccgggacu

SEQ ID NO: 577110 - RNA, 65 nt, Homo Sapiens
cagggcagagcuuacuuuaaagccucucugcauggcugggggaguuaggccuaggcagcucugca

SEQ ID NO: 577111 - RNA, 65 nt, Homo Sapiens
aaagugagacaucgucucaaccaucgcacuccagccugggggacaugcagugagcuaagaucaug

SEQ ID NO: 577112 - RNA, 65 nt, Homo Sapiens
gugucggguagagggaagaguugaaaguggcaaggcugggggaggcucacugagggcgugcaaag

SEQ ID NO: 577113 - RNA, 65 nt, Homo Sapiens
aacuacucuggcaggaucugccaggccggacauggcugggggaccccccaccaugaguccugugu

SEQ ID NO: 577114 - RNA, 65 nt, Homo Sapiens
ucuccggccgugggguccccgcguguguauacccacugggggaaucguaggaagggaaugcgccu

SEQ ID NO: 577115 - RNA, 65 nt, Homo Sapiens
cuccccaggguuagggugcuuucagcccccuccuccugggggauggccugggggguggggccucc

SEQ ID NO: 577116 - RNA, 65 nt, Homo Sapiens
ugggcccugcccuuggcucagcucucgggggcccccugggggaccuccagaaggugcauguccgg

SEQ ID NO: 577117 - RNA, 65 nt, Homo Sapiens
agcagaaguggaagagaucuucuggugcugaaugacugggggacagacagaauuaccaaagugua

SEQ ID NO: 577118 - RNA, 65 nt, Homo Sapiens
ccggaucucuagagccauccaaagcaguuuagagacugggggaggagagacagaaaauuaacuga

SEQ ID NO: 577119 - RNA, 65 nt, Homo Sapiens
ccuuccuccugacuccagcauggggguuucaaagacugggggaccguggaccuucuggaggaagg

SEQ ID NO: 577120 - RNA, 65 nt, Homo Sapiens
aggcuggcagaaguuacccuggcaguuggugggggcugggggaaguucugguuuguucucugugg

SEQ ID NO: 577121 - RNA, 65 nt, Homo Sapiens
aggcugugggccguuaggacuagugagccagcucccugggggaaagccagguggcucaugggcug

SEQ ID NO: 577122 - RNA, 65 nt, Homo Sapiens
gacaaggaugauggaccccugcuggcgugggaggucugggggacacaggcagggugggagcaggg

SEQ ID NO: 577123 - RNA, 65 nt, Homo Sapiens
cccagccccaaggguccgggaggaaaguggcagggcugggggagagaggagaggaggcuguuggu

SEQ ID NO: 577124 - RNA, 65 nt, Homo Sapiens
aauguuaagugcaaaaugacugauguuaaaaccaucugggggaaaucuugggaugcuuuuuccua

SEQ ID NO: 577125 - RNA, 65 nt, Homo Sapiens
cuucaacuucgguaaugaggaagaaggagaaagagcugggggaagggcagaagacugguuuagga

SEQ ID NO: 577126 - RNA, 55 nt, Homo Sapiens
cugaggaagaugacgaguaacuccccugggggauacgacacaugcccuugaugag

SEQ ID NO: 577127 - RNA, 65 nt, Homo Sapiens
aucagagacccugaggaagaugaugaguaacuccccugggggauaugacacaugcccaugaugag

SEQ ID NO: 577128 - RNA, 65 nt, Homo Sapiens
gcugccuuaaagucaguaacuuacccuuagggaggcugggggaaaagguuagauuuuguauucag

SEQ ID NO: 577129 - RNA, 65 nt, Homo Sapiens
uggccuuuggaaccucuccauauacuuucuaagcucugggggaggaggaggaugggaccuccugg

SEQ ID NO: 577130 - RNA, 65 nt, Homo Sapiens
uacauuucuuuaucauuccaguggguaggguuuagcugggggaaggacauuucauaaggguuagu

SEQ ID NO: 577131 - RNA, 65 nt, Homo Sapiens
aacaguaaaccaguuuuucuagggauggcccuuggcugggggaugacagugugggagcugugggg

SEQ ID NO: 577132 - RNA, 65 nt, Homo Sapiens
ugaguuucuauacuuuuaagaagagcucuuuguuccugggggaggggggcagggggugaauuuua

SEQ ID NO: 577133 - RNA, 65 nt, Homo Sapiens
ggggccugccuuucccugacacuuuuggggucugccugggggaggaggggagaaagcaccaugag

SEQ ID NO: 577134 - RNA, 65 nt, Homo Sapiens
ugagcugccccagccccucccagcccuugcccagccugggggaguggggaaggcuugggcauggc

SEQ ID NO: 577135 - RNA, 65 nt, Homo Sapiens
gggaaaggaaaucagcaacuucaugguccacacugcugggggaaacuuccgcccccagcccacuc

SEQ ID NO: 577136 - RNA, 65 nt, Homo Sapiens
cuggcuggcucgacuggcagcaggacaguccgcgccugggggacgacucccugccagcgggcgag

SEQ ID NO: 577137 - RNA, 65 nt, Homo Sapiens
accuguuuaucacuccaguguuuuuuuuaagucaucugggggaaaaauucaugguauccugguua

SEQ ID NO: 577138 - RNA, 65 nt, Homo Sapiens
agaacacaaauccaacgcuuauaagccacugguaucugggggacuuuaauuaccuaagagccaca

SEQ ID NO: 577139 - RNA, 65 nt, Homo Sapiens
agaagggacuuuuccuugugaacaguuauggcaugcugggggaagaguagucuacugaugggagc

SEQ ID NO: 577140 - RNA, 65 nt, Homo Sapiens
uaaugcccuguuguuaccccccaggauucuuuauucugggggaggagcugcuuaccugccucagc

SEQ ID NO: 577141 - RNA, 65 nt, Homo Sapiens
aggagaugugaucaggcccccccugcccagguauccugggggaagcccacccucccaugagacug

SEQ ID NO: 577142 - RNA, 65 nt, Homo Sapiens
cuccucccuucucuccccagcaguguauaugcaaacugggggacucaccauuccagagacaaggc

SEQ ID NO: 577143 - RNA, 65 nt, Homo Sapiens
aaguucaaggaaggcaccacuaugacauggaagaucugggggaggguacaacugagugguacaga

SEQ ID NO: 577144 - RNA, 65 nt, Homo Sapiens
cuagacagccgggaaggcugugggagugggguggccugggggaccgacgacacccugaggcuugc

SEQ ID NO: 577145 - RNA, 65 nt, Homo Sapiens
ugcuuggaguuuucugccccggccaggcuccgaggcugggggaucgcugugcagcauggaacuca

SEQ ID NO: 577146 - RNA, 64 nt, Homo Sapiens; identical to SEQ ID NO: 173443

SEQ ID NO: 577147 - RNA, 64 nt, Homo Sapiens; identical to SEQ ID NO: 173444

SEQ ID NO: 577148 - RNA, 64 nt, Homo Sapiens; identical to SEQ ID NO: 173445

SEQ ID NO: 577149 - RNA, 64 nt, Homo Sapiens; identical to SEQ ID NO: 173446

SEQ ID NO: 577150 - RNA, 64 nt, Homo Sapiens; identical to SEQ ID NO: 90702

SEQ ID NO: 577151 - RNA, 64 nt, Homo Sapiens; identical to SEQ ID NO: 90703

SEQ ID NO: 577152 - RNA, 64 nt, Homo Sapiens; identical to SEQ ID NO: 90704

SEQ ID NO: 577153 - RNA, 64 nt, Homo Sapiens; identical to SEQ ID NO: 90705

SEQ ID NO: 577154 - RNA, 64 nt, Homo Sapiens; identical to SEQ ID NO: 90706

SEQ ID NO: 577155 - RNA, 64 nt, Homo Sapiens; identical to SEQ ID NO: 90707

SEQ ID NO: 577156 - RNA, 64 nt, Homo Sapiens; identical to SEQ ID NO: 90708

SEQ ID NO: 577157 - RNA, 64 nt, Homo Sapiens; identical to SEQ ID NO: 90709

SEQ ID NO: 577158 - RNA, 64 nt, Homo Sapiens; identical to SEQ ID NO: 90710

SEQ ID NO: 577159 - RNA, 64 nt, Homo Sapiens; identical to SEQ ID NO: 90711

SEQ ID NO: 577160 - RNA, 64 nt, Homo Sapiens; identical to SEQ ID NO: 90712

SEQ ID NO: 577161 - RNA, 64 nt, Homo Sapiens; identical to SEQ ID NO: 90713

SEQ ID NO: 577162 - RNA, 64 nt, Homo Sapiens; identical to SEQ ID NO: 90714

SEQ ID NO: 577163 - RNA, 64 nt, Homo Sapiens; identical to SEQ ID NO: 90715

SEQ ID NO: 577164 - RNA, 64 nt, Homo Sapiens; identical to SEQ ID NO: 90716

SEQ ID NO: 577165 - RNA, 64 nt, Homo Sapiens; identical to SEQ ID NO: 90717

SEQ ID NO: 577166 - RNA, 64 nt, Homo Sapiens; identical to SEQ ID NO: 90718

SEQ ID NO: 577167 - RNA, 64 nt, Homo Sapiens; identical to SEQ ID NO: 90719

SEQ ID NO: 577168 - RNA, 64 nt, Homo Sapiens; identical to SEQ ID NO: 90720

SEQ ID NO: 577169 - RNA, 64 nt, Homo Sapiens; identical to SEQ ID NO: 90721

SEQ ID NO: 577170 - RNA, 64 nt, Homo Sapiens; identical to SEQ ID NO: 90722

SEQ ID NO: 577171 - RNA, 64 nt, Homo Sapiens; identical to SEQ ID NO: 90723

SEQ ID NO: 577172 - RNA, 64 nt, Homo Sapiens; identical to SEQ ID NO: 90724

SEQ ID NO: 577173 - RNA, 64 nt, Homo Sapiens; identical to SEQ ID NO: 90725

SEQ ID NO: 577174 - RNA, 64 nt, Homo Sapiens; identical to SEQ ID NO: 90726

SEQ ID NO: 577175 - RNA, 64 nt, Homo Sapiens; identical to SEQ ID NO: 90727

SEQ ID NO: 577176 - RNA, 64 nt, Homo Sapiens; identical to SEQ ID NO: 90728

SEQ ID NO: 577177 - RNA, 64 nt, Homo Sapiens; identical to SEQ ID NO: 90729

SEQ ID NO: 577178 - RNA, 64 nt, Homo Sapiens; identical to SEQ ID NO: 90730

SEQ ID NO: 577179 - RNA, 64 nt, Homo Sapiens; identical to SEQ ID NO: 90731

SEQ ID NO: 577180 - RNA, 64 nt, Homo Sapiens; identical to SEQ ID NO: 90732

SEQ ID NO: 577181 - RNA, 64 nt, Homo Sapiens; identical to SEQ ID NO: 90733

SEQ ID NO: 577182 - RNA, 64 nt, Homo Sapiens; identical to SEQ ID NO: 90734

SEQ ID NO: 577183 - RNA, 64 nt, Homo Sapiens; identical to SEQ ID NO: 465663

SEQ ID NO: 577184 - RNA, 64 nt, Homo Sapiens; identical to SEQ ID NO: 465664

SEQ ID NO: 577185 - RNA, 64 nt, Homo Sapiens; identical to SEQ ID NO: 465665

SEQ ID NO: 577186 - RNA, 64 nt, Homo Sapiens; identical to SEQ ID NO: 465666

SEQ ID NO: 577187 - RNA, 64 nt, Homo Sapiens; identical to SEQ ID NO: 465667

SEQ ID NO: 577188 - RNA, 64 nt, Homo Sapiens; identical to SEQ ID NO: 465668

SEQ ID NO: 577189 - RNA, 64 nt, Homo Sapiens; identical to SEQ ID NO: 465669

SEQ ID NO: 577190 - RNA, 64 nt, Homo Sapiens; identical to SEQ ID NO: 465670

SEQ ID NO: 577191 - RNA, 64 nt, Homo Sapiens; identical to SEQ ID NO: 465671

SEQ ID NO: 577192 - RNA, 64 nt, Homo Sapiens; identical to SEQ ID NO: 465672

SEQ ID NO: 577193 - RNA, 64 nt, Homo Sapiens; identical to SEQ ID NO: 465673

SEQ ID NO: 577194 - RNA, 64 nt, Homo Sapiens; identical to SEQ ID NO: 465674

SEQ ID NO: 577195 - RNA, 64 nt, Homo Sapiens; identical to SEQ ID NO: 465675

SEQ ID NO: 577196 - RNA, 64 nt, Homo Sapiens; identical to SEQ ID NO: 465676

SEQ ID NO: 577197 - RNA, 64 nt, Homo Sapiens; identical to SEQ ID NO: 465677

SEQ ID NO: 577198 - RNA, 64 nt, Homo Sapiens; identical to SEQ ID NO: 465678

SEQ ID NO: 577199 - RNA, 64 nt, Homo Sapiens
aacuuguuuucuucauccaacagauuuguuuaccacucaaaauuuaaugcauguauuuguaaac

SEQ ID NO: 577200 - RNA, 64 nt, Homo Sapiens
uuuuuacaaugcuucuaaaugcaaaauacuuugcacucaaaaugugccagaaaaaccgucacuu

SEQ ID NO: 577201 - RNA, 64 nt, Homo Sapiens
cauuugcauaguucagacuaggagccaaaugaagacucaaaaccaagcuaguuauuaauccaag

SEQ ID NO: 577202 - RNA, 64 nt, Homo Sapiens
uuguacuucagacauuuagagcagaauuccaagaacucaaaagugaaaagcaacaagcagcuuu

SEQ ID NO: 577203 - RNA, 64 nt, Homo Sapiens
ccaaaaagguggucaaauucaaacauuuccagggacucaaaauuuucaaucacacuuuguggaa

SEQ ID NO: 577204 - RNA, 64 nt, Homo Sapiens
gguauuuuuauagaauuuuuauuuuauguuaaugacucaaaaaauggcugcugcuguuuucuuc

SEQ ID NO: 577205 - RNA, 64 nt, Homo Sapiens
uuuuggguaaauaaaaaaggcuaacuuucaguuuacucaaaaacaguugcuguuccuggaguau

SEQ ID NO: 577206 - RNA, 64 nt, Homo Sapiens
caauuugcacuguacacuaguauuugauguauuuacucaaaacaguucuguaagaaaugagugg

SEQ ID NO: 577207 - RNA, 64 nt, Homo Sapiens
uuugauaaugacuggacaucagaagaggaaaaaaacucaaaacaaaagcgagagagacuauugc

SEQ ID NO: 577208 - RNA, 64 nt, Homo Sapiens
caaaacaaaagcgagagagacuauugccauaugaacucaaaagcuaucaugguguucacucuac

SEQ ID NO: 577209 - RNA, 64 nt, Homo Sapiens
cacaggaagugaagaaucuguuucccagcaguggacucaaaacccaucugggcuccuaaccuuc

SEQ ID NO: 577210 - RNA, 64 nt, Homo Sapiens
caucuuggcacauuuaagagacagucaccccaggacucaaaaauagggaaguaacaguaacgca

SEQ ID NO: 577211 - RNA, 64 nt, Homo Sapiens; identical to SEQ ID NO: 46013

SEQ ID NO: 577212 - RNA, 64 nt, Homo Sapiens; identical to SEQ ID NO: 46014

SEQ ID NO: 577213 - RNA, 64 nt, Homo Sapiens; identical to SEQ ID NO: 46015

SEQ ID NO: 577214 - RNA, 64 nt, Homo Sapiens; identical to SEQ ID NO: 46016

SEQ ID NO: 577215 - RNA, 64 nt, Homo Sapiens; identical to SEQ ID NO: 46017

SEQ ID NO: 577216 - RNA, 64 nt, Homo Sapiens; identical to SEQ ID NO: 46018

SEQ ID NO: 577217 - RNA, 64 nt, Homo Sapiens; identical to SEQ ID NO: 46019

SEQ ID NO: 577218 - RNA, 64 nt, Homo Sapiens; identical to SEQ ID NO: 46020

SEQ ID NO: 577219 - RNA, 64 nt, Homo Sapiens; identical to SEQ ID NO: 46021

SEQ ID NO: 577220 - RNA, 64 nt, Homo Sapiens; identical to SEQ ID NO: 46022

SEQ ID NO: 577221 - RNA, 64 nt, Homo Sapiens; identical to SEQ ID NO: 46023

SEQ ID NO: 577222 - RNA, 64 nt, Homo Sapiens; identical to SEQ ID NO: 46024

SEQ ID NO: 577223 - RNA, 64 nt, Homo Sapiens; identical to SEQ ID NO: 46025

SEQ ID NO: 577224 - RNA, 64 nt, Homo Sapiens; identical to SEQ ID NO: 46026

SEQ ID NO: 577225 - RNA, 64 nt, Homo Sapiens; identical to SEQ ID NO: 46027

SEQ ID NO: 577226 - RNA, 64 nt, Homo Sapiens; identical to SEQ ID NO: 46028

SEQ ID NO: 577227 - RNA, 64 nt, Homo Sapiens; identical to SEQ ID NO: 46029

SEQ ID NO: 577228 - RNA, 64 nt, Homo Sapiens; identical to SEQ ID NO: 46030

SEQ ID NO: 577229 - RNA, 64 nt, Homo Sapiens; identical to SEQ ID NO: 385288

SEQ ID NO: 577230 - RNA, 64 nt, Homo Sapiens; identical to SEQ ID NO: 385289

SEQ ID NO: 577231 - RNA, 64 nt, Homo Sapiens; identical to SEQ ID NO: 385290

SEQ ID NO: 577232 - RNA, 64 nt, Homo Sapiens; identical to SEQ ID NO: 385291

SEQ ID NO: 577233 - RNA, 64 nt, Homo Sapiens; identical to SEQ ID NO: 385292

SEQ ID NO: 577234 - RNA, 64 nt, Homo Sapiens; identical to SEQ ID NO: 385293

SEQ ID NO: 577235 - RNA, 64 nt, Homo Sapiens; identical to SEQ ID NO: 385294

SEQ ID NO: 577236 - RNA, 64 nt, Homo Sapiens; identical to SEQ ID NO: 385295

SEQ ID NO: 577237 - RNA, 64 nt, Homo Sapiens; identical to SEQ ID NO: 312854

SEQ ID NO: 577238 - RNA, 64 nt, Homo Sapiens; identical to SEQ ID NO: 312855

SEQ ID NO: 577239 - RNA, 64 nt, Homo Sapiens; identical to SEQ ID NO: 312856

SEQ ID NO: 577240 - RNA, 64 nt, Homo Sapiens; identical to SEQ ID NO: 312857

SEQ ID NO: 577241 - RNA, 64 nt, Homo Sapiens; identical to SEQ ID NO: 312858

SEQ ID NO: 577242 - RNA, 64 nt, Homo Sapiens; identical to SEQ ID NO: 312859

SEQ ID NO: 577243 - RNA, 64 nt, Homo Sapiens; identical to SEQ ID NO: 312860

SEQ ID NO: 577244 - RNA, 64 nt, Homo Sapiens; identical to SEQ ID NO: 312861

SEQ ID NO: 577245 - RNA, 64 nt, Homo Sapiens; identical to SEQ ID NO: 312862

SEQ ID NO: 577246 - RNA, 64 nt, Homo Sapiens; identical to SEQ ID NO: 312863

SEQ ID NO: 577247 - RNA, 64 nt, Homo Sapiens; identical to SEQ ID NO: 312864

SEQ ID NO: 577248 - RNA, 64 nt, Homo Sapiens; identical to SEQ ID NO: 312865

SEQ ID NO: 577249 - RNA, 64 nt, Homo Sapiens; identical to SEQ ID NO: 312866

SEQ ID NO: 577250 - RNA, 64 nt, Homo Sapiens; identical to SEQ ID NO: 312867

SEQ ID NO: 577251 - RNA, 64 nt, Homo Sapiens; identical to SEQ ID NO: 312868

SEQ ID NO: 577252 - RNA, 64 nt, Homo Sapiens; identical to SEQ ID NO: 312869

SEQ ID NO: 577253 - RNA, 64 nt, Homo Sapiens; identical to SEQ ID NO: 312870

SEQ ID NO: 577254 - RNA, 64 nt, Homo Sapiens; identical to SEQ ID NO: 312871

SEQ ID NO: 577255 - RNA, 64 nt, Homo Sapiens; identical to SEQ ID NO: 312872

SEQ ID NO: 577256 - RNA, 64 nt, Homo Sapiens; identical to SEQ ID NO: 312873

SEQ ID NO: 577257 - RNA, 64 nt, Homo Sapiens; identical to SEQ ID NO: 312874

SEQ ID NO: 577258 - RNA, 64 nt, Homo Sapiens; identical to SEQ ID NO: 312875

SEQ ID NO: 577259 - RNA, 64 nt, Homo Sapiens; identical to SEQ ID NO: 312876

SEQ ID NO: 577260 - RNA, 64 nt, Homo Sapiens; identical to SEQ ID NO: 312877

SEQ ID NO: 577261 - RNA, 64 nt, Homo Sapiens; identical to SEQ ID NO: 312878

SEQ ID NO: 577262 - RNA, 64 nt, Homo Sapiens; identical to SEQ ID NO: 312879

SEQ ID NO: 577263 - RNA, 64 nt, Homo Sapiens; identical to SEQ ID NO: 312880

SEQ ID NO: 577264 - RNA, 64 nt, Homo Sapiens; identical to SEQ ID NO: 312881

SEQ ID NO: 577265 - RNA, 64 nt, Homo Sapiens; identical to SEQ ID NO: 312882

SEQ ID NO: 577266 - RNA, 64 nt, Homo Sapiens; identical to SEQ ID NO: 312883

SEQ ID NO: 577267 - RNA, 64 nt, Homo Sapiens; identical to SEQ ID NO: 312884

SEQ ID NO: 577268 - RNA, 64 nt, Homo Sapiens; identical to SEQ ID NO: 312885

SEQ ID NO: 577269 - RNA, 64 nt, Homo Sapiens; identical to SEQ ID NO: 312886

SEQ ID NO: 577270 - RNA, 64 nt, Homo Sapiens; identical to SEQ ID NO: 312887

SEQ ID NO: 577271 - RNA, 64 nt, Homo Sapiens; identical to SEQ ID NO: 312888

SEQ ID NO: 577272 - RNA, 64 nt, Homo Sapiens; identical to SEQ ID NO: 312889

SEQ ID NO: 577273 - RNA, 64 nt, Homo Sapiens; identical to SEQ ID NO: 312890

SEQ ID NO: 577274 - RNA, 64 nt, Homo Sapiens; identical to SEQ ID NO: 312891

SEQ ID NO: 577275 - RNA, 64 nt, Homo Sapiens; identical to SEQ ID NO: 312892

SEQ ID NO: 577276 - RNA, 64 nt, Homo Sapiens; identical to SEQ ID NO: 312893

SEQ ID NO: 577277 - RNA, 64 nt, Homo Sapiens; identical to SEQ ID NO: 312894

SEQ ID NO: 577278 - RNA, 64 nt, Homo Sapiens; identical to SEQ ID NO: 312895

SEQ ID NO: 577279 - RNA, 64 nt, Homo Sapiens; identical to SEQ ID NO: 312896

SEQ ID NO: 577280 - RNA, 64 nt, Homo Sapiens; identical to SEQ ID NO: 312897

SEQ ID NO: 577281 - RNA, 64 nt, Homo Sapiens; identical to SEQ ID NO: 312898

SEQ ID NO: 577282 - RNA, 64 nt, Homo Sapiens; identical to SEQ ID NO: 312899

SEQ ID NO: 577283 - RNA, 64 nt, Homo Sapiens; identical to SEQ ID NO: 312900

SEQ ID NO: 577284 - RNA, 64 nt, Homo Sapiens; identical to SEQ ID NO: 312901

SEQ ID NO: 577285 - RNA, 64 nt, Homo Sapiens; identical to SEQ ID NO: 312902

SEQ ID NO: 577286 - RNA, 64 nt, Homo Sapiens; identical to SEQ ID NO: 312903

SEQ ID NO: 577287 - RNA, 64 nt, Homo Sapiens; identical to SEQ ID NO: 312904

SEQ ID NO: 577288 - RNA, 64 nt, Homo Sapiens; identical to SEQ ID NO: 312905

SEQ ID NO: 577289 - RNA, 64 nt, Homo Sapiens; identical to SEQ ID NO: 312906

SEQ ID NO: 577290 - RNA, 64 nt, Homo Sapiens; identical to SEQ ID NO: 312907

SEQ ID NO: 577291 - RNA, 64 nt, Homo Sapiens; identical to SEQ ID NO: 312908

SEQ ID NO: 577292 - RNA, 64 nt, Homo Sapiens; identical to SEQ ID NO: 312909

SEQ ID NO: 577293 - RNA, 64 nt, Homo Sapiens; identical to SEQ ID NO: 312910

SEQ ID NO: 577294 - RNA, 64 nt, Homo Sapiens; identical to SEQ ID NO: 312911

SEQ ID NO: 577295 - RNA, 64 nt, Homo Sapiens; identical to SEQ ID NO: 312912

SEQ ID NO: 577296 - RNA, 64 nt, Homo Sapiens; identical to SEQ ID NO: 312913

SEQ ID NO: 577297 - RNA, 64 nt, Homo Sapiens; identical to SEQ ID NO: 312914

SEQ ID NO: 577298 - RNA, 64 nt, Homo Sapiens; identical to SEQ ID NO: 312915

SEQ ID NO: 577299 - RNA, 64 nt, Homo Sapiens; identical to SEQ ID NO: 312916

SEQ ID NO: 577300 - RNA, 64 nt, Homo Sapiens; identical to SEQ ID NO: 312917

SEQ ID NO: 577301 - RNA, 64 nt, Homo Sapiens; identical to SEQ ID NO: 312918

SEQ ID NO: 577302 - RNA, 64 nt, Homo Sapiens; identical to SEQ ID NO: 312919

SEQ ID NO: 577303 - RNA, 64 nt, Homo Sapiens; identical to SEQ ID NO: 312920

SEQ ID NO: 577304 - RNA, 64 nt, Homo Sapiens; identical to SEQ ID NO: 312921

SEQ ID NO: 577305 - RNA, 64 nt, Homo Sapiens; identical to SEQ ID NO: 312922

SEQ ID NO: 577306 - RNA, 64 nt, Homo Sapiens; identical to SEQ ID NO: 312923

SEQ ID NO: 577307 - RNA, 64 nt, Homo Sapiens
gaaugucuggagagggccagcaggcccucugaggguucuggaaucugugcaccuuauuugacca

SEQ ID NO: 577308 - RNA, 64 nt, Homo Sapiens
acucccaauguuguuaaugcucugucuuccauuuguucuggaauccuacguguuggucuguggu

SEQ ID NO: 577309 - RNA, 64 nt, Homo Sapiens
cuguguuuguuugaugcuggacaucauuaagaaaguucuggaaagucaagguucucuuggcugg

SEQ ID NO: 577310 - RNA, 64 nt, Homo Sapiens
aaauaugcaaaaguggguacucuauuucuacugaguucuggaagcugggaaaugucuacaaaug

SEQ ID NO: 577311 - RNA, 64 nt, Homo Sapiens
uggauggggaggaugguugcggggugaugagaaaguucuggagguggauacaaaguuucugauu

SEQ ID NO: 577312 - RNA, 64 nt, Homo Sapiens
agaugccauucuuuuuaagcuggcagcauacaguguucuggaaagaaccaaauauuagcuuuga

SEQ ID NO: 577313 - RNA, 64 nt, Homo Sapiens
cuuaugcccaggguuuuucaaagcacacucugcuguucuggaauugacagcuuggugggaaggg

SEQ ID NO: 577314 - RNA, 64 nt, Homo Sapiens
gagggugggcugugugcagcggagguuccaguggguucuggaggguucccaccucuccuccuug

SEQ ID NO: 577315 - RNA, 64 nt, Homo Sapiens
aacugguuuucaccaaguccaaccaccgcaaugaguucuggagugcucugcuggagaaggcuua

SEQ ID NO: 577316 - RNA, 64 nt, Homo Sapiens
cccgucugcagcaccaggucacugaggauggagaguucuggauguccuaugaggauuucaucua

SEQ ID NO: 577317 - RNA, 64 nt, Homo Sapiens
ugacaaggauggagaugguaucaucaagcucaacguucuggaguggcugcagcucaccauguau

SEQ ID NO: 577318 - RNA, 64 nt, Homo Sapiens
uuucauauaaauggaaucacaauagguuuucccuguucuggacauuugugucucuguugucuaa

SEQ ID NO: 577319 - RNA, 64 nt, Homo Sapiens
auucugucaucaccccgugaaccaccucugucacguucuggaacauccagaaaguuguguaggc

SEQ ID NO: 577320 - RNA, 64 nt, Homo Sapiens
cuugguuucaccaucuuccuguccugccugacaguucgcucauuccaacuaaucaucaucuuca

SEQ ID NO: 577321 - RNA, 64 nt, Homo Sapiens
cucuucuucccuaggucaaaccugguggggguucuucgcucaaccuaaggacucucaaaccaua

SEQ ID NO: 577322 - RNA, 64 nt, Homo Sapiens
cagaccuggacucacagccuggcugugaugcuuguucgcucagcuucuccauuuaugagauggg

SEQ ID NO: 577323 - RNA, 64 nt, Homo Sapiens
ccaagcaagacaugcaguuucaugccucugugccuucgcucaugcuguuucuuccgacuggaau

SEQ ID NO: 577324 - RNA, 64 nt, Homo Sapiens
uuuuuuguggacuacuuuuuugaaaaguuuguucuucgcucaauccuguccaaaauugcagacu

SEQ ID NO: 577325 - RNA, 64 nt, Homo Sapiens
uuacgcugucucugacauaacggccaacacuuuguucgcucauuauuaccagagcaaaguguaa

SEQ ID NO: 577326 - RNA, 56 nt, Homo Sapiens
ugugauauuauaaaacauguaaaauguucgcucauuaaauuaaaagaggauauuga

SEQ ID NO: 577327 - RNA, 64 nt, Homo Sapiens
gugccaugccaauuguucuuauauucuauagaaguucgcucaaaauacucaacaggggaauagg

SEQ ID NO: 577328 - RNA, 64 nt, Homo Sapiens
ccccagcgcccucucugacccuuccugcccacccuucgcucacggcaauaacuggaggcgccuc

SEQ ID NO: 577329 - RNA, 64 nt, Homo Sapiens
gaacuauaacaccuuagagcaguuccggaauuuguucgcucaugaguccuuugaaagggaagca

SEQ ID NO: 577330 - RNA, 64 nt, Homo Sapiens
gacccucaauuguccucuuuguucuggcccaggauucgcucacuuuuucagaagacugugacaa

SEQ ID NO: 577331 - RNA, 64 nt, Homo Sapiens
auugucggcucaacaucucaggccacucauuaccuucgcucaugaucccagcagccauuuuucu

SEQ ID NO: 577332 - RNA, 64 nt, Homo Sapiens
cacuacaugaaguuauuuuaauuuuauuaccuaguucgcucaaaacagcgaauacagcaaacag

SEQ ID NO: 577333 - RNA, 64 nt, Homo Sapiens
aacaucuuucucagccuauuuuguguccuaaugauucgcucaauaaacauguuugaauccacac

SEQ ID NO: 577334 - RNA, 64 nt, Homo Sapiens
agggccuccccuuccccucuugacacaugggaacuucgcucagggggaggggagggcacguucu

SEQ ID NO: 577335 - RNA, 64 nt, Homo Sapiens
uggaagcuucuuuugcaucaauaagaauccauuauucgcucauguuguuucuguucuuauguaa

SEQ ID NO: 577336 - RNA, 64 nt, Homo Sapiens
uggacccugcagugucagggacauugcaauguauuucgcucaucaugaaauggguuuagggaag

SEQ ID NO: 577337 - RNA, 64 nt, Homo Sapiens
auucagauggcuuuccagauagugacagguccccuucgcucauccucucauuuuuaccagucug

SEQ ID NO: 577338 - RNA, 64 nt, Homo Sapiens
uaagaguuuuuaagagagggcuacuuaugugucauucgcucaugaaagagcaaaguucaagugc

SEQ ID NO: 577339 - RNA, 64 nt, Homo Sapiens
guuuauaccucagauugggguauaaaaauuguuuuucgcucaguauuuacuggaaaauggacau

SEQ ID NO: 577340 - RNA, 64 nt, Homo Sapiens
aggcauaaugucuaaaaucuaaauaaugugguacuucgcucaucuguauggugaauauauuauu

SEQ ID NO: 577341 - RNA, 64 nt, Homo Sapiens
cuuuaccggcuuuccccaguaccccacccccaccuucgcucagauucccucgcccccacccucu

SEQ ID NO: 577342 - RNA, 64 nt, Homo Sapiens
gugacucucaggguaucuucuccuuccagcuacuuucgcucacugaucucagcuuauccugcaa

SEQ ID NO: 577343 - RNA, 64 nt, Homo Sapiens
agacacucaggcaggcuggcgugccugcuccgucuucgcucaccagauacauguucccacagag

SEQ ID NO: 577344 - RNA, 64 nt, Homo Sapiens
cagcagguaucugguaaguccauacucagaaaccuucgcucacguaguuggauggcauagagau

SEQ ID NO: 577345 - RNA, 64 nt, Homo Sapiens; identical to SEQ ID NO: 577344

SEQ ID NO: 577346 - RNA, 64 nt, Homo Sapiens
gaggagaaggagccccucagcagaguggugcaguuucgcucagagcuugucuccuuggcuucca

SEQ ID NO: 577347 - RNA, 64 nt, Homo Sapiens
ggaucaaguuguuccacuggacagaaaucacgaauucgcucacucacauccugcugugauguaa

SEQ ID NO: 577348 - RNA, 64 nt, Homo Sapiens
acggacagucauuccuucuccaaugggaugugacuucgcucaucguuaccugugacuauggagc

SEQ ID NO: 577349 - RNA, 64 nt, Homo Sapiens
ugagaugagauaugauuuccgcacaaagucuugcuucgcucagaguuuccacuuaaaucguuuu

SEQ ID NO: 577350 - RNA, 64 nt, Homo Sapiens
cugggccuggggcgcgaccucggcccggccucccuucgcucagcuucuccgcgccccugcuccc

SEQ ID NO: 577351 - RNA, 64 nt, Homo Sapiens
aagaaguuuuugggaugggaaccaaagucuccuguucgcucauaugccuugccgcagagaaaac

SEQ ID NO: 577352 - RNA, 64 nt, Homo Sapiens
ugugaaaugggucuaagaauuuuaaaggccucaguucgcucaccuugagagguugauguaaccu

SEQ ID NO: 577353 - RNA, 64 nt, Homo Sapiens
cccacucaucucaggcugagccacaucucacuuuuucgcucaagcuauauaauccuagacugga

SEQ ID NO: 577354 - RNA, 64 nt, Homo Sapiens
gcauuuggugcagcaggaaacauggggacugccuaggcucgaaucuguggcacccugagcaauu

SEQ ID NO: 577355 - RNA, 64 nt, Homo Sapiens
cuguuagcucgugguccucaaggacucagaaaccaggcucgaggccuaucccagcaagugcugc

SEQ ID NO: 577356 - RNA, 64 nt, Homo Sapiens
acgagacuuucagcauccaguagaugggaccucgaggcucgagcugaagcaggcgagagagaaa

SEQ ID NO: 577357 - RNA, 64 nt, Homo Sapiens
gcuccgggguaucugccuucagggagcgaggaacaggcucgaagaugcccuuuuggccuuugug

SEQ ID NO: 577358 - RNA, 64 nt, Homo Sapiens
ucuuuuguuucuugguccacagcagaccugaggaaggcucgauugaauuuaugggacccacgug

SEQ ID NO: 577359 - RNA, 64 nt, Homo Sapiens
gcacugcacacuuguauauugggggcucaccugaaggcucgaagccggcaccagcaggcccuug

SEQ ID NO: 577360 - RNA, 64 nt, Homo Sapiens
aauaagacaaaaucagcuuuacaacaaucccuagaggcucgaccacagaauaaugccagucacc

SEQ ID NO: 577361 - RNA, 64 nt, Homo Sapiens
gagagaagucagaacagagauuuuccugucgccaaggcucgacuauacgccuuuuuuuuuuuuc

SEQ ID NO: 577362 - RNA, 64 nt, Homo Sapiens
cugaggcugcugccaggcccggcaugaggccccgaggcucgagcucggggcugggggcugcagg

SEQ ID NO: 577363 - RNA, 64 nt, Homo Sapiens
gugguugaucauagcucccgggcuguagucucccaggcucgagcaauccucccacuucacccuc

SEQ ID NO: 577364 - RNA, 64 nt, Homo Sapiens
ccucacuggguaugcagucauauugaccucuggcaggcucgaaggacuuuagucugcugggcug

SEQ ID NO: 577365 - RNA, 64 nt, Homo Sapiens
cuuccugccccacccaguggcucaccccaagugaaggcucgagagcugaccgaucucccuccuc

SEQ ID NO: 577366 - RNA, 64 nt, Homo Sapiens
aagcugacuucuuaggcuaaaucccagguuguggaggcucgaggaauucaccugccccuccccc

SEQ ID NO: 577367 - RNA, 64 nt, Homo Sapiens
uugaggccauacaucaggggccacuucaggcagcaggcucgaguccucucacccuccuccaguc

SEQ ID NO: 577368 - RNA, 64 nt, Homo Sapiens
uuguaucugcaggcagacacuaaaacugcguuaaaggcucgauuaaaaagauauauuaaaaaua

SEQ ID NO: 577369 - RNA, 64 nt, Homo Sapiens
uugugaaccccuaaauccgcgcagcuggagcugaaggcucgaucgaggggcuaggggagaagcu

SEQ ID NO: 577370 - RNA, 64 nt, Homo Sapiens
gauugaucauggcucacuguaaccucugccucccaggcucgauccucccaugucagccucccaa

SEQ ID NO: 577371 - RNA, 64 nt, Homo Sapiens
cuuuaauauaaccccaaaugucugauuuucucagaggcucgaguuuccucuauggcuuugccuu

SEQ ID NO: 577372 - RNA, 64 nt, Homo Sapiens
ugauuaagugacaaagaggucuguuggcaguggaaggcucgaguggauccacuguguaagaaga

SEQ ID NO: 577373 - RNA, 64 nt, Homo Sapiens
ggucccggcccuggcccagccagcccagcccucgaggcucgaugccugugccaaggccaggggc

SEQ ID NO: 577374 - RNA, 64 nt, Homo Sapiens
gccgccccauggaccccucgccggccccgagagcaggcucgaccggcgcccgcacccacccggc

SEQ ID NO: 577375 - RNA, 64 nt, Homo Sapiens
caggcuggacaaaugaccacuauguuagacccccaggcucgacuucaggggucaguguuccugu

SEQ ID NO: 577376 - RNA, 64 nt, Homo Sapiens
cuguucccuguccugccucaugggugcaggugccaggcucgaggagccugcaggcuggggaccc

SEQ ID NO: 577377 - RNA, 64 nt, Homo Sapiens
uucuuucauucgucuccuccuagccugggggaccaggcucgaacugacccuggacaucaaagga

SEQ ID NO: 577378 - RNA, 64 nt, Homo Sapiens
uuuuugggcugagcuguuagaggggcuucuccagaggcucgagagcaggccauuucccaagaag

SEQ ID NO: 577379 - RNA, 64 nt, Homo Sapiens
ccaggucaaauuacuuuccuuuggccucugccugaggcucgauuugccucucugguccaauggg

SEQ ID NO: 577380 - RNA, 64 nt, Homo Sapiens
aagcucaacuugagggcguguaguaaguuguagaaggcucgaggggacguggacuuauuugccu

SEQ ID NO: 577381 - RNA, 64 nt, Homo Sapiens
cccagcucaggccggcugaccgugguggugcuggaggcucgaggccugcguccaggacuugcag

SEQ ID NO: 577382 - RNA, 64 nt, Homo Sapiens
gcacgccagugcuguuucccggccuccagacacaaggcucgagguuauggcagugacuuucagc

SEQ ID NO: 577383 - RNA, 64 nt, Homo Sapiens
gucccgcgcgagcgccacggccaggccgggccggaggcucgaaagagggccaggggcgugcaug

SEQ ID NO: 577384 - RNA, 64 nt, Homo Sapiens
uugaggggaaaguuuuacuggaccagcuuauggaaggcucgacccagcccaucuuccuaaaagg

SEQ ID NO: 577385 - RNA, 62 nt, Homo Sapiens
agaagcggaaaggccguuaaucacuuuuaugaaggcucgaguucugcuguucuguaaaagag

SEQ ID NO: 577386 - RNA, 64 nt, Homo Sapiens
aauaguggucuuuguuauuauagauaccggccacaggcucgacacuuugcaaguuugccaccag

SEQ ID NO: 577387 - RNA, 64 nt, Homo Sapiens
gagacugauccccugaccaacccagccguaagucaggcucgaggcaacagaaagauggggcugu

SEQ ID NO: 577388 - RNA, 64 nt, Homo Sapiens
agacaacagcacacaggcagccagccguggccagaggcucgaggggcucagggccucaggcacc

SEQ ID NO: 577389 - RNA, 64 nt, Homo Sapiens
gaguacuaacauuuauugcucugucaauaaugaaaggcucgauguaauauagcuguaauuuacu

SEQ ID NO: 577390 - RNA, 64 nt, Homo Sapiens
accucaacauuggagacauccaaucaaggcuaggaggcucgaccaauauauuuuuuucaacugc

SEQ ID NO: 577391 - RNA, 64 nt, Homo Sapiens
cauaaagucagggguucccuuuuuuggcugcugaaggcucgagcaugccuggauggggcugcac

SEQ ID NO: 577392 - RNA, 64 nt, Homo Sapiens
cagucucuguuuccagcacugagggaagguggccaggcucgaagccuagaagcagccggcacag

SEQ ID NO: 577393 - RNA, 64 nt, Homo Sapiens
uacaagccauucuaaggaaagagaaaaacaggaaaggcucgaaaaauguacaccuacucuauca

SEQ ID NO: 577394 - RNA, 64 nt, Homo Sapiens
uccuauccccgacccccuccggggaacaccgggaaggcucgacgcuccaggacaggaccagcca

SEQ ID NO: 577395 - RNA, 64 nt, Homo Sapiens
accggcuggggaucuguggggcagcggcgggcgcaggcucgacccgggccaggaggcccggggc

SEQ ID NO: 577396 - RNA, 64 nt, Homo Sapiens
auaaauguagugagugugggaaagcuuuuagcaaaggcucgaaucuuacugcccaucaaagagu

SEQ ID NO: 577397 - RNA, 64 nt, Homo Sapiens
ucgccccugggggcguagcacagcgucuucucggaggcucgaggucuaagagaaacgcugaguu

SEQ ID NO: 577398 - RNA, 63 nt, Homo Sapiens
ccaagagcaagaagaacugaggagugguggaccaggcucgaacacuggccgaggaggagcucu

SEQ ID NO: 577399 - RNA, 64 nt, Homo Sapiens
cggcuuuggggagaugggcgauaaguguugagguaggcucgagaacugcuccccaaaucaguga

SEQ ID NO: 577400 - RNA, 64 nt, Homo Sapiens
cuaauucauuuauuaaguauauuuguaaaagcuaaggcucgaguuaaaacaaugaaguguuuua

SEQ ID NO: 577401 - RNA, 64 nt, Homo Sapiens; identical to SEQ ID NO: 162601

SEQ ID NO: 577402 - RNA, 64 nt, Homo Sapiens; identical to SEQ ID NO: 162602

SEQ ID NO: 577403 - RNA, 64 nt, Homo Sapiens; identical to SEQ ID NO: 162603

SEQ ID NO: 577404 - RNA, 64 nt, Homo Sapiens; identical to SEQ ID NO: 162604

SEQ ID NO: 577405 - RNA, 64 nt, Homo Sapiens; identical to SEQ ID NO: 162605

SEQ ID NO: 577406 - RNA, 64 nt, Homo Sapiens; identical to SEQ ID NO: 162606

SEQ ID NO: 577407 - RNA, 64 nt, Homo Sapiens; identical to SEQ ID NO: 162607

SEQ ID NO: 577408 - RNA, 64 nt, Homo Sapiens; identical to SEQ ID NO: 162608

SEQ ID NO: 577409 - RNA, 64 nt, Homo Sapiens; identical to SEQ ID NO: 162609

SEQ ID NO: 577410 - RNA, 64 nt, Homo Sapiens; identical to SEQ ID NO: 162610

SEQ ID NO: 577411 - RNA, 64 nt, Homo Sapiens; identical to SEQ ID NO: 162611

SEQ ID NO: 577412 - RNA, 64 nt, Homo Sapiens; identical to SEQ ID NO: 162612

SEQ ID NO: 577413 - RNA, 64 nt, Homo Sapiens; identical to SEQ ID NO: 162613

SEQ ID NO: 577414 - RNA, 64 nt, Homo Sapiens; identical to SEQ ID NO: 162614

SEQ ID NO: 577415 - RNA, 64 nt, Homo Sapiens; identical to SEQ ID NO: 162615

SEQ ID NO: 577416 - RNA, 64 nt, Homo Sapiens; identical to SEQ ID NO: 162616

SEQ ID NO: 577417 - RNA, 64 nt, Homo Sapiens; identical to SEQ ID NO: 162617

SEQ ID NO: 577418 - RNA, 64 nt, Homo Sapiens; identical to SEQ ID NO: 162618

SEQ ID NO: 577419 - RNA, 64 nt, Homo Sapiens; identical to SEQ ID NO: 162619

SEQ ID NO: 577420 - RNA, 64 nt, Homo Sapiens; identical to SEQ ID NO: 162620

SEQ ID NO: 577421 - RNA, 64 nt, Homo Sapiens; identical to SEQ ID NO: 162621

SEQ ID NO: 577422 - RNA, 64 nt, Homo Sapiens; identical to SEQ ID NO: 162622

SEQ ID NO: 577423 - RNA, 64 nt, Homo Sapiens; identical to SEQ ID NO: 162623

SEQ ID NO: 577424 - RNA, 64 nt, Homo Sapiens; identical to SEQ ID NO: 162624

SEQ ID NO: 577425 - RNA, 64 nt, Homo Sapiens; identical to SEQ ID NO: 162625

SEQ ID NO: 577426 - RNA, 64 nt, Homo Sapiens; identical to SEQ ID NO: 162626

SEQ ID NO: 577427 - RNA, 64 nt, Homo Sapiens; identical to SEQ ID NO: 162627

SEQ ID NO: 577428 - RNA, 64 nt, Homo Sapiens; identical to SEQ ID NO: 162628

SEQ ID NO: 577429 - RNA, 64 nt, Homo Sapiens; identical to SEQ ID NO: 162629

SEQ ID NO: 577430 - RNA, 64 nt, Homo Sapiens; identical to SEQ ID NO: 162630

SEQ ID NO: 577431 - RNA, 64 nt, Homo Sapiens; identical to SEQ ID NO: 162631

SEQ ID NO: 577432 - RNA, 64 nt, Homo Sapiens; identical to SEQ ID NO: 162632

SEQ ID NO: 577433 - RNA, 64 nt, Homo Sapiens; identical to SEQ ID NO: 162633

SEQ ID NO: 577434 - RNA, 64 nt, Homo Sapiens; identical to SEQ ID NO: 162634

SEQ ID NO: 577435 - RNA, 64 nt, Homo Sapiens; identical to SEQ ID NO: 162635

SEQ ID NO: 577436 - RNA, 64 nt, Homo Sapiens; identical to SEQ ID NO: 162636

SEQ ID NO: 577437 - RNA, 64 nt, Homo Sapiens; identical to SEQ ID NO: 162637

SEQ ID NO: 577438 - RNA, 64 nt, Homo Sapiens; identical to SEQ ID NO: 162638

SEQ ID NO: 577439 - RNA, 64 nt, Homo Sapiens; identical to SEQ ID NO: 162639

SEQ ID NO: 577440 - RNA, 64 nt, Homo Sapiens; identical to SEQ ID NO: 162640

SEQ ID NO: 577441 - RNA, 64 nt, Homo Sapiens; identical to SEQ ID NO: 162641

SEQ ID NO: 577442 - RNA, 64 nt, Homo Sapiens; identical to SEQ ID NO: 162642

SEQ ID NO: 577443 - RNA, 64 nt, Homo Sapiens; identical to SEQ ID NO: 162643

SEQ ID NO: 577444 - RNA, 64 nt, Homo Sapiens; identical to SEQ ID NO: 162644

SEQ ID NO: 577445 - RNA, 64 nt, Homo Sapiens; identical to SEQ ID NO: 162645

SEQ ID NO: 577446 - RNA, 64 nt, Homo Sapiens; identical to SEQ ID NO: 162646

SEQ ID NO: 577447 - RNA, 64 nt, Homo Sapiens; identical to SEQ ID NO: 162647

SEQ ID NO: 577448 - RNA, 64 nt, Homo Sapiens; identical to SEQ ID NO: 162648

SEQ ID NO: 577449 - RNA, 64 nt, Homo Sapiens; identical to SEQ ID NO: 162649

SEQ ID NO: 577450 - RNA, 64 nt, Homo Sapiens; identical to SEQ ID NO: 162650

SEQ ID NO: 577451 - RNA, 64 nt, Homo Sapiens; identical to SEQ ID NO: 162651

SEQ ID NO: 577452 - RNA, 64 nt, Homo Sapiens; identical to SEQ ID NO: 162652

SEQ ID NO: 577453 - RNA, 64 nt, Homo Sapiens; identical to SEQ ID NO: 162653

SEQ ID NO: 577454 - RNA, 64 nt, Homo Sapiens; identical to SEQ ID NO: 162654

SEQ ID NO: 577455 - RNA, 64 nt, Homo Sapiens; identical to SEQ ID NO: 162655

SEQ ID NO: 577456 - RNA, 64 nt, Homo Sapiens; identical to SEQ ID NO: 162656

SEQ ID NO: 577457 - RNA, 64 nt, Homo Sapiens; identical to SEQ ID NO: 162657

SEQ ID NO: 577458 - RNA, 64 nt, Homo Sapiens; identical to SEQ ID NO: 162658

SEQ ID NO: 577459 - RNA, 64 nt, Homo Sapiens; identical to SEQ ID NO: 162659

SEQ ID NO: 577460 - RNA, 64 nt, Homo Sapiens; identical to SEQ ID NO: 162660

SEQ ID NO: 577461 - RNA, 64 nt, Homo Sapiens; identical to SEQ ID NO: 162661

SEQ ID NO: 577462 - RNA, 64 nt, Homo Sapiens; identical to SEQ ID NO: 162662

SEQ ID NO: 577463 - RNA, 64 nt, Homo Sapiens; identical to SEQ ID NO: 162663

SEQ ID NO: 577464 - RNA, 64 nt, Homo Sapiens; identical to SEQ ID NO: 162664

SEQ ID NO: 577465 - RNA, 64 nt, Homo Sapiens; identical to SEQ ID NO: 162665

SEQ ID NO: 577466 - RNA, 64 nt, Homo Sapiens; identical to SEQ ID NO: 162666

SEQ ID NO: 577467 - RNA, 64 nt, Homo Sapiens; identical to SEQ ID NO: 162667

SEQ ID NO: 577468 - RNA, 64 nt, Homo Sapiens; identical to SEQ ID NO: 162668

SEQ ID NO: 577469 - RNA, 64 nt, Homo Sapiens; identical to SEQ ID NO: 162669

SEQ ID NO: 577470 - RNA, 64 nt, Homo Sapiens; identical to SEQ ID NO: 162670

SEQ ID NO: 577471 - RNA, 64 nt, Homo Sapiens; identical to SEQ ID NO: 162671

SEQ ID NO: 577472 - RNA, 64 nt, Homo Sapiens; identical to SEQ ID NO: 162672

SEQ ID NO: 577473 - RNA, 64 nt, Homo Sapiens; identical to SEQ ID NO: 162673

SEQ ID NO: 577474 - RNA, 64 nt, Homo Sapiens; identical to SEQ ID NO: 162674

SEQ ID NO: 577475 - RNA, 64 nt, Homo Sapiens; identical to SEQ ID NO: 162675

SEQ ID NO: 577476 - RNA, 64 nt, Homo Sapiens; identical to SEQ ID NO: 162676

SEQ ID NO: 577477 - RNA, 64 nt, Homo Sapiens; identical to SEQ ID NO: 162677

SEQ ID NO: 577478 - RNA, 64 nt, Homo Sapiens; identical to SEQ ID NO: 162678

SEQ ID NO: 577479 - RNA, 64 nt, Homo Sapiens; identical to SEQ ID NO: 162679

SEQ ID NO: 577480 - RNA, 64 nt, Homo Sapiens; identical to SEQ ID NO: 162680

SEQ ID NO: 577481 - RNA, 64 nt, Homo Sapiens; identical to SEQ ID NO: 162681

SEQ ID NO: 577482 - RNA, 64 nt, Homo Sapiens; identical to SEQ ID NO: 162682

SEQ ID NO: 577483 - RNA, 64 nt, Homo Sapiens; identical to SEQ ID NO: 162683

SEQ ID NO: 577484 - RNA, 64 nt, Homo Sapiens; identical to SEQ ID NO: 162684

SEQ ID NO: 577485 - RNA, 64 nt, Homo Sapiens; identical to SEQ ID NO: 162685

SEQ ID NO: 577486 - RNA, 64 nt, Homo Sapiens; identical to SEQ ID NO: 162686

SEQ ID NO: 577487 - RNA, 64 nt, Homo Sapiens; identical to SEQ ID NO: 162687

SEQ ID NO: 577488 - RNA, 64 nt, Homo Sapiens; identical to SEQ ID NO: 162688

SEQ ID NO: 577489 - RNA, 64 nt, Homo Sapiens; identical to SEQ ID NO: 162689

SEQ ID NO: 577490 - RNA, 64 nt, Homo Sapiens; identical to SEQ ID NO: 162690

SEQ ID NO: 577491 - RNA, 64 nt, Homo Sapiens; identical to SEQ ID NO: 162691

SEQ ID NO: 577492 - RNA, 64 nt, Homo Sapiens; identical to SEQ ID NO: 162692

SEQ ID NO: 577493 - RNA, 64 nt, Homo Sapiens; identical to SEQ ID NO: 162693

SEQ ID NO: 577494 - RNA, 64 nt, Homo Sapiens; identical to SEQ ID NO: 162694

SEQ ID NO: 577495 - RNA, 64 nt, Homo Sapiens; identical to SEQ ID NO: 162695

SEQ ID NO: 577496 - RNA, 64 nt, Homo Sapiens; identical to SEQ ID NO: 162696

SEQ ID NO: 577497 - RNA, 64 nt, Homo Sapiens; identical to SEQ ID NO: 162697

SEQ ID NO: 577498 - RNA, 64 nt, Homo Sapiens; identical to SEQ ID NO: 162698

SEQ ID NO: 577499 - RNA, 64 nt, Homo Sapiens; identical to SEQ ID NO: 162699

SEQ ID NO: 577500 - RNA, 64 nt, Homo Sapiens; identical to SEQ ID NO: 162700

SEQ ID NO: 577501 - RNA, 64 nt, Homo Sapiens; identical to SEQ ID NO: 162701

SEQ ID NO: 577502 - RNA, 64 nt, Homo Sapiens; identical to SEQ ID NO: 162702

SEQ ID NO: 577503 - RNA, 64 nt, Homo Sapiens; identical to SEQ ID NO: 162703

SEQ ID NO: 577504 - RNA, 64 nt, Homo Sapiens; identical to SEQ ID NO: 162704

SEQ ID NO: 577505 - RNA, 64 nt, Homo Sapiens; identical to SEQ ID NO: 162705

SEQ ID NO: 577506 - RNA, 64 nt, Homo Sapiens; identical to SEQ ID NO: 162706

SEQ ID NO: 577507 - RNA, 64 nt, Homo Sapiens; identical to SEQ ID NO: 162707

SEQ ID NO: 577508 - RNA, 64 nt, Homo Sapiens; identical to SEQ ID NO: 162708

SEQ ID NO: 577509 - RNA, 64 nt, Homo Sapiens; identical to SEQ ID NO: 162709

SEQ ID NO: 577510 - RNA, 64 nt, Homo Sapiens; identical to SEQ ID NO: 162710

SEQ ID NO: 577511 - RNA, 64 nt, Homo Sapiens; identical to SEQ ID NO: 162711

SEQ ID NO: 577512 - RNA, 64 nt, Homo Sapiens; identical to SEQ ID NO: 162712

SEQ ID NO: 577513 - RNA, 64 nt, Homo Sapiens; identical to SEQ ID NO: 162713

SEQ ID NO: 577514 - RNA, 64 nt, Homo Sapiens; identical to SEQ ID NO: 162714

SEQ ID NO: 577515 - RNA, 64 nt, Homo Sapiens; identical to SEQ ID NO: 162715

SEQ ID NO: 577516 - RNA, 64 nt, Homo Sapiens; identical to SEQ ID NO: 162716

SEQ ID NO: 577517 - RNA, 64 nt, Homo Sapiens; identical to SEQ ID NO: 162717

SEQ ID NO: 577518 - RNA, 64 nt, Homo Sapiens; identical to SEQ ID NO: 162718

SEQ ID NO: 577519 - RNA, 64 nt, Homo Sapiens; identical to SEQ ID NO: 162719

SEQ ID NO: 577520 - RNA, 64 nt, Homo Sapiens; identical to SEQ ID NO: 162720

SEQ ID NO: 577521 - RNA, 64 nt, Homo Sapiens; identical to SEQ ID NO: 162721

SEQ ID NO: 577522 - RNA, 64 nt, Homo Sapiens; identical to SEQ ID NO: 162722

SEQ ID NO: 577523 - RNA, 64 nt, Homo Sapiens; identical to SEQ ID NO: 162723

SEQ ID NO: 577524 - RNA, 64 nt, Homo Sapiens; identical to SEQ ID NO: 162724

SEQ ID NO: 577525 - RNA, 64 nt, Homo Sapiens; identical to SEQ ID NO: 162725

SEQ ID NO: 577526 - RNA, 64 nt, Homo Sapiens; identical to SEQ ID NO: 162726

SEQ ID NO: 577527 - RNA, 64 nt, Homo Sapiens; identical to SEQ ID NO: 162727

SEQ ID NO: 577528 - RNA, 64 nt, Homo Sapiens; identical to SEQ ID NO: 162728

SEQ ID NO: 577529 - RNA, 64 nt, Homo Sapiens; identical to SEQ ID NO: 162729

SEQ ID NO: 577530 - RNA, 64 nt, Homo Sapiens; identical to SEQ ID NO: 162730

SEQ ID NO: 577531 - RNA, 64 nt, Homo Sapiens; identical to SEQ ID NO: 162731

SEQ ID NO: 577532 - RNA, 64 nt, Homo Sapiens; identical to SEQ ID NO: 162732

SEQ ID NO: 577533 - RNA, 64 nt, Homo Sapiens; identical to SEQ ID NO: 162733

SEQ ID NO: 577534 - RNA, 64 nt, Homo Sapiens; identical to SEQ ID NO: 162734

SEQ ID NO: 577535 - RNA, 64 nt, Homo Sapiens; identical to SEQ ID NO: 162735

SEQ ID NO: 577536 - RNA, 64 nt, Homo Sapiens; identical to SEQ ID NO: 162736

SEQ ID NO: 577537 - RNA, 64 nt, Homo Sapiens; identical to SEQ ID NO: 162737

SEQ ID NO: 577538 - RNA, 64 nt, Homo Sapiens; identical to SEQ ID NO: 162738

SEQ ID NO: 577539 - RNA, 64 nt, Homo Sapiens; identical to SEQ ID NO: 162739

SEQ ID NO: 577540 - RNA, 64 nt, Homo Sapiens; identical to SEQ ID NO: 162740

SEQ ID NO: 577541 - RNA, 64 nt, Homo Sapiens; identical to SEQ ID NO: 162741

SEQ ID NO: 577542 - RNA, 64 nt, Homo Sapiens; identical to SEQ ID NO: 162742

SEQ ID NO: 577543 - RNA, 64 nt, Homo Sapiens; identical to SEQ ID NO: 162743

SEQ ID NO: 577544 - RNA, 64 nt, Homo Sapiens; identical to SEQ ID NO: 162744

SEQ ID NO: 577545 - RNA, 63 nt, Homo Sapiens; identical to SEQ ID NO: 162745

SEQ ID NO: 577546 - RNA, 64 nt, Homo Sapiens; identical to SEQ ID NO: 162746

SEQ ID NO: 577547 - RNA, 64 nt, Homo Sapiens; identical to SEQ ID NO: 162747

SEQ ID NO: 577548 - RNA, 64 nt, Homo Sapiens; identical to SEQ ID NO: 162748

SEQ ID NO: 577549 - RNA, 64 nt, Homo Sapiens; identical to SEQ ID NO: 162749

SEQ ID NO: 577550 - RNA, 64 nt, Homo Sapiens; identical to SEQ ID NO: 162750

SEQ ID NO: 577551 - RNA, 64 nt, Homo Sapiens; identical to SEQ ID NO: 162751

SEQ ID NO: 577552 - RNA, 64 nt, Homo Sapiens; identical to SEQ ID NO: 162752

SEQ ID NO: 577553 - RNA, 64 nt, Homo Sapiens; identical to SEQ ID NO: 162753

SEQ ID NO: 577554 - RNA, 64 nt, Homo Sapiens; identical to SEQ ID NO: 162754

SEQ ID NO: 577555 - RNA, 64 nt, Homo Sapiens; identical to SEQ ID NO: 162755

SEQ ID NO: 577556 - RNA, 64 nt, Homo Sapiens; identical to SEQ ID NO: 162756

SEQ ID NO: 577557 - RNA, 64 nt, Homo Sapiens; identical to SEQ ID NO: 162757

SEQ ID NO: 577558 - RNA, 64 nt, Homo Sapiens; identical to SEQ ID NO: 162758

SEQ ID NO: 577559 - RNA, 64 nt, Homo Sapiens; identical to SEQ ID NO: 162759

SEQ ID NO: 577560 - RNA, 64 nt, Homo Sapiens; identical to SEQ ID NO: 162760

SEQ ID NO: 577561 - RNA, 64 nt, Homo Sapiens; identical to SEQ ID NO: 162761

SEQ ID NO: 577562 - RNA, 64 nt, Homo Sapiens; identical to SEQ ID NO: 162762

SEQ ID NO: 577563 - RNA, 64 nt, Homo Sapiens; identical to SEQ ID NO: 162763

SEQ ID NO: 577564 - RNA, 64 nt, Homo Sapiens; identical to SEQ ID NO: 162764

SEQ ID NO: 577565 - RNA, 64 nt, Homo Sapiens; identical to SEQ ID NO: 162765

SEQ ID NO: 577566 - RNA, 64 nt, Homo Sapiens; identical to SEQ ID NO: 162766

SEQ ID NO: 577567 - RNA, 64 nt, Homo Sapiens; identical to SEQ ID NO: 162767

SEQ ID NO: 577568 - RNA, 64 nt, Homo Sapiens; identical to SEQ ID NO: 162768

SEQ ID NO: 577569 - RNA, 64 nt, Homo Sapiens; identical to SEQ ID NO: 162769

SEQ ID NO: 577570 - RNA, 64 nt, Homo Sapiens; identical to SEQ ID NO: 162770

SEQ ID NO: 577571 - RNA, 64 nt, Homo Sapiens; identical to SEQ ID NO: 162771

SEQ ID NO: 577572 - RNA, 64 nt, Homo Sapiens; identical to SEQ ID NO: 162772

SEQ ID NO: 577573 - RNA, 64 nt, Homo Sapiens; identical to SEQ ID NO: 162773

SEQ ID NO: 577574 - RNA, 64 nt, Homo Sapiens; identical to SEQ ID NO: 162774

SEQ ID NO: 577575 - RNA, 64 nt, Homo Sapiens; identical to SEQ ID NO: 162775

SEQ ID NO: 577576 - RNA, 64 nt, Homo Sapiens; identical to SEQ ID NO: 162776

SEQ ID NO: 577577 - RNA, 64 nt, Homo Sapiens; identical to SEQ ID NO: 162777

SEQ ID NO: 577578 - RNA, 64 nt, Homo Sapiens; identical to SEQ ID NO: 162778

SEQ ID NO: 577579 - RNA, 64 nt, Homo Sapiens; identical to SEQ ID NO: 162779

SEQ ID NO: 577580 - RNA, 64 nt, Homo Sapiens; identical to SEQ ID NO: 162780

SEQ ID NO: 577581 - RNA, 64 nt, Homo Sapiens; identical to SEQ ID NO: 162781

SEQ ID NO: 577582 - RNA, 64 nt, Homo Sapiens; identical to SEQ ID NO: 162782

SEQ ID NO: 577583 - RNA, 64 nt, Homo Sapiens; identical to SEQ ID NO: 162783

SEQ ID NO: 577584 - RNA, 64 nt, Homo Sapiens; identical to SEQ ID NO: 162784

SEQ ID NO: 577585 - RNA, 64 nt, Homo Sapiens; identical to SEQ ID NO: 162785

SEQ ID NO: 577586 - RNA, 64 nt, Homo Sapiens; identical to SEQ ID NO: 162786

SEQ ID NO: 577587 - RNA, 64 nt, Homo Sapiens; identical to SEQ ID NO: 162787

SEQ ID NO: 577588 - RNA, 64 nt, Homo Sapiens; identical to SEQ ID NO: 162788

SEQ ID NO: 577589 - RNA, 64 nt, Homo Sapiens; identical to SEQ ID NO: 162789

SEQ ID NO: 577590 - RNA, 64 nt, Homo Sapiens; identical to SEQ ID NO: 162790

SEQ ID NO: 577591 - RNA, 64 nt, Homo Sapiens; identical to SEQ ID NO: 162791

SEQ ID NO: 577592 - RNA, 64 nt, Homo Sapiens; identical to SEQ ID NO: 162792

SEQ ID NO: 577593 - RNA, 64 nt, Homo Sapiens; identical to SEQ ID NO: 162793

SEQ ID NO: 577594 - RNA, 64 nt, Homo Sapiens; identical to SEQ ID NO: 162794

SEQ ID NO: 577595 - RNA, 64 nt, Homo Sapiens; identical to SEQ ID NO: 162795

SEQ ID NO: 577596 - RNA, 64 nt, Homo Sapiens; identical to SEQ ID NO: 162796

SEQ ID NO: 577597 - RNA, 64 nt, Homo Sapiens; identical to SEQ ID NO: 162797

SEQ ID NO: 577598 - RNA, 64 nt, Homo Sapiens; identical to SEQ ID NO: 162798

SEQ ID NO: 577599 - RNA, 64 nt, Homo Sapiens; identical to SEQ ID NO: 162799

SEQ ID NO: 577600 - RNA, 64 nt, Homo Sapiens; identical to SEQ ID NO: 162800

SEQ ID NO: 577601 - RNA, 64 nt, Homo Sapiens; identical to SEQ ID NO: 162801

SEQ ID NO: 577602 - RNA, 64 nt, Homo Sapiens; identical to SEQ ID NO: 162802

SEQ ID NO: 577603 - RNA, 64 nt, Homo Sapiens; identical to SEQ ID NO: 162803

SEQ ID NO: 577604 - RNA, 64 nt, Homo Sapiens; identical to SEQ ID NO: 162804

SEQ ID NO: 577605 - RNA, 64 nt, Homo Sapiens; identical to SEQ ID NO: 162805

SEQ ID NO: 577606 - RNA, 64 nt, Homo Sapiens; identical to SEQ ID NO: 162806

SEQ ID NO: 577607 - RNA, 64 nt, Homo Sapiens; identical to SEQ ID NO: 162807

SEQ ID NO: 577608 - RNA, 64 nt, Homo Sapiens; identical to SEQ ID NO: 162808

SEQ ID NO: 577609 - RNA, 64 nt, Homo Sapiens; identical to SEQ ID NO: 162809

SEQ ID NO: 577610 - RNA, 64 nt, Homo Sapiens; identical to SEQ ID NO: 162810

SEQ ID NO: 577611 - RNA, 64 nt, Homo Sapiens; identical to SEQ ID NO: 162811

SEQ ID NO: 577612 - RNA, 64 nt, Homo Sapiens; identical to SEQ ID NO: 162812

SEQ ID NO: 577613 - RNA, 64 nt, Homo Sapiens; identical to SEQ ID NO: 162813

SEQ ID NO: 577614 - RNA, 62 nt, Homo Sapiens; identical to SEQ ID NO: 162814

SEQ ID NO: 577615 - RNA, 64 nt, Homo Sapiens; identical to SEQ ID NO: 162815

SEQ ID NO: 577616 - RNA, 64 nt, Homo Sapiens; identical to SEQ ID NO: 162816

SEQ ID NO: 577617 - RNA, 64 nt, Homo Sapiens; identical to SEQ ID NO: 162817

SEQ ID NO: 577618 - RNA, 64 nt, Homo Sapiens; identical to SEQ ID NO: 162818

SEQ ID NO: 577619 - RNA, 64 nt, Homo Sapiens; identical to SEQ ID NO: 162819

SEQ ID NO: 577620 - RNA, 64 nt, Homo Sapiens; identical to SEQ ID NO: 162820

SEQ ID NO: 577621 - RNA, 64 nt, Homo Sapiens; identical to SEQ ID NO: 162821

SEQ ID NO: 577622 - RNA, 64 nt, Homo Sapiens; identical to SEQ ID NO: 162822

SEQ ID NO: 577623 - RNA, 64 nt, Homo Sapiens; identical to SEQ ID NO: 162823

SEQ ID NO: 577624 - RNA, 64 nt, Homo Sapiens; identical to SEQ ID NO: 162824

SEQ ID NO: 577625 - RNA, 64 nt, Homo Sapiens; identical to SEQ ID NO: 162825

SEQ ID NO: 577626 - RNA, 64 nt, Homo Sapiens; identical to SEQ ID NO: 162826

SEQ ID NO: 577627 - RNA, 64 nt, Homo Sapiens; identical to SEQ ID NO: 162827

SEQ ID NO: 577628 - RNA, 64 nt, Homo Sapiens; identical to SEQ ID NO: 162828

SEQ ID NO: 577629 - RNA, 64 nt, Homo Sapiens; identical to SEQ ID NO: 162829

SEQ ID NO: 577630 - RNA, 64 nt, Homo Sapiens; identical to SEQ ID NO: 162830

SEQ ID NO: 577631 - RNA, 64 nt, Homo Sapiens; identical to SEQ ID NO: 162831

SEQ ID NO: 577632 - RNA, 64 nt, Homo Sapiens; identical to SEQ ID NO: 162832

SEQ ID NO: 577633 - RNA, 64 nt, Homo Sapiens; identical to SEQ ID NO: 162833

SEQ ID NO: 577634 - RNA, 64 nt, Homo Sapiens; identical to SEQ ID NO: 162834

SEQ ID NO: 577635 - RNA, 64 nt, Homo Sapiens; identical to SEQ ID NO: 162835

SEQ ID NO: 577636 - RNA, 64 nt, Homo Sapiens; identical to SEQ ID NO: 162836

SEQ ID NO: 577637 - RNA, 64 nt, Homo Sapiens; identical to SEQ ID NO: 162837

SEQ ID NO: 577638 - RNA, 64 nt, Homo Sapiens; identical to SEQ ID NO: 162838

SEQ ID NO: 577639 - RNA, 64 nt, Homo Sapiens; identical to SEQ ID NO: 162839

SEQ ID NO: 577640 - RNA, 64 nt, Homo Sapiens; identical to SEQ ID NO: 162840

SEQ ID NO: 577641 - RNA, 64 nt, Homo Sapiens; identical to SEQ ID NO: 162841

SEQ ID NO: 577642 - RNA, 64 nt, Homo Sapiens; identical to SEQ ID NO: 162842

SEQ ID NO: 577643 - RNA, 64 nt, Homo Sapiens; identical to SEQ ID NO: 162843

SEQ ID NO: 577644 - RNA, 64 nt, Homo Sapiens; identical to SEQ ID NO: 162844

SEQ ID NO: 577645 - RNA, 64 nt, Homo Sapiens; identical to SEQ ID NO: 162845

SEQ ID NO: 577646 - RNA, 64 nt, Homo Sapiens; identical to SEQ ID NO: 162846

SEQ ID NO: 577647 - RNA, 64 nt, Homo Sapiens; identical to SEQ ID NO: 162847

SEQ ID NO: 577648 - RNA, 64 nt, Homo Sapiens; identical to SEQ ID NO: 162848

SEQ ID NO: 577649 - RNA, 64 nt, Homo Sapiens; identical to SEQ ID NO: 162849

SEQ ID NO: 577650 - RNA, 64 nt, Homo Sapiens; identical to SEQ ID NO: 162850

SEQ ID NO: 577651 - RNA, 64 nt, Homo Sapiens; identical to SEQ ID NO: 162851

SEQ ID NO: 577652 - RNA, 64 nt, Homo Sapiens; identical to SEQ ID NO: 162852

SEQ ID NO: 577653 - RNA, 64 nt, Homo Sapiens; identical to SEQ ID NO: 162853

SEQ ID NO: 577654 - RNA, 64 nt, Homo Sapiens; identical to SEQ ID NO: 162854

SEQ ID NO: 577655 - RNA, 64 nt, Homo Sapiens; identical to SEQ ID NO: 162855

SEQ ID NO: 577656 - RNA, 64 nt, Homo Sapiens; identical to SEQ ID NO: 162856

SEQ ID NO: 577657 - RNA, 64 nt, Homo Sapiens; identical to SEQ ID NO: 162857

SEQ ID NO: 577658 - RNA, 64 nt, Homo Sapiens; identical to SEQ ID NO: 162858

SEQ ID NO: 577659 - RNA, 64 nt, Homo Sapiens; identical to SEQ ID NO: 162859

SEQ ID NO: 577660 - RNA, 64 nt, Homo Sapiens; identical to SEQ ID NO: 162860

SEQ ID NO: 577661 - RNA, 64 nt, Homo Sapiens; identical to SEQ ID NO: 162861

SEQ ID NO: 577662 - RNA, 64 nt, Homo Sapiens; identical to SEQ ID NO: 162862

SEQ ID NO: 577663 - RNA, 64 nt, Homo Sapiens; identical to SEQ ID NO: 162863

SEQ ID NO: 577664 - RNA, 64 nt, Homo Sapiens; identical to SEQ ID NO: 162864

SEQ ID NO: 577665 - RNA, 64 nt, Homo Sapiens; identical to SEQ ID NO: 162865

SEQ ID NO: 577666 - RNA, 64 nt, Homo Sapiens; identical to SEQ ID NO: 162866

SEQ ID NO: 577667 - RNA, 64 nt, Homo Sapiens; identical to SEQ ID NO: 162867

SEQ ID NO: 577668 - RNA, 64 nt, Homo Sapiens; identical to SEQ ID NO: 162868

SEQ ID NO: 577669 - RNA, 64 nt, Homo Sapiens; identical to SEQ ID NO: 162869

SEQ ID NO: 577670 - RNA, 64 nt, Homo Sapiens; identical to SEQ ID NO: 162870

SEQ ID NO: 577671 - RNA, 64 nt, Homo Sapiens; identical to SEQ ID NO: 162871

SEQ ID NO: 577672 - RNA, 64 nt, Homo Sapiens; identical to SEQ ID NO: 162872

SEQ ID NO: 577673 - RNA, 64 nt, Homo Sapiens; identical to SEQ ID NO: 162873

SEQ ID NO: 577674 - RNA, 64 nt, Homo Sapiens; identical to SEQ ID NO: 162874

SEQ ID NO: 577675 - RNA, 64 nt, Homo Sapiens; identical to SEQ ID NO: 162875

SEQ ID NO: 577676 - RNA, 64 nt, Homo Sapiens; identical to SEQ ID NO: 162876

SEQ ID NO: 577677 - RNA, 64 nt, Homo Sapiens; identical to SEQ ID NO: 162877

SEQ ID NO: 577678 - RNA, 64 nt, Homo Sapiens; identical to SEQ ID NO: 162878

SEQ ID NO: 577679 - RNA, 64 nt, Homo Sapiens; identical to SEQ ID NO: 162879

SEQ ID NO: 577680 - RNA, 64 nt, Homo Sapiens; identical to SEQ ID NO: 162880

SEQ ID NO: 577681 - RNA, 64 nt, Homo Sapiens; identical to SEQ ID NO: 162881

SEQ ID NO: 577682 - RNA, 64 nt, Homo Sapiens; identical to SEQ ID NO: 162882

SEQ ID NO: 577683 - RNA, 64 nt, Homo Sapiens; identical to SEQ ID NO: 162883

SEQ ID NO: 577684 - RNA, 64 nt, Homo Sapiens; identical to SEQ ID NO: 162884

SEQ ID NO: 577685 - RNA, 64 nt, Homo Sapiens; identical to SEQ ID NO: 162885

SEQ ID NO: 577686 - RNA, 64 nt, Homo Sapiens; identical to SEQ ID NO: 162886

SEQ ID NO: 577687 - RNA, 64 nt, Homo Sapiens; identical to SEQ ID NO: 162887

SEQ ID NO: 577688 - RNA, 64 nt, Homo Sapiens; identical to SEQ ID NO: 162888

SEQ ID NO: 577689 - RNA, 64 nt, Homo Sapiens; identical to SEQ ID NO: 162889

SEQ ID NO: 577690 - RNA, 64 nt, Homo Sapiens; identical to SEQ ID NO: 162890

SEQ ID NO: 577691 - RNA, 64 nt, Homo Sapiens; identical to SEQ ID NO: 162891

SEQ ID NO: 577692 - RNA, 64 nt, Homo Sapiens; identical to SEQ ID NO: 162892

SEQ ID NO: 577693 - RNA, 64 nt, Homo Sapiens; identical to SEQ ID NO: 162893

SEQ ID NO: 577694 - RNA, 64 nt, Homo Sapiens; identical to SEQ ID NO: 162894

SEQ ID NO: 577695 - RNA, 64 nt, Homo Sapiens; identical to SEQ ID NO: 162895

SEQ ID NO: 577696 - RNA, 64 nt, Homo Sapiens; identical to SEQ ID NO: 162896

SEQ ID NO: 577697 - RNA, 64 nt, Homo Sapiens; identical to SEQ ID NO: 162897

SEQ ID NO: 577698 - RNA, 64 nt, Homo Sapiens; identical to SEQ ID NO: 162898

SEQ ID NO: 577699 - RNA, 64 nt, Homo Sapiens; identical to SEQ ID NO: 162899

SEQ ID NO: 577700 - RNA, 64 nt, Homo Sapiens; identical to SEQ ID NO: 162900

SEQ ID NO: 577701 - RNA, 64 nt, Homo Sapiens; identical to SEQ ID NO: 162901

SEQ ID NO: 577702 - RNA, 64 nt, Homo Sapiens; identical to SEQ ID NO: 162902

SEQ ID NO: 577703 - RNA, 64 nt, Homo Sapiens; identical to SEQ ID NO: 162903

SEQ ID NO: 577704 - RNA, 64 nt, Homo Sapiens; identical to SEQ ID NO: 162904

SEQ ID NO: 577705 - RNA, 64 nt, Homo Sapiens; identical to SEQ ID NO: 162905

SEQ ID NO: 577706 - RNA, 64 nt, Homo Sapiens; identical to SEQ ID NO: 162906

SEQ ID NO: 577707 - RNA, 64 nt, Homo Sapiens; identical to SEQ ID NO: 162907

SEQ ID NO: 577708 - RNA, 64 nt, Homo Sapiens; identical to SEQ ID NO: 162908

SEQ ID NO: 577709 - RNA, 64 nt, Homo Sapiens; identical to SEQ ID NO: 162909

SEQ ID NO: 577710 - RNA, 64 nt, Homo Sapiens; identical to SEQ ID NO: 162910

SEQ ID NO: 577711 - RNA, 64 nt, Homo Sapiens; identical to SEQ ID NO: 162911

SEQ ID NO: 577712 - RNA, 64 nt, Homo Sapiens; identical to SEQ ID NO: 162912

SEQ ID NO: 577713 - RNA, 64 nt, Homo Sapiens; identical to SEQ ID NO: 162913

SEQ ID NO: 577714 - RNA, 64 nt, Homo Sapiens; identical to SEQ ID NO: 162914

SEQ ID NO: 577715 - RNA, 64 nt, Homo Sapiens; identical to SEQ ID NO: 162915

SEQ ID NO: 577716 - RNA, 64 nt, Homo Sapiens; identical to SEQ ID NO: 162916

SEQ ID NO: 577717 - RNA, 64 nt, Homo Sapiens; identical to SEQ ID NO: 162917

SEQ ID NO: 577718 - RNA, 64 nt, Homo Sapiens; identical to SEQ ID NO: 162918

SEQ ID NO: 577719 - RNA, 64 nt, Homo Sapiens; identical to SEQ ID NO: 162919

SEQ ID NO: 577720 - RNA, 64 nt, Homo Sapiens; identical to SEQ ID NO: 162920

SEQ ID NO: 577721 - RNA, 64 nt, Homo Sapiens; identical to SEQ ID NO: 162921

SEQ ID NO: 577722 - RNA, 64 nt, Homo Sapiens; identical to SEQ ID NO: 162922

SEQ ID NO: 577723 - RNA, 53 nt, Homo Sapiens; identical to SEQ ID NO: 162923

SEQ ID NO: 577724 - RNA, 64 nt, Homo Sapiens; identical to SEQ ID NO: 162924

SEQ ID NO: 577725 - RNA, 64 nt, Homo Sapiens; identical to SEQ ID NO: 162925

SEQ ID NO: 577726 - RNA, 64 nt, Homo Sapiens; identical to SEQ ID NO: 162926

SEQ ID NO: 577727 - RNA, 64 nt, Homo Sapiens; identical to SEQ ID NO: 162927

SEQ ID NO: 577728 - RNA, 64 nt, Homo Sapiens; identical to SEQ ID NO: 162928

SEQ ID NO: 577729 - RNA, 64 nt, Homo Sapiens; identical to SEQ ID NO: 162929

SEQ ID NO: 577730 - RNA, 64 nt, Homo Sapiens; identical to SEQ ID NO: 162930

SEQ ID NO: 577731 - RNA, 64 nt, Homo Sapiens; identical to SEQ ID NO: 162931

SEQ ID NO: 577732 - RNA, 64 nt, Homo Sapiens; identical to SEQ ID NO: 162932

SEQ ID NO: 577733 - RNA, 64 nt, Homo Sapiens; identical to SEQ ID NO: 162933

SEQ ID NO: 577734 - RNA, 64 nt, Homo Sapiens; identical to SEQ ID NO: 162934

SEQ ID NO: 577735 - RNA, 64 nt, Homo Sapiens; identical to SEQ ID NO: 162935

SEQ ID NO: 577736 - RNA, 64 nt, Homo Sapiens; identical to SEQ ID NO: 162936

SEQ ID NO: 577737 - RNA, 64 nt, Homo Sapiens; identical to SEQ ID NO: 162937

SEQ ID NO: 577738 - RNA, 64 nt, Homo Sapiens; identical to SEQ ID NO: 162938

SEQ ID NO: 577739 - RNA, 64 nt, Homo Sapiens; identical to SEQ ID NO: 162939

SEQ ID NO: 577740 - RNA, 64 nt, Homo Sapiens; identical to SEQ ID NO: 162940

SEQ ID NO: 577741 - RNA, 64 nt, Homo Sapiens; identical to SEQ ID NO: 162941

SEQ ID NO: 577742 - RNA, 64 nt, Homo Sapiens; identical to SEQ ID NO: 162942

SEQ ID NO: 577743 - RNA, 64 nt, Homo Sapiens; identical to SEQ ID NO: 162943

SEQ ID NO: 577744 - RNA, 64 nt, Homo Sapiens; identical to SEQ ID NO: 162944

SEQ ID NO: 577745 - RNA, 64 nt, Homo Sapiens; identical to SEQ ID NO: 162945

SEQ ID NO: 577746 - RNA, 64 nt, Homo Sapiens; identical to SEQ ID NO: 162946

SEQ ID NO: 577747 - RNA, 64 nt, Homo Sapiens; identical to SEQ ID NO: 162947

SEQ ID NO: 577748 - RNA, 64 nt, Homo Sapiens; identical to SEQ ID NO: 162948

SEQ ID NO: 577749 - RNA, 64 nt, Homo Sapiens; identical to SEQ ID NO: 162949

SEQ ID NO: 577750 - RNA, 64 nt, Homo Sapiens; identical to SEQ ID NO: 162950

SEQ ID NO: 577751 - RNA, 64 nt, Homo Sapiens; identical to SEQ ID NO: 162951

SEQ ID NO: 577752 - RNA, 64 nt, Homo Sapiens; identical to SEQ ID NO: 162952

SEQ ID NO: 577753 - RNA, 64 nt, Homo Sapiens; identical to SEQ ID NO: 162953

SEQ ID NO: 577754 - RNA, 64 nt, Homo Sapiens; identical to SEQ ID NO: 162954

SEQ ID NO: 577755 - RNA, 64 nt, Homo Sapiens; identical to SEQ ID NO: 162955

SEQ ID NO: 577756 - RNA, 64 nt, Homo Sapiens; identical to SEQ ID NO: 162956

SEQ ID NO: 577757 - RNA, 64 nt, Homo Sapiens; identical to SEQ ID NO: 162957

SEQ ID NO: 577758 - RNA, 64 nt, Homo Sapiens; identical to SEQ ID NO: 162958

SEQ ID NO: 577759 - RNA, 64 nt, Homo Sapiens; identical to SEQ ID NO: 162959

SEQ ID NO: 577760 - RNA, 64 nt, Homo Sapiens; identical to SEQ ID NO: 162960

SEQ ID NO: 577761 - RNA, 64 nt, Homo Sapiens; identical to SEQ ID NO: 162961

SEQ ID NO: 577762 - RNA, 64 nt, Homo Sapiens; identical to SEQ ID NO: 162962

SEQ ID NO: 577763 - RNA, 64 nt, Homo Sapiens; identical to SEQ ID NO: 162963

SEQ ID NO: 577764 - RNA, 64 nt, Homo Sapiens; identical to SEQ ID NO: 162964

SEQ ID NO: 577765 - RNA, 64 nt, Homo Sapiens; identical to SEQ ID NO: 162965

SEQ ID NO: 577766 - RNA, 64 nt, Homo Sapiens; identical to SEQ ID NO: 162966

SEQ ID NO: 577767 - RNA, 64 nt, Homo Sapiens; identical to SEQ ID NO: 162967

SEQ ID NO: 577768 - RNA, 64 nt, Homo Sapiens; identical to SEQ ID NO: 162968

SEQ ID NO: 577769 - RNA, 64 nt, Homo Sapiens; identical to SEQ ID NO: 162969

SEQ ID NO: 577770 - RNA, 64 nt, Homo Sapiens; identical to SEQ ID NO: 162970

SEQ ID NO: 577771 - RNA, 64 nt, Homo Sapiens; identical to SEQ ID NO: 162971

SEQ ID NO: 577772 - RNA, 64 nt, Homo Sapiens; identical to SEQ ID NO: 162972

SEQ ID NO: 577773 - RNA, 64 nt, Homo Sapiens; identical to SEQ ID NO: 162973

SEQ ID NO: 577774 - RNA, 64 nt, Homo Sapiens; identical to SEQ ID NO: 162974

SEQ ID NO: 577775 - RNA, 64 nt, Homo Sapiens; identical to SEQ ID NO: 162975

SEQ ID NO: 577776 - RNA, 64 nt, Homo Sapiens; identical to SEQ ID NO: 162976

SEQ ID NO: 577777 - RNA, 64 nt, Homo Sapiens; identical to SEQ ID NO: 162977

SEQ ID NO: 577778 - RNA, 64 nt, Homo Sapiens; identical to SEQ ID NO: 162978

SEQ ID NO: 577779 - RNA, 64 nt, Homo Sapiens; identical to SEQ ID NO: 162979

SEQ ID NO: 577780 - RNA, 64 nt, Homo Sapiens; identical to SEQ ID NO: 162980

SEQ ID NO: 577781 - RNA, 64 nt, Homo Sapiens; identical to SEQ ID NO: 162981

SEQ ID NO: 577782 - RNA, 64 nt, Homo Sapiens; identical to SEQ ID NO: 162982

SEQ ID NO: 577783 - RNA, 64 nt, Homo Sapiens; identical to SEQ ID NO: 162983

SEQ ID NO: 577784 - RNA, 64 nt, Homo Sapiens; identical to SEQ ID NO: 162984

SEQ ID NO: 577785 - RNA, 64 nt, Homo Sapiens; identical to SEQ ID NO: 162985

SEQ ID NO: 577786 - RNA, 64 nt, Homo Sapiens; identical to SEQ ID NO: 162986

SEQ ID NO: 577787 - RNA, 64 nt, Homo Sapiens; identical to SEQ ID NO: 162987

SEQ ID NO: 577788 - RNA, 64 nt, Homo Sapiens; identical to SEQ ID NO: 162988

SEQ ID NO: 577789 - RNA, 64 nt, Homo Sapiens; identical to SEQ ID NO: 162989

SEQ ID NO: 577790 - RNA, 64 nt, Homo Sapiens; identical to SEQ ID NO: 162990

SEQ ID NO: 577791 - RNA, 64 nt, Homo Sapiens; identical to SEQ ID NO: 162991

SEQ ID NO: 577792 - RNA, 64 nt, Homo Sapiens; identical to SEQ ID NO: 162992

SEQ ID NO: 577793 - RNA, 64 nt, Homo Sapiens; identical to SEQ ID NO: 162993

SEQ ID NO: 577794 - RNA, 64 nt, Homo Sapiens; identical to SEQ ID NO: 162994

SEQ ID NO: 577795 - RNA, 64 nt, Homo Sapiens; identical to SEQ ID NO: 162995

SEQ ID NO: 577796 - RNA, 64 nt, Homo Sapiens; identical to SEQ ID NO: 162996

SEQ ID NO: 577797 - RNA, 64 nt, Homo Sapiens; identical to SEQ ID NO: 162997

SEQ ID NO: 577798 - RNA, 64 nt, Homo Sapiens; identical to SEQ ID NO: 162998

SEQ ID NO: 577799 - RNA, 64 nt, Homo Sapiens; identical to SEQ ID NO: 162999

SEQ ID NO: 577800 - RNA, 64 nt, Homo Sapiens; identical to SEQ ID NO: 163000

SEQ ID NO: 577801 - RNA, 64 nt, Homo Sapiens; identical to SEQ ID NO: 163001

SEQ ID NO: 577802 - RNA, 64 nt, Homo Sapiens; identical to SEQ ID NO: 163002

SEQ ID NO: 577803 - RNA, 64 nt, Homo Sapiens; identical to SEQ ID NO: 163003

SEQ ID NO: 577804 - RNA, 64 nt, Homo Sapiens; identical to SEQ ID NO: 163004

SEQ ID NO: 577805 - RNA, 64 nt, Homo Sapiens; identical to SEQ ID NO: 163005

SEQ ID NO: 577806 - RNA, 64 nt, Homo Sapiens; identical to SEQ ID NO: 163006

SEQ ID NO: 577807 - RNA, 64 nt, Homo Sapiens; identical to SEQ ID NO: 163007

SEQ ID NO: 577808 - RNA, 64 nt, Homo Sapiens; identical to SEQ ID NO: 163008

SEQ ID NO: 577809 - RNA, 64 nt, Homo Sapiens; identical to SEQ ID NO: 163009

SEQ ID NO: 577810 - RNA, 64 nt, Homo Sapiens; identical to SEQ ID NO: 163010

SEQ ID NO: 577811 - RNA, 64 nt, Homo Sapiens; identical to SEQ ID NO: 163011

SEQ ID NO: 577812 - RNA, 64 nt, Homo Sapiens; identical to SEQ ID NO: 163012

SEQ ID NO: 577813 - RNA, 64 nt, Homo Sapiens; identical to SEQ ID NO: 163013

SEQ ID NO: 577814 - RNA, 64 nt, Homo Sapiens; identical to SEQ ID NO: 163014

SEQ ID NO: 577815 - RNA, 64 nt, Homo Sapiens; identical to SEQ ID NO: 163015

SEQ ID NO: 577816 - RNA, 64 nt, Homo Sapiens; identical to SEQ ID NO: 163016

SEQ ID NO: 577817 - RNA, 64 nt, Homo Sapiens; identical to SEQ ID NO: 163017

SEQ ID NO: 577818 - RNA, 64 nt, Homo Sapiens; identical to SEQ ID NO: 163018

SEQ ID NO: 577819 - RNA, 64 nt, Homo Sapiens; identical to SEQ ID NO: 163019

SEQ ID NO: 577820 - RNA, 64 nt, Homo Sapiens; identical to SEQ ID NO: 163020

SEQ ID NO: 577821 - RNA, 64 nt, Homo Sapiens; identical to SEQ ID NO: 163021

SEQ ID NO: 577822 - RNA, 64 nt, Homo Sapiens; identical to SEQ ID NO: 163022

SEQ ID NO: 577823 - RNA, 64 nt, Homo Sapiens; identical to SEQ ID NO: 163023

SEQ ID NO: 577824 - RNA, 64 nt, Homo Sapiens; identical to SEQ ID NO: 163024

SEQ ID NO: 577825 - RNA, 64 nt, Homo Sapiens; identical to SEQ ID NO: 163025

SEQ ID NO: 577826 - RNA, 64 nt, Homo Sapiens; identical to SEQ ID NO: 163026

SEQ ID NO: 577827 - RNA, 64 nt, Homo Sapiens; identical to SEQ ID NO: 163027

SEQ ID NO: 577828 - RNA, 64 nt, Homo Sapiens; identical to SEQ ID NO: 163028

SEQ ID NO: 577829 - RNA, 64 nt, Homo Sapiens; identical to SEQ ID NO: 163029

SEQ ID NO: 577830 - RNA, 64 nt, Homo Sapiens; identical to SEQ ID NO: 163030

SEQ ID NO: 577831 - RNA, 64 nt, Homo Sapiens; identical to SEQ ID NO: 163031

SEQ ID NO: 577832 - RNA, 64 nt, Homo Sapiens; identical to SEQ ID NO: 163032

SEQ ID NO: 577833 - RNA, 64 nt, Homo Sapiens; identical to SEQ ID NO: 163033

SEQ ID NO: 577834 - RNA, 64 nt, Homo Sapiens; identical to SEQ ID NO: 163034

SEQ ID NO: 577835 - RNA, 64 nt, Homo Sapiens; identical to SEQ ID NO: 163035

SEQ ID NO: 577836 - RNA, 64 nt, Homo Sapiens; identical to SEQ ID NO: 163036

SEQ ID NO: 577837 - RNA, 64 nt, Homo Sapiens; identical to SEQ ID NO: 163037

SEQ ID NO: 577838 - RNA, 64 nt, Homo Sapiens; identical to SEQ ID NO: 163038

SEQ ID NO: 577839 - RNA, 64 nt, Homo Sapiens; identical to SEQ ID NO: 163039

SEQ ID NO: 577840 - RNA, 64 nt, Homo Sapiens; identical to SEQ ID NO: 163040

SEQ ID NO: 577841 - RNA, 64 nt, Homo Sapiens; identical to SEQ ID NO: 163041

SEQ ID NO: 577842 - RNA, 64 nt, Homo Sapiens; identical to SEQ ID NO: 163042

SEQ ID NO: 577843 - RNA, 64 nt, Homo Sapiens; identical to SEQ ID NO: 163043

SEQ ID NO: 577844 - RNA, 64 nt, Homo Sapiens; identical to SEQ ID NO: 163044

SEQ ID NO: 577845 - RNA, 64 nt, Homo Sapiens; identical to SEQ ID NO: 163045

SEQ ID NO: 577846 - RNA, 64 nt, Homo Sapiens; identical to SEQ ID NO: 163046

SEQ ID NO: 577847 - RNA, 64 nt, Homo Sapiens; identical to SEQ ID NO: 162809

SEQ ID NO: 577848 - RNA, 64 nt, Homo Sapiens; identical to SEQ ID NO: 163048

SEQ ID NO: 577849 - RNA, 64 nt, Homo Sapiens; identical to SEQ ID NO: 163049

SEQ ID NO: 577850 - RNA, 64 nt, Homo Sapiens; identical to SEQ ID NO: 163050

SEQ ID NO: 577851 - RNA, 64 nt, Homo Sapiens; identical to SEQ ID NO: 163051

SEQ ID NO: 577852 - RNA, 64 nt, Homo Sapiens; identical to SEQ ID NO: 163052

SEQ ID NO: 577853 - RNA, 64 nt, Homo Sapiens; identical to SEQ ID NO: 163053

SEQ ID NO: 577854 - RNA, 64 nt, Homo Sapiens; identical to SEQ ID NO: 163054

SEQ ID NO: 577855 - RNA, 64 nt, Homo Sapiens; identical to SEQ ID NO: 163055

SEQ ID NO: 577856 - RNA, 64 nt, Homo Sapiens; identical to SEQ ID NO: 163056

SEQ ID NO: 577857 - RNA, 64 nt, Homo Sapiens; identical to SEQ ID NO: 163057

SEQ ID NO: 577858 - RNA, 64 nt, Homo Sapiens; identical to SEQ ID NO: 163058

SEQ ID NO: 577859 - RNA, 64 nt, Homo Sapiens; identical to SEQ ID NO: 163059

SEQ ID NO: 577860 - RNA, 64 nt, Homo Sapiens; identical to SEQ ID NO: 163060

SEQ ID NO: 577861 - RNA, 64 nt, Homo Sapiens; identical to SEQ ID NO: 163061

SEQ ID NO: 577862 - RNA, 64 nt, Homo Sapiens; identical to SEQ ID NO: 163062

SEQ ID NO: 577863 - RNA, 64 nt, Homo Sapiens; identical to SEQ ID NO: 163063

SEQ ID NO: 577864 - RNA, 64 nt, Homo Sapiens; identical to SEQ ID NO: 163064

SEQ ID NO: 577865 - RNA, 64 nt, Homo Sapiens; identical to SEQ ID NO: 163065

SEQ ID NO: 577866 - RNA, 64 nt, Homo Sapiens; identical to SEQ ID NO: 163066

SEQ ID NO: 577867 - RNA, 64 nt, Homo Sapiens; identical to SEQ ID NO: 163067

SEQ ID NO: 577868 - RNA, 64 nt, Homo Sapiens; identical to SEQ ID NO: 163068

SEQ ID NO: 577869 - RNA, 64 nt, Homo Sapiens; identical to SEQ ID NO: 163069

SEQ ID NO: 577870 - RNA, 64 nt, Homo Sapiens; identical to SEQ ID NO: 163070

SEQ ID NO: 577871 - RNA, 64 nt, Homo Sapiens; identical to SEQ ID NO: 163071

SEQ ID NO: 577872 - RNA, 64 nt, Homo Sapiens; identical to SEQ ID NO: 163072

SEQ ID NO: 577873 - RNA, 64 nt, Homo Sapiens; identical to SEQ ID NO: 163073

SEQ ID NO: 577874 - RNA, 64 nt, Homo Sapiens; identical to SEQ ID NO: 163074

SEQ ID NO: 577875 - RNA, 64 nt, Homo Sapiens; identical to SEQ ID NO: 163075

SEQ ID NO: 577876 - RNA, 64 nt, Homo Sapiens; identical to SEQ ID NO: 163076

SEQ ID NO: 577877 - RNA, 64 nt, Homo Sapiens; identical to SEQ ID NO: 163077

SEQ ID NO: 577878 - RNA, 64 nt, Homo Sapiens; identical to SEQ ID NO: 163078

SEQ ID NO: 577879 - RNA, 64 nt, Homo Sapiens; identical to SEQ ID NO: 163079

SEQ ID NO: 577880 - RNA, 64 nt, Homo Sapiens; identical to SEQ ID NO: 163080

SEQ ID NO: 577881 - RNA, 64 nt, Homo Sapiens; identical to SEQ ID NO: 163081

SEQ ID NO: 577882 - RNA, 64 nt, Homo Sapiens; identical to SEQ ID NO: 163082

SEQ ID NO: 577883 - RNA, 64 nt, Homo Sapiens; identical to SEQ ID NO: 163083

SEQ ID NO: 577884 - RNA, 64 nt, Homo Sapiens; identical to SEQ ID NO: 163084

SEQ ID NO: 577885 - RNA, 64 nt, Homo Sapiens; identical to SEQ ID NO: 163085

SEQ ID NO: 577886 - RNA, 64 nt, Homo Sapiens; identical to SEQ ID NO: 163086

SEQ ID NO: 577887 - RNA, 64 nt, Homo Sapiens; identical to SEQ ID NO: 163087

SEQ ID NO: 577888 - RNA, 64 nt, Homo Sapiens; identical to SEQ ID NO: 163088

SEQ ID NO: 577889 - RNA, 64 nt, Homo Sapiens; identical to SEQ ID NO: 163089

SEQ ID NO: 577890 - RNA, 64 nt, Homo Sapiens; identical to SEQ ID NO: 163090

SEQ ID NO: 577891 - RNA, 64 nt, Homo Sapiens; identical to SEQ ID NO: 163091

SEQ ID NO: 577892 - RNA, 64 nt, Homo Sapiens; identical to SEQ ID NO: 163092

SEQ ID NO: 577893 - RNA, 64 nt, Homo Sapiens; identical to SEQ ID NO: 163093

SEQ ID NO: 577894 - RNA, 64 nt, Homo Sapiens; identical to SEQ ID NO: 163094

SEQ ID NO: 577895 - RNA, 64 nt, Homo Sapiens; identical to SEQ ID NO: 163095

SEQ ID NO: 577896 - RNA, 64 nt, Homo Sapiens; identical to SEQ ID NO: 163096

SEQ ID NO: 577897 - RNA, 64 nt, Homo Sapiens; identical to SEQ ID NO: 163097

SEQ ID NO: 577898 - RNA, 64 nt, Homo Sapiens; identical to SEQ ID NO: 163098

SEQ ID NO: 577899 - RNA, 64 nt, Homo Sapiens; identical to SEQ ID NO: 163099

SEQ ID NO: 577900 - RNA, 64 nt, Homo Sapiens; identical to SEQ ID NO: 163100

SEQ ID NO: 577901 - RNA, 64 nt, Homo Sapiens; identical to SEQ ID NO: 163101

SEQ ID NO: 577902 - RNA, 64 nt, Homo Sapiens; identical to SEQ ID NO: 163102

SEQ ID NO: 577903 - RNA, 64 nt, Homo Sapiens; identical to SEQ ID NO: 163103

SEQ ID NO: 577904 - RNA, 64 nt, Homo Sapiens; identical to SEQ ID NO: 163104

SEQ ID NO: 577905 - RNA, 64 nt, Homo Sapiens; identical to SEQ ID NO: 163105

SEQ ID NO: 577906 - RNA, 64 nt, Homo Sapiens; identical to SEQ ID NO: 163106

SEQ ID NO: 577907 - RNA, 64 nt, Homo Sapiens; identical to SEQ ID NO: 163107

SEQ ID NO: 577908 - RNA, 64 nt, Homo Sapiens; identical to SEQ ID NO: 163108

SEQ ID NO: 577909 - RNA, 64 nt, Homo Sapiens; identical to SEQ ID NO: 163109

SEQ ID NO: 577910 - RNA, 64 nt, Homo Sapiens; identical to SEQ ID NO: 163110

SEQ ID NO: 577911 - RNA, 64 nt, Homo Sapiens; identical to SEQ ID NO: 163111

SEQ ID NO: 577912 - RNA, 64 nt, Homo Sapiens; identical to SEQ ID NO: 163112

SEQ ID NO: 577913 - RNA, 64 nt, Homo Sapiens; identical to SEQ ID NO: 163113

SEQ ID NO: 577914 - RNA, 64 nt, Homo Sapiens; identical to SEQ ID NO: 163114

SEQ ID NO: 577915 - RNA, 64 nt, Homo Sapiens; identical to SEQ ID NO: 163115

SEQ ID NO: 577916 - RNA, 64 nt, Homo Sapiens; identical to SEQ ID NO: 163116

SEQ ID NO: 577917 - RNA, 64 nt, Homo Sapiens; identical to SEQ ID NO: 163117

SEQ ID NO: 577918 - RNA, 64 nt, Homo Sapiens; identical to SEQ ID NO: 163118

SEQ ID NO: 577919 - RNA, 64 nt, Homo Sapiens; identical to SEQ ID NO: 163119

SEQ ID NO: 577920 - RNA, 64 nt, Homo Sapiens; identical to SEQ ID NO: 163120

SEQ ID NO: 577921 - RNA, 64 nt, Homo Sapiens; identical to SEQ ID NO: 163121

SEQ ID NO: 577922 - RNA, 64 nt, Homo Sapiens; identical to SEQ ID NO: 163122

SEQ ID NO: 577923 - RNA, 64 nt, Homo Sapiens; identical to SEQ ID NO: 163123

SEQ ID NO: 577924 - RNA, 64 nt, Homo Sapiens; identical to SEQ ID NO: 163124

SEQ ID NO: 577925 - RNA, 64 nt, Homo Sapiens; identical to SEQ ID NO: 163125

SEQ ID NO: 577926 - RNA, 64 nt, Homo Sapiens; identical to SEQ ID NO: 163126

SEQ ID NO: 577927 - RNA, 64 nt, Homo Sapiens; identical to SEQ ID NO: 163127

SEQ ID NO: 577928 - RNA, 64 nt, Homo Sapiens; identical to SEQ ID NO: 163128

SEQ ID NO: 577929 - RNA, 64 nt, Homo Sapiens; identical to SEQ ID NO: 163129

SEQ ID NO: 577930 - RNA, 64 nt, Homo Sapiens; identical to SEQ ID NO: 163130

SEQ ID NO: 577931 - RNA, 64 nt, Homo Sapiens; identical to SEQ ID NO: 163131

SEQ ID NO: 577932 - RNA, 64 nt, Homo Sapiens; identical to SEQ ID NO: 163132

SEQ ID NO: 577933 - RNA, 64 nt, Homo Sapiens; identical to SEQ ID NO: 163133

SEQ ID NO: 577934 - RNA, 64 nt, Homo Sapiens; identical to SEQ ID NO: 163134

SEQ ID NO: 577935 - RNA, 64 nt, Homo Sapiens; identical to SEQ ID NO: 163135

SEQ ID NO: 577936 - RNA, 64 nt, Homo Sapiens; identical to SEQ ID NO: 163136

SEQ ID NO: 577937 - RNA, 64 nt, Homo Sapiens; identical to SEQ ID NO: 163137

SEQ ID NO: 577938 - RNA, 64 nt, Homo Sapiens; identical to SEQ ID NO: 163138

SEQ ID NO: 577939 - RNA, 64 nt, Homo Sapiens; identical to SEQ ID NO: 163139

SEQ ID NO: 577940 - RNA, 64 nt, Homo Sapiens; identical to SEQ ID NO: 163140

SEQ ID NO: 577941 - RNA, 64 nt, Homo Sapiens; identical to SEQ ID NO: 163141

SEQ ID NO: 577942 - RNA, 64 nt, Homo Sapiens; identical to SEQ ID NO: 163142

SEQ ID NO: 577943 - RNA, 64 nt, Homo Sapiens; identical to SEQ ID NO: 163143

SEQ ID NO: 577944 - RNA, 64 nt, Homo Sapiens; identical to SEQ ID NO: 163144

SEQ ID NO: 577945 - RNA, 64 nt, Homo Sapiens; identical to SEQ ID NO: 163145

SEQ ID NO: 577946 - RNA, 64 nt, Homo Sapiens; identical to SEQ ID NO: 163146

SEQ ID NO: 577947 - RNA, 64 nt, Homo Sapiens; identical to SEQ ID NO: 163147

SEQ ID NO: 577948 - RNA, 64 nt, Homo Sapiens; identical to SEQ ID NO: 163148

SEQ ID NO: 577949 - RNA, 64 nt, Homo Sapiens; identical to SEQ ID NO: 163149

SEQ ID NO: 577950 - RNA, 64 nt, Homo Sapiens; identical to SEQ ID NO: 163150

SEQ ID NO: 577951 - RNA, 64 nt, Homo Sapiens; identical to SEQ ID NO: 163151

SEQ ID NO: 577952 - RNA, 64 nt, Homo Sapiens; identical to SEQ ID NO: 163152

SEQ ID NO: 577953 - RNA, 64 nt, Homo Sapiens; identical to SEQ ID NO: 163153

SEQ ID NO: 577954 - RNA, 64 nt, Homo Sapiens; identical to SEQ ID NO: 163154

SEQ ID NO: 577955 - RNA, 64 nt, Homo Sapiens; identical to SEQ ID NO: 163155

SEQ ID NO: 577956 - RNA, 64 nt, Homo Sapiens; identical to SEQ ID NO: 163156

SEQ ID NO: 577957 - RNA, 64 nt, Homo Sapiens; identical to SEQ ID NO: 163157

SEQ ID NO: 577958 - RNA, 64 nt, Homo Sapiens; identical to SEQ ID NO: 163158

SEQ ID NO: 577959 - RNA, 64 nt, Homo Sapiens; identical to SEQ ID NO: 163159

SEQ ID NO: 577960 - RNA, 64 nt, Homo Sapiens; identical to SEQ ID NO: 163160

SEQ ID NO: 577961 - RNA, 64 nt, Homo Sapiens; identical to SEQ ID NO: 163161

SEQ ID NO: 577962 - RNA, 64 nt, Homo Sapiens; identical to SEQ ID NO: 163162

SEQ ID NO: 577963 - RNA, 64 nt, Homo Sapiens; identical to SEQ ID NO: 163163

SEQ ID NO: 577964 - RNA, 64 nt, Homo Sapiens; identical to SEQ ID NO: 163164

SEQ ID NO: 577965 - RNA, 64 nt, Homo Sapiens; identical to SEQ ID NO: 163165

SEQ ID NO: 577966 - RNA, 64 nt, Homo Sapiens; identical to SEQ ID NO: 163166

SEQ ID NO: 577967 - RNA, 64 nt, Homo Sapiens; identical to SEQ ID NO: 163167

SEQ ID NO: 577968 - RNA, 64 nt, Homo Sapiens; identical to SEQ ID NO: 163168

SEQ ID NO: 577969 - RNA, 64 nt, Homo Sapiens; identical to SEQ ID NO: 163169

SEQ ID NO: 577970 - RNA, 64 nt, Homo Sapiens; identical to SEQ ID NO: 163170

SEQ ID NO: 577971 - RNA, 64 nt, Homo Sapiens; identical to SEQ ID NO: 163171

SEQ ID NO: 577972 - RNA, 64 nt, Homo Sapiens; identical to SEQ ID NO: 163172

SEQ ID NO: 577973 - RNA, 64 nt, Homo Sapiens; identical to SEQ ID NO: 163173

SEQ ID NO: 577974 - RNA, 64 nt, Homo Sapiens; identical to SEQ ID NO: 163174

SEQ ID NO: 577975 - RNA, 64 nt, Homo Sapiens; identical to SEQ ID NO: 163175

SEQ ID NO: 577976 - RNA, 64 nt, Homo Sapiens; identical to SEQ ID NO: 163176

SEQ ID NO: 577977 - RNA, 64 nt, Homo Sapiens; identical to SEQ ID NO: 163177

SEQ ID NO: 577978 - RNA, 64 nt, Homo Sapiens; identical to SEQ ID NO: 163178

SEQ ID NO: 577979 - RNA, 64 nt, Homo Sapiens; identical to SEQ ID NO: 163179

SEQ ID NO: 577980 - RNA, 64 nt, Homo Sapiens; identical to SEQ ID NO: 163180

SEQ ID NO: 577981 - RNA, 64 nt, Homo Sapiens; identical to SEQ ID NO: 163181

SEQ ID NO: 577982 - RNA, 64 nt, Homo Sapiens; identical to SEQ ID NO: 163182

SEQ ID NO: 577983 - RNA, 64 nt, Homo Sapiens; identical to SEQ ID NO: 163183

SEQ ID NO: 577984 - RNA, 64 nt, Homo Sapiens; identical to SEQ ID NO: 163184

SEQ ID NO: 577985 - RNA, 64 nt, Homo Sapiens
gcccacaccaccauccucucaucccagccaguaagaauuucaguugugggccuccagucuucug

SEQ ID NO: 577986 - RNA, 64 nt, Homo Sapiens
uuuuuuuguuuuuuuuguuuguuuguauuagauggaauuucacucuugucgcccaggcuggagu

SEQ ID NO: 577987 - RNA, 64 nt, Homo Sapiens
cuuuugccagccucagaauaggcgagguaaccuugaauuucagggcccuggaaacucuagcuga

SEQ ID NO: 577988 - RNA, 64 nt, Homo Sapiens
gguuagauucacauccuuaaucuugcagagacuagaauuucacagcucgcuuuggaacauauuc

SEQ ID NO: 577989 - RNA, 64 nt, Homo Sapiens
aaauggaauaauaugaugccaaagggcuugaggugaauuucauuccauauauuuaauaugucaa

SEQ ID NO: 577990 - RNA, 64 nt, Homo Sapiens
auaaagaucacccguuguauuguaaagacagagugaauuucagugggcuggauuuugguucccu

SEQ ID NO: 577991 - RNA, 64 nt, Homo Sapiens
aguaccuuguaagauaaauauaaauuggaguuaggaauuucaugaaccucacuaugaccaaaau

SEQ ID NO: 577992 - RNA, 64 nt, Homo Sapiens
auuguuaaauuuaauuauaguguauuucuuucuugaauuucagucugcugcuuuguaaaaaaua

SEQ ID NO: 577993 - RNA, 64 nt, Homo Sapiens
ucuccacgucugcccaggaauacagugaaauggagaauuucaggucuggacaacuggcccaguu

SEQ ID NO: 577994 - RNA, 64 nt, Homo Sapiens
uuucugccuccaccccugggacuggaggaccugggaauuucauccagggcuggggaaugauggg

SEQ ID NO: 577995 - RNA, 64 nt, Homo Sapiens
cuucaaucaauugaacuuuuacaaaaccacuugagaauuucaugagcacuuuaaaaucugaacu

SEQ ID NO: 577996 - RNA, 64 nt, Homo Sapiens
uucauaauaaaguuuaauaauagguuuauuaacugaauuucauuaguuuuuuaaaaguguuuuu

SEQ ID NO: 577997 - RNA, 64 nt, Homo Sapiens
gggaacaguuuuguccuguaugcugauguguccagaauuucauuuaaugauagacggaaaaugu

SEQ ID NO: 577998 - RNA, 64 nt, Homo Sapiens
aaaugugugguuacugaaaacuguauaugauacagaauuucauaagagccaugcuguugggcaa

SEQ ID NO: 577999 - RNA, 64 nt, Homo Sapiens
ugcaauuguucuugagcaaugaacuuucacugcagaauuucagguuaguuacaaaaagcucagu

SEQ ID NO: 578000 - RNA, 64 nt, Homo Sapiens
uuuagauauacguauauacacaugcugcgguucugaauuucauuuuuuauaacaugaagugcug

SEQ ID NO: 578001 - RNA, 64 nt, Homo Sapiens
aaguaaaggagaaauauuuuccuacaagaguacugaauuucaggaaaugggauagagcuucuaa

SEQ ID NO: 578002 - RNA, 64 nt, Homo Sapiens
uaggacaaaaaaauuuaaccaauuuuauugaaacgaauuucacuguguaaaaguugguuugauu

SEQ ID NO: 578003 - RNA, 64 nt, Homo Sapiens
agcaaaugaguguugcugaggaauaauuaaaugagaauuucauaggagcuccaccauuccuguu

SEQ ID NO: 578004 - RNA, 64 nt, Homo Sapiens
gccucagggaagccacgugauauaacugguuauagaauuucaggguuaggguuuaaagaaagga

SEQ ID NO: 578005 - RNA, 64 nt, Homo Sapiens
uaaacaauuaguuuuuuaaugcccaguuagauuugaauuucagaagcaaauaaaaauaaagauu

SEQ ID NO: 578006 - RNA, 64 nt, Homo Sapiens
caaaggcauaauagcaaugagaggcgaaagaguggaauuucauugugccuguuucuggacaaug

SEQ ID NO: 578007 - RNA, 64 nt, Homo Sapiens
auuaacauuuuauaaucuuaaguacauuguucuggaauuucaucuugcagcagagcuugagaaa

SEQ ID NO: 578008 - RNA, 64 nt, Homo Sapiens
uaaaaggaaggucauuuggagcagacagggaagggaauuucacugagaaaugaggauuugcuau

SEQ ID NO: 578009 - RNA, 64 nt, Homo Sapiens
ucuguaaaauguuaucugcccuuuggcugcauuggaauuucagagaaggcugcagaggccuggg

SEQ ID NO: 578010 - RNA, 64 nt, Homo Sapiens
ugcgagguaguagacaggaugcccaguuaaguuugaauuucagauagaaaauaauuuuagaaua

SEQ ID NO: 578011 - RNA, 64 nt, Homo Sapiens
auuucaaucccacguacuuauaaagaagguuggugaauuucacaagcuauuuuuggaauauuuu

SEQ ID NO: 578012 - RNA, 64 nt, Homo Sapiens
aagcuauuuuuggaauauuuuuagaauauuuuaagaauuucacaagcuauucccucaaaucuga

SEQ ID NO: 578013 - RNA, 64 nt, Homo Sapiens
aauaguugacggaauuggguuucugaaugucugugaauuucagaggucucugcuagccuuggua

SEQ ID NO: 578014 - RNA, 64 nt, Homo Sapiens
uuucuagcaauaacugagagccaguuaauuuuaagaauuucacacauuuagccaaucuuucuag

SEQ ID NO: 578015 - RNA, 64 nt, Homo Sapiens
auggugaugguagagaagcugcccggaauaaacugaauuucauauguucuaaaaugacuagcaa

SEQ ID NO: 578016 - RNA, 64 nt, Homo Sapiens
aauuuacaagauuuaauaggaaaugaaacagcuugaauuucaaacuaaauuguauuuucagagc

SEQ ID NO: 578017 - RNA, 64 nt, Homo Sapiens
uuguuguuguugcuguuguuguuaauuuuguuaagaauuucaauaucaagacugacuggcacca

SEQ ID NO: 578018 - RNA, 64 nt, Homo Sapiens
aggagcuuaauaaugguuacucauuuuaucaggggaauuucagggaacguaggcgucaaagagc

SEQ ID NO: 578019 - RNA, 64 nt, Homo Sapiens
cacugaugagaaguuuuuaagauauuaugugucagaauuucagaauauuuaagaauuccaagag

SEQ ID NO: 578020 - RNA, 64 nt, Homo Sapiens
uuaaaaugcgcauuacaaacgaaaacgacauuaggaauuucacuuuuuuuagagagagagauua

SEQ ID NO: 578021 - RNA, 64 nt, Homo Sapiens
ucuucuaaguccuuuguggcuuguaaguggagaagaauuucauccaaauguuacccuguaauac

SEQ ID NO: 578022 - RNA, 64 nt, Homo Sapiens
cuguccucauucccauauguaauagacauccaaagaauuucaauugcuuuguugaacuuuuacu

SEQ ID NO: 578023 - RNA, 64 nt, Homo Sapiens
ccuuucuauggcugaauaaauguagcaugugucagaauuucauuuuugcaagguuuacccaugu

SEQ ID NO: 578024 - RNA, 64 nt, Homo Sapiens
uuuuggaauauuugcauauagcuagaaguguuuugaauuucagaccuuaugugaaaugcuuggg

SEQ ID NO: 578025 - RNA, 64 nt, Homo Sapiens
ucacuagugacuuagauacaucaagagaccugacugccgccaacugagaguauggggaaaagaa

SEQ ID NO: 578026 - RNA, 64 nt, Homo Sapiens
uaccuuuccuuuuguauucccuccagacuggccaugccgccauagucauuaacuugaucccuuu

SEQ ID NO: 578027 - RNA, 64 nt, Homo Sapiens
acaugauaugcggcuaugccugccucaaagggacugccgccaugcggaacaccaaacgagguuc

SEQ ID NO: 578028 - RNA, 64 nt, Homo Sapiens
gugcaaggagaugucugaauacugcagcacucugugccgccaccucuaccuguucccaggacac

SEQ ID NO: 578029 - RNA, 64 nt, Homo Sapiens; identical to SEQ ID NO: 161048

SEQ ID NO: 578030 - RNA, 64 nt, Homo Sapiens; identical to SEQ ID NO: 161049

SEQ ID NO: 578031 - RNA, 64 nt, Homo Sapiens; identical to SEQ ID NO: 161050

SEQ ID NO: 578032 - RNA, 64 nt, Homo Sapiens; identical to SEQ ID NO: 161051

SEQ ID NO: 578033 - RNA, 64 nt, Homo Sapiens; identical to SEQ ID NO: 161052

SEQ ID NO: 578034 - RNA, 64 nt, Homo Sapiens; identical to SEQ ID NO: 161053

SEQ ID NO: 578035 - RNA, 64 nt, Homo Sapiens; identical to SEQ ID NO: 161054

SEQ ID NO: 578036 - RNA, 64 nt, Homo Sapiens; identical to SEQ ID NO: 161055

SEQ ID NO: 578037 - RNA, 64 nt, Homo Sapiens; identical to SEQ ID NO: 161056

SEQ ID NO: 578038 - RNA, 64 nt, Homo Sapiens; identical to SEQ ID NO: 161057

SEQ ID NO: 578039 - RNA, 64 nt, Homo Sapiens; identical to SEQ ID NO: 161058

SEQ ID NO: 578040 - RNA, 64 nt, Homo Sapiens; identical to SEQ ID NO: 161059

SEQ ID NO: 578041 - RNA, 64 nt, Homo Sapiens; identical to SEQ ID NO: 161060

SEQ ID NO: 578042 - RNA, 64 nt, Homo Sapiens; identical to SEQ ID NO: 161061

SEQ ID NO: 578043 - RNA, 64 nt, Homo Sapiens; identical to SEQ ID NO: 161062

SEQ ID NO: 578044 - RNA, 64 nt, Homo Sapiens; identical to SEQ ID NO: 161063

SEQ ID NO: 578045 - RNA, 64 nt, Homo Sapiens; identical to SEQ ID NO: 161064

SEQ ID NO: 578046 - RNA, 64 nt, Homo Sapiens; identical to SEQ ID NO: 161065

SEQ ID NO: 578047 - RNA, 64 nt, Homo Sapiens; identical to SEQ ID NO: 161066

SEQ ID NO: 578048 - RNA, 64 nt, Homo Sapiens; identical to SEQ ID NO: 161067

SEQ ID NO: 578049 - RNA, 64 nt, Homo Sapiens; identical to SEQ ID NO: 161068

SEQ ID NO: 578050 - RNA, 64 nt, Homo Sapiens; identical to SEQ ID NO: 161069

SEQ ID NO: 578051 - RNA, 64 nt, Homo Sapiens; identical to SEQ ID NO: 161070

SEQ ID NO: 578052 - RNA, 64 nt, Homo Sapiens; identical to SEQ ID NO: 161071

SEQ ID NO: 578053 - RNA, 64 nt, Homo Sapiens; identical to SEQ ID NO: 161072

SEQ ID NO: 578054 - RNA, 64 nt, Homo Sapiens; identical to SEQ ID NO: 161073

SEQ ID NO: 578055 - RNA, 64 nt, Homo Sapiens; identical to SEQ ID NO: 161074

SEQ ID NO: 578056 - RNA, 64 nt, Homo Sapiens; identical to SEQ ID NO: 161075

SEQ ID NO: 578057 - RNA, 64 nt, Homo Sapiens; identical to SEQ ID NO: 161076

SEQ ID NO: 578058 - RNA, 62 nt, Homo Sapiens; identical to SEQ ID NO: 161077

SEQ ID NO: 578059 - RNA, 64 nt, Homo Sapiens; identical to SEQ ID NO: 161078

SEQ ID NO: 578060 - RNA, 64 nt, Homo Sapiens; identical to SEQ ID NO: 161079

SEQ ID NO: 578061 - RNA, 64 nt, Homo Sapiens; identical to SEQ ID NO: 161080

SEQ ID NO: 578062 - RNA, 64 nt, Homo Sapiens; identical to SEQ ID NO: 161081

SEQ ID NO: 578063 - RNA, 64 nt, Homo Sapiens; identical to SEQ ID NO: 161082

SEQ ID NO: 578064 - RNA, 64 nt, Homo Sapiens; identical to SEQ ID NO: 161083

SEQ ID NO: 578065 - RNA, 64 nt, Homo Sapiens; identical to SEQ ID NO: 161084

SEQ ID NO: 578066 - RNA, 64 nt, Homo Sapiens; identical to SEQ ID NO: 161085

SEQ ID NO: 578067 - RNA, 64 nt, Homo Sapiens; identical to SEQ ID NO: 161086

SEQ ID NO: 578068 - RNA, 64 nt, Homo Sapiens; identical to SEQ ID NO: 161087

SEQ ID NO: 578069 - RNA, 64 nt, Homo Sapiens; identical to SEQ ID NO: 161088

SEQ ID NO: 578070 - RNA, 64 nt, Homo Sapiens; identical to SEQ ID NO: 161089

SEQ ID NO: 578071 - RNA, 64 nt, Homo Sapiens; identical to SEQ ID NO: 161090

SEQ ID NO: 578072 - RNA, 64 nt, Homo Sapiens; identical to SEQ ID NO: 161091

SEQ ID NO: 578073 - RNA, 64 nt, Homo Sapiens; identical to SEQ ID NO: 161092

SEQ ID NO: 578074 - RNA, 64 nt, Homo Sapiens; identical to SEQ ID NO: 161093

SEQ ID NO: 578075 - RNA, 64 nt, Homo Sapiens; identical to SEQ ID NO: 161094

SEQ ID NO: 578076 - RNA, 64 nt, Homo Sapiens; identical to SEQ ID NO: 161095

SEQ ID NO: 578077 - RNA, 64 nt, Homo Sapiens; identical to SEQ ID NO: 161096

SEQ ID NO: 578078 - RNA, 64 nt, Homo Sapiens
uuacaacugcagccagaacaauggcuggguggaucgcacguaaagcuugccacuaaaaaucaaa

SEQ ID NO: 578079 - RNA, 64 nt, Homo Sapiens
cucccaaacugcugggauuacaggugugagccaccgcacguagcauuuacauuagguauuacaa

SEQ ID NO: 578080 - RNA, 64 nt, Homo Sapiens
gaaacucccaggaauuggaauucagcaccuguuccgcacguaauuggcaugugucugcaaacau

SEQ ID NO: 578081 - RNA, 64 nt, Homo Sapiens
uaaaaauuuguuuuguauaaagagguuagcccugcgcacguaggacugaauucagugauauccc

SEQ ID NO: 578082 - RNA, 64 nt, Homo Sapiens
ugucugcugaugagagcaccacucaucugcgaaacgcacguaaaacaaagugaaccgugacugu

SEQ ID NO: 578083 - RNA, 64 nt, Homo Sapiens
ucgcagcaggcgugauuacacccccccccguccccgcacguagagaccucaccgggccauggac

SEQ ID NO: 578084 - RNA, 64 nt, Homo Sapiens
aaauugccuauacagucuuagugaccauuuaaaccggacgaacuagguguuuaauuuucacucu

SEQ ID NO: 578085 - RNA, 64 nt, Homo Sapiens
aaagaggaaugaaguacucauacauguuacaacacggacgaaccuugaaaacuuuaugcuaagu

SEQ ID NO: 578086 - RNA, 64 nt, Homo Sapiens
gagcaccucacgcacagcucucagaagcugcaggcggacgaacaucugaccaaagagguguggu

SEQ ID NO: 578087 - RNA, 64 nt, Homo Sapiens
auacggugaauaauucacgcaagagagauguccacggacgaaacaaggccaggggaaugaauuc

SEQ ID NO: 578088 - RNA, 64 nt, Homo Sapiens
acacguguugcaucucaaggccugcgguccuggccggacgaaacugacguauagucaucuacca

SEQ ID NO: 578089 - RNA, 64 nt, Homo Sapiens
cugguguagcuggaaacaaacagcaacuugcaaacggacgaagagccugccguguguuaaucau

SEQ ID NO: 578090 - RNA, 64 nt, Homo Sapiens
uuuugacuuaagugggacuugaaggcugaaaaagcggacgaagauuguguaggucugcaggaag

SEQ ID NO: 578091 - RNA, 64 nt, Homo Sapiens
gggaaaagucaacuccgaugccaccauugcgggccggacgaaggaugcuuucuuccuagaggcu

SEQ ID NO: 578092 - RNA, 64 nt, Homo Sapiens
ugaagaagugaaaccuuucccuuuucccaucugccggacgaaccacaacagcguuccccaugau

SEQ ID NO: 578093 - RNA, 64 nt, Homo Sapiens; identical to SEQ ID NO: 83438

SEQ ID NO: 578094 - RNA, 64 nt, Homo Sapiens; identical to SEQ ID NO: 83439

SEQ ID NO: 578095 - RNA, 64 nt, Homo Sapiens; identical to SEQ ID NO: 83440

SEQ ID NO: 578096 - RNA, 64 nt, Homo Sapiens; identical to SEQ ID NO: 83441

SEQ ID NO: 578097 - RNA, 64 nt, Homo Sapiens; identical to SEQ ID NO: 83442

SEQ ID NO: 578098 - RNA, 64 nt, Homo Sapiens; identical to SEQ ID NO: 83443

SEQ ID NO: 578099 - RNA, 64 nt, Homo Sapiens; identical to SEQ ID NO: 83444

SEQ ID NO: 578100 - RNA, 64 nt, Homo Sapiens; identical to SEQ ID NO: 83445

SEQ ID NO: 578101 - RNA, 64 nt, Homo Sapiens; identical to SEQ ID NO: 83446

SEQ ID NO: 578102 - RNA, 64 nt, Homo Sapiens; identical to SEQ ID NO: 83447

SEQ ID NO: 578103 - RNA, 64 nt, Homo Sapiens; identical to SEQ ID NO: 83448

SEQ ID NO: 578104 - RNA, 64 nt, Homo Sapiens; identical to SEQ ID NO: 83449

SEQ ID NO: 578105 - RNA, 64 nt, Homo Sapiens; identical to SEQ ID NO: 83450

SEQ ID NO: 578106 - RNA, 64 nt, Homo Sapiens; identical to SEQ ID NO: 83451

SEQ ID NO: 578107 - RNA, 51 nt, Homo Sapiens; identical to SEQ ID NO: 83452

SEQ ID NO: 578108 - RNA, 64 nt, Homo Sapiens; identical to SEQ ID NO: 83453

SEQ ID NO: 578109 - RNA, 64 nt, Homo Sapiens; identical to SEQ ID NO: 83454

SEQ ID NO: 578110 - RNA, 64 nt, Homo Sapiens; identical to SEQ ID NO: 83455

SEQ ID NO: 578111 - RNA, 64 nt, Homo Sapiens; identical to SEQ ID NO: 83456

SEQ ID NO: 578112 - RNA, 64 nt, Homo Sapiens; identical to SEQ ID NO: 83457

SEQ ID NO: 578113 - RNA, 64 nt, Homo Sapiens; identical to SEQ ID NO: 83458

SEQ ID NO: 578114 - RNA, 64 nt, Homo Sapiens; identical to SEQ ID NO: 83459

SEQ ID NO: 578115 - RNA, 64 nt, Homo Sapiens; identical to SEQ ID NO: 83460

SEQ ID NO: 578116 - RNA, 64 nt, Homo Sapiens; identical to SEQ ID NO: 83461

SEQ ID NO: 578117 - RNA, 64 nt, Homo Sapiens; identical to SEQ ID NO: 83462

SEQ ID NO: 578118 - RNA, 64 nt, Homo Sapiens; identical to SEQ ID NO: 83463

SEQ ID NO: 578119 - RNA, 64 nt, Homo Sapiens; identical to SEQ ID NO: 83464

SEQ ID NO: 578120 - RNA, 64 nt, Homo Sapiens; identical to SEQ ID NO: 83465

SEQ ID NO: 578121 - RNA, 64 nt, Homo Sapiens; identical to SEQ ID NO: 83466

SEQ ID NO: 578122 - RNA, 64 nt, Homo Sapiens; identical to SEQ ID NO: 83467

SEQ ID NO: 578123 - RNA, 64 nt, Homo Sapiens; identical to SEQ ID NO: 83468

SEQ ID NO: 578124 - RNA, 64 nt, Homo Sapiens; identical to SEQ ID NO: 83469

SEQ ID NO: 578125 - RNA, 64 nt, Homo Sapiens; identical to SEQ ID NO: 83470

SEQ ID NO: 578126 - RNA, 64 nt, Homo Sapiens; identical to SEQ ID NO: 83471

SEQ ID NO: 578127 - RNA, 64 nt, Homo Sapiens; identical to SEQ ID NO: 83472

SEQ ID NO: 578128 - RNA, 64 nt, Homo Sapiens; identical to SEQ ID NO: 83473

SEQ ID NO: 578129 - RNA, 64 nt, Homo Sapiens; identical to SEQ ID NO: 83474

SEQ ID NO: 578130 - RNA, 64 nt, Homo Sapiens; identical to SEQ ID NO: 83475

SEQ ID NO: 578131 - RNA, 64 nt, Homo Sapiens; identical to SEQ ID NO: 83476

SEQ ID NO: 578132 - RNA, 64 nt, Homo Sapiens; identical to SEQ ID NO: 83477

SEQ ID NO: 578133 - RNA, 64 nt, Homo Sapiens; identical to SEQ ID NO: 83478

SEQ ID NO: 578134 - RNA, 64 nt, Homo Sapiens; identical to SEQ ID NO: 83479

SEQ ID NO: 578135 - RNA, 64 nt, Homo Sapiens; identical to SEQ ID NO: 83480

SEQ ID NO: 578136 - RNA, 64 nt, Homo Sapiens; identical to SEQ ID NO: 83481

SEQ ID NO: 578137 - RNA, 64 nt, Homo Sapiens; identical to SEQ ID NO: 83482

SEQ ID NO: 578138 - RNA, 64 nt, Homo Sapiens; identical to SEQ ID NO: 83483

SEQ ID NO: 578139 - RNA, 64 nt, Homo Sapiens; identical to SEQ ID NO: 83484

SEQ ID NO: 578140 - RNA, 64 nt, Homo Sapiens; identical to SEQ ID NO: 83485

SEQ ID NO: 578141 - RNA, 64 nt, Homo Sapiens; identical to SEQ ID NO: 83486

SEQ ID NO: 578142 - RNA, 64 nt, Homo Sapiens; identical to SEQ ID NO: 83487

SEQ ID NO: 578143 - RNA, 64 nt, Homo Sapiens
uaguuugaaaaauaguauuuuauuucucagaacaagguaaaaaggugagugggugcauauguac

SEQ ID NO: 578144 - RNA, 64 nt, Homo Sapiens
caaaauauuuuccugccacuguguaacauagcugagguaaaaacugaacuauguaaaugacucu

SEQ ID NO: 578145 - RNA, 64 nt, Homo Sapiens
uacuuuuacaaauggagcccuugggagguggguuagguaaaagaagcuuuuuacuuaacguugu

SEQ ID NO: 578146 - RNA, 64 nt, Homo Sapiens
acuagagcuugcuuggguuucuuccugcauuacaagguaaaaauuuguuaauguuuguuuuuau

SEQ ID NO: 578147 - RNA, 64 nt, Homo Sapiens
aaaucauugcucucuauacuggaaauauuuaauuagguaaaacuugacaauugauaaaugacaa

SEQ ID NO: 578148 - RNA, 64 nt, Homo Sapiens
gacaucugcagugugacagacgaugaugaggccgagguaaaagauuugcugacagauaacuaac

SEQ ID NO: 578149 - RNA, 64 nt, Homo Sapiens
aaaauaaaaguguauugcacgaagaugacugcaaagguaaaagguguuuacacaacgauuacuc

SEQ ID NO: 578150 - RNA, 64 nt, Homo Sapiens
cuguuaagguucaagaaucagugcaaugacuaaaagguaaaacggugaaaauuggaaggguuuu

SEQ ID NO: 578151 - RNA, 64 nt, Homo Sapiens
uggcaagauuucaagaccacucucugcacugaagagguaaaauuugcacugcaagucacauccc

SEQ ID NO: 578152 - RNA, 64 nt, Homo Sapiens
uucuggguuuucuuuuugacaauucuuggacuugagguaaaacaaggaggauuguggccggauu

SEQ ID NO: 578153 - RNA, 64 nt, Homo Sapiens
acauuuagacuucuuucucaaaauaagaauaaaaagguaaaacuacaaaucuuauuauuucuaa

SEQ ID NO: 578154 - RNA, 64 nt, Homo Sapiens
uaaccauuuuauucucugcuaagaugaaaaaaucagguaaaauccagucauuuuuuaagaaugc

SEQ ID NO: 578155 - RNA, 64 nt, Homo Sapiens
ucaugcuguuacagguguagauccuuuauuuuucagguaaaaggauaaauaaauguaauauuuc

SEQ ID NO: 578156 - RNA, 64 nt, Homo Sapiens
uaguaaguaacgcagaaccagugggaaugacuauagguaaaaugaauauaauauugcauccuuu

SEQ ID NO: 578157 - RNA, 64 nt, Homo Sapiens
auccuccuaccugguccaccccagggcuaccggaagguaaaaucuucaccugaaccaauuauga

SEQ ID NO: 578158 - RNA, 64 nt, Homo Sapiens
ucgcguaaggcuucuugcuuauuuaaacugugcaagguaaaaaucaagccuuuggagccacaga

SEQ ID NO: 578159 - RNA, 64 nt, Homo Sapiens
aaagaaaaaaauaguuggaaguuuucucugcuaaagguaaaagauaugccucuaaaaugaugcu

SEQ ID NO: 578160 - RNA, 64 nt, Homo Sapiens
gcaccuuuuaaagcacuacgugauuuagcaacacagguaaaaauuaguuuuauacuucaugaac

SEQ ID NO: 578161 - RNA, 64 nt, Homo Sapiens
aguguugggaauuauaauuuguuccuuuugucacagguaaaaucuucuucaaggaauuacuauu

SEQ ID NO: 578162 - RNA, 64 nt, Homo Sapiens
ggaucugagaaauuauguaaccacuuaagacaauagguaaaagggugcaugacuaugugcuuau

SEQ ID NO: 578163 - RNA, 64 nt, Homo Sapiens
aaaaaaacaaaaacaaaaaaacaaaaccagaaucagguaaaacagcuaugugauuaaaauauuu

SEQ ID NO: 578164 - RNA, 64 nt, Homo Sapiens
agaucuuugcaccuuaauauuaauggacuguuucagguaaaagagaaugaauguaugauuguga

SEQ ID NO: 578165 - RNA, 64 nt, Homo Sapiens
uaacuuagaggagauuuuaacuuuauuuaaaaauagguaaaauuauuguaccuaauuaugucua

SEQ ID NO: 578166 - RNA, 64 nt, Homo Sapiens
uguaguuuacccuaacgcuucuuuaaaagaaaguagguaaaaaaagaaaaggguagauaaucuu

SEQ ID NO: 578167 - RNA, 64 nt, Homo Sapiens
agauuacaugaaaagguucuccaaauaacagauuagguaaaauguuauuuuaauucuuaagugg

SEQ ID NO: 578168 - RNA, 64 nt, Homo Sapiens
cauaacaacaaugaccaccauaaaauagucucacagguaaaaaauucauugaauuuaguuuguc

SEQ ID NO: 578169 - RNA, 64 nt, Homo Sapiens
cugccuuugcuuguucacugcagucuuaagaaagagguaaaaggcaagcaaaggagaugaaauc

SEQ ID NO: 578170 - RNA, 64 nt, Homo Sapiens
aagaaaccuggcauuuaaaucauauuuugucuuuagguaaaagcuuugguuuguguucguguuu

SEQ ID NO: 578171 - RNA, 64 nt, Homo Sapiens
aaacugacaaaguguuucuaacaaauguauauuaagguaaaauagccuuuuuauuauugccugu

SEQ ID NO: 578172 - RNA, 64 nt, Homo Sapiens
cacugaauuguuguguaauauuauucuugaaacuagguaaaacucucauuuguaacugcaugca

SEQ ID NO: 578173 - RNA, 64 nt, Homo Sapiens
uuaggcaaguuuucccugaauucagcguuuugcaagguaaaauugguuuuuguaaagauuucug

SEQ ID NO: 578174 - RNA, 64 nt, Homo Sapiens
uuaacaggcaaacauuuucuaccaagagcaaggaagguaaaaagauucaaacugaaaagcugag

SEQ ID NO: 578175 - RNA, 64 nt, Homo Sapiens
uugacccacucuggucuauuguguaaauauuuauuuagacuauuuuaauaauacauauuauuua

SEQ ID NO: 578176 - RNA, 64 nt, Homo Sapiens
uaauuauguauaaaguuuuuuuauuuauuugaaguuagacuagauauacguuuuuaaauuuaac

SEQ ID NO: 578177 - RNA, 64 nt, Homo Sapiens
gcaucuauagaagccuagaagaauucuguuauguuuagacuaugucuuaucuuuagacuauuuc

SEQ ID NO: 578178 - RNA, 64 nt, Homo Sapiens
aagaauucuguuauguuuagacuaugucuuaucuuuagacuauuucaggcuuaauuuuccuaac

SEQ ID NO: 578179 - RNA, 64 nt, Homo Sapiens; identical to SEQ ID NO: 352467

SEQ ID NO: 578180 - RNA, 64 nt, Homo Sapiens; identical to SEQ ID NO: 352468

SEQ ID NO: 578181 - RNA, 64 nt, Homo Sapiens; identical to SEQ ID NO: 352469

SEQ ID NO: 578182 - RNA, 64 nt, Homo Sapiens; identical to SEQ ID NO: 352470

SEQ ID NO: 578183 - RNA, 64 nt, Homo Sapiens; identical to SEQ ID NO: 352471

SEQ ID NO: 578184 - RNA, 64 nt, Homo Sapiens; identical to SEQ ID NO: 352472

SEQ ID NO: 578185 - RNA, 64 nt, Homo Sapiens; identical to SEQ ID NO: 352473

SEQ ID NO: 578186 - RNA, 64 nt, Homo Sapiens; identical to SEQ ID NO: 352474

SEQ ID NO: 578187 - RNA, 64 nt, Homo Sapiens; identical to SEQ ID NO: 352475

SEQ ID NO: 578188 - RNA, 64 nt, Homo Sapiens; identical to SEQ ID NO: 352476

SEQ ID NO: 578189 - RNA, 64 nt, Homo Sapiens; identical to SEQ ID NO: 369930

SEQ ID NO: 578190 - RNA, 64 nt, Homo Sapiens; identical to SEQ ID NO: 369931

SEQ ID NO: 578191 - RNA, 64 nt, Homo Sapiens; identical to SEQ ID NO: 369932

SEQ ID NO: 578192 - RNA, 64 nt, Homo Sapiens; identical to SEQ ID NO: 369933

SEQ ID NO: 578193 - RNA, 64 nt, Homo Sapiens; identical to SEQ ID NO: 369934

SEQ ID NO: 578194 - RNA, 64 nt, Homo Sapiens; identical to SEQ ID NO: 369935

SEQ ID NO: 578195 - RNA, 64 nt, Homo Sapiens; identical to SEQ ID NO: 369936

SEQ ID NO: 578196 - RNA, 64 nt, Homo Sapiens; identical to SEQ ID NO: 369937

SEQ ID NO: 578197 - RNA, 64 nt, Homo Sapiens; identical to SEQ ID NO: 369938

SEQ ID NO: 578198 - RNA, 64 nt, Homo Sapiens; identical to SEQ ID NO: 369939

SEQ ID NO: 578199 - RNA, 64 nt, Homo Sapiens; identical to SEQ ID NO: 369940

SEQ ID NO: 578200 - RNA, 64 nt, Homo Sapiens; identical to SEQ ID NO: 369941

SEQ ID NO: 578201 - RNA, 64 nt, Homo Sapiens; identical to SEQ ID NO: 369942

SEQ ID NO: 578202 - RNA, 64 nt, Homo Sapiens; identical to SEQ ID NO: 369943

SEQ ID NO: 578203 - RNA, 64 nt, Homo Sapiens; identical to SEQ ID NO: 369944

SEQ ID NO: 578204 - RNA, 64 nt, Homo Sapiens; identical to SEQ ID NO: 369945

SEQ ID NO: 578205 - RNA, 64 nt, Homo Sapiens; identical to SEQ ID NO: 369946

SEQ ID NO: 578206 - RNA, 64 nt, Homo Sapiens; identical to SEQ ID NO: 369947

SEQ ID NO: 578207 - RNA, 64 nt, Homo Sapiens; identical to SEQ ID NO: 369948

SEQ ID NO: 578208 - RNA, 64 nt, Homo Sapiens; identical to SEQ ID NO: 369949

SEQ ID NO: 578209 - RNA, 64 nt, Homo Sapiens; identical to SEQ ID NO: 369950

SEQ ID NO: 578210 - RNA, 64 nt, Homo Sapiens; identical to SEQ ID NO: 369951

SEQ ID NO: 578211 - RNA, 64 nt, Homo Sapiens; identical to SEQ ID NO: 369952

SEQ ID NO: 578212 - RNA, 64 nt, Homo Sapiens; identical to SEQ ID NO: 369953

SEQ ID NO: 578213 - RNA, 64 nt, Homo Sapiens; identical to SEQ ID NO: 369954

SEQ ID NO: 578214 - RNA, 64 nt, Homo Sapiens; identical to SEQ ID NO: 369955

SEQ ID NO: 578215 - RNA, 64 nt, Homo Sapiens; identical to SEQ ID NO: 369956

SEQ ID NO: 578216 - RNA, 64 nt, Homo Sapiens; identical to SEQ ID NO: 369957

SEQ ID NO: 578217 - RNA, 64 nt, Homo Sapiens; identical to SEQ ID NO: 369958

SEQ ID NO: 578218 - RNA, 64 nt, Homo Sapiens; identical to SEQ ID NO: 369959

SEQ ID NO: 578219 - RNA, 64 nt, Homo Sapiens; identical to SEQ ID NO: 369960

SEQ ID NO: 578220 - RNA, 64 nt, Homo Sapiens; identical to SEQ ID NO: 316944

SEQ ID NO: 578221 - RNA, 64 nt, Homo Sapiens; identical to SEQ ID NO: 316945

SEQ ID NO: 578222 - RNA, 64 nt, Homo Sapiens; identical to SEQ ID NO: 316946

SEQ ID NO: 578223 - RNA, 64 nt, Homo Sapiens; identical to SEQ ID NO: 316947

SEQ ID NO: 578224 - RNA, 64 nt, Homo Sapiens; identical to SEQ ID NO: 316948

SEQ ID NO: 578225 - RNA, 64 nt, Homo Sapiens; identical to SEQ ID NO: 316949

SEQ ID NO: 578226 - RNA, 64 nt, Homo Sapiens; identical to SEQ ID NO: 316950

SEQ ID NO: 578227 - RNA, 64 nt, Homo Sapiens; identical to SEQ ID NO: 316951

SEQ ID NO: 578228 - RNA, 64 nt, Homo Sapiens; identical to SEQ ID NO: 367941

SEQ ID NO: 578229 - RNA, 64 nt, Homo Sapiens; identical to SEQ ID NO: 367942

SEQ ID NO: 578230 - RNA, 64 nt, Homo Sapiens; identical to SEQ ID NO: 367943

SEQ ID NO: 578231 - RNA, 64 nt, Homo Sapiens; identical to SEQ ID NO: 367944

SEQ ID NO: 578232 - RNA, 64 nt, Homo Sapiens; identical to SEQ ID NO: 367945

SEQ ID NO: 578233 - RNA, 64 nt, Homo Sapiens; identical to SEQ ID NO: 367946

SEQ ID NO: 578234 - RNA, 64 nt, Homo Sapiens; identical to SEQ ID NO: 367947

SEQ ID NO: 578235 - RNA, 64 nt, Homo Sapiens; identical to SEQ ID NO: 367948

SEQ ID NO: 578236 - RNA, 64 nt, Homo Sapiens; identical to SEQ ID NO: 367949

SEQ ID NO: 578237 - RNA, 64 nt, Homo Sapiens; identical to SEQ ID NO: 367950

SEQ ID NO: 578238 - RNA, 64 nt, Homo Sapiens; identical to SEQ ID NO: 367951

SEQ ID NO: 578239 - RNA, 64 nt, Homo Sapiens; identical to SEQ ID NO: 367952

SEQ ID NO: 578240 - RNA, 64 nt, Homo Sapiens; identical to SEQ ID NO: 367953

SEQ ID NO: 578241 - RNA, 64 nt, Homo Sapiens; identical to SEQ ID NO: 367954

SEQ ID NO: 578242 - RNA, 64 nt, Homo Sapiens
cuucauuuuuuuaaauuugccagaaaagaaaauauaguuugauugagacucuguuucaaaaaaa

SEQ ID NO: 578243 - RNA, 64 nt, Homo Sapiens
ccgggcacgguggcucacgccuaauuagaaaauauaguuugaggauuaauguguauuuacugua

SEQ ID NO: 578244 - RNA, 64 nt, Homo Sapiens
caugucaauauuggcacaaacuggaaugaaagaauaguuugauucagaccugcuccacuaugug

SEQ ID NO: 578245 - RNA, 64 nt, Homo Sapiens
uauucacuagcuucugaaaagggaggaguauuuuuaguuugacaauuuaauaauuuaaaaacaa

SEQ ID NO: 578246 - RNA, 64 nt, Homo Sapiens
aacaugaacuaaaauggcaugcuauuuggaaauuuaguuugagauaaacuaaaguguguugaug

SEQ ID NO: 578247 - RNA, 64 nt, Homo Sapiens
uauggaagaaacaaugucagccaaguccauuuuauaguuugagugcaauucuuugaacaauaga

SEQ ID NO: 578248 - RNA, 64 nt, Homo Sapiens
auuggauggagcuauuauucacuacuucuuuucuuaguuugaaaauuauaaacaaauuuuaagc

SEQ ID NO: 578249 - RNA, 64 nt, Homo Sapiens
aaagaauuucaugaauauauauucuauauuuguauaguuugagggaugcuauguuaauguauuu

SEQ ID NO: 578250 - RNA, 64 nt, Homo Sapiens
cucagugucuucugguaacuguugaaaauugucuuaguuugagagauggcugaaauaaugaaca

SEQ ID NO: 578251 - RNA, 64 nt, Homo Sapiens
aaaugugaucagauuauuuuacuaccaacaguuauaguuugaaaguccaacuguauuaauugac

SEQ ID NO: 578252 - RNA, 64 nt, Homo Sapiens
caugacaacgcguguuucuguugcaaauaaaaaauaguuugaggaauugugugaaaucauguag

SEQ ID NO: 578253 - RNA, 64 nt, Homo Sapiens
aauuuuauuaaaguuagucauuuagauauugauauaguuugagauucuuaaaaaauauaugcac

SEQ ID NO: 578254 - RNA, 64 nt, Homo Sapiens
gugacaucgacaaccacguauugggcaggagucaccaugcaaggccucuccaugcaagugcugu

SEQ ID NO: 578255 - RNA, 64 nt, Homo Sapiens
gcuguuugggcaggagucacguccauccuccucuccaugcaagucauggguccucggcccaucu

SEQ ID NO: 578256 - RNA, 64 nt, Homo Sapiens
guuuuuuuucuuuuuccugcuguauaacuccuugccaugcaaacucucaagaggccaauauauu

SEQ ID NO: 578257 - RNA, 64 nt, Homo Sapiens
auguuugaaugagccucuuaaaauaaacuuagagccaugcaaaugccagcagcuuaauggauuu

SEQ ID NO: 578258 - RNA, 64 nt, Homo Sapiens
uuuaauugaagcaugauugugguaauucgagccaucuggagaaugcucuggggaguacaccagg

SEQ ID NO: 578259 - RNA, 64 nt, Homo Sapiens
ucaguugucuuuggccauugugggaagucauuauucuggagacaagaaaaucaucacucuggug

SEQ ID NO: 578260 - RNA, 64 nt, Homo Sapiens
cccaccucugugaccucaggcacuagccuuuggcucuggagacagccccagagcaggguguugg

SEQ ID NO: 578261 - RNA, 64 nt, Homo Sapiens
cuccccacgcccuccccuccccugcugcaggggcucuggagagaaacaauaaagagauucacac

SEQ ID NO: 578262 - RNA, 64 nt, Homo Sapiens
acgggcccagcuccugcaccacggacacagaaugucuggagagggccagcaggcccucugaggg

SEQ ID NO: 578263 - RNA, 64 nt, Homo Sapiens
augcuccuuucuguaccagguuuaaauguagucuucuggagaaguauuuuugacauugagcucu

SEQ ID NO: 578264 - RNA, 64 nt, Homo Sapiens
augggaagguuugaguuccaggcagcguaugaacucuggagaggggcugccaguccucucuggg

SEQ ID NO: 578265 - RNA, 64 nt, Homo Sapiens
ggcaccagccaggguaugauggcuacuacccuuuucuggagaaccauagacuucccuuacuaca

SEQ ID NO: 578266 - RNA, 64 nt, Homo Sapiens
cugaauuuuguuggggggaaaaaacaaaacaaaaucuggagauguaaggacuuggcuccaaaac

SEQ ID NO: 578267 - RNA, 64 nt, Homo Sapiens
gcuaccuggacuuuacagaguuaaauugcuacucucuggagauacacaggucuuuccucaaacu

SEQ ID NO: 578268 - RNA, 64 nt, Homo Sapiens
ugcuugaaaaaccaagaggauaugaaaaucugucucuggagaaacaaagacgcaggcauacuca

SEQ ID NO: 578269 - RNA, 64 nt, Homo Sapiens
gcuguaaacuuaagaaaaggguaaaauaaaauuuucuggagaggaacuuggaauuugagggaga

SEQ ID NO: 578270 - RNA, 64 nt, Homo Sapiens
aaagaugugaagaccacagucuuggguuuucauaucuggagaagacuauuugccaugacguuuu

SEQ ID NO: 578271 - RNA, 64 nt, Homo Sapiens
uuuauuuuucuuuaaaaauaaaggauuuuggaacucuggagaguaagaauauaguauagaguuu

SEQ ID NO: 578272 - RNA, 64 nt, Homo Sapiens
agauuccggggagugggaaugagccacucccaguucuggagagugaggaugaccaucuccacuu

SEQ ID NO: 578273 - RNA, 64 nt, Homo Sapiens
aaacccuaaaggagaaggaagcagaauauaacccucuggagagcucaagacaguaggaaccugg

SEQ ID NO: 578274 - RNA, 64 nt, Homo Sapiens
auuauugggucuuucauaaauaacaugagugguuucuggagacauuuaagauugucagcaaacu

SEQ ID NO: 578275 - RNA, 64 nt, Homo Sapiens
aaugccuucucuccagacaauaagacaguucacaucuggagacaucagccuuugguaccuaauu

SEQ ID NO: 578276 - RNA, 64 nt, Homo Sapiens
gcucugaaccgugcguggugccuacagccugcagucuggagacaagcucuuccggagugcucug

SEQ ID NO: 578277 - RNA, 64 nt, Homo Sapiens
uagacaacgcccauaaacagagaugguccugaacucuggagagauccuucccugauccuuucgg

SEQ ID NO: 578278 - RNA, 64 nt, Homo Sapiens
gagaaagaaucaaaggcagaugccuguugaggcaucuggagacugucuuucuuggccugagcua

SEQ ID NO: 578279 - RNA, 64 nt, Homo Sapiens
accuggggugggggcugauggugggcuggaggccucuggagaagggcuuccuuuggagguggga

SEQ ID NO: 578280 - RNA, 64 nt, Homo Sapiens
agaagcuggaggacuagaaccuggagggcuggaaucuggagagcuagaaccuggagggcuagaa

SEQ ID NO: 578281 - RNA, 64 nt, Homo Sapiens
agaaccuggagggcuagaaccuggagggcuagaaucuggagagcuagaaccuggagggcuagaa

SEQ ID NO: 578282 - RNA, 64 nt, Homo Sapiens
agaaucuggagagcuagaaccuggagggcuagaaucuggagagcuagaaccuggagggcuagaa

SEQ ID NO: 578283 - RNA, 64 nt, Homo Sapiens
gaaccuagaagggcuagaaccuggagggcuggaaucuggagagcuagaaccuggagggcuagaa

SEQ ID NO: 578284 - RNA, 64 nt, Homo Sapiens; identical to SEQ ID NO: 578283

SEQ ID NO: 578285 - RNA, 64 nt, Homo Sapiens
aaaacacuuuuuucccuggagucuucucuccacuucuggagaugaauuucuauguuuugcaccu

SEQ ID NO: 578286 - RNA, 64 nt, Homo Sapiens
ccccagguccugggaguggcuaccgcagguaguuucuggagagcacguuuucuucauugauaag

SEQ ID NO: 578287 - RNA, 64 nt, Homo Sapiens
ugccuuugaaugaggcagcuugugaggcaagcauucuggagagaggugcuuugaaaguaaggug

SEQ ID NO: 578288 - RNA, 64 nt, Homo Sapiens
gcaucucuucuuuccuuuagucuucacagcuaacucuggagagcuucaaaacuagaaggaucua

SEQ ID NO: 578289 - RNA, 64 nt, Homo Sapiens
cucauggcccaccuccaacccacuuuccucaguaucuggagagggaagggaagucaggcuuggg

SEQ ID NO: 578290 - RNA, 64 nt, Homo Sapiens
ucugucuccgucauggggagggucccugcucaguucuggagacacuggaguuggggugggggug

SEQ ID NO: 578291 - RNA, 64 nt, Homo Sapiens
guuuggauuucauguggggaacccucaaggccugucuggagaagugacacaggauuuacugggg

SEQ ID NO: 578292 - RNA, 64 nt, Homo Sapiens
cguucuccugcguggcaguccugauuuccaugcuucuggagaauccauuucguuaacacugaaa

SEQ ID NO: 578293 - RNA, 64 nt, Homo Sapiens
gcagccuuuguauggaggcccaaccgcgcucccgucuggagaagcggcuuccgggguguggcug

SEQ ID NO: 578294 - RNA, 64 nt, Homo Sapiens
uccucauuaccucuuuuacauuccggaaacaguuucuggagaucugugugucacacuucaucaa

SEQ ID NO: 578295 - RNA, 64 nt, Homo Sapiens
gccucugagaaggcacugaaucacacauggcuguucuggagagggaaaugaccacagcagaaug

SEQ ID NO: 578296 - RNA, 64 nt, Homo Sapiens
uagaguuuaaaguuuuaaguacugguugaaugccucuggagaccaaggcaauaaguaaauaugu

SEQ ID NO: 578297 - RNA, 64 nt, Homo Sapiens
uuaccauaguuuuauagcauguuccuacaucuuuucuggagagcaauuuucuaguaagcaaggu

SEQ ID NO: 578298 - RNA, 64 nt, Homo Sapiens; identical to SEQ ID NO: 81719

SEQ ID NO: 578299 - RNA, 64 nt, Homo Sapiens; identical to SEQ ID NO: 81720

SEQ ID NO: 578300 - RNA, 64 nt, Homo Sapiens; identical to SEQ ID NO: 81721

SEQ ID NO: 578301 - RNA, 64 nt, Homo Sapiens; identical to SEQ ID NO: 81722

SEQ ID NO: 578302 - RNA, 64 nt, Homo Sapiens; identical to SEQ ID NO: 81723

SEQ ID NO: 578303 - RNA, 64 nt, Homo Sapiens; identical to SEQ ID NO: 81724

SEQ ID NO: 578304 - RNA, 64 nt, Homo Sapiens; identical to SEQ ID NO: 81725

SEQ ID NO: 578305 - RNA, 64 nt, Homo Sapiens; identical to SEQ ID NO: 81726

SEQ ID NO: 578306 - RNA, 64 nt, Homo Sapiens; identical to SEQ ID NO: 81727

SEQ ID NO: 578307 - RNA, 64 nt, Homo Sapiens; identical to SEQ ID NO: 81728

SEQ ID NO: 578308 - RNA, 64 nt, Homo Sapiens; identical to SEQ ID NO: 81729

SEQ ID NO: 578309 - RNA, 64 nt, Homo Sapiens; identical to SEQ ID NO: 81730

SEQ ID NO: 578310 - RNA, 64 nt, Homo Sapiens; identical to SEQ ID NO: 81731

SEQ ID NO: 578311 - RNA, 64 nt, Homo Sapiens; identical to SEQ ID NO: 81732

SEQ ID NO: 578312 - RNA, 64 nt, Homo Sapiens; identical to SEQ ID NO: 81733

SEQ ID NO: 578313 - RNA, 64 nt, Homo Sapiens; identical to SEQ ID NO: 81734

SEQ ID NO: 578314 - RNA, 64 nt, Homo Sapiens
aggaacuucucaagggaugaggagacagaaccccuacuuccaagugcucuauuuguauuaccca

SEQ ID NO: 578315 - RNA, 64 nt, Homo Sapiens
uucuaugugauggaaagacuagagcuuauaaaaguacuuccauuuuuuuauucuccugaauacc

SEQ ID NO: 578316 - RNA, 64 nt, Homo Sapiens
gcaacuacagaaguggaagugcuugauauguaaguacuuccacuuguguauauuuuaaugaaua

SEQ ID NO: 578317 - RNA, 64 nt, Homo Sapiens
auuuaugcugcucauccaaaguugccacagaugauacuuccaagugauaauuuuauuuauaaac

SEQ ID NO: 578318 - RNA, 64 nt, Homo Sapiens
ucugauuucugugaaagcugcucagcaacaaacguacuuccaccagauguguccccagauccac

SEQ ID NO: 578319 - RNA, 64 nt, Homo Sapiens
gacacuccugagguuggacuuccuugcuuuucucuacuuccaaaucacaauuucuuacaaccaa

SEQ ID NO: 578320 - RNA, 64 nt, Homo Sapiens
cgccucccccuacgccgucuuggcuuuuccccucuacuuccaguccuuagguuagaugaaaagu

SEQ ID NO: 578321 - RNA, 64 nt, Homo Sapiens
gcccuguuacauaaaccagagaugauaaaacagauacuuccagaacauagugugcuucaaaaca

SEQ ID NO: 578322 - RNA, 64 nt, Homo Sapiens; identical to SEQ ID NO: 395564

SEQ ID NO: 578323 - RNA, 64 nt, Homo Sapiens; identical to SEQ ID NO: 395565

SEQ ID NO: 578324 - RNA, 64 nt, Homo Sapiens; identical to SEQ ID NO: 395566

SEQ ID NO: 578325 - RNA, 64 nt, Homo Sapiens; identical to SEQ ID NO: 395567

SEQ ID NO: 578326 - RNA, 64 nt, Homo Sapiens; identical to SEQ ID NO: 395568

SEQ ID NO: 578327 - RNA, 64 nt, Homo Sapiens; identical to SEQ ID NO: 395569

SEQ ID NO: 578328 - RNA, 64 nt, Homo Sapiens; identical to SEQ ID NO: 395570

SEQ ID NO: 578329 - RNA, 64 nt, Homo Sapiens; identical to SEQ ID NO: 395571

SEQ ID NO: 578330 - RNA, 64 nt, Homo Sapiens; identical to SEQ ID NO: 395572

SEQ ID NO: 578331 - RNA, 64 nt, Homo Sapiens; identical to SEQ ID NO: 395573

SEQ ID NO: 578332 - RNA, 64 nt, Homo Sapiens; identical to SEQ ID NO: 395574

SEQ ID NO: 578333 - RNA, 64 nt, Homo Sapiens; identical to SEQ ID NO: 395575

SEQ ID NO: 578334 - RNA, 64 nt, Homo Sapiens; identical to SEQ ID NO: 395576

SEQ ID NO: 578335 - RNA, 64 nt, Homo Sapiens; identical to SEQ ID NO: 395577

SEQ ID NO: 578336 - RNA, 64 nt, Homo Sapiens; identical to SEQ ID NO: 395578

SEQ ID NO: 578337 - RNA, 64 nt, Homo Sapiens; identical to SEQ ID NO: 395579

SEQ ID NO: 578338 - RNA, 64 nt, Homo Sapiens; identical to SEQ ID NO: 395580

SEQ ID NO: 578339 - RNA, 64 nt, Homo Sapiens; identical to SEQ ID NO: 395581

SEQ ID NO: 578340 - RNA, 64 nt, Homo Sapiens; identical to SEQ ID NO: 395582

SEQ ID NO: 578341 - RNA, 64 nt, Homo Sapiens; identical to SEQ ID NO: 395583

SEQ ID NO: 578342 - RNA, 64 nt, Homo Sapiens; identical to SEQ ID NO: 395584

SEQ ID NO: 578343 - RNA, 64 nt, Homo Sapiens; identical to SEQ ID NO: 395585

SEQ ID NO: 578344 - RNA, 64 nt, Homo Sapiens; identical to SEQ ID NO: 395586

SEQ ID NO: 578345 - RNA, 64 nt, Homo Sapiens; identical to SEQ ID NO: 395587

SEQ ID NO: 578346 - RNA, 64 nt, Homo Sapiens; identical to SEQ ID NO: 395588

SEQ ID NO: 578347 - RNA, 64 nt, Homo Sapiens; identical to SEQ ID NO: 395589

SEQ ID NO: 578348 - RNA, 64 nt, Homo Sapiens; identical to SEQ ID NO: 395590

SEQ ID NO: 578349 - RNA, 64 nt, Homo Sapiens; identical to SEQ ID NO: 395591

SEQ ID NO: 578350 - RNA, 64 nt, Homo Sapiens; identical to SEQ ID NO: 395592

SEQ ID NO: 578351 - RNA, 64 nt, Homo Sapiens; identical to SEQ ID NO: 395593

SEQ ID NO: 578352 - RNA, 64 nt, Homo Sapiens; identical to SEQ ID NO: 395594

SEQ ID NO: 578353 - RNA, 64 nt, Homo Sapiens; identical to SEQ ID NO: 395595

SEQ ID NO: 578354 - RNA, 64 nt, Homo Sapiens; identical to SEQ ID NO: 395596

SEQ ID NO: 578355 - RNA, 64 nt, Homo Sapiens; identical to SEQ ID NO: 395597

SEQ ID NO: 578356 - RNA, 64 nt, Homo Sapiens; identical to SEQ ID NO: 395598

SEQ ID NO: 578357 - RNA, 64 nt, Homo Sapiens; identical to SEQ ID NO: 395599

SEQ ID NO: 578358 - RNA, 64 nt, Homo Sapiens; identical to SEQ ID NO: 395600

SEQ ID NO: 578359 - RNA, 64 nt, Homo Sapiens; identical to SEQ ID NO: 395601

SEQ ID NO: 578360 - RNA, 64 nt, Homo Sapiens; identical to SEQ ID NO: 395602

SEQ ID NO: 578361 - RNA, 64 nt, Homo Sapiens; identical to SEQ ID NO: 395603

SEQ ID NO: 578362 - RNA, 63 nt, Homo Sapiens
caagagucucuccagccucacagaaguaacucccacuccuaauuugcucgaagacugugacau

SEQ ID NO: 578363 - RNA, 63 nt, Homo Sapiens
uaugauuguuugcacagagguuuuguuuguucacacuccuauagaaugugcugccuuuuuaag

SEQ ID NO: 578364 - RNA, 63 nt, Homo Sapiens
uuuugcuagaccuuucuauuccccuucacaccucacuccuagauuacaacugaucugauuugg

SEQ ID NO: 578365 - RNA, 63 nt, Homo Sapiens
acaacugaucugauuuggccggcuuuuucuuuccacuccuauucccucuguugaaacauccua

SEQ ID NO: 578366 - RNA, 64 nt, Homo Sapiens; identical to SEQ ID NO: 507233

SEQ ID NO: 578367 - RNA, 64 nt, Homo Sapiens; identical to SEQ ID NO: 507234

SEQ ID NO: 578368 - RNA, 64 nt, Homo Sapiens; identical to SEQ ID NO: 507235

SEQ ID NO: 578369 - RNA, 64 nt, Homo Sapiens; identical to SEQ ID NO: 507236

SEQ ID NO: 578370 - RNA, 64 nt, Homo Sapiens; identical to SEQ ID NO: 507237

SEQ ID NO: 578371 - RNA, 64 nt, Homo Sapiens; identical to SEQ ID NO: 507238

SEQ ID NO: 578372 - RNA, 64 nt, Homo Sapiens; identical to SEQ ID NO: 507239

SEQ ID NO: 578373 - RNA, 64 nt, Homo Sapiens; identical to SEQ ID NO: 507240

SEQ ID NO: 578374 - RNA, 64 nt, Homo Sapiens; identical to SEQ ID NO: 507241

SEQ ID NO: 578375 - RNA, 64 nt, Homo Sapiens; identical to SEQ ID NO: 507242

SEQ ID NO: 578376 - RNA, 64 nt, Homo Sapiens; identical to SEQ ID NO: 507243

SEQ ID NO: 578377 - RNA, 64 nt, Homo Sapiens; identical to SEQ ID NO: 507244

SEQ ID NO: 578378 - RNA, 64 nt, Homo Sapiens; identical to SEQ ID NO: 507245

SEQ ID NO: 578379 - RNA, 64 nt, Homo Sapiens; identical to SEQ ID NO: 507246

SEQ ID NO: 578380 - RNA, 64 nt, Homo Sapiens; identical to SEQ ID NO: 507247

SEQ ID NO: 578381 - RNA, 64 nt, Homo Sapiens; identical to SEQ ID NO: 507248

SEQ ID NO: 578382 - RNA, 64 nt, Homo Sapiens; identical to SEQ ID NO: 164859

SEQ ID NO: 578383 - RNA, 64 nt, Homo Sapiens; identical to SEQ ID NO: 164860

SEQ ID NO: 578384 - RNA, 64 nt, Homo Sapiens; identical to SEQ ID NO: 164861

SEQ ID NO: 578385 - RNA, 64 nt, Homo Sapiens; identical to SEQ ID NO: 164862

SEQ ID NO: 578386 - RNA, 64 nt, Homo Sapiens; identical to SEQ ID NO: 164863

SEQ ID NO: 578387 - RNA, 64 nt, Homo Sapiens; identical to SEQ ID NO: 164864

SEQ ID NO: 578388 - RNA, 64 nt, Homo Sapiens; identical to SEQ ID NO: 164865

SEQ ID NO: 578389 - RNA, 64 nt, Homo Sapiens; identical to SEQ ID NO: 164866

SEQ ID NO: 578390 - RNA, 64 nt, Homo Sapiens; identical to SEQ ID NO: 164867

SEQ ID NO: 578391 - RNA, 64 nt, Homo Sapiens; identical to SEQ ID NO: 164868

SEQ ID NO: 578392 - RNA, 64 nt, Homo Sapiens; identical to SEQ ID NO: 164869

SEQ ID NO: 578393 - RNA, 64 nt, Homo Sapiens; identical to SEQ ID NO: 164870

SEQ ID NO: 578394 - RNA, 64 nt, Homo Sapiens; identical to SEQ ID NO: 164871

SEQ ID NO: 578395 - RNA, 64 nt, Homo Sapiens; identical to SEQ ID NO: 164872

SEQ ID NO: 578396 - RNA, 64 nt, Homo Sapiens; identical to SEQ ID NO: 164873

SEQ ID NO: 578397 - RNA, 64 nt, Homo Sapiens; identical to SEQ ID NO: 164874

SEQ ID NO: 578398 - RNA, 64 nt, Homo Sapiens; identical to SEQ ID NO: 164875

SEQ ID NO: 578399 - RNA, 64 nt, Homo Sapiens; identical to SEQ ID NO: 164876

SEQ ID NO: 578400 - RNA, 64 nt, Homo Sapiens; identical to SEQ ID NO: 164877

SEQ ID NO: 578401 - RNA, 64 nt, Homo Sapiens; identical to SEQ ID NO: 164878

SEQ ID NO: 578402 - RNA, 64 nt, Homo Sapiens; identical to SEQ ID NO: 164879

SEQ ID NO: 578403 - RNA, 64 nt, Homo Sapiens; identical to SEQ ID NO: 164880

SEQ ID NO: 578404 - RNA, 64 nt, Homo Sapiens; identical to SEQ ID NO: 164881

SEQ ID NO: 578405 - RNA, 64 nt, Homo Sapiens; identical to SEQ ID NO: 164882

SEQ ID NO: 578406 - RNA, 64 nt, Homo Sapiens; identical to SEQ ID NO: 164883

SEQ ID NO: 578407 - RNA, 64 nt, Homo Sapiens; identical to SEQ ID NO: 164884

SEQ ID NO: 578408 - RNA, 64 nt, Homo Sapiens; identical to SEQ ID NO: 164885

SEQ ID NO: 578409 - RNA, 64 nt, Homo Sapiens; identical to SEQ ID NO: 164886

SEQ ID NO: 578410 - RNA, 64 nt, Homo Sapiens
uuccccuaaaccccugucccaugcaggcccuuugaagccucagcuacccacuuuccuucaugaa

SEQ ID NO: 578411 - RNA, 64 nt, Homo Sapiens
auggccccugccuuaggccuaccugaucaaaauaaagccucagccacauuugcuauagucuugu

SEQ ID NO: 578412 - RNA, 64 nt, Homo Sapiens
ucccccuaaaccccugucccaugcaggcccuuugaagccucagcuacccacuauccuucgugaa

SEQ ID NO: 578413 - RNA, 64 nt, Homo Sapiens
auggucccugccuuaggccuaccugauggaaguaaagccucaaccacauuugcugugugucuug

SEQ ID NO: 578414 - RNA, 64 nt, Homo Sapiens; identical to SEQ ID NO: 578412

SEQ ID NO: 578415 - RNA, 64 nt, Homo Sapiens; identical to SEQ ID NO: 578413

SEQ ID NO: 578416 - RNA, 64 nt, Homo Sapiens
accauaggaucauaggaaagcaggguucuccucaaagccucacaugaauaccccgaguggggag

SEQ ID NO: 578417 - RNA, 64 nt, Homo Sapiens
caucuccuuuccugagcaccgcaccuggaggugcaagccucaugucucugcucaccuuccaaag

SEQ ID NO: 578418 - RNA, 64 nt, Homo Sapiens
ucacuccgaaaguuccuuauguauauuuaaaagaaagccucagagaauugcugauucuugaguu

SEQ ID NO: 578419 - RNA, 64 nt, Homo Sapiens
uuugaguuggaucaucuauugcuggcaaagacagaagccucacugcaagcacugcaugggcaag

SEQ ID NO: 578420 - RNA, 64 nt, Homo Sapiens
gacaucugccugucacaauagaauaggaguaguaaagccucaagcacuauaaacuuuuaggccu

SEQ ID NO: 578421 - RNA, 64 nt, Homo Sapiens
uauccccuaccuauuucucagagugacuuauucuaagccucaucuuucuacccuaauuucacug

SEQ ID NO: 578422 - RNA, 64 nt, Homo Sapiens
uuucuggaagaggaaagccaugcguggaacaucgaagccucagagagugggagacuguccccau

SEQ ID NO: 578423 - RNA, 64 nt, Homo Sapiens
gcauccccuggggcugugaucaugguggaugaggaagccucaacguagauuccugaacucaagg

SEQ ID NO: 578424 - RNA, 64 nt, Homo Sapiens
uucacuuacucuggcagucuuucugcuuuucauuaagccucaaaaucuccucuguucuacuugg

SEQ ID NO: 578425 - RNA, 64 nt, Homo Sapiens
gcuuuuauuuaauaaggaggcugggcacccuauaaagccucaugcauucacaccuuugcagcau

SEQ ID NO: 578426 - RNA, 64 nt, Homo Sapiens; identical to SEQ ID NO: 259226

SEQ ID NO: 578427 - RNA, 64 nt, Homo Sapiens; identical to SEQ ID NO: 259227

SEQ ID NO: 578428 - RNA, 64 nt, Homo Sapiens; identical to SEQ ID NO: 259228

SEQ ID NO: 578429 - RNA, 64 nt, Homo Sapiens; identical to SEQ ID NO: 259229

SEQ ID NO: 578430 - RNA, 64 nt, Homo Sapiens; identical to SEQ ID NO: 259230

SEQ ID NO: 578431 - RNA, 64 nt, Homo Sapiens; identical to SEQ ID NO: 259231

SEQ ID NO: 578432 - RNA, 64 nt, Homo Sapiens; identical to SEQ ID NO: 259232

SEQ ID NO: 578433 - RNA, 64 nt, Homo Sapiens; identical to SEQ ID NO: 259233

SEQ ID NO: 578434 - RNA, 64 nt, Homo Sapiens; identical to SEQ ID NO: 259234

SEQ ID NO: 578435 - RNA, 64 nt, Homo Sapiens; identical to SEQ ID NO: 259235

SEQ ID NO: 578436 - RNA, 64 nt, Homo Sapiens; identical to SEQ ID NO: 259236

SEQ ID NO: 578437 - RNA, 64 nt, Homo Sapiens; identical to SEQ ID NO: 259237

SEQ ID NO: 578438 - RNA, 64 nt, Homo Sapiens; identical to SEQ ID NO: 259238

SEQ ID NO: 578439 - RNA, 64 nt, Homo Sapiens; identical to SEQ ID NO: 259239

SEQ ID NO: 578440 - RNA, 64 nt, Homo Sapiens; identical to SEQ ID NO: 259240

SEQ ID NO: 578441 - RNA, 64 nt, Homo Sapiens; identical to SEQ ID NO: 259241

SEQ ID NO: 578442 - RNA, 64 nt, Homo Sapiens; identical to SEQ ID NO: 259242

SEQ ID NO: 578443 - RNA, 64 nt, Homo Sapiens; identical to SEQ ID NO: 259243

SEQ ID NO: 578444 - RNA, 64 nt, Homo Sapiens; identical to SEQ ID NO: 259244

SEQ ID NO: 578445 - RNA, 64 nt, Homo Sapiens; identical to SEQ ID NO: 259245

SEQ ID NO: 578446 - RNA, 64 nt, Homo Sapiens; identical to SEQ ID NO: 259246

SEQ ID NO: 578447 - RNA, 64 nt, Homo Sapiens; identical to SEQ ID NO: 259247

SEQ ID NO: 578448 - RNA, 64 nt, Homo Sapiens; identical to SEQ ID NO: 259248

SEQ ID NO: 578449 - RNA, 64 nt, Homo Sapiens; identical to SEQ ID NO: 259249

SEQ ID NO: 578450 - RNA, 64 nt, Homo Sapiens; identical to SEQ ID NO: 259250

SEQ ID NO: 578451 - RNA, 64 nt, Homo Sapiens; identical to SEQ ID NO: 259251

SEQ ID NO: 578452 - RNA, 64 nt, Homo Sapiens; identical to SEQ ID NO: 259252

SEQ ID NO: 578453 - RNA, 64 nt, Homo Sapiens; identical to SEQ ID NO: 259253

SEQ ID NO: 578454 - RNA, 64 nt, Homo Sapiens; identical to SEQ ID NO: 259254

SEQ ID NO: 578455 - RNA, 64 nt, Homo Sapiens; identical to SEQ ID NO: 259255

SEQ ID NO: 578456 - RNA, 64 nt, Homo Sapiens; identical to SEQ ID NO: 259256

SEQ ID NO: 578457 - RNA, 64 nt, Homo Sapiens; identical to SEQ ID NO: 259257

SEQ ID NO: 578458 - RNA, 64 nt, Homo Sapiens; identical to SEQ ID NO: 259258

SEQ ID NO: 578459 - RNA, 64 nt, Homo Sapiens; identical to SEQ ID NO: 259259

SEQ ID NO: 578460 - RNA, 64 nt, Homo Sapiens; identical to SEQ ID NO: 259260

SEQ ID NO: 578461 - RNA, 64 nt, Homo Sapiens; identical to SEQ ID NO: 259261

SEQ ID NO: 578462 - RNA, 64 nt, Homo Sapiens; identical to SEQ ID NO: 259262

SEQ ID NO: 578463 - RNA, 64 nt, Homo Sapiens; identical to SEQ ID NO: 259263

SEQ ID NO: 578464 - RNA, 64 nt, Homo Sapiens; identical to SEQ ID NO: 259264

SEQ ID NO: 578465 - RNA, 64 nt, Homo Sapiens; identical to SEQ ID NO: 259265

SEQ ID NO: 578466 - RNA, 64 nt, Homo Sapiens; identical to SEQ ID NO: 259266

SEQ ID NO: 578467 - RNA, 64 nt, Homo Sapiens; identical to SEQ ID NO: 259267

SEQ ID NO: 578468 - RNA, 64 nt, Homo Sapiens; identical to SEQ ID NO: 259268

SEQ ID NO: 578469 - RNA, 64 nt, Homo Sapiens; identical to SEQ ID NO: 259269

SEQ ID NO: 578470 - RNA, 64 nt, Homo Sapiens; identical to SEQ ID NO: 259270

SEQ ID NO: 578471 - RNA, 64 nt, Homo Sapiens; identical to SEQ ID NO: 259271

SEQ ID NO: 578472 - RNA, 64 nt, Homo Sapiens; identical to SEQ ID NO: 259272

SEQ ID NO: 578473 - RNA, 64 nt, Homo Sapiens; identical to SEQ ID NO: 259273

SEQ ID NO: 578474 - RNA, 64 nt, Homo Sapiens; identical to SEQ ID NO: 259274

SEQ ID NO: 578475 - RNA, 64 nt, Homo Sapiens; identical to SEQ ID NO: 259275

SEQ ID NO: 578476 - RNA, 64 nt, Homo Sapiens; identical to SEQ ID NO: 259276

SEQ ID NO: 578477 - RNA, 64 nt, Homo Sapiens; identical to SEQ ID NO: 259277

SEQ ID NO: 578478 - RNA, 64 nt, Homo Sapiens; identical to SEQ ID NO: 259278

SEQ ID NO: 578479 - RNA, 64 nt, Homo Sapiens; identical to SEQ ID NO: 259279

SEQ ID NO: 578480 - RNA, 64 nt, Homo Sapiens; identical to SEQ ID NO: 259280

SEQ ID NO: 578481 - RNA, 64 nt, Homo Sapiens; identical to SEQ ID NO: 259281

SEQ ID NO: 578482 - RNA, 64 nt, Homo Sapiens; identical to SEQ ID NO: 259282

SEQ ID NO: 578483 - RNA, 64 nt, Homo Sapiens; identical to SEQ ID NO: 259283

SEQ ID NO: 578484 - RNA, 64 nt, Homo Sapiens; identical to SEQ ID NO: 259284

SEQ ID NO: 578485 - RNA, 64 nt, Homo Sapiens; identical to SEQ ID NO: 259285

SEQ ID NO: 578486 - RNA, 64 nt, Homo Sapiens; identical to SEQ ID NO: 259286

SEQ ID NO: 578487 - RNA, 64 nt, Homo Sapiens; identical to SEQ ID NO: 259287

SEQ ID NO: 578488 - RNA, 64 nt, Homo Sapiens; identical to SEQ ID NO: 259288

SEQ ID NO: 578489 - RNA, 64 nt, Homo Sapiens; identical to SEQ ID NO: 259289

SEQ ID NO: 578490 - RNA, 64 nt, Homo Sapiens; identical to SEQ ID NO: 259290

SEQ ID NO: 578491 - RNA, 64 nt, Homo Sapiens; identical to SEQ ID NO: 259291

SEQ ID NO: 578492 - RNA, 64 nt, Homo Sapiens; identical to SEQ ID NO: 259292

SEQ ID NO: 578493 - RNA, 64 nt, Homo Sapiens; identical to SEQ ID NO: 259293

SEQ ID NO: 578494 - RNA, 64 nt, Homo Sapiens; identical to SEQ ID NO: 259294

SEQ ID NO: 578495 - RNA, 64 nt, Homo Sapiens; identical to SEQ ID NO: 259295

SEQ ID NO: 578496 - RNA, 64 nt, Homo Sapiens; identical to SEQ ID NO: 259296

SEQ ID NO: 578497 - RNA, 64 nt, Homo Sapiens; identical to SEQ ID NO: 259297

SEQ ID NO: 578498 - RNA, 64 nt, Homo Sapiens; identical to SEQ ID NO: 259298

SEQ ID NO: 578499 - RNA, 64 nt, Homo Sapiens; identical to SEQ ID NO: 259299

SEQ ID NO: 578500 - RNA, 64 nt, Homo Sapiens; identical to SEQ ID NO: 259300

SEQ ID NO: 578501 - RNA, 64 nt, Homo Sapiens; identical to SEQ ID NO: 259301

SEQ ID NO: 578502 - RNA, 64 nt, Homo Sapiens; identical to SEQ ID NO: 259302

SEQ ID NO: 578503 - RNA, 64 nt, Homo Sapiens; identical to SEQ ID NO: 259303

SEQ ID NO: 578504 - RNA, 64 nt, Homo Sapiens; identical to SEQ ID NO: 259304

SEQ ID NO: 578505 - RNA, 64 nt, Homo Sapiens; identical to SEQ ID NO: 259305

SEQ ID NO: 578506 - RNA, 64 nt, Homo Sapiens; identical to SEQ ID NO: 259306

SEQ ID NO: 578507 - RNA, 64 nt, Homo Sapiens; identical to SEQ ID NO: 259307

SEQ ID NO: 578508 - RNA, 64 nt, Homo Sapiens; identical to SEQ ID NO: 259308

SEQ ID NO: 578509 - RNA, 64 nt, Homo Sapiens; identical to SEQ ID NO: 259309

SEQ ID NO: 578510 - RNA, 64 nt, Homo Sapiens; identical to SEQ ID NO: 259310

SEQ ID NO: 578511 - RNA, 64 nt, Homo Sapiens; identical to SEQ ID NO: 259311

SEQ ID NO: 578512 - RNA, 64 nt, Homo Sapiens; identical to SEQ ID NO: 259312

SEQ ID NO: 578513 - RNA, 64 nt, Homo Sapiens; identical to SEQ ID NO: 259313

SEQ ID NO: 578514 - RNA, 64 nt, Homo Sapiens; identical to SEQ ID NO: 259314

SEQ ID NO: 578515 - RNA, 64 nt, Homo Sapiens; identical to SEQ ID NO: 259315

SEQ ID NO: 578516 - RNA, 64 nt, Homo Sapiens; identical to SEQ ID NO: 259316

SEQ ID NO: 578517 - RNA, 64 nt, Homo Sapiens; identical to SEQ ID NO: 259317

SEQ ID NO: 578518 - RNA, 64 nt, Homo Sapiens; identical to SEQ ID NO: 259318

SEQ ID NO: 578519 - RNA, 64 nt, Homo Sapiens; identical to SEQ ID NO: 259319

SEQ ID NO: 578520 - RNA, 64 nt, Homo Sapiens; identical to SEQ ID NO: 259320

SEQ ID NO: 578521 - RNA, 64 nt, Homo Sapiens; identical to SEQ ID NO: 259321

SEQ ID NO: 578522 - RNA, 64 nt, Homo Sapiens; identical to SEQ ID NO: 259322

SEQ ID NO: 578523 - RNA, 64 nt, Homo Sapiens; identical to SEQ ID NO: 259323

SEQ ID NO: 578524 - RNA, 64 nt, Homo Sapiens; identical to SEQ ID NO: 259324

SEQ ID NO: 578525 - RNA, 64 nt, Homo Sapiens; identical to SEQ ID NO: 259325

SEQ ID NO: 578526 - RNA, 64 nt, Homo Sapiens; identical to SEQ ID NO: 259326

SEQ ID NO: 578527 - RNA, 64 nt, Homo Sapiens; identical to SEQ ID NO: 259327

SEQ ID NO: 578528 - RNA, 64 nt, Homo Sapiens; identical to SEQ ID NO: 259328

SEQ ID NO: 578529 - RNA, 64 nt, Homo Sapiens; identical to SEQ ID NO: 259329

SEQ ID NO: 578530 - RNA, 64 nt, Homo Sapiens; identical to SEQ ID NO: 259330

SEQ ID NO: 578531 - RNA, 64 nt, Homo Sapiens; identical to SEQ ID NO: 259331

SEQ ID NO: 578532 - RNA, 64 nt, Homo Sapiens; identical to SEQ ID NO: 259332

SEQ ID NO: 578533 - RNA, 64 nt, Homo Sapiens; identical to SEQ ID NO: 259333

SEQ ID NO: 578534 - RNA, 64 nt, Homo Sapiens; identical to SEQ ID NO: 259334

SEQ ID NO: 578535 - RNA, 64 nt, Homo Sapiens; identical to SEQ ID NO: 259335

SEQ ID NO: 578536 - RNA, 64 nt, Homo Sapiens; identical to SEQ ID NO: 259336

SEQ ID NO: 578537 - RNA, 64 nt, Homo Sapiens; identical to SEQ ID NO: 259337

SEQ ID NO: 578538 - RNA, 64 nt, Homo Sapiens; identical to SEQ ID NO: 259338

SEQ ID NO: 578539 - RNA, 64 nt, Homo Sapiens; identical to SEQ ID NO: 259339

SEQ ID NO: 578540 - RNA, 64 nt, Homo Sapiens; identical to SEQ ID NO: 259340

SEQ ID NO: 578541 - RNA, 64 nt, Homo Sapiens; identical to SEQ ID NO: 259341

SEQ ID NO: 578542 - RNA, 64 nt, Homo Sapiens; identical to SEQ ID NO: 259342

SEQ ID NO: 578543 - RNA, 64 nt, Homo Sapiens; identical to SEQ ID NO: 259343

SEQ ID NO: 578544 - RNA, 64 nt, Homo Sapiens; identical to SEQ ID NO: 259344

SEQ ID NO: 578545 - RNA, 64 nt, Homo Sapiens; identical to SEQ ID NO: 259345

SEQ ID NO: 578546 - RNA, 64 nt, Homo Sapiens; identical to SEQ ID NO: 259346

SEQ ID NO: 578547 - RNA, 64 nt, Homo Sapiens; identical to SEQ ID NO: 259347

SEQ ID NO: 578548 - RNA, 64 nt, Homo Sapiens; identical to SEQ ID NO: 259348

SEQ ID NO: 578549 - RNA, 64 nt, Homo Sapiens; identical to SEQ ID NO: 259349

SEQ ID NO: 578550 - RNA, 64 nt, Homo Sapiens; identical to SEQ ID NO: 259350

SEQ ID NO: 578551 - RNA, 64 nt, Homo Sapiens; identical to SEQ ID NO: 259351

SEQ ID NO: 578552 - RNA, 64 nt, Homo Sapiens; identical to SEQ ID NO: 259352

SEQ ID NO: 578553 - RNA, 64 nt, Homo Sapiens; identical to SEQ ID NO: 259353

SEQ ID NO: 578554 - RNA, 65 nt, Homo Sapiens; identical to SEQ ID NO: 270344

SEQ ID NO: 578555 - RNA, 65 nt, Homo Sapiens; identical to SEQ ID NO: 270345

SEQ ID NO: 578556 - RNA, 65 nt, Homo Sapiens; identical to SEQ ID NO: 270346

SEQ ID NO: 578557 - RNA, 65 nt, Homo Sapiens; identical to SEQ ID NO: 270347

SEQ ID NO: 578558 - RNA, 65 nt, Homo Sapiens; identical to SEQ ID NO: 270348

SEQ ID NO: 578559 - RNA, 65 nt, Homo Sapiens; identical to SEQ ID NO: 270349

SEQ ID NO: 578560 - RNA, 65 nt, Homo Sapiens; identical to SEQ ID NO: 270350

SEQ ID NO: 578561 - RNA, 65 nt, Homo Sapiens; identical to SEQ ID NO: 270351

SEQ ID NO: 578562 - RNA, 65 nt, Homo Sapiens; identical to SEQ ID NO: 270352

SEQ ID NO: 578563 - RNA, 65 nt, Homo Sapiens; identical to SEQ ID NO: 270353

SEQ ID NO: 578564 - RNA, 65 nt, Homo Sapiens; identical to SEQ ID NO: 270354

SEQ ID NO: 578565 - RNA, 65 nt, Homo Sapiens; identical to SEQ ID NO: 270355

SEQ ID NO: 578566 - RNA, 65 nt, Homo Sapiens; identical to SEQ ID NO: 270356

SEQ ID NO: 578567 - RNA, 65 nt, Homo Sapiens; identical to SEQ ID NO: 270357

SEQ ID NO: 578568 - RNA, 64 nt, Homo Sapiens; identical to SEQ ID NO: 297911

SEQ ID NO: 578569 - RNA, 64 nt, Homo Sapiens; identical to SEQ ID NO: 297912

SEQ ID NO: 578570 - RNA, 64 nt, Homo Sapiens; identical to SEQ ID NO: 297913

SEQ ID NO: 578571 - RNA, 64 nt, Homo Sapiens; identical to SEQ ID NO: 297914

SEQ ID NO: 578572 - RNA, 64 nt, Homo Sapiens; identical to SEQ ID NO: 297915

SEQ ID NO: 578573 - RNA, 64 nt, Homo Sapiens; identical to SEQ ID NO: 297916

SEQ ID NO: 578574 - RNA, 64 nt, Homo Sapiens; identical to SEQ ID NO: 297917

SEQ ID NO: 578575 - RNA, 64 nt, Homo Sapiens; identical to SEQ ID NO: 297918

SEQ ID NO: 578576 - RNA, 64 nt, Homo Sapiens; identical to SEQ ID NO: 297919

SEQ ID NO: 578577 - RNA, 64 nt, Homo Sapiens; identical to SEQ ID NO: 297920

SEQ ID NO: 578578 - RNA, 64 nt, Homo Sapiens; identical to SEQ ID NO: 297921

SEQ ID NO: 578579 - RNA, 64 nt, Homo Sapiens; identical to SEQ ID NO: 297922

SEQ ID NO: 578580 - RNA, 64 nt, Homo Sapiens; identical to SEQ ID NO: 297923

SEQ ID NO: 578581 - RNA, 64 nt, Homo Sapiens; identical to SEQ ID NO: 297924

SEQ ID NO: 578582 - RNA, 64 nt, Homo Sapiens; identical to SEQ ID NO: 297925

SEQ ID NO: 578583 - RNA, 64 nt, Homo Sapiens; identical to SEQ ID NO: 297926

SEQ ID NO: 578584 - RNA, 64 nt, Homo Sapiens; identical to SEQ ID NO: 297927

SEQ ID NO: 578585 - RNA, 64 nt, Homo Sapiens; identical to SEQ ID NO: 297928

SEQ ID NO: 578586 - RNA, 64 nt, Homo Sapiens; identical to SEQ ID NO: 297929

SEQ ID NO: 578587 - RNA, 64 nt, Homo Sapiens; identical to SEQ ID NO: 297930

SEQ ID NO: 578588 - RNA, 64 nt, Homo Sapiens; identical to SEQ ID NO: 297931

SEQ ID NO: 578589 - RNA, 64 nt, Homo Sapiens; identical to SEQ ID NO: 297932

SEQ ID NO: 578590 - RNA, 64 nt, Homo Sapiens; identical to SEQ ID NO: 297933

SEQ ID NO: 578591 - RNA, 64 nt, Homo Sapiens; identical to SEQ ID NO: 297934

SEQ ID NO: 578592 - RNA, 64 nt, Homo Sapiens; identical to SEQ ID NO: 297935

SEQ ID NO: 578593 - RNA, 64 nt, Homo Sapiens; identical to SEQ ID NO: 297936

SEQ ID NO: 578594 - RNA, 64 nt, Homo Sapiens; identical to SEQ ID NO: 297937

SEQ ID NO: 578595 - RNA, 64 nt, Homo Sapiens; identical to SEQ ID NO: 297938

SEQ ID NO: 578596 - RNA, 64 nt, Homo Sapiens; identical to SEQ ID NO: 297939

SEQ ID NO: 578597 - RNA, 64 nt, Homo Sapiens; identical to SEQ ID NO: 297940

SEQ ID NO: 578598 - RNA, 64 nt, Homo Sapiens; identical to SEQ ID NO: 297941

SEQ ID NO: 578599 - RNA, 64 nt, Homo Sapiens; identical to SEQ ID NO: 297942

SEQ ID NO: 578600 - RNA, 64 nt, Homo Sapiens; identical to SEQ ID NO: 297943

SEQ ID NO: 578601 - RNA, 64 nt, Homo Sapiens; identical to SEQ ID NO: 297944

SEQ ID NO: 578602 - RNA, 64 nt, Homo Sapiens
cgccagcugucucagccaccaccugugcggcgcuugcuccgaggggucagcaagagcaacugau

SEQ ID NO: 578603 - RNA, 64 nt, Homo Sapiens
gcccagcuugaccuccccuugguucccaggguccugcuccgaagcagucaucucugccugagau

SEQ ID NO: 578604 - RNA, 64 nt, Homo Sapiens
ucggcuggagcccugaaacccgacguggaccuucugcuccgagaaaugcagcugcucaaaggcc

SEQ ID NO: 578605 - RNA, 64 nt, Homo Sapiens
gagcagcagcacaacuaggaaaccccaaagcccaugcuccgacagguggcccuucacagggggc

SEQ ID NO: 578606 - RNA, 64 nt, Homo Sapiens
gccuaccucccgacauucacgcuucgccccacgcugcuccgacuggcugcagcggacacugccc

SEQ ID NO: 578607 - RNA, 64 nt, Homo Sapiens
ccgccauaauaaaaucugauggaagccacgggacugcuccgaagaauugaacucucagucacgu

SEQ ID NO: 578608 - RNA, 64 nt, Homo Sapiens
ccagccccugagcagggagacuccucccaucccuugcuccgaucccuuccccaagccacacauc

SEQ ID NO: 578609 - RNA, 64 nt, Homo Sapiens
cacuuuuaauuuuuuucuuuucuugcaggaauacugcuccgaauauauacaugcgccgggagcu

SEQ ID NO: 578610 - RNA, 64 nt, Homo Sapiens
uauaacucauguauuugaagacuguuucaugcuuugcuccgaacaaauaguaaauaacugagua

SEQ ID NO: 578611 - RNA, 64 nt, Homo Sapiens
agcaccuuccugaaggacgcgccaggggaguuccugcuccgagucuucucuaccgggcgagucu

SEQ ID NO: 578612 - RNA, 64 nt, Homo Sapiens
cucagggcugccucccugagggccugugguucccugcuccgacucccccuggcagggccagcua

SEQ ID NO: 578613 - RNA, 64 nt, Homo Sapiens
uggaaggguggauaugggagacacauucucuaccugcuccgagccugguccucucgcaggaaug

SEQ ID NO: 578614 - RNA, 64 nt, Homo Sapiens
ucuggucuuuuccuguugugcaaaaaugacucauugcuccgaaugucaaaaacaaaugcgacaa

SEQ ID NO: 578615 - RNA, 64 nt, Homo Sapiens
cugguuuaccaguaagguguauuguucaguuuuuugcuccgauuugaauuguggagguggaagc

SEQ ID NO: 578616 - RNA, 64 nt, Homo Sapiens
aucccagaucugucugacucugggucagugacccugcuccgauuccauacuguuuucugucauu

SEQ ID NO: 578617 - RNA, 64 nt, Homo Sapiens
agggggaaaacaguaguucccaaaaaaaaaaaugugcuccgacuuauuugaauggaaagacacc

SEQ ID NO: 578618 - RNA, 64 nt, Homo Sapiens
ggggagacuugucucccuugcccgcaacccuggcugcuccgacaggaccuuccaauccauuugc

SEQ ID NO: 578619 - RNA, 64 nt, Homo Sapiens
cugugugcucaccugguuggaggauucagggcagugcuccgaaggcaguccugagggagaagac

SEQ ID NO: 578620 - RNA, 64 nt, Homo Sapiens
ggaggggcgggcaccagcgccacuuaugugccucugcuccgagggccagugggcugcagggccu

SEQ ID NO: 578621 - RNA, 64 nt, Homo Sapiens
aucacaggagagcaaaaggcggguccaaacauguugcuccgaucauuccugggaagucuucugu

SEQ ID NO: 578622 - RNA, 64 nt, Homo Sapiens
caccugccagcaccgcacaggacgcaggcucagcugcuccgaagcugccuuucccagcuucgga

SEQ ID NO: 578623 - RNA, 64 nt, Homo Sapiens
ggcucauguucaggcagaacaguggcggggccccugcuccgaggggccugaggacccggcgcug

SEQ ID NO: 578624 - RNA, 64 nt, Homo Sapiens
gcgcucggcccucaagugcccgggccggccuucgugcuccgaaacaagagaccugggagcccuc

SEQ ID NO: 578625 - RNA, 64 nt, Homo Sapiens
acucaggaggggagcccugugauuguccagcucaugcuccgaggagggucccagcugcagugug

SEQ ID NO: 578626 - RNA, 64 nt, Homo Sapiens
agaguucaucuuuauauuaacuuuuuaaacucuaugcuccgagucuaggguguuguguagaacu

SEQ ID NO: 578627 - RNA, 64 nt, Homo Sapiens
acuggacuguuuuuuucacacuggggggaacggaugcuccgaggacaaaagggccaggugcggc

SEQ ID NO: 578628 - RNA, 64 nt, Homo Sapiens
ccccacugguaggaugguccucuuguacuucgugugcuccgacccauggugacgaugacacacc

SEQ ID NO: 578629 - RNA, 64 nt, Homo Sapiens
ggaugcaaccugcuuucaccagacugcagaccccugcuccgaggacucuuaguuuuucaaaacc

SEQ ID NO: 578630 - RNA, 64 nt, Homo Sapiens
ccacugcaacgaagacacuccuucuguccccaccugcuccgaagacaaaccaaccuccguuucu

SEQ ID NO: 578631 - RNA, 64 nt, Homo Sapiens
ucagcaugaggacagaccacagagcugucacuuuugcuccgaagcuacuucuccacugucccgu

SEQ ID NO: 578632 - RNA, 64 nt, Homo Sapiens
cucugauuguccuucagcagggaugagucuguuuugcuccgauggaagcaucuguaguguccau

SEQ ID NO: 578633 - RNA, 64 nt, Homo Sapiens
cauaccucagugcagaaccauccuccccguccccugcuccgauggggccacgaagccccucggg

SEQ ID NO: 578634 - RNA, 64 nt, Homo Sapiens
uggagaaugucgggugagguccuuggaaacagauugcuccgagcaaacaccuccuuuccggugg

SEQ ID NO: 578635 - RNA, 64 nt, Homo Sapiens
guggggcgcgugggcacggagcuuccugccucucugcuccgacacccggcaagcagccggagac

SEQ ID NO: 578636 - RNA, 64 nt, Homo Sapiens
uucuuauuagacagagcucauaguauuuguuuucugcuccgaacacuuaaaaaauacuaagacg

SEQ ID NO: 578637 - RNA, 64 nt, Homo Sapiens
caccauccuccucuucuuucuccuucaucgcuggugcuccgacaaaaaaaguaagucucacgaa

SEQ ID NO: 578638 - RNA, 64 nt, Homo Sapiens
gacacaagcuguuucucggaagacccuggacaccugcuccgaagccaagcacgggauggggcuu

SEQ ID NO: 578639 - RNA, 64 nt, Homo Sapiens
uguggguuuugaagacccucgacugccuccccgaugcuccgaagccugaucuuccagggugggg

SEQ ID NO: 578640 - RNA, 64 nt, Homo Sapiens
cuauuugauccauggauaaccgguaaugggaaaaugcuccgacccucaaugcaguaaauauuua

SEQ ID NO: 578641 - RNA, 64 nt, Homo Sapiens
cucccgagggcugcuuggacccuggugggcugagugcuccgaggagggguggacuccaccuugg

SEQ ID NO: 578642 - RNA, 64 nt, Homo Sapiens
ucagacagaggaagcccugcgcccggaaugccagugcuccgagcccccgccuccacuucauccu

SEQ ID NO: 578643 - RNA, 64 nt, Homo Sapiens
ggaacuggcuggcuguccgugugucccacuucacugcuccgaagccccgcaaugcgaggguccu

SEQ ID NO: 578644 - RNA, 64 nt, Homo Sapiens
ucguggacugagugggaagcccauccugaccagcugcuccgaggacccaggaaaggcaggauug

SEQ ID NO: 578645 - RNA, 64 nt, Homo Sapiens
cagcagggaagcuccuccugcccugcacccagcaugcuccgacagcgcccuggaacaacccugc

SEQ ID NO: 578646 - RNA, 64 nt, Homo Sapiens
accuaugugcauaauuaaaaccagcuucauuuguugcuccgagaguguuucuccaagguuuucu

SEQ ID NO: 578647 - RNA, 64 nt, Homo Sapiens
cucucucugggaccacuggguacaagagaugggaugcuccgacagcgucuccaauuaugaaacu

SEQ ID NO: 578648 - RNA, 64 nt, Homo Sapiens
aaaucauuuacaacccuaaggcaucagaggaugcugcuccgaacuguuggaaacaaggacauua

SEQ ID NO: 578649 - RNA, 64 nt, Homo Sapiens
ccuacugccaaacguccucaguguugucugcaccugcuccgacuccuucagccgccccauucag

SEQ ID NO: 578650 - RNA, 64 nt, Homo Sapiens
ccuggccccgggcaaccagccagagaaggagggccgggcgcaccagugccuggagugugaccgc

SEQ ID NO: 578651 - RNA, 64 nt, Homo Sapiens
cacgcagaagagcaacaugaagcugcacaugaagcgggcgcacagcuaugcuggugagaaugcu

SEQ ID NO: 578652 - RNA, 64 nt, Homo Sapiens
guggagaugcugcagauccugcugccgcacuucagcgacgcacgagaggucgugcgcuccuccu

SEQ ID NO: 578653 - RNA, 64 nt, Homo Sapiens
ggcgcugcagccagaggccgcacgcugcacugucgcgacgcagagaggcuucugugcaggcugg

SEQ ID NO: 578654 - RNA, 64 nt, Homo Sapiens
cacgcagggccuugcaccaucaagggugacaccugcgacgcaaguaccaggaggacauaaccgc

SEQ ID NO: 578655 - RNA, 64 nt, Homo Sapiens
uacauacguguugugucuguacagggccugugcugcgacgcacaaugagcguccggucuugccc

SEQ ID NO: 578656 - RNA, 64 nt, Homo Sapiens
ccuggccaucuugccgugucgcagcuucugcugugcgacgcacuccuuaaugcuaaagccaaau

SEQ ID NO: 578657 - RNA, 64 nt, Homo Sapiens
acucaaugcuaaagcaagccguccugggcauugcgcgacgcaggacccagacuuaacaggcaag

SEQ ID NO: 578658 - RNA, 64 nt, Homo Sapiens
aaacuuucugguccgagaacgagccgaacacagcgcgacgcagggacuaggacggcccggugac

SEQ ID NO: 578659 - RNA, 55 nt, Homo Sapiens
gcaagucgcugagccauugaggaucgcgacgcagucggcgggacccucauggaag

SEQ ID NO: 578660 - RNA, 64 nt, Homo Sapiens
ccuuggaggggacaagguugacugcuuaggaggcgcgacgcacagggcugccaggccuggcccc

SEQ ID NO: 578661 - RNA, 64 nt, Homo Sapiens
uguaccucccccugccuuccccagucgcucgacugcgacgcaggggaaacgccggaacccugac

SEQ ID NO: 578662 - RNA, 64 nt, Homo Sapiens
cugcuucaucauuugucaggauggcaggauuucagcgacgcacuacuuuaaggugacaguauug

SEQ ID NO: 578663 - RNA, 64 nt, Homo Sapiens
cgaccccuacaagccuaagugccccgagagcgacgcgacgcagcagaggccggccuucccugag

SEQ ID NO: 578664 - RNA, 64 nt, Homo Sapiens
ucgaggguguccgccggccccggagguguccgaggcgacgcaccugcuggcgccccggcccucg

SEQ ID NO: 578665 - RNA, 64 nt, Homo Sapiens
gccugggagcggggcggggccgccgcgcaagggggcgacgcauaaaggccugcuggcuuggggc

SEQ ID NO: 578666 - RNA, 64 nt, Homo Sapiens
ugugucuuuuguugguguguugagcccggaaccggcgacgcacauuccgggcugcucucuuccc

SEQ ID NO: 578667 - RNA, 64 nt, Homo Sapiens
acccucccccagccagauaccucacuccauccaccucggagaccccaucucuguccccuccacc

SEQ ID NO: 578668 - RNA, 64 nt, Homo Sapiens
uggaggaggacgcucuggaaaccgccgcuggggccucggagacugcgggucucccggugcccga

SEQ ID NO: 578669 - RNA, 64 nt, Homo Sapiens
agcccagggcacagcgcucgcuagcggccugccgccacgucagccaggagguggccgacugcug

SEQ ID NO: 578670 - RNA, 64 nt, Homo Sapiens
gucccggcacacgcugcugugaugauccugcggaccacgucaagaggcugaggccugcacugca

SEQ ID NO: 578671 - RNA, 64 nt, Homo Sapiens; identical to SEQ ID NO: 126132

SEQ ID NO: 578672 - RNA, 64 nt, Homo Sapiens; identical to SEQ ID NO: 126133

SEQ ID NO: 578673 - RNA, 64 nt, Homo Sapiens; identical to SEQ ID NO: 126134

SEQ ID NO: 578674 - RNA, 64 nt, Homo Sapiens; identical to SEQ ID NO: 126135

SEQ ID NO: 578675 - RNA, 64 nt, Homo Sapiens; identical to SEQ ID NO: 126136

SEQ ID NO: 578676 - RNA, 64 nt, Homo Sapiens; identical to SEQ ID NO: 126137

SEQ ID NO: 578677 - RNA, 64 nt, Homo Sapiens; identical to SEQ ID NO: 126138

SEQ ID NO: 578678 - RNA, 64 nt, Homo Sapiens; identical to SEQ ID NO: 126139

SEQ ID NO: 578679 - RNA, 64 nt, Homo Sapiens; identical to SEQ ID NO: 126140

SEQ ID NO: 578680 - RNA, 64 nt, Homo Sapiens; identical to SEQ ID NO: 126141

SEQ ID NO: 578681 - RNA, 64 nt, Homo Sapiens; identical to SEQ ID NO: 126142

SEQ ID NO: 578682 - RNA, 64 nt, Homo Sapiens; identical to SEQ ID NO: 126143

SEQ ID NO: 578683 - RNA, 64 nt, Homo Sapiens; identical to SEQ ID NO: 126144

SEQ ID NO: 578684 - RNA, 64 nt, Homo Sapiens; identical to SEQ ID NO: 126145

SEQ ID NO: 578685 - RNA, 64 nt, Homo Sapiens; identical to SEQ ID NO: 126146

SEQ ID NO: 578686 - RNA, 64 nt, Homo Sapiens; identical to SEQ ID NO: 126147

SEQ ID NO: 578687 - RNA, 64 nt, Homo Sapiens; identical to SEQ ID NO: 126148

SEQ ID NO: 578688 - RNA, 64 nt, Homo Sapiens; identical to SEQ ID NO: 126149

SEQ ID NO: 578689 - RNA, 64 nt, Homo Sapiens; identical to SEQ ID NO: 126150

SEQ ID NO: 578690 - RNA, 64 nt, Homo Sapiens; identical to SEQ ID NO: 126151

SEQ ID NO: 578691 - RNA, 64 nt, Homo Sapiens; identical to SEQ ID NO: 126152

SEQ ID NO: 578692 - RNA, 64 nt, Homo Sapiens; identical to SEQ ID NO: 126153

SEQ ID NO: 578693 - RNA, 64 nt, Homo Sapiens; identical to SEQ ID NO: 259970

SEQ ID NO: 578694 - RNA, 64 nt, Homo Sapiens; identical to SEQ ID NO: 259971

SEQ ID NO: 578695 - RNA, 64 nt, Homo Sapiens; identical to SEQ ID NO: 259972

SEQ ID NO: 578696 - RNA, 64 nt, Homo Sapiens; identical to SEQ ID NO: 259973

SEQ ID NO: 578697 - RNA, 64 nt, Homo Sapiens; identical to SEQ ID NO: 259974

SEQ ID NO: 578698 - RNA, 64 nt, Homo Sapiens; identical to SEQ ID NO: 259975

SEQ ID NO: 578699 - RNA, 64 nt, Homo Sapiens; identical to SEQ ID NO: 259976

SEQ ID NO: 578700 - RNA, 64 nt, Homo Sapiens; identical to SEQ ID NO: 259977

SEQ ID NO: 578701 - RNA, 64 nt, Homo Sapiens; identical to SEQ ID NO: 259978

SEQ ID NO: 578702 - RNA, 64 nt, Homo Sapiens; identical to SEQ ID NO: 259979

SEQ ID NO: 578703 - RNA, 64 nt, Homo Sapiens; identical to SEQ ID NO: 259980

SEQ ID NO: 578704 - RNA, 64 nt, Homo Sapiens; identical to SEQ ID NO: 259981

SEQ ID NO: 578705 - RNA, 64 nt, Homo Sapiens; identical to SEQ ID NO: 259982

SEQ ID NO: 578706 - RNA, 64 nt, Homo Sapiens; identical to SEQ ID NO: 259983

SEQ ID NO: 578707 - RNA, 64 nt, Homo Sapiens; identical to SEQ ID NO: 259984

SEQ ID NO: 578708 - RNA, 64 nt, Homo Sapiens; identical to SEQ ID NO: 259985

SEQ ID NO: 578709 - RNA, 64 nt, Homo Sapiens; identical to SEQ ID NO: 259986

SEQ ID NO: 578710 - RNA, 64 nt, Homo Sapiens; identical to SEQ ID NO: 259987

SEQ ID NO: 578711 - RNA, 64 nt, Homo Sapiens; identical to SEQ ID NO: 259988

SEQ ID NO: 578712 - RNA, 64 nt, Homo Sapiens; identical to SEQ ID NO: 259989

SEQ ID NO: 578713 - RNA, 64 nt, Homo Sapiens; identical to SEQ ID NO: 259990

SEQ ID NO: 578714 - RNA, 64 nt, Homo Sapiens; identical to SEQ ID NO: 259991

SEQ ID NO: 578715 - RNA, 64 nt, Homo Sapiens; identical to SEQ ID NO: 259992

SEQ ID NO: 578716 - RNA, 64 nt, Homo Sapiens; identical to SEQ ID NO: 259993

SEQ ID NO: 578717 - RNA, 64 nt, Homo Sapiens; identical to SEQ ID NO: 259994

SEQ ID NO: 578718 - RNA, 64 nt, Homo Sapiens; identical to SEQ ID NO: 259995

SEQ ID NO: 578719 - RNA, 64 nt, Homo Sapiens; identical to SEQ ID NO: 259996

SEQ ID NO: 578720 - RNA, 64 nt, Homo Sapiens; identical to SEQ ID NO: 259997

SEQ ID NO: 578721 - RNA, 64 nt, Homo Sapiens; identical to SEQ ID NO: 259998

SEQ ID NO: 578722 - RNA, 64 nt, Homo Sapiens
aaaauggcuaaagaaauuauauuuuguucuauugcuaggguaaaauaaauacauuuguguccaa

SEQ ID NO: 578723 - RNA, 64 nt, Homo Sapiens
cagcuaauuauugugguguacuauauuugugagccuaggguaggggcacugcugcaacuucugc

SEQ ID NO: 578724 - RNA, 64 nt, Homo Sapiens
ccucccacccuaggagggagggaaggacaccguccuaggguauaaccuggcaauaaaccgugcc

SEQ ID NO: 578725 - RNA, 64 nt, Homo Sapiens
ggccagaaacaccugacuuaccucugaguuuagacuaggguaucacuucuuugagucugaaguc

SEQ ID NO: 578726 - RNA, 64 nt, Homo Sapiens
cucuuaaaauugagacggggucucacucugucaccuaggguagagugcaguggugccaccauag

SEQ ID NO: 578727 - RNA, 64 nt, Homo Sapiens
acccucaccgcugcguccagucagagagcagggacuaggguaggaggugaugucuucucucugc

SEQ ID NO: 578728 - RNA, 64 nt, Homo Sapiens
gggugcugcccagcaggucgacugauaaggggcccuaggguacagggcagcagaucaggagccc

SEQ ID NO: 578729 - RNA, 64 nt, Homo Sapiens
ggaaauccaaucagagaccaauccagccucacuucuaggguauguagcgcucaauaggaccagg

SEQ ID NO: 578730 - RNA, 64 nt, Homo Sapiens
uuccaguuuauccagacuagcuuggguauaaauucuaggguaaauugcagggguguuuuuaaau

SEQ ID NO: 578731 - RNA, 64 nt, Homo Sapiens
cugacuucucacuuccuaagagcacccuagaggacuaggguaaucacgggacuaguuagcuuua

SEQ ID NO: 578732 - RNA, 64 nt, Homo Sapiens
augaaggccaagagcaucucauuugggugugggacuaggguacaggagauaauuguuuuauggg

SEQ ID NO: 578733 - RNA, 64 nt, Homo Sapiens
uauucuuucucccauccuuauaauaugugggucacuaggguauuucucuugucuguggucuguu

SEQ ID NO: 578734 - RNA, 64 nt, Homo Sapiens
uaaggggugcauuuguagggugugacauuuuacccuaggguauaaaacuauuuuucuuuuauua

SEQ ID NO: 578735 - RNA, 64 nt, Homo Sapiens
uguagcauucaaggcuugaggcuggaggagguagcuaggguauaguggcuggugaggcugcaca

SEQ ID NO: 578736 - RNA, 64 nt, Homo Sapiens
ugcagcucuuuaagaaguuuuuuuuuuuuagcuucuaggguaaagauaaauucagaaaugcucu

SEQ ID NO: 578737 - RNA, 64 nt, Homo Sapiens
aucuuuauguaucuauuaugcauucucuguacuucuaggguagccaggcauucacagauaaacu

SEQ ID NO: 578738 - RNA, 64 nt, Homo Sapiens
uugcagaauguggagggauguaaaauggacaguacuaggguagaggggaagucagauuagagga

SEQ ID NO: 578739 - RNA, 64 nt, Homo Sapiens
ucccucugucagggucaguaaggaaaacgguggccuaggguacaggcaacaaugagcagaccaa

SEQ ID NO: 578740 - RNA, 64 nt, Homo Sapiens
aguaaguucucaauuauuggccugcuaauagcugcuaggguaggaaagcgugguuccaagaaag

SEQ ID NO: 578741 - RNA, 64 nt, Homo Sapiens
uggcagaauucaugcagggcuaucaagugguguucuaggguaacaguguccauaauuaacgcuu

SEQ ID NO: 578742 - RNA, 64 nt, Homo Sapiens
cccauaccucccuggcuccucaggauucagguuccuaggguacguccuugauuaaaucacccca

SEQ ID NO: 578743 - RNA, 64 nt, Homo Sapiens
accaguccaugcuguuuuuaguuguaguuugauucuaggguagagaaugaacacuuuggauuuu

SEQ ID NO: 578744 - RNA, 64 nt, Homo Sapiens
uacccccaaugagucuagccggaaaguuaggagucuaggguaauuuaguuuccucaacuagccu

SEQ ID NO: 578745 - RNA, 64 nt, Homo Sapiens
uacaaauuaaaacugagacaaauauaaaccucaucuaggguauauuaauauuuuauucucauuu

SEQ ID NO: 578746 - RNA, 64 nt, Homo Sapiens
uuuacacauacauacacacacaaauacacaaucucuaggguaagccagaaggcaagaucagauu

SEQ ID NO: 578747 - RNA, 64 nt, Homo Sapiens
aucuguucuuccucuacguuuauccuggcaugugcuaggguaaacgaaggcauaauaagccaug

SEQ ID NO: 578748 - RNA, 64 nt, Homo Sapiens
gaauccuguaaguucaaauuaguaggugcggugucuaggguagucauuuuuaaguuguguuguc

SEQ ID NO: 578749 - RNA, 64 nt, Homo Sapiens
guaaaggauagacucacauucccugggguaaaagcuaggguaagcuaauaaaaauguaccaaau

SEQ ID NO: 578750 - RNA, 64 nt, Homo Sapiens
cuguaauuuggcuccuuaccuuguauuccacauucuaggguauuuuuauuuugucucugagauu

SEQ ID NO: 578751 - RNA, 64 nt, Homo Sapiens
gaugggcuguguagcaacucucccagggaacacacuaggguacuuagggaggugcuuuguggag

SEQ ID NO: 578752 - RNA, 64 nt, Homo Sapiens
guggaucaacugaacugucauucuaggcugaauccuaggguaaggagucaugcuguggaacuua

SEQ ID NO: 578753 - RNA, 64 nt, Homo Sapiens
uuagagcaacuuaaugaggggagagaaguauauacuaggguacucaucagaaaagcaggcccua

SEQ ID NO: 578754 - RNA, 64 nt, Homo Sapiens
ggggugcauuugguuuucaacaccuccacacugacuaggguaguuuuuaaaagucaauugguau

SEQ ID NO: 578755 - RNA, 64 nt, Homo Sapiens
uugcgggguauuaagcaggaucaggggaacuauucuaggguaugccguucucaagggagucaga

SEQ ID NO: 578756 - RNA, 64 nt, Homo Sapiens
gugucgccaguugguacuuucuguuuggguaguccuaggguaacacccugcccuaaacuccaug

SEQ ID NO: 578757 - RNA, 64 nt, Homo Sapiens
acuuuugugucacaauuuauuuuuaucacccucucuaggguaacguguauauuuugguggagau

SEQ ID NO: 578758 - RNA, 64 nt, Homo Sapiens
uuuuccagcacuuugcaaggaauguuuuguagcucuaggguauauauccgccuggcauuucaca

SEQ ID NO: 578759 - RNA, 64 nt, Homo Sapiens
ccagacaccccuuagaugucagaccuguugguugcuaggguagugggcuauagaucucaaauag

SEQ ID NO: 578760 - RNA, 64 nt, Homo Sapiens
caucuuuacuucugguuccucacaucaccugagacuaggguaauuuaaagugacuuuuaaaggc

SEQ ID NO: 578761 - RNA, 64 nt, Homo Sapiens
auuuuguaggucacucuucugccuuggacugcuucuaggguagcagauggaaauucuuuuuugg

SEQ ID NO: 578762 - RNA, 64 nt, Homo Sapiens
ggauagcugcaacaaugaaaacaacauaaauuaccuaggguaaagagaaccucuaaugauacug

SEQ ID NO: 578763 - RNA, 64 nt, Homo Sapiens
ugugaucauuuauugaucgugauaugacuuguuacuaggguacugaaaaaaaugucuaaggccu

SEQ ID NO: 578764 - RNA, 64 nt, Homo Sapiens
aguagcugccaauuuguaauuggagcucuuuucacuaggguauaauaaagugagaguaauguaa

SEQ ID NO: 578765 - RNA, 64 nt, Homo Sapiens
ucaagggaaguaccuaagaagauauagaguguuucuaggguaagggaccugcagguguaagcau

SEQ ID NO: 578766 - RNA, 64 nt, Homo Sapiens
ugcuauuauucauaagaacugugauuccagcaaacuaggguaauuggugccuuuuuacaguuuu

SEQ ID NO: 578767 - RNA, 64 nt, Homo Sapiens
uuggggaaacuccuccucuuaggaaaggcuaauacuaggguauccuugggcccaaugaauuagg

SEQ ID NO: 578768 - RNA, 64 nt, Homo Sapiens
cuugcucuagcauacuuuaauugacauagguucccuaggguacaggaguaagacaaaaauuguu

SEQ ID NO: 578769 - RNA, 64 nt, Homo Sapiens
uucuggcaaacuacccuuuuacuaaugaacucuucuaggguaaacugcuuauauuguuaauugc

SEQ ID NO: 578770 - RNA, 64 nt, Homo Sapiens
guggauauugaaaugaagcauggaaaucagaacacuaggguaaacauggauaugacaaccaaac

SEQ ID NO: 578771 - RNA, 64 nt, Homo Sapiens
gaggacuuagggauguuuccauuaacuugcacuacuaggguagggacauugccagaaacuuacc

SEQ ID NO: 578772 - RNA, 64 nt, Homo Sapiens
uccuaccuguggcucaugccaugccaugaagugccuaggguacauaugugaacauuccagccuu

SEQ ID NO: 578773 - RNA, 64 nt, Homo Sapiens
uuucccuguauagccugcugggagagacccacuucuaggguaugggggaugcagcuucaagccc

SEQ ID NO: 578774 - RNA, 64 nt, Homo Sapiens
aagauuagaaggaacaguggugcugacacaggaccuaggguagggccuguucccaccacccuag

SEQ ID NO: 578775 - RNA, 64 nt, Homo Sapiens
uggugcugggagaggcagccgacuuggccucucucuaggguacaggccccaggggaacacuggg

SEQ ID NO: 578776 - RNA, 64 nt, Homo Sapiens
agaacacuuuucuuggcuacuuccauuuuacugacuaggguagaugagauaucauguuuuagca

SEQ ID NO: 578777 - RNA, 64 nt, Homo Sapiens
guccugacuucaccuuuuugauuuggugugugcccuaggguauguacccuuccccaucugagcc

SEQ ID NO: 578778 - RNA, 64 nt, Homo Sapiens
ccugucuuggguuggcuggcacuggggcgggcaucuaggguacagccucugcucauggcacugg

SEQ ID NO: 578779 - RNA, 64 nt, Homo Sapiens
cugggguagcuccugccugcucucccugcguugccuaggguaaagccuccagauuugccauacu

SEQ ID NO: 578780 - RNA, 64 nt, Homo Sapiens
ccuuucaggcauuucagcagcauacauugacaaucuaggguauauauguauguauguuucuuau

SEQ ID NO: 578781 - RNA, 64 nt, Homo Sapiens
ggaaaggcuuaaugauggaauguuagcaucuucacuaggguaaagaagaacaaaaagaauguug

SEQ ID NO: 578782 - RNA, 64 nt, Homo Sapiens
aauguaaacaguaguaguagcugccaccacaucucuaggguagccaugcagaggagggcuucau

SEQ ID NO: 578783 - RNA, 64 nt, Homo Sapiens
gccuguuguuuucgcugugacuugggucucagugcuaggguauugagucaggcagcuggagggu

SEQ ID NO: 578784 - RNA, 64 nt, Homo Sapiens
gccguaggaaaaauaaaacuaugaaauaauuuuucuaggguaauucuuuuuguucauuggcaag

SEQ ID NO: 578785 - RNA, 64 nt, Homo Sapiens
gaauaaaucuagucuuacuaaaucaaaacuuuuacuaggguauuuuauacuguuggauacuuau

SEQ ID NO: 578786 - RNA, 64 nt, Homo Sapiens
cauucuuaacauguauuuccugucuagcacuuaacuaggguaagguuuuucuaaaggggggcgc

SEQ ID NO: 578787 - RNA, 64 nt, Homo Sapiens
auguguggugcccagaauaaaauauaccucaugccuaggguagggacauccuuuccagcucaaa

SEQ ID NO: 578788 - RNA, 64 nt, Homo Sapiens
uaaugucgaaacuaggccuuugaaccaaggcagucuaggguaaaauauaguuucaaaguaugaa

SEQ ID NO: 578789 - RNA, 64 nt, Homo Sapiens
accacuagugccucuggauuuagagauauauauccuaggguaugauacuacugugacgggucua

SEQ ID NO: 578790 - RNA, 64 nt, Homo Sapiens
uuacagacaggucccaccaaacccaaacaccugccuaggguaaaugggucucucuucuaucccc

SEQ ID NO: 578791 - RNA, 64 nt, Homo Sapiens
ucuguuuucugccuguauuucccagugauuuacucuaggguaagguaguacacauuugguucag

SEQ ID NO: 578792 - RNA, 64 nt, Homo Sapiens
gguagcuguaacccuuaaaaaugaaacgucaacucuaggguacauuugacauugaaagaauagu

SEQ ID NO: 578793 - RNA, 64 nt, Homo Sapiens
aacagcuauuacuaaucucuaugugaaacaacuucuaggguaaauggaaauuuugcaaaauguu

SEQ ID NO: 578794 - RNA, 64 nt, Homo Sapiens
uucaagagcuacaugccucugugaaguaugguuacuaggguaggguggacuuuuaauguaucuu

SEQ ID NO: 578795 - RNA, 64 nt, Homo Sapiens
gcugggaguguagaaguggccugcucugcagggccuaggguagcuccgaguagugucugagacu

SEQ ID NO: 578796 - RNA, 64 nt, Homo Sapiens
auauaauuuuuuuccaaaaagggauaguuaggagcuaggguagaaaagccuuuggguuuauuuu

SEQ ID NO: 578797 - RNA, 64 nt, Homo Sapiens
ucccacgggacucagaagugcgccgccaugcugccuaggguacuguccccacaucugucccaac

SEQ ID NO: 578798 - RNA, 64 nt, Homo Sapiens
cagcuuguggcuuuuuauuagagcucgccacgaacuaggguaaggugagugucuuagcauauuu

SEQ ID NO: 578799 - RNA, 64 nt, Homo Sapiens
ggcaaggaaacucgaauaaacgucagggucggggcuaggguaggagccgcaccuagcuggccaa

SEQ ID NO: 578800 - RNA, 64 nt, Homo Sapiens
cucccaugucaugaaguuacugucauuaauacaucuaggguaccucugcuucugucaagagggu

SEQ ID NO: 578801 - RNA, 64 nt, Homo Sapiens
uggcuguggacuuuucugcagagcuggcuuuacucuaggguaaguaggaagcuggcugcuuaau

SEQ ID NO: 578802 - RNA, 64 nt, Homo Sapiens
gagagguugcuauaaaacgagugaauuuggagaacuaggguagacaaaccugaggaaggcagaa

SEQ ID NO: 578803 - RNA, 64 nt, Homo Sapiens
aaucucccaaagaugguuugggcaccuauagaaacuaggguacaaguuacuuccuggcugggac

SEQ ID NO: 578804 - RNA, 64 nt, Homo Sapiens
gucccugccccuucuuccugcucccccuccuagccuaggguagacuuugaacuguguguguuga

SEQ ID NO: 578805 - RNA, 64 nt, Homo Sapiens
gcuuucucagauuucccuccacgcgucacagaaucuaggguagcuauacagauauauauauaug

SEQ ID NO: 578806 - RNA, 64 nt, Homo Sapiens
acaaguauuugcuaaacacuaacuuaagcuaaugcuaggguagugacugagauguaaaaauaga

SEQ ID NO: 578807 - RNA, 64 nt, Homo Sapiens
cugugugcugcgggaggcagacugcacagcuguccuaggguaacucacucugcagcccuugaac

SEQ ID NO: 578808 - RNA, 64 nt, Homo Sapiens
gacccuggccuaggggucuuagccacuccccacccuaggguauaguucagggguauccaauccu

SEQ ID NO: 578809 - RNA, 64 nt, Homo Sapiens
ggagacugagccggcaguggcuugcuuggaggggcuaggguacccgccuggucucggcuggcuc

SEQ ID NO: 578810 - RNA, 64 nt, Homo Sapiens
gugccacugacuuacauagcccuucaccauuuuucuaggguauaccauucuccuaaggacuuuc

SEQ ID NO: 578811 - RNA, 64 nt, Homo Sapiens
uuaauuuuaaaauaggccaagggguuuucacuuccuaggguagugggcaaaccaggcugcaggu

SEQ ID NO: 578812 - RNA, 64 nt, Homo Sapiens
guuuuguagaaucaguccuugauuaugccaucaccuaggguaaucaguagcugcacaguuuuaa

SEQ ID NO: 578813 - RNA, 64 nt, Homo Sapiens
gccagauuuggaaaccauagagguuaccacaugacuaggguacaggaaucuugaaugcuuauaa

SEQ ID NO: 578814 - RNA, 64 nt, Homo Sapiens
ucaaaaauaugaugugagcucagucaauuauugccuaggguaguuuaucuacaguacugugaga

SEQ ID NO: 578815 - RNA, 64 nt, Homo Sapiens; identical to SEQ ID NO: 84602

SEQ ID NO: 578816 - RNA, 64 nt, Homo Sapiens; identical to SEQ ID NO: 84603

SEQ ID NO: 578817 - RNA, 64 nt, Homo Sapiens; identical to SEQ ID NO: 84604

SEQ ID NO: 578818 - RNA, 64 nt, Homo Sapiens; identical to SEQ ID NO: 84605

SEQ ID NO: 578819 - RNA, 64 nt, Homo Sapiens; identical to SEQ ID NO: 84606

SEQ ID NO: 578820 - RNA, 64 nt, Homo Sapiens; identical to SEQ ID NO: 84607

SEQ ID NO: 578821 - RNA, 64 nt, Homo Sapiens; identical to SEQ ID NO: 84608

SEQ ID NO: 578822 - RNA, 64 nt, Homo Sapiens; identical to SEQ ID NO: 84609

SEQ ID NO: 578823 - RNA, 64 nt, Homo Sapiens; identical to SEQ ID NO: 84610

SEQ ID NO: 578824 - RNA, 64 nt, Homo Sapiens; identical to SEQ ID NO: 84611

SEQ ID NO: 578825 - RNA, 64 nt, Homo Sapiens; identical to SEQ ID NO: 84612

SEQ ID NO: 578826 - RNA, 64 nt, Homo Sapiens; identical to SEQ ID NO: 84613

SEQ ID NO: 578827 - RNA, 64 nt, Homo Sapiens; identical to SEQ ID NO: 84614

SEQ ID NO: 578828 - RNA, 64 nt, Homo Sapiens; identical to SEQ ID NO: 84615

SEQ ID NO: 578829 - RNA, 64 nt, Homo Sapiens; identical to SEQ ID NO: 84616

SEQ ID NO: 578830 - RNA, 64 nt, Homo Sapiens; identical to SEQ ID NO: 84617

SEQ ID NO: 578831 - RNA, 64 nt, Homo Sapiens; identical to SEQ ID NO: 84618

SEQ ID NO: 578832 - RNA, 64 nt, Homo Sapiens; identical to SEQ ID NO: 84619

SEQ ID NO: 578833 - RNA, 64 nt, Homo Sapiens; identical to SEQ ID NO: 84620

SEQ ID NO: 578834 - RNA, 64 nt, Homo Sapiens; identical to SEQ ID NO: 84621

SEQ ID NO: 578835 - RNA, 64 nt, Homo Sapiens; identical to SEQ ID NO: 84622

SEQ ID NO: 578836 - RNA, 64 nt, Homo Sapiens; identical to SEQ ID NO: 84623

SEQ ID NO: 578837 - RNA, 64 nt, Homo Sapiens; identical to SEQ ID NO: 84624

SEQ ID NO: 578838 - RNA, 64 nt, Homo Sapiens; identical to SEQ ID NO: 84625

SEQ ID NO: 578839 - RNA, 64 nt, Homo Sapiens; identical to SEQ ID NO: 84626

SEQ ID NO: 578840 - RNA, 64 nt, Homo Sapiens; identical to SEQ ID NO: 84627

SEQ ID NO: 578841 - RNA, 64 nt, Homo Sapiens; identical to SEQ ID NO: 84628

SEQ ID NO: 578842 - RNA, 64 nt, Homo Sapiens; identical to SEQ ID NO: 84629

SEQ ID NO: 578843 - RNA, 64 nt, Homo Sapiens; identical to SEQ ID NO: 84630

SEQ ID NO: 578844 - RNA, 64 nt, Homo Sapiens; identical to SEQ ID NO: 84631

SEQ ID NO: 578845 - RNA, 64 nt, Homo Sapiens
cagcuucuuccaaagauaacauuccagaguucuugcccuuaaccucacaaaaucuuaccaaaau

SEQ ID NO: 578846 - RNA, 64 nt, Homo Sapiens
uaucugcaaagaagaguaaucuugccagauguaggcccuuaagauagucauuuugggaaagccu

SEQ ID NO: 578847 - RNA, 64 nt, Homo Sapiens; identical to SEQ ID NO: 182067

SEQ ID NO: 578848 - RNA, 64 nt, Homo Sapiens; identical to SEQ ID NO: 182068

SEQ ID NO: 578849 - RNA, 64 nt, Homo Sapiens; identical to SEQ ID NO: 182069

SEQ ID NO: 578850 - RNA, 64 nt, Homo Sapiens; identical to SEQ ID NO: 182070

SEQ ID NO: 578851 - RNA, 64 nt, Homo Sapiens; identical to SEQ ID NO: 182071

SEQ ID NO: 578852 - RNA, 64 nt, Homo Sapiens; identical to SEQ ID NO: 182072

SEQ ID NO: 578853 - RNA, 64 nt, Homo Sapiens; identical to SEQ ID NO: 182073

SEQ ID NO: 578854 - RNA, 64 nt, Homo Sapiens; identical to SEQ ID NO: 182074

SEQ ID NO: 578855 - RNA, 64 nt, Homo Sapiens; identical to SEQ ID NO: 182075

SEQ ID NO: 578856 - RNA, 64 nt, Homo Sapiens; identical to SEQ ID NO: 182076

SEQ ID NO: 578857 - RNA, 64 nt, Homo Sapiens; identical to SEQ ID NO: 182077

SEQ ID NO: 578858 - RNA, 64 nt, Homo Sapiens; identical to SEQ ID NO: 182078

SEQ ID NO: 578859 - RNA, 64 nt, Homo Sapiens; identical to SEQ ID NO: 182079

SEQ ID NO: 578860 - RNA, 64 nt, Homo Sapiens; identical to SEQ ID NO: 182080

SEQ ID NO: 578861 - RNA, 64 nt, Homo Sapiens; identical to SEQ ID NO: 182081

SEQ ID NO: 578862 - RNA, 64 nt, Homo Sapiens; identical to SEQ ID NO: 182082

SEQ ID NO: 578863 - RNA, 64 nt, Homo Sapiens; identical to SEQ ID NO: 182083

SEQ ID NO: 578864 - RNA, 64 nt, Homo Sapiens; identical to SEQ ID NO: 182084

SEQ ID NO: 578865 - RNA, 64 nt, Homo Sapiens; identical to SEQ ID NO: 182085

SEQ ID NO: 578866 - RNA, 64 nt, Homo Sapiens; identical to SEQ ID NO: 182086

SEQ ID NO: 578867 - RNA, 64 nt, Homo Sapiens; identical to SEQ ID NO: 182087

SEQ ID NO: 578868 - RNA, 64 nt, Homo Sapiens; identical to SEQ ID NO: 182088

SEQ ID NO: 578869 - RNA, 64 nt, Homo Sapiens; identical to SEQ ID NO: 182089

SEQ ID NO: 578870 - RNA, 64 nt, Homo Sapiens; identical to SEQ ID NO: 182090

SEQ ID NO: 578871 - RNA, 64 nt, Homo Sapiens; identical to SEQ ID NO: 182091

SEQ ID NO: 578872 - RNA, 64 nt, Homo Sapiens; identical to SEQ ID NO: 182092

SEQ ID NO: 578873 - RNA, 64 nt, Homo Sapiens; identical to SEQ ID NO: 182093

SEQ ID NO: 578874 - RNA, 64 nt, Homo Sapiens; identical to SEQ ID NO: 182094

SEQ ID NO: 578875 - RNA, 64 nt, Homo Sapiens; identical to SEQ ID NO: 182095

SEQ ID NO: 578876 - RNA, 64 nt, Homo Sapiens; identical to SEQ ID NO: 182096

SEQ ID NO: 578877 - RNA, 64 nt, Homo Sapiens; identical to SEQ ID NO: 182097

SEQ ID NO: 578878 - RNA, 64 nt, Homo Sapiens; identical to SEQ ID NO: 182098

SEQ ID NO: 578879 - RNA, 64 nt, Homo Sapiens; identical to SEQ ID NO: 206137

SEQ ID NO: 578880 - RNA, 64 nt, Homo Sapiens; identical to SEQ ID NO: 206138

SEQ ID NO: 578881 - RNA, 64 nt, Homo Sapiens; identical to SEQ ID NO: 206139

SEQ ID NO: 578882 - RNA, 64 nt, Homo Sapiens; identical to SEQ ID NO: 206140

SEQ ID NO: 578883 - RNA, 64 nt, Homo Sapiens; identical to SEQ ID NO: 206141

SEQ ID NO: 578884 - RNA, 64 nt, Homo Sapiens; identical to SEQ ID NO: 206142

SEQ ID NO: 578885 - RNA, 64 nt, Homo Sapiens; identical to SEQ ID NO: 206143

SEQ ID NO: 578886 - RNA, 64 nt, Homo Sapiens; identical to SEQ ID NO: 206144

SEQ ID NO: 578887 - RNA, 64 nt, Homo Sapiens; identical to SEQ ID NO: 206145

SEQ ID NO: 578888 - RNA, 64 nt, Homo Sapiens; identical to SEQ ID NO: 206146

SEQ ID NO: 578889 - RNA, 64 nt, Homo Sapiens; identical to SEQ ID NO: 206147

SEQ ID NO: 578890 - RNA, 64 nt, Homo Sapiens; identical to SEQ ID NO: 206148

SEQ ID NO: 578891 - RNA, 64 nt, Homo Sapiens; identical to SEQ ID NO: 206149

SEQ ID NO: 578892 - RNA, 64 nt, Homo Sapiens; identical to SEQ ID NO: 206150

SEQ ID NO: 578893 - RNA, 64 nt, Homo Sapiens; identical to SEQ ID NO: 73390

SEQ ID NO: 578894 - RNA, 64 nt, Homo Sapiens; identical to SEQ ID NO: 73391

SEQ ID NO: 578895 - RNA, 64 nt, Homo Sapiens; identical to SEQ ID NO: 73392

SEQ ID NO: 578896 - RNA, 64 nt, Homo Sapiens; identical to SEQ ID NO: 73393

SEQ ID NO: 578897 - RNA, 64 nt, Homo Sapiens; identical to SEQ ID NO: 73394

SEQ ID NO: 578898 - RNA, 64 nt, Homo Sapiens; identical to SEQ ID NO: 73395

SEQ ID NO: 578899 - RNA, 64 nt, Homo Sapiens; identical to SEQ ID NO: 73396

SEQ ID NO: 578900 - RNA, 64 nt, Homo Sapiens; identical to SEQ ID NO: 73397

SEQ ID NO: 578901 - RNA, 64 nt, Homo Sapiens; identical to SEQ ID NO: 73398

SEQ ID NO: 578902 - RNA, 64 nt, Homo Sapiens; identical to SEQ ID NO: 73399

SEQ ID NO: 578903 - RNA, 64 nt, Homo Sapiens; identical to SEQ ID NO: 73400

SEQ ID NO: 578904 - RNA, 64 nt, Homo Sapiens; identical to SEQ ID NO: 73401

SEQ ID NO: 578905 - RNA, 64 nt, Homo Sapiens; identical to SEQ ID NO: 73402

SEQ ID NO: 578906 - RNA, 64 nt, Homo Sapiens; identical to SEQ ID NO: 73403

SEQ ID NO: 578907 - RNA, 64 nt, Homo Sapiens; identical to SEQ ID NO: 73404

SEQ ID NO: 578908 - RNA, 64 nt, Homo Sapiens; identical to SEQ ID NO: 73405

SEQ ID NO: 578909 - RNA, 64 nt, Homo Sapiens; identical to SEQ ID NO: 73406

SEQ ID NO: 578910 - RNA, 64 nt, Homo Sapiens; identical to SEQ ID NO: 73407

SEQ ID NO: 578911 - RNA, 64 nt, Homo Sapiens; identical to SEQ ID NO: 73408

SEQ ID NO: 578912 - RNA, 64 nt, Homo Sapiens; identical to SEQ ID NO: 73409

SEQ ID NO: 578913 - RNA, 64 nt, Homo Sapiens; identical to SEQ ID NO: 354645

SEQ ID NO: 578914 - RNA, 64 nt, Homo Sapiens; identical to SEQ ID NO: 354646

SEQ ID NO: 578915 - RNA, 64 nt, Homo Sapiens; identical to SEQ ID NO: 354647

SEQ ID NO: 578916 - RNA, 64 nt, Homo Sapiens; identical to SEQ ID NO: 354648

SEQ ID NO: 578917 - RNA, 64 nt, Homo Sapiens; identical to SEQ ID NO: 354649

SEQ ID NO: 578918 - RNA, 64 nt, Homo Sapiens; identical to SEQ ID NO: 354650

SEQ ID NO: 578919 - RNA, 64 nt, Homo Sapiens; identical to SEQ ID NO: 354651

SEQ ID NO: 578920 - RNA, 64 nt, Homo Sapiens; identical to SEQ ID NO: 354652

SEQ ID NO: 578921 - RNA, 64 nt, Homo Sapiens; identical to SEQ ID NO: 354653

SEQ ID NO: 578922 - RNA, 64 nt, Homo Sapiens; identical to SEQ ID NO: 354654

SEQ ID NO: 578923 - RNA, 64 nt, Homo Sapiens; identical to SEQ ID NO: 354655

SEQ ID NO: 578924 - RNA, 64 nt, Homo Sapiens; identical to SEQ ID NO: 354656

SEQ ID NO: 578925 - RNA, 64 nt, Homo Sapiens; identical to SEQ ID NO: 354657

SEQ ID NO: 578926 - RNA, 64 nt, Homo Sapiens; identical to SEQ ID NO: 354658

SEQ ID NO: 578927 - RNA, 64 nt, Homo Sapiens; identical to SEQ ID NO: 354659

SEQ ID NO: 578928 - RNA, 64 nt, Homo Sapiens; identical to SEQ ID NO: 354660

SEQ ID NO: 578929 - RNA, 64 nt, Homo Sapiens; identical to SEQ ID NO: 354661

SEQ ID NO: 578930 - RNA, 64 nt, Homo Sapiens; identical to SEQ ID NO: 354662

SEQ ID NO: 578931 - RNA, 64 nt, Homo Sapiens; identical to SEQ ID NO: 354663

SEQ ID NO: 578932 - RNA, 64 nt, Homo Sapiens; identical to SEQ ID NO: 354664

SEQ ID NO: 578933 - RNA, 64 nt, Homo Sapiens; identical to SEQ ID NO: 354665

SEQ ID NO: 578934 - RNA, 64 nt, Homo Sapiens; identical to SEQ ID NO: 354666

SEQ ID NO: 578935 - RNA, 64 nt, Homo Sapiens
ugguggagcuagaaaaaaaaccgcaucuuggcaaguugcagagacuuuguugcagauagucuug

SEQ ID NO: 578936 - RNA, 64 nt, Homo Sapiens
gucuugccgcaucuuggcaaguauauuuuacuuuguugcagauaacugguggaauaaaaaaccu

SEQ ID NO: 578937 - RNA, 64 nt, Homo Sapiens
cauuuuguggucauuaagcaaucuuuuaguuuuaguugcagaaacccaacuccuauaauucccu

SEQ ID NO: 578938 - RNA, 64 nt, Homo Sapiens
caguuugucagacuuuaaagguuucagguguuuaguugcagacuagcacauugaaagagaacca

SEQ ID NO: 578939 - RNA, 64 nt, Homo Sapiens
ucauggucaggugcuggugaggacccugaucuggguugcagacugcugacuucuuauugugucc

SEQ ID NO: 578940 - RNA, 64 nt, Homo Sapiens
aggugaucugcaugccuguuaaagucugagcucuguugcagauaaccagagacccaacaaccaa

SEQ ID NO: 578941 - RNA, 64 nt, Homo Sapiens
uuuuaauaaagauuccauggguugaacaagccacguugcagaaaaagagcuuccccuaaccugg

SEQ ID NO: 578942 - RNA, 64 nt, Homo Sapiens
cguugcagaaaaagagcuuccccuaaccuggguuguugcagaguaaaucccacgacauaagcug

SEQ ID NO: 578943 - RNA, 64 nt, Homo Sapiens; identical to SEQ ID NO: 167088

SEQ ID NO: 578944 - RNA, 64 nt, Homo Sapiens; identical to SEQ ID NO: 167089

SEQ ID NO: 578945 - RNA, 64 nt, Homo Sapiens; identical to SEQ ID NO: 167090

SEQ ID NO: 578946 - RNA, 64 nt, Homo Sapiens; identical to SEQ ID NO: 167091

SEQ ID NO: 578947 - RNA, 64 nt, Homo Sapiens; identical to SEQ ID NO: 167092

SEQ ID NO: 578948 - RNA, 64 nt, Homo Sapiens; identical to SEQ ID NO: 167093

SEQ ID NO: 578949 - RNA, 64 nt, Homo Sapiens; identical to SEQ ID NO: 167094

SEQ ID NO: 578950 - RNA, 64 nt, Homo Sapiens; identical to SEQ ID NO: 167095

SEQ ID NO: 578951 - RNA, 64 nt, Homo Sapiens; identical to SEQ ID NO: 167096

SEQ ID NO: 578952 - RNA, 64 nt, Homo Sapiens; identical to SEQ ID NO: 167097

SEQ ID NO: 578953 - RNA, 64 nt, Homo Sapiens; identical to SEQ ID NO: 167098

SEQ ID NO: 578954 - RNA, 64 nt, Homo Sapiens; identical to SEQ ID NO: 167099

SEQ ID NO: 578955 - RNA, 64 nt, Homo Sapiens; identical to SEQ ID NO: 167100

SEQ ID NO: 578956 - RNA, 64 nt, Homo Sapiens; identical to SEQ ID NO: 167101

SEQ ID NO: 578957 - RNA, 64 nt, Homo Sapiens; identical to SEQ ID NO: 167102

SEQ ID NO: 578958 - RNA, 64 nt, Homo Sapiens; identical to SEQ ID NO: 167103

SEQ ID NO: 578959 - RNA, 64 nt, Homo Sapiens; identical to SEQ ID NO: 167104

SEQ ID NO: 578960 - RNA, 64 nt, Homo Sapiens; identical to SEQ ID NO: 167105

SEQ ID NO: 578961 - RNA, 64 nt, Homo Sapiens; identical to SEQ ID NO: 167106

SEQ ID NO: 578962 - RNA, 64 nt, Homo Sapiens; identical to SEQ ID NO: 167107

SEQ ID NO: 578963 - RNA, 64 nt, Homo Sapiens; identical to SEQ ID NO: 167108

SEQ ID NO: 578964 - RNA, 64 nt, Homo Sapiens; identical to SEQ ID NO: 167109

SEQ ID NO: 578965 - RNA, 64 nt, Homo Sapiens; identical to SEQ ID NO: 167110

SEQ ID NO: 578966 - RNA, 64 nt, Homo Sapiens; identical to SEQ ID NO: 167111

SEQ ID NO: 578967 - RNA, 64 nt, Homo Sapiens; identical to SEQ ID NO: 167112

SEQ ID NO: 578968 - RNA, 64 nt, Homo Sapiens; identical to SEQ ID NO: 167113

SEQ ID NO: 578969 - RNA, 64 nt, Homo Sapiens; identical to SEQ ID NO: 167114

SEQ ID NO: 578970 - RNA, 64 nt, Homo Sapiens; identical to SEQ ID NO: 167115

SEQ ID NO: 578971 - RNA, 64 nt, Homo Sapiens; identical to SEQ ID NO: 167116

SEQ ID NO: 578972 - RNA, 64 nt, Homo Sapiens; identical to SEQ ID NO: 167117

SEQ ID NO: 578973 - RNA, 64 nt, Homo Sapiens; identical to SEQ ID NO: 167118

SEQ ID NO: 578974 - RNA, 64 nt, Homo Sapiens; identical to SEQ ID NO: 167119

SEQ ID NO: 578975 - RNA, 64 nt, Homo Sapiens; identical to SEQ ID NO: 167120

SEQ ID NO: 578976 - RNA, 64 nt, Homo Sapiens; identical to SEQ ID NO: 167121

SEQ ID NO: 578977 - RNA, 64 nt, Homo Sapiens; identical to SEQ ID NO: 167122

SEQ ID NO: 578978 - RNA, 64 nt, Homo Sapiens; identical to SEQ ID NO: 167123

SEQ ID NO: 578979 - RNA, 64 nt, Homo Sapiens; identical to SEQ ID NO: 167124

SEQ ID NO: 578980 - RNA, 64 nt, Homo Sapiens; identical to SEQ ID NO: 167125

SEQ ID NO: 578981 - RNA, 64 nt, Homo Sapiens; identical to SEQ ID NO: 167126

SEQ ID NO: 578982 - RNA, 64 nt, Homo Sapiens; identical to SEQ ID NO: 167127

SEQ ID NO: 578983 - RNA, 64 nt, Homo Sapiens; identical to SEQ ID NO: 167128

SEQ ID NO: 578984 - RNA, 64 nt, Homo Sapiens; identical to SEQ ID NO: 167129

SEQ ID NO: 578985 - RNA, 64 nt, Homo Sapiens; identical to SEQ ID NO: 167130

SEQ ID NO: 578986 - RNA, 64 nt, Homo Sapiens; identical to SEQ ID NO: 167131

SEQ ID NO: 578987 - RNA, 64 nt, Homo Sapiens; identical to SEQ ID NO: 167132

SEQ ID NO: 578988 - RNA, 64 nt, Homo Sapiens; identical to SEQ ID NO: 167133

SEQ ID NO: 578989 - RNA, 64 nt, Homo Sapiens; identical to SEQ ID NO: 167134

SEQ ID NO: 578990 - RNA, 64 nt, Homo Sapiens; identical to SEQ ID NO: 167135

SEQ ID NO: 578991 - RNA, 64 nt, Homo Sapiens; identical to SEQ ID NO: 167136

SEQ ID NO: 578992 - RNA, 64 nt, Homo Sapiens; identical to SEQ ID NO: 167137

SEQ ID NO: 578993 - RNA, 64 nt, Homo Sapiens; identical to SEQ ID NO: 167138

SEQ ID NO: 578994 - RNA, 64 nt, Homo Sapiens; identical to SEQ ID NO: 167139

SEQ ID NO: 578995 - RNA, 64 nt, Homo Sapiens; identical to SEQ ID NO: 167140

SEQ ID NO: 578996 - RNA, 64 nt, Homo Sapiens; identical to SEQ ID NO: 167141

SEQ ID NO: 578997 - RNA, 64 nt, Homo Sapiens; identical to SEQ ID NO: 167142

SEQ ID NO: 578998 - RNA, 64 nt, Homo Sapiens; identical to SEQ ID NO: 167143

SEQ ID NO: 578999 - RNA, 64 nt, Homo Sapiens; identical to SEQ ID NO: 167144

SEQ ID NO: 579000 - RNA, 64 nt, Homo Sapiens; identical to SEQ ID NO: 167145

SEQ ID NO: 579001 - RNA, 64 nt, Homo Sapiens; identical to SEQ ID NO: 167146

SEQ ID NO: 579002 - RNA, 64 nt, Homo Sapiens; identical to SEQ ID NO: 167147

SEQ ID NO: 579003 - RNA, 64 nt, Homo Sapiens; identical to SEQ ID NO: 167148

SEQ ID NO: 579004 - RNA, 64 nt, Homo Sapiens; identical to SEQ ID NO: 167149

SEQ ID NO: 579005 - RNA, 64 nt, Homo Sapiens; identical to SEQ ID NO: 167150

SEQ ID NO: 579006 - RNA, 64 nt, Homo Sapiens; identical to SEQ ID NO: 167151

SEQ ID NO: 579007 - RNA, 64 nt, Homo Sapiens; identical to SEQ ID NO: 167152

SEQ ID NO: 579008 - RNA, 64 nt, Homo Sapiens; identical to SEQ ID NO: 167153

SEQ ID NO: 579009 - RNA, 64 nt, Homo Sapiens; identical to SEQ ID NO: 167154

SEQ ID NO: 579010 - RNA, 64 nt, Homo Sapiens; identical to SEQ ID NO: 167155

SEQ ID NO: 579011 - RNA, 64 nt, Homo Sapiens; identical to SEQ ID NO: 167156

SEQ ID NO: 579012 - RNA, 64 nt, Homo Sapiens; identical to SEQ ID NO: 167157

SEQ ID NO: 579013 - RNA, 64 nt, Homo Sapiens; identical to SEQ ID NO: 167158

SEQ ID NO: 579014 - RNA, 64 nt, Homo Sapiens; identical to SEQ ID NO: 167159

SEQ ID NO: 579015 - RNA, 64 nt, Homo Sapiens; identical to SEQ ID NO: 167160

SEQ ID NO: 579016 - RNA, 64 nt, Homo Sapiens; identical to SEQ ID NO: 167161

SEQ ID NO: 579017 - RNA, 64 nt, Homo Sapiens; identical to SEQ ID NO: 167162

SEQ ID NO: 579018 - RNA, 64 nt, Homo Sapiens; identical to SEQ ID NO: 167163

SEQ ID NO: 579019 - RNA, 64 nt, Homo Sapiens; identical to SEQ ID NO: 167164

SEQ ID NO: 579020 - RNA, 64 nt, Homo Sapiens; identical to SEQ ID NO: 167165

SEQ ID NO: 579021 - RNA, 64 nt, Homo Sapiens; identical to SEQ ID NO: 167166

SEQ ID NO: 579022 - RNA, 64 nt, Homo Sapiens; identical to SEQ ID NO: 167167

SEQ ID NO: 579023 - RNA, 64 nt, Homo Sapiens; identical to SEQ ID NO: 167168

SEQ ID NO: 579024 - RNA, 64 nt, Homo Sapiens; identical to SEQ ID NO: 350713

SEQ ID NO: 579025 - RNA, 64 nt, Homo Sapiens; identical to SEQ ID NO: 350714

SEQ ID NO: 579026 - RNA, 64 nt, Homo Sapiens; identical to SEQ ID NO: 350715

SEQ ID NO: 579027 - RNA, 64 nt, Homo Sapiens; identical to SEQ ID NO: 350716

SEQ ID NO: 579028 - RNA, 64 nt, Homo Sapiens; identical to SEQ ID NO: 350717

SEQ ID NO: 579029 - RNA, 64 nt, Homo Sapiens; identical to SEQ ID NO: 350718

SEQ ID NO: 579030 - RNA, 64 nt, Homo Sapiens; identical to SEQ ID NO: 350719

SEQ ID NO: 579031 - RNA, 64 nt, Homo Sapiens; identical to SEQ ID NO: 350720

SEQ ID NO: 579032 - RNA, 64 nt, Homo Sapiens
guucgugccaauccugacaucucgagguuuccucacuagacaacucucuuucgcaggcuccuuu

SEQ ID NO: 579033 - RNA, 64 nt, Homo Sapiens
aaugaagugcuauuuucuuauuuuuaaucaaauaacuagacauauaucagaaacuuuaaaaugu

SEQ ID NO: 579034 - RNA, 64 nt, Homo Sapiens
uacuuaauauuuauguuaauaggacuuaauucuuacuagacaucuaggaacauuacaaagcaaa

SEQ ID NO: 579035 - RNA, 64 nt, Homo Sapiens
aggcucuuccuauuuuuaaucucuucaccucagaacuagacauauggagagcuuuaaaggcaag

SEQ ID NO: 579036 - RNA, 65 nt, Homo Sapiens; identical to SEQ ID NO: 65698

SEQ ID NO: 579037 - RNA, 65 nt, Homo Sapiens; identical to SEQ ID NO: 65699

SEQ ID NO: 579038 - RNA, 65 nt, Homo Sapiens; identical to SEQ ID NO: 65706

SEQ ID NO: 579039 - RNA, 65 nt, Homo Sapiens; identical to SEQ ID NO: 65707

SEQ ID NO: 579040 - RNA, 65 nt, Homo Sapiens; identical to SEQ ID NO: 65720

SEQ ID NO: 579041 - RNA, 65 nt, Homo Sapiens; identical to SEQ ID NO: 65721

SEQ ID NO: 579042 - RNA, 65 nt, Homo Sapiens; identical to SEQ ID NO: 65744

SEQ ID NO: 579043 - RNA, 65 nt, Homo Sapiens; identical to SEQ ID NO: 65745

SEQ ID NO: 579044 - RNA, 65 nt, Homo Sapiens; identical to SEQ ID NO: 65788

SEQ ID NO: 579045 - RNA, 65 nt, Homo Sapiens; identical to SEQ ID NO: 65789

SEQ ID NO: 579046 - RNA, 65 nt, Homo Sapiens; identical to SEQ ID NO: 65808

SEQ ID NO: 579047 - RNA, 65 nt, Homo Sapiens; identical to SEQ ID NO: 65809

SEQ ID NO: 579048 - RNA, 65 nt, Homo Sapiens; identical to SEQ ID NO: 65810

SEQ ID NO: 579049 - RNA, 65 nt, Homo Sapiens; identical to SEQ ID NO: 65811

SEQ ID NO: 579050 - RNA, 65 nt, Homo Sapiens; identical to SEQ ID NO: 65827

SEQ ID NO: 579051 - RNA, 65 nt, Homo Sapiens; identical to SEQ ID NO: 65828

SEQ ID NO: 579052 - RNA, 65 nt, Homo Sapiens; identical to SEQ ID NO: 65831

SEQ ID NO: 579053 - RNA, 56 nt, Homo Sapiens; identical to SEQ ID NO: 61369

SEQ ID NO: 579054 - RNA, 65 nt, Homo Sapiens; identical to SEQ ID NO: 65853

SEQ ID NO: 579055 - RNA, 65 nt, Homo Sapiens; identical to SEQ ID NO: 65854

SEQ ID NO: 579056 - RNA, 65 nt, Homo Sapiens; identical to SEQ ID NO: 65891

SEQ ID NO: 579057 - RNA, 65 nt, Homo Sapiens; identical to SEQ ID NO: 65892

SEQ ID NO: 579058 - RNA, 65 nt, Homo Sapiens; identical to SEQ ID NO: 65896

SEQ ID NO: 579059 - RNA, 65 nt, Homo Sapiens; identical to SEQ ID NO: 65897

SEQ ID NO: 579060 - RNA, 64 nt, Homo Sapiens; identical to SEQ ID NO: 290194

SEQ ID NO: 579061 - RNA, 64 nt, Homo Sapiens; identical to SEQ ID NO: 290195

SEQ ID NO: 579062 - RNA, 64 nt, Homo Sapiens; identical to SEQ ID NO: 290196

SEQ ID NO: 579063 - RNA, 64 nt, Homo Sapiens; identical to SEQ ID NO: 290197

SEQ ID NO: 579064 - RNA, 64 nt, Homo Sapiens; identical to SEQ ID NO: 290198

SEQ ID NO: 579065 - RNA, 64 nt, Homo Sapiens; identical to SEQ ID NO: 290199

SEQ ID NO: 579066 - RNA, 64 nt, Homo Sapiens; identical to SEQ ID NO: 290200

SEQ ID NO: 579067 - RNA, 64 nt, Homo Sapiens; identical to SEQ ID NO: 290201

SEQ ID NO: 579068 - RNA, 64 nt, Homo Sapiens; identical to SEQ ID NO: 290202

SEQ ID NO: 579069 - RNA, 64 nt, Homo Sapiens; identical to SEQ ID NO: 290203

SEQ ID NO: 579070 - RNA, 64 nt, Homo Sapiens; identical to SEQ ID NO: 290204

SEQ ID NO: 579071 - RNA, 64 nt, Homo Sapiens; identical to SEQ ID NO: 290205

SEQ ID NO: 579072 - RNA, 64 nt, Homo Sapiens; identical to SEQ ID NO: 290206

SEQ ID NO: 579073 - RNA, 64 nt, Homo Sapiens; identical to SEQ ID NO: 290207

SEQ ID NO: 579074 - RNA, 64 nt, Homo Sapiens; identical to SEQ ID NO: 290208

SEQ ID NO: 579075 - RNA, 64 nt, Homo Sapiens; identical to SEQ ID NO: 290209

SEQ ID NO: 579076 - RNA, 64 nt, Homo Sapiens; identical to SEQ ID NO: 290210

SEQ ID NO: 579077 - RNA, 64 nt, Homo Sapiens; identical to SEQ ID NO: 290211

SEQ ID NO: 579078 - RNA, 64 nt, Homo Sapiens; identical to SEQ ID NO: 290212

SEQ ID NO: 579079 - RNA, 64 nt, Homo Sapiens; identical to SEQ ID NO: 290213

SEQ ID NO: 579080 - RNA, 64 nt, Homo Sapiens; identical to SEQ ID NO: 290214

SEQ ID NO: 579081 - RNA, 64 nt, Homo Sapiens; identical to SEQ ID NO: 290215

SEQ ID NO: 579082 - RNA, 64 nt, Homo Sapiens; identical to SEQ ID NO: 290216

SEQ ID NO: 579083 - RNA, 64 nt, Homo Sapiens; identical to SEQ ID NO: 290217

SEQ ID NO: 579084 - RNA, 64 nt, Homo Sapiens; identical to SEQ ID NO: 290218

SEQ ID NO: 579085 - RNA, 64 nt, Homo Sapiens; identical to SEQ ID NO: 290219

SEQ ID NO: 579086 - RNA, 64 nt, Homo Sapiens; identical to SEQ ID NO: 290220

SEQ ID NO: 579087 - RNA, 64 nt, Homo Sapiens; identical to SEQ ID NO: 290221

SEQ ID NO: 579088 - RNA, 64 nt, Homo Sapiens; identical to SEQ ID NO: 290222

SEQ ID NO: 579089 - RNA, 64 nt, Homo Sapiens; identical to SEQ ID NO: 290223

SEQ ID NO: 579090 - RNA, 64 nt, Homo Sapiens; identical to SEQ ID NO: 290224

SEQ ID NO: 579091 - RNA, 64 nt, Homo Sapiens; identical to SEQ ID NO: 290225

SEQ ID NO: 579092 - RNA, 64 nt, Homo Sapiens; identical to SEQ ID NO: 290226

SEQ ID NO: 579093 - RNA, 64 nt, Homo Sapiens; identical to SEQ ID NO: 290227

SEQ ID NO: 579094 - RNA, 64 nt, Homo Sapiens; identical to SEQ ID NO: 290228

SEQ ID NO: 579095 - RNA, 64 nt, Homo Sapiens; identical to SEQ ID NO: 290229

SEQ ID NO: 579096 - RNA, 64 nt, Homo Sapiens; identical to SEQ ID NO: 426773

SEQ ID NO: 579097 - RNA, 64 nt, Homo Sapiens; identical to SEQ ID NO: 426774

SEQ ID NO: 579098 - RNA, 64 nt, Homo Sapiens; identical to SEQ ID NO: 426775

SEQ ID NO: 579099 - RNA, 64 nt, Homo Sapiens; identical to SEQ ID NO: 426776

SEQ ID NO: 579100 - RNA, 64 nt, Homo Sapiens; identical to SEQ ID NO: 426777

SEQ ID NO: 579101 - RNA, 64 nt, Homo Sapiens; identical to SEQ ID NO: 426778

SEQ ID NO: 579102 - RNA, 64 nt, Homo Sapiens; identical to SEQ ID NO: 426779

SEQ ID NO: 579103 - RNA, 64 nt, Homo Sapiens; identical to SEQ ID NO: 426780

SEQ ID NO: 579104 - RNA, 64 nt, Homo Sapiens; identical to SEQ ID NO: 426781

SEQ ID NO: 579105 - RNA, 64 nt, Homo Sapiens; identical to SEQ ID NO: 426782

SEQ ID NO: 579106 - RNA, 64 nt, Homo Sapiens; identical to SEQ ID NO: 426783

SEQ ID NO: 579107 - RNA, 64 nt, Homo Sapiens; identical to SEQ ID NO: 426784

SEQ ID NO: 579108 - RNA, 64 nt, Homo Sapiens; identical to SEQ ID NO: 426785

SEQ ID NO: 579109 - RNA, 64 nt, Homo Sapiens; identical to SEQ ID NO: 426786

SEQ ID NO: 579110 - RNA, 64 nt, Homo Sapiens; identical to SEQ ID NO: 426787

SEQ ID NO: 579111 - RNA, 64 nt, Homo Sapiens; identical to SEQ ID NO: 426788

SEQ ID NO: 579112 - RNA, 64 nt, Homo Sapiens; identical to SEQ ID NO: 426789

SEQ ID NO: 579113 - RNA, 64 nt, Homo Sapiens; identical to SEQ ID NO: 426790

SEQ ID NO: 579114 - RNA, 64 nt, Homo Sapiens; identical to SEQ ID NO: 426791

SEQ ID NO: 579115 - RNA, 64 nt, Homo Sapiens; identical to SEQ ID NO: 426792

SEQ ID NO: 579116 - RNA, 64 nt, Homo Sapiens; identical to SEQ ID NO: 426793

SEQ ID NO: 579117 - RNA, 64 nt, Homo Sapiens; identical to SEQ ID NO: 426794

SEQ ID NO: 579118 - RNA, 64 nt, Homo Sapiens; identical to SEQ ID NO: 426795

SEQ ID NO: 579119 - RNA, 64 nt, Homo Sapiens; identical to SEQ ID NO: 426796

SEQ ID NO: 579120 - RNA, 64 nt, Homo Sapiens; identical to SEQ ID NO: 426797

SEQ ID NO: 579121 - RNA, 64 nt, Homo Sapiens; identical to SEQ ID NO: 426798

SEQ ID NO: 579122 - RNA, 64 nt, Homo Sapiens; identical to SEQ ID NO: 426799

SEQ ID NO: 579123 - RNA, 64 nt, Homo Sapiens; identical to SEQ ID NO: 426800

SEQ ID NO: 579124 - RNA, 64 nt, Homo Sapiens; identical to SEQ ID NO: 426801

SEQ ID NO: 579125 - RNA, 64 nt, Homo Sapiens; identical to SEQ ID NO: 426802

SEQ ID NO: 579126 - RNA, 64 nt, Homo Sapiens; identical to SEQ ID NO: 426803

SEQ ID NO: 579127 - RNA, 64 nt, Homo Sapiens; identical to SEQ ID NO: 426804

SEQ ID NO: 579128 - RNA, 64 nt, Homo Sapiens; identical to SEQ ID NO: 426805

SEQ ID NO: 579129 - RNA, 64 nt, Homo Sapiens; identical to SEQ ID NO: 426806

SEQ ID NO: 579130 - RNA, 64 nt, Homo Sapiens; identical to SEQ ID NO: 426807

SEQ ID NO: 579131 - RNA, 64 nt, Homo Sapiens; identical to SEQ ID NO: 426808

SEQ ID NO: 579132 - RNA, 64 nt, Homo Sapiens; identical to SEQ ID NO: 426809

SEQ ID NO: 579133 - RNA, 64 nt, Homo Sapiens; identical to SEQ ID NO: 426810

SEQ ID NO: 579134 - RNA, 64 nt, Homo Sapiens; identical to SEQ ID NO: 426811

SEQ ID NO: 579135 - RNA, 64 nt, Homo Sapiens; identical to SEQ ID NO: 426812

SEQ ID NO: 579136 - RNA, 64 nt, Homo Sapiens; identical to SEQ ID NO: 426813

SEQ ID NO: 579137 - RNA, 64 nt, Homo Sapiens; identical to SEQ ID NO: 426814

SEQ ID NO: 579138 - RNA, 64 nt, Homo Sapiens; identical to SEQ ID NO: 426815

SEQ ID NO: 579139 - RNA, 64 nt, Homo Sapiens; identical to SEQ ID NO: 426816

SEQ ID NO: 579140 - RNA, 64 nt, Homo Sapiens; identical to SEQ ID NO: 426817

SEQ ID NO: 579141 - RNA, 64 nt, Homo Sapiens
gggacaagggacuugacucuaagaagggaaaauagacugggaguggaaggccugagguccaggu

SEQ ID NO: 579142 - RNA, 64 nt, Homo Sapiens
uacguuauagcaaugcacagagcugucugucugggacugggauuugggaacucuuuuaaccugc

SEQ ID NO: 579143 - RNA, 64 nt, Homo Sapiens
gaagccugugaugaggcugacuccccacccucaugacugggaaguuccacugcacauggcccuc

SEQ ID NO: 579144 - RNA, 64 nt, Homo Sapiens
aaaucucccucugucagaucuuauuuuaagccaggacugggauuuuggguuuugagauccuucc

SEQ ID NO: 579145 - RNA, 64 nt, Homo Sapiens
aaaaagugguuuaauuggacaaagacauacccgagacugggaaguccguuuucacgcugcugau

SEQ ID NO: 579146 - RNA, 64 nt, Homo Sapiens
aaaaagagguuuacuuggacaaagacguacccgagacugggaagucuguauuaaugcugcugau

SEQ ID NO: 579147 - RNA, 64 nt, Homo Sapiens
ugcuagcaaacaaauggcuuauacacagcaugcagacugggaguccacacuuugaagguaauaa

SEQ ID NO: 579148 - RNA, 64 nt, Homo Sapiens
uugauggcucagagagcauccucuacgagagugagacugggaacuccucuagaagcagaaccag

SEQ ID NO: 579149 - RNA, 58 nt, Homo Sapiens
gcccucagagugcucuguaggagcuguagacugggaagagaggccaggcgugguggcu

SEQ ID NO: 579150 - RNA, 64 nt, Homo Sapiens
gacagcuagacccugucucaaaaaaaaaaaaaaagacugggaagagagcuagagggacuaggag

SEQ ID NO: 579151 - RNA, 64 nt, Homo Sapiens
aaaccuacaguccuggaaggucucugcuggaagagacugggagaguggggaggggccagggacc

SEQ ID NO: 579152 - RNA, 64 nt, Homo Sapiens
ggggcucccugaggacggggcugugucugccucagacugggaaucccugaagauggggccgugu

SEQ ID NO: 579153 - RNA, 64 nt, Homo Sapiens
guguguuucauugcacugggaaaccaagaaguuugacugggagcuuggcacauagcccacuagg

SEQ ID NO: 579154 - RNA, 64 nt, Homo Sapiens
cuguguggcccaaaucacuguacauauuccacuugacugggaaguguuuuucaaaagaagaaug

SEQ ID NO: 579155 - RNA, 64 nt, Homo Sapiens
uuggcagagccuuugcaacaccuuaaguggacaggacugggaggucuuggugguuggagccaac

SEQ ID NO: 579156 - RNA, 64 nt, Homo Sapiens
aguaugugugugcgugugcaugggagugugcguggacugggauaucaucucuacagccugcaaa

SEQ ID NO: 579157 - RNA, 64 nt, Homo Sapiens
gcucuggguuagguuuucugagggggcuuugagagacugggacucuacaaaaaugugacuggga

SEQ ID NO: 579158 - RNA, 64 nt, Homo Sapiens
ggggcuuugagagacugggaaacuacaaaaaugugacugggaagguaggaauccauucugaaca

SEQ ID NO: 579159 - RNA, 64 nt, Homo Sapiens
gaagugucaacuucugagguuguuuuaagugguggacugggaggggaaaacugagcaugugucc

SEQ ID NO: 579160 - RNA, 64 nt, Homo Sapiens
gaauaaagcacuuacagaagcaguaaucaaaacagacugggaauguuccugauuuauuuucagc

SEQ ID NO: 579161 - RNA, 64 nt, Homo Sapiens
ggcagagcaagccucagagcuaaaccccauuaaggacugggagaguuaaugacgucucucccuc

SEQ ID NO: 579162 - RNA, 64 nt, Homo Sapiens
ggaggaccugcaaccaucuggcaacuugucugaugacugggaaacugcucuggacaagaauuga

SEQ ID NO: 579163 - RNA, 64 nt, Homo Sapiens
agcccagagcgguggccuugcucuuccggcuggagacugggacaucccugauagguucacaucc

SEQ ID NO: 579164 - RNA, 64 nt, Homo Sapiens
ucagcuggugaugaagaggagcaugcuggggugagacugggauucuggcuucucuuugaaccac

SEQ ID NO: 579165 - RNA, 64 nt, Homo Sapiens
gcagagaccugcgcccacaggugcugucuuaguggacugggacgugaaccuuucgcucuccuuc

SEQ ID NO: 579166 - RNA, 64 nt, Homo Sapiens
uggacugggacgugaaccuuucgcucuccuucuggacugggagaagggaggcuuggguguugug

SEQ ID NO: 579167 - RNA, 64 nt, Homo Sapiens
agugccagcauccagcaugagcagaugucggggagacugggaagucuccagcguuacugcucuc

SEQ ID NO: 579168 - RNA, 64 nt, Homo Sapiens
agugccagcauccagcgugagcagacgucggggagacugggaagucuccgauguuacugccugc

SEQ ID NO: 579169 - RNA, 64 nt, Homo Sapiens
aacucaaaugcuggggguagguggcuaaucucaggacugggaagauuacggcgaauuaugcuca

SEQ ID NO: 579170 - RNA, 64 nt, Homo Sapiens
aacaagaugcuuccaguuacagcggcaggagcgggacugggagcacgggcugacggcugcuggu

SEQ ID NO: 579171 - RNA, 64 nt, Homo Sapiens; identical to SEQ ID NO: 88257

SEQ ID NO: 579172 - RNA, 64 nt, Homo Sapiens; identical to SEQ ID NO: 88258

SEQ ID NO: 579173 - RNA, 64 nt, Homo Sapiens; identical to SEQ ID NO: 88259

SEQ ID NO: 579174 - RNA, 64 nt, Homo Sapiens; identical to SEQ ID NO: 88260

SEQ ID NO: 579175 - RNA, 64 nt, Homo Sapiens; identical to SEQ ID NO: 88261

SEQ ID NO: 579176 - RNA, 64 nt, Homo Sapiens; identical to SEQ ID NO: 88262

SEQ ID NO: 579177 - RNA, 64 nt, Homo Sapiens; identical to SEQ ID NO: 88263

SEQ ID NO: 579178 - RNA, 64 nt, Homo Sapiens; identical to SEQ ID NO: 88264

SEQ ID NO: 579179 - RNA, 64 nt, Homo Sapiens; identical to SEQ ID NO: 88265

SEQ ID NO: 579180 - RNA, 64 nt, Homo Sapiens; identical to SEQ ID NO: 88266

SEQ ID NO: 579181 - RNA, 64 nt, Homo Sapiens; identical to SEQ ID NO: 88267

SEQ ID NO: 579182 - RNA, 64 nt, Homo Sapiens; identical to SEQ ID NO: 88268

SEQ ID NO: 579183 - RNA, 64 nt, Homo Sapiens; identical to SEQ ID NO: 88269

SEQ ID NO: 579184 - RNA, 64 nt, Homo Sapiens; identical to SEQ ID NO: 88270

SEQ ID NO: 579185 - RNA, 64 nt, Homo Sapiens; identical to SEQ ID NO: 88271

SEQ ID NO: 579186 - RNA, 64 nt, Homo Sapiens; identical to SEQ ID NO: 88269

SEQ ID NO: 579187 - RNA, 64 nt, Homo Sapiens; identical to SEQ ID NO: 88273

SEQ ID NO: 579188 - RNA, 64 nt, Homo Sapiens; identical to SEQ ID NO: 88274

SEQ ID NO: 579189 - RNA, 64 nt, Homo Sapiens; identical to SEQ ID NO: 88275

SEQ ID NO: 579190 - RNA, 64 nt, Homo Sapiens; identical to SEQ ID NO: 88276

SEQ ID NO: 579191 - RNA, 64 nt, Homo Sapiens; identical to SEQ ID NO: 88277

SEQ ID NO: 579192 - RNA, 64 nt, Homo Sapiens; identical to SEQ ID NO: 88278

SEQ ID NO: 579193 - RNA, 64 nt, Homo Sapiens; identical to SEQ ID NO: 88279

SEQ ID NO: 579194 - RNA, 64 nt, Homo Sapiens; identical to SEQ ID NO: 88280

SEQ ID NO: 579195 - RNA, 64 nt, Homo Sapiens; identical to SEQ ID NO: 88281

SEQ ID NO: 579196 - RNA, 64 nt, Homo Sapiens; identical to SEQ ID NO: 88282

SEQ ID NO: 579197 - RNA, 64 nt, Homo Sapiens; identical to SEQ ID NO: 88283

SEQ ID NO: 579198 - RNA, 64 nt, Homo Sapiens; identical to SEQ ID NO: 88284

SEQ ID NO: 579199 - RNA, 64 nt, Homo Sapiens; identical to SEQ ID NO: 88285

SEQ ID NO: 579200 - RNA, 64 nt, Homo Sapiens; identical to SEQ ID NO: 88286

SEQ ID NO: 579201 - RNA, 64 nt, Homo Sapiens; identical to SEQ ID NO: 88287

SEQ ID NO: 579202 - RNA, 64 nt, Homo Sapiens; identical to SEQ ID NO: 88288

SEQ ID NO: 579203 - RNA, 64 nt, Homo Sapiens; identical to SEQ ID NO: 88289

SEQ ID NO: 579204 - RNA, 64 nt, Homo Sapiens; identical to SEQ ID NO: 88290

SEQ ID NO: 579205 - RNA, 64 nt, Homo Sapiens; identical to SEQ ID NO: 88291

SEQ ID NO: 579206 - RNA, 64 nt, Homo Sapiens; identical to SEQ ID NO: 88292

SEQ ID NO: 579207 - RNA, 64 nt, Homo Sapiens; identical to SEQ ID NO: 88293

SEQ ID NO: 579208 - RNA, 64 nt, Homo Sapiens; identical to SEQ ID NO: 88294

SEQ ID NO: 579209 - RNA, 64 nt, Homo Sapiens; identical to SEQ ID NO: 88295

SEQ ID NO: 579210 - RNA, 64 nt, Homo Sapiens; identical to SEQ ID NO: 88296

SEQ ID NO: 579211 - RNA, 64 nt, Homo Sapiens; identical to SEQ ID NO: 88297

SEQ ID NO: 579212 - RNA, 64 nt, Homo Sapiens; identical to SEQ ID NO: 88298

SEQ ID NO: 579213 - RNA, 64 nt, Homo Sapiens; identical to SEQ ID NO: 88299

SEQ ID NO: 579214 - RNA, 64 nt, Homo Sapiens; identical to SEQ ID NO: 88300

SEQ ID NO: 579215 - RNA, 64 nt, Homo Sapiens; identical to SEQ ID NO: 88298

SEQ ID NO: 579216 - RNA, 64 nt, Homo Sapiens; identical to SEQ ID NO: 88302

SEQ ID NO: 579217 - RNA, 64 nt, Homo Sapiens; identical to SEQ ID NO: 88300

SEQ ID NO: 579218 - RNA, 64 nt, Homo Sapiens; identical to SEQ ID NO: 88304

SEQ ID NO: 579219 - RNA, 64 nt, Homo Sapiens; identical to SEQ ID NO: 88305

SEQ ID NO: 579220 - RNA, 64 nt, Homo Sapiens; identical to SEQ ID NO: 88306

SEQ ID NO: 579221 - RNA, 64 nt, Homo Sapiens; identical to SEQ ID NO: 88307

SEQ ID NO: 579222 - RNA, 64 nt, Homo Sapiens; identical to SEQ ID NO: 88299

SEQ ID NO: 579223 - RNA, 64 nt, Homo Sapiens; identical to SEQ ID NO: 88309

SEQ ID NO: 579224 - RNA, 64 nt, Homo Sapiens; identical to SEQ ID NO: 88310

SEQ ID NO: 579225 - RNA, 64 nt, Homo Sapiens; identical to SEQ ID NO: 88311

SEQ ID NO: 579226 - RNA, 64 nt, Homo Sapiens; identical to SEQ ID NO: 88312

SEQ ID NO: 579227 - RNA, 64 nt, Homo Sapiens; identical to SEQ ID NO: 88313

SEQ ID NO: 579228 - RNA, 64 nt, Homo Sapiens; identical to SEQ ID NO: 88314

SEQ ID NO: 579229 - RNA, 64 nt, Homo Sapiens; identical to SEQ ID NO: 88315

SEQ ID NO: 579230 - RNA, 64 nt, Homo Sapiens; identical to SEQ ID NO: 88316

SEQ ID NO: 579231 - RNA, 64 nt, Homo Sapiens; identical to SEQ ID NO: 88317

SEQ ID NO: 579232 - RNA, 64 nt, Homo Sapiens; identical to SEQ ID NO: 88318

SEQ ID NO: 579233 - RNA, 64 nt, Homo Sapiens; identical to SEQ ID NO: 88319

SEQ ID NO: 579234 - RNA, 64 nt, Homo Sapiens; identical to SEQ ID NO: 88320

SEQ ID NO: 579235 - RNA, 64 nt, Homo Sapiens; identical to SEQ ID NO: 88321

SEQ ID NO: 579236 - RNA, 64 nt, Homo Sapiens; identical to SEQ ID NO: 88322

SEQ ID NO: 579237 - RNA, 64 nt, Homo Sapiens; identical to SEQ ID NO: 88323

SEQ ID NO: 579238 - RNA, 64 nt, Homo Sapiens; identical to SEQ ID NO: 88324

SEQ ID NO: 579239 - RNA, 64 nt, Homo Sapiens; identical to SEQ ID NO: 88325

SEQ ID NO: 579240 - RNA, 64 nt, Homo Sapiens; identical to SEQ ID NO: 88326

SEQ ID NO: 579241 - RNA, 64 nt, Homo Sapiens; identical to SEQ ID NO: 88327

SEQ ID NO: 579242 - RNA, 64 nt, Homo Sapiens; identical to SEQ ID NO: 88328

SEQ ID NO: 579243 - RNA, 64 nt, Homo Sapiens; identical to SEQ ID NO: 88329

SEQ ID NO: 579244 - RNA, 64 nt, Homo Sapiens; identical to SEQ ID NO: 88330

SEQ ID NO: 579245 - RNA, 64 nt, Homo Sapiens; identical to SEQ ID NO: 544068

SEQ ID NO: 579246 - RNA, 64 nt, Homo Sapiens; identical to SEQ ID NO: 544069

SEQ ID NO: 579247 - RNA, 64 nt, Homo Sapiens; identical to SEQ ID NO: 544070

SEQ ID NO: 579248 - RNA, 64 nt, Homo Sapiens; identical to SEQ ID NO: 544071

SEQ ID NO: 579249 - RNA, 64 nt, Homo Sapiens; identical to SEQ ID NO: 544072

SEQ ID NO: 579250 - RNA, 64 nt, Homo Sapiens; identical to SEQ ID NO: 544073

SEQ ID NO: 579251 - RNA, 64 nt, Homo Sapiens; identical to SEQ ID NO: 544074

SEQ ID NO: 579252 - RNA, 64 nt, Homo Sapiens; identical to SEQ ID NO: 544075

SEQ ID NO: 579253 - RNA, 64 nt, Homo Sapiens; identical to SEQ ID NO: 84890

SEQ ID NO: 579254 - RNA, 64 nt, Homo Sapiens; identical to SEQ ID NO: 84891

SEQ ID NO: 579255 - RNA, 64 nt, Homo Sapiens; identical to SEQ ID NO: 84892

SEQ ID NO: 579256 - RNA, 64 nt, Homo Sapiens; identical to SEQ ID NO: 84893

SEQ ID NO: 579257 - RNA, 64 nt, Homo Sapiens; identical to SEQ ID NO: 84894

SEQ ID NO: 579258 - RNA, 64 nt, Homo Sapiens; identical to SEQ ID NO: 84895

SEQ ID NO: 579259 - RNA, 64 nt, Homo Sapiens; identical to SEQ ID NO: 84896

SEQ ID NO: 579260 - RNA, 64 nt, Homo Sapiens; identical to SEQ ID NO: 84897

SEQ ID NO: 579261 - RNA, 64 nt, Homo Sapiens; identical to SEQ ID NO: 84898

SEQ ID NO: 579262 - RNA, 64 nt, Homo Sapiens; identical to SEQ ID NO: 84899

SEQ ID NO: 579263 - RNA, 64 nt, Homo Sapiens; identical to SEQ ID NO: 84900

SEQ ID NO: 579264 - RNA, 64 nt, Homo Sapiens; identical to SEQ ID NO: 84901

SEQ ID NO: 579265 - RNA, 64 nt, Homo Sapiens; identical to SEQ ID NO: 84902

SEQ ID NO: 579266 - RNA, 64 nt, Homo Sapiens; identical to SEQ ID NO: 84903

SEQ ID NO: 579267 - RNA, 64 nt, Homo Sapiens; identical to SEQ ID NO: 84904

SEQ ID NO: 579268 - RNA, 64 nt, Homo Sapiens; identical to SEQ ID NO: 84905

SEQ ID NO: 579269 - RNA, 52 nt, Homo Sapiens; identical to SEQ ID NO: 84906

SEQ ID NO: 579270 - RNA, 64 nt, Homo Sapiens; identical to SEQ ID NO: 84907

SEQ ID NO: 579271 - RNA, 64 nt, Homo Sapiens; identical to SEQ ID NO: 84908

SEQ ID NO: 579272 - RNA, 64 nt, Homo Sapiens; identical to SEQ ID NO: 84909

SEQ ID NO: 579273 - RNA, 64 nt, Homo Sapiens; identical to SEQ ID NO: 84910

SEQ ID NO: 579274 - RNA, 64 nt, Homo Sapiens; identical to SEQ ID NO: 84911

SEQ ID NO: 579275 - RNA, 64 nt, Homo Sapiens; identical to SEQ ID NO: 84912

SEQ ID NO: 579276 - RNA, 64 nt, Homo Sapiens; identical to SEQ ID NO: 84913

SEQ ID NO: 579277 - RNA, 64 nt, Homo Sapiens; identical to SEQ ID NO: 84914

SEQ ID NO: 579278 - RNA, 64 nt, Homo Sapiens; identical to SEQ ID NO: 84915

SEQ ID NO: 579279 - RNA, 64 nt, Homo Sapiens; identical to SEQ ID NO: 84916

SEQ ID NO: 579280 - RNA, 64 nt, Homo Sapiens; identical to SEQ ID NO: 84917

SEQ ID NO: 579281 - RNA, 64 nt, Homo Sapiens; identical to SEQ ID NO: 84918

SEQ ID NO: 579282 - RNA, 64 nt, Homo Sapiens; identical to SEQ ID NO: 84919

SEQ ID NO: 579283 - RNA, 64 nt, Homo Sapiens; identical to SEQ ID NO: 84920

SEQ ID NO: 579284 - RNA, 64 nt, Homo Sapiens; identical to SEQ ID NO: 84921

SEQ ID NO: 579285 - RNA, 64 nt, Homo Sapiens; identical to SEQ ID NO: 84922

SEQ ID NO: 579286 - RNA, 64 nt, Homo Sapiens; identical to SEQ ID NO: 84923

SEQ ID NO: 579287 - RNA, 64 nt, Homo Sapiens; identical to SEQ ID NO: 84924

SEQ ID NO: 579288 - RNA, 64 nt, Homo Sapiens; identical to SEQ ID NO: 84925

SEQ ID NO: 579289 - RNA, 64 nt, Homo Sapiens; identical to SEQ ID NO: 84926

SEQ ID NO: 579290 - RNA, 64 nt, Homo Sapiens; identical to SEQ ID NO: 84927

SEQ ID NO: 579291 - RNA, 64 nt, Homo Sapiens; identical to SEQ ID NO: 84928

SEQ ID NO: 579292 - RNA, 64 nt, Homo Sapiens; identical to SEQ ID NO: 84929

SEQ ID NO: 579293 - RNA, 64 nt, Homo Sapiens; identical to SEQ ID NO: 84930

SEQ ID NO: 579294 - RNA, 64 nt, Homo Sapiens; identical to SEQ ID NO: 84931

SEQ ID NO: 579295 - RNA, 64 nt, Homo Sapiens; identical to SEQ ID NO: 84932

SEQ ID NO: 579296 - RNA, 64 nt, Homo Sapiens; identical to SEQ ID NO: 84933

SEQ ID NO: 579297 - RNA, 64 nt, Homo Sapiens; identical to SEQ ID NO: 84934

SEQ ID NO: 579298 - RNA, 64 nt, Homo Sapiens; identical to SEQ ID NO: 84935

SEQ ID NO: 579299 - RNA, 64 nt, Homo Sapiens; identical to SEQ ID NO: 84936

SEQ ID NO: 579300 - RNA, 64 nt, Homo Sapiens; identical to SEQ ID NO: 84937

SEQ ID NO: 579301 - RNA, 64 nt, Homo Sapiens; identical to SEQ ID NO: 84938

SEQ ID NO: 579302 - RNA, 64 nt, Homo Sapiens; identical to SEQ ID NO: 84939

SEQ ID NO: 579303 - RNA, 64 nt, Homo Sapiens; identical to SEQ ID NO: 84940

SEQ ID NO: 579304 - RNA, 64 nt, Homo Sapiens; identical to SEQ ID NO: 84941

SEQ ID NO: 579305 - RNA, 64 nt, Homo Sapiens; identical to SEQ ID NO: 84942

SEQ ID NO: 579306 - RNA, 64 nt, Homo Sapiens; identical to SEQ ID NO: 84943

SEQ ID NO: 579307 - RNA, 64 nt, Homo Sapiens; identical to SEQ ID NO: 84944

SEQ ID NO: 579308 - RNA, 64 nt, Homo Sapiens; identical to SEQ ID NO: 84945

SEQ ID NO: 579309 - RNA, 64 nt, Homo Sapiens; identical to SEQ ID NO: 84946

SEQ ID NO: 579310 - RNA, 64 nt, Homo Sapiens; identical to SEQ ID NO: 84947

SEQ ID NO: 579311 - RNA, 64 nt, Homo Sapiens; identical to SEQ ID NO: 84948

SEQ ID NO: 579312 - RNA, 64 nt, Homo Sapiens; identical to SEQ ID NO: 84949

SEQ ID NO: 579313 - RNA, 64 nt, Homo Sapiens; identical to SEQ ID NO: 84950

SEQ ID NO: 579314 - RNA, 64 nt, Homo Sapiens; identical to SEQ ID NO: 84951

SEQ ID NO: 579315 - RNA, 64 nt, Homo Sapiens; identical to SEQ ID NO: 84952

SEQ ID NO: 579316 - RNA, 64 nt, Homo Sapiens; identical to SEQ ID NO: 84953

SEQ ID NO: 579317 - RNA, 64 nt, Homo Sapiens; identical to SEQ ID NO: 84954

SEQ ID NO: 579318 - RNA, 64 nt, Homo Sapiens; identical to SEQ ID NO: 84955

SEQ ID NO: 579319 - RNA, 64 nt, Homo Sapiens; identical to SEQ ID NO: 84956

SEQ ID NO: 579320 - RNA, 64 nt, Homo Sapiens; identical to SEQ ID NO: 84957

SEQ ID NO: 579321 - RNA, 64 nt, Homo Sapiens; identical to SEQ ID NO: 84958

SEQ ID NO: 579322 - RNA, 64 nt, Homo Sapiens; identical to SEQ ID NO: 84959

SEQ ID NO: 579323 - RNA, 64 nt, Homo Sapiens; identical to SEQ ID NO: 84960

SEQ ID NO: 579324 - RNA, 64 nt, Homo Sapiens; identical to SEQ ID NO: 84961

SEQ ID NO: 579325 - RNA, 64 nt, Homo Sapiens; identical to SEQ ID NO: 84962

SEQ ID NO: 579326 - RNA, 64 nt, Homo Sapiens; identical to SEQ ID NO: 84963

SEQ ID NO: 579327 - RNA, 64 nt, Homo Sapiens; identical to SEQ ID NO: 84964

SEQ ID NO: 579328 - RNA, 64 nt, Homo Sapiens; identical to SEQ ID NO: 84965

SEQ ID NO: 579329 - RNA, 64 nt, Homo Sapiens; identical to SEQ ID NO: 84966

SEQ ID NO: 579330 - RNA, 64 nt, Homo Sapiens; identical to SEQ ID NO: 84967

SEQ ID NO: 579331 - RNA, 64 nt, Homo Sapiens; identical to SEQ ID NO: 84968

SEQ ID NO: 579332 - RNA, 64 nt, Homo Sapiens; identical to SEQ ID NO: 84969

SEQ ID NO: 579333 - RNA, 64 nt, Homo Sapiens; identical to SEQ ID NO: 84970

SEQ ID NO: 579334 - RNA, 64 nt, Homo Sapiens; identical to SEQ ID NO: 84971

SEQ ID NO: 579335 - RNA, 64 nt, Homo Sapiens; identical to SEQ ID NO: 84972

SEQ ID NO: 579336 - RNA, 58 nt, Homo Sapiens; identical to SEQ ID NO: 84973

SEQ ID NO: 579337 - RNA, 64 nt, Homo Sapiens; identical to SEQ ID NO: 84974

SEQ ID NO: 579338 - RNA, 64 nt, Homo Sapiens; identical to SEQ ID NO: 84975

SEQ ID NO: 579339 - RNA, 64 nt, Homo Sapiens; identical to SEQ ID NO: 84976

SEQ ID NO: 579340 - RNA, 64 nt, Homo Sapiens; identical to SEQ ID NO: 84977

SEQ ID NO: 579341 - RNA, 64 nt, Homo Sapiens; identical to SEQ ID NO: 84978

SEQ ID NO: 579342 - RNA, 64 nt, Homo Sapiens; identical to SEQ ID NO: 84979

SEQ ID NO: 579343 - RNA, 64 nt, Homo Sapiens; identical to SEQ ID NO: 84980

SEQ ID NO: 579344 - RNA, 64 nt, Homo Sapiens; identical to SEQ ID NO: 84981

SEQ ID NO: 579345 - RNA, 64 nt, Homo Sapiens; identical to SEQ ID NO: 84982

SEQ ID NO: 579346 - RNA, 64 nt, Homo Sapiens; identical to SEQ ID NO: 84983

SEQ ID NO: 579347 - RNA, 64 nt, Homo Sapiens; identical to SEQ ID NO: 84984

SEQ ID NO: 579348 - RNA, 64 nt, Homo Sapiens; identical to SEQ ID NO: 84985

SEQ ID NO: 579349 - RNA, 64 nt, Homo Sapiens; identical to SEQ ID NO: 84986

SEQ ID NO: 579350 - RNA, 64 nt, Homo Sapiens; identical to SEQ ID NO: 84987

SEQ ID NO: 579351 - RNA, 64 nt, Homo Sapiens; identical to SEQ ID NO: 84988

SEQ ID NO: 579352 - RNA, 64 nt, Homo Sapiens; identical to SEQ ID NO: 84989

SEQ ID NO: 579353 - RNA, 64 nt, Homo Sapiens; identical to SEQ ID NO: 84990

SEQ ID NO: 579354 - RNA, 64 nt, Homo Sapiens; identical to SEQ ID NO: 84991

SEQ ID NO: 579355 - RNA, 64 nt, Homo Sapiens; identical to SEQ ID NO: 84992

SEQ ID NO: 579356 - RNA, 64 nt, Homo Sapiens; identical to SEQ ID NO: 84993

SEQ ID NO: 579357 - RNA, 64 nt, Homo Sapiens; identical to SEQ ID NO: 84994

SEQ ID NO: 579358 - RNA, 64 nt, Homo Sapiens; identical to SEQ ID NO: 84995

SEQ ID NO: 579359 - RNA, 64 nt, Homo Sapiens; identical to SEQ ID NO: 84996

SEQ ID NO: 579360 - RNA, 64 nt, Homo Sapiens; identical to SEQ ID NO: 84997

SEQ ID NO: 579361 - RNA, 64 nt, Homo Sapiens; identical to SEQ ID NO: 84998

SEQ ID NO: 579362 - RNA, 64 nt, Homo Sapiens; identical to SEQ ID NO: 84999

SEQ ID NO: 579363 - RNA, 64 nt, Homo Sapiens; identical to SEQ ID NO: 85000

SEQ ID NO: 579364 - RNA, 64 nt, Homo Sapiens; identical to SEQ ID NO: 85001

SEQ ID NO: 579365 - RNA, 64 nt, Homo Sapiens; identical to SEQ ID NO: 85002

SEQ ID NO: 579366 - RNA, 64 nt, Homo Sapiens; identical to SEQ ID NO: 85003

SEQ ID NO: 579367 - RNA, 64 nt, Homo Sapiens; identical to SEQ ID NO: 128910

SEQ ID NO: 579368 - RNA, 64 nt, Homo Sapiens; identical to SEQ ID NO: 128911

SEQ ID NO: 579369 - RNA, 64 nt, Homo Sapiens; identical to SEQ ID NO: 128912

SEQ ID NO: 579370 - RNA, 64 nt, Homo Sapiens; identical to SEQ ID NO: 128913

SEQ ID NO: 579371 - RNA, 64 nt, Homo Sapiens; identical to SEQ ID NO: 128914

SEQ ID NO: 579372 - RNA, 64 nt, Homo Sapiens; identical to SEQ ID NO: 128915

SEQ ID NO: 579373 - RNA, 64 nt, Homo Sapiens; identical to SEQ ID NO: 128916

SEQ ID NO: 579374 - RNA, 64 nt, Homo Sapiens; identical to SEQ ID NO: 128917

SEQ ID NO: 579375 - RNA, 64 nt, Homo Sapiens; identical to SEQ ID NO: 128918

SEQ ID NO: 579376 - RNA, 64 nt, Homo Sapiens; identical to SEQ ID NO: 128919

SEQ ID NO: 579377 - RNA, 64 nt, Homo Sapiens; identical to SEQ ID NO: 128920

SEQ ID NO: 579378 - RNA, 64 nt, Homo Sapiens; identical to SEQ ID NO: 128921

SEQ ID NO: 579379 - RNA, 64 nt, Homo Sapiens; identical to SEQ ID NO: 128922

SEQ ID NO: 579380 - RNA, 64 nt, Homo Sapiens; identical to SEQ ID NO: 128923

SEQ ID NO: 579381 - RNA, 64 nt, Homo Sapiens; identical to SEQ ID NO: 128924

SEQ ID NO: 579382 - RNA, 64 nt, Homo Sapiens; identical to SEQ ID NO: 128925

SEQ ID NO: 579383 - RNA, 64 nt, Homo Sapiens; identical to SEQ ID NO: 128926

SEQ ID NO: 579384 - RNA, 64 nt, Homo Sapiens; identical to SEQ ID NO: 128927

SEQ ID NO: 579385 - RNA, 64 nt, Homo Sapiens; identical to SEQ ID NO: 128928

SEQ ID NO: 579386 - RNA, 64 nt, Homo Sapiens; identical to SEQ ID NO: 128929

SEQ ID NO: 579387 - RNA, 64 nt, Homo Sapiens; identical to SEQ ID NO: 128930

SEQ ID NO: 579388 - RNA, 64 nt, Homo Sapiens; identical to SEQ ID NO: 128931

SEQ ID NO: 579389 - RNA, 64 nt, Homo Sapiens; identical to SEQ ID NO: 128932

SEQ ID NO: 579390 - RNA, 64 nt, Homo Sapiens; identical to SEQ ID NO: 128933

SEQ ID NO: 579391 - RNA, 64 nt, Homo Sapiens; identical to SEQ ID NO: 128934

SEQ ID NO: 579392 - RNA, 64 nt, Homo Sapiens; identical to SEQ ID NO: 128935

SEQ ID NO: 579393 - RNA, 64 nt, Homo Sapiens; identical to SEQ ID NO: 128936

SEQ ID NO: 579394 - RNA, 64 nt, Homo Sapiens; identical to SEQ ID NO: 128937

SEQ ID NO: 579395 - RNA, 64 nt, Homo Sapiens; identical to SEQ ID NO: 128938

SEQ ID NO: 579396 - RNA, 64 nt, Homo Sapiens; identical to SEQ ID NO: 128939

SEQ ID NO: 579397 - RNA, 64 nt, Homo Sapiens; identical to SEQ ID NO: 128940

SEQ ID NO: 579398 - RNA, 64 nt, Homo Sapiens; identical to SEQ ID NO: 128941

SEQ ID NO: 579399 - RNA, 64 nt, Homo Sapiens; identical to SEQ ID NO: 128942

SEQ ID NO: 579400 - RNA, 64 nt, Homo Sapiens; identical to SEQ ID NO: 128943

SEQ ID NO: 579401 - RNA, 64 nt, Homo Sapiens; identical to SEQ ID NO: 246263

SEQ ID NO: 579402 - RNA, 64 nt, Homo Sapiens; identical to SEQ ID NO: 246264

SEQ ID NO: 579403 - RNA, 64 nt, Homo Sapiens; identical to SEQ ID NO: 246265

SEQ ID NO: 579404 - RNA, 64 nt, Homo Sapiens; identical to SEQ ID NO: 246266

SEQ ID NO: 579405 - RNA, 64 nt, Homo Sapiens; identical to SEQ ID NO: 246267

SEQ ID NO: 579406 - RNA, 64 nt, Homo Sapiens; identical to SEQ ID NO: 246268

SEQ ID NO: 579407 - RNA, 64 nt, Homo Sapiens; identical to SEQ ID NO: 226265

SEQ ID NO: 579408 - RNA, 64 nt, Homo Sapiens; identical to SEQ ID NO: 226266

SEQ ID NO: 579409 - RNA, 64 nt, Homo Sapiens; identical to SEQ ID NO: 226267

SEQ ID NO: 579410 - RNA, 64 nt, Homo Sapiens; identical to SEQ ID NO: 226268

SEQ ID NO: 579411 - RNA, 64 nt, Homo Sapiens; identical to SEQ ID NO: 226269

SEQ ID NO: 579412 - RNA, 64 nt, Homo Sapiens; identical to SEQ ID NO: 226270

SEQ ID NO: 579413 - RNA, 64 nt, Homo Sapiens; identical to SEQ ID NO: 226271

SEQ ID NO: 579414 - RNA, 64 nt, Homo Sapiens; identical to SEQ ID NO: 226272

SEQ ID NO: 579415 - RNA, 64 nt, Homo Sapiens; identical to SEQ ID NO: 226273

SEQ ID NO: 579416 - RNA, 64 nt, Homo Sapiens; identical to SEQ ID NO: 226274

SEQ ID NO: 579417 - RNA, 64 nt, Homo Sapiens; identical to SEQ ID NO: 226275

SEQ ID NO: 579418 - RNA, 64 nt, Homo Sapiens; identical to SEQ ID NO: 226276

SEQ ID NO: 579419 - RNA, 64 nt, Homo Sapiens; identical to SEQ ID NO: 226277

SEQ ID NO: 579420 - RNA, 64 nt, Homo Sapiens; identical to SEQ ID NO: 226278

SEQ ID NO: 579421 - RNA, 64 nt, Homo Sapiens; identical to SEQ ID NO: 226279

SEQ ID NO: 579422 - RNA, 64 nt, Homo Sapiens; identical to SEQ ID NO: 226280

SEQ ID NO: 579423 - RNA, 64 nt, Homo Sapiens; identical to SEQ ID NO: 226281

SEQ ID NO: 579424 - RNA, 64 nt, Homo Sapiens; identical to SEQ ID NO: 226282

SEQ ID NO: 579425 - RNA, 64 nt, Homo Sapiens; identical to SEQ ID NO: 226283

SEQ ID NO: 579426 - RNA, 64 nt, Homo Sapiens; identical to SEQ ID NO: 226284

SEQ ID NO: 579427 - RNA, 64 nt, Homo Sapiens; identical to SEQ ID NO: 226285

SEQ ID NO: 579428 - RNA, 64 nt, Homo Sapiens; identical to SEQ ID NO: 226286

SEQ ID NO: 579429 - RNA, 64 nt, Homo Sapiens; identical to SEQ ID NO: 226287

SEQ ID NO: 579430 - RNA, 64 nt, Homo Sapiens; identical to SEQ ID NO: 226288

SEQ ID NO: 579431 - RNA, 64 nt, Homo Sapiens; identical to SEQ ID NO: 226289

SEQ ID NO: 579432 - RNA, 64 nt, Homo Sapiens; identical to SEQ ID NO: 226290

SEQ ID NO: 579433 - RNA, 64 nt, Homo Sapiens; identical to SEQ ID NO: 226291

SEQ ID NO: 579434 - RNA, 64 nt, Homo Sapiens; identical to SEQ ID NO: 226292

SEQ ID NO: 579435 - RNA, 64 nt, Homo Sapiens; identical to SEQ ID NO: 226293

SEQ ID NO: 579436 - RNA, 64 nt, Homo Sapiens; identical to SEQ ID NO: 226294

SEQ ID NO: 579437 - RNA, 64 nt, Homo Sapiens; identical to SEQ ID NO: 226295

SEQ ID NO: 579438 - RNA, 64 nt, Homo Sapiens; identical to SEQ ID NO: 226296

SEQ ID NO: 579439 - RNA, 64 nt, Homo Sapiens; identical to SEQ ID NO: 226297

SEQ ID NO: 579440 - RNA, 64 nt, Homo Sapiens; identical to SEQ ID NO: 226298

SEQ ID NO: 579441 - RNA, 64 nt, Homo Sapiens; identical to SEQ ID NO: 226299

SEQ ID NO: 579442 - RNA, 64 nt, Homo Sapiens; identical to SEQ ID NO: 226300

SEQ ID NO: 579443 - RNA, 64 nt, Homo Sapiens; identical to SEQ ID NO: 226301

SEQ ID NO: 579444 - RNA, 64 nt, Homo Sapiens; identical to SEQ ID NO: 226302

SEQ ID NO: 579445 - RNA, 64 nt, Homo Sapiens; identical to SEQ ID NO: 226303

SEQ ID NO: 579446 - RNA, 64 nt, Homo Sapiens; identical to SEQ ID NO: 226304

SEQ ID NO: 579447 - RNA, 64 nt, Homo Sapiens; identical to SEQ ID NO: 226305

SEQ ID NO: 579448 - RNA, 64 nt, Homo Sapiens; identical to SEQ ID NO: 226306

SEQ ID NO: 579449 - RNA, 64 nt, Homo Sapiens; identical to SEQ ID NO: 226307

SEQ ID NO: 579450 - RNA, 64 nt, Homo Sapiens; identical to SEQ ID NO: 226308

SEQ ID NO: 579451 - RNA, 64 nt, Homo Sapiens; identical to SEQ ID NO: 226309

SEQ ID NO: 579452 - RNA, 64 nt, Homo Sapiens; identical to SEQ ID NO: 226310

SEQ ID NO: 579453 - RNA, 64 nt, Homo Sapiens; identical to SEQ ID NO: 226311

SEQ ID NO: 579454 - RNA, 64 nt, Homo Sapiens; identical to SEQ ID NO: 226312

SEQ ID NO: 579455 - RNA, 64 nt, Homo Sapiens; identical to SEQ ID NO: 226313

SEQ ID NO: 579456 - RNA, 64 nt, Homo Sapiens
gaacagauggcugaggcugcagacucaggcccaggacacucaaccccaggaggggagccgcucg

SEQ ID NO: 579457 - RNA, 64 nt, Homo Sapiens
ucacuucugggugcaagaggcuuucuagaccuuagacacucaagauuacggucccgggccagua

SEQ ID NO: 579458 - RNA, 64 nt, Homo Sapiens
gccacugugaagagaaccauaucaagacucuuuggacacucacacggacacucaaaagcugggc

SEQ ID NO: 579459 - RNA, 64 nt, Homo Sapiens
agaaccauaucaagacucuuuggacacucacacggacacucaaaagcugggcagguuggugggg

SEQ ID NO: 579460 - RNA, 64 nt, Homo Sapiens
aaauagggauuccuaauaauaaugucauguagcugacacucaaguaugcaggugaauuguggaa

SEQ ID NO: 579461 - RNA, 64 nt, Homo Sapiens
acagguaaauaggccaccagaaaucuccacgcuagacacucaauugaggacacccacgaauggc

SEQ ID NO: 579462 - RNA, 64 nt, Homo Sapiens
ugggauccaccugucaguccccagcgacucucaugacacucauucugcagcaccgccucuuggg

SEQ ID NO: 579463 - RNA, 64 nt, Homo Sapiens
ccacgccggaagaguccuggagcuaaagcuggaagacacucagcucucuaagcaggggcucggc

SEQ ID NO: 579464 - RNA, 64 nt, Homo Sapiens; identical to SEQ ID NO: 236284

SEQ ID NO: 579465 - RNA, 64 nt, Homo Sapiens; identical to SEQ ID NO: 236285

SEQ ID NO: 579466 - RNA, 64 nt, Homo Sapiens; identical to SEQ ID NO: 236286

SEQ ID NO: 579467 - RNA, 64 nt, Homo Sapiens; identical to SEQ ID NO: 236287

SEQ ID NO: 579468 - RNA, 64 nt, Homo Sapiens; identical to SEQ ID NO: 236288

SEQ ID NO: 579469 - RNA, 64 nt, Homo Sapiens; identical to SEQ ID NO: 236289

SEQ ID NO: 579470 - RNA, 64 nt, Homo Sapiens
caaaauggaaauugucggucauauuucuagaacuuuaaagaaaaaagaauguuauauuaguuuu

SEQ ID NO: 579471 - RNA, 64 nt, Homo Sapiens
uuacauacccaaaaccuuaacuaugacuaagaaauuaaagaagaaaaccagcaaacuaaaacuu

SEQ ID NO: 579472 - RNA, 64 nt, Homo Sapiens
gcaaaaucuuaacaggaacuguauuuucuauauuuuaaagaauuuuauuugucccacuuuuacu

SEQ ID NO: 579473 - RNA, 64 nt, Homo Sapiens
ccacuuuuacuaaacaguggcagcagauuuuaaguuaaagaauauggaauauaguaaaauaagu

SEQ ID NO: 579474 - RNA, 64 nt, Homo Sapiens
aagguacaauugaauggaaaaaagagcucuauuuuuaaagaaaauuacccuaaacuguuuaaau

SEQ ID NO: 579475 - RNA, 64 nt, Homo Sapiens
uuuuccagaguuuaauuucuaccuuacuauuuuuuuaaagaauugagccaccgcgcccagccaa

SEQ ID NO: 579476 - RNA, 64 nt, Homo Sapiens
aaaacaugcuuauaaaagacagucuuucuguuauuuaaagaauauacaauaaugauaauuuauu

SEQ ID NO: 579477 - RNA, 64 nt, Homo Sapiens
gauauucuaauguacucucaggauaauaaaauuuuuaaagaaaaaugaagcagaucaacuuaaa

SEQ ID NO: 579478 - RNA, 64 nt, Homo Sapiens
gccaugucuucaacaucugauugaauagcuauuauuaaagaaaauucaaaaaagaauaaaaagu

SEQ ID NO: 579479 - RNA, 64 nt, Homo Sapiens
aaaaaaaagguacuuagagguaagaucuugucucuuaaagaaaagucccaccugggcaacauag

SEQ ID NO: 579480 - RNA, 64 nt, Homo Sapiens
auguuaauauuuuacuuuuaggauuguuuuuucuuuaaagaagacccagcaggagggauugcug

SEQ ID NO: 579481 - RNA, 64 nt, Homo Sapiens
aaacaaucccagcaggaggguacagggguuguuuuuaaagaaaagacacacaugacgcaccagu

SEQ ID NO: 579482 - RNA, 64 nt, Homo Sapiens
uugaaaucaguaaaaagacaauugcauggacuucuuaaagaaguuugggucuucuccaaaguaa

SEQ ID NO: 579483 - RNA, 64 nt, Homo Sapiens
uuguuuguuauuguuguucuuucugucucaaaaauuaaagaauuacugaccacaaagaagaaaa

SEQ ID NO: 579484 - RNA, 64 nt, Homo Sapiens
guugugcucgcuacacugcuaaaacguucuuauuuuaaagaaaggaaauguucugguggguuga

SEQ ID NO: 579485 - RNA, 64 nt, Homo Sapiens
gaccccagaucugcaagguacacacuucgcuccuuuaaagaagcaaucuggaauagagaacguu

SEQ ID NO: 579486 - RNA, 64 nt, Homo Sapiens
gaaaaaaaaaaacaauaucuuucgcccucugaaauuaaagaaauugcacuuuuuuuacuucguc

SEQ ID NO: 579487 - RNA, 64 nt, Homo Sapiens
cagcucucuauuuugauaaaagcuuuggcugcuguuaaagaaucaaccuauguguuaucauuac

SEQ ID NO: 579488 - RNA, 64 nt, Homo Sapiens
acggcuuguauuuuuaugagacaauuuagugcaauuaaagaaacgcucuaauuccacagguaau

SEQ ID NO: 579489 - RNA, 64 nt, Homo Sapiens
uuuaguauaugaaaauuauuacucuuuuugggguuuaaagaaauggucugcauaaccugaauga

SEQ ID NO: 579490 - RNA, 64 nt, Homo Sapiens
aguagcuaaaauuagaaaaaaacaaaauagaugcuuaaagaauuugcauccauuuuugagucua

SEQ ID NO: 579491 - RNA, 64 nt, Homo Sapiens
cugcaacuuuuuuaugucucgcaaaauauugguauuaaagaauguuggcuguaugucaaauugu

SEQ ID NO: 579492 - RNA, 64 nt, Homo Sapiens
caagacaaacuaaacuuuaccugggccuaauuuuuuaaagaaucuaauuaggauaacuaaaauu

SEQ ID NO: 579493 - RNA, 64 nt, Homo Sapiens
ugugcuccuuuuuauuauauuaguuacagugcuauuaaagaauaaguauuauuugcaauuuuau

SEQ ID NO: 579494 - RNA, 64 nt, Homo Sapiens
ucccuggaaaggaugcuuuuagcuguuucucuccuuaaagaagaugggcacagagcaucacaug

SEQ ID NO: 579495 - RNA, 64 nt, Homo Sapiens
caucuccaauccuuaggccaauuuuuuugauguauuaaagaauguaggugugauauaguguuag

SEQ ID NO: 579496 - RNA, 64 nt, Homo Sapiens
cacuguuccacuguauggcuguuguccuacgagguuaaagaacauagugcccaggcauaugaga

SEQ ID NO: 579497 - RNA, 64 nt, Homo Sapiens
gcagccaagguaguaaccuauucuuuuuuuuuucuuaaagaagguguggaaaaguucuuuuuuu

SEQ ID NO: 579498 - RNA, 64 nt, Homo Sapiens
guauugaauucuuuuuagauaguuuuauguacuguuaaagaauuccauuuucuuuugcaauugu

SEQ ID NO: 579499 - RNA, 64 nt, Homo Sapiens
guacugaauucuuuuuagauaguuuuauguacuguuaaagaauuucauuuucuuuugcaauuuu

SEQ ID NO: 579500 - RNA, 64 nt, Homo Sapiens
cuguaguaacuaugauggguguaacaacauuuuuuuaaagaagggaaucuguuuaucgcuuuuc

SEQ ID NO: 579501 - RNA, 64 nt, Homo Sapiens
aaaugauagcuaucuaacaacuaauuacuaauuuuuaaagaacaaaucacacauuuaaaaaauc

SEQ ID NO: 579502 - RNA, 64 nt, Homo Sapiens
uguagacuauacuguaaaaauucaguuuguugcuuuaaagaaacaaacugauaccugaauuuug

SEQ ID NO: 579503 - RNA, 64 nt, Homo Sapiens
caaacuuaguaacucuguuaaauauuuggaggauuuaaagaacaucccaguuugaauucauuuc

SEQ ID NO: 579504 - RNA, 64 nt, Homo Sapiens
auggcggcucacaagugaaaacugauuucccauuuuaaagaagaaguggaucuaaauggaagca

SEQ ID NO: 579505 - RNA, 64 nt, Homo Sapiens
gcuauuuuugcacagguacauagcucucauguauuuaaagaacacugcaguguuauuuucuuug

SEQ ID NO: 579506 - RNA, 64 nt, Homo Sapiens
cagacucuugugaaguuuucuuaaauuguucacuuuaaagaaaaugacguaccaacaaugauuu

SEQ ID NO: 579507 - RNA, 64 nt, Homo Sapiens
aaaugugaaacugcugucuuuuauauuaaaguaauuaaagaaaauguauugugauugaaauuau

SEQ ID NO: 579508 - RNA, 64 nt, Homo Sapiens
guuuccuguuucuggaauuccuuguuagggaacuuuaaagaagaaaagaaaaacuugaauugug

SEQ ID NO: 579509 - RNA, 64 nt, Homo Sapiens
cuaguuuucaaauuuugugugcgucuguaaguucuuaaagaaccagcuucuuagaauguucagu

SEQ ID NO: 579510 - RNA, 64 nt, Homo Sapiens
aaaccaaaaaaaaaaacaaaaaaaaacuuuuuaauuaaagaaccuaguuugcuaugcuuaaaau

SEQ ID NO: 579511 - RNA, 64 nt, Homo Sapiens
auacaguucuuguauuugaaaggaauugauccuuuuaaagaaacaugguguauauuguucuuac

SEQ ID NO: 579512 - RNA, 64 nt, Homo Sapiens
guggcaaaauggugcauguaauguaaguucugauuuaaagaauguucacugauguagauuaaua

SEQ ID NO: 579513 - RNA, 64 nt, Homo Sapiens
aaugaaacauuuuucugguucuuugcaccuuauuuuaaagaauaaguuuguuguugcaguccuu

SEQ ID NO: 579514 - RNA, 64 nt, Homo Sapiens
auuuuucucaagcuccuauuugugugauucauuuuuaaagaaauuguauaaugguagguguuug

SEQ ID NO: 579515 - RNA, 64 nt, Homo Sapiens
uuauuauggaagcacgauuuacuguuuuucauuuuuaaagaauaaauaaaaaugugugcucuuu

SEQ ID NO: 579516 - RNA, 64 nt, Homo Sapiens
uuguuguuaguuacgugaaauucuuaaccagauuuuaaagaaauacuuuucaauauuuucauau

SEQ ID NO: 579517 - RNA, 64 nt, Homo Sapiens
aaaaauuuuaaaaauuuaaaaaaaauuuuaaauuuuaaagaauucauguaaaacaggacaauuu

SEQ ID NO: 579518 - RNA, 64 nt, Homo Sapiens
uuaauugaugccuuuauugucccaaauuuaccacuuaaagaauucuauuuucauuucuguccug

SEQ ID NO: 579519 - RNA, 64 nt, Homo Sapiens
ccugcaaagccuaaaagauuuacuacuugucuccuuaaagaaaaaguuugccagcuccugaucu

SEQ ID NO: 579520 - RNA, 64 nt, Homo Sapiens
aaguauuugauguuuuguuugaaacaauacagcauuaaagaaccaauguuauucacuaauauca

SEQ ID NO: 579521 - RNA, 64 nt, Homo Sapiens
uugcacuuuuguugaggaaagacaguguaaauaguuaaagaauguugauaaaauugaaacauuu

SEQ ID NO: 579522 - RNA, 64 nt, Homo Sapiens
uccucugccccauucacuauuuaccaauugggaauuaaagaaauaauuaauuugaacaguuaug

SEQ ID NO: 579523 - RNA, 64 nt, Homo Sapiens
guuguauugcauuuuugggggaagcaaauugacuuuaaagaaaaaaguuguggcaaaagaugcu

SEQ ID NO: 579524 - RNA, 64 nt, Homo Sapiens
ggagaguguuuauuuuguuuugaaaaacauauauuuaaagaaauggugcugugugauccuugga

SEQ ID NO: 579525 - RNA, 64 nt, Homo Sapiens
cuuaguuuugccacaacagcgggcgucuuuugcuuuaaagaauucucugagcccugcauugcaa

SEQ ID NO: 579526 - RNA, 64 nt, Homo Sapiens
uucacacaccacuuaauggggaaauaguuaauuguuaaagaaaacuucuuguagccucacauuc

SEQ ID NO: 579527 - RNA, 64 nt, Homo Sapiens
cugcaucacaauugagguaauguagagcaacauguuaaagaaugaugguuagcagaagcuguug

SEQ ID NO: 579528 - RNA, 64 nt, Homo Sapiens
ccuuagguuucuaaguacccuuucugacuccuauuuaaagaaccuuuuuuauuuuuauauauuu

SEQ ID NO: 579529 - RNA, 64 nt, Homo Sapiens
uuuuauuuuuauacaauguugagggcagucaucuuuaaagaacaauagcacucaucuuucaaga

SEQ ID NO: 579530 - RNA, 64 nt, Homo Sapiens
ugggugguaucucugccuuuagaggcaauuacccuuaaagaaucugcaucuguauccugcuggg

SEQ ID NO: 579531 - RNA, 64 nt, Homo Sapiens
cuccaauucagccugagugcuagggaacauuuucuuaaagaacauuugccaaggcacacaaaaa

SEQ ID NO: 579532 - RNA, 64 nt, Homo Sapiens
ugacuugguacuuaaaagaaaauacauuguacaguuaaagaaauuuugaaaaccuucaaauuag

SEQ ID NO: 579533 - RNA, 64 nt, Homo Sapiens
auuccuacagauuuucaaugagauuugaaaauuauuaaagaaaaugaacagagaggccauggga

SEQ ID NO: 579534 - RNA, 64 nt, Homo Sapiens
aggguuuuuaguuuuaucuacucuucuauugaaguuaaagaaagaaaaaaagauuuuuuuauuu

SEQ ID NO: 579535 - RNA, 64 nt, Homo Sapiens
guaauugguugucacuguuguacggugucuagaauuaaagaauacauguaaacuuucaugguau

SEQ ID NO: 579536 - RNA, 64 nt, Homo Sapiens
acacauuuccauucauggauauuugucaacagauuuaaagaaaaccacaguuauuaauuaaaga

SEQ ID NO: 579537 - RNA, 64 nt, Homo Sapiens
ugucaacagauuuaaagaaaaccacaguuauuaauuaaagaaaauuaauuauguguaguuauaa

SEQ ID NO: 579538 - RNA, 64 nt, Homo Sapiens
cugaccaugugauguacauuuauuaugucuuuuuuuaaagaauggaaauauuuauuucagaggc

SEQ ID NO: 579539 - RNA, 64 nt, Homo Sapiens
cuaccaguuaaacuacuuuaauacacauucauuuuuaaagaaaauguuuguuuuaacauaaaua

SEQ ID NO: 579540 - RNA, 64 nt, Homo Sapiens
guaguuuagauauucaaaaguaugcauguagaauuuaaagaauauguuaaaaauuauuaauuuu

SEQ ID NO: 579541 - RNA, 64 nt, Homo Sapiens
uaugaaggauucaaugaaugaucucuagaaagauuuaaagaagaauauucagauaaggauguug

SEQ ID NO: 579542 - RNA, 64 nt, Homo Sapiens
acacacacacacacacacacaguuuaaugaaggcuuaaagaauccaaggagacagauguuguau

SEQ ID NO: 579543 - RNA, 64 nt, Homo Sapiens
ucaaaucuguuuuccugaguauaaauaagaguauuuaaagaaauaauuuggauugcuuuuguuu

SEQ ID NO: 579544 - RNA, 64 nt, Homo Sapiens
gaucguuccauacaguaccuuguuuaucugcuucuuaaagaaucagccgagacaccauaaaaga

SEQ ID NO: 579545 - RNA, 64 nt, Homo Sapiens
ugaccacaguugauugaaccagagcacuuauugcuuaaagaauaacagaguucuagagcugggg

SEQ ID NO: 579546 - RNA, 64 nt, Homo Sapiens
aaguguuagagauggugaauauauuccauuuuaguuaaagaacaaauuuccugaauuuuaagca

SEQ ID NO: 579547 - RNA, 64 nt, Homo Sapiens
agaauuuaaacucuuugucucauugaaaguuugguuaaagaacuugaacauauuucuaaauuug

SEQ ID NO: 579548 - RNA, 64 nt, Homo Sapiens
cccaaaugggcccauuccccuaauaguuuuauuuuuaaagaaagccauacauagaaugcuucaa

SEQ ID NO: 579549 - RNA, 64 nt, Homo Sapiens
aauauacaguauauauuaauaauguacaugguguuuaaagaaugguaagcauuguuaauuucug

SEQ ID NO: 579550 - RNA, 64 nt, Homo Sapiens
caaaggaaaauauuuucacagaaugcccagcuaguuaaagaaugauaccaacagugaagcugug

SEQ ID NO: 579551 - RNA, 64 nt, Homo Sapiens
ccugggggccgguugcggugacucucuggaaccauuaaagaauucagcagucuuuagccagaga

SEQ ID NO: 579552 - RNA, 64 nt, Homo Sapiens
uauacuguauuuuaccaacccucccaagucuuuuuuaaagaaagcuucuaaguugauuuuuuuc

SEQ ID NO: 579553 - RNA, 64 nt, Homo Sapiens
uuuugguuggauaaaaacaugaggaauuuuauauuuaaagaacugacaaggcagaguuuaaagu

SEQ ID NO: 579554 - RNA, 64 nt, Homo Sapiens
caugcccaaaacacuacuacuuugcuuuuaugcuuuaaagaaugacuagauuauagaguuuauu

SEQ ID NO: 579555 - RNA, 64 nt, Homo Sapiens
acaaauuuuaggagacuucaucucaaguccuuuuuuaaagaaugucuuuccccaaaagugauga

SEQ ID NO: 579556 - RNA, 64 nt, Homo Sapiens
cuucugaaugguuuuauuguucuuguaaucuagcuuaaagaaauguuaacugggagggugcuga

SEQ ID NO: 579557 - RNA, 64 nt, Homo Sapiens
aguugcgcaaaaauuguuaaauccuuugucuuuauuaaagaaaaauuugaguaacauuaaguuu

SEQ ID NO: 579558 - RNA, 64 nt, Homo Sapiens
uuggaaacauuuucauaaagcuccauggagaguuuuaaagaaacauauguagcaugauuuugua

SEQ ID NO: 579559 - RNA, 64 nt, Homo Sapiens
gguuuuuuuguaaauccuuguauuccuauuuuuuuuaaagaaaaaaaaaaaaccuuaagcugca

SEQ ID NO: 579560 - RNA, 64 nt, Homo Sapiens
uugcaaauguuauaaaugaacaauugggaaaugguuaaagaagugauggugcauugugugguag

SEQ ID NO: 579561 - RNA, 64 nt, Homo Sapiens
uggugcauugugugguagaauauuaugcauauguuuaaagaaucauauuuucuaagauuauuug

SEQ ID NO: 579562 - RNA, 64 nt, Homo Sapiens
gaugauuuauuuucagcaacaauucaguauuuucuuaaagaaagagucagaagcucaucauugg

SEQ ID NO: 579563 - RNA, 64 nt, Homo Sapiens
auuuugaauauaaauuuaagacaaagcuguaaauuuaaagaaucuuguucuuuaaaauacauag

SEQ ID NO: 579564 - RNA, 64 nt, Homo Sapiens
ggagugggcaacagugaaaaaaagaagauaauuuuuaaagaauguugauuguccuggggcuaag

SEQ ID NO: 579565 - RNA, 64 nt, Homo Sapiens
acacuaguguccaauuucauguaccagaguuauuuuaaagaaaauagacuuugcuaacuuacua

SEQ ID NO: 579566 - RNA, 64 nt, Homo Sapiens
auuuuuagaauaagaauuuggaagcuucaugcacuuaaagaaguaagaauauugcaaaauacau

SEQ ID NO: 579567 - RNA, 64 nt, Homo Sapiens
gaugaaaggcaggccuauuuaacauuuauuuuuuuuaaagaaaaucugagggaaauguuuugua

SEQ ID NO: 579568 - RNA, 64 nt, Homo Sapiens
uaauauagauacaaagucugugucuaaauauuauuuaaagaagugauuuuucauucucuuggau

SEQ ID NO: 579569 - RNA, 64 nt, Homo Sapiens
ucuccuacuaauauucccaagcuccauaugccaauuaaagaagaaacaaaaauaaaaguuuguc

SEQ ID NO: 579570 - RNA, 64 nt, Homo Sapiens
ccugagaauguauccccaaauugcaguucccacauuaaagaagacauguaauggcaguuauauu

SEQ ID NO: 579571 - RNA, 64 nt, Homo Sapiens
aaauugaaauguaaggcuguacaacucacuccuuuuaaagaaaaagcauuuaaccccccuguac

SEQ ID NO: 579572 - RNA, 64 nt, Homo Sapiens
agcuccgauaaggacuuuuuaguaaauguuggcuuuaaagaaauaagaacccaucuguuaaugu

SEQ ID NO: 579573 - RNA, 64 nt, Homo Sapiens
caucuguuaauguaguaaauguaaaauuucuuauuuaaagaaccauaaaaucagugaguugaaa

SEQ ID NO: 579574 - RNA, 64 nt, Homo Sapiens
auuccucaguguaacauuugaaggucuuuaucauuuaaagaaacagugaucaucuguuaauuuu

SEQ ID NO: 579575 - RNA, 64 nt, Homo Sapiens
cuuuccauauuguacuuuauuaaagaccacacgguuaaagaaaucuguaacacuggcacugaaa

SEQ ID NO: 579576 - RNA, 64 nt, Homo Sapiens
guagggcugcagugguggccagaauuagauaucuuuaaagaauuuuaaauacaauaaacacuuc

SEQ ID NO: 579577 - RNA, 64 nt, Homo Sapiens
gaacugaugcacuauauagaacgaauuuggguuuuuaaagaaauauuaaaaguuagguacugua

SEQ ID NO: 579578 - RNA, 64 nt, Homo Sapiens
auucacuugggcuuuuuuucuucccccucuuucuuuaaagaacugcucaauauucaaucuguug

SEQ ID NO: 579579 - RNA, 64 nt, Homo Sapiens
uguugugaagaaccugauuugcacucuguaguguuuaaagaaacaaagaaacucuaauauugaa

SEQ ID NO: 579580 - RNA, 64 nt, Homo Sapiens
uguuuggacuuuguaauuauuuuuuuagcaguaauuaaagaaaaaaguccucugugaggaauau

SEQ ID NO: 579581 - RNA, 64 nt, Homo Sapiens
aagcauuugguaagcuuuaucauauauauauuuuuuaaagaagagaaaaacaccuugagccuua

SEQ ID NO: 579582 - RNA, 64 nt, Homo Sapiens
cagcucaagcaauauuaauguagagaaaauguuuuuaaagaagcacaauuagccguaauaacau

SEQ ID NO: 579583 - RNA, 64 nt, Homo Sapiens
aaaguccaaaagucacuuuucccacucuggguccuuaaagaaacggaaugugcaacauucucug

SEQ ID NO: 579584 - RNA, 64 nt, Homo Sapiens
ugucaauccuagccuuccaaaaauaccagugaacuuaaagaauugguucuuuuacuaaguguuc

SEQ ID NO: 579585 - RNA, 64 nt, Homo Sapiens
uuucaugauuagauuugagccuuuuuauccuacuuuaaagaagcggaauaccgcugauugugcu

SEQ ID NO: 579586 - RNA, 64 nt, Homo Sapiens
aagccaagugaggagccagggcuaacaccugacauuaaagaagcucuaaggaaaggaugcauga

SEQ ID NO: 579587 - RNA, 64 nt, Homo Sapiens
uauuaaaguaauuuuuauaugucuauuauuucauuuaaagaauaugcugugcuaauaauggagu

SEQ ID NO: 579588 - RNA, 64 nt, Homo Sapiens
auggcaucucauuuuucaauacaugcucuuuugauuaaagaaacuuauuacuguugucaacuga

SEQ ID NO: 579589 - RNA, 64 nt, Homo Sapiens
uuuuuaaucgucaaccacuuugauucgaagggucuuaaagaauucuuugugaaagaaugugcuu

SEQ ID NO: 579590 - RNA, 64 nt, Homo Sapiens
gugagaaagggcauacauccaauuuagggugauuuuaaagaacauagagaauguucccaauuug

SEQ ID NO: 579591 - RNA, 64 nt, Homo Sapiens
gccuguuuucuugcaaauuuagcacuuggaacauuuaaagaaaggucuaugcugucauaugggg

SEQ ID NO: 579592 - RNA, 64 nt, Homo Sapiens
ccugccucaugguggcaacaugguucuugaacaauuaaagaaacaaaugacuuuuuggaauagc

SEQ ID NO: 579593 - RNA, 64 nt, Homo Sapiens
gcauucaaguaugacaauaucuggaauuguguuuuuaaagaaaauuuuguaauauauauaagga

SEQ ID NO: 579594 - RNA, 64 nt, Homo Sapiens
auacuuagaaggguuaauuggaugaaacuauaacuuaaagaauaucuaaaucuuuuucaccaug

SEQ ID NO: 579595 - RNA, 64 nt, Homo Sapiens
cauuguuuuugacuaugggagguuacuugaauuguuaaagaaaaauuuauucauguacaauuuu

SEQ ID NO: 579596 - RNA, 64 nt, Homo Sapiens
uaguuaggauaacuaaaauucugggccuaauuuuuuaaagaauccaagacaaacuaaacuuuac

SEQ ID NO: 579597 - RNA, 64 nt, Homo Sapiens
aauggcuguaugugaaauuugcaaaauacugguauuaaagaacgcugcagcuuuuuuaugucac

SEQ ID NO: 579598 - RNA, 64 nt, Homo Sapiens; identical to SEQ ID NO: 579596

SEQ ID NO: 579599 - RNA, 64 nt, Homo Sapiens; identical to SEQ ID NO: 579597

SEQ ID NO: 579600 - RNA, 64 nt, Homo Sapiens
accuuguagaagcucaaguguggaaaagaaaagcuuaaagaagcccuaaccaagcuguaucuuc

SEQ ID NO: 579601 - RNA, 63 nt, Homo Sapiens
ucacacugaauccuuuaacuuggccaaaggacccuuaaagaacaucuaguccaaugucaacau

SEQ ID NO: 579602 - RNA, 64 nt, Homo Sapiens
ggaucaugugugucagcaggccagauuuauugugccacacaaaaaugcuauuguucugcuauua

SEQ ID NO: 579603 - RNA, 64 nt, Homo Sapiens
cauuauaagaagcaaaccagcuaaguacuguaauccacacaacaaaaguaaaugugaaccuugu

SEQ ID NO: 579604 - RNA, 64 nt, Homo Sapiens
aaaagcagucuuagagagugugugaaacuugucaccacacaauaucccggaucaucagcacaau

SEQ ID NO: 579605 - RNA, 64 nt, Homo Sapiens
uccgcaguuuauucuggaugcagaugugggaaaaccacacaaaugacuuauuuguuuuaaugua

SEQ ID NO: 579606 - RNA, 64 nt, Homo Sapiens
aaguucaugggaauuuugugugcagguuaagaauccacacaacccacuuucuuagguaauucac

SEQ ID NO: 579607 - RNA, 64 nt, Homo Sapiens
ggauuauccacauaaucaaaaauaaaugagauguccacacaaaucuuauccuacauuauuggaa

SEQ ID NO: 579608 - RNA, 64 nt, Homo Sapiens
cuuacauacugauauuuagaaaugacuggaaaagccacacaacuucgguuacaaauccauaaca

SEQ ID NO: 579609 - RNA, 64 nt, Homo Sapiens
gauuuuuaaguacgaaguaacauaucacauugacccacacaaaaggggaucugcaucuagccug

SEQ ID NO: 579610 - RNA, 64 nt, Homo Sapiens
acacuuccucuaggaugccagcggaugcagugucccacacaaggagccugggcuguguaugccu

SEQ ID NO: 579611 - RNA, 60 nt, Homo Sapiens
cuugaaagccugugccagauaaagaggagcccacacaaagauucuggggagaagcuauag

SEQ ID NO: 579612 - RNA, 64 nt, Homo Sapiens
acauuccuugagcaaaauauacugcugugaauuugcaaacaagaaaucugagccaaaacuugac

SEQ ID NO: 579613 - RNA, 64 nt, Homo Sapiens
aaauaucugaauaggugcaguuuuaguuuaacaugcaaacaaccauuguugcuaccuauccuga

SEQ ID NO: 579614 - RNA, 64 nt, Homo Sapiens
gggcugguuuuaguacucugaaggacaaaaacaagcaaacaaaaaccccugcugcagcauuuca

SEQ ID NO: 579615 - RNA, 64 nt, Homo Sapiens
gagacccuaccucuuaaaaccaguuuucauuuaugcaaacaaggacaauuaagggaacccugac

SEQ ID NO: 579616 - RNA, 64 nt, Homo Sapiens
gauaggaggagaguccuucucggcagagcucacugcaaacaacuggaauugagguugcacacug

SEQ ID NO: 579617 - RNA, 64 nt, Homo Sapiens
acugacccuaucaccucugcggauguugguuccugcaaacaagaucuugacauuuucuuuuuua

SEQ ID NO: 579618 - RNA, 64 nt, Homo Sapiens
augauugauagcuggacagagcuugggauuuggugcaaacaaacaaauuagucguauuuuaaug

SEQ ID NO: 579619 - RNA, 64 nt, Homo Sapiens
uccaucagcauaaugacuguguguucugagaaaugcaaacaacuuuaugaaaguguggucaucu

SEQ ID NO: 579620 - RNA, 64 nt, Homo Sapiens
aaaaucaaaauacauuaggguuuacuugguuguggcaaacaaacaaaaaaugcuuucaguguug

SEQ ID NO: 579621 - RNA, 64 nt, Homo Sapiens
auaauauagguguuuuguagauucuugugucacugcaaacaauaugaacuccuuuuucguauug

SEQ ID NO: 579622 - RNA, 64 nt, Homo Sapiens
aguuaacaauuuuuaauggaaagagcauguuagagcaaacaaaugcauaagcaagacugagcag

SEQ ID NO: 579623 - RNA, 64 nt, Homo Sapiens
ugguuugaugguuugcugcauuaaagguauuugggcaaacaaaauuggagggcaagugacugca

SEQ ID NO: 579624 - RNA, 64 nt, Homo Sapiens
auaucauuuugugacuguaaacaauuauuuauuagcaaacaauugaucccagaagggcaaauug

SEQ ID NO: 579625 - RNA, 64 nt, Homo Sapiens
accgaauuggguuuagucaaucacugcacugcaugcaaacaagaaacgugucacacuugugacg

SEQ ID NO: 579626 - RNA, 64 nt, Homo Sapiens
aaagguuauguucauuuuucaaaaagggaaguaagcaaacaaauauugccaacucuucuauuua

SEQ ID NO: 579627 - RNA, 64 nt, Homo Sapiens
ccaaauucgaacauucuuagucucaguugcacgugcaaacaaaugacaacuaauguuaauaaga

SEQ ID NO: 579628 - RNA, 64 nt, Homo Sapiens
cuuaaagagauaagcauuaacuugacauuauacugcaaacaaaauuugugcugggacugcuaua

SEQ ID NO: 579629 - RNA, 64 nt, Homo Sapiens
uggugauacuucuaaacuaucuguacauuugauugcaaacaaauaacauuuuucauaauuagug

SEQ ID NO: 579630 - RNA, 64 nt, Homo Sapiens
acucugguuaauaaaugcugacagauaaaaaauugcaaacaaguaagagcuuuaaaauauuuuc

SEQ ID NO: 579631 - RNA, 64 nt, Homo Sapiens
gaauacauauguguauauaagagguuauugauaaacuucugaggcagacauuugucucgcuuuu

SEQ ID NO: 579632 - RNA, 64 nt, Homo Sapiens
aucccuuguacuugccuacuguaauauggauuucacuucugaacaguuuacagcacaauauuua

SEQ ID NO: 579633 - RNA, 64 nt, Homo Sapiens
gccuaauaaauaugacauggaccucuagcuccauacuucugauuuguccuagaguucuuuccug

SEQ ID NO: 579634 - RNA, 64 nt, Homo Sapiens
aaaggucuccaugcuuuugccauugcaacuucccacuucugacgaccuugauuuuggggacaca

SEQ ID NO: 579635 - RNA, 64 nt, Homo Sapiens
uggacaaaagugguagggaaauuguucccucuccacuucugaaaguaugaugauguauuaagga

SEQ ID NO: 579636 - RNA, 64 nt, Homo Sapiens
ugauuuuuuuaauuacuggcuucugauuucuuucacuucugauccuuuuccuuuuucucagaug

SEQ ID NO: 579637 - RNA, 62 nt, Homo Sapiens; identical to SEQ ID NO: 275089

SEQ ID NO: 579638 - RNA, 64 nt, Homo Sapiens
gggcucaucgacgccugugacagggagaaaggauacuucugaacaaggagccuccaagcaaauc

SEQ ID NO: 579639 - RNA, 64 nt, Homo Sapiens
ggucacuagcuuggccauagcaccucucuucuccacuucugaucugcugcuucuaaccuucuau

SEQ ID NO: 579640 - RNA, 64 nt, Homo Sapiens
caggguuucaccacguuagccaugauggucucaaacuucugaccucauaauccacccaccuugg

SEQ ID NO: 579641 - RNA, 64 nt, Homo Sapiens
ugggugugauugucuuccuauggaagaaguugugacuucugacagaugggucauauucuuuauu

SEQ ID NO: 579642 - RNA, 64 nt, Homo Sapiens
uacagcucaggaaaagccuguuugcaggacgaaaacuucugaguacacauuuguaaauacauug

SEQ ID NO: 579643 - RNA, 64 nt, Homo Sapiens
cagacagaggaggauagcucuuuccagaauccacacuucugaccucagccucggucucaugaac

SEQ ID NO: 579644 - RNA, 64 nt, Homo Sapiens
gagaagaccuacuugaacagggcauauuuuuuagacuucugaacaucaguauguucgaggguac

SEQ ID NO: 579645 - RNA, 64 nt, Homo Sapiens
gccaaaaaaugugacugacgaucuuuaggaaugaacuucugaggagaaauuuagaguaguugaa

SEQ ID NO: 579646 - RNA, 64 nt, Homo Sapiens
aagagaccaauuaagauucaagaccaaguuuaccacuucugauggucugacuucgugaauauag

SEQ ID NO: 579647 - RNA, 64 nt, Homo Sapiens
acauggaaaauucaaggauucgaugcuguuaacaacuucugauauauuucauauacuuccgucu

SEQ ID NO: 579648 - RNA, 64 nt, Homo Sapiens
ugaagggaaaaaaaccaccccaguagaagaacuuacuucugaaagcuauguaacagauacacua

SEQ ID NO: 579649 - RNA, 64 nt, Homo Sapiens
aaucuguaucgugccaaaguuguaucacuguuaaacuucugaagacauaaccaguugagucuua

SEQ ID NO: 579650 - RNA, 64 nt, Homo Sapiens
gcucaacccauauuauuggcuguacauccuggucacuucugacuucuguuuuuacuaauggaag

SEQ ID NO: 579651 - RNA, 64 nt, Homo Sapiens
cucagccaaggacacuugauuggaagcagcugacacuucugaaacccggguguuuccaacguca

SEQ ID NO: 579652 - RNA, 64 nt, Homo Sapiens
cugugaaaugugagaaguacguauuacaagaucaacuucugacccuuaucguugguguuuucca

SEQ ID NO: 579653 - RNA, 64 nt, Homo Sapiens
ugaucucuaccccugggugagaccagaaccucagggcugauacuguugaguggcuuccucgguu

SEQ ID NO: 579654 - RNA, 64 nt, Homo Sapiens
caaucuggcugucggaacagauucuggugucuugggcugauaacaguguuguugauucugauug

SEQ ID NO: 579655 - RNA, 64 nt, Homo Sapiens
gcucacgugcgcugcaggaagguaggagagagauggcugauacucagcaguaggcuguggagcg

SEQ ID NO: 579656 - RNA, 64 nt, Homo Sapiens
uuuuggccuuaguuccagguuuccagaacgaaagggcugauaauacaaaugagaucagcucucc

SEQ ID NO: 579657 - RNA, 64 nt, Homo Sapiens
uugaaaagacgguguuaugcuuggguguuagugaggcugauaugucaugucaaucgauaaaccc

SEQ ID NO: 579658 - RNA, 64 nt, Homo Sapiens
acugacaaaagcaaaucaauaacucuaaauucugggcugauauaaagaaaaaaacaauauugga

SEQ ID NO: 579659 - RNA, 64 nt, Homo Sapiens; identical to SEQ ID NO: 557328

SEQ ID NO: 579660 - RNA, 64 nt, Homo Sapiens; identical to SEQ ID NO: 557329

SEQ ID NO: 579661 - RNA, 64 nt, Homo Sapiens; identical to SEQ ID NO: 557330

SEQ ID NO: 579662 - RNA, 64 nt, Homo Sapiens; identical to SEQ ID NO: 557331

SEQ ID NO: 579663 - RNA, 64 nt, Homo Sapiens; identical to SEQ ID NO: 557332

SEQ ID NO: 579664 - RNA, 64 nt, Homo Sapiens; identical to SEQ ID NO: 557333

SEQ ID NO: 579665 - RNA, 64 nt, Homo Sapiens; identical to SEQ ID NO: 557334

SEQ ID NO: 579666 - RNA, 64 nt, Homo Sapiens; identical to SEQ ID NO: 557335

SEQ ID NO: 579667 - RNA, 64 nt, Homo Sapiens; identical to SEQ ID NO: 557336

SEQ ID NO: 579668 - RNA, 64 nt, Homo Sapiens; identical to SEQ ID NO: 557337

SEQ ID NO: 579669 - RNA, 64 nt, Homo Sapiens; identical to SEQ ID NO: 557338

SEQ ID NO: 579670 - RNA, 64 nt, Homo Sapiens; identical to SEQ ID NO: 557339

SEQ ID NO: 579671 - RNA, 64 nt, Homo Sapiens; identical to SEQ ID NO: 557340

SEQ ID NO: 579672 - RNA, 64 nt, Homo Sapiens; identical to SEQ ID NO: 557341

SEQ ID NO: 579673 - RNA, 64 nt, Homo Sapiens; identical to SEQ ID NO: 557342

SEQ ID NO: 579674 - RNA, 64 nt, Homo Sapiens; identical to SEQ ID NO: 557343

SEQ ID NO: 579675 - RNA, 64 nt, Homo Sapiens; identical to SEQ ID NO: 557344

SEQ ID NO: 579676 - RNA, 64 nt, Homo Sapiens; identical to SEQ ID NO: 557345

SEQ ID NO: 579677 - RNA, 64 nt, Homo Sapiens; identical to SEQ ID NO: 557346

SEQ ID NO: 579678 - RNA, 64 nt, Homo Sapiens; identical to SEQ ID NO: 557347

SEQ ID NO: 579679 - RNA, 64 nt, Homo Sapiens; identical to SEQ ID NO: 557348

SEQ ID NO: 579680 - RNA, 64 nt, Homo Sapiens; identical to SEQ ID NO: 557349

SEQ ID NO: 579681 - RNA, 64 nt, Homo Sapiens; identical to SEQ ID NO: 557350

SEQ ID NO: 579682 - RNA, 64 nt, Homo Sapiens; identical to SEQ ID NO: 557351

SEQ ID NO: 579683 - RNA, 64 nt, Homo Sapiens; identical to SEQ ID NO: 557352

SEQ ID NO: 579684 - RNA, 64 nt, Homo Sapiens; identical to SEQ ID NO: 557353

SEQ ID NO: 579685 - RNA, 64 nt, Homo Sapiens; identical to SEQ ID NO: 557354

SEQ ID NO: 579686 - RNA, 64 nt, Homo Sapiens; identical to SEQ ID NO: 557355

SEQ ID NO: 579687 - RNA, 64 nt, Homo Sapiens; identical to SEQ ID NO: 125759

SEQ ID NO: 579688 - RNA, 64 nt, Homo Sapiens; identical to SEQ ID NO: 125760

SEQ ID NO: 579689 - RNA, 64 nt, Homo Sapiens
ccaccaugacugguguccuugaggucacugggguggccccuaacgcagauuaauuagucaccau

SEQ ID NO: 579690 - RNA, 64 nt, Homo Sapiens
agccgguggccucuguaggaaacuugcuucccgaggccccuacauucacaacuuuggacugucc

SEQ ID NO: 579691 - RNA, 64 nt, Homo Sapiens
uuucacaacuuuggacugucaugcccggcuccacggccccuacuaauggccggcgugagccacc

SEQ ID NO: 579692 - RNA, 64 nt, Homo Sapiens
ggcuucugccuuucaccaauaguugugguauugaggccccuaaaucaauuauucaggccccuac

SEQ ID NO: 579693 - RNA, 64 nt, Homo Sapiens
guugugguauugaggccccuacaucaauuauucaggccccuacaacuuuuccauuaauuucuca

SEQ ID NO: 579694 - RNA, 64 nt, Homo Sapiens
cagaagcuguacuuuuaccaguuucuuugucccaccaacuuaaaaaaaaaaaguacaauucauu

SEQ ID NO: 579695 - RNA, 64 nt, Homo Sapiens
ucaaccuagguuauaagacuguuauucuauagcuccaacuuaaggugccuuuuuaauucccuac

SEQ ID NO: 579696 - RNA, 58 nt, Homo Sapiens
aggaaggcgacagccccuaggggccggcccaacuuagacgcggcucuccuccggcagg

SEQ ID NO: 579697 - RNA, 64 nt, Homo Sapiens
uaacuuuaaacaucuuucaucuucugaaagcugcccaacuuaaauccucauagaugucuuucuc

SEQ ID NO: 579698 - RNA, 64 nt, Homo Sapiens
auuuuuucuuauuugaguccaccaaaggauaaugccaacuuauauaaguucucaaaucaugccu

SEQ ID NO: 579699 - RNA, 64 nt, Homo Sapiens
agaaauuuuucucauaauauauaccuaugugaaaccaacuuaucugcauaauuaaaucuaauac

SEQ ID NO: 579700 - RNA, 63 nt, Homo Sapiens
gcacacacagauggucacacagagauacgcaaacacaccgaugcacacgcacauagagauaug

SEQ ID NO: 579701 - RNA, 63 nt, Homo Sapiens
acaucagugcacacggaugcacagagauaugcacacaccgaugugcgcacacacagauaugca

SEQ ID NO: 579702 - RNA, 63 nt, Homo Sapiens
acauggaugagcacacacacaccaaugcgcacacacaccgauguacacacacagaugcacaca

SEQ ID NO: 579703 - RNA, 63 nt, Homo Sapiens
auguacacacacagaugcacacacagaugcacacacaccgaugcugacuccaugugugcuguc

SEQ ID NO: 579704 - RNA, 64 nt, Homo Sapiens; identical to SEQ ID NO: 274997

SEQ ID NO: 579705 - RNA, 64 nt, Homo Sapiens; identical to SEQ ID NO: 274998

SEQ ID NO: 579706 - RNA, 64 nt, Homo Sapiens; identical to SEQ ID NO: 274999

SEQ ID NO: 579707 - RNA, 64 nt, Homo Sapiens; identical to SEQ ID NO: 275000

SEQ ID NO: 579708 - RNA, 64 nt, Homo Sapiens; identical to SEQ ID NO: 51839

SEQ ID NO: 579709 - RNA, 64 nt, Homo Sapiens; identical to SEQ ID NO: 51840

SEQ ID NO: 579710 - RNA, 64 nt, Homo Sapiens; identical to SEQ ID NO: 51841

SEQ ID NO: 579711 - RNA, 64 nt, Homo Sapiens; identical to SEQ ID NO: 51842

SEQ ID NO: 579712 - RNA, 64 nt, Homo Sapiens; identical to SEQ ID NO: 51843

SEQ ID NO: 579713 - RNA, 64 nt, Homo Sapiens; identical to SEQ ID NO: 51844

SEQ ID NO: 579714 - RNA, 64 nt, Homo Sapiens; identical to SEQ ID NO: 51845

SEQ ID NO: 579715 - RNA, 64 nt, Homo Sapiens; identical to SEQ ID NO: 51846

SEQ ID NO: 579716 - RNA, 64 nt, Homo Sapiens; identical to SEQ ID NO: 51847

SEQ ID NO: 579717 - RNA, 64 nt, Homo Sapiens; identical to SEQ ID NO: 51848

SEQ ID NO: 579718 - RNA, 64 nt, Homo Sapiens; identical to SEQ ID NO: 51849

SEQ ID NO: 579719 - RNA, 64 nt, Homo Sapiens; identical to SEQ ID NO: 51850

SEQ ID NO: 579720 - RNA, 64 nt, Homo Sapiens; identical to SEQ ID NO: 51851

SEQ ID NO: 579721 - RNA, 64 nt, Homo Sapiens; identical to SEQ ID NO: 51852

SEQ ID NO: 579722 - RNA, 64 nt, Homo Sapiens; identical to SEQ ID NO: 51853

SEQ ID NO: 579723 - RNA, 64 nt, Homo Sapiens; identical to SEQ ID NO: 51854

SEQ ID NO: 579724 - RNA, 64 nt, Homo Sapiens; identical to SEQ ID NO: 51855

SEQ ID NO: 579725 - RNA, 64 nt, Homo Sapiens; identical to SEQ ID NO: 51856

SEQ ID NO: 579726 - RNA, 64 nt, Homo Sapiens; identical to SEQ ID NO: 51857

SEQ ID NO: 579727 - RNA, 64 nt, Homo Sapiens; identical to SEQ ID NO: 51858

SEQ ID NO: 579728 - RNA, 64 nt, Homo Sapiens; identical to SEQ ID NO: 51859

SEQ ID NO: 579729 - RNA, 64 nt, Homo Sapiens; identical to SEQ ID NO: 51860

SEQ ID NO: 579730 - RNA, 64 nt, Homo Sapiens; identical to SEQ ID NO: 51861

SEQ ID NO: 579731 - RNA, 64 nt, Homo Sapiens; identical to SEQ ID NO: 51862

SEQ ID NO: 579732 - RNA, 64 nt, Homo Sapiens; identical to SEQ ID NO: 51863

SEQ ID NO: 579733 - RNA, 64 nt, Homo Sapiens; identical to SEQ ID NO: 51864

SEQ ID NO: 579734 - RNA, 64 nt, Homo Sapiens; identical to SEQ ID NO: 51865

SEQ ID NO: 579735 - RNA, 64 nt, Homo Sapiens; identical to SEQ ID NO: 51866

SEQ ID NO: 579736 - RNA, 64 nt, Homo Sapiens; identical to SEQ ID NO: 51867

SEQ ID NO: 579737 - RNA, 64 nt, Homo Sapiens; identical to SEQ ID NO: 51868

SEQ ID NO: 579738 - RNA, 64 nt, Homo Sapiens; identical to SEQ ID NO: 51869

SEQ ID NO: 579739 - RNA, 64 nt, Homo Sapiens; identical to SEQ ID NO: 51870

SEQ ID NO: 579740 - RNA, 64 nt, Homo Sapiens; identical to SEQ ID NO: 51871

SEQ ID NO: 579741 - RNA, 64 nt, Homo Sapiens; identical to SEQ ID NO: 51872

SEQ ID NO: 579742 - RNA, 64 nt, Homo Sapiens; identical to SEQ ID NO: 51873

SEQ ID NO: 579743 - RNA, 64 nt, Homo Sapiens; identical to SEQ ID NO: 51874

SEQ ID NO: 579744 - RNA, 64 nt, Homo Sapiens; identical to SEQ ID NO: 51875

SEQ ID NO: 579745 - RNA, 64 nt, Homo Sapiens; identical to SEQ ID NO: 51876

SEQ ID NO: 579746 - RNA, 64 nt, Homo Sapiens; identical to SEQ ID NO: 51877

SEQ ID NO: 579747 - RNA, 64 nt, Homo Sapiens; identical to SEQ ID NO: 51878

SEQ ID NO: 579748 - RNA, 64 nt, Homo Sapiens; identical to SEQ ID NO: 51879

SEQ ID NO: 579749 - RNA, 64 nt, Homo Sapiens; identical to SEQ ID NO: 51880

SEQ ID NO: 579750 - RNA, 64 nt, Homo Sapiens; identical to SEQ ID NO: 51881

SEQ ID NO: 579751 - RNA, 64 nt, Homo Sapiens; identical to SEQ ID NO: 51882

SEQ ID NO: 579752 - RNA, 64 nt, Homo Sapiens; identical to SEQ ID NO: 51883

SEQ ID NO: 579753 - RNA, 64 nt, Homo Sapiens; identical to SEQ ID NO: 51884

SEQ ID NO: 579754 - RNA, 64 nt, Homo Sapiens; identical to SEQ ID NO: 51885

SEQ ID NO: 579755 - RNA, 64 nt, Homo Sapiens; identical to SEQ ID NO: 51886

SEQ ID NO: 579756 - RNA, 64 nt, Homo Sapiens; identical to SEQ ID NO: 51887

SEQ ID NO: 579757 - RNA, 64 nt, Homo Sapiens; identical to SEQ ID NO: 51888

SEQ ID NO: 579758 - RNA, 64 nt, Homo Sapiens; identical to SEQ ID NO: 51889

SEQ ID NO: 579759 - RNA, 64 nt, Homo Sapiens; identical to SEQ ID NO: 51890

SEQ ID NO: 579760 - RNA, 63 nt, Homo Sapiens; identical to SEQ ID NO: 51891

SEQ ID NO: 579761 - RNA, 64 nt, Homo Sapiens; identical to SEQ ID NO: 51892

SEQ ID NO: 579762 - RNA, 64 nt, Homo Sapiens; identical to SEQ ID NO: 51893

SEQ ID NO: 579763 - RNA, 64 nt, Homo Sapiens; identical to SEQ ID NO: 51894

SEQ ID NO: 579764 - RNA, 64 nt, Homo Sapiens; identical to SEQ ID NO: 51895

SEQ ID NO: 579765 - RNA, 64 nt, Homo Sapiens; identical to SEQ ID NO: 51896

SEQ ID NO: 579766 - RNA, 64 nt, Homo Sapiens; identical to SEQ ID NO: 51897

SEQ ID NO: 579767 - RNA, 64 nt, Homo Sapiens; identical to SEQ ID NO: 51898

SEQ ID NO: 579768 - RNA, 64 nt, Homo Sapiens; identical to SEQ ID NO: 51899

SEQ ID NO: 579769 - RNA, 64 nt, Homo Sapiens; identical to SEQ ID NO: 51900

SEQ ID NO: 579770 - RNA, 64 nt, Homo Sapiens; identical to SEQ ID NO: 51901

SEQ ID NO: 579771 - RNA, 64 nt, Homo Sapiens; identical to SEQ ID NO: 51902

SEQ ID NO: 579772 - RNA, 64 nt, Homo Sapiens; identical to SEQ ID NO: 51903

SEQ ID NO: 579773 - RNA, 64 nt, Homo Sapiens; identical to SEQ ID NO: 51904

SEQ ID NO: 579774 - RNA, 64 nt, Homo Sapiens; identical to SEQ ID NO: 51905

SEQ ID NO: 579775 - RNA, 64 nt, Homo Sapiens; identical to SEQ ID NO: 51906

SEQ ID NO: 579776 - RNA, 64 nt, Homo Sapiens; identical to SEQ ID NO: 51907

SEQ ID NO: 579777 - RNA, 64 nt, Homo Sapiens; identical to SEQ ID NO: 51908

SEQ ID NO: 579778 - RNA, 64 nt, Homo Sapiens; identical to SEQ ID NO: 51909

SEQ ID NO: 579779 - RNA, 64 nt, Homo Sapiens; identical to SEQ ID NO: 51910

SEQ ID NO: 579780 - RNA, 64 nt, Homo Sapiens; identical to SEQ ID NO: 51911

SEQ ID NO: 579781 - RNA, 64 nt, Homo Sapiens; identical to SEQ ID NO: 51912

SEQ ID NO: 579782 - RNA, 64 nt, Homo Sapiens; identical to SEQ ID NO: 51913

SEQ ID NO: 579783 - RNA, 64 nt, Homo Sapiens; identical to SEQ ID NO: 51914

SEQ ID NO: 579784 - RNA, 64 nt, Homo Sapiens; identical to SEQ ID NO: 51915

SEQ ID NO: 579785 - RNA, 64 nt, Homo Sapiens; identical to SEQ ID NO: 51916

SEQ ID NO: 579786 - RNA, 64 nt, Homo Sapiens; identical to SEQ ID NO: 51917

SEQ ID NO: 579787 - RNA, 64 nt, Homo Sapiens; identical to SEQ ID NO: 238457

SEQ ID NO: 579788 - RNA, 64 nt, Homo Sapiens; identical to SEQ ID NO: 238458

SEQ ID NO: 579789 - RNA, 64 nt, Homo Sapiens; identical to SEQ ID NO: 238459

SEQ ID NO: 579790 - RNA, 64 nt, Homo Sapiens; identical to SEQ ID NO: 238460

SEQ ID NO: 579791 - RNA, 64 nt, Homo Sapiens; identical to SEQ ID NO: 76474

SEQ ID NO: 579792 - RNA, 64 nt, Homo Sapiens; identical to SEQ ID NO: 76475

SEQ ID NO: 579793 - RNA, 64 nt, Homo Sapiens; identical to SEQ ID NO: 76476

SEQ ID NO: 579794 - RNA, 64 nt, Homo Sapiens; identical to SEQ ID NO: 76477

SEQ ID NO: 579795 - RNA, 64 nt, Homo Sapiens; identical to SEQ ID NO: 76478

SEQ ID NO: 579796 - RNA, 64 nt, Homo Sapiens; identical to SEQ ID NO: 76479

SEQ ID NO: 579797 - RNA, 64 nt, Homo Sapiens; identical to SEQ ID NO: 76480

SEQ ID NO: 579798 - RNA, 64 nt, Homo Sapiens; identical to SEQ ID NO: 76481

SEQ ID NO: 579799 - RNA, 64 nt, Homo Sapiens; identical to SEQ ID NO: 76482

SEQ ID NO: 579800 - RNA, 64 nt, Homo Sapiens; identical to SEQ ID NO: 76483

SEQ ID NO: 579801 - RNA, 64 nt, Homo Sapiens
gcugggggaggcacuggcgggaggccucgggcuccccuggaagggcgcugggcuggcgggucag

SEQ ID NO: 579802 - RNA, 64 nt, Homo Sapiens
aggcuguggaagaacucugcucgagggcagggugcccuggaacacugguaguucuggggcuggg

SEQ ID NO: 579803 - RNA, 64 nt, Homo Sapiens
guauuuguuuucugugagagcacugaaauggcagcccuggaaucuacaauuuggcucuccacug

SEQ ID NO: 579804 - RNA, 64 nt, Homo Sapiens
cccacagccgguucugcacuuaucaccgagucgccccuggaagcagauucccauugaguuuucc

SEQ ID NO: 579805 - RNA, 64 nt, Homo Sapiens
cagcacccugggugccauuccagaaaagaggagacccuggaauuuggggcaugugugccugugg

SEQ ID NO: 579806 - RNA, 64 nt, Homo Sapiens
gggaguugagucacaagagggaauguucccugcacccuggaaaggcuggaaggcagggcagagg

SEQ ID NO: 579807 - RNA, 64 nt, Homo Sapiens
aguauuuuucccacauuuuuugaacucccucucucccuggaauauauaauuugaccacagcauc

SEQ ID NO: 579808 - RNA, 64 nt, Homo Sapiens
cugaaauggguggaauagcgguuggugucuuacucccuggaagcacuaaaagcaguauuuuaag

SEQ ID NO: 579809 - RNA, 57 nt, Homo Sapiens; identical to SEQ ID NO: 265214

SEQ ID NO: 579810 - RNA, 64 nt, Homo Sapiens
gccuuaaaaagauacacaaagaugggcugugggucccuggaaagggggagaguugcccuuuaca

SEQ ID NO: 579811 - RNA, 64 nt, Homo Sapiens
uaaugaacaugagaaaauuuauacuguagagaaacccuggaaaugugaagaacguggcaaaguu

SEQ ID NO: 579812 - RNA, 64 nt, Homo Sapiens
uuacuguauauauauaauuccuacugaagaaauccccuggaaaugcaaaaaauguggcaggauu

SEQ ID NO: 579813 - RNA, 64 nt, Homo Sapiens
agcacuggacauagaccuaggaagcaaccuguuacccuggaaaguuaguccuuuaaaaugagua

SEQ ID NO: 579814 - RNA, 64 nt, Homo Sapiens
gggucagggcccuuggugguaagaggccuugcagcccuggaaguuuucuggaacagcggcaacc

SEQ ID NO: 579815 - RNA, 64 nt, Homo Sapiens
aacaucuuccgaguccuucuugccccucacucugcccuggaauccagaagagccucauccuguc

SEQ ID NO: 579816 - RNA, 64 nt, Homo Sapiens
gccugucccuuuucucugggcucugaauccuagacccuggaauauagguguugagauggggcag

SEQ ID NO: 579817 - RNA, 64 nt, Homo Sapiens
uaugaagcccuuggugaugaggacauagcaucugcccuggaaaucguuauuccaacauaauauu

SEQ ID NO: 579818 - RNA, 64 nt, Homo Sapiens
ucguuauuccaacauaauauuauuuucuagaaugcccuggaaggacagaauauuuaaaaauaua

SEQ ID NO: 579819 - RNA, 64 nt, Homo Sapiens
agccccaagagaauaccaagacaagcaggcuguucccuggaaaaaaucuaaugcaaggagggcu

SEQ ID NO: 579820 - RNA, 64 nt, Homo Sapiens
agccacacagggggcgugggagcaucccaguuaucccuggaaagcuagaaggggacagaggugu

SEQ ID NO: 579821 - RNA, 64 nt, Homo Sapiens
aggguuucaagaagucuuagggcuuccagggguccccuggaagcuuuagaauauuuauggguuu

SEQ ID NO: 579822 - RNA, 64 nt, Homo Sapiens
cuggacaggaagccuggcacccacuucugucuuccccuggaacugggcacuggcguacacuggu

SEQ ID NO: 579823 - RNA, 64 nt, Homo Sapiens
caccauggauggucuuccuaguugccuggggaaacccuggaaugggcaucaggagaaagcaaca

SEQ ID NO: 579824 - RNA, 64 nt, Homo Sapiens
ccguuuucugauuugcuuugccaugggcucaggacccuggaauuuuccaccccacugggcccaa

SEQ ID NO: 579825 - RNA, 64 nt, Homo Sapiens
aucccguccuguaucauaugaggccaggccgagccccuggaaccaggagggcagggcugcgggg

SEQ ID NO: 579826 - RNA, 64 nt, Homo Sapiens
acauguaaaggucuguuguugaauuguacucugccccuggaagcagauacagauggcugccugc

SEQ ID NO: 579827 - RNA, 64 nt, Homo Sapiens
uugcccucugaggccccguacaccagaagggaggcccuggaaaauuuugugcuuccaacguggc

SEQ ID NO: 579828 - RNA, 64 nt, Homo Sapiens
cgugaacuaacaaaccugugaacuguaaauaggccccuggaagcacgugcuuaagcccuuuugc

SEQ ID NO: 579829 - RNA, 64 nt, Homo Sapiens
gcuaggaucugcauuuucagguuccgagccugaccccuggaacugaccagcgcucgauugucag

SEQ ID NO: 579830 - RNA, 64 nt, Homo Sapiens
gucugggaaauugaggggacggcaggcccggcugcccuggaacugggagacagggagaaucccc

SEQ ID NO: 579831 - RNA, 64 nt, Homo Sapiens
gaacugggagacagggagaauccccugccggggucccuggaaacagugcccaccccacaucacu

SEQ ID NO: 579832 - RNA, 64 nt, Homo Sapiens
ccaucuuucuucaucuuuccgucgggagcccaugcccuggaaauugagcgaggggcagauucua

SEQ ID NO: 579833 - RNA, 64 nt, Homo Sapiens
gucuggucugagugugacuucuccaucuuccaaucccuggaaaaucugcaccuccuuucccucu

SEQ ID NO: 579834 - RNA, 64 nt, Homo Sapiens
cccaaggcucuuccuccagcgucacaugcuugugcccuggaagccgaguuuuguaggggucacu

SEQ ID NO: 579835 - RNA, 64 nt, Homo Sapiens; identical to SEQ ID NO: 145129

SEQ ID NO: 579836 - RNA, 64 nt, Homo Sapiens; identical to SEQ ID NO: 145130

SEQ ID NO: 579837 - RNA, 64 nt, Homo Sapiens; identical to SEQ ID NO: 145131

SEQ ID NO: 579838 - RNA, 64 nt, Homo Sapiens; identical to SEQ ID NO: 145132

SEQ ID NO: 579839 - RNA, 64 nt, Homo Sapiens; identical to SEQ ID NO: 145133

SEQ ID NO: 579840 - RNA, 64 nt, Homo Sapiens; identical to SEQ ID NO: 145134

SEQ ID NO: 579841 - RNA, 64 nt, Homo Sapiens; identical to SEQ ID NO: 145135

SEQ ID NO: 579842 - RNA, 64 nt, Homo Sapiens; identical to SEQ ID NO: 145136

SEQ ID NO: 579843 - RNA, 64 nt, Homo Sapiens; identical to SEQ ID NO: 145137

SEQ ID NO: 579844 - RNA, 64 nt, Homo Sapiens; identical to SEQ ID NO: 145138

SEQ ID NO: 579845 - RNA, 64 nt, Homo Sapiens; identical to SEQ ID NO: 145139

SEQ ID NO: 579846 - RNA, 64 nt, Homo Sapiens; identical to SEQ ID NO: 145140

SEQ ID NO: 579847 - RNA, 64 nt, Homo Sapiens; identical to SEQ ID NO: 145141

SEQ ID NO: 579848 - RNA, 64 nt, Homo Sapiens; identical to SEQ ID NO: 145142

SEQ ID NO: 579849 - RNA, 64 nt, Homo Sapiens; identical to SEQ ID NO: 145143

SEQ ID NO: 579850 - RNA, 64 nt, Homo Sapiens; identical to SEQ ID NO: 145144

SEQ ID NO: 579851 - RNA, 64 nt, Homo Sapiens; identical to SEQ ID NO: 145145

SEQ ID NO: 579852 - RNA, 64 nt, Homo Sapiens; identical to SEQ ID NO: 145146

SEQ ID NO: 579853 - RNA, 64 nt, Homo Sapiens; identical to SEQ ID NO: 145147

SEQ ID NO: 579854 - RNA, 64 nt, Homo Sapiens; identical to SEQ ID NO: 145148

SEQ ID NO: 579855 - RNA, 64 nt, Homo Sapiens; identical to SEQ ID NO: 145149

SEQ ID NO: 579856 - RNA, 64 nt, Homo Sapiens; identical to SEQ ID NO: 145150

SEQ ID NO: 579857 - RNA, 64 nt, Homo Sapiens; identical to SEQ ID NO: 145151

SEQ ID NO: 579858 - RNA, 64 nt, Homo Sapiens; identical to SEQ ID NO: 145152

SEQ ID NO: 579859 - RNA, 64 nt, Homo Sapiens; identical to SEQ ID NO: 145153

SEQ ID NO: 579860 - RNA, 64 nt, Homo Sapiens; identical to SEQ ID NO: 145154

SEQ ID NO: 579861 - RNA, 64 nt, Homo Sapiens; identical to SEQ ID NO: 145155

SEQ ID NO: 579862 - RNA, 64 nt, Homo Sapiens; identical to SEQ ID NO: 145156

SEQ ID NO: 579863 - RNA, 64 nt, Homo Sapiens; identical to SEQ ID NO: 145157

SEQ ID NO: 579864 - RNA, 64 nt, Homo Sapiens; identical to SEQ ID NO: 145158

SEQ ID NO: 579865 - RNA, 64 nt, Homo Sapiens; identical to SEQ ID NO: 145159

SEQ ID NO: 579866 - RNA, 64 nt, Homo Sapiens; identical to SEQ ID NO: 145160

SEQ ID NO: 579867 - RNA, 64 nt, Homo Sapiens; identical to SEQ ID NO: 145161

SEQ ID NO: 579868 - RNA, 64 nt, Homo Sapiens; identical to SEQ ID NO: 145162

SEQ ID NO: 579869 - RNA, 64 nt, Homo Sapiens; identical to SEQ ID NO: 145163

SEQ ID NO: 579870 - RNA, 64 nt, Homo Sapiens; identical to SEQ ID NO: 145164

SEQ ID NO: 579871 - RNA, 64 nt, Homo Sapiens; identical to SEQ ID NO: 145165

SEQ ID NO: 579872 - RNA, 64 nt, Homo Sapiens; identical to SEQ ID NO: 145166

SEQ ID NO: 579873 - RNA, 64 nt, Homo Sapiens; identical to SEQ ID NO: 145167

SEQ ID NO: 579874 - RNA, 64 nt, Homo Sapiens; identical to SEQ ID NO: 145168

SEQ ID NO: 579875 - RNA, 64 nt, Homo Sapiens; identical to SEQ ID NO: 145169

SEQ ID NO: 579876 - RNA, 64 nt, Homo Sapiens; identical to SEQ ID NO: 145170

SEQ ID NO: 579877 - RNA, 64 nt, Homo Sapiens; identical to SEQ ID NO: 145171

SEQ ID NO: 579878 - RNA, 64 nt, Homo Sapiens; identical to SEQ ID NO: 145172

SEQ ID NO: 579879 - RNA, 64 nt, Homo Sapiens; identical to SEQ ID NO: 145173

SEQ ID NO: 579880 - RNA, 64 nt, Homo Sapiens; identical to SEQ ID NO: 145174

SEQ ID NO: 579881 - RNA, 64 nt, Homo Sapiens; identical to SEQ ID NO: 145175

SEQ ID NO: 579882 - RNA, 64 nt, Homo Sapiens; identical to SEQ ID NO: 145176

SEQ ID NO: 579883 - RNA, 64 nt, Homo Sapiens; identical to SEQ ID NO: 145177

SEQ ID NO: 579884 - RNA, 64 nt, Homo Sapiens; identical to SEQ ID NO: 145178

SEQ ID NO: 579885 - RNA, 64 nt, Homo Sapiens; identical to SEQ ID NO: 145179

SEQ ID NO: 579886 - RNA, 64 nt, Homo Sapiens; identical to SEQ ID NO: 134735

SEQ ID NO: 579887 - RNA, 64 nt, Homo Sapiens; identical to SEQ ID NO: 134736

SEQ ID NO: 579888 - RNA, 64 nt, Homo Sapiens; identical to SEQ ID NO: 134737

SEQ ID NO: 579889 - RNA, 64 nt, Homo Sapiens; identical to SEQ ID NO: 134738

SEQ ID NO: 579890 - RNA, 64 nt, Homo Sapiens; identical to SEQ ID NO: 134739

SEQ ID NO: 579891 - RNA, 64 nt, Homo Sapiens; identical to SEQ ID NO: 134740

SEQ ID NO: 579892 - RNA, 64 nt, Homo Sapiens; identical to SEQ ID NO: 134741

SEQ ID NO: 579893 - RNA, 64 nt, Homo Sapiens; identical to SEQ ID NO: 134742

SEQ ID NO: 579894 - RNA, 64 nt, Homo Sapiens; identical to SEQ ID NO: 134743

SEQ ID NO: 579895 - RNA, 64 nt, Homo Sapiens; identical to SEQ ID NO: 134744

SEQ ID NO: 579896 - RNA, 64 nt, Homo Sapiens; identical to SEQ ID NO: 134745

SEQ ID NO: 579897 - RNA, 64 nt, Homo Sapiens; identical to SEQ ID NO: 134746

SEQ ID NO: 579898 - RNA, 64 nt, Homo Sapiens; identical to SEQ ID NO: 134747

SEQ ID NO: 579899 - RNA, 64 nt, Homo Sapiens; identical to SEQ ID NO: 134748

SEQ ID NO: 579900 - RNA, 64 nt, Homo Sapiens; identical to SEQ ID NO: 134749

SEQ ID NO: 579901 - RNA, 64 nt, Homo Sapiens; identical to SEQ ID NO: 134750

SEQ ID NO: 579902 - RNA, 64 nt, Homo Sapiens; identical to SEQ ID NO: 134751

SEQ ID NO: 579903 - RNA, 64 nt, Homo Sapiens; identical to SEQ ID NO: 134752

SEQ ID NO: 579904 - RNA, 64 nt, Homo Sapiens; identical to SEQ ID NO: 134753

SEQ ID NO: 579905 - RNA, 64 nt, Homo Sapiens; identical to SEQ ID NO: 134754

SEQ ID NO: 579906 - RNA, 64 nt, Homo Sapiens
agccauaaagagucaaucucuacgagucugucagagcggccauaugaauguaaguuuugagaaa

SEQ ID NO: 579907 - RNA, 64 nt, Homo Sapiens
uucaucuucucacugugaguguuccagccuggaaagcggccaagucucugcuaugcuggagacg

SEQ ID NO: 579908 - RNA, 56 nt, Homo Sapiens
agcagaucccgcaguccugaggagccagcggccaccugcggggagaccaccgccgc

SEQ ID NO: 579909 - RNA, 64 nt, Homo Sapiens
acucggauaccucuugauuucuguggauaagggaagcggccacuucucccucccugagacccga

SEQ ID NO: 579910 - RNA, 64 nt, Homo Sapiens
ccaggggccaggcuugcggagggggagcccgcggagcggccagacuccccggggcgcucagccu

SEQ ID NO: 579911 - RNA, 64 nt, Homo Sapiens
ccuggagcccagccugggagcgcaaaacccaagaagcggccagaacgcaccuccggcuccggcg

SEQ ID NO: 579912 - RNA, 64 nt, Homo Sapiens
gagcagcuccuuggccagaggcuuacaggcaacaagcggccaggcagggucuggccccgggcug

SEQ ID NO: 579913 - RNA, 64 nt, Homo Sapiens
ucccccgaccccuaccccacgcuacccagggcccagcggccaccccguaccacuguugauguga

SEQ ID NO: 579914 - RNA, 64 nt, Homo Sapiens
ccuucauuccacggaggaagcugaggccacagggagcggccaucgccauugggaaggggcgacu

SEQ ID NO: 579915 - RNA, 64 nt, Homo Sapiens; identical to SEQ ID NO: 242974

SEQ ID NO: 579916 - RNA, 64 nt, Homo Sapiens; identical to SEQ ID NO: 242975

SEQ ID NO: 579917 - RNA, 64 nt, Homo Sapiens; identical to SEQ ID NO: 242976

SEQ ID NO: 579918 - RNA, 64 nt, Homo Sapiens; identical to SEQ ID NO: 242977

SEQ ID NO: 579919 - RNA, 64 nt, Homo Sapiens; identical to SEQ ID NO: 242978

SEQ ID NO: 579920 - RNA, 64 nt, Homo Sapiens; identical to SEQ ID NO: 242979

SEQ ID NO: 579921 - RNA, 64 nt, Homo Sapiens; identical to SEQ ID NO: 242980

SEQ ID NO: 579922 - RNA, 64 nt, Homo Sapiens; identical to SEQ ID NO: 242981

SEQ ID NO: 579923 - RNA, 64 nt, Homo Sapiens; identical to SEQ ID NO: 242982

SEQ ID NO: 579924 - RNA, 64 nt, Homo Sapiens; identical to SEQ ID NO: 242983

SEQ ID NO: 579925 - RNA, 64 nt, Homo Sapiens; identical to SEQ ID NO: 242984

SEQ ID NO: 579926 - RNA, 64 nt, Homo Sapiens; identical to SEQ ID NO: 242985

SEQ ID NO: 579927 - RNA, 64 nt, Homo Sapiens; identical to SEQ ID NO: 415481

SEQ ID NO: 579928 - RNA, 64 nt, Homo Sapiens; identical to SEQ ID NO: 415482

SEQ ID NO: 579929 - RNA, 64 nt, Homo Sapiens; identical to SEQ ID NO: 415483

SEQ ID NO: 579930 - RNA, 64 nt, Homo Sapiens; identical to SEQ ID NO: 415484

SEQ ID NO: 579931 - RNA, 64 nt, Homo Sapiens; identical to SEQ ID NO: 415485

SEQ ID NO: 579932 - RNA, 64 nt, Homo Sapiens; identical to SEQ ID NO: 415486

SEQ ID NO: 579933 - RNA, 64 nt, Homo Sapiens; identical to SEQ ID NO: 415487

SEQ ID NO: 579934 - RNA, 64 nt, Homo Sapiens; identical to SEQ ID NO: 415488

SEQ ID NO: 579935 - RNA, 64 nt, Homo Sapiens; identical to SEQ ID NO: 415489

SEQ ID NO: 579936 - RNA, 64 nt, Homo Sapiens; identical to SEQ ID NO: 415490

SEQ ID NO: 579937 - RNA, 64 nt, Homo Sapiens; identical to SEQ ID NO: 415491

SEQ ID NO: 579938 - RNA, 64 nt, Homo Sapiens; identical to SEQ ID NO: 415492

SEQ ID NO: 579939 - RNA, 64 nt, Homo Sapiens; identical to SEQ ID NO: 415493

SEQ ID NO: 579940 - RNA, 64 nt, Homo Sapiens; identical to SEQ ID NO: 415494

SEQ ID NO: 579941 - RNA, 64 nt, Homo Sapiens; identical to SEQ ID NO: 415495

SEQ ID NO: 579942 - RNA, 64 nt, Homo Sapiens; identical to SEQ ID NO: 415496

SEQ ID NO: 579943 - RNA, 64 nt, Homo Sapiens; identical to SEQ ID NO: 415497

SEQ ID NO: 579944 - RNA, 64 nt, Homo Sapiens; identical to SEQ ID NO: 415498

SEQ ID NO: 579945 - RNA, 64 nt, Homo Sapiens; identical to SEQ ID NO: 415499

SEQ ID NO: 579946 - RNA, 64 nt, Homo Sapiens; identical to SEQ ID NO: 415500

SEQ ID NO: 579947 - RNA, 64 nt, Homo Sapiens; identical to SEQ ID NO: 415501

SEQ ID NO: 579948 - RNA, 64 nt, Homo Sapiens; identical to SEQ ID NO: 415502

SEQ ID NO: 579949 - RNA, 58 nt, Homo Sapiens; identical to SEQ ID NO: 415503

SEQ ID NO: 579950 - RNA, 64 nt, Homo Sapiens; identical to SEQ ID NO: 415504

SEQ ID NO: 579951 - RNA, 64 nt, Homo Sapiens; identical to SEQ ID NO: 415505

SEQ ID NO: 579952 - RNA, 64 nt, Homo Sapiens; identical to SEQ ID NO: 415506

SEQ ID NO: 579953 - RNA, 64 nt, Homo Sapiens; identical to SEQ ID NO: 415507

SEQ ID NO: 579954 - RNA, 64 nt, Homo Sapiens; identical to SEQ ID NO: 415508

SEQ ID NO: 579955 - RNA, 64 nt, Homo Sapiens; identical to SEQ ID NO: 415509

SEQ ID NO: 579956 - RNA, 64 nt, Homo Sapiens; identical to SEQ ID NO: 415510

SEQ ID NO: 579957 - RNA, 64 nt, Homo Sapiens; identical to SEQ ID NO: 415511

SEQ ID NO: 579958 - RNA, 64 nt, Homo Sapiens; identical to SEQ ID NO: 415512

SEQ ID NO: 579959 - RNA, 63 nt, Homo Sapiens; identical to SEQ ID NO: 415513

SEQ ID NO: 579960 - RNA, 64 nt, Homo Sapiens; identical to SEQ ID NO: 415514

SEQ ID NO: 579961 - RNA, 64 nt, Homo Sapiens; identical to SEQ ID NO: 415515

SEQ ID NO: 579962 - RNA, 64 nt, Homo Sapiens; identical to SEQ ID NO: 415516

SEQ ID NO: 579963 - RNA, 64 nt, Homo Sapiens; identical to SEQ ID NO: 415517

SEQ ID NO: 579964 - RNA, 64 nt, Homo Sapiens; identical to SEQ ID NO: 415518

SEQ ID NO: 579965 - RNA, 64 nt, Homo Sapiens; identical to SEQ ID NO: 415519

SEQ ID NO: 579966 - RNA, 64 nt, Homo Sapiens; identical to SEQ ID NO: 415520

SEQ ID NO: 579967 - RNA, 64 nt, Homo Sapiens; identical to SEQ ID NO: 415521

SEQ ID NO: 579968 - RNA, 57 nt, Homo Sapiens; identical to SEQ ID NO: 415522

SEQ ID NO: 579969 - RNA, 64 nt, Homo Sapiens; identical to SEQ ID NO: 415523

SEQ ID NO: 579970 - RNA, 64 nt, Homo Sapiens; identical to SEQ ID NO: 415524

SEQ ID NO: 579971 - RNA, 64 nt, Homo Sapiens; identical to SEQ ID NO: 415525

SEQ ID NO: 579972 - RNA, 64 nt, Homo Sapiens; identical to SEQ ID NO: 242974

SEQ ID NO: 579973 - RNA, 64 nt, Homo Sapiens; identical to SEQ ID NO: 242975

SEQ ID NO: 579974 - RNA, 64 nt, Homo Sapiens; identical to SEQ ID NO: 242976

SEQ ID NO: 579975 - RNA, 64 nt, Homo Sapiens; identical to SEQ ID NO: 242977

SEQ ID NO: 579976 - RNA, 64 nt, Homo Sapiens; identical to SEQ ID NO: 242978

SEQ ID NO: 579977 - RNA, 64 nt, Homo Sapiens; identical to SEQ ID NO: 242979

SEQ ID NO: 579978 - RNA, 64 nt, Homo Sapiens; identical to SEQ ID NO: 242980

SEQ ID NO: 579979 - RNA, 64 nt, Homo Sapiens; identical to SEQ ID NO: 242981

SEQ ID NO: 579980 - RNA, 64 nt, Homo Sapiens; identical to SEQ ID NO: 242982

SEQ ID NO: 579981 - RNA, 64 nt, Homo Sapiens; identical to SEQ ID NO: 242983

SEQ ID NO: 579982 - RNA, 64 nt, Homo Sapiens; identical to SEQ ID NO: 242984

SEQ ID NO: 579983 - RNA, 64 nt, Homo Sapiens; identical to SEQ ID NO: 242985

SEQ ID NO: 579984 - RNA, 64 nt, Homo Sapiens; identical to SEQ ID NO: 415481

SEQ ID NO: 579985 - RNA, 64 nt, Homo Sapiens; identical to SEQ ID NO: 415482

SEQ ID NO: 579986 - RNA, 64 nt, Homo Sapiens; identical to SEQ ID NO: 415483

SEQ ID NO: 579987 - RNA, 64 nt, Homo Sapiens; identical to SEQ ID NO: 415484

SEQ ID NO: 579988 - RNA, 64 nt, Homo Sapiens; identical to SEQ ID NO: 415485

SEQ ID NO: 579989 - RNA, 64 nt, Homo Sapiens; identical to SEQ ID NO: 415486

SEQ ID NO: 579990 - RNA, 64 nt, Homo Sapiens; identical to SEQ ID NO: 415487

SEQ ID NO: 579991 - RNA, 64 nt, Homo Sapiens; identical to SEQ ID NO: 415488

SEQ ID NO: 579992 - RNA, 64 nt, Homo Sapiens; identical to SEQ ID NO: 415489

SEQ ID NO: 579993 - RNA, 64 nt, Homo Sapiens; identical to SEQ ID NO: 415490

SEQ ID NO: 579994 - RNA, 64 nt, Homo Sapiens; identical to SEQ ID NO: 415491

SEQ ID NO: 579995 - RNA, 64 nt, Homo Sapiens; identical to SEQ ID NO: 415492

SEQ ID NO: 579996 - RNA, 64 nt, Homo Sapiens; identical to SEQ ID NO: 415493

SEQ ID NO: 579997 - RNA, 64 nt, Homo Sapiens; identical to SEQ ID NO: 415494

SEQ ID NO: 579998 - RNA, 64 nt, Homo Sapiens; identical to SEQ ID NO: 415495

SEQ ID NO: 579999 - RNA, 64 nt, Homo Sapiens; identical to SEQ ID NO: 415496

SEQ ID NO: 580000 - RNA, 64 nt, Homo Sapiens; identical to SEQ ID NO: 415497

SEQ ID NO: 580001 - RNA, 64 nt, Homo Sapiens; identical to SEQ ID NO: 415498

SEQ ID NO: 580002 - RNA, 64 nt, Homo Sapiens; identical to SEQ ID NO: 415499

SEQ ID NO: 580003 - RNA, 64 nt, Homo Sapiens; identical to SEQ ID NO: 415500

SEQ ID NO: 580004 - RNA, 64 nt, Homo Sapiens; identical to SEQ ID NO: 415501

SEQ ID NO: 580005 - RNA, 64 nt, Homo Sapiens; identical to SEQ ID NO: 415502

SEQ ID NO: 580006 - RNA, 58 nt, Homo Sapiens; identical to SEQ ID NO: 415503

SEQ ID NO: 580007 - RNA, 64 nt, Homo Sapiens; identical to SEQ ID NO: 415504

SEQ ID NO: 580008 - RNA, 64 nt, Homo Sapiens; identical to SEQ ID NO: 415505

SEQ ID NO: 580009 - RNA, 64 nt, Homo Sapiens; identical to SEQ ID NO: 415506

SEQ ID NO: 580010 - RNA, 64 nt, Homo Sapiens; identical to SEQ ID NO: 415507

SEQ ID NO: 580011 - RNA, 64 nt, Homo Sapiens; identical to SEQ ID NO: 415508

SEQ ID NO: 580012 - RNA, 64 nt, Homo Sapiens; identical to SEQ ID NO: 415509

SEQ ID NO: 580013 - RNA, 64 nt, Homo Sapiens; identical to SEQ ID NO: 415510

SEQ ID NO: 580014 - RNA, 64 nt, Homo Sapiens; identical to SEQ ID NO: 415511

SEQ ID NO: 580015 - RNA, 64 nt, Homo Sapiens; identical to SEQ ID NO: 415512

SEQ ID NO: 580016 - RNA, 63 nt, Homo Sapiens; identical to SEQ ID NO: 415513

SEQ ID NO: 580017 - RNA, 64 nt, Homo Sapiens; identical to SEQ ID NO: 415514

SEQ ID NO: 580018 - RNA, 64 nt, Homo Sapiens; identical to SEQ ID NO: 415515

SEQ ID NO: 580019 - RNA, 64 nt, Homo Sapiens; identical to SEQ ID NO: 415516

SEQ ID NO: 580020 - RNA, 64 nt, Homo Sapiens; identical to SEQ ID NO: 415517

SEQ ID NO: 580021 - RNA, 64 nt, Homo Sapiens; identical to SEQ ID NO: 415518

SEQ ID NO: 580022 - RNA, 64 nt, Homo Sapiens; identical to SEQ ID NO: 415519

SEQ ID NO: 580023 - RNA, 64 nt, Homo Sapiens; identical to SEQ ID NO: 415520

SEQ ID NO: 580024 - RNA, 64 nt, Homo Sapiens; identical to SEQ ID NO: 415521

SEQ ID NO: 580025 - RNA, 57 nt, Homo Sapiens; identical to SEQ ID NO: 415522

SEQ ID NO: 580026 - RNA, 64 nt, Homo Sapiens; identical to SEQ ID NO: 415523

SEQ ID NO: 580027 - RNA, 64 nt, Homo Sapiens; identical to SEQ ID NO: 415524

SEQ ID NO: 580028 - RNA, 64 nt, Homo Sapiens; identical to SEQ ID NO: 415525

SEQ ID NO: 580029 - RNA, 64 nt, Homo Sapiens; identical to SEQ ID NO: 138852

SEQ ID NO: 580030 - RNA, 64 nt, Homo Sapiens; identical to SEQ ID NO: 138853

SEQ ID NO: 580031 - RNA, 64 nt, Homo Sapiens; identical to SEQ ID NO: 138854

SEQ ID NO: 580032 - RNA, 64 nt, Homo Sapiens; identical to SEQ ID NO: 138855

SEQ ID NO: 580033 - RNA, 64 nt, Homo Sapiens; identical to SEQ ID NO: 138856

SEQ ID NO: 580034 - RNA, 64 nt, Homo Sapiens; identical to SEQ ID NO: 138857

SEQ ID NO: 580035 - RNA, 64 nt, Homo Sapiens; identical to SEQ ID NO: 138858

SEQ ID NO: 580036 - RNA, 64 nt, Homo Sapiens; identical to SEQ ID NO: 138859

SEQ ID NO: 580037 - RNA, 64 nt, Homo Sapiens; identical to SEQ ID NO: 138860

SEQ ID NO: 580038 - RNA, 64 nt, Homo Sapiens; identical to SEQ ID NO: 138861

SEQ ID NO: 580039 - RNA, 64 nt, Homo Sapiens; identical to SEQ ID NO: 138862

SEQ ID NO: 580040 - RNA, 64 nt, Homo Sapiens; identical to SEQ ID NO: 138863

SEQ ID NO: 580041 - RNA, 64 nt, Homo Sapiens; identical to SEQ ID NO: 138864

SEQ ID NO: 580042 - RNA, 64 nt, Homo Sapiens; identical to SEQ ID NO: 138865

SEQ ID NO: 580043 - RNA, 64 nt, Homo Sapiens; identical to SEQ ID NO: 138866

SEQ ID NO: 580044 - RNA, 64 nt, Homo Sapiens; identical to SEQ ID NO: 138867

SEQ ID NO: 580045 - RNA, 64 nt, Homo Sapiens; identical to SEQ ID NO: 138868

SEQ ID NO: 580046 - RNA, 64 nt, Homo Sapiens; identical to SEQ ID NO: 138869

SEQ ID NO: 580047 - RNA, 64 nt, Homo Sapiens; identical to SEQ ID NO: 138870

SEQ ID NO: 580048 - RNA, 64 nt, Homo Sapiens; identical to SEQ ID NO: 138871

SEQ ID NO: 580049 - RNA, 64 nt, Homo Sapiens; identical to SEQ ID NO: 138872

SEQ ID NO: 580050 - RNA, 64 nt, Homo Sapiens; identical to SEQ ID NO: 138873

SEQ ID NO: 580051 - RNA, 64 nt, Homo Sapiens; identical to SEQ ID NO: 138874

SEQ ID NO: 580052 - RNA, 64 nt, Homo Sapiens; identical to SEQ ID NO: 138875

SEQ ID NO: 580053 - RNA, 64 nt, Homo Sapiens; identical to SEQ ID NO: 138876

SEQ ID NO: 580054 - RNA, 64 nt, Homo Sapiens; identical to SEQ ID NO: 138877

SEQ ID NO: 580055 - RNA, 64 nt, Homo Sapiens; identical to SEQ ID NO: 138878

SEQ ID NO: 580056 - RNA, 64 nt, Homo Sapiens; identical to SEQ ID NO: 138879

SEQ ID NO: 580057 - RNA, 64 nt, Homo Sapiens; identical to SEQ ID NO: 138880

SEQ ID NO: 580058 - RNA, 64 nt, Homo Sapiens; identical to SEQ ID NO: 138881

SEQ ID NO: 580059 - RNA, 64 nt, Homo Sapiens; identical to SEQ ID NO: 138882

SEQ ID NO: 580060 - RNA, 64 nt, Homo Sapiens; identical to SEQ ID NO: 138883

SEQ ID NO: 580061 - RNA, 64 nt, Homo Sapiens; identical to SEQ ID NO: 138884

SEQ ID NO: 580062 - RNA, 64 nt, Homo Sapiens; identical to SEQ ID NO: 138885

SEQ ID NO: 580063 - RNA, 64 nt, Homo Sapiens; identical to SEQ ID NO: 138886

SEQ ID NO: 580064 - RNA, 64 nt, Homo Sapiens; identical to SEQ ID NO: 138887

SEQ ID NO: 580065 - RNA, 64 nt, Homo Sapiens; identical to SEQ ID NO: 138888

SEQ ID NO: 580066 - RNA, 64 nt, Homo Sapiens; identical to SEQ ID NO: 138889

SEQ ID NO: 580067 - RNA, 64 nt, Homo Sapiens; identical to SEQ ID NO: 138890

SEQ ID NO: 580068 - RNA, 64 nt, Homo Sapiens; identical to SEQ ID NO: 138891

SEQ ID NO: 580069 - RNA, 64 nt, Homo Sapiens; identical to SEQ ID NO: 138892

SEQ ID NO: 580070 - RNA, 64 nt, Homo Sapiens
aaaaagaccuccagauaggcagacagacagauggaccaccaaccuggacagacagccaaagcuu

SEQ ID NO: 580071 - RNA, 64 nt, Homo Sapiens
gccaacagcuugauagaccagugcagccagagagaccaccaaacagagcccccaaaagacagac

SEQ ID NO: 580072 - RNA, 64 nt, Homo Sapiens
ccgaucggcucuuauuagcuugaucuggaaaucuaccaccaauccccgcuccacaagacaccug

SEQ ID NO: 580073 - RNA, 64 nt, Homo Sapiens
ccgaucggcucuuauuagcuugcuuuggaaauccaccaccaauccccgcuccacaagacaccug

SEQ ID NO: 580074 - RNA, 64 nt, Homo Sapiens
gaugaggaaucugaguugcccuccuccuguggccaccaccaaagccuccugaagccucugggaa

SEQ ID NO: 580075 - RNA, 64 nt, Homo Sapiens
cccagccaaugggccaccucaacgauguccacacaccaccaaaauucacaccccaaaaugaccc

SEQ ID NO: 580076 - RNA, 64 nt, Homo Sapiens
ccaccuugaugucugcugugacaucagaggugccaccaccaaagcacucuucccacccuagucu

SEQ ID NO: 580077 - RNA, 64 nt, Homo Sapiens
guugggaccugagggacagaggaucggaauggaaaccaccaacgugcacuggcacccucagaag

SEQ ID NO: 580078 - RNA, 64 nt, Homo Sapiens
auucgccauacuagcggagggaaauaaagguacuuuacagcaacacugucgcugaagcacuuaa

SEQ ID NO: 580079 - RNA, 64 nt, Homo Sapiens
accucagugauuacaauugaaaaggaaauagcaguuacagcaaacaaaaguugaggacuuggug

SEQ ID NO: 580080 - RNA, 64 nt, Homo Sapiens
gaacaugaacauucacuuagauuauaaggaaaauuuacagcaguuauggguagccuuuuuacca

SEQ ID NO: 580081 - RNA, 64 nt, Homo Sapiens
gaagagauuuuuagaguggggcacugagaauucuuuacagcaaauccagagucuuagcucacau

SEQ ID NO: 580082 - RNA, 64 nt, Homo Sapiens
acaguguucuacuuuuuacauaaucuuccaggcauuacagcagccuguuacuccguaggcuucu

SEQ ID NO: 580083 - RNA, 64 nt, Homo Sapiens
aacauaacucagucaaaugauauuaugagaauaguuacagcaaauauuuucugcuguauguuag

SEQ ID NO: 580084 - RNA, 64 nt, Homo Sapiens
gauagaaaaaugcacauuuugcuuuguauuuucuuuacagcauagcuaaugccaaaaugcucug

SEQ ID NO: 580085 - RNA, 64 nt, Homo Sapiens
uuuaagucuugugaaacugucuccucccuguuguuuacagcauagaggugugacaggcucuagu

SEQ ID NO: 580086 - RNA, 64 nt, Homo Sapiens
uuuaaaugugaccauuuuucugguaugaauaaacuuacagcaacaaauaaucaaagauacaauu

SEQ ID NO: 580087 - RNA, 64 nt, Homo Sapiens
ggcucaaaguaucuuuuagacuuuuaaggacaauuuacagcaaaugaaauuuaugaugcuguga

SEQ ID NO: 580088 - RNA, 64 nt, Homo Sapiens
ccagaaacauacauacacugauauuuauauacaguuacagcagguuugauaaugcauaaauguu

SEQ ID NO: 580089 - RNA, 64 nt, Homo Sapiens
uguuauagguuaaggagacaagaaaauacauucuuuacagcaaagugagccaccgugcccggcc

SEQ ID NO: 580090 - RNA, 64 nt, Homo Sapiens
gaauugcggcaguaacauuuuguguuaaucucauuuacagcauuaguuccauuagguuuucaca

SEQ ID NO: 580091 - RNA, 64 nt, Homo Sapiens
uugccauacaucuauuuaaguaaaccugucucuauuacagcaugguugcagaacugagccuugg

SEQ ID NO: 580092 - RNA, 64 nt, Homo Sapiens; identical to SEQ ID NO: 517266

SEQ ID NO: 580093 - RNA, 64 nt, Homo Sapiens; identical to SEQ ID NO: 517267

SEQ ID NO: 580094 - RNA, 64 nt, Homo Sapiens; identical to SEQ ID NO: 517268

SEQ ID NO: 580095 - RNA, 64 nt, Homo Sapiens; identical to SEQ ID NO: 517269

SEQ ID NO: 580096 - RNA, 64 nt, Homo Sapiens; identical to SEQ ID NO: 517270

SEQ ID NO: 580097 - RNA, 64 nt, Homo Sapiens; identical to SEQ ID NO: 517271

SEQ ID NO: 580098 - RNA, 64 nt, Homo Sapiens; identical to SEQ ID NO: 517272

SEQ ID NO: 580099 - RNA, 64 nt, Homo Sapiens; identical to SEQ ID NO: 517273

SEQ ID NO: 580100 - RNA, 64 nt, Homo Sapiens; identical to SEQ ID NO: 517274

SEQ ID NO: 580101 - RNA, 64 nt, Homo Sapiens; identical to SEQ ID NO: 517275

SEQ ID NO: 580102 - RNA, 64 nt, Homo Sapiens; identical to SEQ ID NO: 517276

SEQ ID NO: 580103 - RNA, 64 nt, Homo Sapiens; identical to SEQ ID NO: 517277

SEQ ID NO: 580104 - RNA, 64 nt, Homo Sapiens; identical to SEQ ID NO: 517278

SEQ ID NO: 580105 - RNA, 64 nt, Homo Sapiens
ugcccagcaaccuguggagagagaccccaaggcaugugagcaucugugccuuaagcagagucag

SEQ ID NO: 580106 - RNA, 64 nt, Homo Sapiens
acuugacagcucucccucugaaucccuggcugucugugagcagcuauaaccauacuuuucuaac

SEQ ID NO: 580107 - RNA, 64 nt, Homo Sapiens
agaagagaccacauuuacagacucuuaucaaaugugugagcaguauaaaagacaaaaggacauc

SEQ ID NO: 580108 - RNA, 64 nt, Homo Sapiens
uagaaauaaaagacaaaagguuuuaaagucaaguugugagcaaaacacacacggaaaaccuuua

SEQ ID NO: 580109 - RNA, 64 nt, Homo Sapiens
guguauauagcagacauggagacaccagcaagccugugagcauuccuuaucuguaaagcaaagc

SEQ ID NO: 580110 - RNA, 64 nt, Homo Sapiens
guaaggguacgugagggguccagcugugagugugugugagcaggguguguggcugagucucuga

SEQ ID NO: 580111 - RNA, 64 nt, Homo Sapiens
ugucacucagcugagaaggccagcccucccuggcugugagcagccuccacuguguccagagaca

SEQ ID NO: 580112 - RNA, 64 nt, Homo Sapiens
gucugguggguggagucaggcuucucuugcuaccugugagcauccuucccagcagacauccuca

SEQ ID NO: 580113 - RNA, 64 nt, Homo Sapiens
aaaucagaugcuuccauguauucagggcgcgcauugugagcaguggaguaugagccuugagggc

SEQ ID NO: 580114 - RNA, 64 nt, Homo Sapiens
acuuagcccuguggacaacuucucuaugcaucugugugagcagaugaucauuguauuaccuuuu

SEQ ID NO: 580115 - RNA, 64 nt, Homo Sapiens
gcuccccuguuuguggccacguuagguguaggguugugagcaaaagggcagcgucgaagcuggg

SEQ ID NO: 580116 - RNA, 64 nt, Homo Sapiens
acgcaaagugucacgugggcgcuggcaggugaagugugagcagcgcacaggugggcagcagcga

SEQ ID NO: 580117 - RNA, 64 nt, Homo Sapiens
gaacuguagaagacccugaggacuccugggcuagugugagcagcuauucugcaugggugcagau

SEQ ID NO: 580118 - RNA, 64 nt, Homo Sapiens
acggaacguugucaagagguagugagauuguugcugugagcaaggcucugggagagucaccuca

SEQ ID NO: 580119 - RNA, 64 nt, Homo Sapiens
ggcaaccaaaacuuagccucaaaggccuuugugaugugagcaaaguucaggacgggucaaaggc

SEQ ID NO: 580120 - RNA, 64 nt, Homo Sapiens
uucuuuaggcauuuccucuucaaaccauccuuaaugugagcaacucuuucugacuccuagccaa

SEQ ID NO: 580121 - RNA, 64 nt, Homo Sapiens
acauacuuggaaaugcugauaauaacugcgauuuugugagcaaaauuacuauaagguacuguga

SEQ ID NO: 580122 - RNA, 64 nt, Homo Sapiens
gagcauaauuauugguuuauugguaggugccuuuugugagcaggaaaaauggucuguucauaau

SEQ ID NO: 580123 - RNA, 64 nt, Homo Sapiens
auaccguuuugugaaaaccagccauaggaaaacaugugagcaacaacccccaugaacauuuguc

SEQ ID NO: 580124 - RNA, 64 nt, Homo Sapiens
caacccccaugaacauuuguccuaacucagauuuugugagcagugaaguuuaacagagcaguga

SEQ ID NO: 580125 - RNA, 64 nt, Homo Sapiens
gcugcuuccuggacgugcgcgcccaggccagugcugugagcaggcggggaggaggcugccggag

SEQ ID NO: 580126 - RNA, 64 nt, Homo Sapiens
agcccugagccuggcagguccccugcccugaggcugugagcagcuagugguggcuucuccagcc

SEQ ID NO: 580127 - RNA, 64 nt, Homo Sapiens
agcaacugaacagagcuccacacaucugucagggugugagcacuccaaggccucgcguggagca

SEQ ID NO: 580128 - RNA, 64 nt, Homo Sapiens
aaggggaucagcuguauuugugugugugugugugugugagcaccugacaaaucuaugaaaccga

SEQ ID NO: 580129 - RNA, 63 nt, Homo Sapiens
uaauauuugauuaaauaaugcagucagcuaagagccaacaaaaccccauauccagauaguuag

SEQ ID NO: 580130 - RNA, 63 nt, Homo Sapiens
aaggaugucaacuugacauccuucccuuagcaugccaacaagccauuagacugauucuuccac

SEQ ID NO: 580131 - RNA, 63 nt, Homo Sapiens
aaugacucauacugugaugauuuccagaugucugccaacaagagcugcuuguaagucacaggu

SEQ ID NO: 580132 - RNA, 63 nt, Homo Sapiens
cuauucuugaaagagcaaagaaccuagcaugaugccaacaagacacauauuacucuuuuuagc

SEQ ID NO: 580133 - RNA, 64 nt, Homo Sapiens; identical to SEQ ID NO: 74290

SEQ ID NO: 580134 - RNA, 64 nt, Homo Sapiens; identical to SEQ ID NO: 74291

SEQ ID NO: 580135 - RNA, 64 nt, Homo Sapiens; identical to SEQ ID NO: 74292

SEQ ID NO: 580136 - RNA, 64 nt, Homo Sapiens; identical to SEQ ID NO: 74293

SEQ ID NO: 580137 - RNA, 64 nt, Homo Sapiens; identical to SEQ ID NO: 74294

SEQ ID NO: 580138 - RNA, 64 nt, Homo Sapiens; identical to SEQ ID NO: 74295

SEQ ID NO: 580139 - RNA, 64 nt, Homo Sapiens; identical to SEQ ID NO: 161026

SEQ ID NO: 580140 - RNA, 64 nt, Homo Sapiens; identical to SEQ ID NO: 161027

SEQ ID NO: 580141 - RNA, 64 nt, Homo Sapiens; identical to SEQ ID NO: 161028

SEQ ID NO: 580142 - RNA, 64 nt, Homo Sapiens; identical to SEQ ID NO: 161029

SEQ ID NO: 580143 - RNA, 64 nt, Homo Sapiens; identical to SEQ ID NO: 161030

SEQ ID NO: 580144 - RNA, 64 nt, Homo Sapiens; identical to SEQ ID NO: 161031

SEQ ID NO: 580145 - RNA, 64 nt, Homo Sapiens; identical to SEQ ID NO: 161032

SEQ ID NO: 580146 - RNA, 64 nt, Homo Sapiens; identical to SEQ ID NO: 161033

SEQ ID NO: 580147 - RNA, 64 nt, Homo Sapiens; identical to SEQ ID NO: 161034

SEQ ID NO: 580148 - RNA, 50 nt, Homo Sapiens; identical to SEQ ID NO: 161035

SEQ ID NO: 580149 - RNA, 64 nt, Homo Sapiens; identical to SEQ ID NO: 161036

SEQ ID NO: 580150 - RNA, 64 nt, Homo Sapiens; identical to SEQ ID NO: 161037

SEQ ID NO: 580151 - RNA, 64 nt, Homo Sapiens; identical to SEQ ID NO: 161038

SEQ ID NO: 580152 - RNA, 64 nt, Homo Sapiens; identical to SEQ ID NO: 161039

SEQ ID NO: 580153 - RNA, 64 nt, Homo Sapiens; identical to SEQ ID NO: 161040

SEQ ID NO: 580154 - RNA, 64 nt, Homo Sapiens; identical to SEQ ID NO: 161041

SEQ ID NO: 580155 - RNA, 64 nt, Homo Sapiens; identical to SEQ ID NO: 161042

SEQ ID NO: 580156 - RNA, 64 nt, Homo Sapiens; identical to SEQ ID NO: 161043

SEQ ID NO: 580157 - RNA, 64 nt, Homo Sapiens; identical to SEQ ID NO: 161044

SEQ ID NO: 580158 - RNA, 64 nt, Homo Sapiens; identical to SEQ ID NO: 161045

SEQ ID NO: 580159 - RNA, 64 nt, Homo Sapiens; identical to SEQ ID NO: 161046

SEQ ID NO: 580160 - RNA, 64 nt, Homo Sapiens; identical to SEQ ID NO: 161047

SEQ ID NO: 580161 - RNA, 63 nt, Homo Sapiens; identical to SEQ ID NO: 530191

SEQ ID NO: 580162 - RNA, 64 nt, Homo Sapiens; identical to SEQ ID NO: 530192

SEQ ID NO: 580163 - RNA, 64 nt, Homo Sapiens; identical to SEQ ID NO: 530193

SEQ ID NO: 580164 - RNA, 64 nt, Homo Sapiens; identical to SEQ ID NO: 530194

SEQ ID NO: 580165 - RNA, 64 nt, Homo Sapiens; identical to SEQ ID NO: 530195

SEQ ID NO: 580166 - RNA, 64 nt, Homo Sapiens; identical to SEQ ID NO: 530196

SEQ ID NO: 580167 - RNA, 64 nt, Homo Sapiens; identical to SEQ ID NO: 530197

SEQ ID NO: 580168 - RNA, 64 nt, Homo Sapiens; identical to SEQ ID NO: 530198

SEQ ID NO: 580169 - RNA, 64 nt, Homo Sapiens; identical to SEQ ID NO: 530199

SEQ ID NO: 580170 - RNA, 64 nt, Homo Sapiens; identical to SEQ ID NO: 530200

SEQ ID NO: 580171 - RNA, 64 nt, Homo Sapiens; identical to SEQ ID NO: 530201

SEQ ID NO: 580172 - RNA, 64 nt, Homo Sapiens; identical to SEQ ID NO: 530202

SEQ ID NO: 580173 - RNA, 64 nt, Homo Sapiens; identical to SEQ ID NO: 530203

SEQ ID NO: 580174 - RNA, 64 nt, Homo Sapiens; identical to SEQ ID NO: 530204

SEQ ID NO: 580175 - RNA, 64 nt, Homo Sapiens; identical to SEQ ID NO: 530205

SEQ ID NO: 580176 - RNA, 64 nt, Homo Sapiens; identical to SEQ ID NO: 530206

SEQ ID NO: 580177 - RNA, 64 nt, Homo Sapiens; identical to SEQ ID NO: 530207

SEQ ID NO: 580178 - RNA, 64 nt, Homo Sapiens; identical to SEQ ID NO: 530208

SEQ ID NO: 580179 - RNA, 64 nt, Homo Sapiens; identical to SEQ ID NO: 530209

SEQ ID NO: 580180 - RNA, 64 nt, Homo Sapiens; identical to SEQ ID NO: 530210

SEQ ID NO: 580181 - RNA, 64 nt, Homo Sapiens; identical to SEQ ID NO: 530211

SEQ ID NO: 580182 - RNA, 64 nt, Homo Sapiens; identical to SEQ ID NO: 530212

SEQ ID NO: 580183 - RNA, 64 nt, Homo Sapiens; identical to SEQ ID NO: 530213

SEQ ID NO: 580184 - RNA, 64 nt, Homo Sapiens; identical to SEQ ID NO: 530214

SEQ ID NO: 580185 - RNA, 64 nt, Homo Sapiens; identical to SEQ ID NO: 530215

SEQ ID NO: 580186 - RNA, 64 nt, Homo Sapiens; identical to SEQ ID NO: 530216

SEQ ID NO: 580187 - RNA, 64 nt, Homo Sapiens; identical to SEQ ID NO: 530217

SEQ ID NO: 580188 - RNA, 64 nt, Homo Sapiens; identical to SEQ ID NO: 530218

SEQ ID NO: 580189 - RNA, 64 nt, Homo Sapiens; identical to SEQ ID NO: 530219

SEQ ID NO: 580190 - RNA, 64 nt, Homo Sapiens; identical to SEQ ID NO: 530220

SEQ ID NO: 580191 - RNA, 64 nt, Homo Sapiens; identical to SEQ ID NO: 530221

SEQ ID NO: 580192 - RNA, 63 nt, Homo Sapiens; identical to SEQ ID NO: 530222

SEQ ID NO: 580193 - RNA, 64 nt, Homo Sapiens; identical to SEQ ID NO: 530223

SEQ ID NO: 580194 - RNA, 64 nt, Homo Sapiens; identical to SEQ ID NO: 530224

SEQ ID NO: 580195 - RNA, 64 nt, Homo Sapiens; identical to SEQ ID NO: 530225

SEQ ID NO: 580196 - RNA, 64 nt, Homo Sapiens; identical to SEQ ID NO: 530226

SEQ ID NO: 580197 - RNA, 64 nt, Homo Sapiens; identical to SEQ ID NO: 530227

SEQ ID NO: 580198 - RNA, 64 nt, Homo Sapiens; identical to SEQ ID NO: 530228

SEQ ID NO: 580199 - RNA, 64 nt, Homo Sapiens; identical to SEQ ID NO: 530229

SEQ ID NO: 580200 - RNA, 64 nt, Homo Sapiens; identical to SEQ ID NO: 530230

SEQ ID NO: 580201 - RNA, 64 nt, Homo Sapiens; identical to SEQ ID NO: 530231

SEQ ID NO: 580202 - RNA, 64 nt, Homo Sapiens; identical to SEQ ID NO: 530232

SEQ ID NO: 580203 - RNA, 64 nt, Homo Sapiens; identical to SEQ ID NO: 530233

SEQ ID NO: 580204 - RNA, 64 nt, Homo Sapiens; identical to SEQ ID NO: 530234

SEQ ID NO: 580205 - RNA, 64 nt, Homo Sapiens; identical to SEQ ID NO: 530235

SEQ ID NO: 580206 - RNA, 64 nt, Homo Sapiens; identical to SEQ ID NO: 530236

SEQ ID NO: 580207 - RNA, 64 nt, Homo Sapiens; identical to SEQ ID NO: 530237

SEQ ID NO: 580208 - RNA, 64 nt, Homo Sapiens; identical to SEQ ID NO: 530238

SEQ ID NO: 580209 - RNA, 64 nt, Homo Sapiens; identical to SEQ ID NO: 530239

SEQ ID NO: 580210 - RNA, 64 nt, Homo Sapiens; identical to SEQ ID NO: 530240

SEQ ID NO: 580211 - RNA, 64 nt, Homo Sapiens; identical to SEQ ID NO: 530241

SEQ ID NO: 580212 - RNA, 64 nt, Homo Sapiens; identical to SEQ ID NO: 530242

SEQ ID NO: 580213 - RNA, 64 nt, Homo Sapiens; identical to SEQ ID NO: 530243

SEQ ID NO: 580214 - RNA, 64 nt, Homo Sapiens; identical to SEQ ID NO: 530244

SEQ ID NO: 580215 - RNA, 64 nt, Homo Sapiens; identical to SEQ ID NO: 530245

SEQ ID NO: 580216 - RNA, 64 nt, Homo Sapiens; identical to SEQ ID NO: 530246

SEQ ID NO: 580217 - RNA, 64 nt, Homo Sapiens; identical to SEQ ID NO: 530247

SEQ ID NO: 580218 - RNA, 64 nt, Homo Sapiens; identical to SEQ ID NO: 530248

SEQ ID NO: 580219 - RNA, 64 nt, Homo Sapiens; identical to SEQ ID NO: 530249

SEQ ID NO: 580220 - RNA, 64 nt, Homo Sapiens; identical to SEQ ID NO: 530250

SEQ ID NO: 580221 - RNA, 64 nt, Homo Sapiens; identical to SEQ ID NO: 530251

SEQ ID NO: 580222 - RNA, 64 nt, Homo Sapiens; identical to SEQ ID NO: 530252

SEQ ID NO: 580223 - RNA, 64 nt, Homo Sapiens; identical to SEQ ID NO: 530253

SEQ ID NO: 580224 - RNA, 64 nt, Homo Sapiens; identical to SEQ ID NO: 530254

SEQ ID NO: 580225 - RNA, 64 nt, Homo Sapiens; identical to SEQ ID NO: 530255

SEQ ID NO: 580226 - RNA, 64 nt, Homo Sapiens; identical to SEQ ID NO: 530256

SEQ ID NO: 580227 - RNA, 64 nt, Homo Sapiens; identical to SEQ ID NO: 530257

SEQ ID NO: 580228 - RNA, 64 nt, Homo Sapiens; identical to SEQ ID NO: 530258

SEQ ID NO: 580229 - RNA, 64 nt, Homo Sapiens; identical to SEQ ID NO: 530259

SEQ ID NO: 580230 - RNA, 64 nt, Homo Sapiens; identical to SEQ ID NO: 530260

SEQ ID NO: 580231 - RNA, 64 nt, Homo Sapiens; identical to SEQ ID NO: 530261

SEQ ID NO: 580232 - RNA, 64 nt, Homo Sapiens; identical to SEQ ID NO: 530262

SEQ ID NO: 580233 - RNA, 64 nt, Homo Sapiens; identical to SEQ ID NO: 530263

SEQ ID NO: 580234 - RNA, 64 nt, Homo Sapiens; identical to SEQ ID NO: 530264

SEQ ID NO: 580235 - RNA, 64 nt, Homo Sapiens; identical to SEQ ID NO: 530265

SEQ ID NO: 580236 - RNA, 64 nt, Homo Sapiens; identical to SEQ ID NO: 530266

SEQ ID NO: 580237 - RNA, 64 nt, Homo Sapiens; identical to SEQ ID NO: 530267

SEQ ID NO: 580238 - RNA, 64 nt, Homo Sapiens; identical to SEQ ID NO: 530268

SEQ ID NO: 580239 - RNA, 64 nt, Homo Sapiens; identical to SEQ ID NO: 530269

SEQ ID NO: 580240 - RNA, 64 nt, Homo Sapiens; identical to SEQ ID NO: 530270

SEQ ID NO: 580241 - RNA, 64 nt, Homo Sapiens; identical to SEQ ID NO: 530271

SEQ ID NO: 580242 - RNA, 64 nt, Homo Sapiens; identical to SEQ ID NO: 530272

SEQ ID NO: 580243 - RNA, 64 nt, Homo Sapiens; identical to SEQ ID NO: 530273

SEQ ID NO: 580244 - RNA, 64 nt, Homo Sapiens; identical to SEQ ID NO: 530274

SEQ ID NO: 580245 - RNA, 64 nt, Homo Sapiens; identical to SEQ ID NO: 530275

SEQ ID NO: 580246 - RNA, 64 nt, Homo Sapiens; identical to SEQ ID NO: 530276

SEQ ID NO: 580247 - RNA, 64 nt, Homo Sapiens; identical to SEQ ID NO: 530277

SEQ ID NO: 580248 - RNA, 64 nt, Homo Sapiens; identical to SEQ ID NO: 530278

SEQ ID NO: 580249 - RNA, 64 nt, Homo Sapiens; identical to SEQ ID NO: 530279

SEQ ID NO: 580250 - RNA, 64 nt, Homo Sapiens; identical to SEQ ID NO: 530280

SEQ ID NO: 580251 - RNA, 64 nt, Homo Sapiens; identical to SEQ ID NO: 530281

SEQ ID NO: 580252 - RNA, 64 nt, Homo Sapiens; identical to SEQ ID NO: 530282

SEQ ID NO: 580253 - RNA, 64 nt, Homo Sapiens; identical to SEQ ID NO: 530283

SEQ ID NO: 580254 - RNA, 64 nt, Homo Sapiens; identical to SEQ ID NO: 530284

SEQ ID NO: 580255 - RNA, 64 nt, Homo Sapiens; identical to SEQ ID NO: 530285

SEQ ID NO: 580256 - RNA, 64 nt, Homo Sapiens; identical to SEQ ID NO: 530286

SEQ ID NO: 580257 - RNA, 64 nt, Homo Sapiens; identical to SEQ ID NO: 530287

SEQ ID NO: 580258 - RNA, 64 nt, Homo Sapiens; identical to SEQ ID NO: 530288

SEQ ID NO: 580259 - RNA, 64 nt, Homo Sapiens; identical to SEQ ID NO: 530289

SEQ ID NO: 580260 - RNA, 64 nt, Homo Sapiens; identical to SEQ ID NO: 530290

SEQ ID NO: 580261 - RNA, 64 nt, Homo Sapiens; identical to SEQ ID NO: 530291

SEQ ID NO: 580262 - RNA, 64 nt, Homo Sapiens; identical to SEQ ID NO: 530292

SEQ ID NO: 580263 - RNA, 64 nt, Homo Sapiens; identical to SEQ ID NO: 530293

SEQ ID NO: 580264 - RNA, 64 nt, Homo Sapiens; identical to SEQ ID NO: 530294

SEQ ID NO: 580265 - RNA, 64 nt, Homo Sapiens; identical to SEQ ID NO: 530295

SEQ ID NO: 580266 - RNA, 64 nt, Homo Sapiens; identical to SEQ ID NO: 530296

SEQ ID NO: 580267 - RNA, 64 nt, Homo Sapiens; identical to SEQ ID NO: 530297

SEQ ID NO: 580268 - RNA, 64 nt, Homo Sapiens; identical to SEQ ID NO: 530298

SEQ ID NO: 580269 - RNA, 64 nt, Homo Sapiens; identical to SEQ ID NO: 530299

SEQ ID NO: 580270 - RNA, 64 nt, Homo Sapiens; identical to SEQ ID NO: 530300

SEQ ID NO: 580271 - RNA, 64 nt, Homo Sapiens; identical to SEQ ID NO: 530301

SEQ ID NO: 580272 - RNA, 64 nt, Homo Sapiens; identical to SEQ ID NO: 530302

SEQ ID NO: 580273 - RNA, 64 nt, Homo Sapiens; identical to SEQ ID NO: 530303

SEQ ID NO: 580274 - RNA, 64 nt, Homo Sapiens; identical to SEQ ID NO: 530304

SEQ ID NO: 580275 - RNA, 64 nt, Homo Sapiens; identical to SEQ ID NO: 530305

SEQ ID NO: 580276 - RNA, 64 nt, Homo Sapiens; identical to SEQ ID NO: 530306

SEQ ID NO: 580277 - RNA, 64 nt, Homo Sapiens; identical to SEQ ID NO: 530307

SEQ ID NO: 580278 - RNA, 64 nt, Homo Sapiens; identical to SEQ ID NO: 530308

SEQ ID NO: 580279 - RNA, 64 nt, Homo Sapiens; identical to SEQ ID NO: 530309

SEQ ID NO: 580280 - RNA, 64 nt, Homo Sapiens; identical to SEQ ID NO: 530310

SEQ ID NO: 580281 - RNA, 64 nt, Homo Sapiens; identical to SEQ ID NO: 530311

SEQ ID NO: 580282 - RNA, 64 nt, Homo Sapiens; identical to SEQ ID NO: 530312

SEQ ID NO: 580283 - RNA, 64 nt, Homo Sapiens; identical to SEQ ID NO: 530313

SEQ ID NO: 580284 - RNA, 64 nt, Homo Sapiens; identical to SEQ ID NO: 530314

SEQ ID NO: 580285 - RNA, 64 nt, Homo Sapiens; identical to SEQ ID NO: 530315

SEQ ID NO: 580286 - RNA, 64 nt, Homo Sapiens; identical to SEQ ID NO: 530316

SEQ ID NO: 580287 - RNA, 64 nt, Homo Sapiens; identical to SEQ ID NO: 530317

SEQ ID NO: 580288 - RNA, 64 nt, Homo Sapiens; identical to SEQ ID NO: 530318

SEQ ID NO: 580289 - RNA, 64 nt, Homo Sapiens; identical to SEQ ID NO: 530319

SEQ ID NO: 580290 - RNA, 64 nt, Homo Sapiens; identical to SEQ ID NO: 530320

SEQ ID NO: 580291 - RNA, 64 nt, Homo Sapiens; identical to SEQ ID NO: 530321

SEQ ID NO: 580292 - RNA, 64 nt, Homo Sapiens; identical to SEQ ID NO: 530322

SEQ ID NO: 580293 - RNA, 64 nt, Homo Sapiens; identical to SEQ ID NO: 530323

SEQ ID NO: 580294 - RNA, 64 nt, Homo Sapiens; identical to SEQ ID NO: 530324

SEQ ID NO: 580295 - RNA, 64 nt, Homo Sapiens; identical to SEQ ID NO: 530325

SEQ ID NO: 580296 - RNA, 64 nt, Homo Sapiens; identical to SEQ ID NO: 530326

SEQ ID NO: 580297 - RNA, 64 nt, Homo Sapiens; identical to SEQ ID NO: 530327

SEQ ID NO: 580298 - RNA, 64 nt, Homo Sapiens; identical to SEQ ID NO: 530328

SEQ ID NO: 580299 - RNA, 64 nt, Homo Sapiens; identical to SEQ ID NO: 530329

SEQ ID NO: 580300 - RNA, 64 nt, Homo Sapiens; identical to SEQ ID NO: 530330

SEQ ID NO: 580301 - RNA, 64 nt, Homo Sapiens; identical to SEQ ID NO: 530331

SEQ ID NO: 580302 - RNA, 64 nt, Homo Sapiens; identical to SEQ ID NO: 530332

SEQ ID NO: 580303 - RNA, 64 nt, Homo Sapiens; identical to SEQ ID NO: 530333

SEQ ID NO: 580304 - RNA, 64 nt, Homo Sapiens; identical to SEQ ID NO: 530334

SEQ ID NO: 580305 - RNA, 64 nt, Homo Sapiens; identical to SEQ ID NO: 530335

SEQ ID NO: 580306 - RNA, 64 nt, Homo Sapiens; identical to SEQ ID NO: 530336

SEQ ID NO: 580307 - RNA, 64 nt, Homo Sapiens; identical to SEQ ID NO: 530337

SEQ ID NO: 580308 - RNA, 64 nt, Homo Sapiens; identical to SEQ ID NO: 530338

SEQ ID NO: 580309 - RNA, 64 nt, Homo Sapiens; identical to SEQ ID NO: 530339

SEQ ID NO: 580310 - RNA, 64 nt, Homo Sapiens; identical to SEQ ID NO: 530340

SEQ ID NO: 580311 - RNA, 64 nt, Homo Sapiens; identical to SEQ ID NO: 530341

SEQ ID NO: 580312 - RNA, 64 nt, Homo Sapiens; identical to SEQ ID NO: 530342

SEQ ID NO: 580313 - RNA, 64 nt, Homo Sapiens; identical to SEQ ID NO: 530343

SEQ ID NO: 580314 - RNA, 64 nt, Homo Sapiens; identical to SEQ ID NO: 530344

SEQ ID NO: 580315 - RNA, 64 nt, Homo Sapiens; identical to SEQ ID NO: 530345

SEQ ID NO: 580316 - RNA, 64 nt, Homo Sapiens
aauuagcccauuauauuuucugaauauauucuuaaucauuaauaaaauccaugaaaacgcuuag

SEQ ID NO: 580317 - RNA, 64 nt, Homo Sapiens
uauuugguuugguggagugaugcaauuuuucuaaaucauuaaauaguuuagugauacaaaugau

SEQ ID NO: 580318 - RNA, 64 nt, Homo Sapiens
agauaugaucuaacaguauuucuaacuauauuugaucauuaaaagccucuuggaauuugaagcg

SEQ ID NO: 580319 - RNA, 64 nt, Homo Sapiens
aaaaauaacaggacucuguacuggaccuaacuuuaucauuaauuagguaauauuuuccucauuu

SEQ ID NO: 580320 - RNA, 64 nt, Homo Sapiens
guucuuauuuuuuuuaauaucuguauacauuacaaucauuaaaagguuugccaaacagcccaaa

SEQ ID NO: 580321 - RNA, 64 nt, Homo Sapiens
cacaucugcagggguuugccuuuuuaaauaaagcaucauuaaugggacuguuuuugguuuuuug

SEQ ID NO: 580322 - RNA, 64 nt, Homo Sapiens
cugcuuucugaacucuaaugugccuucauugauuaucauuaaaauuaucauuaaaauugccuua

SEQ ID NO: 580323 - RNA, 64 nt, Homo Sapiens
cucuaaugugccuucauugauuaucauuaaaauuaucauuaaaauugccuuauuucuauggacu

SEQ ID NO: 580324 - RNA, 64 nt, Homo Sapiens
uuuucucauaguucagaaaacaggugcuuuauguaucauuaaaugcagaggacuugcuauuugc

SEQ ID NO: 580325 - RNA, 64 nt, Homo Sapiens
uauuauauacacugauacuuuaucauuugguacuaucauuaauguuuaucauuaaauuuaguuc

SEQ ID NO: 580326 - RNA, 64 nt, Homo Sapiens
uuaguucuaucauuugguacucuaucauuaauuuaucauuaaauuuuuuccuuuuaaauuuagu

SEQ ID NO: 580327 - RNA, 64 nt, Homo Sapiens
uaucauuaaauuuaguucuauuaaauuuaguucuaucauuaauucuuagaaugacuuuuuccuu

SEQ ID NO: 580328 - RNA, 64 nt, Homo Sapiens
auacuguaacuuccuauaaccuaauauuuucgguaucauuaaccaaaauuucacacucauaguu

SEQ ID NO: 580329 - RNA, 64 nt, Homo Sapiens
ucacacucauaguugcuaaagagaauguuauucaaucauuaaacucugaacugauuucuucuau

SEQ ID NO: 580330 - RNA, 64 nt, Homo Sapiens; identical to SEQ ID NO: 85524

SEQ ID NO: 580331 - RNA, 64 nt, Homo Sapiens; identical to SEQ ID NO: 85525

SEQ ID NO: 580332 - RNA, 64 nt, Homo Sapiens; identical to SEQ ID NO: 85526

SEQ ID NO: 580333 - RNA, 64 nt, Homo Sapiens; identical to SEQ ID NO: 85527

SEQ ID NO: 580334 - RNA, 64 nt, Homo Sapiens; identical to SEQ ID NO: 85528

SEQ ID NO: 580335 - RNA, 64 nt, Homo Sapiens; identical to SEQ ID NO: 85529

SEQ ID NO: 580336 - RNA, 64 nt, Homo Sapiens; identical to SEQ ID NO: 85530

SEQ ID NO: 580337 - RNA, 64 nt, Homo Sapiens; identical to SEQ ID NO: 85531

SEQ ID NO: 580338 - RNA, 64 nt, Homo Sapiens; identical to SEQ ID NO: 85532

SEQ ID NO: 580339 - RNA, 64 nt, Homo Sapiens; identical to SEQ ID NO: 85533

SEQ ID NO: 580340 - RNA, 64 nt, Homo Sapiens; identical to SEQ ID NO: 85534

SEQ ID NO: 580341 - RNA, 64 nt, Homo Sapiens; identical to SEQ ID NO: 85535

SEQ ID NO: 580342 - RNA, 55 nt, Homo Sapiens; identical to SEQ ID NO: 85536

SEQ ID NO: 580343 - RNA, 64 nt, Homo Sapiens; identical to SEQ ID NO: 85537

SEQ ID NO: 580344 - RNA, 64 nt, Homo Sapiens; identical to SEQ ID NO: 85538

SEQ ID NO: 580345 - RNA, 64 nt, Homo Sapiens; identical to SEQ ID NO: 85539

SEQ ID NO: 580346 - RNA, 64 nt, Homo Sapiens; identical to SEQ ID NO: 85540

SEQ ID NO: 580347 - RNA, 64 nt, Homo Sapiens; identical to SEQ ID NO: 85541

SEQ ID NO: 580348 - RNA, 64 nt, Homo Sapiens; identical to SEQ ID NO: 85542

SEQ ID NO: 580349 - RNA, 64 nt, Homo Sapiens; identical to SEQ ID NO: 85543

SEQ ID NO: 580350 - RNA, 64 nt, Homo Sapiens; identical to SEQ ID NO: 85544

SEQ ID NO: 580351 - RNA, 64 nt, Homo Sapiens; identical to SEQ ID NO: 85545

SEQ ID NO: 580352 - RNA, 64 nt, Homo Sapiens; identical to SEQ ID NO: 85546

SEQ ID NO: 580353 - RNA, 64 nt, Homo Sapiens; identical to SEQ ID NO: 85547

SEQ ID NO: 580354 - RNA, 64 nt, Homo Sapiens; identical to SEQ ID NO: 85548

SEQ ID NO: 580355 - RNA, 64 nt, Homo Sapiens; identical to SEQ ID NO: 85549

SEQ ID NO: 580356 - RNA, 64 nt, Homo Sapiens; identical to SEQ ID NO: 85550

SEQ ID NO: 580357 - RNA, 64 nt, Homo Sapiens; identical to SEQ ID NO: 85551

SEQ ID NO: 580358 - RNA, 64 nt, Homo Sapiens; identical to SEQ ID NO: 85552

SEQ ID NO: 580359 - RNA, 64 nt, Homo Sapiens; identical to SEQ ID NO: 85553

SEQ ID NO: 580360 - RNA, 64 nt, Homo Sapiens; identical to SEQ ID NO: 85554

SEQ ID NO: 580361 - RNA, 64 nt, Homo Sapiens; identical to SEQ ID NO: 85555

SEQ ID NO: 580362 - RNA, 64 nt, Homo Sapiens; identical to SEQ ID NO: 85556

SEQ ID NO: 580363 - RNA, 64 nt, Homo Sapiens; identical to SEQ ID NO: 85557

SEQ ID NO: 580364 - RNA, 64 nt, Homo Sapiens; identical to SEQ ID NO: 85558

SEQ ID NO: 580365 - RNA, 64 nt, Homo Sapiens; identical to SEQ ID NO: 85559

SEQ ID NO: 580366 - RNA, 64 nt, Homo Sapiens; identical to SEQ ID NO: 85560

SEQ ID NO: 580367 - RNA, 64 nt, Homo Sapiens; identical to SEQ ID NO: 85561

SEQ ID NO: 580368 - RNA, 64 nt, Homo Sapiens; identical to SEQ ID NO: 85562

SEQ ID NO: 580369 - RNA, 64 nt, Homo Sapiens; identical to SEQ ID NO: 85563

SEQ ID NO: 580370 - RNA, 62 nt, Homo Sapiens; identical to SEQ ID NO: 85564

SEQ ID NO: 580371 - RNA, 57 nt, Homo Sapiens; identical to SEQ ID NO: 85565

SEQ ID NO: 580372 - RNA, 64 nt, Homo Sapiens; identical to SEQ ID NO: 85566

SEQ ID NO: 580373 - RNA, 64 nt, Homo Sapiens; identical to SEQ ID NO: 85567

SEQ ID NO: 580374 - RNA, 64 nt, Homo Sapiens; identical to SEQ ID NO: 85568

SEQ ID NO: 580375 - RNA, 64 nt, Homo Sapiens; identical to SEQ ID NO: 85569

SEQ ID NO: 580376 - RNA, 64 nt, Homo Sapiens; identical to SEQ ID NO: 85570

SEQ ID NO: 580377 - RNA, 64 nt, Homo Sapiens; identical to SEQ ID NO: 85571

SEQ ID NO: 580378 - RNA, 64 nt, Homo Sapiens; identical to SEQ ID NO: 170526

SEQ ID NO: 580379 - RNA, 64 nt, Homo Sapiens; identical to SEQ ID NO: 170527

SEQ ID NO: 580380 - RNA, 64 nt, Homo Sapiens; identical to SEQ ID NO: 170528

SEQ ID NO: 580381 - RNA, 64 nt, Homo Sapiens; identical to SEQ ID NO: 170529

SEQ ID NO: 580382 - RNA, 64 nt, Homo Sapiens; identical to SEQ ID NO: 170530

SEQ ID NO: 580383 - RNA, 64 nt, Homo Sapiens; identical to SEQ ID NO: 170531

SEQ ID NO: 580384 - RNA, 64 nt, Homo Sapiens; identical to SEQ ID NO: 170532

SEQ ID NO: 580385 - RNA, 64 nt, Homo Sapiens; identical to SEQ ID NO: 170533

SEQ ID NO: 580386 - RNA, 64 nt, Homo Sapiens; identical to SEQ ID NO: 170534

SEQ ID NO: 580387 - RNA, 64 nt, Homo Sapiens; identical to SEQ ID NO: 170535

SEQ ID NO: 580388 - RNA, 64 nt, Homo Sapiens; identical to SEQ ID NO: 170536

SEQ ID NO: 580389 - RNA, 64 nt, Homo Sapiens; identical to SEQ ID NO: 170537

SEQ ID NO: 580390 - RNA, 64 nt, Homo Sapiens; identical to SEQ ID NO: 170538

SEQ ID NO: 580391 - RNA, 64 nt, Homo Sapiens; identical to SEQ ID NO: 170539

SEQ ID NO: 580392 - RNA, 64 nt, Homo Sapiens; identical to SEQ ID NO: 170540

SEQ ID NO: 580393 - RNA, 64 nt, Homo Sapiens; identical to SEQ ID NO: 170541

SEQ ID NO: 580394 - RNA, 64 nt, Homo Sapiens; identical to SEQ ID NO: 170542

SEQ ID NO: 580395 - RNA, 64 nt, Homo Sapiens; identical to SEQ ID NO: 170543

SEQ ID NO: 580396 - RNA, 64 nt, Homo Sapiens; identical to SEQ ID NO: 170544

SEQ ID NO: 580397 - RNA, 64 nt, Homo Sapiens; identical to SEQ ID NO: 170545

SEQ ID NO: 580398 - RNA, 64 nt, Homo Sapiens; identical to SEQ ID NO: 170546

SEQ ID NO: 580399 - RNA, 64 nt, Homo Sapiens; identical to SEQ ID NO: 170547

SEQ ID NO: 580400 - RNA, 64 nt, Homo Sapiens; identical to SEQ ID NO: 170548

SEQ ID NO: 580401 - RNA, 64 nt, Homo Sapiens; identical to SEQ ID NO: 170549

SEQ ID NO: 580402 - RNA, 64 nt, Homo Sapiens; identical to SEQ ID NO: 170550

SEQ ID NO: 580403 - RNA, 53 nt, Homo Sapiens; identical to SEQ ID NO: 170551

SEQ ID NO: 580404 - RNA, 64 nt, Homo Sapiens; identical to SEQ ID NO: 170552

SEQ ID NO: 580405 - RNA, 64 nt, Homo Sapiens; identical to SEQ ID NO: 170553

SEQ ID NO: 580406 - RNA, 64 nt, Homo Sapiens; identical to SEQ ID NO: 170554

SEQ ID NO: 580407 - RNA, 64 nt, Homo Sapiens; identical to SEQ ID NO: 170555

SEQ ID NO: 580408 - RNA, 64 nt, Homo Sapiens; identical to SEQ ID NO: 170556

SEQ ID NO: 580409 - RNA, 64 nt, Homo Sapiens; identical to SEQ ID NO: 170557

SEQ ID NO: 580410 - RNA, 64 nt, Homo Sapiens; identical to SEQ ID NO: 170558

SEQ ID NO: 580411 - RNA, 64 nt, Homo Sapiens; identical to SEQ ID NO: 170559

SEQ ID NO: 580412 - RNA, 64 nt, Homo Sapiens; identical to SEQ ID NO: 170560

SEQ ID NO: 580413 - RNA, 64 nt, Homo Sapiens; identical to SEQ ID NO: 170561

SEQ ID NO: 580414 - RNA, 64 nt, Homo Sapiens; identical to SEQ ID NO: 170562

SEQ ID NO: 580415 - RNA, 64 nt, Homo Sapiens; identical to SEQ ID NO: 170563

SEQ ID NO: 580416 - RNA, 64 nt, Homo Sapiens; identical to SEQ ID NO: 170564

SEQ ID NO: 580417 - RNA, 64 nt, Homo Sapiens; identical to SEQ ID NO: 170565

SEQ ID NO: 580418 - RNA, 52 nt, Homo Sapiens; identical to SEQ ID NO: 170566

SEQ ID NO: 580419 - RNA, 64 nt, Homo Sapiens; identical to SEQ ID NO: 170567

SEQ ID NO: 580420 - RNA, 64 nt, Homo Sapiens; identical to SEQ ID NO: 170568

SEQ ID NO: 580421 - RNA, 64 nt, Homo Sapiens; identical to SEQ ID NO: 170569

SEQ ID NO: 580422 - RNA, 64 nt, Homo Sapiens; identical to SEQ ID NO: 170570

SEQ ID NO: 580423 - RNA, 64 nt, Homo Sapiens; identical to SEQ ID NO: 170571

SEQ ID NO: 580424 - RNA, 64 nt, Homo Sapiens; identical to SEQ ID NO: 170572

SEQ ID NO: 580425 - RNA, 64 nt, Homo Sapiens; identical to SEQ ID NO: 170573

SEQ ID NO: 580426 - RNA, 64 nt, Homo Sapiens; identical to SEQ ID NO: 170574

SEQ ID NO: 580427 - RNA, 64 nt, Homo Sapiens; identical to SEQ ID NO: 170575

SEQ ID NO: 580428 - RNA, 64 nt, Homo Sapiens; identical to SEQ ID NO: 170576

SEQ ID NO: 580429 - RNA, 64 nt, Homo Sapiens; identical to SEQ ID NO: 170577

SEQ ID NO: 580430 - RNA, 64 nt, Homo Sapiens; identical to SEQ ID NO: 170578

SEQ ID NO: 580431 - RNA, 64 nt, Homo Sapiens; identical to SEQ ID NO: 170579

SEQ ID NO: 580432 - RNA, 64 nt, Homo Sapiens; identical to SEQ ID NO: 170580

SEQ ID NO: 580433 - RNA, 64 nt, Homo Sapiens; identical to SEQ ID NO: 170581

SEQ ID NO: 580434 - RNA, 64 nt, Homo Sapiens; identical to SEQ ID NO: 170582

SEQ ID NO: 580435 - RNA, 64 nt, Homo Sapiens; identical to SEQ ID NO: 170583

SEQ ID NO: 580436 - RNA, 64 nt, Homo Sapiens; identical to SEQ ID NO: 170584

SEQ ID NO: 580437 - RNA, 64 nt, Homo Sapiens; identical to SEQ ID NO: 170585

SEQ ID NO: 580438 - RNA, 64 nt, Homo Sapiens; identical to SEQ ID NO: 170586

SEQ ID NO: 580439 - RNA, 64 nt, Homo Sapiens; identical to SEQ ID NO: 170587

SEQ ID NO: 580440 - RNA, 64 nt, Homo Sapiens; identical to SEQ ID NO: 170588

SEQ ID NO: 580441 - RNA, 64 nt, Homo Sapiens; identical to SEQ ID NO: 170589

SEQ ID NO: 580442 - RNA, 64 nt, Homo Sapiens; identical to SEQ ID NO: 170590

SEQ ID NO: 580443 - RNA, 64 nt, Homo Sapiens; identical to SEQ ID NO: 170591

SEQ ID NO: 580444 - RNA, 64 nt, Homo Sapiens; identical to SEQ ID NO: 170592

SEQ ID NO: 580445 - RNA, 64 nt, Homo Sapiens; identical to SEQ ID NO: 170593

SEQ ID NO: 580446 - RNA, 64 nt, Homo Sapiens; identical to SEQ ID NO: 170594

SEQ ID NO: 580447 - RNA, 64 nt, Homo Sapiens; identical to SEQ ID NO: 170595

SEQ ID NO: 580448 - RNA, 64 nt, Homo Sapiens; identical to SEQ ID NO: 170596

SEQ ID NO: 580449 - RNA, 64 nt, Homo Sapiens; identical to SEQ ID NO: 170597

SEQ ID NO: 580450 - RNA, 64 nt, Homo Sapiens; identical to SEQ ID NO: 170598

SEQ ID NO: 580451 - RNA, 64 nt, Homo Sapiens; identical to SEQ ID NO: 170599

SEQ ID NO: 580452 - RNA, 64 nt, Homo Sapiens; identical to SEQ ID NO: 170600

SEQ ID NO: 580453 - RNA, 64 nt, Homo Sapiens; identical to SEQ ID NO: 170601

SEQ ID NO: 580454 - RNA, 64 nt, Homo Sapiens; identical to SEQ ID NO: 170602

SEQ ID NO: 580455 - RNA, 64 nt, Homo Sapiens; identical to SEQ ID NO: 170603

SEQ ID NO: 580456 - RNA, 64 nt, Homo Sapiens; identical to SEQ ID NO: 170604

SEQ ID NO: 580457 - RNA, 64 nt, Homo Sapiens; identical to SEQ ID NO: 170605

SEQ ID NO: 580458 - RNA, 64 nt, Homo Sapiens; identical to SEQ ID NO: 170606

SEQ ID NO: 580459 - RNA, 64 nt, Homo Sapiens; identical to SEQ ID NO: 170607

SEQ ID NO: 580460 - RNA, 64 nt, Homo Sapiens; identical to SEQ ID NO: 170608

SEQ ID NO: 580461 - RNA, 64 nt, Homo Sapiens; identical to SEQ ID NO: 170609

SEQ ID NO: 580462 - RNA, 64 nt, Homo Sapiens; identical to SEQ ID NO: 170610

SEQ ID NO: 580463 - RNA, 64 nt, Homo Sapiens; identical to SEQ ID NO: 170611

SEQ ID NO: 580464 - RNA, 64 nt, Homo Sapiens; identical to SEQ ID NO: 170612

SEQ ID NO: 580465 - RNA, 64 nt, Homo Sapiens; identical to SEQ ID NO: 170613

SEQ ID NO: 580466 - RNA, 64 nt, Homo Sapiens; identical to SEQ ID NO: 170614

SEQ ID NO: 580467 - RNA, 64 nt, Homo Sapiens; identical to SEQ ID NO: 468403

SEQ ID NO: 580468 - RNA, 64 nt, Homo Sapiens; identical to SEQ ID NO: 468404

SEQ ID NO: 580469 - RNA, 64 nt, Homo Sapiens; identical to SEQ ID NO: 468405

SEQ ID NO: 580470 - RNA, 64 nt, Homo Sapiens; identical to SEQ ID NO: 468406

SEQ ID NO: 580471 - RNA, 64 nt, Homo Sapiens; identical to SEQ ID NO: 468407

SEQ ID NO: 580472 - RNA, 64 nt, Homo Sapiens; identical to SEQ ID NO: 468408

SEQ ID NO: 580473 - RNA, 64 nt, Homo Sapiens; identical to SEQ ID NO: 468409

SEQ ID NO: 580474 - RNA, 64 nt, Homo Sapiens; identical to SEQ ID NO: 468410

SEQ ID NO: 580475 - RNA, 64 nt, Homo Sapiens; identical to SEQ ID NO: 468411

SEQ ID NO: 580476 - RNA, 64 nt, Homo Sapiens; identical to SEQ ID NO: 468412

SEQ ID NO: 580477 - RNA, 64 nt, Homo Sapiens; identical to SEQ ID NO: 468413

SEQ ID NO: 580478 - RNA, 64 nt, Homo Sapiens; identical to SEQ ID NO: 468414

SEQ ID NO: 580479 - RNA, 64 nt, Homo Sapiens; identical to SEQ ID NO: 468415

SEQ ID NO: 580480 - RNA, 64 nt, Homo Sapiens; identical to SEQ ID NO: 484434

SEQ ID NO: 580481 - RNA, 64 nt, Homo Sapiens; identical to SEQ ID NO: 484435

SEQ ID NO: 580482 - RNA, 64 nt, Homo Sapiens; identical to SEQ ID NO: 484436

SEQ ID NO: 580483 - RNA, 64 nt, Homo Sapiens; identical to SEQ ID NO: 484437

SEQ ID NO: 580484 - RNA, 64 nt, Homo Sapiens; identical to SEQ ID NO: 484438

SEQ ID NO: 580485 - RNA, 64 nt, Homo Sapiens; identical to SEQ ID NO: 484439

SEQ ID NO: 580486 - RNA, 64 nt, Homo Sapiens; identical to SEQ ID NO: 484440

SEQ ID NO: 580487 - RNA, 64 nt, Homo Sapiens; identical to SEQ ID NO: 484441

SEQ ID NO: 580488 - RNA, 64 nt, Homo Sapiens; identical to SEQ ID NO: 484442

SEQ ID NO: 580489 - RNA, 64 nt, Homo Sapiens; identical to SEQ ID NO: 484443

SEQ ID NO: 580490 - RNA, 64 nt, Homo Sapiens; identical to SEQ ID NO: 484444

SEQ ID NO: 580491 - RNA, 64 nt, Homo Sapiens; identical to SEQ ID NO: 484445

SEQ ID NO: 580492 - RNA, 64 nt, Homo Sapiens; identical to SEQ ID NO: 484446

SEQ ID NO: 580493 - RNA, 64 nt, Homo Sapiens; identical to SEQ ID NO: 484447

SEQ ID NO: 580494 - RNA, 64 nt, Homo Sapiens; identical to SEQ ID NO: 484448

SEQ ID NO: 580495 - RNA, 64 nt, Homo Sapiens; identical to SEQ ID NO: 484449

SEQ ID NO: 580496 - RNA, 64 nt, Homo Sapiens; identical to SEQ ID NO: 484450

SEQ ID NO: 580497 - RNA, 64 nt, Homo Sapiens; identical to SEQ ID NO: 484451

SEQ ID NO: 580498 - RNA, 64 nt, Homo Sapiens; identical to SEQ ID NO: 484452

SEQ ID NO: 580499 - RNA, 64 nt, Homo Sapiens; identical to SEQ ID NO: 484453

SEQ ID NO: 580500 - RNA, 64 nt, Homo Sapiens; identical to SEQ ID NO: 484454

SEQ ID NO: 580501 - RNA, 64 nt, Homo Sapiens; identical to SEQ ID NO: 484455

SEQ ID NO: 580502 - RNA, 64 nt, Homo Sapiens; identical to SEQ ID NO: 484456

SEQ ID NO: 580503 - RNA, 64 nt, Homo Sapiens; identical to SEQ ID NO: 484457

SEQ ID NO: 580504 - RNA, 64 nt, Homo Sapiens; identical to SEQ ID NO: 484458

SEQ ID NO: 580505 - RNA, 64 nt, Homo Sapiens; identical to SEQ ID NO: 484459

SEQ ID NO: 580506 - RNA, 64 nt, Homo Sapiens; identical to SEQ ID NO: 484460

SEQ ID NO: 580507 - RNA, 64 nt, Homo Sapiens; identical to SEQ ID NO: 484461

SEQ ID NO: 580508 - RNA, 64 nt, Homo Sapiens; identical to SEQ ID NO: 484462

SEQ ID NO: 580509 - RNA, 64 nt, Homo Sapiens; identical to SEQ ID NO: 484463

SEQ ID NO: 580510 - RNA, 64 nt, Homo Sapiens; identical to SEQ ID NO: 484464

SEQ ID NO: 580511 - RNA, 64 nt, Homo Sapiens; identical to SEQ ID NO: 484465

SEQ ID NO: 580512 - RNA, 64 nt, Homo Sapiens; identical to SEQ ID NO: 484466

SEQ ID NO: 580513 - RNA, 64 nt, Homo Sapiens; identical to SEQ ID NO: 484467

SEQ ID NO: 580514 - RNA, 64 nt, Homo Sapiens; identical to SEQ ID NO: 484468

SEQ ID NO: 580515 - RNA, 64 nt, Homo Sapiens; identical to SEQ ID NO: 484469

SEQ ID NO: 580516 - RNA, 64 nt, Homo Sapiens; identical to SEQ ID NO: 484470

SEQ ID NO: 580517 - RNA, 64 nt, Homo Sapiens; identical to SEQ ID NO: 484471

SEQ ID NO: 580518 - RNA, 64 nt, Homo Sapiens; identical to SEQ ID NO: 484472

SEQ ID NO: 580519 - RNA, 64 nt, Homo Sapiens; identical to SEQ ID NO: 484473

SEQ ID NO: 580520 - RNA, 64 nt, Homo Sapiens; identical to SEQ ID NO: 484474

SEQ ID NO: 580521 - RNA, 64 nt, Homo Sapiens; identical to SEQ ID NO: 484475

SEQ ID NO: 580522 - RNA, 64 nt, Homo Sapiens; identical to SEQ ID NO: 484476

SEQ ID NO: 580523 - RNA, 64 nt, Homo Sapiens; identical to SEQ ID NO: 484477

SEQ ID NO: 580524 - RNA, 64 nt, Homo Sapiens; identical to SEQ ID NO: 484478

SEQ ID NO: 580525 - RNA, 64 nt, Homo Sapiens; identical to SEQ ID NO: 484479

SEQ ID NO: 580526 - RNA, 64 nt, Homo Sapiens; identical to SEQ ID NO: 484480

SEQ ID NO: 580527 - RNA, 64 nt, Homo Sapiens; identical to SEQ ID NO: 484481

SEQ ID NO: 580528 - RNA, 64 nt, Homo Sapiens; identical to SEQ ID NO: 484482

SEQ ID NO: 580529 - RNA, 64 nt, Homo Sapiens; identical to SEQ ID NO: 100251

SEQ ID NO: 580530 - RNA, 64 nt, Homo Sapiens; identical to SEQ ID NO: 100252

SEQ ID NO: 580531 - RNA, 64 nt, Homo Sapiens; identical to SEQ ID NO: 100253

SEQ ID NO: 580532 - RNA, 64 nt, Homo Sapiens; identical to SEQ ID NO: 100254

SEQ ID NO: 580533 - RNA, 64 nt, Homo Sapiens; identical to SEQ ID NO: 100255

SEQ ID NO: 580534 - RNA, 64 nt, Homo Sapiens; identical to SEQ ID NO: 100256

SEQ ID NO: 580535 - RNA, 64 nt, Homo Sapiens; identical to SEQ ID NO: 100257

SEQ ID NO: 580536 - RNA, 64 nt, Homo Sapiens; identical to SEQ ID NO: 100258

SEQ ID NO: 580537 - RNA, 64 nt, Homo Sapiens; identical to SEQ ID NO: 100259

SEQ ID NO: 580538 - RNA, 64 nt, Homo Sapiens; identical to SEQ ID NO: 100260

SEQ ID NO: 580539 - RNA, 64 nt, Homo Sapiens; identical to SEQ ID NO: 100261

SEQ ID NO: 580540 - RNA, 64 nt, Homo Sapiens; identical to SEQ ID NO: 100262

SEQ ID NO: 580541 - RNA, 64 nt, Homo Sapiens; identical to SEQ ID NO: 100263

SEQ ID NO: 580542 - RNA, 64 nt, Homo Sapiens; identical to SEQ ID NO: 100264

SEQ ID NO: 580543 - RNA, 64 nt, Homo Sapiens; identical to SEQ ID NO: 100265

SEQ ID NO: 580544 - RNA, 64 nt, Homo Sapiens; identical to SEQ ID NO: 100266

SEQ ID NO: 580545 - RNA, 64 nt, Homo Sapiens; identical to SEQ ID NO: 100267

SEQ ID NO: 580546 - RNA, 64 nt, Homo Sapiens; identical to SEQ ID NO: 100268

SEQ ID NO: 580547 - RNA, 64 nt, Homo Sapiens; identical to SEQ ID NO: 100269

SEQ ID NO: 580548 - RNA, 64 nt, Homo Sapiens; identical to SEQ ID NO: 100270

SEQ ID NO: 580549 - RNA, 64 nt, Homo Sapiens; identical to SEQ ID NO: 100271

SEQ ID NO: 580550 - RNA, 64 nt, Homo Sapiens; identical to SEQ ID NO: 100272

SEQ ID NO: 580551 - RNA, 64 nt, Homo Sapiens; identical to SEQ ID NO: 100273

SEQ ID NO: 580552 - RNA, 64 nt, Homo Sapiens; identical to SEQ ID NO: 100274

SEQ ID NO: 580553 - RNA, 64 nt, Homo Sapiens; identical to SEQ ID NO: 100275

SEQ ID NO: 580554 - RNA, 64 nt, Homo Sapiens; identical to SEQ ID NO: 100276

SEQ ID NO: 580555 - RNA, 64 nt, Homo Sapiens; identical to SEQ ID NO: 100277

SEQ ID NO: 580556 - RNA, 64 nt, Homo Sapiens; identical to SEQ ID NO: 100278

SEQ ID NO: 580557 - RNA, 64 nt, Homo Sapiens; identical to SEQ ID NO: 100279

SEQ ID NO: 580558 - RNA, 64 nt, Homo Sapiens; identical to SEQ ID NO: 100280

SEQ ID NO: 580559 - RNA, 64 nt, Homo Sapiens; identical to SEQ ID NO: 100281

SEQ ID NO: 580560 - RNA, 64 nt, Homo Sapiens; identical to SEQ ID NO: 100282

SEQ ID NO: 580561 - RNA, 64 nt, Homo Sapiens; identical to SEQ ID NO: 100283

SEQ ID NO: 580562 - RNA, 64 nt, Homo Sapiens; identical to SEQ ID NO: 100284

SEQ ID NO: 580563 - RNA, 64 nt, Homo Sapiens; identical to SEQ ID NO: 100285

SEQ ID NO: 580564 - RNA, 64 nt, Homo Sapiens; identical to SEQ ID NO: 100286

SEQ ID NO: 580565 - RNA, 64 nt, Homo Sapiens; identical to SEQ ID NO: 100287

SEQ ID NO: 580566 - RNA, 64 nt, Homo Sapiens; identical to SEQ ID NO: 100288

SEQ ID NO: 580567 - RNA, 64 nt, Homo Sapiens; identical to SEQ ID NO: 100289

SEQ ID NO: 580568 - RNA, 64 nt, Homo Sapiens; identical to SEQ ID NO: 100290

SEQ ID NO: 580569 - RNA, 64 nt, Homo Sapiens; identical to SEQ ID NO: 100291

SEQ ID NO: 580570 - RNA, 64 nt, Homo Sapiens; identical to SEQ ID NO: 100292

SEQ ID NO: 580571 - RNA, 64 nt, Homo Sapiens; identical to SEQ ID NO: 100293

SEQ ID NO: 580572 - RNA, 64 nt, Homo Sapiens; identical to SEQ ID NO: 100294

SEQ ID NO: 580573 - RNA, 64 nt, Homo Sapiens; identical to SEQ ID NO: 100295

SEQ ID NO: 580574 - RNA, 64 nt, Homo Sapiens; identical to SEQ ID NO: 100296

SEQ ID NO: 580575 - RNA, 64 nt, Homo Sapiens; identical to SEQ ID NO: 100297

SEQ ID NO: 580576 - RNA, 64 nt, Homo Sapiens; identical to SEQ ID NO: 100298

SEQ ID NO: 580577 - RNA, 64 nt, Homo Sapiens; identical to SEQ ID NO: 100299

SEQ ID NO: 580578 - RNA, 64 nt, Homo Sapiens; identical to SEQ ID NO: 100300

SEQ ID NO: 580579 - RNA, 64 nt, Homo Sapiens; identical to SEQ ID NO: 100301

SEQ ID NO: 580580 - RNA, 64 nt, Homo Sapiens; identical to SEQ ID NO: 100302

SEQ ID NO: 580581 - RNA, 64 nt, Homo Sapiens; identical to SEQ ID NO: 100303

SEQ ID NO: 580582 - RNA, 62 nt, Homo Sapiens
aguggccagcuucacucucugggggagugcaggguggacaucaccuuggaggcccugcacug

SEQ ID NO: 580583 - RNA, 62 nt, Homo Sapiens
cagaagcucccagcugaccagacacugccugggguggacauucagcagagugcgaguggaga

SEQ ID NO: 580584 - RNA, 62 nt, Homo Sapiens
uucacugguggaccaguugguagcucagggccgguggacaugggaauaauaaaccaaugagu

SEQ ID NO: 580585 - RNA, 62 nt, Homo Sapiens
uuuucaaccuuuauuaaaaauuuuuaauccaggguggacauuguuccccuugguuaacugau

SEQ ID NO: 580586 - RNA, 62 nt, Homo Sapiens
ggucaccuaucuguagccagcggugagggacagguggacaacgggccggcaaggccauaccu

SEQ ID NO: 580587 - RNA, 62 nt, Homo Sapiens
gaaaggcuucucagccucugcacacccagccugguggacauguccucuugguaaguguggcc

SEQ ID NO: 580588 - RNA, 62 nt, Homo Sapiens
acuucaacgcaugauauuuacacguggcaagugguggacaaagaaccacguaaagcucgaac

SEQ ID NO: 580589 - RNA, 62 nt, Homo Sapiens
caacccagcaucccccgaccagaauggaggaagguggacaaggggggcucuuccaagucaga

SEQ ID NO: 580590 - RNA, 62 nt, Homo Sapiens
agcuaacccugagcuugucccaugggaaagcagguggacaugaccuugguggcacuggugga

SEQ ID NO: 580591 - RNA, 62 nt, Homo Sapiens
ggaaagcagguggacaugagcuugguggcacugguggacaugcccgcuggccagagggacac

SEQ ID NO: 580592 - RNA, 62 nt, Homo Sapiens
cuuucagcgaaguaggagaaacauucaaccaagguggacagcuccgcuuacgguacaagcug

SEQ ID NO: 580593 - RNA, 62 nt, Homo Sapiens
ggaccugcgcagauggggacgauugacuuggagguggacaauugcaugaagaccugcccccu

SEQ ID NO: 580594 - RNA, 62 nt, Homo Sapiens
acucaugccaacagucuuuaugaugggauuaagguggacaagaucuccuaagaucugugaau

SEQ ID NO: 580595 - RNA, 62 nt, Homo Sapiens
caagaucuccuaagaucugugaaugggauuaagguggacaagaucuccuaagaucugaaaag

SEQ ID NO: 580596 - RNA, 64 nt, Homo Sapiens; identical to SEQ ID NO: 266801

SEQ ID NO: 580597 - RNA, 64 nt, Homo Sapiens; identical to SEQ ID NO: 266802

SEQ ID NO: 580598 - RNA, 64 nt, Homo Sapiens; identical to SEQ ID NO: 266803

SEQ ID NO: 580599 - RNA, 64 nt, Homo Sapiens; identical to SEQ ID NO: 266804

SEQ ID NO: 580600 - RNA, 64 nt, Homo Sapiens; identical to SEQ ID NO: 266805

SEQ ID NO: 580601 - RNA, 64 nt, Homo Sapiens; identical to SEQ ID NO: 266806

SEQ ID NO: 580602 - RNA, 64 nt, Homo Sapiens; identical to SEQ ID NO: 58312

SEQ ID NO: 580603 - RNA, 64 nt, Homo Sapiens; identical to SEQ ID NO: 58313

SEQ ID NO: 580604 - RNA, 64 nt, Homo Sapiens; identical to SEQ ID NO: 58314

SEQ ID NO: 580605 - RNA, 64 nt, Homo Sapiens; identical to SEQ ID NO: 58315

SEQ ID NO: 580606 - RNA, 64 nt, Homo Sapiens; identical to SEQ ID NO: 58316

SEQ ID NO: 580607 - RNA, 64 nt, Homo Sapiens; identical to SEQ ID NO: 58317

SEQ ID NO: 580608 - RNA, 64 nt, Homo Sapiens; identical to SEQ ID NO: 58318

SEQ ID NO: 580609 - RNA, 64 nt, Homo Sapiens; identical to SEQ ID NO: 58319

SEQ ID NO: 580610 - RNA, 64 nt, Homo Sapiens; identical to SEQ ID NO: 58320

SEQ ID NO: 580611 - RNA, 64 nt, Homo Sapiens; identical to SEQ ID NO: 58321

SEQ ID NO: 580612 - RNA, 64 nt, Homo Sapiens; identical to SEQ ID NO: 58322

SEQ ID NO: 580613 - RNA, 64 nt, Homo Sapiens; identical to SEQ ID NO: 58323

SEQ ID NO: 580614 - RNA, 64 nt, Homo Sapiens; identical to SEQ ID NO: 58324

SEQ ID NO: 580615 - RNA, 64 nt, Homo Sapiens; identical to SEQ ID NO: 58325

SEQ ID NO: 580616 - RNA, 64 nt, Homo Sapiens; identical to SEQ ID NO: 58326

SEQ ID NO: 580617 - RNA, 64 nt, Homo Sapiens; identical to SEQ ID NO: 58327

SEQ ID NO: 580618 - RNA, 64 nt, Homo Sapiens; identical to SEQ ID NO: 58328

SEQ ID NO: 580619 - RNA, 64 nt, Homo Sapiens; identical to SEQ ID NO: 58329

SEQ ID NO: 580620 - RNA, 64 nt, Homo Sapiens; identical to SEQ ID NO: 58330

SEQ ID NO: 580621 - RNA, 64 nt, Homo Sapiens; identical to SEQ ID NO: 58331

SEQ ID NO: 580622 - RNA, 64 nt, Homo Sapiens; identical to SEQ ID NO: 58332

SEQ ID NO: 580623 - RNA, 64 nt, Homo Sapiens; identical to SEQ ID NO: 58333

SEQ ID NO: 580624 - RNA, 64 nt, Homo Sapiens; identical to SEQ ID NO: 58334

SEQ ID NO: 580625 - RNA, 64 nt, Homo Sapiens; identical to SEQ ID NO: 58335

SEQ ID NO: 580626 - RNA, 64 nt, Homo Sapiens; identical to SEQ ID NO: 58336

SEQ ID NO: 580627 - RNA, 64 nt, Homo Sapiens; identical to SEQ ID NO: 58337

SEQ ID NO: 580628 - RNA, 64 nt, Homo Sapiens; identical to SEQ ID NO: 58338

SEQ ID NO: 580629 - RNA, 64 nt, Homo Sapiens; identical to SEQ ID NO: 58339

SEQ ID NO: 580630 - RNA, 64 nt, Homo Sapiens; identical to SEQ ID NO: 58340

SEQ ID NO: 580631 - RNA, 64 nt, Homo Sapiens; identical to SEQ ID NO: 58341

SEQ ID NO: 580632 - RNA, 64 nt, Homo Sapiens; identical to SEQ ID NO: 58342

SEQ ID NO: 580633 - RNA, 64 nt, Homo Sapiens; identical to SEQ ID NO: 58343

SEQ ID NO: 580634 - RNA, 64 nt, Homo Sapiens; identical to SEQ ID NO: 58344

SEQ ID NO: 580635 - RNA, 64 nt, Homo Sapiens; identical to SEQ ID NO: 58345

SEQ ID NO: 580636 - RNA, 64 nt, Homo Sapiens; identical to SEQ ID NO: 58346

SEQ ID NO: 580637 - RNA, 64 nt, Homo Sapiens; identical to SEQ ID NO: 58347

SEQ ID NO: 580638 - RNA, 64 nt, Homo Sapiens; identical to SEQ ID NO: 58348

SEQ ID NO: 580639 - RNA, 64 nt, Homo Sapiens; identical to SEQ ID NO: 58349

SEQ ID NO: 580640 - RNA, 64 nt, Homo Sapiens; identical to SEQ ID NO: 58350

SEQ ID NO: 580641 - RNA, 64 nt, Homo Sapiens; identical to SEQ ID NO: 58351

SEQ ID NO: 580642 - RNA, 64 nt, Homo Sapiens; identical to SEQ ID NO: 58352

SEQ ID NO: 580643 - RNA, 64 nt, Homo Sapiens; identical to SEQ ID NO: 58353

SEQ ID NO: 580644 - RNA, 64 nt, Homo Sapiens; identical to SEQ ID NO: 58354

SEQ ID NO: 580645 - RNA, 64 nt, Homo Sapiens; identical to SEQ ID NO: 58355

SEQ ID NO: 580646 - RNA, 64 nt, Homo Sapiens; identical to SEQ ID NO: 58356

SEQ ID NO: 580647 - RNA, 64 nt, Homo Sapiens; identical to SEQ ID NO: 58357

SEQ ID NO: 580648 - RNA, 64 nt, Homo Sapiens; identical to SEQ ID NO: 58358

SEQ ID NO: 580649 - RNA, 64 nt, Homo Sapiens; identical to SEQ ID NO: 58359

SEQ ID NO: 580650 - RNA, 64 nt, Homo Sapiens; identical to SEQ ID NO: 58360

SEQ ID NO: 580651 - RNA, 64 nt, Homo Sapiens; identical to SEQ ID NO: 58361

SEQ ID NO: 580652 - RNA, 64 nt, Homo Sapiens; identical to SEQ ID NO: 58362

SEQ ID NO: 580653 - RNA, 64 nt, Homo Sapiens; identical to SEQ ID NO: 58363

SEQ ID NO: 580654 - RNA, 64 nt, Homo Sapiens; identical to SEQ ID NO: 58364

SEQ ID NO: 580655 - RNA, 64 nt, Homo Sapiens; identical to SEQ ID NO: 58365

SEQ ID NO: 580656 - RNA, 64 nt, Homo Sapiens; identical to SEQ ID NO: 58366

SEQ ID NO: 580657 - RNA, 64 nt, Homo Sapiens; identical to SEQ ID NO: 58367

SEQ ID NO: 580658 - RNA, 64 nt, Homo Sapiens; identical to SEQ ID NO: 58368

SEQ ID NO: 580659 - RNA, 64 nt, Homo Sapiens; identical to SEQ ID NO: 58369

SEQ ID NO: 580660 - RNA, 64 nt, Homo Sapiens; identical to SEQ ID NO: 58370

SEQ ID NO: 580661 - RNA, 64 nt, Homo Sapiens; identical to SEQ ID NO: 58371

SEQ ID NO: 580662 - RNA, 64 nt, Homo Sapiens; identical to SEQ ID NO: 58372

SEQ ID NO: 580663 - RNA, 64 nt, Homo Sapiens; identical to SEQ ID NO: 58373

SEQ ID NO: 580664 - RNA, 64 nt, Homo Sapiens; identical to SEQ ID NO: 58374

SEQ ID NO: 580665 - RNA, 64 nt, Homo Sapiens; identical to SEQ ID NO: 58375

SEQ ID NO: 580666 - RNA, 64 nt, Homo Sapiens; identical to SEQ ID NO: 58376

SEQ ID NO: 580667 - RNA, 64 nt, Homo Sapiens; identical to SEQ ID NO: 58377

SEQ ID NO: 580668 - RNA, 64 nt, Homo Sapiens; identical to SEQ ID NO: 58378

SEQ ID NO: 580669 - RNA, 64 nt, Homo Sapiens; identical to SEQ ID NO: 58379

SEQ ID NO: 580670 - RNA, 64 nt, Homo Sapiens; identical to SEQ ID NO: 58380

SEQ ID NO: 580671 - RNA, 64 nt, Homo Sapiens; identical to SEQ ID NO: 58381

SEQ ID NO: 580672 - RNA, 64 nt, Homo Sapiens; identical to SEQ ID NO: 58382

SEQ ID NO: 580673 - RNA, 64 nt, Homo Sapiens; identical to SEQ ID NO: 58383

SEQ ID NO: 580674 - RNA, 64 nt, Homo Sapiens; identical to SEQ ID NO: 58384

SEQ ID NO: 580675 - RNA, 64 nt, Homo Sapiens; identical to SEQ ID NO: 58385

SEQ ID NO: 580676 - RNA, 64 nt, Homo Sapiens; identical to SEQ ID NO: 58386

SEQ ID NO: 580677 - RNA, 64 nt, Homo Sapiens; identical to SEQ ID NO: 58387

SEQ ID NO: 580678 - RNA, 64 nt, Homo Sapiens; identical to SEQ ID NO: 58388

SEQ ID NO: 580679 - RNA, 64 nt, Homo Sapiens; identical to SEQ ID NO: 58389

SEQ ID NO: 580680 - RNA, 64 nt, Homo Sapiens; identical to SEQ ID NO: 58390

SEQ ID NO: 580681 - RNA, 64 nt, Homo Sapiens; identical to SEQ ID NO: 58391

SEQ ID NO: 580682 - RNA, 64 nt, Homo Sapiens; identical to SEQ ID NO: 58392

SEQ ID NO: 580683 - RNA, 64 nt, Homo Sapiens; identical to SEQ ID NO: 58393

SEQ ID NO: 580684 - RNA, 64 nt, Homo Sapiens; identical to SEQ ID NO: 58394

SEQ ID NO: 580685 - RNA, 64 nt, Homo Sapiens; identical to SEQ ID NO: 58395

SEQ ID NO: 580686 - RNA, 64 nt, Homo Sapiens; identical to SEQ ID NO: 58396

SEQ ID NO: 580687 - RNA, 64 nt, Homo Sapiens; identical to SEQ ID NO: 58397

SEQ ID NO: 580688 - RNA, 64 nt, Homo Sapiens; identical to SEQ ID NO: 58398

SEQ ID NO: 580689 - RNA, 64 nt, Homo Sapiens; identical to SEQ ID NO: 58399

SEQ ID NO: 580690 - RNA, 64 nt, Homo Sapiens; identical to SEQ ID NO: 58400

SEQ ID NO: 580691 - RNA, 64 nt, Homo Sapiens; identical to SEQ ID NO: 58401

SEQ ID NO: 580692 - RNA, 64 nt, Homo Sapiens; identical to SEQ ID NO: 58402

SEQ ID NO: 580693 - RNA, 64 nt, Homo Sapiens; identical to SEQ ID NO: 58403

SEQ ID NO: 580694 - RNA, 64 nt, Homo Sapiens; identical to SEQ ID NO: 58404

SEQ ID NO: 580695 - RNA, 64 nt, Homo Sapiens; identical to SEQ ID NO: 58405

SEQ ID NO: 580696 - RNA, 64 nt, Homo Sapiens; identical to SEQ ID NO: 58406

SEQ ID NO: 580697 - RNA, 64 nt, Homo Sapiens; identical to SEQ ID NO: 58407

SEQ ID NO: 580698 - RNA, 64 nt, Homo Sapiens; identical to SEQ ID NO: 58408

SEQ ID NO: 580699 - RNA, 64 nt, Homo Sapiens; identical to SEQ ID NO: 58409

SEQ ID NO: 580700 - RNA, 64 nt, Homo Sapiens; identical to SEQ ID NO: 58410

SEQ ID NO: 580701 - RNA, 64 nt, Homo Sapiens; identical to SEQ ID NO: 58411

SEQ ID NO: 580702 - RNA, 64 nt, Homo Sapiens; identical to SEQ ID NO: 58412

SEQ ID NO: 580703 - RNA, 64 nt, Homo Sapiens; identical to SEQ ID NO: 58413

SEQ ID NO: 580704 - RNA, 64 nt, Homo Sapiens; identical to SEQ ID NO: 58414

SEQ ID NO: 580705 - RNA, 64 nt, Homo Sapiens; identical to SEQ ID NO: 58415

SEQ ID NO: 580706 - RNA, 64 nt, Homo Sapiens; identical to SEQ ID NO: 58416

SEQ ID NO: 580707 - RNA, 64 nt, Homo Sapiens; identical to SEQ ID NO: 58417

SEQ ID NO: 580708 - RNA, 64 nt, Homo Sapiens; identical to SEQ ID NO: 58418

SEQ ID NO: 580709 - RNA, 64 nt, Homo Sapiens; identical to SEQ ID NO: 58419

SEQ ID NO: 580710 - RNA, 64 nt, Homo Sapiens; identical to SEQ ID NO: 58420

SEQ ID NO: 580711 - RNA, 64 nt, Homo Sapiens; identical to SEQ ID NO: 58421

SEQ ID NO: 580712 - RNA, 64 nt, Homo Sapiens; identical to SEQ ID NO: 58422

SEQ ID NO: 580713 - RNA, 64 nt, Homo Sapiens; identical to SEQ ID NO: 58423

SEQ ID NO: 580714 - RNA, 64 nt, Homo Sapiens; identical to SEQ ID NO: 58424

SEQ ID NO: 580715 - RNA, 64 nt, Homo Sapiens; identical to SEQ ID NO: 58425

SEQ ID NO: 580716 - RNA, 64 nt, Homo Sapiens; identical to SEQ ID NO: 58426

SEQ ID NO: 580717 - RNA, 64 nt, Homo Sapiens; identical to SEQ ID NO: 58427

SEQ ID NO: 580718 - RNA, 64 nt, Homo Sapiens; identical to SEQ ID NO: 58428

SEQ ID NO: 580719 - RNA, 64 nt, Homo Sapiens; identical to SEQ ID NO: 58429

SEQ ID NO: 580720 - RNA, 64 nt, Homo Sapiens; identical to SEQ ID NO: 58430

SEQ ID NO: 580721 - RNA, 64 nt, Homo Sapiens; identical to SEQ ID NO: 58431

SEQ ID NO: 580722 - RNA, 64 nt, Homo Sapiens; identical to SEQ ID NO: 58432

SEQ ID NO: 580723 - RNA, 64 nt, Homo Sapiens; identical to SEQ ID NO: 58433

SEQ ID NO: 580724 - RNA, 64 nt, Homo Sapiens; identical to SEQ ID NO: 58434

SEQ ID NO: 580725 - RNA, 64 nt, Homo Sapiens; identical to SEQ ID NO: 58435

SEQ ID NO: 580726 - RNA, 50 nt, Homo Sapiens; identical to SEQ ID NO: 58436

SEQ ID NO: 580727 - RNA, 64 nt, Homo Sapiens; identical to SEQ ID NO: 58437

SEQ ID NO: 580728 - RNA, 64 nt, Homo Sapiens; identical to SEQ ID NO: 58438

SEQ ID NO: 580729 - RNA, 64 nt, Homo Sapiens; identical to SEQ ID NO: 58439

SEQ ID NO: 580730 - RNA, 64 nt, Homo Sapiens; identical to SEQ ID NO: 58440

SEQ ID NO: 580731 - RNA, 64 nt, Homo Sapiens; identical to SEQ ID NO: 58441

SEQ ID NO: 580732 - RNA, 64 nt, Homo Sapiens; identical to SEQ ID NO: 58442

SEQ ID NO: 580733 - RNA, 64 nt, Homo Sapiens; identical to SEQ ID NO: 58443

SEQ ID NO: 580734 - RNA, 64 nt, Homo Sapiens; identical to SEQ ID NO: 58444

SEQ ID NO: 580735 - RNA, 64 nt, Homo Sapiens; identical to SEQ ID NO: 58445

SEQ ID NO: 580736 - RNA, 64 nt, Homo Sapiens; identical to SEQ ID NO: 58446

SEQ ID NO: 580737 - RNA, 64 nt, Homo Sapiens; identical to SEQ ID NO: 58447

SEQ ID NO: 580738 - RNA, 64 nt, Homo Sapiens; identical to SEQ ID NO: 58448

SEQ ID NO: 580739 - RNA, 64 nt, Homo Sapiens; identical to SEQ ID NO: 58449

SEQ ID NO: 580740 - RNA, 64 nt, Homo Sapiens; identical to SEQ ID NO: 58450

SEQ ID NO: 580741 - RNA, 64 nt, Homo Sapiens; identical to SEQ ID NO: 58451

SEQ ID NO: 580742 - RNA, 64 nt, Homo Sapiens; identical to SEQ ID NO: 58452

SEQ ID NO: 580743 - RNA, 64 nt, Homo Sapiens; identical to SEQ ID NO: 58453

SEQ ID NO: 580744 - RNA, 64 nt, Homo Sapiens; identical to SEQ ID NO: 58454

SEQ ID NO: 580745 - RNA, 64 nt, Homo Sapiens; identical to SEQ ID NO: 58455

SEQ ID NO: 580746 - RNA, 64 nt, Homo Sapiens; identical to SEQ ID NO: 58456

SEQ ID NO: 580747 - RNA, 64 nt, Homo Sapiens; identical to SEQ ID NO: 58457

SEQ ID NO: 580748 - RNA, 64 nt, Homo Sapiens; identical to SEQ ID NO: 58458

SEQ ID NO: 580749 - RNA, 64 nt, Homo Sapiens; identical to SEQ ID NO: 58459

SEQ ID NO: 580750 - RNA, 64 nt, Homo Sapiens; identical to SEQ ID NO: 58460

SEQ ID NO: 580751 - RNA, 64 nt, Homo Sapiens; identical to SEQ ID NO: 58461

SEQ ID NO: 580752 - RNA, 64 nt, Homo Sapiens; identical to SEQ ID NO: 58462

SEQ ID NO: 580753 - RNA, 64 nt, Homo Sapiens; identical to SEQ ID NO: 58463

SEQ ID NO: 580754 - RNA, 64 nt, Homo Sapiens; identical to SEQ ID NO: 58464

SEQ ID NO: 580755 - RNA, 64 nt, Homo Sapiens; identical to SEQ ID NO: 58465

SEQ ID NO: 580756 - RNA, 64 nt, Homo Sapiens; identical to SEQ ID NO: 58466

SEQ ID NO: 580757 - RNA, 64 nt, Homo Sapiens; identical to SEQ ID NO: 58467

SEQ ID NO: 580758 - RNA, 64 nt, Homo Sapiens; identical to SEQ ID NO: 118152

SEQ ID NO: 580759 - RNA, 64 nt, Homo Sapiens; identical to SEQ ID NO: 118153

SEQ ID NO: 580760 - RNA, 64 nt, Homo Sapiens; identical to SEQ ID NO: 118154

SEQ ID NO: 580761 - RNA, 64 nt, Homo Sapiens; identical to SEQ ID NO: 118155

SEQ ID NO: 580762 - RNA, 64 nt, Homo Sapiens; identical to SEQ ID NO: 118156

SEQ ID NO: 580763 - RNA, 64 nt, Homo Sapiens; identical to SEQ ID NO: 118157

SEQ ID NO: 580764 - RNA, 64 nt, Homo Sapiens; identical to SEQ ID NO: 118158

SEQ ID NO: 580765 - RNA, 64 nt, Homo Sapiens; identical to SEQ ID NO: 118159

SEQ ID NO: 580766 - RNA, 59 nt, Homo Sapiens; identical to SEQ ID NO: 76155

SEQ ID NO: 580767 - RNA, 64 nt, Homo Sapiens; identical to SEQ ID NO: 76156

SEQ ID NO: 580768 - RNA, 64 nt, Homo Sapiens; identical to SEQ ID NO: 76157

SEQ ID NO: 580769 - RNA, 64 nt, Homo Sapiens; identical to SEQ ID NO: 76158

SEQ ID NO: 580770 - RNA, 64 nt, Homo Sapiens; identical to SEQ ID NO: 76159

SEQ ID NO: 580771 - RNA, 64 nt, Homo Sapiens; identical to SEQ ID NO: 76160

SEQ ID NO: 580772 - RNA, 64 nt, Homo Sapiens; identical to SEQ ID NO: 76161

SEQ ID NO: 580773 - RNA, 64 nt, Homo Sapiens; identical to SEQ ID NO: 76162

SEQ ID NO: 580774 - RNA, 64 nt, Homo Sapiens; identical to SEQ ID NO: 76163

SEQ ID NO: 580775 - RNA, 64 nt, Homo Sapiens; identical to SEQ ID NO: 76164

SEQ ID NO: 580776 - RNA, 64 nt, Homo Sapiens; identical to SEQ ID NO: 76165

SEQ ID NO: 580777 - RNA, 64 nt, Homo Sapiens; identical to SEQ ID NO: 76166

SEQ ID NO: 580778 - RNA, 64 nt, Homo Sapiens; identical to SEQ ID NO: 76167

SEQ ID NO: 580779 - RNA, 64 nt, Homo Sapiens; identical to SEQ ID NO: 76168

SEQ ID NO: 580780 - RNA, 64 nt, Homo Sapiens; identical to SEQ ID NO: 76169

SEQ ID NO: 580781 - RNA, 58 nt, Homo Sapiens; identical to SEQ ID NO: 76170

SEQ ID NO: 580782 - RNA, 64 nt, Homo Sapiens; identical to SEQ ID NO: 76171

SEQ ID NO: 580783 - RNA, 64 nt, Homo Sapiens; identical to SEQ ID NO: 76172

SEQ ID NO: 580784 - RNA, 64 nt, Homo Sapiens; identical to SEQ ID NO: 76173

SEQ ID NO: 580785 - RNA, 64 nt, Homo Sapiens; identical to SEQ ID NO: 76174

SEQ ID NO: 580786 - RNA, 64 nt, Homo Sapiens; identical to SEQ ID NO: 76175

SEQ ID NO: 580787 - RNA, 52 nt, Homo Sapiens; identical to SEQ ID NO: 76176

SEQ ID NO: 580788 - RNA, 64 nt, Homo Sapiens; identical to SEQ ID NO: 76177

SEQ ID NO: 580789 - RNA, 64 nt, Homo Sapiens; identical to SEQ ID NO: 76178

SEQ ID NO: 580790 - RNA, 64 nt, Homo Sapiens; identical to SEQ ID NO: 76179

SEQ ID NO: 580791 - RNA, 64 nt, Homo Sapiens; identical to SEQ ID NO: 76180

SEQ ID NO: 580792 - RNA, 64 nt, Homo Sapiens; identical to SEQ ID NO: 76181

SEQ ID NO: 580793 - RNA, 64 nt, Homo Sapiens; identical to SEQ ID NO: 76182

SEQ ID NO: 580794 - RNA, 64 nt, Homo Sapiens; identical to SEQ ID NO: 76183

SEQ ID NO: 580795 - RNA, 64 nt, Homo Sapiens; identical to SEQ ID NO: 76184

SEQ ID NO: 580796 - RNA, 64 nt, Homo Sapiens; identical to SEQ ID NO: 76185

SEQ ID NO: 580797 - RNA, 64 nt, Homo Sapiens; identical to SEQ ID NO: 76186

SEQ ID NO: 580798 - RNA, 64 nt, Homo Sapiens; identical to SEQ ID NO: 76187

SEQ ID NO: 580799 - RNA, 64 nt, Homo Sapiens; identical to SEQ ID NO: 76188

SEQ ID NO: 580800 - RNA, 64 nt, Homo Sapiens; identical to SEQ ID NO: 76189

SEQ ID NO: 580801 - RNA, 64 nt, Homo Sapiens; identical to SEQ ID NO: 76190

SEQ ID NO: 580802 - RNA, 64 nt, Homo Sapiens; identical to SEQ ID NO: 76191

SEQ ID NO: 580803 - RNA, 64 nt, Homo Sapiens; identical to SEQ ID NO: 76192

SEQ ID NO: 580804 - RNA, 64 nt, Homo Sapiens; identical to SEQ ID NO: 76193

SEQ ID NO: 580805 - RNA, 64 nt, Homo Sapiens; identical to SEQ ID NO: 76194

SEQ ID NO: 580806 - RNA, 64 nt, Homo Sapiens; identical to SEQ ID NO: 76195

SEQ ID NO: 580807 - RNA, 64 nt, Homo Sapiens; identical to SEQ ID NO: 76196

SEQ ID NO: 580808 - RNA, 64 nt, Homo Sapiens; identical to SEQ ID NO: 76197

SEQ ID NO: 580809 - RNA, 64 nt, Homo Sapiens; identical to SEQ ID NO: 76198

SEQ ID NO: 580810 - RNA, 64 nt, Homo Sapiens; identical to SEQ ID NO: 76199

SEQ ID NO: 580811 - RNA, 64 nt, Homo Sapiens; identical to SEQ ID NO: 76200

SEQ ID NO: 580812 - RNA, 64 nt, Homo Sapiens; identical to SEQ ID NO: 76201

SEQ ID NO: 580813 - RNA, 64 nt, Homo Sapiens; identical to SEQ ID NO: 76202

SEQ ID NO: 580814 - RNA, 64 nt, Homo Sapiens; identical to SEQ ID NO: 76203

SEQ ID NO: 580815 - RNA, 64 nt, Homo Sapiens; identical to SEQ ID NO: 76204

SEQ ID NO: 580816 - RNA, 64 nt, Homo Sapiens; identical to SEQ ID NO: 76205

SEQ ID NO: 580817 - RNA, 64 nt, Homo Sapiens; identical to SEQ ID NO: 76206

SEQ ID NO: 580818 - RNA, 64 nt, Homo Sapiens; identical to SEQ ID NO: 76207

SEQ ID NO: 580819 - RNA, 64 nt, Homo Sapiens; identical to SEQ ID NO: 76208

SEQ ID NO: 580820 - RNA, 64 nt, Homo Sapiens; identical to SEQ ID NO: 76209

SEQ ID NO: 580821 - RNA, 64 nt, Homo Sapiens; identical to SEQ ID NO: 76210

SEQ ID NO: 580822 - RNA, 64 nt, Homo Sapiens; identical to SEQ ID NO: 76211

SEQ ID NO: 580823 - RNA, 64 nt, Homo Sapiens; identical to SEQ ID NO: 76212

SEQ ID NO: 580824 - RNA, 64 nt, Homo Sapiens; identical to SEQ ID NO: 76213

SEQ ID NO: 580825 - RNA, 64 nt, Homo Sapiens; identical to SEQ ID NO: 76214

SEQ ID NO: 580826 - RNA, 64 nt, Homo Sapiens; identical to SEQ ID NO: 76215

SEQ ID NO: 580827 - RNA, 64 nt, Homo Sapiens; identical to SEQ ID NO: 76216

SEQ ID NO: 580828 - RNA, 64 nt, Homo Sapiens; identical to SEQ ID NO: 76217

SEQ ID NO: 580829 - RNA, 64 nt, Homo Sapiens; identical to SEQ ID NO: 76218

SEQ ID NO: 580830 - RNA, 64 nt, Homo Sapiens; identical to SEQ ID NO: 76219

SEQ ID NO: 580831 - RNA, 64 nt, Homo Sapiens; identical to SEQ ID NO: 238461

SEQ ID NO: 580832 - RNA, 64 nt, Homo Sapiens; identical to SEQ ID NO: 238462

SEQ ID NO: 580833 - RNA, 64 nt, Homo Sapiens; identical to SEQ ID NO: 238463

SEQ ID NO: 580834 - RNA, 64 nt, Homo Sapiens; identical to SEQ ID NO: 238464

SEQ ID NO: 580835 - RNA, 64 nt, Homo Sapiens; identical to SEQ ID NO: 238465

SEQ ID NO: 580836 - RNA, 64 nt, Homo Sapiens; identical to SEQ ID NO: 238466

SEQ ID NO: 580837 - RNA, 64 nt, Homo Sapiens; identical to SEQ ID NO: 238467

SEQ ID NO: 580838 - RNA, 64 nt, Homo Sapiens; identical to SEQ ID NO: 238468

SEQ ID NO: 580839 - RNA, 64 nt, Homo Sapiens; identical to SEQ ID NO: 265126

SEQ ID NO: 580840 - RNA, 64 nt, Homo Sapiens; identical to SEQ ID NO: 265127

SEQ ID NO: 580841 - RNA, 64 nt, Homo Sapiens; identical to SEQ ID NO: 265128

SEQ ID NO: 580842 - RNA, 64 nt, Homo Sapiens; identical to SEQ ID NO: 265129

SEQ ID NO: 580843 - RNA, 64 nt, Homo Sapiens; identical to SEQ ID NO: 265130

SEQ ID NO: 580844 - RNA, 64 nt, Homo Sapiens; identical to SEQ ID NO: 265131

SEQ ID NO: 580845 - RNA, 64 nt, Homo Sapiens; identical to SEQ ID NO: 265132

SEQ ID NO: 580846 - RNA, 64 nt, Homo Sapiens; identical to SEQ ID NO: 265133

SEQ ID NO: 580847 - RNA, 64 nt, Homo Sapiens; identical to SEQ ID NO: 265134

SEQ ID NO: 580848 - RNA, 64 nt, Homo Sapiens; identical to SEQ ID NO: 265135

SEQ ID NO: 580849 - RNA, 64 nt, Homo Sapiens; identical to SEQ ID NO: 265136

SEQ ID NO: 580850 - RNA, 64 nt, Homo Sapiens; identical to SEQ ID NO: 265137

SEQ ID NO: 580851 - RNA, 64 nt, Homo Sapiens; identical to SEQ ID NO: 265138

SEQ ID NO: 580852 - RNA, 64 nt, Homo Sapiens; identical to SEQ ID NO: 265139

SEQ ID NO: 580853 - RNA, 64 nt, Homo Sapiens; identical to SEQ ID NO: 265140

SEQ ID NO: 580854 - RNA, 64 nt, Homo Sapiens; identical to SEQ ID NO: 265141

SEQ ID NO: 580855 - RNA, 64 nt, Homo Sapiens; identical to SEQ ID NO: 265142

SEQ ID NO: 580856 - RNA, 64 nt, Homo Sapiens; identical to SEQ ID NO: 265143

SEQ ID NO: 580857 - RNA, 64 nt, Homo Sapiens; identical to SEQ ID NO: 265144

SEQ ID NO: 580858 - RNA, 64 nt, Homo Sapiens; identical to SEQ ID NO: 265145

SEQ ID NO: 580859 - RNA, 64 nt, Homo Sapiens; identical to SEQ ID NO: 265146

SEQ ID NO: 580860 - RNA, 64 nt, Homo Sapiens; identical to SEQ ID NO: 265147

SEQ ID NO: 580861 - RNA, 64 nt, Homo Sapiens; identical to SEQ ID NO: 265148

SEQ ID NO: 580862 - RNA, 64 nt, Homo Sapiens; identical to SEQ ID NO: 265149

SEQ ID NO: 580863 - RNA, 63 nt, Homo Sapiens; identical to SEQ ID NO: 265150

SEQ ID NO: 580864 - RNA, 64 nt, Homo Sapiens; identical to SEQ ID NO: 265151

SEQ ID NO: 580865 - RNA, 64 nt, Homo Sapiens; identical to SEQ ID NO: 265152

SEQ ID NO: 580866 - RNA, 64 nt, Homo Sapiens; identical to SEQ ID NO: 265153

SEQ ID NO: 580867 - RNA, 64 nt, Homo Sapiens; identical to SEQ ID NO: 265154

SEQ ID NO: 580868 - RNA, 64 nt, Homo Sapiens; identical to SEQ ID NO: 265155

SEQ ID NO: 580869 - RNA, 64 nt, Homo Sapiens; identical to SEQ ID NO: 265156

SEQ ID NO: 580870 - RNA, 64 nt, Homo Sapiens; identical to SEQ ID NO: 265157

SEQ ID NO: 580871 - RNA, 64 nt, Homo Sapiens; identical to SEQ ID NO: 265158

SEQ ID NO: 580872 - RNA, 64 nt, Homo Sapiens; identical to SEQ ID NO: 265159

SEQ ID NO: 580873 - RNA, 64 nt, Homo Sapiens; identical to SEQ ID NO: 265160

SEQ ID NO: 580874 - RNA, 64 nt, Homo Sapiens; identical to SEQ ID NO: 265161

SEQ ID NO: 580875 - RNA, 64 nt, Homo Sapiens; identical to SEQ ID NO: 265162

SEQ ID NO: 580876 - RNA, 64 nt, Homo Sapiens; identical to SEQ ID NO: 265163

SEQ ID NO: 580877 - RNA, 64 nt, Homo Sapiens; identical to SEQ ID NO: 265164

SEQ ID NO: 580878 - RNA, 64 nt, Homo Sapiens; identical to SEQ ID NO: 265165

SEQ ID NO: 580879 - RNA, 64 nt, Homo Sapiens; identical to SEQ ID NO: 265166

SEQ ID NO: 580880 - RNA, 64 nt, Homo Sapiens; identical to SEQ ID NO: 265167

SEQ ID NO: 580881 - RNA, 64 nt, Homo Sapiens; identical to SEQ ID NO: 265168

SEQ ID NO: 580882 - RNA, 64 nt, Homo Sapiens; identical to SEQ ID NO: 265169

SEQ ID NO: 580883 - RNA, 64 nt, Homo Sapiens; identical to SEQ ID NO: 265170

SEQ ID NO: 580884 - RNA, 64 nt, Homo Sapiens; identical to SEQ ID NO: 265171

SEQ ID NO: 580885 - RNA, 64 nt, Homo Sapiens; identical to SEQ ID NO: 265172

SEQ ID NO: 580886 - RNA, 64 nt, Homo Sapiens; identical to SEQ ID NO: 265173

SEQ ID NO: 580887 - RNA, 64 nt, Homo Sapiens; identical to SEQ ID NO: 265174

SEQ ID NO: 580888 - RNA, 64 nt, Homo Sapiens; identical to SEQ ID NO: 265175

SEQ ID NO: 580889 - RNA, 64 nt, Homo Sapiens; identical to SEQ ID NO: 265176

SEQ ID NO: 580890 - RNA, 64 nt, Homo Sapiens; identical to SEQ ID NO: 265177

SEQ ID NO: 580891 - RNA, 64 nt, Homo Sapiens; identical to SEQ ID NO: 265178

SEQ ID NO: 580892 - RNA, 64 nt, Homo Sapiens; identical to SEQ ID NO: 265179

SEQ ID NO: 580893 - RNA, 64 nt, Homo Sapiens
ucccagccuuugcaggagccggguugaggacgcagcacccgagguugagccguggucaccgaga

SEQ ID NO: 580894 - RNA, 64 nt, Homo Sapiens
cuuggcagcauguaccacacucugcucucucuuggcacccgaccccuuggggaccuggcuucau

SEQ ID NO: 580895 - RNA, 64 nt, Homo Sapiens
ugccaaauuccaggaggacaauucaccgugcccagcacccgaaggaaggacaauguuaucuggg

SEQ ID NO: 580896 - RNA, 64 nt, Homo Sapiens
ccuggcccucugggcccaacgcaggaggcccucagcacccgaacacaucuuccuccuccccacc

SEQ ID NO: 580897 - RNA, 64 nt, Homo Sapiens
gaacccaugguggacuccaccuggagaagcccccgcacccgaggggccagggccuggcacccac

SEQ ID NO: 580898 - RNA, 64 nt, Homo Sapiens
ggcuccugaauuuaagucuguugaacugaugucagcacccgaguucauucauuuugcacaauuc

SEQ ID NO: 580899 - RNA, 64 nt, Homo Sapiens
uuuaauuauauggaucucuucuccuugccuaccagcacccgacuguucggugagccuggcacug

SEQ ID NO: 580900 - RNA, 64 nt, Homo Sapiens
gaaauuaaaggaaagggaaagaaauagaucuggugcacccgaacauuaggagaaaaugaaaaau

SEQ ID NO: 580901 - RNA, 64 nt, Homo Sapiens
uuccuuuuuacuugugugguuauguguggggcuggcacccgaaaugugugacauucagcuucua

SEQ ID NO: 580902 - RNA, 64 nt, Homo Sapiens
guugcuguggcucagucacacguccucuuaauuggcacccgaauauuuacaagaaaaugaaaag

SEQ ID NO: 580903 - RNA, 64 nt, Homo Sapiens
ccggggguuucccucaccucgcuucuguccagcugcacccgaggcuucgcccguccgcaugggc

SEQ ID NO: 580904 - RNA, 64 nt, Homo Sapiens
ucgggcccagccccaggcugcagcccauucgcaggcacccgaaagaacuuccccaguauggugg

SEQ ID NO: 580905 - RNA, 64 nt, Homo Sapiens
cauuauuugaccggaucuaccugugaaguggauggcacccgaggcugcuuucagggccgacugc

SEQ ID NO: 580906 - RNA, 64 nt, Homo Sapiens
ggaaggagccgugaggagaggagugaggcaacaggcacccgaagucccucguccuucccucugu

SEQ ID NO: 580907 - RNA, 64 nt, Homo Sapiens
ccuuccuggagcucccagccagagcugagcuuaggcacccgaguggagccugcagcugagucug

SEQ ID NO: 580908 - RNA, 64 nt, Homo Sapiens
cugaguagugggaugaaguccuacauuuuaaacugcacccgauugauccagaaauaaacaauuc

SEQ ID NO: 580909 - RNA, 64 nt, Homo Sapiens
ggucccucagggugcagggaagggcaucccugaggcacccgaaugucagugccccugggaggga

SEQ ID NO: 580910 - RNA, 64 nt, Homo Sapiens
acguccuccgcauccacuuuccagcucagcagccgcacccgaggcucagccugagggguaugug

SEQ ID NO: 580911 - RNA, 64 nt, Homo Sapiens
cccucgcagcagggagcucaccugccucccccuugcacccgaggacagcuccaugagauagaga

SEQ ID NO: 580912 - RNA, 64 nt, Homo Sapiens
ugcaggcguccgccugggcccgcccccgaaccgcgcacccgacuuuccgcugggguuuccgagc

SEQ ID NO: 580913 - RNA, 64 nt, Homo Sapiens
gucuuuucaaagcuauuuauaggcaugagccaccgcacccgacgucccaaagugcugggauuac

SEQ ID NO: 580914 - RNA, 64 nt, Homo Sapiens
uaaaaaaugacaauuaaaugugcagauuccccacgcacccgaugaccuauuuuuucagccgugg

SEQ ID NO: 580915 - RNA, 64 nt, Homo Sapiens
auguggaagaauagcuaucauuccugucucuguggcacccgaucaauggcuuaaaucugucguu

SEQ ID NO: 580916 - RNA, 64 nt, Homo Sapiens
uucuagugcuccauccaccccucucuccacagacgcacccgaauuucuguccguucccaaagau

SEQ ID NO: 580917 - RNA, 64 nt, Homo Sapiens
cggcccccuccugacuugccagcuccuccugccugcacccgacuccugccugccccugcucccc

SEQ ID NO: 580918 - RNA, 64 nt, Homo Sapiens
uaccaggacgcaugccccucaccucaccuccgcagcacccgacuucaguuuccaaaauggaacc

SEQ ID NO: 580919 - RNA, 64 nt, Homo Sapiens
gcugacuauagcaaccagcuggacccggccucuggcacccgaaacuuccacccccgacggcucc

SEQ ID NO: 580920 - RNA, 64 nt, Homo Sapiens
ugugggccugcugugugccaaaccugagcuaccugcacccgagcccuggggcucagccccacca

SEQ ID NO: 580921 - RNA, 64 nt, Homo Sapiens
aguccaucagaaacaggagcugacaaccugcugggcacccgaagaccaagcccccugccagcuc

SEQ ID NO: 580922 - RNA, 64 nt, Homo Sapiens
acuucugacuuucuaaggaaaugaugcuucccaagcacccgagguugguuggucccaaaucuau

SEQ ID NO: 580923 - RNA, 64 nt, Homo Sapiens
ccuggccugccagggaugggaggagcgagcaccagcacccgacgccuccccaggcuggccccag

SEQ ID NO: 580924 - RNA, 64 nt, Homo Sapiens
gccccuucucagggcucagugacacccccuuggggcacccgaguccaaugugggggguccugaa

SEQ ID NO: 580925 - RNA, 64 nt, Homo Sapiens
gcacacaccgaccgccacauccuuugcagacguggcacccgaguugaccacacuguggaaaaua

SEQ ID NO: 580926 - RNA, 64 nt, Homo Sapiens
acgguuaguggcaauuccuuucagagaaauagaagcacccgaaggcccaggggucccugcugga

SEQ ID NO: 580927 - RNA, 64 nt, Homo Sapiens
gacagagguugugguggggcaagaucgcaccauugcacccgagccuaggcaacaagagugaaau

SEQ ID NO: 580928 - RNA, 64 nt, Homo Sapiens
auuuguguggcccauggauuugaaagaagcugcugcacccgaaacugccagugugcggugacaa

SEQ ID NO: 580929 - RNA, 64 nt, Homo Sapiens
cagucccagcucauccucccgcggaugaacuucagcacccgaguggaagauucuggaaugccgu

SEQ ID NO: 580930 - RNA, 64 nt, Homo Sapiens
gauacucacauuuuuaaacuaggugugagccacugcacccgaccucccaaagugcugggauuac

SEQ ID NO: 580931 - RNA, 64 nt, Homo Sapiens
acccagcuuucucccagccacagccaagauucccaaagucaaggcccaaagauuuccaagguuc

SEQ ID NO: 580932 - RNA, 64 nt, Homo Sapiens
ccaaagucaaggcccaaagauuuccaagguucccaaagucaaggccaggccaaggccugguugg

SEQ ID NO: 580933 - RNA, 64 nt, Homo Sapiens
agaacauugguuuagauaaauacuuauacuuugcaaagucaaaaauggcuugauuuuuggaaac

SEQ ID NO: 580934 - RNA, 64 nt, Homo Sapiens
gagauggcauuguguaagaaggagcccuagacugaaagucaagacaucugaauuucaggcugga

SEQ ID NO: 580935 - RNA, 64 nt, Homo Sapiens
uguauucccuauaauauacaaauuuuccuguaauaaagucaacuuagaaacuccaaggagguua

SEQ ID NO: 580936 - RNA, 64 nt, Homo Sapiens
cauacuagauguucaguuaaauauacuuuagcacaaagucaaacuagagaauguguuaaggagg

SEQ ID NO: 580937 - RNA, 64 nt, Homo Sapiens
uucggagcuagaggacauggaaaauaaagccaggaaagucaaaaaaacgaaagagaaggagaag

SEQ ID NO: 580938 - RNA, 64 nt, Homo Sapiens
agagaaggagaagaaaaaggaaaagggcaaauugaaagucaaggagaaaaagcgcaaagaggag

SEQ ID NO: 580939 - RNA, 64 nt, Homo Sapiens
guauaauaaguguuaauuugucagauuggaggucaaagucaaaaucaucaggguaguagaccug

SEQ ID NO: 580940 - RNA, 64 nt, Homo Sapiens
cuaauagggcagucgccagauuuugugaaacauaaaagucaauuaacaguaacuucgguuuugu

SEQ ID NO: 580941 - RNA, 64 nt, Homo Sapiens
aagugugaguaaaguuaguaucucaggauaugagaaagucaauuaaauaguuuucuuagauuaa

SEQ ID NO: 580942 - RNA, 64 nt, Homo Sapiens
caguguucuaaauaaaaauuacaaaguaauaacaaaagucaaagaauaggauauacuaauaaau

SEQ ID NO: 580943 - RNA, 64 nt, Homo Sapiens
aaucuuuugaucuuucccuaucuugauuagauccaaagucaaagcaaccauacuucaccuagag

SEQ ID NO: 580944 - RNA, 64 nt, Homo Sapiens
gcaaucaugacaccuguaauaaaaacuugaauccaaagucaaaacuuaagcaagauacaaaugu

SEQ ID NO: 580945 - RNA, 64 nt, Homo Sapiens
aaaaauauacaaccaaccguucgugagucaucaaaaagucaaagucagccuggccaacauggca

SEQ ID NO: 580946 - RNA, 64 nt, Homo Sapiens
agagagaccuugucucaaaaaacaacaacaacaaaaagucaaagucauaauaagcaaauuauug

SEQ ID NO: 580947 - RNA, 64 nt, Homo Sapiens
aauuaaguucuaguucugacuuuuaaaaaaugugaaagucaaaguaugaucccagcaauacacu

SEQ ID NO: 580948 - RNA, 64 nt, Homo Sapiens
gauucuacaauuggacauucuagccaugacauggaaagucaacuaauuaccuacuaaacagugg

SEQ ID NO: 580949 - RNA, 64 nt, Homo Sapiens
auagacaguguccuguaaauggacacaacacaauaaagucaaguuauuauugcuguuacucugg

SEQ ID NO: 580950 - RNA, 64 nt, Homo Sapiens
ugcugugaaaagcugggcuaaauauucuuucuguaaagucaaacaggauuccauccccugugaa

SEQ ID NO: 580951 - RNA, 64 nt, Homo Sapiens
gggaaaagguagcugaugagugugugcaacaggaaaagucaaaacauggauagucagacugaac

SEQ ID NO: 580952 - RNA, 64 nt, Homo Sapiens
cuauguaaacugguguccucacuacacacaagugaaagucaacccuuuuaaauucugaacugcu

SEQ ID NO: 580953 - RNA, 64 nt, Homo Sapiens
uuuccauauaaauauuagaagcuuuguucuucuuaaagucaagaauaguuguaacuauagucca

SEQ ID NO: 580954 - RNA, 64 nt, Homo Sapiens
uuuucaguucucuugauuuucuaugugcuuguaaaaagucaaugguguggcaguccuagaugcu

SEQ ID NO: 580955 - RNA, 64 nt, Homo Sapiens
uuguuucuacuguuuuauacuuuauguuuggaauaaagucaaccuucuaacacaaaauaagugu

SEQ ID NO: 580956 - RNA, 64 nt, Homo Sapiens
uuguggcuuauggauucauaaaugguggguacaaaaagucaaguugauauaauuuaguuccaca

SEQ ID NO: 580957 - RNA, 64 nt, Homo Sapiens
guccauuuuuaaggacaccugucuuuauuuccucaaagucaagcagcuuucucuggaaaaugaa

SEQ ID NO: 580958 - RNA, 64 nt, Homo Sapiens
agaacacuauuuuuacauaacaguuucuuaaccuaaagucaaggccuuggacucuucccugagg

SEQ ID NO: 580959 - RNA, 64 nt, Homo Sapiens
aagaugguuuuaccuuuacuuucuuagacacaucaaagucaagagguuugauugauuuccuuuu

SEQ ID NO: 580960 - RNA, 64 nt, Homo Sapiens
gauuugaaccugcaucuggacaucagucaaauccaaagucaaagaauccacuguccauguuccu

SEQ ID NO: 580961 - RNA, 64 nt, Homo Sapiens
caagaaaacugucuauuuuuuccccucuaaaguuaaagucaauaucuuuuuccagggacgacug

SEQ ID NO: 580962 - RNA, 64 nt, Homo Sapiens
uaccuguauuuuuaauccacuuaacugucuacuuaaagucaagguauuacuaaucauauguuga

SEQ ID NO: 580963 - RNA, 64 nt, Homo Sapiens
uauauaguauauauuauguauaguuagauuauuuaaagucaauguuugacuuuuaaaaaugaca

SEQ ID NO: 580964 - RNA, 64 nt, Homo Sapiens
cguuaacaauaguuuuuaucacaguauauucuaaaaagucaaaaaaaaagcauuaaccuucuaa

SEQ ID NO: 580965 - RNA, 64 nt, Homo Sapiens
ugaggagcagaggugagaagagagagagagagagaaagucaaauaaagucaaagaccaguuugg

SEQ ID NO: 580966 - RNA, 64 nt, Homo Sapiens
aggugagaagagagagagagagagaaagucaaauaaagucaaagaccaguuuggaaaccaaagu

SEQ ID NO: 580967 - RNA, 64 nt, Homo Sapiens
agucguuguaagagauguggagucuucgguguuuaaagucaacaaccaugccagggauugagga

SEQ ID NO: 580968 - RNA, 64 nt, Homo Sapiens
aucccaagccaaccaagagcacauucuuaaaggaaaagucaacaucuucucucuuuuuuuuuuu

SEQ ID NO: 580969 - RNA, 64 nt, Homo Sapiens
ugggaacugcgucagacaaacuaagccaaagagaaaagucaaucugaaaggaaaauaaaaauua

SEQ ID NO: 580970 - RNA, 64 nt, Homo Sapiens
gacuuaauucuguauuuuaacuuuucauuuaaaaaaagucaaauucaguaauaaauaugugaga

SEQ ID NO: 580971 - RNA, 64 nt, Homo Sapiens
caauugaacucauggauauaauuugcgggaucuaaaagucaaaaaacauugcauguucucaauu

SEQ ID NO: 580972 - RNA, 64 nt, Homo Sapiens
gugaugauuaauuucauuuaauuuucaccucuugaaagucaaaggauaugcuuuauuacacgcu

SEQ ID NO: 580973 - RNA, 64 nt, Homo Sapiens
gggccagggccacuugucagccggugcugggaaagcuuugcauaagguguauccagagcccagc

SEQ ID NO: 580974 - RNA, 64 nt, Homo Sapiens
uggcauaguuucauggaaaggaccucagaggauggcuuugcacuccagccugcagcauagguac

SEQ ID NO: 580975 - RNA, 64 nt, Homo Sapiens
uugggcucuucuauauauuugaagacuguugacugcuuugcauugagagcccccuuccccauca

SEQ ID NO: 580976 - RNA, 64 nt, Homo Sapiens
agaccuugucuccuuagaaaauauaaguuuccaggcuuugcagaugcuaccacaggccaucaaa

SEQ ID NO: 580977 - RNA, 64 nt, Homo Sapiens
cuggcaccucacuuugagaagagugagcacacuggcuuugcauccuggaagaccugcagggggc

SEQ ID NO: 580978 - RNA, 64 nt, Homo Sapiens
uguuagcaagcggcauuuggaugucuugacaggggcuuugcagggauuuuuaggguuuuuucca

SEQ ID NO: 580979 - RNA, 64 nt, Homo Sapiens; identical to SEQ ID NO: 485963

SEQ ID NO: 580980 - RNA, 64 nt, Homo Sapiens; identical to SEQ ID NO: 485964

SEQ ID NO: 580981 - RNA, 64 nt, Homo Sapiens; identical to SEQ ID NO: 485965

SEQ ID NO: 580982 - RNA, 64 nt, Homo Sapiens; identical to SEQ ID NO: 485966

SEQ ID NO: 580983 - RNA, 64 nt, Homo Sapiens; identical to SEQ ID NO: 485967

SEQ ID NO: 580984 - RNA, 64 nt, Homo Sapiens; identical to SEQ ID NO: 485968

SEQ ID NO: 580985 - RNA, 64 nt, Homo Sapiens; identical to SEQ ID NO: 485969

SEQ ID NO: 580986 - RNA, 64 nt, Homo Sapiens; identical to SEQ ID NO: 485970

SEQ ID NO: 580987 - RNA, 64 nt, Homo Sapiens; identical to SEQ ID NO: 115740

SEQ ID NO: 580988 - RNA, 64 nt, Homo Sapiens; identical to SEQ ID NO: 115741

SEQ ID NO: 580989 - RNA, 64 nt, Homo Sapiens; identical to SEQ ID NO: 115742

SEQ ID NO: 580990 - RNA, 64 nt, Homo Sapiens; identical to SEQ ID NO: 115743

SEQ ID NO: 580991 - RNA, 64 nt, Homo Sapiens; identical to SEQ ID NO: 115744

SEQ ID NO: 580992 - RNA, 64 nt, Homo Sapiens; identical to SEQ ID NO: 115745

SEQ ID NO: 580993 - RNA, 64 nt, Homo Sapiens; identical to SEQ ID NO: 115746

SEQ ID NO: 580994 - RNA, 64 nt, Homo Sapiens; identical to SEQ ID NO: 115747

SEQ ID NO: 580995 - RNA, 64 nt, Homo Sapiens; identical to SEQ ID NO: 115748

SEQ ID NO: 580996 - RNA, 64 nt, Homo Sapiens; identical to SEQ ID NO: 115749

SEQ ID NO: 580997 - RNA, 64 nt, Homo Sapiens; identical to SEQ ID NO: 115750

SEQ ID NO: 580998 - RNA, 64 nt, Homo Sapiens; identical to SEQ ID NO: 115751

SEQ ID NO: 580999 - RNA, 64 nt, Homo Sapiens; identical to SEQ ID NO: 115752

SEQ ID NO: 581000 - RNA, 64 nt, Homo Sapiens; identical to SEQ ID NO: 115753

SEQ ID NO: 581001 - RNA, 64 nt, Homo Sapiens; identical to SEQ ID NO: 115754

SEQ ID NO: 581002 - RNA, 64 nt, Homo Sapiens; identical to SEQ ID NO: 115755

SEQ ID NO: 581003 - RNA, 64 nt, Homo Sapiens; identical to SEQ ID NO: 115756

SEQ ID NO: 581004 - RNA, 64 nt, Homo Sapiens; identical to SEQ ID NO: 115757

SEQ ID NO: 581005 - RNA, 64 nt, Homo Sapiens; identical to SEQ ID NO: 115758

SEQ ID NO: 581006 - RNA, 64 nt, Homo Sapiens; identical to SEQ ID NO: 115759

SEQ ID NO: 581007 - RNA, 64 nt, Homo Sapiens; identical to SEQ ID NO: 115760

SEQ ID NO: 581008 - RNA, 64 nt, Homo Sapiens; identical to SEQ ID NO: 115761

SEQ ID NO: 581009 - RNA, 64 nt, Homo Sapiens; identical to SEQ ID NO: 115762

SEQ ID NO: 581010 - RNA, 64 nt, Homo Sapiens; identical to SEQ ID NO: 115763

SEQ ID NO: 581011 - RNA, 64 nt, Homo Sapiens; identical to SEQ ID NO: 115764

SEQ ID NO: 581012 - RNA, 64 nt, Homo Sapiens; identical to SEQ ID NO: 115765

SEQ ID NO: 581013 - RNA, 64 nt, Homo Sapiens; identical to SEQ ID NO: 115766

SEQ ID NO: 581014 - RNA, 64 nt, Homo Sapiens; identical to SEQ ID NO: 115767

SEQ ID NO: 581015 - RNA, 64 nt, Homo Sapiens; identical to SEQ ID NO: 115768

SEQ ID NO: 581016 - RNA, 64 nt, Homo Sapiens; identical to SEQ ID NO: 115769

SEQ ID NO: 581017 - RNA, 64 nt, Homo Sapiens; identical to SEQ ID NO: 115770

SEQ ID NO: 581018 - RNA, 64 nt, Homo Sapiens; identical to SEQ ID NO: 115771

SEQ ID NO: 581019 - RNA, 64 nt, Homo Sapiens; identical to SEQ ID NO: 115772

SEQ ID NO: 581020 - RNA, 64 nt, Homo Sapiens; identical to SEQ ID NO: 115773

SEQ ID NO: 581021 - RNA, 64 nt, Homo Sapiens; identical to SEQ ID NO: 115774

SEQ ID NO: 581022 - RNA, 64 nt, Homo Sapiens; identical to SEQ ID NO: 115775

SEQ ID NO: 581023 - RNA, 64 nt, Homo Sapiens; identical to SEQ ID NO: 115776

SEQ ID NO: 581024 - RNA, 64 nt, Homo Sapiens; identical to SEQ ID NO: 115777

SEQ ID NO: 581025 - RNA, 61 nt, Homo Sapiens
aaucauauugaugaaaucguacaucuuuaugacucuagaauugcagacucaaaccuuccca

SEQ ID NO: 581026 - RNA, 61 nt, Homo Sapiens
ugcggaccaaacuacuucauuuacccagacaacucuagaaauuguuuuuugguuuuuuuuu

SEQ ID NO: 581027 - RNA, 61 nt, Homo Sapiens
aauuucaagacaggauacuagaaugagcauuacucuagauacaguuuuuccaucaugagau

SEQ ID NO: 581028 - RNA, 61 nt, Homo Sapiens
ccuccugagaccuccguccugacaccagugcacucuagauagauccuagcucuuguaggca

SEQ ID NO: 581029 - RNA, 61 nt, Homo Sapiens
cugaagcccucccagguguuaacauuccaagacucuagaguccaagguuuaaagagucuag

SEQ ID NO: 581030 - RNA, 61 nt, Homo Sapiens
aagauucuaacggucuguucuguuucaaggcacucuagauuccauugguccaagauuccgg

SEQ ID NO: 581031 - RNA, 64 nt, Homo Sapiens
gugcacacaaauguuggcaaagucaaaaccccaugaauuaaaaccuacuggaauuugguuuuua

SEQ ID NO: 581032 - RNA, 64 nt, Homo Sapiens
ucuugacaccaauuuuaagaauagcugugagaccgaauuaaagauaaucccuaccaagugaaaa

SEQ ID NO: 581033 - RNA, 64 nt, Homo Sapiens
aagaaaaucugaaguauugugguaauauagagaagaauuaaagcuuuguuaaauauuuuacugu

SEQ ID NO: 581034 - RNA, 64 nt, Homo Sapiens
uaaaggaauuggagguuuuugaugauauguggaggaauuaaauauauuagucaggcccuucaaa

SEQ ID NO: 581035 - RNA, 64 nt, Homo Sapiens
aaacuuuuacuagggcugaaaugauggcaucuuagaauuaaacaaaaaguuaagguuguucacu

SEQ ID NO: 581036 - RNA, 64 nt, Homo Sapiens
uaugaacaucacaaaacaauaacaguuggcauaagaauuaaacacaaugcugucuucaucagaa

SEQ ID NO: 581037 - RNA, 64 nt, Homo Sapiens
guaaauuaguguaccuauuaaaaguugcaaaguggaauuaaaggaaucccuagaauaaggauuc

SEQ ID NO: 581038 - RNA, 64 nt, Homo Sapiens
auuucaguucuaaaaagauguaauaaucauuuuagaauuaaaauuuauucuacuuuuaaauaaa

SEQ ID NO: 581039 - RNA, 64 nt, Homo Sapiens
auuuaauauuugacugauuuuaaauaauacuuccgaauuaaauuacagguguaguuugugugca

SEQ ID NO: 581040 - RNA, 64 nt, Homo Sapiens
gaaacuuauugaauauacaugagcagauuagauugaauuaaauagcagaauuaaauuucuaauu

SEQ ID NO: 581041 - RNA, 64 nt, Homo Sapiens
ucuaauugagcagauuagauaaaauuuuguggcagaauuaaauuauucaguacuuugcuuuaaa

SEQ ID NO: 581042 - RNA, 64 nt, Homo Sapiens
uaaauuuguccuccaacugucuaaauuuuugauagaauuaaauuaauuuaaauuuauccuccaa

SEQ ID NO: 581043 - RNA, 64 nt, Homo Sapiens
uaaauuuauccuccaacuaaauaaauuuuugauagaauuaaauuguuugcacaauuuaaauuug

SEQ ID NO: 581044 - RNA, 64 nt, Homo Sapiens
cuauugaguauagaacuguuacuauaagcacaaggaauuaaauaucuaugccaauuuugaaaaa

SEQ ID NO: 581045 - RNA, 64 nt, Homo Sapiens
cgaaaaacaaaaaaaaacuccuugggcaccaacagaauuaaaaauuuguagaugauguauuuug

SEQ ID NO: 581046 - RNA, 64 nt, Homo Sapiens
augauagagaacuauaugcaaugggggugggaacgaauuaaaaucuguagucaucuuauuugag

SEQ ID NO: 581047 - RNA, 64 nt, Homo Sapiens
aaauggauccaucaucaaagcacaguuugcgcuggaauuaaaugcgagcaauacuauagcuuca

SEQ ID NO: 581048 - RNA, 64 nt, Homo Sapiens
gcauugugcuagcauggaagaaucaugggcuuuggaauuaaacccauuugguggaauuaaaccc

SEQ ID NO: 581049 - RNA, 64 nt, Homo Sapiens
gaaucaugggcuuuggaauuaaacccauuugguggaauuaaacccauuugguuucaaaucccag

SEQ ID NO: 581050 - RNA, 64 nt, Homo Sapiens
uuuacauguuacuuugagaugcuagguauuuguggaauuaaaaagaaucaggcucuuuuguacu

SEQ ID NO: 581051 - RNA, 64 nt, Homo Sapiens
auuccucucaaauucauaacaguucuauuuaacugaauuaaauaaccauaugaaaaaucuuuug

SEQ ID NO: 581052 - RNA, 64 nt, Homo Sapiens
aaauugcaggagauuuaauguauaaaauuucuaggaauuaaaagcuuaaacccaaaaauuguuc

SEQ ID NO: 581053 - RNA, 64 nt, Homo Sapiens
ccaaaaauuguucauccauauauaagaaauuaucgaauuaaaacuuaauguaugucaauuauuu

SEQ ID NO: 581054 - RNA, 64 nt, Homo Sapiens
auuguaauugguugucacuguuguacggugucuagaauuaaagaauacauguaaacuuucaugg

SEQ ID NO: 581055 - RNA, 64 nt, Homo Sapiens
uaauguacagaaugguuggagaaaugccuauggugaauuaaagcuucauaucugcuuucugaau

SEQ ID NO: 581056 - RNA, 64 nt, Homo Sapiens
aaagcaaagacuauuuuuaugcuuccauaaccuagaauuaaaaccaaauuaugaccuuaugaua

SEQ ID NO: 581057 - RNA, 64 nt, Homo Sapiens
uagugaaauguggaagucaaccagaccaaugauggaauuaaauguaaauuccaagagggcuuuc

SEQ ID NO: 581058 - RNA, 64 nt, Homo Sapiens
caauagaagacauuuucacuggaauuacaaagcagaauuaaaauuauauuguagaaggaaacac

SEQ ID NO: 581059 - RNA, 64 nt, Homo Sapiens
guuuguaauauauucaugaggcuggaaguaagaagaauuaaaaauuuguccuaauuacaaugag

SEQ ID NO: 581060 - RNA, 64 nt, Homo Sapiens
ccuucccagcauuugacuguucauugcauagaaugaauuaaauauccaguuacuugaaugggua

SEQ ID NO: 581061 - RNA, 64 nt, Homo Sapiens
acauagauggguguuuuuauaggggagaaaaugugaauuaaauucucucaagggaaggugaugc

SEQ ID NO: 581062 - RNA, 64 nt, Homo Sapiens
uuuucuaaauauuaauacuaauccaagugaaugagaauuaaaaagcuguaauucugaaauacac

SEQ ID NO: 581063 - RNA, 64 nt, Homo Sapiens
ugucaucugagcaugcuacucagauaguguaugagaauuaaaugaucuggaguugaguuggugu

SEQ ID NO: 581064 - RNA, 64 nt, Homo Sapiens
ucgcacauagacguuucagacaggcgcaaaaucagaauuaaaggguuccagggaugaucaugag

SEQ ID NO: 581065 - RNA, 64 nt, Homo Sapiens
auaucagcaucaaauucuuuggguaucucucuaagaauuaaauaaucuuuucuagcuuaauauu

SEQ ID NO: 581066 - RNA, 64 nt, Homo Sapiens
auaaugacauuuucuuuaaauuagacucuauuuugaauuaaaagaguuuuauuauaaaccgugu

SEQ ID NO: 581067 - RNA, 64 nt, Homo Sapiens
gcauuagcauauucagcaaauccaucuguggugggaauuaaaaauauuauugguauuaaagaaa

SEQ ID NO: 581068 - RNA, 64 nt, Homo Sapiens
uaacuuucgaggcacuggaacauaccugaacuaagaauuaaaucuuuuacuuuauacucacuua

SEQ ID NO: 581069 - RNA, 64 nt, Homo Sapiens
agggguaugauagggacauuaguggaaacugcaugaauuaaaagacauauaccccaaaaugcua

SEQ ID NO: 581070 - RNA, 64 nt, Homo Sapiens
uuaagcuuuguguuuaccuaaaugacuuuaugaggaauuaaaggaaugaguuaaauauaauaac

SEQ ID NO: 581071 - RNA, 64 nt, Homo Sapiens
cauuucauugagcuuuaaagauugguuuuaguaagaauuaaauaauaugcauaccuaaugaagu

SEQ ID NO: 581072 - RNA, 64 nt, Homo Sapiens
gaaagcuuuauguaguuaugucauuaagguuuaugaauuaaaaauaaaaucgggcacucuauau

SEQ ID NO: 581073 - RNA, 64 nt, Homo Sapiens
gcuggacuggauuucuucuggagggaagcaccaugaauuaaaggugccagagcuccaugcaugg

SEQ ID NO: 581074 - RNA, 64 nt, Homo Sapiens
acaauguaacggaugaccauaugcacaauuccaugaauuaaaucuguuuccuguguuagucagu

SEQ ID NO: 581075 - RNA, 64 nt, Homo Sapiens
ccuaucuaaaauucugauuucuaagaaggucuaugaauuaaaugugcagcccuccuucugggca

SEQ ID NO: 581076 - RNA, 64 nt, Homo Sapiens
aaaaauguugcagcucauaaaaacaaugaagacugaauuaaauuugaagaaaguuuuggaaaag

SEQ ID NO: 581077 - RNA, 64 nt, Homo Sapiens
uaacauccaguaaccacaggaauauauucucugugaauuaaaagucuucaaaguuaucauuucu

SEQ ID NO: 581078 - RNA, 64 nt, Homo Sapiens
uaauaauccgaaauguuaccgggguugacucacggaauuaaauuuuuccucuauuuuuauaucc

SEQ ID NO: 581079 - RNA, 64 nt, Homo Sapiens
uaacacagucuuuuuaaaacgacaaaaaaaaauugaauuaaaaaggagaacagagaugagauuu

SEQ ID NO: 581080 - RNA, 64 nt, Homo Sapiens
gucaaaccuuuauaugcaugcaggcaaaaaaguggaauuaaaaacaugccaucuucccugcgau

SEQ ID NO: 581081 - RNA, 64 nt, Homo Sapiens
auuaguaauuuauuauuuuaaguauaugguuuaagaauuaaauuaaagaauuaaagcuucuaug

SEQ ID NO: 581082 - RNA, 64 nt, Homo Sapiens
uucuaugaguauaugguuuauuggagcuuuuaaagaauuaaagcuacauuccccaagggucaaa

SEQ ID NO: 581083 - RNA, 64 nt, Homo Sapiens
uuggcuuuagaauacagaugggcaugaagccauagaauuaaauuuguacuuuuuuugaucaguu

SEQ ID NO: 581084 - RNA, 64 nt, Homo Sapiens; identical to SEQ ID NO: 344043

SEQ ID NO: 581085 - RNA, 64 nt, Homo Sapiens; identical to SEQ ID NO: 344044

SEQ ID NO: 581086 - RNA, 64 nt, Homo Sapiens; identical to SEQ ID NO: 344045

SEQ ID NO: 581087 - RNA, 64 nt, Homo Sapiens; identical to SEQ ID NO: 344046

SEQ ID NO: 581088 - RNA, 64 nt, Homo Sapiens; identical to SEQ ID NO: 344047

SEQ ID NO: 581089 - RNA, 64 nt, Homo Sapiens; identical to SEQ ID NO: 344048

SEQ ID NO: 581090 - RNA, 64 nt, Homo Sapiens; identical to SEQ ID NO: 344049

SEQ ID NO: 581091 - RNA, 64 nt, Homo Sapiens; identical to SEQ ID NO: 344050

SEQ ID NO: 581092 - RNA, 64 nt, Homo Sapiens; identical to SEQ ID NO: 344051

SEQ ID NO: 581093 - RNA, 64 nt, Homo Sapiens; identical to SEQ ID NO: 344052

SEQ ID NO: 581094 - RNA, 64 nt, Homo Sapiens
gaggacgaagcgaggagagucgggguuagggauuccccgggagaaagcgacagguaacgcagug

SEQ ID NO: 581095 - RNA, 64 nt, Homo Sapiens
gaggagcgaagauccggaaccugcgucgcccgagccccgggagaggcgaagacagcccgguagg

SEQ ID NO: 581096 - RNA, 64 nt, Homo Sapiens
uuaccccagcaggcugccaccucacccaagaaacccccgggacuagacaagguggcaucucaac

SEQ ID NO: 581097 - RNA, 64 nt, Homo Sapiens
gcagcggggaagacagagaaucaugauccaccugccccgggaggcuggcugaggcuaggcgcuc

SEQ ID NO: 581098 - RNA, 64 nt, Homo Sapiens
agaagacgcgccugggcucccaccccgcccgggaccccgggagcgaaggugggggcacagggcc

SEQ ID NO: 581099 - RNA, 64 nt, Homo Sapiens
gggccuccccuacaucgcugggaagaggagggggccccgggaagugccagccccaccacauccu

SEQ ID NO: 581100 - RNA, 64 nt, Homo Sapiens
ccaaggagcugcaaaguggauuugugauuccucaccccgggaaacuuccccaaccacaaaggug

SEQ ID NO: 581101 - RNA, 64 nt, Homo Sapiens
cugaugaggcccagggugcaagucuuucaggggaccccgggacgguccggucggaguuguagcc

SEQ ID NO: 581102 - RNA, 64 nt, Homo Sapiens
gcagagcuugcgccucgggcgccaggcuugggguccccgggagacccgcccuccccgcgugugc

SEQ ID NO: 581103 - RNA, 64 nt, Homo Sapiens
cccacggcgcugcccgaugagcgccgccacugggccccgggaccuccaggagaugcugcuucag

SEQ ID NO: 581104 - RNA, 64 nt, Homo Sapiens
ucagcacacacacagcucagacccacggacaggaccccgggacagaaccccgggagcacugccc

SEQ ID NO: 581105 - RNA, 64 nt, Homo Sapiens
agcucagacccacggacaggaccccgggacagaaccccgggagcacugcccuaggagcccggac

SEQ ID NO: 581106 - RNA, 64 nt, Homo Sapiens
agaggcagagggcacaggaaagaagccgggccaagcucggaauuaaugugccacaaguguugug

SEQ ID NO: 581107 - RNA, 64 nt, Homo Sapiens
agccacguugacuucagguggucuucuaccagcagcucggaauaguugcacugaaucuauacuu

SEQ ID NO: 581108 - RNA, 64 nt, Homo Sapiens
ccauacuuuuaaccuccuaaagcuaaaaacaauagcucggaaaccauucuuucuaguuacuuuu

SEQ ID NO: 581109 - RNA, 64 nt, Homo Sapiens
uuggaugcauauucguuaucaaucuaaacugcaggcucggaaagccuuaagcaaagaugggagg

SEQ ID NO: 581110 - RNA, 64 nt, Homo Sapiens
ugcccagccugcgguuccccacagcaucgcaggcgcucggaaauccucucccgugccuuuagag

SEQ ID NO: 581111 - RNA, 64 nt, Homo Sapiens
ucucugaacucagaaggaugaagcuggcaccagggcucggaagguaugaacuggaccugcacca

SEQ ID NO: 581112 - RNA, 64 nt, Homo Sapiens
cauugguagauggaccauaagaggagagagaacugcucggaagauaaagagguagaggagguuu

SEQ ID NO: 581113 - RNA, 64 nt, Homo Sapiens
aggagccuuucccaggaacucuugcugcccgaaugcucggaaacgagaagugugcgccacuccc

SEQ ID NO: 581114 - RNA, 64 nt, Homo Sapiens
cccugggccuucaccgcaccccaucugcuuaagugcucggaaccccgucaccuaauuaaaguuu

SEQ ID NO: 581115 - RNA, 64 nt, Homo Sapiens
guagccauauguuacagaucugcagagaagaucugcucggaauuugguggggcagguuauugga

SEQ ID NO: 581116 - RNA, 64 nt, Homo Sapiens
caguuccucaggaaccccuccgccuugcgagcaagcucggaaucuccgccuccacggaacgucu

SEQ ID NO: 581117 - RNA, 64 nt, Homo Sapiens
ggagaccuaugacuucgacagcaucaugcauuacgcucggaacacauucuccaggugggagacg

SEQ ID NO: 581118 - RNA, 64 nt, Homo Sapiens
uucaugcagauauggauggaaaaguggauucuuggcucggaaaauccaaaugcugcuguguaca

SEQ ID NO: 581119 - RNA, 64 nt, Homo Sapiens
uguugcauauuuuaaauuuuucaugugcaguauggcucggaauauguuuggccuuuugcauguu

SEQ ID NO: 581120 - RNA, 64 nt, Homo Sapiens
ccggcuccugguccucacaggcggggcugccugggcucggaaucacacucccuccuccuuaucu

SEQ ID NO: 581121 - RNA, 64 nt, Homo Sapiens
uuacaaugguaaaaugagugcacagugacaaaaggcucggaauguacauggccacaaagggaca

SEQ ID NO: 581122 - RNA, 64 nt, Homo Sapiens
uacuguguaaauaaacuuucacuguccacuucuagcucggaacugucugacaggaagacuggag

SEQ ID NO: 581123 - RNA, 64 nt, Homo Sapiens
uagacccacggcgugaagggaccugaggcacugugcucggaagucaauuuccacaacuaugaca

SEQ ID NO: 581124 - RNA, 64 nt, Homo Sapiens
cgauggucagggagagggcuagagcucacacccagcucggaauagaucuucccugaugacauuu

SEQ ID NO: 581125 - RNA, 64 nt, Homo Sapiens
aaaggcuuccucugggugccaaucagugaaaccugcucggaauuacuacaccugcuccaggacc

SEQ ID NO: 581126 - RNA, 64 nt, Homo Sapiens
guuggccugccuggcugggguggacauuuccccugcucggaaggcccagcagagggcagcuaga

SEQ ID NO: 581127 - RNA, 64 nt, Homo Sapiens
auucuugggacacagguuuguuuucugcugacuugcucggaaacccauuggagguaucugaaau

SEQ ID NO: 581128 - RNA, 64 nt, Homo Sapiens
uaggagauucuuuuuucuuuuuguucuacuuuucgcucggaaaguuuuuaaauccucauuuggu

SEQ ID NO: 581129 - RNA, 64 nt, Homo Sapiens
agagcuggaggggguggguccgggggagggaguggcucggaaggggcccccacucuccuuucau

SEQ ID NO: 581130 - RNA, 64 nt, Homo Sapiens
agugaacagcaccgcgagacaggccaggcucguggcucggaagacaaaccccacacacacucaa

SEQ ID NO: 581131 - RNA, 64 nt, Homo Sapiens
cguaagacaagaugaagagcucugguuugaacuugcucggaaaguucuagccucaccuuuucuu

SEQ ID NO: 581132 - RNA, 64 nt, Homo Sapiens
gcucacugccagcugcggccccggcccugugccugcucggaagagagucgaccucccggccacc

SEQ ID NO: 581133 - RNA, 64 nt, Homo Sapiens
uaguggcaccagaguaacucuggccguagacuuggcucggaacuauagccacagcuuccagugg

SEQ ID NO: 581134 - RNA, 64 nt, Homo Sapiens
uugaccuugggggaauauuucacauccauccagagcucggaaucuacagcguccagccauuucc

SEQ ID NO: 581135 - RNA, 64 nt, Homo Sapiens
ugagcugaauuccacagccuaaggaccgaguugcgcucggaauuggguggagagucggccacca

SEQ ID NO: 581136 - RNA, 64 nt, Homo Sapiens; identical to SEQ ID NO: 196427

SEQ ID NO: 581137 - RNA, 64 nt, Homo Sapiens; identical to SEQ ID NO: 196428

SEQ ID NO: 581138 - RNA, 64 nt, Homo Sapiens; identical to SEQ ID NO: 196429

SEQ ID NO: 581139 - RNA, 64 nt, Homo Sapiens; identical to SEQ ID NO: 196430

SEQ ID NO: 581140 - RNA, 64 nt, Homo Sapiens; identical to SEQ ID NO: 196431

SEQ ID NO: 581141 - RNA, 64 nt, Homo Sapiens; identical to SEQ ID NO: 196432

SEQ ID NO: 581142 - RNA, 64 nt, Homo Sapiens; identical to SEQ ID NO: 196433

SEQ ID NO: 581143 - RNA, 64 nt, Homo Sapiens; identical to SEQ ID NO: 196434

SEQ ID NO: 581144 - RNA, 64 nt, Homo Sapiens; identical to SEQ ID NO: 196435

SEQ ID NO: 581145 - RNA, 64 nt, Homo Sapiens; identical to SEQ ID NO: 196436

SEQ ID NO: 581146 - RNA, 64 nt, Homo Sapiens; identical to SEQ ID NO: 196437

SEQ ID NO: 581147 - RNA, 64 nt, Homo Sapiens; identical to SEQ ID NO: 196438

SEQ ID NO: 581148 - RNA, 64 nt, Homo Sapiens; identical to SEQ ID NO: 196439

SEQ ID NO: 581149 - RNA, 64 nt, Homo Sapiens; identical to SEQ ID NO: 196440

SEQ ID NO: 581150 - RNA, 64 nt, Homo Sapiens; identical to SEQ ID NO: 196441

SEQ ID NO: 581151 - RNA, 57 nt, Homo Sapiens; identical to SEQ ID NO: 196442

SEQ ID NO: 581152 - RNA, 64 nt, Homo Sapiens; identical to SEQ ID NO: 196443

SEQ ID NO: 581153 - RNA, 64 nt, Homo Sapiens; identical to SEQ ID NO: 196444

SEQ ID NO: 581154 - RNA, 64 nt, Homo Sapiens; identical to SEQ ID NO: 196445

SEQ ID NO: 581155 - RNA, 64 nt, Homo Sapiens; identical to SEQ ID NO: 196446

SEQ ID NO: 581156 - RNA, 64 nt, Homo Sapiens; identical to SEQ ID NO: 196447

SEQ ID NO: 581157 - RNA, 64 nt, Homo Sapiens; identical to SEQ ID NO: 196032

SEQ ID NO: 581158 - RNA, 64 nt, Homo Sapiens; identical to SEQ ID NO: 196033

SEQ ID NO: 581159 - RNA, 64 nt, Homo Sapiens; identical to SEQ ID NO: 196034

SEQ ID NO: 581160 - RNA, 64 nt, Homo Sapiens; identical to SEQ ID NO: 196035

SEQ ID NO: 581161 - RNA, 64 nt, Homo Sapiens; identical to SEQ ID NO: 196036

SEQ ID NO: 581162 - RNA, 64 nt, Homo Sapiens; identical to SEQ ID NO: 196037

SEQ ID NO: 581163 - RNA, 64 nt, Homo Sapiens; identical to SEQ ID NO: 196038

SEQ ID NO: 581164 - RNA, 64 nt, Homo Sapiens; identical to SEQ ID NO: 196039

SEQ ID NO: 581165 - RNA, 64 nt, Homo Sapiens; identical to SEQ ID NO: 196040

SEQ ID NO: 581166 - RNA, 64 nt, Homo Sapiens; identical to SEQ ID NO: 196041

SEQ ID NO: 581167 - RNA, 64 nt, Homo Sapiens; identical to SEQ ID NO: 196042

SEQ ID NO: 581168 - RNA, 64 nt, Homo Sapiens; identical to SEQ ID NO: 196043

SEQ ID NO: 581169 - RNA, 64 nt, Homo Sapiens; identical to SEQ ID NO: 196044

SEQ ID NO: 581170 - RNA, 64 nt, Homo Sapiens; identical to SEQ ID NO: 196045

SEQ ID NO: 581171 - RNA, 64 nt, Homo Sapiens; identical to SEQ ID NO: 196046

SEQ ID NO: 581172 - RNA, 64 nt, Homo Sapiens; identical to SEQ ID NO: 196047

SEQ ID NO: 581173 - RNA, 64 nt, Homo Sapiens; identical to SEQ ID NO: 196048

SEQ ID NO: 581174 - RNA, 64 nt, Homo Sapiens; identical to SEQ ID NO: 196049

SEQ ID NO: 581175 - RNA, 64 nt, Homo Sapiens; identical to SEQ ID NO: 196050

SEQ ID NO: 581176 - RNA, 64 nt, Homo Sapiens; identical to SEQ ID NO: 196051

SEQ ID NO: 581177 - RNA, 64 nt, Homo Sapiens; identical to SEQ ID NO: 196052

SEQ ID NO: 581178 - RNA, 64 nt, Homo Sapiens; identical to SEQ ID NO: 196053

SEQ ID NO: 581179 - RNA, 64 nt, Homo Sapiens; identical to SEQ ID NO: 196054

SEQ ID NO: 581180 - RNA, 64 nt, Homo Sapiens; identical to SEQ ID NO: 196055

SEQ ID NO: 581181 - RNA, 64 nt, Homo Sapiens; identical to SEQ ID NO: 492612

SEQ ID NO: 581182 - RNA, 64 nt, Homo Sapiens; identical to SEQ ID NO: 492613

SEQ ID NO: 581183 - RNA, 64 nt, Homo Sapiens; identical to SEQ ID NO: 492614

SEQ ID NO: 581184 - RNA, 64 nt, Homo Sapiens; identical to SEQ ID NO: 492615

SEQ ID NO: 581185 - RNA, 64 nt, Homo Sapiens; identical to SEQ ID NO: 492616

SEQ ID NO: 581186 - RNA, 64 nt, Homo Sapiens; identical to SEQ ID NO: 492617

SEQ ID NO: 581187 - RNA, 61 nt, Homo Sapiens; identical to SEQ ID NO: 47225

SEQ ID NO: 581188 - RNA, 61 nt, Homo Sapiens; identical to SEQ ID NO: 47226

SEQ ID NO: 581189 - RNA, 61 nt, Homo Sapiens; identical to SEQ ID NO: 47227

SEQ ID NO: 581190 - RNA, 61 nt, Homo Sapiens; identical to SEQ ID NO: 47228

SEQ ID NO: 581191 - RNA, 61 nt, Homo Sapiens; identical to SEQ ID NO: 47229

SEQ ID NO: 581192 - RNA, 61 nt, Homo Sapiens; identical to SEQ ID NO: 47230

SEQ ID NO: 581193 - RNA, 61 nt, Homo Sapiens; identical to SEQ ID NO: 47231

SEQ ID NO: 581194 - RNA, 61 nt, Homo Sapiens; identical to SEQ ID NO: 47232

SEQ ID NO: 581195 - RNA, 61 nt, Homo Sapiens; identical to SEQ ID NO: 47233

SEQ ID NO: 581196 - RNA, 61 nt, Homo Sapiens; identical to SEQ ID NO: 47234

SEQ ID NO: 581197 - RNA, 61 nt, Homo Sapiens; identical to SEQ ID NO: 47235

SEQ ID NO: 581198 - RNA, 61 nt, Homo Sapiens; identical to SEQ ID NO: 47236

SEQ ID NO: 581199 - RNA, 61 nt, Homo Sapiens; identical to SEQ ID NO: 47237

SEQ ID NO: 581200 - RNA, 61 nt, Homo Sapiens; identical to SEQ ID NO: 47238

SEQ ID NO: 581201 - RNA, 61 nt, Homo Sapiens; identical to SEQ ID NO: 47239

SEQ ID NO: 581202 - RNA, 61 nt, Homo Sapiens; identical to SEQ ID NO: 47240

SEQ ID NO: 581203 - RNA, 61 nt, Homo Sapiens; identical to SEQ ID NO: 47241

SEQ ID NO: 581204 - RNA, 64 nt, Homo Sapiens
acaaccaagaacaaagccccgggacuguuuucuuuuuaauaaagccacaggcaggcaucguagc

SEQ ID NO: 581205 - RNA, 64 nt, Homo Sapiens
ugaaugagucaccuugugauuuuuaaauuuuuauuuuaauaaagcuaaucaauuucuacaaccu

SEQ ID NO: 581206 - RNA, 64 nt, Homo Sapiens
ggugcucuuaggaaggaguauaguaaaugccucauuuaauaacauacuccuuuuugaaaguugc

SEQ ID NO: 581207 - RNA, 64 nt, Homo Sapiens
aggaacccuagagcagccaggugaggcucucuaguuuaauaaaaaucauggaaagacucuuaau

SEQ ID NO: 581208 - RNA, 64 nt, Homo Sapiens
gauacuauuuuggauguguaucaguauuuuuguuuuuaauaaugauugauuuguggagcauugu

SEQ ID NO: 581209 - RNA, 64 nt, Homo Sapiens
cacuggcacuucucuccucaacuguaauucuauuuuuaauaauaaaaauggcauacuguagggu

SEQ ID NO: 581210 - RNA, 64 nt, Homo Sapiens
uagucuuaauuuaccuugcauuguaauauucaguuuuaauaaaucuucaaaauauuuuguauuu

SEQ ID NO: 581211 - RNA, 64 nt, Homo Sapiens
uucaaaauauuuuguauuuaggaauagaucugacuuuaauaaaaacauggcucagaaucuacag

SEQ ID NO: 581212 - RNA, 64 nt, Homo Sapiens
guacuauaguauucuuaauacagugcucacugcauuuaauaaauauuuaauaaaugaugaauga

SEQ ID NO: 581213 - RNA, 64 nt, Homo Sapiens
uucuuaauacagugcucacugcauuuaauaaauauuuaauaaaugaugaaugauagaaguuucc

SEQ ID NO: 581214 - RNA, 64 nt, Homo Sapiens
uaaaugaauuuaccaguuuaguaugcugugguauuuuaauaaguuuucaaagauaauugggaaa

SEQ ID NO: 581215 - RNA, 64 nt, Homo Sapiens
uuaagaccucaagcccuuuauucuuaaaaggguuuuuaauaaagucuuucucaaaugagguaga

SEQ ID NO: 581216 - RNA, 64 nt, Homo Sapiens
ucaccuuaucaaauuaaaaugggaagaaaguaauuuuaauaauuuuuaauaaucauaugucagc

SEQ ID NO: 581217 - RNA, 64 nt, Homo Sapiens
aaauuaaaaugggaagaaaguaauuuuaauaauuuuuaauaaucauaugucagcauucugacua

SEQ ID NO: 581218 - RNA, 64 nt, Homo Sapiens
uuuguaagguauucauuuagguuugaaaauacuauuuaauaagggcagaagggcuauauaugau

SEQ ID NO: 581219 - RNA, 64 nt, Homo Sapiens
uugaugcucaggccugguuaagcugaggcuuaccuuuaauaacagccuccaagggaaugaauua

SEQ ID NO: 581220 - RNA, 64 nt, Homo Sapiens
ccucuauacaaguguuugaaugguuaugagcagguuuaauaaauugcugacacuuucuaugaag

SEQ ID NO: 581221 - RNA, 64 nt, Homo Sapiens
aaaaauauuuucgugacaaguuauaacaauuuuuuuuaauaaugccauaucagaagaaauaacu

SEQ ID NO: 581222 - RNA, 64 nt, Homo Sapiens
uauuuuaagcaauuguggaaaauuguauucuuccuuuaauaaaauuaauaaacacuuuuuguua

SEQ ID NO: 581223 - RNA, 64 nt, Homo Sapiens
acuuuuuguuaaauuguauuuauauauuuuccccuuuaauaaacaugugccuuaaacauauuac

SEQ ID NO: 581224 - RNA, 64 nt, Homo Sapiens
aaaggcuggagacaagaaaaaauaaguagaucguuuuaauaacaauuauuuaauugccuauaag

SEQ ID NO: 581225 - RNA, 64 nt, Homo Sapiens
uugcuguuucagaggcuagcccaaaggcaucaaauuuaauaaaguuaaacaaauugauuuacuu

SEQ ID NO: 581226 - RNA, 64 nt, Homo Sapiens
caaccuucuccuuauaaauaaguucagacauacauuuaauaacauagggugacuuguguuuuua

SEQ ID NO: 581227 - RNA, 64 nt, Homo Sapiens
uaaacacauacaugauaccauccaaauucuugcuuuuaauaacaaagguacaauauuuuguuuu

SEQ ID NO: 581228 - RNA, 64 nt, Homo Sapiens
uguuagagcuuaugcauuuguuuuuaugagagauuuuaauaaauuuaauuauuugcuuguccag

SEQ ID NO: 581229 - RNA, 64 nt, Homo Sapiens
acaucuagcuaaaagugugguuuaucuaaaccguuuuaauaagcaagaugacugggaaaucucu

SEQ ID NO: 581230 - RNA, 64 nt, Homo Sapiens
guguacaguaauagaggcuuauuuaaugagauuauuuaauaagguguguauauuugguguuccu

SEQ ID NO: 581231 - RNA, 64 nt, Homo Sapiens
guaaauguguauauuuggugaguccuauggcuuauuuaauaacuguggcuguagauagaagaag

SEQ ID NO: 581232 - RNA, 64 nt, Homo Sapiens
auacagaauuauuuuaaguguuuugaacuuaauuuuuaauaacaugcaugggucccucucacua

SEQ ID NO: 581233 - RNA, 64 nt, Homo Sapiens
ccugguaccuguauuuaaaauguacauuccacauuuuaauaaauuaaccacaagaaaauaaucc

SEQ ID NO: 581234 - RNA, 64 nt, Homo Sapiens
uuuacaaauuuuucaagagguuagccacuaagacuuuaauaauuuuacaagggaaaaagccuuu

SEQ ID NO: 581235 - RNA, 64 nt, Homo Sapiens
acuauuccauuacugcagagauuuaaguaucuguuuuaauaagcucuuuuuguuauuuaaaggc

SEQ ID NO: 581236 - RNA, 64 nt, Homo Sapiens
auuuggcauuuagacuaacuucuagauguauauuuuuaauaauagauucauaauguuacauuua

SEQ ID NO: 581237 - RNA, 64 nt, Homo Sapiens
ucagauuuuauucacauuuuuuaacucacugaacuuuaauaaucaggucaccuguacucuaguc

SEQ ID NO: 581238 - RNA, 64 nt, Homo Sapiens
cuaucuguuuacuauaguguagcuacuggcuucauuuaauaaaaauaaaugauuuugaaauuaa

SEQ ID NO: 581239 - RNA, 64 nt, Homo Sapiens
aauucaaaaauauuucuaaaguacguuccuauuguuuaauaauaguuuugaaauauucuguaca

SEQ ID NO: 581240 - RNA, 64 nt, Homo Sapiens
guuaaauaagcuaacaauguaaagagucuguauuuuuaauaaauuuauccuucugcauuaguau

SEQ ID NO: 581241 - RNA, 64 nt, Homo Sapiens
uucaaaagcagugguagaaaguuaauuuuuuuuuuuuaauaauucaaagcaggagacagccugc

SEQ ID NO: 581242 - RNA, 64 nt, Homo Sapiens
aaauuacaaauucucacuuucacugaauguaauguuuaauaaaguaugaugguuaaagccuuua

SEQ ID NO: 581243 - RNA, 64 nt, Homo Sapiens
auggauuuauauuuuuggucuaagaauuauacuauuuaauaaaaaauaugaugugagauuauaa

SEQ ID NO: 581244 - RNA, 64 nt, Homo Sapiens
guacuauuccugcuucuacacccuaaauuucuauuuuaauaacucauuguuuaaaugugccuuu

SEQ ID NO: 581245 - RNA, 64 nt, Homo Sapiens
auuuuccaaaaauggauauuacauucacuaguuuuuuaauaaauguugguuuuguuuuucugcc

SEQ ID NO: 581246 - RNA, 64 nt, Homo Sapiens
guuuuuauagauguuuuauucauagugcucuauguuuaauaaagaaccuucaaaauuauuuggg

SEQ ID NO: 581247 - RNA, 64 nt, Homo Sapiens
guggaauccuuuaagauuauguccaguuauuugcuuuaauaaagaagaaguuacccuugucaaa

SEQ ID NO: 581248 - RNA, 64 nt, Homo Sapiens
uuauucagaaauguccuaacauggaucuguuuguuuuaauaauugugcuuuuuuuaggcuuauc

SEQ ID NO: 581249 - RNA, 64 nt, Homo Sapiens
uacugugaauuaauauaauguauucacauuauucuuuaauaaucuguuuauuaauaagccauga

SEQ ID NO: 581250 - RNA, 64 nt, Homo Sapiens
aguuacuuaugauauauuuuguuuccucuugugguuuaauaaagugaagugugugugugugugu

SEQ ID NO: 581251 - RNA, 64 nt, Homo Sapiens
acaugggacuguuugcaauaccauauggaaaucuuuuaauaaauauauguaaauaaaauaaaaa

SEQ ID NO: 581252 - RNA, 64 nt, Homo Sapiens
auaaaaugcauaguaaaccacuaacguuagcuguuuuaauaaaaguuuucaguuauaaguuuag

SEQ ID NO: 581253 - RNA, 64 nt, Homo Sapiens
uuauauguauguacguauuucagguccuugaaauuuuaauaaauauuacaguuaaauccugaua

SEQ ID NO: 581254 - RNA, 64 nt, Homo Sapiens
uuuuaaaauugaucaacuuuuaaagacagauuucuuuaauaaguggaggcauuuuauuuuaagu

SEQ ID NO: 581255 - RNA, 64 nt, Homo Sapiens
uugaguacugauggauguuuauucauacauucauuuuaauaacauauauauucauuuacagauu

SEQ ID NO: 581256 - RNA, 64 nt, Homo Sapiens
aguacuuguacaaaaaagcuuauauauguauauauuuaauaaagauuagguccaguaacaccug

SEQ ID NO: 581257 - RNA, 64 nt, Homo Sapiens
aaggggaauauuuuaaaauugaguuuuuuuaagguuuaauaacucaucauguugguuuuuuugg

SEQ ID NO: 581258 - RNA, 64 nt, Homo Sapiens
cuuccuuauguagccauuaauguuuguugguuguuuuaauaauaggaaugacuuaaugucaauu

SEQ ID NO: 581259 - RNA, 64 nt, Homo Sapiens
ccuuuuguauaaaaauguauugucuuacugguuuuuuaauaaauacagugucaugauguaguag

SEQ ID NO: 581260 - RNA, 64 nt, Homo Sapiens
aagaagauauauuuagauuauguaugugugucauuuuaauaagcuagaucguguuuagaggcuu

SEQ ID NO: 581261 - RNA, 64 nt, Homo Sapiens
cuuuuuauuacauugugauuaaagaauagcaaucuuuaauaaacuuaguauagaaaaauugcau

SEQ ID NO: 581262 - RNA, 64 nt, Homo Sapiens
gcaacauguugaaacaagaguuuaaauuuacauuuuuaauaaaagacccaaaugccaagguaau

SEQ ID NO: 581263 - RNA, 64 nt, Homo Sapiens
uaaaaaaucuaaauuuuaacacagaaauuuaccuuuuaauaaaugcauauuuucaggcauggua

SEQ ID NO: 581264 - RNA, 64 nt, Homo Sapiens
ugguuuuucacucuuuuuauuuacuucauuuuccuuuaauaacuuaaucucuucauguucaguu

SEQ ID NO: 581265 - RNA, 64 nt, Homo Sapiens
cuguaacaucagauauuguucaacuagacuaggauuuaauaaaaauugugaaagcuuacuggcc

SEQ ID NO: 581266 - RNA, 64 nt, Homo Sapiens
aacauuuauuuugacauaaaguugauaaagauuuuuuaauaauuuagacuucaagcauggcuau

SEQ ID NO: 581267 - RNA, 64 nt, Homo Sapiens
cucucuuuaugucuguggauuuuuuccuucaaaguuuaauaaauuuauuuucuuggauuccuga

SEQ ID NO: 581268 - RNA, 64 nt, Homo Sapiens
aagauguuaucaauugguuauuguacuguauaguuuuaauaauuuugauugaaacccuuuaaca

SEQ ID NO: 581269 - RNA, 64 nt, Homo Sapiens
ucacaggcacauucuacuuuuaaucagaaauauauuuaauaaguauaauugugaaguuuucaac

SEQ ID NO: 581270 - RNA, 64 nt, Homo Sapiens
guauguguggggcugagguuagaagaaaagaacauuuaauaaauagaguuaccauucauauuug

SEQ ID NO: 581271 - RNA, 64 nt, Homo Sapiens
aauauuguugaguucaaaauagaagaauucuauguuuaauaaugaaacaauuucagaaaguguu

SEQ ID NO: 581272 - RNA, 64 nt, Homo Sapiens
acucuuaaauugccaaccucagguaaauuauuauuuuaauaacauugggaaaaaaucagcaucu

SEQ ID NO: 581273 - RNA, 64 nt, Homo Sapiens
uaauagugaucucaauaccauaagaauuuucuaauuuaauaauuucgucuaauuugaccagugu

SEQ ID NO: 581274 - RNA, 64 nt, Homo Sapiens
ucuaauaacacucauuccucagcuuugaguauuauuuaauaauuaucucuaaaucuaagaacua

SEQ ID NO: 581275 - RNA, 64 nt, Homo Sapiens
uuaaauuugcaccaaauuuacauucauuguaagguuuaauaaaauggaaaaucauaugccacaa

SEQ ID NO: 581276 - RNA, 64 nt, Homo Sapiens
aaccaauuacacucuugagucacagaugaguaaauuuaauaaugauuuguguuauuuuuugaac

SEQ ID NO: 581277 - RNA, 64 nt, Homo Sapiens
cauuugcuuuccucugagauucuaagagaaggccuuuaauaaauuuaauaaauauugaguuagc

SEQ ID NO: 581278 - RNA, 64 nt, Homo Sapiens
uccucugagauucuaagagaaggccuuuaauaaauuuaauaaauauugaguuagcaccuucuuu

SEQ ID NO: 581279 - RNA, 64 nt, Homo Sapiens
ugucacuuaguucuucauguuucuccuucugacuuuuaauaaugguaauaggaaaacaaaaccc

SEQ ID NO: 581280 - RNA, 64 nt, Homo Sapiens
uuucuauuacuaaaguucauaucacaaaaugauauuuaauaauaaccuugggguaaaucaugaa

SEQ ID NO: 581281 - RNA, 64 nt, Homo Sapiens
uguagcaauaaaaugaccaagugcaaugacuugauuuaauaaaaucauauuuuaaaaguugcug

SEQ ID NO: 581282 - RNA, 64 nt, Homo Sapiens
cacaaaugagagugugagagaaaguaccuucuauuuuaauaauaauauuauuauaaaaauaaua

SEQ ID NO: 581283 - RNA, 64 nt, Homo Sapiens
cugccaggccugauaggaaaaaucugcucuuccuuuuaauaacagugaugaauugucaggaccu

SEQ ID NO: 581284 - RNA, 64 nt, Homo Sapiens
acauucucuuuguuuucauuuuccaaauauaaucuuuaauaaacuugauuuaguuucuugggaa

SEQ ID NO: 581285 - RNA, 64 nt, Homo Sapiens
auuaaguguuugucauuuggacaaauugaaaacuuuuaauaaagccauuuucuucuuuguuaaa

SEQ ID NO: 581286 - RNA, 64 nt, Homo Sapiens
cauauucacuugaauauauggauauuaguaugcauuuaauaaaaguacucacauacuauagaaa

SEQ ID NO: 581287 - RNA, 64 nt, Homo Sapiens
auauacauuuuaauuuauuauauaucuaucuauauuuaauaaauaaauaaucauguucugguau

SEQ ID NO: 581288 - RNA, 63 nt, Homo Sapiens
aaacaagggauuuguccuuaauccuauaugaguuuuuaauaauuguguaucuauaaauaaagc

SEQ ID NO: 581289 - RNA, 64 nt, Homo Sapiens
acuaacacaaacuuaaugauaguuauuuuuuguuuuuaauaaagacaucgcugucugaaauuuu

SEQ ID NO: 581290 - RNA, 64 nt, Homo Sapiens
uggaaaaauaugcuucuacaacuggaauaucgcuuuuaauaaaacacuuuucauguggcaggaa

SEQ ID NO: 581291 - RNA, 64 nt, Homo Sapiens
uaaagauuuuuagugcaaugcacuucuggcgcauuuuaauaauuuacaaagaugauaaagcagu

SEQ ID NO: 581292 - RNA, 64 nt, Homo Sapiens
aaaauguuauuuguacaaacauugcacagacuauuuuaauaacaugauuuguucuuuaaauuuu

SEQ ID NO: 581293 - RNA, 64 nt, Homo Sapiens
auggacgauuacacuuagaaaaugaguaauaguguuuaauaagucagugauuauaugugugcuc

SEQ ID NO: 581294 - RNA, 64 nt, Homo Sapiens
uagcucuuuacucuuucucaaccccuuuuaugauuuuaauaauucucacuuaacuaauuuugua

SEQ ID NO: 581295 - RNA, 64 nt, Homo Sapiens
uccccauuuuuacuauuaagaagaccagugauaauuuaauaaugccaccaacucuggcuuaguu

SEQ ID NO: 581296 - RNA, 64 nt, Homo Sapiens
ugaaagggucaacggcccuguaauuaugugccauuuuaauaaaaugaucaguaugcuguuuuaa

SEQ ID NO: 581297 - RNA, 64 nt, Homo Sapiens
augugccauuuuaauaaaaugaucaguaugcuguuuuaauaauuggcuagcagaaguauaaagu

SEQ ID NO: 581298 - RNA, 64 nt, Homo Sapiens
uaauucuaaaggaaauuguguuguacauuuaugauuuaauaaaauguguagaguuaagaagcug

SEQ ID NO: 581299 - RNA, 64 nt, Homo Sapiens
uuaccuuacuguggaggaagaauggauuggauuauuuaauaacaaugcagagagccauuuugug

SEQ ID NO: 581300 - RNA, 64 nt, Homo Sapiens
gugaaccagaacaaaucacuagcuaaggaauaauuuuaauaaaagguguuucacuauaaggaac

SEQ ID NO: 581301 - RNA, 64 nt, Homo Sapiens
caaggaaaacauaaugauguauaugggaaaauauuuuaauaaaauuaauaaauacuuuaauaag

SEQ ID NO: 581302 - RNA, 64 nt, Homo Sapiens
uaugggaaaauauuuuaauaugcuuaauaaauacuuuaauaagauaagcucuacagggacagaa

SEQ ID NO: 581303 - RNA, 64 nt, Homo Sapiens
ugaacuuauuaaaagcuaucuaugauuuaauagauuuaauaaaauuccuucacgaccugguacc

SEQ ID NO: 581304 - RNA, 64 nt, Homo Sapiens
acauaaaaggaaaaagguagcucucucgagucucuuuaauaaagauacuaauucucaugacuga

SEQ ID NO: 581305 - RNA, 64 nt, Homo Sapiens
gugauuauauugcuaacucucauugcaugauaccuuuaauaaaaugaacaauauaagaguuaag

SEQ ID NO: 581306 - RNA, 64 nt, Homo Sapiens
guugugagccaccacaccuggcuugaauguagauuuuaauaauugaauuuauucugccguguug

SEQ ID NO: 581307 - RNA, 64 nt, Homo Sapiens
ccaguuaucuguuaaucaaaauugcauuuuacaauuuaauaaugugauauuuccuaugucuaca

SEQ ID NO: 581308 - RNA, 64 nt, Homo Sapiens
aaaacuaugcauaucuauauauuggccaauuaucuuuaauaauuuaccuuuugaaauugcaugu

SEQ ID NO: 581309 - RNA, 64 nt, Homo Sapiens
uauuuuuucacuacaacagucaguauuauguucauuuaauaaauuuuauaaugcauuuuacucc

SEQ ID NO: 581310 - RNA, 64 nt, Homo Sapiens
gucacaguuauuaauauguuuaauaucaaaauacuuuaauaagugauuuuaaaagcugauucau

SEQ ID NO: 581311 - RNA, 64 nt, Homo Sapiens
aaguuaagaccuucauuuaaguuggauuuuauauuuuaauaaggguaucuuauauaaaccucaa

SEQ ID NO: 581312 - RNA, 64 nt, Homo Sapiens
uuggaaauauauucaagagaaugauuuuuuauuuuuuaauaacaaugugcuaaauauaucuugu

SEQ ID NO: 581313 - RNA, 64 nt, Homo Sapiens
gaugcauacaaagaauuauauauaaagaaggguguuuaauaaugauaguuauaauaauaaauaa

SEQ ID NO: 581314 - RNA, 64 nt, Homo Sapiens
uaaauuauuuuauacgaguugguaauuuuugcuuuuuaauaaaguggaagcuugcuuuuuuaac

SEQ ID NO: 581315 - RNA, 63 nt, Homo Sapiens
auucauuuggcuucauuuuuaauaaauuuauaaauuuaauaaccaagaagaucuggaaaguua

SEQ ID NO: 581316 - RNA, 64 nt, Homo Sapiens
aauuaacagagauugaacucugauacuucacuacuuuaauaaagcauuauaucauuggaacaac

SEQ ID NO: 581317 - RNA, 64 nt, Homo Sapiens
cccuuaccccaguuuuuugaacauggaaagaaaauuuaauaacuuuuuaaagugacauaauuua

SEQ ID NO: 581318 - RNA, 64 nt, Homo Sapiens
guauuaaaauguacaaaauguuuuguuaauaaaauuuaauaauguuuauaacuccgugccauuc

SEQ ID NO: 581319 - RNA, 64 nt, Homo Sapiens
uacuauuuauaggauuccguuuuuucacaagacuuuuaauaaaaagaaauuguagaaauaaaca

SEQ ID NO: 581320 - RNA, 64 nt, Homo Sapiens
uguuucuauauacuccguccaauauagauaauguuuuaauaacaacugugggauaaaaguuauc

SEQ ID NO: 581321 - RNA, 64 nt, Homo Sapiens
auuaguuuucaaguauaagguuuaaguaauuugguuuaauaaucagaaaauauucaauacagug

SEQ ID NO: 581322 - RNA, 64 nt, Homo Sapiens
aaucauuacuguuauaugagaaacauuuuaguaauuuaauaaaaggauaauguuuauuuaaaaa

SEQ ID NO: 581323 - RNA, 64 nt, Homo Sapiens
uuuauucagaauugcguggcugcuguacauauuauuuaauaaacauguguugaauuacuacauu

SEQ ID NO: 581324 - RNA, 64 nt, Homo Sapiens
ucuuguguuaaaauuugcauccaauuugcccgucuuuaauaaaaagaaauucagguaugccuca

SEQ ID NO: 581325 - RNA, 64 nt, Homo Sapiens
gguauagaagcucuucaagccauuuucugauauauuuaauaagauaauuaaucugcauaugaag

SEQ ID NO: 581326 - RNA, 64 nt, Homo Sapiens
cagaugcaaucauuggaagucacagauguagaacuuuaauaaucacauggaaagcccccauuug

SEQ ID NO: 581327 - RNA, 64 nt, Homo Sapiens
aguaauggucaaucuuaacauuuuguuuuaauuguuuaauaaagcugcugggcaguggugcagc

SEQ ID NO: 581328 - RNA, 64 nt, Homo Sapiens
acaggaagagaugguauaauuuacaauuuggagauuuaauaaccagggcuacccagaaaaagug

SEQ ID NO: 581329 - RNA, 64 nt, Homo Sapiens
gaaggaagaccagaucuguaugauuuguuccauuuuuaauaacaaaaauauccacacccuuuua

SEQ ID NO: 581330 - RNA, 64 nt, Homo Sapiens
guuccauuuuuaauaacaaaaauauccacacccuuuuaauaaugcucaguucuguaggcucucu

SEQ ID NO: 581331 - RNA, 64 nt, Homo Sapiens
uuaaaaugccgauuacacccaaauauugugcacauuuaauaaucagacaccagauuuuuagcuc

SEQ ID NO: 581332 - RNA, 64 nt, Homo Sapiens
cacaauuccagacuuucuauuaauauuuauguguuuuaauaaacguuugaaauuauuuaugacu

SEQ ID NO: 581333 - RNA, 64 nt, Homo Sapiens
ggacaaagaaggaaauaucaucguauuucuuuuuuuuaauaaggaaaaaauaauauccauacag

SEQ ID NO: 581334 - RNA, 64 nt, Homo Sapiens
uaaacauugugaugauuauuauuuaaaaccauuauuuaauaagaguaaaaauaugugaaucugg

SEQ ID NO: 581335 - RNA, 64 nt, Homo Sapiens
auuccuacuaucuguguuccaguugcugagguuuuuuaauaaccuuugaagcauagaagaaaau

SEQ ID NO: 581336 - RNA, 64 nt, Homo Sapiens
aggcaagaaaaaugccacuauuccauggaauguuuuuaauaaguguacagagaaaccaucuaca

SEQ ID NO: 581337 - RNA, 64 nt, Homo Sapiens
auguuuguaugugugaagcuuaauaaauauauuuuuuaauaaacuaugcagcagguguaaaaau

SEQ ID NO: 581338 - RNA, 64 nt, Homo Sapiens
cggucaacuucacacuuaggacucaucuagaccuuuuaauaagauuaacuuuaaacauauugug

SEQ ID NO: 581339 - RNA, 64 nt, Homo Sapiens
aaagacauuuuaugaaaucuucauugucaaaaccuuuaauaaaaguggaaauauuuugaaaugc

SEQ ID NO: 581340 - RNA, 64 nt, Homo Sapiens
uacauugagaauuucaacuagcuucugaucaauuuuuaauaaaaaauuuucaaaucauguuagc

SEQ ID NO: 581341 - RNA, 64 nt, Homo Sapiens
cauuucuuuaugaauaugaauaauuguucuaugcuuuaauaaucuauugugaggaaacuacuaa

SEQ ID NO: 581342 - RNA, 64 nt, Homo Sapiens
guccuuacuugaaaugggucuguauuaugguacuuuuaauaaauauuugauuuuucuuucucuu

SEQ ID NO: 581343 - RNA, 64 nt, Homo Sapiens
ccccuucaguuucuauuuaggaggugaagaaucuuuuaauaagguagaaaguugcuuuauuuaa

SEQ ID NO: 581344 - RNA, 64 nt, Homo Sapiens
uaauuucucaaagucuauuguuugaucuaguuauuuuaauaaaggaacucuagaaguuucaagu

SEQ ID NO: 581345 - RNA, 64 nt, Homo Sapiens
auagugcugaaagaauuccucaguggaaggagaauuuaauaaagugaauagacagaacccuauc

SEQ ID NO: 581346 - RNA, 64 nt, Homo Sapiens
cuuuaaaauaaaaauaaaaaaagucugauccauauuuaauaaugacauugcauaaacacuuuuc

SEQ ID NO: 581347 - RNA, 64 nt, Homo Sapiens
aaguaaauacuuuucauuucccauauauaucuuuuuuaauaaccuauuaaaaauuugggggaau

SEQ ID NO: 581348 - RNA, 64 nt, Homo Sapiens
auaagaaaaauuaauacuaucuugaagagcuaauuuuaauaaaacaagauuuguuaguaacaau

SEQ ID NO: 581349 - RNA, 64 nt, Homo Sapiens
uaguuuucauauacauaaucuuuguguacagagguuuaauaaaugcuauacagguauguucauc

SEQ ID NO: 581350 - RNA, 64 nt, Homo Sapiens
uuguuccguuaauuaguacuagcacugagagcuauuuaauaacuucugaauaauggcuugacuu

SEQ ID NO: 581351 - RNA, 64 nt, Homo Sapiens
ccaagcacuugcaacugauguuacugucuucaauuuuaauaauuacacauauuuguauauuuca

SEQ ID NO: 581352 - RNA, 64 nt, Homo Sapiens
uccuguuuucagucucuauguguacagcaguauuuuuaauaaagaauuacagagauaaauuugu

SEQ ID NO: 581353 - RNA, 64 nt, Homo Sapiens
uucuuaaauauucuaaaauguaagucaaauauguuuuaauaacaaagacuuaaauggcuuuucu

SEQ ID NO: 581354 - RNA, 64 nt, Homo Sapiens
uugcuugagacuuaagaggucauguugcuuuagguuuaauaaauagccuuaacuauuuggaggg

SEQ ID NO: 581355 - RNA, 64 nt, Homo Sapiens
agggcuuggggacccaaugcaaagaugaugacuauuuaauaaaauggaaaauuuaauaaauccu

SEQ ID NO: 581356 - RNA, 64 nt, Homo Sapiens
ugcaaagaugaugacuauuuaauaaaauggaaaauuuaauaaauccucauuuuauuaacuaaga

SEQ ID NO: 581357 - RNA, 64 nt, Homo Sapiens
uuucaguguauuuaucauugauauacccugaccuuuuaauaaagaaacaugccuuuuguuuucu

SEQ ID NO: 581358 - RNA, 64 nt, Homo Sapiens
cacuauuacccagggcagauugcaggucuaguauuuuaauaaugcaaggcauaggaagagaucu

SEQ ID NO: 581359 - RNA, 64 nt, Homo Sapiens
cuggauacaguuugaaagaauuauggaaaguaucuuuaauaaaggccugaaauaccaugauugu

SEQ ID NO: 581360 - RNA, 64 nt, Homo Sapiens
uuuuaggguuugguuuuuacuagaauuuguauuauuuaauaaaacagacuuacauguagugaaa

SEQ ID NO: 581361 - RNA, 64 nt, Homo Sapiens
ugagagucucuuguuugucugugacuaugcuugauuuaauaagcgcuuggggcaagugaaguuu

SEQ ID NO: 581362 - RNA, 64 nt, Homo Sapiens
acuuagccucuucugacuucucuauuuauuuuauuuuaauaaguaguccuuuauuuuauucuau

SEQ ID NO: 581363 - RNA, 64 nt, Homo Sapiens
aggggcccugaauuuaugugguuuuuauacauuuuuuaauaagaugcacuuuaugucauuuuuu

SEQ ID NO: 581364 - RNA, 64 nt, Homo Sapiens
uacauuuuuuaauaagaugcacuuuaugucauuuuuuaauaaagucugaagaauuacuguuuaa

SEQ ID NO: 581365 - RNA, 64 nt, Homo Sapiens
auauuuauuaaaccauuuuuagucuuaacauuuauuuaauaauuuuucuuggguuaguauuuaa

SEQ ID NO: 581366 - RNA, 64 nt, Homo Sapiens
cauggaauaccaaggcacaauuuauaaaugcaguuuuaauaaaccuucugcaggagcugaucca

SEQ ID NO: 581367 - RNA, 64 nt, Homo Sapiens
gaauuuuaguuugcuugcagaauaaaagauuuuuuuuaauaacacucccuuccaggagcauuuu

SEQ ID NO: 581368 - RNA, 64 nt, Homo Sapiens
gauuuuuuuuaauaacagaaccuuccaggagcauuuuaauaaaacuaugcaauaccaccugcuc

SEQ ID NO: 581369 - RNA, 64 nt, Homo Sapiens
auauauggcacaccuuuuguaauguuuucuaugauuuaauaaaaagugaaaagauuuguauaca

SEQ ID NO: 581370 - RNA, 64 nt, Homo Sapiens
gugacaacuuaaaacuuguuucagcuuuuuuuguuuuaauaaguacaaccuguuaccaauuauu

SEQ ID NO: 581371 - RNA, 64 nt, Homo Sapiens
uuuaaaaacaaauugcuuuugugucccugaaguauuuaauaagaagcauuuugcacucuagaaa

SEQ ID NO: 581372 - RNA, 64 nt, Homo Sapiens
uucugauuaaaguaaguagaaaugggauguuuuguuuaauaacagccauaguguguguuuagac

SEQ ID NO: 581373 - RNA, 64 nt, Homo Sapiens
cugucuggggugggaugccuuacuuugcacuuaauuuaauaagggcauucucggaggaguagac

SEQ ID NO: 581374 - RNA, 64 nt, Homo Sapiens
auucuaugugaaauaucuuuuuacuuuuaugcauuuuaauaagauuuaaaaauauuuagauuaa

SEQ ID NO: 581375 - RNA, 64 nt, Homo Sapiens
uuuagcuuuuaaucauuuuuaccaauuugaacaguuuaauaaacugguucugcucucuucugaa

SEQ ID NO: 581376 - RNA, 64 nt, Homo Sapiens
gaauccaugugcccaggauuauauuagcauuauuuuuaauaaaucuauaugcuuaacauauuag

SEQ ID NO: 581377 - RNA, 64 nt, Homo Sapiens
aauuuuugccuuaucaagaguuguuuuuuaaaaauuuaauaaauucauaaaaaagacucauauc

SEQ ID NO: 581378 - RNA, 64 nt, Homo Sapiens
uauuuaaaucacuucaguuagcuuucaguguauguuuaauaauauacauuuaaugaugaaaaau

SEQ ID NO: 581379 - RNA, 64 nt, Homo Sapiens
uuuucuuuuugaaaguuuuaauauugucuuccuuuuuaauaacuuauuuuauacauauugugca

SEQ ID NO: 581380 - RNA, 64 nt, Homo Sapiens
ccuaugaaagaaucugugaauauauguaaauacguuuaauaaauuuuauuggucauguuaaauc

SEQ ID NO: 581381 - RNA, 64 nt, Homo Sapiens
cuguuuaaugacuaguugauauuugugcauguuauuuaauaaagaguuauauuuuuauagaaaa

SEQ ID NO: 581382 - RNA, 64 nt, Homo Sapiens
auauugaaguuuugguaaaaauucuuuuuucuuuuuuaauaaaaaauuagguuauuacuuuuuu

SEQ ID NO: 581383 - RNA, 64 nt, Homo Sapiens
uuuucuuugguugucccuauuaacaaaaaaguauuuuaauaaaaaauugaaaugagugagucau

SEQ ID NO: 581384 - RNA, 64 nt, Homo Sapiens
auucauaaauaaagaauuguucuuucuuugugguuuuaauaagaguucaagaauuguucagagu

SEQ ID NO: 581385 - RNA, 64 nt, Homo Sapiens
guucaagaauuguucagagucuuguaaauguuauuuuaauaaucccuuuaaauuuuaucuguug

SEQ ID NO: 581386 - RNA, 64 nt, Homo Sapiens
auguucagccuaugaugaagggaaacuuugcucuuuuaauaauuuugaaaguaagaaagggagg

SEQ ID NO: 581387 - RNA, 64 nt, Homo Sapiens
cugguuaaaaauugagucuuuagagcuuccaggguuuaauaaaauucgauguuuucccguguug

SEQ ID NO: 581388 - RNA, 64 nt, Homo Sapiens
aggcacugccccccuuuccugcccccuccucaucuuuaauaaagaccuggcuucucaucuuuaa

SEQ ID NO: 581389 - RNA, 64 nt, Homo Sapiens
cuccucaucuuuaauaaagaccuggcuucucaucuuuaauaaagaccuguuuguaacagaaguu

SEQ ID NO: 581390 - RNA, 64 nt, Homo Sapiens
uagucuuccuauagguuacuucaccuuuuuuuuuuuuaauaauuugauuugauacauauguagu

SEQ ID NO: 581391 - RNA, 64 nt, Homo Sapiens
uacuauuacaguguaaauauauaacuuaugacaguuuaauaaguuaucagcaauuuagcacuuu

SEQ ID NO: 581392 - RNA, 64 nt, Homo Sapiens
cuuuauggacacugagcuuggaucauggcuauguuuuaauaaaaauagacaaucauaaaugaau

SEQ ID NO: 581393 - RNA, 64 nt, Homo Sapiens
cuuuacagacacugaacuuggaucauggcuauguuuuaauaaaaauagacaaucauaaaugaau

SEQ ID NO: 581394 - RNA, 64 nt, Homo Sapiens
aagaaaguaucauguaaacaauugucagguuauauuuaauaagaaauauuuucauuuaauaaag

SEQ ID NO: 581395 - RNA, 64 nt, Homo Sapiens
auugucagguuauauuuaaucaaaaauauuuucauuuaauaaaguuuuguuguuguugaugaua

SEQ ID NO: 581396 - RNA, 64 nt, Homo Sapiens
gagugaaagcaaauaugacaaucuguaauauuucuuuaauaaaauggugggaguuguuauauuu

SEQ ID NO: 581397 - RNA, 64 nt, Homo Sapiens
ucuugcaaagaacaguacuguaacauuuguauaauuuaauaagaaugcacaaaggaacacagua

SEQ ID NO: 581398 - RNA, 64 nt, Homo Sapiens
ggaagguucauaggagaaaagaaugaauggcuuauuuaauaaaugugcuauugaaaucacuggg

SEQ ID NO: 581399 - RNA, 64 nt, Homo Sapiens
gucaaaaucacaauacuugggaugacaaauacuuuuuaauaaauaaguauccaaaaugguuacu

SEQ ID NO: 581400 - RNA, 64 nt, Homo Sapiens
guacagugaugagcaugccuaguauggucaggaauuuaauaaaagcuaaggcuuauaaaauaug

SEQ ID NO: 581401 - RNA, 64 nt, Homo Sapiens
uagaauucaacuaauaaaaaauaauuaaaauauguuuaauaacuaaugcaguuuggggaugaau

SEQ ID NO: 581402 - RNA, 64 nt, Homo Sapiens
uaaauuuuauuguguaaaauauaaaaugaguuucuuuaauaaauuuuuugaguuaauuauacuc

SEQ ID NO: 581403 - RNA, 64 nt, Homo Sapiens
guacaauauauacauagacuguaacuacuuugcuuuuaauaauuuuaugaaauggcaaagguuu

SEQ ID NO: 581404 - RNA, 64 nt, Homo Sapiens
uuuuaauuuauccuguaaauuucuguauauauaauuuaauaacagaagccuccaccagcaacag

SEQ ID NO: 581405 - RNA, 64 nt, Homo Sapiens
gaaaguacagacuguuucuucagcgaaagcugcauuuaauaaauguauugaguugcaaugugac

SEQ ID NO: 581406 - RNA, 64 nt, Homo Sapiens
augcuucccaucauaacugguguucuggaugcuuuuuaauaauuaucagggcagggcuuuagga

SEQ ID NO: 581407 - RNA, 64 nt, Homo Sapiens
cgggauguaaauuuacaaugcagaguaccacuuauuuaauaagauguaaaucaugcucuuuaca

SEQ ID NO: 581408 - RNA, 64 nt, Homo Sapiens
uuguaaaucaugcucuuuacaagacuuuugaauguuuaauaauuugauauguagcuuuuucuua

SEQ ID NO: 581409 - RNA, 64 nt, Homo Sapiens
gcucaguaguguguucugaauucuauucaguuuguuuaauaaauagggaaaacuggcaacaugc

SEQ ID NO: 581410 - RNA, 64 nt, Homo Sapiens
auaaauagggaaaacuggcaacaugcuaguuacuuuuaauaaaguaaucccugauucuauaccg

SEQ ID NO: 581411 - RNA, 64 nt, Homo Sapiens
uuuuuacuaaugcuaaaacuuuuaaaguuuauuuuuuaauaaauuguugaguauuacaucauuu

SEQ ID NO: 581412 - RNA, 64 nt, Homo Sapiens
uaguuuuaaucagcuuaaaagcuauuuaacccauuuuaauaagcuugcaguuuuguuucucugc

SEQ ID NO: 581413 - RNA, 64 nt, Homo Sapiens
aucuuuacagaaugcuaguuugcauuaccauuuguuuaauaauuaaugaaauaaggaguaaaaa

SEQ ID NO: 581414 - RNA, 64 nt, Homo Sapiens
acauuagguuuaauuuuuuuaaauguaguuucaauuuaauaaucgcagacugauacuaaauuua

SEQ ID NO: 581415 - RNA, 64 nt, Homo Sapiens; identical to SEQ ID NO: 160572

SEQ ID NO: 581416 - RNA, 64 nt, Homo Sapiens; identical to SEQ ID NO: 160573

SEQ ID NO: 581417 - RNA, 64 nt, Homo Sapiens; identical to SEQ ID NO: 160574

SEQ ID NO: 581418 - RNA, 64 nt, Homo Sapiens; identical to SEQ ID NO: 160575

SEQ ID NO: 581419 - RNA, 64 nt, Homo Sapiens; identical to SEQ ID NO: 160576

SEQ ID NO: 581420 - RNA, 64 nt, Homo Sapiens; identical to SEQ ID NO: 160577

SEQ ID NO: 581421 - RNA, 64 nt, Homo Sapiens; identical to SEQ ID NO: 160578

SEQ ID NO: 581422 - RNA, 64 nt, Homo Sapiens; identical to SEQ ID NO: 160579

SEQ ID NO: 581423 - RNA, 64 nt, Homo Sapiens; identical to SEQ ID NO: 160580

SEQ ID NO: 581424 - RNA, 64 nt, Homo Sapiens; identical to SEQ ID NO: 160581

SEQ ID NO: 581425 - RNA, 64 nt, Homo Sapiens; identical to SEQ ID NO: 160582

SEQ ID NO: 581426 - RNA, 64 nt, Homo Sapiens; identical to SEQ ID NO: 160583

SEQ ID NO: 581427 - RNA, 64 nt, Homo Sapiens; identical to SEQ ID NO: 160584

SEQ ID NO: 581428 - RNA, 64 nt, Homo Sapiens; identical to SEQ ID NO: 160585

SEQ ID NO: 581429 - RNA, 64 nt, Homo Sapiens; identical to SEQ ID NO: 160586

SEQ ID NO: 581430 - RNA, 64 nt, Homo Sapiens; identical to SEQ ID NO: 160587

SEQ ID NO: 581431 - RNA, 64 nt, Homo Sapiens; identical to SEQ ID NO: 160588

SEQ ID NO: 581432 - RNA, 64 nt, Homo Sapiens; identical to SEQ ID NO: 160589

SEQ ID NO: 581433 - RNA, 64 nt, Homo Sapiens; identical to SEQ ID NO: 160590

SEQ ID NO: 581434 - RNA, 64 nt, Homo Sapiens; identical to SEQ ID NO: 160591

SEQ ID NO: 581435 - RNA, 64 nt, Homo Sapiens; identical to SEQ ID NO: 160592

SEQ ID NO: 581436 - RNA, 64 nt, Homo Sapiens; identical to SEQ ID NO: 160593

SEQ ID NO: 581437 - RNA, 64 nt, Homo Sapiens; identical to SEQ ID NO: 160594

SEQ ID NO: 581438 - RNA, 64 nt, Homo Sapiens; identical to SEQ ID NO: 160595

SEQ ID NO: 581439 - RNA, 64 nt, Homo Sapiens; identical to SEQ ID NO: 160596

SEQ ID NO: 581440 - RNA, 64 nt, Homo Sapiens; identical to SEQ ID NO: 160597

SEQ ID NO: 581441 - RNA, 64 nt, Homo Sapiens; identical to SEQ ID NO: 160598

SEQ ID NO: 581442 - RNA, 64 nt, Homo Sapiens; identical to SEQ ID NO: 160599

SEQ ID NO: 581443 - RNA, 64 nt, Homo Sapiens; identical to SEQ ID NO: 160600

SEQ ID NO: 581444 - RNA, 64 nt, Homo Sapiens; identical to SEQ ID NO: 160601

SEQ ID NO: 581445 - RNA, 64 nt, Homo Sapiens; identical to SEQ ID NO: 160602

SEQ ID NO: 581446 - RNA, 64 nt, Homo Sapiens; identical to SEQ ID NO: 160603

SEQ ID NO: 581447 - RNA, 64 nt, Homo Sapiens; identical to SEQ ID NO: 160604

SEQ ID NO: 581448 - RNA, 51 nt, Homo Sapiens; identical to SEQ ID NO: 160605

SEQ ID NO: 581449 - RNA, 64 nt, Homo Sapiens; identical to SEQ ID NO: 160606

SEQ ID NO: 581450 - RNA, 64 nt, Homo Sapiens; identical to SEQ ID NO: 160607

SEQ ID NO: 581451 - RNA, 64 nt, Homo Sapiens; identical to SEQ ID NO: 160608

SEQ ID NO: 581452 - RNA, 64 nt, Homo Sapiens; identical to SEQ ID NO: 160609

SEQ ID NO: 581453 - RNA, 64 nt, Homo Sapiens; identical to SEQ ID NO: 160610

SEQ ID NO: 581454 - RNA, 64 nt, Homo Sapiens; identical to SEQ ID NO: 160611

SEQ ID NO: 581455 - RNA, 64 nt, Homo Sapiens; identical to SEQ ID NO: 160612

SEQ ID NO: 581456 - RNA, 64 nt, Homo Sapiens; identical to SEQ ID NO: 160613

SEQ ID NO: 581457 - RNA, 64 nt, Homo Sapiens; identical to SEQ ID NO: 160614

SEQ ID NO: 581458 - RNA, 64 nt, Homo Sapiens; identical to SEQ ID NO: 160615

SEQ ID NO: 581459 - RNA, 64 nt, Homo Sapiens; identical to SEQ ID NO: 160616

SEQ ID NO: 581460 - RNA, 64 nt, Homo Sapiens; identical to SEQ ID NO: 160617

SEQ ID NO: 581461 - RNA, 64 nt, Homo Sapiens; identical to SEQ ID NO: 160618

SEQ ID NO: 581462 - RNA, 64 nt, Homo Sapiens; identical to SEQ ID NO: 160619

SEQ ID NO: 581463 - RNA, 64 nt, Homo Sapiens; identical to SEQ ID NO: 160620

SEQ ID NO: 581464 - RNA, 64 nt, Homo Sapiens; identical to SEQ ID NO: 160621

SEQ ID NO: 581465 - RNA, 64 nt, Homo Sapiens
ucauuuuucagaacuuguuugaagcuuaauguaggcaagccacuaguagcuuuucaauuugcua

SEQ ID NO: 581466 - RNA, 64 nt, Homo Sapiens
gaauuugaguuuucacuuuggcaaugaaaauuuagcaagccacuaugcuuuaaaaaaaaaaaag

SEQ ID NO: 581467 - RNA, 64 nt, Homo Sapiens
ccuagcaggcuguuccauguuugucuuuucagaagcaagccagaucuuuuucuuuuuugcuuuc

SEQ ID NO: 581468 - RNA, 64 nt, Homo Sapiens
ggaaggaggggagagacaggcugucccagccccggcaagccacacuggcuuugaaaccucaggg

SEQ ID NO: 581469 - RNA, 64 nt, Homo Sapiens
guguguccaggcucugggcacagugcugccccuugcaagccauaacgugcccccagaguguagg

SEQ ID NO: 581470 - RNA, 64 nt, Homo Sapiens
uuuggguuuggccagggaggcgcagggacauggggcaagccagggcccagagcccuugacugua

SEQ ID NO: 581471 - RNA, 64 nt, Homo Sapiens
uauaaaauauugugacauguuuguuguaaauacuauguaauauauaaauacuauggaaggggcu

SEQ ID NO: 581472 - RNA, 64 nt, Homo Sapiens
auuacugagucccaugguaaauuucaagauauugauguaauaacuauuacacagaugaagaaac

SEQ ID NO: 581473 - RNA, 64 nt, Homo Sapiens
guuuucugugaguaaacuccuguuguaaauuuucauguaauaguacuuauguacuacuaucaca

SEQ ID NO: 581474 - RNA, 64 nt, Homo Sapiens
gggucugcugcuacuuucugcccguuaguacaguauguaauaguaguuaagaguuguaucuuau

SEQ ID NO: 581475 - RNA, 64 nt, Homo Sapiens
uuguacaaauguaagcaaagaacaaugaagaauuauguaauauaaguauauauuaggaucugca

SEQ ID NO: 581476 - RNA, 64 nt, Homo Sapiens
uucaaaaccugcaguuaacauauaagucaagcacauguaauaaaccuuaggguggcuuuaauug

SEQ ID NO: 581477 - RNA, 64 nt, Homo Sapiens
ugcccggagcccugcucaucaaugaaaaacccauauguaauaaucgaauucauuuaacaugaau

SEQ ID NO: 581478 - RNA, 64 nt, Homo Sapiens
uuugucauuuaaaaguucauuuugagggaauaacauguaauauaauuugaaauaaagguauagu

SEQ ID NO: 581479 - RNA, 64 nt, Homo Sapiens
uuuuaauguauagauuuugcaaauauuaugcuauauguaauaccuaacuguaucuguaguguau

SEQ ID NO: 581480 - RNA, 64 nt, Homo Sapiens
cuauauguaauaccuaacuguaucuguaguguauauguaauauauuuaugcccaauaaauguuu

SEQ ID NO: 581481 - RNA, 64 nt, Homo Sapiens
agacaaauuacugauaaaaaugauauugcucuauauguaauauauccugaaagcauuauuuuuu

SEQ ID NO: 581482 - RNA, 64 nt, Homo Sapiens
acacucauugaaauguaauuucaguucuaaaaagauguaauaaucauuuuagaauuaaaauuua

SEQ ID NO: 581483 - RNA, 64 nt, Homo Sapiens
gcuaaauguugcuuguaggcuacauuaaacucaaauguaauaguuuaucuuauacuccugguuu

SEQ ID NO: 581484 - RNA, 64 nt, Homo Sapiens
uaaauuucuuauuaaaucaaucuugaaauagaaaauguaauaacuuucuuaccauuaacauuuu

SEQ ID NO: 581485 - RNA, 64 nt, Homo Sapiens
uaaacuaaaauuuauggcacaucuauacauuauaauguaauauauucauaaauuauaauguaua

SEQ ID NO: 581486 - RNA, 64 nt, Homo Sapiens
aaacauaacacaaauaauuaucuuaagguucaauauguaauaaaguuuucaaaccaacaaacuc

SEQ ID NO: 581487 - RNA, 64 nt, Homo Sapiens
uuuauugccucauaccauuugaaugauuaaaucaauguaauaaaugauauauguuuacagugua

SEQ ID NO: 581488 - RNA, 64 nt, Homo Sapiens
ugcuaauaaaauuauauugaaaaugugaauuuugauguaauaacgacaguccucuggauccucu

SEQ ID NO: 581489 - RNA, 64 nt, Homo Sapiens
augaauauauuccuuacaaaaaccaagauuuugaauguaauaagcuuuauaaucgucauuguuc

SEQ ID NO: 581490 - RNA, 64 nt, Homo Sapiens
gugugaauucagacuauaaaaauacuauaaauuaauguaauacuuucaaauuaccaagcacugu

SEQ ID NO: 581491 - RNA, 64 nt, Homo Sapiens
augucuacauauuuguguguguguguguauauauauguaauaugcauacacagaugcauaugug

SEQ ID NO: 581492 - RNA, 64 nt, Homo Sapiens
cugguggaugauuaucugcuaaguaagucugaaaauguaauauuuugauaauacuguaauauac

SEQ ID NO: 581493 - RNA, 64 nt, Homo Sapiens
uuugcaaguguuggggagauuggcaaaauggugcauguaauacuaguucugauuuaaagaaugg

SEQ ID NO: 581494 - RNA, 64 nt, Homo Sapiens
aguguuuguaagauacucuugauugcaagguaauauguaauaguauaugaaauauaauguuuca

SEQ ID NO: 581495 - RNA, 64 nt, Homo Sapiens
uguagaacacacacauagauauauauauggauggauguaauauacuagauauauacacacacau

SEQ ID NO: 581496 - RNA, 64 nt, Homo Sapiens
aaaagagagagaaguaccaccacuaugagguaaaauguaauaaccauuugcuauuuucauuaua

SEQ ID NO: 581497 - RNA, 64 nt, Homo Sapiens
aucagggaauuuguauuggagaaaaacccugcaaauguaauaaauauggaaaaacauuuuuuca

SEQ ID NO: 581498 - RNA, 64 nt, Homo Sapiens
uaaaauuaauuaucauuuuguugauugugcuuuuauguaauaaaaugcaguacuuuaaaacauu

SEQ ID NO: 581499 - RNA, 64 nt, Homo Sapiens
acaaaaacagaauaauuuugaaguuuuagaauaaauguaauauauuuacuauaauucuaaaugu

SEQ ID NO: 581500 - RNA, 64 nt, Homo Sapiens
uuucuaaugugguauuuuaaauaaaguaucauaaauguaauaaguaaauauuuauuuaggaaua

SEQ ID NO: 581501 - RNA, 64 nt, Homo Sapiens
auggaaaaauuuuaauuuguagccaucuuuucccauguaauaguauugauucauagagaacuua

SEQ ID NO: 581502 - RNA, 64 nt, Homo Sapiens
agaacuuaauguucaaaauuugcuuuguggaggcauguaauaagauaaacaucauacauuauaa

SEQ ID NO: 581503 - RNA, 64 nt, Homo Sapiens
aaggaaauguaaauauaauauauauuuauauuugauguaauauggacaucugcagauucuaaua

SEQ ID NO: 581504 - RNA, 64 nt, Homo Sapiens
aaaaaacaaaaaguacacagaaauauuuauuaaaauguaauacaguuuauugaacuuucuaggu

SEQ ID NO: 581505 - RNA, 64 nt, Homo Sapiens
guagaaauauugcucuaauuaucuacuaguaauaauguaauacuuaauuuguacccuuguuauu

SEQ ID NO: 581506 - RNA, 64 nt, Homo Sapiens
gaaccacuuugauauugagaaagagccaugugucauguaauacuaucagguaaaauauuuucca

SEQ ID NO: 581507 - RNA, 64 nt, Homo Sapiens
uuaaaagugaaaaucacuacuuuuguaguauuauauguaauauauuuccuuaaaacuucagucu

SEQ ID NO: 581508 - RNA, 64 nt, Homo Sapiens
uacuagugaguguuguuagaaagccacgggaaauauguaauaucucaauaacaugcaaacaaac

SEQ ID NO: 581509 - RNA, 64 nt, Homo Sapiens
uagaacgacauguuaauaaauguaagcuguauuuauguaauauucaauguuugauacucuagua

SEQ ID NO: 581510 - RNA, 64 nt, Homo Sapiens
ggaagccaaaguauucauaugauuuuuucaucuaauguaauaauugacaacucuuauuugaauu

SEQ ID NO: 581511 - RNA, 64 nt, Homo Sapiens
aauaaaacuaugguaaauguuuuuauguaauaauauguaauauacuaagucucucaaacuagcg

SEQ ID NO: 581512 - RNA, 64 nt, Homo Sapiens
auguaauauaaauaaaacuacaaacuagcguuuuauguaauaauagugaauguucuaagucucu

SEQ ID NO: 581513 - RNA, 64 nt, Homo Sapiens
agucaaaccaggcaauacaggacuuuuuaaggaaauguaauacacuucagcucuagcaguccau

SEQ ID NO: 581514 - RNA, 64 nt, Homo Sapiens
uacaugaauguugcauguguuguuagaggaaaauauguaauacuaaggcauaagcagauuuuac

SEQ ID NO: 581515 - RNA, 64 nt, Homo Sapiens
cacguguguauccaaucugcgccauuucauauguauguaauauguaguaugcacagcaguguua

SEQ ID NO: 581516 - RNA, 64 nt, Homo Sapiens
auuuuuaaaaucaucuuaaaaccaggaaaacuuaauguaauauuuucucaaaguugguuauuag

SEQ ID NO: 581517 - RNA, 64 nt, Homo Sapiens
uaccaaauuagggaaguuugauaaugcaaaaauuauguaauagauagauguauaaugaaaaagg

SEQ ID NO: 581518 - RNA, 64 nt, Homo Sapiens
aaaucugauagaccagcacuaguguugaucuguaauguaauagaagauucaucugaacuggacc

SEQ ID NO: 581519 - RNA, 64 nt, Homo Sapiens
uuauuuuaaauguuauuuuaaauuauauuguuuuauguaauauauuuuauguaauauuguguua

SEQ ID NO: 581520 - RNA, 64 nt, Homo Sapiens
guguuaaauuauauuguuuuuaauauuauauuuuauguaauauuuguauuauaaucuuuuaaua

SEQ ID NO: 581521 - RNA, 64 nt, Homo Sapiens
agaaagcccaucacgaacaauaugggaaauucuuauguaauacuauauaucuguaaaaugcaac

SEQ ID NO: 581522 - RNA, 64 nt, Homo Sapiens
uuuuaucacggaugaauggauggacuugcucucuauguaauaugaaauuaaucuauuuuauuaa

SEQ ID NO: 581523 - RNA, 64 nt, Homo Sapiens
ucaaucaauguuauugugaaaacugggaaugugaauguaauauauguagaaaaacauuuagcca

SEQ ID NO: 581524 - RNA, 64 nt, Homo Sapiens
aaacauuuagccacagcccaaaucuuccaggcaaauguaauaaacgugacauugccguuagcca

SEQ ID NO: 581525 - RNA, 64 nt, Homo Sapiens
augcaguacauuuuuaaauucuauuuguacuuuuauguaauaaaaaaauuaguacguuauuuua

SEQ ID NO: 581526 - RNA, 64 nt, Homo Sapiens
uuugaaaaaaaaguuuuccagaaaaacccugcaaauguaauaaaaucagggaauucagauugga

SEQ ID NO: 581527 - RNA, 64 nt, Homo Sapiens
aaaauauauguuuggcugaaauuaugucaaauggauguaauauaggguuuguuugcugcuuuug

SEQ ID NO: 581528 - RNA, 64 nt, Homo Sapiens
gaaauauaaacugugagauaaauaucauuauagcauguaauauuaaauuccuccugucuccucu

SEQ ID NO: 581529 - RNA, 64 nt, Homo Sapiens
guucucaaggaauuugcauucuagaaaguagaagauguaauaaauguacugugggacauguuaa

SEQ ID NO: 581530 - RNA, 64 nt, Homo Sapiens
uuucaaagauacaaauauuuacauaguuuuaaucauguaauauauacaauuuaauguccuagug

SEQ ID NO: 581531 - RNA, 64 nt, Homo Sapiens
gauauuuaaggauugcauauuguuccuaaugaggauguaauaaacaggcauuaguaccccuuuc

SEQ ID NO: 581532 - RNA, 64 nt, Homo Sapiens
aaguaaauagaauaauauuuuauuaauguaugauauguaauacuuauugucuaaaucaaguuuc

SEQ ID NO: 581533 - RNA, 64 nt, Homo Sapiens
uucuuaaaauuuagcauuacuuuaaauagccagcauguaauacaaguaacuacacuaccucaua

SEQ ID NO: 581534 - RNA, 64 nt, Homo Sapiens
gaaucuguaaauauuuuaaauguuuuauuaaggcauguaauaaacuauucuuugaaacuuguug

SEQ ID NO: 581535 - RNA, 64 nt, Homo Sapiens
uuugacaaggcccaaaguugccaaaaguccaaaaauguaauaaugcauuuauucacaagcaacc

SEQ ID NO: 581536 - RNA, 64 nt, Homo Sapiens
ccauuuauaucagaaaccuuuuuuguuagucaucauguaauaagaagaauguacucauacagau

SEQ ID NO: 581537 - RNA, 64 nt, Homo Sapiens
ggccaaaggccucuguaugaaaacacuaauuuaaauguaauaaauuaaauagauauucuauauu

SEQ ID NO: 581538 - RNA, 64 nt, Homo Sapiens
uccaaaauguacauaucuuuggaacagcuguugaauguaauacuccuaaaaauggccagauugu

SEQ ID NO: 581539 - RNA, 64 nt, Homo Sapiens; identical to SEQ ID NO: 117710

SEQ ID NO: 581540 - RNA, 64 nt, Homo Sapiens; identical to SEQ ID NO: 117711

SEQ ID NO: 581541 - RNA, 64 nt, Homo Sapiens; identical to SEQ ID NO: 117712

SEQ ID NO: 581542 - RNA, 64 nt, Homo Sapiens; identical to SEQ ID NO: 117713

SEQ ID NO: 581543 - RNA, 64 nt, Homo Sapiens; identical to SEQ ID NO: 117714

SEQ ID NO: 581544 - RNA, 64 nt, Homo Sapiens; identical to SEQ ID NO: 117715

SEQ ID NO: 581545 - RNA, 64 nt, Homo Sapiens; identical to SEQ ID NO: 117716

SEQ ID NO: 581546 - RNA, 64 nt, Homo Sapiens; identical to SEQ ID NO: 117717

SEQ ID NO: 581547 - RNA, 64 nt, Homo Sapiens; identical to SEQ ID NO: 117718

SEQ ID NO: 581548 - RNA, 64 nt, Homo Sapiens; identical to SEQ ID NO: 117719

SEQ ID NO: 581549 - RNA, 64 nt, Homo Sapiens; identical to SEQ ID NO: 117720

SEQ ID NO: 581550 - RNA, 64 nt, Homo Sapiens; identical to SEQ ID NO: 117721

SEQ ID NO: 581551 - RNA, 64 nt, Homo Sapiens; identical to SEQ ID NO: 117722

SEQ ID NO: 581552 - RNA, 64 nt, Homo Sapiens; identical to SEQ ID NO: 117723

SEQ ID NO: 581553 - RNA, 64 nt, Homo Sapiens; identical to SEQ ID NO: 117724

SEQ ID NO: 581554 - RNA, 64 nt, Homo Sapiens; identical to SEQ ID NO: 117725

SEQ ID NO: 581555 - RNA, 64 nt, Homo Sapiens; identical to SEQ ID NO: 117726

SEQ ID NO: 581556 - RNA, 64 nt, Homo Sapiens; identical to SEQ ID NO: 117727

SEQ ID NO: 581557 - RNA, 64 nt, Homo Sapiens; identical to SEQ ID NO: 117728

SEQ ID NO: 581558 - RNA, 64 nt, Homo Sapiens; identical to SEQ ID NO: 117729

SEQ ID NO: 581559 - RNA, 64 nt, Homo Sapiens; identical to SEQ ID NO: 117730

SEQ ID NO: 581560 - RNA, 64 nt, Homo Sapiens; identical to SEQ ID NO: 117731

SEQ ID NO: 581561 - RNA, 64 nt, Homo Sapiens; identical to SEQ ID NO: 117732

SEQ ID NO: 581562 - RNA, 64 nt, Homo Sapiens; identical to SEQ ID NO: 117733

SEQ ID NO: 581563 - RNA, 64 nt, Homo Sapiens; identical to SEQ ID NO: 117734

SEQ ID NO: 581564 - RNA, 64 nt, Homo Sapiens; identical to SEQ ID NO: 117735

SEQ ID NO: 581565 - RNA, 64 nt, Homo Sapiens; identical to SEQ ID NO: 117736

SEQ ID NO: 581566 - RNA, 64 nt, Homo Sapiens; identical to SEQ ID NO: 117737

SEQ ID NO: 581567 - RNA, 64 nt, Homo Sapiens; identical to SEQ ID NO: 117738

SEQ ID NO: 581568 - RNA, 64 nt, Homo Sapiens; identical to SEQ ID NO: 117739

SEQ ID NO: 581569 - RNA, 64 nt, Homo Sapiens; identical to SEQ ID NO: 117740

SEQ ID NO: 581570 - RNA, 64 nt, Homo Sapiens; identical to SEQ ID NO: 117741

SEQ ID NO: 581571 - RNA, 64 nt, Homo Sapiens; identical to SEQ ID NO: 117742

SEQ ID NO: 581572 - RNA, 64 nt, Homo Sapiens; identical to SEQ ID NO: 117743

SEQ ID NO: 581573 - RNA, 64 nt, Homo Sapiens; identical to SEQ ID NO: 117744

SEQ ID NO: 581574 - RNA, 64 nt, Homo Sapiens; identical to SEQ ID NO: 117745

SEQ ID NO: 581575 - RNA, 64 nt, Homo Sapiens; identical to SEQ ID NO: 117746

SEQ ID NO: 581576 - RNA, 64 nt, Homo Sapiens; identical to SEQ ID NO: 117747

SEQ ID NO: 581577 - RNA, 64 nt, Homo Sapiens; identical to SEQ ID NO: 117748

SEQ ID NO: 581578 - RNA, 64 nt, Homo Sapiens; identical to SEQ ID NO: 117749

SEQ ID NO: 581579 - RNA, 64 nt, Homo Sapiens; identical to SEQ ID NO: 117750

SEQ ID NO: 581580 - RNA, 64 nt, Homo Sapiens; identical to SEQ ID NO: 117751

SEQ ID NO: 581581 - RNA, 64 nt, Homo Sapiens; identical to SEQ ID NO: 117752

SEQ ID NO: 581582 - RNA, 64 nt, Homo Sapiens; identical to SEQ ID NO: 117753

SEQ ID NO: 581583 - RNA, 64 nt, Homo Sapiens; identical to SEQ ID NO: 117754

SEQ ID NO: 581584 - RNA, 64 nt, Homo Sapiens; identical to SEQ ID NO: 117755

SEQ ID NO: 581585 - RNA, 64 nt, Homo Sapiens; identical to SEQ ID NO: 117756

SEQ ID NO: 581586 - RNA, 64 nt, Homo Sapiens; identical to SEQ ID NO: 117757

SEQ ID NO: 581587 - RNA, 64 nt, Homo Sapiens; identical to SEQ ID NO: 117758

SEQ ID NO: 581588 - RNA, 64 nt, Homo Sapiens; identical to SEQ ID NO: 117759

SEQ ID NO: 581589 - RNA, 64 nt, Homo Sapiens; identical to SEQ ID NO: 117760

SEQ ID NO: 581590 - RNA, 64 nt, Homo Sapiens; identical to SEQ ID NO: 117761

SEQ ID NO: 581591 - RNA, 64 nt, Homo Sapiens; identical to SEQ ID NO: 117762

SEQ ID NO: 581592 - RNA, 64 nt, Homo Sapiens; identical to SEQ ID NO: 117763

SEQ ID NO: 581593 - RNA, 64 nt, Homo Sapiens; identical to SEQ ID NO: 117764

SEQ ID NO: 581594 - RNA, 64 nt, Homo Sapiens; identical to SEQ ID NO: 117765

SEQ ID NO: 581595 - RNA, 64 nt, Homo Sapiens; identical to SEQ ID NO: 117766

SEQ ID NO: 581596 - RNA, 64 nt, Homo Sapiens; identical to SEQ ID NO: 117767

SEQ ID NO: 581597 - RNA, 64 nt, Homo Sapiens; identical to SEQ ID NO: 117768

SEQ ID NO: 581598 - RNA, 64 nt, Homo Sapiens; identical to SEQ ID NO: 117769

SEQ ID NO: 581599 - RNA, 64 nt, Homo Sapiens; identical to SEQ ID NO: 117770

SEQ ID NO: 581600 - RNA, 64 nt, Homo Sapiens; identical to SEQ ID NO: 117771

SEQ ID NO: 581601 - RNA, 64 nt, Homo Sapiens; identical to SEQ ID NO: 117772

SEQ ID NO: 581602 - RNA, 64 nt, Homo Sapiens; identical to SEQ ID NO: 117773

SEQ ID NO: 581603 - RNA, 64 nt, Homo Sapiens; identical to SEQ ID NO: 117774

SEQ ID NO: 581604 - RNA, 64 nt, Homo Sapiens; identical to SEQ ID NO: 117775

SEQ ID NO: 581605 - RNA, 64 nt, Homo Sapiens; identical to SEQ ID NO: 117776

SEQ ID NO: 581606 - RNA, 64 nt, Homo Sapiens; identical to SEQ ID NO: 117777

SEQ ID NO: 581607 - RNA, 64 nt, Homo Sapiens; identical to SEQ ID NO: 117778

SEQ ID NO: 581608 - RNA, 64 nt, Homo Sapiens; identical to SEQ ID NO: 117779

SEQ ID NO: 581609 - RNA, 64 nt, Homo Sapiens; identical to SEQ ID NO: 117780

SEQ ID NO: 581610 - RNA, 64 nt, Homo Sapiens; identical to SEQ ID NO: 117781

SEQ ID NO: 581611 - RNA, 64 nt, Homo Sapiens; identical to SEQ ID NO: 117782

SEQ ID NO: 581612 - RNA, 64 nt, Homo Sapiens; identical to SEQ ID NO: 117783

SEQ ID NO: 581613 - RNA, 64 nt, Homo Sapiens; identical to SEQ ID NO: 117784

SEQ ID NO: 581614 - RNA, 64 nt, Homo Sapiens; identical to SEQ ID NO: 117785

SEQ ID NO: 581615 - RNA, 64 nt, Homo Sapiens; identical to SEQ ID NO: 117786

SEQ ID NO: 581616 - RNA, 59 nt, Homo Sapiens; identical to SEQ ID NO: 58889

SEQ ID NO: 581617 - RNA, 64 nt, Homo Sapiens; identical to SEQ ID NO: 117788

SEQ ID NO: 581618 - RNA, 64 nt, Homo Sapiens; identical to SEQ ID NO: 117789

SEQ ID NO: 581619 - RNA, 64 nt, Homo Sapiens; identical to SEQ ID NO: 117790

SEQ ID NO: 581620 - RNA, 64 nt, Homo Sapiens; identical to SEQ ID NO: 117791

SEQ ID NO: 581621 - RNA, 64 nt, Homo Sapiens; identical to SEQ ID NO: 117792

SEQ ID NO: 581622 - RNA, 64 nt, Homo Sapiens; identical to SEQ ID NO: 117793

SEQ ID NO: 581623 - RNA, 64 nt, Homo Sapiens; identical to SEQ ID NO: 117794

SEQ ID NO: 581624 - RNA, 64 nt, Homo Sapiens; identical to SEQ ID NO: 117795

SEQ ID NO: 581625 - RNA, 64 nt, Homo Sapiens; identical to SEQ ID NO: 117796

SEQ ID NO: 581626 - RNA, 64 nt, Homo Sapiens; identical to SEQ ID NO: 117797

SEQ ID NO: 581627 - RNA, 64 nt, Homo Sapiens; identical to SEQ ID NO: 117798

SEQ ID NO: 581628 - RNA, 64 nt, Homo Sapiens; identical to SEQ ID NO: 117799

SEQ ID NO: 581629 - RNA, 64 nt, Homo Sapiens; identical to SEQ ID NO: 117800

SEQ ID NO: 581630 - RNA, 64 nt, Homo Sapiens; identical to SEQ ID NO: 117801

SEQ ID NO: 581631 - RNA, 64 nt, Homo Sapiens; identical to SEQ ID NO: 117802

SEQ ID NO: 581632 - RNA, 64 nt, Homo Sapiens; identical to SEQ ID NO: 117803

SEQ ID NO: 581633 - RNA, 64 nt, Homo Sapiens; identical to SEQ ID NO: 117804

SEQ ID NO: 581634 - RNA, 64 nt, Homo Sapiens; identical to SEQ ID NO: 117805

SEQ ID NO: 581635 - RNA, 64 nt, Homo Sapiens; identical to SEQ ID NO: 117806

SEQ ID NO: 581636 - RNA, 64 nt, Homo Sapiens; identical to SEQ ID NO: 117807

SEQ ID NO: 581637 - RNA, 64 nt, Homo Sapiens; identical to SEQ ID NO: 117808

SEQ ID NO: 581638 - RNA, 64 nt, Homo Sapiens; identical to SEQ ID NO: 117809

SEQ ID NO: 581639 - RNA, 64 nt, Homo Sapiens; identical to SEQ ID NO: 117810

SEQ ID NO: 581640 - RNA, 64 nt, Homo Sapiens; identical to SEQ ID NO: 117811

SEQ ID NO: 581641 - RNA, 64 nt, Homo Sapiens; identical to SEQ ID NO: 117812

SEQ ID NO: 581642 - RNA, 64 nt, Homo Sapiens; identical to SEQ ID NO: 117813

SEQ ID NO: 581643 - RNA, 64 nt, Homo Sapiens; identical to SEQ ID NO: 117814

SEQ ID NO: 581644 - RNA, 64 nt, Homo Sapiens; identical to SEQ ID NO: 117815

SEQ ID NO: 581645 - RNA, 64 nt, Homo Sapiens; identical to SEQ ID NO: 117816

SEQ ID NO: 581646 - RNA, 64 nt, Homo Sapiens; identical to SEQ ID NO: 117817

SEQ ID NO: 581647 - RNA, 64 nt, Homo Sapiens; identical to SEQ ID NO: 117818

SEQ ID NO: 581648 - RNA, 64 nt, Homo Sapiens; identical to SEQ ID NO: 117819

SEQ ID NO: 581649 - RNA, 64 nt, Homo Sapiens; identical to SEQ ID NO: 117820

SEQ ID NO: 581650 - RNA, 64 nt, Homo Sapiens; identical to SEQ ID NO: 117821

SEQ ID NO: 581651 - RNA, 64 nt, Homo Sapiens; identical to SEQ ID NO: 117822

SEQ ID NO: 581652 - RNA, 64 nt, Homo Sapiens; identical to SEQ ID NO: 117823

SEQ ID NO: 581653 - RNA, 64 nt, Homo Sapiens
uuucuggaaaguagaucuuuucuugaccuaguauaucagugacaguugcagcccuugugaugug

SEQ ID NO: 581654 - RNA, 64 nt, Homo Sapiens
ugaagaaaagaccuuuuggcccaaucucugccauaucagugaaccuuuagaaacucaaaaacug

SEQ ID NO: 581655 - RNA, 64 nt, Homo Sapiens
agcaugacccaucuccagagaugggauuugagaaaucagugagagcuuccuauaaagaacucca

SEQ ID NO: 581656 - RNA, 64 nt, Homo Sapiens
ggguaguggagcuucccuccccacccccauauguaucagugaagccuuugaaauuacuuaaggc

SEQ ID NO: 581657 - RNA, 64 nt, Homo Sapiens
ugaaugacuucucagaaccuggacaccuaaacagaucagugaccuugguggccaaguuauuugg

SEQ ID NO: 581658 - RNA, 64 nt, Homo Sapiens
agggguggcuagaguaacuaugcucagcuuccccaucagugaaacccaggcuuuuacaaccugg

SEQ ID NO: 581659 - RNA, 64 nt, Homo Sapiens
gcacggggaaaccuccugaguggaaguuucauucaucagugaugaauagcccccaaacaguggg

SEQ ID NO: 581660 - RNA, 64 nt, Homo Sapiens
uaauaauacaagcuccaguguuauacaauaacccaucagugauuggggaaucaaacauuuuggu

SEQ ID NO: 581661 - RNA, 64 nt, Homo Sapiens
uuuucagcaacaauucuucuguuuauucuaauuaaucagugacugccuuguaagaaauguuugu

SEQ ID NO: 581662 - RNA, 64 nt, Homo Sapiens
aauacuagagcauugguucugacauucauuguaaaucagugaacuguaagauacugucuaaaaa

SEQ ID NO: 581663 - RNA, 64 nt, Homo Sapiens
ugccugcaagcauccccagauggugcuuccaauuaucagugaccaaagucccaggccucugccu

SEQ ID NO: 581664 - RNA, 64 nt, Homo Sapiens
agcuuccuguagccaaucaguguggaacaagucaaucagugacuuuauguaagaaucaucgccu

SEQ ID NO: 581665 - RNA, 64 nt, Homo Sapiens
aaaaaugucagaacugugcuagacuauauuuaugaucagugaauugaucaccuuaaugcucaug

SEQ ID NO: 581666 - RNA, 64 nt, Homo Sapiens
gcuccaugauggucauguucgccagugauggggaaucagugaguaagaugccccgacuucuuug

SEQ ID NO: 581667 - RNA, 65 nt, Homo Sapiens; identical to SEQ ID NO: 227063

SEQ ID NO: 581668 - RNA, 65 nt, Homo Sapiens; identical to SEQ ID NO: 227064

SEQ ID NO: 581669 - RNA, 65 nt, Homo Sapiens; identical to SEQ ID NO: 227065

SEQ ID NO: 581670 - RNA, 65 nt, Homo Sapiens; identical to SEQ ID NO: 227066

SEQ ID NO: 581671 - RNA, 65 nt, Homo Sapiens; identical to SEQ ID NO: 227067

SEQ ID NO: 581672 - RNA, 65 nt, Homo Sapiens; identical to SEQ ID NO: 227068

SEQ ID NO: 581673 - RNA, 65 nt, Homo Sapiens; identical to SEQ ID NO: 227069

SEQ ID NO: 581674 - RNA, 65 nt, Homo Sapiens; identical to SEQ ID NO: 227070

SEQ ID NO: 581675 - RNA, 65 nt, Homo Sapiens; identical to SEQ ID NO: 227071

SEQ ID NO: 581676 - RNA, 65 nt, Homo Sapiens; identical to SEQ ID NO: 227072

SEQ ID NO: 581677 - RNA, 65 nt, Homo Sapiens; identical to SEQ ID NO: 227073

SEQ ID NO: 581678 - RNA, 54 nt, Homo Sapiens; identical to SEQ ID NO: 227074

SEQ ID NO: 581679 - RNA, 65 nt, Homo Sapiens; identical to SEQ ID NO: 227075

SEQ ID NO: 581680 - RNA, 65 nt, Homo Sapiens; identical to SEQ ID NO: 227076

SEQ ID NO: 581681 - RNA, 65 nt, Homo Sapiens; identical to SEQ ID NO: 227077

SEQ ID NO: 581682 - RNA, 65 nt, Homo Sapiens; identical to SEQ ID NO: 227078

SEQ ID NO: 581683 - RNA, 65 nt, Homo Sapiens; identical to SEQ ID NO: 227079

SEQ ID NO: 581684 - RNA, 65 nt, Homo Sapiens; identical to SEQ ID NO: 227080

SEQ ID NO: 581685 - RNA, 65 nt, Homo Sapiens; identical to SEQ ID NO: 227081

SEQ ID NO: 581686 - RNA, 65 nt, Homo Sapiens; identical to SEQ ID NO: 227082

SEQ ID NO: 581687 - RNA, 65 nt, Homo Sapiens; identical to SEQ ID NO: 227083

SEQ ID NO: 581688 - RNA, 65 nt, Homo Sapiens; identical to SEQ ID NO: 58812

SEQ ID NO: 581689 - RNA, 65 nt, Homo Sapiens; identical to SEQ ID NO: 58813

SEQ ID NO: 581690 - RNA, 65 nt, Homo Sapiens; identical to SEQ ID NO: 227086

SEQ ID NO: 581691 - RNA, 65 nt, Homo Sapiens; identical to SEQ ID NO: 227087

SEQ ID NO: 581692 - RNA, 65 nt, Homo Sapiens; identical to SEQ ID NO: 227088

SEQ ID NO: 581693 - RNA, 65 nt, Homo Sapiens; identical to SEQ ID NO: 227089

SEQ ID NO: 581694 - RNA, 65 nt, Homo Sapiens; identical to SEQ ID NO: 227090

SEQ ID NO: 581695 - RNA, 65 nt, Homo Sapiens; identical to SEQ ID NO: 227091

SEQ ID NO: 581696 - RNA, 65 nt, Homo Sapiens; identical to SEQ ID NO: 227092

SEQ ID NO: 581697 - RNA, 65 nt, Homo Sapiens; identical to SEQ ID NO: 227093

SEQ ID NO: 581698 - RNA, 65 nt, Homo Sapiens; identical to SEQ ID NO: 227094

SEQ ID NO: 581699 - RNA, 65 nt, Homo Sapiens; identical to SEQ ID NO: 227095

SEQ ID NO: 581700 - RNA, 65 nt, Homo Sapiens; identical to SEQ ID NO: 227096

SEQ ID NO: 581701 - RNA, 65 nt, Homo Sapiens; identical to SEQ ID NO: 227097

SEQ ID NO: 581702 - RNA, 65 nt, Homo Sapiens; identical to SEQ ID NO: 227098

SEQ ID NO: 581703 - RNA, 65 nt, Homo Sapiens; identical to SEQ ID NO: 58814

SEQ ID NO: 581704 - RNA, 65 nt, Homo Sapiens; identical to SEQ ID NO: 58815

SEQ ID NO: 581705 - RNA, 65 nt, Homo Sapiens; identical to SEQ ID NO: 227101

SEQ ID NO: 581706 - RNA, 65 nt, Homo Sapiens; identical to SEQ ID NO: 227102

SEQ ID NO: 581707 - RNA, 65 nt, Homo Sapiens; identical to SEQ ID NO: 227103

SEQ ID NO: 581708 - RNA, 65 nt, Homo Sapiens; identical to SEQ ID NO: 227104

SEQ ID NO: 581709 - RNA, 65 nt, Homo Sapiens; identical to SEQ ID NO: 227105

SEQ ID NO: 581710 - RNA, 65 nt, Homo Sapiens; identical to SEQ ID NO: 227106

SEQ ID NO: 581711 - RNA, 65 nt, Homo Sapiens; identical to SEQ ID NO: 227107

SEQ ID NO: 581712 - RNA, 65 nt, Homo Sapiens; identical to SEQ ID NO: 227108

SEQ ID NO: 581713 - RNA, 65 nt, Homo Sapiens; identical to SEQ ID NO: 227109

SEQ ID NO: 581714 - RNA, 65 nt, Homo Sapiens; identical to SEQ ID NO: 227110

SEQ ID NO: 581715 - RNA, 65 nt, Homo Sapiens; identical to SEQ ID NO: 227111

SEQ ID NO: 581716 - RNA, 65 nt, Homo Sapiens; identical to SEQ ID NO: 58816

SEQ ID NO: 581717 - RNA, 65 nt, Homo Sapiens; identical to SEQ ID NO: 58817

SEQ ID NO: 581718 - RNA, 65 nt, Homo Sapiens; identical to SEQ ID NO: 227114

SEQ ID NO: 581719 - RNA, 65 nt, Homo Sapiens; identical to SEQ ID NO: 227115

SEQ ID NO: 581720 - RNA, 65 nt, Homo Sapiens; identical to SEQ ID NO: 227116

SEQ ID NO: 581721 - RNA, 65 nt, Homo Sapiens; identical to SEQ ID NO: 227117

SEQ ID NO: 581722 - RNA, 65 nt, Homo Sapiens; identical to SEQ ID NO: 227118

SEQ ID NO: 581723 - RNA, 65 nt, Homo Sapiens; identical to SEQ ID NO: 227119

SEQ ID NO: 581724 - RNA, 65 nt, Homo Sapiens; identical to SEQ ID NO: 227120

SEQ ID NO: 581725 - RNA, 65 nt, Homo Sapiens; identical to SEQ ID NO: 227121

SEQ ID NO: 581726 - RNA, 65 nt, Homo Sapiens; identical to SEQ ID NO: 227122

SEQ ID NO: 581727 - RNA, 65 nt, Homo Sapiens; identical to SEQ ID NO: 227123

SEQ ID NO: 581728 - RNA, 65 nt, Homo Sapiens; identical to SEQ ID NO: 227124

SEQ ID NO: 581729 - RNA, 65 nt, Homo Sapiens; identical to SEQ ID NO: 227125

SEQ ID NO: 581730 - RNA, 65 nt, Homo Sapiens; identical to SEQ ID NO: 227126

SEQ ID NO: 581731 - RNA, 65 nt, Homo Sapiens; identical to SEQ ID NO: 227127

SEQ ID NO: 581732 - RNA, 65 nt, Homo Sapiens; identical to SEQ ID NO: 227128

SEQ ID NO: 581733 - RNA, 65 nt, Homo Sapiens; identical to SEQ ID NO: 227129

SEQ ID NO: 581734 - RNA, 65 nt, Homo Sapiens; identical to SEQ ID NO: 227130

SEQ ID NO: 581735 - RNA, 65 nt, Homo Sapiens; identical to SEQ ID NO: 227131

SEQ ID NO: 581736 - RNA, 65 nt, Homo Sapiens; identical to SEQ ID NO: 227132

SEQ ID NO: 581737 - RNA, 65 nt, Homo Sapiens; identical to SEQ ID NO: 227133

SEQ ID NO: 581738 - RNA, 65 nt, Homo Sapiens; identical to SEQ ID NO: 58818

SEQ ID NO: 581739 - RNA, 65 nt, Homo Sapiens; identical to SEQ ID NO: 58819

SEQ ID NO: 581740 - RNA, 65 nt, Homo Sapiens; identical to SEQ ID NO: 227136

SEQ ID NO: 581741 - RNA, 65 nt, Homo Sapiens; identical to SEQ ID NO: 227137

SEQ ID NO: 581742 - RNA, 65 nt, Homo Sapiens; identical to SEQ ID NO: 227138

SEQ ID NO: 581743 - RNA, 65 nt, Homo Sapiens; identical to SEQ ID NO: 227139

SEQ ID NO: 581744 - RNA, 65 nt, Homo Sapiens; identical to SEQ ID NO: 227140

SEQ ID NO: 581745 - RNA, 65 nt, Homo Sapiens; identical to SEQ ID NO: 227141

SEQ ID NO: 581746 - RNA, 65 nt, Homo Sapiens; identical to SEQ ID NO: 227142

SEQ ID NO: 581747 - RNA, 65 nt, Homo Sapiens; identical to SEQ ID NO: 227143

SEQ ID NO: 581748 - RNA, 65 nt, Homo Sapiens; identical to SEQ ID NO: 227144

SEQ ID NO: 581749 - RNA, 65 nt, Homo Sapiens; identical to SEQ ID NO: 227145

SEQ ID NO: 581750 - RNA, 65 nt, Homo Sapiens; identical to SEQ ID NO: 227146

SEQ ID NO: 581751 - RNA, 65 nt, Homo Sapiens; identical to SEQ ID NO: 227147

SEQ ID NO: 581752 - RNA, 65 nt, Homo Sapiens; identical to SEQ ID NO: 227148

SEQ ID NO: 581753 - RNA, 65 nt, Homo Sapiens; identical to SEQ ID NO: 58820

SEQ ID NO: 581754 - RNA, 65 nt, Homo Sapiens; identical to SEQ ID NO: 58821

SEQ ID NO: 581755 - RNA, 65 nt, Homo Sapiens; identical to SEQ ID NO: 227151

SEQ ID NO: 581756 - RNA, 65 nt, Homo Sapiens; identical to SEQ ID NO: 227152

SEQ ID NO: 581757 - RNA, 65 nt, Homo Sapiens; identical to SEQ ID NO: 227153

SEQ ID NO: 581758 - RNA, 65 nt, Homo Sapiens; identical to SEQ ID NO: 227154

SEQ ID NO: 581759 - RNA, 65 nt, Homo Sapiens; identical to SEQ ID NO: 227155

SEQ ID NO: 581760 - RNA, 65 nt, Homo Sapiens; identical to SEQ ID NO: 227156

SEQ ID NO: 581761 - RNA, 65 nt, Homo Sapiens; identical to SEQ ID NO: 227157

SEQ ID NO: 581762 - RNA, 65 nt, Homo Sapiens; identical to SEQ ID NO: 227158

SEQ ID NO: 581763 - RNA, 65 nt, Homo Sapiens; identical to SEQ ID NO: 227159

SEQ ID NO: 581764 - RNA, 65 nt, Homo Sapiens; identical to SEQ ID NO: 227160

SEQ ID NO: 581765 - RNA, 65 nt, Homo Sapiens; identical to SEQ ID NO: 227161

SEQ ID NO: 581766 - RNA, 65 nt, Homo Sapiens; identical to SEQ ID NO: 227162

SEQ ID NO: 581767 - RNA, 65 nt, Homo Sapiens; identical to SEQ ID NO: 227163

SEQ ID NO: 581768 - RNA, 65 nt, Homo Sapiens; identical to SEQ ID NO: 58822

SEQ ID NO: 581769 - RNA, 65 nt, Homo Sapiens; identical to SEQ ID NO: 58823

SEQ ID NO: 581770 - RNA, 65 nt, Homo Sapiens; identical to SEQ ID NO: 227166

SEQ ID NO: 581771 - RNA, 65 nt, Homo Sapiens; identical to SEQ ID NO: 227167

SEQ ID NO: 581772 - RNA, 65 nt, Homo Sapiens; identical to SEQ ID NO: 227168

SEQ ID NO: 581773 - RNA, 65 nt, Homo Sapiens; identical to SEQ ID NO: 227169

SEQ ID NO: 581774 - RNA, 65 nt, Homo Sapiens; identical to SEQ ID NO: 227170

SEQ ID NO: 581775 - RNA, 65 nt, Homo Sapiens; identical to SEQ ID NO: 227171

SEQ ID NO: 581776 - RNA, 65 nt, Homo Sapiens; identical to SEQ ID NO: 227172

SEQ ID NO: 581777 - RNA, 65 nt, Homo Sapiens; identical to SEQ ID NO: 227173

SEQ ID NO: 581778 - RNA, 65 nt, Homo Sapiens; identical to SEQ ID NO: 227174

SEQ ID NO: 581779 - RNA, 65 nt, Homo Sapiens; identical to SEQ ID NO: 227175

SEQ ID NO: 581780 - RNA, 65 nt, Homo Sapiens; identical to SEQ ID NO: 227176

SEQ ID NO: 581781 - RNA, 65 nt, Homo Sapiens; identical to SEQ ID NO: 58824

SEQ ID NO: 581782 - RNA, 65 nt, Homo Sapiens; identical to SEQ ID NO: 58825

SEQ ID NO: 581783 - RNA, 65 nt, Homo Sapiens; identical to SEQ ID NO: 58826

SEQ ID NO: 581784 - RNA, 65 nt, Homo Sapiens; identical to SEQ ID NO: 58827

SEQ ID NO: 581785 - RNA, 65 nt, Homo Sapiens; identical to SEQ ID NO: 227181

SEQ ID NO: 581786 - RNA, 65 nt, Homo Sapiens; identical to SEQ ID NO: 227182

SEQ ID NO: 581787 - RNA, 65 nt, Homo Sapiens; identical to SEQ ID NO: 227183

SEQ ID NO: 581788 - RNA, 65 nt, Homo Sapiens; identical to SEQ ID NO: 227184

SEQ ID NO: 581789 - RNA, 65 nt, Homo Sapiens; identical to SEQ ID NO: 227185

SEQ ID NO: 581790 - RNA, 65 nt, Homo Sapiens; identical to SEQ ID NO: 227186

SEQ ID NO: 581791 - RNA, 65 nt, Homo Sapiens; identical to SEQ ID NO: 227187

SEQ ID NO: 581792 - RNA, 65 nt, Homo Sapiens; identical to SEQ ID NO: 227188

SEQ ID NO: 581793 - RNA, 65 nt, Homo Sapiens; identical to SEQ ID NO: 227189

SEQ ID NO: 581794 - RNA, 65 nt, Homo Sapiens; identical to SEQ ID NO: 227190

SEQ ID NO: 581795 - RNA, 65 nt, Homo Sapiens; identical to SEQ ID NO: 227191

SEQ ID NO: 581796 - RNA, 65 nt, Homo Sapiens; identical to SEQ ID NO: 227192

SEQ ID NO: 581797 - RNA, 65 nt, Homo Sapiens; identical to SEQ ID NO: 227193

SEQ ID NO: 581798 - RNA, 65 nt, Homo Sapiens; identical to SEQ ID NO: 227194

SEQ ID NO: 581799 - RNA, 65 nt, Homo Sapiens; identical to SEQ ID NO: 227195

SEQ ID NO: 581800 - RNA, 65 nt, Homo Sapiens; identical to SEQ ID NO: 227196

SEQ ID NO: 581801 - RNA, 65 nt, Homo Sapiens; identical to SEQ ID NO: 227197

SEQ ID NO: 581802 - RNA, 65 nt, Homo Sapiens; identical to SEQ ID NO: 227198

SEQ ID NO: 581803 - RNA, 65 nt, Homo Sapiens; identical to SEQ ID NO: 227199

SEQ ID NO: 581804 - RNA, 65 nt, Homo Sapiens; identical to SEQ ID NO: 227200

SEQ ID NO: 581805 - RNA, 65 nt, Homo Sapiens; identical to SEQ ID NO: 227201

SEQ ID NO: 581806 - RNA, 65 nt, Homo Sapiens; identical to SEQ ID NO: 227202

SEQ ID NO: 581807 - RNA, 65 nt, Homo Sapiens; identical to SEQ ID NO: 227203

SEQ ID NO: 581808 - RNA, 65 nt, Homo Sapiens; identical to SEQ ID NO: 227204

SEQ ID NO: 581809 - RNA, 65 nt, Homo Sapiens; identical to SEQ ID NO: 227205

SEQ ID NO: 581810 - RNA, 65 nt, Homo Sapiens; identical to SEQ ID NO: 227206

SEQ ID NO: 581811 - RNA, 65 nt, Homo Sapiens; identical to SEQ ID NO: 227207

SEQ ID NO: 581812 - RNA, 65 nt, Homo Sapiens; identical to SEQ ID NO: 227208

SEQ ID NO: 581813 - RNA, 65 nt, Homo Sapiens; identical to SEQ ID NO: 227209

SEQ ID NO: 581814 - RNA, 65 nt, Homo Sapiens; identical to SEQ ID NO: 227210

SEQ ID NO: 581815 - RNA, 65 nt, Homo Sapiens; identical to SEQ ID NO: 58828

SEQ ID NO: 581816 - RNA, 65 nt, Homo Sapiens; identical to SEQ ID NO: 58829

SEQ ID NO: 581817 - RNA, 65 nt, Homo Sapiens; identical to SEQ ID NO: 227213

SEQ ID NO: 581818 - RNA, 65 nt, Homo Sapiens; identical to SEQ ID NO: 227214

SEQ ID NO: 581819 - RNA, 65 nt, Homo Sapiens; identical to SEQ ID NO: 227215

SEQ ID NO: 581820 - RNA, 65 nt, Homo Sapiens; identical to SEQ ID NO: 227216

SEQ ID NO: 581821 - RNA, 65 nt, Homo Sapiens; identical to SEQ ID NO: 227217

SEQ ID NO: 581822 - RNA, 65 nt, Homo Sapiens; identical to SEQ ID NO: 227218

SEQ ID NO: 581823 - RNA, 65 nt, Homo Sapiens; identical to SEQ ID NO: 227219

SEQ ID NO: 581824 - RNA, 65 nt, Homo Sapiens; identical to SEQ ID NO: 227220

SEQ ID NO: 581825 - RNA, 65 nt, Homo Sapiens; identical to SEQ ID NO: 227221

SEQ ID NO: 581826 - RNA, 65 nt, Homo Sapiens; identical to SEQ ID NO: 227222

SEQ ID NO: 581827 - RNA, 65 nt, Homo Sapiens; identical to SEQ ID NO: 58830

SEQ ID NO: 581828 - RNA, 65 nt, Homo Sapiens; identical to SEQ ID NO: 58831

SEQ ID NO: 581829 - RNA, 65 nt, Homo Sapiens; identical to SEQ ID NO: 227225

SEQ ID NO: 581830 - RNA, 65 nt, Homo Sapiens; identical to SEQ ID NO: 227226

SEQ ID NO: 581831 - RNA, 65 nt, Homo Sapiens; identical to SEQ ID NO: 227227

SEQ ID NO: 581832 - RNA, 65 nt, Homo Sapiens; identical to SEQ ID NO: 227228

SEQ ID NO: 581833 - RNA, 65 nt, Homo Sapiens; identical to SEQ ID NO: 227229

SEQ ID NO: 581834 - RNA, 65 nt, Homo Sapiens; identical to SEQ ID NO: 227230

SEQ ID NO: 581835 - RNA, 65 nt, Homo Sapiens; identical to SEQ ID NO: 227231

SEQ ID NO: 581836 - RNA, 65 nt, Homo Sapiens; identical to SEQ ID NO: 227232

SEQ ID NO: 581837 - RNA, 65 nt, Homo Sapiens; identical to SEQ ID NO: 227233

SEQ ID NO: 581838 - RNA, 65 nt, Homo Sapiens; identical to SEQ ID NO: 227234

SEQ ID NO: 581839 - RNA, 65 nt, Homo Sapiens; identical to SEQ ID NO: 227235

SEQ ID NO: 581840 - RNA, 65 nt, Homo Sapiens; identical to SEQ ID NO: 227236

SEQ ID NO: 581841 - RNA, 65 nt, Homo Sapiens; identical to SEQ ID NO: 227237

SEQ ID NO: 581842 - RNA, 65 nt, Homo Sapiens; identical to SEQ ID NO: 227238

SEQ ID NO: 581843 - RNA, 65 nt, Homo Sapiens; identical to SEQ ID NO: 227239

SEQ ID NO: 581844 - RNA, 65 nt, Homo Sapiens; identical to SEQ ID NO: 227240

SEQ ID NO: 581845 - RNA, 65 nt, Homo Sapiens; identical to SEQ ID NO: 227241

SEQ ID NO: 581846 - RNA, 65 nt, Homo Sapiens; identical to SEQ ID NO: 227242

SEQ ID NO: 581847 - RNA, 65 nt, Homo Sapiens; identical to SEQ ID NO: 227243

SEQ ID NO: 581848 - RNA, 65 nt, Homo Sapiens; identical to SEQ ID NO: 227244

SEQ ID NO: 581849 - RNA, 65 nt, Homo Sapiens; identical to SEQ ID NO: 227245

SEQ ID NO: 581850 - RNA, 65 nt, Homo Sapiens; identical to SEQ ID NO: 227246

SEQ ID NO: 581851 - RNA, 65 nt, Homo Sapiens; identical to SEQ ID NO: 227247

SEQ ID NO: 581852 - RNA, 65 nt, Homo Sapiens; identical to SEQ ID NO: 227248

SEQ ID NO: 581853 - RNA, 65 nt, Homo Sapiens; identical to SEQ ID NO: 227249

SEQ ID NO: 581854 - RNA, 65 nt, Homo Sapiens; identical to SEQ ID NO: 227250

SEQ ID NO: 581855 - RNA, 65 nt, Homo Sapiens; identical to SEQ ID NO: 227251

SEQ ID NO: 581856 - RNA, 65 nt, Homo Sapiens; identical to SEQ ID NO: 227252

SEQ ID NO: 581857 - RNA, 65 nt, Homo Sapiens; identical to SEQ ID NO: 58832

SEQ ID NO: 581858 - RNA, 65 nt, Homo Sapiens; identical to SEQ ID NO: 58833

SEQ ID NO: 581859 - RNA, 65 nt, Homo Sapiens; identical to SEQ ID NO: 58834

SEQ ID NO: 581860 - RNA, 65 nt, Homo Sapiens; identical to SEQ ID NO: 58835

SEQ ID NO: 581861 - RNA, 65 nt, Homo Sapiens; identical to SEQ ID NO: 227257

SEQ ID NO: 581862 - RNA, 65 nt, Homo Sapiens; identical to SEQ ID NO: 227258

SEQ ID NO: 581863 - RNA, 65 nt, Homo Sapiens; identical to SEQ ID NO: 227259

SEQ ID NO: 581864 - RNA, 65 nt, Homo Sapiens; identical to SEQ ID NO: 58836

SEQ ID NO: 581865 - RNA, 65 nt, Homo Sapiens; identical to SEQ ID NO: 58837

SEQ ID NO: 581866 - RNA, 65 nt, Homo Sapiens; identical to SEQ ID NO: 227262

SEQ ID NO: 581867 - RNA, 65 nt, Homo Sapiens; identical to SEQ ID NO: 227263

SEQ ID NO: 581868 - RNA, 65 nt, Homo Sapiens; identical to SEQ ID NO: 227264

SEQ ID NO: 581869 - RNA, 65 nt, Homo Sapiens; identical to SEQ ID NO: 227265

SEQ ID NO: 581870 - RNA, 65 nt, Homo Sapiens; identical to SEQ ID NO: 227266

SEQ ID NO: 581871 - RNA, 65 nt, Homo Sapiens; identical to SEQ ID NO: 227267

SEQ ID NO: 581872 - RNA, 65 nt, Homo Sapiens; identical to SEQ ID NO: 227268

SEQ ID NO: 581873 - RNA, 65 nt, Homo Sapiens; identical to SEQ ID NO: 227269

SEQ ID NO: 581874 - RNA, 65 nt, Homo Sapiens; identical to SEQ ID NO: 227270

SEQ ID NO: 581875 - RNA, 65 nt, Homo Sapiens; identical to SEQ ID NO: 227271

SEQ ID NO: 581876 - RNA, 65 nt, Homo Sapiens; identical to SEQ ID NO: 227272

SEQ ID NO: 581877 - RNA, 65 nt, Homo Sapiens; identical to SEQ ID NO: 227273

SEQ ID NO: 581878 - RNA, 65 nt, Homo Sapiens; identical to SEQ ID NO: 227274

SEQ ID NO: 581879 - RNA, 65 nt, Homo Sapiens; identical to SEQ ID NO: 227275

SEQ ID NO: 581880 - RNA, 65 nt, Homo Sapiens; identical to SEQ ID NO: 227276

SEQ ID NO: 581881 - RNA, 65 nt, Homo Sapiens; identical to SEQ ID NO: 227277

SEQ ID NO: 581882 - RNA, 65 nt, Homo Sapiens; identical to SEQ ID NO: 227278

SEQ ID NO: 581883 - RNA, 65 nt, Homo Sapiens; identical to SEQ ID NO: 227279

SEQ ID NO: 581884 - RNA, 65 nt, Homo Sapiens; identical to SEQ ID NO: 227280

SEQ ID NO: 581885 - RNA, 65 nt, Homo Sapiens; identical to SEQ ID NO: 227281

SEQ ID NO: 581886 - RNA, 65 nt, Homo Sapiens; identical to SEQ ID NO: 227282

SEQ ID NO: 581887 - RNA, 65 nt, Homo Sapiens; identical to SEQ ID NO: 227283

SEQ ID NO: 581888 - RNA, 65 nt, Homo Sapiens; identical to SEQ ID NO: 227284

SEQ ID NO: 581889 - RNA, 65 nt, Homo Sapiens; identical to SEQ ID NO: 227285

SEQ ID NO: 581890 - RNA, 65 nt, Homo Sapiens; identical to SEQ ID NO: 227286

SEQ ID NO: 581891 - RNA, 65 nt, Homo Sapiens; identical to SEQ ID NO: 227287

SEQ ID NO: 581892 - RNA, 65 nt, Homo Sapiens; identical to SEQ ID NO: 227288

SEQ ID NO: 581893 - RNA, 65 nt, Homo Sapiens; identical to SEQ ID NO: 227289

SEQ ID NO: 581894 - RNA, 65 nt, Homo Sapiens; identical to SEQ ID NO: 227290

SEQ ID NO: 581895 - RNA, 65 nt, Homo Sapiens; identical to SEQ ID NO: 227291

SEQ ID NO: 581896 - RNA, 65 nt, Homo Sapiens; identical to SEQ ID NO: 227292

SEQ ID NO: 581897 - RNA, 65 nt, Homo Sapiens; identical to SEQ ID NO: 227293

SEQ ID NO: 581898 - RNA, 65 nt, Homo Sapiens; identical to SEQ ID NO: 227294

SEQ ID NO: 581899 - RNA, 65 nt, Homo Sapiens; identical to SEQ ID NO: 227295

SEQ ID NO: 581900 - RNA, 65 nt, Homo Sapiens; identical to SEQ ID NO: 227296

SEQ ID NO: 581901 - RNA, 65 nt, Homo Sapiens; identical to SEQ ID NO: 227297

SEQ ID NO: 581902 - RNA, 65 nt, Homo Sapiens; identical to SEQ ID NO: 227298

SEQ ID NO: 581903 - RNA, 65 nt, Homo Sapiens; identical to SEQ ID NO: 227299

SEQ ID NO: 581904 - RNA, 65 nt, Homo Sapiens; identical to SEQ ID NO: 227300

SEQ ID NO: 581905 - RNA, 65 nt, Homo Sapiens; identical to SEQ ID NO: 58838

SEQ ID NO: 581906 - RNA, 65 nt, Homo Sapiens; identical to SEQ ID NO: 58839

SEQ ID NO: 581907 - RNA, 65 nt, Homo Sapiens; identical to SEQ ID NO: 58840

SEQ ID NO: 581908 - RNA, 65 nt, Homo Sapiens; identical to SEQ ID NO: 58841

SEQ ID NO: 581909 - RNA, 65 nt, Homo Sapiens; identical to SEQ ID NO: 227305

SEQ ID NO: 581910 - RNA, 65 nt, Homo Sapiens; identical to SEQ ID NO: 58842

SEQ ID NO: 581911 - RNA, 65 nt, Homo Sapiens; identical to SEQ ID NO: 58843

SEQ ID NO: 581912 - RNA, 65 nt, Homo Sapiens; identical to SEQ ID NO: 227308

SEQ ID NO: 581913 - RNA, 65 nt, Homo Sapiens; identical to SEQ ID NO: 227309

SEQ ID NO: 581914 - RNA, 65 nt, Homo Sapiens; identical to SEQ ID NO: 227310

SEQ ID NO: 581915 - RNA, 65 nt, Homo Sapiens; identical to SEQ ID NO: 58844

SEQ ID NO: 581916 - RNA, 65 nt, Homo Sapiens; identical to SEQ ID NO: 58845

SEQ ID NO: 581917 - RNA, 65 nt, Homo Sapiens; identical to SEQ ID NO: 227313

SEQ ID NO: 581918 - RNA, 65 nt, Homo Sapiens; identical to SEQ ID NO: 227314

SEQ ID NO: 581919 - RNA, 65 nt, Homo Sapiens; identical to SEQ ID NO: 227315

SEQ ID NO: 581920 - RNA, 65 nt, Homo Sapiens; identical to SEQ ID NO: 227316

SEQ ID NO: 581921 - RNA, 65 nt, Homo Sapiens; identical to SEQ ID NO: 227317

SEQ ID NO: 581922 - RNA, 65 nt, Homo Sapiens; identical to SEQ ID NO: 227318

SEQ ID NO: 581923 - RNA, 65 nt, Homo Sapiens; identical to SEQ ID NO: 227319

SEQ ID NO: 581924 - RNA, 65 nt, Homo Sapiens; identical to SEQ ID NO: 227320

SEQ ID NO: 581925 - RNA, 65 nt, Homo Sapiens; identical to SEQ ID NO: 227321

SEQ ID NO: 581926 - RNA, 65 nt, Homo Sapiens; identical to SEQ ID NO: 58846

SEQ ID NO: 581927 - RNA, 65 nt, Homo Sapiens; identical to SEQ ID NO: 58847

SEQ ID NO: 581928 - RNA, 65 nt, Homo Sapiens; identical to SEQ ID NO: 227324

SEQ ID NO: 581929 - RNA, 65 nt, Homo Sapiens; identical to SEQ ID NO: 227325

SEQ ID NO: 581930 - RNA, 65 nt, Homo Sapiens; identical to SEQ ID NO: 227326

SEQ ID NO: 581931 - RNA, 65 nt, Homo Sapiens; identical to SEQ ID NO: 227327

SEQ ID NO: 581932 - RNA, 65 nt, Homo Sapiens; identical to SEQ ID NO: 227328

SEQ ID NO: 581933 - RNA, 65 nt, Homo Sapiens; identical to SEQ ID NO: 227329

SEQ ID NO: 581934 - RNA, 56 nt, Homo Sapiens; identical to SEQ ID NO: 227330

SEQ ID NO: 581935 - RNA, 65 nt, Homo Sapiens; identical to SEQ ID NO: 227331

SEQ ID NO: 581936 - RNA, 65 nt, Homo Sapiens; identical to SEQ ID NO: 227332

SEQ ID NO: 581937 - RNA, 65 nt, Homo Sapiens; identical to SEQ ID NO: 227333

SEQ ID NO: 581938 - RNA, 65 nt, Homo Sapiens; identical to SEQ ID NO: 227334

SEQ ID NO: 581939 - RNA, 65 nt, Homo Sapiens; identical to SEQ ID NO: 227335

SEQ ID NO: 581940 - RNA, 65 nt, Homo Sapiens; identical to SEQ ID NO: 227336

SEQ ID NO: 581941 - RNA, 65 nt, Homo Sapiens; identical to SEQ ID NO: 227337

SEQ ID NO: 581942 - RNA, 65 nt, Homo Sapiens; identical to SEQ ID NO: 227338

SEQ ID NO: 581943 - RNA, 65 nt, Homo Sapiens; identical to SEQ ID NO: 227339

SEQ ID NO: 581944 - RNA, 65 nt, Homo Sapiens; identical to SEQ ID NO: 227340

SEQ ID NO: 581945 - RNA, 65 nt, Homo Sapiens; identical to SEQ ID NO: 227341

SEQ ID NO: 581946 - RNA, 65 nt, Homo Sapiens; identical to SEQ ID NO: 227342

SEQ ID NO: 581947 - RNA, 65 nt, Homo Sapiens; identical to SEQ ID NO: 227343

SEQ ID NO: 581948 - RNA, 65 nt, Homo Sapiens; identical to SEQ ID NO: 227344

SEQ ID NO: 581949 - RNA, 65 nt, Homo Sapiens; identical to SEQ ID NO: 227345

SEQ ID NO: 581950 - RNA, 65 nt, Homo Sapiens; identical to SEQ ID NO: 227346

SEQ ID NO: 581951 - RNA, 65 nt, Homo Sapiens; identical to SEQ ID NO: 227347

SEQ ID NO: 581952 - RNA, 65 nt, Homo Sapiens; identical to SEQ ID NO: 227348

SEQ ID NO: 581953 - RNA, 65 nt, Homo Sapiens; identical to SEQ ID NO: 227349

SEQ ID NO: 581954 - RNA, 65 nt, Homo Sapiens; identical to SEQ ID NO: 227350

SEQ ID NO: 581955 - RNA, 65 nt, Homo Sapiens; identical to SEQ ID NO: 58848

SEQ ID NO: 581956 - RNA, 65 nt, Homo Sapiens; identical to SEQ ID NO: 58849

SEQ ID NO: 581957 - RNA, 65 nt, Homo Sapiens; identical to SEQ ID NO: 227353

SEQ ID NO: 581958 - RNA, 65 nt, Homo Sapiens; identical to SEQ ID NO: 227354

SEQ ID NO: 581959 - RNA, 65 nt, Homo Sapiens; identical to SEQ ID NO: 227355

SEQ ID NO: 581960 - RNA, 65 nt, Homo Sapiens; identical to SEQ ID NO: 227356

SEQ ID NO: 581961 - RNA, 65 nt, Homo Sapiens; identical to SEQ ID NO: 227357

SEQ ID NO: 581962 - RNA, 65 nt, Homo Sapiens; identical to SEQ ID NO: 227358

SEQ ID NO: 581963 - RNA, 65 nt, Homo Sapiens; identical to SEQ ID NO: 227359

SEQ ID NO: 581964 - RNA, 65 nt, Homo Sapiens; identical to SEQ ID NO: 227360

SEQ ID NO: 581965 - RNA, 65 nt, Homo Sapiens; identical to SEQ ID NO: 227361

SEQ ID NO: 581966 - RNA, 65 nt, Homo Sapiens; identical to SEQ ID NO: 227362

SEQ ID NO: 581967 - RNA, 65 nt, Homo Sapiens; identical to SEQ ID NO: 227363

SEQ ID NO: 581968 - RNA, 65 nt, Homo Sapiens; identical to SEQ ID NO: 227364

SEQ ID NO: 581969 - RNA, 65 nt, Homo Sapiens; identical to SEQ ID NO: 227365

SEQ ID NO: 581970 - RNA, 65 nt, Homo Sapiens; identical to SEQ ID NO: 227366

SEQ ID NO: 581971 - RNA, 65 nt, Homo Sapiens; identical to SEQ ID NO: 227367

SEQ ID NO: 581972 - RNA, 65 nt, Homo Sapiens; identical to SEQ ID NO: 227368

SEQ ID NO: 581973 - RNA, 65 nt, Homo Sapiens; identical to SEQ ID NO: 227369

SEQ ID NO: 581974 - RNA, 65 nt, Homo Sapiens; identical to SEQ ID NO: 227370

SEQ ID NO: 581975 - RNA, 65 nt, Homo Sapiens; identical to SEQ ID NO: 227371

SEQ ID NO: 581976 - RNA, 65 nt, Homo Sapiens; identical to SEQ ID NO: 227372

SEQ ID NO: 581977 - RNA, 65 nt, Homo Sapiens; identical to SEQ ID NO: 227373

SEQ ID NO: 581978 - RNA, 65 nt, Homo Sapiens; identical to SEQ ID NO: 227374

SEQ ID NO: 581979 - RNA, 65 nt, Homo Sapiens; identical to SEQ ID NO: 227375

SEQ ID NO: 581980 - RNA, 57 nt, Homo Sapiens; identical to SEQ ID NO: 227376

SEQ ID NO: 581981 - RNA, 65 nt, Homo Sapiens; identical to SEQ ID NO: 227377

SEQ ID NO: 581982 - RNA, 65 nt, Homo Sapiens; identical to SEQ ID NO: 227378

SEQ ID NO: 581983 - RNA, 65 nt, Homo Sapiens; identical to SEQ ID NO: 58850

SEQ ID NO: 581984 - RNA, 65 nt, Homo Sapiens; identical to SEQ ID NO: 58851

SEQ ID NO: 581985 - RNA, 65 nt, Homo Sapiens; identical to SEQ ID NO: 227381

SEQ ID NO: 581986 - RNA, 65 nt, Homo Sapiens; identical to SEQ ID NO: 227382

SEQ ID NO: 581987 - RNA, 65 nt, Homo Sapiens; identical to SEQ ID NO: 227383

SEQ ID NO: 581988 - RNA, 65 nt, Homo Sapiens; identical to SEQ ID NO: 227384

SEQ ID NO: 581989 - RNA, 65 nt, Homo Sapiens; identical to SEQ ID NO: 227385

SEQ ID NO: 581990 - RNA, 65 nt, Homo Sapiens; identical to SEQ ID NO: 227386

SEQ ID NO: 581991 - RNA, 65 nt, Homo Sapiens; identical to SEQ ID NO: 227387

SEQ ID NO: 581992 - RNA, 65 nt, Homo Sapiens; identical to SEQ ID NO: 227388

SEQ ID NO: 581993 - RNA, 65 nt, Homo Sapiens; identical to SEQ ID NO: 227389

SEQ ID NO: 581994 - RNA, 65 nt, Homo Sapiens; identical to SEQ ID NO: 227390

SEQ ID NO: 581995 - RNA, 65 nt, Homo Sapiens; identical to SEQ ID NO: 227391

SEQ ID NO: 581996 - RNA, 65 nt, Homo Sapiens; identical to SEQ ID NO: 227392

SEQ ID NO: 581997 - RNA, 65 nt, Homo Sapiens; identical to SEQ ID NO: 227393

SEQ ID NO: 581998 - RNA, 65 nt, Homo Sapiens; identical to SEQ ID NO: 227394

SEQ ID NO: 581999 - RNA, 65 nt, Homo Sapiens; identical to SEQ ID NO: 227395

SEQ ID NO: 582000 - RNA, 65 nt, Homo Sapiens; identical to SEQ ID NO: 227396

SEQ ID NO: 582001 - RNA, 65 nt, Homo Sapiens; identical to SEQ ID NO: 227397

SEQ ID NO: 582002 - RNA, 65 nt, Homo Sapiens; identical to SEQ ID NO: 227398

SEQ ID NO: 582003 - RNA, 65 nt, Homo Sapiens; identical to SEQ ID NO: 227399

SEQ ID NO: 582004 - RNA, 65 nt, Homo Sapiens; identical to SEQ ID NO: 227400

SEQ ID NO: 582005 - RNA, 65 nt, Homo Sapiens; identical to SEQ ID NO: 227401

SEQ ID NO: 582006 - RNA, 65 nt, Homo Sapiens; identical to SEQ ID NO: 227402

SEQ ID NO: 582007 - RNA, 65 nt, Homo Sapiens; identical to SEQ ID NO: 227403

SEQ ID NO: 582008 - RNA, 65 nt, Homo Sapiens; identical to SEQ ID NO: 227404

SEQ ID NO: 582009 - RNA, 65 nt, Homo Sapiens; identical to SEQ ID NO: 227405

SEQ ID NO: 582010 - RNA, 65 nt, Homo Sapiens; identical to SEQ ID NO: 227406

SEQ ID NO: 582011 - RNA, 65 nt, Homo Sapiens; identical to SEQ ID NO: 227407

SEQ ID NO: 582012 - RNA, 65 nt, Homo Sapiens; identical to SEQ ID NO: 227408

SEQ ID NO: 582013 - RNA, 65 nt, Homo Sapiens; identical to SEQ ID NO: 227409

SEQ ID NO: 582014 - RNA, 65 nt, Homo Sapiens; identical to SEQ ID NO: 227410

SEQ ID NO: 582015 - RNA, 65 nt, Homo Sapiens; identical to SEQ ID NO: 227411

SEQ ID NO: 582016 - RNA, 65 nt, Homo Sapiens; identical to SEQ ID NO: 227412

SEQ ID NO: 582017 - RNA, 65 nt, Homo Sapiens; identical to SEQ ID NO: 227413

SEQ ID NO: 582018 - RNA, 65 nt, Homo Sapiens; identical to SEQ ID NO: 227414

SEQ ID NO: 582019 - RNA, 65 nt, Homo Sapiens; identical to SEQ ID NO: 227415

SEQ ID NO: 582020 - RNA, 65 nt, Homo Sapiens; identical to SEQ ID NO: 227416

SEQ ID NO: 582021 - RNA, 65 nt, Homo Sapiens; identical to SEQ ID NO: 227417

SEQ ID NO: 582022 - RNA, 65 nt, Homo Sapiens; identical to SEQ ID NO: 227418

SEQ ID NO: 582023 - RNA, 65 nt, Homo Sapiens; identical to SEQ ID NO: 227419

SEQ ID NO: 582024 - RNA, 65 nt, Homo Sapiens; identical to SEQ ID NO: 227420

SEQ ID NO: 582025 - RNA, 65 nt, Homo Sapiens; identical to SEQ ID NO: 227421

SEQ ID NO: 582026 - RNA, 65 nt, Homo Sapiens; identical to SEQ ID NO: 227422

SEQ ID NO: 582027 - RNA, 65 nt, Homo Sapiens; identical to SEQ ID NO: 58852

SEQ ID NO: 582028 - RNA, 65 nt, Homo Sapiens; identical to SEQ ID NO: 58853

SEQ ID NO: 582029 - RNA, 65 nt, Homo Sapiens; identical to SEQ ID NO: 58854

SEQ ID NO: 582030 - RNA, 65 nt, Homo Sapiens; identical to SEQ ID NO: 58855

SEQ ID NO: 582031 - RNA, 65 nt, Homo Sapiens; identical to SEQ ID NO: 227427

SEQ ID NO: 582032 - RNA, 65 nt, Homo Sapiens; identical to SEQ ID NO: 227428

SEQ ID NO: 582033 - RNA, 65 nt, Homo Sapiens; identical to SEQ ID NO: 227429

SEQ ID NO: 582034 - RNA, 57 nt, Homo Sapiens; identical to SEQ ID NO: 227430

SEQ ID NO: 582035 - RNA, 65 nt, Homo Sapiens; identical to SEQ ID NO: 227431

SEQ ID NO: 582036 - RNA, 65 nt, Homo Sapiens; identical to SEQ ID NO: 227432

SEQ ID NO: 582037 - RNA, 65 nt, Homo Sapiens; identical to SEQ ID NO: 227433

SEQ ID NO: 582038 - RNA, 65 nt, Homo Sapiens; identical to SEQ ID NO: 227434

SEQ ID NO: 582039 - RNA, 65 nt, Homo Sapiens; identical to SEQ ID NO: 227435

SEQ ID NO: 582040 - RNA, 65 nt, Homo Sapiens; identical to SEQ ID NO: 227436

SEQ ID NO: 582041 - RNA, 65 nt, Homo Sapiens; identical to SEQ ID NO: 227437

SEQ ID NO: 582042 - RNA, 65 nt, Homo Sapiens; identical to SEQ ID NO: 58856

SEQ ID NO: 582043 - RNA, 65 nt, Homo Sapiens; identical to SEQ ID NO: 58857

SEQ ID NO: 582044 - RNA, 65 nt, Homo Sapiens; identical to SEQ ID NO: 58858

SEQ ID NO: 582045 - RNA, 65 nt, Homo Sapiens; identical to SEQ ID NO: 58859

SEQ ID NO: 582046 - RNA, 65 nt, Homo Sapiens; identical to SEQ ID NO: 227442

SEQ ID NO: 582047 - RNA, 65 nt, Homo Sapiens; identical to SEQ ID NO: 227443

SEQ ID NO: 582048 - RNA, 65 nt, Homo Sapiens; identical to SEQ ID NO: 227444

SEQ ID NO: 582049 - RNA, 65 nt, Homo Sapiens; identical to SEQ ID NO: 227445

SEQ ID NO: 582050 - RNA, 65 nt, Homo Sapiens; identical to SEQ ID NO: 227446

SEQ ID NO: 582051 - RNA, 65 nt, Homo Sapiens; identical to SEQ ID NO: 227447

SEQ ID NO: 582052 - RNA, 65 nt, Homo Sapiens; identical to SEQ ID NO: 227448

SEQ ID NO: 582053 - RNA, 65 nt, Homo Sapiens; identical to SEQ ID NO: 58860

SEQ ID NO: 582054 - RNA, 65 nt, Homo Sapiens; identical to SEQ ID NO: 58861

SEQ ID NO: 582055 - RNA, 65 nt, Homo Sapiens; identical to SEQ ID NO: 227451

SEQ ID NO: 582056 - RNA, 65 nt, Homo Sapiens; identical to SEQ ID NO: 227452

SEQ ID NO: 582057 - RNA, 65 nt, Homo Sapiens; identical to SEQ ID NO: 227453

SEQ ID NO: 582058 - RNA, 65 nt, Homo Sapiens; identical to SEQ ID NO: 227454

SEQ ID NO: 582059 - RNA, 65 nt, Homo Sapiens; identical to SEQ ID NO: 227455

SEQ ID NO: 582060 - RNA, 65 nt, Homo Sapiens; identical to SEQ ID NO: 227456

SEQ ID NO: 582061 - RNA, 65 nt, Homo Sapiens; identical to SEQ ID NO: 227457

SEQ ID NO: 582062 - RNA, 65 nt, Homo Sapiens; identical to SEQ ID NO: 227458

SEQ ID NO: 582063 - RNA, 65 nt, Homo Sapiens; identical to SEQ ID NO: 227459

SEQ ID NO: 582064 - RNA, 65 nt, Homo Sapiens; identical to SEQ ID NO: 227460

SEQ ID NO: 582065 - RNA, 65 nt, Homo Sapiens; identical to SEQ ID NO: 227461

SEQ ID NO: 582066 - RNA, 65 nt, Homo Sapiens; identical to SEQ ID NO: 227462

SEQ ID NO: 582067 - RNA, 65 nt, Homo Sapiens; identical to SEQ ID NO: 227463

SEQ ID NO: 582068 - RNA, 65 nt, Homo Sapiens; identical to SEQ ID NO: 227464

SEQ ID NO: 582069 - RNA, 65 nt, Homo Sapiens; identical to SEQ ID NO: 227465

SEQ ID NO: 582070 - RNA, 65 nt, Homo Sapiens; identical to SEQ ID NO: 58862

SEQ ID NO: 582071 - RNA, 65 nt, Homo Sapiens; identical to SEQ ID NO: 58863

SEQ ID NO: 582072 - RNA, 65 nt, Homo Sapiens; identical to SEQ ID NO: 227468

SEQ ID NO: 582073 - RNA, 65 nt, Homo Sapiens; identical to SEQ ID NO: 227469

SEQ ID NO: 582074 - RNA, 65 nt, Homo Sapiens; identical to SEQ ID NO: 227470

SEQ ID NO: 582075 - RNA, 65 nt, Homo Sapiens; identical to SEQ ID NO: 227471

SEQ ID NO: 582076 - RNA, 65 nt, Homo Sapiens; identical to SEQ ID NO: 227472

SEQ ID NO: 582077 - RNA, 65 nt, Homo Sapiens; identical to SEQ ID NO: 227473

SEQ ID NO: 582078 - RNA, 65 nt, Homo Sapiens; identical to SEQ ID NO: 227474

SEQ ID NO: 582079 - RNA, 65 nt, Homo Sapiens; identical to SEQ ID NO: 227475

SEQ ID NO: 582080 - RNA, 65 nt, Homo Sapiens; identical to SEQ ID NO: 227476

SEQ ID NO: 582081 - RNA, 65 nt, Homo Sapiens; identical to SEQ ID NO: 227477

SEQ ID NO: 582082 - RNA, 65 nt, Homo Sapiens; identical to SEQ ID NO: 227478

SEQ ID NO: 582083 - RNA, 65 nt, Homo Sapiens; identical to SEQ ID NO: 227479

SEQ ID NO: 582084 - RNA, 65 nt, Homo Sapiens; identical to SEQ ID NO: 58864

SEQ ID NO: 582085 - RNA, 65 nt, Homo Sapiens; identical to SEQ ID NO: 58865

SEQ ID NO: 582086 - RNA, 65 nt, Homo Sapiens; identical to SEQ ID NO: 227482

SEQ ID NO: 582087 - RNA, 65 nt, Homo Sapiens; identical to SEQ ID NO: 227483

SEQ ID NO: 582088 - RNA, 65 nt, Homo Sapiens; identical to SEQ ID NO: 227484

SEQ ID NO: 582089 - RNA, 65 nt, Homo Sapiens; identical to SEQ ID NO: 227485

SEQ ID NO: 582090 - RNA, 65 nt, Homo Sapiens; identical to SEQ ID NO: 227486

SEQ ID NO: 582091 - RNA, 65 nt, Homo Sapiens; identical to SEQ ID NO: 227487

SEQ ID NO: 582092 - RNA, 65 nt, Homo Sapiens; identical to SEQ ID NO: 227488

SEQ ID NO: 582093 - RNA, 65 nt, Homo Sapiens; identical to SEQ ID NO: 227489

SEQ ID NO: 582094 - RNA, 65 nt, Homo Sapiens; identical to SEQ ID NO: 227490

SEQ ID NO: 582095 - RNA, 65 nt, Homo Sapiens; identical to SEQ ID NO: 58866

SEQ ID NO: 582096 - RNA, 65 nt, Homo Sapiens; identical to SEQ ID NO: 58867

SEQ ID NO: 582097 - RNA, 65 nt, Homo Sapiens; identical to SEQ ID NO: 227493

SEQ ID NO: 582098 - RNA, 65 nt, Homo Sapiens; identical to SEQ ID NO: 227494

SEQ ID NO: 582099 - RNA, 65 nt, Homo Sapiens; identical to SEQ ID NO: 227495

SEQ ID NO: 582100 - RNA, 58 nt, Homo Sapiens; identical to SEQ ID NO: 227496

SEQ ID NO: 582101 - RNA, 65 nt, Homo Sapiens; identical to SEQ ID NO: 227497

SEQ ID NO: 582102 - RNA, 65 nt, Homo Sapiens; identical to SEQ ID NO: 227498

SEQ ID NO: 582103 - RNA, 65 nt, Homo Sapiens; identical to SEQ ID NO: 227499

SEQ ID NO: 582104 - RNA, 65 nt, Homo Sapiens; identical to SEQ ID NO: 227500

SEQ ID NO: 582105 - RNA, 65 nt, Homo Sapiens; identical to SEQ ID NO: 227501

SEQ ID NO: 582106 - RNA, 65 nt, Homo Sapiens; identical to SEQ ID NO: 227502

SEQ ID NO: 582107 - RNA, 65 nt, Homo Sapiens; identical to SEQ ID NO: 227503

SEQ ID NO: 582108 - RNA, 65 nt, Homo Sapiens; identical to SEQ ID NO: 227504

SEQ ID NO: 582109 - RNA, 65 nt, Homo Sapiens; identical to SEQ ID NO: 227505

SEQ ID NO: 582110 - RNA, 65 nt, Homo Sapiens; identical to SEQ ID NO: 58868

SEQ ID NO: 582111 - RNA, 65 nt, Homo Sapiens; identical to SEQ ID NO: 58869

SEQ ID NO: 582112 - RNA, 65 nt, Homo Sapiens; identical to SEQ ID NO: 227508

SEQ ID NO: 582113 - RNA, 65 nt, Homo Sapiens; identical to SEQ ID NO: 227509

SEQ ID NO: 582114 - RNA, 65 nt, Homo Sapiens; identical to SEQ ID NO: 227510

SEQ ID NO: 582115 - RNA, 65 nt, Homo Sapiens; identical to SEQ ID NO: 227511

SEQ ID NO: 582116 - RNA, 65 nt, Homo Sapiens; identical to SEQ ID NO: 227512

SEQ ID NO: 582117 - RNA, 65 nt, Homo Sapiens; identical to SEQ ID NO: 227513

SEQ ID NO: 582118 - RNA, 65 nt, Homo Sapiens; identical to SEQ ID NO: 227514

SEQ ID NO: 582119 - RNA, 65 nt, Homo Sapiens; identical to SEQ ID NO: 227515

SEQ ID NO: 582120 - RNA, 65 nt, Homo Sapiens; identical to SEQ ID NO: 227516

SEQ ID NO: 582121 - RNA, 65 nt, Homo Sapiens; identical to SEQ ID NO: 227517

SEQ ID NO: 582122 - RNA, 65 nt, Homo Sapiens; identical to SEQ ID NO: 58870

SEQ ID NO: 582123 - RNA, 65 nt, Homo Sapiens; identical to SEQ ID NO: 58871

SEQ ID NO: 582124 - RNA, 65 nt, Homo Sapiens; identical to SEQ ID NO: 227520

SEQ ID NO: 582125 - RNA, 65 nt, Homo Sapiens; identical to SEQ ID NO: 227521

SEQ ID NO: 582126 - RNA, 65 nt, Homo Sapiens; identical to SEQ ID NO: 227522

SEQ ID NO: 582127 - RNA, 65 nt, Homo Sapiens; identical to SEQ ID NO: 58872

SEQ ID NO: 582128 - RNA, 65 nt, Homo Sapiens; identical to SEQ ID NO: 58873

SEQ ID NO: 582129 - RNA, 65 nt, Homo Sapiens; identical to SEQ ID NO: 227525

SEQ ID NO: 582130 - RNA, 65 nt, Homo Sapiens; identical to SEQ ID NO: 227526

SEQ ID NO: 582131 - RNA, 65 nt, Homo Sapiens; identical to SEQ ID NO: 227527

SEQ ID NO: 582132 - RNA, 65 nt, Homo Sapiens; identical to SEQ ID NO: 227528

SEQ ID NO: 582133 - RNA, 65 nt, Homo Sapiens; identical to SEQ ID NO: 227529

SEQ ID NO: 582134 - RNA, 65 nt, Homo Sapiens; identical to SEQ ID NO: 227530

SEQ ID NO: 582135 - RNA, 65 nt, Homo Sapiens; identical to SEQ ID NO: 227531

SEQ ID NO: 582136 - RNA, 65 nt, Homo Sapiens; identical to SEQ ID NO: 227532

SEQ ID NO: 582137 - RNA, 65 nt, Homo Sapiens; identical to SEQ ID NO: 227533

SEQ ID NO: 582138 - RNA, 65 nt, Homo Sapiens; identical to SEQ ID NO: 227534

SEQ ID NO: 582139 - RNA, 65 nt, Homo Sapiens; identical to SEQ ID NO: 227535

SEQ ID NO: 582140 - RNA, 65 nt, Homo Sapiens; identical to SEQ ID NO: 227536

SEQ ID NO: 582141 - RNA, 65 nt, Homo Sapiens; identical to SEQ ID NO: 227537

SEQ ID NO: 582142 - RNA, 65 nt, Homo Sapiens; identical to SEQ ID NO: 227538

SEQ ID NO: 582143 - RNA, 65 nt, Homo Sapiens; identical to SEQ ID NO: 227539

SEQ ID NO: 582144 - RNA, 65 nt, Homo Sapiens; identical to SEQ ID NO: 227540

SEQ ID NO: 582145 - RNA, 65 nt, Homo Sapiens; identical to SEQ ID NO: 227541

SEQ ID NO: 582146 - RNA, 65 nt, Homo Sapiens; identical to SEQ ID NO: 227542

SEQ ID NO: 582147 - RNA, 65 nt, Homo Sapiens; identical to SEQ ID NO: 227543

SEQ ID NO: 582148 - RNA, 65 nt, Homo Sapiens; identical to SEQ ID NO: 227544

SEQ ID NO: 582149 - RNA, 65 nt, Homo Sapiens; identical to SEQ ID NO: 227545

SEQ ID NO: 582150 - RNA, 65 nt, Homo Sapiens; identical to SEQ ID NO: 227546

SEQ ID NO: 582151 - RNA, 65 nt, Homo Sapiens; identical to SEQ ID NO: 227547

SEQ ID NO: 582152 - RNA, 65 nt, Homo Sapiens; identical to SEQ ID NO: 227548

SEQ ID NO: 582153 - RNA, 65 nt, Homo Sapiens; identical to SEQ ID NO: 227549

SEQ ID NO: 582154 - RNA, 65 nt, Homo Sapiens; identical to SEQ ID NO: 58874

SEQ ID NO: 582155 - RNA, 65 nt, Homo Sapiens; identical to SEQ ID NO: 58875

SEQ ID NO: 582156 - RNA, 65 nt, Homo Sapiens; identical to SEQ ID NO: 227552

SEQ ID NO: 582157 - RNA, 65 nt, Homo Sapiens; identical to SEQ ID NO: 227553

SEQ ID NO: 582158 - RNA, 65 nt, Homo Sapiens; identical to SEQ ID NO: 227554

SEQ ID NO: 582159 - RNA, 65 nt, Homo Sapiens; identical to SEQ ID NO: 58876

SEQ ID NO: 582160 - RNA, 65 nt, Homo Sapiens; identical to SEQ ID NO: 58877

SEQ ID NO: 582161 - RNA, 65 nt, Homo Sapiens; identical to SEQ ID NO: 58878

SEQ ID NO: 582162 - RNA, 65 nt, Homo Sapiens; identical to SEQ ID NO: 58879

SEQ ID NO: 582163 - RNA, 65 nt, Homo Sapiens; identical to SEQ ID NO: 58880

SEQ ID NO: 582164 - RNA, 65 nt, Homo Sapiens; identical to SEQ ID NO: 58881

SEQ ID NO: 582165 - RNA, 65 nt, Homo Sapiens; identical to SEQ ID NO: 58882

SEQ ID NO: 582166 - RNA, 65 nt, Homo Sapiens; identical to SEQ ID NO: 58883

SEQ ID NO: 582167 - RNA, 65 nt, Homo Sapiens; identical to SEQ ID NO: 58884

SEQ ID NO: 582168 - RNA, 65 nt, Homo Sapiens; identical to SEQ ID NO: 58885

SEQ ID NO: 582169 - RNA, 65 nt, Homo Sapiens; identical to SEQ ID NO: 58886

SEQ ID NO: 582170 - RNA, 65 nt, Homo Sapiens; identical to SEQ ID NO: 227566

SEQ ID NO: 582171 - RNA, 65 nt, Homo Sapiens; identical to SEQ ID NO: 227567

SEQ ID NO: 582172 - RNA, 65 nt, Homo Sapiens; identical to SEQ ID NO: 58887

SEQ ID NO: 582173 - RNA, 65 nt, Homo Sapiens; identical to SEQ ID NO: 58888

SEQ ID NO: 582174 - RNA, 65 nt, Homo Sapiens; identical to SEQ ID NO: 227570

SEQ ID NO: 582175 - RNA, 59 nt, Homo Sapiens; identical to SEQ ID NO: 58889

SEQ ID NO: 582176 - RNA, 65 nt, Homo Sapiens; identical to SEQ ID NO: 58890

SEQ ID NO: 582177 - RNA, 65 nt, Homo Sapiens; identical to SEQ ID NO: 58891

SEQ ID NO: 582178 - RNA, 65 nt, Homo Sapiens; identical to SEQ ID NO: 227574

SEQ ID NO: 582179 - RNA, 65 nt, Homo Sapiens; identical to SEQ ID NO: 227575

SEQ ID NO: 582180 - RNA, 65 nt, Homo Sapiens; identical to SEQ ID NO: 227576

SEQ ID NO: 582181 - RNA, 65 nt, Homo Sapiens; identical to SEQ ID NO: 227577

SEQ ID NO: 582182 - RNA, 65 nt, Homo Sapiens; identical to SEQ ID NO: 227578

SEQ ID NO: 582183 - RNA, 65 nt, Homo Sapiens; identical to SEQ ID NO: 227579

SEQ ID NO: 582184 - RNA, 65 nt, Homo Sapiens; identical to SEQ ID NO: 227580

SEQ ID NO: 582185 - RNA, 65 nt, Homo Sapiens; identical to SEQ ID NO: 58892

SEQ ID NO: 582186 - RNA, 65 nt, Homo Sapiens; identical to SEQ ID NO: 58893

SEQ ID NO: 582187 - RNA, 60 nt, Homo Sapiens; identical to SEQ ID NO: 227583

SEQ ID NO: 582188 - RNA, 65 nt, Homo Sapiens; identical to SEQ ID NO: 227584

SEQ ID NO: 582189 - RNA, 65 nt, Homo Sapiens; identical to SEQ ID NO: 227585

SEQ ID NO: 582190 - RNA, 65 nt, Homo Sapiens; identical to SEQ ID NO: 58894

SEQ ID NO: 582191 - RNA, 65 nt, Homo Sapiens; identical to SEQ ID NO: 58895

SEQ ID NO: 582192 - RNA, 65 nt, Homo Sapiens; identical to SEQ ID NO: 58896

SEQ ID NO: 582193 - RNA, 65 nt, Homo Sapiens; identical to SEQ ID NO: 58897

SEQ ID NO: 582194 - RNA, 65 nt, Homo Sapiens; identical to SEQ ID NO: 58898

SEQ ID NO: 582195 - RNA, 65 nt, Homo Sapiens; identical to SEQ ID NO: 58899

SEQ ID NO: 582196 - RNA, 65 nt, Homo Sapiens; identical to SEQ ID NO: 58900

SEQ ID NO: 582197 - RNA, 65 nt, Homo Sapiens; identical to SEQ ID NO: 58901

SEQ ID NO: 582198 - RNA, 65 nt, Homo Sapiens; identical to SEQ ID NO: 58902

SEQ ID NO: 582199 - RNA, 65 nt, Homo Sapiens; identical to SEQ ID NO: 58903

SEQ ID NO: 582200 - RNA, 65 nt, Homo Sapiens; identical to SEQ ID NO: 58904

SEQ ID NO: 582201 - RNA, 65 nt, Homo Sapiens; identical to SEQ ID NO: 58905

SEQ ID NO: 582202 - RNA, 65 nt, Homo Sapiens; identical to SEQ ID NO: 58906

SEQ ID NO: 582203 - RNA, 65 nt, Homo Sapiens; identical to SEQ ID NO: 58907

SEQ ID NO: 582204 - RNA, 65 nt, Homo Sapiens; identical to SEQ ID NO: 58908

SEQ ID NO: 582205 - RNA, 65 nt, Homo Sapiens; identical to SEQ ID NO: 227601

SEQ ID NO: 582206 - RNA, 65 nt, Homo Sapiens; identical to SEQ ID NO: 227602

SEQ ID NO: 582207 - RNA, 65 nt, Homo Sapiens; identical to SEQ ID NO: 227603

SEQ ID NO: 582208 - RNA, 65 nt, Homo Sapiens; identical to SEQ ID NO: 58909

SEQ ID NO: 582209 - RNA, 65 nt, Homo Sapiens; identical to SEQ ID NO: 58910

SEQ ID NO: 582210 - RNA, 65 nt, Homo Sapiens; identical to SEQ ID NO: 227606

SEQ ID NO: 582211 - RNA, 65 nt, Homo Sapiens; identical to SEQ ID NO: 227607

SEQ ID NO: 582212 - RNA, 65 nt, Homo Sapiens; identical to SEQ ID NO: 58911

SEQ ID NO: 582213 - RNA, 65 nt, Homo Sapiens; identical to SEQ ID NO: 58912

SEQ ID NO: 582214 - RNA, 65 nt, Homo Sapiens; identical to SEQ ID NO: 58913

SEQ ID NO: 582215 - RNA, 65 nt, Homo Sapiens; identical to SEQ ID NO: 58914

SEQ ID NO: 582216 - RNA, 65 nt, Homo Sapiens; identical to SEQ ID NO: 58915

SEQ ID NO: 582217 - RNA, 65 nt, Homo Sapiens; identical to SEQ ID NO: 227613

SEQ ID NO: 582218 - RNA, 65 nt, Homo Sapiens; identical to SEQ ID NO: 227614

SEQ ID NO: 582219 - RNA, 65 nt, Homo Sapiens; identical to SEQ ID NO: 227615

SEQ ID NO: 582220 - RNA, 65 nt, Homo Sapiens; identical to SEQ ID NO: 227616

SEQ ID NO: 582221 - RNA, 65 nt, Homo Sapiens; identical to SEQ ID NO: 227617

SEQ ID NO: 582222 - RNA, 65 nt, Homo Sapiens; identical to SEQ ID NO: 227618

SEQ ID NO: 582223 - RNA, 65 nt, Homo Sapiens; identical to SEQ ID NO: 227619

SEQ ID NO: 582224 - RNA, 65 nt, Homo Sapiens; identical to SEQ ID NO: 227620

SEQ ID NO: 582225 - RNA, 65 nt, Homo Sapiens; identical to SEQ ID NO: 227621

SEQ ID NO: 582226 - RNA, 65 nt, Homo Sapiens; identical to SEQ ID NO: 58916

SEQ ID NO: 582227 - RNA, 65 nt, Homo Sapiens; identical to SEQ ID NO: 58917

SEQ ID NO: 582228 - RNA, 65 nt, Homo Sapiens; identical to SEQ ID NO: 227624

SEQ ID NO: 582229 - RNA, 65 nt, Homo Sapiens; identical to SEQ ID NO: 227625

SEQ ID NO: 582230 - RNA, 65 nt, Homo Sapiens; identical to SEQ ID NO: 227626

SEQ ID NO: 582231 - RNA, 65 nt, Homo Sapiens; identical to SEQ ID NO: 227627

SEQ ID NO: 582232 - RNA, 65 nt, Homo Sapiens; identical to SEQ ID NO: 227628

SEQ ID NO: 582233 - RNA, 65 nt, Homo Sapiens; identical to SEQ ID NO: 227629

SEQ ID NO: 582234 - RNA, 65 nt, Homo Sapiens; identical to SEQ ID NO: 227630

SEQ ID NO: 582235 - RNA, 65 nt, Homo Sapiens; identical to SEQ ID NO: 227631

SEQ ID NO: 582236 - RNA, 65 nt, Homo Sapiens; identical to SEQ ID NO: 58918

SEQ ID NO: 582237 - RNA, 65 nt, Homo Sapiens; identical to SEQ ID NO: 58919

SEQ ID NO: 582238 - RNA, 65 nt, Homo Sapiens; identical to SEQ ID NO: 227634

SEQ ID NO: 582239 - RNA, 65 nt, Homo Sapiens; identical to SEQ ID NO: 227635

SEQ ID NO: 582240 - RNA, 65 nt, Homo Sapiens; identical to SEQ ID NO: 227636

SEQ ID NO: 582241 - RNA, 65 nt, Homo Sapiens; identical to SEQ ID NO: 227637

SEQ ID NO: 582242 - RNA, 65 nt, Homo Sapiens; identical to SEQ ID NO: 227638

SEQ ID NO: 582243 - RNA, 65 nt, Homo Sapiens; identical to SEQ ID NO: 227639

SEQ ID NO: 582244 - RNA, 65 nt, Homo Sapiens; identical to SEQ ID NO: 227640

SEQ ID NO: 582245 - RNA, 65 nt, Homo Sapiens; identical to SEQ ID NO: 58920

SEQ ID NO: 582246 - RNA, 65 nt, Homo Sapiens; identical to SEQ ID NO: 58921

SEQ ID NO: 582247 - RNA, 65 nt, Homo Sapiens; identical to SEQ ID NO: 227643

SEQ ID NO: 582248 - RNA, 65 nt, Homo Sapiens; identical to SEQ ID NO: 227644

SEQ ID NO: 582249 - RNA, 65 nt, Homo Sapiens; identical to SEQ ID NO: 227645

SEQ ID NO: 582250 - RNA, 65 nt, Homo Sapiens; identical to SEQ ID NO: 227646

SEQ ID NO: 582251 - RNA, 65 nt, Homo Sapiens; identical to SEQ ID NO: 227647

SEQ ID NO: 582252 - RNA, 65 nt, Homo Sapiens; identical to SEQ ID NO: 58922

SEQ ID NO: 582253 - RNA, 65 nt, Homo Sapiens; identical to SEQ ID NO: 58923

SEQ ID NO: 582254 - RNA, 65 nt, Homo Sapiens; identical to SEQ ID NO: 227650

SEQ ID NO: 582255 - RNA, 65 nt, Homo Sapiens; identical to SEQ ID NO: 58924

SEQ ID NO: 582256 - RNA, 65 nt, Homo Sapiens; identical to SEQ ID NO: 58925

SEQ ID NO: 582257 - RNA, 65 nt, Homo Sapiens; identical to SEQ ID NO: 227653

SEQ ID NO: 582258 - RNA, 65 nt, Homo Sapiens; identical to SEQ ID NO: 227654

SEQ ID NO: 582259 - RNA, 65 nt, Homo Sapiens; identical to SEQ ID NO: 227655

SEQ ID NO: 582260 - RNA, 65 nt, Homo Sapiens; identical to SEQ ID NO: 227656

SEQ ID NO: 582261 - RNA, 65 nt, Homo Sapiens; identical to SEQ ID NO: 227657

SEQ ID NO: 582262 - RNA, 65 nt, Homo Sapiens; identical to SEQ ID NO: 227658

SEQ ID NO: 582263 - RNA, 65 nt, Homo Sapiens; identical to SEQ ID NO: 227659

SEQ ID NO: 582264 - RNA, 65 nt, Homo Sapiens; identical to SEQ ID NO: 227660

SEQ ID NO: 582265 - RNA, 65 nt, Homo Sapiens; identical to SEQ ID NO: 227661

SEQ ID NO: 582266 - RNA, 65 nt, Homo Sapiens; identical to SEQ ID NO: 227662

SEQ ID NO: 582267 - RNA, 65 nt, Homo Sapiens; identical to SEQ ID NO: 227663

SEQ ID NO: 582268 - RNA, 65 nt, Homo Sapiens; identical to SEQ ID NO: 227664

SEQ ID NO: 582269 - RNA, 65 nt, Homo Sapiens; identical to SEQ ID NO: 227665

SEQ ID NO: 582270 - RNA, 65 nt, Homo Sapiens; identical to SEQ ID NO: 227666

SEQ ID NO: 582271 - RNA, 65 nt, Homo Sapiens; identical to SEQ ID NO: 227667

SEQ ID NO: 582272 - RNA, 65 nt, Homo Sapiens; identical to SEQ ID NO: 227668

SEQ ID NO: 582273 - RNA, 65 nt, Homo Sapiens; identical to SEQ ID NO: 227669

SEQ ID NO: 582274 - RNA, 65 nt, Homo Sapiens; identical to SEQ ID NO: 227670

SEQ ID NO: 582275 - RNA, 65 nt, Homo Sapiens; identical to SEQ ID NO: 227671

SEQ ID NO: 582276 - RNA, 65 nt, Homo Sapiens; identical to SEQ ID NO: 227672

SEQ ID NO: 582277 - RNA, 64 nt, Homo Sapiens
gcccccugguggugaguguaaagaagacuuugccucucacaacuacauguauguguggcauuuu

SEQ ID NO: 582278 - RNA, 64 nt, Homo Sapiens
gaggacaagaagucuauuguuuggacuguguuugucucacaaucaccacaaaauaaaaguguag

SEQ ID NO: 582279 - RNA, 64 nt, Homo Sapiens
cuugaacauuuuaaucuuuuaaucuccccuuuccucucacaauaucugaacccauucuauuuug

SEQ ID NO: 582280 - RNA, 64 nt, Homo Sapiens
uuauuaucuacuuauaauuaccggagaauauuucucucacaauaggccaucacacuggccuguu

SEQ ID NO: 582281 - RNA, 64 nt, Homo Sapiens
gaucgcuaucuagcaacccuaaacugacaguaaaucucacaaauauuacacaguuaaugccaca

SEQ ID NO: 582282 - RNA, 64 nt, Homo Sapiens
uggaaaucacauuuacaaaagauuaugaagugacucucacaagaaagccaauggaaaaaucuug

SEQ ID NO: 582283 - RNA, 64 nt, Homo Sapiens
gauaugguauccuuuugagugagguauauacucaucucacaagugaagugccuacugauauuac

SEQ ID NO: 582284 - RNA, 64 nt, Homo Sapiens
aguucuguuaggaauaaaagaugaaacuauuguaucucacaaaaaaucuuauuucagaauggaa

SEQ ID NO: 582285 - RNA, 64 nt, Homo Sapiens
aguuguaaugcuguagcaugcuuguaggagcuccucucacaaguacugggacaaguuuacugcu

SEQ ID NO: 582286 - RNA, 64 nt, Homo Sapiens
gucuguauuaauuucacauaaguuuugcacaaccucucacaaaugccauuuuuguaaauacagu

SEQ ID NO: 582287 - RNA, 64 nt, Homo Sapiens
gcaucuggcugacacuuaccugcuucugguuuucgaagacuauuuaguggaaccuuguagagga

SEQ ID NO: 582288 - RNA, 64 nt, Homo Sapiens
agagaauuccuauuuaaaaaaauagaaaaauagugaagacuacacaagaggaaauagggcuuuu

SEQ ID NO: 582289 - RNA, 64 nt, Homo Sapiens
uacauaggaauuuucuuucuuaaaaaacaguaaugaagacuauaucuccuuucccagcacugaa

SEQ ID NO: 582290 - RNA, 64 nt, Homo Sapiens
caagaaaaagcaccucucuucaccugaaagcuuugaagacuagagacacgcuuuacacguuuua

SEQ ID NO: 582291 - RNA, 64 nt, Homo Sapiens
gggaaggaugucugggaugugaagaggcaaggcagaaauggaugaugaacaucaaaaacuguca

SEQ ID NO: 582292 - RNA, 64 nt, Homo Sapiens
guuuacuauuuuugaaguuuacauuguuacauaugaaauggaaacauuauuuugaaacguuguc

SEQ ID NO: 582293 - RNA, 64 nt, Homo Sapiens
uucccccucaccuucaauaagguuuuucaaaaaggaaauggaaacuuuuuaaccaauuugugaa

SEQ ID NO: 582294 - RNA, 64 nt, Homo Sapiens
uuuaaauuauuuuuaauaccaaaagaguucuuuugaaauggaacugauuaaaagggcagagggu

SEQ ID NO: 582295 - RNA, 64 nt, Homo Sapiens
gaaacaagcccucccaugccuguacaccagauuggaaauggaguguuauagauaaggaauuucc

SEQ ID NO: 582296 - RNA, 64 nt, Homo Sapiens
guuauagauaaggaauuucccaguuaacuggggggaaauggacaguuugaguuuguuggaaaag

SEQ ID NO: 582297 - RNA, 64 nt, Homo Sapiens
cuucucuagaaagcugccaagacagaggcagaaagaaauggaugauaguucugucaagcacacu

SEQ ID NO: 582298 - RNA, 64 nt, Homo Sapiens
ggaacgcauuggcuuuuuuuuucuuguuuugauagaaauggaauuaagcaaaaguaguuuuugu

SEQ ID NO: 582299 - RNA, 64 nt, Homo Sapiens
gauuguuccuuagagcuucuccuucugaugcuuugaaauggaagggaugaauugagcuccuggc

SEQ ID NO: 582300 - RNA, 64 nt, Homo Sapiens
uagugacucuuggauuacagaucuagaagaacaagaaauggaaagcguaagaggcaacagagcc

SEQ ID NO: 582301 - RNA, 64 nt, Homo Sapiens
ccauuccccuguugcucuccucauuaaaccaaaggaaauggaaguggcuugucuugggcuuucg

SEQ ID NO: 582302 - RNA, 64 nt, Homo Sapiens
auuucaggucuccacgucuggcccaguuuacagugaaauggagaugucuuucucuggacaacug

SEQ ID NO: 582303 - RNA, 64 nt, Homo Sapiens
auaagacccuguggagaaauucguuguucccacugaaauggacugacuguaacgauugacacca

SEQ ID NO: 582304 - RNA, 64 nt, Homo Sapiens
auuucuagagagucuccuuacucauuaauucaaugaaauggauugguaagaugucuugaaaaca

SEQ ID NO: 582305 - RNA, 64 nt, Homo Sapiens
cgcugcuuucauuuuucugaccuaauaauuacgggaaauggaaagucugggccagcaucaauaa

SEQ ID NO: 582306 - RNA, 64 nt, Homo Sapiens
gacuggugugaggcaaagugaaaaagggaugggggaaauggagauggcacgggcuccucagagc

SEQ ID NO: 582307 - RNA, 64 nt, Homo Sapiens
acuugguguccuuuuuucucccaaacuuuauuuagaaauggaaggaguucaauuuuuucuuguu

SEQ ID NO: 582308 - RNA, 64 nt, Homo Sapiens
uucuaaaaguuuucaucgccuugguaaagcuccagaaauggacaaugcuagugacugcacaaua

SEQ ID NO: 582309 - RNA, 64 nt, Homo Sapiens
cauuugagucucuuaauagcgcauauuaguugaugaaauggaguuuagaaguagaauugacagg

SEQ ID NO: 582310 - RNA, 64 nt, Homo Sapiens
agugaggaauggaggccauauguuuagagaaugagaaauggaacagucacuacaacugauuagu

SEQ ID NO: 582311 - RNA, 64 nt, Homo Sapiens
uccgguucuuuccaugucuuaguuggaugucccugaaauggacacaggcugugccauugugcca

SEQ ID NO: 582312 - RNA, 64 nt, Homo Sapiens
uuguauaaguagaaaauuacuuaauuucauacuagaaauggauggaugcugcaaguugaaaugg

SEQ ID NO: 582313 - RNA, 64 nt, Homo Sapiens
auuucauacuagaaauggauggaugcugcaaguugaaauggacuguccauugacguuccuaaug

SEQ ID NO: 582314 - RNA, 64 nt, Homo Sapiens
uaaaauauaugugcuuauuauuguuaguugcuuagaaauggaaauuuagguauucuaauguauu

SEQ ID NO: 582315 - RNA, 64 nt, Homo Sapiens
aggaaaaauagcuuuuaucaauuaaaugcuuuaagaaauggagaugaacauuuuuuucauaaaa

SEQ ID NO: 582316 - RNA, 64 nt, Homo Sapiens
augaugagaagccguugagcuuuguccauucaaggaaauggauuauuugucagcccgauuauuu

SEQ ID NO: 582317 - RNA, 64 nt, Homo Sapiens
aacacugccaucuucaaauuuaaauguaauuuaggaaauggaagcuuuuaauuuuaauuucuuu

SEQ ID NO: 582318 - RNA, 64 nt, Homo Sapiens
cugggcagugcugagucccugcaauagagcuaaugaaauggaagauuguacugaaggcucagca

SEQ ID NO: 582319 - RNA, 64 nt, Homo Sapiens
ccaaaauaaauuuuccaauuuuucugaaauccaagaaauggaaucuuuucuugacaggcacacc

SEQ ID NO: 582320 - RNA, 64 nt, Homo Sapiens
cuauucuauucugcugcccccagucuuucucugggaaauggaugaagcaugggaaauguaaagg

SEQ ID NO: 582321 - RNA, 64 nt, Homo Sapiens
uuuucccaggguggaaaauaauuaaagucaucacgaaauggaaguuaauagugaaugcuuuaaa

SEQ ID NO: 582322 - RNA, 64 nt, Homo Sapiens
ggcaaauaauggaacauaaauaaaaauuuaaaaagaaauggaauauacaccuaccauguaccca

SEQ ID NO: 582323 - RNA, 64 nt, Homo Sapiens
ggcacuucauauauucucauuaugcuuuguuuaagaaauggaauuaaauagcuuacagacaguc

SEQ ID NO: 582324 - RNA, 64 nt, Homo Sapiens
ggucucuuugauuuaaaauauaccuguuuguuaggaaauggaauaauggacuacuuuuguaacu

SEQ ID NO: 582325 - RNA, 64 nt, Homo Sapiens
aaauuuuguuaaauaggcaauaccaaagccuuaugaaauggauggaagugcugggaaucacuua

SEQ ID NO: 582326 - RNA, 64 nt, Homo Sapiens
uuaaaauauucuaaaauuuaaugcauucacugaagaaauggacauuaauucuaauaauuucaaa

SEQ ID NO: 582327 - RNA, 64 nt, Homo Sapiens
ucucacaccguaucuagggacaaauuccagcucugaaauggagugcaggauuuaaucuggggag

SEQ ID NO: 582328 - RNA, 64 nt, Homo Sapiens
aggcagagccugaggugguaggaggaggacccuggaaauggacugguuugagauugccccaggu

SEQ ID NO: 582329 - RNA, 64 nt, Homo Sapiens
ucccaaugguccugacuuugggcgcuggguauuggaaauggaugcaaaguacaauguguuuuuc

SEQ ID NO: 582330 - RNA, 64 nt, Homo Sapiens
acaccucuaugcaaauaaacuagaaaaucuagaagaaauggauaaauuccucaacacguacacc

SEQ ID NO: 582331 - RNA, 64 nt, Homo Sapiens
aaccacugcuuaacgaaauaaaagaggaugcaaagaaauggaagagcauuccaugcucaugggu

SEQ ID NO: 582332 - RNA, 64 nt, Homo Sapiens
uuuaaguguguguguguguucuuuguggaggagugaaauggagcuuuaaggaggugccucuguu

SEQ ID NO: 582333 - RNA, 64 nt, Homo Sapiens
cucaccauguuggucaggcuaauucuauuuaguagaaauggaguacgcgccaccacaccuggcu

SEQ ID NO: 582334 - RNA, 64 nt, Homo Sapiens
gcauuucuaaaucaucaauauuugcuugucuuugccccuagacucuagacuauguuaacuaguu

SEQ ID NO: 582335 - RNA, 64 nt, Homo Sapiens
aucuaugcuugcguuugaaacuacaacuugauaaccccuagaaagaagaggacaugaaaggaug

SEQ ID NO: 582336 - RNA, 64 nt, Homo Sapiens
ccaacugucugaccccgagguagaauugagucacccccuagauagaauuguccaguguggcccc

SEQ ID NO: 582337 - RNA, 64 nt, Homo Sapiens
ugagucacccccuagauaccauuguccaguguggccccuagaaucaacucuccacuuggaggga

SEQ ID NO: 582338 - RNA, 64 nt, Homo Sapiens
cuccagggggaacuggaggagcaggaaggauccuccccuagagcgcccccaggagcugggagag

SEQ ID NO: 582339 - RNA, 64 nt, Homo Sapiens
cucuggagggaacuggauacgcaggaaggacccuccccuagaguguccccaggagcugggagag

SEQ ID NO: 582340 - RNA, 64 nt, Homo Sapiens
ucuaccaccaaucccgaucgcacaagacaccugugaucuggaaacucuuauuagcuccccgcuc

SEQ ID NO: 582341 - RNA, 64 nt, Homo Sapiens
uccacgaccaaucccgaucggcugacuccacggggaucuggaaacugcccaggaaagaacuuca

SEQ ID NO: 582342 - RNA, 64 nt, Homo Sapiens
uguuaagauaugcacagucuaaguauuuaauuuggaucuggaucaauaguuugaaauagaaaaa

SEQ ID NO: 582343 - RNA, 64 nt, Homo Sapiens
gccaguuugaccuuugucuuacaaaauugcuccagaucuggaaucauaguuguuuuccugcuuu

SEQ ID NO: 582344 - RNA, 64 nt, Homo Sapiens
cucagccuggccagacacagccaugauggcaacagaucuggaacuucccaggacccugaagggg

SEQ ID NO: 582345 - RNA, 64 nt, Homo Sapiens
ccagacucagacauuggcacuggggucuggaguugaucuggaacaaauggggccagauccagcc

SEQ ID NO: 582346 - RNA, 64 nt, Homo Sapiens
agaggagacauuggcuuaucauggggaaaaagaggaucuggagaaccucauccagcuccccuuc

SEQ ID NO: 582347 - RNA, 64 nt, Homo Sapiens
gccugcaagugguagcaagaagugauuagaggcagaucuggacuuggcaacagaagugguuucc

SEQ ID NO: 582348 - RNA, 64 nt, Homo Sapiens
uuaggucacuacuuuugcagauuuugcuggcacugaucuggagaucugcagaucuggaggagac

SEQ ID NO: 582349 - RNA, 64 nt, Homo Sapiens
gcagauuuugcuggcacugaucuggagaucugcagaucuggaggagacgggaaggagucgauuc

SEQ ID NO: 582350 - RNA, 64 nt, Homo Sapiens
caaggacugucaggcuggaccagagcccagacugcuggaacagcccugguuugcauccggcuca

SEQ ID NO: 582351 - RNA, 64 nt, Homo Sapiens
gugucugccucgcuuccuggcccacgccaagaggcuggaacauagacugacuggcugcagccuu

SEQ ID NO: 582352 - RNA, 64 nt, Homo Sapiens
ugccccaguucagaaauuuggcauugaucuuaaacuggaacaugcuuuuacuuuauugcccuaa

SEQ ID NO: 582353 - RNA, 64 nt, Homo Sapiens
auucuuuuacuuaaccaggcuuauggcaugaucucuggaacaaauuuguaggaaaaaauuacuc

SEQ ID NO: 582354 - RNA, 64 nt, Homo Sapiens
guuugugccccgccaggugaaggucaugcgaugccuggaacaccccaacgugcucaaguucauc

SEQ ID NO: 582355 - RNA, 64 nt, Homo Sapiens
cacccaccugucacccaggccauccuuugugaagcuggaacacuggcuggagacccuccgcaug

SEQ ID NO: 582356 - RNA, 64 nt, Homo Sapiens
cccagagugaaagauggagcgggaauuugugacccuggaacaucguucguggucaaagguuugg

SEQ ID NO: 582357 - RNA, 64 nt, Homo Sapiens
gcagggccuacaacgaggggcaagucaggcccuucuggaacacaauguuugacgaagguuugug

SEQ ID NO: 582358 - RNA, 64 nt, Homo Sapiens
aggagagucacagggcuugacaccugacucugagcuggaacaguaggggcagggagaagacagg

SEQ ID NO: 582359 - RNA, 64 nt, Homo Sapiens
uacuugaucuggagggcauugacaccuggcucagcuggaacaguggggacaggaggaggcaggu

SEQ ID NO: 582360 - RNA, 64 nt, Homo Sapiens
uuggggcugauuugucucuuuuucauuuacagcucuggaacacuugcuucuuaaucaauccaaa

SEQ ID NO: 582361 - RNA, 64 nt, Homo Sapiens
guugaaaacccaggguuuugcagcagaccuggcacuggaacagggaugcagcucagucaaggag

SEQ ID NO: 582362 - RNA, 64 nt, Homo Sapiens
guuugauacucuaguauguaucuugaacuucuuacuggaacaauuaagauagcccuaaauguac

SEQ ID NO: 582363 - RNA, 64 nt, Homo Sapiens
uaaaagggugaaaguuagucuucguaaauuugggcuggaacaugguguauuuuaaaugugaccu

SEQ ID NO: 582364 - RNA, 64 nt, Homo Sapiens
ugucugugcaaacuggaggacuccuuccaacuuccuggaacaaagcgacaucgccagcagcagg

SEQ ID NO: 582365 - RNA, 64 nt, Homo Sapiens
ugacagugugcucacucucagagccauggauuaccuggaacaaagugcagauuagugcccacgg

SEQ ID NO: 582366 - RNA, 64 nt, Homo Sapiens
uuaacagaaggaaaugccgacaggguuccaggaccuggaacacucagugagugggucccaucga

SEQ ID NO: 582367 - RNA, 64 nt, Homo Sapiens
uguguuguaucuguaacacuugaauuccuucuaacuggaacauuuuggaccuuggcauuccguu

SEQ ID NO: 582368 - RNA, 64 nt, Homo Sapiens
cggcugguguugaaagaguggcuagagaaggaugcuggaacaagugacaguccuccuggcuuca

SEQ ID NO: 582369 - RNA, 64 nt, Homo Sapiens
aaggcccuguaaagcccucauuucugcaugaacucuggaacagaagcuuaccugccacagagcu

SEQ ID NO: 582370 - RNA, 64 nt, Homo Sapiens
aggaugggaccauguuugaaaaacccguguccaccuggaacaucaguaaugaauuaucauuccc

SEQ ID NO: 582371 - RNA, 64 nt, Homo Sapiens
cucaggcuucccugacucaggucccaucaggccccuggaacacaagucccugauagagaaggag

SEQ ID NO: 582372 - RNA, 64 nt, Homo Sapiens
cuaauagcaugaagaucgugggucuguguguccgugaagugagucccgucugccaggagcugac

SEQ ID NO: 582373 - RNA, 64 nt, Homo Sapiens
cauguguggccaggcuggucucgaacuccugaccugaagugauccacccgccucgaccucccaa

SEQ ID NO: 582374 - RNA, 64 nt, Homo Sapiens
uuuuuuccccccauaaguuaaagagcuuugaauuugaagugagucaagaugagagcagaaucgu

SEQ ID NO: 582375 - RNA, 64 nt, Homo Sapiens
agaugagagcagaaucguaaacacugaugugcaaugaagugacacugggagaggacaguuauug

SEQ ID NO: 582376 - RNA, 64 nt, Homo Sapiens
ccacuuuucucucuauuuguauuguuagccaucuugaagugauguuguuuaacauaaauuguac

SEQ ID NO: 582377 - RNA, 64 nt, Homo Sapiens
aaacucuccaaauacugauggugcauuuuauucuugaagugaaaucugugcaauaaaauaacag

SEQ ID NO: 582378 - RNA, 56 nt, Homo Sapiens
gacuccgauuuggagaguagcugaagugaagugauguuuucaauuuuccagaauaa

SEQ ID NO: 582379 - RNA, 51 nt, Homo Sapiens
ugauggacuccgauuuggagcugaagugaaguuuucaauuuuccagaauaa

SEQ ID NO: 582380 - RNA, 64 nt, Homo Sapiens
uuuagugagcaaaaggaucaauguuuugacagauugaagugagcuuuggggauuuucccccuug

SEQ ID NO: 582381 - RNA, 64 nt, Homo Sapiens
uucuacuauuguucauugcuaauuauacaaaugcugaagugagaugaauguuuuucuuauaaaa

SEQ ID NO: 582382 - RNA, 64 nt, Homo Sapiens
gcaaugccaguauaacugauaagcuagaaaaaaaugaagugauuugggagacaggauuuucuaa

SEQ ID NO: 582383 - RNA, 64 nt, Homo Sapiens
acaggagaugaugagaaaaggugggcgacagaucugaagugaaggagacaggaauccccucaca

SEQ ID NO: 582384 - RNA, 64 nt, Homo Sapiens
acuagauauuuaauauuuugugaauaauuucuguugaagugaaauauuuagugaauuuuauuua

SEQ ID NO: 582385 - RNA, 64 nt, Homo Sapiens
uuugaaagauuaaugagauaauaaaugaugaaguugaagugaugcugucaagaagguuuauggu

SEQ ID NO: 582386 - RNA, 64 nt, Homo Sapiens
aaguaaauuucuguacauguacuguuuucauaugugaagugagaagaaacuuuaugcuuguuua

SEQ ID NO: 582387 - RNA, 64 nt, Homo Sapiens
gcuaaaugccuguauuugaagucucuccccuuccugaagugaccuuuuaugaggcucuuuccuu

SEQ ID NO: 582388 - RNA, 64 nt, Homo Sapiens
ggcauuauccuuucaaaaucucagggauuugggaugaagugaagaggucaaauuacuuuuuaga

SEQ ID NO: 582389 - RNA, 64 nt, Homo Sapiens
uaaauuggauguuucuuuauaugaccuuggaaacugaagugaucuuagcauuaaacaaaaaugc

SEQ ID NO: 582390 - RNA, 64 nt, Homo Sapiens
uauucaaucauaggagcaaagaacuugcaaaauaugaagugacuuggaauuaaccauguuguag

SEQ ID NO: 582391 - RNA, 64 nt, Homo Sapiens
auggcucuaccauucauucuucugguauuuguaaugaagugaauccacuguuuaaucagaucca

SEQ ID NO: 582392 - RNA, 64 nt, Homo Sapiens
uggcauggugaggugaaaguuauuuuaaaauaaaugaagugagagauaaauuuaaaauguuacu

SEQ ID NO: 582393 - RNA, 64 nt, Homo Sapiens
aaguuuuacaaucucuagguuuuuuuuuaaacaaugaagugaaaggugugccaagacauuaauu

SEQ ID NO: 582394 - RNA, 64 nt, Homo Sapiens
acuuaauagcaucaagauuugaaauacuuaagcaugaagugacuuuuauaaugacucgaucccu

SEQ ID NO: 582395 - RNA, 64 nt, Homo Sapiens
uccuuuuuaaaaaucauauagacaauuagcuguuugaagugaguauuaaauauuucagaagugu

SEQ ID NO: 582396 - RNA, 64 nt, Homo Sapiens
ggugauuggaaauuuuuagccaaggugguauauuugaagugaaucaaaguaaaaaaaguaaaau

SEQ ID NO: 582397 - RNA, 64 nt, Homo Sapiens
ccaugcagugacuggaugauaaagaagauauggaugaagugaacaauaaagaguauucugaaaa

SEQ ID NO: 582398 - RNA, 64 nt, Homo Sapiens
uuaguugucugcucauuuaugcucuggcauccgaugaagugaucguugcauucuuggacagaca

SEQ ID NO: 582399 - RNA, 64 nt, Homo Sapiens
cucucgucucuguuuccccaucaacguuuugagcugaagugauccucccaggcucacugcagcc

SEQ ID NO: 582400 - RNA, 64 nt, Homo Sapiens
uaaaugagugauucuguccccaaauguccauuuuugaagugauuuuccuggaggauuaggguau

SEQ ID NO: 582401 - RNA, 64 nt, Homo Sapiens
gguacaaaaacucaucuuguaauauuuucauuuuugaagugaaaaaguacauauauuuugcaca

SEQ ID NO: 582402 - RNA, 64 nt, Homo Sapiens
gaaccauaggacuguggcaaacaaaaccaauucaugaagugaauuaaugaugaggaucugaaaa

SEQ ID NO: 582403 - RNA, 64 nt, Homo Sapiens
cucacauuggcaaguguaaaaagaugacuuaaggugaagugaggacaaaaucacauucugcaua

SEQ ID NO: 582404 - RNA, 64 nt, Homo Sapiens
aaagucuguguuuuuguguuacauaccacauaacugaagugaaaugaacaaacuggaaaaugca

SEQ ID NO: 582405 - RNA, 64 nt, Homo Sapiens
cacuaaucacggggaacccaucuuguucugugacugaagugauaccacuuaaaagaucucugua

SEQ ID NO: 582406 - RNA, 64 nt, Homo Sapiens
ucucugagcuggugguguggugaccgucccaccgugaagugaaugguucacaguagacuuugag

SEQ ID NO: 582407 - RNA, 64 nt, Homo Sapiens
uugaaaaagaaauguuacuucacaguugaguauuugaagugaauguugcuguuuuuuaaaugaa

SEQ ID NO: 582408 - RNA, 63 nt, Homo Sapiens
uuauuucaugauucaaccugauacauuuacauagugcaaaacugugucacaguuucaggcuuu

SEQ ID NO: 582409 - RNA, 63 nt, Homo Sapiens
augaauaaucaaagugauuuuucagaauuaugugugcaaaaaauuaaugugcauucauauauu

SEQ ID NO: 582410 - RNA, 63 nt, Homo Sapiens
agcucaggugcuccccuccaccaugggcaggcugugcaaaaagccacuggcuuuucucagcau

SEQ ID NO: 582411 - RNA, 63 nt, Homo Sapiens
uuuaaggaacaaguaacuaaaaauguuaagccagugcaaaauaaucugcuuaccuacucacau

SEQ ID NO: 582412 - RNA, 63 nt, Homo Sapiens
uauuaacauaauuguuguagcauaauauuaauagugcaaaaguacauauaagucauuuugaug

SEQ ID NO: 582413 - RNA, 63 nt, Homo Sapiens
gagcacuuugccuaaaagaaaggacugacaagugugcaaaauguuuacaaucuuuugugaaau

SEQ ID NO: 582414 - RNA, 63 nt, Homo Sapiens
cugggucaggaacagagccaacaggaugaacgugugcaaaagccuuggacuuggcugugaucu

SEQ ID NO: 582415 - RNA, 63 nt, Homo Sapiens
gccugacuggggacaccugagaguaguauaguagugcaaaauggaagacugauuuuugacucu

SEQ ID NO: 582416 - RNA, 63 nt, Homo Sapiens
cagcaagguuggccucuggauggugaacgggcugugcaaaaaagcccugcuucuucccuuguc

SEQ ID NO: 582417 - RNA, 63 nt, Homo Sapiens
uaccccauagacugguguuaaauguugucuacagugcaaaauccauguucuaacauauguaau

SEQ ID NO: 582418 - RNA, 63 nt, Homo Sapiens
aucauguccaggccuggaaagaauacaaauccagugcaaaauuaaaccauuaguucuugauga

SEQ ID NO: 582419 - RNA, 63 nt, Homo Sapiens
ugcucgucuaucaccaggaucgcuuuguacuuugugcaaaagggucuggcugucccuugcugu

SEQ ID NO: 582420 - RNA, 63 nt, Homo Sapiens
agagaguguauagacugacucuaaguuaauaaugugcaaaauaucuuaaacaucccuccccuu

SEQ ID NO: 582421 - RNA, 63 nt, Homo Sapiens
agagaguccuuacucccuuccaaucucuguucagugcaaaacccagaaacaugaacagauacg

SEQ ID NO: 582422 - RNA, 63 nt, Homo Sapiens
gaauauuuuguacauuuuuacuuuucuacauuggugcaaaaugugaaacaaucacacaggaca

SEQ ID NO: 582423 - RNA, 63 nt, Homo Sapiens
cuagccuugcccgagcuuuccagucaaaaggacgugcaaaaguguaauguuuugauuuuguga

SEQ ID NO: 582424 - RNA, 63 nt, Homo Sapiens
aucuguuuggggagcacacuagaacauuagccugugcaaaaccggucucuaaggaaaaccagc

SEQ ID NO: 582425 - RNA, 63 nt, Homo Sapiens
caccccucacacugcagccacuggaggugaaaugugcaaaaccggaauauugagaaugagggc

SEQ ID NO: 582426 - RNA, 63 nt, Homo Sapiens
gaugauucuacuugcuguaggcuuccuugcucagugcaaaacucucucauaggagacccaugu

SEQ ID NO: 582427 - RNA, 63 nt, Homo Sapiens
aaauauggggagacuugggaauuggcaagauuugugcaaaauaauuaugagcccugaggaguu

SEQ ID NO: 582428 - RNA, 63 nt, Homo Sapiens
caucuaagcaucuguuaacauuuaggaaaacaugugcaaaaagucaugaagaaaaaaauauau

SEQ ID NO: 582429 - RNA, 63 nt, Homo Sapiens
auuggcccccauuauggugccugccugagccuggugcaaaaggcaccacagcugccuccugag

SEQ ID NO: 582430 - RNA, 63 nt, Homo Sapiens
cacaaccccaaucacacacagagaggcagaugugugcaaaaaguauaaauaggucagugggca

SEQ ID NO: 582431 - RNA, 63 nt, Homo Sapiens
uucuugaaagucucuaggccauuuugagaaaaggugcaaaauacauuuucuuuaaaaaaaagu

SEQ ID NO: 582432 - RNA, 63 nt, Homo Sapiens
cuaaauuucuaaaaauggauagggggaaaaaaggugcaaaauguugaaagaaaaugaaggaac

SEQ ID NO: 582433 - RNA, 63 nt, Homo Sapiens
acuuacugcaagagauauuucauuuucagcacagugcaaaaguucuuuaaaaugcauaugucu

SEQ ID NO: 582434 - RNA, 63 nt, Homo Sapiens
uuuugguaauucauuuuuuuuuaagaucauuaugugcaaaacaccaaguuuuaaaaauaacuc

SEQ ID NO: 582435 - RNA, 63 nt, Homo Sapiens
ucucucucucucucaaagaaaaaaaaaaugggagugcaaaaaaaacaaagccaaaaaauauau

SEQ ID NO: 582436 - RNA, 63 nt, Homo Sapiens
agaaggcuaaaaaauuaccucuuuuuaaauuaugugcaaaauaauucuggcuaacuguaaaau

SEQ ID NO: 582437 - RNA, 63 nt, Homo Sapiens
ggagcauuuauguagacauuguaaauaaauuuugugcaaaaaggacuggaaaaaugaacugua

SEQ ID NO: 582438 - RNA, 63 nt, Homo Sapiens
guagaacauaaaacuuguauugcuucuguuucagugcaaaaauguacuagccaauacgcuuaa

SEQ ID NO: 582439 - RNA, 63 nt, Homo Sapiens
uccuuggaacuggaaguguuauuccuaagucuagugcaaaaugcuucuacucucugugucuuc

SEQ ID NO: 582440 - RNA, 63 nt, Homo Sapiens
gauaguguuauaaauacuguaaaagcauggaaggugcaaaacucaguauuucuacaauugcag

SEQ ID NO: 582441 - RNA, 63 nt, Homo Sapiens
aacacuucgugguucuauauaucagcagcaagugugcaaaauaaaggaccuguuaacucagau

SEQ ID NO: 582442 - RNA, 63 nt, Homo Sapiens
agccugcauuguguauuaaacaccagguaauaugugcaaaaccgagggcuccaguaacaccuu

SEQ ID NO: 582443 - RNA, 63 nt, Homo Sapiens
gucgcugaguauuauuugacuccggucuccuuggugcaaaaacaaaaugggaaaaauaaauaa

SEQ ID NO: 582444 - RNA, 63 nt, Homo Sapiens
agaaaauacagcuggauuggcuuuugaccuguggugcaaaagcgguuuuaguuuuuaaaauau

SEQ ID NO: 582445 - RNA, 63 nt, Homo Sapiens
uuuuuauagauuugaccuacuucugacuuaagugugcaaaauagcuaauuuaguucucagcuc

SEQ ID NO: 582446 - RNA, 63 nt, Homo Sapiens
uagccgggcgugguggcgcagucucuacuaaaagugcaaaaauggcuaacacggugaaacccc

SEQ ID NO: 582447 - RNA, 63 nt, Homo Sapiens
ccuggaacgcaauuaaauacuugaauguguaaugugcaaaagcuuuuuuaaacaaugauuaaa

SEQ ID NO: 582448 - RNA, 63 nt, Homo Sapiens
uuuuggauugacaguaacuuucuuuuuauugaugugcaaaaauuguuccuaaguucuuagaua

SEQ ID NO: 582449 - RNA, 63 nt, Homo Sapiens
accacauucuguccccaaaaugggagagguucugugcaaaacuuuuucuaagcuguuucuuga

SEQ ID NO: 582450 - RNA, 63 nt, Homo Sapiens
ucaggcuuuauggccuauuuuccauugugucaagugcaaaacuacccuggcccaaaggaaggg

SEQ ID NO: 582451 - RNA, 63 nt, Homo Sapiens
aaacuuaaguagauaggagcuuauggucaaaaagugcaaaaaaaaaaacaaaaaaaaagcaau

SEQ ID NO: 582452 - RNA, 63 nt, Homo Sapiens
agagugaauggcuugacguacuugcaguuaacugugcaaaauuggcuggcugccucuguuccu

SEQ ID NO: 582453 - RNA, 63 nt, Homo Sapiens
uccagaaaggguugcuagccuuaacuucagcuggugcaaaacaucugacuguagccgaacuuc

SEQ ID NO: 582454 - RNA, 63 nt, Homo Sapiens
ccaaaucaaggaccaacuuaaacguuaauuuuugugcaaaaacaaaccugaaaaauaugcuuc

SEQ ID NO: 582455 - RNA, 63 nt, Homo Sapiens
uaauuccagugguccauggaaugcuugaaaaaugugcaaaacagcguuuaagacuguaaugaa

SEQ ID NO: 582456 - RNA, 63 nt, Homo Sapiens
acuggcuuuaccaaauugaaugaaaaggagcuugugcaaaaaaauuuaaaaauggaugucaag

SEQ ID NO: 582457 - RNA, 63 nt, Homo Sapiens
ggggaaaaaaaaagaagaaaaaccuguuuccgugugcaaaagcacacauauguaugucugugu

SEQ ID NO: 582458 - RNA, 63 nt, Homo Sapiens
aaaauacuagguaguauaaggcuuucucaaucagugcaaaaauggaagauauauaaagcaaca

SEQ ID NO: 582459 - RNA, 63 nt, Homo Sapiens
aauuuucaaagaaaaacgagggaaaugggaggggugcaaaagaggagaguaagaaacagcaug

SEQ ID NO: 582460 - RNA, 63 nt, Homo Sapiens
ucauugcacauaagcuuccauuuuaauuuuaaagugcaaaagggccagcguggcucuaaaagg

SEQ ID NO: 582461 - RNA, 63 nt, Homo Sapiens
uguucucagagcugaauguuuauaucuuuugcugugcaaaagaaacauguaaaauguuguuca

SEQ ID NO: 582462 - RNA, 63 nt, Homo Sapiens
ccacauauugucugacugcaugaaagaagccaggugcaaaagcagccuugaaaacuugcuaag

SEQ ID NO: 582463 - RNA, 63 nt, Homo Sapiens
caacucaaaacgcauccaaguuacucacacuaugugcaaaaauaaaagaaugagguuggaccu

SEQ ID NO: 582464 - RNA, 63 nt, Homo Sapiens
augagguuggaccuuuacuccaaugauaugcaagugcaaaagauucaacaaauggcaccgaga

SEQ ID NO: 582465 - RNA, 63 nt, Homo Sapiens
cauuuugaauaccaugaucgauaaacuuguacagugcaaaagacagcauaugaucuuuuuucc

SEQ ID NO: 582466 - RNA, 63 nt, Homo Sapiens
aaauaaacauuuaaaaugacuacuguuaaaauugugcaaaauauuuccacagcaaaauuacuc

SEQ ID NO: 582467 - RNA, 63 nt, Homo Sapiens
uugguauuaaagaaugcugcuguaugucaaauugugcaaaauauuugaaaugcuaaacuuggc

SEQ ID NO: 582468 - RNA, 63 nt, Homo Sapiens
auuaaaccuguacauauuccgauuuaccucaaggugcaaaauaaguaguaguugcuauguacu

SEQ ID NO: 582469 - RNA, 63 nt, Homo Sapiens
ggaucucuuaguuggucacuauguguuucauuggugcaaaaguuguucugagguuucaccucc

SEQ ID NO: 582470 - RNA, 63 nt, Homo Sapiens
aacaaauaugauuauugaccgagugcccuccaagugcaaaaauauagaggugaaggagguagg

SEQ ID NO: 582471 - RNA, 63 nt, Homo Sapiens
aauucucuucuuuuuugagucuauuugucaguggugcaaaauuuuugaagugccuaagaugac

SEQ ID NO: 582472 - RNA, 63 nt, Homo Sapiens
aauucuuuuuaauuuuaguauugugaacacaaagugcaaaaugugauggagccucauuucccu

SEQ ID NO: 582473 - RNA, 63 nt, Homo Sapiens
aggcuugugcuuuauaccccuuggucuuacuuugugcaaaagcgggcuaacauuuaggagaag

SEQ ID NO: 582474 - RNA, 63 nt, Homo Sapiens
auacccacaccagcacuaguuuaaggaugaccugugcaaaauugcucccugcaaguguaaaua

SEQ ID NO: 582475 - RNA, 63 nt, Homo Sapiens
cugaguaaccacugggaaaaaacuguuuuuugugugcaaaauauuuuaaguggcagguauugu

SEQ ID NO: 582476 - RNA, 63 nt, Homo Sapiens
guuuuuuaaaaauuauacauaaaaauuuuaccugugcaaaauaucaggguaaaauuugaaaca

SEQ ID NO: 582477 - RNA, 63 nt, Homo Sapiens
acacauaaaaugaaaauucauuuacauuaaugagugcaaaauaugauuuuuuuaaaucuaaaa

SEQ ID NO: 582478 - RNA, 63 nt, Homo Sapiens
uaaucacuagauugaaauacaaaacaaauuauggugcaaaaagugccuccuuuugugguguaa

SEQ ID NO: 582479 - RNA, 63 nt, Homo Sapiens
aaucuccacaggacagcacuuccuguguaguuggugcaaaagcugcuuagaggucaaggaccu

SEQ ID NO: 582480 - RNA, 63 nt, Homo Sapiens
aaaaaccuuugauauuuauaaaaucauuuuuacgugcaaaauauaaccuuaauauuugaagug

SEQ ID NO: 582481 - RNA, 63 nt, Homo Sapiens
guuuuuaagugccuuggcaggcucacuucugaggugcaaaacauagauauagaacugaacagg

SEQ ID NO: 582482 - RNA, 63 nt, Homo Sapiens
ggggaauggggagaugaugaugauggucaaagggugcaaaaucucacacaagacugaggcagg

SEQ ID NO: 582483 - RNA, 63 nt, Homo Sapiens
gaacauuuuccaauuaucuggucuuuuccuguugugcaaaaaugacucauugcuccgaauguc

SEQ ID NO: 582484 - RNA, 63 nt, Homo Sapiens
auauuuaugggcugguaaacucauuguacauaugugcaaaacugcuacugaguggggagcuuc

SEQ ID NO: 582485 - RNA, 63 nt, Homo Sapiens
aaagaaugauuucagaaauaagcagcuaugugugugcaaaauaauuuccaguguucaguaaau

SEQ ID NO: 582486 - RNA, 63 nt, Homo Sapiens
uuuuucccaguuauuuaaucuuucuauuugguugugcaaaaugcauaaguucaggauauuucu

SEQ ID NO: 582487 - RNA, 63 nt, Homo Sapiens
agacagaagagugagaagcauuuccaccaugaggugcaaaacguucuggacguguuuagauag

SEQ ID NO: 582488 - RNA, 63 nt, Homo Sapiens
accccuuugcacagauaguuaaucuggauaaaugugcaaaaguguauugugcuuuuuagaaca

SEQ ID NO: 582489 - RNA, 63 nt, Homo Sapiens
aucguuuuuuuuugcuuuuucuuuuauuuaacagugcaaaaggucuuuucuuuucuccuaaag

SEQ ID NO: 582490 - RNA, 63 nt, Homo Sapiens
aguugcgguuuuucccauuauuauauuagguuggugcaaaacucccauaauaauaacuaacau

SEQ ID NO: 582491 - RNA, 63 nt, Homo Sapiens
augaauaggauauacuaauaauauugaaagucagugcaaaauuguaagcagagauuuaauuuu

SEQ ID NO: 582492 - RNA, 63 nt, Homo Sapiens
guauauaauguguacuuuuuaagaaguaauuaagugcaaaaugugaauuauuuugagauuuua

SEQ ID NO: 582493 - RNA, 63 nt, Homo Sapiens
caauugcuuucugauaucagcucguuugauuuagugcaaaaauguuuucaagacuauuuaaug

SEQ ID NO: 582494 - RNA, 63 nt, Homo Sapiens
auaaaaugaaugaauuacaaugaacaaagaaaagugcaaaauaacacuaacaaguaaauauua

SEQ ID NO: 582495 - RNA, 63 nt, Homo Sapiens
uaauaugcuguuuacauuuauuuucuucagccugugcaaaacaaagcaauggaaaaggaaacu

SEQ ID NO: 582496 - RNA, 63 nt, Homo Sapiens
aauaaaaauuuaauucugguuuuucugauuagagugcaaaagugagaaaaguucaauacucuu

SEQ ID NO: 582497 - RNA, 63 nt, Homo Sapiens
auuuaauuacauacacagugaauugaaaccauugugcaaaauggauuacacauguauacaaag

SEQ ID NO: 582498 - RNA, 63 nt, Homo Sapiens
caugauauguacuauagugauucuguuuuugaggugcaaaaaacauacauauauaccaguugg

SEQ ID NO: 582499 - RNA, 63 nt, Homo Sapiens
aaggagaugcuuauagaugauaguuguacauaugugcaaaaaaaaauccacuugcaaugguaa

SEQ ID NO: 582500 - RNA, 63 nt, Homo Sapiens
aauucuguaugaacaccuggaagcaaaaucauagugcaaaaauacauuuaagguguggucaaa

SEQ ID NO: 582501 - RNA, 63 nt, Homo Sapiens
gggggaggguauuucuggaaaguggaccagcaugugcaaaaauauggaacugagcacgggugc

SEQ ID NO: 582502 - RNA, 63 nt, Homo Sapiens
uuagcacuaauguucaccucguauuuuuuggaagugcaaaaaucucaauuugugucuguuuac

SEQ ID NO: 582503 - RNA, 63 nt, Homo Sapiens
guuaaauuuauuuuuccuaaguuauauguuggugugcaaaaaugcuuuuaucuucucugcagu

SEQ ID NO: 582504 - RNA, 52 nt, Homo Sapiens
uuucaugccuuuuuuuuuuucagugcaaaaacaucguucuccugacacguaa

SEQ ID NO: 582505 - RNA, 63 nt, Homo Sapiens
gauacucuuuucugcauuagcccagagaaaugugugcaaaaauuagcuccagagagugucaaa

SEQ ID NO: 582506 - RNA, 63 nt, Homo Sapiens
uuagugaugaaagccugucuagagcuguguuuugugcaaaaacuuaauuuauuuacgauaucu

SEQ ID NO: 582507 - RNA, 63 nt, Homo Sapiens
uguaggaaacugaaugguuucauggaaugaacugugcaaaaucuauuucccuaaaaguaucuc

SEQ ID NO: 582508 - RNA, 63 nt, Homo Sapiens
gucaguauuaucuaaaugaauuuugaaauuguagugcaaaaugauccaaauuucucauguucc

SEQ ID NO: 582509 - RNA, 63 nt, Homo Sapiens
uuuaaugcuagucaguaugcuauauuagaugaggugcaaaaauauuguauuuguugccuuuuu

SEQ ID NO: 582510 - RNA, 63 nt, Homo Sapiens
cugaaaggcaugugaagggaaggaagaggaagagugcaaaacauugaagagagagcugaguga

SEQ ID NO: 582511 - RNA, 63 nt, Homo Sapiens
uucuacccugcagagugugguuuugggagagaagugcaaaaucccacgacaggugaguugaag

SEQ ID NO: 582512 - RNA, 63 nt, Homo Sapiens
uugggagccaggaugagugucgggcucucgugugugcaaaaggucagaugugacugcugcugu

SEQ ID NO: 582513 - RNA, 63 nt, Homo Sapiens
gccuagguaaauguaagauagaauuaaauggcagugcaaaauuucugagucuuuacaacauac

SEQ ID NO: 582514 - RNA, 63 nt, Homo Sapiens
auuaaaaaggcuaguggcuguguagcauccucagugcaaaacccagcuccagaauuuucaccu

SEQ ID NO: 582515 - RNA, 63 nt, Homo Sapiens
agccagaauguuuccuguggaaauaugcaaccugugcaaaauaaaaugaguuaccucaugccg

SEQ ID NO: 582516 - RNA, 63 nt, Homo Sapiens
aacaucaggaacccagcuuccugggguucccacgugcaaaaucggguucagagcaguguccuc

SEQ ID NO: 582517 - RNA, 63 nt, Homo Sapiens
uuuuccucuaauguauaauaugagggaauguuugugcaaaauuauauaagacuacuggcuuug

SEQ ID NO: 582518 - RNA, 63 nt, Homo Sapiens
aaaaggaaaaccagugaaguaaaagaccaauaggugcaaaaauucaaaccaauucacccagaa

SEQ ID NO: 582519 - RNA, 63 nt, Homo Sapiens
gaguuuucaccugguauccagguucuggauauggugcaaaaaucaggcauaaauuagagaaau

SEQ ID NO: 582520 - RNA, 63 nt, Homo Sapiens
accaaauuuguguccugugcuaauugacaacaugugcaaaaauacaggccugcuuuuugcuua

SEQ ID NO: 582521 - RNA, 63 nt, Homo Sapiens
cucuauggaaaucauaauugugugcuuaggcaagugcaaaauaccuugcucuguuuuugcuuu

SEQ ID NO: 582522 - RNA, 63 nt, Homo Sapiens
aauguaaauauuuucuugagggccaucccuuuugugcaaaacauucucgcuuuggaaaaagac

SEQ ID NO: 582523 - RNA, 63 nt, Homo Sapiens
uuaguaucagaaaauacgagaaauccaacuucugugcaaaauuaacaugcaauuagccuuuug

SEQ ID NO: 582524 - RNA, 63 nt, Homo Sapiens
aaaucagaggcuucuacaacaugagccugguuugugcaaaauuaccauaggcguuuuguucau

SEQ ID NO: 582525 - RNA, 53 nt, Homo Sapiens
acucuucgaagagggauuaaaaggugcaaaaagacaacuaaaauacccauuug

SEQ ID NO: 582526 - RNA, 63 nt, Homo Sapiens
cgccccagggguuggcccaugcuuucccuaacugugcaaaaaugguuugggauaggcugggug

SEQ ID NO: 582527 - RNA, 63 nt, Homo Sapiens
gaaaagagugaggaacagaauguuuuaaaucuggugcaaaagaacuauaucugcuggaugagc

SEQ ID NO: 582528 - RNA, 63 nt, Homo Sapiens
cagaccuuuucuuuuuuuuuuuuuuuuuaaugugugcaaaagcccaaagguuccuaagccugg

SEQ ID NO: 582529 - RNA, 63 nt, Homo Sapiens
uauaguaucuauaaauuaacaagaaguaugcaggugcaaaaaagugguggaacaaauaccaac

SEQ ID NO: 582530 - RNA, 63 nt, Homo Sapiens
acuaaucuaccugagccagaagauugaguuugagugcaaaauauucccgcucauuucucaguc

SEQ ID NO: 582531 - RNA, 63 nt, Homo Sapiens
cccaguccagagacaaaacccaucuguacuccugugcaaaaugaaucugcacccucuggaggg

SEQ ID NO: 582532 - RNA, 63 nt, Homo Sapiens
uguagaauaaauguauaaggacauguauaaagggugcaaaaauaguuauuguuguugccucua

SEQ ID NO: 582533 - RNA, 63 nt, Homo Sapiens
aagcaugugguggcucucauuuuggcauucuuugugcaaaaaguacucaauuuuauguuuccu

SEQ ID NO: 582534 - RNA, 63 nt, Homo Sapiens
auguaagaggaaaaaaaguacaauggagcaugugugcaaaaaacaaaccuugggaagauguau

SEQ ID NO: 582535 - RNA, 63 nt, Homo Sapiens
aaucgugguuuuugccauuuaaauguuagguuggugcaaaacuguggaacucuccauuuuccu

SEQ ID NO: 582536 - RNA, 63 nt, Homo Sapiens
aaaucuucaggaggggacuuugcugagccagccgugcaaaagguaaugccgagcuacccgcag

SEQ ID NO: 582537 - RNA, 63 nt, Homo Sapiens
aucuuggccuuggccguguaacacauucuaacugugcaaaauucauuguggcugguuucuuga

SEQ ID NO: 582538 - RNA, 63 nt, Homo Sapiens
uguuucagccguauaguggauuuagauaaucuugugcaaaaugacucgauuuaaacuccagca

SEQ ID NO: 582539 - RNA, 63 nt, Homo Sapiens
gugcuuucauccaugaaaucuccaauucaguaagugcaaaagagaauuggugugcaucugaga

SEQ ID NO: 582540 - RNA, 63 nt, Homo Sapiens
agauguuccuagacauuuucuuuaugguuccaagugcaaaacagguguucuuaucuaaaacgu

SEQ ID NO: 582541 - RNA, 63 nt, Homo Sapiens
uccuauucccuuccucccauuuuuuuccugcuagugcaaaagguagaugaguaggaagauuag

SEQ ID NO: 582542 - RNA, 63 nt, Homo Sapiens
auaucugccgggacccaccaggucagagguggagugcaaaauaucguuaugauaaggaguggu

SEQ ID NO: 582543 - RNA, 63 nt, Homo Sapiens
ggccuuauauuuugauguaaagauuaaaagaaugugcaaaacagucagaaauuuuuauugccu

SEQ ID NO: 582544 - RNA, 63 nt, Homo Sapiens
aaaaaaaaaauuuauguguaaauauguaagacugugcaaaaaauauucauagaccuugacugg

SEQ ID NO: 582545 - RNA, 63 nt, Homo Sapiens
ggauucuuacaaauucauuaaagaugggaauaagugcaaaagauaauuuuugaaaauuaauua

SEQ ID NO: 582546 - RNA, 63 nt, Homo Sapiens
uuaagauuuuaucugggggaggcuaacagucuagugcaaaagauuucuugcuuuguuuucccu

SEQ ID NO: 582547 - RNA, 63 nt, Homo Sapiens
gaugagaccccacacuuuacaggcaaaacgugggugcaaaagugacaguguggagaaaccaac

SEQ ID NO: 582548 - RNA, 63 nt, Homo Sapiens
ucaauuuuuaauguauaaucuugauacccuguagugcaaaauguauuuuuaaaaucagaauua

SEQ ID NO: 582549 - RNA, 63 nt, Homo Sapiens
uugaagguagaaguuuucuucuccugugaaucugugcaaaacaaaguagcauuuuuuuucccu

SEQ ID NO: 582550 - RNA, 63 nt, Homo Sapiens
gggcuaacggcaccugcagggaucaauccaccagugcaaaacaucucccugugcgccugagca

SEQ ID NO: 582551 - RNA, 63 nt, Homo Sapiens
acaaccagaaguacacauuuacaauagauagaugugcaaaagaccuuuuuguagccaaacaag

SEQ ID NO: 582552 - RNA, 63 nt, Homo Sapiens
uccuuggagcuggaaguauuauuccuaagucuagugcaaaaugcuucuacucucugugucuuc

SEQ ID NO: 582553 - RNA, 63 nt, Homo Sapiens
ugaagccuugaauuuugaaaaaaagacaagaaggugcaaaagucuuuaauccuggcagggauu

SEQ ID NO: 582554 - RNA, 63 nt, Homo Sapiens
gugagcucucaggccgagagccuuauuuaccuagugcaaaaacuguaaaaguguacagacucu

SEQ ID NO: 582555 - RNA, 63 nt, Homo Sapiens
ggugcagguacucuuggggccccagcggugggagugcaaaagacccaacgccaacaccuggug

SEQ ID NO: 582556 - RNA, 63 nt, Homo Sapiens
cuucuacucucugugucuucauuccuaagucuagugcaaaauguccuuggaacuggaaguauu

SEQ ID NO: 582557 - RNA, 63 nt, Homo Sapiens
caacauggcaguuuuaauuuuaaauuauuuuuggugcaaaaguuuaaauuuuauuuuggaaaa

SEQ ID NO: 582558 - RNA, 63 nt, Homo Sapiens
cacugggggcuacccguuagcaaucuuggagaggugcaaaaagucaggggacugguagucacc

SEQ ID NO: 582559 - RNA, 63 nt, Homo Sapiens
aauuuuuuagcaauuuuuguuuuaaaaauugaagugcaaaaaaaaaaguggcacauuuaaaaa

SEQ ID NO: 582560 - RNA, 63 nt, Homo Sapiens
caguccaugaaaaccagaaacagugagcucgaugugcaaaacgagugcuaggacagcucuaaa

SEQ ID NO: 582561 - RNA, 63 nt, Homo Sapiens
uaacauugaaauuuugaaacgggggggaagggcgugcaaaaacuuccuuacaaacaggguugg

SEQ ID NO: 582562 - RNA, 63 nt, Homo Sapiens
auacuuaucuaacuggacacucuacucucagaggugcaaaaagcugucauauuuacuucuaau

SEQ ID NO: 582563 - RNA, 63 nt, Homo Sapiens
cuguuagucagugauucuuugaaaacagucauugugcaaaauuggcaucuucauugagggaaa

SEQ ID NO: 582564 - RNA, 63 nt, Homo Sapiens
ugcaguuaucccuuauggaaucuaguugugaaggugcaaaagagaaaaagucgcugagucguu

SEQ ID NO: 582565 - RNA, 63 nt, Homo Sapiens
gaaaacagagcgucuuuuuugaaauacauuuuugugcaaaaugcuguacuuugggaagucaca

SEQ ID NO: 582566 - RNA, 63 nt, Homo Sapiens
aaaagcaacacuccugagucguguaugauuucugugcaaaaacuaggaagugugaaguuuugu

SEQ ID NO: 582567 - RNA, 63 nt, Homo Sapiens
aaaaacauuuuagaaacggaaaaagaggcccaagugcaaaagacuuuuccugaauuggaaagg

SEQ ID NO: 582568 - RNA, 63 nt, Homo Sapiens
cacaugcuguuuuaccuuccaagaauaggacaugugcaaaaacuaggcuuccagaucgugagg

SEQ ID NO: 582569 - RNA, 63 nt, Homo Sapiens
cauagcgguuuaccuaaaaguaaccaucagucagugcaaaaugugccugguucuuaagacaac

SEQ ID NO: 582570 - RNA, 63 nt, Homo Sapiens
ggaagcccacaaccgcuaacacuuacaauuuuggugcaaaagcaaacaguuccagcaggcucu

SEQ ID NO: 582571 - RNA, 63 nt, Homo Sapiens
aacaucuuguugcacgcauuugaggucaucagggugcaaaauuuguauuccugaaaaugucau

SEQ ID NO: 582572 - RNA, 63 nt, Homo Sapiens
aaaaucccaggggcaaaauaaaguucaacaaaagugcaaaauaugacaaaaauagguacauuu

SEQ ID NO: 582573 - RNA, 63 nt, Homo Sapiens
aauauguugcaaccacccaauucugccauuguagugcaaaagcagccauagacaacacauaca

SEQ ID NO: 582574 - RNA, 63 nt, Homo Sapiens
uuuuucauugugaucagauuaaaauuacuauuugugcaaaacaaauuccacaccacauguacu

SEQ ID NO: 582575 - RNA, 63 nt, Homo Sapiens
auguauguguaaaacaaucuguuuuggcuuuaugugcaaaaucuguuauagcuuuaaaauaua

SEQ ID NO: 582576 - RNA, 63 nt, Homo Sapiens
guuauuucugaaaauuaaagaaugguaagacuagugcaaaacaagacuuauaacagcauagug

SEQ ID NO: 582577 - RNA, 63 nt, Homo Sapiens
aaaaugggaaaaauaaggauugcagucuccuuggugcaaaaacuaguaucuguuuuauuugac

SEQ ID NO: 582578 - RNA, 63 nt, Homo Sapiens
aaagauucuguuauaaagugaguguuucaaaaagugcaaaaaauuuguaaaaucagcaaaggc

SEQ ID NO: 582579 - RNA, 63 nt, Homo Sapiens
cugacuucuguauccccacagcauggagaaugggugcaaaaaggucucaaauuuuauucugua

SEQ ID NO: 582580 - RNA, 63 nt, Homo Sapiens
ccauuagaaaauacuauuugaaauauuuuaaaggugcaaaauaucuuaaaauagaguuugaac

SEQ ID NO: 582581 - RNA, 63 nt, Homo Sapiens
auuaaacuauuuguguuuuuacuauucaguuuagugcaaaagcaauauaacuuuggaguuaua

SEQ ID NO: 582582 - RNA, 63 nt, Homo Sapiens
auuggaaggaugugguguguucuagccuguguugugcaaaagaccucucugcccauuacagcu

SEQ ID NO: 582583 - RNA, 63 nt, Homo Sapiens
uauagucaaauguacuguaaagugaaaagggaugugcaaaaaaauaaaaaaaaacaacaaaaa

SEQ ID NO: 582584 - RNA, 63 nt, Homo Sapiens
acucaguuauuuuuaaugcuuaauacauacauggugcaaaauuuaaaaagcgcaaauagguau

SEQ ID NO: 582585 - RNA, 63 nt, Homo Sapiens
accucucccaaauugggaagaccagaggagaaagugcaaaacuguccccauuuggaaugccca

SEQ ID NO: 582586 - RNA, 63 nt, Homo Sapiens
cgugucuccagauauugucaaauaucccaucgggugcaaaaugaucccuggucaagaucuguu

SEQ ID NO: 582587 - RNA, 63 nt, Homo Sapiens
cgauaaucauugcauagugacugaaaagccuaagugcaaaaaaaaaaaaaaaagauguucuug

SEQ ID NO: 582588 - RNA, 63 nt, Homo Sapiens
ggagcccggaaccguuagguacugccgaaugcggugcaaaauuucccccucucccccaguucg

SEQ ID NO: 582589 - RNA, 63 nt, Homo Sapiens
ugaguucuuucagggaaccaaacccagaauucggugcaaaagccaaacaucuuggugggauuu

SEQ ID NO: 582590 - RNA, 63 nt, Homo Sapiens
uauaacaaagcaguuacgaagccuacagauuuugugcaaaauaaaauacaaacaaggugaauu

SEQ ID NO: 582591 - RNA, 63 nt, Homo Sapiens
caccuguggcacggaaugaaaacagagcuucccgugcaaaaagggucacgccucccacccccg

SEQ ID NO: 582592 - RNA, 63 nt, Homo Sapiens
aaccccuucuuuguagaacugcccauuuccauggugcaaaaacucuuauggccaaauucaaac

SEQ ID NO: 582593 - RNA, 63 nt, Homo Sapiens
agacugaaacucaaacaacccugggcaaguaaugugcaaaagauggcaggguggggauuugaa

SEQ ID NO: 582594 - RNA, 63 nt, Homo Sapiens
gauuuuuaccuggaaauuccaugaccaauacaugugcaaaagaaaaugauggguugaauuuac

SEQ ID NO: 582595 - RNA, 63 nt, Homo Sapiens
aagaaaaaagaaaaaaaaaacugcugaaacucagugcaaaaaauuauauaaaauguuuaaucu

SEQ ID NO: 582596 - RNA, 63 nt, Homo Sapiens
uacuguugcuaugauguaacaaagccuuaaauugugcaaaacaagcugacuaaagaaccagcc

SEQ ID NO: 582597 - RNA, 63 nt, Homo Sapiens
cuauaaaagugauauuccuaaaaacaaacaucugugcaaaaccuucucaguagaaaggaacag

SEQ ID NO: 582598 - RNA, 63 nt, Homo Sapiens
acaagcacgcaaguauuaaaauacccauccauugugcaaaaccaguauccaaggcaaacucua

SEQ ID NO: 582599 - RNA, 63 nt, Homo Sapiens
aaguguagucauuauuguuguauugggugaugugugcaaaacugcagaagcucacugccuaua

SEQ ID NO: 582600 - RNA, 63 nt, Homo Sapiens
uucauuaucacaugauuauagaaggcugucuuagugcaaaaaacauacuuacauuucagacau

SEQ ID NO: 582601 - RNA, 63 nt, Homo Sapiens
aauuuauucucuucagagagaaauauuagguuagugcaaaaguaauugugguuuuugccauug

SEQ ID NO: 582602 - RNA, 63 nt, Homo Sapiens
uguagauauuguaaagcuuuuugugaauuaaaagugcaaaauaaagcaaccacauuuaaguag

SEQ ID NO: 582603 - RNA, 63 nt, Homo Sapiens
auuaaauauuuuaucugcuuuuacaagcgcaaggugcaaaaauauauacaauagucucauuga

SEQ ID NO: 582604 - RNA, 63 nt, Homo Sapiens
accaucuucuuuguuugugguacaauauuuucagugcaaaagagaugucauucaguuaaaaag

SEQ ID NO: 582605 - RNA, 63 nt, Homo Sapiens
acugaaucugcuuguugaucaguguugaagaaagugcaaaaggaacuuuuauauauuugacag

SEQ ID NO: 582606 - RNA, 63 nt, Homo Sapiens
caaggaccugaauucuguuuacuucuucuggcugugcaaaagcacacucaagugaaugacuaa

SEQ ID NO: 582607 - RNA, 63 nt, Homo Sapiens
gggaccugagucaaugcgcaaaaugcagcuugugugcaaaagcagugggcuccuggcagaagg

SEQ ID NO: 582608 - RNA, 63 nt, Homo Sapiens
ggggaauacuucaugcaaagaaaaaaguaacaugugcaaaagcuccccguccagcuuugacag

SEQ ID NO: 582609 - RNA, 63 nt, Homo Sapiens
uuggacauacuucugcuauuguuugauuacccugugcaaaacccaaaugucugaagccaguua

SEQ ID NO: 582610 - RNA, 63 nt, Homo Sapiens
aaaaccuaccaauuaacuugaucuuaaugaaaagugcaaaagauaccugcucguucccaaugu

SEQ ID NO: 582611 - RNA, 63 nt, Homo Sapiens
aaauaaauauuucucuuaccuaagcucguucuugugcaaaauuuugguugaauuuguucagua

SEQ ID NO: 582612 - RNA, 63 nt, Homo Sapiens
uuuacaacuacagucuuuaagaaaugggauuuagugcaaaaagguguuauuuauuuuguuccu

SEQ ID NO: 582613 - RNA, 63 nt, Homo Sapiens
uuuuacugguugcauggaaaacugucaaaugaugugcaaaaccuuuaguguuuuuuuauuucu

SEQ ID NO: 582614 - RNA, 63 nt, Homo Sapiens
aaaugaauggcaauagauuuuuuauacguuuuugugcaaaaauuaagaaaagcuggugacaua

SEQ ID NO: 582615 - RNA, 63 nt, Homo Sapiens
ucaaaucuaguuauguauuggccuaaauuauuugugcaaaauuugaaauguuuuuuauuuaaa

SEQ ID NO: 582616 - RNA, 63 nt, Homo Sapiens
aaguuaauagauuuuuucagacuugucaagccugugcaaaaaaauuaaaauggaugccuugaa

SEQ ID NO: 582617 - RNA, 63 nt, Homo Sapiens
auggguuaggcauuaauguuucuaucugauuuugugcaaaagcuucaaauuaaaacagcugca

SEQ ID NO: 582618 - RNA, 63 nt, Homo Sapiens
ucuuuuaggcauuuaaauuguuucuguuacucugugcaaaauaacuuugagauuggacaagaa

SEQ ID NO: 582619 - RNA, 63 nt, Homo Sapiens
uuguauaauucuguguuauuuacaugugaugcugugcaaaacugcauauagcauaugugucau

SEQ ID NO: 582620 - RNA, 63 nt, Homo Sapiens
aauugugguuuuuccauuacuuguaauggguuggugcaaaaguuugugauuguuaaaacuugu

SEQ ID NO: 582621 - RNA, 63 nt, Homo Sapiens
caccaaaaugcuccuauccaaagaugcaagucugugcaaaaccuugaugucacauucugacac

SEQ ID NO: 582622 - RNA, 63 nt, Homo Sapiens
gcuuugcccaucuguagguagaauggggccagggugcaaaaauaguucucaggggagaacugg

SEQ ID NO: 582623 - RNA, 63 nt, Homo Sapiens
auuaacuuuuuuccuuuuaccaauaacuuugaggugcaaaacucaaacuuaugugggucuuuu

SEQ ID NO: 582624 - RNA, 63 nt, Homo Sapiens
ggucauuugugagcacaagaucucauagggcaggugcaaaauaggaauguuguucucaagugu

SEQ ID NO: 582625 - RNA, 63 nt, Homo Sapiens
uccuccauuaucagccagaagugcaacauguaugugcaaaagcuaaaauggcuuaacaucaug

SEQ ID NO: 582626 - RNA, 63 nt, Homo Sapiens
gugguuuuguguuuguuguuuuguguuuuuuuagugcaaaagguuuaaauuuauaguugugaa

SEQ ID NO: 582627 - RNA, 63 nt, Homo Sapiens
cuguuacuuuauuauuguauaaccuuucccccagugcaaaagauuauuucauuuuucaugcac

SEQ ID NO: 582628 - RNA, 63 nt, Homo Sapiens
acuuuugugaaaagcugauaugaacauuuuguagugcaaaaagacguuccugagcauccaaga

SEQ ID NO: 582629 - RNA, 63 nt, Homo Sapiens
ugaacaaagaggaaaucaucaaauucuucauuugugcaaaauuuuguuuccugcaguaaagaa

SEQ ID NO: 582630 - RNA, 63 nt, Homo Sapiens
ggaaggucugggaaugaccaucuaugaaggguugugcaaaacagcguugcagucacucgguua

SEQ ID NO: 582631 - RNA, 63 nt, Homo Sapiens
aauucuaagugaaugcgcguuucaacuuuaguugugcaaaagacagcuauuuuucugaucuua

SEQ ID NO: 582632 - RNA, 63 nt, Homo Sapiens
agugguaaagaaacagguuguucacuugcugaggugcaaaaauucuuaagacuucuguuugaa

SEQ ID NO: 582633 - RNA, 63 nt, Homo Sapiens
cuauucaccuuuuguuuaugaauggaaagcuuugugcaaaauauacauauaagcagaguaagc

SEQ ID NO: 582634 - RNA, 63 nt, Homo Sapiens
agacagaucagacugauaaccuuaacaccauaggugcaaaaugaguuguucugagguuuuuuu

SEQ ID NO: 582635 - RNA, 63 nt, Homo Sapiens
uucauccacgaaccauccagcgcacagaagcaagugcaaaaaugacacaagcacaacucucca

SEQ ID NO: 582636 - RNA, 63 nt, Homo Sapiens
auuuuuagaucuggccuuuucuuaacaaaaucugugcaaaagaugcagguggaugucccuagg

SEQ ID NO: 582637 - RNA, 63 nt, Homo Sapiens
ccuguucccuacaaugggaaaugucacaagaaugugcaaaaauaaaaaucugaggaaaaaacc

SEQ ID NO: 582638 - RNA, 63 nt, Homo Sapiens
aacaaaaaagccccacacauaacuguuuugcacgugcaaaaauguauugggucaagaagugau

SEQ ID NO: 582639 - RNA, 63 nt, Homo Sapiens
uugagaaucaaucaauaaagcaaagaguuuucugugcaaaaucauuacugcuguucuagcccc

SEQ ID NO: 582640 - RNA, 63 nt, Homo Sapiens
ugaaaaagguugguaaaauauuagcacuauucagugcaaaaaguuccccauccuuuuuuuccc

SEQ ID NO: 582641 - RNA, 63 nt, Homo Sapiens
aguuacaaaugcucgaagucggaaagguucugagugcaaaaguagaaccucuuuggcaaauau

SEQ ID NO: 582642 - RNA, 63 nt, Homo Sapiens
uuuuaacaguuuucucaaauccuuuguaugugagugcaaaacaucauuuuugaauuccaucag

SEQ ID NO: 582643 - RNA, 63 nt, Homo Sapiens
aaaauggacagaauugcagcacuaguuuuuccugugcaaaaaugacuguuugaaucuugucuc

SEQ ID NO: 582644 - RNA, 63 nt, Homo Sapiens
ugggagacagagcuggaccucccuugaagcucugugcaaaaggccccugacuucuggaggcuu

SEQ ID NO: 582645 - RNA, 63 nt, Homo Sapiens
gucaccuucuaaaagauauagauucccuuuaaagugcaaaaugucuccaugauuuucaaaauu

SEQ ID NO: 582646 - RNA, 63 nt, Homo Sapiens
acagacuguuccuuuaccaauauguaaaagaaugugcaaaauuaguaaaaauauacccaaaaa

SEQ ID NO: 582647 - RNA, 63 nt, Homo Sapiens
gggaacggugaucuucuugaaugauguuucagugugcaaaaacuauagagccugucagcacca

SEQ ID NO: 582648 - RNA, 63 nt, Homo Sapiens
gcaaaauguuuggauguaauguuaaagcgcaaugugcaaaauuuaaaauaaagaauauuuauu

SEQ ID NO: 582649 - RNA, 63 nt, Homo Sapiens
cuuuggcaccuugguaggugcaggaggagcucagugcaaaaaucacuuuggggccucauuaac

SEQ ID NO: 582650 - RNA, 63 nt, Homo Sapiens
ucagacugcaagugagcaaaccugccccaucccgugcaaaacaugcuaccugaucccacuccu

SEQ ID NO: 582651 - RNA, 63 nt, Homo Sapiens
cuugaaaaggacugaaucgccacuacagccugggugcaaaaucagcaagaaacauugaguauu

SEQ ID NO: 582652 - RNA, 63 nt, Homo Sapiens
gcuguuuaggaaacugcagcugcacaacguggggugcaaaacugccccgcuuccuuuacagcu

SEQ ID NO: 582653 - RNA, 63 nt, Homo Sapiens
aaauaaacguggauuuuaaaaaaucaaucaauggugcaaaaaaaaacuuaaagcaaaauagua

SEQ ID NO: 582654 - RNA, 63 nt, Homo Sapiens
uuuuucugaaauagcaaacauucuuucuuucacgugcaaaacaugugugccucauaagggcua

SEQ ID NO: 582655 - RNA, 63 nt, Homo Sapiens
uaaacuuaggaaacauuugggugucugugcauugugcaaaaagaaccauacauugucccaaaa

SEQ ID NO: 582656 - RNA, 63 nt, Homo Sapiens
uagaugaccauuuuuaauaaucacguagcugaagugcaaaacauucccaaagaaauuuuauuu

SEQ ID NO: 582657 - RNA, 63 nt, Homo Sapiens
uccuauuuuccaguaaauuaauuuuaugguuuggugcaaaaacucuugauguaaugaaaugca

SEQ ID NO: 582658 - RNA, 63 nt, Homo Sapiens
uguggcugccaggucugggccgcucugcagcuggugcaaaagcgcgguaggaaccccggcccu

SEQ ID NO: 582659 - RNA, 63 nt, Homo Sapiens
gcagugaguuucgugaagccugguuuuuacuuugugcaaaaaggccacagacagaagcugugg

SEQ ID NO: 582660 - RNA, 63 nt, Homo Sapiens
ucuuguguauuucucugugaaaaaugauccucagugcaaaaugucugggaguauacggaaaca

SEQ ID NO: 582661 - RNA, 63 nt, Homo Sapiens
acagauuucugucgucugaagcauuugcaauuggugcaaaaauccaaguucauuguuaacuuu

SEQ ID NO: 582662 - RNA, 63 nt, Homo Sapiens
aaaaaaaaaaaaaaguuugugucuuguuucuaugugcaaaaaauugauacuguacacauggau

SEQ ID NO: 582663 - RNA, 63 nt, Homo Sapiens
gaacaauaaaucauuucaaaccucagcacgcgugugcaaaaguccaggcuggaccugcccugu

SEQ ID NO: 582664 - RNA, 63 nt, Homo Sapiens
cauaccacaaagccaagacguuccaugguauuugugcaaaagagaugaagacuucucaauaug

SEQ ID NO: 582665 - RNA, 63 nt, Homo Sapiens
gcugugguaucuuuuauaaaaccucuugcuugugugcaaaaguuccuaaaaggaaacacaagu

SEQ ID NO: 582666 - RNA, 63 nt, Homo Sapiens
aguugggauuuuugcacucagugaaaagcugaagugcaaaagagcuaucaaagacaagaggau

SEQ ID NO: 582667 - RNA, 63 nt, Homo Sapiens
aucaguucuacggaucaucaacaagauuuccuugugcaaaauauuugacuauucuguaucuuu

SEQ ID NO: 582668 - RNA, 63 nt, Homo Sapiens
gaaacauacaaaauaagacuuuuuuacccuaaagugcaaaagucgguggugaaaaggggacag

SEQ ID NO: 582669 - RNA, 63 nt, Homo Sapiens
uguuaagggauuauaggacuauaggaaaauacagugcaaaaugaguaaaaauuaggugugaaa

SEQ ID NO: 582670 - RNA, 63 nt, Homo Sapiens
ucugaagagcuguacacccaugccugcauucuagugcaaaacaaaauuacauaagggacuuuu

SEQ ID NO: 582671 - RNA, 63 nt, Homo Sapiens
aaucggcuguaugguagauuuugccauuaagcagugcaaaauuaaaacaaucccaugcuagag

SEQ ID NO: 582672 - RNA, 63 nt, Homo Sapiens
augcuuuuuaaaauuuuuacaagaucugaccaagugcaaaaaagccuuugcaaagugauagaa

SEQ ID NO: 582673 - RNA, 63 nt, Homo Sapiens
uuuggcuaagcaucaaaaucaccuagggagucggugcaaaacaaaauaucccaguccccuccc

SEQ ID NO: 582674 - RNA, 63 nt, Homo Sapiens
agaggaagccucugugagcucgcaccuuacugggugcaaaagaauccacggaacuugggagaa

SEQ ID NO: 582675 - RNA, 63 nt, Homo Sapiens
acacuagggagaaacccuaucaauguaagcaaugugcaaaagccuuuauuucuuccacuucuu

SEQ ID NO: 582676 - RNA, 63 nt, Homo Sapiens
aggaucacuugaggucaggaguuugagaccagugugcaaaacauagcaagaccucaucucaga

SEQ ID NO: 582677 - RNA, 63 nt, Homo Sapiens
caugagguuacagcaagaagucagcagucuacagugcaaaagagggccuucaccagaacccaa

SEQ ID NO: 582678 - RNA, 63 nt, Homo Sapiens
uguuugaguggauaauggaaacugaaaggugacgugcaaaacugccuauuacucccaggagug

SEQ ID NO: 582679 - RNA, 63 nt, Homo Sapiens
cccuacuacucaggguugaugagaagauuaaaugugcaaaaccugcuugacugugcccacaaa

SEQ ID NO: 582680 - RNA, 63 nt, Homo Sapiens
gguagauaaauucacgaagaugaggagaaaccagugcaaaaagccugaaaauuccaaaaacca

SEQ ID NO: 582681 - RNA, 63 nt, Homo Sapiens
gaauagugccguggagguguuaaguguuugcuugugcaaaagguaauugagagccgcucucug

SEQ ID NO: 582682 - RNA, 63 nt, Homo Sapiens
ggacguaauaagucuuauguguucuuuauagcagugcaaaaauaaauuaccuagucucaggua

SEQ ID NO: 582683 - RNA, 63 nt, Homo Sapiens
cucccgugcuucccuuuggcuguuccauccucugugcaaaaucccagcucucaggguugacuc

SEQ ID NO: 582684 - RNA, 63 nt, Homo Sapiens
cuguggaaaacuguucuugggacugucucaacugugcaaaaaacaaaagauggaguguuuaca

SEQ ID NO: 582685 - RNA, 63 nt, Homo Sapiens
agcccuagcccuagauagauagcuauuagguuggugcaaaaguaauugugguuuuugccauaa

SEQ ID NO: 582686 - RNA, 63 nt, Homo Sapiens
caguuuucaccuagccagucuugagucuucuccgugcaaaaaggauucacagaaauggaccag

SEQ ID NO: 582687 - RNA, 63 nt, Homo Sapiens
ucacccaaauuccuaugauguuuuuaauacugagugcaaaaggaaagagcaacuugaugguuu

SEQ ID NO: 582688 - RNA, 63 nt, Homo Sapiens
uuugauucucuuuuguagcuaccaguuaacuuggugcaaaacugguuccuuaauggcacuuua

SEQ ID NO: 582689 - RNA, 63 nt, Homo Sapiens
aguugugagccauucuauuauauuaaaguauaugugcaaaaacugauuuuacccaagccuaag

SEQ ID NO: 582690 - RNA, 63 nt, Homo Sapiens
aagacggcgaguguggcucuucacccagggugagugcaaaauacaggagcggccugcccagug

SEQ ID NO: 582691 - RNA, 63 nt, Homo Sapiens
caauguaauguauauuguauugaaauuuacagugugcaaaaguauuuuaccuuugcauaagug

SEQ ID NO: 582692 - RNA, 63 nt, Homo Sapiens
augaaccuuccaccgucuucacugcauccuggagugcaaaaauaaaauccacucaagagucac

SEQ ID NO: 582693 - RNA, 63 nt, Homo Sapiens
ugaaacaagagaaaguggccugagucucugagagugcaaaacuauuucucuaacuuaacaugu

SEQ ID NO: 582694 - RNA, 63 nt, Homo Sapiens
agaaaaagaacuguugguuaaggggaaaugaaugugcaaaaaaaaguucacuuuuuuuguucu

SEQ ID NO: 582695 - RNA, 63 nt, Homo Sapiens
cgcuuccugagcguagggugugcaguagugugugugcaaaaucuucagugaacucuguaugaa

SEQ ID NO: 582696 - RNA, 63 nt, Homo Sapiens
uagcugaugagcuaaaacaaaaaacaaugguuugugcaaaaaucucauaauguuuuaauaaag

SEQ ID NO: 582697 - RNA, 63 nt, Homo Sapiens
gcagguacccauuuuaggacccuacacucaaaugugcaaaauaaaauuucuaucauuuugcua

SEQ ID NO: 582698 - RNA, 63 nt, Homo Sapiens
cgucacaguccugguuucuggaaaagagaaugugugcaaaacauagucacacacugugaaagu

SEQ ID NO: 582699 - RNA, 63 nt, Homo Sapiens
auuagcaguuaugcaauggauuguggcucccuggugcaaaacaaaggcuaguuuuagcuuccu

SEQ ID NO: 582700 - RNA, 63 nt, Homo Sapiens
ugaagaaaauaaggcugcauuuugaaauguuaagugcaaaaugacugauguuaaaaccaucug

SEQ ID NO: 582701 - RNA, 63 nt, Homo Sapiens
uguugcuuuuguuaugucaaguugaaagauuuugugcaaaauuaaauaaaugguguuuugggu

SEQ ID NO: 582702 - RNA, 63 nt, Homo Sapiens
agcuugaugccaguaggcucaacuagggagugagugcaaaaagcugaguauggugagagaagc

SEQ ID NO: 582703 - RNA, 63 nt, Homo Sapiens
uccugcauggaccuuucccaagcgcuagcacaggugcaaaauccaucagagccauuguuuuca

SEQ ID NO: 582704 - RNA, 63 nt, Homo Sapiens
uuuuugugugaaguaaauuaaucaacuagagaggugcaaaacguucucaguugauaucugagu

SEQ ID NO: 582705 - RNA, 63 nt, Homo Sapiens
ucuaacagauuuuccaucaacaaauauuguuaugugcaaaaguauugccuauguuguuuuaca

SEQ ID NO: 582706 - RNA, 63 nt, Homo Sapiens
uuaccagcuccuaccaguccagugugcuuauaagugcaaaagaaaguaaaggcaaccccagau

SEQ ID NO: 582707 - RNA, 63 nt, Homo Sapiens
guauauagguguacuuugcuucucacaaugauugugcaaaaagucacguguaaauugaacuuu

SEQ ID NO: 582708 - RNA, 63 nt, Homo Sapiens
cuuuacuucagaaugguuuaaaguauugucagugugcaaaagguggccucgcugaugucugau

SEQ ID NO: 582709 - RNA, 63 nt, Homo Sapiens
cuucuguggcgaggcaugcuacucugacuuaaagugcaaaaaguuucaacgccugccuuuggc

SEQ ID NO: 582710 - RNA, 63 nt, Homo Sapiens
guuaacguccaaaacgcuuaccaguuucugaaugugcaaaauggagcacugccuauuugguau

SEQ ID NO: 582711 - RNA, 63 nt, Homo Sapiens
gaauuaauuucaaauaggaaugggucacuuguugugcaaaagugugccgcuggaauuggcuug

SEQ ID NO: 582712 - RNA, 63 nt, Homo Sapiens
acuggauuauaaguucuauuuacagcaaaagaugugcaaaaucgaauuuaaaacuguuauuuu

SEQ ID NO: 582713 - RNA, 64 nt, Homo Sapiens; identical to SEQ ID NO: 312521

SEQ ID NO: 582714 - RNA, 64 nt, Homo Sapiens; identical to SEQ ID NO: 312522

SEQ ID NO: 582715 - RNA, 64 nt, Homo Sapiens; identical to SEQ ID NO: 312523

SEQ ID NO: 582716 - RNA, 64 nt, Homo Sapiens; identical to SEQ ID NO: 312524

SEQ ID NO: 582717 - RNA, 64 nt, Homo Sapiens; identical to SEQ ID NO: 312525

SEQ ID NO: 582718 - RNA, 64 nt, Homo Sapiens; identical to SEQ ID NO: 312526

SEQ ID NO: 582719 - RNA, 64 nt, Homo Sapiens; identical to SEQ ID NO: 312527

SEQ ID NO: 582720 - RNA, 64 nt, Homo Sapiens; identical to SEQ ID NO: 312528

SEQ ID NO: 582721 - RNA, 64 nt, Homo Sapiens; identical to SEQ ID NO: 312529

SEQ ID NO: 582722 - RNA, 64 nt, Homo Sapiens; identical to SEQ ID NO: 312530

SEQ ID NO: 582723 - RNA, 64 nt, Homo Sapiens; identical to SEQ ID NO: 312531

SEQ ID NO: 582724 - RNA, 64 nt, Homo Sapiens; identical to SEQ ID NO: 312532

SEQ ID NO: 582725 - RNA, 64 nt, Homo Sapiens; identical to SEQ ID NO: 312533

SEQ ID NO: 582726 - RNA, 64 nt, Homo Sapiens; identical to SEQ ID NO: 312534

SEQ ID NO: 582727 - RNA, 64 nt, Homo Sapiens; identical to SEQ ID NO: 312535

SEQ ID NO: 582728 - RNA, 64 nt, Homo Sapiens; identical to SEQ ID NO: 312536

SEQ ID NO: 582729 - RNA, 64 nt, Homo Sapiens; identical to SEQ ID NO: 312537

SEQ ID NO: 582730 - RNA, 64 nt, Homo Sapiens; identical to SEQ ID NO: 312538

SEQ ID NO: 582731 - RNA, 64 nt, Homo Sapiens; identical to SEQ ID NO: 312539

SEQ ID NO: 582732 - RNA, 64 nt, Homo Sapiens; identical to SEQ ID NO: 312540

SEQ ID NO: 582733 - RNA, 64 nt, Homo Sapiens; identical to SEQ ID NO: 312541

SEQ ID NO: 582734 - RNA, 64 nt, Homo Sapiens; identical to SEQ ID NO: 312542

SEQ ID NO: 582735 - RNA, 64 nt, Homo Sapiens; identical to SEQ ID NO: 312543

SEQ ID NO: 582736 - RNA, 64 nt, Homo Sapiens; identical to SEQ ID NO: 312544

SEQ ID NO: 582737 - RNA, 64 nt, Homo Sapiens; identical to SEQ ID NO: 312545

SEQ ID NO: 582738 - RNA, 64 nt, Homo Sapiens; identical to SEQ ID NO: 312546

SEQ ID NO: 582739 - RNA, 64 nt, Homo Sapiens; identical to SEQ ID NO: 312547

SEQ ID NO: 582740 - RNA, 64 nt, Homo Sapiens; identical to SEQ ID NO: 312548

SEQ ID NO: 582741 - RNA, 64 nt, Homo Sapiens; identical to SEQ ID NO: 312549

SEQ ID NO: 582742 - RNA, 64 nt, Homo Sapiens; identical to SEQ ID NO: 312550

SEQ ID NO: 582743 - RNA, 64 nt, Homo Sapiens; identical to SEQ ID NO: 312551

SEQ ID NO: 582744 - RNA, 64 nt, Homo Sapiens; identical to SEQ ID NO: 312552

SEQ ID NO: 582745 - RNA, 64 nt, Homo Sapiens; identical to SEQ ID NO: 312553

SEQ ID NO: 582746 - RNA, 64 nt, Homo Sapiens; identical to SEQ ID NO: 312554

SEQ ID NO: 582747 - RNA, 64 nt, Homo Sapiens; identical to SEQ ID NO: 312555

SEQ ID NO: 582748 - RNA, 64 nt, Homo Sapiens; identical to SEQ ID NO: 312556

SEQ ID NO: 582749 - RNA, 64 nt, Homo Sapiens; identical to SEQ ID NO: 312557

SEQ ID NO: 582750 - RNA, 64 nt, Homo Sapiens; identical to SEQ ID NO: 312558

SEQ ID NO: 582751 - RNA, 64 nt, Homo Sapiens; identical to SEQ ID NO: 312559

SEQ ID NO: 582752 - RNA, 64 nt, Homo Sapiens; identical to SEQ ID NO: 312560

SEQ ID NO: 582753 - RNA, 64 nt, Homo Sapiens; identical to SEQ ID NO: 312561

SEQ ID NO: 582754 - RNA, 64 nt, Homo Sapiens; identical to SEQ ID NO: 312562

SEQ ID NO: 582755 - RNA, 64 nt, Homo Sapiens; identical to SEQ ID NO: 312563

SEQ ID NO: 582756 - RNA, 64 nt, Homo Sapiens; identical to SEQ ID NO: 312564

SEQ ID NO: 582757 - RNA, 64 nt, Homo Sapiens; identical to SEQ ID NO: 312565

SEQ ID NO: 582758 - RNA, 64 nt, Homo Sapiens; identical to SEQ ID NO: 312566

SEQ ID NO: 582759 - RNA, 64 nt, Homo Sapiens; identical to SEQ ID NO: 312567

SEQ ID NO: 582760 - RNA, 64 nt, Homo Sapiens; identical to SEQ ID NO: 312568

SEQ ID NO: 582761 - RNA, 62 nt, Homo Sapiens
augauuguaugaaguuuuaaaaaaaacuacagcagccaaagaaacuauauauauauauauau

SEQ ID NO: 582762 - RNA, 62 nt, Homo Sapiens
ucugggaauaucauagaguaacaagugcuggucagccaaagaaacauucacugcuggugaac

SEQ ID NO: 582763 - RNA, 62 nt, Homo Sapiens
augcugggauuacaggcaugagccacuguacccagccaaaauuguuuucuuuuuuaagugaa

SEQ ID NO: 582764 - RNA, 62 nt, Homo Sapiens
gagcuuacagucuguucuggggaacagagauucagccaaagucaagaaacacuggaugccag

SEQ ID NO: 582765 - RNA, 62 nt, Homo Sapiens
cugguguuauucugucuccucuucuuugucaucagccaaaacgugguuuuuaaagagaguca

SEQ ID NO: 582766 - RNA, 62 nt, Homo Sapiens
ccuaguguuccuauagugaaauaaguaggguucagccaaagcuuucuuuguuuuguaccuua

SEQ ID NO: 582767 - RNA, 62 nt, Homo Sapiens
ucacagauggcuucucacagaugcccuccugccagccaaaccggacuuguucuuccugccuc

SEQ ID NO: 582768 - RNA, 62 nt, Homo Sapiens
gaauuaguguguuauguggauaauguuauauacagccaaaguggauguuucuauuuggcaag

SEQ ID NO: 582769 - RNA, 62 nt, Homo Sapiens
acgggcagccacaggacugagcccucucacuccagccaaagaaaugggccugccugccucca

SEQ ID NO: 582770 - RNA, 62 nt, Homo Sapiens
gaagaagugggagcagcuucuugggcugagugcagccaaaggggagccagaaaugggcaguu

SEQ ID NO: 582771 - RNA, 62 nt, Homo Sapiens
uccuuuuuacaauuugugaucuaugccgaaugcagccaaaauucacucagauuguccguuug

SEQ ID NO: 582772 - RNA, 62 nt, Homo Sapiens
ucaaaacaguuaaucucccuuuuugggugguucagccaaaccuagcggaaacuacuaaauua

SEQ ID NO: 582773 - RNA, 62 nt, Homo Sapiens
uccuguagcaguagggcccccagccagcgcuccagccaaagcggcggccccaggguuaauug

SEQ ID NO: 582774 - RNA, 62 nt, Homo Sapiens
gcggcuggcaggcaggauguuuugaaauggugcagccaaaggccccgucuagcuuggcuggc

SEQ ID NO: 582775 - RNA, 62 nt, Homo Sapiens
cuaucugguaauaaaauuuccucugggagacucagccaaaucuggggcacccccaaauuuga

SEQ ID NO: 582776 - RNA, 62 nt, Homo Sapiens
ugcagucggaaaagaugcaguuguaggaaaugcagccaaagguucuuuuuacauaaaggaau

SEQ ID NO: 582777 - RNA, 62 nt, Homo Sapiens
guuuagaaacacucagucucagcaccucaguccagccaaaauccuucauggagggugguaac

SEQ ID NO: 582778 - RNA, 62 nt, Homo Sapiens
gcuucucaacccuagacaaaagugagaccacccagccaaauuugggcucuguuuaggagggc

SEQ ID NO: 582779 - RNA, 62 nt, Homo Sapiens
ccugacagcagggucugcccgccuccugacaccagccaaaaugggaucccugcacccaggag

SEQ ID NO: 582780 - RNA, 62 nt, Homo Sapiens
cuucauccggcaccuucuggacaucucagaaucagccaaagaugacucuccuuucugggaug

SEQ ID NO: 582781 - RNA, 62 nt, Homo Sapiens
ccuggcacccccagggugacgagugccugggucagccaaaccguggggcugaaggccaggcu

SEQ ID NO: 582782 - RNA, 64 nt, Homo Sapiens; identical to SEQ ID NO: 497835

SEQ ID NO: 582783 - RNA, 64 nt, Homo Sapiens; identical to SEQ ID NO: 497836

SEQ ID NO: 582784 - RNA, 64 nt, Homo Sapiens; identical to SEQ ID NO: 497837

SEQ ID NO: 582785 - RNA, 64 nt, Homo Sapiens; identical to SEQ ID NO: 497838

SEQ ID NO: 582786 - RNA, 64 nt, Homo Sapiens; identical to SEQ ID NO: 497839

SEQ ID NO: 582787 - RNA, 64 nt, Homo Sapiens; identical to SEQ ID NO: 497840

SEQ ID NO: 582788 - RNA, 64 nt, Homo Sapiens; identical to SEQ ID NO: 497841

SEQ ID NO: 582789 - RNA, 64 nt, Homo Sapiens; identical to SEQ ID NO: 497842

SEQ ID NO: 582790 - RNA, 64 nt, Homo Sapiens; identical to SEQ ID NO: 497843

SEQ ID NO: 582791 - RNA, 64 nt, Homo Sapiens; identical to SEQ ID NO: 497844

SEQ ID NO: 582792 - RNA, 64 nt, Homo Sapiens; identical to SEQ ID NO: 497845

SEQ ID NO: 582793 - RNA, 64 nt, Homo Sapiens; identical to SEQ ID NO: 497846

SEQ ID NO: 582794 - RNA, 64 nt, Homo Sapiens; identical to SEQ ID NO: 497847

SEQ ID NO: 582795 - RNA, 64 nt, Homo Sapiens; identical to SEQ ID NO: 497848

SEQ ID NO: 582796 - RNA, 64 nt, Homo Sapiens; identical to SEQ ID NO: 497849

SEQ ID NO: 582797 - RNA, 64 nt, Homo Sapiens; identical to SEQ ID NO: 497850

SEQ ID NO: 582798 - RNA, 64 nt, Homo Sapiens; identical to SEQ ID NO: 57590

SEQ ID NO: 582799 - RNA, 64 nt, Homo Sapiens; identical to SEQ ID NO: 57591

SEQ ID NO: 582800 - RNA, 64 nt, Homo Sapiens
guucuugggauggagucaguauaaugucauuugaaccucacaauuucagagcaccuucacucac

SEQ ID NO: 582801 - RNA, 64 nt, Homo Sapiens
cuuccauguucccuucuuaacccccgaagacggaaccucacaguugucggguacacagugugaa

SEQ ID NO: 582802 - RNA, 64 nt, Homo Sapiens
auguauuauggugccauggcguaauauucuagguaccucacaaacacauuuuuuguuuccauua

SEQ ID NO: 582803 - RNA, 64 nt, Homo Sapiens
uuuuguuuccauuaguaauaggaaaggucgguuuaccucacauucuggcuucaaaguuucuugg

SEQ ID NO: 582804 - RNA, 64 nt, Homo Sapiens
gagaauugacgagaagccagcucacccaucccagaccucacagucccucagguucuacugggau

SEQ ID NO: 582805 - RNA, 64 nt, Homo Sapiens
ccucaucuguaaaugaagaaaguaggcccugucuaccucacaugcaggucuagggugaggauug

SEQ ID NO: 582806 - RNA, 64 nt, Homo Sapiens
aaguuguaaugaguacagaguaauaauuaaaauaaccucacaaguuuaagaauuuuuuaagaag

SEQ ID NO: 582807 - RNA, 64 nt, Homo Sapiens
uuuuuuugaauuugugaaagaauacuggcauaaaaccucacagacuguugaauaucagaugguu

SEQ ID NO: 582808 - RNA, 64 nt, Homo Sapiens
guuuugcuuuguagcccucacuacuggccaccugaccucacaccugacccugaccccuccucac

SEQ ID NO: 582809 - RNA, 64 nt, Homo Sapiens
uuaaagaaaaaaaaaaguaaaaaccaaacacaacaccucacaaguuguaacucuugguccuucu

SEQ ID NO: 582810 - RNA, 64 nt, Homo Sapiens
acaggugggguagagagugggucagcagccuggcaccucacagaggugggaccuaagaggacuc

SEQ ID NO: 582811 - RNA, 64 nt, Homo Sapiens
ggaagauguuugacuauugcugcucuucaccagaaccucacaccucuccugggacuggaacccu

SEQ ID NO: 582812 - RNA, 64 nt, Homo Sapiens
accccagcaacuguggugguggauauauuccuuuaccucacauguguugggcuaacagucaauu

SEQ ID NO: 582813 - RNA, 52 nt, Homo Sapiens
gccucugcagauggaucccucgaccucacacauuuccaaacaucuucuguag

SEQ ID NO: 582814 - RNA, 64 nt, Homo Sapiens
caaccuggugcuaggucauuucacuuuucugaaaaccucacaucaggcugcauccucuucuguc

SEQ ID NO: 582815 - RNA, 64 nt, Homo Sapiens
ugccccccaccaguggcuucuagggaaagcaaggaccucacaugccaggugcccuaguacuugc

SEQ ID NO: 582816 - RNA, 64 nt, Homo Sapiens
aucuugcuccacucggcaucuccacuacaaagucaccucacagcuucccaaucauugucuucau

SEQ ID NO: 582817 - RNA, 64 nt, Homo Sapiens
agaaccauggccuuggauuauuuuguaaaauauaaccucacauaagguuacaugugagucaaaa

SEQ ID NO: 582818 - RNA, 64 nt, Homo Sapiens
aaacaggaaauuggaauuccuuuguccaggagaaaccucacaaaccuucuuuaaggcauaguuu

SEQ ID NO: 582819 - RNA, 64 nt, Homo Sapiens
aaccucuuaaaucauagcugucugaccucuacggaccucacauccaucugaggcuucauggaca

SEQ ID NO: 582820 - RNA, 64 nt, Homo Sapiens
caucuguggcugggacagcccagggggugugcccacggcugacccaggggugugcacacggcug

SEQ ID NO: 582821 - RNA, 64 nt, Homo Sapiens
ggggugugcccacggcugacccaggggugugcacacggcugagcugggagucccgcuggucucc

SEQ ID NO: 582822 - RNA, 64 nt, Homo Sapiens; identical to SEQ ID NO: 244040

SEQ ID NO: 582823 - RNA, 64 nt, Homo Sapiens; identical to SEQ ID NO: 244041

SEQ ID NO: 582824 - RNA, 64 nt, Homo Sapiens; identical to SEQ ID NO: 244042

SEQ ID NO: 582825 - RNA, 64 nt, Homo Sapiens; identical to SEQ ID NO: 244043

SEQ ID NO: 582826 - RNA, 64 nt, Homo Sapiens; identical to SEQ ID NO: 244044

SEQ ID NO: 582827 - RNA, 64 nt, Homo Sapiens; identical to SEQ ID NO: 244045

SEQ ID NO: 582828 - RNA, 64 nt, Homo Sapiens; identical to SEQ ID NO: 244046

SEQ ID NO: 582829 - RNA, 64 nt, Homo Sapiens; identical to SEQ ID NO: 244047

SEQ ID NO: 582830 - RNA, 64 nt, Homo Sapiens; identical to SEQ ID NO: 244048

SEQ ID NO: 582831 - RNA, 64 nt, Homo Sapiens; identical to SEQ ID NO: 244049

SEQ ID NO: 582832 - RNA, 64 nt, Homo Sapiens; identical to SEQ ID NO: 244050

SEQ ID NO: 582833 - RNA, 64 nt, Homo Sapiens; identical to SEQ ID NO: 244051

SEQ ID NO: 582834 - RNA, 64 nt, Homo Sapiens; identical to SEQ ID NO: 244052

SEQ ID NO: 582835 - RNA, 64 nt, Homo Sapiens; identical to SEQ ID NO: 244053

SEQ ID NO: 582836 - RNA, 64 nt, Homo Sapiens; identical to SEQ ID NO: 244054

SEQ ID NO: 582837 - RNA, 64 nt, Homo Sapiens; identical to SEQ ID NO: 244055

SEQ ID NO: 582838 - RNA, 64 nt, Homo Sapiens
gaaaacuugaaaagaguggaagaguaaguugcaaccuugugacugauuaucuugugaaacgaug

SEQ ID NO: 582839 - RNA, 64 nt, Homo Sapiens
uucgcuaguuaaugugugcucaccccuaaucuagccuugugagcccaggaauuagauuucugua

SEQ ID NO: 582840 - RNA, 64 nt, Homo Sapiens
ugcauugacuuuccccaccagaugcugaaaauguccuugugaugugcacguaaaguacuuguag

SEQ ID NO: 582841 - RNA, 64 nt, Homo Sapiens
aacuccuaguucuagaaaaacaggcacuuggcagccuugugaugucauacagagaagucacagg

SEQ ID NO: 582842 - RNA, 64 nt, Homo Sapiens
ggcucacucccuugccucucccccuccaccaccaccuugugacugaugguuugguuuccucucu

SEQ ID NO: 582843 - RNA, 64 nt, Homo Sapiens
guuguaagugcaaugacccgaguccuccacaugaccuugugaauugugugcuguccuucugugc

SEQ ID NO: 582844 - RNA, 64 nt, Homo Sapiens
ucuucuuugaccccuugauuuauuuucuaauuucccuugugauuuguuuucauucaucucaaag

SEQ ID NO: 582845 - RNA, 64 nt, Homo Sapiens
caaggaugaagucucaguugauucucuuuuuaguccuugugagaaaccacauaaugagaacauu

SEQ ID NO: 582846 - RNA, 64 nt, Homo Sapiens
cacgugcaauacggaacacugucaauggacugcaccuugugaaggaaaaacaugcuuaaggggg

SEQ ID NO: 582847 - RNA, 64 nt, Homo Sapiens
ucuccacgcacucagcuauaccucauucacagcuccuugugagugugugcacaggaaauaagcc

SEQ ID NO: 582848 - RNA, 64 nt, Homo Sapiens
uaggugaucuuugugacccagugauauucuauuaccuugugaaggcccugccuccacuugccuu

SEQ ID NO: 582849 - RNA, 64 nt, Homo Sapiens
uucuauuaccuugugaaguaccugccuccacuugccuugugauacuguguuccugugaucucgc

SEQ ID NO: 582850 - RNA, 64 nt, Homo Sapiens
ucuuaugccugucuuuacuuuccccaaucaauacccuugugauuuuucauggacacugaucacu

SEQ ID NO: 582851 - RNA, 64 nt, Homo Sapiens
gcuuguucccauugccaaauggauuuagaaauucccuugugagugccugguagcuaauacacug

SEQ ID NO: 582852 - RNA, 64 nt, Homo Sapiens
uuaguaucaacauuuuagaaugucaaauuugaugccuugugaacaaguaauuuuauauugugcu

SEQ ID NO: 582853 - RNA, 64 nt, Homo Sapiens; identical to SEQ ID NO: 244040

SEQ ID NO: 582854 - RNA, 64 nt, Homo Sapiens; identical to SEQ ID NO: 244041

SEQ ID NO: 582855 - RNA, 64 nt, Homo Sapiens; identical to SEQ ID NO: 244042

SEQ ID NO: 582856 - RNA, 64 nt, Homo Sapiens; identical to SEQ ID NO: 244043

SEQ ID NO: 582857 - RNA, 64 nt, Homo Sapiens; identical to SEQ ID NO: 244044

SEQ ID NO: 582858 - RNA, 64 nt, Homo Sapiens; identical to SEQ ID NO: 244045

SEQ ID NO: 582859 - RNA, 64 nt, Homo Sapiens; identical to SEQ ID NO: 244046

SEQ ID NO: 582860 - RNA, 64 nt, Homo Sapiens; identical to SEQ ID NO: 244047

SEQ ID NO: 582861 - RNA, 64 nt, Homo Sapiens; identical to SEQ ID NO: 244048

SEQ ID NO: 582862 - RNA, 64 nt, Homo Sapiens; identical to SEQ ID NO: 244049

SEQ ID NO: 582863 - RNA, 64 nt, Homo Sapiens; identical to SEQ ID NO: 244050

SEQ ID NO: 582864 - RNA, 64 nt, Homo Sapiens; identical to SEQ ID NO: 244051

SEQ ID NO: 582865 - RNA, 64 nt, Homo Sapiens; identical to SEQ ID NO: 244052

SEQ ID NO: 582866 - RNA, 64 nt, Homo Sapiens; identical to SEQ ID NO: 244053

SEQ ID NO: 582867 - RNA, 64 nt, Homo Sapiens; identical to SEQ ID NO: 244054

SEQ ID NO: 582868 - RNA, 64 nt, Homo Sapiens; identical to SEQ ID NO: 244055

SEQ ID NO: 582869 - RNA, 64 nt, Homo Sapiens; identical to SEQ ID NO: 582838

SEQ ID NO: 582870 - RNA, 64 nt, Homo Sapiens; identical to SEQ ID NO: 582839

SEQ ID NO: 582871 - RNA, 64 nt, Homo Sapiens; identical to SEQ ID NO: 582840

SEQ ID NO: 582872 - RNA, 64 nt, Homo Sapiens; identical to SEQ ID NO: 582841

SEQ ID NO: 582873 - RNA, 64 nt, Homo Sapiens; identical to SEQ ID NO: 582842

SEQ ID NO: 582874 - RNA, 64 nt, Homo Sapiens; identical to SEQ ID NO: 582843

SEQ ID NO: 582875 - RNA, 64 nt, Homo Sapiens; identical to SEQ ID NO: 582844

SEQ ID NO: 582876 - RNA, 64 nt, Homo Sapiens; identical to SEQ ID NO: 582845

SEQ ID NO: 582877 - RNA, 64 nt, Homo Sapiens; identical to SEQ ID NO: 582846

SEQ ID NO: 582878 - RNA, 64 nt, Homo Sapiens; identical to SEQ ID NO: 582847

SEQ ID NO: 582879 - RNA, 64 nt, Homo Sapiens; identical to SEQ ID NO: 582848

SEQ ID NO: 582880 - RNA, 64 nt, Homo Sapiens; identical to SEQ ID NO: 582849

SEQ ID NO: 582881 - RNA, 64 nt, Homo Sapiens; identical to SEQ ID NO: 582850

SEQ ID NO: 582882 - RNA, 64 nt, Homo Sapiens; identical to SEQ ID NO: 582851

SEQ ID NO: 582883 - RNA, 64 nt, Homo Sapiens; identical to SEQ ID NO: 582852

SEQ ID NO: 582884 - RNA, 64 nt, Homo Sapiens; identical to SEQ ID NO: 244040

SEQ ID NO: 582885 - RNA, 64 nt, Homo Sapiens; identical to SEQ ID NO: 244041

SEQ ID NO: 582886 - RNA, 64 nt, Homo Sapiens; identical to SEQ ID NO: 244042

SEQ ID NO: 582887 - RNA, 64 nt, Homo Sapiens; identical to SEQ ID NO: 244043

SEQ ID NO: 582888 - RNA, 64 nt, Homo Sapiens; identical to SEQ ID NO: 244044

SEQ ID NO: 582889 - RNA, 64 nt, Homo Sapiens; identical to SEQ ID NO: 244045

SEQ ID NO: 582890 - RNA, 64 nt, Homo Sapiens; identical to SEQ ID NO: 244046

SEQ ID NO: 582891 - RNA, 64 nt, Homo Sapiens; identical to SEQ ID NO: 244047

SEQ ID NO: 582892 - RNA, 64 nt, Homo Sapiens; identical to SEQ ID NO: 244048

SEQ ID NO: 582893 - RNA, 64 nt, Homo Sapiens; identical to SEQ ID NO: 244049

SEQ ID NO: 582894 - RNA, 64 nt, Homo Sapiens; identical to SEQ ID NO: 244050

SEQ ID NO: 582895 - RNA, 64 nt, Homo Sapiens; identical to SEQ ID NO: 244051

SEQ ID NO: 582896 - RNA, 64 nt, Homo Sapiens; identical to SEQ ID NO: 244052

SEQ ID NO: 582897 - RNA, 64 nt, Homo Sapiens; identical to SEQ ID NO: 244053

SEQ ID NO: 582898 - RNA, 64 nt, Homo Sapiens; identical to SEQ ID NO: 244054

SEQ ID NO: 582899 - RNA, 64 nt, Homo Sapiens; identical to SEQ ID NO: 244055

SEQ ID NO: 582900 - RNA, 64 nt, Homo Sapiens; identical to SEQ ID NO: 582838

SEQ ID NO: 582901 - RNA, 64 nt, Homo Sapiens; identical to SEQ ID NO: 582839

SEQ ID NO: 582902 - RNA, 64 nt, Homo Sapiens; identical to SEQ ID NO: 582840

SEQ ID NO: 582903 - RNA, 64 nt, Homo Sapiens; identical to SEQ ID NO: 582841

SEQ ID NO: 582904 - RNA, 64 nt, Homo Sapiens; identical to SEQ ID NO: 582842

SEQ ID NO: 582905 - RNA, 64 nt, Homo Sapiens; identical to SEQ ID NO: 582843

SEQ ID NO: 582906 - RNA, 64 nt, Homo Sapiens; identical to SEQ ID NO: 582844

SEQ ID NO: 582907 - RNA, 64 nt, Homo Sapiens; identical to SEQ ID NO: 582845

SEQ ID NO: 582908 - RNA, 64 nt, Homo Sapiens; identical to SEQ ID NO: 582846

SEQ ID NO: 582909 - RNA, 64 nt, Homo Sapiens; identical to SEQ ID NO: 582847

SEQ ID NO: 582910 - RNA, 64 nt, Homo Sapiens; identical to SEQ ID NO: 582848

SEQ ID NO: 582911 - RNA, 64 nt, Homo Sapiens; identical to SEQ ID NO: 582849

SEQ ID NO: 582912 - RNA, 64 nt, Homo Sapiens; identical to SEQ ID NO: 582850

SEQ ID NO: 582913 - RNA, 64 nt, Homo Sapiens; identical to SEQ ID NO: 582851

SEQ ID NO: 582914 - RNA, 64 nt, Homo Sapiens; identical to SEQ ID NO: 582852

SEQ ID NO: 582915 - RNA, 64 nt, Homo Sapiens; identical to SEQ ID NO: 244040

SEQ ID NO: 582916 - RNA, 64 nt, Homo Sapiens; identical to SEQ ID NO: 244041

SEQ ID NO: 582917 - RNA, 64 nt, Homo Sapiens; identical to SEQ ID NO: 244042

SEQ ID NO: 582918 - RNA, 64 nt, Homo Sapiens; identical to SEQ ID NO: 244043

SEQ ID NO: 582919 - RNA, 64 nt, Homo Sapiens; identical to SEQ ID NO: 244044

SEQ ID NO: 582920 - RNA, 64 nt, Homo Sapiens; identical to SEQ ID NO: 244045

SEQ ID NO: 582921 - RNA, 64 nt, Homo Sapiens; identical to SEQ ID NO: 244046

SEQ ID NO: 582922 - RNA, 64 nt, Homo Sapiens; identical to SEQ ID NO: 244047

SEQ ID NO: 582923 - RNA, 64 nt, Homo Sapiens; identical to SEQ ID NO: 244048

SEQ ID NO: 582924 - RNA, 64 nt, Homo Sapiens; identical to SEQ ID NO: 244049

SEQ ID NO: 582925 - RNA, 64 nt, Homo Sapiens; identical to SEQ ID NO: 244050

SEQ ID NO: 582926 - RNA, 64 nt, Homo Sapiens; identical to SEQ ID NO: 244051

SEQ ID NO: 582927 - RNA, 64 nt, Homo Sapiens; identical to SEQ ID NO: 244052

SEQ ID NO: 582928 - RNA, 64 nt, Homo Sapiens; identical to SEQ ID NO: 244053

SEQ ID NO: 582929 - RNA, 64 nt, Homo Sapiens; identical to SEQ ID NO: 244054

SEQ ID NO: 582930 - RNA, 64 nt, Homo Sapiens; identical to SEQ ID NO: 244055

SEQ ID NO: 582931 - RNA, 64 nt, Homo Sapiens; identical to SEQ ID NO: 582838

SEQ ID NO: 582932 - RNA, 64 nt, Homo Sapiens; identical to SEQ ID NO: 582839

SEQ ID NO: 582933 - RNA, 64 nt, Homo Sapiens; identical to SEQ ID NO: 582840

SEQ ID NO: 582934 - RNA, 64 nt, Homo Sapiens; identical to SEQ ID NO: 582841

SEQ ID NO: 582935 - RNA, 64 nt, Homo Sapiens; identical to SEQ ID NO: 582842

SEQ ID NO: 582936 - RNA, 64 nt, Homo Sapiens; identical to SEQ ID NO: 582843

SEQ ID NO: 582937 - RNA, 64 nt, Homo Sapiens; identical to SEQ ID NO: 582844

SEQ ID NO: 582938 - RNA, 64 nt, Homo Sapiens; identical to SEQ ID NO: 582845

SEQ ID NO: 582939 - RNA, 64 nt, Homo Sapiens; identical to SEQ ID NO: 582846

SEQ ID NO: 582940 - RNA, 64 nt, Homo Sapiens; identical to SEQ ID NO: 582847

SEQ ID NO: 582941 - RNA, 64 nt, Homo Sapiens; identical to SEQ ID NO: 582848

SEQ ID NO: 582942 - RNA, 64 nt, Homo Sapiens; identical to SEQ ID NO: 582849

SEQ ID NO: 582943 - RNA, 64 nt, Homo Sapiens; identical to SEQ ID NO: 582850

SEQ ID NO: 582944 - RNA, 64 nt, Homo Sapiens; identical to SEQ ID NO: 582851

SEQ ID NO: 582945 - RNA, 64 nt, Homo Sapiens; identical to SEQ ID NO: 582852

SEQ ID NO: 582946 - RNA, 64 nt, Homo Sapiens; identical to SEQ ID NO: 244040

SEQ ID NO: 582947 - RNA, 64 nt, Homo Sapiens; identical to SEQ ID NO: 244041

SEQ ID NO: 582948 - RNA, 64 nt, Homo Sapiens; identical to SEQ ID NO: 244042

SEQ ID NO: 582949 - RNA, 64 nt, Homo Sapiens; identical to SEQ ID NO: 244043

SEQ ID NO: 582950 - RNA, 64 nt, Homo Sapiens; identical to SEQ ID NO: 244044

SEQ ID NO: 582951 - RNA, 64 nt, Homo Sapiens; identical to SEQ ID NO: 244045

SEQ ID NO: 582952 - RNA, 64 nt, Homo Sapiens; identical to SEQ ID NO: 244046

SEQ ID NO: 582953 - RNA, 64 nt, Homo Sapiens; identical to SEQ ID NO: 244047

SEQ ID NO: 582954 - RNA, 64 nt, Homo Sapiens; identical to SEQ ID NO: 244048

SEQ ID NO: 582955 - RNA, 64 nt, Homo Sapiens; identical to SEQ ID NO: 244049

SEQ ID NO: 582956 - RNA, 64 nt, Homo Sapiens; identical to SEQ ID NO: 244050

SEQ ID NO: 582957 - RNA, 64 nt, Homo Sapiens; identical to SEQ ID NO: 244051

SEQ ID NO: 582958 - RNA, 64 nt, Homo Sapiens; identical to SEQ ID NO: 244052

SEQ ID NO: 582959 - RNA, 64 nt, Homo Sapiens; identical to SEQ ID NO: 244053

SEQ ID NO: 582960 - RNA, 64 nt, Homo Sapiens; identical to SEQ ID NO: 244054

SEQ ID NO: 582961 - RNA, 64 nt, Homo Sapiens; identical to SEQ ID NO: 244055

SEQ ID NO: 582962 - RNA, 64 nt, Homo Sapiens; identical to SEQ ID NO: 582838

SEQ ID NO: 582963 - RNA, 64 nt, Homo Sapiens; identical to SEQ ID NO: 582839

SEQ ID NO: 582964 - RNA, 64 nt, Homo Sapiens; identical to SEQ ID NO: 582840

SEQ ID NO: 582965 - RNA, 64 nt, Homo Sapiens; identical to SEQ ID NO: 582841

SEQ ID NO: 582966 - RNA, 64 nt, Homo Sapiens; identical to SEQ ID NO: 582842

SEQ ID NO: 582967 - RNA, 64 nt, Homo Sapiens; identical to SEQ ID NO: 582843

SEQ ID NO: 582968 - RNA, 64 nt, Homo Sapiens; identical to SEQ ID NO: 582844

SEQ ID NO: 582969 - RNA, 64 nt, Homo Sapiens; identical to SEQ ID NO: 582845

SEQ ID NO: 582970 - RNA, 64 nt, Homo Sapiens; identical to SEQ ID NO: 582846

SEQ ID NO: 582971 - RNA, 64 nt, Homo Sapiens; identical to SEQ ID NO: 582847

SEQ ID NO: 582972 - RNA, 64 nt, Homo Sapiens; identical to SEQ ID NO: 582848

SEQ ID NO: 582973 - RNA, 64 nt, Homo Sapiens; identical to SEQ ID NO: 582849

SEQ ID NO: 582974 - RNA, 64 nt, Homo Sapiens; identical to SEQ ID NO: 582850

SEQ ID NO: 582975 - RNA, 64 nt, Homo Sapiens; identical to SEQ ID NO: 582851

SEQ ID NO: 582976 - RNA, 64 nt, Homo Sapiens; identical to SEQ ID NO: 582852

SEQ ID NO: 582977 - RNA, 64 nt, Homo Sapiens; identical to SEQ ID NO: 411244

SEQ ID NO: 582978 - RNA, 64 nt, Homo Sapiens; identical to SEQ ID NO: 411245

SEQ ID NO: 582979 - RNA, 64 nt, Homo Sapiens; identical to SEQ ID NO: 411246

SEQ ID NO: 582980 - RNA, 64 nt, Homo Sapiens; identical to SEQ ID NO: 411247

SEQ ID NO: 582981 - RNA, 64 nt, Homo Sapiens; identical to SEQ ID NO: 411248

SEQ ID NO: 582982 - RNA, 64 nt, Homo Sapiens; identical to SEQ ID NO: 411249

SEQ ID NO: 582983 - RNA, 64 nt, Homo Sapiens; identical to SEQ ID NO: 411250

SEQ ID NO: 582984 - RNA, 64 nt, Homo Sapiens; identical to SEQ ID NO: 411251

SEQ ID NO: 582985 - RNA, 64 nt, Homo Sapiens; identical to SEQ ID NO: 411252

SEQ ID NO: 582986 - RNA, 64 nt, Homo Sapiens; identical to SEQ ID NO: 411253

SEQ ID NO: 582987 - RNA, 64 nt, Homo Sapiens; identical to SEQ ID NO: 411254

SEQ ID NO: 582988 - RNA, 64 nt, Homo Sapiens; identical to SEQ ID NO: 411255

SEQ ID NO: 582989 - RNA, 64 nt, Homo Sapiens; identical to SEQ ID NO: 209175

SEQ ID NO: 582990 - RNA, 64 nt, Homo Sapiens; identical to SEQ ID NO: 209176

SEQ ID NO: 582991 - RNA, 64 nt, Homo Sapiens; identical to SEQ ID NO: 209177

SEQ ID NO: 582992 - RNA, 64 nt, Homo Sapiens; identical to SEQ ID NO: 209178

SEQ ID NO: 582993 - RNA, 64 nt, Homo Sapiens; identical to SEQ ID NO: 88616

SEQ ID NO: 582994 - RNA, 64 nt, Homo Sapiens; identical to SEQ ID NO: 88617

SEQ ID NO: 582995 - RNA, 64 nt, Homo Sapiens; identical to SEQ ID NO: 88618

SEQ ID NO: 582996 - RNA, 64 nt, Homo Sapiens; identical to SEQ ID NO: 88619

SEQ ID NO: 582997 - RNA, 64 nt, Homo Sapiens; identical to SEQ ID NO: 88620

SEQ ID NO: 582998 - RNA, 64 nt, Homo Sapiens; identical to SEQ ID NO: 88621

SEQ ID NO: 582999 - RNA, 64 nt, Homo Sapiens; identical to SEQ ID NO: 88622

SEQ ID NO: 583000 - RNA, 64 nt, Homo Sapiens; identical to SEQ ID NO: 88623

SEQ ID NO: 583001 - RNA, 64 nt, Homo Sapiens
guauguagccuuuucagacuagaaugucauauuggaaucauauagccauaguucuuccuuuucu

SEQ ID NO: 583002 - RNA, 64 nt, Homo Sapiens
gaauaguuucacugcccuaauaucuacaauuauagaaucauacacuuagacaaauguaugauga

SEQ ID NO: 583003 - RNA, 64 nt, Homo Sapiens
uuguaggaaaagcuguucccauuaaccuaccugugaaucauauggcagugggagacuaagaugu

SEQ ID NO: 583004 - RNA, 64 nt, Homo Sapiens
caaaaacuuuuuuggaaacuugguuucuauacaugaaucauagccuguuguuucuuuuaugugg

SEQ ID NO: 583005 - RNA, 64 nt, Homo Sapiens
cuggguggcaucuggcagucauggguaacacuugcuuuuccaguuaauguggccaugugauucc

SEQ ID NO: 583006 - RNA, 64 nt, Homo Sapiens
cugaugcgugauagcuuaagcuuggggagaaggucuuuuccacugccuagcuaagcagucuggg

SEQ ID NO: 583007 - RNA, 64 nt, Homo Sapiens
cauuuccucacauguccacgagaugcuuggguugcuuuuccaggggcuaguuuggcuuuuccaa

SEQ ID NO: 583008 - RNA, 64 nt, Homo Sapiens
gaugcuuggguugcuuuuccaggggcuaguuuggcuuuuccaaguggguuuucuuuggagaauc

SEQ ID NO: 583009 - RNA, 64 nt, Homo Sapiens
aaagaaagggacagcauuugcugcccccaccccucuuuuccaguccuugccuuccaaccaaaag

SEQ ID NO: 583010 - RNA, 64 nt, Homo Sapiens
aagaaaauuggauuauuaggaauacaucuugacccuuuuccacucaauagaccagggaaagggg

SEQ ID NO: 583011 - RNA, 64 nt, Homo Sapiens
ggggcuaaaguuuguuuuuccagggcugcugauccuuuuccagauagcuccagaguaugaugac

SEQ ID NO: 583012 - RNA, 64 nt, Homo Sapiens
uaugguauuuauuggcauguccaauuugcuugcacuuuuccacaucagaccuuccacuuaaggg

SEQ ID NO: 583013 - RNA, 64 nt, Homo Sapiens
ucaauacaaaagagaaaagaagaaccucucagugcuuuuccaacgaauguaaaguggguuuaaa

SEQ ID NO: 583014 - RNA, 64 nt, Homo Sapiens
aaaugauucuguaucuuuuguguacaucuuguaucuuuuccaaaagguaugaaugugauuuguc

SEQ ID NO: 583015 - RNA, 64 nt, Homo Sapiens
uuaccacuguaccauuauuuuauuucagugggcacuuuuccauuggaagugaugaaauuauauu

SEQ ID NO: 583016 - RNA, 64 nt, Homo Sapiens
auagucuauagaacuggagaaugcaaauucaauacuuuuccauuaaauaucuuuuauuggaaau

SEQ ID NO: 583017 - RNA, 64 nt, Homo Sapiens
ugggugugcaugcuaaaaaccggaggagcaaguccuuuuccaacaagcgaaugaaugguguuuc

SEQ ID NO: 583018 - RNA, 64 nt, Homo Sapiens
cccuuuuacagcucuuggcacaucaccuuuuugacuuuuccaagaaucaauuauuacauuuaua

SEQ ID NO: 583019 - RNA, 64 nt, Homo Sapiens
gcuuauucuugagcacaaaauacuuuccuauuuucuuuuccauuauauuuuagggcuguagacu

SEQ ID NO: 583020 - RNA, 64 nt, Homo Sapiens
aagauuuggcaacucgauaaauuuuuuucauuuucuuuuccaaucuguaacuauaguuacugaa

SEQ ID NO: 583021 - RNA, 64 nt, Homo Sapiens
ugugcaauauauuacuaaaucaguuauuauuuuacuuuuccaaauucagagaaagaaaacagau

SEQ ID NO: 583022 - RNA, 64 nt, Homo Sapiens
aucauuugggcagcuuggguaaguacgcaacuuacuuuuccaccaaagaacugucagcagcugc

SEQ ID NO: 583023 - RNA, 64 nt, Homo Sapiens
ugccugcuuuucugugauguauguauccuguugacuuuuccagaaauuuuuuaagaguuugagu

SEQ ID NO: 583024 - RNA, 64 nt, Homo Sapiens
cagauuugugcacaugugagcuaaaacuuuaguacuuuuccauguaaaguacacaaguccaagu

SEQ ID NO: 583025 - RNA, 64 nt, Homo Sapiens
cucuuaauguauuccuuuuucuuucaguaagcaacuuuuccaugccuuacucuucggggguuuc

SEQ ID NO: 583026 - RNA, 64 nt, Homo Sapiens
uuaaaaaugaaguagaguauauuuuuaacaugugcuuuuccaaaaaugccuuuguauuaaaauu

SEQ ID NO: 583027 - RNA, 64 nt, Homo Sapiens
uauuacauucuauaguuaccuauauuuaguuuugcuuuuccagauaaaaguuugagcaccugau

SEQ ID NO: 583028 - RNA, 64 nt, Homo Sapiens
uuggauuuaucucuuuacugugaguauguucucccuuuuccauucgugccgcuucauggaagcu

SEQ ID NO: 583029 - RNA, 64 nt, Homo Sapiens
auacuucucaauucuuugcuuaguauuugaaagacuuuuccagcgagcuagauacaagcaagaa

SEQ ID NO: 583030 - RNA, 64 nt, Homo Sapiens
uuuaucagugaaguagugauauuccagggucacacuuuuccaaguaaauauuuugcaugaugaa

SEQ ID NO: 583031 - RNA, 64 nt, Homo Sapiens
cagcuucaugaugugcaggcaaaaaaaaaaaaaacuuuuccaggaaaaaaaaaaaaaaaaaaaa

SEQ ID NO: 583032 - RNA, 64 nt, Homo Sapiens
caauuuguuuauuaaacuccguuaaagaacauuucuuuuccauuggugucuuuuccauaauugu

SEQ ID NO: 583033 - RNA, 64 nt, Homo Sapiens
auuguguuaaagaacauuucaaauagaguggugucuuuuccauaauuggauguauuucaauaau

SEQ ID NO: 583034 - RNA, 64 nt, Homo Sapiens
cucggugugugcauacaguucuuccacaagagggcuuuuccacaugauguacacaaauaacuga

SEQ ID NO: 583035 - RNA, 64 nt, Homo Sapiens
guuuuacauucaugugguuucuucuagcugaaaacuuuuccacauggugugcagugcgcucugg

SEQ ID NO: 583036 - RNA, 64 nt, Homo Sapiens
cacacucugcauccuaccccaccuacccaacacacuuuuccaccugggagccugugcccucaga

SEQ ID NO: 583037 - RNA, 64 nt, Homo Sapiens
guaaccucagcaaaaacgaggccucugcaagccacuuuuccaugccaagcauccacccggccca

SEQ ID NO: 583038 - RNA, 64 nt, Homo Sapiens
ggaggugccucugauagaacaugcuagaaauggucuuuuccacagcauagucugggacuggaaa

SEQ ID NO: 583039 - RNA, 64 nt, Homo Sapiens
cguguggaaguaaagacuuuggagcuagagaagccuuuuccagcaaugauuauugacuucacca

SEQ ID NO: 583040 - RNA, 64 nt, Homo Sapiens
uuccacgugcuucccucccaacaugccugaacaacuuuuccacugcaucauuuaaaaaaaaaug

SEQ ID NO: 583041 - RNA, 64 nt, Homo Sapiens
uuuuuuugcuuuuauuuucuaaucaaaagacguccuuuuccauuucuagccaccaaaacggguu

SEQ ID NO: 583042 - RNA, 64 nt, Homo Sapiens
gagugugguuuggcagaacaacugcauuucacagcuuuuccaguuaaauuggagcacugaacgu

SEQ ID NO: 583043 - RNA, 64 nt, Homo Sapiens
ugucuccuuuuauaugcagcucuuacgugggagacuuuuccacuuaaaggagacauagaaugug

SEQ ID NO: 583044 - RNA, 64 nt, Homo Sapiens
acauccaaauuguaauguggggcaaauggaauugcuuuuccauaugggggccauuuucucuaca

SEQ ID NO: 583045 - RNA, 64 nt, Homo Sapiens
uaacacauggagcccuuccccccuuucccuggggcuuuuccauuauaaccagcucuuaguuguu

SEQ ID NO: 583046 - RNA, 64 nt, Homo Sapiens
gugucugcgcacauuuuaagaccugccaagauaccuuuuccaggucaaaauguaaauuauguau

SEQ ID NO: 583047 - RNA, 64 nt, Homo Sapiens
cacacaccccugauguuggaaccacacacacgcgcuuuuccaguaaaacaaaaacaaaacacac

SEQ ID NO: 583048 - RNA, 64 nt, Homo Sapiens
aaaucuuguaaaagguguccaaauacauaguaaucuuuuccaguuaugucugauuaagauuuaa

SEQ ID NO: 583049 - RNA, 64 nt, Homo Sapiens
cauuuauuaaucuuuuuaucugaaacuuuguacacuuuuccacuuucaaaaccuauuuuaagua

SEQ ID NO: 583050 - RNA, 64 nt, Homo Sapiens
ugccaaguuccauugugccaagccuagggguuuccuuuuccauugaccuuggaaaaucuggcca

SEQ ID NO: 583051 - RNA, 64 nt, Homo Sapiens
guuuuucuuagaaccaaccauagcuagauaagaucuuuuccaaaaaggaguggguuguuuuuca

SEQ ID NO: 583052 - RNA, 64 nt, Homo Sapiens
agccccggucgcgcgcuggccccgcaggaccuuccuuuuccaggaagagccagcuuuucucgga

SEQ ID NO: 583053 - RNA, 64 nt, Homo Sapiens
gcugccaggaaacgauuugggccucugucaguuucuuuuccauguaugaggagggggaaauuug

SEQ ID NO: 583054 - RNA, 64 nt, Homo Sapiens
ggacauuuaaaaauauauuuuucuugaguuuaggcuuuuccauaugugcagcuguguuuaccua

SEQ ID NO: 583055 - RNA, 64 nt, Homo Sapiens
aucuucucgucccuuucuuacagccauuuucuugcuuuuccacaaagauauuauuuaaagugga

SEQ ID NO: 583056 - RNA, 64 nt, Homo Sapiens
uaucaaagacaagaggauaaaagacugggauagucuuuuccaaggacccucuuuagagggcccu

SEQ ID NO: 583057 - RNA, 64 nt, Homo Sapiens
ugcggguuuuguuggggugucuuaauguucaucucuuuuccacugcccauccucugugaaccca

SEQ ID NO: 583058 - RNA, 64 nt, Homo Sapiens
uguuuuaaccuaaagcuuaucuguaauucaccuccuuuuccaccacugcuaccuuaugugagcc

SEQ ID NO: 583059 - RNA, 64 nt, Homo Sapiens
ccuuguuuuacuuauuugcuccuuguagagcugccuuuuccaaggauaccauaaacuccugaga

SEQ ID NO: 583060 - RNA, 64 nt, Homo Sapiens
aauuuauaauccguuccccauuaacuuaauuuagcuuuuccaucacuguuaaugaucagaguaa

SEQ ID NO: 583061 - RNA, 64 nt, Homo Sapiens
agaguuuuaauggucuuuguguaaauuuuaauggcuuuuccauuguuuuugcuucucuuaaaaa

SEQ ID NO: 583062 - RNA, 64 nt, Homo Sapiens
cuuuguuauaggcagucuucucuuuaagacaauacuuuuccacuuguuuuccuuuuccauauua

SEQ ID NO: 583063 - RNA, 64 nt, Homo Sapiens
uucucuuuaagacaauacuuuuccacuuguuuuccuuuuccauauuauauauguguauucauau

SEQ ID NO: 583064 - RNA, 64 nt, Homo Sapiens
auuuuucuuuccugucccccuacucccucccuaccuuuuccauccuccuccucugccuucaaaa

SEQ ID NO: 583065 - RNA, 64 nt, Homo Sapiens
acacaguuugaacguggugaaacaggguguaguucuuuuccacauucugugucaucuagucgug

SEQ ID NO: 583066 - RNA, 64 nt, Homo Sapiens; identical to SEQ ID NO: 353564

SEQ ID NO: 583067 - RNA, 64 nt, Homo Sapiens; identical to SEQ ID NO: 353565

SEQ ID NO: 583068 - RNA, 64 nt, Homo Sapiens; identical to SEQ ID NO: 353566

SEQ ID NO: 583069 - RNA, 64 nt, Homo Sapiens; identical to SEQ ID NO: 353567

SEQ ID NO: 583070 - RNA, 64 nt, Homo Sapiens; identical to SEQ ID NO: 353568

SEQ ID NO: 583071 - RNA, 64 nt, Homo Sapiens; identical to SEQ ID NO: 353569

SEQ ID NO: 583072 - RNA, 64 nt, Homo Sapiens; identical to SEQ ID NO: 353570

SEQ ID NO: 583073 - RNA, 64 nt, Homo Sapiens; identical to SEQ ID NO: 353571

SEQ ID NO: 583074 - RNA, 64 nt, Homo Sapiens; identical to SEQ ID NO: 353572

SEQ ID NO: 583075 - RNA, 64 nt, Homo Sapiens; identical to SEQ ID NO: 353573

SEQ ID NO: 583076 - RNA, 64 nt, Homo Sapiens; identical to SEQ ID NO: 353574

SEQ ID NO: 583077 - RNA, 64 nt, Homo Sapiens
aaucacuacagcugcucugcuucugcuuuccaaaguagcccagguccugggccagaugcagggg

SEQ ID NO: 583078 - RNA, 64 nt, Homo Sapiens
ccgcgugguagggcugcuggcaggcacacuggguguagcccaacaccgugaggcacuggcccac

SEQ ID NO: 583079 - RNA, 64 nt, Homo Sapiens
ggguucugugcugguuguuagaacucaucuccagguagcccacggauacgugguuggcacagac

SEQ ID NO: 583080 - RNA, 64 nt, Homo Sapiens
aacccucuagcucccauuggcugaagacacugaaguagcccaccccugcaggcagguccugauu

SEQ ID NO: 583081 - RNA, 64 nt, Homo Sapiens
guuuugaaaguccugcccugccuuccuccugccuguagcccagcccaucuaaauggaagcuggg

SEQ ID NO: 583082 - RNA, 64 nt, Homo Sapiens
aaacaaaaccaaacuggacucucgugcagaaaauguagcccauuaccacauguagccuuggaga

SEQ ID NO: 583083 - RNA, 64 nt, Homo Sapiens
ucucaaaaauaaaaauaaaaauugcuuucagagaguagcccaugaaauuucccauucuucaagg

SEQ ID NO: 583084 - RNA, 64 nt, Homo Sapiens
agaggauauugauaggugugaacuaguucaucaaguagcccaaguaggagagaaucauaggcaa

SEQ ID NO: 583085 - RNA, 64 nt, Homo Sapiens
acagucugaagaggaaggaagcagcaguaucugcguagcccacagagggcccaggccccugccc

SEQ ID NO: 583086 - RNA, 64 nt, Homo Sapiens
cgggggcugcugugagggaucuuggagcuucccuguagcccaccuuccccuugcuucauguuug

SEQ ID NO: 583087 - RNA, 64 nt, Homo Sapiens
cgguuuaaaacaugcuauauguacuguauguccuguagcccagugcggcuccacagcauggaau

SEQ ID NO: 583088 - RNA, 64 nt, Homo Sapiens
cuggagugcaauggcaggauggaguuuugcucuuguagcccagguguacuuuuuuuuuugagac

SEQ ID NO: 583089 - RNA, 64 nt, Homo Sapiens
gaguuaauauuuaaguugucauuuauaucaccagguagcccacuaugaccacuguuuuuuuccu

SEQ ID NO: 583090 - RNA, 64 nt, Homo Sapiens
auuuuuccugugcuuccccaaugguguuggucuuguagcccauuuuucacuuaugugagucauc

SEQ ID NO: 583091 - RNA, 64 nt, Homo Sapiens
gggaauugauucuguuuauucaauaauaguccuuguagcccaauaugaaaauaaaauauaaagu

SEQ ID NO: 583092 - RNA, 64 nt, Homo Sapiens
gccgagagccccacgcucccgcccaccuuccccaguagcccaggccugggcagcaagcgcagcc

SEQ ID NO: 583093 - RNA, 64 nt, Homo Sapiens
uaugguuacggagcugugcaucuugggacauguaguagcccaggucggcuugucacucgcugug

SEQ ID NO: 583094 - RNA, 64 nt, Homo Sapiens
uuccgaggcugcagggccaggcgcgggaccgcagguagcccaggguguuguggguggcagcacu

SEQ ID NO: 583095 - RNA, 64 nt, Homo Sapiens
gagggcgaaugacauuacaguaauggguggugauguagcccaauauuacugaaaagcugaaauu

SEQ ID NO: 583096 - RNA, 63 nt, Homo Sapiens
uugauaauggaacuauacagcugucuguugucuguagcccagcaggaggauggagcuaguuag

SEQ ID NO: 583097 - RNA, 64 nt, Homo Sapiens
uggguuggaggaagggcacguucacauuuauuugguagcccaccggugugugacguuuuuccag

SEQ ID NO: 583098 - RNA, 64 nt, Homo Sapiens
ucauaugucacucauagcauuucuauauuugaaaguagcccaauauaaaacuuuugauucuaaa

SEQ ID NO: 583099 - RNA, 64 nt, Homo Sapiens
aguuaacacacuggagugugcuccaguuugcaggguagcccagugcaagguucagauccaugua

SEQ ID NO: 583100 - RNA, 64 nt, Homo Sapiens
gaucacaagccugccacgauggcugcugcuccuuguagcccacccaugagaagcaagagaccuu

SEQ ID NO: 583101 - RNA, 64 nt, Homo Sapiens
cauuauacccaguuugcacuaacaugggccauuuguagcccaaccuucucuuccaucuaccugu

SEQ ID NO: 583102 - RNA, 64 nt, Homo Sapiens
cucuaguuuccaucucuaucauuuuauaauaaccguagcccacauuguaguaguuuuucagcuc

SEQ ID NO: 583103 - RNA, 64 nt, Homo Sapiens
gaaggguguguuuggaacauagugaaauuuaccuguagcccagugguucaucugcuuccauccc

SEQ ID NO: 583104 - RNA, 64 nt, Homo Sapiens
ggcauuguacuuucugcugaugauauggacauauguagcccagucagugggaaaugguggugga

SEQ ID NO: 583105 - RNA, 64 nt, Homo Sapiens
gaagaaguuuuggacuuaacaugaaggaagauagguagcccagaggguccugagcaccugcuuc

SEQ ID NO: 583106 - RNA, 64 nt, Homo Sapiens
aagcagaaggugugcuauucacaguaccaugcgaguagcccacaguuaauucccggcagauucu

SEQ ID NO: 583107 - RNA, 64 nt, Homo Sapiens
aaaauguaagcugugcuccuugcagacacuguggguagcccaucaguggagcuuuuguaucuuc

SEQ ID NO: 583108 - RNA, 64 nt, Homo Sapiens
uauaagcuaauguuuaaaagcaaaacugcaaauuguagcccaguuggucaaacuuguuuucuuu

SEQ ID NO: 583109 - RNA, 64 nt, Homo Sapiens
ccccagucuccucuccugaucuccuccaaucucuguagcccaagaugugaaagccagacaagaa

SEQ ID NO: 583110 - RNA, 64 nt, Homo Sapiens
uuauguuaaagaucuuacuauguuagagaugaaaguagcccacuugguguauuaauuuuaucuu

SEQ ID NO: 583111 - RNA, 64 nt, Homo Sapiens
cccuauucugcacuguucagaaaugugaugaacuguagcccaaguaauuguuaauaagaaaacc

SEQ ID NO: 583112 - RNA, 64 nt, Homo Sapiens
uccaccccaccacaaaguugauuucccccucacuguagcccauuccccgccacaucccaacuuc

SEQ ID NO: 583113 - RNA, 64 nt, Homo Sapiens
guucuggccuaacagcagacaaauaguucagcaaguagcccacacauuuugauuguaaaccaua

SEQ ID NO: 583114 - RNA, 64 nt, Homo Sapiens
uauauuugaauaguuaauuugcuuuguuuuacacguagcccacugccucauuauagguaaaagg

SEQ ID NO: 583115 - RNA, 64 nt, Homo Sapiens
uugacuagcaaacagcacuuuaggaaaagucaccguagcccacuguggcaucagaaaauucuug

SEQ ID NO: 583116 - RNA, 64 nt, Homo Sapiens
cacaagccccaggaagaacucagagccgucauggguagcccacgccguccuuuccccuccccaa

SEQ ID NO: 583117 - RNA, 64 nt, Homo Sapiens
auugggcaaacaguagacuuauaguaggguugggguagcccauguuaugugacuaucuuuauga

SEQ ID NO: 583118 - RNA, 64 nt, Homo Sapiens
aaaguugaggccaucgacugccaggaacacaccuguagcccagcaugaugucaucuaaaggcca

SEQ ID NO: 583119 - RNA, 64 nt, Homo Sapiens
ccuguuuggcagccauuucuguuucugugguucaguagcccagacauuccauccauuuccucag

SEQ ID NO: 583120 - RNA, 64 nt, Homo Sapiens
gucuaguugguaaauguuacagauauuuuaaaguguagcccagaaccacaccuggcugaacauc

SEQ ID NO: 583121 - RNA, 64 nt, Homo Sapiens
cuuuccucugucccagauucgccugaggugcuggguagcccauccuccucgcccuucaguuuuu

SEQ ID NO: 583122 - RNA, 64 nt, Homo Sapiens
aacaaggcugcugggggccucucugaagugcucaguagcccaaccuguuccagguccucccaac

SEQ ID NO: 583123 - RNA, 64 nt, Homo Sapiens
gccauaucugucaugcuuccucuugcuccccgcuguagcccacauccaggcauuguuuaccugc

SEQ ID NO: 583124 - RNA, 64 nt, Homo Sapiens
uucagggagcuggcuuucucgaagguggagguggguagcccagggggcgagggagagaugagcg

SEQ ID NO: 583125 - RNA, 64 nt, Homo Sapiens
cgugguaggauaaauuacggaacucuucuccacaguagcccaguguuuuagcuucuuuccagca

SEQ ID NO: 583126 - RNA, 64 nt, Homo Sapiens
caaaugcccuuucugauucuagcccaggcuggagguagcccaccggcugacacggaggugcauu

SEQ ID NO: 583127 - RNA, 64 nt, Homo Sapiens
gggucuguuuggacugcagaagcaagggggugauguagcccauccuucccuuuggagaugcuga

SEQ ID NO: 583128 - RNA, 64 nt, Homo Sapiens
augccuauggcgccucaucuuuaaacuguccuuaguagcccaggggagccacacccucacuccc

SEQ ID NO: 583129 - RNA, 64 nt, Homo Sapiens
ccaccacacacugaaucuguagcuuccggauaccguagcccaugggcaccagcuuggaggcccc

SEQ ID NO: 583130 - RNA, 64 nt, Homo Sapiens
uucagagcaauaggaggaaaaggaaagcguuuuuguagcccaccaucuacagcuuuacuguaaa

SEQ ID NO: 583131 - RNA, 64 nt, Homo Sapiens
acagccagcgguggaggugucuugcuccgggcccguagcccacgcccucucuggguggcagggc

SEQ ID NO: 583132 - RNA, 64 nt, Homo Sapiens
uuuuuaguacuaagcaaaauucucaucacagaauguagcccaggccaauuuauaacuaaaucuc

SEQ ID NO: 583133 - RNA, 64 nt, Homo Sapiens
aaugggguuuauauuuacauuaucucucaacuauguagcccauauuacucacccuaugagugaa

SEQ ID NO: 583134 - RNA, 64 nt, Homo Sapiens
auaguaccuuuuugcguaauguuugggauauucaguagcccaggauugcuacaaaaagguccuu

SEQ ID NO: 583135 - RNA, 64 nt, Homo Sapiens
uugaaauauuuauuugguuauacacacuugcaguguagcccagucaugucuucuuguuauuguu

SEQ ID NO: 583136 - RNA, 64 nt, Homo Sapiens
agccuccggcggcccaggaucggcccugccccaaguagcccagaccggcagccgcuccgagccu

SEQ ID NO: 583137 - RNA, 64 nt, Homo Sapiens
gucugggguagagcugacugguccguauuucucuguagcccaggcucugacuugguauuuccag

SEQ ID NO: 583138 - RNA, 64 nt, Homo Sapiens
ucauaaacaugcauugugaaacuguagagagcagguagcccaaaauagagaaagauuagauaaa

SEQ ID NO: 583139 - RNA, 64 nt, Homo Sapiens
caauucaaauucuaguuguuauuugguggaagcaguagcccaaccccaguuuaggggaagguag

SEQ ID NO: 583140 - RNA, 64 nt, Homo Sapiens
ucguccaucccugucccuuucuggcccucuuccuguagcccagucucaggcuuuccucuuccug

SEQ ID NO: 583141 - RNA, 64 nt, Homo Sapiens
gcauccuugcacgccccgcggagcucucuccaugguagcccagggcgcuggcagaccaugcucc

SEQ ID NO: 583142 - RNA, 64 nt, Homo Sapiens
cuacacagccuggacuuugguucucuccaggaagguagcccagcacugugaagacccagcagga

SEQ ID NO: 583143 - RNA, 64 nt, Homo Sapiens
uaaacuuuuuuuuuuugagaugguaucucacucuguagcccagucuggagugcaguggugugau

SEQ ID NO: 583144 - RNA, 64 nt, Homo Sapiens
agaaucaugcacuuuuuaaacuuuccuaaacagaguagcccacaagaaauguguuaucuguaau

SEQ ID NO: 583145 - RNA, 64 nt, Homo Sapiens
ucuugaaauaugaaaaggaagugucuauaggaaaguagcccaugcaauucaggggauuuguaua

SEQ ID NO: 583146 - RNA, 64 nt, Homo Sapiens
accauaauugcaguauuucugaagaggcuggaaaguagcccauacauaguuguguccuauacuu

SEQ ID NO: 583147 - RNA, 64 nt, Homo Sapiens
uuaagcuucuauuuuuuacuuuccagaaaucuuaguagcccaugauacauuucugaaugggcaa

SEQ ID NO: 583148 - RNA, 64 nt, Homo Sapiens
ggccuuuagaaugcuuuaauaaauuugggaaaaaguagcccauggcuggggacucccagcucug

SEQ ID NO: 583149 - RNA, 64 nt, Homo Sapiens
gaaggcacuugggcugccagagggccaggugggaguagcccagcgcccuaaggaaugaaaagca

SEQ ID NO: 583150 - RNA, 64 nt, Homo Sapiens
cgcucuccacauuguacagagcuucagguuuaauguagcccagcugagucagaaagguugugac

SEQ ID NO: 583151 - RNA, 64 nt, Homo Sapiens
gaaacagaaaguauccauaccuauugccuuucuuguagcccagcuugccagagguccaaauauu

SEQ ID NO: 583152 - RNA, 64 nt, Homo Sapiens
uccggcaaaugccuccuucgccagguguguccugguagcccagguucagggcuggggaggagcc

SEQ ID NO: 583153 - RNA, 64 nt, Homo Sapiens
cuugagaggaugaauguaugagucaaugugcaguguagcccacaaaccagguuuagacaguaug

SEQ ID NO: 583154 - RNA, 64 nt, Homo Sapiens
uucuaggcauugugaauaggcacuaccauaucugguagcccauuaggaaagucggggcuuugac

SEQ ID NO: 583155 - RNA, 64 nt, Homo Sapiens
gcugaaggacuugcuuuuccugggacaucugcugguagcccagugaguucagggugacacauuu

SEQ ID NO: 583156 - RNA, 64 nt, Homo Sapiens
gugagcacaaacauuccaguuuuuuggaagaucgguagcccaggcugcuguuccugcucccacc

SEQ ID NO: 583157 - RNA, 64 nt, Homo Sapiens
ugaauuuucuucacucuuauagguaauggauauuguagcccauuaccuugucucuugcaguuua

SEQ ID NO: 583158 - RNA, 64 nt, Homo Sapiens
aagaacaacaacaaaacaauauugugacuuccugguagcccaagacaucuguacgucugucauc

SEQ ID NO: 583159 - RNA, 64 nt, Homo Sapiens
cccacuaacggcuuauaugaacagaaaguacuguguagcccaggaguuuauuuagcaagauaaa

SEQ ID NO: 583160 - RNA, 64 nt, Homo Sapiens
cauucacucuuuaaggauuaagucuuguugacauguagcccaguuuucaauaagguuuaaccuu

SEQ ID NO: 583161 - RNA, 64 nt, Homo Sapiens
ccugcccucuaaaagaauccgauccuuuuuacuuguagcccauuucuguuuccacccacccugg

SEQ ID NO: 583162 - RNA, 64 nt, Homo Sapiens
cucugaccccaaggaguggccacaccuccauccuguagcccauuguucugggcccugauuuugc

SEQ ID NO: 583163 - RNA, 64 nt, Homo Sapiens
cuccccaagcuucccugcauggccuguaucuguuguagcccagguccaucugugucugucuguu

SEQ ID NO: 583164 - RNA, 64 nt, Homo Sapiens
ucuccuaagaccuuuucuaguucauuuguccaugguagcccaucuuuaacagauagaguguggc

SEQ ID NO: 583165 - RNA, 64 nt, Homo Sapiens
cugcucgccuuagcacuaccugcaggaccugccuguagcccacugaugagcucuacccagggcc

SEQ ID NO: 583166 - RNA, 64 nt, Homo Sapiens
accuuggagcacugacuguaacugaugcagcacuguagcccaucaaaaauguguguacagacuc

SEQ ID NO: 583167 - RNA, 64 nt, Homo Sapiens
gaaagugcguggucacaaaauaucagaaaugccaguagcccagagggacuugcaggaaaagcgu

SEQ ID NO: 583168 - RNA, 64 nt, Homo Sapiens
aauauaacaggaauuaaugaucauuccacguuuuguagcccacugcaucuggauauauaccagu

SEQ ID NO: 583169 - RNA, 64 nt, Homo Sapiens
cucuccuaggucacagccugcugggcugggucgcguagcccaggguggaggcagaacgaugcug

SEQ ID NO: 583170 - RNA, 64 nt, Homo Sapiens
cuuugaaggugcuuugugagacuugugauacuggguagcccagagauauuggacuuacugcuau

SEQ ID NO: 583171 - RNA, 64 nt, Homo Sapiens
gcagaugucaauaaaugcaugcuagaaacccaguguagcccagguugcauucgcuucuguucuu

SEQ ID NO: 583172 - RNA, 64 nt, Homo Sapiens
agcuugggugugcugacgagcucuaggagccccaguagcccagggaacccugcugaugagccca

SEQ ID NO: 583173 - RNA, 64 nt, Homo Sapiens
gugcucccaagacuuccauagaccaucuggaccaguagcccaucccgcaguuuucuugggggca

SEQ ID NO: 583174 - RNA, 64 nt, Homo Sapiens
agccgagcagcugugagguggguggggcagggcuguagcccacgccgggugcuauuccaggcuc

SEQ ID NO: 583175 - RNA, 64 nt, Homo Sapiens
cuguuuaucaagcaaugcucaagagguuguugcuguagcccaugcuugcguuaucauaaagaaa

SEQ ID NO: 583176 - RNA, 64 nt, Homo Sapiens
aauguuuuaaaagcuuaauagguuggcaucaguuguagcccacaaacauggcuagggcuuuggg

SEQ ID NO: 583177 - RNA, 64 nt, Homo Sapiens
aauccucagacguucugguuugauuguuguggguguagcccaggcaugggauuuuuuaaagagc

SEQ ID NO: 583178 - RNA, 64 nt, Homo Sapiens
agccaaggcugcagcauauagaccaggaaaucagguagcccagacuggugauggagcagagucu

SEQ ID NO: 583179 - RNA, 64 nt, Homo Sapiens
cugcuggucagcaggcucauagcaugagagcacaguagcccagcuguccaugugggagagagag

SEQ ID NO: 583180 - RNA, 64 nt, Homo Sapiens
aacccugccccuccccagcagccuuggcaucccuguagcccagccuccccuggggcaucccuuu

SEQ ID NO: 583181 - RNA, 64 nt, Homo Sapiens
uucgaccacaugcaccucgacagcaggcuuuccuguagcccaugggccugcuggacagcgagga

SEQ ID NO: 583182 - RNA, 64 nt, Homo Sapiens
ccccucucuucgcgcagagccaaacuuaacccuuguagcccaaugcuugaacuuggccucuacc

SEQ ID NO: 583183 - RNA, 64 nt, Homo Sapiens
ugcaucagggcugcuggguucuagccagguccagguagcccacuugguccauuugguuuucugu

SEQ ID NO: 583184 - RNA, 64 nt, Homo Sapiens
ugaugcuucuauaguuaagacaauucuuacuguaguagcccaucaagguauuuugcuguuaccu

SEQ ID NO: 583185 - RNA, 64 nt, Homo Sapiens
aacuuugcccgcucaccaugucccuugcccccauguagcccauuucccagguuaugcucuuuuc

SEQ ID NO: 583186 - RNA, 64 nt, Homo Sapiens
gaauauucagacaaaauggauacauaaagacuaaguagcccauaaggggucaaaauuugcugcc

SEQ ID NO: 583187 - RNA, 64 nt, Homo Sapiens
cugcuauguggacaguuguuuucuaguguggucuguagcccaauaacuggggaacgaguuacag

SEQ ID NO: 583188 - RNA, 64 nt, Homo Sapiens
ccucuaaucccagcacuuugcuuggccgggugugguagcccacgcuugcuuaaagaaaaucccu

SEQ ID NO: 583189 - RNA, 64 nt, Homo Sapiens
ccaacuuugaccaagaagagcaaucuggauucuuguagcccauggagguuuaccuucuucauag

SEQ ID NO: 583190 - RNA, 64 nt, Homo Sapiens
agcaaaaauuuuugggaguaagaaauaaaugccaguagcccaggacugucauuugacagcauuc

SEQ ID NO: 583191 - RNA, 64 nt, Homo Sapiens
gcaccccaaacuuggagggacaguaucugcuucuguagcccacgaccaagagucccagccccac

SEQ ID NO: 583192 - RNA, 64 nt, Homo Sapiens
ccagagugcaguggcgcgaucggagucuugcucuguagcccagguauuuauuuauuuauugaga

SEQ ID NO: 583193 - RNA, 64 nt, Homo Sapiens
ugagagguugggaaacugaggggcaggacaagcuguagcccauccuaauggccccccaaaagau

SEQ ID NO: 583194 - RNA, 64 nt, Homo Sapiens
cacauuuucuggguccugaauccuuugcaucauaguagcccagauccuuucucaacguuccuaa

SEQ ID NO: 583195 - RNA, 64 nt, Homo Sapiens
ggcggguccccacuguggcgacggagagcugacaguagcccagggcuuuccaccugcauggaac

SEQ ID NO: 583196 - RNA, 64 nt, Homo Sapiens
uagugguagugacuugcuuuuccugugcacacauguagcccaucaggacagcgagccgacgggu

SEQ ID NO: 583197 - RNA, 64 nt, Homo Sapiens
ggacuuguugaaacaggaagcaagggccuucaguguagcccauucuugauccagagcuguugcc

SEQ ID NO: 583198 - RNA, 64 nt, Homo Sapiens
cacuacagcaucaaaguaaaucuuuggggacaguguagcccaucugcauccuauuuaauuucuu

SEQ ID NO: 583199 - RNA, 64 nt, Homo Sapiens
ccuucuucccagccagagagggcagaagcagaccguagcccauuggccuuaugugcgugugugc

SEQ ID NO: 583200 - RNA, 64 nt, Homo Sapiens
cuccaccccgcuguuuuucuagagaaaagguauuguagcccaccgucucaccauucccuuuuuu

SEQ ID NO: 583201 - RNA, 64 nt, Homo Sapiens
acuucucaaacuuggaaaugacuuucccagccucguagcccagcgcuaaccuaaauauucuaga

SEQ ID NO: 583202 - RNA, 64 nt, Homo Sapiens
gggugguuucuggaaagcccccugcccaugcaugguagcccacuggcaggggaagggcacaccc

SEQ ID NO: 583203 - RNA, 64 nt, Homo Sapiens
uccuguuccugugccuucaaagcccuugaaggugguagcccagccagaccucaccaucuuugac

SEQ ID NO: 583204 - RNA, 64 nt, Homo Sapiens
uaacauacaugccuauauauuuuauacacugaggguagcccauuuauaaauuaagagcacauua

SEQ ID NO: 583205 - RNA, 64 nt, Homo Sapiens
gugagcuuuagcucucucuaugaggugccacccaguagcccagaggcaggcaagagaauugaaa

SEQ ID NO: 583206 - RNA, 64 nt, Homo Sapiens
aaaguaaaauaggugucacguacauaaauaguguguagcccagauaggucugaguccuagagau

SEQ ID NO: 583207 - RNA, 64 nt, Homo Sapiens
gcuguagcacaggcuucacauugcguguccaaaaguagcccaggucauguaaccgaguguccuc

SEQ ID NO: 583208 - RNA, 64 nt, Homo Sapiens; identical to SEQ ID NO: 225748

SEQ ID NO: 583209 - RNA, 64 nt, Homo Sapiens; identical to SEQ ID NO: 225749

SEQ ID NO: 583210 - RNA, 64 nt, Homo Sapiens; identical to SEQ ID NO: 225750

SEQ ID NO: 583211 - RNA, 64 nt, Homo Sapiens; identical to SEQ ID NO: 225751

SEQ ID NO: 583212 - RNA, 64 nt, Homo Sapiens; identical to SEQ ID NO: 225752

SEQ ID NO: 583213 - RNA, 64 nt, Homo Sapiens; identical to SEQ ID NO: 225753

SEQ ID NO: 583214 - RNA, 64 nt, Homo Sapiens; identical to SEQ ID NO: 225754

SEQ ID NO: 583215 - RNA, 64 nt, Homo Sapiens; identical to SEQ ID NO: 225755

SEQ ID NO: 583216 - RNA, 57 nt, Homo Sapiens; identical to SEQ ID NO: 225756

SEQ ID NO: 583217 - RNA, 64 nt, Homo Sapiens; identical to SEQ ID NO: 225757

SEQ ID NO: 583218 - RNA, 64 nt, Homo Sapiens; identical to SEQ ID NO: 225758

SEQ ID NO: 583219 - RNA, 64 nt, Homo Sapiens; identical to SEQ ID NO: 225759

SEQ ID NO: 583220 - RNA, 64 nt, Homo Sapiens; identical to SEQ ID NO: 225760

SEQ ID NO: 583221 - RNA, 64 nt, Homo Sapiens; identical to SEQ ID NO: 225761

SEQ ID NO: 583222 - RNA, 64 nt, Homo Sapiens; identical to SEQ ID NO: 225762

SEQ ID NO: 583223 - RNA, 64 nt, Homo Sapiens; identical to SEQ ID NO: 225763

SEQ ID NO: 583224 - RNA, 64 nt, Homo Sapiens; identical to SEQ ID NO: 225764

SEQ ID NO: 583225 - RNA, 64 nt, Homo Sapiens; identical to SEQ ID NO: 225765

SEQ ID NO: 583226 - RNA, 53 nt, Homo Sapiens; identical to SEQ ID NO: 225766

SEQ ID NO: 583227 - RNA, 64 nt, Homo Sapiens; identical to SEQ ID NO: 225767

SEQ ID NO: 583228 - RNA, 64 nt, Homo Sapiens
ccaucagagaugacaagccaccuaguugugggccacgauuuaaaagcugcuuuuaucauacucu

SEQ ID NO: 583229 - RNA, 64 nt, Homo Sapiens
aucgaucagaguaauucuuuauuuuguuuucaauacgauuuaauuaguauuugcuuuuuagucc

SEQ ID NO: 583230 - RNA, 64 nt, Homo Sapiens
aagaagcccaauauuauaaugagcuucucugugaacgauuuagacccauuucuauuuauuuacu

SEQ ID NO: 583231 - RNA, 64 nt, Homo Sapiens
ucgguucccauggacccggcaccccaccugcaugacgauuuauuuguaucugggaaaauauucu

SEQ ID NO: 583232 - RNA, 64 nt, Homo Sapiens
gugaaugaaacugcccacaugaacuuuaugugcuacgauuuaacugcagccuugaacacacaca

SEQ ID NO: 583233 - RNA, 64 nt, Homo Sapiens
gugauauauagagugucuaauuacaaaaucauauacgauuuauuuaauucucuucuguauugua

SEQ ID NO: 583234 - RNA, 64 nt, Homo Sapiens
acauauaaccaaaccggcagcaacccggugguuaacgauuuaaugguuucaacucaaaaccacc

SEQ ID NO: 583235 - RNA, 64 nt, Homo Sapiens
uccauuuuccacuuuuauaguuagaaaucacuuuacgauuuauugcuuuacuccaccuccuuac

SEQ ID NO: 583236 - RNA, 64 nt, Homo Sapiens
uucugaaaaagccuucaaauaaagguauugcaacacgauuuauacauugcauaaaaucugucuu

SEQ ID NO: 583237 - RNA, 64 nt, Homo Sapiens
ugucauacguuucuacuuaaauuauuaagcacuuacgauuuagauguaauaauuauauguaagg

SEQ ID NO: 583238 - RNA, 64 nt, Homo Sapiens
uaaaaaaucuuacacaucugucugcuaaaacaacacgauuuacagcugucaggucugauagucc

SEQ ID NO: 583239 - RNA, 64 nt, Homo Sapiens
aaagcaugaaaugugaauuuuuauuguuguacauacgauuuaagguauuuaaaguauuuucuuc

SEQ ID NO: 583240 - RNA, 64 nt, Homo Sapiens
uaaauagguacauugagacuauuauuauggaagcacgauuuauuguuuuucauuuuuaaagaau

SEQ ID NO: 583241 - RNA, 64 nt, Homo Sapiens
uguaacuuucugaacacauuuuuucucuuuauuaacgauuuaaauguccucucuuucucuuccu

SEQ ID NO: 583242 - RNA, 64 nt, Homo Sapiens
aaaauucaucucuaaauuuuacuuuuauuuuuaaacgauuuaucuuucuucaagaauuuuaaac

SEQ ID NO: 583243 - RNA, 64 nt, Homo Sapiens
ccagcucugaugcaaagagauauaauuuuaaugaacgauuuauccagcaguguguuccaggggu

SEQ ID NO: 583244 - RNA, 64 nt, Homo Sapiens
ucccuuauuacagcacaacuguguaucuaaucuuacgauuuaggagaauguuaccuaggacauu

SEQ ID NO: 583245 - RNA, 64 nt, Homo Sapiens
uuuuuuuuuauuuuucaaagugcaaguauguucaacgauuuaaaaguugaauuucugcaggugu

SEQ ID NO: 583246 - RNA, 64 nt, Homo Sapiens
acagguuuauguuacuucuaauaguuuuuuguuuacgauuuaugucauccaugcugucccacaa

SEQ ID NO: 583247 - RNA, 64 nt, Homo Sapiens
uuaagugggagaauaaguaaaugcauuauuauucacgauuuaaugagagaaagagaggaagaug

SEQ ID NO: 583248 - RNA, 64 nt, Homo Sapiens
ucuuuucaaauguuuuuagggcuaugaccaugacacgauuuaaauuucaaagacucauguuucu

SEQ ID NO: 583249 - RNA, 64 nt, Homo Sapiens
aaucaguaaaaucacaaaggucuauuuaaugaaaacgauuuaccaauguuguuuuuuuuuaaca

SEQ ID NO: 583250 - RNA, 64 nt, Homo Sapiens
ggaaaagaaaaacccaguuucuuaggaaacgcaaacgauuuauuauccagauuauuuggauaag

SEQ ID NO: 583251 - RNA, 64 nt, Homo Sapiens
gaaaagaaugaauggauucuaggaauguuagggaacgauuuacuuuacccgauggcuguaucaa

SEQ ID NO: 583252 - RNA, 64 nt, Homo Sapiens
cuucaaacacccauuuuugcucuaugggaaaaaaacgauuuaccaauuaauauuacucagcaca

SEQ ID NO: 583253 - RNA, 64 nt, Homo Sapiens
uuuaauuucauaggauuuuauuuuuaaaaauaagacgauuuaauacugucuggcuucuuuugca

SEQ ID NO: 583254 - RNA, 64 nt, Homo Sapiens
cccuuucuuggugcugcuuuuuggguaggaccccacgauuuaggguaacuguuaucaucagcug

SEQ ID NO: 583255 - RNA, 64 nt, Homo Sapiens
agcuuguguauccauuaucauguguaaucaauaaacgauuuaauucucuugaaugaaaugacaa

SEQ ID NO: 583256 - RNA, 64 nt, Homo Sapiens
gccaaagccccuuccaggccugaauuccacaaguacgauuuacuguagugucuuaucacucuuu

SEQ ID NO: 583257 - RNA, 64 nt, Homo Sapiens
cuaagguugggaggcuaacgaaccuggcaacaucacgauuuaaggauucagcugaaccaccagg

SEQ ID NO: 583258 - RNA, 64 nt, Homo Sapiens
uuuagguuuggcuucauuguucaauuaaauaaagacgauuuaauaauuuuucucucuaacacug

SEQ ID NO: 583259 - RNA, 64 nt, Homo Sapiens
uugcagaucauaaggcuuuuaauuuaaaccagauacgauuuacuuaaccugagacuugggauga

SEQ ID NO: 583260 - RNA, 64 nt, Homo Sapiens
uguggcucccuccuccugucgggggcuucaggugacgauuuagcagaauccagcaggucacacu

SEQ ID NO: 583261 - RNA, 64 nt, Homo Sapiens
uuuuuugaauuaccaaauauggugccagcaauucacgauuuauagucuaauguuuuuuaaaauu

SEQ ID NO: 583262 - RNA, 64 nt, Homo Sapiens
uuguuauugaugauuuuuuuauauuuuuucacccacgauuuauuguguccagagaucuuggaaa

SEQ ID NO: 583263 - RNA, 64 nt, Homo Sapiens
gcaggagaugagaccagccuucuguguucaccuaacgauuuauacuguguaucugucuuugaug

SEQ ID NO: 583264 - RNA, 64 nt, Homo Sapiens
gaucgggucuccacuccagcuuucucaauuaaagacgauuuauacaacugaagugcugucuguc

SEQ ID NO: 583265 - RNA, 64 nt, Homo Sapiens
agagauggaggcuguggcggacuccuuccaacucacgauuuauccucagcucagaguguauuuu

SEQ ID NO: 583266 - RNA, 64 nt, Homo Sapiens
accagcgcagccagcaggagccuggccugggaggacgauuuauuauuacacuggggguuuccuu

SEQ ID NO: 583267 - RNA, 64 nt, Homo Sapiens
uaucuuuuuuaaaagaugugcuauuuauucuugcacgauuuaggcaauuaucucucuuccaggg

SEQ ID NO: 583268 - RNA, 64 nt, Homo Sapiens
uuagucaguuuaaaaauuguuugguuugaccgccacgauuuaggcuuuaucuaccagagccuuu

SEQ ID NO: 583269 - RNA, 64 nt, Homo Sapiens
aaaaaaaaaaaaagcaaccaaaagaaaaagaaaaacgauuuaaauuaacuuauuaaaaaaaaaa

SEQ ID NO: 583270 - RNA, 64 nt, Homo Sapiens
uguuagcagguucuuguuucaaauauguuacuuuacgauuuaccgacuaauggcaucagggcaa

SEQ ID NO: 583271 - RNA, 64 nt, Homo Sapiens
aauauugucauccgcuugcuuucuucaaauugccacgauuuacaaguuuguuacguugacuaug

SEQ ID NO: 583272 - RNA, 64 nt, Homo Sapiens
ucugcaucaggacauggccucguccacugagggcacgauuuaaacauuugacaucagaagcuuu

SEQ ID NO: 583273 - RNA, 64 nt, Homo Sapiens
augcagcaaaaaccaauacaacaaaacgaguggcacgauuuauuucaaacuaggccagcuggga

SEQ ID NO: 583274 - RNA, 64 nt, Homo Sapiens
cucaugugauuuacccuuuucaacuuuuuggaaaacgauuuaauuuauucuaauuagauuaacc

SEQ ID NO: 583275 - RNA, 64 nt, Homo Sapiens
gagugcagauagcuacagagaggagggucaaagcacgauuuaaucaaggccugauucccaaguc

SEQ ID NO: 583276 - RNA, 64 nt, Homo Sapiens
uuuaaugaugcuucaguggacugcuagcaaugccacgauuuagauugauacauucagcuuccug

SEQ ID NO: 583277 - RNA, 64 nt, Homo Sapiens; identical to SEQ ID NO: 212069

SEQ ID NO: 583278 - RNA, 64 nt, Homo Sapiens; identical to SEQ ID NO: 212070

SEQ ID NO: 583279 - RNA, 64 nt, Homo Sapiens; identical to SEQ ID NO: 212071

SEQ ID NO: 583280 - RNA, 64 nt, Homo Sapiens; identical to SEQ ID NO: 212072

SEQ ID NO: 583281 - RNA, 64 nt, Homo Sapiens; identical to SEQ ID NO: 212073

SEQ ID NO: 583282 - RNA, 64 nt, Homo Sapiens; identical to SEQ ID NO: 212074

SEQ ID NO: 583283 - RNA, 64 nt, Homo Sapiens; identical to SEQ ID NO: 212075

SEQ ID NO: 583284 - RNA, 64 nt, Homo Sapiens; identical to SEQ ID NO: 212076

SEQ ID NO: 583285 - RNA, 64 nt, Homo Sapiens; identical to SEQ ID NO: 212077

SEQ ID NO: 583286 - RNA, 64 nt, Homo Sapiens; identical to SEQ ID NO: 212078

SEQ ID NO: 583287 - RNA, 64 nt, Homo Sapiens; identical to SEQ ID NO: 212079

SEQ ID NO: 583288 - RNA, 64 nt, Homo Sapiens; identical to SEQ ID NO: 212080

SEQ ID NO: 583289 - RNA, 64 nt, Homo Sapiens; identical to SEQ ID NO: 212081

SEQ ID NO: 583290 - RNA, 64 nt, Homo Sapiens; identical to SEQ ID NO: 212082

SEQ ID NO: 583291 - RNA, 64 nt, Homo Sapiens; identical to SEQ ID NO: 212083

SEQ ID NO: 583292 - RNA, 64 nt, Homo Sapiens; identical to SEQ ID NO: 212084

SEQ ID NO: 583293 - RNA, 64 nt, Homo Sapiens; identical to SEQ ID NO: 212085

SEQ ID NO: 583294 - RNA, 64 nt, Homo Sapiens; identical to SEQ ID NO: 212086

SEQ ID NO: 583295 - RNA, 64 nt, Homo Sapiens; identical to SEQ ID NO: 212087

SEQ ID NO: 583296 - RNA, 64 nt, Homo Sapiens; identical to SEQ ID NO: 212088

SEQ ID NO: 583297 - RNA, 64 nt, Homo Sapiens; identical to SEQ ID NO: 212089

SEQ ID NO: 583298 - RNA, 64 nt, Homo Sapiens; identical to SEQ ID NO: 212090

SEQ ID NO: 583299 - RNA, 64 nt, Homo Sapiens; identical to SEQ ID NO: 212091

SEQ ID NO: 583300 - RNA, 64 nt, Homo Sapiens; identical to SEQ ID NO: 212092

SEQ ID NO: 583301 - RNA, 64 nt, Homo Sapiens; identical to SEQ ID NO: 212093

SEQ ID NO: 583302 - RNA, 64 nt, Homo Sapiens; identical to SEQ ID NO: 212094

SEQ ID NO: 583303 - RNA, 64 nt, Homo Sapiens; identical to SEQ ID NO: 212095

SEQ ID NO: 583304 - RNA, 64 nt, Homo Sapiens; identical to SEQ ID NO: 212096

SEQ ID NO: 583305 - RNA, 64 nt, Homo Sapiens; identical to SEQ ID NO: 212097

SEQ ID NO: 583306 - RNA, 64 nt, Homo Sapiens; identical to SEQ ID NO: 212098

SEQ ID NO: 583307 - RNA, 64 nt, Homo Sapiens; identical to SEQ ID NO: 212099

SEQ ID NO: 583308 - RNA, 64 nt, Homo Sapiens; identical to SEQ ID NO: 212100

SEQ ID NO: 583309 - RNA, 64 nt, Homo Sapiens; identical to SEQ ID NO: 212101

SEQ ID NO: 583310 - RNA, 64 nt, Homo Sapiens; identical to SEQ ID NO: 212102

SEQ ID NO: 583311 - RNA, 64 nt, Homo Sapiens; identical to SEQ ID NO: 212103

SEQ ID NO: 583312 - RNA, 64 nt, Homo Sapiens; identical to SEQ ID NO: 212104

SEQ ID NO: 583313 - RNA, 64 nt, Homo Sapiens; identical to SEQ ID NO: 212105

SEQ ID NO: 583314 - RNA, 64 nt, Homo Sapiens; identical to SEQ ID NO: 212106

SEQ ID NO: 583315 - RNA, 64 nt, Homo Sapiens; identical to SEQ ID NO: 212107

SEQ ID NO: 583316 - RNA, 64 nt, Homo Sapiens; identical to SEQ ID NO: 212108

SEQ ID NO: 583317 - RNA, 64 nt, Homo Sapiens; identical to SEQ ID NO: 212109

SEQ ID NO: 583318 - RNA, 64 nt, Homo Sapiens; identical to SEQ ID NO: 212110

SEQ ID NO: 583319 - RNA, 64 nt, Homo Sapiens; identical to SEQ ID NO: 212111

SEQ ID NO: 583320 - RNA, 64 nt, Homo Sapiens; identical to SEQ ID NO: 212112

SEQ ID NO: 583321 - RNA, 64 nt, Homo Sapiens; identical to SEQ ID NO: 212113

SEQ ID NO: 583322 - RNA, 64 nt, Homo Sapiens; identical to SEQ ID NO: 212114

SEQ ID NO: 583323 - RNA, 64 nt, Homo Sapiens; identical to SEQ ID NO: 212115

SEQ ID NO: 583324 - RNA, 64 nt, Homo Sapiens; identical to SEQ ID NO: 212116

SEQ ID NO: 583325 - RNA, 64 nt, Homo Sapiens; identical to SEQ ID NO: 212117

SEQ ID NO: 583326 - RNA, 64 nt, Homo Sapiens; identical to SEQ ID NO: 212118

SEQ ID NO: 583327 - RNA, 64 nt, Homo Sapiens; identical to SEQ ID NO: 212119

SEQ ID NO: 583328 - RNA, 64 nt, Homo Sapiens; identical to SEQ ID NO: 212120

SEQ ID NO: 583329 - RNA, 64 nt, Homo Sapiens; identical to SEQ ID NO: 212121

SEQ ID NO: 583330 - RNA, 64 nt, Homo Sapiens; identical to SEQ ID NO: 212122

SEQ ID NO: 583331 - RNA, 64 nt, Homo Sapiens; identical to SEQ ID NO: 212123

SEQ ID NO: 583332 - RNA, 64 nt, Homo Sapiens; identical to SEQ ID NO: 212124

SEQ ID NO: 583333 - RNA, 64 nt, Homo Sapiens; identical to SEQ ID NO: 212125

SEQ ID NO: 583334 - RNA, 64 nt, Homo Sapiens; identical to SEQ ID NO: 212126

SEQ ID NO: 583335 - RNA, 64 nt, Homo Sapiens; identical to SEQ ID NO: 212127

SEQ ID NO: 583336 - RNA, 64 nt, Homo Sapiens; identical to SEQ ID NO: 212128

SEQ ID NO: 583337 - RNA, 64 nt, Homo Sapiens; identical to SEQ ID NO: 212129

SEQ ID NO: 583338 - RNA, 64 nt, Homo Sapiens; identical to SEQ ID NO: 212130

SEQ ID NO: 583339 - RNA, 64 nt, Homo Sapiens; identical to SEQ ID NO: 212131

SEQ ID NO: 583340 - RNA, 64 nt, Homo Sapiens; identical to SEQ ID NO: 212132

SEQ ID NO: 583341 - RNA, 64 nt, Homo Sapiens; identical to SEQ ID NO: 212133

SEQ ID NO: 583342 - RNA, 64 nt, Homo Sapiens; identical to SEQ ID NO: 212134

SEQ ID NO: 583343 - RNA, 64 nt, Homo Sapiens; identical to SEQ ID NO: 212135

SEQ ID NO: 583344 - RNA, 64 nt, Homo Sapiens; identical to SEQ ID NO: 212136

SEQ ID NO: 583345 - RNA, 64 nt, Homo Sapiens; identical to SEQ ID NO: 212137

SEQ ID NO: 583346 - RNA, 64 nt, Homo Sapiens; identical to SEQ ID NO: 212138

SEQ ID NO: 583347 - RNA, 64 nt, Homo Sapiens; identical to SEQ ID NO: 212139

SEQ ID NO: 583348 - RNA, 64 nt, Homo Sapiens; identical to SEQ ID NO: 212140

SEQ ID NO: 583349 - RNA, 64 nt, Homo Sapiens; identical to SEQ ID NO: 212141

SEQ ID NO: 583350 - RNA, 64 nt, Homo Sapiens; identical to SEQ ID NO: 212142

SEQ ID NO: 583351 - RNA, 64 nt, Homo Sapiens; identical to SEQ ID NO: 212143

SEQ ID NO: 583352 - RNA, 64 nt, Homo Sapiens; identical to SEQ ID NO: 212144

SEQ ID NO: 583353 - RNA, 64 nt, Homo Sapiens; identical to SEQ ID NO: 212145

SEQ ID NO: 583354 - RNA, 64 nt, Homo Sapiens; identical to SEQ ID NO: 432758

SEQ ID NO: 583355 - RNA, 64 nt, Homo Sapiens; identical to SEQ ID NO: 432759

SEQ ID NO: 583356 - RNA, 64 nt, Homo Sapiens; identical to SEQ ID NO: 432760

SEQ ID NO: 583357 - RNA, 64 nt, Homo Sapiens; identical to SEQ ID NO: 432761

SEQ ID NO: 583358 - RNA, 64 nt, Homo Sapiens; identical to SEQ ID NO: 173045

SEQ ID NO: 583359 - RNA, 64 nt, Homo Sapiens; identical to SEQ ID NO: 173046

SEQ ID NO: 583360 - RNA, 64 nt, Homo Sapiens; identical to SEQ ID NO: 173047

SEQ ID NO: 583361 - RNA, 64 nt, Homo Sapiens; identical to SEQ ID NO: 173048

SEQ ID NO: 583362 - RNA, 64 nt, Homo Sapiens; identical to SEQ ID NO: 173049

SEQ ID NO: 583363 - RNA, 64 nt, Homo Sapiens; identical to SEQ ID NO: 173050

SEQ ID NO: 583364 - RNA, 64 nt, Homo Sapiens; identical to SEQ ID NO: 173051

SEQ ID NO: 583365 - RNA, 64 nt, Homo Sapiens; identical to SEQ ID NO: 173052

SEQ ID NO: 583366 - RNA, 64 nt, Homo Sapiens; identical to SEQ ID NO: 173053

SEQ ID NO: 583367 - RNA, 64 nt, Homo Sapiens; identical to SEQ ID NO: 173054

SEQ ID NO: 583368 - RNA, 64 nt, Homo Sapiens; identical to SEQ ID NO: 173055

SEQ ID NO: 583369 - RNA, 64 nt, Homo Sapiens; identical to SEQ ID NO: 173056

SEQ ID NO: 583370 - RNA, 64 nt, Homo Sapiens; identical to SEQ ID NO: 173057

SEQ ID NO: 583371 - RNA, 64 nt, Homo Sapiens; identical to SEQ ID NO: 173058

SEQ ID NO: 583372 - RNA, 59 nt, Homo Sapiens; identical to SEQ ID NO: 173059

SEQ ID NO: 583373 - RNA, 64 nt, Homo Sapiens; identical to SEQ ID NO: 173060

SEQ ID NO: 583374 - RNA, 64 nt, Homo Sapiens; identical to SEQ ID NO: 173061

SEQ ID NO: 583375 - RNA, 64 nt, Homo Sapiens; identical to SEQ ID NO: 173062

SEQ ID NO: 583376 - RNA, 64 nt, Homo Sapiens; identical to SEQ ID NO: 173063

SEQ ID NO: 583377 - RNA, 53 nt, Homo Sapiens; identical to SEQ ID NO: 173064

SEQ ID NO: 583378 - RNA, 64 nt, Homo Sapiens; identical to SEQ ID NO: 173065

SEQ ID NO: 583379 - RNA, 64 nt, Homo Sapiens; identical to SEQ ID NO: 173066

SEQ ID NO: 583380 - RNA, 64 nt, Homo Sapiens; identical to SEQ ID NO: 173067

SEQ ID NO: 583381 - RNA, 64 nt, Homo Sapiens; identical to SEQ ID NO: 173068

SEQ ID NO: 583382 - RNA, 64 nt, Homo Sapiens; identical to SEQ ID NO: 173069

SEQ ID NO: 583383 - RNA, 64 nt, Homo Sapiens; identical to SEQ ID NO: 173070

SEQ ID NO: 583384 - RNA, 64 nt, Homo Sapiens; identical to SEQ ID NO: 173071

SEQ ID NO: 583385 - RNA, 64 nt, Homo Sapiens; identical to SEQ ID NO: 173072

SEQ ID NO: 583386 - RNA, 64 nt, Homo Sapiens; identical to SEQ ID NO: 173073

SEQ ID NO: 583387 - RNA, 64 nt, Homo Sapiens; identical to SEQ ID NO: 173074

SEQ ID NO: 583388 - RNA, 64 nt, Homo Sapiens; identical to SEQ ID NO: 173075

SEQ ID NO: 583389 - RNA, 64 nt, Homo Sapiens; identical to SEQ ID NO: 173076

SEQ ID NO: 583390 - RNA, 64 nt, Homo Sapiens; identical to SEQ ID NO: 173077

SEQ ID NO: 583391 - RNA, 64 nt, Homo Sapiens; identical to SEQ ID NO: 173078

SEQ ID NO: 583392 - RNA, 64 nt, Homo Sapiens; identical to SEQ ID NO: 514707

SEQ ID NO: 583393 - RNA, 64 nt, Homo Sapiens; identical to SEQ ID NO: 514708

SEQ ID NO: 583394 - RNA, 64 nt, Homo Sapiens; identical to SEQ ID NO: 514709

SEQ ID NO: 583395 - RNA, 64 nt, Homo Sapiens; identical to SEQ ID NO: 514710

SEQ ID NO: 583396 - RNA, 64 nt, Homo Sapiens; identical to SEQ ID NO: 514711

SEQ ID NO: 583397 - RNA, 64 nt, Homo Sapiens; identical to SEQ ID NO: 514712

SEQ ID NO: 583398 - RNA, 64 nt, Homo Sapiens; identical to SEQ ID NO: 514713

SEQ ID NO: 583399 - RNA, 64 nt, Homo Sapiens; identical to SEQ ID NO: 514714

SEQ ID NO: 583400 - RNA, 64 nt, Homo Sapiens; identical to SEQ ID NO: 53480

SEQ ID NO: 583401 - RNA, 64 nt, Homo Sapiens; identical to SEQ ID NO: 53481

SEQ ID NO: 583402 - RNA, 64 nt, Homo Sapiens; identical to SEQ ID NO: 53482

SEQ ID NO: 583403 - RNA, 64 nt, Homo Sapiens; identical to SEQ ID NO: 53483

SEQ ID NO: 583404 - RNA, 64 nt, Homo Sapiens; identical to SEQ ID NO: 53484

SEQ ID NO: 583405 - RNA, 64 nt, Homo Sapiens; identical to SEQ ID NO: 53485

SEQ ID NO: 583406 - RNA, 64 nt, Homo Sapiens; identical to SEQ ID NO: 53486

SEQ ID NO: 583407 - RNA, 64 nt, Homo Sapiens; identical to SEQ ID NO: 53487

SEQ ID NO: 583408 - RNA, 64 nt, Homo Sapiens; identical to SEQ ID NO: 53488

SEQ ID NO: 583409 - RNA, 64 nt, Homo Sapiens; identical to SEQ ID NO: 53489

SEQ ID NO: 583410 - RNA, 64 nt, Homo Sapiens; identical to SEQ ID NO: 53490

SEQ ID NO: 583411 - RNA, 64 nt, Homo Sapiens; identical to SEQ ID NO: 53491

SEQ ID NO: 583412 - RNA, 64 nt, Homo Sapiens; identical to SEQ ID NO: 53492

SEQ ID NO: 583413 - RNA, 64 nt, Homo Sapiens; identical to SEQ ID NO: 53493

SEQ ID NO: 583414 - RNA, 64 nt, Homo Sapiens; identical to SEQ ID NO: 53494

SEQ ID NO: 583415 - RNA, 64 nt, Homo Sapiens; identical to SEQ ID NO: 53495

SEQ ID NO: 583416 - RNA, 64 nt, Homo Sapiens; identical to SEQ ID NO: 53496

SEQ ID NO: 583417 - RNA, 64 nt, Homo Sapiens; identical to SEQ ID NO: 53497

SEQ ID NO: 583418 - RNA, 64 nt, Homo Sapiens; identical to SEQ ID NO: 53498

SEQ ID NO: 583419 - RNA, 64 nt, Homo Sapiens; identical to SEQ ID NO: 53499

SEQ ID NO: 583420 - RNA, 64 nt, Homo Sapiens; identical to SEQ ID NO: 342523

SEQ ID NO: 583421 - RNA, 64 nt, Homo Sapiens; identical to SEQ ID NO: 342524

SEQ ID NO: 583422 - RNA, 64 nt, Homo Sapiens; identical to SEQ ID NO: 342525

SEQ ID NO: 583423 - RNA, 64 nt, Homo Sapiens; identical to SEQ ID NO: 342526

SEQ ID NO: 583424 - RNA, 64 nt, Homo Sapiens; identical to SEQ ID NO: 342527

SEQ ID NO: 583425 - RNA, 64 nt, Homo Sapiens; identical to SEQ ID NO: 342528

SEQ ID NO: 583426 - RNA, 64 nt, Homo Sapiens; identical to SEQ ID NO: 342529

SEQ ID NO: 583427 - RNA, 64 nt, Homo Sapiens; identical to SEQ ID NO: 342530

SEQ ID NO: 583428 - RNA, 61 nt, Homo Sapiens
uuuucacauucuggcaugugacuuucuuagcugguccuauuagauuaauuauauuucucuc

SEQ ID NO: 583429 - RNA, 61 nt, Homo Sapiens
uuugugcacauuuuuuugaaaguuucccucuugguccuagucucuucaaugauauuucagc

SEQ ID NO: 583430 - RNA, 64 nt, Homo Sapiens; identical to SEQ ID NO: 270631

SEQ ID NO: 583431 - RNA, 64 nt, Homo Sapiens; identical to SEQ ID NO: 270632

SEQ ID NO: 583432 - RNA, 64 nt, Homo Sapiens; identical to SEQ ID NO: 270633

SEQ ID NO: 583433 - RNA, 64 nt, Homo Sapiens; identical to SEQ ID NO: 270634

SEQ ID NO: 583434 - RNA, 64 nt, Homo Sapiens; identical to SEQ ID NO: 270635

SEQ ID NO: 583435 - RNA, 64 nt, Homo Sapiens; identical to SEQ ID NO: 270636

SEQ ID NO: 583436 - RNA, 64 nt, Homo Sapiens; identical to SEQ ID NO: 270637

SEQ ID NO: 583437 - RNA, 64 nt, Homo Sapiens; identical to SEQ ID NO: 270638

SEQ ID NO: 583438 - RNA, 64 nt, Homo Sapiens; identical to SEQ ID NO: 270639

SEQ ID NO: 583439 - RNA, 64 nt, Homo Sapiens; identical to SEQ ID NO: 270640

SEQ ID NO: 583440 - RNA, 64 nt, Homo Sapiens; identical to SEQ ID NO: 270641

SEQ ID NO: 583441 - RNA, 64 nt, Homo Sapiens; identical to SEQ ID NO: 270642

SEQ ID NO: 583442 - RNA, 64 nt, Homo Sapiens; identical to SEQ ID NO: 270643

SEQ ID NO: 583443 - RNA, 64 nt, Homo Sapiens; identical to SEQ ID NO: 270644

SEQ ID NO: 583444 - RNA, 64 nt, Homo Sapiens; identical to SEQ ID NO: 270645

SEQ ID NO: 583445 - RNA, 64 nt, Homo Sapiens; identical to SEQ ID NO: 270646

SEQ ID NO: 583446 - RNA, 64 nt, Homo Sapiens; identical to SEQ ID NO: 270647

SEQ ID NO: 583447 - RNA, 64 nt, Homo Sapiens; identical to SEQ ID NO: 270648

SEQ ID NO: 583448 - RNA, 64 nt, Homo Sapiens; identical to SEQ ID NO: 270649

SEQ ID NO: 583449 - RNA, 64 nt, Homo Sapiens; identical to SEQ ID NO: 270650

SEQ ID NO: 583450 - RNA, 64 nt, Homo Sapiens; identical to SEQ ID NO: 270651

SEQ ID NO: 583451 - RNA, 64 nt, Homo Sapiens; identical to SEQ ID NO: 270652

SEQ ID NO: 583452 - RNA, 64 nt, Homo Sapiens; identical to SEQ ID NO: 270653

SEQ ID NO: 583453 - RNA, 64 nt, Homo Sapiens; identical to SEQ ID NO: 270654

SEQ ID NO: 583454 - RNA, 64 nt, Homo Sapiens; identical to SEQ ID NO: 270655

SEQ ID NO: 583455 - RNA, 64 nt, Homo Sapiens; identical to SEQ ID NO: 270656

SEQ ID NO: 583456 - RNA, 64 nt, Homo Sapiens; identical to SEQ ID NO: 270657

SEQ ID NO: 583457 - RNA, 62 nt, Homo Sapiens; identical to SEQ ID NO: 270658

SEQ ID NO: 583458 - RNA, 64 nt, Homo Sapiens; identical to SEQ ID NO: 270659

SEQ ID NO: 583459 - RNA, 64 nt, Homo Sapiens; identical to SEQ ID NO: 270660

SEQ ID NO: 583460 - RNA, 64 nt, Homo Sapiens; identical to SEQ ID NO: 270661

SEQ ID NO: 583461 - RNA, 64 nt, Homo Sapiens; identical to SEQ ID NO: 197032

SEQ ID NO: 583462 - RNA, 64 nt, Homo Sapiens; identical to SEQ ID NO: 197033

SEQ ID NO: 583463 - RNA, 64 nt, Homo Sapiens; identical to SEQ ID NO: 197034

SEQ ID NO: 583464 - RNA, 64 nt, Homo Sapiens; identical to SEQ ID NO: 197035

SEQ ID NO: 583465 - RNA, 64 nt, Homo Sapiens; identical to SEQ ID NO: 197036

SEQ ID NO: 583466 - RNA, 64 nt, Homo Sapiens; identical to SEQ ID NO: 197037

SEQ ID NO: 583467 - RNA, 64 nt, Homo Sapiens; identical to SEQ ID NO: 197038

SEQ ID NO: 583468 - RNA, 64 nt, Homo Sapiens; identical to SEQ ID NO: 197039

SEQ ID NO: 583469 - RNA, 64 nt, Homo Sapiens; identical to SEQ ID NO: 197040

SEQ ID NO: 583470 - RNA, 64 nt, Homo Sapiens; identical to SEQ ID NO: 197041

SEQ ID NO: 583471 - RNA, 64 nt, Homo Sapiens; identical to SEQ ID NO: 197042

SEQ ID NO: 583472 - RNA, 64 nt, Homo Sapiens; identical to SEQ ID NO: 197043

SEQ ID NO: 583473 - RNA, 64 nt, Homo Sapiens; identical to SEQ ID NO: 197044

SEQ ID NO: 583474 - RNA, 64 nt, Homo Sapiens; identical to SEQ ID NO: 197045

SEQ ID NO: 583475 - RNA, 64 nt, Homo Sapiens; identical to SEQ ID NO: 197046

SEQ ID NO: 583476 - RNA, 64 nt, Homo Sapiens; identical to SEQ ID NO: 197047

SEQ ID NO: 583477 - RNA, 64 nt, Homo Sapiens; identical to SEQ ID NO: 197048

SEQ ID NO: 583478 - RNA, 64 nt, Homo Sapiens; identical to SEQ ID NO: 197049

SEQ ID NO: 583479 - RNA, 64 nt, Homo Sapiens; identical to SEQ ID NO: 197050

SEQ ID NO: 583480 - RNA, 64 nt, Homo Sapiens; identical to SEQ ID NO: 197051

SEQ ID NO: 583481 - RNA, 64 nt, Homo Sapiens; identical to SEQ ID NO: 197052

SEQ ID NO: 583482 - RNA, 64 nt, Homo Sapiens; identical to SEQ ID NO: 197053

SEQ ID NO: 583483 - RNA, 64 nt, Homo Sapiens; identical to SEQ ID NO: 197054

SEQ ID NO: 583484 - RNA, 64 nt, Homo Sapiens; identical to SEQ ID NO: 197055

SEQ ID NO: 583485 - RNA, 64 nt, Homo Sapiens; identical to SEQ ID NO: 197056

SEQ ID NO: 583486 - RNA, 64 nt, Homo Sapiens; identical to SEQ ID NO: 197057

SEQ ID NO: 583487 - RNA, 64 nt, Homo Sapiens; identical to SEQ ID NO: 197058

SEQ ID NO: 583488 - RNA, 64 nt, Homo Sapiens; identical to SEQ ID NO: 197059

SEQ ID NO: 583489 - RNA, 64 nt, Homo Sapiens; identical to SEQ ID NO: 197060

SEQ ID NO: 583490 - RNA, 64 nt, Homo Sapiens; identical to SEQ ID NO: 197061

SEQ ID NO: 583491 - RNA, 64 nt, Homo Sapiens; identical to SEQ ID NO: 197062

SEQ ID NO: 583492 - RNA, 64 nt, Homo Sapiens; identical to SEQ ID NO: 197063

SEQ ID NO: 583493 - RNA, 64 nt, Homo Sapiens; identical to SEQ ID NO: 197064

SEQ ID NO: 583494 - RNA, 64 nt, Homo Sapiens; identical to SEQ ID NO: 197065

SEQ ID NO: 583495 - RNA, 64 nt, Homo Sapiens; identical to SEQ ID NO: 197066

SEQ ID NO: 583496 - RNA, 64 nt, Homo Sapiens; identical to SEQ ID NO: 197067

SEQ ID NO: 583497 - RNA, 64 nt, Homo Sapiens; identical to SEQ ID NO: 197068

SEQ ID NO: 583498 - RNA, 64 nt, Homo Sapiens; identical to SEQ ID NO: 197069

SEQ ID NO: 583499 - RNA, 64 nt, Homo Sapiens; identical to SEQ ID NO: 197070

SEQ ID NO: 583500 - RNA, 64 nt, Homo Sapiens; identical to SEQ ID NO: 197071

SEQ ID NO: 583501 - RNA, 64 nt, Homo Sapiens; identical to SEQ ID NO: 197072

SEQ ID NO: 583502 - RNA, 63 nt, Homo Sapiens; identical to SEQ ID NO: 197073

SEQ ID NO: 583503 - RNA, 64 nt, Homo Sapiens; identical to SEQ ID NO: 197074

SEQ ID NO: 583504 - RNA, 64 nt, Homo Sapiens; identical to SEQ ID NO: 197075

SEQ ID NO: 583505 - RNA, 64 nt, Homo Sapiens; identical to SEQ ID NO: 197076

SEQ ID NO: 583506 - RNA, 64 nt, Homo Sapiens; identical to SEQ ID NO: 197077

SEQ ID NO: 583507 - RNA, 64 nt, Homo Sapiens; identical to SEQ ID NO: 197078

SEQ ID NO: 583508 - RNA, 64 nt, Homo Sapiens; identical to SEQ ID NO: 197079

SEQ ID NO: 583509 - RNA, 64 nt, Homo Sapiens; identical to SEQ ID NO: 197080

SEQ ID NO: 583510 - RNA, 64 nt, Homo Sapiens; identical to SEQ ID NO: 197081

SEQ ID NO: 583511 - RNA, 64 nt, Homo Sapiens; identical to SEQ ID NO: 197082

SEQ ID NO: 583512 - RNA, 64 nt, Homo Sapiens; identical to SEQ ID NO: 197083

SEQ ID NO: 583513 - RNA, 64 nt, Homo Sapiens; identical to SEQ ID NO: 197084

SEQ ID NO: 583514 - RNA, 64 nt, Homo Sapiens; identical to SEQ ID NO: 197085

SEQ ID NO: 583515 - RNA, 64 nt, Homo Sapiens; identical to SEQ ID NO: 197086

SEQ ID NO: 583516 - RNA, 64 nt, Homo Sapiens; identical to SEQ ID NO: 197087

SEQ ID NO: 583517 - RNA, 64 nt, Homo Sapiens; identical to SEQ ID NO: 197088

SEQ ID NO: 583518 - RNA, 64 nt, Homo Sapiens; identical to SEQ ID NO: 197089

SEQ ID NO: 583519 - RNA, 64 nt, Homo Sapiens; identical to SEQ ID NO: 197090

SEQ ID NO: 583520 - RNA, 64 nt, Homo Sapiens; identical to SEQ ID NO: 197091

SEQ ID NO: 583521 - RNA, 64 nt, Homo Sapiens; identical to SEQ ID NO: 197092

SEQ ID NO: 583522 - RNA, 64 nt, Homo Sapiens; identical to SEQ ID NO: 197093

SEQ ID NO: 583523 - RNA, 64 nt, Homo Sapiens; identical to SEQ ID NO: 197094

SEQ ID NO: 583524 - RNA, 64 nt, Homo Sapiens; identical to SEQ ID NO: 61460

SEQ ID NO: 583525 - RNA, 64 nt, Homo Sapiens; identical to SEQ ID NO: 61461

SEQ ID NO: 583526 - RNA, 64 nt, Homo Sapiens; identical to SEQ ID NO: 61462

SEQ ID NO: 583527 - RNA, 64 nt, Homo Sapiens; identical to SEQ ID NO: 61463

SEQ ID NO: 583528 - RNA, 64 nt, Homo Sapiens; identical to SEQ ID NO: 61464

SEQ ID NO: 583529 - RNA, 64 nt, Homo Sapiens; identical to SEQ ID NO: 61465

SEQ ID NO: 583530 - RNA, 64 nt, Homo Sapiens; identical to SEQ ID NO: 61466

SEQ ID NO: 583531 - RNA, 64 nt, Homo Sapiens; identical to SEQ ID NO: 61467

SEQ ID NO: 583532 - RNA, 64 nt, Homo Sapiens; identical to SEQ ID NO: 61468

SEQ ID NO: 583533 - RNA, 64 nt, Homo Sapiens; identical to SEQ ID NO: 61469

SEQ ID NO: 583534 - RNA, 64 nt, Homo Sapiens; identical to SEQ ID NO: 61470

SEQ ID NO: 583535 - RNA, 64 nt, Homo Sapiens; identical to SEQ ID NO: 61471

SEQ ID NO: 583536 - RNA, 64 nt, Homo Sapiens; identical to SEQ ID NO: 61472

SEQ ID NO: 583537 - RNA, 64 nt, Homo Sapiens; identical to SEQ ID NO: 61473

SEQ ID NO: 583538 - RNA, 64 nt, Homo Sapiens; identical to SEQ ID NO: 61474

SEQ ID NO: 583539 - RNA, 64 nt, Homo Sapiens; identical to SEQ ID NO: 61475

SEQ ID NO: 583540 - RNA, 64 nt, Homo Sapiens; identical to SEQ ID NO: 61476

SEQ ID NO: 583541 - RNA, 64 nt, Homo Sapiens; identical to SEQ ID NO: 61477

SEQ ID NO: 583542 - RNA, 64 nt, Homo Sapiens; identical to SEQ ID NO: 61478

SEQ ID NO: 583543 - RNA, 64 nt, Homo Sapiens; identical to SEQ ID NO: 61479

SEQ ID NO: 583544 - RNA, 64 nt, Homo Sapiens; identical to SEQ ID NO: 61480

SEQ ID NO: 583545 - RNA, 64 nt, Homo Sapiens; identical to SEQ ID NO: 61481

SEQ ID NO: 583546 - RNA, 64 nt, Homo Sapiens; identical to SEQ ID NO: 61482

SEQ ID NO: 583547 - RNA, 64 nt, Homo Sapiens; identical to SEQ ID NO: 61483

SEQ ID NO: 583548 - RNA, 64 nt, Homo Sapiens; identical to SEQ ID NO: 61484

SEQ ID NO: 583549 - RNA, 64 nt, Homo Sapiens; identical to SEQ ID NO: 61485

SEQ ID NO: 583550 - RNA, 64 nt, Homo Sapiens; identical to SEQ ID NO: 61486

SEQ ID NO: 583551 - RNA, 64 nt, Homo Sapiens; identical to SEQ ID NO: 61487

SEQ ID NO: 583552 - RNA, 64 nt, Homo Sapiens; identical to SEQ ID NO: 61488

SEQ ID NO: 583553 - RNA, 64 nt, Homo Sapiens; identical to SEQ ID NO: 61489

SEQ ID NO: 583554 - RNA, 64 nt, Homo Sapiens; identical to SEQ ID NO: 61490

SEQ ID NO: 583555 - RNA, 64 nt, Homo Sapiens; identical to SEQ ID NO: 61491

SEQ ID NO: 583556 - RNA, 64 nt, Homo Sapiens; identical to SEQ ID NO: 61492

SEQ ID NO: 583557 - RNA, 64 nt, Homo Sapiens; identical to SEQ ID NO: 61493

SEQ ID NO: 583558 - RNA, 64 nt, Homo Sapiens; identical to SEQ ID NO: 61494

SEQ ID NO: 583559 - RNA, 64 nt, Homo Sapiens; identical to SEQ ID NO: 556838

SEQ ID NO: 583560 - RNA, 64 nt, Homo Sapiens; identical to SEQ ID NO: 556839

SEQ ID NO: 583561 - RNA, 64 nt, Homo Sapiens; identical to SEQ ID NO: 556840

SEQ ID NO: 583562 - RNA, 64 nt, Homo Sapiens; identical to SEQ ID NO: 556841

SEQ ID NO: 583563 - RNA, 64 nt, Homo Sapiens; identical to SEQ ID NO: 556842

SEQ ID NO: 583564 - RNA, 64 nt, Homo Sapiens; identical to SEQ ID NO: 556843

SEQ ID NO: 583565 - RNA, 64 nt, Homo Sapiens; identical to SEQ ID NO: 556844

SEQ ID NO: 583566 - RNA, 64 nt, Homo Sapiens; identical to SEQ ID NO: 556845

SEQ ID NO: 583567 - RNA, 64 nt, Homo Sapiens; identical to SEQ ID NO: 556846

SEQ ID NO: 583568 - RNA, 64 nt, Homo Sapiens; identical to SEQ ID NO: 556847

SEQ ID NO: 583569 - RNA, 64 nt, Homo Sapiens; identical to SEQ ID NO: 556848

SEQ ID NO: 583570 - RNA, 64 nt, Homo Sapiens; identical to SEQ ID NO: 556849

SEQ ID NO: 583571 - RNA, 64 nt, Homo Sapiens; identical to SEQ ID NO: 556850

SEQ ID NO: 583572 - RNA, 64 nt, Homo Sapiens; identical to SEQ ID NO: 556851

SEQ ID NO: 583573 - RNA, 64 nt, Homo Sapiens; identical to SEQ ID NO: 556852

SEQ ID NO: 583574 - RNA, 64 nt, Homo Sapiens; identical to SEQ ID NO: 556853

SEQ ID NO: 583575 - RNA, 64 nt, Homo Sapiens; identical to SEQ ID NO: 556854

SEQ ID NO: 583576 - RNA, 64 nt, Homo Sapiens; identical to SEQ ID NO: 556855

SEQ ID NO: 583577 - RNA, 64 nt, Homo Sapiens; identical to SEQ ID NO: 556856

SEQ ID NO: 583578 - RNA, 64 nt, Homo Sapiens; identical to SEQ ID NO: 556857

SEQ ID NO: 583579 - RNA, 64 nt, Homo Sapiens; identical to SEQ ID NO: 556858

SEQ ID NO: 583580 - RNA, 64 nt, Homo Sapiens; identical to SEQ ID NO: 556859

SEQ ID NO: 583581 - RNA, 64 nt, Homo Sapiens; identical to SEQ ID NO: 556860

SEQ ID NO: 583582 - RNA, 64 nt, Homo Sapiens; identical to SEQ ID NO: 556861

SEQ ID NO: 583583 - RNA, 64 nt, Homo Sapiens; identical to SEQ ID NO: 71120

SEQ ID NO: 583584 - RNA, 64 nt, Homo Sapiens; identical to SEQ ID NO: 71121

SEQ ID NO: 583585 - RNA, 64 nt, Homo Sapiens; identical to SEQ ID NO: 71122

SEQ ID NO: 583586 - RNA, 64 nt, Homo Sapiens; identical to SEQ ID NO: 71123

SEQ ID NO: 583587 - RNA, 64 nt, Homo Sapiens; identical to SEQ ID NO: 71124

SEQ ID NO: 583588 - RNA, 64 nt, Homo Sapiens; identical to SEQ ID NO: 71125

SEQ ID NO: 583589 - RNA, 64 nt, Homo Sapiens; identical to SEQ ID NO: 71126

SEQ ID NO: 583590 - RNA, 64 nt, Homo Sapiens; identical to SEQ ID NO: 71127

SEQ ID NO: 583591 - RNA, 64 nt, Homo Sapiens; identical to SEQ ID NO: 71128

SEQ ID NO: 583592 - RNA, 64 nt, Homo Sapiens; identical to SEQ ID NO: 71129

SEQ ID NO: 583593 - RNA, 64 nt, Homo Sapiens; identical to SEQ ID NO: 71130

SEQ ID NO: 583594 - RNA, 64 nt, Homo Sapiens; identical to SEQ ID NO: 71131

SEQ ID NO: 583595 - RNA, 64 nt, Homo Sapiens; identical to SEQ ID NO: 71132

SEQ ID NO: 583596 - RNA, 64 nt, Homo Sapiens; identical to SEQ ID NO: 71133

SEQ ID NO: 583597 - RNA, 64 nt, Homo Sapiens; identical to SEQ ID NO: 71134

SEQ ID NO: 583598 - RNA, 64 nt, Homo Sapiens; identical to SEQ ID NO: 71135

SEQ ID NO: 583599 - RNA, 64 nt, Homo Sapiens; identical to SEQ ID NO: 71136

SEQ ID NO: 583600 - RNA, 64 nt, Homo Sapiens; identical to SEQ ID NO: 71137

SEQ ID NO: 583601 - RNA, 64 nt, Homo Sapiens; identical to SEQ ID NO: 71138

SEQ ID NO: 583602 - RNA, 64 nt, Homo Sapiens; identical to SEQ ID NO: 71139

SEQ ID NO: 583603 - RNA, 64 nt, Homo Sapiens; identical to SEQ ID NO: 71140

SEQ ID NO: 583604 - RNA, 64 nt, Homo Sapiens; identical to SEQ ID NO: 71141

SEQ ID NO: 583605 - RNA, 64 nt, Homo Sapiens; identical to SEQ ID NO: 71142

SEQ ID NO: 583606 - RNA, 64 nt, Homo Sapiens; identical to SEQ ID NO: 71143

SEQ ID NO: 583607 - RNA, 64 nt, Homo Sapiens; identical to SEQ ID NO: 71144

SEQ ID NO: 583608 - RNA, 64 nt, Homo Sapiens; identical to SEQ ID NO: 71145

SEQ ID NO: 583609 - RNA, 64 nt, Homo Sapiens; identical to SEQ ID NO: 71146

SEQ ID NO: 583610 - RNA, 62 nt, Homo Sapiens; identical to SEQ ID NO: 71147

SEQ ID NO: 583611 - RNA, 64 nt, Homo Sapiens; identical to SEQ ID NO: 71148

SEQ ID NO: 583612 - RNA, 64 nt, Homo Sapiens; identical to SEQ ID NO: 71149

SEQ ID NO: 583613 - RNA, 64 nt, Homo Sapiens; identical to SEQ ID NO: 71150

SEQ ID NO: 583614 - RNA, 64 nt, Homo Sapiens; identical to SEQ ID NO: 71151

SEQ ID NO: 583615 - RNA, 64 nt, Homo Sapiens; identical to SEQ ID NO: 71152

SEQ ID NO: 583616 - RNA, 64 nt, Homo Sapiens; identical to SEQ ID NO: 71153

SEQ ID NO: 583617 - RNA, 64 nt, Homo Sapiens; identical to SEQ ID NO: 71154

SEQ ID NO: 583618 - RNA, 64 nt, Homo Sapiens; identical to SEQ ID NO: 71155

SEQ ID NO: 583619 - RNA, 64 nt, Homo Sapiens; identical to SEQ ID NO: 71156

SEQ ID NO: 583620 - RNA, 64 nt, Homo Sapiens; identical to SEQ ID NO: 71157

SEQ ID NO: 583621 - RNA, 64 nt, Homo Sapiens; identical to SEQ ID NO: 71158

SEQ ID NO: 583622 - RNA, 64 nt, Homo Sapiens; identical to SEQ ID NO: 71159

SEQ ID NO: 583623 - RNA, 64 nt, Homo Sapiens; identical to SEQ ID NO: 71160

SEQ ID NO: 583624 - RNA, 64 nt, Homo Sapiens; identical to SEQ ID NO: 71161

SEQ ID NO: 583625 - RNA, 64 nt, Homo Sapiens; identical to SEQ ID NO: 71162

SEQ ID NO: 583626 - RNA, 64 nt, Homo Sapiens; identical to SEQ ID NO: 71163

SEQ ID NO: 583627 - RNA, 64 nt, Homo Sapiens; identical to SEQ ID NO: 71164

SEQ ID NO: 583628 - RNA, 64 nt, Homo Sapiens; identical to SEQ ID NO: 71165

SEQ ID NO: 583629 - RNA, 64 nt, Homo Sapiens; identical to SEQ ID NO: 71166

SEQ ID NO: 583630 - RNA, 64 nt, Homo Sapiens; identical to SEQ ID NO: 71167

SEQ ID NO: 583631 - RNA, 64 nt, Homo Sapiens; identical to SEQ ID NO: 71168

SEQ ID NO: 583632 - RNA, 64 nt, Homo Sapiens; identical to SEQ ID NO: 71169

SEQ ID NO: 583633 - RNA, 64 nt, Homo Sapiens; identical to SEQ ID NO: 71170

SEQ ID NO: 583634 - RNA, 64 nt, Homo Sapiens; identical to SEQ ID NO: 71171

SEQ ID NO: 583635 - RNA, 64 nt, Homo Sapiens; identical to SEQ ID NO: 71172

SEQ ID NO: 583636 - RNA, 64 nt, Homo Sapiens; identical to SEQ ID NO: 71173

SEQ ID NO: 583637 - RNA, 64 nt, Homo Sapiens; identical to SEQ ID NO: 71174

SEQ ID NO: 583638 - RNA, 64 nt, Homo Sapiens; identical to SEQ ID NO: 71175

SEQ ID NO: 583639 - RNA, 64 nt, Homo Sapiens; identical to SEQ ID NO: 71176

SEQ ID NO: 583640 - RNA, 64 nt, Homo Sapiens; identical to SEQ ID NO: 71177

SEQ ID NO: 583641 - RNA, 64 nt, Homo Sapiens; identical to SEQ ID NO: 71178

SEQ ID NO: 583642 - RNA, 64 nt, Homo Sapiens; identical to SEQ ID NO: 71179

SEQ ID NO: 583643 - RNA, 64 nt, Homo Sapiens; identical to SEQ ID NO: 71180

SEQ ID NO: 583644 - RNA, 64 nt, Homo Sapiens; identical to SEQ ID NO: 71181

SEQ ID NO: 583645 - RNA, 64 nt, Homo Sapiens; identical to SEQ ID NO: 71182

SEQ ID NO: 583646 - RNA, 64 nt, Homo Sapiens; identical to SEQ ID NO: 71183

SEQ ID NO: 583647 - RNA, 64 nt, Homo Sapiens; identical to SEQ ID NO: 71184

SEQ ID NO: 583648 - RNA, 64 nt, Homo Sapiens; identical to SEQ ID NO: 71185

SEQ ID NO: 583649 - RNA, 64 nt, Homo Sapiens; identical to SEQ ID NO: 71186

SEQ ID NO: 583650 - RNA, 64 nt, Homo Sapiens; identical to SEQ ID NO: 71187

SEQ ID NO: 583651 - RNA, 64 nt, Homo Sapiens; identical to SEQ ID NO: 71188

SEQ ID NO: 583652 - RNA, 64 nt, Homo Sapiens; identical to SEQ ID NO: 71189

SEQ ID NO: 583653 - RNA, 64 nt, Homo Sapiens; identical to SEQ ID NO: 71190

SEQ ID NO: 583654 - RNA, 64 nt, Homo Sapiens; identical to SEQ ID NO: 71191

SEQ ID NO: 583655 - RNA, 64 nt, Homo Sapiens; identical to SEQ ID NO: 71192

SEQ ID NO: 583656 - RNA, 64 nt, Homo Sapiens; identical to SEQ ID NO: 71193

SEQ ID NO: 583657 - RNA, 64 nt, Homo Sapiens; identical to SEQ ID NO: 71194

SEQ ID NO: 583658 - RNA, 64 nt, Homo Sapiens; identical to SEQ ID NO: 71195

SEQ ID NO: 583659 - RNA, 64 nt, Homo Sapiens; identical to SEQ ID NO: 71196

SEQ ID NO: 583660 - RNA, 64 nt, Homo Sapiens; identical to SEQ ID NO: 71197

SEQ ID NO: 583661 - RNA, 64 nt, Homo Sapiens; identical to SEQ ID NO: 71198

SEQ ID NO: 583662 - RNA, 64 nt, Homo Sapiens; identical to SEQ ID NO: 71199

SEQ ID NO: 583663 - RNA, 64 nt, Homo Sapiens; identical to SEQ ID NO: 71200

SEQ ID NO: 583664 - RNA, 64 nt, Homo Sapiens; identical to SEQ ID NO: 71201

SEQ ID NO: 583665 - RNA, 64 nt, Homo Sapiens; identical to SEQ ID NO: 71202

SEQ ID NO: 583666 - RNA, 64 nt, Homo Sapiens; identical to SEQ ID NO: 71203

SEQ ID NO: 583667 - RNA, 64 nt, Homo Sapiens; identical to SEQ ID NO: 71204

SEQ ID NO: 583668 - RNA, 64 nt, Homo Sapiens; identical to SEQ ID NO: 71205

SEQ ID NO: 583669 - RNA, 64 nt, Homo Sapiens; identical to SEQ ID NO: 71206

SEQ ID NO: 583670 - RNA, 64 nt, Homo Sapiens; identical to SEQ ID NO: 71207

SEQ ID NO: 583671 - RNA, 64 nt, Homo Sapiens; identical to SEQ ID NO: 71208

SEQ ID NO: 583672 - RNA, 64 nt, Homo Sapiens
aaugaagcaacacuugagcuguucaggccaguucccuguugaagaaacaguucccuguugaaga

SEQ ID NO: 583673 - RNA, 64 nt, Homo Sapiens
uguucaggccaguucccuguugaagaaacaguucccuguugaagaaaguagagccugacacugc

SEQ ID NO: 583674 - RNA, 64 nt, Homo Sapiens
ccucagacuucaccuaacuuuaguucuagaaucaccuguugacugguugcacuuucauuugcuu

SEQ ID NO: 583675 - RNA, 64 nt, Homo Sapiens
uugcaucuuuccacaggacuaagacaguacaucuccuguugaacccuaacaaagaagucugucu

SEQ ID NO: 583676 - RNA, 64 nt, Homo Sapiens
ggcaaucauaaaaaguaauaaagguucuuuuugaccuguugacaaauguauuuaagccuuugga

SEQ ID NO: 583677 - RNA, 64 nt, Homo Sapiens
guugacaaauguauuuaagccuuuggauuuaaagccuguugaggcuggaguuaggaggcagauu

SEQ ID NO: 583678 - RNA, 64 nt, Homo Sapiens
acuuuuuguuguuuaauguguagcuuguuugugcccuguugacauaaauguuuccuggguuugc

SEQ ID NO: 583679 - RNA, 64 nt, Homo Sapiens
cccauugaucaccuugugcccucuuuuggggcagccuguugaaacugaagcacagucugaccac

SEQ ID NO: 583680 - RNA, 64 nt, Homo Sapiens
ugagucuucagggcagugucuccaugaggguuuuccuguugaggggcaccacauacaauagugu

SEQ ID NO: 583681 - RNA, 64 nt, Homo Sapiens
uguuuugugcaugaguaguacuuguguugauacuccuguugauguuaaauuacuauauaauaua

SEQ ID NO: 583682 - RNA, 64 nt, Homo Sapiens
uggugaauaaaaccuugcucguauuuccugcuucccuguugaauacacagauuauguuccugcu

SEQ ID NO: 583683 - RNA, 64 nt, Homo Sapiens
gccccaucuggauguaaaucgugcugaaugggacccuguugaugauugugcccacccagggaag

SEQ ID NO: 583684 - RNA, 64 nt, Homo Sapiens
uucuguacuaagaaaaauucuucugccuugggauccuguugaucuaugaccuuacccccaaccu

SEQ ID NO: 583685 - RNA, 64 nt, Homo Sapiens
acaagcuagucuagcucacugcagccaagcaaacccuguugauggcugaugggccuuuccauua

SEQ ID NO: 583686 - RNA, 64 nt, Homo Sapiens
acuuccucucuaccccccacaccgagaugugaguccuguugaaguagugagagaggaggccugg

SEQ ID NO: 583687 - RNA, 64 nt, Homo Sapiens
ugggugggccugacuguugcuugaagaaucugccccuguugagggugugugaacugggcacaga

SEQ ID NO: 583688 - RNA, 64 nt, Homo Sapiens
ucgaguucuccuuucccaagccgcugaccuggccccuguugacggccuggggcucugggggucc

SEQ ID NO: 583689 - RNA, 64 nt, Homo Sapiens
cauuuggagauccuagauggcccgucccuacacuccuguugacuggaucuagaagucuuggguc

SEQ ID NO: 583690 - RNA, 64 nt, Homo Sapiens
uaguccagucuucauuuuacauacacacacauauuuuacacacacacacauuuuacacacacac

SEQ ID NO: 583691 - RNA, 64 nt, Homo Sapiens
uacauacacacacauauuuuacacacacacacauuuuacacacacacacacacacacacacaua

SEQ ID NO: 583692 - RNA, 64 nt, Homo Sapiens
cccagaugguagagccuauuaaaaucagcuuguauuuacacaaauaguuagggaaucuugugug

SEQ ID NO: 583693 - RNA, 64 nt, Homo Sapiens
ccauuuuaucacaaaugacuuuaguuucauuacuuuuacacacauuuaacaccccacaccaauu

SEQ ID NO: 583694 - RNA, 64 nt, Homo Sapiens
uuucuguaaaaauuguauuguauauaaugugauuuuuacacauacauacacacacaaauacaca

SEQ ID NO: 583695 - RNA, 64 nt, Homo Sapiens
gcaauauaaaauucauaggaguauuaauagcccauuuacacaucuauaaaauguaaugggauug

SEQ ID NO: 583696 - RNA, 64 nt, Homo Sapiens
agauaaucaucuuaaugugaauaccuaggaaagauuuacacaauacaucaagaaacagacacac

SEQ ID NO: 583697 - RNA, 64 nt, Homo Sapiens
aagaaacagacacacauaccuuucagaguuuugguuuacacaucaaaguuagaucaagagaaua

SEQ ID NO: 583698 - RNA, 64 nt, Homo Sapiens
guugggaguaguuaauaguaaauaagacucugacuuuacacaagcuacacauuuuauacuuuuc

SEQ ID NO: 583699 - RNA, 64 nt, Homo Sapiens
uucuaugaaauuccauauaaagaaugaugauaaguuuacacacugugcaaucucacaaucugaa

SEQ ID NO: 583700 - RNA, 64 nt, Homo Sapiens
gugccacuuauuaaagagcuugauuuauagaggguuuacacaaacauuucgaaucuguuuuuca

SEQ ID NO: 583701 - RNA, 64 nt, Homo Sapiens
gagaugacuauggcagugauuuacccaaauaucguuuacacagaaaauguugugauggcaagcc

SEQ ID NO: 583702 - RNA, 64 nt, Homo Sapiens
auaaaucaucaaauauaucagauuaagaccaggguuuacacacuuaggcaauaguccuuuccaa

SEQ ID NO: 583703 - RNA, 64 nt, Homo Sapiens
gcacagaguugaccaaacacuggcguaaguucaauuuacacagaauauuugaauugaaacaaua

SEQ ID NO: 583704 - RNA, 64 nt, Homo Sapiens
caacacauacuguuuccaaacuuaauguggacaauuuacacacccauauguaaaauauguuuug

SEQ ID NO: 583705 - RNA, 64 nt, Homo Sapiens
agcaacugccaaaucugugggggcaaaguuaugauuuacacagaagccuuugguggauguuaug

SEQ ID NO: 583706 - RNA, 64 nt, Homo Sapiens
uaguaaacaauauuucuacuucccacaucuuugcuuuacacagucaccuugcccuuccuuccac

SEQ ID NO: 583707 - RNA, 64 nt, Homo Sapiens
aauuaccaggcacagauuuagucuugucauuuuguuuacacauuggggaaaacaauucaguuua

SEQ ID NO: 583708 - RNA, 64 nt, Homo Sapiens
cccugcccaagacuuuauuuaacccuggacuccguuuacacagacaaagugacaucagaaggcu

SEQ ID NO: 583709 - RNA, 64 nt, Homo Sapiens
ugaguguuuuuaauuuaaagauaaaagccuguguuuuacacauucuuuuuugguguucauagcu

SEQ ID NO: 583710 - RNA, 64 nt, Homo Sapiens
gugaauccauucccaucaguugcagugaacacuguuuacacaccgcuguuagccuuagagugau

SEQ ID NO: 583711 - RNA, 64 nt, Homo Sapiens
caccucagacacaccauuuccagcaacgguaccguuuacacagucguuuucagucaguguuguc

SEQ ID NO: 583712 - RNA, 64 nt, Homo Sapiens; identical to SEQ ID NO: 216241

SEQ ID NO: 583713 - RNA, 64 nt, Homo Sapiens; identical to SEQ ID NO: 216242

SEQ ID NO: 583714 - RNA, 64 nt, Homo Sapiens; identical to SEQ ID NO: 216243

SEQ ID NO: 583715 - RNA, 64 nt, Homo Sapiens; identical to SEQ ID NO: 216244

SEQ ID NO: 583716 - RNA, 64 nt, Homo Sapiens
uaaaagaaauaguaaagauaaguuauccucacuuaggcaaaagcacagguccuuuccauaucaa

SEQ ID NO: 583717 - RNA, 64 nt, Homo Sapiens
uuuaaauuauaaaacacuuuuaauuauauauaugaggcaaaagaacuaagacuuuuuucaaacu

SEQ ID NO: 583718 - RNA, 64 nt, Homo Sapiens
uugagaaacuucugcauuuaguuucuaucuuuccaggcaaaacaaauggguauucuuuucauac

SEQ ID NO: 583719 - RNA, 64 nt, Homo Sapiens
aaaaugaguaacuuugauaaaguuuuucaugcacaggcaaaauguauucacuagauuucuacgu

SEQ ID NO: 583720 - RNA, 64 nt, Homo Sapiens
augcagagugcuugugaggguuucacuaaaacagaggcaaaacuguccauugaauucaguaaca

SEQ ID NO: 583721 - RNA, 64 nt, Homo Sapiens
uuuggaaauugagagguggagcaaucucagguaaaggcaaaauagaggguaugaccugggguug

SEQ ID NO: 583722 - RNA, 64 nt, Homo Sapiens
uagcaaucugccacaacugcuccaguagccucccaggcaaaauaagauacucccagauccuaaa

SEQ ID NO: 583723 - RNA, 64 nt, Homo Sapiens
ccacauggcuucucccgcauauucccuaacauggaggcaaaauaccagcagccccaaccacagc

SEQ ID NO: 583724 - RNA, 64 nt, Homo Sapiens
acaaaacaaaacaaaacaacucacaaguccugugaggcaaaaaaacuuguuucuuaagacuauu

SEQ ID NO: 583725 - RNA, 64 nt, Homo Sapiens
uucacacaaaguuucugcaaugagauuaaggcagaggcaaaaguguuucauccuauccgaggga

SEQ ID NO: 583726 - RNA, 64 nt, Homo Sapiens
uauuuccccgucccuuaaaaagacaaaaaaaauaaggcaaaaggaaagcaacuaagacacugga

SEQ ID NO: 583727 - RNA, 64 nt, Homo Sapiens
ggaaagaggaaaaaauacacauguucuuucauauaggcaaaauuuaaccacauaaauuugcacu

SEQ ID NO: 583728 - RNA, 64 nt, Homo Sapiens
cuauggguuuuuucaggugauuacaggucaguugaggcaaaaaaguugauauagguggacuuuu

SEQ ID NO: 583729 - RNA, 64 nt, Homo Sapiens
cauccagcagacuuuaauuuaagaauauggguuaaggcaaaaacauaguauuuggaaugaaugg

SEQ ID NO: 583730 - RNA, 64 nt, Homo Sapiens
cauauucaauauuaaaauaguuuuauauuugggaaggcaaaaaugaaucuauuguuuugcaaua

SEQ ID NO: 583731 - RNA, 64 nt, Homo Sapiens
augaaucuauuguuuugcaauauagguuauaaacaggcaaaaugcaauaaaauauauaucuggu

SEQ ID NO: 583732 - RNA, 64 nt, Homo Sapiens
cacaugacuggggaggccucagaaucauggugggaggcaaaaagcacuucuuacauggcggcag

SEQ ID NO: 583733 - RNA, 64 nt, Homo Sapiens
aucgagcgagucaaaggaccugacauucugggagaggcaaaacuguuguaugauugcaauuaua

SEQ ID NO: 583734 - RNA, 64 nt, Homo Sapiens
auuacaagaaaggaaaacuacuaauaccaaagccaggcaaaaacuuugugaggccaggauuacc

SEQ ID NO: 583735 - RNA, 64 nt, Homo Sapiens
uguuuucaaugccugugccugagucuuuacagguaggcaaaauugaccauugucccaaagucua

SEQ ID NO: 583736 - RNA, 64 nt, Homo Sapiens
gaggcaccugaugcauucagggauggggaaacagaggcaaaacucacucaaccugcugaggugu

SEQ ID NO: 583737 - RNA, 64 nt, Homo Sapiens
uccagauuucccuccaugauuugggaaccagcuuaggcaaaagaguccccacaagaugaaaaua

SEQ ID NO: 583738 - RNA, 64 nt, Homo Sapiens
aaucuccuacuuaauauaugaccaugacuuugaaaggcaaaagaggaaucaagaauaaauaaaa

SEQ ID NO: 583739 - RNA, 64 nt, Homo Sapiens
gcacaggccaagguaggggaguaaaaaggaggucaggcaaaagggaggaguuuucuguccuuuc

SEQ ID NO: 583740 - RNA, 64 nt, Homo Sapiens
ucagguguuuuaagaugucucugagaagccaucaaggcaaaagagaacuuuaaguuccuuguuc

SEQ ID NO: 583741 - RNA, 64 nt, Homo Sapiens
ugaauagaacugagauuuuuauguaauuaguuauaggcaaaauacuuucauauuuuuagauuag

SEQ ID NO: 583742 - RNA, 64 nt, Homo Sapiens
acuucuucuuguaaaaauaaguaauuuacaggaaaggcaaaaugcuaauacuaacauuuguagc

SEQ ID NO: 583743 - RNA, 64 nt, Homo Sapiens
gaaaguguucuagguuccaggcguaagcagaauaaggcaaaagguguaaaacaaucaaaaguag

SEQ ID NO: 583744 - RNA, 64 nt, Homo Sapiens
cuacaguucauaucuuccuuauccagaauucuguaggcaaaauggacaauguuuuuaauuacaa

SEQ ID NO: 583745 - RNA, 64 nt, Homo Sapiens
auggcuacuuuuuucuaugccccaaucugagaaaaggcaaaagaaauaugaaagaaaaauggau

SEQ ID NO: 583746 - RNA, 64 nt, Homo Sapiens
aagugaggagaaaccugcaucuuccaauauaacuaggcaaaaagugcucccagauuacuccuuc

SEQ ID NO: 583747 - RNA, 64 nt, Homo Sapiens
guaaaggagucaaaacuacaucuugaaauuaagaaggcaaaaauuuugaaggcaaaauugcaaa

SEQ ID NO: 583748 - RNA, 64 nt, Homo Sapiens
gcaaaucuugaaauuaagaaaagaucuguuuugaaggcaaaauuacuuuuuacaauuaaaaaaa

SEQ ID NO: 583749 - RNA, 64 nt, Homo Sapiens; identical to SEQ ID NO: 60569

SEQ ID NO: 583750 - RNA, 64 nt, Homo Sapiens; identical to SEQ ID NO: 60570

SEQ ID NO: 583751 - RNA, 64 nt, Homo Sapiens; identical to SEQ ID NO: 60571

SEQ ID NO: 583752 - RNA, 64 nt, Homo Sapiens; identical to SEQ ID NO: 60572

SEQ ID NO: 583753 - RNA, 64 nt, Homo Sapiens; identical to SEQ ID NO: 60573

SEQ ID NO: 583754 - RNA, 64 nt, Homo Sapiens; identical to SEQ ID NO: 60574

SEQ ID NO: 583755 - RNA, 64 nt, Homo Sapiens; identical to SEQ ID NO: 60575

SEQ ID NO: 583756 - RNA, 64 nt, Homo Sapiens; identical to SEQ ID NO: 60576

SEQ ID NO: 583757 - RNA, 64 nt, Homo Sapiens; identical to SEQ ID NO: 60577

SEQ ID NO: 583758 - RNA, 64 nt, Homo Sapiens; identical to SEQ ID NO: 60578

SEQ ID NO: 583759 - RNA, 64 nt, Homo Sapiens; identical to SEQ ID NO: 60579

SEQ ID NO: 583760 - RNA, 64 nt, Homo Sapiens; identical to SEQ ID NO: 60580

SEQ ID NO: 583761 - RNA, 64 nt, Homo Sapiens
uguuuuaaaaucuuauuuaaauuuaaaccagaagcugaaaaauagaucagcuuuauuauacaca

SEQ ID NO: 583762 - RNA, 64 nt, Homo Sapiens
guaauaccaacauaugggccccaucugcacacuccugaaaaacagaaaguguauucaaauuuua

SEQ ID NO: 583763 - RNA, 64 nt, Homo Sapiens
ccaaaaaaaucaagauuuaauuuuuuuauuuguacugaaaaacuaaucauaacuguuaauucuc

SEQ ID NO: 583764 - RNA, 64 nt, Homo Sapiens
ccuauuuaugaauccugucgguauuccuugguaucugaaaaaaauaccaaauaguaccauacau

SEQ ID NO: 583765 - RNA, 64 nt, Homo Sapiens
auguuagcuacuaugaauggugccagugaagacacugaaaaauaagugauuucaguaaccuucu

SEQ ID NO: 583766 - RNA, 64 nt, Homo Sapiens
aaggccccacugauaagguaacauuugagcaagucugaaaaaggcaaggggaucuuuggggcua

SEQ ID NO: 583767 - RNA, 64 nt, Homo Sapiens
auugaacacaaucucauugaaaguugcaagaaugcugaaaaaaacaggucuauacuuaagggaa

SEQ ID NO: 583768 - RNA, 64 nt, Homo Sapiens
aucucuaugagcuaaauguccagaauagauagcacugaaaaaaauuggauuaacccucuauaga

SEQ ID NO: 583769 - RNA, 64 nt, Homo Sapiens
aacuccucuucuuagucuuaagagagagagaguacugaaaaagcagaucuagugguucacacag

SEQ ID NO: 583770 - RNA, 64 nt, Homo Sapiens
ggcugcaucaaugcaagccuggaaaccagcaggucugaaaaagagccuuccaagucaguccuuu

SEQ ID NO: 583771 - RNA, 64 nt, Homo Sapiens
ggccagaauggguaaagacugcucaucccuaauccugaaaaacauagacauuauuggcaaaauu

SEQ ID NO: 583772 - RNA, 64 nt, Homo Sapiens
uguccuugaagucccuuccacuuugcccuccgcccugaaaaaggucccuuccuuaacucucccc

SEQ ID NO: 583773 - RNA, 64 nt, Homo Sapiens
aaaacaaacuuauuuuuauccagucucuagagcccugaaaaauauucaguaccuucaccugucu

SEQ ID NO: 583774 - RNA, 56 nt, Homo Sapiens
gaugucuagaacugguccugaggaagcugaaaaauguuugcaaguucaaaaacuag

SEQ ID NO: 583775 - RNA, 64 nt, Homo Sapiens
agaaauaaaaucgcaguuaaacaaaagagacuaucugaaaaagaaaaaauaaggcuaguguacu

SEQ ID NO: 583776 - RNA, 64 nt, Homo Sapiens
aggcuaguguacuacaaaaguaaaaauucgaaaacugaaaaauaucacugugagcaacuuagag

SEQ ID NO: 583777 - RNA, 64 nt, Homo Sapiens
acuguauuuagugauuauuuuugcuuguuuauuucugaaaaagauuugauaaugaaaaaaaucu

SEQ ID NO: 583778 - RNA, 64 nt, Homo Sapiens
uuuguggauuauaaauuucuuuuuaccuuaagaccugaaaaaguaccuguagacuguggaacua

SEQ ID NO: 583779 - RNA, 64 nt, Homo Sapiens
cgagccuuuaaacagcaguuuguaaacuaugcaacugaaaaacugaggaugauuguuagcucca

SEQ ID NO: 583780 - RNA, 64 nt, Homo Sapiens
gguggggcugugagcucuuaauuuguuuuugauucugaaaaacucugcuuccuggcauccagga

SEQ ID NO: 583781 - RNA, 64 nt, Homo Sapiens
uuucaccguuugucuucuuaucugaaaaaaugaucugaaaaaaggcaucagcaaggcauugacu

SEQ ID NO: 583782 - RNA, 64 nt, Homo Sapiens
gaucugaaaaaaguuucacccaaggcauugacuucugaaaaaaucauguugcgcuuugcaucag

SEQ ID NO: 583783 - RNA, 64 nt, Homo Sapiens
aauucucaggcuuuacagcaugcagaagaaccaacugaaaaaaacuuugcagguaucacagccu

SEQ ID NO: 583784 - RNA, 64 nt, Homo Sapiens
aaaaaaagcucauauuaauuaaacauaggcagcacugaaaaaaacacauucuaccagcacaagg

SEQ ID NO: 583785 - RNA, 64 nt, Homo Sapiens
uugucuguuaaauuuauuaugcccaaaucaaccucugaaaaaagguuuuuccaggaagauuuac

SEQ ID NO: 583786 - RNA, 64 nt, Homo Sapiens
uauagaaccugucauacauucaugauaaguagcacugaaaaauuacucauucaaauuuccccug

SEQ ID NO: 583787 - RNA, 64 nt, Homo Sapiens
agucagcacucguaaaugccaagaaaagaauuaccugaaaaagaucauuucucccuauucaaau

SEQ ID NO: 583788 - RNA, 64 nt, Homo Sapiens
ugauauugagcucuaaaugcaaaacucuuuuauacugaaaaaacacuuaaaguaguuuugugug

SEQ ID NO: 583789 - RNA, 64 nt, Homo Sapiens
auaguuuaaaagcacaucuauguucacugccacucugaaaaagggaauuauuucucagucuuuc

SEQ ID NO: 583790 - RNA, 64 nt, Homo Sapiens
gaaacccaagguuggagggugggaugaguacccucugaaaaagggaauuugcuggugaaaagag

SEQ ID NO: 583791 - RNA, 64 nt, Homo Sapiens
caauuucaauauaauguagaaguaguagugugcccugaaaaauguacacguuuuuucuuauugu

SEQ ID NO: 583792 - RNA, 64 nt, Homo Sapiens
augauauuccuuuuuaucuuuucaguacauagugcugaaaaaucugcaacuucuuggaucauau

SEQ ID NO: 583793 - RNA, 64 nt, Homo Sapiens
uuuuuaagauuaaaaaauuuuuaaaccucuaugucugaaaaaaaaaaugacacuccuggaagau

SEQ ID NO: 583794 - RNA, 64 nt, Homo Sapiens
guuugaauaugguuugaaauauuucacuaccgugcugaaaaagguugguugauagcagcuugga

SEQ ID NO: 583795 - RNA, 64 nt, Homo Sapiens
gcugagccagccaucuuuggaggaaugauccauacugaaaaaauucugaaucucguugaggcca

SEQ ID NO: 583796 - RNA, 64 nt, Homo Sapiens
gccauguugucuuuuuuuuuauaagcacagaaaucugaaaaauguccaaagugucacuuggugc

SEQ ID NO: 583797 - RNA, 64 nt, Homo Sapiens
aaauuuuaacuagcaaaugcagaaaacuagaggacugaaaaaacaaguagcugaugugcaguug

SEQ ID NO: 583798 - RNA, 64 nt, Homo Sapiens
uaguuaccugauuauugcacauuacauuuuuuaacugaaaaaccaaucuagcuuauauaagguc

SEQ ID NO: 583799 - RNA, 64 nt, Homo Sapiens
cagcuuauuuuuuaugucuaaagcaacagcuguucugaaaaaucaccaaaagaaaugcacuuug

SEQ ID NO: 583800 - RNA, 64 nt, Homo Sapiens
caugaguagauccaugauggauuaauaaagcuugcugaaaaaaaaaaucuguguaucaauuaga

SEQ ID NO: 583801 - RNA, 64 nt, Homo Sapiens
guugguucauccagaaguguugacauaccuuagacugaaaaacuauaaaaauugaauucguuuc

SEQ ID NO: 583802 - RNA, 64 nt, Homo Sapiens
auuccuuucagauugggguguauauuaucuuauacugaaaaaaauuaguuuucuguauaugaua

SEQ ID NO: 583803 - RNA, 64 nt, Homo Sapiens
uuuuggcagguuucugugccuuuauuucccucuucugaaaaaaagucuguguuuucauaguuug

SEQ ID NO: 583804 - RNA, 64 nt, Homo Sapiens
auaucaauaauuaaucaggaauggguuuuggugccugaaaaauuggccauggaggcacaccaaa

SEQ ID NO: 583805 - RNA, 64 nt, Homo Sapiens
aaaaaaugauuguuuuagaauauauaacccacugcugaaaaagauuuuuaaauuuacagaauau

SEQ ID NO: 583806 - RNA, 64 nt, Homo Sapiens
caacuuguguuuauggcauuagcuugaaaacuugcugaaaaacacuucaacagggaaaacagcu

SEQ ID NO: 583807 - RNA, 64 nt, Homo Sapiens
uuuugcuauagaugaagguagagggcugucagcccugaaaaacacacaggucagacauuuaaaa

SEQ ID NO: 583808 - RNA, 64 nt, Homo Sapiens
ccugcugauggaaaugggaaugaaguuaaguggucugaaaaacuugaaucguucacauuucuca

SEQ ID NO: 583809 - RNA, 64 nt, Homo Sapiens
cagaguuugaaagcucccauuagaugagagaagccugaaaaaggacccuccuggggcucugggg

SEQ ID NO: 583810 - RNA, 64 nt, Homo Sapiens
cuaauuugcugcuuucugacagccgaauucgguccugaaaaacaggagaugcaggagcugcggg

SEQ ID NO: 583811 - RNA, 64 nt, Homo Sapiens
cacgggacuucccgaacuaauuuuuuuaaggauacugaaaaaugagagagaguggucgaaugcc

SEQ ID NO: 583812 - RNA, 64 nt, Homo Sapiens
uuaaugaucacuuaaaguaguuuccuucuuuauucugaaaaaaugaggaaaaaauaacaacagu

SEQ ID NO: 583813 - RNA, 64 nt, Homo Sapiens
cuugcacaaggaaggaucuucagauauucaugcacugaaaaaugcuguuaucuuuuguuuuuaa

SEQ ID NO: 583814 - RNA, 64 nt, Homo Sapiens
accuagggguaagagaaaaaccacaacauaagaccugaaaaacagaagcaaaauuguugcacuc

SEQ ID NO: 583815 - RNA, 64 nt, Homo Sapiens
uuggcagucuuguaugcaaaaacgaauauuuugacugaaaaauugauuucuuuuuaaaguuuua

SEQ ID NO: 583816 - RNA, 64 nt, Homo Sapiens
uguugugggguuucaacaggguuuuaauaaauggcugaaaaaauguccugauagucucuuuggg

SEQ ID NO: 583817 - RNA, 64 nt, Homo Sapiens
cggcagguggccuaaggcugauuugcaggggauacugaaaaauacacucauuuucaauuucuaa

SEQ ID NO: 583818 - RNA, 64 nt, Homo Sapiens
acugucccauucuccacucauuuaaauucugcuccugaaaaaugauguauuauacaucuguauu

SEQ ID NO: 583819 - RNA, 64 nt, Homo Sapiens
gcugacuucauggaauggacauccuguauaagcacugaaaaacaacaacacaauaacacuaaaa

SEQ ID NO: 583820 - RNA, 64 nt, Homo Sapiens
gaaguguaccuguguacauaacucuguaaaaacacugaaaaauuauacuaacuuauuuauguua

SEQ ID NO: 583821 - RNA, 64 nt, Homo Sapiens
uaaccuuagcaucuaagugucgaucuugaauucccugaaaaaauuucuauaggaaaugaagcuu

SEQ ID NO: 583822 - RNA, 64 nt, Homo Sapiens
ugggauuugugucccuuaaaccagacucacuuuucugaaaaaucuccauuguugaggagaggcu

SEQ ID NO: 583823 - RNA, 64 nt, Homo Sapiens
aaauauucaucauuuuuauguaaaauauggacgucugaaaaauauuuuauaaaacuauuacauu

SEQ ID NO: 583824 - RNA, 64 nt, Homo Sapiens
uaaaggaagagacccaucuaucaagauuaugugacugaaaaacaacaugugauaacuauggaaa

SEQ ID NO: 583825 - RNA, 64 nt, Homo Sapiens
cuuuugaacguaugugcucuuauaaaguggacuucugaaaaaugaauguaaaagacacuggugu

SEQ ID NO: 583826 - RNA, 64 nt, Homo Sapiens
gaccauccaaauuuauggccguaucaaaugguagcugaaaaaacuauauuugagcacuggucuc

SEQ ID NO: 583827 - RNA, 64 nt, Homo Sapiens
auuuaaaaaugcagaacugcuuuauccaagaaugcugaaaaauacuguucuauccagguuuccu

SEQ ID NO: 583828 - RNA, 64 nt, Homo Sapiens
uggcacaugacuuuacauaaugacuuucuagacucugaaaaaaaugcuuuuaucauuuuugcaa

SEQ ID NO: 583829 - RNA, 64 nt, Homo Sapiens
auauuuugucugaaaagacugcacaaaagaacaccugaaaaaugguuauaaaauauguugaaag

SEQ ID NO: 583830 - RNA, 64 nt, Homo Sapiens
cacaaauuuaugaaacauuaugugggauagccuucugaaaaagcccagaguagaaaacuaugaa

SEQ ID NO: 583831 - RNA, 64 nt, Homo Sapiens
auucuuuauuucugucauucaaaugggugauauccugaaaaaaaaaaaaaaaaaaaaacuggga

SEQ ID NO: 583832 - RNA, 64 nt, Homo Sapiens
aaagaauauucagagaauaucaagaugauucuggcugaaaaaggccaguggaaauucaggugaa

SEQ ID NO: 583833 - RNA, 64 nt, Homo Sapiens; identical to SEQ ID NO: 360905

SEQ ID NO: 583834 - RNA, 64 nt, Homo Sapiens; identical to SEQ ID NO: 360906

SEQ ID NO: 583835 - RNA, 64 nt, Homo Sapiens; identical to SEQ ID NO: 360907

SEQ ID NO: 583836 - RNA, 64 nt, Homo Sapiens; identical to SEQ ID NO: 360908

SEQ ID NO: 583837 - RNA, 64 nt, Homo Sapiens; identical to SEQ ID NO: 360909

SEQ ID NO: 583838 - RNA, 64 nt, Homo Sapiens; identical to SEQ ID NO: 360910

SEQ ID NO: 583839 - RNA, 64 nt, Homo Sapiens
guaaacuguauuuaaaaccuuugacuugagucugcugguaaagcuucugaauauugaguuugcu

SEQ ID NO: 583840 - RNA, 64 nt, Homo Sapiens
uuugcugagaaauaaaaaucaaaacuucuuuaagcugguaaagugaggggcccaccagcaguga

SEQ ID NO: 583841 - RNA, 64 nt, Homo Sapiens
aaguaugacaugagcuucaaccagaauucagccucugguaaacaugaacacuuaaaucuaacag

SEQ ID NO: 583842 - RNA, 64 nt, Homo Sapiens
gagacaguauuucaagagaguggcaggucuguuccugguaaaauuuuaaccauuaggauugcag

SEQ ID NO: 583843 - RNA, 64 nt, Homo Sapiens
cacuacccucagagagagccuuugauaaagcaugcugguaaaaccucucccugauaguuuaguu

SEQ ID NO: 583844 - RNA, 64 nt, Homo Sapiens
auuuugguggcagcugccaugucagaagggugugcugguaaaguuucuucugagaaaugcugca

SEQ ID NO: 583845 - RNA, 64 nt, Homo Sapiens
uaagcccaugugauguccacucacguaaccuucgcugguaaaaaggcugagugcguuuuguccu

SEQ ID NO: 583846 - RNA, 64 nt, Homo Sapiens
aucuuaaucagacuuauuuuuucauucauguauccugguaaagcaaaagcauauaccaccuuag

SEQ ID NO: 583847 - RNA, 64 nt, Homo Sapiens; identical to SEQ ID NO: 110917

SEQ ID NO: 583848 - RNA, 64 nt, Homo Sapiens; identical to SEQ ID NO: 110918

SEQ ID NO: 583849 - RNA, 64 nt, Homo Sapiens; identical to SEQ ID NO: 110919

SEQ ID NO: 583850 - RNA, 64 nt, Homo Sapiens; identical to SEQ ID NO: 110920

SEQ ID NO: 583851 - RNA, 64 nt, Homo Sapiens; identical to SEQ ID NO: 110921

SEQ ID NO: 583852 - RNA, 64 nt, Homo Sapiens; identical to SEQ ID NO: 110922

SEQ ID NO: 583853 - RNA, 64 nt, Homo Sapiens; identical to SEQ ID NO: 110923

SEQ ID NO: 583854 - RNA, 64 nt, Homo Sapiens; identical to SEQ ID NO: 110924

SEQ ID NO: 583855 - RNA, 64 nt, Homo Sapiens; identical to SEQ ID NO: 110925

SEQ ID NO: 583856 - RNA, 64 nt, Homo Sapiens; identical to SEQ ID NO: 110926

SEQ ID NO: 583857 - RNA, 64 nt, Homo Sapiens; identical to SEQ ID NO: 110927

SEQ ID NO: 583858 - RNA, 64 nt, Homo Sapiens; identical to SEQ ID NO: 110928

SEQ ID NO: 583859 - RNA, 61 nt, Homo Sapiens; identical to SEQ ID NO: 110929

SEQ ID NO: 583860 - RNA, 64 nt, Homo Sapiens; identical to SEQ ID NO: 110930

SEQ ID NO: 583861 - RNA, 64 nt, Homo Sapiens; identical to SEQ ID NO: 110931

SEQ ID NO: 583862 - RNA, 64 nt, Homo Sapiens; identical to SEQ ID NO: 110932

SEQ ID NO: 583863 - RNA, 64 nt, Homo Sapiens; identical to SEQ ID NO: 110933

SEQ ID NO: 583864 - RNA, 64 nt, Homo Sapiens; identical to SEQ ID NO: 110934

SEQ ID NO: 583865 - RNA, 64 nt, Homo Sapiens; identical to SEQ ID NO: 110935

SEQ ID NO: 583866 - RNA, 64 nt, Homo Sapiens; identical to SEQ ID NO: 110936

SEQ ID NO: 583867 - RNA, 64 nt, Homo Sapiens; identical to SEQ ID NO: 110937

SEQ ID NO: 583868 - RNA, 64 nt, Homo Sapiens; identical to SEQ ID NO: 110938

SEQ ID NO: 583869 - RNA, 64 nt, Homo Sapiens; identical to SEQ ID NO: 110939

SEQ ID NO: 583870 - RNA, 64 nt, Homo Sapiens; identical to SEQ ID NO: 110940

SEQ ID NO: 583871 - RNA, 64 nt, Homo Sapiens; identical to SEQ ID NO: 110941

SEQ ID NO: 583872 - RNA, 64 nt, Homo Sapiens; identical to SEQ ID NO: 110942

SEQ ID NO: 583873 - RNA, 64 nt, Homo Sapiens; identical to SEQ ID NO: 110943

SEQ ID NO: 583874 - RNA, 64 nt, Homo Sapiens; identical to SEQ ID NO: 110944

SEQ ID NO: 583875 - RNA, 64 nt, Homo Sapiens; identical to SEQ ID NO: 110945

SEQ ID NO: 583876 - RNA, 64 nt, Homo Sapiens; identical to SEQ ID NO: 110946

SEQ ID NO: 583877 - RNA, 64 nt, Homo Sapiens; identical to SEQ ID NO: 110947

SEQ ID NO: 583878 - RNA, 64 nt, Homo Sapiens; identical to SEQ ID NO: 110948

SEQ ID NO: 583879 - RNA, 64 nt, Homo Sapiens; identical to SEQ ID NO: 110949

SEQ ID NO: 583880 - RNA, 64 nt, Homo Sapiens; identical to SEQ ID NO: 110950

SEQ ID NO: 583881 - RNA, 64 nt, Homo Sapiens; identical to SEQ ID NO: 110951

SEQ ID NO: 583882 - RNA, 64 nt, Homo Sapiens; identical to SEQ ID NO: 110952

SEQ ID NO: 583883 - RNA, 64 nt, Homo Sapiens; identical to SEQ ID NO: 110953

SEQ ID NO: 583884 - RNA, 64 nt, Homo Sapiens; identical to SEQ ID NO: 110954

SEQ ID NO: 583885 - RNA, 64 nt, Homo Sapiens; identical to SEQ ID NO: 110955

SEQ ID NO: 583886 - RNA, 64 nt, Homo Sapiens; identical to SEQ ID NO: 110956

SEQ ID NO: 583887 - RNA, 64 nt, Homo Sapiens; identical to SEQ ID NO: 110957

SEQ ID NO: 583888 - RNA, 64 nt, Homo Sapiens; identical to SEQ ID NO: 110958

SEQ ID NO: 583889 - RNA, 64 nt, Homo Sapiens; identical to SEQ ID NO: 324299

SEQ ID NO: 583890 - RNA, 64 nt, Homo Sapiens; identical to SEQ ID NO: 324300

SEQ ID NO: 583891 - RNA, 64 nt, Homo Sapiens; identical to SEQ ID NO: 324301

SEQ ID NO: 583892 - RNA, 64 nt, Homo Sapiens; identical to SEQ ID NO: 324302

SEQ ID NO: 583893 - RNA, 64 nt, Homo Sapiens; identical to SEQ ID NO: 324303

SEQ ID NO: 583894 - RNA, 64 nt, Homo Sapiens; identical to SEQ ID NO: 324304

SEQ ID NO: 583895 - RNA, 64 nt, Homo Sapiens; identical to SEQ ID NO: 324305

SEQ ID NO: 583896 - RNA, 64 nt, Homo Sapiens; identical to SEQ ID NO: 324306

SEQ ID NO: 583897 - RNA, 64 nt, Homo Sapiens; identical to SEQ ID NO: 324307

SEQ ID NO: 583898 - RNA, 64 nt, Homo Sapiens; identical to SEQ ID NO: 324308

SEQ ID NO: 583899 - RNA, 64 nt, Homo Sapiens; identical to SEQ ID NO: 324309

SEQ ID NO: 583900 - RNA, 64 nt, Homo Sapiens; identical to SEQ ID NO: 324310

SEQ ID NO: 583901 - RNA, 54 nt, Homo Sapiens; identical to SEQ ID NO: 324311

SEQ ID NO: 583902 - RNA, 64 nt, Homo Sapiens; identical to SEQ ID NO: 324312

SEQ ID NO: 583903 - RNA, 64 nt, Homo Sapiens; identical to SEQ ID NO: 324313

SEQ ID NO: 583904 - RNA, 64 nt, Homo Sapiens; identical to SEQ ID NO: 324314

SEQ ID NO: 583905 - RNA, 64 nt, Homo Sapiens; identical to SEQ ID NO: 324315

SEQ ID NO: 583906 - RNA, 64 nt, Homo Sapiens; identical to SEQ ID NO: 324316

SEQ ID NO: 583907 - RNA, 64 nt, Homo Sapiens; identical to SEQ ID NO: 324317

SEQ ID NO: 583908 - RNA, 64 nt, Homo Sapiens; identical to SEQ ID NO: 324318

SEQ ID NO: 583909 - RNA, 63 nt, Homo Sapiens
cugcccacacucagagcaagcagcccacucucccuguuacacauguuacacacuguccgcucu

SEQ ID NO: 583910 - RNA, 63 nt, Homo Sapiens
cuguccgcucucagcccacuagucugcuucucccuguuacacacucauuguggccccacaccc

SEQ ID NO: 583911 - RNA, 63 nt, Homo Sapiens
agaguauuaacguuuuuguucuccuccggcccccuguuacaaugaaggggcaaaaguauuugc

SEQ ID NO: 583912 - RNA, 63 nt, Homo Sapiens
ucgacaucaaacugccuggauuuuucuaccacccuguuacaucauaacaacuucugaaacaca

SEQ ID NO: 583913 - RNA, 63 nt, Homo Sapiens
cucuuccuuuugcuucuagucaaccuuaaugggcuguuacagaaacuaguucguguuuauaua

SEQ ID NO: 583914 - RNA, 63 nt, Homo Sapiens
uguaacuaucagcugcaauaccauggugaccagcuguuacaaaagauuuuuuccuguuuuauc

SEQ ID NO: 583915 - RNA, 63 nt, Homo Sapiens
ccugccuucuuacccccaacucuagggaugggacuguuacaauacuucaagaucacucuuuac

SEQ ID NO: 583916 - RNA, 63 nt, Homo Sapiens
aggacauccaugccaggugaggugccugggucccuguuacaagucaggagcccuguagggaga

SEQ ID NO: 583917 - RNA, 63 nt, Homo Sapiens
guaaguggauggaugacacauugcaauaaagcucuguuacaacauaaccuuauuugaaaugaa

SEQ ID NO: 583918 - RNA, 63 nt, Homo Sapiens
uuuuuggcaucugguaauauuaaaaggcaaaugcuguuacaaacagugggaacaaguuucuau

SEQ ID NO: 583919 - RNA, 63 nt, Homo Sapiens
cuugacugugaggcaggacuucccucgcuugaacuguuacacauacgaugugugugucacauc

SEQ ID NO: 583920 - RNA, 63 nt, Homo Sapiens
uucucaucugggaauuugaaaucucggugcuuacuguuacaccaauuuguccaaagaguugaa

SEQ ID NO: 583921 - RNA, 64 nt, Homo Sapiens; identical to SEQ ID NO: 354645

SEQ ID NO: 583922 - RNA, 64 nt, Homo Sapiens; identical to SEQ ID NO: 354646

SEQ ID NO: 583923 - RNA, 64 nt, Homo Sapiens; identical to SEQ ID NO: 354647

SEQ ID NO: 583924 - RNA, 64 nt, Homo Sapiens; identical to SEQ ID NO: 354648

SEQ ID NO: 583925 - RNA, 64 nt, Homo Sapiens; identical to SEQ ID NO: 354649

SEQ ID NO: 583926 - RNA, 64 nt, Homo Sapiens; identical to SEQ ID NO: 354650

SEQ ID NO: 583927 - RNA, 64 nt, Homo Sapiens; identical to SEQ ID NO: 354651

SEQ ID NO: 583928 - RNA, 64 nt, Homo Sapiens; identical to SEQ ID NO: 354652

SEQ ID NO: 583929 - RNA, 64 nt, Homo Sapiens; identical to SEQ ID NO: 354653

SEQ ID NO: 583930 - RNA, 64 nt, Homo Sapiens; identical to SEQ ID NO: 354654

SEQ ID NO: 583931 - RNA, 64 nt, Homo Sapiens; identical to SEQ ID NO: 354655

SEQ ID NO: 583932 - RNA, 64 nt, Homo Sapiens; identical to SEQ ID NO: 354656

SEQ ID NO: 583933 - RNA, 64 nt, Homo Sapiens; identical to SEQ ID NO: 354657

SEQ ID NO: 583934 - RNA, 64 nt, Homo Sapiens; identical to SEQ ID NO: 354658

SEQ ID NO: 583935 - RNA, 64 nt, Homo Sapiens; identical to SEQ ID NO: 354659

SEQ ID NO: 583936 - RNA, 64 nt, Homo Sapiens; identical to SEQ ID NO: 354660

SEQ ID NO: 583937 - RNA, 64 nt, Homo Sapiens; identical to SEQ ID NO: 354661

SEQ ID NO: 583938 - RNA, 64 nt, Homo Sapiens; identical to SEQ ID NO: 354662

SEQ ID NO: 583939 - RNA, 64 nt, Homo Sapiens; identical to SEQ ID NO: 354663

SEQ ID NO: 583940 - RNA, 64 nt, Homo Sapiens; identical to SEQ ID NO: 354664

SEQ ID NO: 583941 - RNA, 64 nt, Homo Sapiens; identical to SEQ ID NO: 354665

SEQ ID NO: 583942 - RNA, 64 nt, Homo Sapiens; identical to SEQ ID NO: 354666

SEQ ID NO: 583943 - RNA, 64 nt, Homo Sapiens
guuggagaccagccuggaugacauaaugagauucugucucuacuggaaaaaaaaaaaauuagcu

SEQ ID NO: 583944 - RNA, 64 nt, Homo Sapiens
acuguacuccagccugggugacaaaaugagacauugucucuaaaauacauaaguaaauuuaaaa

SEQ ID NO: 583945 - RNA, 64 nt, Homo Sapiens
gaucaagacuguccuggacaacauggugaaacccugucucuacugucucuaacauuuguaaacc

SEQ ID NO: 583946 - RNA, 64 nt, Homo Sapiens
uguccuggacaacauggugaaacccugucucuacugucucuaacauuuguaaaccugucucuaa

SEQ ID NO: 583947 - RNA, 64 nt, Homo Sapiens
acccugucucuacugucucuaacauuuguaaaccugucucuaauuuguaauuuguaaacccugu

SEQ ID NO: 583948 - RNA, 64 nt, Homo Sapiens
aaugcauagaaauuuguaacacuuuggucacaucugucucuagauggucauugaauuuguuuaa

SEQ ID NO: 583949 - RNA, 64 nt, Homo Sapiens
guuugaaaccagccuggccaacauggugaaaaccugucucuacuaaaaauacaaaaauuagccg

SEQ ID NO: 583950 - RNA, 64 nt, Homo Sapiens
uuuggagaggccaaauggucuuagccucagucucugucucuaaauauuccaccauaaaacagcu

SEQ ID NO: 583951 - RNA, 64 nt, Homo Sapiens
guucgagacuagccugggcaacauggagaagcccugucucuacaaaauacagagagaaaaaauc

SEQ ID NO: 583952 - RNA, 64 nt, Homo Sapiens
gaguaauaggagcuuccagcucuaauaaaacagcugucucuaacuuauuuuauuuccaucaugu

SEQ ID NO: 583953 - RNA, 64 nt, Homo Sapiens
ugguacucuuguugaguucuguagagccuucugaugucucuaaagcacuaccgauucuuuggag

SEQ ID NO: 583954 - RNA, 64 nt, Homo Sapiens
aaaaaauuuuaaaaaguaaagcauauugagacucugucucuacaugagacucugucucuaaaaa

SEQ ID NO: 583955 - RNA, 64 nt, Homo Sapiens
aagcauauugagacucugucacauauugagacucugucucuaaaagaaguuugagaucugggca

SEQ ID NO: 583956 - RNA, 64 nt, Homo Sapiens
acagauagagauucugccugugcuuuuguuugacugucucuagauuuugaaaccaaaaaacuga

SEQ ID NO: 583957 - RNA, 64 nt, Homo Sapiens
cagauuggaaauuacucuuguauuuguagaagauugucucuaaaauugugguuuaacucacgca

SEQ ID NO: 583958 - RNA, 64 nt, Homo Sapiens
guuugagaccaaucuaggcaauguagugagacccugucucuaauuuaaaaaagaaaaagaaaaa

SEQ ID NO: 583959 - RNA, 64 nt, Homo Sapiens
gaucgagaccauccuggccaacauggugaaacccugucucuauuaaaaauacaaaaauuagcug

SEQ ID NO: 583960 - RNA, 64 nt, Homo Sapiens
guggcaugacugacauacauacucaaauauaggcugucucuaguaaaucuuaaaaucuugaagc

SEQ ID NO: 583961 - RNA, 64 nt, Homo Sapiens
cuacaauuauuauaauggacaauacuuuuaccuuugucucuaaagaucagauuaguuuuauuug

SEQ ID NO: 583962 - RNA, 64 nt, Homo Sapiens
aaaaacauaaaaauuagcugacauggcaaaacccugucucuacuguuugagaccagccuggcca

SEQ ID NO: 583963 - RNA, 64 nt, Homo Sapiens
acaauacggugauugcuugucauuuucaauaaaaugucucuaauuaauacauuuccuauuuucg

SEQ ID NO: 583964 - RNA, 64 nt, Homo Sapiens
uaaguaaaaucuaaugcguauuugagaauguaugugucucuaagggauauagaauauuacaucu

SEQ ID NO: 583965 - RNA, 64 nt, Homo Sapiens
uauuuuuuaauuuucaaacuauuaaugugaaaguugucucuaaacaugaauauauuauuuugcu

SEQ ID NO: 583966 - RNA, 64 nt, Homo Sapiens
ccaggcucuguuuuguguauugcuucuugagcuaugucucuacucucacacuacacuuacaacu

SEQ ID NO: 583967 - RNA, 64 nt, Homo Sapiens
cuuuaaaagaggggucaaucuuuugggagcaucuugucucuaacuugcugcuggaugaugcccu

SEQ ID NO: 583968 - RNA, 64 nt, Homo Sapiens
ugucuccuagucacuuucuuucucacucugucucugucucuauuucugucucuccucugcugug

SEQ ID NO: 583969 - RNA, 64 nt, Homo Sapiens
aggcucuauuucugucucugaugcucuucuucugugucucuauuucucuuccugucacuuaauc

SEQ ID NO: 583970 - RNA, 64 nt, Homo Sapiens
ugcaucaagcauacaauaaacuugcccuuggaauugucucuaaagauaauaucccuauccagug

SEQ ID NO: 583971 - RNA, 64 nt, Homo Sapiens
ggugucuucuggggggcagaccuguagugcacagugucucuacauggccucccgugagugcaug

SEQ ID NO: 583972 - RNA, 64 nt, Homo Sapiens
aguuacccugaucuggacccuuggccuccauuucugucucuaaccauucaaaugacgccugaug

SEQ ID NO: 583973 - RNA, 64 nt, Homo Sapiens
auaucauucagcaucuacucuaaagaaaaaugccugucucuagcuguucuggacuacacccaag

SEQ ID NO: 583974 - RNA, 64 nt, Homo Sapiens
guuccagaccagccuggccaacaugaugaaacccugucucuacuaaaaauacaaaaauuagccg

SEQ ID NO: 583975 - RNA, 64 nt, Homo Sapiens
gaguuugagaccagccugggcaacauggcacaauugucucuacaaaaaauacaaaaauuagcca

SEQ ID NO: 583976 - RNA, 64 nt, Homo Sapiens
gagcucaggaguucgugaccagccugggcaacccugucucuacaaaaaauacaaaaauuaacca

SEQ ID NO: 583977 - RNA, 64 nt, Homo Sapiens
gaucaagaccauccuggccaacauggugaaacccugucucuacuaaaaauacaaaaauagcugg

SEQ ID NO: 583978 - RNA, 64 nt, Homo Sapiens
uucuugaguaccaauuguaaaaucaaaugauuucugucucuauuagcagaugguuucugggcaa

SEQ ID NO: 583979 - RNA, 64 nt, Homo Sapiens
uaaaauacaaaaauuagcugacauggugaaacacugucucuacaguucgagaccaacuugggca

SEQ ID NO: 583980 - RNA, 64 nt, Homo Sapiens
gagcuucaaagcauacagguaagggauaagauugugucucuauacccaagaaaauacaggccug

SEQ ID NO: 583981 - RNA, 64 nt, Homo Sapiens
aaauauuagcggggugugguacauggugaaacccugucucuacuguucaaaaccagccugacca

SEQ ID NO: 583982 - RNA, 64 nt, Homo Sapiens
aaaaauacaaaaaacuagccacacggugaaacccugucucuacugaucgagaccauccuggcua

SEQ ID NO: 583983 - RNA, 64 nt, Homo Sapiens
uuaaaauaauaauaacacaaacagaacaaggcccugucucuauucugcauuccagccugggugg

SEQ ID NO: 583984 - RNA, 64 nt, Homo Sapiens
cauuucugccuucucucuuuucuucauguguuuuugucucuagccuauguguauuuguguagaa

SEQ ID NO: 583985 - RNA, 64 nt, Homo Sapiens
guucgagaccaaccuggccgacauggugaaacgcugucucuacuaaaaauauaaaaaauuagcc

SEQ ID NO: 583986 - RNA, 64 nt, Homo Sapiens
gaguucaagacaauccuggccaacggcgaaacucugucucuacaaaaaauauacaggcguguua

SEQ ID NO: 583987 - RNA, 64 nt, Homo Sapiens
ccauugcacuccagccuggcugacagagcgagacugucucuaaaaaaaaaagacucaaguggac

SEQ ID NO: 583988 - RNA, 64 nt, Homo Sapiens
guuugagaccagcccgaccaacauggagaaacccugucucuacuaaaaauacaaaauuagccag

SEQ ID NO: 583989 - RNA, 64 nt, Homo Sapiens
guuugagaccagccugggcaacauagugagacccugucucuaaaaaaauaaaaauagaaauaaa

SEQ ID NO: 583990 - RNA, 64 nt, Homo Sapiens
aaaaauacaaaaaaaaaaaaacauggcaagacccugucucuacuguucaagaccagccugggca

SEQ ID NO: 583991 - RNA, 64 nt, Homo Sapiens
uuggccucuguggcaagacccuucuccaaacugcugucucuaauuucuggacugaagcuauuuu

SEQ ID NO: 583992 - RNA, 64 nt, Homo Sapiens
gucugagacaagccuaggcaacaaaacaagacucugucucuacaaaaaguuuaagaaaugagcc

SEQ ID NO: 583993 - RNA, 64 nt, Homo Sapiens
acggcacucaagccugggcaauguagcaagauccugucucuacaagaaauuuuuuaaaaaugag

SEQ ID NO: 583994 - RNA, 64 nt, Homo Sapiens
aaguuugagaccagccuggcaaacauggcaaaacugucucuauuaaaaauacaggccaggggcc

SEQ ID NO: 583995 - RNA, 64 nt, Homo Sapiens
gauugagaccauccuggcuaauauggugaaacccugucucuacuaaaaauacaaaaaaauuagc

SEQ ID NO: 583996 - RNA, 64 nt, Homo Sapiens
uaaauaaagagacaauaagcacaaagugagccccugucucuaaaacugcaccccagcccaggca

SEQ ID NO: 583997 - RNA, 64 nt, Homo Sapiens
aaaaauaauaaaaacuuagcgcauagcaagacccugucucuaaaaaaaaugaccagccugggca

SEQ ID NO: 583998 - RNA, 64 nt, Homo Sapiens; identical to SEQ ID NO: 481838

SEQ ID NO: 583999 - RNA, 64 nt, Homo Sapiens; identical to SEQ ID NO: 481839

SEQ ID NO: 584000 - RNA, 64 nt, Homo Sapiens; identical to SEQ ID NO: 481840

SEQ ID NO: 584001 - RNA, 64 nt, Homo Sapiens; identical to SEQ ID NO: 481841

SEQ ID NO: 584002 - RNA, 64 nt, Homo Sapiens; identical to SEQ ID NO: 361028

SEQ ID NO: 584003 - RNA, 64 nt, Homo Sapiens; identical to SEQ ID NO: 361029

SEQ ID NO: 584004 - RNA, 64 nt, Homo Sapiens
guugacuuuuuuccaggauaaauuaucucugaugcuucuuuagauuuaagaguucauaauucca

SEQ ID NO: 584005 - RNA, 64 nt, Homo Sapiens
ucccuacugcaaaacccuauuguaguaaaaaagucuucuuuacuaucuuaauaaaacagauauu

SEQ ID NO: 584006 - RNA, 64 nt, Homo Sapiens
ugaaacuuacuaagaaucuauauguuuuaugcaccuucuuuaccuuccauuuucaucaauaaca

SEQ ID NO: 584007 - RNA, 64 nt, Homo Sapiens
gcugguuaauugguucaaauuacaaagcagaguacuucuuuagguuguuggauauuuuaguuca

SEQ ID NO: 584008 - RNA, 64 nt, Homo Sapiens
ucaguucucuucuuucuuuagcaaaucagagugacuucuuuaaaccacagguuguugaaauggc

SEQ ID NO: 584009 - RNA, 64 nt, Homo Sapiens
uguuuacugauggggauacaagaugugacacacccuucuuuauuugaaacaaacaaacauuuag

SEQ ID NO: 584010 - RNA, 64 nt, Homo Sapiens
gugugcaugacacuaagauuuuauguuggagauacuucuuuaaauaaccuacagcuugggucua

SEQ ID NO: 584011 - RNA, 64 nt, Homo Sapiens
uucucuaugaagacuuuaaaagccuuaauaaagucuucuuuaccucugacuuuauccccacguc

SEQ ID NO: 584012 - RNA, 64 nt, Homo Sapiens
cacauggagggaaagaagaugcagaggggaacuacuucuuuaaaucgauccauaagcauaucuu

SEQ ID NO: 584013 - RNA, 64 nt, Homo Sapiens
cugggaugacaauaauugcuauuugaaauauaugcuucuuuauuucuugcaaggggcaaguuuc

SEQ ID NO: 584014 - RNA, 64 nt, Homo Sapiens
auuuugaaacauauaauaaugauuuucuuguucccuucuuuaacuagcugccuuuagauuuuga

SEQ ID NO: 584015 - RNA, 64 nt, Homo Sapiens
ucuccuuuaguggacaccuagagccacagauucccuucuuuacuaaacaaaucccauggauucu

SEQ ID NO: 584016 - RNA, 64 nt, Homo Sapiens
uucuuuuuauauacuuuuucagauuuuuuauaugcuucuuuacuacuuacaucauaaugcacaa

SEQ ID NO: 584017 - RNA, 64 nt, Homo Sapiens
cuucuuccaauuuuuauuauuguuauuucugccccuucuuuaccaaagaguuagcugccagcuc

SEQ ID NO: 584018 - RNA, 64 nt, Homo Sapiens
caucuggugaguauugcagaaaauguuuuaaccucuucuuuaggacccuacuaagaauuggcag

SEQ ID NO: 584019 - RNA, 64 nt, Homo Sapiens
caccuugcgugcaugcagcaggcaacaacugccccuucuuuaugcagaggugcagaaccaggga

SEQ ID NO: 584020 - RNA, 64 nt, Homo Sapiens
cuuuguaaagugugaucuaugagaauuggagacacuucuuuacuguucaccaaagaaaugggua

SEQ ID NO: 584021 - RNA, 64 nt, Homo Sapiens
cuucggaaagauuagccuaguugugggauuauaacuucuuuacagcucugagaaauguguucaa

SEQ ID NO: 584022 - RNA, 64 nt, Homo Sapiens
aaauuauauuacucuaauaauguaaauaugcuaucuucuuuaagauuuucauguguuagaugug

SEQ ID NO: 584023 - RNA, 64 nt, Homo Sapiens
augcucuuaaauaugcauauuuucugccaacucacuucuuuaaacaucuuucagcccagcgcug

SEQ ID NO: 584024 - RNA, 64 nt, Homo Sapiens
ugaugucagaaucaaaccagauaauucucuaauucuucuuuaaucuaaaguagauagcuuccca

SEQ ID NO: 584025 - RNA, 64 nt, Homo Sapiens
cuaaacauaaguaacuuuaaggugaaugaaagaucuucuuuaggaauaauagaugaugguaagu

SEQ ID NO: 584026 - RNA, 64 nt, Homo Sapiens
uggaauuccuuuguccaggagaaaccucacaaaccuucuuuaaggcauaguuuuguuguuuguu

SEQ ID NO: 584027 - RNA, 63 nt, Homo Sapiens
ccacuuucugcuacccuagggaggccaggaggagcuucggaggaccaucgccccacuggucua

SEQ ID NO: 584028 - RNA, 63 nt, Homo Sapiens
cauccgggucacuccuucucaucacgcucgcgugcuucggaagccggcccgccuccauccaaa

SEQ ID NO: 584029 - RNA, 63 nt, Homo Sapiens
caaauaggcuccucuacaccagugacucucuaggcuucggacagcagccgagagugagaacca

SEQ ID NO: 584030 - RNA, 63 nt, Homo Sapiens
aaagagcagcagcucucuccgccagcucccagagcuucggaagaaaaggaaguccucagcugu

SEQ ID NO: 584031 - RNA, 63 nt, Homo Sapiens
aaagagcagcagcucucuccgccagcucccagagcuucggaagcaaaggaaguccugggcugu

SEQ ID NO: 584032 - RNA, 63 nt, Homo Sapiens
gguccucaguggcgccaccuccaggagcagagcgcuucggagccugguccgcagagaaagcac

SEQ ID NO: 584033 - RNA, 63 nt, Homo Sapiens
uguucauggagagcuguucgcuccucccagauggcuucggagggccgcagggcccaccuugga

SEQ ID NO: 584034 - RNA, 63 nt, Homo Sapiens
gaggccuuucuguugagcugcucuguccccuuggcuucggauguauauauauaaaacauuccc

SEQ ID NO: 584035 - RNA, 63 nt, Homo Sapiens
gcugccucguugucuauccugggaggguguggugcuucggacacguugaggggcuuugucagc

SEQ ID NO: 584036 - RNA, 63 nt, Homo Sapiens
uaauuuuugugcaaaaacaaaccugaaaaauaugcuucggaaacugugcauaguucuaauugu

SEQ ID NO: 584037 - RNA, 63 nt, Homo Sapiens
acuaauuuccagccaucaccuuugguggggugggcuucggaggacagucugucugaaccugcc

SEQ ID NO: 584038 - RNA, 63 nt, Homo Sapiens
gcuccuucccgcuucccccgacuucacacggcggcuucggaccaacucccucacucccgcccg

SEQ ID NO: 584039 - RNA, 63 nt, Homo Sapiens
gcgugacgaagcaguaguccgccccacucagcugcuucggaaaucugcaaggucacuuacaua

SEQ ID NO: 584040 - RNA, 63 nt, Homo Sapiens
aaaacauuuuauuuuuaaaauauuacacaggaggcuucggaguuucuuagucauuacuguccu

SEQ ID NO: 584041 - RNA, 63 nt, Homo Sapiens
ggcauuuuuauuugaauaugaugaguauauuuugcuucggaaauaauauaggaaggaaaugua

SEQ ID NO: 584042 - RNA, 63 nt, Homo Sapiens
auacagagaccaccaccacgcucccuacccccagcuucggaaaugaccuugcuagucugccca

SEQ ID NO: 584043 - RNA, 63 nt, Homo Sapiens
acuuuuuuuaguaaguuaauguauauaaaaauggcuucggacaaaauaucucugaguucugug

SEQ ID NO: 584044 - RNA, 63 nt, Homo Sapiens
acccugccaggccccugggcacugagcaccucggcuucggagccuugguuccagagccgcugu

SEQ ID NO: 584045 - RNA, 63 nt, Homo Sapiens
cagaauuccaugcccuuugcgcuagaaugcgcggcuucggacuguggccccugguggagcugc

SEQ ID NO: 584046 - RNA, 63 nt, Homo Sapiens
gggaguccccuccuccgccaccgagaguccugugcuucggaaugaagggagggcgaccuccuu

SEQ ID NO: 584047 - RNA, 63 nt, Homo Sapiens
cagcccuacugucccuuacuggggcagcagagggcuucggaggcagaagugaggccugggguu

SEQ ID NO: 584048 - RNA, 63 nt, Homo Sapiens
cgcaggcucagcugcuccgaucugccuuucccagcuucggagacaggcacgggcagcuccugu

SEQ ID NO: 584049 - RNA, 54 nt, Homo Sapiens
gaacaggacagauggaugucacuggcuucggacaacagcagugacucagaauga

SEQ ID NO: 584050 - RNA, 63 nt, Homo Sapiens
cguuaaaaaaauauguacgucuagcuccucagggcuucggaucgcagcucacucgaggccugg

SEQ ID NO: 584051 - RNA, 63 nt, Homo Sapiens
uuuacuggcucugcucccgcccugucauugaaagcuucggaagggcuccuaaucuccagcuuu

SEQ ID NO: 584052 - RNA, 63 nt, Homo Sapiens
cccagugcaccaucacccugcccugcccucguggcuucggagagcagaggggucaggcccagg

SEQ ID NO: 584053 - RNA, 63 nt, Homo Sapiens
gacuguuccagggaagggaugggggcagcagcugcuucggauccacacuguaucugugucauc

SEQ ID NO: 584054 - RNA, 63 nt, Homo Sapiens
cagauugagcaggaaguaaaaacaaauggaaaugcuucggauaguggcagggguggggguugc

SEQ ID NO: 584055 - RNA, 63 nt, Homo Sapiens
ccaggcuuuuagaggaccuucccuaagggcgcagcuucggagcaggaucuguccagcucauac

SEQ ID NO: 584056 - RNA, 63 nt, Homo Sapiens
cuucaucugugggaugcugaaggagaugagugggcuucggagugaauguggcaguuuaaaaaa

SEQ ID NO: 584057 - RNA, 63 nt, Homo Sapiens
caaggccugaccuaggcugcagagccagcuguggcuucggaccaagcaggagcucagacucuu

SEQ ID NO: 584058 - RNA, 63 nt, Homo Sapiens
ccacgccucugcaagugggacugucauccggaugcuucggaccuugcugucccuuuuguguau

SEQ ID NO: 584059 - RNA, 63 nt, Homo Sapiens
accacagcaucaaagacaucaugcagccagcaagcuucggaaacacgaacaaaggcaacaagc

SEQ ID NO: 584060 - RNA, 63 nt, Homo Sapiens
cagacaucuggggacacagcucaugacgcggcugcuucggaagacuuccucagcagaaacccg

SEQ ID NO: 584061 - RNA, 63 nt, Homo Sapiens
gauagugaugccacacauucucucucaauuucagcuucggaacgcuaugaaaauaauacauga

SEQ ID NO: 584062 - RNA, 63 nt, Homo Sapiens
gcuggguaaguggucuuggaaacugggaaaagugcuucggaagguuggaaccacagcucuggg

SEQ ID NO: 584063 - RNA, 63 nt, Homo Sapiens
uccgccucugcccgggagaagugcugcuccuuugcuucggaccuccaccugaagagaaccugc

SEQ ID NO: 584064 - RNA, 63 nt, Homo Sapiens
gcaggacccgcacgccucuucccacaccugucagcuucggaagcaucucucgaggacucuggu

SEQ ID NO: 584065 - RNA, 63 nt, Homo Sapiens
acccuaugugugccacaauggacguuagcagcugcuucggaacaccgucccuccuaugcaccc

SEQ ID NO: 584066 - RNA, 63 nt, Homo Sapiens
uggagucccuuuucauucucucaagcugagcuggcuucggagagggguagugccgcagugggg

SEQ ID NO: 584067 - RNA, 63 nt, Homo Sapiens
ugccuggcucauggcccaacggccucagugacugcuucggagcgaccugggugcaggcucccu

SEQ ID NO: 584068 - RNA, 59 nt, Homo Sapiens
ccgggaaaggccauacgaagggcugagacgcuucggaccuggacguuggccugggcuag

SEQ ID NO: 584069 - RNA, 63 nt, Homo Sapiens
acagcaggagccccgacugccaaugggggaggggcuucggaccaucaacugccugagaggaca

SEQ ID NO: 584070 - RNA, 63 nt, Homo Sapiens
gcccugcagagccagccgccaagguugaccucagcuucggagccaccucuggaugaacugccc

SEQ ID NO: 584071 - RNA, 63 nt, Homo Sapiens
gagguuuuaagaagcgucugccgugaucauggagcuucggaagcgggaaugguucuuccgggu

SEQ ID NO: 584072 - RNA, 63 nt, Homo Sapiens
cucccccagcagguuacgggcaggacuugaguggcuucggacagggcuucucagaccccagcc

SEQ ID NO: 584073 - RNA, 63 nt, Homo Sapiens
uuuauauauuuauucaucugggaggcagaacaggcuucggacagugcccaugcaauggcuugg

SEQ ID NO: 584074 - RNA, 63 nt, Homo Sapiens
ccagacuggcgagauucaaauccuggcucuaucgcuucggagccaggugggccugggggggcg

SEQ ID NO: 584075 - RNA, 63 nt, Homo Sapiens
gcgggaacuccucaggcagcuucuggcugcccagcuucggacaggcccggggccaagccugca

SEQ ID NO: 584076 - RNA, 63 nt, Homo Sapiens
cauagucaucccuccugcacguacuccaggcuugcuucggaguugguagguuucuuccucgcu

SEQ ID NO: 584077 - RNA, 63 nt, Homo Sapiens
aggugagggaggagcagguccugaccgaauccggcuucggauggggagggaggaauuacacag

SEQ ID NO: 584078 - RNA, 63 nt, Homo Sapiens
uggggguucugagaaggaaaguacccaacauuggcuucggaguauuugacuuuggggaaaagg

SEQ ID NO: 584079 - RNA, 63 nt, Homo Sapiens
ggucuccccggcugcucugcgggggcuucacuggcuucggagugagcgcgaagugcuggugag

SEQ ID NO: 584080 - RNA, 63 nt, Homo Sapiens
gccccugugugggggccaguagugugcacuccagcuucggaggagaguacagaagcuuuagca

SEQ ID NO: 584081 - RNA, 63 nt, Homo Sapiens
agcuucaagcccauccugucauuuucaucauuagcuucggagagguuuggggaggagagugac

SEQ ID NO: 584082 - RNA, 63 nt, Homo Sapiens
aggcccaggauccucagaggaagauggagaggagcuucggaccaagaucaaaccaaacagugg

SEQ ID NO: 584083 - RNA, 56 nt, Homo Sapiens
aaguugugcaaaacugguaaacgucugcuucggagcuugcugcuuaauaaauguug

SEQ ID NO: 584084 - RNA, 63 nt, Homo Sapiens
gcacaggacugcgugggcgcgggagccucagcugcuucggacccaaccacacgcuguacccca

SEQ ID NO: 584085 - RNA, 63 nt, Homo Sapiens
gcggcgcgcgcuggccgcccaggcagcggcugcgcuucggaccugguaggcaacaagcgggac

SEQ ID NO: 584086 - RNA, 63 nt, Homo Sapiens
aaggcccagcccugucaccuuuggaaggcuggagcuucggaccuuccucucacaggccuuggc

SEQ ID NO: 584087 - RNA, 63 nt, Homo Sapiens
ccccuggucuaacuugggauagagcagauuccagcuucggaaguugggcagccuugccuccag

SEQ ID NO: 584088 - RNA, 63 nt, Homo Sapiens
cuuuuauaaucccccuuuuucccugcccccugggcuucggaggggggugcuugugccccuaac

SEQ ID NO: 584089 - RNA, 63 nt, Homo Sapiens
aaaugaaaauggaaacaugaagauuuuccuggagcuucggaaguaaaugauuguuagcaaguu

SEQ ID NO: 584090 - RNA, 63 nt, Homo Sapiens
ccacaagcucagccucaggccgagccaggucaggcuucggaggugggcgccacagacgagcuc

SEQ ID NO: 584091 - RNA, 64 nt, Homo Sapiens; identical to SEQ ID NO: 213179

SEQ ID NO: 584092 - RNA, 64 nt, Homo Sapiens; identical to SEQ ID NO: 213180

SEQ ID NO: 584093 - RNA, 64 nt, Homo Sapiens; identical to SEQ ID NO: 213181

SEQ ID NO: 584094 - RNA, 64 nt, Homo Sapiens; identical to SEQ ID NO: 213182

SEQ ID NO: 584095 - RNA, 64 nt, Homo Sapiens; identical to SEQ ID NO: 213183

SEQ ID NO: 584096 - RNA, 64 nt, Homo Sapiens; identical to SEQ ID NO: 213184

SEQ ID NO: 584097 - RNA, 64 nt, Homo Sapiens; identical to SEQ ID NO: 213185

SEQ ID NO: 584098 - RNA, 64 nt, Homo Sapiens; identical to SEQ ID NO: 213186

SEQ ID NO: 584099 - RNA, 64 nt, Homo Sapiens; identical to SEQ ID NO: 213187

SEQ ID NO: 584100 - RNA, 64 nt, Homo Sapiens; identical to SEQ ID NO: 213188

SEQ ID NO: 584101 - RNA, 64 nt, Homo Sapiens; identical to SEQ ID NO: 213189

SEQ ID NO: 584102 - RNA, 64 nt, Homo Sapiens; identical to SEQ ID NO: 213190

SEQ ID NO: 584103 - RNA, 64 nt, Homo Sapiens; identical to SEQ ID NO: 213191

SEQ ID NO: 584104 - RNA, 64 nt, Homo Sapiens; identical to SEQ ID NO: 213192

SEQ ID NO: 584105 - RNA, 64 nt, Homo Sapiens; identical to SEQ ID NO: 213193

SEQ ID NO: 584106 - RNA, 64 nt, Homo Sapiens; identical to SEQ ID NO: 213194

SEQ ID NO: 584107 - RNA, 64 nt, Homo Sapiens; identical to SEQ ID NO: 213195

SEQ ID NO: 584108 - RNA, 64 nt, Homo Sapiens; identical to SEQ ID NO: 213196

SEQ ID NO: 584109 - RNA, 64 nt, Homo Sapiens; identical to SEQ ID NO: 213197

SEQ ID NO: 584110 - RNA, 64 nt, Homo Sapiens; identical to SEQ ID NO: 213198

SEQ ID NO: 584111 - RNA, 64 nt, Homo Sapiens; identical to SEQ ID NO: 293103

SEQ ID NO: 584112 - RNA, 64 nt, Homo Sapiens; identical to SEQ ID NO: 293104

SEQ ID NO: 584113 - RNA, 64 nt, Homo Sapiens; identical to SEQ ID NO: 293105

SEQ ID NO: 584114 - RNA, 64 nt, Homo Sapiens; identical to SEQ ID NO: 293106

SEQ ID NO: 584115 - RNA, 64 nt, Homo Sapiens; identical to SEQ ID NO: 293107

SEQ ID NO: 584116 - RNA, 64 nt, Homo Sapiens; identical to SEQ ID NO: 293108

SEQ ID NO: 584117 - RNA, 64 nt, Homo Sapiens; identical to SEQ ID NO: 293109

SEQ ID NO: 584118 - RNA, 64 nt, Homo Sapiens; identical to SEQ ID NO: 293110

SEQ ID NO: 584119 - RNA, 64 nt, Homo Sapiens; identical to SEQ ID NO: 293111

SEQ ID NO: 584120 - RNA, 64 nt, Homo Sapiens; identical to SEQ ID NO: 293112

SEQ ID NO: 584121 - RNA, 64 nt, Homo Sapiens; identical to SEQ ID NO: 293113

SEQ ID NO: 584122 - RNA, 64 nt, Homo Sapiens; identical to SEQ ID NO: 293114

SEQ ID NO: 584123 - RNA, 64 nt, Homo Sapiens; identical to SEQ ID NO: 293115

SEQ ID NO: 584124 - RNA, 64 nt, Homo Sapiens; identical to SEQ ID NO: 293116

SEQ ID NO: 584125 - RNA, 64 nt, Homo Sapiens; identical to SEQ ID NO: 293117

SEQ ID NO: 584126 - RNA, 64 nt, Homo Sapiens; identical to SEQ ID NO: 293118

SEQ ID NO: 584127 - RNA, 64 nt, Homo Sapiens; identical to SEQ ID NO: 293119

SEQ ID NO: 584128 - RNA, 64 nt, Homo Sapiens; identical to SEQ ID NO: 293120

SEQ ID NO: 584129 - RNA, 64 nt, Homo Sapiens; identical to SEQ ID NO: 293121

SEQ ID NO: 584130 - RNA, 64 nt, Homo Sapiens; identical to SEQ ID NO: 293122

SEQ ID NO: 584131 - RNA, 64 nt, Homo Sapiens; identical to SEQ ID NO: 293123

SEQ ID NO: 584132 - RNA, 64 nt, Homo Sapiens; identical to SEQ ID NO: 293124

SEQ ID NO: 584133 - RNA, 64 nt, Homo Sapiens; identical to SEQ ID NO: 293125

SEQ ID NO: 584134 - RNA, 64 nt, Homo Sapiens; identical to SEQ ID NO: 293126

SEQ ID NO: 584135 - RNA, 64 nt, Homo Sapiens; identical to SEQ ID NO: 293127

SEQ ID NO: 584136 - RNA, 64 nt, Homo Sapiens; identical to SEQ ID NO: 293128

SEQ ID NO: 584137 - RNA, 64 nt, Homo Sapiens; identical to SEQ ID NO: 293129

SEQ ID NO: 584138 - RNA, 64 nt, Homo Sapiens; identical to SEQ ID NO: 293130

SEQ ID NO: 584139 - RNA, 64 nt, Homo Sapiens; identical to SEQ ID NO: 293131

SEQ ID NO: 584140 - RNA, 64 nt, Homo Sapiens; identical to SEQ ID NO: 293132

SEQ ID NO: 584141 - RNA, 64 nt, Homo Sapiens; identical to SEQ ID NO: 293133

SEQ ID NO: 584142 - RNA, 64 nt, Homo Sapiens; identical to SEQ ID NO: 293134

SEQ ID NO: 584143 - RNA, 64 nt, Homo Sapiens; identical to SEQ ID NO: 293135

SEQ ID NO: 584144 - RNA, 64 nt, Homo Sapiens; identical to SEQ ID NO: 293136

SEQ ID NO: 584145 - RNA, 64 nt, Homo Sapiens; identical to SEQ ID NO: 293137

SEQ ID NO: 584146 - RNA, 64 nt, Homo Sapiens; identical to SEQ ID NO: 293138

SEQ ID NO: 584147 - RNA, 64 nt, Homo Sapiens; identical to SEQ ID NO: 293139

SEQ ID NO: 584148 - RNA, 64 nt, Homo Sapiens; identical to SEQ ID NO: 293140

SEQ ID NO: 584149 - RNA, 64 nt, Homo Sapiens; identical to SEQ ID NO: 293141

SEQ ID NO: 584150 - RNA, 64 nt, Homo Sapiens; identical to SEQ ID NO: 293142

SEQ ID NO: 584151 - RNA, 63 nt, Homo Sapiens
uuuacccuaagucgaacugaguauaaggugugacuauuggauucuugaacuaaaauuugaccc

SEQ ID NO: 584152 - RNA, 64 nt, Homo Sapiens
gccuauaaucuguugcuuuuucucaauauguguccuauuggaaauuccucaaaucguuggugcc

SEQ ID NO: 584153 - RNA, 64 nt, Homo Sapiens
cuucggaugcguaaaagaaacugauauaaagccccuauuggauuugaaauacgaaguccuuggu

SEQ ID NO: 584154 - RNA, 64 nt, Homo Sapiens
ggcauugacagccagggacaacucuaaugacuuccuauuggaaaggggguggaauuuuuuucuc

SEQ ID NO: 584155 - RNA, 64 nt, Homo Sapiens; identical to SEQ ID NO: 282605

SEQ ID NO: 584156 - RNA, 64 nt, Homo Sapiens; identical to SEQ ID NO: 282606

SEQ ID NO: 584157 - RNA, 64 nt, Homo Sapiens; identical to SEQ ID NO: 282607

SEQ ID NO: 584158 - RNA, 64 nt, Homo Sapiens; identical to SEQ ID NO: 282608

SEQ ID NO: 584159 - RNA, 64 nt, Homo Sapiens; identical to SEQ ID NO: 76340

SEQ ID NO: 584160 - RNA, 64 nt, Homo Sapiens; identical to SEQ ID NO: 76341

SEQ ID NO: 584161 - RNA, 64 nt, Homo Sapiens; identical to SEQ ID NO: 76342

SEQ ID NO: 584162 - RNA, 64 nt, Homo Sapiens; identical to SEQ ID NO: 76343

SEQ ID NO: 584163 - RNA, 64 nt, Homo Sapiens; identical to SEQ ID NO: 76344

SEQ ID NO: 584164 - RNA, 64 nt, Homo Sapiens; identical to SEQ ID NO: 76345

SEQ ID NO: 584165 - RNA, 64 nt, Homo Sapiens; identical to SEQ ID NO: 76346

SEQ ID NO: 584166 - RNA, 64 nt, Homo Sapiens; identical to SEQ ID NO: 76347

SEQ ID NO: 584167 - RNA, 64 nt, Homo Sapiens; identical to SEQ ID NO: 76348

SEQ ID NO: 584168 - RNA, 64 nt, Homo Sapiens; identical to SEQ ID NO: 76349

SEQ ID NO: 584169 - RNA, 64 nt, Homo Sapiens; identical to SEQ ID NO: 76350

SEQ ID NO: 584170 - RNA, 64 nt, Homo Sapiens; identical to SEQ ID NO: 76351

SEQ ID NO: 584171 - RNA, 64 nt, Homo Sapiens; identical to SEQ ID NO: 76352

SEQ ID NO: 584172 - RNA, 64 nt, Homo Sapiens; identical to SEQ ID NO: 76353

SEQ ID NO: 584173 - RNA, 64 nt, Homo Sapiens; identical to SEQ ID NO: 76354

SEQ ID NO: 584174 - RNA, 64 nt, Homo Sapiens; identical to SEQ ID NO: 76355

SEQ ID NO: 584175 - RNA, 64 nt, Homo Sapiens; identical to SEQ ID NO: 76356

SEQ ID NO: 584176 - RNA, 64 nt, Homo Sapiens; identical to SEQ ID NO: 76357

SEQ ID NO: 584177 - RNA, 64 nt, Homo Sapiens; identical to SEQ ID NO: 76358

SEQ ID NO: 584178 - RNA, 64 nt, Homo Sapiens; identical to SEQ ID NO: 76359

SEQ ID NO: 584179 - RNA, 64 nt, Homo Sapiens; identical to SEQ ID NO: 76360

SEQ ID NO: 584180 - RNA, 64 nt, Homo Sapiens; identical to SEQ ID NO: 76361

SEQ ID NO: 584181 - RNA, 64 nt, Homo Sapiens; identical to SEQ ID NO: 76362

SEQ ID NO: 584182 - RNA, 64 nt, Homo Sapiens; identical to SEQ ID NO: 76363

SEQ ID NO: 584183 - RNA, 64 nt, Homo Sapiens; identical to SEQ ID NO: 76364

SEQ ID NO: 584184 - RNA, 64 nt, Homo Sapiens; identical to SEQ ID NO: 76365

SEQ ID NO: 584185 - RNA, 64 nt, Homo Sapiens; identical to SEQ ID NO: 76366

SEQ ID NO: 584186 - RNA, 64 nt, Homo Sapiens; identical to SEQ ID NO: 76367

SEQ ID NO: 584187 - RNA, 64 nt, Homo Sapiens; identical to SEQ ID NO: 76368

SEQ ID NO: 584188 - RNA, 64 nt, Homo Sapiens; identical to SEQ ID NO: 76369

SEQ ID NO: 584189 - RNA, 64 nt, Homo Sapiens; identical to SEQ ID NO: 76370

SEQ ID NO: 584190 - RNA, 64 nt, Homo Sapiens; identical to SEQ ID NO: 76371

SEQ ID NO: 584191 - RNA, 64 nt, Homo Sapiens; identical to SEQ ID NO: 76372

SEQ ID NO: 584192 - RNA, 64 nt, Homo Sapiens; identical to SEQ ID NO: 76373

SEQ ID NO: 584193 - RNA, 64 nt, Homo Sapiens; identical to SEQ ID NO: 76374

SEQ ID NO: 584194 - RNA, 64 nt, Homo Sapiens; identical to SEQ ID NO: 76375

SEQ ID NO: 584195 - RNA, 64 nt, Homo Sapiens; identical to SEQ ID NO: 76376

SEQ ID NO: 584196 - RNA, 64 nt, Homo Sapiens; identical to SEQ ID NO: 76377

SEQ ID NO: 584197 - RNA, 64 nt, Homo Sapiens; identical to SEQ ID NO: 76378

SEQ ID NO: 584198 - RNA, 64 nt, Homo Sapiens; identical to SEQ ID NO: 76379

SEQ ID NO: 584199 - RNA, 64 nt, Homo Sapiens; identical to SEQ ID NO: 76380

SEQ ID NO: 584200 - RNA, 64 nt, Homo Sapiens; identical to SEQ ID NO: 76381

SEQ ID NO: 584201 - RNA, 64 nt, Homo Sapiens; identical to SEQ ID NO: 153628

SEQ ID NO: 584202 - RNA, 64 nt, Homo Sapiens; identical to SEQ ID NO: 153629

SEQ ID NO: 584203 - RNA, 64 nt, Homo Sapiens; identical to SEQ ID NO: 153630

SEQ ID NO: 584204 - RNA, 64 nt, Homo Sapiens; identical to SEQ ID NO: 153631

SEQ ID NO: 584205 - RNA, 64 nt, Homo Sapiens; identical to SEQ ID NO: 153632

SEQ ID NO: 584206 - RNA, 64 nt, Homo Sapiens; identical to SEQ ID NO: 153633

SEQ ID NO: 584207 - RNA, 64 nt, Homo Sapiens; identical to SEQ ID NO: 153634

SEQ ID NO: 584208 - RNA, 64 nt, Homo Sapiens; identical to SEQ ID NO: 153635

SEQ ID NO: 584209 - RNA, 64 nt, Homo Sapiens; identical to SEQ ID NO: 153636

SEQ ID NO: 584210 - RNA, 64 nt, Homo Sapiens; identical to SEQ ID NO: 153637

SEQ ID NO: 584211 - RNA, 64 nt, Homo Sapiens; identical to SEQ ID NO: 110389

SEQ ID NO: 584212 - RNA, 64 nt, Homo Sapiens; identical to SEQ ID NO: 110390

SEQ ID NO: 584213 - RNA, 64 nt, Homo Sapiens; identical to SEQ ID NO: 110391

SEQ ID NO: 584214 - RNA, 64 nt, Homo Sapiens; identical to SEQ ID NO: 110392

SEQ ID NO: 584215 - RNA, 64 nt, Homo Sapiens; identical to SEQ ID NO: 110393

SEQ ID NO: 584216 - RNA, 63 nt, Homo Sapiens; identical to SEQ ID NO: 110394

SEQ ID NO: 584217 - RNA, 60 nt, Homo Sapiens; identical to SEQ ID NO: 110395

SEQ ID NO: 584218 - RNA, 64 nt, Homo Sapiens; identical to SEQ ID NO: 110396

SEQ ID NO: 584219 - RNA, 64 nt, Homo Sapiens; identical to SEQ ID NO: 110397

SEQ ID NO: 584220 - RNA, 64 nt, Homo Sapiens; identical to SEQ ID NO: 110398

SEQ ID NO: 584221 - RNA, 64 nt, Homo Sapiens; identical to SEQ ID NO: 110399

SEQ ID NO: 584222 - RNA, 64 nt, Homo Sapiens; identical to SEQ ID NO: 110400

SEQ ID NO: 584223 - RNA, 64 nt, Homo Sapiens; identical to SEQ ID NO: 110401

SEQ ID NO: 584224 - RNA, 58 nt, Homo Sapiens; identical to SEQ ID NO: 110402

SEQ ID NO: 584225 - RNA, 64 nt, Homo Sapiens; identical to SEQ ID NO: 110403

SEQ ID NO: 584226 - RNA, 64 nt, Homo Sapiens; identical to SEQ ID NO: 110404

SEQ ID NO: 584227 - RNA, 64 nt, Homo Sapiens; identical to SEQ ID NO: 110405

SEQ ID NO: 584228 - RNA, 64 nt, Homo Sapiens; identical to SEQ ID NO: 110406

SEQ ID NO: 584229 - RNA, 64 nt, Homo Sapiens; identical to SEQ ID NO: 110407

SEQ ID NO: 584230 - RNA, 64 nt, Homo Sapiens; identical to SEQ ID NO: 110408

SEQ ID NO: 584231 - RNA, 64 nt, Homo Sapiens; identical to SEQ ID NO: 110409

SEQ ID NO: 584232 - RNA, 64 nt, Homo Sapiens; identical to SEQ ID NO: 110410

SEQ ID NO: 584233 - RNA, 64 nt, Homo Sapiens; identical to SEQ ID NO: 110411

SEQ ID NO: 584234 - RNA, 64 nt, Homo Sapiens; identical to SEQ ID NO: 110412

SEQ ID NO: 584235 - RNA, 64 nt, Homo Sapiens; identical to SEQ ID NO: 110413

SEQ ID NO: 584236 - RNA, 64 nt, Homo Sapiens; identical to SEQ ID NO: 110414

SEQ ID NO: 584237 - RNA, 64 nt, Homo Sapiens; identical to SEQ ID NO: 110415

SEQ ID NO: 584238 - RNA, 64 nt, Homo Sapiens; identical to SEQ ID NO: 110416

SEQ ID NO: 584239 - RNA, 64 nt, Homo Sapiens; identical to SEQ ID NO: 110417

SEQ ID NO: 584240 - RNA, 64 nt, Homo Sapiens; identical to SEQ ID NO: 110418

SEQ ID NO: 584241 - RNA, 64 nt, Homo Sapiens; identical to SEQ ID NO: 110419

SEQ ID NO: 584242 - RNA, 64 nt, Homo Sapiens; identical to SEQ ID NO: 110420

SEQ ID NO: 584243 - RNA, 64 nt, Homo Sapiens; identical to SEQ ID NO: 110421

SEQ ID NO: 584244 - RNA, 64 nt, Homo Sapiens; identical to SEQ ID NO: 110422

SEQ ID NO: 584245 - RNA, 64 nt, Homo Sapiens; identical to SEQ ID NO: 110423

SEQ ID NO: 584246 - RNA, 64 nt, Homo Sapiens; identical to SEQ ID NO: 110424

SEQ ID NO: 584247 - RNA, 64 nt, Homo Sapiens; identical to SEQ ID NO: 110425

SEQ ID NO: 584248 - RNA, 64 nt, Homo Sapiens; identical to SEQ ID NO: 110426

SEQ ID NO: 584249 - RNA, 64 nt, Homo Sapiens; identical to SEQ ID NO: 110427

SEQ ID NO: 584250 - RNA, 64 nt, Homo Sapiens; identical to SEQ ID NO: 110428

SEQ ID NO: 584251 - RNA, 64 nt, Homo Sapiens; identical to SEQ ID NO: 110429

SEQ ID NO: 584252 - RNA, 64 nt, Homo Sapiens; identical to SEQ ID NO: 110430

SEQ ID NO: 584253 - RNA, 64 nt, Homo Sapiens; identical to SEQ ID NO: 110431

SEQ ID NO: 584254 - RNA, 64 nt, Homo Sapiens; identical to SEQ ID NO: 110432

SEQ ID NO: 584255 - RNA, 64 nt, Homo Sapiens; identical to SEQ ID NO: 110433

SEQ ID NO: 584256 - RNA, 64 nt, Homo Sapiens; identical to SEQ ID NO: 110434

SEQ ID NO: 584257 - RNA, 64 nt, Homo Sapiens; identical to SEQ ID NO: 110435

SEQ ID NO: 584258 - RNA, 64 nt, Homo Sapiens; identical to SEQ ID NO: 110436

SEQ ID NO: 584259 - RNA, 64 nt, Homo Sapiens; identical to SEQ ID NO: 110437

SEQ ID NO: 584260 - RNA, 64 nt, Homo Sapiens; identical to SEQ ID NO: 110438

SEQ ID NO: 584261 - RNA, 64 nt, Homo Sapiens; identical to SEQ ID NO: 110439

SEQ ID NO: 584262 - RNA, 64 nt, Homo Sapiens; identical to SEQ ID NO: 56439

SEQ ID NO: 584263 - RNA, 64 nt, Homo Sapiens; identical to SEQ ID NO: 56440

SEQ ID NO: 584264 - RNA, 64 nt, Homo Sapiens; identical to SEQ ID NO: 56441

SEQ ID NO: 584265 - RNA, 64 nt, Homo Sapiens; identical to SEQ ID NO: 56442

SEQ ID NO: 584266 - RNA, 64 nt, Homo Sapiens; identical to SEQ ID NO: 56443

SEQ ID NO: 584267 - RNA, 64 nt, Homo Sapiens; identical to SEQ ID NO: 56444

SEQ ID NO: 584268 - RNA, 64 nt, Homo Sapiens; identical to SEQ ID NO: 56445

SEQ ID NO: 584269 - RNA, 64 nt, Homo Sapiens; identical to SEQ ID NO: 56446

SEQ ID NO: 584270 - RNA, 64 nt, Homo Sapiens; identical to SEQ ID NO: 56447

SEQ ID NO: 584271 - RNA, 64 nt, Homo Sapiens; identical to SEQ ID NO: 56448

SEQ ID NO: 584272 - RNA, 64 nt, Homo Sapiens; identical to SEQ ID NO: 56449

SEQ ID NO: 584273 - RNA, 64 nt, Homo Sapiens; identical to SEQ ID NO: 56450

SEQ ID NO: 584274 - RNA, 64 nt, Homo Sapiens; identical to SEQ ID NO: 56451

SEQ ID NO: 584275 - RNA, 64 nt, Homo Sapiens; identical to SEQ ID NO: 56452

SEQ ID NO: 584276 - RNA, 64 nt, Homo Sapiens; identical to SEQ ID NO: 56453

SEQ ID NO: 584277 - RNA, 64 nt, Homo Sapiens; identical to SEQ ID NO: 56454

SEQ ID NO: 584278 - RNA, 64 nt, Homo Sapiens; identical to SEQ ID NO: 56455

SEQ ID NO: 584279 - RNA, 64 nt, Homo Sapiens; identical to SEQ ID NO: 56456

SEQ ID NO: 584280 - RNA, 64 nt, Homo Sapiens; identical to SEQ ID NO: 56457

SEQ ID NO: 584281 - RNA, 64 nt, Homo Sapiens; identical to SEQ ID NO: 56458

SEQ ID NO: 584282 - RNA, 64 nt, Homo Sapiens; identical to SEQ ID NO: 56459

SEQ ID NO: 584283 - RNA, 64 nt, Homo Sapiens; identical to SEQ ID NO: 56460

SEQ ID NO: 584284 - RNA, 64 nt, Homo Sapiens; identical to SEQ ID NO: 56461

SEQ ID NO: 584285 - RNA, 64 nt, Homo Sapiens; identical to SEQ ID NO: 56462

SEQ ID NO: 584286 - RNA, 64 nt, Homo Sapiens; identical to SEQ ID NO: 56463

SEQ ID NO: 584287 - RNA, 64 nt, Homo Sapiens; identical to SEQ ID NO: 56464

SEQ ID NO: 584288 - RNA, 64 nt, Homo Sapiens; identical to SEQ ID NO: 56465

SEQ ID NO: 584289 - RNA, 64 nt, Homo Sapiens; identical to SEQ ID NO: 56466

SEQ ID NO: 584290 - RNA, 64 nt, Homo Sapiens; identical to SEQ ID NO: 56467

SEQ ID NO: 584291 - RNA, 50 nt, Homo Sapiens; identical to SEQ ID NO: 56468

SEQ ID NO: 584292 - RNA, 64 nt, Homo Sapiens; identical to SEQ ID NO: 56469

SEQ ID NO: 584293 - RNA, 64 nt, Homo Sapiens; identical to SEQ ID NO: 56470

SEQ ID NO: 584294 - RNA, 64 nt, Homo Sapiens; identical to SEQ ID NO: 56471

SEQ ID NO: 584295 - RNA, 64 nt, Homo Sapiens; identical to SEQ ID NO: 56472

SEQ ID NO: 584296 - RNA, 64 nt, Homo Sapiens; identical to SEQ ID NO: 56473

SEQ ID NO: 584297 - RNA, 64 nt, Homo Sapiens; identical to SEQ ID NO: 56474

SEQ ID NO: 584298 - RNA, 64 nt, Homo Sapiens; identical to SEQ ID NO: 56475

SEQ ID NO: 584299 - RNA, 64 nt, Homo Sapiens; identical to SEQ ID NO: 56476

SEQ ID NO: 584300 - RNA, 64 nt, Homo Sapiens; identical to SEQ ID NO: 56477

SEQ ID NO: 584301 - RNA, 64 nt, Homo Sapiens; identical to SEQ ID NO: 56478

SEQ ID NO: 584302 - RNA, 64 nt, Homo Sapiens; identical to SEQ ID NO: 56479

SEQ ID NO: 584303 - RNA, 64 nt, Homo Sapiens; identical to SEQ ID NO: 56480

SEQ ID NO: 584304 - RNA, 64 nt, Homo Sapiens; identical to SEQ ID NO: 56481

SEQ ID NO: 584305 - RNA, 64 nt, Homo Sapiens; identical to SEQ ID NO: 56482

SEQ ID NO: 584306 - RNA, 64 nt, Homo Sapiens; identical to SEQ ID NO: 56483

SEQ ID NO: 584307 - RNA, 64 nt, Homo Sapiens; identical to SEQ ID NO: 56484

SEQ ID NO: 584308 - RNA, 64 nt, Homo Sapiens; identical to SEQ ID NO: 56485

SEQ ID NO: 584309 - RNA, 64 nt, Homo Sapiens; identical to SEQ ID NO: 56486

SEQ ID NO: 584310 - RNA, 64 nt, Homo Sapiens; identical to SEQ ID NO: 56487

SEQ ID NO: 584311 - RNA, 64 nt, Homo Sapiens; identical to SEQ ID NO: 56488

SEQ ID NO: 584312 - RNA, 64 nt, Homo Sapiens; identical to SEQ ID NO: 56489

SEQ ID NO: 584313 - RNA, 64 nt, Homo Sapiens; identical to SEQ ID NO: 56490

SEQ ID NO: 584314 - RNA, 64 nt, Homo Sapiens; identical to SEQ ID NO: 56491

SEQ ID NO: 584315 - RNA, 64 nt, Homo Sapiens; identical to SEQ ID NO: 56492

SEQ ID NO: 584316 - RNA, 64 nt, Homo Sapiens; identical to SEQ ID NO: 56493

SEQ ID NO: 584317 - RNA, 64 nt, Homo Sapiens; identical to SEQ ID NO: 56494

SEQ ID NO: 584318 - RNA, 64 nt, Homo Sapiens; identical to SEQ ID NO: 56495

SEQ ID NO: 584319 - RNA, 64 nt, Homo Sapiens; identical to SEQ ID NO: 56496

SEQ ID NO: 584320 - RNA, 64 nt, Homo Sapiens; identical to SEQ ID NO: 56497

SEQ ID NO: 584321 - RNA, 64 nt, Homo Sapiens; identical to SEQ ID NO: 56498

SEQ ID NO: 584322 - RNA, 64 nt, Homo Sapiens; identical to SEQ ID NO: 56499

SEQ ID NO: 584323 - RNA, 64 nt, Homo Sapiens; identical to SEQ ID NO: 56500

SEQ ID NO: 584324 - RNA, 64 nt, Homo Sapiens; identical to SEQ ID NO: 56501

SEQ ID NO: 584325 - RNA, 64 nt, Homo Sapiens; identical to SEQ ID NO: 56502

SEQ ID NO: 584326 - RNA, 64 nt, Homo Sapiens; identical to SEQ ID NO: 56503

SEQ ID NO: 584327 - RNA, 64 nt, Homo Sapiens; identical to SEQ ID NO: 56504

SEQ ID NO: 584328 - RNA, 64 nt, Homo Sapiens; identical to SEQ ID NO: 56505

SEQ ID NO: 584329 - RNA, 64 nt, Homo Sapiens; identical to SEQ ID NO: 56506

SEQ ID NO: 584330 - RNA, 64 nt, Homo Sapiens; identical to SEQ ID NO: 56507

SEQ ID NO: 584331 - RNA, 64 nt, Homo Sapiens; identical to SEQ ID NO: 56508

SEQ ID NO: 584332 - RNA, 64 nt, Homo Sapiens; identical to SEQ ID NO: 56509

SEQ ID NO: 584333 - RNA, 64 nt, Homo Sapiens; identical to SEQ ID NO: 56510

SEQ ID NO: 584334 - RNA, 64 nt, Homo Sapiens; identical to SEQ ID NO: 56511

SEQ ID NO: 584335 - RNA, 64 nt, Homo Sapiens; identical to SEQ ID NO: 56512

SEQ ID NO: 584336 - RNA, 64 nt, Homo Sapiens; identical to SEQ ID NO: 56513

SEQ ID NO: 584337 - RNA, 64 nt, Homo Sapiens; identical to SEQ ID NO: 56514

SEQ ID NO: 584338 - RNA, 64 nt, Homo Sapiens; identical to SEQ ID NO: 56515

SEQ ID NO: 584339 - RNA, 64 nt, Homo Sapiens; identical to SEQ ID NO: 56516

SEQ ID NO: 584340 - RNA, 64 nt, Homo Sapiens; identical to SEQ ID NO: 56517

SEQ ID NO: 584341 - RNA, 64 nt, Homo Sapiens; identical to SEQ ID NO: 56518

SEQ ID NO: 584342 - RNA, 64 nt, Homo Sapiens; identical to SEQ ID NO: 56519

SEQ ID NO: 584343 - RNA, 64 nt, Homo Sapiens; identical to SEQ ID NO: 56520

SEQ ID NO: 584344 - RNA, 64 nt, Homo Sapiens; identical to SEQ ID NO: 56521

SEQ ID NO: 584345 - RNA, 64 nt, Homo Sapiens; identical to SEQ ID NO: 56522

SEQ ID NO: 584346 - RNA, 64 nt, Homo Sapiens; identical to SEQ ID NO: 56523

SEQ ID NO: 584347 - RNA, 64 nt, Homo Sapiens; identical to SEQ ID NO: 56524

SEQ ID NO: 584348 - RNA, 64 nt, Homo Sapiens; identical to SEQ ID NO: 56525

SEQ ID NO: 584349 - RNA, 64 nt, Homo Sapiens; identical to SEQ ID NO: 56526

SEQ ID NO: 584350 - RNA, 64 nt, Homo Sapiens; identical to SEQ ID NO: 56527

SEQ ID NO: 584351 - RNA, 64 nt, Homo Sapiens; identical to SEQ ID NO: 56528

SEQ ID NO: 584352 - RNA, 64 nt, Homo Sapiens; identical to SEQ ID NO: 56529

SEQ ID NO: 584353 - RNA, 64 nt, Homo Sapiens; identical to SEQ ID NO: 56530

SEQ ID NO: 584354 - RNA, 64 nt, Homo Sapiens; identical to SEQ ID NO: 56531

SEQ ID NO: 584355 - RNA, 64 nt, Homo Sapiens; identical to SEQ ID NO: 56532

SEQ ID NO: 584356 - RNA, 64 nt, Homo Sapiens; identical to SEQ ID NO: 56533

SEQ ID NO: 584357 - RNA, 64 nt, Homo Sapiens; identical to SEQ ID NO: 56534

SEQ ID NO: 584358 - RNA, 59 nt, Homo Sapiens; identical to SEQ ID NO: 56535

SEQ ID NO: 584359 - RNA, 64 nt, Homo Sapiens; identical to SEQ ID NO: 56536

SEQ ID NO: 584360 - RNA, 64 nt, Homo Sapiens; identical to SEQ ID NO: 56537

SEQ ID NO: 584361 - RNA, 64 nt, Homo Sapiens; identical to SEQ ID NO: 56538

SEQ ID NO: 584362 - RNA, 64 nt, Homo Sapiens; identical to SEQ ID NO: 56539

SEQ ID NO: 584363 - RNA, 64 nt, Homo Sapiens; identical to SEQ ID NO: 56540

SEQ ID NO: 584364 - RNA, 64 nt, Homo Sapiens; identical to SEQ ID NO: 56541

SEQ ID NO: 584365 - RNA, 64 nt, Homo Sapiens; identical to SEQ ID NO: 56542

SEQ ID NO: 584366 - RNA, 64 nt, Homo Sapiens; identical to SEQ ID NO: 56543

SEQ ID NO: 584367 - RNA, 64 nt, Homo Sapiens; identical to SEQ ID NO: 56544

SEQ ID NO: 584368 - RNA, 64 nt, Homo Sapiens; identical to SEQ ID NO: 56545

SEQ ID NO: 584369 - RNA, 64 nt, Homo Sapiens; identical to SEQ ID NO: 56546

SEQ ID NO: 584370 - RNA, 64 nt, Homo Sapiens; identical to SEQ ID NO: 56547

SEQ ID NO: 584371 - RNA, 64 nt, Homo Sapiens; identical to SEQ ID NO: 56548

SEQ ID NO: 584372 - RNA, 64 nt, Homo Sapiens; identical to SEQ ID NO: 56549

SEQ ID NO: 584373 - RNA, 64 nt, Homo Sapiens; identical to SEQ ID NO: 56550

SEQ ID NO: 584374 - RNA, 64 nt, Homo Sapiens; identical to SEQ ID NO: 56551

SEQ ID NO: 584375 - RNA, 64 nt, Homo Sapiens; identical to SEQ ID NO: 56552

SEQ ID NO: 584376 - RNA, 64 nt, Homo Sapiens; identical to SEQ ID NO: 56553

SEQ ID NO: 584377 - RNA, 64 nt, Homo Sapiens; identical to SEQ ID NO: 56554

SEQ ID NO: 584378 - RNA, 64 nt, Homo Sapiens; identical to SEQ ID NO: 56555

SEQ ID NO: 584379 - RNA, 64 nt, Homo Sapiens; identical to SEQ ID NO: 56556

SEQ ID NO: 584380 - RNA, 62 nt, Homo Sapiens; identical to SEQ ID NO: 56557

SEQ ID NO: 584381 - RNA, 58 nt, Homo Sapiens; identical to SEQ ID NO: 56558

SEQ ID NO: 584382 - RNA, 64 nt, Homo Sapiens; identical to SEQ ID NO: 56559

SEQ ID NO: 584383 - RNA, 64 nt, Homo Sapiens; identical to SEQ ID NO: 56560

SEQ ID NO: 584384 - RNA, 64 nt, Homo Sapiens; identical to SEQ ID NO: 56561

SEQ ID NO: 584385 - RNA, 64 nt, Homo Sapiens; identical to SEQ ID NO: 56562

SEQ ID NO: 584386 - RNA, 64 nt, Homo Sapiens; identical to SEQ ID NO: 56563

SEQ ID NO: 584387 - RNA, 64 nt, Homo Sapiens; identical to SEQ ID NO: 56564

SEQ ID NO: 584388 - RNA, 64 nt, Homo Sapiens; identical to SEQ ID NO: 56565

SEQ ID NO: 584389 - RNA, 64 nt, Homo Sapiens; identical to SEQ ID NO: 56566

SEQ ID NO: 584390 - RNA, 64 nt, Homo Sapiens; identical to SEQ ID NO: 56567

SEQ ID NO: 584391 - RNA, 64 nt, Homo Sapiens; identical to SEQ ID NO: 56568

SEQ ID NO: 584392 - RNA, 64 nt, Homo Sapiens; identical to SEQ ID NO: 56569

SEQ ID NO: 584393 - RNA, 64 nt, Homo Sapiens; identical to SEQ ID NO: 56570

SEQ ID NO: 584394 - RNA, 64 nt, Homo Sapiens; identical to SEQ ID NO: 56571

SEQ ID NO: 584395 - RNA, 64 nt, Homo Sapiens; identical to SEQ ID NO: 56572

SEQ ID NO: 584396 - RNA, 64 nt, Homo Sapiens; identical to SEQ ID NO: 56573

SEQ ID NO: 584397 - RNA, 64 nt, Homo Sapiens; identical to SEQ ID NO: 56574

SEQ ID NO: 584398 - RNA, 64 nt, Homo Sapiens; identical to SEQ ID NO: 56575

SEQ ID NO: 584399 - RNA, 64 nt, Homo Sapiens; identical to SEQ ID NO: 56576

SEQ ID NO: 584400 - RNA, 64 nt, Homo Sapiens; identical to SEQ ID NO: 56577

SEQ ID NO: 584401 - RNA, 64 nt, Homo Sapiens; identical to SEQ ID NO: 56578

SEQ ID NO: 584402 - RNA, 64 nt, Homo Sapiens; identical to SEQ ID NO: 56579

SEQ ID NO: 584403 - RNA, 64 nt, Homo Sapiens; identical to SEQ ID NO: 56580

SEQ ID NO: 584404 - RNA, 64 nt, Homo Sapiens; identical to SEQ ID NO: 56581

SEQ ID NO: 584405 - RNA, 64 nt, Homo Sapiens; identical to SEQ ID NO: 56582

SEQ ID NO: 584406 - RNA, 64 nt, Homo Sapiens; identical to SEQ ID NO: 290771

SEQ ID NO: 584407 - RNA, 64 nt, Homo Sapiens; identical to SEQ ID NO: 290772

SEQ ID NO: 584408 - RNA, 64 nt, Homo Sapiens; identical to SEQ ID NO: 290773

SEQ ID NO: 584409 - RNA, 64 nt, Homo Sapiens; identical to SEQ ID NO: 290774

SEQ ID NO: 584410 - RNA, 64 nt, Homo Sapiens; identical to SEQ ID NO: 290775

SEQ ID NO: 584411 - RNA, 64 nt, Homo Sapiens; identical to SEQ ID NO: 290776

SEQ ID NO: 584412 - RNA, 64 nt, Homo Sapiens
uuuggaugugugauuaauuuucaaaucaucuaaaguuuaaaaguaguauucaugauuucuggcu

SEQ ID NO: 584413 - RNA, 64 nt, Homo Sapiens
ccauuauuucaaguaauaaaucugaauucuauuaguuuaaaaauuguaaaauucaaguuaaaug

SEQ ID NO: 584414 - RNA, 64 nt, Homo Sapiens
aggauauugcagcuucagcaguguugaacuguguguuuaaaaaugugaauuacuguuauuguau

SEQ ID NO: 584415 - RNA, 64 nt, Homo Sapiens
gucuuuguuugcauuguauaacuuuaacgagugaguuuaaaauuauuuaauuuccuuagaaaaa

SEQ ID NO: 584416 - RNA, 64 nt, Homo Sapiens
uugcuguuuuucccuuuuuuuuuuaauugcuuuuguuuaaaauuugaucgccuuaacuacugua

SEQ ID NO: 584417 - RNA, 64 nt, Homo Sapiens
ucccagauaauuaacuagcuugcaauauccaaauguuuaaaaauaguauuuuauucacauuauu

SEQ ID NO: 584418 - RNA, 64 nt, Homo Sapiens
uguaaauuucuaaauccaauuagaauucuuaugaguuuaaaauuguuuccauuuucaaauuauu

SEQ ID NO: 584419 - RNA, 64 nt, Homo Sapiens
auuauuuuccagaaaguuuguuauauauguaaguguuuaaaaagugcugauucuauaagauuau

SEQ ID NO: 584420 - RNA, 64 nt, Homo Sapiens
aaauccucccuucccccuuuuugaaauagcuuuaguuuaaaaaaccuuccccuuuuuucuaaau

SEQ ID NO: 584421 - RNA, 64 nt, Homo Sapiens
uuagcaugcaaguauguugguacguuauguccugguuuaaaaaggauuaaaauuuuaaaauaau

SEQ ID NO: 584422 - RNA, 64 nt, Homo Sapiens
uuuuaaaauaauccuugcaucuaaaggccuugugguuuaaaaaaaaaaagcaaacuuuuuuuug

SEQ ID NO: 584423 - RNA, 64 nt, Homo Sapiens
auuuuuagcaaaaaagaaaaaaaaaaggcacauaguuuaaaaaguuucucauuuugugcaauau

SEQ ID NO: 584424 - RNA, 64 nt, Homo Sapiens
uuuagacuugaaagaaagagccacuuaaauucuuguuuaaaaauaccaauuugccuccuccuuc

SEQ ID NO: 584425 - RNA, 64 nt, Homo Sapiens
uauauacuguauuuucuucuaaauuaacccuaauguuuaaaaacucacuuucccccuuuaauug

SEQ ID NO: 584426 - RNA, 64 nt, Homo Sapiens
acaaauaauuacuggcaguagguuauaauuggugguuuaaaaauaacauuggaauacaggacuu

SEQ ID NO: 584427 - RNA, 64 nt, Homo Sapiens
gauuugaaaccuggaaauacaguaaaauuugacuguuuaaaauguuggccaaaaaaaucaagau

SEQ ID NO: 584428 - RNA, 64 nt, Homo Sapiens
aaagaaccugcauugcacuaggaauucuguguuaguuuaaaagagaucucuaaaacuuccccau

SEQ ID NO: 584429 - RNA, 64 nt, Homo Sapiens
agcccugauaggggaagugggaguugacaggaugguuuaaaauaagacgugaagguuucaguua

SEQ ID NO: 584430 - RNA, 64 nt, Homo Sapiens
ugcagucucauuuugauaaucauuugcuuccaguguuuaaaaauuaaaaaaagaauggggagaa

SEQ ID NO: 584431 - RNA, 64 nt, Homo Sapiens
aauuauaugagacuugccagucaaaugcuauuugguuuaaaaaaauuauugcaaucucaaguua

SEQ ID NO: 584432 - RNA, 64 nt, Homo Sapiens
aguuaauggaauauuuuuaaaucccacauucagaguuuaaaacacugguuuucaauguguuuuu

SEQ ID NO: 584433 - RNA, 64 nt, Homo Sapiens
auuauuuuuugcaucauuuaaacaugcagaagauguuuaaaaauaaaaaaaaaacugcuuuauc

SEQ ID NO: 584434 - RNA, 64 nt, Homo Sapiens
aauaacugaauaguuuacuauuucauucaagcauguuuaaaacaaauaauuuccuuucaccagu

SEQ ID NO: 584435 - RNA, 64 nt, Homo Sapiens
uauaaguugaggcauuugggcaauguuuaaaaaaguuuaaaaugacgaaguugggcaauauaac

SEQ ID NO: 584436 - RNA, 64 nt, Homo Sapiens
guuuaaaauguauaaguugagcaauauaaccaauguuuaaaaaaucuuucaauaacgaaguugg

SEQ ID NO: 584437 - RNA, 64 nt, Homo Sapiens
accauuacuuguuuuuuaaauuuuacaugguuuuguuuaaaauuaaaauauuuccacuuagaua

SEQ ID NO: 584438 - RNA, 64 nt, Homo Sapiens
caaaaaaggcaagaugggcuugcagaaaccucuuguuuaaaaaagucuggaagauggaagcuag

SEQ ID NO: 584439 - RNA, 64 nt, Homo Sapiens
uaucuugacauaagcgucauuuucaaauaaugauguuuaaaaauagggacauuuuccuguacuu

SEQ ID NO: 584440 - RNA, 64 nt, Homo Sapiens
uguuuguuguugcuguuuuuuaauaagccugcucguuuaaaaguguggcuucaaaucugaaaau

SEQ ID NO: 584441 - RNA, 64 nt, Homo Sapiens
gggagaugagaaagggaauaaguauucuacuucuguuuaaaaaggucuuuucacuaaauuguac

SEQ ID NO: 584442 - RNA, 64 nt, Homo Sapiens
aacucaauacagauaaagauacuguucuaaaaauguuuaaaagauaugaauauaaccaucuguu

SEQ ID NO: 584443 - RNA, 64 nt, Homo Sapiens
aaaacacaagucuguggcuagaaccugaugugguguuuaaaagagaagaaacacugaagauguc

SEQ ID NO: 584444 - RNA, 64 nt, Homo Sapiens
uggcaucggaaacuccccuaugcacuugaagaugguuuaaaagauuaaagaaacgauuaagaga

SEQ ID NO: 584445 - RNA, 64 nt, Homo Sapiens
uuauguaaagucccucuaagacuacauacuuuuuguuuaaaacaaaauuggaauuuguuuuccc

SEQ ID NO: 584446 - RNA, 64 nt, Homo Sapiens
guagugcguuuuauuuuauaugccaaucuacuuuguuuaaaaaaggucugaaucaggacuugug

SEQ ID NO: 584447 - RNA, 64 nt, Homo Sapiens
cagauauuccuuacauuuuucaaaacuacugcauguuuaaaacuucaacaaaaaaagagagaaa

SEQ ID NO: 584448 - RNA, 64 nt, Homo Sapiens
cacucaaaaaugcaaaaugugauaaugggcacuuguuuaaaagaauuaguguauccagccuuca

SEQ ID NO: 584449 - RNA, 64 nt, Homo Sapiens
aggccuacagaugaguaaugaaguuaucuuuuuuguuuaaaaaaaaaaaaaacacugcauuaaa

SEQ ID NO: 584450 - RNA, 64 nt, Homo Sapiens
uuuuauauuaccuauuaguuuuggaguucuuuauguuuaaaaauucagguguaaauuuuauugc

SEQ ID NO: 584451 - RNA, 64 nt, Homo Sapiens
auuuuggaaugugaaauaaucaccuaggaaguugguuuaaaaugcacacuagugagcccaccuu

SEQ ID NO: 584452 - RNA, 64 nt, Homo Sapiens
agaagaaaauuauucaaauuuggacauuuuaauuguuuaaaaauuguacaaaaggaaaaaauua

SEQ ID NO: 584453 - RNA, 64 nt, Homo Sapiens
agaauaaguacuggcgaaccaucucuguggucuuguuuaaaaagggcaaaaguuuuagacugua

SEQ ID NO: 584454 - RNA, 64 nt, Homo Sapiens
gugggauaugcuagaaaaggcauuuugggguuauguuuaaaaaaacauuauugucccacaauau

SEQ ID NO: 584455 - RNA, 64 nt, Homo Sapiens
aaaccaaauuagccagacaugguggcaugcgcuuguuuaaaaaaacaaauaaauaaauaaucga

SEQ ID NO: 584456 - RNA, 64 nt, Homo Sapiens
aacaugcuauuuuuuaaaugagauauaaaauucaguuuaaaaagcaagacugaagacauugauu

SEQ ID NO: 584457 - RNA, 64 nt, Homo Sapiens
uacagaaaugggagaaaauugugaugaaagauggguuuaaaauauuucccuauuuuguuuagua

SEQ ID NO: 584458 - RNA, 64 nt, Homo Sapiens
gcauuucugggcaaauucaaccaacauauagaguguuuaaaauauuccacaaaaaaacagcaga

SEQ ID NO: 584459 - RNA, 64 nt, Homo Sapiens
caaacaucgaaaggcuuauguguauauuucacugguuuaaaaaauauuucugucuugcgugauu

SEQ ID NO: 584460 - RNA, 64 nt, Homo Sapiens
ucacuuuuuugguuuuuauuaaaagcacuaauuaguuuaaaaugagcaaaagaucuugaaagca

SEQ ID NO: 584461 - RNA, 64 nt, Homo Sapiens
cugucauucucuggcucuucugaauucauuccaaguuuaaaaucuguaauuuagcauaauauuc

SEQ ID NO: 584462 - RNA, 64 nt, Homo Sapiens
cuuaucucuaagaugucuaugcacuggcaaaaauguuuaaaaugaagaacuugcucucagagaa

SEQ ID NO: 584463 - RNA, 64 nt, Homo Sapiens
augcucauucaacuugaaucagaccacccccaaaguuuaaaaaucuuugagaugggguggacua

SEQ ID NO: 584464 - RNA, 64 nt, Homo Sapiens
cuguguaucaaauugugcacgcacuuuucaugcuguuuaaaagauuucauuuuuaaguuaucag

SEQ ID NO: 584465 - RNA, 64 nt, Homo Sapiens
agaagcagcagaaaacuagcgaaacaugguuaaaguuuaaaacuugcagcauuccuugucauca

SEQ ID NO: 584466 - RNA, 64 nt, Homo Sapiens
caacugguaauucugaaacauauaucuacuuuguguuuaaaaaugauuagccaccauuagcauc

SEQ ID NO: 584467 - RNA, 64 nt, Homo Sapiens
aauaaauaaaaauuaaaaaaugaccucuguuauuguuuaaaaaauggagguccacaucuguggu

SEQ ID NO: 584468 - RNA, 64 nt, Homo Sapiens
caaucucaaacaaaagacuuuguuugcuaccuuaguuuaaaaaaacugccauuacauggcaaaa

SEQ ID NO: 584469 - RNA, 64 nt, Homo Sapiens
augcucuguaacucuguacuaccugcaacuaaguguuuaaaauugaaacauaccauacuuauau

SEQ ID NO: 584470 - RNA, 64 nt, Homo Sapiens
ugaacagugccuagugaaguuuuuauugucucuuguuuaaaaaguauuguuugugggcaauauu

SEQ ID NO: 584471 - RNA, 64 nt, Homo Sapiens
ugaaucuagguagcaugaacaaauuauaaaauuuguuuaaaaaagcaaacuugcaugcauuauu

SEQ ID NO: 584472 - RNA, 64 nt, Homo Sapiens
aaaagcaaacuugcaugcauuauugugacuucaaguuuaaaaaaucgucuuacauguguacaau

SEQ ID NO: 584473 - RNA, 64 nt, Homo Sapiens
uuuuuaaacuuuauuuucauaauuucugcuuaauguuuaaaauugaagagccuuuucauguauu

SEQ ID NO: 584474 - RNA, 64 nt, Homo Sapiens
gguuuuuaacaagcuguuuguucaucuauauuuaguuuaaaauagguaguauuaucuuucugua

SEQ ID NO: 584475 - RNA, 64 nt, Homo Sapiens
aguaguuuaaucauuggucuuuucaaaacuagguguuuaaaaaaagagacauauaugauauugc

SEQ ID NO: 584476 - RNA, 64 nt, Homo Sapiens
agauggcuguuugcaggaaggcagacgagacaguguuuaaaaaguccacaagaaugaucaagua

SEQ ID NO: 584477 - RNA, 64 nt, Homo Sapiens
uguuuuuauucuuacagacaucacccguguucaaguuuaaaaguacacuuugcaacuauuuuuc

SEQ ID NO: 584478 - RNA, 64 nt, Homo Sapiens
ggauuucaauguaagcaaauaaaggauuuuuuuuguuuaaaacucuuaacaacugaaccauuca

SEQ ID NO: 584479 - RNA, 64 nt, Homo Sapiens
uugcacaaaguacuuuaaagacagaaugauggauguuuaaaauacugugacaaucauuuugcug

SEQ ID NO: 584480 - RNA, 64 nt, Homo Sapiens
cuaauaaugucucauuuccaaaaugcuauuguuuguuuaaaaucuugcuuccuacuuuaugucu

SEQ ID NO: 584481 - RNA, 64 nt, Homo Sapiens
uggaaggaaauacuacucaucagcuucugaaaauguuuaaaaauuauugacugggguuugaucu

SEQ ID NO: 584482 - RNA, 64 nt, Homo Sapiens
uuucuuacuuaacuuuugcaguacuuuaagccuuguuuaaaacaaaauuuuauaauugacuuga

SEQ ID NO: 584483 - RNA, 64 nt, Homo Sapiens
agcucacuuuaaagcuaguuaauauuuuuaugaaguuuaaaaauuucaaacuaauaaaaucaug

SEQ ID NO: 584484 - RNA, 64 nt, Homo Sapiens
ucaauauuuuaaauguccggauaauauucuagagguuuaaaaaauggaaauauuugaacuuucu

SEQ ID NO: 584485 - RNA, 64 nt, Homo Sapiens
gagacuuucauucuuuaaauauuauugacuuacaguuuaaaaauaaauaaauaaaagcauacua

SEQ ID NO: 584486 - RNA, 64 nt, Homo Sapiens
uggaaaauuugacaauuuugauucucacugguauguuuaaaaacugaauaaaaggaauagaauu

SEQ ID NO: 584487 - RNA, 64 nt, Homo Sapiens
cuucuauuuaucuuugauuucagucuuggcaauuguuuaaaaaaaaaaucuagauuuguuuuau

SEQ ID NO: 584488 - RNA, 64 nt, Homo Sapiens
uuuuuguaacaauaauuuuuuagauaaaauuaauguuuaaaauguaguaauaguaugaaaauac

SEQ ID NO: 584489 - RNA, 64 nt, Homo Sapiens
acuuaggauuaaauaaauaaagcaugauagcaguguuuaaaaaucagccagaauuaggugaagu

SEQ ID NO: 584490 - RNA, 64 nt, Homo Sapiens
uugcuuaagacaauugcauccugcgaaacaauuuguuuaaaaaccuggcagaauggcagaguag

SEQ ID NO: 584491 - RNA, 64 nt, Homo Sapiens
uuucagauggccuaguuucacauucauauaaacuguuuaaaauuauaguuuguguuaagcaugu

SEQ ID NO: 584492 - RNA, 64 nt, Homo Sapiens
uuuauaacagggcggcugguuaauaucucacacaguuuaaaaaaucagccccuaauuucuccau

SEQ ID NO: 584493 - RNA, 64 nt, Homo Sapiens
ugauagcauauguguucagguuuauagcuguuguguuuaaaaauugaaaaaaguggaaaacauc

SEQ ID NO: 584494 - RNA, 64 nt, Homo Sapiens
ucuggcuucaaaguuucuugcaagugccuuaauuguuuaaaaucguacauauacuuaauguuuu

SEQ ID NO: 584495 - RNA, 64 nt, Homo Sapiens
ggcuuuugcuuuucuaggucagaggcuuuaaguaguuuaaaauguugacucauuggacuagugc

SEQ ID NO: 584496 - RNA, 64 nt, Homo Sapiens
uuauauuaaauuuauuaaaaugaaauaaguaucaguuuaaaaaucaaaaguuuuuuucaagaau

SEQ ID NO: 584497 - RNA, 64 nt, Homo Sapiens
caaaauuggaucaagacauuaaaauuuuaauuaaguuuaaaauauuuuucaacagaaggcuauc

SEQ ID NO: 584498 - RNA, 64 nt, Homo Sapiens
uuaaacuugucuuuuuccuccuucuguggacacaguuuaaaaucaaagauuuagauuguuuauu

SEQ ID NO: 584499 - RNA, 64 nt, Homo Sapiens
aaauugagguuguucaaagucuaguacuuuauuaguuuaaaaagcugauuucacauauugcaac

SEQ ID NO: 584500 - RNA, 64 nt, Homo Sapiens
aaccaaauuuuaauuuuugcuuuuagaaaagggaguuuaaaaaugguaucaaaauuacauauac

SEQ ID NO: 584501 - RNA, 64 nt, Homo Sapiens
uuaaucacccuaccaacuuuacuguccuaacaugguuuaaaagaaaaaaugacaccaucuuuua

SEQ ID NO: 584502 - RNA, 64 nt, Homo Sapiens
ugauucuguaacuuuuuuauaagcacuucuggugguuuaaaaugguucuaggucaguuauaccc

SEQ ID NO: 584503 - RNA, 64 nt, Homo Sapiens
uuucucauuuauuuuuucuguaauuuuuuuucagguuuaaaauugcccaguaguaacuuagguu

SEQ ID NO: 584504 - RNA, 64 nt, Homo Sapiens
aaaaaaaacacacacgaaaaacaaaaguuugcuuguuuaaaaugacaguugugauguaaaaagu

SEQ ID NO: 584505 - RNA, 64 nt, Homo Sapiens
gaacuguuuaugauaccaaaaaaauuacaguuuuguuuaaaaggaaauguugauguuuucaacu

SEQ ID NO: 584506 - RNA, 64 nt, Homo Sapiens
ggagacagcuaaucucucuagggacuauuuggugguuuaaaaaaagggucagacuuuuaaacac

SEQ ID NO: 584507 - RNA, 64 nt, Homo Sapiens
gaagaaagcaagcagaaauaguaaaauucaguagguuuaaaacaaucuauaaauguauuuuauu

SEQ ID NO: 584508 - RNA, 64 nt, Homo Sapiens
aagauuuuuuuauuuguauuaaugaaaagcuuuaguuuaaaauaaggagauccagaauaaaaag

SEQ ID NO: 584509 - RNA, 64 nt, Homo Sapiens
cuccauuuagacauaggucaauuaaaauauuuggguuuaaaaugacuaaaugcuuuaaacauau

SEQ ID NO: 584510 - RNA, 64 nt, Homo Sapiens
uauuaauuuguaccuuaagcauuuuccauacugaguuuaaaauuugcuuuaauuuauuaaaugu

SEQ ID NO: 584511 - RNA, 64 nt, Homo Sapiens
cugaaccuuuugcugauguguaaagucuacauuuguuuaaaacagcacuuuguacaguacaaaa

SEQ ID NO: 584512 - RNA, 64 nt, Homo Sapiens
aggacuuuuauuauuuuucaaccaaaacucagugguuuaaaacaaucacugcauaacaaaccac

SEQ ID NO: 584513 - RNA, 64 nt, Homo Sapiens
aaaaauauuuauuguguacuauguacaauucaguguuuaaaaauucucauguuuuauaugaaag

SEQ ID NO: 584514 - RNA, 64 nt, Homo Sapiens
auaaauguugacuuaaucagcauaguaaacugauguuuaaaauuccauacuucaugcccacacu

SEQ ID NO: 584515 - RNA, 64 nt, Homo Sapiens
ugaaauugcaucgaggguaagacuguguccacagguuuaaaauucucucuucugaguaauagug

SEQ ID NO: 584516 - RNA, 64 nt, Homo Sapiens
aauguauuuaaacaauuuccgaugcccaugaugaguuuaaaaaccagcauugacaccaucccca

SEQ ID NO: 584517 - RNA, 64 nt, Homo Sapiens
ccucuacgauuuuuaaguaaguuggggaccaucaguuuaaaauaaaugcaauacuauuucauga

SEQ ID NO: 584518 - RNA, 64 nt, Homo Sapiens
uuccccccauguaauuauugcguuauuguuggugguuuaaaaaaagugaguggauuuuauuuuu

SEQ ID NO: 584519 - RNA, 64 nt, Homo Sapiens
ccaacauuccucugcuucauuuuuaucugcuucuguuuaaaaagggaguccugcaucuuuuuuu

SEQ ID NO: 584520 - RNA, 64 nt, Homo Sapiens
uuggauagauuugucaaaacgacauuuaagucauguuuaaaaagucauuugggcaguucuggaa

SEQ ID NO: 584521 - RNA, 64 nt, Homo Sapiens
aaauuguccaaucuggugaaugucuaacccuaaaguuuaaaaauuucugccuccuaaguuuaug

SEQ ID NO: 584522 - RNA, 64 nt, Homo Sapiens
aaaaggaauccauaccaugaaagaaaaaaagauuguuuaaaaaauacauuuaagaaaaaaaaaa

SEQ ID NO: 584523 - RNA, 64 nt, Homo Sapiens
auucaauuacaaaagcggcaccuguuuguuugagguuuaaaacagccugagugacagcggcagu

SEQ ID NO: 584524 - RNA, 64 nt, Homo Sapiens
uacuuauaauuaaucacuaguguccaauuggauuguuuaaaaacaguauugugaauacaaugua

SEQ ID NO: 584525 - RNA, 64 nt, Homo Sapiens
caggaaauuucuacaaucaucucacugaguuuuuguuuaaaaacgugagagggcagucauucuu

SEQ ID NO: 584526 - RNA, 64 nt, Homo Sapiens
uccuguggcaccaaccaguggugcucauucuauuguuuaaaaauggccuucuuggcugggcgcg

SEQ ID NO: 584527 - RNA, 64 nt, Homo Sapiens
uaugagguuuccuaaauaaaugaggaguagcauaguuuaaaauauauauaucuuauaacuuucu

SEQ ID NO: 584528 - RNA, 64 nt, Homo Sapiens
augacaagauguaaaauaauauguuuuucaugcaguuuaaaauauuacuaacuuaaggguuucu

SEQ ID NO: 584529 - RNA, 64 nt, Homo Sapiens
ccuucuuugauguugacaucaaauaaaguaugugguuuaaaaaaaucuccaaauaccuuuuuuu

SEQ ID NO: 584530 - RNA, 64 nt, Homo Sapiens
aaaaaugaagcuuauauuaauuguugcuucaauaguuuaaaaaauuuauggagauagguagguc

SEQ ID NO: 584531 - RNA, 64 nt, Homo Sapiens
gccuguucugaaacuuauaggaaauuggaauuuuguuuaaaauuuuacacuuuaagguagcaaa

SEQ ID NO: 584532 - RNA, 64 nt, Homo Sapiens
acaugaggaccaaaccaugcacauaaagcuuguaguuuaaaaaagaaaagcaaaaaaauaauua

SEQ ID NO: 584533 - RNA, 64 nt, Homo Sapiens
acaggauuuuuugaugcuuugcucuaauggaacuguuuaaaaaauuuuuuuuucuuuuuaauau

SEQ ID NO: 584534 - RNA, 64 nt, Homo Sapiens
uacugaaugcaaucuagauguugugaagaaugcaguuuaaaauauguagaacauuugauucaca

SEQ ID NO: 584535 - RNA, 64 nt, Homo Sapiens
auacaucagcauacagacuggugccaggaaaacaguuuaaaauuuuaugcuuggcaugaauaag

SEQ ID NO: 584536 - RNA, 64 nt, Homo Sapiens
aauauuguuuucaucacugauauuaauagaguauguuuaaaauaauuguuaauuuaaggauaua

SEQ ID NO: 584537 - RNA, 64 nt, Homo Sapiens
caaggacuguuccugauuaguacauuuucaugaaguuuaaaaauaacagaauggaauaucagag

SEQ ID NO: 584538 - RNA, 64 nt, Homo Sapiens
uaaaggcauuuuggguuuuauguuucuuuaaucaguuuaaaagauucugccuuccaagaguaua

SEQ ID NO: 584539 - RNA, 64 nt, Homo Sapiens
gaauucagccuguuucuaaaagcugaaaaucucaguuuaaaaaucaaaauguuaacacaaagcu

SEQ ID NO: 584540 - RNA, 64 nt, Homo Sapiens
uguccucuguucuuccaguucacgagggcaggggguuuaaaacaagaaugauaggccaggaagg

SEQ ID NO: 584541 - RNA, 64 nt, Homo Sapiens
aaaagacaacccacccccuggguagggaaagcagguuuaaaauaucuucaugacaagaguauuu

SEQ ID NO: 584542 - RNA, 64 nt, Homo Sapiens
aucacuuuuuugucuuugggccauuuuucccauuguuuaaaaccccaaguaccuguuuucauuc

SEQ ID NO: 584543 - RNA, 64 nt, Homo Sapiens
uacuguacaggaaagucacaugucuugccacaauguuuaaaaauucugauuagaugaucauugg

SEQ ID NO: 584544 - RNA, 64 nt, Homo Sapiens
aguggccccucccugcuuuugauuguugugaaacguuuaaaagcgaggcuagaaguaucaucug

SEQ ID NO: 584545 - RNA, 64 nt, Homo Sapiens
aauucauguucaaaggagcuuugcuagacuguaaguuuaaaaacuguuuuaaaaauuaggcuua

SEQ ID NO: 584546 - RNA, 64 nt, Homo Sapiens
cuauuuucagauuauaaaagcacauuaaaggaagguuuaaaaauacacauuaaagagaaaauuu

SEQ ID NO: 584547 - RNA, 64 nt, Homo Sapiens
uuuugguuauaggcaugaauuauuaagcuguuuuguuuaaaagcuugcuuaccugaccacuuuu

SEQ ID NO: 584548 - RNA, 64 nt, Homo Sapiens
acuaaaacguucuuucaaaauuuuuuuaaacucaguuuaaaaaguuaaaaauugcauuguuauu

SEQ ID NO: 584549 - RNA, 64 nt, Homo Sapiens
ugcauuguuauuuuuuuuuaguuuucaaaacaguguuuaaaaauguauauugcugcacuuuuaa

SEQ ID NO: 584550 - RNA, 64 nt, Homo Sapiens
aaaaaaaaacuacuucaucugaauaaacagauaaguuuaaaaaaaaacaagaaacuugguuauu

SEQ ID NO: 584551 - RNA, 64 nt, Homo Sapiens
gaucagaaauggcaagcccuugugaaggcauggaguuuaaaauuggaaugcaaaaauuagcaga

SEQ ID NO: 584552 - RNA, 64 nt, Homo Sapiens
agguuuauaucuuguuuuaccuuggcucauuaguguuuaaaaauguacugaugaugugcuuaga

SEQ ID NO: 584553 - RNA, 64 nt, Homo Sapiens
uaaaauauaugaaaauaugugcaaaguuaugagaguuuaaaaaacaauauuuuacugcuagcuu

SEQ ID NO: 584554 - RNA, 64 nt, Homo Sapiens
uauucuaucuuaaggccaacguuggaucuauuugguuuaaaaaggugugauauuuuccagauuu

SEQ ID NO: 584555 - RNA, 64 nt, Homo Sapiens
aauuuauuguuugagggaaauacgagguuucauuguuuaaaaucaagaguguauuguuuacugu

SEQ ID NO: 584556 - RNA, 64 nt, Homo Sapiens
guuucugagucauuugggaccaacugcagugguuguuuaaaaugcugguuccugcacacaauuc

SEQ ID NO: 584557 - RNA, 64 nt, Homo Sapiens
gaauucugguuagcuaauugaacuuuugugaccuguuuaaaaacaaaucaaauuuauugaacaa

SEQ ID NO: 584558 - RNA, 64 nt, Homo Sapiens
auauuuaucuuucaguuuauuugaaagaggucugguuuaaaauuuguagccuacauuuguuuua

SEQ ID NO: 584559 - RNA, 64 nt, Homo Sapiens
cucaaaacgauuuggucagguucugguuggacaaguuuaaaaucaaaguagugcccggaauucc

SEQ ID NO: 584560 - RNA, 64 nt, Homo Sapiens
agucacuuacuucauauccucagugguauugcuaguuuaaaauguuaaucuuugaaaacucaua

SEQ ID NO: 584561 - RNA, 64 nt, Homo Sapiens
cagaaagacauucuuaguuaaguuagauguuuuaguuuaaaaauaugugucuuguauuaucaua

SEQ ID NO: 584562 - RNA, 64 nt, Homo Sapiens
aagaaauggugggaaggaaaauauaaauccuguaguuuaaaaggcugaaauaaaacauuuuaaa

SEQ ID NO: 584563 - RNA, 64 nt, Homo Sapiens
guaucuuaaagagucauuuuuuucuagcccauggguuuaaaacugcuaauuaacagucguauga

SEQ ID NO: 584564 - RNA, 64 nt, Homo Sapiens
caaaguauauuuuauuuuaucuuuacugagcaaaguuuaaaaaaguuacuugagcuuaaaugua

SEQ ID NO: 584565 - RNA, 64 nt, Homo Sapiens
uuuaaagagaaauugcauuauauauauuaaaaacguuuaaaaguagaaacuguaacauaucucu

SEQ ID NO: 584566 - RNA, 64 nt, Homo Sapiens
cuugauguugccuaccuuauugugguaucguggaguuuaaaagaucaaguuaggaugcugacuu

SEQ ID NO: 584567 - RNA, 64 nt, Homo Sapiens
aaagagcaugguucucaggaaaaccaguuccccaguuuaaaaaaaaaaaaaaaaauuccuugua

SEQ ID NO: 584568 - RNA, 64 nt, Homo Sapiens
cuuucuaauaaaugcagaaucugaagguaaauagguuuaaaacaaaacaaaaacccaccccuuu

SEQ ID NO: 584569 - RNA, 64 nt, Homo Sapiens
uagaggccccucgugcuaccaacacuuacccuguguuuaaaaagaucuuguaccaagccaacgg

SEQ ID NO: 584570 - RNA, 64 nt, Homo Sapiens
uuagcagauagcugcuucgauaaaggaauuuggaguuuaaaaaucaacuugugaaaacaagguu

SEQ ID NO: 584571 - RNA, 64 nt, Homo Sapiens
ucucaugguggauuugugacugugagaguuuccgguuuaaaaucugaaaagccagauaugccug

SEQ ID NO: 584572 - RNA, 64 nt, Homo Sapiens
gcaguuugcaaaaaauguuuaaagcaaaucauuuguuuaaaaagaugcacaguauuuguaauua

SEQ ID NO: 584573 - RNA, 64 nt, Homo Sapiens
ucaguuucacagaaaauaagauuuucuggccaguguuuaaaacuuguugaaauggcaaucaaac

SEQ ID NO: 584574 - RNA, 64 nt, Homo Sapiens
auccaguauuaaguucuuagucauugauuuuuguguuuaaaaaaaaauaggaaagagggaaacu

SEQ ID NO: 584575 - RNA, 64 nt, Homo Sapiens
auuugaaugguacaguagauguaaaaaaaauucaguuuaaaagaacauuuguuuuuacauuaaa

SEQ ID NO: 584576 - RNA, 64 nt, Homo Sapiens
uaacaagccagcuggcuuaugcugguucucagcuguuuaaaaaaaaaaaaaaaaaggaauagaa

SEQ ID NO: 584577 - RNA, 64 nt, Homo Sapiens
acugugaucugggaacuuuuugcuguacaaaucuguuuaaaaaaaaaaaaaaguaacucauuga

SEQ ID NO: 584578 - RNA, 64 nt, Homo Sapiens
aaaacucugcuagucuuggcauuucauacagaauguuuaaaagacccgucccccagucugacau

SEQ ID NO: 584579 - RNA, 64 nt, Homo Sapiens
aaaacaaugaauuagaagagagcuugugcacaauguuuaaaagaaugcuuucuaugugaauaua

SEQ ID NO: 584580 - RNA, 64 nt, Homo Sapiens
guaaaucaguaagucacuucgaaaggggggguuuguuuaaaauagaugguaaacauuuaaaggg

SEQ ID NO: 584581 - RNA, 64 nt, Homo Sapiens
cuuuaauuuacaaauuaaauuaauugguucauauguuuaaaagaccccuuuaaacuaauauuca

SEQ ID NO: 584582 - RNA, 64 nt, Homo Sapiens
aagacaaaaaaaaaaaagccauuuauaaaacuuaguuuaaaaaaacacagaguuaucagacauu

SEQ ID NO: 584583 - RNA, 64 nt, Homo Sapiens
uaaagaaaaaagagcugcaguaaauuaauuauauguuuaaaaguaguuccuuuuacaaaguuau

SEQ ID NO: 584584 - RNA, 64 nt, Homo Sapiens
auucaaauacauaccuuauuuuaugcaauaaauuguuuaaaaugcaaggugguuauucugcaua

SEQ ID NO: 584585 - RNA, 64 nt, Homo Sapiens
aaggucuucgaggcuggggcucuguaaugaauuaguuuaaaagccaaggucauaacaugaauug

SEQ ID NO: 584586 - RNA, 64 nt, Homo Sapiens
caagcaauaggggguugaaguguuuaucugauuuguuuaaaauuuuguauaucaccaaauuuuu

SEQ ID NO: 584587 - RNA, 64 nt, Homo Sapiens
uuuuaucugagaauuucucaguaugaaaaugauuguuuaaaauuuccccucuuuuugucagugc

SEQ ID NO: 584588 - RNA, 64 nt, Homo Sapiens
ugaguuaauuuuaccaagaguaacuuuacucuguguuuaaaaaguaaguuaauaauguauugua

SEQ ID NO: 584589 - RNA, 64 nt, Homo Sapiens
gguauaauguuuaaaucauguauguuaugauauuguuuaaaauucaguuuuuguaucuuggggc

SEQ ID NO: 584590 - RNA, 64 nt, Homo Sapiens
aaucgaagagcuaaaaaauaugugacucacucauguuuaaaaaaaaauuuaagagcaguuacag

SEQ ID NO: 584591 - RNA, 64 nt, Homo Sapiens
aaguucgguuaacaaggaagcagcaaacaugucaguuuaaaaaucaaaagguaauaucaaccgu

SEQ ID NO: 584592 - RNA, 64 nt, Homo Sapiens
guaaauaaauuaaacuuuucaauuuguguaauuuguuuaaaauuugaggaaauaguuccugucc

SEQ ID NO: 584593 - RNA, 64 nt, Homo Sapiens
uaaacaagaaauauugaguacacuuuaagugauaguuuaaaaaaauaucacauuauuauguauu

SEQ ID NO: 584594 - RNA, 64 nt, Homo Sapiens
ucuugauauuuucacaaauucaauuauaaagauuguuuaaaauauauucuuuuuugaaaauuag

SEQ ID NO: 584595 - RNA, 64 nt, Homo Sapiens
uagauguguugcaguuuugcaaugugugcaaauuguuuaaaaauguauauaugugauauaaauu

SEQ ID NO: 584596 - RNA, 64 nt, Homo Sapiens
cucgagacgucauuucuguuugacuacuccagcaguuuaaaaccccaucucccugcccuuuugu

SEQ ID NO: 584597 - RNA, 64 nt, Homo Sapiens
cucaagaauuagaaaacuuugcaagauuugacuuguuuaaaaaucacauuuauaagugaaccgu

SEQ ID NO: 584598 - RNA, 64 nt, Homo Sapiens
aaaaccaaaauuauagacuauucaauaauaaaauguuuaaaauccuuuuguauguguuugaaau

SEQ ID NO: 584599 - RNA, 64 nt, Homo Sapiens
aauuagaaacuaucaaaaauguugucugaccacaguuuaaaauugcaaaaggcuuacaaucccu

SEQ ID NO: 584600 - RNA, 64 nt, Homo Sapiens
cugaauuucauauguucuaaaaugacuagcaaugguuuaaaaaggaagaagaguggaagugaag

SEQ ID NO: 584601 - RNA, 64 nt, Homo Sapiens
agaaugucauuaguaaaaauucuaacuucguuuuguuuaaaagacauguggaugcuccaugccc

SEQ ID NO: 584602 - RNA, 64 nt, Homo Sapiens
auuauugcuugcuacuuggaauuuaaccauguugguuuaaaaauugauuucuacaaaucuuaac

SEQ ID NO: 584603 - RNA, 64 nt, Homo Sapiens
augugaauaaauauuuugauuagcuucaacuuuaguuuaaaauucauuaccacggaagauauau

SEQ ID NO: 584604 - RNA, 64 nt, Homo Sapiens
aucagaaaggaaaaacaaacccuguucuuuaagaguuuaaaaucuucuucuuaccagaugcuuu

SEQ ID NO: 584605 - RNA, 64 nt, Homo Sapiens
acgacaguggaugcugggucugucccaggaaucaguuuaaaagcgcuguuccagugguaagcua

SEQ ID NO: 584606 - RNA, 64 nt, Homo Sapiens
ccacauggcacagagauucuccaacaaucuuccuguuuaaaaaaucuaucuuaauacuaaggaa

SEQ ID NO: 584607 - RNA, 64 nt, Homo Sapiens
uaauaauuuaccaggaagcagaggagagcuacuuguuuaaaaauccacauucuuggacccaauc

SEQ ID NO: 584608 - RNA, 64 nt, Homo Sapiens
cauuccuaugauuguuacuaaaauguauuuucauguuuaaaauguuuuuggauauuuuuggguu

SEQ ID NO: 584609 - RNA, 64 nt, Homo Sapiens
aacaucuaguuuuagaagggaaacaguugaaacuguuuaaaaauagaugugccuuauuuauugc

SEQ ID NO: 584610 - RNA, 64 nt, Homo Sapiens
ugacgcuuuuuagcuaaauauauacucuucucuaguuuaaaacauuugaacuugccuaguuagu

SEQ ID NO: 584611 - RNA, 64 nt, Homo Sapiens
uucuuagagaauaguuauauuuucuauuacacaaguuuaaaaauauuauuaacuuguauuuucu

SEQ ID NO: 584612 - RNA, 64 nt, Homo Sapiens
gaggacuguaguuuaauacuuuuuacccaaauauguuuaaaaacuucgugcauuuguuacagcu

SEQ ID NO: 584613 - RNA, 64 nt, Homo Sapiens
ugagguuucagaaauauauugaaaguuuaacaauguuuaaaaauagaaaagcaugaguguucau

SEQ ID NO: 584614 - RNA, 64 nt, Homo Sapiens
aaacuucauuuuauguccuuucacaaauaaauuaguuuaaaacagaaaguggcuacuugccauu

SEQ ID NO: 584615 - RNA, 64 nt, Homo Sapiens
aacucauuuugcgaggcuuaggcagcuagacaucguuuaaaacaaaauauuaacuuauauuaca

SEQ ID NO: 584616 - RNA, 64 nt, Homo Sapiens
gauuuucuugacucugagcuagcuggguauuuggguuuaaaauauagccacaaacuggacaaga

SEQ ID NO: 584617 - RNA, 64 nt, Homo Sapiens
uuaaacuuuuucuaccuucugauauuuaagagauguuuaaaauuaagaacaggacucauaucuu

SEQ ID NO: 584618 - RNA, 64 nt, Homo Sapiens; identical to SEQ ID NO: 312521

SEQ ID NO: 584619 - RNA, 64 nt, Homo Sapiens; identical to SEQ ID NO: 312522

SEQ ID NO: 584620 - RNA, 64 nt, Homo Sapiens; identical to SEQ ID NO: 312523

SEQ ID NO: 584621 - RNA, 64 nt, Homo Sapiens; identical to SEQ ID NO: 312524

SEQ ID NO: 584622 - RNA, 64 nt, Homo Sapiens; identical to SEQ ID NO: 312525

SEQ ID NO: 584623 - RNA, 64 nt, Homo Sapiens; identical to SEQ ID NO: 312526

SEQ ID NO: 584624 - RNA, 64 nt, Homo Sapiens; identical to SEQ ID NO: 312527

SEQ ID NO: 584625 - RNA, 64 nt, Homo Sapiens; identical to SEQ ID NO: 312528

SEQ ID NO: 584626 - RNA, 64 nt, Homo Sapiens; identical to SEQ ID NO: 312529

SEQ ID NO: 584627 - RNA, 64 nt, Homo Sapiens; identical to SEQ ID NO: 312530

SEQ ID NO: 584628 - RNA, 64 nt, Homo Sapiens; identical to SEQ ID NO: 312531

SEQ ID NO: 584629 - RNA, 64 nt, Homo Sapiens; identical to SEQ ID NO: 312532

SEQ ID NO: 584630 - RNA, 64 nt, Homo Sapiens; identical to SEQ ID NO: 312533

SEQ ID NO: 584631 - RNA, 64 nt, Homo Sapiens; identical to SEQ ID NO: 312534

SEQ ID NO: 584632 - RNA, 64 nt, Homo Sapiens; identical to SEQ ID NO: 312535

SEQ ID NO: 584633 - RNA, 64 nt, Homo Sapiens; identical to SEQ ID NO: 312536

SEQ ID NO: 584634 - RNA, 64 nt, Homo Sapiens; identical to SEQ ID NO: 312537

SEQ ID NO: 584635 - RNA, 64 nt, Homo Sapiens; identical to SEQ ID NO: 312538

SEQ ID NO: 584636 - RNA, 64 nt, Homo Sapiens; identical to SEQ ID NO: 312539

SEQ ID NO: 584637 - RNA, 64 nt, Homo Sapiens; identical to SEQ ID NO: 312540

SEQ ID NO: 584638 - RNA, 64 nt, Homo Sapiens; identical to SEQ ID NO: 312541

SEQ ID NO: 584639 - RNA, 64 nt, Homo Sapiens; identical to SEQ ID NO: 312542

SEQ ID NO: 584640 - RNA, 64 nt, Homo Sapiens; identical to SEQ ID NO: 312543

SEQ ID NO: 584641 - RNA, 64 nt, Homo Sapiens; identical to SEQ ID NO: 312544

SEQ ID NO: 584642 - RNA, 64 nt, Homo Sapiens; identical to SEQ ID NO: 312545

SEQ ID NO: 584643 - RNA, 64 nt, Homo Sapiens; identical to SEQ ID NO: 312546

SEQ ID NO: 584644 - RNA, 64 nt, Homo Sapiens; identical to SEQ ID NO: 312547

SEQ ID NO: 584645 - RNA, 64 nt, Homo Sapiens; identical to SEQ ID NO: 312548

SEQ ID NO: 584646 - RNA, 64 nt, Homo Sapiens; identical to SEQ ID NO: 312549

SEQ ID NO: 584647 - RNA, 64 nt, Homo Sapiens; identical to SEQ ID NO: 312550

SEQ ID NO: 584648 - RNA, 64 nt, Homo Sapiens; identical to SEQ ID NO: 312551

SEQ ID NO: 584649 - RNA, 64 nt, Homo Sapiens; identical to SEQ ID NO: 312552

SEQ ID NO: 584650 - RNA, 64 nt, Homo Sapiens; identical to SEQ ID NO: 312553

SEQ ID NO: 584651 - RNA, 64 nt, Homo Sapiens; identical to SEQ ID NO: 312554

SEQ ID NO: 584652 - RNA, 64 nt, Homo Sapiens; identical to SEQ ID NO: 312555

SEQ ID NO: 584653 - RNA, 64 nt, Homo Sapiens; identical to SEQ ID NO: 312556

SEQ ID NO: 584654 - RNA, 64 nt, Homo Sapiens; identical to SEQ ID NO: 312557

SEQ ID NO: 584655 - RNA, 64 nt, Homo Sapiens; identical to SEQ ID NO: 312558

SEQ ID NO: 584656 - RNA, 64 nt, Homo Sapiens; identical to SEQ ID NO: 312559

SEQ ID NO: 584657 - RNA, 64 nt, Homo Sapiens; identical to SEQ ID NO: 312560

SEQ ID NO: 584658 - RNA, 64 nt, Homo Sapiens; identical to SEQ ID NO: 312561

SEQ ID NO: 584659 - RNA, 64 nt, Homo Sapiens; identical to SEQ ID NO: 312562

SEQ ID NO: 584660 - RNA, 64 nt, Homo Sapiens; identical to SEQ ID NO: 312563

SEQ ID NO: 584661 - RNA, 64 nt, Homo Sapiens; identical to SEQ ID NO: 312564

SEQ ID NO: 584662 - RNA, 64 nt, Homo Sapiens; identical to SEQ ID NO: 312565

SEQ ID NO: 584663 - RNA, 64 nt, Homo Sapiens; identical to SEQ ID NO: 312566

SEQ ID NO: 584664 - RNA, 64 nt, Homo Sapiens; identical to SEQ ID NO: 312567

SEQ ID NO: 584665 - RNA, 64 nt, Homo Sapiens; identical to SEQ ID NO: 312568

SEQ ID NO: 584666 - RNA, 64 nt, Homo Sapiens
auagugucagacggaaguuauaaucaucuuggaggaaccauaagaaaagguguccaggguaucu

SEQ ID NO: 584667 - RNA, 64 nt, Homo Sapiens
ucuaucccauagaacacucuuuuuuaucuucccugaaccauauugaugagauaaauagggcugg

SEQ ID NO: 584668 - RNA, 64 nt, Homo Sapiens
gaugagauaaauagggcugguuuuuaucuucccugaaccauauuucuaucccauagaacacucu

SEQ ID NO: 584669 - RNA, 64 nt, Homo Sapiens
aaaaaguguccaggguaucuuaaucaucuuggaggaaccauaagauagugucagacggaaguua

SEQ ID NO: 584670 - RNA, 64 nt, Homo Sapiens; identical to SEQ ID NO: 199847

SEQ ID NO: 584671 - RNA, 64 nt, Homo Sapiens; identical to SEQ ID NO: 199848

SEQ ID NO: 584672 - RNA, 64 nt, Homo Sapiens; identical to SEQ ID NO: 199849

SEQ ID NO: 584673 - RNA, 64 nt, Homo Sapiens; identical to SEQ ID NO: 199850

SEQ ID NO: 584674 - RNA, 64 nt, Homo Sapiens; identical to SEQ ID NO: 199851

SEQ ID NO: 584675 - RNA, 64 nt, Homo Sapiens; identical to SEQ ID NO: 199852

SEQ ID NO: 584676 - RNA, 64 nt, Homo Sapiens; identical to SEQ ID NO: 199853

SEQ ID NO: 584677 - RNA, 64 nt, Homo Sapiens; identical to SEQ ID NO: 199854

SEQ ID NO: 584678 - RNA, 55 nt, Homo Sapiens; identical to SEQ ID NO: 199855

SEQ ID NO: 584679 - RNA, 64 nt, Homo Sapiens; identical to SEQ ID NO: 199856

SEQ ID NO: 584680 - RNA, 64 nt, Homo Sapiens; identical to SEQ ID NO: 199857

SEQ ID NO: 584681 - RNA, 64 nt, Homo Sapiens; identical to SEQ ID NO: 199858

SEQ ID NO: 584682 - RNA, 64 nt, Homo Sapiens; identical to SEQ ID NO: 199859

SEQ ID NO: 584683 - RNA, 64 nt, Homo Sapiens; identical to SEQ ID NO: 199860

SEQ ID NO: 584684 - RNA, 64 nt, Homo Sapiens; identical to SEQ ID NO: 199861

SEQ ID NO: 584685 - RNA, 64 nt, Homo Sapiens; identical to SEQ ID NO: 199862

SEQ ID NO: 584686 - RNA, 64 nt, Homo Sapiens; identical to SEQ ID NO: 199863

SEQ ID NO: 584687 - RNA, 64 nt, Homo Sapiens; identical to SEQ ID NO: 199864

SEQ ID NO: 584688 - RNA, 64 nt, Homo Sapiens; identical to SEQ ID NO: 199865

SEQ ID NO: 584689 - RNA, 64 nt, Homo Sapiens; identical to SEQ ID NO: 199866

SEQ ID NO: 584690 - RNA, 64 nt, Homo Sapiens
uuaucuuuguucccaaggcaucuaaauagaugcccuaguccacugccagggcuuacuccaggaa

SEQ ID NO: 584691 - RNA, 64 nt, Homo Sapiens
uacgauucucacugacuccccuauuuccccucaucuaguccauugugauaaagaagggcccauc

SEQ ID NO: 584692 - RNA, 64 nt, Homo Sapiens; identical to SEQ ID NO: 266386

SEQ ID NO: 584693 - RNA, 64 nt, Homo Sapiens; identical to SEQ ID NO: 266387

SEQ ID NO: 584694 - RNA, 64 nt, Homo Sapiens; identical to SEQ ID NO: 266388

SEQ ID NO: 584695 - RNA, 64 nt, Homo Sapiens; identical to SEQ ID NO: 266389

SEQ ID NO: 584696 - RNA, 64 nt, Homo Sapiens; identical to SEQ ID NO: 266390

SEQ ID NO: 584697 - RNA, 64 nt, Homo Sapiens; identical to SEQ ID NO: 266391

SEQ ID NO: 584698 - RNA, 64 nt, Homo Sapiens; identical to SEQ ID NO: 266392

SEQ ID NO: 584699 - RNA, 64 nt, Homo Sapiens; identical to SEQ ID NO: 266393

SEQ ID NO: 584700 - RNA, 64 nt, Homo Sapiens; identical to SEQ ID NO: 266394

SEQ ID NO: 584701 - RNA, 64 nt, Homo Sapiens; identical to SEQ ID NO: 266395

SEQ ID NO: 584702 - RNA, 64 nt, Homo Sapiens; identical to SEQ ID NO: 266396

SEQ ID NO: 584703 - RNA, 64 nt, Homo Sapiens; identical to SEQ ID NO: 266397

SEQ ID NO: 584704 - RNA, 64 nt, Homo Sapiens; identical to SEQ ID NO: 266398

SEQ ID NO: 584705 - RNA, 64 nt, Homo Sapiens; identical to SEQ ID NO: 266399

SEQ ID NO: 584706 - RNA, 64 nt, Homo Sapiens; identical to SEQ ID NO: 266400

SEQ ID NO: 584707 - RNA, 64 nt, Homo Sapiens; identical to SEQ ID NO: 266401

SEQ ID NO: 584708 - RNA, 64 nt, Homo Sapiens; identical to SEQ ID NO: 266402

SEQ ID NO: 584709 - RNA, 64 nt, Homo Sapiens; identical to SEQ ID NO: 266403

SEQ ID NO: 584710 - RNA, 64 nt, Homo Sapiens; identical to SEQ ID NO: 266404

SEQ ID NO: 584711 - RNA, 64 nt, Homo Sapiens; identical to SEQ ID NO: 266405

SEQ ID NO: 584712 - RNA, 64 nt, Homo Sapiens; identical to SEQ ID NO: 266406

SEQ ID NO: 584713 - RNA, 64 nt, Homo Sapiens; identical to SEQ ID NO: 266407

SEQ ID NO: 584714 - RNA, 64 nt, Homo Sapiens; identical to SEQ ID NO: 266408

SEQ ID NO: 584715 - RNA, 64 nt, Homo Sapiens; identical to SEQ ID NO: 266409

SEQ ID NO: 584716 - RNA, 64 nt, Homo Sapiens; identical to SEQ ID NO: 266410

SEQ ID NO: 584717 - RNA, 64 nt, Homo Sapiens; identical to SEQ ID NO: 266411

SEQ ID NO: 584718 - RNA, 64 nt, Homo Sapiens; identical to SEQ ID NO: 266412

SEQ ID NO: 584719 - RNA, 64 nt, Homo Sapiens; identical to SEQ ID NO: 266413

SEQ ID NO: 584720 - RNA, 64 nt, Homo Sapiens; identical to SEQ ID NO: 266414

SEQ ID NO: 584721 - RNA, 64 nt, Homo Sapiens; identical to SEQ ID NO: 266415

SEQ ID NO: 584722 - RNA, 64 nt, Homo Sapiens; identical to SEQ ID NO: 266416

SEQ ID NO: 584723 - RNA, 64 nt, Homo Sapiens; identical to SEQ ID NO: 266417

SEQ ID NO: 584724 - RNA, 64 nt, Homo Sapiens; identical to SEQ ID NO: 266418

SEQ ID NO: 584725 - RNA, 64 nt, Homo Sapiens; identical to SEQ ID NO: 266419

SEQ ID NO: 584726 - RNA, 64 nt, Homo Sapiens; identical to SEQ ID NO: 266420

SEQ ID NO: 584727 - RNA, 64 nt, Homo Sapiens; identical to SEQ ID NO: 266421

SEQ ID NO: 584728 - RNA, 64 nt, Homo Sapiens; identical to SEQ ID NO: 266422

SEQ ID NO: 584729 - RNA, 64 nt, Homo Sapiens; identical to SEQ ID NO: 266423

SEQ ID NO: 584730 - RNA, 64 nt, Homo Sapiens; identical to SEQ ID NO: 266424

SEQ ID NO: 584731 - RNA, 64 nt, Homo Sapiens; identical to SEQ ID NO: 144070

SEQ ID NO: 584732 - RNA, 64 nt, Homo Sapiens; identical to SEQ ID NO: 144071

SEQ ID NO: 584733 - RNA, 64 nt, Homo Sapiens; identical to SEQ ID NO: 144072

SEQ ID NO: 584734 - RNA, 64 nt, Homo Sapiens; identical to SEQ ID NO: 144073

SEQ ID NO: 584735 - RNA, 64 nt, Homo Sapiens; identical to SEQ ID NO: 144074

SEQ ID NO: 584736 - RNA, 64 nt, Homo Sapiens; identical to SEQ ID NO: 144075

SEQ ID NO: 584737 - RNA, 64 nt, Homo Sapiens; identical to SEQ ID NO: 144076

SEQ ID NO: 584738 - RNA, 64 nt, Homo Sapiens; identical to SEQ ID NO: 144077

SEQ ID NO: 584739 - RNA, 64 nt, Homo Sapiens; identical to SEQ ID NO: 144078

SEQ ID NO: 584740 - RNA, 64 nt, Homo Sapiens; identical to SEQ ID NO: 144079

SEQ ID NO: 584741 - RNA, 64 nt, Homo Sapiens; identical to SEQ ID NO: 144080

SEQ ID NO: 584742 - RNA, 64 nt, Homo Sapiens; identical to SEQ ID NO: 144081

SEQ ID NO: 584743 - RNA, 64 nt, Homo Sapiens; identical to SEQ ID NO: 144082

SEQ ID NO: 584744 - RNA, 64 nt, Homo Sapiens; identical to SEQ ID NO: 144083

SEQ ID NO: 584745 - RNA, 64 nt, Homo Sapiens; identical to SEQ ID NO: 144084

SEQ ID NO: 584746 - RNA, 64 nt, Homo Sapiens; identical to SEQ ID NO: 144085

SEQ ID NO: 584747 - RNA, 64 nt, Homo Sapiens; identical to SEQ ID NO: 144086

SEQ ID NO: 584748 - RNA, 64 nt, Homo Sapiens; identical to SEQ ID NO: 144087

SEQ ID NO: 584749 - RNA, 64 nt, Homo Sapiens; identical to SEQ ID NO: 144088

SEQ ID NO: 584750 - RNA, 64 nt, Homo Sapiens; identical to SEQ ID NO: 144089

SEQ ID NO: 584751 - RNA, 64 nt, Homo Sapiens; identical to SEQ ID NO: 144090

SEQ ID NO: 584752 - RNA, 64 nt, Homo Sapiens; identical to SEQ ID NO: 144091

SEQ ID NO: 584753 - RNA, 64 nt, Homo Sapiens; identical to SEQ ID NO: 144092

SEQ ID NO: 584754 - RNA, 64 nt, Homo Sapiens; identical to SEQ ID NO: 144093

SEQ ID NO: 584755 - RNA, 64 nt, Homo Sapiens; identical to SEQ ID NO: 144094

SEQ ID NO: 584756 - RNA, 64 nt, Homo Sapiens; identical to SEQ ID NO: 144095

SEQ ID NO: 584757 - RNA, 64 nt, Homo Sapiens; identical to SEQ ID NO: 144096

SEQ ID NO: 584758 - RNA, 64 nt, Homo Sapiens; identical to SEQ ID NO: 144097

SEQ ID NO: 584759 - RNA, 64 nt, Homo Sapiens; identical to SEQ ID NO: 144098

SEQ ID NO: 584760 - RNA, 64 nt, Homo Sapiens; identical to SEQ ID NO: 144099

SEQ ID NO: 584761 - RNA, 64 nt, Homo Sapiens; identical to SEQ ID NO: 144100

SEQ ID NO: 584762 - RNA, 64 nt, Homo Sapiens; identical to SEQ ID NO: 144101

SEQ ID NO: 584763 - RNA, 64 nt, Homo Sapiens; identical to SEQ ID NO: 144102

SEQ ID NO: 584764 - RNA, 64 nt, Homo Sapiens; identical to SEQ ID NO: 144103

SEQ ID NO: 584765 - RNA, 64 nt, Homo Sapiens; identical to SEQ ID NO: 144104

SEQ ID NO: 584766 - RNA, 64 nt, Homo Sapiens; identical to SEQ ID NO: 144105

SEQ ID NO: 584767 - RNA, 64 nt, Homo Sapiens; identical to SEQ ID NO: 144106

SEQ ID NO: 584768 - RNA, 64 nt, Homo Sapiens; identical to SEQ ID NO: 144107

SEQ ID NO: 584769 - RNA, 64 nt, Homo Sapiens; identical to SEQ ID NO: 144108

SEQ ID NO: 584770 - RNA, 64 nt, Homo Sapiens; identical to SEQ ID NO: 144109

SEQ ID NO: 584771 - RNA, 64 nt, Homo Sapiens; identical to SEQ ID NO: 144110

SEQ ID NO: 584772 - RNA, 64 nt, Homo Sapiens; identical to SEQ ID NO: 144111

SEQ ID NO: 584773 - RNA, 64 nt, Homo Sapiens; identical to SEQ ID NO: 144112

SEQ ID NO: 584774 - RNA, 64 nt, Homo Sapiens; identical to SEQ ID NO: 144113

SEQ ID NO: 584775 - RNA, 64 nt, Homo Sapiens; identical to SEQ ID NO: 144114

SEQ ID NO: 584776 - RNA, 64 nt, Homo Sapiens; identical to SEQ ID NO: 144115

SEQ ID NO: 584777 - RNA, 64 nt, Homo Sapiens; identical to SEQ ID NO: 144116

SEQ ID NO: 584778 - RNA, 64 nt, Homo Sapiens; identical to SEQ ID NO: 144117

SEQ ID NO: 584779 - RNA, 64 nt, Homo Sapiens; identical to SEQ ID NO: 144118

SEQ ID NO: 584780 - RNA, 64 nt, Homo Sapiens; identical to SEQ ID NO: 144119

SEQ ID NO: 584781 - RNA, 64 nt, Homo Sapiens; identical to SEQ ID NO: 144120

SEQ ID NO: 584782 - RNA, 64 nt, Homo Sapiens; identical to SEQ ID NO: 144121

SEQ ID NO: 584783 - RNA, 64 nt, Homo Sapiens; identical to SEQ ID NO: 144122

SEQ ID NO: 584784 - RNA, 64 nt, Homo Sapiens; identical to SEQ ID NO: 144123

SEQ ID NO: 584785 - RNA, 64 nt, Homo Sapiens; identical to SEQ ID NO: 144124

SEQ ID NO: 584786 - RNA, 64 nt, Homo Sapiens; identical to SEQ ID NO: 144125

SEQ ID NO: 584787 - RNA, 64 nt, Homo Sapiens; identical to SEQ ID NO: 144126

SEQ ID NO: 584788 - RNA, 64 nt, Homo Sapiens; identical to SEQ ID NO: 144127

SEQ ID NO: 584789 - RNA, 64 nt, Homo Sapiens; identical to SEQ ID NO: 144128

SEQ ID NO: 584790 - RNA, 64 nt, Homo Sapiens; identical to SEQ ID NO: 144129

SEQ ID NO: 584791 - RNA, 64 nt, Homo Sapiens; identical to SEQ ID NO: 144130

SEQ ID NO: 584792 - RNA, 64 nt, Homo Sapiens; identical to SEQ ID NO: 144131

SEQ ID NO: 584793 - RNA, 64 nt, Homo Sapiens; identical to SEQ ID NO: 144132

SEQ ID NO: 584794 - RNA, 64 nt, Homo Sapiens; identical to SEQ ID NO: 144133

SEQ ID NO: 584795 - RNA, 64 nt, Homo Sapiens; identical to SEQ ID NO: 144134

SEQ ID NO: 584796 - RNA, 64 nt, Homo Sapiens; identical to SEQ ID NO: 144135

SEQ ID NO: 584797 - RNA, 64 nt, Homo Sapiens; identical to SEQ ID NO: 144136

SEQ ID NO: 584798 - RNA, 64 nt, Homo Sapiens; identical to SEQ ID NO: 144137

SEQ ID NO: 584799 - RNA, 64 nt, Homo Sapiens; identical to SEQ ID NO: 144138

SEQ ID NO: 584800 - RNA, 64 nt, Homo Sapiens; identical to SEQ ID NO: 144139

SEQ ID NO: 584801 - RNA, 64 nt, Homo Sapiens; identical to SEQ ID NO: 144140

SEQ ID NO: 584802 - RNA, 64 nt, Homo Sapiens; identical to SEQ ID NO: 144141

SEQ ID NO: 584803 - RNA, 64 nt, Homo Sapiens; identical to SEQ ID NO: 144142

SEQ ID NO: 584804 - RNA, 64 nt, Homo Sapiens; identical to SEQ ID NO: 144143

SEQ ID NO: 584805 - RNA, 64 nt, Homo Sapiens; identical to SEQ ID NO: 144144

SEQ ID NO: 584806 - RNA, 64 nt, Homo Sapiens; identical to SEQ ID NO: 144145

SEQ ID NO: 584807 - RNA, 64 nt, Homo Sapiens; identical to SEQ ID NO: 144146

SEQ ID NO: 584808 - RNA, 64 nt, Homo Sapiens; identical to SEQ ID NO: 144147

SEQ ID NO: 584809 - RNA, 64 nt, Homo Sapiens; identical to SEQ ID NO: 144148

SEQ ID NO: 584810 - RNA, 64 nt, Homo Sapiens; identical to SEQ ID NO: 144149

SEQ ID NO: 584811 - RNA, 64 nt, Homo Sapiens; identical to SEQ ID NO: 144150

SEQ ID NO: 584812 - RNA, 64 nt, Homo Sapiens; identical to SEQ ID NO: 144151

SEQ ID NO: 584813 - RNA, 64 nt, Homo Sapiens; identical to SEQ ID NO: 144152

SEQ ID NO: 584814 - RNA, 64 nt, Homo Sapiens; identical to SEQ ID NO: 144153

SEQ ID NO: 584815 - RNA, 64 nt, Homo Sapiens; identical to SEQ ID NO: 144154

SEQ ID NO: 584816 - RNA, 64 nt, Homo Sapiens; identical to SEQ ID NO: 144155

SEQ ID NO: 584817 - RNA, 64 nt, Homo Sapiens
agcauguguagcaccaguugauaauuggucucuaguagcuuacugucaaaauguucaaugaagu

SEQ ID NO: 584818 - RNA, 64 nt, Homo Sapiens
cacugaugcguguauggaugugugugagucagugguagcuuauuuaaaaagcaccuuauccuuu

SEQ ID NO: 584819 - RNA, 64 nt, Homo Sapiens
uuuuauuugcaauuaauuuaucaggcuauauauuguagcuuaauuuuguucuagucauuuuuau

SEQ ID NO: 584820 - RNA, 64 nt, Homo Sapiens
gagcaaccuagcucaaggauccuuggugugaaugguagcuuaguugguaacgauggugucacac

SEQ ID NO: 584821 - RNA, 64 nt, Homo Sapiens; identical to SEQ ID NO: 309737

SEQ ID NO: 584822 - RNA, 64 nt, Homo Sapiens; identical to SEQ ID NO: 309738

SEQ ID NO: 584823 - RNA, 64 nt, Homo Sapiens; identical to SEQ ID NO: 309739

SEQ ID NO: 584824 - RNA, 64 nt, Homo Sapiens; identical to SEQ ID NO: 309740

SEQ ID NO: 584825 - RNA, 64 nt, Homo Sapiens; identical to SEQ ID NO: 309741

SEQ ID NO: 584826 - RNA, 64 nt, Homo Sapiens; identical to SEQ ID NO: 309742

SEQ ID NO: 584827 - RNA, 64 nt, Homo Sapiens
guaacaaaucguggaauauuuuuaaggaaaacuguuguauaaaacuuuaccauaguaaccuuag

SEQ ID NO: 584828 - RNA, 64 nt, Homo Sapiens
aguguaauaguccccacuauacgaauuuuaugguuuguauaaacacuaacauuuuccccuucug

SEQ ID NO: 584829 - RNA, 64 nt, Homo Sapiens
acucuuuuuggcaagcacuuaaauguucugaaauuuguauaagacauuuauuauauuuuuuucu

SEQ ID NO: 584830 - RNA, 64 nt, Homo Sapiens
gguuuggaaugauugugugcaugaauuugggagauuguauaaaacaaaacuagcagaauguuuu

SEQ ID NO: 584831 - RNA, 64 nt, Homo Sapiens
uaugguuuuguagauauggugacuccagucuuuguuguauaaagguugggggagcugauaaggu

SEQ ID NO: 584832 - RNA, 64 nt, Homo Sapiens
uuguacaguauuuucuccuucguuguauugauuuuuguauaaaaauguaacuucuacgugucua

SEQ ID NO: 584833 - RNA, 64 nt, Homo Sapiens
uccaaaaugaaugcaaaauuuaaaauuaaaugccuuguauaaaauaaugggggugguaggccua

SEQ ID NO: 584834 - RNA, 64 nt, Homo Sapiens
caagcacauguaauaaauucuaggguggcuuuaauuguauaaguuuuuuuaaagcaagucaccu

SEQ ID NO: 584835 - RNA, 64 nt, Homo Sapiens
accuauagcaaucauuucaaaucuauucugcaaauuguauaagaauaaaguuagaauuaacaau

SEQ ID NO: 584836 - RNA, 64 nt, Homo Sapiens
uaucaaaaaagggaaaugaaguauaaaucaauuuuuguauaaucuguuugaaacaugaguuuua

SEQ ID NO: 584837 - RNA, 64 nt, Homo Sapiens
uauuaaauccacaauauuuuauuacauuuuuaacuuguauaaauuuuaggucaaauccuucaag

SEQ ID NO: 584838 - RNA, 64 nt, Homo Sapiens
augauaucuuaaauuaccuuuaugaaauauaguuuuguauaauagcauagauuuuccuucaaaa

SEQ ID NO: 584839 - RNA, 64 nt, Homo Sapiens
auuuauguugacccacuuauuugaagucaguauuuuguauaaacagaaagugcuuuguauuuug

SEQ ID NO: 584840 - RNA, 64 nt, Homo Sapiens
uaaauuuauuucuccaaauccuggcaauauaguguuguauaaugacgucccugcccucuuugac

SEQ ID NO: 584841 - RNA, 64 nt, Homo Sapiens
cuuaacugacuguagcaaaguuuaguuugaaaaguuguauaauaaauauuuugauuuguuuucc

SEQ ID NO: 584842 - RNA, 64 nt, Homo Sapiens
gaggguacuguugguucaaagugcugaaauuguuuuguauaacuuuuugaaucaccuauccuca

SEQ ID NO: 584843 - RNA, 64 nt, Homo Sapiens
ggcucaaauucucuaccucuugccaaggcugucuuuguauaaugccugaugagagagaagaugg

SEQ ID NO: 584844 - RNA, 64 nt, Homo Sapiens
uuuuuuaaaugcugguuaaaugccaguguuaugauuguauaaauuuugucuucccauuaaccuu

SEQ ID NO: 584845 - RNA, 64 nt, Homo Sapiens
ugcaucuuuacuaauguaugaugaauaucaaaauuuguauaauuuuuaauagcuauuauaguuu

SEQ ID NO: 584846 - RNA, 64 nt, Homo Sapiens
auuaccaauacuauuuauuaguguuaacaaaaaauuguauaaucuugugaugagugauguaucu

SEQ ID NO: 584847 - RNA, 64 nt, Homo Sapiens
ucuuaaaaguugugauuccaccuuuugaaguaguuuguauaacuaaacuauuugucuuucagga

SEQ ID NO: 584848 - RNA, 64 nt, Homo Sapiens
uaucaguuuguccuguagagauuaauagcuuuuauuguauaaacguugccuuaaagaaagucga

SEQ ID NO: 584849 - RNA, 64 nt, Homo Sapiens
ucauuuaagauaaucauaaguuguaugaugauaauuguauaaaaauuuguaugaugauaauugu

SEQ ID NO: 584850 - RNA, 64 nt, Homo Sapiens
gaugauaauuguauaaaaauuuguaugaugauaauuguauaauaauuauacaugaaagugccaa

SEQ ID NO: 584851 - RNA, 64 nt, Homo Sapiens
aaagcaucaacagauaauuuuaacagugaauccuuuguauaauguuaacuauaucuauaguauu

SEQ ID NO: 584852 - RNA, 64 nt, Homo Sapiens
cauucugcuaaggcccagggcuugaccaucuacuuuguauaacaauuuauucauuuuccacaca

SEQ ID NO: 584853 - RNA, 64 nt, Homo Sapiens
aaaccuaaaagcaguaucugaaaguuuagaugcauuguauaaaaagcacuuaaauuucgaaccu

SEQ ID NO: 584854 - RNA, 64 nt, Homo Sapiens
uauuuagagugaggcuggagggaauaacuugauuuuguauaagccuggauuuguguuagcuaug

SEQ ID NO: 584855 - RNA, 64 nt, Homo Sapiens
aguuugugaauaacucaaggcaauagaauguaaauuguauaaaauggcucauuaaaaaauuuag

SEQ ID NO: 584856 - RNA, 64 nt, Homo Sapiens
caaauuuucauuaagccaguaaaaauuucugcuuuuguauaauaugccuacuuuaaaacaguau

SEQ ID NO: 584857 - RNA, 64 nt, Homo Sapiens
cugccuacauuugcguugcuuucuacauagagacuuguauaauaguauuaauaguagcucauuc

SEQ ID NO: 584858 - RNA, 64 nt, Homo Sapiens
uuaacaaauaugacacagaaaaggucagaugcuguuguauaaaauuuuuuacuagugugucuua

SEQ ID NO: 584859 - RNA, 64 nt, Homo Sapiens
cuaugcaaauauugcuuaugauuguauaauuuacuuguauaauuuauguugcugcugcuuaaau

SEQ ID NO: 584860 - RNA, 64 nt, Homo Sapiens
uacuuguauaauucuaugcacugcugcuuaaauauuguauaauuuuaaauuucagcauauguug

SEQ ID NO: 584861 - RNA, 64 nt, Homo Sapiens
guaauuugauaacauggguauuuuauuauguguuuuguauaaaucccuaauauuuaaaaaaaaa

SEQ ID NO: 584862 - RNA, 64 nt, Homo Sapiens
uuuguuauuucucucugauguuuuuuguaagacauuguauaagugcccaugucccacuuuuuua

SEQ ID NO: 584863 - RNA, 64 nt, Homo Sapiens
uauuuuugccauacauuuugcuguuuugcaaaguuuguauaagaacacauaacacuacugaauu

SEQ ID NO: 584864 - RNA, 64 nt, Homo Sapiens
ugugugaguauaugugugcauguuuagcagauauuuguauaaaauauaaacacucuguugucau

SEQ ID NO: 584865 - RNA, 64 nt, Homo Sapiens
uaaaacauguaugauuccagaauuuuaguauguuuuguauaaaacuauuuuucauuacggagac

SEQ ID NO: 584866 - RNA, 64 nt, Homo Sapiens
ugcacagcuagaguguuuuuguaaauaaauguauuuguauaacacagucauguaauauacagaa

SEQ ID NO: 584867 - RNA, 64 nt, Homo Sapiens
agaugagauccucaaaaaucaucaaaguguuuaauuguauaaaacaguguuuccagugacacaa

SEQ ID NO: 584868 - RNA, 64 nt, Homo Sapiens
agccuuauaaagaaaaagaagcuuuucuagggguuuguauaaauaguguugaaacuuuauuuua

SEQ ID NO: 584869 - RNA, 63 nt, Homo Sapiens
uuauguaaucugaugcaugaguauaaugugacaauuguauaauuucaaaaguauguaagcauu

SEQ ID NO: 584870 - RNA, 64 nt, Homo Sapiens
ugacaauuguauaauuuaugaaaguauguaagcauuguauaauguuuuugcagguacaaauuca

SEQ ID NO: 584871 - RNA, 64 nt, Homo Sapiens
aggaaguucugaucuguuaauuuacuacaaguuuuuguauaaaaugaaaacucguauucuaccu

SEQ ID NO: 584872 - RNA, 64 nt, Homo Sapiens
aaaugcaauaauaagcaaauaaauuacuuuguuuuuguauaaguauguauaggauugagcucua

SEQ ID NO: 584873 - RNA, 64 nt, Homo Sapiens
uaucuugacaaauuuuacuaaaaaugcuuugaguuuguauaauaauuagacugaugcuuuaucu

SEQ ID NO: 584874 - RNA, 64 nt, Homo Sapiens
uaccugggagagguagcauauuauuaugaccccuuuguauaagauuaauaauaauagacaauaa

SEQ ID NO: 584875 - RNA, 64 nt, Homo Sapiens
guguguuuuugguuuuucuaaguauauagaaagcuuguauaauucagauuuaucaauuuccuga

SEQ ID NO: 584876 - RNA, 64 nt, Homo Sapiens
aaauauuuuaaguacauuuauuuuugguguuuuauuguauaaaaccuuagacaaucaaucaguc

SEQ ID NO: 584877 - RNA, 64 nt, Homo Sapiens
caaccaucucuuuaaaguuagccuauaaauauuguuguauaauuuucuuuggucagaaacacuu

SEQ ID NO: 584878 - RNA, 64 nt, Homo Sapiens
gcacaugccauccaauuuucugucaaucacacuguuguauaaagcagcagaacugaaggggaaa

SEQ ID NO: 584879 - RNA, 64 nt, Homo Sapiens
cuaguuuuauaugaaacuaguuagaaacugaauuuuguauaauauugcugauggacagugauca

SEQ ID NO: 584880 - RNA, 64 nt, Homo Sapiens
gaauuuauggugcuauuuaaacuugaggugugccuuguauaacuccaaaugaggccuacugauu

SEQ ID NO: 584881 - RNA, 64 nt, Homo Sapiens
uauuuaaaagggauacuuuuguaaaaguaaaaccuuguauaaagaacaaaauguuucuuaauuu

SEQ ID NO: 584882 - RNA, 64 nt, Homo Sapiens
gaaagggggcuuagggaugagguccugguuuuucuuguauaaauaggagucaugggcguuaguu

SEQ ID NO: 584883 - RNA, 64 nt, Homo Sapiens
aaaagcaaguuucuuuguauuccucacccuagauuuguauaaaugccuuuuuguccaucccuuu

SEQ ID NO: 584884 - RNA, 64 nt, Homo Sapiens
uuguugaaaacaaacuggaaacuuguuucuuuuuuuguauaaaugagagauugcaaauguagug

SEQ ID NO: 584885 - RNA, 64 nt, Homo Sapiens
uauuggcauguaaacagcacccauaugagaaccuuuguauaaaagaaguaacugacagcugaca

SEQ ID NO: 584886 - RNA, 64 nt, Homo Sapiens
guacaguguuuaauagagguugggcuggacuguuuuguauaacuuuaacugcagagaaucacuc

SEQ ID NO: 584887 - RNA, 64 nt, Homo Sapiens
cccuauuguauuuguauuuaaaauuuguacacauuuguauaauaaucuguaccuugugguauuu

SEQ ID NO: 584888 - RNA, 64 nt, Homo Sapiens
aaauucuagugguuugauccaaaucccauuacaguuguauaaagaaauaaaauuuuguacuuau

SEQ ID NO: 584889 - RNA, 64 nt, Homo Sapiens
guaccaacagaaauauuauuguaagaugccuuucuuguauaagauaugccaauauuugcuuuaa

SEQ ID NO: 584890 - RNA, 64 nt, Homo Sapiens
ugucaguuuaucuccccuccucaguauaucugauuuguauaaguaaguugaugagcuucucucu

SEQ ID NO: 584891 - RNA, 64 nt, Homo Sapiens; identical to SEQ ID NO: 97841

SEQ ID NO: 584892 - RNA, 64 nt, Homo Sapiens; identical to SEQ ID NO: 97842

SEQ ID NO: 584893 - RNA, 64 nt, Homo Sapiens; identical to SEQ ID NO: 97843

SEQ ID NO: 584894 - RNA, 64 nt, Homo Sapiens; identical to SEQ ID NO: 97844

SEQ ID NO: 584895 - RNA, 64 nt, Homo Sapiens; identical to SEQ ID NO: 97845

SEQ ID NO: 584896 - RNA, 64 nt, Homo Sapiens; identical to SEQ ID NO: 97846

SEQ ID NO: 584897 - RNA, 64 nt, Homo Sapiens; identical to SEQ ID NO: 97847

SEQ ID NO: 584898 - RNA, 64 nt, Homo Sapiens; identical to SEQ ID NO: 97848

SEQ ID NO: 584899 - RNA, 64 nt, Homo Sapiens; identical to SEQ ID NO: 50853

SEQ ID NO: 584900 - RNA, 64 nt, Homo Sapiens; identical to SEQ ID NO: 50854

SEQ ID NO: 584901 - RNA, 64 nt, Homo Sapiens; identical to SEQ ID NO: 50855

SEQ ID NO: 584902 - RNA, 64 nt, Homo Sapiens; identical to SEQ ID NO: 50856

SEQ ID NO: 584903 - RNA, 64 nt, Homo Sapiens; identical to SEQ ID NO: 50857

SEQ ID NO: 584904 - RNA, 64 nt, Homo Sapiens; identical to SEQ ID NO: 50858

SEQ ID NO: 584905 - RNA, 64 nt, Homo Sapiens; identical to SEQ ID NO: 50859

SEQ ID NO: 584906 - RNA, 64 nt, Homo Sapiens; identical to SEQ ID NO: 50860

SEQ ID NO: 584907 - RNA, 64 nt, Homo Sapiens; identical to SEQ ID NO: 50861

SEQ ID NO: 584908 - RNA, 64 nt, Homo Sapiens; identical to SEQ ID NO: 50862

SEQ ID NO: 584909 - RNA, 64 nt, Homo Sapiens; identical to SEQ ID NO: 50863

SEQ ID NO: 584910 - RNA, 64 nt, Homo Sapiens; identical to SEQ ID NO: 50864

SEQ ID NO: 584911 - RNA, 64 nt, Homo Sapiens; identical to SEQ ID NO: 50865

SEQ ID NO: 584912 - RNA, 64 nt, Homo Sapiens; identical to SEQ ID NO: 50866

SEQ ID NO: 584913 - RNA, 64 nt, Homo Sapiens; identical to SEQ ID NO: 50867

SEQ ID NO: 584914 - RNA, 64 nt, Homo Sapiens; identical to SEQ ID NO: 50868

SEQ ID NO: 584915 - RNA, 64 nt, Homo Sapiens; identical to SEQ ID NO: 50869

SEQ ID NO: 584916 - RNA, 64 nt, Homo Sapiens; identical to SEQ ID NO: 50870

SEQ ID NO: 584917 - RNA, 64 nt, Homo Sapiens; identical to SEQ ID NO: 50871

SEQ ID NO: 584918 - RNA, 64 nt, Homo Sapiens; identical to SEQ ID NO: 50872

SEQ ID NO: 584919 - RNA, 64 nt, Homo Sapiens; identical to SEQ ID NO: 50873

SEQ ID NO: 584920 - RNA, 64 nt, Homo Sapiens; identical to SEQ ID NO: 50874

SEQ ID NO: 584921 - RNA, 64 nt, Homo Sapiens; identical to SEQ ID NO: 50875

SEQ ID NO: 584922 - RNA, 64 nt, Homo Sapiens; identical to SEQ ID NO: 50876

SEQ ID NO: 584923 - RNA, 64 nt, Homo Sapiens; identical to SEQ ID NO: 50877

SEQ ID NO: 584924 - RNA, 64 nt, Homo Sapiens; identical to SEQ ID NO: 50878

SEQ ID NO: 584925 - RNA, 64 nt, Homo Sapiens; identical to SEQ ID NO: 50879

SEQ ID NO: 584926 - RNA, 64 nt, Homo Sapiens; identical to SEQ ID NO: 50880

SEQ ID NO: 584927 - RNA, 64 nt, Homo Sapiens; identical to SEQ ID NO: 50881

SEQ ID NO: 584928 - RNA, 64 nt, Homo Sapiens; identical to SEQ ID NO: 50882

SEQ ID NO: 584929 - RNA, 64 nt, Homo Sapiens; identical to SEQ ID NO: 50883

SEQ ID NO: 584930 - RNA, 64 nt, Homo Sapiens; identical to SEQ ID NO: 50884

SEQ ID NO: 584931 - RNA, 64 nt, Homo Sapiens; identical to SEQ ID NO: 50885

SEQ ID NO: 584932 - RNA, 64 nt, Homo Sapiens; identical to SEQ ID NO: 50886

SEQ ID NO: 584933 - RNA, 64 nt, Homo Sapiens; identical to SEQ ID NO: 50887

SEQ ID NO: 584934 - RNA, 64 nt, Homo Sapiens; identical to SEQ ID NO: 50888

SEQ ID NO: 584935 - RNA, 64 nt, Homo Sapiens; identical to SEQ ID NO: 50889

SEQ ID NO: 584936 - RNA, 64 nt, Homo Sapiens; identical to SEQ ID NO: 50890

SEQ ID NO: 584937 - RNA, 64 nt, Homo Sapiens; identical to SEQ ID NO: 50891

SEQ ID NO: 584938 - RNA, 64 nt, Homo Sapiens; identical to SEQ ID NO: 50892

SEQ ID NO: 584939 - RNA, 64 nt, Homo Sapiens; identical to SEQ ID NO: 50893

SEQ ID NO: 584940 - RNA, 64 nt, Homo Sapiens; identical to SEQ ID NO: 50894

SEQ ID NO: 584941 - RNA, 64 nt, Homo Sapiens; identical to SEQ ID NO: 50895

SEQ ID NO: 584942 - RNA, 64 nt, Homo Sapiens; identical to SEQ ID NO: 50896

SEQ ID NO: 584943 - RNA, 64 nt, Homo Sapiens; identical to SEQ ID NO: 50897

SEQ ID NO: 584944 - RNA, 64 nt, Homo Sapiens; identical to SEQ ID NO: 50898

SEQ ID NO: 584945 - RNA, 64 nt, Homo Sapiens; identical to SEQ ID NO: 50899

SEQ ID NO: 584946 - RNA, 64 nt, Homo Sapiens; identical to SEQ ID NO: 50900

SEQ ID NO: 584947 - RNA, 64 nt, Homo Sapiens; identical to SEQ ID NO: 50901

SEQ ID NO: 584948 - RNA, 64 nt, Homo Sapiens; identical to SEQ ID NO: 50902

SEQ ID NO: 584949 - RNA, 64 nt, Homo Sapiens; identical to SEQ ID NO: 50903

SEQ ID NO: 584950 - RNA, 64 nt, Homo Sapiens; identical to SEQ ID NO: 50904

SEQ ID NO: 584951 - RNA, 64 nt, Homo Sapiens; identical to SEQ ID NO: 50905

SEQ ID NO: 584952 - RNA, 64 nt, Homo Sapiens; identical to SEQ ID NO: 50906

SEQ ID NO: 584953 - RNA, 64 nt, Homo Sapiens; identical to SEQ ID NO: 50907

SEQ ID NO: 584954 - RNA, 64 nt, Homo Sapiens; identical to SEQ ID NO: 50908

SEQ ID NO: 584955 - RNA, 64 nt, Homo Sapiens; identical to SEQ ID NO: 50909

SEQ ID NO: 584956 - RNA, 64 nt, Homo Sapiens; identical to SEQ ID NO: 50910

SEQ ID NO: 584957 - RNA, 64 nt, Homo Sapiens; identical to SEQ ID NO: 50911

SEQ ID NO: 584958 - RNA, 64 nt, Homo Sapiens; identical to SEQ ID NO: 50912

SEQ ID NO: 584959 - RNA, 64 nt, Homo Sapiens; identical to SEQ ID NO: 50913

SEQ ID NO: 584960 - RNA, 64 nt, Homo Sapiens; identical to SEQ ID NO: 50914

SEQ ID NO: 584961 - RNA, 64 nt, Homo Sapiens; identical to SEQ ID NO: 50915

SEQ ID NO: 584962 - RNA, 64 nt, Homo Sapiens; identical to SEQ ID NO: 50916

SEQ ID NO: 584963 - RNA, 64 nt, Homo Sapiens; identical to SEQ ID NO: 50917

SEQ ID NO: 584964 - RNA, 64 nt, Homo Sapiens; identical to SEQ ID NO: 50918

SEQ ID NO: 584965 - RNA, 64 nt, Homo Sapiens; identical to SEQ ID NO: 50919

SEQ ID NO: 584966 - RNA, 64 nt, Homo Sapiens; identical to SEQ ID NO: 50920

SEQ ID NO: 584967 - RNA, 64 nt, Homo Sapiens; identical to SEQ ID NO: 50921

SEQ ID NO: 584968 - RNA, 64 nt, Homo Sapiens; identical to SEQ ID NO: 50922

SEQ ID NO: 584969 - RNA, 64 nt, Homo Sapiens; identical to SEQ ID NO: 50923

SEQ ID NO: 584970 - RNA, 64 nt, Homo Sapiens; identical to SEQ ID NO: 50924

SEQ ID NO: 584971 - RNA, 64 nt, Homo Sapiens; identical to SEQ ID NO: 50925

SEQ ID NO: 584972 - RNA, 64 nt, Homo Sapiens; identical to SEQ ID NO: 50926

SEQ ID NO: 584973 - RNA, 64 nt, Homo Sapiens; identical to SEQ ID NO: 50927

SEQ ID NO: 584974 - RNA, 64 nt, Homo Sapiens; identical to SEQ ID NO: 50928

SEQ ID NO: 584975 - RNA, 64 nt, Homo Sapiens
uccugcccaugcuucaaacuuuguucugugucugaccuacuaauugaugaagacugcucuucuu

SEQ ID NO: 584976 - RNA, 64 nt, Homo Sapiens
gggauugcuggaucgaaugguccuuuggguagauaccuacuaguggugauuuuaaaauauaauu

SEQ ID NO: 584977 - RNA, 64 nt, Homo Sapiens
uuagcacuuuacuuccauuagguuccuuuagcuuaccuacuaauguaacuaucuuaaguaauag

SEQ ID NO: 584978 - RNA, 64 nt, Homo Sapiens
ucucuguucuguacauuauuguuuaauauaagaaaccuacuagcauucaaauaaucauucccua

SEQ ID NO: 584979 - RNA, 64 nt, Homo Sapiens
auuuaucugugcaaauccuugauacugcucaucauuccuugagaaaaacaaugagcugagaggc

SEQ ID NO: 584980 - RNA, 64 nt, Homo Sapiens
aguaacugccaucaagaugagagaacuggaggaguuccuugaucuguauauacaauaacauaau

SEQ ID NO: 584981 - RNA, 64 nt, Homo Sapiens
ucauggaauucuggagaguucuaacguccagugcuuccuugagaugagcgagucccuuccugcu

SEQ ID NO: 584982 - RNA, 64 nt, Homo Sapiens
uuauucgugauacagauuccugggcacaguaccuuuccuugaacaucuagccuacgugcacauc

SEQ ID NO: 584983 - RNA, 64 nt, Homo Sapiens
agggucucacacccuggaggcaggaaucacuguuuuccuugaccugguuugacuuacuaagaca

SEQ ID NO: 584984 - RNA, 64 nt, Homo Sapiens
ugucagaggucacaguaaccagaaaauaacuuguuuccuugaucugugcuguaaucacaagagg

SEQ ID NO: 584985 - RNA, 64 nt, Homo Sapiens
cuaucaucguguguacuugguaaagucaguuguauuccuugaaguuccuugaaaauucauauca

SEQ ID NO: 584986 - RNA, 56 nt, Homo Sapiens
auucauaucauaaagucagugauacguuccuugaaaauucuucaaaauccauauaa

SEQ ID NO: 584987 - RNA, 64 nt, Homo Sapiens
cuuuugucaucuucugacauaaguuuaccugaguuuccuugauuuggaagauuuguuucuuuua

SEQ ID NO: 584988 - RNA, 64 nt, Homo Sapiens
cuuaauagaccaaaaauaucuauacagcacugauuuccuugaauauuguguguuaauugauaua

SEQ ID NO: 584989 - RNA, 64 nt, Homo Sapiens
aauccaugaaaggaauaauugccaauuuuaaaauuuccuugaauuguauaaguacuaggcagaa

SEQ ID NO: 584990 - RNA, 64 nt, Homo Sapiens
auguauuuaucugaagaucacaguuuugcuugcauuccuugagauuaagcauaaaaaaaaugcu

SEQ ID NO: 584991 - RNA, 64 nt, Homo Sapiens
ggcuggcaugaaaaucugacuuugcccagcucuuuuccuugaugcaguuucccgguguggaagg

SEQ ID NO: 584992 - RNA, 64 nt, Homo Sapiens
acccucaucagauucaucuccacugauaaccgguuuccuugaugcagacauaguuuagcuuucu

SEQ ID NO: 584993 - RNA, 64 nt, Homo Sapiens
ccucucuccuucucugccuaaugguuuuacggauuuccuugaagguggcuuagaaguguguguu

SEQ ID NO: 584994 - RNA, 64 nt, Homo Sapiens
ggccuuggcuccaucuccuugaaaaguccuuuucuuccuugacacuuucuccaacucuuggugg

SEQ ID NO: 584995 - RNA, 64 nt, Homo Sapiens
auuuauuuuauagucuaaaucuggagggguugaauuccuugagaacauuaagaaaaaguauuga

SEQ ID NO: 584996 - RNA, 64 nt, Homo Sapiens
augugagauuuaaaaauuuuugcuguagaaaauauuccuugaaguucuacuuuuucaaaugaua

SEQ ID NO: 584997 - RNA, 64 nt, Homo Sapiens
ucuucucaagcucuuaugacaaugugcggaagauuuccuugaaaaaccugauuggaccgugucc

SEQ ID NO: 584998 - RNA, 64 nt, Homo Sapiens
ugauacuggacuucuuaccaauccggagguuuccuuccuugaaugucaguguguaaaccuggcu

SEQ ID NO: 584999 - RNA, 64 nt, Homo Sapiens
uuccuaauuauaaaagcugcuuuuuugcagaacauuccuugaaaauauaagguuuugaaaagac

SEQ ID NO: 585000 - RNA, 64 nt, Homo Sapiens
agaaguacagauuuuuuaaacaaaguguucuuuuuuccuugaaauuaagccacagcgcccggcc

SEQ ID NO: 585001 - RNA, 64 nt, Homo Sapiens
cagagucucucucugucgucuuuguuuguuuguuuuccuugagauacauucaaaguauacuuuu

SEQ ID NO: 585002 - RNA, 64 nt, Homo Sapiens
aauagauugcuuuuaaggucuuucugcucugugauuccuugauaauacauuucuuuccuugaaa

SEQ ID NO: 585003 - RNA, 64 nt, Homo Sapiens
uuucugcucugugauuccuugauaauacauuucuuuccuugaaaaauaugaggacguuuuucag

SEQ ID NO: 585004 - RNA, 64 nt, Homo Sapiens
auaucugaagugguuauuuauuguccgaaaauaauuccuugaucaagacccauuuggcaagagg

SEQ ID NO: 585005 - RNA, 64 nt, Homo Sapiens
ccccaggugccacuuugcuguuucucacccaugcuuccuugaagcuuaaccuuuuugcuuugcu

SEQ ID NO: 585006 - RNA, 64 nt, Homo Sapiens
aaauaccaaaucaaauaauaaccauuguacuuauaacuguuauugguuuucuuuuucagugucu

SEQ ID NO: 585007 - RNA, 64 nt, Homo Sapiens
gguacuuuugaaauauuuguacauuaaaguugauaacuguuauuuuuuucuccuuuaugauauu

SEQ ID NO: 585008 - RNA, 64 nt, Homo Sapiens
aguaguaaaaauaaagcuauacaaaguaaaaauaaacuguuauguuugcauuuuuguauuuugu

SEQ ID NO: 585009 - RNA, 64 nt, Homo Sapiens
uagguuaacaacccuguugaucuuuaaacuacugaacuguuacccuuccagaugucuaaaagau

SEQ ID NO: 585010 - RNA, 64 nt, Homo Sapiens
ugcucuugaagaagaugucaaagguuccauaauaaacuguuagggguagaauuggcacagaguu

SEQ ID NO: 585011 - RNA, 64 nt, Homo Sapiens
auuuaaaaaaaauuuaaaucuuaagauugccaaaaacuguuaaauuguaauauauuguacuuua

SEQ ID NO: 585012 - RNA, 64 nt, Homo Sapiens
gucuuucccaggacauuuuugauacauuauuagaaacuguuaggccucaaugcauugucaguag

SEQ ID NO: 585013 - RNA, 64 nt, Homo Sapiens
gucuuucccgggacauuuuuaauacauuauuagaaacuguuaagccucaaugcauugucaguag

SEQ ID NO: 585014 - RNA, 64 nt, Homo Sapiens
uuauucaaagagaaaacaucuuucaauguaauuaaacuguuaacuaagcccacaguauauuuua

SEQ ID NO: 585015 - RNA, 64 nt, Homo Sapiens
guaaugucauaaagugagaauguuucuguccuguaacuguuacaaauauaaauguguguaugug

SEQ ID NO: 585016 - RNA, 64 nt, Homo Sapiens
aaauacccuguugacucccaauucuaauguccucaacuguuaccuacccuuuucaguucccuuc

SEQ ID NO: 585017 - RNA, 59 nt, Homo Sapiens
caagccaccacauuuuguaaaagagaaguaacuguuacuccacugaaagaaauucauga

SEQ ID NO: 585018 - RNA, 64 nt, Homo Sapiens
auaagagacaaaguuuggaaguacauaaaguaauaacuguuagaauuagguaauggauaugaaa

SEQ ID NO: 585019 - RNA, 64 nt, Homo Sapiens
uucuuuuuucaauguacuguauugggacgcugguaacuguuaacccaguguucagcauagagcu

SEQ ID NO: 585020 - RNA, 64 nt, Homo Sapiens
cauguuggcgcgugauugacauuacagcacagaaaacuguuagugacugguuuccuguuagaua

SEQ ID NO: 585021 - RNA, 64 nt, Homo Sapiens
aucugcaucucaaaagaaaaugcuuacccacaggaacuguuaacucagggguucuuaacuuggg

SEQ ID NO: 585022 - RNA, 64 nt, Homo Sapiens
gcugcuuuuuggguaggaccccacgauuuaggguaacuguuaucaucagcugccauuucugaua

SEQ ID NO: 585023 - RNA, 64 nt, Homo Sapiens
ccucuuagaagcaccugugaaugggaauugagccaacuguuauagaaaauugguucagaaagug

SEQ ID NO: 585024 - RNA, 64 nt, Homo Sapiens
aaauauucuuuguaaagaaaaucgcugcagcaaaaacuguuacuguguuuauuauauuuguaga

SEQ ID NO: 585025 - RNA, 64 nt, Homo Sapiens
auuuguucuuagaaccugguugaaaauaccaggaaacuguuacagacgccauuuuuuuuuuuuu

SEQ ID NO: 585026 - RNA, 64 nt, Homo Sapiens
cuaaguuaagcuuuggagauacauguuagugguuaacuguuaagagcuuugaaaacacugcaca

SEQ ID NO: 585027 - RNA, 62 nt, Homo Sapiens
uuugucgauugcuuagauuuguuccuguugucaaaacuguuacccccaaaauuggugugaca

SEQ ID NO: 585028 - RNA, 64 nt, Homo Sapiens
aucuugagauguucaaaaaauuugggguuagagcaacuguuagcgucucuaugagcaaucagua

SEQ ID NO: 585029 - RNA, 64 nt, Homo Sapiens
agccuugacugugaggcaggacuucccucgcuugaacuguuacacauacgaugugugugucaca

SEQ ID NO: 585030 - RNA, 64 nt, Homo Sapiens
agaguguuaauggauuauugugaccacacccaauaacuguuauuaugguuaagaauuuccagua

SEQ ID NO: 585031 - RNA, 64 nt, Homo Sapiens
ggaaauaccuuuuuuuuuuucuaugaaaauuaacaacuguuaaaauguagcucuuggaguacag

SEQ ID NO: 585032 - RNA, 64 nt, Homo Sapiens
ugguaaauuacuucuuuuuuuucuuuuuaauaaaaacuguuacucauuaacuuugcuuauaaug

SEQ ID NO: 585033 - RNA, 64 nt, Homo Sapiens
uggaaaagagucuccaguucugcucuggccuacuaacuguuaccacugagagaacaacauguuc

SEQ ID NO: 585034 - RNA, 64 nt, Homo Sapiens
uuugucauuguuuuucgcaauugagcuaucugaaaacuguuauuccuaaguaauguucaaaaau

SEQ ID NO: 585035 - RNA, 64 nt, Homo Sapiens
uagaugcagaggaauucaucuacugucuguuauuaacuguuaguuuauucucauacuuacgaug

SEQ ID NO: 585036 - RNA, 64 nt, Homo Sapiens
auuguugaaucaauuacuuuuuguugcaugcuagaacuguuaguaacauuagauaguagauggu

SEQ ID NO: 585037 - RNA, 64 nt, Homo Sapiens
auuugggaaauauucuuuacaucauuccaaauagaacuguuaugaugcuuguagaguugugggu

SEQ ID NO: 585038 - RNA, 64 nt, Homo Sapiens
agacagauauaaaaguaucuauauaauaucuauaaacuguuaaugcugagguauagucugugaa

SEQ ID NO: 585039 - RNA, 64 nt, Homo Sapiens
gauuuuccagacaaaugguaugguguugaaaaauaacuguuacuucuuaaagcagcauuuuauc

SEQ ID NO: 585040 - RNA, 64 nt, Homo Sapiens
ccagaaugauguguuuuucuuucugaagaauggaaacuguuaguaaaucaaaagguggauuauc

SEQ ID NO: 585041 - RNA, 64 nt, Homo Sapiens
gcaguggguccagcccaggcgaccccaaguaggcaacuguuaugcccacuccauccuacccagg

SEQ ID NO: 585042 - RNA, 64 nt, Homo Sapiens
caccuguuugauaaauaguuaaggaguauguuaaaaugaccagagaaugaauauuguucaaagc

SEQ ID NO: 585043 - RNA, 64 nt, Homo Sapiens
uuuaugugguuguuacacuucagaccacaaggguaaugaccaaauggcagacuacuacuaauca

SEQ ID NO: 585044 - RNA, 64 nt, Homo Sapiens
ugagaugcaaaaguucacuguugcaguguuuucaaaugaccaaucaaguacuacuucuugguua

SEQ ID NO: 585045 - RNA, 64 nt, Homo Sapiens
gagccacgcccaaaagagagcucccuuagggaaaaaugaccaaaacacacacacacauuuacaa

SEQ ID NO: 585046 - RNA, 64 nt, Homo Sapiens
uuugcagaaaguaaacugauagaugaccaaugacaaugaccaccaauacaacaguuuagguuua

SEQ ID NO: 585047 - RNA, 64 nt, Homo Sapiens
gccauucacaagaacuuugaugagcaccaccaucaaugaccaccaagccaagacacaucgacaa

SEQ ID NO: 585048 - RNA, 64 nt, Homo Sapiens
uucuuguuaaauaaauuaaaucuuacuuucuuuuaaugaccaaccuuagguaaaacaaaaauau

SEQ ID NO: 585049 - RNA, 64 nt, Homo Sapiens
auaauguaaaggccuuguuuugcuguagcaauaaaaugaccaagugcaaugacuugauuuaaua

SEQ ID NO: 585050 - RNA, 64 nt, Homo Sapiens
uguaggcuuagccaguuuauaacauguuuuucugaaugaccagauuuaauuagcuuuggauuuu

SEQ ID NO: 585051 - RNA, 64 nt, Homo Sapiens
agagcuuguccucauauucauucugaggggguuuaaugaccacugacauucugaaucuuagacu

SEQ ID NO: 585052 - RNA, 64 nt, Homo Sapiens
caaaugguuauaaagucauauccacuucuuccacaaugaccacagcaaaugaccaagcaugaac

SEQ ID NO: 585053 - RNA, 64 nt, Homo Sapiens
agucauauccacuucuuccacaaugaccacagcaaaugaccaagcaugaacuaaagguaaagau

SEQ ID NO: 585054 - RNA, 64 nt, Homo Sapiens
cccuuuuagcucgguaaucucauguaccacagguaaugaccaagcaucucugcuagaggaugua

SEQ ID NO: 585055 - RNA, 64 nt, Homo Sapiens
aaaauaaucucuaaaccauguuagguuaaaacaaaaugaccaucucacaaaaacgaguuuaguu

SEQ ID NO: 585056 - RNA, 64 nt, Homo Sapiens
aauggaugaggagggaaaacucugccaaauggaaaaugaccaaauuuaagagggugggacaguc

SEQ ID NO: 585057 - RNA, 64 nt, Homo Sapiens
guucuccauuuuuuguaguuuugucuaaauuuuuaaugaccauuuccuggaaucaguuuauuau

SEQ ID NO: 585058 - RNA, 64 nt, Homo Sapiens
acacaguacaauugcccuuuauguagggaccccaaaugaccacacaggcugcacaucucaguau

SEQ ID NO: 585059 - RNA, 64 nt, Homo Sapiens
agcccaagguaggggaguuuggcuauacgugacaaaugaccaaaagaaucccggugcccugaga

SEQ ID NO: 585060 - RNA, 64 nt, Homo Sapiens; identical to SEQ ID NO: 389582

SEQ ID NO: 585061 - RNA, 64 nt, Homo Sapiens; identical to SEQ ID NO: 389583

SEQ ID NO: 585062 - RNA, 64 nt, Homo Sapiens; identical to SEQ ID NO: 389584

SEQ ID NO: 585063 - RNA, 64 nt, Homo Sapiens; identical to SEQ ID NO: 389585

SEQ ID NO: 585064 - RNA, 64 nt, Homo Sapiens; identical to SEQ ID NO: 389586

SEQ ID NO: 585065 - RNA, 64 nt, Homo Sapiens; identical to SEQ ID NO: 389587

SEQ ID NO: 585066 - RNA, 64 nt, Homo Sapiens; identical to SEQ ID NO: 180484

SEQ ID NO: 585067 - RNA, 64 nt, Homo Sapiens; identical to SEQ ID NO: 180485

SEQ ID NO: 585068 - RNA, 64 nt, Homo Sapiens; identical to SEQ ID NO: 180486

SEQ ID NO: 585069 - RNA, 64 nt, Homo Sapiens; identical to SEQ ID NO: 180487

SEQ ID NO: 585070 - RNA, 64 nt, Homo Sapiens; identical to SEQ ID NO: 180488

SEQ ID NO: 585071 - RNA, 64 nt, Homo Sapiens; identical to SEQ ID NO: 180489

SEQ ID NO: 585072 - RNA, 64 nt, Homo Sapiens; identical to SEQ ID NO: 180490

SEQ ID NO: 585073 - RNA, 64 nt, Homo Sapiens; identical to SEQ ID NO: 180491

SEQ ID NO: 585074 - RNA, 64 nt, Homo Sapiens; identical to SEQ ID NO: 180492

SEQ ID NO: 585075 - RNA, 64 nt, Homo Sapiens; identical to SEQ ID NO: 180493

SEQ ID NO: 585076 - RNA, 64 nt, Homo Sapiens; identical to SEQ ID NO: 180494

SEQ ID NO: 585077 - RNA, 64 nt, Homo Sapiens; identical to SEQ ID NO: 180495

SEQ ID NO: 585078 - RNA, 64 nt, Homo Sapiens; identical to SEQ ID NO: 180496

SEQ ID NO: 585079 - RNA, 64 nt, Homo Sapiens; identical to SEQ ID NO: 180497

SEQ ID NO: 585080 - RNA, 64 nt, Homo Sapiens; identical to SEQ ID NO: 180498

SEQ ID NO: 585081 - RNA, 64 nt, Homo Sapiens; identical to SEQ ID NO: 180499

SEQ ID NO: 585082 - RNA, 64 nt, Homo Sapiens; identical to SEQ ID NO: 180500

SEQ ID NO: 585083 - RNA, 64 nt, Homo Sapiens; identical to SEQ ID NO: 180501

SEQ ID NO: 585084 - RNA, 64 nt, Homo Sapiens; identical to SEQ ID NO: 180502

SEQ ID NO: 585085 - RNA, 64 nt, Homo Sapiens; identical to SEQ ID NO: 180503

SEQ ID NO: 585086 - RNA, 64 nt, Homo Sapiens; identical to SEQ ID NO: 180504

SEQ ID NO: 585087 - RNA, 64 nt, Homo Sapiens; identical to SEQ ID NO: 180505

SEQ ID NO: 585088 - RNA, 64 nt, Homo Sapiens
auggccccucccccuggggagugcccugugugauggaggcgauacagccccuaccuucagagag

SEQ ID NO: 585089 - RNA, 64 nt, Homo Sapiens
gguacacaggguggaguagggagaagcugccccaggaggcgauguagugguggaaagaagaggc

SEQ ID NO: 585090 - RNA, 64 nt, Homo Sapiens
ccuggccguccaaauagaucccccaggguaccacggaggcgaaggaguuggagguguuuuccag

SEQ ID NO: 585091 - RNA, 64 nt, Homo Sapiens
cugucaucugucccaccugcggugacucgggggaggaggcgaccuauuuauuuauugccuggcc

SEQ ID NO: 585092 - RNA, 64 nt, Homo Sapiens
gaaucagaaauugaggacagccugaggaggaagaggaggcgaggccuucugcugggaaagcagc

SEQ ID NO: 585093 - RNA, 64 nt, Homo Sapiens
guugcagugagccgagauugauugcuugaaccugggaggcgaagugcgaggcugaggcaggaga

SEQ ID NO: 585094 - RNA, 64 nt, Homo Sapiens
cacgagaaucgcuugaaccuaucccagcuacuuuggaggcgaggcgugguggcgggcuccugua

SEQ ID NO: 585095 - RNA, 64 nt, Homo Sapiens
ccagccuuggggggugggggucagaacucuccagggaggcgaugugagcauggggcgcucccac

SEQ ID NO: 585096 - RNA, 64 nt, Homo Sapiens
agaagcugugccacuuggaauaggccuucccagaggaggcgagccuuggcuguguucucugauc

SEQ ID NO: 585097 - RNA, 64 nt, Homo Sapiens
ugcuuccgagagugugcagguggcccuuccccuuggaggcgagaagagagaaugugcugucuau

SEQ ID NO: 585098 - RNA, 64 nt, Homo Sapiens
cucgcgcuacaagaggccacucccagggacccagggaggcgauggccaccccagaggccaccuu

SEQ ID NO: 585099 - RNA, 64 nt, Homo Sapiens
cugcgagucuaauccgggagcggcugcugccagcggaggcgacagcagcguugggagcuccucg

SEQ ID NO: 585100 - RNA, 64 nt, Homo Sapiens
gaucagccccccgcccggcuagccgccccguccgggaggcgaggggcgccucugcccggcugcc

SEQ ID NO: 585101 - RNA, 64 nt, Homo Sapiens
cauaugcugacccugucucugugugguuggguugggaggcgaucagcagauaccauagugaacg

SEQ ID NO: 585102 - RNA, 64 nt, Homo Sapiens
ugguggcacaagggauggggacgcgagggggaggggaggcgaggaacaaggagaaggggcaacu

SEQ ID NO: 585103 - RNA, 64 nt, Homo Sapiens
cagauuaggccuggaguugggcaggaggacagguggaggcgagcguuucagcugaccagaagug

SEQ ID NO: 585104 - RNA, 64 nt, Homo Sapiens
aaacuaaaaugucuuaauggacugaaagguuuaaggaggcgaucuauaaugaugucuuagaggg

SEQ ID NO: 585105 - RNA, 64 nt, Homo Sapiens
ggaucaugggugugaagccugguggggccggcugggaggcgacuguguaauccccaauguuaga

SEQ ID NO: 585106 - RNA, 64 nt, Homo Sapiens
ggcuggcccagaauggccuguugccauagcaacuggaggcgauggggcagugaacagaauaaca

SEQ ID NO: 585107 - RNA, 64 nt, Homo Sapiens
agcaauacaggagaggaugaagggaggagcuccaggaggcgagggaagagcccuagcagggcgg

SEQ ID NO: 585108 - RNA, 64 nt, Homo Sapiens
ucuucuguagggguauggugcgccgcaugacaugggaggcgauggggacgauggacagagacag

SEQ ID NO: 585109 - RNA, 64 nt, Homo Sapiens
aaauguucaaacuguaugcuguuguacaagcucaggaggcgaaucugcagcaacucccacgacu

SEQ ID NO: 585110 - RNA, 64 nt, Homo Sapiens
aagaguaauauuuagcauucccuaccucaggaggggaggcgaggggccaggaauguuugcauga

SEQ ID NO: 585111 - RNA, 64 nt, Homo Sapiens
cagccaggccccugugggugagccagggcuuccuggaggcgaugugugggcagccccucccggc

SEQ ID NO: 585112 - RNA, 64 nt, Homo Sapiens
ugaucaggggagguggggguuuaacaugggugagggaggcgaccucacauacuguguuuuuauu

SEQ ID NO: 585113 - RNA, 64 nt, Homo Sapiens
uaauuuggaugagugugauuccuuuaaagcaagaggaggcgaguaauaugcacagugauuacaa

SEQ ID NO: 585114 - RNA, 64 nt, Homo Sapiens
ugcgguggcuccggccgguuguccuggcacacaaggaggcgaggcuaugcguucgaggccaacc

SEQ ID NO: 585115 - RNA, 64 nt, Homo Sapiens
ugagcuccuugcagagggcccugugcacauccuuggaggcgagauucccaagaacaaaccauuu

SEQ ID NO: 585116 - RNA, 64 nt, Homo Sapiens
ugggaggcugaagcaggagaauugcucaaaccugggaggcgaagauugcagugagcugaaauca

SEQ ID NO: 585117 - RNA, 64 nt, Homo Sapiens
gcacccugcaaaauuugaugccaggacacgcuuuggaggcgauuuaccuguuuucgcaccuacc

SEQ ID NO: 585118 - RNA, 64 nt, Homo Sapiens
gaggcucuguaugaaacagacaagcgccuccacgggaggcgaggggaaggaaagaucaaggaac

SEQ ID NO: 585119 - RNA, 64 nt, Homo Sapiens
cuagaacugcaccagcuuccggcagggaaaucgaggaggcgagaugagagagaggaagacugcu

SEQ ID NO: 585120 - RNA, 64 nt, Homo Sapiens
ucccaggacagcccagagggaggcugccugcgugggaggcgaagccacccaccccucaccuugc

SEQ ID NO: 585121 - RNA, 64 nt, Homo Sapiens
ugggaggcugaggcaggagaaucacuugaacucgggaggcgaagguugcagugagccgagauuu

SEQ ID NO: 585122 - RNA, 64 nt, Homo Sapiens
aauuccaaaagccugagaagagagaaguggagggggaggcgagugugugaauaaaggcucccau

SEQ ID NO: 585123 - RNA, 64 nt, Homo Sapiens
accggacgggugguccggagggaggcuggagcggggaggcgaggagggggcugugaguccucag

SEQ ID NO: 585124 - RNA, 64 nt, Homo Sapiens
aguccaucagcagaaagucaugagucuacaaagaggaggcgacaaccuugacagaaaacuacuu

SEQ ID NO: 585125 - RNA, 64 nt, Homo Sapiens
agugaccccaagucuguuucccucagcugcauaaggaggcgauauaguuugaauauuugucccc

SEQ ID NO: 585126 - RNA, 64 nt, Homo Sapiens
ugugguggcucaugccuguaaucccagcacuuugggaggcgaggcggggguggaucacaagguc

SEQ ID NO: 585127 - RNA, 64 nt, Homo Sapiens
ggugcccaggcagacggguucagccugcagaacuggaggcgaccugugaaacccacccgggcac

SEQ ID NO: 585128 - RNA, 64 nt, Homo Sapiens
aggcccugcaugccuuccugccagccccgagcggggaggcgaggcgucauccaggcugucaaca

SEQ ID NO: 585129 - RNA, 64 nt, Homo Sapiens
ucaggcugguucugccacugugacucacgggcagggaggcgacacgccugcccaggggccgugg

SEQ ID NO: 585130 - RNA, 64 nt, Homo Sapiens
uggaaaggaguugccucuucuccaaucagagcguggaggcgaguugggcgacuucaagggccug

SEQ ID NO: 585131 - RNA, 64 nt, Homo Sapiens
auuuuguuagauuuugccuuucuuuuggaaggaaggaggcgauauucuggauuauaaaaaugaa

SEQ ID NO: 585132 - RNA, 64 nt, Homo Sapiens
cuggacaaccagaggagauacagcugcuuagaaaggaggcgacuccuagauccagggauagccc

SEQ ID NO: 585133 - RNA, 64 nt, Homo Sapiens
gaagucaaauauauccugcaccaccagugcugcaggaggcgacaccugugacugcagcaucuuc

SEQ ID NO: 585134 - RNA, 64 nt, Homo Sapiens
gccugagguuuuccaucuucggcauugggggaagggaggcgaaggguguguguuagggacccag

SEQ ID NO: 585135 - RNA, 64 nt, Homo Sapiens
cauccuggccuccuuugagagccuguggaguucaggaggcgagacucaagccccgcuucuacca

SEQ ID NO: 585136 - RNA, 64 nt, Homo Sapiens
ccuaagcccuuucuaacgagagucucaaacaagcggaggcgagggccaauucaaccccauucuu

SEQ ID NO: 585137 - RNA, 64 nt, Homo Sapiens
gaguggaauuucauucaaaguguuucuggacaauggaggcgaaaaaaacaagcugauaugugcc

SEQ ID NO: 585138 - RNA, 63 nt, Homo Sapiens
ugagcuggcgcagccccgccgcucagcccagguggaggcgagaagcccucucaccccuacuag

SEQ ID NO: 585139 - RNA, 64 nt, Homo Sapiens
acauuugccgcaguggauguguacugagggggcuggaggcgaagggugggagcauagcauagga

SEQ ID NO: 585140 - RNA, 64 nt, Homo Sapiens
ccauagagugggcuuugccaguugcuguugcacaggaggcgagaacagcacacuucaaccccag

SEQ ID NO: 585141 - RNA, 64 nt, Homo Sapiens
cuuccugcgaggucucagaggucuaacaaaggccggaggcgacuaccgcacugucugccccaau

SEQ ID NO: 585142 - RNA, 64 nt, Homo Sapiens
gcaugguggagagggagcugggucgccaggcccaggaggcgacuuagagcaggccccgaacugu

SEQ ID NO: 585143 - RNA, 64 nt, Homo Sapiens
aggguggggagagacgggcccuggugguggcucgggaggcgaagcguuguccucagccccgcgu

SEQ ID NO: 585144 - RNA, 64 nt, Homo Sapiens
uuccagaugagccagugccucgcaugauaccagaggaggcgagggacagagacagcaaggcaga

SEQ ID NO: 585145 - RNA, 64 nt, Homo Sapiens
cccgcagagcaaagguggaagccccaggcccggaggaggcgaagcgucccggcgcuuuccagga

SEQ ID NO: 585146 - RNA, 64 nt, Homo Sapiens
gcagugcccaggggacuucuacugucugggccugggaggcgagagagagaacccaguucuaggu

SEQ ID NO: 585147 - RNA, 64 nt, Homo Sapiens
ggaguguggaagaggagggucaggcugcagaccuggaggcgaaguccauuuugagcaccucugc

SEQ ID NO: 585148 - RNA, 64 nt, Homo Sapiens
caguggauucuuggucaggugugcccacagaugcggaggcgaggugagugauuccaucauuuca

SEQ ID NO: 585149 - RNA, 64 nt, Homo Sapiens
cagcccagccugcucagagaagcuggcaggacugggaggcgacagaugggccccucuuggccuc

SEQ ID NO: 585150 - RNA, 64 nt, Homo Sapiens
cgaggggccuuggccaggacuggcccuguggccaggaggcgagaagguggcuguucccggauug

SEQ ID NO: 585151 - RNA, 64 nt, Homo Sapiens
cugcacacgacagcagauucgcuguccccucguuggaggcgaauggucggaccccgaguggcgg

SEQ ID NO: 585152 - RNA, 64 nt, Homo Sapiens
caaagacuggcguguguggagggaucauggcaugggaggcgacugcacggucguauccaaggga

SEQ ID NO: 585153 - RNA, 64 nt, Homo Sapiens
ccauagucgagcucucccgcugggggcacugcggggaggcgaggccucgggaagcugaauuuuc

SEQ ID NO: 585154 - RNA, 64 nt, Homo Sapiens
cgugggacagaacuccugcccacccuaccccgagggaggcgaacccgcacuuccaggcuuggga

SEQ ID NO: 585155 - RNA, 64 nt, Homo Sapiens
aucaaagccuuaaccuuugcuuuaugcucuugugggaggcgacgggggggcaggcgggagcagg

SEQ ID NO: 585156 - RNA, 64 nt, Homo Sapiens
guggaugugacaacaacuuccaaauuggcucuuuggaggcgagaggaaggggagaacuuggaga

SEQ ID NO: 585157 - RNA, 64 nt, Homo Sapiens
cuuguuggcugccaguaggggcgggaggaaaggcggaggcgagcccuggaggagggaggccaca

SEQ ID NO: 585158 - RNA, 64 nt, Homo Sapiens
ggcccaccccuccccacucccugaucccguagguggaggcgaugggucacgagccauguuaagc

SEQ ID NO: 585159 - RNA, 59 nt, Homo Sapiens
cacuagagaagagucugugagucacuugaggaggcgagucuagcagauucuuucagagg

SEQ ID NO: 585160 - RNA, 64 nt, Homo Sapiens
auuuucacugcuaggacaagucugagcccugcuuggaggcgagcccuggagggcuccagaccuu

SEQ ID NO: 585161 - RNA, 64 nt, Homo Sapiens
cuggcugcaaaagccucaguuugcuuccucugugggaggcgaauaauuuuucauggagggaaaa

SEQ ID NO: 585162 - RNA, 64 nt, Homo Sapiens
guccuaucuagacaucauacgcagcuggacauggggaggcgacaacauaaccuauauaccucca

SEQ ID NO: 585163 - RNA, 64 nt, Homo Sapiens
aaccuauauuuucgccauuugcaguuuaaaauccuaucgugaacacaauaaauugccuuuagca

SEQ ID NO: 585164 - RNA, 64 nt, Homo Sapiens
agugcugccgauuuccugacgacgauuucuccuuuaucgugaccuaauucugugcuugacaaag

SEQ ID NO: 585165 - RNA, 64 nt, Homo Sapiens; identical to SEQ ID NO: 218812

SEQ ID NO: 585166 - RNA, 64 nt, Homo Sapiens; identical to SEQ ID NO: 218813

SEQ ID NO: 585167 - RNA, 64 nt, Homo Sapiens; identical to SEQ ID NO: 218814

SEQ ID NO: 585168 - RNA, 64 nt, Homo Sapiens; identical to SEQ ID NO: 218815

SEQ ID NO: 585169 - RNA, 64 nt, Homo Sapiens; identical to SEQ ID NO: 218816

SEQ ID NO: 585170 - RNA, 64 nt, Homo Sapiens; identical to SEQ ID NO: 218817

SEQ ID NO: 585171 - RNA, 64 nt, Homo Sapiens; identical to SEQ ID NO: 218818

SEQ ID NO: 585172 - RNA, 64 nt, Homo Sapiens; identical to SEQ ID NO: 218819

SEQ ID NO: 585173 - RNA, 64 nt, Homo Sapiens; identical to SEQ ID NO: 218820

SEQ ID NO: 585174 - RNA, 64 nt, Homo Sapiens; identical to SEQ ID NO: 218821

SEQ ID NO: 585175 - RNA, 64 nt, Homo Sapiens; identical to SEQ ID NO: 218822

SEQ ID NO: 585176 - RNA, 64 nt, Homo Sapiens; identical to SEQ ID NO: 218823

SEQ ID NO: 585177 - RNA, 64 nt, Homo Sapiens; identical to SEQ ID NO: 218824

SEQ ID NO: 585178 - RNA, 64 nt, Homo Sapiens; identical to SEQ ID NO: 218825

SEQ ID NO: 585179 - RNA, 64 nt, Homo Sapiens; identical to SEQ ID NO: 218826

SEQ ID NO: 585180 - RNA, 64 nt, Homo Sapiens; identical to SEQ ID NO: 218827

SEQ ID NO: 585181 - RNA, 64 nt, Homo Sapiens; identical to SEQ ID NO: 218828

SEQ ID NO: 585182 - RNA, 64 nt, Homo Sapiens; identical to SEQ ID NO: 218829

SEQ ID NO: 585183 - RNA, 64 nt, Homo Sapiens; identical to SEQ ID NO: 218830

SEQ ID NO: 585184 - RNA, 64 nt, Homo Sapiens; identical to SEQ ID NO: 218831

SEQ ID NO: 585185 - RNA, 64 nt, Homo Sapiens; identical to SEQ ID NO: 218832

SEQ ID NO: 585186 - RNA, 64 nt, Homo Sapiens; identical to SEQ ID NO: 218833

SEQ ID NO: 585187 - RNA, 64 nt, Homo Sapiens; identical to SEQ ID NO: 218834

SEQ ID NO: 585188 - RNA, 64 nt, Homo Sapiens; identical to SEQ ID NO: 218835

SEQ ID NO: 585189 - RNA, 64 nt, Homo Sapiens; identical to SEQ ID NO: 218836

SEQ ID NO: 585190 - RNA, 64 nt, Homo Sapiens; identical to SEQ ID NO: 137985

SEQ ID NO: 585191 - RNA, 64 nt, Homo Sapiens; identical to SEQ ID NO: 137986

SEQ ID NO: 585192 - RNA, 64 nt, Homo Sapiens; identical to SEQ ID NO: 137987

SEQ ID NO: 585193 - RNA, 64 nt, Homo Sapiens; identical to SEQ ID NO: 137988

SEQ ID NO: 585194 - RNA, 64 nt, Homo Sapiens; identical to SEQ ID NO: 137989

SEQ ID NO: 585195 - RNA, 64 nt, Homo Sapiens; identical to SEQ ID NO: 137990

SEQ ID NO: 585196 - RNA, 64 nt, Homo Sapiens; identical to SEQ ID NO: 137991

SEQ ID NO: 585197 - RNA, 64 nt, Homo Sapiens; identical to SEQ ID NO: 137992

SEQ ID NO: 585198 - RNA, 64 nt, Homo Sapiens; identical to SEQ ID NO: 137993

SEQ ID NO: 585199 - RNA, 64 nt, Homo Sapiens; identical to SEQ ID NO: 137994

SEQ ID NO: 585200 - RNA, 64 nt, Homo Sapiens; identical to SEQ ID NO: 137995

SEQ ID NO: 585201 - RNA, 64 nt, Homo Sapiens; identical to SEQ ID NO: 137996

SEQ ID NO: 585202 - RNA, 64 nt, Homo Sapiens; identical to SEQ ID NO: 137997

SEQ ID NO: 585203 - RNA, 64 nt, Homo Sapiens; identical to SEQ ID NO: 137998

SEQ ID NO: 585204 - RNA, 64 nt, Homo Sapiens; identical to SEQ ID NO: 137999

SEQ ID NO: 585205 - RNA, 64 nt, Homo Sapiens; identical to SEQ ID NO: 138000

SEQ ID NO: 585206 - RNA, 64 nt, Homo Sapiens; identical to SEQ ID NO: 138001

SEQ ID NO: 585207 - RNA, 64 nt, Homo Sapiens; identical to SEQ ID NO: 138002

SEQ ID NO: 585208 - RNA, 64 nt, Homo Sapiens; identical to SEQ ID NO: 138003

SEQ ID NO: 585209 - RNA, 64 nt, Homo Sapiens; identical to SEQ ID NO: 138004

SEQ ID NO: 585210 - RNA, 64 nt, Homo Sapiens; identical to SEQ ID NO: 138005

SEQ ID NO: 585211 - RNA, 64 nt, Homo Sapiens; identical to SEQ ID NO: 138006

SEQ ID NO: 585212 - RNA, 64 nt, Homo Sapiens; identical to SEQ ID NO: 138007

SEQ ID NO: 585213 - RNA, 64 nt, Homo Sapiens; identical to SEQ ID NO: 138008

SEQ ID NO: 585214 - RNA, 64 nt, Homo Sapiens; identical to SEQ ID NO: 138009

SEQ ID NO: 585215 - RNA, 64 nt, Homo Sapiens; identical to SEQ ID NO: 138010

SEQ ID NO: 585216 - RNA, 64 nt, Homo Sapiens
cugacuccugagcaggaccugggcccgguucagcuccccacaaggacuucucugucuggagaca

SEQ ID NO: 585217 - RNA, 64 nt, Homo Sapiens
ugccacagcugcagacugagagggugggucugaguccccacaaugucugaagcugccccuggga

SEQ ID NO: 585218 - RNA, 64 nt, Homo Sapiens
ccuguacauccaucccaggacacagcccagccccuccccacaccauacaagguaucagaaaagu

SEQ ID NO: 585219 - RNA, 64 nt, Homo Sapiens
cugccuuugaaaaugcuuccaaaaguagacccuguccccacacaggucaagacuacagagaagg

SEQ ID NO: 585220 - RNA, 64 nt, Homo Sapiens
aggucuccaugcagggggaggaggccugcuucuuuccccacagcucucacgucucccuucuccc

SEQ ID NO: 585221 - RNA, 64 nt, Homo Sapiens
ggaccaccuccuuccugccucauuguaauaaaauuccccacacugaggccuucuugucuucaac

SEQ ID NO: 585222 - RNA, 64 nt, Homo Sapiens
ucaucuugccuuguggcauguuuuaaaaauguuuuccccacaaguccacaaaauuggaagcuuu

SEQ ID NO: 585223 - RNA, 64 nt, Homo Sapiens
ccagugccacugugggugacacucuggccucuacuccccacaccaaaucaggcucaguuccccu

SEQ ID NO: 585224 - RNA, 64 nt, Homo Sapiens
ucucugggcugggcagccgggaagugagucauacuccccacaaguagccacaauggccccccgc

SEQ ID NO: 585225 - RNA, 64 nt, Homo Sapiens
gugcccgguccccacggcgcguugcucccaccuuuccccacagggagcccuugggagaccagcu

SEQ ID NO: 585226 - RNA, 64 nt, Homo Sapiens
cccgcaccaaaggggaaacaaugcaccuggggaguccccacacagggggucgaggguccugcau

SEQ ID NO: 585227 - RNA, 64 nt, Homo Sapiens
ugagcuccagcuucucugagcauccccucugcuguccccacauccugauagccccucugggagc

SEQ ID NO: 585228 - RNA, 64 nt, Homo Sapiens
gcugugcuguagccuguaauuacugacaugaagguccccacacagagucuggauggaggcugcc

SEQ ID NO: 585229 - RNA, 64 nt, Homo Sapiens
ggaauaguccauccccagauagcccggcuuccacuccccacauagccagcuuuuccucaccagg

SEQ ID NO: 585230 - RNA, 64 nt, Homo Sapiens
cuggcgcucggcuccacccccugccgucuucacuuccccacagggggcugaguguccagcacac

SEQ ID NO: 585231 - RNA, 64 nt, Homo Sapiens
aggacacggaggguucagaccccuccucagacccuccccacaucugaaacugccuccccccaac

SEQ ID NO: 585232 - RNA, 64 nt, Homo Sapiens
cagcagcagcagggcccuccucccccaccagcucuccccacagggccccucagcaucauggaga

SEQ ID NO: 585233 - RNA, 64 nt, Homo Sapiens
gcaggagaggcacagagugccuuaagaagugcccuccccacaaugguccugaauuuuacuuugc

SEQ ID NO: 585234 - RNA, 64 nt, Homo Sapiens
uaccccgagucaccggaaaagggagcuuucuaaguccccacauuuucuacuuuugccuucuagg

SEQ ID NO: 585235 - RNA, 64 nt, Homo Sapiens
gaaauacuguauugaauauuuucuucuucuagaauccccacaggcacuuccuucagcaucucac

SEQ ID NO: 585236 - RNA, 64 nt, Homo Sapiens
gacagucacuuccuucagcaauuuaggacuggguuccccacaguggaaagcuaagucuugucuc

SEQ ID NO: 585237 - RNA, 64 nt, Homo Sapiens
ucccauccccacguccccucaucccgucaccucguccccacauccccuugccccgucaccucgu

SEQ ID NO: 585238 - RNA, 64 nt, Homo Sapiens
ccucauccccacguccucucguccccuugucccguccccacauacccucguccccaugucccca

SEQ ID NO: 585239 - RNA, 64 nt, Homo Sapiens
gcagaggaaacaggccagccgccuccuccacuccuccccacagcuguucuucaugagaguacua

SEQ ID NO: 585240 - RNA, 64 nt, Homo Sapiens
ccugcagccaccucccagcacccgcccuccauccuccccacaucgcgagaugagcuggcgcagc

SEQ ID NO: 585241 - RNA, 64 nt, Homo Sapiens
uugcuauguuaauauuugcuaaacaauuguguccuccccacauugaaguagggauauuuuuaua

SEQ ID NO: 585242 - RNA, 64 nt, Homo Sapiens
aucucaccauauccaucuccgcuuucuaacauccuccccacaccagaagugauaaacaccucca

SEQ ID NO: 585243 - RNA, 64 nt, Homo Sapiens
acgcccgagaaagccugggggacccagacaccuguccccacagucaaagccuggggacccagac

SEQ ID NO: 585244 - RNA, 64 nt, Homo Sapiens
cccacagucaaagccuggggacccagacauccuguccccacagucagccuccugucccugcugg

SEQ ID NO: 585245 - RNA, 64 nt, Homo Sapiens
cagcucagagagcaccaucccgggggucagggccuccccacaggagcccugcagugugguagcg

SEQ ID NO: 585246 - RNA, 64 nt, Homo Sapiens
uccacuccggaucgaggccuguauagggcucguuuccccacacaugccuauuucugaagaggcu

SEQ ID NO: 585247 - RNA, 64 nt, Homo Sapiens
cuuuaacaccagguuuauggaaaaugucaggccuuccccacaacuccugucuaacugcugucgc

SEQ ID NO: 585248 - RNA, 64 nt, Homo Sapiens
ccacggggcuccuuucccuccgaagggcugcucuuccccacaggcgcggggacagcagcccgac

SEQ ID NO: 585249 - RNA, 64 nt, Homo Sapiens
acacacaugcaggcggcguggucucccugcucuguccccacacguuccucacauacaggcaaga

SEQ ID NO: 585250 - RNA, 64 nt, Homo Sapiens
acagugcccuccagaagcagcaaaccucacaggguccccacacagccccuuugcccgccuccug

SEQ ID NO: 585251 - RNA, 64 nt, Homo Sapiens
cccagcugccuggcugggucccccaucagccuccuccccacaucaggacagcugccuguuuccu

SEQ ID NO: 585252 - RNA, 64 nt, Homo Sapiens
acccacccagcugcugucauuuccccucagccucuccccacaccgccccccugggggggcugcc

SEQ ID NO: 585253 - RNA, 64 nt, Homo Sapiens
uccaggaacuccacucccagaaaacacgccccccuccccacaccgcugagauuuuucuaaauug

SEQ ID NO: 585254 - RNA, 64 nt, Homo Sapiens
gcauccuccucucaucugugucuuuggggaaagauccccacagacagucccauaaaccuggccc

SEQ ID NO: 585255 - RNA, 64 nt, Homo Sapiens
aagggaaggcagcuggcucugggcuuggucccccuccccacagcggcaccucagugggugggca

SEQ ID NO: 585256 - RNA, 64 nt, Homo Sapiens
aacugcccagccugcuccuggcccccuggaagccuccccacagcugguaaucuggacuuaagga

SEQ ID NO: 585257 - RNA, 64 nt, Homo Sapiens
ccauggcugggaggggccucugaacggaacaguguccccacagagcgaauaaagccaaggcuuc

SEQ ID NO: 585258 - RNA, 64 nt, Homo Sapiens
ccagccaucgccgcccgcucccgccgggagucuuuccccacaccugacguucgugauguccugc

SEQ ID NO: 585259 - RNA, 64 nt, Homo Sapiens
cggggcagaggcccuucucuacccaagcccugcauccccacauguacgagcaagugccggcugg

SEQ ID NO: 585260 - RNA, 64 nt, Homo Sapiens
cacagaaauuugugaucugaaaacccggcucccuuccccacaaggcuccugggccuccgggaag

SEQ ID NO: 585261 - RNA, 64 nt, Homo Sapiens
uucuugguucuuugagcucguuucagaggcugaguccccacaucagcuuuaguucuuggacuuc

SEQ ID NO: 585262 - RNA, 64 nt, Homo Sapiens
ugauacggcauccugcgagacacacccauagcucuccccacagcggcccccgaagaauggaacc

SEQ ID NO: 585263 - RNA, 64 nt, Homo Sapiens
cuagaauucucccaacauuuacauucuggaauccuccccacauuaauauucuaguacuuucuga

SEQ ID NO: 585264 - RNA, 64 nt, Homo Sapiens
gaugacaacagcaucaugaccuucaaccucagucagcucccaggguugcuagagcuccuuguag

SEQ ID NO: 585265 - RNA, 64 nt, Homo Sapiens
uggauccugggagguucagcaaggugucuaguccagcucccauggaggguggggaagaagaaga

SEQ ID NO: 585266 - RNA, 64 nt, Homo Sapiens
gcucugagccaagggugaggauggggaaacucuaagcucccaccuaauaagaagcauaggcaga

SEQ ID NO: 585267 - RNA, 64 nt, Homo Sapiens
uauugagcagaaaaugaguuggauggagauaaacagcucccaucccuggguaauggaugguaag

SEQ ID NO: 585268 - RNA, 64 nt, Homo Sapiens
gaaauucccagaccuguaccuguggcuuggggccagcucccaggacuacggagcuggggagggc

SEQ ID NO: 585269 - RNA, 64 nt, Homo Sapiens
agauaaccucuccuccugggggguuuccuggaagagcucccagaccugaauucuccaaggacuc

SEQ ID NO: 585270 - RNA, 64 nt, Homo Sapiens
uguugugggugucucagcucugagggucuuugugagcucccacuguugugggugucucagcucu

SEQ ID NO: 585271 - RNA, 64 nt, Homo Sapiens; identical to SEQ ID NO: 585270

SEQ ID NO: 585272 - RNA, 64 nt, Homo Sapiens
ucuacucucccauggcuuaacucuuaaguuucucagcucccauucuucucagcucccauuucua

SEQ ID NO: 585273 - RNA, 64 nt, Homo Sapiens
ucuacucuuaaguuucucagcacuucaucuucucagcucccauucggguuugaggauaggaguu

SEQ ID NO: 585274 - RNA, 64 nt, Homo Sapiens
gccacaaacuccauccagauccggaacgucagccagcucccagccacauggcgcaugaaggaga

SEQ ID NO: 585275 - RNA, 64 nt, Homo Sapiens
uucucacucucccuggagcugcucuccuaucagaagcucccagcugaccagacacugccugggg

SEQ ID NO: 585276 - RNA, 64 nt, Homo Sapiens
acuggcuccacccuggggccgccuagcuggacacagcucccagaugccauuuggggucacagau

SEQ ID NO: 585277 - RNA, 64 nt, Homo Sapiens
ggcaggccaggcauggcucaucgguuuguggucuagcucccagggacccacgagcagggcugcg

SEQ ID NO: 585278 - RNA, 64 nt, Homo Sapiens
ggaaacucuugaccaccaguccccuuucccugggagcucccagaagcagggcugaacuggggag

SEQ ID NO: 585279 - RNA, 64 nt, Homo Sapiens
uggcccauuccagggccucacccagccgccggccagcucccaaauggccggccggccccccucc

SEQ ID NO: 585280 - RNA, 64 nt, Homo Sapiens
guccaggacucagaccggggaggcccgggccagcagcucccagugugaccugacaaaaacacgu

SEQ ID NO: 585281 - RNA, 64 nt, Homo Sapiens
uuuuccguacugugaagaaagaacucuccaccccagcucccacccugcccuggccuggguggag

SEQ ID NO: 585282 - RNA, 64 nt, Homo Sapiens
ccggccccccacccgcagccggccacacuggagcagcucccagcacagccuuacgcgcccgacg

SEQ ID NO: 585283 - RNA, 64 nt, Homo Sapiens
acagccuuugacguccaccccacgcugaugcagaagcucccagaacacucaggaaacuucuccg

SEQ ID NO: 585284 - RNA, 64 nt, Homo Sapiens
accaggacccacuggggcaucggcuucccaguugagcucccaagaaaucucugcuguauccuuu

SEQ ID NO: 585285 - RNA, 64 nt, Homo Sapiens
accaggacccacuggggcaucggcuucccaguugagcucccaagccuucucugcuguguccuuu

SEQ ID NO: 585286 - RNA, 64 nt, Homo Sapiens
acaugcaguggcccagggcauucugccugaccagagcucccacuggaccugcuuuucaaaagac

SEQ ID NO: 585287 - RNA, 64 nt, Homo Sapiens
uccaucuucauccauggccacgaaauuuacucugagcucccaguucgugguuuccuguuuucag

SEQ ID NO: 585288 - RNA, 64 nt, Homo Sapiens
gcugcugggaggacauggucuuaaaggaguccgcagcucccacgcgguuagaaaugugccaggg

SEQ ID NO: 585289 - RNA, 64 nt, Homo Sapiens
uaaaaacaaaauacuuuuuaaggcagaguuugaaagcucccauuagaugagagaagccugaaaa

SEQ ID NO: 585290 - RNA, 64 nt, Homo Sapiens
cuaccagagcaccugucccucggccgccugguacagcucccacucucagcaggugacacucgcg

SEQ ID NO: 585291 - RNA, 64 nt, Homo Sapiens
guguaaacacacgugcacacaucguacacaugugagcucccacacguacacacagaugcacaug

SEQ ID NO: 585292 - RNA, 64 nt, Homo Sapiens
cuacacacaugcacacacguguacaccacaaacgagcucccagacauguaaacacacgucuccc

SEQ ID NO: 585293 - RNA, 64 nt, Homo Sapiens
ucccagacauguaaacacacgucucccacacgugagcucccacacguacacaugcacauguacg

SEQ ID NO: 585294 - RNA, 64 nt, Homo Sapiens
ugaccccagccccugccccuggacaccugcugacagcucccacacagaacagucugaggugaug

SEQ ID NO: 585295 - RNA, 64 nt, Homo Sapiens
caguggacaggaagacuucucauccuugaauucuagcucccauuccaaacuguuaguccccaac

SEQ ID NO: 585296 - RNA, 64 nt, Homo Sapiens
aagagaugccucauuuuagaaccaccaacaagcaagcucccaagggauggugcccuguucucua

SEQ ID NO: 585297 - RNA, 64 nt, Homo Sapiens
ugaagccaaagccaauaacacacagcuaacacacagcucccauaaccgcugauucucagggucu

SEQ ID NO: 585298 - RNA, 64 nt, Homo Sapiens
uccuuuggaaagggacagggcugcagagcacugcagcucccagcgugagagcuaguggccacag

SEQ ID NO: 585299 - RNA, 64 nt, Homo Sapiens
aggcccuaagucuggcuucauguccuuggguaacagcucccagcccuuagcccccauaucuggc

SEQ ID NO: 585300 - RNA, 64 nt, Homo Sapiens; identical to SEQ ID NO: 239468

SEQ ID NO: 585301 - RNA, 64 nt, Homo Sapiens; identical to SEQ ID NO: 239469

SEQ ID NO: 585302 - RNA, 64 nt, Homo Sapiens; identical to SEQ ID NO: 239470

SEQ ID NO: 585303 - RNA, 64 nt, Homo Sapiens; identical to SEQ ID NO: 239471

SEQ ID NO: 585304 - RNA, 64 nt, Homo Sapiens; identical to SEQ ID NO: 239472

SEQ ID NO: 585305 - RNA, 64 nt, Homo Sapiens; identical to SEQ ID NO: 239473

SEQ ID NO: 585306 - RNA, 64 nt, Homo Sapiens; identical to SEQ ID NO: 239474

SEQ ID NO: 585307 - RNA, 64 nt, Homo Sapiens; identical to SEQ ID NO: 239475

SEQ ID NO: 585308 - RNA, 64 nt, Homo Sapiens; identical to SEQ ID NO: 239476

SEQ ID NO: 585309 - RNA, 64 nt, Homo Sapiens; identical to SEQ ID NO: 239477

SEQ ID NO: 585310 - RNA, 64 nt, Homo Sapiens; identical to SEQ ID NO: 239478

SEQ ID NO: 585311 - RNA, 64 nt, Homo Sapiens; identical to SEQ ID NO: 239479

SEQ ID NO: 585312 - RNA, 64 nt, Homo Sapiens; identical to SEQ ID NO: 239480

SEQ ID NO: 585313 - RNA, 64 nt, Homo Sapiens; identical to SEQ ID NO: 239481

SEQ ID NO: 585314 - RNA, 64 nt, Homo Sapiens; identical to SEQ ID NO: 239482

SEQ ID NO: 585315 - RNA, 64 nt, Homo Sapiens; identical to SEQ ID NO: 239483

SEQ ID NO: 585316 - RNA, 64 nt, Homo Sapiens; identical to SEQ ID NO: 239484

SEQ ID NO: 585317 - RNA, 64 nt, Homo Sapiens; identical to SEQ ID NO: 239485

SEQ ID NO: 585318 - RNA, 64 nt, Homo Sapiens; identical to SEQ ID NO: 239486

SEQ ID NO: 585319 - RNA, 64 nt, Homo Sapiens; identical to SEQ ID NO: 239487

SEQ ID NO: 585320 - RNA, 64 nt, Homo Sapiens; identical to SEQ ID NO: 239488

SEQ ID NO: 585321 - RNA, 64 nt, Homo Sapiens; identical to SEQ ID NO: 239489

SEQ ID NO: 585322 - RNA, 64 nt, Homo Sapiens; identical to SEQ ID NO: 239490

SEQ ID NO: 585323 - RNA, 64 nt, Homo Sapiens; identical to SEQ ID NO: 239491

SEQ ID NO: 585324 - RNA, 64 nt, Homo Sapiens; identical to SEQ ID NO: 239492

SEQ ID NO: 585325 - RNA, 64 nt, Homo Sapiens; identical to SEQ ID NO: 239493

SEQ ID NO: 585326 - RNA, 64 nt, Homo Sapiens; identical to SEQ ID NO: 239494

SEQ ID NO: 585327 - RNA, 64 nt, Homo Sapiens; identical to SEQ ID NO: 239495

SEQ ID NO: 585328 - RNA, 64 nt, Homo Sapiens; identical to SEQ ID NO: 239496

SEQ ID NO: 585329 - RNA, 64 nt, Homo Sapiens; identical to SEQ ID NO: 239497

SEQ ID NO: 585330 - RNA, 64 nt, Homo Sapiens; identical to SEQ ID NO: 239498

SEQ ID NO: 585331 - RNA, 64 nt, Homo Sapiens; identical to SEQ ID NO: 239499

SEQ ID NO: 585332 - RNA, 64 nt, Homo Sapiens; identical to SEQ ID NO: 239500

SEQ ID NO: 585333 - RNA, 64 nt, Homo Sapiens; identical to SEQ ID NO: 239501

SEQ ID NO: 585334 - RNA, 64 nt, Homo Sapiens; identical to SEQ ID NO: 239502

SEQ ID NO: 585335 - RNA, 64 nt, Homo Sapiens; identical to SEQ ID NO: 239503

SEQ ID NO: 585336 - RNA, 64 nt, Homo Sapiens; identical to SEQ ID NO: 239504

SEQ ID NO: 585337 - RNA, 64 nt, Homo Sapiens; identical to SEQ ID NO: 239505

SEQ ID NO: 585338 - RNA, 64 nt, Homo Sapiens; identical to SEQ ID NO: 239506

SEQ ID NO: 585339 - RNA, 64 nt, Homo Sapiens; identical to SEQ ID NO: 239507

SEQ ID NO: 585340 - RNA, 64 nt, Homo Sapiens; identical to SEQ ID NO: 239508

SEQ ID NO: 585341 - RNA, 64 nt, Homo Sapiens; identical to SEQ ID NO: 239509

SEQ ID NO: 585342 - RNA, 64 nt, Homo Sapiens; identical to SEQ ID NO: 239510

SEQ ID NO: 585343 - RNA, 64 nt, Homo Sapiens; identical to SEQ ID NO: 239511

SEQ ID NO: 585344 - RNA, 64 nt, Homo Sapiens; identical to SEQ ID NO: 239512

SEQ ID NO: 585345 - RNA, 64 nt, Homo Sapiens; identical to SEQ ID NO: 239513

SEQ ID NO: 585346 - RNA, 64 nt, Homo Sapiens; identical to SEQ ID NO: 239514

SEQ ID NO: 585347 - RNA, 64 nt, Homo Sapiens; identical to SEQ ID NO: 257854

SEQ ID NO: 585348 - RNA, 64 nt, Homo Sapiens; identical to SEQ ID NO: 257855

SEQ ID NO: 585349 - RNA, 64 nt, Homo Sapiens; identical to SEQ ID NO: 257856

SEQ ID NO: 585350 - RNA, 64 nt, Homo Sapiens; identical to SEQ ID NO: 257857

SEQ ID NO: 585351 - RNA, 64 nt, Homo Sapiens; identical to SEQ ID NO: 257858

SEQ ID NO: 585352 - RNA, 64 nt, Homo Sapiens; identical to SEQ ID NO: 257859

SEQ ID NO: 585353 - RNA, 64 nt, Homo Sapiens; identical to SEQ ID NO: 257860

SEQ ID NO: 585354 - RNA, 64 nt, Homo Sapiens; identical to SEQ ID NO: 257861

SEQ ID NO: 585355 - RNA, 64 nt, Homo Sapiens; identical to SEQ ID NO: 257862

SEQ ID NO: 585356 - RNA, 64 nt, Homo Sapiens; identical to SEQ ID NO: 257863

SEQ ID NO: 585357 - RNA, 64 nt, Homo Sapiens; identical to SEQ ID NO: 257864

SEQ ID NO: 585358 - RNA, 64 nt, Homo Sapiens; identical to SEQ ID NO: 257865

SEQ ID NO: 585359 - RNA, 64 nt, Homo Sapiens; identical to SEQ ID NO: 257866

SEQ ID NO: 585360 - RNA, 64 nt, Homo Sapiens; identical to SEQ ID NO: 257867

SEQ ID NO: 585361 - RNA, 64 nt, Homo Sapiens; identical to SEQ ID NO: 257868

SEQ ID NO: 585362 - RNA, 64 nt, Homo Sapiens; identical to SEQ ID NO: 257869

SEQ ID NO: 585363 - RNA, 64 nt, Homo Sapiens; identical to SEQ ID NO: 257870

SEQ ID NO: 585364 - RNA, 64 nt, Homo Sapiens; identical to SEQ ID NO: 257871

SEQ ID NO: 585365 - RNA, 64 nt, Homo Sapiens; identical to SEQ ID NO: 257872

SEQ ID NO: 585366 - RNA, 64 nt, Homo Sapiens; identical to SEQ ID NO: 257873

SEQ ID NO: 585367 - RNA, 64 nt, Homo Sapiens; identical to SEQ ID NO: 257874

SEQ ID NO: 585368 - RNA, 64 nt, Homo Sapiens; identical to SEQ ID NO: 257875

SEQ ID NO: 585369 - RNA, 64 nt, Homo Sapiens; identical to SEQ ID NO: 257876

SEQ ID NO: 585370 - RNA, 64 nt, Homo Sapiens; identical to SEQ ID NO: 257877

SEQ ID NO: 585371 - RNA, 64 nt, Homo Sapiens; identical to SEQ ID NO: 257878

SEQ ID NO: 585372 - RNA, 64 nt, Homo Sapiens; identical to SEQ ID NO: 257879

SEQ ID NO: 585373 - RNA, 64 nt, Homo Sapiens; identical to SEQ ID NO: 257880

SEQ ID NO: 585374 - RNA, 64 nt, Homo Sapiens; identical to SEQ ID NO: 257881

SEQ ID NO: 585375 - RNA, 64 nt, Homo Sapiens; identical to SEQ ID NO: 257882

SEQ ID NO: 585376 - RNA, 64 nt, Homo Sapiens; identical to SEQ ID NO: 257883

SEQ ID NO: 585377 - RNA, 64 nt, Homo Sapiens; identical to SEQ ID NO: 360935

SEQ ID NO: 585378 - RNA, 64 nt, Homo Sapiens; identical to SEQ ID NO: 360936

SEQ ID NO: 585379 - RNA, 64 nt, Homo Sapiens; identical to SEQ ID NO: 360937

SEQ ID NO: 585380 - RNA, 64 nt, Homo Sapiens; identical to SEQ ID NO: 360938

SEQ ID NO: 585381 - RNA, 64 nt, Homo Sapiens; identical to SEQ ID NO: 360939

SEQ ID NO: 585382 - RNA, 64 nt, Homo Sapiens; identical to SEQ ID NO: 360940

SEQ ID NO: 585383 - RNA, 64 nt, Homo Sapiens; identical to SEQ ID NO: 360941

SEQ ID NO: 585384 - RNA, 64 nt, Homo Sapiens; identical to SEQ ID NO: 360942

SEQ ID NO: 585385 - RNA, 64 nt, Homo Sapiens; identical to SEQ ID NO: 360943

SEQ ID NO: 585386 - RNA, 64 nt, Homo Sapiens; identical to SEQ ID NO: 360944

SEQ ID NO: 585387 - RNA, 64 nt, Homo Sapiens; identical to SEQ ID NO: 360945

SEQ ID NO: 585388 - RNA, 64 nt, Homo Sapiens; identical to SEQ ID NO: 360946

SEQ ID NO: 585389 - RNA, 64 nt, Homo Sapiens; identical to SEQ ID NO: 360947

SEQ ID NO: 585390 - RNA, 64 nt, Homo Sapiens; identical to SEQ ID NO: 360948

SEQ ID NO: 585391 - RNA, 64 nt, Homo Sapiens; identical to SEQ ID NO: 360949

SEQ ID NO: 585392 - RNA, 64 nt, Homo Sapiens; identical to SEQ ID NO: 360950

SEQ ID NO: 585393 - RNA, 64 nt, Homo Sapiens; identical to SEQ ID NO: 360951

SEQ ID NO: 585394 - RNA, 64 nt, Homo Sapiens; identical to SEQ ID NO: 360952

SEQ ID NO: 585395 - RNA, 64 nt, Homo Sapiens; identical to SEQ ID NO: 360953

SEQ ID NO: 585396 - RNA, 64 nt, Homo Sapiens; identical to SEQ ID NO: 360954

SEQ ID NO: 585397 - RNA, 64 nt, Homo Sapiens; identical to SEQ ID NO: 360955

SEQ ID NO: 585398 - RNA, 64 nt, Homo Sapiens; identical to SEQ ID NO: 360956

SEQ ID NO: 585399 - RNA, 64 nt, Homo Sapiens; identical to SEQ ID NO: 360957

SEQ ID NO: 585400 - RNA, 64 nt, Homo Sapiens; identical to SEQ ID NO: 360958

SEQ ID NO: 585401 - RNA, 52 nt, Homo Sapiens; identical to SEQ ID NO: 360959

SEQ ID NO: 585402 - RNA, 64 nt, Homo Sapiens; identical to SEQ ID NO: 360960

SEQ ID NO: 585403 - RNA, 64 nt, Homo Sapiens; identical to SEQ ID NO: 360961

SEQ ID NO: 585404 - RNA, 64 nt, Homo Sapiens; identical to SEQ ID NO: 360962

SEQ ID NO: 585405 - RNA, 64 nt, Homo Sapiens; identical to SEQ ID NO: 360963

SEQ ID NO: 585406 - RNA, 64 nt, Homo Sapiens; identical to SEQ ID NO: 360964

SEQ ID NO: 585407 - RNA, 64 nt, Homo Sapiens; identical to SEQ ID NO: 360965

SEQ ID NO: 585408 - RNA, 64 nt, Homo Sapiens; identical to SEQ ID NO: 360966

SEQ ID NO: 585409 - RNA, 64 nt, Homo Sapiens; identical to SEQ ID NO: 360967

SEQ ID NO: 585410 - RNA, 64 nt, Homo Sapiens; identical to SEQ ID NO: 360968

SEQ ID NO: 585411 - RNA, 64 nt, Homo Sapiens; identical to SEQ ID NO: 360969

SEQ ID NO: 585412 - RNA, 64 nt, Homo Sapiens; identical to SEQ ID NO: 360970

SEQ ID NO: 585413 - RNA, 64 nt, Homo Sapiens; identical to SEQ ID NO: 360971

SEQ ID NO: 585414 - RNA, 64 nt, Homo Sapiens; identical to SEQ ID NO: 360972

SEQ ID NO: 585415 - RNA, 64 nt, Homo Sapiens; identical to SEQ ID NO: 360973

SEQ ID NO: 585416 - RNA, 64 nt, Homo Sapiens; identical to SEQ ID NO: 360974

SEQ ID NO: 585417 - RNA, 64 nt, Homo Sapiens; identical to SEQ ID NO: 360975

SEQ ID NO: 585418 - RNA, 64 nt, Homo Sapiens; identical to SEQ ID NO: 360976

SEQ ID NO: 585419 - RNA, 64 nt, Homo Sapiens; identical to SEQ ID NO: 360977

SEQ ID NO: 585420 - RNA, 64 nt, Homo Sapiens; identical to SEQ ID NO: 360978

SEQ ID NO: 585421 - RNA, 64 nt, Homo Sapiens; identical to SEQ ID NO: 360979

SEQ ID NO: 585422 - RNA, 64 nt, Homo Sapiens; identical to SEQ ID NO: 360980

SEQ ID NO: 585423 - RNA, 64 nt, Homo Sapiens; identical to SEQ ID NO: 360981

SEQ ID NO: 585424 - RNA, 64 nt, Homo Sapiens; identical to SEQ ID NO: 360982

SEQ ID NO: 585425 - RNA, 64 nt, Homo Sapiens; identical to SEQ ID NO: 360983

SEQ ID NO: 585426 - RNA, 64 nt, Homo Sapiens; identical to SEQ ID NO: 360984

SEQ ID NO: 585427 - RNA, 64 nt, Homo Sapiens; identical to SEQ ID NO: 360985

SEQ ID NO: 585428 - RNA, 64 nt, Homo Sapiens; identical to SEQ ID NO: 360986

SEQ ID NO: 585429 - RNA, 64 nt, Homo Sapiens; identical to SEQ ID NO: 360987

SEQ ID NO: 585430 - RNA, 64 nt, Homo Sapiens; identical to SEQ ID NO: 360988

SEQ ID NO: 585431 - RNA, 64 nt, Homo Sapiens; identical to SEQ ID NO: 360989

SEQ ID NO: 585432 - RNA, 64 nt, Homo Sapiens; identical to SEQ ID NO: 360990

SEQ ID NO: 585433 - RNA, 64 nt, Homo Sapiens; identical to SEQ ID NO: 360991

SEQ ID NO: 585434 - RNA, 64 nt, Homo Sapiens; identical to SEQ ID NO: 360992

SEQ ID NO: 585435 - RNA, 64 nt, Homo Sapiens; identical to SEQ ID NO: 360993

SEQ ID NO: 585436 - RNA, 64 nt, Homo Sapiens; identical to SEQ ID NO: 360994

SEQ ID NO: 585437 - RNA, 64 nt, Homo Sapiens; identical to SEQ ID NO: 360995

SEQ ID NO: 585438 - RNA, 64 nt, Homo Sapiens; identical to SEQ ID NO: 528631

SEQ ID NO: 585439 - RNA, 64 nt, Homo Sapiens; identical to SEQ ID NO: 528632

SEQ ID NO: 585440 - RNA, 64 nt, Homo Sapiens; identical to SEQ ID NO: 528633

SEQ ID NO: 585441 - RNA, 64 nt, Homo Sapiens; identical to SEQ ID NO: 528634

SEQ ID NO: 585442 - RNA, 64 nt, Homo Sapiens; identical to SEQ ID NO: 528635

SEQ ID NO: 585443 - RNA, 64 nt, Homo Sapiens; identical to SEQ ID NO: 528636

SEQ ID NO: 585444 - RNA, 64 nt, Homo Sapiens; identical to SEQ ID NO: 528637

SEQ ID NO: 585445 - RNA, 64 nt, Homo Sapiens; identical to SEQ ID NO: 528638

SEQ ID NO: 585446 - RNA, 64 nt, Homo Sapiens; identical to SEQ ID NO: 528639

SEQ ID NO: 585447 - RNA, 64 nt, Homo Sapiens; identical to SEQ ID NO: 528640

SEQ ID NO: 585448 - RNA, 64 nt, Homo Sapiens; identical to SEQ ID NO: 528641

SEQ ID NO: 585449 - RNA, 64 nt, Homo Sapiens; identical to SEQ ID NO: 528642

SEQ ID NO: 585450 - RNA, 64 nt, Homo Sapiens; identical to SEQ ID NO: 528643

SEQ ID NO: 585451 - RNA, 64 nt, Homo Sapiens; identical to SEQ ID NO: 528644

SEQ ID NO: 585452 - RNA, 64 nt, Homo Sapiens; identical to SEQ ID NO: 528645

SEQ ID NO: 585453 - RNA, 64 nt, Homo Sapiens; identical to SEQ ID NO: 528646

SEQ ID NO: 585454 - RNA, 64 nt, Homo Sapiens; identical to SEQ ID NO: 528647

SEQ ID NO: 585455 - RNA, 64 nt, Homo Sapiens; identical to SEQ ID NO: 528648

SEQ ID NO: 585456 - RNA, 64 nt, Homo Sapiens; identical to SEQ ID NO: 528649

SEQ ID NO: 585457 - RNA, 64 nt, Homo Sapiens; identical to SEQ ID NO: 528650

SEQ ID NO: 585458 - RNA, 64 nt, Homo Sapiens; identical to SEQ ID NO: 528651

SEQ ID NO: 585459 - RNA, 64 nt, Homo Sapiens; identical to SEQ ID NO: 528652

SEQ ID NO: 585460 - RNA, 64 nt, Homo Sapiens; identical to SEQ ID NO: 528653

SEQ ID NO: 585461 - RNA, 64 nt, Homo Sapiens; identical to SEQ ID NO: 528654

SEQ ID NO: 585462 - RNA, 57 nt, Homo Sapiens; identical to SEQ ID NO: 528655

SEQ ID NO: 585463 - RNA, 64 nt, Homo Sapiens; identical to SEQ ID NO: 528656

SEQ ID NO: 585464 - RNA, 64 nt, Homo Sapiens; identical to SEQ ID NO: 528657

SEQ ID NO: 585465 - RNA, 64 nt, Homo Sapiens; identical to SEQ ID NO: 528658

SEQ ID NO: 585466 - RNA, 64 nt, Homo Sapiens; identical to SEQ ID NO: 528659

SEQ ID NO: 585467 - RNA, 64 nt, Homo Sapiens; identical to SEQ ID NO: 528660

SEQ ID NO: 585468 - RNA, 64 nt, Homo Sapiens
gugacuacacacaguacgaaccuacaguuuuaacuguggauauuguuacguagccuaaggcucc

SEQ ID NO: 585469 - RNA, 64 nt, Homo Sapiens
gcauuguaaaauuauuucaugauuagaaauuaccuguggauauuuguauaaaagugugaaauaa

SEQ ID NO: 585470 - RNA, 64 nt, Homo Sapiens
acaaaguaaaguuuucaauacaaauucuuugccuuguggauaucaagaaaucccaaaauauuuu

SEQ ID NO: 585471 - RNA, 64 nt, Homo Sapiens
auuuuuuaagaaggcaguuugucaauuuuaaucuuguggauaccuuuauacucuuaggguauua

SEQ ID NO: 585472 - RNA, 64 nt, Homo Sapiens
gcaucaauuuuauacagggauauaaaaaaguauauguggauaaauuuuuuguaaucuuuaggga

SEQ ID NO: 585473 - RNA, 64 nt, Homo Sapiens
uuuuuuguaaucuuuagggauauaaaaaaguguauguggauaaauuuuuuguaaucuuuauuuu

SEQ ID NO: 585474 - RNA, 64 nt, Homo Sapiens
ccaguguuuccucaucauugauuauugggcuagcuguggauagcuugcauuaauuguauauuuu

SEQ ID NO: 585475 - RNA, 64 nt, Homo Sapiens
guaugguguuuuuacacuacaaagaagucccccauguggauauuucuuauacuaauuguaucau

SEQ ID NO: 585476 - RNA, 64 nt, Homo Sapiens
uauacugcauccccuaccacaauuuacacaauccuguggauaguccuaccucacccuggucaac

SEQ ID NO: 585477 - RNA, 64 nt, Homo Sapiens
ccacaaaguggcucaggcuuuaaaaaaaaaacacuguggauaaugacaaaaagcauaaguaaaa

SEQ ID NO: 585478 - RNA, 62 nt, Homo Sapiens
uaagucuuuuaccaaaagugucuguacagcagccauccaaguugccccuacuuaguggcuug

SEQ ID NO: 585479 - RNA, 62 nt, Homo Sapiens
aaguuggcugagccauugagugcugggggaggccauccaagauggcaugaaucgggcuaagg

SEQ ID NO: 585480 - RNA, 62 nt, Homo Sapiens
cuccgcacucaccugccgggacccucccuauuccauccaagggaagcagaacugccaaagac

SEQ ID NO: 585481 - RNA, 62 nt, Homo Sapiens
aggaacuaaccuaccccaacucugcccuucucccauccaagagaaaccagcaaaaugauaaa

SEQ ID NO: 585482 - RNA, 62 nt, Homo Sapiens
gccugaugugguacgucccuccacccccggacccauccaagucaucugauugaagagcauga

SEQ ID NO: 585483 - RNA, 62 nt, Homo Sapiens
uuaugaccuaaaucuaauuuacuuccacugaaccauccaagaccucuggcaggcagggaaau

SEQ ID NO: 585484 - RNA, 62 nt, Homo Sapiens
auuuuuucuugguaggaaaaauuauacugaacccauccaaaccugaagucacagaugaugug

SEQ ID NO: 585485 - RNA, 62 nt, Homo Sapiens
cuucaauccugaacgucacugacuugcugugaccauccaaauaauuuuccugucucugccuc

SEQ ID NO: 585486 - RNA, 62 nt, Homo Sapiens
uuucugaaaaccuaccauguuucuuuacagagccauccaaaaauuuuuugucccuacauagc

SEQ ID NO: 585487 - RNA, 62 nt, Homo Sapiens
ggucaguggucugugccaaccaaacgauagccccauccaagccagcugagaaccuaggaagg

SEQ ID NO: 585488 - RNA, 62 nt, Homo Sapiens
guuaggacaugcuaucaguaauagucccaguuccauccaacuuucugaaauuucauuuuuuu

SEQ ID NO: 585489 - RNA, 62 nt, Homo Sapiens
ucacgcucgcgugcuucggaaccggcccgccuccauccaaaaccggcagcagcuaggcaguc

SEQ ID NO: 585490 - RNA, 62 nt, Homo Sapiens
ggcacauaggcuacccaagacuuguucacauaccauccaagaaucugcaguuucaucccuac

SEQ ID NO: 585491 - RNA, 62 nt, Homo Sapiens
ccaccuucugcagcaaaaggauacuacuuuagccauccaaggugguuaauugcuaagaguaa

SEQ ID NO: 585492 - RNA, 62 nt, Homo Sapiens
ccuguuuagcuucuuccuccaguagaccgaaaccauccaaaaagauuugauaagcuagaugc

SEQ ID NO: 585493 - RNA, 62 nt, Homo Sapiens
ggccaccgcagcauuggcccauucacccaggaccauccaaggucugaaugccgagucccuga

SEQ ID NO: 585494 - RNA, 62 nt, Homo Sapiens
ucaugccaguucccuucuuuuugaucauuaagccauccaacuucucucuuaccuuuagcugc

SEQ ID NO: 585495 - RNA, 62 nt, Homo Sapiens
aaugauaaagucuauucaucugacuggacaaaccauccaaauguugaaccuaaagaaaugga

SEQ ID NO: 585496 - RNA, 62 nt, Homo Sapiens
cuuucuuucuuuuuuuuuaaauuuuguauuuuccauccaacagcaguguguagagagaauau

SEQ ID NO: 585497 - RNA, 62 nt, Homo Sapiens
aaugccagggacagugugcucaguaaagucuuccauccaaaaggggcagggcacgguggcuc

SEQ ID NO: 585498 - RNA, 62 nt, Homo Sapiens
uaugguagaauuuuauaaacacauacaugauaccauccaaauucuugcuuuuaauaacaaag

SEQ ID NO: 585499 - RNA, 62 nt, Homo Sapiens
ccagguucuccguuagcucccucugagcgccuccauccaaggggugucuugggcagagcugg

SEQ ID NO: 585500 - RNA, 62 nt, Homo Sapiens
gacuccugggauggggcagcacgucaggcugcccauccaauagaccaugagugacaaccauc

SEQ ID NO: 585501 - RNA, 62 nt, Homo Sapiens
caaauuccuccuucaaccuuacugaccugcauccauccaaaaaguuaaguauagcaauucaa

SEQ ID NO: 585502 - RNA, 62 nt, Homo Sapiens
ggaaauuccccuuucuugguggacacuauugaccauccaaaugucuuguccuuggcagaacu

SEQ ID NO: 585503 - RNA, 62 nt, Homo Sapiens
gaccaaccugccuuacacauucagucuacaguccauccaaagcacuacaguuauaggaaguu

SEQ ID NO: 585504 - RNA, 62 nt, Homo Sapiens
aaaucauacaagaaaguuuuguuggcauuuaaccauccaaacaagggggaauauaugcaaug

SEQ ID NO: 585505 - RNA, 62 nt, Homo Sapiens
agauguuuggcaagaaauccccuaacugauuuccauccaaaccuaccuuauagagcacaaua

SEQ ID NO: 585506 - RNA, 62 nt, Homo Sapiens
ggaaaugaaagcuaaaacaacccauuugcuacccauccaaagcacuuacaguuuagcaaaua

SEQ ID NO: 585507 - RNA, 62 nt, Homo Sapiens
uuugcauauaucuagcuacucccuaaaugguuccauccaaggcuuagaguacccaaaggcua

SEQ ID NO: 585508 - RNA, 62 nt, Homo Sapiens
aacgaagaaugaaaaaaagccuagucagacucccauccaaaguaggaacuaucucuuuaaca

SEQ ID NO: 585509 - RNA, 62 nt, Homo Sapiens
ugcaucaagucugcguggccauccuccccccaccauccaagacuauuagguuuugucccugc

SEQ ID NO: 585510 - RNA, 62 nt, Homo Sapiens
gacuggagcaucuucugcacaaccuugggagcccauccaaggguuggugaggacuggucucc

SEQ ID NO: 585511 - RNA, 62 nt, Homo Sapiens
gaauauuauugcagaauuuaauuuaauuguggccauccaaauuauuucuugauauaacacuc

SEQ ID NO: 585512 - RNA, 62 nt, Homo Sapiens
uugauaaauggaaccagaggucucuuucuagcccauccaaauuuugccuagaggagacuaau

SEQ ID NO: 585513 - RNA, 62 nt, Homo Sapiens
uaguucaauaaaauucaaauucucuagcacugccauccaauuugcccucaucauaaauauca

SEQ ID NO: 585514 - RNA, 62 nt, Homo Sapiens
gaugauggcuuuuccuggagaaggaacacaugccauccaagugugaaaucaaugcguggaua

SEQ ID NO: 585515 - RNA, 62 nt, Homo Sapiens
cuggauggucaucucggaguccucgggaagccccauccaacacagcgauucugcagcaccgg

SEQ ID NO: 585516 - RNA, 62 nt, Homo Sapiens
uuauucuauuuuaagccuucuaucauauuuucccauccaauuguuugguuucagugguccag

SEQ ID NO: 585517 - RNA, 62 nt, Homo Sapiens
auugguuacuccugcagaguguaaucagcaccccauccaacuggcccgaaagcccagaccug

SEQ ID NO: 585518 - RNA, 62 nt, Homo Sapiens
gauacugcuguuucucgagguaagagauucagccauccaauugguuuuaggucuugcauauc

SEQ ID NO: 585519 - RNA, 62 nt, Homo Sapiens
ugaaucuucucaggcaguucagauuuaaagcaccauccaaaccuuggaaauacgacagggug

SEQ ID NO: 585520 - RNA, 62 nt, Homo Sapiens
augggcagccugcaguguggugucauuagacaccauccaaggguguucaugcacggaacuga

SEQ ID NO: 585521 - RNA, 62 nt, Homo Sapiens
gauuuuacaguuuuauuuuugcugggcuaacuccauccaaaucuaggacaccaaaagaccua

SEQ ID NO: 585522 - RNA, 62 nt, Homo Sapiens
accaaaguuuguauaaacaguuauaaacuaguccauccaagacaggucugcaaaaacaaaaa

SEQ ID NO: 585523 - RNA, 62 nt, Homo Sapiens
auguccagauguccaugugccagaguaauggcccauccaaaguguuuauucccugugaugcc

SEQ ID NO: 585524 - RNA, 62 nt, Homo Sapiens
cggucauuagauugggucaucagaaguaccugccauccaauaguauuacuauuaacugacuu

SEQ ID NO: 585525 - RNA, 62 nt, Homo Sapiens
uuuaaaaaacaaaacgaaagagggccauccaaccauccaaccaaugcauugguguuuaacua

SEQ ID NO: 585526 - RNA, 62 nt, Homo Sapiens
auccaaccuuuaaaaaacaauuuaacuaagggccauccaaccaccauuugaaugcauuggug

SEQ ID NO: 585527 - RNA, 61 nt, Homo Sapiens
ggugcacauuccugccauagcgcagugaccaccauccaagcucagaucugugugucuacgc

SEQ ID NO: 585528 - RNA, 62 nt, Homo Sapiens
cccaggagguuucuuucaaacaucauggccucccauccaaucaacaucaucaaauuacaugu

SEQ ID NO: 585529 - RNA, 62 nt, Homo Sapiens
ucucaaacuaugacagaaaaguaauguaaaauccauccaaucuauuauuucucuaauuaugc

SEQ ID NO: 585530 - RNA, 62 nt, Homo Sapiens
aaccuguacaaauauguuuauguauuaaaucaccauccaaaauauuuaaggaauauauaaaa

SEQ ID NO: 585531 - RNA, 62 nt, Homo Sapiens
aaaaacucucauuauggugaucauagaauugaccauccaaacugggacacucuugagaguaa

SEQ ID NO: 585532 - RNA, 62 nt, Homo Sapiens
gcuguucugcuucagcugguagcugauaaggaccauccaaaauucaaggaaauucagaaucu

SEQ ID NO: 585533 - RNA, 62 nt, Homo Sapiens
aauucugggauuacaggcauaagccaaugugcccauccaaaguuuuauuuauuuauuuuuuu

SEQ ID NO: 585534 - RNA, 62 nt, Homo Sapiens
ugaauaugcaaaagcaguuccgcugggaacccccauccaaucaacugcuguacccauggggg

SEQ ID NO: 585535 - RNA, 62 nt, Homo Sapiens
uucccuaugaaaaauguguugcaccagagaauccauccaaagauuuacuguuuuuuucugua

SEQ ID NO: 585536 - RNA, 62 nt, Homo Sapiens
cugugggaggaguaaacaacgacccucaaaacccauccaagaguucaccggacaccgcacca

SEQ ID NO: 585537 - RNA, 62 nt, Homo Sapiens
cugcauguauucauaauucuuuucauuucuaaccauccaauugcuggaccuaaauagauuga

SEQ ID NO: 585538 - RNA, 62 nt, Homo Sapiens
gccaaaaagaaaaagaaaaaagauugaccaaaccauccaaauacuuuggaauaaggaagaga

SEQ ID NO: 585539 - RNA, 62 nt, Homo Sapiens
uagaugcagcugauacauuccuagucagaagaccauccaagacuuuccuuggacaguagcaa

SEQ ID NO: 585540 - RNA, 62 nt, Homo Sapiens
gccugggugaguucuguuugcuccuuguaccaccauccaaaugguguuaucaaaucucuuag

SEQ ID NO: 585541 - RNA, 62 nt, Homo Sapiens
caugauaaggugguucuuucauaacucuaaugccauccaacauagcccugggagaggcaugu

SEQ ID NO: 585542 - RNA, 62 nt, Homo Sapiens
uguuccccuggccccccacucucccuccauguccauccaaaaaccauaaaaucacuggguuc

SEQ ID NO: 585543 - RNA, 62 nt, Homo Sapiens
cugucuccugucuucagagcaaaagacuugagccauccaaagaaacacuaagcucucugggc

SEQ ID NO: 585544 - RNA, 62 nt, Homo Sapiens
ccugcgucacacugugugaggcugugucucugccauccaaaagggggccccuugagaauggu

SEQ ID NO: 585545 - RNA, 62 nt, Homo Sapiens
guccaaaagugaucuggucggaucucacaaggccauccaaugagaccccgcacagcauuuuc

SEQ ID NO: 585546 - RNA, 62 nt, Homo Sapiens
caaaugaagacaaaacauacauuuuguaccaaccauccaauuagcuuauguuaacugacaag

SEQ ID NO: 585547 - RNA, 62 nt, Homo Sapiens
uggagagagggcgcagagcaaaccaugucacgccauccaaugacaccagcuggucagcucac

SEQ ID NO: 585548 - RNA, 62 nt, Homo Sapiens
gucuucuguaccaaugcaccagagaaugccuaccauccaaaaaagcagucagcugauggaaa

SEQ ID NO: 585549 - RNA, 62 nt, Homo Sapiens
ucacuucgccuuacaggucucccaccguccagccauccaaccauccaggacugcaccccacc

SEQ ID NO: 585550 - RNA, 62 nt, Homo Sapiens
cuuugaauuucccagucuccccuaugguuucuccauccaauuccccugacauuaucuuggau

SEQ ID NO: 585551 - RNA, 62 nt, Homo Sapiens
agaggaugcucagauuucuccagcagcuucggccauccaaacuccagaccagaguuugaugc

SEQ ID NO: 585552 - RNA, 62 nt, Homo Sapiens
cuggggcaaagaugauuaccgggugagaaacaccauccaaagcacgccuggugaaggagccu

SEQ ID NO: 585553 - RNA, 62 nt, Homo Sapiens
ccaucagggaaaugagcugaauggccccagcaccauccaaguugacacagcuaaaggaauaa

SEQ ID NO: 585554 - RNA, 62 nt, Homo Sapiens
aaugaaaggcuuuaguuauuucuagaggagucccauccaacacuauuuggcgacuguuaaua

SEQ ID NO: 585555 - RNA, 62 nt, Homo Sapiens
ccucuccaucuacuuuucccugugcauaauauccauccaaaggacaacaguggcaaagcuga

SEQ ID NO: 585556 - RNA, 62 nt, Homo Sapiens
aguguuuuaaacucuccuagucaauauccaccccauccaauuuaucaaggaagaaaugguuc

SEQ ID NO: 585557 - RNA, 62 nt, Homo Sapiens
gugcaaaaaagugguggaacaaauaccaacauccauccaaaaugaaaaagaacaggaaauuc

SEQ ID NO: 585558 - RNA, 62 nt, Homo Sapiens
cauauuuuaaaucaacuacuccacguguuuuuccauccaaucacacugcugugauucaggga

SEQ ID NO: 585559 - RNA, 62 nt, Homo Sapiens
gggcacaaaauccaagagaaggucugugagccccauccaacacccacaguaauuauuaucug

SEQ ID NO: 585560 - RNA, 62 nt, Homo Sapiens
cccgugcgccacugcagugagaugcuguccccccauccaaaagccacagcugugagggccaa

SEQ ID NO: 585561 - RNA, 62 nt, Homo Sapiens
uuucuggugaauuacacagauuucuaauuauuccauccaaaaauguuuuaaccucuuuuuuu

SEQ ID NO: 585562 - RNA, 62 nt, Homo Sapiens
aaaugcagccagguuuagcccacuuccaucacccauccaauauuuaccauaguacucccacc

SEQ ID NO: 585563 - RNA, 62 nt, Homo Sapiens
aucauugcuuuuaacuguuucaucuuauugaaccauccaaaauguuuuaaguuauauauaca

SEQ ID NO: 585564 - RNA, 55 nt, Homo Sapiens
uagcauacauaaaauguugcuauugccauccaauuuugcagaagauguaaucuaa

SEQ ID NO: 585565 - RNA, 62 nt, Homo Sapiens
cuuagacucacgaacaaaucgucagccaacccccauccaacccaaaugugggcccagccuag

SEQ ID NO: 585566 - RNA, 62 nt, Homo Sapiens
uuuaacagcuguaaccaaugguacugaucuauccauccaauguugucauuauauuugacugu

SEQ ID NO: 585567 - RNA, 62 nt, Homo Sapiens
ucccacccuaagucuuacauaaugccaccaguccauccaaaaccuauauaucaccuauacua

SEQ ID NO: 585568 - RNA, 62 nt, Homo Sapiens
agaagggaggaaacguccaucaugauuuaagcccauccaaaaauucaaugugagacacuauc

SEQ ID NO: 585569 - RNA, 62 nt, Homo Sapiens
cucgcccgacccaaacaccuugaaggcggagcccauccaaccgccaaggaccugcaagggac

SEQ ID NO: 585570 - RNA, 62 nt, Homo Sapiens
agcugggaccacaggugugccucccaccucagccauccaaauccucucaggcucaagcgauu

SEQ ID NO: 585571 - RNA, 62 nt, Homo Sapiens
ucacccaguggauggaacaugaagaaacucucccauccaacauugucacaugaccgguacug

SEQ ID NO: 585572 - RNA, 62 nt, Homo Sapiens
uugaaagcuguugauagaaagaaaagggaaagccauccaaauugaguaaccagauagcaaaa

SEQ ID NO: 585573 - RNA, 62 nt, Homo Sapiens
ccuacuaggaagagagugggaaggagaagcucccauccaaauaacacaauguauagccagag

SEQ ID NO: 585574 - RNA, 62 nt, Homo Sapiens
ccucuagucagcacuagaucucucacagauacccauccaacuggcuuccuuguuuauggggc

SEQ ID NO: 585575 - RNA, 62 nt, Homo Sapiens
ugagagacagaauucaaguggguauucuggggccauccaauuucucuuuacuugaaauuugg

SEQ ID NO: 585576 - RNA, 62 nt, Homo Sapiens
accuucccugucgaucccuucugagguauggcccauccaagacuuuuaggccauucuugaug

SEQ ID NO: 585577 - RNA, 62 nt, Homo Sapiens
gccuggcaccuccauccugaggugcugccccuccauccaaaacugccaagugacucauugcc

SEQ ID NO: 585578 - RNA, 62 nt, Homo Sapiens
accuggauauaaauuaauugugccugccaccaccauccaacagaccuggugcucuaaugcca

SEQ ID NO: 585579 - RNA, 62 nt, Homo Sapiens
ccacaccagcaccuuguuacagugucggcuccccauccaaaucacaugucagggaagcaccc

SEQ ID NO: 585580 - RNA, 62 nt, Homo Sapiens
gaaaugauaaucagaaaagacuguaaauagauccauccaaaugauuucucuguacaaaugaa

SEQ ID NO: 585581 - RNA, 62 nt, Homo Sapiens
ugggguaggguggaguggggagggauuaaaacccauccaaaaaauaaauaaaaacuauauag

SEQ ID NO: 585582 - RNA, 62 nt, Homo Sapiens
aaaguacugaaaugaguauaaggcaguaucacccauccaaaagaaaggucuuuauagaccug

SEQ ID NO: 585583 - RNA, 62 nt, Homo Sapiens
uaagucuguuucugaaauagucaauagucuucccauccaaacuauaagagaaugugaauuuc

SEQ ID NO: 585584 - RNA, 62 nt, Homo Sapiens
aggggcugggacuggggagggggcagccaccuccauccaaggcucuuccuaggggcccugcu

SEQ ID NO: 585585 - RNA, 62 nt, Homo Sapiens
ugugccuuggacauggugauggugauggguugccauccaagugaaagucuuuuccuugacca

SEQ ID NO: 585586 - RNA, 62 nt, Homo Sapiens
gugcuaugccuggaggcucaacacaaaacuucccauccaaacauucagaugaacugagcguc

SEQ ID NO: 585587 - RNA, 62 nt, Homo Sapiens
caagcuucucgcccacuccacggcucugagccccauccaagggcaagacuuggugcccagcu

SEQ ID NO: 585588 - RNA, 62 nt, Homo Sapiens
aagauacaguuugaagacaguacaucuuaauuccauccaaaguuaucuuaaaacuauacagu

SEQ ID NO: 585589 - RNA, 62 nt, Homo Sapiens
ccaaggaccugggauaaacugaauuucccgggccauccaagcggugcuuccguggggcauga

SEQ ID NO: 585590 - RNA, 62 nt, Homo Sapiens
ucagaaggcuuugggauaugugaugcagugcuccauccaaacuggggcuucugugaaaaacc

SEQ ID NO: 585591 - RNA, 62 nt, Homo Sapiens
cuuuuucucucaggguucugagucagaggacaccauccaagaauguuguuagcuuuucaguu

SEQ ID NO: 585592 - RNA, 62 nt, Homo Sapiens
guggacucaacgcagaagaauggacgaaaugaccauccaacgugauuaaggauaggaaucgg

SEQ ID NO: 585593 - RNA, 62 nt, Homo Sapiens
uagcacccuuuacugcuguguauggggcuucaccauccaagaggugguagguuggaguaaga

SEQ ID NO: 585594 - RNA, 62 nt, Homo Sapiens
agacuccucuuccuccuggaccccauccucuaccauccaagcccugucccacuuuggcccua

SEQ ID NO: 585595 - RNA, 62 nt, Homo Sapiens
cucccccaguguuggagugcaaggaggcggggccauccaaagcaacgcugaaggccuuuucc

SEQ ID NO: 585596 - RNA, 62 nt, Homo Sapiens
cugaaggcuacugcaggucacugaguugccugccauccaaaggggaugggcgggauuggaag

SEQ ID NO: 585597 - RNA, 62 nt, Homo Sapiens
aaggccccuuggcuguggcauaugugcccucaccauccaauaagcagccaccugccugcucc

SEQ ID NO: 585598 - RNA, 62 nt, Homo Sapiens
aacuacuaccuaucaagaauaauuuugcagcaccauccaagaaggaacaccaaggccauuuc

SEQ ID NO: 585599 - RNA, 62 nt, Homo Sapiens
uuaacacaacauuucucaguaaaaaaauaaauccauccaacuuuuuuuuguacugggccuuu

SEQ ID NO: 585600 - RNA, 62 nt, Homo Sapiens
acuaaccaggcccgacccugauaaaauuucucccauccaagucuaguguucauguguucuuu

SEQ ID NO: 585601 - RNA, 62 nt, Homo Sapiens
gacggcgcugcagggccucagagaagaauaaaccauccaagaaccuaggggaaaaccugcca

SEQ ID NO: 585602 - RNA, 62 nt, Homo Sapiens
aucuacccaccugucuuccuugauuuaucucaccauccaauuuacccaucuacucaaauauc

SEQ ID NO: 585603 - RNA, 62 nt, Homo Sapiens
uacagcccuggccuccacccccaccccgccgaccauccaagggagagugagaccuggcagcc

SEQ ID NO: 585604 - RNA, 62 nt, Homo Sapiens
uagauuuggggcucagaaggcccugcucucucccauccaagugaccagaugcccuacucagc

SEQ ID NO: 585605 - RNA, 62 nt, Homo Sapiens
auuggaucugugccuguaauaucaggauacuaccauccaaaucuaucuagauaucuugugca

SEQ ID NO: 585606 - RNA, 62 nt, Homo Sapiens
cuaagucucuagccucuuucucccuucugcucccauccaagaaagacaguguauaaggaaca

SEQ ID NO: 585607 - RNA, 62 nt, Homo Sapiens
gguaugauucuauuauauauuuuauauaaaauccauccaaauuaaguuuuggguaagugugu

SEQ ID NO: 585608 - RNA, 62 nt, Homo Sapiens
uaaacagaugacauuuucugaccaggcacaugccauccaauuuucugucaaucacacuguug

SEQ ID NO: 585609 - RNA, 62 nt, Homo Sapiens
caugaucauuugcaaaccucccccagccccuaccauccaauguggaaggaaaacaagaacug

SEQ ID NO: 585610 - RNA, 62 nt, Homo Sapiens
aaaagcauggacugugccacacacccagugauccauccaaaaacaaggacugcagccuaaau

SEQ ID NO: 585611 - RNA, 62 nt, Homo Sapiens
aagaaaccuaaaauaauuggcucgugggagagccauccaaaugaaguaaucccgccaccuau

SEQ ID NO: 585612 - RNA, 62 nt, Homo Sapiens
uugaacugugaaagagagguauauuaguaaccccauccaagauguugauagcagauggauca

SEQ ID NO: 585613 - RNA, 62 nt, Homo Sapiens
aggccuuuuaacucagccucaucuuucugccuccauccaaagggauuugagagcuggagccc

SEQ ID NO: 585614 - RNA, 62 nt, Homo Sapiens
gauugugcaaauccccucccugugacaugaacccauccaaugaccagugagcagagcccuca

SEQ ID NO: 585615 - RNA, 62 nt, Homo Sapiens
gcagagaaccaaaggggccagcauaaauccauccauccaaaggcucccuccagacaaugcca

SEQ ID NO: 585616 - RNA, 62 nt, Homo Sapiens
uggauucaguuuugugaaaauggauucuguggccauccaagggauguaucagggaugaucag

SEQ ID NO: 585617 - RNA, 62 nt, Homo Sapiens
uuccuaccaguuucucagaauuacacgcacgaccauccaaacauuggcuccaugccagggcu

SEQ ID NO: 585618 - RNA, 62 nt, Homo Sapiens
cucaccccugggcaagaggcuggaaguucacaccauccaaaauuuauccuuguuuuuuuucu

SEQ ID NO: 585619 - RNA, 62 nt, Homo Sapiens
ugggcucuucucuggccucuucaccagggcacccauccaaggaaccuccgaacagccaggaa

SEQ ID NO: 585620 - RNA, 62 nt, Homo Sapiens
acuuggccuaaaaauacuccuuaagucaccucccauccaagaagaucagagccagaucagcc

SEQ ID NO: 585621 - RNA, 62 nt, Homo Sapiens
agagagauggggagguuuuuauuuucaaauacccauccaacagcagauaucaagaguuuguu

SEQ ID NO: 585622 - RNA, 62 nt, Homo Sapiens
agggauacaggggaggcgguaagaaaggcuaaccauccaaacgcuaacacgggcaagaggga

SEQ ID NO: 585623 - RNA, 62 nt, Homo Sapiens
ugccccccacucaucugccaagggaacagaguccauccaagcugugcuccucuggccaggaa

SEQ ID NO: 585624 - RNA, 62 nt, Homo Sapiens
cgccaucauaaaggaaucuuuagaacuguguaccauccaauucagugacugggacccuacuc

SEQ ID NO: 585625 - RNA, 62 nt, Homo Sapiens
aggcacagccgucauuacugcugaggucuccaccauccaagggccuguguugcagaccauuu

SEQ ID NO: 585626 - RNA, 62 nt, Homo Sapiens
uguugcauguaugaauaguuuucccuugaaauccauccaaguucuuuuuucauucagcauaa

SEQ ID NO: 585627 - RNA, 62 nt, Homo Sapiens
ggagggaaacuuuaaaacaagaauaugaucuuccauccaaguacaaagagaaaucucuaaaa

SEQ ID NO: 585628 - RNA, 62 nt, Homo Sapiens
cuuauuuuauuuuaccuucaaaaacaaaaacgccauccaaaaccaaggaaguccuugguguu

SEQ ID NO: 585629 - RNA, 62 nt, Homo Sapiens
cccacggggacaucaguaaccuucugcagccaccauccaaugccauuacugucaagugagac

SEQ ID NO: 585630 - RNA, 62 nt, Homo Sapiens
aucaguuugaggaaguggcugucccuguggccccauccaaccacuguacacacccgccugac

SEQ ID NO: 585631 - RNA, 62 nt, Homo Sapiens
acccaaacuuuacucugggagguaggcuaugcccauccaaauaaaucuccaugagaaacuug

SEQ ID NO: 585632 - RNA, 62 nt, Homo Sapiens
cucuuuuucugcacugccauauucacccccaaccauccaaucuguggauaauuggauguuag

SEQ ID NO: 585633 - RNA, 62 nt, Homo Sapiens
uacugagcucuccacucuguuucccgccugggccauccaaccuugaaguccuaaaccacacc

SEQ ID NO: 585634 - RNA, 62 nt, Homo Sapiens
auccucccacccagucugccccuggucucugcccauccaaucagagcccacccuccuggaag

SEQ ID NO: 585635 - RNA, 62 nt, Homo Sapiens
uccgauaacuuaaaaacguagcucaucccuuaccauccaaggggcacucccuugguuggauu

SEQ ID NO: 585636 - RNA, 62 nt, Homo Sapiens
cacccaagacacaguacccagucaugguuuccccauccaacuauuaguuucauacuuugaaa

SEQ ID NO: 585637 - RNA, 62 nt, Homo Sapiens
aaaaucaggagccugcuaaguugaaaaugccaccauccaauacaagauccucuugccacauc

SEQ ID NO: 585638 - RNA, 62 nt, Homo Sapiens
auccagggacuugaagaaagacuaggugugucccauccaaguugagcacgcgccuuccccag

SEQ ID NO: 585639 - RNA, 62 nt, Homo Sapiens
uggaugggccaccgccuugcccagccuggaugccauccaaguuguauauuuuuuuaaucucu

SEQ ID NO: 585640 - RNA, 62 nt, Homo Sapiens
ucucagagaaucagcuaaguuuccuaacuuguccauccaaaugugaucaccacgauucaaca

SEQ ID NO: 585641 - RNA, 62 nt, Homo Sapiens
aguggagaauuguggaaggauuguaacauggaccauccaaauuuauggccguaucaaauggu

SEQ ID NO: 585642 - RNA, 62 nt, Homo Sapiens
gugugaagggacugcuguuugcaaugggcuuaccauccaaauaucccaaaggcuuugaccag

SEQ ID NO: 585643 - RNA, 62 nt, Homo Sapiens
guucugcccaaauuccgauaucaccccuucccccauccaagcauccuucgauuagggaagug

SEQ ID NO: 585644 - RNA, 62 nt, Homo Sapiens
auuuccaguacauucuuucagagucuguuuuuccauccaaauauaagccccaggccauucca

SEQ ID NO: 585645 - RNA, 62 nt, Homo Sapiens
cuugaguuuucucacugauuucccucccucagccauccaauuccccagugcgcuuccucugu

SEQ ID NO: 585646 - RNA, 62 nt, Homo Sapiens
uuugggccuaugugaaaagauucagcuaccacccauccaaccguagggggaaaaucaguucu

SEQ ID NO: 585647 - RNA, 62 nt, Homo Sapiens
ccugaaaagcaaauuuggcagauguauugguuccauccaacacauggugucaggaaggcuga

SEQ ID NO: 585648 - RNA, 62 nt, Homo Sapiens
ccugaaaaacaaacuuggcagaugcauuggcuccauccaacacauggugucuggaaggcuua

SEQ ID NO: 585649 - RNA, 62 nt, Homo Sapiens
aggguucuuccuuccuguggccguccacacucccauccaagggaguaguggcaacagcccuu

SEQ ID NO: 585650 - RNA, 62 nt, Homo Sapiens
acuuuuagaaaucuucucugaccuagaagaauccauccaaaucccugccuuccucucugaac

SEQ ID NO: 585651 - RNA, 62 nt, Homo Sapiens
agguccucaagugcucgugacacauaaucauuccauccaaugaucgccuuugcuuuaccacu

SEQ ID NO: 585652 - RNA, 62 nt, Homo Sapiens
ugcaacucagagcugcugcacucaggagggccccauccaaucccgggccccugcagggaaaa

SEQ ID NO: 585653 - RNA, 62 nt, Homo Sapiens
uccugcuguguguccuguuccauguuccgguuccauccaaauacacuuucuggaacaaaugc

SEQ ID NO: 585654 - RNA, 62 nt, Homo Sapiens
augcaugccugaugaccaaacucucccuuuccccauccaaucgguccacacuccccgcccug

SEQ ID NO: 585655 - RNA, 62 nt, Homo Sapiens
aaaagauuguggccaagaagagugaaugugucccauccaaaggugcauccagauaugucugu

SEQ ID NO: 585656 - RNA, 62 nt, Homo Sapiens
ccugugucuuuccauagucagcgccagacccuccauccaagcgcuccauccaucccuccugg

SEQ ID NO: 585657 - RNA, 62 nt, Homo Sapiens
ggucccagagcuggagcuucaggauucaaaccccauccaacucacuaacaggagccaggguu

SEQ ID NO: 585658 - RNA, 62 nt, Homo Sapiens
gcucucaaggacaccggcaagggccugagugcccauccaaggagggcccugcugggacaugg

SEQ ID NO: 585659 - RNA, 62 nt, Homo Sapiens
gguccacacuccccgccccccucucccuuucuccauccaaucaugcgugccugaugaccaaa

SEQ ID NO: 585660 - RNA, 62 nt, Homo Sapiens
uguucugcauaucauuguucuuaaccugaaauccauccaagugcuauuucaacuaaagcaga

SEQ ID NO: 585661 - RNA, 62 nt, Homo Sapiens
cuaacucugccaaccacuuuuaugcuuacacuccauccaaacagucccucaugcuaccuuuu

SEQ ID NO: 585662 - RNA, 62 nt, Homo Sapiens
ugcacuauguucacuuugggguugguucucagccauccaagggucuccagugagguggcugc

SEQ ID NO: 585663 - RNA, 62 nt, Homo Sapiens
ucauggacccagauggggcuuucccuuuguagccauccaaugggcauugugugggugcuugg

SEQ ID NO: 585664 - RNA, 57 nt, Homo Sapiens
acaaagcaagcaggcuuuagaccuccaccauccaaagcucaugcccggcaguggacu

SEQ ID NO: 585665 - RNA, 62 nt, Homo Sapiens
uugguuuaguggauguucguggaauugcugacccauccaagggcguccuuuggagccagugg

SEQ ID NO: 585666 - RNA, 62 nt, Homo Sapiens
aggagaccacaaagguuucacuucuuuuagauccauccaauaugcgaaaaaaggguacauuu

SEQ ID NO: 585667 - RNA, 62 nt, Homo Sapiens
cucaucuuaaauuguaaucuggcucugugucuccauccaaauaauauggagugauauaguuu

SEQ ID NO: 585668 - RNA, 62 nt, Homo Sapiens
augaguaauagcacaaaguauccccucacccaccauccaauaaggacauauauuuuguauuu

SEQ ID NO: 585669 - RNA, 62 nt, Homo Sapiens
gauaaauugcuaauuaagcacaaucuaaccugccauccaaauaggcuuuccugagcaaguga

SEQ ID NO: 585670 - RNA, 62 nt, Homo Sapiens
cucaucuugaauuguucccguuggcuguguccccauccaaauaaaucccuaguugauagggu

SEQ ID NO: 585671 - RNA, 62 nt, Homo Sapiens
gcuguuggggcugguggugacccuguccugacccauccaagccagaaugaauugucugguag

SEQ ID NO: 585672 - RNA, 62 nt, Homo Sapiens
accauuuuuucuuucaguccgucauugacuggccauccaauuuauuuggacugcauuaauug

SEQ ID NO: 585673 - RNA, 62 nt, Homo Sapiens
gccuuuucugaaguuacagacacacguugucuccauccaaugcucugcuuccuguagacacg

SEQ ID NO: 585674 - RNA, 62 nt, Homo Sapiens
aaaugcuggaaaacuguaaagacuuccaggucccauccaaggagauuuugcuucugauugac

SEQ ID NO: 585675 - RNA, 62 nt, Homo Sapiens
auaaauugaguccuaaguauuaauuauugccaccauccaacucauugagucuuaugguucac

SEQ ID NO: 585676 - RNA, 62 nt, Homo Sapiens
gauuauugagucguaaguauuaauuauugccaccauccaacucauugagucuuaugguucac

SEQ ID NO: 585677 - RNA, 62 nt, Homo Sapiens
ccacagugccaguuccuugccccaaccuggccccauccaaguacagaagaccuuccuuuccu

SEQ ID NO: 585678 - RNA, 62 nt, Homo Sapiens
guugggguaaugggaacuggggcuccauucccccauccaagacaaguccuguaacuucccca

SEQ ID NO: 585679 - RNA, 62 nt, Homo Sapiens
ggugggagcacaucugcccuuucagcccagcaccauccaaagccagcaggacuccaggaugg

SEQ ID NO: 585680 - RNA, 62 nt, Homo Sapiens
uuguucugccaccacuggaugagcacuggggcccauccaaguugaggguccugguuccagca

SEQ ID NO: 585681 - RNA, 62 nt, Homo Sapiens
uaaaugccacagcuggggcuugcauccccuccccauccaaccgccccuuccuccuuccauuc

SEQ ID NO: 585682 - RNA, 62 nt, Homo Sapiens
ucagcaggccuucucgggccucgcacucaaagccauccaaccccucugucacccagcuaucc

SEQ ID NO: 585683 - RNA, 62 nt, Homo Sapiens
acugaggcagccuuggggaauuuccuuccagcccauccaaacgcccucccagaaccucagca

SEQ ID NO: 585684 - RNA, 62 nt, Homo Sapiens
aaaaugaucaaucaagauaaaaggugaucuauccauccaauggaauauuauuuggccuuaaa

SEQ ID NO: 585685 - RNA, 62 nt, Homo Sapiens
ucaccucuuccuggaagccuuccucuuuuccaccauccaaaacccucuuaauacccugugua

SEQ ID NO: 585686 - RNA, 62 nt, Homo Sapiens
agagggaaagaucguaaggaugagagaggagaccauccaagccagaaauuauuuaauaaauc

SEQ ID NO: 585687 - RNA, 62 nt, Homo Sapiens
uguucagggagccuugcaguguuauacgcgugccauccaaauuaauccugcauuugcagaug

SEQ ID NO: 585688 - RNA, 62 nt, Homo Sapiens
uauuuuuccgaacaauccuuguagaguauguaccauccaaaggcaggagggccucgccgugg

SEQ ID NO: 585689 - RNA, 62 nt, Homo Sapiens
ggagaaucuuccccaggguuacaacacaaauuccauccaagaagcacaaaagucuugauagc

SEQ ID NO: 585690 - RNA, 62 nt, Homo Sapiens
uuuuguauguuuuuguaaacguaucccuugugccauccaacaaauccguuuauauuagcacu

SEQ ID NO: 585691 - RNA, 62 nt, Homo Sapiens
aaaggauuacgucugcaucuaaacaaccaccaccauccaacaaaccaauagucucaaaguaa

SEQ ID NO: 585692 - RNA, 62 nt, Homo Sapiens
agaaggucccuuuuuccaacauaguaggugcaccauccaaggugccauaaauuauguggcuc

SEQ ID NO: 585693 - RNA, 62 nt, Homo Sapiens
ugcuuuagucauauaugaauuuaaaccuaguaccauccaaaaccauguaauggauuuuaaga

SEQ ID NO: 585694 - RNA, 63 nt, Homo Sapiens
uuaagucuuuuaccaaaagugucuguacagcagccauccaaguugccccuacuuaguggcuug

SEQ ID NO: 585695 - RNA, 63 nt, Homo Sapiens
gaaguuggcugagccauugagugcugggggaggccauccaagauggcaugaaucgggcuaagg

SEQ ID NO: 585696 - RNA, 63 nt, Homo Sapiens
ccuccgcacucaccugccgggacccucccuauuccauccaagggaagcagaacugccaaagac

SEQ ID NO: 585697 - RNA, 63 nt, Homo Sapiens
uaggaacuaaccuaccccaacucugcccuucucccauccaagagaaaccagcaaaaugauaaa

SEQ ID NO: 585698 - RNA, 63 nt, Homo Sapiens
ggccugaugugguacgucccuccacccccggacccauccaagucaucugauugaagagcauga

SEQ ID NO: 585699 - RNA, 63 nt, Homo Sapiens
auuaugaccuaaaucuaauuuacuuccacugaaccauccaagaccucuggcaggcagggaaau

SEQ ID NO: 585700 - RNA, 63 nt, Homo Sapiens
aauuuuuucuugguaggaaaaauuauacugaacccauccaaaccugaagucacagaugaugug

SEQ ID NO: 585701 - RNA, 63 nt, Homo Sapiens
gcuucaauccugaacgucacugacuugcugugaccauccaaauaauuuuccugucucugccuc

SEQ ID NO: 585702 - RNA, 63 nt, Homo Sapiens
auuucugaaaaccuaccauguuucuuuacagagccauccaaaaauuuuuugucccuacauagc

SEQ ID NO: 585703 - RNA, 63 nt, Homo Sapiens
gggucaguggucugugccaaccaaacgauagccccauccaagccagcugagaaccuaggaagg

SEQ ID NO: 585704 - RNA, 63 nt, Homo Sapiens
aguuaggacaugcuaucaguaauagucccaguuccauccaacuuucugaaauuucauuuuuuu

SEQ ID NO: 585705 - RNA, 63 nt, Homo Sapiens
ucacgcucgcgugcuucggacaccggcccgccuccauccaaaaaccggcagcagcuaggcagu

SEQ ID NO: 585706 - RNA, 63 nt, Homo Sapiens
ggcacauaggcuacccaagaccuuguucacauaccauccaagacaucugcaguuucaucccua

SEQ ID NO: 585707 - RNA, 63 nt, Homo Sapiens
ccaccuucugcagcaaaaggaauacuacuuuagccauccaagggugguuaauugcuaagagua

SEQ ID NO: 585708 - RNA, 63 nt, Homo Sapiens
ccuguuuagcuucuuccucccaguagaccgaaaccauccaaaauagauuugauaagcuagaug

SEQ ID NO: 585709 - RNA, 63 nt, Homo Sapiens
ggccaccgcagcauuggcccaauucacccaggaccauccaagggucugaaugccgagucccug

SEQ ID NO: 585710 - RNA, 63 nt, Homo Sapiens
ucaugccaguucccuucuuucuugaucauuaagccauccaacugucucucuuaccuuuagcug

SEQ ID NO: 585711 - RNA, 63 nt, Homo Sapiens
aaugauaaagucuauucaucaugacuggacaaaccauccaaaugguugaaccuaaagaaaugg

SEQ ID NO: 585712 - RNA, 63 nt, Homo Sapiens
ucuuucuuucuuuuuuuuuaaauuuuguauuuuccauccaacagcaguguguagagagaauau

SEQ ID NO: 585713 - RNA, 63 nt, Homo Sapiens
gaaugccagggacagugugcucaguaaagucuuccauccaaaaggggcagggcacgguggcuc

SEQ ID NO: 585714 - RNA, 63 nt, Homo Sapiens
auaugguagaauuuuauaaacacauacaugauaccauccaaauucuugcuuuuaauaacaaag

SEQ ID NO: 585715 - RNA, 63 nt, Homo Sapiens
ccagguucuccguuagcuccgcucugagcgccuccauccaagggggugucuugggcagagcug

SEQ ID NO: 585716 - RNA, 63 nt, Homo Sapiens
gacuccugggauggggcagccacgucaggcugcccauccaauaggaccaugagugacaaccau

SEQ ID NO: 585717 - RNA, 63 nt, Homo Sapiens
caaauuccuccuucaaccuuaacugaccugcauccauccaaaauaguuaaguauagcaauuca

SEQ ID NO: 585718 - RNA, 63 nt, Homo Sapiens
ggaaauuccccuuucuugguuggacacuauugaccauccaaauagucuuguccuuggcagaac

SEQ ID NO: 585719 - RNA, 63 nt, Homo Sapiens
gaccaaccugccuuacacauuucagucuacaguccauccaaagucacuacaguuauaggaagu

SEQ ID NO: 585720 - RNA, 63 nt, Homo Sapiens
aaaucauacaagaaaguuuugguuggcauuuaaccauccaaacaaagggggaauauaugcaau

SEQ ID NO: 585721 - RNA, 63 nt, Homo Sapiens
gagauguuuggcaagaaauccccuaacugauuuccauccaaaccuaccuuauagagcacaaua

SEQ ID NO: 585722 - RNA, 63 nt, Homo Sapiens
aggaaaugaaagcuaaaacaacccauuugcuacccauccaaagcacuuacaguuuagcaaaua

SEQ ID NO: 585723 - RNA, 63 nt, Homo Sapiens
cuuugcauauaucuagcuacucccuaaaugguuccauccaaggcuuagaguacccaaaggcua

SEQ ID NO: 585724 - RNA, 63 nt, Homo Sapiens
caacgaagaaugaaaaaaagccuagucagacucccauccaaaguaggaacuaucucuuuaaca

SEQ ID NO: 585725 - RNA, 63 nt, Homo Sapiens
cugcaucaagucugcguggccauccuccccccaccauccaagacuauuagguuuugucccugc

SEQ ID NO: 585726 - RNA, 63 nt, Homo Sapiens
ugacuggagcaucuucugcacaaccuugggagcccauccaaggguuggugaggacuggucucc

SEQ ID NO: 585727 - RNA, 63 nt, Homo Sapiens
gaauauuauugcagaauuuacauuuaauuguggccauccaaaucuauuucuugauauaacacu

SEQ ID NO: 585728 - RNA, 63 nt, Homo Sapiens
uugauaaauggaaccagagguucucuuucuagcccauccaaauguuugccuagaggagacuaa

SEQ ID NO: 585729 - RNA, 63 nt, Homo Sapiens
uaguucaauaaaauucaaauaucucuagcacugccauccaauugugcccucaucauaaauauc

SEQ ID NO: 585730 - RNA, 63 nt, Homo Sapiens
gaugauggcuuuuccuggagaaaggaacacaugccauccaaguugugaaaucaaugcguggau

SEQ ID NO: 585731 - RNA, 63 nt, Homo Sapiens
cuggauggucaucucggagugccucgggaagccccauccaacaacagcgauucugcagcaccg

SEQ ID NO: 585732 - RNA, 63 nt, Homo Sapiens
uuuauucuauuuuaagccuucuaucauauuuucccauccaauuguuugguuucagugguccag

SEQ ID NO: 585733 - RNA, 63 nt, Homo Sapiens
cauugguuacuccugcagaguguaaucagcaccccauccaacuggcccgaaagcccagaccug

SEQ ID NO: 585734 - RNA, 63 nt, Homo Sapiens
cgauacugcuguuucucgagguaagagauucagccauccaauugguuuuaggucuugcauauc

SEQ ID NO: 585735 - RNA, 63 nt, Homo Sapiens
cugaaucuucucaggcaguucagauuuaaagcaccauccaaaccuuggaaauacgacagggug

SEQ ID NO: 585736 - RNA, 63 nt, Homo Sapiens
augggcagccugcaguguggaugucauuagacaccauccaagguguguucaugcacggaacug

SEQ ID NO: 585737 - RNA, 63 nt, Homo Sapiens
gauuuuacaguuuuauuuuuagcugggcuaacuccauccaaaugcuaggacaccaaaagaccu

SEQ ID NO: 585738 - RNA, 63 nt, Homo Sapiens
accaaaguuuguauaaacagauuauaaacuaguccauccaagaacaggucugcaaaaacaaaa

SEQ ID NO: 585739 - RNA, 63 nt, Homo Sapiens
auguccagauguccaugugcccagaguaauggcccauccaaagcuguuuauucccugugaugc

SEQ ID NO: 585740 - RNA, 63 nt, Homo Sapiens
cggucauuagauugggucauucagaaguaccugccauccaauaaguauuacuauuaacugacu

SEQ ID NO: 585741 - RNA, 63 nt, Homo Sapiens
uuuaaaaaacaaaacgaaagaagggccauccaaccauccaaccgaaugcauugguguuuaacu

SEQ ID NO: 585742 - RNA, 63 nt, Homo Sapiens
auccaaccuuuaaaaaacaaguuuaacuaagggccauccaaccuaccauuugaaugcauuggu

SEQ ID NO: 585743 - RNA, 61 nt, Homo Sapiens; identical to SEQ ID NO: 585527

SEQ ID NO: 585744 - RNA, 63 nt, Homo Sapiens
gcccaggagguuucuuucaaacaucauggccucccauccaaucaacaucaucaaauuacaugu

SEQ ID NO: 585745 - RNA, 63 nt, Homo Sapiens
aucucaaacuaugacagaaaaguaauguaaaauccauccaaucuauuauuucucuaauuaugc

SEQ ID NO: 585746 - RNA, 63 nt, Homo Sapiens
aaaccuguacaaauauguuuauguauuaaaucaccauccaaaauauuuaaggaauauauaaaa

SEQ ID NO: 585747 - RNA, 63 nt, Homo Sapiens
aaaaaacucucauuauggugaucauagaauugaccauccaaacugggacacucuugagaguaa

SEQ ID NO: 585748 - RNA, 63 nt, Homo Sapiens
ggcuguucugcuucagcugguagcugauaaggaccauccaaaauucaaggaaauucagaaucu

SEQ ID NO: 585749 - RNA, 63 nt, Homo Sapiens
aaauucugggauuacaggcauaagccaaugugcccauccaaaguuuuauuuauuuauuuuuuu

SEQ ID NO: 585750 - RNA, 63 nt, Homo Sapiens
uugaauaugcaaaagcaguuccgcugggaacccccauccaaucaacugcuguacccauggggg

SEQ ID NO: 585751 - RNA, 63 nt, Homo Sapiens
uucccuaugaaaaauguguuagcaccagagaauccauccaaagcauuuacuguuuuuuucugu

SEQ ID NO: 585752 - RNA, 63 nt, Homo Sapiens
cugugggaggaguaaacaacagacccucaaaacccauccaagacguucaccggacaccgcacc

SEQ ID NO: 585753 - RNA, 63 nt, Homo Sapiens
cugcauguauucauaauucuauuucauuucuaaccauccaauuggcuggaccuaaauagauug

SEQ ID NO: 585754 - RNA, 63 nt, Homo Sapiens
gccaaaaagaaaaagaaaaaaagauugaccaaaccauccaaauaacuuuggaauaaggaagag

SEQ ID NO: 585755 - RNA, 63 nt, Homo Sapiens
uagaugcagcugauacauucacuagucagaagaccauccaagaucuuuccuuggacaguagca

SEQ ID NO: 585756 - RNA, 63 nt, Homo Sapiens
ggccugggugaguucuguuugcuccuuguaccaccauccaaaugguguuaucaaaucucuuag

SEQ ID NO: 585757 - RNA, 63 nt, Homo Sapiens
acaugauaaggugguucuuucauaacucuaaugccauccaacauagcccugggagaggcaugu

SEQ ID NO: 585758 - RNA, 63 nt, Homo Sapiens
uuguuccccuggccccccacucucccuccauguccauccaaaaaccauaaaaucacuggguuc

SEQ ID NO: 585759 - RNA, 63 nt, Homo Sapiens
ucugucuccugucuucagagcaaaagacuugagccauccaaagaaacacuaagcucucugggc

SEQ ID NO: 585760 - RNA, 63 nt, Homo Sapiens
cccugcgucacacugugugaggcugugucucugccauccaaaagggggccccuugagaauggu

SEQ ID NO: 585761 - RNA, 63 nt, Homo Sapiens
uguccaaaagugaucuggucggaucucacaaggccauccaaugagaccccgcacagcauuuuc

SEQ ID NO: 585762 - RNA, 63 nt, Homo Sapiens
acaaaugaagacaaaacauacauuuuguaccaaccauccaauuagcuuauguuaacugacaag

SEQ ID NO: 585763 - RNA, 63 nt, Homo Sapiens
auggagagagggcgcagagcaaaccaugucacgccauccaaugacaccagcuggucagcucac

SEQ ID NO: 585764 - RNA, 63 nt, Homo Sapiens
agucuucuguaccaaugcaccagagaaugccuaccauccaaaaaagcagucagcugauggaaa

SEQ ID NO: 585765 - RNA, 63 nt, Homo Sapiens
ucacuucgccuuacaggucuccccaccguccagccauccaaccgauccaggacugcaccccac

SEQ ID NO: 585766 - RNA, 63 nt, Homo Sapiens
cuuugaauuucccagucuccuccuaugguuucuccauccaauucccccugacauuaucuugga

SEQ ID NO: 585767 - RNA, 63 nt, Homo Sapiens
agaggaugcucagauuucucccagcagcuucggccauccaaacuuccagaccagaguuugaug

SEQ ID NO: 585768 - RNA, 63 nt, Homo Sapiens
cuggggcaaagaugauuaccugggugagaaacaccauccaaagccacgccuggugaaggagcc

SEQ ID NO: 585769 - RNA, 63 nt, Homo Sapiens
uccaucagggaaaugagcugaauggccccagcaccauccaaguugacacagcuaaaggaauaa

SEQ ID NO: 585770 - RNA, 63 nt, Homo Sapiens
aaaugaaaggcuuuaguuauuucuagaggagucccauccaacacuauuuggcgacuguuaaua

SEQ ID NO: 585771 - RNA, 63 nt, Homo Sapiens
uccucuccaucuacuuuucccugugcauaauauccauccaaaggacaacaguggcaaagcuga

SEQ ID NO: 585772 - RNA, 63 nt, Homo Sapiens
caguguuuuaaacucuccuagucaauauccaccccauccaauuuaucaaggaagaaaugguuc

SEQ ID NO: 585773 - RNA, 63 nt, Homo Sapiens
ggugcaaaaaagugguggaacaaauaccaacauccauccaaaaugaaaaagaacaggaaauuc

SEQ ID NO: 585774 - RNA, 63 nt, Homo Sapiens
ccauauuuuaaaucaacuacuccacguguuuuuccauccaaucacacugcugugauucaggga

SEQ ID NO: 585775 - RNA, 63 nt, Homo Sapiens
agggcacaaaauccaagagaaggucugugagccccauccaacacccacaguaauuauuaucug

SEQ ID NO: 585776 - RNA, 63 nt, Homo Sapiens
cccgugcgccacugcagugaagaugcuguccccccauccaaaaugccacagcugugagggcca

SEQ ID NO: 585777 - RNA, 63 nt, Homo Sapiens
uuucuggugaauuacacagauuuucuaauuauuccauccaaaacauguuuuaaccucuuuuuu

SEQ ID NO: 585778 - RNA, 63 nt, Homo Sapiens
aaaugcagccagguuuagccccacuuccaucacccauccaauacuuuaccauaguacucccac

SEQ ID NO: 585779 - RNA, 63 nt, Homo Sapiens
aucauugcuuuuaacuguuuacaucuuauugaaccauccaaaauuguuuuaaguuauauauac

SEQ ID NO: 585780 - RNA, 55 nt, Homo Sapiens; identical to SEQ ID NO: 585564

SEQ ID NO: 585781 - RNA, 63 nt, Homo Sapiens
cuuagacucacgaacaaaucggucagccaacccccauccaaccucaaaugugggcccagccua

SEQ ID NO: 585782 - RNA, 63 nt, Homo Sapiens
guuuaacagcuguaaccaaugguacugaucuauccauccaauguugucauuauauuugacugu

SEQ ID NO: 585783 - RNA, 63 nt, Homo Sapiens
cucccacccuaagucuuacauaaugccaccaguccauccaaaaccuauauaucaccuauacua

SEQ ID NO: 585784 - RNA, 63 nt, Homo Sapiens
agaagggaggaaacguccauccaugauuuaagcccauccaaaacauucaaugugagacacuau

SEQ ID NO: 585785 - RNA, 63 nt, Homo Sapiens
cucgcccgacccaaacaccucugaaggcggagcccauccaacccgccaaggaccugcaaggga

SEQ ID NO: 585786 - RNA, 63 nt, Homo Sapiens
agcugggaccacaggugugcucucccaccucagccauccaaauaccucucaggcucaagcgau

SEQ ID NO: 585787 - RNA, 63 nt, Homo Sapiens
ucacccaguggauggaacauggaagaaacucucccauccaacaauugucacaugaccgguacu

SEQ ID NO: 585788 - RNA, 63 nt, Homo Sapiens
uugaaagcuguugauagaaaagaaaagggaaagccauccaaaugugaguaaccagauagcaaa

SEQ ID NO: 585789 - RNA, 63 nt, Homo Sapiens
ccuacuaggaagagaguggggaaggagaagcucccauccaaauaaacacaauguauagccaga

SEQ ID NO: 585790 - RNA, 63 nt, Homo Sapiens
ccucuagucagcacuagauccucucacagauacccauccaacuuggcuuccuuguuuaugggg

SEQ ID NO: 585791 - RNA, 63 nt, Homo Sapiens
cugagagacagaauucaaguggguauucuggggccauccaauuucucuuuacuugaaauuugg

SEQ ID NO: 585792 - RNA, 63 nt, Homo Sapiens
caccuucccugucgaucccuucugagguauggcccauccaagacuuuuaggccauucuugaug

SEQ ID NO: 585793 - RNA, 63 nt, Homo Sapiens
ggccuggcaccuccauccugaggugcugccccuccauccaaaacugccaagugacucauugcc

SEQ ID NO: 585794 - RNA, 63 nt, Homo Sapiens
uaccuggauauaaauuaauugugccugccaccaccauccaacagaccuggugcucuaaugcca

SEQ ID NO: 585795 - RNA, 63 nt, Homo Sapiens
ccacaccagcaccuuguuaccagugucggcuccccauccaaaugcacaugucagggaagcacc

SEQ ID NO: 585796 - RNA, 63 nt, Homo Sapiens
ggaaaugauaaucagaaaagacuguaaauagauccauccaaaugauuucucuguacaaaugaa

SEQ ID NO: 585797 - RNA, 63 nt, Homo Sapiens
uugggguaggguggaguggggagggauuaaaacccauccaaaaaauaaauaaaaacuauauag

SEQ ID NO: 585798 - RNA, 63 nt, Homo Sapiens
aaaaguacugaaaugaguauaaggcaguaucacccauccaaaagaaaggucuuuauagaccug

SEQ ID NO: 585799 - RNA, 63 nt, Homo Sapiens
auaagucuguuucugaaauagucaauagucuucccauccaaacuauaagagaaugugaauuuc

SEQ ID NO: 585800 - RNA, 63 nt, Homo Sapiens
gaggggcugggacuggggagggggcagccaccuccauccaaggcucuuccuaggggcccugcu

SEQ ID NO: 585801 - RNA, 63 nt, Homo Sapiens
cugugccuuggacauggugauggugauggguugccauccaagugaaagucuuuuccuugacca

SEQ ID NO: 585802 - RNA, 63 nt, Homo Sapiens
agugcuaugccuggaggcucaacacaaaacuucccauccaaacauucagaugaacugagcguc

SEQ ID NO: 585803 - RNA, 63 nt, Homo Sapiens
ucaagcuucucgcccacuccacggcucugagccccauccaagggcaagacuuggugcccagcu

SEQ ID NO: 585804 - RNA, 63 nt, Homo Sapiens
aagauacaguuugaagacaguuacaucuuaauuccauccaaaguuuaucuuaaaacuauacag

SEQ ID NO: 585805 - RNA, 63 nt, Homo Sapiens
ccaaggaccugggauaaacuagaauuucccgggccauccaagcgggugcuuccguggggcaug

SEQ ID NO: 585806 - RNA, 63 nt, Homo Sapiens
ucagaaggcuuugggauaugcugaugcagugcuccauccaaacuuggggcuucugugaaaaac

SEQ ID NO: 585807 - RNA, 63 nt, Homo Sapiens
gcuuuuucucucaggguucugagucagaggacaccauccaagaauguuguuagcuuuucaguu

SEQ ID NO: 585808 - RNA, 63 nt, Homo Sapiens
aguggacucaacgcagaagaauggacgaaaugaccauccaacgugauuaaggauaggaaucgg

SEQ ID NO: 585809 - RNA, 63 nt, Homo Sapiens
cuagcacccuuuacugcuguguauggggcuucaccauccaagaggugguagguuggaguaaga

SEQ ID NO: 585810 - RNA, 63 nt, Homo Sapiens
uagacuccucuuccuccuggaccccauccucuaccauccaagcccugucccacuuuggcccua

SEQ ID NO: 585811 - RNA, 63 nt, Homo Sapiens
ucucccccaguguuggagugcaaggaggcggggccauccaaagcaacgcugaaggccuuuucc

SEQ ID NO: 585812 - RNA, 63 nt, Homo Sapiens
acugaaggcuacugcaggucacugaguugccugccauccaaaggggaugggcgggauuggaag

SEQ ID NO: 585813 - RNA, 63 nt, Homo Sapiens
aaggccccuuggcuguggcacuaugugcccucaccauccaauauagcagccaccugccugcuc

SEQ ID NO: 585814 - RNA, 63 nt, Homo Sapiens
aacuacuaccuaucaagaaucaauuuugcagcaccauccaagaaaggaacaccaaggccauuu

SEQ ID NO: 585815 - RNA, 63 nt, Homo Sapiens
uuaacacaacauuucucaguuaaaaaaauaaauccauccaacuauuuuuuuguacugggccuu

SEQ ID NO: 585816 - RNA, 63 nt, Homo Sapiens
acuaaccaggcccgacccuguauaaaauuucucccauccaagugcuaguguucauguguucuu

SEQ ID NO: 585817 - RNA, 63 nt, Homo Sapiens
gacggcgcugcagggccucaagagaagaauaaaccauccaagauaccuaggggaaaaccugcc

SEQ ID NO: 585818 - RNA, 63 nt, Homo Sapiens
aucuacccaccugucuuccucugauuuaucucaccauccaauuuuacccaucuacucaaauau

SEQ ID NO: 585819 - RNA, 63 nt, Homo Sapiens
cuacagcccuggccuccacccccaccccgccgaccauccaagggagagugagaccuggcagcc

SEQ ID NO: 585820 - RNA, 63 nt, Homo Sapiens
cuagauuuggggcucagaaggcccugcucucucccauccaagugaccagaugcccuacucagc

SEQ ID NO: 585821 - RNA, 63 nt, Homo Sapiens
uauuggaucugugccuguaauaucaggauacuaccauccaaaucuaucuagauaucuugugca

SEQ ID NO: 585822 - RNA, 63 nt, Homo Sapiens
acuaagucucuagccucuuucucccuucugcucccauccaagaaagacaguguauaaggaaca

SEQ ID NO: 585823 - RNA, 63 nt, Homo Sapiens
ugguaugauucuauuauauauuuuauauaaaauccauccaaauuaaguuuuggguaagugugu

SEQ ID NO: 585824 - RNA, 63 nt, Homo Sapiens
guaaacagaugacauuuucugaccaggcacaugccauccaauuuucugucaaucacacuguug

SEQ ID NO: 585825 - RNA, 63 nt, Homo Sapiens
acaugaucauuugcaaaccucccccagccccuaccauccaauguggaaggaaaacaagaacug

SEQ ID NO: 585826 - RNA, 63 nt, Homo Sapiens
uaaaagcauggacugugccacacacccagugauccauccaaaaacaaggacugcagccuaaau

SEQ ID NO: 585827 - RNA, 63 nt, Homo Sapiens
aagaaaccuaaaauaauuggucucgugggagagccauccaaauugaaguaaucccgccaccua

SEQ ID NO: 585828 - RNA, 63 nt, Homo Sapiens
uugaacugugaaagagagguaauauuaguaaccccauccaagauuguugauagcagauggauc

SEQ ID NO: 585829 - RNA, 63 nt, Homo Sapiens
aggccuuuuaacucagccuccaucuuucugccuccauccaaagaggauuugagagcuggagcc

SEQ ID NO: 585830 - RNA, 63 nt, Homo Sapiens
gauugugcaaauccccucccaugugacaugaacccauccaauguaccagugagcagagcccuc

SEQ ID NO: 585831 - RNA, 63 nt, Homo Sapiens
gcagagaaccaaaggggccaagcauaaauccauccauccaaagggcucccuccagacaaugcc

SEQ ID NO: 585832 - RNA, 63 nt, Homo Sapiens
uuggauucaguuuugugaaaauggauucuguggccauccaagggauguaucagggaugaucag

SEQ ID NO: 585833 - RNA, 63 nt, Homo Sapiens
cuuccuaccaguuucucagaauuacacgcacgaccauccaaacauuggcuccaugccagggcu

SEQ ID NO: 585834 - RNA, 63 nt, Homo Sapiens
gcucaccccugggcaagaggcuggaaguucacaccauccaaaauuuauccuuguuuuuuuucu

SEQ ID NO: 585835 - RNA, 63 nt, Homo Sapiens
cugggcucuucucuggccucuucaccagggcacccauccaaggaaccuccgaacagccaggaa

SEQ ID NO: 585836 - RNA, 63 nt, Homo Sapiens
acuuggccuaaaaauacucccuuaagucaccucccauccaagagagaucagagccagaucagc

SEQ ID NO: 585837 - RNA, 63 nt, Homo Sapiens
agagagauggggagguuuuuuauuuucaaauacccauccaacaugcagauaucaagaguuugu

SEQ ID NO: 585838 - RNA, 63 nt, Homo Sapiens
agggauacaggggaggcgguaaagaaaggcuaaccauccaaacggcuaacacgggcaagaggg

SEQ ID NO: 585839 - RNA, 63 nt, Homo Sapiens
ugccccccacucaucugccaaagggaacagaguccauccaagcuugugcuccucuggccagga

SEQ ID NO: 585840 - RNA, 63 nt, Homo Sapiens
cgccaucauaaaggaaucuucuagaacuguguaccauccaauuccagugacugggacccuacu

SEQ ID NO: 585841 - RNA, 63 nt, Homo Sapiens
aggcacagccgucauuacugucugaggucuccaccauccaaggugccuguguugcagaccauu

SEQ ID NO: 585842 - RNA, 63 nt, Homo Sapiens
uguugcauguaugaauaguuauucccuugaaauccauccaaguaucuuuuuucauucagcaua

SEQ ID NO: 585843 - RNA, 63 nt, Homo Sapiens
ggagggaaacuuuaaaacaaagaauaugaucuuccauccaaguuacaaagagaaaucucuaaa

SEQ ID NO: 585844 - RNA, 63 nt, Homo Sapiens
ucuuauuuuauuuuaccuucaaaaacaaaaacgccauccaaaaccaaggaaguccuugguguu

SEQ ID NO: 585845 - RNA, 63 nt, Homo Sapiens
gcccacggggacaucaguaaccuucugcagccaccauccaaugccauuacugucaagugagac

SEQ ID NO: 585846 - RNA, 63 nt, Homo Sapiens
uaucaguuugaggaaguggcugucccuguggccccauccaaccacuguacacacccgccugac

SEQ ID NO: 585847 - RNA, 63 nt, Homo Sapiens
gacccaaacuuuacucugggagguaggcuaugcccauccaaauaaaucuccaugagaaacuug

SEQ ID NO: 585848 - RNA, 63 nt, Homo Sapiens
ccucuuuuucugcacugccauauucacccccaaccauccaaucuguggauaauuggauguuag

SEQ ID NO: 585849 - RNA, 63 nt, Homo Sapiens
cuacugagcucuccacucuguuucccgccugggccauccaaccuugaaguccuaaaccacacc

SEQ ID NO: 585850 - RNA, 63 nt, Homo Sapiens
gauccucccacccagucugccccuggucucugcccauccaaucagagcccacccuccuggaag

SEQ ID NO: 585851 - RNA, 63 nt, Homo Sapiens
auccgauaacuuaaaaacguagcucaucccuuaccauccaaggggcacucccuugguuggauu

SEQ ID NO: 585852 - RNA, 63 nt, Homo Sapiens
ccacccaagacacaguacccagucaugguuuccccauccaacuauuaguuucauacuuugaaa

SEQ ID NO: 585853 - RNA, 63 nt, Homo Sapiens
aaaaucaggagccugcuaagcuugaaaaugccaccauccaauaucaagauccucuugccacau

SEQ ID NO: 585854 - RNA, 63 nt, Homo Sapiens
aauccagggacuugaagaaagacuaggugugucccauccaaguugagcacgcgccuuccccag

SEQ ID NO: 585855 - RNA, 63 nt, Homo Sapiens
guggaugggccaccgccuugcccagccuggaugccauccaaguuguauauuuuuuuaaucucu

SEQ ID NO: 585856 - RNA, 63 nt, Homo Sapiens
aucucagagaaucagcuaaguuuccuaacuuguccauccaaaugugaucaccacgauucaaca

SEQ ID NO: 585857 - RNA, 63 nt, Homo Sapiens
aaguggagaauuguggaaggauuguaacauggaccauccaaauuuauggccguaucaaauggu

SEQ ID NO: 585858 - RNA, 63 nt, Homo Sapiens
ggugugaagggacugcuguuugcaaugggcuuaccauccaaauaucccaaaggcuuugaccag

SEQ ID NO: 585859 - RNA, 63 nt, Homo Sapiens
aguucugcccaaauuccgauaucaccccuucccccauccaagcauccuucgauuagggaagug

SEQ ID NO: 585860 - RNA, 63 nt, Homo Sapiens
uauuuccaguacauucuuucagagucuguuuuuccauccaaauauaagccccaggccauucca

SEQ ID NO: 585861 - RNA, 63 nt, Homo Sapiens
cuugaguuuucucacugauuuucccucccucagccauccaauugccccagugcgcuuccucug

SEQ ID NO: 585862 - RNA, 63 nt, Homo Sapiens
uuugggccuaugugaaaagauuucagcuaccacccauccaaccgguagggggaaaaucaguuc

SEQ ID NO: 585863 - RNA, 63 nt, Homo Sapiens
ccugaaaagcaaauuuggcaagauguauugguuccauccaacaucauggugucaggaaggcug

SEQ ID NO: 585864 - RNA, 63 nt, Homo Sapiens
ccugaaaaacaaacuuggcaagaugcauuggcuccauccaacaucauggugucuggaaggcuu

SEQ ID NO: 585865 - RNA, 63 nt, Homo Sapiens
aggguucuuccuuccugugguccguccacacucccauccaaggggaguaguggcaacagcccu

SEQ ID NO: 585866 - RNA, 63 nt, Homo Sapiens
cacuuuuagaaaucuucucugaccuagaagaauccauccaaaucccugccuuccucucugaac

SEQ ID NO: 585867 - RNA, 63 nt, Homo Sapiens
uagguccucaagugcucgugacacauaaucauuccauccaaugaucgccuuugcuuuaccacu

SEQ ID NO: 585868 - RNA, 63 nt, Homo Sapiens
uugcaacucagagcugcugcacucaggagggccccauccaaucccgggccccugcagggaaaa

SEQ ID NO: 585869 - RNA, 63 nt, Homo Sapiens
auccugcuguguguccuguuccauguuccgguuccauccaaauacacuuucuggaacaaaugc

SEQ ID NO: 585870 - RNA, 63 nt, Homo Sapiens
aaugcaugccugaugaccaaacucucccuuuccccauccaaucgguccacacuccccgcccug

SEQ ID NO: 585871 - RNA, 63 nt, Homo Sapiens
gaaaagauuguggccaagaagagugaaugugucccauccaaaggugcauccagauaugucugu

SEQ ID NO: 585872 - RNA, 63 nt, Homo Sapiens
ccugugucuuuccauagucaggcgccagacccuccauccaagcugcuccauccaucccuccug

SEQ ID NO: 585873 - RNA, 63 nt, Homo Sapiens
ggucccagagcuggagcuucuaggauucaaaccccauccaacuccacuaacaggagccagggu

SEQ ID NO: 585874 - RNA, 63 nt, Homo Sapiens
gcucucaaggacaccggcaaggggccugagugcccauccaagguagggcccugcugggacaug

SEQ ID NO: 585875 - RNA, 63 nt, Homo Sapiens
gguccacacuccccgcccccacucucccuuucuccauccaaucaaugcgugccugaugaccaa

SEQ ID NO: 585876 - RNA, 63 nt, Homo Sapiens
uguucugcauaucauuguucauuaaccugaaauccauccaaguggcuauuucaacuaaagcag

SEQ ID NO: 585877 - RNA, 63 nt, Homo Sapiens
cuaacucugccaaccacuuuuuaugcuuacacuccauccaaacaagucccucaugcuaccuuu

SEQ ID NO: 585878 - RNA, 63 nt, Homo Sapiens
uugcacuauguucacuuugggguugguucucagccauccaagggucuccagugagguggcugc

SEQ ID NO: 585879 - RNA, 63 nt, Homo Sapiens
gucauggacccagauggggcuuucccuuuguagccauccaaugggcauugugugggugcuugg

SEQ ID NO: 585880 - RNA, 57 nt, Homo Sapiens; identical to SEQ ID NO: 585664

SEQ ID NO: 585881 - RNA, 63 nt, Homo Sapiens
guugguuuaguggauguucguggaauugcugacccauccaagggcguccuuuggagccagugg

SEQ ID NO: 585882 - RNA, 63 nt, Homo Sapiens
caggagaccacaaagguuucacuucuuuuagauccauccaauaugcgaaaaaaggguacauuu

SEQ ID NO: 585883 - RNA, 63 nt, Homo Sapiens
cucaucuuaaauuguaaucuuggcucugugucuccauccaaauuaauauggagugauauaguu

SEQ ID NO: 585884 - RNA, 63 nt, Homo Sapiens
augaguaauagcacaaaguauuccccucacccaccauccaauauaggacauauauuuuguauu

SEQ ID NO: 585885 - RNA, 63 nt, Homo Sapiens
gauaaauugcuaauuaagcaacaaucuaaccugccauccaaauaaggcuuuccugagcaagug

SEQ ID NO: 585886 - RNA, 63 nt, Homo Sapiens
cucaucuugaauuguucccguuuggcuguguccccauccaaaucaaaucccuaguugauaggg

SEQ ID NO: 585887 - RNA, 63 nt, Homo Sapiens
gcuguuggggcugguggugagcccuguccugacccauccaagcgcagaaugaauugucuggua

SEQ ID NO: 585888 - RNA, 63 nt, Homo Sapiens
accauuuuuucuuucaguccggucauugacuggccauccaauuuuauuuggacugcauuaauu

SEQ ID NO: 585889 - RNA, 63 nt, Homo Sapiens
gccuuuucugaaguuacagagcacacguugucuccauccaauggcucugcuuccuguagacac

SEQ ID NO: 585890 - RNA, 63 nt, Homo Sapiens
aaaaugcuggaaaacuguaaagacuuccaggucccauccaaggagauuuugcuucugauugac

SEQ ID NO: 585891 - RNA, 63 nt, Homo Sapiens
uauaaauugaguccuaaguauuaauuauugccaccauccaacucauugagucuuaugguucac

SEQ ID NO: 585892 - RNA, 63 nt, Homo Sapiens
cgauuauugagucguaaguauuaauuauugccaccauccaacucauugagucuuaugguucac

SEQ ID NO: 585893 - RNA, 63 nt, Homo Sapiens
uccacagugccaguuccuugccccaaccuggccccauccaaguacagaagaccuuccuuuccu

SEQ ID NO: 585894 - RNA, 63 nt, Homo Sapiens
guugggguaaugggaacuggaggcuccauucccccauccaagaacaaguccuguaacuucccc

SEQ ID NO: 585895 - RNA, 63 nt, Homo Sapiens
ggugggagcacaucugcccuguucagcccagcaccauccaaaguccagcaggacuccaggaug

SEQ ID NO: 585896 - RNA, 63 nt, Homo Sapiens
uuguucugccaccacuggauagagcacuggggcccauccaagugugaggguccugguuccagc

SEQ ID NO: 585897 - RNA, 63 nt, Homo Sapiens
uaaaugccacagcuggggcucugcauccccuccccauccaaccagccccuuccuccuuccauu

SEQ ID NO: 585898 - RNA, 63 nt, Homo Sapiens
ucagcaggccuucucgggcccucgcacucaaagccauccaaccgccucugucacccagcuauc

SEQ ID NO: 585899 - RNA, 63 nt, Homo Sapiens
acugaggcagccuuggggaaauuuccuuccagcccauccaaacggcccucccagaaccucagc

SEQ ID NO: 585900 - RNA, 63 nt, Homo Sapiens
uaaaaugaucaaucaagauaaaaggugaucuauccauccaauggaauauuauuuggccuuaaa

SEQ ID NO: 585901 - RNA, 63 nt, Homo Sapiens
aucaccucuuccuggaagccuuccucuuuuccaccauccaaaacccucuuaauacccugugua

SEQ ID NO: 585902 - RNA, 63 nt, Homo Sapiens
gagagggaaagaucguaaggaugagagaggagaccauccaagccagaaauuauuuaauaaauc

SEQ ID NO: 585903 - RNA, 63 nt, Homo Sapiens
auguucagggagccuugcaguguuauacgcgugccauccaaauuaauccugcauuugcagaug

SEQ ID NO: 585904 - RNA, 63 nt, Homo Sapiens
cuauuuuuccgaacaauccuuguagaguauguaccauccaaaggcaggagggccucgccgugg

SEQ ID NO: 585905 - RNA, 63 nt, Homo Sapiens
ggagaaucuuccccaggguucacaacacaaauuccauccaagauagcacaaaagucuugauag

SEQ ID NO: 585906 - RNA, 63 nt, Homo Sapiens
uuuuguauguuuuuguaaacuguaucccuugugccauccaacacaauccguuuauauuagcac

SEQ ID NO: 585907 - RNA, 63 nt, Homo Sapiens
aaaggauuacgucugcaucuaaaacaaccaccaccauccaacagaaccaauagucucaaagua

SEQ ID NO: 585908 - RNA, 63 nt, Homo Sapiens
agaaggucccuuuuuccaaccauaguaggugcaccauccaagggugccauaaauuauguggcu

SEQ ID NO: 585909 - RNA, 63 nt, Homo Sapiens
gugcuuuagucauauaugaauuuaaaccuaguaccauccaaaaccauguaauggauuuuaaga

SEQ ID NO: 585910 - RNA, 64 nt, Homo Sapiens
acggucccacccaagccugucaccucugcucauccuccaagaccacccagcuuucucccagcca

SEQ ID NO: 585911 - RNA, 64 nt, Homo Sapiens
uucuccucaggacaaggccuugcucacucacucacuccaagaccaccagggucccaggaagccg

SEQ ID NO: 585912 - RNA, 64 nt, Homo Sapiens
uccccccucaauugagagcucuuguuauucagagcuccaagacuagaccuggcuaacaaacaua

SEQ ID NO: 585913 - RNA, 64 nt, Homo Sapiens
uguuuucaaagcccccgauaaucgcucuuuuccacuccaagaugcccucauaaaccaauguggc

SEQ ID NO: 585914 - RNA, 64 nt, Homo Sapiens
gggggcggcuugucuucgcuggcuccuaccccaucuccaagauaagccugagccuuagcuccca

SEQ ID NO: 585915 - RNA, 64 nt, Homo Sapiens
auauuauuuaaauguugaaaucuuaaaaaccugccuccaagauuucagaagccaaguuuuucua

SEQ ID NO: 585916 - RNA, 64 nt, Homo Sapiens
gaaagauauaauuugagcaguggcuuuaugcagacuccaagaacaaaaccaccagguauuuuuu

SEQ ID NO: 585917 - RNA, 64 nt, Homo Sapiens
agaugagaccaaagaaucuggcaaacaucacagacuccaagaauuaccuaauaauccagaucac

SEQ ID NO: 585918 - RNA, 64 nt, Homo Sapiens
cuacauuauaagaauaaguaaacauuuccuggaccuccaagaagauuuugauaaagcugcuuua

SEQ ID NO: 585919 - RNA, 64 nt, Homo Sapiens
cccucacugcacuuuggaccccuggggccaacaucuccaagacaaaguuuuucagaaaagagga

SEQ ID NO: 585920 - RNA, 64 nt, Homo Sapiens
cuguuuccuaauucaggaccccacucaucuagcccuccaagagccuccgccaaauuguagccau

SEQ ID NO: 585921 - RNA, 64 nt, Homo Sapiens
guuguucacagauauuuuauguuuuuuuaauuuucuccaagaauauuuauagaauuccaaagaa

SEQ ID NO: 585922 - RNA, 64 nt, Homo Sapiens
aaggcugggguuagaguggggagugggcuucuuccuccaagaucucagucucucagugcuuggc

SEQ ID NO: 585923 - RNA, 64 nt, Homo Sapiens
cauugacccgucuccaucggaccccagccccuaucuccaagagacagaggaggggucaggaggc

SEQ ID NO: 585924 - RNA, 64 nt, Homo Sapiens
aggcuugcccagauagacuaacaacccuuuagugcuccaagaagugagaauuuccgaaaaagau

SEQ ID NO: 585925 - RNA, 64 nt, Homo Sapiens
cugagccuggucuuuuguccuuuuuuauuuuggucuccaagaugaaugcucaucuuuggagggu

SEQ ID NO: 585926 - RNA, 64 nt, Homo Sapiens
acuaaagggcuugucuugguggggucucccaccccuccaagacccauucugcacagucccucca

SEQ ID NO: 585927 - RNA, 64 nt, Homo Sapiens
auuugaucugcucaucuucaguugaaugcccucacuccaagacuggaugcuggaucucauagaa

SEQ ID NO: 585928 - RNA, 64 nt, Homo Sapiens
uguuuaaaaaaaaaaaaguguguggaccacagaacuccaagaauauugaaacagaaggaaaugc

SEQ ID NO: 585929 - RNA, 64 nt, Homo Sapiens
ggccacccauagagcucaucgcagaacccaggagcuccaagaaaagcauuucaugggggcugag

SEQ ID NO: 585930 - RNA, 64 nt, Homo Sapiens
cuguguggagccaccacuccgggccaccucaggacuccaagaggaggcaccucagugggguucc

SEQ ID NO: 585931 - RNA, 64 nt, Homo Sapiens
gaagcaguagcugagcaccuuccuuggucaccugcuccaagaaggcagggagugauagccaaac

SEQ ID NO: 585932 - RNA, 64 nt, Homo Sapiens
gccuguauuauacguguccuacucaucccucugccuccaagaagugcccaugagcugacauuuu

SEQ ID NO: 585933 - RNA, 64 nt, Homo Sapiens
guuucauaucuauuccuuaaccuucuaauuuuuacuccaagauuuacaaacuugaagcaaguug

SEQ ID NO: 585934 - RNA, 64 nt, Homo Sapiens
acugcacaccagcuccucacuggggacaguccuacuccaagaaccuggccggcuuuucuccauc

SEQ ID NO: 585935 - RNA, 64 nt, Homo Sapiens
caggccccgcugaugcaagaaccagcuuagacaccuccaagaacccucagauaagcccuuaggc

SEQ ID NO: 585936 - RNA, 64 nt, Homo Sapiens
auuggaaugcuuccaaagcaugcuugggaagaaacuccaagaagagguggcagggcggaggacc

SEQ ID NO: 585937 - RNA, 64 nt, Homo Sapiens
agagauccacauaccauucuucuccugaggaucacuccaagaaaggaaauggacaccaagaaua

SEQ ID NO: 585938 - RNA, 64 nt, Homo Sapiens
agagugaggaagacccccaaagucuugguugugacuccaagagcggacuucguugguuuuuugg

SEQ ID NO: 585939 - RNA, 64 nt, Homo Sapiens
agagcagggaagagcccaagaguguuggucaugacuccaagagcgggacuuuguuggcuuuuag

SEQ ID NO: 585940 - RNA, 64 nt, Homo Sapiens
uacccaacuccuucccccuccacuccuuugcuuccuccaagacugauuuuccccuuuuucuacc

SEQ ID NO: 585941 - RNA, 64 nt, Homo Sapiens
uaccccagagaccuuaaacacuauucucuguuggcuccaagagcgaucccuauuccuaccccau

SEQ ID NO: 585942 - RNA, 64 nt, Homo Sapiens
ccugaccucaucuuccaccuguggguuggaaaaucuccaagagcauuuagaaacaaguucuagg

SEQ ID NO: 585943 - RNA, 64 nt, Homo Sapiens
ggaggcuguaggaauauaacggcaaaggagccuacuccaagaaugcuaaggugaaaaggggugu

SEQ ID NO: 585944 - RNA, 64 nt, Homo Sapiens
uucauuaagugcuuuguuucgccuagaagaaacacuccaagauaaaaugaaacccaggcaacca

SEQ ID NO: 585945 - RNA, 64 nt, Homo Sapiens
cuguggacuuggucaccagcuucccucaucucuccuccaagacaaacguguugccuugaaccac

SEQ ID NO: 585946 - RNA, 64 nt, Homo Sapiens
ucacauuaaaaaaaacccauacauaagaaacagccuccaagaacauucaagcagcagucagaga

SEQ ID NO: 585947 - RNA, 64 nt, Homo Sapiens
gagcaagauuguguuuuagagaggaaacuugaaacuccaagaaagcacuugauguuuuuauaug

SEQ ID NO: 585948 - RNA, 64 nt, Homo Sapiens
aaggugagcucgcugaguccagccucguggucuucuccaagaugccgccagaugcccagccuac

SEQ ID NO: 585949 - RNA, 64 nt, Homo Sapiens
ugcauuccagccugguugacagagugacccuugucuccaagaaaaaaaaaaagcaaaugggauu

SEQ ID NO: 585950 - RNA, 64 nt, Homo Sapiens
acccccaagaaaccuccauccugccaggagcagccuccaagaaacuuuuaaaaaauagauuugc

SEQ ID NO: 585951 - RNA, 64 nt, Homo Sapiens
cuucagaugacacguuuuguuuagagcuacuuugcuccaagacucuuaagcccaaaguaacugg

SEQ ID NO: 585952 - RNA, 64 nt, Homo Sapiens
uguggcuuaguaauagaucacggcauguuucccgcuccaagagaauucacuuuaccuucagcag

SEQ ID NO: 585953 - RNA, 64 nt, Homo Sapiens
gccugcccucgggcucugcucaccucuggugacccuccaagaugccccugcccucaguuucccc

SEQ ID NO: 585954 - RNA, 64 nt, Homo Sapiens
ucucaguccugcaucuuuucuucugcuuucuucccuccaagagcaaaaccugggcaaggggacu

SEQ ID NO: 585955 - RNA, 64 nt, Homo Sapiens
auccauucacagccaggagaugcugggccaguuccuccaagaggucuccaucauggcagugaug

SEQ ID NO: 585956 - RNA, 64 nt, Homo Sapiens
aaucugcuuuuuucaucauuuguuuaaagaaguacuccaagaacccagguguuuuaagguuaag

SEQ ID NO: 585957 - RNA, 64 nt, Homo Sapiens
ccuuaaugaggggcaggaguaaggccaaacuguccuccaagacuaagacaggaugaccuuggac

SEQ ID NO: 585958 - RNA, 64 nt, Homo Sapiens
acaaagaagaagcaauggucucuugggccugcaccuccaagauauaagauuuuuacuucaucuu

SEQ ID NO: 585959 - RNA, 64 nt, Homo Sapiens
aaaaaucacacucugaauggggggaugcgaguaccuccaagaagugagcuagaggaagaugagg

SEQ ID NO: 585960 - RNA, 64 nt, Homo Sapiens
uaagccaacuugaugugaaaucacuaagacuuuccuccaagaacugaucuguguacaauuuuag

SEQ ID NO: 585961 - RNA, 55 nt, Homo Sapiens
ggcaugauaucuuugaauuucuuuccuccaagauucaagcauaauuacuuacuga

SEQ ID NO: 585962 - RNA, 64 nt, Homo Sapiens
gaagaagaaacugagcaguuucucuguagaaugucuccaagauuuaauuugcucuuagguucua

SEQ ID NO: 585963 - RNA, 64 nt, Homo Sapiens
aguuccggcagcuuuccccacaccugaggagugacuccaagaaggcacaucucuucugggcggc

SEQ ID NO: 585964 - RNA, 64 nt, Homo Sapiens
ccugcagcagccucgcgccccgcguuccgggcggcuccaagagagagcggagcaagugucccgg

SEQ ID NO: 585965 - RNA, 64 nt, Homo Sapiens
guggaaaacugcaugggaggcaaaaugcucuguucuccaagaggacccggaaguaaucacauag

SEQ ID NO: 585966 - RNA, 64 nt, Homo Sapiens
auuaaaggaaggggcacaauucgcuaucacacaccuccaagaucaagauccuguucugagucag

SEQ ID NO: 585967 - RNA, 64 nt, Homo Sapiens
ggucuaaaauuuuuaaggacuuuccuuccuccaucuccaagaaugcugaaaccaagggggauga

SEQ ID NO: 585968 - RNA, 64 nt, Homo Sapiens
cgaccaaggggucuucauuuccaugaaaaagggacuccaagaggcagugguggcuguggccccc

SEQ ID NO: 585969 - RNA, 64 nt, Homo Sapiens
cgguuccccagagcuuuggggaccacgcgaaaaccuccaagauauuuuucacaaaauagaaacu

SEQ ID NO: 585970 - RNA, 64 nt, Homo Sapiens
cuuagguaggugcuuaacucuugugguggccagccuccaagaugagccccaguguucuugccuc

SEQ ID NO: 585971 - RNA, 64 nt, Homo Sapiens
auggugacucacucucaaguauuucccaccugcccuccaagaaaacaaaugugauaaugacaug

SEQ ID NO: 585972 - RNA, 64 nt, Homo Sapiens
uugaguagggaaauauuuguaaaccuugauuuagcuccaagaaaguuuuuacuggaaacauagc

SEQ ID NO: 585973 - RNA, 64 nt, Homo Sapiens
gccauguaggguaauggagacucagggucccuuccuccaagauguaaagagcaaaggcaacgcc

SEQ ID NO: 585974 - RNA, 64 nt, Homo Sapiens
ucguuagcagcaucaguccaccgguacuagcuaacuccaagagauaaauacucugaauaagaga

SEQ ID NO: 585975 - RNA, 64 nt, Homo Sapiens
cuccugaaugugacuggcguguguauaagucaagcuccaagagggauauugcgccugugugcgu

SEQ ID NO: 585976 - RNA, 64 nt, Homo Sapiens
gauaaccugcaccccucccuacccagcccuccugcuccaagaggccuagguuuuccuuccaagc

SEQ ID NO: 585977 - RNA, 64 nt, Homo Sapiens
augucacuaguuuucuagaauguaagaggggcuucuccaagagcucucagcuucuuuggccuuc

SEQ ID NO: 585978 - RNA, 64 nt, Homo Sapiens
ucacugaugcacgccgaguucuccuuggcgaggacuccaagaacuaagaaaaagaaacuauuug

SEQ ID NO: 585979 - RNA, 64 nt, Homo Sapiens
gccagaguuuaauacaucuuuacuuuggaaucuccuccaagauaaagagcuggagaacuccaug

SEQ ID NO: 585980 - RNA, 64 nt, Homo Sapiens
uguugguuccaagcccuggaacagagcucuccagcuccaagaccuuccuauggcuggccacugc

SEQ ID NO: 585981 - RNA, 64 nt, Homo Sapiens
ccccagagcugccugcauaguugcuuagaggcggcuccaagagcuucuccuggugucuacaugu

SEQ ID NO: 585982 - RNA, 64 nt, Homo Sapiens
uaagcccuccaagggaucaguaugcccuccagagcuccaagauacaggaagcuucuagagacuu

SEQ ID NO: 585983 - RNA, 64 nt, Homo Sapiens
agccuucccugcgcccaggcccuccccaccuguccuccaagaacagagggcucuuccuccaaau

SEQ ID NO: 585984 - RNA, 64 nt, Homo Sapiens
gugcuccucggcagaugcuguuguuguuacuucccuccaagaggcuggaaaagggcucagagcu

SEQ ID NO: 585985 - RNA, 64 nt, Homo Sapiens
aggaaaacaaaaaccucucuccucagccuuccaccuccaagagaggaggaaaaacaguugucug

SEQ ID NO: 585986 - RNA, 64 nt, Homo Sapiens
uguguugugaaaguuuggaaggucagaccuuuuucuccaagaaggacaagccccuguguaagaa

SEQ ID NO: 585987 - RNA, 57 nt, Homo Sapiens
uaacuauuucaaggagaugaagagcaucuccaagaagagaugguaaaaagauauaua

SEQ ID NO: 585988 - RNA, 64 nt, Homo Sapiens
uagggcagcagaguggagcggacucuuuagaauacuccaagagucuuguaaauagcacuaguua

SEQ ID NO: 585989 - RNA, 64 nt, Homo Sapiens
aaauagaaaggcugcuuuaguaugauaacuaggucuccaagagaaacaaauuuguucuuccuga

SEQ ID NO: 585990 - RNA, 64 nt, Homo Sapiens
aaaauccucacuuauuaacuaugacaguagcugucuccaagagaucgaccuccaguucucccug

SEQ ID NO: 585991 - RNA, 64 nt, Homo Sapiens
cuaucaguuccuuggggacacacuaccuguuugccuccaagagagaguaaacuccacaucuuug

SEQ ID NO: 585992 - RNA, 64 nt, Homo Sapiens
uggaccaggcacacacacacggaagggaagagugcuccaagacuauaguaggacccaagggaaa

SEQ ID NO: 585993 - RNA, 64 nt, Homo Sapiens
cacaacucaagcugaacuguugguuugccucauucuccaagagcaaaugaaugaaacagucaaa

SEQ ID NO: 585994 - RNA, 64 nt, Homo Sapiens
gcaacagugcccccuccguccacuacgcuccugucuccaagaauguuuugcuagagcuaacaga

SEQ ID NO: 585995 - RNA, 64 nt, Homo Sapiens
gauagauuuucugcuacuuugcugcuaugguuuucuccaagagcuacauaauuuaguuucauau

SEQ ID NO: 585996 - RNA, 64 nt, Homo Sapiens
ugaucuggacuuccuauaauacaaauacacaauccuccaagaauuugacuuggaaaaaaauguc

SEQ ID NO: 585997 - RNA, 64 nt, Homo Sapiens
acucauucaaggaggugaaaaugauggaugacuccuccaagaugaaaauggaccagccgcagug

SEQ ID NO: 585998 - RNA, 64 nt, Homo Sapiens
gagaugcaaagagaagcgagagaggcaccuuguucuccaagaacuuacuguccaaucaugcugu

SEQ ID NO: 585999 - RNA, 64 nt, Homo Sapiens
aaagaaaagaacacuugcccagggcagcuuugcccuccaagaggcucccuccugucucuaaguc

SEQ ID NO: 586000 - RNA, 64 nt, Homo Sapiens
guggcuugaacuugccagaugcaaauaccacagacuccaagaaaacccgaguugggguuuguuu

SEQ ID NO: 586001 - RNA, 64 nt, Homo Sapiens
cuguuuuagggguuauacauuuggacugugcauucuccaagagaugaagcggugaaguugggau

SEQ ID NO: 586002 - RNA, 64 nt, Homo Sapiens
aguggaagcuuaauggaaaaggaaaguuaugauccuccaagacccuuaauugauagaccauacc

SEQ ID NO: 586003 - RNA, 64 nt, Homo Sapiens
acugaauuugcacaccuccuugccaccuuccuuccuccaagauaccaucuccucauccuaaccc

SEQ ID NO: 586004 - RNA, 64 nt, Homo Sapiens
auaauuacauuggcacaaugaaguucuagaaggucuccaagacauucuugcuauaugauuuagc

SEQ ID NO: 586005 - RNA, 64 nt, Homo Sapiens
caccucuauuuuauacaucaugugcauuuuaaaucuccaagaagucagaccuuugauacgcuaa

SEQ ID NO: 586006 - RNA, 64 nt, Homo Sapiens
ccaacugaguccccagcaccauaacuaagugcuucuccaagaccauuuaugagacauucuugcu

SEQ ID NO: 586007 - RNA, 64 nt, Homo Sapiens
uguuucugugcccaacuuuccucuuuuacagauucuccaagauucagagugugaaaacgaguuu

SEQ ID NO: 586008 - RNA, 64 nt, Homo Sapiens
agaccaggccaccucauccguugccacccugcuucuccaagagcaauacuggcccugucgacua

SEQ ID NO: 586009 - RNA, 64 nt, Homo Sapiens
gucuccuuuuggccaauaucacaguaagcagcaccuccaagacuacauuccaaaaggaaguuca

SEQ ID NO: 586010 - RNA, 64 nt, Homo Sapiens
uaggcucauggacgagauggccuccaacacaaggcuccaagacccguuccugacaucacagcag

SEQ ID NO: 586011 - RNA, 64 nt, Homo Sapiens
gacaggccucucugcaagagggaaagaccuucuacuccaagaaguaugucagaucaaccuggaa

SEQ ID NO: 586012 - RNA, 64 nt, Homo Sapiens
ccucaguccccaagacugcccagucuucccuucucuccaagagguccauggacuucugagccga

SEQ ID NO: 586013 - RNA, 64 nt, Homo Sapiens
agagacacagagugaugugaggcguuggcuuuuucuccaagaagguacagauaccucagauucg

SEQ ID NO: 586014 - RNA, 64 nt, Homo Sapiens
ccacggucuguucuugaagcaguagccuaacacacuccaagauauggacacacgggagccgcug

SEQ ID NO: 586015 - RNA, 64 nt, Homo Sapiens
cugucaugcaguguugucccuuccuaccuucuuccuccaagagaguaucaugaaguaaacuaca

SEQ ID NO: 586016 - RNA, 64 nt, Homo Sapiens
aggcucccuugggaaagcccugcuuugcuccaggcuccaagaucuccuggcuaagucagcaagu

SEQ ID NO: 586017 - RNA, 64 nt, Homo Sapiens
aacauuucuuucuuacaguucuggaggcuggaaacuccaagauuaaggcagauuucaugccuau

SEQ ID NO: 586018 - RNA, 64 nt, Homo Sapiens
uccauuuguccaguuaauacuuccucuuaaaaaucuccaagaagcugggucuccagaucccauu

SEQ ID NO: 586019 - RNA, 64 nt, Homo Sapiens
ggggcucuccagaccccuuuuccaugaugacccacuccaagauauuauguguaaauuguguuau

SEQ ID NO: 586020 - RNA, 64 nt, Homo Sapiens
uguucagccacuauggaaagcaguuuggagauuucuccaagaacuuaaaauagaacuaccauuc

SEQ ID NO: 586021 - RNA, 64 nt, Homo Sapiens
augggccuagaaagccaagugauccccacuacagcuccaagaggucccucuuccugugucccca

SEQ ID NO: 586022 - RNA, 64 nt, Homo Sapiens
guggaccagggucugcaaguaccgcuggcuuccacuccaagaagccucagggguccccuucugc

SEQ ID NO: 586023 - RNA, 64 nt, Homo Sapiens
cguggaucucccccucauccugagaaauagugcacuccaagaaagccccuccccucccgaacac

SEQ ID NO: 586024 - RNA, 64 nt, Homo Sapiens
caggcuuuacauaaacagcuagauaacacccugucuccaagacaaaugcaugugacugauaaag

SEQ ID NO: 586025 - RNA, 64 nt, Homo Sapiens
aaccucugauuuauuuuguaacaaguagggcugccuccaagagguccuagaauguuucauuugc

SEQ ID NO: 586026 - RNA, 64 nt, Homo Sapiens
guggcccaaggcuauagcccucgacagccagaugcuccaagagguguaacagggucacaagaau

SEQ ID NO: 586027 - RNA, 64 nt, Homo Sapiens
aaaaaauuaaagugcuuuucugacuaaauuaugccuccaagaaagaaaagugcuuuaggugaga

SEQ ID NO: 586028 - RNA, 64 nt, Homo Sapiens
auccgauucuuuaaaaugcaccaucagaccuggccuccaagaagagcuguagcguaccaugcgu

SEQ ID NO: 586029 - RNA, 64 nt, Homo Sapiens
uuucuccaaaggccauccuuuuggggccaccuggcuccaagaagcaucgcuggucuuggggacg

SEQ ID NO: 586030 - RNA, 64 nt, Homo Sapiens
augaauucuaaaccaaucaaaugucugggaagcccuccaagaaaaaaaauagaaaagcacuuga

SEQ ID NO: 586031 - RNA, 64 nt, Homo Sapiens
aaagagcaucuucucucccacugcaccccuucuccuccaagaauaguugcccacauucccaaaa

SEQ ID NO: 586032 - RNA, 64 nt, Homo Sapiens
agaggcccccagggaguugugagcagauuagacccuccaagaccgccccagggguuggcccaug

SEQ ID NO: 586033 - RNA, 64 nt, Homo Sapiens
acugcaucagccccugugagccuggcuucagugucuccaagaacuguaaccucggcaagugcca

SEQ ID NO: 586034 - RNA, 64 nt, Homo Sapiens
ucauccugguagcucuccugaugcucguuuuccgcuccaagagagaggugaaacggugagcgag

SEQ ID NO: 586035 - RNA, 64 nt, Homo Sapiens
ugccuuuuguuaaaagaugguaaaccagaucugucuccaagaccuuggccucuccuuggaggac

SEQ ID NO: 586036 - RNA, 64 nt, Homo Sapiens
agaagucacauuccugaacaggauauucucacagcuccaagaauuucuaggacugaauuaugaa

SEQ ID NO: 586037 - RNA, 64 nt, Homo Sapiens
aggcccauuaguugagaaagucacagauauauuucuccaagaaagccaacaaccaccaccacaa

SEQ ID NO: 586038 - RNA, 64 nt, Homo Sapiens
cgccaucuaugguguggaugggaaacugcuccagcuccaagagguuuuucagcucuuugacaac

SEQ ID NO: 586039 - RNA, 64 nt, Homo Sapiens
gaaaaaaaaaacucuugaaaagucagauuguuaacuccaagauuucuuugauaaaagaaaaaua

SEQ ID NO: 586040 - RNA, 59 nt, Homo Sapiens
accucucuccugugggugcaacaagcauucuccaagaaguuuuacagaagauucuauaa

SEQ ID NO: 586041 - RNA, 64 nt, Homo Sapiens
caaaguccagaguggcauuuaagcaaaauugaaacuccaagaugaaacuggggucuaaauccua

SEQ ID NO: 586042 - RNA, 64 nt, Homo Sapiens
uugaucucaguacccauuuagccugauauucuuccuccaagaaugacauugaaauuguuuaaga

SEQ ID NO: 586043 - RNA, 64 nt, Homo Sapiens
gaaccucaguuuacagcacaugacaugacauaaacuccaagacacccuucagcacaggaccugg

SEQ ID NO: 586044 - RNA, 64 nt, Homo Sapiens
uuaccuauguaaguguucaaaguaauauauuauucuccaagacugcauacaacagcaugccaac

SEQ ID NO: 586045 - RNA, 64 nt, Homo Sapiens
caacaucacugcucuuuuagcccuuuuaagggggcuccaagaacuaggcagagagcucagaugg

SEQ ID NO: 586046 - RNA, 64 nt, Homo Sapiens
ucggacugaggccuucucaaacuuuacucuaagucuccaagaauacagaaaaugcuuuuccgcg

SEQ ID NO: 586047 - RNA, 64 nt, Homo Sapiens
auuuuuguaaaaguuuaaugacccacuuuagaugcuccaagaacaagcaucccuuccauguaug

SEQ ID NO: 586048 - RNA, 64 nt, Homo Sapiens
ccacucaaacaucuccucuuccuccccauuuguccuccaagacuuucccugaguccucaccagc

SEQ ID NO: 586049 - RNA, 64 nt, Homo Sapiens
gagauugaugcaucagguucgcacacugagacaccuccaagaaguaagguggauucagugucug

SEQ ID NO: 586050 - RNA, 64 nt, Homo Sapiens
aaaacgaggauggaaaaccuggauggaaagaagacuccaagaggcggaaaauucaugcagauau

SEQ ID NO: 586051 - RNA, 64 nt, Homo Sapiens
acgcccucaugcucagcacaggcaaauagagagucuccaagagacugucccuguaaaagagagg

SEQ ID NO: 586052 - RNA, 64 nt, Homo Sapiens
aaacaaacagacagguccucccaagucacacaagcuccaagacucgacauaacagaauugcccu

SEQ ID NO: 586053 - RNA, 64 nt, Homo Sapiens
gagacguucagcuagauuugcuuuccccgcuucucuccaagaagaccucaacaagacugagagc

SEQ ID NO: 586054 - RNA, 64 nt, Homo Sapiens
cuaucugcuuaugcaguuuuacuuuagcugcauccuccaagaauguggcaauauagaaacacga

SEQ ID NO: 586055 - RNA, 64 nt, Homo Sapiens
acccuuugagccuuacaucucauucacugucuuucuccaagaaaaguauuuugggcggacaguc

SEQ ID NO: 586056 - RNA, 64 nt, Homo Sapiens
caaaaacuuuacaauacauuuauguugaauggaacuccaagaucucaccucuccauccaggaau

SEQ ID NO: 586057 - RNA, 64 nt, Homo Sapiens
auagcggcccuggaggauguuagacuugcucccucuccaagacagcagcagccugcaccugccc

SEQ ID NO: 586058 - RNA, 64 nt, Homo Sapiens
ccuccucccccggcugggccuccuucuuccacuucuccaagaauggaagccugaacugaggccu

SEQ ID NO: 586059 - RNA, 64 nt, Homo Sapiens
aaaguaaaugauucuauuuugacucuuucccggucuccaagaacgauuaaauauguauuuugua

SEQ ID NO: 586060 - RNA, 64 nt, Homo Sapiens
cauaguuacugaaaagggaguaaguuauccaggacuccaagaaccagacaggucucuauuuuuu

SEQ ID NO: 586061 - RNA, 64 nt, Homo Sapiens
uggguaauuugguuuaaaaauaacagagauugaacuccaagaggucacuacuuuaauaaagaau

SEQ ID NO: 586062 - RNA, 64 nt, Homo Sapiens
auuauuaacgcugcuguaccccagaguauuaacgcuccaagaguccccaagugccugccccucc

SEQ ID NO: 586063 - RNA, 64 nt, Homo Sapiens
agcacacuuuggggagauguccccugaggccccucuccaagagggcugguugugcugcaggcuc

SEQ ID NO: 586064 - RNA, 64 nt, Homo Sapiens
gguggcggccgggcaggcacgccauucccuccaccuccaagacagcugggggagccaccccucg

SEQ ID NO: 586065 - RNA, 64 nt, Homo Sapiens
auugaguguguucuaagugaaggcaaugggguuucuccaagacagccuguguggccucuacucu

SEQ ID NO: 586066 - RNA, 64 nt, Homo Sapiens
uccccaaaacuguugguaaaugucagauuuuuuccuccaagaguugugcuuuuguguuauuugu

SEQ ID NO: 586067 - RNA, 64 nt, Homo Sapiens
cugucacaguaacgugaaaacugauuauucuuuacuccaagagaauguuuuaacccaagcaagu

SEQ ID NO: 586068 - RNA, 64 nt, Homo Sapiens
aagugguaguccaaauuuucuuuaagcagcugcucuccaagacagggcccuggaaaggcccaca

SEQ ID NO: 586069 - RNA, 64 nt, Homo Sapiens
ccugagcaccaugauucccacagccagcucuuggcuccaagaugagcacccacaggaagccgac

SEQ ID NO: 586070 - RNA, 64 nt, Homo Sapiens
uguugaacuucaaccugagggggccgacagugcccuccaagacagagacgacugaacuuuuggg

SEQ ID NO: 586071 - RNA, 64 nt, Homo Sapiens
uucuguuuuucuccuagucccucuccugccaccucuccaagacuuccgugggacacccacuucc

SEQ ID NO: 586072 - RNA, 64 nt, Homo Sapiens
acccagacaucugacuaauggcucugugcccacacuccaagaccugugccuuuuagagaagcuc

SEQ ID NO: 586073 - RNA, 64 nt, Homo Sapiens
ugugucccagaugcugucauuagucuauaugguucuccaagaaacugaaugaauccauuggaga

SEQ ID NO: 586074 - RNA, 64 nt, Homo Sapiens
aggcccugcuuccuggaaaggacacucagagcagcuccaagacagaggcucuguggcggggguc

SEQ ID NO: 586075 - RNA, 64 nt, Homo Sapiens
cugugaacuucugcaaagaccucaaagugaggugcuccaagacguuguuucuaaugucucugaa

SEQ ID NO: 586076 - RNA, 64 nt, Homo Sapiens
aguugcacuuaacuuuuuuuuccccuuauucccucuccaagaguggguaucuuuuucuuuugac

SEQ ID NO: 586077 - RNA, 64 nt, Homo Sapiens
gggcccuggaaagaggcccauuuaagcagcugcucuccaagacaaagugauaguccaaauuuuc

SEQ ID NO: 586078 - RNA, 64 nt, Homo Sapiens
guguauuuacaauauuugccaauuacaaagucaacuccaagaaucuguugaauaacaucggugu

SEQ ID NO: 586079 - RNA, 64 nt, Homo Sapiens
agcccuguuggugcuuuaccuuuucuuucucuugcuccaagaagagcuuacucaccccggaguc

SEQ ID NO: 586080 - RNA, 64 nt, Homo Sapiens
uuauggaauuaagaauuuuuuuacuguugcuuaucuccaagauauuaaaacguuuucuaacagu

SEQ ID NO: 586081 - RNA, 64 nt, Homo Sapiens
agcaggccaaggccaagcccaccaagcucaacgccuccaagacccgcuccuccaccccuuccag

SEQ ID NO: 586082 - RNA, 64 nt, Homo Sapiens
ugcaaggcaccccauccacacauuugcaccacuacuccaagauaguauuuuucuuuucacacaa

SEQ ID NO: 586083 - RNA, 64 nt, Homo Sapiens
ccacccccuucccuguccuuccccaacuccccagcuccaagaguggaagaaauccccaagauca

SEQ ID NO: 586084 - RNA, 64 nt, Homo Sapiens
cggccccagauagcagccccagggaggaugcugccuccaagaggugugagcccucugucucggg

SEQ ID NO: 586085 - RNA, 64 nt, Homo Sapiens
ugugggagguuaagaggagucccuucuggguugacuccaagagccaaggagauggcagacccug

SEQ ID NO: 586086 - RNA, 64 nt, Homo Sapiens
ccuuauucuuugggccuugaaugaagauuucagacuccaagaucgaggacuuaagguugcaaga

SEQ ID NO: 586087 - RNA, 64 nt, Homo Sapiens
gucucauauucuaccuggaccaaaaaucaaaacccuccaagauuucggagaccuguuuaacaag

SEQ ID NO: 586088 - RNA, 64 nt, Homo Sapiens
cuuacugaucuacugugaauuuuuacaauaugagcuccaagacaauagggcccaaaccuuuuua

SEQ ID NO: 586089 - RNA, 64 nt, Homo Sapiens
ugccuguggucaggccccagcuuugcgucuguggcuccaagaagacaauccccgagggcugcug

SEQ ID NO: 586090 - RNA, 64 nt, Homo Sapiens
uaaauuguuguuuuguauuuauccccaagauuuucuccaagaaaaaauuuucauuuuuaaugua

SEQ ID NO: 586091 - RNA, 64 nt, Homo Sapiens
aagcagagcccgggccacugucccgcugucuccucuccaagaacgucgcgcaucuccgugguua

SEQ ID NO: 586092 - RNA, 64 nt, Homo Sapiens
cuucgccuugggacaggaaugggcaggaagcggccuccaagaccccagcgccuggaggaggcag

SEQ ID NO: 586093 - RNA, 64 nt, Homo Sapiens
aagaaaauuuucaaauaaaacuagaaacaaaauacuccaagaaauuuaaacuguaguaguuggu

SEQ ID NO: 586094 - RNA, 64 nt, Homo Sapiens
gcaucccaucucagaagaugguuuuagaccucaucuccaagauaacaaccacucaccaguccua

SEQ ID NO: 586095 - RNA, 64 nt, Homo Sapiens
agaaugaaccuggcugugucggcugcugccucagcuccaagacaccgucuguagcaggagcuag

SEQ ID NO: 586096 - RNA, 64 nt, Homo Sapiens
acaaggacaggagacuuggggucucuaagguucccuccaagaagccagagcuagauccugaugg

SEQ ID NO: 586097 - RNA, 64 nt, Homo Sapiens
ucguuuccuguggccaauaagcaccagucacuuacuccaagaaguuguccagaugggccucgga

SEQ ID NO: 586098 - RNA, 64 nt, Homo Sapiens
uguucuacaggaaaggguccggaccuauuccucacuccaagacugugcuugaaauggacaagcu

SEQ ID NO: 586099 - RNA, 64 nt, Homo Sapiens
gcccguugcucuugggcugguuuccccugaacaccuccaagaggcugccugccuugccagcacc

SEQ ID NO: 586100 - RNA, 64 nt, Homo Sapiens
uccuggaguggagcauuuagcccaggucuuaauucuccaagaggaggaauacauaguaugguaa

SEQ ID NO: 586101 - RNA, 64 nt, Homo Sapiens
uggcaccucccucccucucaaccacuugagcaaacuccaagacaccuucuaccccaacaccagc

SEQ ID NO: 586102 - RNA, 64 nt, Homo Sapiens
cuuuguuaguagucuuaaagcugcugccauaguccuccaagaagaaagcaccaagacaacauuu

SEQ ID NO: 586103 - RNA, 64 nt, Homo Sapiens
ucagagacccaggaguugggagcuuucgcuccuucuccaagacucaggccugugggcacucuau

SEQ ID NO: 586104 - RNA, 64 nt, Homo Sapiens
augccuuccuguccuuucuacucaaugguccccacuccaagaugaguugacacaaccccuuccc

SEQ ID NO: 586105 - RNA, 64 nt, Homo Sapiens
auaaggaauaaaaggaaaaacuuucuuccucucucuccaagaggauaugggaagcuucugugag

SEQ ID NO: 586106 - RNA, 64 nt, Homo Sapiens
accugugcaggccccauggcaccaucuaucuggccuccaagaugagaaaggagcaugggacaga

SEQ ID NO: 586107 - RNA, 64 nt, Homo Sapiens
ggucugcuucuuccacuuauacuuagucucugugcuccaagaggucaaauuuuugcuucuagaa

SEQ ID NO: 586108 - RNA, 64 nt, Homo Sapiens
aaguuuuuuuguuuuuguuuuuguuuuguggcuccuccaagauauagguacaugaaguuuaggu

SEQ ID NO: 586109 - RNA, 64 nt, Homo Sapiens
aagaugggaauuaccuucaucccucucucuuugccuccaagaaguguaaccgccuugaagagcu

SEQ ID NO: 586110 - RNA, 64 nt, Homo Sapiens
aguagcugaugaagcugcccggcucaggaaguugcuccaagaacggggaagcaagauggguaag

SEQ ID NO: 586111 - RNA, 64 nt, Homo Sapiens
caauuauagaaacagcuccuaagcuauucugcagcuccaagauguaguugaccuucaaauauuc

SEQ ID NO: 586112 - RNA, 64 nt, Homo Sapiens
aaagaagagagauccuaaagaaacaugcaugauucuccaagacaccauagaacaauuucacugc

SEQ ID NO: 586113 - RNA, 64 nt, Homo Sapiens
gaauggucaaguuguuucaugguuuucuaugugacuccaagagggaaccaggguauuuuuguua

SEQ ID NO: 586114 - RNA, 64 nt, Homo Sapiens
ugagaucaauuuagggauugaaugcuucaugucccuccaagauuaaacagagacaugguucuau

SEQ ID NO: 586115 - RNA, 64 nt, Homo Sapiens
augggaggaaggggagcccccaacugcuuaccugcuccaagaaguccagcuucuacgcucacag

SEQ ID NO: 586116 - RNA, 64 nt, Homo Sapiens
uucuccugauguagcuugagggcaacugacauugcuccaagaugauucccagggaaccccaggg

SEQ ID NO: 586117 - RNA, 64 nt, Homo Sapiens
ccauugucucccuuuaaucuaaacuguaguuugccuccaagacaacggaaaguuaucuuacagc

SEQ ID NO: 586118 - RNA, 64 nt, Homo Sapiens
cuacagagccugaggggcacugcccgggcccuuccuccaagaccgacgcgccgcucccucaugc

SEQ ID NO: 586119 - RNA, 64 nt, Homo Sapiens
uuauuuaaaagccaaacgugcccugagcccucuccuccaagagguccccucagcaucaagcagc

SEQ ID NO: 586120 - RNA, 64 nt, Homo Sapiens
agacucugaggacauggagagagacucaaagagacuccaagauucaaagagacuaauagagaca

SEQ ID NO: 586121 - RNA, 64 nt, Homo Sapiens
agugaaguggugggagagaagagggauagacagucuccaagaaauacauaggcaaagagaauuc

SEQ ID NO: 586122 - RNA, 64 nt, Homo Sapiens
cugaggacuuugcccaggauggcaaggaaacaggcuccaagaggauuacuguccacauuuuaca

SEQ ID NO: 586123 - RNA, 64 nt, Homo Sapiens
cuugagaaacugcuaaaauuucaaaucugcucaacuccaagaguggcgauucugauuucccuuc

SEQ ID NO: 586124 - RNA, 64 nt, Homo Sapiens
uggagauaaggcuggacuggucuaucagauugaacuccaagaaugaucacacaaaauguuuagg

SEQ ID NO: 586125 - RNA, 64 nt, Homo Sapiens
ccaguguccgccaucuucaggguugcacagaauccuccaagauacuuugcagccuuuuuucccc

SEQ ID NO: 586126 - RNA, 64 nt, Homo Sapiens
uaucuuucuuccaccagacuccaagcccacucuccuccaagacuguguugucuuuucucaccaa

SEQ ID NO: 586127 - RNA, 64 nt, Homo Sapiens
gauccugcuuauuguaacugacaacuguuuucaacuccaagagcuaaacuauuggcaguucaug

SEQ ID NO: 586128 - RNA, 64 nt, Homo Sapiens
ggacugaagauuggcaaaaacgaaaagcuucuuccuccaagagcccauugaagaagcccaguga

SEQ ID NO: 586129 - RNA, 64 nt, Homo Sapiens
cacaagcugaacuguggcauagcucucucuucuucuccaagaagacucagcagccuacauuccc

SEQ ID NO: 586130 - RNA, 64 nt, Homo Sapiens
uuuucaguuuuaaaugugggcaaaaaggcauuuucuccaagauuuuaaaacuaauucuuauuuu

SEQ ID NO: 586131 - RNA, 64 nt, Homo Sapiens
cucacucccuaaagcccucuucaggggucaccuccuccaagaagcccuccuugccaccccccgc

SEQ ID NO: 586132 - RNA, 64 nt, Homo Sapiens
uacgaguuaaggaagagugcccuuccaagcuugccuccaagaguucauagcgggaaauaaagca

SEQ ID NO: 586133 - RNA, 64 nt, Homo Sapiens
agcuuuuuuucaucucuuaguugggggaagugagcuccaagaguuuaggaauguggugcucuug

SEQ ID NO: 586134 - RNA, 64 nt, Homo Sapiens
uggguaagcucugggccuucugauucaacuugggcuccaagacuucucccaacccucugguugg

SEQ ID NO: 586135 - RNA, 64 nt, Homo Sapiens
cuguguucauuugguguuccuucccccacuuccccuccaagaccccuuggggcauuauggguuc

SEQ ID NO: 586136 - RNA, 64 nt, Homo Sapiens
aguagagaauuuaagcacaaucucuuauccccuccuccaagagcccaaggggcaggaggcaccc

SEQ ID NO: 586137 - RNA, 64 nt, Homo Sapiens
ggaaacaugucgugugucuggaacaguagauagucuccaagaugucugacauuuuagaaaagcc

SEQ ID NO: 586138 - RNA, 64 nt, Homo Sapiens
ccgccucuccaaaauaaccggccacacucccaaacuccaagacagccauacuuccagcgaaaug

SEQ ID NO: 586139 - RNA, 64 nt, Homo Sapiens
auuaggauuagagacaaguucuguuuagaaauaacuccaagauugggaggccgaccugggugga

SEQ ID NO: 586140 - RNA, 64 nt, Homo Sapiens
ggaccugagcccgcacauuccacucccauucucccuccaagaggggcccagcauuguauuuccc

SEQ ID NO: 586141 - RNA, 64 nt, Homo Sapiens
cucagcagaguuacuguacucaaauggcaugugucuccaagacagcuuaugaauaucuaaaagg

SEQ ID NO: 586142 - RNA, 64 nt, Homo Sapiens
gaaggagaacugcaaaccucugaagaguuacaugcuccaagacucccuggagcacgugcagcug

SEQ ID NO: 586143 - RNA, 64 nt, Homo Sapiens
gaacagacucgaucguuagggaauggucuuagaacuccaagauguuccauaaguguuuuuacuu

SEQ ID NO: 586144 - RNA, 64 nt, Homo Sapiens
gaggaauucaguccccaggcagcccugccucugacuccaagagggugaaguccacagaagugag

SEQ ID NO: 586145 - RNA, 64 nt, Homo Sapiens
auugguccuacuuucuuucucuggaaaggaaagccuccaagacuccaugugcuugggcagcuug

SEQ ID NO: 586146 - RNA, 64 nt, Homo Sapiens
caacacuaucaaugucuuuggaggcagaaagaugcuccaagaacugagaccagacaaagcccgg

SEQ ID NO: 586147 - RNA, 64 nt, Homo Sapiens
aggucccuguggcgaaguuaggaagggaaggcagcuccaagaaggauuggagagggauggggag

SEQ ID NO: 586148 - RNA, 64 nt, Homo Sapiens
acaaaucguccuuguucuuauucaguaugugcuucuccaagaaugguuucacuggauuuucuuc

SEQ ID NO: 586149 - RNA, 64 nt, Homo Sapiens
agaauggccccgagagaacuauuugcucccugagcuccaagauaccucuugcguuuuggccccc

SEQ ID NO: 586150 - RNA, 64 nt, Homo Sapiens
aggagcagcugugagcuggagagaccacgcugcccuccaagacccacugggggcuucuccccag

SEQ ID NO: 586151 - RNA, 64 nt, Homo Sapiens
uccugcucccucugccagaagugucucccccucccuccaagagggccaggaggcugcagaacgu

SEQ ID NO: 586152 - RNA, 64 nt, Homo Sapiens
ucuggacaggaggcagacacgcugcuggcccggccuccaagagugggugggaggggcugagaug

SEQ ID NO: 586153 - RNA, 64 nt, Homo Sapiens
cuuccucuucuuugccgcggacucccuuuccugccuccaagaccuggugucucccacugugagc

SEQ ID NO: 586154 - RNA, 64 nt, Homo Sapiens
caucauggaggagcggugagaacauggaaccggacuccaagaugacgaucuaaagacccgggag

SEQ ID NO: 586155 - RNA, 64 nt, Homo Sapiens
ccucucucacuccuugaaaacacuguucucugcccuccaagaccuucuccuucaccuuuguccc

SEQ ID NO: 586156 - RNA, 64 nt, Homo Sapiens
cuaagcaggguccaagccuggggcugccucugcucuccaagacccaaagacccugggaaccucc

SEQ ID NO: 586157 - RNA, 64 nt, Homo Sapiens
uacugacuggucuccucuauucuccuccugcccccuccaagaagucucgcccucccuuuuccuc

SEQ ID NO: 586158 - RNA, 64 nt, Homo Sapiens
aauguggcauacacaguggguuuuaaaguggucccuccaagaauuaaauuauccaucacuuuug

SEQ ID NO: 586159 - RNA, 64 nt, Homo Sapiens
gacacccugguucagaacacaccgccucuauggacuccaagacuucauucuccuugaugaagcc

SEQ ID NO: 586160 - RNA, 64 nt, Homo Sapiens
guauuagauuuuugugaugauucuugggcacauacuccaagauuggacccuugcuuugauacca

SEQ ID NO: 586161 - RNA, 64 nt, Homo Sapiens
gcaugaauauggcagagucuauccauugaaaaaccuccaagagggaucaaguaucaucagauuc

SEQ ID NO: 586162 - RNA, 64 nt, Homo Sapiens
ucuugugucaaauuaguaaccacccucaggaucucuccaagaaaucuuuuuuucccuacagggu

SEQ ID NO: 586163 - RNA, 64 nt, Homo Sapiens
gugauggaaaaagcgcuguuuccuugccugcuuucuccaagacagauuuucggaacacauuucc

SEQ ID NO: 586164 - RNA, 64 nt, Homo Sapiens
uucuuccuuuaccccccauuuuuccuauuauucgcuccaagaaagaugcuaagucugagcucca

SEQ ID NO: 586165 - RNA, 64 nt, Homo Sapiens
gcagaaaaaaaaaaaaccaaaaaggauugcuuuacuccaagaggagagauugucuuaggauaaa

SEQ ID NO: 586166 - RNA, 64 nt, Homo Sapiens
ggucccacaaagcacuuucuuaaaccuugagaaucuccaagagaaaaauauuuggggaaggagg

SEQ ID NO: 586167 - RNA, 52 nt, Homo Sapiens
gauacaucacuaaaggcuaaggcuccaagagcuugggaucagaagucagaag

SEQ ID NO: 586168 - RNA, 64 nt, Homo Sapiens
uggagcugcacaaagucagcagggaccacuaaaucuccaagaccuggugugcggaggcaggagc

SEQ ID NO: 586169 - RNA, 64 nt, Homo Sapiens
gccccagcaaucgugacugacguuugcuccuugacuccaagaaacugagaccaaagaagcugcu

SEQ ID NO: 586170 - RNA, 64 nt, Homo Sapiens
uuacuucagggggaccacuguaagaaaagccaaacuccaagaccaaguaaguuagaggagucuu

SEQ ID NO: 586171 - RNA, 64 nt, Homo Sapiens
acuugguaucacucuuucagauugaagcugacaucuccaagagguacagcgggcgcccugugaa

SEQ ID NO: 586172 - RNA, 64 nt, Homo Sapiens
cuaacaucguggcuguggagagggucaaggaguacuccaagacagagacagagguggguacugg

SEQ ID NO: 586173 - RNA, 64 nt, Homo Sapiens
acauggguccacugcaccagugugacaucuacaacuccaagauugccgggaagcuccuggggug

SEQ ID NO: 586174 - RNA, 51 nt, Homo Sapiens
cagggaguuggggccacugaacuccaagauaaagacaccaugaggggacug

SEQ ID NO: 586175 - RNA, 64 nt, Homo Sapiens
gaagcucacucccuuccucuccaucucucccucucuccaagacucuggcaguggccuaugaucc

SEQ ID NO: 586176 - RNA, 64 nt, Homo Sapiens
cagcugcuucggaacaccgucccuccuaugcacccuccaagacgugcagcagaugcaaaggguu

SEQ ID NO: 586177 - RNA, 64 nt, Homo Sapiens
cagcagccgggacccucuggagagcuuguuuucccuccaagaagagguuugagacaggcggcau

SEQ ID NO: 586178 - RNA, 64 nt, Homo Sapiens
acuguccacccagccuugcuguuaggcaccaugacuccaagaugaagauguggucccugcccuu

SEQ ID NO: 586179 - RNA, 64 nt, Homo Sapiens
uuaguuaccgagacaugaauaguggcuguucaugcuccaagacuuuacuauugaacuguauucu

SEQ ID NO: 586180 - RNA, 64 nt, Homo Sapiens
ucccgugcguaggcuggacaccaagcagccacgucuccaagagcugaccacuccaguuaggaug

SEQ ID NO: 586181 - RNA, 64 nt, Homo Sapiens
gguucaucuuuucuuccuuuaccaaaguacaacacuccaagaugccacuguuggcucuccagca

SEQ ID NO: 586182 - RNA, 64 nt, Homo Sapiens
agggcuugcgaaaggaaagccagccuccugccugcuccaagaaacccaugaggacaaaguguag

SEQ ID NO: 586183 - RNA, 64 nt, Homo Sapiens
agagauaguggggagacuucaaaccaggccuuaucuccaagaccgcucagaccagcucuuccga

SEQ ID NO: 586184 - RNA, 64 nt, Homo Sapiens
acacuucugucuugauggucauggaaaacaaagucuccaagaaaagaccauuauuuacagaugc

SEQ ID NO: 586185 - RNA, 64 nt, Homo Sapiens
cccacccgggggggaagaaggagacgugguaggucuccaagagugggaggugcaggggccaaga

SEQ ID NO: 586186 - RNA, 64 nt, Homo Sapiens
uaaccugcaaguugcucugaucugaggccccugccuccaagauucucaggggcuccaugcuggg

SEQ ID NO: 586187 - RNA, 64 nt, Homo Sapiens
cuacagcccugugucuggccgugccccuacccaccuccaagaggaggcauaugauggggagggg

SEQ ID NO: 586188 - RNA, 64 nt, Homo Sapiens
ugccaccgcuggggcugcacacuaaacggacagacuccaagagcgacgcucgugggggaaacau

SEQ ID NO: 586189 - RNA, 64 nt, Homo Sapiens
gauuugguccgucauaacccagcaguccccuucccuccaagaagucccugggagggacaugcuu

SEQ ID NO: 586190 - RNA, 64 nt, Homo Sapiens
ggccgaaauuucuacaccugugucuaguccuccccuccaagagcauuaacuauuuaaaacaagg

SEQ ID NO: 586191 - RNA, 64 nt, Homo Sapiens
auuauuucuucuguaaauauuucagaauguaucucuccaagaugagagcucauuaaaagacaau

SEQ ID NO: 586192 - RNA, 64 nt, Homo Sapiens
aguuuagagaaaaaaaauuaaaaagaaacaaagucuccaagaaauaugggacuaugugaaaaga

SEQ ID NO: 586193 - RNA, 64 nt, Homo Sapiens
agaacgccacaaagauacuccuugagaagagcaacuccaagacacauaauugucagauucacca

SEQ ID NO: 586194 - RNA, 64 nt, Homo Sapiens
uagauucucugugucuaagauucuagaucagaugcuccaagauucuagaugauuaaauaagauu

SEQ ID NO: 586195 - RNA, 64 nt, Homo Sapiens
ggccaaggucccagaccaagcugaaucacgcuuucuccaagacagcccgcaggcuaagugcauu

SEQ ID NO: 586196 - RNA, 64 nt, Homo Sapiens
ucaaaacgacgggggcaggugcaaguucauaggucuccaagaccacccuccuuucauuugcuag

SEQ ID NO: 586197 - RNA, 64 nt, Homo Sapiens
gcuccaggcuucagaaaguggugcugagaacuugcuccaagaagaagucaaaccaaacuugcag

SEQ ID NO: 586198 - RNA, 64 nt, Homo Sapiens
uucguuggcccgccccuuuccucuggccccuccucuccaagaaaauuagcuccucccucguucu

SEQ ID NO: 586199 - RNA, 64 nt, Homo Sapiens
gcagcgcucccagugguggguccgacucaucacccuccaagaggaggggagagaagacuuuguu

SEQ ID NO: 586200 - RNA, 64 nt, Homo Sapiens
cagccccuuucugcuccacaccucuaccaagccacuccaagagcccccaggggauggcccuccc

SEQ ID NO: 586201 - RNA, 64 nt, Homo Sapiens
ucuguccacagacuucugccccggauucuugggucuccaagaagaggaggaggggacugggguc

SEQ ID NO: 586202 - RNA, 64 nt, Homo Sapiens
gacuggagacaaaacccucugcuuccuugggucccuccaagacucccuggggcccaacuguguu

SEQ ID NO: 586203 - RNA, 64 nt, Homo Sapiens
cgcccugcacauuccccaccuccacauuccccuccuccaagaucucagcuccuuaacauaucag

SEQ ID NO: 586204 - RNA, 64 nt, Homo Sapiens
gaaaagaacguauuuuaaaagccacauagagugacuccaagaacaauuguccauggucucaaac

SEQ ID NO: 586205 - RNA, 64 nt, Homo Sapiens
gggcacuucacagccagccuagggucuucggcaccuccaagagcugaaucucccuccaacccuu

SEQ ID NO: 586206 - RNA, 64 nt, Homo Sapiens
gcuuuuccagacugugguugugaaccggcuccuucuccaagaaagguugcaagcugagaacauc

SEQ ID NO: 586207 - RNA, 64 nt, Homo Sapiens
gccaugcagacccaugccccccucccccaggcagcuccaagaaagcucccugacucgccccuuc

SEQ ID NO: 586208 - RNA, 64 nt, Homo Sapiens
gucugucuccccugccccacugcuggaacagaggcuccaagaaaacagggaccuuauuauucau

SEQ ID NO: 586209 - RNA, 64 nt, Homo Sapiens
caucccccugguccuaccccuggcccuuggccuccuccaagagggcucaccccgggugcugcuc

SEQ ID NO: 586210 - RNA, 64 nt, Homo Sapiens
caccagccucgagucucccauguuguaguacauucuccaagaugcagcccaggagccucucuga

SEQ ID NO: 586211 - RNA, 64 nt, Homo Sapiens
agccgacugcuguucccagacuucccuggccacgcuccaagacgccagcucugccgcgggcacu

SEQ ID NO: 586212 - RNA, 64 nt, Homo Sapiens
cugggggucuuggcugcugcggauuucgcuuccccuccaagacgcagagcgggugucagacuga

SEQ ID NO: 586213 - RNA, 64 nt, Homo Sapiens
ccaccuaccucccugaugcuccacgucgcguggucuccaagaccugccagauggagccuuuauu

SEQ ID NO: 586214 - RNA, 64 nt, Homo Sapiens
uggcaccaggccgggagggccuguaccgugucaacuccaagagccccugggcugugucuccucc

SEQ ID NO: 586215 - RNA, 64 nt, Homo Sapiens
aacucgacuugucugaaaucaggaacuagucuuucuccaagaagccucagcuccucccugggga

SEQ ID NO: 586216 - RNA, 64 nt, Homo Sapiens
ccccugagcucagcccucugauggggugaguguccuccaagagcccagaagcaucccauggacc

SEQ ID NO: 586217 - RNA, 64 nt, Homo Sapiens
uugggauaagagugugagagucuucuucccuuaacuccaagaacaggacugaacuccaucgcca

SEQ ID NO: 586218 - RNA, 64 nt, Homo Sapiens
uucugccucccuuguguccgugcaguuuauucuacuccaagagauuguccacuucuuuaaggaa

SEQ ID NO: 586219 - RNA, 64 nt, Homo Sapiens
uuucccacaaccguauaacgaccgauggucauuucuccaagagcaggcuuggcgaguccuugca

SEQ ID NO: 586220 - RNA, 64 nt, Homo Sapiens
aagugaauuuacuuuuuggguccagaaugacuuucuccaagaauuauaagaugaaaauuauaua

SEQ ID NO: 586221 - RNA, 64 nt, Homo Sapiens
auaucuaauggagcaauuugucuuuugcuauauucuccaagauuaucucuuaagaccauaugcc

SEQ ID NO: 586222 - RNA, 64 nt, Homo Sapiens
ccauugccuagaaaccuuugcauucauccuccuucuccaagaccuauggagaaggucccaggcc

SEQ ID NO: 586223 - RNA, 64 nt, Homo Sapiens
uuuuauuuuucauuuuuuugauaauggaaauggucuccaagaaguuucauugauuuaaucauaa

SEQ ID NO: 586224 - RNA, 64 nt, Homo Sapiens
cucagauccagguuaggaaaaaaauaauuuuuuccuccaagauuuugacaggagggagccuggg

SEQ ID NO: 586225 - RNA, 64 nt, Homo Sapiens
cugucugaaacuuguacagcuuguauucuuuauucuccaagaauaaaaacaaguuccuuagagg

SEQ ID NO: 586226 - RNA, 64 nt, Homo Sapiens
uuucuuagaauugucuacagguucuuauuacaaacuccaagacacuucucuuuguguuuguuuu

SEQ ID NO: 586227 - RNA, 64 nt, Homo Sapiens
uccuuguugacaacagggguacacucacacagaccuccaagacuuucuucuccaccucuucuuu

SEQ ID NO: 586228 - RNA, 64 nt, Homo Sapiens
caauuuugauagucugaacacaagcauuucacuucuccaagaaguaccugugaacaguacaaua

SEQ ID NO: 586229 - RNA, 64 nt, Homo Sapiens; identical to SEQ ID NO: 586228

SEQ ID NO: 586230 - RNA, 65 nt, Homo Sapiens
aacggucccacccaagccugucaccucugcucauccuccaagaccacccagcuuucucccagcca

SEQ ID NO: 586231 - RNA, 65 nt, Homo Sapiens
uuucuccucaggacaaggccuugcucacucacucacuccaagaccaccagggucccaggaagccg

SEQ ID NO: 586232 - RNA, 65 nt, Homo Sapiens
uuccccccucaauugagagcucuuguuauucagagcuccaagacuagaccuggcuaacaaacaua

SEQ ID NO: 586233 - RNA, 65 nt, Homo Sapiens
cuguuuucaaagcccccgauaaucgcucuuuuccacuccaagaugcccucauaaaccaauguggc

SEQ ID NO: 586234 - RNA, 65 nt, Homo Sapiens
ugggggcggcuugucuucgcuggcuccuaccccaucuccaagauaagccugagccuuagcuccca

SEQ ID NO: 586235 - RNA, 65 nt, Homo Sapiens
gauauuauuuaaauguugaaaucuuaaaaaccugccuccaagauuucagaagccaaguuuuucua

SEQ ID NO: 586236 - RNA, 65 nt, Homo Sapiens
ggaaagauauaauuugagcaguggcuuuaugcagacuccaagaacaaaaccaccagguauuuuuu

SEQ ID NO: 586237 - RNA, 65 nt, Homo Sapiens
aagaugagaccaaagaaucuggcaaacaucacagacuccaagaauuaccuaauaauccagaucac

SEQ ID NO: 586238 - RNA, 65 nt, Homo Sapiens
gcuacauuauaagaauaaguaaacauuuccuggaccuccaagaagauuuugauaaagcugcuuua

SEQ ID NO: 586239 - RNA, 65 nt, Homo Sapiens
ccccucacugcacuuuggaccccuggggccaacaucuccaagacaaaguuuuucagaaaagagga

SEQ ID NO: 586240 - RNA, 65 nt, Homo Sapiens
ucuguuuccuaauucaggaccccacucaucuagcccuccaagagccuccgccaaauuguagccau

SEQ ID NO: 586241 - RNA, 65 nt, Homo Sapiens
aguuguucacagauauuuuauguuuuuuuaauuuucuccaagaauauuuauagaauuccaaagaa

SEQ ID NO: 586242 - RNA, 65 nt, Homo Sapiens
gaaggcugggguuagaguggggagugggcuucuuccuccaagaucucagucucucagugcuuggc

SEQ ID NO: 586243 - RNA, 65 nt, Homo Sapiens
gcauugacccgucuccaucggaccccagccccuaucuccaagagacagaggaggggucaggaggc

SEQ ID NO: 586244 - RNA, 65 nt, Homo Sapiens
gaggcuugcccagauagacuaacaacccuuuagugcuccaagaagugagaauuuccgaaaaagau

SEQ ID NO: 586245 - RNA, 65 nt, Homo Sapiens
ucugagccuggucuuuuguccuuuuuuauuuuggucuccaagaugaaugcucaucuuuggagggu

SEQ ID NO: 586246 - RNA, 65 nt, Homo Sapiens
gacuaaagggcuugucuugguggggucucccaccccuccaagacccauucugcacagucccucca

SEQ ID NO: 586247 - RNA, 65 nt, Homo Sapiens
gauuugaucugcucaucuucaguugaaugcccucacuccaagacuggaugcuggaucucauagaa

SEQ ID NO: 586248 - RNA, 65 nt, Homo Sapiens
uguuuaaaaaaaaaaaagugcuguggaccacagaacuccaagaaucauugaaacagaaggaaaug

SEQ ID NO: 586249 - RNA, 65 nt, Homo Sapiens
ggccacccauagagcucaucggcagaacccaggagcuccaagaaacagcauuucaugggggcuga

SEQ ID NO: 586250 - RNA, 65 nt, Homo Sapiens
cuguguggagccaccacucccgggccaccucaggacuccaagaggcaggcaccucagugggguuc

SEQ ID NO: 586251 - RNA, 65 nt, Homo Sapiens
gaagcaguagcugagcaccucuccuuggucaccugcuccaagaagggcagggagugauagccaaa

SEQ ID NO: 586252 - RNA, 65 nt, Homo Sapiens
gccuguauuauacguguccuuacucaucccucugccuccaagaagaugcccaugagcugacauuu

SEQ ID NO: 586253 - RNA, 65 nt, Homo Sapiens
guuucauaucuauuccuuaagccuucuaauuuuuacuccaagauuguacaaacuugaagcaaguu

SEQ ID NO: 586254 - RNA, 65 nt, Homo Sapiens
acugcacaccagcuccucaccuggggacaguccuacuccaagaacccuggccggcuuuucuccau

SEQ ID NO: 586255 - RNA, 65 nt, Homo Sapiens
caggccccgcugaugcaagacaccagcuuagacaccuccaagaacuccucagauaagcccuuagg

SEQ ID NO: 586256 - RNA, 65 nt, Homo Sapiens
auuggaaugcuuccaaagcacugcuugggaagaaacuccaagaaggagguggcagggcggaggac

SEQ ID NO: 586257 - RNA, 65 nt, Homo Sapiens
agagauccacauaccauucuaucuccugaggaucacuccaagaaacggaaauggacaccaagaau

SEQ ID NO: 586258 - RNA, 65 nt, Homo Sapiens
agagugaggaagacccccaagagucuugguugugacuccaagagcgggacuucguugguuuuuug

SEQ ID NO: 586259 - RNA, 65 nt, Homo Sapiens
agagcagggaagagcccaaggaguguuggucaugacuccaagagcagggacuuuguuggcuuuua

SEQ ID NO: 586260 - RNA, 65 nt, Homo Sapiens
uacccaacuccuucccccucccacuccuuugcuuccuccaagacuggauuuuccccuuuuucuac

SEQ ID NO: 586261 - RNA, 65 nt, Homo Sapiens
uaccccagagaccuuaaacaucuauucucuguuggcuccaagagcggaucccuauuccuacccca

SEQ ID NO: 586262 - RNA, 65 nt, Homo Sapiens
ccugaccucaucuuccaccugguggguuggaaaaucuccaagagccauuuagaaacaaguucuag

SEQ ID NO: 586263 - RNA, 65 nt, Homo Sapiens
ggaggcuguaggaauauaacuggcaaaggagccuacuccaagaaucgcuaaggugaaaaggggug

SEQ ID NO: 586264 - RNA, 65 nt, Homo Sapiens
uucauuaagugcuuuguuucagccuagaagaaacacuccaagauagaaaugaaacccaggcaacc

SEQ ID NO: 586265 - RNA, 65 nt, Homo Sapiens
cuguggacuuggucaccagccuucccucaucucuccuccaagacaaaacguguugccuugaacca

SEQ ID NO: 586266 - RNA, 65 nt, Homo Sapiens
aucacauuaaaaaaaacccauacauaagaaacagccuccaagaacauucaagcagcagucagaga

SEQ ID NO: 586267 - RNA, 65 nt, Homo Sapiens
ugagcaagauuguguuuuagagaggaaacuugaaacuccaagaaagcacuugauguuuuuauaug

SEQ ID NO: 586268 - RNA, 65 nt, Homo Sapiens
caaggugagcucgcugaguccagccucguggucuucuccaagaugccgccagaugcccagccuac

SEQ ID NO: 586269 - RNA, 65 nt, Homo Sapiens
cugcauuccagccugguugacagagugacccuugucuccaagaaaaaaaaaaagcaaaugggauu

SEQ ID NO: 586270 - RNA, 65 nt, Homo Sapiens
cacccccaagaaaccuccauccugccaggagcagccuccaagaaacuuuuaaaaaauagauuugc

SEQ ID NO: 586271 - RNA, 65 nt, Homo Sapiens
gcuucagaugacacguuuuguuuagagcuacuuugcuccaagacucuuaagcccaaaguaacugg

SEQ ID NO: 586272 - RNA, 65 nt, Homo Sapiens
guguggcuuaguaauagaucacggcauguuucccgcuccaagagaauucacuuuaccuucagcag

SEQ ID NO: 586273 - RNA, 65 nt, Homo Sapiens
agccugcccucgggcucugcucaccucuggugacccuccaagaugccccugcccucaguuucccc

SEQ ID NO: 586274 - RNA, 65 nt, Homo Sapiens
aucucaguccugcaucuuuucuucugcuuucuucccuccaagagcaaaaccugggcaaggggacu

SEQ ID NO: 586275 - RNA, 65 nt, Homo Sapiens
cauccauucacagccaggagaugcugggccaguuccuccaagaggucuccaucauggcagugaug

SEQ ID NO: 586276 - RNA, 65 nt, Homo Sapiens
aaucugcuuuuuucaucauuguguuuaaagaaguacuccaagaacaccagguguuuuaagguuaa

SEQ ID NO: 586277 - RNA, 65 nt, Homo Sapiens
ccuuaaugaggggcaggagucaaggccaaacuguccuccaagacuaaagacaggaugaccuugga

SEQ ID NO: 586278 - RNA, 65 nt, Homo Sapiens
acaaagaagaagcaauggucuucuugggccugcaccuccaagauauuaagauuuuuacuucaucu

SEQ ID NO: 586279 - RNA, 65 nt, Homo Sapiens
aaaaaucacacucugaaugggggggaugcgaguaccuccaagaagaugagcuagaggaagaugag

SEQ ID NO: 586280 - RNA, 65 nt, Homo Sapiens
uaagccaacuugaugugaaagucacuaagacuuuccuccaagaacgugaucuguguacaauuuua

SEQ ID NO: 586281 - RNA, 55 nt, Homo Sapiens; identical to SEQ ID NO: 585961

SEQ ID NO: 586282 - RNA, 65 nt, Homo Sapiens
gaagaagaaacugagcaguuaucucuguagaaugucuccaagauuuuaauuugcucuuagguucu

SEQ ID NO: 586283 - RNA, 65 nt, Homo Sapiens
aguuccggcagcuuuccccaccaccugaggagugacuccaagaagcgcacaucucuucugggcgg

SEQ ID NO: 586284 - RNA, 65 nt, Homo Sapiens
cccugcagcagccucgcgccccgcguuccgggcggcuccaagagagagcggagcaagugucccgg

SEQ ID NO: 586285 - RNA, 65 nt, Homo Sapiens
aguggaaaacugcaugggaggcaaaaugcucuguucuccaagaggacccggaaguaaucacauag

SEQ ID NO: 586286 - RNA, 65 nt, Homo Sapiens
gauuaaaggaaggggcacaauucgcuaucacacaccuccaagaucaagauccuguucugagucag

SEQ ID NO: 586287 - RNA, 65 nt, Homo Sapiens
gggucuaaaauuuuuaaggacuuuccuuccuccaucuccaagaaugcugaaaccaagggggauga

SEQ ID NO: 586288 - RNA, 65 nt, Homo Sapiens
acgaccaaggggucuucauuuccaugaaaaagggacuccaagaggcagugguggcuguggccccc

SEQ ID NO: 586289 - RNA, 65 nt, Homo Sapiens
acgguuccccagagcuuuggggaccacgcgaaaaccuccaagauauuuuucacaaaauagaaacu

SEQ ID NO: 586290 - RNA, 65 nt, Homo Sapiens
ucuuagguaggugcuuaacucuugugguggccagccuccaagaugagccccaguguucuugccuc

SEQ ID NO: 586291 - RNA, 65 nt, Homo Sapiens
auggugacucacucucaagugauuucccaccugcccuccaagaaagacaaaugugauaaugacau

SEQ ID NO: 586292 - RNA, 65 nt, Homo Sapiens
uugaguagggaaauauuugucaaaccuugauuuagcuccaagaaauguuuuuacuggaaacauag

SEQ ID NO: 586293 - RNA, 65 nt, Homo Sapiens
gccauguaggguaauggagaccucagggucccuuccuccaagaugguaaagagcaaaggcaacgc

SEQ ID NO: 586294 - RNA, 65 nt, Homo Sapiens
ucguuagcagcaucaguccaaccgguacuagcuaacuccaagagaguaaauacucugaauaagag

SEQ ID NO: 586295 - RNA, 65 nt, Homo Sapiens
cuccugaaugugacuggcguuguguauaagucaagcuccaagaggagauauugcgccugugugcg

SEQ ID NO: 586296 - RNA, 65 nt, Homo Sapiens
gauaaccugcaccccucccucacccagcccuccugcuccaagagguccuagguuuuccuuccaag

SEQ ID NO: 586297 - RNA, 65 nt, Homo Sapiens
augucacuaguuuucuagaacuguaagaggggcuucuccaagagcuucucagcuucuuuggccuu

SEQ ID NO: 586298 - RNA, 65 nt, Homo Sapiens
ucacugaugcacgccgaguugcuccuuggcgaggacuccaagaacguaagaaaaagaaacuauuu

SEQ ID NO: 586299 - RNA, 65 nt, Homo Sapiens
gccagaguuuaauacaucuuguacuuuggaaucuccuccaagauaaaagagcuggagaacuccau

SEQ ID NO: 586300 - RNA, 65 nt, Homo Sapiens
uguugguuccaagcccuggacacagagcucuccagcuccaagaccguuccuauggcuggccacug

SEQ ID NO: 586301 - RNA, 65 nt, Homo Sapiens
ccccagagcugccugcauaguuugcuuagaggcggcuccaagagccuucuccuggugucuacaug

SEQ ID NO: 586302 - RNA, 65 nt, Homo Sapiens
uaagcccuccaagggaucaguuaugcccuccagagcuccaagauaucaggaagcuucuagagacu

SEQ ID NO: 586303 - RNA, 65 nt, Homo Sapiens
agccuucccugcgcccaggcuccuccccaccuguccuccaagaacgagagggcucuuccuccaaa

SEQ ID NO: 586304 - RNA, 65 nt, Homo Sapiens
ugugcuccucggcagaugcuguuguuguuacuucccuccaagaggcuggaaaagggcucagagcu

SEQ ID NO: 586305 - RNA, 65 nt, Homo Sapiens
uaggaaaacaaaaaccucucuccucagccuuccaccuccaagagaggaggaaaaacaguugucug

SEQ ID NO: 586306 - RNA, 65 nt, Homo Sapiens
guguguugugaaaguuuggaaggucagaccuuuuucuccaagaaggacaagccccuguguaagaa

SEQ ID NO: 586307 - RNA, 57 nt, Homo Sapiens; identical to SEQ ID NO: 585987

SEQ ID NO: 586308 - RNA, 65 nt, Homo Sapiens
uagggcagcagaguggagcgagacucuuuagaauacuccaagaguacuuguaaauagcacuaguu

SEQ ID NO: 586309 - RNA, 65 nt, Homo Sapiens
aaauagaaaggcugcuuuagauaugauaacuaggucuccaagagagaacaaauuuguucuuccug

SEQ ID NO: 586310 - RNA, 65 nt, Homo Sapiens
aaaauccucacuuauuaacugaugacaguagcugucuccaagagauucgaccuccaguucucccu

SEQ ID NO: 586311 - RNA, 65 nt, Homo Sapiens
cuaucaguuccuuggggacagcacuaccuguuugccuccaagagaagaguaaacuccacaucuuu

SEQ ID NO: 586312 - RNA, 65 nt, Homo Sapiens
uggaccaggcacacacacacaggaagggaagagugcuccaagacugauaguaggacccaagggaa

SEQ ID NO: 586313 - RNA, 65 nt, Homo Sapiens
cacaacucaagcugaacuguaugguuugccucauucuccaagagcaaaaugaaugaaacagucaa

SEQ ID NO: 586314 - RNA, 65 nt, Homo Sapiens
agcaacagugcccccuccguccacuacgcuccugucuccaagaauguuuugcuagagcuaacaga

SEQ ID NO: 586315 - RNA, 65 nt, Homo Sapiens
ugauagauuuucugcuacuuugcugcuaugguuuucuccaagagcuacauaauuuaguuucauau

SEQ ID NO: 586316 - RNA, 65 nt, Homo Sapiens
augaucuggacuuccuauaauacaaauacacaauccuccaagaauuugacuuggaaaaaaauguc

SEQ ID NO: 586317 - RNA, 65 nt, Homo Sapiens
aacucauucaaggaggugaaaaugauggaugacuccuccaagaugaaaauggaccagccgcagug

SEQ ID NO: 586318 - RNA, 65 nt, Homo Sapiens
agagaugcaaagagaagcgagagaggcaccuuguucuccaagaacuuacuguccaaucaugcugu

SEQ ID NO: 586319 - RNA, 65 nt, Homo Sapiens
gaaagaaaagaacacuugcccagggcagcuuugcccuccaagaggcucccuccugucucuaaguc

SEQ ID NO: 586320 - RNA, 65 nt, Homo Sapiens
uguggcuugaacuugccagaugcaaauaccacagacuccaagaaaacccgaguugggguuuguuu

SEQ ID NO: 586321 - RNA, 65 nt, Homo Sapiens
ccuguuuuagggguuauacauuuggacugugcauucuccaagagaugaagcggugaaguugggau

SEQ ID NO: 586322 - RNA, 65 nt, Homo Sapiens
uaguggaagcuuaauggaaaaggaaaguuaugauccuccaagacccuuaauugauagaccauacc

SEQ ID NO: 586323 - RNA, 65 nt, Homo Sapiens
uacugaauuugcacaccuccuugccaccuuccuuccuccaagauaccaucuccucauccuaaccc

SEQ ID NO: 586324 - RNA, 65 nt, Homo Sapiens
auaauuacauuggcacaaugcaaguucuagaaggucuccaagacacuucuugcuauaugauuuag

SEQ ID NO: 586325 - RNA, 65 nt, Homo Sapiens
caccucuauuuuauacaucaaugugcauuuuaaaucuccaagaaguucagaccuuugauacgcua

SEQ ID NO: 586326 - RNA, 65 nt, Homo Sapiens
ccaacugaguccccagcaccuauaacuaagugcuucuccaagacccauuuaugagacauucuugc

SEQ ID NO: 586327 - RNA, 65 nt, Homo Sapiens
uguuucugugcccaacuuucucucuuuuacagauucuccaagauuucagagugugaaaacgaguu

SEQ ID NO: 586328 - RNA, 65 nt, Homo Sapiens
agaccaggccaccucauccgauugccacccugcuucuccaagagcgaauacuggcccugucgacu

SEQ ID NO: 586329 - RNA, 65 nt, Homo Sapiens
gucuccuuuuggccaauaucaacaguaagcagcaccuccaagacuuacauuccaaaaggaaguuc

SEQ ID NO: 586330 - RNA, 65 nt, Homo Sapiens
uaggcucauggacgagaugggccuccaacacaaggcuccaagaccccguuccugacaucacagca

SEQ ID NO: 586331 - RNA, 65 nt, Homo Sapiens
gacaggccucucugcaagagaggaaagaccuucuacuccaagaagauaugucagaucaaccugga

SEQ ID NO: 586332 - RNA, 65 nt, Homo Sapiens
ccucaguccccaagacugccacagucuucccuucucuccaagaggcuccauggacuucugagccg

SEQ ID NO: 586333 - RNA, 65 nt, Homo Sapiens
uagagacacagagugaugugaggcguuggcuuuuucuccaagaagguacagauaccucagauucg

SEQ ID NO: 586334 - RNA, 65 nt, Homo Sapiens
uccacggucuguucuugaagcaguagccuaacacacuccaagauauggacacacgggagccgcug

SEQ ID NO: 586335 - RNA, 65 nt, Homo Sapiens
ucugucaugcaguguugucccuuccuaccuucuuccuccaagagaguaucaugaaguaaacuaca

SEQ ID NO: 586336 - RNA, 65 nt, Homo Sapiens
caggcucccuugggaaagcccugcuuugcuccaggcuccaagaucuccuggcuaagucagcaagu

SEQ ID NO: 586337 - RNA, 65 nt, Homo Sapiens
aaacauuucuuucuuacaguucuggaggcuggaaacuccaagauuaaggcagauuucaugccuau

SEQ ID NO: 586338 - RNA, 65 nt, Homo Sapiens
uuccauuuguccaguuaauacuuccucuuaaaaaucuccaagaagcugggucuccagaucccauu

SEQ ID NO: 586339 - RNA, 65 nt, Homo Sapiens
aggggcucuccagaccccuuuuccaugaugacccacuccaagauauuauguguaaauuguguuau

SEQ ID NO: 586340 - RNA, 65 nt, Homo Sapiens
uuguucagccacuauggaaagcaguuuggagauuucuccaagaacuuaaaauagaacuaccauuc

SEQ ID NO: 586341 - RNA, 65 nt, Homo Sapiens
augggccuagaaagccaaguagauccccacuacagcuccaagagguucccucuuccugugucccc

SEQ ID NO: 586342 - RNA, 65 nt, Homo Sapiens
guggaccagggucugcaagucaccgcuggcuuccacuccaagaaggccucagggguccccuucug

SEQ ID NO: 586343 - RNA, 65 nt, Homo Sapiens
cguggaucucccccucaucccugagaaauagugcacuccaagaaaggccccuccccucccgaaca

SEQ ID NO: 586344 - RNA, 65 nt, Homo Sapiens
caggcuuuacauaaacagcugagauaacacccugucuccaagacacaaugcaugugacugauaaa

SEQ ID NO: 586345 - RNA, 65 nt, Homo Sapiens
aaccucugauuuauuuuguacacaaguagggcugccuccaagaggguccuagaauguuucauuug

SEQ ID NO: 586346 - RNA, 65 nt, Homo Sapiens
guggcccaaggcuauagcccuucgacagccagaugcuccaagaggguguaacagggucacaagaa

SEQ ID NO: 586347 - RNA, 65 nt, Homo Sapiens
aaaaaauuaaagugcuuuucaugacuaaauuaugccuccaagaaaugaaaagugcuuuaggugag

SEQ ID NO: 586348 - RNA, 65 nt, Homo Sapiens
aauccgauucuuuaaaaugcaccaucagaccuggccuccaagaagagcuguagcguaccaugcgu

SEQ ID NO: 586349 - RNA, 65 nt, Homo Sapiens
uuuucuccaaaggccauccuuuuggggccaccuggcuccaagaagcaucgcuggucuuggggacg

SEQ ID NO: 586350 - RNA, 65 nt, Homo Sapiens
aaugaauucuaaaccaaucaaaugucugggaagcccuccaagaaaaaaaauagaaaagcacuuga

SEQ ID NO: 586351 - RNA, 65 nt, Homo Sapiens
gaaagagcaucuucucucccacugcaccccuucuccuccaagaauaguugcccacauucccaaaa

SEQ ID NO: 586352 - RNA, 65 nt, Homo Sapiens
aagaggcccccagggaguugugagcagauuagacccuccaagaccgccccagggguuggcccaug

SEQ ID NO: 586353 - RNA, 65 nt, Homo Sapiens
uacugcaucagccccugugagccuggcuucagugucuccaagaacuguaaccucggcaagugcca

SEQ ID NO: 586354 - RNA, 65 nt, Homo Sapiens
aucauccugguagcucuccugaugcucguuuuccgcuccaagagagaggugaaacggugagcgag

SEQ ID NO: 586355 - RNA, 65 nt, Homo Sapiens
uugccuuuuguuaaaagaugguaaaccagaucugucuccaagaccuuggccucuccuuggaggac

SEQ ID NO: 586356 - RNA, 65 nt, Homo Sapiens
uagaagucacauuccugaacaggauauucucacagcuccaagaauuucuaggacugaauuaugaa

SEQ ID NO: 586357 - RNA, 65 nt, Homo Sapiens
gaggcccauuaguugagaaagucacagauauauuucuccaagaaagccaacaaccaccaccacaa

SEQ ID NO: 586358 - RNA, 65 nt, Homo Sapiens
gcgccaucuaugguguggaugggaaacugcuccagcuccaagagguuuuucagcucuuugacaac

SEQ ID NO: 586359 - RNA, 65 nt, Homo Sapiens
gaaaaaaaaaacucuugaaaaagucagauuguuaacuccaagauuuucuuugauaaaagaaaaau

SEQ ID NO: 586360 - RNA, 59 nt, Homo Sapiens; identical to SEQ ID NO: 586040

SEQ ID NO: 586361 - RNA, 65 nt, Homo Sapiens
caaaguccagaguggcauuuaaagcaaaauugaaacuccaagauguaaacuggggucuaaauccu

SEQ ID NO: 586362 - RNA, 65 nt, Homo Sapiens
uugaucucaguacccauuuaagccugauauucuuccuccaagaauugacauugaaauuguuuaag

SEQ ID NO: 586363 - RNA, 65 nt, Homo Sapiens
gaaccucaguuuacagcacagugacaugacauaaacuccaagacagcccuucagcacaggaccug

SEQ ID NO: 586364 - RNA, 65 nt, Homo Sapiens
uuaccuauguaaguguucaacaguaauauauuauucuccaagacuagcauacaacagcaugccaa

SEQ ID NO: 586365 - RNA, 65 nt, Homo Sapiens
caacaucacugcucuuuuaggcccuuuuaagggggcuccaagaacuuaggcagagagcucagaug

SEQ ID NO: 586366 - RNA, 65 nt, Homo Sapiens
uucggacugaggccuucucaaacuuuacucuaagucuccaagaauacagaaaaugcuuuuccgcg

SEQ ID NO: 586367 - RNA, 65 nt, Homo Sapiens
cauuuuuguaaaaguuuaaugacccacuuuagaugcuccaagaacaagcaucccuuccauguaug

SEQ ID NO: 586368 - RNA, 65 nt, Homo Sapiens
ccacucaaacaucuccucuucccuccccauuuguccuccaagacucuucccugaguccucaccag

SEQ ID NO: 586369 - RNA, 65 nt, Homo Sapiens
gagauugaugcaucagguucggcacacugagacaccuccaagaagcuaagguggauucagugucu

SEQ ID NO: 586370 - RNA, 65 nt, Homo Sapiens
aaaacgaggauggaaaaccuuggauggaaagaagacuccaagaggucggaaaauucaugcagaua

SEQ ID NO: 586371 - RNA, 65 nt, Homo Sapiens
acgcccucaugcucagcacagggcaaauagagagucuccaagagaucugucccuguaaaagagag

SEQ ID NO: 586372 - RNA, 65 nt, Homo Sapiens
aaacaaacagacagguccucuccaagucacacaagcuccaagacuacgacauaacagaauugccc

SEQ ID NO: 586373 - RNA, 65 nt, Homo Sapiens
gagacguucagcuagauuugccuuuccccgcuucucuccaagaaguaccucaacaagacugagag

SEQ ID NO: 586374 - RNA, 65 nt, Homo Sapiens
cuaucugcuuaugcaguuuuaacuuuagcugcauccuccaagaauaguggcaauauagaaacacg

SEQ ID NO: 586375 - RNA, 65 nt, Homo Sapiens
aacccuuugagccuuacaucucauucacugucuuucuccaagaaaaguauuuugggcggacaguc

SEQ ID NO: 586376 - RNA, 65 nt, Homo Sapiens
acaaaaacuuuacaauacauuuauguugaauggaacuccaagaucucaccucuccauccaggaau

SEQ ID NO: 586377 - RNA, 65 nt, Homo Sapiens
aauagcggcccuggaggauguuagacuugcucccucuccaagacagcagcagccugcaccugccc

SEQ ID NO: 586378 - RNA, 65 nt, Homo Sapiens
cccuccucccccggcugggccuccuucuuccacuucuccaagaauggaagccugaacugaggccu

SEQ ID NO: 586379 - RNA, 65 nt, Homo Sapiens
aaaguaaaugauucuauuuuagacucuuucccggucuccaagaacggauuaaauauguauuuugu

SEQ ID NO: 586380 - RNA, 65 nt, Homo Sapiens
cauaguuacugaaaagggaguuaaguuauccaggacuccaagaacccagacaggucucuauuuuu

SEQ ID NO: 586381 - RNA, 65 nt, Homo Sapiens
uggguaauuugguuuaaaaauuaacagagauugaacuccaagagguucacuacuuuaauaaagaa

SEQ ID NO: 586382 - RNA, 65 nt, Homo Sapiens
auuauuaacgcugcuguacccccagaguauuaacgcuccaagagucccccaagugccugccccuc

SEQ ID NO: 586383 - RNA, 65 nt, Homo Sapiens
agcacacuuuggggagaugucccccugaggccccucuccaagaggggcugguugugcugcaggcu

SEQ ID NO: 586384 - RNA, 65 nt, Homo Sapiens
gguggcggccgggcaggcacggccauucccuccaccuccaagacaagcugggggagccaccccuc

SEQ ID NO: 586385 - RNA, 65 nt, Homo Sapiens
aauugaguguguucuaagugaaggcaaugggguuucuccaagacagccuguguggccucuacucu

SEQ ID NO: 586386 - RNA, 65 nt, Homo Sapiens
cuccccaaaacuguugguaaaugucagauuuuuuccuccaagaguugugcuuuuguguuauuugu

SEQ ID NO: 586387 - RNA, 65 nt, Homo Sapiens
ccugucacaguaacgugaaaacugauuauucuuuacuccaagagaauguuuuaacccaagcaagu

SEQ ID NO: 586388 - RNA, 65 nt, Homo Sapiens
uaagugguaguccaaauuuucuuuaagcagcugcucuccaagacagggcccuggaaaggcccaca

SEQ ID NO: 586389 - RNA, 65 nt, Homo Sapiens
gccugagcaccaugauucccacagccagcucuuggcuccaagaugagcacccacaggaagccgac

SEQ ID NO: 586390 - RNA, 65 nt, Homo Sapiens
guguugaacuucaaccugagggggccgacagugcccuccaagacagagacgacugaacuuuuggg

SEQ ID NO: 586391 - RNA, 65 nt, Homo Sapiens
guucuguuuuucuccuagucccucuccugccaccucuccaagacuuccgugggacacccacuucc

SEQ ID NO: 586392 - RNA, 65 nt, Homo Sapiens
cacccagacaucugacuaauggcucugugcccacacuccaagaccugugccuuuuagagaagcuc

SEQ ID NO: 586393 - RNA, 65 nt, Homo Sapiens
gugugucccagaugcugucauuagucuauaugguucuccaagaaacugaaugaauccauuggaga

SEQ ID NO: 586394 - RNA, 65 nt, Homo Sapiens
aaggcccugcuuccuggaaaggacacucagagcagcuccaagacagaggcucuguggcggggguc

SEQ ID NO: 586395 - RNA, 65 nt, Homo Sapiens
cugugaacuucugcaaagacacucaaagugaggugcuccaagacgauuguuucuaaugucucuga

SEQ ID NO: 586396 - RNA, 65 nt, Homo Sapiens
aguugcacuuaacuuuuuuucuccccuuauucccucuccaagagugggguaucuuuuucuuuuga

SEQ ID NO: 586397 - RNA, 65 nt, Homo Sapiens
gggcccuggaaagaggcccacuuuaagcagcugcucuccaagacauaagugauaguccaaauuuu

SEQ ID NO: 586398 - RNA, 65 nt, Homo Sapiens
guguauuuacaauauuugccuaauuacaaagucaacuccaagaauucuguugaauaacaucggug

SEQ ID NO: 586399 - RNA, 65 nt, Homo Sapiens
agcccuguuggugcuuuacccuuuucuuucucuugcuccaagaaggagcuuacucaccccggagu

SEQ ID NO: 586400 - RNA, 65 nt, Homo Sapiens
uuauggaauuaagaauuuuuuuuacuguugcuuaucuccaagauaguuaaaacguuuucuaacag

SEQ ID NO: 586401 - RNA, 65 nt, Homo Sapiens
agcaggccaaggccaagcccgaccaagcucaacgccuccaagaccacgcuccuccaccccuucca

SEQ ID NO: 586402 - RNA, 65 nt, Homo Sapiens
gugcaaggcaccccauccacacauuugcaccacuacuccaagauaguauuuuucuuuucacacaa

SEQ ID NO: 586403 - RNA, 65 nt, Homo Sapiens
gccacccccuucccuguccuuccccaacuccccagcuccaagaguggaagaaauccccaagauca

SEQ ID NO: 586404 - RNA, 65 nt, Homo Sapiens
ccggccccagauagcagccccagggaggaugcugccuccaagaggugugagcccucugucucggg

SEQ ID NO: 586405 - RNA, 65 nt, Homo Sapiens
cugugggagguuaagaggagucccuucuggguugacuccaagagccaaggagauggcagacccug

SEQ ID NO: 586406 - RNA, 65 nt, Homo Sapiens
ccuuauucuuugggccuugaaaugaagauuucagacuccaagaucugaggacuuaagguugcaag

SEQ ID NO: 586407 - RNA, 65 nt, Homo Sapiens
gucucauauucuaccuggacgcaaaaaucaaaacccuccaagauucucggagaccuguuuaacaa

SEQ ID NO: 586408 - RNA, 65 nt, Homo Sapiens
cuuacugaucuacugugaauauuuuacaauaugagcuccaagacaaauagggcccaaaccuuuuu

SEQ ID NO: 586409 - RNA, 65 nt, Homo Sapiens
ugccuguggucaggccccaggcuuugcgucuguggcuccaagaagaacaauccccgagggcugcu

SEQ ID NO: 586410 - RNA, 65 nt, Homo Sapiens
uaaauuguuguuuuguauuuaauccccaagauuuucuccaagaaacaaauuuucauuuuuaaugu

SEQ ID NO: 586411 - RNA, 65 nt, Homo Sapiens
aagcagagcccgggccacugaucccgcugucuccucuccaagaacagucgcgcaucuccgugguu

SEQ ID NO: 586412 - RNA, 65 nt, Homo Sapiens
cuucgccuugggacaggaauggggcaggaagcggccuccaagaccuccagcgccuggaggaggca

SEQ ID NO: 586413 - RNA, 65 nt, Homo Sapiens
aagaaaauuuucaaauaaaaucuagaaacaaaauacuccaagaaacuuuaaacuguaguaguugg

SEQ ID NO: 586414 - RNA, 65 nt, Homo Sapiens
gcaucccaucucagaagaugaguuuuagaccucaucuccaagauacacaaccacucaccaguccu

SEQ ID NO: 586415 - RNA, 65 nt, Homo Sapiens
agaaugaaccuggcugugucgggcugcugccucagcuccaagacauccgucuguagcaggagcua

SEQ ID NO: 586416 - RNA, 65 nt, Homo Sapiens
acaaggacaggagacuugggggucucuaagguucccuccaagaaguccagagcuagauccugaug

SEQ ID NO: 586417 - RNA, 65 nt, Homo Sapiens
ucguuuccuguggccaauaaagcaccagucacuuacuccaagaaguuuguccagaugggccucgg

SEQ ID NO: 586418 - RNA, 65 nt, Homo Sapiens
uguucuacaggaaaggguccuggaccuauuccucacuccaagacuagugcuugaaauggacaagc

SEQ ID NO: 586419 - RNA, 65 nt, Homo Sapiens
ugcccguugcucuugggcugguuuccccugaacaccuccaagaggcugccugccuugccagcacc

SEQ ID NO: 586420 - RNA, 65 nt, Homo Sapiens
auccuggaguggagcauuuagcccaggucuuaauucuccaagaggaggaauacauaguaugguaa

SEQ ID NO: 586421 - RNA, 65 nt, Homo Sapiens
auggcaccucccucccucucaaccacuugagcaaacuccaagacaccuucuaccccaacaccagc

SEQ ID NO: 586422 - RNA, 65 nt, Homo Sapiens
ucuuuguuaguagucuuaaagcugcugccauaguccuccaagaagaaagcaccaagacaacauuu

SEQ ID NO: 586423 - RNA, 65 nt, Homo Sapiens
uucagagacccaggaguugggagcuuucgcuccuucuccaagacucaggccugugggcacucuau

SEQ ID NO: 586424 - RNA, 65 nt, Homo Sapiens
uaugccuuccuguccuuucuacucaaugguccccacuccaagaugaguugacacaaccccuuccc

SEQ ID NO: 586425 - RNA, 65 nt, Homo Sapiens
uauaaggaauaaaaggaaaaacuuucuuccucucucuccaagaggauaugggaagcuucugugag

SEQ ID NO: 586426 - RNA, 65 nt, Homo Sapiens
caccugugcaggccccauggcaccaucuaucuggccuccaagaugagaaaggagcaugggacaga

SEQ ID NO: 586427 - RNA, 65 nt, Homo Sapiens
aggucugcuucuuccacuuauacuuagucucugugcuccaagaggucaaauuuuugcuucuagaa

SEQ ID NO: 586428 - RNA, 65 nt, Homo Sapiens
aaaguuuuuuuguuuuuguuuuuguuuuguggcuccuccaagauauagguacaugaaguuuaggu

SEQ ID NO: 586429 - RNA, 65 nt, Homo Sapiens
gaagaugggaauuaccuucaucccucucucuuugccuccaagaaguguaaccgccuugaagagcu

SEQ ID NO: 586430 - RNA, 65 nt, Homo Sapiens
aguagcugaugaagcugcccgggcucaggaaguugcuccaagaacaggggaagcaagauggguaa

SEQ ID NO: 586431 - RNA, 65 nt, Homo Sapiens
caauuauagaaacagcuccucaagcuauucugcagcuccaagauguuaguugaccuucaaauauu

SEQ ID NO: 586432 - RNA, 65 nt, Homo Sapiens
aaagaagagagauccuaaagcaaacaugcaugauucuccaagacaaccauagaacaauuucacug

SEQ ID NO: 586433 - RNA, 65 nt, Homo Sapiens
gaauggucaaguuguuucauagguuuucuaugugacuccaagaggugaaccaggguauuuuuguu

SEQ ID NO: 586434 - RNA, 65 nt, Homo Sapiens
ugagaucaauuuagggauuguaaugcuucaugucccuccaagauuaaaacagagacaugguucua

SEQ ID NO: 586435 - RNA, 65 nt, Homo Sapiens
augggaggaaggggagccccgcaacugcuuaccugcuccaagaagcuccagcuucuacgcucaca

SEQ ID NO: 586436 - RNA, 65 nt, Homo Sapiens
uucuccugauguagcuugaggggcaacugacauugcuccaagauguauucccagggaaccccagg

SEQ ID NO: 586437 - RNA, 65 nt, Homo Sapiens
ccauugucucccuuuaaucucaaacuguaguuugccuccaagacacacggaaaguuaucuuacag

SEQ ID NO: 586438 - RNA, 65 nt, Homo Sapiens
cuacagagccugaggggcaccugcccgggcccuuccuccaagaccggacgcgccgcucccucaug

SEQ ID NO: 586439 - RNA, 65 nt, Homo Sapiens
cuuauuuaaaagccaaacgugcccugagcccucuccuccaagagguccccucagcaucaagcagc

SEQ ID NO: 586440 - RNA, 65 nt, Homo Sapiens
gagacucugaggacauggagagagacucaaagagacuccaagauucaaagagacuaauagagaca

SEQ ID NO: 586441 - RNA, 65 nt, Homo Sapiens
agugaaguggugggagagaacgagggauagacagucuccaagaaacuacauaggcaaagagaauu

SEQ ID NO: 586442 - RNA, 65 nt, Homo Sapiens
cugaggacuuugcccaggauaggcaaggaaacaggcuccaagagguauuacuguccacauuuuac

SEQ ID NO: 586443 - RNA, 65 nt, Homo Sapiens
cuugagaaacugcuaaaauucucaaaucugcucaacuccaagagucggcgauucugauuucccuu

SEQ ID NO: 586444 - RNA, 65 nt, Homo Sapiens
guggagauaaggcuggacuggucuaucagauugaacuccaagaaugaucacacaaaauguuuagg

SEQ ID NO: 586445 - RNA, 65 nt, Homo Sapiens
uccaguguccgccaucuucaggguugcacagaauccuccaagauacuuugcagccuuuuuucccc

SEQ ID NO: 586446 - RNA, 65 nt, Homo Sapiens
cuaucuuucuuccaccagacuccaagcccacucuccuccaagacuguguugucuuuucucaccaa

SEQ ID NO: 586447 - RNA, 65 nt, Homo Sapiens
ugauccugcuuauuguaacugacaacuguuuucaacuccaagagcuaaacuauuggcaguucaug

SEQ ID NO: 586448 - RNA, 65 nt, Homo Sapiens
aggacugaagauuggcaaaaacgaaaagcuucuuccuccaagagcccauugaagaagcccaguga

SEQ ID NO: 586449 - RNA, 65 nt, Homo Sapiens
ccacaagcugaacuguggcauagcucucucuucuucuccaagaagacucagcagccuacauuccc

SEQ ID NO: 586450 - RNA, 65 nt, Homo Sapiens
auuuucaguuuuaaaugugggcaaaaaggcauuuucuccaagauuuuaaaacuaauucuuauuuu

SEQ ID NO: 586451 - RNA, 65 nt, Homo Sapiens
gcucacucccuaaagcccucuucaggggucaccuccuccaagaagcccuccuugccaccccccgc

SEQ ID NO: 586452 - RNA, 65 nt, Homo Sapiens
uacgaguuaaggaagagugcaccuuccaagcuugccuccaagaguaucauagcgggaaauaaagc

SEQ ID NO: 586453 - RNA, 65 nt, Homo Sapiens
agcuuuuuuucaucucuuagguugggggaagugagcuccaagaguguuaggaauguggugcucuu

SEQ ID NO: 586454 - RNA, 65 nt, Homo Sapiens
uggguaagcucugggccuucgugauucaacuugggcuccaagacucucucccaacccucugguug

SEQ ID NO: 586455 - RNA, 65 nt, Homo Sapiens
cuguguucauuugguguucccuucccccacuuccccuccaagaccgccuuggggcauuauggguu

SEQ ID NO: 586456 - RNA, 65 nt, Homo Sapiens
aguagagaauuuaagcacaacucucuuauccccuccuccaagagcgccaaggggcaggaggcacc

SEQ ID NO: 586457 - RNA, 65 nt, Homo Sapiens
ggaaacaugucgugugucugcgaacaguagauagucuccaagaugaucugacauuuuagaaaagc

SEQ ID NO: 586458 - RNA, 65 nt, Homo Sapiens
gccgccucuccaaaauaaccggccacacucccaaacuccaagacagccauacuuccagcgaaaug

SEQ ID NO: 586459 - RNA, 65 nt, Homo Sapiens
cauuaggauuagagacaaguucuguuuagaaauaacuccaagauugggaggccgaccugggugga

SEQ ID NO: 586460 - RNA, 65 nt, Homo Sapiens
uggaccugagcccgcacauuccacucccauucucccuccaagaggggcccagcauuguauuuccc

SEQ ID NO: 586461 - RNA, 65 nt, Homo Sapiens
ucucagcagaguuacuguacucaaauggcaugugucuccaagacagcuuaugaauaucuaaaagg

SEQ ID NO: 586462 - RNA, 65 nt, Homo Sapiens
ugaaggagaacugcaaaccucugaagaguuacaugcuccaagacucccuggagcacgugcagcug

SEQ ID NO: 586463 - RNA, 65 nt, Homo Sapiens
ugaacagacucgaucguuagggaauggucuuagaacuccaagauguuccauaaguguuuuuacuu

SEQ ID NO: 586464 - RNA, 65 nt, Homo Sapiens
agaggaauucaguccccaggcagcccugccucugacuccaagagggugaaguccacagaagugag

SEQ ID NO: 586465 - RNA, 65 nt, Homo Sapiens
gauugguccuacuuucuuucucuggaaaggaaagccuccaagacuccaugugcuugggcagcuug

SEQ ID NO: 586466 - RNA, 65 nt, Homo Sapiens
caacacuaucaaugucuuugggaggcagaaagaugcuccaagaaccugagaccagacaaagcccg

SEQ ID NO: 586467 - RNA, 65 nt, Homo Sapiens
aggucccuguggcgaaguuagggaagggaaggcagcuccaagaagggauuggagagggaugggga

SEQ ID NO: 586468 - RNA, 65 nt, Homo Sapiens
acaaaucguccuuguucuuacuucaguaugugcuucuccaagaauugguuucacuggauuuucuu

SEQ ID NO: 586469 - RNA, 65 nt, Homo Sapiens
agaauggccccgagagaacucauuugcucccugagcuccaagauauccucuugcguuuuggcccc

SEQ ID NO: 586470 - RNA, 65 nt, Homo Sapiens
aggagcagcugugagcuggaggagaccacgcugcccuccaagaccgcacugggggcuucucccca

SEQ ID NO: 586471 - RNA, 65 nt, Homo Sapiens
uccugcucccucugccagaaugugucucccccucccuccaagaggggccaggaggcugcagaacg

SEQ ID NO: 586472 - RNA, 65 nt, Homo Sapiens
ucuggacaggaggcagacacggcugcuggcccggccuccaagaguggggugggaggggcugagau

SEQ ID NO: 586473 - RNA, 65 nt, Homo Sapiens
ucuuccucuucuuugccgcggacucccuuuccugccuccaagaccuggugucucccacugugagc

SEQ ID NO: 586474 - RNA, 65 nt, Homo Sapiens
ucaucauggaggagcggugagaacauggaaccggacuccaagaugacgaucuaaagacccgggag

SEQ ID NO: 586475 - RNA, 65 nt, Homo Sapiens
accucucucacuccuugaaaacacuguucucugcccuccaagaccuucuccuucaccuuuguccc

SEQ ID NO: 586476 - RNA, 65 nt, Homo Sapiens
gcuaagcaggguccaagccuggggcugccucugcucuccaagacccaaagacccugggaaccucc

SEQ ID NO: 586477 - RNA, 65 nt, Homo Sapiens
uacugacuggucuccucuaucucuccuccugcccccuccaagaaguucucgcccucccuuuuccu

SEQ ID NO: 586478 - RNA, 65 nt, Homo Sapiens
aauguggcauacacagugggguuuuaaaguggucccuccaagaauguaaauuauccaucacuuuu

SEQ ID NO: 586479 - RNA, 65 nt, Homo Sapiens
gacacccugguucagaacaccaccgccucuauggacuccaagacuaucauucuccuugaugaagc

SEQ ID NO: 586480 - RNA, 65 nt, Homo Sapiens
guauuagauuuuugugaugaauucuugggcacauacuccaagauuuggacccuugcuuugauacc

SEQ ID NO: 586481 - RNA, 65 nt, Homo Sapiens
gcaugaauauggcagagucucauccauugaaaaaccuccaagaggggaucaaguaucaucagauu

SEQ ID NO: 586482 - RNA, 65 nt, Homo Sapiens
ucuugugucaaauuaguaacucacccucaggaucucuccaagaaauucuuuuuuucccuacaggg

SEQ ID NO: 586483 - RNA, 65 nt, Homo Sapiens
ggugauggaaaaagcgcuguuuccuugccugcuuucuccaagacagauuuucggaacacauuucc

SEQ ID NO: 586484 - RNA, 65 nt, Homo Sapiens
uuucuuccuuuaccccccauuuuuccuauuauucgcuccaagaaagaugcuaagucugagcucca

SEQ ID NO: 586485 - RNA, 65 nt, Homo Sapiens
ugcagaaaaaaaaaaaaccaaaaaggauugcuuuacuccaagaggagagauugucuuaggauaaa

SEQ ID NO: 586486 - RNA, 65 nt, Homo Sapiens
cggucccacaaagcacuuucuuaaaccuugagaaucuccaagagaaaaauauuuggggaaggagg

SEQ ID NO: 586487 - RNA, 52 nt, Homo Sapiens; identical to SEQ ID NO: 586167

SEQ ID NO: 586488 - RNA, 65 nt, Homo Sapiens
uuggagcugcacaaagucagcagggaccacuaaaucuccaagaccuggugugcggaggcaggagc

SEQ ID NO: 586489 - RNA, 65 nt, Homo Sapiens
ggccccagcaaucgugacugacguuugcuccuugacuccaagaaacugagaccaaagaagcugcu

SEQ ID NO: 586490 - RNA, 65 nt, Homo Sapiens
uuuacuucagggggaccacuguaagaaaagccaaacuccaagaccaaguaaguuagaggagucuu

SEQ ID NO: 586491 - RNA, 65 nt, Homo Sapiens
accaaggagcugcagaagcugauugaagcugacaucuccaagagguacagcgggcgcccugugaa

SEQ ID NO: 586492 - RNA, 65 nt, Homo Sapiens
ucuaacaucguggcuguggagagggucaaggaguacuccaagacagagacagagguggguacugg

SEQ ID NO: 586493 - RNA, 65 nt, Homo Sapiens
cacauggguccacugcaccagugugacaucuacaacuccaagauugccgggaagcuccuggggug

SEQ ID NO: 586494 - RNA, 51 nt, Homo Sapiens; identical to SEQ ID NO: 586174

SEQ ID NO: 586495 - RNA, 65 nt, Homo Sapiens
cgaagcucacucccuuccucuccaucucucccucucuccaagacucuggcaguggccuaugaucc

SEQ ID NO: 586496 - RNA, 65 nt, Homo Sapiens
gcagcugcuucggaacaccgucccuccuaugcacccuccaagacgugcagcagaugcaaaggguu

SEQ ID NO: 586497 - RNA, 65 nt, Homo Sapiens
ccagcagccgggacccucuggagagcuuguuuucccuccaagaagagguuugagacaggcggcau

SEQ ID NO: 586498 - RNA, 65 nt, Homo Sapiens
gacuguccacccagccuugcuguuaggcaccaugacuccaagaugaagauguggucccugcccuu

SEQ ID NO: 586499 - RNA, 65 nt, Homo Sapiens
uuaguuaccgagacaugaauuaguggcuguucaugcuccaagacuuuuacuauugaacuguauuc

SEQ ID NO: 586500 - RNA, 65 nt, Homo Sapiens
ucccgugcguaggcuggacagccaagcagccacgucuccaagagccugaccacuccaguuaggau

SEQ ID NO: 586501 - RNA, 65 nt, Homo Sapiens
gguucaucuuuucuuccuuuaaccaaaguacaacacuccaagauguccacuguuggcucuccagc

SEQ ID NO: 586502 - RNA, 65 nt, Homo Sapiens
agggcuugcgaaaggaaagcgcagccuccugccugcuccaagaaagcccaugaggacaaagugua

SEQ ID NO: 586503 - RNA, 65 nt, Homo Sapiens
agagauaguggggagacuucaaaaccaggccuuaucuccaagaccugcucagaccagcucuuccg

SEQ ID NO: 586504 - RNA, 65 nt, Homo Sapiens
acacuucugucuugaugguccauggaaaacaaagucuccaagaaacagaccauuauuuacagaug

SEQ ID NO: 586505 - RNA, 65 nt, Homo Sapiens
cccacccgggggggaagaagagagacgugguaggucuccaagaguugggaggugcaggggccaag

SEQ ID NO: 586506 - RNA, 65 nt, Homo Sapiens
uaaccugcaaguugcucugagucugaggccccugccuccaagauugcucaggggcuccaugcugg

SEQ ID NO: 586507 - RNA, 65 nt, Homo Sapiens
cuacagcccugugucuggccggugccccuacccaccuccaagagguaggcauaugauggggaggg

SEQ ID NO: 586508 - RNA, 65 nt, Homo Sapiens
ugccaccgcuggggcugcacuacuaaacggacagacuccaagagccgacgcucgugggggaaaca

SEQ ID NO: 586509 - RNA, 65 nt, Homo Sapiens
gauuugguccgucauaacccuagcaguccccuucccuccaagaaggucccugggagggacaugcu

SEQ ID NO: 586510 - RNA, 65 nt, Homo Sapiens
uggccgaaauuucuacaccugugucuaguccuccccuccaagagcauuaacuauuuaaaacaagg

SEQ ID NO: 586511 - RNA, 65 nt, Homo Sapiens
gauuauuucuucuguaaauauuucagaauguaucucuccaagaugagagcucauuaaaagacaau

SEQ ID NO: 586512 - RNA, 65 nt, Homo Sapiens
aaguuuagagaaaaaaaauuaaaaagaaacaaagucuccaagaaauaugggacuaugugaaaaga

SEQ ID NO: 586513 - RNA, 65 nt, Homo Sapiens
gagaacgccacaaagauacuccuugagaagagcaacuccaagacacauaauugucagauucacca

SEQ ID NO: 586514 - RNA, 65 nt, Homo Sapiens
uuagauucucugugucuaagauucuagaucagaugcuccaagauucuagaugauuaaauaagauu

SEQ ID NO: 586515 - RNA, 65 nt, Homo Sapiens
gggccaaggucccagaccaagcugaaucacgcuuucuccaagacagcccgcaggcuaagugcauu

SEQ ID NO: 586516 - RNA, 65 nt, Homo Sapiens
cucaaaacgacgggggcaggugcaaguucauaggucuccaagaccacccuccuuucauuugcuag

SEQ ID NO: 586517 - RNA, 65 nt, Homo Sapiens
agcuccaggcuucagaaaguggugcugagaacuugcuccaagaagaagucaaaccaaacuugcag

SEQ ID NO: 586518 - RNA, 65 nt, Homo Sapiens
cuucguuggcccgccccuuuccucuggccccuccucuccaagaaaauuagcuccucccucguucu

SEQ ID NO: 586519 - RNA, 65 nt, Homo Sapiens
gcagcgcucccagugguggguuccgacucaucacccuccaagagggaggggagagaagacuuugu

SEQ ID NO: 586520 - RNA, 65 nt, Homo Sapiens
cagccccuuucugcuccacacccucuaccaagccacuccaagagcuccccaggggauggcccucc

SEQ ID NO: 586521 - RNA, 65 nt, Homo Sapiens
ucuguccacagacuucugcccccggauucuugggucuccaagaaggaggaggaggggacuggggu

SEQ ID NO: 586522 - RNA, 65 nt, Homo Sapiens
ggacuggagacaaaacccucugcuuccuugggucccuccaagacucccuggggcccaacuguguu

SEQ ID NO: 586523 - RNA, 65 nt, Homo Sapiens
ucgcccugcacauuccccaccuccacauuccccuccuccaagaucucagcuccuuaacauaucag

SEQ ID NO: 586524 - RNA, 65 nt, Homo Sapiens
agaaaagaacguauuuuaaaagccacauagagugacuccaagaacaauuguccauggucucaaac

SEQ ID NO: 586525 - RNA, 65 nt, Homo Sapiens
ugggcacuucacagccagccuagggucuucggcaccuccaagagcugaaucucccuccaacccuu

SEQ ID NO: 586526 - RNA, 65 nt, Homo Sapiens
ugcuuuuccagacugugguugugaaccggcuccuucuccaagaaagguugcaagcugagaacauc

SEQ ID NO: 586527 - RNA, 65 nt, Homo Sapiens
ugccaugcagacccaugccccccucccccaggcagcuccaagaaagcucccugacucgccccuuc

SEQ ID NO: 586528 - RNA, 65 nt, Homo Sapiens
ugucugucuccccugccccacugcuggaacagaggcuccaagaaaacagggaccuuauuauucau

SEQ ID NO: 586529 - RNA, 65 nt, Homo Sapiens
acaucccccugguccuaccccuggcccuuggccuccuccaagagggcucaccccgggugcugcuc

SEQ ID NO: 586530 - RNA, 65 nt, Homo Sapiens
gcaccagccucgagucucccauguuguaguacauucuccaagaugcagcccaggagccucucuga

SEQ ID NO: 586531 - RNA, 65 nt, Homo Sapiens
cagccgacugcuguucccagacuucccuggccacgcuccaagacgccagcucugccgcgggcacu

SEQ ID NO: 586532 - RNA, 65 nt, Homo Sapiens
cugggggucuuggcugcugcaggauuucgcuuccccuccaagacggcagagcgggugucagacug

SEQ ID NO: 586533 - RNA, 65 nt, Homo Sapiens
ccaccuaccucccugaugcuuccacgucgcguggucuccaagaccgugccagauggagccuuuau

SEQ ID NO: 586534 - RNA, 65 nt, Homo Sapiens
uggcaccaggccgggagggcccuguaccgugucaacuccaagagcacccugggcugugucuccuc

SEQ ID NO: 586535 - RNA, 65 nt, Homo Sapiens
aacucgacuugucugaaaucaaggaacuagucuuucuccaagaaggccucagcuccucccugggg

SEQ ID NO: 586536 - RNA, 65 nt, Homo Sapiens
ccccugagcucagcccucugcauggggugaguguccuccaagagcgccagaagcaucccauggac

SEQ ID NO: 586537 - RNA, 65 nt, Homo Sapiens
uugggauaagagugugagagaucuucuucccuuaacuccaagaacaaggacugaacuccaucgcc

SEQ ID NO: 586538 - RNA, 65 nt, Homo Sapiens
uucugccucccuuguguccgaugcaguuuauucuacuccaagagacuuguccacuucuuuaagga

SEQ ID NO: 586539 - RNA, 65 nt, Homo Sapiens
cuuucccacaaccguauaacgaccgauggucauuucuccaagagcaggcuuggcgaguccuugca

SEQ ID NO: 586540 - RNA, 65 nt, Homo Sapiens
gaagugaauuuacuuuuuggguccagaaugacuuucuccaagaauuauaagaugaaaauuauaua

SEQ ID NO: 586541 - RNA, 65 nt, Homo Sapiens
aauaucuaauggagcaauuugucuuuugcuauauucuccaagauuaucucuuaagaccauaugcc

SEQ ID NO: 586542 - RNA, 65 nt, Homo Sapiens
cccauugccuagaaaccuuugcauucauccuccuucuccaagaccuauggagaaggucccaggcc

SEQ ID NO: 586543 - RNA, 65 nt, Homo Sapiens
uuuuauuuuucauuuuuuugaauaauggaaauggucuccaagaagguuucauugauuuaaucaua

SEQ ID NO: 586544 - RNA, 65 nt, Homo Sapiens
cucagauccagguuaggaaagaaaauaauuuuuuccuccaagauuuuugacaggagggagccugg

SEQ ID NO: 586545 - RNA, 65 nt, Homo Sapiens
cugucugaaacuuguacagcguuguauucuuuauucuccaagaaugaaaaacaaguuccuuagag

SEQ ID NO: 586546 - RNA, 65 nt, Homo Sapiens
uuucuuagaauugucuacaguguucuuauuacaaacuccaagacaucuucucuuuguguuuguuu

SEQ ID NO: 586547 - RNA, 65 nt, Homo Sapiens
uuccuuguugacaacagggguacacucacacagaccuccaagacuuucuucuccaccucuucuuu

SEQ ID NO: 586548 - RNA, 65 nt, Homo Sapiens
acaauuuugauagucugaacacaagcauuucacuucuccaagaaguaccugugaacaguacaaua

SEQ ID NO: 586549 - RNA, 65 nt, Homo Sapiens; identical to SEQ ID NO: 586548

SEQ ID NO: 586550 - RNA, 64 nt, Homo Sapiens; identical to SEQ ID NO: 120914

SEQ ID NO: 586551 - RNA, 64 nt, Homo Sapiens; identical to SEQ ID NO: 120915

SEQ ID NO: 586552 - RNA, 64 nt, Homo Sapiens; identical to SEQ ID NO: 341009

SEQ ID NO: 586553 - RNA, 64 nt, Homo Sapiens; identical to SEQ ID NO: 341010

SEQ ID NO: 586554 - RNA, 64 nt, Homo Sapiens; identical to SEQ ID NO: 341011

SEQ ID NO: 586555 - RNA, 64 nt, Homo Sapiens; identical to SEQ ID NO: 341012

SEQ ID NO: 586556 - RNA, 64 nt, Homo Sapiens; identical to SEQ ID NO: 341013

SEQ ID NO: 586557 - RNA, 64 nt, Homo Sapiens; identical to SEQ ID NO: 341014

SEQ ID NO: 586558 - RNA, 64 nt, Homo Sapiens; identical to SEQ ID NO: 341015

SEQ ID NO: 586559 - RNA, 64 nt, Homo Sapiens; identical to SEQ ID NO: 341016

SEQ ID NO: 586560 - RNA, 64 nt, Homo Sapiens; identical to SEQ ID NO: 341017

SEQ ID NO: 586561 - RNA, 64 nt, Homo Sapiens; identical to SEQ ID NO: 341018

SEQ ID NO: 586562 - RNA, 64 nt, Homo Sapiens; identical to SEQ ID NO: 341019

SEQ ID NO: 586563 - RNA, 64 nt, Homo Sapiens; identical to SEQ ID NO: 341020

SEQ ID NO: 586564 - RNA, 64 nt, Homo Sapiens; identical to SEQ ID NO: 341021

SEQ ID NO: 586565 - RNA, 64 nt, Homo Sapiens; identical to SEQ ID NO: 341022

SEQ ID NO: 586566 - RNA, 64 nt, Homo Sapiens; identical to SEQ ID NO: 341023

SEQ ID NO: 586567 - RNA, 64 nt, Homo Sapiens; identical to SEQ ID NO: 341024

SEQ ID NO: 586568 - RNA, 64 nt, Homo Sapiens; identical to SEQ ID NO: 341025

SEQ ID NO: 586569 - RNA, 64 nt, Homo Sapiens; identical to SEQ ID NO: 341026

SEQ ID NO: 586570 - RNA, 64 nt, Homo Sapiens; identical to SEQ ID NO: 341027

SEQ ID NO: 586571 - RNA, 64 nt, Homo Sapiens; identical to SEQ ID NO: 341028

SEQ ID NO: 586572 - RNA, 64 nt, Homo Sapiens; identical to SEQ ID NO: 341029

SEQ ID NO: 586573 - RNA, 64 nt, Homo Sapiens; identical to SEQ ID NO: 341030

SEQ ID NO: 586574 - RNA, 64 nt, Homo Sapiens; identical to SEQ ID NO: 341031

SEQ ID NO: 586575 - RNA, 64 nt, Homo Sapiens; identical to SEQ ID NO: 341032

SEQ ID NO: 586576 - RNA, 64 nt, Homo Sapiens; identical to SEQ ID NO: 341033

SEQ ID NO: 586577 - RNA, 64 nt, Homo Sapiens; identical to SEQ ID NO: 341034

SEQ ID NO: 586578 - RNA, 64 nt, Homo Sapiens; identical to SEQ ID NO: 341035

SEQ ID NO: 586579 - RNA, 64 nt, Homo Sapiens; identical to SEQ ID NO: 341036

SEQ ID NO: 586580 - RNA, 64 nt, Homo Sapiens; identical to SEQ ID NO: 341037

SEQ ID NO: 586581 - RNA, 64 nt, Homo Sapiens; identical to SEQ ID NO: 341038

SEQ ID NO: 586582 - RNA, 64 nt, Homo Sapiens; identical to SEQ ID NO: 341039

SEQ ID NO: 586583 - RNA, 64 nt, Homo Sapiens; identical to SEQ ID NO: 341040

SEQ ID NO: 586584 - RNA, 64 nt, Homo Sapiens; identical to SEQ ID NO: 341041

SEQ ID NO: 586585 - RNA, 64 nt, Homo Sapiens
uauagaccuggggcugcaguuggggacuucaugucagugcaaaugccauuaguuccauuuguac

SEQ ID NO: 586586 - RNA, 64 nt, Homo Sapiens
uaauuuaaggaacaaguaacuaaaaauguuaagccagugcaaaauaaucugcuuaccuacucac

SEQ ID NO: 586587 - RNA, 64 nt, Homo Sapiens
cgcccugacaccugcuucuaaugagaaaugaagucagugcaaggaggaaugagagguggggagg

SEQ ID NO: 586588 - RNA, 64 nt, Homo Sapiens
aauaucauguccaggccuggaaagaauacaaauccagugcaaaauuaaaccauuaguucuugau

SEQ ID NO: 586589 - RNA, 64 nt, Homo Sapiens
aguacucaguaagacagugcagugcucaguaaggcagugcaauacucaguaacaguguaguacu

SEQ ID NO: 586590 - RNA, 64 nt, Homo Sapiens
gugcaguacucaggaaugcagcacaguacucaggcagugcaauacucagugcgguacucaguaa

SEQ ID NO: 586591 - RNA, 64 nt, Homo Sapiens
uucaagucucuuuuaccccuggcagagccaguugcagugcaauuuuuuguacuaaaugccaaua

SEQ ID NO: 586592 - RNA, 64 nt, Homo Sapiens
agaaaaaauugucugaaauguuuauuuugcaaaacagugcaauagaaucuaguuaugccuucau

SEQ ID NO: 586593 - RNA, 64 nt, Homo Sapiens
cuuucugguuuuaauuuuuaguugugcuuugagucagugcaauaaacuagacuuuuuccaaacc

SEQ ID NO: 586594 - RNA, 64 nt, Homo Sapiens
ugugagaaguguccucagccgacacucacgagggcagugcaagggagaaccugccagcccagcc

SEQ ID NO: 586595 - RNA, 64 nt, Homo Sapiens
cuugaugcugcgccguccccaaagcagaaauuuucagugcaaguuccauuccacgcaguugcuc

SEQ ID NO: 586596 - RNA, 64 nt, Homo Sapiens
uccgccacccggguucaggcgugcgaucucagcucagugcaaccgcccaggcuggaguacaaug

SEQ ID NO: 586597 - RNA, 64 nt, Homo Sapiens; identical to SEQ ID NO: 353575

SEQ ID NO: 586598 - RNA, 64 nt, Homo Sapiens; identical to SEQ ID NO: 353576

SEQ ID NO: 586599 - RNA, 64 nt, Homo Sapiens; identical to SEQ ID NO: 161197

SEQ ID NO: 586600 - RNA, 64 nt, Homo Sapiens; identical to SEQ ID NO: 161198

SEQ ID NO: 586601 - RNA, 64 nt, Homo Sapiens; identical to SEQ ID NO: 161199

SEQ ID NO: 586602 - RNA, 64 nt, Homo Sapiens; identical to SEQ ID NO: 161200

SEQ ID NO: 586603 - RNA, 64 nt, Homo Sapiens; identical to SEQ ID NO: 161201

SEQ ID NO: 586604 - RNA, 64 nt, Homo Sapiens; identical to SEQ ID NO: 161202

SEQ ID NO: 586605 - RNA, 64 nt, Homo Sapiens; identical to SEQ ID NO: 161203

SEQ ID NO: 586606 - RNA, 64 nt, Homo Sapiens; identical to SEQ ID NO: 161204

SEQ ID NO: 586607 - RNA, 64 nt, Homo Sapiens; identical to SEQ ID NO: 161205

SEQ ID NO: 586608 - RNA, 64 nt, Homo Sapiens; identical to SEQ ID NO: 161206

SEQ ID NO: 586609 - RNA, 64 nt, Homo Sapiens; identical to SEQ ID NO: 161207

SEQ ID NO: 586610 - RNA, 64 nt, Homo Sapiens; identical to SEQ ID NO: 161208

SEQ ID NO: 586611 - RNA, 64 nt, Homo Sapiens; identical to SEQ ID NO: 161209

SEQ ID NO: 586612 - RNA, 64 nt, Homo Sapiens; identical to SEQ ID NO: 161210

SEQ ID NO: 586613 - RNA, 64 nt, Homo Sapiens; identical to SEQ ID NO: 161211

SEQ ID NO: 586614 - RNA, 64 nt, Homo Sapiens; identical to SEQ ID NO: 161212

SEQ ID NO: 586615 - RNA, 64 nt, Homo Sapiens; identical to SEQ ID NO: 161213

SEQ ID NO: 586616 - RNA, 64 nt, Homo Sapiens; identical to SEQ ID NO: 161214

SEQ ID NO: 586617 - RNA, 64 nt, Homo Sapiens; identical to SEQ ID NO: 161215

SEQ ID NO: 586618 - RNA, 64 nt, Homo Sapiens; identical to SEQ ID NO: 161216

SEQ ID NO: 586619 - RNA, 64 nt, Homo Sapiens; identical to SEQ ID NO: 161217

SEQ ID NO: 586620 - RNA, 64 nt, Homo Sapiens; identical to SEQ ID NO: 161218

SEQ ID NO: 586621 - RNA, 64 nt, Homo Sapiens; identical to SEQ ID NO: 161219

SEQ ID NO: 586622 - RNA, 64 nt, Homo Sapiens; identical to SEQ ID NO: 161220

SEQ ID NO: 586623 - RNA, 64 nt, Homo Sapiens; identical to SEQ ID NO: 161221

SEQ ID NO: 586624 - RNA, 64 nt, Homo Sapiens; identical to SEQ ID NO: 161222

SEQ ID NO: 586625 - RNA, 64 nt, Homo Sapiens; identical to SEQ ID NO: 161223

SEQ ID NO: 586626 - RNA, 64 nt, Homo Sapiens; identical to SEQ ID NO: 161224

SEQ ID NO: 586627 - RNA, 64 nt, Homo Sapiens; identical to SEQ ID NO: 161225

SEQ ID NO: 586628 - RNA, 64 nt, Homo Sapiens; identical to SEQ ID NO: 161226

SEQ ID NO: 586629 - RNA, 64 nt, Homo Sapiens; identical to SEQ ID NO: 161227

SEQ ID NO: 586630 - RNA, 64 nt, Homo Sapiens; identical to SEQ ID NO: 161228

SEQ ID NO: 586631 - RNA, 64 nt, Homo Sapiens; identical to SEQ ID NO: 161229

SEQ ID NO: 586632 - RNA, 64 nt, Homo Sapiens; identical to SEQ ID NO: 161230

SEQ ID NO: 586633 - RNA, 64 nt, Homo Sapiens; identical to SEQ ID NO: 161231

SEQ ID NO: 586634 - RNA, 64 nt, Homo Sapiens; identical to SEQ ID NO: 161232

SEQ ID NO: 586635 - RNA, 60 nt, Homo Sapiens; identical to SEQ ID NO: 161233

SEQ ID NO: 586636 - RNA, 64 nt, Homo Sapiens; identical to SEQ ID NO: 161234

SEQ ID NO: 586637 - RNA, 64 nt, Homo Sapiens; identical to SEQ ID NO: 161235

SEQ ID NO: 586638 - RNA, 64 nt, Homo Sapiens; identical to SEQ ID NO: 161236

SEQ ID NO: 586639 - RNA, 64 nt, Homo Sapiens; identical to SEQ ID NO: 161237

SEQ ID NO: 586640 - RNA, 64 nt, Homo Sapiens; identical to SEQ ID NO: 161238

SEQ ID NO: 586641 - RNA, 64 nt, Homo Sapiens; identical to SEQ ID NO: 161239

SEQ ID NO: 586642 - RNA, 64 nt, Homo Sapiens; identical to SEQ ID NO: 161240

SEQ ID NO: 586643 - RNA, 64 nt, Homo Sapiens; identical to SEQ ID NO: 161241

SEQ ID NO: 586644 - RNA, 64 nt, Homo Sapiens; identical to SEQ ID NO: 161242

SEQ ID NO: 586645 - RNA, 64 nt, Homo Sapiens; identical to SEQ ID NO: 161243

SEQ ID NO: 586646 - RNA, 64 nt, Homo Sapiens; identical to SEQ ID NO: 161244

SEQ ID NO: 586647 - RNA, 64 nt, Homo Sapiens; identical to SEQ ID NO: 161245

SEQ ID NO: 586648 - RNA, 64 nt, Homo Sapiens; identical to SEQ ID NO: 161246

SEQ ID NO: 586649 - RNA, 64 nt, Homo Sapiens; identical to SEQ ID NO: 161247

SEQ ID NO: 586650 - RNA, 64 nt, Homo Sapiens; identical to SEQ ID NO: 161248

SEQ ID NO: 586651 - RNA, 64 nt, Homo Sapiens; identical to SEQ ID NO: 161249

SEQ ID NO: 586652 - RNA, 64 nt, Homo Sapiens; identical to SEQ ID NO: 161250

SEQ ID NO: 586653 - RNA, 64 nt, Homo Sapiens; identical to SEQ ID NO: 161251

SEQ ID NO: 586654 - RNA, 64 nt, Homo Sapiens; identical to SEQ ID NO: 161252

SEQ ID NO: 586655 - RNA, 64 nt, Homo Sapiens; identical to SEQ ID NO: 161253

SEQ ID NO: 586656 - RNA, 64 nt, Homo Sapiens; identical to SEQ ID NO: 161254

SEQ ID NO: 586657 - RNA, 64 nt, Homo Sapiens; identical to SEQ ID NO: 161255

SEQ ID NO: 586658 - RNA, 64 nt, Homo Sapiens; identical to SEQ ID NO: 161256

SEQ ID NO: 586659 - RNA, 64 nt, Homo Sapiens; identical to SEQ ID NO: 161257

SEQ ID NO: 586660 - RNA, 64 nt, Homo Sapiens; identical to SEQ ID NO: 161258

SEQ ID NO: 586661 - RNA, 64 nt, Homo Sapiens; identical to SEQ ID NO: 161259

SEQ ID NO: 586662 - RNA, 64 nt, Homo Sapiens; identical to SEQ ID NO: 161260

SEQ ID NO: 586663 - RNA, 64 nt, Homo Sapiens; identical to SEQ ID NO: 161261

SEQ ID NO: 586664 - RNA, 64 nt, Homo Sapiens; identical to SEQ ID NO: 161262

SEQ ID NO: 586665 - RNA, 64 nt, Homo Sapiens; identical to SEQ ID NO: 161263

SEQ ID NO: 586666 - RNA, 64 nt, Homo Sapiens; identical to SEQ ID NO: 161264

SEQ ID NO: 586667 - RNA, 64 nt, Homo Sapiens; identical to SEQ ID NO: 161265

SEQ ID NO: 586668 - RNA, 64 nt, Homo Sapiens; identical to SEQ ID NO: 161266

SEQ ID NO: 586669 - RNA, 64 nt, Homo Sapiens; identical to SEQ ID NO: 161267

SEQ ID NO: 586670 - RNA, 64 nt, Homo Sapiens; identical to SEQ ID NO: 161268

SEQ ID NO: 586671 - RNA, 64 nt, Homo Sapiens; identical to SEQ ID NO: 161269

SEQ ID NO: 586672 - RNA, 64 nt, Homo Sapiens; identical to SEQ ID NO: 161270

SEQ ID NO: 586673 - RNA, 64 nt, Homo Sapiens; identical to SEQ ID NO: 161271

SEQ ID NO: 586674 - RNA, 64 nt, Homo Sapiens; identical to SEQ ID NO: 161272

SEQ ID NO: 586675 - RNA, 64 nt, Homo Sapiens; identical to SEQ ID NO: 161273

SEQ ID NO: 586676 - RNA, 64 nt, Homo Sapiens; identical to SEQ ID NO: 161274

SEQ ID NO: 586677 - RNA, 64 nt, Homo Sapiens; identical to SEQ ID NO: 161275

SEQ ID NO: 586678 - RNA, 64 nt, Homo Sapiens; identical to SEQ ID NO: 161276

SEQ ID NO: 586679 - RNA, 64 nt, Homo Sapiens; identical to SEQ ID NO: 161277

SEQ ID NO: 586680 - RNA, 64 nt, Homo Sapiens; identical to SEQ ID NO: 161278

SEQ ID NO: 586681 - RNA, 64 nt, Homo Sapiens; identical to SEQ ID NO: 161279

SEQ ID NO: 586682 - RNA, 63 nt, Homo Sapiens; identical to SEQ ID NO: 161280

SEQ ID NO: 586683 - RNA, 64 nt, Homo Sapiens; identical to SEQ ID NO: 161281

SEQ ID NO: 586684 - RNA, 64 nt, Homo Sapiens; identical to SEQ ID NO: 161282

SEQ ID NO: 586685 - RNA, 64 nt, Homo Sapiens; identical to SEQ ID NO: 161283

SEQ ID NO: 586686 - RNA, 64 nt, Homo Sapiens; identical to SEQ ID NO: 161284

SEQ ID NO: 586687 - RNA, 64 nt, Homo Sapiens; identical to SEQ ID NO: 261645

SEQ ID NO: 586688 - RNA, 64 nt, Homo Sapiens; identical to SEQ ID NO: 261646

SEQ ID NO: 586689 - RNA, 64 nt, Homo Sapiens; identical to SEQ ID NO: 261647

SEQ ID NO: 586690 - RNA, 64 nt, Homo Sapiens; identical to SEQ ID NO: 261648

SEQ ID NO: 586691 - RNA, 64 nt, Homo Sapiens; identical to SEQ ID NO: 263253

SEQ ID NO: 586692 - RNA, 64 nt, Homo Sapiens; identical to SEQ ID NO: 263254

SEQ ID NO: 586693 - RNA, 64 nt, Homo Sapiens; identical to SEQ ID NO: 263255

SEQ ID NO: 586694 - RNA, 64 nt, Homo Sapiens; identical to SEQ ID NO: 263256

SEQ ID NO: 586695 - RNA, 64 nt, Homo Sapiens; identical to SEQ ID NO: 263257

SEQ ID NO: 586696 - RNA, 64 nt, Homo Sapiens; identical to SEQ ID NO: 263258

SEQ ID NO: 586697 - RNA, 64 nt, Homo Sapiens; identical to SEQ ID NO: 263259

SEQ ID NO: 586698 - RNA, 64 nt, Homo Sapiens; identical to SEQ ID NO: 263260

SEQ ID NO: 586699 - RNA, 64 nt, Homo Sapiens; identical to SEQ ID NO: 263261

SEQ ID NO: 586700 - RNA, 64 nt, Homo Sapiens; identical to SEQ ID NO: 263262

SEQ ID NO: 586701 - RNA, 64 nt, Homo Sapiens; identical to SEQ ID NO: 263263

SEQ ID NO: 586702 - RNA, 64 nt, Homo Sapiens; identical to SEQ ID NO: 263264

SEQ ID NO: 586703 - RNA, 64 nt, Homo Sapiens; identical to SEQ ID NO: 263265

SEQ ID NO: 586704 - RNA, 64 nt, Homo Sapiens; identical to SEQ ID NO: 263266

SEQ ID NO: 586705 - RNA, 64 nt, Homo Sapiens; identical to SEQ ID NO: 263267

SEQ ID NO: 586706 - RNA, 64 nt, Homo Sapiens; identical to SEQ ID NO: 263268

SEQ ID NO: 586707 - RNA, 64 nt, Homo Sapiens; identical to SEQ ID NO: 263269

SEQ ID NO: 586708 - RNA, 64 nt, Homo Sapiens; identical to SEQ ID NO: 263270

SEQ ID NO: 586709 - RNA, 64 nt, Homo Sapiens; identical to SEQ ID NO: 263271

SEQ ID NO: 586710 - RNA, 64 nt, Homo Sapiens; identical to SEQ ID NO: 263272

SEQ ID NO: 586711 - RNA, 59 nt, Homo Sapiens; identical to SEQ ID NO: 263273

SEQ ID NO: 586712 - RNA, 64 nt, Homo Sapiens; identical to SEQ ID NO: 24683

SEQ ID NO: 586713 - RNA, 64 nt, Homo Sapiens; identical to SEQ ID NO: 24684

SEQ ID NO: 586714 - RNA, 64 nt, Homo Sapiens; identical to SEQ ID NO: 24685

SEQ ID NO: 586715 - RNA, 64 nt, Homo Sapiens; identical to SEQ ID NO: 24686

SEQ ID NO: 586716 - RNA, 64 nt, Homo Sapiens; identical to SEQ ID NO: 24687

SEQ ID NO: 586717 - RNA, 64 nt, Homo Sapiens; identical to SEQ ID NO: 24688

SEQ ID NO: 586718 - RNA, 64 nt, Homo Sapiens; identical to SEQ ID NO: 24689

SEQ ID NO: 586719 - RNA, 64 nt, Homo Sapiens; identical to SEQ ID NO: 24690

SEQ ID NO: 586720 - RNA, 64 nt, Homo Sapiens; identical to SEQ ID NO: 24691

SEQ ID NO: 586721 - RNA, 64 nt, Homo Sapiens; identical to SEQ ID NO: 24692

SEQ ID NO: 586722 - RNA, 64 nt, Homo Sapiens; identical to SEQ ID NO: 24693

SEQ ID NO: 586723 - RNA, 64 nt, Homo Sapiens; identical to SEQ ID NO: 24694

SEQ ID NO: 586724 - RNA, 64 nt, Homo Sapiens; identical to SEQ ID NO: 24695

SEQ ID NO: 586725 - RNA, 64 nt, Homo Sapiens; identical to SEQ ID NO: 24696

SEQ ID NO: 586726 - RNA, 64 nt, Homo Sapiens; identical to SEQ ID NO: 24697

SEQ ID NO: 586727 - RNA, 64 nt, Homo Sapiens; identical to SEQ ID NO: 24698

SEQ ID NO: 586728 - RNA, 64 nt, Homo Sapiens; identical to SEQ ID NO: 24699

SEQ ID NO: 586729 - RNA, 64 nt, Homo Sapiens; identical to SEQ ID NO: 24700

SEQ ID NO: 586730 - RNA, 64 nt, Homo Sapiens; identical to SEQ ID NO: 24701

SEQ ID NO: 586731 - RNA, 64 nt, Homo Sapiens; identical to SEQ ID NO: 24702

SEQ ID NO: 586732 - RNA, 64 nt, Homo Sapiens; identical to SEQ ID NO: 24703

SEQ ID NO: 586733 - RNA, 64 nt, Homo Sapiens; identical to SEQ ID NO: 24704

SEQ ID NO: 586734 - RNA, 64 nt, Homo Sapiens; identical to SEQ ID NO: 24705

SEQ ID NO: 586735 - RNA, 64 nt, Homo Sapiens; identical to SEQ ID NO: 24706

SEQ ID NO: 586736 - RNA, 64 nt, Homo Sapiens; identical to SEQ ID NO: 24707

SEQ ID NO: 586737 - RNA, 64 nt, Homo Sapiens; identical to SEQ ID NO: 24708

SEQ ID NO: 586738 - RNA, 64 nt, Homo Sapiens; identical to SEQ ID NO: 24709

SEQ ID NO: 586739 - RNA, 64 nt, Homo Sapiens; identical to SEQ ID NO: 24710

SEQ ID NO: 586740 - RNA, 64 nt, Homo Sapiens; identical to SEQ ID NO: 24711

SEQ ID NO: 586741 - RNA, 64 nt, Homo Sapiens; identical to SEQ ID NO: 24712

SEQ ID NO: 586742 - RNA, 64 nt, Homo Sapiens; identical to SEQ ID NO: 24713

SEQ ID NO: 586743 - RNA, 64 nt, Homo Sapiens; identical to SEQ ID NO: 24714

SEQ ID NO: 586744 - RNA, 64 nt, Homo Sapiens; identical to SEQ ID NO: 24715

SEQ ID NO: 586745 - RNA, 64 nt, Homo Sapiens; identical to SEQ ID NO: 24716

SEQ ID NO: 586746 - RNA, 64 nt, Homo Sapiens; identical to SEQ ID NO: 24717

SEQ ID NO: 586747 - RNA, 64 nt, Homo Sapiens; identical to SEQ ID NO: 24718

SEQ ID NO: 586748 - RNA, 64 nt, Homo Sapiens; identical to SEQ ID NO: 24719

SEQ ID NO: 586749 - RNA, 64 nt, Homo Sapiens; identical to SEQ ID NO: 24720

SEQ ID NO: 586750 - RNA, 50 nt, Homo Sapiens; identical to SEQ ID NO: 24721

SEQ ID NO: 586751 - RNA, 64 nt, Homo Sapiens; identical to SEQ ID NO: 24722

SEQ ID NO: 586752 - RNA, 64 nt, Homo Sapiens; identical to SEQ ID NO: 24723

SEQ ID NO: 586753 - RNA, 64 nt, Homo Sapiens; identical to SEQ ID NO: 24724

SEQ ID NO: 586754 - RNA, 64 nt, Homo Sapiens; identical to SEQ ID NO: 24725

SEQ ID NO: 586755 - RNA, 64 nt, Homo Sapiens; identical to SEQ ID NO: 24726

SEQ ID NO: 586756 - RNA, 64 nt, Homo Sapiens; identical to SEQ ID NO: 24727

SEQ ID NO: 586757 - RNA, 64 nt, Homo Sapiens; identical to SEQ ID NO: 111411

SEQ ID NO: 586758 - RNA, 64 nt, Homo Sapiens; identical to SEQ ID NO: 111412

SEQ ID NO: 586759 - RNA, 64 nt, Homo Sapiens; identical to SEQ ID NO: 111413

SEQ ID NO: 586760 - RNA, 64 nt, Homo Sapiens; identical to SEQ ID NO: 111414

SEQ ID NO: 586761 - RNA, 64 nt, Homo Sapiens; identical to SEQ ID NO: 111415

SEQ ID NO: 586762 - RNA, 64 nt, Homo Sapiens; identical to SEQ ID NO: 111416

SEQ ID NO: 586763 - RNA, 64 nt, Homo Sapiens; identical to SEQ ID NO: 111417

SEQ ID NO: 586764 - RNA, 64 nt, Homo Sapiens; identical to SEQ ID NO: 111418

SEQ ID NO: 586765 - RNA, 64 nt, Homo Sapiens; identical to SEQ ID NO: 111419

SEQ ID NO: 586766 - RNA, 64 nt, Homo Sapiens; identical to SEQ ID NO: 111420

SEQ ID NO: 586767 - RNA, 64 nt, Homo Sapiens; identical to SEQ ID NO: 111421

SEQ ID NO: 586768 - RNA, 64 nt, Homo Sapiens; identical to SEQ ID NO: 111422

SEQ ID NO: 586769 - RNA, 64 nt, Homo Sapiens; identical to SEQ ID NO: 111423

SEQ ID NO: 586770 - RNA, 64 nt, Homo Sapiens; identical to SEQ ID NO: 111424

SEQ ID NO: 586771 - RNA, 64 nt, Homo Sapiens; identical to SEQ ID NO: 111425

SEQ ID NO: 586772 - RNA, 64 nt, Homo Sapiens; identical to SEQ ID NO: 111426

SEQ ID NO: 586773 - RNA, 64 nt, Homo Sapiens; identical to SEQ ID NO: 111427

SEQ ID NO: 586774 - RNA, 64 nt, Homo Sapiens; identical to SEQ ID NO: 111428

SEQ ID NO: 586775 - RNA, 64 nt, Homo Sapiens; identical to SEQ ID NO: 111429

SEQ ID NO: 586776 - RNA, 64 nt, Homo Sapiens; identical to SEQ ID NO: 111430

SEQ ID NO: 586777 - RNA, 64 nt, Homo Sapiens; identical to SEQ ID NO: 111431

SEQ ID NO: 586778 - RNA, 64 nt, Homo Sapiens; identical to SEQ ID NO: 111432

SEQ ID NO: 586779 - RNA, 64 nt, Homo Sapiens; identical to SEQ ID NO: 111433

SEQ ID NO: 586780 - RNA, 64 nt, Homo Sapiens; identical to SEQ ID NO: 111434

SEQ ID NO: 586781 - RNA, 58 nt, Homo Sapiens; identical to SEQ ID NO: 111435

SEQ ID NO: 586782 - RNA, 64 nt, Homo Sapiens; identical to SEQ ID NO: 111436

SEQ ID NO: 586783 - RNA, 64 nt, Homo Sapiens; identical to SEQ ID NO: 111437

SEQ ID NO: 586784 - RNA, 64 nt, Homo Sapiens; identical to SEQ ID NO: 111438

SEQ ID NO: 586785 - RNA, 64 nt, Homo Sapiens; identical to SEQ ID NO: 111439

SEQ ID NO: 586786 - RNA, 64 nt, Homo Sapiens; identical to SEQ ID NO: 111440

SEQ ID NO: 586787 - RNA, 64 nt, Homo Sapiens; identical to SEQ ID NO: 111441

SEQ ID NO: 586788 - RNA, 64 nt, Homo Sapiens; identical to SEQ ID NO: 111442

SEQ ID NO: 586789 - RNA, 64 nt, Homo Sapiens; identical to SEQ ID NO: 111443

SEQ ID NO: 586790 - RNA, 64 nt, Homo Sapiens; identical to SEQ ID NO: 111444

SEQ ID NO: 586791 - RNA, 64 nt, Homo Sapiens; identical to SEQ ID NO: 111445

SEQ ID NO: 586792 - RNA, 64 nt, Homo Sapiens; identical to SEQ ID NO: 111446

SEQ ID NO: 586793 - RNA, 64 nt, Homo Sapiens; identical to SEQ ID NO: 111447

SEQ ID NO: 586794 - RNA, 64 nt, Homo Sapiens; identical to SEQ ID NO: 111448

SEQ ID NO: 586795 - RNA, 64 nt, Homo Sapiens; identical to SEQ ID NO: 111449

SEQ ID NO: 586796 - RNA, 64 nt, Homo Sapiens; identical to SEQ ID NO: 111450

SEQ ID NO: 586797 - RNA, 64 nt, Homo Sapiens; identical to SEQ ID NO: 111451

SEQ ID NO: 586798 - RNA, 64 nt, Homo Sapiens; identical to SEQ ID NO: 111452

SEQ ID NO: 586799 - RNA, 64 nt, Homo Sapiens; identical to SEQ ID NO: 111453

SEQ ID NO: 586800 - RNA, 64 nt, Homo Sapiens; identical to SEQ ID NO: 111454

SEQ ID NO: 586801 - RNA, 64 nt, Homo Sapiens; identical to SEQ ID NO: 111455

SEQ ID NO: 586802 - RNA, 64 nt, Homo Sapiens; identical to SEQ ID NO: 111456

SEQ ID NO: 586803 - RNA, 64 nt, Homo Sapiens; identical to SEQ ID NO: 111457

SEQ ID NO: 586804 - RNA, 64 nt, Homo Sapiens; identical to SEQ ID NO: 111458

SEQ ID NO: 586805 - RNA, 64 nt, Homo Sapiens; identical to SEQ ID NO: 111459

SEQ ID NO: 586806 - RNA, 52 nt, Homo Sapiens; identical to SEQ ID NO: 111460

SEQ ID NO: 586807 - RNA, 64 nt, Homo Sapiens; identical to SEQ ID NO: 111461

SEQ ID NO: 586808 - RNA, 64 nt, Homo Sapiens; identical to SEQ ID NO: 111462

SEQ ID NO: 586809 - RNA, 64 nt, Homo Sapiens; identical to SEQ ID NO: 111463

SEQ ID NO: 586810 - RNA, 64 nt, Homo Sapiens; identical to SEQ ID NO: 111464

SEQ ID NO: 586811 - RNA, 64 nt, Homo Sapiens; identical to SEQ ID NO: 111465

SEQ ID NO: 586812 - RNA, 64 nt, Homo Sapiens; identical to SEQ ID NO: 111466

SEQ ID NO: 586813 - RNA, 64 nt, Homo Sapiens; identical to SEQ ID NO: 111467

SEQ ID NO: 586814 - RNA, 64 nt, Homo Sapiens; identical to SEQ ID NO: 92614

SEQ ID NO: 586815 - RNA, 64 nt, Homo Sapiens; identical to SEQ ID NO: 92615

SEQ ID NO: 586816 - RNA, 64 nt, Homo Sapiens; identical to SEQ ID NO: 92616

SEQ ID NO: 586817 - RNA, 64 nt, Homo Sapiens; identical to SEQ ID NO: 92617

SEQ ID NO: 586818 - RNA, 64 nt, Homo Sapiens; identical to SEQ ID NO: 92618

SEQ ID NO: 586819 - RNA, 64 nt, Homo Sapiens; identical to SEQ ID NO: 92619

SEQ ID NO: 586820 - RNA, 64 nt, Homo Sapiens; identical to SEQ ID NO: 92620

SEQ ID NO: 586821 - RNA, 64 nt, Homo Sapiens; identical to SEQ ID NO: 92621

SEQ ID NO: 586822 - RNA, 64 nt, Homo Sapiens; identical to SEQ ID NO: 92622

SEQ ID NO: 586823 - RNA, 64 nt, Homo Sapiens; identical to SEQ ID NO: 92623

SEQ ID NO: 586824 - RNA, 64 nt, Homo Sapiens; identical to SEQ ID NO: 92624

SEQ ID NO: 586825 - RNA, 64 nt, Homo Sapiens; identical to SEQ ID NO: 92625

SEQ ID NO: 586826 - RNA, 64 nt, Homo Sapiens; identical to SEQ ID NO: 92626

SEQ ID NO: 586827 - RNA, 64 nt, Homo Sapiens; identical to SEQ ID NO: 92627

SEQ ID NO: 586828 - RNA, 64 nt, Homo Sapiens; identical to SEQ ID NO: 92628

SEQ ID NO: 586829 - RNA, 64 nt, Homo Sapiens; identical to SEQ ID NO: 92629

SEQ ID NO: 586830 - RNA, 64 nt, Homo Sapiens; identical to SEQ ID NO: 92630

SEQ ID NO: 586831 - RNA, 64 nt, Homo Sapiens; identical to SEQ ID NO: 92631

SEQ ID NO: 586832 - RNA, 64 nt, Homo Sapiens; identical to SEQ ID NO: 92632

SEQ ID NO: 586833 - RNA, 64 nt, Homo Sapiens; identical to SEQ ID NO: 92633

SEQ ID NO: 586834 - RNA, 64 nt, Homo Sapiens; identical to SEQ ID NO: 92634

SEQ ID NO: 586835 - RNA, 64 nt, Homo Sapiens; identical to SEQ ID NO: 92635

SEQ ID NO: 586836 - RNA, 64 nt, Homo Sapiens; identical to SEQ ID NO: 92636

SEQ ID NO: 586837 - RNA, 64 nt, Homo Sapiens; identical to SEQ ID NO: 92637

SEQ ID NO: 586838 - RNA, 64 nt, Homo Sapiens; identical to SEQ ID NO: 92638

SEQ ID NO: 586839 - RNA, 64 nt, Homo Sapiens; identical to SEQ ID NO: 92639

SEQ ID NO: 586840 - RNA, 64 nt, Homo Sapiens; identical to SEQ ID NO: 92640

SEQ ID NO: 586841 - RNA, 64 nt, Homo Sapiens; identical to SEQ ID NO: 92641

SEQ ID NO: 586842 - RNA, 64 nt, Homo Sapiens; identical to SEQ ID NO: 92642

SEQ ID NO: 586843 - RNA, 64 nt, Homo Sapiens; identical to SEQ ID NO: 92643

SEQ ID NO: 586844 - RNA, 64 nt, Homo Sapiens; identical to SEQ ID NO: 92644

SEQ ID NO: 586845 - RNA, 64 nt, Homo Sapiens; identical to SEQ ID NO: 92645

SEQ ID NO: 586846 - RNA, 64 nt, Homo Sapiens; identical to SEQ ID NO: 92646

SEQ ID NO: 586847 - RNA, 64 nt, Homo Sapiens; identical to SEQ ID NO: 92647

SEQ ID NO: 586848 - RNA, 64 nt, Homo Sapiens; identical to SEQ ID NO: 92648

SEQ ID NO: 586849 - RNA, 64 nt, Homo Sapiens; identical to SEQ ID NO: 92649

SEQ ID NO: 586850 - RNA, 64 nt, Homo Sapiens; identical to SEQ ID NO: 92650

SEQ ID NO: 586851 - RNA, 64 nt, Homo Sapiens; identical to SEQ ID NO: 92651

SEQ ID NO: 586852 - RNA, 64 nt, Homo Sapiens; identical to SEQ ID NO: 92652

SEQ ID NO: 586853 - RNA, 64 nt, Homo Sapiens; identical to SEQ ID NO: 92653

SEQ ID NO: 586854 - RNA, 64 nt, Homo Sapiens; identical to SEQ ID NO: 92654

SEQ ID NO: 586855 - RNA, 64 nt, Homo Sapiens; identical to SEQ ID NO: 92655

SEQ ID NO: 586856 - RNA, 64 nt, Homo Sapiens; identical to SEQ ID NO: 92656

SEQ ID NO: 586857 - RNA, 64 nt, Homo Sapiens; identical to SEQ ID NO: 92657

SEQ ID NO: 586858 - RNA, 64 nt, Homo Sapiens; identical to SEQ ID NO: 92658

SEQ ID NO: 586859 - RNA, 64 nt, Homo Sapiens; identical to SEQ ID NO: 92659

SEQ ID NO: 586860 - RNA, 64 nt, Homo Sapiens; identical to SEQ ID NO: 92660

SEQ ID NO: 586861 - RNA, 64 nt, Homo Sapiens; identical to SEQ ID NO: 92661

SEQ ID NO: 586862 - RNA, 64 nt, Homo Sapiens; identical to SEQ ID NO: 92662

SEQ ID NO: 586863 - RNA, 64 nt, Homo Sapiens; identical to SEQ ID NO: 92663

SEQ ID NO: 586864 - RNA, 64 nt, Homo Sapiens; identical to SEQ ID NO: 92664

SEQ ID NO: 586865 - RNA, 64 nt, Homo Sapiens; identical to SEQ ID NO: 92665

SEQ ID NO: 586866 - RNA, 64 nt, Homo Sapiens; identical to SEQ ID NO: 92666

SEQ ID NO: 586867 - RNA, 64 nt, Homo Sapiens; identical to SEQ ID NO: 92667

SEQ ID NO: 586868 - RNA, 64 nt, Homo Sapiens; identical to SEQ ID NO: 92668

SEQ ID NO: 586869 - RNA, 64 nt, Homo Sapiens; identical to SEQ ID NO: 92669

SEQ ID NO: 586870 - RNA, 64 nt, Homo Sapiens; identical to SEQ ID NO: 92670

SEQ ID NO: 586871 - RNA, 64 nt, Homo Sapiens; identical to SEQ ID NO: 92671

SEQ ID NO: 586872 - RNA, 64 nt, Homo Sapiens; identical to SEQ ID NO: 92672

SEQ ID NO: 586873 - RNA, 64 nt, Homo Sapiens; identical to SEQ ID NO: 92673

SEQ ID NO: 586874 - RNA, 64 nt, Homo Sapiens; identical to SEQ ID NO: 92674

SEQ ID NO: 586875 - RNA, 64 nt, Homo Sapiens; identical to SEQ ID NO: 92675

SEQ ID NO: 586876 - RNA, 64 nt, Homo Sapiens; identical to SEQ ID NO: 92676

SEQ ID NO: 586877 - RNA, 64 nt, Homo Sapiens; identical to SEQ ID NO: 92677

SEQ ID NO: 586878 - RNA, 64 nt, Homo Sapiens; identical to SEQ ID NO: 92678

SEQ ID NO: 586879 - RNA, 64 nt, Homo Sapiens; identical to SEQ ID NO: 92679

SEQ ID NO: 586880 - RNA, 64 nt, Homo Sapiens; identical to SEQ ID NO: 92680

SEQ ID NO: 586881 - RNA, 64 nt, Homo Sapiens; identical to SEQ ID NO: 92681

SEQ ID NO: 586882 - RNA, 64 nt, Homo Sapiens; identical to SEQ ID NO: 92682

SEQ ID NO: 586883 - RNA, 64 nt, Homo Sapiens; identical to SEQ ID NO: 92683

SEQ ID NO: 586884 - RNA, 64 nt, Homo Sapiens; identical to SEQ ID NO: 92684

SEQ ID NO: 586885 - RNA, 64 nt, Homo Sapiens; identical to SEQ ID NO: 92685

SEQ ID NO: 586886 - RNA, 64 nt, Homo Sapiens; identical to SEQ ID NO: 92686

SEQ ID NO: 586887 - RNA, 64 nt, Homo Sapiens; identical to SEQ ID NO: 92687

SEQ ID NO: 586888 - RNA, 64 nt, Homo Sapiens; identical to SEQ ID NO: 92688

SEQ ID NO: 586889 - RNA, 62 nt, Homo Sapiens; identical to SEQ ID NO: 92689

SEQ ID NO: 586890 - RNA, 64 nt, Homo Sapiens; identical to SEQ ID NO: 92690

SEQ ID NO: 586891 - RNA, 64 nt, Homo Sapiens; identical to SEQ ID NO: 92691

SEQ ID NO: 586892 - RNA, 64 nt, Homo Sapiens; identical to SEQ ID NO: 92692

SEQ ID NO: 586893 - RNA, 64 nt, Homo Sapiens; identical to SEQ ID NO: 92693

SEQ ID NO: 586894 - RNA, 64 nt, Homo Sapiens; identical to SEQ ID NO: 92694

SEQ ID NO: 586895 - RNA, 64 nt, Homo Sapiens; identical to SEQ ID NO: 92695

SEQ ID NO: 586896 - RNA, 64 nt, Homo Sapiens; identical to SEQ ID NO: 92696

SEQ ID NO: 586897 - RNA, 64 nt, Homo Sapiens; identical to SEQ ID NO: 92697

SEQ ID NO: 586898 - RNA, 64 nt, Homo Sapiens; identical to SEQ ID NO: 92698

SEQ ID NO: 586899 - RNA, 64 nt, Homo Sapiens; identical to SEQ ID NO: 92699

SEQ ID NO: 586900 - RNA, 64 nt, Homo Sapiens; identical to SEQ ID NO: 92700

SEQ ID NO: 586901 - RNA, 64 nt, Homo Sapiens; identical to SEQ ID NO: 92701

SEQ ID NO: 586902 - RNA, 64 nt, Homo Sapiens; identical to SEQ ID NO: 92702

SEQ ID NO: 586903 - RNA, 64 nt, Homo Sapiens; identical to SEQ ID NO: 92703

SEQ ID NO: 586904 - RNA, 64 nt, Homo Sapiens; identical to SEQ ID NO: 92704

SEQ ID NO: 586905 - RNA, 64 nt, Homo Sapiens; identical to SEQ ID NO: 92705

SEQ ID NO: 586906 - RNA, 64 nt, Homo Sapiens; identical to SEQ ID NO: 92706

SEQ ID NO: 586907 - RNA, 64 nt, Homo Sapiens; identical to SEQ ID NO: 92707

SEQ ID NO: 586908 - RNA, 64 nt, Homo Sapiens; identical to SEQ ID NO: 92708

SEQ ID NO: 586909 - RNA, 64 nt, Homo Sapiens; identical to SEQ ID NO: 92709

SEQ ID NO: 586910 - RNA, 64 nt, Homo Sapiens; identical to SEQ ID NO: 92710

SEQ ID NO: 586911 - RNA, 64 nt, Homo Sapiens; identical to SEQ ID NO: 92711

SEQ ID NO: 586912 - RNA, 64 nt, Homo Sapiens; identical to SEQ ID NO: 92712

SEQ ID NO: 586913 - RNA, 64 nt, Homo Sapiens; identical to SEQ ID NO: 92713

SEQ ID NO: 586914 - RNA, 64 nt, Homo Sapiens; identical to SEQ ID NO: 92714

SEQ ID NO: 586915 - RNA, 64 nt, Homo Sapiens; identical to SEQ ID NO: 92715

SEQ ID NO: 586916 - RNA, 64 nt, Homo Sapiens; identical to SEQ ID NO: 92716

SEQ ID NO: 586917 - RNA, 64 nt, Homo Sapiens; identical to SEQ ID NO: 92717

SEQ ID NO: 586918 - RNA, 64 nt, Homo Sapiens; identical to SEQ ID NO: 92718

SEQ ID NO: 586919 - RNA, 64 nt, Homo Sapiens; identical to SEQ ID NO: 92719

SEQ ID NO: 586920 - RNA, 64 nt, Homo Sapiens; identical to SEQ ID NO: 92720

SEQ ID NO: 586921 - RNA, 64 nt, Homo Sapiens; identical to SEQ ID NO: 92721

SEQ ID NO: 586922 - RNA, 64 nt, Homo Sapiens; identical to SEQ ID NO: 92722

SEQ ID NO: 586923 - RNA, 64 nt, Homo Sapiens; identical to SEQ ID NO: 92723

SEQ ID NO: 586924 - RNA, 64 nt, Homo Sapiens; identical to SEQ ID NO: 92724

SEQ ID NO: 586925 - RNA, 64 nt, Homo Sapiens; identical to SEQ ID NO: 92725

SEQ ID NO: 586926 - RNA, 64 nt, Homo Sapiens; identical to SEQ ID NO: 92726

SEQ ID NO: 586927 - RNA, 64 nt, Homo Sapiens; identical to SEQ ID NO: 92727

SEQ ID NO: 586928 - RNA, 64 nt, Homo Sapiens; identical to SEQ ID NO: 92728

SEQ ID NO: 586929 - RNA, 64 nt, Homo Sapiens; identical to SEQ ID NO: 92729

SEQ ID NO: 586930 - RNA, 64 nt, Homo Sapiens; identical to SEQ ID NO: 92730

SEQ ID NO: 586931 - RNA, 64 nt, Homo Sapiens; identical to SEQ ID NO: 92731

SEQ ID NO: 586932 - RNA, 64 nt, Homo Sapiens; identical to SEQ ID NO: 92732

SEQ ID NO: 586933 - RNA, 64 nt, Homo Sapiens; identical to SEQ ID NO: 92733

SEQ ID NO: 586934 - RNA, 64 nt, Homo Sapiens; identical to SEQ ID NO: 92734

SEQ ID NO: 586935 - RNA, 64 nt, Homo Sapiens; identical to SEQ ID NO: 92735

SEQ ID NO: 586936 - RNA, 64 nt, Homo Sapiens; identical to SEQ ID NO: 92736

SEQ ID NO: 586937 - RNA, 64 nt, Homo Sapiens; identical to SEQ ID NO: 92737

SEQ ID NO: 586938 - RNA, 64 nt, Homo Sapiens; identical to SEQ ID NO: 92738

SEQ ID NO: 586939 - RNA, 64 nt, Homo Sapiens; identical to SEQ ID NO: 92739

SEQ ID NO: 586940 - RNA, 64 nt, Homo Sapiens; identical to SEQ ID NO: 92740

SEQ ID NO: 586941 - RNA, 64 nt, Homo Sapiens; identical to SEQ ID NO: 92741

SEQ ID NO: 586942 - RNA, 64 nt, Homo Sapiens; identical to SEQ ID NO: 92742

SEQ ID NO: 586943 - RNA, 64 nt, Homo Sapiens; identical to SEQ ID NO: 92743

SEQ ID NO: 586944 - RNA, 64 nt, Homo Sapiens; identical to SEQ ID NO: 92744

SEQ ID NO: 586945 - RNA, 64 nt, Homo Sapiens; identical to SEQ ID NO: 92745

SEQ ID NO: 586946 - RNA, 64 nt, Homo Sapiens; identical to SEQ ID NO: 92746

SEQ ID NO: 586947 - RNA, 64 nt, Homo Sapiens; identical to SEQ ID NO: 92747

SEQ ID NO: 586948 - RNA, 64 nt, Homo Sapiens; identical to SEQ ID NO: 92748

SEQ ID NO: 586949 - RNA, 64 nt, Homo Sapiens; identical to SEQ ID NO: 92749

SEQ ID NO: 586950 - RNA, 64 nt, Homo Sapiens; identical to SEQ ID NO: 92750

SEQ ID NO: 586951 - RNA, 64 nt, Homo Sapiens; identical to SEQ ID NO: 92751

SEQ ID NO: 586952 - RNA, 64 nt, Homo Sapiens; identical to SEQ ID NO: 92752

SEQ ID NO: 586953 - RNA, 64 nt, Homo Sapiens; identical to SEQ ID NO: 92753

SEQ ID NO: 586954 - RNA, 64 nt, Homo Sapiens; identical to SEQ ID NO: 92754

SEQ ID NO: 586955 - RNA, 64 nt, Homo Sapiens; identical to SEQ ID NO: 92755

SEQ ID NO: 586956 - RNA, 64 nt, Homo Sapiens; identical to SEQ ID NO: 92756

SEQ ID NO: 586957 - RNA, 64 nt, Homo Sapiens; identical to SEQ ID NO: 92757

SEQ ID NO: 586958 - RNA, 64 nt, Homo Sapiens; identical to SEQ ID NO: 92758

SEQ ID NO: 586959 - RNA, 64 nt, Homo Sapiens; identical to SEQ ID NO: 92759

SEQ ID NO: 586960 - RNA, 64 nt, Homo Sapiens; identical to SEQ ID NO: 92760

SEQ ID NO: 586961 - RNA, 64 nt, Homo Sapiens; identical to SEQ ID NO: 92761

SEQ ID NO: 586962 - RNA, 64 nt, Homo Sapiens; identical to SEQ ID NO: 92762

SEQ ID NO: 586963 - RNA, 64 nt, Homo Sapiens; identical to SEQ ID NO: 92763

SEQ ID NO: 586964 - RNA, 64 nt, Homo Sapiens; identical to SEQ ID NO: 92764

SEQ ID NO: 586965 - RNA, 64 nt, Homo Sapiens; identical to SEQ ID NO: 92765

SEQ ID NO: 586966 - RNA, 64 nt, Homo Sapiens; identical to SEQ ID NO: 92766

SEQ ID NO: 586967 - RNA, 64 nt, Homo Sapiens; identical to SEQ ID NO: 92767

SEQ ID NO: 586968 - RNA, 64 nt, Homo Sapiens; identical to SEQ ID NO: 92768

SEQ ID NO: 586969 - RNA, 64 nt, Homo Sapiens; identical to SEQ ID NO: 92769

SEQ ID NO: 586970 - RNA, 64 nt, Homo Sapiens; identical to SEQ ID NO: 92770

SEQ ID NO: 586971 - RNA, 64 nt, Homo Sapiens; identical to SEQ ID NO: 92771

SEQ ID NO: 586972 - RNA, 64 nt, Homo Sapiens; identical to SEQ ID NO: 92772

SEQ ID NO: 586973 - RNA, 64 nt, Homo Sapiens; identical to SEQ ID NO: 92773

SEQ ID NO: 586974 - RNA, 64 nt, Homo Sapiens; identical to SEQ ID NO: 92774

SEQ ID NO: 586975 - RNA, 64 nt, Homo Sapiens; identical to SEQ ID NO: 92775

SEQ ID NO: 586976 - RNA, 64 nt, Homo Sapiens; identical to SEQ ID NO: 92776

SEQ ID NO: 586977 - RNA, 64 nt, Homo Sapiens; identical to SEQ ID NO: 92777

SEQ ID NO: 586978 - RNA, 64 nt, Homo Sapiens; identical to SEQ ID NO: 92778

SEQ ID NO: 586979 - RNA, 64 nt, Homo Sapiens; identical to SEQ ID NO: 92779

SEQ ID NO: 586980 - RNA, 64 nt, Homo Sapiens; identical to SEQ ID NO: 92780

SEQ ID NO: 586981 - RNA, 64 nt, Homo Sapiens; identical to SEQ ID NO: 92781

SEQ ID NO: 586982 - RNA, 64 nt, Homo Sapiens; identical to SEQ ID NO: 92782

SEQ ID NO: 586983 - RNA, 64 nt, Homo Sapiens; identical to SEQ ID NO: 92783

SEQ ID NO: 586984 - RNA, 64 nt, Homo Sapiens; identical to SEQ ID NO: 92784

SEQ ID NO: 586985 - RNA, 64 nt, Homo Sapiens; identical to SEQ ID NO: 92785

SEQ ID NO: 586986 - RNA, 64 nt, Homo Sapiens; identical to SEQ ID NO: 92786

SEQ ID NO: 586987 - RNA, 64 nt, Homo Sapiens; identical to SEQ ID NO: 92787

SEQ ID NO: 586988 - RNA, 64 nt, Homo Sapiens; identical to SEQ ID NO: 92788

SEQ ID NO: 586989 - RNA, 64 nt, Homo Sapiens; identical to SEQ ID NO: 92789

SEQ ID NO: 586990 - RNA, 64 nt, Homo Sapiens; identical to SEQ ID NO: 92790

SEQ ID NO: 586991 - RNA, 64 nt, Homo Sapiens; identical to SEQ ID NO: 92791

SEQ ID NO: 586992 - RNA, 64 nt, Homo Sapiens; identical to SEQ ID NO: 92792

SEQ ID NO: 586993 - RNA, 64 nt, Homo Sapiens; identical to SEQ ID NO: 92793

SEQ ID NO: 586994 - RNA, 64 nt, Homo Sapiens; identical to SEQ ID NO: 92794

SEQ ID NO: 586995 - RNA, 64 nt, Homo Sapiens; identical to SEQ ID NO: 92795

SEQ ID NO: 586996 - RNA, 64 nt, Homo Sapiens; identical to SEQ ID NO: 92796

SEQ ID NO: 586997 - RNA, 64 nt, Homo Sapiens; identical to SEQ ID NO: 92797

SEQ ID NO: 586998 - RNA, 64 nt, Homo Sapiens; identical to SEQ ID NO: 92798

SEQ ID NO: 586999 - RNA, 64 nt, Homo Sapiens; identical to SEQ ID NO: 92799

SEQ ID NO: 587000 - RNA, 64 nt, Homo Sapiens; identical to SEQ ID NO: 92800

SEQ ID NO: 587001 - RNA, 64 nt, Homo Sapiens; identical to SEQ ID NO: 92801

SEQ ID NO: 587002 - RNA, 64 nt, Homo Sapiens; identical to SEQ ID NO: 92802

SEQ ID NO: 587003 - RNA, 64 nt, Homo Sapiens; identical to SEQ ID NO: 92803

SEQ ID NO: 587004 - RNA, 64 nt, Homo Sapiens; identical to SEQ ID NO: 92804

SEQ ID NO: 587005 - RNA, 64 nt, Homo Sapiens; identical to SEQ ID NO: 92805

SEQ ID NO: 587006 - RNA, 64 nt, Homo Sapiens; identical to SEQ ID NO: 92806

SEQ ID NO: 587007 - RNA, 64 nt, Homo Sapiens; identical to SEQ ID NO: 92807

SEQ ID NO: 587008 - RNA, 64 nt, Homo Sapiens; identical to SEQ ID NO: 92808

SEQ ID NO: 587009 - RNA, 64 nt, Homo Sapiens; identical to SEQ ID NO: 92809

SEQ ID NO: 587010 - RNA, 64 nt, Homo Sapiens; identical to SEQ ID NO: 92810

SEQ ID NO: 587011 - RNA, 64 nt, Homo Sapiens; identical to SEQ ID NO: 92811

SEQ ID NO: 587012 - RNA, 64 nt, Homo Sapiens; identical to SEQ ID NO: 92812

SEQ ID NO: 587013 - RNA, 64 nt, Homo Sapiens; identical to SEQ ID NO: 92813

SEQ ID NO: 587014 - RNA, 64 nt, Homo Sapiens; identical to SEQ ID NO: 92814

SEQ ID NO: 587015 - RNA, 64 nt, Homo Sapiens; identical to SEQ ID NO: 92815

SEQ ID NO: 587016 - RNA, 64 nt, Homo Sapiens; identical to SEQ ID NO: 92816

SEQ ID NO: 587017 - RNA, 64 nt, Homo Sapiens; identical to SEQ ID NO: 92817

SEQ ID NO: 587018 - RNA, 64 nt, Homo Sapiens; identical to SEQ ID NO: 92818

SEQ ID NO: 587019 - RNA, 64 nt, Homo Sapiens; identical to SEQ ID NO: 92819

SEQ ID NO: 587020 - RNA, 64 nt, Homo Sapiens; identical to SEQ ID NO: 92820

SEQ ID NO: 587021 - RNA, 64 nt, Homo Sapiens; identical to SEQ ID NO: 92821

SEQ ID NO: 587022 - RNA, 64 nt, Homo Sapiens; identical to SEQ ID NO: 92822

SEQ ID NO: 587023 - RNA, 64 nt, Homo Sapiens; identical to SEQ ID NO: 92823

SEQ ID NO: 587024 - RNA, 64 nt, Homo Sapiens; identical to SEQ ID NO: 92824

SEQ ID NO: 587025 - RNA, 64 nt, Homo Sapiens; identical to SEQ ID NO: 92825

SEQ ID NO: 587026 - RNA, 64 nt, Homo Sapiens; identical to SEQ ID NO: 92826

SEQ ID NO: 587027 - RNA, 64 nt, Homo Sapiens; identical to SEQ ID NO: 92827

SEQ ID NO: 587028 - RNA, 64 nt, Homo Sapiens; identical to SEQ ID NO: 92828

SEQ ID NO: 587029 - RNA, 64 nt, Homo Sapiens; identical to SEQ ID NO: 92829

SEQ ID NO: 587030 - RNA, 64 nt, Homo Sapiens; identical to SEQ ID NO: 92830

SEQ ID NO: 587031 - RNA, 64 nt, Homo Sapiens; identical to SEQ ID NO: 92831

SEQ ID NO: 587032 - RNA, 64 nt, Homo Sapiens; identical to SEQ ID NO: 92832

SEQ ID NO: 587033 - RNA, 64 nt, Homo Sapiens; identical to SEQ ID NO: 92833

SEQ ID NO: 587034 - RNA, 64 nt, Homo Sapiens; identical to SEQ ID NO: 92834

SEQ ID NO: 587035 - RNA, 64 nt, Homo Sapiens; identical to SEQ ID NO: 92835

SEQ ID NO: 587036 - RNA, 64 nt, Homo Sapiens; identical to SEQ ID NO: 92836

SEQ ID NO: 587037 - RNA, 64 nt, Homo Sapiens; identical to SEQ ID NO: 92837

SEQ ID NO: 587038 - RNA, 64 nt, Homo Sapiens; identical to SEQ ID NO: 92838

SEQ ID NO: 587039 - RNA, 64 nt, Homo Sapiens; identical to SEQ ID NO: 92839

SEQ ID NO: 587040 - RNA, 64 nt, Homo Sapiens; identical to SEQ ID NO: 92840

SEQ ID NO: 587041 - RNA, 64 nt, Homo Sapiens; identical to SEQ ID NO: 92841

SEQ ID NO: 587042 - RNA, 64 nt, Homo Sapiens; identical to SEQ ID NO: 92842

SEQ ID NO: 587043 - RNA, 64 nt, Homo Sapiens; identical to SEQ ID NO: 92843

SEQ ID NO: 587044 - RNA, 64 nt, Homo Sapiens; identical to SEQ ID NO: 92844

SEQ ID NO: 587045 - RNA, 64 nt, Homo Sapiens; identical to SEQ ID NO: 92845

SEQ ID NO: 587046 - RNA, 64 nt, Homo Sapiens; identical to SEQ ID NO: 92846

SEQ ID NO: 587047 - RNA, 64 nt, Homo Sapiens; identical to SEQ ID NO: 92847

SEQ ID NO: 587048 - RNA, 64 nt, Homo Sapiens; identical to SEQ ID NO: 92848

SEQ ID NO: 587049 - RNA, 64 nt, Homo Sapiens; identical to SEQ ID NO: 92849

SEQ ID NO: 587050 - RNA, 64 nt, Homo Sapiens; identical to SEQ ID NO: 92850

SEQ ID NO: 587051 - RNA, 64 nt, Homo Sapiens; identical to SEQ ID NO: 92851

SEQ ID NO: 587052 - RNA, 64 nt, Homo Sapiens; identical to SEQ ID NO: 92852

SEQ ID NO: 587053 - RNA, 64 nt, Homo Sapiens; identical to SEQ ID NO: 92853

SEQ ID NO: 587054 - RNA, 64 nt, Homo Sapiens; identical to SEQ ID NO: 92854

SEQ ID NO: 587055 - RNA, 64 nt, Homo Sapiens; identical to SEQ ID NO: 92855

SEQ ID NO: 587056 - RNA, 64 nt, Homo Sapiens; identical to SEQ ID NO: 92856

SEQ ID NO: 587057 - RNA, 64 nt, Homo Sapiens; identical to SEQ ID NO: 92857

SEQ ID NO: 587058 - RNA, 64 nt, Homo Sapiens; identical to SEQ ID NO: 92858

SEQ ID NO: 587059 - RNA, 64 nt, Homo Sapiens; identical to SEQ ID NO: 92859

SEQ ID NO: 587060 - RNA, 64 nt, Homo Sapiens; identical to SEQ ID NO: 92860

SEQ ID NO: 587061 - RNA, 64 nt, Homo Sapiens; identical to SEQ ID NO: 92861

SEQ ID NO: 587062 - RNA, 64 nt, Homo Sapiens; identical to SEQ ID NO: 92862

SEQ ID NO: 587063 - RNA, 64 nt, Homo Sapiens; identical to SEQ ID NO: 92863

SEQ ID NO: 587064 - RNA, 64 nt, Homo Sapiens; identical to SEQ ID NO: 92864

SEQ ID NO: 587065 - RNA, 64 nt, Homo Sapiens; identical to SEQ ID NO: 92865

SEQ ID NO: 587066 - RNA, 64 nt, Homo Sapiens; identical to SEQ ID NO: 92866

SEQ ID NO: 587067 - RNA, 64 nt, Homo Sapiens; identical to SEQ ID NO: 92867

SEQ ID NO: 587068 - RNA, 64 nt, Homo Sapiens; identical to SEQ ID NO: 92868

SEQ ID NO: 587069 - RNA, 64 nt, Homo Sapiens; identical to SEQ ID NO: 92869

SEQ ID NO: 587070 - RNA, 64 nt, Homo Sapiens; identical to SEQ ID NO: 92870

SEQ ID NO: 587071 - RNA, 64 nt, Homo Sapiens; identical to SEQ ID NO: 92871

SEQ ID NO: 587072 - RNA, 64 nt, Homo Sapiens; identical to SEQ ID NO: 92872

SEQ ID NO: 587073 - RNA, 64 nt, Homo Sapiens; identical to SEQ ID NO: 92873

SEQ ID NO: 587074 - RNA, 64 nt, Homo Sapiens; identical to SEQ ID NO: 92874

SEQ ID NO: 587075 - RNA, 64 nt, Homo Sapiens; identical to SEQ ID NO: 92875

SEQ ID NO: 587076 - RNA, 64 nt, Homo Sapiens; identical to SEQ ID NO: 92876

SEQ ID NO: 587077 - RNA, 64 nt, Homo Sapiens; identical to SEQ ID NO: 92877

SEQ ID NO: 587078 - RNA, 64 nt, Homo Sapiens; identical to SEQ ID NO: 92878

SEQ ID NO: 587079 - RNA, 64 nt, Homo Sapiens; identical to SEQ ID NO: 92879

SEQ ID NO: 587080 - RNA, 64 nt, Homo Sapiens; identical to SEQ ID NO: 92880

SEQ ID NO: 587081 - RNA, 64 nt, Homo Sapiens; identical to SEQ ID NO: 92881

SEQ ID NO: 587082 - RNA, 64 nt, Homo Sapiens; identical to SEQ ID NO: 92882

SEQ ID NO: 587083 - RNA, 64 nt, Homo Sapiens; identical to SEQ ID NO: 92883

SEQ ID NO: 587084 - RNA, 64 nt, Homo Sapiens; identical to SEQ ID NO: 92884

SEQ ID NO: 587085 - RNA, 64 nt, Homo Sapiens; identical to SEQ ID NO: 92885

SEQ ID NO: 587086 - RNA, 64 nt, Homo Sapiens; identical to SEQ ID NO: 92886

SEQ ID NO: 587087 - RNA, 64 nt, Homo Sapiens; identical to SEQ ID NO: 92887

SEQ ID NO: 587088 - RNA, 64 nt, Homo Sapiens; identical to SEQ ID NO: 92888

SEQ ID NO: 587089 - RNA, 64 nt, Homo Sapiens; identical to SEQ ID NO: 92889

SEQ ID NO: 587090 - RNA, 64 nt, Homo Sapiens; identical to SEQ ID NO: 92890

SEQ ID NO: 587091 - RNA, 64 nt, Homo Sapiens; identical to SEQ ID NO: 92891

SEQ ID NO: 587092 - RNA, 64 nt, Homo Sapiens; identical to SEQ ID NO: 92892

SEQ ID NO: 587093 - RNA, 64 nt, Homo Sapiens; identical to SEQ ID NO: 92893

SEQ ID NO: 587094 - RNA, 64 nt, Homo Sapiens; identical to SEQ ID NO: 92894

SEQ ID NO: 587095 - RNA, 64 nt, Homo Sapiens; identical to SEQ ID NO: 92895

SEQ ID NO: 587096 - RNA, 64 nt, Homo Sapiens; identical to SEQ ID NO: 92896

SEQ ID NO: 587097 - RNA, 64 nt, Homo Sapiens; identical to SEQ ID NO: 92897

SEQ ID NO: 587098 - RNA, 64 nt, Homo Sapiens; identical to SEQ ID NO: 92898

SEQ ID NO: 587099 - RNA, 64 nt, Homo Sapiens; identical to SEQ ID NO: 92899

SEQ ID NO: 587100 - RNA, 64 nt, Homo Sapiens; identical to SEQ ID NO: 92900

SEQ ID NO: 587101 - RNA, 64 nt, Homo Sapiens; identical to SEQ ID NO: 92901

SEQ ID NO: 587102 - RNA, 64 nt, Homo Sapiens; identical to SEQ ID NO: 92902

SEQ ID NO: 587103 - RNA, 64 nt, Homo Sapiens; identical to SEQ ID NO: 92903

SEQ ID NO: 587104 - RNA, 64 nt, Homo Sapiens; identical to SEQ ID NO: 92904

SEQ ID NO: 587105 - RNA, 64 nt, Homo Sapiens; identical to SEQ ID NO: 92905

SEQ ID NO: 587106 - RNA, 64 nt, Homo Sapiens; identical to SEQ ID NO: 92906

SEQ ID NO: 587107 - RNA, 64 nt, Homo Sapiens; identical to SEQ ID NO: 92907

SEQ ID NO: 587108 - RNA, 64 nt, Homo Sapiens; identical to SEQ ID NO: 92908

SEQ ID NO: 587109 - RNA, 64 nt, Homo Sapiens; identical to SEQ ID NO: 92909

SEQ ID NO: 587110 - RNA, 64 nt, Homo Sapiens; identical to SEQ ID NO: 92910

SEQ ID NO: 587111 - RNA, 64 nt, Homo Sapiens; identical to SEQ ID NO: 92911

SEQ ID NO: 587112 - RNA, 64 nt, Homo Sapiens; identical to SEQ ID NO: 92912

SEQ ID NO: 587113 - RNA, 64 nt, Homo Sapiens; identical to SEQ ID NO: 92913

SEQ ID NO: 587114 - RNA, 64 nt, Homo Sapiens; identical to SEQ ID NO: 92914

SEQ ID NO: 587115 - RNA, 64 nt, Homo Sapiens; identical to SEQ ID NO: 92915

SEQ ID NO: 587116 - RNA, 64 nt, Homo Sapiens; identical to SEQ ID NO: 92916

SEQ ID NO: 587117 - RNA, 64 nt, Homo Sapiens; identical to SEQ ID NO: 92917

SEQ ID NO: 587118 - RNA, 64 nt, Homo Sapiens; identical to SEQ ID NO: 92918

SEQ ID NO: 587119 - RNA, 64 nt, Homo Sapiens; identical to SEQ ID NO: 92919

SEQ ID NO: 587120 - RNA, 64 nt, Homo Sapiens; identical to SEQ ID NO: 92920

SEQ ID NO: 587121 - RNA, 64 nt, Homo Sapiens; identical to SEQ ID NO: 92921

SEQ ID NO: 587122 - RNA, 64 nt, Homo Sapiens; identical to SEQ ID NO: 92922

SEQ ID NO: 587123 - RNA, 64 nt, Homo Sapiens; identical to SEQ ID NO: 92923

SEQ ID NO: 587124 - RNA, 64 nt, Homo Sapiens; identical to SEQ ID NO: 92924

SEQ ID NO: 587125 - RNA, 64 nt, Homo Sapiens; identical to SEQ ID NO: 92925

SEQ ID NO: 587126 - RNA, 64 nt, Homo Sapiens; identical to SEQ ID NO: 92926

SEQ ID NO: 587127 - RNA, 64 nt, Homo Sapiens; identical to SEQ ID NO: 92927

SEQ ID NO: 587128 - RNA, 64 nt, Homo Sapiens; identical to SEQ ID NO: 92928

SEQ ID NO: 587129 - RNA, 64 nt, Homo Sapiens; identical to SEQ ID NO: 92929

SEQ ID NO: 587130 - RNA, 64 nt, Homo Sapiens; identical to SEQ ID NO: 92930

SEQ ID NO: 587131 - RNA, 64 nt, Homo Sapiens; identical to SEQ ID NO: 92931

SEQ ID NO: 587132 - RNA, 64 nt, Homo Sapiens; identical to SEQ ID NO: 92932

SEQ ID NO: 587133 - RNA, 64 nt, Homo Sapiens; identical to SEQ ID NO: 92933

SEQ ID NO: 587134 - RNA, 64 nt, Homo Sapiens; identical to SEQ ID NO: 92934

SEQ ID NO: 587135 - RNA, 64 nt, Homo Sapiens; identical to SEQ ID NO: 92935

SEQ ID NO: 587136 - RNA, 64 nt, Homo Sapiens; identical to SEQ ID NO: 92936

SEQ ID NO: 587137 - RNA, 64 nt, Homo Sapiens; identical to SEQ ID NO: 92937

SEQ ID NO: 587138 - RNA, 64 nt, Homo Sapiens; identical to SEQ ID NO: 92938

SEQ ID NO: 587139 - RNA, 64 nt, Homo Sapiens; identical to SEQ ID NO: 92939

SEQ ID NO: 587140 - RNA, 64 nt, Homo Sapiens; identical to SEQ ID NO: 92940

SEQ ID NO: 587141 - RNA, 64 nt, Homo Sapiens; identical to SEQ ID NO: 92941

SEQ ID NO: 587142 - RNA, 64 nt, Homo Sapiens; identical to SEQ ID NO: 92942

SEQ ID NO: 587143 - RNA, 64 nt, Homo Sapiens; identical to SEQ ID NO: 92943

SEQ ID NO: 587144 - RNA, 64 nt, Homo Sapiens; identical to SEQ ID NO: 92944

SEQ ID NO: 587145 - RNA, 62 nt, Homo Sapiens; identical to SEQ ID NO: 92945

SEQ ID NO: 587146 - RNA, 64 nt, Homo Sapiens; identical to SEQ ID NO: 92946

SEQ ID NO: 587147 - RNA, 64 nt, Homo Sapiens; identical to SEQ ID NO: 92947

SEQ ID NO: 587148 - RNA, 64 nt, Homo Sapiens; identical to SEQ ID NO: 92948

SEQ ID NO: 587149 - RNA, 64 nt, Homo Sapiens; identical to SEQ ID NO: 92949

SEQ ID NO: 587150 - RNA, 64 nt, Homo Sapiens; identical to SEQ ID NO: 92950

SEQ ID NO: 587151 - RNA, 64 nt, Homo Sapiens; identical to SEQ ID NO: 92951

SEQ ID NO: 587152 - RNA, 64 nt, Homo Sapiens; identical to SEQ ID NO: 92952

SEQ ID NO: 587153 - RNA, 64 nt, Homo Sapiens; identical to SEQ ID NO: 92953

SEQ ID NO: 587154 - RNA, 64 nt, Homo Sapiens; identical to SEQ ID NO: 92954

SEQ ID NO: 587155 - RNA, 64 nt, Homo Sapiens; identical to SEQ ID NO: 92955

SEQ ID NO: 587156 - RNA, 64 nt, Homo Sapiens; identical to SEQ ID NO: 92956

SEQ ID NO: 587157 - RNA, 64 nt, Homo Sapiens; identical to SEQ ID NO: 92957

SEQ ID NO: 587158 - RNA, 64 nt, Homo Sapiens; identical to SEQ ID NO: 92958

SEQ ID NO: 587159 - RNA, 64 nt, Homo Sapiens; identical to SEQ ID NO: 92959

SEQ ID NO: 587160 - RNA, 64 nt, Homo Sapiens; identical to SEQ ID NO: 92960

SEQ ID NO: 587161 - RNA, 64 nt, Homo Sapiens; identical to SEQ ID NO: 92961

SEQ ID NO: 587162 - RNA, 64 nt, Homo Sapiens; identical to SEQ ID NO: 92962

SEQ ID NO: 587163 - RNA, 64 nt, Homo Sapiens; identical to SEQ ID NO: 92963

SEQ ID NO: 587164 - RNA, 64 nt, Homo Sapiens; identical to SEQ ID NO: 92964

SEQ ID NO: 587165 - RNA, 64 nt, Homo Sapiens; identical to SEQ ID NO: 92965

SEQ ID NO: 587166 - RNA, 64 nt, Homo Sapiens; identical to SEQ ID NO: 92966

SEQ ID NO: 587167 - RNA, 64 nt, Homo Sapiens; identical to SEQ ID NO: 92967

SEQ ID NO: 587168 - RNA, 64 nt, Homo Sapiens; identical to SEQ ID NO: 92968

SEQ ID NO: 587169 - RNA, 64 nt, Homo Sapiens; identical to SEQ ID NO: 92969

SEQ ID NO: 587170 - RNA, 64 nt, Homo Sapiens; identical to SEQ ID NO: 92970

SEQ ID NO: 587171 - RNA, 64 nt, Homo Sapiens; identical to SEQ ID NO: 92971

SEQ ID NO: 587172 - RNA, 64 nt, Homo Sapiens; identical to SEQ ID NO: 92972

SEQ ID NO: 587173 - RNA, 64 nt, Homo Sapiens; identical to SEQ ID NO: 92973

SEQ ID NO: 587174 - RNA, 64 nt, Homo Sapiens; identical to SEQ ID NO: 92974

SEQ ID NO: 587175 - RNA, 64 nt, Homo Sapiens; identical to SEQ ID NO: 92975

SEQ ID NO: 587176 - RNA, 64 nt, Homo Sapiens; identical to SEQ ID NO: 92976

SEQ ID NO: 587177 - RNA, 64 nt, Homo Sapiens; identical to SEQ ID NO: 92977

SEQ ID NO: 587178 - RNA, 64 nt, Homo Sapiens; identical to SEQ ID NO: 92978

SEQ ID NO: 587179 - RNA, 64 nt, Homo Sapiens; identical to SEQ ID NO: 92979

SEQ ID NO: 587180 - RNA, 64 nt, Homo Sapiens; identical to SEQ ID NO: 92980

SEQ ID NO: 587181 - RNA, 64 nt, Homo Sapiens; identical to SEQ ID NO: 92981

SEQ ID NO: 587182 - RNA, 64 nt, Homo Sapiens; identical to SEQ ID NO: 92982

SEQ ID NO: 587183 - RNA, 64 nt, Homo Sapiens; identical to SEQ ID NO: 92983

SEQ ID NO: 587184 - RNA, 64 nt, Homo Sapiens; identical to SEQ ID NO: 92984

SEQ ID NO: 587185 - RNA, 64 nt, Homo Sapiens; identical to SEQ ID NO: 92985

SEQ ID NO: 587186 - RNA, 64 nt, Homo Sapiens; identical to SEQ ID NO: 92986

SEQ ID NO: 587187 - RNA, 64 nt, Homo Sapiens; identical to SEQ ID NO: 92987

SEQ ID NO: 587188 - RNA, 64 nt, Homo Sapiens; identical to SEQ ID NO: 92988

SEQ ID NO: 587189 - RNA, 64 nt, Homo Sapiens; identical to SEQ ID NO: 92989

SEQ ID NO: 587190 - RNA, 64 nt, Homo Sapiens; identical to SEQ ID NO: 92990

SEQ ID NO: 587191 - RNA, 64 nt, Homo Sapiens; identical to SEQ ID NO: 92991

SEQ ID NO: 587192 - RNA, 64 nt, Homo Sapiens; identical to SEQ ID NO: 92992

SEQ ID NO: 587193 - RNA, 64 nt, Homo Sapiens; identical to SEQ ID NO: 92993

SEQ ID NO: 587194 - RNA, 64 nt, Homo Sapiens; identical to SEQ ID NO: 92994

SEQ ID NO: 587195 - RNA, 64 nt, Homo Sapiens; identical to SEQ ID NO: 92995

SEQ ID NO: 587196 - RNA, 64 nt, Homo Sapiens; identical to SEQ ID NO: 92996

SEQ ID NO: 587197 - RNA, 64 nt, Homo Sapiens; identical to SEQ ID NO: 92997

SEQ ID NO: 587198 - RNA, 64 nt, Homo Sapiens; identical to SEQ ID NO: 92998

SEQ ID NO: 587199 - RNA, 64 nt, Homo Sapiens; identical to SEQ ID NO: 92999

SEQ ID NO: 587200 - RNA, 64 nt, Homo Sapiens; identical to SEQ ID NO: 93000

SEQ ID NO: 587201 - RNA, 64 nt, Homo Sapiens; identical to SEQ ID NO: 93001

SEQ ID NO: 587202 - RNA, 64 nt, Homo Sapiens; identical to SEQ ID NO: 93002

SEQ ID NO: 587203 - RNA, 64 nt, Homo Sapiens; identical to SEQ ID NO: 93003

SEQ ID NO: 587204 - RNA, 64 nt, Homo Sapiens; identical to SEQ ID NO: 93004

SEQ ID NO: 587205 - RNA, 64 nt, Homo Sapiens; identical to SEQ ID NO: 93005

SEQ ID NO: 587206 - RNA, 64 nt, Homo Sapiens; identical to SEQ ID NO: 93006

SEQ ID NO: 587207 - RNA, 64 nt, Homo Sapiens; identical to SEQ ID NO: 93007

SEQ ID NO: 587208 - RNA, 64 nt, Homo Sapiens; identical to SEQ ID NO: 93008

SEQ ID NO: 587209 - RNA, 64 nt, Homo Sapiens; identical to SEQ ID NO: 93009

SEQ ID NO: 587210 - RNA, 64 nt, Homo Sapiens; identical to SEQ ID NO: 93010

SEQ ID NO: 587211 - RNA, 64 nt, Homo Sapiens; identical to SEQ ID NO: 93011

SEQ ID NO: 587212 - RNA, 64 nt, Homo Sapiens; identical to SEQ ID NO: 93012

SEQ ID NO: 587213 - RNA, 64 nt, Homo Sapiens; identical to SEQ ID NO: 93013

SEQ ID NO: 587214 - RNA, 64 nt, Homo Sapiens; identical to SEQ ID NO: 93014

SEQ ID NO: 587215 - RNA, 64 nt, Homo Sapiens; identical to SEQ ID NO: 93015

SEQ ID NO: 587216 - RNA, 64 nt, Homo Sapiens; identical to SEQ ID NO: 93016

SEQ ID NO: 587217 - RNA, 64 nt, Homo Sapiens; identical to SEQ ID NO: 93017

SEQ ID NO: 587218 - RNA, 64 nt, Homo Sapiens; identical to SEQ ID NO: 93018

SEQ ID NO: 587219 - RNA, 64 nt, Homo Sapiens; identical to SEQ ID NO: 93019

SEQ ID NO: 587220 - RNA, 64 nt, Homo Sapiens; identical to SEQ ID NO: 93020

SEQ ID NO: 587221 - RNA, 64 nt, Homo Sapiens; identical to SEQ ID NO: 93021

SEQ ID NO: 587222 - RNA, 64 nt, Homo Sapiens; identical to SEQ ID NO: 93022

SEQ ID NO: 587223 - RNA, 64 nt, Homo Sapiens; identical to SEQ ID NO: 93023

SEQ ID NO: 587224 - RNA, 64 nt, Homo Sapiens; identical to SEQ ID NO: 93024

SEQ ID NO: 587225 - RNA, 64 nt, Homo Sapiens; identical to SEQ ID NO: 93025

SEQ ID NO: 587226 - RNA, 64 nt, Homo Sapiens; identical to SEQ ID NO: 93026

SEQ ID NO: 587227 - RNA, 64 nt, Homo Sapiens; identical to SEQ ID NO: 93027

SEQ ID NO: 587228 - RNA, 64 nt, Homo Sapiens; identical to SEQ ID NO: 93028

SEQ ID NO: 587229 - RNA, 64 nt, Homo Sapiens; identical to SEQ ID NO: 93029

SEQ ID NO: 587230 - RNA, 64 nt, Homo Sapiens; identical to SEQ ID NO: 93030

SEQ ID NO: 587231 - RNA, 64 nt, Homo Sapiens; identical to SEQ ID NO: 93031

SEQ ID NO: 587232 - RNA, 64 nt, Homo Sapiens; identical to SEQ ID NO: 93032

SEQ ID NO: 587233 - RNA, 64 nt, Homo Sapiens; identical to SEQ ID NO: 93033

SEQ ID NO: 587234 - RNA, 64 nt, Homo Sapiens; identical to SEQ ID NO: 93034

SEQ ID NO: 587235 - RNA, 64 nt, Homo Sapiens; identical to SEQ ID NO: 93035

SEQ ID NO: 587236 - RNA, 64 nt, Homo Sapiens; identical to SEQ ID NO: 93036

SEQ ID NO: 587237 - RNA, 64 nt, Homo Sapiens; identical to SEQ ID NO: 93037

SEQ ID NO: 587238 - RNA, 64 nt, Homo Sapiens; identical to SEQ ID NO: 93038

SEQ ID NO: 587239 - RNA, 64 nt, Homo Sapiens; identical to SEQ ID NO: 93039

SEQ ID NO: 587240 - RNA, 64 nt, Homo Sapiens; identical to SEQ ID NO: 93040

SEQ ID NO: 587241 - RNA, 64 nt, Homo Sapiens; identical to SEQ ID NO: 93041

SEQ ID NO: 587242 - RNA, 64 nt, Homo Sapiens; identical to SEQ ID NO: 93042

SEQ ID NO: 587243 - RNA, 64 nt, Homo Sapiens; identical to SEQ ID NO: 93043

SEQ ID NO: 587244 - RNA, 64 nt, Homo Sapiens; identical to SEQ ID NO: 93044

SEQ ID NO: 587245 - RNA, 64 nt, Homo Sapiens; identical to SEQ ID NO: 93045

SEQ ID NO: 587246 - RNA, 64 nt, Homo Sapiens; identical to SEQ ID NO: 93046

SEQ ID NO: 587247 - RNA, 64 nt, Homo Sapiens; identical to SEQ ID NO: 93047

SEQ ID NO: 587248 - RNA, 64 nt, Homo Sapiens; identical to SEQ ID NO: 93048

SEQ ID NO: 587249 - RNA, 64 nt, Homo Sapiens; identical to SEQ ID NO: 93049

SEQ ID NO: 587250 - RNA, 64 nt, Homo Sapiens; identical to SEQ ID NO: 93050

SEQ ID NO: 587251 - RNA, 64 nt, Homo Sapiens; identical to SEQ ID NO: 93051

SEQ ID NO: 587252 - RNA, 64 nt, Homo Sapiens; identical to SEQ ID NO: 93052

SEQ ID NO: 587253 - RNA, 64 nt, Homo Sapiens; identical to SEQ ID NO: 93053

SEQ ID NO: 587254 - RNA, 64 nt, Homo Sapiens; identical to SEQ ID NO: 93054

SEQ ID NO: 587255 - RNA, 64 nt, Homo Sapiens; identical to SEQ ID NO: 93055

SEQ ID NO: 587256 - RNA, 64 nt, Homo Sapiens; identical to SEQ ID NO: 93056

SEQ ID NO: 587257 - RNA, 64 nt, Homo Sapiens; identical to SEQ ID NO: 93057

SEQ ID NO: 587258 - RNA, 64 nt, Homo Sapiens; identical to SEQ ID NO: 93058

SEQ ID NO: 587259 - RNA, 64 nt, Homo Sapiens; identical to SEQ ID NO: 93059

SEQ ID NO: 587260 - RNA, 64 nt, Homo Sapiens; identical to SEQ ID NO: 93060

SEQ ID NO: 587261 - RNA, 64 nt, Homo Sapiens; identical to SEQ ID NO: 93061

SEQ ID NO: 587262 - RNA, 64 nt, Homo Sapiens; identical to SEQ ID NO: 93062

SEQ ID NO: 587263 - RNA, 64 nt, Homo Sapiens; identical to SEQ ID NO: 93063

SEQ ID NO: 587264 - RNA, 64 nt, Homo Sapiens; identical to SEQ ID NO: 93064

SEQ ID NO: 587265 - RNA, 64 nt, Homo Sapiens; identical to SEQ ID NO: 93065

SEQ ID NO: 587266 - RNA, 64 nt, Homo Sapiens; identical to SEQ ID NO: 93066

SEQ ID NO: 587267 - RNA, 64 nt, Homo Sapiens; identical to SEQ ID NO: 93067

SEQ ID NO: 587268 - RNA, 64 nt, Homo Sapiens; identical to SEQ ID NO: 93068

SEQ ID NO: 587269 - RNA, 64 nt, Homo Sapiens; identical to SEQ ID NO: 93069

SEQ ID NO: 587270 - RNA, 64 nt, Homo Sapiens; identical to SEQ ID NO: 93070

SEQ ID NO: 587271 - RNA, 64 nt, Homo Sapiens; identical to SEQ ID NO: 93071

SEQ ID NO: 587272 - RNA, 64 nt, Homo Sapiens; identical to SEQ ID NO: 93072

SEQ ID NO: 587273 - RNA, 64 nt, Homo Sapiens; identical to SEQ ID NO: 93073

SEQ ID NO: 587274 - RNA, 64 nt, Homo Sapiens; identical to SEQ ID NO: 93074

SEQ ID NO: 587275 - RNA, 64 nt, Homo Sapiens; identical to SEQ ID NO: 93075

SEQ ID NO: 587276 - RNA, 64 nt, Homo Sapiens; identical to SEQ ID NO: 93076

SEQ ID NO: 587277 - RNA, 64 nt, Homo Sapiens; identical to SEQ ID NO: 93077

SEQ ID NO: 587278 - RNA, 64 nt, Homo Sapiens; identical to SEQ ID NO: 93078

SEQ ID NO: 587279 - RNA, 64 nt, Homo Sapiens; identical to SEQ ID NO: 93079

SEQ ID NO: 587280 - RNA, 64 nt, Homo Sapiens; identical to SEQ ID NO: 93080

SEQ ID NO: 587281 - RNA, 64 nt, Homo Sapiens; identical to SEQ ID NO: 93081

SEQ ID NO: 587282 - RNA, 64 nt, Homo Sapiens; identical to SEQ ID NO: 93082

SEQ ID NO: 587283 - RNA, 64 nt, Homo Sapiens; identical to SEQ ID NO: 93083

SEQ ID NO: 587284 - RNA, 64 nt, Homo Sapiens; identical to SEQ ID NO: 93084

SEQ ID NO: 587285 - RNA, 64 nt, Homo Sapiens; identical to SEQ ID NO: 93085

SEQ ID NO: 587286 - RNA, 64 nt, Homo Sapiens; identical to SEQ ID NO: 93086

SEQ ID NO: 587287 - RNA, 64 nt, Homo Sapiens; identical to SEQ ID NO: 93087

SEQ ID NO: 587288 - RNA, 64 nt, Homo Sapiens; identical to SEQ ID NO: 93088

SEQ ID NO: 587289 - RNA, 64 nt, Homo Sapiens; identical to SEQ ID NO: 93089

SEQ ID NO: 587290 - RNA, 64 nt, Homo Sapiens; identical to SEQ ID NO: 93090

SEQ ID NO: 587291 - RNA, 64 nt, Homo Sapiens; identical to SEQ ID NO: 93091

SEQ ID NO: 587292 - RNA, 64 nt, Homo Sapiens; identical to SEQ ID NO: 93092

SEQ ID NO: 587293 - RNA, 64 nt, Homo Sapiens; identical to SEQ ID NO: 93093

SEQ ID NO: 587294 - RNA, 64 nt, Homo Sapiens; identical to SEQ ID NO: 93094

SEQ ID NO: 587295 - RNA, 64 nt, Homo Sapiens; identical to SEQ ID NO: 93095

SEQ ID NO: 587296 - RNA, 64 nt, Homo Sapiens; identical to SEQ ID NO: 93096

SEQ ID NO: 587297 - RNA, 64 nt, Homo Sapiens; identical to SEQ ID NO: 93097

SEQ ID NO: 587298 - RNA, 64 nt, Homo Sapiens; identical to SEQ ID NO: 93098

SEQ ID NO: 587299 - RNA, 64 nt, Homo Sapiens; identical to SEQ ID NO: 93099

SEQ ID NO: 587300 - RNA, 64 nt, Homo Sapiens; identical to SEQ ID NO: 93100

SEQ ID NO: 587301 - RNA, 64 nt, Homo Sapiens; identical to SEQ ID NO: 93101

SEQ ID NO: 587302 - RNA, 64 nt, Homo Sapiens; identical to SEQ ID NO: 93102

SEQ ID NO: 587303 - RNA, 64 nt, Homo Sapiens; identical to SEQ ID NO: 93103

SEQ ID NO: 587304 - RNA, 64 nt, Homo Sapiens; identical to SEQ ID NO: 93104

SEQ ID NO: 587305 - RNA, 64 nt, Homo Sapiens; identical to SEQ ID NO: 93105

SEQ ID NO: 587306 - RNA, 64 nt, Homo Sapiens; identical to SEQ ID NO: 93106

SEQ ID NO: 587307 - RNA, 64 nt, Homo Sapiens; identical to SEQ ID NO: 93107

SEQ ID NO: 587308 - RNA, 64 nt, Homo Sapiens; identical to SEQ ID NO: 93108

SEQ ID NO: 587309 - RNA, 64 nt, Homo Sapiens; identical to SEQ ID NO: 93109

SEQ ID NO: 587310 - RNA, 64 nt, Homo Sapiens; identical to SEQ ID NO: 93110

SEQ ID NO: 587311 - RNA, 64 nt, Homo Sapiens; identical to SEQ ID NO: 93111

SEQ ID NO: 587312 - RNA, 64 nt, Homo Sapiens; identical to SEQ ID NO: 93112

SEQ ID NO: 587313 - RNA, 64 nt, Homo Sapiens; identical to SEQ ID NO: 93113

SEQ ID NO: 587314 - RNA, 64 nt, Homo Sapiens; identical to SEQ ID NO: 93114

SEQ ID NO: 587315 - RNA, 64 nt, Homo Sapiens; identical to SEQ ID NO: 93115

SEQ ID NO: 587316 - RNA, 64 nt, Homo Sapiens; identical to SEQ ID NO: 93116

SEQ ID NO: 587317 - RNA, 64 nt, Homo Sapiens; identical to SEQ ID NO: 93117

SEQ ID NO: 587318 - RNA, 64 nt, Homo Sapiens; identical to SEQ ID NO: 93118

SEQ ID NO: 587319 - RNA, 64 nt, Homo Sapiens; identical to SEQ ID NO: 93119

SEQ ID NO: 587320 - RNA, 64 nt, Homo Sapiens; identical to SEQ ID NO: 93120

SEQ ID NO: 587321 - RNA, 64 nt, Homo Sapiens; identical to SEQ ID NO: 93121

SEQ ID NO: 587322 - RNA, 64 nt, Homo Sapiens; identical to SEQ ID NO: 93122

SEQ ID NO: 587323 - RNA, 64 nt, Homo Sapiens; identical to SEQ ID NO: 93123

SEQ ID NO: 587324 - RNA, 64 nt, Homo Sapiens; identical to SEQ ID NO: 93124

SEQ ID NO: 587325 - RNA, 64 nt, Homo Sapiens; identical to SEQ ID NO: 93125

SEQ ID NO: 587326 - RNA, 64 nt, Homo Sapiens; identical to SEQ ID NO: 93126

SEQ ID NO: 587327 - RNA, 64 nt, Homo Sapiens; identical to SEQ ID NO: 93127

SEQ ID NO: 587328 - RNA, 64 nt, Homo Sapiens; identical to SEQ ID NO: 93128

SEQ ID NO: 587329 - RNA, 64 nt, Homo Sapiens; identical to SEQ ID NO: 93129

SEQ ID NO: 587330 - RNA, 64 nt, Homo Sapiens; identical to SEQ ID NO: 93130

SEQ ID NO: 587331 - RNA, 64 nt, Homo Sapiens; identical to SEQ ID NO: 93131

SEQ ID NO: 587332 - RNA, 64 nt, Homo Sapiens; identical to SEQ ID NO: 93132

SEQ ID NO: 587333 - RNA, 64 nt, Homo Sapiens; identical to SEQ ID NO: 93133

SEQ ID NO: 587334 - RNA, 64 nt, Homo Sapiens; identical to SEQ ID NO: 93134

SEQ ID NO: 587335 - RNA, 64 nt, Homo Sapiens; identical to SEQ ID NO: 93135

SEQ ID NO: 587336 - RNA, 64 nt, Homo Sapiens; identical to SEQ ID NO: 93136

SEQ ID NO: 587337 - RNA, 64 nt, Homo Sapiens; identical to SEQ ID NO: 93137

SEQ ID NO: 587338 - RNA, 64 nt, Homo Sapiens; identical to SEQ ID NO: 93138

SEQ ID NO: 587339 - RNA, 64 nt, Homo Sapiens; identical to SEQ ID NO: 93139

SEQ ID NO: 587340 - RNA, 64 nt, Homo Sapiens; identical to SEQ ID NO: 93140

SEQ ID NO: 587341 - RNA, 64 nt, Homo Sapiens; identical to SEQ ID NO: 93141

SEQ ID NO: 587342 - RNA, 64 nt, Homo Sapiens; identical to SEQ ID NO: 93142

SEQ ID NO: 587343 - RNA, 64 nt, Homo Sapiens; identical to SEQ ID NO: 93143

SEQ ID NO: 587344 - RNA, 64 nt, Homo Sapiens; identical to SEQ ID NO: 93144

SEQ ID NO: 587345 - RNA, 64 nt, Homo Sapiens; identical to SEQ ID NO: 93145

SEQ ID NO: 587346 - RNA, 64 nt, Homo Sapiens; identical to SEQ ID NO: 93146

SEQ ID NO: 587347 - RNA, 64 nt, Homo Sapiens; identical to SEQ ID NO: 93147

SEQ ID NO: 587348 - RNA, 64 nt, Homo Sapiens; identical to SEQ ID NO: 93148

SEQ ID NO: 587349 - RNA, 64 nt, Homo Sapiens; identical to SEQ ID NO: 93149

SEQ ID NO: 587350 - RNA, 64 nt, Homo Sapiens; identical to SEQ ID NO: 93150

SEQ ID NO: 587351 - RNA, 64 nt, Homo Sapiens; identical to SEQ ID NO: 93151

SEQ ID NO: 587352 - RNA, 64 nt, Homo Sapiens; identical to SEQ ID NO: 234551

SEQ ID NO: 587353 - RNA, 64 nt, Homo Sapiens; identical to SEQ ID NO: 234551

SEQ ID NO: 587354 - RNA, 65 nt, Homo Sapiens; identical to SEQ ID NO: 489615

SEQ ID NO: 587355 - RNA, 65 nt, Homo Sapiens; identical to SEQ ID NO: 489616

SEQ ID NO: 587356 - RNA, 65 nt, Homo Sapiens; identical to SEQ ID NO: 489617

SEQ ID NO: 587357 - RNA, 65 nt, Homo Sapiens; identical to SEQ ID NO: 489618

SEQ ID NO: 587358 - RNA, 65 nt, Homo Sapiens; identical to SEQ ID NO: 489619

SEQ ID NO: 587359 - RNA, 65 nt, Homo Sapiens; identical to SEQ ID NO: 489625

SEQ ID NO: 587360 - RNA, 65 nt, Homo Sapiens; identical to SEQ ID NO: 489626

SEQ ID NO: 587361 - RNA, 65 nt, Homo Sapiens; identical to SEQ ID NO: 489658

SEQ ID NO: 587362 - RNA, 65 nt, Homo Sapiens; identical to SEQ ID NO: 489659

SEQ ID NO: 587363 - RNA, 65 nt, Homo Sapiens; identical to SEQ ID NO: 489665

SEQ ID NO: 587364 - RNA, 65 nt, Homo Sapiens; identical to SEQ ID NO: 489666

SEQ ID NO: 587365 - RNA, 65 nt, Homo Sapiens; identical to SEQ ID NO: 489682

SEQ ID NO: 587366 - RNA, 65 nt, Homo Sapiens; identical to SEQ ID NO: 489683

SEQ ID NO: 587367 - RNA, 65 nt, Homo Sapiens; identical to SEQ ID NO: 489692

SEQ ID NO: 587368 - RNA, 65 nt, Homo Sapiens; identical to SEQ ID NO: 489693

SEQ ID NO: 587369 - RNA, 65 nt, Homo Sapiens; identical to SEQ ID NO: 489712

SEQ ID NO: 587370 - RNA, 65 nt, Homo Sapiens; identical to SEQ ID NO: 489713

SEQ ID NO: 587371 - RNA, 65 nt, Homo Sapiens; identical to SEQ ID NO: 489714

SEQ ID NO: 587372 - RNA, 65 nt, Homo Sapiens; identical to SEQ ID NO: 489715

SEQ ID NO: 587373 - RNA, 65 nt, Homo Sapiens; identical to SEQ ID NO: 489731

SEQ ID NO: 587374 - RNA, 65 nt, Homo Sapiens; identical to SEQ ID NO: 489732

SEQ ID NO: 587375 - RNA, 65 nt, Homo Sapiens; identical to SEQ ID NO: 489745

SEQ ID NO: 587376 - RNA, 65 nt, Homo Sapiens; identical to SEQ ID NO: 489746

SEQ ID NO: 587377 - RNA, 65 nt, Homo Sapiens; identical to SEQ ID NO: 489754

SEQ ID NO: 587378 - RNA, 65 nt, Homo Sapiens; identical to SEQ ID NO: 489755

SEQ ID NO: 587379 - RNA, 65 nt, Homo Sapiens; identical to SEQ ID NO: 489756

SEQ ID NO: 587380 - RNA, 65 nt, Homo Sapiens; identical to SEQ ID NO: 489760

SEQ ID NO: 587381 - RNA, 65 nt, Homo Sapiens; identical to SEQ ID NO: 489761

SEQ ID NO: 587382 - RNA, 65 nt, Homo Sapiens; identical to SEQ ID NO: 489762

SEQ ID NO: 587383 - RNA, 65 nt, Homo Sapiens; identical to SEQ ID NO: 489777

SEQ ID NO: 587384 - RNA, 65 nt, Homo Sapiens; identical to SEQ ID NO: 489778

SEQ ID NO: 587385 - RNA, 65 nt, Homo Sapiens; identical to SEQ ID NO: 489781

SEQ ID NO: 587386 - RNA, 65 nt, Homo Sapiens; identical to SEQ ID NO: 489782

SEQ ID NO: 587387 - RNA, 65 nt, Homo Sapiens; identical to SEQ ID NO: 489849

SEQ ID NO: 587388 - RNA, 65 nt, Homo Sapiens; identical to SEQ ID NO: 489850

SEQ ID NO: 587389 - RNA, 65 nt, Homo Sapiens; identical to SEQ ID NO: 489855

SEQ ID NO: 587390 - RNA, 65 nt, Homo Sapiens; identical to SEQ ID NO: 489856

SEQ ID NO: 587391 - RNA, 65 nt, Homo Sapiens; identical to SEQ ID NO: 489893

SEQ ID NO: 587392 - RNA, 65 nt, Homo Sapiens; identical to SEQ ID NO: 489894

SEQ ID NO: 587393 - RNA, 65 nt, Homo Sapiens; identical to SEQ ID NO: 489898

SEQ ID NO: 587394 - RNA, 65 nt, Homo Sapiens; identical to SEQ ID NO: 489899

SEQ ID NO: 587395 - RNA, 65 nt, Homo Sapiens; identical to SEQ ID NO: 489914

SEQ ID NO: 587396 - RNA, 65 nt, Homo Sapiens; identical to SEQ ID NO: 489915

SEQ ID NO: 587397 - RNA, 65 nt, Homo Sapiens; identical to SEQ ID NO: 489918

SEQ ID NO: 587398 - RNA, 65 nt, Homo Sapiens; identical to SEQ ID NO: 489919

SEQ ID NO: 587399 - RNA, 65 nt, Homo Sapiens; identical to SEQ ID NO: 489925

SEQ ID NO: 587400 - RNA, 65 nt, Homo Sapiens; identical to SEQ ID NO: 489926

SEQ ID NO: 587401 - RNA, 65 nt, Homo Sapiens; identical to SEQ ID NO: 489956

SEQ ID NO: 587402 - RNA, 65 nt, Homo Sapiens; identical to SEQ ID NO: 489957

SEQ ID NO: 587403 - RNA, 65 nt, Homo Sapiens; identical to SEQ ID NO: 490016

SEQ ID NO: 587404 - RNA, 65 nt, Homo Sapiens; identical to SEQ ID NO: 490017

SEQ ID NO: 587405 - RNA, 65 nt, Homo Sapiens; identical to SEQ ID NO: 490087

SEQ ID NO: 587406 - RNA, 65 nt, Homo Sapiens; identical to SEQ ID NO: 490088

SEQ ID NO: 587407 - RNA, 65 nt, Homo Sapiens; identical to SEQ ID NO: 490090

SEQ ID NO: 587408 - RNA, 65 nt, Homo Sapiens; identical to SEQ ID NO: 490091

SEQ ID NO: 587409 - RNA, 65 nt, Homo Sapiens; identical to SEQ ID NO: 490105

SEQ ID NO: 587410 - RNA, 65 nt, Homo Sapiens; identical to SEQ ID NO: 490106

SEQ ID NO: 587411 - RNA, 64 nt, Homo Sapiens; identical to SEQ ID NO: 437741

SEQ ID NO: 587412 - RNA, 64 nt, Homo Sapiens; identical to SEQ ID NO: 437742

SEQ ID NO: 587413 - RNA, 64 nt, Homo Sapiens; identical to SEQ ID NO: 437743

SEQ ID NO: 587414 - RNA, 64 nt, Homo Sapiens; identical to SEQ ID NO: 437744

SEQ ID NO: 587415 - RNA, 64 nt, Homo Sapiens; identical to SEQ ID NO: 437745

SEQ ID NO: 587416 - RNA, 64 nt, Homo Sapiens; identical to SEQ ID NO: 437746

SEQ ID NO: 587417 - RNA, 64 nt, Homo Sapiens
aaacuuacauuccugccaagacaugaagguuaacacagucaaucucugcuucaaaaggcucuca

SEQ ID NO: 587418 - RNA, 64 nt, Homo Sapiens
uuguaaugaacuuuuuaaaauuuuagcauuuuauacagucaacuuuuuguauauauggauuaug

SEQ ID NO: 587419 - RNA, 64 nt, Homo Sapiens
cggcucuagcucugauaacauucugcagaucaacacagucaaagccgccugcaucuagugcugc

SEQ ID NO: 587420 - RNA, 64 nt, Homo Sapiens
aaagagaaaaaagauaaaguuuugugccuccuacacagucaaagcacagcagguuacucagcag

SEQ ID NO: 587421 - RNA, 64 nt, Homo Sapiens
auugccuaggguaguucaaauacaguacugugagacagucaauugcuaaguacagaauuuuauc

SEQ ID NO: 587422 - RNA, 64 nt, Homo Sapiens
uuagaacauuucguuaccccguguaaccgugaccacagucaauuuuuaguguauucacaaaguu

SEQ ID NO: 587423 - RNA, 64 nt, Homo Sapiens; identical to SEQ ID NO: 326924

SEQ ID NO: 587424 - RNA, 64 nt, Homo Sapiens; identical to SEQ ID NO: 326925

SEQ ID NO: 587425 - RNA, 64 nt, Homo Sapiens; identical to SEQ ID NO: 326926

SEQ ID NO: 587426 - RNA, 64 nt, Homo Sapiens; identical to SEQ ID NO: 326927

SEQ ID NO: 587427 - RNA, 64 nt, Homo Sapiens; identical to SEQ ID NO: 326928

SEQ ID NO: 587428 - RNA, 64 nt, Homo Sapiens; identical to SEQ ID NO: 326929

SEQ ID NO: 587429 - RNA, 64 nt, Homo Sapiens; identical to SEQ ID NO: 326930

SEQ ID NO: 587430 - RNA, 64 nt, Homo Sapiens; identical to SEQ ID NO: 326931

SEQ ID NO: 587431 - RNA, 64 nt, Homo Sapiens; identical to SEQ ID NO: 326932

SEQ ID NO: 587432 - RNA, 64 nt, Homo Sapiens; identical to SEQ ID NO: 326933

SEQ ID NO: 587433 - RNA, 64 nt, Homo Sapiens; identical to SEQ ID NO: 326934

SEQ ID NO: 587434 - RNA, 64 nt, Homo Sapiens; identical to SEQ ID NO: 326935

SEQ ID NO: 587435 - RNA, 64 nt, Homo Sapiens; identical to SEQ ID NO: 326936

SEQ ID NO: 587436 - RNA, 64 nt, Homo Sapiens; identical to SEQ ID NO: 326937

SEQ ID NO: 587437 - RNA, 64 nt, Homo Sapiens; identical to SEQ ID NO: 326938

SEQ ID NO: 587438 - RNA, 64 nt, Homo Sapiens; identical to SEQ ID NO: 326939

SEQ ID NO: 587439 - RNA, 64 nt, Homo Sapiens; identical to SEQ ID NO: 326940

SEQ ID NO: 587440 - RNA, 56 nt, Homo Sapiens; identical to SEQ ID NO: 326941

SEQ ID NO: 587441 - RNA, 64 nt, Homo Sapiens; identical to SEQ ID NO: 326942

SEQ ID NO: 587442 - RNA, 64 nt, Homo Sapiens; identical to SEQ ID NO: 326943

SEQ ID NO: 587443 - RNA, 64 nt, Homo Sapiens; identical to SEQ ID NO: 326944

SEQ ID NO: 587444 - RNA, 64 nt, Homo Sapiens; identical to SEQ ID NO: 326945

SEQ ID NO: 587445 - RNA, 64 nt, Homo Sapiens; identical to SEQ ID NO: 326946

SEQ ID NO: 587446 - RNA, 64 nt, Homo Sapiens; identical to SEQ ID NO: 326947

SEQ ID NO: 587447 - RNA, 64 nt, Homo Sapiens; identical to SEQ ID NO: 326948

SEQ ID NO: 587448 - RNA, 64 nt, Homo Sapiens; identical to SEQ ID NO: 326949

SEQ ID NO: 587449 - RNA, 64 nt, Homo Sapiens; identical to SEQ ID NO: 326950

SEQ ID NO: 587450 - RNA, 64 nt, Homo Sapiens; identical to SEQ ID NO: 326951

SEQ ID NO: 587451 - RNA, 64 nt, Homo Sapiens; identical to SEQ ID NO: 326952

SEQ ID NO: 587452 - RNA, 64 nt, Homo Sapiens; identical to SEQ ID NO: 326953

SEQ ID NO: 587453 - RNA, 64 nt, Homo Sapiens; identical to SEQ ID NO: 326954

SEQ ID NO: 587454 - RNA, 64 nt, Homo Sapiens; identical to SEQ ID NO: 326955

SEQ ID NO: 587455 - RNA, 63 nt, Homo Sapiens
guccucaguuugcagugcucuagcuccuggcagaagcaagagggaaacauuccuaauuuaguu

SEQ ID NO: 587456 - RNA, 63 nt, Homo Sapiens
uaaaagcaaccauggggagaaaaagaucagugaaagcaagacagucaaauacuuaguaggcuu

SEQ ID NO: 587457 - RNA, 63 nt, Homo Sapiens
uagucucaugagcccuuugcauucuuuccccuuaagcaagaauagaauguaguggaaauuuau

SEQ ID NO: 587458 - RNA, 63 nt, Homo Sapiens
acugacuaccugggguaggcacauuauguguuaaagcaagacagaggccagagaggggcaggu

SEQ ID NO: 587459 - RNA, 63 nt, Homo Sapiens
aaaagacagcagcaucaagagaagaagcaggaaaagcaagaaggagcagagcaugcagugaug

SEQ ID NO: 587460 - RNA, 63 nt, Homo Sapiens
aagaaaaggcgacaucaagaagaacaucagaaaaagcaagaaggcacccagaacaugcugagc

SEQ ID NO: 587461 - RNA, 63 nt, Homo Sapiens
ucuauauuuguuuuuuuaaaaaaaguuacguggaagcaagauuacaauggacauuaguuuuua

SEQ ID NO: 587462 - RNA, 63 nt, Homo Sapiens
aaucuggaaggaacaaaaauuaauugucuacagaagcaagagcguugaauaauaauuagcaua

SEQ ID NO: 587463 - RNA, 63 nt, Homo Sapiens
cuaugguuucacauagacgugcagugugaaccaaagcaagacugaaugugacuguaaauaauu

SEQ ID NO: 587464 - RNA, 63 nt, Homo Sapiens
aguauaaaagaucucuggcuuugcugaaauuuuaagcaagaaguucuauuuaauggagauguc

SEQ ID NO: 587465 - RNA, 63 nt, Homo Sapiens
aauguguuacaugggaagaaaaagauuaagaaaaagcaagauaauuuugaagaaggacgagag

SEQ ID NO: 587466 - RNA, 63 nt, Homo Sapiens
uucaugauuuugcaaaugggaaggauuucuuuaaagcaagacacaaaagcauacacaggaaaa

SEQ ID NO: 587467 - RNA, 63 nt, Homo Sapiens
gucuugauaccuugguuugucccagcugaagugaagcaagagaguuugaauuaauuuuuccau

SEQ ID NO: 587468 - RNA, 63 nt, Homo Sapiens
augauugcgccacugcacucagcccgggugacaaagcaagacccugucucagaaaaaaagaaa

SEQ ID NO: 587469 - RNA, 63 nt, Homo Sapiens
aauaaacugguuguauggccauagcuauccgaaaagcaagagacaaagcaagacaaauauuca

SEQ ID NO: 587470 - RNA, 63 nt, Homo Sapiens
guauggccauagcuauccgaaaagcaagagacaaagcaagacaaauauucacacaaaaaugaa

SEQ ID NO: 587471 - RNA, 63 nt, Homo Sapiens
ugggugggagaauguauccuaucuuuguccgggaagcaagaagaucugcuaaugggagaccaa

SEQ ID NO: 587472 - RNA, 63 nt, Homo Sapiens
ccugaucuuucaugcugcacgaggcugguuaggaagcaagaguggucccuguccucugucuuu

SEQ ID NO: 587473 - RNA, 63 nt, Homo Sapiens
aaggaagaaagaaaaagacaaaagaaaaagaaaaagcaagaagcuugcuuucuuucuuaaaaa

SEQ ID NO: 587474 - RNA, 63 nt, Homo Sapiens
caaaucucuugcuuucuuucgaggcccccccagaagcaagauuugacaauagagggccacggg

SEQ ID NO: 587475 - RNA, 63 nt, Homo Sapiens
cacuugaaugcaaaggaaaacacuugcacagcaaagcaagagaagucacagcagcaagacacg

SEQ ID NO: 587476 - RNA, 63 nt, Homo Sapiens
augacucuccuuugaaaugagaaaaagaaaagaaagcaagaacagaaaacgaagccacaggaa

SEQ ID NO: 587477 - RNA, 64 nt, Homo Sapiens; identical to SEQ ID NO: 72787

SEQ ID NO: 587478 - RNA, 64 nt, Homo Sapiens; identical to SEQ ID NO: 72788

SEQ ID NO: 587479 - RNA, 64 nt, Homo Sapiens; identical to SEQ ID NO: 72789

SEQ ID NO: 587480 - RNA, 64 nt, Homo Sapiens; identical to SEQ ID NO: 72790

SEQ ID NO: 587481 - RNA, 64 nt, Homo Sapiens; identical to SEQ ID NO: 72791

SEQ ID NO: 587482 - RNA, 64 nt, Homo Sapiens; identical to SEQ ID NO: 72792

SEQ ID NO: 587483 - RNA, 64 nt, Homo Sapiens; identical to SEQ ID NO: 72793

SEQ ID NO: 587484 - RNA, 64 nt, Homo Sapiens; identical to SEQ ID NO: 72794

SEQ ID NO: 587485 - RNA, 64 nt, Homo Sapiens; identical to SEQ ID NO: 72795

SEQ ID NO: 587486 - RNA, 64 nt, Homo Sapiens; identical to SEQ ID NO: 72796

SEQ ID NO: 587487 - RNA, 64 nt, Homo Sapiens; identical to SEQ ID NO: 72797

SEQ ID NO: 587488 - RNA, 64 nt, Homo Sapiens; identical to SEQ ID NO: 72798

SEQ ID NO: 587489 - RNA, 64 nt, Homo Sapiens; identical to SEQ ID NO: 72799

SEQ ID NO: 587490 - RNA, 64 nt, Homo Sapiens; identical to SEQ ID NO: 72800

SEQ ID NO: 587491 - RNA, 64 nt, Homo Sapiens; identical to SEQ ID NO: 72801

SEQ ID NO: 587492 - RNA, 64 nt, Homo Sapiens; identical to SEQ ID NO: 72802

SEQ ID NO: 587493 - RNA, 64 nt, Homo Sapiens; identical to SEQ ID NO: 72803

SEQ ID NO: 587494 - RNA, 64 nt, Homo Sapiens; identical to SEQ ID NO: 72804

SEQ ID NO: 587495 - RNA, 64 nt, Homo Sapiens; identical to SEQ ID NO: 72805

SEQ ID NO: 587496 - RNA, 64 nt, Homo Sapiens; identical to SEQ ID NO: 72806

SEQ ID NO: 587497 - RNA, 64 nt, Homo Sapiens; identical to SEQ ID NO: 72807

SEQ ID NO: 587498 - RNA, 64 nt, Homo Sapiens; identical to SEQ ID NO: 72808

SEQ ID NO: 587499 - RNA, 64 nt, Homo Sapiens; identical to SEQ ID NO: 72809

SEQ ID NO: 587500 - RNA, 64 nt, Homo Sapiens; identical to SEQ ID NO: 72810

SEQ ID NO: 587501 - RNA, 64 nt, Homo Sapiens; identical to SEQ ID NO: 72811

SEQ ID NO: 587502 - RNA, 64 nt, Homo Sapiens; identical to SEQ ID NO: 72812

SEQ ID NO: 587503 - RNA, 64 nt, Homo Sapiens; identical to SEQ ID NO: 72813

SEQ ID NO: 587504 - RNA, 64 nt, Homo Sapiens; identical to SEQ ID NO: 72814

SEQ ID NO: 587505 - RNA, 64 nt, Homo Sapiens; identical to SEQ ID NO: 72815

SEQ ID NO: 587506 - RNA, 64 nt, Homo Sapiens; identical to SEQ ID NO: 72816

SEQ ID NO: 587507 - RNA, 64 nt, Homo Sapiens; identical to SEQ ID NO: 72817

SEQ ID NO: 587508 - RNA, 64 nt, Homo Sapiens; identical to SEQ ID NO: 72818

SEQ ID NO: 587509 - RNA, 64 nt, Homo Sapiens; identical to SEQ ID NO: 72819

SEQ ID NO: 587510 - RNA, 64 nt, Homo Sapiens; identical to SEQ ID NO: 72820

SEQ ID NO: 587511 - RNA, 64 nt, Homo Sapiens; identical to SEQ ID NO: 72821

SEQ ID NO: 587512 - RNA, 64 nt, Homo Sapiens; identical to SEQ ID NO: 72822

SEQ ID NO: 587513 - RNA, 64 nt, Homo Sapiens; identical to SEQ ID NO: 72823

SEQ ID NO: 587514 - RNA, 64 nt, Homo Sapiens; identical to SEQ ID NO: 72824

SEQ ID NO: 587515 - RNA, 64 nt, Homo Sapiens; identical to SEQ ID NO: 72825

SEQ ID NO: 587516 - RNA, 64 nt, Homo Sapiens; identical to SEQ ID NO: 72826

SEQ ID NO: 587517 - RNA, 64 nt, Homo Sapiens; identical to SEQ ID NO: 72827

SEQ ID NO: 587518 - RNA, 64 nt, Homo Sapiens; identical to SEQ ID NO: 72828

SEQ ID NO: 587519 - RNA, 64 nt, Homo Sapiens; identical to SEQ ID NO: 72829

SEQ ID NO: 587520 - RNA, 64 nt, Homo Sapiens; identical to SEQ ID NO: 72830

SEQ ID NO: 587521 - RNA, 64 nt, Homo Sapiens; identical to SEQ ID NO: 72831

SEQ ID NO: 587522 - RNA, 64 nt, Homo Sapiens; identical to SEQ ID NO: 72832

SEQ ID NO: 587523 - RNA, 64 nt, Homo Sapiens; identical to SEQ ID NO: 72833

SEQ ID NO: 587524 - RNA, 64 nt, Homo Sapiens; identical to SEQ ID NO: 72834

SEQ ID NO: 587525 - RNA, 64 nt, Homo Sapiens; identical to SEQ ID NO: 72835

SEQ ID NO: 587526 - RNA, 64 nt, Homo Sapiens; identical to SEQ ID NO: 72836

SEQ ID NO: 587527 - RNA, 64 nt, Homo Sapiens; identical to SEQ ID NO: 72837

SEQ ID NO: 587528 - RNA, 64 nt, Homo Sapiens; identical to SEQ ID NO: 72838

SEQ ID NO: 587529 - RNA, 64 nt, Homo Sapiens; identical to SEQ ID NO: 72839

SEQ ID NO: 587530 - RNA, 64 nt, Homo Sapiens; identical to SEQ ID NO: 72840

SEQ ID NO: 587531 - RNA, 64 nt, Homo Sapiens; identical to SEQ ID NO: 72841

SEQ ID NO: 587532 - RNA, 64 nt, Homo Sapiens; identical to SEQ ID NO: 370200

SEQ ID NO: 587533 - RNA, 64 nt, Homo Sapiens; identical to SEQ ID NO: 370201

SEQ ID NO: 587534 - RNA, 64 nt, Homo Sapiens; identical to SEQ ID NO: 370202

SEQ ID NO: 587535 - RNA, 64 nt, Homo Sapiens; identical to SEQ ID NO: 370203

SEQ ID NO: 587536 - RNA, 64 nt, Homo Sapiens; identical to SEQ ID NO: 370204

SEQ ID NO: 587537 - RNA, 64 nt, Homo Sapiens; identical to SEQ ID NO: 370205

SEQ ID NO: 587538 - RNA, 64 nt, Homo Sapiens; identical to SEQ ID NO: 370206

SEQ ID NO: 587539 - RNA, 64 nt, Homo Sapiens; identical to SEQ ID NO: 370207

SEQ ID NO: 587540 - RNA, 64 nt, Homo Sapiens; identical to SEQ ID NO: 370208

SEQ ID NO: 587541 - RNA, 64 nt, Homo Sapiens; identical to SEQ ID NO: 370209

SEQ ID NO: 587542 - RNA, 64 nt, Homo Sapiens; identical to SEQ ID NO: 370210

SEQ ID NO: 587543 - RNA, 64 nt, Homo Sapiens; identical to SEQ ID NO: 370211

SEQ ID NO: 587544 - RNA, 64 nt, Homo Sapiens; identical to SEQ ID NO: 302078

SEQ ID NO: 587545 - RNA, 64 nt, Homo Sapiens; identical to SEQ ID NO: 302079

SEQ ID NO: 587546 - RNA, 64 nt, Homo Sapiens; identical to SEQ ID NO: 302080

SEQ ID NO: 587547 - RNA, 63 nt, Homo Sapiens; identical to SEQ ID NO: 302081

SEQ ID NO: 587548 - RNA, 64 nt, Homo Sapiens; identical to SEQ ID NO: 302082

SEQ ID NO: 587549 - RNA, 64 nt, Homo Sapiens; identical to SEQ ID NO: 302083

SEQ ID NO: 587550 - RNA, 64 nt, Homo Sapiens; identical to SEQ ID NO: 302084

SEQ ID NO: 587551 - RNA, 64 nt, Homo Sapiens; identical to SEQ ID NO: 302085

SEQ ID NO: 587552 - RNA, 64 nt, Homo Sapiens
uuuuguagaaguuuucggucaaauaaguaaggguggguuuuauaugugggugguauuuucaugc

SEQ ID NO: 587553 - RNA, 64 nt, Homo Sapiens
uaagugaaguagaagaaauuuuucaguccugucuggguuuuaaaagucuuauaccucaacuacc

SEQ ID NO: 587554 - RNA, 64 nt, Homo Sapiens
gaaucaccaaugugggugugaaaaugccuacaaaggguuuuagugccuuagaaguccuaagaag

SEQ ID NO: 587555 - RNA, 64 nt, Homo Sapiens
ucucaaccuuggcugcacauuggaaucaccuguaggguuuuaaagcauccaaaugguaauuaac

SEQ ID NO: 587556 - RNA, 64 nt, Homo Sapiens
gaaaacaggguggguagcuaaggucauuccuccuggguuuuaguggcauugccuuccuucacua

SEQ ID NO: 587557 - RNA, 64 nt, Homo Sapiens
acucugagaauucagcuuuggagucccgggugagggguuuuagauaaacccaucaauaucaccc

SEQ ID NO: 587558 - RNA, 64 nt, Homo Sapiens
gaacgcauggaccccauucaauucagguuucucuggguuuuacagcugugccaguugcucuggu

SEQ ID NO: 587559 - RNA, 64 nt, Homo Sapiens
uuuugcugaugacuauugauuuucugaguuuuuuggguuuuauuucuuuuuccugguuaauugu

SEQ ID NO: 587560 - RNA, 64 nt, Homo Sapiens
gcuuucuuugagggcauuuauucugugugacuguggguuuuauuuuguauucugguuaagaaaa

SEQ ID NO: 587561 - RNA, 64 nt, Homo Sapiens
uuugaguauauguguguguguguaacuaucauguggguuuuaaaaauccuuuuuuacaguggua

SEQ ID NO: 587562 - RNA, 64 nt, Homo Sapiens
gcagaaugguuggccuaaugauuaugcuacagauggguuuuaaaugacccgucuagguuacugc

SEQ ID NO: 587563 - RNA, 64 nt, Homo Sapiens
aaauuggagcuauucuucacugguccuuaaccuuggguuuuaaaaagaaggcuucucuguuugg

SEQ ID NO: 587564 - RNA, 64 nt, Homo Sapiens
cuuucugaagccuggggagaaaucagugacagagggguuuuauuguuauguggguuuucuuuug

SEQ ID NO: 587565 - RNA, 64 nt, Homo Sapiens
uccccauuuuuaucauauuuccaccaucacuucaggguuuuaagagucagugcucaccugggcg

SEQ ID NO: 587566 - RNA, 64 nt, Homo Sapiens
cggagagcucugggccguucagaucaccgcaggcggguuuuaccuagguggagacacacuuccc

SEQ ID NO: 587567 - RNA, 64 nt, Homo Sapiens
ugacaaagaagggcgagugguccgcgucgggacaggguuuuaagacagaggucuagacgugaga

SEQ ID NO: 587568 - RNA, 64 nt, Homo Sapiens
cagucaaguugaguucaagugaaagauucuuccaggguuuuauuuuuuccccuccuaacaaagu

SEQ ID NO: 587569 - RNA, 64 nt, Homo Sapiens
uggcuugguuuggaccacaguccucugcuacccaggguuuuagagccccugcucuaggaaacag

SEQ ID NO: 587570 - RNA, 64 nt, Homo Sapiens
ugcgguuuuauuacauuaauaaccuuucaccucaggguuuuaugaagaggaaaggguuuuaugc

SEQ ID NO: 587571 - RNA, 64 nt, Homo Sapiens
uaaccuuucaccucaggguuuuaugaagaggaaaggguuuuaugcaaaagaaagugcuacaauu

SEQ ID NO: 587572 - RNA, 64 nt, Homo Sapiens
uaguauaaaagaaaacuuguuuaucaauauaauuggguuuuaaaauguuguccucuggacauau

SEQ ID NO: 587573 - RNA, 64 nt, Homo Sapiens
acgcuagguuucccuuccauuguacauccagugaggguuuuauugcucaccauacuccuuucca

SEQ ID NO: 587574 - RNA, 64 nt, Homo Sapiens; identical to SEQ ID NO: 388546

SEQ ID NO: 587575 - RNA, 64 nt, Homo Sapiens; identical to SEQ ID NO: 388547

SEQ ID NO: 587576 - RNA, 64 nt, Homo Sapiens; identical to SEQ ID NO: 388548

SEQ ID NO: 587577 - RNA, 64 nt, Homo Sapiens; identical to SEQ ID NO: 388549

SEQ ID NO: 587578 - RNA, 64 nt, Homo Sapiens; identical to SEQ ID NO: 388550

SEQ ID NO: 587579 - RNA, 64 nt, Homo Sapiens; identical to SEQ ID NO: 388551

SEQ ID NO: 587580 - RNA, 64 nt, Homo Sapiens; identical to SEQ ID NO: 388552

SEQ ID NO: 587581 - RNA, 64 nt, Homo Sapiens; identical to SEQ ID NO: 388553

SEQ ID NO: 587582 - RNA, 64 nt, Homo Sapiens; identical to SEQ ID NO: 388554

SEQ ID NO: 587583 - RNA, 64 nt, Homo Sapiens; identical to SEQ ID NO: 388555

SEQ ID NO: 587584 - RNA, 64 nt, Homo Sapiens; identical to SEQ ID NO: 388556

SEQ ID NO: 587585 - RNA, 64 nt, Homo Sapiens; identical to SEQ ID NO: 388557

SEQ ID NO: 587586 - RNA, 64 nt, Homo Sapiens; identical to SEQ ID NO: 388558

SEQ ID NO: 587587 - RNA, 64 nt, Homo Sapiens; identical to SEQ ID NO: 388559

SEQ ID NO: 587588 - RNA, 64 nt, Homo Sapiens; identical to SEQ ID NO: 45815

SEQ ID NO: 587589 - RNA, 64 nt, Homo Sapiens; identical to SEQ ID NO: 45816

SEQ ID NO: 587590 - RNA, 64 nt, Homo Sapiens; identical to SEQ ID NO: 45817

SEQ ID NO: 587591 - RNA, 64 nt, Homo Sapiens; identical to SEQ ID NO: 45818

SEQ ID NO: 587592 - RNA, 64 nt, Homo Sapiens; identical to SEQ ID NO: 45819

SEQ ID NO: 587593 - RNA, 64 nt, Homo Sapiens; identical to SEQ ID NO: 45820

SEQ ID NO: 587594 - RNA, 64 nt, Homo Sapiens; identical to SEQ ID NO: 45821

SEQ ID NO: 587595 - RNA, 64 nt, Homo Sapiens; identical to SEQ ID NO: 45822

SEQ ID NO: 587596 - RNA, 64 nt, Homo Sapiens; identical to SEQ ID NO: 45823

SEQ ID NO: 587597 - RNA, 64 nt, Homo Sapiens; identical to SEQ ID NO: 45824

SEQ ID NO: 587598 - RNA, 64 nt, Homo Sapiens; identical to SEQ ID NO: 45825

SEQ ID NO: 587599 - RNA, 64 nt, Homo Sapiens; identical to SEQ ID NO: 45826

SEQ ID NO: 587600 - RNA, 64 nt, Homo Sapiens; identical to SEQ ID NO: 45827

SEQ ID NO: 587601 - RNA, 64 nt, Homo Sapiens; identical to SEQ ID NO: 45828

SEQ ID NO: 587602 - RNA, 64 nt, Homo Sapiens; identical to SEQ ID NO: 45829

SEQ ID NO: 587603 - RNA, 64 nt, Homo Sapiens; identical to SEQ ID NO: 45830

SEQ ID NO: 587604 - RNA, 64 nt, Homo Sapiens; identical to SEQ ID NO: 45831

SEQ ID NO: 587605 - RNA, 64 nt, Homo Sapiens; identical to SEQ ID NO: 45832

SEQ ID NO: 587606 - RNA, 64 nt, Homo Sapiens; identical to SEQ ID NO: 276199

SEQ ID NO: 587607 - RNA, 64 nt, Homo Sapiens; identical to SEQ ID NO: 276200

SEQ ID NO: 587608 - RNA, 64 nt, Homo Sapiens; identical to SEQ ID NO: 276201

SEQ ID NO: 587609 - RNA, 64 nt, Homo Sapiens; identical to SEQ ID NO: 276202

SEQ ID NO: 587610 - RNA, 64 nt, Homo Sapiens; identical to SEQ ID NO: 276203

SEQ ID NO: 587611 - RNA, 64 nt, Homo Sapiens; identical to SEQ ID NO: 276204

SEQ ID NO: 587612 - RNA, 64 nt, Homo Sapiens; identical to SEQ ID NO: 276205

SEQ ID NO: 587613 - RNA, 64 nt, Homo Sapiens; identical to SEQ ID NO: 276206

SEQ ID NO: 587614 - RNA, 64 nt, Homo Sapiens; identical to SEQ ID NO: 276207

SEQ ID NO: 587615 - RNA, 64 nt, Homo Sapiens; identical to SEQ ID NO: 276208

SEQ ID NO: 587616 - RNA, 64 nt, Homo Sapiens; identical to SEQ ID NO: 276209

SEQ ID NO: 587617 - RNA, 56 nt, Homo Sapiens; identical to SEQ ID NO: 276210

SEQ ID NO: 587618 - RNA, 64 nt, Homo Sapiens; identical to SEQ ID NO: 276211

SEQ ID NO: 587619 - RNA, 64 nt, Homo Sapiens; identical to SEQ ID NO: 276212

SEQ ID NO: 587620 - RNA, 64 nt, Homo Sapiens; identical to SEQ ID NO: 276213

SEQ ID NO: 587621 - RNA, 64 nt, Homo Sapiens; identical to SEQ ID NO: 276214

SEQ ID NO: 587622 - RNA, 64 nt, Homo Sapiens; identical to SEQ ID NO: 276215

SEQ ID NO: 587623 - RNA, 64 nt, Homo Sapiens; identical to SEQ ID NO: 276216

SEQ ID NO: 587624 - RNA, 64 nt, Homo Sapiens; identical to SEQ ID NO: 276217

SEQ ID NO: 587625 - RNA, 64 nt, Homo Sapiens; identical to SEQ ID NO: 276218

SEQ ID NO: 587626 - RNA, 64 nt, Homo Sapiens; identical to SEQ ID NO: 276219

SEQ ID NO: 587627 - RNA, 64 nt, Homo Sapiens; identical to SEQ ID NO: 276220

SEQ ID NO: 587628 - RNA, 64 nt, Homo Sapiens; identical to SEQ ID NO: 276221

SEQ ID NO: 587629 - RNA, 64 nt, Homo Sapiens; identical to SEQ ID NO: 276222

SEQ ID NO: 587630 - RNA, 64 nt, Homo Sapiens; identical to SEQ ID NO: 276222

SEQ ID NO: 587631 - RNA, 64 nt, Homo Sapiens; identical to SEQ ID NO: 276224

SEQ ID NO: 587632 - RNA, 64 nt, Homo Sapiens; identical to SEQ ID NO: 276225

SEQ ID NO: 587633 - RNA, 64 nt, Homo Sapiens; identical to SEQ ID NO: 276226

SEQ ID NO: 587634 - RNA, 64 nt, Homo Sapiens; identical to SEQ ID NO: 276227

SEQ ID NO: 587635 - RNA, 64 nt, Homo Sapiens
auaagacuguuuuugacaauuuuuuuaucaagaaagagcaaauaaaaagcagugguaaugaucc

SEQ ID NO: 587636 - RNA, 64 nt, Homo Sapiens
accacagcucagaauuccagcaguucauccagucagagcaaaaugguuaauugcccaguuuguc

SEQ ID NO: 587637 - RNA, 64 nt, Homo Sapiens
aauaaauucuacacaaggcuuucaagaccaucagagagcaaaaccacauguucugucuugagga

SEQ ID NO: 587638 - RNA, 64 nt, Homo Sapiens
accacauguucugucuugaggagccauagcagaaagagcaaauuagucauuauuuacugaacau

SEQ ID NO: 587639 - RNA, 64 nt, Homo Sapiens
gcaucuagauuggagugcugcacaaacaaacauaagagcaaagcaaaacuguaucacauagggu

SEQ ID NO: 587640 - RNA, 64 nt, Homo Sapiens
uugugcuggucuugcaaguuugucuaccaguaagagagcaaaguuuccuuccuuucuucucuuu

SEQ ID NO: 587641 - RNA, 64 nt, Homo Sapiens
aacuaaguugucacccaauaucuuagacacuuugagagcaaagggggugcuguaaauaaguaua

SEQ ID NO: 587642 - RNA, 64 nt, Homo Sapiens
aggcuccaccucagaaauucugaaauggguaguaagagcaaauuuucauuuuaaagcacaccug

SEQ ID NO: 587643 - RNA, 64 nt, Homo Sapiens
aaagccacugaagaguauaauggauuuuacucuaagagcaaaggagguugugcagugcugugua

SEQ ID NO: 587644 - RNA, 64 nt, Homo Sapiens
caaaagccugaaggaaagaauccauacugaaagaagagcaaauaaacagcuuggggaagagaau

SEQ ID NO: 587645 - RNA, 64 nt, Homo Sapiens
gucacuaaacuuggauaaauuaaaaaagcaguuuagagcaaacuauuuaccauauuauuguuuu

SEQ ID NO: 587646 - RNA, 64 nt, Homo Sapiens
agauuuuuuuuuuccuuuucgaaaagaggguugaagagcaaagcaucuuuaacuauagccuaga

SEQ ID NO: 587647 - RNA, 64 nt, Homo Sapiens
gccaucucaaaaaauauacaccagccugggcaaaagagcaaaaccaagaucgugccacuucacu

SEQ ID NO: 587648 - RNA, 64 nt, Homo Sapiens
ugacaaagauguguagcuguagaaagaauugaguagagcaaaaauaauaauaauaaacuuuuuc

SEQ ID NO: 587649 - RNA, 64 nt, Homo Sapiens
agaaaucuggcuguccuuccgagagaaugagcagagagcaaaggaauggguaaccuagacuuca

SEQ ID NO: 587650 - RNA, 64 nt, Homo Sapiens
uaacaggagaaaggacaaccauaucaacucugaaagagcaaaccccauccuccugugucacuga

SEQ ID NO: 587651 - RNA, 64 nt, Homo Sapiens
aaaaauuucaacuuguauauaagaaggcagaaagagagcaaauggugaccaauauggaauaaag

SEQ ID NO: 587652 - RNA, 64 nt, Homo Sapiens
uuaauaauaauucuuuuuuacacggccauguuggagagcaaaacguccucugggagcugaagca

SEQ ID NO: 587653 - RNA, 64 nt, Homo Sapiens
aaagcuauuuuuguuaauguaaaguaaauauuucagagcaaauuuuuuaaacuuauugcacuaa

SEQ ID NO: 587654 - RNA, 64 nt, Homo Sapiens
aauuauauaacuaacaauuguccaaauagaugagagagcaaaucaugugagaaaauucagaaua

SEQ ID NO: 587655 - RNA, 64 nt, Homo Sapiens
cacccucuggccccuuggcagccagguuuucucaagagcaaaaugccuaugauuuagcuggcag

SEQ ID NO: 587656 - RNA, 64 nt, Homo Sapiens
ccuuggguuucucgcauucagcaacucuagcaucagagcaaaagcuauguguguggauuccagg

SEQ ID NO: 587657 - RNA, 64 nt, Homo Sapiens
ucuguccaaaaaaaaaaaaacagccuggguaacaagagcaaaaccagaucgcgccauugcacuc

SEQ ID NO: 587658 - RNA, 64 nt, Homo Sapiens
uauuauuaagauggguuggagaaaaaggcugaagagagcaaauaacugaugagaguacuaacug

SEQ ID NO: 587659 - RNA, 54 nt, Homo Sapiens
ucauuauaugaaaguccucugaggagagcaaauauuggagccuucuuacuauag

SEQ ID NO: 587660 - RNA, 64 nt, Homo Sapiens
aaaguucugcguaaugagacaaggaaagaaccgaagagcaaacaguagagcauaccacuugaag

SEQ ID NO: 587661 - RNA, 64 nt, Homo Sapiens
agcuccggagucccugcaggggauaggaagacgcagagcaaauguacaguuuuagcggggaggg

SEQ ID NO: 587662 - RNA, 64 nt, Homo Sapiens
gcauuacuuaaagaugcaguuggaaaaaacccagagagcaaagugcacuuuaaauaagguagaa

SEQ ID NO: 587663 - RNA, 64 nt, Homo Sapiens
gcucguguucuuugucgaaggaugccuggcagcuagagcaaaugccugucccucgccauacacu

SEQ ID NO: 587664 - RNA, 64 nt, Homo Sapiens
ggcauuacauuggcaaauaagguuuggaagcagaagagcaaaaaaaagauauuguuaaaaugag

SEQ ID NO: 587665 - RNA, 64 nt, Homo Sapiens
uaugguauuuguuaaauacguuuguuuuuauugcagagcaaaaauaaaucaaauuagaagcaau

SEQ ID NO: 587666 - RNA, 64 nt, Homo Sapiens
cugaauacaugccacaaggaugaagcuugugaguagagcaaacaaacguuuuuccaaagaauuc

SEQ ID NO: 587667 - RNA, 64 nt, Homo Sapiens
cacaucccacaaaauggcccuugguggcagcaauagagcaaagguuaccuuuuuguauggugaa

SEQ ID NO: 587668 - RNA, 64 nt, Homo Sapiens
cagugggcgccucacacucagaaccucauaccccagagcaaaccgauggucagggagagggcua

SEQ ID NO: 587669 - RNA, 64 nt, Homo Sapiens
aagaccaugccauuacacucaagcuugggcaacgagagcaaaacucugucucaaaaaaaaaauu

SEQ ID NO: 587670 - RNA, 64 nt, Homo Sapiens
gcucuugucccugucgcgucuguuuccuggaagcagagcaaaauugaggagcggacucacuuga

SEQ ID NO: 587671 - RNA, 64 nt, Homo Sapiens
gcucagcgcgucucagcucagaaguggaaaaaggagagcaaacuugguuccagaaccgacgcau

SEQ ID NO: 587672 - RNA, 64 nt, Homo Sapiens; identical to SEQ ID NO: 300594

SEQ ID NO: 587673 - RNA, 64 nt, Homo Sapiens; identical to SEQ ID NO: 300595

SEQ ID NO: 587674 - RNA, 64 nt, Homo Sapiens; identical to SEQ ID NO: 300596

SEQ ID NO: 587675 - RNA, 64 nt, Homo Sapiens; identical to SEQ ID NO: 300597

SEQ ID NO: 587676 - RNA, 64 nt, Homo Sapiens; identical to SEQ ID NO: 300598

SEQ ID NO: 587677 - RNA, 64 nt, Homo Sapiens; identical to SEQ ID NO: 300599

SEQ ID NO: 587678 - RNA, 64 nt, Homo Sapiens; identical to SEQ ID NO: 300600

SEQ ID NO: 587679 - RNA, 64 nt, Homo Sapiens; identical to SEQ ID NO: 300601

SEQ ID NO: 587680 - RNA, 64 nt, Homo Sapiens; identical to SEQ ID NO: 300602

SEQ ID NO: 587681 - RNA, 64 nt, Homo Sapiens; identical to SEQ ID NO: 300603

SEQ ID NO: 587682 - RNA, 64 nt, Homo Sapiens; identical to SEQ ID NO: 300604

SEQ ID NO: 587683 - RNA, 64 nt, Homo Sapiens; identical to SEQ ID NO: 300605

SEQ ID NO: 587684 - RNA, 64 nt, Homo Sapiens; identical to SEQ ID NO: 300606

SEQ ID NO: 587685 - RNA, 64 nt, Homo Sapiens; identical to SEQ ID NO: 300607

SEQ ID NO: 587686 - RNA, 64 nt, Homo Sapiens; identical to SEQ ID NO: 300608

SEQ ID NO: 587687 - RNA, 64 nt, Homo Sapiens; identical to SEQ ID NO: 300609

SEQ ID NO: 587688 - RNA, 64 nt, Homo Sapiens; identical to SEQ ID NO: 300610

SEQ ID NO: 587689 - RNA, 64 nt, Homo Sapiens; identical to SEQ ID NO: 300611

SEQ ID NO: 587690 - RNA, 64 nt, Homo Sapiens; identical to SEQ ID NO: 300612

SEQ ID NO: 587691 - RNA, 64 nt, Homo Sapiens; identical to SEQ ID NO: 300613

SEQ ID NO: 587692 - RNA, 64 nt, Homo Sapiens; identical to SEQ ID NO: 300614

SEQ ID NO: 587693 - RNA, 64 nt, Homo Sapiens; identical to SEQ ID NO: 300615

SEQ ID NO: 587694 - RNA, 64 nt, Homo Sapiens; identical to SEQ ID NO: 300616

SEQ ID NO: 587695 - RNA, 64 nt, Homo Sapiens; identical to SEQ ID NO: 300617

SEQ ID NO: 587696 - RNA, 64 nt, Homo Sapiens; identical to SEQ ID NO: 300618

SEQ ID NO: 587697 - RNA, 64 nt, Homo Sapiens; identical to SEQ ID NO: 300619

SEQ ID NO: 587698 - RNA, 64 nt, Homo Sapiens; identical to SEQ ID NO: 300620

SEQ ID NO: 587699 - RNA, 64 nt, Homo Sapiens; identical to SEQ ID NO: 300621

SEQ ID NO: 587700 - RNA, 64 nt, Homo Sapiens; identical to SEQ ID NO: 300622

SEQ ID NO: 587701 - RNA, 64 nt, Homo Sapiens; identical to SEQ ID NO: 300623

SEQ ID NO: 587702 - RNA, 64 nt, Homo Sapiens; identical to SEQ ID NO: 300624

SEQ ID NO: 587703 - RNA, 64 nt, Homo Sapiens; identical to SEQ ID NO: 300625

SEQ ID NO: 587704 - RNA, 64 nt, Homo Sapiens; identical to SEQ ID NO: 300626

SEQ ID NO: 587705 - RNA, 64 nt, Homo Sapiens; identical to SEQ ID NO: 300627

SEQ ID NO: 587706 - RNA, 64 nt, Homo Sapiens; identical to SEQ ID NO: 300628

SEQ ID NO: 587707 - RNA, 64 nt, Homo Sapiens; identical to SEQ ID NO: 300629

SEQ ID NO: 587708 - RNA, 64 nt, Homo Sapiens; identical to SEQ ID NO: 300630

SEQ ID NO: 587709 - RNA, 64 nt, Homo Sapiens; identical to SEQ ID NO: 300631

SEQ ID NO: 587710 - RNA, 64 nt, Homo Sapiens; identical to SEQ ID NO: 300632

SEQ ID NO: 587711 - RNA, 64 nt, Homo Sapiens; identical to SEQ ID NO: 300633

SEQ ID NO: 587712 - RNA, 64 nt, Homo Sapiens; identical to SEQ ID NO: 300634

SEQ ID NO: 587713 - RNA, 64 nt, Homo Sapiens; identical to SEQ ID NO: 300635

SEQ ID NO: 587714 - RNA, 64 nt, Homo Sapiens; identical to SEQ ID NO: 300636

SEQ ID NO: 587715 - RNA, 64 nt, Homo Sapiens; identical to SEQ ID NO: 300637

SEQ ID NO: 587716 - RNA, 64 nt, Homo Sapiens; identical to SEQ ID NO: 300638

SEQ ID NO: 587717 - RNA, 64 nt, Homo Sapiens; identical to SEQ ID NO: 300639

SEQ ID NO: 587718 - RNA, 64 nt, Homo Sapiens; identical to SEQ ID NO: 300640

SEQ ID NO: 587719 - RNA, 64 nt, Homo Sapiens; identical to SEQ ID NO: 300641

SEQ ID NO: 587720 - RNA, 64 nt, Homo Sapiens; identical to SEQ ID NO: 300642

SEQ ID NO: 587721 - RNA, 64 nt, Homo Sapiens; identical to SEQ ID NO: 300643

SEQ ID NO: 587722 - RNA, 64 nt, Homo Sapiens; identical to SEQ ID NO: 300644

SEQ ID NO: 587723 - RNA, 64 nt, Homo Sapiens; identical to SEQ ID NO: 300645

SEQ ID NO: 587724 - RNA, 64 nt, Homo Sapiens; identical to SEQ ID NO: 300646

SEQ ID NO: 587725 - RNA, 64 nt, Homo Sapiens; identical to SEQ ID NO: 300647

SEQ ID NO: 587726 - RNA, 64 nt, Homo Sapiens; identical to SEQ ID NO: 300648

SEQ ID NO: 587727 - RNA, 64 nt, Homo Sapiens; identical to SEQ ID NO: 300649

SEQ ID NO: 587728 - RNA, 64 nt, Homo Sapiens; identical to SEQ ID NO: 300650

SEQ ID NO: 587729 - RNA, 64 nt, Homo Sapiens; identical to SEQ ID NO: 300651

SEQ ID NO: 587730 - RNA, 64 nt, Homo Sapiens; identical to SEQ ID NO: 300652

SEQ ID NO: 587731 - RNA, 64 nt, Homo Sapiens; identical to SEQ ID NO: 300653

SEQ ID NO: 587732 - RNA, 64 nt, Homo Sapiens; identical to SEQ ID NO: 300654

SEQ ID NO: 587733 - RNA, 64 nt, Homo Sapiens; identical to SEQ ID NO: 300655

SEQ ID NO: 587734 - RNA, 64 nt, Homo Sapiens; identical to SEQ ID NO: 300656

SEQ ID NO: 587735 - RNA, 64 nt, Homo Sapiens; identical to SEQ ID NO: 300657

SEQ ID NO: 587736 - RNA, 64 nt, Homo Sapiens; identical to SEQ ID NO: 300658

SEQ ID NO: 587737 - RNA, 64 nt, Homo Sapiens; identical to SEQ ID NO: 300659

SEQ ID NO: 587738 - RNA, 64 nt, Homo Sapiens; identical to SEQ ID NO: 300660

SEQ ID NO: 587739 - RNA, 64 nt, Homo Sapiens; identical to SEQ ID NO: 300661

SEQ ID NO: 587740 - RNA, 64 nt, Homo Sapiens; identical to SEQ ID NO: 300662

SEQ ID NO: 587741 - RNA, 64 nt, Homo Sapiens; identical to SEQ ID NO: 300663

SEQ ID NO: 587742 - RNA, 64 nt, Homo Sapiens; identical to SEQ ID NO: 482054

SEQ ID NO: 587743 - RNA, 64 nt, Homo Sapiens; identical to SEQ ID NO: 482055

SEQ ID NO: 587744 - RNA, 64 nt, Homo Sapiens; identical to SEQ ID NO: 482056

SEQ ID NO: 587745 - RNA, 64 nt, Homo Sapiens; identical to SEQ ID NO: 482057

SEQ ID NO: 587746 - RNA, 64 nt, Homo Sapiens; identical to SEQ ID NO: 482058

SEQ ID NO: 587747 - RNA, 64 nt, Homo Sapiens; identical to SEQ ID NO: 482059

SEQ ID NO: 587748 - RNA, 64 nt, Homo Sapiens; identical to SEQ ID NO: 482060

SEQ ID NO: 587749 - RNA, 64 nt, Homo Sapiens; identical to SEQ ID NO: 482061

SEQ ID NO: 587750 - RNA, 64 nt, Homo Sapiens; identical to SEQ ID NO: 482062

SEQ ID NO: 587751 - RNA, 64 nt, Homo Sapiens; identical to SEQ ID NO: 482063

SEQ ID NO: 587752 - RNA, 64 nt, Homo Sapiens; identical to SEQ ID NO: 482064

SEQ ID NO: 587753 - RNA, 64 nt, Homo Sapiens; identical to SEQ ID NO: 482065

SEQ ID NO: 587754 - RNA, 64 nt, Homo Sapiens; identical to SEQ ID NO: 482066

SEQ ID NO: 587755 - RNA, 64 nt, Homo Sapiens; identical to SEQ ID NO: 482067

SEQ ID NO: 587756 - RNA, 64 nt, Homo Sapiens; identical to SEQ ID NO: 482068

SEQ ID NO: 587757 - RNA, 64 nt, Homo Sapiens; identical to SEQ ID NO: 482069

SEQ ID NO: 587758 - RNA, 64 nt, Homo Sapiens; identical to SEQ ID NO: 482070

SEQ ID NO: 587759 - RNA, 64 nt, Homo Sapiens; identical to SEQ ID NO: 482071

SEQ ID NO: 587760 - RNA, 64 nt, Homo Sapiens; identical to SEQ ID NO: 482072

SEQ ID NO: 587761 - RNA, 64 nt, Homo Sapiens; identical to SEQ ID NO: 482073

SEQ ID NO: 587762 - RNA, 64 nt, Homo Sapiens; identical to SEQ ID NO: 482074

SEQ ID NO: 587763 - RNA, 64 nt, Homo Sapiens; identical to SEQ ID NO: 482075

SEQ ID NO: 587764 - RNA, 64 nt, Homo Sapiens; identical to SEQ ID NO: 482076

SEQ ID NO: 587765 - RNA, 64 nt, Homo Sapiens; identical to SEQ ID NO: 482077

SEQ ID NO: 587766 - RNA, 64 nt, Homo Sapiens; identical to SEQ ID NO: 482078

SEQ ID NO: 587767 - RNA, 64 nt, Homo Sapiens; identical to SEQ ID NO: 482079

SEQ ID NO: 587768 - RNA, 64 nt, Homo Sapiens; identical to SEQ ID NO: 482080

SEQ ID NO: 587769 - RNA, 64 nt, Homo Sapiens; identical to SEQ ID NO: 482081

SEQ ID NO: 587770 - RNA, 64 nt, Homo Sapiens; identical to SEQ ID NO: 482082

SEQ ID NO: 587771 - RNA, 64 nt, Homo Sapiens; identical to SEQ ID NO: 482083

SEQ ID NO: 587772 - RNA, 64 nt, Homo Sapiens; identical to SEQ ID NO: 482084

SEQ ID NO: 587773 - RNA, 64 nt, Homo Sapiens; identical to SEQ ID NO: 482085

SEQ ID NO: 587774 - RNA, 64 nt, Homo Sapiens; identical to SEQ ID NO: 482086

SEQ ID NO: 587775 - RNA, 64 nt, Homo Sapiens; identical to SEQ ID NO: 482087

SEQ ID NO: 587776 - RNA, 64 nt, Homo Sapiens; identical to SEQ ID NO: 482088

SEQ ID NO: 587777 - RNA, 64 nt, Homo Sapiens; identical to SEQ ID NO: 482089

SEQ ID NO: 587778 - RNA, 64 nt, Homo Sapiens; identical to SEQ ID NO: 482090

SEQ ID NO: 587779 - RNA, 64 nt, Homo Sapiens; identical to SEQ ID NO: 482091

SEQ ID NO: 587780 - RNA, 64 nt, Homo Sapiens; identical to SEQ ID NO: 482092

SEQ ID NO: 587781 - RNA, 64 nt, Homo Sapiens; identical to SEQ ID NO: 482093

SEQ ID NO: 587782 - RNA, 64 nt, Homo Sapiens; identical to SEQ ID NO: 482094

SEQ ID NO: 587783 - RNA, 64 nt, Homo Sapiens; identical to SEQ ID NO: 482095

SEQ ID NO: 587784 - RNA, 64 nt, Homo Sapiens; identical to SEQ ID NO: 482096

SEQ ID NO: 587785 - RNA, 64 nt, Homo Sapiens; identical to SEQ ID NO: 482097

SEQ ID NO: 587786 - RNA, 64 nt, Homo Sapiens; identical to SEQ ID NO: 482098

SEQ ID NO: 587787 - RNA, 64 nt, Homo Sapiens; identical to SEQ ID NO: 482099

SEQ ID NO: 587788 - RNA, 64 nt, Homo Sapiens; identical to SEQ ID NO: 482100

SEQ ID NO: 587789 - RNA, 64 nt, Homo Sapiens; identical to SEQ ID NO: 482101

SEQ ID NO: 587790 - RNA, 64 nt, Homo Sapiens; identical to SEQ ID NO: 482102

SEQ ID NO: 587791 - RNA, 64 nt, Homo Sapiens; identical to SEQ ID NO: 482103

SEQ ID NO: 587792 - RNA, 64 nt, Homo Sapiens; identical to SEQ ID NO: 482104

SEQ ID NO: 587793 - RNA, 64 nt, Homo Sapiens; identical to SEQ ID NO: 482105

SEQ ID NO: 587794 - RNA, 64 nt, Homo Sapiens; identical to SEQ ID NO: 482106

SEQ ID NO: 587795 - RNA, 64 nt, Homo Sapiens; identical to SEQ ID NO: 482107

SEQ ID NO: 587796 - RNA, 64 nt, Homo Sapiens; identical to SEQ ID NO: 482108

SEQ ID NO: 587797 - RNA, 64 nt, Homo Sapiens; identical to SEQ ID NO: 482109

SEQ ID NO: 587798 - RNA, 64 nt, Homo Sapiens; identical to SEQ ID NO: 482110

SEQ ID NO: 587799 - RNA, 64 nt, Homo Sapiens; identical to SEQ ID NO: 482111

SEQ ID NO: 587800 - RNA, 64 nt, Homo Sapiens; identical to SEQ ID NO: 482112

SEQ ID NO: 587801 - RNA, 64 nt, Homo Sapiens; identical to SEQ ID NO: 482113

SEQ ID NO: 587802 - RNA, 64 nt, Homo Sapiens; identical to SEQ ID NO: 482114

SEQ ID NO: 587803 - RNA, 64 nt, Homo Sapiens; identical to SEQ ID NO: 482115

SEQ ID NO: 587804 - RNA, 64 nt, Homo Sapiens; identical to SEQ ID NO: 482116

SEQ ID NO: 587805 - RNA, 64 nt, Homo Sapiens; identical to SEQ ID NO: 482117

SEQ ID NO: 587806 - RNA, 64 nt, Homo Sapiens; identical to SEQ ID NO: 482118

SEQ ID NO: 587807 - RNA, 64 nt, Homo Sapiens; identical to SEQ ID NO: 482119

SEQ ID NO: 587808 - RNA, 64 nt, Homo Sapiens; identical to SEQ ID NO: 482120

SEQ ID NO: 587809 - RNA, 63 nt, Homo Sapiens; identical to SEQ ID NO: 482121

SEQ ID NO: 587810 - RNA, 64 nt, Homo Sapiens; identical to SEQ ID NO: 482122

SEQ ID NO: 587811 - RNA, 64 nt, Homo Sapiens; identical to SEQ ID NO: 482123

SEQ ID NO: 587812 - RNA, 64 nt, Homo Sapiens; identical to SEQ ID NO: 482124

SEQ ID NO: 587813 - RNA, 64 nt, Homo Sapiens; identical to SEQ ID NO: 482125

SEQ ID NO: 587814 - RNA, 64 nt, Homo Sapiens; identical to SEQ ID NO: 482126

SEQ ID NO: 587815 - RNA, 64 nt, Homo Sapiens; identical to SEQ ID NO: 482127

SEQ ID NO: 587816 - RNA, 64 nt, Homo Sapiens; identical to SEQ ID NO: 482128

SEQ ID NO: 587817 - RNA, 64 nt, Homo Sapiens; identical to SEQ ID NO: 482129

SEQ ID NO: 587818 - RNA, 64 nt, Homo Sapiens; identical to SEQ ID NO: 482130

SEQ ID NO: 587819 - RNA, 64 nt, Homo Sapiens; identical to SEQ ID NO: 482131

SEQ ID NO: 587820 - RNA, 64 nt, Homo Sapiens; identical to SEQ ID NO: 482132

SEQ ID NO: 587821 - RNA, 64 nt, Homo Sapiens; identical to SEQ ID NO: 482133

SEQ ID NO: 587822 - RNA, 64 nt, Homo Sapiens; identical to SEQ ID NO: 482134

SEQ ID NO: 587823 - RNA, 64 nt, Homo Sapiens; identical to SEQ ID NO: 482135

SEQ ID NO: 587824 - RNA, 64 nt, Homo Sapiens; identical to SEQ ID NO: 482136

SEQ ID NO: 587825 - RNA, 64 nt, Homo Sapiens; identical to SEQ ID NO: 482137

SEQ ID NO: 587826 - RNA, 64 nt, Homo Sapiens; identical to SEQ ID NO: 482138

SEQ ID NO: 587827 - RNA, 64 nt, Homo Sapiens; identical to SEQ ID NO: 482139

SEQ ID NO: 587828 - RNA, 64 nt, Homo Sapiens; identical to SEQ ID NO: 482140

SEQ ID NO: 587829 - RNA, 64 nt, Homo Sapiens; identical to SEQ ID NO: 482141

SEQ ID NO: 587830 - RNA, 64 nt, Homo Sapiens; identical to SEQ ID NO: 482142

SEQ ID NO: 587831 - RNA, 64 nt, Homo Sapiens; identical to SEQ ID NO: 482143

SEQ ID NO: 587832 - RNA, 64 nt, Homo Sapiens; identical to SEQ ID NO: 482144

SEQ ID NO: 587833 - RNA, 64 nt, Homo Sapiens; identical to SEQ ID NO: 482145

SEQ ID NO: 587834 - RNA, 64 nt, Homo Sapiens; identical to SEQ ID NO: 482146

SEQ ID NO: 587835 - RNA, 64 nt, Homo Sapiens; identical to SEQ ID NO: 482147

SEQ ID NO: 587836 - RNA, 64 nt, Homo Sapiens; identical to SEQ ID NO: 482148

SEQ ID NO: 587837 - RNA, 64 nt, Homo Sapiens; identical to SEQ ID NO: 482149

SEQ ID NO: 587838 - RNA, 64 nt, Homo Sapiens; identical to SEQ ID NO: 482150

SEQ ID NO: 587839 - RNA, 64 nt, Homo Sapiens; identical to SEQ ID NO: 482151

SEQ ID NO: 587840 - RNA, 64 nt, Homo Sapiens; identical to SEQ ID NO: 482152

SEQ ID NO: 587841 - RNA, 64 nt, Homo Sapiens; identical to SEQ ID NO: 482153

SEQ ID NO: 587842 - RNA, 64 nt, Homo Sapiens; identical to SEQ ID NO: 482154

SEQ ID NO: 587843 - RNA, 64 nt, Homo Sapiens; identical to SEQ ID NO: 482155

SEQ ID NO: 587844 - RNA, 64 nt, Homo Sapiens; identical to SEQ ID NO: 482156

SEQ ID NO: 587845 - RNA, 64 nt, Homo Sapiens; identical to SEQ ID NO: 482157

SEQ ID NO: 587846 - RNA, 64 nt, Homo Sapiens; identical to SEQ ID NO: 482158

SEQ ID NO: 587847 - RNA, 64 nt, Homo Sapiens; identical to SEQ ID NO: 482159

SEQ ID NO: 587848 - RNA, 64 nt, Homo Sapiens; identical to SEQ ID NO: 482160

SEQ ID NO: 587849 - RNA, 64 nt, Homo Sapiens; identical to SEQ ID NO: 482161

SEQ ID NO: 587850 - RNA, 64 nt, Homo Sapiens; identical to SEQ ID NO: 482162

SEQ ID NO: 587851 - RNA, 64 nt, Homo Sapiens; identical to SEQ ID NO: 482163

SEQ ID NO: 587852 - RNA, 64 nt, Homo Sapiens; identical to SEQ ID NO: 482164

SEQ ID NO: 587853 - RNA, 64 nt, Homo Sapiens; identical to SEQ ID NO: 465416

SEQ ID NO: 587854 - RNA, 64 nt, Homo Sapiens; identical to SEQ ID NO: 465417

SEQ ID NO: 587855 - RNA, 64 nt, Homo Sapiens; identical to SEQ ID NO: 465418

SEQ ID NO: 587856 - RNA, 64 nt, Homo Sapiens; identical to SEQ ID NO: 465419

SEQ ID NO: 587857 - RNA, 64 nt, Homo Sapiens; identical to SEQ ID NO: 465420

SEQ ID NO: 587858 - RNA, 64 nt, Homo Sapiens; identical to SEQ ID NO: 465421

SEQ ID NO: 587859 - RNA, 64 nt, Homo Sapiens; identical to SEQ ID NO: 465422

SEQ ID NO: 587860 - RNA, 64 nt, Homo Sapiens; identical to SEQ ID NO: 465423

SEQ ID NO: 587861 - RNA, 64 nt, Homo Sapiens; identical to SEQ ID NO: 465424

SEQ ID NO: 587862 - RNA, 64 nt, Homo Sapiens; identical to SEQ ID NO: 465425

SEQ ID NO: 587863 - RNA, 64 nt, Homo Sapiens; identical to SEQ ID NO: 465426

SEQ ID NO: 587864 - RNA, 64 nt, Homo Sapiens; identical to SEQ ID NO: 465427

SEQ ID NO: 587865 - RNA, 64 nt, Homo Sapiens; identical to SEQ ID NO: 465428

SEQ ID NO: 587866 - RNA, 64 nt, Homo Sapiens; identical to SEQ ID NO: 465429

SEQ ID NO: 587867 - RNA, 64 nt, Homo Sapiens; identical to SEQ ID NO: 465430

SEQ ID NO: 587868 - RNA, 64 nt, Homo Sapiens; identical to SEQ ID NO: 465431

SEQ ID NO: 587869 - RNA, 64 nt, Homo Sapiens; identical to SEQ ID NO: 465432

SEQ ID NO: 587870 - RNA, 64 nt, Homo Sapiens; identical to SEQ ID NO: 465433

SEQ ID NO: 587871 - RNA, 64 nt, Homo Sapiens; identical to SEQ ID NO: 465434

SEQ ID NO: 587872 - RNA, 64 nt, Homo Sapiens; identical to SEQ ID NO: 465435

SEQ ID NO: 587873 - RNA, 64 nt, Homo Sapiens; identical to SEQ ID NO: 465436

SEQ ID NO: 587874 - RNA, 64 nt, Homo Sapiens; identical to SEQ ID NO: 465437

SEQ ID NO: 587875 - RNA, 64 nt, Homo Sapiens; identical to SEQ ID NO: 465438

SEQ ID NO: 587876 - RNA, 64 nt, Homo Sapiens; identical to SEQ ID NO: 465439

SEQ ID NO: 587877 - RNA, 64 nt, Homo Sapiens; identical to SEQ ID NO: 156063

SEQ ID NO: 587878 - RNA, 64 nt, Homo Sapiens; identical to SEQ ID NO: 156064

SEQ ID NO: 587879 - RNA, 64 nt, Homo Sapiens; identical to SEQ ID NO: 156065

SEQ ID NO: 587880 - RNA, 64 nt, Homo Sapiens; identical to SEQ ID NO: 156066

SEQ ID NO: 587881 - RNA, 64 nt, Homo Sapiens; identical to SEQ ID NO: 156067

SEQ ID NO: 587882 - RNA, 64 nt, Homo Sapiens; identical to SEQ ID NO: 156068

SEQ ID NO: 587883 - RNA, 64 nt, Homo Sapiens; identical to SEQ ID NO: 156069

SEQ ID NO: 587884 - RNA, 64 nt, Homo Sapiens; identical to SEQ ID NO: 156070

SEQ ID NO: 587885 - RNA, 64 nt, Homo Sapiens; identical to SEQ ID NO: 156071

SEQ ID NO: 587886 - RNA, 64 nt, Homo Sapiens; identical to SEQ ID NO: 156072

SEQ ID NO: 587887 - RNA, 64 nt, Homo Sapiens; identical to SEQ ID NO: 156073

SEQ ID NO: 587888 - RNA, 64 nt, Homo Sapiens; identical to SEQ ID NO: 156074

SEQ ID NO: 587889 - RNA, 64 nt, Homo Sapiens; identical to SEQ ID NO: 156075

SEQ ID NO: 587890 - RNA, 64 nt, Homo Sapiens; identical to SEQ ID NO: 156076

SEQ ID NO: 587891 - RNA, 64 nt, Homo Sapiens; identical to SEQ ID NO: 156077

SEQ ID NO: 587892 - RNA, 64 nt, Homo Sapiens; identical to SEQ ID NO: 156078

SEQ ID NO: 587893 - RNA, 64 nt, Homo Sapiens; identical to SEQ ID NO: 156079

SEQ ID NO: 587894 - RNA, 64 nt, Homo Sapiens; identical to SEQ ID NO: 156080

SEQ ID NO: 587895 - RNA, 64 nt, Homo Sapiens; identical to SEQ ID NO: 156081

SEQ ID NO: 587896 - RNA, 64 nt, Homo Sapiens; identical to SEQ ID NO: 156082

SEQ ID NO: 587897 - RNA, 64 nt, Homo Sapiens; identical to SEQ ID NO: 156083

SEQ ID NO: 587898 - RNA, 64 nt, Homo Sapiens; identical to SEQ ID NO: 156084

SEQ ID NO: 587899 - RNA, 64 nt, Homo Sapiens; identical to SEQ ID NO: 156085

SEQ ID NO: 587900 - RNA, 64 nt, Homo Sapiens; identical to SEQ ID NO: 156086

SEQ ID NO: 587901 - RNA, 64 nt, Homo Sapiens; identical to SEQ ID NO: 156087

SEQ ID NO: 587902 - RNA, 64 nt, Homo Sapiens; identical to SEQ ID NO: 156088

SEQ ID NO: 587903 - RNA, 64 nt, Homo Sapiens; identical to SEQ ID NO: 156089

SEQ ID NO: 587904 - RNA, 64 nt, Homo Sapiens; identical to SEQ ID NO: 156090

SEQ ID NO: 587905 - RNA, 64 nt, Homo Sapiens; identical to SEQ ID NO: 156091

SEQ ID NO: 587906 - RNA, 64 nt, Homo Sapiens; identical to SEQ ID NO: 156092

SEQ ID NO: 587907 - RNA, 64 nt, Homo Sapiens; identical to SEQ ID NO: 156093

SEQ ID NO: 587908 - RNA, 64 nt, Homo Sapiens; identical to SEQ ID NO: 156094

SEQ ID NO: 587909 - RNA, 64 nt, Homo Sapiens; identical to SEQ ID NO: 156095

SEQ ID NO: 587910 - RNA, 64 nt, Homo Sapiens; identical to SEQ ID NO: 156096

SEQ ID NO: 587911 - RNA, 64 nt, Homo Sapiens; identical to SEQ ID NO: 156097

SEQ ID NO: 587912 - RNA, 64 nt, Homo Sapiens; identical to SEQ ID NO: 156098

SEQ ID NO: 587913 - RNA, 64 nt, Homo Sapiens; identical to SEQ ID NO: 156099

SEQ ID NO: 587914 - RNA, 64 nt, Homo Sapiens; identical to SEQ ID NO: 156100

SEQ ID NO: 587915 - RNA, 64 nt, Homo Sapiens; identical to SEQ ID NO: 156101

SEQ ID NO: 587916 - RNA, 64 nt, Homo Sapiens; identical to SEQ ID NO: 156102

SEQ ID NO: 587917 - RNA, 64 nt, Homo Sapiens; identical to SEQ ID NO: 156103

SEQ ID NO: 587918 - RNA, 64 nt, Homo Sapiens; identical to SEQ ID NO: 156104

SEQ ID NO: 587919 - RNA, 64 nt, Homo Sapiens; identical to SEQ ID NO: 156105

SEQ ID NO: 587920 - RNA, 64 nt, Homo Sapiens; identical to SEQ ID NO: 156106

SEQ ID NO: 587921 - RNA, 64 nt, Homo Sapiens; identical to SEQ ID NO: 156107

SEQ ID NO: 587922 - RNA, 64 nt, Homo Sapiens; identical to SEQ ID NO: 156108

SEQ ID NO: 587923 - RNA, 64 nt, Homo Sapiens; identical to SEQ ID NO: 156109

SEQ ID NO: 587924 - RNA, 64 nt, Homo Sapiens; identical to SEQ ID NO: 156110

SEQ ID NO: 587925 - RNA, 64 nt, Homo Sapiens; identical to SEQ ID NO: 156111

SEQ ID NO: 587926 - RNA, 64 nt, Homo Sapiens
auauauguugguaggauguuauuagagagauaugugugcauauauauuuuuuugcaccugaauc

SEQ ID NO: 587927 - RNA, 64 nt, Homo Sapiens
auuaagauuucuuuuuauaaguauucauuuugaaugugcauauaguuauuugaccccuuccaaa

SEQ ID NO: 587928 - RNA, 64 nt, Homo Sapiens
ucucauccacaggggaagaucuaguuuacuugugugugcauacacccauagaauaaaauucucu

SEQ ID NO: 587929 - RNA, 64 nt, Homo Sapiens
gaccuuuaagcaaacuacuaugcaugcuuuguucugugcauagauagagagacauaauuagaga

SEQ ID NO: 587930 - RNA, 64 nt, Homo Sapiens
agcugacuuuuuguuuguuuggacuggaaccaauugugcauauccgcucucugaagcagaaaag

SEQ ID NO: 587931 - RNA, 64 nt, Homo Sapiens
uuaaauuuugucucuugauuuauauauaaaacugugugcauauauacauggugugaugcugcau

SEQ ID NO: 587932 - RNA, 64 nt, Homo Sapiens
aaugugaaaauccacucuuuuuauauucuuuauuugugcauaccuuuguaaaaauaacuguagc

SEQ ID NO: 587933 - RNA, 64 nt, Homo Sapiens
ugaauuuuucaugcaguuuuugugguguuuuuacugugcauauuaaauuuaguccugugcauac

SEQ ID NO: 587934 - RNA, 64 nt, Homo Sapiens
gugguguuuuuacugugcauuuaaaauuuaguccugugcauacucagcauuccaugcacuugcu

SEQ ID NO: 587935 - RNA, 64 nt, Homo Sapiens
uacauucaucccuuaauguuauagagugugaggcugugcauacgaauucaggacacauacauuu

SEQ ID NO: 587936 - RNA, 64 nt, Homo Sapiens
aaauuuccacucaauuuaaauauuuuuuauuaacugugcauauguuauucauucuuuuuaaggu

SEQ ID NO: 587937 - RNA, 64 nt, Homo Sapiens
cuacucggauccccaccugaagcuguuuggccaaugugcauaacugggugagcauaccugucuc

SEQ ID NO: 587938 - RNA, 64 nt, Homo Sapiens
ccucuuguucaugucagcuucuggccucccuuugugugcauacguuguuaaacccuucugucua

SEQ ID NO: 587939 - RNA, 64 nt, Homo Sapiens
ugauuacaguguguuuuggagcuggcucuguuugugugcauaugauaaugcagaguugagccag

SEQ ID NO: 587940 - RNA, 64 nt, Homo Sapiens
cuuuuuaaaaauauauauaucuaaaugaaugcaaugugcauaaauauuuuuuaaacauaacagu

SEQ ID NO: 587941 - RNA, 64 nt, Homo Sapiens
uuugagccugauguuuacagugucugugugugugugugcauaugugugugugugcauaugcaug

SEQ ID NO: 587942 - RNA, 64 nt, Homo Sapiens
acagugucugugugugugugugcauaugugugugugugcauaugcaugugugugugugugugug

SEQ ID NO: 587943 - RNA, 64 nt, Homo Sapiens
uuuacuacugcuuuuccuaaacagaugguuuauuugugcauauuaagacuuaaaaauuguguuu

SEQ ID NO: 587944 - RNA, 64 nt, Homo Sapiens
aagcacagacaugcauguguuuuuaaauuguguaugugcauauggguaaagaugaagcaauaau

SEQ ID NO: 587945 - RNA, 64 nt, Homo Sapiens
uuccuuuuagccaucuuuuguucuuguaaucccaacuagauaggcuuuaugcucacaucauugu

SEQ ID NO: 587946 - RNA, 64 nt, Homo Sapiens
gacuaaauuccagugagaguaugaaugaagaacaacuagauauuaaugucaaucauuuaagauu

SEQ ID NO: 587947 - RNA, 64 nt, Homo Sapiens
auuaauguuuaaaauguuuuaauaguaugaaaauacuagauaaaaucaaagaucuugaaauagu

SEQ ID NO: 587948 - RNA, 64 nt, Homo Sapiens
cugcaaacuacaguggggauauaguuuauguccuacuagauacauaagcuuuguaagcuaagca

SEQ ID NO: 587949 - RNA, 64 nt, Homo Sapiens
aauacacaacccccuucccaccauccuucaugucacuagauacacaacccccuucccaccaucc

SEQ ID NO: 587950 - RNA, 64 nt, Homo Sapiens
auuggucugauauaugcugcucuugguucuauaaacuagauaaaagcagugcuuugugaaaugc

SEQ ID NO: 587951 - RNA, 64 nt, Homo Sapiens; identical to SEQ ID NO: 421834

SEQ ID NO: 587952 - RNA, 64 nt, Homo Sapiens; identical to SEQ ID NO: 421835

SEQ ID NO: 587953 - RNA, 64 nt, Homo Sapiens; identical to SEQ ID NO: 421836

SEQ ID NO: 587954 - RNA, 64 nt, Homo Sapiens; identical to SEQ ID NO: 421837

SEQ ID NO: 587955 - RNA, 64 nt, Homo Sapiens; identical to SEQ ID NO: 421838

SEQ ID NO: 587956 - RNA, 64 nt, Homo Sapiens; identical to SEQ ID NO: 421839

SEQ ID NO: 587957 - RNA, 64 nt, Homo Sapiens; identical to SEQ ID NO: 421840

SEQ ID NO: 587958 - RNA, 64 nt, Homo Sapiens; identical to SEQ ID NO: 421841

SEQ ID NO: 587959 - RNA, 64 nt, Homo Sapiens; identical to SEQ ID NO: 421842

SEQ ID NO: 587960 - RNA, 64 nt, Homo Sapiens; identical to SEQ ID NO: 421843

SEQ ID NO: 587961 - RNA, 64 nt, Homo Sapiens; identical to SEQ ID NO: 421844

SEQ ID NO: 587962 - RNA, 64 nt, Homo Sapiens; identical to SEQ ID NO: 421845

SEQ ID NO: 587963 - RNA, 64 nt, Homo Sapiens; identical to SEQ ID NO: 421846

SEQ ID NO: 587964 - RNA, 64 nt, Homo Sapiens; identical to SEQ ID NO: 421847

SEQ ID NO: 587965 - RNA, 64 nt, Homo Sapiens; identical to SEQ ID NO: 421848

SEQ ID NO: 587966 - RNA, 64 nt, Homo Sapiens; identical to SEQ ID NO: 421849

SEQ ID NO: 587967 - RNA, 64 nt, Homo Sapiens; identical to SEQ ID NO: 421850

SEQ ID NO: 587968 - RNA, 64 nt, Homo Sapiens; identical to SEQ ID NO: 421851

SEQ ID NO: 587969 - RNA, 64 nt, Homo Sapiens; identical to SEQ ID NO: 421852

SEQ ID NO: 587970 - RNA, 64 nt, Homo Sapiens; identical to SEQ ID NO: 421853

SEQ ID NO: 587971 - RNA, 64 nt, Homo Sapiens; identical to SEQ ID NO: 421854

SEQ ID NO: 587972 - RNA, 64 nt, Homo Sapiens; identical to SEQ ID NO: 421855

SEQ ID NO: 587973 - RNA, 63 nt, Homo Sapiens; identical to SEQ ID NO: 421856

SEQ ID NO: 587974 - RNA, 64 nt, Homo Sapiens; identical to SEQ ID NO: 421857

SEQ ID NO: 587975 - RNA, 64 nt, Homo Sapiens; identical to SEQ ID NO: 421858

SEQ ID NO: 587976 - RNA, 64 nt, Homo Sapiens; identical to SEQ ID NO: 421859

SEQ ID NO: 587977 - RNA, 64 nt, Homo Sapiens; identical to SEQ ID NO: 421860

SEQ ID NO: 587978 - RNA, 64 nt, Homo Sapiens; identical to SEQ ID NO: 421861

SEQ ID NO: 587979 - RNA, 64 nt, Homo Sapiens; identical to SEQ ID NO: 421862

SEQ ID NO: 587980 - RNA, 64 nt, Homo Sapiens; identical to SEQ ID NO: 421863

SEQ ID NO: 587981 - RNA, 64 nt, Homo Sapiens; identical to SEQ ID NO: 421864

SEQ ID NO: 587982 - RNA, 64 nt, Homo Sapiens; identical to SEQ ID NO: 421865

SEQ ID NO: 587983 - RNA, 64 nt, Homo Sapiens; identical to SEQ ID NO: 421866

SEQ ID NO: 587984 - RNA, 64 nt, Homo Sapiens; identical to SEQ ID NO: 421867

SEQ ID NO: 587985 - RNA, 64 nt, Homo Sapiens; identical to SEQ ID NO: 421868

SEQ ID NO: 587986 - RNA, 64 nt, Homo Sapiens; identical to SEQ ID NO: 421869

SEQ ID NO: 587987 - RNA, 64 nt, Homo Sapiens; identical to SEQ ID NO: 421870

SEQ ID NO: 587988 - RNA, 64 nt, Homo Sapiens; identical to SEQ ID NO: 421871

SEQ ID NO: 587989 - RNA, 64 nt, Homo Sapiens; identical to SEQ ID NO: 421872

SEQ ID NO: 587990 - RNA, 64 nt, Homo Sapiens; identical to SEQ ID NO: 421873

SEQ ID NO: 587991 - RNA, 64 nt, Homo Sapiens
cccagcucguuguuaaacgugcugacggcaaggggcaauggagugaguuucccaacuaagaaac

SEQ ID NO: 587992 - RNA, 64 nt, Homo Sapiens
uggaggacugcaggaggagggcaggguugggugggcaauggaaggagggaggagagaaaugaau

SEQ ID NO: 587993 - RNA, 64 nt, Homo Sapiens
acaccuaaggucugccagccaggcuccuggcugggcaauggaagaugguguggcccuguuaguc

SEQ ID NO: 587994 - RNA, 64 nt, Homo Sapiens
aauguuaguauuucugcuuugaauccuugauauugcaauggaauuccuacuuuauuaaauguau

SEQ ID NO: 587995 - RNA, 64 nt, Homo Sapiens
ggacacucacuuuuucagagacucaacagucucugcaauggaguguggguccaccuuagccucu

SEQ ID NO: 587996 - RNA, 64 nt, Homo Sapiens
caaaagcccucaagucacaaaguaaaugguucaagcaauggaguacugggucacagggauuccu

SEQ ID NO: 587997 - RNA, 64 nt, Homo Sapiens
acaagaagcaccagggaaaguuuagagauuugcggcaauggaccgaagaacgggccaggaaguc

SEQ ID NO: 587998 - RNA, 64 nt, Homo Sapiens
acuuuuaguuccuaaaaagaaacauauuucaaaagcaauggaaucuagaauucuuauaacauga

SEQ ID NO: 587999 - RNA, 64 nt, Homo Sapiens
ccgaguggaaauguggaacuugaugccacccccugcaauggagagacugauuuaggagcauugu

SEQ ID NO: 588000 - RNA, 64 nt, Homo Sapiens
gaaugagugcgugcugggugaggcuuguguuaaggcaauggacuugugagaaaacagccccauc

SEQ ID NO: 588001 - RNA, 64 nt, Homo Sapiens
gcccagcccccacgucuuacggagccaggguugagcaauggagauuggacagcucucccagaca

SEQ ID NO: 588002 - RNA, 64 nt, Homo Sapiens
uacacgugcaugugccuuuauugugaacagugcugcaauggacauugauuccuuaucuuugcua

SEQ ID NO: 588003 - RNA, 64 nt, Homo Sapiens
uuagcauuauaagagagauuuucuggaggcuucagcaauggaaugauguagcagaagagaucau

SEQ ID NO: 588004 - RNA, 64 nt, Homo Sapiens
gaagaccucuuccugaaucaaagagcaagauggagcaauggagaggacuagggguccuuuguga

SEQ ID NO: 588005 - RNA, 64 nt, Homo Sapiens
cgcucuaggauucuaguuuggaguccaauucuuagcaauggaauacucaagucuauuacuugua

SEQ ID NO: 588006 - RNA, 64 nt, Homo Sapiens
aauagauaccacugaaugaaaaaggagguaucuagcaauggauaguaccuuagguucuuucuga

SEQ ID NO: 588007 - RNA, 64 nt, Homo Sapiens
agccuccugcucacuccaccgucaggcccuggccgcaauggacaggugagcccacucuucaccc

SEQ ID NO: 588008 - RNA, 64 nt, Homo Sapiens
guaugaagaaaccuggucuuugcagacaacugcugcaauggagacaugaauucaccgcaacaca

SEQ ID NO: 588009 - RNA, 64 nt, Homo Sapiens
ugauacugguuuuuguuaaacauuggaaguucaggcaauggaauaaauguaggaacauacagaa

SEQ ID NO: 588010 - RNA, 64 nt, Homo Sapiens
ucgcaucucagcggggcgcacauguuauccacaagcaauggaccuuuggggaagggggaguuuu

SEQ ID NO: 588011 - RNA, 64 nt, Homo Sapiens
gaguccccucccucaucccuuaggguccagaagagcaauggaggaagugacagcuaauguugca

SEQ ID NO: 588012 - RNA, 64 nt, Homo Sapiens
gauucccuacuaaugagaggcagggagagcaugggcaauggagacccaccaaugauccccaacc

SEQ ID NO: 588013 - RNA, 64 nt, Homo Sapiens
agcgacccucccugcagggcugggcuuuugcauggcaauggaugggacauuaaagggacaugua

SEQ ID NO: 588014 - RNA, 64 nt, Homo Sapiens
aacgccaaaaaaagaugaaagucuuguauccaaagcaauggaguacauguuuggcugguaguag

SEQ ID NO: 588015 - RNA, 64 nt, Homo Sapiens
gacccucacacuccuuuucucuuaacagcaaaaugcaauggaaggaagaaaaguuccaacaaag

SEQ ID NO: 588016 - RNA, 64 nt, Homo Sapiens
augcuuuggaugaguuaauuuuucugacuuaucagcaauggaagaaagaagcuacaggaggaac

SEQ ID NO: 588017 - RNA, 64 nt, Homo Sapiens
gguuuuuuuggcacuaacuuauaaagcaugaucugcaauggaaacuucagcagaauauuaagaa

SEQ ID NO: 588018 - RNA, 64 nt, Homo Sapiens
auuuugaucaaaaauguaaugaagacaagugaaugcaauggaagauuugucaagaugggauuug

SEQ ID NO: 588019 - RNA, 64 nt, Homo Sapiens
gaucccuuucaucccaacugccaucuuaaaggaagcaauggauggaaaacccacugccuagagg

SEQ ID NO: 588020 - RNA, 64 nt, Homo Sapiens
ugguuuauagucccuugcucagcaggccuugaaugcaauggaagauuugugccucuuggaucca

SEQ ID NO: 588021 - RNA, 64 nt, Homo Sapiens
cacugcuuccagcuggggcaauuccgaaucuggggcaauggaaugaggccuaguuuaaaucaca

SEQ ID NO: 588022 - RNA, 64 nt, Homo Sapiens
uuuauuugaaaaaaauucuccagacccauucuaugcaauggacagauguagaagcagccaguca

SEQ ID NO: 588023 - RNA, 64 nt, Homo Sapiens
ggucuaggauugagcaaaaaccuuucuuugugaggcaauggaguuuucucuguagcacauguua

SEQ ID NO: 588024 - RNA, 64 nt, Homo Sapiens
ugcuuggguuccucuugcuucccacacaaguccagcaauggaaaccugcacauucccucaugcu

SEQ ID NO: 588025 - RNA, 64 nt, Homo Sapiens
ucuuucuucaaacaaaagcuaaccccguuuuuaagcaauggaacgguuuuuaccacuguacucc

SEQ ID NO: 588026 - RNA, 64 nt, Homo Sapiens
uuguuguuuuucuuuuugauuuuuugcagcacuagcaauggacuugacacaaaagcaaguuuga

SEQ ID NO: 588027 - RNA, 64 nt, Homo Sapiens
guggcuggcuuggugguuauauccuggucggucggcaauggaggaaaucccauggggugggggu

SEQ ID NO: 588028 - RNA, 64 nt, Homo Sapiens
gcaggaggcagguuccuggagcaaggaagaccuggcaauggacacucagcacaggugucagggu

SEQ ID NO: 588029 - RNA, 64 nt, Homo Sapiens
ugugaguaaacccuacuggacagugacauaaaaggcaauggaauuuucuauaaacauuuucuca

SEQ ID NO: 588030 - RNA, 64 nt, Homo Sapiens
acagcccuuucgguuaugaagucccugcuugaaggcaauggaccuggggaagagacuaucacaa

SEQ ID NO: 588031 - RNA, 64 nt, Homo Sapiens
aaaugccaaaauuguccaucugccucugaguagggcaauggaaauaccaaaccuucugacuuug

SEQ ID NO: 588032 - RNA, 64 nt, Homo Sapiens
ugcucacaacuuaguguaauauaccagcuuguaugcaauggauuuucaaccagauaacauaccu

SEQ ID NO: 588033 - RNA, 64 nt, Homo Sapiens
cuuccauuuugaaaaguagagguugcuuaagcaagcaauggauaauaagagacuuuuccugagg

SEQ ID NO: 588034 - RNA, 64 nt, Homo Sapiens
ccaaaacguugauuugcauaauacagugguaugugcaauggauaaauugccguuauuucaaaaa

SEQ ID NO: 588035 - RNA, 64 nt, Homo Sapiens
uuuuuuuuugcccaagaggcaucucaguacuccagcaauggaggaagaauagagaauuuugccu

SEQ ID NO: 588036 - RNA, 64 nt, Homo Sapiens
auuauuagacucuaaaaagauguggucuguccacgcaauggaaccugaugaaugggaaauaaaa

SEQ ID NO: 588037 - RNA, 64 nt, Homo Sapiens
aacugacaaaucacaagugggauagccugcauuugcaauggaaucaaauuuaaagacugcucca

SEQ ID NO: 588038 - RNA, 64 nt, Homo Sapiens
cuccaacaccaccagguggagcucacaauccagagcaauggaucccuggguggccagacucugu

SEQ ID NO: 588039 - RNA, 64 nt, Homo Sapiens
acacuaccacugcuuuuugaagaauuaucauaaggcaauggagaauaaaagaaagaccaugauu

SEQ ID NO: 588040 - RNA, 64 nt, Homo Sapiens
gugaauugugaaauuacuuucagugguuuaagaagcaauggagaaaaugauaauacagcauaau

SEQ ID NO: 588041 - RNA, 64 nt, Homo Sapiens
uauuccuauucuuauuucuucauuuuaagucauugcaauggaaaguaauauuauaaaaugguaa

SEQ ID NO: 588042 - RNA, 64 nt, Homo Sapiens
auauuauagaagagaauauacacaacucagagaugcaauggauaauauaaaaagaguaccugag

SEQ ID NO: 588043 - RNA, 64 nt, Homo Sapiens
acacuacgcuacuugguugaccaacuuuagaggugcaauggaagagacgugggaucagaaucuu

SEQ ID NO: 588044 - RNA, 64 nt, Homo Sapiens
ucaugacacuacuguuaauacauugaggaagauugcaauggagaacuucacaggagauugaugg

SEQ ID NO: 588045 - RNA, 64 nt, Homo Sapiens
aucuuuuaaguuuuaaaaaauucuucuuaauucggcaauggaaucuuuccauauaacacuuauc

SEQ ID NO: 588046 - RNA, 64 nt, Homo Sapiens
uuuguacuguuuaauguucucuugaaccuaugaagcaauggauauuugacuuuaauuuauguaa

SEQ ID NO: 588047 - RNA, 64 nt, Homo Sapiens
uagcuuuuggauagaaauuuugaguggaucaacagcaauggaaugaggagugaggcuuuuuauu

SEQ ID NO: 588048 - RNA, 64 nt, Homo Sapiens
uuacauuuauuuucuucagccugugcaaaacaaagcaauggaaaaggaaacuaaaaaauauaca

SEQ ID NO: 588049 - RNA, 64 nt, Homo Sapiens
accguaaacuauggacucuaguucaguuuuauaugcaauggaucacuauuuuauuuaauuuuuu

SEQ ID NO: 588050 - RNA, 64 nt, Homo Sapiens
cuggcuuuuguaguuuugauaaagaccauugcaggcaauggaauugugccagagaaaucugauu

SEQ ID NO: 588051 - RNA, 64 nt, Homo Sapiens
uuaaugugccuaagaaauuuucucugaggcuuuagcaauggaaauuugauugcccauuguauaa

SEQ ID NO: 588052 - RNA, 64 nt, Homo Sapiens
cucuuuuuuccaucccuuuuuaauuuuuuuaacagcaauggaggaaguuaacaauuuuuaaugg

SEQ ID NO: 588053 - RNA, 64 nt, Homo Sapiens
gggggcuccugccugagguccucagaaucccacugcaauggacccaggcagcgccccaggaagc

SEQ ID NO: 588054 - RNA, 64 nt, Homo Sapiens
ccagauuuuaguaagucagauaggaaaguccuaggcaauggaguuuggcauuauuugcugaggg

SEQ ID NO: 588055 - RNA, 64 nt, Homo Sapiens
cuaugccuggauaccagucuaaauaguuuccugagcaauggauguucauuuaauuucugcagau

SEQ ID NO: 588056 - RNA, 64 nt, Homo Sapiens
caaaugaccuugcucuuggaaggaagaagucagagcaauggauaaguagggcacugaguacccu

SEQ ID NO: 588057 - RNA, 64 nt, Homo Sapiens
caaggggcugcagagcccagcucuugcugcggcugcaauggaggccugacggacaaguggaggc

SEQ ID NO: 588058 - RNA, 64 nt, Homo Sapiens
gaaaacgaucccuuccuucuggucaguaacaagugcaauggaaaugcaaggaagcagucucuuu

SEQ ID NO: 588059 - RNA, 64 nt, Homo Sapiens
uaguuucugcagaucaagcaaaagaaaaaguucagcaauggaacacuauaaacauauauugugu

SEQ ID NO: 588060 - RNA, 64 nt, Homo Sapiens
aaagcagcucagaaguauuguugcucaugguguggcaauggacugaacuguaaugaaaauguua

SEQ ID NO: 588061 - RNA, 64 nt, Homo Sapiens
uaagccauuugaauuuuuaaaaaauuucauacaugcaauggaauauagauauguauauacacau

SEQ ID NO: 588062 - RNA, 64 nt, Homo Sapiens
ugauguguuuugaccuuugcaggcgaguaaccaggcaauggaguggagugucuccuggagagag

SEQ ID NO: 588063 - RNA, 64 nt, Homo Sapiens
ggauugaagugcagaauuuggcauaucgaugcaugcaauggaaagaaaaaaaauuuguuaaaau

SEQ ID NO: 588064 - RNA, 64 nt, Homo Sapiens
acaauugaaggaguggcaaaaauccaaagugucugcaauggacacauuuggauucuuaaccuug

SEQ ID NO: 588065 - RNA, 64 nt, Homo Sapiens
gccccagcuauugcaccacugcucuccaagcugggcaauggagucagauucucuuucuuaaaaa

SEQ ID NO: 588066 - RNA, 64 nt, Homo Sapiens
uccuuaaaauaucagcacaaguugggggaggcaggcaauggaauauaauggaauauucuugaga

SEQ ID NO: 588067 - RNA, 64 nt, Homo Sapiens
auaguuuaaucauggccugaguaaccaucuuucagcaauggauuuugucuggauguggugccug

SEQ ID NO: 588068 - RNA, 64 nt, Homo Sapiens
cauuagccuuuuacaagaggauuguauuucaguggcaauggacaguggauuuuaagcugcuauu

SEQ ID NO: 588069 - RNA, 64 nt, Homo Sapiens
gaaaucauaacagacgguggaacggcuuucugcugcaauggagaaccugcugucugcuuagaag

SEQ ID NO: 588070 - RNA, 64 nt, Homo Sapiens
ccaccaaacugucuugaaggcugaagagaucaaagcaauggagaaguaccauucagaauaggau

SEQ ID NO: 588071 - RNA, 64 nt, Homo Sapiens
aaaacacgauuaaaaacguuuagaguaggcuguggcaauggaaucugcggggugguagaaaagg

SEQ ID NO: 588072 - RNA, 64 nt, Homo Sapiens
cucuauucaauaaaucgugcaaaacaagcaaugggcaauggauugaucuucgaugaaccugaca

SEQ ID NO: 588073 - RNA, 64 nt, Homo Sapiens
ugacauuuauuauaccaauuaagcuuggaauggggcaauggaugcauuucccaaaacgugugaa

SEQ ID NO: 588074 - RNA, 64 nt, Homo Sapiens
cccuuaagguauaguguguguugcaaaucacucugcaauggaaacuuuuauauucaggguaggu

SEQ ID NO: 588075 - RNA, 64 nt, Homo Sapiens
aaaacucaucuggcugcaucucaucagauguacugcaauggaacauucucugauagaauucugg

SEQ ID NO: 588076 - RNA, 64 nt, Homo Sapiens
gagacgaucuagcuauagauaguacuuuccuugugcaauggaggguggaaauucaccuagagug

SEQ ID NO: 588077 - RNA, 64 nt, Homo Sapiens
auuaucucacaaauauaaaauauaaagcaaugaagcaauggaguaacagaaggacccauggcag

SEQ ID NO: 588078 - RNA, 64 nt, Homo Sapiens
cucauggaagaaaguggguacuuacauugugauugcaauggauaagaaauucagaaacguaauu

SEQ ID NO: 588079 - RNA, 64 nt, Homo Sapiens
aaaauggacaaccucuugacagaauaguaaccaugcaauggaaauguuguuaguuucuggggaa

SEQ ID NO: 588080 - RNA, 64 nt, Homo Sapiens
cauuuuucuggagaucauuuaugucccagcugaagcaauggaaaacucccugaaaccucuuucu

SEQ ID NO: 588081 - RNA, 64 nt, Homo Sapiens
ugucugcacacaccagaaauggacauuuucauaugcaauggaaaacagccacaaaaaaaccuac

SEQ ID NO: 588082 - RNA, 64 nt, Homo Sapiens
auguagcaguugaugauuuucuaucuuaauaaaugcaauggaaguguuacuauaguagauuccu

SEQ ID NO: 588083 - RNA, 64 nt, Homo Sapiens
cacaugcacuguggcuuaaauaccauaccuacuagcaauggagguucagucaggcucucuucua

SEQ ID NO: 588084 - RNA, 64 nt, Homo Sapiens
ucaagaacagacucuggaguaaguuggagcucuugcaauggaauccaucccuucugaaaguagg

SEQ ID NO: 588085 - RNA, 64 nt, Homo Sapiens
aacaaguuauauaugcugacuuugaauauucaaagcaauggagagcuuuaaaaauugugaauua

SEQ ID NO: 588086 - RNA, 64 nt, Homo Sapiens
guguuuauugguggcagugacaccaaagauagaggcaauggauagaaauuuuuaaacuggaaag

SEQ ID NO: 588087 - RNA, 64 nt, Homo Sapiens
uuuaacuagcuuuaaguuuaaagauggaagcuaagcaauggaaaugcuauacguuuuugacauu

SEQ ID NO: 588088 - RNA, 64 nt, Homo Sapiens
ucuuucccucccaucucugccaucugucugucuggcaauggaaggagcuucagcaggagguccu

SEQ ID NO: 588089 - RNA, 64 nt, Homo Sapiens
ugaucucugcccagccccuuccuuuccaaaccaugcaauggaagagcccagaugggugaagauu

SEQ ID NO: 588090 - RNA, 64 nt, Homo Sapiens
auaccucuuucuucuucgcuuccuccucucccaagcaauggaaacuuuuacccauguaauucua

SEQ ID NO: 588091 - RNA, 64 nt, Homo Sapiens
cuaagugauuccuccagggugggaagcacggggagcaauggaaucagauggcucauucucuccu

SEQ ID NO: 588092 - RNA, 64 nt, Homo Sapiens
cacaauuuaaguauuaauacguguuuacaucauggcaauggaaacuccauccagcucuaucuuu

SEQ ID NO: 588093 - RNA, 64 nt, Homo Sapiens
uagaaaauaaaauucaagaaauccacaaaaauaugcaauggaugccccaaaauugaaucuguac

SEQ ID NO: 588094 - RNA, 64 nt, Homo Sapiens
cuggagugugacuggaaaaacagaagccagugaagcaauggaagucaaagugaagaaaauguaa

SEQ ID NO: 588095 - RNA, 64 nt, Homo Sapiens
aacauuuauucuuuuaaauauuuuuauaagauuggcaauggaaaaacacagccuggauugagaa

SEQ ID NO: 588096 - RNA, 64 nt, Homo Sapiens
aaaguugcaggaaguuaguucugcagagcuggcagcaauggauggggaaugagcuuccauuaug

SEQ ID NO: 588097 - RNA, 64 nt, Homo Sapiens
aggaaggaauaaagggagaaaaagaagguugagggcaauggacaccaggccagagcaaacagaa

SEQ ID NO: 588098 - RNA, 64 nt, Homo Sapiens
uggaagcugaaaauuacuugagagaaccuggcaugcaauggacaggagcaaggccaccaggucc

SEQ ID NO: 588099 - RNA, 64 nt, Homo Sapiens
ccucacagagcuccucuaucuguucgagagcucagcaauggaccuuuuggaauuuccuucguga

SEQ ID NO: 588100 - RNA, 64 nt, Homo Sapiens
ggcagcaaucccaauaaauucugacauguccuuggcaauggaagccuggguuggagauccugag

SEQ ID NO: 588101 - RNA, 64 nt, Homo Sapiens
aacauauagugaauuucuaauucuaauguucagugcaauggaagacauuuauuuggacaguaau

SEQ ID NO: 588102 - RNA, 64 nt, Homo Sapiens
uuuuguauuucagagaaaauucagguaccaggaugcaauggauuuauuugauucaggggaccug

SEQ ID NO: 588103 - RNA, 64 nt, Homo Sapiens
ccggcgaaacuagcaaccagggcgggccaguugggcaauggagcugcuggagcccgguacccac

SEQ ID NO: 588104 - RNA, 58 nt, Homo Sapiens
uaccagagaguauuguguagugcucucugcaauggaacaugugauuucaggguugccg

SEQ ID NO: 588105 - RNA, 64 nt, Homo Sapiens
guguggaugcucaccugugcccauacccccuguggcaauggaguuugaugggucaugggccaug

SEQ ID NO: 588106 - RNA, 64 nt, Homo Sapiens
cagaacuaagucugaaccgccaagaugcuaaauugcaauggaagcuuaacuuuaguuuauuucu

SEQ ID NO: 588107 - RNA, 64 nt, Homo Sapiens
aaagaaacauuuucucugaaauauauuauuaagggcaauggagauaaauuaauaguagaugugg

SEQ ID NO: 588108 - RNA, 64 nt, Homo Sapiens
auugugugcuggucuaagcaagcugagaucauuugcaauggaaaacacguaacuuguuuaaaag

SEQ ID NO: 588109 - RNA, 64 nt, Homo Sapiens
cuauuauaaggccauuuccuaaaaaaauuacaaggcaauggaaacuauaaaaagaaaaaaaugg

SEQ ID NO: 588110 - RNA, 64 nt, Homo Sapiens
gcauaaauuagaaacuucuagcuuuuugauuagggcaauggaguuggauacuggaaaauguaua

SEQ ID NO: 588111 - RNA, 64 nt, Homo Sapiens
gaaacagaaacagccuguagaggcaucuaguuuagcaauggaggccccagugcuaaaagauacc

SEQ ID NO: 588112 - RNA, 50 nt, Homo Sapiens
ggcugccauggaaggaagaagcaauggaguaugaagguaauccggaguga

SEQ ID NO: 588113 - RNA, 64 nt, Homo Sapiens
gaaggagaagcucugaagccagaaggagcuuccugcaauggaagauuacccacccaaggcuucu

SEQ ID NO: 588114 - RNA, 64 nt, Homo Sapiens
ggauauguuaaaagaaacaucuuuuggagggaaagcaauggaugucgucuuuugcuaccuuugu

SEQ ID NO: 588115 - RNA, 64 nt, Homo Sapiens
uuuuaauguaauaaaucuuuugccucaggguuuggcaauggaaugcaccggucagagcccugag

SEQ ID NO: 588116 - RNA, 64 nt, Homo Sapiens
gaaccucugcuccccacacaaggaggcugcagaagcaauggaguggaggaggaggagucaggug

SEQ ID NO: 588117 - RNA, 64 nt, Homo Sapiens
acuuguguuacuaauuuguauaacccauaucugugcaauggaauauaaauaucacaaaguuguu

SEQ ID NO: 588118 - RNA, 64 nt, Homo Sapiens
ccuauugacuccuacaguucuuucccuucucuuggcaauggaagcuccaguacccagauuggag

SEQ ID NO: 588119 - RNA, 64 nt, Homo Sapiens
agauguguguagggccacaagaaugagaaagggggcaauggagugacaggugaccugcucaggu

SEQ ID NO: 588120 - RNA, 64 nt, Homo Sapiens
gcaggggagaguguuccuuucacacaggauaccagcaauggaugugaaucugagguaucaaaca

SEQ ID NO: 588121 - RNA, 64 nt, Homo Sapiens
gugucugagaaacaaaucuuuguucucuuaggcugcaauggaacaacuuuaccaggguuuuggc

SEQ ID NO: 588122 - RNA, 64 nt, Homo Sapiens
auguaaacuggauugagaaauucucagugauucugcaauggauuuuuuuuuaaugcagaaguaa

SEQ ID NO: 588123 - RNA, 64 nt, Homo Sapiens
uucgaagguaggaagagaguaaaggcugcgacgagcaauggaacagaacauuuaguucguuuug

SEQ ID NO: 588124 - RNA, 64 nt, Homo Sapiens
guacuuugcucauacgagcuuucauguucagcaugcaauggaaucaugcuuguccaugugaaau

SEQ ID NO: 588125 - RNA, 64 nt, Homo Sapiens
uucgagcuggcaguucuguucacguccauugccggcaauggaugucuuuguggugaugauccuu

SEQ ID NO: 588126 - RNA, 63 nt, Homo Sapiens
auuguaacaggcaaaacuagaugguggaagacagcaauggagaccuguccucauggcugugac

SEQ ID NO: 588127 - RNA, 50 nt, Homo Sapiens
acaagaaaaaggccaccuaggcaauggaagcccucaaagaagucggaaug

SEQ ID NO: 588128 - RNA, 64 nt, Homo Sapiens
aacuauuauaaugcaaauacuuuuuaacuuagaggcaauggaaaaauaaaaguugacuguacua

SEQ ID NO: 588129 - RNA, 64 nt, Homo Sapiens
aaagauuugcauuuuauuaugucugucuuaucaugcaauggaaaugaugcuuuuuguaaguaug

SEQ ID NO: 588130 - RNA, 64 nt, Homo Sapiens
gggugccacagccuuuugggaugggggugagcgugcaauggaggcuggggguggcgaggugccg

SEQ ID NO: 588131 - RNA, 64 nt, Homo Sapiens
ugcagggccagaccugccugcauucugagacaaagcaauggacgguccgcagaagcagaccuca

SEQ ID NO: 588132 - RNA, 64 nt, Homo Sapiens
aaaaugggaagcaaugguuuuucaucccagcauugcaauggagaauuuaguuagugauaagaug

SEQ ID NO: 588133 - RNA, 64 nt, Homo Sapiens
gcguuucccccucucauuauaagggggcagcugagcaauggaacugcaggcccaaggcguuggu

SEQ ID NO: 588134 - RNA, 64 nt, Homo Sapiens
agaacagacaacuaaugauuggggaaauggugaagcaauggaaauuaacauuuggggccugaua

SEQ ID NO: 588135 - RNA, 64 nt, Homo Sapiens
aaaaaacagaugguagggagacuagagaggaacagcaauggauacacaucuuguuuucauaaac

SEQ ID NO: 588136 - RNA, 64 nt, Homo Sapiens
ucaucguucuaguggccaugcucacuagcccuuugcaauggagaaauugaggcagggaauagac

SEQ ID NO: 588137 - RNA, 64 nt, Homo Sapiens
gcuggcccuuuguuccuaaggauguuauuuguaugcaauggauugaauuccugcaccuguguuu

SEQ ID NO: 588138 - RNA, 64 nt, Homo Sapiens
gcaaacuuucaaaggugguuauuauaacauacuagcaauggaccuuacuacuguaaggaaugua

SEQ ID NO: 588139 - RNA, 64 nt, Homo Sapiens
acauuauuauuaguggauuucuuaauaggaagaugcaauggagaugacaaauuuggaaaaacca

SEQ ID NO: 588140 - RNA, 64 nt, Homo Sapiens
guaaagcccuuuggcucuugcgugaacugcaggggcaauggaugaggacuuagggccagcccug

SEQ ID NO: 588141 - RNA, 64 nt, Homo Sapiens
gccacuagaaaucuucaggcucaggcauauguaugcaauggaaaaggaaauuuuuuagguaagu

SEQ ID NO: 588142 - RNA, 64 nt, Homo Sapiens
uggaaaacauuuuucguaaaagacaacuguagaggcaauggauacucgugugccaaagaaacau

SEQ ID NO: 588143 - RNA, 64 nt, Homo Sapiens
gcugagguuugugaaacaguaggauucucuuuuggcaauggagaauugcaucugaugguucaag

SEQ ID NO: 588144 - RNA, 64 nt, Homo Sapiens
ugaggugggauuuucccuccccacagugcacugagcaauggaggguggugagggagccaugcug

SEQ ID NO: 588145 - RNA, 64 nt, Homo Sapiens
augagacucagauucuaugacuggaacuaaauaugcaauggaucgucugcucauuguuuuguug

SEQ ID NO: 588146 - RNA, 64 nt, Homo Sapiens
uaacaaauauugugcauuuuaucacucaaaguaagcaauggaggguaacauaaaacauguuuuu

SEQ ID NO: 588147 - RNA, 64 nt, Homo Sapiens
ugcgaugcuaagugcuuuucuccucugagucuuagcaauggacaauuccaauaccuccacacag

SEQ ID NO: 588148 - RNA, 64 nt, Homo Sapiens
ggugcggcacggaggagcgcaugcgugcuuaucugcaauggaggcgcucuggaggcuguggugu

SEQ ID NO: 588149 - RNA, 64 nt, Homo Sapiens
cgugagaagucaacaacuuagccaccacuuccccgcaauggaccauguaacaaauaccucagca

SEQ ID NO: 588150 - RNA, 64 nt, Homo Sapiens
auggguuauauaaagacugcuuugauuuuugacagcaauggagaucagcuguccuuuuuucuug

SEQ ID NO: 588151 - RNA, 64 nt, Homo Sapiens
ugauucuaguuuauucuaaucaauuagcaguuaugcaauggaccuguggcucccuggugcaaaa

SEQ ID NO: 588152 - RNA, 64 nt, Homo Sapiens
aaagcucagagacugguuugaaugguuuaauuuugcaauggaucauguccaugccagguguuac

SEQ ID NO: 588153 - RNA, 64 nt, Homo Sapiens
ccaucccuguuauagaagcuuagagagccagccagcaauggaaccuucugguuccugcgccaau

SEQ ID NO: 588154 - RNA, 64 nt, Homo Sapiens
cuuuuuugaaaaauuauugcaaggaaacauaguagcaauggauauuuugaguguuauaaggugg

SEQ ID NO: 588155 - RNA, 64 nt, Homo Sapiens
ucccuucugggagguaagauauauuauuuaggaagcaauggaauccgcuucuucauguagaugu

SEQ ID NO: 588156 - RNA, 64 nt, Homo Sapiens
uucaugaaaugguccacauaccacugagaacuaugcaauggagugggcaccccuucugcccccc

SEQ ID NO: 588157 - RNA, 64 nt, Homo Sapiens
aacugaaagugaugaacuggaguuagagaaucuggcaauggaugucaacauaccuuggccagca

SEQ ID NO: 588158 - RNA, 64 nt, Homo Sapiens
aaaaaugaugauuuaaaauguguuuuaaauaguugcaauggauuauuuuuauauuuguuuuaga

SEQ ID NO: 588159 - RNA, 64 nt, Homo Sapiens
agcaguuaccucauucaaagacaauauuucacaagcaauggaaaccggacauacgcagcaccau

SEQ ID NO: 588160 - RNA, 64 nt, Homo Sapiens
gcaaaugcgucccugaggagucuugggcaugauugcaauggagggacgggccuccugauaaucg

SEQ ID NO: 588161 - RNA, 64 nt, Homo Sapiens
aggccaccagcagcagcugucaagggaggcuagggcaauggagcugacuguguagugucaccca

SEQ ID NO: 588162 - RNA, 64 nt, Homo Sapiens
ucaggcucugagauaaguaugacaagugacaggggcaauggauccauuucaauacccaaagaaa

SEQ ID NO: 588163 - RNA, 64 nt, Homo Sapiens
ccaucccucuaaagccugccgaugcacagcaaaagcaauggaccuguaacugcuaaucaagggu

SEQ ID NO: 588164 - RNA, 64 nt, Homo Sapiens; identical to SEQ ID NO: 215532

SEQ ID NO: 588165 - RNA, 64 nt, Homo Sapiens; identical to SEQ ID NO: 215533

SEQ ID NO: 588166 - RNA, 64 nt, Homo Sapiens; identical to SEQ ID NO: 215534

SEQ ID NO: 588167 - RNA, 64 nt, Homo Sapiens; identical to SEQ ID NO: 215535

SEQ ID NO: 588168 - RNA, 64 nt, Homo Sapiens; identical to SEQ ID NO: 215536

SEQ ID NO: 588169 - RNA, 64 nt, Homo Sapiens; identical to SEQ ID NO: 215537

SEQ ID NO: 588170 - RNA, 64 nt, Homo Sapiens; identical to SEQ ID NO: 215538

SEQ ID NO: 588171 - RNA, 64 nt, Homo Sapiens; identical to SEQ ID NO: 215539

SEQ ID NO: 588172 - RNA, 64 nt, Homo Sapiens; identical to SEQ ID NO: 212558

SEQ ID NO: 588173 - RNA, 64 nt, Homo Sapiens; identical to SEQ ID NO: 212559

SEQ ID NO: 588174 - RNA, 64 nt, Homo Sapiens; identical to SEQ ID NO: 212560

SEQ ID NO: 588175 - RNA, 64 nt, Homo Sapiens; identical to SEQ ID NO: 212561

SEQ ID NO: 588176 - RNA, 64 nt, Homo Sapiens; identical to SEQ ID NO: 212562

SEQ ID NO: 588177 - RNA, 64 nt, Homo Sapiens; identical to SEQ ID NO: 212563

SEQ ID NO: 588178 - RNA, 64 nt, Homo Sapiens; identical to SEQ ID NO: 212564

SEQ ID NO: 588179 - RNA, 64 nt, Homo Sapiens; identical to SEQ ID NO: 212565

SEQ ID NO: 588180 - RNA, 53 nt, Homo Sapiens
caacaucaacaaauaaauaagaaagcaaaaagaucugggauauguguuggaaa

SEQ ID NO: 588181 - RNA, 64 nt, Homo Sapiens
ucucaucaucucuguuauacaccuguaucaugaaagcaaaaagaaguaaacaucaggagucagc

SEQ ID NO: 588182 - RNA, 52 nt, Homo Sapiens
agaccgacgaggaugacuagacagcaaaaaaggaaaaguuaaacuaaaaaaa

SEQ ID NO: 588183 - RNA, 64 nt, Homo Sapiens
uaaucucaaaggagaaaaaaaaccuuguaaaaaaagcaaaaaugacaacagaaaaacaaucuua

SEQ ID NO: 588184 - RNA, 64 nt, Homo Sapiens
aagucauuguugucuucaaguguaccaucugccuagcaaaaaauugcuacaaacuuucucuuau

SEQ ID NO: 588185 - RNA, 64 nt, Homo Sapiens
cauuagcuuuugauuauaaagcucaacuaguauaagcaaaaauauaacaucuagaagcacaguu

SEQ ID NO: 588186 - RNA, 64 nt, Homo Sapiens
cuaacuaaaaccaaaaaaaccuguccagugugcaagcaaaaaguuguuccuucucaaggcgauu

SEQ ID NO: 588187 - RNA, 64 nt, Homo Sapiens
uucaguguccuuaaggguucuguaguguuaucaaagcaaaaagaaaaugcugcauaaaaauacc

SEQ ID NO: 588188 - RNA, 64 nt, Homo Sapiens
aacucaguguaagagaaggcgagcagcugaaaggagcaaaaaaguccaacagacaggauugugu

SEQ ID NO: 588189 - RNA, 64 nt, Homo Sapiens
uuacuguucuaaugcugaaguuuuuuaguaauuuagcaaaaacaucuuucuuucuuuuuuuuuu

SEQ ID NO: 588190 - RNA, 64 nt, Homo Sapiens
agaagaagaaacagcagaaaaaaagcaaaagaaaagcaaaaaaaaagcaaaaaucaggcugaga

SEQ ID NO: 588191 - RNA, 64 nt, Homo Sapiens
aggcugagaaaaagcaaaagagaaaaagaagccaagcaaaaaucaugguauaaagaggaaacca

SEQ ID NO: 588192 - RNA, 64 nt, Homo Sapiens
gaaugauauuuuaggaauaacggacuuuuaaagaagcaaaaaaaaagacugaauuuccuugcuu

SEQ ID NO: 588193 - RNA, 64 nt, Homo Sapiens
uucauguuuaauuuguauuuguaaaaaaacaaaaagcaaaaaaauucccaaaacccagauaaca

SEQ ID NO: 588194 - RNA, 64 nt, Homo Sapiens
ggcucgccuucccucucccauagaucagagacucagcaaaaacaauagcccucuggagaccgcc

SEQ ID NO: 588195 - RNA, 64 nt, Homo Sapiens
uguacucgcuuugugguucauuuuuacagacaaaagcaaaaaccucaagcagguacgcuguaca

SEQ ID NO: 588196 - RNA, 64 nt, Homo Sapiens
cucuguccagaggcuuuaaaacuggugcaauuacagcaaaaagggauucuguagcuuuaacuug

SEQ ID NO: 588197 - RNA, 64 nt, Homo Sapiens
uuguaaaccacaucuuuuuugcacuuuuuuuauaagcaaaaacgugccguuuaaaccacuggau

SEQ ID NO: 588198 - RNA, 64 nt, Homo Sapiens
aacaucuuuguacauuuaagucuguauuauaauaagcaaaaagauuguguguauguauguuuaa

SEQ ID NO: 588199 - RNA, 64 nt, Homo Sapiens
gacauuuggacagauccugucauuguuuaagcugagcaaaaaaccacacaaaaguuguguaaga

SEQ ID NO: 588200 - RNA, 64 nt, Homo Sapiens
uuccugacauaguaaaguuugcuuucauaacugcagcaaaaaaggucaacuugccaagucacug

SEQ ID NO: 588201 - RNA, 64 nt, Homo Sapiens
cuguauucuccuccaacaucaccacuagcguaaaagcaaaaagcuuuuacaaaacacagccaaa

SEQ ID NO: 588202 - RNA, 64 nt, Homo Sapiens
auggaagaauguguuauguucaucuuguaaucauagcaaaaagucugcaaaccccagggucaag

SEQ ID NO: 588203 - RNA, 64 nt, Homo Sapiens
ugacuuggauauaugguugaagaaucaaaacaaaagcaaaaaaaaaaagcaaaaaaagaaaaga

SEQ ID NO: 588204 - RNA, 64 nt, Homo Sapiens
ugguugaagaaucaaaacaaaagcaaaaaaaaaaagcaaaaaaagaaaagagaaaaaaagaaaa

SEQ ID NO: 588205 - RNA, 64 nt, Homo Sapiens
aaauuugucucuauagcuaagugagauucaguuaagcaaaaauguuagauugccuuuucaugca

SEQ ID NO: 588206 - RNA, 64 nt, Homo Sapiens
ucucaaacugaggagcaacauauuucucaaagacagcaaaaacccauuagaaugucugggaaaa

SEQ ID NO: 588207 - RNA, 64 nt, Homo Sapiens
cacaaaugggaucuaauuaaacaauugcaacagaagcaaaaauuucaugacgaagacgccaaaa

SEQ ID NO: 588208 - RNA, 64 nt, Homo Sapiens
acaaagcuggaggcaucacgguaaggcaauccuaagcaaaaagaaaucuaaagaaauauugaua

SEQ ID NO: 588209 - RNA, 64 nt, Homo Sapiens
gaugcuggauucagauauaagaccucauuuacaaagcaaaaagaaacaucuggauuucauccuu

SEQ ID NO: 588210 - RNA, 64 nt, Homo Sapiens
aaaaagcuaaugucuucuaagccagcuggucuucagcaaaaaaaggauugacauacccaaagua

SEQ ID NO: 588211 - RNA, 64 nt, Homo Sapiens
cauuacauuggcaaauaagguuuggaagcagaagagcaaaaaaaagauauuguuaaaaugaggc

SEQ ID NO: 588212 - RNA, 64 nt, Homo Sapiens
ugguauuuguuaaauacguuuguuuuuauugcagagcaaaaauaaaucaaauuagaagcaauac

SEQ ID NO: 588213 - RNA, 64 nt, Homo Sapiens
aggugaugggcagaucuuuucuuuaaaauaaaaaagcaaaaacucuugugguaccuagucagau

SEQ ID NO: 588214 - RNA, 64 nt, Homo Sapiens
caaauuaccuaggcugagguuagagagauuggccagcaaaaacugugggaagaugaacuuuguc

SEQ ID NO: 588215 - RNA, 64 nt, Homo Sapiens
ggagaagacaacagugagcuuagaauaucuauaaagcaaaaaauguagucucuuguuuaaaaaa

SEQ ID NO: 588216 - RNA, 64 nt, Homo Sapiens
ggaaugcaaggauacaaaacuuuagcaugcuuugagcaaaaauuuaaacuuacuggaaucuuuu

SEQ ID NO: 588217 - RNA, 64 nt, Homo Sapiens
gagcaagauaugacuauagcccacaacccaaagaagcaaaaauucguuuuuaucuuuugaaauc

SEQ ID NO: 588218 - RNA, 64 nt, Homo Sapiens
guuugacuguguggcacaggggggcauuuggcacagcaaaaagcccacccaggacuuagccuca

SEQ ID NO: 588219 - RNA, 64 nt, Homo Sapiens
cccugccuaaggaacugcagagagguggcaaaucagcaaaaaggacaccaggcucuucuuggcc

SEQ ID NO: 588220 - RNA, 64 nt, Homo Sapiens
acucucaacauuucccuuauuugguucagcuuuuagcaaaaagggcuacaguucacccugcaga

SEQ ID NO: 588221 - RNA, 64 nt, Homo Sapiens
uucaucaagaaaaaguggaaccagcugucccuccagcaaaaacagcagcccuaauagcagccca

SEQ ID NO: 588222 - RNA, 64 nt, Homo Sapiens
gagcaaagggaggcuccggcugccccagauuggcagcaaaaauaagccgucaaguaguaagaag

SEQ ID NO: 588223 - RNA, 64 nt, Homo Sapiens
ccaaaaaagagcccaaaaagccaaagcaauccuaagcaaaaagaacaaagcuggaggcaucgca

SEQ ID NO: 588224 - RNA, 64 nt, Homo Sapiens
ucaugacaaagaucccaaaaauaauuguaacgaaagcaaaaauugacaaaugggacaugauuaa

SEQ ID NO: 588225 - RNA, 64 nt, Homo Sapiens
uuaaauucuauugaaaaaggaaaaucagcaauucagcaaaaaauaaauaaaaaauaaaaaugua

SEQ ID NO: 588226 - RNA, 64 nt, Homo Sapiens
gugugaccgaccccuuggccaaaaaaaaacaaaaagcaaaaaacaaaaaccuacccuguucugg

SEQ ID NO: 588227 - RNA, 64 nt, Homo Sapiens
uauagcguaaauacuuauuuucucuuuuuagcagagcaaaaaaaaaugucaguuuaauaagugg

SEQ ID NO: 588228 - RNA, 64 nt, Homo Sapiens
gacuucaauguuguggacaauuuuguaauauuuuagcaaaaagagaaaguguuuacuggauuca

SEQ ID NO: 588229 - RNA, 64 nt, Homo Sapiens
agugcucugcuuuuauuugguuguauuucuauuuagcaaaaaugaaaaauuuuacauagaucag

SEQ ID NO: 588230 - RNA, 64 nt, Homo Sapiens
ucaccuuuuaguuuuaguuuuccacagacuggguagcaaaaaaacacgcguuucauucaauguc

SEQ ID NO: 588231 - RNA, 64 nt, Homo Sapiens
aauaagugcuauaaagaaauauaaaggguuugggagcaaaaagagggaguggaucuauuuuaga

SEQ ID NO: 588232 - RNA, 64 nt, Homo Sapiens
uuaaaauguucauuaauaaaguuguuggacgggaagcaaaaaaaaaaaguuguuuaagauaaau

SEQ ID NO: 588233 - RNA, 64 nt, Homo Sapiens
gacauacacuagagacaccuuguaguauuuugggagcaaaaaaauuauuuucucuuaacaagac

SEQ ID NO: 588234 - RNA, 64 nt, Homo Sapiens
acacacacacacacuuucuauaaaacuugaaaauagcaaaaacccucaacuguuguaaaucaug

SEQ ID NO: 588235 - RNA, 64 nt, Homo Sapiens
aaaaauguaguuuuuguuugucucuaaaugaacuagcaaaaaaaccuaaacagcaguuaaguug

SEQ ID NO: 588236 - RNA, 64 nt, Homo Sapiens
ucccauuguacuggacugagaggacuugggaaaaagcaaaaaggcaauugaucagauuacuaaa

SEQ ID NO: 588237 - RNA, 64 nt, Homo Sapiens
aaaauguugccuuuguccaauaaaguuaagacuuagcaaaaauuuacauuucaacccaucuggc

SEQ ID NO: 588238 - RNA, 64 nt, Homo Sapiens
aacagcuaguauauaauauauaaaauacaauugaagcaaaaaauuguuuuuuuaacaaaagaga

SEQ ID NO: 588239 - RNA, 62 nt, Homo Sapiens
ggaucaugugugucagcaggagauuuauugugccacacaaaagcuauuguucugcuauuacc

SEQ ID NO: 588240 - RNA, 62 nt, Homo Sapiens
cauuauaagaagcaaaccagaaguacuguaauccacacaacaaguaaaugugaaccuugucu

SEQ ID NO: 588241 - RNA, 62 nt, Homo Sapiens
aaaagcagucuuagagagugugaaacuugucaccacacaauaccggaucaucagcacaauug

SEQ ID NO: 588242 - RNA, 62 nt, Homo Sapiens
uccgcaguuuauucuggauggaugugggaaaaccacacaaaucuuauuuguuuuaauguaca

SEQ ID NO: 588243 - RNA, 62 nt, Homo Sapiens
aaguucaugggaauuuugugcagguuaagaauccacacaacccuuucuuagguaauucacug

SEQ ID NO: 588244 - RNA, 62 nt, Homo Sapiens
ggauuauccacauaaucaaauaaaugagauguccacacaaauuauccuacauuauuggaaaa

SEQ ID NO: 588245 - RNA, 62 nt, Homo Sapiens
cuuacauacugauauuuagaugacuggaaaagccacacaacugguuacaaauccauaacaaa

SEQ ID NO: 588246 - RNA, 62 nt, Homo Sapiens
gauuuuuaaguacgaaguaauaucacauugacccacacaaaaggaucugcaucuagccugca

SEQ ID NO: 588247 - RNA, 62 nt, Homo Sapiens
acacuuccucuaggaugccaggaugcagugucccacacaaggccugggcuguguaugccugc

SEQ ID NO: 588248 - RNA, 60 nt, Homo Sapiens; identical to SEQ ID NO: 579611

SEQ ID NO: 588249 - RNA, 64 nt, Homo Sapiens
acguggauauaccucuucaggauggccuccuugcugucuuuauugaagagcugcccacccagag

SEQ ID NO: 588250 - RNA, 64 nt, Homo Sapiens
gcacucuuuuuucuccauauuaguuaacaagaggugucuuuaggcccuggauguuaccaucuca

SEQ ID NO: 588251 - RNA, 64 nt, Homo Sapiens
acauaugugaugucgaugucucugucuuuuuuuuugucuuuaaaaaauaauuggcagcaacugu

SEQ ID NO: 588252 - RNA, 64 nt, Homo Sapiens
agaaacugugaauuuccaaauaaaucugaacacuugucuuuauuaauuacuggcucuucugucu

SEQ ID NO: 588253 - RNA, 64 nt, Homo Sapiens
augcaauugugcucuucauuuaggaugcuuucauugucuuuaagauguguuaggaaugucaaca

SEQ ID NO: 588254 - RNA, 64 nt, Homo Sapiens
aaaaagccugugaaaggugucuucuuugacuuaaugucuuuaaaaguauccagagauacuacaa

SEQ ID NO: 588255 - RNA, 64 nt, Homo Sapiens
uucucaauaaagaaauuacuuuccuuaggaaccaugucuuuauucauggucauuuuuagcccuu

SEQ ID NO: 588256 - RNA, 64 nt, Homo Sapiens
agaguucuugacaugugguauagucaucuuuguaugucuuuagcugggagcucagguacucuuu

SEQ ID NO: 588257 - RNA, 64 nt, Homo Sapiens
cauauggcaucucucaacuuaagucugacuaccaugucuuuaaaauagaaaugugauuacaaag

SEQ ID NO: 588258 - RNA, 64 nt, Homo Sapiens
ccuucaaaaauuauacuaugaaauccuuagaaauugucuuuauaguagguauuaacuagaauau

SEQ ID NO: 588259 - RNA, 64 nt, Homo Sapiens
gaggguaguuucuccagucuccccagucuguuggugucuuuauaggaaacuauaaagcagagca

SEQ ID NO: 588260 - RNA, 64 nt, Homo Sapiens
ugucuuuauaggaaacuauaaagcagagcaguggugucuuuagaggaaacucauucaagucagg

SEQ ID NO: 588261 - RNA, 64 nt, Homo Sapiens
acaacaacacauaaggaaucaacccccugcaaauugucuuuaaaaccuuuucaguccuucuccc

SEQ ID NO: 588262 - RNA, 64 nt, Homo Sapiens
uuaaaucauuagcauuaauccuaguccugugauuugucuuuauacaauugaucuugaaguauuu

SEQ ID NO: 588263 - RNA, 64 nt, Homo Sapiens
gcaaguuccaguaaaccacagcuggauuauugucugucuuuauaugugagcaaaguuuguagcu

SEQ ID NO: 588264 - RNA, 64 nt, Homo Sapiens
guauuuuuguucucugguaauguacagugaaaauugucuuuacuuuuuuccuuucuuuaagcug

SEQ ID NO: 588265 - RNA, 64 nt, Homo Sapiens
agaagcagugaaggcacuggaacauuaaauuaaaugucuuuacaaaaauaaauaaauaugcaau

SEQ ID NO: 588266 - RNA, 64 nt, Homo Sapiens
aaaauaugucucaaaagaaccaaauguuaauuucugucuuuauaaaucaaaccugcugaugcua

SEQ ID NO: 588267 - RNA, 64 nt, Homo Sapiens
uuuucuaugugauugugccgugguaccaguguuuugucuuuagcccaggccuaagggcuauguu

SEQ ID NO: 588268 - RNA, 64 nt, Homo Sapiens
agaaagaauuguauuucuuugucuuucuggaaauugucuuuagaguacccauagggaaaggcag

SEQ ID NO: 588269 - RNA, 64 nt, Homo Sapiens
aaccccuuaaagauaauguacaugcuucaugucaugucuuuaaaauaauuuaaucaacuuuauu

SEQ ID NO: 588270 - RNA, 64 nt, Homo Sapiens
gucgaucuuuaaguuguuacuauuguguuauucaugucuuuaaaucagauaccaaauauuuuuu

SEQ ID NO: 588271 - RNA, 64 nt, Homo Sapiens
aaaaaaaugcugcaaaaccaauacagugagaccuugucuuuaaaacugcauuucagccuggggg

SEQ ID NO: 588272 - RNA, 64 nt, Homo Sapiens
aaaaguuuaaaaauuagcuuacauggugaaauccugucuuuaccguucgagaucagccuaggca

SEQ ID NO: 588273 - RNA, 64 nt, Homo Sapiens
uauguuuuagggccauacauuuuaccugaggguaugucuuuagcuagaagauauuuucaguguc

SEQ ID NO: 588274 - RNA, 64 nt, Homo Sapiens
ugaggguaugucuuuagcuagaagauauuuucagugucuuuaccuugugaauuacauuuuuaua

SEQ ID NO: 588275 - RNA, 64 nt, Homo Sapiens
uuaguguguuaaaaccuuauuguuuuauaagaaaugucuuuauuucacuagguuugaaugauca

SEQ ID NO: 588276 - RNA, 64 nt, Homo Sapiens
caaugcuuuucucuugugaguucuguggguggccugucuuuaaguaucuuucaauucugaaaaa

SEQ ID NO: 588277 - RNA, 64 nt, Homo Sapiens
guauuuuaauagcgucauaacuagaacugaauuuugucuuuaugauuuuuaaagaaaaguuuug

SEQ ID NO: 588278 - RNA, 64 nt, Homo Sapiens
ugacucaagacuuccagagccucaaaugagaaaaugucuuuauuaaauguagaaagugauccau

SEQ ID NO: 588279 - RNA, 64 nt, Homo Sapiens
caaugugaauagucaucuccuaauuuguuucuucugucuuuauguuuuucuauaaccuggauuu

SEQ ID NO: 588280 - RNA, 64 nt, Homo Sapiens
ccauagugucacuuccacacaauuauuuauuucaugucuuuacuggaccugaaauuuaaacugc

SEQ ID NO: 588281 - RNA, 64 nt, Homo Sapiens
uuaaccuuugauagaaccauauguuuauuuuucuugucuuuauuacucuuuguuauuugaaaac

SEQ ID NO: 588282 - RNA, 64 nt, Homo Sapiens
ucuguaucuguagacggcucagauugaauuucacugucuuuaauaagugaggugugucacaaug

SEQ ID NO: 588283 - RNA, 64 nt, Homo Sapiens
gcagaagacaguguguugccacacacacucugacugucuuuauuacacucacauacacacacac

SEQ ID NO: 588284 - RNA, 64 nt, Homo Sapiens
auuuuuugcuggugcuucuuccaggucauuucucugucuuuagugugguauuugaaucauuuug

SEQ ID NO: 588285 - RNA, 64 nt, Homo Sapiens
gguaagauaugugugaccuucuuggaaugaauauugucuuuagaauacccuuugauaagcugag

SEQ ID NO: 588286 - RNA, 64 nt, Homo Sapiens
gucacauauggaauuuugagaaaauaaagcaugcugucuuuaggaauuuuuauacuucuuuguc

SEQ ID NO: 588287 - RNA, 64 nt, Homo Sapiens
aggugagaaagaaaguuaagguuaaggcuagaguugucuuuaaggguuaggguuaggaccaggu

SEQ ID NO: 588288 - RNA, 64 nt, Homo Sapiens
guuauggggucuuuccccuguauacuaccaguugugucuuuagauggcacacaaguccaaauaa

SEQ ID NO: 588289 - RNA, 64 nt, Homo Sapiens
auaaaaaaaaaaaucagagauuacaucugcuuuuugucuuuaaaauuuaugcacauuauaaugg

SEQ ID NO: 588290 - RNA, 64 nt, Homo Sapiens
uuuuaucauuugaacugauagcaaaauuuuaauuugucuuuauuguauaauuuuaaauuuuaau

SEQ ID NO: 588291 - RNA, 64 nt, Homo Sapiens
caucgucuuuuaguuccaacaaagaaaggugccaugucuuuacuagacugaggagcccucucgc

SEQ ID NO: 588292 - RNA, 64 nt, Homo Sapiens
gauggcaauagucauuaaaaacauagaaaaaugaugucuuuaaguggagaauuguggaaggauu

SEQ ID NO: 588293 - RNA, 64 nt, Homo Sapiens
ucuuaaauuguuugguccuagggaaaggauagugugucuuuaacuacagguauugcacugggug

SEQ ID NO: 588294 - RNA, 64 nt, Homo Sapiens
uguuaaagaugcacuauccuuauuggagcagguuugucuuuaaagaccaguuucugugggcgug

SEQ ID NO: 588295 - RNA, 64 nt, Homo Sapiens
uauucccaauccuaggcaccacugaguuguuuucugucuuuauaaguuuuucuuucuacaucuu

SEQ ID NO: 588296 - RNA, 64 nt, Homo Sapiens
agugucuucaaauccucaccaacauccaggauugugucuuuaugauuauagccauuuuuguagg

SEQ ID NO: 588297 - RNA, 64 nt, Homo Sapiens
uuaaucuccuaauccugucaugauuucuuaugccugucuuuacuuuccccaaucaauacccuug

SEQ ID NO: 588298 - RNA, 64 nt, Homo Sapiens
gcaaucucuaaacacaaauuuaauuuccuaugccugucuuuaccuccccaaauuaauacuuuua

SEQ ID NO: 588299 - RNA, 64 nt, Homo Sapiens
cauaaauugguuuuagcuaaacacuuacuaguagugucuuuaaauuauuuaaucaaccuugucu

SEQ ID NO: 588300 - RNA, 64 nt, Homo Sapiens
cauuaaauuaaauauguuauaagguggcuuuacuugucuuuauaaaaauaaauauaucuacuaa

SEQ ID NO: 588301 - RNA, 64 nt, Homo Sapiens; identical to SEQ ID NO: 251943

SEQ ID NO: 588302 - RNA, 64 nt, Homo Sapiens; identical to SEQ ID NO: 251944

SEQ ID NO: 588303 - RNA, 64 nt, Homo Sapiens; identical to SEQ ID NO: 251945

SEQ ID NO: 588304 - RNA, 64 nt, Homo Sapiens; identical to SEQ ID NO: 251946

SEQ ID NO: 588305 - RNA, 64 nt, Homo Sapiens; identical to SEQ ID NO: 251947

SEQ ID NO: 588306 - RNA, 64 nt, Homo Sapiens; identical to SEQ ID NO: 251948

SEQ ID NO: 588307 - RNA, 64 nt, Homo Sapiens; identical to SEQ ID NO: 251949

SEQ ID NO: 588308 - RNA, 64 nt, Homo Sapiens; identical to SEQ ID NO: 251950

SEQ ID NO: 588309 - RNA, 64 nt, Homo Sapiens; identical to SEQ ID NO: 251951

SEQ ID NO: 588310 - RNA, 64 nt, Homo Sapiens; identical to SEQ ID NO: 251952

SEQ ID NO: 588311 - RNA, 64 nt, Homo Sapiens; identical to SEQ ID NO: 251953

SEQ ID NO: 588312 - RNA, 64 nt, Homo Sapiens; identical to SEQ ID NO: 251954

SEQ ID NO: 588313 - RNA, 64 nt, Homo Sapiens; identical to SEQ ID NO: 251955

SEQ ID NO: 588314 - RNA, 64 nt, Homo Sapiens; identical to SEQ ID NO: 251956

SEQ ID NO: 588315 - RNA, 64 nt, Homo Sapiens
auuuuuccucccaauacccacccuucucucucgagggaucuaggcaccuuggucccagugucuu

SEQ ID NO: 588316 - RNA, 64 nt, Homo Sapiens
uuccuuuuguucucacugccaaacugccuguccugggaucuaguuaucuuggcccugcacucuc

SEQ ID NO: 588317 - RNA, 64 nt, Homo Sapiens
aaaggagacauagcccaaacccuggcuuauucuugggaucuacugauugcgggcucugcaagac

SEQ ID NO: 588318 - RNA, 64 nt, Homo Sapiens
uccucccuugcccuugcaaucuccagcaaaaggugggaucuaggaagaaagaauccaguguaga

SEQ ID NO: 588319 - RNA, 64 nt, Homo Sapiens; identical to SEQ ID NO: 529719

SEQ ID NO: 588320 - RNA, 64 nt, Homo Sapiens; identical to SEQ ID NO: 529720

SEQ ID NO: 588321 - RNA, 64 nt, Homo Sapiens; identical to SEQ ID NO: 529721

SEQ ID NO: 588322 - RNA, 64 nt, Homo Sapiens; identical to SEQ ID NO: 529722

SEQ ID NO: 588323 - RNA, 64 nt, Homo Sapiens; identical to SEQ ID NO: 529723

SEQ ID NO: 588324 - RNA, 64 nt, Homo Sapiens; identical to SEQ ID NO: 529724

SEQ ID NO: 588325 - RNA, 64 nt, Homo Sapiens; identical to SEQ ID NO: 529725

SEQ ID NO: 588326 - RNA, 64 nt, Homo Sapiens; identical to SEQ ID NO: 529726

SEQ ID NO: 588327 - RNA, 64 nt, Homo Sapiens; identical to SEQ ID NO: 74837

SEQ ID NO: 588328 - RNA, 64 nt, Homo Sapiens; identical to SEQ ID NO: 74838

SEQ ID NO: 588329 - RNA, 64 nt, Homo Sapiens; identical to SEQ ID NO: 74839

SEQ ID NO: 588330 - RNA, 64 nt, Homo Sapiens; identical to SEQ ID NO: 74840

SEQ ID NO: 588331 - RNA, 64 nt, Homo Sapiens; identical to SEQ ID NO: 74841

SEQ ID NO: 588332 - RNA, 64 nt, Homo Sapiens; identical to SEQ ID NO: 74842

SEQ ID NO: 588333 - RNA, 64 nt, Homo Sapiens; identical to SEQ ID NO: 74843

SEQ ID NO: 588334 - RNA, 64 nt, Homo Sapiens
aguacaauggcagcuacuucgacagaggagccaagggcggcagccgccucugcacaccggaagg

SEQ ID NO: 588335 - RNA, 64 nt, Homo Sapiens
gugaguggucuucaaacgagggucccgauccccggggcggcaggaagggggccgacuccacgcu

SEQ ID NO: 588336 - RNA, 64 nt, Homo Sapiens
auaggauguaacauaaugaaacacaccugucuaggggcggcaaucaacagucuuacacagagag

SEQ ID NO: 588337 - RNA, 64 nt, Homo Sapiens
uggugagucucgaccccgcaagcucgagauggaggggcggcagggauccucagcgggcagcgga

SEQ ID NO: 588338 - RNA, 64 nt, Homo Sapiens
cagggguuauccggccccacugugagcccggugagggcggcaggcgcugugacaguuuccccgg

SEQ ID NO: 588339 - RNA, 64 nt, Homo Sapiens
agggagguuugugagagcgaggaggguuggggaggggcggcaggcuuaagaacacaaagcgggg

SEQ ID NO: 588340 - RNA, 64 nt, Homo Sapiens
cggucggcucgcucugggcgacucgggcgggggagggcggcaguugcagccacugccugacuuc

SEQ ID NO: 588341 - RNA, 64 nt, Homo Sapiens
aggcccugggcaaggggauggggcugugggggcggggcggcaugggcuucagaaguaucugcac

SEQ ID NO: 588342 - RNA, 64 nt, Homo Sapiens
ggccuggagauccuccugcagaggacuguagggagggcggcaggggacucagccuucagacaga

SEQ ID NO: 588343 - RNA, 64 nt, Homo Sapiens
ccuuucccagagggcaccacgcaagggcagagcugggcggcauccacagccagagaggcagagg

SEQ ID NO: 588344 - RNA, 64 nt, Homo Sapiens
aacaggauaacccuugaauguagcagccccgggagggcggcacaggucgggcgcaggauucagc

SEQ ID NO: 588345 - RNA, 64 nt, Homo Sapiens
acgccgugccccuccuggcccauacgccuugccagggcggcaggauugucacaccguuuuagga

SEQ ID NO: 588346 - RNA, 64 nt, Homo Sapiens
acagauggcccggcuagccgccuggacugcaggggggcggcagcagcggcgguggcagugggug

SEQ ID NO: 588347 - RNA, 50 nt, Homo Sapiens
accagccagcagcagcccaagggcggcagggucgucugaagaagcucuga

SEQ ID NO: 588348 - RNA, 64 nt, Homo Sapiens
gugcgggugagccgggaacaaccugacuggggaugggcggcacucugcgaggccugcccuccaa

SEQ ID NO: 588349 - RNA, 64 nt, Homo Sapiens
gaucaggacgaaggaccaccgucgguccucagcagggcggcagccuccuccuggcuguccgggg

SEQ ID NO: 588350 - RNA, 64 nt, Homo Sapiens
cgagccccuguuucuccucccugguggcccugcggggcggcaucgcguguguggccuaauccac

SEQ ID NO: 588351 - RNA, 64 nt, Homo Sapiens
uuugauaugucugcaugcaaaguggaacagaguugggcggcaaugacagaagagcuuccuuggc

SEQ ID NO: 588352 - RNA, 64 nt, Homo Sapiens
acuagcuagacuuccacauagucccaccccaagugggcggcaguguuccuggcaugaccaggau

SEQ ID NO: 588353 - RNA, 64 nt, Homo Sapiens
ugcgagaccaaauaucauuugguagaggaagccagggcggcaaaccuuccagaaacuuuauaug

SEQ ID NO: 588354 - RNA, 64 nt, Homo Sapiens
ugccuuggggacauccugccgccuccagacgugcgggcggcacauggcccuggcaggacccagg

SEQ ID NO: 588355 - RNA, 64 nt, Homo Sapiens
uagaauuuagcagacagcuguuccacgcgggccagggcggcaugaagaagucccgccgcuacgu

SEQ ID NO: 588356 - RNA, 64 nt, Homo Sapiens
agaugggguggagggggccaccggggcagggagggggcggcaaggggggaaugggaguugucuc

SEQ ID NO: 588357 - RNA, 64 nt, Homo Sapiens
caauuguguccauucugaggucucuccagugggagggcggcagcuccugucccuggguucaggc

SEQ ID NO: 588358 - RNA, 64 nt, Homo Sapiens
acaagaggcucaacuucaucacugaguacaucaagggcggcacgcuccggggcaucaucaagag

SEQ ID NO: 588359 - RNA, 64 nt, Homo Sapiens
gcaucaacgcgcagaccuaauguccggugugcuugggcggcauccaucgacgugaagucccacg

SEQ ID NO: 588360 - RNA, 64 nt, Homo Sapiens
gucacuucugccuguugcucggaugacagcccacgggcggcacaaugacacaguagccaccggu

SEQ ID NO: 588361 - RNA, 64 nt, Homo Sapiens
agaagaggccauagcugcuccagccggggcuccggggcggcagcagagcuggcacaccgauucu

SEQ ID NO: 588362 - RNA, 55 nt, Homo Sapiens
gcggaaggugcuccucaggcacccagggcggcaggucugcaacucggaacucuga

SEQ ID NO: 588363 - RNA, 64 nt, Homo Sapiens
acaccaccccagcccccaccggauaaagacagaagggcggcaacacgggggcuggagaaggccu

SEQ ID NO: 588364 - RNA, 64 nt, Homo Sapiens
gaguuccugagcccuuucugugaagaaggcccacgggcggcacgccgaagucagucggaguacu

SEQ ID NO: 588365 - RNA, 64 nt, Homo Sapiens
uuacugcucagaauuuggaguccccagugccccggggcggcauuggggucucauuccuuucugu

SEQ ID NO: 588366 - RNA, 64 nt, Homo Sapiens
gguacaucgugagcaaggagccugcauucccagggggcggcagggacagcauguaaggucuuag

SEQ ID NO: 588367 - RNA, 64 nt, Homo Sapiens
cuggguucauuccccggcccccaggccuccacgggggcggcaggcuggcugaccccuggccggc

SEQ ID NO: 588368 - RNA, 64 nt, Homo Sapiens
ccgaagggucugcuggguguggcuuccugguagagggcggcauguggcgagcuccuaggccucu

SEQ ID NO: 588369 - RNA, 64 nt, Homo Sapiens
ugaguguuuuugguuagagcuguuguuggacgcagggcggcacaaacuguaaguccuguuuggu

SEQ ID NO: 588370 - RNA, 64 nt, Homo Sapiens
gggggcucggggcagaggggcggugucuuguagcgggcggcagcgccagcgccccucugucagg

SEQ ID NO: 588371 - RNA, 64 nt, Homo Sapiens
gugggcagcuguggcagagcagcgacccgcggcggggcggcauccccagcugguucgggccgug

SEQ ID NO: 588372 - RNA, 64 nt, Homo Sapiens
aaccuguugcuccaggaugcauucugauaggagggggcggcagggcugggccuugugacaaucu

SEQ ID NO: 588373 - RNA, 64 nt, Homo Sapiens
ugugcaggugacguccgggcugccgucccagcaggggcggcaggagagagaggcuggccuacac

SEQ ID NO: 588374 - RNA, 64 nt, Homo Sapiens
cacacgcgaaaguaucaccaacccggcccacguagggcggcacugagcagcaccucgaguuaga

SEQ ID NO: 588375 - RNA, 64 nt, Homo Sapiens
cggugggccgagggccgggugggaugcuauguuggggcggcaagccacgugcagguggagcucu

SEQ ID NO: 588376 - RNA, 64 nt, Homo Sapiens
aucagagugaaagcagaggcugagaacagaaggugggcggcaggguauagacagaacccagggu

SEQ ID NO: 588377 - RNA, 64 nt, Homo Sapiens
cugucugcugcugagugauuggcugagacccccagggcggcagccaccuggugagcccuagcag

SEQ ID NO: 588378 - RNA, 64 nt, Homo Sapiens
cccuaucaucaacuguccaggaggagaggguauggggcggcagacacaaauuccuaagggggaa

SEQ ID NO: 588379 - RNA, 64 nt, Homo Sapiens
uaacucuguccugaagagugggacaaaugcagccgggcggcagaucuagcgggagcucaaaggg

SEQ ID NO: 588380 - RNA, 64 nt, Homo Sapiens
cuccuaccuggggacuccucaaaccacuugccuggggcggcaugaacccucuugccauccugau

SEQ ID NO: 588381 - RNA, 64 nt, Homo Sapiens
ccccucugcacaggccucccgaaguccugaagcugggcggcagugaggugucaccccccuccag

SEQ ID NO: 588382 - RNA, 64 nt, Homo Sapiens
ccccagggcccacccccaggaaggccacagugcugggcggcaucccugcagaggaaagacagga

SEQ ID NO: 588383 - RNA, 64 nt, Homo Sapiens
agcagaagcggggucuccgucuggucgggggcgggggcggcaggugaccagcaggcagccucau

SEQ ID NO: 588384 - RNA, 64 nt, Homo Sapiens
ccgggcguggaccacccgcccuggcaguugaauggggcggcaauugcggggcccaccuuagacc

SEQ ID NO: 588385 - RNA, 64 nt, Homo Sapiens
augaaaaugacugccagcaggcaccuuuuucacagggcggcaggggcagaaaaaggagaagcag

SEQ ID NO: 588386 - RNA, 64 nt, Homo Sapiens
cuccagggagaaggaccucaaaucgccacucuuugggcggcaggugcgguccccacggccggcu

SEQ ID NO: 588387 - RNA, 64 nt, Homo Sapiens
agcccaggggccccaggccucacgggguccaggcgggcggcagccaggcccucugagugagccc

SEQ ID NO: 588388 - RNA, 57 nt, Homo Sapiens
uggggcuacccucgacuuugggccgcagggcggcaccuggucuccuggaacugguga

SEQ ID NO: 588389 - RNA, 64 nt, Homo Sapiens
uguguggucguuccaaacugccccagggcuuugggggcggcacuugggguuucugggaaugaca

SEQ ID NO: 588390 - RNA, 64 nt, Homo Sapiens
caauacuuugauugcauauuagacauucuuaacagggcggcagucuaguguugaaaguuuuauu

SEQ ID NO: 588391 - RNA, 64 nt, Homo Sapiens
ggcaacuucagugucccuguacaggccccucacggggcggcagagggcugggucuggggccgcc

SEQ ID NO: 588392 - RNA, 64 nt, Homo Sapiens
ggcugggcuccagcagguggggccucuccucagagggcggcacacgugcccagcugucccccca

SEQ ID NO: 588393 - RNA, 64 nt, Homo Sapiens
ccacccaggcaccgaggcaaaaggggggagaugugggcggcaaguggcgauucuaguuaauaaa

SEQ ID NO: 588394 - RNA, 64 nt, Homo Sapiens
agcgggagccacgcagacccaaagcgcccuuccagggcggcagccacgagaaaagccaguggag

SEQ ID NO: 588395 - RNA, 64 nt, Homo Sapiens
ccucaggccgggggagccacagcguggccacaaggggcggcacuaaggagccggccugcugggc

SEQ ID NO: 588396 - RNA, 64 nt, Homo Sapiens
uugcuggggcuguccugguugcagccaucguccugggcggcacgggcuggggauuuaaguaaga

SEQ ID NO: 588397 - RNA, 64 nt, Homo Sapiens
agucugucuggauugaguccuacagugucagauagggcggcaaaugccaaagcagggaaacagg

SEQ ID NO: 588398 - RNA, 64 nt, Homo Sapiens
aucccugaccuccuggagacaccaccugcuuuccgggcggcacugugaugggagcugguggcga

SEQ ID NO: 588399 - RNA, 64 nt, Homo Sapiens
gccguuccggaggccugguccguguugagugugugggcggcaguugagugcccccgcgugccug

SEQ ID NO: 588400 - RNA, 64 nt, Homo Sapiens
gugcuggugccucuggccccgcagagccgagucggggcggcaucgcaggcccacaggggccacc

SEQ ID NO: 588401 - RNA, 64 nt, Homo Sapiens
gaggacuguugacauccaaggacagagaggacgugggcggcagauggaggcacacagcugcaga

SEQ ID NO: 588402 - RNA, 64 nt, Homo Sapiens
gcuuucagccucugggucugagucauggccgggugggcggcacagccuucuccacuggccggag

SEQ ID NO: 588403 - RNA, 64 nt, Homo Sapiens
auguggcagaggggucucagucgugcuaggcaucgggcggcagcgccgacagcccuucccucgc

SEQ ID NO: 588404 - RNA, 64 nt, Homo Sapiens
gggugggagucgggguguggcaggccgcgguggggggcggcaguggcuccgcgcacucacccgg

SEQ ID NO: 588405 - RNA, 52 nt, Homo Sapiens
ggaugaccaugagcgugugauggggcggcagccccgggccucucugcgggcc

SEQ ID NO: 588406 - RNA, 64 nt, Homo Sapiens
gcuccccugugacugcauccucacugcagggcgggggcggcaccccgucuccgggccauggcgu

SEQ ID NO: 588407 - RNA, 64 nt, Homo Sapiens
gcguccagggcagccucccuguguggccccgggcgggcggcaccggggugacucggagcagcag

SEQ ID NO: 588408 - RNA, 64 nt, Homo Sapiens
gggcacggccuccagcuucccccggcugugaggagggcggcaggaagaagggggcacugcccgg

SEQ ID NO: 588409 - RNA, 64 nt, Homo Sapiens
gacacugcaccucuccuuucuaggugggaggagagggcggcaaucccauccacuauuaaugcac

SEQ ID NO: 588410 - RNA, 64 nt, Homo Sapiens
cuccacuucggcgagagguuucuuaccccagggagggcggcagguggggacauguaggaugggc

SEQ ID NO: 588411 - RNA, 64 nt, Homo Sapiens
gggacagccauaacacccccgggacaguaggucugggcggcaccacugggaacucuggacuuga

SEQ ID NO: 588412 - RNA, 64 nt, Homo Sapiens
cccacccagggcucccuccuggagcaucccaggcgggcggcacgccaacagccccccccuugaa

SEQ ID NO: 588413 - RNA, 64 nt, Homo Sapiens
cagaguucccugaagugggagcccagauaaaacugggcggcagccccacgagaauaugucacuu

SEQ ID NO: 588414 - RNA, 64 nt, Homo Sapiens
uggcuccagaacuccugugccaggcgggagggaagggcggcacuggagagaugggcccaucauu

SEQ ID NO: 588415 - RNA, 64 nt, Homo Sapiens
uaaauaggaauuucuauuuuggccugucgcacacgggcggcauuacaugcagaagcaaauauca

SEQ ID NO: 588416 - RNA, 64 nt, Homo Sapiens
ccuuuugccauggaggucugggagagagagcagagggcggcagggcuaaguuggugaucauugg

SEQ ID NO: 588417 - RNA, 64 nt, Homo Sapiens
aaccaacaacacagcuggggcgggcccuguggcugggcggcagccaguccagcucuugcuuccu

SEQ ID NO: 588418 - RNA, 64 nt, Homo Sapiens
acccgaggaggccggacucagacacauaggcggggggcggcaccuggcaucagcaauacgcagu

SEQ ID NO: 588419 - RNA, 64 nt, Homo Sapiens
cugcacagagcuccugggccggggcuaggucaucgggcggcaccucucggacgugagugcaacu

SEQ ID NO: 588420 - RNA, 64 nt, Homo Sapiens
cagagagcgcacccuacucuuuccgugacgaugagggcggcaaaaacagacauuucuuccuuca

SEQ ID NO: 588421 - RNA, 50 nt, Homo Sapiens
agagccacauccaggccugagggcggcaccccagcccugcccuugcuucc

SEQ ID NO: 588422 - RNA, 64 nt, Homo Sapiens; identical to SEQ ID NO: 159322

SEQ ID NO: 588423 - RNA, 64 nt, Homo Sapiens; identical to SEQ ID NO: 159323

SEQ ID NO: 588424 - RNA, 64 nt, Homo Sapiens; identical to SEQ ID NO: 159324

SEQ ID NO: 588425 - RNA, 64 nt, Homo Sapiens; identical to SEQ ID NO: 159325

SEQ ID NO: 588426 - RNA, 64 nt, Homo Sapiens; identical to SEQ ID NO: 159326

SEQ ID NO: 588427 - RNA, 64 nt, Homo Sapiens; identical to SEQ ID NO: 159327

SEQ ID NO: 588428 - RNA, 64 nt, Homo Sapiens; identical to SEQ ID NO: 159328

SEQ ID NO: 588429 - RNA, 64 nt, Homo Sapiens; identical to SEQ ID NO: 159329

SEQ ID NO: 588430 - RNA, 64 nt, Homo Sapiens; identical to SEQ ID NO: 159330

SEQ ID NO: 588431 - RNA, 64 nt, Homo Sapiens; identical to SEQ ID NO: 159331

SEQ ID NO: 588432 - RNA, 64 nt, Homo Sapiens; identical to SEQ ID NO: 159332

SEQ ID NO: 588433 - RNA, 64 nt, Homo Sapiens; identical to SEQ ID NO: 159333

SEQ ID NO: 588434 - RNA, 64 nt, Homo Sapiens; identical to SEQ ID NO: 159334

SEQ ID NO: 588435 - RNA, 64 nt, Homo Sapiens; identical to SEQ ID NO: 159335

SEQ ID NO: 588436 - RNA, 64 nt, Homo Sapiens; identical to SEQ ID NO: 159336

SEQ ID NO: 588437 - RNA, 64 nt, Homo Sapiens; identical to SEQ ID NO: 159337

SEQ ID NO: 588438 - RNA, 64 nt, Homo Sapiens; identical to SEQ ID NO: 159338

SEQ ID NO: 588439 - RNA, 64 nt, Homo Sapiens; identical to SEQ ID NO: 159339

SEQ ID NO: 588440 - RNA, 64 nt, Homo Sapiens; identical to SEQ ID NO: 159340

SEQ ID NO: 588441 - RNA, 64 nt, Homo Sapiens; identical to SEQ ID NO: 159341

SEQ ID NO: 588442 - RNA, 64 nt, Homo Sapiens; identical to SEQ ID NO: 159342

SEQ ID NO: 588443 - RNA, 64 nt, Homo Sapiens; identical to SEQ ID NO: 159343

SEQ ID NO: 588444 - RNA, 64 nt, Homo Sapiens; identical to SEQ ID NO: 159344

SEQ ID NO: 588445 - RNA, 64 nt, Homo Sapiens; identical to SEQ ID NO: 159345

SEQ ID NO: 588446 - RNA, 64 nt, Homo Sapiens; identical to SEQ ID NO: 159346

SEQ ID NO: 588447 - RNA, 64 nt, Homo Sapiens; identical to SEQ ID NO: 159347

SEQ ID NO: 588448 - RNA, 64 nt, Homo Sapiens; identical to SEQ ID NO: 159348

SEQ ID NO: 588449 - RNA, 64 nt, Homo Sapiens; identical to SEQ ID NO: 159349

SEQ ID NO: 588450 - RNA, 64 nt, Homo Sapiens; identical to SEQ ID NO: 159350

SEQ ID NO: 588451 - RNA, 64 nt, Homo Sapiens; identical to SEQ ID NO: 159351

SEQ ID NO: 588452 - RNA, 64 nt, Homo Sapiens; identical to SEQ ID NO: 159352

SEQ ID NO: 588453 - RNA, 64 nt, Homo Sapiens; identical to SEQ ID NO: 159353

SEQ ID NO: 588454 - RNA, 64 nt, Homo Sapiens; identical to SEQ ID NO: 159354

SEQ ID NO: 588455 - RNA, 64 nt, Homo Sapiens; identical to SEQ ID NO: 159355

SEQ ID NO: 588456 - RNA, 64 nt, Homo Sapiens; identical to SEQ ID NO: 159356

SEQ ID NO: 588457 - RNA, 64 nt, Homo Sapiens; identical to SEQ ID NO: 159357

SEQ ID NO: 588458 - RNA, 64 nt, Homo Sapiens; identical to SEQ ID NO: 159358

SEQ ID NO: 588459 - RNA, 64 nt, Homo Sapiens; identical to SEQ ID NO: 159359

SEQ ID NO: 588460 - RNA, 64 nt, Homo Sapiens; identical to SEQ ID NO: 159360

SEQ ID NO: 588461 - RNA, 64 nt, Homo Sapiens; identical to SEQ ID NO: 159361

SEQ ID NO: 588462 - RNA, 64 nt, Homo Sapiens; identical to SEQ ID NO: 159362

SEQ ID NO: 588463 - RNA, 64 nt, Homo Sapiens; identical to SEQ ID NO: 159363

SEQ ID NO: 588464 - RNA, 64 nt, Homo Sapiens; identical to SEQ ID NO: 159364

SEQ ID NO: 588465 - RNA, 64 nt, Homo Sapiens; identical to SEQ ID NO: 159365

SEQ ID NO: 588466 - RNA, 64 nt, Homo Sapiens; identical to SEQ ID NO: 159366

SEQ ID NO: 588467 - RNA, 64 nt, Homo Sapiens; identical to SEQ ID NO: 159365

SEQ ID NO: 588468 - RNA, 64 nt, Homo Sapiens; identical to SEQ ID NO: 159368

SEQ ID NO: 588469 - RNA, 64 nt, Homo Sapiens; identical to SEQ ID NO: 159369

SEQ ID NO: 588470 - RNA, 64 nt, Homo Sapiens; identical to SEQ ID NO: 159370

SEQ ID NO: 588471 - RNA, 64 nt, Homo Sapiens; identical to SEQ ID NO: 159371

SEQ ID NO: 588472 - RNA, 64 nt, Homo Sapiens; identical to SEQ ID NO: 159372

SEQ ID NO: 588473 - RNA, 64 nt, Homo Sapiens; identical to SEQ ID NO: 159373

SEQ ID NO: 588474 - RNA, 64 nt, Homo Sapiens; identical to SEQ ID NO: 159374

SEQ ID NO: 588475 - RNA, 64 nt, Homo Sapiens; identical to SEQ ID NO: 159375

SEQ ID NO: 588476 - RNA, 64 nt, Homo Sapiens; identical to SEQ ID NO: 159376

SEQ ID NO: 588477 - RNA, 64 nt, Homo Sapiens; identical to SEQ ID NO: 159377

SEQ ID NO: 588478 - RNA, 64 nt, Homo Sapiens; identical to SEQ ID NO: 318507

SEQ ID NO: 588479 - RNA, 64 nt, Homo Sapiens; identical to SEQ ID NO: 318508

SEQ ID NO: 588480 - RNA, 64 nt, Homo Sapiens; identical to SEQ ID NO: 318509

SEQ ID NO: 588481 - RNA, 64 nt, Homo Sapiens; identical to SEQ ID NO: 318510

SEQ ID NO: 588482 - RNA, 64 nt, Homo Sapiens; identical to SEQ ID NO: 318511

SEQ ID NO: 588483 - RNA, 64 nt, Homo Sapiens; identical to SEQ ID NO: 318512

SEQ ID NO: 588484 - RNA, 64 nt, Homo Sapiens; identical to SEQ ID NO: 318513

SEQ ID NO: 588485 - RNA, 64 nt, Homo Sapiens; identical to SEQ ID NO: 318514

SEQ ID NO: 588486 - RNA, 64 nt, Homo Sapiens; identical to SEQ ID NO: 318515

SEQ ID NO: 588487 - RNA, 64 nt, Homo Sapiens; identical to SEQ ID NO: 318516

SEQ ID NO: 588488 - RNA, 64 nt, Homo Sapiens; identical to SEQ ID NO: 318517

SEQ ID NO: 588489 - RNA, 64 nt, Homo Sapiens; identical to SEQ ID NO: 318518

SEQ ID NO: 588490 - RNA, 64 nt, Homo Sapiens; identical to SEQ ID NO: 318519

SEQ ID NO: 588491 - RNA, 64 nt, Homo Sapiens; identical to SEQ ID NO: 318520

SEQ ID NO: 588492 - RNA, 64 nt, Homo Sapiens; identical to SEQ ID NO: 318521

SEQ ID NO: 588493 - RNA, 64 nt, Homo Sapiens; identical to SEQ ID NO: 318522

SEQ ID NO: 588494 - RNA, 57 nt, Homo Sapiens; identical to SEQ ID NO: 318523

SEQ ID NO: 588495 - RNA, 64 nt, Homo Sapiens; identical to SEQ ID NO: 318524

SEQ ID NO: 588496 - RNA, 64 nt, Homo Sapiens; identical to SEQ ID NO: 318525

SEQ ID NO: 588497 - RNA, 64 nt, Homo Sapiens; identical to SEQ ID NO: 532235

SEQ ID NO: 588498 - RNA, 64 nt, Homo Sapiens; identical to SEQ ID NO: 532236

SEQ ID NO: 588499 - RNA, 64 nt, Homo Sapiens; identical to SEQ ID NO: 532237

SEQ ID NO: 588500 - RNA, 63 nt, Homo Sapiens; identical to SEQ ID NO: 532238

SEQ ID NO: 588501 - RNA, 50 nt, Homo Sapiens; identical to SEQ ID NO: 532239

SEQ ID NO: 588502 - RNA, 64 nt, Homo Sapiens; identical to SEQ ID NO: 532240

SEQ ID NO: 588503 - RNA, 64 nt, Homo Sapiens; identical to SEQ ID NO: 532241

SEQ ID NO: 588504 - RNA, 61 nt, Homo Sapiens; identical to SEQ ID NO: 532242

SEQ ID NO: 588505 - RNA, 64 nt, Homo Sapiens; identical to SEQ ID NO: 532243

SEQ ID NO: 588506 - RNA, 64 nt, Homo Sapiens; identical to SEQ ID NO: 532244

SEQ ID NO: 588507 - RNA, 64 nt, Homo Sapiens; identical to SEQ ID NO: 532245

SEQ ID NO: 588508 - RNA, 64 nt, Homo Sapiens; identical to SEQ ID NO: 532246

SEQ ID NO: 588509 - RNA, 64 nt, Homo Sapiens; identical to SEQ ID NO: 532247

SEQ ID NO: 588510 - RNA, 64 nt, Homo Sapiens; identical to SEQ ID NO: 532248

SEQ ID NO: 588511 - RNA, 64 nt, Homo Sapiens; identical to SEQ ID NO: 532249

SEQ ID NO: 588512 - RNA, 64 nt, Homo Sapiens; identical to SEQ ID NO: 532250

SEQ ID NO: 588513 - RNA, 64 nt, Homo Sapiens; identical to SEQ ID NO: 532251

SEQ ID NO: 588514 - RNA, 64 nt, Homo Sapiens; identical to SEQ ID NO: 532252

SEQ ID NO: 588515 - RNA, 64 nt, Homo Sapiens; identical to SEQ ID NO: 532253

SEQ ID NO: 588516 - RNA, 64 nt, Homo Sapiens; identical to SEQ ID NO: 532254

SEQ ID NO: 588517 - RNA, 64 nt, Homo Sapiens; identical to SEQ ID NO: 532255

SEQ ID NO: 588518 - RNA, 64 nt, Homo Sapiens; identical to SEQ ID NO: 532256

SEQ ID NO: 588519 - RNA, 64 nt, Homo Sapiens; identical to SEQ ID NO: 138645

SEQ ID NO: 588520 - RNA, 64 nt, Homo Sapiens; identical to SEQ ID NO: 138646

SEQ ID NO: 588521 - RNA, 64 nt, Homo Sapiens; identical to SEQ ID NO: 138647

SEQ ID NO: 588522 - RNA, 64 nt, Homo Sapiens; identical to SEQ ID NO: 138648

SEQ ID NO: 588523 - RNA, 64 nt, Homo Sapiens; identical to SEQ ID NO: 138649

SEQ ID NO: 588524 - RNA, 64 nt, Homo Sapiens; identical to SEQ ID NO: 138650

SEQ ID NO: 588525 - RNA, 64 nt, Homo Sapiens
gaaacuugauuugagauuuuuaugccugugacuuccuuggaaaucaaauguaaaguuuaauuga

SEQ ID NO: 588526 - RNA, 64 nt, Homo Sapiens
ugcauaguucccaugcacgcugggcaaugagaauccuuggaaacauuggugaugcuaucaguuu

SEQ ID NO: 588527 - RNA, 64 nt, Homo Sapiens
accuaauccacagaaaguaaugucuuuccccuccccuuggaauuuuuguuuuguuuuuggaaau

SEQ ID NO: 588528 - RNA, 64 nt, Homo Sapiens
aggccccguccugccgugacacccuucauccuacccuuggaaccccaaggccaaguugguucaa

SEQ ID NO: 588529 - RNA, 64 nt, Homo Sapiens
gaaccgacugaguaaugaagaagaggaaggaagcccuuggaaggaacguaaaauccauuucagc

SEQ ID NO: 588530 - RNA, 64 nt, Homo Sapiens
ggaaggaacguaaaauccauuucagccugccgccccuuggaauggagggucuucuagggaccag

SEQ ID NO: 588531 - RNA, 64 nt, Homo Sapiens
agccccaucagaaccugagcuauaugaccagaagccuuggaaccuuggaaauagaaagaagcca

SEQ ID NO: 588532 - RNA, 64 nt, Homo Sapiens
agaaagaagccauauaugacgacacauuggaaugccuuggaaauccaaccucuuuuuccuccug

SEQ ID NO: 588533 - RNA, 64 nt, Homo Sapiens
cucuggccacugugggagggaaggacaaggguucccuuggaaaugugaagggucuuggccucau

SEQ ID NO: 588534 - RNA, 64 nt, Homo Sapiens
cuuucucucuggaaaguugaaguaucuccaaaggccuuggaaauggcacaaaggugauaaggag

SEQ ID NO: 588535 - RNA, 64 nt, Homo Sapiens
ggcuuuggaaauagcuaucuacugcuuugaggugccuuggaacugcacaauuauucaggacuga

SEQ ID NO: 588536 - RNA, 64 nt, Homo Sapiens
uccucagagaucaacuagcccucugagaccaugaccuuggaagagcaagaggcagaaacacuga

SEQ ID NO: 588537 - RNA, 64 nt, Homo Sapiens
ugagcugccaaugccagcccggcauaaggggaggccuuggaaccggaagggaaagccugaggcc

SEQ ID NO: 588538 - RNA, 64 nt, Homo Sapiens
ucccugauccuacaaaacaaaaagguaucaaaugccuuggaagcagagcccuucuucccaucaa

SEQ ID NO: 588539 - RNA, 64 nt, Homo Sapiens
cuugagaaucacauuuauguaaacugagcaagggccuuggaaucaagaaaacagcauggccagu

SEQ ID NO: 588540 - RNA, 64 nt, Homo Sapiens
caaauaguucuuauuugccagaaaucgucaucugccuuggaaugaccucuaagcuccuuucaca

SEQ ID NO: 588541 - RNA, 64 nt, Homo Sapiens
uuugaggaccugcaauagaaugaagcaguguuuuccuuggaaugaaugagcugucugcaggagg

SEQ ID NO: 588542 - RNA, 64 nt, Homo Sapiens
gcaaugugugagcuaaggacuucaggauccucucccuuggaaggccacugagcacauggggucu

SEQ ID NO: 588543 - RNA, 64 nt, Homo Sapiens
agaaagcaguggagaccgggaaacagaucgcaucccuuggaauugagucaccagaugaggcucu

SEQ ID NO: 588544 - RNA, 64 nt, Homo Sapiens
cugugcuuacauaccuuugucaucucucuuccccccuuggaaguuguccucagggggauuuguu

SEQ ID NO: 588545 - RNA, 64 nt, Homo Sapiens
gcagaacgaugugcacccucugcguuuuggauguccuuggaaugugggagccuagaaauaaccc

SEQ ID NO: 588546 - RNA, 64 nt, Homo Sapiens
uucaauguagcaaagcauuccuaguuaaccagagccuuggaaucuacugccugcuggccaggcu

SEQ ID NO: 588547 - RNA, 64 nt, Homo Sapiens
augaguaacuuacauucucuuaauuguaaugguuccuuggaaagucaucguggaaaaugaaggc

SEQ ID NO: 588548 - RNA, 64 nt, Homo Sapiens
ugguuaaauuaaaaaaaaaaaagagcacgacaaaccuuggaaaucaagaaaguucuggaaugau

SEQ ID NO: 588549 - RNA, 64 nt, Homo Sapiens
cagacagucuuugaguaacaucuguucccaucuuccuuggaagcaggacacaccagcuccuccg

SEQ ID NO: 588550 - RNA, 64 nt, Homo Sapiens
ggcagcccucuaccugggccccgggagccgugcuccuuggaacgcaaagggccgaggagcaucu

SEQ ID NO: 588551 - RNA, 64 nt, Homo Sapiens
uagccaaauucugucuccugcauacacuccggcaugcauccaacaccaauggcuuucuagauga

SEQ ID NO: 588552 - RNA, 64 nt, Homo Sapiens
uuugagauucaagaaaaauuucuauucuuuuuuuugcauccaauugugccugaacuuuuaaaau

SEQ ID NO: 588553 - RNA, 64 nt, Homo Sapiens
acuggagggccaugauggcaucgugcuggcucucugcauccaggggugaguccaggcacaugug

SEQ ID NO: 588554 - RNA, 64 nt, Homo Sapiens
uuacucauagaucugggacauccgaacccuugacugcauccacguccugcagacgucugguggc

SEQ ID NO: 588555 - RNA, 64 nt, Homo Sapiens
ugggauccacgucuagggaccacucuggcuucugugcauccacccaggcccccgacccaucacu

SEQ ID NO: 588556 - RNA, 64 nt, Homo Sapiens
ccacauucuccgggucauggccgagcuugaccucugcauccauggugacggagguggcaaugac

SEQ ID NO: 588557 - RNA, 64 nt, Homo Sapiens; identical to SEQ ID NO: 324616

SEQ ID NO: 588558 - RNA, 64 nt, Homo Sapiens; identical to SEQ ID NO: 324617

SEQ ID NO: 588559 - RNA, 64 nt, Homo Sapiens; identical to SEQ ID NO: 54817

SEQ ID NO: 588560 - RNA, 64 nt, Homo Sapiens; identical to SEQ ID NO: 54818

SEQ ID NO: 588561 - RNA, 64 nt, Homo Sapiens; identical to SEQ ID NO: 54819

SEQ ID NO: 588562 - RNA, 64 nt, Homo Sapiens; identical to SEQ ID NO: 54820

SEQ ID NO: 588563 - RNA, 64 nt, Homo Sapiens; identical to SEQ ID NO: 54821

SEQ ID NO: 588564 - RNA, 64 nt, Homo Sapiens; identical to SEQ ID NO: 54822

SEQ ID NO: 588565 - RNA, 64 nt, Homo Sapiens; identical to SEQ ID NO: 54823

SEQ ID NO: 588566 - RNA, 64 nt, Homo Sapiens; identical to SEQ ID NO: 54824

SEQ ID NO: 588567 - RNA, 64 nt, Homo Sapiens; identical to SEQ ID NO: 54825

SEQ ID NO: 588568 - RNA, 64 nt, Homo Sapiens; identical to SEQ ID NO: 54826

SEQ ID NO: 588569 - RNA, 64 nt, Homo Sapiens; identical to SEQ ID NO: 54827

SEQ ID NO: 588570 - RNA, 64 nt, Homo Sapiens; identical to SEQ ID NO: 54828

SEQ ID NO: 588571 - RNA, 64 nt, Homo Sapiens; identical to SEQ ID NO: 54829

SEQ ID NO: 588572 - RNA, 64 nt, Homo Sapiens; identical to SEQ ID NO: 54830

SEQ ID NO: 588573 - RNA, 64 nt, Homo Sapiens; identical to SEQ ID NO: 54831

SEQ ID NO: 588574 - RNA, 64 nt, Homo Sapiens; identical to SEQ ID NO: 54832

SEQ ID NO: 588575 - RNA, 64 nt, Homo Sapiens; identical to SEQ ID NO: 54833

SEQ ID NO: 588576 - RNA, 64 nt, Homo Sapiens; identical to SEQ ID NO: 54834

SEQ ID NO: 588577 - RNA, 64 nt, Homo Sapiens; identical to SEQ ID NO: 54835

SEQ ID NO: 588578 - RNA, 64 nt, Homo Sapiens; identical to SEQ ID NO: 54836

SEQ ID NO: 588579 - RNA, 64 nt, Homo Sapiens; identical to SEQ ID NO: 54837

SEQ ID NO: 588580 - RNA, 64 nt, Homo Sapiens; identical to SEQ ID NO: 54838

SEQ ID NO: 588581 - RNA, 64 nt, Homo Sapiens; identical to SEQ ID NO: 54839

SEQ ID NO: 588582 - RNA, 64 nt, Homo Sapiens; identical to SEQ ID NO: 54840

SEQ ID NO: 588583 - RNA, 64 nt, Homo Sapiens; identical to SEQ ID NO: 54841

SEQ ID NO: 588584 - RNA, 64 nt, Homo Sapiens; identical to SEQ ID NO: 54842

SEQ ID NO: 588585 - RNA, 64 nt, Homo Sapiens; identical to SEQ ID NO: 54843

SEQ ID NO: 588586 - RNA, 64 nt, Homo Sapiens; identical to SEQ ID NO: 54844

SEQ ID NO: 588587 - RNA, 64 nt, Homo Sapiens; identical to SEQ ID NO: 54845

SEQ ID NO: 588588 - RNA, 64 nt, Homo Sapiens; identical to SEQ ID NO: 54846

SEQ ID NO: 588589 - RNA, 64 nt, Homo Sapiens; identical to SEQ ID NO: 54847

SEQ ID NO: 588590 - RNA, 64 nt, Homo Sapiens; identical to SEQ ID NO: 54848

SEQ ID NO: 588591 - RNA, 64 nt, Homo Sapiens; identical to SEQ ID NO: 54849

SEQ ID NO: 588592 - RNA, 64 nt, Homo Sapiens; identical to SEQ ID NO: 54850

SEQ ID NO: 588593 - RNA, 64 nt, Homo Sapiens; identical to SEQ ID NO: 54851

SEQ ID NO: 588594 - RNA, 64 nt, Homo Sapiens; identical to SEQ ID NO: 54852

SEQ ID NO: 588595 - RNA, 64 nt, Homo Sapiens; identical to SEQ ID NO: 54853

SEQ ID NO: 588596 - RNA, 64 nt, Homo Sapiens; identical to SEQ ID NO: 54854

SEQ ID NO: 588597 - RNA, 64 nt, Homo Sapiens; identical to SEQ ID NO: 54855

SEQ ID NO: 588598 - RNA, 64 nt, Homo Sapiens; identical to SEQ ID NO: 54856

SEQ ID NO: 588599 - RNA, 64 nt, Homo Sapiens; identical to SEQ ID NO: 54857

SEQ ID NO: 588600 - RNA, 64 nt, Homo Sapiens; identical to SEQ ID NO: 54858

SEQ ID NO: 588601 - RNA, 64 nt, Homo Sapiens; identical to SEQ ID NO: 54859

SEQ ID NO: 588602 - RNA, 64 nt, Homo Sapiens; identical to SEQ ID NO: 54860

SEQ ID NO: 588603 - RNA, 64 nt, Homo Sapiens; identical to SEQ ID NO: 54861

SEQ ID NO: 588604 - RNA, 64 nt, Homo Sapiens; identical to SEQ ID NO: 54862

SEQ ID NO: 588605 - RNA, 64 nt, Homo Sapiens; identical to SEQ ID NO: 54863

SEQ ID NO: 588606 - RNA, 64 nt, Homo Sapiens; identical to SEQ ID NO: 54864

SEQ ID NO: 588607 - RNA, 64 nt, Homo Sapiens; identical to SEQ ID NO: 54865

SEQ ID NO: 588608 - RNA, 64 nt, Homo Sapiens; identical to SEQ ID NO: 54866

SEQ ID NO: 588609 - RNA, 64 nt, Homo Sapiens; identical to SEQ ID NO: 54867

SEQ ID NO: 588610 - RNA, 64 nt, Homo Sapiens; identical to SEQ ID NO: 54868

SEQ ID NO: 588611 - RNA, 64 nt, Homo Sapiens; identical to SEQ ID NO: 54869

SEQ ID NO: 588612 - RNA, 64 nt, Homo Sapiens; identical to SEQ ID NO: 54870

SEQ ID NO: 588613 - RNA, 64 nt, Homo Sapiens; identical to SEQ ID NO: 54871

SEQ ID NO: 588614 - RNA, 64 nt, Homo Sapiens; identical to SEQ ID NO: 54872

SEQ ID NO: 588615 - RNA, 64 nt, Homo Sapiens; identical to SEQ ID NO: 54870

SEQ ID NO: 588616 - RNA, 64 nt, Homo Sapiens; identical to SEQ ID NO: 54871

SEQ ID NO: 588617 - RNA, 64 nt, Homo Sapiens; identical to SEQ ID NO: 54872

SEQ ID NO: 588618 - RNA, 64 nt, Homo Sapiens; identical to SEQ ID NO: 54870

SEQ ID NO: 588619 - RNA, 64 nt, Homo Sapiens; identical to SEQ ID NO: 54877

SEQ ID NO: 588620 - RNA, 64 nt, Homo Sapiens; identical to SEQ ID NO: 54878

SEQ ID NO: 588621 - RNA, 64 nt, Homo Sapiens; identical to SEQ ID NO: 54879

SEQ ID NO: 588622 - RNA, 64 nt, Homo Sapiens; identical to SEQ ID NO: 54880

SEQ ID NO: 588623 - RNA, 64 nt, Homo Sapiens; identical to SEQ ID NO: 54881

SEQ ID NO: 588624 - RNA, 64 nt, Homo Sapiens; identical to SEQ ID NO: 54882

SEQ ID NO: 588625 - RNA, 64 nt, Homo Sapiens; identical to SEQ ID NO: 54883

SEQ ID NO: 588626 - RNA, 64 nt, Homo Sapiens; identical to SEQ ID NO: 54884

SEQ ID NO: 588627 - RNA, 64 nt, Homo Sapiens; identical to SEQ ID NO: 54885

SEQ ID NO: 588628 - RNA, 64 nt, Homo Sapiens; identical to SEQ ID NO: 54886

SEQ ID NO: 588629 - RNA, 64 nt, Homo Sapiens; identical to SEQ ID NO: 54887

SEQ ID NO: 588630 - RNA, 64 nt, Homo Sapiens; identical to SEQ ID NO: 54888

SEQ ID NO: 588631 - RNA, 64 nt, Homo Sapiens; identical to SEQ ID NO: 54889

SEQ ID NO: 588632 - RNA, 64 nt, Homo Sapiens; identical to SEQ ID NO: 54890

SEQ ID NO: 588633 - RNA, 64 nt, Homo Sapiens; identical to SEQ ID NO: 54891

SEQ ID NO: 588634 - RNA, 64 nt, Homo Sapiens; identical to SEQ ID NO: 54892

SEQ ID NO: 588635 - RNA, 64 nt, Homo Sapiens; identical to SEQ ID NO: 54893

SEQ ID NO: 588636 - RNA, 64 nt, Homo Sapiens; identical to SEQ ID NO: 54894

SEQ ID NO: 588637 - RNA, 64 nt, Homo Sapiens; identical to SEQ ID NO: 54895

SEQ ID NO: 588638 - RNA, 64 nt, Homo Sapiens; identical to SEQ ID NO: 54896

SEQ ID NO: 588639 - RNA, 64 nt, Homo Sapiens
cuguugcccaauucacgguauuuccuuucacagcugcuccaagcgccagaagaaauugaggaug

SEQ ID NO: 588640 - RNA, 64 nt, Homo Sapiens
ugaggcagcuucaugugcaggcugggaaucuaguugcuccaauagcuccaguaagaaucacagu

SEQ ID NO: 588641 - RNA, 64 nt, Homo Sapiens
gucagaagcaaacaggagcggcaacuucuaacuuugcuccaagccacucucuuuuuaaacagca

SEQ ID NO: 588642 - RNA, 64 nt, Homo Sapiens
aauggugucuguccagccccucccucugucccugugcuccaagcugcccccggcugcagcccag

SEQ ID NO: 588643 - RNA, 64 nt, Homo Sapiens
cuuuaguuaccgagacaugacuaguggcuguucaugcuccaagauuuuacuauugaacuguauu

SEQ ID NO: 588644 - RNA, 64 nt, Homo Sapiens
gacaggugggccuggcggccugagugcugggcacugcuccaaggcccugaucucugaccucugc

SEQ ID NO: 588645 - RNA, 64 nt, Homo Sapiens
aauggcauuugcugauuucauaaaccuuucacgucuggacgaauuaccaaaugccaugaauugc

SEQ ID NO: 588646 - RNA, 64 nt, Homo Sapiens
aaagcuguucuucucuuagacacaauuucuucaucuggacgagcaguggagagggaaagcaacu

SEQ ID NO: 588647 - RNA, 64 nt, Homo Sapiens
cggccucgcagcaaagugugaggaggacaugggccuggacgacaugucugcaggagagcaagcc

SEQ ID NO: 588648 - RNA, 64 nt, Homo Sapiens
aggaaacuucacacgucaaaauccauagaagcgccuggacgaggcuuaaagugcuuugugagug

SEQ ID NO: 588649 - RNA, 64 nt, Homo Sapiens
gauauugcuuccaaugaaagaaggaguucuugaucuggacgaugacuguguccaucugacccca

SEQ ID NO: 588650 - RNA, 64 nt, Homo Sapiens
uuauaauagguggggaaauuaggcuuauuucauccuggacgaguuauuaucuuuaauuuugaaa

SEQ ID NO: 588651 - RNA, 64 nt, Homo Sapiens
acaacuggaccaguuugguauuagaaguaggaggcuggacgacuucacccccaaaggguccuga

SEQ ID NO: 588652 - RNA, 64 nt, Homo Sapiens
caacgcagcacuagcaagcagguucgggacagcccuggacgauuucccgaccgcugcucaggcu

SEQ ID NO: 588653 - RNA, 64 nt, Homo Sapiens
uaaaaauauauauuuuuuaacugucuaaagaguacuggacgauaugggaacuugacucucucau

SEQ ID NO: 588654 - RNA, 64 nt, Homo Sapiens
gagcaagacuccgucucuaacacugcucuccagccuggacgacaugcaugagccgagauggcgc

SEQ ID NO: 588655 - RNA, 64 nt, Homo Sapiens
ucaggcagaccuggaagcugcaggguucaucucacuggacgagugaucauagacagugaucauu

SEQ ID NO: 588656 - RNA, 64 nt, Homo Sapiens
acguggggaaacccuccaccugagcuguccugaccuggacgaugugcuuggugaagaaacugug

SEQ ID NO: 588657 - RNA, 64 nt, Homo Sapiens
uccuugcaucugagggcagaaaaucagggcguggcuggacgauuucagccuuaacaggcucagc

SEQ ID NO: 588658 - RNA, 64 nt, Homo Sapiens
ccucggcuugaccuuuuuugaauggccuguuuggcuggacgaugugaguguguuuccugucacc

SEQ ID NO: 588659 - RNA, 64 nt, Homo Sapiens
ugaaagcucagauuaagcaagccaugccaagaaacuggacgauguguaagccuagacucuaaaa

SEQ ID NO: 588660 - RNA, 64 nt, Homo Sapiens
gugcaaugcugugugcucccaaugaagagcauaucuggacgacuuuugcaaaugucuuucucuc

SEQ ID NO: 588661 - RNA, 64 nt, Homo Sapiens
cagcuggggcgaaggagcaccggccugggucuugcuggacgaguguggccuagagcugggggag

SEQ ID NO: 588662 - RNA, 64 nt, Homo Sapiens
ggcugggccuccgccccugcaccagucacaugcacuggacgagggccgaaacuccugucugcua

SEQ ID NO: 588663 - RNA, 64 nt, Homo Sapiens
gggagugagcuugagccuuuaaugaaaagucugucuggacgaagcuaaucuucaucaaacaaaa

SEQ ID NO: 588664 - RNA, 51 nt, Homo Sapiens
cacaggugcgucagaugcuggcuggacgacuggcaugucggcgucagauga

SEQ ID NO: 588665 - RNA, 64 nt, Homo Sapiens
ggcucacgccaggaacgccgcccacucuccggaucuggacgaugcggagugacgggcgcccggc

SEQ ID NO: 588666 - RNA, 64 nt, Homo Sapiens
uccucgcugauuagcuuccugccugcugucagugcuggacgaagugcuauaacuacuuuaugua

SEQ ID NO: 588667 - RNA, 64 nt, Homo Sapiens
aagggugagggucacucccucccagaagccccgucuggacgagccuugccugaccucuucggug

SEQ ID NO: 588668 - RNA, 64 nt, Homo Sapiens
cgagggguacaaggccagccacaagccggaggaacuggacgagcacgcgcugguggagcuggag

SEQ ID NO: 588669 - RNA, 64 nt, Homo Sapiens
ggccucgaggcaacccugggugcugcugcucucccuggacgaccucaucuccugaggcucuucc

SEQ ID NO: 588670 - RNA, 64 nt, Homo Sapiens
cggaccgaggcuaggacgugccgcgggccauacgcuggacgaguccccgcacgccaugagcccg

SEQ ID NO: 588671 - RNA, 64 nt, Homo Sapiens
gccuggucagagggugaccuguccacgacccaggcuggacgaauaacaccccacggggcuguuu

SEQ ID NO: 588672 - RNA, 64 nt, Homo Sapiens
ucuuucuuuaaaaagaaagaggguugaaaauccucuggacgaacagaagucacuuuggcuguuc

SEQ ID NO: 588673 - RNA, 64 nt, Homo Sapiens
gagcgagacuccgucucaaacacugcauuccagccuggacgacagcagugagccaagaucacgc

SEQ ID NO: 588674 - RNA, 64 nt, Homo Sapiens
gauaccaaacguuucuuucucuguaaaaugggaucuggacgaauccacuccuguaguuucuuuu

SEQ ID NO: 588675 - RNA, 64 nt, Homo Sapiens
gagugagauucugucucaaacacugcacuccagccuggacgacaacagugagucgagaucgcgc

SEQ ID NO: 588676 - RNA, 64 nt, Homo Sapiens
aauagacauagccggcauaucucauggucaggagcuggacgauucugguaacuuaggcuuuuuu

SEQ ID NO: 588677 - RNA, 64 nt, Homo Sapiens
ucaccgggagccacgccgugcauggcagccuucccuggacgagcgcucgguguucacacugaac

SEQ ID NO: 588678 - RNA, 64 nt, Homo Sapiens
gcuuggagggauggagaggcggcgguggacugcgcuggacgauaccagcggcacggccugaggc

SEQ ID NO: 588679 - RNA, 64 nt, Homo Sapiens
uaguccuccagcucuuuuauugagcauccacgugcuggacgauacuuauuuacaauuccuaagu

SEQ ID NO: 588680 - RNA, 64 nt, Homo Sapiens
cccccgccacaggauccagagcaagcaccgcccccuggacgagcgggcccugcaggucugcugg

SEQ ID NO: 588681 - RNA, 64 nt, Homo Sapiens
gcuagagaagagccuggagcucaaguuugacguccuggacgaaaaccagagcaagcucagcgag

SEQ ID NO: 588682 - RNA, 64 nt, Homo Sapiens
gugaccucgggaauggcaauuuuuugggcggccccuggacgaaggucugaaucccgacucugau

SEQ ID NO: 588683 - RNA, 58 nt, Homo Sapiens
gccuggcccugcaggucugagcccgggacuggacgagcaguagauccagcagccugca

SEQ ID NO: 588684 - RNA, 64 nt, Homo Sapiens
gagugagacucugucucaaacacugcacuccauccuggacgacaacagugagcugagaucgugc

SEQ ID NO: 588685 - RNA, 64 nt, Homo Sapiens
ccucaccuacaugcccucccagccccucccaucucuggacgaggccuccuuccucagguuccuc

SEQ ID NO: 588686 - RNA, 64 nt, Homo Sapiens
gaaaaucauuugaggucagaaguucaaggccagccuggacgacauagcgagacuccaccucuac

SEQ ID NO: 588687 - RNA, 64 nt, Homo Sapiens
acagcagcuucuugaaacauuugcauagaauucacuggacgaauuaagccugcacucauauggc

SEQ ID NO: 588688 - RNA, 64 nt, Homo Sapiens
gagcgagacucagucucaaacugagauugcgccacuggacgacagaggcggagguugcaguuag

SEQ ID NO: 588689 - RNA, 64 nt, Homo Sapiens
aaucaggggagaggagaggccugauggggcagagcuggacgaagucugcuaagagagauggagg

SEQ ID NO: 588690 - RNA, 64 nt, Homo Sapiens
aggcugcagcggcagcuccagauggccuccugagcuggacgaccccaggucuccagacaucuag

SEQ ID NO: 588691 - RNA, 64 nt, Homo Sapiens
gaagcgccccaggaagggcgccgagugcccucuccuggacgaucgcgggucgcagaagcccagg

SEQ ID NO: 588692 - RNA, 64 nt, Homo Sapiens
ggccuaggguuccagacugguuggacuuguucgucuggacgacacuggaguggaacacugccuc

SEQ ID NO: 588693 - RNA, 64 nt, Homo Sapiens
ugauuggacuugcgaauagccacugcacugcggccuggacgacguagugauacccugacucuua

SEQ ID NO: 588694 - RNA, 64 nt, Homo Sapiens
gagcaagacuccgucucaaacacugcacuccagccuggacgacagcaguaagccgagaucgcgc

SEQ ID NO: 588695 - RNA, 64 nt, Homo Sapiens
ugucuuugacacaucugaccccuuugggcucauucuggacgacgccuuauggagugagcagcca

SEQ ID NO: 588696 - RNA, 64 nt, Homo Sapiens
caccucgucuugaaucugaccuuguccaagaaggcuggacgagagaccuucuguccccucccag

SEQ ID NO: 588697 - RNA, 64 nt, Homo Sapiens
ucuucaguagaugaccuggcuguaaagagauucccuggacgagccagaucauucaguuucagcg

SEQ ID NO: 588698 - RNA, 64 nt, Homo Sapiens
aucagcuacugcggugucaggacugcuuuagucacuggacgagcauaaaaucuguuuucagccu

SEQ ID NO: 588699 - RNA, 64 nt, Homo Sapiens
uuggguuuuuccucuaggaggccugaauggaguccuggacgacaacuuccucugaacuguuacu

SEQ ID NO: 588700 - RNA, 64 nt, Homo Sapiens
ucucucgggcccaggccuggaggaacaacaccuccuggacgagccagcucugcaucggccuugc

SEQ ID NO: 588701 - RNA, 64 nt, Homo Sapiens
uugugucuggcuugcugaguguaaaaguuguuaucuggacgaucugucucucugcuccaaagaa

SEQ ID NO: 588702 - RNA, 64 nt, Homo Sapiens
gcagaagcugggcccugaacacacggggccaugucuggacgagcaggggagagaggcugaacug

SEQ ID NO: 588703 - RNA, 64 nt, Homo Sapiens
uguuaauguaguuguuucuacauugggcaugaggcuggacgacucaucuguucaaaaauuguga

SEQ ID NO: 588704 - RNA, 64 nt, Homo Sapiens
ccuccccaccucagccugggaguuccagaggauccuggacgaccgccucaggaucuggagaugc

SEQ ID NO: 588705 - RNA, 64 nt, Homo Sapiens
augugauuugguaccauuucacaccagcaggugucuggacgaaaacaucaaugugaauaagggc

SEQ ID NO: 588706 - RNA, 64 nt, Homo Sapiens
gcagugagcccugauugugccagugcacuccagccuggacgacagagcaagacccuguauuaaa

SEQ ID NO: 588707 - RNA, 64 nt, Homo Sapiens; identical to SEQ ID NO: 334582

SEQ ID NO: 588708 - RNA, 64 nt, Homo Sapiens; identical to SEQ ID NO: 334583

SEQ ID NO: 588709 - RNA, 64 nt, Homo Sapiens; identical to SEQ ID NO: 334584

SEQ ID NO: 588710 - RNA, 64 nt, Homo Sapiens; identical to SEQ ID NO: 334585

SEQ ID NO: 588711 - RNA, 64 nt, Homo Sapiens; identical to SEQ ID NO: 334586

SEQ ID NO: 588712 - RNA, 64 nt, Homo Sapiens; identical to SEQ ID NO: 334587

SEQ ID NO: 588713 - RNA, 64 nt, Homo Sapiens; identical to SEQ ID NO: 84166

SEQ ID NO: 588714 - RNA, 64 nt, Homo Sapiens; identical to SEQ ID NO: 84167

SEQ ID NO: 588715 - RNA, 64 nt, Homo Sapiens; identical to SEQ ID NO: 84168

SEQ ID NO: 588716 - RNA, 64 nt, Homo Sapiens; identical to SEQ ID NO: 84169

SEQ ID NO: 588717 - RNA, 64 nt, Homo Sapiens; identical to SEQ ID NO: 84170

SEQ ID NO: 588718 - RNA, 64 nt, Homo Sapiens; identical to SEQ ID NO: 84171

SEQ ID NO: 588719 - RNA, 64 nt, Homo Sapiens; identical to SEQ ID NO: 84172

SEQ ID NO: 588720 - RNA, 64 nt, Homo Sapiens; identical to SEQ ID NO: 84173

SEQ ID NO: 588721 - RNA, 64 nt, Homo Sapiens; identical to SEQ ID NO: 84174

SEQ ID NO: 588722 - RNA, 64 nt, Homo Sapiens; identical to SEQ ID NO: 84175

SEQ ID NO: 588723 - RNA, 64 nt, Homo Sapiens; identical to SEQ ID NO: 84176

SEQ ID NO: 588724 - RNA, 64 nt, Homo Sapiens; identical to SEQ ID NO: 84177

SEQ ID NO: 588725 - RNA, 64 nt, Homo Sapiens; identical to SEQ ID NO: 84178

SEQ ID NO: 588726 - RNA, 64 nt, Homo Sapiens; identical to SEQ ID NO: 84179

SEQ ID NO: 588727 - RNA, 64 nt, Homo Sapiens; identical to SEQ ID NO: 84180

SEQ ID NO: 588728 - RNA, 64 nt, Homo Sapiens; identical to SEQ ID NO: 84181

SEQ ID NO: 588729 - RNA, 64 nt, Homo Sapiens; identical to SEQ ID NO: 84182

SEQ ID NO: 588730 - RNA, 64 nt, Homo Sapiens; identical to SEQ ID NO: 84183

SEQ ID NO: 588731 - RNA, 64 nt, Homo Sapiens; identical to SEQ ID NO: 84184

SEQ ID NO: 588732 - RNA, 64 nt, Homo Sapiens; identical to SEQ ID NO: 84185

SEQ ID NO: 588733 - RNA, 64 nt, Homo Sapiens; identical to SEQ ID NO: 84186

SEQ ID NO: 588734 - RNA, 64 nt, Homo Sapiens; identical to SEQ ID NO: 84187

SEQ ID NO: 588735 - RNA, 64 nt, Homo Sapiens; identical to SEQ ID NO: 84188

SEQ ID NO: 588736 - RNA, 64 nt, Homo Sapiens; identical to SEQ ID NO: 84189

SEQ ID NO: 588737 - RNA, 64 nt, Homo Sapiens; identical to SEQ ID NO: 84190

SEQ ID NO: 588738 - RNA, 64 nt, Homo Sapiens; identical to SEQ ID NO: 84191

SEQ ID NO: 588739 - RNA, 64 nt, Homo Sapiens; identical to SEQ ID NO: 84192

SEQ ID NO: 588740 - RNA, 64 nt, Homo Sapiens; identical to SEQ ID NO: 84193

SEQ ID NO: 588741 - RNA, 64 nt, Homo Sapiens; identical to SEQ ID NO: 84194

SEQ ID NO: 588742 - RNA, 64 nt, Homo Sapiens; identical to SEQ ID NO: 84195

SEQ ID NO: 588743 - RNA, 64 nt, Homo Sapiens; identical to SEQ ID NO: 84196

SEQ ID NO: 588744 - RNA, 64 nt, Homo Sapiens; identical to SEQ ID NO: 84197

SEQ ID NO: 588745 - RNA, 64 nt, Homo Sapiens; identical to SEQ ID NO: 84198

SEQ ID NO: 588746 - RNA, 64 nt, Homo Sapiens; identical to SEQ ID NO: 84199

SEQ ID NO: 588747 - RNA, 64 nt, Homo Sapiens; identical to SEQ ID NO: 84200

SEQ ID NO: 588748 - RNA, 64 nt, Homo Sapiens; identical to SEQ ID NO: 84201

SEQ ID NO: 588749 - RNA, 64 nt, Homo Sapiens; identical to SEQ ID NO: 84202

SEQ ID NO: 588750 - RNA, 64 nt, Homo Sapiens; identical to SEQ ID NO: 84203

SEQ ID NO: 588751 - RNA, 64 nt, Homo Sapiens; identical to SEQ ID NO: 84204

SEQ ID NO: 588752 - RNA, 64 nt, Homo Sapiens; identical to SEQ ID NO: 84205

SEQ ID NO: 588753 - RNA, 64 nt, Homo Sapiens; identical to SEQ ID NO: 84206

SEQ ID NO: 588754 - RNA, 64 nt, Homo Sapiens; identical to SEQ ID NO: 84207

SEQ ID NO: 588755 - RNA, 64 nt, Homo Sapiens; identical to SEQ ID NO: 84208

SEQ ID NO: 588756 - RNA, 64 nt, Homo Sapiens; identical to SEQ ID NO: 84209

SEQ ID NO: 588757 - RNA, 64 nt, Homo Sapiens; identical to SEQ ID NO: 84210

SEQ ID NO: 588758 - RNA, 64 nt, Homo Sapiens; identical to SEQ ID NO: 84211

SEQ ID NO: 588759 - RNA, 64 nt, Homo Sapiens; identical to SEQ ID NO: 84212

SEQ ID NO: 588760 - RNA, 64 nt, Homo Sapiens; identical to SEQ ID NO: 84213

SEQ ID NO: 588761 - RNA, 64 nt, Homo Sapiens; identical to SEQ ID NO: 84214

SEQ ID NO: 588762 - RNA, 64 nt, Homo Sapiens; identical to SEQ ID NO: 84215

SEQ ID NO: 588763 - RNA, 64 nt, Homo Sapiens; identical to SEQ ID NO: 84216

SEQ ID NO: 588764 - RNA, 64 nt, Homo Sapiens; identical to SEQ ID NO: 84217

SEQ ID NO: 588765 - RNA, 64 nt, Homo Sapiens; identical to SEQ ID NO: 84218

SEQ ID NO: 588766 - RNA, 64 nt, Homo Sapiens; identical to SEQ ID NO: 84219

SEQ ID NO: 588767 - RNA, 64 nt, Homo Sapiens; identical to SEQ ID NO: 84220

SEQ ID NO: 588768 - RNA, 64 nt, Homo Sapiens; identical to SEQ ID NO: 84221

SEQ ID NO: 588769 - RNA, 64 nt, Homo Sapiens; identical to SEQ ID NO: 84222

SEQ ID NO: 588770 - RNA, 64 nt, Homo Sapiens; identical to SEQ ID NO: 84223

SEQ ID NO: 588771 - RNA, 64 nt, Homo Sapiens; identical to SEQ ID NO: 84224

SEQ ID NO: 588772 - RNA, 64 nt, Homo Sapiens; identical to SEQ ID NO: 84225

SEQ ID NO: 588773 - RNA, 64 nt, Homo Sapiens; identical to SEQ ID NO: 84226

SEQ ID NO: 588774 - RNA, 64 nt, Homo Sapiens; identical to SEQ ID NO: 84227

SEQ ID NO: 588775 - RNA, 64 nt, Homo Sapiens; identical to SEQ ID NO: 84228

SEQ ID NO: 588776 - RNA, 64 nt, Homo Sapiens; identical to SEQ ID NO: 84229

SEQ ID NO: 588777 - RNA, 64 nt, Homo Sapiens; identical to SEQ ID NO: 84230

SEQ ID NO: 588778 - RNA, 64 nt, Homo Sapiens; identical to SEQ ID NO: 84231

SEQ ID NO: 588779 - RNA, 64 nt, Homo Sapiens; identical to SEQ ID NO: 84232

SEQ ID NO: 588780 - RNA, 64 nt, Homo Sapiens; identical to SEQ ID NO: 84233

SEQ ID NO: 588781 - RNA, 64 nt, Homo Sapiens; identical to SEQ ID NO: 424256

SEQ ID NO: 588782 - RNA, 64 nt, Homo Sapiens; identical to SEQ ID NO: 424257

SEQ ID NO: 588783 - RNA, 64 nt, Homo Sapiens; identical to SEQ ID NO: 424258

SEQ ID NO: 588784 - RNA, 64 nt, Homo Sapiens; identical to SEQ ID NO: 424259

SEQ ID NO: 588785 - RNA, 64 nt, Homo Sapiens; identical to SEQ ID NO: 424260

SEQ ID NO: 588786 - RNA, 64 nt, Homo Sapiens; identical to SEQ ID NO: 424261

SEQ ID NO: 588787 - RNA, 64 nt, Homo Sapiens; identical to SEQ ID NO: 424262

SEQ ID NO: 588788 - RNA, 64 nt, Homo Sapiens; identical to SEQ ID NO: 424263

SEQ ID NO: 588789 - RNA, 64 nt, Homo Sapiens; identical to SEQ ID NO: 424264

SEQ ID NO: 588790 - RNA, 64 nt, Homo Sapiens; identical to SEQ ID NO: 424265

SEQ ID NO: 588791 - RNA, 64 nt, Homo Sapiens; identical to SEQ ID NO: 424266

SEQ ID NO: 588792 - RNA, 64 nt, Homo Sapiens; identical to SEQ ID NO: 424267

SEQ ID NO: 588793 - RNA, 64 nt, Homo Sapiens; identical to SEQ ID NO: 424268

SEQ ID NO: 588794 - RNA, 64 nt, Homo Sapiens; identical to SEQ ID NO: 424269

SEQ ID NO: 588795 - RNA, 64 nt, Homo Sapiens; identical to SEQ ID NO: 424270

SEQ ID NO: 588796 - RNA, 64 nt, Homo Sapiens; identical to SEQ ID NO: 424271

SEQ ID NO: 588797 - RNA, 64 nt, Homo Sapiens; identical to SEQ ID NO: 424272

SEQ ID NO: 588798 - RNA, 64 nt, Homo Sapiens; identical to SEQ ID NO: 424273

SEQ ID NO: 588799 - RNA, 64 nt, Homo Sapiens; identical to SEQ ID NO: 424274

SEQ ID NO: 588800 - RNA, 59 nt, Homo Sapiens; identical to SEQ ID NO: 424275

SEQ ID NO: 588801 - RNA, 64 nt, Homo Sapiens; identical to SEQ ID NO: 424276

SEQ ID NO: 588802 - RNA, 64 nt, Homo Sapiens; identical to SEQ ID NO: 424277

SEQ ID NO: 588803 - RNA, 64 nt, Homo Sapiens; identical to SEQ ID NO: 550329

SEQ ID NO: 588804 - RNA, 64 nt, Homo Sapiens; identical to SEQ ID NO: 550330

SEQ ID NO: 588805 - RNA, 64 nt, Homo Sapiens; identical to SEQ ID NO: 550331

SEQ ID NO: 588806 - RNA, 64 nt, Homo Sapiens; identical to SEQ ID NO: 550332

SEQ ID NO: 588807 - RNA, 64 nt, Homo Sapiens; identical to SEQ ID NO: 550333

SEQ ID NO: 588808 - RNA, 64 nt, Homo Sapiens; identical to SEQ ID NO: 550334

SEQ ID NO: 588809 - RNA, 64 nt, Homo Sapiens; identical to SEQ ID NO: 550335

SEQ ID NO: 588810 - RNA, 64 nt, Homo Sapiens; identical to SEQ ID NO: 550336

SEQ ID NO: 588811 - RNA, 64 nt, Homo Sapiens; identical to SEQ ID NO: 550337

SEQ ID NO: 588812 - RNA, 64 nt, Homo Sapiens; identical to SEQ ID NO: 550338

SEQ ID NO: 588813 - RNA, 64 nt, Homo Sapiens; identical to SEQ ID NO: 550339

SEQ ID NO: 588814 - RNA, 64 nt, Homo Sapiens; identical to SEQ ID NO: 550340

SEQ ID NO: 588815 - RNA, 64 nt, Homo Sapiens; identical to SEQ ID NO: 550341

SEQ ID NO: 588816 - RNA, 64 nt, Homo Sapiens; identical to SEQ ID NO: 550342

SEQ ID NO: 588817 - RNA, 64 nt, Homo Sapiens
gccaccugagaccugcuccacgacccuuccaggcagagccgagaguucgccccaacccuucccc

SEQ ID NO: 588818 - RNA, 64 nt, Homo Sapiens
aacccggacagcucaguccugccagcagccgcaaagagccgaggcugccaggcccauuuauguc

SEQ ID NO: 588819 - RNA, 63 nt, Homo Sapiens
gccaccuaaacgaucaguguggugcugcguucuggccaguaaauuccauguuuuuggcuauau

SEQ ID NO: 588820 - RNA, 63 nt, Homo Sapiens
ucuagaccuuagacacucaagauuacggucccgggccaguaacagcaccugggagcuugguag

SEQ ID NO: 588821 - RNA, 63 nt, Homo Sapiens
gagaacuaaguaagaaacacaaugccaacagcuggccaguaauuaguguugugcacuucaugu

SEQ ID NO: 588822 - RNA, 63 nt, Homo Sapiens
auuuauuuauugagaguuuuuuagugcaaucugggccaguauuuuuauagauuaugauuaugu

SEQ ID NO: 588823 - RNA, 63 nt, Homo Sapiens
gaaaaguuuggcuacuaacaguagcauugugauggccaguauauccaguccauggauaaagaa

SEQ ID NO: 588824 - RNA, 63 nt, Homo Sapiens
augucagaacagagugcaacccagucacacuguggccaguaaaauacuauugccucauauugu

SEQ ID NO: 588825 - RNA, 63 nt, Homo Sapiens
gccacaaacaaguacuuuaccccacagcuuaguggccaguaaacacccuggggacuaggaaaa

SEQ ID NO: 588826 - RNA, 63 nt, Homo Sapiens
agcugucuugguaaaggagagagagagacauggggccaguaauuccggggugcucagaaguuu

SEQ ID NO: 588827 - RNA, 63 nt, Homo Sapiens
ugugcagaccccuccccgccacaaagucauuucggccaguagggucccaaggguccacgaugu

SEQ ID NO: 588828 - RNA, 63 nt, Homo Sapiens
ccccuguccccagccacacaccagacccaccugggccaguaggcuuccucacuguaucuuugc

SEQ ID NO: 588829 - RNA, 63 nt, Homo Sapiens
uggcagcccgaaagacacacagugucagagcauggccaguagugcccagcccugaccucagga

SEQ ID NO: 588830 - RNA, 63 nt, Homo Sapiens
uugggcaugggggagccuuugauuagguguucaggccaguaucugccacccccugugagcagg

SEQ ID NO: 588831 - RNA, 63 nt, Homo Sapiens
caggcaagucauagaauugaagaacaggaaaguggccaguagcaagacuuaauuuccuuguug

SEQ ID NO: 588832 - RNA, 63 nt, Homo Sapiens
uaaagugcaagacugaauuauuaaauuggcuuuggccaguagccagcuuuuuuuuuuuuuuuu

SEQ ID NO: 588833 - RNA, 63 nt, Homo Sapiens
aagcagaaguucuaccaccuugucaaaagcacaggccaguauucaaaguuugccaaccauaag

SEQ ID NO: 588834 - RNA, 63 nt, Homo Sapiens
uauacauccuggguaaugagagguggcuuuugcggccaguauuagacuggaaguucauaccua

SEQ ID NO: 588835 - RNA, 63 nt, Homo Sapiens
gcaggggcagagaaggaagggaccaggggacugggccaguauguggaggauggggccugcgug

SEQ ID NO: 588836 - RNA, 63 nt, Homo Sapiens
auaucuguuuuuaauguuuuguuucucccuccaggccaguauaaagggacuugaaguauuuuu

SEQ ID NO: 588837 - RNA, 63 nt, Homo Sapiens
guauaauuuuuaugcucuuugauuaucuaauaaggccaguauuucaaaagcuguucugaauuu

SEQ ID NO: 588838 - RNA, 63 nt, Homo Sapiens
auagagcuagcuaaucucuacaaacccucuguaggccaguaguucucaaaguguggucucugg

SEQ ID NO: 588839 - RNA, 63 nt, Homo Sapiens
ugcuagccucucuuacuaauggaauuauauacuggccaguaaaaugggccucccaauugcugu

SEQ ID NO: 588840 - RNA, 63 nt, Homo Sapiens
gucuuugaggaguucaccacguagcggcaucauggccaguaguaugaagugcucucguucuca

SEQ ID NO: 588841 - RNA, 63 nt, Homo Sapiens
ucagugagaauguuuauguuuuagguuuuggggggccaguaguauuauugauugugagauagg

SEQ ID NO: 588842 - RNA, 63 nt, Homo Sapiens
aauguuguguucacagucuaucucucuuucguaggccaguagcuuucucucucccucuuucuc

SEQ ID NO: 588843 - RNA, 63 nt, Homo Sapiens
caucuuagcuuggcagguguggcuucaacauugggccaguaggccuucccuuggagagggccu

SEQ ID NO: 588844 - RNA, 63 nt, Homo Sapiens
ugcggugugcgugguagguucagugaugagggcggccaguacccucugcacgcuugaccaaag

SEQ ID NO: 588845 - RNA, 63 nt, Homo Sapiens
aaguugagaaagaaagccacccaagacguuugaggccaguaggcguacuaacgucugcaaacc

SEQ ID NO: 588846 - RNA, 63 nt, Homo Sapiens
uuugacacuucccaguggaaccuucuaccccaaggccaguaguucucuuucucugguggucuu

SEQ ID NO: 588847 - RNA, 63 nt, Homo Sapiens
ccaaaccucuuccacgucacucuguaugucuuaggccaguauccccuaaacccaacucacguu

SEQ ID NO: 588848 - RNA, 63 nt, Homo Sapiens
uguggcucaguggagggagacccagcauagccaggccaguauggagcaccucacgcacagcuc

SEQ ID NO: 588849 - RNA, 63 nt, Homo Sapiens
uggugaaauugcuguggggguaucgggggauauggccaguaaaguauugagagacuaacaaau

SEQ ID NO: 588850 - RNA, 63 nt, Homo Sapiens
guugguugccccucaccucagagcucccccaaaggccaguaauggauccccggccucaguccc

SEQ ID NO: 588851 - RNA, 63 nt, Homo Sapiens
uacaguuccuagaagcagcccugcucuggcagaggccaguaaaggugcaggcauagcugccug

SEQ ID NO: 588852 - RNA, 63 nt, Homo Sapiens
ggaaauagaaaaacccugccccaccugcucccaggccaguaagccauaugaccucaugcaucu

SEQ ID NO: 588853 - RNA, 63 nt, Homo Sapiens
uguucucccuugccccaaccggagugaaaugcuggccaguacuggucucauacaaggauauuu

SEQ ID NO: 588854 - RNA, 63 nt, Homo Sapiens
uauugcuaaagaaagggagauuagcccucagcuggccaguacuucuuucaauccucauuaucu

SEQ ID NO: 588855 - RNA, 63 nt, Homo Sapiens
uuagccuccuucgcaggcauguccuggacaccgggccaguaucuauauauguguauguacguu

SEQ ID NO: 588856 - RNA, 63 nt, Homo Sapiens
gugcugggauuacaggugugagccaccacacuuggccaguauauccucaguaugaagauauuu

SEQ ID NO: 588857 - RNA, 63 nt, Homo Sapiens
ugucugcaucugugcuguguguguagugugguuggccaguaggugaguaucccugugugugug

SEQ ID NO: 588858 - RNA, 63 nt, Homo Sapiens
ugugaguguuuauauagaaaugaacauagaccuggccaguaaaaggcucugaggaggcuuaaa

SEQ ID NO: 588859 - RNA, 63 nt, Homo Sapiens
gagugcagggaggggcaggaaaggagacaaggaggccaguauggacacuguguccaguauggc

SEQ ID NO: 588860 - RNA, 63 nt, Homo Sapiens
caguuccccacccagcgauuagggagcugggcuggccaguacagccaguggggaguggguggg

SEQ ID NO: 588861 - RNA, 63 nt, Homo Sapiens
uucacacagaaaucuguagcacugcuuuuuugaggccaguagcaacauccagagaucauucuu

SEQ ID NO: 588862 - RNA, 63 nt, Homo Sapiens
uacgggaaaaaauguuuacuaagugaccaccaaggccaguaagauuuggggcaucucuauaga

SEQ ID NO: 588863 - RNA, 63 nt, Homo Sapiens
gaggaggagccauuguggcaccauucaggcagaggccaguacacucucucaugacugcacacc

SEQ ID NO: 588864 - RNA, 63 nt, Homo Sapiens
ccuuacccucuguaagauacugauucuuccuggggccaguauuaccuuguaugcaaauauuac

SEQ ID NO: 588865 - RNA, 63 nt, Homo Sapiens
gaaagucacauuuaggguuuauuuuuuacacuuggccaguaaaauaggguaaauccuauuaga

SEQ ID NO: 588866 - RNA, 63 nt, Homo Sapiens
caguuggggaaggugggaaguauccaguagccaggccaguaggauuauguacagaauaggacc

SEQ ID NO: 588867 - RNA, 63 nt, Homo Sapiens
gggagggaaagggagagggggugagggaggacaggccaguagggcuuuauaagugaggguagg

SEQ ID NO: 588868 - RNA, 63 nt, Homo Sapiens
gaucuuaugaagcuggaggagggugaagauuggggccaguaucgccccaggggguuagaggag

SEQ ID NO: 588869 - RNA, 63 nt, Homo Sapiens
gacuguguggugguaaaugccucuuaaaagccaggccaguacuaguuucugaagucuucacag

SEQ ID NO: 588870 - RNA, 63 nt, Homo Sapiens
uggcagcagcuuuucauugcguuuuuaguccuaggccaguagagugcuuuggguugaaaagaa

SEQ ID NO: 588871 - RNA, 63 nt, Homo Sapiens
gggucguaaugacuuauuguguaaaacacagagggccaguaacaacuguaucuugagguggua

SEQ ID NO: 588872 - RNA, 63 nt, Homo Sapiens
cuuuauucuuccaaguucauucauacucaaagaggccaguacuuugccauccuugcacuucug

SEQ ID NO: 588873 - RNA, 63 nt, Homo Sapiens
gaauuuauagagcauuuuuuuucuuaccaagauggccaguaucauuuuacccccaccucccaa

SEQ ID NO: 588874 - RNA, 63 nt, Homo Sapiens
aucucugcuuucagaaguagcccuuuaaaugagggccaguauuugauauuuaauccuuaaaac

SEQ ID NO: 588875 - RNA, 63 nt, Homo Sapiens
guauacuacaguuauguuuagugagguacuuugggccaguagacaaauuuaauaacuuuaugg

SEQ ID NO: 588876 - RNA, 63 nt, Homo Sapiens
auuauaccauuggcaugaaguuaauaauuuuguggccaguaaauuuauuuaauacaaucggau

SEQ ID NO: 588877 - RNA, 63 nt, Homo Sapiens
cuccagcccucccaaugccaaggucaggucugaggccaguaucgggaacgucaggucucucug

SEQ ID NO: 588878 - RNA, 63 nt, Homo Sapiens
agcagagauaacacuucccaacucauuuugugaggccaguauuacccuaauagcaaaaccagg

SEQ ID NO: 588879 - RNA, 63 nt, Homo Sapiens
aaaaagauggaacuuuuccaauucaguuuuugaggccaguacaaccuugauaacaaaaccuaa

SEQ ID NO: 588880 - RNA, 63 nt, Homo Sapiens
caggccucuuggcagucacaucucuuccuccgaggccaguaccuuuccauuuauucuuugauc

SEQ ID NO: 588881 - RNA, 63 nt, Homo Sapiens
guccuggcaggaagccaccauuggagaaggugaggccaguaaccaucucaugggauucgcuau

SEQ ID NO: 588882 - RNA, 63 nt, Homo Sapiens
gggguacaaaggggcccaugcaggagaugcccuggccaguaggaccuccaacagguuguuucc

SEQ ID NO: 588883 - RNA, 63 nt, Homo Sapiens
uguuuuuagugaaauauuaucucuuuguagguuggccaguauaacucuaaauacuaccggagu

SEQ ID NO: 588884 - RNA, 63 nt, Homo Sapiens
aaaaaguauauuuauugcagaggauguucauaaggccaguaugauuuauaaaugcaaucuccc

SEQ ID NO: 588885 - RNA, 63 nt, Homo Sapiens
gcuaucauuagccacagguacugcugauuauaaggccaguaaaauuuuaguaccuggagguuu

SEQ ID NO: 588886 - RNA, 63 nt, Homo Sapiens
ugcugugggcuggucccacacauccaggaaagaggccaguagagaauucugcccacuuuuuau

SEQ ID NO: 588887 - RNA, 63 nt, Homo Sapiens
cucuaccugaacaaagagaugaauaauuccaugggccaguaugccaguuugaauucucagucu

SEQ ID NO: 588888 - RNA, 63 nt, Homo Sapiens
uuuccuaagucuuugcucaauggugccaccacuggccaguaccggcuaauaggaauucccucc

SEQ ID NO: 588889 - RNA, 52 nt, Homo Sapiens
agugaguggccccaccugugagggccaguaccucuuucaggcaaagcacuaa

SEQ ID NO: 588890 - RNA, 63 nt, Homo Sapiens
augacauaauuuaugucuccauuuuguuguauuggccaguacuuuuacaaaucaaaacaucuc

SEQ ID NO: 588891 - RNA, 63 nt, Homo Sapiens
ucugagucuagaacccaggcuucuaaauuucuaggccaguacuacugcucucaaaagagauua

SEQ ID NO: 588892 - RNA, 63 nt, Homo Sapiens
guaccaagugaauuuaaauaauugguguggauuggccaguagcuaagaagugggcuuuuaaag

SEQ ID NO: 588893 - RNA, 63 nt, Homo Sapiens
ccccccaaccacaggaauggaggcgggacacagggccaguaggagcaauaggauuuuaauaaa

SEQ ID NO: 588894 - RNA, 63 nt, Homo Sapiens
aucauauuuguauuucagguucuuuuuuaucuuggccaguauauuaugacuaaacgauuauau

SEQ ID NO: 588895 - RNA, 63 nt, Homo Sapiens
ucauugucugaccaaaauuccuucugcacaugaggccaguauaggcaacgucacauuuguuug

SEQ ID NO: 588896 - RNA, 63 nt, Homo Sapiens
gcccacugccuaccgcgugagccgcagcccuggggccaguaggaagcggacccgcuccaggua

SEQ ID NO: 588897 - RNA, 63 nt, Homo Sapiens
cugagcaagggccuuggaauaagaaaacagcauggccaguaaaguucuuccuacauaaaaugc

SEQ ID NO: 588898 - RNA, 63 nt, Homo Sapiens
guggacuuaacucccaaguggacccgcagugacggccaguaaaaacacucuguacugugugcg

SEQ ID NO: 588899 - RNA, 63 nt, Homo Sapiens
augcauuacaacucuguagauuguuaguuacuaggccaguagcuaggaauugguauaaauuua

SEQ ID NO: 588900 - RNA, 63 nt, Homo Sapiens
uucagagggagccagcucuuuauguuggccccaggccaguacuaagcaaauuaaaaagaccga

SEQ ID NO: 588901 - RNA, 63 nt, Homo Sapiens
gauuuuuuugaaguuucaaucagcucaggugaaggccaguaauauuauggauaacucgaaaga

SEQ ID NO: 588902 - RNA, 63 nt, Homo Sapiens
agacacgacagcacacacagcugagaucgaagaggccaguaggagcacagcacuuugguuuug

SEQ ID NO: 588903 - RNA, 63 nt, Homo Sapiens
cacagguggaaaacgcagccguagaauaugcacggccaguaguccguucuuauagaugauuuu

SEQ ID NO: 588904 - RNA, 63 nt, Homo Sapiens
uccaggccugaggcugcugacguuugacaccagggccaguagagagugcccuuuuguaucuua

SEQ ID NO: 588905 - RNA, 63 nt, Homo Sapiens
gauguuuaaucuucauuaauaaauaccucaaauggccaguaacucaauauuacuuuucuuccu

SEQ ID NO: 588906 - RNA, 63 nt, Homo Sapiens
agugcuuugucuauucuuuauuucucucaggguggccaguauuuugacuuauuuauccugcuu

SEQ ID NO: 588907 - RNA, 63 nt, Homo Sapiens
ucuuaaacaaaugaauaggccuacuguuaaaaaggccaguauauuggucuaacuucuacauuc

SEQ ID NO: 588908 - RNA, 63 nt, Homo Sapiens
acagucauuacuccauuaacgaucccaucgccuggccaguagauaagcacugaauucacuacu

SEQ ID NO: 588909 - RNA, 63 nt, Homo Sapiens
cacugggcccauuugaaggugucucagacauuuggccaguaugucuuucucagggguuugguc

SEQ ID NO: 588910 - RNA, 63 nt, Homo Sapiens
aguuuuauaagguauuugcauuuuagaagcucuggccaguaguuguuaagauguuggcauuaa

SEQ ID NO: 588911 - RNA, 63 nt, Homo Sapiens
agugaagucugcuccuugaagucacgugaguggggccaguaagaagcauucccuuggugaauu

SEQ ID NO: 588912 - RNA, 63 nt, Homo Sapiens
aauguguucuuaauuccuagugccacuagaaagggccaguagccuagauaaauguggugaaau

SEQ ID NO: 588913 - RNA, 63 nt, Homo Sapiens
ucgugcccgccuggugccuugcuggaaccuuuuggccaguagggcuuggcaccuuagcagacu

SEQ ID NO: 588914 - RNA, 63 nt, Homo Sapiens
uauugggacaguccucuucuauauguuuuaaguggccaguaauuuaaugaauuucugguuugu

SEQ ID NO: 588915 - RNA, 63 nt, Homo Sapiens
ccagguucguauagaaaaagcacagcucucacuggccaguagcugccaaaaagaacacccauc

SEQ ID NO: 588916 - RNA, 63 nt, Homo Sapiens
ugagaggcaguggccucuugagugaacaggggaggccaguagaugccccagauccagagccgu

SEQ ID NO: 588917 - RNA, 63 nt, Homo Sapiens
cugguuacccaacuacagaaccuccuuugaucaggccaguagguugugaugcaggcuggagcc

SEQ ID NO: 588918 - RNA, 63 nt, Homo Sapiens
cucccauagggcuuuuccaagcugccacuggucggccaguacagccuccggaagcagcccuac

SEQ ID NO: 588919 - RNA, 63 nt, Homo Sapiens
gugaaacccugucucuccuacgagaccagcaauggccaguaugggaucaugaagucaagaguu

SEQ ID NO: 588920 - RNA, 63 nt, Homo Sapiens
agccucuagcuacccuguaucgaggcaaggggaggccaguaaaguuugccaagccugauccug

SEQ ID NO: 588921 - RNA, 63 nt, Homo Sapiens
aauguaacuaagcauuuguguucugauaucugaggccaguaacuauuaauaucuaguucucag

SEQ ID NO: 588922 - RNA, 63 nt, Homo Sapiens
uaauaauguuuauaagcugggcauggucgcucaggccaguaaucccagugacuuaggaggcug

SEQ ID NO: 588923 - RNA, 63 nt, Homo Sapiens
cggccuggcagaggagcccaagggacugaagauggccaguagcuggguccugaggccccugaa

SEQ ID NO: 588924 - RNA, 63 nt, Homo Sapiens
cugaccucagggcucccagcucggggccuguggggccaguaugcuggucugggagucccuccu

SEQ ID NO: 588925 - RNA, 63 nt, Homo Sapiens
ugagaaaccuggcagccugcuguuaacaacacaggccaguauuggguuuuauugaauuuggua

SEQ ID NO: 588926 - RNA, 63 nt, Homo Sapiens
uggauuguauugugagauccugugauuccugguggccaguauccuggauuccucuaagaucuu

SEQ ID NO: 588927 - RNA, 63 nt, Homo Sapiens
auagaagcagaaaaacauuuagggauaacaucaggccaguagaauuaagccucuccaccuguc

SEQ ID NO: 588928 - RNA, 63 nt, Homo Sapiens
cacccccaaaguaagaagaaacauguuuccaguggccaguaugucuuucauugcuuugcaccc

SEQ ID NO: 588929 - RNA, 63 nt, Homo Sapiens
auuaacugccaaaacaagagccugauuuuuugaggccaguaauucguuugcuagaauugauuu

SEQ ID NO: 588930 - RNA, 63 nt, Homo Sapiens
cuauuaggagacucuuggaacauuucuccagagggccaguauccuaaugggauccagcagggc

SEQ ID NO: 588931 - RNA, 63 nt, Homo Sapiens
uuggggguaggaguccccuaguaggggagccaaggccaguagucagaagcgaugggguaccgu

SEQ ID NO: 588932 - RNA, 63 nt, Homo Sapiens
cagaauuaaagugggggagacuguuugcccuuaggccaguacaagacaccaccuuccugccag

SEQ ID NO: 588933 - RNA, 63 nt, Homo Sapiens
uauuaauaucuaguucucaguucugauaucugaggccaguaacaguguaacuaagcauuugug

SEQ ID NO: 588934 - RNA, 63 nt, Homo Sapiens
cauccuguccuucucuuuccaagagaagaaaauggccaguauuauccacuuucuucuaaaaua

SEQ ID NO: 588935 - RNA, 63 nt, Homo Sapiens
uauuaauaucuaguucucaguucugauaucugaggccaguaacaauguaacuaaguauuugug

SEQ ID NO: 588936 - RNA, 63 nt, Homo Sapiens
gcagauuuuaacugauuuggauaaaagaauauuggccaguauuaagcugcggucuccuguuug

SEQ ID NO: 588937 - RNA, 63 nt, Homo Sapiens
ccuuucacguauuccgucugcacaggcaaccaaggccaguagaaagcuauggcugcaaaaccc

SEQ ID NO: 588938 - RNA, 63 nt, Homo Sapiens
aaaaauuggauaaaguauaggaggguuacuuggggccaguaaaucaguagacugaacauucaa

SEQ ID NO: 588939 - RNA, 63 nt, Homo Sapiens
ccccugcuggucgcuguuucggggacucggggcggccaguaccaccgccugaggcggggcuca

SEQ ID NO: 588940 - RNA, 63 nt, Homo Sapiens
ggcugcaaugcagcauguugcccuggcaccuguggccaguacucgggacagacuaagggcgcu

SEQ ID NO: 588941 - RNA, 63 nt, Homo Sapiens
cuguguuggccccugugccucagucccgcggauggccaguagggggcgcuggaggacugcggg

SEQ ID NO: 588942 - RNA, 63 nt, Homo Sapiens
uuaauccuauuuauccccuggaaugugcgugcuggccaguaggagggcuggcuuuggcagcuc

SEQ ID NO: 588943 - RNA, 63 nt, Homo Sapiens
aaagagccccccgggucacccccgccccacugaggccaguagggggccaggccucccacuccu

SEQ ID NO: 588944 - RNA, 63 nt, Homo Sapiens
gcucuuguccaggaagaucugcaacauacacauggccaguaauacuacuaguuauuugugaua

SEQ ID NO: 588945 - RNA, 63 nt, Homo Sapiens
gauugaguucaucaugagccguugcuaaugccaggccaguaaaaguauaacagcaaauaacca

SEQ ID NO: 588946 - RNA, 63 nt, Homo Sapiens
ucgccagaggagcacuuggcaaggucagugaggggccaguagacccccggagaagcaguaccg

SEQ ID NO: 588947 - RNA, 63 nt, Homo Sapiens
cauuguugugguuguguuuuaacggcuuuugaaggccaguaacccaucagggaagcuuguugu

SEQ ID NO: 588948 - RNA, 63 nt, Homo Sapiens
ugccagccauuucucaaaccuagugauuuugguggccaguaaauuuugcuuguacagaaucug

SEQ ID NO: 588949 - RNA, 63 nt, Homo Sapiens
aaaaaugaagucugacuagaauucuauugcagaggccaguacauuuaguauggcauugaguug

SEQ ID NO: 588950 - RNA, 63 nt, Homo Sapiens
caguuuacuucuaaguaaucacagauaauacauggccaguaaucccaggcuggccauucauuc

SEQ ID NO: 588951 - RNA, 63 nt, Homo Sapiens
cauggaagugaagacuguaagugacuaagcccuggccaguaggcuugcagcuagcaagguugu

SEQ ID NO: 588952 - RNA, 63 nt, Homo Sapiens
ucacuguguccacaugagcgaaccccagcacguggccaguaucaucagcuccuucuuacagug

SEQ ID NO: 588953 - RNA, 63 nt, Homo Sapiens
gggcccccucccucuccucugugcagacggcagggccaguauguuaguggggaaagggacggg

SEQ ID NO: 588954 - RNA, 63 nt, Homo Sapiens
gaucagaaccauuuuacuuuuacucuuagaggaggccaguaaucuacuuaaguacuugucaug

SEQ ID NO: 588955 - RNA, 63 nt, Homo Sapiens
cuuggggguggggggaggguagcccucuuaaaaggccaguacuacagugaccuccacccccgc

SEQ ID NO: 588956 - RNA, 63 nt, Homo Sapiens
cagccaaccccguggggaccauggagagucgggggccaguagccacccacauucgcugaagcg

SEQ ID NO: 588957 - RNA, 63 nt, Homo Sapiens
acaguacaggaucuuuggucuacucuaucacaaggccaguaccacacucaugaagaaagaaca

SEQ ID NO: 588958 - RNA, 63 nt, Homo Sapiens
aaaauguaguagacuuaaaggucauguagaaaaggccaguauaaaauaugcucacaguuugua

SEQ ID NO: 588959 - RNA, 63 nt, Homo Sapiens
aggaauaauaaaucccacuucccaauaaggugaggccaguagcccggaagggcuccauacugu

SEQ ID NO: 588960 - RNA, 64 nt, Homo Sapiens; identical to SEQ ID NO: 68768

SEQ ID NO: 588961 - RNA, 64 nt, Homo Sapiens; identical to SEQ ID NO: 68769

SEQ ID NO: 588962 - RNA, 64 nt, Homo Sapiens; identical to SEQ ID NO: 68770

SEQ ID NO: 588963 - RNA, 64 nt, Homo Sapiens; identical to SEQ ID NO: 68771

SEQ ID NO: 588964 - RNA, 64 nt, Homo Sapiens; identical to SEQ ID NO: 68772

SEQ ID NO: 588965 - RNA, 64 nt, Homo Sapiens; identical to SEQ ID NO: 68773

SEQ ID NO: 588966 - RNA, 64 nt, Homo Sapiens; identical to SEQ ID NO: 68774

SEQ ID NO: 588967 - RNA, 64 nt, Homo Sapiens; identical to SEQ ID NO: 68775

SEQ ID NO: 588968 - RNA, 64 nt, Homo Sapiens; identical to SEQ ID NO: 68776

SEQ ID NO: 588969 - RNA, 64 nt, Homo Sapiens; identical to SEQ ID NO: 68777

SEQ ID NO: 588970 - RNA, 64 nt, Homo Sapiens; identical to SEQ ID NO: 68778

SEQ ID NO: 588971 - RNA, 64 nt, Homo Sapiens; identical to SEQ ID NO: 68779

SEQ ID NO: 588972 - RNA, 64 nt, Homo Sapiens; identical to SEQ ID NO: 68780

SEQ ID NO: 588973 - RNA, 64 nt, Homo Sapiens; identical to SEQ ID NO: 68781

SEQ ID NO: 588974 - RNA, 64 nt, Homo Sapiens; identical to SEQ ID NO: 68782

SEQ ID NO: 588975 - RNA, 64 nt, Homo Sapiens; identical to SEQ ID NO: 68783

SEQ ID NO: 588976 - RNA, 64 nt, Homo Sapiens; identical to SEQ ID NO: 68784

SEQ ID NO: 588977 - RNA, 64 nt, Homo Sapiens; identical to SEQ ID NO: 68785

SEQ ID NO: 588978 - RNA, 64 nt, Homo Sapiens; identical to SEQ ID NO: 68786

SEQ ID NO: 588979 - RNA, 64 nt, Homo Sapiens; identical to SEQ ID NO: 68787

SEQ ID NO: 588980 - RNA, 64 nt, Homo Sapiens; identical to SEQ ID NO: 68788

SEQ ID NO: 588981 - RNA, 64 nt, Homo Sapiens; identical to SEQ ID NO: 68789

SEQ ID NO: 588982 - RNA, 64 nt, Homo Sapiens; identical to SEQ ID NO: 68790

SEQ ID NO: 588983 - RNA, 64 nt, Homo Sapiens; identical to SEQ ID NO: 68791

SEQ ID NO: 588984 - RNA, 64 nt, Homo Sapiens; identical to SEQ ID NO: 68792

SEQ ID NO: 588985 - RNA, 64 nt, Homo Sapiens; identical to SEQ ID NO: 68793

SEQ ID NO: 588986 - RNA, 64 nt, Homo Sapiens; identical to SEQ ID NO: 68794

SEQ ID NO: 588987 - RNA, 64 nt, Homo Sapiens; identical to SEQ ID NO: 68795

SEQ ID NO: 588988 - RNA, 64 nt, Homo Sapiens; identical to SEQ ID NO: 68796

SEQ ID NO: 588989 - RNA, 64 nt, Homo Sapiens; identical to SEQ ID NO: 68797

SEQ ID NO: 588990 - RNA, 64 nt, Homo Sapiens; identical to SEQ ID NO: 68798

SEQ ID NO: 588991 - RNA, 64 nt, Homo Sapiens; identical to SEQ ID NO: 68799

SEQ ID NO: 588992 - RNA, 64 nt, Homo Sapiens; identical to SEQ ID NO: 68800

SEQ ID NO: 588993 - RNA, 64 nt, Homo Sapiens; identical to SEQ ID NO: 68801

SEQ ID NO: 588994 - RNA, 59 nt, Homo Sapiens; identical to SEQ ID NO: 68802

SEQ ID NO: 588995 - RNA, 64 nt, Homo Sapiens; identical to SEQ ID NO: 68803

SEQ ID NO: 588996 - RNA, 64 nt, Homo Sapiens; identical to SEQ ID NO: 68804

SEQ ID NO: 588997 - RNA, 64 nt, Homo Sapiens; identical to SEQ ID NO: 68805

SEQ ID NO: 588998 - RNA, 64 nt, Homo Sapiens; identical to SEQ ID NO: 68806

SEQ ID NO: 588999 - RNA, 64 nt, Homo Sapiens; identical to SEQ ID NO: 68807

SEQ ID NO: 589000 - RNA, 64 nt, Homo Sapiens; identical to SEQ ID NO: 68808

SEQ ID NO: 589001 - RNA, 64 nt, Homo Sapiens; identical to SEQ ID NO: 68809

SEQ ID NO: 589002 - RNA, 64 nt, Homo Sapiens; identical to SEQ ID NO: 68810

SEQ ID NO: 589003 - RNA, 64 nt, Homo Sapiens; identical to SEQ ID NO: 68811

SEQ ID NO: 589004 - RNA, 64 nt, Homo Sapiens; identical to SEQ ID NO: 68812

SEQ ID NO: 589005 - RNA, 64 nt, Homo Sapiens
gcguguauaauuuucuuaacuuguacaguugguaaacuuuuaugagaggaauuguuauucugag

SEQ ID NO: 589006 - RNA, 64 nt, Homo Sapiens
aguuuuauauagcugauagaccaaccuauauccaaacuuuuauaaaauauuaauuauucuuguu

SEQ ID NO: 589007 - RNA, 64 nt, Homo Sapiens
aguaugaguuuuuuguuguuuuuguuuuacuuaaaacuuuuaauuuauccagaauggcaguagc

SEQ ID NO: 589008 - RNA, 64 nt, Homo Sapiens
acccagagcagauacucauaaaguauaaaguaaaaacuuuuaaccauuauuaaacagagaacuu

SEQ ID NO: 589009 - RNA, 64 nt, Homo Sapiens
ucagaaaauacaagauuuacauaaaggucauuucaacuuuuaagguuaccagugauuguauaaa

SEQ ID NO: 589010 - RNA, 64 nt, Homo Sapiens
ugcaauuguuuugcaguguauucuuuaccuccuaaacuuuuagucagacuuccaagugugcuaa

SEQ ID NO: 589011 - RNA, 64 nt, Homo Sapiens
uucaacaccugaaaaucaugacuuucauugguaaaacuuuuaaagaauacuaauucauuuuauc

SEQ ID NO: 589012 - RNA, 64 nt, Homo Sapiens
gugauuauaaagcauuuuuuaagagacaaauuuuaacuuuuaauuuuuauuuuggcaaaacugu

SEQ ID NO: 589013 - RNA, 64 nt, Homo Sapiens
cgaucacaucuacagaaaauggcuaaaccaaguuaacuuuuauuauagacagugaauaaaacac

SEQ ID NO: 589014 - RNA, 64 nt, Homo Sapiens
uuuauauuucucguauuuaauaugggugaacaccaacuuuuauuuggaauaauaauuuuccucc

SEQ ID NO: 589015 - RNA, 64 nt, Homo Sapiens
uuugacuuauuguccccacuaaaacaaaacaaaaaacuuuuaaugccuuccacauuaauuagau

SEQ ID NO: 589016 - RNA, 64 nt, Homo Sapiens
acuuccuuaacauuuauacauuguuuuaagaaaaaacuuuuaaaaauauuucuuauagucuccu

SEQ ID NO: 589017 - RNA, 64 nt, Homo Sapiens
gucucagcucugagggucuuugugaguucccaccaacuuuuaauuauucaugcccuugaccaug

SEQ ID NO: 589018 - RNA, 64 nt, Homo Sapiens
aacauuuuccugugcauuaaccucugcaugugaaaacuuuuaacaguuacugaacuauguaaau

SEQ ID NO: 589019 - RNA, 64 nt, Homo Sapiens
gaauggggucugugggcuaguuaaaauagaaauaaacuuuuaaaauauccacagaauugauauu

SEQ ID NO: 589020 - RNA, 64 nt, Homo Sapiens
ggaggagugaguguguucaaagaucaacauauuuaacuuuuaaacacuaucucaaagccagcau

SEQ ID NO: 589021 - RNA, 64 nt, Homo Sapiens
ggaugaauaacuaccuguggcauuguugguucugaacuuuuacaguucaggccugcugugaauc

SEQ ID NO: 589022 - RNA, 64 nt, Homo Sapiens
acauuugcucaagaauuuuuuccgucaaauugugaacuuuuaauucuugcauuguaauuggcug

SEQ ID NO: 589023 - RNA, 64 nt, Homo Sapiens
ugcaaauauuuuaacaauauuaaaugugcaauagaacuuuuauaaaauaauuagaacagagauu

SEQ ID NO: 589024 - RNA, 64 nt, Homo Sapiens
auaugugaauuaauaggcuguggugccauauauuaacuuuuaauuguguaacuuuuauguuuaa

SEQ ID NO: 589025 - RNA, 64 nt, Homo Sapiens
ggcuguggugccauauauuaacuuuuaauuguguaacuuuuauguuuaaauuuugcacugcaau

SEQ ID NO: 589026 - RNA, 64 nt, Homo Sapiens
uuaugcuccaucccauucacuucugcauuccuguaacuuuuaaucccuauguuugucucacuuu

SEQ ID NO: 589027 - RNA, 64 nt, Homo Sapiens
aauaugcagaaucucugccuagaaucuuuauucaaacuuuuauuagccagugaaacacuugcuu

SEQ ID NO: 589028 - RNA, 64 nt, Homo Sapiens
uuuuuuucccauguugcucauuuuguagagacaaaacuuuuauuccagcuaauuuuuuauauuu

SEQ ID NO: 589029 - RNA, 64 nt, Homo Sapiens
accccuuuccccccaucucuucccuuuccaaucaaacuuuuagcguguuguaaccauggaaaag

SEQ ID NO: 589030 - RNA, 64 nt, Homo Sapiens
cauuuguuuuuguuuggcuguuuguuuauuuuuuaacuuuuauuucgucucaguuuuuggucac

SEQ ID NO: 589031 - RNA, 64 nt, Homo Sapiens
uagcuguuacuuuuacaguaccugauacuccuaaaacuuuuaacuuauacaaauuagucaauaa

SEQ ID NO: 589032 - RNA, 64 nt, Homo Sapiens
aacauugcaacucagggcuaaagucauccagugaaacuuuuagagccagaaguaacuuuguccc

SEQ ID NO: 589033 - RNA, 64 nt, Homo Sapiens
aguuacagcaauaaagaauaaaucucaggaauuaaacuuuuaacgaacuuuuaccgacuccaaa

SEQ ID NO: 589034 - RNA, 64 nt, Homo Sapiens
gacuccaaaaaucucaggaacugcucacuuuaagaacuuuuaccgggaaagacauuucuuuccu

SEQ ID NO: 589035 - RNA, 64 nt, Homo Sapiens
ucuagccuaaccuucaacauaaaauaaugaagagaacuuuuaaacuuuuuuaugaauuccuaaa

SEQ ID NO: 589036 - RNA, 64 nt, Homo Sapiens
aacaaagggauuaaagaccuaaauaugaagacaaaacuuuuaaaugagaaucuauaagguuauu

SEQ ID NO: 589037 - RNA, 64 nt, Homo Sapiens
ccauuuuguuaaaaaaaaaaaaaaaaaagcacauaacuuuuaacacuagaaucagcccgcaaga

SEQ ID NO: 589038 - RNA, 64 nt, Homo Sapiens
aggaucuaaauauucagguuuuaagccugcugcaaacuuuuaaaauauuaugauagauucugua

SEQ ID NO: 589039 - RNA, 64 nt, Homo Sapiens
uaaaauagucucuugaagcccuagucauggaaguaacuuuuauuuuaauugacauucucuuauu

SEQ ID NO: 589040 - RNA, 64 nt, Homo Sapiens
uucaucagauuuuuguuauauuuuuuggaagugaaacuuuuagcaagugggugucuaguuuuua

SEQ ID NO: 589041 - RNA, 64 nt, Homo Sapiens
uuguacauuucuguguuuuuuggaggugcaguuaaacuuuuaagcuuaagugugacaggacuga

SEQ ID NO: 589042 - RNA, 64 nt, Homo Sapiens
acgcuaagcuacuguccaaucucuugugauguguaacuuuuacaugugaauauuaaaguagauu

SEQ ID NO: 589043 - RNA, 64 nt, Homo Sapiens
gaaccuugcgauuugcacauuucuuuuuaagaugaacuuuuaaacucauuuuuguccaguguuu

SEQ ID NO: 589044 - RNA, 64 nt, Homo Sapiens
uguauagauauauauuucccuuuacaauaaaagcaacuuuuaaucauuuuucucuccaacauau

SEQ ID NO: 589045 - RNA, 64 nt, Homo Sapiens
accuaaauugcaagaucuaaauuuuccuguaauaaacuuuuagcuguacauuguuuacaucugg

SEQ ID NO: 589046 - RNA, 64 nt, Homo Sapiens
uuaaguucaaggguacauguggcaacaauuuuuuaacuuuuauuacuaaaaaugaaaaugauag

SEQ ID NO: 589047 - RNA, 64 nt, Homo Sapiens
guuuuuguuacaugcauugucuaucaacuuuuaaaacuuuuaacguuacguaccauauuuguaa

SEQ ID NO: 589048 - RNA, 64 nt, Homo Sapiens
acuuuuaacguuuuuguuacuauuuguaacuaucaacuuuuaaauagaaaauuguuacguacca

SEQ ID NO: 589049 - RNA, 64 nt, Homo Sapiens
ugaaucuguuaugauaaagaaaaaauaaaguggaaacuuuuagaguauuacuucauagggcaga

SEQ ID NO: 589050 - RNA, 64 nt, Homo Sapiens
uaaaauauuuucucaaacuaauucaugaaacagcaacuuuuaccaauaccuuuguauacucuca

SEQ ID NO: 589051 - RNA, 64 nt, Homo Sapiens
guugauccagcuguacggaaauuuaggguauuuaaacuuuuaaaggaucaugagcuguuucuug

SEQ ID NO: 589052 - RNA, 64 nt, Homo Sapiens
gaauuuuauuuuuaaaaaauacaugcacacucaaaacuuuuagcuuugaucacaaguggacaaa

SEQ ID NO: 589053 - RNA, 64 nt, Homo Sapiens
auagugauguucuguucuaagauuuuuuuuaaucaacuuuuaagcucucuacaugacauauuga

SEQ ID NO: 589054 - RNA, 64 nt, Homo Sapiens
acuuaaggcuuuguaaaaacguauguccucauagaacuuuuaauauuaaauaggauucuuagaa

SEQ ID NO: 589055 - RNA, 64 nt, Homo Sapiens
agauuauucaagaugaauuucuuggacaaauuuaaacuuuuaaaauuauuuucuuaguuuuguu

SEQ ID NO: 589056 - RNA, 64 nt, Homo Sapiens
uccaugacagaccagccuguuguuuuccaggugaaacuuuuagcauuagcaaagagguggguuc

SEQ ID NO: 589057 - RNA, 64 nt, Homo Sapiens
ugcugauauucagcaaauuucuaaguuuauggugaacuuuuaacucaauguguaaauagaucug

SEQ ID NO: 589058 - RNA, 64 nt, Homo Sapiens
auaguguuuuucaaaucuuuaacaucauuuuuucaacuuuuaagauauaauaucaacuauucua

SEQ ID NO: 589059 - RNA, 64 nt, Homo Sapiens
ggcauguuauuugaagugcuguaaaucacuugacaacuuuuaagagaaauuauauuuauaugaa

SEQ ID NO: 589060 - RNA, 64 nt, Homo Sapiens
gacaaauuguguuuuuauacaaacauuuuauacaaacuuuuauaggugacaugauaccuauucg

SEQ ID NO: 589061 - RNA, 64 nt, Homo Sapiens
uaccaaugcuacucugcuguucucugcauaccucaacuuuuacgcuuagccuccuucgaccuag

SEQ ID NO: 589062 - RNA, 64 nt, Homo Sapiens
uauuugaauugacaguuacaauuuacacaagcaaaacuuuuaaaaauacuagcccuuuuuauau

SEQ ID NO: 589063 - RNA, 64 nt, Homo Sapiens
uaucugaagguucuuuugcccuuauuaaccucucaacuuuuauugcuguauucuagucagacca

SEQ ID NO: 589064 - RNA, 64 nt, Homo Sapiens
cagcaauuuauuggcuagucauagaaaauuuuugaacuuuuaacuguauuuuaauugauguuua

SEQ ID NO: 589065 - RNA, 64 nt, Homo Sapiens
uuugacuuuaauuguaaaagccguuaauguagaaaacuuuuaaaaaaauuaauauggcagaaua

SEQ ID NO: 589066 - RNA, 64 nt, Homo Sapiens
gcuuguugaucaguguugaagaaagugcaaaaggaacuuuuauauauuugacaguguaggaaau

SEQ ID NO: 589067 - RNA, 64 nt, Homo Sapiens
uaugguuccuuccuucccuccuaaaauaugacuuaacuuuuaagagaaauguucugacacccac

SEQ ID NO: 589068 - RNA, 64 nt, Homo Sapiens
cgcugugugcgccucacaucuggcucccaguggaaacuuuuacuccuccucauccgcagaugug

SEQ ID NO: 589069 - RNA, 64 nt, Homo Sapiens
cuugaaucuaccuaccaaguagagucggggguauaacuuuuauaaacccuuucauucugguaca

SEQ ID NO: 589070 - RNA, 64 nt, Homo Sapiens
guuuacaaguuuuuuuuuucuuuuaucaacacuaaacuuuuaaauuugcuacuuauauaaaaau

SEQ ID NO: 589071 - RNA, 64 nt, Homo Sapiens
uuguagauaauauaaaauaauaaguuaagggaaaaacuuuuacugucuacagugguucaacuuu

SEQ ID NO: 589072 - RNA, 64 nt, Homo Sapiens
uuaagggaaaaacuuuuacugucuacagugguucaacuuuuaagaguuugaugaggugaucacu

SEQ ID NO: 589073 - RNA, 64 nt, Homo Sapiens
guuuggaauugcccugcccaagucacugucuuuuaacuuuuaaacugaauauuaaaauguaucu

SEQ ID NO: 589074 - RNA, 64 nt, Homo Sapiens
uuucauuugcuacugaauuugguaaauccuggguaacuuuuaucaagaugaagacauuuuaccc

SEQ ID NO: 589075 - RNA, 64 nt, Homo Sapiens
guacaucacacacacacucacugugcccagcccuaacuuuuaauuggauuacaggcgugagcca

SEQ ID NO: 589076 - RNA, 64 nt, Homo Sapiens
auacaacacacacacacacaccgcaccuggcccuaacuuuuaaugggauuacaggugugaucca

SEQ ID NO: 589077 - RNA, 64 nt, Homo Sapiens
uuauuuuauuuuauuuauuucagguguucuauuuaacuuuuauuaggaucuuaaagacaucccu

SEQ ID NO: 589078 - RNA, 64 nt, Homo Sapiens
auaaagaaauaaguaguuucgguuuccuuuuauuaacuuuuaaaauucuuccuaaaaauugaga

SEQ ID NO: 589079 - RNA, 64 nt, Homo Sapiens
cacacuaagauaaagauagauugucuagguugagaacuuuuacagaaaauucuaaaauuugucc

SEQ ID NO: 589080 - RNA, 64 nt, Homo Sapiens
gucaugaaaaagcauuaaccaaaauacauuuagaaacuuuuaaaauuuuuacuuagauacuaau

SEQ ID NO: 589081 - RNA, 64 nt, Homo Sapiens
guugaaaagacaauagcccaaaaacaauaauuuuaacuuuuaagaaaguaucauuacauauagg

SEQ ID NO: 589082 - RNA, 64 nt, Homo Sapiens
auggaucauacacaauagguuuuuaaaaauuaauaacuuuuaguaauuacuuuuauuaauuuaa

SEQ ID NO: 589083 - RNA, 64 nt, Homo Sapiens
cauacacaauagguuuuuuaaaauuaauauuaauaacuuuuauuaauuuaaaauagaaugcuua

SEQ ID NO: 589084 - RNA, 64 nt, Homo Sapiens
cccaauuguaaaacagucaccauuuacuaccaguaacuuuuaguuaaugucuuacaaggaaaaa

SEQ ID NO: 589085 - RNA, 64 nt, Homo Sapiens
uuuucccuaugucuguucuuacguauuuuuuuuaaacuuuuauuucaguaguguuuggggaaca

SEQ ID NO: 589086 - RNA, 64 nt, Homo Sapiens
aaccaaauucugcuauaagucuugaucuucaaugaacuuuuaaauaaugcauuuagcuggaaaa

SEQ ID NO: 589087 - RNA, 64 nt, Homo Sapiens
uuggcccagugugauugauugcuuuaucuuugguaacuuuuacuugaaugggauuugcugaauu

SEQ ID NO: 589088 - RNA, 64 nt, Homo Sapiens
cuuuugaaauaccuggaaaugcaguuuuaauaugaacuuuuaagacagaugucucuuacaugau

SEQ ID NO: 589089 - RNA, 64 nt, Homo Sapiens
aaaguucaaauucgagaagauuuaacucaaguggaacuuuuaacucguuugaccuccaaaccau

SEQ ID NO: 589090 - RNA, 64 nt, Homo Sapiens
ugaaagaugugacagugcuuuugacaacaccuaaaacuuuuaaacauaaaaaaucauacuggug

SEQ ID NO: 589091 - RNA, 64 nt, Homo Sapiens
aagaaaacuucuacaagugugaacaguguggcaaaacuuuuaaugaaugcucacaccuuauugc

SEQ ID NO: 589092 - RNA, 64 nt, Homo Sapiens
acagaugauuguuuuuuguucccagcuuacucugaacuuuuauguaaagucaugugccaccaca

SEQ ID NO: 589093 - RNA, 64 nt, Homo Sapiens
caaagaaauaagaugguauuugcugaagcuaaguaacuuuuaauguauuuugaauguacacgca

SEQ ID NO: 589094 - RNA, 64 nt, Homo Sapiens
uuuauucagauuuagaguaaaaaauaagcauauaaacuuuuauuaugugcucuuaacaguuuua

SEQ ID NO: 589095 - RNA, 64 nt, Homo Sapiens
uguuugcaucucucuaugaagauacgucuguccaaacuuuuaaaaggcauaacuguauuuuaug

SEQ ID NO: 589096 - RNA, 64 nt, Homo Sapiens
uuuguguauuagcaaugguuuuuacuaaugcuaaaacuuuuaaaguuuauuuuuuaauaaauug

SEQ ID NO: 589097 - RNA, 64 nt, Homo Sapiens
aagcccaaucaccagcaguuuuuaaaaaggugauaacuuuuauuagcucuugugggcuaucaag

SEQ ID NO: 589098 - RNA, 64 nt, Homo Sapiens
uuaaguucagggguacguguguacuuuucuuuuuaacuuuuauuuuugacccugugggaggaug

SEQ ID NO: 589099 - RNA, 64 nt, Homo Sapiens
acauaaacaccaacgauggcaagccaaaauacacaacuuuuagcgucaauuuuaugguucucag

SEQ ID NO: 589100 - RNA, 64 nt, Homo Sapiens
uccuaauuuaaaagcugugaaacuaauuguaugaaacuuuuauaaaaccauauccacacacaac

SEQ ID NO: 589101 - RNA, 64 nt, Homo Sapiens
ucaguuuuuaugaaguuguuuuuuuuuccuuuuaaacuuuuaagcagaaggacuuagaaacaug

SEQ ID NO: 589102 - RNA, 64 nt, Homo Sapiens
cuugaaaucuccucuacaugaucuuuguucuuuaacaguguauaccagaggguuaguuggggaa

SEQ ID NO: 589103 - RNA, 64 nt, Homo Sapiens
uaauuaugguuucauggacacuguugagcaauguacaguguauggugugcuuaccuguccacuc

SEQ ID NO: 589104 - RNA, 64 nt, Homo Sapiens
cuguaaaauacugucauacuugcuauuuccugguacaguguaguuuuuccccuuucauuugaau

SEQ ID NO: 589105 - RNA, 64 nt, Homo Sapiens
ugcagugcucaguaaggcagugcaauacucaguaacaguguaguacucaguaacagugaaguac

SEQ ID NO: 589106 - RNA, 64 nt, Homo Sapiens
cagugcucaguaaggcagugaauugcuuaguaacacaguguagugcucaguaggacagcauagu

SEQ ID NO: 589107 - RNA, 64 nt, Homo Sapiens
auuauaacucuauuggucuuugaaacaaagcgauacaguguaggugguaucauucucuuucuca

SEQ ID NO: 589108 - RNA, 64 nt, Homo Sapiens
uaggagcuaauuuguccaccagcauuaauguaacacaguguaguuaugaaaauauauugaagga

SEQ ID NO: 589109 - RNA, 64 nt, Homo Sapiens
uggcauugcuuuaucucacucuguuuugcuacuuacaguguacuuagaagcaucccuuuguaua

SEQ ID NO: 589110 - RNA, 64 nt, Homo Sapiens
uucuuuuaaauuauaucguguuguguacuuguacacaguguacauuauuuuuucuacaucuauu

SEQ ID NO: 589111 - RNA, 64 nt, Homo Sapiens
gucuuaggauaauugcugacuuuguaucuuggauacaguguaaaccagauccauauaaggugaa

SEQ ID NO: 589112 - RNA, 64 nt, Homo Sapiens
aggcucaaagaauuuauguaaccuucccagagucacaguguaaaguuagauguugaaacccagu

SEQ ID NO: 589113 - RNA, 64 nt, Homo Sapiens
guuauguggucacaugaugugcauagagauagcuacaguguaauaauuuacacuauuuugugcu

SEQ ID NO: 589114 - RNA, 64 nt, Homo Sapiens
ugauucuuagacauugcagucucuucgaggcuuuacaguguaaacugucuugccccuucaucuu

SEQ ID NO: 589115 - RNA, 64 nt, Homo Sapiens
aaguagcuuacaaggggacaagugguauucagggacaguguagccuuggugacuguauaaaguu

SEQ ID NO: 589116 - RNA, 64 nt, Homo Sapiens
auuacauacugaauuauuucuuuugugauguguaacaguguauaaggaaugccuguggucauag

SEQ ID NO: 589117 - RNA, 64 nt, Homo Sapiens
ggcuuaauuugggaggggggacuuauuucuguuuacaguguauuaccuuccuucccuccucuuc

SEQ ID NO: 589118 - RNA, 64 nt, Homo Sapiens
uuguuuuuacagaaaagauaaaacucaaaagagaacaguguauuccuucugaggggcuuuuaua

SEQ ID NO: 589119 - RNA, 64 nt, Homo Sapiens
cccucccaagcccucccugaugcaucucucggacacaguguaccuucuuuugccgaacgauggu

SEQ ID NO: 589120 - RNA, 64 nt, Homo Sapiens
cagcagggucagggccaaagggguggcagguaccacaguguaggcuacucuggguccugagggg

SEQ ID NO: 589121 - RNA, 64 nt, Homo Sapiens
gauucuccauggacuccagauuauguuuuaugauauggguuaggguuauguuuuauuauauauu

SEQ ID NO: 589122 - RNA, 64 nt, Homo Sapiens
uuuuauuauauauuuuauguuuauguuuuaugauauggguuaugacauuaauccagagagaauu

SEQ ID NO: 589123 - RNA, 64 nt, Homo Sapiens
augacaaaacuaaagguagaugaaaggauugugaauacuggaaauuccccuuuaaaggaaacuu

SEQ ID NO: 589124 - RNA, 64 nt, Homo Sapiens
gggaugucuguaaguccuaggccuuuuguaucuuauacuggaauauggguaaaggaaacauuuu

SEQ ID NO: 589125 - RNA, 64 nt, Homo Sapiens
ugauccuacaagcuuacuacacauaggaaaauucauacuggagagaaacuacaaaugugaagaa

SEQ ID NO: 589126 - RNA, 64 nt, Homo Sapiens
ugauccucaacuuuuacuaaacauaagguaauucauacuggagaaaagccauacaaaugagaag

SEQ ID NO: 589127 - RNA, 64 nt, Homo Sapiens
caguccucacaccuuucuacacauaagauaauuuauacuggagaggaacucuauaguugugaag

SEQ ID NO: 589128 - RNA, 64 nt, Homo Sapiens
uaaccaauccucauaccuuacuauacagaaauucauacuggagagaaagccuacaauugugaag

SEQ ID NO: 589129 - RNA, 64 nt, Homo Sapiens
cuuccuuaacccuuaacuguagauaagaaaauucauacuggaaagaaacccuacaaaugugaag

SEQ ID NO: 589130 - RNA, 64 nt, Homo Sapiens
ugauucucaacucuuacuacauguaagaguauuuauacuggaaagaaacccuacaaauguaaaa

SEQ ID NO: 589131 - RNA, 64 nt, Homo Sapiens
caguccgcaaagcucacugaacauaaguuaauucauacuggagaaaaacccuacaaauguaaag

SEQ ID NO: 589132 - RNA, 64 nt, Homo Sapiens
aaguccucaacucuuacugcacauaagaucauucauacuggagagaaaccuuacaaaugugagg

SEQ ID NO: 589133 - RNA, 64 nt, Homo Sapiens
caagucucaacacuuacuauacauaagauaauuuauacuggagcaaaaccuuggaaauucaaag

SEQ ID NO: 589134 - RNA, 64 nt, Homo Sapiens
aagucuucaacccuuucugcacauaauauaauucauacuggagagaaaccccacaaauaugaag

SEQ ID NO: 589135 - RNA, 64 nt, Homo Sapiens
gaaguuacacaaaugugaugacauaagaugauucauacuggagacauuucucaacccuuacuaa

SEQ ID NO: 589136 - RNA, 64 nt, Homo Sapiens
gaaaccuuacaagugugaagacacaagaaaauucauacuggagaugauccucaaaacucauuga

SEQ ID NO: 589137 - RNA, 64 nt, Homo Sapiens
gaaacccuacaaaugugaagacauaagagaauucauacuggagacgaucuucaacccuuauugg

SEQ ID NO: 589138 - RNA, 64 nt, Homo Sapiens
cuuucuuucucuaauaauccauguaacaaguucuauacuggaucauuuuuuuuuaaaguucagu

SEQ ID NO: 589139 - RNA, 64 nt, Homo Sapiens
uuuaaugagaaaaaguaccaaucuacagcuuaggauacuggagagcugaaaauaacagcuacac

SEQ ID NO: 589140 - RNA, 64 nt, Homo Sapiens
cuuaggucaaauuucuguuccaauuuaauugaccauacuggauaucaacucauaggcuuauuuc

SEQ ID NO: 589141 - RNA, 64 nt, Homo Sapiens
ccucuucccaagauggcacuuucuguggaauaagauacuggacucuguuuuccagacauacagg

SEQ ID NO: 589142 - RNA, 64 nt, Homo Sapiens
uuauagaguuugagccauuaucaauagacugauaauacuggaauugguugcuuucccuauuugu

SEQ ID NO: 589143 - RNA, 64 nt, Homo Sapiens
uuagcaguuuauuuaugaaaccuccuuuugacaaauacuggauaauugugagagacaacaguug

SEQ ID NO: 589144 - RNA, 64 nt, Homo Sapiens
cagacauaaauacuuauuuaguauuaaccugaccauacuggaauuguguuucuaaaguauuuau

SEQ ID NO: 589145 - RNA, 64 nt, Homo Sapiens
cagggauuuuuuuaaaaagucaaucagaaaagggauacuggagcuucuucauguauguaacagc

SEQ ID NO: 589146 - RNA, 64 nt, Homo Sapiens
gcucuuaaauguuccuguuaccauccuaauguaaauacuggauuuuucugucauuuagcaccau

SEQ ID NO: 589147 - RNA, 64 nt, Homo Sapiens
aagcccucaauucuuaacagacauaagauaauuuauacuggagagaaacucuacaaaucagaaa

SEQ ID NO: 589148 - RNA, 64 nt, Homo Sapiens
ugguugucacacuucauuguagguaagauaauucauacuggagaaaacgccuacaugugugaac

SEQ ID NO: 589149 - RNA, 64 nt, Homo Sapiens
cacuucucaacccugccuacacguaagauaauucauacuggaaggaaacccuacaaauaugagg

SEQ ID NO: 589150 - RNA, 64 nt, Homo Sapiens
aaauccucauccauuaguaaacauaagauaauucauacuggagagaaaaccuacaaaugugagg

SEQ ID NO: 589151 - RNA, 64 nt, Homo Sapiens
cugucccuccaauuuacugcacauaagauaauuuauacuggagagaagcccuacaaaugugaaa

SEQ ID NO: 589152 - RNA, 64 nt, Homo Sapiens
caauuuucaaaccuuacuaaacauaagauaacucauacuggagaaaaaucuuacaaaugugaag

SEQ ID NO: 589153 - RNA, 64 nt, Homo Sapiens
caguccucaauuuuuacuaaacauaagaaaauucauacuggagagaaacccuaugauugugaaa

SEQ ID NO: 589154 - RNA, 64 nt, Homo Sapiens
uuuaaaaguucucaacccuuauuacacauaauuuauacuggacagaaauccuaaagugugaaga

SEQ ID NO: 589155 - RNA, 64 nt, Homo Sapiens
aaguccucaauucuuaacagauauaagauguuucauacuggagcgaaacuacaauccugaauga

SEQ ID NO: 589156 - RNA, 64 nt, Homo Sapiens
cauaggucgucccugcuucaacaucacaguauucauacuggagagaaaccuuacgaauguauua

SEQ ID NO: 589157 - RNA, 64 nt, Homo Sapiens
uguaguucaaaccuuacuguacaucagagaauucauacuggagaaaagccauauaaauguagug

SEQ ID NO: 589158 - RNA, 64 nt, Homo Sapiens
cagaaaucaaaccucacugaacaugagaaaauucauacuggagagaaaccuuaucauuguaauc

SEQ ID NO: 589159 - RNA, 64 nt, Homo Sapiens
cagagacaaaaucuucuugagcaugaaaaaauucauacuggagagaaaccauucaaauguaaug

SEQ ID NO: 589160 - RNA, 64 nt, Homo Sapiens
ccuggccaaaaaauuaacauucuaaaggauuuaaauacuggaauuugaaaagccaaacugugaa

SEQ ID NO: 589161 - RNA, 55 nt, Homo Sapiens
agccuugcaugucaucauagacuucauacuggagagaaaccuuacaaaugugaag

SEQ ID NO: 589162 - RNA, 64 nt, Homo Sapiens
cacagaucacgccuuaaaagacauaggagaauucauacuggagagaaaccuuacaaguguaaug

SEQ ID NO: 589163 - RNA, 64 nt, Homo Sapiens
caucguucauaccuugcaguucaucagugaacucauacuggagagaaaccuuacaaaugucaug

SEQ ID NO: 589164 - RNA, 64 nt, Homo Sapiens
uuaagguccaaccucauucaccaucagcgaguucauacuggagaaaggcaugagugcgggcagu

SEQ ID NO: 589165 - RNA, 64 nt, Homo Sapiens
cacaguucuucguuccgucgccaucagagaguucauacuggaaugaggccuuauaagugaagca

SEQ ID NO: 589166 - RNA, 64 nt, Homo Sapiens
guaguugcaugaauguaaguugauaugaaaguucauacuggaggauuuuaacgauuuucaaagu

SEQ ID NO: 589167 - RNA, 64 nt, Homo Sapiens
gaaacccuaugaauguaaagacaugaacgaauucauacuggagaaguuccaguuauauucauau

SEQ ID NO: 589168 - RNA, 64 nt, Homo Sapiens
gaaacccuacaaauguaaggacaugaaaggacucauacuggagauacuacuacucagcucaaag

SEQ ID NO: 589169 - RNA, 64 nt, Homo Sapiens
gaaacccuacaaaugcaaggacaugaaaagacucauacuggagauaucacaacucugcucaaag

SEQ ID NO: 589170 - RNA, 64 nt, Homo Sapiens
gaaacccuacaaauguaaggacaugaaaaggcucauacuggagauaccaccaaucugcucaaaa

SEQ ID NO: 589171 - RNA, 64 nt, Homo Sapiens
gaaacccuauaaauauuaagacacaugagaauguauacuggagacuucacacagccuuuugagc

SEQ ID NO: 589172 - RNA, 64 nt, Homo Sapiens
gaagcugugugaauacaaacacacaaaagaguucauacuggacauguuccagcuccuucugaau

SEQ ID NO: 589173 - RNA, 64 nt, Homo Sapiens
aaacuucuacaugugugaacagguaagguaaguuauacuggagaugguugucacacuugauugu

SEQ ID NO: 589174 - RNA, 64 nt, Homo Sapiens
gaacuccugugacugugaagacauaaaaaaauucauacuggaggcaguccucaacucuuacuaa

SEQ ID NO: 589175 - RNA, 64 nt, Homo Sapiens
aaacuacuagaauaaacaauguagguaagauaauauacuggagaaauggcugucacacuugauu

SEQ ID NO: 589176 - RNA, 64 nt, Homo Sapiens
gaaaccaugcaugugugaagauauaagacaacucauacuggagacaguccuuaaggcuuacuac

SEQ ID NO: 589177 - RNA, 64 nt, Homo Sapiens
gaauuccuauaauuguguggcauucauguaauucauacuggaggguuccucaauccuuacuaaa

SEQ ID NO: 589178 - RNA, 64 nt, Homo Sapiens
aaaagcccuacaaaugugaaucauaaaagaauucauacuggagguguuccucacaccuuacuac

SEQ ID NO: 589179 - RNA, 64 nt, Homo Sapiens
gaaacccuacaaaugcgaagacauaagagaauucauacuggagacgguccucaaaccuugugga

SEQ ID NO: 589180 - RNA, 64 nt, Homo Sapiens
gaaaaucuacaaaggugaagacauaagaaaauucauacuggagagcugauucucagucuaguaa

SEQ ID NO: 589181 - RNA, 64 nt, Homo Sapiens
guaacuacacaaagauaaugacaucacaggguuuauacuggagaacccaggcaucaaaaccgga

SEQ ID NO: 589182 - RNA, 64 nt, Homo Sapiens
aaaacuuugcaaguauaaugacauacaauaauuuauacuggagauagcauuaaagccuuguaag

SEQ ID NO: 589183 - RNA, 64 nt, Homo Sapiens
gaaaucuuacaaaugucaucacaucagagaaucuauacuggacaucacguucacacgucauuag

SEQ ID NO: 589184 - RNA, 64 nt, Homo Sapiens
gaaaccuuacaaaugucaugucaucggugaacucauacuggagagaucguucacauauugcagg

SEQ ID NO: 589185 - RNA, 64 nt, Homo Sapiens
ucacacuggagagaaaccuuacaccuggaacaacauacuggacuacaagacuugggagugauuc

SEQ ID NO: 589186 - RNA, 64 nt, Homo Sapiens
gaaagcuuacaaauguaaggacauaggagaauuuauacuggagauuggaaaucacaccuuaaag

SEQ ID NO: 589187 - RNA, 64 nt, Homo Sapiens
aaaaacauacaaauguaaggagacaggagaauucauacuggagagucacaaaucacagcuugaa

SEQ ID NO: 589188 - RNA, 64 nt, Homo Sapiens
gaaacuuuacaaguguaaugucacaaagccauucauacuggagacacaauucaacccuuguaag

SEQ ID NO: 589189 - RNA, 64 nt, Homo Sapiens
gaaaccuuacaaaugggaggucaccauagacuucauacuggagacaaaaagcaaccuuugcaca

SEQ ID NO: 589190 - RNA, 64 nt, Homo Sapiens
gaaaccuuacaagcauaaugucauaaggcaauucauacuggagaucacaauucaacccuguaag

SEQ ID NO: 589191 - RNA, 64 nt, Homo Sapiens; identical to SEQ ID NO: 90763

SEQ ID NO: 589192 - RNA, 64 nt, Homo Sapiens; identical to SEQ ID NO: 90764

SEQ ID NO: 589193 - RNA, 64 nt, Homo Sapiens; identical to SEQ ID NO: 90765

SEQ ID NO: 589194 - RNA, 64 nt, Homo Sapiens; identical to SEQ ID NO: 90766

SEQ ID NO: 589195 - RNA, 64 nt, Homo Sapiens; identical to SEQ ID NO: 90767

SEQ ID NO: 589196 - RNA, 64 nt, Homo Sapiens; identical to SEQ ID NO: 90768

SEQ ID NO: 589197 - RNA, 64 nt, Homo Sapiens; identical to SEQ ID NO: 90769

SEQ ID NO: 589198 - RNA, 64 nt, Homo Sapiens; identical to SEQ ID NO: 90770

SEQ ID NO: 589199 - RNA, 64 nt, Homo Sapiens; identical to SEQ ID NO: 90771

SEQ ID NO: 589200 - RNA, 64 nt, Homo Sapiens; identical to SEQ ID NO: 90772

SEQ ID NO: 589201 - RNA, 64 nt, Homo Sapiens; identical to SEQ ID NO: 90773

SEQ ID NO: 589202 - RNA, 64 nt, Homo Sapiens; identical to SEQ ID NO: 90774

SEQ ID NO: 589203 - RNA, 64 nt, Homo Sapiens; identical to SEQ ID NO: 90775

SEQ ID NO: 589204 - RNA, 64 nt, Homo Sapiens; identical to SEQ ID NO: 90776

SEQ ID NO: 589205 - RNA, 64 nt, Homo Sapiens; identical to SEQ ID NO: 90777

SEQ ID NO: 589206 - RNA, 64 nt, Homo Sapiens; identical to SEQ ID NO: 90778

SEQ ID NO: 589207 - RNA, 64 nt, Homo Sapiens; identical to SEQ ID NO: 90779

SEQ ID NO: 589208 - RNA, 64 nt, Homo Sapiens; identical to SEQ ID NO: 90780

SEQ ID NO: 589209 - RNA, 64 nt, Homo Sapiens; identical to SEQ ID NO: 90781

SEQ ID NO: 589210 - RNA, 64 nt, Homo Sapiens; identical to SEQ ID NO: 90782

SEQ ID NO: 589211 - RNA, 64 nt, Homo Sapiens; identical to SEQ ID NO: 90783

SEQ ID NO: 589212 - RNA, 64 nt, Homo Sapiens; identical to SEQ ID NO: 90784

SEQ ID NO: 589213 - RNA, 64 nt, Homo Sapiens; identical to SEQ ID NO: 90785

SEQ ID NO: 589214 - RNA, 64 nt, Homo Sapiens; identical to SEQ ID NO: 90786

SEQ ID NO: 589215 - RNA, 64 nt, Homo Sapiens; identical to SEQ ID NO: 90787

SEQ ID NO: 589216 - RNA, 64 nt, Homo Sapiens; identical to SEQ ID NO: 90788

SEQ ID NO: 589217 - RNA, 64 nt, Homo Sapiens; identical to SEQ ID NO: 90789

SEQ ID NO: 589218 - RNA, 64 nt, Homo Sapiens; identical to SEQ ID NO: 90790

SEQ ID NO: 589219 - RNA, 64 nt, Homo Sapiens; identical to SEQ ID NO: 90791

SEQ ID NO: 589220 - RNA, 64 nt, Homo Sapiens; identical to SEQ ID NO: 90792

SEQ ID NO: 589221 - RNA, 64 nt, Homo Sapiens; identical to SEQ ID NO: 90793

SEQ ID NO: 589222 - RNA, 64 nt, Homo Sapiens; identical to SEQ ID NO: 90794

SEQ ID NO: 589223 - RNA, 64 nt, Homo Sapiens; identical to SEQ ID NO: 90795

SEQ ID NO: 589224 - RNA, 64 nt, Homo Sapiens; identical to SEQ ID NO: 90796

SEQ ID NO: 589225 - RNA, 64 nt, Homo Sapiens; identical to SEQ ID NO: 90797

SEQ ID NO: 589226 - RNA, 64 nt, Homo Sapiens; identical to SEQ ID NO: 90798

SEQ ID NO: 589227 - RNA, 64 nt, Homo Sapiens; identical to SEQ ID NO: 90799

SEQ ID NO: 589228 - RNA, 64 nt, Homo Sapiens; identical to SEQ ID NO: 90800

SEQ ID NO: 589229 - RNA, 64 nt, Homo Sapiens; identical to SEQ ID NO: 90801

SEQ ID NO: 589230 - RNA, 64 nt, Homo Sapiens; identical to SEQ ID NO: 90802

SEQ ID NO: 589231 - RNA, 64 nt, Homo Sapiens; identical to SEQ ID NO: 90803

SEQ ID NO: 589232 - RNA, 64 nt, Homo Sapiens; identical to SEQ ID NO: 90804

SEQ ID NO: 589233 - RNA, 64 nt, Homo Sapiens; identical to SEQ ID NO: 90805

SEQ ID NO: 589234 - RNA, 64 nt, Homo Sapiens; identical to SEQ ID NO: 90806

SEQ ID NO: 589235 - RNA, 64 nt, Homo Sapiens; identical to SEQ ID NO: 90807

SEQ ID NO: 589236 - RNA, 64 nt, Homo Sapiens; identical to SEQ ID NO: 90808

SEQ ID NO: 589237 - RNA, 64 nt, Homo Sapiens; identical to SEQ ID NO: 90809

SEQ ID NO: 589238 - RNA, 64 nt, Homo Sapiens; identical to SEQ ID NO: 90810

SEQ ID NO: 589239 - RNA, 64 nt, Homo Sapiens; identical to SEQ ID NO: 90811

SEQ ID NO: 589240 - RNA, 64 nt, Homo Sapiens; identical to SEQ ID NO: 90812

SEQ ID NO: 589241 - RNA, 64 nt, Homo Sapiens; identical to SEQ ID NO: 90813

SEQ ID NO: 589242 - RNA, 64 nt, Homo Sapiens; identical to SEQ ID NO: 90814

SEQ ID NO: 589243 - RNA, 64 nt, Homo Sapiens; identical to SEQ ID NO: 90815

SEQ ID NO: 589244 - RNA, 64 nt, Homo Sapiens; identical to SEQ ID NO: 90816

SEQ ID NO: 589245 - RNA, 64 nt, Homo Sapiens; identical to SEQ ID NO: 90817

SEQ ID NO: 589246 - RNA, 64 nt, Homo Sapiens; identical to SEQ ID NO: 90818

SEQ ID NO: 589247 - RNA, 64 nt, Homo Sapiens; identical to SEQ ID NO: 90819

SEQ ID NO: 589248 - RNA, 64 nt, Homo Sapiens; identical to SEQ ID NO: 90820

SEQ ID NO: 589249 - RNA, 64 nt, Homo Sapiens; identical to SEQ ID NO: 90821

SEQ ID NO: 589250 - RNA, 64 nt, Homo Sapiens; identical to SEQ ID NO: 90822

SEQ ID NO: 589251 - RNA, 64 nt, Homo Sapiens; identical to SEQ ID NO: 90823

SEQ ID NO: 589252 - RNA, 64 nt, Homo Sapiens; identical to SEQ ID NO: 90824

SEQ ID NO: 589253 - RNA, 64 nt, Homo Sapiens; identical to SEQ ID NO: 90825

SEQ ID NO: 589254 - RNA, 64 nt, Homo Sapiens; identical to SEQ ID NO: 90826

SEQ ID NO: 589255 - RNA, 64 nt, Homo Sapiens; identical to SEQ ID NO: 90827

SEQ ID NO: 589256 - RNA, 64 nt, Homo Sapiens; identical to SEQ ID NO: 90828

SEQ ID NO: 589257 - RNA, 64 nt, Homo Sapiens; identical to SEQ ID NO: 90829

SEQ ID NO: 589258 - RNA, 64 nt, Homo Sapiens; identical to SEQ ID NO: 90830

SEQ ID NO: 589259 - RNA, 64 nt, Homo Sapiens; identical to SEQ ID NO: 90831

SEQ ID NO: 589260 - RNA, 64 nt, Homo Sapiens; identical to SEQ ID NO: 90832

SEQ ID NO: 589261 - RNA, 64 nt, Homo Sapiens; identical to SEQ ID NO: 90833

SEQ ID NO: 589262 - RNA, 64 nt, Homo Sapiens; identical to SEQ ID NO: 90834

SEQ ID NO: 589263 - RNA, 64 nt, Homo Sapiens; identical to SEQ ID NO: 90835

SEQ ID NO: 589264 - RNA, 64 nt, Homo Sapiens; identical to SEQ ID NO: 90836

SEQ ID NO: 589265 - RNA, 64 nt, Homo Sapiens; identical to SEQ ID NO: 90837

SEQ ID NO: 589266 - RNA, 64 nt, Homo Sapiens; identical to SEQ ID NO: 90838

SEQ ID NO: 589267 - RNA, 64 nt, Homo Sapiens; identical to SEQ ID NO: 90839

SEQ ID NO: 589268 - RNA, 64 nt, Homo Sapiens; identical to SEQ ID NO: 90840

SEQ ID NO: 589269 - RNA, 64 nt, Homo Sapiens; identical to SEQ ID NO: 90841

SEQ ID NO: 589270 - RNA, 64 nt, Homo Sapiens; identical to SEQ ID NO: 90842

SEQ ID NO: 589271 - RNA, 64 nt, Homo Sapiens; identical to SEQ ID NO: 90843

SEQ ID NO: 589272 - RNA, 64 nt, Homo Sapiens; identical to SEQ ID NO: 90844

SEQ ID NO: 589273 - RNA, 64 nt, Homo Sapiens; identical to SEQ ID NO: 90845

SEQ ID NO: 589274 - RNA, 64 nt, Homo Sapiens; identical to SEQ ID NO: 90846

SEQ ID NO: 589275 - RNA, 64 nt, Homo Sapiens; identical to SEQ ID NO: 90847

SEQ ID NO: 589276 - RNA, 64 nt, Homo Sapiens; identical to SEQ ID NO: 90848

SEQ ID NO: 589277 - RNA, 64 nt, Homo Sapiens; identical to SEQ ID NO: 90849

SEQ ID NO: 589278 - RNA, 64 nt, Homo Sapiens; identical to SEQ ID NO: 90850

SEQ ID NO: 589279 - RNA, 64 nt, Homo Sapiens; identical to SEQ ID NO: 90851

SEQ ID NO: 589280 - RNA, 64 nt, Homo Sapiens; identical to SEQ ID NO: 90852

SEQ ID NO: 589281 - RNA, 64 nt, Homo Sapiens; identical to SEQ ID NO: 90853

SEQ ID NO: 589282 - RNA, 64 nt, Homo Sapiens; identical to SEQ ID NO: 90854

SEQ ID NO: 589283 - RNA, 64 nt, Homo Sapiens; identical to SEQ ID NO: 90855

SEQ ID NO: 589284 - RNA, 64 nt, Homo Sapiens; identical to SEQ ID NO: 90856

SEQ ID NO: 589285 - RNA, 64 nt, Homo Sapiens; identical to SEQ ID NO: 90857

SEQ ID NO: 589286 - RNA, 64 nt, Homo Sapiens; identical to SEQ ID NO: 90858

SEQ ID NO: 589287 - RNA, 64 nt, Homo Sapiens; identical to SEQ ID NO: 90859

SEQ ID NO: 589288 - RNA, 64 nt, Homo Sapiens; identical to SEQ ID NO: 90860

SEQ ID NO: 589289 - RNA, 64 nt, Homo Sapiens; identical to SEQ ID NO: 90861

SEQ ID NO: 589290 - RNA, 64 nt, Homo Sapiens; identical to SEQ ID NO: 90862

SEQ ID NO: 589291 - RNA, 64 nt, Homo Sapiens; identical to SEQ ID NO: 90863

SEQ ID NO: 589292 - RNA, 64 nt, Homo Sapiens; identical to SEQ ID NO: 90864

SEQ ID NO: 589293 - RNA, 64 nt, Homo Sapiens; identical to SEQ ID NO: 90865

SEQ ID NO: 589294 - RNA, 64 nt, Homo Sapiens; identical to SEQ ID NO: 90866

SEQ ID NO: 589295 - RNA, 64 nt, Homo Sapiens; identical to SEQ ID NO: 90867

SEQ ID NO: 589296 - RNA, 64 nt, Homo Sapiens; identical to SEQ ID NO: 90868

SEQ ID NO: 589297 - RNA, 64 nt, Homo Sapiens; identical to SEQ ID NO: 90869

SEQ ID NO: 589298 - RNA, 64 nt, Homo Sapiens; identical to SEQ ID NO: 90870

SEQ ID NO: 589299 - RNA, 64 nt, Homo Sapiens; identical to SEQ ID NO: 90871

SEQ ID NO: 589300 - RNA, 64 nt, Homo Sapiens; identical to SEQ ID NO: 90872

SEQ ID NO: 589301 - RNA, 64 nt, Homo Sapiens; identical to SEQ ID NO: 90873

SEQ ID NO: 589302 - RNA, 64 nt, Homo Sapiens; identical to SEQ ID NO: 90874

SEQ ID NO: 589303 - RNA, 64 nt, Homo Sapiens; identical to SEQ ID NO: 90875

SEQ ID NO: 589304 - RNA, 64 nt, Homo Sapiens; identical to SEQ ID NO: 90876

SEQ ID NO: 589305 - RNA, 64 nt, Homo Sapiens; identical to SEQ ID NO: 90877

SEQ ID NO: 589306 - RNA, 64 nt, Homo Sapiens; identical to SEQ ID NO: 90878

SEQ ID NO: 589307 - RNA, 64 nt, Homo Sapiens; identical to SEQ ID NO: 90879

SEQ ID NO: 589308 - RNA, 64 nt, Homo Sapiens; identical to SEQ ID NO: 90880

SEQ ID NO: 589309 - RNA, 64 nt, Homo Sapiens; identical to SEQ ID NO: 90881

SEQ ID NO: 589310 - RNA, 64 nt, Homo Sapiens; identical to SEQ ID NO: 90882

SEQ ID NO: 589311 - RNA, 64 nt, Homo Sapiens; identical to SEQ ID NO: 90883

SEQ ID NO: 589312 - RNA, 64 nt, Homo Sapiens; identical to SEQ ID NO: 90884

SEQ ID NO: 589313 - RNA, 64 nt, Homo Sapiens; identical to SEQ ID NO: 90885

SEQ ID NO: 589314 - RNA, 64 nt, Homo Sapiens; identical to SEQ ID NO: 90886

SEQ ID NO: 589315 - RNA, 64 nt, Homo Sapiens; identical to SEQ ID NO: 90887

SEQ ID NO: 589316 - RNA, 64 nt, Homo Sapiens; identical to SEQ ID NO: 90888

SEQ ID NO: 589317 - RNA, 64 nt, Homo Sapiens; identical to SEQ ID NO: 90889

SEQ ID NO: 589318 - RNA, 64 nt, Homo Sapiens; identical to SEQ ID NO: 90890

SEQ ID NO: 589319 - RNA, 64 nt, Homo Sapiens; identical to SEQ ID NO: 90891

SEQ ID NO: 589320 - RNA, 64 nt, Homo Sapiens; identical to SEQ ID NO: 90892

SEQ ID NO: 589321 - RNA, 64 nt, Homo Sapiens; identical to SEQ ID NO: 90893

SEQ ID NO: 589322 - RNA, 64 nt, Homo Sapiens; identical to SEQ ID NO: 90894

SEQ ID NO: 589323 - RNA, 64 nt, Homo Sapiens; identical to SEQ ID NO: 90895

SEQ ID NO: 589324 - RNA, 64 nt, Homo Sapiens; identical to SEQ ID NO: 90896

SEQ ID NO: 589325 - RNA, 64 nt, Homo Sapiens; identical to SEQ ID NO: 90897

SEQ ID NO: 589326 - RNA, 64 nt, Homo Sapiens; identical to SEQ ID NO: 90898

SEQ ID NO: 589327 - RNA, 64 nt, Homo Sapiens; identical to SEQ ID NO: 90899

SEQ ID NO: 589328 - RNA, 54 nt, Homo Sapiens; identical to SEQ ID NO: 90900

SEQ ID NO: 589329 - RNA, 64 nt, Homo Sapiens; identical to SEQ ID NO: 90901

SEQ ID NO: 589330 - RNA, 64 nt, Homo Sapiens; identical to SEQ ID NO: 90902

SEQ ID NO: 589331 - RNA, 64 nt, Homo Sapiens; identical to SEQ ID NO: 90903

SEQ ID NO: 589332 - RNA, 64 nt, Homo Sapiens; identical to SEQ ID NO: 90904

SEQ ID NO: 589333 - RNA, 64 nt, Homo Sapiens; identical to SEQ ID NO: 90905

SEQ ID NO: 589334 - RNA, 64 nt, Homo Sapiens; identical to SEQ ID NO: 90906

SEQ ID NO: 589335 - RNA, 64 nt, Homo Sapiens; identical to SEQ ID NO: 90907

SEQ ID NO: 589336 - RNA, 64 nt, Homo Sapiens; identical to SEQ ID NO: 90908

SEQ ID NO: 589337 - RNA, 64 nt, Homo Sapiens; identical to SEQ ID NO: 90909

SEQ ID NO: 589338 - RNA, 64 nt, Homo Sapiens; identical to SEQ ID NO: 90910

SEQ ID NO: 589339 - RNA, 64 nt, Homo Sapiens; identical to SEQ ID NO: 90911

SEQ ID NO: 589340 - RNA, 64 nt, Homo Sapiens; identical to SEQ ID NO: 90912

SEQ ID NO: 589341 - RNA, 64 nt, Homo Sapiens; identical to SEQ ID NO: 90913

SEQ ID NO: 589342 - RNA, 64 nt, Homo Sapiens; identical to SEQ ID NO: 90914

SEQ ID NO: 589343 - RNA, 64 nt, Homo Sapiens; identical to SEQ ID NO: 90915

SEQ ID NO: 589344 - RNA, 64 nt, Homo Sapiens; identical to SEQ ID NO: 90916

SEQ ID NO: 589345 - RNA, 64 nt, Homo Sapiens; identical to SEQ ID NO: 90917

SEQ ID NO: 589346 - RNA, 64 nt, Homo Sapiens; identical to SEQ ID NO: 90918

SEQ ID NO: 589347 - RNA, 64 nt, Homo Sapiens; identical to SEQ ID NO: 90919

SEQ ID NO: 589348 - RNA, 64 nt, Homo Sapiens; identical to SEQ ID NO: 90920

SEQ ID NO: 589349 - RNA, 64 nt, Homo Sapiens; identical to SEQ ID NO: 90921

SEQ ID NO: 589350 - RNA, 64 nt, Homo Sapiens; identical to SEQ ID NO: 90922

SEQ ID NO: 589351 - RNA, 64 nt, Homo Sapiens; identical to SEQ ID NO: 90923

SEQ ID NO: 589352 - RNA, 64 nt, Homo Sapiens; identical to SEQ ID NO: 90924

SEQ ID NO: 589353 - RNA, 64 nt, Homo Sapiens; identical to SEQ ID NO: 90925

SEQ ID NO: 589354 - RNA, 64 nt, Homo Sapiens; identical to SEQ ID NO: 90926

SEQ ID NO: 589355 - RNA, 64 nt, Homo Sapiens; identical to SEQ ID NO: 90927

SEQ ID NO: 589356 - RNA, 64 nt, Homo Sapiens; identical to SEQ ID NO: 90928

SEQ ID NO: 589357 - RNA, 64 nt, Homo Sapiens; identical to SEQ ID NO: 90929

SEQ ID NO: 589358 - RNA, 64 nt, Homo Sapiens; identical to SEQ ID NO: 90811

SEQ ID NO: 589359 - RNA, 64 nt, Homo Sapiens; identical to SEQ ID NO: 90931

SEQ ID NO: 589360 - RNA, 64 nt, Homo Sapiens; identical to SEQ ID NO: 90932

SEQ ID NO: 589361 - RNA, 64 nt, Homo Sapiens; identical to SEQ ID NO: 90933

SEQ ID NO: 589362 - RNA, 64 nt, Homo Sapiens; identical to SEQ ID NO: 90934

SEQ ID NO: 589363 - RNA, 64 nt, Homo Sapiens; identical to SEQ ID NO: 90935

SEQ ID NO: 589364 - RNA, 64 nt, Homo Sapiens; identical to SEQ ID NO: 90936

SEQ ID NO: 589365 - RNA, 64 nt, Homo Sapiens; identical to SEQ ID NO: 90937

SEQ ID NO: 589366 - RNA, 64 nt, Homo Sapiens; identical to SEQ ID NO: 90938

SEQ ID NO: 589367 - RNA, 64 nt, Homo Sapiens; identical to SEQ ID NO: 90939

SEQ ID NO: 589368 - RNA, 64 nt, Homo Sapiens; identical to SEQ ID NO: 90940

SEQ ID NO: 589369 - RNA, 64 nt, Homo Sapiens; identical to SEQ ID NO: 90941

SEQ ID NO: 589370 - RNA, 64 nt, Homo Sapiens; identical to SEQ ID NO: 90942

SEQ ID NO: 589371 - RNA, 64 nt, Homo Sapiens; identical to SEQ ID NO: 90943

SEQ ID NO: 589372 - RNA, 64 nt, Homo Sapiens; identical to SEQ ID NO: 90944

SEQ ID NO: 589373 - RNA, 64 nt, Homo Sapiens; identical to SEQ ID NO: 90945

SEQ ID NO: 589374 - RNA, 64 nt, Homo Sapiens; identical to SEQ ID NO: 90946

SEQ ID NO: 589375 - RNA, 64 nt, Homo Sapiens; identical to SEQ ID NO: 90947

SEQ ID NO: 589376 - RNA, 64 nt, Homo Sapiens; identical to SEQ ID NO: 90948

SEQ ID NO: 589377 - RNA, 64 nt, Homo Sapiens; identical to SEQ ID NO: 90949

SEQ ID NO: 589378 - RNA, 64 nt, Homo Sapiens; identical to SEQ ID NO: 90950

SEQ ID NO: 589379 - RNA, 64 nt, Homo Sapiens; identical to SEQ ID NO: 90951

SEQ ID NO: 589380 - RNA, 64 nt, Homo Sapiens; identical to SEQ ID NO: 90952

SEQ ID NO: 589381 - RNA, 64 nt, Homo Sapiens; identical to SEQ ID NO: 90953

SEQ ID NO: 589382 - RNA, 64 nt, Homo Sapiens; identical to SEQ ID NO: 90954

SEQ ID NO: 589383 - RNA, 64 nt, Homo Sapiens; identical to SEQ ID NO: 90955

SEQ ID NO: 589384 - RNA, 64 nt, Homo Sapiens; identical to SEQ ID NO: 90956

SEQ ID NO: 589385 - RNA, 64 nt, Homo Sapiens; identical to SEQ ID NO: 90957

SEQ ID NO: 589386 - RNA, 64 nt, Homo Sapiens; identical to SEQ ID NO: 90958

SEQ ID NO: 589387 - RNA, 64 nt, Homo Sapiens; identical to SEQ ID NO: 90959

SEQ ID NO: 589388 - RNA, 64 nt, Homo Sapiens; identical to SEQ ID NO: 90960

SEQ ID NO: 589389 - RNA, 64 nt, Homo Sapiens; identical to SEQ ID NO: 90961

SEQ ID NO: 589390 - RNA, 64 nt, Homo Sapiens; identical to SEQ ID NO: 90962

SEQ ID NO: 589391 - RNA, 64 nt, Homo Sapiens; identical to SEQ ID NO: 90963

SEQ ID NO: 589392 - RNA, 64 nt, Homo Sapiens; identical to SEQ ID NO: 90964

SEQ ID NO: 589393 - RNA, 64 nt, Homo Sapiens; identical to SEQ ID NO: 90965

SEQ ID NO: 589394 - RNA, 64 nt, Homo Sapiens; identical to SEQ ID NO: 90966

SEQ ID NO: 589395 - RNA, 64 nt, Homo Sapiens; identical to SEQ ID NO: 90967

SEQ ID NO: 589396 - RNA, 64 nt, Homo Sapiens; identical to SEQ ID NO: 90968

SEQ ID NO: 589397 - RNA, 64 nt, Homo Sapiens; identical to SEQ ID NO: 90969

SEQ ID NO: 589398 - RNA, 64 nt, Homo Sapiens; identical to SEQ ID NO: 90970

SEQ ID NO: 589399 - RNA, 64 nt, Homo Sapiens; identical to SEQ ID NO: 90971

SEQ ID NO: 589400 - RNA, 64 nt, Homo Sapiens; identical to SEQ ID NO: 90972

SEQ ID NO: 589401 - RNA, 64 nt, Homo Sapiens; identical to SEQ ID NO: 90973

SEQ ID NO: 589402 - RNA, 64 nt, Homo Sapiens; identical to SEQ ID NO: 90974

SEQ ID NO: 589403 - RNA, 64 nt, Homo Sapiens; identical to SEQ ID NO: 90975

SEQ ID NO: 589404 - RNA, 64 nt, Homo Sapiens; identical to SEQ ID NO: 90976

SEQ ID NO: 589405 - RNA, 64 nt, Homo Sapiens; identical to SEQ ID NO: 90977

SEQ ID NO: 589406 - RNA, 64 nt, Homo Sapiens; identical to SEQ ID NO: 90978

SEQ ID NO: 589407 - RNA, 64 nt, Homo Sapiens; identical to SEQ ID NO: 90979

SEQ ID NO: 589408 - RNA, 64 nt, Homo Sapiens; identical to SEQ ID NO: 90980

SEQ ID NO: 589409 - RNA, 64 nt, Homo Sapiens; identical to SEQ ID NO: 90981

SEQ ID NO: 589410 - RNA, 64 nt, Homo Sapiens; identical to SEQ ID NO: 90982

SEQ ID NO: 589411 - RNA, 64 nt, Homo Sapiens; identical to SEQ ID NO: 90983

SEQ ID NO: 589412 - RNA, 64 nt, Homo Sapiens; identical to SEQ ID NO: 90984

SEQ ID NO: 589413 - RNA, 64 nt, Homo Sapiens; identical to SEQ ID NO: 90985

SEQ ID NO: 589414 - RNA, 64 nt, Homo Sapiens; identical to SEQ ID NO: 90986

SEQ ID NO: 589415 - RNA, 64 nt, Homo Sapiens; identical to SEQ ID NO: 90987

SEQ ID NO: 589416 - RNA, 64 nt, Homo Sapiens; identical to SEQ ID NO: 90988

SEQ ID NO: 589417 - RNA, 64 nt, Homo Sapiens; identical to SEQ ID NO: 90989

SEQ ID NO: 589418 - RNA, 64 nt, Homo Sapiens; identical to SEQ ID NO: 90990

SEQ ID NO: 589419 - RNA, 64 nt, Homo Sapiens; identical to SEQ ID NO: 90991

SEQ ID NO: 589420 - RNA, 64 nt, Homo Sapiens; identical to SEQ ID NO: 90992

SEQ ID NO: 589421 - RNA, 64 nt, Homo Sapiens; identical to SEQ ID NO: 90993

SEQ ID NO: 589422 - RNA, 64 nt, Homo Sapiens; identical to SEQ ID NO: 90994

SEQ ID NO: 589423 - RNA, 64 nt, Homo Sapiens; identical to SEQ ID NO: 90995

SEQ ID NO: 589424 - RNA, 64 nt, Homo Sapiens; identical to SEQ ID NO: 90996

SEQ ID NO: 589425 - RNA, 64 nt, Homo Sapiens; identical to SEQ ID NO: 90997

SEQ ID NO: 589426 - RNA, 64 nt, Homo Sapiens; identical to SEQ ID NO: 90998

SEQ ID NO: 589427 - RNA, 64 nt, Homo Sapiens; identical to SEQ ID NO: 90999

SEQ ID NO: 589428 - RNA, 64 nt, Homo Sapiens; identical to SEQ ID NO: 91000

SEQ ID NO: 589429 - RNA, 64 nt, Homo Sapiens; identical to SEQ ID NO: 91001

SEQ ID NO: 589430 - RNA, 64 nt, Homo Sapiens; identical to SEQ ID NO: 91002

SEQ ID NO: 589431 - RNA, 64 nt, Homo Sapiens; identical to SEQ ID NO: 91003

SEQ ID NO: 589432 - RNA, 64 nt, Homo Sapiens; identical to SEQ ID NO: 91004

SEQ ID NO: 589433 - RNA, 64 nt, Homo Sapiens; identical to SEQ ID NO: 91005

SEQ ID NO: 589434 - RNA, 64 nt, Homo Sapiens; identical to SEQ ID NO: 91006

SEQ ID NO: 589435 - RNA, 64 nt, Homo Sapiens; identical to SEQ ID NO: 91007

SEQ ID NO: 589436 - RNA, 64 nt, Homo Sapiens; identical to SEQ ID NO: 91008

SEQ ID NO: 589437 - RNA, 64 nt, Homo Sapiens; identical to SEQ ID NO: 91009

SEQ ID NO: 589438 - RNA, 64 nt, Homo Sapiens; identical to SEQ ID NO: 91010

SEQ ID NO: 589439 - RNA, 64 nt, Homo Sapiens; identical to SEQ ID NO: 91011

SEQ ID NO: 589440 - RNA, 64 nt, Homo Sapiens; identical to SEQ ID NO: 91012

SEQ ID NO: 589441 - RNA, 64 nt, Homo Sapiens; identical to SEQ ID NO: 91013

SEQ ID NO: 589442 - RNA, 64 nt, Homo Sapiens; identical to SEQ ID NO: 91014

SEQ ID NO: 589443 - RNA, 64 nt, Homo Sapiens; identical to SEQ ID NO: 91015

SEQ ID NO: 589444 - RNA, 64 nt, Homo Sapiens; identical to SEQ ID NO: 91016

SEQ ID NO: 589445 - RNA, 64 nt, Homo Sapiens; identical to SEQ ID NO: 91017

SEQ ID NO: 589446 - RNA, 64 nt, Homo Sapiens; identical to SEQ ID NO: 91018

SEQ ID NO: 589447 - RNA, 64 nt, Homo Sapiens; identical to SEQ ID NO: 91019

SEQ ID NO: 589448 - RNA, 64 nt, Homo Sapiens; identical to SEQ ID NO: 91020

SEQ ID NO: 589449 - RNA, 64 nt, Homo Sapiens; identical to SEQ ID NO: 91021

SEQ ID NO: 589450 - RNA, 64 nt, Homo Sapiens; identical to SEQ ID NO: 91022

SEQ ID NO: 589451 - RNA, 64 nt, Homo Sapiens; identical to SEQ ID NO: 91023

SEQ ID NO: 589452 - RNA, 64 nt, Homo Sapiens; identical to SEQ ID NO: 91024

SEQ ID NO: 589453 - RNA, 64 nt, Homo Sapiens; identical to SEQ ID NO: 91025

SEQ ID NO: 589454 - RNA, 64 nt, Homo Sapiens; identical to SEQ ID NO: 91026

SEQ ID NO: 589455 - RNA, 64 nt, Homo Sapiens; identical to SEQ ID NO: 91027

SEQ ID NO: 589456 - RNA, 64 nt, Homo Sapiens; identical to SEQ ID NO: 91028

SEQ ID NO: 589457 - RNA, 64 nt, Homo Sapiens; identical to SEQ ID NO: 91029

SEQ ID NO: 589458 - RNA, 64 nt, Homo Sapiens; identical to SEQ ID NO: 248033

SEQ ID NO: 589459 - RNA, 64 nt, Homo Sapiens; identical to SEQ ID NO: 248034

SEQ ID NO: 589460 - RNA, 64 nt, Homo Sapiens; identical to SEQ ID NO: 248035

SEQ ID NO: 589461 - RNA, 64 nt, Homo Sapiens; identical to SEQ ID NO: 248036

SEQ ID NO: 589462 - RNA, 64 nt, Homo Sapiens; identical to SEQ ID NO: 248037

SEQ ID NO: 589463 - RNA, 64 nt, Homo Sapiens; identical to SEQ ID NO: 248038

SEQ ID NO: 589464 - RNA, 64 nt, Homo Sapiens; identical to SEQ ID NO: 248039

SEQ ID NO: 589465 - RNA, 64 nt, Homo Sapiens; identical to SEQ ID NO: 248040

SEQ ID NO: 589466 - RNA, 64 nt, Homo Sapiens; identical to SEQ ID NO: 248041

SEQ ID NO: 589467 - RNA, 64 nt, Homo Sapiens; identical to SEQ ID NO: 248042

SEQ ID NO: 589468 - RNA, 64 nt, Homo Sapiens; identical to SEQ ID NO: 248043

SEQ ID NO: 589469 - RNA, 64 nt, Homo Sapiens; identical to SEQ ID NO: 248044

SEQ ID NO: 589470 - RNA, 64 nt, Homo Sapiens; identical to SEQ ID NO: 248045

SEQ ID NO: 589471 - RNA, 64 nt, Homo Sapiens; identical to SEQ ID NO: 248046

SEQ ID NO: 589472 - RNA, 64 nt, Homo Sapiens; identical to SEQ ID NO: 248047

SEQ ID NO: 589473 - RNA, 64 nt, Homo Sapiens; identical to SEQ ID NO: 248048

SEQ ID NO: 589474 - RNA, 64 nt, Homo Sapiens; identical to SEQ ID NO: 248049

SEQ ID NO: 589475 - RNA, 64 nt, Homo Sapiens; identical to SEQ ID NO: 248050

SEQ ID NO: 589476 - RNA, 64 nt, Homo Sapiens; identical to SEQ ID NO: 248051

SEQ ID NO: 589477 - RNA, 64 nt, Homo Sapiens; identical to SEQ ID NO: 248052

SEQ ID NO: 589478 - RNA, 64 nt, Homo Sapiens; identical to SEQ ID NO: 248053

SEQ ID NO: 589479 - RNA, 64 nt, Homo Sapiens; identical to SEQ ID NO: 248054

SEQ ID NO: 589480 - RNA, 64 nt, Homo Sapiens; identical to SEQ ID NO: 248055

SEQ ID NO: 589481 - RNA, 64 nt, Homo Sapiens; identical to SEQ ID NO: 248056

SEQ ID NO: 589482 - RNA, 64 nt, Homo Sapiens; identical to SEQ ID NO: 248057

SEQ ID NO: 589483 - RNA, 64 nt, Homo Sapiens; identical to SEQ ID NO: 248058

SEQ ID NO: 589484 - RNA, 64 nt, Homo Sapiens; identical to SEQ ID NO: 248059

SEQ ID NO: 589485 - RNA, 64 nt, Homo Sapiens; identical to SEQ ID NO: 248060

SEQ ID NO: 589486 - RNA, 64 nt, Homo Sapiens; identical to SEQ ID NO: 248061

SEQ ID NO: 589487 - RNA, 64 nt, Homo Sapiens; identical to SEQ ID NO: 248062

SEQ ID NO: 589488 - RNA, 64 nt, Homo Sapiens; identical to SEQ ID NO: 248063

SEQ ID NO: 589489 - RNA, 64 nt, Homo Sapiens; identical to SEQ ID NO: 248064

SEQ ID NO: 589490 - RNA, 64 nt, Homo Sapiens; identical to SEQ ID NO: 248065

SEQ ID NO: 589491 - RNA, 64 nt, Homo Sapiens; identical to SEQ ID NO: 248066

SEQ ID NO: 589492 - RNA, 64 nt, Homo Sapiens; identical to SEQ ID NO: 248067

SEQ ID NO: 589493 - RNA, 64 nt, Homo Sapiens; identical to SEQ ID NO: 248068

SEQ ID NO: 589494 - RNA, 64 nt, Homo Sapiens; identical to SEQ ID NO: 248069

SEQ ID NO: 589495 - RNA, 64 nt, Homo Sapiens; identical to SEQ ID NO: 248070

SEQ ID NO: 589496 - RNA, 64 nt, Homo Sapiens; identical to SEQ ID NO: 248071

SEQ ID NO: 589497 - RNA, 64 nt, Homo Sapiens; identical to SEQ ID NO: 248072

SEQ ID NO: 589498 - RNA, 64 nt, Homo Sapiens; identical to SEQ ID NO: 248073

SEQ ID NO: 589499 - RNA, 53 nt, Homo Sapiens; identical to SEQ ID NO: 248074

SEQ ID NO: 589500 - RNA, 64 nt, Homo Sapiens; identical to SEQ ID NO: 248075

SEQ ID NO: 589501 - RNA, 64 nt, Homo Sapiens; identical to SEQ ID NO: 248076

SEQ ID NO: 589502 - RNA, 64 nt, Homo Sapiens; identical to SEQ ID NO: 248077

SEQ ID NO: 589503 - RNA, 64 nt, Homo Sapiens; identical to SEQ ID NO: 248078

SEQ ID NO: 589504 - RNA, 64 nt, Homo Sapiens; identical to SEQ ID NO: 248079

SEQ ID NO: 589505 - RNA, 64 nt, Homo Sapiens; identical to SEQ ID NO: 248080

SEQ ID NO: 589506 - RNA, 64 nt, Homo Sapiens; identical to SEQ ID NO: 248081

SEQ ID NO: 589507 - RNA, 64 nt, Homo Sapiens; identical to SEQ ID NO: 248082

SEQ ID NO: 589508 - RNA, 64 nt, Homo Sapiens; identical to SEQ ID NO: 248083

SEQ ID NO: 589509 - RNA, 64 nt, Homo Sapiens; identical to SEQ ID NO: 248084

SEQ ID NO: 589510 - RNA, 64 nt, Homo Sapiens; identical to SEQ ID NO: 248085

SEQ ID NO: 589511 - RNA, 64 nt, Homo Sapiens; identical to SEQ ID NO: 248086

SEQ ID NO: 589512 - RNA, 64 nt, Homo Sapiens; identical to SEQ ID NO: 248087

SEQ ID NO: 589513 - RNA, 64 nt, Homo Sapiens; identical to SEQ ID NO: 248088

SEQ ID NO: 589514 - RNA, 64 nt, Homo Sapiens; identical to SEQ ID NO: 248089

SEQ ID NO: 589515 - RNA, 64 nt, Homo Sapiens; identical to SEQ ID NO: 248090

SEQ ID NO: 589516 - RNA, 64 nt, Homo Sapiens; identical to SEQ ID NO: 248091

SEQ ID NO: 589517 - RNA, 64 nt, Homo Sapiens; identical to SEQ ID NO: 248092

SEQ ID NO: 589518 - RNA, 64 nt, Homo Sapiens; identical to SEQ ID NO: 248093

SEQ ID NO: 589519 - RNA, 64 nt, Homo Sapiens; identical to SEQ ID NO: 248094

SEQ ID NO: 589520 - RNA, 64 nt, Homo Sapiens; identical to SEQ ID NO: 248095

SEQ ID NO: 589521 - RNA, 63 nt, Homo Sapiens; identical to SEQ ID NO: 248096

SEQ ID NO: 589522 - RNA, 64 nt, Homo Sapiens; identical to SEQ ID NO: 248097

SEQ ID NO: 589523 - RNA, 64 nt, Homo Sapiens; identical to SEQ ID NO: 248098

SEQ ID NO: 589524 - RNA, 64 nt, Homo Sapiens; identical to SEQ ID NO: 248099

SEQ ID NO: 589525 - RNA, 64 nt, Homo Sapiens; identical to SEQ ID NO: 248100

SEQ ID NO: 589526 - RNA, 64 nt, Homo Sapiens; identical to SEQ ID NO: 248101

SEQ ID NO: 589527 - RNA, 64 nt, Homo Sapiens; identical to SEQ ID NO: 248102

SEQ ID NO: 589528 - RNA, 64 nt, Homo Sapiens; identical to SEQ ID NO: 248103

SEQ ID NO: 589529 - RNA, 64 nt, Homo Sapiens; identical to SEQ ID NO: 248104

SEQ ID NO: 589530 - RNA, 64 nt, Homo Sapiens; identical to SEQ ID NO: 248105

SEQ ID NO: 589531 - RNA, 64 nt, Homo Sapiens; identical to SEQ ID NO: 248106

SEQ ID NO: 589532 - RNA, 64 nt, Homo Sapiens; identical to SEQ ID NO: 248107

SEQ ID NO: 589533 - RNA, 64 nt, Homo Sapiens; identical to SEQ ID NO: 248108

SEQ ID NO: 589534 - RNA, 64 nt, Homo Sapiens; identical to SEQ ID NO: 248109

SEQ ID NO: 589535 - RNA, 64 nt, Homo Sapiens; identical to SEQ ID NO: 248110

SEQ ID NO: 589536 - RNA, 64 nt, Homo Sapiens; identical to SEQ ID NO: 248111

SEQ ID NO: 589537 - RNA, 64 nt, Homo Sapiens; identical to SEQ ID NO: 248112

SEQ ID NO: 589538 - RNA, 64 nt, Homo Sapiens; identical to SEQ ID NO: 248113

SEQ ID NO: 589539 - RNA, 64 nt, Homo Sapiens; identical to SEQ ID NO: 248114

SEQ ID NO: 589540 - RNA, 64 nt, Homo Sapiens; identical to SEQ ID NO: 248115

SEQ ID NO: 589541 - RNA, 64 nt, Homo Sapiens; identical to SEQ ID NO: 248116

SEQ ID NO: 589542 - RNA, 64 nt, Homo Sapiens; identical to SEQ ID NO: 248117

SEQ ID NO: 589543 - RNA, 64 nt, Homo Sapiens; identical to SEQ ID NO: 248118

SEQ ID NO: 589544 - RNA, 64 nt, Homo Sapiens; identical to SEQ ID NO: 248119

SEQ ID NO: 589545 - RNA, 64 nt, Homo Sapiens; identical to SEQ ID NO: 248120

SEQ ID NO: 589546 - RNA, 64 nt, Homo Sapiens; identical to SEQ ID NO: 248121

SEQ ID NO: 589547 - RNA, 64 nt, Homo Sapiens; identical to SEQ ID NO: 248122

SEQ ID NO: 589548 - RNA, 64 nt, Homo Sapiens; identical to SEQ ID NO: 248123

SEQ ID NO: 589549 - RNA, 64 nt, Homo Sapiens; identical to SEQ ID NO: 248124

SEQ ID NO: 589550 - RNA, 64 nt, Homo Sapiens; identical to SEQ ID NO: 248125

SEQ ID NO: 589551 - RNA, 64 nt, Homo Sapiens; identical to SEQ ID NO: 248126

SEQ ID NO: 589552 - RNA, 64 nt, Homo Sapiens; identical to SEQ ID NO: 248127

SEQ ID NO: 589553 - RNA, 64 nt, Homo Sapiens; identical to SEQ ID NO: 526357

SEQ ID NO: 589554 - RNA, 64 nt, Homo Sapiens; identical to SEQ ID NO: 526358

SEQ ID NO: 589555 - RNA, 64 nt, Homo Sapiens; identical to SEQ ID NO: 526359

SEQ ID NO: 589556 - RNA, 64 nt, Homo Sapiens; identical to SEQ ID NO: 526360

SEQ ID NO: 589557 - RNA, 64 nt, Homo Sapiens; identical to SEQ ID NO: 526361

SEQ ID NO: 589558 - RNA, 64 nt, Homo Sapiens; identical to SEQ ID NO: 526362

SEQ ID NO: 589559 - RNA, 64 nt, Homo Sapiens; identical to SEQ ID NO: 526363

SEQ ID NO: 589560 - RNA, 64 nt, Homo Sapiens; identical to SEQ ID NO: 526364

SEQ ID NO: 589561 - RNA, 64 nt, Homo Sapiens; identical to SEQ ID NO: 526365

SEQ ID NO: 589562 - RNA, 64 nt, Homo Sapiens; identical to SEQ ID NO: 526366

SEQ ID NO: 589563 - RNA, 64 nt, Homo Sapiens; identical to SEQ ID NO: 526367

SEQ ID NO: 589564 - RNA, 64 nt, Homo Sapiens; identical to SEQ ID NO: 526368

SEQ ID NO: 589565 - RNA, 64 nt, Homo Sapiens; identical to SEQ ID NO: 526369

SEQ ID NO: 589566 - RNA, 64 nt, Homo Sapiens; identical to SEQ ID NO: 526370

SEQ ID NO: 589567 - RNA, 64 nt, Homo Sapiens; identical to SEQ ID NO: 526371

SEQ ID NO: 589568 - RNA, 64 nt, Homo Sapiens; identical to SEQ ID NO: 526372

SEQ ID NO: 589569 - RNA, 64 nt, Homo Sapiens; identical to SEQ ID NO: 526373

SEQ ID NO: 589570 - RNA, 64 nt, Homo Sapiens; identical to SEQ ID NO: 526374

SEQ ID NO: 589571 - RNA, 64 nt, Homo Sapiens; identical to SEQ ID NO: 526375

SEQ ID NO: 589572 - RNA, 64 nt, Homo Sapiens; identical to SEQ ID NO: 526376

SEQ ID NO: 589573 - RNA, 64 nt, Homo Sapiens; identical to SEQ ID NO: 526377

SEQ ID NO: 589574 - RNA, 64 nt, Homo Sapiens; identical to SEQ ID NO: 526378

SEQ ID NO: 589575 - RNA, 64 nt, Homo Sapiens; identical to SEQ ID NO: 526379

SEQ ID NO: 589576 - RNA, 64 nt, Homo Sapiens; identical to SEQ ID NO: 526380

SEQ ID NO: 589577 - RNA, 64 nt, Homo Sapiens; identical to SEQ ID NO: 526381

SEQ ID NO: 589578 - RNA, 64 nt, Homo Sapiens; identical to SEQ ID NO: 526382

SEQ ID NO: 589579 - RNA, 64 nt, Homo Sapiens; identical to SEQ ID NO: 526383

SEQ ID NO: 589580 - RNA, 64 nt, Homo Sapiens; identical to SEQ ID NO: 526384

SEQ ID NO: 589581 - RNA, 64 nt, Homo Sapiens; identical to SEQ ID NO: 526385

SEQ ID NO: 589582 - RNA, 64 nt, Homo Sapiens; identical to SEQ ID NO: 526386

SEQ ID NO: 589583 - RNA, 64 nt, Homo Sapiens; identical to SEQ ID NO: 526387

SEQ ID NO: 589584 - RNA, 64 nt, Homo Sapiens; identical to SEQ ID NO: 526388

SEQ ID NO: 589585 - RNA, 64 nt, Homo Sapiens; identical to SEQ ID NO: 126433

SEQ ID NO: 589586 - RNA, 64 nt, Homo Sapiens; identical to SEQ ID NO: 126434

SEQ ID NO: 589587 - RNA, 64 nt, Homo Sapiens; identical to SEQ ID NO: 126435

SEQ ID NO: 589588 - RNA, 64 nt, Homo Sapiens; identical to SEQ ID NO: 126436

SEQ ID NO: 589589 - RNA, 64 nt, Homo Sapiens; identical to SEQ ID NO: 126437

SEQ ID NO: 589590 - RNA, 64 nt, Homo Sapiens; identical to SEQ ID NO: 126438

SEQ ID NO: 589591 - RNA, 64 nt, Homo Sapiens; identical to SEQ ID NO: 126439

SEQ ID NO: 589592 - RNA, 64 nt, Homo Sapiens; identical to SEQ ID NO: 126440

SEQ ID NO: 589593 - RNA, 64 nt, Homo Sapiens; identical to SEQ ID NO: 126441

SEQ ID NO: 589594 - RNA, 64 nt, Homo Sapiens; identical to SEQ ID NO: 126442

SEQ ID NO: 589595 - RNA, 64 nt, Homo Sapiens; identical to SEQ ID NO: 126443

SEQ ID NO: 589596 - RNA, 64 nt, Homo Sapiens; identical to SEQ ID NO: 126444

SEQ ID NO: 589597 - RNA, 64 nt, Homo Sapiens; identical to SEQ ID NO: 126445

SEQ ID NO: 589598 - RNA, 64 nt, Homo Sapiens; identical to SEQ ID NO: 126446

SEQ ID NO: 589599 - RNA, 64 nt, Homo Sapiens; identical to SEQ ID NO: 126447

SEQ ID NO: 589600 - RNA, 64 nt, Homo Sapiens; identical to SEQ ID NO: 126448

SEQ ID NO: 589601 - RNA, 64 nt, Homo Sapiens; identical to SEQ ID NO: 126449

SEQ ID NO: 589602 - RNA, 64 nt, Homo Sapiens; identical to SEQ ID NO: 126450

SEQ ID NO: 589603 - RNA, 64 nt, Homo Sapiens; identical to SEQ ID NO: 126451

SEQ ID NO: 589604 - RNA, 64 nt, Homo Sapiens; identical to SEQ ID NO: 126452

SEQ ID NO: 589605 - RNA, 64 nt, Homo Sapiens; identical to SEQ ID NO: 126453

SEQ ID NO: 589606 - RNA, 64 nt, Homo Sapiens; identical to SEQ ID NO: 126454

SEQ ID NO: 589607 - RNA, 64 nt, Homo Sapiens; identical to SEQ ID NO: 126455

SEQ ID NO: 589608 - RNA, 64 nt, Homo Sapiens; identical to SEQ ID NO: 126456

SEQ ID NO: 589609 - RNA, 64 nt, Homo Sapiens; identical to SEQ ID NO: 126457

SEQ ID NO: 589610 - RNA, 64 nt, Homo Sapiens; identical to SEQ ID NO: 126458

SEQ ID NO: 589611 - RNA, 64 nt, Homo Sapiens
aaccuguaaauaugaaagaacaaagguuauuuccuggagaaaagacaauuuauucaacaccaac

SEQ ID NO: 589612 - RNA, 64 nt, Homo Sapiens
cucaucauaugggcacaacucugguguccuucuauggagaaaaccucaaguaaaguuuuauucu

SEQ ID NO: 589613 - RNA, 64 nt, Homo Sapiens
aauuaacaauaaagaauuuuaaaaauauaucuguuggagaaagauguggcuccauauuucaacu

SEQ ID NO: 589614 - RNA, 64 nt, Homo Sapiens
ugcaguccucaggaagggggcuggggagagcggcuggagaaagacucacuggcaggugugggau

SEQ ID NO: 589615 - RNA, 64 nt, Homo Sapiens
acucuguuucgaauauagccacagaaauaaaggauggagaaaaaucugggacagguaauuuugc

SEQ ID NO: 589616 - RNA, 64 nt, Homo Sapiens
auucuguuucgaacauagccacagaaauaaaggauggagaaaaaucugggacagguaauuuugc

SEQ ID NO: 589617 - RNA, 64 nt, Homo Sapiens
guucuguuuugaguauagccagagaaaacaaggauggagaaaaaucuaggacagguaauuuuga

SEQ ID NO: 589618 - RNA, 64 nt, Homo Sapiens
auucuuuuucgaauauaaccagaggaaaaaaggauggagaaauaucuaggaaagguaauuuugc

SEQ ID NO: 589619 - RNA, 64 nt, Homo Sapiens
auucuuuuucgaauauaaccagagaaaaaaaggauggagaaauaucuaggaaagguaauuuugc

SEQ ID NO: 589620 - RNA, 64 nt, Homo Sapiens
auucuguuuuggguauagccagagaaaacaaggauggagaaaaaucuaggacagguaauuuuga

SEQ ID NO: 589621 - RNA, 64 nt, Homo Sapiens
ugaggucaagaguucgagaccagccugaccaacauggagaaacccccaucucuacugaaaauac

SEQ ID NO: 589622 - RNA, 64 nt, Homo Sapiens
gaguggcucuuugcaugaacacugugcaagguguuggagaaauccaaagcugaccaaaacaugg

SEQ ID NO: 589623 - RNA, 64 nt, Homo Sapiens
uaaaauugcaauucuacuuaaagaaaaacuucucuggagaaaaaagcggaguuguuaaggacug

SEQ ID NO: 589624 - RNA, 64 nt, Homo Sapiens
agcccagcuuggcgugggguguugagaauuccuuuggagaaaaccagaaauucuguugaagaca

SEQ ID NO: 589625 - RNA, 64 nt, Homo Sapiens
aaaugcagagauuaagagcauauagaccaccuaguggagaaaaauggaguaaaggagauaagua

SEQ ID NO: 589626 - RNA, 64 nt, Homo Sapiens
aacaggacagcagcucugcuagcuuggcuagugcuggagaaaguaccgggaagaaggagguggc

SEQ ID NO: 589627 - RNA, 64 nt, Homo Sapiens
cagagucugagggucccggggcccgguuggcagcuggagaaagaggcaaaaagcccguagccgg

SEQ ID NO: 589628 - RNA, 64 nt, Homo Sapiens
augaaggcagugggaaagcaaugccaaaugguuguggagaaaguggccggagccucccuggagu

SEQ ID NO: 589629 - RNA, 64 nt, Homo Sapiens
ugagccuaggaguucgagaccagccuaggcaacauggagaaaccccgucucuaucagaaauaca

SEQ ID NO: 589630 - RNA, 64 nt, Homo Sapiens
guaguaagcuuggaaaaauaauuuaagaauacaauggagaaauguaaauaaguaucuauguaaa

SEQ ID NO: 589631 - RNA, 64 nt, Homo Sapiens
ugcacccuacaggcaaccagaaguggagaaaugcuggagaaagcaaagcaaaagcuagagaagc

SEQ ID NO: 589632 - RNA, 64 nt, Homo Sapiens
cuggagaaagcugcacccuagcuagagaagcaaguggagaaaugcaccacugcccaaagcaaaa

SEQ ID NO: 589633 - RNA, 64 nt, Homo Sapiens
gagcucuguggcuucccaccgagaaacugugaauuggagaaauguucgauuuuucuggucugug

SEQ ID NO: 589634 - RNA, 64 nt, Homo Sapiens
gugaauuggagaaauggagcauuuuucuggucuguggagaaacuguuuugcuguguucacuucg

SEQ ID NO: 589635 - RNA, 64 nt, Homo Sapiens
uugcuguucuggggggugaaaauagacuaacuacuggagaaacaaagagagaaagaaaacccag

SEQ ID NO: 589636 - RNA, 64 nt, Homo Sapiens
uuuuuuucucucacuauaguauaagaaucuauuuuggagaaaaaaagaaaauaugagggucucg

SEQ ID NO: 589637 - RNA, 64 nt, Homo Sapiens
cugccuguugcaaacgugaugcucccggauggaguggagaaacuaggagacugggacaagcaaa

SEQ ID NO: 589638 - RNA, 64 nt, Homo Sapiens
cugcaaacaacccagaagcccauccucagaagacuggagaaaugauugaggaaugcaugggcac

SEQ ID NO: 589639 - RNA, 64 nt, Homo Sapiens
ccucaacuuuuacuaaacauaagguaauucauacuggagaaaagccauacaaaugagaagaaug

SEQ ID NO: 589640 - RNA, 64 nt, Homo Sapiens
gcucaaauguuguucaacaccagaaaauuuauauuggagaaaagcacuguaaauguaaugcauu

SEQ ID NO: 589641 - RNA, 64 nt, Homo Sapiens
ccgcaaagcucacugaacauaaguuaauucauacuggagaaaaacccuacaaauguaaagaaug

SEQ ID NO: 589642 - RNA, 64 nt, Homo Sapiens
ccucaacucuuauuacacauaagauaauucacaguggagaaaaacccuacaaaugugaagaaug

SEQ ID NO: 589643 - RNA, 64 nt, Homo Sapiens
ugucacacuugauuguauauaagauaauucauacuggagaaaacucccagaaguggaguuuucc

SEQ ID NO: 589644 - RNA, 64 nt, Homo Sapiens
guucaaacuuuguucaauaccaggaaauuuauauuggagaaaaacccuaugaguguaaugaauu

SEQ ID NO: 589645 - RNA, 64 nt, Homo Sapiens
ugucacgcuugauuguagguaagauaauuuauauuggagaaaaauccuccaaguaugaagaaug

SEQ ID NO: 589646 - RNA, 64 nt, Homo Sapiens
gcucaaacuuuguucgacaucagggaauuuguauuggagaaaaacccugcaaauguaauaaaua

SEQ ID NO: 589647 - RNA, 64 nt, Homo Sapiens
uccauccauucuguuacacuuuguauuuucuaacuggagaaaagagugaggaacagaauguuuu

SEQ ID NO: 589648 - RNA, 64 nt, Homo Sapiens
gggaccuuggaggaugaaggcgaguaugugacacuggagaaaaguggaccaggcaugucuuuug

SEQ ID NO: 589649 - RNA, 64 nt, Homo Sapiens
ccauuuccacuuuuagauucaagagguccagccguggagaaacauccgggacccucagacacug

SEQ ID NO: 589650 - RNA, 64 nt, Homo Sapiens
gccuacaagccccgagagaaugaugaauuggcacuggagaaagccgacguggugauggugacuc

SEQ ID NO: 589651 - RNA, 64 nt, Homo Sapiens
gggauuaaaaauaaggauaacaaagcuaucaacuuggagaaacaaauuacugaauauuucagag

SEQ ID NO: 589652 - RNA, 64 nt, Homo Sapiens
gaaccacaaacacagaucacaagccugcucaauuuggagaaauauuaaaaacuauauucaguaa

SEQ ID NO: 589653 - RNA, 64 nt, Homo Sapiens
uuagacagcagcucuguguucucggaggggaguuuggagaaauuucugaguguugccugcugaa

SEQ ID NO: 589654 - RNA, 64 nt, Homo Sapiens
uggggaaguguuuucugaacccacaguguucuguuggagaaacucacacuaccaggcccugcag

SEQ ID NO: 589655 - RNA, 64 nt, Homo Sapiens
uauuucaagaucuaguccaacaacccuguagucauggagaaaggaauaugcucugguuggcagg

SEQ ID NO: 589656 - RNA, 64 nt, Homo Sapiens
uugaagaacaaguucaaacuuuuugacaauauacuggagaaacucacuucuugagcuuuaucuu

SEQ ID NO: 589657 - RNA, 64 nt, Homo Sapiens
uaucaacagaacucuagccaaggcugagucuagguggagaaaaauaccguugagaagggaagaa

SEQ ID NO: 589658 - RNA, 64 nt, Homo Sapiens
cugauaccaggcacagccuacaucccuucaguucuggagaaagcaacaauaaucacaauauauu

SEQ ID NO: 589659 - RNA, 64 nt, Homo Sapiens
gcuucaggcuggugacuagccaaaauagcugaaauggagaaaggaaagucaccuaggcaacugc

SEQ ID NO: 589660 - RNA, 64 nt, Homo Sapiens
aacaggcaaaacgugggugcugcuccugacaguguggagaaaccgccacagugaguuggucaaa

SEQ ID NO: 589661 - RNA, 64 nt, Homo Sapiens
uccuagaaaaggucagacccggaggacagcagcauggagaaagauaaauuugccaugacuuccu

SEQ ID NO: 589662 - RNA, 64 nt, Homo Sapiens
cagagcaguccagaaccagugaaacaaauggccauggagaaacguuugagcagcuccaggccaa

SEQ ID NO: 589663 - RNA, 64 nt, Homo Sapiens
agaugaauuauagcuccggaaaugugggugguauuggagaaagaaaagcuaaauaaccuuuaag

SEQ ID NO: 589664 - RNA, 64 nt, Homo Sapiens
cuaaauaaccuuuaagaaugucuacguauccuuguggagaaaaguggaggggaaaaagauccau

SEQ ID NO: 589665 - RNA, 64 nt, Homo Sapiens
ccaucucuacuaaaaauacacagccuuaccaacauggagaaaccugaggucgggaguucgagac

SEQ ID NO: 589666 - RNA, 64 nt, Homo Sapiens
uauuauuuccaugaucaaauguauuguauaucaguggagaaaugcuuuuccagugcauuacaug

SEQ ID NO: 589667 - RNA, 64 nt, Homo Sapiens
ggagugcuugggcagaaaguuguaaaguuugugcuggagaaagguuuauuuggacuuugauuac

SEQ ID NO: 589668 - RNA, 64 nt, Homo Sapiens
cauguugcacacucuuugacagcaugcuguuuuguggagaaacuugcauucaugaagagcccau

SEQ ID NO: 589669 - RNA, 61 nt, Homo Sapiens; identical to SEQ ID NO: 448102

SEQ ID NO: 589670 - RNA, 64 nt, Homo Sapiens
ugaggucaggaguucgagaccagccugaccaacauggagaaacccugucucaacuaauaauaca

SEQ ID NO: 589671 - RNA, 64 nt, Homo Sapiens
ugaaguaauauggcccacacuuuauucaccacccuggagaaaaaaaaacccaggaauaugugga

SEQ ID NO: 589672 - RNA, 64 nt, Homo Sapiens
auuccuaccaggaaagaauacauauccaauagauuggagaaagccagagauuagcccucauucc

SEQ ID NO: 589673 - RNA, 64 nt, Homo Sapiens
aaaacaguuuauuucaucuuggaguagagauuucuggagaaaaaucuugugugcugugggcacu

SEQ ID NO: 589674 - RNA, 64 nt, Homo Sapiens
ggcucuuauuaaacuuagauacaacaguggcccauggagaaagagccagaaaaggcuucuguuc

SEQ ID NO: 589675 - RNA, 64 nt, Homo Sapiens
gcauucauaaaacaauuggaguuugaaagauaucuggagaaaucucuagugaauaaaaaaauua

SEQ ID NO: 589676 - RNA, 64 nt, Homo Sapiens
gcuauucuuccuguuguccaaauaggacucgacuuggagaaauuacaaaaaugaaaauauuuau

SEQ ID NO: 589677 - RNA, 64 nt, Homo Sapiens
gaauggacaaagcucaggaauguggaagggccaauggagaaaauagaauuucuggaagaaaggc

SEQ ID NO: 589678 - RNA, 64 nt, Homo Sapiens
aagcagaggaaggaaacauaugagguuagcccaauggagaaaugugugugcagacaauucuccc

SEQ ID NO: 589679 - RNA, 64 nt, Homo Sapiens
agggccguaccccacccucagcaccccuuccauguggagaaaggagugaaaccuuuagggcagc

SEQ ID NO: 589680 - RNA, 64 nt, Homo Sapiens
gguggcacugagcccccccaacacugugcccugguggagaaagcacugaccugucaugcccccc

SEQ ID NO: 589681 - RNA, 64 nt, Homo Sapiens
ggaccagagagucugccccucugucagcaaagccuggagaaaugaaucaucuaaaagccagcca

SEQ ID NO: 589682 - RNA, 64 nt, Homo Sapiens
ggaaugucgcugcauucagcggagaaugagcggguggagaaacucgcuuuauggagcucaugca

SEQ ID NO: 589683 - RNA, 64 nt, Homo Sapiens
caacuaggauguguugggugagauguuucagaucuggagaaaugagcaggugucgggaaaugug

SEQ ID NO: 589684 - RNA, 64 nt, Homo Sapiens
gggaauguucuaaaacuuuuucuuccuuaaaaaauggagaaaauugcacuugugcuugcugugu

SEQ ID NO: 589685 - RNA, 64 nt, Homo Sapiens
auuuauaauuuugaucgaguuucuuaaaagacccuggagaaagaguggcauuucuucuguuuca

SEQ ID NO: 589686 - RNA, 64 nt, Homo Sapiens
ucagaauucucccacaccaagugcaugucaguuguggagaaaacauagcaaaaagagccguacg

SEQ ID NO: 589687 - RNA, 64 nt, Homo Sapiens
acagcaucauggaugcugugugaucagggaauuuuggagaaacuggauggugaggacacagcua

SEQ ID NO: 589688 - RNA, 64 nt, Homo Sapiens
ccgucucuauuaaaaauacagaccagccucaacauggagaaaccaccugaggucaggaguucga

SEQ ID NO: 589689 - RNA, 64 nt, Homo Sapiens
agccaaagcugggcucaguggggaaggucaggaauggagaaauugccuuuucucguuagccucc

SEQ ID NO: 589690 - RNA, 64 nt, Homo Sapiens
ugaggucaggaguucgaaaccagccuggccaacauggagaaaccccaucucuacuaaaaauaca

SEQ ID NO: 589691 - RNA, 64 nt, Homo Sapiens
gcuguacacugaagagucaucagagaguucacacuggagaaagaccuuuugaaugcagcauuug

SEQ ID NO: 589692 - RNA, 64 nt, Homo Sapiens
acucaaaucauauuagacaucggagaaaucacuuuggagaaaggucuuuugagugcacugagug

SEQ ID NO: 589693 - RNA, 64 nt, Homo Sapiens
gcuccacacucauuagucaugagagaguucauacuggagaaaagccuuaugagugcagugaaug

SEQ ID NO: 589694 - RNA, 64 nt, Homo Sapiens
gguccaaccucauucaccaucagcgaguucauacuggagaaaggcaugagugcgggcagugugg

SEQ ID NO: 589695 - RNA, 64 nt, Homo Sapiens
aaucuagccuuauuauacaucugagaguucacacuggagaaaggccuuaugagugcagugacug

SEQ ID NO: 589696 - RNA, 64 nt, Homo Sapiens
acuccagccuuauuaaacacuugagaguucacacuggagaaaggccauaugaaugcauugauug

SEQ ID NO: 589697 - RNA, 64 nt, Homo Sapiens
ccgucucuacuaaaaaaaaacauccuggcuaacguggagaaacccgaggucaggagaucgagac

SEQ ID NO: 589698 - RNA, 64 nt, Homo Sapiens
guaggcugacucaggaaacauaaugaccaaaaaauggagaaaaaaaaaaaaaaaccggauagaa

SEQ ID NO: 589699 - RNA, 64 nt, Homo Sapiens
ccucuagaaacauauuggcuggguucaagagaguuggagaaaccguacuuguaccuaaggcccu

SEQ ID NO: 589700 - RNA, 64 nt, Homo Sapiens
cauuccaaauauaacuauuacagagaacucaugcuggagaaagaggaaggcauuccaucaacau

SEQ ID NO: 589701 - RNA, 64 nt, Homo Sapiens
ucaagagggaaucaucuggccccuaauacugauguggagaaagcuucugacccuacaaacaggu

SEQ ID NO: 589702 - RNA, 64 nt, Homo Sapiens
gaauuauccccacuucacagguuuggccuuguguuggagaaagacuguacaugaaccaggucau

SEQ ID NO: 589703 - RNA, 64 nt, Homo Sapiens
guuuucguagcucaccaaugugagcaugaaucccuggagaaaucgcauauacaugaauauaccu

SEQ ID NO: 589704 - RNA, 64 nt, Homo Sapiens
aaaauuauuucuuggggaugaucagauuuuaccuuggagaaaugcucaaugaaauaagcugcua

SEQ ID NO: 589705 - RNA, 64 nt, Homo Sapiens
gaagaauaggccuguuuaauguucccuacaagcauggagaaaauauuggugaagacagacacca

SEQ ID NO: 589706 - RNA, 64 nt, Homo Sapiens
ugaguuguaggaacugcuuuccaacuccaagcucccuccacaaguuucccucccaggcccccca

SEQ ID NO: 589707 - RNA, 64 nt, Homo Sapiens
ugcggccagcccaggucugcaugcugagccccauccuccacagcuugccgcugacgcucucucc

SEQ ID NO: 589708 - RNA, 64 nt, Homo Sapiens
aaggagcugccuugcuggguguguggcuucccuaccuccacaccgcucugcuccagaaacaugu

SEQ ID NO: 589709 - RNA, 64 nt, Homo Sapiens
gagcccucccaugucugcugguggaaaaagcucuccuccacagagcuaucagcauuuuggcugg

SEQ ID NO: 589710 - RNA, 64 nt, Homo Sapiens
ccuuuaucuuaaccugaacaacaauaaaacuuggccuccacaaucugcugagagcuuccccugc

SEQ ID NO: 589711 - RNA, 64 nt, Homo Sapiens
aggacuaagcucugauuuuuguggccggcacccaccuccacacgacuggcgugugggagacccu

SEQ ID NO: 589712 - RNA, 64 nt, Homo Sapiens
uauucuagacuuguuuuaguaauggaaacucuuaccuccacauauuauccuacagauguuucca

SEQ ID NO: 589713 - RNA, 64 nt, Homo Sapiens
agauuuguuucuguuuuauagauuuaauucaauaccuccacauagauguuuuuauauuacauga

SEQ ID NO: 589714 - RNA, 64 nt, Homo Sapiens
ccccuccguuccgcuagccucccccugcuacucuccuccacacaguuucaacuugacccuccca

SEQ ID NO: 589715 - RNA, 64 nt, Homo Sapiens
cgguccacacaucaguaaggcgccacucaugucuccuccacaugcccggccugcugcuugcugu

SEQ ID NO: 589716 - RNA, 64 nt, Homo Sapiens
cacacgcccgucacccacacagaaggggggcugcccuccacacagauggcagaggcaaauccac

SEQ ID NO: 589717 - RNA, 64 nt, Homo Sapiens
caggcccugcacgcccaccucagcucuccugucuccuccacagcgaaggccuccccuccgagcc

SEQ ID NO: 589718 - RNA, 64 nt, Homo Sapiens
gcccaucucugaugucuggccugcccccuccuccccuccacacuagggaugggaccccucucug

SEQ ID NO: 589719 - RNA, 64 nt, Homo Sapiens
ggugaagcugugacaagggagugaccauccauccccuccacaggagggugaggaauugggacag

SEQ ID NO: 589720 - RNA, 64 nt, Homo Sapiens
ccaucuuucuguuugucgucuuguugauuugcugccuccacacugucagcuccuugggaacaga

SEQ ID NO: 589721 - RNA, 64 nt, Homo Sapiens
gagaacaacugagggccacccggucggggccaucccuccacacucugcauccuaccccaccuac

SEQ ID NO: 589722 - RNA, 64 nt, Homo Sapiens
aggaaggcugugugggucuggagcccacgucccaccuccacacccuuggcuugggcccaugccc

SEQ ID NO: 589723 - RNA, 64 nt, Homo Sapiens
ugaaaauagugaagcccacagaaaauaaguagcuccuccacagguuguaagcuaggucuagcug

SEQ ID NO: 589724 - RNA, 64 nt, Homo Sapiens
cccagagccauacugccuugggucaguccagcccccuccacaucacugagccaucaaugagcug

SEQ ID NO: 589725 - RNA, 64 nt, Homo Sapiens
ucuggggccagaauggcuguccuugucguagagcccuccacauuuucuuuuucuuuuuugagac

SEQ ID NO: 589726 - RNA, 64 nt, Homo Sapiens
acuacaagugugagccaccgcgccuggcccaagcccuccacauuuucaauccaggagccuugag

SEQ ID NO: 589727 - RNA, 64 nt, Homo Sapiens
acccuuugggacaguuacuucugggacccccuuuccuccacagagcccuucucccugguuucac

SEQ ID NO: 589728 - RNA, 64 nt, Homo Sapiens
ccuaccacaaaccaggcuggaacccaagccccuuccuccacagcugccuucaguggguagaaug

SEQ ID NO: 589729 - RNA, 64 nt, Homo Sapiens
uuuucugccagggguacugggucccccucagcacccuccacagcacaggccuuccaaguggaug

SEQ ID NO: 589730 - RNA, 64 nt, Homo Sapiens
ccagcauguccucacaugcucaugcccacccgcuccuccacaagccuaguccauccugccugag

SEQ ID NO: 589731 - RNA, 64 nt, Homo Sapiens
aguggccucgugguuauuagagaggaggcagcccccuccacaccaaggagacugaggcuuagag

SEQ ID NO: 589732 - RNA, 64 nt, Homo Sapiens
ccagcagcccaagcuuaauauaggcccaagguccccuccacaucgagcuggguggggacaguga

SEQ ID NO: 589733 - RNA, 64 nt, Homo Sapiens; identical to SEQ ID NO: 312329

SEQ ID NO: 589734 - RNA, 64 nt, Homo Sapiens; identical to SEQ ID NO: 312330

SEQ ID NO: 589735 - RNA, 64 nt, Homo Sapiens; identical to SEQ ID NO: 312331

SEQ ID NO: 589736 - RNA, 64 nt, Homo Sapiens; identical to SEQ ID NO: 312332

SEQ ID NO: 589737 - RNA, 64 nt, Homo Sapiens; identical to SEQ ID NO: 312333

SEQ ID NO: 589738 - RNA, 64 nt, Homo Sapiens; identical to SEQ ID NO: 312334

SEQ ID NO: 589739 - RNA, 64 nt, Homo Sapiens; identical to SEQ ID NO: 312335

SEQ ID NO: 589740 - RNA, 64 nt, Homo Sapiens; identical to SEQ ID NO: 312336

SEQ ID NO: 589741 - RNA, 64 nt, Homo Sapiens; identical to SEQ ID NO: 312337

SEQ ID NO: 589742 - RNA, 64 nt, Homo Sapiens; identical to SEQ ID NO: 312338

SEQ ID NO: 589743 - RNA, 61 nt, Homo Sapiens; identical to SEQ ID NO: 312339

SEQ ID NO: 589744 - RNA, 64 nt, Homo Sapiens; identical to SEQ ID NO: 312340

SEQ ID NO: 589745 - RNA, 64 nt, Homo Sapiens; identical to SEQ ID NO: 312341

SEQ ID NO: 589746 - RNA, 64 nt, Homo Sapiens; identical to SEQ ID NO: 312342

SEQ ID NO: 589747 - RNA, 64 nt, Homo Sapiens; identical to SEQ ID NO: 312343

SEQ ID NO: 589748 - RNA, 64 nt, Homo Sapiens; identical to SEQ ID NO: 312344

SEQ ID NO: 589749 - RNA, 64 nt, Homo Sapiens; identical to SEQ ID NO: 312345

SEQ ID NO: 589750 - RNA, 64 nt, Homo Sapiens; identical to SEQ ID NO: 312346

SEQ ID NO: 589751 - RNA, 64 nt, Homo Sapiens
guucuucuguuggagagaugagacauuugacccuuagcuccaguuuucuucugauguuuccauc

SEQ ID NO: 589752 - RNA, 64 nt, Homo Sapiens
uacacucccgcaacacagccauuauuuuauugucuagcuccaguuaucuguauuuuauguaaug

SEQ ID NO: 589753 - RNA, 64 nt, Homo Sapiens
gggggcuggggugucaaaagugagaugaaguucuuagcuccagguuuugggguaaaccaaggua

SEQ ID NO: 589754 - RNA, 64 nt, Homo Sapiens
auugcugcugauaugcuggugauucccaaauacauagcuccaacccccaacuucccccagacuu

SEQ ID NO: 589755 - RNA, 64 nt, Homo Sapiens
cuuuucuaaccagacuugauggcuuugccacuuuuagcuccaggugagcacaggacaggaaaug

SEQ ID NO: 589756 - RNA, 64 nt, Homo Sapiens
auuuugugaccacuauuguguuguugggugcugguagcuccagacuuguauaguaauuuuguug

SEQ ID NO: 589757 - RNA, 64 nt, Homo Sapiens
augcaauaaguauguauugaacuguacuguaaaguagcuccaaaacuuaauuacucuccuguuu

SEQ ID NO: 589758 - RNA, 64 nt, Homo Sapiens
uccuauauagauauauguaacuuagcuuuauuguuagcuccauaagcugccaguguugcuuuuc

SEQ ID NO: 589759 - RNA, 64 nt, Homo Sapiens; identical to SEQ ID NO: 370200

SEQ ID NO: 589760 - RNA, 64 nt, Homo Sapiens; identical to SEQ ID NO: 370201

SEQ ID NO: 589761 - RNA, 64 nt, Homo Sapiens; identical to SEQ ID NO: 370202

SEQ ID NO: 589762 - RNA, 64 nt, Homo Sapiens; identical to SEQ ID NO: 370203

SEQ ID NO: 589763 - RNA, 64 nt, Homo Sapiens; identical to SEQ ID NO: 370204

SEQ ID NO: 589764 - RNA, 64 nt, Homo Sapiens; identical to SEQ ID NO: 370205

SEQ ID NO: 589765 - RNA, 64 nt, Homo Sapiens; identical to SEQ ID NO: 370206

SEQ ID NO: 589766 - RNA, 64 nt, Homo Sapiens; identical to SEQ ID NO: 370207

SEQ ID NO: 589767 - RNA, 64 nt, Homo Sapiens; identical to SEQ ID NO: 370208

SEQ ID NO: 589768 - RNA, 64 nt, Homo Sapiens; identical to SEQ ID NO: 370209

SEQ ID NO: 589769 - RNA, 64 nt, Homo Sapiens; identical to SEQ ID NO: 370210

SEQ ID NO: 589770 - RNA, 64 nt, Homo Sapiens; identical to SEQ ID NO: 370211

SEQ ID NO: 589771 - RNA, 64 nt, Homo Sapiens
uguuuuuauuuaccgaacaguuggaaaguaaaacuuugaauaucccagcgaagaaauggauaaa

SEQ ID NO: 589772 - RNA, 64 nt, Homo Sapiens
aauguuaaucaaaaugaguauaucauuuccugucuuugaauaauccacucauuaauuuuuaaua

SEQ ID NO: 589773 - RNA, 64 nt, Homo Sapiens
ccgcacaaaaaauaaaguuaaaggaaaaccacuguuugaauaaguccuacuuaaaugauuucau

SEQ ID NO: 589774 - RNA, 64 nt, Homo Sapiens
gggaaaugcccaagauguccagugucucuacaacuuugaauaaauccccuuucccggaauuuua

SEQ ID NO: 589775 - RNA, 64 nt, Homo Sapiens
uacauguauguauauacagauuauauguauauaauuugaauauaucuugaaucuacaaauaucu

SEQ ID NO: 589776 - RNA, 64 nt, Homo Sapiens
ucaugcuuuccuagaauuuacauggaaaauccaauuugaauaagaucuguaaaacuaaauauag

SEQ ID NO: 589777 - RNA, 64 nt, Homo Sapiens
gccaugacaguguuaaaaacuugugcaacuguguuuugaauaaaaaacuuugaaguuaauacuu

SEQ ID NO: 589778 - RNA, 64 nt, Homo Sapiens
uguaaguuuuuaagaaguuauuuuuucccuuuguuuugaauauuuaaaucuuggcuaucuaaaa

SEQ ID NO: 589779 - RNA, 64 nt, Homo Sapiens
aauaaauaacaaaacaauaagggaaacaaauucuuuugaauaaaguuaucuaauuuuugugaua

SEQ ID NO: 589780 - RNA, 64 nt, Homo Sapiens
uuuuucuuuuuuucuuuuccgguuuuggauuuguuuugaauauucucuccccaaagucaucaug

SEQ ID NO: 589781 - RNA, 64 nt, Homo Sapiens
ccauucagguuauauuuaaaaagaaaguuucucuuuugaauauugccacaagaauaaugggugg

SEQ ID NO: 589782 - RNA, 64 nt, Homo Sapiens
acuuucaggcuacaagugacaagacagauucugcuuugaauauagcuacagaaauaaaggaugg

SEQ ID NO: 589783 - RNA, 64 nt, Homo Sapiens
ccauucaggcuacaagugaugagaaagauucuguuuugaauauagccagaggaaaaaaggaugg

SEQ ID NO: 589784 - RNA, 64 nt, Homo Sapiens
cuggagcagcacgcucagagacagugaacuagcauuugaauacacaaguccaagucuacugugu

SEQ ID NO: 589785 - RNA, 64 nt, Homo Sapiens
uagugguuaauaguuuuccaguugcauuuaauuuuuugaauaugauaccuugucacauguaaau

SEQ ID NO: 589786 - RNA, 64 nt, Homo Sapiens
agacccacaaucauuuacaguuuuaucuuuggccuuugaauagguucuuuuuucuuuaaugucu

SEQ ID NO: 589787 - RNA, 64 nt, Homo Sapiens
uuaugccuuaaaauagguuucugauuacauaaaauuugaauagaacacucaagaaguauguaga

SEQ ID NO: 589788 - RNA, 64 nt, Homo Sapiens
gaugcaaaggaacaaugguguuggcaaagucuucuuugaauaucagggacugagucaauaaaaa

SEQ ID NO: 589789 - RNA, 64 nt, Homo Sapiens
aaauuggcuuccaacuaaaauacguuugacccauuuugaauaaggaaauugaaaagaaaaauuu

SEQ ID NO: 589790 - RNA, 64 nt, Homo Sapiens
uguugccuuaauuucaaaagcugcuauuuuagaauuugaauaaguacuccuaaagugaccauua

SEQ ID NO: 589791 - RNA, 64 nt, Homo Sapiens
auauuugauuuugaaauguauuuuuguacuuuauuuugaauaucauccauaugucugacauuau

SEQ ID NO: 589792 - RNA, 64 nt, Homo Sapiens
gcccugggaccaccucaacacgggcaaauuggcauuugaauaaaauaacccuguggcagugaca

SEQ ID NO: 589793 - RNA, 64 nt, Homo Sapiens
auacauuauaccucauaggucauuucacacaaaguuugaauagagacaggugaguuaaauauac

SEQ ID NO: 589794 - RNA, 64 nt, Homo Sapiens
cauuaaaagauuucuaaacuucuuuauuuuguccuuugaauaaaugugucucauugguucauag

SEQ ID NO: 589795 - RNA, 64 nt, Homo Sapiens
aauuuaucauuuaguuauaaacguauucaaacaauuugaauauaguacucugaaaguuuuggaa

SEQ ID NO: 589796 - RNA, 64 nt, Homo Sapiens
aguuuccuuuaauaggaguacacugucucuuaauuuugaauaaucaggaugaugauguugucac

SEQ ID NO: 589797 - RNA, 64 nt, Homo Sapiens
guuuauuuuacuuuacuaguugguuuggucugccuuugaauauuagauauauuuagauuagaaa

SEQ ID NO: 589798 - RNA, 64 nt, Homo Sapiens
aauaacucuggucuagauuucuuuuaaggaguaauuugaauauuauagaaaacaauugccuuca

SEQ ID NO: 589799 - RNA, 64 nt, Homo Sapiens
gcuuuuaaaugaaauguuacagauccuaucuucauuugaauauaagcacaaauagcuuauauuc

SEQ ID NO: 589800 - RNA, 64 nt, Homo Sapiens
guggacauugggauuguugcuugaaaaauuaaaauuugaauauuuucucucucauuugcaucau

SEQ ID NO: 589801 - RNA, 64 nt, Homo Sapiens
gaaacauucugucaggcgguaugacuggacagacuuugaauauacucuaaaaguggacagaaaa

SEQ ID NO: 589802 - RNA, 64 nt, Homo Sapiens
gugacuuauuuuuuccauuauaccauuagucagauuugaauaacgagguuuugaaaggauaaaa

SEQ ID NO: 589803 - RNA, 64 nt, Homo Sapiens
aguucauguuaguauaauuauagauuuacauauauuugaauaguuaauuugcuuuguuuuacac

SEQ ID NO: 589804 - RNA, 64 nt, Homo Sapiens
uaguagucaaucuaacugcaauuagaaauugucuuuugaauauacuauauauauuuuuuauguu

SEQ ID NO: 589805 - RNA, 64 nt, Homo Sapiens
auugucaucaauaucuacagaagcucuuugacgguuugaauacuauggcucaagguuuucauau

SEQ ID NO: 589806 - RNA, 64 nt, Homo Sapiens
ucagaauuaccaucagaaccucaauugacauuccuuugaauacgcuaauaagugacaaauaaga

SEQ ID NO: 589807 - RNA, 64 nt, Homo Sapiens
auaaaccaaaaacauuugauuaauaaaauaucuauuugaauaaauuaugagcuauccuuucaaa

SEQ ID NO: 589808 - RNA, 64 nt, Homo Sapiens
aacuacuacauuggcugugcccaaaugaguccucuuugaauagaaagugaacccagggcaauga

SEQ ID NO: 589809 - RNA, 64 nt, Homo Sapiens
auaggauagaaacguauuguuguauauuuccauuuuugaauagggucaaggagcccaagcaaau

SEQ ID NO: 589810 - RNA, 64 nt, Homo Sapiens
gauacauuaagggugaaaauagcaauacaguagauuugaauaccuugauguuuugcauuacuuc

SEQ ID NO: 589811 - RNA, 64 nt, Homo Sapiens
uaagugaucuuucuaauucgaaagcuguguucuuuuugaauaccgugcauggggguuaagcuga

SEQ ID NO: 589812 - RNA, 64 nt, Homo Sapiens
ugauuuuuuuuaaugggagaauuuacaucaauauuuugaauaucggauuaauuuaaacuuuaca

SEQ ID NO: 589813 - RNA, 64 nt, Homo Sapiens
ugaaaggauuaauuuaaacuauuuagaucaauauuuugaauauguaaaaggauuaaacuuuaca

SEQ ID NO: 589814 - RNA, 64 nt, Homo Sapiens
uaacugcuaagucuuauauuaacuuuaaacaauguuugaauaauaguuuccauaugcagggagu

SEQ ID NO: 589815 - RNA, 64 nt, Homo Sapiens
agcucuaaaccuagguuauaauuugcuuaguuuauuugaauaaaaauaggaaaaaaaaauaugc

SEQ ID NO: 589816 - RNA, 64 nt, Homo Sapiens
guauugagauaugauaagugccuucuauuucauuuuugaauaauucuucauuuuuauaauuuua

SEQ ID NO: 589817 - RNA, 64 nt, Homo Sapiens
cauuaauauuaugguuauugucagcaauuuuauguuugaauauuugaaauaaaaguuuaagauu

SEQ ID NO: 589818 - RNA, 64 nt, Homo Sapiens
acuuaauucuuuuccauauauugugauacaaacuuuugaauauggaaucuuacuauuugaauag

SEQ ID NO: 589819 - RNA, 64 nt, Homo Sapiens
ugugauacaaacuuuugaauauggaaucuuacuauuugaauagaaauguguauguauaauauac

SEQ ID NO: 589820 - RNA, 64 nt, Homo Sapiens
agugacaaggaagcucacagcugggcgagugcauuuugaauaguuuuuuguaaguagugcuuuu

SEQ ID NO: 589821 - RNA, 64 nt, Homo Sapiens
agagucagagauggggcuggucauguuccuuugguuugaauaacucccuugacgaaaacagacu

SEQ ID NO: 589822 - RNA, 64 nt, Homo Sapiens
acugccucaauaucaagggcugagacuuuugaauuuugaauauucguuggguuucauguuaaga

SEQ ID NO: 589823 - RNA, 64 nt, Homo Sapiens
agugcuauucaguguuucuuuuccugauaaacacuuugaauauuuuuuuuguguuuuuguuucc

SEQ ID NO: 589824 - RNA, 64 nt, Homo Sapiens
ugaaaccagcauuagagcuuagauacuuguaguguuugaauaaacacaguguccagcauauggu

SEQ ID NO: 589825 - RNA, 64 nt, Homo Sapiens
uuauuaaacaguuauaaauauuuuagaugcuaauuuugaauaguguguguccaaaguauaauua

SEQ ID NO: 589826 - RNA, 64 nt, Homo Sapiens
aagcuaagauguggauuuacaggaagaacccugguuugaauaacugaucugaaauuaguaguua

SEQ ID NO: 589827 - RNA, 64 nt, Homo Sapiens
ucuuuuaggaaaauaagagaaagguaagggcucuuuugaauaaacugcuguuuuauuuguggca

SEQ ID NO: 589828 - RNA, 64 nt, Homo Sapiens
gcauugugugaguugugauuggacuuuggcauaauuugaauauacaaaugaaaugaauauguug

SEQ ID NO: 589829 - RNA, 64 nt, Homo Sapiens
uaauggcuaaagauuuuccaggcaugaagaaguauuugaauaaaaggagaggagaaaaugaaga

SEQ ID NO: 589830 - RNA, 64 nt, Homo Sapiens
ggggaacaagccaauaaagauguuuaggauaaaauuugaauagugaauauuaacaucguaaguc

SEQ ID NO: 589831 - RNA, 64 nt, Homo Sapiens
uucuagaaguucuuauuuuguuuuuguuguaauguuugaauacuauuuaauauccgguuuuaau

SEQ ID NO: 589832 - RNA, 64 nt, Homo Sapiens
gcacauuugaaauuugguaggcauugcaaacacauuugaauauuguguauuucauacuauucuu

SEQ ID NO: 589833 - RNA, 64 nt, Homo Sapiens
guaccuaaguaguuuuucauuauuuuaaguugaauuugaauaaagauuccagaaauaaacaugg

SEQ ID NO: 589834 - RNA, 64 nt, Homo Sapiens
aaauuuggaccaaaugauaaaauauuuuuuguaguuugaauaugauauguuuucuuuauuaaaa

SEQ ID NO: 589835 - RNA, 64 nt, Homo Sapiens
uuuucuuuauuaaaaaauauguguauauguauguuuugaauauguccucccacuguguguaugu

SEQ ID NO: 589836 - RNA, 64 nt, Homo Sapiens
augacaauaacuaaagcuagucaaauggcauccauuugaauaaaaaugcucaauacuuaccuaa

SEQ ID NO: 589837 - RNA, 64 nt, Homo Sapiens
cagagccuugauccagaagcauuugcuuguuuguuuugaauauauuugccccaccuacucugua

SEQ ID NO: 589838 - RNA, 64 nt, Homo Sapiens
uauauuuuuccaaccacugauuguuuuaauuacauuugaauaaucauguuuauuaccuauaugg

SEQ ID NO: 589839 - RNA, 64 nt, Homo Sapiens
guccuuccugcuuuaucugcauauguaagugacauuugaauacucuucguggaaugcugcauuu

SEQ ID NO: 589840 - RNA, 64 nt, Homo Sapiens
cauuuuccacuuuguuuuccccaaaacauaucaguuugaauacuugaaucaugcaggccaauau

SEQ ID NO: 589841 - RNA, 64 nt, Homo Sapiens
gcagcccaccugccacccaggacgggcccugcacuuugaauaggcuuuccauuuuguuuuggag

SEQ ID NO: 589842 - RNA, 64 nt, Homo Sapiens
aacacagaauacuuuaugcauauuacugauuuaauuugaauauaguuuuacagccuccuugaca

SEQ ID NO: 589843 - RNA, 64 nt, Homo Sapiens
uaaauauacugaguugcccguuuugaaaaugcacuuugaauaaucucaaaaagauguacaaguu

SEQ ID NO: 589844 - RNA, 64 nt, Homo Sapiens
uuagaugggacaaaaauugucagguggacuuugcuuugaauauuuuuuuguucuagagucagaa

SEQ ID NO: 589845 - RNA, 64 nt, Homo Sapiens
gauaaacauuuuauccugauuuuaagauauuuuauuugaauacuuucuuuccugucucuuucca

SEQ ID NO: 589846 - RNA, 64 nt, Homo Sapiens
cuuacaauauacuggcuuauuguuaagcagauuuuuugaauacaaaguucgguuaacaaggaag

SEQ ID NO: 589847 - RNA, 64 nt, Homo Sapiens
uauucuauuaaacugaguuuauagucaauucuuauuugaauauuuucucuacuggaauauuggu

SEQ ID NO: 589848 - RNA, 64 nt, Homo Sapiens
cauugugggaaagcauucauaucugccaagauccuuugaauacaugcaagaacacacaauggag

SEQ ID NO: 589849 - RNA, 64 nt, Homo Sapiens
caguaugggaaagcguucagaccugacaagauucuuugaauacagauaaugaauguaaacaauu

SEQ ID NO: 589850 - RNA, 64 nt, Homo Sapiens
cauugugggaaagcauucauaucugccaagaucguuugaauacaugcaaaacacacacuggaga

SEQ ID NO: 589851 - RNA, 64 nt, Homo Sapiens
caguaugggaaagccuucagaucggcuaggauucuuugaauacaaauaaugaauguaaacaauu

SEQ ID NO: 589852 - RNA, 64 nt, Homo Sapiens
uuuacuucuuucuuauuuacuaagaauuugccuguuugaauaagaacaaaacgcuaaggugggu

SEQ ID NO: 589853 - RNA, 64 nt, Homo Sapiens
ugcuuuucuucucucaaaauggauccgauaaauauuugaauagagcagauuguagaaugucgug

SEQ ID NO: 589854 - RNA, 64 nt, Homo Sapiens
uuguuugcuuauuuuuaaauuaacuguuuugagcuuugaauacuuaaggcuuuagagggagaac

SEQ ID NO: 589855 - RNA, 64 nt, Homo Sapiens
cgaguaaaguguaaugaguacuguggaaaccaaauuugaauacugcaaauuuguaggaguuacu

SEQ ID NO: 589856 - RNA, 64 nt, Homo Sapiens
cagagcuuucagggagggcuguucaaguuugguuuuugaauagacagagguuucauuuucaucu

SEQ ID NO: 589857 - RNA, 64 nt, Homo Sapiens
cguauuacauaaaacacccuugaaaauauaugacuuugaauaaaauaaagcuaccauguuaaua

SEQ ID NO: 589858 - RNA, 64 nt, Homo Sapiens
uuuauaugguaaaggaauccuuucagcugccaguuuugaauaaugaauaucauauuguaucauc

SEQ ID NO: 589859 - RNA, 64 nt, Homo Sapiens
uggaaagcugggugaagccaguuguggagaauuguuugaauauuaucccauugaauacccagag

SEQ ID NO: 589860 - RNA, 64 nt, Homo Sapiens
gaaaaacagaguuccuguuaucaggcuugugacauuugaauaaggcaauauguacaguaacgcg

SEQ ID NO: 589861 - RNA, 64 nt, Homo Sapiens
uuuaggaagaguugcuucccuguagcucuggcccuuugaauaugcaaaaauacaagucccguuc

SEQ ID NO: 589862 - RNA, 64 nt, Homo Sapiens
aaguuucaucacaaaucauggaaaacauuuagcauuugaauaguuauauaccuuauuaaagcuu

SEQ ID NO: 589863 - RNA, 64 nt, Homo Sapiens
guaaaacugugauaaacuuugcaggucugucauuuuugaauacuuuuuuguuuuguuuuuuaag

SEQ ID NO: 589864 - RNA, 64 nt, Homo Sapiens; identical to SEQ ID NO: 220362

SEQ ID NO: 589865 - RNA, 64 nt, Homo Sapiens; identical to SEQ ID NO: 220363

SEQ ID NO: 589866 - RNA, 64 nt, Homo Sapiens; identical to SEQ ID NO: 220364

SEQ ID NO: 589867 - RNA, 64 nt, Homo Sapiens; identical to SEQ ID NO: 220365

SEQ ID NO: 589868 - RNA, 64 nt, Homo Sapiens; identical to SEQ ID NO: 220366

SEQ ID NO: 589869 - RNA, 64 nt, Homo Sapiens; identical to SEQ ID NO: 220367

SEQ ID NO: 589870 - RNA, 64 nt, Homo Sapiens; identical to SEQ ID NO: 220368

SEQ ID NO: 589871 - RNA, 64 nt, Homo Sapiens; identical to SEQ ID NO: 220369

SEQ ID NO: 589872 - RNA, 64 nt, Homo Sapiens; identical to SEQ ID NO: 220370

SEQ ID NO: 589873 - RNA, 64 nt, Homo Sapiens; identical to SEQ ID NO: 220371

SEQ ID NO: 589874 - RNA, 64 nt, Homo Sapiens; identical to SEQ ID NO: 220372

SEQ ID NO: 589875 - RNA, 64 nt, Homo Sapiens; identical to SEQ ID NO: 220373

SEQ ID NO: 589876 - RNA, 64 nt, Homo Sapiens; identical to SEQ ID NO: 220374

SEQ ID NO: 589877 - RNA, 64 nt, Homo Sapiens; identical to SEQ ID NO: 220375

SEQ ID NO: 589878 - RNA, 64 nt, Homo Sapiens; identical to SEQ ID NO: 220376

SEQ ID NO: 589879 - RNA, 64 nt, Homo Sapiens; identical to SEQ ID NO: 220377

SEQ ID NO: 589880 - RNA, 64 nt, Homo Sapiens; identical to SEQ ID NO: 220378

SEQ ID NO: 589881 - RNA, 64 nt, Homo Sapiens; identical to SEQ ID NO: 220379

SEQ ID NO: 589882 - RNA, 64 nt, Homo Sapiens; identical to SEQ ID NO: 220380

SEQ ID NO: 589883 - RNA, 64 nt, Homo Sapiens; identical to SEQ ID NO: 220381

SEQ ID NO: 589884 - RNA, 64 nt, Homo Sapiens; identical to SEQ ID NO: 220382

SEQ ID NO: 589885 - RNA, 64 nt, Homo Sapiens; identical to SEQ ID NO: 220383

SEQ ID NO: 589886 - RNA, 64 nt, Homo Sapiens; identical to SEQ ID NO: 220384

SEQ ID NO: 589887 - RNA, 64 nt, Homo Sapiens; identical to SEQ ID NO: 220385

SEQ ID NO: 589888 - RNA, 64 nt, Homo Sapiens; identical to SEQ ID NO: 220386

SEQ ID NO: 589889 - RNA, 64 nt, Homo Sapiens; identical to SEQ ID NO: 220387

SEQ ID NO: 589890 - RNA, 64 nt, Homo Sapiens; identical to SEQ ID NO: 220388

SEQ ID NO: 589891 - RNA, 64 nt, Homo Sapiens; identical to SEQ ID NO: 220389

SEQ ID NO: 589892 - RNA, 64 nt, Homo Sapiens; identical to SEQ ID NO: 220390

SEQ ID NO: 589893 - RNA, 64 nt, Homo Sapiens; identical to SEQ ID NO: 220391

SEQ ID NO: 589894 - RNA, 64 nt, Homo Sapiens; identical to SEQ ID NO: 220392

SEQ ID NO: 589895 - RNA, 64 nt, Homo Sapiens; identical to SEQ ID NO: 220393

SEQ ID NO: 589896 - RNA, 64 nt, Homo Sapiens; identical to SEQ ID NO: 220394

SEQ ID NO: 589897 - RNA, 64 nt, Homo Sapiens; identical to SEQ ID NO: 220395

SEQ ID NO: 589898 - RNA, 64 nt, Homo Sapiens; identical to SEQ ID NO: 220396

SEQ ID NO: 589899 - RNA, 64 nt, Homo Sapiens; identical to SEQ ID NO: 220397

SEQ ID NO: 589900 - RNA, 64 nt, Homo Sapiens; identical to SEQ ID NO: 220398

SEQ ID NO: 589901 - RNA, 64 nt, Homo Sapiens; identical to SEQ ID NO: 220399

SEQ ID NO: 589902 - RNA, 64 nt, Homo Sapiens; identical to SEQ ID NO: 220400

SEQ ID NO: 589903 - RNA, 64 nt, Homo Sapiens; identical to SEQ ID NO: 220401

SEQ ID NO: 589904 - RNA, 64 nt, Homo Sapiens; identical to SEQ ID NO: 220402

SEQ ID NO: 589905 - RNA, 64 nt, Homo Sapiens; identical to SEQ ID NO: 220403

SEQ ID NO: 589906 - RNA, 64 nt, Homo Sapiens; identical to SEQ ID NO: 220404

SEQ ID NO: 589907 - RNA, 64 nt, Homo Sapiens; identical to SEQ ID NO: 220405

SEQ ID NO: 589908 - RNA, 64 nt, Homo Sapiens; identical to SEQ ID NO: 220406

SEQ ID NO: 589909 - RNA, 64 nt, Homo Sapiens; identical to SEQ ID NO: 220407

SEQ ID NO: 589910 - RNA, 64 nt, Homo Sapiens; identical to SEQ ID NO: 220408

SEQ ID NO: 589911 - RNA, 64 nt, Homo Sapiens; identical to SEQ ID NO: 220409

SEQ ID NO: 589912 - RNA, 64 nt, Homo Sapiens; identical to SEQ ID NO: 220410

SEQ ID NO: 589913 - RNA, 64 nt, Homo Sapiens; identical to SEQ ID NO: 220411

SEQ ID NO: 589914 - RNA, 64 nt, Homo Sapiens; identical to SEQ ID NO: 220412

SEQ ID NO: 589915 - RNA, 64 nt, Homo Sapiens; identical to SEQ ID NO: 220413

SEQ ID NO: 589916 - RNA, 64 nt, Homo Sapiens; identical to SEQ ID NO: 220414

SEQ ID NO: 589917 - RNA, 64 nt, Homo Sapiens; identical to SEQ ID NO: 220415

SEQ ID NO: 589918 - RNA, 64 nt, Homo Sapiens; identical to SEQ ID NO: 220416

SEQ ID NO: 589919 - RNA, 64 nt, Homo Sapiens; identical to SEQ ID NO: 220417

SEQ ID NO: 589920 - RNA, 64 nt, Homo Sapiens; identical to SEQ ID NO: 220418

SEQ ID NO: 589921 - RNA, 64 nt, Homo Sapiens; identical to SEQ ID NO: 220419

SEQ ID NO: 589922 - RNA, 64 nt, Homo Sapiens; identical to SEQ ID NO: 220420

SEQ ID NO: 589923 - RNA, 64 nt, Homo Sapiens; identical to SEQ ID NO: 220421

SEQ ID NO: 589924 - RNA, 64 nt, Homo Sapiens; identical to SEQ ID NO: 220422

SEQ ID NO: 589925 - RNA, 64 nt, Homo Sapiens; identical to SEQ ID NO: 142269

SEQ ID NO: 589926 - RNA, 64 nt, Homo Sapiens; identical to SEQ ID NO: 142270

SEQ ID NO: 589927 - RNA, 64 nt, Homo Sapiens; identical to SEQ ID NO: 142271

SEQ ID NO: 589928 - RNA, 64 nt, Homo Sapiens; identical to SEQ ID NO: 142272

SEQ ID NO: 589929 - RNA, 64 nt, Homo Sapiens; identical to SEQ ID NO: 142273

SEQ ID NO: 589930 - RNA, 64 nt, Homo Sapiens; identical to SEQ ID NO: 142274

SEQ ID NO: 589931 - RNA, 64 nt, Homo Sapiens; identical to SEQ ID NO: 142275

SEQ ID NO: 589932 - RNA, 64 nt, Homo Sapiens; identical to SEQ ID NO: 142276

SEQ ID NO: 589933 - RNA, 64 nt, Homo Sapiens; identical to SEQ ID NO: 142277

SEQ ID NO: 589934 - RNA, 64 nt, Homo Sapiens; identical to SEQ ID NO: 142278

SEQ ID NO: 589935 - RNA, 64 nt, Homo Sapiens; identical to SEQ ID NO: 142279

SEQ ID NO: 589936 - RNA, 64 nt, Homo Sapiens; identical to SEQ ID NO: 142280

SEQ ID NO: 589937 - RNA, 64 nt, Homo Sapiens; identical to SEQ ID NO: 142281

SEQ ID NO: 589938 - RNA, 64 nt, Homo Sapiens; identical to SEQ ID NO: 142282

SEQ ID NO: 589939 - RNA, 64 nt, Homo Sapiens; identical to SEQ ID NO: 142283

SEQ ID NO: 589940 - RNA, 64 nt, Homo Sapiens; identical to SEQ ID NO: 142284

SEQ ID NO: 589941 - RNA, 64 nt, Homo Sapiens; identical to SEQ ID NO: 142285

SEQ ID NO: 589942 - RNA, 64 nt, Homo Sapiens; identical to SEQ ID NO: 142286

SEQ ID NO: 589943 - RNA, 64 nt, Homo Sapiens; identical to SEQ ID NO: 142287

SEQ ID NO: 589944 - RNA, 64 nt, Homo Sapiens; identical to SEQ ID NO: 142288

SEQ ID NO: 589945 - RNA, 64 nt, Homo Sapiens; identical to SEQ ID NO: 142289

SEQ ID NO: 589946 - RNA, 64 nt, Homo Sapiens; identical to SEQ ID NO: 142290

SEQ ID NO: 589947 - RNA, 64 nt, Homo Sapiens; identical to SEQ ID NO: 142291

SEQ ID NO: 589948 - RNA, 64 nt, Homo Sapiens; identical to SEQ ID NO: 142292

SEQ ID NO: 589949 - RNA, 64 nt, Homo Sapiens; identical to SEQ ID NO: 142293

SEQ ID NO: 589950 - RNA, 64 nt, Homo Sapiens; identical to SEQ ID NO: 142294

SEQ ID NO: 589951 - RNA, 64 nt, Homo Sapiens; identical to SEQ ID NO: 142295

SEQ ID NO: 589952 - RNA, 64 nt, Homo Sapiens; identical to SEQ ID NO: 142296

SEQ ID NO: 589953 - RNA, 64 nt, Homo Sapiens; identical to SEQ ID NO: 142297

SEQ ID NO: 589954 - RNA, 64 nt, Homo Sapiens; identical to SEQ ID NO: 142298

SEQ ID NO: 589955 - RNA, 64 nt, Homo Sapiens; identical to SEQ ID NO: 142299

SEQ ID NO: 589956 - RNA, 64 nt, Homo Sapiens; identical to SEQ ID NO: 142300

SEQ ID NO: 589957 - RNA, 64 nt, Homo Sapiens; identical to SEQ ID NO: 142301

SEQ ID NO: 589958 - RNA, 64 nt, Homo Sapiens; identical to SEQ ID NO: 142302

SEQ ID NO: 589959 - RNA, 64 nt, Homo Sapiens; identical to SEQ ID NO: 142303

SEQ ID NO: 589960 - RNA, 64 nt, Homo Sapiens; identical to SEQ ID NO: 142304

SEQ ID NO: 589961 - RNA, 64 nt, Homo Sapiens; identical to SEQ ID NO: 142305

SEQ ID NO: 589962 - RNA, 64 nt, Homo Sapiens; identical to SEQ ID NO: 142306

SEQ ID NO: 589963 - RNA, 64 nt, Homo Sapiens; identical to SEQ ID NO: 142307

SEQ ID NO: 589964 - RNA, 64 nt, Homo Sapiens; identical to SEQ ID NO: 142308

SEQ ID NO: 589965 - RNA, 64 nt, Homo Sapiens; identical to SEQ ID NO: 142309

SEQ ID NO: 589966 - RNA, 64 nt, Homo Sapiens; identical to SEQ ID NO: 142310

SEQ ID NO: 589967 - RNA, 64 nt, Homo Sapiens; identical to SEQ ID NO: 142311

SEQ ID NO: 589968 - RNA, 64 nt, Homo Sapiens; identical to SEQ ID NO: 142312

SEQ ID NO: 589969 - RNA, 64 nt, Homo Sapiens; identical to SEQ ID NO: 142313

SEQ ID NO: 589970 - RNA, 64 nt, Homo Sapiens; identical to SEQ ID NO: 142314

SEQ ID NO: 589971 - RNA, 64 nt, Homo Sapiens; identical to SEQ ID NO: 142315

SEQ ID NO: 589972 - RNA, 64 nt, Homo Sapiens; identical to SEQ ID NO: 142316

SEQ ID NO: 589973 - RNA, 64 nt, Homo Sapiens; identical to SEQ ID NO: 142317

SEQ ID NO: 589974 - RNA, 64 nt, Homo Sapiens; identical to SEQ ID NO: 142318

SEQ ID NO: 589975 - RNA, 64 nt, Homo Sapiens; identical to SEQ ID NO: 142319

SEQ ID NO: 589976 - RNA, 64 nt, Homo Sapiens; identical to SEQ ID NO: 142320

SEQ ID NO: 589977 - RNA, 64 nt, Homo Sapiens; identical to SEQ ID NO: 142321

SEQ ID NO: 589978 - RNA, 64 nt, Homo Sapiens; identical to SEQ ID NO: 142322

SEQ ID NO: 589979 - RNA, 64 nt, Homo Sapiens; identical to SEQ ID NO: 142323

SEQ ID NO: 589980 - RNA, 64 nt, Homo Sapiens; identical to SEQ ID NO: 142324

SEQ ID NO: 589981 - RNA, 64 nt, Homo Sapiens; identical to SEQ ID NO: 142325

SEQ ID NO: 589982 - RNA, 64 nt, Homo Sapiens; identical to SEQ ID NO: 142326

SEQ ID NO: 589983 - RNA, 64 nt, Homo Sapiens; identical to SEQ ID NO: 142327

SEQ ID NO: 589984 - RNA, 64 nt, Homo Sapiens; identical to SEQ ID NO: 142328

SEQ ID NO: 589985 - RNA, 64 nt, Homo Sapiens; identical to SEQ ID NO: 142329

SEQ ID NO: 589986 - RNA, 64 nt, Homo Sapiens; identical to SEQ ID NO: 142330

SEQ ID NO: 589987 - RNA, 64 nt, Homo Sapiens; identical to SEQ ID NO: 142331

SEQ ID NO: 589988 - RNA, 64 nt, Homo Sapiens; identical to SEQ ID NO: 142332

SEQ ID NO: 589989 - RNA, 64 nt, Homo Sapiens; identical to SEQ ID NO: 142333

SEQ ID NO: 589990 - RNA, 64 nt, Homo Sapiens; identical to SEQ ID NO: 142334

SEQ ID NO: 589991 - RNA, 64 nt, Homo Sapiens; identical to SEQ ID NO: 142335

SEQ ID NO: 589992 - RNA, 64 nt, Homo Sapiens; identical to SEQ ID NO: 142336

SEQ ID NO: 589993 - RNA, 64 nt, Homo Sapiens; identical to SEQ ID NO: 142337

SEQ ID NO: 589994 - RNA, 64 nt, Homo Sapiens; identical to SEQ ID NO: 142338

SEQ ID NO: 589995 - RNA, 64 nt, Homo Sapiens; identical to SEQ ID NO: 142339

SEQ ID NO: 589996 - RNA, 64 nt, Homo Sapiens; identical to SEQ ID NO: 142340

SEQ ID NO: 589997 - RNA, 64 nt, Homo Sapiens; identical to SEQ ID NO: 142341

SEQ ID NO: 589998 - RNA, 64 nt, Homo Sapiens; identical to SEQ ID NO: 142342

SEQ ID NO: 589999 - RNA, 64 nt, Homo Sapiens; identical to SEQ ID NO: 142343

SEQ ID NO: 590000 - RNA, 64 nt, Homo Sapiens; identical to SEQ ID NO: 142344

SEQ ID NO: 590001 - RNA, 64 nt, Homo Sapiens; identical to SEQ ID NO: 142345

SEQ ID NO: 590002 - RNA, 64 nt, Homo Sapiens; identical to SEQ ID NO: 142346

SEQ ID NO: 590003 - RNA, 64 nt, Homo Sapiens; identical to SEQ ID NO: 142347

SEQ ID NO: 590004 - RNA, 64 nt, Homo Sapiens; identical to SEQ ID NO: 142348

SEQ ID NO: 590005 - RNA, 64 nt, Homo Sapiens; identical to SEQ ID NO: 142349

SEQ ID NO: 590006 - RNA, 64 nt, Homo Sapiens; identical to SEQ ID NO: 142350

SEQ ID NO: 590007 - RNA, 64 nt, Homo Sapiens; identical to SEQ ID NO: 142351

SEQ ID NO: 590008 - RNA, 64 nt, Homo Sapiens; identical to SEQ ID NO: 142352

SEQ ID NO: 590009 - RNA, 64 nt, Homo Sapiens; identical to SEQ ID NO: 142353

SEQ ID NO: 590010 - RNA, 64 nt, Homo Sapiens; identical to SEQ ID NO: 142354

SEQ ID NO: 590011 - RNA, 64 nt, Homo Sapiens; identical to SEQ ID NO: 142355

SEQ ID NO: 590012 - RNA, 64 nt, Homo Sapiens; identical to SEQ ID NO: 142356

SEQ ID NO: 590013 - RNA, 64 nt, Homo Sapiens; identical to SEQ ID NO: 142357

SEQ ID NO: 590014 - RNA, 64 nt, Homo Sapiens; identical to SEQ ID NO: 142358

SEQ ID NO: 590015 - RNA, 64 nt, Homo Sapiens; identical to SEQ ID NO: 142359

SEQ ID NO: 590016 - RNA, 64 nt, Homo Sapiens; identical to SEQ ID NO: 142360

SEQ ID NO: 590017 - RNA, 64 nt, Homo Sapiens; identical to SEQ ID NO: 142361

SEQ ID NO: 590018 - RNA, 64 nt, Homo Sapiens; identical to SEQ ID NO: 142362

SEQ ID NO: 590019 - RNA, 64 nt, Homo Sapiens; identical to SEQ ID NO: 142363

SEQ ID NO: 590020 - RNA, 64 nt, Homo Sapiens; identical to SEQ ID NO: 142364

SEQ ID NO: 590021 - RNA, 64 nt, Homo Sapiens; identical to SEQ ID NO: 142365

SEQ ID NO: 590022 - RNA, 64 nt, Homo Sapiens; identical to SEQ ID NO: 142366

SEQ ID NO: 590023 - RNA, 64 nt, Homo Sapiens; identical to SEQ ID NO: 142367

SEQ ID NO: 590024 - RNA, 64 nt, Homo Sapiens; identical to SEQ ID NO: 142368

SEQ ID NO: 590025 - RNA, 64 nt, Homo Sapiens; identical to SEQ ID NO: 142369

SEQ ID NO: 590026 - RNA, 64 nt, Homo Sapiens; identical to SEQ ID NO: 142370

SEQ ID NO: 590027 - RNA, 64 nt, Homo Sapiens; identical to SEQ ID NO: 142371

SEQ ID NO: 590028 - RNA, 64 nt, Homo Sapiens; identical to SEQ ID NO: 142372

SEQ ID NO: 590029 - RNA, 64 nt, Homo Sapiens; identical to SEQ ID NO: 142373

SEQ ID NO: 590030 - RNA, 64 nt, Homo Sapiens; identical to SEQ ID NO: 142374

SEQ ID NO: 590031 - RNA, 64 nt, Homo Sapiens; identical to SEQ ID NO: 142375

SEQ ID NO: 590032 - RNA, 64 nt, Homo Sapiens; identical to SEQ ID NO: 142376

SEQ ID NO: 590033 - RNA, 64 nt, Homo Sapiens; identical to SEQ ID NO: 142377

SEQ ID NO: 590034 - RNA, 64 nt, Homo Sapiens; identical to SEQ ID NO: 142378

SEQ ID NO: 590035 - RNA, 64 nt, Homo Sapiens; identical to SEQ ID NO: 142379

SEQ ID NO: 590036 - RNA, 64 nt, Homo Sapiens; identical to SEQ ID NO: 142380

SEQ ID NO: 590037 - RNA, 64 nt, Homo Sapiens; identical to SEQ ID NO: 142381

SEQ ID NO: 590038 - RNA, 64 nt, Homo Sapiens; identical to SEQ ID NO: 142382

SEQ ID NO: 590039 - RNA, 64 nt, Homo Sapiens; identical to SEQ ID NO: 142383

SEQ ID NO: 590040 - RNA, 64 nt, Homo Sapiens; identical to SEQ ID NO: 142384

SEQ ID NO: 590041 - RNA, 64 nt, Homo Sapiens; identical to SEQ ID NO: 142385

SEQ ID NO: 590042 - RNA, 64 nt, Homo Sapiens; identical to SEQ ID NO: 142386

SEQ ID NO: 590043 - RNA, 64 nt, Homo Sapiens; identical to SEQ ID NO: 142387

SEQ ID NO: 590044 - RNA, 64 nt, Homo Sapiens; identical to SEQ ID NO: 142388

SEQ ID NO: 590045 - RNA, 64 nt, Homo Sapiens; identical to SEQ ID NO: 142389

SEQ ID NO: 590046 - RNA, 64 nt, Homo Sapiens; identical to SEQ ID NO: 142390

SEQ ID NO: 590047 - RNA, 64 nt, Homo Sapiens; identical to SEQ ID NO: 142391

SEQ ID NO: 590048 - RNA, 64 nt, Homo Sapiens; identical to SEQ ID NO: 142392

SEQ ID NO: 590049 - RNA, 64 nt, Homo Sapiens; identical to SEQ ID NO: 142393

SEQ ID NO: 590050 - RNA, 64 nt, Homo Sapiens; identical to SEQ ID NO: 142394

SEQ ID NO: 590051 - RNA, 61 nt, Homo Sapiens; identical to SEQ ID NO: 142395

SEQ ID NO: 590052 - RNA, 64 nt, Homo Sapiens; identical to SEQ ID NO: 142396

SEQ ID NO: 590053 - RNA, 64 nt, Homo Sapiens; identical to SEQ ID NO: 142397

SEQ ID NO: 590054 - RNA, 64 nt, Homo Sapiens; identical to SEQ ID NO: 142398

SEQ ID NO: 590055 - RNA, 64 nt, Homo Sapiens; identical to SEQ ID NO: 142399

SEQ ID NO: 590056 - RNA, 64 nt, Homo Sapiens; identical to SEQ ID NO: 142400

SEQ ID NO: 590057 - RNA, 64 nt, Homo Sapiens; identical to SEQ ID NO: 142401

SEQ ID NO: 590058 - RNA, 64 nt, Homo Sapiens; identical to SEQ ID NO: 142402

SEQ ID NO: 590059 - RNA, 64 nt, Homo Sapiens; identical to SEQ ID NO: 142403

SEQ ID NO: 590060 - RNA, 64 nt, Homo Sapiens; identical to SEQ ID NO: 142404

SEQ ID NO: 590061 - RNA, 64 nt, Homo Sapiens; identical to SEQ ID NO: 142405

SEQ ID NO: 590062 - RNA, 64 nt, Homo Sapiens; identical to SEQ ID NO: 142406

SEQ ID NO: 590063 - RNA, 64 nt, Homo Sapiens; identical to SEQ ID NO: 142407

SEQ ID NO: 590064 - RNA, 64 nt, Homo Sapiens; identical to SEQ ID NO: 142408

SEQ ID NO: 590065 - RNA, 64 nt, Homo Sapiens; identical to SEQ ID NO: 142409

SEQ ID NO: 590066 - RNA, 64 nt, Homo Sapiens; identical to SEQ ID NO: 142410

SEQ ID NO: 590067 - RNA, 64 nt, Homo Sapiens; identical to SEQ ID NO: 142411

SEQ ID NO: 590068 - RNA, 64 nt, Homo Sapiens; identical to SEQ ID NO: 142412

SEQ ID NO: 590069 - RNA, 64 nt, Homo Sapiens; identical to SEQ ID NO: 142413

SEQ ID NO: 590070 - RNA, 64 nt, Homo Sapiens; identical to SEQ ID NO: 142414

SEQ ID NO: 590071 - RNA, 64 nt, Homo Sapiens; identical to SEQ ID NO: 142415

SEQ ID NO: 590072 - RNA, 64 nt, Homo Sapiens; identical to SEQ ID NO: 142416

SEQ ID NO: 590073 - RNA, 64 nt, Homo Sapiens; identical to SEQ ID NO: 142417

SEQ ID NO: 590074 - RNA, 64 nt, Homo Sapiens; identical to SEQ ID NO: 142418

SEQ ID NO: 590075 - RNA, 64 nt, Homo Sapiens; identical to SEQ ID NO: 142419

SEQ ID NO: 590076 - RNA, 64 nt, Homo Sapiens; identical to SEQ ID NO: 142420

SEQ ID NO: 590077 - RNA, 64 nt, Homo Sapiens; identical to SEQ ID NO: 142421

SEQ ID NO: 590078 - RNA, 64 nt, Homo Sapiens; identical to SEQ ID NO: 142422

SEQ ID NO: 590079 - RNA, 64 nt, Homo Sapiens; identical to SEQ ID NO: 142423

SEQ ID NO: 590080 - RNA, 64 nt, Homo Sapiens; identical to SEQ ID NO: 142424

SEQ ID NO: 590081 - RNA, 64 nt, Homo Sapiens; identical to SEQ ID NO: 142425

SEQ ID NO: 590082 - RNA, 64 nt, Homo Sapiens; identical to SEQ ID NO: 142426

SEQ ID NO: 590083 - RNA, 64 nt, Homo Sapiens; identical to SEQ ID NO: 142427

SEQ ID NO: 590084 - RNA, 64 nt, Homo Sapiens; identical to SEQ ID NO: 142428

SEQ ID NO: 590085 - RNA, 64 nt, Homo Sapiens; identical to SEQ ID NO: 142429

SEQ ID NO: 590086 - RNA, 64 nt, Homo Sapiens; identical to SEQ ID NO: 142430

SEQ ID NO: 590087 - RNA, 64 nt, Homo Sapiens; identical to SEQ ID NO: 142431

SEQ ID NO: 590088 - RNA, 64 nt, Homo Sapiens; identical to SEQ ID NO: 142432

SEQ ID NO: 590089 - RNA, 64 nt, Homo Sapiens; identical to SEQ ID NO: 142433

SEQ ID NO: 590090 - RNA, 64 nt, Homo Sapiens; identical to SEQ ID NO: 142434

SEQ ID NO: 590091 - RNA, 64 nt, Homo Sapiens; identical to SEQ ID NO: 142435

SEQ ID NO: 590092 - RNA, 64 nt, Homo Sapiens; identical to SEQ ID NO: 142436

SEQ ID NO: 590093 - RNA, 64 nt, Homo Sapiens; identical to SEQ ID NO: 142437

SEQ ID NO: 590094 - RNA, 64 nt, Homo Sapiens; identical to SEQ ID NO: 142438

SEQ ID NO: 590095 - RNA, 64 nt, Homo Sapiens; identical to SEQ ID NO: 142439

SEQ ID NO: 590096 - RNA, 64 nt, Homo Sapiens; identical to SEQ ID NO: 142440

SEQ ID NO: 590097 - RNA, 64 nt, Homo Sapiens; identical to SEQ ID NO: 142441

SEQ ID NO: 590098 - RNA, 64 nt, Homo Sapiens; identical to SEQ ID NO: 142442

SEQ ID NO: 590099 - RNA, 64 nt, Homo Sapiens; identical to SEQ ID NO: 142443

SEQ ID NO: 590100 - RNA, 64 nt, Homo Sapiens; identical to SEQ ID NO: 142444

SEQ ID NO: 590101 - RNA, 64 nt, Homo Sapiens; identical to SEQ ID NO: 142445

SEQ ID NO: 590102 - RNA, 64 nt, Homo Sapiens; identical to SEQ ID NO: 142446

SEQ ID NO: 590103 - RNA, 56 nt, Homo Sapiens; identical to SEQ ID NO: 142447

SEQ ID NO: 590104 - RNA, 64 nt, Homo Sapiens; identical to SEQ ID NO: 142448

SEQ ID NO: 590105 - RNA, 64 nt, Homo Sapiens; identical to SEQ ID NO: 142449

SEQ ID NO: 590106 - RNA, 64 nt, Homo Sapiens; identical to SEQ ID NO: 142450

SEQ ID NO: 590107 - RNA, 64 nt, Homo Sapiens; identical to SEQ ID NO: 142451

SEQ ID NO: 590108 - RNA, 64 nt, Homo Sapiens; identical to SEQ ID NO: 142452

SEQ ID NO: 590109 - RNA, 64 nt, Homo Sapiens; identical to SEQ ID NO: 142453

SEQ ID NO: 590110 - RNA, 64 nt, Homo Sapiens; identical to SEQ ID NO: 142454

SEQ ID NO: 590111 - RNA, 64 nt, Homo Sapiens; identical to SEQ ID NO: 142455

SEQ ID NO: 590112 - RNA, 64 nt, Homo Sapiens; identical to SEQ ID NO: 142456

SEQ ID NO: 590113 - RNA, 64 nt, Homo Sapiens; identical to SEQ ID NO: 142457

SEQ ID NO: 590114 - RNA, 64 nt, Homo Sapiens; identical to SEQ ID NO: 142458

SEQ ID NO: 590115 - RNA, 64 nt, Homo Sapiens; identical to SEQ ID NO: 142459

SEQ ID NO: 590116 - RNA, 64 nt, Homo Sapiens; identical to SEQ ID NO: 142460

SEQ ID NO: 590117 - RNA, 64 nt, Homo Sapiens; identical to SEQ ID NO: 142461

SEQ ID NO: 590118 - RNA, 64 nt, Homo Sapiens; identical to SEQ ID NO: 142462

SEQ ID NO: 590119 - RNA, 64 nt, Homo Sapiens; identical to SEQ ID NO: 142463

SEQ ID NO: 590120 - RNA, 64 nt, Homo Sapiens; identical to SEQ ID NO: 142464

SEQ ID NO: 590121 - RNA, 64 nt, Homo Sapiens; identical to SEQ ID NO: 142465

SEQ ID NO: 590122 - RNA, 64 nt, Homo Sapiens; identical to SEQ ID NO: 142466

SEQ ID NO: 590123 - RNA, 64 nt, Homo Sapiens; identical to SEQ ID NO: 142467

SEQ ID NO: 590124 - RNA, 64 nt, Homo Sapiens; identical to SEQ ID NO: 142468

SEQ ID NO: 590125 - RNA, 64 nt, Homo Sapiens; identical to SEQ ID NO: 142469

SEQ ID NO: 590126 - RNA, 64 nt, Homo Sapiens; identical to SEQ ID NO: 142470

SEQ ID NO: 590127 - RNA, 64 nt, Homo Sapiens; identical to SEQ ID NO: 142471

SEQ ID NO: 590128 - RNA, 64 nt, Homo Sapiens; identical to SEQ ID NO: 142472

SEQ ID NO: 590129 - RNA, 64 nt, Homo Sapiens; identical to SEQ ID NO: 142473

SEQ ID NO: 590130 - RNA, 64 nt, Homo Sapiens; identical to SEQ ID NO: 142474

SEQ ID NO: 590131 - RNA, 64 nt, Homo Sapiens; identical to SEQ ID NO: 142475

SEQ ID NO: 590132 - RNA, 64 nt, Homo Sapiens; identical to SEQ ID NO: 142476

SEQ ID NO: 590133 - RNA, 64 nt, Homo Sapiens; identical to SEQ ID NO: 142477

SEQ ID NO: 590134 - RNA, 64 nt, Homo Sapiens; identical to SEQ ID NO: 142478

SEQ ID NO: 590135 - RNA, 64 nt, Homo Sapiens; identical to SEQ ID NO: 142479

SEQ ID NO: 590136 - RNA, 64 nt, Homo Sapiens; identical to SEQ ID NO: 142480

SEQ ID NO: 590137 - RNA, 64 nt, Homo Sapiens; identical to SEQ ID NO: 142481

SEQ ID NO: 590138 - RNA, 64 nt, Homo Sapiens; identical to SEQ ID NO: 142482

SEQ ID NO: 590139 - RNA, 64 nt, Homo Sapiens; identical to SEQ ID NO: 142483

SEQ ID NO: 590140 - RNA, 64 nt, Homo Sapiens; identical to SEQ ID NO: 142484

SEQ ID NO: 590141 - RNA, 64 nt, Homo Sapiens; identical to SEQ ID NO: 142485

SEQ ID NO: 590142 - RNA, 64 nt, Homo Sapiens; identical to SEQ ID NO: 142486

SEQ ID NO: 590143 - RNA, 64 nt, Homo Sapiens; identical to SEQ ID NO: 142487

SEQ ID NO: 590144 - RNA, 64 nt, Homo Sapiens; identical to SEQ ID NO: 142488

SEQ ID NO: 590145 - RNA, 64 nt, Homo Sapiens; identical to SEQ ID NO: 142489

SEQ ID NO: 590146 - RNA, 64 nt, Homo Sapiens; identical to SEQ ID NO: 142490

SEQ ID NO: 590147 - RNA, 64 nt, Homo Sapiens; identical to SEQ ID NO: 142491

SEQ ID NO: 590148 - RNA, 64 nt, Homo Sapiens; identical to SEQ ID NO: 142492

SEQ ID NO: 590149 - RNA, 64 nt, Homo Sapiens; identical to SEQ ID NO: 142493

SEQ ID NO: 590150 - RNA, 64 nt, Homo Sapiens; identical to SEQ ID NO: 142494

SEQ ID NO: 590151 - RNA, 64 nt, Homo Sapiens; identical to SEQ ID NO: 142495

SEQ ID NO: 590152 - RNA, 64 nt, Homo Sapiens; identical to SEQ ID NO: 142496

SEQ ID NO: 590153 - RNA, 64 nt, Homo Sapiens; identical to SEQ ID NO: 142497

SEQ ID NO: 590154 - RNA, 64 nt, Homo Sapiens; identical to SEQ ID NO: 142498

SEQ ID NO: 590155 - RNA, 64 nt, Homo Sapiens; identical to SEQ ID NO: 142499

SEQ ID NO: 590156 - RNA, 64 nt, Homo Sapiens; identical to SEQ ID NO: 142500

SEQ ID NO: 590157 - RNA, 64 nt, Homo Sapiens; identical to SEQ ID NO: 142501

SEQ ID NO: 590158 - RNA, 64 nt, Homo Sapiens; identical to SEQ ID NO: 142502

SEQ ID NO: 590159 - RNA, 64 nt, Homo Sapiens; identical to SEQ ID NO: 142503

SEQ ID NO: 590160 - RNA, 64 nt, Homo Sapiens; identical to SEQ ID NO: 142504

SEQ ID NO: 590161 - RNA, 64 nt, Homo Sapiens; identical to SEQ ID NO: 142505

SEQ ID NO: 590162 - RNA, 64 nt, Homo Sapiens; identical to SEQ ID NO: 142506

SEQ ID NO: 590163 - RNA, 64 nt, Homo Sapiens; identical to SEQ ID NO: 142507

SEQ ID NO: 590164 - RNA, 64 nt, Homo Sapiens; identical to SEQ ID NO: 142508

SEQ ID NO: 590165 - RNA, 64 nt, Homo Sapiens; identical to SEQ ID NO: 142509

SEQ ID NO: 590166 - RNA, 64 nt, Homo Sapiens; identical to SEQ ID NO: 142510

SEQ ID NO: 590167 - RNA, 64 nt, Homo Sapiens; identical to SEQ ID NO: 142511

SEQ ID NO: 590168 - RNA, 64 nt, Homo Sapiens; identical to SEQ ID NO: 142512

SEQ ID NO: 590169 - RNA, 64 nt, Homo Sapiens; identical to SEQ ID NO: 142513

SEQ ID NO: 590170 - RNA, 64 nt, Homo Sapiens; identical to SEQ ID NO: 142514

SEQ ID NO: 590171 - RNA, 64 nt, Homo Sapiens; identical to SEQ ID NO: 142515

SEQ ID NO: 590172 - RNA, 64 nt, Homo Sapiens; identical to SEQ ID NO: 142516

SEQ ID NO: 590173 - RNA, 64 nt, Homo Sapiens; identical to SEQ ID NO: 142517

SEQ ID NO: 590174 - RNA, 64 nt, Homo Sapiens; identical to SEQ ID NO: 142518

SEQ ID NO: 590175 - RNA, 64 nt, Homo Sapiens; identical to SEQ ID NO: 142519

SEQ ID NO: 590176 - RNA, 64 nt, Homo Sapiens; identical to SEQ ID NO: 142520

SEQ ID NO: 590177 - RNA, 64 nt, Homo Sapiens; identical to SEQ ID NO: 142521

SEQ ID NO: 590178 - RNA, 64 nt, Homo Sapiens; identical to SEQ ID NO: 142522

SEQ ID NO: 590179 - RNA, 64 nt, Homo Sapiens; identical to SEQ ID NO: 142523

SEQ ID NO: 590180 - RNA, 64 nt, Homo Sapiens; identical to SEQ ID NO: 142524

SEQ ID NO: 590181 - RNA, 64 nt, Homo Sapiens; identical to SEQ ID NO: 142525

SEQ ID NO: 590182 - RNA, 64 nt, Homo Sapiens; identical to SEQ ID NO: 142526

SEQ ID NO: 590183 - RNA, 64 nt, Homo Sapiens; identical to SEQ ID NO: 142527

SEQ ID NO: 590184 - RNA, 64 nt, Homo Sapiens; identical to SEQ ID NO: 142528

SEQ ID NO: 590185 - RNA, 64 nt, Homo Sapiens; identical to SEQ ID NO: 142529

SEQ ID NO: 590186 - RNA, 64 nt, Homo Sapiens; identical to SEQ ID NO: 142530

SEQ ID NO: 590187 - RNA, 64 nt, Homo Sapiens; identical to SEQ ID NO: 142531

SEQ ID NO: 590188 - RNA, 64 nt, Homo Sapiens; identical to SEQ ID NO: 142532

SEQ ID NO: 590189 - RNA, 64 nt, Homo Sapiens; identical to SEQ ID NO: 142533

SEQ ID NO: 590190 - RNA, 64 nt, Homo Sapiens; identical to SEQ ID NO: 142534

SEQ ID NO: 590191 - RNA, 64 nt, Homo Sapiens; identical to SEQ ID NO: 142535

SEQ ID NO: 590192 - RNA, 64 nt, Homo Sapiens; identical to SEQ ID NO: 142536

SEQ ID NO: 590193 - RNA, 64 nt, Homo Sapiens; identical to SEQ ID NO: 142537

SEQ ID NO: 590194 - RNA, 64 nt, Homo Sapiens; identical to SEQ ID NO: 142538

SEQ ID NO: 590195 - RNA, 64 nt, Homo Sapiens; identical to SEQ ID NO: 142539

SEQ ID NO: 590196 - RNA, 64 nt, Homo Sapiens; identical to SEQ ID NO: 142540

SEQ ID NO: 590197 - RNA, 64 nt, Homo Sapiens; identical to SEQ ID NO: 142541

SEQ ID NO: 590198 - RNA, 59 nt, Homo Sapiens; identical to SEQ ID NO: 142542

SEQ ID NO: 590199 - RNA, 64 nt, Homo Sapiens; identical to SEQ ID NO: 142543

SEQ ID NO: 590200 - RNA, 64 nt, Homo Sapiens; identical to SEQ ID NO: 142544

SEQ ID NO: 590201 - RNA, 64 nt, Homo Sapiens; identical to SEQ ID NO: 142545

SEQ ID NO: 590202 - RNA, 64 nt, Homo Sapiens; identical to SEQ ID NO: 142546

SEQ ID NO: 590203 - RNA, 64 nt, Homo Sapiens; identical to SEQ ID NO: 142547

SEQ ID NO: 590204 - RNA, 64 nt, Homo Sapiens; identical to SEQ ID NO: 142548

SEQ ID NO: 590205 - RNA, 64 nt, Homo Sapiens; identical to SEQ ID NO: 142549

SEQ ID NO: 590206 - RNA, 64 nt, Homo Sapiens; identical to SEQ ID NO: 142550

SEQ ID NO: 590207 - RNA, 64 nt, Homo Sapiens; identical to SEQ ID NO: 142551

SEQ ID NO: 590208 - RNA, 64 nt, Homo Sapiens; identical to SEQ ID NO: 142552

SEQ ID NO: 590209 - RNA, 64 nt, Homo Sapiens; identical to SEQ ID NO: 142553

SEQ ID NO: 590210 - RNA, 64 nt, Homo Sapiens; identical to SEQ ID NO: 142554

SEQ ID NO: 590211 - RNA, 64 nt, Homo Sapiens; identical to SEQ ID NO: 142555

SEQ ID NO: 590212 - RNA, 64 nt, Homo Sapiens; identical to SEQ ID NO: 142556

SEQ ID NO: 590213 - RNA, 64 nt, Homo Sapiens; identical to SEQ ID NO: 142557

SEQ ID NO: 590214 - RNA, 64 nt, Homo Sapiens; identical to SEQ ID NO: 142558

SEQ ID NO: 590215 - RNA, 64 nt, Homo Sapiens; identical to SEQ ID NO: 142559

SEQ ID NO: 590216 - RNA, 64 nt, Homo Sapiens; identical to SEQ ID NO: 142560

SEQ ID NO: 590217 - RNA, 64 nt, Homo Sapiens; identical to SEQ ID NO: 142561

SEQ ID NO: 590218 - RNA, 64 nt, Homo Sapiens; identical to SEQ ID NO: 142562

SEQ ID NO: 590219 - RNA, 64 nt, Homo Sapiens; identical to SEQ ID NO: 142563

SEQ ID NO: 590220 - RNA, 64 nt, Homo Sapiens; identical to SEQ ID NO: 142564

SEQ ID NO: 590221 - RNA, 64 nt, Homo Sapiens; identical to SEQ ID NO: 142565

SEQ ID NO: 590222 - RNA, 64 nt, Homo Sapiens; identical to SEQ ID NO: 142566

SEQ ID NO: 590223 - RNA, 64 nt, Homo Sapiens; identical to SEQ ID NO: 142567

SEQ ID NO: 590224 - RNA, 64 nt, Homo Sapiens; identical to SEQ ID NO: 142568

SEQ ID NO: 590225 - RNA, 64 nt, Homo Sapiens; identical to SEQ ID NO: 142569

SEQ ID NO: 590226 - RNA, 64 nt, Homo Sapiens; identical to SEQ ID NO: 142570

SEQ ID NO: 590227 - RNA, 64 nt, Homo Sapiens; identical to SEQ ID NO: 142571

SEQ ID NO: 590228 - RNA, 64 nt, Homo Sapiens; identical to SEQ ID NO: 142572

SEQ ID NO: 590229 - RNA, 64 nt, Homo Sapiens; identical to SEQ ID NO: 142573

SEQ ID NO: 590230 - RNA, 64 nt, Homo Sapiens; identical to SEQ ID NO: 142574

SEQ ID NO: 590231 - RNA, 64 nt, Homo Sapiens; identical to SEQ ID NO: 142575

SEQ ID NO: 590232 - RNA, 64 nt, Homo Sapiens; identical to SEQ ID NO: 142576

SEQ ID NO: 590233 - RNA, 64 nt, Homo Sapiens; identical to SEQ ID NO: 142577

SEQ ID NO: 590234 - RNA, 64 nt, Homo Sapiens; identical to SEQ ID NO: 142578

SEQ ID NO: 590235 - RNA, 64 nt, Homo Sapiens; identical to SEQ ID NO: 142579

SEQ ID NO: 590236 - RNA, 64 nt, Homo Sapiens; identical to SEQ ID NO: 142580

SEQ ID NO: 590237 - RNA, 64 nt, Homo Sapiens; identical to SEQ ID NO: 142581

SEQ ID NO: 590238 - RNA, 64 nt, Homo Sapiens; identical to SEQ ID NO: 142582

SEQ ID NO: 590239 - RNA, 64 nt, Homo Sapiens; identical to SEQ ID NO: 142583

SEQ ID NO: 590240 - RNA, 55 nt, Homo Sapiens; identical to SEQ ID NO: 142584

SEQ ID NO: 590241 - RNA, 64 nt, Homo Sapiens; identical to SEQ ID NO: 142585

SEQ ID NO: 590242 - RNA, 64 nt, Homo Sapiens; identical to SEQ ID NO: 142586

SEQ ID NO: 590243 - RNA, 64 nt, Homo Sapiens; identical to SEQ ID NO: 142587

SEQ ID NO: 590244 - RNA, 64 nt, Homo Sapiens; identical to SEQ ID NO: 142588

SEQ ID NO: 590245 - RNA, 64 nt, Homo Sapiens; identical to SEQ ID NO: 142589

SEQ ID NO: 590246 - RNA, 64 nt, Homo Sapiens; identical to SEQ ID NO: 142590

SEQ ID NO: 590247 - RNA, 64 nt, Homo Sapiens; identical to SEQ ID NO: 142591

SEQ ID NO: 590248 - RNA, 64 nt, Homo Sapiens; identical to SEQ ID NO: 142592

SEQ ID NO: 590249 - RNA, 64 nt, Homo Sapiens; identical to SEQ ID NO: 142593

SEQ ID NO: 590250 - RNA, 64 nt, Homo Sapiens; identical to SEQ ID NO: 142594

SEQ ID NO: 590251 - RNA, 64 nt, Homo Sapiens; identical to SEQ ID NO: 142595

SEQ ID NO: 590252 - RNA, 64 nt, Homo Sapiens; identical to SEQ ID NO: 142596

SEQ ID NO: 590253 - RNA, 64 nt, Homo Sapiens; identical to SEQ ID NO: 142597

SEQ ID NO: 590254 - RNA, 64 nt, Homo Sapiens; identical to SEQ ID NO: 142598

SEQ ID NO: 590255 - RNA, 64 nt, Homo Sapiens; identical to SEQ ID NO: 142599

SEQ ID NO: 590256 - RNA, 64 nt, Homo Sapiens; identical to SEQ ID NO: 142600

SEQ ID NO: 590257 - RNA, 64 nt, Homo Sapiens; identical to SEQ ID NO: 142601

SEQ ID NO: 590258 - RNA, 64 nt, Homo Sapiens; identical to SEQ ID NO: 142602

SEQ ID NO: 590259 - RNA, 64 nt, Homo Sapiens; identical to SEQ ID NO: 142603

SEQ ID NO: 590260 - RNA, 64 nt, Homo Sapiens; identical to SEQ ID NO: 142604

SEQ ID NO: 590261 - RNA, 64 nt, Homo Sapiens; identical to SEQ ID NO: 142605

SEQ ID NO: 590262 - RNA, 64 nt, Homo Sapiens; identical to SEQ ID NO: 142606

SEQ ID NO: 590263 - RNA, 64 nt, Homo Sapiens; identical to SEQ ID NO: 142607

SEQ ID NO: 590264 - RNA, 64 nt, Homo Sapiens; identical to SEQ ID NO: 142608

SEQ ID NO: 590265 - RNA, 64 nt, Homo Sapiens; identical to SEQ ID NO: 142609

SEQ ID NO: 590266 - RNA, 64 nt, Homo Sapiens; identical to SEQ ID NO: 142610

SEQ ID NO: 590267 - RNA, 64 nt, Homo Sapiens; identical to SEQ ID NO: 142611

SEQ ID NO: 590268 - RNA, 64 nt, Homo Sapiens; identical to SEQ ID NO: 142612

SEQ ID NO: 590269 - RNA, 64 nt, Homo Sapiens; identical to SEQ ID NO: 142613

SEQ ID NO: 590270 - RNA, 64 nt, Homo Sapiens; identical to SEQ ID NO: 142614

SEQ ID NO: 590271 - RNA, 64 nt, Homo Sapiens; identical to SEQ ID NO: 142615

SEQ ID NO: 590272 - RNA, 64 nt, Homo Sapiens; identical to SEQ ID NO: 142616

SEQ ID NO: 590273 - RNA, 64 nt, Homo Sapiens; identical to SEQ ID NO: 142617

SEQ ID NO: 590274 - RNA, 64 nt, Homo Sapiens; identical to SEQ ID NO: 142618

SEQ ID NO: 590275 - RNA, 64 nt, Homo Sapiens; identical to SEQ ID NO: 142619

SEQ ID NO: 590276 - RNA, 64 nt, Homo Sapiens; identical to SEQ ID NO: 142620

SEQ ID NO: 590277 - RNA, 64 nt, Homo Sapiens; identical to SEQ ID NO: 142621

SEQ ID NO: 590278 - RNA, 64 nt, Homo Sapiens; identical to SEQ ID NO: 142622

SEQ ID NO: 590279 - RNA, 64 nt, Homo Sapiens; identical to SEQ ID NO: 142623

SEQ ID NO: 590280 - RNA, 64 nt, Homo Sapiens; identical to SEQ ID NO: 142624

SEQ ID NO: 590281 - RNA, 64 nt, Homo Sapiens; identical to SEQ ID NO: 142625

SEQ ID NO: 590282 - RNA, 64 nt, Homo Sapiens; identical to SEQ ID NO: 142626

SEQ ID NO: 590283 - RNA, 64 nt, Homo Sapiens; identical to SEQ ID NO: 142627

SEQ ID NO: 590284 - RNA, 64 nt, Homo Sapiens; identical to SEQ ID NO: 142628

SEQ ID NO: 590285 - RNA, 64 nt, Homo Sapiens; identical to SEQ ID NO: 142629

SEQ ID NO: 590286 - RNA, 64 nt, Homo Sapiens; identical to SEQ ID NO: 142630

SEQ ID NO: 590287 - RNA, 64 nt, Homo Sapiens; identical to SEQ ID NO: 142631

SEQ ID NO: 590288 - RNA, 64 nt, Homo Sapiens; identical to SEQ ID NO: 142632

SEQ ID NO: 590289 - RNA, 64 nt, Homo Sapiens; identical to SEQ ID NO: 142633

SEQ ID NO: 590290 - RNA, 64 nt, Homo Sapiens; identical to SEQ ID NO: 142634

SEQ ID NO: 590291 - RNA, 64 nt, Homo Sapiens; identical to SEQ ID NO: 142635

SEQ ID NO: 590292 - RNA, 64 nt, Homo Sapiens; identical to SEQ ID NO: 142636

SEQ ID NO: 590293 - RNA, 64 nt, Homo Sapiens; identical to SEQ ID NO: 142637

SEQ ID NO: 590294 - RNA, 64 nt, Homo Sapiens; identical to SEQ ID NO: 142638

SEQ ID NO: 590295 - RNA, 64 nt, Homo Sapiens; identical to SEQ ID NO: 142639

SEQ ID NO: 590296 - RNA, 64 nt, Homo Sapiens; identical to SEQ ID NO: 142640

SEQ ID NO: 590297 - RNA, 64 nt, Homo Sapiens; identical to SEQ ID NO: 142641

SEQ ID NO: 590298 - RNA, 64 nt, Homo Sapiens; identical to SEQ ID NO: 142642

SEQ ID NO: 590299 - RNA, 64 nt, Homo Sapiens; identical to SEQ ID NO: 142643

SEQ ID NO: 590300 - RNA, 64 nt, Homo Sapiens; identical to SEQ ID NO: 142644

SEQ ID NO: 590301 - RNA, 64 nt, Homo Sapiens; identical to SEQ ID NO: 142645

SEQ ID NO: 590302 - RNA, 64 nt, Homo Sapiens; identical to SEQ ID NO: 142646

SEQ ID NO: 590303 - RNA, 64 nt, Homo Sapiens; identical to SEQ ID NO: 142647

SEQ ID NO: 590304 - RNA, 64 nt, Homo Sapiens; identical to SEQ ID NO: 142648

SEQ ID NO: 590305 - RNA, 64 nt, Homo Sapiens; identical to SEQ ID NO: 142649

SEQ ID NO: 590306 - RNA, 64 nt, Homo Sapiens; identical to SEQ ID NO: 142650

SEQ ID NO: 590307 - RNA, 64 nt, Homo Sapiens; identical to SEQ ID NO: 142651

SEQ ID NO: 590308 - RNA, 64 nt, Homo Sapiens; identical to SEQ ID NO: 142652

SEQ ID NO: 590309 - RNA, 64 nt, Homo Sapiens; identical to SEQ ID NO: 142653

SEQ ID NO: 590310 - RNA, 64 nt, Homo Sapiens; identical to SEQ ID NO: 142654

SEQ ID NO: 590311 - RNA, 64 nt, Homo Sapiens; identical to SEQ ID NO: 142655

SEQ ID NO: 590312 - RNA, 64 nt, Homo Sapiens; identical to SEQ ID NO: 142656

SEQ ID NO: 590313 - RNA, 64 nt, Homo Sapiens; identical to SEQ ID NO: 142657

SEQ ID NO: 590314 - RNA, 64 nt, Homo Sapiens; identical to SEQ ID NO: 142658

SEQ ID NO: 590315 - RNA, 64 nt, Homo Sapiens; identical to SEQ ID NO: 142659

SEQ ID NO: 590316 - RNA, 64 nt, Homo Sapiens; identical to SEQ ID NO: 142660

SEQ ID NO: 590317 - RNA, 64 nt, Homo Sapiens; identical to SEQ ID NO: 142661

SEQ ID NO: 590318 - RNA, 64 nt, Homo Sapiens; identical to SEQ ID NO: 142662

SEQ ID NO: 590319 - RNA, 64 nt, Homo Sapiens; identical to SEQ ID NO: 142663

SEQ ID NO: 590320 - RNA, 64 nt, Homo Sapiens; identical to SEQ ID NO: 142664

SEQ ID NO: 590321 - RNA, 64 nt, Homo Sapiens; identical to SEQ ID NO: 142665

SEQ ID NO: 590322 - RNA, 64 nt, Homo Sapiens; identical to SEQ ID NO: 142666

SEQ ID NO: 590323 - RNA, 64 nt, Homo Sapiens; identical to SEQ ID NO: 142667

SEQ ID NO: 590324 - RNA, 64 nt, Homo Sapiens; identical to SEQ ID NO: 142668

SEQ ID NO: 590325 - RNA, 64 nt, Homo Sapiens; identical to SEQ ID NO: 142669

SEQ ID NO: 590326 - RNA, 64 nt, Homo Sapiens; identical to SEQ ID NO: 142670

SEQ ID NO: 590327 - RNA, 64 nt, Homo Sapiens; identical to SEQ ID NO: 142671

SEQ ID NO: 590328 - RNA, 64 nt, Homo Sapiens; identical to SEQ ID NO: 142672

SEQ ID NO: 590329 - RNA, 64 nt, Homo Sapiens; identical to SEQ ID NO: 142673

SEQ ID NO: 590330 - RNA, 64 nt, Homo Sapiens; identical to SEQ ID NO: 142674

SEQ ID NO: 590331 - RNA, 64 nt, Homo Sapiens; identical to SEQ ID NO: 142675

SEQ ID NO: 590332 - RNA, 64 nt, Homo Sapiens; identical to SEQ ID NO: 142676

SEQ ID NO: 590333 - RNA, 64 nt, Homo Sapiens; identical to SEQ ID NO: 142677

SEQ ID NO: 590334 - RNA, 64 nt, Homo Sapiens; identical to SEQ ID NO: 142678

SEQ ID NO: 590335 - RNA, 64 nt, Homo Sapiens; identical to SEQ ID NO: 142679

SEQ ID NO: 590336 - RNA, 64 nt, Homo Sapiens; identical to SEQ ID NO: 142680

SEQ ID NO: 590337 - RNA, 64 nt, Homo Sapiens; identical to SEQ ID NO: 142681

SEQ ID NO: 590338 - RNA, 64 nt, Homo Sapiens; identical to SEQ ID NO: 142682

SEQ ID NO: 590339 - RNA, 64 nt, Homo Sapiens; identical to SEQ ID NO: 142683

SEQ ID NO: 590340 - RNA, 64 nt, Homo Sapiens; identical to SEQ ID NO: 142684

SEQ ID NO: 590341 - RNA, 64 nt, Homo Sapiens; identical to SEQ ID NO: 142685

SEQ ID NO: 590342 - RNA, 64 nt, Homo Sapiens; identical to SEQ ID NO: 142686

SEQ ID NO: 590343 - RNA, 64 nt, Homo Sapiens; identical to SEQ ID NO: 142687

SEQ ID NO: 590344 - RNA, 64 nt, Homo Sapiens; identical to SEQ ID NO: 142688

SEQ ID NO: 590345 - RNA, 64 nt, Homo Sapiens; identical to SEQ ID NO: 142689

SEQ ID NO: 590346 - RNA, 64 nt, Homo Sapiens; identical to SEQ ID NO: 142690

SEQ ID NO: 590347 - RNA, 64 nt, Homo Sapiens; identical to SEQ ID NO: 142691

SEQ ID NO: 590348 - RNA, 64 nt, Homo Sapiens; identical to SEQ ID NO: 142692

SEQ ID NO: 590349 - RNA, 64 nt, Homo Sapiens; identical to SEQ ID NO: 142693

SEQ ID NO: 590350 - RNA, 64 nt, Homo Sapiens; identical to SEQ ID NO: 142694

SEQ ID NO: 590351 - RNA, 64 nt, Homo Sapiens; identical to SEQ ID NO: 142695

SEQ ID NO: 590352 - RNA, 64 nt, Homo Sapiens; identical to SEQ ID NO: 142696

SEQ ID NO: 590353 - RNA, 64 nt, Homo Sapiens; identical to SEQ ID NO: 142697

SEQ ID NO: 590354 - RNA, 64 nt, Homo Sapiens; identical to SEQ ID NO: 142698

SEQ ID NO: 590355 - RNA, 64 nt, Homo Sapiens; identical to SEQ ID NO: 142699

SEQ ID NO: 590356 - RNA, 64 nt, Homo Sapiens; identical to SEQ ID NO: 142700

SEQ ID NO: 590357 - RNA, 64 nt, Homo Sapiens; identical to SEQ ID NO: 142701

SEQ ID NO: 590358 - RNA, 64 nt, Homo Sapiens; identical to SEQ ID NO: 142702

SEQ ID NO: 590359 - RNA, 64 nt, Homo Sapiens; identical to SEQ ID NO: 142703

SEQ ID NO: 590360 - RNA, 64 nt, Homo Sapiens; identical to SEQ ID NO: 142704

SEQ ID NO: 590361 - RNA, 64 nt, Homo Sapiens; identical to SEQ ID NO: 142705

SEQ ID NO: 590362 - RNA, 64 nt, Homo Sapiens; identical to SEQ ID NO: 142706

SEQ ID NO: 590363 - RNA, 64 nt, Homo Sapiens; identical to SEQ ID NO: 142707

SEQ ID NO: 590364 - RNA, 64 nt, Homo Sapiens; identical to SEQ ID NO: 142708

SEQ ID NO: 590365 - RNA, 64 nt, Homo Sapiens; identical to SEQ ID NO: 142709

SEQ ID NO: 590366 - RNA, 64 nt, Homo Sapiens; identical to SEQ ID NO: 142710

SEQ ID NO: 590367 - RNA, 64 nt, Homo Sapiens; identical to SEQ ID NO: 142711

SEQ ID NO: 590368 - RNA, 64 nt, Homo Sapiens; identical to SEQ ID NO: 142712

SEQ ID NO: 590369 - RNA, 64 nt, Homo Sapiens; identical to SEQ ID NO: 142713

SEQ ID NO: 590370 - RNA, 64 nt, Homo Sapiens; identical to SEQ ID NO: 142714

SEQ ID NO: 590371 - RNA, 64 nt, Homo Sapiens; identical to SEQ ID NO: 142715

SEQ ID NO: 590372 - RNA, 64 nt, Homo Sapiens; identical to SEQ ID NO: 142716

SEQ ID NO: 590373 - RNA, 64 nt, Homo Sapiens; identical to SEQ ID NO: 142717

SEQ ID NO: 590374 - RNA, 64 nt, Homo Sapiens; identical to SEQ ID NO: 142718

SEQ ID NO: 590375 - RNA, 64 nt, Homo Sapiens; identical to SEQ ID NO: 142719

SEQ ID NO: 590376 - RNA, 64 nt, Homo Sapiens; identical to SEQ ID NO: 142720

SEQ ID NO: 590377 - RNA, 64 nt, Homo Sapiens; identical to SEQ ID NO: 142721

SEQ ID NO: 590378 - RNA, 64 nt, Homo Sapiens; identical to SEQ ID NO: 142722

SEQ ID NO: 590379 - RNA, 64 nt, Homo Sapiens; identical to SEQ ID NO: 142723

SEQ ID NO: 590380 - RNA, 64 nt, Homo Sapiens; identical to SEQ ID NO: 142724

SEQ ID NO: 590381 - RNA, 64 nt, Homo Sapiens; identical to SEQ ID NO: 142725

SEQ ID NO: 590382 - RNA, 64 nt, Homo Sapiens; identical to SEQ ID NO: 142726

SEQ ID NO: 590383 - RNA, 64 nt, Homo Sapiens; identical to SEQ ID NO: 142727

SEQ ID NO: 590384 - RNA, 64 nt, Homo Sapiens; identical to SEQ ID NO: 142728

SEQ ID NO: 590385 - RNA, 64 nt, Homo Sapiens; identical to SEQ ID NO: 142729

SEQ ID NO: 590386 - RNA, 64 nt, Homo Sapiens; identical to SEQ ID NO: 142730

SEQ ID NO: 590387 - RNA, 64 nt, Homo Sapiens; identical to SEQ ID NO: 142731

SEQ ID NO: 590388 - RNA, 64 nt, Homo Sapiens; identical to SEQ ID NO: 142732

SEQ ID NO: 590389 - RNA, 64 nt, Homo Sapiens; identical to SEQ ID NO: 142733

SEQ ID NO: 590390 - RNA, 64 nt, Homo Sapiens; identical to SEQ ID NO: 142734

SEQ ID NO: 590391 - RNA, 64 nt, Homo Sapiens; identical to SEQ ID NO: 142735

SEQ ID NO: 590392 - RNA, 64 nt, Homo Sapiens; identical to SEQ ID NO: 142736

SEQ ID NO: 590393 - RNA, 64 nt, Homo Sapiens; identical to SEQ ID NO: 142737

SEQ ID NO: 590394 - RNA, 64 nt, Homo Sapiens; identical to SEQ ID NO: 142738

SEQ ID NO: 590395 - RNA, 64 nt, Homo Sapiens; identical to SEQ ID NO: 142739

SEQ ID NO: 590396 - RNA, 64 nt, Homo Sapiens; identical to SEQ ID NO: 142740

SEQ ID NO: 590397 - RNA, 64 nt, Homo Sapiens; identical to SEQ ID NO: 142741

SEQ ID NO: 590398 - RNA, 64 nt, Homo Sapiens; identical to SEQ ID NO: 142742

SEQ ID NO: 590399 - RNA, 64 nt, Homo Sapiens; identical to SEQ ID NO: 142743

SEQ ID NO: 590400 - RNA, 64 nt, Homo Sapiens; identical to SEQ ID NO: 142744

SEQ ID NO: 590401 - RNA, 64 nt, Homo Sapiens; identical to SEQ ID NO: 142745

SEQ ID NO: 590402 - RNA, 64 nt, Homo Sapiens; identical to SEQ ID NO: 142746

SEQ ID NO: 590403 - RNA, 64 nt, Homo Sapiens; identical to SEQ ID NO: 142747

SEQ ID NO: 590404 - RNA, 64 nt, Homo Sapiens; identical to SEQ ID NO: 142748

SEQ ID NO: 590405 - RNA, 64 nt, Homo Sapiens; identical to SEQ ID NO: 142749

SEQ ID NO: 590406 - RNA, 64 nt, Homo Sapiens; identical to SEQ ID NO: 142750

SEQ ID NO: 590407 - RNA, 64 nt, Homo Sapiens; identical to SEQ ID NO: 142751

SEQ ID NO: 590408 - RNA, 64 nt, Homo Sapiens; identical to SEQ ID NO: 142752

SEQ ID NO: 590409 - RNA, 64 nt, Homo Sapiens; identical to SEQ ID NO: 142753

SEQ ID NO: 590410 - RNA, 64 nt, Homo Sapiens; identical to SEQ ID NO: 142754

SEQ ID NO: 590411 - RNA, 64 nt, Homo Sapiens; identical to SEQ ID NO: 142755

SEQ ID NO: 590412 - RNA, 64 nt, Homo Sapiens; identical to SEQ ID NO: 142756

SEQ ID NO: 590413 - RNA, 64 nt, Homo Sapiens; identical to SEQ ID NO: 142757

SEQ ID NO: 590414 - RNA, 64 nt, Homo Sapiens; identical to SEQ ID NO: 142758

SEQ ID NO: 590415 - RNA, 64 nt, Homo Sapiens; identical to SEQ ID NO: 142759

SEQ ID NO: 590416 - RNA, 64 nt, Homo Sapiens; identical to SEQ ID NO: 142760

SEQ ID NO: 590417 - RNA, 64 nt, Homo Sapiens; identical to SEQ ID NO: 142761

SEQ ID NO: 590418 - RNA, 64 nt, Homo Sapiens; identical to SEQ ID NO: 142762

SEQ ID NO: 590419 - RNA, 64 nt, Homo Sapiens; identical to SEQ ID NO: 142763

SEQ ID NO: 590420 - RNA, 64 nt, Homo Sapiens; identical to SEQ ID NO: 142764

SEQ ID NO: 590421 - RNA, 64 nt, Homo Sapiens; identical to SEQ ID NO: 142765

SEQ ID NO: 590422 - RNA, 64 nt, Homo Sapiens; identical to SEQ ID NO: 142766

SEQ ID NO: 590423 - RNA, 64 nt, Homo Sapiens; identical to SEQ ID NO: 142767

SEQ ID NO: 590424 - RNA, 64 nt, Homo Sapiens; identical to SEQ ID NO: 142768

SEQ ID NO: 590425 - RNA, 64 nt, Homo Sapiens; identical to SEQ ID NO: 142769

SEQ ID NO: 590426 - RNA, 64 nt, Homo Sapiens; identical to SEQ ID NO: 142770

SEQ ID NO: 590427 - RNA, 64 nt, Homo Sapiens; identical to SEQ ID NO: 142771

SEQ ID NO: 590428 - RNA, 64 nt, Homo Sapiens; identical to SEQ ID NO: 142772

SEQ ID NO: 590429 - RNA, 64 nt, Homo Sapiens; identical to SEQ ID NO: 142773

SEQ ID NO: 590430 - RNA, 64 nt, Homo Sapiens; identical to SEQ ID NO: 142774

SEQ ID NO: 590431 - RNA, 64 nt, Homo Sapiens; identical to SEQ ID NO: 142775

SEQ ID NO: 590432 - RNA, 64 nt, Homo Sapiens; identical to SEQ ID NO: 142776

SEQ ID NO: 590433 - RNA, 64 nt, Homo Sapiens; identical to SEQ ID NO: 142777

SEQ ID NO: 590434 - RNA, 64 nt, Homo Sapiens; identical to SEQ ID NO: 142778

SEQ ID NO: 590435 - RNA, 64 nt, Homo Sapiens; identical to SEQ ID NO: 142779

SEQ ID NO: 590436 - RNA, 64 nt, Homo Sapiens; identical to SEQ ID NO: 142780

SEQ ID NO: 590437 - RNA, 64 nt, Homo Sapiens; identical to SEQ ID NO: 142781

SEQ ID NO: 590438 - RNA, 64 nt, Homo Sapiens; identical to SEQ ID NO: 142782

SEQ ID NO: 590439 - RNA, 64 nt, Homo Sapiens; identical to SEQ ID NO: 142783

SEQ ID NO: 590440 - RNA, 64 nt, Homo Sapiens; identical to SEQ ID NO: 142784

SEQ ID NO: 590441 - RNA, 64 nt, Homo Sapiens; identical to SEQ ID NO: 142785

SEQ ID NO: 590442 - RNA, 64 nt, Homo Sapiens; identical to SEQ ID NO: 142786

SEQ ID NO: 590443 - RNA, 64 nt, Homo Sapiens; identical to SEQ ID NO: 142787

SEQ ID NO: 590444 - RNA, 64 nt, Homo Sapiens; identical to SEQ ID NO: 142788

SEQ ID NO: 590445 - RNA, 64 nt, Homo Sapiens; identical to SEQ ID NO: 142789

SEQ ID NO: 590446 - RNA, 64 nt, Homo Sapiens; identical to SEQ ID NO: 142790

SEQ ID NO: 590447 - RNA, 64 nt, Homo Sapiens; identical to SEQ ID NO: 142791

SEQ ID NO: 590448 - RNA, 64 nt, Homo Sapiens; identical to SEQ ID NO: 142792

SEQ ID NO: 590449 - RNA, 64 nt, Homo Sapiens; identical to SEQ ID NO: 142793

SEQ ID NO: 590450 - RNA, 64 nt, Homo Sapiens; identical to SEQ ID NO: 142794

SEQ ID NO: 590451 - RNA, 64 nt, Homo Sapiens; identical to SEQ ID NO: 142795

SEQ ID NO: 590452 - RNA, 64 nt, Homo Sapiens; identical to SEQ ID NO: 142796

SEQ ID NO: 590453 - RNA, 64 nt, Homo Sapiens; identical to SEQ ID NO: 142797

SEQ ID NO: 590454 - RNA, 64 nt, Homo Sapiens; identical to SEQ ID NO: 142798

SEQ ID NO: 590455 - RNA, 64 nt, Homo Sapiens; identical to SEQ ID NO: 142799

SEQ ID NO: 590456 - RNA, 64 nt, Homo Sapiens; identical to SEQ ID NO: 142800

SEQ ID NO: 590457 - RNA, 64 nt, Homo Sapiens; identical to SEQ ID NO: 142801

SEQ ID NO: 590458 - RNA, 64 nt, Homo Sapiens; identical to SEQ ID NO: 142802

SEQ ID NO: 590459 - RNA, 64 nt, Homo Sapiens; identical to SEQ ID NO: 142803

SEQ ID NO: 590460 - RNA, 64 nt, Homo Sapiens; identical to SEQ ID NO: 142804

SEQ ID NO: 590461 - RNA, 64 nt, Homo Sapiens; identical to SEQ ID NO: 142805

SEQ ID NO: 590462 - RNA, 64 nt, Homo Sapiens; identical to SEQ ID NO: 142806

SEQ ID NO: 590463 - RNA, 64 nt, Homo Sapiens; identical to SEQ ID NO: 142807

SEQ ID NO: 590464 - RNA, 64 nt, Homo Sapiens; identical to SEQ ID NO: 142808

SEQ ID NO: 590465 - RNA, 64 nt, Homo Sapiens; identical to SEQ ID NO: 142809

SEQ ID NO: 590466 - RNA, 64 nt, Homo Sapiens; identical to SEQ ID NO: 142810

SEQ ID NO: 590467 - RNA, 64 nt, Homo Sapiens; identical to SEQ ID NO: 142811

SEQ ID NO: 590468 - RNA, 64 nt, Homo Sapiens; identical to SEQ ID NO: 142812

SEQ ID NO: 590469 - RNA, 64 nt, Homo Sapiens; identical to SEQ ID NO: 142813

SEQ ID NO: 590470 - RNA, 64 nt, Homo Sapiens; identical to SEQ ID NO: 142814

SEQ ID NO: 590471 - RNA, 64 nt, Homo Sapiens; identical to SEQ ID NO: 142815

SEQ ID NO: 590472 - RNA, 64 nt, Homo Sapiens; identical to SEQ ID NO: 142816

SEQ ID NO: 590473 - RNA, 64 nt, Homo Sapiens; identical to SEQ ID NO: 142817

SEQ ID NO: 590474 - RNA, 64 nt, Homo Sapiens; identical to SEQ ID NO: 142818

SEQ ID NO: 590475 - RNA, 64 nt, Homo Sapiens; identical to SEQ ID NO: 142819

SEQ ID NO: 590476 - RNA, 64 nt, Homo Sapiens; identical to SEQ ID NO: 142820

SEQ ID NO: 590477 - RNA, 64 nt, Homo Sapiens; identical to SEQ ID NO: 142821

SEQ ID NO: 590478 - RNA, 64 nt, Homo Sapiens; identical to SEQ ID NO: 142822

SEQ ID NO: 590479 - RNA, 64 nt, Homo Sapiens; identical to SEQ ID NO: 142823

SEQ ID NO: 590480 - RNA, 64 nt, Homo Sapiens; identical to SEQ ID NO: 142824

SEQ ID NO: 590481 - RNA, 64 nt, Homo Sapiens; identical to SEQ ID NO: 142825

SEQ ID NO: 590482 - RNA, 64 nt, Homo Sapiens; identical to SEQ ID NO: 142826

SEQ ID NO: 590483 - RNA, 64 nt, Homo Sapiens; identical to SEQ ID NO: 142827

SEQ ID NO: 590484 - RNA, 64 nt, Homo Sapiens; identical to SEQ ID NO: 142828

SEQ ID NO: 590485 - RNA, 64 nt, Homo Sapiens; identical to SEQ ID NO: 142829

SEQ ID NO: 590486 - RNA, 64 nt, Homo Sapiens; identical to SEQ ID NO: 142830

SEQ ID NO: 590487 - RNA, 64 nt, Homo Sapiens; identical to SEQ ID NO: 142831

SEQ ID NO: 590488 - RNA, 64 nt, Homo Sapiens; identical to SEQ ID NO: 142832

SEQ ID NO: 590489 - RNA, 64 nt, Homo Sapiens; identical to SEQ ID NO: 142833

SEQ ID NO: 590490 - RNA, 64 nt, Homo Sapiens; identical to SEQ ID NO: 142834

SEQ ID NO: 590491 - RNA, 64 nt, Homo Sapiens; identical to SEQ ID NO: 142835

SEQ ID NO: 590492 - RNA, 64 nt, Homo Sapiens; identical to SEQ ID NO: 142836

SEQ ID NO: 590493 - RNA, 64 nt, Homo Sapiens; identical to SEQ ID NO: 142837

SEQ ID NO: 590494 - RNA, 64 nt, Homo Sapiens; identical to SEQ ID NO: 142838

SEQ ID NO: 590495 - RNA, 64 nt, Homo Sapiens; identical to SEQ ID NO: 142839

SEQ ID NO: 590496 - RNA, 64 nt, Homo Sapiens; identical to SEQ ID NO: 142840

SEQ ID NO: 590497 - RNA, 64 nt, Homo Sapiens; identical to SEQ ID NO: 142841

SEQ ID NO: 590498 - RNA, 64 nt, Homo Sapiens; identical to SEQ ID NO: 142842

SEQ ID NO: 590499 - RNA, 64 nt, Homo Sapiens; identical to SEQ ID NO: 142843

SEQ ID NO: 590500 - RNA, 64 nt, Homo Sapiens; identical to SEQ ID NO: 142844

SEQ ID NO: 590501 - RNA, 64 nt, Homo Sapiens; identical to SEQ ID NO: 142845

SEQ ID NO: 590502 - RNA, 64 nt, Homo Sapiens; identical to SEQ ID NO: 142846

SEQ ID NO: 590503 - RNA, 64 nt, Homo Sapiens; identical to SEQ ID NO: 142847

SEQ ID NO: 590504 - RNA, 64 nt, Homo Sapiens; identical to SEQ ID NO: 142848

SEQ ID NO: 590505 - RNA, 64 nt, Homo Sapiens; identical to SEQ ID NO: 142849

SEQ ID NO: 590506 - RNA, 64 nt, Homo Sapiens; identical to SEQ ID NO: 142850

SEQ ID NO: 590507 - RNA, 64 nt, Homo Sapiens; identical to SEQ ID NO: 142851

SEQ ID NO: 590508 - RNA, 64 nt, Homo Sapiens; identical to SEQ ID NO: 142852

SEQ ID NO: 590509 - RNA, 64 nt, Homo Sapiens; identical to SEQ ID NO: 142853

SEQ ID NO: 590510 - RNA, 64 nt, Homo Sapiens; identical to SEQ ID NO: 142854

SEQ ID NO: 590511 - RNA, 64 nt, Homo Sapiens; identical to SEQ ID NO: 142855

SEQ ID NO: 590512 - RNA, 64 nt, Homo Sapiens; identical to SEQ ID NO: 142856

SEQ ID NO: 590513 - RNA, 64 nt, Homo Sapiens; identical to SEQ ID NO: 142857

SEQ ID NO: 590514 - RNA, 64 nt, Homo Sapiens; identical to SEQ ID NO: 142858

SEQ ID NO: 590515 - RNA, 64 nt, Homo Sapiens; identical to SEQ ID NO: 142859

SEQ ID NO: 590516 - RNA, 64 nt, Homo Sapiens; identical to SEQ ID NO: 142860

SEQ ID NO: 590517 - RNA, 64 nt, Homo Sapiens; identical to SEQ ID NO: 142861

SEQ ID NO: 590518 - RNA, 64 nt, Homo Sapiens; identical to SEQ ID NO: 142862

SEQ ID NO: 590519 - RNA, 64 nt, Homo Sapiens; identical to SEQ ID NO: 142863

SEQ ID NO: 590520 - RNA, 64 nt, Homo Sapiens; identical to SEQ ID NO: 142864

SEQ ID NO: 590521 - RNA, 64 nt, Homo Sapiens; identical to SEQ ID NO: 142865

SEQ ID NO: 590522 - RNA, 64 nt, Homo Sapiens; identical to SEQ ID NO: 142866

SEQ ID NO: 590523 - RNA, 64 nt, Homo Sapiens; identical to SEQ ID NO: 142867

SEQ ID NO: 590524 - RNA, 64 nt, Homo Sapiens; identical to SEQ ID NO: 142868

SEQ ID NO: 590525 - RNA, 64 nt, Homo Sapiens; identical to SEQ ID NO: 142869

SEQ ID NO: 590526 - RNA, 64 nt, Homo Sapiens; identical to SEQ ID NO: 142870

SEQ ID NO: 590527 - RNA, 64 nt, Homo Sapiens; identical to SEQ ID NO: 142871

SEQ ID NO: 590528 - RNA, 64 nt, Homo Sapiens; identical to SEQ ID NO: 142872

SEQ ID NO: 590529 - RNA, 64 nt, Homo Sapiens; identical to SEQ ID NO: 142873

SEQ ID NO: 590530 - RNA, 64 nt, Homo Sapiens; identical to SEQ ID NO: 142874

SEQ ID NO: 590531 - RNA, 64 nt, Homo Sapiens; identical to SEQ ID NO: 142875

SEQ ID NO: 590532 - RNA, 64 nt, Homo Sapiens; identical to SEQ ID NO: 142876

SEQ ID NO: 590533 - RNA, 64 nt, Homo Sapiens; identical to SEQ ID NO: 142877

SEQ ID NO: 590534 - RNA, 64 nt, Homo Sapiens; identical to SEQ ID NO: 142878

SEQ ID NO: 590535 - RNA, 64 nt, Homo Sapiens; identical to SEQ ID NO: 142879

SEQ ID NO: 590536 - RNA, 64 nt, Homo Sapiens; identical to SEQ ID NO: 142880

SEQ ID NO: 590537 - RNA, 64 nt, Homo Sapiens; identical to SEQ ID NO: 142881

SEQ ID NO: 590538 - RNA, 64 nt, Homo Sapiens; identical to SEQ ID NO: 142882

SEQ ID NO: 590539 - RNA, 64 nt, Homo Sapiens; identical to SEQ ID NO: 142883

SEQ ID NO: 590540 - RNA, 64 nt, Homo Sapiens; identical to SEQ ID NO: 142884

SEQ ID NO: 590541 - RNA, 64 nt, Homo Sapiens; identical to SEQ ID NO: 142885

SEQ ID NO: 590542 - RNA, 64 nt, Homo Sapiens; identical to SEQ ID NO: 142886

SEQ ID NO: 590543 - RNA, 64 nt, Homo Sapiens; identical to SEQ ID NO: 142887

SEQ ID NO: 590544 - RNA, 64 nt, Homo Sapiens; identical to SEQ ID NO: 142888

SEQ ID NO: 590545 - RNA, 64 nt, Homo Sapiens; identical to SEQ ID NO: 142889

SEQ ID NO: 590546 - RNA, 64 nt, Homo Sapiens; identical to SEQ ID NO: 142890

SEQ ID NO: 590547 - RNA, 64 nt, Homo Sapiens; identical to SEQ ID NO: 142891

SEQ ID NO: 590548 - RNA, 64 nt, Homo Sapiens; identical to SEQ ID NO: 142892

SEQ ID NO: 590549 - RNA, 64 nt, Homo Sapiens; identical to SEQ ID NO: 142893

SEQ ID NO: 590550 - RNA, 64 nt, Homo Sapiens; identical to SEQ ID NO: 142894

SEQ ID NO: 590551 - RNA, 64 nt, Homo Sapiens; identical to SEQ ID NO: 142895

SEQ ID NO: 590552 - RNA, 64 nt, Homo Sapiens; identical to SEQ ID NO: 142896

SEQ ID NO: 590553 - RNA, 64 nt, Homo Sapiens; identical to SEQ ID NO: 142897

SEQ ID NO: 590554 - RNA, 64 nt, Homo Sapiens; identical to SEQ ID NO: 142898

SEQ ID NO: 590555 - RNA, 64 nt, Homo Sapiens; identical to SEQ ID NO: 142899

SEQ ID NO: 590556 - RNA, 64 nt, Homo Sapiens; identical to SEQ ID NO: 142900

SEQ ID NO: 590557 - RNA, 64 nt, Homo Sapiens; identical to SEQ ID NO: 142901

SEQ ID NO: 590558 - RNA, 64 nt, Homo Sapiens; identical to SEQ ID NO: 142902

SEQ ID NO: 590559 - RNA, 64 nt, Homo Sapiens; identical to SEQ ID NO: 142903

SEQ ID NO: 590560 - RNA, 64 nt, Homo Sapiens; identical to SEQ ID NO: 142904

SEQ ID NO: 590561 - RNA, 64 nt, Homo Sapiens; identical to SEQ ID NO: 142905

SEQ ID NO: 590562 - RNA, 64 nt, Homo Sapiens; identical to SEQ ID NO: 142906

SEQ ID NO: 590563 - RNA, 64 nt, Homo Sapiens; identical to SEQ ID NO: 142907

SEQ ID NO: 590564 - RNA, 64 nt, Homo Sapiens; identical to SEQ ID NO: 142908

SEQ ID NO: 590565 - RNA, 64 nt, Homo Sapiens; identical to SEQ ID NO: 142909

SEQ ID NO: 590566 - RNA, 64 nt, Homo Sapiens; identical to SEQ ID NO: 142910

SEQ ID NO: 590567 - RNA, 64 nt, Homo Sapiens; identical to SEQ ID NO: 142911

SEQ ID NO: 590568 - RNA, 64 nt, Homo Sapiens; identical to SEQ ID NO: 142912

SEQ ID NO: 590569 - RNA, 64 nt, Homo Sapiens; identical to SEQ ID NO: 142913

SEQ ID NO: 590570 - RNA, 64 nt, Homo Sapiens; identical to SEQ ID NO: 142914

SEQ ID NO: 590571 - RNA, 64 nt, Homo Sapiens; identical to SEQ ID NO: 142915

SEQ ID NO: 590572 - RNA, 64 nt, Homo Sapiens; identical to SEQ ID NO: 142916

SEQ ID NO: 590573 - RNA, 64 nt, Homo Sapiens; identical to SEQ ID NO: 142917

SEQ ID NO: 590574 - RNA, 64 nt, Homo Sapiens; identical to SEQ ID NO: 142918

SEQ ID NO: 590575 - RNA, 64 nt, Homo Sapiens; identical to SEQ ID NO: 142919

SEQ ID NO: 590576 - RNA, 64 nt, Homo Sapiens; identical to SEQ ID NO: 142920

SEQ ID NO: 590577 - RNA, 64 nt, Homo Sapiens; identical to SEQ ID NO: 142921

SEQ ID NO: 590578 - RNA, 64 nt, Homo Sapiens; identical to SEQ ID NO: 142922

SEQ ID NO: 590579 - RNA, 64 nt, Homo Sapiens; identical to SEQ ID NO: 142923

SEQ ID NO: 590580 - RNA, 64 nt, Homo Sapiens; identical to SEQ ID NO: 142924

SEQ ID NO: 590581 - RNA, 64 nt, Homo Sapiens; identical to SEQ ID NO: 142925

SEQ ID NO: 590582 - RNA, 64 nt, Homo Sapiens; identical to SEQ ID NO: 142926

SEQ ID NO: 590583 - RNA, 64 nt, Homo Sapiens; identical to SEQ ID NO: 142927

SEQ ID NO: 590584 - RNA, 64 nt, Homo Sapiens; identical to SEQ ID NO: 142928

SEQ ID NO: 590585 - RNA, 64 nt, Homo Sapiens; identical to SEQ ID NO: 142929

SEQ ID NO: 590586 - RNA, 64 nt, Homo Sapiens; identical to SEQ ID NO: 142930

SEQ ID NO: 590587 - RNA, 64 nt, Homo Sapiens; identical to SEQ ID NO: 142931

SEQ ID NO: 590588 - RNA, 64 nt, Homo Sapiens; identical to SEQ ID NO: 142932

SEQ ID NO: 590589 - RNA, 64 nt, Homo Sapiens; identical to SEQ ID NO: 142933

SEQ ID NO: 590590 - RNA, 64 nt, Homo Sapiens; identical to SEQ ID NO: 142934

SEQ ID NO: 590591 - RNA, 64 nt, Homo Sapiens; identical to SEQ ID NO: 142935

SEQ ID NO: 590592 - RNA, 64 nt, Homo Sapiens; identical to SEQ ID NO: 142936

SEQ ID NO: 590593 - RNA, 64 nt, Homo Sapiens; identical to SEQ ID NO: 142937

SEQ ID NO: 590594 - RNA, 64 nt, Homo Sapiens; identical to SEQ ID NO: 142938

SEQ ID NO: 590595 - RNA, 64 nt, Homo Sapiens; identical to SEQ ID NO: 142939

SEQ ID NO: 590596 - RNA, 64 nt, Homo Sapiens; identical to SEQ ID NO: 142940

SEQ ID NO: 590597 - RNA, 64 nt, Homo Sapiens; identical to SEQ ID NO: 142941

SEQ ID NO: 590598 - RNA, 64 nt, Homo Sapiens; identical to SEQ ID NO: 142942

SEQ ID NO: 590599 - RNA, 64 nt, Homo Sapiens; identical to SEQ ID NO: 142943

SEQ ID NO: 590600 - RNA, 64 nt, Homo Sapiens; identical to SEQ ID NO: 142944

SEQ ID NO: 590601 - RNA, 64 nt, Homo Sapiens; identical to SEQ ID NO: 142945

SEQ ID NO: 590602 - RNA, 64 nt, Homo Sapiens; identical to SEQ ID NO: 142946

SEQ ID NO: 590603 - RNA, 64 nt, Homo Sapiens; identical to SEQ ID NO: 142947

SEQ ID NO: 590604 - RNA, 64 nt, Homo Sapiens; identical to SEQ ID NO: 142948

SEQ ID NO: 590605 - RNA, 64 nt, Homo Sapiens; identical to SEQ ID NO: 142949

SEQ ID NO: 590606 - RNA, 64 nt, Homo Sapiens; identical to SEQ ID NO: 142950

SEQ ID NO: 590607 - RNA, 64 nt, Homo Sapiens; identical to SEQ ID NO: 142951

SEQ ID NO: 590608 - RNA, 64 nt, Homo Sapiens; identical to SEQ ID NO: 142952

SEQ ID NO: 590609 - RNA, 64 nt, Homo Sapiens; identical to SEQ ID NO: 142953

SEQ ID NO: 590610 - RNA, 64 nt, Homo Sapiens; identical to SEQ ID NO: 142954

SEQ ID NO: 590611 - RNA, 64 nt, Homo Sapiens; identical to SEQ ID NO: 142955

SEQ ID NO: 590612 - RNA, 64 nt, Homo Sapiens; identical to SEQ ID NO: 142956

SEQ ID NO: 590613 - RNA, 64 nt, Homo Sapiens; identical to SEQ ID NO: 142957

SEQ ID NO: 590614 - RNA, 64 nt, Homo Sapiens; identical to SEQ ID NO: 142958

SEQ ID NO: 590615 - RNA, 64 nt, Homo Sapiens; identical to SEQ ID NO: 142959

SEQ ID NO: 590616 - RNA, 64 nt, Homo Sapiens; identical to SEQ ID NO: 142960

SEQ ID NO: 590617 - RNA, 64 nt, Homo Sapiens; identical to SEQ ID NO: 142961

SEQ ID NO: 590618 - RNA, 64 nt, Homo Sapiens; identical to SEQ ID NO: 142962

SEQ ID NO: 590619 - RNA, 64 nt, Homo Sapiens; identical to SEQ ID NO: 142963

SEQ ID NO: 590620 - RNA, 64 nt, Homo Sapiens; identical to SEQ ID NO: 142964

SEQ ID NO: 590621 - RNA, 64 nt, Homo Sapiens; identical to SEQ ID NO: 142965

SEQ ID NO: 590622 - RNA, 64 nt, Homo Sapiens; identical to SEQ ID NO: 142966

SEQ ID NO: 590623 - RNA, 64 nt, Homo Sapiens; identical to SEQ ID NO: 142967

SEQ ID NO: 590624 - RNA, 64 nt, Homo Sapiens; identical to SEQ ID NO: 142968

SEQ ID NO: 590625 - RNA, 64 nt, Homo Sapiens; identical to SEQ ID NO: 142969

SEQ ID NO: 590626 - RNA, 64 nt, Homo Sapiens; identical to SEQ ID NO: 142970

SEQ ID NO: 590627 - RNA, 64 nt, Homo Sapiens; identical to SEQ ID NO: 142971

SEQ ID NO: 590628 - RNA, 64 nt, Homo Sapiens; identical to SEQ ID NO: 142972

SEQ ID NO: 590629 - RNA, 64 nt, Homo Sapiens; identical to SEQ ID NO: 142973

SEQ ID NO: 590630 - RNA, 64 nt, Homo Sapiens; identical to SEQ ID NO: 142974

SEQ ID NO: 590631 - RNA, 64 nt, Homo Sapiens; identical to SEQ ID NO: 142975

SEQ ID NO: 590632 - RNA, 64 nt, Homo Sapiens; identical to SEQ ID NO: 142976

SEQ ID NO: 590633 - RNA, 64 nt, Homo Sapiens; identical to SEQ ID NO: 142977

SEQ ID NO: 590634 - RNA, 64 nt, Homo Sapiens; identical to SEQ ID NO: 142978

SEQ ID NO: 590635 - RNA, 64 nt, Homo Sapiens; identical to SEQ ID NO: 142979

SEQ ID NO: 590636 - RNA, 64 nt, Homo Sapiens; identical to SEQ ID NO: 142980

SEQ ID NO: 590637 - RNA, 64 nt, Homo Sapiens; identical to SEQ ID NO: 142981

SEQ ID NO: 590638 - RNA, 64 nt, Homo Sapiens; identical to SEQ ID NO: 142982

SEQ ID NO: 590639 - RNA, 64 nt, Homo Sapiens; identical to SEQ ID NO: 142983

SEQ ID NO: 590640 - RNA, 64 nt, Homo Sapiens; identical to SEQ ID NO: 142984

SEQ ID NO: 590641 - RNA, 64 nt, Homo Sapiens; identical to SEQ ID NO: 142985

SEQ ID NO: 590642 - RNA, 64 nt, Homo Sapiens; identical to SEQ ID NO: 142986

SEQ ID NO: 590643 - RNA, 64 nt, Homo Sapiens; identical to SEQ ID NO: 142987

SEQ ID NO: 590644 - RNA, 64 nt, Homo Sapiens; identical to SEQ ID NO: 142988

SEQ ID NO: 590645 - RNA, 64 nt, Homo Sapiens; identical to SEQ ID NO: 142989

SEQ ID NO: 590646 - RNA, 64 nt, Homo Sapiens; identical to SEQ ID NO: 142990

SEQ ID NO: 590647 - RNA, 64 nt, Homo Sapiens; identical to SEQ ID NO: 142991

SEQ ID NO: 590648 - RNA, 64 nt, Homo Sapiens; identical to SEQ ID NO: 142992

SEQ ID NO: 590649 - RNA, 64 nt, Homo Sapiens; identical to SEQ ID NO: 142993

SEQ ID NO: 590650 - RNA, 64 nt, Homo Sapiens; identical to SEQ ID NO: 142994

SEQ ID NO: 590651 - RNA, 64 nt, Homo Sapiens; identical to SEQ ID NO: 142995

SEQ ID NO: 590652 - RNA, 64 nt, Homo Sapiens; identical to SEQ ID NO: 142996

SEQ ID NO: 590653 - RNA, 64 nt, Homo Sapiens; identical to SEQ ID NO: 142997

SEQ ID NO: 590654 - RNA, 64 nt, Homo Sapiens; identical to SEQ ID NO: 142998

SEQ ID NO: 590655 - RNA, 64 nt, Homo Sapiens; identical to SEQ ID NO: 142999

SEQ ID NO: 590656 - RNA, 64 nt, Homo Sapiens; identical to SEQ ID NO: 143000

SEQ ID NO: 590657 - RNA, 64 nt, Homo Sapiens; identical to SEQ ID NO: 143001

SEQ ID NO: 590658 - RNA, 64 nt, Homo Sapiens; identical to SEQ ID NO: 143002

SEQ ID NO: 590659 - RNA, 64 nt, Homo Sapiens; identical to SEQ ID NO: 143003

SEQ ID NO: 590660 - RNA, 64 nt, Homo Sapiens; identical to SEQ ID NO: 143004

SEQ ID NO: 590661 - RNA, 64 nt, Homo Sapiens; identical to SEQ ID NO: 143005

SEQ ID NO: 590662 - RNA, 64 nt, Homo Sapiens; identical to SEQ ID NO: 143006

SEQ ID NO: 590663 - RNA, 64 nt, Homo Sapiens; identical to SEQ ID NO: 143007

SEQ ID NO: 590664 - RNA, 64 nt, Homo Sapiens; identical to SEQ ID NO: 143008

SEQ ID NO: 590665 - RNA, 64 nt, Homo Sapiens; identical to SEQ ID NO: 143009

SEQ ID NO: 590666 - RNA, 64 nt, Homo Sapiens; identical to SEQ ID NO: 143010

SEQ ID NO: 590667 - RNA, 64 nt, Homo Sapiens; identical to SEQ ID NO: 143011

SEQ ID NO: 590668 - RNA, 64 nt, Homo Sapiens; identical to SEQ ID NO: 143012

SEQ ID NO: 590669 - RNA, 64 nt, Homo Sapiens; identical to SEQ ID NO: 143013

SEQ ID NO: 590670 - RNA, 64 nt, Homo Sapiens; identical to SEQ ID NO: 143014

SEQ ID NO: 590671 - RNA, 64 nt, Homo Sapiens; identical to SEQ ID NO: 143015

SEQ ID NO: 590672 - RNA, 64 nt, Homo Sapiens; identical to SEQ ID NO: 143016

SEQ ID NO: 590673 - RNA, 64 nt, Homo Sapiens; identical to SEQ ID NO: 143017

SEQ ID NO: 590674 - RNA, 64 nt, Homo Sapiens; identical to SEQ ID NO: 143018

SEQ ID NO: 590675 - RNA, 64 nt, Homo Sapiens; identical to SEQ ID NO: 143019

SEQ ID NO: 590676 - RNA, 64 nt, Homo Sapiens; identical to SEQ ID NO: 143020

SEQ ID NO: 590677 - RNA, 64 nt, Homo Sapiens; identical to SEQ ID NO: 143021

SEQ ID NO: 590678 - RNA, 64 nt, Homo Sapiens; identical to SEQ ID NO: 143022

SEQ ID NO: 590679 - RNA, 64 nt, Homo Sapiens; identical to SEQ ID NO: 143023

SEQ ID NO: 590680 - RNA, 64 nt, Homo Sapiens; identical to SEQ ID NO: 143024

SEQ ID NO: 590681 - RNA, 64 nt, Homo Sapiens; identical to SEQ ID NO: 143025

SEQ ID NO: 590682 - RNA, 64 nt, Homo Sapiens; identical to SEQ ID NO: 143026

SEQ ID NO: 590683 - RNA, 64 nt, Homo Sapiens; identical to SEQ ID NO: 143027

SEQ ID NO: 590684 - RNA, 64 nt, Homo Sapiens; identical to SEQ ID NO: 143028

SEQ ID NO: 590685 - RNA, 64 nt, Homo Sapiens; identical to SEQ ID NO: 143029

SEQ ID NO: 590686 - RNA, 64 nt, Homo Sapiens; identical to SEQ ID NO: 143030

SEQ ID NO: 590687 - RNA, 64 nt, Homo Sapiens; identical to SEQ ID NO: 143031

SEQ ID NO: 590688 - RNA, 64 nt, Homo Sapiens; identical to SEQ ID NO: 143032

SEQ ID NO: 590689 - RNA, 64 nt, Homo Sapiens; identical to SEQ ID NO: 143033

SEQ ID NO: 590690 - RNA, 64 nt, Homo Sapiens; identical to SEQ ID NO: 143034

SEQ ID NO: 590691 - RNA, 64 nt, Homo Sapiens; identical to SEQ ID NO: 143035

SEQ ID NO: 590692 - RNA, 64 nt, Homo Sapiens; identical to SEQ ID NO: 143036

SEQ ID NO: 590693 - RNA, 64 nt, Homo Sapiens; identical to SEQ ID NO: 143037

SEQ ID NO: 590694 - RNA, 64 nt, Homo Sapiens; identical to SEQ ID NO: 143038

SEQ ID NO: 590695 - RNA, 64 nt, Homo Sapiens; identical to SEQ ID NO: 143039

SEQ ID NO: 590696 - RNA, 64 nt, Homo Sapiens; identical to SEQ ID NO: 143040

SEQ ID NO: 590697 - RNA, 64 nt, Homo Sapiens; identical to SEQ ID NO: 143041

SEQ ID NO: 590698 - RNA, 64 nt, Homo Sapiens; identical to SEQ ID NO: 143042

SEQ ID NO: 590699 - RNA, 64 nt, Homo Sapiens; identical to SEQ ID NO: 143043

SEQ ID NO: 590700 - RNA, 64 nt, Homo Sapiens; identical to SEQ ID NO: 143044

SEQ ID NO: 590701 - RNA, 64 nt, Homo Sapiens; identical to SEQ ID NO: 143045

SEQ ID NO: 590702 - RNA, 64 nt, Homo Sapiens; identical to SEQ ID NO: 143046

SEQ ID NO: 590703 - RNA, 64 nt, Homo Sapiens; identical to SEQ ID NO: 143047

SEQ ID NO: 590704 - RNA, 64 nt, Homo Sapiens; identical to SEQ ID NO: 143048

SEQ ID NO: 590705 - RNA, 64 nt, Homo Sapiens; identical to SEQ ID NO: 143049

SEQ ID NO: 590706 - RNA, 64 nt, Homo Sapiens; identical to SEQ ID NO: 143050

SEQ ID NO: 590707 - RNA, 64 nt, Homo Sapiens; identical to SEQ ID NO: 143051

SEQ ID NO: 590708 - RNA, 64 nt, Homo Sapiens; identical to SEQ ID NO: 143052

SEQ ID NO: 590709 - RNA, 64 nt, Homo Sapiens; identical to SEQ ID NO: 143053

SEQ ID NO: 590710 - RNA, 64 nt, Homo Sapiens; identical to SEQ ID NO: 143054

SEQ ID NO: 590711 - RNA, 64 nt, Homo Sapiens; identical to SEQ ID NO: 143055

SEQ ID NO: 590712 - RNA, 64 nt, Homo Sapiens; identical to SEQ ID NO: 143056

SEQ ID NO: 590713 - RNA, 64 nt, Homo Sapiens; identical to SEQ ID NO: 143057

SEQ ID NO: 590714 - RNA, 64 nt, Homo Sapiens; identical to SEQ ID NO: 143058

SEQ ID NO: 590715 - RNA, 64 nt, Homo Sapiens; identical to SEQ ID NO: 143059

SEQ ID NO: 590716 - RNA, 64 nt, Homo Sapiens; identical to SEQ ID NO: 143060

SEQ ID NO: 590717 - RNA, 64 nt, Homo Sapiens; identical to SEQ ID NO: 143061

SEQ ID NO: 590718 - RNA, 64 nt, Homo Sapiens; identical to SEQ ID NO: 143062

SEQ ID NO: 590719 - RNA, 64 nt, Homo Sapiens; identical to SEQ ID NO: 143063

SEQ ID NO: 590720 - RNA, 64 nt, Homo Sapiens; identical to SEQ ID NO: 143064

SEQ ID NO: 590721 - RNA, 64 nt, Homo Sapiens; identical to SEQ ID NO: 143065

SEQ ID NO: 590722 - RNA, 64 nt, Homo Sapiens; identical to SEQ ID NO: 143066

SEQ ID NO: 590723 - RNA, 64 nt, Homo Sapiens; identical to SEQ ID NO: 143067

SEQ ID NO: 590724 - RNA, 64 nt, Homo Sapiens; identical to SEQ ID NO: 143068

SEQ ID NO: 590725 - RNA, 64 nt, Homo Sapiens; identical to SEQ ID NO: 143069

SEQ ID NO: 590726 - RNA, 64 nt, Homo Sapiens; identical to SEQ ID NO: 143070

SEQ ID NO: 590727 - RNA, 64 nt, Homo Sapiens; identical to SEQ ID NO: 143071

SEQ ID NO: 590728 - RNA, 64 nt, Homo Sapiens; identical to SEQ ID NO: 143072

SEQ ID NO: 590729 - RNA, 64 nt, Homo Sapiens; identical to SEQ ID NO: 143073

SEQ ID NO: 590730 - RNA, 64 nt, Homo Sapiens; identical to SEQ ID NO: 143074

SEQ ID NO: 590731 - RNA, 64 nt, Homo Sapiens; identical to SEQ ID NO: 143075

SEQ ID NO: 590732 - RNA, 64 nt, Homo Sapiens; identical to SEQ ID NO: 143076

SEQ ID NO: 590733 - RNA, 64 nt, Homo Sapiens; identical to SEQ ID NO: 143077

SEQ ID NO: 590734 - RNA, 64 nt, Homo Sapiens; identical to SEQ ID NO: 143078

SEQ ID NO: 590735 - RNA, 64 nt, Homo Sapiens; identical to SEQ ID NO: 143079

SEQ ID NO: 590736 - RNA, 64 nt, Homo Sapiens; identical to SEQ ID NO: 143080

SEQ ID NO: 590737 - RNA, 64 nt, Homo Sapiens; identical to SEQ ID NO: 143081

SEQ ID NO: 590738 - RNA, 64 nt, Homo Sapiens; identical to SEQ ID NO: 143082

SEQ ID NO: 590739 - RNA, 64 nt, Homo Sapiens; identical to SEQ ID NO: 143083

SEQ ID NO: 590740 - RNA, 64 nt, Homo Sapiens; identical to SEQ ID NO: 143084

SEQ ID NO: 590741 - RNA, 64 nt, Homo Sapiens; identical to SEQ ID NO: 143085

SEQ ID NO: 590742 - RNA, 64 nt, Homo Sapiens; identical to SEQ ID NO: 143086

SEQ ID NO: 590743 - RNA, 64 nt, Homo Sapiens; identical to SEQ ID NO: 143087

SEQ ID NO: 590744 - RNA, 64 nt, Homo Sapiens; identical to SEQ ID NO: 143088

SEQ ID NO: 590745 - RNA, 64 nt, Homo Sapiens; identical to SEQ ID NO: 143089

SEQ ID NO: 590746 - RNA, 64 nt, Homo Sapiens; identical to SEQ ID NO: 143090

SEQ ID NO: 590747 - RNA, 64 nt, Homo Sapiens; identical to SEQ ID NO: 143091

SEQ ID NO: 590748 - RNA, 64 nt, Homo Sapiens; identical to SEQ ID NO: 143092

SEQ ID NO: 590749 - RNA, 64 nt, Homo Sapiens; identical to SEQ ID NO: 143093

SEQ ID NO: 590750 - RNA, 64 nt, Homo Sapiens; identical to SEQ ID NO: 143094

SEQ ID NO: 590751 - RNA, 64 nt, Homo Sapiens; identical to SEQ ID NO: 143095

SEQ ID NO: 590752 - RNA, 64 nt, Homo Sapiens; identical to SEQ ID NO: 143096

SEQ ID NO: 590753 - RNA, 64 nt, Homo Sapiens; identical to SEQ ID NO: 143097

SEQ ID NO: 590754 - RNA, 64 nt, Homo Sapiens; identical to SEQ ID NO: 143098

SEQ ID NO: 590755 - RNA, 64 nt, Homo Sapiens; identical to SEQ ID NO: 143099

SEQ ID NO: 590756 - RNA, 64 nt, Homo Sapiens; identical to SEQ ID NO: 143100

SEQ ID NO: 590757 - RNA, 64 nt, Homo Sapiens; identical to SEQ ID NO: 143101

SEQ ID NO: 590758 - RNA, 64 nt, Homo Sapiens; identical to SEQ ID NO: 143102

SEQ ID NO: 590759 - RNA, 64 nt, Homo Sapiens; identical to SEQ ID NO: 143103

SEQ ID NO: 590760 - RNA, 64 nt, Homo Sapiens; identical to SEQ ID NO: 143104

SEQ ID NO: 590761 - RNA, 64 nt, Homo Sapiens; identical to SEQ ID NO: 143105

SEQ ID NO: 590762 - RNA, 64 nt, Homo Sapiens; identical to SEQ ID NO: 143106

SEQ ID NO: 590763 - RNA, 64 nt, Homo Sapiens; identical to SEQ ID NO: 143107

SEQ ID NO: 590764 - RNA, 64 nt, Homo Sapiens; identical to SEQ ID NO: 143108

SEQ ID NO: 590765 - RNA, 64 nt, Homo Sapiens; identical to SEQ ID NO: 143109

SEQ ID NO: 590766 - RNA, 64 nt, Homo Sapiens; identical to SEQ ID NO: 143110

SEQ ID NO: 590767 - RNA, 64 nt, Homo Sapiens; identical to SEQ ID NO: 143111

SEQ ID NO: 590768 - RNA, 64 nt, Homo Sapiens; identical to SEQ ID NO: 143112

SEQ ID NO: 590769 - RNA, 64 nt, Homo Sapiens; identical to SEQ ID NO: 143113

SEQ ID NO: 590770 - RNA, 64 nt, Homo Sapiens; identical to SEQ ID NO: 143114

SEQ ID NO: 590771 - RNA, 64 nt, Homo Sapiens; identical to SEQ ID NO: 143115

SEQ ID NO: 590772 - RNA, 64 nt, Homo Sapiens; identical to SEQ ID NO: 143116

SEQ ID NO: 590773 - RNA, 64 nt, Homo Sapiens; identical to SEQ ID NO: 143117

SEQ ID NO: 590774 - RNA, 64 nt, Homo Sapiens; identical to SEQ ID NO: 143118

SEQ ID NO: 590775 - RNA, 64 nt, Homo Sapiens; identical to SEQ ID NO: 143119

SEQ ID NO: 590776 - RNA, 64 nt, Homo Sapiens; identical to SEQ ID NO: 143120

SEQ ID NO: 590777 - RNA, 64 nt, Homo Sapiens; identical to SEQ ID NO: 143121

SEQ ID NO: 590778 - RNA, 64 nt, Homo Sapiens; identical to SEQ ID NO: 143122

SEQ ID NO: 590779 - RNA, 64 nt, Homo Sapiens; identical to SEQ ID NO: 143123

SEQ ID NO: 590780 - RNA, 64 nt, Homo Sapiens; identical to SEQ ID NO: 143124

SEQ ID NO: 590781 - RNA, 64 nt, Homo Sapiens; identical to SEQ ID NO: 143125

SEQ ID NO: 590782 - RNA, 64 nt, Homo Sapiens; identical to SEQ ID NO: 143126

SEQ ID NO: 590783 - RNA, 64 nt, Homo Sapiens; identical to SEQ ID NO: 143127

SEQ ID NO: 590784 - RNA, 64 nt, Homo Sapiens; identical to SEQ ID NO: 143128

SEQ ID NO: 590785 - RNA, 64 nt, Homo Sapiens; identical to SEQ ID NO: 143129

SEQ ID NO: 590786 - RNA, 64 nt, Homo Sapiens; identical to SEQ ID NO: 143130

SEQ ID NO: 590787 - RNA, 64 nt, Homo Sapiens; identical to SEQ ID NO: 143131

SEQ ID NO: 590788 - RNA, 64 nt, Homo Sapiens; identical to SEQ ID NO: 143132

SEQ ID NO: 590789 - RNA, 64 nt, Homo Sapiens; identical to SEQ ID NO: 143133

SEQ ID NO: 590790 - RNA, 64 nt, Homo Sapiens; identical to SEQ ID NO: 143134

SEQ ID NO: 590791 - RNA, 64 nt, Homo Sapiens; identical to SEQ ID NO: 143135

SEQ ID NO: 590792 - RNA, 64 nt, Homo Sapiens; identical to SEQ ID NO: 143136

SEQ ID NO: 590793 - RNA, 64 nt, Homo Sapiens; identical to SEQ ID NO: 143137

SEQ ID NO: 590794 - RNA, 64 nt, Homo Sapiens; identical to SEQ ID NO: 143138

SEQ ID NO: 590795 - RNA, 64 nt, Homo Sapiens; identical to SEQ ID NO: 143139

SEQ ID NO: 590796 - RNA, 64 nt, Homo Sapiens; identical to SEQ ID NO: 143140

SEQ ID NO: 590797 - RNA, 64 nt, Homo Sapiens; identical to SEQ ID NO: 143141

SEQ ID NO: 590798 - RNA, 64 nt, Homo Sapiens; identical to SEQ ID NO: 143142

SEQ ID NO: 590799 - RNA, 64 nt, Homo Sapiens; identical to SEQ ID NO: 143143

SEQ ID NO: 590800 - RNA, 64 nt, Homo Sapiens; identical to SEQ ID NO: 143144

SEQ ID NO: 590801 - RNA, 64 nt, Homo Sapiens; identical to SEQ ID NO: 143145

SEQ ID NO: 590802 - RNA, 64 nt, Homo Sapiens; identical to SEQ ID NO: 143146

SEQ ID NO: 590803 - RNA, 64 nt, Homo Sapiens; identical to SEQ ID NO: 143147

SEQ ID NO: 590804 - RNA, 64 nt, Homo Sapiens; identical to SEQ ID NO: 143148

SEQ ID NO: 590805 - RNA, 64 nt, Homo Sapiens; identical to SEQ ID NO: 143149

SEQ ID NO: 590806 - RNA, 64 nt, Homo Sapiens; identical to SEQ ID NO: 143150

SEQ ID NO: 590807 - RNA, 64 nt, Homo Sapiens; identical to SEQ ID NO: 143151

SEQ ID NO: 590808 - RNA, 64 nt, Homo Sapiens; identical to SEQ ID NO: 143152

SEQ ID NO: 590809 - RNA, 64 nt, Homo Sapiens; identical to SEQ ID NO: 143153

SEQ ID NO: 590810 - RNA, 64 nt, Homo Sapiens; identical to SEQ ID NO: 143154

SEQ ID NO: 590811 - RNA, 64 nt, Homo Sapiens; identical to SEQ ID NO: 143155

SEQ ID NO: 590812 - RNA, 64 nt, Homo Sapiens; identical to SEQ ID NO: 143156

SEQ ID NO: 590813 - RNA, 64 nt, Homo Sapiens; identical to SEQ ID NO: 143157

SEQ ID NO: 590814 - RNA, 64 nt, Homo Sapiens; identical to SEQ ID NO: 143158

SEQ ID NO: 590815 - RNA, 64 nt, Homo Sapiens; identical to SEQ ID NO: 143159

SEQ ID NO: 590816 - RNA, 64 nt, Homo Sapiens; identical to SEQ ID NO: 143160

SEQ ID NO: 590817 - RNA, 64 nt, Homo Sapiens; identical to SEQ ID NO: 143161

SEQ ID NO: 590818 - RNA, 64 nt, Homo Sapiens; identical to SEQ ID NO: 143162

SEQ ID NO: 590819 - RNA, 64 nt, Homo Sapiens; identical to SEQ ID NO: 143163

SEQ ID NO: 590820 - RNA, 64 nt, Homo Sapiens; identical to SEQ ID NO: 143164

SEQ ID NO: 590821 - RNA, 64 nt, Homo Sapiens; identical to SEQ ID NO: 143165

SEQ ID NO: 590822 - RNA, 64 nt, Homo Sapiens; identical to SEQ ID NO: 143166

SEQ ID NO: 590823 - RNA, 64 nt, Homo Sapiens; identical to SEQ ID NO: 143167

SEQ ID NO: 590824 - RNA, 64 nt, Homo Sapiens; identical to SEQ ID NO: 143168

SEQ ID NO: 590825 - RNA, 64 nt, Homo Sapiens; identical to SEQ ID NO: 143169

SEQ ID NO: 590826 - RNA, 64 nt, Homo Sapiens; identical to SEQ ID NO: 143170

SEQ ID NO: 590827 - RNA, 64 nt, Homo Sapiens; identical to SEQ ID NO: 143171

SEQ ID NO: 590828 - RNA, 64 nt, Homo Sapiens; identical to SEQ ID NO: 143172

SEQ ID NO: 590829 - RNA, 64 nt, Homo Sapiens; identical to SEQ ID NO: 143173

SEQ ID NO: 590830 - RNA, 64 nt, Homo Sapiens; identical to SEQ ID NO: 143174

SEQ ID NO: 590831 - RNA, 64 nt, Homo Sapiens; identical to SEQ ID NO: 143175

SEQ ID NO: 590832 - RNA, 64 nt, Homo Sapiens; identical to SEQ ID NO: 143176

SEQ ID NO: 590833 - RNA, 64 nt, Homo Sapiens; identical to SEQ ID NO: 143177

SEQ ID NO: 590834 - RNA, 64 nt, Homo Sapiens; identical to SEQ ID NO: 143178

SEQ ID NO: 590835 - RNA, 64 nt, Homo Sapiens; identical to SEQ ID NO: 143179

SEQ ID NO: 590836 - RNA, 64 nt, Homo Sapiens; identical to SEQ ID NO: 143180

SEQ ID NO: 590837 - RNA, 64 nt, Homo Sapiens; identical to SEQ ID NO: 143181

SEQ ID NO: 590838 - RNA, 64 nt, Homo Sapiens; identical to SEQ ID NO: 143182

SEQ ID NO: 590839 - RNA, 64 nt, Homo Sapiens; identical to SEQ ID NO: 143183

SEQ ID NO: 590840 - RNA, 64 nt, Homo Sapiens; identical to SEQ ID NO: 143184

SEQ ID NO: 590841 - RNA, 64 nt, Homo Sapiens; identical to SEQ ID NO: 143185

SEQ ID NO: 590842 - RNA, 64 nt, Homo Sapiens; identical to SEQ ID NO: 143186

SEQ ID NO: 590843 - RNA, 64 nt, Homo Sapiens; identical to SEQ ID NO: 143187

SEQ ID NO: 590844 - RNA, 64 nt, Homo Sapiens; identical to SEQ ID NO: 143188

SEQ ID NO: 590845 - RNA, 64 nt, Homo Sapiens; identical to SEQ ID NO: 143189

SEQ ID NO: 590846 - RNA, 64 nt, Homo Sapiens; identical to SEQ ID NO: 143190

SEQ ID NO: 590847 - RNA, 64 nt, Homo Sapiens; identical to SEQ ID NO: 143191

SEQ ID NO: 590848 - RNA, 64 nt, Homo Sapiens; identical to SEQ ID NO: 143192

SEQ ID NO: 590849 - RNA, 64 nt, Homo Sapiens; identical to SEQ ID NO: 143193

SEQ ID NO: 590850 - RNA, 64 nt, Homo Sapiens; identical to SEQ ID NO: 143194

SEQ ID NO: 590851 - RNA, 64 nt, Homo Sapiens; identical to SEQ ID NO: 143195

SEQ ID NO: 590852 - RNA, 64 nt, Homo Sapiens; identical to SEQ ID NO: 143196

SEQ ID NO: 590853 - RNA, 64 nt, Homo Sapiens; identical to SEQ ID NO: 143197

SEQ ID NO: 590854 - RNA, 64 nt, Homo Sapiens; identical to SEQ ID NO: 143198

SEQ ID NO: 590855 - RNA, 64 nt, Homo Sapiens; identical to SEQ ID NO: 143199

SEQ ID NO: 590856 - RNA, 64 nt, Homo Sapiens; identical to SEQ ID NO: 143200

SEQ ID NO: 590857 - RNA, 64 nt, Homo Sapiens; identical to SEQ ID NO: 143201

SEQ ID NO: 590858 - RNA, 64 nt, Homo Sapiens; identical to SEQ ID NO: 143202

SEQ ID NO: 590859 - RNA, 64 nt, Homo Sapiens; identical to SEQ ID NO: 143203

SEQ ID NO: 590860 - RNA, 64 nt, Homo Sapiens; identical to SEQ ID NO: 143204

SEQ ID NO: 590861 - RNA, 64 nt, Homo Sapiens; identical to SEQ ID NO: 143205

SEQ ID NO: 590862 - RNA, 64 nt, Homo Sapiens; identical to SEQ ID NO: 143206

SEQ ID NO: 590863 - RNA, 64 nt, Homo Sapiens; identical to SEQ ID NO: 143207

SEQ ID NO: 590864 - RNA, 64 nt, Homo Sapiens; identical to SEQ ID NO: 143208

SEQ ID NO: 590865 - RNA, 64 nt, Homo Sapiens; identical to SEQ ID NO: 299359

SEQ ID NO: 590866 - RNA, 64 nt, Homo Sapiens; identical to SEQ ID NO: 299360

SEQ ID NO: 590867 - RNA, 64 nt, Homo Sapiens; identical to SEQ ID NO: 299361

SEQ ID NO: 590868 - RNA, 64 nt, Homo Sapiens; identical to SEQ ID NO: 299362

SEQ ID NO: 590869 - RNA, 64 nt, Homo Sapiens; identical to SEQ ID NO: 299363

SEQ ID NO: 590870 - RNA, 64 nt, Homo Sapiens; identical to SEQ ID NO: 299364

SEQ ID NO: 590871 - RNA, 64 nt, Homo Sapiens; identical to SEQ ID NO: 299365

SEQ ID NO: 590872 - RNA, 64 nt, Homo Sapiens; identical to SEQ ID NO: 299366

SEQ ID NO: 590873 - RNA, 64 nt, Homo Sapiens; identical to SEQ ID NO: 299367

SEQ ID NO: 590874 - RNA, 64 nt, Homo Sapiens; identical to SEQ ID NO: 299368

SEQ ID NO: 590875 - RNA, 64 nt, Homo Sapiens; identical to SEQ ID NO: 299369

SEQ ID NO: 590876 - RNA, 64 nt, Homo Sapiens; identical to SEQ ID NO: 299370

SEQ ID NO: 590877 - RNA, 64 nt, Homo Sapiens; identical to SEQ ID NO: 299371

SEQ ID NO: 590878 - RNA, 64 nt, Homo Sapiens; identical to SEQ ID NO: 299372

SEQ ID NO: 590879 - RNA, 64 nt, Homo Sapiens; identical to SEQ ID NO: 299373

SEQ ID NO: 590880 - RNA, 64 nt, Homo Sapiens; identical to SEQ ID NO: 299374

SEQ ID NO: 590881 - RNA, 64 nt, Homo Sapiens; identical to SEQ ID NO: 299375

SEQ ID NO: 590882 - RNA, 64 nt, Homo Sapiens; identical to SEQ ID NO: 299376

SEQ ID NO: 590883 - RNA, 64 nt, Homo Sapiens; identical to SEQ ID NO: 299377

SEQ ID NO: 590884 - RNA, 64 nt, Homo Sapiens; identical to SEQ ID NO: 299378

SEQ ID NO: 590885 - RNA, 64 nt, Homo Sapiens; identical to SEQ ID NO: 299379

SEQ ID NO: 590886 - RNA, 64 nt, Homo Sapiens; identical to SEQ ID NO: 299380

SEQ ID NO: 590887 - RNA, 64 nt, Homo Sapiens; identical to SEQ ID NO: 299381

SEQ ID NO: 590888 - RNA, 64 nt, Homo Sapiens; identical to SEQ ID NO: 299382

SEQ ID NO: 590889 - RNA, 64 nt, Homo Sapiens; identical to SEQ ID NO: 299383

SEQ ID NO: 590890 - RNA, 64 nt, Homo Sapiens; identical to SEQ ID NO: 299384

SEQ ID NO: 590891 - RNA, 64 nt, Homo Sapiens; identical to SEQ ID NO: 299385

SEQ ID NO: 590892 - RNA, 64 nt, Homo Sapiens; identical to SEQ ID NO: 299386

SEQ ID NO: 590893 - RNA, 64 nt, Homo Sapiens; identical to SEQ ID NO: 299387

SEQ ID NO: 590894 - RNA, 64 nt, Homo Sapiens; identical to SEQ ID NO: 299388

SEQ ID NO: 590895 - RNA, 64 nt, Homo Sapiens; identical to SEQ ID NO: 299389

SEQ ID NO: 590896 - RNA, 64 nt, Homo Sapiens; identical to SEQ ID NO: 299390

SEQ ID NO: 590897 - RNA, 64 nt, Homo Sapiens; identical to SEQ ID NO: 299391

SEQ ID NO: 590898 - RNA, 64 nt, Homo Sapiens; identical to SEQ ID NO: 299392

SEQ ID NO: 590899 - RNA, 64 nt, Homo Sapiens; identical to SEQ ID NO: 299393

SEQ ID NO: 590900 - RNA, 64 nt, Homo Sapiens; identical to SEQ ID NO: 299394

SEQ ID NO: 590901 - RNA, 64 nt, Homo Sapiens; identical to SEQ ID NO: 299395

SEQ ID NO: 590902 - RNA, 64 nt, Homo Sapiens; identical to SEQ ID NO: 299396

SEQ ID NO: 590903 - RNA, 64 nt, Homo Sapiens; identical to SEQ ID NO: 299397

SEQ ID NO: 590904 - RNA, 64 nt, Homo Sapiens; identical to SEQ ID NO: 299398

SEQ ID NO: 590905 - RNA, 64 nt, Homo Sapiens; identical to SEQ ID NO: 299399

SEQ ID NO: 590906 - RNA, 64 nt, Homo Sapiens; identical to SEQ ID NO: 299400

SEQ ID NO: 590907 - RNA, 64 nt, Homo Sapiens; identical to SEQ ID NO: 299401

SEQ ID NO: 590908 - RNA, 64 nt, Homo Sapiens; identical to SEQ ID NO: 299402

SEQ ID NO: 590909 - RNA, 64 nt, Homo Sapiens; identical to SEQ ID NO: 299403

SEQ ID NO: 590910 - RNA, 64 nt, Homo Sapiens; identical to SEQ ID NO: 299404

SEQ ID NO: 590911 - RNA, 64 nt, Homo Sapiens; identical to SEQ ID NO: 299405

SEQ ID NO: 590912 - RNA, 64 nt, Homo Sapiens; identical to SEQ ID NO: 299406

SEQ ID NO: 590913 - RNA, 64 nt, Homo Sapiens; identical to SEQ ID NO: 299407

SEQ ID NO: 590914 - RNA, 64 nt, Homo Sapiens; identical to SEQ ID NO: 299408

SEQ ID NO: 590915 - RNA, 64 nt, Homo Sapiens; identical to SEQ ID NO: 299409

SEQ ID NO: 590916 - RNA, 64 nt, Homo Sapiens; identical to SEQ ID NO: 299410

SEQ ID NO: 590917 - RNA, 64 nt, Homo Sapiens; identical to SEQ ID NO: 299411

SEQ ID NO: 590918 - RNA, 64 nt, Homo Sapiens; identical to SEQ ID NO: 299412

SEQ ID NO: 590919 - RNA, 64 nt, Homo Sapiens; identical to SEQ ID NO: 299413

SEQ ID NO: 590920 - RNA, 64 nt, Homo Sapiens; identical to SEQ ID NO: 299414

SEQ ID NO: 590921 - RNA, 64 nt, Homo Sapiens; identical to SEQ ID NO: 299415

SEQ ID NO: 590922 - RNA, 64 nt, Homo Sapiens; identical to SEQ ID NO: 299416

SEQ ID NO: 590923 - RNA, 64 nt, Homo Sapiens; identical to SEQ ID NO: 299417

SEQ ID NO: 590924 - RNA, 64 nt, Homo Sapiens; identical to SEQ ID NO: 299418

SEQ ID NO: 590925 - RNA, 64 nt, Homo Sapiens; identical to SEQ ID NO: 299419

SEQ ID NO: 590926 - RNA, 64 nt, Homo Sapiens; identical to SEQ ID NO: 299420

SEQ ID NO: 590927 - RNA, 64 nt, Homo Sapiens; identical to SEQ ID NO: 299421

SEQ ID NO: 590928 - RNA, 64 nt, Homo Sapiens; identical to SEQ ID NO: 299422

SEQ ID NO: 590929 - RNA, 64 nt, Homo Sapiens; identical to SEQ ID NO: 299423

SEQ ID NO: 590930 - RNA, 64 nt, Homo Sapiens; identical to SEQ ID NO: 299424

SEQ ID NO: 590931 - RNA, 64 nt, Homo Sapiens; identical to SEQ ID NO: 299425

SEQ ID NO: 590932 - RNA, 64 nt, Homo Sapiens; identical to SEQ ID NO: 299426

SEQ ID NO: 590933 - RNA, 64 nt, Homo Sapiens; identical to SEQ ID NO: 299427

SEQ ID NO: 590934 - RNA, 64 nt, Homo Sapiens; identical to SEQ ID NO: 511695

SEQ ID NO: 590935 - RNA, 64 nt, Homo Sapiens; identical to SEQ ID NO: 511696

SEQ ID NO: 590936 - RNA, 64 nt, Homo Sapiens; identical to SEQ ID NO: 511697

SEQ ID NO: 590937 - RNA, 64 nt, Homo Sapiens; identical to SEQ ID NO: 511698

SEQ ID NO: 590938 - RNA, 64 nt, Homo Sapiens; identical to SEQ ID NO: 511699

SEQ ID NO: 590939 - RNA, 64 nt, Homo Sapiens; identical to SEQ ID NO: 511700

SEQ ID NO: 590940 - RNA, 64 nt, Homo Sapiens; identical to SEQ ID NO: 511701

SEQ ID NO: 590941 - RNA, 64 nt, Homo Sapiens; identical to SEQ ID NO: 511702

SEQ ID NO: 590942 - RNA, 64 nt, Homo Sapiens; identical to SEQ ID NO: 511703

SEQ ID NO: 590943 - RNA, 64 nt, Homo Sapiens; identical to SEQ ID NO: 511704

SEQ ID NO: 590944 - RNA, 64 nt, Homo Sapiens; identical to SEQ ID NO: 511705

SEQ ID NO: 590945 - RNA, 64 nt, Homo Sapiens; identical to SEQ ID NO: 511706

SEQ ID NO: 590946 - RNA, 64 nt, Homo Sapiens; identical to SEQ ID NO: 511707

SEQ ID NO: 590947 - RNA, 64 nt, Homo Sapiens; identical to SEQ ID NO: 511708

SEQ ID NO: 590948 - RNA, 64 nt, Homo Sapiens; identical to SEQ ID NO: 511709

SEQ ID NO: 590949 - RNA, 64 nt, Homo Sapiens; identical to SEQ ID NO: 511710

SEQ ID NO: 590950 - RNA, 64 nt, Homo Sapiens; identical to SEQ ID NO: 511711

SEQ ID NO: 590951 - RNA, 64 nt, Homo Sapiens; identical to SEQ ID NO: 511712

SEQ ID NO: 590952 - RNA, 64 nt, Homo Sapiens; identical to SEQ ID NO: 511713

SEQ ID NO: 590953 - RNA, 64 nt, Homo Sapiens; identical to SEQ ID NO: 511714

SEQ ID NO: 590954 - RNA, 64 nt, Homo Sapiens; identical to SEQ ID NO: 511715

SEQ ID NO: 590955 - RNA, 64 nt, Homo Sapiens; identical to SEQ ID NO: 511716

SEQ ID NO: 590956 - RNA, 64 nt, Homo Sapiens; identical to SEQ ID NO: 483685

SEQ ID NO: 590957 - RNA, 64 nt, Homo Sapiens; identical to SEQ ID NO: 483686

SEQ ID NO: 590958 - RNA, 64 nt, Homo Sapiens; identical to SEQ ID NO: 483687

SEQ ID NO: 590959 - RNA, 64 nt, Homo Sapiens; identical to SEQ ID NO: 483688

SEQ ID NO: 590960 - RNA, 62 nt, Homo Sapiens
gcuggaucucauagaaaauucacagccagacaaucuucuaaucuggagucuuugagaucuuc

SEQ ID NO: 590961 - RNA, 62 nt, Homo Sapiens
gccagacaaucuucuaaucuggagucuuugagaucuucuaccccaacucaucauuuuccuau

SEQ ID NO: 590962 - RNA, 62 nt, Homo Sapiens
gauuuuuuuuauauuguguauaggagauaggcaucuucuaaacccaccauucacugacucau

SEQ ID NO: 590963 - RNA, 62 nt, Homo Sapiens
ggcuacuuaauuagacauuauaauaauuucugaucuucuaguuucauagcuguaguccauuc

SEQ ID NO: 590964 - RNA, 62 nt, Homo Sapiens
uugagaauuggcuauguuaaggagauucauaaaucuucuauauuuauaaaguggaaguauua

SEQ ID NO: 590965 - RNA, 62 nt, Homo Sapiens
uuuguauuuaaauggauuaagaucagagucugaucuucuaugaaaauauagaaauaauguca

SEQ ID NO: 590966 - RNA, 64 nt, Homo Sapiens; identical to SEQ ID NO: 226243

SEQ ID NO: 590967 - RNA, 64 nt, Homo Sapiens; identical to SEQ ID NO: 226244

SEQ ID NO: 590968 - RNA, 64 nt, Homo Sapiens; identical to SEQ ID NO: 226245

SEQ ID NO: 590969 - RNA, 64 nt, Homo Sapiens; identical to SEQ ID NO: 226246

SEQ ID NO: 590970 - RNA, 64 nt, Homo Sapiens; identical to SEQ ID NO: 226247

SEQ ID NO: 590971 - RNA, 64 nt, Homo Sapiens; identical to SEQ ID NO: 226248

SEQ ID NO: 590972 - RNA, 64 nt, Homo Sapiens; identical to SEQ ID NO: 226249

SEQ ID NO: 590973 - RNA, 64 nt, Homo Sapiens; identical to SEQ ID NO: 226250

SEQ ID NO: 590974 - RNA, 64 nt, Homo Sapiens; identical to SEQ ID NO: 226251

SEQ ID NO: 590975 - RNA, 64 nt, Homo Sapiens; identical to SEQ ID NO: 226252

SEQ ID NO: 590976 - RNA, 64 nt, Homo Sapiens; identical to SEQ ID NO: 226253

SEQ ID NO: 590977 - RNA, 64 nt, Homo Sapiens; identical to SEQ ID NO: 226254

SEQ ID NO: 590978 - RNA, 64 nt, Homo Sapiens; identical to SEQ ID NO: 226255

SEQ ID NO: 590979 - RNA, 64 nt, Homo Sapiens; identical to SEQ ID NO: 226256

SEQ ID NO: 590980 - RNA, 64 nt, Homo Sapiens; identical to SEQ ID NO: 226257

SEQ ID NO: 590981 - RNA, 64 nt, Homo Sapiens; identical to SEQ ID NO: 226258

SEQ ID NO: 590982 - RNA, 64 nt, Homo Sapiens; identical to SEQ ID NO: 226259

SEQ ID NO: 590983 - RNA, 64 nt, Homo Sapiens; identical to SEQ ID NO: 226260

SEQ ID NO: 590984 - RNA, 64 nt, Homo Sapiens; identical to SEQ ID NO: 226261

SEQ ID NO: 590985 - RNA, 64 nt, Homo Sapiens; identical to SEQ ID NO: 226262

SEQ ID NO: 590986 - RNA, 64 nt, Homo Sapiens; identical to SEQ ID NO: 226263

SEQ ID NO: 590987 - RNA, 64 nt, Homo Sapiens; identical to SEQ ID NO: 226264

SEQ ID NO: 590988 - RNA, 64 nt, Homo Sapiens; identical to SEQ ID NO: 246723

SEQ ID NO: 590989 - RNA, 64 nt, Homo Sapiens; identical to SEQ ID NO: 246724

SEQ ID NO: 590990 - RNA, 64 nt, Homo Sapiens; identical to SEQ ID NO: 246725

SEQ ID NO: 590991 - RNA, 64 nt, Homo Sapiens; identical to SEQ ID NO: 246726

SEQ ID NO: 590992 - RNA, 64 nt, Homo Sapiens; identical to SEQ ID NO: 246727

SEQ ID NO: 590993 - RNA, 64 nt, Homo Sapiens; identical to SEQ ID NO: 246728

SEQ ID NO: 590994 - RNA, 64 nt, Homo Sapiens; identical to SEQ ID NO: 246729

SEQ ID NO: 590995 - RNA, 64 nt, Homo Sapiens; identical to SEQ ID NO: 246730

SEQ ID NO: 590996 - RNA, 64 nt, Homo Sapiens; identical to SEQ ID NO: 246731

SEQ ID NO: 590997 - RNA, 64 nt, Homo Sapiens; identical to SEQ ID NO: 246732

SEQ ID NO: 590998 - RNA, 64 nt, Homo Sapiens; identical to SEQ ID NO: 246733

SEQ ID NO: 590999 - RNA, 64 nt, Homo Sapiens; identical to SEQ ID NO: 246734

SEQ ID NO: 591000 - RNA, 64 nt, Homo Sapiens; identical to SEQ ID NO: 246735

SEQ ID NO: 591001 - RNA, 64 nt, Homo Sapiens; identical to SEQ ID NO: 246736

SEQ ID NO: 591002 - RNA, 64 nt, Homo Sapiens; identical to SEQ ID NO: 246737

SEQ ID NO: 591003 - RNA, 64 nt, Homo Sapiens; identical to SEQ ID NO: 246738

SEQ ID NO: 591004 - RNA, 64 nt, Homo Sapiens; identical to SEQ ID NO: 246739

SEQ ID NO: 591005 - RNA, 64 nt, Homo Sapiens; identical to SEQ ID NO: 246740

SEQ ID NO: 591006 - RNA, 64 nt, Homo Sapiens; identical to SEQ ID NO: 246741

SEQ ID NO: 591007 - RNA, 64 nt, Homo Sapiens; identical to SEQ ID NO: 246742

SEQ ID NO: 591008 - RNA, 64 nt, Homo Sapiens; identical to SEQ ID NO: 246743

SEQ ID NO: 591009 - RNA, 64 nt, Homo Sapiens; identical to SEQ ID NO: 246744

SEQ ID NO: 591010 - RNA, 64 nt, Homo Sapiens; identical to SEQ ID NO: 246745

SEQ ID NO: 591011 - RNA, 64 nt, Homo Sapiens; identical to SEQ ID NO: 246746

SEQ ID NO: 591012 - RNA, 64 nt, Homo Sapiens; identical to SEQ ID NO: 246747

SEQ ID NO: 591013 - RNA, 64 nt, Homo Sapiens; identical to SEQ ID NO: 246748

SEQ ID NO: 591014 - RNA, 64 nt, Homo Sapiens; identical to SEQ ID NO: 246749

SEQ ID NO: 591015 - RNA, 64 nt, Homo Sapiens; identical to SEQ ID NO: 246750

SEQ ID NO: 591016 - RNA, 64 nt, Homo Sapiens; identical to SEQ ID NO: 246751

SEQ ID NO: 591017 - RNA, 64 nt, Homo Sapiens
aauauuugaguuauuuuuauuauuuuguacaaaaucaucauauucgguccuacuucaaaagaau

SEQ ID NO: 591018 - RNA, 64 nt, Homo Sapiens
gacaacugugagcauuccacaggguuuucaucauucaucauagucguuucugaguagcagcaau

SEQ ID NO: 591019 - RNA, 64 nt, Homo Sapiens
ugagcaugucuccucuuuucaguggguaacaguaucaucauauuccuuuauaguuacuaaguuu

SEQ ID NO: 591020 - RNA, 64 nt, Homo Sapiens
guugaagacaauuagugaaaguaauguuauaguaucaucauauucccuuuugcuaucugucccu

SEQ ID NO: 591021 - RNA, 64 nt, Homo Sapiens
cuucauacugcagagaaaucucacaccuugcaagucaucauagugcauaguuuuuaaucaacag

SEQ ID NO: 591022 - RNA, 64 nt, Homo Sapiens
auucauacugcagagaaacuacaacccuugcacgucaucauagagcaagguuuuuaaucaaaaa

SEQ ID NO: 591023 - RNA, 64 nt, Homo Sapiens; identical to SEQ ID NO: 290000

SEQ ID NO: 591024 - RNA, 64 nt, Homo Sapiens; identical to SEQ ID NO: 290001

SEQ ID NO: 591025 - RNA, 64 nt, Homo Sapiens; identical to SEQ ID NO: 290002

SEQ ID NO: 591026 - RNA, 64 nt, Homo Sapiens; identical to SEQ ID NO: 290003

SEQ ID NO: 591027 - RNA, 64 nt, Homo Sapiens; identical to SEQ ID NO: 290004

SEQ ID NO: 591028 - RNA, 64 nt, Homo Sapiens; identical to SEQ ID NO: 290005

SEQ ID NO: 591029 - RNA, 64 nt, Homo Sapiens; identical to SEQ ID NO: 290006

SEQ ID NO: 591030 - RNA, 64 nt, Homo Sapiens; identical to SEQ ID NO: 290007

SEQ ID NO: 591031 - RNA, 64 nt, Homo Sapiens; identical to SEQ ID NO: 290008

SEQ ID NO: 591032 - RNA, 64 nt, Homo Sapiens; identical to SEQ ID NO: 290009

SEQ ID NO: 591033 - RNA, 64 nt, Homo Sapiens; identical to SEQ ID NO: 290010

SEQ ID NO: 591034 - RNA, 64 nt, Homo Sapiens; identical to SEQ ID NO: 290011

SEQ ID NO: 591035 - RNA, 64 nt, Homo Sapiens; identical to SEQ ID NO: 290012

SEQ ID NO: 591036 - RNA, 64 nt, Homo Sapiens; identical to SEQ ID NO: 290013

SEQ ID NO: 591037 - RNA, 64 nt, Homo Sapiens; identical to SEQ ID NO: 290014

SEQ ID NO: 591038 - RNA, 64 nt, Homo Sapiens; identical to SEQ ID NO: 290015

SEQ ID NO: 591039 - RNA, 64 nt, Homo Sapiens; identical to SEQ ID NO: 290016

SEQ ID NO: 591040 - RNA, 64 nt, Homo Sapiens; identical to SEQ ID NO: 290017

SEQ ID NO: 591041 - RNA, 64 nt, Homo Sapiens; identical to SEQ ID NO: 290018

SEQ ID NO: 591042 - RNA, 64 nt, Homo Sapiens; identical to SEQ ID NO: 290019

SEQ ID NO: 591043 - RNA, 64 nt, Homo Sapiens; identical to SEQ ID NO: 290020

SEQ ID NO: 591044 - RNA, 64 nt, Homo Sapiens; identical to SEQ ID NO: 290021

SEQ ID NO: 591045 - RNA, 64 nt, Homo Sapiens; identical to SEQ ID NO: 290022

SEQ ID NO: 591046 - RNA, 64 nt, Homo Sapiens; identical to SEQ ID NO: 290023

SEQ ID NO: 591047 - RNA, 64 nt, Homo Sapiens; identical to SEQ ID NO: 290024

SEQ ID NO: 591048 - RNA, 64 nt, Homo Sapiens; identical to SEQ ID NO: 290025

SEQ ID NO: 591049 - RNA, 64 nt, Homo Sapiens; identical to SEQ ID NO: 290026

SEQ ID NO: 591050 - RNA, 64 nt, Homo Sapiens; identical to SEQ ID NO: 290027

SEQ ID NO: 591051 - RNA, 64 nt, Homo Sapiens; identical to SEQ ID NO: 290028

SEQ ID NO: 591052 - RNA, 64 nt, Homo Sapiens; identical to SEQ ID NO: 290029

SEQ ID NO: 591053 - RNA, 56 nt, Homo Sapiens; identical to SEQ ID NO: 290030

SEQ ID NO: 591054 - RNA, 64 nt, Homo Sapiens; identical to SEQ ID NO: 290031

SEQ ID NO: 591055 - RNA, 64 nt, Homo Sapiens; identical to SEQ ID NO: 290032

SEQ ID NO: 591056 - RNA, 64 nt, Homo Sapiens; identical to SEQ ID NO: 290033

SEQ ID NO: 591057 - RNA, 64 nt, Homo Sapiens; identical to SEQ ID NO: 290034

SEQ ID NO: 591058 - RNA, 64 nt, Homo Sapiens; identical to SEQ ID NO: 290035

SEQ ID NO: 591059 - RNA, 64 nt, Homo Sapiens; identical to SEQ ID NO: 290036

SEQ ID NO: 591060 - RNA, 64 nt, Homo Sapiens; identical to SEQ ID NO: 290037

SEQ ID NO: 591061 - RNA, 64 nt, Homo Sapiens; identical to SEQ ID NO: 290038

SEQ ID NO: 591062 - RNA, 64 nt, Homo Sapiens; identical to SEQ ID NO: 290039

SEQ ID NO: 591063 - RNA, 64 nt, Homo Sapiens; identical to SEQ ID NO: 290040

SEQ ID NO: 591064 - RNA, 64 nt, Homo Sapiens; identical to SEQ ID NO: 272928

SEQ ID NO: 591065 - RNA, 64 nt, Homo Sapiens; identical to SEQ ID NO: 272929

SEQ ID NO: 591066 - RNA, 64 nt, Homo Sapiens; identical to SEQ ID NO: 272930

SEQ ID NO: 591067 - RNA, 64 nt, Homo Sapiens; identical to SEQ ID NO: 272931

SEQ ID NO: 591068 - RNA, 62 nt, Homo Sapiens
accgaccccaagcucaucaccgacgacgccaccgcgcuuauggaggcccugccagcucccag

SEQ ID NO: 591069 - RNA, 62 nt, Homo Sapiens
gggcccucgcacccuugggugcucccggccgccgcgcuuaagaacauugccucuggguguca

SEQ ID NO: 591070 - RNA, 62 nt, Homo Sapiens
uucuuccccuuccucucucccccaccagggggcgcgcuuaaauuuccagacagagaccagaa

SEQ ID NO: 591071 - RNA, 62 nt, Homo Sapiens
accuggcuagaacacaaggucaacaguacagucgcgcuuacgggggagcugggguugcaggg

SEQ ID NO: 591072 - RNA, 64 nt, Homo Sapiens
uuuauuguggaaucuuugaaaggacaaggccucugugaaugaaucagucccagggaagcauuug

SEQ ID NO: 591073 - RNA, 64 nt, Homo Sapiens
uauuguaaaucuuugcuaaguaguguuuuccuuggugaaugaagucauuguugucuucaagugu

SEQ ID NO: 591074 - RNA, 64 nt, Homo Sapiens
gugcuguuuggaaguguaaugauuuuaucacauggugaaugacuacuaagaguaaugauuauau

SEQ ID NO: 591075 - RNA, 64 nt, Homo Sapiens
gaaugacuacuaagaguaaugauuauaucacauugugaaugacuacuugccacaguaaaaauac

SEQ ID NO: 591076 - RNA, 64 nt, Homo Sapiens
uauacagaguaauauucuguggcccuuugacuuugugaaugagcacaaugaaaugccgccuacu

SEQ ID NO: 591077 - RNA, 64 nt, Homo Sapiens
guuuuaggugauuuaaaaauauaccguguugguggugaaugacuauugaugacuguguuaagug

SEQ ID NO: 591078 - RNA, 64 nt, Homo Sapiens
auuauaguuacaaauuuuagguuggugaauccaagugaaugaaauaucagcauaacuauguggg

SEQ ID NO: 591079 - RNA, 64 nt, Homo Sapiens
uguauaaauuucucuuugcauauaauacauauuugugaaugagacauauucccaaaaaauucuu

SEQ ID NO: 591080 - RNA, 64 nt, Homo Sapiens
cgauucugaaguugccacaaaaaauaagacacuggugaaugagaguauaauuguuuuucuucua

SEQ ID NO: 591081 - RNA, 64 nt, Homo Sapiens
cgguauggaggauuugaggaacaguaaccaggaugugaaugauuuuguuacaucaguguucacu

SEQ ID NO: 591082 - RNA, 64 nt, Homo Sapiens
uguuguauauguaacucuaagagaccuuccuagagugaaugaagguagaaaacugaaaagggag

SEQ ID NO: 591083 - RNA, 64 nt, Homo Sapiens
cucuucucacaauccgagcugcucuuuguccucugugaaugaagguacuuuugcuuccauuuca

SEQ ID NO: 591084 - RNA, 61 nt, Homo Sapiens
ccugcugcucagagugcagggaggcccugggcccagucagcaguguacaccugcaagggcu

SEQ ID NO: 591085 - RNA, 61 nt, Homo Sapiens
ccugcugcacauggcacagggaaucccugggcccagucagcggccuacaccugccaaggcu

SEQ ID NO: 591086 - RNA, 61 nt, Homo Sapiens
uuuuggggggacagugccaaguccaucuuugcccagucaauucagugauugauagcaauuu

SEQ ID NO: 591087 - RNA, 61 nt, Homo Sapiens
ugagcuuaucuguuugaugcuguggcagggucccagucacugggcauauccuccuucuccu

SEQ ID NO: 591088 - RNA, 61 nt, Homo Sapiens
uuauaauuucugaacuguucugagaccuguucccagucacugauugcaauuucuuuuacac

SEQ ID NO: 591089 - RNA, 61 nt, Homo Sapiens
ugacaguccccaggcaugcccacaggccaggcccagucacagcugggcuuccacaggucag

SEQ ID NO: 591090 - RNA, 61 nt, Homo Sapiens
gguuccuucucagccgaaacagguccaguaucccagucauuucuucaaaugcugauagggg

SEQ ID NO: 591091 - RNA, 61 nt, Homo Sapiens
cccaggacaagagcaagaaggacaucaguugcccagucaugugauccccugccaucuugcc

SEQ ID NO: 591092 - RNA, 61 nt, Homo Sapiens
gggagcagaaagagcaaguggcagaggguaucccagucauacugcccaugaggcucaugaa

SEQ ID NO: 591093 - RNA, 61 nt, Homo Sapiens
ucaacccaguccugcuucaguggggcacagccccagucagcgaaccaaagcgucaggggcu

SEQ ID NO: 591094 - RNA, 61 nt, Homo Sapiens
augaccccuaaagcuuccuuacuuccccugccccagucacguuucuugaguccuugcacuc

SEQ ID NO: 591095 - RNA, 61 nt, Homo Sapiens
cucuuuuacacauguggguccccaguucagccccagucaccauucuggcagauaucaggcc

SEQ ID NO: 591096 - RNA, 64 nt, Homo Sapiens; identical to SEQ ID NO: 376674

SEQ ID NO: 591097 - RNA, 64 nt, Homo Sapiens; identical to SEQ ID NO: 376675

SEQ ID NO: 591098 - RNA, 64 nt, Homo Sapiens; identical to SEQ ID NO: 376676

SEQ ID NO: 591099 - RNA, 64 nt, Homo Sapiens; identical to SEQ ID NO: 376677

SEQ ID NO: 591100 - RNA, 64 nt, Homo Sapiens; identical to SEQ ID NO: 376678

SEQ ID NO: 591101 - RNA, 64 nt, Homo Sapiens; identical to SEQ ID NO: 376679

SEQ ID NO: 591102 - RNA, 64 nt, Homo Sapiens; identical to SEQ ID NO: 376680

SEQ ID NO: 591103 - RNA, 64 nt, Homo Sapiens; identical to SEQ ID NO: 376681

SEQ ID NO: 591104 - RNA, 64 nt, Homo Sapiens; identical to SEQ ID NO: 376682

SEQ ID NO: 591105 - RNA, 64 nt, Homo Sapiens; identical to SEQ ID NO: 376683

SEQ ID NO: 591106 - RNA, 64 nt, Homo Sapiens; identical to SEQ ID NO: 376684

SEQ ID NO: 591107 - RNA, 64 nt, Homo Sapiens; identical to SEQ ID NO: 376685

SEQ ID NO: 591108 - RNA, 64 nt, Homo Sapiens; identical to SEQ ID NO: 376686

SEQ ID NO: 591109 - RNA, 64 nt, Homo Sapiens; identical to SEQ ID NO: 376687

SEQ ID NO: 591110 - RNA, 64 nt, Homo Sapiens; identical to SEQ ID NO: 376688

SEQ ID NO: 591111 - RNA, 64 nt, Homo Sapiens; identical to SEQ ID NO: 376689

SEQ ID NO: 591112 - RNA, 64 nt, Homo Sapiens; identical to SEQ ID NO: 376690

SEQ ID NO: 591113 - RNA, 64 nt, Homo Sapiens; identical to SEQ ID NO: 376691

SEQ ID NO: 591114 - RNA, 64 nt, Homo Sapiens; identical to SEQ ID NO: 376692

SEQ ID NO: 591115 - RNA, 64 nt, Homo Sapiens; identical to SEQ ID NO: 376693

SEQ ID NO: 591116 - RNA, 64 nt, Homo Sapiens; identical to SEQ ID NO: 376694

SEQ ID NO: 591117 - RNA, 64 nt, Homo Sapiens; identical to SEQ ID NO: 376695

SEQ ID NO: 591118 - RNA, 64 nt, Homo Sapiens; identical to SEQ ID NO: 376696

SEQ ID NO: 591119 - RNA, 64 nt, Homo Sapiens; identical to SEQ ID NO: 376697

SEQ ID NO: 591120 - RNA, 64 nt, Homo Sapiens; identical to SEQ ID NO: 376698

SEQ ID NO: 591121 - RNA, 64 nt, Homo Sapiens; identical to SEQ ID NO: 376699

SEQ ID NO: 591122 - RNA, 64 nt, Homo Sapiens; identical to SEQ ID NO: 376700

SEQ ID NO: 591123 - RNA, 64 nt, Homo Sapiens; identical to SEQ ID NO: 376701

SEQ ID NO: 591124 - RNA, 64 nt, Homo Sapiens; identical to SEQ ID NO: 376702

SEQ ID NO: 591125 - RNA, 64 nt, Homo Sapiens; identical to SEQ ID NO: 376703

SEQ ID NO: 591126 - RNA, 64 nt, Homo Sapiens; identical to SEQ ID NO: 376704

SEQ ID NO: 591127 - RNA, 64 nt, Homo Sapiens; identical to SEQ ID NO: 376705

SEQ ID NO: 591128 - RNA, 64 nt, Homo Sapiens; identical to SEQ ID NO: 376706

SEQ ID NO: 591129 - RNA, 64 nt, Homo Sapiens; identical to SEQ ID NO: 376707

SEQ ID NO: 591130 - RNA, 64 nt, Homo Sapiens; identical to SEQ ID NO: 376708

SEQ ID NO: 591131 - RNA, 64 nt, Homo Sapiens; identical to SEQ ID NO: 376709

SEQ ID NO: 591132 - RNA, 64 nt, Homo Sapiens; identical to SEQ ID NO: 376710

SEQ ID NO: 591133 - RNA, 64 nt, Homo Sapiens; identical to SEQ ID NO: 376711

SEQ ID NO: 591134 - RNA, 64 nt, Homo Sapiens; identical to SEQ ID NO: 376712

SEQ ID NO: 591135 - RNA, 64 nt, Homo Sapiens; identical to SEQ ID NO: 376713

SEQ ID NO: 591136 - RNA, 64 nt, Homo Sapiens; identical to SEQ ID NO: 376714

SEQ ID NO: 591137 - RNA, 64 nt, Homo Sapiens; identical to SEQ ID NO: 376715

SEQ ID NO: 591138 - RNA, 64 nt, Homo Sapiens; identical to SEQ ID NO: 376716

SEQ ID NO: 591139 - RNA, 64 nt, Homo Sapiens; identical to SEQ ID NO: 376717

SEQ ID NO: 591140 - RNA, 64 nt, Homo Sapiens; identical to SEQ ID NO: 376718

SEQ ID NO: 591141 - RNA, 64 nt, Homo Sapiens; identical to SEQ ID NO: 376719

SEQ ID NO: 591142 - RNA, 64 nt, Homo Sapiens; identical to SEQ ID NO: 376720

SEQ ID NO: 591143 - RNA, 64 nt, Homo Sapiens; identical to SEQ ID NO: 376721

SEQ ID NO: 591144 - RNA, 64 nt, Homo Sapiens; identical to SEQ ID NO: 376722

SEQ ID NO: 591145 - RNA, 64 nt, Homo Sapiens; identical to SEQ ID NO: 376723

SEQ ID NO: 591146 - RNA, 64 nt, Homo Sapiens; identical to SEQ ID NO: 376724

SEQ ID NO: 591147 - RNA, 64 nt, Homo Sapiens; identical to SEQ ID NO: 376725

SEQ ID NO: 591148 - RNA, 64 nt, Homo Sapiens; identical to SEQ ID NO: 376726

SEQ ID NO: 591149 - RNA, 64 nt, Homo Sapiens; identical to SEQ ID NO: 376727

SEQ ID NO: 591150 - RNA, 64 nt, Homo Sapiens; identical to SEQ ID NO: 376728

SEQ ID NO: 591151 - RNA, 64 nt, Homo Sapiens; identical to SEQ ID NO: 376729

SEQ ID NO: 591152 - RNA, 64 nt, Homo Sapiens; identical to SEQ ID NO: 376730

SEQ ID NO: 591153 - RNA, 64 nt, Homo Sapiens; identical to SEQ ID NO: 376731

SEQ ID NO: 591154 - RNA, 62 nt, Homo Sapiens; identical to SEQ ID NO: 376732

SEQ ID NO: 591155 - RNA, 64 nt, Homo Sapiens; identical to SEQ ID NO: 376733

SEQ ID NO: 591156 - RNA, 64 nt, Homo Sapiens; identical to SEQ ID NO: 376734

SEQ ID NO: 591157 - RNA, 55 nt, Homo Sapiens; identical to SEQ ID NO: 376735

SEQ ID NO: 591158 - RNA, 64 nt, Homo Sapiens; identical to SEQ ID NO: 376736

SEQ ID NO: 591159 - RNA, 64 nt, Homo Sapiens; identical to SEQ ID NO: 376737

SEQ ID NO: 591160 - RNA, 64 nt, Homo Sapiens; identical to SEQ ID NO: 376738

SEQ ID NO: 591161 - RNA, 64 nt, Homo Sapiens; identical to SEQ ID NO: 376739

SEQ ID NO: 591162 - RNA, 64 nt, Homo Sapiens; identical to SEQ ID NO: 376740

SEQ ID NO: 591163 - RNA, 64 nt, Homo Sapiens; identical to SEQ ID NO: 376741

SEQ ID NO: 591164 - RNA, 64 nt, Homo Sapiens; identical to SEQ ID NO: 376742

SEQ ID NO: 591165 - RNA, 64 nt, Homo Sapiens; identical to SEQ ID NO: 376743

SEQ ID NO: 591166 - RNA, 64 nt, Homo Sapiens; identical to SEQ ID NO: 376744

SEQ ID NO: 591167 - RNA, 64 nt, Homo Sapiens; identical to SEQ ID NO: 376745

SEQ ID NO: 591168 - RNA, 64 nt, Homo Sapiens; identical to SEQ ID NO: 376746

SEQ ID NO: 591169 - RNA, 64 nt, Homo Sapiens; identical to SEQ ID NO: 376747

SEQ ID NO: 591170 - RNA, 64 nt, Homo Sapiens; identical to SEQ ID NO: 376748

SEQ ID NO: 591171 - RNA, 64 nt, Homo Sapiens; identical to SEQ ID NO: 376749

SEQ ID NO: 591172 - RNA, 64 nt, Homo Sapiens; identical to SEQ ID NO: 376750

SEQ ID NO: 591173 - RNA, 64 nt, Homo Sapiens; identical to SEQ ID NO: 376751

SEQ ID NO: 591174 - RNA, 64 nt, Homo Sapiens; identical to SEQ ID NO: 376752

SEQ ID NO: 591175 - RNA, 64 nt, Homo Sapiens; identical to SEQ ID NO: 376753

SEQ ID NO: 591176 - RNA, 64 nt, Homo Sapiens; identical to SEQ ID NO: 376754

SEQ ID NO: 591177 - RNA, 64 nt, Homo Sapiens; identical to SEQ ID NO: 376755

SEQ ID NO: 591178 - RNA, 64 nt, Homo Sapiens; identical to SEQ ID NO: 376756

SEQ ID NO: 591179 - RNA, 64 nt, Homo Sapiens; identical to SEQ ID NO: 376757

SEQ ID NO: 591180 - RNA, 64 nt, Homo Sapiens; identical to SEQ ID NO: 376758

SEQ ID NO: 591181 - RNA, 64 nt, Homo Sapiens; identical to SEQ ID NO: 376759

SEQ ID NO: 591182 - RNA, 64 nt, Homo Sapiens; identical to SEQ ID NO: 376760

SEQ ID NO: 591183 - RNA, 64 nt, Homo Sapiens; identical to SEQ ID NO: 376761

SEQ ID NO: 591184 - RNA, 64 nt, Homo Sapiens; identical to SEQ ID NO: 376762

SEQ ID NO: 591185 - RNA, 64 nt, Homo Sapiens; identical to SEQ ID NO: 376763

SEQ ID NO: 591186 - RNA, 64 nt, Homo Sapiens; identical to SEQ ID NO: 376764

SEQ ID NO: 591187 - RNA, 64 nt, Homo Sapiens; identical to SEQ ID NO: 376765

SEQ ID NO: 591188 - RNA, 64 nt, Homo Sapiens; identical to SEQ ID NO: 376766

SEQ ID NO: 591189 - RNA, 64 nt, Homo Sapiens; identical to SEQ ID NO: 376767

SEQ ID NO: 591190 - RNA, 64 nt, Homo Sapiens; identical to SEQ ID NO: 376768

SEQ ID NO: 591191 - RNA, 64 nt, Homo Sapiens; identical to SEQ ID NO: 376769

SEQ ID NO: 591192 - RNA, 64 nt, Homo Sapiens; identical to SEQ ID NO: 376770

SEQ ID NO: 591193 - RNA, 64 nt, Homo Sapiens; identical to SEQ ID NO: 376771

SEQ ID NO: 591194 - RNA, 64 nt, Homo Sapiens; identical to SEQ ID NO: 376772

SEQ ID NO: 591195 - RNA, 64 nt, Homo Sapiens; identical to SEQ ID NO: 376773

SEQ ID NO: 591196 - RNA, 64 nt, Homo Sapiens; identical to SEQ ID NO: 376774

SEQ ID NO: 591197 - RNA, 64 nt, Homo Sapiens; identical to SEQ ID NO: 376775

SEQ ID NO: 591198 - RNA, 64 nt, Homo Sapiens; identical to SEQ ID NO: 376776

SEQ ID NO: 591199 - RNA, 64 nt, Homo Sapiens; identical to SEQ ID NO: 376777

SEQ ID NO: 591200 - RNA, 64 nt, Homo Sapiens; identical to SEQ ID NO: 376778

SEQ ID NO: 591201 - RNA, 64 nt, Homo Sapiens; identical to SEQ ID NO: 376779

SEQ ID NO: 591202 - RNA, 64 nt, Homo Sapiens; identical to SEQ ID NO: 376780

SEQ ID NO: 591203 - RNA, 64 nt, Homo Sapiens; identical to SEQ ID NO: 376781

SEQ ID NO: 591204 - RNA, 64 nt, Homo Sapiens; identical to SEQ ID NO: 376782

SEQ ID NO: 591205 - RNA, 64 nt, Homo Sapiens; identical to SEQ ID NO: 376783

SEQ ID NO: 591206 - RNA, 64 nt, Homo Sapiens; identical to SEQ ID NO: 376784

SEQ ID NO: 591207 - RNA, 64 nt, Homo Sapiens; identical to SEQ ID NO: 376785

SEQ ID NO: 591208 - RNA, 64 nt, Homo Sapiens
augaggcaagggaaggaaaaucacauggggacaggggauggagcgaagccguggggcagccucu

SEQ ID NO: 591209 - RNA, 64 nt, Homo Sapiens
gacagcuaagagggcggcugagcuggaggagauggggauggacugugcuguuggagcauggagg

SEQ ID NO: 591210 - RNA, 64 nt, Homo Sapiens
ggauggugcauuuccagugccucuggaaaguguggggauggagaguguccucauccuugcuuua

SEQ ID NO: 591211 - RNA, 64 nt, Homo Sapiens
gaacagucacuguucuauagccgcugucauuugggggauggaauagccucugacacguggcuca

SEQ ID NO: 591212 - RNA, 64 nt, Homo Sapiens
gggaagaccaccuggcaugagggagaggggcugagggauggacuucagccccucugcucuguac

SEQ ID NO: 591213 - RNA, 64 nt, Homo Sapiens
gcugggcagagcagaggggcagcgauagacucuggggauggagcaggacggggacgggaggggc

SEQ ID NO: 591214 - RNA, 64 nt, Homo Sapiens
gcuucggccaagcguuuuaguguucucaggauuggggauggacggaaagagaaacagacaacuc

SEQ ID NO: 591215 - RNA, 64 nt, Homo Sapiens
gaggguggagggcgcgucagaggagcugugccccgggauggaguuuuuccuaagcaccagcgga

SEQ ID NO: 591216 - RNA, 64 nt, Homo Sapiens
accacucuguccagaucugguaggaucuguccaugggauggagaccuacgugaagaccuccugg

SEQ ID NO: 591217 - RNA, 64 nt, Homo Sapiens
caaaccagcucgucucagagguccaaaggcuucagggauggaaaaucaagaccucauccagcuc

SEQ ID NO: 591218 - RNA, 64 nt, Homo Sapiens
gugaccugucuucauuuugcccaguuucucuucagggauggauaagaggcagaccugggaugcc

SEQ ID NO: 591219 - RNA, 64 nt, Homo Sapiens
ucccuacugaccucugagaauuuuuaaaauauuugggauggaaccauugaaaaaauauauuuag

SEQ ID NO: 591220 - RNA, 64 nt, Homo Sapiens
ccuuuuccuugcaggagauggcgucuaccagaaggggauggacuucauuuuggagaagcucaac

SEQ ID NO: 591221 - RNA, 64 nt, Homo Sapiens
ucuggauucuuggcccgcacagagcuggggcugagggauggacugaugcuuuuagcucaaacgu

SEQ ID NO: 591222 - RNA, 64 nt, Homo Sapiens
acugcucucauaauugaagacguguuuguuauuggcagagaaccuuaaaaaaggccuuuaccuc

SEQ ID NO: 591223 - RNA, 64 nt, Homo Sapiens
cuuuaccucagcgaugcuuccuagccccaggcuugcagagaacacagagugguguuguggucua

SEQ ID NO: 591224 - RNA, 64 nt, Homo Sapiens
acagggagaaaaaacuuguaaacuacagcaaaaggcagagaauugugagacucaauaauaacug

SEQ ID NO: 591225 - RNA, 64 nt, Homo Sapiens
auggcauucccuauuccacaagugugggggaccugcagagaaccuugcugacuuaaccccccau

SEQ ID NO: 591226 - RNA, 64 nt, Homo Sapiens
uaaugccccaguugucccccacuccuaaugccaggcagagaaggacagccuuuauagacuuaau

SEQ ID NO: 591227 - RNA, 64 nt, Homo Sapiens
cuggaccuaagucuaguguauccauacaauuggugcagagaaauaagguguaaauggugcuuug

SEQ ID NO: 591228 - RNA, 64 nt, Homo Sapiens
cuaaauuuguucucaccaagcacugccugugcaugcagagaaaaucugugcauccucuuuuaua

SEQ ID NO: 591229 - RNA, 64 nt, Homo Sapiens
uuguugagugcaacuuucauagucccaaagauaggcagagaacaucuccagaaaugugugugug

SEQ ID NO: 591230 - RNA, 64 nt, Homo Sapiens
aaagggaaacuggcugagggcugagugugggagugcagagaaagaauucauguggaucugggga

SEQ ID NO: 591231 - RNA, 64 nt, Homo Sapiens
auugguuuguuggccucaaguauccaagaagcaugcagagaagagaaccauuacaacaccuaua

SEQ ID NO: 591232 - RNA, 64 nt, Homo Sapiens
ggccuggaacucgggcagcaugguggggacagcugcagagaagaagggcuccuucuggagcauu

SEQ ID NO: 591233 - RNA, 64 nt, Homo Sapiens
aggacagaggccaggcacugggcugcaaggaugagcagagaacaccagggagggggccugcauu

SEQ ID NO: 591234 - RNA, 64 nt, Homo Sapiens
cugugcagcuuaucaacgaccgcuguguggacaugcagagaagcaggcacgguagccacuggga

SEQ ID NO: 591235 - RNA, 64 nt, Homo Sapiens
cuuaucaacgaccgcuguguggacaugcagagaagcagagaagaagaaaggagcugaggaggag

SEQ ID NO: 591236 - RNA, 64 nt, Homo Sapiens
gaagggaacuggagcuggccagggcagggcuggggcagagaaagcuggacaccgccaugagcac

SEQ ID NO: 591237 - RNA, 64 nt, Homo Sapiens
gcucauugggucacuggugacacacagacccgaggcagagaacauggcccaggagccauggccu

SEQ ID NO: 591238 - RNA, 64 nt, Homo Sapiens
cacuugcauccuaugcagccacccacggugagaagcagagaagguuaaggaggaaauuagugcc

SEQ ID NO: 591239 - RNA, 64 nt, Homo Sapiens
aaaagagcagcaacagcagacuuuguuuuggggugcagagaaagauuugucaagaugguuagcu

SEQ ID NO: 591240 - RNA, 64 nt, Homo Sapiens
gucagagcugaaaguuccuuacaaagaagaugaggcagagaauuuucccacuccuuaagcaagc

SEQ ID NO: 591241 - RNA, 64 nt, Homo Sapiens
acagggccaaggguccagaggagagcuggacagagcagagaacucuguagaucccuaggccccu

SEQ ID NO: 591242 - RNA, 64 nt, Homo Sapiens
aaagucuggacccacuccauuucuacggcuggcagcagagaaacagaucugacagcccagaccu

SEQ ID NO: 591243 - RNA, 50 nt, Homo Sapiens
uaaaaguacgacauagaaaugcagagaaaguuguuuuuuccuucuuuuga

SEQ ID NO: 591244 - RNA, 64 nt, Homo Sapiens
ucagaacccacagugagaggggagggcuccuggggcagagaaguuccuuagguuuucuuuggaa

SEQ ID NO: 591245 - RNA, 64 nt, Homo Sapiens
uaucuuauauugggcgauuugggggcucggggaggcagagaaucucuugggagucuuggguggc

SEQ ID NO: 591246 - RNA, 64 nt, Homo Sapiens
cgugagcagugugucuccugcaugcagaaagggagcagagaaggccaggggcuuuugcuaaaaa

SEQ ID NO: 591247 - RNA, 64 nt, Homo Sapiens
accucagcauuaucuauauaguaccuuugcucuugcagagaagccuugguacuaggcaguuaga

SEQ ID NO: 591248 - RNA, 64 nt, Homo Sapiens
agagaggcagagagggagagaaggaaagagacaggcagagaaggagagagggaaagaggcagag

SEQ ID NO: 591249 - RNA, 64 nt, Homo Sapiens
aaagagacaggcagagaaggagagagggaaagaggcagagaaggagacagaggggaagagaggc

SEQ ID NO: 591250 - RNA, 64 nt, Homo Sapiens
cuuacaaaugugaagacuguauagucuucauacugcagagaaaugucacaccuugcaagucauc

SEQ ID NO: 591251 - RNA, 64 nt, Homo Sapiens
uuuacaaauaggaagaauguauagaauucauacugcagagaaacaacaacccuugcacgucauc

SEQ ID NO: 591252 - RNA, 64 nt, Homo Sapiens
ugggacaccuguaauguaacccacacagcgguuugcagagaauguuagccaugacuugggcuuu

SEQ ID NO: 591253 - RNA, 64 nt, Homo Sapiens
caacuuucuuagcucaagagagaggcugagaaaugcagagaagaauaagacauaaaauagcucc

SEQ ID NO: 591254 - RNA, 64 nt, Homo Sapiens
uccagcugcguggucuccgcagaccaggcucugugugggcuagaggaaugucgcccauuacucc

SEQ ID NO: 591255 - RNA, 64 nt, Homo Sapiens
ccagggcccucagggaggggacccugcggcuagagugggcuaggcccuggcuuugcccgucaga

SEQ ID NO: 591256 - RNA, 64 nt, Homo Sapiens
uaaggaacaagauggaagagaaguggacugggaguauuuuuauggccugcuuuuuaccucagag

SEQ ID NO: 591257 - RNA, 64 nt, Homo Sapiens
acaggcaugugccaccacgcccggcuaauguuuguauuuuuaguagagacgggguuucaccaug

SEQ ID NO: 591258 - RNA, 64 nt, Homo Sapiens
aggagugaaggaggcaggugggaaaugguauuucuauuuuuaaauccagugaaauuaucuugag

SEQ ID NO: 591259 - RNA, 64 nt, Homo Sapiens
uuaaauccagugaaauuaucuugagucuacacauuauuuuuaaaacacaaaaauuguucggcug

SEQ ID NO: 591260 - RNA, 64 nt, Homo Sapiens
gccuuaaaauauucauaguuaauacagguauaucuauuuuuauuuacuuuguaagaaacaagcu

SEQ ID NO: 591261 - RNA, 64 nt, Homo Sapiens
uauaugaauugccauaauggaaauaaucugauuuuauuuuuacaacuaacauccauuccccuuc

SEQ ID NO: 591262 - RNA, 64 nt, Homo Sapiens
uuauaaauagucaagguuugggccacacaaaguauauuuuuaucauggaaaaauuucaacuccu

SEQ ID NO: 591263 - RNA, 64 nt, Homo Sapiens
ucuaaaaugagaaaaaagagagaaaacaaaauguuauuuuuauaccauaacuugaguguauugc

SEQ ID NO: 591264 - RNA, 64 nt, Homo Sapiens
aaaaggcaguuuuggaaacuacauugggggacguuauuuuuauuuauauauggggccuaggcca

SEQ ID NO: 591265 - RNA, 64 nt, Homo Sapiens
guacaggcgucugccaccaugccuaauuuuuuucuauuuuuaggagagaccgguuuucaccacg

SEQ ID NO: 591266 - RNA, 64 nt, Homo Sapiens
gugacccacugcgcacagccccagcuaauuuucauauuuuuaguagagacaggguuuugccaug

SEQ ID NO: 591267 - RNA, 64 nt, Homo Sapiens
auauaucuuauaaauguuugauucccuuccuugcuauuuuuauucaguagauuuuuguuuggca

SEQ ID NO: 591268 - RNA, 64 nt, Homo Sapiens
gaguuuuuugaaagaccccaauuuaagccuugcuuauuuuuaaauuauuuccauucagugaugu

SEQ ID NO: 591269 - RNA, 64 nt, Homo Sapiens
uaaaagaaauaugaucagagcuugaacacaggcuuauuuuuaaaauaaaaauauuuuuaacaug

SEQ ID NO: 591270 - RNA, 64 nt, Homo Sapiens
gagcuugaacacaggcuuauuuuuaaaauaaaaauauuuuuaacauggguuuccuuauugaaaa

SEQ ID NO: 591271 - RNA, 64 nt, Homo Sapiens
gugcuuaaauauaucaugcugaccagaauccuguuauuuuuauaugcaucauaaaauuucccau

SEQ ID NO: 591272 - RNA, 64 nt, Homo Sapiens
uauccaucugcauagccuuguaaaagugccauuuuauuuuuagugcuaaauucuuguuaaauaa

SEQ ID NO: 591273 - RNA, 64 nt, Homo Sapiens
cauuuuaaugaucaauuuaccugcauauaaaauuuauuuuuaaucaagcugaucuuaauguaua

SEQ ID NO: 591274 - RNA, 64 nt, Homo Sapiens
caauuucugaccaaucaaguacacuaaauuagaauauuuuuaaaguauguaacauucccaguuu

SEQ ID NO: 591275 - RNA, 64 nt, Homo Sapiens
caguuuuaauguugaauuugguauuuugaaggguuauuuuuaauguauuuugguaauacauuua

SEQ ID NO: 591276 - RNA, 64 nt, Homo Sapiens
gaugcugcuaaguaguucucuguauuaaaggagauauuuuuaaaacaggguacaacccccugcu

SEQ ID NO: 591277 - RNA, 64 nt, Homo Sapiens
auucagaaucaaauagaguuuuugagcauuugacuauuuuuagaaucauaaaauuaguuacuaa

SEQ ID NO: 591278 - RNA, 64 nt, Homo Sapiens
guaauagacucuaagcaauugccaagauguauucuauuuuuaugaaguguauauauauuaccuu

SEQ ID NO: 591279 - RNA, 64 nt, Homo Sapiens
gaacuuccugauacaaauguagggauauauacuguauuuuuaaacauuucucaccaacuuucuu

SEQ ID NO: 591280 - RNA, 64 nt, Homo Sapiens
acugacuagauuuauucauaccaugagacaacacuauuuuuauuuauauaugcauauauauaca

SEQ ID NO: 591281 - RNA, 64 nt, Homo Sapiens
aggcaccugccaacacgcccggcuaauuuuuuuguauuuuuaguagagacgggguuucaccaug

SEQ ID NO: 591282 - RNA, 62 nt, Homo Sapiens
uaaaaaauguaucaaaauaauaaacguguucugauauuuuuaaaauaagugaccuuguguuc

SEQ ID NO: 591283 - RNA, 64 nt, Homo Sapiens
acuuaaaacucuuagaauauucucuuauuauuuauauuuuuauauuucuugaaagaugguaagu

SEQ ID NO: 591284 - RNA, 64 nt, Homo Sapiens
acaggcgcccgucaccacacccagguaauuuuuguauuuuuaguagagacggaguuuugccaug

SEQ ID NO: 591285 - RNA, 64 nt, Homo Sapiens
agaaguaaguaaaaguaggaauaguuuccauggauauuuuuauuuuuauuaacuuuuuucaguu

SEQ ID NO: 591286 - RNA, 64 nt, Homo Sapiens
aaguaaaaguaggaauaguuuccauggauauuuuuauuuuuauuaacuuuuuucaguuucuuuu

SEQ ID NO: 591287 - RNA, 64 nt, Homo Sapiens
ggaauauaguaaaauaaguaaauuucuuuuggaauauuuuuaguaacaaauagccacuauaauu

SEQ ID NO: 591288 - RNA, 64 nt, Homo Sapiens
cccaaauggaaaauuucugaaaugcuggauuaucuauuuuuaaacaagcaguugacuuaaaacu

SEQ ID NO: 591289 - RNA, 64 nt, Homo Sapiens
acugguguuaugaagaacguaaaugcacuguuuuuauuuuuauuuuauauaauuuaaauugacu

SEQ ID NO: 591290 - RNA, 64 nt, Homo Sapiens
ucugugugaggauacauaaucuuucaguaaacuguauuuuuaacuuuuccauaagcugauuuug

SEQ ID NO: 591291 - RNA, 64 nt, Homo Sapiens
uuaguacaaagccuuggauacaguuugcuuguaauauuuuuaauaaugugaggaguacaguguu

SEQ ID NO: 591292 - RNA, 64 nt, Homo Sapiens
auuuuuuuaauuuuguggguacauaguaggaguguauuuuuauggguuacaugagauauucuga

SEQ ID NO: 591293 - RNA, 64 nt, Homo Sapiens
auacuguuaguuauuuuaaaaugugcaauuaaauuauuuuuaacuauauucacccuguugugcu

SEQ ID NO: 591294 - RNA, 64 nt, Homo Sapiens
agaauaaagucuauuuuuuuuacugaauggaauguauuuuuaaggcuucccagcucagaacaua

SEQ ID NO: 591295 - RNA, 64 nt, Homo Sapiens
uguccucagcauugcagaaauucuagauagauuuuauuuuuaagguuucuuuaaucugcacacu

SEQ ID NO: 591296 - RNA, 64 nt, Homo Sapiens
gaaaaaagguacaauugaauuaaauaaagagcucuauuuuuaaaugguauuacccuaaacuguu

SEQ ID NO: 591297 - RNA, 64 nt, Homo Sapiens
agagacgggguuucaccaugggcuaauuuuuuuguauuuuuaguaggcacccgccaccacaccu

SEQ ID NO: 591298 - RNA, 64 nt, Homo Sapiens
aacaacuuaauaaaaacuuauuuaagggaaaaguuauuuuuaaacgaaaucaacccuuccuaag

SEQ ID NO: 591299 - RNA, 64 nt, Homo Sapiens
agagacugguuucuccauguccuggcuaauuuuguauuuuuaguuacaggcaugugccacaacg

SEQ ID NO: 591300 - RNA, 64 nt, Homo Sapiens
gugagcuuucccauguuuuuaaauauuuugauaauauuuuuacaaagcaagauaucuuauguag

SEQ ID NO: 591301 - RNA, 64 nt, Homo Sapiens
gaaguuggugucuuacuuggcagugcaugaagcauauuuuuaaacaucuuaaaaaaauccagua

SEQ ID NO: 591302 - RNA, 64 nt, Homo Sapiens
agagaugggguuucgcuaugcuggcuaauuuuuguauuuuuaguacaggugcacgccaccacaa

SEQ ID NO: 591303 - RNA, 64 nt, Homo Sapiens
uuuucaugaaaauuauugguagguuuuuuuuuucuauuuuuauucuugucuguuugugucuggg

SEQ ID NO: 591304 - RNA, 64 nt, Homo Sapiens
agagaugggguuucaccauguggcuaauuuuuuguauuuuuaguuaugugcgcaccaccacgcc

SEQ ID NO: 591305 - RNA, 64 nt, Homo Sapiens
gacaaaguaaaaagacagauauacuaaggacaauuauuuuuauaauuuggaaaagaauuuagga

SEQ ID NO: 591306 - RNA, 64 nt, Homo Sapiens
aguaucugucaaguuaauauagguaaaauaaguuuauuuuuaauggauuuuaaaauuaaaugug

SEQ ID NO: 591307 - RNA, 64 nt, Homo Sapiens
ccacaggccuaaauaaaacucucuuguaucucaauauuuuuaaaaucucaaaaaaaaaaaaaaa

SEQ ID NO: 591308 - RNA, 64 nt, Homo Sapiens
acuaauauaaaucaagaaaaauauauuuuuccuuuauuuuuaugcuauaaagaaaauacuugca

SEQ ID NO: 591309 - RNA, 64 nt, Homo Sapiens
gauaagaaaaaugaagccaagaaggguauggcuuuauuuuuauauaauaaccugguauaaacau

SEQ ID NO: 591310 - RNA, 64 nt, Homo Sapiens
aaguauguucuauaguaaaagugugaaauuacuuuauuuuuagauuccauucuaacauuucagu

SEQ ID NO: 591311 - RNA, 64 nt, Homo Sapiens
cguaaaaauuauggaaaugaugaucagcucuuucuauuuuuacuagugacaauauuaagguaca

SEQ ID NO: 591312 - RNA, 64 nt, Homo Sapiens
auaugauaagccugggauucgauaaaugucucaguauuuuuauacauuuauauuaguuauguuu

SEQ ID NO: 591313 - RNA, 64 nt, Homo Sapiens
uaaauaacuuuauuuauaacuaaugcauuaaaaauauuuuuauuagaauccaccugacuucccc

SEQ ID NO: 591314 - RNA, 64 nt, Homo Sapiens
uucuuuuacuuuucuacauaucauuuuugccaguuauuuuuauuuuuuagaauggauuuauuuu

SEQ ID NO: 591315 - RNA, 64 nt, Homo Sapiens
uauguauuuaucguucuugaaucuuugcuagagcuauuuuuacccaucucagagccauaagguc

SEQ ID NO: 591316 - RNA, 64 nt, Homo Sapiens
gaaagucuauuucuuugaaaguaaaaauuguauauauuuuuacagacagcuuguaaauguauuu

SEQ ID NO: 591317 - RNA, 64 nt, Homo Sapiens
aaagacaggguuuugccacaccagcuaauuuuuguauuuuuaguauaggcgugcaccaccacgc

SEQ ID NO: 591318 - RNA, 64 nt, Homo Sapiens
uaauucagauggaucuuccuuacuccacugcucauauuuuuaucaaccagaauaaaauaaccaa

SEQ ID NO: 591319 - RNA, 64 nt, Homo Sapiens
uagucaucaacaauuugaccguauuaguccaaauuauuuuuacguuaaugaucaacaauuuaau

SEQ ID NO: 591320 - RNA, 64 nt, Homo Sapiens
uuauguuaaaguaaagaaaugaggauucaacacauauuuuuauaaagacccugucuuaaaaaaa

SEQ ID NO: 591321 - RNA, 64 nt, Homo Sapiens
uuuuuuuagagauggagucuuuuuuauuuauuuuuauuuuuauugcccuuuccauuaguuguau

SEQ ID NO: 591322 - RNA, 64 nt, Homo Sapiens
uuuauuuuuuuuuagagauguuguauuuuuuauuuauuuuuauuuuucuugcccuuuccauuag

SEQ ID NO: 591323 - RNA, 64 nt, Homo Sapiens
agagacaggguuucaccaugccaacuaauuuuuguauuuuuagugccaccgugccuggccacgc

SEQ ID NO: 591324 - RNA, 64 nt, Homo Sapiens
agagacgggguuucaccaugccggcuaauuuuuguauuuuuaguauaggcaccuaccaccacgc

SEQ ID NO: 591325 - RNA, 64 nt, Homo Sapiens
gacaaauauuuccuccucagagggaaccuacauuuauuuuuaaggcagccaaagagaacaaucc

SEQ ID NO: 591326 - RNA, 64 nt, Homo Sapiens
acuucccugaugaauaaucuacauguauauaggauauuuuuauauuaaaaugccucaaaugugc

SEQ ID NO: 591327 - RNA, 64 nt, Homo Sapiens
agagacgggguuucaccaugcaagcuaauuuuuguauuuuuaguacaggcaugugccaccacgc

SEQ ID NO: 591328 - RNA, 64 nt, Homo Sapiens
aaaugaaauagugauguugugauaucuuaauuuuuauuuuuaaaauuuugggggugggugggug

SEQ ID NO: 591329 - RNA, 64 nt, Homo Sapiens
uucuuggcuuuguguuuuagagaauguccauauuuauuuuuaugcucuaggccuucaggacucu

SEQ ID NO: 591330 - RNA, 64 nt, Homo Sapiens
agagacaggguuucuccaugcccggcuaauuuuguauuuuuaguuacaggcgcccgccaccaug

SEQ ID NO: 591331 - RNA, 64 nt, Homo Sapiens
uauuuauuuauuuuuuugagguuauuuuuauuuuuauuuuuauuauggucuggaguaacgcuuc

SEQ ID NO: 591332 - RNA, 64 nt, Homo Sapiens
uuuauuuauuuauuuauuuucgcuucguuauuuuuauuuuuauucugggaauggucuggaguaa

SEQ ID NO: 591333 - RNA, 64 nt, Homo Sapiens
uuuauuuuuauuuauuuauugaguaacgcuucguuauuuuuauuggcauccugggaauggucug

SEQ ID NO: 591334 - RNA, 64 nt, Homo Sapiens
uuugaaaagaaaauguuuuauagucuucuuggauuauuuuuauagaguagccuuuaaucaugga

SEQ ID NO: 591335 - RNA, 64 nt, Homo Sapiens
uaaaccaaaaaaaaacagaaagguugcuguuuucuauuuuuaaaguaggcuauaaaacaaaaaa

SEQ ID NO: 591336 - RNA, 64 nt, Homo Sapiens
agagaugggguuucaccauguuggcuaauuuuuguauuuuuaguacaggcacccaccaucaugc

SEQ ID NO: 591337 - RNA, 64 nt, Homo Sapiens
agagauggaauuuugccaugccagcuaauuuuuguauuuuuaguacaggcaugcaccaccaugc

SEQ ID NO: 591338 - RNA, 64 nt, Homo Sapiens
aaaacaaacagaugaaaaccgcauuugcuauaauuauuuuuaaagacuaagucuuuguacuaaa

SEQ ID NO: 591339 - RNA, 64 nt, Homo Sapiens
uuauuuuauuuuuugagaugcauuuuuauuuauuuauuuuuauuauauaccuuuguuucccuag

SEQ ID NO: 591340 - RNA, 64 nt, Homo Sapiens
ucucuguccauugcuuuuaauauaccuagauuuuuauuuuuagguauuaaaauuauucugcuaa

SEQ ID NO: 591341 - RNA, 64 nt, Homo Sapiens
agagaagguguuucaccguguggcuaauuuuuuguauuuuuagugcaggcaccgccaccacgcc

SEQ ID NO: 591342 - RNA, 64 nt, Homo Sapiens
uuuuuguauuauuuauagcuaacuuauuuuuauauauuuuuauaaagcuuauauuacuacaaaa

SEQ ID NO: 591343 - RNA, 64 nt, Homo Sapiens
uauuuuuauauuuuuguauuuacuacaaaaaacuuauuuuuauaguguauuaagaagcuuauau

SEQ ID NO: 591344 - RNA, 64 nt, Homo Sapiens
uugugaugcuuuucuacaagcacauggagaaauauauuuuuaaugggauugaaagcacuuuuac

SEQ ID NO: 591345 - RNA, 64 nt, Homo Sapiens
uauaucuucagguuauuuucaugaugcuauuuuuuauuuuuaaaccaaaaacuuggagugaagg

SEQ ID NO: 591346 - RNA, 64 nt, Homo Sapiens
uaaaaauaaaaauuaauuugagagugcaauauuauauuuuuaugcagaauaacuggucuuguua

SEQ ID NO: 591347 - RNA, 64 nt, Homo Sapiens
uggggugcugcuuuauuggcgauggcugucuguauauuuuuacugccgucugucucucccauau

SEQ ID NO: 591348 - RNA, 64 nt, Homo Sapiens
caugaacaaacucccaugggaguuuaaagagcuauauuuuuaaaaagaugccuaaauagaagca

SEQ ID NO: 591349 - RNA, 64 nt, Homo Sapiens
uaugguuaaagagaccugucaacaguguuggcacuauuuuuauacauuucucaaguggaaagua

SEQ ID NO: 591350 - RNA, 64 nt, Homo Sapiens
uuguaugaauacauuauccugccuuuuacuauguuauuuuuauugguucaauuauaaacauuug

SEQ ID NO: 591351 - RNA, 64 nt, Homo Sapiens
acucagaacauguauauuggguuuagguggaguauauuuuuaaaaagauuaaacuagacagaua

SEQ ID NO: 591352 - RNA, 62 nt, Homo Sapiens
uuggacaaccaagaccaugauagacucuaacuuauuuuuauaaggaauauugacuccuuggc

SEQ ID NO: 591353 - RNA, 64 nt, Homo Sapiens
acaggcaccugccaccacgcccagcuaauuuuuguauuuuuaguaaagacgggggauuucacca

SEQ ID NO: 591354 - RNA, 64 nt, Homo Sapiens
uauacacauacaauuuauguuuuccuguugaauguauuuuuaugagauuuuaaccagaacaaag

SEQ ID NO: 591355 - RNA, 64 nt, Homo Sapiens
ucaaaggaaaaaaagauuuauuaucaaggggcaauauuuuuaucuuuuccaaaauaaauuuguu

SEQ ID NO: 591356 - RNA, 64 nt, Homo Sapiens
ucagcuuuuaagauacgaguuuuguguaauuugguauuuuuaaucauuuauguuauuuuaaaag

SEQ ID NO: 591357 - RNA, 64 nt, Homo Sapiens
acauaagguacuugaagauuuauuaguuuaauucuauuuuuacaguaaccuugaauucuucuga

SEQ ID NO: 591358 - RNA, 64 nt, Homo Sapiens
auaaauaauagauuauacacaucaucuuaauaacuauuuuuaaguuauuuaccauagccucugu

SEQ ID NO: 591359 - RNA, 64 nt, Homo Sapiens
aauguauaauugccaauugauuguaacuauuauuuauuuuuaaaugaaaguguaagaaugcuuu

SEQ ID NO: 591360 - RNA, 64 nt, Homo Sapiens
ucuaaucucugauuauuaaaauguuuauaaaguuuauuuuuaccaaagagaugcaauucauuau

SEQ ID NO: 591361 - RNA, 64 nt, Homo Sapiens
uaaaugucuuuuuaaaaagagaaauauaaacauauauuuuuacuauuaaaauauucaguuuuuu

SEQ ID NO: 591362 - RNA, 64 nt, Homo Sapiens
gcacugcugugaaaugugaaguacuuuguuuuuuuauuuuuaaugauuuucuuuuuguuauuaa

SEQ ID NO: 591363 - RNA, 64 nt, Homo Sapiens
acugagccagcuaacuuaaaaagcugccuuaguuuauuuuuagagauuacagaauuuuuaaaca

SEQ ID NO: 591364 - RNA, 64 nt, Homo Sapiens
cuucccuacuauugccucucugaccuuuuuaaauuauuuuuaauaccaaaagaguucuuuugaa

SEQ ID NO: 591365 - RNA, 64 nt, Homo Sapiens
uccuuuccccaagaaucuccuugggacuuugacuuauuuuuaaagcuguguuggagcucaucuu

SEQ ID NO: 591366 - RNA, 64 nt, Homo Sapiens
cuguuuuguaacugguuuaccucuauaguuuauuuauuuuuaaauuauaaacacuuuucagcug

SEQ ID NO: 591367 - RNA, 64 nt, Homo Sapiens
uuauagccucuaaagccugugguauuuuauauaauauuuuuauaacuuuaagagacuguaguaa

SEQ ID NO: 591368 - RNA, 64 nt, Homo Sapiens
aacacuuauuucuguguuaugguucuuauucauauauuuuuauagcacuuuuggaaccuauauu

SEQ ID NO: 591369 - RNA, 64 nt, Homo Sapiens
agauaagguacaggaaugaaccuugguuuaaagguauuuuuauaugaaaaugguguguuauugg

SEQ ID NO: 591370 - RNA, 64 nt, Homo Sapiens
auuuuacacuuauauuuucacaguuaauugaacauauuuuuaaacaacuguaguuuugggcaac

SEQ ID NO: 591371 - RNA, 64 nt, Homo Sapiens
uuuaaaggaaaaaugaaauuaucuuccuuuagcuuauuuuuaagguaaaacagcuuuuuacucu

SEQ ID NO: 591372 - RNA, 64 nt, Homo Sapiens
acuacagcugugcgccaccacaucuggcuaauuuuauuuuuauuuuuguagagacaggagucuu

SEQ ID NO: 591373 - RNA, 64 nt, Homo Sapiens
caugacuuagaagauaucauugccauguagguuuuauuuuuaaaagucuugagcucuucuuaaa

SEQ ID NO: 591374 - RNA, 64 nt, Homo Sapiens
aucagucucggcugucagaauaacuucuaaaagguauuuuuauaagcaguucaaguuacugaaa

SEQ ID NO: 591375 - RNA, 64 nt, Homo Sapiens
aguagcuugaaagagcuuaaucauaugcaguaaguauuuuuauuaccaauaaauuuaaaauuuu

SEQ ID NO: 591376 - RNA, 64 nt, Homo Sapiens
uauuaccaauaaauuuaaaauuuuuuaagaaaaauauuuuuauccuagggccaaguguugccug

SEQ ID NO: 591377 - RNA, 64 nt, Homo Sapiens
ucagcuaugcagaaaaauuuagcuuaugcuuccauauuuuuaaauuuuguuuuuuaaguuuugc

SEQ ID NO: 591378 - RNA, 64 nt, Homo Sapiens
uaccuuuuaguaauaaaaugacuugaaaucauauuauuuuuaaaagcccuuugcuucuuucauu

SEQ ID NO: 591379 - RNA, 64 nt, Homo Sapiens
uuuuuucacaguuauuauucuucuauuaacaaauuauuuuuaucuuuccuaguacauuuucacu

SEQ ID NO: 591380 - RNA, 64 nt, Homo Sapiens
agcugaggcaauucuaacuuuuuugcuauccagcuauuuuuauuuguuugugcauuugggggga

SEQ ID NO: 591381 - RNA, 64 nt, Homo Sapiens
aauauuuuccaugaaaaugcaacaacauguauaauauuuuuaauuaaauaaaaaucuguggugg

SEQ ID NO: 591382 - RNA, 64 nt, Homo Sapiens
cuacagcaauuaacuuuaagccuccuuuuagagauauuuuuaaaacuuguuuaaaauuuuugug

SEQ ID NO: 591383 - RNA, 64 nt, Homo Sapiens
acuugcauacgcucauauucuaggguuuuuucucuauuuuuaggguaucauaguaaaucauuag

SEQ ID NO: 591384 - RNA, 64 nt, Homo Sapiens
uuucuuucuuacaaaaacugauuuuucccauaaauauuuuuacuucagaggacuaggaccauuu

SEQ ID NO: 591385 - RNA, 64 nt, Homo Sapiens
agcaguuuggguuuggaguauuauauuuggcuucuauuuuuauuauuuuggaucaccauucucc

SEQ ID NO: 591386 - RNA, 64 nt, Homo Sapiens
caggcgcccgccaccacgccuggcuaauuuuuuauauuuuuaguagagacaggguuucaccaug

SEQ ID NO: 591387 - RNA, 64 nt, Homo Sapiens
auaggcguccaccaccacgcccagcuaauuuuuguauuuuuaguagaaaugggguuucaccaug

SEQ ID NO: 591388 - RNA, 64 nt, Homo Sapiens
uaucuaaaaguaaguguuuugaaauauccuaaucuauuuuuauuugugucuuuuuugaaguuua

SEQ ID NO: 591389 - RNA, 64 nt, Homo Sapiens
augcaauaaacaucucaguauuuaagaguguggauauuuuuaaagaggaauuugaaacaggaua

SEQ ID NO: 591390 - RNA, 64 nt, Homo Sapiens
augugcuuuuccaaauuaaacuuuguauuaaaauuauuuuuaacuaaauuuacacuuauaaugc

SEQ ID NO: 591391 - RNA, 64 nt, Homo Sapiens
gguucuuuuucagaaguaaauuuuuaauacgaucuauuuuuauaguuuuaaaucuuuuuaaguu

SEQ ID NO: 591392 - RNA, 64 nt, Homo Sapiens
aaguaaagccaaguaucaaaguauuuaaguuguguauuuuuauauuguaaacagagugucauau

SEQ ID NO: 591393 - RNA, 64 nt, Homo Sapiens
cuauagcuuacaaaauacauuuucugaagaguaauauuuuuaaaauuccugcuugggcuccaaa

SEQ ID NO: 591394 - RNA, 64 nt, Homo Sapiens
ugccuuuggcuuuuuauugcuuaaaguuaaaauauauuuuuacguuacuguaacuaaguuauuu

SEQ ID NO: 591395 - RNA, 64 nt, Homo Sapiens
guuaaaauauauuuuuacguuacuguaacuaaguuauuuuuaaaguaagacacaggcaaaguau

SEQ ID NO: 591396 - RNA, 64 nt, Homo Sapiens
ggcauuagagucaacuacacaaaaaucaugccaguauuuuuaaaagcuguacuucuugaauaua

SEQ ID NO: 591397 - RNA, 64 nt, Homo Sapiens
acaucuuuauugaaauucuacuaagauguguucuuauuuuuauagcgaaucucaaaauuagauc

SEQ ID NO: 591398 - RNA, 64 nt, Homo Sapiens
uguaacucuuuuuuuaccucugaauuuuuauaucuauuuuuauauuuucaucauugcuuugaau

SEQ ID NO: 591399 - RNA, 54 nt, Homo Sapiens
cuuuuucucuaucugaagugacaguauuuuuaacauaacaagaagaaaaauuag

SEQ ID NO: 591400 - RNA, 64 nt, Homo Sapiens
cauuaaaagucaacuuaaaauugugagggguuuuuauuuuuacuggcuacugaguaaacuugac

SEQ ID NO: 591401 - RNA, 64 nt, Homo Sapiens
aggacuagcagaaaucaaaaaggugcuauacuuguauuuuuaccggaaagcacuccuacccucc

SEQ ID NO: 591402 - RNA, 64 nt, Homo Sapiens
uaaaaauaaauauuccuuuaacuuugauguaucauauuuuuaaaguuuaaaaugucacugcuuu

SEQ ID NO: 591403 - RNA, 64 nt, Homo Sapiens
uuugucagaaauuuuagauuugguuucuguaggguauuuuuaauaucauugcuguacaauaugc

SEQ ID NO: 591404 - RNA, 64 nt, Homo Sapiens
uguugcuuguucucuuaaaauauauugaagcuuguauuuuuaacguguuaggcacuauaguauu

SEQ ID NO: 591405 - RNA, 64 nt, Homo Sapiens
uuuuuaauuuuuucuuuuuuggauucauuguuuuuauuuuuauuauuuguguuaacauggaaga

SEQ ID NO: 591406 - RNA, 64 nt, Homo Sapiens
uguucuaacauaagaccuguaagacaaacauguauauuuuuaaacaagaacacauugcagaagu

SEQ ID NO: 591407 - RNA, 64 nt, Homo Sapiens
aggagaaguuuaacuuugcuuugguuuguugcuuuauuuuuaaauuuuccauuuuguugcuugg

SEQ ID NO: 591408 - RNA, 64 nt, Homo Sapiens
cucuuaagucaauguaaaaaauggauaaugguuuuauuuuuaaugaugaugucuuauuuauuag

SEQ ID NO: 591409 - RNA, 64 nt, Homo Sapiens
auuucauuauuuuucagagggaucucaaaaccacuauuuuuauuccaaaauauuaauaaauuua

SEQ ID NO: 591410 - RNA, 64 nt, Homo Sapiens
gggacuuuauuuuuugaucuggagcaaccaaaguuauuuuuacacaucauaugacgugugggug

SEQ ID NO: 591411 - RNA, 64 nt, Homo Sapiens
gaucugucauauuaugaaaguuaaaagagccauuuauuuuuagauuuuuugauggcaugcugcc

SEQ ID NO: 591412 - RNA, 64 nt, Homo Sapiens
gaaauguuuauacaauaauucuuucuacagaccauauuuuuaaaaacuuagguuuuacucuuuu

SEQ ID NO: 591413 - RNA, 64 nt, Homo Sapiens
uaugaugugauguaggggucauccauuucgaguauauuuuuauaaguucucacaauggucuuug

SEQ ID NO: 591414 - RNA, 64 nt, Homo Sapiens
ugaguugucuuuuuuuuuuuccagguccuuugccuauuuuuaauuucuuuggagaaaggucuau

SEQ ID NO: 591415 - RNA, 64 nt, Homo Sapiens
ucuuuccuggcacagcuguuuccucagauuuuaauauuuuuauuaaugcagaaauuauauaguc

SEQ ID NO: 591416 - RNA, 64 nt, Homo Sapiens
ugcaacauuuacaugauaaccccgaucauauagauauuuuuaaggucuagauggauauuagaug

SEQ ID NO: 591417 - RNA, 64 nt, Homo Sapiens
uugaguagguaccuuguagcaagugugggaacauuauuuuuagauuagugcuuaacauuuuccc

SEQ ID NO: 591418 - RNA, 64 nt, Homo Sapiens
agagaugggguuucaccaugccggcuaauuuuuguauuuuuaguacaggcaacugccaccaugc

SEQ ID NO: 591419 - RNA, 64 nt, Homo Sapiens
gacaauuuggaucuaaauauccaguuguaaugcauauuuuuaaacuuauucucaguggaaaacu

SEQ ID NO: 591420 - RNA, 64 nt, Homo Sapiens
caaaguauucuguuucagcaaauauuuaaaggauuauuuuuauggugccuguaaagucuccucu

SEQ ID NO: 591421 - RNA, 64 nt, Homo Sapiens
aaauuuguucuagugcauuuuuccauaucugccauauuuuuacagcauccauucuauuuuuaac

SEQ ID NO: 591422 - RNA, 64 nt, Homo Sapiens
uuccauaucugccauauuuuccuugcauccauucuauuuuuaacccaaacaccuuuaguacagu

SEQ ID NO: 591423 - RNA, 64 nt, Homo Sapiens
guuuuauacccagaaguuauagguagaauauuuuuauuuuuacuucacuugauuuaacacacuc

SEQ ID NO: 591424 - RNA, 64 nt, Homo Sapiens
uuuacuguuuuauacccagaacacucagguagaauauuuuuauuuacaaaucacuugauuuaac

SEQ ID NO: 591425 - RNA, 64 nt, Homo Sapiens
aucagauggggcaacauauuaaagagcaccuuuguauuuuuauuuaagguuuaugguuuagcuu

SEQ ID NO: 591426 - RNA, 64 nt, Homo Sapiens
aacaaauucuucaaguaugauuuugcaucuuaguuauuuuuaaacaagacuagcuaauuuauuu

SEQ ID NO: 591427 - RNA, 64 nt, Homo Sapiens
uaacuggugaucuauaauuuugucuuuucccguguauuuuuaaaugauacuaccuuuguauguc

SEQ ID NO: 591428 - RNA, 64 nt, Homo Sapiens
accguacauauuucucguuuaguuuauuaaagauuauuuuuauuaccggaauccucucuauaca

SEQ ID NO: 591429 - RNA, 64 nt, Homo Sapiens
uuuuuccuuccuuaucacugcgugaaguauacuguauuuuuaccuuuuugaguggaugauguuu

SEQ ID NO: 591430 - RNA, 64 nt, Homo Sapiens
guucucccaagggaguuagguggucacauacaauuauuuuuacaaauacauucugcuuucaucu

SEQ ID NO: 591431 - RNA, 64 nt, Homo Sapiens
aauaaacauuuuauaguguuuuuuuauuuucuaauauuuuuaauaacaugucaucuucaaaaua

SEQ ID NO: 591432 - RNA, 64 nt, Homo Sapiens
uucuaauauuuuuaauaauaugucaucuucaaaauauuuuuauuucguauauccuggaauaaca

SEQ ID NO: 591433 - RNA, 64 nt, Homo Sapiens
gaaagaugacauguauuugcaagugcgcuaugcauauuuuuaauaacuaaaccaacuuuuucca

SEQ ID NO: 591434 - RNA, 64 nt, Homo Sapiens
caaccuccaaaaaaaaaaacauuuuuuaaauuuguauuuuuauauuuaugauuaauaaaaguuc

SEQ ID NO: 591435 - RNA, 64 nt, Homo Sapiens
cucuguauaauucagaacagaaguagcugacacauauuuuuagacaagaguauuuacaggaaug

SEQ ID NO: 591436 - RNA, 64 nt, Homo Sapiens
gaaaaagaaaacaaaagccauuuuacuguacauuuauuuuuaaaugacaaacuuuugcuuguag

SEQ ID NO: 591437 - RNA, 64 nt, Homo Sapiens
gauuuugcacuucugaauucaauggaaauauuuuuauuuuuacaauccauagauugcugagaaa

SEQ ID NO: 591438 - RNA, 64 nt, Homo Sapiens
uuuacagauuuugcacuucugagaaaaauggaaauauuuuuauuagguuaauccauagauugcu

SEQ ID NO: 591439 - RNA, 64 nt, Homo Sapiens
cuggugaaacugacccaaauuuuguuaguaccuauauuuuuaaaucucccaugaaagaauucag

SEQ ID NO: 591440 - RNA, 64 nt, Homo Sapiens
gaagugggcaaaaauuauuuagcaaauggggugauauuuuuauagucucucucauaugcuaggu

SEQ ID NO: 591441 - RNA, 64 nt, Homo Sapiens
aaaacgucuuuauuuaucaaaaaaacacagaggcuauuuuuauauccuugguaugaaauaugua

SEQ ID NO: 591442 - RNA, 64 nt, Homo Sapiens
caacaaugcuauacagcgcaguuguuuccauuccuauuuuuaauaaaucucaggggaagccuca

SEQ ID NO: 591443 - RNA, 64 nt, Homo Sapiens
agauuuacuuggaagagcaaagaaggaaaaauuauauuuuuaaagaaagagaauauucaggcuu

SEQ ID NO: 591444 - RNA, 64 nt, Homo Sapiens
uuucugguuagaaacauugcugguaguuggauuauauuuuuauuguauucauuuaucuuagggg

SEQ ID NO: 591445 - RNA, 64 nt, Homo Sapiens
aauaucuauaucuauaucuauaucuauaucuauauauuuuuaaucaucuacauguaaaugaagc

SEQ ID NO: 591446 - RNA, 64 nt, Homo Sapiens
uaagucuguaaccuggcaacauuuuacaacccuguauuuuuaaagauggcuuucuaauaaaaaa

SEQ ID NO: 591447 - RNA, 64 nt, Homo Sapiens
gagcuaggccucugcuacaagcacuugaaaaugauauuuuuauuuuuaacgucucaacaaucug

SEQ ID NO: 591448 - RNA, 64 nt, Homo Sapiens
ggccucugcuacaagcacuugaaaaugauauuuuuauuuuuaacgucucaacaaucugauaucg

SEQ ID NO: 591449 - RNA, 64 nt, Homo Sapiens
cccaaagcagcuggagagacuuuggggacuuuuuuauuuuuauuuuuugccuaacagcuuuugg

SEQ ID NO: 591450 - RNA, 64 nt, Homo Sapiens
acacucagugggggacauuuuggugaagaugcaauauuuuuaugucaugugaugcucuuuccuc

SEQ ID NO: 591451 - RNA, 64 nt, Homo Sapiens
caggggcccaccaccgcgcccggcuaauuuuuuguauuuuuaguagagacgggguuucaccgug

SEQ ID NO: 591452 - RNA, 64 nt, Homo Sapiens
uacuuaaacacaccaauuguagaaagcaacccuuuauuuuuagcaaguuugguuuacucuucuc

SEQ ID NO: 591453 - RNA, 64 nt, Homo Sapiens
uuuucaugcuuuaucaauagcccaggauauauuuuauuuuuagaauuuugugaaacagacuugu

SEQ ID NO: 591454 - RNA, 64 nt, Homo Sapiens
aaaccgaacugggcauauuucuaauuggcuuuacuauuuuuauuuuuaaauuauguuuuacugu

SEQ ID NO: 591455 - RNA, 64 nt, Homo Sapiens
aacugggcauauuucuaauuggcuuuacuauuuuuauuuuuaaauuauguuuuacuguucauuu

SEQ ID NO: 591456 - RNA, 64 nt, Homo Sapiens
uaagaauaugcaucuuaaaauggcaaguuuuccauauuuuuacaacucacuggugguuuuccgc

SEQ ID NO: 591457 - RNA, 64 nt, Homo Sapiens
accaggcuuucuagaaagaauaaacuuacauauuuauuuuuaggacaugaaaauagcaauauuc

SEQ ID NO: 591458 - RNA, 64 nt, Homo Sapiens
aaauugggguuuauuucagcaaacuuguugaauuuauuuuuaagaaagaaauacuguauuggga

SEQ ID NO: 591459 - RNA, 64 nt, Homo Sapiens
uagacaauauaagagcuuccaauuuuccuucagauauuuuuaauauuaaauauauuuuagugac

SEQ ID NO: 591460 - RNA, 64 nt, Homo Sapiens
guuuagguagagccacaaaagaaaagacuuguaauauuuuuauauacagaggaaaucuguaaca

SEQ ID NO: 591461 - RNA, 64 nt, Homo Sapiens
uucuuucagauuuuuugaaccauccacuuacauauauuuuuaaaaaaugaaauccuuuuccugu

SEQ ID NO: 591462 - RNA, 64 nt, Homo Sapiens
acuaauguaaaaugauuuguaguggaaacauuuauauuuuuauaauaaacauaaugaaaauauu

SEQ ID NO: 591463 - RNA, 64 nt, Homo Sapiens
gacuucuaggaauuuauaaccaaaauuuuaaaacuauuuuuauauuuuuuuaaaucuuuaaaaa

SEQ ID NO: 591464 - RNA, 64 nt, Homo Sapiens
cuguauuuggcauuuagacuaacuucuagauguauauuuuuaauaauagauucauaauguuaca

SEQ ID NO: 591465 - RNA, 64 nt, Homo Sapiens
guuugugagaaaccauugggaacuauacucuuuuuauuuuuauuuuuuauuuuuuuuauuauuu

SEQ ID NO: 591466 - RNA, 64 nt, Homo Sapiens
uacaggcaugcuccaccaugcccagcuaauuuuguauuuuuaguagaaacgggguuucaccaua

SEQ ID NO: 591467 - RNA, 64 nt, Homo Sapiens
acaggcgugugccaccaugccuggcuaacuuuuguauuuuuaguagagacgggguuucaccacg

SEQ ID NO: 591468 - RNA, 64 nt, Homo Sapiens
acagacaugcgccaccaugucuggcuaauuuuuguauuuuuaguggagaugggguuucgccuug

SEQ ID NO: 591469 - RNA, 64 nt, Homo Sapiens
acagguguacgccaccacacccagcuaauuuuuguauuuuuaguagggacagguuuugccaugu

SEQ ID NO: 591470 - RNA, 64 nt, Homo Sapiens
gcccaccaccaugcccggcuaauuuuuguuuuuguauuuuuaguagagacaggguuucacugug

SEQ ID NO: 591471 - RNA, 64 nt, Homo Sapiens
caggugugugccuccacacccggcuaauuuuuuguauuuuuaguagagacgggguuuugccaug

SEQ ID NO: 591472 - RNA, 64 nt, Homo Sapiens
gccuacuauaaggaauauaugacaugcuaaauuuuauuuuuaaacgguucuucaagucagauua

SEQ ID NO: 591473 - RNA, 64 nt, Homo Sapiens
uacacuaucuaucuuagauagauauauuuuuuuuuauuuuuaaauauuguacuauuuauggugg

SEQ ID NO: 591474 - RNA, 64 nt, Homo Sapiens
uuuuguuuuucuuaguaaguguaaaugguugcuuuauuuuuauuuuaaaaagguaugucuuugg

SEQ ID NO: 591475 - RNA, 64 nt, Homo Sapiens
auccaaauaccucagcuaaguaauucuauuuuauuauuuuuacuguuauguauguuuuuaauca

SEQ ID NO: 591476 - RNA, 64 nt, Homo Sapiens
uuaaauuuucagguauuuagcuccccuuucauauuauuuuuaaauuuuuuaauuaccuguugua

SEQ ID NO: 591477 - RNA, 64 nt, Homo Sapiens
gaaaaggcauuuggcauuuaacugucucuuguuuuauuuuuaaguuuuuggaaaccuuuugaca

SEQ ID NO: 591478 - RNA, 64 nt, Homo Sapiens
aauuuaaaauagauacagaaaaguacacugguaauauuuuuauuuccuauuggagagugaaucc

SEQ ID NO: 591479 - RNA, 64 nt, Homo Sapiens
aaauauagcauccuucuguuguuuauuuuaaauauauuuuuaaugaaaagggacuuaaaaagua

SEQ ID NO: 591480 - RNA, 64 nt, Homo Sapiens
ucaggugcauuccaccacacauggcuaauuuuuguauuuuuaguagaaaugggguuucgucaug

SEQ ID NO: 591481 - RNA, 64 nt, Homo Sapiens
acaggugccuaccaccaugccaggcuaauuuuuguauuuuuaguaaagacaggguuucaccaua

SEQ ID NO: 591482 - RNA, 64 nt, Homo Sapiens
gaaaaauuauaucugaaucaagauucauguuuuuuauuuuuauuuuuuuugauacagagucuca

SEQ ID NO: 591483 - RNA, 64 nt, Homo Sapiens
caggcacccgccaccacacccagcuauuuuuuuguauuuuuaguagagacagagucucaccaca

SEQ ID NO: 591484 - RNA, 64 nt, Homo Sapiens
ugucuuuucuguugucuucaaauuuuaugccuuuuauuuuuaauuuaaucccguucaauuauuu

SEQ ID NO: 591485 - RNA, 64 nt, Homo Sapiens
uuacuucaaaauauucacaaggcuaaauaacucuuauuuuuauuuuugaagguuuuuuuuuuua

SEQ ID NO: 591486 - RNA, 64 nt, Homo Sapiens
gcagcagaaggaagacagaaagauagaaauugauuauuuuuaugauagcaguauucaggaucuc

SEQ ID NO: 591487 - RNA, 64 nt, Homo Sapiens
uuguagccaaucauuuuauaggggcugggaaauguauuuuuacacuauacuuguguuuuguuug

SEQ ID NO: 591488 - RNA, 64 nt, Homo Sapiens
aaaauuaauacagcucuguguguuggcauaugauuauuuuuacuagaaagugguucaauucccc

SEQ ID NO: 591489 - RNA, 64 nt, Homo Sapiens
uuaauuugcuuagcuguuugcuuagaaauuguuuuauuuuuaaaaucgugauuauauucaucua

SEQ ID NO: 591490 - RNA, 64 nt, Homo Sapiens
ccuuucuacacuacaaccaagucucccuguuuuuuauuuuuauuuagcaacagccuccuuauua

SEQ ID NO: 591491 - RNA, 64 nt, Homo Sapiens
aaaauuuguuuuagacugccauaucuguucuucguauuuuuaaagcaggcaccucuucccuuca

SEQ ID NO: 591492 - RNA, 64 nt, Homo Sapiens
agagacgggguuucacuguguggguuauuuuuuauauuuuuagucaagugccugccaccacgcc

SEQ ID NO: 591493 - RNA, 64 nt, Homo Sapiens
gucuuuuuuauuuuuugagaccccaguauagggauauuuuuacugauaccuuguaaaguuccug

SEQ ID NO: 591494 - RNA, 64 nt, Homo Sapiens
caagcuuuuaguaauagccuauagggcuuguuguuauuuuuauuacgaguuuacugauuggagc

SEQ ID NO: 591495 - RNA, 64 nt, Homo Sapiens
aaugaaaucuuaauucauuuuaaauaugucucuuuauuuuuaaaaaaaagagaguuauuacaaa

SEQ ID NO: 591496 - RNA, 64 nt, Homo Sapiens
aaauguuaaauaagcuaacaguauaaagagucuguauuuuuaauaggcuuauccuucugcauua

SEQ ID NO: 591497 - RNA, 64 nt, Homo Sapiens
ugaaucaucuccucugugguugcauauaguggcauauuuuuauaugugacuaagaaggaaaaua

SEQ ID NO: 591498 - RNA, 64 nt, Homo Sapiens
ccacugucuugggcuaaaauuagacacaaucucuuauuuuuauaaucacaugauuuggagaaau

SEQ ID NO: 591499 - RNA, 64 nt, Homo Sapiens
aauuauaacuaaaagaccaaguuuuaaaaugucuuauuuuuaagaaauaaugcacauuuaauau

SEQ ID NO: 591500 - RNA, 64 nt, Homo Sapiens
aaucauguuugacaucuuucaaacugguaguaguuauuuuuaaauuucgccagggaucuuuuca

SEQ ID NO: 591501 - RNA, 64 nt, Homo Sapiens
agagacgggguuuuacuuugccagcuaauuuuuguauuuuuaguuauaggugugcgccaccaca

SEQ ID NO: 591502 - RNA, 64 nt, Homo Sapiens
ugaccuuuuuccuuugguuuuuuuuuccuuuaaauauuuuuagucauuugauucauucucacau

SEQ ID NO: 591503 - RNA, 64 nt, Homo Sapiens
cagguggugagaaauuucugggcugaauuauuuuuauuuuuaaauagaagaagcuaugucaaga

SEQ ID NO: 591504 - RNA, 64 nt, Homo Sapiens
uuuaaacagguggugagaaaucaagaggcugaauuauuuuuauuuuuaccuagaagaagcuaug

SEQ ID NO: 591505 - RNA, 64 nt, Homo Sapiens
agagacaggguuucacuguguaacuaacuuuuuguauuuuuaguaccacgccuggcuaacuaac

SEQ ID NO: 591506 - RNA, 64 nt, Homo Sapiens
auauauuguacuugaauuauuugaaauaaauauauauuuuuaacacaguugaagcaucuaaaaa

SEQ ID NO: 591507 - RNA, 64 nt, Homo Sapiens
uuuuccuuuuuuuccgauuacuucaguuuguuuuuauuuuuaaugguuuaucuuggcauauauc

SEQ ID NO: 591508 - RNA, 64 nt, Homo Sapiens
uuguaugccacuuuuguuuaucuagaaaaagagauauuuuuagacuagauuacauaauaguauu

SEQ ID NO: 591509 - RNA, 64 nt, Homo Sapiens
uuaggagguguacuugacacguagagcccaucaauauuuuuauuacugcccgugucuccagaau

SEQ ID NO: 591510 - RNA, 64 nt, Homo Sapiens
aaaguguagcuaauauuucaauaaaguucaaaaguauuuuuaccuccuugccgcgacugugaag

SEQ ID NO: 591511 - RNA, 64 nt, Homo Sapiens
cagaaaaaauaauuuuucaucucaagguauuuuauauuuuuagucauauacauuuuucuugagu

SEQ ID NO: 591512 - RNA, 64 nt, Homo Sapiens
acagaaaaagcucccuauaacuacuguagaacacuauuuuuaauuucaaauguccuguuugaua

SEQ ID NO: 591513 - RNA, 64 nt, Homo Sapiens
gaaguuugaaaauuuaaugcaauuuuuaagugcuuauuuuuauaacccaaccccuggaaaacua

SEQ ID NO: 591514 - RNA, 64 nt, Homo Sapiens
agagacgggguuucaccguggcuaauuuuuuuuguauuuuuaguggugccugccaccacaccca

SEQ ID NO: 591515 - RNA, 64 nt, Homo Sapiens
uuuucauucacucuucuguucaccauuauuguuuuauuuuuaaacauucaggaauagauuuaua

SEQ ID NO: 591516 - RNA, 64 nt, Homo Sapiens
auauucaaacaaaacuaaaaaaauaaguaagaacuauuuuuaaauucccaauacguuucauaga

SEQ ID NO: 591517 - RNA, 64 nt, Homo Sapiens
ugcuuuuugcugcuaguuucguuaucuuccauucuauuuuuaucaauuuugauauuagucuuau

SEQ ID NO: 591518 - RNA, 64 nt, Homo Sapiens
ggacuuuuuaagaguuccuugugcaacaauuuaauauuuuuaagucuuuuccacuguuuguaag

SEQ ID NO: 591519 - RNA, 64 nt, Homo Sapiens
uauaagugggcauaaaauaauugaauaaaagguuuauuuuuauuuucccagauuuuauauacuc

SEQ ID NO: 591520 - RNA, 64 nt, Homo Sapiens
uuuauuuuccuguuguacaaaguaaaaaaaaacauauuuuuaacuuuaugaaaacucaacauug

SEQ ID NO: 591521 - RNA, 64 nt, Homo Sapiens
gaaguaaguuauagcauacuuugugauaugcuuauauuuuuaagauauauuuauucuuuaguuu

SEQ ID NO: 591522 - RNA, 64 nt, Homo Sapiens
uuuaugcugaacuguucaauucauucugauucuauauuuuuagcuacauuauuuacugccuauu

SEQ ID NO: 591523 - RNA, 64 nt, Homo Sapiens
uucuuuuuuaaaaaauuauaagcauaagacgugauauuuuuaauaaauauaucuauauauauuu

SEQ ID NO: 591524 - RNA, 64 nt, Homo Sapiens
uugccuaaaucccuguauucgcauauaaacuuuuuauuuuuaacacaauauucagaaaguuuaa

SEQ ID NO: 591525 - RNA, 64 nt, Homo Sapiens
ggguguuaacuuugacagcuuuugcuuuguagaguauuuuuauuguuauuugcaaguguauuuc

SEQ ID NO: 591526 - RNA, 64 nt, Homo Sapiens
ucuguucuuuauaacaaggugcaggugguucuaauauuuuuagcuuauuuuguuacacuaaagg

SEQ ID NO: 591527 - RNA, 64 nt, Homo Sapiens
ugcucucaucagaaaugucauuuaaguauuguuuuauuuuuauggagcauuuuauauccacauc

SEQ ID NO: 591528 - RNA, 64 nt, Homo Sapiens
gagcuaucuguuuauguagauaaugagagaguacuauuuuuaagucuuucugucaaauuagauu

SEQ ID NO: 591529 - RNA, 64 nt, Homo Sapiens
aauuuacaucaagagaggcaugauacuguaauaauauuuuuaaaguuguuguuaguggggacua

SEQ ID NO: 591530 - RNA, 64 nt, Homo Sapiens
aaacagcauugauugaagcaauucguugcuuugcuauuuuuacacagcuuugauugauuucagc

SEQ ID NO: 591531 - RNA, 64 nt, Homo Sapiens
uuuuuuugauaauagagaaaaaauaaacucaaaguauuuuuaaagcuguaaagaugaaggcauc

SEQ ID NO: 591532 - RNA, 64 nt, Homo Sapiens
auagacgggguuucaccaugcuggcuaauuuuuguauuuuuauuacaggcacacacuaccacgc

SEQ ID NO: 591533 - RNA, 64 nt, Homo Sapiens
guaacuuauuugacuauuaaguuuuugaguuauuuauuuuuacauuucacuuuaucuuauugga

SEQ ID NO: 591534 - RNA, 64 nt, Homo Sapiens
uaucuuuacaauuauuaucugcccagccggaauuuauuuuuaauuuacaggcgugagccaccgc

SEQ ID NO: 591535 - RNA, 64 nt, Homo Sapiens
uuuauuaguugauuuucauuuuucaguuguauuuuauuuuuaguuuuuaaaugaguuuuguuag

SEQ ID NO: 591536 - RNA, 64 nt, Homo Sapiens
ucauguacacacagaaaaaaaaaccagucauuuuuauuuuuauuuuuugagacagaguuucgcu

SEQ ID NO: 591537 - RNA, 64 nt, Homo Sapiens
cagacacccaucaccacgcccagcuaauuuuauguauuuuuaguagagaugggguuucaccaug

SEQ ID NO: 591538 - RNA, 64 nt, Homo Sapiens
uaaacuugaaacaaaaauggacaaauaucuaaaauauuuuuaaauguauguauuuuaauuggca

SEQ ID NO: 591539 - RNA, 64 nt, Homo Sapiens
caggcgcccgccaccacgccuggcuaauuuuuuguauuuuuaguagagacgggauuuuaucaug

SEQ ID NO: 591540 - RNA, 64 nt, Homo Sapiens
guagcugggauuacagcugccugccaaauuuuuguauuuuuaguggaaccgggguuucaccaug

SEQ ID NO: 591541 - RNA, 64 nt, Homo Sapiens
ucaaauaaaauguuuuuuuguauuuucuccaaguuauuuuuauauguaaaguuaaaauuagaua

SEQ ID NO: 591542 - RNA, 64 nt, Homo Sapiens
auagugaagauggaauaugucugcuacaaaugcuuauuuuuauuguugcuauuuucaguguaua

SEQ ID NO: 591543 - RNA, 64 nt, Homo Sapiens
gaaauaauaccucaagauaaucugauuuauuagcuauuuuuaaacauuuuuaaucacaagcugu

SEQ ID NO: 591544 - RNA, 64 nt, Homo Sapiens
caaaccuugauccauuuugacauuuguuaugcacuauuuuuauaucucugugagagauuuuucc

SEQ ID NO: 591545 - RNA, 64 nt, Homo Sapiens
aauuuuucauauucuugucauuaauauuauuuuguauuuuuauguggaaauauauaauuuuaug

SEQ ID NO: 591546 - RNA, 64 nt, Homo Sapiens
caagaauauguauuaauagugccuaauguaucuauauuuuuauuauucaugaauuaaauuacua

SEQ ID NO: 591547 - RNA, 64 nt, Homo Sapiens
aaagcaacagcaagacauauuuuguuagauauuuuauuuuuaauguuuucuauaauuuaaaaau

SEQ ID NO: 591548 - RNA, 64 nt, Homo Sapiens
uaauaugaccuuuuuaaauuuuuuuuauuuuuuuuauuuuuauuucuuuaagauggagucuugc

SEQ ID NO: 591549 - RNA, 64 nt, Homo Sapiens
gauuacaggcagcaccacaccuggcuaauuuucauauuuuuaguagagaugggguuucaacaua

SEQ ID NO: 591550 - RNA, 64 nt, Homo Sapiens
gugcagaaaauauuuaauaucaaaagaaaauugauauuuuuauacaaguaauuuccugagcuaa

SEQ ID NO: 591551 - RNA, 64 nt, Homo Sapiens
cacacuugaagccuaaauuugugcuuuuuaagaauauuuuuagacuauuucuuuuuauaggggc

SEQ ID NO: 591552 - RNA, 64 nt, Homo Sapiens
acaggcgcaugccaccaugcccagcuaauuuuuguauuuuuaguagaggcgggguuucaccaug

SEQ ID NO: 591553 - RNA, 64 nt, Homo Sapiens
aaaaucauuuuuauaaaauggggggaaauacugguauuuuuauaaucucgcagauaaaaaaggg

SEQ ID NO: 591554 - RNA, 64 nt, Homo Sapiens
cuuugagggguucuuuucugguagcucaggcaauuauuuuuaccauaucagcacaugacaaggc

SEQ ID NO: 591555 - RNA, 64 nt, Homo Sapiens
uacagacucaugccaccacgccagcuaauuuuuguauuuuuaguagagacgggguuucaccaug

SEQ ID NO: 591556 - RNA, 64 nt, Homo Sapiens
auuacauauauaaaacuaaggcuuuuauuucuguuauuuuuaagcuuuuauuucuuguagcuaa

SEQ ID NO: 591557 - RNA, 64 nt, Homo Sapiens
auucuucuugaaaauaaaaaauauugaaaugcuguauuuuuacagcuacuuuaaccuaugauaa

SEQ ID NO: 591558 - RNA, 64 nt, Homo Sapiens
gauagcagacauuguuacaaggacauggugagucuauuuuuaaugcaccaaucuuguuuauagc

SEQ ID NO: 591559 - RNA, 64 nt, Homo Sapiens
acaggcaugaaccaccacaccuggauaauuuuuguauuuuuaguagacacaaaguuucaccaug

SEQ ID NO: 591560 - RNA, 64 nt, Homo Sapiens
caaaguauuugacaucuuaagcaaauauccagaauauuuuuaaguaaaaaaccaucuuaaguau

SEQ ID NO: 591561 - RNA, 64 nt, Homo Sapiens
uguguacuuugucauguauggaguuucuaucuuuuauuuuuacuaaauaacuauagauauguau

SEQ ID NO: 591562 - RNA, 64 nt, Homo Sapiens
aucaacaaagcaucgaugauggacagucucacacuauuuuuaucauauguuucuuugucagccu

SEQ ID NO: 591563 - RNA, 64 nt, Homo Sapiens
acaggcgugcacuaccacacccagcugauuuuuguauuuuuaguauagaugggguuucaccaug

SEQ ID NO: 591564 - RNA, 64 nt, Homo Sapiens
aacaauuuguuuuaauuuuuuauauauauguuuuuauuuuuaaaaaacauaccaguugaauggg

SEQ ID NO: 591565 - RNA, 64 nt, Homo Sapiens
ugcaauccgauggaucuaauuaaaaaaaaggcaauauuuuuauauuaaaguacuauacuaggag

SEQ ID NO: 591566 - RNA, 64 nt, Homo Sapiens
cuggguuuguguuacauauuuauauauuuuauuuuauuuuuauaauauagacaucaccuagaug

SEQ ID NO: 591567 - RNA, 64 nt, Homo Sapiens
aucuacugcaaaacaccacuguuggaaaaauagguauuuuuaaauuguuuuuaaucuuuuuugg

SEQ ID NO: 591568 - RNA, 64 nt, Homo Sapiens
auacaaaugggauuauacuaaaauaaguaaugccuauuuuuaaggauagguuaaauuugugaau

SEQ ID NO: 591569 - RNA, 64 nt, Homo Sapiens
aaguuauuugucuucuuuucaaaauaauuagcuauauuuuuauauaauaugaauauauacauaa

SEQ ID NO: 591570 - RNA, 64 nt, Homo Sapiens
cauauuuuuguaaauaugacagaauuugugaauauauuuuuaaagcaaaaaacuucaacaugca

SEQ ID NO: 591571 - RNA, 64 nt, Homo Sapiens
uuacacucaggggucugaaaggcaguuugauuuuuauuuuuaacacacuugaaaaaagguugga

SEQ ID NO: 591572 - RNA, 64 nt, Homo Sapiens
ucccuaguguuucuuaauuucuuuuuagaaaguguauuuuuauuaguauuuuuccggugaacag

SEQ ID NO: 591573 - RNA, 64 nt, Homo Sapiens
uauaggcaugcaccaccaugcccagcuaauuuuguauuuuuauuagagacaggguuucuccgug

SEQ ID NO: 591574 - RNA, 64 nt, Homo Sapiens
uuagcugaagguaaaucaauggaaaaaugaaauuuauuuuuaauauuacuacuauaugaauuau

SEQ ID NO: 591575 - RNA, 64 nt, Homo Sapiens
uuaaaacagaagcucucuccuucauuaauuuaaauauuuuuaucggcucuagaaaaugcauaag

SEQ ID NO: 591576 - RNA, 64 nt, Homo Sapiens
gcuuuuauuaucuuuaaacuuguugcauuuaaaauauuuuuaaaaccuucuuaacaaaacuucu

SEQ ID NO: 591577 - RNA, 64 nt, Homo Sapiens
auaucauuaaguauauaaacaaucauuacuucuguauuuuuaaugaaugcaggaaaauaauauu

SEQ ID NO: 591578 - RNA, 64 nt, Homo Sapiens
uacuucuguauuuuuaaugaaugcaggaaaauaauauuuuuauguauaaaagaugaagaaaaaa

SEQ ID NO: 591579 - RNA, 64 nt, Homo Sapiens
uaauaugaaaaacaaauuuuuuaauucauaaaaguauuuuuauuagauuucauaugcaugaaac

SEQ ID NO: 591580 - RNA, 64 nt, Homo Sapiens
aggugccugccaccaugccuggcuaauuuuuuuguauuuuuaguagaaacagggugucaccaug

SEQ ID NO: 591581 - RNA, 64 nt, Homo Sapiens
uagucgugagccaccacgccuggccagaguuuuuuauuuuuaucaccaccauagauguuacagu

SEQ ID NO: 591582 - RNA, 64 nt, Homo Sapiens
acaggcgccugccaccacgcccagcuaauuuuuguauuuuuaguagagaugggguuucaccaug

SEQ ID NO: 591583 - RNA, 64 nt, Homo Sapiens
ucuacaaaaaaauuuguuuuuauuuguauuuauauauuuuuauuuuuguuuuuguugguaggcg

SEQ ID NO: 591584 - RNA, 64 nt, Homo Sapiens
acaggugugugucaccacgcccggcuaauuuuuguauuuuuaguagagaugggguuucaccaug

SEQ ID NO: 591585 - RNA, 64 nt, Homo Sapiens
uuuuugggagagaauauuucgcuccucucauuuuuauuuuuauucccaucaaaauguaagcugu

SEQ ID NO: 591586 - RNA, 64 nt, Homo Sapiens
aaaucgagauuuaguaaaucuaagagcaauaaauuauuuuuaagaauaauaauaaaaagacuau

SEQ ID NO: 591587 - RNA, 64 nt, Homo Sapiens
uuauguauauacuauacaacgauguuaaauggaguauuuuuauugauguaguuaaguauuuaca

SEQ ID NO: 591588 - RNA, 64 nt, Homo Sapiens
auacuguuagcucaguuauuagaauuuuuuuacauauuuuuauauaucugguaauuaugaaucu

SEQ ID NO: 591589 - RNA, 64 nt, Homo Sapiens
agagacaggguuucaccauguggcuaauuuuuuguauuuuuagucaggcacccgccacagugcc

SEQ ID NO: 591590 - RNA, 64 nt, Homo Sapiens
cuuacaaaauuuccuguaaaucuauaccaguaccuauuuuuacuaugcauaauauuuucaaagu

SEQ ID NO: 591591 - RNA, 64 nt, Homo Sapiens
cuaucaguuacugaagacuuagaagaaauugauuuauuuuuaaauccaagauauuguauuccca

SEQ ID NO: 591592 - RNA, 64 nt, Homo Sapiens
uaaauuuucuuuaauuuacuuuaaaauacucacauauuuuuacuuaguugcaaaauccaguagg

SEQ ID NO: 591593 - RNA, 64 nt, Homo Sapiens
cacaguaaaucuucagcaacacgccuggccggcuuauuuuuaucgauuacaggugugagccacc

SEQ ID NO: 591594 - RNA, 64 nt, Homo Sapiens
agagacgggguuucaccaugccggcuaauuuuuguauuuuuaguacaggcaugugccacaguuc

SEQ ID NO: 591595 - RNA, 64 nt, Homo Sapiens
cuuuuuugggaaauacuuguuucaggaaauaaucuauuuuuacuauauuauuuauuaaauguag

SEQ ID NO: 591596 - RNA, 64 nt, Homo Sapiens
aaaaccagaaaacacuguauuuuauuuaaguaaauauuuuuauaauuuagauuuauuuuaaaag

SEQ ID NO: 591597 - RNA, 64 nt, Homo Sapiens
ucuuuaaauaccuaucuucugaaaaaauuuguucuauuuuuacaauuugggcacauucagagug

SEQ ID NO: 591598 - RNA, 64 nt, Homo Sapiens
augcucaacauuaacuauucauggucaauaaguauauuuuuaaaucccaaaggaagacauauac

SEQ ID NO: 591599 - RNA, 64 nt, Homo Sapiens
aauuguauuguaauuccaugugguaaaggaaaguuauuuuuaaauugucuuuaacaaugucuau

SEQ ID NO: 591600 - RNA, 64 nt, Homo Sapiens
agacacaggguuucuccaugccaggcuaauuuuguauuuuuaguuacaggcaugcaccaccaca

SEQ ID NO: 591601 - RNA, 64 nt, Homo Sapiens
uccugcauaccauuagaauaaaaugacuuuauuuuauuuuuauuguuuuuauaaaaaguuaugc

SEQ ID NO: 591602 - RNA, 64 nt, Homo Sapiens
gaaaaauauuuuguuguuuuuaaaaaaccuaauuuauuuuuacaacuagaagaacauuucagua

SEQ ID NO: 591603 - RNA, 64 nt, Homo Sapiens
cuaggaaaaggaguuacuauauaguuucuggcacuauuuuuauauucaauauauuugaacaaau

SEQ ID NO: 591604 - RNA, 64 nt, Homo Sapiens
auucugguaaaaaaacaaaaacauaaugcaguuuuauuuuuaucgaguguguacaaauaucuug

SEQ ID NO: 591605 - RNA, 64 nt, Homo Sapiens
uuugcacaacuuuugagagucuuugccacugcuguauuuuuauugugucuguauuugguauaua

SEQ ID NO: 591606 - RNA, 64 nt, Homo Sapiens
uauuaccuuauuugaucuucuaggcuucaaaauguauuuuuauauaaacauguagaccgcuuua

SEQ ID NO: 591607 - RNA, 64 nt, Homo Sapiens
acacaaguagaaugauuuaauaaaagagucuuuuuauuuuuaaacaaauugaacuuucuaaaac

SEQ ID NO: 591608 - RNA, 64 nt, Homo Sapiens
cgaugaugaauuuugacaguuuuaaauuuauggcuauuuuuacauguuaguaauucugaaguuu

SEQ ID NO: 591609 - RNA, 64 nt, Homo Sapiens
cauauauuuuagcauauucgcaaaaggagucaguuauuuuuauuauuacaacuuuggugauaaa

SEQ ID NO: 591610 - RNA, 64 nt, Homo Sapiens
uacagaaguaugucucuuaauauaaauacauggauauuuuuaugaacucuguuccauacacuug

SEQ ID NO: 591611 - RNA, 64 nt, Homo Sapiens
uugguaaauuuuucuaaacacaacuuagaucaacuauuuuuagcuuuaauauucuuuuuuauga

SEQ ID NO: 591612 - RNA, 64 nt, Homo Sapiens
aaagguauuuaauauucuuuuuguuaaauauaucuauuuuuaccaacuguuggcuuuucuaauc

SEQ ID NO: 591613 - RNA, 64 nt, Homo Sapiens
acccugugguaaaagccucacagcucauuuuccauauuuuuaaacaaauuguuucuuugugcuu

SEQ ID NO: 591614 - RNA, 64 nt, Homo Sapiens
guagcuauguuugguuauuuccucacaauguguguauuuuuacaaaagaucaucaaugcuaaca

SEQ ID NO: 591615 - RNA, 64 nt, Homo Sapiens
cagugccaacauuuaaaaaaguaugaaaaugauuuauuuuuauaugauguauacccauaaagaa

SEQ ID NO: 591616 - RNA, 64 nt, Homo Sapiens
aaaauauuuuaggauaauugccuacagagggauuuauuuuuaugaugcuggaaauaugaaaugu

SEQ ID NO: 591617 - RNA, 64 nt, Homo Sapiens
ugauaaucuuucuccacuguucuaauauauauuguauuuuuauuugauagcuugggauuuaaaa

SEQ ID NO: 591618 - RNA, 64 nt, Homo Sapiens
auauuguauaguaucuugugcuaggugaggaaauuauuuuuaauuuugauaauuuaauauuccu

SEQ ID NO: 591619 - RNA, 64 nt, Homo Sapiens
uuuucccuaagugguaagcaauuacuuuaaaacauauuuuuaaaaacaucgguaucgggagcug

SEQ ID NO: 591620 - RNA, 64 nt, Homo Sapiens
acaggugcccaccaccaugccuggcuaguuuuuguauuuuuaguagaggcaagguuucaccauc

SEQ ID NO: 591621 - RNA, 64 nt, Homo Sapiens
ugauuauucauucuguuauacucuaacaucuguauauuuuuaccaguauucucagaccacuucu

SEQ ID NO: 591622 - RNA, 64 nt, Homo Sapiens
uuaucuuguaaaaacacuuuuuugguuuaauauauauuuuuaaaacauuucacuagugauugaa

SEQ ID NO: 591623 - RNA, 64 nt, Homo Sapiens
uuuuccauaugacacugguuccgauuuuaaaaauuauuuuuaaauaaccgauuauugauuacug

SEQ ID NO: 591624 - RNA, 64 nt, Homo Sapiens
uaacacaaguuuaccauuuuuaucaucuuuagauuauuuuuaaaucucacuaccuugaaguuug

SEQ ID NO: 591625 - RNA, 64 nt, Homo Sapiens
uaccuuugugcuuucuaaguauaaagauuuaaauuauuuuuaauacgguuuuuagaaccacaga

SEQ ID NO: 591626 - RNA, 64 nt, Homo Sapiens
gucauauuugauuuagaggguaacuuaaaucaguuauuuuuagcuuuuuagaacuuugaucugc

SEQ ID NO: 591627 - RNA, 64 nt, Homo Sapiens
agggauugucaaaauaaucuccuugaggcaucuuuauuuuuaaaaugagauuaaaguaugugau

SEQ ID NO: 591628 - RNA, 64 nt, Homo Sapiens
ggaagauacuuacaggggaaauuaauauuuugacuauuuuuauauauaaagaagaacucaaaaa

SEQ ID NO: 591629 - RNA, 64 nt, Homo Sapiens
ggcagagcuaucucucucauagcuuuuaugcccuuauuuuuauucaacugguauuaauguuuuu

SEQ ID NO: 591630 - RNA, 64 nt, Homo Sapiens
acaggugcccaccaccaugccuggcugguuuuuguauuuuuaguagaggcaagguuucaccauc

SEQ ID NO: 591631 - RNA, 64 nt, Homo Sapiens; identical to SEQ ID NO: 591621

SEQ ID NO: 591632 - RNA, 64 nt, Homo Sapiens
aguugcuuuuuucauaguucuuguuuucauguuuuauuuuuaaaaagacauauaaagauugcau

SEQ ID NO: 591633 - RNA, 64 nt, Homo Sapiens
acauuuccuaauaaaccccuuugauuuaaaaauguauuuuuaaaaauguuuacauugaugauga

SEQ ID NO: 591634 - RNA, 64 nt, Homo Sapiens
cucuucuagacuuuguguauaugauuuaaucuuuuauuuuuauuuuuguagaauggggguaaaa

SEQ ID NO: 591635 - RNA, 64 nt, Homo Sapiens
ggggguaaaacuacaaaucuccuccucagggugauauuuuuaaagauuaaggaguaugacauca

SEQ ID NO: 591636 - RNA, 64 nt, Homo Sapiens
ccagacccucgaggcugccacuccgucgugguuuuauuuuuaauauagagagaguuuugaauuc

SEQ ID NO: 591637 - RNA, 64 nt, Homo Sapiens
ucaucacaugacaaaggauaaugugcaagaaaaguauuuuuauguaucauaaauguauuuugaa

SEQ ID NO: 591638 - RNA, 64 nt, Homo Sapiens
auaggcacaugccaccgcgcccagcuaauuuuuguauuuuuaguagagaugggguuucaucaug

SEQ ID NO: 591639 - RNA, 64 nt, Homo Sapiens
aggcgccugccaccaugcccgccuaauuuuuuuguauuuuuaguagagaugggguuucaccgug

SEQ ID NO: 591640 - RNA, 64 nt, Homo Sapiens
aggccuuuuuuggcuuuagacacuggcugccagcuauuuuuacuagaacacagaaagccuauca

SEQ ID NO: 591641 - RNA, 64 nt, Homo Sapiens
uugggauuggugggaaaugucaaaacaugcccuuuauuuuuaaaggcauucacaaacucucuga

SEQ ID NO: 591642 - RNA, 64 nt, Homo Sapiens
caacagagagagacaugaguaagacccagauugcuauuuuuauuguuauuuuuaacaugaaucu

SEQ ID NO: 591643 - RNA, 64 nt, Homo Sapiens
acaugaguaagacccagauugcuauuuuuauuguuauuuuuaacaugaaucuaaaguuuauggu

SEQ ID NO: 591644 - RNA, 64 nt, Homo Sapiens
gaaaucaaucuuucuacuaauguaaauuugagauuauuuuuaaaaauggaauaaaagagguuuu

SEQ ID NO: 591645 - RNA, 64 nt, Homo Sapiens
gggacaauauuguauucaacuguuuuauuuuuuauauuuuuaaaauuuaaaguauaauuaguuu

SEQ ID NO: 591646 - RNA, 64 nt, Homo Sapiens
acugaauguaaugguugauauauguacauucugauauuuuuaaaucuuuaacuuuuuaaaguua

SEQ ID NO: 591647 - RNA, 64 nt, Homo Sapiens
gugcaugcagagaaaaucugugcauccucuuuuauauuuuuaaaauacuguuuaacauuuguga

SEQ ID NO: 591648 - RNA, 64 nt, Homo Sapiens
aaauaaacuaguauuuauaauauuuauauuuuuguauuuuuauguucauauuuuuauaaaugua

SEQ ID NO: 591649 - RNA, 64 nt, Homo Sapiens
aauguauauuuauauuuuuguguuaauucauucauauuuuuauauuaguugaagaaugucuuug

SEQ ID NO: 591650 - RNA, 64 nt, Homo Sapiens
auuucuuuaucacuuuauugugcuuuuuaaaguuuauuuuuacuauugucagacuauaaaccuu

SEQ ID NO: 591651 - RNA, 64 nt, Homo Sapiens
uugaaacagcacaguaaauaauacuuagcaaaauuauuuuuaaaauagacuucaguugagaugu

SEQ ID NO: 591652 - RNA, 64 nt, Homo Sapiens
uugucuugacaacugaaagaacuuuaugcaaccauauuuuuacuagcaguuuauauuuuuugug

SEQ ID NO: 591653 - RNA, 64 nt, Homo Sapiens
guuacaaauuuguauauggauuaacagaagacuguauuuuuaaagcagcauaauguuccugaug

SEQ ID NO: 591654 - RNA, 64 nt, Homo Sapiens
guagacgggguuucacuaugcggcuaauuuuucguauuuuuagucaggcgugugccaccacacc

SEQ ID NO: 591655 - RNA, 64 nt, Homo Sapiens
uaaugucaaaucuuuuuccagcccuaauaaauaauauuuuuaccuauaaugugguaccaccuca

SEQ ID NO: 591656 - RNA, 64 nt, Homo Sapiens
uuuucaacugacuaacuucagaauuguucuuuuuuauuuuuauugaagauuuauuccaauucua

SEQ ID NO: 591657 - RNA, 64 nt, Homo Sapiens
ucugugcuuucuuuuucaugacagaauuuaaggguauuuuuaucuuaacauguuuguaauugcu

SEQ ID NO: 591658 - RNA, 64 nt, Homo Sapiens
aaacucaaugcuaguuuuaauguuuggccauuaguauuuuuauaauugccuuaguuuuuaaaaa

SEQ ID NO: 591659 - RNA, 64 nt, Homo Sapiens
auggcauuuauauauaguucaaagcacuuucguauauuuuuauucuuuucuuaucuguacuucc

SEQ ID NO: 591660 - RNA, 64 nt, Homo Sapiens
agagacgggguuucaccaugacuaaaaauacuuguauuuuuaguuuacaccaccaugcccagcu

SEQ ID NO: 591661 - RNA, 64 nt, Homo Sapiens
agagaugggguuucaccaugccagcuaauuuuuguauuuuuaguacaggcaccugccaccacgc

SEQ ID NO: 591662 - RNA, 64 nt, Homo Sapiens
acugaaauccugagcaacagugucuugauuuggcuauuuuuauauuuuaagcuguaauugucuu

SEQ ID NO: 591663 - RNA, 64 nt, Homo Sapiens
acuucuugugagucuuaaguggaucucucugaacuauuuuuauaagcuaagcaguggguaccug

SEQ ID NO: 591664 - RNA, 64 nt, Homo Sapiens
agagaugggguuucaccaugauuuuuguauuuuguauuuuuagucgcgccaccacgcccggcua

SEQ ID NO: 591665 - RNA, 64 nt, Homo Sapiens
uuagaaaagguuuuuuguugcugaaaaaaguauguauuuuuacauuaaguuguucccccucccu

SEQ ID NO: 591666 - RNA, 64 nt, Homo Sapiens
uuccaagaugccgugugugcaaauuggcaagauguauuuuuacuuguaacugcacaauagcaga

SEQ ID NO: 591667 - RNA, 64 nt, Homo Sapiens
ucaauagcacaaaggaaaacuuaaauaaagccauuauuuuuauaaaauaaucacuuacuaagcc

SEQ ID NO: 591668 - RNA, 64 nt, Homo Sapiens
guauuauuuaaagauaaagguacuuuaaacuugauauuuuuagucauguagaguauuauguuua

SEQ ID NO: 591669 - RNA, 64 nt, Homo Sapiens
uagaugucauauuuuuuuaaaguacaguucucaauauuuuuaauuggaaaaggauauucacagu

SEQ ID NO: 591670 - RNA, 64 nt, Homo Sapiens
ggagacggauuuucaccguguggcuaauuuuuuguauuuuuagucaggcgccugccaccacgcc

SEQ ID NO: 591671 - RNA, 64 nt, Homo Sapiens
guucuuauacuuuuuaaaagaaacuuuaaguaauuauuuuuaaaaugcauaugagugaggaaau

SEQ ID NO: 591672 - RNA, 64 nt, Homo Sapiens
auaaauguuuuuauucuuuauugaugcuaaaugguauuuuuaaagccugccaaacuuggggcaa

SEQ ID NO: 591673 - RNA, 64 nt, Homo Sapiens
gcugucauuacacuuaaaguuugacagcauaauuuauuuuuaaugaaaagauauuuuuuguaua

SEQ ID NO: 591674 - RNA, 64 nt, Homo Sapiens
aaaaagcaguagaaaauuacuguugucuuuuuuauauuuuuauguagguuuuuaaaacuauaaa

SEQ ID NO: 591675 - RNA, 64 nt, Homo Sapiens
uuuauguucagaaaguuaucuaauaaaugugcucuauuuuuacacuuaggaguuuuccuacuau

SEQ ID NO: 591676 - RNA, 64 nt, Homo Sapiens
agcugacuuacaugaucguuaauuuguuaaagaauauuuuuaacaaguguggauaucaauauaa

SEQ ID NO: 591677 - RNA, 64 nt, Homo Sapiens
auuagaggaaaaugaccauucuccauuuuuuuucuauuuuuaagcucuucaccaccacuaccca

SEQ ID NO: 591678 - RNA, 64 nt, Homo Sapiens
uuuuuaaaugaaaccauauuuugaaguguugaaguauuuuuaauacuaaguggagacuuaguuu

SEQ ID NO: 591679 - RNA, 64 nt, Homo Sapiens
cuggcuuuuaaaaugggaaucugugguuaauguauauuuuuauuuccaguuagaguaaguacuu

SEQ ID NO: 591680 - RNA, 64 nt, Homo Sapiens
ugcucauuaugauuccuccuaagcuuuccuuuaauauuuuuacccuuuugagcuggggcauuua

SEQ ID NO: 591681 - RNA, 64 nt, Homo Sapiens
uggcuaaaauaaucuaaaaguccaucuguaaauuuauuuuuauuauguuaguggaccucaguua

SEQ ID NO: 591682 - RNA, 64 nt, Homo Sapiens
ugcauucucuauggcuauauaauguacguaaaucuauuuuuaaagguucagaggaauccauacc

SEQ ID NO: 591683 - RNA, 64 nt, Homo Sapiens
aggugugaucuaccacaccugucuaaaaaguauguauuuuuaaauuuuuuuguagagacaggau

SEQ ID NO: 591684 - RNA, 64 nt, Homo Sapiens
uaaagacuguuuauaaaggagagagcuggcgacuuauuuuuauuuuuauuuuuuggacagaguc

SEQ ID NO: 591685 - RNA, 64 nt, Homo Sapiens
cuguuuauaaaggagagagcuggcgacuuauuuuuauuuuuauuuuuuggacagagucucccuu

SEQ ID NO: 591686 - RNA, 64 nt, Homo Sapiens
caggcgucugccaccaugcccagcuacuuuuuuguauuuuuaguagauacgggguuucaccgug

SEQ ID NO: 591687 - RNA, 64 nt, Homo Sapiens
aaugccaaacaaaguuaaauuacaguuaucaaaguauuuuuaaaacuucauagugauaaaugag

SEQ ID NO: 591688 - RNA, 64 nt, Homo Sapiens
guucauauuagugagcauggcuuacugcuuuauuuauuuuuauuucuugucagggaguauucuc

SEQ ID NO: 591689 - RNA, 64 nt, Homo Sapiens
cuuaucuccucucauugggaaagcuacaugauaguauuuuuaugcacucuucucccacacauac

SEQ ID NO: 591690 - RNA, 64 nt, Homo Sapiens
gaggagacgaagugaaaacaaaucuauaaauauauauuuuuaaaauauuuaacuuuuuuuuaug

SEQ ID NO: 591691 - RNA, 64 nt, Homo Sapiens
aggacaugcgugugucagggaugaguugaggugauauuuuuaugugcagcgacccuugguguuu

SEQ ID NO: 591692 - RNA, 64 nt, Homo Sapiens
augugcacaguaguuuuuuuauugaaacuuguauuauuuuuaaagagaucuauacuauaaauau

SEQ ID NO: 591693 - RNA, 64 nt, Homo Sapiens
uguguguguguguguguguguauauauauauauauauuuuuacuuuuauccucuuaccgaaggu

SEQ ID NO: 591694 - RNA, 64 nt, Homo Sapiens
auuaggugccaaaauacccagcacaauacuuguauauuuuuaguaccauacagaaguaaaaucc

SEQ ID NO: 591695 - RNA, 64 nt, Homo Sapiens
gggccugagaaaagaaugggagggggcuauuaauuauuuuuagcaaaauguugccuuugucuug

SEQ ID NO: 591696 - RNA, 64 nt, Homo Sapiens
caaacaaauuauauuguacuuguaucuuuuuaccuauuuuuauacuuuuuauaauguuuacguu

SEQ ID NO: 591697 - RNA, 64 nt, Homo Sapiens
aauauagucccacagaauacuuauguucacuuucuauuuuuaaaagacuacucugaaaaacacu

SEQ ID NO: 591698 - RNA, 64 nt, Homo Sapiens
caggugugcaccaacaugcccagcuaauuuuuuauauuuuuaguagagacgggguuucaccaug

SEQ ID NO: 591699 - RNA, 64 nt, Homo Sapiens
ccaagguagugaugguggccacgugccucguugcuauuuuuaaaguaauauucagaugugguuu

SEQ ID NO: 591700 - RNA, 64 nt, Homo Sapiens
aagagaugcaacauacuacuuuugugucacaauuuauuuuuaucacccucucuaggguaacgug

SEQ ID NO: 591701 - RNA, 64 nt, Homo Sapiens
cuuauucucauggucuuaaauuaaauuauucaaguauuuuuaaauauccaauuuguugugauuu

SEQ ID NO: 591702 - RNA, 64 nt, Homo Sapiens
augaguuccacucccuuugaugauauauguuguauauuuuuaguuguaaagcaguaaucuuuaa

SEQ ID NO: 591703 - RNA, 64 nt, Homo Sapiens
aguguguauaaaagucuccuuuuuaaaaagaucauauuuuuaaauaaagcauuuuuuguagaaa

SEQ ID NO: 591704 - RNA, 64 nt, Homo Sapiens
augguauaacuccuaaagcuuucucugcuccaguuauuuuuauuaaauauuuuucacuuggcuu

SEQ ID NO: 591705 - RNA, 64 nt, Homo Sapiens
ccaguuauuuuuauuaaauauuuuucacuuggcuuauuuuuaaaacugggaacauaaagugccu

SEQ ID NO: 591706 - RNA, 64 nt, Homo Sapiens
auuucacuuuucucgaucacuaaacauaugcauauauuuuuaaaaaucaguaaaagcauuacuc

SEQ ID NO: 591707 - RNA, 64 nt, Homo Sapiens
uuauuacuguaagaaauaguuuuauaaaaaauuauauuuuuauucaguaauuuaauuuuguaaa

SEQ ID NO: 591708 - RNA, 64 nt, Homo Sapiens
uaggcacgugccaccacacccggcuaauuuuuuguauuuuuaguagagacagcguuucaccaug

SEQ ID NO: 591709 - RNA, 64 nt, Homo Sapiens
auuuuucgucuauucuuaauauuuuuuaauuauuuauuuuuaagaguuuuauaccuugagcaga

SEQ ID NO: 591710 - RNA, 64 nt, Homo Sapiens
guuugucuuccacagggaagcuuaaaacaaaagauauuuuuaacccacugacagaacaacaagg

SEQ ID NO: 591711 - RNA, 64 nt, Homo Sapiens
ccauagacccaaagcccuuacguuugaugcaauuuauuuuuaaaauaggccuuguuuuucagcu

SEQ ID NO: 591712 - RNA, 64 nt, Homo Sapiens
aguuucucauuuauauuuaacguauuggaccugauauuuuuagugggugcauucuuccagaaag

SEQ ID NO: 591713 - RNA, 64 nt, Homo Sapiens
agacacccgccaacacgccaggcuaauguuuuuguauuuuuaauagagaugggguuuugccaug

SEQ ID NO: 591714 - RNA, 64 nt, Homo Sapiens
acacucaaauaguauucucuucuuuugaaaauuuuauuuuuaucugaaaauaacaguugaucug

SEQ ID NO: 591715 - RNA, 64 nt, Homo Sapiens
guaauacuguauaaagaccucaaucuauccagaguauuuuuauauaauguuggaugaguuagga

SEQ ID NO: 591716 - RNA, 64 nt, Homo Sapiens
aaaauuuacucaaaucaaaguuaaguacagaguuuauuuuuaacaaaugucauagcuaugucac

SEQ ID NO: 591717 - RNA, 64 nt, Homo Sapiens
aaucucuguauccuuagauacgugguaguucuuuuauuuuuauuuacuuggagggcacuucuuu

SEQ ID NO: 591718 - RNA, 64 nt, Homo Sapiens
agagacgggguuucaccgugcggcuaauuuuuuguauuuuuagucaggcgcccgccaccacgcc

SEQ ID NO: 591719 - RNA, 64 nt, Homo Sapiens
acaauaguuugaagcaguaagggcuuuauuuauuuauuuuuaccaggcgugagccaccacgcca

SEQ ID NO: 591720 - RNA, 64 nt, Homo Sapiens
agagacgggguuucgccaugaccacgcgaacuuguauuuuuaguugggauuacaggcgcgcgcc

SEQ ID NO: 591721 - RNA, 64 nt, Homo Sapiens
auuuccaaacaaauguacugcuaauuuguagaauuauuuuuacguagcaacauaauauauggag

SEQ ID NO: 591722 - RNA, 64 nt, Homo Sapiens
agagacgggguuucacugugcagcuaauuuuuuguauuuuuagucaggcgcccgccaccacgcc

SEQ ID NO: 591723 - RNA, 64 nt, Homo Sapiens
uuuguaaauagcuuuaaauucauuuauguacauuuauuuuuaaauguuuaaugugaugugaaua

SEQ ID NO: 591724 - RNA, 64 nt, Homo Sapiens
uaucauguaaccucaaagugugccucuauuaauguauuuuuauuaaggaaccaauaaauaaucc

SEQ ID NO: 591725 - RNA, 64 nt, Homo Sapiens
uuagaacuuugaccuaauuuugauacacaacugcuauuuuuaauauugcuagaauaagguaaau

SEQ ID NO: 591726 - RNA, 64 nt, Homo Sapiens
uuuuuucaauaaagauauucuggcgaacugauuuuauuuuuaaugccacacuucuaacugcuuc

SEQ ID NO: 591727 - RNA, 64 nt, Homo Sapiens
cacacaccucuaaggaagaagggaaacgugagacuauuuuuaaaaagagccacuuagccugaau

SEQ ID NO: 591728 - RNA, 64 nt, Homo Sapiens
agagaugggguuucacugugagcuaauuuuuuuguauuuuuaguaggcaccugccaccgcgccc

SEQ ID NO: 591729 - RNA, 64 nt, Homo Sapiens
ccuagauauggaggaaacauugagggaggguggauauuuuuauuauguguacaugaugaaucau

SEQ ID NO: 591730 - RNA, 64 nt, Homo Sapiens
uaucuuggucauaaguuggcuagauuuaaacuuuuauuuuuacuugauacaacagcuccacuca

SEQ ID NO: 591731 - RNA, 64 nt, Homo Sapiens
ccaaggauuugcaucgugaaagggcaauauggauuauuuuuauauggauugcuuuauuauauuc

SEQ ID NO: 591732 - RNA, 64 nt, Homo Sapiens
uuccaggcauagcaauguuacuaacagauuuggauauuuuuaaucuuuccuuuuccacuucuuu

SEQ ID NO: 591733 - RNA, 64 nt, Homo Sapiens
uaaagaagaauuuuucuccagucaguauuacugguauuuuuaaagugaauugcuuuugaagucu

SEQ ID NO: 591734 - RNA, 64 nt, Homo Sapiens
cggguuaucaaauuugauuuauaaagcuggaaaauauuuuuagugcugugcagcuccuuaaaua

SEQ ID NO: 591735 - RNA, 64 nt, Homo Sapiens
ucucugugguuuugaaacuuccaaggauuauguauauuuuuauacaugcagugacauacaaaga

SEQ ID NO: 591736 - RNA, 64 nt, Homo Sapiens
agagaugggguuucacccuacuggcuaauuuuuguauuuuuaguacgggcacgcaccaccacgu

SEQ ID NO: 591737 - RNA, 64 nt, Homo Sapiens
gcauguuaaaaauuuagguuagauauagagugacuauuuuuaaaucuccauucguauuuguauu

SEQ ID NO: 591738 - RNA, 64 nt, Homo Sapiens
gaaauagcugagaguuucuauuuacuaaccauucuauuuuuauaaaaauacacugaaugcuauu

SEQ ID NO: 591739 - RNA, 64 nt, Homo Sapiens
aaccauucuauuuuuauagaaauacacugaaugcuauuuuuacuuaaauagccucccuaaggaa

SEQ ID NO: 591740 - RNA, 64 nt, Homo Sapiens
uaaggauuuagaccagaggucuagauuaauacucuauuuuuacauuuaaaccuuuuauuauaag

SEQ ID NO: 591741 - RNA, 64 nt, Homo Sapiens
uuauaaaauuaaaaguuugaaaagcaauauuguauauuuuuaucuauauaaaauaacuaaaaug

SEQ ID NO: 591742 - RNA, 64 nt, Homo Sapiens
acuaaaaguaugagcguuaggacacuauuuuaauuauuuuuaauuuauuaauauuuaaauaugu

SEQ ID NO: 591743 - RNA, 64 nt, Homo Sapiens
gugaagcugaguuaauuuauguaagucauauuuauauuuuuaagaaguaccacuugaaacauuu

SEQ ID NO: 591744 - RNA, 64 nt, Homo Sapiens
uaggcuuaccucaaauaaauggcuaacuuauacauauuuuuaaagaaauauuuauauuguauuu

SEQ ID NO: 591745 - RNA, 64 nt, Homo Sapiens
aaauucuuaaagauguuggguuguuuauuagugguauuuuuauguugucuuauuuuagguaagc

SEQ ID NO: 591746 - RNA, 64 nt, Homo Sapiens
ugaaaaacacauacuaugccaccaauugucauauuauuuuuagaugauguaacauagccaucaa

SEQ ID NO: 591747 - RNA, 64 nt, Homo Sapiens
caauucuguuaaaugaaacguguaucguaaaauguauuuuuauuuuacccacgagaauguuguu

SEQ ID NO: 591748 - RNA, 64 nt, Homo Sapiens
aaauguauuuuuauuuuacccacgagaauguuguuauuuuuagcaaauagaacucaaugcagug

SEQ ID NO: 591749 - RNA, 64 nt, Homo Sapiens
guaaaaaaauuaaggucaaugaaagccauucuguuauuuuuagcauucucacuuauuuagacuc

SEQ ID NO: 591750 - RNA, 64 nt, Homo Sapiens
uccaccaggcaauagacaggagagaggugagaacuauuuuuagaaggaggaaaaguagauacgc

SEQ ID NO: 591751 - RNA, 64 nt, Homo Sapiens
caggcacacaucgccacacccggcuaauuuuuaguauuuuuaguagagacgggguuucaccgug

SEQ ID NO: 591752 - RNA, 64 nt, Homo Sapiens
gccaccguguccggccguaguuuauuuuaaaauauauuuuuaaaagcuuuguaaaaauuauguc

SEQ ID NO: 591753 - RNA, 64 nt, Homo Sapiens
auaggcgagugccaucaugcccggcuaauuuuuguauuuuuaguagagugaggguuucaccaug

SEQ ID NO: 591754 - RNA, 64 nt, Homo Sapiens
ggauuacaggcaugagccacagugcccggccaaguauuuuuauauuucagaucauaucuacuga

SEQ ID NO: 591755 - RNA, 64 nt, Homo Sapiens
gguucacuuuuuuuuacauuuauuuuagucuuuauauuuuuauuuuuaagcauugauguacuua

SEQ ID NO: 591756 - RNA, 64 nt, Homo Sapiens
cuuuuuuuuacauuuauuuuagucuuuauauuuuuauuuuuaagcauugauguacuuaguuguu

SEQ ID NO: 591757 - RNA, 64 nt, Homo Sapiens
cuuggugcaaaguguaucauguggaauauccucauauuuuuaccauauuuuaagaacuuuaaga

SEQ ID NO: 591758 - RNA, 64 nt, Homo Sapiens
ucacagcugccauauaaaguucuacucaugccauuauuuuuaugacuucuacguucaguuacaa

SEQ ID NO: 591759 - RNA, 64 nt, Homo Sapiens
gugcccgccaccaugcccggcugauuucuuuuuguauuuuuaguagagacggaguuucaccgug

SEQ ID NO: 591760 - RNA, 64 nt, Homo Sapiens
ucauggacuuccucaaaaugaagugcuauuuucuuauuuuuaaucaaauaacuagacauauauc

SEQ ID NO: 591761 - RNA, 64 nt, Homo Sapiens
uagaggaauagaaguuuauauauauauaauaccauauuuuuaauuucacaaauaaaaaauucaa

SEQ ID NO: 591762 - RNA, 64 nt, Homo Sapiens
aaacucaaaauaagacaaguaauuuguugauaaauauuuuuaaagauaacucagcauguuugua

SEQ ID NO: 591763 - RNA, 64 nt, Homo Sapiens
acauuuaaaguguuauauuuuuuauaaaaauguuuauuuuuaaugauaugagaaaaauuuuguu

SEQ ID NO: 591764 - RNA, 64 nt, Homo Sapiens
gaggaggcugaguuuccagagcuuugcuuucauuuauuuuuauacacauugucucucuauaucu

SEQ ID NO: 591765 - RNA, 64 nt, Homo Sapiens
uuaagcaagugaaauucugcugcccuccaccauuuauuuuuacagugcuuuguaauuuuuuuca

SEQ ID NO: 591766 - RNA, 64 nt, Homo Sapiens
aaugggaaagguuuaaaugcuaaccaaagcaauuuauuuuuaauuaauauuuuuagacucugug

SEQ ID NO: 591767 - RNA, 64 nt, Homo Sapiens
uaaaugcuaaccaaagcaauuuauuuuuaauuaauauuuuuagacucugugcugucauacugaa

SEQ ID NO: 591768 - RNA, 64 nt, Homo Sapiens
guuacaaacgcagauaucuauagaaagcaaugccuauuuuuaaagagcagcacuuagugcuuca

SEQ ID NO: 591769 - RNA, 64 nt, Homo Sapiens
auggcagcuauaaaguuaaccuuucuaacaguaguauuuuuagaugaaauuauaacaaaagaua

SEQ ID NO: 591770 - RNA, 64 nt, Homo Sapiens
auuguuuuguaaauaucuuuucuaaaugcauucauauuuuuaugaaaugcaaauagauccggug

SEQ ID NO: 591771 - RNA, 64 nt, Homo Sapiens
uuuuucaugcaugcauucucacgaagaauguuuuuauuuuuauuuuuuuuuuuuuuuuuuuuug

SEQ ID NO: 591772 - RNA, 64 nt, Homo Sapiens
uaagacguauacggcaccuuauuaauggaauguauauuuuuauagguuagggagaggauauaag

SEQ ID NO: 591773 - RNA, 64 nt, Homo Sapiens
ucccuggguggacagaauuugcugucugcauguuuauuuuuacucuggaaaacaugucuuuagg

SEQ ID NO: 591774 - RNA, 64 nt, Homo Sapiens
uuuuugagauaauuucacucuucuguaacuuuuuuauuuuuauuucuggugguuuaaaauguga

SEQ ID NO: 591775 - RNA, 64 nt, Homo Sapiens
ggagaugguguuucaccaugcuggcuaauuuuuguauuuuuaguacaggcacccgccaccacgc

SEQ ID NO: 591776 - RNA, 64 nt, Homo Sapiens
uauagaaauguggaaagcuuuaacauaugagucuuauuuuuauuuaaggccugaaagcaauuua

SEQ ID NO: 591777 - RNA, 64 nt, Homo Sapiens
uauuuuuucugacuccuauucuugcuuuguuuuuuauuuuuauaauuuuuauacaauguucuuu

SEQ ID NO: 591778 - RNA, 64 nt, Homo Sapiens
caauguucuuucuugcuuuguuuaaagaacauuuuauuuuuauauucaagagagggcagucauc

SEQ ID NO: 591779 - RNA, 64 nt, Homo Sapiens
gucuaaucagugauuauuuuguuaugcagugaacuauuuuuaaggccuuugugcuuuuugucau

SEQ ID NO: 591780 - RNA, 64 nt, Homo Sapiens
gaaaugcacuugccuaugauguuuuucuuuucuuuauuuuuaaaauauuuaagcagcuugaaug

SEQ ID NO: 591781 - RNA, 64 nt, Homo Sapiens
aacuauauucaguaaaagccuauguagugaaauguauuuuuaaauaaauaauaacugaaaagac

SEQ ID NO: 591782 - RNA, 64 nt, Homo Sapiens
aauguuuauuuaucaaagucauaaaaaacaauuguauuuuuaaguuaccucucucuuaaauguu

SEQ ID NO: 591783 - RNA, 64 nt, Homo Sapiens
auaguaaaugaucacaauuuuuuuauaggagauguauuuuuaucaaaaaagauauuugaagugu

SEQ ID NO: 591784 - RNA, 64 nt, Homo Sapiens
gauaaagaauaucuaaaaugcacauauuuauauguauuuuuaaaauaaaaaacaacauagagua

SEQ ID NO: 591785 - RNA, 64 nt, Homo Sapiens
uuauuugcauugcuuaccuacauucucucucuguuauuuuuauucuguggcucuauguugagag

SEQ ID NO: 591786 - RNA, 64 nt, Homo Sapiens
ucuggauuuugaauuagauuacugucaauauuuuuauuuuuaacaccuuugaaauauuaaaauc

SEQ ID NO: 591787 - RNA, 64 nt, Homo Sapiens
uuuaacucuggauuuugaauaaaaucacugucaauauuuuuauuauuuauaccuuugaaauauu

SEQ ID NO: 591788 - RNA, 64 nt, Homo Sapiens
aucuccuuucuacugguuauacaaauguaauaaauauuuuuaaaauuuucuaugauuucuagaa

SEQ ID NO: 591789 - RNA, 64 nt, Homo Sapiens
uuuuuauuagcuuaaagaaaauaaaaauuauuuguauuuuuaagauggauuucaaaucuuugua

SEQ ID NO: 591790 - RNA, 64 nt, Homo Sapiens
cuucguuggcacuuuccagcagccaaaccuuugcuauuuuuaauucacgccauucuccugccuc

SEQ ID NO: 591791 - RNA, 64 nt, Homo Sapiens
auauuggcacacugagaaauuguaauauaauucauauuuuuaugcuacugaacucuauaguuag

SEQ ID NO: 591792 - RNA, 64 nt, Homo Sapiens
cuguagcaaaugugacaggcuuauugacugggguuauuuuuaugaaggagcccuuaaauacuug

SEQ ID NO: 591793 - RNA, 64 nt, Homo Sapiens
gugaaauacuaaacacuacuuauauauauauauauauuuuuaaggggaagacugaucuauauau

SEQ ID NO: 591794 - RNA, 64 nt, Homo Sapiens
ucgcauuaguauuaauuuugaaguagcuacaaaguauuuuuaagaaauuauaauuuuaugacug

SEQ ID NO: 591795 - RNA, 64 nt, Homo Sapiens
acagguaccucuaccaugccuggcugauuuuuuguauuuuuaguagagacaggguuucaccaug

SEQ ID NO: 591796 - RNA, 64 nt, Homo Sapiens
cacuuugggagccggaaggaggugcuagucauuuuauuuuuacgugaaauagaugaccuauuua

SEQ ID NO: 591797 - RNA, 64 nt, Homo Sapiens
uacaggagauacguaaaguaggccccacaaauaauauuuuuaaaauacaaaggaucaccacaau

SEQ ID NO: 591798 - RNA, 64 nt, Homo Sapiens
uccagaccuaguauucuaaguuauuaccacauaguauuuuuauguuacccaucaucuuuaaaaa

SEQ ID NO: 591799 - RNA, 64 nt, Homo Sapiens
cacuaagcagaauagguauuaguugguuuuuuauuauuuuuaaauuuauauagcucucauguau

SEQ ID NO: 591800 - RNA, 64 nt, Homo Sapiens
aacugguaaaauaacaauucauacuaucucuacauauuuuuaggauaugaauuuuuuuuuccug

SEQ ID NO: 591801 - RNA, 64 nt, Homo Sapiens
uuuauguuauuauuccugggagcuuauagcccauuauuuuuacuuuuuuuuuuuaauucagaag

SEQ ID NO: 591802 - RNA, 64 nt, Homo Sapiens
ugaacuguacacuuuaaaauggaaaauuuauauguauuuuuaccacaauaaacaaaaaacccua

SEQ ID NO: 591803 - RNA, 64 nt, Homo Sapiens
ggucuuuuuuuuuagauguuugauacauuuuaaguauuuuuaaauagaugaaaauucuaaauga

SEQ ID NO: 591804 - RNA, 64 nt, Homo Sapiens
caguucucuuuaaagagaagaacuuuuuuauuauuauuuuuaucuccaacugcagguggugucu

SEQ ID NO: 591805 - RNA, 64 nt, Homo Sapiens
acaugaaccacuccaaaaaucagugcauuuugcauauuuuuaaacaaagacagcuuguugaaua

SEQ ID NO: 591806 - RNA, 64 nt, Homo Sapiens
uccaaaaagguuugacuggccuccagauuccaguuauuuuuaaaaagcaacuuaccacuaaauc

SEQ ID NO: 591807 - RNA, 64 nt, Homo Sapiens
guuucuuugguuuuuauuuuguaguccuuucaguuauuuuuaaugugccaaaaauuuguacaug

SEQ ID NO: 591808 - RNA, 64 nt, Homo Sapiens
auaggaaauuaaauuuguccaaagauuuggagacuauuuuuaaaacauaaauacauaaaauuuc

SEQ ID NO: 591809 - RNA, 64 nt, Homo Sapiens
uuugauuaaaauuuauauucuuguuuaauaagcuuauuuuuaaacaauuuaaaagcuauuauuc

SEQ ID NO: 591810 - RNA, 64 nt, Homo Sapiens
aacaauuuaaaagcuauuauucuuagcauuaaccuauuuuuaaagaaaccuuuuuugcuauuga

SEQ ID NO: 591811 - RNA, 64 nt, Homo Sapiens
guuaagcugccaaaaauuaaagugcaauauuguauauuuuuaagaacaaauuuaaaauagaauu

SEQ ID NO: 591812 - RNA, 64 nt, Homo Sapiens
aaaugccaugucuauuugauuagucuuauuuuuuuauuuuuacaggcuuaucagucucacuguu

SEQ ID NO: 591813 - RNA, 64 nt, Homo Sapiens
guguuuuugcuuacccuaagagagguuuucuucuuauuuuuagauaauucaagugcuuagauaa

SEQ ID NO: 591814 - RNA, 64 nt, Homo Sapiens
aguucagugaaauaggagauacauaguaguauuuuauuuuuaaaauuaauuucucauuugguuu

SEQ ID NO: 591815 - RNA, 64 nt, Homo Sapiens
cuagaauaguuguaucuaaaucauauuuuaaaauuauuuuuauuuuuaaaaaauuaugguaaaa

SEQ ID NO: 591816 - RNA, 64 nt, Homo Sapiens
uaguuguaucuaaaucauauuuuaaaauuauuuuuauuuuuaaaaaauuaugguaaaaacauau

SEQ ID NO: 591817 - RNA, 64 nt, Homo Sapiens
cauuuggaagugguggggacuuuguuuauuuauuuauuuuuaauuuuuuaauuuuauauuauua

SEQ ID NO: 591818 - RNA, 64 nt, Homo Sapiens
uucaauaacuauggucagggaauuuauaauauuauauuuuuauauacugaacugccauagaugc

SEQ ID NO: 591819 - RNA, 64 nt, Homo Sapiens
uauugugaaauaauucauuuuauaaauguauaauuauuuuuauaaauuuuauuguuggaaauca

SEQ ID NO: 591820 - RNA, 64 nt, Homo Sapiens
cucaggcuaguuuguacuaguagaguuuuguuucuauuuuuauuuuuauuaauuuuauuuuuuu

SEQ ID NO: 591821 - RNA, 64 nt, Homo Sapiens
cuaguuuguacuaguagaguuuuguuucuauuuuuauuuuuauuaauuuuauuuuuuuuaauac

SEQ ID NO: 591822 - RNA, 64 nt, Homo Sapiens
caaagaagaagaaacagagauggaagaguaaagauauuuuuaaaauggcuagcuauugggcacc

SEQ ID NO: 591823 - RNA, 64 nt, Homo Sapiens
uguuaucuaaaauuucacacaacuucauuguuuuuauuuuuauauuaugaguuguccaucuuaa

SEQ ID NO: 591824 - RNA, 64 nt, Homo Sapiens
ccuaguauuuuucuuuaccugaaggagggccauuuauuuuuaauuucacuacauuuuucuuugc

SEQ ID NO: 591825 - RNA, 64 nt, Homo Sapiens
uugaugcuggauuguuucuagagucacaaugaauuauuuuuaugagauuaccuuauuuuuauau

SEQ ID NO: 591826 - RNA, 64 nt, Homo Sapiens
agagucacaaugaauuauuuuuaugagauuaccuuauuuuuauauaugacaaacuacuucuaua

SEQ ID NO: 591827 - RNA, 64 nt, Homo Sapiens
ucucacacacacacacguauacacacacacaguuuauuuuuaauaaaauaggauuauaccacac

SEQ ID NO: 591828 - RNA, 64 nt, Homo Sapiens
accauuuuauucaccaguggauuuacccuuagaguauuuuuagaucugagcugaugacuuguga

SEQ ID NO: 591829 - RNA, 64 nt, Homo Sapiens
auauuuguauaguuugagggaugcuauguuaauguauuuuuaauuagauacauauuuuguaaag

SEQ ID NO: 591830 - RNA, 64 nt, Homo Sapiens
acauauuuuguaaaguguuacuauauuuuaaaguuauuuuuauauguuuuaaaauguuuacucu

SEQ ID NO: 591831 - RNA, 64 nt, Homo Sapiens
uuauguuuuguauuguugauauauaaucuccuauuauuuuuaucuccuguaugaaauauguuuu

SEQ ID NO: 591832 - RNA, 64 nt, Homo Sapiens
aacaaugacaacuuguugccaagucuaaaucagauauuuuuauuucaugcaacuccuaaacuca

SEQ ID NO: 591833 - RNA, 64 nt, Homo Sapiens
ccaucaccauuuacccuuuuucccuugaucugcuuauuuuuauuuuauuuuaugauagcacacu

SEQ ID NO: 591834 - RNA, 64 nt, Homo Sapiens
ucgagcuacacacaugcuugugaaauaguccuuuuauuuuuauugccaacaagcagucaugaca

SEQ ID NO: 591835 - RNA, 64 nt, Homo Sapiens
agagacgggguuucaccaugcuggcuaauuuuuguauuuuuagugcaggcacccgccaccacgc

SEQ ID NO: 591836 - RNA, 64 nt, Homo Sapiens
uuuuuugagacagaaucucauaagauuuuucuuuuauuuuuaaugugucagccuuaucaguguu

SEQ ID NO: 591837 - RNA, 64 nt, Homo Sapiens
agcugaaugugauaauaaggacugcacuuggcauuauuuuuauaggaacauccuguaacuuuuc

SEQ ID NO: 591838 - RNA, 64 nt, Homo Sapiens
acuguuccaccaaagugaugaucuuucuaaauucuauuuuuaaugguaucacuugugaucauuu

SEQ ID NO: 591839 - RNA, 64 nt, Homo Sapiens
agaaaugggguuucaccaugccagcuaauuuuuguauuuuuaguacaggcacccaccaccacgc

SEQ ID NO: 591840 - RNA, 64 nt, Homo Sapiens
ucauggguuuuaauuucucucauugucuuugugguauuuuuauucaacuuucagauucuguuga

SEQ ID NO: 591841 - RNA, 64 nt, Homo Sapiens
aagaaaaauugguuugcauauucuacuuguaaaauauuuuuaaucaauuucaguauuuuauagu

SEQ ID NO: 591842 - RNA, 64 nt, Homo Sapiens
gugauaguccaagugcccugacuugauauaaauguauuuuuacuuguccugcauuauguuuuuu

SEQ ID NO: 591843 - RNA, 64 nt, Homo Sapiens
acuagauuuauagacuuuuuuauuuuugaauuuguauuuuuaaacagagcaagaagaugauacu

SEQ ID NO: 591844 - RNA, 64 nt, Homo Sapiens
ugauugaaugaguucuguauuguaaauuuguguuuauuuuuauauuguauaguugaugagucaa

SEQ ID NO: 591845 - RNA, 64 nt, Homo Sapiens
agggaggaaaaaaauaacaaagugcuuuaaaguauauuuuuaaagccuuuuuuugauuaccugu

SEQ ID NO: 591846 - RNA, 64 nt, Homo Sapiens
ucauucacauuaaugagaagaacuaucuucucuauauuuuuauuaaaacucuauguccggcuuu

SEQ ID NO: 591847 - RNA, 64 nt, Homo Sapiens
aaacugccugacaauuaugauaaggaaacugcuuuauuuuuauaauuggcagauuguuuuuucc

SEQ ID NO: 591848 - RNA, 64 nt, Homo Sapiens
aaaaguugcaaagguaaucaauguugaauacuuauauuuuuaaucaguuugguuguguaagaga

SEQ ID NO: 591849 - RNA, 64 nt, Homo Sapiens
uagcuugaaacauagagggauuaugccauuuguuuauuuuuauaucuguaccauagcgcugcuc

SEQ ID NO: 591850 - RNA, 64 nt, Homo Sapiens
uaucuucauuggagaugaacguccuuauugccauuauuuuuaagucuguaauuccuggccacag

SEQ ID NO: 591851 - RNA, 64 nt, Homo Sapiens
ggaaaauguuaggguagaggcacucuguuucagauauuuuuauucaaacccauuucucccgcuu

SEQ ID NO: 591852 - RNA, 64 nt, Homo Sapiens
ccauucuucugguuugccaauuuauuuauuuauuuauuuuuagggguacacucuucuucuuuua

SEQ ID NO: 591853 - RNA, 64 nt, Homo Sapiens
aaugccuuauuguugcacucuucuacuacaauguuauuuuuacuuucacauaugcaaaaucugu

SEQ ID NO: 591854 - RNA, 64 nt, Homo Sapiens
uuuuuaagcuuuuggaaaagauaauuccauuuuuuauuuuuauuggugucaggaaaugucaaau

SEQ ID NO: 591855 - RNA, 64 nt, Homo Sapiens
uuugugaucuaccuugaauuuuauauaaacuuuauauuuuuauaauuucagauauucugcucua

SEQ ID NO: 591856 - RNA, 64 nt, Homo Sapiens
uaauuuccuacacaaaugauccuauucaaauuccuauuuuuaaacuuuccagggauuuuugagu

SEQ ID NO: 591857 - RNA, 64 nt, Homo Sapiens
uaaaaacuuaauacaaauguaaaagugugauaaauauuuuuaaaucaauggaacccuugcacaa

SEQ ID NO: 591858 - RNA, 64 nt, Homo Sapiens
ccuaagauuuugcccuacaaaaggaauauuuggauauuuuuaaucaagaaaccacuaggaauug

SEQ ID NO: 591859 - RNA, 64 nt, Homo Sapiens
aaguaucaagagguagccugagucugccccuauuuauuuuuagugggaaccaagguuuuugaga

SEQ ID NO: 591860 - RNA, 64 nt, Homo Sapiens
gcuuaggggaagaauauaaggaauuagaucuuuguauuuuuaauauucuagguccuaggaucua

SEQ ID NO: 591861 - RNA, 64 nt, Homo Sapiens
aaaagaaacuuuguaaaaguuuuguaaagaaguauauuuuuaugcuuauauuaaugcauacacu

SEQ ID NO: 591862 - RNA, 64 nt, Homo Sapiens
uuucuguaccuuuauuguuaaucauauuuuuauauauuuuuaaauugccuacaauuguggacuu

SEQ ID NO: 591863 - RNA, 64 nt, Homo Sapiens
uauuuuuaaauuucuguaccuuguggacuuaucauauuuuuauauauaaauuuauugccuacaa

SEQ ID NO: 591864 - RNA, 64 nt, Homo Sapiens
auuuuuuaaucccaaauguggguuuuuuccuauuuauuuuuauuuucacuccuugcuucaauau

SEQ ID NO: 591865 - RNA, 64 nt, Homo Sapiens
auuuuaucuguauaagcuguuuuucuguguggaguauuuuuauaucuaauagguacugccauau

SEQ ID NO: 591866 - RNA, 64 nt, Homo Sapiens
ggaaaguuuguagcauuuuuaaagagaaaauauauauuuuuaauucuguuuauuaugacaaaug

SEQ ID NO: 591867 - RNA, 64 nt, Homo Sapiens
aaauuagaagacugaaaauggacccaugagaguauauuuuuaugagggagcaaaaguuagacug

SEQ ID NO: 591868 - RNA, 64 nt, Homo Sapiens
uacuagacaucuaggaacauuacaaagcaaagacuauuuuuaugcuuccauaaccuagaauuaa

SEQ ID NO: 591869 - RNA, 64 nt, Homo Sapiens
cauuuugaaucuucacucccuaccaggcucuuccuauuuuuaaucucuucaccucagaacuaga

SEQ ID NO: 591870 - RNA, 64 nt, Homo Sapiens
ugauuauguuaugugugcuuuuaugaaagauuguuauuuuuauauaucaagaugauagaaccug

SEQ ID NO: 591871 - RNA, 64 nt, Homo Sapiens
aaaaacagagcccuagagaaaugcuguuacuuuuuauuuuuacacccaucagauuuaaggaaaa

SEQ ID NO: 591872 - RNA, 64 nt, Homo Sapiens
aggcaguuaugauuccacuucuccuacauuuaauuauuuuuaauugagaacaacucaugaucac

SEQ ID NO: 591873 - RNA, 64 nt, Homo Sapiens
cuucauaggaaaacuauauuuagugggcaacaacuauuuuuaugaugggaugggggaguauaua

SEQ ID NO: 591874 - RNA, 64 nt, Homo Sapiens
aaaaugacaaucaauuugagaaaauagaaauagauauuuuuaaauaaaaccauucacaguuuac

SEQ ID NO: 591875 - RNA, 64 nt, Homo Sapiens
ccaagcacacaugugugaagggcuauagccaaaguauuuuuacuagccuguaugaaaucacuag

SEQ ID NO: 591876 - RNA, 64 nt, Homo Sapiens
uauuuuuacuagccuguaugaaaucacuaguccuuauuuuuaaaggucuaugguuucuuggaag

SEQ ID NO: 591877 - RNA, 64 nt, Homo Sapiens
gcauguucuauuuuuuaacuaaucaccccugauauauuuuuauuuuuauauauccaguuuucau

SEQ ID NO: 591878 - RNA, 64 nt, Homo Sapiens
ucuauuuuuuaacuaaucaccccugauauauuuuuauuuuuauauauccaguuuucauuuuuuu

SEQ ID NO: 591879 - RNA, 64 nt, Homo Sapiens
uucaagccugccccucuucugcuuuuuuagacaguauuuuuagagcuggaaagaaauuuucuag

SEQ ID NO: 591880 - RNA, 64 nt, Homo Sapiens
uacagcacccaccaccacacccagcuaauuuuuguauuuuuaguagagacagggguuucaccac

SEQ ID NO: 591881 - RNA, 64 nt, Homo Sapiens
auuacagggcccugccaccaagcccagcuaauuguauuuuuaguagagacaggauuucaccaug

SEQ ID NO: 591882 - RNA, 64 nt, Homo Sapiens
ugaagaaaaagccaguugguuuuguuuaauggccuauuuuuagauuuauaaauccuaaaguaua

SEQ ID NO: 591883 - RNA, 64 nt, Homo Sapiens
ugauuaguguuuuuuuccucggaagagggacggauauuuuuaauuaaauuugcuguagcagugg

SEQ ID NO: 591884 - RNA, 64 nt, Homo Sapiens
uuuaauccugacauuagcuggaaaaauuccaacuuauuuuuaucgcagcaaaccuccuggguuu

SEQ ID NO: 591885 - RNA, 64 nt, Homo Sapiens
agagaugggguuucaccaugccuggcuaauuuuguauuuuuaguuacaggugugcaccacuaug

SEQ ID NO: 591886 - RNA, 64 nt, Homo Sapiens
uuugagauggaguuucacucuauauauauauauauauuuuuauuuauggaauauauauauuuua

SEQ ID NO: 591887 - RNA, 64 nt, Homo Sapiens
uauauaauauauauggaauaauguauauuauauauauuuuuauaauauauaauauauauggaau

SEQ ID NO: 591888 - RNA, 64 nt, Homo Sapiens
gacauguuuuuuaaaaauccugccuuaaacguuguauuuuuauaguacaaaugcauuuccaaac

SEQ ID NO: 591889 - RNA, 64 nt, Homo Sapiens
aagaaauuaaaaguuuuaaacuucagaaauaauuuauuuuuaaagaauuuuuauaaauuguaug

SEQ ID NO: 591890 - RNA, 64 nt, Homo Sapiens
uugagcuuuaaaaagaugaaagauuugaggacauuauuuuuauuaaaggagcacucaauugcag

SEQ ID NO: 591891 - RNA, 64 nt, Homo Sapiens
aaccagcuuauaauuccucguauuuaaugauuguuauuuuuaaaaaauuaauauuuauaaugga

SEQ ID NO: 591892 - RNA, 64 nt, Homo Sapiens
cuuaaaaggcugacaugugcguuugggaaaagauuauuuuuaaguuggguauaaaucaauccca

SEQ ID NO: 591893 - RNA, 64 nt, Homo Sapiens
uugaauaaacagaaagaaaucauaauucuauguguauuuuuauuaaauaguaaaccuauauuuu

SEQ ID NO: 591894 - RNA, 64 nt, Homo Sapiens
uuauauuguauaguuugcucuuguaucagaacuguauuuuuauggaggaacugaucucauauau

SEQ ID NO: 591895 - RNA, 64 nt, Homo Sapiens
uagcuaugaucguuguguacaaugaauacacacauauuuuuacaauuaguucccuagcuuucuc

SEQ ID NO: 591896 - RNA, 64 nt, Homo Sapiens
uauuuauuuuguuuguuuucuuaaccagucucuuuauuuuuauuuuggauauauaauaauuuau

SEQ ID NO: 591897 - RNA, 64 nt, Homo Sapiens
aacauugaguacuuacugaacagucuuuuuucaauauuuuuauauagucuagcuuauuuccuuu

SEQ ID NO: 591898 - RNA, 64 nt, Homo Sapiens
uacaaaucucuggguggaugaucuucuaguacuguauuuuuaaauuaaggaguuuuaguuauaa

SEQ ID NO: 591899 - RNA, 64 nt, Homo Sapiens
uuuucuuuaaauuguucuuacagugauaucuuacuauuuuuaacugucugggguuucugauaug

SEQ ID NO: 591900 - RNA, 64 nt, Homo Sapiens
uaaccuauguugagccuugcuuaccagcaaagaauauuuuuaauguggauaucuaauucuaaag

SEQ ID NO: 591901 - RNA, 64 nt, Homo Sapiens
aaaauagaagcuauuuauuaugagcuucuacagguauuuuuaaauagagcaagcauguugaauu

SEQ ID NO: 591902 - RNA, 64 nt, Homo Sapiens
guaaaggauguuuuaugaagucacaagauacauauauuuuuauuuugaccuaaauuuguacagu

SEQ ID NO: 591903 - RNA, 64 nt, Homo Sapiens
uagcuucucagugaacaucagauaguagagaaaguauuuuuaacuguauccaauguguggaugu

SEQ ID NO: 591904 - RNA, 64 nt, Homo Sapiens
ggauaucuagcaauuuaagaaaauguggaaaaaauauuuuuauugagaaauagcauuuuacuuu

SEQ ID NO: 591905 - RNA, 64 nt, Homo Sapiens
cuguuacgcuaaacuuuugauucuuuaacacaauuauuuuuaaacacuggcauuuuccaaaacu

SEQ ID NO: 591906 - RNA, 64 nt, Homo Sapiens
gaugauauuuuaaauugaaaaguuuguuuuaaauuauuuuuacagugaagacuguuuucagcuc

SEQ ID NO: 591907 - RNA, 64 nt, Homo Sapiens
cuucccauucuuuuacuuagugcauuugugcagauauuuuuaacucuguacaucagaagagagc

SEQ ID NO: 591908 - RNA, 64 nt, Homo Sapiens
aucugucacuccucuuaucugagaagugaccuuuuauuuuuaagaugacuacagaccuauuuuu

SEQ ID NO: 591909 - RNA, 64 nt, Homo Sapiens
aagugaccuuuuauuuuuaagaugacuacagaccuauuuuuagauauguuuucaguacaauuuu

SEQ ID NO: 591910 - RNA, 64 nt, Homo Sapiens
uaauuuuaauucaauaaaugagucaaaauuuguauauuuuuauaaggcuuuuuuauaauagcuu

SEQ ID NO: 591911 - RNA, 64 nt, Homo Sapiens
uucuacucuguaugcccaugaggucaauugauuuuauuuuuagaucccauaaauaaaugagaac

SEQ ID NO: 591912 - RNA, 64 nt, Homo Sapiens
uucugaauauguccuuuuuaacugauuuuuaaguuauuuuuacaaguuagccaauauuuuucuu

SEQ ID NO: 591913 - RNA, 64 nt, Homo Sapiens
auauacuaugaggcccuaucugcuaauuauauaauauuuuuaauagcagcagcaguaguaguca

SEQ ID NO: 591914 - RNA, 64 nt, Homo Sapiens
uuuucuucuagcuuuucagaguugauuuuguuuuuauuuuuauuaauuaccaaugccaaggacu

SEQ ID NO: 591915 - RNA, 64 nt, Homo Sapiens
ucuucccagggaaaauucaucuuuguaagacccauauuuuuaaccucaccuguggccaacuuca

SEQ ID NO: 591916 - RNA, 64 nt, Homo Sapiens
uggucuguuguauuuuguuguccagauuggaaaauauuuuuauaucagcuuucauguuucugau

SEQ ID NO: 591917 - RNA, 64 nt, Homo Sapiens
uguuuacauauguuuacauguucaaaggcaucacuauuuuuaaauugacauuuuccccuuacau

SEQ ID NO: 591918 - RNA, 64 nt, Homo Sapiens
ugcuacuaagugguaacuuucauuaagauaguauuauuuuuaaugauauaaauuacguagucag

SEQ ID NO: 591919 - RNA, 64 nt, Homo Sapiens
agagaugggguuucaccgugcgggcaaauuuuuguauuuuuaguuauaggcgugagccaccgcc

SEQ ID NO: 591920 - RNA, 64 nt, Homo Sapiens
agagaugggguuucaccaugagcuaauuuuuuuguauuuuuaguaggugcccaccaccacaccc

SEQ ID NO: 591921 - RNA, 64 nt, Homo Sapiens
gggaagaccuucugcugcuucaccccuuuguucauauuuuuaaaaguuuucauucuguaguucu

SEQ ID NO: 591922 - RNA, 64 nt, Homo Sapiens
uauuagaaagaaaauauauucuagcauuuuaaauuauuuuuauuaaaauagucauguauagccu

SEQ ID NO: 591923 - RNA, 64 nt, Homo Sapiens
ggaauaaauuaauuuuaugaauaauauuauuuuguauuuuuauuuuucauaucuggucaauguc

SEQ ID NO: 591924 - RNA, 64 nt, Homo Sapiens
aagauuuuuugcuaagaaaacaaauuuucauuguuauuuuuagaauguagccuuuguacugaga

SEQ ID NO: 591925 - RNA, 64 nt, Homo Sapiens
cugaaauguuuauacagguuuaauauaaaguaccuauuuuuauguuuugucuucagacauuuag

SEQ ID NO: 591926 - RNA, 64 nt, Homo Sapiens
ggaggaggaagcaucauucaaaaaccauggagauuauuuuuauuuuguaucuauaagaagacug

SEQ ID NO: 591927 - RNA, 64 nt, Homo Sapiens
aauaaguguaaaguauauuacaaauaaauauuuuuauuuuuaaaaucaugcuacuaauauuuuc

SEQ ID NO: 591928 - RNA, 64 nt, Homo Sapiens
uuuaaaaauaaguguaaaguauuuuccaaauaaauauuuuuauuugaguuaucaugcuacuaau

SEQ ID NO: 591929 - RNA, 64 nt, Homo Sapiens
ucugacauucauuuuauuugcuucuuugugacaguauuuuuauuacaucuuccaauaaggggug

SEQ ID NO: 591930 - RNA, 64 nt, Homo Sapiens
accaagaauuauagcguuuaagacauaacuuaccuauuuuuagcugcuaccacuuugcuguuca

SEQ ID NO: 591931 - RNA, 64 nt, Homo Sapiens
ggaagccaauuaaaaaaaaacucauuugccgacuuauuuuuauaccaacugagcauugaaaucu

SEQ ID NO: 591932 - RNA, 64 nt, Homo Sapiens
uggauucacuguccaaaauguuucuaccuugccuuauuuuuaaucugaaccacccaagcaacac

SEQ ID NO: 591933 - RNA, 64 nt, Homo Sapiens
auaguuauaaaaaguauuagguucaaagauguuuuauuuuuagaacuucaaaaugaaaauauau

SEQ ID NO: 591934 - RNA, 64 nt, Homo Sapiens
cuccagcauaucgggugaguaugauaaaaauguuuauuuuuacacaucaagacaacuaaaacaa

SEQ ID NO: 591935 - RNA, 64 nt, Homo Sapiens
gcaguauuauuuuauaaccaacuauuucugcuauuauuuuuaaauacuucuguuacauaauuaa

SEQ ID NO: 591936 - RNA, 64 nt, Homo Sapiens
ugauuuguacaaauuuuuucuuucuuccauggauuauuuuuauaccacucccccaaaauacuga

SEQ ID NO: 591937 - RNA, 64 nt, Homo Sapiens
uuaucugaacaaauacuuuuguuuauuuuuauauuauuuuuaaggaggaaaagucaaauucauu

SEQ ID NO: 591938 - RNA, 64 nt, Homo Sapiens
uuauuuuuaaguuaucugaaucaaauucauuguuuauuuuuauauuuuuuauuuugaggaaaag

SEQ ID NO: 591939 - RNA, 64 nt, Homo Sapiens
acaggcacccaccaccaugcccaacuaauuuuuguauuuuuauagagauaggguuucaccgugu

SEQ ID NO: 591940 - RNA, 64 nt, Homo Sapiens
guucucaucuauguuaaugaaagaaauuggccuguauuuuuacauucuuguaauaucuuugcca

SEQ ID NO: 591941 - RNA, 64 nt, Homo Sapiens
augaaucccuauauuuccauuauaguauuuauuguauuuuuauguucugaaaauuacccaugga

SEQ ID NO: 591942 - RNA, 64 nt, Homo Sapiens
aauacaggcaggaugacacuuuguguuaaaguguuauuuuuauguauuaccuggaaugaggcag

SEQ ID NO: 591943 - RNA, 64 nt, Homo Sapiens
gucagcuuucuauuaccuggauauggaaggaaacuauuuuuacucugcauguucuguccuaagc

SEQ ID NO: 591944 - RNA, 64 nt, Homo Sapiens
uaaauguauaucuuuuaugucucuacucagaccauauuuuuaaaggggugccucauuauggggc

SEQ ID NO: 591945 - RNA, 64 nt, Homo Sapiens
gguguuggagaaagaguuaaagaugaggaagagauauuuuuaguauaugaaguuauccaggacu

SEQ ID NO: 591946 - RNA, 64 nt, Homo Sapiens
uacuuaccaaaugguuuagagucauaagaugaccuauuuuuauauaaaaguuauauuauagaau

SEQ ID NO: 591947 - RNA, 64 nt, Homo Sapiens
uuuacuuagcuaucagaagccaaguaugauucuuuauuuuuacuuuuucauuucaagaaauuua

SEQ ID NO: 591948 - RNA, 64 nt, Homo Sapiens
caauauccuagacccuaguuuuauacuagaguuuuauuuuuagcaaugccuauugcaagugcaa

SEQ ID NO: 591949 - RNA, 64 nt, Homo Sapiens
acaggugcacaccaccacgccuggcuaauuuuuuuauuuuuauuuuuaguaaaggcgggguuuc

SEQ ID NO: 591950 - RNA, 64 nt, Homo Sapiens
gcacaccaccacgccuggcuaauuuuuuuauuuuuauuuuuaguaaaggcgggguuucaccaug

SEQ ID NO: 591951 - RNA, 64 nt, Homo Sapiens
auaggcacacgccaccacgcccagcuaauuuuuauauuuuuaguagagacaggauugcaccaua

SEQ ID NO: 591952 - RNA, 64 nt, Homo Sapiens
acaggcgaccgccaccacgccuggcuacuuuuuguauuuuuaguagagacaggguuucaccacg

SEQ ID NO: 591953 - RNA, 64 nt, Homo Sapiens
uaaagagaagacgaaauagugacauaauauauucuauuuuuauacucuuccuauuuuuguagug

SEQ ID NO: 591954 - RNA, 64 nt, Homo Sapiens
cuucugccuuugauguuacagauuuaauacaguuuauuuuuaaagauagauccuuuuauaggug

SEQ ID NO: 591955 - RNA, 64 nt, Homo Sapiens
caugccaacaagccauuagacugauucuuccaccuauuuuuaugaaccuccaggaagaaaaaca

SEQ ID NO: 591956 - RNA, 64 nt, Homo Sapiens
auacauuuuuuaauucauuuguuuuccaccauuauauuuuuauacuuuucaguuagauauacuu

SEQ ID NO: 591957 - RNA, 64 nt, Homo Sapiens
aacugguauuuuuggugcugauacaagagaaauguauuuuuaaauaucccacauccuggaucuu

SEQ ID NO: 591958 - RNA, 64 nt, Homo Sapiens
uggaucuuuguuggguauuuaguauauugacauauauuuuuauaaggugagguaacucagaacu

SEQ ID NO: 591959 - RNA, 64 nt, Homo Sapiens
caggcgccugccaccacgccuggccaauuuuuuguauuuuuaguagagacugcguuucaccaug

SEQ ID NO: 591960 - RNA, 64 nt, Homo Sapiens
uaaggcuuuucccucaaauuuauuacaaauuuaguauuuuuaguacuugaugacucuaauuaca

SEQ ID NO: 591961 - RNA, 64 nt, Homo Sapiens
aaagauguaaauuauauauauaguauauuauauauauuuuuaaagcuuuauaugccucaaauau

SEQ ID NO: 591962 - RNA, 64 nt, Homo Sapiens
uggaucuuuagaccucaucuauaaauugaaauuauauuuuuagucauaagccaaguacaaucua

SEQ ID NO: 591963 - RNA, 64 nt, Homo Sapiens
uuaggagggauaauagagaaguccauuuaaaaauuauuuuuagaagcuaaagaaaguaauuaug

SEQ ID NO: 591964 - RNA, 64 nt, Homo Sapiens
caaaaaugguaacugucaugugcacacuguugguuauuuuuaauaagccucuuccuacuagaac

SEQ ID NO: 591965 - RNA, 64 nt, Homo Sapiens
aacuaucuuuaaaaaaacuuuauuaauaaucauguauuuuuacugaucacauuuugaaaugccu

SEQ ID NO: 591966 - RNA, 64 nt, Homo Sapiens
aguuacguguuccacagaauaauuaaauugcacauauuuuuaaacucggagcauuuauuuuguu

SEQ ID NO: 591967 - RNA, 64 nt, Homo Sapiens
uaauuucuuuuucucuuccgcucaaagaauguuauauuuuuaaugacacugcacuugauaggga

SEQ ID NO: 591968 - RNA, 64 nt, Homo Sapiens
cauaaguuguucaaauuaaauuauuuauaaaauguauuuuuaaucaaucaagucuauggaaaaa

SEQ ID NO: 591969 - RNA, 64 nt, Homo Sapiens
uagggguauagcuauauuuugauguauaauguuguauuuuuaaagcacaaagaaaaugcugugu

SEQ ID NO: 591970 - RNA, 64 nt, Homo Sapiens
acagauggguuucauuauguuggcuaauuuuuuguauuuuuagucaggcacaugccaccaugcc

SEQ ID NO: 591971 - RNA, 64 nt, Homo Sapiens
cugucaauuauuucagucauccuaaagaaaaagauauuuuuaaucaaaagauuauuuuuugguu

SEQ ID NO: 591972 - RNA, 64 nt, Homo Sapiens
acuguaaaaaaaguaaauaguuuugauaauguauuauuuuuauauguguuuuguaaguugucua

SEQ ID NO: 591973 - RNA, 64 nt, Homo Sapiens
agagaugggguuuugccuugccaaguaacuuuuguauuuuuaguauaggcgccccccaccacgc

SEQ ID NO: 591974 - RNA, 64 nt, Homo Sapiens
auuauuauuauuugcaaugaggacugaaggcaguuauuuuuauuuagggucagucaccaggccu

SEQ ID NO: 591975 - RNA, 64 nt, Homo Sapiens
uuaaccuggcaaauuaaguguccugcuucacuguuauuuuuaauauaagugcaaugaauaauuu

SEQ ID NO: 591976 - RNA, 64 nt, Homo Sapiens
ggaauaaaaauuuuaaaaaucaaaaucuuuuuuuuauuuuuaagucuucauaauaucuucuauu

SEQ ID NO: 591977 - RNA, 64 nt, Homo Sapiens
auguguaaaacaucuuuuguuagaauuuuuguuuuauuuuuaaaugcacuggagaagauaugug

SEQ ID NO: 591978 - RNA, 64 nt, Homo Sapiens
gcugcuuuguuagguuccuuggauuaguauggccuauuuuuaaaaagaacuuuugaaaauggaa

SEQ ID NO: 591979 - RNA, 64 nt, Homo Sapiens
auguucauaauuaaaaaguacuucugcuguuuuuuauuuuuaacaaaaagagguaauaucaggg

SEQ ID NO: 591980 - RNA, 64 nt, Homo Sapiens
auaaaguuuuaaaaauaacuaaaauagaugcucauauuuuuaaacaauaauuaucaaaacuuuu

SEQ ID NO: 591981 - RNA, 64 nt, Homo Sapiens
uuguaccaaucacaagaaaaugaaaacauagacuuauuuuuaaauauauuuuuuaaaaucaaug

SEQ ID NO: 591982 - RNA, 64 nt, Homo Sapiens
auaaaauuguucuccuucuauuguuaccaaguucuauuuuuagagaccagcuuuugguauuuca

SEQ ID NO: 591983 - RNA, 64 nt, Homo Sapiens
aacuucuuuugagcuuucaacauuaaggagcacauauuuuuauucuguuagggauccauuggag

SEQ ID NO: 591984 - RNA, 64 nt, Homo Sapiens
gugguuacaucuauucuugcgaaaacaauguaacuauuuuuaaaugaaauauuuacuuaaucug

SEQ ID NO: 591985 - RNA, 64 nt, Homo Sapiens
cugaaaaggggauccuugaaugaaaggcauucauuauuuuuaaggaaagauaacuguagucagg

SEQ ID NO: 591986 - RNA, 64 nt, Homo Sapiens
aauuugugcaugaaacaaagguaauuuuauauaauauuuuuaaucuuguucacauacccugaag

SEQ ID NO: 591987 - RNA, 64 nt, Homo Sapiens
gauucuccaaaaaguccagaaaugaaaauacggguauuuuuaaauuuuauuuuuauauuuaaga

SEQ ID NO: 591988 - RNA, 64 nt, Homo Sapiens
uuuaagaaaugaaaauacggguuuuauuuuauuuuauuuuuauagucacaagcugcuggggcgg

SEQ ID NO: 591989 - RNA, 64 nt, Homo Sapiens
uucucuauucuuuccaugacacccaagggucgccuauuuuuaaaaaguaccacauuccaugacg

SEQ ID NO: 591990 - RNA, 64 nt, Homo Sapiens
acauaugauuguauuuguguauaggggaaaauauuauuuuuaugccugguaaguggcuuuuugu

SEQ ID NO: 591991 - RNA, 64 nt, Homo Sapiens
uauuggaggaauacuucugauaauuuauugucuuuauuuuuaucccaggaaauaaaagguuacc

SEQ ID NO: 591992 - RNA, 64 nt, Homo Sapiens
gacuauaaguucucagccuuuauggaccuaaucuuauuuuuauuuacuugaguaauguuuauuc

SEQ ID NO: 591993 - RNA, 64 nt, Homo Sapiens
gcugugaauauguauuaacaaauauauacauuucuauuuuuauaauccauaaggauaugccugu

SEQ ID NO: 591994 - RNA, 64 nt, Homo Sapiens
caaauccauacuugcagaauaauucaucaaauuuuauuuuuaagugaaaaguaaccuuucaggc

SEQ ID NO: 591995 - RNA, 64 nt, Homo Sapiens
gguauguuuuugccaucugguccacucaauuguauauuuuuauuuugcaaaacaacccaaaacu

SEQ ID NO: 591996 - RNA, 64 nt, Homo Sapiens
aaaauuugaacacuggcuaaagauaauugcuauuuauuuuuacaagaaguuuauucucauuugg

SEQ ID NO: 591997 - RNA, 64 nt, Homo Sapiens
guaaacacagucaaaauaauucuaaaucccucgauauuuuuaaagaucuguaaguaacuucaca

SEQ ID NO: 591998 - RNA, 64 nt, Homo Sapiens
cauugcuuguaaauaauucagcagauuuguaauauauuuuuauauuuugaaauguacuguagau

SEQ ID NO: 591999 - RNA, 64 nt, Homo Sapiens
gguauuauccauuugaucuauagcaaugugauuuuauuuuuaaaaagaaaagcaguguguuuuc

SEQ ID NO: 592000 - RNA, 64 nt, Homo Sapiens
aauagaaguguuucagauacauaguuuguaccuguauuuuuauuuuauugccucauguucuugu

SEQ ID NO: 592001 - RNA, 64 nt, Homo Sapiens
gacauguaacauguuaaaagguuaaacuuauggcuauuuuuaaagggcuauucauuuaaucuga

SEQ ID NO: 592002 - RNA, 64 nt, Homo Sapiens
aaacaugucuacaaaaauagauuacagcuuauuuuauuuuuaguuaaaucucuuaauacacaga

SEQ ID NO: 592003 - RNA, 64 nt, Homo Sapiens
auuuauauuucuuauucagaacccuugaugagacuauuuuuaaacauacuagucugcugauaga

SEQ ID NO: 592004 - RNA, 64 nt, Homo Sapiens
aaaauugacaauaaaagucacucuucuaauugaauauuuuuauauuuuuaugaaacaaaagagc

SEQ ID NO: 592005 - RNA, 64 nt, Homo Sapiens
caauaaaagucacucuucuaauugaauauuuuuauauuuuuaugaaacaaaagagcauuucuuc

SEQ ID NO: 592006 - RNA, 64 nt, Homo Sapiens
gacaugaccaugaaggcugcuuguagaauuaguguauuuuuauuaaacuauuuuuuuaaauguc

SEQ ID NO: 592007 - RNA, 64 nt, Homo Sapiens
uuucuauacuuuuucuguuuuuuaaacaccugcauauuuuuauguaaaucucuaaauuuaaaau

SEQ ID NO: 592008 - RNA, 64 nt, Homo Sapiens
ugccagccacaccuccacuugccucuuauugucuuauuuuuauauauuuuucuaaauauaugua

SEQ ID NO: 592009 - RNA, 64 nt, Homo Sapiens
uaccugccaccacgccuggcuaauuuuguuuuuguauuuuuaguagagacgggguuucaccgug

SEQ ID NO: 592010 - RNA, 64 nt, Homo Sapiens
uuuacucaguuugaaacuauucauuucuacacacuauuuuuaaaaauugccuacuaggugaaac

SEQ ID NO: 592011 - RNA, 64 nt, Homo Sapiens
ugaaauucaccugauuauuagauaacuuaaaguuuauuuuuaaaagcugacaacuuuuuaugaa

SEQ ID NO: 592012 - RNA, 64 nt, Homo Sapiens
auguugcauuuuuuucaucuguuguacauaguuguauuuuuaucuaaugccauuuuagaauuuu

SEQ ID NO: 592013 - RNA, 64 nt, Homo Sapiens
uaguuaaaucguauuauuuuuuucuuaacagaaauauuuuuaaaaaugaaaaaguacucaaaag

SEQ ID NO: 592014 - RNA, 64 nt, Homo Sapiens
gagaacacagccugauacuuaauuuucuuaaaacuauuuuuaaugauccacuaaacaaagcagg

SEQ ID NO: 592015 - RNA, 64 nt, Homo Sapiens
ucacacuaccauuauuuccccuucaaacaaauaauauuuuuacagaagcaggagcaaaauaugg

SEQ ID NO: 592016 - RNA, 64 nt, Homo Sapiens
cgggcgcccgccaccacgcccggcuaauuuuuuguauuuuuaguagagacaggguuucaccgug

SEQ ID NO: 592017 - RNA, 64 nt, Homo Sapiens
uacaagcaccagccaccaugccuggcuaauuuuguauuuuuaguagagacaggguuucaccaug

SEQ ID NO: 592018 - RNA, 64 nt, Homo Sapiens
auagcaaucauuaaaaucuugggccagagaacacuauuuuuacauaacaguuucuuaaccuaaa

SEQ ID NO: 592019 - RNA, 64 nt, Homo Sapiens
uuauggggauucaaauucuaguaauaggcuuuuuuauuuuuauuuuuauacccuuaaccaguuu

SEQ ID NO: 592020 - RNA, 64 nt, Homo Sapiens
ggauucaaauucuaguaauaggcuuuuuuauuuuuauuuuuauacccuuaaccaguuuaauuuu

SEQ ID NO: 592021 - RNA, 64 nt, Homo Sapiens
gcuucggggaaacagccaggaaaauggucaagauuauuuuuagagguuauuuuauuggggauuu

SEQ ID NO: 592022 - RNA, 64 nt, Homo Sapiens
auuggggauuuuaagaacuaauaacaucuugaguuauuuuuaauucagggggauguggaaaggu

SEQ ID NO: 592023 - RNA, 64 nt, Homo Sapiens
uucauauacuguuaaugcacaacugacuucauaauauuuuuauauuuaagucuguguaguauuc

SEQ ID NO: 592024 - RNA, 64 nt, Homo Sapiens
ucuguguaguauucaacugaauauuuacuucauauauuuuuaagucauccauauguuuauacau

SEQ ID NO: 592025 - RNA, 64 nt, Homo Sapiens
aaauccuuucauuuuaaaaaguacaaaucuuaaauauuuuuaaucauauaacaaauuaauuuua

SEQ ID NO: 592026 - RNA, 64 nt, Homo Sapiens
uuuuggacuuuaagcaucuuuguauaaaaugccauauuuuuaaaagaaaaaagcauggcuaaaa

SEQ ID NO: 592027 - RNA, 64 nt, Homo Sapiens
aaaugcuuuccuaaaaugauagaaauaaagguuuuauuuuuauuaaccuuuuguauuauacaau

SEQ ID NO: 592028 - RNA, 64 nt, Homo Sapiens
acuacagauuuugcauuuuuaauuaccaauaaaauauuuuuauggccccacuuauacuauguaa

SEQ ID NO: 592029 - RNA, 64 nt, Homo Sapiens
uguucaauauucaacuauuguuuuuuuuuauauauauuuuuaaaagagugugauguucuaguua

SEQ ID NO: 592030 - RNA, 64 nt, Homo Sapiens
uugacuuuuuacauaaacuucugaauuaacuugguauuuuuaaguucaaaacuuuuugaacuga

SEQ ID NO: 592031 - RNA, 64 nt, Homo Sapiens
gaaguggagggaugcacuaucuuuguguggcuccuauuuuuauaagucagcacucuuuuuagau

SEQ ID NO: 592032 - RNA, 64 nt, Homo Sapiens
uuuaaccuccauuaacuaagccugaauuuaacuguauuuuuaaaacgggauuuucagaaguuag

SEQ ID NO: 592033 - RNA, 64 nt, Homo Sapiens
uagcucuuggaguacagcuaugguucuucuggaauauuuuuaugucauucauugcuacauaauu

SEQ ID NO: 592034 - RNA, 64 nt, Homo Sapiens
aaaauauuaagcuuuauaaagauuuuuuuucuaauauuuuuaggguaaacugauuuuuuguucu

SEQ ID NO: 592035 - RNA, 64 nt, Homo Sapiens
uuuugacccaauaaaauguuguaggguuuuauuuuauuuuuauucuuagauguagaauccuggu

SEQ ID NO: 592036 - RNA, 64 nt, Homo Sapiens
uuguauagucuuaguugguuggaugaagacagcuuauuuuuaaguggcaaaucaaacuuuucua

SEQ ID NO: 592037 - RNA, 64 nt, Homo Sapiens
uuaguaucuugaugcuccugaguacuuauuacauuauuuuuauugaaaauuguuauauuuugaa

SEQ ID NO: 592038 - RNA, 64 nt, Homo Sapiens
uuuucucuuuuuauuuauuuuuuuauuuuuuacuuauuuuuaaagcugcuuuuuaaaaauauuu

SEQ ID NO: 592039 - RNA, 64 nt, Homo Sapiens
gguuuuauaccaauauuauagcuuuuuuuaaaaguauuuuuacuaaauuacucgggaaguaaac

SEQ ID NO: 592040 - RNA, 64 nt, Homo Sapiens
uaugguuaaaccuuggcguccagccgagaauuaguauuuuuaugcaggcauaagccagugcacc

SEQ ID NO: 592041 - RNA, 64 nt, Homo Sapiens
agagacggggguuccaccauccugcuaauuuuuguauuuuuaguacaggugcaugccaccacac

SEQ ID NO: 592042 - RNA, 64 nt, Homo Sapiens
gauguuauuuaaauaaugcagggaugucuaaaccuauuuuuauagcuucugaguauaacgaauu

SEQ ID NO: 592043 - RNA, 64 nt, Homo Sapiens
acagacgggguuucauugugcggcuaauuuuuuguauuuuuagugggcgccccaccaccacgcc

SEQ ID NO: 592044 - RNA, 64 nt, Homo Sapiens
agagacaggguuuugccaugccggcuaauuuuuguauuuuuaguagaggcgccagccaacacac

SEQ ID NO: 592045 - RNA, 64 nt, Homo Sapiens
ugaggugaaaaaaucugauguuugaggaaguuuuuauuuuuauuuauuuguuuuguuuuuuuuu

SEQ ID NO: 592046 - RNA, 64 nt, Homo Sapiens
acaggcaugcaccaccacgcccagcuaauuuuuguauuuuuagcagagacagggaggaaguuuu

SEQ ID NO: 592047 - RNA, 64 nt, Homo Sapiens
uuuguauuuuuagcagagacagggaggaaguuuuuauuuuuauaaacaaaaucugauguucaga

SEQ ID NO: 592048 - RNA, 64 nt, Homo Sapiens
uauguuguccugugccauaaagugauauauuuaauauuuuuauucuuugguuuugaacauugua

SEQ ID NO: 592049 - RNA, 64 nt, Homo Sapiens
gaccauuaccuauuaggaagauuaaaaaugacuguauuuuuaaaggaauaaaucccagugugcc

SEQ ID NO: 592050 - RNA, 64 nt, Homo Sapiens
uuauauaaucguuauccauuuggguauaaaucuguauuuuuaguuuuuucccuuugauuaguau

SEQ ID NO: 592051 - RNA, 64 nt, Homo Sapiens
auaggcacccaccaccacaccuggcuaauuuuuguauuuuuaguggagacgggguuucaccaug

SEQ ID NO: 592052 - RNA, 64 nt, Homo Sapiens
acuaauuuuuguugugguuaguuagaaaaaugguuauuuuuaguggguuuuaauaugugaaaaa

SEQ ID NO: 592053 - RNA, 64 nt, Homo Sapiens
caggcgcgugccaccacgcccagcuaauuuuuuguauuuuuaguugagacaggguuucacuguc

SEQ ID NO: 592054 - RNA, 64 nt, Homo Sapiens
uugcuaaugaauuugacuuagaaaagaauugccuuauuuuuaagagauuguuucagugguucac

SEQ ID NO: 592055 - RNA, 64 nt, Homo Sapiens
augauucaacuacuguuuuuccuucagcugacuuuauuuuuaaacacccuuaaagacagauaua

SEQ ID NO: 592056 - RNA, 64 nt, Homo Sapiens
uugcugaauuauaaguuuauuuuuuaucaauaaauauuuuuauacuuacauugagugauguguu

SEQ ID NO: 592057 - RNA, 64 nt, Homo Sapiens
caugugaaacuauguuaaaacugaaggcacuauauauuuuuacauaaaagcuugaacauacaga

SEQ ID NO: 592058 - RNA, 64 nt, Homo Sapiens
uugaugaaauauacaaauauuuuauuguagcaccuauuuuuauaugcacauuuagcauuccucu

SEQ ID NO: 592059 - RNA, 64 nt, Homo Sapiens
caaguuuuggguuuuauuagaaaauauuugaaaguauuuuuauuaaugaaccaaaaugacaugu

SEQ ID NO: 592060 - RNA, 64 nt, Homo Sapiens
auauacugauguauaugguuaucuggguuauaucuauuuuuauguaaacucuauuuuguuuuug

SEQ ID NO: 592061 - RNA, 64 nt, Homo Sapiens
uucccauuuuccuauuauguuugauaauuauauguauuuuuaaaaacugugagaggaaaaauua

SEQ ID NO: 592062 - RNA, 64 nt, Homo Sapiens
cagagcccauuuucuccauaaauuuguaacaugcuauuuuuaugugcauguuuuaugaguucaa

SEQ ID NO: 592063 - RNA, 64 nt, Homo Sapiens
agauaauaaacccccccccucuuuucuuuuucuuuauuuuuauuucuuuuagcuauuugauccu

SEQ ID NO: 592064 - RNA, 64 nt, Homo Sapiens
gggcuggcacuuuuuuaaauauaaaaauggguguuauuuuuauuuuuauuuguaaagugauuuu

SEQ ID NO: 592065 - RNA, 64 nt, Homo Sapiens
gcacuuuuuuaaauauaaaaauggguguuauuuuuauuuuuauuuguaaagugauuuuuggucu

SEQ ID NO: 592066 - RNA, 64 nt, Homo Sapiens
gcuuucugaauguagacggauucauugcacaauauauuuuuacuuacgcuuaagguggaaagug

SEQ ID NO: 592067 - RNA, 64 nt, Homo Sapiens
augacuggucuuccuuaccugaauuuauauaaaguauuuuuauaauguuuuuaguucugacuuu

SEQ ID NO: 592068 - RNA, 64 nt, Homo Sapiens
ggcuuggauguuuuuaguucuuauuaggaaaagauauuuuuauauuauccaggaauugauacgu

SEQ ID NO: 592069 - RNA, 64 nt, Homo Sapiens
gugaauuuuaauuucuaucucuuuuguuuguuucuauuuuuaaguaaugucaguuuaaguuguc

SEQ ID NO: 592070 - RNA, 64 nt, Homo Sapiens
aguuaaugucaguuuaaguuaguaaauuugaacauauuuuuauugaagugcccaugauucuguc

SEQ ID NO: 592071 - RNA, 64 nt, Homo Sapiens
uauauauuuaaaguuuucuacuaugaaaauugucuauuuuuaucuacucaucuucauguaggac

SEQ ID NO: 592072 - RNA, 64 nt, Homo Sapiens
uaaaguauugcuaguaaauguacaaagggagcauuauuuuuauuaguuccuauuuuagcuugcu

SEQ ID NO: 592073 - RNA, 64 nt, Homo Sapiens
uguuaacgucauauuauguucaaaacaccagaaauauuuuuauaauuguggcugaacagcaaau

SEQ ID NO: 592074 - RNA, 64 nt, Homo Sapiens
cuaaaguaaaggcugugaagacaagaaaacugucuauuuuuagcccucuaaaguuaaagucaau

SEQ ID NO: 592075 - RNA, 64 nt, Homo Sapiens
ccacuaauuuuuuuuuaguuagucaagguaccuguauuuuuaauuugauuaacugucuacuuaa

SEQ ID NO: 592076 - RNA, 64 nt, Homo Sapiens
ugaaggcaaauaaguacuuagcuguaaaauggaauauuuuuaaagggcugccuaucuguagaua

SEQ ID NO: 592077 - RNA, 64 nt, Homo Sapiens
accauguacugaauuuuuacuuuaaauuuuagauuauuuuuauuauuaauauauuuaauuucua

SEQ ID NO: 592078 - RNA, 64 nt, Homo Sapiens
ucaaugggacucugauauaaucuaaaaagagauuuauuuuuaaacacucagaauuucuauucuu

SEQ ID NO: 592079 - RNA, 64 nt, Homo Sapiens
ugaauuugaaaagucgauuaaaaugauagcucucuauuuuuaaaaaaaauagcugagcuuucua

SEQ ID NO: 592080 - RNA, 64 nt, Homo Sapiens
aaguugccuucuccaguggcauaucugacuucuguauuuuuaaauuguaauauaacaugggcaa

SEQ ID NO: 592081 - RNA, 64 nt, Homo Sapiens
uuuuauguaauuaguuauaggcaaaauacuuucauauuuuuagauuagacagacgaaagaccaa

SEQ ID NO: 592082 - RNA, 64 nt, Homo Sapiens
acauuuuauauguacuauucuuaaagaucacaauuauuuuuaaacuuucuauuuucaaauacuu

SEQ ID NO: 592083 - RNA, 64 nt, Homo Sapiens
ggucuuuuuagagguauauuccaaaauuuccuuguauuuuuagguuaugcaacuaauaaaaacu

SEQ ID NO: 592084 - RNA, 64 nt, Homo Sapiens
cagguaaaagucaguaggauggaacauuuuaguguauuuuuacuccuuaaagagcuagaauaca

SEQ ID NO: 592085 - RNA, 64 nt, Homo Sapiens
auuguuuaagguuauacacucgagcuuaaauagauauuuuuaaccagguguuugguuuuuguuu

SEQ ID NO: 592086 - RNA, 64 nt, Homo Sapiens
uguuaaaaguaacaaaaccaagucaaacuugguguauuuuuauuuuaaauauuaacucuaaagc

SEQ ID NO: 592087 - RNA, 64 nt, Homo Sapiens
acaggcgugugccaccacgcccagcuaauuuuuguauuuuuaguagcgaugguguuucacuaca

SEQ ID NO: 592088 - RNA, 64 nt, Homo Sapiens
acagaugccuaucaccaugccuggguaauuuuuguauuuuuaguugagaugggguuucaccaug

SEQ ID NO: 592089 - RNA, 64 nt, Homo Sapiens
uacagguaugugccaccaugccuggcuaauuuuguauuuuuaguagagacgggguuucuccaug

SEQ ID NO: 592090 - RNA, 64 nt, Homo Sapiens
uuuuuuuaguagagaugagguuuauuuuuauuuuuauuuuuauuuuuuuuuuucuuucuuucuu

SEQ ID NO: 592091 - RNA, 64 nt, Homo Sapiens
uuuauuuuuuuuuaguagaguuucuuuuuauuuuuauuuuuauucucaguuuuuuuuuucuuuc

SEQ ID NO: 592092 - RNA, 64 nt, Homo Sapiens
uuuauuuuuauuuuuuuuuaucuuucuuucuuuuuauuuuuauucucaaccucaguuuuuuuuu

SEQ ID NO: 592093 - RNA, 64 nt, Homo Sapiens
uuugaacuuuagguccuuccuuuuuagcaauuuuuauuuuuauuuaauuuuguaauggcuuuua

SEQ ID NO: 592094 - RNA, 64 nt, Homo Sapiens
aauuuuuauuuuuauuuuuguuuguaauggcuuuuauuuuuagcgcuaaaggagggggcuuaau

SEQ ID NO: 592095 - RNA, 64 nt, Homo Sapiens
aauuauucccccuaucauucccaugucauuccuuuauuuuuauaaagcuccuugagagcaggau

SEQ ID NO: 592096 - RNA, 64 nt, Homo Sapiens
uauguuacuauguaaauauguuuauauguauauuuauuuuuaugguugguuauucauaugucua

SEQ ID NO: 592097 - RNA, 64 nt, Homo Sapiens
guaccuucuuuauguuuagaagauuacaauacuguauuuuuacuuauauggcagugguuccaua

SEQ ID NO: 592098 - RNA, 64 nt, Homo Sapiens
aauuuaacacagaucaaaggcaggaguaagcauguauuuuuaucuacauuguucgauguuugua

SEQ ID NO: 592099 - RNA, 64 nt, Homo Sapiens
agagacgggguuucaccgugcggcuaaauuuuuguauuuuuagucaggcaccugccaccaugcc

SEQ ID NO: 592100 - RNA, 64 nt, Homo Sapiens
guuugaacaggaagugaacacuuacuguuuaauuuauuuuuauuugaacugaaaaauauguuuu

SEQ ID NO: 592101 - RNA, 64 nt, Homo Sapiens
guauauguuucucuucaggcauuacagugaauuuuauuuuuaaucuauaagcaggauuugagua

SEQ ID NO: 592102 - RNA, 64 nt, Homo Sapiens
guuaaguagcaugcauauauacauaaaugguacauauuuuuaaaggcauugaaaagguuaagaa

SEQ ID NO: 592103 - RNA, 64 nt, Homo Sapiens
uagagacagggucuugcucuuuugacucuauuuuuauuuuuacugaaaugauucuggaugguuc

SEQ ID NO: 592104 - RNA, 64 nt, Homo Sapiens
uuuacuuagagacagggucuugguucuuugacucuauuuuuauuaaaaaggaaaugauucugga

SEQ ID NO: 592105 - RNA, 64 nt, Homo Sapiens
guacaguagggugugaauuaguggacuuuguuguuauuuuuaaaauuauagcaaaacaagaaaa

SEQ ID NO: 592106 - RNA, 64 nt, Homo Sapiens
cuauuauaauugucuuuuguuacauauaaacaguuauuuuuauccuuuuuuuucuuaaaugaua

SEQ ID NO: 592107 - RNA, 64 nt, Homo Sapiens
auuaaagguacacugauggauuaguauugugguguauuuuuaaggaaagcuacggaaccugcca

SEQ ID NO: 592108 - RNA, 64 nt, Homo Sapiens
ggagauugaagccauagaacacccuuaagaauuuuauuuuuaaacccccucuucuuuguuuugg

SEQ ID NO: 592109 - RNA, 64 nt, Homo Sapiens
acugaauucaaagggaaauguuauaaggcauucauauuuuuagggauacuuauuuugaaauuaa

SEQ ID NO: 592110 - RNA, 64 nt, Homo Sapiens
aacacauaaacacacagccggagcauuuacuuuguauuuuuacaaaaucacuucaacauuauuu

SEQ ID NO: 592111 - RNA, 64 nt, Homo Sapiens
uuuuguaaagccaaguagcucuaauccucuauuuuauuuuuauuucuuccugucuguuccuccc

SEQ ID NO: 592112 - RNA, 64 nt, Homo Sapiens
ggagcucguaauuuuuuaacguaggcacuugcuguauuuuuacuuauugguugguucauaugau

SEQ ID NO: 592113 - RNA, 64 nt, Homo Sapiens
aaaaaccucuuagcuuuucugcaauucaacuuuuuauuuuuauuuuuauuucuaucaaagacgg

SEQ ID NO: 592114 - RNA, 64 nt, Homo Sapiens
cucuuagcuuuucugcaauucaacuuuuuauuuuuauuuuuauuucuaucaaagacgguagaga

SEQ ID NO: 592115 - RNA, 64 nt, Homo Sapiens
caggugcccgccaccacgcccagcuaauuuuuuguauuuuuaguagagacgguuucaccguguu

SEQ ID NO: 592116 - RNA, 64 nt, Homo Sapiens
gaaauuaauuuccuucaauagcauccuaaaacucuauuuuuauuuggggcagaguaauuucauu

SEQ ID NO: 592117 - RNA, 64 nt, Homo Sapiens
uaauugucuaauguucugaugggaacguaacacuuauuuuuauauaaaaagagacugaguaaac

SEQ ID NO: 592118 - RNA, 64 nt, Homo Sapiens
uuuacauaacaauaacuuuuuaucaguuacauuuuauuuuuauuuaaacuggccaaaagcaaaa

SEQ ID NO: 592119 - RNA, 64 nt, Homo Sapiens
aaaacaugacacuguaggcagcaguuuuaagucuuauuuuuacuguuuauauauuugaaugcug

SEQ ID NO: 592120 - RNA, 64 nt, Homo Sapiens
cagcugccucccaaaggaggggcagccgugcuuauauuuuuaugguuacaauggcacaaaauua

SEQ ID NO: 592121 - RNA, 64 nt, Homo Sapiens
uguuuuuuuucuaucaucugguauaccauugcuuuauuuuuauaaauuauuuucucauugccau

SEQ ID NO: 592122 - RNA, 64 nt, Homo Sapiens
uaucaggaaauacugccuguagaguuaguauuucuauuuuuauauaauguuugcacacugaauu

SEQ ID NO: 592123 - RNA, 64 nt, Homo Sapiens
acaggcacccaccaccaugcccagcuaauuuuuguauuuuuaauagagagcuaauaauuguaua

SEQ ID NO: 592124 - RNA, 64 nt, Homo Sapiens
guucuugaaauuguggaaugcaugauugacaauauauuuuuaauuuuuauuuuuucaaguaaua

SEQ ID NO: 592125 - RNA, 64 nt, Homo Sapiens
auaggcaugcgccaccauggccagcuaauuuuuguauuuuuaguagagacgagguuucacugug

SEQ ID NO: 592126 - RNA, 64 nt, Homo Sapiens
acaggcacacaccaccacgccuggcuaauuuuuguauuuuuaguagagacggguuucaccaugu

SEQ ID NO: 592127 - RNA, 64 nt, Homo Sapiens
ucuaucaaagacgguagagacaacuuuuuauuuuuauuuuuauucucuuagcuuuucugcaauu

SEQ ID NO: 592128 - RNA, 64 nt, Homo Sapiens
uuuauuucuaucaaagacgggcaauucaacuuuuuauuuuuauuaaaaaccucuuagcuuuucu

SEQ ID NO: 592129 - RNA, 64 nt, Homo Sapiens
acuaugugguaauuucaccuuuuucaaagcuauuuauuuuuaggagccaccgcacccgacgguc

SEQ ID NO: 592130 - RNA, 64 nt, Homo Sapiens
agagacggggguucaccaagcuggcuaauuuuuguauuuuuaguacaggugccugccaucacgc

SEQ ID NO: 592131 - RNA, 64 nt, Homo Sapiens
gccuguauuauuuaaaaugcgucucuggugaucuuauuuuuaaacgcaaccacuaacaauugug

SEQ ID NO: 592132 - RNA, 64 nt, Homo Sapiens
agagacuggguuucaccaugccggcuaauuuuuguauuuuuaguacaggcacaugccaccacgc

SEQ ID NO: 592133 - RNA, 64 nt, Homo Sapiens
uuuuucuuggguuaguauuuucuuacugaauuuguauuuuuaaaaauuguuguuagagcaaaag

SEQ ID NO: 592134 - RNA, 64 nt, Homo Sapiens
uuuucucaaaaaguaacuaacauuucaauguauuuauuuuuaaauacuuucgcucucuaaucag

SEQ ID NO: 592135 - RNA, 64 nt, Homo Sapiens
uguauaucuauuuaaaacuaugaaucauuugaaguauuuuuauauaagaguguucaauccgaga

SEQ ID NO: 592136 - RNA, 64 nt, Homo Sapiens
ggagacagguuucaccauguccagcuaauuuuuguauuuuuaguacaggcaccugccaccacgc

SEQ ID NO: 592137 - RNA, 64 nt, Homo Sapiens
uggauauacuaggauuguaaaauacagacuccuuuauuuuuauauucuauaggacaaaaaaacu

SEQ ID NO: 592138 - RNA, 64 nt, Homo Sapiens
agagaugggguuucaccaugccggcuaauuuucauauuuuuaguauaggcacgugccaccacac

SEQ ID NO: 592139 - RNA, 64 nt, Homo Sapiens
aucacucuaguaaaaaaaccuagucgcauuuuuauauuuuuaguacagauuaagcuaauuucug

SEQ ID NO: 592140 - RNA, 64 nt, Homo Sapiens
cacuuuuaaauaauguguugauaguacgacaacuuauuuuuaauuauaaaaagcauuugaagaa

SEQ ID NO: 592141 - RNA, 64 nt, Homo Sapiens
ucauugagcaauauuuuuuaaaagaaauaauauauauuuuuaugauaugcauaaauggcaaagg

SEQ ID NO: 592142 - RNA, 64 nt, Homo Sapiens
uaaccuguuacaaaauagaccauuuauuggcccauauuuuuaugcuguuucugcauucauaaug

SEQ ID NO: 592143 - RNA, 64 nt, Homo Sapiens
uucccagaaauuguuucuuauauguaaaauucaauauuuuuauaaguuucucaagacucugaaa

SEQ ID NO: 592144 - RNA, 64 nt, Homo Sapiens
agagaugaguuucaccauguuuuuuuuuuuuuuguauuuuuaguugccaccacgccuggguaau

SEQ ID NO: 592145 - RNA, 64 nt, Homo Sapiens
uuuuuuuuagcauccuuuuguuuuauuuuuauuuuauuuuuauuugaugcugccaaggcgcacu

SEQ ID NO: 592146 - RNA, 64 nt, Homo Sapiens
uuauuuuuauuuuuuuuuuacaaggcgcacuuuuuauuuuuauuccucauccugaugaugcugc

SEQ ID NO: 592147 - RNA, 64 nt, Homo Sapiens
acaggcaccugucaccacacccagcuaauuuuuguauuuuuaguagagaugggguuucaccaua

SEQ ID NO: 592148 - RNA, 64 nt, Homo Sapiens
acagucugaugagacugugccuguuauuguuuuuuauuuuuacucuggauuuuccuugcaucug

SEQ ID NO: 592149 - RNA, 64 nt, Homo Sapiens
caggcaccugccacgaugccuagcuaauuuuuuguauuuuuaguagagaugaaguuucaccgug

SEQ ID NO: 592150 - RNA, 64 nt, Homo Sapiens
acaggcaggugccaccaugccuggcucauuuuuguauuuuuaguagagagggcguuuugccaug

SEQ ID NO: 592151 - RNA, 64 nt, Homo Sapiens
uuugauggauuuuuauuuauauacuuuuuuugcuuauuuuuacuuugaguggaauguucauuaa

SEQ ID NO: 592152 - RNA, 64 nt, Homo Sapiens
uuugaguggaauguucauuaauguaaauuguauuuauuuuuauacuuuuauuuucacuaguuuu

SEQ ID NO: 592153 - RNA, 64 nt, Homo Sapiens
acagguuccugcuaccacgcccagcuaauuuuuguauuuuuaguagagacgaggcuucaccaug

SEQ ID NO: 592154 - RNA, 64 nt, Homo Sapiens
acaggugugugccacuacggcuggcuaauuuuuguauuuuuaguagagacagguuucaccauau

SEQ ID NO: 592155 - RNA, 64 nt, Homo Sapiens
gggcgucuucaggagggcuucgggguuuugcuuuuauuuuuauuuugucauugcgggguauaug

SEQ ID NO: 592156 - RNA, 64 nt, Homo Sapiens
acaggcgugagcuaccaugcccggcuaauuuuuguauuuuuaguagagaugggguuucauuaug

SEQ ID NO: 592157 - RNA, 64 nt, Homo Sapiens
uauauauuuguauagucaucuuacaugggaaaguuauuuuuaauuuuauaguugauuauugcuu

SEQ ID NO: 592158 - RNA, 64 nt, Homo Sapiens
guugauuauugcuuuuacauaguuuuuuccauuauauuuuuauauuacacaauuuuguuauugu

SEQ ID NO: 592159 - RNA, 64 nt, Homo Sapiens
agagacaggauuucaccaugccagcuaauuuuuguauuuuuaguacaggcgugagccagcacgc

SEQ ID NO: 592160 - RNA, 64 nt, Homo Sapiens
gucugaucuuuugacuucuaauuacaauaucugauauuuuuacaagacuuguuuggagcucuua

SEQ ID NO: 592161 - RNA, 64 nt, Homo Sapiens
uuuguaaaguaaguuugguuacaaguuuugguuauauuuuuauaauggcaaauguauaaaagaa

SEQ ID NO: 592162 - RNA, 64 nt, Homo Sapiens
guacuuguucagucacuugacuuuuuaaugacuuuauuuuuacauugugcucuuauguucucgg

SEQ ID NO: 592163 - RNA, 64 nt, Homo Sapiens
uugcagaauuaucuaauagucuuuuuuuggcuaauauuuuuauaacgugguucuuauuuaacug

SEQ ID NO: 592164 - RNA, 64 nt, Homo Sapiens
ggcccugauccaccuaccugcuaacuccagauauuauuuuuaaguuggagaccuaaaaauaauu

SEQ ID NO: 592165 - RNA, 64 nt, Homo Sapiens
uuaaggauggugguguauugcucuuuuucagcuuuauuuuuaagaguacagucaggaaaccaac

SEQ ID NO: 592166 - RNA, 64 nt, Homo Sapiens
ucaugaagaaaucucucccaauacccauuuauccuauuuuuagcaauaauucguuaaugauucc

SEQ ID NO: 592167 - RNA, 64 nt, Homo Sapiens
cuguacuuuaagcaugaaaagcaauauuucaaaguauuuuuaaacucaacaaaugucaucaaau

SEQ ID NO: 592168 - RNA, 64 nt, Homo Sapiens
auuuauaaaggaucaaugcugcuguaaauacagguauuuuuaauuuuaaaauuucauuccacca

SEQ ID NO: 592169 - RNA, 64 nt, Homo Sapiens
guaggcauguaccaccaugcccagcuaauuuuuauauuuuuaguagagaugggguuuugccaua

SEQ ID NO: 592170 - RNA, 64 nt, Homo Sapiens
acuuuccaucuuaauguaaccuuaugcuauucuguauuuuuacuguauauugcuuuuacaauaa

SEQ ID NO: 592171 - RNA, 64 nt, Homo Sapiens
acaggcacacgccaccacacccaacuaauuuuuguauuuuuaguagagaugggguuucaccaug

SEQ ID NO: 592172 - RNA, 64 nt, Homo Sapiens
cagacaugagccaccacgcuuggccgggauaguauauuuuuauagcacuuccccuacugauugc

SEQ ID NO: 592173 - RNA, 64 nt, Homo Sapiens
agguggccagaugguuccaggacuacaaugucuuuauuuuuaacuguuugccacugcugcccuc

SEQ ID NO: 592174 - RNA, 64 nt, Homo Sapiens
gagugcuuuuauaaauuauuuuccuuguagauuuuauuuuuaauuuaucucugugaccugccag

SEQ ID NO: 592175 - RNA, 64 nt, Homo Sapiens
uaagauauauaugugugugugugugcuacauauauauuuuuaagaaaggaccaucucuuuagga

SEQ ID NO: 592176 - RNA, 64 nt, Homo Sapiens
uauauuuuuaagaaaggaccaucucuuuaggauauauuuuuaaauucuuugaaacacauaacca

SEQ ID NO: 592177 - RNA, 64 nt, Homo Sapiens
auuuuugggaggagccauagauuccugguuauccuauuuuuaaacaaaauguagacaaagugaa

SEQ ID NO: 592178 - RNA, 64 nt, Homo Sapiens
uuccuauuguacugcacaaaccauggauuguacauauuuuuauauauuaugucuuauuuuauua

SEQ ID NO: 592179 - RNA, 64 nt, Homo Sapiens
aaaguccucugugaggaauauucucuauuuuaaauauuuuuaguauguacuguguaugauucau

SEQ ID NO: 592180 - RNA, 64 nt, Homo Sapiens
uaugauucauuaccauuuugaggggauuuauacauauuuuuagauaaaauuaaaugcucuuauu

SEQ ID NO: 592181 - RNA, 64 nt, Homo Sapiens
cuccuuucagauuauuuuacaauuuuaguucauuuauuuuuaaagaaaagauaauaguuauaaa

SEQ ID NO: 592182 - RNA, 64 nt, Homo Sapiens
ugcuccuaguuguauagucugagaggagucuuauuauuuuuaaaauucuuuggaagaaggcaga

SEQ ID NO: 592183 - RNA, 64 nt, Homo Sapiens
auugugucuuuuaaaagaaagacauuuuucuuaauauuuuuaacgcagcccuccagauuuugua

SEQ ID NO: 592184 - RNA, 64 nt, Homo Sapiens
ggguaaaacuaguuauggcaaguauaggcuacaguauuuuuacacuuucauugcaauuugauac

SEQ ID NO: 592185 - RNA, 64 nt, Homo Sapiens
agagacaggguuucaccaugcuggcuaauuuuuguauuuuuaguacaggcgucggccaccacac

SEQ ID NO: 592186 - RNA, 64 nt, Homo Sapiens
aucaucuuaaaggauccaagacuuaauguaauauuauuuuuaaauugguuauuagaccaggaaa

SEQ ID NO: 592187 - RNA, 64 nt, Homo Sapiens
auacuguuaaauaucacaucaauucagucaauuuuauuuuuagcuguuguggacaaaaucauac

SEQ ID NO: 592188 - RNA, 64 nt, Homo Sapiens
uuuuugagauagggucuuacuauuuuuauauuuauauuuuuauuugggcagagguacgcucuuu

SEQ ID NO: 592189 - RNA, 64 nt, Homo Sapiens
uuuauauuuuuauuuuuuuggagguacgcucuuuuauuuuuauaaaaguuaagggacgugggca

SEQ ID NO: 592190 - RNA, 64 nt, Homo Sapiens
agagacaggguuucaccaugcccagcuaauuuuguauuuuuaguuuacaggcaugugcaacuca

SEQ ID NO: 592191 - RNA, 64 nt, Homo Sapiens
uuuuuuugagacagagucucuuccacuugguuuuuauuuuuauuaguaucaccccaucuuuucu

SEQ ID NO: 592192 - RNA, 64 nt, Homo Sapiens
aauuagcauugucauacaguauauauauauauauuauuuuuaaacauccuuaacagaaacaaaa

SEQ ID NO: 592193 - RNA, 64 nt, Homo Sapiens
auuuguacacauucuuugagguuuuaaagaaugguauuuuuaaucuuccugguuuuggauguaa

SEQ ID NO: 592194 - RNA, 64 nt, Homo Sapiens
auuaaaugugcagauaugcuuuuauuuauuuuuuuauuuuuaauccugaaucagaacgcuggcu

SEQ ID NO: 592195 - RNA, 64 nt, Homo Sapiens
auauuaacuuuguggauucauacuguguauauuuuauuuuuaaucaucuggaugccuguuguuu

SEQ ID NO: 592196 - RNA, 64 nt, Homo Sapiens
uuucucucagugucuuauauugauauuuauguauuauuuuuacuuauauccuggcucaguggag

SEQ ID NO: 592197 - RNA, 64 nt, Homo Sapiens
aacuauauuauaaguacagauagcagcaauguucuauuuuuagauuuaaauacauuuauuuuua

SEQ ID NO: 592198 - RNA, 64 nt, Homo Sapiens
gcagcaauguucuauuuuuauuuuuaaauacauuuauuuuuauaccuguuuaaacccgugguuu

SEQ ID NO: 592199 - RNA, 64 nt, Homo Sapiens
caguaaagaguggagaaagaugaauuguugaguuuauuuuuacaauuuucuugcugaaaugaca

SEQ ID NO: 592200 - RNA, 64 nt, Homo Sapiens
aaagaaaaggacaaaccuauuuaccaaacaagaguauuuuuaugacuguagaagaaaaaguuua

SEQ ID NO: 592201 - RNA, 64 nt, Homo Sapiens
uucucuugcauugaaacccucuuggauauuacaguauuuuuaauugaaaguccuaauucuguua

SEQ ID NO: 592202 - RNA, 64 nt, Homo Sapiens
cccacauugguaauaaacauuacaaaauacaauguauuuuuagguaggcauuuuauaaaaugca

SEQ ID NO: 592203 - RNA, 64 nt, Homo Sapiens
ugcucugauuguauaggugagacucuguuucuguuauuuuuaauugcuguaugaaaugugauca

SEQ ID NO: 592204 - RNA, 64 nt, Homo Sapiens
acaggugugagccaacaagcccggcuaauuuuuguauuuuuaguagagacaagguuucaccaug

SEQ ID NO: 592205 - RNA, 64 nt, Homo Sapiens
uacagucacugaacuaguagaugucaauaauuauuauuuuuaaaaauuuuuauuuguuggccgg

SEQ ID NO: 592206 - RNA, 64 nt, Homo Sapiens
acaggugcaugccaccaugccuggcuaauuuugguauuuuuaguagagaugagguuuugccauu

SEQ ID NO: 592207 - RNA, 64 nt, Homo Sapiens
uugucagagccuucuucauuuuacaauauuuuguuauuuuuauuuuaccuuuuucauuuuacaa

SEQ ID NO: 592208 - RNA, 64 nt, Homo Sapiens
uuuauuuuaccuuuuucauuuuacaauauuucguuauuuuuauuuuaccuuuuucauuuuacaa

SEQ ID NO: 592209 - RNA, 64 nt, Homo Sapiens
aaguauuguaauauuguuuuuagccuaaacuuaauauuuuuauacuuuuuuaaaugaauaaugg

SEQ ID NO: 592210 - RNA, 64 nt, Homo Sapiens
uugccaagaaaaacaacuuuuuuaaauuguucuguauuuuuaaacuaacuuaauguguauucau

SEQ ID NO: 592211 - RNA, 64 nt, Homo Sapiens
agagacgcaguuucaccguguggcuaguuuuuuguauuuuuagucaggugcccaccaccacgcc

SEQ ID NO: 592212 - RNA, 64 nt, Homo Sapiens
auaguauauguggacacauaauaauuuacaugcuuauuuuuaaaacuuauguuuuauaaugauu

SEQ ID NO: 592213 - RNA, 64 nt, Homo Sapiens
augccuuaccaaguacauccacuuacguagauuuuauuuuuacuaaauauaguauuagauuguu

SEQ ID NO: 592214 - RNA, 64 nt, Homo Sapiens
ggcaugaaaugaaugaaagcuuuuugcauucuacuauuuuuagggugaaaaccauaaaauacau

SEQ ID NO: 592215 - RNA, 64 nt, Homo Sapiens
aaauuuauuggcaaaacugguuuaccacuuugcuuauuuuuaaacgaucuaagcuuuuaacccc

SEQ ID NO: 592216 - RNA, 64 nt, Homo Sapiens
auguucuuaagcaaauauauucuaaaaaaagaaauauuuuuaaaaaccuauugugaauuccaaa

SEQ ID NO: 592217 - RNA, 64 nt, Homo Sapiens
gcuuucauuuuucccccaguugugcaagaaaauauauuuuuaaaugaaauuuaugguauuugag

SEQ ID NO: 592218 - RNA, 64 nt, Homo Sapiens
agagacgggguuucacugugcggcuaauuuuuuguauuuuuaaucaggcgcccaccaccacgcc

SEQ ID NO: 592219 - RNA, 64 nt, Homo Sapiens
gcaaguuguugcuuaucuuuuacucaccaauuuauauuuuuaaauucucaauuuugaauuaugc

SEQ ID NO: 592220 - RNA, 64 nt, Homo Sapiens
aaaguauauacaaaauucuuuaguuuuccaaaguuauuuuuaauuauugcugaucaggcaaaaa

SEQ ID NO: 592221 - RNA, 64 nt, Homo Sapiens
acugcaaguuuuuggucuuuauacuuucagaauguauuuuuacuagugaaauuuaaguuuuaaa

SEQ ID NO: 592222 - RNA, 64 nt, Homo Sapiens
uuacuuaucuucuauccaaguuucaauuuuuacauauuuuuaaauauaaacaaguacacaaauu

SEQ ID NO: 592223 - RNA, 64 nt, Homo Sapiens
uuauugcucuuuuaguuugguuguggauggaaaauauuuuuauuguaguugauguaaaaccguu

SEQ ID NO: 592224 - RNA, 64 nt, Homo Sapiens
aaagacaggguuuuaccauguggcuaauuuuuuguauuuuuagucaggcacccaccaccacacc

SEQ ID NO: 592225 - RNA, 64 nt, Homo Sapiens
uggaucccuguguaugcugauuaaaugucagauuuauuuuuaugguugggagaaucaccagggu

SEQ ID NO: 592226 - RNA, 64 nt, Homo Sapiens
gagaugaugcagaaaacuccuagaggugaaaaaauauuuuuaugcuucaauucuuugaugacuu

SEQ ID NO: 592227 - RNA, 64 nt, Homo Sapiens
gccauuuaaugccauugucauccuuuccuguagauauuuuuaauaauauuguauuucgugguag

SEQ ID NO: 592228 - RNA, 64 nt, Homo Sapiens
uaacuauacaguaagcauuuucuugauggauuucuauuuuuauaugguuucuugaggauuggac

SEQ ID NO: 592229 - RNA, 64 nt, Homo Sapiens
agugacagcguuucaccacauuggcucauuuuuguauuuuuaguacaggugcacgccaccaugc

SEQ ID NO: 592230 - RNA, 64 nt, Homo Sapiens
ucaucaccucccuugccuuuggccuagcaggauuuauuuuuauguaaaaaauggcaccauauuu

SEQ ID NO: 592231 - RNA, 64 nt, Homo Sapiens
aauauauauuuuuucugaauuaggcuugacauuuuauuuuuauaagacuaucaauuggugggau

SEQ ID NO: 592232 - RNA, 64 nt, Homo Sapiens
uuucuggugugugaacuuuaagugguauguaucauauuuuuaugaaaucuucugcuuuuugaaa

SEQ ID NO: 592233 - RNA, 64 nt, Homo Sapiens
ggagaagaaauguuacuuuuuuuauuuuguuaguuauuuuuaaaguuuuauauagcauaguggu

SEQ ID NO: 592234 - RNA, 64 nt, Homo Sapiens
aaauagcuuuugcugaggagugaaaagcaaguucuauuuuuaagcauuuuuucugaauauuaag

SEQ ID NO: 592235 - RNA, 64 nt, Homo Sapiens
gaauuucgccacagaacuuaacacaaguauugccuauuuuuauauucaacuuccggauauaaaa

SEQ ID NO: 592236 - RNA, 64 nt, Homo Sapiens
guucccuaaaaagguuugucuuccuuuuuuuuuuuauuuuuauuuuucaaaucuauacauuuuc

SEQ ID NO: 592237 - RNA, 64 nt, Homo Sapiens
aaaucacauaccugcagacaaacuggagcaauguuauuuuuaaaggguuuuuuucaccuccuua

SEQ ID NO: 592238 - RNA, 64 nt, Homo Sapiens
gaaaacagagccccguucauaaauuuuucaucuuuauuuuuaagguuauacuccucuaaauaac

SEQ ID NO: 592239 - RNA, 64 nt, Homo Sapiens
cccuuaagccucaucaagaaagguuuguuuauaguauuuuuacuauagcuucauccuugauaac

SEQ ID NO: 592240 - RNA, 64 nt, Homo Sapiens
caggcacccgccaacacgcccggcuaauuuuuuguauuuuuaguaaagacaggguuucaccgug

SEQ ID NO: 592241 - RNA, 64 nt, Homo Sapiens
acaggcacccgccaccaugcccagcuaauuuuuguauuuuuaguagagacagaguuucaccaua

SEQ ID NO: 592242 - RNA, 64 nt, Homo Sapiens
auucuucaucaaaugacuuuuggaguagagauuuuauuuuuauagcaauagaugcacagauauu

SEQ ID NO: 592243 - RNA, 64 nt, Homo Sapiens
acaggcacccaccaccacauccagcuaauuguuguauuuuuaauagaggcgggguuucgccaug

SEQ ID NO: 592244 - RNA, 64 nt, Homo Sapiens
uauuaauuguacuucuaugaaauaauaugcagucuauuuuuaaauuauaaauuaugugugaacu

SEQ ID NO: 592245 - RNA, 64 nt, Homo Sapiens
uuuauuacaagcaauucaauuguacacuuuuaguuauuuuuaaauuuacaauguuauugauuac

SEQ ID NO: 592246 - RNA, 64 nt, Homo Sapiens
uguaaaaucuauacauuucugaguucugaauaaauauuuuuaaaaauuuuaauauauuuuucuu

SEQ ID NO: 592247 - RNA, 64 nt, Homo Sapiens
acaggcaugcacuaccacgcuuggcuaauuuuuguauuuuuaguagagaugggguuucacugug

SEQ ID NO: 592248 - RNA, 64 nt, Homo Sapiens
acaggcgucccccaccacgccuggcuaaauuuuguauuuuuagguggucuugaacuccugaugu

SEQ ID NO: 592249 - RNA, 64 nt, Homo Sapiens
aucaaugauaacccuguuuauugugggauaucaauauuuuuaaagugccaacacagucaugaua

SEQ ID NO: 592250 - RNA, 64 nt, Homo Sapiens
cuccauaauuagugccaaccauuagucucguucauauuuuuacaccaggagucaacaaacugug

SEQ ID NO: 592251 - RNA, 64 nt, Homo Sapiens
acagacgugcgccaccacacccaguucauuuuuguauuuuuaguagagacaguguuuaccaugu

SEQ ID NO: 592252 - RNA, 64 nt, Homo Sapiens
acaggcguguaccaccauacccagcuaauuuuuguauuuuuaguagagaugggguuucaccacg

SEQ ID NO: 592253 - RNA, 64 nt, Homo Sapiens
acaggcacauaccacugcacccagcuaauuuuuguauuuuuaguagagaugggguuucacugug

SEQ ID NO: 592254 - RNA, 64 nt, Homo Sapiens
uucauuguucuucucuuuuuuuauuuauuuuauuuauuuuuauuuuuauuuuuauuugagacag

SEQ ID NO: 592255 - RNA, 64 nt, Homo Sapiens
guucuucucuuuuuuuauuuauuuuauuuauuuuuauuuuuauuuuuauuugagacagagucuc

SEQ ID NO: 592256 - RNA, 64 nt, Homo Sapiens
cucuuuuuuuauuuauuuuauuuauuuuuauuuuuauuuuuauuugagacagagucucacucug

SEQ ID NO: 592257 - RNA, 64 nt, Homo Sapiens
uccuuaguuuacagugcaauuuuaucucaggaauuauuuuuaaaaggaggaggggacauagaaa

SEQ ID NO: 592258 - RNA, 64 nt, Homo Sapiens
uuugcuacccugcaaccuuauugaguucacuuauuauuuuuagcuauuucuuucgacagaaucc

SEQ ID NO: 592259 - RNA, 64 nt, Homo Sapiens
acaggcgcccgccaccacgccuggcuaauuuuuguauuuuuaguagagacgggguuucaccauc

SEQ ID NO: 592260 - RNA, 64 nt, Homo Sapiens
uacaggugugcgccgccacacccagcuaauuuuguauuuuuaguagagacgggguuucaccaug

SEQ ID NO: 592261 - RNA, 64 nt, Homo Sapiens
caggcacccgccacuacgccuggcuaauuuuuuguauuuuuaguagagacgggguuucaccguu

SEQ ID NO: 592262 - RNA, 64 nt, Homo Sapiens
uacacauuuagagcguuuuguaauuccuuuuuuauauuuuuaagacuagauuuugagccaugug

SEQ ID NO: 592263 - RNA, 64 nt, Homo Sapiens
aggugccugccaccacgccuggcuaauuuuuuuguauuuuuaguagagacgggguuucaccgug

SEQ ID NO: 592264 - RNA, 64 nt, Homo Sapiens
acgggcgugagccaccgcgccuggccaggauuucuauuuuuaauauuuuugggaaaauuuuucc

SEQ ID NO: 592265 - RNA, 64 nt, Homo Sapiens
uuaaaccugaugacuugcacauuguuauuuuuauuauuuuuaauacagucuuuuuuuauuuugu

SEQ ID NO: 592266 - RNA, 64 nt, Homo Sapiens
auuuuuaauuuaaaccugauuuauuuuguauuguuauuuuuauuuuguuugagacagucuuuuu

SEQ ID NO: 592267 - RNA, 64 nt, Homo Sapiens
agagaugggguuucaccauggcuaaauuuuuuuguauuuuuaguggcgcgugccaccacaacca

SEQ ID NO: 592268 - RNA, 64 nt, Homo Sapiens
uauggaaugcuuuuagguuuuauauauuuauauauauuuuuaaaugucuagagggcugugugua

SEQ ID NO: 592269 - RNA, 64 nt, Homo Sapiens
ggagacgggguuucaccgugcggcucauuuuuuguauuuuuagucaggcgcccgccaccacgcc

SEQ ID NO: 592270 - RNA, 64 nt, Homo Sapiens
agagacgggguuucaccaugccaacuaauuuuuauauuuuuaguacaggcacaugccaccacgc

SEQ ID NO: 592271 - RNA, 64 nt, Homo Sapiens
agagacaguguuucaccaugccagcuaauuuuuauauuuuuaguacaagugcccaccaccaugc

SEQ ID NO: 592272 - RNA, 64 nt, Homo Sapiens
cuauuuuuguaauauggcuuuggcagaauagagguauuuuuaggaauccucuggcccagccuca

SEQ ID NO: 592273 - RNA, 64 nt, Homo Sapiens
uuucuuuuuuuuuuuacauugaaugaauuauuauuauuuuuauuauuuccuuacacucugacau

SEQ ID NO: 592274 - RNA, 64 nt, Homo Sapiens
agagaugagguuucaccaugcggcuaauuuuuuuuauuuuuaaucaggugugcaccaccacacc

SEQ ID NO: 592275 - RNA, 64 nt, Homo Sapiens
uuugagacagagccucgcucauuuuuuuuauuuuuauuuuuauuuuuucugucucucucuuuuu

SEQ ID NO: 592276 - RNA, 64 nt, Homo Sapiens
uuuauuuuugagacagagcccuuuuuauuuuuuuuauuuuuauuguuuccuuuucugucucucu

SEQ ID NO: 592277 - RNA, 64 nt, Homo Sapiens
uuuuguagagacaggugucuccugguuaauuuuuuauuuuuauuuacagacaugcaccaccaca

SEQ ID NO: 592278 - RNA, 64 nt, Homo Sapiens
auuuuugagcuagguucucauguggccgaccuacuauuuuuauuggauuacaggugugagccac

SEQ ID NO: 592279 - RNA, 64 nt, Homo Sapiens
agagauggaguuucaccaugcagccuaauuuuuguauuuuuaguuaggcgugagccaccaugcc

SEQ ID NO: 592280 - RNA, 64 nt, Homo Sapiens
guuuucuaauauuuauuuuugaggccugaauaaguauuuuuaaaaauaaaaucccuacauuucu

SEQ ID NO: 592281 - RNA, 64 nt, Homo Sapiens
gucauaauaaaaguuauguaauugauuacaguguuauuuuuaugaaauguaaaauuaaauuguu

SEQ ID NO: 592282 - RNA, 64 nt, Homo Sapiens
ugaggugagguuucaccaugcuggcugauuuuuguauuuuuagucaaggugcccuccagcaugc

SEQ ID NO: 592283 - RNA, 64 nt, Homo Sapiens
ggugacaauuaugacuuuuaauaugaaauauggcuauuuuuaauuaaauagaauaguguugaag

SEQ ID NO: 592284 - RNA, 64 nt, Homo Sapiens
guuuuuuuuugaguauuuucuuuuuauuguauuuuauuuuuauuguauuuuucaauuugcauua

SEQ ID NO: 592285 - RNA, 64 nt, Homo Sapiens
guauuuuauuuuuauuguuuuuuucaauuugcauuauuuuuauuaaauaguuguuauacuguau

SEQ ID NO: 592286 - RNA, 64 nt, Homo Sapiens
agagaugggguuucuccaaaccuggcuaauuuuguauuuuuaguuacaggugugagccaccacg

SEQ ID NO: 592287 - RNA, 64 nt, Homo Sapiens
agagacggaguugcaccaugcccggcuaauuuuguauuuuuaguuacaggcaugcgccaccaug

SEQ ID NO: 592288 - RNA, 64 nt, Homo Sapiens
aaauuagagugaagaaaaauuauauuaacagaaauauuuuuaaauaagugacaaauuaagucua

SEQ ID NO: 592289 - RNA, 64 nt, Homo Sapiens
agagacgggauaucuccgugaccggcuaauuuuauauuuuuaguuacaggcaugcgccaccaug

SEQ ID NO: 592290 - RNA, 64 nt, Homo Sapiens
gucuuacagcucaucauuuuagucagauacaauguauuuuuacauccacagaguuagcacuccu

SEQ ID NO: 592291 - RNA, 64 nt, Homo Sapiens
agagacaggguuucaccuggcuggauaauuuuuguauuuuuaguacaggugcgagccccuacac

SEQ ID NO: 592292 - RNA, 64 nt, Homo Sapiens
uuuugagauagcgucucacuagccaggauuuuuuuauuuuuauuguuuccuuaguaagggacag

SEQ ID NO: 592293 - RNA, 64 nt, Homo Sapiens
augucucuuuuaaagucuuuuggccucauuugaguauuuuuauacaggcaugagccaccgugcc

SEQ ID NO: 592294 - RNA, 64 nt, Homo Sapiens
agagacaggguuucaccauuuuuuuuuuuaaaaauauuuuuaguaugccaacacgcccggcuaa

SEQ ID NO: 592295 - RNA, 64 nt, Homo Sapiens
agagacagaguuuugcuaugcagcuaauuuuuuguauuuuuaguaggcaugcaccaccacagcc

SEQ ID NO: 592296 - RNA, 64 nt, Homo Sapiens
ugacauuguuuucuguucaguuuuuugcuuguaguauuuuuagucaccuucauucucagugaug

SEQ ID NO: 592297 - RNA, 64 nt, Homo Sapiens
agagacgggguuucaucguggcuaauuuuuuuuguauuuuuaguggcgcccgccaccacgcccg

SEQ ID NO: 592298 - RNA, 64 nt, Homo Sapiens
agagacaggguuucaccaugcuggcuaauuuuuguauuuuuaguacaggcacaggccauuaugc

SEQ ID NO: 592299 - RNA, 64 nt, Homo Sapiens
agagacgggguuucaccaugcaggcuaauuuuuguauuuuuaguacaggcacgcgccaccaagc

SEQ ID NO: 592300 - RNA, 64 nt, Homo Sapiens
uuuuucucgaggcagaaucuagauacucauuucuuauuuuuauuuuguaucauaauuuacaugu

SEQ ID NO: 592301 - RNA, 64 nt, Homo Sapiens
agagacuggguuucaccgugcggguaauuuuuuguauuuuuagucaggugcgugccaccaugcc

SEQ ID NO: 592302 - RNA, 64 nt, Homo Sapiens
auggaaucuugcucugucgcuuuauuuauuuauuuauuuuuaaguuucccagccuguauguucu

SEQ ID NO: 592303 - RNA, 64 nt, Homo Sapiens
agagacgggguuucuccgugcccagcuuauuuuguauuuuuaguuacaggcaugcaccaccacg

SEQ ID NO: 592304 - RNA, 64 nt, Homo Sapiens
uuuuuugagacagaguuucgaccauuuuuauuuuuauuuuuauucgccaguuucuaacgcccuc

SEQ ID NO: 592305 - RNA, 64 nt, Homo Sapiens
uuuauuuuuuuugagacagagcccucaccauuuuuauuuuuauuccugaucgccaguuucuaac

SEQ ID NO: 592306 - RNA, 64 nt, Homo Sapiens
auaacagaauaucagccuccaaaauaauaaacacuauuuuuagaauuuugcaugacacauuuua

SEQ ID NO: 592307 - RNA, 64 nt, Homo Sapiens
agagacaggguuucaccaugauuuauuucuuuuguauuuuuaguaccaccaugcccagcuaauu

SEQ ID NO: 592308 - RNA, 64 nt, Homo Sapiens
uuauguuuuauuguagaccuuugugguauuaaauuauuuuuaaaguuuuuuuucuuuggaguuu

SEQ ID NO: 592309 - RNA, 64 nt, Homo Sapiens
agagacgggguuucaccaugggcuaguuuuuuuguauuuuuaguaggcgcccaccaccaugccc

SEQ ID NO: 592310 - RNA, 64 nt, Homo Sapiens
guuaugucuuauuuuuuuccuaaaagauaauguuuauuuuuaaaaaggaaggaaggagcaagug

SEQ ID NO: 592311 - RNA, 64 nt, Homo Sapiens
ucggaguguacauaaaacagaaaaaaucuucauguauuuuuauuaaauauaacaaugucugagu

SEQ ID NO: 592312 - RNA, 64 nt, Homo Sapiens
uacaggugugugccaucaugccugacuaauuuuguauuuuuaguagagacaggguuucaccaug

SEQ ID NO: 592313 - RNA, 64 nt, Homo Sapiens
aggugcccaccaccaagcccugcaaauuuuuuuguauuuuuaguagagacaguguuuugccaug

SEQ ID NO: 592314 - RNA, 64 nt, Homo Sapiens
uuauuuugccguuugacauuuuuuaugguucauuuauuuuuaauauagagaggaagauugaaua

SEQ ID NO: 592315 - RNA, 64 nt, Homo Sapiens
caauuguguccugaaaauuguuucaagaauuuaauauuuuuaugaaaauuauuuuauuuaacuu

SEQ ID NO: 592316 - RNA, 64 nt, Homo Sapiens
auuugaugaacagaaauaaagugauaacaagaguuauuuuuaaacagaacuccucuuacccccc

SEQ ID NO: 592317 - RNA, 64 nt, Homo Sapiens
uaugaaguaccucauguugaauguuauuguacuguauuuuuaauguaacagugcagaucuuguu

SEQ ID NO: 592318 - RNA, 64 nt, Homo Sapiens
agucauuuuacauuucaaagcaguguguguuucuuauuuuuauauuuuuaacucuuuauucuug

SEQ ID NO: 592319 - RNA, 64 nt, Homo Sapiens
uacauuucaaagcaguguguguuucuuauuuuuauauuuuuaacucuuuauucuuggauguaua

SEQ ID NO: 592320 - RNA, 64 nt, Homo Sapiens
uauauaaauaucacccaaaaggcuuucugcccuauauuuuuaaaauacagaauaguuauauuug

SEQ ID NO: 592321 - RNA, 64 nt, Homo Sapiens
ccuggcccuaguucuauagggcuuggcuauuuaauauuuuuauggaagaaguguuuaguucugg

SEQ ID NO: 592322 - RNA, 64 nt, Homo Sapiens
accgggguugacucacggaauuaaauuuuuccucuauuuuuauauccuuuccuguuguggaugu

SEQ ID NO: 592323 - RNA, 50 nt, Homo Sapiens
uauggaaugcaucuuggugauauuuuuaaauuaauauuuuaaauugcuug

SEQ ID NO: 592324 - RNA, 64 nt, Homo Sapiens
uuuuaaaguaugugucucuaaaggaagaaauacauauuuuuauuugacuauguuuggaguuuaa

SEQ ID NO: 592325 - RNA, 64 nt, Homo Sapiens
agagaugggguuucuccaugcccagcuaauuuuguauuuuuaguuacaggcauguaccaccaca

SEQ ID NO: 592326 - RNA, 64 nt, Homo Sapiens
uuuuugagauggaguuucacucauuuguuuauuuuauuuuuauuggagcaagcauuguuucuuu

SEQ ID NO: 592327 - RNA, 64 nt, Homo Sapiens
guuguuuuccccuaaaaggaaaggacuagaacuguauuuuuaaguuuuucuuuguucacugccc

SEQ ID NO: 592328 - RNA, 64 nt, Homo Sapiens
aauuaauuguuuggaacucugacaaauguuuuguuauuuuuauaauccugaucuuuuuuucaua

SEQ ID NO: 592329 - RNA, 64 nt, Homo Sapiens
aaaaaguauaaaguauacaguuuguaagaauauuuauuuuuauaacagacacagcgccuguccu

SEQ ID NO: 592330 - RNA, 64 nt, Homo Sapiens
gcuuuguauuuuugugguuauguuaacauguuuuuauuuuuauuuuucaggcaacugaaauuca

SEQ ID NO: 592331 - RNA, 64 nt, Homo Sapiens
ugguaugugaucgugucauuuaaagguguuaagauauuuuuaagaguaugagaugagaucuaag

SEQ ID NO: 592332 - RNA, 64 nt, Homo Sapiens
agagacgggguuuccccaugccaacugauuuuuguauuuuuaguacaggcgcacaccaccacgc

SEQ ID NO: 592333 - RNA, 64 nt, Homo Sapiens
aauauaaaguccuguuuauucuuuuuuaugaugcuauuuuuauugagaaaaauggccugcaaac

SEQ ID NO: 592334 - RNA, 64 nt, Homo Sapiens
auuauaaauucacgucuugucucugcugugaaauuauuuuuagauaucuagguauaugcuuucu

SEQ ID NO: 592335 - RNA, 64 nt, Homo Sapiens
auauuucagaaauauacauuuucuuccuacauuauauuuuuagaucuguguauuugauaaauau

SEQ ID NO: 592336 - RNA, 64 nt, Homo Sapiens
acugcuuuuccuaaaugcaugguuuauuugugcauauuuuuacuuaaaaauuguguuuacagau

SEQ ID NO: 592337 - RNA, 64 nt, Homo Sapiens
aggacuuuaacgaagucaaacuagagaacaccucuauuuuuaaaauaaaaacauuauugggaaa

SEQ ID NO: 592338 - RNA, 64 nt, Homo Sapiens
caaaaaauaaguuaaucaggaacuguacggaauauauuuuuaaaaauuuuuguuugguuauauc

SEQ ID NO: 592339 - RNA, 64 nt, Homo Sapiens
ccaucugaaagugguacuugaucauuuuuaccauuauuuuuaggauguguauuucauuuauuua

SEQ ID NO: 592340 - RNA, 64 nt, Homo Sapiens
uaaguguuugauaaaaaugaacuguucuaauauuuauuuuuauggcaucucauuuuucaauaca

SEQ ID NO: 592341 - RNA, 64 nt, Homo Sapiens
uaauuucaauugugcaagacaugugccuuauaauuauuuuuagcuuaaaauuaaacagauuuug

SEQ ID NO: 592342 - RNA, 64 nt, Homo Sapiens
caggcaugagcuaccacgccuggcuaauuuuuuguauuuuuaguagagacucgguuucaccaug

SEQ ID NO: 592343 - RNA, 64 nt, Homo Sapiens
uauuuuuuuaacccuacccuuaacccaugaacacuauuuuuaauuaaaguaucugauguaaaau

SEQ ID NO: 592344 - RNA, 64 nt, Homo Sapiens
caaaggagcgagcaugucguggacacacacagacuauuuuuagauuuucuuuugccuuuugcaa

SEQ ID NO: 592345 - RNA, 64 nt, Homo Sapiens
cuuuucagagaucaggagggauuuauguagcagcuauuuuuacugcaaaaguaauucacuggaa

SEQ ID NO: 592346 - RNA, 64 nt, Homo Sapiens
cacuggaaaaaaaauguaauuuguaagaaagcuuuauuuuuaucucagcucuauguaaaguuaa

SEQ ID NO: 592347 - RNA, 64 nt, Homo Sapiens
ccuguuucauuugcuauauagaaaaagaaacuccuauuuuuaccuugcuggaauuauuggauaa

SEQ ID NO: 592348 - RNA, 64 nt, Homo Sapiens
uuuuuaccuugcuggaauuauuggauaaaaaagcuauuuuuauaaauucguuaugaauuggaug

SEQ ID NO: 592349 - RNA, 64 nt, Homo Sapiens
uacaggcaugcgccaccacacccggcuaauuuuguauuuuuaguagagauggguuucuccaugu

SEQ ID NO: 592350 - RNA, 64 nt, Homo Sapiens
auuuguauuaagugucauaacuacaauagaugaguauuuuuacucauuuuacaaacccauaagc

SEQ ID NO: 592351 - RNA, 64 nt, Homo Sapiens
ugaauuguuucauguauuuagaccuuaacauuuauauuuuuauaugccauauuuugcugugagu

SEQ ID NO: 592352 - RNA, 64 nt, Homo Sapiens
uuuugugguuauauucccaaaaugugacaaaauuuauuuuuauuaauuuuaaucaaguaacuca

SEQ ID NO: 592353 - RNA, 64 nt, Homo Sapiens
auaagauguuuuuaauauaaagcucaugagaguuuauuuuuauuaccacuguuugaguucuaca

SEQ ID NO: 592354 - RNA, 64 nt, Homo Sapiens
ggaggauuuggucagaaugcaaauuuuauggcacuauuuuuauuaagguauccaaugucgcugu

SEQ ID NO: 592355 - RNA, 64 nt, Homo Sapiens
uacguuuauauaaauauauaauuugggugguuuuuauuuuuauaauugcaaaaugcguauuugc

SEQ ID NO: 592356 - RNA, 64 nt, Homo Sapiens
uuuuccgcaccuuaucaauuuggcaucuaauucuuauuuuuaaugggaugcaacucgcccuguu

SEQ ID NO: 592357 - RNA, 64 nt, Homo Sapiens
cauauuuaaacauuuuuacaacuuuggguuacaguauuuuuauuauuuuuaaaaguaggcaacu

SEQ ID NO: 592358 - RNA, 64 nt, Homo Sapiens
aguuucauuuuuaaaaguaguuugggcucccucuuauuuuuacaaacuaagacuuucuaugugg

SEQ ID NO: 592359 - RNA, 64 nt, Homo Sapiens
gauuugagugcauguuuuaaaagugcugguaaauuauuuuuaauguuauaaacuugaauuuaua

SEQ ID NO: 592360 - RNA, 64 nt, Homo Sapiens
ugcacuugcuggucuuuguauaaaucaugacuguuauuuuuauuugaaaaguuaugaaugugac

SEQ ID NO: 592361 - RNA, 64 nt, Homo Sapiens
uacaggcaugcaccaccaugccuggcuaauuuuguauuuuuaguagagaugggguuucuccaug

SEQ ID NO: 592362 - RNA, 64 nt, Homo Sapiens
caggcacgugugaccaugccgggcuaauuuuuuauauuuuuaguagagagagguuucaccgugu

SEQ ID NO: 592363 - RNA, 64 nt, Homo Sapiens
caggcaugcaccaccacacuuggccaauguucuguauuuuuaauagggacgggguuuugccaug

SEQ ID NO: 592364 - RNA, 64 nt, Homo Sapiens
acaggcgugugccaccaugccuggcuaauuuuuguauuuuuaguagagaugggguuucgccaug

SEQ ID NO: 592365 - RNA, 64 nt, Homo Sapiens
ucuccauuucuuuccagccaugauguuuaguaaauauuuuuaguaccgcacuuagcagacagcu

SEQ ID NO: 592366 - RNA, 64 nt, Homo Sapiens
uucuugccacaaaaguguccuggcaagagccccuuauuuuuaagacaucaggaagccagaccgc

SEQ ID NO: 592367 - RNA, 64 nt, Homo Sapiens
uuuugaauguuuuguauguaaaauagcaaguggcuauuuuuaaaguuaaguuuguauaaauagu

SEQ ID NO: 592368 - RNA, 64 nt, Homo Sapiens
uuuaagcuuaucuugauuuucaaacaugcauagcuauuuuuaucacucuaaucaguaaggcuac

SEQ ID NO: 592369 - RNA, 64 nt, Homo Sapiens
uccugggccuguuuucucacggcuuugagugacauauuuuuauuuucugauucugucacucauu

SEQ ID NO: 592370 - RNA, 64 nt, Homo Sapiens
uauuuuaagggugcaggaggugaggcaggauaaguauuuuuacaaaugucacucuugcagucuu

SEQ ID NO: 592371 - RNA, 64 nt, Homo Sapiens
agguaaagcauuauguuggguaguacuuuauuuuuauuuuuaagaccugugauguauauagaau

SEQ ID NO: 592372 - RNA, 64 nt, Homo Sapiens
uuuaagagguaaagcauuauuagaauuaguacuuuauuuuuauuuaugguaccugugauguaua

SEQ ID NO: 592373 - RNA, 64 nt, Homo Sapiens
aauagugauuaucaggcguugagccuuuuuguaguauuuuuagucuuugauacucuguaagugc

SEQ ID NO: 592374 - RNA, 64 nt, Homo Sapiens
uuaauccauuccauuuucuaaaacugucauaaacuauuuuuaaucauuuuaaauaaauguaaaa

SEQ ID NO: 592375 - RNA, 64 nt, Homo Sapiens
aguuaaaauaaaauuuuugaaauuauugucuuaauauuuuuauauaggcugaugucuuugccuc

SEQ ID NO: 592376 - RNA, 64 nt, Homo Sapiens
ugaacuguguauguaugugugggguuuuuuucuuuauuuuuaaaugaaaauuaagacaccuuuu

SEQ ID NO: 592377 - RNA, 64 nt, Homo Sapiens
ugagagccuuucaggggggacuaugagaucaaaauauuuuuauuauaaugugaagacauugucu

SEQ ID NO: 592378 - RNA, 64 nt, Homo Sapiens
uauuacauucaccuuugauuguuuuuuaaaaguuuauuuuuacagaauauauuuaguaccuuuc

SEQ ID NO: 592379 - RNA, 64 nt, Homo Sapiens
gaugcuugguuuacauuaaauuaugguauuuaacuauuuuuauguuuauacuagguagggucuu

SEQ ID NO: 592380 - RNA, 64 nt, Homo Sapiens
uauguuucuguguuuuugguaugcuaaauaaagcuauuuuuaaacccaagagauuuuuuuucug

SEQ ID NO: 592381 - RNA, 64 nt, Homo Sapiens
guggggguguccaggcaguagaucauuuuuugucuauuuuuaaccaaauaagaauaacacucaa

SEQ ID NO: 592382 - RNA, 64 nt, Homo Sapiens
gaguuauuauaguuauucaaauccauaagcagguuauuuuuauuuuuuuacuguuugaaaagaa

SEQ ID NO: 592383 - RNA, 64 nt, Homo Sapiens
auagcagcuauuaugaaaucagcuuucauaggccuauuuuuaaaaggaaucugaaauuuaauuc

SEQ ID NO: 592384 - RNA, 64 nt, Homo Sapiens
acaggcaugcgccacuacaccuggcuaauuuuuguauuuuuaguugagaugggguuuuuccacg

SEQ ID NO: 592385 - RNA, 64 nt, Homo Sapiens
cccauugaaggcauucuucaacucaguuauguuuuauuuuuauuuguaauauuuccauuugauu

SEQ ID NO: 592386 - RNA, 64 nt, Homo Sapiens
agcccauaauacccucuaacauauuaaucauaguuauuuuuaacucccugucugauaguuccaa

SEQ ID NO: 592387 - RNA, 64 nt, Homo Sapiens
agaacgaaugaaguacuauuauugauaacuuauauauuuuuauuuagagcaaucccacaugcuu

SEQ ID NO: 592388 - RNA, 64 nt, Homo Sapiens
ugagaagcaccauuuaugcagauuuucuucagaauauuuuuaaaagguacagaauccuuaaaau

SEQ ID NO: 592389 - RNA, 64 nt, Homo Sapiens
aaaauguuugauuuuuaucuugucuagauuggcauauuuuuaacauuuuacuuaagauagcaaa

SEQ ID NO: 592390 - RNA, 64 nt, Homo Sapiens
ucuucucacagugaucuugugaguuaguuacuuauauuuuuauuagaacucauuauucugggua

SEQ ID NO: 592391 - RNA, 64 nt, Homo Sapiens
ugguacuuguuuucuaccuccuaaaaauguagcuuauuuuuaggauuuaaaucacuaaguaaau

SEQ ID NO: 592392 - RNA, 64 nt, Homo Sapiens
gugaucaugagugucauuuuuguucuaagacuaauauuuuuagaucuuuuuacuucaccucaua

SEQ ID NO: 592393 - RNA, 64 nt, Homo Sapiens
caacauggcuacuugcuuugaggcucaccagaauuauuuuuaagugguuuuaauaaaauaauaa

SEQ ID NO: 592394 - RNA, 64 nt, Homo Sapiens
aauauagauuaaaucauacuccuaugcuuuagcuuauuuuuacaguuauagaaagcaagaugua

SEQ ID NO: 592395 - RNA, 64 nt, Homo Sapiens
uucuguuguauuucauuuccaguuuucaggcaguuauuuuuauuauuguacuuuaagcuuuuaa

SEQ ID NO: 592396 - RNA, 64 nt, Homo Sapiens
gaggugcuuaugcuuagcuugaugaccaggauguuauuuuuaacaaaaugauugcugaaguguu

SEQ ID NO: 592397 - RNA, 64 nt, Homo Sapiens
uaggaguaaaaaagucuuugcauaaaacaguauuuauuuuuacuuuugugaccacuauuuuaga

SEQ ID NO: 592398 - RNA, 64 nt, Homo Sapiens
cucaaugcuugcuuuuauuuuaaccaucuuuuacuauuuuuagaaggaaacuagcuuuaguagu

SEQ ID NO: 592399 - RNA, 64 nt, Homo Sapiens
agaaaauguuuuccccuaauuuuccagagaagccuauuuuuauauuuuuaaaaaacugacaggg

SEQ ID NO: 592400 - RNA, 64 nt, Homo Sapiens
uuuuccccuaauuuuccagagaagccuauuuuuauauuuuuaaaaaacugacagggcccaguua

SEQ ID NO: 592401 - RNA, 64 nt, Homo Sapiens
uacaacauuugcuccuuaaugcaguuacaugcauuauuuuuauuugguuaaucugacauacauu

SEQ ID NO: 592402 - RNA, 64 nt, Homo Sapiens
ucagauggugauucugaagcagacauuggacagauauuuuuagugcuucuuuugucuggguaau

SEQ ID NO: 592403 - RNA, 64 nt, Homo Sapiens
acuuguuuagaaaggauucauagauuacgaaauauauuuuuagacaggaaaaugcuaaaucuga

SEQ ID NO: 592404 - RNA, 64 nt, Homo Sapiens
uaggagucagauacaaaaagaauaugagaagccauauuuuuacaacacuaacaagaggaagcag

SEQ ID NO: 592405 - RNA, 64 nt, Homo Sapiens
uaaaaauugggaauaagcuugcccggccaugaaauauuuuuacuacaggcgugugagccaccac

SEQ ID NO: 592406 - RNA, 64 nt, Homo Sapiens
agagacaggguuucaccauacuggcuaauuuuuguauuuuuaguauaggcgugcaccaccacac

SEQ ID NO: 592407 - RNA, 64 nt, Homo Sapiens
uaaaaauugggaauaagcucgcccaaccaugaaauauuuuuacuuuacaggcgugagccaccgu

SEQ ID NO: 592408 - RNA, 64 nt, Homo Sapiens
agagacaggguuucaccauaccggcuaauuuuuguauuuuuaguacaggcgcgugccaccacgc

SEQ ID NO: 592409 - RNA, 64 nt, Homo Sapiens
ucaauuaaugaaaacaguccuugacuuaacucaguauuuuuauuuuacuuaauucacagauaag

SEQ ID NO: 592410 - RNA, 64 nt, Homo Sapiens
ggaaauauuucaugucccuuacaccauauagcauuauuuuuauaaaaaauacacugaauaaagu

SEQ ID NO: 592411 - RNA, 64 nt, Homo Sapiens
uauaugacauguuuacuacuuauucuauauuuauuauuuuuaaagcuauuaguuucuguacugc

SEQ ID NO: 592412 - RNA, 64 nt, Homo Sapiens
ucaaauauacaguucuaauacuuaauuauaaacauauuuuuauauaauauacaaauuuggauag

SEQ ID NO: 592413 - RNA, 64 nt, Homo Sapiens
uguggaaaauugaaauaagaugcaauaaaaaauauauuuuuauauggccuuaacuguucaguau

SEQ ID NO: 592414 - RNA, 64 nt, Homo Sapiens
aagucauuucaaaauauguguuuauuuaugcuaauauuuuuaacaagugugaccaguuuugaua

SEQ ID NO: 592415 - RNA, 64 nt, Homo Sapiens
aguggguaggauugugaauuuacaugucuaaauauauuuuuagaaaacaagcccaccgcuucug

SEQ ID NO: 592416 - RNA, 64 nt, Homo Sapiens
aaaaaagcaaacaauuuaaaauucaccuuuaauauauuuuuacaggaagggagagaggauuucu

SEQ ID NO: 592417 - RNA, 64 nt, Homo Sapiens
acaauauaacugaguuauaucaugcuagcauggguauuuuuauacacacauauauaggcaguug

SEQ ID NO: 592418 - RNA, 64 nt, Homo Sapiens
gcaaaagaugugcaaaaucagaauuuaaaacuguuauuuuuacacuuugguuuuuccaaccaag

SEQ ID NO: 592419 - RNA, 64 nt, Homo Sapiens
agauaaauauuccuuuuuauaguguucaaaguuguauuuuuaaauuuguaaaugagaugccagu

SEQ ID NO: 592420 - RNA, 64 nt, Homo Sapiens
gguuuucaaguggaaguuccuagaaagugauuuauauuuuuaauaaauauguguuggacaagca

SEQ ID NO: 592421 - RNA, 62 nt, Homo Sapiens
aauugcuaauacccaguuacuuaugauuuaaaaacaaccaacagaaaacaucccacugacug

SEQ ID NO: 592422 - RNA, 62 nt, Homo Sapiens
aaauaaaaugaacaucucuugaaaccuguuaaaacaaccaguuaaagccacagauggcuuuc

SEQ ID NO: 592423 - RNA, 62 nt, Homo Sapiens
guaucccuuuugcuuuucagugucuucucagaaacaaccagcugagaagguaauuaaagucu

SEQ ID NO: 592424 - RNA, 62 nt, Homo Sapiens
guuucccuuuugcuuuucagugucuucucagaaacaaccagcugagaagguaauuaaagucu

SEQ ID NO: 592425 - RNA, 62 nt, Homo Sapiens
guaucccuuuugcuuuucagugucuucucagaaacaaccagccucaaagguaauuaaacucu

SEQ ID NO: 592426 - RNA, 62 nt, Homo Sapiens
guaucccuuuugcuuuucagugucuucucagaaacaaccagccuugaagguaauuaaacucu

SEQ ID NO: 592427 - RNA, 62 nt, Homo Sapiens
uaucccuuuuugcuuuucagugucuucucagaaacaaccagccuugaagguaauuaaacucu

SEQ ID NO: 592428 - RNA, 62 nt, Homo Sapiens
gggaauggugagaccugauaauccaaaggcucaacaaccagaccauagccauguggauuuuu

SEQ ID NO: 592429 - RNA, 62 nt, Homo Sapiens
auaacauuaauaauagaaaacuuuuauuuuaaaacaaccacaggucauauauacauucagaa

SEQ ID NO: 592430 - RNA, 62 nt, Homo Sapiens
aaaugccuugcugauucacuacuuuuuuaaacaacaaccaaauguuucuauaaggaaauaau

SEQ ID NO: 592431 - RNA, 62 nt, Homo Sapiens
uuugucacagaaauuuaguuuuuaaaaacaacaacaaccauacuauaucauguucucgguau

SEQ ID NO: 592432 - RNA, 62 nt, Homo Sapiens
uaguugguguaaaaaacuuucuaguggcugugaacaaccauuguaguucauauguacaccag

SEQ ID NO: 592433 - RNA, 62 nt, Homo Sapiens
uaagagauguggagucuucgguguuuaaagucaacaaccaugccagggauugaggaggacua

SEQ ID NO: 592434 - RNA, 62 nt, Homo Sapiens
aauuauauaguauaccauacauuaucauucaaaacaaccauccugcucauaacaucuuugaa

SEQ ID NO: 592435 - RNA, 55 nt, Homo Sapiens; identical to SEQ ID NO: 194635

SEQ ID NO: 592436 - RNA, 64 nt, Homo Sapiens; identical to SEQ ID NO: 417042

SEQ ID NO: 592437 - RNA, 64 nt, Homo Sapiens; identical to SEQ ID NO: 417043

SEQ ID NO: 592438 - RNA, 64 nt, Homo Sapiens; identical to SEQ ID NO: 417044

SEQ ID NO: 592439 - RNA, 64 nt, Homo Sapiens; identical to SEQ ID NO: 417045

SEQ ID NO: 592440 - RNA, 64 nt, Homo Sapiens; identical to SEQ ID NO: 417046

SEQ ID NO: 592441 - RNA, 64 nt, Homo Sapiens; identical to SEQ ID NO: 417047

SEQ ID NO: 592442 - RNA, 64 nt, Homo Sapiens; identical to SEQ ID NO: 417048

SEQ ID NO: 592443 - RNA, 64 nt, Homo Sapiens; identical to SEQ ID NO: 417049

SEQ ID NO: 592444 - RNA, 64 nt, Homo Sapiens; identical to SEQ ID NO: 417050

SEQ ID NO: 592445 - RNA, 64 nt, Homo Sapiens; identical to SEQ ID NO: 417051

SEQ ID NO: 592446 - RNA, 64 nt, Homo Sapiens; identical to SEQ ID NO: 417052

SEQ ID NO: 592447 - RNA, 64 nt, Homo Sapiens; identical to SEQ ID NO: 417053

SEQ ID NO: 592448 - RNA, 64 nt, Homo Sapiens; identical to SEQ ID NO: 417054

SEQ ID NO: 592449 - RNA, 64 nt, Homo Sapiens; identical to SEQ ID NO: 417055

SEQ ID NO: 592450 - RNA, 64 nt, Homo Sapiens; identical to SEQ ID NO: 417056

SEQ ID NO: 592451 - RNA, 64 nt, Homo Sapiens; identical to SEQ ID NO: 417057

SEQ ID NO: 592452 - RNA, 64 nt, Homo Sapiens; identical to SEQ ID NO: 417058

SEQ ID NO: 592453 - RNA, 64 nt, Homo Sapiens; identical to SEQ ID NO: 417059

SEQ ID NO: 592454 - RNA, 64 nt, Homo Sapiens; identical to SEQ ID NO: 417060

SEQ ID NO: 592455 - RNA, 64 nt, Homo Sapiens; identical to SEQ ID NO: 417061

SEQ ID NO: 592456 - RNA, 64 nt, Homo Sapiens; identical to SEQ ID NO: 417062

SEQ ID NO: 592457 - RNA, 64 nt, Homo Sapiens; identical to SEQ ID NO: 417063

SEQ ID NO: 592458 - RNA, 64 nt, Homo Sapiens; identical to SEQ ID NO: 417064

SEQ ID NO: 592459 - RNA, 64 nt, Homo Sapiens; identical to SEQ ID NO: 417065

SEQ ID NO: 592460 - RNA, 64 nt, Homo Sapiens; identical to SEQ ID NO: 417066

SEQ ID NO: 592461 - RNA, 64 nt, Homo Sapiens; identical to SEQ ID NO: 417067

SEQ ID NO: 592462 - RNA, 64 nt, Homo Sapiens; identical to SEQ ID NO: 417068

SEQ ID NO: 592463 - RNA, 64 nt, Homo Sapiens; identical to SEQ ID NO: 417069

SEQ ID NO: 592464 - RNA, 64 nt, Homo Sapiens; identical to SEQ ID NO: 417070

SEQ ID NO: 592465 - RNA, 64 nt, Homo Sapiens; identical to SEQ ID NO: 417071

SEQ ID NO: 592466 - RNA, 64 nt, Homo Sapiens; identical to SEQ ID NO: 417072

SEQ ID NO: 592467 - RNA, 64 nt, Homo Sapiens; identical to SEQ ID NO: 417073

SEQ ID NO: 592468 - RNA, 64 nt, Homo Sapiens; identical to SEQ ID NO: 417074

SEQ ID NO: 592469 - RNA, 64 nt, Homo Sapiens; identical to SEQ ID NO: 417075

SEQ ID NO: 592470 - RNA, 64 nt, Homo Sapiens; identical to SEQ ID NO: 417076

SEQ ID NO: 592471 - RNA, 64 nt, Homo Sapiens; identical to SEQ ID NO: 417077

SEQ ID NO: 592472 - RNA, 64 nt, Homo Sapiens; identical to SEQ ID NO: 417078

SEQ ID NO: 592473 - RNA, 64 nt, Homo Sapiens; identical to SEQ ID NO: 417079

SEQ ID NO: 592474 - RNA, 64 nt, Homo Sapiens; identical to SEQ ID NO: 417080

SEQ ID NO: 592475 - RNA, 64 nt, Homo Sapiens; identical to SEQ ID NO: 417081

SEQ ID NO: 592476 - RNA, 64 nt, Homo Sapiens; identical to SEQ ID NO: 212638

SEQ ID NO: 592477 - RNA, 64 nt, Homo Sapiens; identical to SEQ ID NO: 212639

SEQ ID NO: 592478 - RNA, 64 nt, Homo Sapiens; identical to SEQ ID NO: 212640

SEQ ID NO: 592479 - RNA, 64 nt, Homo Sapiens; identical to SEQ ID NO: 212641

SEQ ID NO: 592480 - RNA, 64 nt, Homo Sapiens; identical to SEQ ID NO: 212642

SEQ ID NO: 592481 - RNA, 64 nt, Homo Sapiens; identical to SEQ ID NO: 212643

SEQ ID NO: 592482 - RNA, 64 nt, Homo Sapiens; identical to SEQ ID NO: 212644

SEQ ID NO: 592483 - RNA, 64 nt, Homo Sapiens; identical to SEQ ID NO: 212645

SEQ ID NO: 592484 - RNA, 64 nt, Homo Sapiens; identical to SEQ ID NO: 212646

SEQ ID NO: 592485 - RNA, 64 nt, Homo Sapiens; identical to SEQ ID NO: 212647

SEQ ID NO: 592486 - RNA, 64 nt, Homo Sapiens; identical to SEQ ID NO: 212648

SEQ ID NO: 592487 - RNA, 64 nt, Homo Sapiens; identical to SEQ ID NO: 212649

SEQ ID NO: 592488 - RNA, 64 nt, Homo Sapiens; identical to SEQ ID NO: 212650

SEQ ID NO: 592489 - RNA, 64 nt, Homo Sapiens; identical to SEQ ID NO: 212651

SEQ ID NO: 592490 - RNA, 64 nt, Homo Sapiens; identical to SEQ ID NO: 212652

SEQ ID NO: 592491 - RNA, 64 nt, Homo Sapiens; identical to SEQ ID NO: 212653

SEQ ID NO: 592492 - RNA, 64 nt, Homo Sapiens; identical to SEQ ID NO: 212654

SEQ ID NO: 592493 - RNA, 64 nt, Homo Sapiens; identical to SEQ ID NO: 212655

SEQ ID NO: 592494 - RNA, 64 nt, Homo Sapiens; identical to SEQ ID NO: 212656

SEQ ID NO: 592495 - RNA, 64 nt, Homo Sapiens; identical to SEQ ID NO: 212657

SEQ ID NO: 592496 - RNA, 64 nt, Homo Sapiens; identical to SEQ ID NO: 212658

SEQ ID NO: 592497 - RNA, 64 nt, Homo Sapiens; identical to SEQ ID NO: 212659

SEQ ID NO: 592498 - RNA, 64 nt, Homo Sapiens; identical to SEQ ID NO: 212660

SEQ ID NO: 592499 - RNA, 64 nt, Homo Sapiens; identical to SEQ ID NO: 212661

SEQ ID NO: 592500 - RNA, 64 nt, Homo Sapiens; identical to SEQ ID NO: 212662

SEQ ID NO: 592501 - RNA, 64 nt, Homo Sapiens; identical to SEQ ID NO: 212663

SEQ ID NO: 592502 - RNA, 64 nt, Homo Sapiens; identical to SEQ ID NO: 212664

SEQ ID NO: 592503 - RNA, 64 nt, Homo Sapiens; identical to SEQ ID NO: 212665

SEQ ID NO: 592504 - RNA, 64 nt, Homo Sapiens; identical to SEQ ID NO: 212666

SEQ ID NO: 592505 - RNA, 62 nt, Homo Sapiens; identical to SEQ ID NO: 212667

SEQ ID NO: 592506 - RNA, 64 nt, Homo Sapiens; identical to SEQ ID NO: 212668

SEQ ID NO: 592507 - RNA, 64 nt, Homo Sapiens; identical to SEQ ID NO: 212669

SEQ ID NO: 592508 - RNA, 64 nt, Homo Sapiens; identical to SEQ ID NO: 212670

SEQ ID NO: 592509 - RNA, 64 nt, Homo Sapiens; identical to SEQ ID NO: 212671

SEQ ID NO: 592510 - RNA, 64 nt, Homo Sapiens; identical to SEQ ID NO: 212672

SEQ ID NO: 592511 - RNA, 64 nt, Homo Sapiens; identical to SEQ ID NO: 212673

SEQ ID NO: 592512 - RNA, 64 nt, Homo Sapiens; identical to SEQ ID NO: 212674

SEQ ID NO: 592513 - RNA, 64 nt, Homo Sapiens; identical to SEQ ID NO: 212675

SEQ ID NO: 592514 - RNA, 64 nt, Homo Sapiens; identical to SEQ ID NO: 212676

SEQ ID NO: 592515 - RNA, 64 nt, Homo Sapiens; identical to SEQ ID NO: 212677

SEQ ID NO: 592516 - RNA, 64 nt, Homo Sapiens; identical to SEQ ID NO: 212678

SEQ ID NO: 592517 - RNA, 64 nt, Homo Sapiens; identical to SEQ ID NO: 212679

SEQ ID NO: 592518 - RNA, 64 nt, Homo Sapiens; identical to SEQ ID NO: 244624

SEQ ID NO: 592519 - RNA, 64 nt, Homo Sapiens; identical to SEQ ID NO: 244625

SEQ ID NO: 592520 - RNA, 64 nt, Homo Sapiens; identical to SEQ ID NO: 244626

SEQ ID NO: 592521 - RNA, 64 nt, Homo Sapiens; identical to SEQ ID NO: 244627

SEQ ID NO: 592522 - RNA, 64 nt, Homo Sapiens; identical to SEQ ID NO: 244628

SEQ ID NO: 592523 - RNA, 64 nt, Homo Sapiens; identical to SEQ ID NO: 244629

SEQ ID NO: 592524 - RNA, 64 nt, Homo Sapiens
uugcucuucaguauguagccuaaaaaaaucuuaauuauuucauggaucaugaagcaaggaugaa

SEQ ID NO: 592525 - RNA, 64 nt, Homo Sapiens
acaugguuuuuagaauuauaauuauggauucuucuuauuucaugguagguugucuuuaaagaua

SEQ ID NO: 592526 - RNA, 64 nt, Homo Sapiens
ggccagacauugugcuaugugcauaucauauguauuauuucauuuaauucucacaacaauucug

SEQ ID NO: 592527 - RNA, 64 nt, Homo Sapiens
auguaaggcauugucccauuuugcauaacuugccuuauuucaucauuaucacuacccauuuagu

SEQ ID NO: 592528 - RNA, 64 nt, Homo Sapiens
guggggcccaaugugaucuauuugagacgagggauuauuucaggugacugacugaugucugaag

SEQ ID NO: 592529 - RNA, 64 nt, Homo Sapiens
uugaguuguuuguuuguccuuaaugccuuuguauuuauuucaggucgacguaccaagaagcaca

SEQ ID NO: 592530 - RNA, 64 nt, Homo Sapiens
auaaaacagucccuucaaacccaggaaauaacaguuauuucauccugucauucaacaauuagcu

SEQ ID NO: 592531 - RNA, 64 nt, Homo Sapiens
cagcucugacacuuguuuagcaacaaugcuugguuuauuucaauggucucuccauaauucagcc

SEQ ID NO: 592532 - RNA, 64 nt, Homo Sapiens
aaagaccucuugacauuuaaguguaacugugcuauuauuucaauaaguggaaaggguauuagaa

SEQ ID NO: 592533 - RNA, 64 nt, Homo Sapiens
ugcaguuguauuaguucucaauaggcuauuuuauuuauuucaaauuuuacuuuaaauuauuuaa

SEQ ID NO: 592534 - RNA, 64 nt, Homo Sapiens
uuguauucuuuguaaaauuccaaccagcccaaaauuauuucauccacggaagucuauuccaggc

SEQ ID NO: 592535 - RNA, 64 nt, Homo Sapiens
cugcugcgaucuguucuucucugccaccuccccuuuauuucacaaagaaaacacacgcccugcc

SEQ ID NO: 592536 - RNA, 64 nt, Homo Sapiens
gggacaggaacuaggauagagagccucuuuucaauuauuucaaucaaggccuuuuucauaaacu

SEQ ID NO: 592537 - RNA, 64 nt, Homo Sapiens
gauuauuuaugagagcuaaugccagaaguaaaguuuauuucaugacaugauacuauucagagga

SEQ ID NO: 592538 - RNA, 64 nt, Homo Sapiens
gaagaacucuaagauguugcaaguuuacuuguauuuauuucagacuguccccugcuacaugucu

SEQ ID NO: 592539 - RNA, 64 nt, Homo Sapiens
uauuuuauaguuuugaaacuuugaaccaauguuuuuauuucauauucacuaggaacaccucuac

SEQ ID NO: 592540 - RNA, 64 nt, Homo Sapiens
gauggggggguguguuggggauucuuuguauuguuuauuucauuuugguuuauuuuaaaagaug

SEQ ID NO: 592541 - RNA, 64 nt, Homo Sapiens
ggauguaauuuuaaucucuugccauucauuaguguuauuucauuguaaacguuauugugccaaa

SEQ ID NO: 592542 - RNA, 64 nt, Homo Sapiens
gcagcaucugaagccacaaucuauuauaaauacuuuauuucaacuagaagguacaaucucucag

SEQ ID NO: 592543 - RNA, 64 nt, Homo Sapiens
auauuacaucaggcuagaaguaauuaauguugauuuauuucaucuacaagcaguuggucccuaa

SEQ ID NO: 592544 - RNA, 64 nt, Homo Sapiens
augcaaauaauucugcuuuuagagccuuguuauuuuauuucacaaaacaggcauaugucuagga

SEQ ID NO: 592545 - RNA, 64 nt, Homo Sapiens
acuucacacagucgucuauguuauccagagauuuuuauuucauuuuacauuuuagggcacaguu

SEQ ID NO: 592546 - RNA, 64 nt, Homo Sapiens
gguuuaagaaauagaauuauaacuguaaagauguuuauuucaggcauuggauauuuuuuacuuu

SEQ ID NO: 592547 - RNA, 64 nt, Homo Sapiens
uugauacauuuuuguacuaacuagcauuguaaaauuauuucaugauuagaaauuaccuguggau

SEQ ID NO: 592548 - RNA, 64 nt, Homo Sapiens
acgaaauacuuaacuacuguuuaagugaauugacuuauuucacuuuaguuuuugaacugugauu

SEQ ID NO: 592549 - RNA, 64 nt, Homo Sapiens
uguacauaaacauuaggcagguugcuuaaccuuuuuauuucaaacucucucaacucuaaagugc

SEQ ID NO: 592550 - RNA, 64 nt, Homo Sapiens
aacuaauaaauugaauguuuccauguaccucacuuuauuucaguuaacaagauacuuugacuug

SEQ ID NO: 592551 - RNA, 64 nt, Homo Sapiens
uuuuugguacaucuaaguuuucacuuauaaacuguuauuucaaagcaaacauacuagugauaua

SEQ ID NO: 592552 - RNA, 64 nt, Homo Sapiens
aaaaguuauggaguuaugggaaacugaauuuguguuauuucaguaggauuuagagaaggagccu

SEQ ID NO: 592553 - RNA, 64 nt, Homo Sapiens
agauaggcuucuguuuaucaugaaauuaaauuuuuuauuucaaacugcgcaauccuugauuuaa

SEQ ID NO: 592554 - RNA, 64 nt, Homo Sapiens
cuauguuuuacuuguauauggcagaaaugacuguuuauuucaaacuuauaucuucagaucccua

SEQ ID NO: 592555 - RNA, 64 nt, Homo Sapiens
uaaaaucaugugacgcagaaguucauuuuuguauuuauuucauuaguuauguguugauugugug

SEQ ID NO: 592556 - RNA, 64 nt, Homo Sapiens
uaauucuacauguugucuuaagauggaaauacaguuauuucaucuuuuauucaaggaaguuuua

SEQ ID NO: 592557 - RNA, 64 nt, Homo Sapiens
cuauugacuuuucaauaaaucagcugcaauccauuuauuucauuuacaaaagauuuauuguaag

SEQ ID NO: 592558 - RNA, 64 nt, Homo Sapiens
ugcacacaaugauaauaaugauuauuaaaauaaauuauuucauuaaccagaaagcuuaaacauu

SEQ ID NO: 592559 - RNA, 64 nt, Homo Sapiens
aaugugaauagauuucuggcaagcuuaucauaaauuauuucauguaaagaguacuuguacaaaa

SEQ ID NO: 592560 - RNA, 64 nt, Homo Sapiens
gugcacgguggacccagacacaucgcacuguggauuauuucauuuuguaacaaaugaacgauau

SEQ ID NO: 592561 - RNA, 64 nt, Homo Sapiens
cagcgcuaugcaauucuuaauuuucauuaaguuguuauuucaguuuuaaauguaccuucagaau

SEQ ID NO: 592562 - RNA, 64 nt, Homo Sapiens
uuuaagacucuuaaaauacgguaccuggcaauguuuauuucauaaagaauugugaacuucuuga

SEQ ID NO: 592563 - RNA, 64 nt, Homo Sapiens
uucuccauauuuuugggggaugacauucagugaauuauuucaguggugacccacugaaaauuaa

SEQ ID NO: 592564 - RNA, 64 nt, Homo Sapiens
auuuaucauuuuguaauauuaaauuauggcaauuuuauuucaaacuaaaguuugaacaccggaa

SEQ ID NO: 592565 - RNA, 64 nt, Homo Sapiens
uauucaccacuugagauucauaacauaucaauaguuauuucauaaauauagaaaugaaauaauu

SEQ ID NO: 592566 - RNA, 64 nt, Homo Sapiens
uuaucccugccagguaucgaguuggaauauccaguuauuucaugucacacaucggcacguauga

SEQ ID NO: 592567 - RNA, 64 nt, Homo Sapiens
gaaaaaauacugagauagacauguuuaguugaaguuauuucauuucagguuauauuaucuuggg

SEQ ID NO: 592568 - RNA, 64 nt, Homo Sapiens
aacauauuuggagaaguuuguuugucuuugguguuuauuucaugaauagauugugugcccauuu

SEQ ID NO: 592569 - RNA, 64 nt, Homo Sapiens
cuuaagaaaaacucauguuuguuaaauagaauuuuuauuucauuugaauaaauauaugauagaa

SEQ ID NO: 592570 - RNA, 64 nt, Homo Sapiens
caaagcuaaaauuuucagaaaggaauggggaagcuuauuucaauugcuagauauauuaacauga

SEQ ID NO: 592571 - RNA, 64 nt, Homo Sapiens
acauucuaagaagccuugacucuuggcuuugaccuuauuucaacauuuauuaugcucaaauaua

SEQ ID NO: 592572 - RNA, 64 nt, Homo Sapiens
uugugaugagugauguaucuuuaaaacauuggcuuuauuucauuggcagauuuacauauuuaau

SEQ ID NO: 592573 - RNA, 64 nt, Homo Sapiens
uggaaaaucagugacaucugauuggcagaugagcuuauuucaaaaggaaggguggcuuugcauu

SEQ ID NO: 592574 - RNA, 64 nt, Homo Sapiens
cuacggaacugcacacucagugggcuguuucugcuuauuucaucuguucuaugcuuccucgugc

SEQ ID NO: 592575 - RNA, 64 nt, Homo Sapiens
uacacacaacuaaguuaaaauguugaugugaguuuuauuucacauggauggaauaaacuugugg

SEQ ID NO: 592576 - RNA, 64 nt, Homo Sapiens
aaguuggucaagggcuuaauuuauggaauuucuauuauuucauugguugggaugcuuugccagg

SEQ ID NO: 592577 - RNA, 64 nt, Homo Sapiens
gaggauagcaagcuccagaaucugucucaaauaauuauuucacaccugggugacagagcgagac

SEQ ID NO: 592578 - RNA, 64 nt, Homo Sapiens
ggccggguguggugguucaccugcacauuagaaauuauuucacuauggacaauuauggcuguga

SEQ ID NO: 592579 - RNA, 64 nt, Homo Sapiens
cauaauccaccaugaacaguagauuucucacaaguuauuucauuaccaucuuccaauuucauag

SEQ ID NO: 592580 - RNA, 64 nt, Homo Sapiens
uuucuuuuucguuugguuuguuuuucccaagguuuuauuucagacaaaauucaguguuggaagc

SEQ ID NO: 592581 - RNA, 64 nt, Homo Sapiens
cagaugaaagugauacgauuuuauuguuucuaaauuauuucaauuagugagauuaagaucaucc

SEQ ID NO: 592582 - RNA, 64 nt, Homo Sapiens
aguaauuuaaaaaucacuggucuuauuuuugccuuuauuucauauuuauaaauaguauuuuaca

SEQ ID NO: 592583 - RNA, 64 nt, Homo Sapiens
uaaaguggaugaaaugagcaaguaccuaaaaauuuuauuucagauaaaagucaggaguuacugc

SEQ ID NO: 592584 - RNA, 64 nt, Homo Sapiens
gguguuuagcaaauuguauuacauaaauaaauauuuauuucauggauugaguuauguugcauau

SEQ ID NO: 592585 - RNA, 64 nt, Homo Sapiens
uucuuaauauuacauacaagaaaaugcaguuagguuauuucaauugacaauucugccuccucuu

SEQ ID NO: 592586 - RNA, 64 nt, Homo Sapiens
uguuuuugacaauuuuguuugaaauucauauaucuuauuucaaaggauagcauaauaucugcau

SEQ ID NO: 592587 - RNA, 64 nt, Homo Sapiens
uaguuaagaugucugagagaccaucuccuaucuuuuauuucauucauauccuccgcccuuuuug

SEQ ID NO: 592588 - RNA, 64 nt, Homo Sapiens
caguauuaaacucuccuuugauauuauguggcuuuuauuucagugccauacauguuauuguuuu

SEQ ID NO: 592589 - RNA, 64 nt, Homo Sapiens
ugcccuuaugcuuuauuuuauaauuauccuaauguuauuucacuuguggcauuuggaaaaucuu

SEQ ID NO: 592590 - RNA, 64 nt, Homo Sapiens
uuacaauaauauguguaguaucuuuuuaaauguguuauuucacauacugaaaggggaaccuucg

SEQ ID NO: 592591 - RNA, 64 nt, Homo Sapiens
uaauauaucuaugucuauauauuuugauaguuaauuauuucaacguuuccugcugagcuccagu

SEQ ID NO: 592592 - RNA, 64 nt, Homo Sapiens
cuguuuuggucacaucacuaugugaauagauggguuauuucaacaaccuaugaaacuauugaua

SEQ ID NO: 592593 - RNA, 64 nt, Homo Sapiens
uauuuauugaaugauuacuaaagauucacauaguuuauuucaacagucaaguagaggcaaugca

SEQ ID NO: 592594 - RNA, 62 nt, Homo Sapiens
cagugacaucuuauuccacuagaauaaaggcguuuuauuucaagguauuugguguaugccaa

SEQ ID NO: 592595 - RNA, 64 nt, Homo Sapiens
aaacgagacugucaaucauuguauuugacaaacauuauuucauuugugcccggcagcaaauuaa

SEQ ID NO: 592596 - RNA, 64 nt, Homo Sapiens
uuucaguacacccccuuagagaauagcuuaugaguuauuucacacauuccugagcacauggcug

SEQ ID NO: 592597 - RNA, 64 nt, Homo Sapiens
uaaauuguacagucaaauguucauugauuucauguuauuucaaagcauuuucuuauuaaaaaua

SEQ ID NO: 592598 - RNA, 64 nt, Homo Sapiens
aagauuguauuucucugcuuucauuucaauuucauuauuucaaauugcuugucaaaauggccca

SEQ ID NO: 592599 - RNA, 64 nt, Homo Sapiens
ucaacuagcuguauucguauuaaaaugaagucucuuauuucaauuaccuaguguuguugggaac

SEQ ID NO: 592600 - RNA, 64 nt, Homo Sapiens
auuaugcaaaacgucaaaauuggauacgugcauguuauuucagaccuuauucucaauuuaucaa

SEQ ID NO: 592601 - RNA, 64 nt, Homo Sapiens
acuagcucagcccaucucuauuuugguuuuauuauuauuucagaaggauacucgaaugucaggu

SEQ ID NO: 592602 - RNA, 64 nt, Homo Sapiens
auggauauauuguccugccuguguuccagcaugcuuauuucaaacguccaguguugugugugaa

SEQ ID NO: 592603 - RNA, 64 nt, Homo Sapiens
gagguaaaauagcccuugacaugaugaacaucacuuauuucagcacuuggauugucuggcaaug

SEQ ID NO: 592604 - RNA, 64 nt, Homo Sapiens
uauaagauggcucaauguauaaaauuuuauuuucuuauuucauuaccccauuuguaaacagaug

SEQ ID NO: 592605 - RNA, 64 nt, Homo Sapiens
cauagagcaacaacaaaaauuauagagaggggcuuuauuucaauuuaaauguuaaaacacuaaa

SEQ ID NO: 592606 - RNA, 64 nt, Homo Sapiens
auuuuucagauguuuaaauagccuucaguuuaaauuauuucaggaauauuuugguuuguucugu

SEQ ID NO: 592607 - RNA, 64 nt, Homo Sapiens
uaguuuuauaaugauuuuuauagcaugucacugauuauuucagugcugggguuuauuguaucug

SEQ ID NO: 592608 - RNA, 64 nt, Homo Sapiens
auauaacuuuuuucaauguucuugcaaguaaauuuuauuucauucauuuguuacaugauauucc

SEQ ID NO: 592609 - RNA, 64 nt, Homo Sapiens
auaaacugacucuggggagcugguguaaaaaacuuuauuucaaugcugugaacaaccauuuagu

SEQ ID NO: 592610 - RNA, 64 nt, Homo Sapiens
uugguuuacaauacagcaagccugaugguuugucuuauuucauucauacugaaaauucuuugca

SEQ ID NO: 592611 - RNA, 64 nt, Homo Sapiens
aaguuaucaugaaaagguuuauauucacuauucuuuauuucaguguagcacuuuuagagccaaa

SEQ ID NO: 592612 - RNA, 64 nt, Homo Sapiens
uuaugaaaguauaaccaagcaauguaagaaaccauuauuucaggagccauuuuuuauuucagga

SEQ ID NO: 592613 - RNA, 64 nt, Homo Sapiens
aaauguaagaaaccauuauucaggaagccauuuuuuauuucagguuuaaauaaaauaccaauau

SEQ ID NO: 592614 - RNA, 64 nt, Homo Sapiens
aaaaauguauagaaacuuguuggguguugaauuuuuauuucaaauaguaaauuuuuuucugccu

SEQ ID NO: 592615 - RNA, 64 nt, Homo Sapiens
aaauauuuugcuuuuuagacagcuguaggauauuuuauuucauggguauaccauaacuuuaaga

SEQ ID NO: 592616 - RNA, 64 nt, Homo Sapiens
uggauaaauguccuuauuuucuucuaguauuuucuuauuucacuuuuacaccuaucuuuaaaag

SEQ ID NO: 592617 - RNA, 64 nt, Homo Sapiens
aaaggagccaggaaaugugcuucuacuuugccaguuauuucagacagcacuaccaagaggaggu

SEQ ID NO: 592618 - RNA, 64 nt, Homo Sapiens
uuagaauagugcuauauaucagguaugugaccauuuauuucagaaggcugaacauaagagguuu

SEQ ID NO: 592619 - RNA, 64 nt, Homo Sapiens
augggggaaaacaggcaacguguucuuguaaccuuuauuucaugaaggacuucuuuuuguuucu

SEQ ID NO: 592620 - RNA, 64 nt, Homo Sapiens
cuaacuauaaacuuggaucaccuauguuaaaaccuuauuucacauuccacaucauuuuagaauu

SEQ ID NO: 592621 - RNA, 64 nt, Homo Sapiens
guaaaauaaucuacucuuauucaucuauucagaauuauuucauaguuucucacauuuuaugcuu

SEQ ID NO: 592622 - RNA, 64 nt, Homo Sapiens
uuugauuuguccuuuaagguaaagauuuaaauucuuauuucaaauaagcccuaacagcuugucc

SEQ ID NO: 592623 - RNA, 64 nt, Homo Sapiens
uggguuuccucacauacugaucuaggauuuuaaauuauuucauugcaaaguaauugugucucuc

SEQ ID NO: 592624 - RNA, 64 nt, Homo Sapiens
gcuucccugaauuacucuuuuaauuaaaacuagauuauuucaaucuagaaaagccuuguugagc

SEQ ID NO: 592625 - RNA, 64 nt, Homo Sapiens
uacaguuuuccccugacauauaagugauuucaguuuauuucaaauaaaccauguggugaaggcu

SEQ ID NO: 592626 - RNA, 64 nt, Homo Sapiens
ggauuucaaagacaugaaaggggaaagccuuuguuuauuucauuucacaaaaugcaagauaugu

SEQ ID NO: 592627 - RNA, 64 nt, Homo Sapiens
agcaggggugggaggcagguuuauuuauacuuauuuauuucagggccuggggggcaucugugcc

SEQ ID NO: 592628 - RNA, 64 nt, Homo Sapiens
acugggggcgaaacagccagucuuauuuauuuauuuauuucaguaccguccuuccaaagccaga

SEQ ID NO: 592629 - RNA, 64 nt, Homo Sapiens
uuuauuuuuguuaaugcaaaauuugguuccauuuuuauuucauuauuuuaaacuuuagaugauc

SEQ ID NO: 592630 - RNA, 64 nt, Homo Sapiens
gacuaacccaggacaguuucgugguuagacauuuuuauuucauuaagaucauauccauguguau

SEQ ID NO: 592631 - RNA, 64 nt, Homo Sapiens
aaauuugguuuaauggaaaguaagcaaaaggauguuauuucauuaacagcuuuaaaaauagccu

SEQ ID NO: 592632 - RNA, 64 nt, Homo Sapiens
gaacuuuucagcgaagggagaacacccacguuguuuauuucaaaaggcucugggcucaccauac

SEQ ID NO: 592633 - RNA, 64 nt, Homo Sapiens
auaagacaagaguugcuuucauguccaaguauuguuauuucauauuuuguuuucaugcugcugu

SEQ ID NO: 592634 - RNA, 64 nt, Homo Sapiens
uaaugaaaacaguccucuuuuuaacucaguauuuuuauuucaauuaauucacagauaaguugac

SEQ ID NO: 592635 - RNA, 64 nt, Homo Sapiens
ugugguccucuuauucucuucuuucuaccuaaauuuauuucaucuauguucacaaaauggaagg

SEQ ID NO: 592636 - RNA, 64 nt, Homo Sapiens
cugugcuggcagcuuugcccacacauacccagcagcuccccaggcugaaagcagcccuggccca

SEQ ID NO: 592637 - RNA, 64 nt, Homo Sapiens
uuccuccauccucagaccgugacaucuccccuaggcuccccagcagccaagaggagaggaaugu

SEQ ID NO: 592638 - RNA, 64 nt, Homo Sapiens
ggggaggugacuguguuuccuccugccuggcccugcuccccagugucaugggcccugaggcccc

SEQ ID NO: 592639 - RNA, 64 nt, Homo Sapiens
guccaaauaagcugaaagugugaccuggggcgcugcuccccacacuuccccagcggccaccaac

SEQ ID NO: 592640 - RNA, 64 nt, Homo Sapiens
uguucuuucucucugcccucccuuuccaucuccagcuccccauuuccuuucucaccuccuccuc

SEQ ID NO: 592641 - RNA, 64 nt, Homo Sapiens
ucgcugaaccccguuugccuguccacacccccucgcuccccaccauuuuuccugaccggccugu

SEQ ID NO: 592642 - RNA, 64 nt, Homo Sapiens
uggccugaggcuuaccucucggcacuggcauugggcuccccagccggaacugguuaccaaggac

SEQ ID NO: 592643 - RNA, 64 nt, Homo Sapiens
cacuguuucugccacccuguaacaggccauuaaagcuccccaguguucagccuccuucacuccc

SEQ ID NO: 592644 - RNA, 64 nt, Homo Sapiens
agucgguuuccacaucuguggcugccuuccuugagcuccccaggaccaccuagggaccacguua

SEQ ID NO: 592645 - RNA, 64 nt, Homo Sapiens
ggugaccucuggaggcaguggccagguggccugugcuccccaugucccaaaauaaaauucagaa

SEQ ID NO: 592646 - RNA, 64 nt, Homo Sapiens
ggggagggcgaagggggugcacaaccagggcaaggcuccccacuuccuuagucccccaugcuca

SEQ ID NO: 592647 - RNA, 64 nt, Homo Sapiens
gcugcucccaauccuugccccaaacacuuagcuggcuccccaugacuuaaguguguucucuugu

SEQ ID NO: 592648 - RNA, 64 nt, Homo Sapiens
gcugcccuggcagcugucuucaaggguaggcugagcuccccacccuggagccccugagggcggc

SEQ ID NO: 592649 - RNA, 64 nt, Homo Sapiens
ccuggccucuugauauaccucgagcuuccccugugcuccccagccccaggaccacuggccccuu

SEQ ID NO: 592650 - RNA, 64 nt, Homo Sapiens
gccuuggaggccauaaggccaagaauguacaguggcuccccaauugugaagucauugccugcuc

SEQ ID NO: 592651 - RNA, 64 nt, Homo Sapiens
ugcagcacaaugccuucuccgggcccccagggcugcuccccacucagggcacaggggacuggcu

SEQ ID NO: 592652 - RNA, 64 nt, Homo Sapiens
ggccucggucuccuccccaugaagugggagcgaggcuccccaauggugcuuuuggcuuuagugu

SEQ ID NO: 592653 - RNA, 64 nt, Homo Sapiens
ccaugggccuggggccccaagccggggcgucugagcuccccaggcaugaccaaaccucagugga

SEQ ID NO: 592654 - RNA, 64 nt, Homo Sapiens
agggaggagcccaggggcuuaccucacugagagugcuccccagcaggcauccacuaccccaggg

SEQ ID NO: 592655 - RNA, 64 nt, Homo Sapiens
aaucuacacuggaagccaacuugcuggcacccccgcuccccaacccuucuugccuggguaggag

SEQ ID NO: 592656 - RNA, 64 nt, Homo Sapiens
ucucucuagugcugccucacauugggccucagcagcuccccagcaccaauucacaggucacccc

SEQ ID NO: 592657 - RNA, 64 nt, Homo Sapiens
aacgcggcucugcgcuggaacagcgccaccccaugcuccccaagccccauauuggcaacacccc

SEQ ID NO: 592658 - RNA, 64 nt, Homo Sapiens
cccccauauuggcaacacccagcgccuccccuccgcuccccacgaucagcaucgcagccacucc

SEQ ID NO: 592659 - RNA, 64 nt, Homo Sapiens
cccccaaagagggaaaagcaccuacuccagaaaugcuccccaccgccccaugccccaguccuuu

SEQ ID NO: 592660 - RNA, 64 nt, Homo Sapiens
aaagcaguggcagccucugggguguggccuccaagcuccccagguccugcccugcagucacaug

SEQ ID NO: 592661 - RNA, 64 nt, Homo Sapiens
aggugugggcccagccccccuccuuccagccuuugcuccccaucccacguuccacucgcccugc

SEQ ID NO: 592662 - RNA, 64 nt, Homo Sapiens
agcugcccugcaggucuuggcacaugcacagcaggcuccccauagcuuugucaccacaaagggc

SEQ ID NO: 592663 - RNA, 64 nt, Homo Sapiens
gauuugucaccagugagcccuuggcacggucucugcuccccaccagggcagcacgggacagaaa

SEQ ID NO: 592664 - RNA, 64 nt, Homo Sapiens
ccugcagcuugcauggggccuaugacauccucaggcuccccagauccacucuaccaggaagccc

SEQ ID NO: 592665 - RNA, 64 nt, Homo Sapiens
cagggcuugacacgcccacacgggcaggcagcaggcuccccagcagccacagcugaggaguggc

SEQ ID NO: 592666 - RNA, 64 nt, Homo Sapiens
uuggcucccccauccucagaacucacaagccauugcuccccagcuggggaaccucaaccucccc

SEQ ID NO: 592667 - RNA, 64 nt, Homo Sapiens
agagcugccucccgucagggcccacaucaucuaggcuccccagcccccacugugaaggggcugg

SEQ ID NO: 592668 - RNA, 64 nt, Homo Sapiens
caucucagggaccaugaugucucagucacuccacgcuccccacaggccaacccuggcacagguc

SEQ ID NO: 592669 - RNA, 64 nt, Homo Sapiens
guggaaggguugggggaagagcuccagccugucugcuccccagcucuguaguggcagaccagcg

SEQ ID NO: 592670 - RNA, 64 nt, Homo Sapiens
ugcacauccugaggacagaacagggcccggcugggcuccccaucgcuuuauccgggcuugugug

SEQ ID NO: 592671 - RNA, 64 nt, Homo Sapiens
uugcaggaggaaucggugagccccccgcccacaugcuccccagcacccacccccccaccccccc

SEQ ID NO: 592672 - RNA, 64 nt, Homo Sapiens
gcugggcgauuccgaugcugacccguccuccugggcuccccacccccgcuccccaagugucaca

SEQ ID NO: 592673 - RNA, 64 nt, Homo Sapiens
gaugcugacccguccuccugggcuccccacccccgcuccccaagugucacacaggcacuuugua

SEQ ID NO: 592674 - RNA, 64 nt, Homo Sapiens
ggcccaaagauggacccccccuggccuugugacagcuccccaaguguucuccgguggagaaacu

SEQ ID NO: 592675 - RNA, 64 nt, Homo Sapiens
ccgguggagaaacugcagaggacuggugggcggggcuccccagccaucaccauccuguguacaa

SEQ ID NO: 592676 - RNA, 64 nt, Homo Sapiens
agcugggagcagccagaggcggugcaagcgcccagcuccccagagcuccccaaccucggaccuc

SEQ ID NO: 592677 - RNA, 64 nt, Homo Sapiens
agccagaggcggugcaagcgcccagcuccccagagcuccccaaccucggaccucaccgcagggg

SEQ ID NO: 592678 - RNA, 64 nt, Homo Sapiens
gugucagagaugaaacuccccucccagagguggagcuccccaagcagcccuuccagagguucga

SEQ ID NO: 592679 - RNA, 64 nt, Homo Sapiens
gcuccugaggucaagcuuccggaccugaagugaagcuccccaagccgaggucaaggugcccaag

SEQ ID NO: 592680 - RNA, 64 nt, Homo Sapiens
cucagccucauguguugguccucugcuccuccuagcuccccagggauguuggggacccagcuug

SEQ ID NO: 592681 - RNA, 64 nt, Homo Sapiens
aggacacaucuagcugccauugcaaccucacugggcuccccagacucugugugugagaaauuaa

SEQ ID NO: 592682 - RNA, 64 nt, Homo Sapiens
guaggggagaagguugggguggccaacaggagaagcuccccagagaagcaagagcagacuguug

SEQ ID NO: 592683 - RNA, 64 nt, Homo Sapiens
ugguugcccaguuccuauugaagcuccccuggcggcuccccaccgcuccuacucugcccucucc

SEQ ID NO: 592684 - RNA, 64 nt, Homo Sapiens; identical to SEQ ID NO: 209951

SEQ ID NO: 592685 - RNA, 64 nt, Homo Sapiens; identical to SEQ ID NO: 209952

SEQ ID NO: 592686 - RNA, 64 nt, Homo Sapiens; identical to SEQ ID NO: 209953

SEQ ID NO: 592687 - RNA, 64 nt, Homo Sapiens; identical to SEQ ID NO: 209954

SEQ ID NO: 592688 - RNA, 64 nt, Homo Sapiens; identical to SEQ ID NO: 209955

SEQ ID NO: 592689 - RNA, 64 nt, Homo Sapiens; identical to SEQ ID NO: 209956

SEQ ID NO: 592690 - RNA, 64 nt, Homo Sapiens; identical to SEQ ID NO: 209957

SEQ ID NO: 592691 - RNA, 64 nt, Homo Sapiens; identical to SEQ ID NO: 209958

SEQ ID NO: 592692 - RNA, 64 nt, Homo Sapiens; identical to SEQ ID NO: 209959

SEQ ID NO: 592693 - RNA, 64 nt, Homo Sapiens; identical to SEQ ID NO: 209960

SEQ ID NO: 592694 - RNA, 64 nt, Homo Sapiens; identical to SEQ ID NO: 209961

SEQ ID NO: 592695 - RNA, 64 nt, Homo Sapiens; identical to SEQ ID NO: 209962

SEQ ID NO: 592696 - RNA, 64 nt, Homo Sapiens; identical to SEQ ID NO: 209963

SEQ ID NO: 592697 - RNA, 64 nt, Homo Sapiens; identical to SEQ ID NO: 209964

SEQ ID NO: 592698 - RNA, 64 nt, Homo Sapiens; identical to SEQ ID NO: 209965

SEQ ID NO: 592699 - RNA, 64 nt, Homo Sapiens; identical to SEQ ID NO: 209966

SEQ ID NO: 592700 - RNA, 64 nt, Homo Sapiens; identical to SEQ ID NO: 209967

SEQ ID NO: 592701 - RNA, 64 nt, Homo Sapiens; identical to SEQ ID NO: 209968

SEQ ID NO: 592702 - RNA, 64 nt, Homo Sapiens; identical to SEQ ID NO: 209969

SEQ ID NO: 592703 - RNA, 64 nt, Homo Sapiens; identical to SEQ ID NO: 209970

SEQ ID NO: 592704 - RNA, 64 nt, Homo Sapiens; identical to SEQ ID NO: 209971

SEQ ID NO: 592705 - RNA, 64 nt, Homo Sapiens; identical to SEQ ID NO: 209972

SEQ ID NO: 592706 - RNA, 64 nt, Homo Sapiens; identical to SEQ ID NO: 209973

SEQ ID NO: 592707 - RNA, 64 nt, Homo Sapiens; identical to SEQ ID NO: 209974

SEQ ID NO: 592708 - RNA, 64 nt, Homo Sapiens; identical to SEQ ID NO: 209975

SEQ ID NO: 592709 - RNA, 64 nt, Homo Sapiens; identical to SEQ ID NO: 209976

SEQ ID NO: 592710 - RNA, 64 nt, Homo Sapiens; identical to SEQ ID NO: 209977

SEQ ID NO: 592711 - RNA, 64 nt, Homo Sapiens; identical to SEQ ID NO: 209978

SEQ ID NO: 592712 - RNA, 64 nt, Homo Sapiens; identical to SEQ ID NO: 209979

SEQ ID NO: 592713 - RNA, 64 nt, Homo Sapiens; identical to SEQ ID NO: 209980

SEQ ID NO: 592714 - RNA, 64 nt, Homo Sapiens; identical to SEQ ID NO: 209981

SEQ ID NO: 592715 - RNA, 64 nt, Homo Sapiens; identical to SEQ ID NO: 209982

SEQ ID NO: 592716 - RNA, 64 nt, Homo Sapiens; identical to SEQ ID NO: 209983

SEQ ID NO: 592717 - RNA, 64 nt, Homo Sapiens; identical to SEQ ID NO: 209984

SEQ ID NO: 592718 - RNA, 64 nt, Homo Sapiens; identical to SEQ ID NO: 209985

SEQ ID NO: 592719 - RNA, 64 nt, Homo Sapiens; identical to SEQ ID NO: 209986

SEQ ID NO: 592720 - RNA, 64 nt, Homo Sapiens; identical to SEQ ID NO: 209987

SEQ ID NO: 592721 - RNA, 64 nt, Homo Sapiens; identical to SEQ ID NO: 209988

SEQ ID NO: 592722 - RNA, 64 nt, Homo Sapiens; identical to SEQ ID NO: 209989

SEQ ID NO: 592723 - RNA, 64 nt, Homo Sapiens; identical to SEQ ID NO: 209990

SEQ ID NO: 592724 - RNA, 64 nt, Homo Sapiens; identical to SEQ ID NO: 209991

SEQ ID NO: 592725 - RNA, 64 nt, Homo Sapiens; identical to SEQ ID NO: 209992

SEQ ID NO: 592726 - RNA, 64 nt, Homo Sapiens; identical to SEQ ID NO: 209993

SEQ ID NO: 592727 - RNA, 64 nt, Homo Sapiens; identical to SEQ ID NO: 209994

SEQ ID NO: 592728 - RNA, 64 nt, Homo Sapiens; identical to SEQ ID NO: 209995

SEQ ID NO: 592729 - RNA, 64 nt, Homo Sapiens; identical to SEQ ID NO: 209996

SEQ ID NO: 592730 - RNA, 64 nt, Homo Sapiens; identical to SEQ ID NO: 209997

SEQ ID NO: 592731 - RNA, 64 nt, Homo Sapiens; identical to SEQ ID NO: 209998

SEQ ID NO: 592732 - RNA, 64 nt, Homo Sapiens; identical to SEQ ID NO: 209999

SEQ ID NO: 592733 - RNA, 64 nt, Homo Sapiens; identical to SEQ ID NO: 210000

SEQ ID NO: 592734 - RNA, 64 nt, Homo Sapiens; identical to SEQ ID NO: 210001

SEQ ID NO: 592735 - RNA, 64 nt, Homo Sapiens; identical to SEQ ID NO: 210002

SEQ ID NO: 592736 - RNA, 64 nt, Homo Sapiens; identical to SEQ ID NO: 210003

SEQ ID NO: 592737 - RNA, 64 nt, Homo Sapiens; identical to SEQ ID NO: 210004

SEQ ID NO: 592738 - RNA, 64 nt, Homo Sapiens; identical to SEQ ID NO: 210005

SEQ ID NO: 592739 - RNA, 64 nt, Homo Sapiens; identical to SEQ ID NO: 210006

SEQ ID NO: 592740 - RNA, 64 nt, Homo Sapiens; identical to SEQ ID NO: 210007

SEQ ID NO: 592741 - RNA, 64 nt, Homo Sapiens; identical to SEQ ID NO: 210008

SEQ ID NO: 592742 - RNA, 64 nt, Homo Sapiens; identical to SEQ ID NO: 210009

SEQ ID NO: 592743 - RNA, 64 nt, Homo Sapiens; identical to SEQ ID NO: 210010

SEQ ID NO: 592744 - RNA, 64 nt, Homo Sapiens; identical to SEQ ID NO: 210011

SEQ ID NO: 592745 - RNA, 64 nt, Homo Sapiens; identical to SEQ ID NO: 210012

SEQ ID NO: 592746 - RNA, 64 nt, Homo Sapiens; identical to SEQ ID NO: 210013

SEQ ID NO: 592747 - RNA, 64 nt, Homo Sapiens; identical to SEQ ID NO: 210014

SEQ ID NO: 592748 - RNA, 64 nt, Homo Sapiens; identical to SEQ ID NO: 210015

SEQ ID NO: 592749 - RNA, 64 nt, Homo Sapiens; identical to SEQ ID NO: 210016

SEQ ID NO: 592750 - RNA, 64 nt, Homo Sapiens; identical to SEQ ID NO: 210017

SEQ ID NO: 592751 - RNA, 64 nt, Homo Sapiens; identical to SEQ ID NO: 210018

SEQ ID NO: 592752 - RNA, 64 nt, Homo Sapiens; identical to SEQ ID NO: 210019

SEQ ID NO: 592753 - RNA, 64 nt, Homo Sapiens; identical to SEQ ID NO: 210020

SEQ ID NO: 592754 - RNA, 64 nt, Homo Sapiens; identical to SEQ ID NO: 210021

SEQ ID NO: 592755 - RNA, 64 nt, Homo Sapiens; identical to SEQ ID NO: 210022

SEQ ID NO: 592756 - RNA, 64 nt, Homo Sapiens; identical to SEQ ID NO: 210023

SEQ ID NO: 592757 - RNA, 64 nt, Homo Sapiens; identical to SEQ ID NO: 210024

SEQ ID NO: 592758 - RNA, 64 nt, Homo Sapiens; identical to SEQ ID NO: 210025

SEQ ID NO: 592759 - RNA, 64 nt, Homo Sapiens; identical to SEQ ID NO: 210026

SEQ ID NO: 592760 - RNA, 64 nt, Homo Sapiens; identical to SEQ ID NO: 210027

SEQ ID NO: 592761 - RNA, 64 nt, Homo Sapiens; identical to SEQ ID NO: 210028

SEQ ID NO: 592762 - RNA, 64 nt, Homo Sapiens; identical to SEQ ID NO: 210029

SEQ ID NO: 592763 - RNA, 64 nt, Homo Sapiens; identical to SEQ ID NO: 210030

SEQ ID NO: 592764 - RNA, 64 nt, Homo Sapiens; identical to SEQ ID NO: 210031

SEQ ID NO: 592765 - RNA, 64 nt, Homo Sapiens; identical to SEQ ID NO: 210032

SEQ ID NO: 592766 - RNA, 64 nt, Homo Sapiens; identical to SEQ ID NO: 210033

SEQ ID NO: 592767 - RNA, 64 nt, Homo Sapiens; identical to SEQ ID NO: 210034

SEQ ID NO: 592768 - RNA, 64 nt, Homo Sapiens; identical to SEQ ID NO: 210035

SEQ ID NO: 592769 - RNA, 64 nt, Homo Sapiens; identical to SEQ ID NO: 210036

SEQ ID NO: 592770 - RNA, 64 nt, Homo Sapiens; identical to SEQ ID NO: 210037

SEQ ID NO: 592771 - RNA, 64 nt, Homo Sapiens; identical to SEQ ID NO: 210038

SEQ ID NO: 592772 - RNA, 64 nt, Homo Sapiens; identical to SEQ ID NO: 210039

SEQ ID NO: 592773 - RNA, 64 nt, Homo Sapiens; identical to SEQ ID NO: 210040

SEQ ID NO: 592774 - RNA, 64 nt, Homo Sapiens; identical to SEQ ID NO: 210041

SEQ ID NO: 592775 - RNA, 64 nt, Homo Sapiens; identical to SEQ ID NO: 210042

SEQ ID NO: 592776 - RNA, 64 nt, Homo Sapiens; identical to SEQ ID NO: 210043

SEQ ID NO: 592777 - RNA, 64 nt, Homo Sapiens; identical to SEQ ID NO: 210044

SEQ ID NO: 592778 - RNA, 64 nt, Homo Sapiens; identical to SEQ ID NO: 210045

SEQ ID NO: 592779 - RNA, 64 nt, Homo Sapiens; identical to SEQ ID NO: 210046

SEQ ID NO: 592780 - RNA, 64 nt, Homo Sapiens; identical to SEQ ID NO: 210047

SEQ ID NO: 592781 - RNA, 64 nt, Homo Sapiens; identical to SEQ ID NO: 210048

SEQ ID NO: 592782 - RNA, 64 nt, Homo Sapiens; identical to SEQ ID NO: 210049

SEQ ID NO: 592783 - RNA, 64 nt, Homo Sapiens; identical to SEQ ID NO: 210050

SEQ ID NO: 592784 - RNA, 64 nt, Homo Sapiens; identical to SEQ ID NO: 210051

SEQ ID NO: 592785 - RNA, 64 nt, Homo Sapiens; identical to SEQ ID NO: 210052

SEQ ID NO: 592786 - RNA, 56 nt, Homo Sapiens; identical to SEQ ID NO: 210053

SEQ ID NO: 592787 - RNA, 64 nt, Homo Sapiens; identical to SEQ ID NO: 210054

SEQ ID NO: 592788 - RNA, 64 nt, Homo Sapiens; identical to SEQ ID NO: 210055

SEQ ID NO: 592789 - RNA, 64 nt, Homo Sapiens; identical to SEQ ID NO: 210056

SEQ ID NO: 592790 - RNA, 64 nt, Homo Sapiens; identical to SEQ ID NO: 210057

SEQ ID NO: 592791 - RNA, 64 nt, Homo Sapiens; identical to SEQ ID NO: 210058

SEQ ID NO: 592792 - RNA, 64 nt, Homo Sapiens; identical to SEQ ID NO: 210059

SEQ ID NO: 592793 - RNA, 64 nt, Homo Sapiens; identical to SEQ ID NO: 210060

SEQ ID NO: 592794 - RNA, 64 nt, Homo Sapiens; identical to SEQ ID NO: 210061

SEQ ID NO: 592795 - RNA, 64 nt, Homo Sapiens; identical to SEQ ID NO: 210062

SEQ ID NO: 592796 - RNA, 64 nt, Homo Sapiens; identical to SEQ ID NO: 210063

SEQ ID NO: 592797 - RNA, 64 nt, Homo Sapiens; identical to SEQ ID NO: 210064

SEQ ID NO: 592798 - RNA, 64 nt, Homo Sapiens; identical to SEQ ID NO: 210065

SEQ ID NO: 592799 - RNA, 64 nt, Homo Sapiens; identical to SEQ ID NO: 210066

SEQ ID NO: 592800 - RNA, 64 nt, Homo Sapiens; identical to SEQ ID NO: 210067

SEQ ID NO: 592801 - RNA, 64 nt, Homo Sapiens; identical to SEQ ID NO: 210068

SEQ ID NO: 592802 - RNA, 64 nt, Homo Sapiens; identical to SEQ ID NO: 210069

SEQ ID NO: 592803 - RNA, 64 nt, Homo Sapiens; identical to SEQ ID NO: 210070

SEQ ID NO: 592804 - RNA, 55 nt, Homo Sapiens; identical to SEQ ID NO: 210071

SEQ ID NO: 592805 - RNA, 64 nt, Homo Sapiens; identical to SEQ ID NO: 210072

SEQ ID NO: 592806 - RNA, 64 nt, Homo Sapiens; identical to SEQ ID NO: 210073

SEQ ID NO: 592807 - RNA, 64 nt, Homo Sapiens; identical to SEQ ID NO: 210074

SEQ ID NO: 592808 - RNA, 64 nt, Homo Sapiens; identical to SEQ ID NO: 210075

SEQ ID NO: 592809 - RNA, 64 nt, Homo Sapiens; identical to SEQ ID NO: 210076

SEQ ID NO: 592810 - RNA, 64 nt, Homo Sapiens; identical to SEQ ID NO: 210077

SEQ ID NO: 592811 - RNA, 64 nt, Homo Sapiens; identical to SEQ ID NO: 210078

SEQ ID NO: 592812 - RNA, 64 nt, Homo Sapiens; identical to SEQ ID NO: 210079

SEQ ID NO: 592813 - RNA, 64 nt, Homo Sapiens; identical to SEQ ID NO: 210080

SEQ ID NO: 592814 - RNA, 64 nt, Homo Sapiens; identical to SEQ ID NO: 210081

SEQ ID NO: 592815 - RNA, 64 nt, Homo Sapiens; identical to SEQ ID NO: 210082

SEQ ID NO: 592816 - RNA, 64 nt, Homo Sapiens; identical to SEQ ID NO: 210083

SEQ ID NO: 592817 - RNA, 64 nt, Homo Sapiens; identical to SEQ ID NO: 210084

SEQ ID NO: 592818 - RNA, 64 nt, Homo Sapiens; identical to SEQ ID NO: 210085

SEQ ID NO: 592819 - RNA, 64 nt, Homo Sapiens; identical to SEQ ID NO: 210086

SEQ ID NO: 592820 - RNA, 64 nt, Homo Sapiens; identical to SEQ ID NO: 210087

SEQ ID NO: 592821 - RNA, 64 nt, Homo Sapiens; identical to SEQ ID NO: 210088

SEQ ID NO: 592822 - RNA, 64 nt, Homo Sapiens; identical to SEQ ID NO: 210089

SEQ ID NO: 592823 - RNA, 64 nt, Homo Sapiens; identical to SEQ ID NO: 210090

SEQ ID NO: 592824 - RNA, 64 nt, Homo Sapiens; identical to SEQ ID NO: 210091

SEQ ID NO: 592825 - RNA, 64 nt, Homo Sapiens; identical to SEQ ID NO: 210092

SEQ ID NO: 592826 - RNA, 64 nt, Homo Sapiens; identical to SEQ ID NO: 210093

SEQ ID NO: 592827 - RNA, 64 nt, Homo Sapiens; identical to SEQ ID NO: 210094

SEQ ID NO: 592828 - RNA, 64 nt, Homo Sapiens; identical to SEQ ID NO: 210095

SEQ ID NO: 592829 - RNA, 64 nt, Homo Sapiens; identical to SEQ ID NO: 210096

SEQ ID NO: 592830 - RNA, 64 nt, Homo Sapiens; identical to SEQ ID NO: 210097

SEQ ID NO: 592831 - RNA, 64 nt, Homo Sapiens; identical to SEQ ID NO: 210098

SEQ ID NO: 592832 - RNA, 64 nt, Homo Sapiens; identical to SEQ ID NO: 210099

SEQ ID NO: 592833 - RNA, 64 nt, Homo Sapiens; identical to SEQ ID NO: 210100

SEQ ID NO: 592834 - RNA, 64 nt, Homo Sapiens; identical to SEQ ID NO: 210101

SEQ ID NO: 592835 - RNA, 64 nt, Homo Sapiens; identical to SEQ ID NO: 210102

SEQ ID NO: 592836 - RNA, 64 nt, Homo Sapiens; identical to SEQ ID NO: 210103

SEQ ID NO: 592837 - RNA, 64 nt, Homo Sapiens; identical to SEQ ID NO: 210104

SEQ ID NO: 592838 - RNA, 64 nt, Homo Sapiens; identical to SEQ ID NO: 210105

SEQ ID NO: 592839 - RNA, 64 nt, Homo Sapiens; identical to SEQ ID NO: 210106

SEQ ID NO: 592840 - RNA, 64 nt, Homo Sapiens; identical to SEQ ID NO: 210107

SEQ ID NO: 592841 - RNA, 64 nt, Homo Sapiens; identical to SEQ ID NO: 210108

SEQ ID NO: 592842 - RNA, 64 nt, Homo Sapiens; identical to SEQ ID NO: 210109

SEQ ID NO: 592843 - RNA, 64 nt, Homo Sapiens; identical to SEQ ID NO: 210110

SEQ ID NO: 592844 - RNA, 64 nt, Homo Sapiens; identical to SEQ ID NO: 210111

SEQ ID NO: 592845 - RNA, 64 nt, Homo Sapiens; identical to SEQ ID NO: 210112

SEQ ID NO: 592846 - RNA, 64 nt, Homo Sapiens; identical to SEQ ID NO: 210113

SEQ ID NO: 592847 - RNA, 63 nt, Homo Sapiens; identical to SEQ ID NO: 210114

SEQ ID NO: 592848 - RNA, 60 nt, Homo Sapiens; identical to SEQ ID NO: 210115

SEQ ID NO: 592849 - RNA, 57 nt, Homo Sapiens; identical to SEQ ID NO: 210116

SEQ ID NO: 592850 - RNA, 64 nt, Homo Sapiens; identical to SEQ ID NO: 210117

SEQ ID NO: 592851 - RNA, 64 nt, Homo Sapiens; identical to SEQ ID NO: 210118

SEQ ID NO: 592852 - RNA, 64 nt, Homo Sapiens; identical to SEQ ID NO: 210119

SEQ ID NO: 592853 - RNA, 64 nt, Homo Sapiens; identical to SEQ ID NO: 210120

SEQ ID NO: 592854 - RNA, 64 nt, Homo Sapiens; identical to SEQ ID NO: 210121

SEQ ID NO: 592855 - RNA, 64 nt, Homo Sapiens; identical to SEQ ID NO: 210122

SEQ ID NO: 592856 - RNA, 64 nt, Homo Sapiens; identical to SEQ ID NO: 210123

SEQ ID NO: 592857 - RNA, 64 nt, Homo Sapiens; identical to SEQ ID NO: 210124

SEQ ID NO: 592858 - RNA, 64 nt, Homo Sapiens; identical to SEQ ID NO: 210125

SEQ ID NO: 592859 - RNA, 64 nt, Homo Sapiens; identical to SEQ ID NO: 210126

SEQ ID NO: 592860 - RNA, 64 nt, Homo Sapiens; identical to SEQ ID NO: 210127

SEQ ID NO: 592861 - RNA, 64 nt, Homo Sapiens; identical to SEQ ID NO: 210128

SEQ ID NO: 592862 - RNA, 64 nt, Homo Sapiens; identical to SEQ ID NO: 210129

SEQ ID NO: 592863 - RNA, 64 nt, Homo Sapiens; identical to SEQ ID NO: 210130

SEQ ID NO: 592864 - RNA, 64 nt, Homo Sapiens; identical to SEQ ID NO: 210131

SEQ ID NO: 592865 - RNA, 64 nt, Homo Sapiens; identical to SEQ ID NO: 169280

SEQ ID NO: 592866 - RNA, 64 nt, Homo Sapiens; identical to SEQ ID NO: 169281

SEQ ID NO: 592867 - RNA, 64 nt, Homo Sapiens; identical to SEQ ID NO: 169282

SEQ ID NO: 592868 - RNA, 64 nt, Homo Sapiens; identical to SEQ ID NO: 169283

SEQ ID NO: 592869 - RNA, 64 nt, Homo Sapiens; identical to SEQ ID NO: 169284

SEQ ID NO: 592870 - RNA, 64 nt, Homo Sapiens; identical to SEQ ID NO: 169285

SEQ ID NO: 592871 - RNA, 64 nt, Homo Sapiens; identical to SEQ ID NO: 169286

SEQ ID NO: 592872 - RNA, 64 nt, Homo Sapiens; identical to SEQ ID NO: 169287

SEQ ID NO: 592873 - RNA, 64 nt, Homo Sapiens; identical to SEQ ID NO: 169288

SEQ ID NO: 592874 - RNA, 64 nt, Homo Sapiens; identical to SEQ ID NO: 169289

SEQ ID NO: 592875 - RNA, 64 nt, Homo Sapiens; identical to SEQ ID NO: 169290

SEQ ID NO: 592876 - RNA, 64 nt, Homo Sapiens; identical to SEQ ID NO: 169291

SEQ ID NO: 592877 - RNA, 64 nt, Homo Sapiens; identical to SEQ ID NO: 169292

SEQ ID NO: 592878 - RNA, 64 nt, Homo Sapiens; identical to SEQ ID NO: 169293

SEQ ID NO: 592879 - RNA, 64 nt, Homo Sapiens; identical to SEQ ID NO: 169294

SEQ ID NO: 592880 - RNA, 64 nt, Homo Sapiens; identical to SEQ ID NO: 169295

SEQ ID NO: 592881 - RNA, 64 nt, Homo Sapiens; identical to SEQ ID NO: 169296

SEQ ID NO: 592882 - RNA, 64 nt, Homo Sapiens; identical to SEQ ID NO: 169297

SEQ ID NO: 592883 - RNA, 64 nt, Homo Sapiens; identical to SEQ ID NO: 169298

SEQ ID NO: 592884 - RNA, 64 nt, Homo Sapiens; identical to SEQ ID NO: 169299

SEQ ID NO: 592885 - RNA, 64 nt, Homo Sapiens; identical to SEQ ID NO: 169300

SEQ ID NO: 592886 - RNA, 64 nt, Homo Sapiens; identical to SEQ ID NO: 169301

SEQ ID NO: 592887 - RNA, 64 nt, Homo Sapiens; identical to SEQ ID NO: 169302

SEQ ID NO: 592888 - RNA, 64 nt, Homo Sapiens; identical to SEQ ID NO: 169303

SEQ ID NO: 592889 - RNA, 64 nt, Homo Sapiens; identical to SEQ ID NO: 169304

SEQ ID NO: 592890 - RNA, 64 nt, Homo Sapiens; identical to SEQ ID NO: 169305

SEQ ID NO: 592891 - RNA, 64 nt, Homo Sapiens; identical to SEQ ID NO: 169306

SEQ ID NO: 592892 - RNA, 64 nt, Homo Sapiens; identical to SEQ ID NO: 169307

SEQ ID NO: 592893 - RNA, 64 nt, Homo Sapiens; identical to SEQ ID NO: 143712

SEQ ID NO: 592894 - RNA, 64 nt, Homo Sapiens; identical to SEQ ID NO: 143713

SEQ ID NO: 592895 - RNA, 64 nt, Homo Sapiens; identical to SEQ ID NO: 143714

SEQ ID NO: 592896 - RNA, 64 nt, Homo Sapiens; identical to SEQ ID NO: 143715

SEQ ID NO: 592897 - RNA, 64 nt, Homo Sapiens; identical to SEQ ID NO: 143716

SEQ ID NO: 592898 - RNA, 64 nt, Homo Sapiens; identical to SEQ ID NO: 143717

SEQ ID NO: 592899 - RNA, 64 nt, Homo Sapiens; identical to SEQ ID NO: 143718

SEQ ID NO: 592900 - RNA, 64 nt, Homo Sapiens; identical to SEQ ID NO: 143719

SEQ ID NO: 592901 - RNA, 64 nt, Homo Sapiens; identical to SEQ ID NO: 143720

SEQ ID NO: 592902 - RNA, 64 nt, Homo Sapiens; identical to SEQ ID NO: 143721

SEQ ID NO: 592903 - RNA, 64 nt, Homo Sapiens; identical to SEQ ID NO: 143722

SEQ ID NO: 592904 - RNA, 64 nt, Homo Sapiens; identical to SEQ ID NO: 143723

SEQ ID NO: 592905 - RNA, 64 nt, Homo Sapiens; identical to SEQ ID NO: 143724

SEQ ID NO: 592906 - RNA, 64 nt, Homo Sapiens; identical to SEQ ID NO: 143725

SEQ ID NO: 592907 - RNA, 64 nt, Homo Sapiens; identical to SEQ ID NO: 143726

SEQ ID NO: 592908 - RNA, 64 nt, Homo Sapiens; identical to SEQ ID NO: 143727

SEQ ID NO: 592909 - RNA, 64 nt, Homo Sapiens; identical to SEQ ID NO: 143728

SEQ ID NO: 592910 - RNA, 64 nt, Homo Sapiens; identical to SEQ ID NO: 143729

SEQ ID NO: 592911 - RNA, 64 nt, Homo Sapiens; identical to SEQ ID NO: 143730

SEQ ID NO: 592912 - RNA, 64 nt, Homo Sapiens; identical to SEQ ID NO: 143731

SEQ ID NO: 592913 - RNA, 64 nt, Homo Sapiens; identical to SEQ ID NO: 143732

SEQ ID NO: 592914 - RNA, 64 nt, Homo Sapiens; identical to SEQ ID NO: 143733

SEQ ID NO: 592915 - RNA, 64 nt, Homo Sapiens; identical to SEQ ID NO: 143734

SEQ ID NO: 592916 - RNA, 64 nt, Homo Sapiens; identical to SEQ ID NO: 143735

SEQ ID NO: 592917 - RNA, 64 nt, Homo Sapiens; identical to SEQ ID NO: 143736

SEQ ID NO: 592918 - RNA, 64 nt, Homo Sapiens; identical to SEQ ID NO: 143737

SEQ ID NO: 592919 - RNA, 64 nt, Homo Sapiens; identical to SEQ ID NO: 143738

SEQ ID NO: 592920 - RNA, 64 nt, Homo Sapiens; identical to SEQ ID NO: 143739

SEQ ID NO: 592921 - RNA, 64 nt, Homo Sapiens; identical to SEQ ID NO: 143740

SEQ ID NO: 592922 - RNA, 64 nt, Homo Sapiens; identical to SEQ ID NO: 143741

SEQ ID NO: 592923 - RNA, 64 nt, Homo Sapiens; identical to SEQ ID NO: 143742

SEQ ID NO: 592924 - RNA, 64 nt, Homo Sapiens; identical to SEQ ID NO: 143743

SEQ ID NO: 592925 - RNA, 64 nt, Homo Sapiens; identical to SEQ ID NO: 143744

SEQ ID NO: 592926 - RNA, 64 nt, Homo Sapiens; identical to SEQ ID NO: 143745

SEQ ID NO: 592927 - RNA, 64 nt, Homo Sapiens; identical to SEQ ID NO: 143746

SEQ ID NO: 592928 - RNA, 64 nt, Homo Sapiens; identical to SEQ ID NO: 143747

SEQ ID NO: 592929 - RNA, 64 nt, Homo Sapiens; identical to SEQ ID NO: 143748

SEQ ID NO: 592930 - RNA, 64 nt, Homo Sapiens; identical to SEQ ID NO: 143749

SEQ ID NO: 592931 - RNA, 64 nt, Homo Sapiens; identical to SEQ ID NO: 143750

SEQ ID NO: 592932 - RNA, 64 nt, Homo Sapiens; identical to SEQ ID NO: 143751

SEQ ID NO: 592933 - RNA, 64 nt, Homo Sapiens; identical to SEQ ID NO: 143752

SEQ ID NO: 592934 - RNA, 64 nt, Homo Sapiens; identical to SEQ ID NO: 143753

SEQ ID NO: 592935 - RNA, 64 nt, Homo Sapiens; identical to SEQ ID NO: 143754

SEQ ID NO: 592936 - RNA, 64 nt, Homo Sapiens; identical to SEQ ID NO: 143755

SEQ ID NO: 592937 - RNA, 64 nt, Homo Sapiens; identical to SEQ ID NO: 143756

SEQ ID NO: 592938 - RNA, 64 nt, Homo Sapiens; identical to SEQ ID NO: 143757

SEQ ID NO: 592939 - RNA, 64 nt, Homo Sapiens; identical to SEQ ID NO: 143758

SEQ ID NO: 592940 - RNA, 64 nt, Homo Sapiens; identical to SEQ ID NO: 143759

SEQ ID NO: 592941 - RNA, 64 nt, Homo Sapiens; identical to SEQ ID NO: 143760

SEQ ID NO: 592942 - RNA, 64 nt, Homo Sapiens; identical to SEQ ID NO: 143761

SEQ ID NO: 592943 - RNA, 64 nt, Homo Sapiens; identical to SEQ ID NO: 143762

SEQ ID NO: 592944 - RNA, 64 nt, Homo Sapiens; identical to SEQ ID NO: 143763

SEQ ID NO: 592945 - RNA, 64 nt, Homo Sapiens; identical to SEQ ID NO: 143764

SEQ ID NO: 592946 - RNA, 64 nt, Homo Sapiens; identical to SEQ ID NO: 143765

SEQ ID NO: 592947 - RNA, 64 nt, Homo Sapiens; identical to SEQ ID NO: 143766

SEQ ID NO: 592948 - RNA, 64 nt, Homo Sapiens; identical to SEQ ID NO: 143767

SEQ ID NO: 592949 - RNA, 64 nt, Homo Sapiens; identical to SEQ ID NO: 143768

SEQ ID NO: 592950 - RNA, 64 nt, Homo Sapiens; identical to SEQ ID NO: 143769

SEQ ID NO: 592951 - RNA, 64 nt, Homo Sapiens; identical to SEQ ID NO: 143770

SEQ ID NO: 592952 - RNA, 64 nt, Homo Sapiens; identical to SEQ ID NO: 143771

SEQ ID NO: 592953 - RNA, 64 nt, Homo Sapiens; identical to SEQ ID NO: 143772

SEQ ID NO: 592954 - RNA, 64 nt, Homo Sapiens; identical to SEQ ID NO: 143773

SEQ ID NO: 592955 - RNA, 64 nt, Homo Sapiens; identical to SEQ ID NO: 143774

SEQ ID NO: 592956 - RNA, 64 nt, Homo Sapiens; identical to SEQ ID NO: 143775

SEQ ID NO: 592957 - RNA, 64 nt, Homo Sapiens; identical to SEQ ID NO: 143776

SEQ ID NO: 592958 - RNA, 64 nt, Homo Sapiens; identical to SEQ ID NO: 143777

SEQ ID NO: 592959 - RNA, 64 nt, Homo Sapiens; identical to SEQ ID NO: 143778

SEQ ID NO: 592960 - RNA, 64 nt, Homo Sapiens; identical to SEQ ID NO: 143779

SEQ ID NO: 592961 - RNA, 64 nt, Homo Sapiens; identical to SEQ ID NO: 143780

SEQ ID NO: 592962 - RNA, 64 nt, Homo Sapiens; identical to SEQ ID NO: 143781

SEQ ID NO: 592963 - RNA, 64 nt, Homo Sapiens; identical to SEQ ID NO: 143782

SEQ ID NO: 592964 - RNA, 64 nt, Homo Sapiens; identical to SEQ ID NO: 143783

SEQ ID NO: 592965 - RNA, 64 nt, Homo Sapiens; identical to SEQ ID NO: 143784

SEQ ID NO: 592966 - RNA, 64 nt, Homo Sapiens; identical to SEQ ID NO: 143785

SEQ ID NO: 592967 - RNA, 64 nt, Homo Sapiens; identical to SEQ ID NO: 143786

SEQ ID NO: 592968 - RNA, 64 nt, Homo Sapiens; identical to SEQ ID NO: 143787

SEQ ID NO: 592969 - RNA, 64 nt, Homo Sapiens; identical to SEQ ID NO: 143788

SEQ ID NO: 592970 - RNA, 64 nt, Homo Sapiens; identical to SEQ ID NO: 143789

SEQ ID NO: 592971 - RNA, 57 nt, Homo Sapiens; identical to SEQ ID NO: 143790

SEQ ID NO: 592972 - RNA, 64 nt, Homo Sapiens; identical to SEQ ID NO: 143791

SEQ ID NO: 592973 - RNA, 64 nt, Homo Sapiens; identical to SEQ ID NO: 143792

SEQ ID NO: 592974 - RNA, 64 nt, Homo Sapiens; identical to SEQ ID NO: 143793

SEQ ID NO: 592975 - RNA, 64 nt, Homo Sapiens; identical to SEQ ID NO: 143794

SEQ ID NO: 592976 - RNA, 64 nt, Homo Sapiens; identical to SEQ ID NO: 143795

SEQ ID NO: 592977 - RNA, 64 nt, Homo Sapiens; identical to SEQ ID NO: 143796

SEQ ID NO: 592978 - RNA, 64 nt, Homo Sapiens; identical to SEQ ID NO: 143797

SEQ ID NO: 592979 - RNA, 64 nt, Homo Sapiens; identical to SEQ ID NO: 143798

SEQ ID NO: 592980 - RNA, 64 nt, Homo Sapiens; identical to SEQ ID NO: 143799

SEQ ID NO: 592981 - RNA, 64 nt, Homo Sapiens; identical to SEQ ID NO: 143800

SEQ ID NO: 592982 - RNA, 64 nt, Homo Sapiens; identical to SEQ ID NO: 143801

SEQ ID NO: 592983 - RNA, 64 nt, Homo Sapiens; identical to SEQ ID NO: 143802

SEQ ID NO: 592984 - RNA, 64 nt, Homo Sapiens; identical to SEQ ID NO: 143803

SEQ ID NO: 592985 - RNA, 64 nt, Homo Sapiens; identical to SEQ ID NO: 143804

SEQ ID NO: 592986 - RNA, 64 nt, Homo Sapiens; identical to SEQ ID NO: 143805

SEQ ID NO: 592987 - RNA, 64 nt, Homo Sapiens; identical to SEQ ID NO: 143806

SEQ ID NO: 592988 - RNA, 64 nt, Homo Sapiens; identical to SEQ ID NO: 143807

SEQ ID NO: 592989 - RNA, 64 nt, Homo Sapiens; identical to SEQ ID NO: 143808

SEQ ID NO: 592990 - RNA, 64 nt, Homo Sapiens; identical to SEQ ID NO: 143809

SEQ ID NO: 592991 - RNA, 64 nt, Homo Sapiens; identical to SEQ ID NO: 143810

SEQ ID NO: 592992 - RNA, 64 nt, Homo Sapiens; identical to SEQ ID NO: 143811

SEQ ID NO: 592993 - RNA, 64 nt, Homo Sapiens; identical to SEQ ID NO: 143812

SEQ ID NO: 592994 - RNA, 64 nt, Homo Sapiens
gaaauucauuuaaacaguugggcuguauaauuguuaauucaaaucgaauguaggaccucugagu

SEQ ID NO: 592995 - RNA, 64 nt, Homo Sapiens
gaacccaucaacuggaugccgccuccaaaccauuuaauucaaaucaauuuaaaaaaucacguua

SEQ ID NO: 592996 - RNA, 64 nt, Homo Sapiens
uaaauguguucauguacagucuaaaauguuguuguaauucaauuuaagauucuauauuuccuau

SEQ ID NO: 592997 - RNA, 64 nt, Homo Sapiens
acuuaaguagcuuuauuguuuuacuguuuauuucuaauucaaacuuauaauuaauacagauguu

SEQ ID NO: 592998 - RNA, 64 nt, Homo Sapiens
uuaauuuuuuuuccuuaaagauuggaguauuuuauaauucaaggagcauacaaaacaaugguug

SEQ ID NO: 592999 - RNA, 64 nt, Homo Sapiens
aacuuuguuguguguaggaaacaugaaggcauguuaauucaauauaaaugaccuuugauuucau

SEQ ID NO: 593000 - RNA, 64 nt, Homo Sapiens
agccucagaguauuucauauaaauuuucucuaucuaauucaaacauaucuccccaugauacacc

SEQ ID NO: 593001 - RNA, 64 nt, Homo Sapiens
aaggcaaagcagggaauagaggcaauuagcuagauaauucaagcagaaauccauuuucaucgaa

SEQ ID NO: 593002 - RNA, 64 nt, Homo Sapiens
aauguugcauuaauuguauaaaccugugugcuaauaauucaaacuggauucuguggauucuuua

SEQ ID NO: 593003 - RNA, 64 nt, Homo Sapiens
agaggcgcuagaucaaggucacagaggacaaaguuaauucaaaagaccuuaauuccaggaaagc

SEQ ID NO: 593004 - RNA, 64 nt, Homo Sapiens
gaaugcauguuucacauugucuuagauauuuauauaauucaaaauuggaauguuauuauaaacu

SEQ ID NO: 593005 - RNA, 64 nt, Homo Sapiens
uuaaagacucaagguggucaguaaacgacaagaauaauucaauucuuuuaaaguguuacuuuuu

SEQ ID NO: 593006 - RNA, 64 nt, Homo Sapiens
agagugucccagaaaaaaacgacuaauuaaacaauaauucaaguucuuuugaagaucuaugguu

SEQ ID NO: 593007 - RNA, 64 nt, Homo Sapiens
uugcagguugcaaacaaauauuauaucagcaaaauaauucaauuucaagugaguucuuaguauu

SEQ ID NO: 593008 - RNA, 64 nt, Homo Sapiens
uuaaauaaucuuuucuagcuuaauauuuuaauucuaauucaaacaacucugagguuuugguuuc

SEQ ID NO: 593009 - RNA, 64 nt, Homo Sapiens
uaacuauucuugaaaugguauugaaaaauaccguuaauucaaauugacagagauugauaaaaag

SEQ ID NO: 593010 - RNA, 64 nt, Homo Sapiens
gacaguccuuaaugcugaaaacacagagaauggguaauucaagaggccuuucuuuuaaaauaga

SEQ ID NO: 593011 - RNA, 64 nt, Homo Sapiens
gcaaucuguguacugaacauaguagauugacaucuaauucaagauuacaacaucuguuacauuc

SEQ ID NO: 593012 - RNA, 64 nt, Homo Sapiens; identical to SEQ ID NO: 48734

SEQ ID NO: 593013 - RNA, 64 nt, Homo Sapiens; identical to SEQ ID NO: 48735

SEQ ID NO: 593014 - RNA, 64 nt, Homo Sapiens; identical to SEQ ID NO: 48736

SEQ ID NO: 593015 - RNA, 64 nt, Homo Sapiens; identical to SEQ ID NO: 48737

SEQ ID NO: 593016 - RNA, 64 nt, Homo Sapiens; identical to SEQ ID NO: 48738

SEQ ID NO: 593017 - RNA, 64 nt, Homo Sapiens; identical to SEQ ID NO: 48739

SEQ ID NO: 593018 - RNA, 64 nt, Homo Sapiens; identical to SEQ ID NO: 48740

SEQ ID NO: 593019 - RNA, 64 nt, Homo Sapiens; identical to SEQ ID NO: 48741

SEQ ID NO: 593020 - RNA, 64 nt, Homo Sapiens; identical to SEQ ID NO: 48742

SEQ ID NO: 593021 - RNA, 64 nt, Homo Sapiens; identical to SEQ ID NO: 48743

SEQ ID NO: 593022 - RNA, 64 nt, Homo Sapiens; identical to SEQ ID NO: 48744

SEQ ID NO: 593023 - RNA, 64 nt, Homo Sapiens; identical to SEQ ID NO: 48745

SEQ ID NO: 593024 - RNA, 64 nt, Homo Sapiens; identical to SEQ ID NO: 48746

SEQ ID NO: 593025 - RNA, 64 nt, Homo Sapiens; identical to SEQ ID NO: 48747

SEQ ID NO: 593026 - RNA, 64 nt, Homo Sapiens; identical to SEQ ID NO: 48748

SEQ ID NO: 593027 - RNA, 64 nt, Homo Sapiens
uucacagcaacagggagcuacuagagcccaggugcacgguuagcaugagcccaggcauagagga

SEQ ID NO: 593028 - RNA, 64 nt, Homo Sapiens
gacuuagaugauguauuaaauuaauuuuguuuaacacgguuacuguaagcuguaacuugucauu

SEQ ID NO: 593029 - RNA, 64 nt, Homo Sapiens
caggugcacacaccuccacagugaccucugugcacacgguuaccaccaacuggcuggcccuccu

SEQ ID NO: 593030 - RNA, 64 nt, Homo Sapiens
ugucucgagcccauugguagggucauacaaagcccacgguuacaagcagugguaggauugcagc

SEQ ID NO: 593031 - RNA, 64 nt, Homo Sapiens
gugguuggauaaaaucaagaaaaggcugaaugagcacgguuacccccaaguggagggguuugua

SEQ ID NO: 593032 - RNA, 64 nt, Homo Sapiens
uggaaaagcacuuucagucuuccagguaauccaccacgguuaacgaugauguacaaauugcucu

SEQ ID NO: 593033 - RNA, 64 nt, Homo Sapiens
cuccaaacuucucaacuuuguguuuaaauuuugucacgguuaguccuugccuucacauaccuga

SEQ ID NO: 593034 - RNA, 64 nt, Homo Sapiens
agaagcuaauauuugaaacauuucauuaaacagucacgguuagagaguugauagugaauugaau

SEQ ID NO: 593035 - RNA, 64 nt, Homo Sapiens
gauucaagcagucggagcagccagaacuuucuuucacgguuacuguuccugaaaagaaaaagcc

SEQ ID NO: 593036 - RNA, 64 nt, Homo Sapiens
ggcaaugagaaacaagcagagacuggguuuguaacacgguuaaauuuuggaauguuuacuuuug

SEQ ID NO: 593037 - RNA, 64 nt, Homo Sapiens
uaaaaagaugauggaagguguggugacuaagggccacgguuauugggugaaauuugagauugua

SEQ ID NO: 593038 - RNA, 64 nt, Homo Sapiens
aacauauaaauauguaugcaaaaaagaaaagaaacacgguuaauccuggacacucugucucgaa

SEQ ID NO: 593039 - RNA, 64 nt, Homo Sapiens
ggagcccugccucccacugccugacuuccugccacacgguuaaugcugcagcaacaccgacugc

SEQ ID NO: 593040 - RNA, 64 nt, Homo Sapiens
ccauaaucuagagccauuguuuucauuguuggcccacgguuaguaagugcagccagcaauuuau

SEQ ID NO: 593041 - RNA, 64 nt, Homo Sapiens
aaaaccaugggaaggggaauuacaggcugagguacacgguuagcaagcucaugcuccccuacgg

SEQ ID NO: 593042 - RNA, 64 nt, Homo Sapiens
gggaagcacgggcgacuggacagcagccgccgggcacgguuaugggggcggggugggcggggag

SEQ ID NO: 593043 - RNA, 64 nt, Homo Sapiens
ggaggucgucacugggguggagaucaacaagaaacacgguuaagucucagugucccuaucugua

SEQ ID NO: 593044 - RNA, 64 nt, Homo Sapiens
gacuucagcauagaucacaggaaaucacauggcacacgguuaaacacguauggcuucaaaucca

SEQ ID NO: 593045 - RNA, 64 nt, Homo Sapiens
ggacuuguuaccaaaccuuaauguauagggcuuucacgguuaauuuuagaaguucaaagugaca

SEQ ID NO: 593046 - RNA, 64 nt, Homo Sapiens
gaaaucuuuccauauuguacugaaauaaagaccacacgguuaaauguaucuguaacacuggcac

SEQ ID NO: 593047 - RNA, 64 nt, Homo Sapiens
aggggugaguggccguggcugugggcagcauccacacgguuagccgugcaugcacuuuguggcc

SEQ ID NO: 593048 - RNA, 64 nt, Homo Sapiens
ccccccugggggggcugccuaauugcagugauuccacgguuaggcaagucgggaucucagagga

SEQ ID NO: 593049 - RNA, 64 nt, Homo Sapiens
uaagcauaaucugaaaacaugaaaaauuucuaaccacgguuauuggggcaggaaagcaugcauu

SEQ ID NO: 593050 - RNA, 64 nt, Homo Sapiens
gggaccagacgugaugcuggaaggugggcgucgucacgguuaaagagaaaugggcucgucccga

SEQ ID NO: 593051 - RNA, 64 nt, Homo Sapiens
uugcaaagccuuacucuaaagaucauagcuaccucacgguuacaccacaucuggaaauaaggau

SEQ ID NO: 593052 - RNA, 64 nt, Homo Sapiens
ggggagagcacgggguagccgggucauggggcaacacgguuagcugaucucaucaguucugagc

SEQ ID NO: 593053 - RNA, 64 nt, Homo Sapiens
uuacaacccaaacagcaaaaugguuacuuguauucacgguuaaugucuguggagaggauuuucu

SEQ ID NO: 593054 - RNA, 64 nt, Homo Sapiens
aggcauagcccugauccuucuggaaggcauagaacacgguuacagcugguucuguagaaagagg

SEQ ID NO: 593055 - RNA, 64 nt, Homo Sapiens
uuugccaggauuuuguugugcugagauugccaaucacgguuaaacacaaaguguuuuuauagaa

SEQ ID NO: 593056 - RNA, 63 nt, Homo Sapiens
ucuuuuauaacuuuguuagguuuuugaagcugcaaacacuacaaugcuuugagggggucugug

SEQ ID NO: 593057 - RNA, 63 nt, Homo Sapiens
uuuucuuuagcuuacauuuuaaacauacacaauaaacacuaauccuccaaacuuucacuguuu

SEQ ID NO: 593058 - RNA, 63 nt, Homo Sapiens
cuauguuugugaaaaacauaucauguaauucaaaaacacuauugauauugaauaccagauacc

SEQ ID NO: 593059 - RNA, 63 nt, Homo Sapiens
ucaguguuaacaacaaucaugauaauuaaauuaaaacacuaguuuguucacuuguaggacugc

SEQ ID NO: 593060 - RNA, 63 nt, Homo Sapiens
gaauguugaauucucaugcuaaaacugaagaugaaacacuaaugcaagcaucaagugucaauc

SEQ ID NO: 593061 - RNA, 63 nt, Homo Sapiens
uuguagauuuacuguagguuaguggucaaauguaaacacuauaacuucuacauaacacaaacc

SEQ ID NO: 593062 - RNA, 63 nt, Homo Sapiens
gaguguguucaaagaucaacauauuuaacuuuuaaacacuaucucaaagccagcauaauuaac

SEQ ID NO: 593063 - RNA, 63 nt, Homo Sapiens
agguguucccuggaaaggucaagugagucugggaaacacuaugucuguacaccucuugaaggu

SEQ ID NO: 593064 - RNA, 63 nt, Homo Sapiens
auguaccauacaaaucccuugauguuaucaaucaaacacuaaaauuuuuuucuggaaacacua

SEQ ID NO: 593065 - RNA, 63 nt, Homo Sapiens
uguuaucaaucaaacacuaaaauuuuuuucuggaaacacuagaucuucauuaugaacaagaug

SEQ ID NO: 593066 - RNA, 63 nt, Homo Sapiens
uucauacccuacuuuuucugaaugccagaaggaaaacacuauuccuuaauguaauuuacuuau

SEQ ID NO: 593067 - RNA, 63 nt, Homo Sapiens
uucugucuguggauucuguaaaggugaaauacuaaacacuacuauauauauauauauauuuuu

SEQ ID NO: 593068 - RNA, 63 nt, Homo Sapiens
aaauaauuuuccacaguuccaaacgauaggcucaaacacuagagcugcuaguaaaaagaagac

SEQ ID NO: 593069 - RNA, 63 nt, Homo Sapiens
aauaaaagcagaauguauaucaucccaucugaaaaacacuaauuauugacaugugcaucugua

SEQ ID NO: 593070 - RNA, 63 nt, Homo Sapiens
ucuuucuaaaauggaacuuguuaaaaaguguucaaacacuaucccuaaugccugcggcagaau

SEQ ID NO: 593071 - RNA, 63 nt, Homo Sapiens
agaaauuauuuaaauuacuuuauaguaauuauuaaacacuaauuuuuguacugucauugaagg

SEQ ID NO: 593072 - RNA, 63 nt, Homo Sapiens
uuaaaugacaaguguuuaugaagaaacuauaucaaacacuaugcaaaaguauuugcaguacaa

SEQ ID NO: 593073 - RNA, 63 nt, Homo Sapiens
ugcuuuugaauuuuuuucacagauaaacaagauaaacacuagguacacacacguauuuccuug

SEQ ID NO: 593074 - RNA, 63 nt, Homo Sapiens
guauacugcaacacaaaagauuuccaauuuugcaaacacuacaaccuuauuuugauuaaaucu

SEQ ID NO: 593075 - RNA, 63 nt, Homo Sapiens
uguuucuuuuuuaaaacaucacugucaggguauaaacacuauucuuauuuuucuuggacccaa

SEQ ID NO: 593076 - RNA, 63 nt, Homo Sapiens
auuacuaaaucuacaacagcucaaaucacagagaaacacuaaagacagaaggagauggaauga

SEQ ID NO: 593077 - RNA, 63 nt, Homo Sapiens
accaacaagaggauuuuuuagaaugcaugcccaaaacacuacuuuuugcuuuuaugcuuuaaa

SEQ ID NO: 593078 - RNA, 63 nt, Homo Sapiens
aaaaaaacaguuuauauuuuuacugcucguuauaaacacuacugaaauauuuagcuucaggaa

SEQ ID NO: 593079 - RNA, 63 nt, Homo Sapiens
uauuguuaauuguauucacccuaauaaucuaugaaacacuaggucuuacuucuucuaucuaac

SEQ ID NO: 593080 - RNA, 63 nt, Homo Sapiens
uuucccaauguuuugucauggcuauuucuacucaaacacuaaucccccauucucuaaucacca

SEQ ID NO: 593081 - RNA, 63 nt, Homo Sapiens
aaaaacuuguuuaaauuguaacaaauuguguacaaacacuaaaaauugaauauugaaaaauug

SEQ ID NO: 593082 - RNA, 63 nt, Homo Sapiens
auuuuuuguaccaaaaauacuaaccauugacaaaaacacuauuauuuacagcaaaauauugaa

SEQ ID NO: 593083 - RNA, 63 nt, Homo Sapiens
agaauacauuuuaccagcaaaccuaaggaugacaaacacuauccacaucugaaaacuaccaca

SEQ ID NO: 593084 - RNA, 63 nt, Homo Sapiens
gcuucuuaguucaaaaagaauucugaguuuuucaaacacuagucuagagguggacauugucag

SEQ ID NO: 593085 - RNA, 63 nt, Homo Sapiens
cuuggaccuuggucaguugugcuauucauuauuaaacacuaaaacuuuggcgguucuugcaua

SEQ ID NO: 593086 - RNA, 63 nt, Homo Sapiens
aucaacgacuuguaguagacucaaguuuuuaaaaaacacuauuuuacuuaaacuguuucuuau

SEQ ID NO: 593087 - RNA, 63 nt, Homo Sapiens
augaauuuaauguauaaaauagcauuuaaaugcaaacacuacccuuuuaauuuuauauaugac

SEQ ID NO: 593088 - RNA, 63 nt, Homo Sapiens
caaaaugggaauuaggcuuagcauuuccaaacaaaacacuaaguugaagaaucauuguuagaa

SEQ ID NO: 593089 - RNA, 63 nt, Homo Sapiens
cuggaaagauguuuucaaggaauuugaaccauaaaacacuaucugaugcacagaacaccucua

SEQ ID NO: 593090 - RNA, 63 nt, Homo Sapiens
uuuauucauccauccauucaacaaguauuugcuaaacacuaacuuaagcuaaugcuaggguag

SEQ ID NO: 593091 - RNA, 63 nt, Homo Sapiens
uuucaguaacugaauuugugcacaaaacauucuaaacacuagugaagccuguuucguugaacu

SEQ ID NO: 593092 - RNA, 63 nt, Homo Sapiens
uauuuaugguuuuuuuuuuuuuuucauuuccagaaacacuauuuaaacacaaaaauaaauuuu

SEQ ID NO: 593093 - RNA, 63 nt, Homo Sapiens
cccaggauugaaaaagcaaaacaccaguucagaaaacacuagaguugaucuuuagccugucuc

SEQ ID NO: 593094 - RNA, 64 nt, Homo Sapiens
uuccauggacacaugacauugagacccucaaccagcccaacaucaagcuguauccucuaaccac

SEQ ID NO: 593095 - RNA, 64 nt, Homo Sapiens
ggagauuucuauaguuauugcacaacagaauucugcccaacacauuuuuaaugggccaccuccc

SEQ ID NO: 593096 - RNA, 64 nt, Homo Sapiens
uugcacuucggcuggcuguggauagcuuucaagggcccaacacuggcggcgguggcacugaaga

SEQ ID NO: 593097 - RNA, 51 nt, Homo Sapiens
aucacggcacucugggacagugcccaacagcugaucaccaucuacuccuaa

SEQ ID NO: 593098 - RNA, 64 nt, Homo Sapiens
gaaauucucauuuuggucgacuccaacccuaauggcccaacaggauaggggaggguuaauaaga

SEQ ID NO: 593099 - RNA, 64 nt, Homo Sapiens
cucuguugccaguuaaagguagcaucucaugauggcccaacaauuguucauagagcuagaaagu

SEQ ID NO: 593100 - RNA, 64 nt, Homo Sapiens
ccugaucucucagccccaaacacccacccaauuggcccaacacugucugccccucgggguguca

SEQ ID NO: 593101 - RNA, 64 nt, Homo Sapiens
uaguggagcugggggcucucagugguuaaacaaugcccaacaaccaaccagcuggcccuugguc

SEQ ID NO: 593102 - RNA, 64 nt, Homo Sapiens
agcuuccucuuucucccuuggccugccccucucagcccaacaucugugagaccuacccuguaac

SEQ ID NO: 593103 - RNA, 64 nt, Homo Sapiens
cccaagggggcaggagacggccaggcuccucggagcccaacagugaagaccuccgaccccagcg

SEQ ID NO: 593104 - RNA, 64 nt, Homo Sapiens; identical to SEQ ID NO: 578935

SEQ ID NO: 593105 - RNA, 64 nt, Homo Sapiens; identical to SEQ ID NO: 578936

SEQ ID NO: 593106 - RNA, 64 nt, Homo Sapiens; identical to SEQ ID NO: 578937

SEQ ID NO: 593107 - RNA, 64 nt, Homo Sapiens; identical to SEQ ID NO: 578938

SEQ ID NO: 593108 - RNA, 64 nt, Homo Sapiens; identical to SEQ ID NO: 578939

SEQ ID NO: 593109 - RNA, 64 nt, Homo Sapiens; identical to SEQ ID NO: 578940

SEQ ID NO: 593110 - RNA, 64 nt, Homo Sapiens; identical to SEQ ID NO: 578941

SEQ ID NO: 593111 - RNA, 64 nt, Homo Sapiens; identical to SEQ ID NO: 578942

SEQ ID NO: 593112 - RNA, 64 nt, Homo Sapiens; identical to SEQ ID NO: 70765

SEQ ID NO: 593113 - RNA, 64 nt, Homo Sapiens; identical to SEQ ID NO: 70766

SEQ ID NO: 593114 - RNA, 64 nt, Homo Sapiens; identical to SEQ ID NO: 70767

SEQ ID NO: 593115 - RNA, 64 nt, Homo Sapiens; identical to SEQ ID NO: 70768

SEQ ID NO: 593116 - RNA, 64 nt, Homo Sapiens; identical to SEQ ID NO: 70769

SEQ ID NO: 593117 - RNA, 64 nt, Homo Sapiens; identical to SEQ ID NO: 70770

SEQ ID NO: 593118 - RNA, 64 nt, Homo Sapiens; identical to SEQ ID NO: 70771

SEQ ID NO: 593119 - RNA, 64 nt, Homo Sapiens; identical to SEQ ID NO: 70772

SEQ ID NO: 593120 - RNA, 64 nt, Homo Sapiens; identical to SEQ ID NO: 70773

SEQ ID NO: 593121 - RNA, 64 nt, Homo Sapiens; identical to SEQ ID NO: 70774

SEQ ID NO: 593122 - RNA, 64 nt, Homo Sapiens; identical to SEQ ID NO: 70775

SEQ ID NO: 593123 - RNA, 64 nt, Homo Sapiens; identical to SEQ ID NO: 70776

SEQ ID NO: 593124 - RNA, 64 nt, Homo Sapiens; identical to SEQ ID NO: 70777

SEQ ID NO: 593125 - RNA, 64 nt, Homo Sapiens; identical to SEQ ID NO: 70778

SEQ ID NO: 593126 - RNA, 64 nt, Homo Sapiens; identical to SEQ ID NO: 70779

SEQ ID NO: 593127 - RNA, 64 nt, Homo Sapiens; identical to SEQ ID NO: 70780

SEQ ID NO: 593128 - RNA, 64 nt, Homo Sapiens; identical to SEQ ID NO: 70781

SEQ ID NO: 593129 - RNA, 64 nt, Homo Sapiens; identical to SEQ ID NO: 70782

SEQ ID NO: 593130 - RNA, 64 nt, Homo Sapiens; identical to SEQ ID NO: 70783

SEQ ID NO: 593131 - RNA, 64 nt, Homo Sapiens; identical to SEQ ID NO: 70784

SEQ ID NO: 593132 - RNA, 64 nt, Homo Sapiens; identical to SEQ ID NO: 70785

SEQ ID NO: 593133 - RNA, 64 nt, Homo Sapiens; identical to SEQ ID NO: 70786

SEQ ID NO: 593134 - RNA, 64 nt, Homo Sapiens; identical to SEQ ID NO: 70787

SEQ ID NO: 593135 - RNA, 64 nt, Homo Sapiens; identical to SEQ ID NO: 70788

SEQ ID NO: 593136 - RNA, 64 nt, Homo Sapiens; identical to SEQ ID NO: 70789

SEQ ID NO: 593137 - RNA, 64 nt, Homo Sapiens; identical to SEQ ID NO: 70790

SEQ ID NO: 593138 - RNA, 64 nt, Homo Sapiens; identical to SEQ ID NO: 70791

SEQ ID NO: 593139 - RNA, 64 nt, Homo Sapiens; identical to SEQ ID NO: 70792

SEQ ID NO: 593140 - RNA, 64 nt, Homo Sapiens; identical to SEQ ID NO: 70793

SEQ ID NO: 593141 - RNA, 64 nt, Homo Sapiens; identical to SEQ ID NO: 70794

SEQ ID NO: 593142 - RNA, 64 nt, Homo Sapiens; identical to SEQ ID NO: 70795

SEQ ID NO: 593143 - RNA, 64 nt, Homo Sapiens; identical to SEQ ID NO: 70796

SEQ ID NO: 593144 - RNA, 64 nt, Homo Sapiens; identical to SEQ ID NO: 70797

SEQ ID NO: 593145 - RNA, 64 nt, Homo Sapiens; identical to SEQ ID NO: 70798

SEQ ID NO: 593146 - RNA, 64 nt, Homo Sapiens; identical to SEQ ID NO: 70799

SEQ ID NO: 593147 - RNA, 64 nt, Homo Sapiens; identical to SEQ ID NO: 70800

SEQ ID NO: 593148 - RNA, 64 nt, Homo Sapiens; identical to SEQ ID NO: 70801

SEQ ID NO: 593149 - RNA, 64 nt, Homo Sapiens; identical to SEQ ID NO: 70802

SEQ ID NO: 593150 - RNA, 64 nt, Homo Sapiens; identical to SEQ ID NO: 70803

SEQ ID NO: 593151 - RNA, 64 nt, Homo Sapiens; identical to SEQ ID NO: 70804

SEQ ID NO: 593152 - RNA, 64 nt, Homo Sapiens; identical to SEQ ID NO: 70805

SEQ ID NO: 593153 - RNA, 64 nt, Homo Sapiens; identical to SEQ ID NO: 70806

SEQ ID NO: 593154 - RNA, 64 nt, Homo Sapiens; identical to SEQ ID NO: 70807

SEQ ID NO: 593155 - RNA, 64 nt, Homo Sapiens; identical to SEQ ID NO: 70808

SEQ ID NO: 593156 - RNA, 64 nt, Homo Sapiens; identical to SEQ ID NO: 70809

SEQ ID NO: 593157 - RNA, 64 nt, Homo Sapiens; identical to SEQ ID NO: 70810

SEQ ID NO: 593158 - RNA, 64 nt, Homo Sapiens; identical to SEQ ID NO: 70811

SEQ ID NO: 593159 - RNA, 64 nt, Homo Sapiens; identical to SEQ ID NO: 70812

SEQ ID NO: 593160 - RNA, 64 nt, Homo Sapiens; identical to SEQ ID NO: 70813

SEQ ID NO: 593161 - RNA, 64 nt, Homo Sapiens; identical to SEQ ID NO: 70814

SEQ ID NO: 593162 - RNA, 64 nt, Homo Sapiens; identical to SEQ ID NO: 70814

SEQ ID NO: 593163 - RNA, 64 nt, Homo Sapiens; identical to SEQ ID NO: 70816

SEQ ID NO: 593164 - RNA, 64 nt, Homo Sapiens; identical to SEQ ID NO: 70817

SEQ ID NO: 593165 - RNA, 64 nt, Homo Sapiens; identical to SEQ ID NO: 70818

SEQ ID NO: 593166 - RNA, 64 nt, Homo Sapiens; identical to SEQ ID NO: 70819

SEQ ID NO: 593167 - RNA, 64 nt, Homo Sapiens; identical to SEQ ID NO: 70820

SEQ ID NO: 593168 - RNA, 64 nt, Homo Sapiens; identical to SEQ ID NO: 70821

SEQ ID NO: 593169 - RNA, 64 nt, Homo Sapiens; identical to SEQ ID NO: 70822

SEQ ID NO: 593170 - RNA, 64 nt, Homo Sapiens; identical to SEQ ID NO: 70823

SEQ ID NO: 593171 - RNA, 64 nt, Homo Sapiens; identical to SEQ ID NO: 70824

SEQ ID NO: 593172 - RNA, 64 nt, Homo Sapiens; identical to SEQ ID NO: 70825
